United States Patent 8,084,598 (BIOIONFORMALITY DETECTABLE GROUP OF NOVEL REGULATORY OLIGONUCLEOTIDES AND USES THEREOF) - sequence listing, part 3

SEQ ID NO: 86254 - RNA, 21 nt, Human
agcuguguugcugggccuggu

SEQ ID NO: 86255 - RNA, 21 nt, Human
cugagguuuagcugggugggg

SEQ ID NO: 86256 - RNA, 23 nt, Human
agggccgcugcucccucaguugc

SEQ ID NO: 86257 - RNA, 21 nt, Human
uggaagagaccagcaugucuu

SEQ ID NO: 86258 - RNA, 21 nt, Human
ugaauggcuuggagugcacug

SEQ ID NO: 86259 - RNA, 19 nt, Human
ccuguuccccucugcuacu

SEQ ID NO: 86260 - RNA, 22 nt, Human
ugccuaaaucacuuuucucgca

SEQ ID NO: 86261 - RNA, 20 nt, Human
ggguaauuuccuuugcuuca

SEQ ID NO: 86262 - RNA, 20 nt, Human
aggccugaggaguggcagga

SEQ ID NO: 86263 - RNA, 21 nt, Human
agcuagccaggcaaagggggc

SEQ ID NO: 86264 - RNA, 25 nt, Human
gagacuccuccagccuccucccuau

SEQ ID NO: 86265 - RNA, 26 nt, Human
uauuaugguuauguacauuguuaaca

SEQ ID NO: 86266 - RNA, 27 nt, Human
cuaacuugcccauauucuaaaucaucu

SEQ ID NO: 86267 - RNA, 20 nt, Human
accucaaggcacugaagcug

SEQ ID NO: 86268 - RNA, 17 nt, Human
gggagcacuguucacau

SEQ ID NO: 86269 - RNA, 22 nt, Human
cugucucucuggcuccugaccu

SEQ ID NO: 86270 - RNA, 26 nt, Human
uaugcuguuuuugaggugucaaauac

SEQ ID NO: 86271 - RNA, 21 nt, Human
gcagguuggccagucuguacc

SEQ ID NO: 86272 - RNA, 27 nt, Human
ccuuugucucaccucauagcuaauuuu

SEQ ID NO: 86273 - RNA, 23 nt, Human
uuugagacuuagcugugauacug

SEQ ID NO: 86274 - RNA, 22 nt, Human
accugaucacccucccuccucc

SEQ ID NO: 86275 - RNA, 24 nt, Human
uucaccuccuuggcgcugccaccu

SEQ ID NO: 86276 - RNA, 24 nt, Human
auggacucagagaaaagagauuga

SEQ ID NO: 86277 - RNA, 22 nt, Human
caauguggcgaaacuccaucuc

SEQ ID NO: 86278 - RNA, 23 nt, Human
uggccuagccugggcaucacugu

SEQ ID NO: 86279 - RNA, 22 nt, Human
ccccugguuccccaaggcagag

SEQ ID NO: 86280 - RNA, 21 nt, Human
ccuguucuccagccuaggugg

SEQ ID NO: 86281 - RNA, 23 nt, Human
auugcccaggcuggagugcaaug

SEQ ID NO: 86282 - RNA, 23 nt, Human
guugcccaagcuggagugcaaug

SEQ ID NO: 86283 - RNA, 22 nt, Human
gaaacaguggcuuauuucuuca

SEQ ID NO: 86284 - RNA, 20 nt, Human
uuccuuuaagauuugcaguu

SEQ ID NO: 86285 - RNA, 18 nt, Human
ccucucuuggagcauuuu

SEQ ID NO: 86286 - RNA, 21 nt, Human
gcuagaggagcuucuuuucag

SEQ ID NO: 86287 - RNA, 22 nt, Human
cuuaaggucaggaguuugagac

SEQ ID NO: 86288 - RNA, 25 nt, Human
ucucauuccaccucuucucagagca

SEQ ID NO: 86289 - RNA, 25 nt, Human
gcugcuuuguuguucugccuguccu

SEQ ID NO: 86290 - RNA, 20 nt, Human
ugaggaaagcaguugaaaug

SEQ ID NO: 86291 - RNA, 32 nt, Human
gcacacgaugcucugggacauaacuggugccu

SEQ ID NO: 86292 - RNA, 20 nt, Human
gacagagcuagacuguaaag

SEQ ID NO: 86293 - RNA, 20 nt, Human
caucuucccucaguucccau

SEQ ID NO: 86294 - RNA, 20 nt, Human
uuguaaucaagaaaagugau

SEQ ID NO: 86295 - RNA, 21 nt, Human
gguaugcucuggcaucccauu

SEQ ID NO: 86296 - RNA, 20 nt, Human
gcagaaaucuggauaugaga

SEQ ID NO: 86297 - RNA, 21 nt, Human
gcuagugauagagguggggcc

SEQ ID NO: 86298 - RNA, 24 nt, Human
augccguauauguaguagcacuuu

SEQ ID NO: 86299 - RNA, 26 nt, Human
cauggacugaaggcgcccucgcccca

SEQ ID NO: 86300 - RNA, 27 nt, Human
acuaggccuggccuccucuacacaucc

SEQ ID NO: 86301 - RNA, 20 nt, Human
uuuucuuaguagugcagacc

SEQ ID NO: 86302 - RNA, 22 nt, Human
ccagaagccagagggccaggga

SEQ ID NO: 86303 - RNA, 27 nt, Human
ugaccgacauggagaaaccucgucucu

SEQ ID NO: 86304 - RNA, 32 nt, Human
auauggggacaaugaagacaagcacacaggag

SEQ ID NO: 86305 - RNA, 21 nt, Human
uuuucccgucauucucucugc

SEQ ID NO: 86306 - RNA, 27 nt, Human
ccagcauggugaggacaccuucaaccg

SEQ ID NO: 86307 - RNA, 22 nt, Human
uuguucaaagauccagugcagu

SEQ ID NO: 86308 - RNA, 27 nt, Human
ccuguuucccgcagaguucccugcagc

SEQ ID NO: 86309 - RNA, 21 nt, Human
ugcucugucucccaggcugga

SEQ ID NO: 86310 - RNA, 22 nt, Human
cuuucuucccagcccuggagcc

SEQ ID NO: 86311 - RNA, 27 nt, Human
cccuccaggcugacuuggggacagugg

SEQ ID NO: 86312 - RNA, 25 nt, Human
ucauugagccugaaggcuucaagcc

SEQ ID NO: 86313 - RNA, 21 nt, Human
agggagacugcuuuccagaca

SEQ ID NO: 86314 - RNA, 20 nt, Human
uggcacuuccccuccuggcu

SEQ ID NO: 86315 - RNA, 26 nt, Human
gacucagagauggauuuugacucugg

SEQ ID NO: 86316 - RNA, 17 nt, Human
uuccuccuaccaccuca

SEQ ID NO: 86317 - RNA, 22 nt, Human
cucagccgccucagucgccuca

SEQ ID NO: 86318 - RNA, 21 nt, Human
ggaggcggagguggggguggg

SEQ ID NO: 86319 - RNA, 22 nt, Human
gaacccaggaggaagagguugc

SEQ ID NO: 86320 - RNA, 22 nt, Human
gaacacaggaggcagagguugc

SEQ ID NO: 86321 - RNA, 27 nt, Human
gggggagaucugacagcccagaccuuu

SEQ ID NO: 86322 - RNA, 21 nt, Human
cagugugaggacucacccugg

SEQ ID NO: 86323 - RNA, 21 nt, Human
ugucgccaggcuggagugcag

SEQ ID NO: 86324 - RNA, 24 nt, Human
cacagccucagcauuucuuggagc

SEQ ID NO: 86325 - RNA, 24 nt, Human
gugcauggugcuuuuuaacuuuca

SEQ ID NO: 86326 - RNA, 21 nt, Human
gagccgcacaacauacaauua

SEQ ID NO: 86327 - RNA, 24 nt, Human
uuuauuuuguggcauuuccaugcc

SEQ ID NO: 86328 - RNA, 28 nt, Human
ccggcgugcaccaccaugccaggcuaau

SEQ ID NO: 86329 - RNA, 22 nt, Human
gagccagccuggccaacauggu

SEQ ID NO: 86330 - RNA, 26 nt, Human
cgucuauaggagugggaccccucccu

SEQ ID NO: 86331 - RNA, 15 nt, Human
gagcuuauuacuugu

SEQ ID NO: 86332 - RNA, 22 nt, Human
gggguccacuggcggguaaagg

SEQ ID NO: 86333 - RNA, 24 nt, Human
cuuuguuuucaguuccauguaaca

SEQ ID NO: 86334 - RNA, 21 nt, Human
ggcuacuucccuuccucccgg

SEQ ID NO: 86335 - RNA, 18 nt, Human
uaaguugcuaucagcuga

SEQ ID NO: 86336 - RNA, 22 nt, Human
cugagaccuccacccacugugg

SEQ ID NO: 86337 - RNA, 23 nt, Human
uaccagccacagccagcagauag

SEQ ID NO: 86338 - RNA, 22 nt, Human
gggaauccugcuccuccucagg

SEQ ID NO: 86339 - RNA, 19 nt, Human
agugggcuuugcuauucac

SEQ ID NO: 86340 - RNA, 26 nt, Human
uuagaauguugaggcaguuucccaga

SEQ ID NO: 86341 - RNA, 27 nt, Human
uguaauaacuaccuuauggggucauuc

SEQ ID NO: 86342 - RNA, 27 nt, Human
cuuccaaccuccuuccccaccuccuuc

SEQ ID NO: 86343 - RNA, 21 nt, Human
cagaaaugaucuaaacacgag

SEQ ID NO: 86344 - RNA, 23 nt, Human
ucauucuuucugagaaggcccca

SEQ ID NO: 86345 - RNA, 28 nt, Human
gcacacacguacacacccacacacaucu

SEQ ID NO: 86346 - RNA, 19 nt, Human
uuccagucuccaccaggaa

SEQ ID NO: 86347 - RNA, 22 nt, Human
cacuucgcuucagccuccggac

SEQ ID NO: 86348 - RNA, 27 nt, Human
ugcucugucaccaggcuggagugcagu

SEQ ID NO: 86349 - RNA, 27 nt, Human
caggcagcgguccuagccaguuccuug

SEQ ID NO: 86350 - RNA, 26 nt, Human
aaaugagaguauugguucuaagauuu

SEQ ID NO: 86351 - RNA, 23 nt, Human
ugcucuggggcuggaggcuagua

SEQ ID NO: 86352 - RNA, 22 nt, Human
cccagccucuuguucuuagggc

SEQ ID NO: 86353 - RNA, 22 nt, Human
cagaagaucccagaaaaguucu

SEQ ID NO: 86354 - RNA, 25 nt, Human
gacuguacuguacaccuucuugcac

SEQ ID NO: 86355 - RNA, 25 nt, Human
cgauauucuuugcuccuugccauag

SEQ ID NO: 86356 - RNA, 19 nt, Human
cccaacaagcgcuagccug

SEQ ID NO: 86357 - RNA, 22 nt, Human
ucagaguacaagcucucaucau

SEQ ID NO: 86358 - RNA, 22 nt, Human
cucagagagaucaggccaguuu

SEQ ID NO: 86359 - RNA, 20 nt, Human
cagcccugaguuccuagcca

SEQ ID NO: 86360 - RNA, 20 nt, Human
uguacaccuacaccauuauc

SEQ ID NO: 86361 - RNA, 24 nt, Human
ucuaguacuuauuacaugcugcua

SEQ ID NO: 86362 - RNA, 25 nt, Human
gcauccgugaggcuggacagcgaua

SEQ ID NO: 86363 - RNA, 21 nt, Human
agcauguugucuucuuuggga

SEQ ID NO: 86364 - RNA, 21 nt, Human
agccucccaguagcuaggacu

SEQ ID NO: 86365 - RNA, 22 nt, Human
gggcagggaagagagcgcccgg

SEQ ID NO: 86366 - RNA, 19 nt, Human
uacguauauagauagugau

SEQ ID NO: 86367 - RNA, 20 nt, Human
uuugcagugagcagugcagu

SEQ ID NO: 86368 - RNA, 27 nt, Human
agcuagcagccgccuacuuggugcuaa

SEQ ID NO: 86369 - RNA, 21 nt, Human
acucucaccaagucaccagag

SEQ ID NO: 86370 - RNA, 24 nt, Human
aagggagugccagggaagguuuga

SEQ ID NO: 86371 - RNA, 20 nt, Human
uuaguucauagucaaaguca

SEQ ID NO: 86372 - RNA, 25 nt, Human
ggaaauuugcagcuuccaaugccuc

SEQ ID NO: 86373 - RNA, 20 nt, Human
agccucccgaguaguggauc

SEQ ID NO: 86374 - RNA, 21 nt, Human
aaacccagcggcggcgaagcg

SEQ ID NO: 86375 - RNA, 27 nt, Human
uguggugcaguaagccaagaucacgcc

SEQ ID NO: 86376 - RNA, 20 nt, Human
agccucuucagggugaguga

SEQ ID NO: 86377 - RNA, 18 nt, Human
agcuguaucacugccuuc

SEQ ID NO: 86378 - RNA, 24 nt, Human
ucugaacucccgccacauuuuagc

SEQ ID NO: 86379 - RNA, 23 nt, Human
agccccacucucucacaccaugu

SEQ ID NO: 86380 - RNA, 25 nt, Human
cagugucuuuucagcacuuugagca

SEQ ID NO: 86381 - RNA, 26 nt, Human
cuccaaauucacuucugccuuccuca

SEQ ID NO: 86382 - RNA, 21 nt, Human
ugaugcuucauucauguacua

SEQ ID NO: 86383 - RNA, 20 nt, Human
gcugccucuuacgguuuggu

SEQ ID NO: 86384 - RNA, 22 nt, Human
uggguuaggccuugccuaggca

SEQ ID NO: 86385 - RNA, 27 nt, Human
ucagaagcagguuucaguugcagaguu

SEQ ID NO: 86386 - RNA, 23 nt, Human
agccucuccccugccugcccugg

SEQ ID NO: 86387 - RNA, 21 nt, Human
gggugguuccaauugguggag

SEQ ID NO: 86388 - RNA, 20 nt, Human
ugccuuguaaucuaacuuug

SEQ ID NO: 86389 - RNA, 22 nt, Human
cuuccucucugcaccuccuggc

SEQ ID NO: 86390 - RNA, 21 nt, Human
cucucaguuucauauugccca

SEQ ID NO: 86391 - RNA, 27 nt, Human
uuagcuguuaaugcucugugaguuuag

SEQ ID NO: 86392 - RNA, 19 nt, Human
gccagccacacuugaaccu

SEQ ID NO: 86393 - RNA, 21 nt, Human
uuagugggcaugggauuuguu

SEQ ID NO: 86394 - RNA, 23 nt, Human
auuguuucuggaauugugcuuau

SEQ ID NO: 86395 - RNA, 21 nt, Human
ugcacaagguggaguguacug

SEQ ID NO: 86396 - RNA, 27 nt, Human
ggacuccggcauaagccacuuccccac

SEQ ID NO: 86397 - RNA, 22 nt, Human
augucuuguuccugugcauugg

SEQ ID NO: 86398 - RNA, 21 nt, Human
aagcgcugagauuacaggugu

SEQ ID NO: 86399 - RNA, 21 nt, Human
gggacuagcaggaagcggcac

SEQ ID NO: 86400 - RNA, 26 nt, Human
ggaggugaugguggaugacaggcuag

SEQ ID NO: 86401 - RNA, 24 nt, Human
agaaggaaaggagaauguuuugug

SEQ ID NO: 86402 - RNA, 24 nt, Human
agccuuggcaagaaaacuugcugc

SEQ ID NO: 86403 - RNA, 26 nt, Human
ugcucagaaaaaugagggagagagaa

SEQ ID NO: 86404 - RNA, 24 nt, Human
gaggaggaagggagcaccagugaa

SEQ ID NO: 86405 - RNA, 24 nt, Human
gggaagagauuagcaugaaaggua

SEQ ID NO: 86406 - RNA, 20 nt, Human
cccuauccuccccuuuuacc

SEQ ID NO: 86407 - RNA, 20 nt, Human
cucccuucccucucucccau

SEQ ID NO: 86408 - RNA, 22 nt, Human
gcaugcgccaccaugcccugcu

SEQ ID NO: 86409 - RNA, 27 nt, Human
cucccagauccuuguguccacuugcag

SEQ ID NO: 86410 - RNA, 20 nt, Human
uggggaggggauggagaaac

SEQ ID NO: 86411 - RNA, 28 nt, Human
ucuuuuucucccucuuucauaacuggau

SEQ ID NO: 86412 - RNA, 27 nt, Human
acugaacagcuuuuauguacagcucug

SEQ ID NO: 86413 - RNA, 25 nt, Human
ggggggcccucuaggugcugaaucu

SEQ ID NO: 86414 - RNA, 18 nt, Human
uaaaccaaugccuauaaa

SEQ ID NO: 86415 - RNA, 27 nt, Human
uucuccucuucucuucuugggacagga

SEQ ID NO: 86416 - RNA, 22 nt, Human
gaccucccaggcucaagcuguc

SEQ ID NO: 86417 - RNA, 22 nt, Human
ucuccaucucgcuugcugccca

SEQ ID NO: 86418 - RNA, 19 nt, Human
ccagccugggugacaguga

SEQ ID NO: 86419 - RNA, 21 nt, Human
cuacaaguaguucuuucucua

SEQ ID NO: 86420 - RNA, 27 nt, Human
agggggugacguggcagugacaggcgc

SEQ ID NO: 86421 - RNA, 27 nt, Human
gcucagggaaggccucuucaugggcau

SEQ ID NO: 86422 - RNA, 28 nt, Human
gccagcccuagccaacaugguguaaaca

SEQ ID NO: 86423 - RNA, 22 nt, Human
aauagcaaucccuuuuauuuca

SEQ ID NO: 86424 - RNA, 23 nt, Human
ugccuguaaucccagcuacucag

SEQ ID NO: 86425 - RNA, 23 nt, Human
aucuauccuuauauuuuucuccc

SEQ ID NO: 86426 - RNA, 26 nt, Human
gcaacugccuggauguauuugauuuu

SEQ ID NO: 86427 - RNA, 24 nt, Human
aacaaaccauugcuuaugcuguua

SEQ ID NO: 86428 - RNA, 27 nt, Human
acuugcucuucugugauuauugucaug

SEQ ID NO: 86429 - RNA, 20 nt, Human
uugggaggcagaggcaggug

SEQ ID NO: 86430 - RNA, 24 nt, Human
acucccgccugggcgacuccaucu

SEQ ID NO: 86431 - RNA, 27 nt, Human
ucugccuggcguuucacuugugucugc

SEQ ID NO: 86432 - RNA, 21 nt, Human
aguacuaugaaugaauuuggu

SEQ ID NO: 86433 - RNA, 23 nt, Human
ucguucucucuuugcauggauuu

SEQ ID NO: 86434 - RNA, 22 nt, Human
aguguucuguggagaaacugca

SEQ ID NO: 86435 - RNA, 21 nt, Human
cagcccacguucucucugccu

SEQ ID NO: 86436 - RNA, 24 nt, Human
ugcuuuaagaaacuguuacagggc

SEQ ID NO: 86437 - RNA, 22 nt, Human
ucacccaggcugcagugccaug

SEQ ID NO: 86438 - RNA, 32 nt, Human
ggugcagaauggcugaccucagucuugcagau

SEQ ID NO: 86439 - RNA, 22 nt, Human
cugucucuuccucuggagacug

SEQ ID NO: 86440 - RNA, 26 nt, Human
auagccugcauuugcauguguguaca

SEQ ID NO: 86441 - RNA, 21 nt, Human
auaagaaaauugagguuugga

SEQ ID NO: 86442 - RNA, 21 nt, Human
agccagaggagggcagaggga

SEQ ID NO: 86443 - RNA, 20 nt, Human
ccuccucccaccugccacca

SEQ ID NO: 86444 - RNA, 21 nt, Human
cacuugaaccugggaggugga

SEQ ID NO: 86445 - RNA, 31 nt, Human
uuaaggcccagggacuuccuuaaaggaaagu

SEQ ID NO: 86446 - RNA, 22 nt, Human
ugagggccacgggucuguguuc

SEQ ID NO: 86447 - RNA, 24 nt, Human
uccaucaccuuccuccucugcucu

SEQ ID NO: 86448 - RNA, 20 nt, Human
cuguuaccuuucccugcuga

SEQ ID NO: 86449 - RNA, 20 nt, Human
cauccaagaacucaccaaga

SEQ ID NO: 86450 - RNA, 25 nt, Human
cagggaagguuguuaaacagcaccg

SEQ ID NO: 86451 - RNA, 20 nt, Human
gauacuuggguagcucaaca

SEQ ID NO: 86452 - RNA, 24 nt, Human
cuugggagcccuccuuugccugcu

SEQ ID NO: 86453 - RNA, 27 nt, Human
cgggggcaggccgggccugcugucacc

SEQ ID NO: 86454 - RNA, 15 nt, Human
agcccucccaccuca

SEQ ID NO: 86455 - RNA, 22 nt, Human
ucacccaggcuggaguggagug

SEQ ID NO: 86456 - RNA, 23 nt, Human
caugccuguaaucccagcuacac

SEQ ID NO: 86457 - RNA, 20 nt, Human
agagcaggaagcucugugau

SEQ ID NO: 86458 - RNA, 21 nt, Human
uggguucauuccaaauaguuu

SEQ ID NO: 86459 - RNA, 22 nt, Human
uacgggucuauuuuuaugucaa

SEQ ID NO: 86460 - RNA, 27 nt, Human
uuugccucaccuaauaggcugggagac

SEQ ID NO: 86461 - RNA, 25 nt, Human
gccucugccuccagcccggcagcuc

SEQ ID NO: 86462 - RNA, 26 nt, Human
aaauccaccucuuaacaucucuuuca

SEQ ID NO: 86463 - RNA, 19 nt, Human
cucugugagagcacugucc

SEQ ID NO: 86464 - RNA, 21 nt, Human
uuccugagaugauggaaaugu

SEQ ID NO: 86465 - RNA, 26 nt, Human
agaagcagagaaggcacuugcauccu

SEQ ID NO: 86466 - RNA, 27 nt, Human
uauauuccuuuaaguuuuccugguugc

SEQ ID NO: 86467 - RNA, 25 nt, Human
ucuggcuccccuccugggguuguaa

SEQ ID NO: 86468 - RNA, 22 nt, Human
uggcuccgucugccagggauga

SEQ ID NO: 86469 - RNA, 25 nt, Human
agaauucugguguuuacacaaccaa

SEQ ID NO: 86470 - RNA, 23 nt, Human
gggaagggaagggccaggccaga

SEQ ID NO: 86471 - RNA, 21 nt, Human
aucccugcuacugucccuucu

SEQ ID NO: 86472 - RNA, 23 nt, Human
aaacucaaucacauucaauucca

SEQ ID NO: 86473 - RNA, 32 nt, Human
gcaauccucccgcuucagccuccugaguagcu

SEQ ID NO: 86474 - RNA, 17 nt, Human
aucaggaucaugccuua

SEQ ID NO: 86475 - RNA, 18 nt, Human
ucacuguccagccuggag

SEQ ID NO: 86476 - RNA, 22 nt, Human
gcuuguaauccuagcacuuuuu

SEQ ID NO: 86477 - RNA, 20 nt, Human
gccugacagccaggacccca

SEQ ID NO: 86478 - RNA, 19 nt, Human
caucuuugaauauauuuca

SEQ ID NO: 86479 - RNA, 22 nt, Human
cccgaaucucagccaccguguc

SEQ ID NO: 86480 - RNA, 26 nt, Human
ggaauagaaaucauuguuauaaagac

SEQ ID NO: 86481 - RNA, 26 nt, Human
cauuguacuccagccugugugacaga

SEQ ID NO: 86482 - RNA, 24 nt, Human
uguggguggagaagggaggguggc

SEQ ID NO: 86483 - RNA, 22 nt, Human
ucagcacucuggacuccacgau

SEQ ID NO: 86484 - RNA, 23 nt, Human
cuggagcuagugucuccucucug

SEQ ID NO: 86485 - RNA, 22 nt, Human
ccuguguggcccuggacacagc

SEQ ID NO: 86486 - RNA, 27 nt, Human
gaagaaaaguauugcaccuuugaaaug

SEQ ID NO: 86487 - RNA, 21 nt, Human
auccgugggucaggaugcaau

SEQ ID NO: 86488 - RNA, 31 nt, Human
cugaccucgugauuugccugccugggccucc

SEQ ID NO: 86489 - RNA, 29 nt, Human
ccaccugucuuggcuuucucauccuuccc

SEQ ID NO: 86490 - RNA, 21 nt, Human
aggacuuccuacccagaggag

SEQ ID NO: 86491 - RNA, 22 nt, Human
gccuauaaucccagcauuuugg

SEQ ID NO: 86492 - RNA, 23 nt, Human
aucgucccacugcacuccagccu

SEQ ID NO: 86493 - RNA, 19 nt, Human
cuucugcccaugucuggga

SEQ ID NO: 86494 - RNA, 24 nt, Human
gcagggcccagagacacuguccuu

SEQ ID NO: 86495 - RNA, 21 nt, Human
gcagccucaaccuccugggcu

SEQ ID NO: 86496 - RNA, 20 nt, Human
caagcuucgguucucagccu

SEQ ID NO: 86497 - RNA, 20 nt, Human
gacuaaaaacuaacagaacu

SEQ ID NO: 86498 - RNA, 22 nt, Human
uuuguaaaaucagcucguuuua

SEQ ID NO: 86499 - RNA, 26 nt, Human
gcggccgccucaggaggaucccuuuu

SEQ ID NO: 86500 - RNA, 23 nt, Human
cucucuggagauuuaguucucuu

SEQ ID NO: 86501 - RNA, 24 nt, Human
ugcaugcugugaggaggcuacaaa

SEQ ID NO: 86502 - RNA, 20 nt, Human
cauguggaccugcagcuuug

SEQ ID NO: 86503 - RNA, 22 nt, Human
gugguaggaucaccugagguca

SEQ ID NO: 86504 - RNA, 20 nt, Human
caaacucagggguacaaaau

SEQ ID NO: 86505 - RNA, 20 nt, Human
cgcugaccucggccuaggag

SEQ ID NO: 86506 - RNA, 26 nt, Human
gucucgaacucgugaccgcaagcgau

SEQ ID NO: 86507 - RNA, 23 nt, Human
uucauugucuuagucaaagcagg

SEQ ID NO: 86508 - RNA, 21 nt, Human
uugucacucgaugucauucca

SEQ ID NO: 86509 - RNA, 26 nt, Human
ucuuucuaacuacaugcaucucucca

SEQ ID NO: 86510 - RNA, 21 nt, Human
gaggaccugccccuaccugcu

SEQ ID NO: 86511 - RNA, 26 nt, Human
ccuuccucucugugccgugcuugcuc

SEQ ID NO: 86512 - RNA, 21 nt, Human
cccagcacuuugggaagcuga

SEQ ID NO: 86513 - RNA, 21 nt, Human
ggcaugccuuggaauauugcc

SEQ ID NO: 86514 - RNA, 22 nt, Human
cugcuuccacguccuugcuuca

SEQ ID NO: 86515 - RNA, 21 nt, Human
gauuuugguuucuuccuuucc

SEQ ID NO: 86516 - RNA, 27 nt, Human
ccguguuccauauagaggaaccccaaa

SEQ ID NO: 86517 - RNA, 21 nt, Human
cgagucuccugcacugugucu

SEQ ID NO: 86518 - RNA, 24 nt, Human
uuaagccccaauagcuacaaggag

SEQ ID NO: 86519 - RNA, 23 nt, Human
acccccagccaaucaggacuuuc

SEQ ID NO: 86520 - RNA, 17 nt, Human
gccuauucaauagcuca

SEQ ID NO: 86521 - RNA, 21 nt, Human
ccuggccccuccucugacaca

SEQ ID NO: 86522 - RNA, 24 nt, Human
cuuguauuuugcacauuuuauaaa

SEQ ID NO: 86523 - RNA, 20 nt, Human
aauccaggcugguguucugu

SEQ ID NO: 86524 - RNA, 20 nt, Human
uauuuuacaagguaugaccu

SEQ ID NO: 86525 - RNA, 21 nt, Human
augggaaaagagucucuaccc

SEQ ID NO: 86526 - RNA, 19 nt, Human
uuugcccagaagaggcagu

SEQ ID NO: 86527 - RNA, 22 nt, Human
uggcuuugcccuggaauuugcc

SEQ ID NO: 86528 - RNA, 23 nt, Human
cugucucuaccagggaggugccu

SEQ ID NO: 86529 - RNA, 21 nt, Human
gacugaaugaaugaaugaaug

SEQ ID NO: 86530 - RNA, 27 nt, Human
uggcaugugugagcagaagggaggaug

SEQ ID NO: 86531 - RNA, 20 nt, Human
gcugggguguugcacuuugg

SEQ ID NO: 86532 - RNA, 26 nt, Human
gcaugguucauuaucaugccaauaaa

SEQ ID NO: 86533 - RNA, 20 nt, Human
acacacaagcccucugcauu

SEQ ID NO: 86534 - RNA, 22 nt, Human
cccuugccaacuuuuacccucc

SEQ ID NO: 86535 - RNA, 24 nt, Human
aauaaucaaaagcauaauguuuuc

SEQ ID NO: 86536 - RNA, 20 nt, Human
gggugaguaggcuucaauuc

SEQ ID NO: 86537 - RNA, 22 nt, Human
uggagugugacuggaaaaauac

SEQ ID NO: 86538 - RNA, 29 nt, Human
uccugggggaagaggagaugugaucaggc

SEQ ID NO: 86539 - RNA, 24 nt, Human
ucugaacuaaggcuuggccuuggg

SEQ ID NO: 86540 - RNA, 24 nt, Human
cgggauguaguugguguuggugca

SEQ ID NO: 86541 - RNA, 23 nt, Human
guguucuguccuuccucccaucg

SEQ ID NO: 86542 - RNA, 18 nt, Human
ccacuccucaaugcucaa

SEQ ID NO: 86543 - RNA, 22 nt, Human
ccaugauguacuuuuucauaca

SEQ ID NO: 86544 - RNA, 22 nt, Human
ugggcuucaucaacuccuucug

SEQ ID NO: 86545 - RNA, 24 nt, Human
uuucuacagauauuaauguuaaca

SEQ ID NO: 86546 - RNA, 26 nt, Human
gaaauuccuuguuaagacacaaggaa

SEQ ID NO: 86547 - RNA, 24 nt, Human
cugagauacauucuuccaaucugu

SEQ ID NO: 86548 - RNA, 24 nt, Human
gggccucuaaggggaguguggggu

SEQ ID NO: 86549 - RNA, 21 nt, Human
gaugaauggcguccguggguu

SEQ ID NO: 86550 - RNA, 22 nt, Human
gccuggacgggaucugaugcac

SEQ ID NO: 86551 - RNA, 28 nt, Human
ccccuccccucccuggggcagcagccac

SEQ ID NO: 86552 - RNA, 22 nt, Human
cugcaaccuccaccucccuggu

SEQ ID NO: 86553 - RNA, 22 nt, Human
ggaggcugagguaggagaauca

SEQ ID NO: 86554 - RNA, 22 nt, Human
ggaggcugaaguaggaggauca

SEQ ID NO: 86555 - RNA, 20 nt, Human
gcuuccagccacagguucuc

SEQ ID NO: 86556 - RNA, 20 nt, Human
uucauacagcauuacaaauu

SEQ ID NO: 86557 - RNA, 21 nt, Human
ccucaaccccugucagugucc

SEQ ID NO: 86558 - RNA, 27 nt, Human
ugcagugagccgagcuugcacuacugc

SEQ ID NO: 86559 - RNA, 24 nt, Human
ccugccuuuuuagaagcagccuca

SEQ ID NO: 86560 - RNA, 23 nt, Human
aaggcauucauccguccaucauu

SEQ ID NO: 86561 - RNA, 21 nt, Human
cccagcuacucccuccagagg

SEQ ID NO: 86562 - RNA, 25 nt, Human
ccagcagaggaaacuuauaaccucg

SEQ ID NO: 86563 - RNA, 27 nt, Human
ccguucccgguccuuucucccgggccg

SEQ ID NO: 86564 - RNA, 26 nt, Human
acucacugcaaaaucaccacgacucu

SEQ ID NO: 86565 - RNA, 21 nt, Human
agcaaagagaaaaagcacagg

SEQ ID NO: 86566 - RNA, 22 nt, Human
cuucuuguaaauaccugccucc

SEQ ID NO: 86567 - RNA, 21 nt, Human
cuguugcccaggcuggagugc

SEQ ID NO: 86568 - RNA, 21 nt, Human
acccaggccgggaccuggggg

SEQ ID NO: 86569 - RNA, 22 nt, Human
ucacugcagccuccacuuccug

SEQ ID NO: 86570 - RNA, 22 nt, Human
cagguucacaguuaagaaggaa

SEQ ID NO: 86571 - RNA, 29 nt, Human
ggcugcaggacugggcacagcaugagauc

SEQ ID NO: 86572 - RNA, 27 nt, Human
ccaugugguucuucaaauuuugaugcc

SEQ ID NO: 86573 - RNA, 20 nt, Human
agggaauuggcccugggaga

SEQ ID NO: 86574 - RNA, 24 nt, Human
ggccucgggcgggccuggcgcuca

SEQ ID NO: 86575 - RNA, 23 nt, Human
ggcaaguuguuuaaaaaaugucu

SEQ ID NO: 86576 - RNA, 22 nt, Human
ccaacaggaagguuauucuucc

SEQ ID NO: 86577 - RNA, 22 nt, Human
cacuugaaccugggaggcagag

SEQ ID NO: 86578 - RNA, 22 nt, Human
gaugggguuucaccauguuguc

SEQ ID NO: 86579 - RNA, 27 nt, Human
gaguagcugggauuacaagugcgcacu

SEQ ID NO: 86580 - RNA, 23 nt, Human
cagcagcugcugccccagcugcc

SEQ ID NO: 86581 - RNA, 22 nt, Human
uggcgcgcaccuguaaucccag

SEQ ID NO: 86582 - RNA, 22 nt, Human
gcagugccaccaccgcagccgc

SEQ ID NO: 86583 - RNA, 21 nt, Human
agggucaccacagacacuuag

SEQ ID NO: 86584 - RNA, 26 nt, Human
gggugggagagcgggaccagaucucg

SEQ ID NO: 86585 - RNA, 23 nt, Human
ccauugcuaauuuaaaggagcag

SEQ ID NO: 86586 - RNA, 27 nt, Human
cuccagccucuuucuccuggaggucac

SEQ ID NO: 86587 - RNA, 28 nt, Human
cgcucugccgugcgcuaggcuugguggg

SEQ ID NO: 86588 - RNA, 19 nt, Human
gcugacuaaagacugugug

SEQ ID NO: 86589 - RNA, 19 nt, Human
uuaaggcugaaggaaugaa

SEQ ID NO: 86590 - RNA, 26 nt, Human
uuauauuuacaaaugggaaacaaaag

SEQ ID NO: 86591 - RNA, 18 nt, Human
aaaugaacccuucuuaca

SEQ ID NO: 86592 - RNA, 19 nt, Human
acucugucucccaggcugg

SEQ ID NO: 86593 - RNA, 19 nt, Human
agucuccugacuccuggcc

SEQ ID NO: 86594 - RNA, 27 nt, Human
gcagacaccagcagcccugucacgccg

SEQ ID NO: 86595 - RNA, 25 nt, Human
aauuaguuucaaauauuuuugacau

SEQ ID NO: 86596 - RNA, 19 nt, Human
aacagcuuugaagugugga

SEQ ID NO: 86597 - RNA, 23 nt, Human
cuagggagggcggaaagggaggc

SEQ ID NO: 86598 - RNA, 22 nt, Human
ugcuguacugcauacccugcca

SEQ ID NO: 86599 - RNA, 20 nt, Human
uuugacauccagcaguccaa

SEQ ID NO: 86600 - RNA, 22 nt, Human
guuacuuuucucuucccccuca

SEQ ID NO: 86601 - RNA, 23 nt, Human
ccucaugccugucucgccaccuc

SEQ ID NO: 86602 - RNA, 22 nt, Human
ccaacaaaauucacuguucucu

SEQ ID NO: 86603 - RNA, 21 nt, Human
agagauuugcuccauucucuu

SEQ ID NO: 86604 - RNA, 26 nt, Human
aauccuucucuuucuuaaggcacuuu

SEQ ID NO: 86605 - RNA, 27 nt, Human
aucucccucuccuugcuggcuccaucu

SEQ ID NO: 86606 - RNA, 20 nt, Human
ggcuuugcugagugaaggaa

SEQ ID NO: 86607 - RNA, 28 nt, Human
ggguccagaagagagaggaggcacugcc

SEQ ID NO: 86608 - RNA, 24 nt, Human
aggcugagacagugaauuugggcu

SEQ ID NO: 86609 - RNA, 19 nt, Human
caggaccuggaauguacug

SEQ ID NO: 86610 - RNA, 27 nt, Human
uguugccaagcuagucuacaaagcauc

SEQ ID NO: 86611 - RNA, 21 nt, Human
uggaaucucuuggaugcagcu

SEQ ID NO: 86612 - RNA, 20 nt, Human
cuagugucaccugcacaggg

SEQ ID NO: 86613 - RNA, 23 nt, Human
gaguccuggggccagcgggaggu

SEQ ID NO: 86614 - RNA, 27 nt, Human
agccucaaacuccugggcuccagugau

SEQ ID NO: 86615 - RNA, 24 nt, Human
gccucccaggcuggggcagugggc

SEQ ID NO: 86616 - RNA, 22 nt, Human
accuguaaucccagcacacugg

SEQ ID NO: 86617 - RNA, 20 nt, Human
ucuuuaugccacaccuacca

SEQ ID NO: 86618 - RNA, 15 nt, Human
augacagauuccagu

SEQ ID NO: 86619 - RNA, 25 nt, Human
gccucucccugauggcacacaagga

SEQ ID NO: 86620 - RNA, 21 nt, Human
ugagggagagagaaagggugg

SEQ ID NO: 86621 - RNA, 22 nt, Human
aauugagcaccuacuguguguc

SEQ ID NO: 86622 - RNA, 21 nt, Human
caucacagagaacgucuguuu

SEQ ID NO: 86623 - RNA, 24 nt, Human
accggucagccagccuccugcugc

SEQ ID NO: 86624 - RNA, 26 nt, Human
ugccauagaguuuaacacaaguccug

SEQ ID NO: 86625 - RNA, 21 nt, Human
ucuuuuucccuccuuucuucu

SEQ ID NO: 86626 - RNA, 27 nt, Human
gccucaagcccaugaaugccaccccag

SEQ ID NO: 86627 - RNA, 22 nt, Human
acucccuuaccuacuggcauuc

SEQ ID NO: 86628 - RNA, 25 nt, Human
aggucucuaagaauauaaguggggg

SEQ ID NO: 86629 - RNA, 22 nt, Human
caaccccaaaccacauuagaag

SEQ ID NO: 86630 - RNA, 22 nt, Human
ccgcugcacuccagccuggggg

SEQ ID NO: 86631 - RNA, 19 nt, Human
gagaaggcuuccuccagcg

SEQ ID NO: 86632 - RNA, 25 nt, Human
acaaucuccccuaccuccugggacu

SEQ ID NO: 86633 - RNA, 23 nt, Human
ccccuucccggcgcacucggggg

SEQ ID NO: 86634 - RNA, 25 nt, Human
gggcuguggggcaccggcugccuuu

SEQ ID NO: 86635 - RNA, 23 nt, Human
ugugggucccuggcaagugucuu

SEQ ID NO: 86636 - RNA, 20 nt, Human
uuaaugaucauacaaauggg

SEQ ID NO: 86637 - RNA, 23 nt, Human
gaaccccaggcuggagugcagug

SEQ ID NO: 86638 - RNA, 22 nt, Human
gagcagccuggccaaccuggug

SEQ ID NO: 86639 - RNA, 21 nt, Human
cugugagccuagcagggcaga

SEQ ID NO: 86640 - RNA, 26 nt, Human
ggggaaagaaaaggaagcugcaggaa

SEQ ID NO: 86641 - RNA, 20 nt, Human
ccgccagccacuaucauguc

SEQ ID NO: 86642 - RNA, 27 nt, Human
guccuuuuccuccuuggagccugggcc

SEQ ID NO: 86643 - RNA, 20 nt, Human
uguaaaagauuguuuugaaa

SEQ ID NO: 86644 - RNA, 24 nt, Human
agcaccccugucucuagccacuuu

SEQ ID NO: 86645 - RNA, 25 nt, Human
ugaggggacagugacucccuuccaa

SEQ ID NO: 86646 - RNA, 25 nt, Human
uucaaauguaauuaucacacuaugu

SEQ ID NO: 86647 - RNA, 27 nt, Human
ccuacucaccgcucuccucccugcccc

SEQ ID NO: 86648 - RNA, 22 nt, Human
aaucccuggaucacgacgcugc

SEQ ID NO: 86649 - RNA, 21 nt, Human
cccucccagggccaggucaca

SEQ ID NO: 86650 - RNA, 21 nt, Human
auggggaggggauggagaaac

SEQ ID NO: 86651 - RNA, 21 nt, Human
cugugcuuguguuugcugcua

SEQ ID NO: 86652 - RNA, 27 nt, Human
ggcucagacacaaggagaggcuuggag

SEQ ID NO: 86653 - RNA, 21 nt, Human
gugggggccggcuuugcccau

SEQ ID NO: 86654 - RNA, 19 nt, Human
aucuuuugaauuacucgaa

SEQ ID NO: 86655 - RNA, 22 nt, Human
cuccccgaaaccaaaggggaag

SEQ ID NO: 86656 - RNA, 23 nt, Human
cacuucaggaggggccuggagca

SEQ ID NO: 86657 - RNA, 21 nt, Human
gccugcugcagauggggaaga

SEQ ID NO: 86658 - RNA, 21 nt, Human
acugucgcugccgagauccac

SEQ ID NO: 86659 - RNA, 22 nt, Human
uccuccaggggucuuggguggg

SEQ ID NO: 86660 - RNA, 22 nt, Human
uguaaaaauaggauggcgaguu

SEQ ID NO: 86661 - RNA, 21 nt, Human
aauguggcugccccucuccuc

SEQ ID NO: 86662 - RNA, 22 nt, Human
ggugggccuguuggggagccag

SEQ ID NO: 86663 - RNA, 18 nt, Human
ggagggagagacccuggg

SEQ ID NO: 86664 - RNA, 22 nt, Human
gacuacguucuuggcuccagac

SEQ ID NO: 86665 - RNA, 22 nt, Human
uaaaccagaauauuuuggucaa

SEQ ID NO: 86666 - RNA, 24 nt, Human
cacagccaaggcggcgcuggcuuu

SEQ ID NO: 86667 - RNA, 26 nt, Human
auaucugaaccaagauguaaaacaag

SEQ ID NO: 86668 - RNA, 23 nt, Human
aggcuggaguacaauggugcgau

SEQ ID NO: 86669 - RNA, 21 nt, Human
cucaaagcuccuaggaaucau

SEQ ID NO: 86670 - RNA, 30 nt, Human
cagagcuggacagccccaggaaaacccacc

SEQ ID NO: 86671 - RNA, 27 nt, Human
ggaggcugugccaggggacccggaagc

SEQ ID NO: 86672 - RNA, 21 nt, Human
ggcauuuuccuguguggcgga

SEQ ID NO: 86673 - RNA, 21 nt, Human
cuuccuccucucaaaccuggc

SEQ ID NO: 86674 - RNA, 24 nt, Human
cauuauucuuuuagggaaggugag

SEQ ID NO: 86675 - RNA, 22 nt, Human
ugcgggugugcugguuggugag

SEQ ID NO: 86676 - RNA, 21 nt, Human
ccucuaucacgaagauauuga

SEQ ID NO: 86677 - RNA, 21 nt, Human
ccgagacuaauguguggccca

SEQ ID NO: 86678 - RNA, 23 nt, Human
uacaaaccaaguugcccucuccg

SEQ ID NO: 86679 - RNA, 23 nt, Human
agagagaagaacagaguguucga

SEQ ID NO: 86680 - RNA, 23 nt, Human
cagcugucuguguuucuccuguu

SEQ ID NO: 86681 - RNA, 21 nt, Human
ggcaggugggggaauggaggc

SEQ ID NO: 86682 - RNA, 21 nt, Human
uggaugagggguagccuccca

SEQ ID NO: 86683 - RNA, 26 nt, Human
ccaggacacauuuccacuauaauuuu

SEQ ID NO: 86684 - RNA, 27 nt, Human
cccacugcaguuagagcugagcacuuu

SEQ ID NO: 86685 - RNA, 27 nt, Human
ggagaggggagaggacucgggggaggg

SEQ ID NO: 86686 - RNA, 21 nt, Human
cagagucuugcucugucacca

SEQ ID NO: 86687 - RNA, 25 nt, Human
ggaacuccugccauuaccagcuccc

SEQ ID NO: 86688 - RNA, 20 nt, Human
agcuaauacuccuguccuga

SEQ ID NO: 86689 - RNA, 23 nt, Human
gucaugccacugcacugcagccu

SEQ ID NO: 86690 - RNA, 20 nt, Human
uguuucucagucauaguugg

SEQ ID NO: 86691 - RNA, 20 nt, Human
cugacucauuuuucucaggu

SEQ ID NO: 86692 - RNA, 22 nt, Human
acuuggaaaaacccaaugggga

SEQ ID NO: 86693 - RNA, 21 nt, Human
ccacccagcaucccaggcugg

SEQ ID NO: 86694 - RNA, 26 nt, Human
cuccagccucagccuccugaguagcu

SEQ ID NO: 86695 - RNA, 26 nt, Human
cuggaguuugaguccagccuggguga

SEQ ID NO: 86696 - RNA, 27 nt, Human
cgcugcacugacauacuaagcuggaag

SEQ ID NO: 86697 - RNA, 25 nt, Human
cuuucuccaacgacucacggaggau

SEQ ID NO: 86698 - RNA, 25 nt, Human
ggcucacugcaguuuugaccuccca

SEQ ID NO: 86699 - RNA, 24 nt, Human
gcgccccugggagacaacuggaca

SEQ ID NO: 86700 - RNA, 20 nt, Human
cucucucuucccuagggccu

SEQ ID NO: 86701 - RNA, 25 nt, Human
ccacagcagcaaaggucaccaggcu

SEQ ID NO: 86702 - RNA, 31 nt, Human
gggagggagugaggggcaguggugcccuucc

SEQ ID NO: 86703 - RNA, 20 nt, Human
agccccagccccagcucccu

SEQ ID NO: 86704 - RNA, 21 nt, Human
ucagcagccuugcgcggccac

SEQ ID NO: 86705 - RNA, 21 nt, Human
ucccaagucggccauugaaaa

SEQ ID NO: 86706 - RNA, 19 nt, Human
ccacugcacugccaaggag

SEQ ID NO: 86707 - RNA, 26 nt, Human
uacuauacugaaaucugugcucucaa

SEQ ID NO: 86708 - RNA, 19 nt, Human
cgcugggagucuagaaaga

SEQ ID NO: 86709 - RNA, 22 nt, Human
gagccccagccaguuuacucca

SEQ ID NO: 86710 - RNA, 26 nt, Human
aucuuuugauuccucuugggcugaag

SEQ ID NO: 86711 - RNA, 25 nt, Human
gggccuuuccgccuccucaccacug

SEQ ID NO: 86712 - RNA, 26 nt, Human
gcacccaggcggaucugcaagcaccu

SEQ ID NO: 86713 - RNA, 20 nt, Human
ccccaggaagccggacucua

SEQ ID NO: 86714 - RNA, 22 nt, Human
aagguggccgcagucugccuuu

SEQ ID NO: 86715 - RNA, 27 nt, Human
cacagaugcauauagacacacauacau

SEQ ID NO: 86716 - RNA, 22 nt, Human
uccacaagaaacaaagaggaca

SEQ ID NO: 86717 - RNA, 20 nt, Human
acgugaagacuucugcucuu

SEQ ID NO: 86718 - RNA, 24 nt, Human
aaugguugggggagagaagggcag

SEQ ID NO: 86719 - RNA, 20 nt, Human
ugccucuugugccucuggca

SEQ ID NO: 86720 - RNA, 24 nt, Human
acugcagccucauacuccugggcu

SEQ ID NO: 86721 - RNA, 22 nt, Human
uggcccaguccaucuaccuggc

SEQ ID NO: 86722 - RNA, 22 nt, Human
aagacuuauauuuaucucuuca

SEQ ID NO: 86723 - RNA, 21 nt, Human
cggccaggcuggagugcagug

SEQ ID NO: 86724 - RNA, 21 nt, Human
aacaacaaaaguccauucaua

SEQ ID NO: 86725 - RNA, 19 nt, Human
cgggccuugcgugcagccu

SEQ ID NO: 86726 - RNA, 22 nt, Human
gccaugccugcuccucugccug

SEQ ID NO: 86727 - RNA, 26 nt, Human
ugaacaaauaagggacuuacugauaa

SEQ ID NO: 86728 - RNA, 22 nt, Human
uggcucccgccuguaaucccag

SEQ ID NO: 86729 - RNA, 27 nt, Human
auccuauucaguuucuuuaauagauga

SEQ ID NO: 86730 - RNA, 23 nt, Human
aacuucugcuuucaucccaugcc

SEQ ID NO: 86731 - RNA, 27 nt, Human
ucuacuuucuucuccauccugcuuuaa

SEQ ID NO: 86732 - RNA, 26 nt, Human
accgaggucuugcggcacaggcaacg

SEQ ID NO: 86733 - RNA, 21 nt, Human
ucaccuaggcuggagugcagu

SEQ ID NO: 86734 - RNA, 24 nt, Human
uuucuugcucggcuuccuggagcu

SEQ ID NO: 86735 - RNA, 20 nt, Human
ggacccuacacacuucggcu

SEQ ID NO: 86736 - RNA, 26 nt, Human
ugauaugcuuauacacuuacacuuua

SEQ ID NO: 86737 - RNA, 26 nt, Human
ugaggacguggugacuuccugaacau

SEQ ID NO: 86738 - RNA, 23 nt, Human
ucuucucccguccauuccaguca

SEQ ID NO: 86739 - RNA, 24 nt, Human
ccaguuccuucacuuacagauggc

SEQ ID NO: 86740 - RNA, 22 nt, Human
gaacuccuggucucaagugauc

SEQ ID NO: 86741 - RNA, 26 nt, Human
augaaugacugucccagaaugagaau

SEQ ID NO: 86742 - RNA, 27 nt, Human
gacacaagaccucagacuuguguuauu

SEQ ID NO: 86743 - RNA, 25 nt, Human
ccugcuguauccuguggcacugguc

SEQ ID NO: 86744 - RNA, 26 nt, Human
gcucacuguagccucaaccugccagg

SEQ ID NO: 86745 - RNA, 27 nt, Human
gggggaucuuuguggcuucagcaaauu

SEQ ID NO: 86746 - RNA, 24 nt, Human
aagugcuucaaaugaauuaagagu

SEQ ID NO: 86747 - RNA, 26 nt, Human
cccaccccagcccagggcccucaccc

SEQ ID NO: 86748 - RNA, 27 nt, Human
guucagcuccagcucaccagccccagu

SEQ ID NO: 86749 - RNA, 20 nt, Human
uaggguggguaccucugagu

SEQ ID NO: 86750 - RNA, 25 nt, Human
uugguuauaaauucaaagagcuuga

SEQ ID NO: 86751 - RNA, 21 nt, Human
uuucuacugcuuacucauguc

SEQ ID NO: 86752 - RNA, 21 nt, Human
aaucuacccaaaaugcagaca

SEQ ID NO: 86753 - RNA, 22 nt, Human
uguuuuuaaauuaugcuuucua

SEQ ID NO: 86754 - RNA, 22 nt, Human
uuucccacucccuuugcgucag

SEQ ID NO: 86755 - RNA, 18 nt, Human
gccuggugcaguggcuca

SEQ ID NO: 86756 - RNA, 24 nt, Human
gaguuucaggccccugggcauuuu

SEQ ID NO: 86757 - RNA, 27 nt, Human
ucacugcacauggaccucugggaagac

SEQ ID NO: 86758 - RNA, 21 nt, Human
ucaccaggcuggagugcagug

SEQ ID NO: 86759 - RNA, 25 nt, Human
ccuccugcaccugcugccuggaucc

SEQ ID NO: 86760 - RNA, 26 nt, Human
accgucggcacacugcuguuccucca

SEQ ID NO: 86761 - RNA, 22 nt, Human
ucacagcgaaccaggucucuca

SEQ ID NO: 86762 - RNA, 21 nt, Human
augaagagaaaauuaguagca

SEQ ID NO: 86763 - RNA, 22 nt, Human
ccucgugccagcugcuggugca

SEQ ID NO: 86764 - RNA, 22 nt, Human
agggacaagaggagcagaggac

SEQ ID NO: 86765 - RNA, 21 nt, Human
agcgcccagggaggagucagu

SEQ ID NO: 86766 - RNA, 26 nt, Human
cucuaccuucccacucaccuucccca

SEQ ID NO: 86767 - RNA, 15 nt, Human
acacaaaaacuugua

SEQ ID NO: 86768 - RNA, 15 nt, Human
gccaaaaaugcccca

SEQ ID NO: 86769 - RNA, 27 nt, Human
aaaacucaucacagaagauuggugaaa

SEQ ID NO: 86770 - RNA, 19 nt, Human
gacauaaaaugaauuaaug

SEQ ID NO: 86771 - RNA, 21 nt, Human
ugcuauucuuacugcugcuuc

SEQ ID NO: 86772 - RNA, 25 nt, Human
uauaugugauuuucaaauauguaaa

SEQ ID NO: 86773 - RNA, 27 nt, Human
gaguagcugggauugcaggcgcccgcc

SEQ ID NO: 86774 - RNA, 28 nt, Human
cucugacacuugccccuaaguccuucag

SEQ ID NO: 86775 - RNA, 23 nt, Human
ggugaccgcggaucccagcuucc

SEQ ID NO: 86776 - RNA, 24 nt, Human
ccauggcucuucccagccuagggg

SEQ ID NO: 86777 - RNA, 22 nt, Human
cacaacucccuuaaggucucca

SEQ ID NO: 86778 - RNA, 22 nt, Human
agcaaguaauaaagcagccuca

SEQ ID NO: 86779 - RNA, 24 nt, Human
ggugucuugauaccaggaggccag

SEQ ID NO: 86780 - RNA, 22 nt, Human
uccaucagccaggcuggagugc

SEQ ID NO: 86781 - RNA, 18 nt, Human
uaucuguguuuucaccau

SEQ ID NO: 86782 - RNA, 23 nt, Human
gcugcugcugucacucccucucc

SEQ ID NO: 86783 - RNA, 22 nt, Human
ugcccaggauggagugcagugg

SEQ ID NO: 86784 - RNA, 27 nt, Human
accgcaaccuccgccucccggauucaa

SEQ ID NO: 86785 - RNA, 21 nt, Human
guggagcccaggcuuugaugu

SEQ ID NO: 86786 - RNA, 26 nt, Human
ccucaggugauccacccaccugggcc

SEQ ID NO: 86787 - RNA, 24 nt, Human
ggcuuugacacaguccucugcugu

SEQ ID NO: 86788 - RNA, 24 nt, Human
ucaacagggguccagggugcagug

SEQ ID NO: 86789 - RNA, 24 nt, Human
ccaagucuugccauauuucaagca

SEQ ID NO: 86790 - RNA, 25 nt, Human
cucugagaaacucuggcaaguggac

SEQ ID NO: 86791 - RNA, 21 nt, Human
ggacccucugggcugcugugg

SEQ ID NO: 86792 - RNA, 21 nt, Human
gcccccuucuuugcagcugcc

SEQ ID NO: 86793 - RNA, 23 nt, Human
uuccuccacucuguaucuaugca

SEQ ID NO: 86794 - RNA, 21 nt, Human
cgcacacucuucauacuaagu

SEQ ID NO: 86795 - RNA, 29 nt, Human
gcaaguuuucccugaaguuauguguaugu

SEQ ID NO: 86796 - RNA, 23 nt, Human
gaggaggcccagagcagugcacu

SEQ ID NO: 86797 - RNA, 28 nt, Human
gaucuucagagcagggguccuuggugug

SEQ ID NO: 86798 - RNA, 22 nt, Human
uccuccagggagacuagguuau

SEQ ID NO: 86799 - RNA, 23 nt, Human
ggagccuaaagagaaaccgaggu

SEQ ID NO: 86800 - RNA, 25 nt, Human
ggaccugccuucuguccuggccggg

SEQ ID NO: 86801 - RNA, 22 nt, Human
caggccggaguccaguggugca

SEQ ID NO: 86802 - RNA, 23 nt, Human
cagggccuccauuccuggagccc

SEQ ID NO: 86803 - RNA, 25 nt, Human
ggcucacugcaacccccaucuccca

SEQ ID NO: 86804 - RNA, 20 nt, Human
uaagcaaaaaaccaaccacu

SEQ ID NO: 86805 - RNA, 25 nt, Human
ugcacguaucuccccuccgaauccc

SEQ ID NO: 86806 - RNA, 25 nt, Human
ucuccuguauaaccccaccuugcca

SEQ ID NO: 86807 - RNA, 21 nt, Human
ucucacugcaaccuccgccuc

SEQ ID NO: 86808 - RNA, 22 nt, Human
guauuuaucuuauuuccaguca

SEQ ID NO: 86809 - RNA, 22 nt, Human
gugugucuucauugccucucuc

SEQ ID NO: 86810 - RNA, 21 nt, Human
cccugcagacaaaagcugguu

SEQ ID NO: 86811 - RNA, 24 nt, Human
aaaaggacuacuuaaacauuuguc

SEQ ID NO: 86812 - RNA, 21 nt, Human
aggacagcgugguacuggcug

SEQ ID NO: 86813 - RNA, 27 nt, Human
ccaggaggcagggagggcuccgccgcg

SEQ ID NO: 86814 - RNA, 21 nt, Human
ucccaagcuggagugcagugg

SEQ ID NO: 86815 - RNA, 18 nt, Human
agggcacccucccuuccu

SEQ ID NO: 86816 - RNA, 22 nt, Human
accuauaaucccagcacuuugg

SEQ ID NO: 86817 - RNA, 23 nt, Human
cuuauaaggagaguuauaggcua

SEQ ID NO: 86818 - RNA, 21 nt, Human
cagacagagucucagggccca

SEQ ID NO: 86819 - RNA, 24 nt, Human
caggggcagccgcagggaggcagg

SEQ ID NO: 86820 - RNA, 26 nt, Human
gagggcaccaacagcguuccuccucc

SEQ ID NO: 86821 - RNA, 30 nt, Human
ggauguaauucgcuuugcucucuccucauu

SEQ ID NO: 86822 - RNA, 22 nt, Human
augggaaugcccugaaacuacu

SEQ ID NO: 86823 - RNA, 21 nt, Human
uugaaggguccuugugccagu

SEQ ID NO: 86824 - RNA, 21 nt, Human
aggaggcggagcuugcaguga

SEQ ID NO: 86825 - RNA, 18 nt, Human
cgcccacucuccaccuca

SEQ ID NO: 86826 - RNA, 28 nt, Human
ggcccaggagauccuacucucccccgag

SEQ ID NO: 86827 - RNA, 24 nt, Human
ccuccuccuccccugcagccuggu

SEQ ID NO: 86828 - RNA, 22 nt, Human
gggauuacaagggugagccacc

SEQ ID NO: 86829 - RNA, 23 nt, Human
uccauucauaguggauuaaugca

SEQ ID NO: 86830 - RNA, 22 nt, Human
aaaugauuuucauguuaggcca

SEQ ID NO: 86831 - RNA, 21 nt, Human
acugucugaagaugaggaauc

SEQ ID NO: 86832 - RNA, 20 nt, Human
cgcccaggcuggacugcagu

SEQ ID NO: 86833 - RNA, 18 nt, Human
uggcggucaucauccccu

SEQ ID NO: 86834 - RNA, 23 nt, Human
ggaaugcuugaaaaaugugcaaa

SEQ ID NO: 86835 - RNA, 21 nt, Human
gaagaagaaagaagacgcgau

SEQ ID NO: 86836 - RNA, 21 nt, Human
uccagaugugugagaucaugu

SEQ ID NO: 86837 - RNA, 24 nt, Human
aauugguuucucauaacuugcauc

SEQ ID NO: 86838 - RNA, 22 nt, Human
cacacucucucugcucuuccca

SEQ ID NO: 86839 - RNA, 20 nt, Human
agcuugguaguuaacacauc

SEQ ID NO: 86840 - RNA, 27 nt, Human
gaccagccugggcagcauagcaagauc

SEQ ID NO: 86841 - RNA, 23 nt, Human
uuguguccccuccucccccucca

SEQ ID NO: 86842 - RNA, 19 nt, Human
aacacaaccagucuuuuug

SEQ ID NO: 86843 - RNA, 19 nt, Human
uggcugcugcucacccucc

SEQ ID NO: 86844 - RNA, 22 nt, Human
ccugcagcugcccuggaauucc

SEQ ID NO: 86845 - RNA, 22 nt, Human
ucacccagucuggagugcagug

SEQ ID NO: 86846 - RNA, 19 nt, Human
acuguggaugacuacuuuc

SEQ ID NO: 86847 - RNA, 23 nt, Human
auccuagugcgggaccccgccuc

SEQ ID NO: 86848 - RNA, 23 nt, Human
augguguguaacuucagcuccag

SEQ ID NO: 86849 - RNA, 24 nt, Human
cuaccaugggaccagcucuggcca

SEQ ID NO: 86850 - RNA, 23 nt, Human
gccugaucucaucaaucuagcgg

SEQ ID NO: 86851 - RNA, 21 nt, Human
uuccugccucuccuuucacca

SEQ ID NO: 86852 - RNA, 21 nt, Human
aacacaagaaaaagauaagaa

SEQ ID NO: 86853 - RNA, 21 nt, Human
gcgcuuuggggguggaggggg

SEQ ID NO: 86854 - RNA, 18 nt, Human
gggaaugggguggagagg

SEQ ID NO: 86855 - RNA, 21 nt, Human
agcaaacuguuaaaguaguca

SEQ ID NO: 86856 - RNA, 25 nt, Human
ccggcgggucccagcaucucgagac

SEQ ID NO: 86857 - RNA, 23 nt, Human
uccuccagacaacccucagauuu

SEQ ID NO: 86858 - RNA, 22 nt, Human
agaccagccugcccaacauagu

SEQ ID NO: 86859 - RNA, 22 nt, Human
agaccagccugaccaacaucgu

SEQ ID NO: 86860 - RNA, 25 nt, Human
agcucugucuuuccagcugucuguc

SEQ ID NO: 86861 - RNA, 22 nt, Human
ugggguaccaccuacacccaac

SEQ ID NO: 86862 - RNA, 27 nt, Human
acucuagacacaguuuuuaucuuggau

SEQ ID NO: 86863 - RNA, 23 nt, Human
uaaacaaaugcauaugauaugua

SEQ ID NO: 86864 - RNA, 25 nt, Human
ccucagacccugggcuuccgaccuc

SEQ ID NO: 86865 - RNA, 18 nt, Human
aggaggggagcagaggaa

SEQ ID NO: 86866 - RNA, 23 nt, Human
cccugcacuccgccgccucagag

SEQ ID NO: 86867 - RNA, 25 nt, Human
agcauuagcagcaccuaaguccuca

SEQ ID NO: 86868 - RNA, 22 nt, Human
uguuccugccuuuagaguucca

SEQ ID NO: 86869 - RNA, 23 nt, Human
cccaucagagagcgagcgcuacc

SEQ ID NO: 86870 - RNA, 23 nt, Human
agacgucuacagggaagacacca

SEQ ID NO: 86871 - RNA, 27 nt, Human
augagacaaauaccuacuucuuuuauu

SEQ ID NO: 86872 - RNA, 23 nt, Human
uggcuucaucuuucucuugugug

SEQ ID NO: 86873 - RNA, 28 nt, Human
cccauucuacuugcucuggaccugcccc

SEQ ID NO: 86874 - RNA, 23 nt, Human
ugucuuucuuugaaaacugcaau

SEQ ID NO: 86875 - RNA, 22 nt, Human
ugcaugcuacccgggucucgga

SEQ ID NO: 86876 - RNA, 23 nt, Human
guggggcucagggccagugcuca

SEQ ID NO: 86877 - RNA, 21 nt, Human
caaacagaucuuuauaguucg

SEQ ID NO: 86878 - RNA, 26 nt, Human
ggaggcagagguugcagugcgcugag

SEQ ID NO: 86879 - RNA, 27 nt, Human
aggcacuggggaucucaccagaaagga

SEQ ID NO: 86880 - RNA, 24 nt, Human
cugccaccaaaggccagggucacu

SEQ ID NO: 86881 - RNA, 21 nt, Human
ucagccuguggcccagcacug

SEQ ID NO: 86882 - RNA, 22 nt, Human
agccuagaccaagcaggaagaa

SEQ ID NO: 86883 - RNA, 22 nt, Human
cucggagcucccccugccuccu

SEQ ID NO: 86884 - RNA, 23 nt, Human
cauggaagaggaggaggaggagc

SEQ ID NO: 86885 - RNA, 26 nt, Human
aaaucaggagucaaaauucaucgucu

SEQ ID NO: 86886 - RNA, 23 nt, Human
agcuuugagagaggagugugugu

SEQ ID NO: 86887 - RNA, 20 nt, Human
gcugugcacugcuguaaacu

SEQ ID NO: 86888 - RNA, 21 nt, Human
ugcugcuuaacaggcuuugug

SEQ ID NO: 86889 - RNA, 22 nt, Human
auguuuguaaaacuacacaucc

SEQ ID NO: 86890 - RNA, 23 nt, Human
aucaaaugcaaccccaucuuguu

SEQ ID NO: 86891 - RNA, 17 nt, Human
caauugcuuuguaagug

SEQ ID NO: 86892 - RNA, 25 nt, Human
acaggaaacacuucucacccccuca

SEQ ID NO: 86893 - RNA, 20 nt, Human
gacccuccagccagccuucu

SEQ ID NO: 86894 - RNA, 22 nt, Human
acauuuagugccagccuaggca

SEQ ID NO: 86895 - RNA, 23 nt, Human
ugcuccgcuuuuguugcaucacu

SEQ ID NO: 86896 - RNA, 22 nt, Human
uccaagguggucugcucgggcc

SEQ ID NO: 86897 - RNA, 26 nt, Human
gggagccauaaucugcaacuucauuu

SEQ ID NO: 86898 - RNA, 23 nt, Human
uccaguaagccaauaauuuuaaa

SEQ ID NO: 86899 - RNA, 20 nt, Human
acuggccuccaggaugagga

SEQ ID NO: 86900 - RNA, 23 nt, Human
gaccggguggaggcgguggggac

SEQ ID NO: 86901 - RNA, 27 nt, Human
agcaggagcggucagggcuccaggcau

SEQ ID NO: 86902 - RNA, 25 nt, Human
cucagggagcauuuaauggcagcua

SEQ ID NO: 86903 - RNA, 21 nt, Human
cuguguguuaagcauaugcuu

SEQ ID NO: 86904 - RNA, 27 nt, Human
cacugccucuuuccaggggccucuggg

SEQ ID NO: 86905 - RNA, 26 nt, Human
gggacuggccagguuucugcccacau

SEQ ID NO: 86906 - RNA, 21 nt, Human
ugcugcuaugacaucucucca

SEQ ID NO: 86907 - RNA, 21 nt, Human
uugacaauaaaggaaugagua

SEQ ID NO: 86908 - RNA, 25 nt, Human
ugcugugaauuguacauuucugugu

SEQ ID NO: 86909 - RNA, 22 nt, Human
ugagugcugauucaaaccaaag

SEQ ID NO: 86910 - RNA, 18 nt, Human
aguggcuucagcggugga

SEQ ID NO: 86911 - RNA, 19 nt, Human
aaagaucuuugucugugaa

SEQ ID NO: 86912 - RNA, 26 nt, Human
uucaucucaaggaauaaugggcuuag

SEQ ID NO: 86913 - RNA, 19 nt, Human
ugggagaagagggguauag

SEQ ID NO: 86914 - RNA, 27 nt, Human
uggccaacaugaugaaaccccgucucu

SEQ ID NO: 86915 - RNA, 21 nt, Human
cugcuguuugccccucagucu

SEQ ID NO: 86916 - RNA, 22 nt, Human
aaaauucugggauuacaggcau

SEQ ID NO: 86917 - RNA, 19 nt, Human
ccuccuuugcuccugcugc

SEQ ID NO: 86918 - RNA, 21 nt, Human
cagcaaccucuaccuccuggg

SEQ ID NO: 86919 - RNA, 25 nt, Human
aggggcgugcagacacuucccuaac

SEQ ID NO: 86920 - RNA, 27 nt, Human
cuccucgggucucuccauaauucagcc

SEQ ID NO: 86921 - RNA, 25 nt, Human
uguuaaaauaucuuuuuguuauacu

SEQ ID NO: 86922 - RNA, 21 nt, Human
ugggaggccgagaugggugaa

SEQ ID NO: 86923 - RNA, 18 nt, Human
gcugauucuuuaaauggu

SEQ ID NO: 86924 - RNA, 24 nt, Human
uucucuaucagcuauucagucuua

SEQ ID NO: 86925 - RNA, 27 nt, Human
gagaaucgcuugaacccgggaggcaga

SEQ ID NO: 86926 - RNA, 21 nt, Human
ccagggguagaggcugggggc

SEQ ID NO: 86927 - RNA, 25 nt, Human
agccccuggccuggcugaguuuggc

SEQ ID NO: 86928 - RNA, 24 nt, Human
gugaacaauaaagaggaaugucca

SEQ ID NO: 86929 - RNA, 21 nt, Human
uagauuuggagauacuguggu

SEQ ID NO: 86930 - RNA, 23 nt, Human
gcaggcaggcgggucacagggac

SEQ ID NO: 86931 - RNA, 23 nt, Human
cccuguccuccaccugccuucca

SEQ ID NO: 86932 - RNA, 26 nt, Human
acagugucucuucacuagucauuuag

SEQ ID NO: 86933 - RNA, 31 nt, Human
ugguguucacagcugccucuuuggcaccucc

SEQ ID NO: 86934 - RNA, 20 nt, Human
ggccuccagggccaggaguc

SEQ ID NO: 86935 - RNA, 21 nt, Human
ccgucacuccauacaguauua

SEQ ID NO: 86936 - RNA, 22 nt, Human
cugugcucuccucucaggggca

SEQ ID NO: 86937 - RNA, 22 nt, Human
agaucacugcaaccucugccuc

SEQ ID NO: 86938 - RNA, 23 nt, Human
ugccuccccacugcagccugcgg

SEQ ID NO: 86939 - RNA, 19 nt, Human
auucagccacacuggccuu

SEQ ID NO: 86940 - RNA, 28 nt, Human
gggcuccagaccuuucugagcccugcuu

SEQ ID NO: 86941 - RNA, 21 nt, Human
ggucucaauugcccagcuccg

SEQ ID NO: 86942 - RNA, 19 nt, Human
gacuacaggcucaugccau

SEQ ID NO: 86943 - RNA, 27 nt, Human
gggaaagagcaaaagguuuaugagggg

SEQ ID NO: 86944 - RNA, 22 nt, Human
ugccucccggguucaaguaauu

SEQ ID NO: 86945 - RNA, 22 nt, Human
ugucaccuaggcaagagugcaa

SEQ ID NO: 86946 - RNA, 22 nt, Human
acgggacccugaaacuccacuu

SEQ ID NO: 86947 - RNA, 22 nt, Human
gggccugggacaguggcugcuc

SEQ ID NO: 86948 - RNA, 22 nt, Human
auaccagccugggcaacauagu

SEQ ID NO: 86949 - RNA, 21 nt, Human
acccugaguuucucuggugac

SEQ ID NO: 86950 - RNA, 26 nt, Human
aauccauccugcucaggaaaccacaa

SEQ ID NO: 86951 - RNA, 21 nt, Human
gaguguugaggugagucagaa

SEQ ID NO: 86952 - RNA, 22 nt, Human
aaaagccaaaagguggccaggc

SEQ ID NO: 86953 - RNA, 23 nt, Human
ugggacccacagucacacagagc

SEQ ID NO: 86954 - RNA, 21 nt, Human
gaagggaggggggacgacggc

SEQ ID NO: 86955 - RNA, 19 nt, Human
gcaaauucuggcagcuggc

SEQ ID NO: 86956 - RNA, 27 nt, Human
agggaguccccuuucugaagcuguggu

SEQ ID NO: 86957 - RNA, 26 nt, Human
guggguugcuugggggugggauggga

SEQ ID NO: 86958 - RNA, 25 nt, Human
ccugccuggucugacccuccccugc

SEQ ID NO: 86959 - RNA, 25 nt, Human
gagguggaggguagcccuggggccc

SEQ ID NO: 86960 - RNA, 27 nt, Human
agccuccucccgaccccuuccugcgcg

SEQ ID NO: 86961 - RNA, 24 nt, Human
agcaaggacacaacaucagaggga

SEQ ID NO: 86962 - RNA, 29 nt, Human
gcaucugcaguacaccaagcacaugauuc

SEQ ID NO: 86963 - RNA, 21 nt, Human
uccuggagaagccucguuuug

SEQ ID NO: 86964 - RNA, 20 nt, Human
gcaaguccccguccaaaaag

SEQ ID NO: 86965 - RNA, 24 nt, Human
cucuucucccuucucccuccauca

SEQ ID NO: 86966 - RNA, 23 nt, Human
agaugccagagccggagaugucu

SEQ ID NO: 86967 - RNA, 27 nt, Human
gggagagaggaaguugccgccugcugc

SEQ ID NO: 86968 - RNA, 28 nt, Human
cuggucccaucugccucuuuucucuccc

SEQ ID NO: 86969 - RNA, 22 nt, Human
gcucaugucugcaaucccagcg

SEQ ID NO: 86970 - RNA, 22 nt, Human
uccacaucccuaacaucaugca

SEQ ID NO: 86971 - RNA, 25 nt, Human
aaguucuaugaagaguauuaaugua

SEQ ID NO: 86972 - RNA, 23 nt, Human
uugcccaggcuggucugaagcug

SEQ ID NO: 86973 - RNA, 23 nt, Human
cuucuacugagccuucagucuug

SEQ ID NO: 86974 - RNA, 23 nt, Human
ggccaccccaaccucuguucccc

SEQ ID NO: 86975 - RNA, 23 nt, Human
gagguccuucacuguguguacac

SEQ ID NO: 86976 - RNA, 25 nt, Human
ucaguuacacaggaacccuaaagca

SEQ ID NO: 86977 - RNA, 21 nt, Human
ugaagaagaaacugaauacuc

SEQ ID NO: 86978 - RNA, 22 nt, Human
agcacagaacuccagccccgcu

SEQ ID NO: 86979 - RNA, 21 nt, Human
guguugagauuucuguguucu

SEQ ID NO: 86980 - RNA, 24 nt, Human
uacagaagaagcuccugaaucccu

SEQ ID NO: 86981 - RNA, 27 nt, Human
ucccuccaucuucccugggguucuccu

SEQ ID NO: 86982 - RNA, 25 nt, Human
agccccugcugccccagccuguguc

SEQ ID NO: 86983 - RNA, 26 nt, Human
gaguagcuauauauuucuacuuugug

SEQ ID NO: 86984 - RNA, 26 nt, Human
uccucccuccccuuucaaccauggac

SEQ ID NO: 86985 - RNA, 21 nt, Human
gucacaaagcucuagugcaau

SEQ ID NO: 86986 - RNA, 31 nt, Human
acugcaucccucugugccucaguuucccauu

SEQ ID NO: 86987 - RNA, 21 nt, Human
cccgaguggcugggauuagcg

SEQ ID NO: 86988 - RNA, 22 nt, Human
aggccaagaugggcaaaucacu

SEQ ID NO: 86989 - RNA, 21 nt, Human
ggagaagccucagggaaaggc

SEQ ID NO: 86990 - RNA, 22 nt, Human
cucuccucucuugaguuaaccc

SEQ ID NO: 86991 - RNA, 21 nt, Human
uguuacccaggcuggucucaa

SEQ ID NO: 86992 - RNA, 23 nt, Human
uucuggaguuuuguuuuuuccuu

SEQ ID NO: 86993 - RNA, 23 nt, Human
gggcuggugugcaguggugcgac

SEQ ID NO: 86994 - RNA, 21 nt, Human
auagaagucuucaugaaaugc

SEQ ID NO: 86995 - RNA, 22 nt, Human
cccggcagacuucaagagucuc

SEQ ID NO: 86996 - RNA, 24 nt, Human
ggccaucaaaucaaugauuuaaug

SEQ ID NO: 86997 - RNA, 27 nt, Human
ccagaaacaaaucucaaaguguacaaa

SEQ ID NO: 86998 - RNA, 21 nt, Human
ccacuucucacacuggccuua

SEQ ID NO: 86999 - RNA, 20 nt, Human
cccaggcuccacuccugggc

SEQ ID NO: 87000 - RNA, 31 nt, Human
cuucuccaccaagccucucaccugucuguuc

SEQ ID NO: 87001 - RNA, 21 nt, Human
cugaccauuuaaaauugaaca

SEQ ID NO: 87002 - RNA, 22 nt, Human
uauaggaaucucuccaggucaa

SEQ ID NO: 87003 - RNA, 32 nt, Human
cugggcugacaggcccaaguugcagucagcag

SEQ ID NO: 87004 - RNA, 27 nt, Human
auggaaagaaacaucaggagggacagg

SEQ ID NO: 87005 - RNA, 21 nt, Human
cacccuacuaagaauuggcag

SEQ ID NO: 87006 - RNA, 22 nt, Human
agcucacugcagccucugccac

SEQ ID NO: 87007 - RNA, 21 nt, Human
auauuccucuuggccuuguga

SEQ ID NO: 87008 - RNA, 22 nt, Human
acuguuaaaaucuuacuacuuc

SEQ ID NO: 87009 - RNA, 19 nt, Human
aguuuggaguacuugcugu

SEQ ID NO: 87010 - RNA, 23 nt, Human
gccccacccacuccaucaucucc

SEQ ID NO: 87011 - RNA, 23 nt, Human
accaugauggaguggcggccagu

SEQ ID NO: 87012 - RNA, 22 nt, Human
uccuuucucucccugcuuugcu

SEQ ID NO: 87013 - RNA, 25 nt, Human
augucaauucuuccugcucuucuua

SEQ ID NO: 87014 - RNA, 27 nt, Human
cagggcccuguugaauuuuguucucug

SEQ ID NO: 87015 - RNA, 20 nt, Human
gcagggcucccaugggcuga

SEQ ID NO: 87016 - RNA, 19 nt, Human
uuuaacuauagcuuuauua

SEQ ID NO: 87017 - RNA, 22 nt, Human
gcaaaacugcugucgcugcagu

SEQ ID NO: 87018 - RNA, 25 nt, Human
aacugacuuaauuuucaagcacuug

SEQ ID NO: 87019 - RNA, 25 nt, Human
ugaacaacgagccuuuucacccuuc

SEQ ID NO: 87020 - RNA, 26 nt, Human
auuuuuaaaaagcuuauuauuucuug

SEQ ID NO: 87021 - RNA, 27 nt, Human
ugggcaacauggugaaaccuugucucu

SEQ ID NO: 87022 - RNA, 26 nt, Human
gcuaagcugggaccggcaguccucac

SEQ ID NO: 87023 - RNA, 23 nt, Human
ugcccgcuccccucccauugucc

SEQ ID NO: 87024 - RNA, 20 nt, Human
augugggaaaaaagaaaucc

SEQ ID NO: 87025 - RNA, 22 nt, Human
ugcccacagaguuccaccugcu

SEQ ID NO: 87026 - RNA, 21 nt, Human
ucugacagccucagugacccu

SEQ ID NO: 87027 - RNA, 26 nt, Human
aggagaggcacacaugugcugcagcc

SEQ ID NO: 87028 - RNA, 23 nt, Human
uacaagcacccaaccacgcccag

SEQ ID NO: 87029 - RNA, 26 nt, Human
uccuuaacagaugaacuauccacaga

SEQ ID NO: 87030 - RNA, 20 nt, Human
ucaccccacacccucccucu

SEQ ID NO: 87031 - RNA, 22 nt, Human
cagugcugguuccucugccugu

SEQ ID NO: 87032 - RNA, 22 nt, Human
cugaggcaggagaacuacuuga

SEQ ID NO: 87033 - RNA, 26 nt, Human
guuagauuugaauauauacauucuau

SEQ ID NO: 87034 - RNA, 26 nt, Human
uggcaguguuuuuaugacuuuuauac

SEQ ID NO: 87035 - RNA, 20 nt, Human
ggcagauacugucucuuuca

SEQ ID NO: 87036 - RNA, 22 nt, Human
acugaggauauggacacuggug

SEQ ID NO: 87037 - RNA, 21 nt, Human
aacaacaaagacaugcuuucc

SEQ ID NO: 87038 - RNA, 24 nt, Human
uccacagacuggaguggaccugga

SEQ ID NO: 87039 - RNA, 20 nt, Human
gcgggagggggagggggagu

SEQ ID NO: 87040 - RNA, 18 nt, Human
gcaggaucacagcucacg

SEQ ID NO: 87041 - RNA, 25 nt, Human
ccccucggagccacuuccggcggca

SEQ ID NO: 87042 - RNA, 22 nt, Human
cccagcgcuggguucucuccac

SEQ ID NO: 87043 - RNA, 15 nt, Human
gccagaaaugccucc

SEQ ID NO: 87044 - RNA, 19 nt, Human
acgauuuucuuuacuacca

SEQ ID NO: 87045 - RNA, 26 nt, Human
aauuauucaacuaagaaccaauaaug

SEQ ID NO: 87046 - RNA, 21 nt, Human
gaacuauauauaaacuguaca

SEQ ID NO: 87047 - RNA, 22 nt, Human
uuccugccuccuuccucugugg

SEQ ID NO: 87048 - RNA, 22 nt, Human
ugucacccaggcuggaguacag

SEQ ID NO: 87049 - RNA, 22 nt, Human
ugucacccagacuggagugcag

SEQ ID NO: 87050 - RNA, 21 nt, Human
cacgccgccucgccugccgcc

SEQ ID NO: 87051 - RNA, 24 nt, Human
ccugcacugccagcaucuggagac

SEQ ID NO: 87052 - RNA, 22 nt, Human
cagaaggcagagguugcaguga

SEQ ID NO: 87053 - RNA, 25 nt, Human
uucagcaccucggacagaacacgca

SEQ ID NO: 87054 - RNA, 21 nt, Human
gucagcgagcuggacuggggu

SEQ ID NO: 87055 - RNA, 24 nt, Human
acugcuugacccaggaacaagugg

SEQ ID NO: 87056 - RNA, 21 nt, Human
cucauuucccagccuuucuug

SEQ ID NO: 87057 - RNA, 24 nt, Human
aagauguugaauuucuucuguuca

SEQ ID NO: 87058 - RNA, 19 nt, Human
ucuuccacuucuccagaaa

SEQ ID NO: 87059 - RNA, 19 nt, Human
aguccuggugucuccagcc

SEQ ID NO: 87060 - RNA, 25 nt, Human
auggauacacauguguauaucugua

SEQ ID NO: 87061 - RNA, 21 nt, Human
uaucguuuaacuuugcaccua

SEQ ID NO: 87062 - RNA, 21 nt, Human
ccuccaaggcuggagugcagu

SEQ ID NO: 87063 - RNA, 23 nt, Human
gcuuucagucuucugucagcagu

SEQ ID NO: 87064 - RNA, 22 nt, Human
ugcagcccaggcuggagugcag

SEQ ID NO: 87065 - RNA, 20 nt, Human
gaaguuaaccacagucggga

SEQ ID NO: 87066 - RNA, 23 nt, Human
gagugagacucccaucucaaaaa

SEQ ID NO: 87067 - RNA, 25 nt, Human
uuuugccauguuggccaagcugauc

SEQ ID NO: 87068 - RNA, 22 nt, Human
cugaggcaggagaaugguguga

SEQ ID NO: 87069 - RNA, 21 nt, Human
uaagcagagggagagaaccuc

SEQ ID NO: 87070 - RNA, 25 nt, Human
cugagccucuuguuuuuccucagcu

SEQ ID NO: 87071 - RNA, 26 nt, Human
aggcagcaguauaagcuguagaucug

SEQ ID NO: 87072 - RNA, 21 nt, Human
uccuguaaugaaagcuguuug

SEQ ID NO: 87073 - RNA, 21 nt, Human
gcugugggugaggagguaggu

SEQ ID NO: 87074 - RNA, 24 nt, Human
caggguccccaccccuuuucuccc

SEQ ID NO: 87075 - RNA, 23 nt, Human
cagucuaacaguuugccugcugu

SEQ ID NO: 87076 - RNA, 22 nt, Human
aggcugaggugggagaauugcc

SEQ ID NO: 87077 - RNA, 27 nt, Human
ucacuauguccaugaaaaacagcagag

SEQ ID NO: 87078 - RNA, 25 nt, Human
ccugccaggcccuccagcaggagga

SEQ ID NO: 87079 - RNA, 23 nt, Human
aggcaucuguuuguuugugucuu

SEQ ID NO: 87080 - RNA, 26 nt, Human
cuccacccauuuuccugcauucuguc

SEQ ID NO: 87081 - RNA, 22 nt, Human
ucagaggcagagucagaggccu

SEQ ID NO: 87082 - RNA, 22 nt, Human
uugcaauuuuugacccugacca

SEQ ID NO: 87083 - RNA, 23 nt, Human
guuauuuggaagcaguuuccuuu

SEQ ID NO: 87084 - RNA, 23 nt, Human
caucugccucuggcugccugcgu

SEQ ID NO: 87085 - RNA, 22 nt, Human
gugggcugcggugauggguguu

SEQ ID NO: 87086 - RNA, 22 nt, Human
aggcugagccaggaggaucacu

SEQ ID NO: 87087 - RNA, 21 nt, Human
cucauaagaugguccacucug

SEQ ID NO: 87088 - RNA, 23 nt, Human
cauccccaguccagccugggcaa

SEQ ID NO: 87089 - RNA, 21 nt, Human
uucagcuuucaaaaagagugc

SEQ ID NO: 87090 - RNA, 17 nt, Human
uccuagcuucaggcuac

SEQ ID NO: 87091 - RNA, 21 nt, Human
agaggugagaggaaugagggg

SEQ ID NO: 87092 - RNA, 21 nt, Human
ucacuacuaacuacagaugac

SEQ ID NO: 87093 - RNA, 22 nt, Human
ugggagcagcagagaaauaaac

SEQ ID NO: 87094 - RNA, 23 nt, Human
aaaugauuaauuugauauucuuu

SEQ ID NO: 87095 - RNA, 21 nt, Human
gcucugaagcccauggcccag

SEQ ID NO: 87096 - RNA, 28 nt, Human
cuuuucuuugcccuccugauucuuggcu

SEQ ID NO: 87097 - RNA, 22 nt, Human
cccaagcugacucauccuaacu

SEQ ID NO: 87098 - RNA, 24 nt, Human
gcuguuuaacacuauccugggcaa

SEQ ID NO: 87099 - RNA, 25 nt, Human
ccuccuccucuucaauucucccggu

SEQ ID NO: 87100 - RNA, 21 nt, Human
augaaaggaauaaaaccuaca

SEQ ID NO: 87101 - RNA, 21 nt, Human
guggcuccugaccugcugcua

SEQ ID NO: 87102 - RNA, 30 nt, Human
ugucauccagagcuggagugcagcggcaca

SEQ ID NO: 87103 - RNA, 20 nt, Human
gcucacugcagccuccgcuu

SEQ ID NO: 87104 - RNA, 23 nt, Human
ugucacucaggcuggagcacagu

SEQ ID NO: 87105 - RNA, 19 nt, Human
gcuucagcaaaaacggaga

SEQ ID NO: 87106 - RNA, 23 nt, Human
guaauaugagcaaccaaaguggg

SEQ ID NO: 87107 - RNA, 22 nt, Human
cccuccuccuccucggaauccu

SEQ ID NO: 87108 - RNA, 23 nt, Human
ggagcaguacuacgugggagagc

SEQ ID NO: 87109 - RNA, 20 nt, Human
ggggcagcagcugccucuga

SEQ ID NO: 87110 - RNA, 27 nt, Human
ccacugcacuccagccuggggacagag

SEQ ID NO: 87111 - RNA, 21 nt, Human
ggcccucugggcuccugccuc

SEQ ID NO: 87112 - RNA, 22 nt, Human
cugcccagguccugggguggug

SEQ ID NO: 87113 - RNA, 23 nt, Human
ccuccacucccuucugacuuucc

SEQ ID NO: 87114 - RNA, 28 nt, Human
gagcugaaaacacaagcccaggagugca

SEQ ID NO: 87115 - RNA, 23 nt, Human
ggacagaucaggucagagcccag

SEQ ID NO: 87116 - RNA, 23 nt, Human
gaagucaggccagcguccuccuc

SEQ ID NO: 87117 - RNA, 22 nt, Human
gaccaccaugcugaucgcuucu

SEQ ID NO: 87118 - RNA, 26 nt, Human
ccccacugcugucauugucacaggau

SEQ ID NO: 87119 - RNA, 22 nt, Human
aacugcacuacaagacacuuug

SEQ ID NO: 87120 - RNA, 21 nt, Human
ccagauuugaagacucaugcc

SEQ ID NO: 87121 - RNA, 21 nt, Human
ggggggagaagaaauuuugag

SEQ ID NO: 87122 - RNA, 22 nt, Human
cgggaggcagagguugcagccg

SEQ ID NO: 87123 - RNA, 22 nt, Human
cacagcgcuccagccuggucga

SEQ ID NO: 87124 - RNA, 24 nt, Human
caucauggaguuaaugacccgugg

SEQ ID NO: 87125 - RNA, 21 nt, Human
ccugguuuucacauacacuca

SEQ ID NO: 87126 - RNA, 22 nt, Human
gcccaacuccagugcagcugcc

SEQ ID NO: 87127 - RNA, 26 nt, Human
aucucgaacuucuggccucuagcgau

SEQ ID NO: 87128 - RNA, 22 nt, Human
uugcaaccucugccucccaggu

SEQ ID NO: 87129 - RNA, 21 nt, Human
guuuuuaaauagaguuugcua

SEQ ID NO: 87130 - RNA, 23 nt, Human
gugaaggagggauaugugguaga

SEQ ID NO: 87131 - RNA, 22 nt, Human
cugccaccgacugcccagccac

SEQ ID NO: 87132 - RNA, 21 nt, Human
ugacuucugcuggguccuaag

SEQ ID NO: 87133 - RNA, 27 nt, Human
ugaggggaaggacugugaccugccaua

SEQ ID NO: 87134 - RNA, 24 nt, Human
uggugcucaggagcgaaggacugu

SEQ ID NO: 87135 - RNA, 21 nt, Human
ucaaccagugaucccccaccu

SEQ ID NO: 87136 - RNA, 21 nt, Human
uuuaucucccuuuccacucuc

SEQ ID NO: 87137 - RNA, 27 nt, Human
cagccucuagcuucaggcugggcacgg

SEQ ID NO: 87138 - RNA, 24 nt, Human
ggcaauguugauuaaucucaguau

SEQ ID NO: 87139 - RNA, 23 nt, Human
guugauugugucucaaaccauga

SEQ ID NO: 87140 - RNA, 22 nt, Human
gaagaagccccacgggagccag

SEQ ID NO: 87141 - RNA, 25 nt, Human
cuucugcugcaguacagaauccaca

SEQ ID NO: 87142 - RNA, 18 nt, Human
ccagggccagacagcccu

SEQ ID NO: 87143 - RNA, 15 nt, Human
gagauggaguuucgc

SEQ ID NO: 87144 - RNA, 26 nt, Human
gcccuaauccaucuucauagcccaaa

SEQ ID NO: 87145 - RNA, 26 nt, Human
ggcuuccagggcuccaacuugcagac

SEQ ID NO: 87146 - RNA, 21 nt, Human
gccggcuuugcccauccugcu

SEQ ID NO: 87147 - RNA, 22 nt, Human
uuagguccgcacuccucagccu

SEQ ID NO: 87148 - RNA, 26 nt, Human
ugggauggugcccagggguugccuug

SEQ ID NO: 87149 - RNA, 27 nt, Human
gugcuguuugggggcucaggagccauc

SEQ ID NO: 87150 - RNA, 24 nt, Human
ucuguccuugucaaaaggcaggug

SEQ ID NO: 87151 - RNA, 23 nt, Human
uuuuuuagaggucagacuuccua

SEQ ID NO: 87152 - RNA, 26 nt, Human
cccugugccggacuccagccggggcg

SEQ ID NO: 87153 - RNA, 22 nt, Human
gccucuaaucccaggacuuugg

SEQ ID NO: 87154 - RNA, 26 nt, Human
agugcugguaguaucaccuuuugcca

SEQ ID NO: 87155 - RNA, 22 nt, Human
gucauuucugccugacugcucc

SEQ ID NO: 87156 - RNA, 25 nt, Human
uauuaaaaugcauugaguuuuugua

SEQ ID NO: 87157 - RNA, 21 nt, Human
ccacaggaggcugaagcgggu

SEQ ID NO: 87158 - RNA, 22 nt, Human
ccacugcauuugcagccuugag

SEQ ID NO: 87159 - RNA, 23 nt, Human
gcccagcccuguucugggugcag

SEQ ID NO: 87160 - RNA, 24 nt, Human
ggauauuuccuguucacuugugca

SEQ ID NO: 87161 - RNA, 25 nt, Human
auugcccagucuucagcggagcagu

SEQ ID NO: 87162 - RNA, 23 nt, Human
ucucuuccuacccuccuuccaca

SEQ ID NO: 87163 - RNA, 21 nt, Human
guuucucucugucuucuaguc

SEQ ID NO: 87164 - RNA, 25 nt, Human
uauauuucuuccacuguuuuugaaa

SEQ ID NO: 87165 - RNA, 19 nt, Human
uuguuagcauuuucaaugu

SEQ ID NO: 87166 - RNA, 20 nt, Human
uuccacccuccugucuggcu

SEQ ID NO: 87167 - RNA, 23 nt, Human
agggaggaaaccuagcagaggaa

SEQ ID NO: 87168 - RNA, 27 nt, Human
caaaaucaguuuuuuaccucuuuccua

SEQ ID NO: 87169 - RNA, 22 nt, Human
auccagggguccucauuucucc

SEQ ID NO: 87170 - RNA, 19 nt, Human
aguaggacugcuggaggcu

SEQ ID NO: 87171 - RNA, 19 nt, Human
gccuuuuguucauuucauc

SEQ ID NO: 87172 - RNA, 23 nt, Human
aucaucugauagugucuuauuua

SEQ ID NO: 87173 - RNA, 21 nt, Human
gcucuucccuucuguccuccg

SEQ ID NO: 87174 - RNA, 27 nt, Human
agucuacuaguaccugguugcugccuc

SEQ ID NO: 87175 - RNA, 24 nt, Human
gcaucaauacuccuagggcucagg

SEQ ID NO: 87176 - RNA, 22 nt, Human
gguugaagaaaacaaaauagcu

SEQ ID NO: 87177 - RNA, 21 nt, Human
cagugccaggcuggaggcggc

SEQ ID NO: 87178 - RNA, 26 nt, Human
cauuugugagcaaaagcagaagugga

SEQ ID NO: 87179 - RNA, 22 nt, Human
ugcucaggcuggaguacagugg

SEQ ID NO: 87180 - RNA, 16 nt, Human
acgugugcaaaagccu

SEQ ID NO: 87181 - RNA, 26 nt, Human
cucugucccugguaaggagugacaag

SEQ ID NO: 87182 - RNA, 22 nt, Human
ugaaacuauggaaaugcugcua

SEQ ID NO: 87183 - RNA, 26 nt, Human
gugcagcucugguaccuccugcccac

SEQ ID NO: 87184 - RNA, 25 nt, Human
cccuucccaaaucugcuccagcagg

SEQ ID NO: 87185 - RNA, 23 nt, Human
gccagcaccaucucuuuaccucc

SEQ ID NO: 87186 - RNA, 21 nt, Human
cgcccaaacuggagugcagug

SEQ ID NO: 87187 - RNA, 30 nt, Human
ugcuuuuguaucuugucauaguuauccaca

SEQ ID NO: 87188 - RNA, 26 nt, Human
cuuuauuccuccacaggaacccagca

SEQ ID NO: 87189 - RNA, 22 nt, Human
cccuucagucccuccagugugu

SEQ ID NO: 87190 - RNA, 26 nt, Human
agccuacuuccccuuccccggggcug

SEQ ID NO: 87191 - RNA, 20 nt, Human
ugaacaaugcguaaaaggug

SEQ ID NO: 87192 - RNA, 21 nt, Human
guuuuuaaauggaauuuucua

SEQ ID NO: 87193 - RNA, 19 nt, Human
gugacagagcaaggcucug

SEQ ID NO: 87194 - RNA, 21 nt, Human
gguggggaguggaaauucagc

SEQ ID NO: 87195 - RNA, 21 nt, Human
gugagcugccauuccacaccc

SEQ ID NO: 87196 - RNA, 23 nt, Human
ggaagaggagagcaugaagcaaa

SEQ ID NO: 87197 - RNA, 26 nt, Human
cacucaccacagaaaaccauucuuua

SEQ ID NO: 87198 - RNA, 19 nt, Human
caggcuggggcagugggca

SEQ ID NO: 87199 - RNA, 27 nt, Human
aagacucccagaucagcuaccaggcag

SEQ ID NO: 87200 - RNA, 22 nt, Human
agagaauaguauuccaaucaug

SEQ ID NO: 87201 - RNA, 21 nt, Human
ugaggcugaaagcugugucgu

SEQ ID NO: 87202 - RNA, 24 nt, Human
agcguggccguucgggaggcggaa

SEQ ID NO: 87203 - RNA, 21 nt, Human
caauguagacaacauuauauu

SEQ ID NO: 87204 - RNA, 29 nt, Human
accucuugagcuccuggaaauaguagaau

SEQ ID NO: 87205 - RNA, 23 nt, Human
uccguuauuuuaggaggucccug

SEQ ID NO: 87206 - RNA, 25 nt, Human
ccaagcagggguugcagggcaguag

SEQ ID NO: 87207 - RNA, 21 nt, Human
cuccagccugaagucuucggc

SEQ ID NO: 87208 - RNA, 20 nt, Human
cuucucccuagugcugguau

SEQ ID NO: 87209 - RNA, 22 nt, Human
guuacccacguugggauccagu

SEQ ID NO: 87210 - RNA, 24 nt, Human
cccagcccugggaaccacucccac

SEQ ID NO: 87211 - RNA, 30 nt, Human
caaaauaaucuauauuaaaugaggguuucu

SEQ ID NO: 87212 - RNA, 23 nt, Human
ccuagaggcagagguugaagaug

SEQ ID NO: 87213 - RNA, 23 nt, Human
uugcucuuagguucuaucucugu

SEQ ID NO: 87214 - RNA, 17 nt, Human
cucuaaccucuccagcu

SEQ ID NO: 87215 - RNA, 21 nt, Human
cacccaggcugcagugccaug

SEQ ID NO: 87216 - RNA, 24 nt, Human
guugugccuucuucuuaagaauaa

SEQ ID NO: 87217 - RNA, 21 nt, Human
aagcuuagauuguagcuguuc

SEQ ID NO: 87218 - RNA, 21 nt, Human
auggaaagguaaauggucaga

SEQ ID NO: 87219 - RNA, 23 nt, Human
uuugguuccugggagaauaggca

SEQ ID NO: 87220 - RNA, 27 nt, Human
gcaaaacugguaacgucugcuucggag

SEQ ID NO: 87221 - RNA, 23 nt, Human
ccccacccaccucuaucccagug

SEQ ID NO: 87222 - RNA, 20 nt, Human
cgaggguuggguucaucuga

SEQ ID NO: 87223 - RNA, 26 nt, Human
ucucaguuuacagccauuucuuaggu

SEQ ID NO: 87224 - RNA, 27 nt, Human
gcacagccaguuaaaagaugcagccuc

SEQ ID NO: 87225 - RNA, 23 nt, Human
ccccaucaggaggacauggcucu

SEQ ID NO: 87226 - RNA, 27 nt, Human
ugcuuggaaacuguuguuuuccugaac

SEQ ID NO: 87227 - RNA, 22 nt, Human
uccaagcuuuccugcucagugu

SEQ ID NO: 87228 - RNA, 22 nt, Human
ggggugacuggguagaggccag

SEQ ID NO: 87229 - RNA, 21 nt, Human
agaucugaaggucucaccucc

SEQ ID NO: 87230 - RNA, 19 nt, Human
aggaggugguugugcagga

SEQ ID NO: 87231 - RNA, 19 nt, Human
gugucuuggagugcauuug

SEQ ID NO: 87232 - RNA, 21 nt, Human
auuuuauuuuuucagucuuac

SEQ ID NO: 87233 - RNA, 21 nt, Human
aaaauguuacccuuuacaggg

SEQ ID NO: 87234 - RNA, 26 nt, Human
uuccaaaaucagagucagacuacucc

SEQ ID NO: 87235 - RNA, 23 nt, Human
ggcuggguucugggccuguaucg

SEQ ID NO: 87236 - RNA, 27 nt, Human
uuccuugguuuauuacagccagugggg

SEQ ID NO: 87237 - RNA, 22 nt, Human
ccccagcaucaaaaaaccaaug

SEQ ID NO: 87238 - RNA, 26 nt, Human
ccucuagccucugcuggagugcagug

SEQ ID NO: 87239 - RNA, 22 nt, Human
cugcccccucaguuuuccacuu

SEQ ID NO: 87240 - RNA, 21 nt, Human
accagaaggagcugaguuugg

SEQ ID NO: 87241 - RNA, 21 nt, Human
uguaauaaacaccagauucca

SEQ ID NO: 87242 - RNA, 22 nt, Human
uucauucuaguuuauauuuuca

SEQ ID NO: 87243 - RNA, 22 nt, Human
acauacuuuuuuccaaaagccu

SEQ ID NO: 87244 - RNA, 25 nt, Human
ucgcccacccgaguaccuccaguca

SEQ ID NO: 87245 - RNA, 22 nt, Human
uugucucuugccugccacugug

SEQ ID NO: 87246 - RNA, 21 nt, Human
ccuuccugccuuuuagcucua

SEQ ID NO: 87247 - RNA, 22 nt, Human
uuuuaacaaaaaaggaaaauga

SEQ ID NO: 87248 - RNA, 22 nt, Human
augcaagggccuuccucucuua

SEQ ID NO: 87249 - RNA, 23 nt, Human
ugcuggaggugaggucaggugcc

SEQ ID NO: 87250 - RNA, 22 nt, Human
ugagggaagggggauuccuuuu

SEQ ID NO: 87251 - RNA, 22 nt, Human
caccaaacagaccaucuuccca

SEQ ID NO: 87252 - RNA, 23 nt, Human
gcuuuuuagcuguuucagucacc

SEQ ID NO: 87253 - RNA, 23 nt, Human
gaaaacuauggacugugcugcug

SEQ ID NO: 87254 - RNA, 22 nt, Human
uacauuccugagauucugggaa

SEQ ID NO: 87255 - RNA, 25 nt, Human
gaccucaggugauccgcccaccuca

SEQ ID NO: 87256 - RNA, 17 nt, Human
cuccugcacuggccuug

SEQ ID NO: 87257 - RNA, 28 nt, Human
gugaauccucuucuuuauacuguaauuu

SEQ ID NO: 87258 - RNA, 23 nt, Human
agccccaucuccuagcggcagcc

SEQ ID NO: 87259 - RNA, 19 nt, Human
uuaguaaagccucugagac

SEQ ID NO: 87260 - RNA, 27 nt, Human
aucucauggcauauuaaaagaaaaauc

SEQ ID NO: 87261 - RNA, 20 nt, Human
uuucuucccuacccuugcca

SEQ ID NO: 87262 - RNA, 21 nt, Human
uggaguguccguuauccugcc

SEQ ID NO: 87263 - RNA, 26 nt, Human
ccuggcccaacucggcccuucgagcu

SEQ ID NO: 87264 - RNA, 20 nt, Human
gaguuucucucaaaaggucc

SEQ ID NO: 87265 - RNA, 21 nt, Human
ugaaguagcuaauauuacagc

SEQ ID NO: 87266 - RNA, 22 nt, Human
guuuccugaauaccaguggagg

SEQ ID NO: 87267 - RNA, 30 nt, Human
gucccgggcuggcgggagugcaguucugag

SEQ ID NO: 87268 - RNA, 21 nt, Human
caaauguuaaauuauccagaa

SEQ ID NO: 87269 - RNA, 24 nt, Human
cuuccuggguauaugacucggcac

SEQ ID NO: 87270 - RNA, 20 nt, Human
ccguccuccucgcugugcca

SEQ ID NO: 87271 - RNA, 24 nt, Human
uucuuucccccucuccugguuucc

SEQ ID NO: 87272 - RNA, 20 nt, Human
acucugagaucagagcuggg

SEQ ID NO: 87273 - RNA, 27 nt, Human
uucagaagaagacaaagagagauugaa

SEQ ID NO: 87274 - RNA, 22 nt, Human
gucaccgaggcuggagugcagu

SEQ ID NO: 87275 - RNA, 16 nt, Human
auguccacuugcugga

SEQ ID NO: 87276 - RNA, 18 nt, Human
agccgaauccacucucau

SEQ ID NO: 87277 - RNA, 21 nt, Human
cagugccuaauccugcuuugu

SEQ ID NO: 87278 - RNA, 21 nt, Human
gggagggaaggggauggaggc

SEQ ID NO: 87279 - RNA, 22 nt, Human
gaccagccugggcaacacagcg

SEQ ID NO: 87280 - RNA, 21 nt, Human
ucgccauccccuuccugcugc

SEQ ID NO: 87281 - RNA, 23 nt, Human
aaccuauauagcggguucucccc

SEQ ID NO: 87282 - RNA, 27 nt, Human
ccgggaggcagagguugcagccggcug

SEQ ID NO: 87283 - RNA, 21 nt, Human
ugcuucuuaguaacugaacug

SEQ ID NO: 87284 - RNA, 19 nt, Human
ucgucaacuuucuuagcuc

SEQ ID NO: 87285 - RNA, 21 nt, Human
ucgguucuucccccuccuccc

SEQ ID NO: 87286 - RNA, 21 nt, Human
uaucuucuuugccugccugua

SEQ ID NO: 87287 - RNA, 22 nt, Human
accuccaggcaggccaggcugc

SEQ ID NO: 87288 - RNA, 26 nt, Human
ucaccgccacuacugcagcucagugc

SEQ ID NO: 87289 - RNA, 23 nt, Human
ugaagagacaaugcuacuucagu

SEQ ID NO: 87290 - RNA, 24 nt, Human
cucuggagaaaaauaaaauggaaa

SEQ ID NO: 87291 - RNA, 24 nt, Human
cagccucguguacccaucuuccca

SEQ ID NO: 87292 - RNA, 23 nt, Human
uugauguaaaauacucugucauu

SEQ ID NO: 87293 - RNA, 21 nt, Human
ccccagccucuucuagagccg

SEQ ID NO: 87294 - RNA, 24 nt, Human
cuguugagagaaccucagguacgg

SEQ ID NO: 87295 - RNA, 25 nt, Human
ugcagcuccgggaaacaagugaauu

SEQ ID NO: 87296 - RNA, 26 nt, Human
gauccuucccaagguacagcuguaua

SEQ ID NO: 87297 - RNA, 21 nt, Human
cagaaaaacacaaaaagguga

SEQ ID NO: 87298 - RNA, 23 nt, Human
cuuucucuuggaggugggucgca

SEQ ID NO: 87299 - RNA, 20 nt, Human
caauguuuuaaacauucuuc

SEQ ID NO: 87300 - RNA, 26 nt, Human
ccugaauccugucccugccaucucgc

SEQ ID NO: 87301 - RNA, 23 nt, Human
augaaugcagauugcgaaggucc

SEQ ID NO: 87302 - RNA, 22 nt, Human
gccuuucuccuccaacccaacc

SEQ ID NO: 87303 - RNA, 19 nt, Human
acugaaagagucauuguuu

SEQ ID NO: 87304 - RNA, 26 nt, Human
uaaaucugcauguccucugugugacu

SEQ ID NO: 87305 - RNA, 21 nt, Human
ucccaccaacugagcugugug

SEQ ID NO: 87306 - RNA, 20 nt, Human
acacuuuucaaaauaugugg

SEQ ID NO: 87307 - RNA, 20 nt, Human
cuggaguuuaaguacaguga

SEQ ID NO: 87308 - RNA, 19 nt, Human
cuguacuuacuaaguguca

SEQ ID NO: 87309 - RNA, 26 nt, Human
agggcugcggggaggccaggccgagc

SEQ ID NO: 87310 - RNA, 23 nt, Human
ggcuggagaaagggaaguggaag

SEQ ID NO: 87311 - RNA, 23 nt, Human
aauuagacauuccugggcacagg

SEQ ID NO: 87312 - RNA, 22 nt, Human
ggcugcugccuuccuguccucu

SEQ ID NO: 87313 - RNA, 26 nt, Human
uugacaccauuuuccugccucagccu

SEQ ID NO: 87314 - RNA, 20 nt, Human
cgugaucuucccugcagccu

SEQ ID NO: 87315 - RNA, 24 nt, Human
gcuugcgggggccgccuguccuca

SEQ ID NO: 87316 - RNA, 21 nt, Human
aacaacgagauaccaucucac

SEQ ID NO: 87317 - RNA, 27 nt, Human
uccucacccucauccuuugggaggcug

SEQ ID NO: 87318 - RNA, 21 nt, Human
ggaugugaauggcaugcugaa

SEQ ID NO: 87319 - RNA, 23 nt, Human
ggaugucuuugcauaucucucuc

SEQ ID NO: 87320 - RNA, 21 nt, Human
aggagugccuagugaggccuc

SEQ ID NO: 87321 - RNA, 22 nt, Human
cucauuucggcuaccauuugcu

SEQ ID NO: 87322 - RNA, 19 nt, Human
gaaagagaaaucacugaca

SEQ ID NO: 87323 - RNA, 19 nt, Human
ucaugcaggagaccccagg

SEQ ID NO: 87324 - RNA, 24 nt, Human
acauggggcagaggagcuccaggc

SEQ ID NO: 87325 - RNA, 23 nt, Human
gccuucaguggagcuagaccugc

SEQ ID NO: 87326 - RNA, 20 nt, Human
ucuuuuucuuuucaucuggc

SEQ ID NO: 87327 - RNA, 26 nt, Human
gaggcucccagacccagggcagugug

SEQ ID NO: 87328 - RNA, 22 nt, Human
ggaggugggcaggauggagaac

SEQ ID NO: 87329 - RNA, 24 nt, Human
guaaaguuuucaauacaaauucuu

SEQ ID NO: 87330 - RNA, 21 nt, Human
cuguccaucugggccuuugua

SEQ ID NO: 87331 - RNA, 22 nt, Human
augggcacaauuauagcucacu

SEQ ID NO: 87332 - RNA, 23 nt, Human
caggucgagcccagcccagcugg

SEQ ID NO: 87333 - RNA, 21 nt, Human
gaugaaugucggaaaagggug

SEQ ID NO: 87334 - RNA, 18 nt, Human
cccaugccaccccaccau

SEQ ID NO: 87335 - RNA, 20 nt, Human
caacauuugugucacuguac

SEQ ID NO: 87336 - RNA, 23 nt, Human
uggagagaguugcuauuccaguc

SEQ ID NO: 87337 - RNA, 23 nt, Human
gggcucagccuggcaggcuuugu

SEQ ID NO: 87338 - RNA, 19 nt, Human
gagccuucgaacuaaaggg

SEQ ID NO: 87339 - RNA, 25 nt, Human
ccauuuaucuuuuguauaucuaaga

SEQ ID NO: 87340 - RNA, 27 nt, Human
ggccacguugaggaaggcgaagggcau

SEQ ID NO: 87341 - RNA, 26 nt, Human
aggugaaggaauauauggcagaguug

SEQ ID NO: 87342 - RNA, 26 nt, Human
aacacaauaugggcucaggucacuuu

SEQ ID NO: 87343 - RNA, 23 nt, Human
auacauauaugagguacaguuuu

SEQ ID NO: 87344 - RNA, 20 nt, Human
ggcccagggccagagcccag

SEQ ID NO: 87345 - RNA, 27 nt, Human
acaucaggauaguuuacugaagcacaa

SEQ ID NO: 87346 - RNA, 26 nt, Human
ggcuguaaauccuaauuaaaaauaga

SEQ ID NO: 87347 - RNA, 21 nt, Human
ccacagcagcuccauccacug

SEQ ID NO: 87348 - RNA, 22 nt, Human
ccugccccugccccaaguccug

SEQ ID NO: 87349 - RNA, 23 nt, Human
cuaagcacagcuuguccugggug

SEQ ID NO: 87350 - RNA, 24 nt, Human
cuggggguuuuggagugaucacga

SEQ ID NO: 87351 - RNA, 22 nt, Human
gccuguaaucccagcacuaugg

SEQ ID NO: 87352 - RNA, 22 nt, Human
gcauguaaucccagcacucugg

SEQ ID NO: 87353 - RNA, 27 nt, Human
ccccagcccuguggaagggacuaggag

SEQ ID NO: 87354 - RNA, 27 nt, Human
uagaaaugcugguuuuucaguuuucag

SEQ ID NO: 87355 - RNA, 23 nt, Human
uugggaagagaaaguuaucaaga

SEQ ID NO: 87356 - RNA, 20 nt, Human
ggguccucgcucaggcacag

SEQ ID NO: 87357 - RNA, 22 nt, Human
uccacgcccuugcagugggaga

SEQ ID NO: 87358 - RNA, 29 nt, Human
augccugcgccugcugccugcugagauga

SEQ ID NO: 87359 - RNA, 24 nt, Human
acugcccccgguugccugccuggg

SEQ ID NO: 87360 - RNA, 20 nt, Human
gcaccugccaacacgcccgg

SEQ ID NO: 87361 - RNA, 23 nt, Human
guugcccaaccuggagugcagug

SEQ ID NO: 87362 - RNA, 24 nt, Human
gacacaaugguagcucugaaggga

SEQ ID NO: 87363 - RNA, 21 nt, Human
uccaacaacaaccagcuccaa

SEQ ID NO: 87364 - RNA, 31 nt, Human
agagcugagacagccacccaggggguccacu

SEQ ID NO: 87365 - RNA, 19 nt, Human
gaccacccuucucauucca

SEQ ID NO: 87366 - RNA, 27 nt, Human
gcuuaauuaaccuaguauacuggguga

SEQ ID NO: 87367 - RNA, 21 nt, Human
cgggaggcagaaguugcagug

SEQ ID NO: 87368 - RNA, 23 nt, Human
cacugcuacagccuagaagguga

SEQ ID NO: 87369 - RNA, 20 nt, Human
auccuaaggugcuuaccuca

SEQ ID NO: 87370 - RNA, 21 nt, Human
uuuuuuaaagggaacuuucua

SEQ ID NO: 87371 - RNA, 22 nt, Human
uagaagcuguagagauaggcuu

SEQ ID NO: 87372 - RNA, 27 nt, Human
guguccuugcggugcugggcagcagac

SEQ ID NO: 87373 - RNA, 23 nt, Human
acccagcacuccagacucgaggg

SEQ ID NO: 87374 - RNA, 21 nt, Human
ucaguuccugccuuuucucau

SEQ ID NO: 87375 - RNA, 23 nt, Human
agcauucacauucucaggauaaa

SEQ ID NO: 87376 - RNA, 26 nt, Human
ggucuguccucacaugugcacuggua

SEQ ID NO: 87377 - RNA, 23 nt, Human
cucccgcagcccuccucccuccc

SEQ ID NO: 87378 - RNA, 22 nt, Human
uuuuguaauuccucuagcuacc

SEQ ID NO: 87379 - RNA, 22 nt, Human
accuguaauuccagcacuuugg

SEQ ID NO: 87380 - RNA, 22 nt, Human
aucuguaaucccagcacuuugg

SEQ ID NO: 87381 - RNA, 22 nt, Human
aggcugagguaggagaaucauu

SEQ ID NO: 87382 - RNA, 27 nt, Human
ccccacccuccaggguugggggagcag

SEQ ID NO: 87383 - RNA, 17 nt, Human
gcacagcccagggccug

SEQ ID NO: 87384 - RNA, 19 nt, Human
gcugggagguuaaaaagaa

SEQ ID NO: 87385 - RNA, 23 nt, Human
aguaacccugggaggcauaggag

SEQ ID NO: 87386 - RNA, 20 nt, Human
uugcaauucucuguauucua

SEQ ID NO: 87387 - RNA, 21 nt, Human
ccuccuggcaggagccugcuu

SEQ ID NO: 87388 - RNA, 29 nt, Human
ugaaacauuccaggaagguuacuucuugu

SEQ ID NO: 87389 - RNA, 22 nt, Human
ggcugccaggcuggaguggagu

SEQ ID NO: 87390 - RNA, 23 nt, Human
ucuauauugugaaucauccugcc

SEQ ID NO: 87391 - RNA, 22 nt, Human
ccuccagcauuuaaaaggacug

SEQ ID NO: 87392 - RNA, 20 nt, Human
ugugguacuggcaauaagau

SEQ ID NO: 87393 - RNA, 20 nt, Human
uaucauuauagcauguaaua

SEQ ID NO: 87394 - RNA, 21 nt, Human
aagaauauauuucacugugcc

SEQ ID NO: 87395 - RNA, 22 nt, Human
ccagaacaacaguuggcaggac

SEQ ID NO: 87396 - RNA, 24 nt, Human
ugcuucuuccccucugcggcuuuc

SEQ ID NO: 87397 - RNA, 23 nt, Human
uuuugcagagcucugcuaucacu

SEQ ID NO: 87398 - RNA, 22 nt, Human
auugcaggccucugccugcugc

SEQ ID NO: 87399 - RNA, 27 nt, Human
ccagcacugcgagcuucugccuucccu

SEQ ID NO: 87400 - RNA, 27 nt, Human
cacugcacuccagccugggagacagag

SEQ ID NO: 87401 - RNA, 22 nt, Human
caggcuggaaugcaguggugug

SEQ ID NO: 87402 - RNA, 20 nt, Human
ccaggccugguuuucacagg

SEQ ID NO: 87403 - RNA, 22 nt, Human
caaugccauuauuuuguuccau

SEQ ID NO: 87404 - RNA, 20 nt, Human
acugguauaacaugccuuca

SEQ ID NO: 87405 - RNA, 23 nt, Human
gagccagcacuaucuguacucca

SEQ ID NO: 87406 - RNA, 21 nt, Human
gcauacaacuguccacuagga

SEQ ID NO: 87407 - RNA, 23 nt, Human
acuaggucaauaaccugagggaa

SEQ ID NO: 87408 - RNA, 20 nt, Human
cuccuccauuuuccucccgc

SEQ ID NO: 87409 - RNA, 22 nt, Human
agcugauugcagaaaggagaga

SEQ ID NO: 87410 - RNA, 14 nt, Human
caugacacucugaa

SEQ ID NO: 87411 - RNA, 19 nt, Human
aggaaggacaucugggagg

SEQ ID NO: 87412 - RNA, 22 nt, Human
uacaguuucuuugacuccuggc

SEQ ID NO: 87413 - RNA, 21 nt, Human
agggccugcacgaacccuaca

SEQ ID NO: 87414 - RNA, 27 nt, Human
cuucaucuugacauguaaugaaugguc

SEQ ID NO: 87415 - RNA, 20 nt, Human
cugguaaaugaaaauauuac

SEQ ID NO: 87416 - RNA, 26 nt, Human
ucuuucuuaaaacaauaaauuccgcu

SEQ ID NO: 87417 - RNA, 25 nt, Human
cuuugcagggcuuuggcuguuaccu

SEQ ID NO: 87418 - RNA, 25 nt, Human
cucaccuccccacucuucacagcaa

SEQ ID NO: 87419 - RNA, 23 nt, Human
uuucaguugaaggaagaaauagc

SEQ ID NO: 87420 - RNA, 20 nt, Human
agacuuuuuugaaguaucuu

SEQ ID NO: 87421 - RNA, 24 nt, Human
ugucauguguccuugucccuaggc

SEQ ID NO: 87422 - RNA, 24 nt, Human
aggccugggggcugggcagaggaa

SEQ ID NO: 87423 - RNA, 22 nt, Human
ccugccagaggaaacugagcug

SEQ ID NO: 87424 - RNA, 27 nt, Human
ucacagucuaaggcuggaaguuuaaug

SEQ ID NO: 87425 - RNA, 27 nt, Human
gaggaagagauagccauggaggacagc

SEQ ID NO: 87426 - RNA, 28 nt, Human
ucauugccucgucacaucaaugcaaaag

SEQ ID NO: 87427 - RNA, 24 nt, Human
aaaaacugaguauuaauaucugag

SEQ ID NO: 87428 - RNA, 20 nt, Human
uguccuguacccucuaccuc

SEQ ID NO: 87429 - RNA, 22 nt, Human
cgcaaccucgggcgccggggca

SEQ ID NO: 87430 - RNA, 23 nt, Human
ccuagucacagcuccaaccuaca

SEQ ID NO: 87431 - RNA, 27 nt, Human
cucugacagcugugagugugugugagc

SEQ ID NO: 87432 - RNA, 23 nt, Human
acagguucugggcucucaacuga

SEQ ID NO: 87433 - RNA, 22 nt, Human
gcucacgccuguaaucccagcu

SEQ ID NO: 87434 - RNA, 29 nt, Human
ccuccaaacacugggcucugaggagugga

SEQ ID NO: 87435 - RNA, 21 nt, Human
aagcuucguuccagagcccag

SEQ ID NO: 87436 - RNA, 24 nt, Human
acuauguacugcguuuuucauucu

SEQ ID NO: 87437 - RNA, 24 nt, Human
auuuuucuggaagacacugacuga

SEQ ID NO: 87438 - RNA, 21 nt, Human
cugcuccccccucagcaucuc

SEQ ID NO: 87439 - RNA, 21 nt, Human
acucugcagcaguggcagcag

SEQ ID NO: 87440 - RNA, 21 nt, Human
aacccuguuucugucuguuuu

SEQ ID NO: 87441 - RNA, 27 nt, Human
agggaaaggucagcccguuucagaagg

SEQ ID NO: 87442 - RNA, 24 nt, Human
auguaucuuauaaucuuuucuccc

SEQ ID NO: 87443 - RNA, 23 nt, Human
ucaggucaagagacaacugccuu

SEQ ID NO: 87444 - RNA, 29 nt, Human
ccugcacgcccuguucccuccaccuagac

SEQ ID NO: 87445 - RNA, 21 nt, Human
ucccaaggagccagaguccuc

SEQ ID NO: 87446 - RNA, 21 nt, Human
ccuccucuuuggaccuagcca

SEQ ID NO: 87447 - RNA, 25 nt, Human
ggcuucaugccagcuacuuccuccu

SEQ ID NO: 87448 - RNA, 22 nt, Human
gauggucuuacgccacagggug

SEQ ID NO: 87449 - RNA, 22 nt, Human
ggaggcgcuggagcugaaggaa

SEQ ID NO: 87450 - RNA, 23 nt, Human
ccacagccagaaccccgagcccu

SEQ ID NO: 87451 - RNA, 21 nt, Human
auauaugggaggaaaggccac

SEQ ID NO: 87452 - RNA, 27 nt, Human
ucacccuuguugcccaggcuggagugc

SEQ ID NO: 87453 - RNA, 27 nt, Human
gauuacaucaagcuaauugugcgagcu

SEQ ID NO: 87454 - RNA, 26 nt, Human
ucugccgcccaaacuggagugcagug

SEQ ID NO: 87455 - RNA, 29 nt, Human
gucaugcccagcuuggagugccacguggc

SEQ ID NO: 87456 - RNA, 22 nt, Human
aacucacuguaaccuccgccuc

SEQ ID NO: 87457 - RNA, 19 nt, Human
aaaagagauuucuuucccu

SEQ ID NO: 87458 - RNA, 20 nt, Human
agcuaugucucuacuccagg

SEQ ID NO: 87459 - RNA, 22 nt, Human
gcucucaggaacucugcuuccu

SEQ ID NO: 87460 - RNA, 27 nt, Human
ggucucgaacuccuggacuuaagugag

SEQ ID NO: 87461 - RNA, 22 nt, Human
agccucccaaguagcugggauu

SEQ ID NO: 87462 - RNA, 22 nt, Human
agcuucccaagcagcugggauu

SEQ ID NO: 87463 - RNA, 24 nt, Human
uagccuuuaacacuaugcaacuuu

SEQ ID NO: 87464 - RNA, 22 nt, Human
aacccuguaggauuuuacuucu

SEQ ID NO: 87465 - RNA, 23 nt, Human
ccauguuuacagauaccgcuaau

SEQ ID NO: 87466 - RNA, 21 nt, Human
uccucaaggaguuuggaacaa

SEQ ID NO: 87467 - RNA, 22 nt, Human
gacccugcaagguccuccaggc

SEQ ID NO: 87468 - RNA, 21 nt, Human
acaagcuguaucacugccuuc

SEQ ID NO: 87469 - RNA, 21 nt, Human
acacagccgaggcgggcucgg

SEQ ID NO: 87470 - RNA, 18 nt, Human
uuuauccuggagugcaga

SEQ ID NO: 87471 - RNA, 22 nt, Human
gaacagcuucccucacugugua

SEQ ID NO: 87472 - RNA, 22 nt, Human
cacugcuggggagucccugcca

SEQ ID NO: 87473 - RNA, 23 nt, Human
uaauuggcaccguugcuuucuaa

SEQ ID NO: 87474 - RNA, 22 nt, Human
cccacagauaccacugcugcuc

SEQ ID NO: 87475 - RNA, 21 nt, Human
uugcacacaccuucuucuaca

SEQ ID NO: 87476 - RNA, 23 nt, Human
accccuucucuaacacuagcuuc

SEQ ID NO: 87477 - RNA, 23 nt, Human
auguauccuuucacacauuugcc

SEQ ID NO: 87478 - RNA, 22 nt, Human
ggcucuggcuaaauucaugcug

SEQ ID NO: 87479 - RNA, 26 nt, Human
ugagaucacugacucugacucauccc

SEQ ID NO: 87480 - RNA, 23 nt, Human
aaauacaacagaaaauugcacag

SEQ ID NO: 87481 - RNA, 23 nt, Human
caucugucccugcagccauagcc

SEQ ID NO: 87482 - RNA, 21 nt, Human
cuccccuccgcuccccacgcc

SEQ ID NO: 87483 - RNA, 22 nt, Human
ucauugacuaauacaucaucuc

SEQ ID NO: 87484 - RNA, 25 nt, Human
gagguugagaaugcagugagcuugu

SEQ ID NO: 87485 - RNA, 22 nt, Human
caagcuguacauuuggugcacu

SEQ ID NO: 87486 - RNA, 22 nt, Human
uggagguggagccugcggcugg

SEQ ID NO: 87487 - RNA, 23 nt, Human
uuccgcccaggcugcagugcagu

SEQ ID NO: 87488 - RNA, 20 nt, Human
ucuccaauguccaaaaggcu

SEQ ID NO: 87489 - RNA, 25 nt, Human
acuuuaauuacaacugaaaaaucag

SEQ ID NO: 87490 - RNA, 23 nt, Human
cugucuccuggaaauguuaugca

SEQ ID NO: 87491 - RNA, 23 nt, Human
auggaaagaugaaaauggaaagg

SEQ ID NO: 87492 - RNA, 23 nt, Human
agcagcucuccuuccccugccuu

SEQ ID NO: 87493 - RNA, 26 nt, Human
guaaagccucucugacaucaaauggg

SEQ ID NO: 87494 - RNA, 22 nt, Human
cucagccucccaaguagcucgg

SEQ ID NO: 87495 - RNA, 22 nt, Human
aggccgaggcaggcagaucacc

SEQ ID NO: 87496 - RNA, 27 nt, Human
auggaaauguuugggaccauacaggcu

SEQ ID NO: 87497 - RNA, 21 nt, Human
guccucagucgccagcacuua

SEQ ID NO: 87498 - RNA, 21 nt, Human
caggaaggaugugggacucug

SEQ ID NO: 87499 - RNA, 22 nt, Human
gacucaauccuuuucuggacca

SEQ ID NO: 87500 - RNA, 24 nt, Human
uuucauucaaggccaaaguccuga

SEQ ID NO: 87501 - RNA, 23 nt, Human
gcacuauuuauuuacaaauguuu

SEQ ID NO: 87502 - RNA, 27 nt, Human
gggaggucaaggcugcagugaaccaug

SEQ ID NO: 87503 - RNA, 19 nt, Human
gcuggcccugccuccuggg

SEQ ID NO: 87504 - RNA, 27 nt, Human
gcccuacucccugcagaugccacccua

SEQ ID NO: 87505 - RNA, 21 nt, Human
aggaagagucugggaggcagg

SEQ ID NO: 87506 - RNA, 20 nt, Human
caagcagaugucacauggag

SEQ ID NO: 87507 - RNA, 21 nt, Human
cgggaggcggagauugcggug

SEQ ID NO: 87508 - RNA, 21 nt, Human
caggaggcggagauugcagug

SEQ ID NO: 87509 - RNA, 23 nt, Human
ugcagccgccuuccuugaccuuc

SEQ ID NO: 87510 - RNA, 21 nt, Human
ugucaucuucacugccaauca

SEQ ID NO: 87511 - RNA, 24 nt, Human
uccaaccaaaagaaauggauguuu

SEQ ID NO: 87512 - RNA, 25 nt, Human
uaggaguuuuauguuuaccauguga

SEQ ID NO: 87513 - RNA, 27 nt, Human
cucauagaaugccuuuaaugcuaaucc

SEQ ID NO: 87514 - RNA, 23 nt, Human
uuccaauaauguuuuauacauca

SEQ ID NO: 87515 - RNA, 22 nt, Human
accuuucucccccaacaggauc

SEQ ID NO: 87516 - RNA, 16 nt, Human
cauuuuaaaagcaauu

SEQ ID NO: 87517 - RNA, 27 nt, Human
auggauggggacauggaaaugagaaua

SEQ ID NO: 87518 - RNA, 21 nt, Human
cuccuagcuggagugccaugg

SEQ ID NO: 87519 - RNA, 21 nt, Human
uccagccugggcaacagaggg

SEQ ID NO: 87520 - RNA, 22 nt, Human
aagcaggaacuccuacuuuuuc

SEQ ID NO: 87521 - RNA, 23 nt, Human
uacuuuuaacacuuuagugccug

SEQ ID NO: 87522 - RNA, 24 nt, Human
ucugacccacugcuuuuggucugu

SEQ ID NO: 87523 - RNA, 23 nt, Human
gcaggauugagggagccagggga

SEQ ID NO: 87524 - RNA, 22 nt, Human
agcccccuaugggcucaguggg

SEQ ID NO: 87525 - RNA, 21 nt, Human
uaggggaugagguugcuguga

SEQ ID NO: 87526 - RNA, 22 nt, Human
guaccagcgaguccacagccuu

SEQ ID NO: 87527 - RNA, 21 nt, Human
cccagguaucucucagaucug

SEQ ID NO: 87528 - RNA, 24 nt, Human
ccacuuccccuuuucccaguauua

SEQ ID NO: 87529 - RNA, 22 nt, Human
gauucagagaacagugugacca

SEQ ID NO: 87530 - RNA, 23 nt, Human
ucaacagcaaucgcccauuucca

SEQ ID NO: 87531 - RNA, 29 nt, Human
uuagcauucagaaugacaccauauucuua

SEQ ID NO: 87532 - RNA, 24 nt, Human
gcucaggcuggagugcagugaugc

SEQ ID NO: 87533 - RNA, 21 nt, Human
cucaaagcuuggaggaacggg

SEQ ID NO: 87534 - RNA, 25 nt, Human
aucagccugguggggcuacugcagu

SEQ ID NO: 87535 - RNA, 23 nt, Human
ugagaggagacacaaggagcagc

SEQ ID NO: 87536 - RNA, 22 nt, Human
ugccuguaaaacaugugauuug

SEQ ID NO: 87537 - RNA, 19 nt, Human
acaucucccuuccaccuca

SEQ ID NO: 87538 - RNA, 22 nt, Human
ucucagccuuuauggaccuaau

SEQ ID NO: 87539 - RNA, 26 nt, Human
cacagcccucccucggcacacuuuga

SEQ ID NO: 87540 - RNA, 23 nt, Human
gucaaucaugucgagucacugga

SEQ ID NO: 87541 - RNA, 22 nt, Human
ugcacccaggaggugacuggga

SEQ ID NO: 87542 - RNA, 28 nt, Human
gacuucacugcagccuuucacaggacuc

SEQ ID NO: 87543 - RNA, 22 nt, Human
uuuggcugauuuaaaaagugag

SEQ ID NO: 87544 - RNA, 22 nt, Human
ggauuuccccuagcaagcuacc

SEQ ID NO: 87545 - RNA, 23 nt, Human
cccaaguguccaucuccaucgga

SEQ ID NO: 87546 - RNA, 19 nt, Human
gcacagcccucccgccccu

SEQ ID NO: 87547 - RNA, 21 nt, Human
ucaucccuuaagcaagcaggg

SEQ ID NO: 87548 - RNA, 24 nt, Human
ggggaccuggcacugggaggcagg

SEQ ID NO: 87549 - RNA, 23 nt, Human
uguggagggcauuugcugcccca

SEQ ID NO: 87550 - RNA, 24 nt, Human
gugaagcugugggugcaguggcgc

SEQ ID NO: 87551 - RNA, 24 nt, Human
ucagcccaggaguuuaaggcugca

SEQ ID NO: 87552 - RNA, 21 nt, Human
cuggacacacacuuccagaca

SEQ ID NO: 87553 - RNA, 21 nt, Human
ggcuuggaguccagaguuggu

SEQ ID NO: 87554 - RNA, 25 nt, Human
ccgccaaucagcucagcauucuccc

SEQ ID NO: 87555 - RNA, 27 nt, Human
caggcagcagagcacucgcugcugugu

SEQ ID NO: 87556 - RNA, 23 nt, Human
ugaaaccacuggugucugcucag

SEQ ID NO: 87557 - RNA, 27 nt, Human
acacagccugggaccagggcauauuaa

SEQ ID NO: 87558 - RNA, 26 nt, Human
uucaucugcugacuucugucuaggcu

SEQ ID NO: 87559 - RNA, 22 nt, Human
ugguuacaaacuacagaccugc

SEQ ID NO: 87560 - RNA, 20 nt, Human
caucaucuccaggugcccca

SEQ ID NO: 87561 - RNA, 20 nt, Human
ccagcucaguauuuaaacau

SEQ ID NO: 87562 - RNA, 21 nt, Human
gaagaaaaagaaaauuaacag

SEQ ID NO: 87563 - RNA, 26 nt, Human
acugucaggcugggccugccuccuug

SEQ ID NO: 87564 - RNA, 22 nt, Human
aaggaagaauaaaguugaaauu

SEQ ID NO: 87565 - RNA, 20 nt, Human
caggaguugaauuuuccuca

SEQ ID NO: 87566 - RNA, 23 nt, Human
ugcugggugguugagugagugaa

SEQ ID NO: 87567 - RNA, 22 nt, Human
cacaggacccgcauccugggug

SEQ ID NO: 87568 - RNA, 24 nt, Human
cagggaggagaguaacugaagguc

SEQ ID NO: 87569 - RNA, 21 nt, Human
ucuaugcaguggccccuuagg

SEQ ID NO: 87570 - RNA, 21 nt, Human
ccucgcuccuccucccaccca

SEQ ID NO: 87571 - RNA, 27 nt, Human
ggcaaugcaggugaaguggcugccuuc

SEQ ID NO: 87572 - RNA, 22 nt, Human
guugacucgguguucuguccca

SEQ ID NO: 87573 - RNA, 22 nt, Human
cccagugugcugggauuacagg

SEQ ID NO: 87574 - RNA, 24 nt, Human
uuuccugagcugucgcugccucca

SEQ ID NO: 87575 - RNA, 24 nt, Human
ggugcucaggaagcugagguggga

SEQ ID NO: 87576 - RNA, 18 nt, Human
ugcauuccagccuaggcg

SEQ ID NO: 87577 - RNA, 22 nt, Human
acugcuugaccguacucucaca

SEQ ID NO: 87578 - RNA, 20 nt, Human
ccucacagcacuaguauuuc

SEQ ID NO: 87579 - RNA, 23 nt, Human
cuauguuccuguguugugugcau

SEQ ID NO: 87580 - RNA, 22 nt, Human
gaccccaggagacguagguugu

SEQ ID NO: 87581 - RNA, 23 nt, Human
cucacccaggcugagggugccuu

SEQ ID NO: 87582 - RNA, 24 nt, Human
gcuuaacacaacagaaacuuauuu

SEQ ID NO: 87583 - RNA, 21 nt, Human
ucugaugucugugcugcuguc

SEQ ID NO: 87584 - RNA, 20 nt, Human
aaaaccugcagaguaguuag

SEQ ID NO: 87585 - RNA, 20 nt, Human
gaagggagaccccgccuagc

SEQ ID NO: 87586 - RNA, 24 nt, Human
acauuaaaacaaagucucugacuu

SEQ ID NO: 87587 - RNA, 22 nt, Human
caucucaagacaauuugucaaa

SEQ ID NO: 87588 - RNA, 24 nt, Human
gaguugugccuuucuuuacucaca

SEQ ID NO: 87589 - RNA, 23 nt, Human
aagacagagacugcaggggucca

SEQ ID NO: 87590 - RNA, 22 nt, Human
caggcuggagugcagugacaug

SEQ ID NO: 87591 - RNA, 24 nt, Human
agaccagccuggccaaaauaguga

SEQ ID NO: 87592 - RNA, 19 nt, Human
cucuccuccccaucguccc

SEQ ID NO: 87593 - RNA, 22 nt, Human
cuggagggcuagaaccuggaga

SEQ ID NO: 87594 - RNA, 25 nt, Human
gguggguugagaccaggaagucagg

SEQ ID NO: 87595 - RNA, 21 nt, Human
accagccuggucaacauggug

SEQ ID NO: 87596 - RNA, 21 nt, Human
gggagcugcuccuaaggaagc

SEQ ID NO: 87597 - RNA, 22 nt, Human
cugcaguuucaaguuccugggc

SEQ ID NO: 87598 - RNA, 28 nt, Human
gagggaguugggacaggaggauugaugg

SEQ ID NO: 87599 - RNA, 24 nt, Human
cugcuuaggggaaggugauuggag

SEQ ID NO: 87600 - RNA, 23 nt, Human
ugaguagcugggaugacaggcgu

SEQ ID NO: 87601 - RNA, 13 nt, Human
ucagcacugugaa

SEQ ID NO: 87602 - RNA, 19 nt, Human
uugggggugggugggugga

SEQ ID NO: 87603 - RNA, 20 nt, Human
acagaaauuggaguuuuaaa

SEQ ID NO: 87604 - RNA, 30 nt, Human
gcugaccccacuccaggaccuaggcccagc

SEQ ID NO: 87605 - RNA, 28 nt, Human
ugccagauucugccucucuggaaagagg

SEQ ID NO: 87606 - RNA, 26 nt, Human
aggguuugaggauuccugaguguggg

SEQ ID NO: 87607 - RNA, 21 nt, Human
gcccugggcacgagauuugcu

SEQ ID NO: 87608 - RNA, 25 nt, Human
cguggguggcaggacugaacuugaa

SEQ ID NO: 87609 - RNA, 26 nt, Human
ccuucuguugcugaauauuacuuguc

SEQ ID NO: 87610 - RNA, 20 nt, Human
agccacgucuggccuguguc

SEQ ID NO: 87611 - RNA, 22 nt, Human
gacugccucugagucauugugu

SEQ ID NO: 87612 - RNA, 26 nt, Human
cugagacggagucucagucugucacc

SEQ ID NO: 87613 - RNA, 21 nt, Human
uugugcugugacugcaucacc

SEQ ID NO: 87614 - RNA, 17 nt, Human
ggccccuucccaccugu

SEQ ID NO: 87615 - RNA, 22 nt, Human
cugggagguggagguugcauug

SEQ ID NO: 87616 - RNA, 24 nt, Human
uguuuucacuggauuuuuaucucu

SEQ ID NO: 87617 - RNA, 20 nt, Human
ggugggggcugggugcagug

SEQ ID NO: 87618 - RNA, 22 nt, Human
ucuccucucugggaaacguccc

SEQ ID NO: 87619 - RNA, 27 nt, Human
ggugucaggagagcccucugcugcuuu

SEQ ID NO: 87620 - RNA, 21 nt, Human
cugccugaaggcgaguguggg

SEQ ID NO: 87621 - RNA, 24 nt, Human
agcccccugcacccaccccugccc

SEQ ID NO: 87622 - RNA, 20 nt, Human
uuacauaccugguuugcuua

SEQ ID NO: 87623 - RNA, 23 nt, Human
caccauugcacuccagccuuggg

SEQ ID NO: 87624 - RNA, 19 nt, Human
auguuuauuaaugggccaa

SEQ ID NO: 87625 - RNA, 26 nt, Human
auggcaacucugcguugagccagucu

SEQ ID NO: 87626 - RNA, 22 nt, Human
gaaggaugagacaaaaggccag

SEQ ID NO: 87627 - RNA, 22 nt, Human
gcaaaggcaggcaaggccaggc

SEQ ID NO: 87628 - RNA, 22 nt, Human
gcacuccucugucucugcucuu

SEQ ID NO: 87629 - RNA, 22 nt, Human
gcagaucucagacuccugggcu

SEQ ID NO: 87630 - RNA, 22 nt, Human
ucuuccccaaaaagcaccauga

SEQ ID NO: 87631 - RNA, 22 nt, Human
ccaacugaucuguuauaggucc

SEQ ID NO: 87632 - RNA, 25 nt, Human
ugggaacacuggguauucucaugag

SEQ ID NO: 87633 - RNA, 23 nt, Human
gccuguaaucccaguuacucggg

SEQ ID NO: 87634 - RNA, 26 nt, Human
cuccaggcuccggagccaugcccugc

SEQ ID NO: 87635 - RNA, 22 nt, Human
ucuccaaaacuagcauucuuaa

SEQ ID NO: 87636 - RNA, 23 nt, Human
aggccacacccugcccugcucug

SEQ ID NO: 87637 - RNA, 24 nt, Human
caccugcuccuuccuggacgcuca

SEQ ID NO: 87638 - RNA, 24 nt, Human
cggaggcagugacuuggggccaag

SEQ ID NO: 87639 - RNA, 25 nt, Human
uugcccaggguccugugccuggaug

SEQ ID NO: 87640 - RNA, 25 nt, Human
aguuuuaaaagucuaugaucugauc

SEQ ID NO: 87641 - RNA, 25 nt, Human
uuuguuuugaagcuuuacuaaucua

SEQ ID NO: 87642 - RNA, 23 nt, Human
aucgugccacugcauuccagccu

SEQ ID NO: 87643 - RNA, 26 nt, Human
gcugugggacagggaccgggccugga

SEQ ID NO: 87644 - RNA, 17 nt, Human
aaugauuucaaaugcug

SEQ ID NO: 87645 - RNA, 27 nt, Human
ggcugagaaaugcagagaagaauaaga

SEQ ID NO: 87646 - RNA, 27 nt, Human
uguuuuuaagauggaguuucccucugu

SEQ ID NO: 87647 - RNA, 25 nt, Human
ggucauuuucauaaauauuguugca

SEQ ID NO: 87648 - RNA, 27 nt, Human
ugguucugcagcuugaguccucugguu

SEQ ID NO: 87649 - RNA, 21 nt, Human
gagcccccucgaggaaccugg

SEQ ID NO: 87650 - RNA, 24 nt, Human
gagagcggaggagagagaggcaga

SEQ ID NO: 87651 - RNA, 27 nt, Human
gcaagcagaugggggugggcaccugag

SEQ ID NO: 87652 - RNA, 28 nt, Human
uucccucacccuguauccugucuccccu

SEQ ID NO: 87653 - RNA, 24 nt, Human
uauaugaauguguugcacaugucc

SEQ ID NO: 87654 - RNA, 22 nt, Human
uuccccuucagcuucagacccc

SEQ ID NO: 87655 - RNA, 22 nt, Human
guccgcccaggcugggugcagu

SEQ ID NO: 87656 - RNA, 22 nt, Human
uuucccgcucagcccuggagcg

SEQ ID NO: 87657 - RNA, 23 nt, Human
uccucuuggucucagcacugaug

SEQ ID NO: 87658 - RNA, 19 nt, Human
ugguggucggcuccagcgc

SEQ ID NO: 87659 - RNA, 29 nt, Human
ggggaaccugagcucagaggaugugcugc

SEQ ID NO: 87660 - RNA, 22 nt, Human
ggucucuuuccaaagcauuuuu

SEQ ID NO: 87661 - RNA, 20 nt, Human
gaacaccugacuuugcucuu

SEQ ID NO: 87662 - RNA, 19 nt, Human
uuuccuuucucucuccucc

SEQ ID NO: 87663 - RNA, 27 nt, Human
ggugaagccuagcagaggacgcggcca

SEQ ID NO: 87664 - RNA, 26 nt, Human
ucugcacuugccuugcccaauagcca

SEQ ID NO: 87665 - RNA, 21 nt, Human
aagcccaaacaucccaaaugu

SEQ ID NO: 87666 - RNA, 27 nt, Human
cccaaguagcugagacuacaagcaccc

SEQ ID NO: 87667 - RNA, 22 nt, Human
cauacguauauguguguguaua

SEQ ID NO: 87668 - RNA, 22 nt, Human
aaauguucagaagguugcucua

SEQ ID NO: 87669 - RNA, 23 nt, Human
cacagccgcugggagcgccucag

SEQ ID NO: 87670 - RNA, 24 nt, Human
gcugcugcugccaguggccucuuc

SEQ ID NO: 87671 - RNA, 17 nt, Human
acggcuuugccuagcca

SEQ ID NO: 87672 - RNA, 24 nt, Human
agaauacuguauuguuacagcuga

SEQ ID NO: 87673 - RNA, 27 nt, Human
ucgaguagcugggaccacacagacagg

SEQ ID NO: 87674 - RNA, 22 nt, Human
cugcaaccacugccuccagggu

SEQ ID NO: 87675 - RNA, 23 nt, Human
aucgugccacugcaguccagccu

SEQ ID NO: 87676 - RNA, 26 nt, Human
uuacagacacacagagacacauacac

SEQ ID NO: 87677 - RNA, 20 nt, Human
aaacuaguaaacuccaccuu

SEQ ID NO: 87678 - RNA, 22 nt, Human
uuggaaagauauaauuucuuga

SEQ ID NO: 87679 - RNA, 26 nt, Human
gggcaccccgacucugucuccaggag

SEQ ID NO: 87680 - RNA, 25 nt, Human
aggaaacugaacuugagguggccuc

SEQ ID NO: 87681 - RNA, 21 nt, Human
ccccugagggaaucgcuuuuu

SEQ ID NO: 87682 - RNA, 17 nt, Human
guucccuuacuguuuca

SEQ ID NO: 87683 - RNA, 19 nt, Human
ugacuucucccuauaagag

SEQ ID NO: 87684 - RNA, 22 nt, Human
uuugggguuuuauuuugauguc

SEQ ID NO: 87685 - RNA, 21 nt, Human
ugacuugccauuucauuuaca

SEQ ID NO: 87686 - RNA, 19 nt, Human
uucacauaugcacauacac

SEQ ID NO: 87687 - RNA, 23 nt, Human
gcgaggcagaggacagaucaaug

SEQ ID NO: 87688 - RNA, 22 nt, Human
cugugguuucaaacaucuacug

SEQ ID NO: 87689 - RNA, 21 nt, Human
ggagagagggcacgggaguug

SEQ ID NO: 87690 - RNA, 23 nt, Human
ggcagauguggcaugucuuuuug

SEQ ID NO: 87691 - RNA, 27 nt, Human
gucacccaggaccugccuccugccugc

SEQ ID NO: 87692 - RNA, 18 nt, Human
ucuucuucuuuguuuuca

SEQ ID NO: 87693 - RNA, 23 nt, Human
uguucccagccccuccucccuca

SEQ ID NO: 87694 - RNA, 23 nt, Human
ccuaccccacacggugcucagug

SEQ ID NO: 87695 - RNA, 21 nt, Human
ggcucuccagcgaucuuccca

SEQ ID NO: 87696 - RNA, 23 nt, Human
ucuugagucuaaaaaugaccuca

SEQ ID NO: 87697 - RNA, 19 nt, Human
gaggaagaccaaagcagca

SEQ ID NO: 87698 - RNA, 20 nt, Human
gaacuuaccucuugccaaag

SEQ ID NO: 87699 - RNA, 22 nt, Human
gcuuaaaaauggacaaaaagaa

SEQ ID NO: 87700 - RNA, 21 nt, Human
cuguauagcuccuuuugaccu

SEQ ID NO: 87701 - RNA, 22 nt, Human
gcugcgguuucaggcggcugcu

SEQ ID NO: 87702 - RNA, 23 nt, Human
cacaugcuuccacuccauccaua

SEQ ID NO: 87703 - RNA, 26 nt, Human
gagccuugcaggcuggagggcggcug

SEQ ID NO: 87704 - RNA, 26 nt, Human
caggcaauucuccugccuuugccucc

SEQ ID NO: 87705 - RNA, 22 nt, Human
gaagaagagaaugugacaggca

SEQ ID NO: 87706 - RNA, 19 nt, Human
ccuagcugauaaagcuuag

SEQ ID NO: 87707 - RNA, 22 nt, Human
augaaauuuagaauaccaauga

SEQ ID NO: 87708 - RNA, 22 nt, Human
cucuccucugccuccauuuguu

SEQ ID NO: 87709 - RNA, 20 nt, Human
uuccaauuccugaucaccca

SEQ ID NO: 87710 - RNA, 24 nt, Human
agcaauugguuguuuaacacuucu

SEQ ID NO: 87711 - RNA, 23 nt, Human
agaaccucaguuugcuaacugaa

SEQ ID NO: 87712 - RNA, 24 nt, Human
gccuauacucugguggccuggucc

SEQ ID NO: 87713 - RNA, 23 nt, Human
ggaaagggaaggagcaagccgug

SEQ ID NO: 87714 - RNA, 22 nt, Human
aacuugcauuucggaagccacu

SEQ ID NO: 87715 - RNA, 23 nt, Human
ucucuaggccucuccaguuugca

SEQ ID NO: 87716 - RNA, 17 nt, Human
ccugcucugcugcagcc

SEQ ID NO: 87717 - RNA, 19 nt, Human
uuaggaggugacugcaucc

SEQ ID NO: 87718 - RNA, 23 nt, Human
uuguggccagaugcaaugaucuu

SEQ ID NO: 87719 - RNA, 23 nt, Human
guuucaaagugucucauucucag

SEQ ID NO: 87720 - RNA, 29 nt, Human
aaaugaucacuucauuugauacuguuuuu

SEQ ID NO: 87721 - RNA, 24 nt, Human
uuguggacugaagguagacaccag

SEQ ID NO: 87722 - RNA, 21 nt, Human
cugcucccucuuguuucuuac

SEQ ID NO: 87723 - RNA, 21 nt, Human
uucuguagguuaaaugcaggu

SEQ ID NO: 87724 - RNA, 24 nt, Human
gcgcaggagccaccucccugagcc

SEQ ID NO: 87725 - RNA, 18 nt, Human
uugcccaucuccuguguc

SEQ ID NO: 87726 - RNA, 22 nt, Human
gggcccccagucggccgcuuca

SEQ ID NO: 87727 - RNA, 21 nt, Human
auaaagugcuuugaaaaugcu

SEQ ID NO: 87728 - RNA, 25 nt, Human
augauuugacucaguuugcucacuu

SEQ ID NO: 87729 - RNA, 22 nt, Human
ugcagcgcagcuguguuggagg

SEQ ID NO: 87730 - RNA, 22 nt, Human
uuauuuuucucaaaaaacaaac

SEQ ID NO: 87731 - RNA, 27 nt, Human
caucagcugcugaaacaacaaauagga

SEQ ID NO: 87732 - RNA, 22 nt, Human
gcccaaguguucuuuagcuuuu

SEQ ID NO: 87733 - RNA, 22 nt, Human
guguguagggggguucagggcu

SEQ ID NO: 87734 - RNA, 23 nt, Human
uugcuguuuuaaauugcauuucu

SEQ ID NO: 87735 - RNA, 19 nt, Human
agggcauugcucagcccgc

SEQ ID NO: 87736 - RNA, 21 nt, Human
cagccuggagugcagugagcu

SEQ ID NO: 87737 - RNA, 23 nt, Human
aaugcgguucagggcugggguga

SEQ ID NO: 87738 - RNA, 23 nt, Human
gauggauguuucugagucaucuu

SEQ ID NO: 87739 - RNA, 28 nt, Human
agggagcugaggccucccuugaguaggc

SEQ ID NO: 87740 - RNA, 23 nt, Human
ggggcucgagagcagguaguccc

SEQ ID NO: 87741 - RNA, 21 nt, Human
cugggcagaggggaagggugg

SEQ ID NO: 87742 - RNA, 20 nt, Human
ccagccaccacugaguccac

SEQ ID NO: 87743 - RNA, 25 nt, Human
cccagagcugggacagcagccgggc

SEQ ID NO: 87744 - RNA, 22 nt, Human
cuguuuucccaaccuccugugg

SEQ ID NO: 87745 - RNA, 20 nt, Human
ccuccacuucacaggacucu

SEQ ID NO: 87746 - RNA, 26 nt, Human
cggcuggaguaaggcuugcuguggga

SEQ ID NO: 87747 - RNA, 21 nt, Human
uggacagauggcuggccaagu

SEQ ID NO: 87748 - RNA, 22 nt, Human
aaaaggaucuuuguggccaagg

SEQ ID NO: 87749 - RNA, 21 nt, Human
accgcccaggcuggagugcag

SEQ ID NO: 87750 - RNA, 22 nt, Human
aucggcucccagcaagugccuc

SEQ ID NO: 87751 - RNA, 21 nt, Human
ggagccugagcccaggaaggg

SEQ ID NO: 87752 - RNA, 21 nt, Human
cagggaggugugaggcaggag

SEQ ID NO: 87753 - RNA, 28 nt, Human
cacuauuuauuuuuaaugcuucuguaga

SEQ ID NO: 87754 - RNA, 27 nt, Human
ggcucagaaguccugaugugggagagg

SEQ ID NO: 87755 - RNA, 23 nt, Human
cgacugucaagguggcuguuaua

SEQ ID NO: 87756 - RNA, 22 nt, Human
uuuaaucauuuguagcuucauu

SEQ ID NO: 87757 - RNA, 19 nt, Human
ggugugguaucaaacuuca

SEQ ID NO: 87758 - RNA, 20 nt, Human
ccuucccagcucucccucug

SEQ ID NO: 87759 - RNA, 20 nt, Human
cugccacuccagcuccuggg

SEQ ID NO: 87760 - RNA, 26 nt, Human
ccagcacugccgucuacucacuguag

SEQ ID NO: 87761 - RNA, 24 nt, Human
ggaguaacaggcuuauuccacuuu

SEQ ID NO: 87762 - RNA, 21 nt, Human
cugucugcuagggucaccucc

SEQ ID NO: 87763 - RNA, 32 nt, Human
gcuagccuguucuuuuaccacugacagcuaga

SEQ ID NO: 87764 - RNA, 18 nt, Human
gcgucaaaaguugcugaa

SEQ ID NO: 87765 - RNA, 22 nt, Human
ugaaggcuaaaaagguccugua

SEQ ID NO: 87766 - RNA, 21 nt, Human
ccuuucucugccgccugcugc

SEQ ID NO: 87767 - RNA, 22 nt, Human
ugcagccugccaagcugugauu

SEQ ID NO: 87768 - RNA, 21 nt, Human
gcucucaaaccccugaccuca

SEQ ID NO: 87769 - RNA, 18 nt, Human
ggugggaccuaaugucac

SEQ ID NO: 87770 - RNA, 20 nt, Human
uuugcuugccuuuuaaguua

SEQ ID NO: 87771 - RNA, 21 nt, Human
auacucauguuaagugcaaug

SEQ ID NO: 87772 - RNA, 22 nt, Human
agucugcaagaugucaagggcc

SEQ ID NO: 87773 - RNA, 26 nt, Human
gcagacagcacugucaacacugggcc

SEQ ID NO: 87774 - RNA, 27 nt, Human
cuucaaaauuauuugggcauacugcuc

SEQ ID NO: 87775 - RNA, 21 nt, Human
gcucugugccaccucccaaga

SEQ ID NO: 87776 - RNA, 18 nt, Human
gcauuuuccuuggcuuca

SEQ ID NO: 87777 - RNA, 19 nt, Human
ccuugcaaucccaggcugg

SEQ ID NO: 87778 - RNA, 21 nt, Human
gccuauggcaucuuccccaac

SEQ ID NO: 87779 - RNA, 21 nt, Human
cugccuaacgguuuuguuucu

SEQ ID NO: 87780 - RNA, 22 nt, Human
cucaggcucccaaguagcuagg

SEQ ID NO: 87781 - RNA, 24 nt, Human
caaugagaaagaauggaagauggu

SEQ ID NO: 87782 - RNA, 21 nt, Human
acugguauaaauauaacugaa

SEQ ID NO: 87783 - RNA, 22 nt, Human
cuuggccucccaaguugcuggg

SEQ ID NO: 87784 - RNA, 24 nt, Human
aggcccgcucucucaggcccucag

SEQ ID NO: 87785 - RNA, 25 nt, Human
cugggcuucagagcuaggucuuugg

SEQ ID NO: 87786 - RNA, 21 nt, Human
auucccgcaggcuccuggacu

SEQ ID NO: 87787 - RNA, 23 nt, Human
ggcauuuucugacuucuuccucc

SEQ ID NO: 87788 - RNA, 23 nt, Human
gcauccagucuuuaagagccaag

SEQ ID NO: 87789 - RNA, 21 nt, Human
agaccagccugaccaacgugg

SEQ ID NO: 87790 - RNA, 22 nt, Human
ccuccaucuucucaugcccucu

SEQ ID NO: 87791 - RNA, 22 nt, Human
ccugcagcgguucccuggacgg

SEQ ID NO: 87792 - RNA, 22 nt, Human
agaggucucuaacugaagagag

SEQ ID NO: 87793 - RNA, 20 nt, Human
ugguauucuggugauggggu

SEQ ID NO: 87794 - RNA, 28 nt, Human
guagaggcccuucuuugcacuugcuucu

SEQ ID NO: 87795 - RNA, 25 nt, Human
cagaaguccauuggaauauuaagcc

SEQ ID NO: 87796 - RNA, 22 nt, Human
aaaggcugacaacccaguuuuu

SEQ ID NO: 87797 - RNA, 22 nt, Human
ggcauuagagggagcccagucu

SEQ ID NO: 87798 - RNA, 22 nt, Human
cgcagcgucccuggucucucca

SEQ ID NO: 87799 - RNA, 26 nt, Human
acucagccugggacuggcugggcgag

SEQ ID NO: 87800 - RNA, 23 nt, Human
cugucgccaaguuggagugcaau

SEQ ID NO: 87801 - RNA, 28 nt, Human
cauaaaguaacacaacagcauugcacgg

SEQ ID NO: 87802 - RNA, 22 nt, Human
uggcuuuaugguuuuccuuccu

SEQ ID NO: 87803 - RNA, 18 nt, Human
caacuugcuacuuucaga

SEQ ID NO: 87804 - RNA, 19 nt, Human
uguggggaguucacuguga

SEQ ID NO: 87805 - RNA, 27 nt, Human
uacucacucacucuccaccagccuggg

SEQ ID NO: 87806 - RNA, 24 nt, Human
guauuuauuugacuucauuccgua

SEQ ID NO: 87807 - RNA, 22 nt, Human
ucuguaacugaagugugggucc

SEQ ID NO: 87808 - RNA, 22 nt, Human
gugucccgccaccuuugcuucc

SEQ ID NO: 87809 - RNA, 22 nt, Human
gcugggcugccagguacccugg

SEQ ID NO: 87810 - RNA, 26 nt, Human
caagggaaaguuucagcucacuguga

SEQ ID NO: 87811 - RNA, 27 nt, Human
auacaugccuaaauucuuuuaaaaugu

SEQ ID NO: 87812 - RNA, 23 nt, Human
ggcucagagcaaccuccagccuu

SEQ ID NO: 87813 - RNA, 26 nt, Human
uuuuucucaugcccugccuucaucug

SEQ ID NO: 87814 - RNA, 23 nt, Human
aggcuggaaugcaauggcaugau

SEQ ID NO: 87815 - RNA, 23 nt, Human
aggcuggagugcaaugacaugau

SEQ ID NO: 87816 - RNA, 26 nt, Human
gaggcuuucuuugauuccuccucagu

SEQ ID NO: 87817 - RNA, 21 nt, Human
uggagcccagaguuucugccu

SEQ ID NO: 87818 - RNA, 25 nt, Human
cagcccagugcgagacagccuugaa

SEQ ID NO: 87819 - RNA, 26 nt, Human
ucucugcuuguuaguugcucuuucug

SEQ ID NO: 87820 - RNA, 27 nt, Human
cagaaaccuuccagagaacacagggcu

SEQ ID NO: 87821 - RNA, 22 nt, Human
cucagcaccugcuuccugcucc

SEQ ID NO: 87822 - RNA, 19 nt, Human
gcccaggcaagagugcagu

SEQ ID NO: 87823 - RNA, 20 nt, Human
gauguaaaacugaacuucag

SEQ ID NO: 87824 - RNA, 20 nt, Human
ugucugacacugauuuuguu

SEQ ID NO: 87825 - RNA, 24 nt, Human
agaaggaggggacagaggagcuga

SEQ ID NO: 87826 - RNA, 24 nt, Human
uuguacaguucuguuagauguugu

SEQ ID NO: 87827 - RNA, 26 nt, Human
gcagagggagcgagcgggcggccggc

SEQ ID NO: 87828 - RNA, 21 nt, Human
cacuauauacagaugcaagca

SEQ ID NO: 87829 - RNA, 21 nt, Human
ggugcggggggcagugcagug

SEQ ID NO: 87830 - RNA, 23 nt, Human
ccucaccuucccccacugccccc

SEQ ID NO: 87831 - RNA, 27 nt, Human
agcccugugcuggggcccugcaauugg

SEQ ID NO: 87832 - RNA, 26 nt, Human
cauuccccucccucugugguccagug

SEQ ID NO: 87833 - RNA, 21 nt, Human
guugcccagaaaaagugccca

SEQ ID NO: 87834 - RNA, 19 nt, Human
uuggcaccugcacacucca

SEQ ID NO: 87835 - RNA, 24 nt, Human
aggagccuucugcugggggugggg

SEQ ID NO: 87836 - RNA, 22 nt, Human
acugcaaccucugccucccggg

SEQ ID NO: 87837 - RNA, 22 nt, Human
uuuaaggcuauuuuaaaauaug

SEQ ID NO: 87838 - RNA, 20 nt, Human
gugcaaucaccccugccuuu

SEQ ID NO: 87839 - RNA, 29 nt, Human
ggggguuguuaggcuuuucugccugcucc

SEQ ID NO: 87840 - RNA, 25 nt, Human
ccggccccugucccggcaucucucg

SEQ ID NO: 87841 - RNA, 22 nt, Human
caucuuuguuuuccucuuugau

SEQ ID NO: 87842 - RNA, 22 nt, Human
acccaggcuggagugcaaugau

SEQ ID NO: 87843 - RNA, 22 nt, Human
gugaccuaaggccucucugccg

SEQ ID NO: 87844 - RNA, 20 nt, Human
ccaacuugcucuuaaucaca

SEQ ID NO: 87845 - RNA, 21 nt, Human
uucacaguauucaguuuucuc

SEQ ID NO: 87846 - RNA, 20 nt, Human
uacaugagaggagauaguga

SEQ ID NO: 87847 - RNA, 25 nt, Human
caaguuggagugcaguggccccgca

SEQ ID NO: 87848 - RNA, 22 nt, Human
ugacuugcccggggcuccaggu

SEQ ID NO: 87849 - RNA, 22 nt, Human
aaaguuguacugugaacuggaa

SEQ ID NO: 87850 - RNA, 22 nt, Human
cugucgucaacugacagugauu

SEQ ID NO: 87851 - RNA, 25 nt, Human
acuguucuucccacugcaaucugac

SEQ ID NO: 87852 - RNA, 19 nt, Human
ccgcugcccuggccuugag

SEQ ID NO: 87853 - RNA, 25 nt, Human
uguuuaauguuaguuguuuaugugu

SEQ ID NO: 87854 - RNA, 25 nt, Human
ccccuguguuuguagagaacucccu

SEQ ID NO: 87855 - RNA, 19 nt, Human
auuucaggaaaugggauag

SEQ ID NO: 87856 - RNA, 25 nt, Human
aaauagagaccuguugguugcuagg

SEQ ID NO: 87857 - RNA, 22 nt, Human
cugcccuucuaccuuccucgcc

SEQ ID NO: 87858 - RNA, 21 nt, Human
acuccuacuuuucauccuagu

SEQ ID NO: 87859 - RNA, 26 nt, Human
uccugcucuccuccagccgagggacc

SEQ ID NO: 87860 - RNA, 31 nt, Human
cauacaccucaccugccuuggcaagccuauu

SEQ ID NO: 87861 - RNA, 22 nt, Human
aggcugaggcaagagaauuguu

SEQ ID NO: 87862 - RNA, 21 nt, Human
cagucucucagugcuuggcag

SEQ ID NO: 87863 - RNA, 24 nt, Human
ccagccagggcacgagcccuccuu

SEQ ID NO: 87864 - RNA, 21 nt, Human
acugauugucccaacucagag

SEQ ID NO: 87865 - RNA, 21 nt, Human
auggguagagucaggaagccc

SEQ ID NO: 87866 - RNA, 20 nt, Human
cugccaaaucuacucugccu

SEQ ID NO: 87867 - RNA, 21 nt, Human
uuaccugaauaaaugguagua

SEQ ID NO: 87868 - RNA, 18 nt, Human
ugcaggacacaagcacag

SEQ ID NO: 87869 - RNA, 23 nt, Human
agucagcucuccuuuccuugcug

SEQ ID NO: 87870 - RNA, 23 nt, Human
ggucuagggacguucucucucca

SEQ ID NO: 87871 - RNA, 24 nt, Human
uucaaccugugugcugcgaaggac

SEQ ID NO: 87872 - RNA, 21 nt, Human
acauauuauacucuugugugu

SEQ ID NO: 87873 - RNA, 24 nt, Human
ggagcaguacaugggaaaggaggc

SEQ ID NO: 87874 - RNA, 24 nt, Human
ugagaaagggagaggaagagaagc

SEQ ID NO: 87875 - RNA, 26 nt, Human
uuugagugucaggcucugaaucucuc

SEQ ID NO: 87876 - RNA, 26 nt, Human
ucacacaccagcacuuuauacacuuc

SEQ ID NO: 87877 - RNA, 19 nt, Human
cuuugcaggagccugggug

SEQ ID NO: 87878 - RNA, 26 nt, Human
ucgcccaggcuggagcuggccccgcu

SEQ ID NO: 87879 - RNA, 21 nt, Human
ccuuuaaauuuuaaaaaauuu

SEQ ID NO: 87880 - RNA, 27 nt, Human
gugggcggagccacccgaaaggcuccg

SEQ ID NO: 87881 - RNA, 22 nt, Human
auccgccauucuugucaccuca

SEQ ID NO: 87882 - RNA, 25 nt, Human
gucuguccucccuguugauuggucu

SEQ ID NO: 87883 - RNA, 26 nt, Human
ccuaguuaguacucggacuccugugc

SEQ ID NO: 87884 - RNA, 24 nt, Human
acgcccggcccccgcgccugcugc

SEQ ID NO: 87885 - RNA, 22 nt, Human
caagcucaacagaaaccaguug

SEQ ID NO: 87886 - RNA, 22 nt, Human
cugcaaccuccaccuuccuggu

SEQ ID NO: 87887 - RNA, 26 nt, Human
ccugggaucccucagccaacucugaa

SEQ ID NO: 87888 - RNA, 24 nt, Human
ggacaugcaucuuuaagcuuuauc

SEQ ID NO: 87889 - RNA, 24 nt, Human
uggauccugggguagggaggcagg

SEQ ID NO: 87890 - RNA, 23 nt, Human
gccuaaggcauuggagaacugga

SEQ ID NO: 87891 - RNA, 22 nt, Human
aaucugaaguccuuuccaggga

SEQ ID NO: 87892 - RNA, 21 nt, Human
ugucaacuugcccugcuuugu

SEQ ID NO: 87893 - RNA, 22 nt, Human
ggcagauccuggcacuaccuca

SEQ ID NO: 87894 - RNA, 21 nt, Human
uuugauuguuuucuaaaagga

SEQ ID NO: 87895 - RNA, 23 nt, Human
uguugcccaggcuggaaugcagu

SEQ ID NO: 87896 - RNA, 23 nt, Human
ggcccuccugcccagcugcucuu

SEQ ID NO: 87897 - RNA, 23 nt, Human
aucgucccggcugaagugcagug

SEQ ID NO: 87898 - RNA, 21 nt, Human
cacugcacccagccuagaauc

SEQ ID NO: 87899 - RNA, 22 nt, Human
auguuuauuuauucugcauuuu

SEQ ID NO: 87900 - RNA, 23 nt, Human
gccuggggccauugagcccagcc

SEQ ID NO: 87901 - RNA, 19 nt, Human
cuugcuggugccucuuuuc

SEQ ID NO: 87902 - RNA, 21 nt, Human
ugacacuuagagaaaaaggaa

SEQ ID NO: 87903 - RNA, 23 nt, Human
gggaacacuggucuagaauugag

SEQ ID NO: 87904 - RNA, 22 nt, Human
ggucugcaaacucccaccugca

SEQ ID NO: 87905 - RNA, 27 nt, Human
ggcucacaccuguaauaccagcaguuu

SEQ ID NO: 87906 - RNA, 21 nt, Human
ccacugcaccgggccacagag

SEQ ID NO: 87907 - RNA, 21 nt, Human
cucuccucugcuaaauuugca

SEQ ID NO: 87908 - RNA, 22 nt, Human
caggccugugcauguguguaca

SEQ ID NO: 87909 - RNA, 22 nt, Human
caggagguggagguugcaguaa

SEQ ID NO: 87910 - RNA, 22 nt, Human
caggggguggagguugcaguga

SEQ ID NO: 87911 - RNA, 24 nt, Human
ggccccucccacacacacccacac

SEQ ID NO: 87912 - RNA, 30 nt, Human
aguucuccuccucggccugcccaagagucc

SEQ ID NO: 87913 - RNA, 21 nt, Human
uccuguuacugaauuugcuaa

SEQ ID NO: 87914 - RNA, 22 nt, Human
aggcugaggcacgagaaucacu

SEQ ID NO: 87915 - RNA, 22 nt, Human
aggaugaggcaggagaaucgcu

SEQ ID NO: 87916 - RNA, 21 nt, Human
gaagguuuuccauuauacuuu

SEQ ID NO: 87917 - RNA, 21 nt, Human
aucucuaguugucacuuuccu

SEQ ID NO: 87918 - RNA, 20 nt, Human
guggaaaugucacuugcuac

SEQ ID NO: 87919 - RNA, 18 nt, Human
gcaaaauuugaaaccauu

SEQ ID NO: 87920 - RNA, 23 nt, Human
ucacccagcggggcuuccaggcc

SEQ ID NO: 87921 - RNA, 20 nt, Human
uggucugguuaaaguuccuu

SEQ ID NO: 87922 - RNA, 23 nt, Human
ucuggggcugggucccacaugcc

SEQ ID NO: 87923 - RNA, 27 nt, Human
ugcacuuuauuaccaagccucugggau

SEQ ID NO: 87924 - RNA, 23 nt, Human
ugggaaagauggacuuacgggag

SEQ ID NO: 87925 - RNA, 27 nt, Human
acaaaccugcccauguguuuccugaau

SEQ ID NO: 87926 - RNA, 21 nt, Human
uccuuaccguccugcccauac

SEQ ID NO: 87927 - RNA, 22 nt, Human
accuagaguugccaguggcaca

SEQ ID NO: 87928 - RNA, 21 nt, Human
ggaagagagagacggggucag

SEQ ID NO: 87929 - RNA, 21 nt, Human
ccacccuuugggcucagagga

SEQ ID NO: 87930 - RNA, 23 nt, Human
accugcaugaucacaagcuuucu

SEQ ID NO: 87931 - RNA, 27 nt, Human
augugguucccaggagggaagagguuc

SEQ ID NO: 87932 - RNA, 22 nt, Human
cuguccauuucugugauggguu

SEQ ID NO: 87933 - RNA, 24 nt, Human
uuuuuuaaaaguguuguuuuucua

SEQ ID NO: 87934 - RNA, 22 nt, Human
gcucuagguggaggaaaggagg

SEQ ID NO: 87935 - RNA, 20 nt, Human
ggaggcggagcuggcaguga

SEQ ID NO: 87936 - RNA, 21 nt, Human
ucuuucuuccuuucuccauga

SEQ ID NO: 87937 - RNA, 21 nt, Human
cauucugcaaguauacuaggg

SEQ ID NO: 87938 - RNA, 23 nt, Human
gacucuuucaccuacugagauga

SEQ ID NO: 87939 - RNA, 25 nt, Human
aucacuuccauagugacgauacucc

SEQ ID NO: 87940 - RNA, 21 nt, Human
cacagcccaaagaaggaaaag

SEQ ID NO: 87941 - RNA, 26 nt, Human
gggcuggagcccagagaugagagugc

SEQ ID NO: 87942 - RNA, 25 nt, Human
gugcccagagggcggcgggggugcg

SEQ ID NO: 87943 - RNA, 22 nt, Human
ugcaaccucugacucccugguu

SEQ ID NO: 87944 - RNA, 19 nt, Human
ugccuuucuauuuacuuga

SEQ ID NO: 87945 - RNA, 21 nt, Human
agccucuccugaaccaaacaa

SEQ ID NO: 87946 - RNA, 20 nt, Human
guggcuuaaaacaauagaaa

SEQ ID NO: 87947 - RNA, 22 nt, Human
guccugucccugucugggaguu

SEQ ID NO: 87948 - RNA, 23 nt, Human
ugucgccuaagcuggaguguggu

SEQ ID NO: 87949 - RNA, 26 nt, Human
ucccuccucccccuccucucuggcag

SEQ ID NO: 87950 - RNA, 23 nt, Human
ggccccuucucuuccucauuuug

SEQ ID NO: 87951 - RNA, 23 nt, Human
ggcaggagaauggcaugaacccc

SEQ ID NO: 87952 - RNA, 20 nt, Human
ccguggccgcagggucucca

SEQ ID NO: 87953 - RNA, 26 nt, Human
uguucuuugguguaaucucucauggu

SEQ ID NO: 87954 - RNA, 21 nt, Human
cucccaaaggcugucauuuca

SEQ ID NO: 87955 - RNA, 27 nt, Human
gggaauggaauaacuaucucacuucca

SEQ ID NO: 87956 - RNA, 23 nt, Human
gcuuccagagcucugacccacag

SEQ ID NO: 87957 - RNA, 24 nt, Human
caaggcaacuuccuggcuuuuuac

SEQ ID NO: 87958 - RNA, 21 nt, Human
agucugcugcagaugaccuca

SEQ ID NO: 87959 - RNA, 25 nt, Human
ggcugguaaaaugaauuuuguaaua

SEQ ID NO: 87960 - RNA, 19 nt, Human
agaaaacagaaaucugcau

SEQ ID NO: 87961 - RNA, 23 nt, Human
uaucucccuugaaaauacuuuca

SEQ ID NO: 87962 - RNA, 20 nt, Human
uuccgcagcagcagcaauug

SEQ ID NO: 87963 - RNA, 22 nt, Human
gccucgcccagccagcccucuc

SEQ ID NO: 87964 - RNA, 23 nt, Human
gggaacugagacgccagcuuaaa

SEQ ID NO: 87965 - RNA, 22 nt, Human
aggcugagaugggcagaucacu

SEQ ID NO: 87966 - RNA, 20 nt, Human
ugccuccaagccccagaugg

SEQ ID NO: 87967 - RNA, 26 nt, Human
acccuuuagccucucugcccuuccac

SEQ ID NO: 87968 - RNA, 27 nt, Human
agaaauucaaaguuaucaaaguuccuu

SEQ ID NO: 87969 - RNA, 20 nt, Human
guaacaucauuuuguuuucc

SEQ ID NO: 87970 - RNA, 22 nt, Human
gggcugugccguggagcugggc

SEQ ID NO: 87971 - RNA, 22 nt, Human
uccagcuguacuucagaaaaau

SEQ ID NO: 87972 - RNA, 21 nt, Human
cccuccguuccuccucagccu

SEQ ID NO: 87973 - RNA, 23 nt, Human
auguuuguuuugccucuucuguu

SEQ ID NO: 87974 - RNA, 20 nt, Human
aagaaagagaaaguagcagg

SEQ ID NO: 87975 - RNA, 27 nt, Human
gccucaaccuccugggcuaagugaucc

SEQ ID NO: 87976 - RNA, 25 nt, Human
cacaggcccauagacagaugggcag

SEQ ID NO: 87977 - RNA, 25 nt, Human
ggagcacguggagaggccggguagc

SEQ ID NO: 87978 - RNA, 27 nt, Human
ccugcaacuaaacacgagccugggcag

SEQ ID NO: 87979 - RNA, 28 nt, Human
agcagccucugggcaucguucccagugu

SEQ ID NO: 87980 - RNA, 21 nt, Human
gaugccacugagauggcaccu

SEQ ID NO: 87981 - RNA, 23 nt, Human
gggaggggagagaccacagccgg

SEQ ID NO: 87982 - RNA, 21 nt, Human
uucuuuuaugagcagaaggaa

SEQ ID NO: 87983 - RNA, 21 nt, Human
aaacuccaagaaagcacuuga

SEQ ID NO: 87984 - RNA, 23 nt, Human
acaccgcacugcgcaaaggggcc

SEQ ID NO: 87985 - RNA, 27 nt, Human
ucccagaacaugacaaauuaugaauaa

SEQ ID NO: 87986 - RNA, 22 nt, Human
ggugacauccaggaggggccuc

SEQ ID NO: 87987 - RNA, 23 nt, Human
ucugccuuuaauuuucucuuuga

SEQ ID NO: 87988 - RNA, 27 nt, Human
uccugcucuccuccguggacauuucau

SEQ ID NO: 87989 - RNA, 27 nt, Human
ggaagacggcagccaccugacugggca

SEQ ID NO: 87990 - RNA, 24 nt, Human
cagucaugcauaaauaugcaguga

SEQ ID NO: 87991 - RNA, 27 nt, Human
ucuugcauuucugcucucuuaugucac

SEQ ID NO: 87992 - RNA, 21 nt, Human
uggacaagcagacacacucac

SEQ ID NO: 87993 - RNA, 22 nt, Human
aggcugaggcaggaggauuguu

SEQ ID NO: 87994 - RNA, 23 nt, Human
ucacugcaaccuccgacucccug

SEQ ID NO: 87995 - RNA, 22 nt, Human
ggagcccggcccugcgcucggc

SEQ ID NO: 87996 - RNA, 19 nt, Human
ggagagggugagguucagc

SEQ ID NO: 87997 - RNA, 24 nt, Human
ccaaaacacuaagaauucuaucau

SEQ ID NO: 87998 - RNA, 26 nt, Human
uucuccccacugauauuuuacauaga

SEQ ID NO: 87999 - RNA, 25 nt, Human
caggcagcgcagggcuggcacguga

SEQ ID NO: 88000 - RNA, 21 nt, Human
cccgcugcucugugcccuguc

SEQ ID NO: 88001 - RNA, 27 nt, Human
agcauuuucacugcuaggacaagcuca

SEQ ID NO: 88002 - RNA, 23 nt, Human
gguguucuucuucucuucucugc

SEQ ID NO: 88003 - RNA, 21 nt, Human
ggagauggaaguugcagugag

SEQ ID NO: 88004 - RNA, 21 nt, Human
aucauuccaaccaaagcaggg

SEQ ID NO: 88005 - RNA, 22 nt, Human
caggaguuccagaucacaucga

SEQ ID NO: 88006 - RNA, 21 nt, Human
gugguucugcaguguuuauga

SEQ ID NO: 88007 - RNA, 21 nt, Human
gcaggagacacuggucucaga

SEQ ID NO: 88008 - RNA, 30 nt, Human
ggagacccugaguccgggaggcaccguccg

SEQ ID NO: 88009 - RNA, 21 nt, Human
ccuagccuugagcaguguugc

SEQ ID NO: 88010 - RNA, 20 nt, Human
uuaauaacaagucaaacuuu

SEQ ID NO: 88011 - RNA, 22 nt, Human
uguggugagcagaaugauuucc

SEQ ID NO: 88012 - RNA, 17 nt, Human
ucugugacccggcauga

SEQ ID NO: 88013 - RNA, 25 nt, Human
cagccucugucccucuuugccugug

SEQ ID NO: 88014 - RNA, 24 nt, Human
ucaggauuaggaauuuggguuugu

SEQ ID NO: 88015 - RNA, 24 nt, Human
ggugccuacuuccacuguaagaaa

SEQ ID NO: 88016 - RNA, 24 nt, Human
ggcguagggugggggcagugagga

SEQ ID NO: 88017 - RNA, 26 nt, Human
ggaggugggaguggcugcagggaccc

SEQ ID NO: 88018 - RNA, 18 nt, Human
cuguauacacuugagugc

SEQ ID NO: 88019 - RNA, 22 nt, Human
agucaagcuucacaggcauugu

SEQ ID NO: 88020 - RNA, 20 nt, Human
auccucuccagcuauaacag

SEQ ID NO: 88021 - RNA, 24 nt, Human
agcaguuucaucagcauuacuugg

SEQ ID NO: 88022 - RNA, 24 nt, Human
gcagauguaagguaauuucugugu

SEQ ID NO: 88023 - RNA, 22 nt, Human
ggauagucugggucagacccau

SEQ ID NO: 88024 - RNA, 20 nt, Human
ccugcaguaguggaucaugu

SEQ ID NO: 88025 - RNA, 27 nt, Human
caggcuggagugcaguggcacuaucuu

SEQ ID NO: 88026 - RNA, 27 nt, Human
ugcuggcauguugguagagucaucccu

SEQ ID NO: 88027 - RNA, 22 nt, Human
aaccucugggcuggaguagagg

SEQ ID NO: 88028 - RNA, 22 nt, Human
ccccugagagauuguaccuucu

SEQ ID NO: 88029 - RNA, 23 nt, Human
ggagaaacucuagacugcaagaa

SEQ ID NO: 88030 - RNA, 26 nt, Human
guggguggagggagggagaucaugag

SEQ ID NO: 88031 - RNA, 21 nt, Human
uugccacccucuccgcuugcc

SEQ ID NO: 88032 - RNA, 27 nt, Human
uuucaucucagcuuuugaugguacuga

SEQ ID NO: 88033 - RNA, 21 nt, Human
cugcucccacccaccugacuc

SEQ ID NO: 88034 - RNA, 27 nt, Human
uggaugccuuugccaaaugguucaugu

SEQ ID NO: 88035 - RNA, 22 nt, Human
ucuaggaugccagaggcagcgc

SEQ ID NO: 88036 - RNA, 20 nt, Human
cucuguuccuuaucaaaaac

SEQ ID NO: 88037 - RNA, 21 nt, Human
guaaaaguuuuaauguauugg

SEQ ID NO: 88038 - RNA, 27 nt, Human
gggugauaaaugggcuagagaggcaga

SEQ ID NO: 88039 - RNA, 27 nt, Human
gcugaacaaauccucugaccucaggcc

SEQ ID NO: 88040 - RNA, 24 nt, Human
ucccagccucuccacucccccgcc

SEQ ID NO: 88041 - RNA, 23 nt, Human
gagcugggaagaccacacuggug

SEQ ID NO: 88042 - RNA, 24 nt, Human
cuguaacaggcuugaaucaaagaa

SEQ ID NO: 88043 - RNA, 21 nt, Human
aucaggcaaggaacaaaccuc

SEQ ID NO: 88044 - RNA, 26 nt, Human
ucacccaggcuggagugcaaugguga

SEQ ID NO: 88045 - RNA, 20 nt, Human
gcugggagacugaagacuca

SEQ ID NO: 88046 - RNA, 30 nt, Human
uucauuucuccugucaccuuccggggagcu

SEQ ID NO: 88047 - RNA, 22 nt, Human
ccuucugaguaccucucuggcu

SEQ ID NO: 88048 - RNA, 24 nt, Human
ccauccaccuccacacugccuccu

SEQ ID NO: 88049 - RNA, 25 nt, Human
aggaaacugcaucagaaacaugaac

SEQ ID NO: 88050 - RNA, 21 nt, Human
guuccaucuguaguccuaacc

SEQ ID NO: 88051 - RNA, 30 nt, Human
gcugccuccguggucccugccuggcugagg

SEQ ID NO: 88052 - RNA, 21 nt, Human
uagguccaagauuuuuauaug

SEQ ID NO: 88053 - RNA, 21 nt, Human
aaaucacuggaacugagcauu

SEQ ID NO: 88054 - RNA, 16 nt, Human
ugcucuaacuucagua

SEQ ID NO: 88055 - RNA, 23 nt, Human
ugcuaacuugaacaccaagggug

SEQ ID NO: 88056 - RNA, 22 nt, Human
auuacacuccagccugagucag

SEQ ID NO: 88057 - RNA, 20 nt, Human
cugcaacccccauuuuggga

SEQ ID NO: 88058 - RNA, 23 nt, Human
accauggauacccaucacuuugg

SEQ ID NO: 88059 - RNA, 27 nt, Human
ucucccucccucucucaugaggcacag

SEQ ID NO: 88060 - RNA, 25 nt, Human
uguacuuugcagaagugaaguuuuu

SEQ ID NO: 88061 - RNA, 21 nt, Human
gcagcccaggcuggagugcag

SEQ ID NO: 88062 - RNA, 23 nt, Human
gggaagugucuucuugcccacau

SEQ ID NO: 88063 - RNA, 21 nt, Human
gacacagucuugagcugucca

SEQ ID NO: 88064 - RNA, 24 nt, Human
ugggcucacugcaggcaugcugaa

SEQ ID NO: 88065 - RNA, 24 nt, Human
cccucucggucaggguuggccagg

SEQ ID NO: 88066 - RNA, 28 nt, Human
ggccauuuugccuuucugacauuuccuu

SEQ ID NO: 88067 - RNA, 22 nt, Human
cuucaaaaugaaaacagaauga

SEQ ID NO: 88068 - RNA, 20 nt, Human
ggggcgcagcgcugagguca

SEQ ID NO: 88069 - RNA, 17 nt, Human
aggcaaaccucuguggu

SEQ ID NO: 88070 - RNA, 26 nt, Human
cccaaagugcugggauuagaggcaug

SEQ ID NO: 88071 - RNA, 20 nt, Human
uguguggucaguaggugcgg

SEQ ID NO: 88072 - RNA, 22 nt, Human
ccuagccccugucauggugucc

SEQ ID NO: 88073 - RNA, 27 nt, Human
ucaggaggcagaaggaagcagguguga

SEQ ID NO: 88074 - RNA, 20 nt, Human
cuccuucuccucaaggccag

SEQ ID NO: 88075 - RNA, 22 nt, Human
cugucucaacaacaacaacaaa

SEQ ID NO: 88076 - RNA, 22 nt, Human
gaacagugucuggugcacauaa

SEQ ID NO: 88077 - RNA, 19 nt, Human
uuaguuuggugguagcuua

SEQ ID NO: 88078 - RNA, 22 nt, Human
ccucuccaaggguuuucaccuu

SEQ ID NO: 88079 - RNA, 27 nt, Human
uuugaugucaugguccccucucuuagg

SEQ ID NO: 88080 - RNA, 21 nt, Human
uccagagcuggagugcagcgg

SEQ ID NO: 88081 - RNA, 21 nt, Human
ccguguugugagcacaggcau

SEQ ID NO: 88082 - RNA, 24 nt, Human
aguuucuggcauagaguccuggcu

SEQ ID NO: 88083 - RNA, 23 nt, Human
uuuuucuuaauaaauaaaggaca

SEQ ID NO: 88084 - RNA, 22 nt, Human
aggcugaggcagguggauugcu

SEQ ID NO: 88085 - RNA, 23 nt, Human
gcugccucugcugcgcugcgugc

SEQ ID NO: 88086 - RNA, 20 nt, Human
gcugagcagagaagaugacu

SEQ ID NO: 88087 - RNA, 21 nt, Human
ugcagccucagacuccugggu

SEQ ID NO: 88088 - RNA, 22 nt, Human
cgccuauaaucccagcacuuug

SEQ ID NO: 88089 - RNA, 22 nt, Human
cgccuauaaucucagcacucug

SEQ ID NO: 88090 - RNA, 22 nt, Human
cgccuguaaucccagcacuuua

SEQ ID NO: 88091 - RNA, 23 nt, Human
uaucuaugcauuuucuggacccg

SEQ ID NO: 88092 - RNA, 25 nt, Human
ggagaaccguucgcggaggaaaggc

SEQ ID NO: 88093 - RNA, 23 nt, Human
aaauuaacuaaggaaauauuuca

SEQ ID NO: 88094 - RNA, 21 nt, Human
uuggugagaaaacaggcucag

SEQ ID NO: 88095 - RNA, 25 nt, Human
caaaacagaucaugccaaaugaguu

SEQ ID NO: 88096 - RNA, 19 nt, Human
cuccacugaugagagaucc

SEQ ID NO: 88097 - RNA, 19 nt, Human
cucuugcugccuccugggc

SEQ ID NO: 88098 - RNA, 19 nt, Human
gaguuuguuaccuaccuua

SEQ ID NO: 88099 - RNA, 26 nt, Human
auggcucuccgggcaguagagugugu

SEQ ID NO: 88100 - RNA, 27 nt, Human
cccuccuggaauggagcuguauaacug

SEQ ID NO: 88101 - RNA, 30 nt, Human
cacagcucccuccagaagcugcaagagcuu

SEQ ID NO: 88102 - RNA, 22 nt, Human
guugccaaggcuggagugcagg

SEQ ID NO: 88103 - RNA, 27 nt, Human
ucugcugauuaucacacaucaugagcu

SEQ ID NO: 88104 - RNA, 21 nt, Human
uccauuuggcuucuucauaga

SEQ ID NO: 88105 - RNA, 23 nt, Human
aacucugcuuuuggucuugcuuc

SEQ ID NO: 88106 - RNA, 21 nt, Human
agcuaaguccggagugaagga

SEQ ID NO: 88107 - RNA, 22 nt, Human
gaagcaguuucagauaaaucau

SEQ ID NO: 88108 - RNA, 25 nt, Human
gcuccuggaccaaugcaucuuccca

SEQ ID NO: 88109 - RNA, 21 nt, Human
gagagagccaugaagcauuaa

SEQ ID NO: 88110 - RNA, 21 nt, Human
gcagguacugacagauccgua

SEQ ID NO: 88111 - RNA, 18 nt, Human
agcagccuucagugccuu

SEQ ID NO: 88112 - RNA, 20 nt, Human
agcuuucuauuaccuggaua

SEQ ID NO: 88113 - RNA, 23 nt, Human
acaacaucaagccuaaauacuga

SEQ ID NO: 88114 - RNA, 21 nt, Human
uucgaggcuuuacaguguaaa

SEQ ID NO: 88115 - RNA, 27 nt, Human
ucccuccagcccaugccaggagcuugu

SEQ ID NO: 88116 - RNA, 22 nt, Human
gaggaagagggagggauggaca

SEQ ID NO: 88117 - RNA, 25 nt, Human
ccaggggugagagggaggaaaccgg

SEQ ID NO: 88118 - RNA, 21 nt, Human
ugggcuuuucaggaagugaau

SEQ ID NO: 88119 - RNA, 24 nt, Human
ucuuccacuggaacguuucacugc

SEQ ID NO: 88120 - RNA, 18 nt, Human
auucucugggucaacaag

SEQ ID NO: 88121 - RNA, 23 nt, Human
uuagaugauaauggacaacuaua

SEQ ID NO: 88122 - RNA, 27 nt, Human
cacaggcuugguauuaacagaaucaag

SEQ ID NO: 88123 - RNA, 22 nt, Human
caagcagcagaauuguacuuga

SEQ ID NO: 88124 - RNA, 26 nt, Human
caucccucgccauugacacaucuuca

SEQ ID NO: 88125 - RNA, 22 nt, Human
aaacuccugggcuccagugauc

SEQ ID NO: 88126 - RNA, 23 nt, Human
ggggcugggggacggggcggggc

SEQ ID NO: 88127 - RNA, 20 nt, Human
uuuggaaccuuuagcacaga

SEQ ID NO: 88128 - RNA, 22 nt, Human
ucucagaacuccugugugugga

SEQ ID NO: 88129 - RNA, 19 nt, Human
accuauugaauuaccauag

SEQ ID NO: 88130 - RNA, 28 nt, Human
agcagaacuggugaggauguuugauccg

SEQ ID NO: 88131 - RNA, 20 nt, Human
auaaagcucugugggccaag

SEQ ID NO: 88132 - RNA, 25 nt, Human
uuuuuaucaaaaugucaaaauaaca

SEQ ID NO: 88133 - RNA, 24 nt, Human
gcuaagcccuacauuucuauucag

SEQ ID NO: 88134 - RNA, 24 nt, Human
cuggaaccucccugggccugucuc

SEQ ID NO: 88135 - RNA, 21 nt, Human
gucccugacucugacugcugu

SEQ ID NO: 88136 - RNA, 20 nt, Human
caguccgaagcccucccuca

SEQ ID NO: 88137 - RNA, 22 nt, Human
acaugggcagaguuucucuugc

SEQ ID NO: 88138 - RNA, 22 nt, Human
gacagcuuccuguacuggcgga

SEQ ID NO: 88139 - RNA, 25 nt, Human
cugaucuguagugguugcuguuacc

SEQ ID NO: 88140 - RNA, 23 nt, Human
ugcagggcacacuggcagagggu

SEQ ID NO: 88141 - RNA, 22 nt, Human
gcuguguccuaaaugcaaagca

SEQ ID NO: 88142 - RNA, 18 nt, Human
ggacauagccagcauuuu

SEQ ID NO: 88143 - RNA, 27 nt, Human
caggcagcacccagguuuugcacucuu

SEQ ID NO: 88144 - RNA, 21 nt, Human
acacauuuggaccacagcaug

SEQ ID NO: 88145 - RNA, 18 nt, Human
gcccaggcagggaauggc

SEQ ID NO: 88146 - RNA, 21 nt, Human
ccuaaaauucagcauuugcag

SEQ ID NO: 88147 - RNA, 21 nt, Human
uaacccuauuuuaccuagcua

SEQ ID NO: 88148 - RNA, 20 nt, Human
cacccaaguuggagugcagu

SEQ ID NO: 88149 - RNA, 27 nt, Human
ccuccauggcccugaauccuccucugc

SEQ ID NO: 88150 - RNA, 26 nt, Human
cccccaucugcucaauaucacugcuc

SEQ ID NO: 88151 - RNA, 21 nt, Human
uuguuuaauauccagaagaau

SEQ ID NO: 88152 - RNA, 24 nt, Human
aggcuggccagacuucagcuguuc

SEQ ID NO: 88153 - RNA, 21 nt, Human
gcauuuauacuuuaagcacaa

SEQ ID NO: 88154 - RNA, 24 nt, Human
augguacuuuuccacaguguacca

SEQ ID NO: 88155 - RNA, 22 nt, Human
gggaggucucuaggcugaggcg

SEQ ID NO: 88156 - RNA, 22 nt, Human
cacccaggcuggagugcagugu

SEQ ID NO: 88157 - RNA, 20 nt, Human
gugaucauucaagugcucac

SEQ ID NO: 88158 - RNA, 21 nt, Human
acaaaggccugugaaggaauu

SEQ ID NO: 88159 - RNA, 22 nt, Human
ccucagccacacccaggcacuu

SEQ ID NO: 88160 - RNA, 27 nt, Human
ccaggaagcagagguugcaguaagcug

SEQ ID NO: 88161 - RNA, 21 nt, Human
ggagagaaugaagcaaaacag

SEQ ID NO: 88162 - RNA, 24 nt, Human
ugcagcugaacugcaggggaggga

SEQ ID NO: 88163 - RNA, 23 nt, Human
ugcccacacucccagcugcugga

SEQ ID NO: 88164 - RNA, 25 nt, Human
auccucccacaauaaaggcuucuca

SEQ ID NO: 88165 - RNA, 13 nt, Human
accaaaugccugg

SEQ ID NO: 88166 - RNA, 18 nt, Human
uuccaaaucucauacaca

SEQ ID NO: 88167 - RNA, 23 nt, Human
ggcuggugggugucgggggugga

SEQ ID NO: 88168 - RNA, 27 nt, Human
ccucacacuugccacccccagaaccag

SEQ ID NO: 88169 - RNA, 19 nt, Human
aggaagcagaggcagaugg

SEQ ID NO: 88170 - RNA, 26 nt, Human
uacauacuuuaucaaugugucuuucu

SEQ ID NO: 88171 - RNA, 27 nt, Human
ggaggcugaggcaggagacucgcuuga

SEQ ID NO: 88172 - RNA, 20 nt, Human
ggccucggccucccaaagug

SEQ ID NO: 88173 - RNA, 25 nt, Human
uggcuggagcaguacuacgugggag

SEQ ID NO: 88174 - RNA, 18 nt, Human
agaguguuucuucacuca

SEQ ID NO: 88175 - RNA, 20 nt, Human
uggagcagagucccuucgcc

SEQ ID NO: 88176 - RNA, 27 nt, Human
ucaaaaauuugggauucauguagcaga

SEQ ID NO: 88177 - RNA, 23 nt, Human
aggaggaagggagggcagagggg

SEQ ID NO: 88178 - RNA, 22 nt, Human
aaguacacuuuaaaauauuuua

SEQ ID NO: 88179 - RNA, 22 nt, Human
ucuuuuuugauagaaucuugcu

SEQ ID NO: 88180 - RNA, 27 nt, Human
agggucugcagccuccuggcugugcca

SEQ ID NO: 88181 - RNA, 24 nt, Human
cgcgagacccgggucuccaggguc

SEQ ID NO: 88182 - RNA, 27 nt, Human
ucucugagcucccuagcacuguccuca

SEQ ID NO: 88183 - RNA, 22 nt, Human
ugugcucuucuucuuucuacag

SEQ ID NO: 88184 - RNA, 22 nt, Human
cucacccuauugccaguuccac

SEQ ID NO: 88185 - RNA, 29 nt, Human
ccugagccugcuucugccugcuuuccacc

SEQ ID NO: 88186 - RNA, 27 nt, Human
cacuaggucucugggcccuugugcuuc

SEQ ID NO: 88187 - RNA, 27 nt, Human
cugugugacucugggugagucccuuaa

SEQ ID NO: 88188 - RNA, 27 nt, Human
cuagggcugcgcugccagggucacuuc

SEQ ID NO: 88189 - RNA, 22 nt, Human
ccauucacugaguuuucucagc

SEQ ID NO: 88190 - RNA, 24 nt, Human
aaguaugugauuugcuuguuaugu

SEQ ID NO: 88191 - RNA, 26 nt, Human
agaggaagcaaggaggagggaggugg

SEQ ID NO: 88192 - RNA, 27 nt, Human
caggcuggagugcaguggcgugaucug

SEQ ID NO: 88193 - RNA, 22 nt, Human
guccaggcuggagugcaguggc

SEQ ID NO: 88194 - RNA, 17 nt, Human
gccugacagaagcacaa

SEQ ID NO: 88195 - RNA, 19 nt, Human
caggagaccuggcacugga

SEQ ID NO: 88196 - RNA, 21 nt, Human
gcccacugcuaguuugacuuu

SEQ ID NO: 88197 - RNA, 23 nt, Human
uucugggagaaaugagauaaaag

SEQ ID NO: 88198 - RNA, 27 nt, Human
ccccagccuacugaagagguguuuauu

SEQ ID NO: 88199 - RNA, 18 nt, Human
uuggagaaggaauuugug

SEQ ID NO: 88200 - RNA, 21 nt, Human
caguuucugugcccuuuugga

SEQ ID NO: 88201 - RNA, 27 nt, Human
ccugagcguagggugcugagcuggcgc

SEQ ID NO: 88202 - RNA, 21 nt, Human
gcuccaggacuggcgggaugg

SEQ ID NO: 88203 - RNA, 18 nt, Human
cuaaacuguacaugugaa

SEQ ID NO: 88204 - RNA, 27 nt, Human
uauauucauuucguugguuucucuccu

SEQ ID NO: 88205 - RNA, 20 nt, Human
uuguauucccagccuguguc

SEQ ID NO: 88206 - RNA, 26 nt, Human
uuccuuucagccuugcugacuucucc

SEQ ID NO: 88207 - RNA, 23 nt, Human
ucacacugcaaccgcacgugcuu

SEQ ID NO: 88208 - RNA, 22 nt, Human
acauuuauucaugccagucugu

SEQ ID NO: 88209 - RNA, 26 nt, Human
gccaucacacccggcugguuuuuugu

SEQ ID NO: 88210 - RNA, 24 nt, Human
cuucugcugacacuccugccugcu

SEQ ID NO: 88211 - RNA, 22 nt, Human
cauuuaggcuggaaaaaaguug

SEQ ID NO: 88212 - RNA, 21 nt, Human
cagccugggcgacuccaucuc

SEQ ID NO: 88213 - RNA, 27 nt, Human
gccagccugggaacauggaguggcagc

SEQ ID NO: 88214 - RNA, 21 nt, Human
cgacuuccaaguccucucaca

SEQ ID NO: 88215 - RNA, 22 nt, Human
ugcccccguuccagcugacauc

SEQ ID NO: 88216 - RNA, 22 nt, Human
cuggcuuucugucagcaggccg

SEQ ID NO: 88217 - RNA, 18 nt, Human
uugcugaggcaaagcacu

SEQ ID NO: 88218 - RNA, 23 nt, Human
aacagaagaagcagagcagauga

SEQ ID NO: 88219 - RNA, 21 nt, Human
ugagaccacacuagggcauug

SEQ ID NO: 88220 - RNA, 24 nt, Human
ugacugggacaaucagggaccugg

SEQ ID NO: 88221 - RNA, 24 nt, Human
uuuccccucugcucuggccugugu

SEQ ID NO: 88222 - RNA, 27 nt, Human
gccccaggcugaauacucagggacagc

SEQ ID NO: 88223 - RNA, 23 nt, Human
uccuggguugugaggagucgccg

SEQ ID NO: 88224 - RNA, 22 nt, Human
agccucaugaauagcugggauu

SEQ ID NO: 88225 - RNA, 21 nt, Human
acuucucaggauggggucaga

SEQ ID NO: 88226 - RNA, 24 nt, Human
ccaggaggcagaggguugcaguga

SEQ ID NO: 88227 - RNA, 24 nt, Human
gucagggacugucuguauauaucu

SEQ ID NO: 88228 - RNA, 26 nt, Human
cauggacuucuggaugcccauccacu

SEQ ID NO: 88229 - RNA, 25 nt, Human
ugguggcgggcgccuauaaucccag

SEQ ID NO: 88230 - RNA, 25 nt, Human
ugguggcaggcgccuguaaucccag

SEQ ID NO: 88231 - RNA, 21 nt, Human
gucacuccccacacggaguag

SEQ ID NO: 88232 - RNA, 22 nt, Human
cuuucaaauccuucaucauguc

SEQ ID NO: 88233 - RNA, 30 nt, Human
gggaacagagaagagacaggccacuaaggu

SEQ ID NO: 88234 - RNA, 24 nt, Human
gcauaggaaaccacacagacuugg

SEQ ID NO: 88235 - RNA, 24 nt, Human
ccauucacugcuagcacaggcucc

SEQ ID NO: 88236 - RNA, 23 nt, Human
ccucugaagaggaguugcuugau

SEQ ID NO: 88237 - RNA, 22 nt, Human
uuuccacccucaccugcccccu

SEQ ID NO: 88238 - RNA, 20 nt, Human
gcuaaaccauuacaauguua

SEQ ID NO: 88239 - RNA, 23 nt, Human
uuugggccacugcacucuagccu

SEQ ID NO: 88240 - RNA, 24 nt, Human
accaguuuuugauaaauuuuuuaa

SEQ ID NO: 88241 - RNA, 23 nt, Human
ugcacccaggcugcagggugagg

SEQ ID NO: 88242 - RNA, 22 nt, Human
gcagguugaucaccugagguca

SEQ ID NO: 88243 - RNA, 26 nt, Human
aggcugaguggaguucacucacaugg

SEQ ID NO: 88244 - RNA, 21 nt, Human
uaacauccacuggucaacucu

SEQ ID NO: 88245 - RNA, 23 nt, Human
guuucugucuucuguuccuucua

SEQ ID NO: 88246 - RNA, 28 nt, Human
cacgagguuaaagaagcugcauguuaag

SEQ ID NO: 88247 - RNA, 22 nt, Human
cccugcaggucaucaugguuuu

SEQ ID NO: 88248 - RNA, 25 nt, Human
ugagaauaaacugcagacugaaaga

SEQ ID NO: 88249 - RNA, 27 nt, Human
ugcagugaccacuuauucuguauugcc

SEQ ID NO: 88250 - RNA, 23 nt, Human
acaauuccaucucguuucuucuu

SEQ ID NO: 88251 - RNA, 21 nt, Human
ccugugaaugccacugccuuc

SEQ ID NO: 88252 - RNA, 20 nt, Human
cugaagagaccaugucuuuu

SEQ ID NO: 88253 - RNA, 21 nt, Human
guucuugucuuuaggaugacc

SEQ ID NO: 88254 - RNA, 22 nt, Human
gagcgagagucugucucaaaag

SEQ ID NO: 88255 - RNA, 24 nt, Human
cucuggcuucucuccucagacuuc

SEQ ID NO: 88256 - RNA, 25 nt, Human
ucucuuugcugaauuaaugaguucu

SEQ ID NO: 88257 - RNA, 27 nt, Human
ccugccuggcucccugccaggcucccu

SEQ ID NO: 88258 - RNA, 22 nt, Human
gucugggcaaguauuugacuca

SEQ ID NO: 88259 - RNA, 20 nt, Human
uuccauccugucaccaugac

SEQ ID NO: 88260 - RNA, 23 nt, Human
cacaucucaguuaucuaaacuag

SEQ ID NO: 88261 - RNA, 24 nt, Human
auugcuaauaaccuguggcucaau

SEQ ID NO: 88262 - RNA, 23 nt, Human
gucaucuggcaguguugcgcguc

SEQ ID NO: 88263 - RNA, 21 nt, Human
ccacccucucuccaccugccu

SEQ ID NO: 88264 - RNA, 25 nt, Human
uucaguuuauuuccacuauuuucaa

SEQ ID NO: 88265 - RNA, 25 nt, Human
ggggaagaucuguuguugcaguugc

SEQ ID NO: 88266 - RNA, 29 nt, Human
gccucccugcagccaccagacuuggccuc

SEQ ID NO: 88267 - RNA, 21 nt, Human
uuaacaacagccaggagcuuc

SEQ ID NO: 88268 - RNA, 21 nt, Human
cagccucagccccaggcacag

SEQ ID NO: 88269 - RNA, 21 nt, Human
guuuugagcaauaaacuaaua

SEQ ID NO: 88270 - RNA, 20 nt, Human
acggagaagagaaggacuag

SEQ ID NO: 88271 - RNA, 21 nt, Human
gcuguuggccucgccugggcc

SEQ ID NO: 88272 - RNA, 23 nt, Human
gccuggcaccagcaccuuccuac

SEQ ID NO: 88273 - RNA, 22 nt, Human
auccggguguggaaaucucacu

SEQ ID NO: 88274 - RNA, 26 nt, Human
ccugcaggcagacgaggccuuugcuu

SEQ ID NO: 88275 - RNA, 17 nt, Human
ccccacugcugcccucc

SEQ ID NO: 88276 - RNA, 22 nt, Human
cccagaccccagccuccccucc

SEQ ID NO: 88277 - RNA, 22 nt, Human
uucgccuucuugccagccacau

SEQ ID NO: 88278 - RNA, 20 nt, Human
uuccauuuccccucugcacc

SEQ ID NO: 88279 - RNA, 23 nt, Human
ugcucucugcagggcaccaccuu

SEQ ID NO: 88280 - RNA, 24 nt, Human
ugacugccagcucuaaaucucgau

SEQ ID NO: 88281 - RNA, 28 nt, Human
uuuauuuuucugcaccuuccuuucuucc

SEQ ID NO: 88282 - RNA, 23 nt, Human
ggcuucccuggcuggugccugag

SEQ ID NO: 88283 - RNA, 24 nt, Human
ggccugaauuuuauuagcuucauu

SEQ ID NO: 88284 - RNA, 26 nt, Human
ccuguucucuagcugugaucuuacca

SEQ ID NO: 88285 - RNA, 21 nt, Human
gaagaagaagaaaaaaguuuc

SEQ ID NO: 88286 - RNA, 22 nt, Human
caucagugcacaaaucauucca

SEQ ID NO: 88287 - RNA, 27 nt, Human
agcucacuucuuuggaggcaccugucc

SEQ ID NO: 88288 - RNA, 27 nt, Human
auacuauauuaacuuuuauuacgguga

SEQ ID NO: 88289 - RNA, 22 nt, Human
gagcccccgaccgagagcccag

SEQ ID NO: 88290 - RNA, 21 nt, Human
aagcacuacauuuuagcucug

SEQ ID NO: 88291 - RNA, 18 nt, Human
gccuuacuucucuugccu

SEQ ID NO: 88292 - RNA, 20 nt, Human
ccuagcauccugcugccuuc

SEQ ID NO: 88293 - RNA, 21 nt, Human
ucucauuaacaaugaauuuau

SEQ ID NO: 88294 - RNA, 23 nt, Human
uguccuucagggagcagagcaga

SEQ ID NO: 88295 - RNA, 23 nt, Human
aucuugccacugcacaccagccu

SEQ ID NO: 88296 - RNA, 22 nt, Human
ggagaaacucuugucaagaaug

SEQ ID NO: 88297 - RNA, 27 nt, Human
guaugcccugcgcuccuccacagccug

SEQ ID NO: 88298 - RNA, 23 nt, Human
ggagcgcucagaccucccucccu

SEQ ID NO: 88299 - RNA, 25 nt, Human
gcaucccagcaccugccuccucguu

SEQ ID NO: 88300 - RNA, 20 nt, Human
agcaagguuggaaacagggc

SEQ ID NO: 88301 - RNA, 21 nt, Human
uagcccaggccagagugcagu

SEQ ID NO: 88302 - RNA, 20 nt, Human
acacuaaccaccucaugcag

SEQ ID NO: 88303 - RNA, 24 nt, Human
cacccaggcugggaauugcagugg

SEQ ID NO: 88304 - RNA, 24 nt, Human
uucuucccuuuccaaagguuucug

SEQ ID NO: 88305 - RNA, 16 nt, Human
cuucagagccuagcca

SEQ ID NO: 88306 - RNA, 23 nt, Human
ugucuucauuuugggaugcagcu

SEQ ID NO: 88307 - RNA, 22 nt, Human
ugauguucuugucuuuggagcu

SEQ ID NO: 88308 - RNA, 23 nt, Human
ugcuagccauggucaucugacag

SEQ ID NO: 88309 - RNA, 25 nt, Human
guuuucgccucuucugugaucacca

SEQ ID NO: 88310 - RNA, 27 nt, Human
gaagcagcgaacauugaaucucaggga

SEQ ID NO: 88311 - RNA, 23 nt, Human
cucguugugcucaucugugaagc

SEQ ID NO: 88312 - RNA, 19 nt, Human
uauguauaugcacauacac

SEQ ID NO: 88313 - RNA, 26 nt, Human
ucuccaucugcccuuaaaugcuguau

SEQ ID NO: 88314 - RNA, 22 nt, Human
gggaguuagagguugcagugag

SEQ ID NO: 88315 - RNA, 22 nt, Human
cccaacguacugggauuacagg

SEQ ID NO: 88316 - RNA, 20 nt, Human
ucaaaaguuuugaaguuuga

SEQ ID NO: 88317 - RNA, 29 nt, Human
ccugugcgggcaguggccccggugaccuu

SEQ ID NO: 88318 - RNA, 21 nt, Human
ugcuuuguuauuaauauugug

SEQ ID NO: 88319 - RNA, 19 nt, Human
ucucccacuugcucagcag

SEQ ID NO: 88320 - RNA, 23 nt, Human
cacuccuuggcuggaggcagugc

SEQ ID NO: 88321 - RNA, 25 nt, Human
ucacugcagcuccugucacaagcug

SEQ ID NO: 88322 - RNA, 25 nt, Human
ucugacaaccucuuggucgaccuua

SEQ ID NO: 88323 - RNA, 21 nt, Human
agcuggacugcaggggaggcc

SEQ ID NO: 88324 - RNA, 23 nt, Human
uuagggucucuaccaaguagaca

SEQ ID NO: 88325 - RNA, 20 nt, Human
cagaauuacccagucaucag

SEQ ID NO: 88326 - RNA, 27 nt, Human
ugcccccagcugcuccucgcaguucgg

SEQ ID NO: 88327 - RNA, 23 nt, Human
gggcuuucuuuucaggccagcgu

SEQ ID NO: 88328 - RNA, 26 nt, Human
ggagcccagaaggaacauguguuucc

SEQ ID NO: 88329 - RNA, 22 nt, Human
aggugcuucuggagacaagagc

SEQ ID NO: 88330 - RNA, 22 nt, Human
cgccgaauggcagccuccagaa

SEQ ID NO: 88331 - RNA, 24 nt, Human
acagacugcauguaguuggguaua

SEQ ID NO: 88332 - RNA, 22 nt, Human
cccacccccuguauucccaccc

SEQ ID NO: 88333 - RNA, 27 nt, Human
uggcaaagagaauacaaaugaaacccc

SEQ ID NO: 88334 - RNA, 22 nt, Human
uguugccugggcuggagaacag

SEQ ID NO: 88335 - RNA, 21 nt, Human
uagggaacaaaaagugcugcu

SEQ ID NO: 88336 - RNA, 23 nt, Human
ugugaccacaggcugguguguag

SEQ ID NO: 88337 - RNA, 21 nt, Human
agaagaagagacagagcugcc

SEQ ID NO: 88338 - RNA, 21 nt, Human
gucuacauucaguaucuuuag

SEQ ID NO: 88339 - RNA, 20 nt, Human
caaagaugcuaaaucuugcu

SEQ ID NO: 88340 - RNA, 27 nt, Human
aaaggaguacccucucuggucaaguac

SEQ ID NO: 88341 - RNA, 18 nt, Human
cuuuguguuuagcuaccu

SEQ ID NO: 88342 - RNA, 26 nt, Human
ccaacaucauuccagcaguugaaaaa

SEQ ID NO: 88343 - RNA, 23 nt, Human
guggccaggcaggcgggggcugc

SEQ ID NO: 88344 - RNA, 21 nt, Human
ucacugcagccuugacuccgu

SEQ ID NO: 88345 - RNA, 23 nt, Human
ugcaggagcaugccaucaugccc

SEQ ID NO: 88346 - RNA, 22 nt, Human
uggaugccugcugcaucuuccc

SEQ ID NO: 88347 - RNA, 25 nt, Human
guugcaaauaacucuaaaacuuauu

SEQ ID NO: 88348 - RNA, 20 nt, Human
acugaggcaggcauggaguu

SEQ ID NO: 88349 - RNA, 23 nt, Human
cgaguagcugggauuacaggcgu

SEQ ID NO: 88350 - RNA, 25 nt, Human
uguccuguuuucaccagaggcacag

SEQ ID NO: 88351 - RNA, 21 nt, Human
gcccaaauguuccauuauuca

SEQ ID NO: 88352 - RNA, 22 nt, Human
gaugaauccagacaggagggau

SEQ ID NO: 88353 - RNA, 22 nt, Human
cuuucuggcugaaaacuugccu

SEQ ID NO: 88354 - RNA, 19 nt, Human
ccaaacccacccaccaagg

SEQ ID NO: 88355 - RNA, 20 nt, Human
gcagggcucucccuuugcuu

SEQ ID NO: 88356 - RNA, 23 nt, Human
gccuaggagggagccucagcaua

SEQ ID NO: 88357 - RNA, 21 nt, Human
uuacccagcaaaaagugaguu

SEQ ID NO: 88358 - RNA, 23 nt, Human
uuugugcacucugcucuaaaaca

SEQ ID NO: 88359 - RNA, 22 nt, Human
auggacuuucaggaauuuugua

SEQ ID NO: 88360 - RNA, 25 nt, Human
cagccuggccuugccuucacagggc

SEQ ID NO: 88361 - RNA, 27 nt, Human
aagacuuguuuuaugcucagggucaau

SEQ ID NO: 88362 - RNA, 27 nt, Human
ggcagagcaucuucuggccacgcccac

SEQ ID NO: 88363 - RNA, 21 nt, Human
cuguugccugggcagggggaa

SEQ ID NO: 88364 - RNA, 21 nt, Human
ggaggcuggcgcuagcgggcg

SEQ ID NO: 88365 - RNA, 28 nt, Human
uguucacuuacugacaugugaagaaggg

SEQ ID NO: 88366 - RNA, 22 nt, Human
aggauacguacaccucuugccu

SEQ ID NO: 88367 - RNA, 21 nt, Human
caguauguucuagcuacuuca

SEQ ID NO: 88368 - RNA, 24 nt, Human
ccugccagggaacuggccugcugc

SEQ ID NO: 88369 - RNA, 26 nt, Human
ugcccagcuuggagugccacauggcc

SEQ ID NO: 88370 - RNA, 25 nt, Human
cccccaugccuguccuccaggcugg

SEQ ID NO: 88371 - RNA, 24 nt, Human
gugaacaaacaagcaacaguuuau

SEQ ID NO: 88372 - RNA, 27 nt, Human
ucaggaggcugaggcaggaggauugcc

SEQ ID NO: 88373 - RNA, 16 nt, Human
uucaucuucaccagag

SEQ ID NO: 88374 - RNA, 22 nt, Human
ucugucccacugcugcuucuug

SEQ ID NO: 88375 - RNA, 27 nt, Human
gugguccagggugagagucacaccaca

SEQ ID NO: 88376 - RNA, 25 nt, Human
gcagugaaguauaaucagcacuuug

SEQ ID NO: 88377 - RNA, 24 nt, Human
cuucuccuccccugcucgcugcag

SEQ ID NO: 88378 - RNA, 22 nt, Human
cgcacgguacccgugcugcagu

SEQ ID NO: 88379 - RNA, 22 nt, Human
gaacuccuggccucaaaugauc

SEQ ID NO: 88380 - RNA, 22 nt, Human
gguucacugcagucuugaccuu

SEQ ID NO: 88381 - RNA, 20 nt, Human
ccauuuuuccuccacugaac

SEQ ID NO: 88382 - RNA, 22 nt, Human
cagcagcaccugcccuaccugc

SEQ ID NO: 88383 - RNA, 20 nt, Human
agggagucccagagcccugg

SEQ ID NO: 88384 - RNA, 27 nt, Human
gggaaucacuggggcagagggcgccug

SEQ ID NO: 88385 - RNA, 22 nt, Human
uugcccaggcuggagcgcagug

SEQ ID NO: 88386 - RNA, 32 nt, Human
gcuucugaguuuucccuucuuuuuauacuguu

SEQ ID NO: 88387 - RNA, 19 nt, Human
cagcgcuggcccugccucc

SEQ ID NO: 88388 - RNA, 30 nt, Human
auuguguccuccuccaccuucccugugcuc

SEQ ID NO: 88389 - RNA, 24 nt, Human
cuccuaaggcuccccaccccgaaa

SEQ ID NO: 88390 - RNA, 31 nt, Human
uuccagugccuuaacuacuuaccggaucccu

SEQ ID NO: 88391 - RNA, 16 nt, Human
gcugccccugccugug

SEQ ID NO: 88392 - RNA, 21 nt, Human
gccaccacaccccagauccca

SEQ ID NO: 88393 - RNA, 22 nt, Human
cucaaagaaauuuccacucagg

SEQ ID NO: 88394 - RNA, 23 nt, Human
augucuguugccaaacagccugc

SEQ ID NO: 88395 - RNA, 20 nt, Human
aggcuacaaccacuagcacg

SEQ ID NO: 88396 - RNA, 23 nt, Human
acucaccucuauuuugucaguuc

SEQ ID NO: 88397 - RNA, 24 nt, Human
uuucacugcaggcagugcuauuuc

SEQ ID NO: 88398 - RNA, 25 nt, Human
uccacuuugugcuaacccauucaua

SEQ ID NO: 88399 - RNA, 19 nt, Human
gcauacuuuucuagcuacc

SEQ ID NO: 88400 - RNA, 23 nt, Human
guaggaaagugccacaauuguca

SEQ ID NO: 88401 - RNA, 25 nt, Human
auaaagugaugcaaacagaaauucc

SEQ ID NO: 88402 - RNA, 23 nt, Human
ucuccauccagcucacgccuggu

SEQ ID NO: 88403 - RNA, 23 nt, Human
aggcuuuucaaccacaaaacuca

SEQ ID NO: 88404 - RNA, 23 nt, Human
acagaucuuuuguucucuguaau

SEQ ID NO: 88405 - RNA, 23 nt, Human
acucccgauauucccaggcccuc

SEQ ID NO: 88406 - RNA, 24 nt, Human
uuuuuaaaaacaucuacuacacuc

SEQ ID NO: 88407 - RNA, 19 nt, Human
agaaaugugcugcaaagag

SEQ ID NO: 88408 - RNA, 21 nt, Human
cucuccaggagccucagccca

SEQ ID NO: 88409 - RNA, 27 nt, Human
ccacuggucuacugaguugcagucaca

SEQ ID NO: 88410 - RNA, 21 nt, Human
ggggacagaaaaguguguaga

SEQ ID NO: 88411 - RNA, 27 nt, Human
uggccuuuuugcauauaacucucgggu

SEQ ID NO: 88412 - RNA, 22 nt, Human
ucugcccucacaugcacaggga

SEQ ID NO: 88413 - RNA, 22 nt, Human
cuguggacucaacaguuugugg

SEQ ID NO: 88414 - RNA, 17 nt, Human
gcuuuugaaaguguuuu

SEQ ID NO: 88415 - RNA, 19 nt, Human
gacaugcucacacauuaca

SEQ ID NO: 88416 - RNA, 26 nt, Human
gcucacugcagccccucugccccuau

SEQ ID NO: 88417 - RNA, 21 nt, Human
cuccuguuuuucuggguggcc

SEQ ID NO: 88418 - RNA, 20 nt, Human
ccaacaacagcagacuucua

SEQ ID NO: 88419 - RNA, 28 nt, Human
caaugucugucucuguugcuucggggca

SEQ ID NO: 88420 - RNA, 21 nt, Human
aucucaguguaucuagucacu

SEQ ID NO: 88421 - RNA, 26 nt, Human
ucugcauuuacacagauuugagucag

SEQ ID NO: 88422 - RNA, 23 nt, Human
uccuccaccucucccauuccauc

SEQ ID NO: 88423 - RNA, 23 nt, Human
uggucccagcagguaugggcagg

SEQ ID NO: 88424 - RNA, 27 nt, Human
uuuccaaaaucuuuguaguaguucaua

SEQ ID NO: 88425 - RNA, 24 nt, Human
accuguacagcgcucggcacuuug

SEQ ID NO: 88426 - RNA, 18 nt, Human
cuaggaacccccaaaagg

SEQ ID NO: 88427 - RNA, 22 nt, Human
ccuggguggcuacucugugcca

SEQ ID NO: 88428 - RNA, 19 nt, Human
aacagcuucauggggugga

SEQ ID NO: 88429 - RNA, 26 nt, Human
ccuccuaaccuggguuuuuuacacgc

SEQ ID NO: 88430 - RNA, 29 nt, Human
cacaucugcuccugcucucucuccuccag

SEQ ID NO: 88431 - RNA, 25 nt, Human
ggcagaguaguugaucucacacaac

SEQ ID NO: 88432 - RNA, 22 nt, Human
caaacucaacacaauuguaagu

SEQ ID NO: 88433 - RNA, 20 nt, Human
cccagaggagccacuccuau

SEQ ID NO: 88434 - RNA, 21 nt, Human
auuuuucuagagguuggcuuu

SEQ ID NO: 88435 - RNA, 18 nt, Human
ccuuucucccacccagcc

SEQ ID NO: 88436 - RNA, 23 nt, Human
gcccugcccaugcccacacuaca

SEQ ID NO: 88437 - RNA, 21 nt, Human
ccccaccuuuguucugaggcc

SEQ ID NO: 88438 - RNA, 24 nt, Human
ggaacagagaagagauuacaccag

SEQ ID NO: 88439 - RNA, 22 nt, Human
gcuuacugcaaccuccgccuuc

SEQ ID NO: 88440 - RNA, 29 nt, Human
ccuggaaaaggagcuucaguauugugggg

SEQ ID NO: 88441 - RNA, 21 nt, Human
ugggaaagccuacaguuggaa

SEQ ID NO: 88442 - RNA, 27 nt, Human
gcaaggcacggacgacugugcagacac

SEQ ID NO: 88443 - RNA, 23 nt, Human
ggagguuggagagaggaggcagg

SEQ ID NO: 88444 - RNA, 22 nt, Human
ucuuagcagcuaggauucucaa

SEQ ID NO: 88445 - RNA, 21 nt, Human
caugcugcugcucaaaaugcc

SEQ ID NO: 88446 - RNA, 21 nt, Human
aaggguggccccuccucucag

SEQ ID NO: 88447 - RNA, 26 nt, Human
aguggagccuugcccacagggcugcu

SEQ ID NO: 88448 - RNA, 17 nt, Human
ccuacuucuccagccua

SEQ ID NO: 88449 - RNA, 22 nt, Human
ccauuucacuaaggaaccuuga

SEQ ID NO: 88450 - RNA, 22 nt, Human
agaaugagauugcaauugaaaa

SEQ ID NO: 88451 - RNA, 26 nt, Human
ggauguauuuaaaugaaugcugguca

SEQ ID NO: 88452 - RNA, 26 nt, Human
uaguaugauuaguauagcuuucucca

SEQ ID NO: 88453 - RNA, 24 nt, Human
auguaauugacaggauggcugcug

SEQ ID NO: 88454 - RNA, 25 nt, Human
gggagaccuuccaaaagcaaaaaca

SEQ ID NO: 88455 - RNA, 26 nt, Human
gcuuccuggaaguggagaggauccuu

SEQ ID NO: 88456 - RNA, 25 nt, Human
aucuucuuuuaaaaauaccacaguu

SEQ ID NO: 88457 - RNA, 27 nt, Human
uuauuuuauuugccuccagucuggcua

SEQ ID NO: 88458 - RNA, 23 nt, Human
aaggauucuuucaacuucuuuau

SEQ ID NO: 88459 - RNA, 26 nt, Human
acccugcauugcagguuggcaccuua

SEQ ID NO: 88460 - RNA, 27 nt, Human
uaccuuacucuguuuagaaaaguauac

SEQ ID NO: 88461 - RNA, 21 nt, Human
cccagcacucugggaggcuga

SEQ ID NO: 88462 - RNA, 23 nt, Human
ucuccaacuccugaccucaggua

SEQ ID NO: 88463 - RNA, 26 nt, Human
agauaaauccuuaacauuucucucca

SEQ ID NO: 88464 - RNA, 27 nt, Human
gcugccucuuugcugcuuuguuuuccu

SEQ ID NO: 88465 - RNA, 26 nt, Human
ugaaccaagaucgcggcgcugcacuc

SEQ ID NO: 88466 - RNA, 22 nt, Human
guuaagguggcguguugcagug

SEQ ID NO: 88467 - RNA, 22 nt, Human
gccugagccaccgcguccggcc

SEQ ID NO: 88468 - RNA, 26 nt, Human
accugccuacggagggugggcucuga

SEQ ID NO: 88469 - RNA, 27 nt, Human
gaagaauuacuagguugccauguggcu

SEQ ID NO: 88470 - RNA, 18 nt, Human
ccuuucucccugcagccu

SEQ ID NO: 88471 - RNA, 24 nt, Human
gacucccgucuccuccuguccucc

SEQ ID NO: 88472 - RNA, 24 nt, Human
agggcuggcuauugagaacuggaa

SEQ ID NO: 88473 - RNA, 23 nt, Human
ugcccagguucagguguaucgug

SEQ ID NO: 88474 - RNA, 23 nt, Human
uguuuuuagagcaugcaaucuua

SEQ ID NO: 88475 - RNA, 24 nt, Human
gccugcuuucucagacccucaucu

SEQ ID NO: 88476 - RNA, 27 nt, Human
cugccucuccaucaccaucucucucca

SEQ ID NO: 88477 - RNA, 24 nt, Human
caagccuugugaccugggaggcag

SEQ ID NO: 88478 - RNA, 23 nt, Human
cugcccaggugaccaguccuggg

SEQ ID NO: 88479 - RNA, 26 nt, Human
ccagccgcccgcauguggcugccacg

SEQ ID NO: 88480 - RNA, 24 nt, Human
aaagagaccaccuucacuuguuga

SEQ ID NO: 88481 - RNA, 19 nt, Human
uuuaaggcuccaggaaaga

SEQ ID NO: 88482 - RNA, 26 nt, Human
augaugauaacagaacuuuuccucug

SEQ ID NO: 88483 - RNA, 23 nt, Human
augaggaaacugcacuguuuuau

SEQ ID NO: 88484 - RNA, 22 nt, Human
cagaagcccgcacgcaccucgc

SEQ ID NO: 88485 - RNA, 24 nt, Human
cagccucagggccagggagccaag

SEQ ID NO: 88486 - RNA, 21 nt, Human
gcuuugcagugagugcugcuc

SEQ ID NO: 88487 - RNA, 19 nt, Human
cagaugcucacagaccaca

SEQ ID NO: 88488 - RNA, 27 nt, Human
acucacuggcauauuucugagguaucu

SEQ ID NO: 88489 - RNA, 20 nt, Human
acacuggucagcugguuucu

SEQ ID NO: 88490 - RNA, 20 nt, Human
ucucucucgcugcguccuca

SEQ ID NO: 88491 - RNA, 26 nt, Human
cucuccucagaagaaagaaucuuucc

SEQ ID NO: 88492 - RNA, 22 nt, Human
cagcucuuuacucuaaacccuu

SEQ ID NO: 88493 - RNA, 26 nt, Human
uuuccuaugggaacaauugaaguaaa

SEQ ID NO: 88494 - RNA, 23 nt, Human
acuuguauuccuaacuguuuugu

SEQ ID NO: 88495 - RNA, 22 nt, Human
gaccccagccgggcgugaucuc

SEQ ID NO: 88496 - RNA, 27 nt, Human
aggugcccgcuacuucccagaaccucc

SEQ ID NO: 88497 - RNA, 22 nt, Human
ggggaucacuggcuggccugag

SEQ ID NO: 88498 - RNA, 20 nt, Human
ucuggagaaggugggcacug

SEQ ID NO: 88499 - RNA, 22 nt, Human
uugaucuccuggaggcugguuc

SEQ ID NO: 88500 - RNA, 27 nt, Human
uccuccagggccucugguuuguuguau

SEQ ID NO: 88501 - RNA, 28 nt, Human
uccaugugucaagugggucuuguguugc

SEQ ID NO: 88502 - RNA, 27 nt, Human
ucaugccaccugccagguaguguagua

SEQ ID NO: 88503 - RNA, 22 nt, Human
gcuggggucucugcacacagcu

SEQ ID NO: 88504 - RNA, 21 nt, Human
cagucccagggcuuagccgga

SEQ ID NO: 88505 - RNA, 21 nt, Human
auggaugcagcacagacucag

SEQ ID NO: 88506 - RNA, 24 nt, Human
cuggggaggagcuuuguuuugggg

SEQ ID NO: 88507 - RNA, 23 nt, Human
gggcuggcuggaacuagccuaag

SEQ ID NO: 88508 - RNA, 19 nt, Human
aacucucgcuuucuuuuua

SEQ ID NO: 88509 - RNA, 26 nt, Human
ccagggcacugacaggacaggagagc

SEQ ID NO: 88510 - RNA, 24 nt, Human
ggggaggcugagacugcagaggag

SEQ ID NO: 88511 - RNA, 23 nt, Human
cuuacucugugccugaccuugug

SEQ ID NO: 88512 - RNA, 26 nt, Human
ggaguguguaagguauauguuuuaua

SEQ ID NO: 88513 - RNA, 26 nt, Human
ggagugugaggagaggguggcaucag

SEQ ID NO: 88514 - RNA, 27 nt, Human
gcugccucuccuuucuuccucuugccu

SEQ ID NO: 88515 - RNA, 21 nt, Human
ugcugcugaaacuguguacga

SEQ ID NO: 88516 - RNA, 21 nt, Human
ucagaaguggaagccagccac

SEQ ID NO: 88517 - RNA, 30 nt, Human
auugcuguuaacuacuacugauaacugagc

SEQ ID NO: 88518 - RNA, 23 nt, Human
ccauuguugucugcaacucugaa

SEQ ID NO: 88519 - RNA, 20 nt, Human
gacggacucagacuccuggc

SEQ ID NO: 88520 - RNA, 21 nt, Human
cuggaccccugccccucucug

SEQ ID NO: 88521 - RNA, 19 nt, Human
acuccucccuucccucgcu

SEQ ID NO: 88522 - RNA, 21 nt, Human
gcaggaaguaacuacagggcc

SEQ ID NO: 88523 - RNA, 21 nt, Human
ccugccccuugguugagaacc

SEQ ID NO: 88524 - RNA, 22 nt, Human
aauaaaucaccccagucuuaau

SEQ ID NO: 88525 - RNA, 27 nt, Human
agcuuuuuaauuaaaugagccaagugg

SEQ ID NO: 88526 - RNA, 23 nt, Human
uacuauguaaauucacagcagua

SEQ ID NO: 88527 - RNA, 19 nt, Human
ccagugaugcucugugcca

SEQ ID NO: 88528 - RNA, 19 nt, Human
cucucugcucaucaugccc

SEQ ID NO: 88529 - RNA, 27 nt, Human
caggagaaucagccuggggccugggga

SEQ ID NO: 88530 - RNA, 22 nt, Human
gaggcaauaaaagcugcaguga

SEQ ID NO: 88531 - RNA, 24 nt, Human
agcuagaaccugcugcaagucacu

SEQ ID NO: 88532 - RNA, 24 nt, Human
ccaggauaaggagacugaggcuua

SEQ ID NO: 88533 - RNA, 22 nt, Human
gauuguuuccagucucugggcc

SEQ ID NO: 88534 - RNA, 20 nt, Human
uuuagcaacaguauucugca

SEQ ID NO: 88535 - RNA, 19 nt, Human
cuucaggcugccaggggag

SEQ ID NO: 88536 - RNA, 21 nt, Human
ccuccaucuuacucugcccua

SEQ ID NO: 88537 - RNA, 21 nt, Human
uguauuuaaaugaaugcuggu

SEQ ID NO: 88538 - RNA, 26 nt, Human
auuguccuccuccuccuggcucggcc

SEQ ID NO: 88539 - RNA, 26 nt, Human
ccagccugggcaacauagcgagaccu

SEQ ID NO: 88540 - RNA, 22 nt, Human
gggaguggauucuaaaugugau

SEQ ID NO: 88541 - RNA, 19 nt, Human
ccugaguggggauuacagg

SEQ ID NO: 88542 - RNA, 23 nt, Human
uuguugccaggcuggagugcagu

SEQ ID NO: 88543 - RNA, 23 nt, Human
ucacaaaccuccaaguagcucca

SEQ ID NO: 88544 - RNA, 20 nt, Human
caggccaggcuccagcacuu

SEQ ID NO: 88545 - RNA, 23 nt, Human
cucuaguaaguauuuaguuauau

SEQ ID NO: 88546 - RNA, 19 nt, Human
cuuccacucuccuugcuac

SEQ ID NO: 88547 - RNA, 21 nt, Human
gcaaugcuucugccucagcuu

SEQ ID NO: 88548 - RNA, 24 nt, Human
auuuuucucgagugacuagaccaa

SEQ ID NO: 88549 - RNA, 23 nt, Human
ugaaggcacaagcugcuguuaua

SEQ ID NO: 88550 - RNA, 26 nt, Human
uuucugcuuuaaaggcauguguguuu

SEQ ID NO: 88551 - RNA, 22 nt, Human
ccagcauggugaaaccccaucu

SEQ ID NO: 88552 - RNA, 26 nt, Human
gaggggacagggaggagcagaagcca

SEQ ID NO: 88553 - RNA, 22 nt, Human
ccacugcacccuagcuugggug

SEQ ID NO: 88554 - RNA, 23 nt, Human
uccuagcucucccagugaacucc

SEQ ID NO: 88555 - RNA, 26 nt, Human
cuuugaacuuuccaaagugcagccac

SEQ ID NO: 88556 - RNA, 18 nt, Human
acccggacacuugcucug

SEQ ID NO: 88557 - RNA, 22 nt, Human
cuuccaaaaccugcuuccuuca

SEQ ID NO: 88558 - RNA, 26 nt, Human
agcugcacuaucacgagccuuuguuu

SEQ ID NO: 88559 - RNA, 23 nt, Human
uguugcccaggcuggggugcagu

SEQ ID NO: 88560 - RNA, 25 nt, Human
ggcugagacccgagaagggagccag

SEQ ID NO: 88561 - RNA, 19 nt, Human
ggacuucucuugccuggag

SEQ ID NO: 88562 - RNA, 22 nt, Human
aggacaccaaacuguucugcuu

SEQ ID NO: 88563 - RNA, 23 nt, Human
cuguguaaguauaugcaagugua

SEQ ID NO: 88564 - RNA, 19 nt, Human
ccauccagcagcgcuaagg

SEQ ID NO: 88565 - RNA, 22 nt, Human
cccucccuuccuuccucugccg

SEQ ID NO: 88566 - RNA, 25 nt, Human
aggcauaugcaauauuuacauuuuu

SEQ ID NO: 88567 - RNA, 22 nt, Human
uugaggcagcagaauugcuuga

SEQ ID NO: 88568 - RNA, 25 nt, Human
cucaccuuagagcuucugaguuucc

SEQ ID NO: 88569 - RNA, 19 nt, Human
agacuuuaauuucucugca

SEQ ID NO: 88570 - RNA, 21 nt, Human
cuacauugugcugcaccuggu

SEQ ID NO: 88571 - RNA, 27 nt, Human
cucagcaccucacucguuauucuccau

SEQ ID NO: 88572 - RNA, 22 nt, Human
ucaaggagaagaaucauuuguu

SEQ ID NO: 88573 - RNA, 15 nt, Human
uuucccuuaugucca

SEQ ID NO: 88574 - RNA, 21 nt, Human
cggcccagacugaagugcagu

SEQ ID NO: 88575 - RNA, 20 nt, Human
gcgggcggaucaugagguca

SEQ ID NO: 88576 - RNA, 22 nt, Human
aucgcuugagcccaggaguugg

SEQ ID NO: 88577 - RNA, 25 nt, Human
ucuccucccucagcucucugggacc

SEQ ID NO: 88578 - RNA, 25 nt, Human
ccuucucuccuuccucuuccucaug

SEQ ID NO: 88579 - RNA, 21 nt, Human
cgugccccuccagcgccuauc

SEQ ID NO: 88580 - RNA, 21 nt, Human
caguucaguccacaggcaugg

SEQ ID NO: 88581 - RNA, 21 nt, Human
uaguucagccacaaaguaguu

SEQ ID NO: 88582 - RNA, 27 nt, Human
gggagcugccuacagguuggaccggga

SEQ ID NO: 88583 - RNA, 23 nt, Human
acaacaaaagcuggcaggcugac

SEQ ID NO: 88584 - RNA, 19 nt, Human
ccaacuacaaaagaaaaau

SEQ ID NO: 88585 - RNA, 18 nt, Human
uaggugcuucuucacuuc

SEQ ID NO: 88586 - RNA, 23 nt, Human
aagagugagcgcgggguggggga

SEQ ID NO: 88587 - RNA, 26 nt, Human
ugcacacccaucaucuuuaaccccaa

SEQ ID NO: 88588 - RNA, 17 nt, Human
cucucacccacacucac

SEQ ID NO: 88589 - RNA, 27 nt, Human
auucuaaaggaaaaugugugcucuuua

SEQ ID NO: 88590 - RNA, 19 nt, Human
caaaguauuuuucaaucag

SEQ ID NO: 88591 - RNA, 23 nt, Human
gcgcaggcagacugcacagcccg

SEQ ID NO: 88592 - RNA, 23 nt, Human
ugcuuccuuucacaaaugagcug

SEQ ID NO: 88593 - RNA, 22 nt, Human
cucugggaaugaggaacaagac

SEQ ID NO: 88594 - RNA, 23 nt, Human
ucacauuccccucccucuguggu

SEQ ID NO: 88595 - RNA, 27 nt, Human
cagcucuuucuuuucugcuguuuccca

SEQ ID NO: 88596 - RNA, 27 nt, Human
ggcaggcagguuggugccugacagaca

SEQ ID NO: 88597 - RNA, 18 nt, Human
gggaagagaguaccggca

SEQ ID NO: 88598 - RNA, 27 nt, Human
ucugggaggagucccuggggccacaaa

SEQ ID NO: 88599 - RNA, 19 nt, Human
aacaggaucagcgcuuuaa

SEQ ID NO: 88600 - RNA, 22 nt, Human
cugccaccaccaagucauugac

SEQ ID NO: 88601 - RNA, 22 nt, Human
gugggagccaccaugccugacc

SEQ ID NO: 88602 - RNA, 21 nt, Human
gauuaaacuguaugucuuaua

SEQ ID NO: 88603 - RNA, 25 nt, Human
acaggaccccuauguccaggaaagg

SEQ ID NO: 88604 - RNA, 22 nt, Human
cgccgcacccggggccugggug

SEQ ID NO: 88605 - RNA, 23 nt, Human
ggcuacacugcaacuuccgucca

SEQ ID NO: 88606 - RNA, 21 nt, Human
uaacuugcccauuucuccaca

SEQ ID NO: 88607 - RNA, 24 nt, Human
cucuucugucauagcauugugugu

SEQ ID NO: 88608 - RNA, 25 nt, Human
uccgugauugcaaauuaugaccuca

SEQ ID NO: 88609 - RNA, 23 nt, Human
cccaggaggucaaggcuucagug

SEQ ID NO: 88610 - RNA, 20 nt, Human
ucuaagugaaaggaaauacu

SEQ ID NO: 88611 - RNA, 26 nt, Human
acucaggcuggggucugcagugcagc

SEQ ID NO: 88612 - RNA, 24 nt, Human
gguaucacagucuauugaccucag

SEQ ID NO: 88613 - RNA, 21 nt, Human
uucucugauaccagcuggagg

SEQ ID NO: 88614 - RNA, 20 nt, Human
ugcuguggcuggagcuggac

SEQ ID NO: 88615 - RNA, 22 nt, Human
cuucugcuccgcccucccugcu

SEQ ID NO: 88616 - RNA, 29 nt, Human
uugccauucugcuguacagacacugauuu

SEQ ID NO: 88617 - RNA, 24 nt, Human
cagcuagaaauuuuccucugugau

SEQ ID NO: 88618 - RNA, 21 nt, Human
cuuucccucucuggaccucag

SEQ ID NO: 88619 - RNA, 19 nt, Human
ucagcacugguuuuguuag

SEQ ID NO: 88620 - RNA, 25 nt, Human
cugcccccaccccaggcugggcugu

SEQ ID NO: 88621 - RNA, 20 nt, Human
uucugugagugcggguauag

SEQ ID NO: 88622 - RNA, 27 nt, Human
aaagacaaagcccccacacauggggaa

SEQ ID NO: 88623 - RNA, 27 nt, Human
ugcugcucgcgaaggucccacagcccu

SEQ ID NO: 88624 - RNA, 22 nt, Human
cucauuuccuucaauuuccuuu

SEQ ID NO: 88625 - RNA, 24 nt, Human
uccucuucacauguaacuucugca

SEQ ID NO: 88626 - RNA, 21 nt, Human
caccuccuccuccuucugcau

SEQ ID NO: 88627 - RNA, 19 nt, Human
caaacuaaaauuagaaaug

SEQ ID NO: 88628 - RNA, 22 nt, Human
aaugauuguaguaaucugcauu

SEQ ID NO: 88629 - RNA, 25 nt, Human
aaggcaccaaagagcacaaugagua

SEQ ID NO: 88630 - RNA, 26 nt, Human
ccccucucgcgggugcugguggagaa

SEQ ID NO: 88631 - RNA, 22 nt, Human
gccuuucuuggguccucaugcc

SEQ ID NO: 88632 - RNA, 27 nt, Human
ugcuguucuagguacuggccuggguga

SEQ ID NO: 88633 - RNA, 18 nt, Human
ccugcuguaaccucuguc

SEQ ID NO: 88634 - RNA, 23 nt, Human
cggcccagggggcagcuggagug

SEQ ID NO: 88635 - RNA, 22 nt, Human
agccucuggccacaaggagagc

SEQ ID NO: 88636 - RNA, 20 nt, Human
uucagccaaggcugggccag

SEQ ID NO: 88637 - RNA, 21 nt, Human
ugggcccugacucuuccccau

SEQ ID NO: 88638 - RNA, 20 nt, Human
uggugcuagcagagcuguac

SEQ ID NO: 88639 - RNA, 21 nt, Human
gcacgagaagguacacugguc

SEQ ID NO: 88640 - RNA, 22 nt, Human
ggucacugcaaccuccaccucc

SEQ ID NO: 88641 - RNA, 23 nt, Human
gguucugaggaagcagauguuuc

SEQ ID NO: 88642 - RNA, 30 nt, Human
uuuucacaacaaucucuccccagccuccca

SEQ ID NO: 88643 - RNA, 26 nt, Human
gcagcucuagcugggagcuuggccuc

SEQ ID NO: 88644 - RNA, 27 nt, Human
caugcucuguggccuucuuacacuucu

SEQ ID NO: 88645 - RNA, 24 nt, Human
cugccuggaucucacgagcacuuu

SEQ ID NO: 88646 - RNA, 24 nt, Human
uggucucuagaggguugcugccuu

SEQ ID NO: 88647 - RNA, 24 nt, Human
guggcucucccuuaucauuuguau

SEQ ID NO: 88648 - RNA, 27 nt, Human
uucccacauccguccucccccuuccca

SEQ ID NO: 88649 - RNA, 22 nt, Human
gguggagguugcagugagcugu

SEQ ID NO: 88650 - RNA, 27 nt, Human
ugcauuccagguucccuagacucacaa

SEQ ID NO: 88651 - RNA, 25 nt, Human
uguggagggcaugacugcuggccag

SEQ ID NO: 88652 - RNA, 19 nt, Human
aucgcagcugaaggaucug

SEQ ID NO: 88653 - RNA, 20 nt, Human
cuguaugcugaucaucgcca

SEQ ID NO: 88654 - RNA, 22 nt, Human
ucacccagggucuguggcucug

SEQ ID NO: 88655 - RNA, 24 nt, Human
cagagaccugcccuucuaccuucc

SEQ ID NO: 88656 - RNA, 19 nt, Human
uggaggcagagcacugagc

SEQ ID NO: 88657 - RNA, 20 nt, Human
aacucuguuuacaugggugg

SEQ ID NO: 88658 - RNA, 23 nt, Human
ugcuguugaccuuugguugaacu

SEQ ID NO: 88659 - RNA, 16 nt, Human
cuucccuucuuugcac

SEQ ID NO: 88660 - RNA, 23 nt, Human
ugcaaccucugccuaccggauuc

SEQ ID NO: 88661 - RNA, 23 nt, Human
cuccacuucgcuucucugcucca

SEQ ID NO: 88662 - RNA, 23 nt, Human
uugaguguggaaggaucuuggca

SEQ ID NO: 88663 - RNA, 23 nt, Human
aaauguucucuacaugaacugcu

SEQ ID NO: 88664 - RNA, 20 nt, Human
gcacuuagagacagaaagaa

SEQ ID NO: 88665 - RNA, 24 nt, Human
gaaguucagucaguccuguggaau

SEQ ID NO: 88666 - RNA, 23 nt, Human
ggccaagggaaaugcuguuggug

SEQ ID NO: 88667 - RNA, 22 nt, Human
ugcagccugcagcaagugcuuc

SEQ ID NO: 88668 - RNA, 21 nt, Human
cuucauuuuaugcuuuuuuau

SEQ ID NO: 88669 - RNA, 26 nt, Human
gcuguggcccucuguguaugccuggg

SEQ ID NO: 88670 - RNA, 24 nt, Human
gugacuucgucucuguucucaagg

SEQ ID NO: 88671 - RNA, 27 nt, Human
agguacccaaggcucagccagucucua

SEQ ID NO: 88672 - RNA, 27 nt, Human
ccuaaaccuugagggggagggugcucu

SEQ ID NO: 88673 - RNA, 22 nt, Human
gcacuucaccaccuccuucauc

SEQ ID NO: 88674 - RNA, 23 nt, Human
ggugacagagugagacuccaucu

SEQ ID NO: 88675 - RNA, 20 nt, Human
gacacagcccucuuucccca

SEQ ID NO: 88676 - RNA, 20 nt, Human
uguaccccagaugggugggg

SEQ ID NO: 88677 - RNA, 27 nt, Human
cccugcagaacuucuucaguaugaugu

SEQ ID NO: 88678 - RNA, 23 nt, Human
auugagccacugcacuccagccu

SEQ ID NO: 88679 - RNA, 22 nt, Human
cgccgccgccucgcacccgcag

SEQ ID NO: 88680 - RNA, 23 nt, Human
ggcggugggcgcgcgcagaggga

SEQ ID NO: 88681 - RNA, 27 nt, Human
ccccaucacacucggccacuagugggg

SEQ ID NO: 88682 - RNA, 27 nt, Human
ucucccagcccaucugaacacaaccag

SEQ ID NO: 88683 - RNA, 21 nt, Human
aggguucccagaaggaaggaa

SEQ ID NO: 88684 - RNA, 24 nt, Human
gcaucuccagcaggacuccaggau

SEQ ID NO: 88685 - RNA, 27 nt, Human
gcuuuguguaauauauuguacacuaca

SEQ ID NO: 88686 - RNA, 24 nt, Human
uagcccaggcuuggaggccagcug

SEQ ID NO: 88687 - RNA, 22 nt, Human
gcccuucuccccaagggaggcu

SEQ ID NO: 88688 - RNA, 25 nt, Human
auuguguuuaauuucuucuuuggca

SEQ ID NO: 88689 - RNA, 19 nt, Human
ucagcacugugccagugga

SEQ ID NO: 88690 - RNA, 24 nt, Human
ugcuccagugggccaaguugggca

SEQ ID NO: 88691 - RNA, 27 nt, Human
cccaacaagguguacauauucugcgua

SEQ ID NO: 88692 - RNA, 22 nt, Human
cucaaccucccaaagugcugag

SEQ ID NO: 88693 - RNA, 18 nt, Human
cugcccuggaaaacccaa

SEQ ID NO: 88694 - RNA, 22 nt, Human
cucagccucccaaagugcuggg

SEQ ID NO: 88695 - RNA, 22 nt, Human
cucggccucccaaagugcuagg

SEQ ID NO: 88696 - RNA, 22 nt, Human
ggaaaaguggcgugggagccag

SEQ ID NO: 88697 - RNA, 22 nt, Human
cacugcccugaccccugggcag

SEQ ID NO: 88698 - RNA, 20 nt, Human
caguuuuuccuggaauugcc

SEQ ID NO: 88699 - RNA, 22 nt, Human
cccucuggcuccuggcgugccc

SEQ ID NO: 88700 - RNA, 23 nt, Human
cccauccaucccaugccucccuc

SEQ ID NO: 88701 - RNA, 20 nt, Human
agggauccuguagacaauca

SEQ ID NO: 88702 - RNA, 21 nt, Human
ccucuacugguaaccaaggca

SEQ ID NO: 88703 - RNA, 21 nt, Human
gggagagagaaggugacacgg

SEQ ID NO: 88704 - RNA, 21 nt, Human
uuccaccuugaugcauccugu

SEQ ID NO: 88705 - RNA, 20 nt, Human
aauauggaugagguggagag

SEQ ID NO: 88706 - RNA, 22 nt, Human
cgaggccuggcuucaggaggga

SEQ ID NO: 88707 - RNA, 23 nt, Human
cacucaggugacauccuccagau

SEQ ID NO: 88708 - RNA, 22 nt, Human
cuacagacaugcaccaccacac

SEQ ID NO: 88709 - RNA, 22 nt, Human
caacuccugcccucaagugauc

SEQ ID NO: 88710 - RNA, 24 nt, Human
agcaaauguuucagcccaauguca

SEQ ID NO: 88711 - RNA, 23 nt, Human
ccuggaggaccugagccugccga

SEQ ID NO: 88712 - RNA, 25 nt, Human
caaagccuaaggagcuagaacuguu

SEQ ID NO: 88713 - RNA, 22 nt, Human
gccaaguccuagcuccuccucc

SEQ ID NO: 88714 - RNA, 18 nt, Human
accaguugaggaggaauu

SEQ ID NO: 88715 - RNA, 22 nt, Human
cccagcccccaaccccaagacc

SEQ ID NO: 88716 - RNA, 23 nt, Human
gccucuacugggucuauauugug

SEQ ID NO: 88717 - RNA, 23 nt, Human
aauguucaaagugucugccugug

SEQ ID NO: 88718 - RNA, 22 nt, Human
cucagccucccaaguagcugag

SEQ ID NO: 88719 - RNA, 25 nt, Human
gugaagcauuuacagaaacgcaucc

SEQ ID NO: 88720 - RNA, 26 nt, Human
ccaacaacaauaaaaaccaccaggau

SEQ ID NO: 88721 - RNA, 26 nt, Human
gaaacaaugaaauguguuaaaaauuu

SEQ ID NO: 88722 - RNA, 20 nt, Human
uuaagaaaaagaaauguaca

SEQ ID NO: 88723 - RNA, 26 nt, Human
gcuggguugggaagugacacgucugu

SEQ ID NO: 88724 - RNA, 25 nt, Human
cccucuaggaaccuuggagggcaua

SEQ ID NO: 88725 - RNA, 22 nt, Human
cugcccaccgacgccagccugc

SEQ ID NO: 88726 - RNA, 24 nt, Human
cgucuucagcaaaacgaccuugga

SEQ ID NO: 88727 - RNA, 27 nt, Human
agaacaaagggaacucaagauucuucc

SEQ ID NO: 88728 - RNA, 20 nt, Human
cuucccuuuuucuaagacua

SEQ ID NO: 88729 - RNA, 26 nt, Human
ucuuuucauuuguuauauauuacaaa

SEQ ID NO: 88730 - RNA, 20 nt, Human
ggugacacccgugcccagcc

SEQ ID NO: 88731 - RNA, 19 nt, Human
aauaugcggagaauguaua

SEQ ID NO: 88732 - RNA, 17 nt, Human
auguagacauggcuggc

SEQ ID NO: 88733 - RNA, 20 nt, Human
aagcuaagaccagagccuuc

SEQ ID NO: 88734 - RNA, 18 nt, Human
auugucauuacugccuuu

SEQ ID NO: 88735 - RNA, 20 nt, Human
ucuuauguuucaauauuucu

SEQ ID NO: 88736 - RNA, 24 nt, Human
cccagcaccagcucugcucaggcc

SEQ ID NO: 88737 - RNA, 21 nt, Human
gcaauaugacaaaaaguuuaa

SEQ ID NO: 88738 - RNA, 20 nt, Human
ugggaaggcuugggagccag

SEQ ID NO: 88739 - RNA, 21 nt, Human
acuggcgcaucauaugcagug

SEQ ID NO: 88740 - RNA, 26 nt, Human
ggagccggcgggaggucugccaggcu

SEQ ID NO: 88741 - RNA, 21 nt, Human
ugcuugaacuggggaggcaga

SEQ ID NO: 88742 - RNA, 24 nt, Human
ugaaaaggauauuaucuaccuguu

SEQ ID NO: 88743 - RNA, 25 nt, Human
guaacauccuccucuggauaacuug

SEQ ID NO: 88744 - RNA, 24 nt, Human
cuggagugcucacaguguggcugg

SEQ ID NO: 88745 - RNA, 16 nt, Human
ucuuuuguuuuuugcu

SEQ ID NO: 88746 - RNA, 20 nt, Human
gaagggagggcagagggggc

SEQ ID NO: 88747 - RNA, 21 nt, Human
ucucggccgccgugcccagcc

SEQ ID NO: 88748 - RNA, 20 nt, Human
uuucucuuaacucagcuuuu

SEQ ID NO: 88749 - RNA, 21 nt, Human
cgccuguaauucuagcacuuu

SEQ ID NO: 88750 - RNA, 21 nt, Human
aacuucugccacucccauguc

SEQ ID NO: 88751 - RNA, 21 nt, Human
acagcaucuuauauuuuuuga

SEQ ID NO: 88752 - RNA, 22 nt, Human
ccuguccuucacuguccuugcc

SEQ ID NO: 88753 - RNA, 22 nt, Human
ugaaauccuaucucuaccaaaa

SEQ ID NO: 88754 - RNA, 22 nt, Human
guguccuaaucuucucuucuua

SEQ ID NO: 88755 - RNA, 28 nt, Human
gcauuuugagaagaacaaagugugcacu

SEQ ID NO: 88756 - RNA, 27 nt, Human
aaggcauuuaaaggaccucugccgccu

SEQ ID NO: 88757 - RNA, 24 nt, Human
aagauguuucauuuuacuguauau

SEQ ID NO: 88758 - RNA, 23 nt, Human
auccuccucccacccggcugcag

SEQ ID NO: 88759 - RNA, 22 nt, Human
ggaggcugaggcggguggauca

SEQ ID NO: 88760 - RNA, 23 nt, Human
ccuuucuuccuuguuucaguugg

SEQ ID NO: 88761 - RNA, 26 nt, Human
uuccucagcauggcuguuuugaaaaa

SEQ ID NO: 88762 - RNA, 21 nt, Human
agaaagccggggcuggaaguc

SEQ ID NO: 88763 - RNA, 22 nt, Human
uaaauacaaagcccauucuucc

SEQ ID NO: 88764 - RNA, 26 nt, Human
uccagugaguugagaucaugccccug

SEQ ID NO: 88765 - RNA, 21 nt, Human
cuguugguaaugauggccuga

SEQ ID NO: 88766 - RNA, 21 nt, Human
cuuaaacuucuggcauuucag

SEQ ID NO: 88767 - RNA, 22 nt, Human
gguuaauuuuuguauuuuuagu

SEQ ID NO: 88768 - RNA, 22 nt, Human
ggcuaauuuuuguauuuucagu

SEQ ID NO: 88769 - RNA, 24 nt, Human
acuggcacaagcucagcacaugcc

SEQ ID NO: 88770 - RNA, 23 nt, Human
auuuuucuguaaaacaaaaccuu

SEQ ID NO: 88771 - RNA, 25 nt, Human
uugcuuuuaaaugagugauuucauu

SEQ ID NO: 88772 - RNA, 22 nt, Human
gcauguaauccuagcacuuugg

SEQ ID NO: 88773 - RNA, 26 nt, Human
ccagaagccaggaaggcugugcagga

SEQ ID NO: 88774 - RNA, 25 nt, Human
cugcuucaugggccuggaugcagau

SEQ ID NO: 88775 - RNA, 27 nt, Human
uaaccaaaacucagguaacaaccauua

SEQ ID NO: 88776 - RNA, 21 nt, Human
agccuugugcucuuuaucucu

SEQ ID NO: 88777 - RNA, 22 nt, Human
uaaggguccccuccucacugga

SEQ ID NO: 88778 - RNA, 22 nt, Human
ggacccagggaugacauguccc

SEQ ID NO: 88779 - RNA, 21 nt, Human
acaguauuucauugccugugu

SEQ ID NO: 88780 - RNA, 22 nt, Human
uuugaaaaauacagucaguaga

SEQ ID NO: 88781 - RNA, 15 nt, Human
cuucccuuccagcuc

SEQ ID NO: 88782 - RNA, 23 nt, Human
ugucugucuguuggccuguaucu

SEQ ID NO: 88783 - RNA, 27 nt, Human
ugggagccacagaggagcgucccuggg

SEQ ID NO: 88784 - RNA, 24 nt, Human
gauacugagaggugguggcaguaa

SEQ ID NO: 88785 - RNA, 22 nt, Human
gagcccaggaguuugaggcugc

SEQ ID NO: 88786 - RNA, 26 nt, Human
cgaaagucugaaucucccaaggaggg

SEQ ID NO: 88787 - RNA, 23 nt, Human
gccuuuauuucucugucauuugg

SEQ ID NO: 88788 - RNA, 27 nt, Human
gugcagccucuggcagagcauccgacc

SEQ ID NO: 88789 - RNA, 22 nt, Human
ucacugugauuuguacauaugc

SEQ ID NO: 88790 - RNA, 22 nt, Human
ugggucaggagucccaaagguc

SEQ ID NO: 88791 - RNA, 22 nt, Human
acaacugccuggugacacugcu

SEQ ID NO: 88792 - RNA, 20 nt, Human
ucagucaagacucccuuugg

SEQ ID NO: 88793 - RNA, 19 nt, Human
aaagagacgcuucaagugg

SEQ ID NO: 88794 - RNA, 21 nt, Human
cuccagccgagggcuccaggc

SEQ ID NO: 88795 - RNA, 27 nt, Human
guguccugggagcugccugcucccggc

SEQ ID NO: 88796 - RNA, 22 nt, Human
agcucacugcaagcuccaacuc

SEQ ID NO: 88797 - RNA, 18 nt, Human
ucuuccuucauccuugcc

SEQ ID NO: 88798 - RNA, 22 nt, Human
uacagacugugaguacagcaga

SEQ ID NO: 88799 - RNA, 21 nt, Human
uuguuuaucaugaaugcagga

SEQ ID NO: 88800 - RNA, 21 nt, Human
cuauucuucuagacuauccca

SEQ ID NO: 88801 - RNA, 25 nt, Human
ccuacuccucccccuccuccaugcu

SEQ ID NO: 88802 - RNA, 26 nt, Human
cgggggcggaggcuggcagggggcgc

SEQ ID NO: 88803 - RNA, 22 nt, Human
ugguagaggaaaaggcucguga

SEQ ID NO: 88804 - RNA, 23 nt, Human
guuccgccuccucagucuccucg

SEQ ID NO: 88805 - RNA, 24 nt, Human
gacucugggcggcaccgggcgucc

SEQ ID NO: 88806 - RNA, 25 nt, Human
ggagaugguuuugcccucccucucu

SEQ ID NO: 88807 - RNA, 22 nt, Human
uugcucuuaauuaauauaugaa

SEQ ID NO: 88808 - RNA, 24 nt, Human
ucuaaacaucgagaaacuauggga

SEQ ID NO: 88809 - RNA, 20 nt, Human
agcccaaacuuuauuuuuau

SEQ ID NO: 88810 - RNA, 22 nt, Human
gaggaugaagucuacacuucag

SEQ ID NO: 88811 - RNA, 25 nt, Human
cucauugcccaggcuggagugcagu

SEQ ID NO: 88812 - RNA, 27 nt, Human
cccagcaccucagaaugugcccucccu

SEQ ID NO: 88813 - RNA, 24 nt, Human
uggauuucaugucuuccuccagca

SEQ ID NO: 88814 - RNA, 23 nt, Human
ccgggcggggacggggcggggac

SEQ ID NO: 88815 - RNA, 21 nt, Human
auaugcaauggaaaacagcca

SEQ ID NO: 88816 - RNA, 20 nt, Human
gacucaaggaguugguaaag

SEQ ID NO: 88817 - RNA, 22 nt, Human
uucauucucuuuuauuaauuua

SEQ ID NO: 88818 - RNA, 22 nt, Human
uguaggcccauggaaaucacua

SEQ ID NO: 88819 - RNA, 23 nt, Human
uuaggcaaccuggcuuuuauuca

SEQ ID NO: 88820 - RNA, 21 nt, Human
guaccaaaguugucuuuguga

SEQ ID NO: 88821 - RNA, 26 nt, Human
ucuacccccuuccuucuuugucuugc

SEQ ID NO: 88822 - RNA, 21 nt, Human
ugagccaagauugcgccacug

SEQ ID NO: 88823 - RNA, 21 nt, Human
ccugagccaccaccgagccau

SEQ ID NO: 88824 - RNA, 28 nt, Human
gucacacucuccaggcuggagugcagug

SEQ ID NO: 88825 - RNA, 21 nt, Human
acgcagggggaaggcuuggag

SEQ ID NO: 88826 - RNA, 22 nt, Human
uguauaugacaauuuguauuga

SEQ ID NO: 88827 - RNA, 22 nt, Human
ccaccacugcugcuucccaccc

SEQ ID NO: 88828 - RNA, 22 nt, Human
gcugggaggaaaccagcuccag

SEQ ID NO: 88829 - RNA, 27 nt, Human
ggcucagaaaccgugagagagccccca

SEQ ID NO: 88830 - RNA, 22 nt, Human
ccaaguagcuaggauuacagac

SEQ ID NO: 88831 - RNA, 23 nt, Human
gaccagccagggcaacauaauaa

SEQ ID NO: 88832 - RNA, 23 nt, Human
ucugagugagcugaauucuugcc

SEQ ID NO: 88833 - RNA, 27 nt, Human
cugagguaccuggaucuuggguucuuc

SEQ ID NO: 88834 - RNA, 23 nt, Human
agucugucugugcaccaaacucu

SEQ ID NO: 88835 - RNA, 23 nt, Human
gcuucuauuuuuggaaagggcug

SEQ ID NO: 88836 - RNA, 27 nt, Human
ccgcugggccugcaggucucugucgag

SEQ ID NO: 88837 - RNA, 28 nt, Human
aaucagauaccugcugucaccacacuug

SEQ ID NO: 88838 - RNA, 25 nt, Human
ccuucacccacugccucugccuccc

SEQ ID NO: 88839 - RNA, 21 nt, Human
uaaacaauguguauugcagug

SEQ ID NO: 88840 - RNA, 19 nt, Human
uccagucucugcucgcgca

SEQ ID NO: 88841 - RNA, 20 nt, Human
agcuuagauuguagcuguuc

SEQ ID NO: 88842 - RNA, 25 nt, Human
acugagcucucuuccauuuuacuua

SEQ ID NO: 88843 - RNA, 20 nt, Human
aaaccacugacauuccucca

SEQ ID NO: 88844 - RNA, 22 nt, Human
cuguaaaaccaccuuuucugcu

SEQ ID NO: 88845 - RNA, 20 nt, Human
ugcugagggaccgagcccag

SEQ ID NO: 88846 - RNA, 22 nt, Human
ucggccaggcuggagugcagug

SEQ ID NO: 88847 - RNA, 22 nt, Human
uagugaaacugcauuauuuguu

SEQ ID NO: 88848 - RNA, 20 nt, Human
aauauuaaaaugaaaugaua

SEQ ID NO: 88849 - RNA, 19 nt, Human
gccaggagggugugcugug

SEQ ID NO: 88850 - RNA, 21 nt, Human
uuacaagguuauuuuguacuu

SEQ ID NO: 88851 - RNA, 23 nt, Human
ccuggugccugcaggccacccag

SEQ ID NO: 88852 - RNA, 26 nt, Human
gcucacugcaaccucaauccugggcu

SEQ ID NO: 88853 - RNA, 21 nt, Human
cccagcccacacuagccuggg

SEQ ID NO: 88854 - RNA, 25 nt, Human
cucuccaggguccaaggccacgcuu

SEQ ID NO: 88855 - RNA, 20 nt, Human
gguggugaccucugccugaa

SEQ ID NO: 88856 - RNA, 20 nt, Human
uucauuguuaaaacuccuuu

SEQ ID NO: 88857 - RNA, 26 nt, Human
aaaugagagcuguaacugaggacugu

SEQ ID NO: 88858 - RNA, 19 nt, Human
agaauugaaaaaugugagu

SEQ ID NO: 88859 - RNA, 24 nt, Human
cccuucauuucccccuccuuugcu

SEQ ID NO: 88860 - RNA, 19 nt, Human
guaucaucuggcacacaac

SEQ ID NO: 88861 - RNA, 19 nt, Human
ccgugugcucaggccaggu

SEQ ID NO: 88862 - RNA, 24 nt, Human
uuucugcacucucuguggccacag

SEQ ID NO: 88863 - RNA, 24 nt, Human
cucugugccaacuccuuguggacc

SEQ ID NO: 88864 - RNA, 21 nt, Human
cacuuccuguuuuaagcagcu

SEQ ID NO: 88865 - RNA, 22 nt, Human
ucacccccaauuaaacccagaa

SEQ ID NO: 88866 - RNA, 22 nt, Human
aggcugaggcaggagacuagcu

SEQ ID NO: 88867 - RNA, 22 nt, Human
gaggcucacccuuugccacuuu

SEQ ID NO: 88868 - RNA, 23 nt, Human
uuaccucccuaucaguucuagca

SEQ ID NO: 88869 - RNA, 24 nt, Human
ugguaaugaaggacagugaggcuc

SEQ ID NO: 88870 - RNA, 22 nt, Human
ggucucgaauuccugaccucag

SEQ ID NO: 88871 - RNA, 22 nt, Human
cucccaggcugaagugcaguga

SEQ ID NO: 88872 - RNA, 22 nt, Human
auuaucuacuacagaguguuau

SEQ ID NO: 88873 - RNA, 22 nt, Human
gcccaggcuggacugcagugac

SEQ ID NO: 88874 - RNA, 21 nt, Human
gcacacagggcucacagggca

SEQ ID NO: 88875 - RNA, 28 nt, Human
ucugggcaggggacagagagacacaggc

SEQ ID NO: 88876 - RNA, 20 nt, Human
aucugcaugagugacuuuaa

SEQ ID NO: 88877 - RNA, 26 nt, Human
ucccauaggccugggguuucuagacu

SEQ ID NO: 88878 - RNA, 28 nt, Human
ugacuguuggccaguucucaccggggaa

SEQ ID NO: 88879 - RNA, 26 nt, Human
ggggcugaagagacaggggaagagaa

SEQ ID NO: 88880 - RNA, 22 nt, Human
guccugcagugugaaacugaag

SEQ ID NO: 88881 - RNA, 18 nt, Human
cucagccuggagugcagu

SEQ ID NO: 88882 - RNA, 24 nt, Human
acuguuaauauuuuguauauugug

SEQ ID NO: 88883 - RNA, 22 nt, Human
agggguucgugcgcuguggaga

SEQ ID NO: 88884 - RNA, 22 nt, Human
cggccgaggcuucgggggcgca

SEQ ID NO: 88885 - RNA, 20 nt, Human
cacaugacuccagucuagcu

SEQ ID NO: 88886 - RNA, 25 nt, Human
ugagcuauaugcacacucagaccuc

SEQ ID NO: 88887 - RNA, 24 nt, Human
ucuuuuaucugugucuguguauca

SEQ ID NO: 88888 - RNA, 19 nt, Human
cccagagcuguggcagcuc

SEQ ID NO: 88889 - RNA, 22 nt, Human
agaccagccucaucaacacagu

SEQ ID NO: 88890 - RNA, 20 nt, Human
cuccccacucugcccccgcc

SEQ ID NO: 88891 - RNA, 21 nt, Human
gagucuugauuccugaucauc

SEQ ID NO: 88892 - RNA, 21 nt, Human
gccucuuucauagugugcaaa

SEQ ID NO: 88893 - RNA, 21 nt, Human
gccaaugugacaacaugugga

SEQ ID NO: 88894 - RNA, 19 nt, Human
uaaaugauguaguugauca

SEQ ID NO: 88895 - RNA, 27 nt, Human
caugggcugggagaucauagcccuucc

SEQ ID NO: 88896 - RNA, 29 nt, Human
acaguuacucagacccaggcauuucaaca

SEQ ID NO: 88897 - RNA, 24 nt, Human
uuucuuuauaaacuuuagaguagc

SEQ ID NO: 88898 - RNA, 20 nt, Human
uugcugcuaugguuuucucc

SEQ ID NO: 88899 - RNA, 27 nt, Human
gggcuccugccuucuguccugguguca

SEQ ID NO: 88900 - RNA, 23 nt, Human
ggcuccacugcacuggcucauuc

SEQ ID NO: 88901 - RNA, 23 nt, Human
cugagaauuagcuaaauggaggc

SEQ ID NO: 88902 - RNA, 27 nt, Human
guggggaggggcugugggcgugagacc

SEQ ID NO: 88903 - RNA, 22 nt, Human
uggcucccaccuguagucccag

SEQ ID NO: 88904 - RNA, 22 nt, Human
ccacagcaccuuugugaacuca

SEQ ID NO: 88905 - RNA, 20 nt, Human
uaugcaaauacuuugaucua

SEQ ID NO: 88906 - RNA, 21 nt, Human
ugacacugcacugagcacuuu

SEQ ID NO: 88907 - RNA, 26 nt, Human
cugcuucucuggggucccuuccacag

SEQ ID NO: 88908 - RNA, 26 nt, Human
ccccucugagguuucucagguggcaa

SEQ ID NO: 88909 - RNA, 23 nt, Human
uaacugcauaaguaaugacuuuc

SEQ ID NO: 88910 - RNA, 20 nt, Human
cuggcugcugaaauacuuuu

SEQ ID NO: 88911 - RNA, 26 nt, Human
cucucucuccuuuguccagaguaagg

SEQ ID NO: 88912 - RNA, 26 nt, Human
uugcccaggucuggguauugcuccug

SEQ ID NO: 88913 - RNA, 22 nt, Human
cauugcacuucagccuggguga

SEQ ID NO: 88914 - RNA, 21 nt, Human
ugaaguaaacuuuuuguucug

SEQ ID NO: 88915 - RNA, 20 nt, Human
ccugcccugcccugcccugu

SEQ ID NO: 88916 - RNA, 27 nt, Human
aacuugucacuugcaugucccaucacg

SEQ ID NO: 88917 - RNA, 23 nt, Human
ugucauccaggcuggagugcggu

SEQ ID NO: 88918 - RNA, 23 nt, Human
ugucguccaggcuggagugcagu

SEQ ID NO: 88919 - RNA, 21 nt, Human
ccacucccuugccccaaaagg

SEQ ID NO: 88920 - RNA, 21 nt, Human
ucccgcaccuuccuccucccc

SEQ ID NO: 88921 - RNA, 20 nt, Human
agaacaauccgauucacgua

SEQ ID NO: 88922 - RNA, 23 nt, Human
uguggaauuuuuagcucagcauu

SEQ ID NO: 88923 - RNA, 20 nt, Human
aggagucuggagugcaaugg

SEQ ID NO: 88924 - RNA, 27 nt, Human
gcccuuggccagcauguggaguggagg

SEQ ID NO: 88925 - RNA, 22 nt, Human
ccacaaccauucuuucuuguca

SEQ ID NO: 88926 - RNA, 21 nt, Human
aaaauagcaucccaccucugg

SEQ ID NO: 88927 - RNA, 22 nt, Human
cacggcuguggccgcugccucu

SEQ ID NO: 88928 - RNA, 21 nt, Human
cucugcuuuccuccaccugaa

SEQ ID NO: 88929 - RNA, 22 nt, Human
gguggggugagggaauaugagu

SEQ ID NO: 88930 - RNA, 19 nt, Human
ucccuguggagguuccccu

SEQ ID NO: 88931 - RNA, 26 nt, Human
agcucuguugcuacuaagcagcuuuu

SEQ ID NO: 88932 - RNA, 21 nt, Human
gaaagggagagaaagagaagc

SEQ ID NO: 88933 - RNA, 22 nt, Human
ccaaaaagguacaggcagcagu

SEQ ID NO: 88934 - RNA, 20 nt, Human
gcucacugcaaccucugcuu

SEQ ID NO: 88935 - RNA, 22 nt, Human
cccuacugacaguaacuaccug

SEQ ID NO: 88936 - RNA, 22 nt, Human
gggagcacagaaggccaguugc

SEQ ID NO: 88937 - RNA, 19 nt, Human
caacuuuccuucaaaguca

SEQ ID NO: 88938 - RNA, 30 nt, Human
gggagggagcgggagagggaggagagcucc

SEQ ID NO: 88939 - RNA, 22 nt, Human
ucucagucagacuggggugcag

SEQ ID NO: 88940 - RNA, 25 nt, Human
uugaggccacuguguuccuuccgcu

SEQ ID NO: 88941 - RNA, 21 nt, Human
ugggugggugcccuccagaga

SEQ ID NO: 88942 - RNA, 21 nt, Human
acagauggguagaggcagcuc

SEQ ID NO: 88943 - RNA, 23 nt, Human
uguauguguggguguguguuaca

SEQ ID NO: 88944 - RNA, 26 nt, Human
cccucaggagcccuccagagccugug

SEQ ID NO: 88945 - RNA, 20 nt, Human
uggagaggacaguguggcau

SEQ ID NO: 88946 - RNA, 20 nt, Human
gggagaggagguuguguggg

SEQ ID NO: 88947 - RNA, 27 nt, Human
gaagaauagagaggaggcuugaaggaa

SEQ ID NO: 88948 - RNA, 20 nt, Human
cugagcugugggauucugca

SEQ ID NO: 88949 - RNA, 22 nt, Human
gccuguauucccagcaguuugg

SEQ ID NO: 88950 - RNA, 21 nt, Human
uauuguaauccuagcacuuug

SEQ ID NO: 88951 - RNA, 23 nt, Human
gagggugagacagugggggugcc

SEQ ID NO: 88952 - RNA, 21 nt, Human
ggcuaacucucccaaaaagga

SEQ ID NO: 88953 - RNA, 23 nt, Human
uauguauguguccuuguguuaug

SEQ ID NO: 88954 - RNA, 26 nt, Human
ggaaagugggacugagagggagucag

SEQ ID NO: 88955 - RNA, 20 nt, Human
uggcugggugcaguggcuca

SEQ ID NO: 88956 - RNA, 30 nt, Human
gacgcuuugcuuuucuucugcucuugguga

SEQ ID NO: 88957 - RNA, 22 nt, Human
cccacccccucgggugccgucg

SEQ ID NO: 88958 - RNA, 27 nt, Human
ucuaggcccauuauuuuuauuaaaacu

SEQ ID NO: 88959 - RNA, 23 nt, Human
ggacugcacaauuccaccugccc

SEQ ID NO: 88960 - RNA, 22 nt, Human
aauacaugcaauguggcuggug

SEQ ID NO: 88961 - RNA, 27 nt, Human
gugaugguaacugaugccuuucauuuu

SEQ ID NO: 88962 - RNA, 23 nt, Human
gccagccaaagccacugggugag

SEQ ID NO: 88963 - RNA, 21 nt, Human
cucagcuguguguuccugggc

SEQ ID NO: 88964 - RNA, 21 nt, Human
augggugggacacaugccuuc

SEQ ID NO: 88965 - RNA, 22 nt, Human
uauguauguugucuucuucaau

SEQ ID NO: 88966 - RNA, 25 nt, Human
cccucugcucugaucaguucuugua

SEQ ID NO: 88967 - RNA, 27 nt, Human
caggaggugggguggaaauaggguggg

SEQ ID NO: 88968 - RNA, 20 nt, Human
gcuggggucggcgcgguguc

SEQ ID NO: 88969 - RNA, 22 nt, Human
uggcgcaugccuguaaucccag

SEQ ID NO: 88970 - RNA, 22 nt, Human
uggcucaugccuuuaaucccag

SEQ ID NO: 88971 - RNA, 16 nt, Human
cuucccuugagaguca

SEQ ID NO: 88972 - RNA, 24 nt, Human
cacuuagggaaagauguagaaaga

SEQ ID NO: 88973 - RNA, 21 nt, Human
uguuugucugugugcuguaac

SEQ ID NO: 88974 - RNA, 20 nt, Human
accagugaggagaugcggcc

SEQ ID NO: 88975 - RNA, 20 nt, Human
auuuuuaaaaauugcucuua

SEQ ID NO: 88976 - RNA, 23 nt, Human
cugagguuccaccaaaauaugga

SEQ ID NO: 88977 - RNA, 27 nt, Human
acaguguuuugcaaacaaacaaaaaga

SEQ ID NO: 88978 - RNA, 24 nt, Human
ggaggggaggaaaggcgucccucu

SEQ ID NO: 88979 - RNA, 22 nt, Human
gauacucuacuacacucagccu

SEQ ID NO: 88980 - RNA, 21 nt, Human
guucugucucccaggcugaag

SEQ ID NO: 88981 - RNA, 20 nt, Human
ugcaccaauuaagaugugcu

SEQ ID NO: 88982 - RNA, 27 nt, Human
acugccucugccacacucugacgcaaa

SEQ ID NO: 88983 - RNA, 24 nt, Human
cagaagcagaggcuaauucagugu

SEQ ID NO: 88984 - RNA, 20 nt, Human
acuaauaaaaccucuaauuc

SEQ ID NO: 88985 - RNA, 23 nt, Human
uuguaacaaccuaaaacgcagag

SEQ ID NO: 88986 - RNA, 22 nt, Human
ggcgcugcugccaucuuuccuc

SEQ ID NO: 88987 - RNA, 19 nt, Human
ccccaagacggacagugua

SEQ ID NO: 88988 - RNA, 24 nt, Human
guagcaagugaccagaaucugcca

SEQ ID NO: 88989 - RNA, 21 nt, Human
agaucccuuccuuccucuucg

SEQ ID NO: 88990 - RNA, 23 nt, Human
gcagggcugguuagaagugcuca

SEQ ID NO: 88991 - RNA, 24 nt, Human
ggcugcugcuuagcuugcaccuug

SEQ ID NO: 88992 - RNA, 23 nt, Human
gcgccaucuuggcucacugcacc

SEQ ID NO: 88993 - RNA, 25 nt, Human
ggggguggagccggaggaggaaggc

SEQ ID NO: 88994 - RNA, 26 nt, Human
gggcagccagggcugaagaacaaacu

SEQ ID NO: 88995 - RNA, 22 nt, Human
ggcaggagaauugcuggaaccc

SEQ ID NO: 88996 - RNA, 22 nt, Human
ugccucccgaguucaagcaauu

SEQ ID NO: 88997 - RNA, 27 nt, Human
accaggaugucggacaccgaggagcag

SEQ ID NO: 88998 - RNA, 22 nt, Human
agacaauacucccuuuaaagag

SEQ ID NO: 88999 - RNA, 24 nt, Human
uccuuaugucuccagucuggugcc

SEQ ID NO: 89000 - RNA, 21 nt, Human
cugcgaguguuaagguuguca

SEQ ID NO: 89001 - RNA, 31 nt, Human
aggaagggaagggaacauccacaucuucugu

SEQ ID NO: 89002 - RNA, 20 nt, Human
gccuugacacacacaugcac

SEQ ID NO: 89003 - RNA, 21 nt, Human
cagaaauugacuggacuguca

SEQ ID NO: 89004 - RNA, 25 nt, Human
uugucgcucaggcuggagugccaug

SEQ ID NO: 89005 - RNA, 24 nt, Human
gaaaaagaagaaucuugcugcuuu

SEQ ID NO: 89006 - RNA, 27 nt, Human
gcgugagccaucgcuuuugacccaaau

SEQ ID NO: 89007 - RNA, 23 nt, Human
auuaggaaugaaaauugccuaga

SEQ ID NO: 89008 - RNA, 27 nt, Human
gcuaauuaaauaauaguacugcagcuu

SEQ ID NO: 89009 - RNA, 22 nt, Human
ucuaaaaugucaaggcaguugc

SEQ ID NO: 89010 - RNA, 28 nt, Human
uuuuguuuuuguuuuccuugcagauacu

SEQ ID NO: 89011 - RNA, 26 nt, Human
cucuuuccaacgcuguaaaaaggaca

SEQ ID NO: 89012 - RNA, 23 nt, Human
agggggacugcaagggacaggga

SEQ ID NO: 89013 - RNA, 24 nt, Human
ccugaaggugccucuuggccuaaa

SEQ ID NO: 89014 - RNA, 22 nt, Human
uggugaccuugaucaagggguu

SEQ ID NO: 89015 - RNA, 25 nt, Human
uugagauguugagaggaacaagaag

SEQ ID NO: 89016 - RNA, 21 nt, Human
gaggaugaagagcuucccugc

SEQ ID NO: 89017 - RNA, 21 nt, Human
gcugugaggaggcccagaaaa

SEQ ID NO: 89018 - RNA, 21 nt, Human
gggaggggguaagggagccag

SEQ ID NO: 89019 - RNA, 22 nt, Human
cucuggaucaccacuugauuau

SEQ ID NO: 89020 - RNA, 20 nt, Human
gacacugaagacacugcaga

SEQ ID NO: 89021 - RNA, 19 nt, Human
cuuacaggccuuccaguca

SEQ ID NO: 89022 - RNA, 20 nt, Human
gagacccuucaggacgagga

SEQ ID NO: 89023 - RNA, 21 nt, Human
agucucuugggaaguguguuu

SEQ ID NO: 89024 - RNA, 27 nt, Human
aggcuucuaaauaaauggcagaauucu

SEQ ID NO: 89025 - RNA, 19 nt, Human
uuacaagauauagcacuuu

SEQ ID NO: 89026 - RNA, 24 nt, Human
uucuggaucuuucggacugaggcc

SEQ ID NO: 89027 - RNA, 24 nt, Human
gaagcaauggaaacauuuuucugg

SEQ ID NO: 89028 - RNA, 20 nt, Human
gccaucugucucaaaucaaa

SEQ ID NO: 89029 - RNA, 23 nt, Human
cuacuuuccauucacuguuaaca

SEQ ID NO: 89030 - RNA, 22 nt, Human
ugugacucuuuccaaccugcuu

SEQ ID NO: 89031 - RNA, 24 nt, Human
gaacuucccucauuucucucugca

SEQ ID NO: 89032 - RNA, 26 nt, Human
ucaucagccacaacaaaaauaaaacc

SEQ ID NO: 89033 - RNA, 26 nt, Human
gucaaguacccauagggaaaggcagg

SEQ ID NO: 89034 - RNA, 25 nt, Human
aucaggauaacaugaccuugccuug

SEQ ID NO: 89035 - RNA, 21 nt, Human
agaugugcaacacucaggccu

SEQ ID NO: 89036 - RNA, 23 nt, Human
ggcccagaaaucauacuguaagg

SEQ ID NO: 89037 - RNA, 21 nt, Human
guugcccuugugcuccaguca

SEQ ID NO: 89038 - RNA, 24 nt, Human
gggagcugguucccagaggauugu

SEQ ID NO: 89039 - RNA, 22 nt, Human
acgaggacgaggaguggcccac

SEQ ID NO: 89040 - RNA, 26 nt, Human
cugccugggccuguucacguguuuuc

SEQ ID NO: 89041 - RNA, 25 nt, Human
ggacagugacaacccuuucucucca

SEQ ID NO: 89042 - RNA, 25 nt, Human
ucagagucaucagcaaacuguccaa

SEQ ID NO: 89043 - RNA, 26 nt, Human
uuccuggacagaggaggacuacgcgu

SEQ ID NO: 89044 - RNA, 26 nt, Human
gggaaaaaaugaacagauuucagaga

SEQ ID NO: 89045 - RNA, 24 nt, Human
ccugguucugaugaugugccuggg

SEQ ID NO: 89046 - RNA, 16 nt, Human
ggaagggagaggcagc

SEQ ID NO: 89047 - RNA, 21 nt, Human
agggaaagcccagaaaaggac

SEQ ID NO: 89048 - RNA, 24 nt, Human
aaaaggggcaacucuucuuuuuag

SEQ ID NO: 89049 - RNA, 20 nt, Human
cacuuuuguuagugcuuuau

SEQ ID NO: 89050 - RNA, 26 nt, Human
uuaagcaugaaugcguucuggaacac

SEQ ID NO: 89051 - RNA, 23 nt, Human
gaagaggcuuucaggaauuugua

SEQ ID NO: 89052 - RNA, 21 nt, Human
ccucguuccagaccugccuca

SEQ ID NO: 89053 - RNA, 21 nt, Human
cauguugaagccacugccuuc

SEQ ID NO: 89054 - RNA, 23 nt, Human
uccagcggagacuuauguaggag

SEQ ID NO: 89055 - RNA, 26 nt, Human
ccuguccagaagccuggccuaggcag

SEQ ID NO: 89056 - RNA, 24 nt, Human
ggcggucaggcaccugcagaggag

SEQ ID NO: 89057 - RNA, 26 nt, Human
ccuugcucauucuugaggagcauuaa

SEQ ID NO: 89058 - RNA, 23 nt, Human
gcccguaaucccagcuacuaagg

SEQ ID NO: 89059 - RNA, 27 nt, Human
agcuccuucccuuacucuaccuugcuc

SEQ ID NO: 89060 - RNA, 26 nt, Human
uguaauuuucaggaagaugauuuguu

SEQ ID NO: 89061 - RNA, 23 nt, Human
caaguagcugggauuacaggugc

SEQ ID NO: 89062 - RNA, 22 nt, Human
cccuucaguaauaacguauugc

SEQ ID NO: 89063 - RNA, 24 nt, Human
uuuccaguaccaucuggaugcccu

SEQ ID NO: 89064 - RNA, 27 nt, Human
gcagcacuugacagcucucccucugug

SEQ ID NO: 89065 - RNA, 27 nt, Human
ugcuuugagugugaaugcagcaggcuc

SEQ ID NO: 89066 - RNA, 25 nt, Human
aagcguuucccagucuuagcccugu

SEQ ID NO: 89067 - RNA, 19 nt, Human
cuccaucuaaaauaagaca

SEQ ID NO: 89068 - RNA, 27 nt, Human
cucaauuucuuaggcuggagugcagug

SEQ ID NO: 89069 - RNA, 23 nt, Human
agcaaugcugaugaaucacuguu

SEQ ID NO: 89070 - RNA, 27 nt, Human
guaguuauuuugcaccagcagugccuu

SEQ ID NO: 89071 - RNA, 26 nt, Human
auuuauaaauggugucauuuaugaac

SEQ ID NO: 89072 - RNA, 24 nt, Human
gacauuuuucuccucaguagcaua

SEQ ID NO: 89073 - RNA, 26 nt, Human
ugccacccucucuggcauucaugcag

SEQ ID NO: 89074 - RNA, 21 nt, Human
ugcucacugcaaccucugcca

SEQ ID NO: 89075 - RNA, 25 nt, Human
ccaucgucccggcugaagugcagug

SEQ ID NO: 89076 - RNA, 26 nt, Human
gguacccggccaacaucaagugacuu

SEQ ID NO: 89077 - RNA, 21 nt, Human
aucacccucagaccuuggagc

SEQ ID NO: 89078 - RNA, 24 nt, Human
uccaugcugagugaaaacuaacca

SEQ ID NO: 89079 - RNA, 26 nt, Human
uucugcuccaugcucuuccucggguc

SEQ ID NO: 89080 - RNA, 24 nt, Human
caugauuuuggcucacugcagccu

SEQ ID NO: 89081 - RNA, 22 nt, Human
aauggcagauguggagcuauuc

SEQ ID NO: 89082 - RNA, 24 nt, Human
cuggggaacaggagagcugcugca

SEQ ID NO: 89083 - RNA, 27 nt, Human
ucuuuuaggagcuuguaccacagucuu

SEQ ID NO: 89084 - RNA, 21 nt, Human
gccuucaucuuccauauacca

SEQ ID NO: 89085 - RNA, 20 nt, Human
ucuggagaagacuauuugcc

SEQ ID NO: 89086 - RNA, 21 nt, Human
gagcuaaagugacuuuuccca

SEQ ID NO: 89087 - RNA, 27 nt, Human
cacugccugggaccugugcugagagag

SEQ ID NO: 89088 - RNA, 22 nt, Human
uccuccagggggcccagggugc

SEQ ID NO: 89089 - RNA, 22 nt, Human
gcuuuggagaaaaugaaugaag

SEQ ID NO: 89090 - RNA, 25 nt, Human
gggcuggggguucccaggagccaug

SEQ ID NO: 89091 - RNA, 21 nt, Human
ugaacuuccuguuggugcugg

SEQ ID NO: 89092 - RNA, 27 nt, Human
gucgcucaggcuggagugccauggcgc

SEQ ID NO: 89093 - RNA, 24 nt, Human
aggucucuuuucauccuucaucug

SEQ ID NO: 89094 - RNA, 20 nt, Human
agaccuacagucagauguuu

SEQ ID NO: 89095 - RNA, 21 nt, Human
ugccagcccagcuggccuggc

SEQ ID NO: 89096 - RNA, 21 nt, Human
gcguucucccccucuuggcuc

SEQ ID NO: 89097 - RNA, 24 nt, Human
auccagucagauacauuuguuuga

SEQ ID NO: 89098 - RNA, 22 nt, Human
gagauguuucguuuucaugcuu

SEQ ID NO: 89099 - RNA, 21 nt, Human
caccccucuuccuuaaugaaa

SEQ ID NO: 89100 - RNA, 20 nt, Human
gaaggcaggcuucuggcuuc

SEQ ID NO: 89101 - RNA, 26 nt, Human
uaccugcaagccucuuaguacuuaau

SEQ ID NO: 89102 - RNA, 18 nt, Human
cuuccucugcaucauucu

SEQ ID NO: 89103 - RNA, 27 nt, Human
ggagcacgguuuaagcaccacuggacu

SEQ ID NO: 89104 - RNA, 21 nt, Human
cugaaguccucacccucucuu

SEQ ID NO: 89105 - RNA, 22 nt, Human
agaggcugccuuucugguucca

SEQ ID NO: 89106 - RNA, 21 nt, Human
ucacccuucugggcaaggggg

SEQ ID NO: 89107 - RNA, 26 nt, Human
cugugcuccugggccugugaccccag

SEQ ID NO: 89108 - RNA, 24 nt, Human
gcacacacaucccugucauuguuc

SEQ ID NO: 89109 - RNA, 23 nt, Human
ggcuggcaagggaaaguuucagc

SEQ ID NO: 89110 - RNA, 27 nt, Human
ccuguguagcugggauuauagauugga

SEQ ID NO: 89111 - RNA, 23 nt, Human
aggcuggagugcaacgguacgau

SEQ ID NO: 89112 - RNA, 22 nt, Human
accucagacucccgaauagcug

SEQ ID NO: 89113 - RNA, 26 nt, Human
ucggcgcgaggcggagcuuggcaguu

SEQ ID NO: 89114 - RNA, 18 nt, Human
caaggcagagauccaugc

SEQ ID NO: 89115 - RNA, 21 nt, Human
uugccauucccugccuggggc

SEQ ID NO: 89116 - RNA, 29 nt, Human
guagcuaauuuuucuuuaccuauuuucua

SEQ ID NO: 89117 - RNA, 20 nt, Human
cccaccucuaugcugcguuc

SEQ ID NO: 89118 - RNA, 22 nt, Human
uucucucucaguucuacacuga

SEQ ID NO: 89119 - RNA, 20 nt, Human
uuucccuuauggauggacua

SEQ ID NO: 89120 - RNA, 23 nt, Human
uguggugaauggaggaccacguc

SEQ ID NO: 89121 - RNA, 22 nt, Human
caggcuggagugcaauagcgcg

SEQ ID NO: 89122 - RNA, 27 nt, Human
agacaacuucugcagggucacucccug

SEQ ID NO: 89123 - RNA, 21 nt, Human
caccgccuuacagucaccuca

SEQ ID NO: 89124 - RNA, 26 nt, Human
gucaugugcauuuccacgucaacaga

SEQ ID NO: 89125 - RNA, 25 nt, Human
uuugguuacauuugcauaugccauu

SEQ ID NO: 89126 - RNA, 26 nt, Human
ggagaggggaagcagaucugaggaca

SEQ ID NO: 89127 - RNA, 19 nt, Human
cccugggaaccuccucugg

SEQ ID NO: 89128 - RNA, 21 nt, Human
cugucucaaacucuaaggucg

SEQ ID NO: 89129 - RNA, 27 nt, Human
ucuccauccacuuuucuccugggggcu

SEQ ID NO: 89130 - RNA, 27 nt, Human
uccuggacugacggucacgacugccua

SEQ ID NO: 89131 - RNA, 22 nt, Human
gaaauccaguuagaagugcaau

SEQ ID NO: 89132 - RNA, 23 nt, Human
guccuucccaccuccagucauca

SEQ ID NO: 89133 - RNA, 19 nt, Human
gggcuguaguuagcuuuuc

SEQ ID NO: 89134 - RNA, 20 nt, Human
aggauaacugugacuccagg

SEQ ID NO: 89135 - RNA, 22 nt, Human
ggggccaccgggaggcacuuuu

SEQ ID NO: 89136 - RNA, 22 nt, Human
ugaccagcucugggguuuguaa

SEQ ID NO: 89137 - RNA, 22 nt, Human
ugauuguccuagaugcacuacu

SEQ ID NO: 89138 - RNA, 19 nt, Human
ggcugcccugccacuuugg

SEQ ID NO: 89139 - RNA, 20 nt, Human
cgcccaggcuggagugcaac

SEQ ID NO: 89140 - RNA, 23 nt, Human
uccuuugauugauauagaccaaa

SEQ ID NO: 89141 - RNA, 24 nt, Human
acaagcuuuuaacuuuuuaaguua

SEQ ID NO: 89142 - RNA, 22 nt, Human
uuauuuagucaaaauguguucc

SEQ ID NO: 89143 - RNA, 20 nt, Human
ugggcagcagcucagccucc

SEQ ID NO: 89144 - RNA, 20 nt, Human
gggagcgugagcaggacggu

SEQ ID NO: 89145 - RNA, 21 nt, Human
acagagcaguggcacuggacc

SEQ ID NO: 89146 - RNA, 24 nt, Human
aucuuagucccaugaucugucccc

SEQ ID NO: 89147 - RNA, 18 nt, Human
cccaaggugcaccaccuu

SEQ ID NO: 89148 - RNA, 22 nt, Human
uuccuguuuucucccgauugcu

SEQ ID NO: 89149 - RNA, 22 nt, Human
cacugcaugugcugugcauauu

SEQ ID NO: 89150 - RNA, 20 nt, Human
ugugcaugcucugccuuucu

SEQ ID NO: 89151 - RNA, 24 nt, Human
cgccaaccagcuccugcugccauc

SEQ ID NO: 89152 - RNA, 21 nt, Human
acuucauugugcuguucacuc

SEQ ID NO: 89153 - RNA, 24 nt, Human
uacaacacagacgauauuuaauuc

SEQ ID NO: 89154 - RNA, 24 nt, Human
uaagaaaauauauuuucauuccug

SEQ ID NO: 89155 - RNA, 25 nt, Human
ggacaccugaccuuuugaagcuuca

SEQ ID NO: 89156 - RNA, 27 nt, Human
gcgagcagaguggcgggggccgcugac

SEQ ID NO: 89157 - RNA, 20 nt, Human
ugaaagccuccucaccucuu

SEQ ID NO: 89158 - RNA, 23 nt, Human
acugcuuucagugccugcuguuc

SEQ ID NO: 89159 - RNA, 23 nt, Human
cacugugccaucuuccugaccac

SEQ ID NO: 89160 - RNA, 19 nt, Human
agaacaaaugucacaggcc

SEQ ID NO: 89161 - RNA, 22 nt, Human
gagugagacuccaucucaaaac

SEQ ID NO: 89162 - RNA, 25 nt, Human
agcuaugccucuaauuucaccaggg

SEQ ID NO: 89163 - RNA, 23 nt, Human
uuuaaaaaacacacaucuuaugg

SEQ ID NO: 89164 - RNA, 23 nt, Human
agggccgaucuguuacaggcaag

SEQ ID NO: 89165 - RNA, 24 nt, Human
gagcccaggcaguuggagaccagu

SEQ ID NO: 89166 - RNA, 26 nt, Human
cccagcucccuguuuugcugaggccu

SEQ ID NO: 89167 - RNA, 21 nt, Human
cacugcugggcacacucucca

SEQ ID NO: 89168 - RNA, 22 nt, Human
guggcuccccugcccagccugc

SEQ ID NO: 89169 - RNA, 27 nt, Human
ccuugucucccacucuuucuucauaua

SEQ ID NO: 89170 - RNA, 27 nt, Human
cuugacagagucuguguccgcucaguc

SEQ ID NO: 89171 - RNA, 22 nt, Human
aguaaauccacagugaguuggg

SEQ ID NO: 89172 - RNA, 27 nt, Human
ugaguauggagggucuagccuggguga

SEQ ID NO: 89173 - RNA, 22 nt, Human
cuaucucuuucuacaucagauc

SEQ ID NO: 89174 - RNA, 23 nt, Human
ccuuucauccugggaccugccga

SEQ ID NO: 89175 - RNA, 22 nt, Human
uuugggcaucucccaugucccc

SEQ ID NO: 89176 - RNA, 21 nt, Human
uagaagauuggucuccaguaa

SEQ ID NO: 89177 - RNA, 27 nt, Human
cuaggagguggagguugcauucaacug

SEQ ID NO: 89178 - RNA, 27 nt, Human
augagacauggcugucucacaggucac

SEQ ID NO: 89179 - RNA, 22 nt, Human
uagaaggcugcagauaacagaa

SEQ ID NO: 89180 - RNA, 21 nt, Human
ucugccggcuccccuaggcaa

SEQ ID NO: 89181 - RNA, 23 nt, Human
gcugaccugcugaccugugcaca

SEQ ID NO: 89182 - RNA, 27 nt, Human
acugacacagcauucaugauguuaccu

SEQ ID NO: 89183 - RNA, 22 nt, Human
ccuuugggcaucucuucugccu

SEQ ID NO: 89184 - RNA, 23 nt, Human
aucagccuggcagcagcauugug

SEQ ID NO: 89185 - RNA, 26 nt, Human
gagcaacaugggagaaacugagaaaa

SEQ ID NO: 89186 - RNA, 24 nt, Human
gugacuucuccuuggggaucuggg

SEQ ID NO: 89187 - RNA, 26 nt, Human
acaccccaagguucaaacugucucaa

SEQ ID NO: 89188 - RNA, 22 nt, Human
gagagggcacaucuccagaaaa

SEQ ID NO: 89189 - RNA, 27 nt, Human
gacaagaaucaaguaucugagacugug

SEQ ID NO: 89190 - RNA, 22 nt, Human
gcccaggcgggcaucucauggc

SEQ ID NO: 89191 - RNA, 22 nt, Human
uacccuuuaauauuuuuuccuc

SEQ ID NO: 89192 - RNA, 22 nt, Human
uuuguaacccguuacacugugu

SEQ ID NO: 89193 - RNA, 25 nt, Human
gaccuccaggcugcguugagcagcc

SEQ ID NO: 89194 - RNA, 19 nt, Human
ucucuguaaugguggagag

SEQ ID NO: 89195 - RNA, 19 nt, Human
ccuggcagggucaggcugg

SEQ ID NO: 89196 - RNA, 23 nt, Human
gagcaucuaaccccuccuuucuu

SEQ ID NO: 89197 - RNA, 24 nt, Human
ccugguguucccuuucccugcuga

SEQ ID NO: 89198 - RNA, 22 nt, Human
uauuagauuuuucuaguugucu

SEQ ID NO: 89199 - RNA, 20 nt, Human
cacuccaccuuccuuccauc

SEQ ID NO: 89200 - RNA, 25 nt, Human
ucaggaggggacacaagcauggagc

SEQ ID NO: 89201 - RNA, 22 nt, Human
acaguguguuguaauuuuguaa

SEQ ID NO: 89202 - RNA, 29 nt, Human
ucaggcccuucaaagaugauauguggagg

SEQ ID NO: 89203 - RNA, 24 nt, Human
cagagggaggggaggacccauggc

SEQ ID NO: 89204 - RNA, 26 nt, Human
cugcuguccaucacuguccuuuugaa

SEQ ID NO: 89205 - RNA, 24 nt, Human
cccugcucccuucccagagggauu

SEQ ID NO: 89206 - RNA, 22 nt, Human
gaucuagcccaucuuacuccag

SEQ ID NO: 89207 - RNA, 24 nt, Human
cucuccaagcccccaaauagcucc

SEQ ID NO: 89208 - RNA, 24 nt, Human
ugcuuacggguguuauuuuuauaa

SEQ ID NO: 89209 - RNA, 18 nt, Human
uuuuguuuuacuaguuuu

SEQ ID NO: 89210 - RNA, 22 nt, Human
ccgauccuggcccuccaccugc

SEQ ID NO: 89211 - RNA, 24 nt, Human
ggcagcaaggacacagaugcagcc

SEQ ID NO: 89212 - RNA, 26 nt, Human
aaacuucaggaaccaguugcuguuuc

SEQ ID NO: 89213 - RNA, 19 nt, Human
gcauugccagcucuuccaa

SEQ ID NO: 89214 - RNA, 23 nt, Human
uuggcuucucccuggggacgggg

SEQ ID NO: 89215 - RNA, 21 nt, Human
gcccugacccuccugccuagg

SEQ ID NO: 89216 - RNA, 21 nt, Human
aggagguugaggcugcaguga

SEQ ID NO: 89217 - RNA, 22 nt, Human
cuggggacugagcccacuguug

SEQ ID NO: 89218 - RNA, 19 nt, Human
guuucccccuaugaagguu

SEQ ID NO: 89219 - RNA, 21 nt, Human
ucauccagccacugcccaaag

SEQ ID NO: 89220 - RNA, 22 nt, Human
cacacaggcuggagugcagugg

SEQ ID NO: 89221 - RNA, 21 nt, Human
ucccugccuccuuccgggaca

SEQ ID NO: 89222 - RNA, 23 nt, Human
cccaacaaacuguacuuuauaca

SEQ ID NO: 89223 - RNA, 25 nt, Human
cccgccauaugcugccugccucggc

SEQ ID NO: 89224 - RNA, 26 nt, Human
gaggcaugacugcuuuucucagcccc

SEQ ID NO: 89225 - RNA, 25 nt, Human
gggaugggggaaauggagauggcac

SEQ ID NO: 89226 - RNA, 25 nt, Human
cucagaccucaccuuccucccaccc

SEQ ID NO: 89227 - RNA, 22 nt, Human
ugcuacuuuuaagauuguggag

SEQ ID NO: 89228 - RNA, 23 nt, Human
ugggcagcuaguucguagcuuuc

SEQ ID NO: 89229 - RNA, 22 nt, Human
cgaacuccuggccucaagugau

SEQ ID NO: 89230 - RNA, 27 nt, Human
aggcugaagaccugggacaggucgauu

SEQ ID NO: 89231 - RNA, 22 nt, Human
ucuacccaaaaugcagacagau

SEQ ID NO: 89232 - RNA, 22 nt, Human
cugccaggcuggaguggagugg

SEQ ID NO: 89233 - RNA, 20 nt, Human
aaauguuuucuuugcuugca

SEQ ID NO: 89234 - RNA, 28 nt, Human
gugacucacaccuuguggcugccuucag

SEQ ID NO: 89235 - RNA, 24 nt, Human
gggagggugagacacugcacagaa

SEQ ID NO: 89236 - RNA, 23 nt, Human
uuuuuaaagaagauaagauucug

SEQ ID NO: 89237 - RNA, 27 nt, Human
auauuuugagugugucagggccauuca

SEQ ID NO: 89238 - RNA, 23 nt, Human
gcaugaucuguuucuacuaugga

SEQ ID NO: 89239 - RNA, 25 nt, Human
cauucucccuccuucccuuccuugu

SEQ ID NO: 89240 - RNA, 25 nt, Human
gagaaggcugccacaaugacagcag

SEQ ID NO: 89241 - RNA, 22 nt, Human
gucauccaggcuggacaguuca

SEQ ID NO: 89242 - RNA, 20 nt, Human
aaaauugagggguuggcagg

SEQ ID NO: 89243 - RNA, 20 nt, Human
cgcaucucauaacuaacuuu

SEQ ID NO: 89244 - RNA, 21 nt, Human
accuccuccucuucugggcuc

SEQ ID NO: 89245 - RNA, 24 nt, Human
cugagccuagaaucaaccaaggag

SEQ ID NO: 89246 - RNA, 21 nt, Human
ggcucacugcaaccucuaccu

SEQ ID NO: 89247 - RNA, 21 nt, Human
uugcccaggaucaagggugcg

SEQ ID NO: 89248 - RNA, 20 nt, Human
gacucaguucagaagucacc

SEQ ID NO: 89249 - RNA, 21 nt, Human
cgugagccaucgcaccuagcc

SEQ ID NO: 89250 - RNA, 27 nt, Human
aaagcagggacgugaacagcccuccuc

SEQ ID NO: 89251 - RNA, 20 nt, Human
uguuaguuauagaugucuag

SEQ ID NO: 89252 - RNA, 19 nt, Human
cccuucaguugccuuaugu

SEQ ID NO: 89253 - RNA, 18 nt, Human
ugucuucuuagcugucac

SEQ ID NO: 89254 - RNA, 21 nt, Human
gguccucagcuuccuccauca

SEQ ID NO: 89255 - RNA, 19 nt, Human
cucccacaaggccccccua

SEQ ID NO: 89256 - RNA, 29 nt, Human
gcaguaacuuccaugaugacacugacgcc

SEQ ID NO: 89257 - RNA, 21 nt, Human
cuccuagugcuuccggaccuu

SEQ ID NO: 89258 - RNA, 23 nt, Human
agcccucuauaaagacuuccugu

SEQ ID NO: 89259 - RNA, 21 nt, Human
ccucacuugccucugccucca

SEQ ID NO: 89260 - RNA, 16 nt, Human
aggaugagaugacaga

SEQ ID NO: 89261 - RNA, 19 nt, Human
aggcucucuuuucucccuu

SEQ ID NO: 89262 - RNA, 22 nt, Human
acccaggcuggagugcaguagc

SEQ ID NO: 89263 - RNA, 27 nt, Human
gcucugccgcccaggcuggagugcagu

SEQ ID NO: 89264 - RNA, 23 nt, Human
uuuaacuuuuauaccuaucugag

SEQ ID NO: 89265 - RNA, 25 nt, Human
ccugucucacgucgcagugccaugg

SEQ ID NO: 89266 - RNA, 27 nt, Human
ccugccugcgucuuccgccccugccug

SEQ ID NO: 89267 - RNA, 27 nt, Human
cugcccuuguaauagacgucacggcca

SEQ ID NO: 89268 - RNA, 19 nt, Human
uguguuacccaggcugguc

SEQ ID NO: 89269 - RNA, 20 nt, Human
cagccugcacacaccugccu

SEQ ID NO: 89270 - RNA, 24 nt, Human
ggggcaucccucccugccggccuc

SEQ ID NO: 89271 - RNA, 21 nt, Human
ccgcugcugccccgccuugca

SEQ ID NO: 89272 - RNA, 27 nt, Human
uccccaugugaggagaucugcuuucag

SEQ ID NO: 89273 - RNA, 27 nt, Human
gcuuagcaaucuccuuaguucuugcua

SEQ ID NO: 89274 - RNA, 20 nt, Human
ggguuuucagaaccaccuca

SEQ ID NO: 89275 - RNA, 27 nt, Human
uauugcagagacucauuucacagccuu

SEQ ID NO: 89276 - RNA, 26 nt, Human
agcaggaagucaaaaggagagugaug

SEQ ID NO: 89277 - RNA, 23 nt, Human
ggcuaauuuuuugcauuuuuagu

SEQ ID NO: 89278 - RNA, 22 nt, Human
ucaucccagggggucugccuga

SEQ ID NO: 89279 - RNA, 24 nt, Human
agcucaggcuggagcagguauaug

SEQ ID NO: 89280 - RNA, 22 nt, Human
aaugccagugguggaggugggu

SEQ ID NO: 89281 - RNA, 20 nt, Human
cccaaaccucugcauggccc

SEQ ID NO: 89282 - RNA, 22 nt, Human
gggggcaaggaaauuagcugag

SEQ ID NO: 89283 - RNA, 20 nt, Human
uauuugacuucauuccguau

SEQ ID NO: 89284 - RNA, 24 nt, Human
uaucuguguaauuuuauaacauac

SEQ ID NO: 89285 - RNA, 18 nt, Human
cuccuccugccugucugc

SEQ ID NO: 89286 - RNA, 25 nt, Human
gagagagcaguugcacucuacaggc

SEQ ID NO: 89287 - RNA, 22 nt, Human
gcaugugcaugcgcgugugugc

SEQ ID NO: 89288 - RNA, 21 nt, Human
augcccaggcucacuucagug

SEQ ID NO: 89289 - RNA, 20 nt, Human
ggcucuuuggagaucaagga

SEQ ID NO: 89290 - RNA, 20 nt, Human
cuccaguuuucuguuaaugg

SEQ ID NO: 89291 - RNA, 23 nt, Human
ccucuuaucuucugccaggauca

SEQ ID NO: 89292 - RNA, 27 nt, Human
uucuccuccucagccuuuuccuccuca

SEQ ID NO: 89293 - RNA, 27 nt, Human
ccaagcccacucuccuccaagacugug

SEQ ID NO: 89294 - RNA, 20 nt, Human
gucagucucucucaucuuuc

SEQ ID NO: 89295 - RNA, 21 nt, Human
cucuccucgcucccccgggcc

SEQ ID NO: 89296 - RNA, 23 nt, Human
gucuugguuugcuucucucugua

SEQ ID NO: 89297 - RNA, 22 nt, Human
gacccaagggcagagcauuuaa

SEQ ID NO: 89298 - RNA, 25 nt, Human
accucugccuucuuccucuguugcc

SEQ ID NO: 89299 - RNA, 27 nt, Human
agaugcacacacagauauacacaugga

SEQ ID NO: 89300 - RNA, 21 nt, Human
agucccucagccacugaaguc

SEQ ID NO: 89301 - RNA, 20 nt, Human
caucuccaauggcugggauu

SEQ ID NO: 89302 - RNA, 22 nt, Human
cacaccaacauggcauauguau

SEQ ID NO: 89303 - RNA, 22 nt, Human
uggcucacgccuguaauuccag

SEQ ID NO: 89304 - RNA, 22 nt, Human
uggcucacgucuguaaucccag

SEQ ID NO: 89305 - RNA, 20 nt, Human
aucacuggcauauuuagaau

SEQ ID NO: 89306 - RNA, 22 nt, Human
cggaguuuccucuuucacugga

SEQ ID NO: 89307 - RNA, 22 nt, Human
ucugucacccaggcugcagugc

SEQ ID NO: 89308 - RNA, 22 nt, Human
cuugcugacuuugcaccuccuu

SEQ ID NO: 89309 - RNA, 27 nt, Human
ggaggcugaggcaggaaaauugcuuga

SEQ ID NO: 89310 - RNA, 24 nt, Human
ggucagggagaguuugggaacugc

SEQ ID NO: 89311 - RNA, 21 nt, Human
ccccauacccuucagugcagu

SEQ ID NO: 89312 - RNA, 21 nt, Human
gggcaacacagcaagacccca

SEQ ID NO: 89313 - RNA, 20 nt, Human
ccuccugcuaacuccuagcu

SEQ ID NO: 89314 - RNA, 26 nt, Human
cccugcacuccacgcuggccaagaag

SEQ ID NO: 89315 - RNA, 19 nt, Human
gcacuugagugcacuggca

SEQ ID NO: 89316 - RNA, 22 nt, Human
accugccacuacauucugguuu

SEQ ID NO: 89317 - RNA, 21 nt, Human
guuuuucuaacaacuguggag

SEQ ID NO: 89318 - RNA, 21 nt, Human
uuagaaaacauguaccuuccu

SEQ ID NO: 89319 - RNA, 25 nt, Human
caauugucaucuauauauucuauau

SEQ ID NO: 89320 - RNA, 22 nt, Human
gcucggcuguaaacagcucugu

SEQ ID NO: 89321 - RNA, 26 nt, Human
cgugcuguuugcaaaccugccuguac

SEQ ID NO: 89322 - RNA, 25 nt, Human
ucacaccugacauguauguccucca

SEQ ID NO: 89323 - RNA, 22 nt, Human
gcucaagcuucccaaguagcug

SEQ ID NO: 89324 - RNA, 18 nt, Human
acccuucucacacccuca

SEQ ID NO: 89325 - RNA, 22 nt, Human
gagcugagaauacuacaucuua

SEQ ID NO: 89326 - RNA, 22 nt, Human
uuacaguguaguguuuauucua

SEQ ID NO: 89327 - RNA, 25 nt, Human
ucagcccuaccaucuugccagcucu

SEQ ID NO: 89328 - RNA, 22 nt, Human
ggggacaucacuuagaaguucu

SEQ ID NO: 89329 - RNA, 22 nt, Human
gucuuguguugcuucuggucuc

SEQ ID NO: 89330 - RNA, 22 nt, Human
uaaacacauuaaaagacaaaua

SEQ ID NO: 89331 - RNA, 20 nt, Human
cacugcauauaguacacagg

SEQ ID NO: 89332 - RNA, 11 nt, Human
agggugccuua

SEQ ID NO: 89333 - RNA, 21 nt, Human
ucagggcccuuuccuguguac

SEQ ID NO: 89334 - RNA, 27 nt, Human
cccugcacagcacuggccuuucggaag

SEQ ID NO: 89335 - RNA, 27 nt, Human
gguguuuuuauaauauccauauagaaa

SEQ ID NO: 89336 - RNA, 21 nt, Human
uugggugguggagugcaaagg

SEQ ID NO: 89337 - RNA, 22 nt, Human
cccuaacaaagaccaccaggac

SEQ ID NO: 89338 - RNA, 27 nt, Human
ugcacccaggcagcggcucagaggcag

SEQ ID NO: 89339 - RNA, 21 nt, Human
acccuguguuguggacucuuu

SEQ ID NO: 89340 - RNA, 22 nt, Human
ccaagauggugaaaccccgucu

SEQ ID NO: 89341 - RNA, 17 nt, Human
uuuauucuucuuuucca

SEQ ID NO: 89342 - RNA, 25 nt, Human
uagccucuucucuaaaugcuuccuc

SEQ ID NO: 89343 - RNA, 23 nt, Human
guguacacuacugaugcuguuug

SEQ ID NO: 89344 - RNA, 18 nt, Human
uugcggacuucucugccu

SEQ ID NO: 89345 - RNA, 21 nt, Human
ccagaagcauagcuuagaugg

SEQ ID NO: 89346 - RNA, 19 nt, Human
uuuucagcaugacacuguu

SEQ ID NO: 89347 - RNA, 26 nt, Human
ucuuuccuugacaaguugauuuugca

SEQ ID NO: 89348 - RNA, 24 nt, Human
ccuaacauaugacacuucaucuua

SEQ ID NO: 89349 - RNA, 21 nt, Human
ccugccugccccaccugccuc

SEQ ID NO: 89350 - RNA, 21 nt, Human
aagugcugggauugcaggcgu

SEQ ID NO: 89351 - RNA, 26 nt, Human
ggccaaggucagcauagacugaggca

SEQ ID NO: 89352 - RNA, 22 nt, Human
agcuugagcagggaggauccga

SEQ ID NO: 89353 - RNA, 25 nt, Human
acugacacuuccuguccuuguucau

SEQ ID NO: 89354 - RNA, 20 nt, Human
uggggugacuuccuggucac

SEQ ID NO: 89355 - RNA, 17 nt, Human
ugcucccuccggacagc

SEQ ID NO: 89356 - RNA, 22 nt, Human
uggccugcacacagcugcucag

SEQ ID NO: 89357 - RNA, 20 nt, Human
uggacuuuuuauuuuuauau

SEQ ID NO: 89358 - RNA, 22 nt, Human
ggucuugaauuccugaccucag

SEQ ID NO: 89359 - RNA, 23 nt, Human
gagcuccccccagacuggagagc

SEQ ID NO: 89360 - RNA, 22 nt, Human
uuuaagccauucuucugccuca

SEQ ID NO: 89361 - RNA, 23 nt, Human
auugccaggcugugguugugagu

SEQ ID NO: 89362 - RNA, 24 nt, Human
guccccaggugaacauggcugaag

SEQ ID NO: 89363 - RNA, 26 nt, Human
cacauuggaagagcagcaccuccuca

SEQ ID NO: 89364 - RNA, 27 nt, Human
gcuuuggggauggcuggaagugcaaug

SEQ ID NO: 89365 - RNA, 21 nt, Human
uguguaugagucccauuugcc

SEQ ID NO: 89366 - RNA, 22 nt, Human
cacaguaagccuugcagcuuga

SEQ ID NO: 89367 - RNA, 19 nt, Human
ccuuccucagcugccuccu

SEQ ID NO: 89368 - RNA, 21 nt, Human
ucuaaaucaccagaaaauuaa

SEQ ID NO: 89369 - RNA, 22 nt, Human
ggcucacugcagccucuaccuc

SEQ ID NO: 89370 - RNA, 23 nt, Human
aacacaaaaagcaugaacuugua

SEQ ID NO: 89371 - RNA, 22 nt, Human
acccuccaugaacugugcuccc

SEQ ID NO: 89372 - RNA, 20 nt, Human
ugggagccuagcuccugcca

SEQ ID NO: 89373 - RNA, 21 nt, Human
aaacuguugauuauuagccag

SEQ ID NO: 89374 - RNA, 23 nt, Human
ccguggccagagucuggcggcgg

SEQ ID NO: 89375 - RNA, 22 nt, Human
agccuuccaaguagcugggucu

SEQ ID NO: 89376 - RNA, 21 nt, Human
ugggcuguucaucucuugcuu

SEQ ID NO: 89377 - RNA, 22 nt, Human
ccuguaaucccaacuacuuggg

SEQ ID NO: 89378 - RNA, 22 nt, Human
agcaucuggggagguacugaac

SEQ ID NO: 89379 - RNA, 22 nt, Human
gggagcuggagcagcugauagu

SEQ ID NO: 89380 - RNA, 24 nt, Human
cugcaggcagacuuuucccuaccu

SEQ ID NO: 89381 - RNA, 21 nt, Human
ccuccccccgaucugccucca

SEQ ID NO: 89382 - RNA, 23 nt, Human
aaaggaagaaauacauauuuuua

SEQ ID NO: 89383 - RNA, 27 nt, Human
ucuucugggcauuuaagcugguauguu

SEQ ID NO: 89384 - RNA, 20 nt, Human
gcugcacaucaugggcucug

SEQ ID NO: 89385 - RNA, 24 nt, Human
cgacuggcugcagcggacacugcc

SEQ ID NO: 89386 - RNA, 23 nt, Human
aggaagagcuguguggccuggca

SEQ ID NO: 89387 - RNA, 24 nt, Human
acucagaguugcaaccucagccuc

SEQ ID NO: 89388 - RNA, 27 nt, Human
ccacauacuuaacguuucuauauuucu

SEQ ID NO: 89389 - RNA, 17 nt, Human
acuaugaaaaugccagu

SEQ ID NO: 89390 - RNA, 18 nt, Human
uguuuccucuuuauuuuu

SEQ ID NO: 89391 - RNA, 19 nt, Human
cacucugggacaggcacgg

SEQ ID NO: 89392 - RNA, 21 nt, Human
aggaauuauucagaaaaacac

SEQ ID NO: 89393 - RNA, 24 nt, Human
gaagaagaagaaguccccuguaag

SEQ ID NO: 89394 - RNA, 22 nt, Human
cacagccgaggcuggagcacag

SEQ ID NO: 89395 - RNA, 25 nt, Human
ucugccacccaggcuggaguacagu

SEQ ID NO: 89396 - RNA, 21 nt, Human
ggaggcagagcuugcagugag

SEQ ID NO: 89397 - RNA, 26 nt, Human
cuucauuuguguucagucugaauuau

SEQ ID NO: 89398 - RNA, 23 nt, Human
uuuaccuccccuuuucuauguug

SEQ ID NO: 89399 - RNA, 30 nt, Human
ucuugggccacaccugcucacucugggguu

SEQ ID NO: 89400 - RNA, 21 nt, Human
ccgacuugcccuccugccuca

SEQ ID NO: 89401 - RNA, 20 nt, Human
aacaacaaaguacagauuua

SEQ ID NO: 89402 - RNA, 21 nt, Human
agccggcagaaauagcuaugg

SEQ ID NO: 89403 - RNA, 20 nt, Human
uacacauuccugcauucaug

SEQ ID NO: 89404 - RNA, 22 nt, Human
agagaagaacacugaacuuuga

SEQ ID NO: 89405 - RNA, 26 nt, Human
ccugcccaaucagagaugccaaaaau

SEQ ID NO: 89406 - RNA, 23 nt, Human
uuauaaaacaugaaaaucgcuuu

SEQ ID NO: 89407 - RNA, 30 nt, Human
uggaccaaacacuggugcuggcuuuggugg

SEQ ID NO: 89408 - RNA, 25 nt, Human
cccaggcuggagugcagugccauga

SEQ ID NO: 89409 - RNA, 22 nt, Human
cguugugcuccagccugggcga

SEQ ID NO: 89410 - RNA, 21 nt, Human
uucucaucuuuggccuguuca

SEQ ID NO: 89411 - RNA, 21 nt, Human
gucguucuuugacaguucuuu

SEQ ID NO: 89412 - RNA, 22 nt, Human
agaauugaaacgucagcucagg

SEQ ID NO: 89413 - RNA, 20 nt, Human
ucucuuugccuucaggcugg

SEQ ID NO: 89414 - RNA, 22 nt, Human
ugugagccaccgugccuggcca

SEQ ID NO: 89415 - RNA, 20 nt, Human
cuuccagucagguaguugca

SEQ ID NO: 89416 - RNA, 27 nt, Human
ccguggcucccaccagcagugccaccg

SEQ ID NO: 89417 - RNA, 23 nt, Human
uuccugcgccccagacuccaggc

SEQ ID NO: 89418 - RNA, 26 nt, Human
uucuccaacuccugacuucaugaucc

SEQ ID NO: 89419 - RNA, 24 nt, Human
aguaacaaaugaaggacaagcaua

SEQ ID NO: 89420 - RNA, 24 nt, Human
gcguggagccugacgcacucugag

SEQ ID NO: 89421 - RNA, 20 nt, Human
gcagguggaucaugagguca

SEQ ID NO: 89422 - RNA, 23 nt, Human
cuaguagcugggauugcaggcac

SEQ ID NO: 89423 - RNA, 19 nt, Human
cacacguacacacccacac

SEQ ID NO: 89424 - RNA, 21 nt, Human
ccagccaccacccacucccac

SEQ ID NO: 89425 - RNA, 23 nt, Human
gucuggauaucaguacaugacaa

SEQ ID NO: 89426 - RNA, 22 nt, Human
cucaaccucccaaguaguuggg

SEQ ID NO: 89427 - RNA, 24 nt, Human
cggguuuugacuuaacucacaaga

SEQ ID NO: 89428 - RNA, 20 nt, Human
ccagauuuugggauuacaaa

SEQ ID NO: 89429 - RNA, 23 nt, Human
ugcauugaguugaaaacugcaaa

SEQ ID NO: 89430 - RNA, 25 nt, Human
ccagcacucugguuaaauuuuaagg

SEQ ID NO: 89431 - RNA, 21 nt, Human
acaagcugcagucuguagcac

SEQ ID NO: 89432 - RNA, 22 nt, Human
gccuaccagaagaacuaguaga

SEQ ID NO: 89433 - RNA, 21 nt, Human
ucagcaguauuauaucugcca

SEQ ID NO: 89434 - RNA, 27 nt, Human
gagcuaaaaccuuagauaucugguucu

SEQ ID NO: 89435 - RNA, 20 nt, Human
aagaauuucaaaaauggcua

SEQ ID NO: 89436 - RNA, 20 nt, Human
gcucuacuuccccauggccc

SEQ ID NO: 89437 - RNA, 27 nt, Human
ugccuucuguuucacagcugccaccac

SEQ ID NO: 89438 - RNA, 24 nt, Human
aaccacauuuuuccucaucaucca

SEQ ID NO: 89439 - RNA, 21 nt, Human
ggcucucugcaaccuccgccu

SEQ ID NO: 89440 - RNA, 22 nt, Human
cugcaaccucugccuaccggau

SEQ ID NO: 89441 - RNA, 22 nt, Human
ugagacuccguacuacuggaug

SEQ ID NO: 89442 - RNA, 23 nt, Human
uuccaccuuggccaucuucuucc

SEQ ID NO: 89443 - RNA, 21 nt, Human
ccauccacagagcagugcagu

SEQ ID NO: 89444 - RNA, 20 nt, Human
uuuuuagcugcugaacugcc

SEQ ID NO: 89445 - RNA, 20 nt, Human
uguaagguggugguaacuau

SEQ ID NO: 89446 - RNA, 25 nt, Human
uccacauaaggaaacuggguuccug

SEQ ID NO: 89447 - RNA, 20 nt, Human
cuucuuucaaauugagagaa

SEQ ID NO: 89448 - RNA, 26 nt, Human
cugacuucucugggcugaggcugguc

SEQ ID NO: 89449 - RNA, 22 nt, Human
caacaccagcaggguaucuccc

SEQ ID NO: 89450 - RNA, 27 nt, Human
cuuuagucaaagacuccuggaaaggag

SEQ ID NO: 89451 - RNA, 24 nt, Human
gcugcagccuccaccgugcugagg

SEQ ID NO: 89452 - RNA, 22 nt, Human
aaugccaggaaaaauuccuggg

SEQ ID NO: 89453 - RNA, 28 nt, Human
ccccacccuguaacuccagcugccacuc

SEQ ID NO: 89454 - RNA, 22 nt, Human
agacccagcaggaagccaggcu

SEQ ID NO: 89455 - RNA, 27 nt, Human
cugcuuuggaggguaaaguggggaaga

SEQ ID NO: 89456 - RNA, 24 nt, Human
cgcccauucucucuccauaccacc

SEQ ID NO: 89457 - RNA, 20 nt, Human
guccacccucuccagugguc

SEQ ID NO: 89458 - RNA, 24 nt, Human
aacacccugaagagcaacauggga

SEQ ID NO: 89459 - RNA, 25 nt, Human
cccuccaggcagaggcucuagcuca

SEQ ID NO: 89460 - RNA, 19 nt, Human
agcggccuccccuuugcga

SEQ ID NO: 89461 - RNA, 25 nt, Human
cccaggagguuauaugauugcucuu

SEQ ID NO: 89462 - RNA, 31 nt, Human
accuggagcugaaucacaugaccuagcugca

SEQ ID NO: 89463 - RNA, 19 nt, Human
ucugggagccagagccucu

SEQ ID NO: 89464 - RNA, 21 nt, Human
uuuugaaagaucuucucucca

SEQ ID NO: 89465 - RNA, 27 nt, Human
ugaaauccaggaagucccucuccuggu

SEQ ID NO: 89466 - RNA, 22 nt, Human
ggacucuaucccuggcuucccc

SEQ ID NO: 89467 - RNA, 23 nt, Human
uccuggagccacguccagcacag

SEQ ID NO: 89468 - RNA, 25 nt, Human
caggcagcuggcaggaguggggugg

SEQ ID NO: 89469 - RNA, 22 nt, Human
gcagagcuagguggaaaagccu

SEQ ID NO: 89470 - RNA, 27 nt, Human
ucacccaguuuaguuugggaugauuug

SEQ ID NO: 89471 - RNA, 20 nt, Human
uacccaggguggagugcagu

SEQ ID NO: 89472 - RNA, 24 nt, Human
ggagacacagauggcaccuguggc

SEQ ID NO: 89473 - RNA, 23 nt, Human
cugucaccaaggcuuagugcagu

SEQ ID NO: 89474 - RNA, 20 nt, Human
ccagaccacucugcuucauu

SEQ ID NO: 89475 - RNA, 26 nt, Human
ucccucacuggcugccauugaaagag

SEQ ID NO: 89476 - RNA, 22 nt, Human
cugaauucugcccuuuucucuc

SEQ ID NO: 89477 - RNA, 21 nt, Human
gugcugcugcuccugcagcug

SEQ ID NO: 89478 - RNA, 23 nt, Human
aaacuuggcccugcgucuuccca

SEQ ID NO: 89479 - RNA, 21 nt, Human
gucgccaggcuggaguguagu

SEQ ID NO: 89480 - RNA, 22 nt, Human
auaaaugcagcaaaucuagcuu

SEQ ID NO: 89481 - RNA, 21 nt, Human
ugggacacgagaccucaucau

SEQ ID NO: 89482 - RNA, 21 nt, Human
acagaagucacuuuggcuguu

SEQ ID NO: 89483 - RNA, 21 nt, Human
gguaauucgagccaucuggag

SEQ ID NO: 89484 - RNA, 24 nt, Human
guggggcgagggggacaggguugc

SEQ ID NO: 89485 - RNA, 18 nt, Human
ggccucggacuuagcugg

SEQ ID NO: 89486 - RNA, 27 nt, Human
uauuacugcuaaguauuucccagcaca

SEQ ID NO: 89487 - RNA, 21 nt, Human
ucacaggaagcugauguggcc

SEQ ID NO: 89488 - RNA, 22 nt, Human
ggacugcaaaacaguucuacua

SEQ ID NO: 89489 - RNA, 27 nt, Human
ucauugcacuccagccugggcaacaag

SEQ ID NO: 89490 - RNA, 20 nt, Human
ccagaaaggucugggcugug

SEQ ID NO: 89491 - RNA, 23 nt, Human
aaccuauaaacuagcuggaccau

SEQ ID NO: 89492 - RNA, 29 nt, Human
cuccucacucuucuccaucaggcauuaaa

SEQ ID NO: 89493 - RNA, 24 nt, Human
ggaggcugggcggaggugggcagg

SEQ ID NO: 89494 - RNA, 23 nt, Human
ucagggguagcgagguugcagga

SEQ ID NO: 89495 - RNA, 20 nt, Human
acaccugagguucuggagcu

SEQ ID NO: 89496 - RNA, 17 nt, Human
uaaaagaguuuauauac

SEQ ID NO: 89497 - RNA, 22 nt, Human
ccccccaggcugaagugcagug

SEQ ID NO: 89498 - RNA, 26 nt, Human
auguagaaugaaugaggguacuguca

SEQ ID NO: 89499 - RNA, 19 nt, Human
ugcuguugucugucuggca

SEQ ID NO: 89500 - RNA, 32 nt, Human; identical to SEQ ID NO: 8129

SEQ ID NO: 89501 - RNA, 19 nt, Human
ggacuucucccaggagaag

SEQ ID NO: 89502 - RNA, 18 nt, Human
agcccaccagccaccuca

SEQ ID NO: 89503 - RNA, 22 nt, Human
cccaaaguguugggauuacagg

SEQ ID NO: 89504 - RNA, 22 nt, Human
cucaaagugcugggauuacagg

SEQ ID NO: 89505 - RNA, 20 nt, Human
gagaaauugaauguaccuua

SEQ ID NO: 89506 - RNA, 27 nt, Human
acaaaccuugcuccuguguaaaacuau

SEQ ID NO: 89507 - RNA, 24 nt, Human
cucguggcccacgcuccaugccag

SEQ ID NO: 89508 - RNA, 27 nt, Human
gucucugaggggagcggcgaccccgcc

SEQ ID NO: 89509 - RNA, 27 nt, Human
caggcagccgguggagagggacgcggc

SEQ ID NO: 89510 - RNA, 24 nt, Human
gagccucuccuacucagacuguua

SEQ ID NO: 89511 - RNA, 20 nt, Human
ggggcacggcccgcaugcau

SEQ ID NO: 89512 - RNA, 25 nt, Human
uggaccuuuuaaguauauuaauucc

SEQ ID NO: 89513 - RNA, 22 nt, Human
aaccuccugggcucaagccauc

SEQ ID NO: 89514 - RNA, 22 nt, Human
aaacuccugggcucaagcaauc

SEQ ID NO: 89515 - RNA, 25 nt, Human
ucugcagcuuguccucccuuccguc

SEQ ID NO: 89516 - RNA, 27 nt, Human
gggaccaggggaccuuuuggugcagug

SEQ ID NO: 89517 - RNA, 27 nt, Human
caggcuggggacagagguggcccuggu

SEQ ID NO: 89518 - RNA, 20 nt, Human
guaccacauuuuaacuuacc

SEQ ID NO: 89519 - RNA, 21 nt, Human
cugguaaugguggauucauuu

SEQ ID NO: 89520 - RNA, 21 nt, Human
gaaaugaggguccuggguggg

SEQ ID NO: 89521 - RNA, 25 nt, Human
ggagguccuuccagccaccuuauuu

SEQ ID NO: 89522 - RNA, 22 nt, Human
accaugucugcacacaccagaa

SEQ ID NO: 89523 - RNA, 21 nt, Human
agcaguuuuacuaucgaauca

SEQ ID NO: 89524 - RNA, 26 nt, Human
ugagccccaacuucuaaaaauguauc

SEQ ID NO: 89525 - RNA, 27 nt, Human
ccugaauccuguucucugacauccgug

SEQ ID NO: 89526 - RNA, 27 nt, Human
agccuccucugcuugcaucacuugggg

SEQ ID NO: 89527 - RNA, 27 nt, Human
uuccacauucugugucaucuagucgug

SEQ ID NO: 89528 - RNA, 22 nt, Human
uucacacaucccuucuuuugaa

SEQ ID NO: 89529 - RNA, 27 nt, Human
cacccuccaaguccucugaccuaauuu

SEQ ID NO: 89530 - RNA, 22 nt, Human
cccugcugcuccaggacauaua

SEQ ID NO: 89531 - RNA, 25 nt, Human
gcugcauugugguguucucuucuca

SEQ ID NO: 89532 - RNA, 22 nt, Human
cacgcauguaaucccagcacuc

SEQ ID NO: 89533 - RNA, 22 nt, Human
gcucacgucuguaaucccagcg

SEQ ID NO: 89534 - RNA, 26 nt, Human
aauguuucucauuuggaaaaugaaau

SEQ ID NO: 89535 - RNA, 21 nt, Human
ccuaucaacagaucauccugc

SEQ ID NO: 89536 - RNA, 23 nt, Human
cgugaagaaagcagggcaagugc

SEQ ID NO: 89537 - RNA, 20 nt, Human
accugcccauguccagaggg

SEQ ID NO: 89538 - RNA, 23 nt, Human
agaaggaaugugaaucuguuguu

SEQ ID NO: 89539 - RNA, 23 nt, Human
aggcuggaguggaguggcgugau

SEQ ID NO: 89540 - RNA, 26 nt, Human
uggcaaaaacagacuuccggggaauu

SEQ ID NO: 89541 - RNA, 22 nt, Human
caggauggagugcaguggugag

SEQ ID NO: 89542 - RNA, 22 nt, Human
caggcuggaguguaguggugug

SEQ ID NO: 89543 - RNA, 22 nt, Human
caggcuggagugcaguggugcg

SEQ ID NO: 89544 - RNA, 22 nt, Human
cagguuggagugcaguggugug

SEQ ID NO: 89545 - RNA, 27 nt, Human
ucugaaggaaauaaugcaaacauuuua

SEQ ID NO: 89546 - RNA, 26 nt, Human
agagggcugccugagggcugugcuga

SEQ ID NO: 89547 - RNA, 20 nt, Human
cugauaccacugcacugucu

SEQ ID NO: 89548 - RNA, 22 nt, Human
uacagaaguuucuguugcuguu

SEQ ID NO: 89549 - RNA, 25 nt, Human
acagaaguccuguaugucugucauu

SEQ ID NO: 89550 - RNA, 25 nt, Human
auuucauuucugaauagcuuuugaa

SEQ ID NO: 89551 - RNA, 16 nt, Human
uagaaaauggaaccac

SEQ ID NO: 89552 - RNA, 22 nt, Human
cgccucccagguucaagcaguu

SEQ ID NO: 89553 - RNA, 21 nt, Human
aguuucuagcauuaaacaaau

SEQ ID NO: 89554 - RNA, 22 nt, Human
aaaaaugcucaaucucagcuaa

SEQ ID NO: 89555 - RNA, 23 nt, Human
gagcaagccuggcuuuaaagauu

SEQ ID NO: 89556 - RNA, 22 nt, Human
cccgcuuccuccuccugcucca

SEQ ID NO: 89557 - RNA, 26 nt, Human
cuccugggcauaagcuguggccauga

SEQ ID NO: 89558 - RNA, 22 nt, Human
caacauagcaaaauccugucuc

SEQ ID NO: 89559 - RNA, 22 nt, Human
uucugccaugacuguguauuuu

SEQ ID NO: 89560 - RNA, 22 nt, Human
ccccccuguauucucagcacuu

SEQ ID NO: 89561 - RNA, 24 nt, Human
ccuggcaaugacagcauuucucac

SEQ ID NO: 89562 - RNA, 23 nt, Human
ggcuuugacauggguauuucugu

SEQ ID NO: 89563 - RNA, 22 nt, Human
cuaacauggugaaaccucaucu

SEQ ID NO: 89564 - RNA, 22 nt, Human
ccaacauggcaaaaccucgucu

SEQ ID NO: 89565 - RNA, 27 nt, Human
gucgccuugacaccgccaucucuuuuc

SEQ ID NO: 89566 - RNA, 25 nt, Human
aucguggcuggcccgguucuccgcu

SEQ ID NO: 89567 - RNA, 25 nt, Human
ugccuggaaaguggagacugagaug

SEQ ID NO: 89568 - RNA, 22 nt, Human
aggcugaggcggaagaaucacu

SEQ ID NO: 89569 - RNA, 26 nt, Human
acugccuggcuccacgugccuccugg

SEQ ID NO: 89570 - RNA, 27 nt, Human
gagguuagaugggaggaugaauuguca

SEQ ID NO: 89571 - RNA, 21 nt, Human
agcugccaggcucaagaaauc

SEQ ID NO: 89572 - RNA, 22 nt, Human
guuuuucugugugucaguuuuc

SEQ ID NO: 89573 - RNA, 22 nt, Human
ccgccaucuacccuccgcuccu

SEQ ID NO: 89574 - RNA, 19 nt, Human
uugcccagaguuugcucaa

SEQ ID NO: 89575 - RNA, 24 nt, Human
ugguggaggugggguuggagcagg

SEQ ID NO: 89576 - RNA, 27 nt, Human
cgggagccggacccgucggcagaggag

SEQ ID NO: 89577 - RNA, 29 nt, Human
uucugguucucacacuguacucugagguc

SEQ ID NO: 89578 - RNA, 18 nt, Human
uuuucugcuuuugaaauc

SEQ ID NO: 89579 - RNA, 21 nt, Human
gccaagccaccaagugaaacc

SEQ ID NO: 89580 - RNA, 27 nt, Human
gccgcguaucccccggcuaccugggcc

SEQ ID NO: 89581 - RNA, 26 nt, Human
guguaucuaucauuagcuauauggga

SEQ ID NO: 89582 - RNA, 24 nt, Human
cuacagugagcuaugauuacacca

SEQ ID NO: 89583 - RNA, 26 nt, Human
cucaaggacccucagcaacuggggcc

SEQ ID NO: 89584 - RNA, 27 nt, Human
ccuccauggugccucuggaggccucug

SEQ ID NO: 89585 - RNA, 26 nt, Human
gaggggcccuagugccucuguuccug

SEQ ID NO: 89586 - RNA, 27 nt, Human
ucagcacugggcauucuuggagggauc

SEQ ID NO: 89587 - RNA, 24 nt, Human
uccugucuugugcuuuauccugcc

SEQ ID NO: 89588 - RNA, 27 nt, Human
cuaccaugaauccgcucccaagggucu

SEQ ID NO: 89589 - RNA, 22 nt, Human
ugccauugcugcuaaagguuac

SEQ ID NO: 89590 - RNA, 22 nt, Human
aaccaaaaagcaugguuuauuc

SEQ ID NO: 89591 - RNA, 23 nt, Human
ccugaacuuccugcuuccucaga

SEQ ID NO: 89592 - RNA, 27 nt, Human
aaacuugccaccaagagcccaacaauc

SEQ ID NO: 89593 - RNA, 19 nt, Human
uaaaaacaaugugcugcug

SEQ ID NO: 89594 - RNA, 21 nt, Human
uuuuaaggaacaagaauugcu

SEQ ID NO: 89595 - RNA, 20 nt, Human
gcugcugggaugguggugaa

SEQ ID NO: 89596 - RNA, 19 nt, Human
uccucauucuguggggcca

SEQ ID NO: 89597 - RNA, 21 nt, Human
uuaguaaucauguuggcuggu

SEQ ID NO: 89598 - RNA, 23 nt, Human
cgcagccgccggacccugcccag

SEQ ID NO: 89599 - RNA, 20 nt, Human
aaaugagaaaauugucuggg

SEQ ID NO: 89600 - RNA, 27 nt, Human
cugugugaucuugggcaagucacuuaa

SEQ ID NO: 89601 - RNA, 24 nt, Human
acuggacuuuuuaaacccucuuca

SEQ ID NO: 89602 - RNA, 18 nt, Human
ccucugccuucauuucuc

SEQ ID NO: 89603 - RNA, 24 nt, Human
uccugggggccucguguucaucaa

SEQ ID NO: 89604 - RNA, 18 nt, Human
uuuucuuuguuucuuucu

SEQ ID NO: 89605 - RNA, 26 nt, Human
cugccuacacuccugccugcugugcc

SEQ ID NO: 89606 - RNA, 21 nt, Human
cucaucaugucccaaaccaga

SEQ ID NO: 89607 - RNA, 23 nt, Human
gaggaagagccgcgggcccggcg

SEQ ID NO: 89608 - RNA, 21 nt, Human
ccugaaucuaacagugacuuc

SEQ ID NO: 89609 - RNA, 23 nt, Human
ugaaugucauaguuagcuacuuu

SEQ ID NO: 89610 - RNA, 20 nt, Human
cccugcuugggagagcucuu

SEQ ID NO: 89611 - RNA, 21 nt, Human
ggcuuugggguccuagcccag

SEQ ID NO: 89612 - RNA, 23 nt, Human
gcugggugggguggggcacggag

SEQ ID NO: 89613 - RNA, 17 nt, Human
acggacacgcucugcug

SEQ ID NO: 89614 - RNA, 27 nt, Human
gacuuuguaucuucacugccaagcaaa

SEQ ID NO: 89615 - RNA, 26 nt, Human
caucuugccagccccuggcugagugu

SEQ ID NO: 89616 - RNA, 21 nt, Human
uuguuucuuuaagaaaguacu

SEQ ID NO: 89617 - RNA, 22 nt, Human
gcgcacacacauacauacgcgc

SEQ ID NO: 89618 - RNA, 22 nt, Human
uggguacaugugaggacugggg

SEQ ID NO: 89619 - RNA, 21 nt, Human
caguaagugaaauacaaccua

SEQ ID NO: 89620 - RNA, 21 nt, Human
caaucacuguaaccugauuca

SEQ ID NO: 89621 - RNA, 21 nt, Human
ugccaaggcuggagugcaggc

SEQ ID NO: 89622 - RNA, 21 nt, Human
uggaguaaaccuucaacaccg

SEQ ID NO: 89623 - RNA, 23 nt, Human
aucaauaaagaaaggcuucuuca

SEQ ID NO: 89624 - RNA, 21 nt, Human
uagaauuuuuguacugcagca

SEQ ID NO: 89625 - RNA, 18 nt, Human
ucaggcccugaagccggu

SEQ ID NO: 89626 - RNA, 21 nt, Human
uggagguggagggaccgagga

SEQ ID NO: 89627 - RNA, 22 nt, Human
agaaguuacuuuaaaaagacuu

SEQ ID NO: 89628 - RNA, 22 nt, Human
aagcaccgcauaaauacuugag

SEQ ID NO: 89629 - RNA, 31 nt, Human
cggguuccagcggaccucacagcagccccag

SEQ ID NO: 89630 - RNA, 22 nt, Human
accagccuggacaacauaguga

SEQ ID NO: 89631 - RNA, 18 nt, Human
aagaauuguugauaguua

SEQ ID NO: 89632 - RNA, 23 nt, Human
acugucgucuucuguuagugcca

SEQ ID NO: 89633 - RNA, 29 nt, Human
ucuucuccuccaugaacaucauggacuga

SEQ ID NO: 89634 - RNA, 22 nt, Human
cugcccuuuuccaugugucuuc

SEQ ID NO: 89635 - RNA, 21 nt, Human
uuuuuauauguauauagauga

SEQ ID NO: 89636 - RNA, 23 nt, Human
cacccaggccuggagcugggaug

SEQ ID NO: 89637 - RNA, 23 nt, Human
ccuagguccugcccuccuggucc

SEQ ID NO: 89638 - RNA, 24 nt, Human
aguggacaguuuuaagcagaggaa

SEQ ID NO: 89639 - RNA, 22 nt, Human
acacacauauacacacagacau

SEQ ID NO: 89640 - RNA, 25 nt, Human
cugggucucacuacaagcagccuau

SEQ ID NO: 89641 - RNA, 22 nt, Human
ccccaauuacagggugacucac

SEQ ID NO: 89642 - RNA, 21 nt, Human
ccagccacauguccuccauca

SEQ ID NO: 89643 - RNA, 24 nt, Human
cacugcccaaucccaguaaugcug

SEQ ID NO: 89644 - RNA, 26 nt, Human
uucugucaaaacacuugcuuccauuu

SEQ ID NO: 89645 - RNA, 20 nt, Human
ccuaaaacaaaagcucaucc

SEQ ID NO: 89646 - RNA, 22 nt, Human
ggcucacugcaacguccgccuc

SEQ ID NO: 89647 - RNA, 23 nt, Human
guugccuggcacccaccugucgc

SEQ ID NO: 89648 - RNA, 22 nt, Human
guugggauaaauagcuaaaugg

SEQ ID NO: 89649 - RNA, 27 nt, Human
ggaacauuugaacaugaaugcuguuug

SEQ ID NO: 89650 - RNA, 26 nt, Human
gauugcacuagagaaacuugaaugcu

SEQ ID NO: 89651 - RNA, 20 nt, Human
cucuaaaacaugaaugcuuu

SEQ ID NO: 89652 - RNA, 20 nt, Human
gcuggcuuuggaaugagguu

SEQ ID NO: 89653 - RNA, 19 nt, Human
ccaccugcacagguauuuu

SEQ ID NO: 89654 - RNA, 22 nt, Human
uuccuuagugggcuucagcugu

SEQ ID NO: 89655 - RNA, 22 nt, Human
cuccccauguacauaauaucca

SEQ ID NO: 89656 - RNA, 19 nt, Human
cuucugcucccaccccaga

SEQ ID NO: 89657 - RNA, 23 nt, Human
uggggucaauaccaccuaccuca

SEQ ID NO: 89658 - RNA, 22 nt, Human
cacaguuuuuauagugucugua

SEQ ID NO: 89659 - RNA, 27 nt, Human
caggcuggagugcaguggcgccaucuc

SEQ ID NO: 89660 - RNA, 27 nt, Human
caggcuggagugcaguggugccaucuu

SEQ ID NO: 89661 - RNA, 22 nt, Human
ucucuucuuuauucccuguaau

SEQ ID NO: 89662 - RNA, 20 nt, Human
ugaagucagaauuugccauu

SEQ ID NO: 89663 - RNA, 27 nt, Human
caggcuggagugcaguggcgggaucuc

SEQ ID NO: 89664 - RNA, 23 nt, Human
cauaaauuuggugauucucugcu

SEQ ID NO: 89665 - RNA, 20 nt, Human
aauccuuuggggagcgaugu

SEQ ID NO: 89666 - RNA, 21 nt, Human
gaagguggggucaagggaggc

SEQ ID NO: 89667 - RNA, 27 nt, Human
cccuccagaacuucaggcucucaguga

SEQ ID NO: 89668 - RNA, 23 nt, Human
gguucaccuuuacagagcauaag

SEQ ID NO: 89669 - RNA, 21 nt, Human
ugucugguccauugcuggcag

SEQ ID NO: 89670 - RNA, 19 nt, Human
cccuggcauucaacaaaua

SEQ ID NO: 89671 - RNA, 23 nt, Human
cuccugccucagccucccaaaua

SEQ ID NO: 89672 - RNA, 23 nt, Human
ggaccccggaaauuggagugaag

SEQ ID NO: 89673 - RNA, 21 nt, Human
uugcucucugggcuuuugguu

SEQ ID NO: 89674 - RNA, 19 nt, Human
guagggagaguaagucagc

SEQ ID NO: 89675 - RNA, 22 nt, Human
ccgaguagcugggauuagaggc

SEQ ID NO: 89676 - RNA, 24 nt, Human
auuucauugacuaacccaggacag

SEQ ID NO: 89677 - RNA, 19 nt, Human
ccucagcccggcagccagc

SEQ ID NO: 89678 - RNA, 23 nt, Human
agauaauucaaccaucuaaucaa

SEQ ID NO: 89679 - RNA, 24 nt, Human
ucuugagguugucugagucuuggg

SEQ ID NO: 89680 - RNA, 22 nt, Human
aggccugaaucaugagccugcu

SEQ ID NO: 89681 - RNA, 21 nt, Human
uuacaguuuacguccauucca

SEQ ID NO: 89682 - RNA, 25 nt, Human
ucuagugggaaggggugcccccagg

SEQ ID NO: 89683 - RNA, 21 nt, Human
ugcaaccucugcuccaaagag

SEQ ID NO: 89684 - RNA, 22 nt, Human
cccggccagagggagagcuugg

SEQ ID NO: 89685 - RNA, 18 nt, Human
aggugaggagcaggcucc

SEQ ID NO: 89686 - RNA, 22 nt, Human
uuucaugucuguacagauuauu

SEQ ID NO: 89687 - RNA, 24 nt, Human
cucugcccggggagccucaggcag

SEQ ID NO: 89688 - RNA, 20 nt, Human
agaaagauggaggagaagaa

SEQ ID NO: 89689 - RNA, 20 nt, Human
gaaccacugacaauguaacu

SEQ ID NO: 89690 - RNA, 19 nt, Human
uagauuuucauaagccaca

SEQ ID NO: 89691 - RNA, 23 nt, Human
cccaggaggcggaccuuguagug

SEQ ID NO: 89692 - RNA, 23 nt, Human
cccaauacagagaccaccagagc

SEQ ID NO: 89693 - RNA, 27 nt, Human
ggcuuauugugggcauuucugcaguga

SEQ ID NO: 89694 - RNA, 25 nt, Human
ccuaccugugccugacccuacuucu

SEQ ID NO: 89695 - RNA, 27 nt, Human
gggaggcacuuuucacacucugucuua

SEQ ID NO: 89696 - RNA, 27 nt, Human
ucuccuggguugugcuuuuuugggggc

SEQ ID NO: 89697 - RNA, 19 nt, Human
aaaacaaagacauucuucc

SEQ ID NO: 89698 - RNA, 22 nt, Human
acucacgccagcucagcccuac

SEQ ID NO: 89699 - RNA, 21 nt, Human
cugcugccgcuacugcugcug

SEQ ID NO: 89700 - RNA, 22 nt, Human
cuacaucuaaguggccccucca

SEQ ID NO: 89701 - RNA, 19 nt, Human
gccaugguaacaugcacau

SEQ ID NO: 89702 - RNA, 23 nt, Human
uucaguguuuuuucacuuagcua

SEQ ID NO: 89703 - RNA, 25 nt, Human
gaccucaggugauccguccaccuca

SEQ ID NO: 89704 - RNA, 25 nt, Human
gucacccaggcuggagugcaauggg

SEQ ID NO: 89705 - RNA, 23 nt, Human
ggaacucggaaguugcugcucca

SEQ ID NO: 89706 - RNA, 22 nt, Human
gggacagugcugcuggaaaggc

SEQ ID NO: 89707 - RNA, 24 nt, Human
aaauucucucacaaauaaccugca

SEQ ID NO: 89708 - RNA, 19 nt, Human
aagaugugauuuuuguugc

SEQ ID NO: 89709 - RNA, 27 nt, Human
aggauuaccauuacuggguguaucacc

SEQ ID NO: 89710 - RNA, 19 nt, Human
ggaaggaagggcacuguga

SEQ ID NO: 89711 - RNA, 26 nt, Human
agcuggauuuguuuguuuucuugucu

SEQ ID NO: 89712 - RNA, 22 nt, Human
ugaccauggaucccuggggcca

SEQ ID NO: 89713 - RNA, 27 nt, Human
agguacuugggaagcugagguaggaga

SEQ ID NO: 89714 - RNA, 19 nt, Human
cacauuugucccagaucug

SEQ ID NO: 89715 - RNA, 27 nt, Human
uugcacuagaggcuucugacuccuggg

SEQ ID NO: 89716 - RNA, 20 nt, Human
cuccucagccaccugaccuc

SEQ ID NO: 89717 - RNA, 21 nt, Human
cccagcacugugggaagcuga

SEQ ID NO: 89718 - RNA, 23 nt, Human
cacuggagacuacaagugguggg

SEQ ID NO: 89719 - RNA, 26 nt, Human
aggcugagaaaugcaaaggcucauau

SEQ ID NO: 89720 - RNA, 22 nt, Human
cuuaagagcuggacugggucuu

SEQ ID NO: 89721 - RNA, 20 nt, Human
gggggccagagcuagggugg

SEQ ID NO: 89722 - RNA, 21 nt, Human
gcaggggcugccgagugcugu

SEQ ID NO: 89723 - RNA, 25 nt, Human
gacugaggcaggagaauggcgugaa

SEQ ID NO: 89724 - RNA, 24 nt, Human
cugaggcagugugggaguugaacg

SEQ ID NO: 89725 - RNA, 27 nt, Human
cugaguauguuaagcucuuuaugacug

SEQ ID NO: 89726 - RNA, 25 nt, Human
acugccgcugcccccacccugcuuc

SEQ ID NO: 89727 - RNA, 26 nt, Human
caugcacagacagaucuggcaucucc

SEQ ID NO: 89728 - RNA, 20 nt, Human
cagguaaccaacaagaaaug

SEQ ID NO: 89729 - RNA, 21 nt, Human
ccaagccccaaugccagaauu

SEQ ID NO: 89730 - RNA, 28 nt, Human
cugucucccaggcuggagugcuauggug

SEQ ID NO: 89731 - RNA, 24 nt, Human
gaccagccugggcaacaugaugug

SEQ ID NO: 89732 - RNA, 21 nt, Human
ucaauugaguuaaaucaguaa

SEQ ID NO: 89733 - RNA, 22 nt, Human
acuggcugcggcaucuguggga

SEQ ID NO: 89734 - RNA, 27 nt, Human
ugggagccguguucuaaccuguggaaa

SEQ ID NO: 89735 - RNA, 21 nt, Human
cccccuuccuaagacuucucu

SEQ ID NO: 89736 - RNA, 22 nt, Human
ucugggcagcaaaaauauauaa

SEQ ID NO: 89737 - RNA, 27 nt, Human
gcucuucacaccauucauucuggucau

SEQ ID NO: 89738 - RNA, 22 nt, Human
cucagccucccaaaguguuggg

SEQ ID NO: 89739 - RNA, 22 nt, Human
aguuucucccggcuccgaggcu

SEQ ID NO: 89740 - RNA, 31 nt, Human
agucccgggcuggcgggagugcaguucugag

SEQ ID NO: 89741 - RNA, 20 nt, Human
gcaggggccugaaacccacu

SEQ ID NO: 89742 - RNA, 22 nt, Human
uacuacuguacuuguuggcucu

SEQ ID NO: 89743 - RNA, 23 nt, Human
cagaguaaguaggcagcacuuuu

SEQ ID NO: 89744 - RNA, 25 nt, Human
uaggagccucacagcgcagaucagg

SEQ ID NO: 89745 - RNA, 27 nt, Human
cauuccucugcugaauuuuuaaauguu

SEQ ID NO: 89746 - RNA, 18 nt, Human
auuagacaaaucccacug

SEQ ID NO: 89747 - RNA, 21 nt, Human
ugugcccaggcuagggggcua

SEQ ID NO: 89748 - RNA, 27 nt, Human
ugaagaaaaauaaaguacagugugaga

SEQ ID NO: 89749 - RNA, 23 nt, Human
gacucuguggugcccucugacaa

SEQ ID NO: 89750 - RNA, 21 nt, Human
gggcacuggucuaggccaggu

SEQ ID NO: 89751 - RNA, 21 nt, Human
auuccgaaaacaucacuggcg

SEQ ID NO: 89752 - RNA, 24 nt, Human
ugucacauuguaacugaacuucag

SEQ ID NO: 89753 - RNA, 26 nt, Human
cccgcagccaugggcaccgggggccg

SEQ ID NO: 89754 - RNA, 22 nt, Human
ugaccuccuggguuccggugau

SEQ ID NO: 89755 - RNA, 22 nt, Human
aaggugcuaggauuacaggcau

SEQ ID NO: 89756 - RNA, 24 nt, Human
ggauaguuauauuuccaccugccc

SEQ ID NO: 89757 - RNA, 21 nt, Human
uugccucugugugccucagug

SEQ ID NO: 89758 - RNA, 27 nt, Human
uucuggcuuuuuaucuucuuagcucau

SEQ ID NO: 89759 - RNA, 23 nt, Human
uacuuucacagccucugcagcaa

SEQ ID NO: 89760 - RNA, 19 nt, Human
ccccucaucaaccagccca

SEQ ID NO: 89761 - RNA, 23 nt, Human
cuugagccucaggauucuuguuc

SEQ ID NO: 89762 - RNA, 23 nt, Human
ggggaagcugggguuugcagugg

SEQ ID NO: 89763 - RNA, 21 nt, Human
gagcugaaaaaggauccugac

SEQ ID NO: 89764 - RNA, 21 nt, Human
ggagguaguggugagcaaaga

SEQ ID NO: 89765 - RNA, 23 nt, Human
cucccuggguccaggaguguaga

SEQ ID NO: 89766 - RNA, 27 nt, Human
ugucauuguguuucccagccucuccac

SEQ ID NO: 89767 - RNA, 20 nt, Human
uugacauguuggcauucaua

SEQ ID NO: 89768 - RNA, 19 nt, Human
cucagaguguggcuguacc

SEQ ID NO: 89769 - RNA, 26 nt, Human
cccucgggccugggccacacgcaggc

SEQ ID NO: 89770 - RNA, 27 nt, Human
uugcccagccugcugcaauccaagaga

SEQ ID NO: 89771 - RNA, 26 nt, Human
aaggucccugcuggaguguuuccagu

SEQ ID NO: 89772 - RNA, 31 nt, Human
aaaugguaacuuuacaacuggcaguggccuc

SEQ ID NO: 89773 - RNA, 19 nt, Human
gaaauaaagagcuguuaua

SEQ ID NO: 89774 - RNA, 27 nt, Human
accgucuggugucacagagcccgcgug

SEQ ID NO: 89775 - RNA, 22 nt, Human
ccauccauucucacagguccca

SEQ ID NO: 89776 - RNA, 22 nt, Human
ggcuuggaggcuccgcgcucug

SEQ ID NO: 89777 - RNA, 22 nt, Human
cugccaccugcugcugcugcug

SEQ ID NO: 89778 - RNA, 22 nt, Human
cggaguuaugacaagcuuucca

SEQ ID NO: 89779 - RNA, 22 nt, Human
acuccugaaauucagauuuuua

SEQ ID NO: 89780 - RNA, 22 nt, Human
caacucuggguucacacacaag

SEQ ID NO: 89781 - RNA, 23 nt, Human
ucucagcuccacaacccaagcaa

SEQ ID NO: 89782 - RNA, 25 nt, Human
ggacuuggaaaagacuuggcucugu

SEQ ID NO: 89783 - RNA, 20 nt, Human
ugcccucaagccccagagag

SEQ ID NO: 89784 - RNA, 20 nt, Human
cuuauuucuuaaaaaggaca

SEQ ID NO: 89785 - RNA, 23 nt, Human
gaucaucagaaauuucaccagaa

SEQ ID NO: 89786 - RNA, 21 nt, Human
caggaauaauaaagagcauga

SEQ ID NO: 89787 - RNA, 22 nt, Human
ccaggcggcagagguugcagug

SEQ ID NO: 89788 - RNA, 23 nt, Human
ucugcacacaagaggcuacguuu

SEQ ID NO: 89789 - RNA, 22 nt, Human
ggccccugcuugugcucaggga

SEQ ID NO: 89790 - RNA, 26 nt, Human
gagucuguccuggaaccaggcuugcc

SEQ ID NO: 89791 - RNA, 22 nt, Human
aaccuucagggcucaagcugag

SEQ ID NO: 89792 - RNA, 21 nt, Human
gcgcccaggcugguaugcagu

SEQ ID NO: 89793 - RNA, 22 nt, Human
auugcuugaggucgggaguuug

SEQ ID NO: 89794 - RNA, 22 nt, Human
uucaagggauucuccugccuca

SEQ ID NO: 89795 - RNA, 21 nt, Human
ugcccacagcucuccccgcua

SEQ ID NO: 89796 - RNA, 26 nt, Human
aucaagggauuagugcaaccaguaga

SEQ ID NO: 89797 - RNA, 21 nt, Human
uccucaagaaccugaagauug

SEQ ID NO: 89798 - RNA, 23 nt, Human
cuguuaaaaguuguguuuugaaa

SEQ ID NO: 89799 - RNA, 26 nt, Human
acaccuuuucagguuggagugcauuc

SEQ ID NO: 89800 - RNA, 22 nt, Human
gucuguguagagccugagacug

SEQ ID NO: 89801 - RNA, 22 nt, Human
ggcagggggaggcacguuucau

SEQ ID NO: 89802 - RNA, 30 nt, Human
gcuuaucagugaaguaacacugcaggagcc

SEQ ID NO: 89803 - RNA, 23 nt, Human
uagucccaguauacucacuuauc

SEQ ID NO: 89804 - RNA, 27 nt, Human
cugggcccuggcugugggcagaggcca

SEQ ID NO: 89805 - RNA, 21 nt, Human
uacuucucagcuucugcgauc

SEQ ID NO: 89806 - RNA, 26 nt, Human
accagccugggcaacacagcaagacu

SEQ ID NO: 89807 - RNA, 20 nt, Human
ugacgcuucccuugccguug

SEQ ID NO: 89808 - RNA, 24 nt, Human
ccccacugaugggaccagagagag

SEQ ID NO: 89809 - RNA, 22 nt, Human
ucacugcacuccaaccugggug

SEQ ID NO: 89810 - RNA, 22 nt, Human
ccacuucauuccagccugggug

SEQ ID NO: 89811 - RNA, 21 nt, Human
gggccccccaaacucaguucg

SEQ ID NO: 89812 - RNA, 19 nt, Human
aaaugauuugcacuuuuuc

SEQ ID NO: 89813 - RNA, 27 nt, Human
cucaaguacacauccugauuugguuuc

SEQ ID NO: 89814 - RNA, 21 nt, Human
ugccuguaauccgagcacuuu

SEQ ID NO: 89815 - RNA, 20 nt, Human
aaccuuuauggcucaagauc

SEQ ID NO: 89816 - RNA, 23 nt, Human
agacacacacugcccuaaccuca

SEQ ID NO: 89817 - RNA, 26 nt, Human
uguccgucaacugaugaguggauuaa

SEQ ID NO: 89818 - RNA, 21 nt, Human
ggcagagacacucgcuuaaga

SEQ ID NO: 89819 - RNA, 22 nt, Human
cuuaccucccuucagccaagcc

SEQ ID NO: 89820 - RNA, 22 nt, Human
agauggagagaccuauaaagga

SEQ ID NO: 89821 - RNA, 27 nt, Human
gagguugcaggagcuggcuggcccugg

SEQ ID NO: 89822 - RNA, 20 nt, Human
uuaccaccccucucucugac

SEQ ID NO: 89823 - RNA, 22 nt, Human
cuaaauucuccacauuuuguaa

SEQ ID NO: 89824 - RNA, 22 nt, Human
auuauuuacacaaccuuggaag

SEQ ID NO: 89825 - RNA, 31 nt, Human
gcuaacaaggugacccacacacucaccauga

SEQ ID NO: 89826 - RNA, 22 nt, Human
ccugccccaaaccucgccagag

SEQ ID NO: 89827 - RNA, 19 nt, Human
guaaaacaacagcgccccc

SEQ ID NO: 89828 - RNA, 19 nt, Human
ucuaauguuuauucuuccc

SEQ ID NO: 89829 - RNA, 21 nt, Human
acaaaauguugaccucagguc

SEQ ID NO: 89830 - RNA, 24 nt, Human
ugaccccagcucuccacucugcug

SEQ ID NO: 89831 - RNA, 24 nt, Human
ccugggucuuuaugcaugaagaua

SEQ ID NO: 89832 - RNA, 22 nt, Human
agacccaugcaagagccugguu

SEQ ID NO: 89833 - RNA, 23 nt, Human
aggcuggagugcgguggugcgau

SEQ ID NO: 89834 - RNA, 23 nt, Human
cucucauuuugaccuacucucau

SEQ ID NO: 89835 - RNA, 26 nt, Human
gcagccgccuucugagcccccgaccc

SEQ ID NO: 89836 - RNA, 20 nt, Human
cccaccccacauucuccccg

SEQ ID NO: 89837 - RNA, 21 nt, Human
ccacucgccucucacagcccu

SEQ ID NO: 89838 - RNA, 26 nt, Human
caccacgccagcaucuccuucuacgu

SEQ ID NO: 89839 - RNA, 19 nt, Human
ucggguaccgggcgucccg

SEQ ID NO: 89840 - RNA, 26 nt, Human
ggucauuuuguugcauuuccccauuu

SEQ ID NO: 89841 - RNA, 21 nt, Human
gcacuaugcaugucucacuca

SEQ ID NO: 89842 - RNA, 21 nt, Human
uagaaaggggcagggagggga

SEQ ID NO: 89843 - RNA, 20 nt, Human
gggcaggagucccagcacca

SEQ ID NO: 89844 - RNA, 22 nt, Human
acugcaaucucugccuccuggg

SEQ ID NO: 89845 - RNA, 22 nt, Human
acugcaaccucugcccccuggg

SEQ ID NO: 89846 - RNA, 25 nt, Human
ggggcugcgaccuccagacucucca

SEQ ID NO: 89847 - RNA, 25 nt, Human
ccaugugcaagucugugucuuguca

SEQ ID NO: 89848 - RNA, 29 nt, Human
caggaagaacgcuccagcccaggacuucg

SEQ ID NO: 89849 - RNA, 21 nt, Human
auucacugcaaugccuauucc

SEQ ID NO: 89850 - RNA, 23 nt, Human
uguggagaggguguuauuuagag

SEQ ID NO: 89851 - RNA, 22 nt, Human
agguguccacagccaggcaggu

SEQ ID NO: 89852 - RNA, 24 nt, Human
uguccugggcauggguccagggcc

SEQ ID NO: 89853 - RNA, 28 nt, Human
agacuuuggagaccagagacgcgccugg

SEQ ID NO: 89854 - RNA, 21 nt, Human
gggccucaccagcacugucuu

SEQ ID NO: 89855 - RNA, 21 nt, Human
auacaguguacucuuauucuu

SEQ ID NO: 89856 - RNA, 22 nt, Human
ggagguggaagaggagggggag

SEQ ID NO: 89857 - RNA, 22 nt, Human
uuccaccugcuuucuccugggc

SEQ ID NO: 89858 - RNA, 27 nt, Human
guagggagaggcucuggacagaugaau

SEQ ID NO: 89859 - RNA, 22 nt, Human
cacggaggaacaagaucaagau

SEQ ID NO: 89860 - RNA, 18 nt, Human
uucuauguguuuaccuca

SEQ ID NO: 89861 - RNA, 23 nt, Human
acauugaaccaagggauccuccc

SEQ ID NO: 89862 - RNA, 26 nt, Human
cucucaucaucuaguguuccucaugu

SEQ ID NO: 89863 - RNA, 29 nt, Human
gucuuuagggcuggaaggcagcaucccuc

SEQ ID NO: 89864 - RNA, 22 nt, Human
gguuuccagccuggugccuggg

SEQ ID NO: 89865 - RNA, 26 nt, Human
gauucauauauguacauaaaucugug

SEQ ID NO: 89866 - RNA, 26 nt, Human
gaggcugaggccaaaggggcugggga

SEQ ID NO: 89867 - RNA, 23 nt, Human
acacaggaaaacugaauuuagua

SEQ ID NO: 89868 - RNA, 23 nt, Human
guucccaggcuggggaugcuuug

SEQ ID NO: 89869 - RNA, 18 nt, Human
caagcccaggagugcaga

SEQ ID NO: 89870 - RNA, 22 nt, Human
ccccacuggggggauguuacaa

SEQ ID NO: 89871 - RNA, 22 nt, Human
gaucuccaggguucuaggaaag

SEQ ID NO: 89872 - RNA, 21 nt, Human
ggaaaugacuagagaggcaga

SEQ ID NO: 89873 - RNA, 27 nt, Human
guugaguggguuagcuccgagaacaau

SEQ ID NO: 89874 - RNA, 24 nt, Human
caggguuucgagaagcugcucugg

SEQ ID NO: 89875 - RNA, 20 nt, Human
auuuuucugugaaagcucuc

SEQ ID NO: 89876 - RNA, 19 nt, Human
uuuccucccuuucaucaca

SEQ ID NO: 89877 - RNA, 21 nt, Human
aaaugauuugcuaugauuuuu

SEQ ID NO: 89878 - RNA, 19 nt, Human
ggggagugaagaaacccgu

SEQ ID NO: 89879 - RNA, 21 nt, Human
cuccuuucaaaacaaaaaaga

SEQ ID NO: 89880 - RNA, 27 nt, Human
ggcuuuccuggaggugaagaagcaauu

SEQ ID NO: 89881 - RNA, 20 nt, Human
ccugcucucuuuccugggcc

SEQ ID NO: 89882 - RNA, 25 nt, Human
gcucacggggacccgcucaggcugg

SEQ ID NO: 89883 - RNA, 21 nt, Human
guuguagcuuuggagugcaga

SEQ ID NO: 89884 - RNA, 21 nt, Human
guggguggggagggagguguu

SEQ ID NO: 89885 - RNA, 25 nt, Human
gggggcuaggggaggggggagccag

SEQ ID NO: 89886 - RNA, 20 nt, Human
cuggacccagcuuugcuagg

SEQ ID NO: 89887 - RNA, 27 nt, Human
cuccagccuuccccuggccccgugaca

SEQ ID NO: 89888 - RNA, 23 nt, Human
ccgaccauggcagugaccaggcc

SEQ ID NO: 89889 - RNA, 24 nt, Human
uguuuuauauuguuuugacugccu

SEQ ID NO: 89890 - RNA, 27 nt, Human
uccagauaggcuggcaagagcuguuuu

SEQ ID NO: 89891 - RNA, 21 nt, Human
gaaacaaaggccagcccaggg

SEQ ID NO: 89892 - RNA, 31 nt, Human
ugcagcuuccaggcuggcgugcagcaucagc

SEQ ID NO: 89893 - RNA, 23 nt, Human
gcaggcuggaucaccugaggaca

SEQ ID NO: 89894 - RNA, 22 nt, Human
caggcuggagugcaauggugca

SEQ ID NO: 89895 - RNA, 26 nt, Human
cuuccaggaaccagguguccaaggcc

SEQ ID NO: 89896 - RNA, 17 nt, Human
gcuuuaaaaaugucuua

SEQ ID NO: 89897 - RNA, 17 nt, Human
uggaagcuuuuccaagu

SEQ ID NO: 89898 - RNA, 21 nt, Human
cuucccuuaccucaaaggcuc

SEQ ID NO: 89899 - RNA, 25 nt, Human
cccaggucugggagccccaggcugg

SEQ ID NO: 89900 - RNA, 22 nt, Human
gcaaacaaaugguacagucaua

SEQ ID NO: 89901 - RNA, 24 nt, Human
gucuccaaaagugcugggauuaca

SEQ ID NO: 89902 - RNA, 28 nt, Human
acauuagguuaacacagcuuuauaaacc

SEQ ID NO: 89903 - RNA, 20 nt, Human
uaugcaaaguacauuuugga

SEQ ID NO: 89904 - RNA, 22 nt, Human
ugagguccuagagcuccaggac

SEQ ID NO: 89905 - RNA, 26 nt, Human
cgccuucaucucccaaagugcuggga

SEQ ID NO: 89906 - RNA, 23 nt, Human
ccuuuugguuuuccuacuuacuc

SEQ ID NO: 89907 - RNA, 28 nt, Human
cacaucacacaccauccccacugucauu

SEQ ID NO: 89908 - RNA, 23 nt, Human
cuguuucucucugcccucuagag

SEQ ID NO: 89909 - RNA, 29 nt, Human
ggcaggauugggcuuuucuggcuucuacc

SEQ ID NO: 89910 - RNA, 21 nt, Human
agaaccucaccucuaguugag

SEQ ID NO: 89911 - RNA, 27 nt, Human
ucugagagugugauuucaugcaguggu

SEQ ID NO: 89912 - RNA, 21 nt, Human
ugaaacgaaugguacaaggaa

SEQ ID NO: 89913 - RNA, 26 nt, Human
ucugcucccuucugggacccaggcuu

SEQ ID NO: 89914 - RNA, 21 nt, Human
auugccacgugccugcuggua

SEQ ID NO: 89915 - RNA, 24 nt, Human
agcaucagauggaagcuuacucuc

SEQ ID NO: 89916 - RNA, 24 nt, Human
uugcuccucuauucuaccucucuu

SEQ ID NO: 89917 - RNA, 29 nt, Human
gccagcaccggaccagccuggcccacccc

SEQ ID NO: 89918 - RNA, 22 nt, Human
aggcugaggcaggagaaucucu

SEQ ID NO: 89919 - RNA, 22 nt, Human
aggcugaggcaugagaaucgcu

SEQ ID NO: 89920 - RNA, 20 nt, Human
gcuauugcucugagaaagua

SEQ ID NO: 89921 - RNA, 27 nt, Human
gcccagccuggcuggccugcagguguc

SEQ ID NO: 89922 - RNA, 19 nt, Human
cugcuuugggauaguguga

SEQ ID NO: 89923 - RNA, 26 nt, Human
gcaacuugggaaaugcuuauguuaca

SEQ ID NO: 89924 - RNA, 21 nt, Human
gggcagcuccuggaauggaag

SEQ ID NO: 89925 - RNA, 21 nt, Human
cacuccacuccaggugggcca

SEQ ID NO: 89926 - RNA, 23 nt, Human
cuuaucucccuuguccuguaucc

SEQ ID NO: 89927 - RNA, 20 nt, Human
uggauggcagagaaauauac

SEQ ID NO: 89928 - RNA, 18 nt, Human
cuggggcauggagcugaa

SEQ ID NO: 89929 - RNA, 29 nt, Human
cuccggucgggggcgggaacaggaucggc

SEQ ID NO: 89930 - RNA, 21 nt, Human
uuucugcagagcuucauuugg

SEQ ID NO: 89931 - RNA, 23 nt, Human
ggaauuucugccuuucugucuca

SEQ ID NO: 89932 - RNA, 23 nt, Human
agcucacugcaaccucugccucc

SEQ ID NO: 89933 - RNA, 22 nt, Human
gcggaagaccuaagauuaucgg

SEQ ID NO: 89934 - RNA, 21 nt, Human
uauauuuaagugucuguuaua

SEQ ID NO: 89935 - RNA, 23 nt, Human
gaggcugcccagaggggccaggu

SEQ ID NO: 89936 - RNA, 26 nt, Human
ucauucuccucaaauauuccauuugc

SEQ ID NO: 89937 - RNA, 21 nt, Human
guuccuuaaaaagaagaugga

SEQ ID NO: 89938 - RNA, 23 nt, Human
aggcagaugaccagagagccuga

SEQ ID NO: 89939 - RNA, 21 nt, Human
aauucaaauacucccaaugag

SEQ ID NO: 89940 - RNA, 21 nt, Human
agaaaacauaaucuucugccu

SEQ ID NO: 89941 - RNA, 22 nt, Human
augagugagcuggcacugugcc

SEQ ID NO: 89942 - RNA, 23 nt, Human
agcccagauucaucugugccuug

SEQ ID NO: 89943 - RNA, 26 nt, Human
acugcuuuaaaaaacaauuaucccuu

SEQ ID NO: 89944 - RNA, 21 nt, Human
cgggcacggaucacgauguaa

SEQ ID NO: 89945 - RNA, 19 nt, Human
ucaucugcaguucuuuuug

SEQ ID NO: 89946 - RNA, 27 nt, Human
gggcuucaugguuucugcucagucugu

SEQ ID NO: 89947 - RNA, 26 nt, Human
cacugugccagcaugcuuccuccaca

SEQ ID NO: 89948 - RNA, 22 nt, Human
acuuggcagcuaguaaguuuaa

SEQ ID NO: 89949 - RNA, 20 nt, Human
cuuaagggaucuccaugcgg

SEQ ID NO: 89950 - RNA, 19 nt, Human
caaugcaaccaacuaucca

SEQ ID NO: 89951 - RNA, 23 nt, Human
uuggauuuguagguccugugcca

SEQ ID NO: 89952 - RNA, 21 nt, Human
ucgcucaggcuggagugcagu

SEQ ID NO: 89953 - RNA, 21 nt, Human
guuuuuaauugaucaguuuuc

SEQ ID NO: 89954 - RNA, 26 nt, Human
gcuaaauugaauacacaaauuucccc

SEQ ID NO: 89955 - RNA, 24 nt, Human
acucaggaguccuacccugggaga

SEQ ID NO: 89956 - RNA, 21 nt, Human
caggccuggggacaggaaagc

SEQ ID NO: 89957 - RNA, 21 nt, Human
cugggauuggaacuacccuuc

SEQ ID NO: 89958 - RNA, 25 nt, Human
aacaccguccaacauuccuuguuug

SEQ ID NO: 89959 - RNA, 22 nt, Human
agaccccacuaacccagccugc

SEQ ID NO: 89960 - RNA, 22 nt, Human
uccuguaauuuuguaguaguug

SEQ ID NO: 89961 - RNA, 22 nt, Human
uggucgccacugggacacugug

SEQ ID NO: 89962 - RNA, 24 nt, Human
gcuccucgcucgcaccugccuccg

SEQ ID NO: 89963 - RNA, 19 nt, Human
gggugagacucuuuaaagu

SEQ ID NO: 89964 - RNA, 25 nt, Human
ccaucuccuccucuggcccuuccuu

SEQ ID NO: 89965 - RNA, 21 nt, Human
uauugcugggauugggagaaa

SEQ ID NO: 89966 - RNA, 22 nt, Human
aaaucucaaacuucuauuuuua

SEQ ID NO: 89967 - RNA, 21 nt, Human
gccggcgacaggacagguucg

SEQ ID NO: 89968 - RNA, 20 nt, Human
accaggaugucucugaaaug

SEQ ID NO: 89969 - RNA, 28 nt, Human
gggagcggaagagagggcuucaagaugg

SEQ ID NO: 89970 - RNA, 23 nt, Human
ggagacaaaagcaguuucucucc

SEQ ID NO: 89971 - RNA, 24 nt, Human
ucgacucaggcagacagcaggcug

SEQ ID NO: 89972 - RNA, 21 nt, Human
cacagccugcuccauucucca

SEQ ID NO: 89973 - RNA, 26 nt, Human
ucuagagugacgagauaauugggaga

SEQ ID NO: 89974 - RNA, 21 nt, Human
auaggaugucagacaauacca

SEQ ID NO: 89975 - RNA, 21 nt, Human
cuuuucuuuuggacuuuuggg

SEQ ID NO: 89976 - RNA, 27 nt, Human
ucuucucucccccaccuuuaucgaggg

SEQ ID NO: 89977 - RNA, 20 nt, Human
ccuccccucuuccuggagcc

SEQ ID NO: 89978 - RNA, 21 nt, Human
ggcugaagagagcgggcccag

SEQ ID NO: 89979 - RNA, 20 nt, Human
cugccgccgcugccugccgc

SEQ ID NO: 89980 - RNA, 22 nt, Human
ucucuacaacccucucuccuca

SEQ ID NO: 89981 - RNA, 25 nt, Human
gccaucucaaccucuuccccgcccg

SEQ ID NO: 89982 - RNA, 19 nt, Human
cuaaacaaguaagaaaaau

SEQ ID NO: 89983 - RNA, 22 nt, Human
guuggugcuugaacucuugccu

SEQ ID NO: 89984 - RNA, 23 nt, Human
ucucagcccugccuuucucugga

SEQ ID NO: 89985 - RNA, 23 nt, Human
ccuucauuuuugaaaguaguuuu

SEQ ID NO: 89986 - RNA, 25 nt, Human
acugagaaaggggaaagggaagggu

SEQ ID NO: 89987 - RNA, 22 nt, Human
uaaaacaugaaaaucgcuuuga

SEQ ID NO: 89988 - RNA, 22 nt, Human
cuuccuggaccugggcauucag

SEQ ID NO: 89989 - RNA, 22 nt, Human
cuucccaaggcugcagacaccg

SEQ ID NO: 89990 - RNA, 26 nt, Human
caggaggcggagguugcaguaagcca

SEQ ID NO: 89991 - RNA, 27 nt, Human
caggcuguagugcaguggcacgaucuu

SEQ ID NO: 89992 - RNA, 19 nt, Human
gacuccaucucaaaaaaga

SEQ ID NO: 89993 - RNA, 18 nt, Human
ccccaaaugugcuuucug

SEQ ID NO: 89994 - RNA, 21 nt, Human
augccuuugcaggcagccugc

SEQ ID NO: 89995 - RNA, 25 nt, Human
cagaacaccaggaaggucaagacgc

SEQ ID NO: 89996 - RNA, 21 nt, Human
ucugcagcugugccucggcuc

SEQ ID NO: 89997 - RNA, 26 nt, Human
gcaggcagccuucugaucaguacugu

SEQ ID NO: 89998 - RNA, 23 nt, Human
acuccaggacugccagaggcuca

SEQ ID NO: 89999 - RNA, 22 nt, Human
ugcucagaauuuggagggaggg

SEQ ID NO: 90000 - RNA, 27 nt, Human
ugccaugacccaggagccauucagaga

SEQ ID NO: 90001 - RNA, 24 nt, Human
ucuccaccacugucccuucucccc

SEQ ID NO: 90002 - RNA, 27 nt, Human
gaagguugaggcugaagagugaggacu

SEQ ID NO: 90003 - RNA, 22 nt, Human
cugucccaggcuguggugccac

SEQ ID NO: 90004 - RNA, 24 nt, Human
gaaagggagagagggccaggcagu

SEQ ID NO: 90005 - RNA, 24 nt, Human
auuucauaguuuccacuuucuugu

SEQ ID NO: 90006 - RNA, 23 nt, Human
gaucaaauaauaucuccucauga

SEQ ID NO: 90007 - RNA, 22 nt, Human
gccucagccuccagaauagcug

SEQ ID NO: 90008 - RNA, 20 nt, Human
aacagguugggaugggauag

SEQ ID NO: 90009 - RNA, 21 nt, Human
auuacaucuguuuuacuauga

SEQ ID NO: 90010 - RNA, 22 nt, Human
auacuucccuuccuaauuauca

SEQ ID NO: 90011 - RNA, 24 nt, Human
cagcuaggacacagcaggucguga

SEQ ID NO: 90012 - RNA, 31 nt, Human
uggagaagaaagagaaaugugcagcuggugc

SEQ ID NO: 90013 - RNA, 21 nt, Human
gccagcuguguugguagugcu

SEQ ID NO: 90014 - RNA, 20 nt, Human
uuuaaacaaaguauauguaa

SEQ ID NO: 90015 - RNA, 22 nt, Human
gucucuauccaugcugucaacu

SEQ ID NO: 90016 - RNA, 22 nt, Human
uuccauguuacccucccuuccu

SEQ ID NO: 90017 - RNA, 26 nt, Human
ccccucaaccccucugcucagugccu

SEQ ID NO: 90018 - RNA, 22 nt, Human
ggcauuugagccacuuccucau

SEQ ID NO: 90019 - RNA, 22 nt, Human
cucgccaggcuggaguguagug

SEQ ID NO: 90020 - RNA, 20 nt, Human
aggcugggccagccugcugc

SEQ ID NO: 90021 - RNA, 21 nt, Human
uugaguuguacaacagaacac

SEQ ID NO: 90022 - RNA, 21 nt, Human
cuuaucugaaaguagugcuua

SEQ ID NO: 90023 - RNA, 26 nt, Human
gcaaagcauuuuaccguacaaauauc

SEQ ID NO: 90024 - RNA, 23 nt, Human
acacauuuaagaaguaggugugu

SEQ ID NO: 90025 - RNA, 26 nt, Human
ucacccagccugguacugaaggugcc

SEQ ID NO: 90026 - RNA, 24 nt, Human
gcacuuggauacacacagacccac

SEQ ID NO: 90027 - RNA, 24 nt, Human
cuuucuaugucccagcugaagcaa

SEQ ID NO: 90028 - RNA, 23 nt, Human
ucuauagcaaccacauuugacua

SEQ ID NO: 90029 - RNA, 20 nt, Human
gugucuugagaccagccugc

SEQ ID NO: 90030 - RNA, 27 nt, Human
cuacauacaucaauuaaacuuaugucc

SEQ ID NO: 90031 - RNA, 23 nt, Human
cacccugcccuggccuaccacag

SEQ ID NO: 90032 - RNA, 24 nt, Human
acaguuccuuucaaaggagaauga

SEQ ID NO: 90033 - RNA, 22 nt, Human
ggagaggcccagcgggagucgc

SEQ ID NO: 90034 - RNA, 20 nt, Human
ccauaccacacacauuauca

SEQ ID NO: 90035 - RNA, 25 nt, Human
gaagcaucugcuguuuaauuccugg

SEQ ID NO: 90036 - RNA, 27 nt, Human
guagguugaggacaggagagggaaggg

SEQ ID NO: 90037 - RNA, 30 nt, Human
uucuuaaggcuaugcuucaguuuuucuuug

SEQ ID NO: 90038 - RNA, 19 nt, Human
ggcugcccugagucuggga

SEQ ID NO: 90039 - RNA, 21 nt, Human
ucucgacucagacaagauggu

SEQ ID NO: 90040 - RNA, 26 nt, Human
acaucaccagccucgguugacgugga

SEQ ID NO: 90041 - RNA, 27 nt, Human
gucagccagacuggacaggcaaagacu

SEQ ID NO: 90042 - RNA, 23 nt, Human
ucagcauuuuguaccaucugcuc

SEQ ID NO: 90043 - RNA, 22 nt, Human
guacuauauguauaucuuugca

SEQ ID NO: 90044 - RNA, 20 nt, Human
ccuuucucauucuccaagcc

SEQ ID NO: 90045 - RNA, 26 nt, Human
augcaugagagggaagauggaggcca

SEQ ID NO: 90046 - RNA, 22 nt, Human
cggcccccugcccguucuugaa

SEQ ID NO: 90047 - RNA, 21 nt, Human
cccuccagaacuucaggcucu

SEQ ID NO: 90048 - RNA, 22 nt, Human
uccggacggcuuacuuaccuca

SEQ ID NO: 90049 - RNA, 27 nt, Human
ccuguuacagugaggagaucacagugu

SEQ ID NO: 90050 - RNA, 22 nt, Human
uucaucugaggacuuucaucug

SEQ ID NO: 90051 - RNA, 20 nt, Human
acaguaagccccaggaaagg

SEQ ID NO: 90052 - RNA, 27 nt, Human
cccugcacugccucgcagaguggccug

SEQ ID NO: 90053 - RNA, 23 nt, Human
accauucagucaccagacugggu

SEQ ID NO: 90054 - RNA, 22 nt, Human
aggcugagucaggagaaucgcu

SEQ ID NO: 90055 - RNA, 24 nt, Human
agagcccucggacacucccagccc

SEQ ID NO: 90056 - RNA, 23 nt, Human
ugucuggagcagcaggaucccgg

SEQ ID NO: 90057 - RNA, 23 nt, Human
cccagcaccuagaguagugcuug

SEQ ID NO: 90058 - RNA, 23 nt, Human
aucaagggauucuccugccucag

SEQ ID NO: 90059 - RNA, 19 nt, Human
aagccuguaucucugugau

SEQ ID NO: 90060 - RNA, 22 nt, Human
ucugcuuccccagccuaagcag

SEQ ID NO: 90061 - RNA, 29 nt, Human
cugucuccuggcccucucucugaucaugc

SEQ ID NO: 90062 - RNA, 21 nt, Human
caggaggaggaaugagaguga

SEQ ID NO: 90063 - RNA, 22 nt, Human
cacuugaacccaggaggcagag

SEQ ID NO: 90064 - RNA, 21 nt, Human
gcagcugagcuuccacaagac

SEQ ID NO: 90065 - RNA, 22 nt, Human
agcuuucuguuuuuacuggaaa

SEQ ID NO: 90066 - RNA, 22 nt, Human
ccucuucuuuaccagaacgguu

SEQ ID NO: 90067 - RNA, 21 nt, Human
gauuaaaaugagauauggcua

SEQ ID NO: 90068 - RNA, 26 nt, Human
accaugucccaggacaguguuacuuc

SEQ ID NO: 90069 - RNA, 23 nt, Human
uacaugauuucaaaauaaaguug

SEQ ID NO: 90070 - RNA, 21 nt, Human
acugagaaaauacaucacaga

SEQ ID NO: 90071 - RNA, 21 nt, Human
cacaugcacacauaucuagca

SEQ ID NO: 90072 - RNA, 31 nt, Human
gccaccaccauucuccuuccccaccccacca

SEQ ID NO: 90073 - RNA, 22 nt, Human
agauacugaucugagcuguaag

SEQ ID NO: 90074 - RNA, 21 nt, Human
acauuuauauuccuuuucugg

SEQ ID NO: 90075 - RNA, 20 nt, Human
cuguuuucugggccagugag

SEQ ID NO: 90076 - RNA, 22 nt, Human
uuaaagcaggagaauccaaagu

SEQ ID NO: 90077 - RNA, 26 nt, Human
gucuuccugcugcugccagggagagc

SEQ ID NO: 90078 - RNA, 21 nt, Human
aagcacugggauuacaggcgu

SEQ ID NO: 90079 - RNA, 21 nt, Human
cacaucuucuguacucgucca

SEQ ID NO: 90080 - RNA, 26 nt, Human
ggccuggagcacaaagacccuggcuu

SEQ ID NO: 90081 - RNA, 23 nt, Human
uuagguuucauuaacaguacugg

SEQ ID NO: 90082 - RNA, 24 nt, Human
uauccuacugagcauuugcaccuc

SEQ ID NO: 90083 - RNA, 21 nt, Human
augcccggcaggcugggguug

SEQ ID NO: 90084 - RNA, 27 nt, Human
ccucagccucugauccucacacaugcu

SEQ ID NO: 90085 - RNA, 23 nt, Human
ccgccuugagagcgaguacuuuu

SEQ ID NO: 90086 - RNA, 18 nt, Human
cuucccuuuccugagucc

SEQ ID NO: 90087 - RNA, 19 nt, Human
ucuaucuccccgucacacc

SEQ ID NO: 90088 - RNA, 19 nt, Human
uggcguucucccuccaggg

SEQ ID NO: 90089 - RNA, 23 nt, Human
ccaggaggacccagggcucugua

SEQ ID NO: 90090 - RNA, 22 nt, Human
agcuuucaucauuauacuccaa

SEQ ID NO: 90091 - RNA, 21 nt, Human
aggccguuagaaaggagggag

SEQ ID NO: 90092 - RNA, 24 nt, Human
gcaaagagcaacaacugaauguga

SEQ ID NO: 90093 - RNA, 22 nt, Human
ggaccuuuggguggcaauucca

SEQ ID NO: 90094 - RNA, 25 nt, Human
caccucucggacuccagcuugaugg

SEQ ID NO: 90095 - RNA, 22 nt, Human
ucuccccucuguggcuuggacu

SEQ ID NO: 90096 - RNA, 19 nt, Human
cuccaguuuugacuacgag

SEQ ID NO: 90097 - RNA, 30 nt, Human
ggugcccgagccucucagggccagaccaga

SEQ ID NO: 90098 - RNA, 22 nt, Human
gggagagagagggaggaguaaa

SEQ ID NO: 90099 - RNA, 23 nt, Human
cccauggggacacgggugccuau

SEQ ID NO: 90100 - RNA, 27 nt, Human
ucacccaggcuggagugcaguagcgcg

SEQ ID NO: 90101 - RNA, 23 nt, Human
auguagcacuauuaguguccccc

SEQ ID NO: 90102 - RNA, 21 nt, Human
uguggcuccccucuauuuagc

SEQ ID NO: 90103 - RNA, 21 nt, Human
ucuaacuguggagugaaugga

SEQ ID NO: 90104 - RNA, 19 nt, Human
cggagccaccaugccugcu

SEQ ID NO: 90105 - RNA, 22 nt, Human
ucagaagcucaauaugcaaaag

SEQ ID NO: 90106 - RNA, 21 nt, Human
accgccacccuugcccccuca

SEQ ID NO: 90107 - RNA, 26 nt, Human
cuucccucagccauuccugagacuug

SEQ ID NO: 90108 - RNA, 21 nt, Human
caaaugauucuccugccucag

SEQ ID NO: 90109 - RNA, 21 nt, Human
caagugauucuccugccucgg

SEQ ID NO: 90110 - RNA, 23 nt, Human
uauagcacgugacccuggaacgc

SEQ ID NO: 90111 - RNA, 28 nt, Human
uuuuguuugucauacauggaaccauuuu

SEQ ID NO: 90112 - RNA, 23 nt, Human
uguucaaauaagauuauuuacaa

SEQ ID NO: 90113 - RNA, 28 nt, Human
uguggucgcugccaagcaucaguguuag

SEQ ID NO: 90114 - RNA, 22 nt, Human
auaauuccuuggacugccuggu

SEQ ID NO: 90115 - RNA, 27 nt, Human
caagucaaguuccaccuuagcuccagg

SEQ ID NO: 90116 - RNA, 22 nt, Human
uggcuucuccacagguuuucca

SEQ ID NO: 90117 - RNA, 23 nt, Human
aggcuggagugccauggcgcgau

SEQ ID NO: 90118 - RNA, 26 nt, Human
cuuaaugucacaauuauuccuauuga

SEQ ID NO: 90119 - RNA, 22 nt, Human
gcugacccaggcuggaggacag

SEQ ID NO: 90120 - RNA, 25 nt, Human
ggcucccuccccugccuaggggcaa

SEQ ID NO: 90121 - RNA, 21 nt, Human
uugaaaaacaguggggugggg

SEQ ID NO: 90122 - RNA, 20 nt, Human
gagcacaacaggaaagccug

SEQ ID NO: 90123 - RNA, 21 nt, Human
cacccaggcuggaguacacug

SEQ ID NO: 90124 - RNA, 27 nt, Human
guucccuuugucuuucaaacuccaagg

SEQ ID NO: 90125 - RNA, 30 nt, Human
uccgcuggcccauagugaucuuugcaguga

SEQ ID NO: 90126 - RNA, 21 nt, Human
gggagcuggagcagccgcugg

SEQ ID NO: 90127 - RNA, 27 nt, Human
gccagccugacauggaaauggaggcaa

SEQ ID NO: 90128 - RNA, 27 nt, Human
ggcucacugcaaccuccacccccgggg

SEQ ID NO: 90129 - RNA, 24 nt, Human
ccucugugucacuggcugccucca

SEQ ID NO: 90130 - RNA, 24 nt, Human
uggcuggcgggacaggugggcagg

SEQ ID NO: 90131 - RNA, 20 nt, Human
cuccucucugagccucaguu

SEQ ID NO: 90132 - RNA, 23 nt, Human
ccugcccagcccugcccggaggc

SEQ ID NO: 90133 - RNA, 21 nt, Human
gcuauaaucucagcacuuugg

SEQ ID NO: 90134 - RNA, 22 nt, Human
gacuacagacaugugcaaccau

SEQ ID NO: 90135 - RNA, 27 nt, Human
ccaggcccugaaccccaacgccggcau

SEQ ID NO: 90136 - RNA, 25 nt, Human
augaucuuggcucacugcaacuucc

SEQ ID NO: 90137 - RNA, 23 nt, Human
uggagagaaaaugacugucuccu

SEQ ID NO: 90138 - RNA, 27 nt, Human
gccucgaacuccuggcacuaccaaagg

SEQ ID NO: 90139 - RNA, 19 nt, Human
gguugcagcucccaccuca

SEQ ID NO: 90140 - RNA, 27 nt, Human
cuugcugugugaauugacaagcacuuu

SEQ ID NO: 90141 - RNA, 19 nt, Human
ccuuucacuggcaugggag

SEQ ID NO: 90142 - RNA, 17 nt, Human
cuuggcuucuuuacuua

SEQ ID NO: 90143 - RNA, 24 nt, Human
uuaauaaaaauguuauuuguacaa

SEQ ID NO: 90144 - RNA, 21 nt, Human
gagcuaagcucaggagcccga

SEQ ID NO: 90145 - RNA, 24 nt, Human
ucuccccaguauggaagucccggu

SEQ ID NO: 90146 - RNA, 32 nt, Human
gagagaagaaaaagacaggaagggugaauuug

SEQ ID NO: 90147 - RNA, 23 nt, Human
ugcuaggagauacucuucugccu

SEQ ID NO: 90148 - RNA, 23 nt, Human
uacaguuucuggcuggcuucauu

SEQ ID NO: 90149 - RNA, 22 nt, Human
gguucacugcaaccuccgcauc

SEQ ID NO: 90150 - RNA, 28 nt, Human
cagagcagcacaauaaaugaggccacug

SEQ ID NO: 90151 - RNA, 18 nt, Human
augcgguuaacuacacac

SEQ ID NO: 90152 - RNA, 22 nt, Human
cugacaacugcacuuccagaca

SEQ ID NO: 90153 - RNA, 22 nt, Human
uaagugaagugguucucagucc

SEQ ID NO: 90154 - RNA, 23 nt, Human
uggagccauuccugaaucucccc

SEQ ID NO: 90155 - RNA, 22 nt, Human
acuaauuuaaagagacaguauc

SEQ ID NO: 90156 - RNA, 19 nt, Human
aauuuucccaaugaucuug

SEQ ID NO: 90157 - RNA, 26 nt, Human
ucaggaggcugagacaggagaaucgc

SEQ ID NO: 90158 - RNA, 18 nt, Human
ucccucgggacccuccca

SEQ ID NO: 90159 - RNA, 22 nt, Human
ugcuucuuaaccguaccaguuu

SEQ ID NO: 90160 - RNA, 21 nt, Human
cugggcucaguuuccucaccu

SEQ ID NO: 90161 - RNA, 23 nt, Human
caacaagaacaaaacuccaucuc

SEQ ID NO: 90162 - RNA, 21 nt, Human
gccacugcacuccagccuggg

SEQ ID NO: 90163 - RNA, 26 nt, Human
gggaggggauggcagaaacucaggga

SEQ ID NO: 90164 - RNA, 27 nt, Human
ccggguucaagcaauuuccugccucag

SEQ ID NO: 90165 - RNA, 23 nt, Human
ggccucgggagaggugccgccca

SEQ ID NO: 90166 - RNA, 23 nt, Human
acugcugcuucucuuagcuccuc

SEQ ID NO: 90167 - RNA, 20 nt, Human
gccgcaggggccccuccucc

SEQ ID NO: 90168 - RNA, 20 nt, Human
aagcucccggaaggcaggga

SEQ ID NO: 90169 - RNA, 23 nt, Human
ggguuaaaaauaagccacugccu

SEQ ID NO: 90170 - RNA, 21 nt, Human
uggacuuuuugguuacuuuaa

SEQ ID NO: 90171 - RNA, 27 nt, Human
uaacucuagcuguauuucuucuuguca

SEQ ID NO: 90172 - RNA, 30 nt, Human
agguaacccaggggucagcccaggcugcug

SEQ ID NO: 90173 - RNA, 20 nt, Human
ucauggcucuguugauugca

SEQ ID NO: 90174 - RNA, 27 nt, Human
gcuuuggggggcacuagaagaugaggg

SEQ ID NO: 90175 - RNA, 23 nt, Human
cauacuugagagaaacugugaau

SEQ ID NO: 90176 - RNA, 22 nt, Human
gcccaggcuggagugcaguagu

SEQ ID NO: 90177 - RNA, 27 nt, Human
uagaaucaagauagaaccuuuagaugu

SEQ ID NO: 90178 - RNA, 23 nt, Human
ccuuaucuccuugugcucaggcc

SEQ ID NO: 90179 - RNA, 23 nt, Human
uagaaaguuuuauguucugcuca

SEQ ID NO: 90180 - RNA, 24 nt, Human
auuucuccagcgguuccugcagau

SEQ ID NO: 90181 - RNA, 21 nt, Human
accggcaccuggcgaggcuca

SEQ ID NO: 90182 - RNA, 27 nt, Human
gucacccaggcuggagugcuauggcuc

SEQ ID NO: 90183 - RNA, 22 nt, Human
gacaggguuuuuccauguugcc

SEQ ID NO: 90184 - RNA, 26 nt, Human
aggauacaaugcauuuccucagugau

SEQ ID NO: 90185 - RNA, 29 nt, Human
ccugcagaaguaagccucaucaucagagc

SEQ ID NO: 90186 - RNA, 26 nt, Human
uagaaaacaguaggcccucacaggag

SEQ ID NO: 90187 - RNA, 30 nt, Human
ccaugggauggagaaccacucuguccagau

SEQ ID NO: 90188 - RNA, 21 nt, Human
auccugcgaccuugcaaccuc

SEQ ID NO: 90189 - RNA, 20 nt, Human
agaggagacugacagaggaa

SEQ ID NO: 90190 - RNA, 26 nt, Human
gaaagaggucuaauaggaugggcagg

SEQ ID NO: 90191 - RNA, 26 nt, Human
uugcucuaucaccuaggcuggagugc

SEQ ID NO: 90192 - RNA, 27 nt, Human
gggaacagaugggacaauaaagacugg

SEQ ID NO: 90193 - RNA, 22 nt, Human
cugucgucuucuguuagugcca

SEQ ID NO: 90194 - RNA, 27 nt, Human
cuguggcuggggcucccuggacccgcc

SEQ ID NO: 90195 - RNA, 27 nt, Human
ccggaccccacucugcccuccaaaaag

SEQ ID NO: 90196 - RNA, 19 nt, Human
ucuguuuacacauuuugca

SEQ ID NO: 90197 - RNA, 22 nt, Human
gugcaucuggugagugugucac

SEQ ID NO: 90198 - RNA, 27 nt, Human
acugaacagauacuguugcuuauugaa

SEQ ID NO: 90199 - RNA, 27 nt, Human
gguuaucugucccagguuaucugggca

SEQ ID NO: 90200 - RNA, 22 nt, Human
guucacugcaugugcugccccc

SEQ ID NO: 90201 - RNA, 21 nt, Human
cgcuuccuggguucugcugag

SEQ ID NO: 90202 - RNA, 28 nt, Human
agagccgggcgagcagagcugcgcugcg

SEQ ID NO: 90203 - RNA, 24 nt, Human
uuguacuggccugcaccagaagau

SEQ ID NO: 90204 - RNA, 24 nt, Human
gccaucaggcaccagaaggauuuu

SEQ ID NO: 90205 - RNA, 21 nt, Human
gguaagucuacauccucucug

SEQ ID NO: 90206 - RNA, 23 nt, Human
uugauagacuuucggcaaccagu

SEQ ID NO: 90207 - RNA, 21 nt, Human
aaauuuuaaagggaggggguc

SEQ ID NO: 90208 - RNA, 22 nt, Human
ggaggaagggagggcagagggg

SEQ ID NO: 90209 - RNA, 21 nt, Human
ggcaaggagagaacaggucag

SEQ ID NO: 90210 - RNA, 23 nt, Human
ggacccagggaacagccacuccc

SEQ ID NO: 90211 - RNA, 20 nt, Human
ggcucagcuccuccccacua

SEQ ID NO: 90212 - RNA, 26 nt, Human
cuccacccccuucuuccagaaucugc

SEQ ID NO: 90213 - RNA, 24 nt, Human
caguguccuaagauacugcuauca

SEQ ID NO: 90214 - RNA, 26 nt, Human
ucuagggugagaccagugcucagcac

SEQ ID NO: 90215 - RNA, 23 nt, Human
ccuaguagcugggaguaucaggu

SEQ ID NO: 90216 - RNA, 22 nt, Human
cuuugcaggccaucugugaugg

SEQ ID NO: 90217 - RNA, 23 nt, Human
gugaggccaacacacagggcaag

SEQ ID NO: 90218 - RNA, 28 nt, Human
ggagaaguauuuuuaugagacucuuuac

SEQ ID NO: 90219 - RNA, 18 nt, Human
aacaccagccccacuucu

SEQ ID NO: 90220 - RNA, 22 nt, Human
gcccuguggacuuucacccagc

SEQ ID NO: 90221 - RNA, 26 nt, Human
uagaucauccuauucuuaugugucuu

SEQ ID NO: 90222 - RNA, 23 nt, Human
cugagcccucuccauucagaguu

SEQ ID NO: 90223 - RNA, 27 nt, Human
gggcagcuuuguccuauacucucucca

SEQ ID NO: 90224 - RNA, 22 nt, Human
ccucuuccuggcucauccuggc

SEQ ID NO: 90225 - RNA, 20 nt, Human
uccuccaaaugcagugaggu

SEQ ID NO: 90226 - RNA, 27 nt, Human
cacugcacuccaucuugggcaacacag

SEQ ID NO: 90227 - RNA, 26 nt, Human
ugcuuuugugccaagguuagccaguc

SEQ ID NO: 90228 - RNA, 21 nt, Human
guucuagcccuguaucuguca

SEQ ID NO: 90229 - RNA, 22 nt, Human
ugcucucaaaccccugaccuca

SEQ ID NO: 90230 - RNA, 22 nt, Human
uuccgacaaaacaaaagggaga

SEQ ID NO: 90231 - RNA, 19 nt, Human
augagaugccauuuuccga

SEQ ID NO: 90232 - RNA, 22 nt, Human
cugaggugggaggguugcuuga

SEQ ID NO: 90233 - RNA, 16 nt, Human
acacauuuagaugcac

SEQ ID NO: 90234 - RNA, 21 nt, Human
aggcugcuuuccaaagccaau

SEQ ID NO: 90235 - RNA, 23 nt, Human
gcuacccaggccgggcugccagc

SEQ ID NO: 90236 - RNA, 19 nt, Human
gaauuuuacuugcaccuua

SEQ ID NO: 90237 - RNA, 24 nt, Human
cucuuuuugauuuuauuuguacuu

SEQ ID NO: 90238 - RNA, 24 nt, Human
gugcuauuuuuggucacuugcuuu

SEQ ID NO: 90239 - RNA, 26 nt, Human
ggccccucuauuuuauuuuucuugaa

SEQ ID NO: 90240 - RNA, 23 nt, Human
ucacccagccugugaggguccug

SEQ ID NO: 90241 - RNA, 24 nt, Human
gcccaggcugccggugcugaggga

SEQ ID NO: 90242 - RNA, 26 nt, Human
cucuguaccuaccaucuccugccucc

SEQ ID NO: 90243 - RNA, 23 nt, Human
aucaggacuuguauuagcagguu

SEQ ID NO: 90244 - RNA, 20 nt, Human
uccagcaugauguucuuguc

SEQ ID NO: 90245 - RNA, 18 nt, Human
auggcagagaaaagcagg

SEQ ID NO: 90246 - RNA, 22 nt, Human
ccuggccuggccugaccaauga

SEQ ID NO: 90247 - RNA, 26 nt, Human
gcccgccugccuccacuccugccucc

SEQ ID NO: 90248 - RNA, 20 nt, Human
uuugccugcuaaauucucca

SEQ ID NO: 90249 - RNA, 16 nt, Human
acgcucugggucgccg

SEQ ID NO: 90250 - RNA, 23 nt, Human
gaaauugaaaucuugagggcagc

SEQ ID NO: 90251 - RNA, 22 nt, Human
accuuugucucuaaagaucaga

SEQ ID NO: 90252 - RNA, 22 nt, Human
cagugcacuccagccuugguga

SEQ ID NO: 90253 - RNA, 21 nt, Human
ccucuacuguacuuuagaacc

SEQ ID NO: 90254 - RNA, 23 nt, Human
ucuauauuuaauuuaggucaaau

SEQ ID NO: 90255 - RNA, 21 nt, Human
acgcagccaccuuccucacca

SEQ ID NO: 90256 - RNA, 22 nt, Human
aggaccucacuuccccggggug

SEQ ID NO: 90257 - RNA, 24 nt, Human
gcccccacucagcauuucggugcu

SEQ ID NO: 90258 - RNA, 22 nt, Human
gaaaugucuguacugauccuca

SEQ ID NO: 90259 - RNA, 27 nt, Human
cggguucaagcgauuuuccugccucag

SEQ ID NO: 90260 - RNA, 23 nt, Human
ggcacucucucuaccccaccucu

SEQ ID NO: 90261 - RNA, 26 nt, Human
cagcaggcuaccccugguuucuggag

SEQ ID NO: 90262 - RNA, 20 nt, Human
auuaaacaauaauugaaaug

SEQ ID NO: 90263 - RNA, 23 nt, Human
agaaacugaaugaauccauugga

SEQ ID NO: 90264 - RNA, 26 nt, Human
ugccuagguugccagagcauuugcac

SEQ ID NO: 90265 - RNA, 20 nt, Human
acucacugcaagcuccgccu

SEQ ID NO: 90266 - RNA, 25 nt, Human
gccuucaguggagcuagaccugcca

SEQ ID NO: 90267 - RNA, 23 nt, Human
gaccuaccccuguccuugcugac

SEQ ID NO: 90268 - RNA, 18 nt, Human
ggaagguuggcagaggga

SEQ ID NO: 90269 - RNA, 25 nt, Human
acauaauagcacaaaaugacacucu

SEQ ID NO: 90270 - RNA, 22 nt, Human
ggauauaauacauauuacucca

SEQ ID NO: 90271 - RNA, 18 nt, Human
ucuccaucucugucuuuc

SEQ ID NO: 90272 - RNA, 28 nt, Human
aggcugccagacgucacuccacccgcca

SEQ ID NO: 90273 - RNA, 21 nt, Human
auaauuuaacacgguugccug

SEQ ID NO: 90274 - RNA, 23 nt, Human
ggggagccuuggauggggugggg

SEQ ID NO: 90275 - RNA, 22 nt, Human
cugagcccugccccacccugcu

SEQ ID NO: 90276 - RNA, 22 nt, Human
cauaccuguaauccuagcacuc

SEQ ID NO: 90277 - RNA, 25 nt, Human
agcuccaaggacucaggcagaggga

SEQ ID NO: 90278 - RNA, 22 nt, Human
ccagccugggcaacauggugag

SEQ ID NO: 90279 - RNA, 26 nt, Human
agggcgggaaaggcaguuggagaaga

SEQ ID NO: 90280 - RNA, 27 nt, Human
ggcaaaguggauaaagccuggucccug

SEQ ID NO: 90281 - RNA, 23 nt, Human
cucagccucccaauuagcuuggc

SEQ ID NO: 90282 - RNA, 24 nt, Human
ccuaccccaacucugcccuucucc

SEQ ID NO: 90283 - RNA, 22 nt, Human
ugcaggcgcgcgccaccaggcc

SEQ ID NO: 90284 - RNA, 20 nt, Human
aagcucucuucacacucccg

SEQ ID NO: 90285 - RNA, 25 nt, Human
aggaggugggguggaaauagggugg

SEQ ID NO: 90286 - RNA, 23 nt, Human
gccagggacggacgugggccagu

SEQ ID NO: 90287 - RNA, 22 nt, Human
caggaggcggagguugcaguga

SEQ ID NO: 90288 - RNA, 20 nt, Human
cugcgcaggguggagggagu

SEQ ID NO: 90289 - RNA, 20 nt, Human
accccugcagccuccuggcc

SEQ ID NO: 90290 - RNA, 21 nt, Human
ccagccuucacugacagccgc

SEQ ID NO: 90291 - RNA, 22 nt, Human
ggcgugaacccgggagguggag

SEQ ID NO: 90292 - RNA, 30 nt, Human
cagccucacgacagauaccaggcaauccag

SEQ ID NO: 90293 - RNA, 20 nt, Human
uuugcaucagccuggaguga

SEQ ID NO: 90294 - RNA, 28 nt, Human
ccgugcgcuccggcacaaucgcgucucu

SEQ ID NO: 90295 - RNA, 22 nt, Human
cugagccauuuauucugcuaca

SEQ ID NO: 90296 - RNA, 22 nt, Human
ccaccgcgccuggccuucaguu

SEQ ID NO: 90297 - RNA, 25 nt, Human
acacuggcuccagcugccagcucgu

SEQ ID NO: 90298 - RNA, 19 nt, Human
gcucacugcugcugccucu

SEQ ID NO: 90299 - RNA, 28 nt, Human
uguuggcagacuggagugcaaucauggc

SEQ ID NO: 90300 - RNA, 20 nt, Human
cuggcccgacgcaguggcac

SEQ ID NO: 90301 - RNA, 22 nt, Human
caggaguuugaggcugcagugc

SEQ ID NO: 90302 - RNA, 23 nt, Human
ccauuagcccauuucccccaaau

SEQ ID NO: 90303 - RNA, 22 nt, Human
uuuuguauuaagaaugcuauua

SEQ ID NO: 90304 - RNA, 21 nt, Human
auaaugugcccuacagacccu

SEQ ID NO: 90305 - RNA, 23 nt, Human
aaucauguucuuuguggacuauu

SEQ ID NO: 90306 - RNA, 21 nt, Human
agcaggacgaagggggagggu

SEQ ID NO: 90307 - RNA, 21 nt, Human
cucagucucucuucucuccag

SEQ ID NO: 90308 - RNA, 21 nt, Human
ccaggaaccacaccacaucua

SEQ ID NO: 90309 - RNA, 27 nt, Human
acaaaccuucauggcaugaaacauuaa

SEQ ID NO: 90310 - RNA, 20 nt, Human
aaauguucguucauguauau

SEQ ID NO: 90311 - RNA, 21 nt, Human
aaggccagggacaggggcgca

SEQ ID NO: 90312 - RNA, 17 nt, Human
gcauccucaguuccugc

SEQ ID NO: 90313 - RNA, 20 nt, Human
guucacugcaaccucugccu

SEQ ID NO: 90314 - RNA, 21 nt, Human
ggggugaggggcaggcagcag

SEQ ID NO: 90315 - RNA, 22 nt, Human
ucacccaggcuggggcgcaaug

SEQ ID NO: 90316 - RNA, 24 nt, Human
gcugacaucuugcacggugacccc

SEQ ID NO: 90317 - RNA, 22 nt, Human
ccuggucuucaguucugugccc

SEQ ID NO: 90318 - RNA, 22 nt, Human
ugacuaaugaccacaccugccu

SEQ ID NO: 90319 - RNA, 27 nt, Human
ccuggcaccugggugcucuggcuggag

SEQ ID NO: 90320 - RNA, 20 nt, Human
ucugcuuggcuuccccucca

SEQ ID NO: 90321 - RNA, 21 nt, Human
ucaaagguuauauagugaaug

SEQ ID NO: 90322 - RNA, 23 nt, Human
ucuccuccugccccagccuccug

SEQ ID NO: 90323 - RNA, 25 nt, Human
uucuuuucucuuccaauaaugcaug

SEQ ID NO: 90324 - RNA, 24 nt, Human
ugaggacgaggaguaauggcauuu

SEQ ID NO: 90325 - RNA, 21 nt, Human
cgggcgcugaugaugggugag

SEQ ID NO: 90326 - RNA, 21 nt, Human
cccaguaaaacagauucuaag

SEQ ID NO: 90327 - RNA, 23 nt, Human
ccugcggggcggagaugggcagg

SEQ ID NO: 90328 - RNA, 20 nt, Human
ugcccugacagauggguccc

SEQ ID NO: 90329 - RNA, 22 nt, Human
gugaugcccccagacacuguca

SEQ ID NO: 90330 - RNA, 24 nt, Human
uaauagguauguagacauaucuaa

SEQ ID NO: 90331 - RNA, 18 nt, Human
gugagacaaggcuugcug

SEQ ID NO: 90332 - RNA, 20 nt, Human
augacccaggcugggcaagg

SEQ ID NO: 90333 - RNA, 27 nt, Human
ucaacagcaagugugaauacugcuuga

SEQ ID NO: 90334 - RNA, 24 nt, Human
ccauucccuuucaucugugcucau

SEQ ID NO: 90335 - RNA, 22 nt, Human
cacucacugcaggcuccgccuc

SEQ ID NO: 90336 - RNA, 25 nt, Human
uuuggguccugggagggugggugaa

SEQ ID NO: 90337 - RNA, 24 nt, Human
gcucagaacuugcugcugucuugu

SEQ ID NO: 90338 - RNA, 21 nt, Human
gcauaauuaaacuccaugcgg

SEQ ID NO: 90339 - RNA, 21 nt, Human
aagcucagauuauuuaaaugg

SEQ ID NO: 90340 - RNA, 23 nt, Human
uguuuuuccgacacuccuggguc

SEQ ID NO: 90341 - RNA, 22 nt, Human
acugaacaaagacaacauuguu

SEQ ID NO: 90342 - RNA, 21 nt, Human
ugcuggcuucagccccuugag

SEQ ID NO: 90343 - RNA, 27 nt, Human
ccugccccaccccugaugucugcucca

SEQ ID NO: 90344 - RNA, 27 nt, Human
aaggcauugaccuccacccaccugccc

SEQ ID NO: 90345 - RNA, 23 nt, Human
gugcucuuaccuaccuauauuug

SEQ ID NO: 90346 - RNA, 20 nt, Human
ugggggguggagggagguga

SEQ ID NO: 90347 - RNA, 22 nt, Human
ucaacuugccauacaccucaaa

SEQ ID NO: 90348 - RNA, 22 nt, Human
ucgcccaggcuggaaugcagug

SEQ ID NO: 90349 - RNA, 26 nt, Human
cccugagcaucccucuggacucagag

SEQ ID NO: 90350 - RNA, 21 nt, Human
ccuguaauccuagcaguuugg

SEQ ID NO: 90351 - RNA, 26 nt, Human
ggguuggagugcgggugggcuccugg

SEQ ID NO: 90352 - RNA, 20 nt, Human
agggaaagauuagcuuugaa

SEQ ID NO: 90353 - RNA, 22 nt, Human
auugaaacuugaguuuguuucu

SEQ ID NO: 90354 - RNA, 23 nt, Human
ucagauucugguucaaauucugc

SEQ ID NO: 90355 - RNA, 24 nt, Human
ccucugccucugucuccugccaca

SEQ ID NO: 90356 - RNA, 27 nt, Human
acaaaccuccuugucaaaguguguaaa

SEQ ID NO: 90357 - RNA, 27 nt, Human
gccuacuggggggcuuuggccugugag

SEQ ID NO: 90358 - RNA, 22 nt, Human
ccugcccugcccugccaccugu

SEQ ID NO: 90359 - RNA, 22 nt, Human
gcgggauguccaucgcuccagc

SEQ ID NO: 90360 - RNA, 25 nt, Human
cauuuucagcacuuccuguuccuau

SEQ ID NO: 90361 - RNA, 27 nt, Human
ccaccauccaacagaccuggugcucua

SEQ ID NO: 90362 - RNA, 21 nt, Human
ugaggaagagguugcagugag

SEQ ID NO: 90363 - RNA, 27 nt, Human
ccaacagcaggcccaucucagaucuuc

SEQ ID NO: 90364 - RNA, 19 nt, Human
cgaggcgaggaggccaggc

SEQ ID NO: 90365 - RNA, 19 nt, Human
uuguuugcuaagcauucca

SEQ ID NO: 90366 - RNA, 28 nt, Human
ccugucuuccugucccuugucugcccag

SEQ ID NO: 90367 - RNA, 26 nt, Human
gggucgccugcccugucucccuacuu

SEQ ID NO: 90368 - RNA, 24 nt, Human
cacaaccaccuccagccugggaga

SEQ ID NO: 90369 - RNA, 21 nt, Human
uacggagucuucaggcccagu

SEQ ID NO: 90370 - RNA, 24 nt, Human
auaaacuuuuauuaugugcucuua

SEQ ID NO: 90371 - RNA, 26 nt, Human
gggggugaaacuuuccaguuuacuga

SEQ ID NO: 90372 - RNA, 22 nt, Human
aggcaggcggaucaugagguca

SEQ ID NO: 90373 - RNA, 21 nt, Human
ggcuuuuaguaaucauguugg

SEQ ID NO: 90374 - RNA, 27 nt, Human
ugcagugaucaggguccugcaagcagu

SEQ ID NO: 90375 - RNA, 27 nt, Human
ugaaggugguuuauuacaaauaagcac

SEQ ID NO: 90376 - RNA, 22 nt, Human
gcggcggcggggccugccugug

SEQ ID NO: 90377 - RNA, 22 nt, Human
ugugccagcugagaggugguag

SEQ ID NO: 90378 - RNA, 21 nt, Human
accaucaggaacagccugccu

SEQ ID NO: 90379 - RNA, 20 nt, Human
gcuucugccacugccuuucc

SEQ ID NO: 90380 - RNA, 22 nt, Human
ggcucacagaaaaagaaaaaga

SEQ ID NO: 90381 - RNA, 21 nt, Human
aacacauguaucacauucaua

SEQ ID NO: 90382 - RNA, 23 nt, Human
ucacagaccacacacccagcccu

SEQ ID NO: 90383 - RNA, 24 nt, Human
acagaagaagagaaacugggccag

SEQ ID NO: 90384 - RNA, 21 nt, Human
ccucaucuccagccucaguag

SEQ ID NO: 90385 - RNA, 26 nt, Human
agccaucuuauucuuguaauuuuaga

SEQ ID NO: 90386 - RNA, 20 nt, Human
guugcuagagaauguuagag

SEQ ID NO: 90387 - RNA, 25 nt, Human
gaccucaggugaucugcccaccuca

SEQ ID NO: 90388 - RNA, 17 nt, Human
agcuaaauaucuuugua

SEQ ID NO: 90389 - RNA, 24 nt, Human
gccauggccuauaggguccugggc

SEQ ID NO: 90390 - RNA, 26 nt, Human
uuuaauaacauacuccuuuuugaaag

SEQ ID NO: 90391 - RNA, 20 nt, Human
cugcagcuuccuccacagcc

SEQ ID NO: 90392 - RNA, 25 nt, Human
gcaugggcucuaaacccacagaacu

SEQ ID NO: 90393 - RNA, 27 nt, Human
uggcucacaccuguaaucccaacacuu

SEQ ID NO: 90394 - RNA, 21 nt, Human
aaaaacaccguggaugcugaa

SEQ ID NO: 90395 - RNA, 20 nt, Human
cgcaggacuggcaagaggga

SEQ ID NO: 90396 - RNA, 23 nt, Human
cuaggauuguccacucaucccag

SEQ ID NO: 90397 - RNA, 21 nt, Human
uguuauuuaaaucaaaccaga

SEQ ID NO: 90398 - RNA, 23 nt, Human
agaggaggaaagcaggcauuuga

SEQ ID NO: 90399 - RNA, 24 nt, Human
ucugccuggucaaugcugagcugu

SEQ ID NO: 90400 - RNA, 21 nt, Human
acagugggggaaauagaaaac

SEQ ID NO: 90401 - RNA, 21 nt, Human
ccggguugggagcuugcugug

SEQ ID NO: 90402 - RNA, 23 nt, Human
gaggauugcguuagagauaaacc

SEQ ID NO: 90403 - RNA, 22 nt, Human
ucacuccucagcugcaggagcc

SEQ ID NO: 90404 - RNA, 27 nt, Human
cugggcccuggcugggaguagaggggc

SEQ ID NO: 90405 - RNA, 23 nt, Human
uccugaucuugccccuccagaga

SEQ ID NO: 90406 - RNA, 22 nt, Human
gagcaagcgcacagcagaggag

SEQ ID NO: 90407 - RNA, 22 nt, Human
ccugcagcuccaauuucaugca

SEQ ID NO: 90408 - RNA, 23 nt, Human
cccugcucccucgcuggcaagcc

SEQ ID NO: 90409 - RNA, 26 nt, Human
aauacaaaaucauggugacacuucca

SEQ ID NO: 90410 - RNA, 27 nt, Human
uucuggcucccucuucuuucagacuug

SEQ ID NO: 90411 - RNA, 23 nt, Human
acaaaugauguugauuauguaag

SEQ ID NO: 90412 - RNA, 26 nt, Human
cagacacccacccucgcuucagccac

SEQ ID NO: 90413 - RNA, 20 nt, Human
acauccagaguucugugaca

SEQ ID NO: 90414 - RNA, 23 nt, Human
uaagugaaaacauucauucacug

SEQ ID NO: 90415 - RNA, 26 nt, Human
gggaagagaggaggccaggccaggcc

SEQ ID NO: 90416 - RNA, 19 nt, Human
caucuugagcucuucauuu

SEQ ID NO: 90417 - RNA, 25 nt, Human
ucugccgucgguccugcugcuaacc

SEQ ID NO: 90418 - RNA, 27 nt, Human
caccccacuccagccucgaggaagcuu

SEQ ID NO: 90419 - RNA, 21 nt, Human
gguucuugagcuuaucuccca

SEQ ID NO: 90420 - RNA, 24 nt, Human
gcuccguuuggcagugcaauggua

SEQ ID NO: 90421 - RNA, 23 nt, Human
uucaguuuuaccauuguuagcaa

SEQ ID NO: 90422 - RNA, 20 nt, Human
ggggauaauagcacuaccua

SEQ ID NO: 90423 - RNA, 26 nt, Human
cagcccgaggcacugcagcagaagag

SEQ ID NO: 90424 - RNA, 25 nt, Human
uacagaccucgaagccuugcugcua

SEQ ID NO: 90425 - RNA, 21 nt, Human
acgcggccugcuucagccuga

SEQ ID NO: 90426 - RNA, 19 nt, Human
auguugggccuccugcugc

SEQ ID NO: 90427 - RNA, 24 nt, Human
uugaagcccagacaucuuucucca

SEQ ID NO: 90428 - RNA, 24 nt, Human
ggccuucagcacccgcccaccucc

SEQ ID NO: 90429 - RNA, 22 nt, Human
ugccuccacaugcugccuggca

SEQ ID NO: 90430 - RNA, 23 nt, Human
cgaccuguggacuaaaucugcca

SEQ ID NO: 90431 - RNA, 23 nt, Human
gaggggcucagaggaauacuugg

SEQ ID NO: 90432 - RNA, 30 nt, Human
guuucaacuguuuggagucuuuuaugaagu

SEQ ID NO: 90433 - RNA, 22 nt, Human
agguaauacuauaaauauauug

SEQ ID NO: 90434 - RNA, 21 nt, Human
gaacuaagccaggaagacaug

SEQ ID NO: 90435 - RNA, 27 nt, Human
gaccagccuggccaacacuaucuguac

SEQ ID NO: 90436 - RNA, 25 nt, Human
uggugcuaaauugcugucucaaaau

SEQ ID NO: 90437 - RNA, 28 nt, Human
ggugagaggaagccucgcagaauccagc

SEQ ID NO: 90438 - RNA, 14 nt, Human
agggagcagaggac

SEQ ID NO: 90439 - RNA, 22 nt, Human
ccuccaucccaaccuggcuccc

SEQ ID NO: 90440 - RNA, 22 nt, Human
agccucccaaguagcugggaua

SEQ ID NO: 90441 - RNA, 19 nt, Human
cauugccuugggccuggga

SEQ ID NO: 90442 - RNA, 19 nt, Human
ccucaccucucccuaguuc

SEQ ID NO: 90443 - RNA, 22 nt, Human
accacgcgccuccuccuccucg

SEQ ID NO: 90444 - RNA, 22 nt, Human
gcuggucucggacuccugggcu

SEQ ID NO: 90445 - RNA, 25 nt, Human
uuggguuguuuaaaaauuuauaaca

SEQ ID NO: 90446 - RNA, 22 nt, Human
acccaacagcguccaguuccua

SEQ ID NO: 90447 - RNA, 19 nt, Human
uguauaauauaaggcucca

SEQ ID NO: 90448 - RNA, 21 nt, Human
gccgcccaggcuggagugcag

SEQ ID NO: 90449 - RNA, 29 nt, Human
gacuucauguugccaaggaaucccugucu

SEQ ID NO: 90450 - RNA, 22 nt, Human
guuuuaaaaacuuucucgcucc

SEQ ID NO: 90451 - RNA, 21 nt, Human
ccccucuggccacgacuuggc

SEQ ID NO: 90452 - RNA, 22 nt, Human
ccacaucucccuggcagcagau

SEQ ID NO: 90453 - RNA, 27 nt, Human
ccacugcacuccaaccuagguaacaga

SEQ ID NO: 90454 - RNA, 22 nt, Human
gcuggccaccccgccuccuugg

SEQ ID NO: 90455 - RNA, 23 nt, Human
aucaccuaggcuggagugcagcg

SEQ ID NO: 90456 - RNA, 27 nt, Human
aaccaaaacagaguggauugggcugca

SEQ ID NO: 90457 - RNA, 20 nt, Human
uuuccuggcucaucucuuua

SEQ ID NO: 90458 - RNA, 21 nt, Human
cgugugccaccaugcuuggcu

SEQ ID NO: 90459 - RNA, 21 nt, Human
aagugggaccgguggagcagc

SEQ ID NO: 90460 - RNA, 28 nt, Human
gggugagccacuggcagugugcuuaccu

SEQ ID NO: 90461 - RNA, 26 nt, Human
ucgggaggcugaggcaggagaaucgc

SEQ ID NO: 90462 - RNA, 20 nt, Human
ugcagggacagagcauuggg

SEQ ID NO: 90463 - RNA, 23 nt, Human
aguguucugcacagcaaaccgca

SEQ ID NO: 90464 - RNA, 22 nt, Human
ucaagcaguucuccugccucag

SEQ ID NO: 90465 - RNA, 19 nt, Human
cggccuuauuucugccuuu

SEQ ID NO: 90466 - RNA, 18 nt, Human
gagcacuggaggaagagc

SEQ ID NO: 90467 - RNA, 21 nt, Human
ccacaacauccgccuccuggg

SEQ ID NO: 90468 - RNA, 21 nt, Human
aggggaggggacgggcagggu

SEQ ID NO: 90469 - RNA, 26 nt, Human
cuacacacaccucuucuuuucuuggu

SEQ ID NO: 90470 - RNA, 23 nt, Human
cgcaucaguggcgaugacuuuau

SEQ ID NO: 90471 - RNA, 22 nt, Human
ucuuuaaauuucaucucaggcc

SEQ ID NO: 90472 - RNA, 26 nt, Human
agagugagacagaccuggauucaaau

SEQ ID NO: 90473 - RNA, 20 nt, Human
auguuaugcuccugcugauc

SEQ ID NO: 90474 - RNA, 22 nt, Human
cgcugccgccgccggaucccag

SEQ ID NO: 90475 - RNA, 22 nt, Human
ugcaaccucuaccucccagguu

SEQ ID NO: 90476 - RNA, 22 nt, Human
gcgccguggcuccggaucucuu

SEQ ID NO: 90477 - RNA, 21 nt, Human
cuagaaugcacaccaaaaaga

SEQ ID NO: 90478 - RNA, 22 nt, Human
gcucccuccccagcaggcacag

SEQ ID NO: 90479 - RNA, 20 nt, Human
uucaaagcuuguuccaucaa

SEQ ID NO: 90480 - RNA, 24 nt, Human
gccucucccccgccuccuccugcc

SEQ ID NO: 90481 - RNA, 24 nt, Human
ugaagauggcuuuuccuggacagc

SEQ ID NO: 90482 - RNA, 23 nt, Human
aauguuguuuacaauauagauga

SEQ ID NO: 90483 - RNA, 21 nt, Human
uugcaggccucugccugcugc

SEQ ID NO: 90484 - RNA, 22 nt, Human
uagaagaagcugggcaugggug

SEQ ID NO: 90485 - RNA, 23 nt, Human
aaguacccccuuuccuccucacc

SEQ ID NO: 90486 - RNA, 24 nt, Human
cuucaguuuaguuuaugaauuuua

SEQ ID NO: 90487 - RNA, 27 nt, Human
gagagagacugacugagcaggaauggu

SEQ ID NO: 90488 - RNA, 22 nt, Human
cugagcuggggagggaggcagg

SEQ ID NO: 90489 - RNA, 23 nt, Human
gugagccagcacaccgggccaag

SEQ ID NO: 90490 - RNA, 29 nt, Human
aguuagguuugaauaaauauuuucauuaa

SEQ ID NO: 90491 - RNA, 23 nt, Human
cccuccagcaccacuuuggcuua

SEQ ID NO: 90492 - RNA, 26 nt, Human
uuugcaaauaaugcauuuuuuacaaa

SEQ ID NO: 90493 - RNA, 25 nt, Human
ugauccagcccucacccaccuuccu

SEQ ID NO: 90494 - RNA, 24 nt, Human
agcuucuggcugcuccugaauggu

SEQ ID NO: 90495 - RNA, 23 nt, Human
agugccacauggccgcugcccac

SEQ ID NO: 90496 - RNA, 23 nt, Human
uuugccccucuuucccacaugcc

SEQ ID NO: 90497 - RNA, 27 nt, Human
gccuuucucccucacaucaggagguag

SEQ ID NO: 90498 - RNA, 21 nt, Human
aaguuuucuggagagcuguug

SEQ ID NO: 90499 - RNA, 20 nt, Human
cuuccaucuggcaucccacg

SEQ ID NO: 90500 - RNA, 21 nt, Human
gcugggagacugaagacucag

SEQ ID NO: 90501 - RNA, 22 nt, Human
cuggacccagagcugaccuaug

SEQ ID NO: 90502 - RNA, 24 nt, Human
agcacagugccuugccuagaguag

SEQ ID NO: 90503 - RNA, 17 nt, Human
ccugcuguucucuuguu

SEQ ID NO: 90504 - RNA, 28 nt, Human
gugugggguucucagugccggagcuugg

SEQ ID NO: 90505 - RNA, 24 nt, Human
agcucacucucaccccuucugccu

SEQ ID NO: 90506 - RNA, 21 nt, Human
gggcccuguacccaccugcug

SEQ ID NO: 90507 - RNA, 20 nt, Human
cucuaauacugcaagaaggu

SEQ ID NO: 90508 - RNA, 27 nt, Human
auguucucugcucaccuugguuuccgc

SEQ ID NO: 90509 - RNA, 21 nt, Human
uugucucccaggcuggagugc

SEQ ID NO: 90510 - RNA, 29 nt, Human
uuccugugccugccuuccccaccccagca

SEQ ID NO: 90511 - RNA, 28 nt, Human
ggccaaacaaaaauagcuacaaauccac

SEQ ID NO: 90512 - RNA, 20 nt, Human
acacacacgcaaccuccugg

SEQ ID NO: 90513 - RNA, 23 nt, Human
accuuugccauuucucugccaua

SEQ ID NO: 90514 - RNA, 24 nt, Human
agggaggccucuugccugagggau

SEQ ID NO: 90515 - RNA, 25 nt, Human
ugggggcgggggugcucaaugagaa

SEQ ID NO: 90516 - RNA, 26 nt, Human
gccuguaaucccagcacuuuagauca

SEQ ID NO: 90517 - RNA, 25 nt, Human
agacagccacuugguuuuuggcucu

SEQ ID NO: 90518 - RNA, 26 nt, Human
ugucuuugaggaagaagauguccgug

SEQ ID NO: 90519 - RNA, 27 nt, Human
guuauuucugcauuguuaccugcauau

SEQ ID NO: 90520 - RNA, 22 nt, Human
uucuccauguuggucaggcugg

SEQ ID NO: 90521 - RNA, 28 nt, Human
gaauguguggcccgcuggcagccaggca

SEQ ID NO: 90522 - RNA, 22 nt, Human
cagccagcuuucuuccuuaaua

SEQ ID NO: 90523 - RNA, 21 nt, Human
uggcggggagcggagagcagc

SEQ ID NO: 90524 - RNA, 23 nt, Human
cuccauggucgggccucugacag

SEQ ID NO: 90525 - RNA, 22 nt, Human
gccuccucaacuaugaccucaa

SEQ ID NO: 90526 - RNA, 27 nt, Human
uauuacccaacuaguugguaaugugau

SEQ ID NO: 90527 - RNA, 22 nt, Human
ccccucccacacaguuggaccc

SEQ ID NO: 90528 - RNA, 27 nt, Human
cccugcaggaagcaucacccaggcugg

SEQ ID NO: 90529 - RNA, 25 nt, Human
cgggcagccguccugcagccgccac

SEQ ID NO: 90530 - RNA, 30 nt, Human
gcugcagugagccaugaucaugccacugca

SEQ ID NO: 90531 - RNA, 23 nt, Human
cgcugagaugcccuucugcucca

SEQ ID NO: 90532 - RNA, 23 nt, Human
gggcaguguggcagguggagagg

SEQ ID NO: 90533 - RNA, 22 nt, Human
ccgaggcaggagaauugcugga

SEQ ID NO: 90534 - RNA, 21 nt, Human
aacuggaguuucucuugugag

SEQ ID NO: 90535 - RNA, 24 nt, Human
gcgugaucucagcucacugcaacc

SEQ ID NO: 90536 - RNA, 26 nt, Human
uuuacaaccuaaugacuuuuguauuu

SEQ ID NO: 90537 - RNA, 27 nt, Human
uggccucaaacagccacgaggugguag

SEQ ID NO: 90538 - RNA, 26 nt, Human
gaggcugaggcaugaggaucucuuga

SEQ ID NO: 90539 - RNA, 28 nt, Human
uggcucuaauucacagugcucuuucucc

SEQ ID NO: 90540 - RNA, 23 nt, Human
gugggcagguggacgcucugcug

SEQ ID NO: 90541 - RNA, 26 nt, Human
accaucucauuaauuuacaaaggaua

SEQ ID NO: 90542 - RNA, 18 nt, Human
uuacaauucucucacuua

SEQ ID NO: 90543 - RNA, 29 nt, Human
ccucugucgggggcuaagccagccuggcg

SEQ ID NO: 90544 - RNA, 29 nt, Human
gggaggcugagacaggaggauuccuugag

SEQ ID NO: 90545 - RNA, 21 nt, Human
aguguggcugucugcgagauu

SEQ ID NO: 90546 - RNA, 22 nt, Human
gcaaagaaaauaaaaauaacac

SEQ ID NO: 90547 - RNA, 27 nt, Human
auacaguucggugagcuacaaaugcau

SEQ ID NO: 90548 - RNA, 22 nt, Human
ccugcagugucgccaugacuga

SEQ ID NO: 90549 - RNA, 27 nt, Human
gacauacagugcuggccacaaccuucu

SEQ ID NO: 90550 - RNA, 22 nt, Human
agaagcccggagguugcgcugg

SEQ ID NO: 90551 - RNA, 22 nt, Human
ggauagguggggaaaucugaag

SEQ ID NO: 90552 - RNA, 24 nt, Human
caggcagccaaaucuugccugugc

SEQ ID NO: 90553 - RNA, 17 nt, Human
caacugugcccuccaca

SEQ ID NO: 90554 - RNA, 22 nt, Human
guccuggggagcaggacacaug

SEQ ID NO: 90555 - RNA, 26 nt, Human
cgauguugugcaauauccaucuacug

SEQ ID NO: 90556 - RNA, 30 nt, Human
gggaggagcagagccagggagccaucuaca

SEQ ID NO: 90557 - RNA, 25 nt, Human
uugaggcagauauucuuucgucaua

SEQ ID NO: 90558 - RNA, 21 nt, Human
gugccuggccccagucugggc

SEQ ID NO: 90559 - RNA, 26 nt, Human
caucccgcaaggcaggcuggaggugc

SEQ ID NO: 90560 - RNA, 27 nt, Human
gagacuccacccuccccaccuggcuca

SEQ ID NO: 90561 - RNA, 20 nt, Human
uucuagaaucagaucuguuu

SEQ ID NO: 90562 - RNA, 23 nt, Human
aguauagaaaaguuaacacaagu

SEQ ID NO: 90563 - RNA, 22 nt, Human
gaguuugaagggcuuuuauagu

SEQ ID NO: 90564 - RNA, 21 nt, Human
uaacaaaucuuuucgcguuuu

SEQ ID NO: 90565 - RNA, 25 nt, Human
gguugaauuucuccaggcacucccu

SEQ ID NO: 90566 - RNA, 27 nt, Human
uugcccaggcuggucuugaacuccggg

SEQ ID NO: 90567 - RNA, 28 nt, Human
uuuauuucacuuuuaauuugcugguguu

SEQ ID NO: 90568 - RNA, 20 nt, Human
ucuucccucugggccuguuc

SEQ ID NO: 90569 - RNA, 26 nt, Human
ucauucuaugugccguuuuguuguua

SEQ ID NO: 90570 - RNA, 22 nt, Human
aggaagggcacgguggagagaa

SEQ ID NO: 90571 - RNA, 32 nt, Human; identical to SEQ ID NO: 5859

SEQ ID NO: 90572 - RNA, 27 nt, Human
cauuaaacaucccaggucucauccuuc

SEQ ID NO: 90573 - RNA, 27 nt, Human
guugcccaggcuggagugcaauggcac

SEQ ID NO: 90574 - RNA, 22 nt, Human
ccaggggccccgggucgcagag

SEQ ID NO: 90575 - RNA, 31 nt, Human
cacccaggucgggcggugggggcgagcggag

SEQ ID NO: 90576 - RNA, 20 nt, Human
ggccacuguggugacuuugg

SEQ ID NO: 90577 - RNA, 22 nt, Human
acaucucaggaagcacuggaca

SEQ ID NO: 90578 - RNA, 22 nt, Human
gcugcuugcgcucaucaucucu

SEQ ID NO: 90579 - RNA, 24 nt, Human
gggagcuggacaguggagugcaaa

SEQ ID NO: 90580 - RNA, 21 nt, Human
ggagggagaccccacaguggc

SEQ ID NO: 90581 - RNA, 27 nt, Human
ucaucccagauuacuaacccuuccuga

SEQ ID NO: 90582 - RNA, 22 nt, Human
uucaagaaauuguucugccugg

SEQ ID NO: 90583 - RNA, 25 nt, Human
gugugcgccagcccgcggcccagcc

SEQ ID NO: 90584 - RNA, 20 nt, Human
guugagauuucagcauuucc

SEQ ID NO: 90585 - RNA, 27 nt, Human
ccccucggugggcccagggccuagggg

SEQ ID NO: 90586 - RNA, 23 nt, Human
uuguuaggauguccugugcugcu

SEQ ID NO: 90587 - RNA, 22 nt, Human
uuuucucucacugaugcccuuu

SEQ ID NO: 90588 - RNA, 23 nt, Human
gcuggugucccugucguggagcu

SEQ ID NO: 90589 - RNA, 21 nt, Human
uguacuccaagccuccgucac

SEQ ID NO: 90590 - RNA, 21 nt, Human
ggggagauuuuucuuuugaaa

SEQ ID NO: 90591 - RNA, 23 nt, Human
gcaaaguucuguguuuaauuucu

SEQ ID NO: 90592 - RNA, 21 nt, Human
aucugcuacuuuacuaauuca

SEQ ID NO: 90593 - RNA, 24 nt, Human
aguauucaauaaauguaguuuaca

SEQ ID NO: 90594 - RNA, 21 nt, Human
cugaucuugguguucaaaaca

SEQ ID NO: 90595 - RNA, 31 nt, Human
ggaucacaggugucagccauugcacccagcc

SEQ ID NO: 90596 - RNA, 25 nt, Human
aagggaugggggaaauggagauggc

SEQ ID NO: 90597 - RNA, 27 nt, Human
auuuugggggaacauuucuuuuacauu

SEQ ID NO: 90598 - RNA, 21 nt, Human
gggagacggagguugcaguga

SEQ ID NO: 90599 - RNA, 21 nt, Human
ggugagggcgguguguuguau

SEQ ID NO: 90600 - RNA, 27 nt, Human
uguaucuugcauucacacucaauaguc

SEQ ID NO: 90601 - RNA, 27 nt, Human
ccacugcacuccagccuggcaauagac

SEQ ID NO: 90602 - RNA, 23 nt, Human
ugaagugauucuguugacaauaa

SEQ ID NO: 90603 - RNA, 25 nt, Human
uuugggggaagagaaacuugcagug

SEQ ID NO: 90604 - RNA, 22 nt, Human
acccaggcuggagugcaguguu

SEQ ID NO: 90605 - RNA, 21 nt, Human
aaacuaagagaaugaaaagua

SEQ ID NO: 90606 - RNA, 23 nt, Human
uugcccaaggucacacagcuagu

SEQ ID NO: 90607 - RNA, 28 nt, Human
agccuggguuuggagugagugccuggaa

SEQ ID NO: 90608 - RNA, 20 nt, Human
cacauggugcugcuuuucag

SEQ ID NO: 90609 - RNA, 24 nt, Human
guugcccaggcuggucugaagcug

SEQ ID NO: 90610 - RNA, 23 nt, Human
uggggcgggcaccuggcagugag

SEQ ID NO: 90611 - RNA, 23 nt, Human
ucuuuuuuguuuuccucucagac

SEQ ID NO: 90612 - RNA, 28 nt, Human
ucuacugcugcugacauaaaaccaggac

SEQ ID NO: 90613 - RNA, 27 nt, Human
cugcuuucuguuccaaauucaguuuca

SEQ ID NO: 90614 - RNA, 20 nt, Human
ucugcucuccgaccucucuc

SEQ ID NO: 90615 - RNA, 23 nt, Human
cccuccaguguccccggagcuga

SEQ ID NO: 90616 - RNA, 22 nt, Human
ucuccaccucucuaucuauguc

SEQ ID NO: 90617 - RNA, 17 nt, Human
cuccagccucagcuggc

SEQ ID NO: 90618 - RNA, 27 nt, Human
caggcuggagugcagugguguggucuc

SEQ ID NO: 90619 - RNA, 27 nt, Human
caggcuggagugcaauggcgugaucuu

SEQ ID NO: 90620 - RNA, 23 nt, Human
gcccaccucccccucuuguugcc

SEQ ID NO: 90621 - RNA, 23 nt, Human
uccuggaaggcacuucucucccu

SEQ ID NO: 90622 - RNA, 26 nt, Human
cccgacgaucuuccuggcuccaacac

SEQ ID NO: 90623 - RNA, 20 nt, Human
cugcagacugccuuguacuc

SEQ ID NO: 90624 - RNA, 20 nt, Human
uggccuugguuccuccagca

SEQ ID NO: 90625 - RNA, 24 nt, Human
cuuaaaaaacauauaugugugugg

SEQ ID NO: 90626 - RNA, 22 nt, Human
acagaugaacucuuucuggccu

SEQ ID NO: 90627 - RNA, 21 nt, Human
gaacaggcugacacgcagcag

SEQ ID NO: 90628 - RNA, 21 nt, Human
ggagucaggggacuucucuuc

SEQ ID NO: 90629 - RNA, 29 nt, Human
gcuuggaaccucugaagguggggagcgga

SEQ ID NO: 90630 - RNA, 23 nt, Human
ccgccucuuccuucccagccugc

SEQ ID NO: 90631 - RNA, 27 nt, Human
ucauuuugcaggcuggaagcaccaggg

SEQ ID NO: 90632 - RNA, 21 nt, Human
aaccagaguuaaaaccucuuu

SEQ ID NO: 90633 - RNA, 23 nt, Human
gggcggugcguuccacugcucug

SEQ ID NO: 90634 - RNA, 24 nt, Human
cucuccucuguagauacccacccc

SEQ ID NO: 90635 - RNA, 21 nt, Human
gaagcacaagaaaaauuucag

SEQ ID NO: 90636 - RNA, 25 nt, Human
uccagucuagggggucucagauugg

SEQ ID NO: 90637 - RNA, 22 nt, Human
aaggaggcggggccugcagcug

SEQ ID NO: 90638 - RNA, 28 nt, Human
uacuuaguagauaaaaacaaauuuuaag

SEQ ID NO: 90639 - RNA, 26 nt, Human
cagcuaucuugucugguuuucuugag

SEQ ID NO: 90640 - RNA, 25 nt, Human
uugccucaacguccaacccuucugc

SEQ ID NO: 90641 - RNA, 22 nt, Human
cucggccucccaaaaugcuggg

SEQ ID NO: 90642 - RNA, 23 nt, Human
gucuuaaagaauuugaaaguuuc

SEQ ID NO: 90643 - RNA, 22 nt, Human
auuucuuuucuuucucaucuug

SEQ ID NO: 90644 - RNA, 21 nt, Human
cugucccccaggcuggagugc

SEQ ID NO: 90645 - RNA, 27 nt, Human
caugccuuucuggggugaagcccuuug

SEQ ID NO: 90646 - RNA, 25 nt, Human
gccagcccacacagcccgagccccu

SEQ ID NO: 90647 - RNA, 21 nt, Human
ggaauuuguuuuaucucuuug

SEQ ID NO: 90648 - RNA, 23 nt, Human
gaguugugggcccaggagcccug

SEQ ID NO: 90649 - RNA, 22 nt, Human
ggcuaauuuuuguauuuuguau

SEQ ID NO: 90650 - RNA, 26 nt, Human
uacaauuaaaagcacauuguuggacc

SEQ ID NO: 90651 - RNA, 20 nt, Human
gccaccccuccucuagcucu

SEQ ID NO: 90652 - RNA, 28 nt, Human
gcccucugcuccaccccuccuguguguc

SEQ ID NO: 90653 - RNA, 21 nt, Human
agcaggaacuccuacuuuuuc

SEQ ID NO: 90654 - RNA, 20 nt, Human
gugguaagggaagcccuccc

SEQ ID NO: 90655 - RNA, 26 nt, Human
cuaagaugcccggacauccuggaagc

SEQ ID NO: 90656 - RNA, 27 nt, Human
gccggggacacaggagccggugugugc

SEQ ID NO: 90657 - RNA, 22 nt, Human
acugagucgggagcccagagga

SEQ ID NO: 90658 - RNA, 28 nt, Human
ccagcauguucccaaaucugugcuggac

SEQ ID NO: 90659 - RNA, 22 nt, Human
aggcugaggugggaggaucggu

SEQ ID NO: 90660 - RNA, 27 nt, Human
cagguucgaguucaguggugccaucuc

SEQ ID NO: 90661 - RNA, 24 nt, Human
ggcugugguggagcugacgcuggg

SEQ ID NO: 90662 - RNA, 30 nt, Human
ugucucuuuaaugucacaggcaggucccag

SEQ ID NO: 90663 - RNA, 17 nt, Human
auacuuccuguugccgg

SEQ ID NO: 90664 - RNA, 20 nt, Human
caugucaaucaagaugggug

SEQ ID NO: 90665 - RNA, 20 nt, Human
cguggggaaagauggcggaa

SEQ ID NO: 90666 - RNA, 27 nt, Human
ucauugaauucucacagcaacuccuga

SEQ ID NO: 90667 - RNA, 20 nt, Human
cccuauuuaacagggucucu

SEQ ID NO: 90668 - RNA, 23 nt, Human
ucugccuaccugccccaccccuc

SEQ ID NO: 90669 - RNA, 26 nt, Human
ccuuucccagcugcacucgcccugug

SEQ ID NO: 90670 - RNA, 19 nt, Human
guggguggggaaggaaggc

SEQ ID NO: 90671 - RNA, 21 nt, Human
ggaacuccugagucaagugau

SEQ ID NO: 90672 - RNA, 22 nt, Human
ugccuuuccuucuaaagggaau

SEQ ID NO: 90673 - RNA, 26 nt, Human
guccuuuaaauuuugcacugcucaau

SEQ ID NO: 90674 - RNA, 23 nt, Human
uggaauacaguacgaguuccaca

SEQ ID NO: 90675 - RNA, 26 nt, Human
ugauauucugcaacacuguacacaua

SEQ ID NO: 90676 - RNA, 24 nt, Human
agugcagcuugacauuauguuuua

SEQ ID NO: 90677 - RNA, 18 nt, Human
cugucucuuggcuuuguc

SEQ ID NO: 90678 - RNA, 22 nt, Human
gcccuccacgucagugccaucg

SEQ ID NO: 90679 - RNA, 21 nt, Human
ucuguuuccccagccuagcaa

SEQ ID NO: 90680 - RNA, 21 nt, Human
acaggcuuuauuuucaccuug

SEQ ID NO: 90681 - RNA, 23 nt, Human
aaugccuuccacugcuccuuuau

SEQ ID NO: 90682 - RNA, 22 nt, Human
aaguuugagccugaaauuuuaa

SEQ ID NO: 90683 - RNA, 19 nt, Human
ccaccuccccaacauguga

SEQ ID NO: 90684 - RNA, 23 nt, Human
gcucaagcaauccuccugccuca

SEQ ID NO: 90685 - RNA, 24 nt, Human
aacaccaaucccauccacacucac

SEQ ID NO: 90686 - RNA, 23 nt, Human
uucucagagccaaauacucuuug

SEQ ID NO: 90687 - RNA, 26 nt, Human
ucuccugguccuucugccaucaugcc

SEQ ID NO: 90688 - RNA, 27 nt, Human
ccaggagggaggguuuugguugcuggc

SEQ ID NO: 90689 - RNA, 26 nt, Human
gcaaaacuacacagucuugacugugu

SEQ ID NO: 90690 - RNA, 24 nt, Human
uaaauugagcuauuaaacuaauga

SEQ ID NO: 90691 - RNA, 27 nt, Human
ccaggugguggaggugggguuggagca

SEQ ID NO: 90692 - RNA, 24 nt, Human
auauuuuucauauuuaacuugucu

SEQ ID NO: 90693 - RNA, 20 nt, Human
ucuucauuuuuccuccuguc

SEQ ID NO: 90694 - RNA, 23 nt, Human
gccaugagguucggcacccaggu

SEQ ID NO: 90695 - RNA, 22 nt, Human
cauugcacuccagccugggcaa

SEQ ID NO: 90696 - RNA, 22 nt, Human
cacugcacucuaaccugggcga

SEQ ID NO: 90697 - RNA, 22 nt, Human
cauuacacuccagccugggcga

SEQ ID NO: 90698 - RNA, 18 nt, Human
agcuaauuuuuguuuugu

SEQ ID NO: 90699 - RNA, 23 nt, Human
cuguguccuaaauuugaaguuca

SEQ ID NO: 90700 - RNA, 28 nt, Human
gcacuauugucccuucuuccucacugca

SEQ ID NO: 90701 - RNA, 26 nt, Human
ugcuguuguccaacuauuuauugacu

SEQ ID NO: 90702 - RNA, 24 nt, Human
gagguaggaaugagcaggucagau

SEQ ID NO: 90703 - RNA, 23 nt, Human
acagucagggcacggcgccccuc

SEQ ID NO: 90704 - RNA, 23 nt, Human
gucccacuggcuggccucaggcu

SEQ ID NO: 90705 - RNA, 25 nt, Human
gccuguugccagacuggagugcagu

SEQ ID NO: 90706 - RNA, 22 nt, Human
cgggagguggagauugcaguga

SEQ ID NO: 90707 - RNA, 22 nt, Human
accggccuggccaacaugguga

SEQ ID NO: 90708 - RNA, 22 nt, Human
aaaaccucacugcaaggcugaa

SEQ ID NO: 90709 - RNA, 23 nt, Human
ggucucaagguucucauuucuca

SEQ ID NO: 90710 - RNA, 21 nt, Human
caccauugcacuccagcuggg

SEQ ID NO: 90711 - RNA, 22 nt, Human
gccauuucucaaacccaccucg

SEQ ID NO: 90712 - RNA, 22 nt, Human
cagucauuugcugcugcugcug

SEQ ID NO: 90713 - RNA, 22 nt, Human
aagcucagaucucuagagcugu

SEQ ID NO: 90714 - RNA, 21 nt, Human
uugugacccaggguggggaca

SEQ ID NO: 90715 - RNA, 23 nt, Human
cagggccuucaagaggccugugu

SEQ ID NO: 90716 - RNA, 18 nt, Human
ugccauugguagcuuaaa

SEQ ID NO: 90717 - RNA, 24 nt, Human
agcuugggagcugcagaugccucc

SEQ ID NO: 90718 - RNA, 20 nt, Human
uuuguacuucugucaugcuu

SEQ ID NO: 90719 - RNA, 23 nt, Human
ccugccuccccugccucaccagc

SEQ ID NO: 90720 - RNA, 21 nt, Human
ggcuaggccaucaccaaccaa

SEQ ID NO: 90721 - RNA, 23 nt, Human
gcaagauaaccccaagacagucu

SEQ ID NO: 90722 - RNA, 19 nt, Human
ugggacagaagcagaggag

SEQ ID NO: 90723 - RNA, 21 nt, Human
ucuguaagugaggagcacugu

SEQ ID NO: 90724 - RNA, 22 nt, Human
acaucauggaccaaaugugcca

SEQ ID NO: 90725 - RNA, 25 nt, Human
gcccaugcuggagugcaauggcacg

SEQ ID NO: 90726 - RNA, 21 nt, Human
gcagugagucaugaguaugcc

SEQ ID NO: 90727 - RNA, 22 nt, Human
ggucaagccuugucccuuccuc

SEQ ID NO: 90728 - RNA, 19 nt, Human
gauuacagacaugagccac

SEQ ID NO: 90729 - RNA, 26 nt, Human
cugccucugugacugcugcuuugcau

SEQ ID NO: 90730 - RNA, 26 nt, Human
accagcacugagcccccucucccucc

SEQ ID NO: 90731 - RNA, 27 nt, Human
uugcuuacuuuuuaccaggagugcagu

SEQ ID NO: 90732 - RNA, 19 nt, Human
gagucucucuuccuccuca

SEQ ID NO: 90733 - RNA, 21 nt, Human
uaaaguacugggauuacaggc

SEQ ID NO: 90734 - RNA, 26 nt, Human
cgggccccugcccuccucugcaccug

SEQ ID NO: 90735 - RNA, 26 nt, Human
ucuuucuaaccugccuaaacucuagg

SEQ ID NO: 90736 - RNA, 29 nt, Human
ucccuugcgggucccccaggaagccaggu

SEQ ID NO: 90737 - RNA, 21 nt, Human
uggggagccacuggggagggg

SEQ ID NO: 90738 - RNA, 23 nt, Human
acccuacaacugagcacaaccuc

SEQ ID NO: 90739 - RNA, 17 nt, Human
ccuacuuccucugcaaa

SEQ ID NO: 90740 - RNA, 22 nt, Human
ugaccucugcugggucacagcc

SEQ ID NO: 90741 - RNA, 23 nt, Human
gcagcagugaguccagugaccuc

SEQ ID NO: 90742 - RNA, 21 nt, Human
cugcaauuuuuugguauuuuu

SEQ ID NO: 90743 - RNA, 23 nt, Human
ggcacuugcguggauguuucuca

SEQ ID NO: 90744 - RNA, 20 nt, Human
ccaguauuuucuaguuuaaa

SEQ ID NO: 90745 - RNA, 26 nt, Human
cagguuugugugugcaggauguuggc

SEQ ID NO: 90746 - RNA, 22 nt, Human
ugaaccccuaggcucaagcaau

SEQ ID NO: 90747 - RNA, 22 nt, Human
gcucugucacccagucuggagu

SEQ ID NO: 90748 - RNA, 25 nt, Human
cacugcacuccagucuggucggcaa

SEQ ID NO: 90749 - RNA, 27 nt, Human
ggacagcuucuguccaaucauguugag

SEQ ID NO: 90750 - RNA, 27 nt, Human
gcgugagccaccgcgcccggcggcgaa

SEQ ID NO: 90751 - RNA, 21 nt, Human
gagcucccuccuuauggcagc

SEQ ID NO: 90752 - RNA, 26 nt, Human
gugacucugugcuugucuguuuaguu

SEQ ID NO: 90753 - RNA, 24 nt, Human
gaagucuguuaauucuacuuuuug

SEQ ID NO: 90754 - RNA, 23 nt, Human
ccucccuuccuuuucccugcuuc

SEQ ID NO: 90755 - RNA, 21 nt, Human
ugaacaaaggcuucacuuguc

SEQ ID NO: 90756 - RNA, 20 nt, Human
aaugucagaaacucgaugaa

SEQ ID NO: 90757 - RNA, 21 nt, Human
cacccaugccaucucaaccuc

SEQ ID NO: 90758 - RNA, 27 nt, Human
uccagaagaccuugagaguaggcgucc

SEQ ID NO: 90759 - RNA, 21 nt, Human
agcuuccuaguagcugggauu

SEQ ID NO: 90760 - RNA, 24 nt, Human
accgaccucugcccaccauggguu

SEQ ID NO: 90761 - RNA, 25 nt, Human
gcccagacccugggcucagccucgc

SEQ ID NO: 90762 - RNA, 27 nt, Human
cagacauaaaucucggcgacucggccc

SEQ ID NO: 90763 - RNA, 24 nt, Human
ucaaccugguguuaggugugcaaa

SEQ ID NO: 90764 - RNA, 23 nt, Human
aagcagacgaugcuguaaaaacu

SEQ ID NO: 90765 - RNA, 22 nt, Human
gugagccgagaucgucccacug

SEQ ID NO: 90766 - RNA, 26 nt, Human
cuaagaaugaaccggauuugguggug

SEQ ID NO: 90767 - RNA, 18 nt, Human
ggggugauuucaccugga

SEQ ID NO: 90768 - RNA, 24 nt, Human
ggaguggcaggaaagagggagcag

SEQ ID NO: 90769 - RNA, 20 nt, Human
uacaucuuuaauccuuuuua

SEQ ID NO: 90770 - RNA, 25 nt, Human
guucugaaauggauagauuguuuua

SEQ ID NO: 90771 - RNA, 25 nt, Human
cccagaugccaucacaucccugaua

SEQ ID NO: 90772 - RNA, 21 nt, Human
ccuccaaugucucauuuugca

SEQ ID NO: 90773 - RNA, 22 nt, Human
ucugccccucucucagccucag

SEQ ID NO: 90774 - RNA, 27 nt, Human
gaccagccuggccaacaugguaaaacc

SEQ ID NO: 90775 - RNA, 27 nt, Human
gaccagccuggcuaacauggcaaaacc

SEQ ID NO: 90776 - RNA, 27 nt, Human
guggaaucuaucagcauuguugaaaug

SEQ ID NO: 90777 - RNA, 23 nt, Human
acacucacuucucuuccuuggga

SEQ ID NO: 90778 - RNA, 19 nt, Human
ggggcaggccaggccaggu

SEQ ID NO: 90779 - RNA, 20 nt, Human
gcuucaguccugccccugca

SEQ ID NO: 90780 - RNA, 25 nt, Human
gacuccauuagugagcugugguaug

SEQ ID NO: 90781 - RNA, 28 nt, Human
ugcagccagggucugggcagggugcagc

SEQ ID NO: 90782 - RNA, 24 nt, Human
accacugaauucauguaauagaua

SEQ ID NO: 90783 - RNA, 22 nt, Human
uaggcuaccaagacacagcugc

SEQ ID NO: 90784 - RNA, 27 nt, Human
acugcccuucucuugcugccuccuggg

SEQ ID NO: 90785 - RNA, 19 nt, Human
ucccaagcuggagugcagu

SEQ ID NO: 90786 - RNA, 24 nt, Human
ugccccugccuuggccaaugcgag

SEQ ID NO: 90787 - RNA, 24 nt, Human
ccccacuggccaggacucugagau

SEQ ID NO: 90788 - RNA, 23 nt, Human
agaguuuauguagaaagcauuga

SEQ ID NO: 90789 - RNA, 24 nt, Human
ugaucagcuuucaaagcauuuaca

SEQ ID NO: 90790 - RNA, 27 nt, Human
uguuguccaguccaacuccacagucac

SEQ ID NO: 90791 - RNA, 22 nt, Human
ccuccccacucuguccugggug

SEQ ID NO: 90792 - RNA, 25 nt, Human
ccugccuguccuucuacucagcugu

SEQ ID NO: 90793 - RNA, 21 nt, Human
cuagaccuccccaucugugga

SEQ ID NO: 90794 - RNA, 22 nt, Human
cccaggcccgcgaacuuggcca

SEQ ID NO: 90795 - RNA, 21 nt, Human
acccccaccucuggacuugcc

SEQ ID NO: 90796 - RNA, 24 nt, Human
ccugcuuggcuuuggaugccuuca

SEQ ID NO: 90797 - RNA, 25 nt, Human
ccucaaggaguacaaccuggucugg

SEQ ID NO: 90798 - RNA, 27 nt, Human
gcucuugaccuguccccucuggcugcc

SEQ ID NO: 90799 - RNA, 19 nt, Human
uucgcaucuucucuaucca

SEQ ID NO: 90800 - RNA, 26 nt, Human
ucuggcagugagacugaggaugagga

SEQ ID NO: 90801 - RNA, 22 nt, Human
caccucgugauccgcccgccuc

SEQ ID NO: 90802 - RNA, 27 nt, Human
uggagggagccacagagagggguccag

SEQ ID NO: 90803 - RNA, 20 nt, Human
uuaagcuuugauaguggcac

SEQ ID NO: 90804 - RNA, 24 nt, Human
uucauagauacuucauuuguauuu

SEQ ID NO: 90805 - RNA, 20 nt, Human
caugagccacugugccuguc

SEQ ID NO: 90806 - RNA, 23 nt, Human
acuccccuucauugaauagugau

SEQ ID NO: 90807 - RNA, 22 nt, Human
gcaaucaugguucacugcaguc

SEQ ID NO: 90808 - RNA, 26 nt, Human
ucuccuccuuuucacaguucucuccu

SEQ ID NO: 90809 - RNA, 19 nt, Human
ccucuagccccuaccccca

SEQ ID NO: 90810 - RNA, 18 nt, Human
gggaccaccuguccaucc

SEQ ID NO: 90811 - RNA, 19 nt, Human
ucagaaacacuccuucaau

SEQ ID NO: 90812 - RNA, 20 nt, Human
gcagcugaugucugcacuga

SEQ ID NO: 90813 - RNA, 20 nt, Human
cuauuuuguaaaucauucca

SEQ ID NO: 90814 - RNA, 22 nt, Human
ccacucccggcccaggcugcuu

SEQ ID NO: 90815 - RNA, 23 nt, Human
uuuguuuauaaauguguacaguu

SEQ ID NO: 90816 - RNA, 21 nt, Human
aggcaggaauguguggcagau

SEQ ID NO: 90817 - RNA, 25 nt, Human
uucauagcuguuuauaucucuuuua

SEQ ID NO: 90818 - RNA, 22 nt, Human
gcaugagccaccaugccuggcc

SEQ ID NO: 90819 - RNA, 22 nt, Human
guguaagccaccgugcccagcc

SEQ ID NO: 90820 - RNA, 22 nt, Human
uccuuucucuguauauugggcu

SEQ ID NO: 90821 - RNA, 27 nt, Human
auggaaagacauagggaagaaugggcu

SEQ ID NO: 90822 - RNA, 19 nt, Human
uccauccugacugcagcau

SEQ ID NO: 90823 - RNA, 21 nt, Human
gccuguaaucguagcgcuuug

SEQ ID NO: 90824 - RNA, 23 nt, Human
gagccuccguacugggugcaaug

SEQ ID NO: 90825 - RNA, 27 nt, Human
guguugaaaauguucagaagguugcuc

SEQ ID NO: 90826 - RNA, 23 nt, Human
cacaucuccgcgagacagaggga

SEQ ID NO: 90827 - RNA, 24 nt, Human
ccgaguagcugggacucuacuaaa

SEQ ID NO: 90828 - RNA, 24 nt, Human
gaagacugucagcuuccaaacauu

SEQ ID NO: 90829 - RNA, 27 nt, Human
uguggguggggaaggaaggcgugucca

SEQ ID NO: 90830 - RNA, 24 nt, Human
gucaucugaggucaggaguucaag

SEQ ID NO: 90831 - RNA, 26 nt, Human
ggagagaaugaagagcgcugugccag

SEQ ID NO: 90832 - RNA, 27 nt, Human
agaggagaaggccgcggcggaggcagg

SEQ ID NO: 90833 - RNA, 27 nt, Human
gcuggggacagugucuucguuugauua

SEQ ID NO: 90834 - RNA, 22 nt, Human
ugggagccggaggcugcaguga

SEQ ID NO: 90835 - RNA, 24 nt, Human
ggauaaucuauucucuagcuuagg

SEQ ID NO: 90836 - RNA, 19 nt, Human
cuggcugcugccaugucuc

SEQ ID NO: 90837 - RNA, 22 nt, Human
gagagcuguaacugaggacugu

SEQ ID NO: 90838 - RNA, 22 nt, Human
cuuccaggcuggauuuuuaaug

SEQ ID NO: 90839 - RNA, 21 nt, Human
cagugaagggaaaagagucug

SEQ ID NO: 90840 - RNA, 22 nt, Human
gcaugagccacugagccuggcc

SEQ ID NO: 90841 - RNA, 27 nt, Human
aaauuauguguaguuauaaaccaauga

SEQ ID NO: 90842 - RNA, 17 nt, Human
uuuccaggugggcaugg

SEQ ID NO: 90843 - RNA, 22 nt, Human
ucuugcauuuuaguaagaaagc

SEQ ID NO: 90844 - RNA, 22 nt, Human
ugucuguaauccuagcacugug

SEQ ID NO: 90845 - RNA, 23 nt, Human
ccaaaagauggaagacaaaaaga

SEQ ID NO: 90846 - RNA, 23 nt, Human
ggcuaauuuuuuguguuuuuaca

SEQ ID NO: 90847 - RNA, 26 nt, Human
uguggugagcuagcggauucccugcu

SEQ ID NO: 90848 - RNA, 22 nt, Human
cuuaccucauucuuacuaucca

SEQ ID NO: 90849 - RNA, 23 nt, Human
aacuuuuuauugccuucucacca

SEQ ID NO: 90850 - RNA, 21 nt, Human
uuuuccuuugcuuucucuuua

SEQ ID NO: 90851 - RNA, 21 nt, Human
guagugcucccaauccuaugg

SEQ ID NO: 90852 - RNA, 22 nt, Human
ugagacuacaggcaccugccac

SEQ ID NO: 90853 - RNA, 24 nt, Human
cacugggacucguguggccugugu

SEQ ID NO: 90854 - RNA, 23 nt, Human
ccauacuggacagcacagacaca

SEQ ID NO: 90855 - RNA, 22 nt, Human
aucucccauccuguggaacccg

SEQ ID NO: 90856 - RNA, 23 nt, Human
ccaugaucagucaucauucuucu

SEQ ID NO: 90857 - RNA, 26 nt, Human
cgcaacccauccagugccagcuuuga

SEQ ID NO: 90858 - RNA, 25 nt, Human
aacaaaaucggcaaggucucaggga

SEQ ID NO: 90859 - RNA, 29 nt, Human
aucucgaucucuugaccucaugucugccu

SEQ ID NO: 90860 - RNA, 27 nt, Human
aggcgccauggacuggaagacacucca

SEQ ID NO: 90861 - RNA, 23 nt, Human
cucucugcccugccucccucugc

SEQ ID NO: 90862 - RNA, 21 nt, Human
ccugcuucauaggugccaccu

SEQ ID NO: 90863 - RNA, 18 nt, Human
agguaguaagcaccagcu

SEQ ID NO: 90864 - RNA, 23 nt, Human
agggcuguggcccugccucacac

SEQ ID NO: 90865 - RNA, 21 nt, Human
gguuuugccaacgcaugccca

SEQ ID NO: 90866 - RNA, 21 nt, Human
cugugcuguuccuucuugccu

SEQ ID NO: 90867 - RNA, 23 nt, Human
ucccucccagccccaaaccuuuu

SEQ ID NO: 90868 - RNA, 22 nt, Human
ccuucauuucauguauaguuuu

SEQ ID NO: 90869 - RNA, 22 nt, Human
gaucacucacuuucccccuaca

SEQ ID NO: 90870 - RNA, 23 nt, Human
uccaugcccugggucacuuccuu

SEQ ID NO: 90871 - RNA, 23 nt, Human
caaguagcugagauuacaggcgc

SEQ ID NO: 90872 - RNA, 21 nt, Human
acugccaggaagccccagcug

SEQ ID NO: 90873 - RNA, 28 nt, Human
uggcgccccagcccagugccccccgaag

SEQ ID NO: 90874 - RNA, 22 nt, Human
cugcaaccucugucucccgggu

SEQ ID NO: 90875 - RNA, 30 nt, Human
ggcugacaggcccaaguugcagucagcaga

SEQ ID NO: 90876 - RNA, 26 nt, Human
gcucuaugaagaaaauccauuuccau

SEQ ID NO: 90877 - RNA, 21 nt, Human
ggcucucuuuccuucuugccu

SEQ ID NO: 90878 - RNA, 27 nt, Human
cuccuguugugcaggcuguagugcagu

SEQ ID NO: 90879 - RNA, 25 nt, Human
cuucggcgauggcuuuuccgccgcg

SEQ ID NO: 90880 - RNA, 20 nt, Human
gcuucggagccgcucucugc

SEQ ID NO: 90881 - RNA, 22 nt, Human
gcugccaccuccgcagcccggg

SEQ ID NO: 90882 - RNA, 21 nt, Human
gcgaccagcggggauccuccc

SEQ ID NO: 90883 - RNA, 22 nt, Human
aggcccugugcucauagcuuua

SEQ ID NO: 90884 - RNA, 22 nt, Human
auugcccugguuauauucucac

SEQ ID NO: 90885 - RNA, 22 nt, Human
caugccuguaaucccgacacuu

SEQ ID NO: 90886 - RNA, 23 nt, Human
cagaaccuugucccagccaguga

SEQ ID NO: 90887 - RNA, 25 nt, Human
gcaaggguaaucuuuacaagcauag

SEQ ID NO: 90888 - RNA, 22 nt, Human
cacccaggcuggaguacacugg

SEQ ID NO: 90889 - RNA, 25 nt, Human
gcuggcgugggggucucagaaugga

SEQ ID NO: 90890 - RNA, 27 nt, Human
ucaucaucucuuuuacaccaaaagguc

SEQ ID NO: 90891 - RNA, 23 nt, Human
uuccugccucagcucuguacaca

SEQ ID NO: 90892 - RNA, 27 nt, Human
agguauuuacagugguuggaagauagc

SEQ ID NO: 90893 - RNA, 26 nt, Human
gaugccacuacuucuguagcaggggc

SEQ ID NO: 90894 - RNA, 20 nt, Human
gcagacaagacccagagaag

SEQ ID NO: 90895 - RNA, 21 nt, Human
aagaaaaauauagaauagaaa

SEQ ID NO: 90896 - RNA, 22 nt, Human
ggagagggcuggguggggcaga

SEQ ID NO: 90897 - RNA, 24 nt, Human
ugucauccaggcuggagugcggug

SEQ ID NO: 90898 - RNA, 21 nt, Human
ccgcccugacccuccugcugc

SEQ ID NO: 90899 - RNA, 22 nt, Human
uuuuguuuuguuuucuuguacu

SEQ ID NO: 90900 - RNA, 22 nt, Human
uugccuaaauuuaaugcugccu

SEQ ID NO: 90901 - RNA, 23 nt, Human
auccugcacagcaggguucaguu

SEQ ID NO: 90902 - RNA, 20 nt, Human
aggcuggacagauggcggaa

SEQ ID NO: 90903 - RNA, 17 nt, Human
gcuuaaaaaaugccugg

SEQ ID NO: 90904 - RNA, 19 nt, Human
cugaaaacuguuuuggaga

SEQ ID NO: 90905 - RNA, 24 nt, Human
ucuuaugaaucauacauacacuca

SEQ ID NO: 90906 - RNA, 27 nt, Human
cucccacaugugucaccuccccaucau

SEQ ID NO: 90907 - RNA, 22 nt, Human
gaggucccucauguuguugccc

SEQ ID NO: 90908 - RNA, 23 nt, Human
gagaauuaccccuaccaauuggg

SEQ ID NO: 90909 - RNA, 20 nt, Human
guuggggcccaaggauguga

SEQ ID NO: 90910 - RNA, 22 nt, Human
aacccugugggcuuaugucucu

SEQ ID NO: 90911 - RNA, 19 nt, Human
gcugggcuggggaggaccu

SEQ ID NO: 90912 - RNA, 22 nt, Human
cucaagcgauccuccugccuca

SEQ ID NO: 90913 - RNA, 19 nt, Human
ugcuuuguuaaugcuuuuc

SEQ ID NO: 90914 - RNA, 27 nt, Human
ggaggcugagccggguggaucgccuga

SEQ ID NO: 90915 - RNA, 25 nt, Human
aacaacaacagaacaacaacaaagc

SEQ ID NO: 90916 - RNA, 23 nt, Human
agagguccacagccuuguccaga

SEQ ID NO: 90917 - RNA, 27 nt, Human
cacaugcaaacuccagucccugccuuc

SEQ ID NO: 90918 - RNA, 22 nt, Human
gggaaguuuaucaugacugccu

SEQ ID NO: 90919 - RNA, 26 nt, Human
gcagccuggaacagacccaggcggag

SEQ ID NO: 90920 - RNA, 24 nt, Human
ucaccgaggcucugagucucaggu

SEQ ID NO: 90921 - RNA, 21 nt, Human
gcgauucccgugccucagccu

SEQ ID NO: 90922 - RNA, 26 nt, Human
ucucccacuaccugaugggcacaugg

SEQ ID NO: 90923 - RNA, 21 nt, Human
guggacucuuuaaaaucuggu

SEQ ID NO: 90924 - RNA, 22 nt, Human
cuuggggccaacccuggcuccu

SEQ ID NO: 90925 - RNA, 18 nt, Human
uugaagcagaugugguga

SEQ ID NO: 90926 - RNA, 19 nt, Human
ugguucccugaaggaggag

SEQ ID NO: 90927 - RNA, 22 nt, Human
cccaaguagcuggaacuacagg

SEQ ID NO: 90928 - RNA, 22 nt, Human
cccaaauagcugggacuacagg

SEQ ID NO: 90929 - RNA, 22 nt, Human
uccaaauagcugggaccacagg

SEQ ID NO: 90930 - RNA, 27 nt, Human
cugcaccccucccuucuccaucucgcu

SEQ ID NO: 90931 - RNA, 24 nt, Human
gguuucugaaugucugugaauuuc

SEQ ID NO: 90932 - RNA, 26 nt, Human
gugagcucucacaggcucagacuaaa

SEQ ID NO: 90933 - RNA, 22 nt, Human
gccccugccacaccccagccuc

SEQ ID NO: 90934 - RNA, 24 nt, Human
gguccagcuacucgggaggcugag

SEQ ID NO: 90935 - RNA, 22 nt, Human
gagcaagacucugucucaaaaa

SEQ ID NO: 90936 - RNA, 22 nt, Human
gagugagacuccgucucaaaga

SEQ ID NO: 90937 - RNA, 27 nt, Human
ucauggcuucaucucuaucuuuacuuu

SEQ ID NO: 90938 - RNA, 24 nt, Human
guagaggccuguccugggcuccag

SEQ ID NO: 90939 - RNA, 27 nt, Human
ggagagggguaggauguacagggguag

SEQ ID NO: 90940 - RNA, 21 nt, Human
gcucuucaccugcauccuggc

SEQ ID NO: 90941 - RNA, 21 nt, Human
uggcuggaccaauucucucca

SEQ ID NO: 90942 - RNA, 27 nt, Human
agggcacacacaccuccauucagccca

SEQ ID NO: 90943 - RNA, 22 nt, Human
aguggcaugaucuuggcucacu

SEQ ID NO: 90944 - RNA, 22 nt, Human
aguggugugaucucagcucacu

SEQ ID NO: 90945 - RNA, 21 nt, Human
ggcugccuugcuguucuugaa

SEQ ID NO: 90946 - RNA, 25 nt, Human
aacaaacuucagccugggaagugag

SEQ ID NO: 90947 - RNA, 22 nt, Human
ucugcuuucuuuguaacaugac

SEQ ID NO: 90948 - RNA, 24 nt, Human
cauguugucuguucgaccgugacu

SEQ ID NO: 90949 - RNA, 26 nt, Human
cccggcgcucuccccguguccucucc

SEQ ID NO: 90950 - RNA, 21 nt, Human
cacugaagaaaaagaugaaaa

SEQ ID NO: 90951 - RNA, 27 nt, Human
cuacuguacuccagccagggcaagaga

SEQ ID NO: 90952 - RNA, 22 nt, Human
ccuucauuuugaaagaaguuuu

SEQ ID NO: 90953 - RNA, 20 nt, Human
gccagggccugugcugcagu

SEQ ID NO: 90954 - RNA, 26 nt, Human
ccucuuucucguuuguggacaaagca

SEQ ID NO: 90955 - RNA, 21 nt, Human
uucuuauuaauuucagucuug

SEQ ID NO: 90956 - RNA, 24 nt, Human
gucuggcccuaugcuuccggccuc

SEQ ID NO: 90957 - RNA, 27 nt, Human
ucacggacacauuucugccuagaaaac

SEQ ID NO: 90958 - RNA, 23 nt, Human
uuccuuaaggauuuuagccagua

SEQ ID NO: 90959 - RNA, 20 nt, Human
uuucaguggguauaauuuaa

SEQ ID NO: 90960 - RNA, 18 nt, Human
uguuacuuguuacugcag

SEQ ID NO: 90961 - RNA, 24 nt, Human
ucuccugguacccaaagaaauacu

SEQ ID NO: 90962 - RNA, 21 nt, Human
guggcgcuccacagucauccg

SEQ ID NO: 90963 - RNA, 22 nt, Human
acugcagccuugaacuccuggg

SEQ ID NO: 90964 - RNA, 22 nt, Human
cugggaaauuuaaguuugcaga

SEQ ID NO: 90965 - RNA, 21 nt, Human
gcugcauugccaaagugucuu

SEQ ID NO: 90966 - RNA, 26 nt, Human
gggggaggaagagaggccaaguucag

SEQ ID NO: 90967 - RNA, 27 nt, Human
cugcuuccguacuauggcuccaacaga

SEQ ID NO: 90968 - RNA, 25 nt, Human
gagggcugaggucagggaggucuga

SEQ ID NO: 90969 - RNA, 27 nt, Human
ccccucggggcacggcguaucuuggca

SEQ ID NO: 90970 - RNA, 27 nt, Human
ugggaggcuggaguuggggcagaggag

SEQ ID NO: 90971 - RNA, 22 nt, Human
ucaugaagcagauuugcacugg

SEQ ID NO: 90972 - RNA, 21 nt, Human
aaaccaucugccuugccccca

SEQ ID NO: 90973 - RNA, 31 nt, Human
uugccucaggcuggcccuggucccagguggc

SEQ ID NO: 90974 - RNA, 22 nt, Human
ucauuaaaaguuuuauguacuu

SEQ ID NO: 90975 - RNA, 25 nt, Human
ccaccucccugcugggaaaccacag

SEQ ID NO: 90976 - RNA, 19 nt, Human
gaccagccgggccagggcg

SEQ ID NO: 90977 - RNA, 30 nt, Human
gggaaagaucagagaggcagagguggcaca

SEQ ID NO: 90978 - RNA, 19 nt, Human
gagacucuuaaaagcauca

SEQ ID NO: 90979 - RNA, 23 nt, Human
ugucaccaggcuggagugcagug

SEQ ID NO: 90980 - RNA, 26 nt, Human
cugcagcugacccccucacacugagu

SEQ ID NO: 90981 - RNA, 22 nt, Human
ggccgggcgggagugcagggga

SEQ ID NO: 90982 - RNA, 25 nt, Human
aagugcacuguuuaaagcauuugca

SEQ ID NO: 90983 - RNA, 23 nt, Human
agggaaaacugcaaagcucggug

SEQ ID NO: 90984 - RNA, 21 nt, Human
ugacguccuacagaauuucuc

SEQ ID NO: 90985 - RNA, 27 nt, Human
gccaggauucaaacccagguguggcuc

SEQ ID NO: 90986 - RNA, 23 nt, Human
ccucaggugaucuaccugccuca

SEQ ID NO: 90987 - RNA, 23 nt, Human
ccucaagugaucugccugccuca

SEQ ID NO: 90988 - RNA, 19 nt, Human
ugacuucuuuauuucagag

SEQ ID NO: 90989 - RNA, 22 nt, Human
ccacuccacuccagucugggcg

SEQ ID NO: 90990 - RNA, 23 nt, Human
ggagccccgcugccugcccaccc

SEQ ID NO: 90991 - RNA, 27 nt, Human
ccacugcacuccagccuggugacagcg

SEQ ID NO: 90992 - RNA, 22 nt, Human
ccuguacaaccuacaugucuuu

SEQ ID NO: 90993 - RNA, 21 nt, Human
ugagacaccgccuucugccca

SEQ ID NO: 90994 - RNA, 22 nt, Human
cugcuguggacccugucuucug

SEQ ID NO: 90995 - RNA, 24 nt, Human
ugccuaagccucucccuccagcca

SEQ ID NO: 90996 - RNA, 22 nt, Human
ugccagacagcugcccuggcgu

SEQ ID NO: 90997 - RNA, 21 nt, Human
ggggccugugggcugugggaa

SEQ ID NO: 90998 - RNA, 23 nt, Human
ccccacuggcggccuugcuggau

SEQ ID NO: 90999 - RNA, 22 nt, Human
agguugaggcaggagaauugcu

SEQ ID NO: 91000 - RNA, 20 nt, Human
aaaugauuuuuguguucuuu

SEQ ID NO: 91001 - RNA, 22 nt, Human
cacucagcugcuucuuugguca

SEQ ID NO: 91002 - RNA, 24 nt, Human
gaccaaagucccuuccugcuuccu

SEQ ID NO: 91003 - RNA, 21 nt, Human
cugucugauucuaugccugua

SEQ ID NO: 91004 - RNA, 22 nt, Human
uuuaaaaucgacagcauuucua

SEQ ID NO: 91005 - RNA, 26 nt, Human
gcuccucugugccuaggccuuacgca

SEQ ID NO: 91006 - RNA, 22 nt, Human
cgggccagacgcgcugcagccu

SEQ ID NO: 91007 - RNA, 24 nt, Human
ucaugacagagcgcacuauuucug

SEQ ID NO: 91008 - RNA, 25 nt, Human
gaggaagaaauaugaagccuuagcg

SEQ ID NO: 91009 - RNA, 26 nt, Human
ucucacugagccacccaucauuguga

SEQ ID NO: 91010 - RNA, 27 nt, Human
cauucucaagacaguuugucauggcuc

SEQ ID NO: 91011 - RNA, 22 nt, Human
acacuccuaaauuuagagucaa

SEQ ID NO: 91012 - RNA, 32 nt, Human
ccuccagcaggccuagucucaggcucuaaagu

SEQ ID NO: 91013 - RNA, 27 nt, Human
gagcuagggcuggagggacagggagca

SEQ ID NO: 91014 - RNA, 17 nt, Human
cagaugggggaaagcac

SEQ ID NO: 91015 - RNA, 25 nt, Human
gccaagcuaugcccaggaauguguc

SEQ ID NO: 91016 - RNA, 21 nt, Human
agucucaaacuccuggccuca

SEQ ID NO: 91017 - RNA, 23 nt, Human
gcagcaacgagcaacaaucggaa

SEQ ID NO: 91018 - RNA, 21 nt, Human
uucauagaaaaggaacauaga

SEQ ID NO: 91019 - RNA, 27 nt, Human
cucugccuuccuucuaguauuuucuuu

SEQ ID NO: 91020 - RNA, 21 nt, Human
guaacccucacccacagccug

SEQ ID NO: 91021 - RNA, 27 nt, Human
accagcugaaggaacgcugccuggcga

SEQ ID NO: 91022 - RNA, 23 nt, Human
ccccaacagcgauacugcuguuu

SEQ ID NO: 91023 - RNA, 23 nt, Human
ggugaagccucugggcuuccuga

SEQ ID NO: 91024 - RNA, 20 nt, Human
cccuccaggaugcucgcugg

SEQ ID NO: 91025 - RNA, 20 nt, Human
cagcucuguaguuucuugag

SEQ ID NO: 91026 - RNA, 27 nt, Human
auucacugcaaggagaccucuacuguc

SEQ ID NO: 91027 - RNA, 21 nt, Human
cuuauuucucauaucaacuua

SEQ ID NO: 91028 - RNA, 25 nt, Human
auuguuuuugugggaaugacacuuu

SEQ ID NO: 91029 - RNA, 28 nt, Human
cggcacacaucuguaauccuagcuacuu

SEQ ID NO: 91030 - RNA, 20 nt, Human
gagaccccaggaagucagga

SEQ ID NO: 91031 - RNA, 22 nt, Human
cucuuguccuguuugcauuuca

SEQ ID NO: 91032 - RNA, 19 nt, Human
caggcugcuuccucucucu

SEQ ID NO: 91033 - RNA, 19 nt, Human
accagugagcucagguguc

SEQ ID NO: 91034 - RNA, 25 nt, Human
uggaaggaagacuggguugcaggga

SEQ ID NO: 91035 - RNA, 27 nt, Human
gcaucacagccgcagcucuguucagcg

SEQ ID NO: 91036 - RNA, 23 nt, Human
uuccuuuauagagugucucaggg

SEQ ID NO: 91037 - RNA, 27 nt, Human
uggcgcgaucucagcucacugcagccu

SEQ ID NO: 91038 - RNA, 20 nt, Human
caccugcugggaggaggugg

SEQ ID NO: 91039 - RNA, 28 nt, Human
agaggaucuaguucaagaggcaagaaga

SEQ ID NO: 91040 - RNA, 27 nt, Human
ccugugggaaguggccccagccaucuc

SEQ ID NO: 91041 - RNA, 24 nt, Human
cauuccccucuuuugucuuccuca

SEQ ID NO: 91042 - RNA, 18 nt, Human
agagaaaggcaagggagg

SEQ ID NO: 91043 - RNA, 21 nt, Human
acaucccucugagaagcacaa

SEQ ID NO: 91044 - RNA, 24 nt, Human
ugcccuuugguacagaaggugagu

SEQ ID NO: 91045 - RNA, 31 nt, Human
gggcaucgaucuuccucacaccacaaaucug

SEQ ID NO: 91046 - RNA, 21 nt, Human
accagugagucauccguccag

SEQ ID NO: 91047 - RNA, 26 nt, Human
cugggacgugugggcccuggggagag

SEQ ID NO: 91048 - RNA, 21 nt, Human
ggcugugcuggggcuugggga

SEQ ID NO: 91049 - RNA, 22 nt, Human
gccuguaaucccagcccuuugg

SEQ ID NO: 91050 - RNA, 22 nt, Human
gccuguacucccagcacuuugg

SEQ ID NO: 91051 - RNA, 21 nt, Human
aaaucuuccucauuuggauuu

SEQ ID NO: 91052 - RNA, 22 nt, Human
gggagauggcgcuugcagugag

SEQ ID NO: 91053 - RNA, 22 nt, Human
auaaauuucccaaguauuugaa

SEQ ID NO: 91054 - RNA, 27 nt, Human
gcuauuuuucucuuugucuaggaaagg

SEQ ID NO: 91055 - RNA, 26 nt, Human
uggaagucucucccugccuacuuccu

SEQ ID NO: 91056 - RNA, 24 nt, Human
ggcuaauuuucuuguaguuuuagu

SEQ ID NO: 91057 - RNA, 20 nt, Human
gcagcuggccaacaugugua

SEQ ID NO: 91058 - RNA, 24 nt, Human
gugaaucaggcaccggagugcagg

SEQ ID NO: 91059 - RNA, 22 nt, Human
aaaaugcugggauuauaggcau

SEQ ID NO: 91060 - RNA, 22 nt, Human
cgaggagacuuggucacuguga

SEQ ID NO: 91061 - RNA, 22 nt, Human
aucugaaaacagaagacagucu

SEQ ID NO: 91062 - RNA, 23 nt, Human
cccaggagguuguggcugcagug

SEQ ID NO: 91063 - RNA, 26 nt, Human
cagcucucagcaccugcuuccugcuc

SEQ ID NO: 91064 - RNA, 22 nt, Human
ucacccaggcuggaguacacug

SEQ ID NO: 91065 - RNA, 20 nt, Human
uauuugaguacugugaagga

SEQ ID NO: 91066 - RNA, 19 nt, Human
aaagaacaguguugaaauu

SEQ ID NO: 91067 - RNA, 25 nt, Human
cuucagaauucuaagaugaauuuac

SEQ ID NO: 91068 - RNA, 18 nt, Human
cccugucacucaggcugg

SEQ ID NO: 91069 - RNA, 22 nt, Human
caauuguggcccauagccauau

SEQ ID NO: 91070 - RNA, 23 nt, Human
aggaaaggagguggcuaguggua

SEQ ID NO: 91071 - RNA, 28 nt, Human
ggcacagccuggcaguguggccaggggu

SEQ ID NO: 91072 - RNA, 26 nt, Human
cuucccaagcccuggugaccagacca

SEQ ID NO: 91073 - RNA, 22 nt, Human
acagccugucucuuguagcuuc

SEQ ID NO: 91074 - RNA, 24 nt, Human
gccaagacucacgcaugugugaca

SEQ ID NO: 91075 - RNA, 21 nt, Human
ccacccuucugaucuuagggg

SEQ ID NO: 91076 - RNA, 22 nt, Human
ucaacauggcgaaaucccgucu

SEQ ID NO: 91077 - RNA, 22 nt, Human
gcacuguacuuggaucuucccg

SEQ ID NO: 91078 - RNA, 20 nt, Human
caguguugaaacuacaagag

SEQ ID NO: 91079 - RNA, 25 nt, Human
ccugccucuggcccugguccugggc

SEQ ID NO: 91080 - RNA, 26 nt, Human
ggcucagagaggaaagacgugucccu

SEQ ID NO: 91081 - RNA, 19 nt, Human
gccuguggcccagcacugg

SEQ ID NO: 91082 - RNA, 22 nt, Human
gugauucuucucccuggcaagg

SEQ ID NO: 91083 - RNA, 22 nt, Human
uuauuugagcaaguaacauuaa

SEQ ID NO: 91084 - RNA, 22 nt, Human
gaggggcaggugggggaaugga

SEQ ID NO: 91085 - RNA, 23 nt, Human
uuucuagcaccuuaucuaugaug

SEQ ID NO: 91086 - RNA, 19 nt, Human
gaaagugccauuccugucc

SEQ ID NO: 91087 - RNA, 25 nt, Human
ccucuguuacaaccucagcacuuug

SEQ ID NO: 91088 - RNA, 23 nt, Human
aggccucugcuccugcuccugcc

SEQ ID NO: 91089 - RNA, 15 nt, Human
augaagcugcaguga

SEQ ID NO: 91090 - RNA, 24 nt, Human
cccggcaggaacaccagacaugaa

SEQ ID NO: 91091 - RNA, 23 nt, Human
ugcacacaucucgaaauccauuu

SEQ ID NO: 91092 - RNA, 25 nt, Human
ugugaggcggguggcugguauaaau

SEQ ID NO: 91093 - RNA, 26 nt, Human
cuucauuuucuuagcguuucuggaga

SEQ ID NO: 91094 - RNA, 21 nt, Human
cugggacacaaaacuccgccc

SEQ ID NO: 91095 - RNA, 24 nt, Human
cacacccaggcuugacaaagcugu

SEQ ID NO: 91096 - RNA, 22 nt, Human
cccagcugcuugggaggcugag

SEQ ID NO: 91097 - RNA, 20 nt, Human
uaauuaguuggcauauuguu

SEQ ID NO: 91098 - RNA, 22 nt, Human
cacucuuaaaugaucugccucu

SEQ ID NO: 91099 - RNA, 20 nt, Human
acccccacugggcccaggcc

SEQ ID NO: 91100 - RNA, 21 nt, Human
guucgaguccagccugggcag

SEQ ID NO: 91101 - RNA, 27 nt, Human
gccaggccugggcugggcacacuccac

SEQ ID NO: 91102 - RNA, 20 nt, Human
agacccacaggcagaguuga

SEQ ID NO: 91103 - RNA, 27 nt, Human
gccuccaacucuugggcucaagcauca

SEQ ID NO: 91104 - RNA, 18 nt, Human
ugguucaccuguagacag

SEQ ID NO: 91105 - RNA, 19 nt, Human
gcauccuguucuccaccga

SEQ ID NO: 91106 - RNA, 28 nt, Human
cccugccuuaguagagggugggacuaua

SEQ ID NO: 91107 - RNA, 26 nt, Human
auauauacaucauacuuaacuuuacu

SEQ ID NO: 91108 - RNA, 21 nt, Human
gagaauggguagauggaacgg

SEQ ID NO: 91109 - RNA, 27 nt, Human
cagacgccuggcugcugaucgccuucc

SEQ ID NO: 91110 - RNA, 21 nt, Human
gcagaaaaggauccuaggaaa

SEQ ID NO: 91111 - RNA, 27 nt, Human
gaucagcuuccuccuucugucacuugu

SEQ ID NO: 91112 - RNA, 25 nt, Human
auucuuucuuuuugugccaaaugac

SEQ ID NO: 91113 - RNA, 21 nt, Human
uacagcuguguggugcuucug

SEQ ID NO: 91114 - RNA, 20 nt, Human
ggagagggggcaagggcaac

SEQ ID NO: 91115 - RNA, 25 nt, Human
uauacuccagggaaauucaccacac

SEQ ID NO: 91116 - RNA, 25 nt, Human
ggggugagggcucuugguggguuag

SEQ ID NO: 91117 - RNA, 27 nt, Human
gacugugauuacaugcaccugccuuag

SEQ ID NO: 91118 - RNA, 27 nt, Human
ucuagggucuuacucuuuguaugauga

SEQ ID NO: 91119 - RNA, 21 nt, Human
gggagguugaggagggaggau

SEQ ID NO: 91120 - RNA, 29 nt, Human
ucuuccauuucuuuuucuuuguucccagc

SEQ ID NO: 91121 - RNA, 27 nt, Human
gcacucugaugucagaguaguagguua

SEQ ID NO: 91122 - RNA, 25 nt, Human
cccaguauuugcugcuauuuuuaaa

SEQ ID NO: 91123 - RNA, 21 nt, Human
cuggccuaggcuggcuccagu

SEQ ID NO: 91124 - RNA, 24 nt, Human
cgcccccagaggcucagcacuuug

SEQ ID NO: 91125 - RNA, 22 nt, Human
uuuccugacaguucuuucagcu

SEQ ID NO: 91126 - RNA, 20 nt, Human
cucagccucaggcgaguggc

SEQ ID NO: 91127 - RNA, 20 nt, Human
ucucacucuagcuuggggag

SEQ ID NO: 91128 - RNA, 27 nt, Human
agcucuauucaggccaggucuugcugu

SEQ ID NO: 91129 - RNA, 20 nt, Human
gcuuccuccucccuccugcc

SEQ ID NO: 91130 - RNA, 22 nt, Human
uucuucaccuaagucucuguga

SEQ ID NO: 91131 - RNA, 24 nt, Human
ggcucagagccagcccagagggaa

SEQ ID NO: 91132 - RNA, 21 nt, Human
cugagcaccuguuguauguca

SEQ ID NO: 91133 - RNA, 25 nt, Human
gaggggaagggcuggguccgucuga

SEQ ID NO: 91134 - RNA, 21 nt, Human
aguggcugauauggguguggg

SEQ ID NO: 91135 - RNA, 21 nt, Human
uaaagucaucauacacaaaaa

SEQ ID NO: 91136 - RNA, 22 nt, Human
accagguauucuuagagcuaua

SEQ ID NO: 91137 - RNA, 24 nt, Human
cauggccaccaccacgguggucac

SEQ ID NO: 91138 - RNA, 24 nt, Human
gaaggcccugcucccuauccugcc

SEQ ID NO: 91139 - RNA, 18 nt, Human
gucacaccaccuuagccu

SEQ ID NO: 91140 - RNA, 27 nt, Human
aguaaaucucuggguuucuguuacgaa

SEQ ID NO: 91141 - RNA, 21 nt, Human
uucagccugggugacagagug

SEQ ID NO: 91142 - RNA, 18 nt, Human
agccccacacccaccuca

SEQ ID NO: 91143 - RNA, 19 nt, Human
ccugcacacagccugggga

SEQ ID NO: 91144 - RNA, 26 nt, Human
ugcuucccaauuacucauuuccucag

SEQ ID NO: 91145 - RNA, 22 nt, Human
aggaauuuucuugaaacuguga

SEQ ID NO: 91146 - RNA, 23 nt, Human
uaggaauauagacaaaugacugu

SEQ ID NO: 91147 - RNA, 29 nt, Human
ugaaaacagauauugucagaguucugcuc

SEQ ID NO: 91148 - RNA, 20 nt, Human
aucagugaccuuuucuucac

SEQ ID NO: 91149 - RNA, 20 nt, Human
guugcccaggcuggucucaa

SEQ ID NO: 91150 - RNA, 23 nt, Human
ugcuuccuccuuugcucuuggga

SEQ ID NO: 91151 - RNA, 22 nt, Human
caggccugugucccaagcagua

SEQ ID NO: 91152 - RNA, 21 nt, Human
uagacgauccuccugccucag

SEQ ID NO: 91153 - RNA, 19 nt, Human
cugggcuggagugaggugg

SEQ ID NO: 91154 - RNA, 22 nt, Human
gcaucagagaugaugcugcagu

SEQ ID NO: 91155 - RNA, 21 nt, Human
gaagaagaaaaagaaauuuua

SEQ ID NO: 91156 - RNA, 28 nt, Human
cacaugaacacaugcacaugugcacaca

SEQ ID NO: 91157 - RNA, 22 nt, Human
cagaaaacaggaagaaccaggc

SEQ ID NO: 91158 - RNA, 31 nt, Human
cacuccucgcacuuccagccuuggagcccuu

SEQ ID NO: 91159 - RNA, 20 nt, Human
ggguuugggcaguggagagg

SEQ ID NO: 91160 - RNA, 22 nt, Human
ucugcccuccagaacuucaggc

SEQ ID NO: 91161 - RNA, 23 nt, Human
ggaaggaaaaugaagagagccag

SEQ ID NO: 91162 - RNA, 27 nt, Human
uucuacaagugggugguuuuggucuuu

SEQ ID NO: 91163 - RNA, 25 nt, Human
cucacgcccuaagcgcacauucaug

SEQ ID NO: 91164 - RNA, 20 nt, Human
ccccaggauggauaugagau

SEQ ID NO: 91165 - RNA, 24 nt, Human
uccuccaggcucugccuggccuga

SEQ ID NO: 91166 - RNA, 25 nt, Human
augaaguuccuuccacaaacacagc

SEQ ID NO: 91167 - RNA, 25 nt, Human
cuucaaaaucagaacuauguucuuu

SEQ ID NO: 91168 - RNA, 23 nt, Human
cccaggccuguuccuggcagcug

SEQ ID NO: 91169 - RNA, 23 nt, Human
gggguuuuguaauuuagcagaac

SEQ ID NO: 91170 - RNA, 22 nt, Human
aagaucugaaaucauuggaccu

SEQ ID NO: 91171 - RNA, 26 nt, Human
ugggaaugccaugcucaucuuucguc

SEQ ID NO: 91172 - RNA, 20 nt, Human
aaaauacaaaaauuagcugg

SEQ ID NO: 91173 - RNA, 21 nt, Human
ugggcgugagaggauaggugg

SEQ ID NO: 91174 - RNA, 26 nt, Human
ccucucucccccucggugaaugaugg

SEQ ID NO: 91175 - RNA, 26 nt, Human
gcagaaggaggcuguucaaggcuguu

SEQ ID NO: 91176 - RNA, 22 nt, Human
ccugccugguccgccauguucc

SEQ ID NO: 91177 - RNA, 22 nt, Human
agccucccguguagcugggacu

SEQ ID NO: 91178 - RNA, 25 nt, Human
gugguccagcagaggcgcugggugg

SEQ ID NO: 91179 - RNA, 22 nt, Human
accugacagcuuuaucucccca

SEQ ID NO: 91180 - RNA, 21 nt, Human
auaaucaagaaggggcucugg

SEQ ID NO: 91181 - RNA, 21 nt, Human
ucauuaaagcaucugagaucu

SEQ ID NO: 91182 - RNA, 25 nt, Human
ccuucacagccuccauccuuagcuu

SEQ ID NO: 91183 - RNA, 27 nt, Human
ccugccuggugugccucaguauauuua

SEQ ID NO: 91184 - RNA, 21 nt, Human
uuuuuucugaaaguaggcuuu

SEQ ID NO: 91185 - RNA, 24 nt, Human
ugggcaaagccacaaggcuggcca

SEQ ID NO: 91186 - RNA, 17 nt, Human
caggcagccaccagugg

SEQ ID NO: 91187 - RNA, 25 nt, Human
cacugcucaccuggguuuacugaug

SEQ ID NO: 91188 - RNA, 23 nt, Human
aggaaugugcauaauggagagaa

SEQ ID NO: 91189 - RNA, 19 nt, Human
ucugcagcuuuccaaagcu

SEQ ID NO: 91190 - RNA, 25 nt, Human
gcucagggcgugcacugugaggcug

SEQ ID NO: 91191 - RNA, 27 nt, Human
gucagugcucucagcuggcagugcaau

SEQ ID NO: 91192 - RNA, 22 nt, Human
guucagaccucuuggcccaacc

SEQ ID NO: 91193 - RNA, 23 nt, Human
aagggagggcacggcagccaggc

SEQ ID NO: 91194 - RNA, 20 nt, Human
ccucagcccugcugcccagc

SEQ ID NO: 91195 - RNA, 25 nt, Human
ugggagccaggcgggcggcugggcu

SEQ ID NO: 91196 - RNA, 21 nt, Human
uuuugauggugucugugacau

SEQ ID NO: 91197 - RNA, 24 nt, Human
ugagaugaauacuuccugagaaac

SEQ ID NO: 91198 - RNA, 24 nt, Human
cuggcuauggucacagagagacac

SEQ ID NO: 91199 - RNA, 20 nt, Human
augaggucugaaauggaggu

SEQ ID NO: 91200 - RNA, 26 nt, Human
ugcucaggcuggugccagccuuucag

SEQ ID NO: 91201 - RNA, 22 nt, Human
cuguuucuuuuuccuuuucccc

SEQ ID NO: 91202 - RNA, 21 nt, Human
uuccucagaguggcuuuuccu

SEQ ID NO: 91203 - RNA, 19 nt, Human
caguagaguacuggcuccu

SEQ ID NO: 91204 - RNA, 26 nt, Human
gccuguaauccuagcacuuuugggag

SEQ ID NO: 91205 - RNA, 23 nt, Human
caugccuauaaucccagcuacuu

SEQ ID NO: 91206 - RNA, 21 nt, Human
uguugaccaggcuggucucga

SEQ ID NO: 91207 - RNA, 27 nt, Human
cucuaggcaagaaucccggaggcagag

SEQ ID NO: 91208 - RNA, 25 nt, Human
gcgccccaccaugcccaacaucgug

SEQ ID NO: 91209 - RNA, 27 nt, Human
caggcuggagugcaauggcgcguucuc

SEQ ID NO: 91210 - RNA, 23 nt, Human
auacacaggacgaagaaggcuuc

SEQ ID NO: 91211 - RNA, 22 nt, Human
ggguuuggccucaggagcuggg

SEQ ID NO: 91212 - RNA, 21 nt, Human
auacuuuuaagacaacuuggc

SEQ ID NO: 91213 - RNA, 21 nt, Human
uugcucaggcuggucucaaac

SEQ ID NO: 91214 - RNA, 24 nt, Human
ccuggcagcugcugcgcccucgcu

SEQ ID NO: 91215 - RNA, 22 nt, Human
caccacugcacuccggccuggg

SEQ ID NO: 91216 - RNA, 23 nt, Human
cugcuucucuuacuauacucaua

SEQ ID NO: 91217 - RNA, 21 nt, Human
aggggaggggcgaggggaagc

SEQ ID NO: 91218 - RNA, 23 nt, Human
cucguguuauaaauuacccaguu

SEQ ID NO: 91219 - RNA, 27 nt, Human
acagaacucagccuuaagaaagcuaua

SEQ ID NO: 91220 - RNA, 22 nt, Human
uaggcuaacuuuaaacauguau

SEQ ID NO: 91221 - RNA, 23 nt, Human
cuugcagaaugaaaggcaucaca

SEQ ID NO: 91222 - RNA, 21 nt, Human
cuguaaccccagcacuuuggg

SEQ ID NO: 91223 - RNA, 20 nt, Human
acucuccugaauuaaaggag

SEQ ID NO: 91224 - RNA, 22 nt, Human
uucucucuccucccgccgccca

SEQ ID NO: 91225 - RNA, 25 nt, Human
uggaugucugauucaggaacaggau

SEQ ID NO: 91226 - RNA, 21 nt, Human
gcccucuggagaacacugccu

SEQ ID NO: 91227 - RNA, 21 nt, Human
cugcuucugcuauagagaaca

SEQ ID NO: 91228 - RNA, 21 nt, Human
ucuucuuucaaaccagugggg

SEQ ID NO: 91229 - RNA, 23 nt, Human
cuuuuauggcucuaucuuuuccu

SEQ ID NO: 91230 - RNA, 22 nt, Human
cacccagccucaaaaauauaug

SEQ ID NO: 91231 - RNA, 22 nt, Human
cucacccugcuuggggccuggc

SEQ ID NO: 91232 - RNA, 23 nt, Human
ggggagccacuugggcaggaggc

SEQ ID NO: 91233 - RNA, 26 nt, Human
uuaaggcuuugggaauguuuuuagcu

SEQ ID NO: 91234 - RNA, 22 nt, Human
cacgcguccgccagccuagcag

SEQ ID NO: 91235 - RNA, 20 nt, Human
uuugcccagccugcugcaau

SEQ ID NO: 91236 - RNA, 21 nt, Human
cugggcauggcagggccaggc

SEQ ID NO: 91237 - RNA, 20 nt, Human
uucauucuuguaguauuuca

SEQ ID NO: 91238 - RNA, 22 nt, Human
auggcagccuuuucuccuucau

SEQ ID NO: 91239 - RNA, 22 nt, Human
cgcccaggcuagaguggauugg

SEQ ID NO: 91240 - RNA, 19 nt, Human
aagagggagaugagacagc

SEQ ID NO: 91241 - RNA, 28 nt, Human
ccugcccugcugccaggcuuacaucuuc

SEQ ID NO: 91242 - RNA, 23 nt, Human
cagaaggcagcuauucccagcag

SEQ ID NO: 91243 - RNA, 21 nt, Human
gucaguuuucagaagcagguu

SEQ ID NO: 91244 - RNA, 22 nt, Human
gagauggagagcaaagcccugc

SEQ ID NO: 91245 - RNA, 22 nt, Human
ucugauccucacacaugcucug

SEQ ID NO: 91246 - RNA, 27 nt, Human
ggucuugaacucuugaccucaugaucc

SEQ ID NO: 91247 - RNA, 20 nt, Human
uaagagagaaagacugguua

SEQ ID NO: 91248 - RNA, 22 nt, Human
ccugcuguuuacauuaaacuga

SEQ ID NO: 91249 - RNA, 23 nt, Human
agugcucugcuggaaguucugcc

SEQ ID NO: 91250 - RNA, 19 nt, Human
uugugauccaccuccucgg

SEQ ID NO: 91251 - RNA, 23 nt, Human
cuguauccagcuaucuuucuuug

SEQ ID NO: 91252 - RNA, 26 nt, Human
gcauguuguagcaaacauuucuguaa

SEQ ID NO: 91253 - RNA, 20 nt, Human
ccaacuaugccaagcauuaa

SEQ ID NO: 91254 - RNA, 20 nt, Human
ugaauuauugaccuaauaaa

SEQ ID NO: 91255 - RNA, 27 nt, Human
aacuauacugccuugugaugccucccu

SEQ ID NO: 91256 - RNA, 21 nt, Human
uucagugagguaggccagcuu

SEQ ID NO: 91257 - RNA, 27 nt, Human
acucccucaccuucagccuucagugaa

SEQ ID NO: 91258 - RNA, 22 nt, Human
aggugggcagaucacgaaguca

SEQ ID NO: 91259 - RNA, 22 nt, Human
ugacggugcgaagaguauuuaa

SEQ ID NO: 91260 - RNA, 23 nt, Human
gcggagaccgcacucaucuuaca

SEQ ID NO: 91261 - RNA, 27 nt, Human
cugguuauuuuaaaaagaauaaagaca

SEQ ID NO: 91262 - RNA, 21 nt, Human
gcugggacauggggguguggg

SEQ ID NO: 91263 - RNA, 25 nt, Human
uuccugagcccccgucgugccucuc

SEQ ID NO: 91264 - RNA, 27 nt, Human
gaagccuccugucuccagcucucucca

SEQ ID NO: 91265 - RNA, 20 nt, Human
ucaugccacuguuugagucu

SEQ ID NO: 91266 - RNA, 19 nt, Human
ccucugccaagcccccagg

SEQ ID NO: 91267 - RNA, 22 nt, Human
uggggcuggggaagaggacugu

SEQ ID NO: 91268 - RNA, 22 nt, Human
uuccugccuccugccccacuca

SEQ ID NO: 91269 - RNA, 24 nt, Human
ucccuuuaaugcuugcagaagcug

SEQ ID NO: 91270 - RNA, 24 nt, Human
uucugccauguacuccagaacuca

SEQ ID NO: 91271 - RNA, 20 nt, Human
gccuaccuuagcacaggguc

SEQ ID NO: 91272 - RNA, 19 nt, Human
acaaagucuagaaaccacu

SEQ ID NO: 91273 - RNA, 23 nt, Human
gccacugcacucuagccugggcc

SEQ ID NO: 91274 - RNA, 20 nt, Human
ccgguggaaguggccguggg

SEQ ID NO: 91275 - RNA, 22 nt, Human
caggcuggagugcaguggcaca

SEQ ID NO: 91276 - RNA, 25 nt, Human
ucacuuuagccugauuauaauauua

SEQ ID NO: 91277 - RNA, 21 nt, Human
uugucugacugggccuggacc

SEQ ID NO: 91278 - RNA, 23 nt, Human
uucaugacuggugcguuccuaaa

SEQ ID NO: 91279 - RNA, 20 nt, Human
cucucugucuugaccaauaa

SEQ ID NO: 91280 - RNA, 23 nt, Human
ugagggcugccaggggguggugu

SEQ ID NO: 91281 - RNA, 26 nt, Human
gacacagucauggcccccuuccuccc

SEQ ID NO: 91282 - RNA, 20 nt, Human
gguuucuagcaugaauugag

SEQ ID NO: 91283 - RNA, 22 nt, Human
gaauaacaaaaacuuugcucag

SEQ ID NO: 91284 - RNA, 21 nt, Human
gggguuucagcucauaucuua

SEQ ID NO: 91285 - RNA, 21 nt, Human
acauaagaugagaacuuucua

SEQ ID NO: 91286 - RNA, 27 nt, Human
ugcuugaaauaugcacuuagcacuuug

SEQ ID NO: 91287 - RNA, 22 nt, Human
uuuuaaggacaguaucuuuuca

SEQ ID NO: 91288 - RNA, 26 nt, Human
accuguaaucccagcacuuuaggagg

SEQ ID NO: 91289 - RNA, 23 nt, Human
gcugggggugcuggcugagggaa

SEQ ID NO: 91290 - RNA, 20 nt, Human
ucuugacugaacacauucuc

SEQ ID NO: 91291 - RNA, 25 nt, Human
cagcaaagucacccuuacaaagaag

SEQ ID NO: 91292 - RNA, 21 nt, Human
cuuccccccauuuuuguuuua

SEQ ID NO: 91293 - RNA, 20 nt, Human
cagguagauggugaacggcc

SEQ ID NO: 91294 - RNA, 22 nt, Human
uccucucuuggggacugcuuuu

SEQ ID NO: 91295 - RNA, 23 nt, Human
gccugugaucccagcuacuuggg

SEQ ID NO: 91296 - RNA, 18 nt, Human
agugaggagaguguguga

SEQ ID NO: 91297 - RNA, 25 nt, Human
aaggacagcuuccugggggcagcac

SEQ ID NO: 91298 - RNA, 22 nt, Human
gcgugagccacugcgcccggcc

SEQ ID NO: 91299 - RNA, 22 nt, Human
gugugagccacugcgccuggcc

SEQ ID NO: 91300 - RNA, 22 nt, Human
gagauguuucagauuuuucccu

SEQ ID NO: 91301 - RNA, 20 nt, Human
gagaccugcauuugccaaca

SEQ ID NO: 91302 - RNA, 23 nt, Human
uugcucaaccauggcugaaggaa

SEQ ID NO: 91303 - RNA, 21 nt, Human
uauugcaccacugaacuccag

SEQ ID NO: 91304 - RNA, 26 nt, Human
uuuuuuaaaaaauauauuccucuuca

SEQ ID NO: 91305 - RNA, 20 nt, Human
cagaauggggaauggagagg

SEQ ID NO: 91306 - RNA, 26 nt, Human
gcagcaaacuuggugaaacuacaucu

SEQ ID NO: 91307 - RNA, 28 nt, Human
agggggagaucccaagccuagccuuggg

SEQ ID NO: 91308 - RNA, 23 nt, Human
ucucacucuugucaccuaggcaa

SEQ ID NO: 91309 - RNA, 26 nt, Human
caaggacgcauuuccccaguacaucc

SEQ ID NO: 91310 - RNA, 32 nt, Human; identical to SEQ ID NO: 7557

SEQ ID NO: 91311 - RNA, 24 nt, Human
ggguccugaagaauuaagauacaa

SEQ ID NO: 91312 - RNA, 21 nt, Human
accugugaucccagcacuuug

SEQ ID NO: 91313 - RNA, 22 nt, Human
agguggcggcgggcagagggug

SEQ ID NO: 91314 - RNA, 25 nt, Human
uucgcgcuccgcuggugaauggagu

SEQ ID NO: 91315 - RNA, 22 nt, Human
ggcccccaaccccccauuucuu

SEQ ID NO: 91316 - RNA, 21 nt, Human
gaguuccugccuuucccacca

SEQ ID NO: 91317 - RNA, 23 nt, Human
agcuggacuauggcucuacuuuc

SEQ ID NO: 91318 - RNA, 26 nt, Human
cccagcucgguuuuuccgcaggauuu

SEQ ID NO: 91319 - RNA, 22 nt, Human
caacucuugggcucaagcauca

SEQ ID NO: 91320 - RNA, 27 nt, Human
cuugcagagagcgcgguccacucugcu

SEQ ID NO: 91321 - RNA, 22 nt, Human
agacuccuggguucaagcaauc

SEQ ID NO: 91322 - RNA, 27 nt, Human
cugggcaauaagagcaaaacuccauca

SEQ ID NO: 91323 - RNA, 22 nt, Human
gaccucucaaguagcugggauu

SEQ ID NO: 91324 - RNA, 24 nt, Human
aucucuagcagagcaauuugauca

SEQ ID NO: 91325 - RNA, 19 nt, Human
cugcaucuucuucucagcu

SEQ ID NO: 91326 - RNA, 27 nt, Human
gcaagggacucuccaggcuccuccucc

SEQ ID NO: 91327 - RNA, 22 nt, Human
cugaucuuuuuauacacaauau

SEQ ID NO: 91328 - RNA, 27 nt, Human
ggagaaggagggagacaugagcauggc

SEQ ID NO: 91329 - RNA, 19 nt, Human
uggcagccauucugccuuu

SEQ ID NO: 91330 - RNA, 25 nt, Human
agacacaugugcuggccaccugcug

SEQ ID NO: 91331 - RNA, 22 nt, Human
cuccugaguuccacugcucuag

SEQ ID NO: 91332 - RNA, 21 nt, Human
acccugaggaauucaccagga

SEQ ID NO: 91333 - RNA, 21 nt, Human
gccaugaggccuuuccccagu

SEQ ID NO: 91334 - RNA, 22 nt, Human
gccccucccccuccuucucacc

SEQ ID NO: 91335 - RNA, 24 nt, Human
uccccucagacauucucaggauuu

SEQ ID NO: 91336 - RNA, 22 nt, Human
ucuccucuccuucccauggccc

SEQ ID NO: 91337 - RNA, 27 nt, Human
caaguagcugggauuacagucaggcac

SEQ ID NO: 91338 - RNA, 27 nt, Human
cucccuauacuccucaggcuccugggu

SEQ ID NO: 91339 - RNA, 22 nt, Human
uuaaaaugggcaggaggacugu

SEQ ID NO: 91340 - RNA, 26 nt, Human
ggagagagcaucuucauugacauugc

SEQ ID NO: 91341 - RNA, 21 nt, Human
ggguugcccaaaaaaugugau

SEQ ID NO: 91342 - RNA, 22 nt, Human
ucgcugcugcagccaacccagu

SEQ ID NO: 91343 - RNA, 27 nt, Human
cugggaggugggcggggagcaucacca

SEQ ID NO: 91344 - RNA, 23 nt, Human
caucccucugccugcaaugagag

SEQ ID NO: 91345 - RNA, 25 nt, Human
uggccucuccuuguggccugggccu

SEQ ID NO: 91346 - RNA, 19 nt, Human
gcacuauacuuucuggaau

SEQ ID NO: 91347 - RNA, 24 nt, Human
ccuggagagccucagucccuguag

SEQ ID NO: 91348 - RNA, 20 nt, Human
agcuuuggugcaauggcuga

SEQ ID NO: 91349 - RNA, 23 nt, Human
ugagaucagagcugggguggaag

SEQ ID NO: 91350 - RNA, 19 nt, Human
cugagucuuuggcagccug

SEQ ID NO: 91351 - RNA, 25 nt, Human
guuccagccucucccuacucccauc

SEQ ID NO: 91352 - RNA, 22 nt, Human
gagcaaaauuuuggacugugaa

SEQ ID NO: 91353 - RNA, 21 nt, Human
cgucaauaaaaaagacuugcu

SEQ ID NO: 91354 - RNA, 25 nt, Human
gcugugcccucuccauuccacugcu

SEQ ID NO: 91355 - RNA, 22 nt, Human
gagcuggagugauuagagcccu

SEQ ID NO: 91356 - RNA, 21 nt, Human
ugcuccuuggccgcuuacugg

SEQ ID NO: 91357 - RNA, 27 nt, Human
aggguucccugguugugaaaauacaug

SEQ ID NO: 91358 - RNA, 20 nt, Human
auuaucuauggaaaugugag

SEQ ID NO: 91359 - RNA, 27 nt, Human
aacugauuaagggugagcagaggcauu

SEQ ID NO: 91360 - RNA, 21 nt, Human
caugcugguguguaccuguag

SEQ ID NO: 91361 - RNA, 22 nt, Human
gaccacccuggccaacauggug

SEQ ID NO: 91362 - RNA, 20 nt, Human
acuguggcaucuccguccug

SEQ ID NO: 91363 - RNA, 21 nt, Human
uucuugugcuuucuguauuua

SEQ ID NO: 91364 - RNA, 20 nt, Human
gcuuccuucucaucuugccu

SEQ ID NO: 91365 - RNA, 26 nt, Human
ugccuagguuuuggagaguuugccug

SEQ ID NO: 91366 - RNA, 23 nt, Human
caaacagaugcauaguauggguu

SEQ ID NO: 91367 - RNA, 24 nt, Human
auugcuugagcaacaggcagguua

SEQ ID NO: 91368 - RNA, 21 nt, Human
cugcucccucugcugcauuuc

SEQ ID NO: 91369 - RNA, 18 nt, Human
ggccucggccuggcuuca

SEQ ID NO: 91370 - RNA, 27 nt, Human
uugcccagggauuaggagcagcucuuc

SEQ ID NO: 91371 - RNA, 20 nt, Human
aucccucuucuuuuuucuua

SEQ ID NO: 91372 - RNA, 23 nt, Human
cccaccccacuccuaggcugccu

SEQ ID NO: 91373 - RNA, 23 nt, Human
ugggcacagaguucgcauuggcg

SEQ ID NO: 91374 - RNA, 18 nt, Human
cuaccugcagagcacggu

SEQ ID NO: 91375 - RNA, 20 nt, Human
cuacugauuuuuccuguuga

SEQ ID NO: 91376 - RNA, 30 nt, Human
uccguuucaagagaggagaucaugauugag

SEQ ID NO: 91377 - RNA, 27 nt, Human
aggagagaaggggacacucgaguccag

SEQ ID NO: 91378 - RNA, 22 nt, Human
cuccagccucagccuccugagu

SEQ ID NO: 91379 - RNA, 25 nt, Human
gauugcuuuuguauuuaauucugca

SEQ ID NO: 91380 - RNA, 22 nt, Human
agucgaguguucuauuuuuugu

SEQ ID NO: 91381 - RNA, 21 nt, Human
ccacaggcggagguugcggug

SEQ ID NO: 91382 - RNA, 27 nt, Human
agggaggggccaggcagcugagggcca

SEQ ID NO: 91383 - RNA, 27 nt, Human
gcugaggccgggccaugggcacaugga

SEQ ID NO: 91384 - RNA, 26 nt, Human
gguacccgcccgguaccgcgcgagcc

SEQ ID NO: 91385 - RNA, 28 nt, Human
ggggcuggugggccuuucuguguccuac

SEQ ID NO: 91386 - RNA, 22 nt, Human
ugucgcccaggcuggagugcaa

SEQ ID NO: 91387 - RNA, 22 nt, Human
ccaacguggugaaagccuguau

SEQ ID NO: 91388 - RNA, 25 nt, Human
cuuagcuggguuuauucaaaguggg

SEQ ID NO: 91389 - RNA, 27 nt, Human
uguuuuuaaaaagcacauuguagccua

SEQ ID NO: 91390 - RNA, 23 nt, Human
ccccacaccugggggacccccug

SEQ ID NO: 91391 - RNA, 24 nt, Human
uucacugugcucaucaagaacaau

SEQ ID NO: 91392 - RNA, 27 nt, Human
agcaguuugagcaguauuuccgagacg

SEQ ID NO: 91393 - RNA, 21 nt, Human
auuuaggucaaaugcuuucca

SEQ ID NO: 91394 - RNA, 20 nt, Human
cucguuugacaccuuccugg

SEQ ID NO: 91395 - RNA, 21 nt, Human
uggggagggggagggggaagu

SEQ ID NO: 91396 - RNA, 32 nt, Human
ggcaagcccuguugacacaggucuuuccuaag

SEQ ID NO: 91397 - RNA, 20 nt, Human
ggugucagaacuugcuugaa

SEQ ID NO: 91398 - RNA, 25 nt, Human
ccuuggugggaguccguggugccac

SEQ ID NO: 91399 - RNA, 23 nt, Human
uggccacagaggacucacuugcc

SEQ ID NO: 91400 - RNA, 19 nt, Human
acccucuaccaucuguaaa

SEQ ID NO: 91401 - RNA, 21 nt, Human
ucucuggcuccuccuccgcca

SEQ ID NO: 91402 - RNA, 24 nt, Human
caguguccagacuuucuguaauca

SEQ ID NO: 91403 - RNA, 20 nt, Human
uaccugaauauaacaaccuu

SEQ ID NO: 91404 - RNA, 18 nt, Human
uagcagggguaauuuucu

SEQ ID NO: 91405 - RNA, 19 nt, Human
ggagagcuugggggugggg

SEQ ID NO: 91406 - RNA, 24 nt, Human
aagccacuguaccugaaucaugcu

SEQ ID NO: 91407 - RNA, 25 nt, Human
gaagaagaagaaaagaagacgcugg

SEQ ID NO: 91408 - RNA, 20 nt, Human
ggcuuugggcucugccccuc

SEQ ID NO: 91409 - RNA, 21 nt, Human
uggacuagcugggaucuccgc

SEQ ID NO: 91410 - RNA, 20 nt, Human
accaaacugccuuccccuca

SEQ ID NO: 91411 - RNA, 22 nt, Human
agccuccaaaguagcugggauu

SEQ ID NO: 91412 - RNA, 22 nt, Human
ucacaggcucagggcaaagaag

SEQ ID NO: 91413 - RNA, 20 nt, Human
cuuccugguccuguucuaug

SEQ ID NO: 91414 - RNA, 20 nt, Human
ucugcuacuuuacuaauuca

SEQ ID NO: 91415 - RNA, 22 nt, Human
cuuugauaaaauaaaugagcua

SEQ ID NO: 91416 - RNA, 24 nt, Human
ccccacuccccuuccucaucccca

SEQ ID NO: 91417 - RNA, 27 nt, Human
uacagcccagaaacccagaagccccua

SEQ ID NO: 91418 - RNA, 27 nt, Human
cgggaggccucuugguuucagggucuc

SEQ ID NO: 91419 - RNA, 22 nt, Human
caggagccgugggcaagggaag

SEQ ID NO: 91420 - RNA, 27 nt, Human
ugcugcaauugaaaacuuucuuucuaa

SEQ ID NO: 91421 - RNA, 21 nt, Human
gguuccuuaguuuugcacugg

SEQ ID NO: 91422 - RNA, 22 nt, Human
cccacccccacagagagaacuu

SEQ ID NO: 91423 - RNA, 21 nt, Human
gcaaaguuuuuauucauucca

SEQ ID NO: 91424 - RNA, 24 nt, Human
ggcaggcggaucaugaggucagga

SEQ ID NO: 91425 - RNA, 27 nt, Human
cugugugaugcuggggagguguuugug

SEQ ID NO: 91426 - RNA, 24 nt, Human
gccuuuuaggagcuuuauguuuag

SEQ ID NO: 91427 - RNA, 26 nt, Human
cagccagcugcacugcagggcacggg

SEQ ID NO: 91428 - RNA, 19 nt, Human
cucucacuccugaauucag

SEQ ID NO: 91429 - RNA, 20 nt, Human
auaccuguauacacacacau

SEQ ID NO: 91430 - RNA, 22 nt, Human
cccugcagaggggcuccagcug

SEQ ID NO: 91431 - RNA, 21 nt, Human
aggggaggcaccuccaggcag

SEQ ID NO: 91432 - RNA, 25 nt, Human
caguuucauuguuaacgggccuuau

SEQ ID NO: 91433 - RNA, 22 nt, Human
gcgcuucuucuuucuugguuug

SEQ ID NO: 91434 - RNA, 22 nt, Human
uccaaguagcugggacuacagg

SEQ ID NO: 91435 - RNA, 22 nt, Human
cuggugaagagaaaaaggcuga

SEQ ID NO: 91436 - RNA, 19 nt, Human
ucugcucccuuucuccaga

SEQ ID NO: 91437 - RNA, 27 nt, Human
aggcugagguggaaggcuugagcccag

SEQ ID NO: 91438 - RNA, 22 nt, Human
gcuuuccuguuucucagucuca

SEQ ID NO: 91439 - RNA, 27 nt, Human
ucugcacaccuugaaucugccugcugg

SEQ ID NO: 91440 - RNA, 23 nt, Human
gucaucaggacacuaucucaccc

SEQ ID NO: 91441 - RNA, 22 nt, Human
ggaccuguucacguugccacag

SEQ ID NO: 91442 - RNA, 22 nt, Human
cacguauguaaucccagcacuu

SEQ ID NO: 91443 - RNA, 22 nt, Human
cugcaaccucugccucccgggu

SEQ ID NO: 91444 - RNA, 21 nt, Human
aggagguggagguuacaguga

SEQ ID NO: 91445 - RNA, 26 nt, Human
aagcuuagaggagugaaauguuuuga

SEQ ID NO: 91446 - RNA, 26 nt, Human
ggagagaaggaaaccugaggaguagu

SEQ ID NO: 91447 - RNA, 26 nt, Human
aaggaugauuuuaacaacuuuuuaau

SEQ ID NO: 91448 - RNA, 21 nt, Human
ugcugcaagccagacaggaaa

SEQ ID NO: 91449 - RNA, 22 nt, Human
aagccuuuuagcuuuuccagca

SEQ ID NO: 91450 - RNA, 22 nt, Human
cagccucuuuccucguuucuag

SEQ ID NO: 91451 - RNA, 20 nt, Human
augcucuuaacuagugcucu

SEQ ID NO: 91452 - RNA, 22 nt, Human
aaaacaauucuuagagagggua

SEQ ID NO: 91453 - RNA, 21 nt, Human
acugcagcuuccuccacagcc

SEQ ID NO: 91454 - RNA, 27 nt, Human
gggcccaggucccaggggagagguugg

SEQ ID NO: 91455 - RNA, 21 nt, Human
ccuucccagccggggccuucc

SEQ ID NO: 91456 - RNA, 22 nt, Human
ucucuguggagucuggcucucu

SEQ ID NO: 91457 - RNA, 25 nt, Human
gcgccguuguacuccagccugggca

SEQ ID NO: 91458 - RNA, 24 nt, Human
uucuucuccucuaucucauaaugc

SEQ ID NO: 91459 - RNA, 26 nt, Human
uccucaaguuaguuauguuguaggag

SEQ ID NO: 91460 - RNA, 21 nt, Human
gugccaauguuguguguugca

SEQ ID NO: 91461 - RNA, 19 nt, Human
cuggcuggggcauucucau

SEQ ID NO: 91462 - RNA, 26 nt, Human
agagacacaccugaccagccccuccc

SEQ ID NO: 91463 - RNA, 22 nt, Human
agauuccugggcuuaagcaguc

SEQ ID NO: 91464 - RNA, 24 nt, Human
uggacaguggagugcaaaaggcuu

SEQ ID NO: 91465 - RNA, 19 nt, Human
cuuugcagagcacuuccuu

SEQ ID NO: 91466 - RNA, 22 nt, Human
ugguacugugauggggucauca

SEQ ID NO: 91467 - RNA, 26 nt, Human
ucucuacugcuggacuguggaggguc

SEQ ID NO: 91468 - RNA, 21 nt, Human
aagugguggccacaaguacaa

SEQ ID NO: 91469 - RNA, 21 nt, Human
gccuccgccaccuccuccgcc

SEQ ID NO: 91470 - RNA, 26 nt, Human
aaagauguacauauucauuauacuuc

SEQ ID NO: 91471 - RNA, 21 nt, Human
uuugauggaauagggaacugc

SEQ ID NO: 91472 - RNA, 22 nt, Human
cagcacagggaucucagcucug

SEQ ID NO: 91473 - RNA, 20 nt, Human
aucccaggucucauccuuca

SEQ ID NO: 91474 - RNA, 25 nt, Human
augaaauguaaaaugugaacucccu

SEQ ID NO: 91475 - RNA, 22 nt, Human
uggccugugaggagcagugagg

SEQ ID NO: 91476 - RNA, 20 nt, Human
cuggauugaagccagaauca

SEQ ID NO: 91477 - RNA, 22 nt, Human
uccggaggaggaagcugggaca

SEQ ID NO: 91478 - RNA, 27 nt, Human
gcagugcccuggcuguguccuggacgg

SEQ ID NO: 91479 - RNA, 27 nt, Human
agcucacuuguccaugaaaauauuuua

SEQ ID NO: 91480 - RNA, 26 nt, Human
caccuggagagcaucuuccuggugau

SEQ ID NO: 91481 - RNA, 19 nt, Human
auuggccauauacaggguc

SEQ ID NO: 91482 - RNA, 21 nt, Human
ccugugucuccugcccccagg

SEQ ID NO: 91483 - RNA, 26 nt, Human
ccagaguccggaggcagcagacacgc

SEQ ID NO: 91484 - RNA, 20 nt, Human
guacuacgggguggggaaga

SEQ ID NO: 91485 - RNA, 27 nt, Human
cccuccugccccgaaagugcugacuau

SEQ ID NO: 91486 - RNA, 23 nt, Human
agcuccacucugcuucucugacu

SEQ ID NO: 91487 - RNA, 22 nt, Human
ccgugcaggggagcuugcggga

SEQ ID NO: 91488 - RNA, 26 nt, Human
ugaguauuuuugaauugagaugauca

SEQ ID NO: 91489 - RNA, 27 nt, Human
ccuucuguuacccagcuccuggaggca

SEQ ID NO: 91490 - RNA, 22 nt, Human
ccaccgcacccagccuauuuua

SEQ ID NO: 91491 - RNA, 21 nt, Human
agggucccaaggauugggaga

SEQ ID NO: 91492 - RNA, 22 nt, Human
cacacaggugguaaaugcucug

SEQ ID NO: 91493 - RNA, 23 nt, Human
gcugggagcagagagaagccugg

SEQ ID NO: 91494 - RNA, 27 nt, Human
ccugccgaggugugaccccaccugcuc

SEQ ID NO: 91495 - RNA, 27 nt, Human
guaaaacaaggaggauuguggccggau

SEQ ID NO: 91496 - RNA, 28 nt, Human
ccaaacuggccagacuguucuguagguu

SEQ ID NO: 91497 - RNA, 27 nt, Human
guagagcccucucaaccccauuguccu

SEQ ID NO: 91498 - RNA, 22 nt, Human
cuguaaucccagcuacucgaga

SEQ ID NO: 91499 - RNA, 22 nt, Human
caccuguaauuccagcacuuug

SEQ ID NO: 91500 - RNA, 22 nt, Human
caucuguaaucccagcacuuug

SEQ ID NO: 91501 - RNA, 23 nt, Human
gcccccucuucuggcugcucaag

SEQ ID NO: 91502 - RNA, 21 nt, Human
ucauuugguucaaauaguuga

SEQ ID NO: 91503 - RNA, 23 nt, Human
ugaaaacagaauauucuguggug

SEQ ID NO: 91504 - RNA, 27 nt, Human
ggucuugaacuccuggacucaagcaac

SEQ ID NO: 91505 - RNA, 23 nt, Human
gacaggguuucaccguguuagcc

SEQ ID NO: 91506 - RNA, 27 nt, Human
cauaugcagagccccaaggccacccca

SEQ ID NO: 91507 - RNA, 28 nt, Human
gccaccuaaggcuggaugggaaagugca

SEQ ID NO: 91508 - RNA, 24 nt, Human
agauagacuucaggauggccaguc

SEQ ID NO: 91509 - RNA, 21 nt, Human
ccugucuguagugccugcugu

SEQ ID NO: 91510 - RNA, 21 nt, Human
gaccagcucagccucugauaa

SEQ ID NO: 91511 - RNA, 19 nt, Human
acucccugcacugcugaag

SEQ ID NO: 91512 - RNA, 27 nt, Human
cugucuuugcuguauuuugaaaaacac

SEQ ID NO: 91513 - RNA, 21 nt, Human
auagucuuguuucucagaauc

SEQ ID NO: 91514 - RNA, 22 nt, Human
ccgaguagcugggauuacagga

SEQ ID NO: 91515 - RNA, 27 nt, Human
gagagugagagagagugagagcacaaa

SEQ ID NO: 91516 - RNA, 26 nt, Human
ucuugcccucauucuuugggucugaa

SEQ ID NO: 91517 - RNA, 23 nt, Human
aggguguuuugucaaagcagguu

SEQ ID NO: 91518 - RNA, 20 nt, Human
auaggcccagccuccuuccc

SEQ ID NO: 91519 - RNA, 23 nt, Human
cuucucagacucuuccucuguca

SEQ ID NO: 91520 - RNA, 22 nt, Human
ugccucugccauucacacugac

SEQ ID NO: 91521 - RNA, 22 nt, Human
cccccugcugcccacucuccug

SEQ ID NO: 91522 - RNA, 19 nt, Human
aaguaggaagggagccaga

SEQ ID NO: 91523 - RNA, 21 nt, Human
gagcgccuggccgagauggag

SEQ ID NO: 91524 - RNA, 21 nt, Human
cugccaccuccugugcacuuu

SEQ ID NO: 91525 - RNA, 25 nt, Human
guucugcugguguccuuccuuggcu

SEQ ID NO: 91526 - RNA, 26 nt, Human
cuacauuugcuguacauauuauuuaa

SEQ ID NO: 91527 - RNA, 24 nt, Human
ccaguucuuacacucugauacgca

SEQ ID NO: 91528 - RNA, 23 nt, Human
gggcugcuucucaggaggccagg

SEQ ID NO: 91529 - RNA, 22 nt, Human
gugggcggaucaccugagguca

SEQ ID NO: 91530 - RNA, 22 nt, Human
guggguggaucacuugagguca

SEQ ID NO: 91531 - RNA, 22 nt, Human
ccaaucacagcuuuacucuuuc

SEQ ID NO: 91532 - RNA, 20 nt, Human
agcuuucaauguaucaaaga

SEQ ID NO: 91533 - RNA, 21 nt, Human
agcuguagaguccaucuguuu

SEQ ID NO: 91534 - RNA, 22 nt, Human
cugggccucaguuuucccagcu

SEQ ID NO: 91535 - RNA, 20 nt, Human
gaggcuguuuacuggggugg

SEQ ID NO: 91536 - RNA, 22 nt, Human
acacuaagaggugaacauguau

SEQ ID NO: 91537 - RNA, 27 nt, Human
uuuugaccuuccacuagaccaugagca

SEQ ID NO: 91538 - RNA, 23 nt, Human
ccccagccguccuccuggggugg

SEQ ID NO: 91539 - RNA, 25 nt, Human
cuccugaggcucuuuggaccuccag

SEQ ID NO: 91540 - RNA, 22 nt, Human
ccugcacaccauggcccccggg

SEQ ID NO: 91541 - RNA, 27 nt, Human
uaagccuuugcuguacuucuugaaaug

SEQ ID NO: 91542 - RNA, 22 nt, Human
ggaggcagaguugggaggauca

SEQ ID NO: 91543 - RNA, 27 nt, Human
ucccugccucuaacuccgaucccccca

SEQ ID NO: 91544 - RNA, 20 nt, Human
ccaaggauagaagcugcagu

SEQ ID NO: 91545 - RNA, 21 nt, Human
aacauagugacuaaaauucag

SEQ ID NO: 91546 - RNA, 27 nt, Human
uuaugcuguuaacagaugucagaguga

SEQ ID NO: 91547 - RNA, 25 nt, Human
ccucauccuccucagcggcaggcca

SEQ ID NO: 91548 - RNA, 23 nt, Human
aucugcaagcuccuguuuuacug

SEQ ID NO: 91549 - RNA, 24 nt, Human
ggguuucuagacuggggccuggcc

SEQ ID NO: 91550 - RNA, 26 nt, Human
ucucucuuauuaauagagaaguaaaa

SEQ ID NO: 91551 - RNA, 24 nt, Human
agguacccuugccuuacuccaucu

SEQ ID NO: 91552 - RNA, 26 nt, Human
uuguuuucuguucccuugccaucaca

SEQ ID NO: 91553 - RNA, 24 nt, Human
ggggagauagacgcugcugccuuu

SEQ ID NO: 91554 - RNA, 25 nt, Human
agcacaugaugaaaacagacuucca

SEQ ID NO: 91555 - RNA, 26 nt, Human
uccuccucacauggggguacacauac

SEQ ID NO: 91556 - RNA, 31 nt, Human
ccagcccgaaugacggcaucuguuugccaug

SEQ ID NO: 91557 - RNA, 27 nt, Human
agguacuuggauaauaaugaaauaaaa

SEQ ID NO: 91558 - RNA, 25 nt, Human
gagaggaggagggaggcugucagga

SEQ ID NO: 91559 - RNA, 21 nt, Human
ugucugugucauuaugugugc

SEQ ID NO: 91560 - RNA, 24 nt, Human
ccuauuuuccuguucugcagcccc

SEQ ID NO: 91561 - RNA, 22 nt, Human
aagacuccagaccuuuuguuuu

SEQ ID NO: 91562 - RNA, 25 nt, Human
uugcccucucgccaggcuggagugu

SEQ ID NO: 91563 - RNA, 18 nt, Human
cuugcccagccuggggga

SEQ ID NO: 91564 - RNA, 19 nt, Human
aguuagacacauacauacc

SEQ ID NO: 91565 - RNA, 21 nt, Human
acuggaaaugagugggcuagg

SEQ ID NO: 91566 - RNA, 27 nt, Human
ucucuguaccuuccucuccauuuugcu

SEQ ID NO: 91567 - RNA, 22 nt, Human
cugcucugcaagcccacuggcc

SEQ ID NO: 91568 - RNA, 22 nt, Human
agggcacagcugcccugcugcc

SEQ ID NO: 91569 - RNA, 22 nt, Human
acucaugacuccuuucucuaaa

SEQ ID NO: 91570 - RNA, 22 nt, Human
auauuaaaaauaggugugauuu

SEQ ID NO: 91571 - RNA, 27 nt, Human
caucccuguuggcaguaaaucuuccca

SEQ ID NO: 91572 - RNA, 27 nt, Human
gggaauaguauagacaauaaggaagga

SEQ ID NO: 91573 - RNA, 21 nt, Human
gucccuaucccacaccugccu

SEQ ID NO: 91574 - RNA, 27 nt, Human
gaguuugaaggauguuuauauagggua

SEQ ID NO: 91575 - RNA, 20 nt, Human
acacacacccauaccucuca

SEQ ID NO: 91576 - RNA, 27 nt, Human
cagggagaccuggacacaggccugcuc

SEQ ID NO: 91577 - RNA, 32 nt, Human
ucccugcaccacucucuucauccugggggcuc

SEQ ID NO: 91578 - RNA, 24 nt, Human
caguguguuagcucugucuuagca

SEQ ID NO: 91579 - RNA, 22 nt, Human
cuguucuccuuguucuguucug

SEQ ID NO: 91580 - RNA, 21 nt, Human
caguucuggcagugggcggcu

SEQ ID NO: 91581 - RNA, 22 nt, Human
uucauuugggaugcuacucuag

SEQ ID NO: 91582 - RNA, 22 nt, Human
gaguuugauccaugaaccuggc

SEQ ID NO: 91583 - RNA, 23 nt, Human
uucuacugaauggggguggaccu

SEQ ID NO: 91584 - RNA, 18 nt, Human
ugcgagaguguguuuccu

SEQ ID NO: 91585 - RNA, 17 nt, Human
gcagugcugcuuugcca

SEQ ID NO: 91586 - RNA, 22 nt, Human
caguggguucuggagggagggu

SEQ ID NO: 91587 - RNA, 18 nt, Human
caaguugacaacagcaga

SEQ ID NO: 91588 - RNA, 27 nt, Human
ggucaucugacagucucuacgcuguga

SEQ ID NO: 91589 - RNA, 20 nt, Human
cucaugacccuccuguccag

SEQ ID NO: 91590 - RNA, 21 nt, Human
uugccuugguuauuauggaug

SEQ ID NO: 91591 - RNA, 25 nt, Human
agccuguuuauuagcagcugccauu

SEQ ID NO: 91592 - RNA, 26 nt, Human
ucaagauaaaugcagaaaauguuuag

SEQ ID NO: 91593 - RNA, 26 nt, Human
gccaugguucacacauaugacacacu

SEQ ID NO: 91594 - RNA, 23 nt, Human
ugggugaauggggagaccagaaa

SEQ ID NO: 91595 - RNA, 21 nt, Human
ucugucauccugcuaguuugu

SEQ ID NO: 91596 - RNA, 22 nt, Human
ccauuuuuguuuuaauagggac

SEQ ID NO: 91597 - RNA, 23 nt, Human
ggaacucacgccuccaaucccag

SEQ ID NO: 91598 - RNA, 20 nt, Human
auauuuaagugucuguuaua

SEQ ID NO: 91599 - RNA, 25 nt, Human
acacagugcuuuuuaccacugugga

SEQ ID NO: 91600 - RNA, 20 nt, Human
uggucagcucucagcaaggc

SEQ ID NO: 91601 - RNA, 21 nt, Human
ccugcugcacccucaccaccc

SEQ ID NO: 91602 - RNA, 22 nt, Human
ucuuugcacaaauaaacaguga

SEQ ID NO: 91603 - RNA, 27 nt, Human
gcuggagcacucagagcuucccugacu

SEQ ID NO: 91604 - RNA, 24 nt, Human
cugagucuugaaccacagaaggga

SEQ ID NO: 91605 - RNA, 29 nt, Human
agucuaggaguuagaaaugaauuuuuuag

SEQ ID NO: 91606 - RNA, 22 nt, Human
gguuccauccaccaccuugcca

SEQ ID NO: 91607 - RNA, 27 nt, Human
uggcugcugacucagcggucauucuac

SEQ ID NO: 91608 - RNA, 26 nt, Human
ggagaggugaaagcaaagacugcuuu

SEQ ID NO: 91609 - RNA, 24 nt, Human
cccuucuccccuuccugguagacc

SEQ ID NO: 91610 - RNA, 19 nt, Human
cuucugcccugccuccucc

SEQ ID NO: 91611 - RNA, 21 nt, Human
ccuauuugccagagaacaucu

SEQ ID NO: 91612 - RNA, 20 nt, Human
agagucuugguuucucucua

SEQ ID NO: 91613 - RNA, 26 nt, Human
gggggcucuccuggcaagucaggaag

SEQ ID NO: 91614 - RNA, 19 nt, Human
gccgaaagcggagcucgaa

SEQ ID NO: 91615 - RNA, 22 nt, Human
aagaaacguacuuaacugugug

SEQ ID NO: 91616 - RNA, 23 nt, Human
cccaccccgucuggggccugccc

SEQ ID NO: 91617 - RNA, 19 nt, Human
cagacccacacacauacac

SEQ ID NO: 91618 - RNA, 21 nt, Human
aaguucucgcuuccuccuuug

SEQ ID NO: 91619 - RNA, 23 nt, Human
agggcuguacauccagcuacaga

SEQ ID NO: 91620 - RNA, 19 nt, Human
ggggcuuucucagccccac

SEQ ID NO: 91621 - RNA, 20 nt, Human
cagauguugucuuuaacucu

SEQ ID NO: 91622 - RNA, 25 nt, Human
cacugggcucagccugggcauuaaa

SEQ ID NO: 91623 - RNA, 23 nt, Human
ggggaguuaucaugauggugcug

SEQ ID NO: 91624 - RNA, 27 nt, Human
aaauguucuuuagaugguggcacauuc

SEQ ID NO: 91625 - RNA, 27 nt, Human
uucuaauucuuuuucaucuauuugcac

SEQ ID NO: 91626 - RNA, 26 nt, Human
gaauuuuugaaagguagucaaacuuc

SEQ ID NO: 91627 - RNA, 27 nt, Human
gggcaguucauuccaaauccagcacug

SEQ ID NO: 91628 - RNA, 22 nt, Human
cugaugcaugagaauugcuuga

SEQ ID NO: 91629 - RNA, 22 nt, Human
gggagggagaagaaacgccugc

SEQ ID NO: 91630 - RNA, 22 nt, Human
gcgcccgccaccaugcccggcu

SEQ ID NO: 91631 - RNA, 25 nt, Human
acuggccgagcugccccgccuucuc

SEQ ID NO: 91632 - RNA, 20 nt, Human
ucccaaaacugauacccuuu

SEQ ID NO: 91633 - RNA, 27 nt, Human
uggggacugccuggugaacacagaugu

SEQ ID NO: 91634 - RNA, 25 nt, Human
uggggagcuuuguguuggaugguca

SEQ ID NO: 91635 - RNA, 24 nt, Human
uuugcuuuggugaaggacacgugu

SEQ ID NO: 91636 - RNA, 21 nt, Human
cuauccuggccacacugaggu

SEQ ID NO: 91637 - RNA, 21 nt, Human
ccuuggcgagggcagguucca

SEQ ID NO: 91638 - RNA, 22 nt, Human
ucucugccucugcaacagggca

SEQ ID NO: 91639 - RNA, 19 nt, Human
ggggcaaaagcaaucuucu

SEQ ID NO: 91640 - RNA, 23 nt, Human
gggagggaaggagagggagggug

SEQ ID NO: 91641 - RNA, 22 nt, Human
cucuccaggacugccaggcugc

SEQ ID NO: 91642 - RNA, 22 nt, Human
cugcaacccugccaggcuggga

SEQ ID NO: 91643 - RNA, 22 nt, Human
ccagaguauuuuuguuaauaaa

SEQ ID NO: 91644 - RNA, 17 nt, Human
ggcugagaaucagagac

SEQ ID NO: 91645 - RNA, 26 nt, Human
caccucuucuuuucuugguauuucug

SEQ ID NO: 91646 - RNA, 27 nt, Human
gguacaguuucaggagcgugaaggacu

SEQ ID NO: 91647 - RNA, 23 nt, Human
ugccuguagucccagcuacucug

SEQ ID NO: 91648 - RNA, 22 nt, Human
cucuuccaaaccacaugggaga

SEQ ID NO: 91649 - RNA, 21 nt, Human
cccccugaggaccucaggagg

SEQ ID NO: 91650 - RNA, 16 nt, Human
ccgagacuggagccua

SEQ ID NO: 91651 - RNA, 18 nt, Human
auuacucagcagugcagu

SEQ ID NO: 91652 - RNA, 27 nt, Human
ggggcuccacuccacagccaaggguaa

SEQ ID NO: 91653 - RNA, 28 nt, Human
gaggugggauagaggaagggagguuuga

SEQ ID NO: 91654 - RNA, 21 nt, Human
acacacaguauacacauacac

SEQ ID NO: 91655 - RNA, 25 nt, Human
ucugcacuccagcccaggacugugg

SEQ ID NO: 91656 - RNA, 28 nt, Human
gcgguuuccuguaccugccuugggaucc

SEQ ID NO: 91657 - RNA, 22 nt, Human
uuuguugcccaggcuggggugc

SEQ ID NO: 91658 - RNA, 27 nt, Human
gggguggaaugcaugugugggggcaga

SEQ ID NO: 91659 - RNA, 26 nt, Human
gcuggguggggacagugauaggccca

SEQ ID NO: 91660 - RNA, 25 nt, Human
uuucccccucucccuccccaauggc

SEQ ID NO: 91661 - RNA, 22 nt, Human
agugcugugcugugcuauggug

SEQ ID NO: 91662 - RNA, 28 nt, Human
ggcgcaaaaguagagcugucaagauggg

SEQ ID NO: 91663 - RNA, 27 nt, Human
caggcuggagugcaguggugagaucuc

SEQ ID NO: 91664 - RNA, 22 nt, Human
gccacugcgcccggcugagugu

SEQ ID NO: 91665 - RNA, 24 nt, Human
uuggguggaggauggacgagugag

SEQ ID NO: 91666 - RNA, 20 nt, Human
uggccaggcuggagugcagu

SEQ ID NO: 91667 - RNA, 30 nt, Human
ggcucacuacaaccucugccucccggguuc

SEQ ID NO: 91668 - RNA, 21 nt, Human
aaagcuauucugaugaugauu

SEQ ID NO: 91669 - RNA, 27 nt, Human
ggacugggucagagagcagggaguggc

SEQ ID NO: 91670 - RNA, 21 nt, Human
uaguucugcaaauacuuuguc

SEQ ID NO: 91671 - RNA, 27 nt, Human
ggugaagcucagagaagggucggaucu

SEQ ID NO: 91672 - RNA, 27 nt, Human
uuacucuugucacccaggcuggagugc

SEQ ID NO: 91673 - RNA, 22 nt, Human
gucacccaggcuggagcacacu

SEQ ID NO: 91674 - RNA, 26 nt, Human
cagccuauagaugaugauguguuugg

SEQ ID NO: 91675 - RNA, 22 nt, Human
uccuccuuuccuccucugacuu

SEQ ID NO: 91676 - RNA, 29 nt, Human
aauuaugcuguuaaaacuacuuuagguga

SEQ ID NO: 91677 - RNA, 22 nt, Human
cagcccaggcaauaguguugag

SEQ ID NO: 91678 - RNA, 31 nt, Human
cagcccggccacccacuccccgugccgccca

SEQ ID NO: 91679 - RNA, 20 nt, Human
aaacuuaugcagagcacuuu

SEQ ID NO: 91680 - RNA, 22 nt, Human
gccuuucucaccgugcgacgcc

SEQ ID NO: 91681 - RNA, 24 nt, Human
ccagcagagcuggaggagggggug

SEQ ID NO: 91682 - RNA, 27 nt, Human
uaaguuuaacaguuuugcauuacaggc

SEQ ID NO: 91683 - RNA, 22 nt, Human
ugccuuuuaauaguguaauauc

SEQ ID NO: 91684 - RNA, 23 nt, Human
uacacaguggacugaagugcaau

SEQ ID NO: 91685 - RNA, 21 nt, Human
acugugugcuaaaacaagcac

SEQ ID NO: 91686 - RNA, 22 nt, Human
augaaaccaggccauagcuguc

SEQ ID NO: 91687 - RNA, 21 nt, Human
ugcuuccuggcgcacgcggag

SEQ ID NO: 91688 - RNA, 20 nt, Human
cugagcuaccuggggugggg

SEQ ID NO: 91689 - RNA, 23 nt, Human
guguucacugcuccuugcugcau

SEQ ID NO: 91690 - RNA, 22 nt, Human
ccgcccaggcuggacugcagug

SEQ ID NO: 91691 - RNA, 23 nt, Human
cacccaggaggugcgaguguggc

SEQ ID NO: 91692 - RNA, 29 nt, Human
ccugcuguguguccuguuccauguuccgg

SEQ ID NO: 91693 - RNA, 24 nt, Human
aggccggagagcuggugacuuugg

SEQ ID NO: 91694 - RNA, 17 nt, Human
ggcaaagcccgcauaau

SEQ ID NO: 91695 - RNA, 19 nt, Human
acagacaccuuccacucug

SEQ ID NO: 91696 - RNA, 19 nt, Human
uacacacccccaagccaca

SEQ ID NO: 91697 - RNA, 17 nt, Human
cugucucuuccaugccg

SEQ ID NO: 91698 - RNA, 22 nt, Human
ggauacacucucuagcuuuagg

SEQ ID NO: 91699 - RNA, 19 nt, Human
agcucaguucuuagcaaca

SEQ ID NO: 91700 - RNA, 26 nt, Human
uuucaguuuuuccaucaugagaugaa

SEQ ID NO: 91701 - RNA, 25 nt, Human
aagagacucuuguagcagugguuac

SEQ ID NO: 91702 - RNA, 27 nt, Human
ugaguuuaguuucucuccuaaaaugaa

SEQ ID NO: 91703 - RNA, 22 nt, Human
cccaagcaccugggauuacaag

SEQ ID NO: 91704 - RNA, 25 nt, Human
caccacugcacuccagccuggggac

SEQ ID NO: 91705 - RNA, 21 nt, Human
gggggaagagggugguucagc

SEQ ID NO: 91706 - RNA, 20 nt, Human
gugucugucagugagcgggc

SEQ ID NO: 91707 - RNA, 21 nt, Human
aaaugagagaaacaaaauggg

SEQ ID NO: 91708 - RNA, 23 nt, Human
ugucugugccaucucuguuuccc

SEQ ID NO: 91709 - RNA, 21 nt, Human
ccucacugcaaccuccgccuc

SEQ ID NO: 91710 - RNA, 20 nt, Human
gagucuauugaaacugcaaa

SEQ ID NO: 91711 - RNA, 21 nt, Human
caaaacccacagcacucagaa

SEQ ID NO: 91712 - RNA, 23 nt, Human
cugagcuuuuuaucuuacaccau

SEQ ID NO: 91713 - RNA, 22 nt, Human
gaauaauaaauuuugacacuga

SEQ ID NO: 91714 - RNA, 25 nt, Human
ccugagugaggauuacaugcccauc

SEQ ID NO: 91715 - RNA, 24 nt, Human
uaaaccugcuugcuuccuaccaca

SEQ ID NO: 91716 - RNA, 23 nt, Human
cacccugauuuuacacacauuaa

SEQ ID NO: 91717 - RNA, 22 nt, Human
gggguugggguuucugccacuu

SEQ ID NO: 91718 - RNA, 30 nt, Human
aacucaaacuuuuccccuguccugaugguc

SEQ ID NO: 91719 - RNA, 30 nt, Human
auggcaucgcccuguccugccuuggccaga

SEQ ID NO: 91720 - RNA, 23 nt, Human
guucaugaagguccuagcuuuau

SEQ ID NO: 91721 - RNA, 18 nt, Human
agacccacaaggccaggu

SEQ ID NO: 91722 - RNA, 20 nt, Human
acucuugucgcccaggcugg

SEQ ID NO: 91723 - RNA, 26 nt, Human
ccuguuucuccuggcccugggugggc

SEQ ID NO: 91724 - RNA, 20 nt, Human
uccagagacuaaggaagggg

SEQ ID NO: 91725 - RNA, 21 nt, Human
ugcuuuuguuaaaagcuuuau

SEQ ID NO: 91726 - RNA, 22 nt, Human
gggccaaggcaggcuggaucac

SEQ ID NO: 91727 - RNA, 27 nt, Human
gaccagccugaccaacauggagaaacc

SEQ ID NO: 91728 - RNA, 22 nt, Human
gacagggaauugcggugugaga

SEQ ID NO: 91729 - RNA, 19 nt, Human
ccuggagugugaccgcgcc

SEQ ID NO: 91730 - RNA, 26 nt, Human
ugaugaagcugcccagaagugccuug

SEQ ID NO: 91731 - RNA, 27 nt, Human
gggcuguaacguggcacugguagguug

SEQ ID NO: 91732 - RNA, 22 nt, Human
agccucccaaauagcuggggcu

SEQ ID NO: 91733 - RNA, 23 nt, Human
cuuccuugaaugucaguguguaa

SEQ ID NO: 91734 - RNA, 26 nt, Human
ugagcuaagaucacaucacugcacuc

SEQ ID NO: 91735 - RNA, 22 nt, Human
ccaggccuggccgugcccgcuc

SEQ ID NO: 91736 - RNA, 21 nt, Human
cuucaguccuucuacuguccu

SEQ ID NO: 91737 - RNA, 22 nt, Human
auacuagauguuaagguuguua

SEQ ID NO: 91738 - RNA, 18 nt, Human
ccuguucucuuugccuug

SEQ ID NO: 91739 - RNA, 22 nt, Human
gugggcgccuguaaucccaguu

SEQ ID NO: 91740 - RNA, 26 nt, Human
gaucuacagaacaagaaucucugcua

SEQ ID NO: 91741 - RNA, 22 nt, Human
uauugcacuccagccugggcga

SEQ ID NO: 91742 - RNA, 24 nt, Human
cagucucugcugaucacaugugcc

SEQ ID NO: 91743 - RNA, 26 nt, Human
gacucugaaaccucaagcugucuacu

SEQ ID NO: 91744 - RNA, 26 nt, Human
ugagacugagaagagagccagccacg

SEQ ID NO: 91745 - RNA, 23 nt, Human
acaggauaugggcuaccaggaag

SEQ ID NO: 91746 - RNA, 27 nt, Human
uuggucugagccacuguugucuguaaa

SEQ ID NO: 91747 - RNA, 26 nt, Human
uccuaugcucacccagagaacucucu

SEQ ID NO: 91748 - RNA, 21 nt, Human
aggcaugcugaacaaggggcc

SEQ ID NO: 91749 - RNA, 27 nt, Human
auauauauugauauguauuacacuuac

SEQ ID NO: 91750 - RNA, 18 nt, Human
uccacucuggagugaagu

SEQ ID NO: 91751 - RNA, 22 nt, Human
uaccccccaggcugaagugcag

SEQ ID NO: 91752 - RNA, 22 nt, Human
uggaaccauuacgcccaggguu

SEQ ID NO: 91753 - RNA, 26 nt, Human
ccaaguagcugggacuacaguugugc

SEQ ID NO: 91754 - RNA, 27 nt, Human
aagcagagcacucacacauaaauggcu

SEQ ID NO: 91755 - RNA, 25 nt, Human
ucguguguugccauuuugucuggcu

SEQ ID NO: 91756 - RNA, 23 nt, Human
ucagcucuguccuguuaggccaa

SEQ ID NO: 91757 - RNA, 21 nt, Human
accaugucagacgcagccgua

SEQ ID NO: 91758 - RNA, 23 nt, Human
uuccaguuuuauuagcuugcucu

SEQ ID NO: 91759 - RNA, 27 nt, Human
cccagugcuugcccugccugccaggaa

SEQ ID NO: 91760 - RNA, 27 nt, Human
uuuaccuccucuucugaucacuuccag

SEQ ID NO: 91761 - RNA, 22 nt, Human
ugggauaaagcaagaagacuga

SEQ ID NO: 91762 - RNA, 26 nt, Human
gccuguaaucccagcuacaccugagg

SEQ ID NO: 91763 - RNA, 22 nt, Human
aauauaacucugcagacuugcu

SEQ ID NO: 91764 - RNA, 30 nt, Human
cccucccacucugggcucaggcugucccug

SEQ ID NO: 91765 - RNA, 21 nt, Human
gcugagcgccaggccugggga

SEQ ID NO: 91766 - RNA, 22 nt, Human
ggcccuaggcagcuuguugacu

SEQ ID NO: 91767 - RNA, 23 nt, Human
uuuuuaauaauagccauucucau

SEQ ID NO: 91768 - RNA, 22 nt, Human
auggaaauucuaguuuguuaga

SEQ ID NO: 91769 - RNA, 21 nt, Human
ugggaggccucucugggcugg

SEQ ID NO: 91770 - RNA, 21 nt, Human
gcacauuuaaauaaaauguuu

SEQ ID NO: 91771 - RNA, 19 nt, Human
uggagguggaagacaguga

SEQ ID NO: 91772 - RNA, 17 nt, Human
ccugccucgugccaccu

SEQ ID NO: 91773 - RNA, 19 nt, Human
uucagcagcuguggggagg

SEQ ID NO: 91774 - RNA, 20 nt, Human
ugggagguggggccuuagug

SEQ ID NO: 91775 - RNA, 20 nt, Human
guguucaaagaguccugguc

SEQ ID NO: 91776 - RNA, 19 nt, Human
ucauuaaccacacaguccu

SEQ ID NO: 91777 - RNA, 19 nt, Human
uucuaaaguuuaauuugga

SEQ ID NO: 91778 - RNA, 22 nt, Human
gaaggaugccugggugccaggc

SEQ ID NO: 91779 - RNA, 21 nt, Human
ccugguaucuuaguguggacc

SEQ ID NO: 91780 - RNA, 27 nt, Human
uacuaaauuuuauuucuuuauuugcaa

SEQ ID NO: 91781 - RNA, 21 nt, Human
cccuucagcaacuuauuuugc

SEQ ID NO: 91782 - RNA, 23 nt, Human
gccacuguaaacagcaagcaguu

SEQ ID NO: 91783 - RNA, 12 nt, Human
gccaaugccuuu

SEQ ID NO: 91784 - RNA, 22 nt, Human
gaaggugaccucacaguacugg

SEQ ID NO: 91785 - RNA, 22 nt, Human
cugauuccaguuugccucucuc

SEQ ID NO: 91786 - RNA, 21 nt, Human
ugcucagugcaaccucugccu

SEQ ID NO: 91787 - RNA, 26 nt, Human
cugcugucuggugcccugugagcugu

SEQ ID NO: 91788 - RNA, 26 nt, Human
ccugaauccuguucucugacauccgu

SEQ ID NO: 91789 - RNA, 27 nt, Human
ggccgggcacaguagcucacgccugua

SEQ ID NO: 91790 - RNA, 19 nt, Human
cacuuccucccucccgauu

SEQ ID NO: 91791 - RNA, 23 nt, Human
aaugcagacaacaccuuccuccu

SEQ ID NO: 91792 - RNA, 22 nt, Human
gagcccaauuauucauucuccc

SEQ ID NO: 91793 - RNA, 23 nt, Human
gcugggucuaggcuguucugugc

SEQ ID NO: 91794 - RNA, 18 nt, Human
uucaaagcucucucccaa

SEQ ID NO: 91795 - RNA, 23 nt, Human
uaugggguuucgccauguuggcc

SEQ ID NO: 91796 - RNA, 21 nt, Human
ggaaucucaguagcugggaau

SEQ ID NO: 91797 - RNA, 22 nt, Human
ugcaaccucugccuccugggcu

SEQ ID NO: 91798 - RNA, 22 nt, Human
uagggggcacucauuuuguuuc

SEQ ID NO: 91799 - RNA, 20 nt, Human
gccggucauaccacagccuu

SEQ ID NO: 91800 - RNA, 25 nt, Human
caccuuaaagacuucugucauuuua

SEQ ID NO: 91801 - RNA, 23 nt, Human
ugaauccuucaguuaacugcuuu

SEQ ID NO: 91802 - RNA, 22 nt, Human
aggcccucagcugucgggggcc

SEQ ID NO: 91803 - RNA, 22 nt, Human
cgggccucagccucccaucucc

SEQ ID NO: 91804 - RNA, 19 nt, Human
ccaugaucgacccuccucg

SEQ ID NO: 91805 - RNA, 23 nt, Human
gacgggguuucacuguguuggcc

SEQ ID NO: 91806 - RNA, 19 nt, Human
cuucugcugcccacucacu

SEQ ID NO: 91807 - RNA, 20 nt, Human
aggguccagguuucacacuu

SEQ ID NO: 91808 - RNA, 22 nt, Human
cccucuguuauucauucaucaa

SEQ ID NO: 91809 - RNA, 17 nt, Human
aaagaacaaaagaaaug

SEQ ID NO: 91810 - RNA, 21 nt, Human
guuaacuuggaaaucaguaga

SEQ ID NO: 91811 - RNA, 31 nt, Human
gcuuuauuuggaaagcagugugcauaucuug

SEQ ID NO: 91812 - RNA, 23 nt, Human
ucugaaacuggcaaacacaaagg

SEQ ID NO: 91813 - RNA, 19 nt, Human
acuuucucccucaucggcc

SEQ ID NO: 91814 - RNA, 23 nt, Human
cccucucgcuccuuccuuuccgg

SEQ ID NO: 91815 - RNA, 27 nt, Human
gaauuuuauacuguuuucuacuuuucc

SEQ ID NO: 91816 - RNA, 23 nt, Human
cccagaaacaacaggggaaacua

SEQ ID NO: 91817 - RNA, 21 nt, Human
ccaaguccaaacccuuuuuag

SEQ ID NO: 91818 - RNA, 19 nt, Human
ccgggagguugaggcugca

SEQ ID NO: 91819 - RNA, 19 nt, Human
cuaggaggucaaggcugca

SEQ ID NO: 91820 - RNA, 25 nt, Human
gugguuguucauucucaaacauaga

SEQ ID NO: 91821 - RNA, 22 nt, Human
ggcggauggagugggaagugag

SEQ ID NO: 91822 - RNA, 23 nt, Human
uuguguccaggcuggagugcagu

SEQ ID NO: 91823 - RNA, 21 nt, Human
agaagcagcaaaaugccuuua

SEQ ID NO: 91824 - RNA, 20 nt, Human
aguuggaccuugauauuuau

SEQ ID NO: 91825 - RNA, 20 nt, Human
aaggauucuggaauacauau

SEQ ID NO: 91826 - RNA, 20 nt, Human
cuccacccucuuuagcuguu

SEQ ID NO: 91827 - RNA, 20 nt, Human
auccauucaacaagggugca

SEQ ID NO: 91828 - RNA, 21 nt, Human
cagaaggcaccagugccuaag

SEQ ID NO: 91829 - RNA, 21 nt, Human
gccacucccucccagaaaaac

SEQ ID NO: 91830 - RNA, 22 nt, Human
ggugggcugggguggugccacu

SEQ ID NO: 91831 - RNA, 23 nt, Human
gcucucagcuggcagugcaaugc

SEQ ID NO: 91832 - RNA, 24 nt, Human
uaaacagaucucuacagacuugca

SEQ ID NO: 91833 - RNA, 22 nt, Human
cgugcaccccaucaucacugga

SEQ ID NO: 91834 - RNA, 25 nt, Human
agcuuagaggagugaaauguuuuga

SEQ ID NO: 91835 - RNA, 26 nt, Human
uugggagcugguuauugguguggucc

SEQ ID NO: 91836 - RNA, 22 nt, Human
caguaggggcgggaggaaaggc

SEQ ID NO: 91837 - RNA, 25 nt, Human
cuccaaucagagcguggaggcgagu

SEQ ID NO: 91838 - RNA, 23 nt, Human
auuauccacucaugcuucuccua

SEQ ID NO: 91839 - RNA, 21 nt, Human
gugaucuuuuaggccaaggaa

SEQ ID NO: 91840 - RNA, 25 nt, Human
agggacacaacaaaauuuaagaaug

SEQ ID NO: 91841 - RNA, 21 nt, Human
gcucacauaucugucauuuga

SEQ ID NO: 91842 - RNA, 26 nt, Human
ugauucagacuggaguggauaggaua

SEQ ID NO: 91843 - RNA, 27 nt, Human
ggaggcugagacaggagaaucucuuga

SEQ ID NO: 91844 - RNA, 27 nt, Human
ggaggcugaggcaugagaaucgcuugg

SEQ ID NO: 91845 - RNA, 23 nt, Human
accucauucaucacuuggacaca

SEQ ID NO: 91846 - RNA, 22 nt, Human
cugggagguugugguugcagug

SEQ ID NO: 91847 - RNA, 22 nt, Human
cugaguuugaaggauguuuaua

SEQ ID NO: 91848 - RNA, 25 nt, Human
gcugcugcugcgcccuuaccuuccc

SEQ ID NO: 91849 - RNA, 22 nt, Human
cugcaaccuccaccucccaggu

SEQ ID NO: 91850 - RNA, 22 nt, Human
ccacaaccuccaccuccugggu

SEQ ID NO: 91851 - RNA, 22 nt, Human
agcugaaaacuggacacucccu

SEQ ID NO: 91852 - RNA, 27 nt, Human
uaagccuucuugcuuuugauaacacag

SEQ ID NO: 91853 - RNA, 23 nt, Human
ucucuucucugcacuccugccga

SEQ ID NO: 91854 - RNA, 19 nt, Human
cagacaaauucaccuucac

SEQ ID NO: 91855 - RNA, 20 nt, Human
agacucacucuccaucucag

SEQ ID NO: 91856 - RNA, 23 nt, Human
ugaggcaggauaauuuugcuuaa

SEQ ID NO: 91857 - RNA, 25 nt, Human
gacucuuccuagccuuucuaaacca

SEQ ID NO: 91858 - RNA, 24 nt, Human
ccuggauaugccuccacuguggag

SEQ ID NO: 91859 - RNA, 20 nt, Human
caguauuuuguguccuccag

SEQ ID NO: 91860 - RNA, 25 nt, Human
cugggugcugcagauacugcaguga

SEQ ID NO: 91861 - RNA, 21 nt, Human
cucccaggcugaagugcagug

SEQ ID NO: 91862 - RNA, 26 nt, Human
cuucugggacaugguggacagucacc

SEQ ID NO: 91863 - RNA, 22 nt, Human
cugagaucgugcuauugcacuc

SEQ ID NO: 91864 - RNA, 24 nt, Human
cuaucuuucagccuucugccagca

SEQ ID NO: 91865 - RNA, 20 nt, Human
aggaaauauaaacagaggaa

SEQ ID NO: 91866 - RNA, 18 nt, Human
aucaccaucugugccuuu

SEQ ID NO: 91867 - RNA, 27 nt, Human
accgagacaaugauaugcaagugcaaa

SEQ ID NO: 91868 - RNA, 23 nt, Human
agaagauacaauggucccagggg

SEQ ID NO: 91869 - RNA, 26 nt, Human
cuuaagaauacacaggauauuuuggg

SEQ ID NO: 91870 - RNA, 22 nt, Human
agggggauuauaaaacuaauca

SEQ ID NO: 91871 - RNA, 27 nt, Human
gccuuucugucuugcuuccagggggcu

SEQ ID NO: 91872 - RNA, 21 nt, Human
gcgcagacuggcgcgcgcgga

SEQ ID NO: 91873 - RNA, 27 nt, Human
ugccaggacuccucugggcuugcaguc

SEQ ID NO: 91874 - RNA, 23 nt, Human
gaaaggagagaccaauauuugug

SEQ ID NO: 91875 - RNA, 24 nt, Human
acagcuguccccccguccuccucc

SEQ ID NO: 91876 - RNA, 25 nt, Human
gagcccaaguucucgcuaggcuugu

SEQ ID NO: 91877 - RNA, 23 nt, Human
cuuauuucucauuuggauucuua

SEQ ID NO: 91878 - RNA, 28 nt, Human
ugugggggccccaggaauccuuagcuga

SEQ ID NO: 91879 - RNA, 27 nt, Human
uuccagccucagccuacuccgcucacu

SEQ ID NO: 91880 - RNA, 27 nt, Human
ucccacaugaugucaccuccccaucau

SEQ ID NO: 91881 - RNA, 22 nt, Human
ccuggagaagaugggggaggcu

SEQ ID NO: 91882 - RNA, 21 nt, Human
uggaagaagcauccauuaagg

SEQ ID NO: 91883 - RNA, 22 nt, Human
cucggccucccaaaguauuggg

SEQ ID NO: 91884 - RNA, 21 nt, Human
aguaaauauuaugauuuuauu

SEQ ID NO: 91885 - RNA, 22 nt, Human
aagguggacgugcguucugccu

SEQ ID NO: 91886 - RNA, 28 nt, Human
ggcagggggagagccugggcugaacagc

SEQ ID NO: 91887 - RNA, 24 nt, Human
uucucaucuucuuagguaaguuua

SEQ ID NO: 91888 - RNA, 22 nt, Human
uacuccuccccaucauucucca

SEQ ID NO: 91889 - RNA, 21 nt, Human
ccuaagugcugggauugcagg

SEQ ID NO: 91890 - RNA, 24 nt, Human
agcuuuuccucccuuggguucuga

SEQ ID NO: 91891 - RNA, 18 nt, Human
uuguugaccucuuucucu

SEQ ID NO: 91892 - RNA, 22 nt, Human
ggguccccaguguucgcugugu

SEQ ID NO: 91893 - RNA, 28 nt, Human
aauacagaggcauauucuuuuuaaacua

SEQ ID NO: 91894 - RNA, 23 nt, Human
uguaguaauucuguucuggauuu

SEQ ID NO: 91895 - RNA, 20 nt, Human
ggcuccucuccagucugauc

SEQ ID NO: 91896 - RNA, 22 nt, Human
ccgggacgcagagguuacagug

SEQ ID NO: 91897 - RNA, 25 nt, Human
ggguucaagugauucuuccaccuca

SEQ ID NO: 91898 - RNA, 25 nt, Human
ccugggccuggccccacugcccugu

SEQ ID NO: 91899 - RNA, 28 nt, Human
uugguaccccacauaauagugcuaggua

SEQ ID NO: 91900 - RNA, 21 nt, Human
aucucugaggagaagcagcag

SEQ ID NO: 91901 - RNA, 23 nt, Human
ugccuguaauccuagcuacucag

SEQ ID NO: 91902 - RNA, 21 nt, Human
uuaaaaaacacuucaugaaag

SEQ ID NO: 91903 - RNA, 23 nt, Human
ccauccacugcugagaaaucucc

SEQ ID NO: 91904 - RNA, 15 nt, Human
ggcuacuggcauuaa

SEQ ID NO: 91905 - RNA, 27 nt, Human
ggguucaauuucauucuucuucauaug

SEQ ID NO: 91906 - RNA, 21 nt, Human
agacccucuuuagcugugcaa

SEQ ID NO: 91907 - RNA, 21 nt, Human
cgggauaaagagaacuagucu

SEQ ID NO: 91908 - RNA, 27 nt, Human
gcacagccaagaaaaauuacauuccuu

SEQ ID NO: 91909 - RNA, 20 nt, Human
gugcaugccuguagucucag

SEQ ID NO: 91910 - RNA, 24 nt, Human
guucagcagacugguuugcaguga

SEQ ID NO: 91911 - RNA, 21 nt, Human
uggggucugcaaacucccacc

SEQ ID NO: 91912 - RNA, 22 nt, Human
cccugaauccuccucugcucca

SEQ ID NO: 91913 - RNA, 27 nt, Human
ucuggcccuucagcaguuucucuuggc

SEQ ID NO: 91914 - RNA, 22 nt, Human
aggcuuucuuucaugcacuuua

SEQ ID NO: 91915 - RNA, 25 nt, Human
cuguccuuuuaagaauuauuuuacc

SEQ ID NO: 91916 - RNA, 24 nt, Human
ggaggaaguuguggggagauccac

SEQ ID NO: 91917 - RNA, 21 nt, Human
ggaggagauuuuccacaagaa

SEQ ID NO: 91918 - RNA, 23 nt, Human
cucaagcgauucuccugccucag

SEQ ID NO: 91919 - RNA, 22 nt, Human
accagccuguuggacccgcucu

SEQ ID NO: 91920 - RNA, 22 nt, Human
gcccgcuugggauggaggaauc

SEQ ID NO: 91921 - RNA, 27 nt, Human
cuuuggacugaguuuggguucuuugcu

SEQ ID NO: 91922 - RNA, 23 nt, Human
ugguggagccggggagaggaagg

SEQ ID NO: 91923 - RNA, 20 nt, Human
aggugcuuucucaaaggccc

SEQ ID NO: 91924 - RNA, 22 nt, Human
cucaugcaaucuuccugccuca

SEQ ID NO: 91925 - RNA, 22 nt, Human
acacuucacguggacugaggua

SEQ ID NO: 91926 - RNA, 20 nt, Human
uaucucuggcucaaguguuc

SEQ ID NO: 91927 - RNA, 28 nt, Human
gagcagcaugggcuuugaggagcugcug

SEQ ID NO: 91928 - RNA, 22 nt, Human
cacuugaagcuggaggagaaac

SEQ ID NO: 91929 - RNA, 23 nt, Human
ucugagcagagagcagcagcagc

SEQ ID NO: 91930 - RNA, 22 nt, Human
ccguugggagagucucuguucc

SEQ ID NO: 91931 - RNA, 23 nt, Human
cuguaacccagcuauucaagagg

SEQ ID NO: 91932 - RNA, 27 nt, Human
cccagcaccugugcuacagccauguca

SEQ ID NO: 91933 - RNA, 20 nt, Human
ggcugagagaccaggagggc

SEQ ID NO: 91934 - RNA, 19 nt, Human
gagaauguucaucucucca

SEQ ID NO: 91935 - RNA, 20 nt, Human
ccaagagguccaaggcugca

SEQ ID NO: 91936 - RNA, 24 nt, Human
cagaggcugagcaggacguuaggc

SEQ ID NO: 91937 - RNA, 26 nt, Human
ugagcaauuggugaauuuaagcaacc

SEQ ID NO: 91938 - RNA, 20 nt, Human
uuucaggauguggaaacacu

SEQ ID NO: 91939 - RNA, 25 nt, Human
aguuuucucaccucuugcuauugua

SEQ ID NO: 91940 - RNA, 19 nt, Human
ugaggcuggggaaggggaa

SEQ ID NO: 91941 - RNA, 21 nt, Human
ccugcucuuuccucccccgcc

SEQ ID NO: 91942 - RNA, 22 nt, Human
ucuccgaccagacaccuugaca

SEQ ID NO: 91943 - RNA, 22 nt, Human
ugugugcaugugacugugcugg

SEQ ID NO: 91944 - RNA, 21 nt, Human
acuucuccaaaaggacagggc

SEQ ID NO: 91945 - RNA, 23 nt, Human
uuaaauacccaucuucauuaaag

SEQ ID NO: 91946 - RNA, 22 nt, Human
uggccugacucaggaagccagg

SEQ ID NO: 91947 - RNA, 22 nt, Human
aggaaaacgggaccggccaggc

SEQ ID NO: 91948 - RNA, 22 nt, Human
uccagucuccugcacagcaccu

SEQ ID NO: 91949 - RNA, 27 nt, Human
ccgcagccgccugugcugguacgacua

SEQ ID NO: 91950 - RNA, 22 nt, Human
ggcucagagcaaccuccagccu

SEQ ID NO: 91951 - RNA, 23 nt, Human
cccaguagcugggauuacagugu

SEQ ID NO: 91952 - RNA, 17 nt, Human
ccuggggcugcucagcc

SEQ ID NO: 91953 - RNA, 25 nt, Human
cuuaucuguuuccccuuccuuguca

SEQ ID NO: 91954 - RNA, 21 nt, Human
gugcugggugguagauuuccu

SEQ ID NO: 91955 - RNA, 22 nt, Human
ugaacauccuuccuucccaccc

SEQ ID NO: 91956 - RNA, 22 nt, Human
caaaaccucaguuaaacuguga

SEQ ID NO: 91957 - RNA, 19 nt, Human
ucucagcccuaaaccuagg

SEQ ID NO: 91958 - RNA, 20 nt, Human
ugcccaggauggagugcagu

SEQ ID NO: 91959 - RNA, 20 nt, Human
gacuuccgggcucaaguugc

SEQ ID NO: 91960 - RNA, 26 nt, Human
gccaugccgugccaccgucaccagag

SEQ ID NO: 91961 - RNA, 21 nt, Human
ccccacccuccaaucugcacu

SEQ ID NO: 91962 - RNA, 26 nt, Human
ugucuagggugugauuuaggucagua

SEQ ID NO: 91963 - RNA, 25 nt, Human
gggacacaccuguguccuccucacc

SEQ ID NO: 91964 - RNA, 23 nt, Human
caccacugcugaggagucugagg

SEQ ID NO: 91965 - RNA, 28 nt, Human
gcagaguuccuuaccugcccuccgccca

SEQ ID NO: 91966 - RNA, 21 nt, Human
cacuacacaggaggcugaggc

SEQ ID NO: 91967 - RNA, 20 nt, Human
gguggcacugggggcugguc

SEQ ID NO: 91968 - RNA, 19 nt, Human
aucuggaggaaugugagaa

SEQ ID NO: 91969 - RNA, 23 nt, Human
agugcagccacuguuacaauuca

SEQ ID NO: 91970 - RNA, 20 nt, Human
uccuccaggaccucagcugc

SEQ ID NO: 91971 - RNA, 30 nt, Human
guucauuaugacagucacauugcugaugcu

SEQ ID NO: 91972 - RNA, 21 nt, Human
gugaagccucugagggccugg

SEQ ID NO: 91973 - RNA, 22 nt, Human
ccuguucuccggguuuggaaca

SEQ ID NO: 91974 - RNA, 20 nt, Human
gaucugcccagcuuuccagc

SEQ ID NO: 91975 - RNA, 21 nt, Human
ggaaacuuggcuguaacuuca

SEQ ID NO: 91976 - RNA, 24 nt, Human
uguguuugcuuuugcuugcacuga

SEQ ID NO: 91977 - RNA, 23 nt, Human
gcaggauaagaaaaauaggucag

SEQ ID NO: 91978 - RNA, 21 nt, Human
uauguauguauguuucuuauu

SEQ ID NO: 91979 - RNA, 18 nt, Human
ucucugcaaacugccuuc

SEQ ID NO: 91980 - RNA, 21 nt, Human
uuaguccacagucucgcaagg

SEQ ID NO: 91981 - RNA, 22 nt, Human
cacugcccuccagccuggguga

SEQ ID NO: 91982 - RNA, 22 nt, Human
caccacccuccagccugggcaa

SEQ ID NO: 91983 - RNA, 20 nt, Human
gccaguugggccacagccuc

SEQ ID NO: 91984 - RNA, 26 nt, Human
gcuguagagagcagauuucuauggua

SEQ ID NO: 91985 - RNA, 30 nt, Human
ccccacuacauacagagaaacuaucaaccu

SEQ ID NO: 91986 - RNA, 21 nt, Human
cacagcccagcgagggagagg

SEQ ID NO: 91987 - RNA, 22 nt, Human
ccuucgucugugccggcuuauc

SEQ ID NO: 91988 - RNA, 20 nt, Human
uaguuuuugcuuucuguuuu

SEQ ID NO: 91989 - RNA, 27 nt, Human
cuuggacccaccuguggggccugggga

SEQ ID NO: 91990 - RNA, 24 nt, Human
ggagggggaggagcagggcugagc

SEQ ID NO: 91991 - RNA, 32 nt, Human
uuucuuucccuaaccaucauacacuuggcaug

SEQ ID NO: 91992 - RNA, 23 nt, Human
ucaucccaugacuucccuccgau

SEQ ID NO: 91993 - RNA, 19 nt, Human
uuaagacgacagccugcgc

SEQ ID NO: 91994 - RNA, 19 nt, Human
aguggcuuucugauuuuug

SEQ ID NO: 91995 - RNA, 26 nt, Human
ugcuauuguguuauuuuacuacuucu

SEQ ID NO: 91996 - RNA, 19 nt, Human
aagaccugcauuuggcagg

SEQ ID NO: 91997 - RNA, 29 nt, Human
cugcugcggaugcugagugcuggggcggg

SEQ ID NO: 91998 - RNA, 22 nt, Human
ccaggaccagcacucuucuccc

SEQ ID NO: 91999 - RNA, 25 nt, Human
uacaaccagagaacaggauucuucc

SEQ ID NO: 92000 - RNA, 25 nt, Human
uaaucaguucauuagaaauauuuua

SEQ ID NO: 92001 - RNA, 21 nt, Human
aaugagagggcaguguuuccu

SEQ ID NO: 92002 - RNA, 26 nt, Human
uuuauuguuuuccauauuuaaggaaa

SEQ ID NO: 92003 - RNA, 22 nt, Human
ggucucgaacuccugacaucag

SEQ ID NO: 92004 - RNA, 26 nt, Human
ggggaucacuggcuggccugagcaac

SEQ ID NO: 92005 - RNA, 25 nt, Human
cagcuuucaaaucuguugcugcuuu

SEQ ID NO: 92006 - RNA, 23 nt, Human
uucauucugggcagugccagcca

SEQ ID NO: 92007 - RNA, 20 nt, Human
ucagccccacuucucagccu

SEQ ID NO: 92008 - RNA, 21 nt, Human
ucauuuuucuuuucuucuugc

SEQ ID NO: 92009 - RNA, 25 nt, Human
gcccucuccccaccccuuccaauga

SEQ ID NO: 92010 - RNA, 24 nt, Human
aucagcugaugccggaggguuuga

SEQ ID NO: 92011 - RNA, 22 nt, Human
augugauccuuuucucccuccc

SEQ ID NO: 92012 - RNA, 23 nt, Human
gucggccagcugcccagggacgg

SEQ ID NO: 92013 - RNA, 26 nt, Human
aaagcaacaacaagcuucaaggaauu

SEQ ID NO: 92014 - RNA, 30 nt, Human
ucaacaugacagggugaaacuauucccccu

SEQ ID NO: 92015 - RNA, 22 nt, Human
auuuuucuaauauuuagacuuu

SEQ ID NO: 92016 - RNA, 22 nt, Human
ugagccaagauugcacuuguga

SEQ ID NO: 92017 - RNA, 21 nt, Human
uugccucacaauuaugcugug

SEQ ID NO: 92018 - RNA, 24 nt, Human
gggcggcgugguuaggcacaugua

SEQ ID NO: 92019 - RNA, 24 nt, Human
agauucaagacaagagcuguuaug

SEQ ID NO: 92020 - RNA, 23 nt, Human
ccugugaggaagagguugcagug

SEQ ID NO: 92021 - RNA, 26 nt, Human
uuuuaucuucugcucuuucuucuucc

SEQ ID NO: 92022 - RNA, 25 nt, Human
augugggcacaaaaacuaccauucg

SEQ ID NO: 92023 - RNA, 28 nt, Human
ugugggugauauggacagcagaaggggg

SEQ ID NO: 92024 - RNA, 25 nt, Human
agggcuuggggaaagccuguuccuc

SEQ ID NO: 92025 - RNA, 22 nt, Human
gcucucugcaaccucugccucc

SEQ ID NO: 92026 - RNA, 22 nt, Human
cauaaugcuuaaagccauaugg

SEQ ID NO: 92027 - RNA, 21 nt, Human
gccuccgcucuccuguccucg

SEQ ID NO: 92028 - RNA, 19 nt, Human
gggcaggcaccagccaggg

SEQ ID NO: 92029 - RNA, 21 nt, Human
agaaggcagagguuguaguga

SEQ ID NO: 92030 - RNA, 25 nt, Human
uuuucucuucuguucugauuuuguu

SEQ ID NO: 92031 - RNA, 19 nt, Human
accaggcuggagugcagug

SEQ ID NO: 92032 - RNA, 23 nt, Human
caaguagcugggauuacaggcgc

SEQ ID NO: 92033 - RNA, 23 nt, Human
cgaguagcugggauuacgggcgc

SEQ ID NO: 92034 - RNA, 19 nt, Human
gccaggcuagagugcagug

SEQ ID NO: 92035 - RNA, 24 nt, Human
gggagggagauaagaagaccccgc

SEQ ID NO: 92036 - RNA, 20 nt, Human
ugccucugauaagcacuuuu

SEQ ID NO: 92037 - RNA, 20 nt, Human
gugauugguugcauccaggc

SEQ ID NO: 92038 - RNA, 25 nt, Human
augaggccaaagacuuuuccugcca

SEQ ID NO: 92039 - RNA, 27 nt, Human
gggagugagagaaaucaagggagggcu

SEQ ID NO: 92040 - RNA, 22 nt, Human
agagacaggguuucacuguguu

SEQ ID NO: 92041 - RNA, 27 nt, Human
cuggagugcugugaugcgaucucggcu

SEQ ID NO: 92042 - RNA, 23 nt, Human
ccccugccggagccucagacaca

SEQ ID NO: 92043 - RNA, 20 nt, Human
uuccuuugacagaugguauc

SEQ ID NO: 92044 - RNA, 30 nt, Human
uuaccuagaacccuuccugcaguauucaua

SEQ ID NO: 92045 - RNA, 24 nt, Human
gacuccuguuugcucgcuggacca

SEQ ID NO: 92046 - RNA, 22 nt, Human
gguuauaugccucccuugcagc

SEQ ID NO: 92047 - RNA, 27 nt, Human
aaaauacugggauuacaggcuugagcc

SEQ ID NO: 92048 - RNA, 22 nt, Human
agagagggagagcagagaaaga

SEQ ID NO: 92049 - RNA, 23 nt, Human
ggagugagugccuggaacgugaa

SEQ ID NO: 92050 - RNA, 21 nt, Human
ugaagugcugggauuacaggc

SEQ ID NO: 92051 - RNA, 21 nt, Human
uaaaaguaauacacuuccugu

SEQ ID NO: 92052 - RNA, 22 nt, Human
gccgcccaggcuggagugcagu

SEQ ID NO: 92053 - RNA, 27 nt, Human
agcugcaaggcaaacuccauuccucau

SEQ ID NO: 92054 - RNA, 27 nt, Human
guggcuguggggguggcuggugccagu

SEQ ID NO: 92055 - RNA, 22 nt, Human
ggcaggcagguuggugccugac

SEQ ID NO: 92056 - RNA, 26 nt, Human
ucccugccuuugccucacuuuacgca

SEQ ID NO: 92057 - RNA, 23 nt, Human
uucuucuguucuaccaaguuaua

SEQ ID NO: 92058 - RNA, 21 nt, Human
aaacuccuuuguuuagggaca

SEQ ID NO: 92059 - RNA, 26 nt, Human
ugucagcagaaggaaaguacuggacu

SEQ ID NO: 92060 - RNA, 26 nt, Human
ggcagccaaauuguugacacuucuuu

SEQ ID NO: 92061 - RNA, 24 nt, Human
cugcacuguccuuuuucuuccuca

SEQ ID NO: 92062 - RNA, 22 nt, Human
cucaggacugcuauuuagcucc

SEQ ID NO: 92063 - RNA, 28 nt, Human
uugccuucaggcuggaugaggaagucau

SEQ ID NO: 92064 - RNA, 22 nt, Human
augcaaggggucccugggggac

SEQ ID NO: 92065 - RNA, 21 nt, Human
gugagccauagugggccaggc

SEQ ID NO: 92066 - RNA, 23 nt, Human
caggcugguguguaggugguaaa

SEQ ID NO: 92067 - RNA, 22 nt, Human
uucagccugggcaacaagagug

SEQ ID NO: 92068 - RNA, 25 nt, Human
ggcaccgauugggccaacaucagag

SEQ ID NO: 92069 - RNA, 25 nt, Human
cacccaggcgggaguggugcaaugg

SEQ ID NO: 92070 - RNA, 20 nt, Human
uaaauguuaaccaagcagag

SEQ ID NO: 92071 - RNA, 21 nt, Human
ugaccgagcuggagaaagccu

SEQ ID NO: 92072 - RNA, 26 nt, Human
cucagccaacucugaagacaggaugg

SEQ ID NO: 92073 - RNA, 22 nt, Human
ucaugaucucaggauguaugga

SEQ ID NO: 92074 - RNA, 26 nt, Human
acagguugcuuacagcuuugcacccc

SEQ ID NO: 92075 - RNA, 21 nt, Human
cugcaaccaagaggcaagagg

SEQ ID NO: 92076 - RNA, 22 nt, Human
uugugcaggcuggagugcagug

SEQ ID NO: 92077 - RNA, 19 nt, Human
cucagcccugugguuacag

SEQ ID NO: 92078 - RNA, 21 nt, Human
uaaguguguacuaguuuaugg

SEQ ID NO: 92079 - RNA, 22 nt, Human
agcaaaacaaagcugauuuccc

SEQ ID NO: 92080 - RNA, 26 nt, Human
uggggaccucugacacccaaaugccc

SEQ ID NO: 92081 - RNA, 18 nt, Human
aauauguuaugcacagaa

SEQ ID NO: 92082 - RNA, 20 nt, Human
agagacacauucagcagcca

SEQ ID NO: 92083 - RNA, 22 nt, Human
aauggugugaucucagcucacu

SEQ ID NO: 92084 - RNA, 22 nt, Human
aauggcaugaucucggcucacc

SEQ ID NO: 92085 - RNA, 22 nt, Human
ggaaggcaccuucuagaagaga

SEQ ID NO: 92086 - RNA, 23 nt, Human
ccaccugcagccaaaucuggccc

SEQ ID NO: 92087 - RNA, 23 nt, Human
uuuguauaggaguaugcucacuu

SEQ ID NO: 92088 - RNA, 21 nt, Human
cgacucucuccaucagaaggg

SEQ ID NO: 92089 - RNA, 21 nt, Human
uggagggagagguugugcuga

SEQ ID NO: 92090 - RNA, 22 nt, Human
gcugagucuccgccuugcuggg

SEQ ID NO: 92091 - RNA, 20 nt, Human
ucgauuggugucaguaguuu

SEQ ID NO: 92092 - RNA, 19 nt, Human
acagaguucuucaauccaa

SEQ ID NO: 92093 - RNA, 26 nt, Human
cagggugggaggcaggcagcugccug

SEQ ID NO: 92094 - RNA, 25 nt, Human
uugccgugcucuuugaaugcagacu

SEQ ID NO: 92095 - RNA, 20 nt, Human
gcuccuuugggaucauagaa

SEQ ID NO: 92096 - RNA, 21 nt, Human
ucuguggcugauuuacuaaca

SEQ ID NO: 92097 - RNA, 23 nt, Human
uuaccuuucagugcaguuucuuu

SEQ ID NO: 92098 - RNA, 26 nt, Human
gaguuugccacuccccuaaacuccag

SEQ ID NO: 92099 - RNA, 22 nt, Human
ggcuggaggcagggagacacug

SEQ ID NO: 92100 - RNA, 25 nt, Human
ucacaugcucugcucucacguggca

SEQ ID NO: 92101 - RNA, 20 nt, Human
cacguacacacacugucuua

SEQ ID NO: 92102 - RNA, 22 nt, Human
cugaggcagaagaauugaaccc

SEQ ID NO: 92103 - RNA, 17 nt, Human
uggcugaggcagucaua

SEQ ID NO: 92104 - RNA, 21 nt, Human
uuuguuugguuuacacaauau

SEQ ID NO: 92105 - RNA, 20 nt, Human
ugcuucuuaggggcccccgu

SEQ ID NO: 92106 - RNA, 21 nt, Human
agccacagguacagagcccag

SEQ ID NO: 92107 - RNA, 21 nt, Human
cuccccagccgcugcccacuc

SEQ ID NO: 92108 - RNA, 20 nt, Human
ugguggccuguuguggugca

SEQ ID NO: 92109 - RNA, 26 nt, Human
gaaaccagagcuucccucauuuaccu

SEQ ID NO: 92110 - RNA, 22 nt, Human
uccuccuucacaucagaaugga

SEQ ID NO: 92111 - RNA, 24 nt, Human
augaggugcuggggaugacaggaa

SEQ ID NO: 92112 - RNA, 23 nt, Human
guaugagacuuauuuauauuuuu

SEQ ID NO: 92113 - RNA, 26 nt, Human
cauguaugguuacuaaaaaguaccag

SEQ ID NO: 92114 - RNA, 22 nt, Human
ucuuggaaagaaaaccaagcaa

SEQ ID NO: 92115 - RNA, 26 nt, Human
guucacccauggugcccaugucguuc

SEQ ID NO: 92116 - RNA, 21 nt, Human
acucaagucguggccugggga

SEQ ID NO: 92117 - RNA, 22 nt, Human
gagccuggacucagagcucaag

SEQ ID NO: 92118 - RNA, 27 nt, Human
uguuuuaauuucuaaagguaggaccaa

SEQ ID NO: 92119 - RNA, 27 nt, Human
agauuagaagggagcacuugugaucaa

SEQ ID NO: 92120 - RNA, 31 nt, Human
ccagcccccagcaaccaccaaucugcuuucu

SEQ ID NO: 92121 - RNA, 22 nt, Human
gcgccagccaccaugccuggcu

SEQ ID NO: 92122 - RNA, 27 nt, Human
gcuggccuccuaugccucaucaugucc

SEQ ID NO: 92123 - RNA, 26 nt, Human
gcaccaaacacccacauaccuggccc

SEQ ID NO: 92124 - RNA, 27 nt, Human
ucagcacuugcccgucuguauugauug

SEQ ID NO: 92125 - RNA, 24 nt, Human
gcucaggcacugagggccugggga

SEQ ID NO: 92126 - RNA, 22 nt, Human
cugccucucggugaccuccguc

SEQ ID NO: 92127 - RNA, 28 nt, Human
gugucacccacuccugggugcgugcaga

SEQ ID NO: 92128 - RNA, 24 nt, Human
uggaaacauuuaaaugaucaggag

SEQ ID NO: 92129 - RNA, 21 nt, Human
agaguucuggagauggcagcu

SEQ ID NO: 92130 - RNA, 22 nt, Human
ucgcccagucuguaaugcagug

SEQ ID NO: 92131 - RNA, 22 nt, Human
gcugaguuagaauuacucugaa

SEQ ID NO: 92132 - RNA, 26 nt, Human
ggggugagaggcuggugguugccucc

SEQ ID NO: 92133 - RNA, 21 nt, Human
ccuucgccggcucugccuccu

SEQ ID NO: 92134 - RNA, 24 nt, Human
cccagcccugccagggggcugcgg

SEQ ID NO: 92135 - RNA, 21 nt, Human
ucccgcauuucucaugcuucu

SEQ ID NO: 92136 - RNA, 27 nt, Human
ccucaaccuccugcaccaccuccaaga

SEQ ID NO: 92137 - RNA, 24 nt, Human
cgcccgccucugccucccaaggug

SEQ ID NO: 92138 - RNA, 22 nt, Human
gcucccuggcugaggcucaggc

SEQ ID NO: 92139 - RNA, 25 nt, Human
cagaucucccaguaauuuuucuuau

SEQ ID NO: 92140 - RNA, 27 nt, Human
ccugcagccgcucauggcggugaggug

SEQ ID NO: 92141 - RNA, 26 nt, Human
guuccugaauacaagccuaugcguga

SEQ ID NO: 92142 - RNA, 23 nt, Human
auugcaccacugcacuucagcuu

SEQ ID NO: 92143 - RNA, 21 nt, Human
gagacacuguccuuccccuca

SEQ ID NO: 92144 - RNA, 22 nt, Human
ugguuaccugcaauggcugcuu

SEQ ID NO: 92145 - RNA, 23 nt, Human
cuccaccccugucauucacuucc

SEQ ID NO: 92146 - RNA, 21 nt, Human
aacacccuuccuuguccugga

SEQ ID NO: 92147 - RNA, 21 nt, Human
aaagcucuuggauucaucuca

SEQ ID NO: 92148 - RNA, 22 nt, Human
ccugaaaauauucuguuuguga

SEQ ID NO: 92149 - RNA, 19 nt, Human
aggauucuggcugaaggaa

SEQ ID NO: 92150 - RNA, 27 nt, Human
agcccagaucacccauuccggguucac

SEQ ID NO: 92151 - RNA, 26 nt, Human
cucugccccacugccagccugagugg

SEQ ID NO: 92152 - RNA, 21 nt, Human
cauguaaauuuuaaaugggua

SEQ ID NO: 92153 - RNA, 27 nt, Human
ccaaagaggaagccauuagucuccacg

SEQ ID NO: 92154 - RNA, 24 nt, Human
cugcagccacaguguucuguugga

SEQ ID NO: 92155 - RNA, 27 nt, Human
gccagccuggcugagagaugggcugga

SEQ ID NO: 92156 - RNA, 27 nt, Human
agcagcaucugcugaagagacagaaac

SEQ ID NO: 92157 - RNA, 26 nt, Human
cucagggcaucacugaacaaacauuu

SEQ ID NO: 92158 - RNA, 16 nt, Human
aaguuuauagagccag

SEQ ID NO: 92159 - RNA, 26 nt, Human
gucugcagaacuuuguucuguuuucu

SEQ ID NO: 92160 - RNA, 27 nt, Human
agguaucuugugcuuuaauacuuuaug

SEQ ID NO: 92161 - RNA, 18 nt, Human
ccacauccuucuuucucu

SEQ ID NO: 92162 - RNA, 27 nt, Human
aguagcugagacugcaggcacgagcca

SEQ ID NO: 92163 - RNA, 25 nt, Human
agccugguuggccauucucaugccc

SEQ ID NO: 92164 - RNA, 20 nt, Human
gugcagagccccauccacug

SEQ ID NO: 92165 - RNA, 23 nt, Human
gagagguucacuguaguccugaa

SEQ ID NO: 92166 - RNA, 31 nt, Human
agggauagagacgcagauuucagauguaaga

SEQ ID NO: 92167 - RNA, 23 nt, Human
ucggggaggggggaggggguggu

SEQ ID NO: 92168 - RNA, 21 nt, Human
ggcuuugaauuuuaagcaauu

SEQ ID NO: 92169 - RNA, 20 nt, Human
ugccuuuaaaccgcacuuug

SEQ ID NO: 92170 - RNA, 24 nt, Human
ggaagcucugccuuuuugacuuca

SEQ ID NO: 92171 - RNA, 25 nt, Human
ccuuacccuuuccuccuuuaucaca

SEQ ID NO: 92172 - RNA, 22 nt, Human
ugcuuacuacugcagugcauuu

SEQ ID NO: 92173 - RNA, 22 nt, Human
aacaacaacaacaacuuauuua

SEQ ID NO: 92174 - RNA, 27 nt, Human
gggggccaagguggguggaucgcuuga

SEQ ID NO: 92175 - RNA, 24 nt, Human
ugaaauauccaggaauauauguca

SEQ ID NO: 92176 - RNA, 23 nt, Human
ccccugagaagagccagucagau

SEQ ID NO: 92177 - RNA, 27 nt, Human
ucauugugcccauugcucuuucacugc

SEQ ID NO: 92178 - RNA, 22 nt, Human
ggcucugcuccucccggcgcag

SEQ ID NO: 92179 - RNA, 26 nt, Human
gacugagugccuggugcucucgugga

SEQ ID NO: 92180 - RNA, 20 nt, Human
aucuaacuguuguuacugga

SEQ ID NO: 92181 - RNA, 26 nt, Human
agauacaaugaagccauuuucccccu

SEQ ID NO: 92182 - RNA, 20 nt, Human
ugcccuuuaugaugcacuga

SEQ ID NO: 92183 - RNA, 24 nt, Human
gcaggaaagggagggaauagagga

SEQ ID NO: 92184 - RNA, 20 nt, Human
acugccuugguggcuuuguu

SEQ ID NO: 92185 - RNA, 25 nt, Human
ugucuagcuuaaaccuacuaccuca

SEQ ID NO: 92186 - RNA, 22 nt, Human
gccagaggcaucugacagcccu

SEQ ID NO: 92187 - RNA, 18 nt, Human
ggggcacagcugucugcc

SEQ ID NO: 92188 - RNA, 22 nt, Human
aauucaggcuguagacggcgag

SEQ ID NO: 92189 - RNA, 24 nt, Human
cauuaucacauuugauccucccag

SEQ ID NO: 92190 - RNA, 27 nt, Human
guggcaaaugaaagcauaagcuuaagc

SEQ ID NO: 92191 - RNA, 21 nt, Human
uguucagauacaggccaguuu

SEQ ID NO: 92192 - RNA, 22 nt, Human
guuuuuaugucuuugugcauac

SEQ ID NO: 92193 - RNA, 27 nt, Human
ugccaugucacagcauggccucucggc

SEQ ID NO: 92194 - RNA, 23 nt, Human
cccagacaucagccuccuucuuu

SEQ ID NO: 92195 - RNA, 24 nt, Human
uagcaugcauuuuacacacauugg

SEQ ID NO: 92196 - RNA, 25 nt, Human
augccaggccccugccucucacagc

SEQ ID NO: 92197 - RNA, 26 nt, Human
cagagggagagugugcauacagcagc

SEQ ID NO: 92198 - RNA, 19 nt, Human
cgcuucacaggacaggaaa

SEQ ID NO: 92199 - RNA, 27 nt, Human
cccaacugcaccagcacugccuccccc

SEQ ID NO: 92200 - RNA, 24 nt, Human
auuauuccaagaguaucccaguau

SEQ ID NO: 92201 - RNA, 26 nt, Human
gcauaugcaugucucaauuucuaccu

SEQ ID NO: 92202 - RNA, 27 nt, Human
ugcagugaacugagauucugaaacucc

SEQ ID NO: 92203 - RNA, 21 nt, Human
ugacugcccagagacucagag

SEQ ID NO: 92204 - RNA, 27 nt, Human
cugggcgugcuagagguugcagcauga

SEQ ID NO: 92205 - RNA, 27 nt, Human
ccacuguuuuccagccugggcaauaca

SEQ ID NO: 92206 - RNA, 18 nt, Human
gaaauaaaaaugaacuua

SEQ ID NO: 92207 - RNA, 23 nt, Human
ugggcagugccuccugggaccau

SEQ ID NO: 92208 - RNA, 26 nt, Human
caagccccagaacucagacaacagaa

SEQ ID NO: 92209 - RNA, 21 nt, Human
ccugccugccugccugucugc

SEQ ID NO: 92210 - RNA, 19 nt, Human
aaacagagcaugcuuucca

SEQ ID NO: 92211 - RNA, 20 nt, Human
ccaccuacuccauugcuuua

SEQ ID NO: 92212 - RNA, 22 nt, Human
ccggccuggccuugccugcaga

SEQ ID NO: 92213 - RNA, 21 nt, Human
cggagguagagguugugguga

SEQ ID NO: 92214 - RNA, 23 nt, Human
cacaagugucuuauauaugcaga

SEQ ID NO: 92215 - RNA, 24 nt, Human
cacuggagcuggaguggcuggaug

SEQ ID NO: 92216 - RNA, 23 nt, Human
gaacuuccaaaugcugagcccag

SEQ ID NO: 92217 - RNA, 22 nt, Human
gcauuggcaaccccaggggcca

SEQ ID NO: 92218 - RNA, 20 nt, Human
gaucacugcaaaccugccuc

SEQ ID NO: 92219 - RNA, 21 nt, Human
aauugccuccagccugagucc

SEQ ID NO: 92220 - RNA, 21 nt, Human
ugacuuuagaaguggugaaag

SEQ ID NO: 92221 - RNA, 21 nt, Human
acuguaaaccauuucugucaa

SEQ ID NO: 92222 - RNA, 27 nt, Human
uccagcugauaguaguuagaggcuuac

SEQ ID NO: 92223 - RNA, 22 nt, Human
uagccucugcuggagugcagug

SEQ ID NO: 92224 - RNA, 26 nt, Human
gcugggagaggggguagcuagccuga

SEQ ID NO: 92225 - RNA, 23 nt, Human
acggagaagaaguuguagcagag

SEQ ID NO: 92226 - RNA, 23 nt, Human
acugacauuccuccauguccuca

SEQ ID NO: 92227 - RNA, 22 nt, Human
acaccagccugggcaacauagu

SEQ ID NO: 92228 - RNA, 21 nt, Human
uucaguuacaacuguaauguu

SEQ ID NO: 92229 - RNA, 22 nt, Human
uucucaugacugucuuaccucu

SEQ ID NO: 92230 - RNA, 24 nt, Human
gggggagagaauaaaacuccagcg

SEQ ID NO: 92231 - RNA, 25 nt, Human
cccugccacucuccccaagagggcc

SEQ ID NO: 92232 - RNA, 27 nt, Human
gccccaggcaagcagcaccucccugcu

SEQ ID NO: 92233 - RNA, 22 nt, Human
acaggauuuagcauccagggaa

SEQ ID NO: 92234 - RNA, 23 nt, Human
caccagggcuguggaaggguggg

SEQ ID NO: 92235 - RNA, 23 nt, Human
guuguuccugugccguguggacc

SEQ ID NO: 92236 - RNA, 27 nt, Human
cuauacagcuuggcagagaaaauaaau

SEQ ID NO: 92237 - RNA, 22 nt, Human
guucagccgcacccacacccca

SEQ ID NO: 92238 - RNA, 23 nt, Human
caagccuccuguaccucagugga

SEQ ID NO: 92239 - RNA, 20 nt, Human
guucccauuuggaguacagu

SEQ ID NO: 92240 - RNA, 23 nt, Human
acugguccuugggcugggugguu

SEQ ID NO: 92241 - RNA, 23 nt, Human
cacugccugcucccauccugugu

SEQ ID NO: 92242 - RNA, 20 nt, Human
aggaggcugugaaugcugag

SEQ ID NO: 92243 - RNA, 22 nt, Human
gggggcgcagcacggcucagac

SEQ ID NO: 92244 - RNA, 22 nt, Human
cggcucacccuccccuccaucu

SEQ ID NO: 92245 - RNA, 21 nt, Human
cgcccaggcuggaaugcagug

SEQ ID NO: 92246 - RNA, 23 nt, Human
uugcccagaguugggggcuaggg

SEQ ID NO: 92247 - RNA, 22 nt, Human
uggaagcuaaagggcauugcuc

SEQ ID NO: 92248 - RNA, 23 nt, Human
cgcccauucucccucgggucucc

SEQ ID NO: 92249 - RNA, 24 nt, Human
agcauuugacaaagacuugcuugu

SEQ ID NO: 92250 - RNA, 25 nt, Human
cuucugcauuuccucccggagucac

SEQ ID NO: 92251 - RNA, 27 nt, Human
augaaggagcggggguguggcaggcgg

SEQ ID NO: 92252 - RNA, 25 nt, Human
ggagguggcgaggauggggacagaa

SEQ ID NO: 92253 - RNA, 18 nt, Human
guaacuaaaagaaccaua

SEQ ID NO: 92254 - RNA, 23 nt, Human
cacagucgggacagaauucgaug

SEQ ID NO: 92255 - RNA, 25 nt, Human
uccacuccuuccaucucuuccuuca

SEQ ID NO: 92256 - RNA, 22 nt, Human
cugacccagcaaaagaacugag

SEQ ID NO: 92257 - RNA, 22 nt, Human
gcccaggcuggagugcagcagc

SEQ ID NO: 92258 - RNA, 25 nt, Human
uguugcugaccagcuggagugaggg

SEQ ID NO: 92259 - RNA, 21 nt, Human
ugaaggguaggaaaccuggaa

SEQ ID NO: 92260 - RNA, 21 nt, Human
guuuccuggguaccagugggg

SEQ ID NO: 92261 - RNA, 23 nt, Human
uuccuuagcccucccgccuucgg

SEQ ID NO: 92262 - RNA, 24 nt, Human
ugguaaagagcaggaccagaggaa

SEQ ID NO: 92263 - RNA, 20 nt, Human
ugagccaagcacugucauuc

SEQ ID NO: 92264 - RNA, 23 nt, Human
aagaaaccuggggugaauacuua

SEQ ID NO: 92265 - RNA, 22 nt, Human
gaaguauuuuuaguuauauaag

SEQ ID NO: 92266 - RNA, 22 nt, Human
cuccaguuuuguugagaauugu

SEQ ID NO: 92267 - RNA, 22 nt, Human
cuuaaccuugaaauggaaaguc

SEQ ID NO: 92268 - RNA, 25 nt, Human
cuucucacgggcucuaugccugcac

SEQ ID NO: 92269 - RNA, 29 nt, Human
ucacuaucugaaacuaucuuguuguugau

SEQ ID NO: 92270 - RNA, 22 nt, Human
cuuacuuagauguucccugaga

SEQ ID NO: 92271 - RNA, 19 nt, Human
cuccaauguaccagcagcu

SEQ ID NO: 92272 - RNA, 21 nt, Human
gagaacaucuuaaagcauuaa

SEQ ID NO: 92273 - RNA, 24 nt, Human
uucauuuauucauccauccauuca

SEQ ID NO: 92274 - RNA, 20 nt, Human
cuccuuauggagaacuauuu

SEQ ID NO: 92275 - RNA, 19 nt, Human
caaggugaauggugagcag

SEQ ID NO: 92276 - RNA, 23 nt, Human
guuucugcuugcugugccuuguu

SEQ ID NO: 92277 - RNA, 27 nt, Human
gcucauucagcaucugaccucuaccuu

SEQ ID NO: 92278 - RNA, 26 nt, Human
cacaugcucaggcuacuauaggucca

SEQ ID NO: 92279 - RNA, 21 nt, Human
ucuccuucccaccaucauggg

SEQ ID NO: 92280 - RNA, 22 nt, Human
aguggcaggaucucggcucacu

SEQ ID NO: 92281 - RNA, 21 nt, Human
ucccacccucccgcacauacc

SEQ ID NO: 92282 - RNA, 21 nt, Human
uauuauggucuuugugcacau

SEQ ID NO: 92283 - RNA, 22 nt, Human
ucaagaaccgcauaggucucca

SEQ ID NO: 92284 - RNA, 25 nt, Human
ggggugagcucauuucauucucuag

SEQ ID NO: 92285 - RNA, 23 nt, Human
aggcuucugggcucugagaaaua

SEQ ID NO: 92286 - RNA, 23 nt, Human
agccccuggugucacauggggcc

SEQ ID NO: 92287 - RNA, 27 nt, Human
cuuucucagccacaaaauaaauguugg

SEQ ID NO: 92288 - RNA, 25 nt, Human
cauccaguggagcuuucugcaguga

SEQ ID NO: 92289 - RNA, 27 nt, Human
aacuacaguuuucaccauuuguccuca

SEQ ID NO: 92290 - RNA, 27 nt, Human
uaaagagaccaccuucacuuguugaga

SEQ ID NO: 92291 - RNA, 26 nt, Human
gcagccgcccaggcccgcagccucac

SEQ ID NO: 92292 - RNA, 24 nt, Human
gcaaaguuccuaauguguauuuuu

SEQ ID NO: 92293 - RNA, 19 nt, Human
cuuaacggcuccaggauuu

SEQ ID NO: 92294 - RNA, 25 nt, Human
acacugguugacuugaauaggauua

SEQ ID NO: 92295 - RNA, 24 nt, Human
gggagggacggggaggggagccag

SEQ ID NO: 92296 - RNA, 22 nt, Human
acuaguuuucacauuuccuaag

SEQ ID NO: 92297 - RNA, 21 nt, Human
gcccacacccuucuuaaagcg

SEQ ID NO: 92298 - RNA, 20 nt, Human
ugccuaggcuggagugcagu

SEQ ID NO: 92299 - RNA, 19 nt, Human
ggccucggccucggccucc

SEQ ID NO: 92300 - RNA, 24 nt, Human
ggagaaggggcuguggaaugcagc

SEQ ID NO: 92301 - RNA, 22 nt, Human
uaaggcagugcaauacucagua

SEQ ID NO: 92302 - RNA, 32 nt, Human
cugcuuuucaguucccuucccugcuguucuau

SEQ ID NO: 92303 - RNA, 19 nt, Human
ucuccuccuuucucccacg

SEQ ID NO: 92304 - RNA, 20 nt, Human
aagcaaguucugagagccag

SEQ ID NO: 92305 - RNA, 20 nt, Human
ucugcuccugcuucucucuc

SEQ ID NO: 92306 - RNA, 23 nt, Human
aggcuagagugcaguggugcgau

SEQ ID NO: 92307 - RNA, 28 nt, Human
ggggagaagggccucucugccauuucgg

SEQ ID NO: 92308 - RNA, 21 nt, Human
cucuggagagacagaucugaa

SEQ ID NO: 92309 - RNA, 25 nt, Human
uucuuuuccauuccaaagguguacu

SEQ ID NO: 92310 - RNA, 23 nt, Human
gcugcuagaguucugucuggacu

SEQ ID NO: 92311 - RNA, 21 nt, Human
ccgcccagucuggauccuggg

SEQ ID NO: 92312 - RNA, 21 nt, Human
cccagcacucgugcuuguuca

SEQ ID NO: 92313 - RNA, 26 nt, Human
gggaagggaagaggcagucagaggac

SEQ ID NO: 92314 - RNA, 27 nt, Human
ucacagcugccucuuuggcaccuccuc

SEQ ID NO: 92315 - RNA, 21 nt, Human
uaaacaaacaagaggugacca

SEQ ID NO: 92316 - RNA, 23 nt, Human
gccucuguucaguucauucccag

SEQ ID NO: 92317 - RNA, 27 nt, Human
uuccaaguccgugcagcacuaacguau

SEQ ID NO: 92318 - RNA, 25 nt, Human
cuauaguuuccaagguauuauguua

SEQ ID NO: 92319 - RNA, 23 nt, Human
augccucagucaagucagccaaa

SEQ ID NO: 92320 - RNA, 23 nt, Human
gccugcucuccuugcccugggcc

SEQ ID NO: 92321 - RNA, 27 nt, Human
cuggagugcuggauggagccuuucucu

SEQ ID NO: 92322 - RNA, 23 nt, Human
uaaggggugggaaguggguggca

SEQ ID NO: 92323 - RNA, 23 nt, Human
ugaguccuugaagauuuuuguaa

SEQ ID NO: 92324 - RNA, 27 nt, Human
acaagaugaagacugugcucaugguug

SEQ ID NO: 92325 - RNA, 21 nt, Human
gaauuguuuuuguacaguuau

SEQ ID NO: 92326 - RNA, 21 nt, Human
augaugggcucuuggaagcac

SEQ ID NO: 92327 - RNA, 19 nt, Human
cugcuccuccagggccacg

SEQ ID NO: 92328 - RNA, 21 nt, Human
ggagcgugggcucagcagggc

SEQ ID NO: 92329 - RNA, 22 nt, Human
ucccucuucaccuucugaggcc

SEQ ID NO: 92330 - RNA, 20 nt, Human
cccucugcuuucccuuuucc

SEQ ID NO: 92331 - RNA, 24 nt, Human
agcagcagcagcagcagcaguuug

SEQ ID NO: 92332 - RNA, 25 nt, Human
cucuaguucuugcacgcucuuuaag

SEQ ID NO: 92333 - RNA, 24 nt, Human
cagugaggccaagggguccuggcc

SEQ ID NO: 92334 - RNA, 23 nt, Human
gugcuaagcugagcagugcagug

SEQ ID NO: 92335 - RNA, 24 nt, Human
guguuucuuucccaaaaugugccu

SEQ ID NO: 92336 - RNA, 21 nt, Human
cuucccuuaacucuguagccu

SEQ ID NO: 92337 - RNA, 19 nt, Human
cugccucugggcagccugc

SEQ ID NO: 92338 - RNA, 23 nt, Human
cagaaagcuggauuuucugcagu

SEQ ID NO: 92339 - RNA, 24 nt, Human
cagcagugcugaugacaagacuga

SEQ ID NO: 92340 - RNA, 23 nt, Human
ggaccuggaacuuagagacggga

SEQ ID NO: 92341 - RNA, 27 nt, Human
ucccuauucacugugcuuaguagugac

SEQ ID NO: 92342 - RNA, 20 nt, Human
aggauuacauaagggacacu

SEQ ID NO: 92343 - RNA, 24 nt, Human
aagagcccccaagagacaggagag

SEQ ID NO: 92344 - RNA, 26 nt, Human
gaaaccaggggcaauguuuacaagac

SEQ ID NO: 92345 - RNA, 24 nt, Human
ugucauauucguggaaaauucacc

SEQ ID NO: 92346 - RNA, 22 nt, Human
gcgaagguucuuccaccaggac

SEQ ID NO: 92347 - RNA, 20 nt, Human
cccggggcuccucuguccca

SEQ ID NO: 92348 - RNA, 20 nt, Human
uggagguggggguugcuguu

SEQ ID NO: 92349 - RNA, 30 nt, Human
acuggcuucagagcaaaaugagcucgggug

SEQ ID NO: 92350 - RNA, 22 nt, Human
ccggagcagagaggacaugaug

SEQ ID NO: 92351 - RNA, 19 nt, Human
aggccagaggaacagcuuu

SEQ ID NO: 92352 - RNA, 23 nt, Human
gcugcccaggcuggaguacagug

SEQ ID NO: 92353 - RNA, 22 nt, Human
cugaggcacaccagcagcauga

SEQ ID NO: 92354 - RNA, 24 nt, Human
ggcagggaaggacagaguguugga

SEQ ID NO: 92355 - RNA, 17 nt, Human
agacauccuugcaguuu

SEQ ID NO: 92356 - RNA, 22 nt, Human
auuuuauuucagugaacugcug

SEQ ID NO: 92357 - RNA, 23 nt, Human
cuacaucuaaaauauuuucuaca

SEQ ID NO: 92358 - RNA, 23 nt, Human
cgcagccgccgcuccauccccag

SEQ ID NO: 92359 - RNA, 20 nt, Human
aguucuugucugauuggcuc

SEQ ID NO: 92360 - RNA, 22 nt, Human
ugggauuacagacaugagccac

SEQ ID NO: 92361 - RNA, 27 nt, Human
uguauuuuuaguagacacaggguuucu

SEQ ID NO: 92362 - RNA, 26 nt, Human
ccaccauuuucauuugugcaguguau

SEQ ID NO: 92363 - RNA, 25 nt, Human
gcccaggcuggagugcaguggcgug

SEQ ID NO: 92364 - RNA, 20 nt, Human
ccccaacagcacagcuaaau

SEQ ID NO: 92365 - RNA, 24 nt, Human
gaggagaggaggcuucagucucag

SEQ ID NO: 92366 - RNA, 23 nt, Human
acuccugacgugucucauucaca

SEQ ID NO: 92367 - RNA, 31 nt, Human
gcucugucuuauuguuucuucauacuguguc

SEQ ID NO: 92368 - RNA, 26 nt, Human
guccucucucagcuaucacaucacaa

SEQ ID NO: 92369 - RNA, 21 nt, Human
ugagguaccgucuacauuuca

SEQ ID NO: 92370 - RNA, 22 nt, Human
ggcucuaggaucccaaggccca

SEQ ID NO: 92371 - RNA, 23 nt, Human
uuugauagcugugccaggaaggg

SEQ ID NO: 92372 - RNA, 20 nt, Human
gcuggucucuaacuccuggg

SEQ ID NO: 92373 - RNA, 26 nt, Human
gcguucuuucaaugcugacuggacug

SEQ ID NO: 92374 - RNA, 26 nt, Human
cccugcuaucccuccucccauccugu

SEQ ID NO: 92375 - RNA, 21 nt, Human
uucugucuuuaagacucaggg

SEQ ID NO: 92376 - RNA, 24 nt, Human
ugcaaccucaccuuccugugggug

SEQ ID NO: 92377 - RNA, 23 nt, Human
agugugagccucaugaucugcug

SEQ ID NO: 92378 - RNA, 24 nt, Human
gcugucgcaucucagcggggcgca

SEQ ID NO: 92379 - RNA, 21 nt, Human
uugaauuauaccauuuacucu

SEQ ID NO: 92380 - RNA, 19 nt, Human
gcuuccuucugucauuccc

SEQ ID NO: 92381 - RNA, 25 nt, Human
ucucaggauccaaguuuaaaaagaa

SEQ ID NO: 92382 - RNA, 28 nt, Human
ucuccacguacuaccaucuugauuaaau

SEQ ID NO: 92383 - RNA, 21 nt, Human
gguucagaaucaguucccuuu

SEQ ID NO: 92384 - RNA, 19 nt, Human
aaagacaaaaguugaacag

SEQ ID NO: 92385 - RNA, 24 nt, Human
caccccagccaccccagccauccc

SEQ ID NO: 92386 - RNA, 20 nt, Human
agagacaaauucaucuauug

SEQ ID NO: 92387 - RNA, 21 nt, Human
ccuuauugucccaucuguggg

SEQ ID NO: 92388 - RNA, 19 nt, Human
uucaguuaaguauuuugua

SEQ ID NO: 92389 - RNA, 18 nt, Human
acaauaaaaaugacuuug

SEQ ID NO: 92390 - RNA, 27 nt, Human
ccuucacugcuagggaugcucaagggg

SEQ ID NO: 92391 - RNA, 26 nt, Human
cugcccaggacacagugcaggccaga

SEQ ID NO: 92392 - RNA, 21 nt, Human
cucucaagagugcugagaacc

SEQ ID NO: 92393 - RNA, 23 nt, Human
ucuccuccaccucaacuccgugc

SEQ ID NO: 92394 - RNA, 27 nt, Human
ucugaagggaggagucuuucucuugga

SEQ ID NO: 92395 - RNA, 20 nt, Human
uccuggaagugggaacugga

SEQ ID NO: 92396 - RNA, 18 nt, Human
uaggacuagcaacuucau

SEQ ID NO: 92397 - RNA, 22 nt, Human
uuggagccaggaugggucucca

SEQ ID NO: 92398 - RNA, 27 nt, Human
ucaauuugccauugguuucugaaaagu

SEQ ID NO: 92399 - RNA, 22 nt, Human
cgcacucaggaaagugaccagu

SEQ ID NO: 92400 - RNA, 21 nt, Human
ugaguauguuuaaauuauugg

SEQ ID NO: 92401 - RNA, 20 nt, Human
uacgggcucccaacugcugg

SEQ ID NO: 92402 - RNA, 21 nt, Human
caagucaugcuguagagccag

SEQ ID NO: 92403 - RNA, 24 nt, Human
auggucucucccugccaauuuugg

SEQ ID NO: 92404 - RNA, 23 nt, Human
guccggcccuacuucagucugag

SEQ ID NO: 92405 - RNA, 23 nt, Human
uugcccaggcuggucuugaacuc

SEQ ID NO: 92406 - RNA, 20 nt, Human
cuccaaggcuggagugcagu

SEQ ID NO: 92407 - RNA, 21 nt, Human
agccccuccccuccguagcac

SEQ ID NO: 92408 - RNA, 19 nt, Human
cuaagcuggagugcagugg

SEQ ID NO: 92409 - RNA, 26 nt, Human
gcugucacaagagucuagaucaguua

SEQ ID NO: 92410 - RNA, 20 nt, Human
gcucauucugcaccuuucca

SEQ ID NO: 92411 - RNA, 26 nt, Human
acugaaccaggagaucuggcuggggc

SEQ ID NO: 92412 - RNA, 20 nt, Human
gacugauuucagagugacua

SEQ ID NO: 92413 - RNA, 20 nt, Human
ccucacugcagcuggccucu

SEQ ID NO: 92414 - RNA, 23 nt, Human
gccucacccaccccaccugggcc

SEQ ID NO: 92415 - RNA, 19 nt, Human
auacauacucuggguuucc

SEQ ID NO: 92416 - RNA, 24 nt, Human
aggccaucaucaaacaggacagag

SEQ ID NO: 92417 - RNA, 20 nt, Human
cuguggcccaaccuuuuauu

SEQ ID NO: 92418 - RNA, 26 nt, Human
gauguucucuguucaaaaguaauugg

SEQ ID NO: 92419 - RNA, 26 nt, Human
cugaaucugugccugcacugagaggg

SEQ ID NO: 92420 - RNA, 23 nt, Human
cgagauaggucaucagcccaggg

SEQ ID NO: 92421 - RNA, 22 nt, Human
gccgccuccccucuccugggag

SEQ ID NO: 92422 - RNA, 21 nt, Human
ugcugccugggcacacacuuc

SEQ ID NO: 92423 - RNA, 24 nt, Human
uuacugccaccuggcacuggugac

SEQ ID NO: 92424 - RNA, 21 nt, Human
uccuguacauuucacaaaaag

SEQ ID NO: 92425 - RNA, 24 nt, Human
ccaguccuccuaggcaucuuauug

SEQ ID NO: 92426 - RNA, 24 nt, Human
aggcugagaacacccagaacagga

SEQ ID NO: 92427 - RNA, 24 nt, Human
cgccccuccuccagcuuagcuguc

SEQ ID NO: 92428 - RNA, 19 nt, Human
ccgugccccacacucugag

SEQ ID NO: 92429 - RNA, 19 nt, Human
uuccucugcaggacacaga

SEQ ID NO: 92430 - RNA, 32 nt, Human; identical to SEQ ID NO: 5235

SEQ ID NO: 92431 - RNA, 20 nt, Human
ugugguccugagcacugauc

SEQ ID NO: 92432 - RNA, 20 nt, Human
gucgacgccuucacugccau

SEQ ID NO: 92433 - RNA, 19 nt, Human
uguggugagggaagacgcc

SEQ ID NO: 92434 - RNA, 24 nt, Human
ucgggaggcugagacaggagaauc

SEQ ID NO: 92435 - RNA, 21 nt, Human
uguugccaggcuggagugcag

SEQ ID NO: 92436 - RNA, 22 nt, Human
auugcuugagcccaggaguuag

SEQ ID NO: 92437 - RNA, 26 nt, Human
uggucagucacucucagccauagcac

SEQ ID NO: 92438 - RNA, 22 nt, Human
cagcccaggcaccuuaugguua

SEQ ID NO: 92439 - RNA, 20 nt, Human
aacucacaacucucugguuc

SEQ ID NO: 92440 - RNA, 21 nt, Human
uguccaugcaccacagacaca

SEQ ID NO: 92441 - RNA, 19 nt, Human
ugggggguggagggaggug

SEQ ID NO: 92442 - RNA, 26 nt, Human
uucuauaagugaggaagaguuuaugg

SEQ ID NO: 92443 - RNA, 22 nt, Human
agucccagcuacacaggaggcu

SEQ ID NO: 92444 - RNA, 24 nt, Human
gggcaggggcugcagggaggagga

SEQ ID NO: 92445 - RNA, 25 nt, Human
uggggaccuggcacugggaggcagg

SEQ ID NO: 92446 - RNA, 21 nt, Human
auuuucucucaggaaagguuu

SEQ ID NO: 92447 - RNA, 23 nt, Human
agaaggcaggguaacuugcugca

SEQ ID NO: 92448 - RNA, 30 nt, Human
gcccaacaugcagaacaugaauccucugag

SEQ ID NO: 92449 - RNA, 23 nt, Human
uaauauugauaauaacaaaaaga

SEQ ID NO: 92450 - RNA, 22 nt, Human
ggaagccggggagggcaguuga

SEQ ID NO: 92451 - RNA, 22 nt, Human
ccaucuuccaccugugcccuca

SEQ ID NO: 92452 - RNA, 22 nt, Human
cucacagucugcuuccauuucc

SEQ ID NO: 92453 - RNA, 29 nt, Human
caacuuccguaauuaggaaccuguuucuu

SEQ ID NO: 92454 - RNA, 21 nt, Human
cuaauuacagcccccaaccuc

SEQ ID NO: 92455 - RNA, 24 nt, Human
cucucuccaucuaccuuccaguca

SEQ ID NO: 92456 - RNA, 21 nt, Human
caucggucagaagcaccaaga

SEQ ID NO: 92457 - RNA, 21 nt, Human
uucccgggaggcuuccccuuc

SEQ ID NO: 92458 - RNA, 25 nt, Human
ggaacgcuugccuuuccucccucca

SEQ ID NO: 92459 - RNA, 26 nt, Human
cuccuggaugugauggggauugccag

SEQ ID NO: 92460 - RNA, 22 nt, Human
gcuccuuccauuccuguacucg

SEQ ID NO: 92461 - RNA, 21 nt, Human
gaccucuggguugggaucagg

SEQ ID NO: 92462 - RNA, 26 nt, Human
agcuggagacuggaaccaacugagaa

SEQ ID NO: 92463 - RNA, 22 nt, Human
cuguuucacguguaccuguguc

SEQ ID NO: 92464 - RNA, 26 nt, Human
gaguaugagugcaagcaaagcagaac

SEQ ID NO: 92465 - RNA, 20 nt, Human
gcccuccuggcuccugggcu

SEQ ID NO: 92466 - RNA, 26 nt, Human
ucacccaggcuggagugcaauggcgc

SEQ ID NO: 92467 - RNA, 21 nt, Human
ccgucguccucccagacaaau

SEQ ID NO: 92468 - RNA, 28 nt, Human
ucugcauguuugucugugugucugcguu

SEQ ID NO: 92469 - RNA, 25 nt, Human
gagcaccuccagucucuccuugauu

SEQ ID NO: 92470 - RNA, 23 nt, Human
aggaggagaccagguugcagugg

SEQ ID NO: 92471 - RNA, 29 nt, Human
uuccagugcugcacacuccugguuuggaa

SEQ ID NO: 92472 - RNA, 19 nt, Human
acacagcuggcuggggcag

SEQ ID NO: 92473 - RNA, 21 nt, Human
uuaggguggucuacuugaggc

SEQ ID NO: 92474 - RNA, 23 nt, Human
ccggaguagcugggauugcaggc

SEQ ID NO: 92475 - RNA, 27 nt, Human
ggcucagagcagaaccaaagcaugauu

SEQ ID NO: 92476 - RNA, 18 nt, Human
uccauaaaagguguguug

SEQ ID NO: 92477 - RNA, 24 nt, Human
aggggaggggucaguagcagaagc

SEQ ID NO: 92478 - RNA, 21 nt, Human
gacuucaugcaaguuggcagu

SEQ ID NO: 92479 - RNA, 21 nt, Human
cccucuuuucccacauucaua

SEQ ID NO: 92480 - RNA, 16 nt, Human
cggacgcgcgagcccg

SEQ ID NO: 92481 - RNA, 21 nt, Human
guagggccacccagggccagg

SEQ ID NO: 92482 - RNA, 21 nt, Human
guguacuggcuccucuguggu

SEQ ID NO: 92483 - RNA, 27 nt, Human
ggcuggcugcaccccuuccuaccaccc

SEQ ID NO: 92484 - RNA, 23 nt, Human
cucacgcuccagcacaguggcca

SEQ ID NO: 92485 - RNA, 22 nt, Human
guuugcuuacuccugacuuugg

SEQ ID NO: 92486 - RNA, 20 nt, Human
gcucuuuugguacaccagaa

SEQ ID NO: 92487 - RNA, 20 nt, Human
ugucucaucccuugcccugg

SEQ ID NO: 92488 - RNA, 27 nt, Human
cgcagccgccgccuccuccgcgccgcg

SEQ ID NO: 92489 - RNA, 23 nt, Human
uccucugcuguguucuguguguc

SEQ ID NO: 92490 - RNA, 26 nt, Human
uccuccuccccaacugugggggugug

SEQ ID NO: 92491 - RNA, 21 nt, Human
guuucuuucucucuugauucu

SEQ ID NO: 92492 - RNA, 25 nt, Human
cuuguacguuguugcuuucgacuuu

SEQ ID NO: 92493 - RNA, 21 nt, Human
uggguccuaaacagcuuuuua

SEQ ID NO: 92494 - RNA, 22 nt, Human
gccagccacauaugagagcucu

SEQ ID NO: 92495 - RNA, 20 nt, Human
aggaccacucuguaccaucu

SEQ ID NO: 92496 - RNA, 21 nt, Human
aguguuacagaguguggguac

SEQ ID NO: 92497 - RNA, 27 nt, Human
acugaugugucuaaaugagcaugacag

SEQ ID NO: 92498 - RNA, 25 nt, Human
ggacuccuuguucugcucuggcaag

SEQ ID NO: 92499 - RNA, 22 nt, Human
aaaaggagaggguccgagggug

SEQ ID NO: 92500 - RNA, 22 nt, Human
ugcaagcucugccucccggguu

SEQ ID NO: 92501 - RNA, 20 nt, Human
gcagcuagcaaaagcaaaga

SEQ ID NO: 92502 - RNA, 25 nt, Human
ucaugcaucagggcauuuagaaaga

SEQ ID NO: 92503 - RNA, 22 nt, Human
cauucccccggugccucuccca

SEQ ID NO: 92504 - RNA, 22 nt, Human
ucaauuacuggaaaauaaaagg

SEQ ID NO: 92505 - RNA, 25 nt, Human
ugcucccuggcucugggucugcugg

SEQ ID NO: 92506 - RNA, 22 nt, Human
gggauuacaggcaugagucacc

SEQ ID NO: 92507 - RNA, 19 nt, Human
gcaggaagggugggccagc

SEQ ID NO: 92508 - RNA, 18 nt, Human
agggugggcaggaauacu

SEQ ID NO: 92509 - RNA, 24 nt, Human
ugggagggugagcaggagcaaggc

SEQ ID NO: 92510 - RNA, 23 nt, Human
uuuaccucaggaugacgugcaga

SEQ ID NO: 92511 - RNA, 21 nt, Human
gcaaccucugccuccuggguu

SEQ ID NO: 92512 - RNA, 22 nt, Human
cagaucccucauuugauacucc

SEQ ID NO: 92513 - RNA, 23 nt, Human
ggagaucagagaccagaggaaca

SEQ ID NO: 92514 - RNA, 19 nt, Human
cccaggcugcagugcagug

SEQ ID NO: 92515 - RNA, 25 nt, Human
ccugugccugaucuguguguucccc

SEQ ID NO: 92516 - RNA, 25 nt, Human
ccugcaagucauuucauuuguauuu

SEQ ID NO: 92517 - RNA, 28 nt, Human
gaccugccugccuuccugacuucuguuc

SEQ ID NO: 92518 - RNA, 23 nt, Human
aaagugacucacuuaucccaaga

SEQ ID NO: 92519 - RNA, 23 nt, Human
ccuucaagacauuccacuugcua

SEQ ID NO: 92520 - RNA, 21 nt, Human
ggggaaagaaugguagagaca

SEQ ID NO: 92521 - RNA, 22 nt, Human
ggcucauuguuguauuuuuggu

SEQ ID NO: 92522 - RNA, 18 nt, Human
uacuaccuagggcacuuu

SEQ ID NO: 92523 - RNA, 22 nt, Human
ucuccaaacucccguccccagg

SEQ ID NO: 92524 - RNA, 25 nt, Human
cuuucccugacuccuggugcccucu

SEQ ID NO: 92525 - RNA, 22 nt, Human
cugaggcaggagacuggcguga

SEQ ID NO: 92526 - RNA, 25 nt, Human
aaagggcagagacccuggaagugga

SEQ ID NO: 92527 - RNA, 27 nt, Human
cugggauuggcugugaacugaucaugu

SEQ ID NO: 92528 - RNA, 22 nt, Human
gcugcucugugcucugcguguc

SEQ ID NO: 92529 - RNA, 22 nt, Human
ccgaguagcugggacuacaggg

SEQ ID NO: 92530 - RNA, 27 nt, Human
cccauucacaccacacagagguucccu

SEQ ID NO: 92531 - RNA, 27 nt, Human
aguuagauuuggacaaacaagauuccu

SEQ ID NO: 92532 - RNA, 22 nt, Human
ugcgcccaggcugguaugcagu

SEQ ID NO: 92533 - RNA, 22 nt, Human
ccugcauuccuguuaaagccac

SEQ ID NO: 92534 - RNA, 27 nt, Human
uuagaaaacaguagguccugagaacca

SEQ ID NO: 92535 - RNA, 22 nt, Human
guagaaucugaagauagaaagg

SEQ ID NO: 92536 - RNA, 27 nt, Human
cccugcagcuccagccccgggcugcac

SEQ ID NO: 92537 - RNA, 21 nt, Human
uuuuuauagccuuuagcuugu

SEQ ID NO: 92538 - RNA, 24 nt, Human
cagggagggagcugaggaccaggc

SEQ ID NO: 92539 - RNA, 22 nt, Human
agagcaucuugcauccaaaccu

SEQ ID NO: 92540 - RNA, 24 nt, Human
ucucucccuccugaccucugggca

SEQ ID NO: 92541 - RNA, 18 nt, Human
uagucccagcuacucuga

SEQ ID NO: 92542 - RNA, 20 nt, Human
aguacccccuuuccuccuca

SEQ ID NO: 92543 - RNA, 24 nt, Human
caugccuguaaucucggaaggcug

SEQ ID NO: 92544 - RNA, 22 nt, Human
aaagugcagccgguuugaaaug

SEQ ID NO: 92545 - RNA, 21 nt, Human
gugguucauguucauucucau

SEQ ID NO: 92546 - RNA, 20 nt, Human
auauuuaaaccaaaaugaaa

SEQ ID NO: 92547 - RNA, 26 nt, Human
gacauuucugugguuuuuaacuuuuu

SEQ ID NO: 92548 - RNA, 19 nt, Human
agugagcagcugcccagcu

SEQ ID NO: 92549 - RNA, 22 nt, Human
ugugugccaggccgggugcggu

SEQ ID NO: 92550 - RNA, 28 nt, Human
cacaaguccagacccaggugcucuguau

SEQ ID NO: 92551 - RNA, 30 nt, Human
cuccagcugguuuuugacagcuguugcugu

SEQ ID NO: 92552 - RNA, 24 nt, Human
uuuucuuucuccccuacuccaucu

SEQ ID NO: 92553 - RNA, 21 nt, Human
gccagaugcaaugaucuuuaa

SEQ ID NO: 92554 - RNA, 27 nt, Human
uuagaugaaacugcaaaguguucucag

SEQ ID NO: 92555 - RNA, 25 nt, Human
cugucauccaggcuggagugcagug

SEQ ID NO: 92556 - RNA, 23 nt, Human
uuauugcagccuuucuuuuccua

SEQ ID NO: 92557 - RNA, 22 nt, Human
gucagcaaccuuggcauugaua

SEQ ID NO: 92558 - RNA, 28 nt, Human
gggaguuggacguggcucaggcaguggg

SEQ ID NO: 92559 - RNA, 21 nt, Human
aagaauugcuuggcacuuuca

SEQ ID NO: 92560 - RNA, 22 nt, Human
caccuguaaucuuaacacugug

SEQ ID NO: 92561 - RNA, 21 nt, Human
uagucaagacaacacugaccu

SEQ ID NO: 92562 - RNA, 25 nt, Human
ucuccaccugcccucccacucuucc

SEQ ID NO: 92563 - RNA, 22 nt, Human
cugugagcuuccccaggucagg

SEQ ID NO: 92564 - RNA, 26 nt, Human
ggcccaaacucaucuugaucaaccaa

SEQ ID NO: 92565 - RNA, 23 nt, Human
cgggccauuggcgagagcuucau

SEQ ID NO: 92566 - RNA, 17 nt, Human
gucaugcacaugccuua

SEQ ID NO: 92567 - RNA, 22 nt, Human
ucucucuuuggcuggaauuaca

SEQ ID NO: 92568 - RNA, 22 nt, Human
cccuucagcacgagcacacugc

SEQ ID NO: 92569 - RNA, 26 nt, Human
cuccccuccacuucuuggguaaucug

SEQ ID NO: 92570 - RNA, 26 nt, Human
gccucuguaugcccuaggccugugcc

SEQ ID NO: 92571 - RNA, 20 nt, Human
agaagagaccccgcacuugg

SEQ ID NO: 92572 - RNA, 24 nt, Human
ugccaaagcauucugacacuuugg

SEQ ID NO: 92573 - RNA, 19 nt, Human
caccagcauggagaccuca

SEQ ID NO: 92574 - RNA, 23 nt, Human
gccuagggaacugggagcuuggg

SEQ ID NO: 92575 - RNA, 24 nt, Human
ugcucagggacuggggaacaagac

SEQ ID NO: 92576 - RNA, 22 nt, Human
ugucuuugcuccuuggcagcua

SEQ ID NO: 92577 - RNA, 27 nt, Human
cuuacuuccuguucaucucuaaagugu

SEQ ID NO: 92578 - RNA, 22 nt, Human
caggcuggagugcaguggcacc

SEQ ID NO: 92579 - RNA, 24 nt, Human
aaccuugcucucaucaccagcuag

SEQ ID NO: 92580 - RNA, 20 nt, Human
uccuucauucaucaacuagg

SEQ ID NO: 92581 - RNA, 25 nt, Human
acaggguuuguuuuauuuuagccuc

SEQ ID NO: 92582 - RNA, 26 nt, Human
ggauuugagcucugugaucuaugucu

SEQ ID NO: 92583 - RNA, 26 nt, Human
uccuguccccacccccaccccagcag

SEQ ID NO: 92584 - RNA, 22 nt, Human
cuggggcauggagaggucugag

SEQ ID NO: 92585 - RNA, 25 nt, Human
gcagagccugcccuuacucacgcuc

SEQ ID NO: 92586 - RNA, 24 nt, Human
uuuuaaucuuuauguauuuuuugu

SEQ ID NO: 92587 - RNA, 22 nt, Human
cacccaggcuggagugcaauga

SEQ ID NO: 92588 - RNA, 26 nt, Human
cacagcauagccagcaggccacuuuu

SEQ ID NO: 92589 - RNA, 26 nt, Human
gacgugggaggguagcuugaggccag

SEQ ID NO: 92590 - RNA, 18 nt, Human
cccacccaggaaacccuu

SEQ ID NO: 92591 - RNA, 27 nt, Human
gcccacacagagacuugcacagcugcc

SEQ ID NO: 92592 - RNA, 27 nt, Human
uggaaugugugaggggcugacagcaca

SEQ ID NO: 92593 - RNA, 23 nt, Human
ugucuaccuuuagccaggcacag

SEQ ID NO: 92594 - RNA, 18 nt, Human
ugaaacauguuacuggga

SEQ ID NO: 92595 - RNA, 23 nt, Human
ucugaggaagccauuugagucug

SEQ ID NO: 92596 - RNA, 24 nt, Human
ucuccccuaggugguuccugagcc

SEQ ID NO: 92597 - RNA, 24 nt, Human
aaaugcugauuugagaacaaaagg

SEQ ID NO: 92598 - RNA, 25 nt, Human
cucaucucacacccuuucccucucc

SEQ ID NO: 92599 - RNA, 19 nt, Human
guccaucuugcugauuuca

SEQ ID NO: 92600 - RNA, 20 nt, Human
cucaaacaccugaccuugug

SEQ ID NO: 92601 - RNA, 23 nt, Human
aggagagggaaguaguggcagca

SEQ ID NO: 92602 - RNA, 22 nt, Human
ugagagaagcagggacaggagg

SEQ ID NO: 92603 - RNA, 24 nt, Human
guucuguaagcaucaggagcuaga

SEQ ID NO: 92604 - RNA, 29 nt, Human
cuccaucauccugauuagcauguuuauuc

SEQ ID NO: 92605 - RNA, 21 nt, Human
uucuccugcacuuccuccuca

SEQ ID NO: 92606 - RNA, 26 nt, Human
accaucaugucuggcuaauuuuucau

SEQ ID NO: 92607 - RNA, 21 nt, Human
cuggucccucugucccugugu

SEQ ID NO: 92608 - RNA, 22 nt, Human
uuggagacaugacaaucauuuu

SEQ ID NO: 92609 - RNA, 31 nt, Human
gacuauuuugccauggagaaaucugacagca

SEQ ID NO: 92610 - RNA, 24 nt, Human
cagagcaaccuccagccuucucca

SEQ ID NO: 92611 - RNA, 27 nt, Human
gucucgaacuccugggcucaagugauc

SEQ ID NO: 92612 - RNA, 21 nt, Human
ggugcuugcuggugccugcca

SEQ ID NO: 92613 - RNA, 22 nt, Human
aagacccugggaaccuccucug

SEQ ID NO: 92614 - RNA, 20 nt, Human
ugacauugacccagacauau

SEQ ID NO: 92615 - RNA, 27 nt, Human
ccccagcccuuggcaacacuggagugc

SEQ ID NO: 92616 - RNA, 25 nt, Human
ugcugcacuccagccugcgggacag

SEQ ID NO: 92617 - RNA, 24 nt, Human
ucagcgacuccggcugcucugcgg

SEQ ID NO: 92618 - RNA, 22 nt, Human
gacuacaggugugcaccaccau

SEQ ID NO: 92619 - RNA, 22 nt, Human
gcaugagccaccacgccuggcc

SEQ ID NO: 92620 - RNA, 28 nt, Human
ccucugccaacuccucuggacccucgcg

SEQ ID NO: 92621 - RNA, 27 nt, Human
uccucaagccuauuucaugagaucuac

SEQ ID NO: 92622 - RNA, 22 nt, Human
ugcccaggcuggagugcaauag

SEQ ID NO: 92623 - RNA, 26 nt, Human
ucaguaggaaaauuaauacaguggau

SEQ ID NO: 92624 - RNA, 23 nt, Human
ucuccacugucaucaaacuggcc

SEQ ID NO: 92625 - RNA, 29 nt, Human
cccuucuagguggcaaggcugugcucccu

SEQ ID NO: 92626 - RNA, 23 nt, Human
ccuccguguguuagacucuuguc

SEQ ID NO: 92627 - RNA, 22 nt, Human
aaaaugcugggauuacaggcau

SEQ ID NO: 92628 - RNA, 28 nt, Human
gcgcuaucucccugccuccugccggcuc

SEQ ID NO: 92629 - RNA, 22 nt, Human
aguggagagaucauagcucacu

SEQ ID NO: 92630 - RNA, 22 nt, Human
auugcuugaacccgggaggcag

SEQ ID NO: 92631 - RNA, 27 nt, Human
ggggugagaaucuggcagauggugccu

SEQ ID NO: 92632 - RNA, 22 nt, Human
agccucccaaauugcugggauu

SEQ ID NO: 92633 - RNA, 26 nt, Human
acugggguacagccugggcucaggga

SEQ ID NO: 92634 - RNA, 26 nt, Human
ccucauucuuugucugagaaacagcc

SEQ ID NO: 92635 - RNA, 21 nt, Human
augugcuauugaacugagcca

SEQ ID NO: 92636 - RNA, 23 nt, Human
gucacccaaguuggagugcagug

SEQ ID NO: 92637 - RNA, 20 nt, Human
ucuuagcaacuggcagacca

SEQ ID NO: 92638 - RNA, 22 nt, Human
agcauuuuugauccuguaauca

SEQ ID NO: 92639 - RNA, 24 nt, Human
gcucacccaggcugagggugccuu

SEQ ID NO: 92640 - RNA, 23 nt, Human
gaggggguaccagguggccaggu

SEQ ID NO: 92641 - RNA, 27 nt, Human
acuuauagacaguaucccuuguccuca

SEQ ID NO: 92642 - RNA, 26 nt, Human
acuuuuauaugacauucuuauacugc

SEQ ID NO: 92643 - RNA, 22 nt, Human
ugugauuuaaaaauucuuacua

SEQ ID NO: 92644 - RNA, 20 nt, Human
uucauagacacaucuugcag

SEQ ID NO: 92645 - RNA, 27 nt, Human
uuauauuguugagaaagaacaaaaagg

SEQ ID NO: 92646 - RNA, 30 nt, Human
cucaaaauaaccaugacaccaagguuauga

SEQ ID NO: 92647 - RNA, 26 nt, Human
uugcguagaggcuacagggguuagcc

SEQ ID NO: 92648 - RNA, 22 nt, Human
uucuccuguggcaguggcgaug

SEQ ID NO: 92649 - RNA, 21 nt, Human
ggcaccuccccucccgcccaa

SEQ ID NO: 92650 - RNA, 28 nt, Human
gacccugugcagccugggacaaaacugu

SEQ ID NO: 92651 - RNA, 25 nt, Human
ccagggaccuuggagauagccgcag

SEQ ID NO: 92652 - RNA, 23 nt, Human
aucugaacugggggcaggugcau

SEQ ID NO: 92653 - RNA, 21 nt, Human
aauuugggaaggaauggaaga

SEQ ID NO: 92654 - RNA, 27 nt, Human
ccaugaucccacugaccuacucuugcc

SEQ ID NO: 92655 - RNA, 20 nt, Human
cuguaaaaucuuuguuguuu

SEQ ID NO: 92656 - RNA, 24 nt, Human
cugccugguccucagcagugcagc

SEQ ID NO: 92657 - RNA, 26 nt, Human
ucuccucucuucagugaaacccucaa

SEQ ID NO: 92658 - RNA, 25 nt, Human
gcacagccacagccuccucgccucc

SEQ ID NO: 92659 - RNA, 27 nt, Human
accagccugggcaacauaccaagaccc

SEQ ID NO: 92660 - RNA, 22 nt, Human
cugagaagaucuaccccaggga

SEQ ID NO: 92661 - RNA, 20 nt, Human
ccuacccccugugccuuguc

SEQ ID NO: 92662 - RNA, 20 nt, Human
ucuuuuaccaauuugagugc

SEQ ID NO: 92663 - RNA, 23 nt, Human
caguuuacccugcucccucucuc

SEQ ID NO: 92664 - RNA, 20 nt, Human
uguacaacagggaaaauauc

SEQ ID NO: 92665 - RNA, 18 nt, Human
cccaaggagacugagaug

SEQ ID NO: 92666 - RNA, 23 nt, Human
gggugcugcagauacugcaguga

SEQ ID NO: 92667 - RNA, 22 nt, Human
uuccuuuauucuuuucauaguc

SEQ ID NO: 92668 - RNA, 23 nt, Human
ugcacccacugcauuugcagccu

SEQ ID NO: 92669 - RNA, 21 nt, Human
uuaauuucuuuucuuccuguc

SEQ ID NO: 92670 - RNA, 19 nt, Human
caggaauacaaggauguga

SEQ ID NO: 92671 - RNA, 21 nt, Human
ccgaaccuggcuucgccuguc

SEQ ID NO: 92672 - RNA, 21 nt, Human
gaagagaagagcaggccucag

SEQ ID NO: 92673 - RNA, 25 nt, Human
gggagugaggcggcggaggagccag

SEQ ID NO: 92674 - RNA, 22 nt, Human
ucuguagcuuguucccugucuu

SEQ ID NO: 92675 - RNA, 21 nt, Human
ucuucuuccaaaugcaguuca

SEQ ID NO: 92676 - RNA, 27 nt, Human
uccagagacaggaaagaauuugccuuc

SEQ ID NO: 92677 - RNA, 25 nt, Human
gggcuccugguccgcaguggcagag

SEQ ID NO: 92678 - RNA, 20 nt, Human
caucucagccuaccaugaga

SEQ ID NO: 92679 - RNA, 16 nt, Human
aacacagccuccacug

SEQ ID NO: 92680 - RNA, 22 nt, Human
ccuuucccggccgcacaggguu

SEQ ID NO: 92681 - RNA, 26 nt, Human
agaugaugcaugaugcccuccccuca

SEQ ID NO: 92682 - RNA, 27 nt, Human
ucugggucucuguaucucauguagaac

SEQ ID NO: 92683 - RNA, 22 nt, Human
gcucaugccgauaaucccagca

SEQ ID NO: 92684 - RNA, 20 nt, Human
cucccucccuuccucaggca

SEQ ID NO: 92685 - RNA, 21 nt, Human
uggaggagggaggugcuguga

SEQ ID NO: 92686 - RNA, 23 nt, Human
uugaguauuccaugagcugcuca

SEQ ID NO: 92687 - RNA, 26 nt, Human
gagcaguuuuccaggaggccgggggg

SEQ ID NO: 92688 - RNA, 27 nt, Human
uccuggagcgggaaucccucaccgucu

SEQ ID NO: 92689 - RNA, 22 nt, Human
gucgcccaggcuggagugcaau

SEQ ID NO: 92690 - RNA, 21 nt, Human
auguacacauuaaaaggccuu

SEQ ID NO: 92691 - RNA, 27 nt, Human
gcuuuaucuuugauauaauacauaguc

SEQ ID NO: 92692 - RNA, 28 nt, Human
uccugagcucaagugaucuuccugccuu

SEQ ID NO: 92693 - RNA, 23 nt, Human
cugcccagccccugccuggcugc

SEQ ID NO: 92694 - RNA, 22 nt, Human
guauagguaacccacaggccca

SEQ ID NO: 92695 - RNA, 24 nt, Human
ggaguuggugagagcaggaggaga

SEQ ID NO: 92696 - RNA, 21 nt, Human
ccugcugcuaccacccuuuuc

SEQ ID NO: 92697 - RNA, 26 nt, Human
ucucacccucuccuccagugugggcu

SEQ ID NO: 92698 - RNA, 22 nt, Human
uuguggugcucuucaugaucau

SEQ ID NO: 92699 - RNA, 24 nt, Human
uuuauugcugugaauagucugugu

SEQ ID NO: 92700 - RNA, 21 nt, Human
cuggccagaagcaggagugug

SEQ ID NO: 92701 - RNA, 21 nt, Human
auaggggcauccuagcccugu

SEQ ID NO: 92702 - RNA, 23 nt, Human
aagcagaugcucugaacccugag

SEQ ID NO: 92703 - RNA, 22 nt, Human
agaaggcaguagggccccugca

SEQ ID NO: 92704 - RNA, 23 nt, Human
cuguguuuauugguggcagugac

SEQ ID NO: 92705 - RNA, 17 nt, Human
uuugcagcugcccagcc

SEQ ID NO: 92706 - RNA, 22 nt, Human
gcaugugccaccaugcccggcu

SEQ ID NO: 92707 - RNA, 23 nt, Human
ccucugguucuucauuuauugag

SEQ ID NO: 92708 - RNA, 27 nt, Human
cuucauuaagcccucuuccaucauguc

SEQ ID NO: 92709 - RNA, 22 nt, Human
uaggauuuguguuuuacaguau

SEQ ID NO: 92710 - RNA, 20 nt, Human
ccucugagccccggccucgg

SEQ ID NO: 92711 - RNA, 22 nt, Human
agauuccuguacuauuguguuu

SEQ ID NO: 92712 - RNA, 25 nt, Human
agggucuguaggcaucacauuguga

SEQ ID NO: 92713 - RNA, 21 nt, Human
uuuccacauucugugucaucu

SEQ ID NO: 92714 - RNA, 21 nt, Human
cugagcagcucccagugccag

SEQ ID NO: 92715 - RNA, 20 nt, Human
aacugcugccuuugccucca

SEQ ID NO: 92716 - RNA, 21 nt, Human
uguagacugaauggugaccca

SEQ ID NO: 92717 - RNA, 21 nt, Human
ccugcagcaucucuaagggcc

SEQ ID NO: 92718 - RNA, 27 nt, Human
ccacaaacacaugcgcaggcuccugca

SEQ ID NO: 92719 - RNA, 26 nt, Human
guucaggcugacacuggcaaugagua

SEQ ID NO: 92720 - RNA, 24 nt, Human
ggcggcaacauggcagagaccgcg

SEQ ID NO: 92721 - RNA, 27 nt, Human
agagacuccuccagacccacucagacc

SEQ ID NO: 92722 - RNA, 21 nt, Human
cccucuucauccgcagcagug

SEQ ID NO: 92723 - RNA, 28 nt, Human
aacuguccacguggaguggucuggugaa

SEQ ID NO: 92724 - RNA, 23 nt, Human
augaagccucaaaacaucacgag

SEQ ID NO: 92725 - RNA, 20 nt, Human
ugugccuuuuuauucaucua

SEQ ID NO: 92726 - RNA, 22 nt, Human
gguccucaguccacugcugagg

SEQ ID NO: 92727 - RNA, 27 nt, Human
uuucccaagcaguucuauuacccgguu

SEQ ID NO: 92728 - RNA, 25 nt, Human
ggacgagagcacgccugggagcgaa

SEQ ID NO: 92729 - RNA, 24 nt, Human
ugcggccugcuacauggggugggg

SEQ ID NO: 92730 - RNA, 23 nt, Human
gcuaggaccugcaacuucagugc

SEQ ID NO: 92731 - RNA, 21 nt, Human
cagcucugaucaggaaaguga

SEQ ID NO: 92732 - RNA, 21 nt, Human
ugucccuaauguguuagauug

SEQ ID NO: 92733 - RNA, 20 nt, Human
auucaccucuucuuucccuc

SEQ ID NO: 92734 - RNA, 20 nt, Human
gacuuucuguugucuaccuc

SEQ ID NO: 92735 - RNA, 23 nt, Human
auagagggagagagggagagagc

SEQ ID NO: 92736 - RNA, 20 nt, Human
aggcuggagugcaggccgcg

SEQ ID NO: 92737 - RNA, 22 nt, Human
gcccugugggcuucaacaucca

SEQ ID NO: 92738 - RNA, 22 nt, Human
ccugagucuuggccugccuccc

SEQ ID NO: 92739 - RNA, 23 nt, Human
ccuccuggccaagcaggcugguu

SEQ ID NO: 92740 - RNA, 21 nt, Human
uacugccagaacaugaauuca

SEQ ID NO: 92741 - RNA, 17 nt, Human
ucauccuucuucaggga

SEQ ID NO: 92742 - RNA, 26 nt, Human
agaacccaacuuaguuuuucagugaa

SEQ ID NO: 92743 - RNA, 22 nt, Human
gucccuuuggcuggagugccuc

SEQ ID NO: 92744 - RNA, 21 nt, Human
ucagaucacugaauuuauaaa

SEQ ID NO: 92745 - RNA, 20 nt, Human
uacauacauuugaacauucc

SEQ ID NO: 92746 - RNA, 23 nt, Human
aagaccuuaugguuuuguagaua

SEQ ID NO: 92747 - RNA, 27 nt, Human
cacugcacuggggccagcugggaagcc

SEQ ID NO: 92748 - RNA, 28 nt, Human
ccuccccuggcccucugauuuguucugu

SEQ ID NO: 92749 - RNA, 26 nt, Human
ggacaacaggcuaaugaaggauuugg

SEQ ID NO: 92750 - RNA, 23 nt, Human
caagccuauaccagcuguguaca

SEQ ID NO: 92751 - RNA, 22 nt, Human
gccuuucuccuguuuauggguu

SEQ ID NO: 92752 - RNA, 24 nt, Human
cugcacuuccagucacccaggccu

SEQ ID NO: 92753 - RNA, 22 nt, Human
caccuccuggguucaagugauu

SEQ ID NO: 92754 - RNA, 20 nt, Human
ccucacugcaaauuuccucc

SEQ ID NO: 92755 - RNA, 21 nt, Human
aaucugaggccuccucucuca

SEQ ID NO: 92756 - RNA, 20 nt, Human
cccccaggcuggagugcagu

SEQ ID NO: 92757 - RNA, 20 nt, Human
cacccaggcuggagugccgu

SEQ ID NO: 92758 - RNA, 22 nt, Human
ccugguuucuccuccuggaguc

SEQ ID NO: 92759 - RNA, 22 nt, Human
uccagagagccucccugcagcc

SEQ ID NO: 92760 - RNA, 23 nt, Human
auugugccacugcacaccggccu

SEQ ID NO: 92761 - RNA, 30 nt, Human
ugagcuuaugugugggcauuuuacugccuc

SEQ ID NO: 92762 - RNA, 29 nt, Human
caguugcuuugucuucuguagucgccaag

SEQ ID NO: 92763 - RNA, 18 nt, Human
ccacugccaccaccccuc

SEQ ID NO: 92764 - RNA, 20 nt, Human
ggccucggagcacccccuuc

SEQ ID NO: 92765 - RNA, 19 nt, Human
ucucucucccaguacacca

SEQ ID NO: 92766 - RNA, 20 nt, Human
auuucugggcuccuggggcu

SEQ ID NO: 92767 - RNA, 19 nt, Human
ucugccugugagccagucu

SEQ ID NO: 92768 - RNA, 27 nt, Human
gucccuguagcucuggaacugaaggaa

SEQ ID NO: 92769 - RNA, 20 nt, Human
uuuugguuccacacuguuuu

SEQ ID NO: 92770 - RNA, 21 nt, Human
uuugggaaguuaaagggaaga

SEQ ID NO: 92771 - RNA, 22 nt, Human
uugcccaggcuggagggcaaug

SEQ ID NO: 92772 - RNA, 22 nt, Human
uugcccaugcuggagugcaaug

SEQ ID NO: 92773 - RNA, 19 nt, Human
ccaggcucugcuccgagca

SEQ ID NO: 92774 - RNA, 20 nt, Human
aaccauuuacaugcaccuua

SEQ ID NO: 92775 - RNA, 20 nt, Human
cgcagcugacugcugccucu

SEQ ID NO: 92776 - RNA, 25 nt, Human
cugucauucaggcuggagugcagug

SEQ ID NO: 92777 - RNA, 26 nt, Human
gggcauguccucauccuuuccugcca

SEQ ID NO: 92778 - RNA, 20 nt, Human
uucauucuuuacugcacuca

SEQ ID NO: 92779 - RNA, 19 nt, Human
cuguccagcagcccccagg

SEQ ID NO: 92780 - RNA, 18 nt, Human
guauuggaccugcccaca

SEQ ID NO: 92781 - RNA, 22 nt, Human
guaggggagagagcagagaagu

SEQ ID NO: 92782 - RNA, 22 nt, Human
ccugcccugcccggccucaugu

SEQ ID NO: 92783 - RNA, 21 nt, Human
cucugggugaauagagccuga

SEQ ID NO: 92784 - RNA, 25 nt, Human
ugcucacagaccacacucagcucag

SEQ ID NO: 92785 - RNA, 24 nt, Human
cucagaagcaucgcuccucuccag

SEQ ID NO: 92786 - RNA, 22 nt, Human
gccacugcaccucuagucuggg

SEQ ID NO: 92787 - RNA, 22 nt, Human
gaccaggcuggagugaaguggu

SEQ ID NO: 92788 - RNA, 26 nt, Human
uucucccauauuuugaagggugugua

SEQ ID NO: 92789 - RNA, 27 nt, Human
cccuccaggagcaaugacagucuuuau

SEQ ID NO: 92790 - RNA, 21 nt, Human
uugucccagggcugaugcugu

SEQ ID NO: 92791 - RNA, 22 nt, Human
uuucuauggccuugcuguguac

SEQ ID NO: 92792 - RNA, 27 nt, Human
ccuguccaguguccucuggccugcugc

SEQ ID NO: 92793 - RNA, 19 nt, Human
uggugguugugaaagugau

SEQ ID NO: 92794 - RNA, 21 nt, Human
auuagugcuuugccagaggcu

SEQ ID NO: 92795 - RNA, 26 nt, Human
cccugccuaugcucaaagccagcagg

SEQ ID NO: 92796 - RNA, 24 nt, Human
gucuauggauuugccuucucuaaa

SEQ ID NO: 92797 - RNA, 22 nt, Human
gagcccaggagauugaggcugc

SEQ ID NO: 92798 - RNA, 25 nt, Human
aggcugaggcucaaggaaggugguc

SEQ ID NO: 92799 - RNA, 21 nt, Human
uuugcacaaacucacacaacc

SEQ ID NO: 92800 - RNA, 21 nt, Human
ugagauacaaacauguuccug

SEQ ID NO: 92801 - RNA, 19 nt, Human
guugcccaaggugugcagg

SEQ ID NO: 92802 - RNA, 26 nt, Human
ccugucucccuggggucacaugcuuu

SEQ ID NO: 92803 - RNA, 22 nt, Human
acugggccacguacaagcaggg

SEQ ID NO: 92804 - RNA, 20 nt, Human
cugccuagaaaauguuucca

SEQ ID NO: 92805 - RNA, 19 nt, Human
ggaucuugccucugcuccg

SEQ ID NO: 92806 - RNA, 25 nt, Human
cucuccaaaguuaaccaacagcucc

SEQ ID NO: 92807 - RNA, 22 nt, Human
agccuuguagcuguuacugcaa

SEQ ID NO: 92808 - RNA, 30 nt, Human
guggagccuugcccacagggcugcugcuuc

SEQ ID NO: 92809 - RNA, 18 nt, Human
cccugcugagcagagcca

SEQ ID NO: 92810 - RNA, 23 nt, Human
aguuuuguuuguucacacuccua

SEQ ID NO: 92811 - RNA, 27 nt, Human
agaaugcugggaguuuuacagugccau

SEQ ID NO: 92812 - RNA, 27 nt, Human
ugucagauguggaguauuagugacacc

SEQ ID NO: 92813 - RNA, 25 nt, Human
gugugcaugugucuuuauagcagca

SEQ ID NO: 92814 - RNA, 26 nt, Human
cagggaaaugucuucagccccacgua

SEQ ID NO: 92815 - RNA, 21 nt, Human
ccaauccuguuuuuccuaugc

SEQ ID NO: 92816 - RNA, 25 nt, Human
ggaagggggaagaaaacccucccau

SEQ ID NO: 92817 - RNA, 21 nt, Human
gugcguacucauucauucuaa

SEQ ID NO: 92818 - RNA, 22 nt, Human
ccagaguugaugagcagaucug

SEQ ID NO: 92819 - RNA, 16 nt, Human
uuaaagguggugccaa

SEQ ID NO: 92820 - RNA, 22 nt, Human
aaguacuagaugcaucacuggg

SEQ ID NO: 92821 - RNA, 20 nt, Human
ugacaggaauguuggcagaa

SEQ ID NO: 92822 - RNA, 22 nt, Human
cucagcaccaggguccccuucc

SEQ ID NO: 92823 - RNA, 26 nt, Human
ucuggcuucuagucuauuuacuguuu

SEQ ID NO: 92824 - RNA, 25 nt, Human
ggcccaggaaaaaagguuucacaua

SEQ ID NO: 92825 - RNA, 24 nt, Human
agucagagauucaguaagugccuu

SEQ ID NO: 92826 - RNA, 20 nt, Human
auuuuauaauguuguauuua

SEQ ID NO: 92827 - RNA, 21 nt, Human
ucuccacuggccaucuugucc

SEQ ID NO: 92828 - RNA, 23 nt, Human
cugauggagcuuguggcuggccu

SEQ ID NO: 92829 - RNA, 20 nt, Human
aaaaccagaaguuuuaucag

SEQ ID NO: 92830 - RNA, 20 nt, Human
accagaguuccaaccaaugg

SEQ ID NO: 92831 - RNA, 21 nt, Human
cugcccugcacuccugccucc

SEQ ID NO: 92832 - RNA, 23 nt, Human
cuggaagguggagcuugcaguga

SEQ ID NO: 92833 - RNA, 22 nt, Human
uucuccucuuguaaauaaagcc

SEQ ID NO: 92834 - RNA, 21 nt, Human
aagugaucuugagaaccuuuu

SEQ ID NO: 92835 - RNA, 23 nt, Human
aagagguguugagguuaugucaa

SEQ ID NO: 92836 - RNA, 22 nt, Human
uuccuuuauuuaauggccaaau

SEQ ID NO: 92837 - RNA, 21 nt, Human
acuuucuccccauccccuucc

SEQ ID NO: 92838 - RNA, 21 nt, Human
cccuuugacaggaaggggcuu

SEQ ID NO: 92839 - RNA, 27 nt, Human
ccagaagcagcacuuugacugcucugg

SEQ ID NO: 92840 - RNA, 21 nt, Human
auuugucaugaaaagccauau

SEQ ID NO: 92841 - RNA, 32 nt, Human
cccauuugcagccauggucacgagucauuucu

SEQ ID NO: 92842 - RNA, 24 nt, Human
acacuggugggcagcugaggacac

SEQ ID NO: 92843 - RNA, 32 nt, Human
ucucagccuggaauccccaccuugcccacccc

SEQ ID NO: 92844 - RNA, 22 nt, Human
cagggugggggacagcaggauc

SEQ ID NO: 92845 - RNA, 27 nt, Human
uacccuuuugaacuuugcaacuuccgu

SEQ ID NO: 92846 - RNA, 28 nt, Human
cucccuccacagcuucugcagcagacug

SEQ ID NO: 92847 - RNA, 21 nt, Human
aaccuggagugcaguggugcg

SEQ ID NO: 92848 - RNA, 31 nt, Human
uccucauuugacaaaucagagcuguaauuca

SEQ ID NO: 92849 - RNA, 24 nt, Human
cucaaguacaugccuccugcuuag

SEQ ID NO: 92850 - RNA, 23 nt, Human
ugucuccaagccucugucuuuuc

SEQ ID NO: 92851 - RNA, 25 nt, Human
uugcuggucagaggcccugggggug

SEQ ID NO: 92852 - RNA, 31 nt, Human
ccugccccucaacucuccuccagagucagaa

SEQ ID NO: 92853 - RNA, 25 nt, Human
guuuaacuguuuucuuguauaugga

SEQ ID NO: 92854 - RNA, 23 nt, Human
agaaguuagaacacucucaguuu

SEQ ID NO: 92855 - RNA, 22 nt, Human
gccuguagucccggcacuuugg

SEQ ID NO: 92856 - RNA, 22 nt, Human
gccuauagucccagcacuuugg

SEQ ID NO: 92857 - RNA, 19 nt, Human
gggaaggugugauucucug

SEQ ID NO: 92858 - RNA, 22 nt, Human
aggaacuggagccacagagcug

SEQ ID NO: 92859 - RNA, 22 nt, Human
uucauucuuuucugcuuuucca

SEQ ID NO: 92860 - RNA, 26 nt, Human
ugagacaagcucaggccuauucaaua

SEQ ID NO: 92861 - RNA, 24 nt, Human
ccuccuccuagaaugucuggagcu

SEQ ID NO: 92862 - RNA, 25 nt, Human
uugcuuuuucccugccugucuuggu

SEQ ID NO: 92863 - RNA, 22 nt, Human
agugcuuggccacagucgcagc

SEQ ID NO: 92864 - RNA, 18 nt, Human
ugucagaaacuuuaaauu

SEQ ID NO: 92865 - RNA, 22 nt, Human
uuuaaaaaauacuguggccggg

SEQ ID NO: 92866 - RNA, 23 nt, Human
ccacggcaacccaaccuacucua

SEQ ID NO: 92867 - RNA, 27 nt, Human
guuuguauagccuuucucaagagcugu

SEQ ID NO: 92868 - RNA, 24 nt, Human
agcuuucgcuuguuccugccucgg

SEQ ID NO: 92869 - RNA, 20 nt, Human
gcacacccaaagaauuuuca

SEQ ID NO: 92870 - RNA, 26 nt, Human
gacaccugccuuucucaagcugagau

SEQ ID NO: 92871 - RNA, 20 nt, Human
uauuuauucuuuaacugucu

SEQ ID NO: 92872 - RNA, 21 nt, Human
uggaaacacugcaguucuuac

SEQ ID NO: 92873 - RNA, 24 nt, Human
gaauuucuaaaaaugagugcagau

SEQ ID NO: 92874 - RNA, 27 nt, Human
gacuggguggacaagaaugaacccaug

SEQ ID NO: 92875 - RNA, 21 nt, Human
cuccacugaucaccucucucc

SEQ ID NO: 92876 - RNA, 23 nt, Human
uggcucuuucacaugugcuuuau

SEQ ID NO: 92877 - RNA, 22 nt, Human
uuccucuucucaaaaugguaga

SEQ ID NO: 92878 - RNA, 20 nt, Human
ccuucauuuuacuacuucuu

SEQ ID NO: 92879 - RNA, 22 nt, Human
gccccgcgccugagacuggcug

SEQ ID NO: 92880 - RNA, 27 nt, Human
agagggcccccuacuuguuuuauuuaa

SEQ ID NO: 92881 - RNA, 23 nt, Human
agauggccagcugucgagagcag

SEQ ID NO: 92882 - RNA, 21 nt, Human
cuccacuggcuccaugauucu

SEQ ID NO: 92883 - RNA, 19 nt, Human
acccuccuccacagcugca

SEQ ID NO: 92884 - RNA, 24 nt, Human
ccaucauugcugucugcagccuug

SEQ ID NO: 92885 - RNA, 27 nt, Human
ggggaugucuccuggggacuuugccua

SEQ ID NO: 92886 - RNA, 21 nt, Human
gcugggaggccaggagacugc

SEQ ID NO: 92887 - RNA, 23 nt, Human
ucccucggcccugugugccucag

SEQ ID NO: 92888 - RNA, 25 nt, Human
cuuugcagagaaccuuuuuuguuuu

SEQ ID NO: 92889 - RNA, 27 nt, Human
ccaggaagcaagcggagguugcaguga

SEQ ID NO: 92890 - RNA, 23 nt, Human
uuauccguuaaggcuggaggcac

SEQ ID NO: 92891 - RNA, 17 nt, Human
uguuuaaugugauguga

SEQ ID NO: 92892 - RNA, 26 nt, Human
ugacuccgucggaggaaaaugacucc

SEQ ID NO: 92893 - RNA, 27 nt, Human
ugaaaacaaauaaaguugaacuuguuu

SEQ ID NO: 92894 - RNA, 27 nt, Human
ggggucugaucuuucuccuuggucggg

SEQ ID NO: 92895 - RNA, 27 nt, Human
aggcuccuggugcaucuucaaaaugag

SEQ ID NO: 92896 - RNA, 20 nt, Human
ccaugcagcggccugagcag

SEQ ID NO: 92897 - RNA, 26 nt, Human
uccaugcucaccagccucgccgagga

SEQ ID NO: 92898 - RNA, 26 nt, Human
ucaguuacauccgaaagugucuggag

SEQ ID NO: 92899 - RNA, 22 nt, Human
cccacuccccucaccaccuaau

SEQ ID NO: 92900 - RNA, 24 nt, Human
aggcgggcggaucacucgagguca

SEQ ID NO: 92901 - RNA, 20 nt, Human
cccuguguugcccaggcugg

SEQ ID NO: 92902 - RNA, 26 nt, Human
gcaaggcuuuucucuguuuccaguaa

SEQ ID NO: 92903 - RNA, 28 nt, Human
gaguccccuagagagaggcauuguacug

SEQ ID NO: 92904 - RNA, 26 nt, Human
ugaacaaaaccaaagucugcucugaa

SEQ ID NO: 92905 - RNA, 22 nt, Human
gcuguaucccuguugugagguu

SEQ ID NO: 92906 - RNA, 21 nt, Human
ucacacagccugugugcagug

SEQ ID NO: 92907 - RNA, 28 nt, Human
gguggugaggaggagcaccugggcucuc

SEQ ID NO: 92908 - RNA, 22 nt, Human
guucucucaguacuuguuaccc

SEQ ID NO: 92909 - RNA, 18 nt, Human
uccuuugaccgagguccu

SEQ ID NO: 92910 - RNA, 23 nt, Human
cuccaucuguuaaacacaguaua

SEQ ID NO: 92911 - RNA, 25 nt, Human
ucuggacgacacuggaguggaacac

SEQ ID NO: 92912 - RNA, 21 nt, Human
acguagcugcucacaccagcc

SEQ ID NO: 92913 - RNA, 21 nt, Human
aaaugccugucaacugcacuu

SEQ ID NO: 92914 - RNA, 25 nt, Human
aaugaaaaguguuuuaaugcugcca

SEQ ID NO: 92915 - RNA, 23 nt, Human
gaaguauguccuuguucuuuuug

SEQ ID NO: 92916 - RNA, 25 nt, Human
gcucgcucaaccucuuuuguucagu

SEQ ID NO: 92917 - RNA, 23 nt, Human
uauauagucuuugcagaggucca

SEQ ID NO: 92918 - RNA, 25 nt, Human
auaggacaagggguggaagggcagg

SEQ ID NO: 92919 - RNA, 20 nt, Human
ggcauauccuggaagaggcu

SEQ ID NO: 92920 - RNA, 21 nt, Human
caggcauggaaagauggggag

SEQ ID NO: 92921 - RNA, 24 nt, Human
ccuuuucacccugcccccugggcc

SEQ ID NO: 92922 - RNA, 21 nt, Human
cccagcuggacugagccuggg

SEQ ID NO: 92923 - RNA, 25 nt, Human
uucacacaccuacuuuucugcuucg

SEQ ID NO: 92924 - RNA, 22 nt, Human
gcuggagaaggguggggcuccu

SEQ ID NO: 92925 - RNA, 23 nt, Human
ugcuguugccaauaccucagacu

SEQ ID NO: 92926 - RNA, 22 nt, Human
gugaugguuagcauauggugcu

SEQ ID NO: 92927 - RNA, 22 nt, Human
gcaguucuuccccuccuacacc

SEQ ID NO: 92928 - RNA, 20 nt, Human
ugcccaggcugcagugcagu

SEQ ID NO: 92929 - RNA, 20 nt, Human
gcaggcugagguggggaagg

SEQ ID NO: 92930 - RNA, 23 nt, Human
cuuucuccaauagucacauuggc

SEQ ID NO: 92931 - RNA, 27 nt, Human
cacuacccuguucuguaguuauucuga

SEQ ID NO: 92932 - RNA, 22 nt, Human
acuggucaguauuaauguguag

SEQ ID NO: 92933 - RNA, 27 nt, Human
ggcggguugcuucagccagugcaguga

SEQ ID NO: 92934 - RNA, 23 nt, Human
ccuuuucuuugagaguucgugaa

SEQ ID NO: 92935 - RNA, 22 nt, Human
cugccuuugcuaggcuuuugcu

SEQ ID NO: 92936 - RNA, 22 nt, Human
ucagauugcaugugacucugaa

SEQ ID NO: 92937 - RNA, 23 nt, Human
uaaauuucaaaauuaugaagaau

SEQ ID NO: 92938 - RNA, 21 nt, Human
ccuguaaucccagcauuuugg

SEQ ID NO: 92939 - RNA, 21 nt, Human
ccuguaaccccagcacuuugg

SEQ ID NO: 92940 - RNA, 31 nt, Human
gcucggaggccccaaaggaaaaagcacaaga

SEQ ID NO: 92941 - RNA, 22 nt, Human
uccccccuccuggggugcagug

SEQ ID NO: 92942 - RNA, 31 nt, Human
ccagcagccccagacugcccaaaaacuugcc

SEQ ID NO: 92943 - RNA, 22 nt, Human
ccccucaccccagaggugagag

SEQ ID NO: 92944 - RNA, 22 nt, Human
gccgccuucugcuccagcugca

SEQ ID NO: 92945 - RNA, 21 nt, Human
agucaucuguguguuuuuaag

SEQ ID NO: 92946 - RNA, 26 nt, Human
cucuucugugggauuuucaaaaugcu

SEQ ID NO: 92947 - RNA, 22 nt, Human
uccacacccucugagucacucc

SEQ ID NO: 92948 - RNA, 26 nt, Human
ggauuuaggguucugaagggccuuuu

SEQ ID NO: 92949 - RNA, 23 nt, Human
cuuugcucuuugguccucaggcc

SEQ ID NO: 92950 - RNA, 23 nt, Human
ggcaagcuuugcuccuucaguuc

SEQ ID NO: 92951 - RNA, 21 nt, Human
aggggcuggaagcuggagggg

SEQ ID NO: 92952 - RNA, 22 nt, Human
aguugagaaaaucagcgguccu

SEQ ID NO: 92953 - RNA, 22 nt, Human
ccugcucuucuguuugcacacc

SEQ ID NO: 92954 - RNA, 18 nt, Human
gauugggaaggcucagaa

SEQ ID NO: 92955 - RNA, 22 nt, Human
gcucacugcgaccuccgucucc

SEQ ID NO: 92956 - RNA, 24 nt, Human
acuuuuuccuucuuugccugggag

SEQ ID NO: 92957 - RNA, 20 nt, Human
uauucuucacugucuucuau

SEQ ID NO: 92958 - RNA, 21 nt, Human
uuccuacccuguaucuaacau

SEQ ID NO: 92959 - RNA, 23 nt, Human
gccugcagggcaggucaggcugg

SEQ ID NO: 92960 - RNA, 17 nt, Human
uuaccuuucagugcagu

SEQ ID NO: 92961 - RNA, 23 nt, Human
gauuauaaauuuucuccccggga

SEQ ID NO: 92962 - RNA, 27 nt, Human
ggcaaagugcugugucaguuccuguuu

SEQ ID NO: 92963 - RNA, 22 nt, Human
auugcuugagcucaggaguuug

SEQ ID NO: 92964 - RNA, 22 nt, Human
cugaguggcugggauugcaggu

SEQ ID NO: 92965 - RNA, 20 nt, Human
gucgaggucaagaucaagau

SEQ ID NO: 92966 - RNA, 23 nt, Human
agccuaauuuuuguauuuuuagu

SEQ ID NO: 92967 - RNA, 27 nt, Human
acggggucauacuacauacaagcauaa

SEQ ID NO: 92968 - RNA, 20 nt, Human
cugggcuggcacugcugggg

SEQ ID NO: 92969 - RNA, 26 nt, Human
ccucaagcucagugaauguaucccgg

SEQ ID NO: 92970 - RNA, 22 nt, Human
cacaugggaugggggaggcaga

SEQ ID NO: 92971 - RNA, 23 nt, Human
ucuuuaagaugcagaguggaggg

SEQ ID NO: 92972 - RNA, 21 nt, Human
ggcuuggaacccggugcuccc

SEQ ID NO: 92973 - RNA, 23 nt, Human
aaacauuggaagauuauugagag

SEQ ID NO: 92974 - RNA, 23 nt, Human
gcccucucugagucucaguuuuu

SEQ ID NO: 92975 - RNA, 25 nt, Human
gcccucuugacuggcgcagugggaa

SEQ ID NO: 92976 - RNA, 21 nt, Human
acagccuggcaguguggccag

SEQ ID NO: 92977 - RNA, 19 nt, Human
aucaugcaaaaaugcuuug

SEQ ID NO: 92978 - RNA, 22 nt, Human
cacaguuacagccacaagccug

SEQ ID NO: 92979 - RNA, 26 nt, Human
ccagcagguguaggcgcugccgcgcu

SEQ ID NO: 92980 - RNA, 21 nt, Human
caagagccugcauuaaguugu

SEQ ID NO: 92981 - RNA, 22 nt, Human
guuugcaugguccauggcucau

SEQ ID NO: 92982 - RNA, 25 nt, Human
guaaauuuuaauuuucaucauucca

SEQ ID NO: 92983 - RNA, 22 nt, Human
gcugacugcaaccacugccucc

SEQ ID NO: 92984 - RNA, 21 nt, Human
ccaggguugagaacagaaggu

SEQ ID NO: 92985 - RNA, 23 nt, Human
agcauccugccugugggcaucca

SEQ ID NO: 92986 - RNA, 25 nt, Human
gggaucaggcucgccagggccacag

SEQ ID NO: 92987 - RNA, 27 nt, Human
gcaaaccuguggcuuugcaaaauguac

SEQ ID NO: 92988 - RNA, 27 nt, Human
agagaaacuguaaauggugcucugggg

SEQ ID NO: 92989 - RNA, 19 nt, Human
gcucuuucucagcacauug

SEQ ID NO: 92990 - RNA, 24 nt, Human
ucuccugccucagccucuugagua

SEQ ID NO: 92991 - RNA, 21 nt, Human
caaaggaugaagaacacagca

SEQ ID NO: 92992 - RNA, 20 nt, Human
cugccuggccagccuggggc

SEQ ID NO: 92993 - RNA, 27 nt, Human
uugccuaggcuggaaauaggauuuuga

SEQ ID NO: 92994 - RNA, 21 nt, Human
gucagcuccgccccuugaaca

SEQ ID NO: 92995 - RNA, 21 nt, Human
ggcugucgcauggagcauuuu

SEQ ID NO: 92996 - RNA, 22 nt, Human
guuccugccuuagagucaucuc

SEQ ID NO: 92997 - RNA, 26 nt, Human
ugugcacuccagcuucggaggcccug

SEQ ID NO: 92998 - RNA, 25 nt, Human
uagccucucuuuguuuuucuuuugc

SEQ ID NO: 92999 - RNA, 22 nt, Human
cuccugcuugaguucugagggc

SEQ ID NO: 93000 - RNA, 27 nt, Human
uuuaccuccccuuuucuauguugcuau

SEQ ID NO: 93001 - RNA, 22 nt, Human
gccagccugagcugccuccucc

SEQ ID NO: 93002 - RNA, 22 nt, Human
uaugaacaguugaaugccuuua

SEQ ID NO: 93003 - RNA, 22 nt, Human
ugagauaaagcuggcuguuauc

SEQ ID NO: 93004 - RNA, 24 nt, Human
acuguugugccuguuugucugcaa

SEQ ID NO: 93005 - RNA, 23 nt, Human
ggacacucugacauucggcuuga

SEQ ID NO: 93006 - RNA, 24 nt, Human
gguagaaaugccugaggaaagcag

SEQ ID NO: 93007 - RNA, 24 nt, Human
ugcagugaguugagaucgcacucc

SEQ ID NO: 93008 - RNA, 23 nt, Human
ggacccagacguggaguggagug

SEQ ID NO: 93009 - RNA, 22 nt, Human
cuaagccacaagaaauuugauu

SEQ ID NO: 93010 - RNA, 20 nt, Human
guauguacugcuuuaacucc

SEQ ID NO: 93011 - RNA, 23 nt, Human
ccaacuugccacauguucuaggu

SEQ ID NO: 93012 - RNA, 16 nt, Human
gcccaaggaugccuua

SEQ ID NO: 93013 - RNA, 21 nt, Human
ggcccuggcuggaguucagug

SEQ ID NO: 93014 - RNA, 21 nt, Human
augcagacugguuguagugga

SEQ ID NO: 93015 - RNA, 22 nt, Human
agcccacaccuuccuugcugau

SEQ ID NO: 93016 - RNA, 20 nt, Human
uagagcauucuggggugggg

SEQ ID NO: 93017 - RNA, 26 nt, Human
guccagacuggacuuguugcagacug

SEQ ID NO: 93018 - RNA, 21 nt, Human
caugcacacauuuaacgacag

SEQ ID NO: 93019 - RNA, 21 nt, Human
agaggcaccguucaccagagg

SEQ ID NO: 93020 - RNA, 21 nt, Human
ugcuccacauccgcugucugc

SEQ ID NO: 93021 - RNA, 22 nt, Human
caggaauaaguagacacuuuga

SEQ ID NO: 93022 - RNA, 21 nt, Human
gcuuggauacgucuguacuau

SEQ ID NO: 93023 - RNA, 32 nt, Human
acugaaucgccacuacagccugggugcaaaau

SEQ ID NO: 93024 - RNA, 21 nt, Human
ucuggcuguugaguugacggg

SEQ ID NO: 93025 - RNA, 24 nt, Human
aauuagcaggugcaccuucugugg

SEQ ID NO: 93026 - RNA, 30 nt, Human
aggaaccucuguuuucaagagagaugccug

SEQ ID NO: 93027 - RNA, 21 nt, Human
caccuggaaguggagugcagg

SEQ ID NO: 93028 - RNA, 20 nt, Human
gagacugaauucuugcaaug

SEQ ID NO: 93029 - RNA, 21 nt, Human
cccucauccuggucacugcuu

SEQ ID NO: 93030 - RNA, 26 nt, Human
gcugucucaaaaugcagaggaucuaa

SEQ ID NO: 93031 - RNA, 21 nt, Human
agaggguggcgacgucggggc

SEQ ID NO: 93032 - RNA, 23 nt, Human
ucccaaaccaaaccaaucaugga

SEQ ID NO: 93033 - RNA, 26 nt, Human
acagcuuccucacaccccugucccac

SEQ ID NO: 93034 - RNA, 21 nt, Human
caccgaggcuggagugcaaug

SEQ ID NO: 93035 - RNA, 27 nt, Human
ugccuguaaucccagcuacucaugagg

SEQ ID NO: 93036 - RNA, 20 nt, Human
guuuuccucaaccacacuca

SEQ ID NO: 93037 - RNA, 25 nt, Human
gcccugcacuccgccuuaguccugg

SEQ ID NO: 93038 - RNA, 26 nt, Human
augugggaaaacccccuguguguucu

SEQ ID NO: 93039 - RNA, 19 nt, Human
gcaaaccugagugagcaca

SEQ ID NO: 93040 - RNA, 19 nt, Human
gcauugacauacacagcaa

SEQ ID NO: 93041 - RNA, 21 nt, Human
cuguggccugaccugccugug

SEQ ID NO: 93042 - RNA, 22 nt, Human
cugaaccaggcgccaggcucca

SEQ ID NO: 93043 - RNA, 22 nt, Human
uggaaacacuaggauucaggaa

SEQ ID NO: 93044 - RNA, 19 nt, Human
gaaauaaaaauugaccuua

SEQ ID NO: 93045 - RNA, 30 nt, Human
uuuuccuagggcuccaaggcuguuccuaga

SEQ ID NO: 93046 - RNA, 26 nt, Human
cggccagagcggcgcuggcagaggag

SEQ ID NO: 93047 - RNA, 21 nt, Human
aggguccuugucccaucugcc

SEQ ID NO: 93048 - RNA, 23 nt, Human
ggcugagaagaggaaaaaagguc

SEQ ID NO: 93049 - RNA, 22 nt, Human
gaaagagaauagaaugaaauga

SEQ ID NO: 93050 - RNA, 20 nt, Human
gggaaagaugaaaugaagaa

SEQ ID NO: 93051 - RNA, 27 nt, Human
uguagugagccaagaucgcaacauugc

SEQ ID NO: 93052 - RNA, 21 nt, Human
gaagacgagaaaguugagaag

SEQ ID NO: 93053 - RNA, 22 nt, Human
gaguuugaaugguauaaaaagu

SEQ ID NO: 93054 - RNA, 21 nt, Human
uaagcauuuguauuuucucuc

SEQ ID NO: 93055 - RNA, 23 nt, Human
cuuccuccaaggcuggagugcag

SEQ ID NO: 93056 - RNA, 27 nt, Human
gcuccaaccugcaaagaucuguccuca

SEQ ID NO: 93057 - RNA, 24 nt, Human
aaaaaguugcuuuguuauuaauau

SEQ ID NO: 93058 - RNA, 21 nt, Human
gugaacaaacugcauggccuu

SEQ ID NO: 93059 - RNA, 24 nt, Human
ugagaucagccugggcaaugugau

SEQ ID NO: 93060 - RNA, 24 nt, Human
cuuggaccucuccacgugguugcc

SEQ ID NO: 93061 - RNA, 28 nt, Human
cccaucauuccuucuggccucugcugaa

SEQ ID NO: 93062 - RNA, 27 nt, Human
gccuggggcucuagcccaaggcucaga

SEQ ID NO: 93063 - RNA, 24 nt, Human
ggcuuccugcguccuccucaccuc

SEQ ID NO: 93064 - RNA, 24 nt, Human
agugccggaccaccaugccgcgcu

SEQ ID NO: 93065 - RNA, 24 nt, Human
gcugaguuuaguuuuucacuuuag

SEQ ID NO: 93066 - RNA, 27 nt, Human
gaggaaaagacuccuccugggggcugg

SEQ ID NO: 93067 - RNA, 20 nt, Human
uguuauauucaaggaaauua

SEQ ID NO: 93068 - RNA, 24 nt, Human
ucaucagcaggaguggaggguggg

SEQ ID NO: 93069 - RNA, 21 nt, Human
accucucuucugcacagcucc

SEQ ID NO: 93070 - RNA, 27 nt, Human
ggucuaaaacuccugaccucaagugau

SEQ ID NO: 93071 - RNA, 22 nt, Human
agagggaaagaggucugcugua

SEQ ID NO: 93072 - RNA, 28 nt, Human
gcuugauaucuucuguuuucccauugca

SEQ ID NO: 93073 - RNA, 20 nt, Human
auuucagagaguccuucccu

SEQ ID NO: 93074 - RNA, 22 nt, Human
gagcuccucucaucaaagccuu

SEQ ID NO: 93075 - RNA, 23 nt, Human
uucaguuuuuuauuguuaagcug

SEQ ID NO: 93076 - RNA, 26 nt, Human
uuuuauuuucuuuuucccuguuuagc

SEQ ID NO: 93077 - RNA, 27 nt, Human
uaccccugaggucccaugugccaugag

SEQ ID NO: 93078 - RNA, 22 nt, Human
cugauugcagagcacuaugagg

SEQ ID NO: 93079 - RNA, 27 nt, Human
ccuacuuccuuccagugccaugauccc

SEQ ID NO: 93080 - RNA, 24 nt, Human
cuccugcuggcuccuccugcccag

SEQ ID NO: 93081 - RNA, 27 nt, Human
ucccugccucgccucccgcgcgccuag

SEQ ID NO: 93082 - RNA, 26 nt, Human
cugccuucucguggcccugugugagc

SEQ ID NO: 93083 - RNA, 27 nt, Human
ggaggcugaagugggaggaucgcuuga

SEQ ID NO: 93084 - RNA, 27 nt, Human
auuuccagguuuucugggggagugcag

SEQ ID NO: 93085 - RNA, 25 nt, Human
aaagagugaugguaggcagagggca

SEQ ID NO: 93086 - RNA, 21 nt, Human
cuugcucaaguucaccagcau

SEQ ID NO: 93087 - RNA, 26 nt, Human
ucugaccucuuuggaaacuauaacau

SEQ ID NO: 93088 - RNA, 31 nt, Human
gccugaacgcuaagaacaugacuucugucug

SEQ ID NO: 93089 - RNA, 18 nt, Human
uggggacguggcacugaa

SEQ ID NO: 93090 - RNA, 26 nt, Human
guguugcucuggcacagaccacugug

SEQ ID NO: 93091 - RNA, 21 nt, Human
gccucacugcaaccuucaccu

SEQ ID NO: 93092 - RNA, 20 nt, Human
ccucuugcuauuuuguuaua

SEQ ID NO: 93093 - RNA, 21 nt, Human
aaaagugcugggauuacaggc

SEQ ID NO: 93094 - RNA, 26 nt, Human
aaucccugggccacuggagucaaggc

SEQ ID NO: 93095 - RNA, 23 nt, Human
ccaugccuugguggggccugugu

SEQ ID NO: 93096 - RNA, 31 nt, Human
ggaugacuuggagauuuaucucuguuuccuu

SEQ ID NO: 93097 - RNA, 26 nt, Human
guucccacuccuucaggacagcugcu

SEQ ID NO: 93098 - RNA, 23 nt, Human
cuugcuuuuuagcugaucuucca

SEQ ID NO: 93099 - RNA, 20 nt, Human
aagugugagggcugaaagaa

SEQ ID NO: 93100 - RNA, 25 nt, Human
guuccucccuccuuuucucuucucc

SEQ ID NO: 93101 - RNA, 20 nt, Human
ucaggaccaccuuccucuag

SEQ ID NO: 93102 - RNA, 21 nt, Human
gccccucuggccagggccccu

SEQ ID NO: 93103 - RNA, 27 nt, Human
uaguccuguaauggaagcaucuagcau

SEQ ID NO: 93104 - RNA, 27 nt, Human
acugcaaccuccaucuccuggauucaa

SEQ ID NO: 93105 - RNA, 25 nt, Human
gguaggcugcaggggugggcagaag

SEQ ID NO: 93106 - RNA, 25 nt, Human
gccuccugaauuaacuaucaucagu

SEQ ID NO: 93107 - RNA, 26 nt, Human
ugaacuucggcaacagaaugaugaac

SEQ ID NO: 93108 - RNA, 24 nt, Human
guuccaucauguuccaugcugcug

SEQ ID NO: 93109 - RNA, 23 nt, Human
cuccaaggacugagacugaccuc

SEQ ID NO: 93110 - RNA, 21 nt, Human
aggcugaggcacagaggagcu

SEQ ID NO: 93111 - RNA, 19 nt, Human
cccuuuugaaccucauugg

SEQ ID NO: 93112 - RNA, 25 nt, Human
ggcccuugggguuucucuuuuccac

SEQ ID NO: 93113 - RNA, 20 nt, Human
cccuuccuccuccuuugccu

SEQ ID NO: 93114 - RNA, 27 nt, Human
ccaugaucuugagauuauuuuuagcuu

SEQ ID NO: 93115 - RNA, 20 nt, Human
agguugggggaaccagcaga

SEQ ID NO: 93116 - RNA, 21 nt, Human
uaggagugauuugcaccuugc

SEQ ID NO: 93117 - RNA, 21 nt, Human
uguggguucaaacacauuuca

SEQ ID NO: 93118 - RNA, 22 nt, Human
ucccaggcugcuggagugcagu

SEQ ID NO: 93119 - RNA, 27 nt, Human
uucucaucagugugaaacugaggaguc

SEQ ID NO: 93120 - RNA, 27 nt, Human
ccuggcaccuccaacccgacacaugcu

SEQ ID NO: 93121 - RNA, 22 nt, Human
aucccaggucuaaagccacaag

SEQ ID NO: 93122 - RNA, 23 nt, Human
cuuccaggaagcuguagagaggg

SEQ ID NO: 93123 - RNA, 24 nt, Human
gggagagaugaguggguuagcuac

SEQ ID NO: 93124 - RNA, 19 nt, Human
aaaaucaaauuuugcuuaa

SEQ ID NO: 93125 - RNA, 27 nt, Human
ugcaguacucaggaaugcagcacagua

SEQ ID NO: 93126 - RNA, 26 nt, Human
cgcccagcuaauuuuuauauucuuua

SEQ ID NO: 93127 - RNA, 25 nt, Human
ccuccugccgccuuaugaacagggu

SEQ ID NO: 93128 - RNA, 23 nt, Human
ucagcguccugggcucaaaugau

SEQ ID NO: 93129 - RNA, 22 nt, Human
ggauuugaacccagcugcucug

SEQ ID NO: 93130 - RNA, 22 nt, Human
gcugcacuugccaugcuggaaa

SEQ ID NO: 93131 - RNA, 26 nt, Human
uagacacccgcccugcccuucccugg

SEQ ID NO: 93132 - RNA, 24 nt, Human
ggauucauuuggaaaguggguaaa

SEQ ID NO: 93133 - RNA, 21 nt, Human
ccagcccgcagagguggggug

SEQ ID NO: 93134 - RNA, 24 nt, Human
ggcccuccccacccacacccacag

SEQ ID NO: 93135 - RNA, 21 nt, Human
agcaaaugacaucacagcagg

SEQ ID NO: 93136 - RNA, 20 nt, Human
gggccugggggcaguuugag

SEQ ID NO: 93137 - RNA, 21 nt, Human
aagggacauccuuggggcugu

SEQ ID NO: 93138 - RNA, 22 nt, Human
caucauugcauuccagccuggg

SEQ ID NO: 93139 - RNA, 21 nt, Human
aauccaggucgugggggcugu

SEQ ID NO: 93140 - RNA, 22 nt, Human
caccauugcacuccagccuggg

SEQ ID NO: 93141 - RNA, 22 nt, Human
caccacugcacucuagccuggg

SEQ ID NO: 93142 - RNA, 26 nt, Human
ccauuuaucuuaacacagaacaugag

SEQ ID NO: 93143 - RNA, 19 nt, Human
aggcugaggaucuucaugc

SEQ ID NO: 93144 - RNA, 26 nt, Human
ugaaccaagaucgggccacugcacuc

SEQ ID NO: 93145 - RNA, 22 nt, Human
aagaacuucauagacacucaca

SEQ ID NO: 93146 - RNA, 27 nt, Human
gcaaucagccaaaaugauaccuggagg

SEQ ID NO: 93147 - RNA, 22 nt, Human
ccaauccuagacucacgugugc

SEQ ID NO: 93148 - RNA, 23 nt, Human
ccuaaauuggauccucuuccugc

SEQ ID NO: 93149 - RNA, 20 nt, Human
cuggagcugcuggggccaag

SEQ ID NO: 93150 - RNA, 23 nt, Human
ucgaccaccugugcucaagcaau

SEQ ID NO: 93151 - RNA, 20 nt, Human
gcuuuuguguaugucugacu

SEQ ID NO: 93152 - RNA, 23 nt, Human
cacgccuguaaucucagcuacuc

SEQ ID NO: 93153 - RNA, 26 nt, Human
gucacccaguuggugacugggaaagu

SEQ ID NO: 93154 - RNA, 23 nt, Human
ccaucugugugccugcagcugug

SEQ ID NO: 93155 - RNA, 22 nt, Human
gcauuucucaugcuucuucuca

SEQ ID NO: 93156 - RNA, 22 nt, Human
ccccgacggacaccaccaggcc

SEQ ID NO: 93157 - RNA, 27 nt, Human
gagagggaguccucgcggacgucagcc

SEQ ID NO: 93158 - RNA, 21 nt, Human
gcaaucucugccuccuggguu

SEQ ID NO: 93159 - RNA, 23 nt, Human
uacugccugagcaagaagugcug

SEQ ID NO: 93160 - RNA, 27 nt, Human
ccugggcaacagagcgagaccucuauc

SEQ ID NO: 93161 - RNA, 21 nt, Human
uggcugggagcagggcuuucu

SEQ ID NO: 93162 - RNA, 20 nt, Human
gccacccggguucaagcaau

SEQ ID NO: 93163 - RNA, 22 nt, Human
ggcaggcggagguugcagugag

SEQ ID NO: 93164 - RNA, 23 nt, Human
acauucucauaaaauugggcaca

SEQ ID NO: 93165 - RNA, 23 nt, Human
ccuuucucccaucuuaaggggcu

SEQ ID NO: 93166 - RNA, 22 nt, Human
ggucucaaacucccgaccucag

SEQ ID NO: 93167 - RNA, 24 nt, Human
ccaacaguagccaaaccccuagag

SEQ ID NO: 93168 - RNA, 22 nt, Human
uaucugccuccccugucuguaa

SEQ ID NO: 93169 - RNA, 20 nt, Human
ccuugcuguccgccugcacu

SEQ ID NO: 93170 - RNA, 20 nt, Human
accucgcccucucucaccag

SEQ ID NO: 93171 - RNA, 19 nt, Human
cauaacugaagcaugugaa

SEQ ID NO: 93172 - RNA, 27 nt, Human
aagcuuccagaccagcccuucacacac

SEQ ID NO: 93173 - RNA, 27 nt, Human
gcuccagaaagcaggaguugaagaccu

SEQ ID NO: 93174 - RNA, 24 nt, Human
cagcaccgcuaucucagccacuuu

SEQ ID NO: 93175 - RNA, 22 nt, Human
acuguucuuaaauugggcucac

SEQ ID NO: 93176 - RNA, 24 nt, Human
cugguugcugugucauaacuucau

SEQ ID NO: 93177 - RNA, 19 nt, Human
ggccaggcuggaggcaggg

SEQ ID NO: 93178 - RNA, 21 nt, Human
gcccccacugccgcaggugcc

SEQ ID NO: 93179 - RNA, 20 nt, Human
uggucucacuguguugccca

SEQ ID NO: 93180 - RNA, 27 nt, Human
gggagagauggagcaaagugagggccg

SEQ ID NO: 93181 - RNA, 21 nt, Human
agccgaggugggaggcauggg

SEQ ID NO: 93182 - RNA, 19 nt, Human
ccucccucauaccuagcca

SEQ ID NO: 93183 - RNA, 30 nt, Human
ggugcagagccccuggcacagccaacccug

SEQ ID NO: 93184 - RNA, 20 nt, Human
cugagcucaaaggaacagga

SEQ ID NO: 93185 - RNA, 28 nt, Human
caagaucuucuaaccccaagagacuuca

SEQ ID NO: 93186 - RNA, 24 nt, Human
gagcuggucuauggaaguuuccag

SEQ ID NO: 93187 - RNA, 22 nt, Human
gugaguuagagguaugcuauca

SEQ ID NO: 93188 - RNA, 25 nt, Human
gccucugccucccaaagugcuagga

SEQ ID NO: 93189 - RNA, 23 nt, Human
agauucucuguggggagagugaa

SEQ ID NO: 93190 - RNA, 23 nt, Human
gcagucaucuucagcguuuucca

SEQ ID NO: 93191 - RNA, 24 nt, Human
guggccuuuaaaaaccuacuuccc

SEQ ID NO: 93192 - RNA, 18 nt, Human
agaucaacaacacuacuu

SEQ ID NO: 93193 - RNA, 19 nt, Human
uacccugggaucccaucca

SEQ ID NO: 93194 - RNA, 21 nt, Human
cuagaugaagagaguaucauu

SEQ ID NO: 93195 - RNA, 23 nt, Human
ggcacucagaaacccgggcgcug

SEQ ID NO: 93196 - RNA, 21 nt, Human
uauucuggauuagacaacaaa

SEQ ID NO: 93197 - RNA, 25 nt, Human
auuccuuccaugauagauauaaagg

SEQ ID NO: 93198 - RNA, 21 nt, Human
gccacaauuuuugcacuugcu

SEQ ID NO: 93199 - RNA, 21 nt, Human
gcgggccgccaccacugcucc

SEQ ID NO: 93200 - RNA, 22 nt, Human
ucugccaccauccugcugcugu

SEQ ID NO: 93201 - RNA, 18 nt, Human
gaucaagaagacuuccuu

SEQ ID NO: 93202 - RNA, 21 nt, Human
ccucagggaaccucucccugg

SEQ ID NO: 93203 - RNA, 24 nt, Human
caggaagggaaggagaggugucug

SEQ ID NO: 93204 - RNA, 27 nt, Human
uucauagacccaucuucugcugggacu

SEQ ID NO: 93205 - RNA, 27 nt, Human
uuccaguucagcuccugcacaguugcu

SEQ ID NO: 93206 - RNA, 22 nt, Human
aguggugugaucacagcucacu

SEQ ID NO: 93207 - RNA, 23 nt, Human
aaguaugucagcaccuuuucuca

SEQ ID NO: 93208 - RNA, 23 nt, Human
cuaguagcugggauuacaggcgc

SEQ ID NO: 93209 - RNA, 18 nt, Human
cucugccacagggacuug

SEQ ID NO: 93210 - RNA, 22 nt, Human
ccccucacggggcggcagaggc

SEQ ID NO: 93211 - RNA, 22 nt, Human
guacagucauucuguugggcug

SEQ ID NO: 93212 - RNA, 32 nt, Human
gaaacuuauaguuaauauuuuguucuuauuug

SEQ ID NO: 93213 - RNA, 23 nt, Human
ccugugagguggagcuugcagug

SEQ ID NO: 93214 - RNA, 28 nt, Human
gcaggaccugcacccuguguguuggcac

SEQ ID NO: 93215 - RNA, 20 nt, Human
uaccaucccagcucccggga

SEQ ID NO: 93216 - RNA, 22 nt, Human
ucauagaagguggaaucggaca

SEQ ID NO: 93217 - RNA, 23 nt, Human
ccugcagccugcccccuaggcag

SEQ ID NO: 93218 - RNA, 18 nt, Human
ggccugcacugguguuuu

SEQ ID NO: 93219 - RNA, 22 nt, Human
ugcuacugcugcugcuacugcu

SEQ ID NO: 93220 - RNA, 27 nt, Human
uguuuuaucuucuacuguaucgccagu

SEQ ID NO: 93221 - RNA, 22 nt, Human
ugcuucagaauuaaaacaauga

SEQ ID NO: 93222 - RNA, 21 nt, Human
gagagggauggcucacgaggc

SEQ ID NO: 93223 - RNA, 21 nt, Human
ggggagaagagccacccccag

SEQ ID NO: 93224 - RNA, 26 nt, Human
ggggcaggaggaaugcaggagcagga

SEQ ID NO: 93225 - RNA, 22 nt, Human
gcgccugccaccaugccuggcu

SEQ ID NO: 93226 - RNA, 22 nt, Human
uccgcgcccuccgaccucucuc

SEQ ID NO: 93227 - RNA, 21 nt, Human
uccuucacuuggucugucugu

SEQ ID NO: 93228 - RNA, 21 nt, Human
aaguugagccacgguccuuac

SEQ ID NO: 93229 - RNA, 22 nt, Human
ggcucagugcaaccucugccuc

SEQ ID NO: 93230 - RNA, 22 nt, Human
gcccaggcuggagugcaaugca

SEQ ID NO: 93231 - RNA, 21 nt, Human
guggcccaggcugagagcagc

SEQ ID NO: 93232 - RNA, 20 nt, Human
ggaugucugagucaccagaa

SEQ ID NO: 93233 - RNA, 24 nt, Human
ugccucgggggugguuguucuuca

SEQ ID NO: 93234 - RNA, 28 nt, Human
agacccaggagucucugaaggcuuccgc

SEQ ID NO: 93235 - RNA, 27 nt, Human
gugacaggccaaucagacagggcccag

SEQ ID NO: 93236 - RNA, 23 nt, Human
ggagcacggcacacuccucgccc

SEQ ID NO: 93237 - RNA, 27 nt, Human
cccagcaccugccuccucguuccuuuc

SEQ ID NO: 93238 - RNA, 22 nt, Human
gagaggggaagaaacacuuucu

SEQ ID NO: 93239 - RNA, 22 nt, Human
aggcuggagugcaauagcucga

SEQ ID NO: 93240 - RNA, 21 nt, Human
uuucugaugcuaucagacucu

SEQ ID NO: 93241 - RNA, 19 nt, Human
ucugcucucagcuugugcc

SEQ ID NO: 93242 - RNA, 23 nt, Human
uuuccuggcuuuuccucccucag

SEQ ID NO: 93243 - RNA, 26 nt, Human
aguauuuuuaaaaaguugccuucucc

SEQ ID NO: 93244 - RNA, 21 nt, Human
uuuucuauuuagagaaugcuu

SEQ ID NO: 93245 - RNA, 22 nt, Human
ggcucacugcauccucaaccuc

SEQ ID NO: 93246 - RNA, 26 nt, Human
aauaaauugaauauauugguugcuca

SEQ ID NO: 93247 - RNA, 22 nt, Human
cugaguauuuccuaauuguaua

SEQ ID NO: 93248 - RNA, 18 nt, Human
auccacccucaugguguc

SEQ ID NO: 93249 - RNA, 23 nt, Human
gcugaccuugaacuccugggcuc

SEQ ID NO: 93250 - RNA, 25 nt, Human
ccgaguagcugggacuacaagcggc

SEQ ID NO: 93251 - RNA, 21 nt, Human
ucauuuuucuuccaaaauugc

SEQ ID NO: 93252 - RNA, 25 nt, Human
ugagaacaggcuaugggaaggcugc

SEQ ID NO: 93253 - RNA, 20 nt, Human
ugcuaaagaauuauuuacca

SEQ ID NO: 93254 - RNA, 21 nt, Human
uuccuauaacauaguauuuua

SEQ ID NO: 93255 - RNA, 21 nt, Human
ccaccugcccuugaagcuuua

SEQ ID NO: 93256 - RNA, 23 nt, Human
gagagugacgacauggaaaauga

SEQ ID NO: 93257 - RNA, 27 nt, Human
uguggcggguuucuuccuggggaacac

SEQ ID NO: 93258 - RNA, 21 nt, Human
agaucuggaaccucagccugg

SEQ ID NO: 93259 - RNA, 20 nt, Human
agaagcaccacauccuuuca

SEQ ID NO: 93260 - RNA, 21 nt, Human
auugcauuuucuuccuuucgc

SEQ ID NO: 93261 - RNA, 28 nt, Human
aggaaaggcugccugcagaggacaggug

SEQ ID NO: 93262 - RNA, 24 nt, Human
agccuccaaaguggagcugggagg

SEQ ID NO: 93263 - RNA, 23 nt, Human
aggagauguuuugaaauggagag

SEQ ID NO: 93264 - RNA, 27 nt, Human
gcugcaucuuauagcacuuugaaauac

SEQ ID NO: 93265 - RNA, 27 nt, Human
gccagccuggccaaaauggcaaaaccc

SEQ ID NO: 93266 - RNA, 20 nt, Human
gacagcuguagucauaucug

SEQ ID NO: 93267 - RNA, 27 nt, Human
uugugugacccuaggccucucaccucu

SEQ ID NO: 93268 - RNA, 27 nt, Human
auuggccaaccugccuuuccccagaag

SEQ ID NO: 93269 - RNA, 22 nt, Human
acugcagccuccaccuccuggg

SEQ ID NO: 93270 - RNA, 26 nt, Human
gcugacaguccugcccugccugcucc

SEQ ID NO: 93271 - RNA, 21 nt, Human
uguuuacacuucaaucugcag

SEQ ID NO: 93272 - RNA, 23 nt, Human
aacaucugcacuccugaacacac

SEQ ID NO: 93273 - RNA, 28 nt, Human
ggauuugcccagaguucaguccuggcug

SEQ ID NO: 93274 - RNA, 26 nt, Human
uucauuucuccugguaccuguauuua

SEQ ID NO: 93275 - RNA, 27 nt, Human
cccuccagguccucagaguuugcagau

SEQ ID NO: 93276 - RNA, 24 nt, Human
gcccggugcuggggaccuccugga

SEQ ID NO: 93277 - RNA, 23 nt, Human
gcuggagauccuuucucucaagg

SEQ ID NO: 93278 - RNA, 25 nt, Human
uacaucacggcuucucucccacguu

SEQ ID NO: 93279 - RNA, 18 nt, Human
cagccaggccucuguggc

SEQ ID NO: 93280 - RNA, 23 nt, Human
agcuugaggcuguggugugaaag

SEQ ID NO: 93281 - RNA, 22 nt, Human
uuccaggguugaaucuuguccc

SEQ ID NO: 93282 - RNA, 23 nt, Human
guuggccaggcuggagugcagua

SEQ ID NO: 93283 - RNA, 27 nt, Human
ugaauccaggucgugggggcugucaua

SEQ ID NO: 93284 - RNA, 26 nt, Human
gcacacaccuaaagauaucuuuuuag

SEQ ID NO: 93285 - RNA, 21 nt, Human
gcagcuguucccaggaggcag

SEQ ID NO: 93286 - RNA, 20 nt, Human
ccuacacacugucaugcuuc

SEQ ID NO: 93287 - RNA, 21 nt, Human
ccccccuccuggggugcagug

SEQ ID NO: 93288 - RNA, 25 nt, Human
ucugaugcagaacuuucucuuuuga

SEQ ID NO: 93289 - RNA, 19 nt, Human
cauggacucagccgcccgg

SEQ ID NO: 93290 - RNA, 25 nt, Human
gaaaggagagccaggagcauuuaaa

SEQ ID NO: 93291 - RNA, 26 nt, Human
agcggaggagucgugucgugccugag

SEQ ID NO: 93292 - RNA, 26 nt, Human
ccagugcuuggccuggcaguggcuuc

SEQ ID NO: 93293 - RNA, 20 nt, Human
caggaaggggguccacccag

SEQ ID NO: 93294 - RNA, 22 nt, Human
ugcucacuggccccgcuugucu

SEQ ID NO: 93295 - RNA, 17 nt, Human
cagagagguaacucccu

SEQ ID NO: 93296 - RNA, 22 nt, Human
ggaaagccgaaggcggagcagc

SEQ ID NO: 93297 - RNA, 23 nt, Human
gaccucgugaucugcccaccucg

SEQ ID NO: 93298 - RNA, 22 nt, Human
ucuguuuuuucuugaagccuau

SEQ ID NO: 93299 - RNA, 23 nt, Human
acacacaaccuccccuguuuuca

SEQ ID NO: 93300 - RNA, 20 nt, Human
ucccaaaggggcaacgggag

SEQ ID NO: 93301 - RNA, 21 nt, Human
cuugcccuucccugaaugugc

SEQ ID NO: 93302 - RNA, 29 nt, Human
aggaaauguagacaaaauggauauaaaug

SEQ ID NO: 93303 - RNA, 21 nt, Human
gaggaacugggcagagcuuga

SEQ ID NO: 93304 - RNA, 22 nt, Human
ugagacgcacagagaggucucu

SEQ ID NO: 93305 - RNA, 24 nt, Human
aagcagaugaccucacaggaguga

SEQ ID NO: 93306 - RNA, 22 nt, Human
agcaguuucaggacuucauuca

SEQ ID NO: 93307 - RNA, 23 nt, Human
guccucugaccccuuuggcaagg

SEQ ID NO: 93308 - RNA, 26 nt, Human
cccaggccacacagauucuccucaag

SEQ ID NO: 93309 - RNA, 21 nt, Human
gcucgggccauguccgagggg

SEQ ID NO: 93310 - RNA, 26 nt, Human
ccuucuggcccuggaagacugagucu

SEQ ID NO: 93311 - RNA, 21 nt, Human
uaagcauuaacuaacaaccuu

SEQ ID NO: 93312 - RNA, 23 nt, Human
ugggauaacauguauauguguac

SEQ ID NO: 93313 - RNA, 21 nt, Human
cucaggguuacacaguuccaa

SEQ ID NO: 93314 - RNA, 22 nt, Human
ccaaccuggugaaaccccgucu

SEQ ID NO: 93315 - RNA, 22 nt, Human
gugccgggagaggacucugccu

SEQ ID NO: 93316 - RNA, 29 nt, Human
gcugacaguccugcccugccugcuccucg

SEQ ID NO: 93317 - RNA, 23 nt, Human
ucuuacuggcaaguucuggagcu

SEQ ID NO: 93318 - RNA, 20 nt, Human
acaugcucuuuuucugugau

SEQ ID NO: 93319 - RNA, 18 nt, Human
ccuguauucucuuugcca

SEQ ID NO: 93320 - RNA, 23 nt, Human
uugacauuuuaugauagauuugc

SEQ ID NO: 93321 - RNA, 21 nt, Human
uuuuacaaauuuaauuuugca

SEQ ID NO: 93322 - RNA, 24 nt, Human
cucagcgaccaggugcugcugcug

SEQ ID NO: 93323 - RNA, 23 nt, Human
cagccaggccucuguggccucug

SEQ ID NO: 93324 - RNA, 21 nt, Human
aucucuagaugacuguuccca

SEQ ID NO: 93325 - RNA, 21 nt, Human
cuacauagccaaauguuugua

SEQ ID NO: 93326 - RNA, 21 nt, Human
uacucagaaauggacaaagaa

SEQ ID NO: 93327 - RNA, 25 nt, Human
uccaggaaaugcagaagaggaaugu

SEQ ID NO: 93328 - RNA, 22 nt, Human
ucaggcuggaguacaguggugc

SEQ ID NO: 93329 - RNA, 21 nt, Human
agcaagucccugagcugugcu

SEQ ID NO: 93330 - RNA, 22 nt, Human
auugugcaccuacuauguggcg

SEQ ID NO: 93331 - RNA, 23 nt, Human
uuccaaccuugcuggcuacuuua

SEQ ID NO: 93332 - RNA, 24 nt, Human
auuucugacugaucaaaaaggccu

SEQ ID NO: 93333 - RNA, 26 nt, Human
gcccuuucccacaccuuuguuccuca

SEQ ID NO: 93334 - RNA, 22 nt, Human
gaagggagagcggggcagucuc

SEQ ID NO: 93335 - RNA, 19 nt, Human
gaaacacagaacucagccu

SEQ ID NO: 93336 - RNA, 24 nt, Human
guguaagcaauaacagaucugcca

SEQ ID NO: 93337 - RNA, 22 nt, Human
cccagacccagggccucaggcc

SEQ ID NO: 93338 - RNA, 27 nt, Human
aggauuuucacacccccuccucaagcu

SEQ ID NO: 93339 - RNA, 23 nt, Human
gggucucaaacaguccugacuca

SEQ ID NO: 93340 - RNA, 22 nt, Human
uauggcucgaucuuggcucacu

SEQ ID NO: 93341 - RNA, 27 nt, Human
ggucuugaacuccuggccucaagugau

SEQ ID NO: 93342 - RNA, 21 nt, Human
cuuugagcuccugggaacagg

SEQ ID NO: 93343 - RNA, 26 nt, Human
ggcugcugcuuucugcccagcucgcc

SEQ ID NO: 93344 - RNA, 20 nt, Human
aguagcaaauguuuacugua

SEQ ID NO: 93345 - RNA, 23 nt, Human
cccaucauucaguccaagugcuu

SEQ ID NO: 93346 - RNA, 20 nt, Human
cccuccacuccagcucugag

SEQ ID NO: 93347 - RNA, 21 nt, Human
auuggccugugaagcauugga

SEQ ID NO: 93348 - RNA, 22 nt, Human
ccucacccuccaggcugcugug

SEQ ID NO: 93349 - RNA, 20 nt, Human
cucguuuggaucugugacac

SEQ ID NO: 93350 - RNA, 22 nt, Human
augagggagagagaaagggugg

SEQ ID NO: 93351 - RNA, 20 nt, Human
uggacucaggcuggaggcag

SEQ ID NO: 93352 - RNA, 20 nt, Human
uaauuggcugcccucaggac

SEQ ID NO: 93353 - RNA, 18 nt, Human
cagauguucuuaauccag

SEQ ID NO: 93354 - RNA, 24 nt, Human
gguuaccauuuugaggcaguugga

SEQ ID NO: 93355 - RNA, 28 nt, Human
ccacaagaauucacaggucucaaagcag

SEQ ID NO: 93356 - RNA, 24 nt, Human
uguuggugacaucauguaaaauuu

SEQ ID NO: 93357 - RNA, 20 nt, Human
cauuuuggaguguccuggcu

SEQ ID NO: 93358 - RNA, 27 nt, Human
gggccgaaggcugauuuggaagggcgu

SEQ ID NO: 93359 - RNA, 23 nt, Human
ugugcagaaugaacgaagucaca

SEQ ID NO: 93360 - RNA, 20 nt, Human
gcaggaggauggugccugga

SEQ ID NO: 93361 - RNA, 29 nt, Human
gcuggcauggugguacagaagguaucagu

SEQ ID NO: 93362 - RNA, 26 nt, Human
gucucuuuuuacacuucaccuccuuc

SEQ ID NO: 93363 - RNA, 22 nt, Human
gaacuccugaccuuaggugauc

SEQ ID NO: 93364 - RNA, 21 nt, Human
auugaacuuauccuaaaacaa

SEQ ID NO: 93365 - RNA, 22 nt, Human
aaagugcuguuuuuaaaagcau

SEQ ID NO: 93366 - RNA, 22 nt, Human
ucaccgaggcuggagugcaaug

SEQ ID NO: 93367 - RNA, 19 nt, Human
uuuugccaggcuggugcaa

SEQ ID NO: 93368 - RNA, 21 nt, Human
uuccuccaggagucucuggug

SEQ ID NO: 93369 - RNA, 26 nt, Human
gaagugagugugaacagccaauggac

SEQ ID NO: 93370 - RNA, 26 nt, Human
gccguuuuuacccugcccuggcuggc

SEQ ID NO: 93371 - RNA, 19 nt, Human
uggagccagcacagugcuc

SEQ ID NO: 93372 - RNA, 20 nt, Human
uaaacaacagguuugcauuc

SEQ ID NO: 93373 - RNA, 23 nt, Human
uuccccaagcugcacaggaggcc

SEQ ID NO: 93374 - RNA, 24 nt, Human
ccgcaggaggcuguggcagcugug

SEQ ID NO: 93375 - RNA, 19 nt, Human
ccuuguuccuggcagcagg

SEQ ID NO: 93376 - RNA, 20 nt, Human
acauaugaccugaaacaacu

SEQ ID NO: 93377 - RNA, 22 nt, Human
cacgaggcacagaaaacaaaua

SEQ ID NO: 93378 - RNA, 20 nt, Human
ugacccugugggagucagaa

SEQ ID NO: 93379 - RNA, 32 nt, Human
uugccugucaaaggcuggagggcaggaggagg

SEQ ID NO: 93380 - RNA, 18 nt, Human
accauccggucaccagaa

SEQ ID NO: 93381 - RNA, 22 nt, Human
uccuugcccauuaucagaagga

SEQ ID NO: 93382 - RNA, 27 nt, Human
ugaccucucugauuuucuacugcucuu

SEQ ID NO: 93383 - RNA, 25 nt, Human
ugcuauuucauaucuguacuccagg

SEQ ID NO: 93384 - RNA, 24 nt, Human
uuaguaguucuucacuuugcugug

SEQ ID NO: 93385 - RNA, 26 nt, Human
auauguauguagacacuuuuaaaagc

SEQ ID NO: 93386 - RNA, 26 nt, Human
cacccaggcugcagggugaggccagg

SEQ ID NO: 93387 - RNA, 27 nt, Human
uucauucucucugaacacacauugcua

SEQ ID NO: 93388 - RNA, 20 nt, Human
gcuugcuuuuucucuaccuu

SEQ ID NO: 93389 - RNA, 23 nt, Human
ccugcagcuucccugaccacgcc

SEQ ID NO: 93390 - RNA, 22 nt, Human
cuccaucucggaugaaagugcu

SEQ ID NO: 93391 - RNA, 21 nt, Human
gagucugaccuuaggugucuc

SEQ ID NO: 93392 - RNA, 20 nt, Human
aaggcaaggcccugcccugc

SEQ ID NO: 93393 - RNA, 20 nt, Human
ggaggcaccaugagcgugga

SEQ ID NO: 93394 - RNA, 21 nt, Human
uccucaagauuuuuaguuugg

SEQ ID NO: 93395 - RNA, 22 nt, Human
uuacuuuauuugauggugguug

SEQ ID NO: 93396 - RNA, 23 nt, Human
cccagccugggauccuucgugcu

SEQ ID NO: 93397 - RNA, 26 nt, Human
uccuucaaauacugcuguauuuucag

SEQ ID NO: 93398 - RNA, 26 nt, Human
gaucagaucuguaauucacaacugug

SEQ ID NO: 93399 - RNA, 22 nt, Human
ccuccuccuccuccuggcccug

SEQ ID NO: 93400 - RNA, 22 nt, Human
caccuccuggguucaggcgauu

SEQ ID NO: 93401 - RNA, 25 nt, Human
ggggagagauagggugggaggcagg

SEQ ID NO: 93402 - RNA, 21 nt, Human
acuugucugccuuccuuucca

SEQ ID NO: 93403 - RNA, 22 nt, Human
aggcagaggcaggaaacuaacu

SEQ ID NO: 93404 - RNA, 22 nt, Human
ugggauucuaaacaugaggcag

SEQ ID NO: 93405 - RNA, 25 nt, Human
auuucucccagcaguuuuaaaggau

SEQ ID NO: 93406 - RNA, 22 nt, Human
uauguauguauauauuaucagu

SEQ ID NO: 93407 - RNA, 28 nt, Human
gcccaaccuucuuucacugacacccacc

SEQ ID NO: 93408 - RNA, 21 nt, Human
ccggcccagccggcucuccug

SEQ ID NO: 93409 - RNA, 27 nt, Human
aacacaaauaucguuuuccauacagca

SEQ ID NO: 93410 - RNA, 22 nt, Human
ggccaaucaugcgcccaccucu

SEQ ID NO: 93411 - RNA, 22 nt, Human
ucugucuugaagcucagccaag

SEQ ID NO: 93412 - RNA, 21 nt, Human
gacucaggcuggaggcagaua

SEQ ID NO: 93413 - RNA, 23 nt, Human
gcccuacuauuuucaacaaaaca

SEQ ID NO: 93414 - RNA, 19 nt, Human
gcuucucugugccccugua

SEQ ID NO: 93415 - RNA, 21 nt, Human
cugcagaauguauauaacaca

SEQ ID NO: 93416 - RNA, 22 nt, Human
uagaagcuagcugagguagcuu

SEQ ID NO: 93417 - RNA, 20 nt, Human
uauuaccugcagauaguaag

SEQ ID NO: 93418 - RNA, 25 nt, Human
uguggguauugagugugauuugaau

SEQ ID NO: 93419 - RNA, 24 nt, Human
ggcccugaauccuccucugcucca

SEQ ID NO: 93420 - RNA, 25 nt, Human
ggaagagaugguugcaggcaaaaug

SEQ ID NO: 93421 - RNA, 28 nt, Human
gugcaccuuucaggcacagcccuaguuu

SEQ ID NO: 93422 - RNA, 19 nt, Human
ugauucuuucaauccacag

SEQ ID NO: 93423 - RNA, 22 nt, Human
ccaaagugcugggauuacaaga

SEQ ID NO: 93424 - RNA, 24 nt, Human
gacuguuuaauuugaaaguuuaca

SEQ ID NO: 93425 - RNA, 27 nt, Human
aacagccaacacugaaaacacugugag

SEQ ID NO: 93426 - RNA, 21 nt, Human
aaaauccacaaaagccacuuu

SEQ ID NO: 93427 - RNA, 22 nt, Human
cacccagggcaggggaucuucu

SEQ ID NO: 93428 - RNA, 25 nt, Human
uccucuauuuuuauauccuuuccug

SEQ ID NO: 93429 - RNA, 22 nt, Human
ugggacuacaaacgugugucac

SEQ ID NO: 93430 - RNA, 17 nt, Human
accaaauauaugccuua

SEQ ID NO: 93431 - RNA, 21 nt, Human
gcugcugccugcucauggccc

SEQ ID NO: 93432 - RNA, 26 nt, Human
caacacccauucaucucaagugcuuc

SEQ ID NO: 93433 - RNA, 21 nt, Human
agacggcccuggcagaggucg

SEQ ID NO: 93434 - RNA, 25 nt, Human
cauguuugcuucauaaaugaagcag

SEQ ID NO: 93435 - RNA, 21 nt, Human
uuugggaaaccaaggucagga

SEQ ID NO: 93436 - RNA, 26 nt, Human
ccucauccugacuccacccucccacu

SEQ ID NO: 93437 - RNA, 24 nt, Human
gacagagcucuggguugugcacau

SEQ ID NO: 93438 - RNA, 22 nt, Human
gcacuucccaauugggauuuua

SEQ ID NO: 93439 - RNA, 23 nt, Human
ugggugguguauuugagaagaua

SEQ ID NO: 93440 - RNA, 26 nt, Human
cagggaaggaaaggcuccgccauuug

SEQ ID NO: 93441 - RNA, 22 nt, Human
ugcuucuugggaggccagccuu

SEQ ID NO: 93442 - RNA, 24 nt, Human
uugggauaccuggauucugguucu

SEQ ID NO: 93443 - RNA, 23 nt, Human
cggagccgccuccuccuggccag

SEQ ID NO: 93444 - RNA, 24 nt, Human
cagaguccuguaaucagugcaugu

SEQ ID NO: 93445 - RNA, 23 nt, Human
caacuucaagaaaagcagcucag

SEQ ID NO: 93446 - RNA, 27 nt, Human
uacuacugcauuuccuguuuuccuuuu

SEQ ID NO: 93447 - RNA, 26 nt, Human
gaggccacauauuuuguucacuguug

SEQ ID NO: 93448 - RNA, 21 nt, Human
ccucugcugcuuuccaacaca

SEQ ID NO: 93449 - RNA, 24 nt, Human
ccucccagggcccugccagguugu

SEQ ID NO: 93450 - RNA, 19 nt, Human
uaucuagauuuuucuguga

SEQ ID NO: 93451 - RNA, 22 nt, Human
caggaggaagagguugcaguga

SEQ ID NO: 93452 - RNA, 27 nt, Human
uggcuguaaagguauuuuuccucugcc

SEQ ID NO: 93453 - RNA, 22 nt, Human
gcaguauuuauacuauuguaaa

SEQ ID NO: 93454 - RNA, 22 nt, Human
gcugaaguucuucugcgcugag

SEQ ID NO: 93455 - RNA, 26 nt, Human
ucuaccuuccuuaccaugauucagcc

SEQ ID NO: 93456 - RNA, 24 nt, Human
ucuucacauuaucauaaccucucc

SEQ ID NO: 93457 - RNA, 20 nt, Human
gucuuaaauauauuguacuc

SEQ ID NO: 93458 - RNA, 19 nt, Human
cuguucuaaggcugugcca

SEQ ID NO: 93459 - RNA, 27 nt, Human
gcuagaugagcccagauuucuuccccc

SEQ ID NO: 93460 - RNA, 28 nt, Human
ggcuccagcucuggcacagugguuccug

SEQ ID NO: 93461 - RNA, 21 nt, Human
ggggucaggguuuucuguuca

SEQ ID NO: 93462 - RNA, 29 nt, Human
ccguuucuaccaccgcauccucacugggc

SEQ ID NO: 93463 - RNA, 22 nt, Human
gggcaccagggaugcaauucca

SEQ ID NO: 93464 - RNA, 23 nt, Human
ucugcgagcaacagugcccccuc

SEQ ID NO: 93465 - RNA, 27 nt, Human
gauugaaaagauaacauguaggccagg

SEQ ID NO: 93466 - RNA, 21 nt, Human
gguggggaggggaugggcugg

SEQ ID NO: 93467 - RNA, 27 nt, Human
cucaaagcaggauuucaggcaauuccc

SEQ ID NO: 93468 - RNA, 27 nt, Human
ccagcacuccucugucucugcucuugc

SEQ ID NO: 93469 - RNA, 24 nt, Human
guucucuuuuugaaaugaauuugu

SEQ ID NO: 93470 - RNA, 20 nt, Human
agaguuuguuaccuaccuua

SEQ ID NO: 93471 - RNA, 23 nt, Human
ccauuucuucccugcucagcuuc

SEQ ID NO: 93472 - RNA, 19 nt, Human
aacugagagaaagauucug

SEQ ID NO: 93473 - RNA, 21 nt, Human
ggcagaaaagcacauuuuaaa

SEQ ID NO: 93474 - RNA, 21 nt, Human
aaacaaaacacuaacaaucuu

SEQ ID NO: 93475 - RNA, 20 nt, Human
gccucuuuccuguuguuguu

SEQ ID NO: 93476 - RNA, 22 nt, Human
cuccgucucucuccauuguguu

SEQ ID NO: 93477 - RNA, 22 nt, Human
ugcugccccuucagcugcccuc

SEQ ID NO: 93478 - RNA, 23 nt, Human
accaugcccccaccuaagucaca

SEQ ID NO: 93479 - RNA, 15 nt, Human
ccagaucucuguaaa

SEQ ID NO: 93480 - RNA, 20 nt, Human
cugccaggcugcgaugcgug

SEQ ID NO: 93481 - RNA, 21 nt, Human
ccucugcagacaccaaugucc

SEQ ID NO: 93482 - RNA, 26 nt, Human
auaccagacacguacaaaauccagcu

SEQ ID NO: 93483 - RNA, 23 nt, Human
agggauccuagaaagcauuguca

SEQ ID NO: 93484 - RNA, 23 nt, Human
uggagauugaggggucugcugca

SEQ ID NO: 93485 - RNA, 24 nt, Human
guccauguaacaaaagaucuggaa

SEQ ID NO: 93486 - RNA, 20 nt, Human
aaagagaauaaagacauaug

SEQ ID NO: 93487 - RNA, 27 nt, Human
ugacccuaccagagguuggagaacaaa

SEQ ID NO: 93488 - RNA, 23 nt, Human
uaaucuuucugucauuuaaagca

SEQ ID NO: 93489 - RNA, 20 nt, Human
ugcccaggcagcugguggug

SEQ ID NO: 93490 - RNA, 24 nt, Human
uucacacacggaccaucuuuagca

SEQ ID NO: 93491 - RNA, 23 nt, Human
uaaguugccauuugaacuaaacg

SEQ ID NO: 93492 - RNA, 26 nt, Human
cauuaccuuuuuauucugguauauag

SEQ ID NO: 93493 - RNA, 21 nt, Human
ucuucagucuuuuucaguuaa

SEQ ID NO: 93494 - RNA, 20 nt, Human
cucacccugguaaguacagu

SEQ ID NO: 93495 - RNA, 19 nt, Human
aaccagccacugcccucuc

SEQ ID NO: 93496 - RNA, 28 nt, Human
ugaacaaugucaacaaggcacugcgggu

SEQ ID NO: 93497 - RNA, 23 nt, Human
gcuguucuucaacuccugggcuc

SEQ ID NO: 93498 - RNA, 24 nt, Human
cucugucucuguggaaaagccauc

SEQ ID NO: 93499 - RNA, 22 nt, Human
ugcccuaguccacuuuaucuuu

SEQ ID NO: 93500 - RNA, 27 nt, Human
gccugcccuuacucacgcucugcucug

SEQ ID NO: 93501 - RNA, 26 nt, Human
gcguaguugcagcgggggcuugggga

SEQ ID NO: 93502 - RNA, 21 nt, Human
cugcccaggcuggaguacagu

SEQ ID NO: 93503 - RNA, 22 nt, Human
ucacacaggcuggagugcagug

SEQ ID NO: 93504 - RNA, 26 nt, Human
aacaucuucaguuuuucucccacugg

SEQ ID NO: 93505 - RNA, 24 nt, Human
cuaugucaauugauauuucugugu

SEQ ID NO: 93506 - RNA, 20 nt, Human
gacuucuguuucacaguuca

SEQ ID NO: 93507 - RNA, 22 nt, Human
guguccaggcuggagugcagug

SEQ ID NO: 93508 - RNA, 22 nt, Human
gcucagcaguucccacagccuc

SEQ ID NO: 93509 - RNA, 22 nt, Human
uuuuggauuuaccgcuuggggg

SEQ ID NO: 93510 - RNA, 27 nt, Human
ccacugcacccagccuagaaucuugua

SEQ ID NO: 93511 - RNA, 20 nt, Human
uccgacagagaagaccauuu

SEQ ID NO: 93512 - RNA, 22 nt, Human
uagauguauguacuucaugcug

SEQ ID NO: 93513 - RNA, 20 nt, Human
cuccuccccucuucucuuuu

SEQ ID NO: 93514 - RNA, 19 nt, Human
cagaaggcuggguccaggg

SEQ ID NO: 93515 - RNA, 23 nt, Human
aaccaucauauaaacguguagua

SEQ ID NO: 93516 - RNA, 23 nt, Human
uggaaacagcaacuuguacagug

SEQ ID NO: 93517 - RNA, 25 nt, Human
ugguggcauaggccuguaauuccag

SEQ ID NO: 93518 - RNA, 22 nt, Human
uccgcaaaaucuuaacuaccua

SEQ ID NO: 93519 - RNA, 18 nt, Human
gcaaucacaacacuggcu

SEQ ID NO: 93520 - RNA, 22 nt, Human
cuuuaaaaugggacaaaaucua

SEQ ID NO: 93521 - RNA, 25 nt, Human
cucagcuucccacggaaucagaugg

SEQ ID NO: 93522 - RNA, 31 nt, Human
gggcgguguuaacucuuucugcuccuugcau

SEQ ID NO: 93523 - RNA, 27 nt, Human
uaucugugccuuuacugcuuugcgcau

SEQ ID NO: 93524 - RNA, 25 nt, Human
gggcugguggggagcuguaguugcc

SEQ ID NO: 93525 - RNA, 19 nt, Human
auggcugccacauuggcgc

SEQ ID NO: 93526 - RNA, 22 nt, Human
uaguuccuucugcuugcuuuau

SEQ ID NO: 93527 - RNA, 20 nt, Human
ccucuacuccuccuugcgcu

SEQ ID NO: 93528 - RNA, 25 nt, Human
cuccaggcuggagugcaguggcaca

SEQ ID NO: 93529 - RNA, 26 nt, Human
uugagacagagucucacacuguugcc

SEQ ID NO: 93530 - RNA, 27 nt, Human
ggaagcuguggggagaccagaggauca

SEQ ID NO: 93531 - RNA, 19 nt, Human
cuccagugcccaccaggag

SEQ ID NO: 93532 - RNA, 20 nt, Human
aaagaacaacacuuguuaug

SEQ ID NO: 93533 - RNA, 24 nt, Human
uuugggaauagaaggcuacacaga

SEQ ID NO: 93534 - RNA, 26 nt, Human
ggcaacucuggcuccaggcagaagga

SEQ ID NO: 93535 - RNA, 26 nt, Human
aaaaccagagauuauuuguaugcuca

SEQ ID NO: 93536 - RNA, 19 nt, Human
ggaccuccugccuacucca

SEQ ID NO: 93537 - RNA, 19 nt, Human
ccacagccauccugucccu

SEQ ID NO: 93538 - RNA, 24 nt, Human
uucauucucuuuuaaugaggacca

SEQ ID NO: 93539 - RNA, 21 nt, Human
gugcgucugugugugccugug

SEQ ID NO: 93540 - RNA, 21 nt, Human
gcuaagaugcucuaucuugcu

SEQ ID NO: 93541 - RNA, 26 nt, Human
uuauauuuaacuauauauaaauacgc

SEQ ID NO: 93542 - RNA, 24 nt, Human
ggccuuuacuggaucccaaaagca

SEQ ID NO: 93543 - RNA, 23 nt, Human
ccucacucugucacccaggcugg

SEQ ID NO: 93544 - RNA, 24 nt, Human
ccuaauaaauaucauuuccuuggc

SEQ ID NO: 93545 - RNA, 24 nt, Human
cggcgccuguaaucccagcuacuu

SEQ ID NO: 93546 - RNA, 29 nt, Human
uauguacuaaauauuuacacuaauaucaa

SEQ ID NO: 93547 - RNA, 21 nt, Human
gggcagugucacccuggaaaa

SEQ ID NO: 93548 - RNA, 22 nt, Human
guucaagcaauuuccugccuca

SEQ ID NO: 93549 - RNA, 21 nt, Human
aacacagcccugcuucugaca

SEQ ID NO: 93550 - RNA, 25 nt, Human
cuuaaguucucacaucacacucaaa

SEQ ID NO: 93551 - RNA, 19 nt, Human
ccucuacugcguagaggcc

SEQ ID NO: 93552 - RNA, 22 nt, Human
cacucacucuuuccccugccgc

SEQ ID NO: 93553 - RNA, 21 nt, Human
uuuagcuugcuuacaaaggga

SEQ ID NO: 93554 - RNA, 21 nt, Human
ucugccaucacucgugucucu

SEQ ID NO: 93555 - RNA, 21 nt, Human
cucauugucuugcugcccaga

SEQ ID NO: 93556 - RNA, 26 nt, Human
uaggaggcagagucucuaguuccauc

SEQ ID NO: 93557 - RNA, 24 nt, Human
caguaguuaggauggcugaagggg

SEQ ID NO: 93558 - RNA, 20 nt, Human
acccaccccuuuuagcuuuu

SEQ ID NO: 93559 - RNA, 21 nt, Human
cuggaggcggagguugcagug

SEQ ID NO: 93560 - RNA, 23 nt, Human
ugucaauaaagcaaauacuuacu

SEQ ID NO: 93561 - RNA, 19 nt, Human
guuaaaagucauugcucug

SEQ ID NO: 93562 - RNA, 18 nt, Human
uggucaaacaacagucua

SEQ ID NO: 93563 - RNA, 21 nt, Human
guggguuucucugugcucuga

SEQ ID NO: 93564 - RNA, 22 nt, Human
guuaaggcggcacagggccgag

SEQ ID NO: 93565 - RNA, 21 nt, Human
ucauuccagagaaaagccacu

SEQ ID NO: 93566 - RNA, 20 nt, Human
gaccucucauccauucccau

SEQ ID NO: 93567 - RNA, 22 nt, Human
cuccugccugcaggaucaugcc

SEQ ID NO: 93568 - RNA, 22 nt, Human
ccuauauccugguuuuuguagc

SEQ ID NO: 93569 - RNA, 27 nt, Human
ggggugagacacaacagucugacuaug

SEQ ID NO: 93570 - RNA, 21 nt, Human
ucuccuaagcuggagugcagu

SEQ ID NO: 93571 - RNA, 24 nt, Human
cuguguuagggguauaugaugggg

SEQ ID NO: 93572 - RNA, 20 nt, Human
auaacugccacgcagggcau

SEQ ID NO: 93573 - RNA, 20 nt, Human
gcugagccaucaugcccacc

SEQ ID NO: 93574 - RNA, 21 nt, Human
ccaugcugcccccacucccgc

SEQ ID NO: 93575 - RNA, 21 nt, Human
cagcugggggagcuccuggcc

SEQ ID NO: 93576 - RNA, 21 nt, Human
ggcggcggaggcaggagcagc

SEQ ID NO: 93577 - RNA, 22 nt, Human
cgccaucgcacuccagccuggg

SEQ ID NO: 93578 - RNA, 21 nt, Human
cucauccccccugcugcccag

SEQ ID NO: 93579 - RNA, 21 nt, Human
cccagaaaacagaaagcacuc

SEQ ID NO: 93580 - RNA, 26 nt, Human
ccuccaucugagaaguggcccaugug

SEQ ID NO: 93581 - RNA, 21 nt, Human
uggcagcaggcgggcgcgugg

SEQ ID NO: 93582 - RNA, 22 nt, Human
cugggaggggaagagugcucug

SEQ ID NO: 93583 - RNA, 27 nt, Human
gaguaauuguauugucagaaaagugau

SEQ ID NO: 93584 - RNA, 26 nt, Human
uguggcuggggaggcccuggcagcag

SEQ ID NO: 93585 - RNA, 18 nt, Human
uaagugcacugcacuucu

SEQ ID NO: 93586 - RNA, 24 nt, Human
uuugcagaagaaauguucguuacc

SEQ ID NO: 93587 - RNA, 21 nt, Human
ggaggugggcaaagggaagua

SEQ ID NO: 93588 - RNA, 27 nt, Human
gaggcuugggcucccacauaagcacua

SEQ ID NO: 93589 - RNA, 22 nt, Human
cuagcccggcccugcccuuaac

SEQ ID NO: 93590 - RNA, 20 nt, Human
cuugucugucugucucuguc

SEQ ID NO: 93591 - RNA, 23 nt, Human
uucuacucucaugcauuccagag

SEQ ID NO: 93592 - RNA, 25 nt, Human
agcaagaaaugaauuggaggcagga

SEQ ID NO: 93593 - RNA, 21 nt, Human
aauggaauauugggggcuguu

SEQ ID NO: 93594 - RNA, 19 nt, Human
gcucaggcuggaggccagc

SEQ ID NO: 93595 - RNA, 24 nt, Human
ugcccuuuaugaugcacugauucc

SEQ ID NO: 93596 - RNA, 22 nt, Human
aacagccggaccagacaggcca

SEQ ID NO: 93597 - RNA, 22 nt, Human
aacugcuccagccucugccgcu

SEQ ID NO: 93598 - RNA, 24 nt, Human
gguggcugacaccuguaaucccag

SEQ ID NO: 93599 - RNA, 24 nt, Human
uuucacaggcugugcgggagcagg

SEQ ID NO: 93600 - RNA, 20 nt, Human
cucuggagaucagguggaag

SEQ ID NO: 93601 - RNA, 24 nt, Human
acaaacgccuucacuggaucagcc

SEQ ID NO: 93602 - RNA, 19 nt, Human
ucugaccuuguuucagcaa

SEQ ID NO: 93603 - RNA, 20 nt, Human
gcucuugucgcccaggcugg

SEQ ID NO: 93604 - RNA, 25 nt, Human
ugccucuuacuauacgacuguagug

SEQ ID NO: 93605 - RNA, 22 nt, Human
aggcuaggcaugugaaaucacu

SEQ ID NO: 93606 - RNA, 21 nt, Human
cuuccucucuuccuccaggga

SEQ ID NO: 93607 - RNA, 22 nt, Human
ccucaacuuccugaguagcugg

SEQ ID NO: 93608 - RNA, 19 nt, Human
uacuaccucuaccugcaga

SEQ ID NO: 93609 - RNA, 22 nt, Human
ucccccagccaggucggcucuc

SEQ ID NO: 93610 - RNA, 24 nt, Human
cucaugucuuuacaccuucacuca

SEQ ID NO: 93611 - RNA, 26 nt, Human
cauagcagaagaauuggaguuggaag

SEQ ID NO: 93612 - RNA, 19 nt, Human
ugcucugugagaucaaggg

SEQ ID NO: 93613 - RNA, 22 nt, Human
ccgagauagcaccauugcacuc

SEQ ID NO: 93614 - RNA, 29 nt, Human
ucuugcaucuaccugcuccuuggccuagu

SEQ ID NO: 93615 - RNA, 22 nt, Human
uggagucaguggauacaaguag

SEQ ID NO: 93616 - RNA, 25 nt, Human
gccucuggauacugggcuccccaga

SEQ ID NO: 93617 - RNA, 25 nt, Human
gaggaugaaggggcuccauuucugc

SEQ ID NO: 93618 - RNA, 19 nt, Human
gggggcugagcaguggcgc

SEQ ID NO: 93619 - RNA, 27 nt, Human
uccuagagggagauuguuagaucauga

SEQ ID NO: 93620 - RNA, 21 nt, Human
cccagagcagcugggucucca

SEQ ID NO: 93621 - RNA, 24 nt, Human
aaggcugacuugccugaacgcuaa

SEQ ID NO: 93622 - RNA, 24 nt, Human
cacuggaggucaggaguucgaaac

SEQ ID NO: 93623 - RNA, 22 nt, Human
gccacugcugagaacuaugugg

SEQ ID NO: 93624 - RNA, 16 nt, Human
ggcaaagcaacauggc

SEQ ID NO: 93625 - RNA, 25 nt, Human
gcugcagcugcucccggcgcguccc

SEQ ID NO: 93626 - RNA, 23 nt, Human
ggccccagaaacugggggagggc

SEQ ID NO: 93627 - RNA, 22 nt, Human
aacucugcacuucucucuccuu

SEQ ID NO: 93628 - RNA, 23 nt, Human
ccaaaguagcugggauuacaggc

SEQ ID NO: 93629 - RNA, 23 nt, Human
gaccuccagcuuuccuguauuuc

SEQ ID NO: 93630 - RNA, 27 nt, Human
agucaggcagugagacugguggggcac

SEQ ID NO: 93631 - RNA, 27 nt, Human
ccuacuuccuaauuuauucuuauuuga

SEQ ID NO: 93632 - RNA, 22 nt, Human
caggagguugagaaugcaguga

SEQ ID NO: 93633 - RNA, 28 nt, Human
cccuucuccucugcugcagcaugauuuu

SEQ ID NO: 93634 - RNA, 27 nt, Human
auggaaauaaauuuuguauuuguauua

SEQ ID NO: 93635 - RNA, 26 nt, Human
ggagcagcagccacugcacaggagga

SEQ ID NO: 93636 - RNA, 22 nt, Human
uuugaacuaauguaacaugauu

SEQ ID NO: 93637 - RNA, 24 nt, Human
agcaaugggauguucuguuccgcu

SEQ ID NO: 93638 - RNA, 19 nt, Human
cauaaauuagaggucucca

SEQ ID NO: 93639 - RNA, 23 nt, Human
ccaugagguggagguugcgguga

SEQ ID NO: 93640 - RNA, 25 nt, Human
agagaagaagggggucuuugcccac

SEQ ID NO: 93641 - RNA, 24 nt, Human
gaagaacaauccagggcugagaaa

SEQ ID NO: 93642 - RNA, 20 nt, Human
ggggguggagguugcaguga

SEQ ID NO: 93643 - RNA, 23 nt, Human
ccugguugcaaccucucuuccuc

SEQ ID NO: 93644 - RNA, 22 nt, Human
ugacugccccuugcuucucaac

SEQ ID NO: 93645 - RNA, 19 nt, Human
aguguuagcaucaacuaga

SEQ ID NO: 93646 - RNA, 24 nt, Human
aucagcaccaaccugcuaaaugcc

SEQ ID NO: 93647 - RNA, 20 nt, Human
ucaaucaaguugcugcagcc

SEQ ID NO: 93648 - RNA, 24 nt, Human
auaagaauugucccaaaaguaccu

SEQ ID NO: 93649 - RNA, 20 nt, Human
aaggaacaacauagauagug

SEQ ID NO: 93650 - RNA, 19 nt, Human
ggcuuugucucuagccggg

SEQ ID NO: 93651 - RNA, 22 nt, Human
gccacucaagaggcacaggcgg

SEQ ID NO: 93652 - RNA, 23 nt, Human
aauucuauugaaaacagugucuu

SEQ ID NO: 93653 - RNA, 21 nt, Human
acccugggaaacccaccacac

SEQ ID NO: 93654 - RNA, 24 nt, Human
ucgguugcagaagaucaugggcau

SEQ ID NO: 93655 - RNA, 21 nt, Human
cgcggaagaggagcuguggga

SEQ ID NO: 93656 - RNA, 27 nt, Human
uccucaagugaguucuuaguauuuuau

SEQ ID NO: 93657 - RNA, 21 nt, Human
aaccccagggcuccagcacua

SEQ ID NO: 93658 - RNA, 18 nt, Human
ggggaaaggaagguggca

SEQ ID NO: 93659 - RNA, 24 nt, Human
acuauucuguuucucuccugggcu

SEQ ID NO: 93660 - RNA, 22 nt, Human
ccauccagccaccauuccaagg

SEQ ID NO: 93661 - RNA, 27 nt, Human
cccucauucuugaacagcuggaggaau

SEQ ID NO: 93662 - RNA, 19 nt, Human
augccucugggcugcugug

SEQ ID NO: 93663 - RNA, 22 nt, Human
auguuuugagucagugcauuuc

SEQ ID NO: 93664 - RNA, 24 nt, Human
agcauuccguccaucuaagcucau

SEQ ID NO: 93665 - RNA, 21 nt, Human
uucucuuuagggacugcucca

SEQ ID NO: 93666 - RNA, 27 nt, Human
ccaacccaugagugcuaagagccucug

SEQ ID NO: 93667 - RNA, 26 nt, Human
ccuccugguccccugcaccucuccug

SEQ ID NO: 93668 - RNA, 22 nt, Human
cauagucuguuccuuuucucuc

SEQ ID NO: 93669 - RNA, 27 nt, Human
augcucucgagcguugagcaggcacag

SEQ ID NO: 93670 - RNA, 31 nt, Human
agccugguuugucaucccugcccuagcccaa

SEQ ID NO: 93671 - RNA, 27 nt, Human
ucuacuucccauauuucuuuucuuugc

SEQ ID NO: 93672 - RNA, 26 nt, Human
acucaggacucaggucucccauagcu

SEQ ID NO: 93673 - RNA, 22 nt, Human
gaccagccuggccagcauggug

SEQ ID NO: 93674 - RNA, 24 nt, Human
uuuuaccuugcuggaauuauugga

SEQ ID NO: 93675 - RNA, 26 nt, Human
gcagaagggaaauggggagccucagc

SEQ ID NO: 93676 - RNA, 24 nt, Human
cgggcuggccccagcccaucugcu

SEQ ID NO: 93677 - RNA, 30 nt, Human
cagucguucgccggaaagcauuugucuccc

SEQ ID NO: 93678 - RNA, 26 nt, Human
uccagagguagccauagggugugaca

SEQ ID NO: 93679 - RNA, 21 nt, Human
acaaguguucaaacagaaaga

SEQ ID NO: 93680 - RNA, 26 nt, Human
gugacuucaucucuucgaacuucagu

SEQ ID NO: 93681 - RNA, 22 nt, Human
auguccauuauucaagaaagau

SEQ ID NO: 93682 - RNA, 23 nt, Human
cugugcagucaucaacaaaaggg

SEQ ID NO: 93683 - RNA, 17 nt, Human
ucuccaaugaacuuguu

SEQ ID NO: 93684 - RNA, 23 nt, Human
uuccacgugcacccacugccucu

SEQ ID NO: 93685 - RNA, 21 nt, Human
cagaagcacaaauuuugguga

SEQ ID NO: 93686 - RNA, 22 nt, Human
gaauguaguuaucuauugaaaa

SEQ ID NO: 93687 - RNA, 19 nt, Human
cugaaguuuacuggaguuu

SEQ ID NO: 93688 - RNA, 27 nt, Human
gguucacauuccauuauuuguaaaguu

SEQ ID NO: 93689 - RNA, 23 nt, Human
ggucacacagccugugugcagug

SEQ ID NO: 93690 - RNA, 22 nt, Human
ucugcuuuucauccucuguggu

SEQ ID NO: 93691 - RNA, 22 nt, Human
gcuggggugagaguaagcugcu

SEQ ID NO: 93692 - RNA, 26 nt, Human
ugggauguguggcccagagguaagaa

SEQ ID NO: 93693 - RNA, 25 nt, Human
gcaguugagauaagaggaaggcuuc

SEQ ID NO: 93694 - RNA, 27 nt, Human
ggucucaaacaccugaccuugugaucc

SEQ ID NO: 93695 - RNA, 27 nt, Human
ggagaggggagaauggaguagaguccc

SEQ ID NO: 93696 - RNA, 23 nt, Human
caggcauucgaguuuuugucuuu

SEQ ID NO: 93697 - RNA, 22 nt, Human
uucuuucuucuucauguauuca

SEQ ID NO: 93698 - RNA, 19 nt, Human
ugcuuggaaauuuuugaac

SEQ ID NO: 93699 - RNA, 24 nt, Human
gucacuuucucucuuauaaauucu

SEQ ID NO: 93700 - RNA, 26 nt, Human
ggacaaaagugacaauuguaggccag

SEQ ID NO: 93701 - RNA, 19 nt, Human
gagauguguguucuuuuug

SEQ ID NO: 93702 - RNA, 30 nt, Human
uaucuuuauauacucuuugcaccuccuuuu

SEQ ID NO: 93703 - RNA, 26 nt, Human
uuuuugaugaucuucagauggaagga

SEQ ID NO: 93704 - RNA, 21 nt, Human
agcugagaacauagcacaggc

SEQ ID NO: 93705 - RNA, 20 nt, Human
aguucuguaacgccaucucc

SEQ ID NO: 93706 - RNA, 24 nt, Human
gccagcucucagucccacagcucu

SEQ ID NO: 93707 - RNA, 22 nt, Human
cucaauaccccuaguaucuggc

SEQ ID NO: 93708 - RNA, 21 nt, Human
ggagggaagaccucucacuua

SEQ ID NO: 93709 - RNA, 25 nt, Human
agacuucucccgugagccaggcaaa

SEQ ID NO: 93710 - RNA, 23 nt, Human
uccuuucuccccuuuggaugguu

SEQ ID NO: 93711 - RNA, 25 nt, Human
gcacaggaacaauacgucauauauu

SEQ ID NO: 93712 - RNA, 22 nt, Human
acaugccugaauuuggcaagaa

SEQ ID NO: 93713 - RNA, 23 nt, Human
acugagaaccaccaaaucugacu

SEQ ID NO: 93714 - RNA, 20 nt, Human
caggcacaugggcagcucug

SEQ ID NO: 93715 - RNA, 26 nt, Human
gcagccaauuucacacgcgccugugu

SEQ ID NO: 93716 - RNA, 21 nt, Human
gucucaccauguugcccaggc

SEQ ID NO: 93717 - RNA, 22 nt, Human
auuucuuaggcuggagugcagu

SEQ ID NO: 93718 - RNA, 20 nt, Human
cccaggccugucaagagacg

SEQ ID NO: 93719 - RNA, 22 nt, Human
ggaaagagaaaaagaccacgga

SEQ ID NO: 93720 - RNA, 21 nt, Human
ugcuucugggauaacuggaac

SEQ ID NO: 93721 - RNA, 24 nt, Human
ucagcuugugaaaaaucaggacuu

SEQ ID NO: 93722 - RNA, 23 nt, Human
agcaguuuucagccuccucuacc

SEQ ID NO: 93723 - RNA, 23 nt, Human
gccuuccacccuccugucuggcu

SEQ ID NO: 93724 - RNA, 22 nt, Human
uucuccauguuggccaggcugg

SEQ ID NO: 93725 - RNA, 23 nt, Human
aucagaaucaggugagugugacc

SEQ ID NO: 93726 - RNA, 21 nt, Human
cuugcagcuguugagcgcacc

SEQ ID NO: 93727 - RNA, 27 nt, Human
ccaaugccacucaccaaaucuuugcac

SEQ ID NO: 93728 - RNA, 24 nt, Human
aggccuuggaggaaagcagaggau

SEQ ID NO: 93729 - RNA, 21 nt, Human
ccuuuccacaaccucuaccuu

SEQ ID NO: 93730 - RNA, 21 nt, Human
cccccauccugcugggggccu

SEQ ID NO: 93731 - RNA, 22 nt, Human
ugaccucucaggcucaagcgau

SEQ ID NO: 93732 - RNA, 22 nt, Human
cugccuccuuuucuuuuuucuu

SEQ ID NO: 93733 - RNA, 20 nt, Human
cauccuguccuucucuuucc

SEQ ID NO: 93734 - RNA, 27 nt, Human
ccucggugcuuguuucuccuucauugc

SEQ ID NO: 93735 - RNA, 18 nt, Human
uguacuccccagugccuu

SEQ ID NO: 93736 - RNA, 21 nt, Human
cagugacccagauauugcacu

SEQ ID NO: 93737 - RNA, 23 nt, Human
uauuaaaaucaauauuguuuuug

SEQ ID NO: 93738 - RNA, 25 nt, Human
ggucccuuggucuguacaaauaaua

SEQ ID NO: 93739 - RNA, 26 nt, Human
ugagccaagaucgcaacauugcacuc

SEQ ID NO: 93740 - RNA, 22 nt, Human
agcaaaaggcaaacuugccugg

SEQ ID NO: 93741 - RNA, 22 nt, Human
gccucccguccugggcaggcug

SEQ ID NO: 93742 - RNA, 23 nt, Human
aaaggaggcucccagcaucaucu

SEQ ID NO: 93743 - RNA, 21 nt, Human
cugcugucuaucuucuugcuc

SEQ ID NO: 93744 - RNA, 27 nt, Human
gagagugagacccaguggagggagcaa

SEQ ID NO: 93745 - RNA, 22 nt, Human
aaaaggaggacacgucucugug

SEQ ID NO: 93746 - RNA, 22 nt, Human
uucucucuggccuggacauucu

SEQ ID NO: 93747 - RNA, 29 nt, Human
agccaaggacgugaagagauguacggggg

SEQ ID NO: 93748 - RNA, 22 nt, Human
augaggguaaauauaguuuauu

SEQ ID NO: 93749 - RNA, 22 nt, Human
ucacugcggccucuaagaaggu

SEQ ID NO: 93750 - RNA, 22 nt, Human
ccugccugguuuaaacuauugu

SEQ ID NO: 93751 - RNA, 26 nt, Human
ucgaggcagaaucuugcucugucacc

SEQ ID NO: 93752 - RNA, 22 nt, Human
auagauauguugcugugguuuu

SEQ ID NO: 93753 - RNA, 20 nt, Human
ggagaaaggaaagaguugua

SEQ ID NO: 93754 - RNA, 22 nt, Human
gaccagccuggucaacauggcg

SEQ ID NO: 93755 - RNA, 24 nt, Human
ugaugauuuugccaaaaugaguug

SEQ ID NO: 93756 - RNA, 22 nt, Human
gggagucuauaccagugcugug

SEQ ID NO: 93757 - RNA, 23 nt, Human
ucucccauggauuugugaucagc

SEQ ID NO: 93758 - RNA, 24 nt, Human
agaaguuacagaugaggcacugga

SEQ ID NO: 93759 - RNA, 21 nt, Human
cuccugcccgggucccgccuc

SEQ ID NO: 93760 - RNA, 26 nt, Human
ggggugaguggguggugggagccugg

SEQ ID NO: 93761 - RNA, 21 nt, Human
gccuguaauccagcacuuugg

SEQ ID NO: 93762 - RNA, 21 nt, Human
aacaacaacaaaugcugcuua

SEQ ID NO: 93763 - RNA, 20 nt, Human
uucucaccucuccuucacuu

SEQ ID NO: 93764 - RNA, 21 nt, Human
uuaauuaaagcacacuuuucc

SEQ ID NO: 93765 - RNA, 24 nt, Human
agcaugggaggggagcuggcggga

SEQ ID NO: 93766 - RNA, 21 nt, Human
ugggaaacuguugugggcgcu

SEQ ID NO: 93767 - RNA, 23 nt, Human
ugcaggaaaaaugaauugcuugg

SEQ ID NO: 93768 - RNA, 21 nt, Human
gcucacugcagguucagccuu

SEQ ID NO: 93769 - RNA, 24 nt, Human
acccccaccuugaaagguuuuguu

SEQ ID NO: 93770 - RNA, 21 nt, Human
ggaaagaaugaggcucaggga

SEQ ID NO: 93771 - RNA, 22 nt, Human
ccaccucccgggcucaagcgau

SEQ ID NO: 93772 - RNA, 21 nt, Human
caggaggcagagguugcagcg

SEQ ID NO: 93773 - RNA, 27 nt, Human
ggagaauuggccagagccuguggcccc

SEQ ID NO: 93774 - RNA, 19 nt, Human
cccuccagccccgggccgg

SEQ ID NO: 93775 - RNA, 26 nt, Human
ggcccaggagguggagguugcaguga

SEQ ID NO: 93776 - RNA, 23 nt, Human
agcugggacugcaggcacgcgcc

SEQ ID NO: 93777 - RNA, 20 nt, Human
cagcauuuuucuucauguau

SEQ ID NO: 93778 - RNA, 23 nt, Human
acugcaggaaggucugugcucug

SEQ ID NO: 93779 - RNA, 24 nt, Human
uucuggcuuuuuguuagaaacuug

SEQ ID NO: 93780 - RNA, 27 nt, Human
uggagcagcugccucucuggggagaug

SEQ ID NO: 93781 - RNA, 18 nt, Human
uuggcugcuaucgccgcc

SEQ ID NO: 93782 - RNA, 25 nt, Human
uggaaggaagcaggauggcagccgg

SEQ ID NO: 93783 - RNA, 22 nt, Human
guacagguacaggcuggagauu

SEQ ID NO: 93784 - RNA, 24 nt, Human
agagaggcaccugcuggaaaccac

SEQ ID NO: 93785 - RNA, 25 nt, Human
uugcccagccugggggaguggggaa

SEQ ID NO: 93786 - RNA, 23 nt, Human
aaauguugaucuuccacugcaaa

SEQ ID NO: 93787 - RNA, 22 nt, Human
gcucugaaagcaaauaguccug

SEQ ID NO: 93788 - RNA, 23 nt, Human
uccuuuccgcucagacuguagag

SEQ ID NO: 93789 - RNA, 24 nt, Human
gugccaauaauaaacuguguuaau

SEQ ID NO: 93790 - RNA, 25 nt, Human
ggagguggguagggcaggggcaggu

SEQ ID NO: 93791 - RNA, 21 nt, Human
gaucuuggauggugacauuga

SEQ ID NO: 93792 - RNA, 19 nt, Human
cuugaucucuaaugagcua

SEQ ID NO: 93793 - RNA, 20 nt, Human
cuugauguggugaggcaggc

SEQ ID NO: 93794 - RNA, 26 nt, Human
uugcaaaaaugguccuggaguuggua

SEQ ID NO: 93795 - RNA, 20 nt, Human
cggucccugagaguccugcu

SEQ ID NO: 93796 - RNA, 21 nt, Human
ucggccacagccucagccucc

SEQ ID NO: 93797 - RNA, 26 nt, Human
ggcuguaguuucuaagcugugaacau

SEQ ID NO: 93798 - RNA, 21 nt, Human
agaaagaacacgcucucucca

SEQ ID NO: 93799 - RNA, 23 nt, Human
caagcgauucucaugucucagcc

SEQ ID NO: 93800 - RNA, 20 nt, Human
acacagauaugcacacacau

SEQ ID NO: 93801 - RNA, 23 nt, Human
uggauauuuuaugauuuuacuug

SEQ ID NO: 93802 - RNA, 25 nt, Human
aaaaagugguuaauauuaauaagac

SEQ ID NO: 93803 - RNA, 22 nt, Human
guucacugcaaucucugccucc

SEQ ID NO: 93804 - RNA, 21 nt, Human
cuuuagcuuuagaaaauaaca

SEQ ID NO: 93805 - RNA, 22 nt, Human
gcccgcugcagccucugccucu

SEQ ID NO: 93806 - RNA, 22 nt, Human
cucugccucccaaggugcugga

SEQ ID NO: 93807 - RNA, 22 nt, Human
cucugccucccaaagugcuggg

SEQ ID NO: 93808 - RNA, 23 nt, Human
ccacagcaggaagcuugagucaa

SEQ ID NO: 93809 - RNA, 21 nt, Human
guggcuuguguucagggagag

SEQ ID NO: 93810 - RNA, 21 nt, Human
cucacacacucucacauguac

SEQ ID NO: 93811 - RNA, 27 nt, Human
ugccccgccucagccccagcugcccug

SEQ ID NO: 93812 - RNA, 26 nt, Human
ccuauggccugcuggcccaccucccu

SEQ ID NO: 93813 - RNA, 20 nt, Human
cagccuauggaaugauuucc

SEQ ID NO: 93814 - RNA, 26 nt, Human
uugaagauuaacuuuuccuaacauug

SEQ ID NO: 93815 - RNA, 20 nt, Human
agaguaucuugcacagcagg

SEQ ID NO: 93816 - RNA, 21 nt, Human
uuuccugacaauggggcaucu

SEQ ID NO: 93817 - RNA, 30 nt, Human
ugcucuucccuccccucuccagcuacauac

SEQ ID NO: 93818 - RNA, 23 nt, Human
ccaccaccaucaccagacaggug

SEQ ID NO: 93819 - RNA, 26 nt, Human
cugcucacagccuuucugaggacacc

SEQ ID NO: 93820 - RNA, 28 nt, Human
ccagcagcagcuacagugacgacuaaga

SEQ ID NO: 93821 - RNA, 22 nt, Human
cuggguauuguuaaaaacugca

SEQ ID NO: 93822 - RNA, 27 nt, Human
ggaggcugagguaggaggauugauuga

SEQ ID NO: 93823 - RNA, 23 nt, Human
cucgguugauugugcauggaacu

SEQ ID NO: 93824 - RNA, 21 nt, Human
aauuuugaagccagaaggaca

SEQ ID NO: 93825 - RNA, 20 nt, Human
cguccgccuuggccucccaa

SEQ ID NO: 93826 - RNA, 27 nt, Human
acgcagcccugcuuugggcugcccugg

SEQ ID NO: 93827 - RNA, 21 nt, Human
auuccugagucugaagcugga

SEQ ID NO: 93828 - RNA, 24 nt, Human
gcucagcccugacuggugcuauag

SEQ ID NO: 93829 - RNA, 21 nt, Human
ccuggagcugcuggggccaag

SEQ ID NO: 93830 - RNA, 27 nt, Human
aguggcugguuuccagggcugagggga

SEQ ID NO: 93831 - RNA, 27 nt, Human
cccaggccacccugccuccucccgucc

SEQ ID NO: 93832 - RNA, 22 nt, Human
ccaggcugaagugcaguggggc

SEQ ID NO: 93833 - RNA, 18 nt, Human
gggaccaacaaggcacca

SEQ ID NO: 93834 - RNA, 22 nt, Human
ucagcacuugcccgucuguauu

SEQ ID NO: 93835 - RNA, 20 nt, Human
gggaagcucugagaugaggc

SEQ ID NO: 93836 - RNA, 21 nt, Human
cacucacacacacucucucuc

SEQ ID NO: 93837 - RNA, 26 nt, Human
gccccuuacugaggggggagugcagc

SEQ ID NO: 93838 - RNA, 22 nt, Human
acaagcagacagauggacacuu

SEQ ID NO: 93839 - RNA, 24 nt, Human
gcuaugcaccagccucacuccacc

SEQ ID NO: 93840 - RNA, 21 nt, Human
ugggcuccacgggcagggguc

SEQ ID NO: 93841 - RNA, 23 nt, Human
cccuggcucggagcccagggcag

SEQ ID NO: 93842 - RNA, 23 nt, Human
accacaccuggcuaauuuuuuaa

SEQ ID NO: 93843 - RNA, 22 nt, Human
cacucaaucuggaaugcagugg

SEQ ID NO: 93844 - RNA, 20 nt, Human
ggccugugccucccaccucu

SEQ ID NO: 93845 - RNA, 21 nt, Human
guuucuggacucuuccuugcc

SEQ ID NO: 93846 - RNA, 25 nt, Human
gguuuuuuagguggagagacacacc

SEQ ID NO: 93847 - RNA, 26 nt, Human
aggacaagaaacacaaaaaggauaga

SEQ ID NO: 93848 - RNA, 26 nt, Human
ggagacuuggggucuuccuggcucac

SEQ ID NO: 93849 - RNA, 26 nt, Human
uguuugugugggaugauuuauuuaau

SEQ ID NO: 93850 - RNA, 23 nt, Human
caggcagcaguggcgccuggugu

SEQ ID NO: 93851 - RNA, 28 nt, Human
cuuugcugccccucuccccuaccuggcc

SEQ ID NO: 93852 - RNA, 20 nt, Human
ugaacgcaugugaugcugug

SEQ ID NO: 93853 - RNA, 22 nt, Human
gcucugaaggacccacuuucag

SEQ ID NO: 93854 - RNA, 25 nt, Human
ccucucucccugccuguuuucccca

SEQ ID NO: 93855 - RNA, 23 nt, Human
gcugcaugggugccugcugcugc

SEQ ID NO: 93856 - RNA, 23 nt, Human
uuaucuagccuagaaaugacaca

SEQ ID NO: 93857 - RNA, 20 nt, Human
agcaagguggaauguuuccc

SEQ ID NO: 93858 - RNA, 24 nt, Human
uuauguacuacugaacuguaccag

SEQ ID NO: 93859 - RNA, 25 nt, Human
ccucccaaaugcaggaaaaaauaug

SEQ ID NO: 93860 - RNA, 23 nt, Human
gcauucagacuccaaacagaccc

SEQ ID NO: 93861 - RNA, 17 nt, Human
cccagcugcuuuuuugu

SEQ ID NO: 93862 - RNA, 27 nt, Human
ugcugagauacauacagaauuacugua

SEQ ID NO: 93863 - RNA, 21 nt, Human
cccaccccacucccuccacca

SEQ ID NO: 93864 - RNA, 26 nt, Human
cagcacuuaaaauguuugugugggaa

SEQ ID NO: 93865 - RNA, 21 nt, Human
uaaccagccauauuggcucaa

SEQ ID NO: 93866 - RNA, 22 nt, Human
agagcugccuccuggaagcuuu

SEQ ID NO: 93867 - RNA, 21 nt, Human
gagcugagauccagcccaggg

SEQ ID NO: 93868 - RNA, 21 nt, Human
auuuaaauaaggcucuaccuc

SEQ ID NO: 93869 - RNA, 25 nt, Human
gcccaggcuggagugcaauggcaug

SEQ ID NO: 93870 - RNA, 19 nt, Human
auaaagccucauauccagg

SEQ ID NO: 93871 - RNA, 24 nt, Human
cccuugcccagccugggggagugg

SEQ ID NO: 93872 - RNA, 26 nt, Human
caccagacggggcuggagugugaggg

SEQ ID NO: 93873 - RNA, 32 nt, Human; identical to SEQ ID NO: 6629

SEQ ID NO: 93874 - RNA, 25 nt, Human
gagccccuccugguugauacuuguu

SEQ ID NO: 93875 - RNA, 27 nt, Human
gcggaaacaaggggagcccccagagcu

SEQ ID NO: 93876 - RNA, 26 nt, Human
gggaggcggacggcgcuguuccggag

SEQ ID NO: 93877 - RNA, 23 nt, Human
aguacuuuucacacuuguuaaga

SEQ ID NO: 93878 - RNA, 25 nt, Human
ggugaucguagcucggaaauggcgg

SEQ ID NO: 93879 - RNA, 19 nt, Human
acuuuuguucuguuuuucu

SEQ ID NO: 93880 - RNA, 21 nt, Human
uuaaagagaauuagcuuagcg

SEQ ID NO: 93881 - RNA, 28 nt, Human
cgcuccgcuccgggccugggugccuaca

SEQ ID NO: 93882 - RNA, 22 nt, Human
cagcagcagugaccacagccuu

SEQ ID NO: 93883 - RNA, 25 nt, Human
uggaagucauuugauagaaagauga

SEQ ID NO: 93884 - RNA, 22 nt, Human
aaaagugccuuaggggaacccu

SEQ ID NO: 93885 - RNA, 32 nt, Human
ggguguggguaaagacagggaugaaggauaga

SEQ ID NO: 93886 - RNA, 22 nt, Human
ucaaaugaacccaucaacugga

SEQ ID NO: 93887 - RNA, 27 nt, Human
cuccggccuguccuccaacaccaagca

SEQ ID NO: 93888 - RNA, 24 nt, Human
cagaccaacaaaccuucccccuga

SEQ ID NO: 93889 - RNA, 22 nt, Human
uuuguacguuccuucucauguc

SEQ ID NO: 93890 - RNA, 21 nt, Human
caggagguugaggcagcagaa

SEQ ID NO: 93891 - RNA, 22 nt, Human
gggcaguggacagggaauuggg

SEQ ID NO: 93892 - RNA, 18 nt, Human
accacuaaaaaugccucu

SEQ ID NO: 93893 - RNA, 27 nt, Human
ugugggucucugggcacagugggccug

SEQ ID NO: 93894 - RNA, 23 nt, Human
gcucugaagacgccggcgcccgc

SEQ ID NO: 93895 - RNA, 23 nt, Human
ccccgaucacuggcauucacccc

SEQ ID NO: 93896 - RNA, 26 nt, Human
agaugguagacgagcugucugcugcc

SEQ ID NO: 93897 - RNA, 22 nt, Human
cccugcucugcagcucuggccc

SEQ ID NO: 93898 - RNA, 19 nt, Human
cuggagauguacagccuga

SEQ ID NO: 93899 - RNA, 19 nt, Human
gcucaaagcaaucccagug

SEQ ID NO: 93900 - RNA, 25 nt, Human
ggaaggaaagaugugaauaggcuga

SEQ ID NO: 93901 - RNA, 26 nt, Human
cuaccugcuaauucuugccgcauuuc

SEQ ID NO: 93902 - RNA, 28 nt, Human
ccuucuuguccuccucucuggccccauc

SEQ ID NO: 93903 - RNA, 21 nt, Human
caccaagcccaucagaaggag

SEQ ID NO: 93904 - RNA, 23 nt, Human
ccugccucuucccccauucucau

SEQ ID NO: 93905 - RNA, 26 nt, Human
cccaggcugaauucagacuccugggc

SEQ ID NO: 93906 - RNA, 27 nt, Human
gaggaagaguagaugagccggguccgg

SEQ ID NO: 93907 - RNA, 20 nt, Human
ucccauggccuucccucccc

SEQ ID NO: 93908 - RNA, 29 nt, Human
ggacgcccucccgacacaccagcagcagg

SEQ ID NO: 93909 - RNA, 25 nt, Human
uuuauuuuaaaaauaaugguagguu

SEQ ID NO: 93910 - RNA, 22 nt, Human
aguguguccacaaagggacucc

SEQ ID NO: 93911 - RNA, 27 nt, Human
ggacacucaucuguuacacuggaacac

SEQ ID NO: 93912 - RNA, 26 nt, Human
ggagagagaggggaagggggucucau

SEQ ID NO: 93913 - RNA, 22 nt, Human
caagcugaaaccccaucuccac

SEQ ID NO: 93914 - RNA, 22 nt, Human
caguuuuuaauauuagccauag

SEQ ID NO: 93915 - RNA, 23 nt, Human
agguacaaggaagcacaacgccc

SEQ ID NO: 93916 - RNA, 23 nt, Human
cucagcuucucaaaguucuggga

SEQ ID NO: 93917 - RNA, 22 nt, Human
gcuuacgccuguaauccuagca

SEQ ID NO: 93918 - RNA, 22 nt, Human
aaaggguuucacugucaccaag

SEQ ID NO: 93919 - RNA, 26 nt, Human
gggacccagagggcuugaggacaucu

SEQ ID NO: 93920 - RNA, 27 nt, Human
cgucauuuugaaucaucaugugacgcu

SEQ ID NO: 93921 - RNA, 20 nt, Human
cgggcagggagcagagggcu

SEQ ID NO: 93922 - RNA, 22 nt, Human
ccugacugccgcucacacugcc

SEQ ID NO: 93923 - RNA, 22 nt, Human
gagcccaggaguuagagaccag

SEQ ID NO: 93924 - RNA, 21 nt, Human
uaaagcauuuuguugaaaugc

SEQ ID NO: 93925 - RNA, 23 nt, Human
cuccuaguaaaguuccugcucuu

SEQ ID NO: 93926 - RNA, 28 nt, Human
ucucucauuuucuuuuguuuuccauugc

SEQ ID NO: 93927 - RNA, 21 nt, Human
cuccagccacauucucauagc

SEQ ID NO: 93928 - RNA, 22 nt, Human
gagucaucucagcccugccuuu

SEQ ID NO: 93929 - RNA, 24 nt, Human
ugcagcucccuguccaagugccuu

SEQ ID NO: 93930 - RNA, 20 nt, Human
gcaauuggaaaguuaguaag

SEQ ID NO: 93931 - RNA, 20 nt, Human
acuccaccugccuccucccc

SEQ ID NO: 93932 - RNA, 22 nt, Human
aguauucuacuagaacuggaag

SEQ ID NO: 93933 - RNA, 24 nt, Human
cacuugaaugaagggaguaugucu

SEQ ID NO: 93934 - RNA, 21 nt, Human
gagguggaguugcagugagcc

SEQ ID NO: 93935 - RNA, 17 nt, Human
aggaagcucuucuaagc

SEQ ID NO: 93936 - RNA, 25 nt, Human
ccaccucccaaaggcugucauuuca

SEQ ID NO: 93937 - RNA, 20 nt, Human
auuuagcucugaagcaagag

SEQ ID NO: 93938 - RNA, 27 nt, Human
cauugcacuccagccugggcaacagag

SEQ ID NO: 93939 - RNA, 21 nt, Human
gugggaggaggaacuguggga

SEQ ID NO: 93940 - RNA, 25 nt, Human
ugguauuuuaagagaaaacugcagg

SEQ ID NO: 93941 - RNA, 24 nt, Human
cccaggaggcagcagggucugguc

SEQ ID NO: 93942 - RNA, 24 nt, Human
ccacuugggcucuguuuucucagc

SEQ ID NO: 93943 - RNA, 20 nt, Human
aucuacccuccgcuccuggg

SEQ ID NO: 93944 - RNA, 27 nt, Human
ucuguucuguucuguucuccuaauacc

SEQ ID NO: 93945 - RNA, 27 nt, Human
uguccauugggugcagucauguagauc

SEQ ID NO: 93946 - RNA, 22 nt, Human
ggaccuccaucuccacccugcu

SEQ ID NO: 93947 - RNA, 21 nt, Human
cacuugaacccgggaggcaga

SEQ ID NO: 93948 - RNA, 27 nt, Human
ugcaggagucccugccaucauguuuac

SEQ ID NO: 93949 - RNA, 23 nt, Human
ggcuaauguuuuguauuuuuagu

SEQ ID NO: 93950 - RNA, 26 nt, Human
cuguaggaguucaaggaucacacaaa

SEQ ID NO: 93951 - RNA, 22 nt, Human
ugguuuacgccuauaaucccag

SEQ ID NO: 93952 - RNA, 22 nt, Human
agaagggugccugggaggccag

SEQ ID NO: 93953 - RNA, 21 nt, Human
cugcccagcuggaaaccacag

SEQ ID NO: 93954 - RNA, 23 nt, Human
ccucucuccucugaaacccuccu

SEQ ID NO: 93955 - RNA, 18 nt, Human
ugcauuccagccugggca

SEQ ID NO: 93956 - RNA, 20 nt, Human
uggcggcggggguggcagcg

SEQ ID NO: 93957 - RNA, 22 nt, Human
cugcaaccuucgccaccugggu

SEQ ID NO: 93958 - RNA, 20 nt, Human
uuccuggugaauguggagaa

SEQ ID NO: 93959 - RNA, 21 nt, Human
cucacagaacagagaguuucu

SEQ ID NO: 93960 - RNA, 20 nt, Human
cagaauuaaaagcuucccaa

SEQ ID NO: 93961 - RNA, 26 nt, Human
uuaacaaaagcaauuguauuacuucc

SEQ ID NO: 93962 - RNA, 27 nt, Human
acccaggcugggaauugcaguggcaca

SEQ ID NO: 93963 - RNA, 28 nt, Human
uccugaccucaagugaucuuccggccuc

SEQ ID NO: 93964 - RNA, 26 nt, Human
ccgaucccacccccucccccagggcu

SEQ ID NO: 93965 - RNA, 21 nt, Human
aucauuuaucagaggagguuc

SEQ ID NO: 93966 - RNA, 20 nt, Human
uucccaugccuccucuggag

SEQ ID NO: 93967 - RNA, 23 nt, Human
ucuuaagcccagcucuguucugc

SEQ ID NO: 93968 - RNA, 25 nt, Human
ucuaugugcagcaugacucucucca

SEQ ID NO: 93969 - RNA, 27 nt, Human
auccuuaaugcuucucagucuucagcc

SEQ ID NO: 93970 - RNA, 21 nt, Human
cccacuccagggcccagcaca

SEQ ID NO: 93971 - RNA, 24 nt, Human
auuccaugaugcauauuacuggau

SEQ ID NO: 93972 - RNA, 19 nt, Human
uggaaacugucccauugcu

SEQ ID NO: 93973 - RNA, 22 nt, Human
uucugcaccccucuccccaugg

SEQ ID NO: 93974 - RNA, 21 nt, Human
ggucuuucugagcucaagggu

SEQ ID NO: 93975 - RNA, 19 nt, Human
uuugucaaacuucccacug

SEQ ID NO: 93976 - RNA, 21 nt, Human
cucacagucuuuuuuguucca

SEQ ID NO: 93977 - RNA, 26 nt, Human
acucugguggcaggugcuuguccuca

SEQ ID NO: 93978 - RNA, 17 nt, Human
gggcuccugccugccca

SEQ ID NO: 93979 - RNA, 27 nt, Human
uuuaaagcucaugcauuucaagcagcu

SEQ ID NO: 93980 - RNA, 24 nt, Human
ucccugacgauugcuuagcauuaa

SEQ ID NO: 93981 - RNA, 28 nt, Human
gagggacagagagacagggagagucagc

SEQ ID NO: 93982 - RNA, 17 nt, Human
uuauucuucucaaccca

SEQ ID NO: 93983 - RNA, 21 nt, Human
ugggccagcggcugagcugua

SEQ ID NO: 93984 - RNA, 25 nt, Human
gagauuguugaaugcagccagugaa

SEQ ID NO: 93985 - RNA, 20 nt, Human
ucugccccuggggaaugugu

SEQ ID NO: 93986 - RNA, 22 nt, Human
uccuggugugaugagcaggauc

SEQ ID NO: 93987 - RNA, 26 nt, Human
acucagucuaaacaauaaauauuuca

SEQ ID NO: 93988 - RNA, 27 nt, Human
ugcccaaggucucucugcaccccacca

SEQ ID NO: 93989 - RNA, 24 nt, Human
aguccuaggcuggaugggagggug

SEQ ID NO: 93990 - RNA, 26 nt, Human
cacaugcuucccuuuccugaguccca

SEQ ID NO: 93991 - RNA, 23 nt, Human
ucccugagaagggcgggccuucc

SEQ ID NO: 93992 - RNA, 28 nt, Human
ggaugggcuucacuggggcccugucugu

SEQ ID NO: 93993 - RNA, 20 nt, Human
caaauuaccaccaauaauau

SEQ ID NO: 93994 - RNA, 22 nt, Human
acauucugcuuucaucuugguc

SEQ ID NO: 93995 - RNA, 20 nt, Human
aacagccaccaggaaagcag

SEQ ID NO: 93996 - RNA, 16 nt, Human
auggcuuuugaugauu

SEQ ID NO: 93997 - RNA, 20 nt, Human
agaaacacuuaaaacuugaa

SEQ ID NO: 93998 - RNA, 16 nt, Human
ggauacuuucucucuc

SEQ ID NO: 93999 - RNA, 27 nt, Human
ucccaccgggucugggcucuggaagga

SEQ ID NO: 94000 - RNA, 23 nt, Human
ucaaguucuggucaacuaguagc

SEQ ID NO: 94001 - RNA, 21 nt, Human
caggaaggaagaccagaucug

SEQ ID NO: 94002 - RNA, 19 nt, Human
cagugguugcuguccucuu

SEQ ID NO: 94003 - RNA, 21 nt, Human
gcuguccccucuugcuucucc

SEQ ID NO: 94004 - RNA, 22 nt, Human
caacauggugaaacuccaucuc

SEQ ID NO: 94005 - RNA, 21 nt, Human
accagcaccagccccagcccc

SEQ ID NO: 94006 - RNA, 25 nt, Human
cguuauuuacaauuauucagcucuu

SEQ ID NO: 94007 - RNA, 22 nt, Human
ggccuacucucagcugccuauc

SEQ ID NO: 94008 - RNA, 25 nt, Human
gucuuugaaucugaaucagccaguc

SEQ ID NO: 94009 - RNA, 32 nt, Human
ccuggccccuuggaagaggcccccagaugccc

SEQ ID NO: 94010 - RNA, 23 nt, Human
agacccaugucuccaucugguca

SEQ ID NO: 94011 - RNA, 20 nt, Human
acagaguuguuacauuuuua

SEQ ID NO: 94012 - RNA, 25 nt, Human
ccugccguuggaccuucaccuccua

SEQ ID NO: 94013 - RNA, 21 nt, Human
acccagcauguagaucaugug

SEQ ID NO: 94014 - RNA, 21 nt, Human
ggccucggaccgcccacucca

SEQ ID NO: 94015 - RNA, 20 nt, Human
ccacagaccuguuucagcug

SEQ ID NO: 94016 - RNA, 26 nt, Human
cuuuuuugaucaacugguuuguguuu

SEQ ID NO: 94017 - RNA, 23 nt, Human
ccauagccacaaaauauuuaaug

SEQ ID NO: 94018 - RNA, 19 nt, Human
caaggagaccugggguggg

SEQ ID NO: 94019 - RNA, 21 nt, Human
gaucugacagacaaugaucca

SEQ ID NO: 94020 - RNA, 24 nt, Human
aucagccuggcagcagcauuguga

SEQ ID NO: 94021 - RNA, 21 nt, Human
agggcugugaaggcagagggg

SEQ ID NO: 94022 - RNA, 21 nt, Human
ccaucccugcuucccaaaaau

SEQ ID NO: 94023 - RNA, 22 nt, Human
ccagucugcugcccuccauccc

SEQ ID NO: 94024 - RNA, 28 nt, Human
agguguguccacagaguuuuucaggaga

SEQ ID NO: 94025 - RNA, 25 nt, Human
uucugcuggggauggccacugugaa

SEQ ID NO: 94026 - RNA, 20 nt, Human
ggcccaaggcccccaccucu

SEQ ID NO: 94027 - RNA, 18 nt, Human
aauacugcuuagcauuuu

SEQ ID NO: 94028 - RNA, 19 nt, Human
cuuugaguggguuugcuau

SEQ ID NO: 94029 - RNA, 22 nt, Human
ugucccccaggcuggagugcag

SEQ ID NO: 94030 - RNA, 22 nt, Human
ugucacccaggcuggagugccg

SEQ ID NO: 94031 - RNA, 22 nt, Human
agaccuaccuuccaguugucag

SEQ ID NO: 94032 - RNA, 30 nt, Human
cuauuugaguuauuaaauguuaaucaaaau

SEQ ID NO: 94033 - RNA, 23 nt, Human
cacguauguuauucuucauccug

SEQ ID NO: 94034 - RNA, 25 nt, Human
gaggaggacacagucgcugugggca

SEQ ID NO: 94035 - RNA, 23 nt, Human
ugaacaaugcaacuuuuuauuua

SEQ ID NO: 94036 - RNA, 22 nt, Human
uggagguggggguugcuguuga

SEQ ID NO: 94037 - RNA, 27 nt, Human
cucccacacugagaaaccccccaaccc

SEQ ID NO: 94038 - RNA, 21 nt, Human
ucuccacuguuucaugagccc

SEQ ID NO: 94039 - RNA, 21 nt, Human
ccuaccccaucuauucucugu

SEQ ID NO: 94040 - RNA, 21 nt, Human
ccccauagcacaacagguuua

SEQ ID NO: 94041 - RNA, 19 nt, Human
ggguauuaaagaacuccgc

SEQ ID NO: 94042 - RNA, 22 nt, Human
ccauccaggaaugggagcccgg

SEQ ID NO: 94043 - RNA, 25 nt, Human
cuucuagccccugaacuuucagccg

SEQ ID NO: 94044 - RNA, 20 nt, Human
agagguccacaacacacaga

SEQ ID NO: 94045 - RNA, 23 nt, Human
gcggcaugcaccaccacgcccag

SEQ ID NO: 94046 - RNA, 25 nt, Human
uguuuuucagcugaauucucauggu

SEQ ID NO: 94047 - RNA, 22 nt, Human
uuaccuuucugcuccugaaucg

SEQ ID NO: 94048 - RNA, 20 nt, Human
gaacccagcuagaaugugcc

SEQ ID NO: 94049 - RNA, 19 nt, Human
auuauaaaaauuuaccucg

SEQ ID NO: 94050 - RNA, 21 nt, Human
aucucuaauaaaaacaggagg

SEQ ID NO: 94051 - RNA, 24 nt, Human
ggaacuccagaaguuguggggaga

SEQ ID NO: 94052 - RNA, 22 nt, Human
uuucugcuggcuggacugaacu

SEQ ID NO: 94053 - RNA, 23 nt, Human
uuccugacuacagccaucaugcc

SEQ ID NO: 94054 - RNA, 28 nt, Human
gccuguguuugccacuguguuucccugc

SEQ ID NO: 94055 - RNA, 25 nt, Human
ugaguguguggcaccugugauggca

SEQ ID NO: 94056 - RNA, 24 nt, Human
cucaaguucugggcacacaggguu

SEQ ID NO: 94057 - RNA, 24 nt, Human
gguucaaagcauacuuuucaugau

SEQ ID NO: 94058 - RNA, 23 nt, Human
acacauuugggcccauaugccac

SEQ ID NO: 94059 - RNA, 20 nt, Human
ggcugaagucggcuugggga

SEQ ID NO: 94060 - RNA, 22 nt, Human
gggauuacaggcgugcgccacc

SEQ ID NO: 94061 - RNA, 27 nt, Human
gguggcaccuccagacacccugaaacu

SEQ ID NO: 94062 - RNA, 27 nt, Human
uuccaaaacaugauuuaauuucuaacu

SEQ ID NO: 94063 - RNA, 21 nt, Human
ccugcagcacaccccacagcc

SEQ ID NO: 94064 - RNA, 22 nt, Human
guccuacagagggagaggccag

SEQ ID NO: 94065 - RNA, 27 nt, Human
guagcacauuagcauugauggcuguuc

SEQ ID NO: 94066 - RNA, 21 nt, Human
ugucaaaacuaugacucuguu

SEQ ID NO: 94067 - RNA, 28 nt, Human
ucuuuucuuugcccuccugauucuuggc

SEQ ID NO: 94068 - RNA, 25 nt, Human
uguuguuuuaggggcuaaaggggag

SEQ ID NO: 94069 - RNA, 24 nt, Human
gucuggcuucuuucacuuugcaua

SEQ ID NO: 94070 - RNA, 23 nt, Human
cagagcuccaucuguauacacga

SEQ ID NO: 94071 - RNA, 23 nt, Human
ugugaucacagcucacugcagcc

SEQ ID NO: 94072 - RNA, 26 nt, Human
cgggccucggccuggcuucaccgcau

SEQ ID NO: 94073 - RNA, 28 nt, Human
cagagcagcauaauaaaugaggccacug

SEQ ID NO: 94074 - RNA, 29 nt, Human
gguacuggaaaaccuuccacaugcccaac

SEQ ID NO: 94075 - RNA, 23 nt, Human
auugugcagaauuaaagugcagu

SEQ ID NO: 94076 - RNA, 22 nt, Human
augccuaaggucgccacugccu

SEQ ID NO: 94077 - RNA, 26 nt, Human
gacaucucaucagccacuugugugaa

SEQ ID NO: 94078 - RNA, 22 nt, Human
accauccuggccaauaugguga

SEQ ID NO: 94079 - RNA, 22 nt, Human
accaucuuggccaacaugguga

SEQ ID NO: 94080 - RNA, 24 nt, Human
ucugcugcugccucuuuccuccuc

SEQ ID NO: 94081 - RNA, 23 nt, Human
uguaaccagauauaacuggccag

SEQ ID NO: 94082 - RNA, 26 nt, Human
ugcccagagcacuacucucaaaauca

SEQ ID NO: 94083 - RNA, 21 nt, Human
ggcaaguaaguuaagcauuuu

SEQ ID NO: 94084 - RNA, 18 nt, Human
accaauaaaaauguuaac

SEQ ID NO: 94085 - RNA, 22 nt, Human
aggcuggagugcaguggugcua

SEQ ID NO: 94086 - RNA, 18 nt, Human
uuuuccugauagcuguau

SEQ ID NO: 94087 - RNA, 21 nt, Human
gcagacggccgaagagccagg

SEQ ID NO: 94088 - RNA, 25 nt, Human
acgcgagaagggaagaugggggccg

SEQ ID NO: 94089 - RNA, 23 nt, Human
gagccuggacauccagagccugg

SEQ ID NO: 94090 - RNA, 31 nt, Human
ccagccucuguggcccuguggccugcaggua

SEQ ID NO: 94091 - RNA, 24 nt, Human
agacuugcgcuucucugcaccuua

SEQ ID NO: 94092 - RNA, 23 nt, Human
cccacccccaaccugucccaccc

SEQ ID NO: 94093 - RNA, 19 nt, Human
uguaaauguggugccaaau

SEQ ID NO: 94094 - RNA, 24 nt, Human
ggucgcugugcugagcggcgggac

SEQ ID NO: 94095 - RNA, 20 nt, Human
agagccugcacggcugugcg

SEQ ID NO: 94096 - RNA, 27 nt, Human
ccaucacugaagagcagacccguuugg

SEQ ID NO: 94097 - RNA, 27 nt, Human
cauuggucuugccugagcucuuccuca

SEQ ID NO: 94098 - RNA, 21 nt, Human
agggaccuaaggcccacugga

SEQ ID NO: 94099 - RNA, 21 nt, Human
cagucacugcagcaacgccuu

SEQ ID NO: 94100 - RNA, 28 nt, Human
acacuauguuacauacucuaauauagua

SEQ ID NO: 94101 - RNA, 22 nt, Human
ucgguaccuguuacugcugcua

SEQ ID NO: 94102 - RNA, 23 nt, Human
acugagaccuccacccacugugg

SEQ ID NO: 94103 - RNA, 28 nt, Human
cagccagugugacacugcuuuaaacugc

SEQ ID NO: 94104 - RNA, 26 nt, Human
gggcuaagccaguuggaucucugguu

SEQ ID NO: 94105 - RNA, 21 nt, Human
aucaaauuuaagaauuuguga

SEQ ID NO: 94106 - RNA, 27 nt, Human
uguuuuuaaaaaccuuuuauugucaaa

SEQ ID NO: 94107 - RNA, 25 nt, Human
uuuugugcugcuccaacaccagcag

SEQ ID NO: 94108 - RNA, 22 nt, Human
cacaucuguaaccccagcacuu

SEQ ID NO: 94109 - RNA, 21 nt, Human
ucucaugaaacaagagcuaga

SEQ ID NO: 94110 - RNA, 19 nt, Human
accagccucagaucagggc

SEQ ID NO: 94111 - RNA, 21 nt, Human
aaaagagacuguuuuggggga

SEQ ID NO: 94112 - RNA, 22 nt, Human
uuuguuacccaggcuggagugc

SEQ ID NO: 94113 - RNA, 23 nt, Human
cgaguagcugggauuacaggugu

SEQ ID NO: 94114 - RNA, 21 nt, Human
gcagugagccaagaucaugcc

SEQ ID NO: 94115 - RNA, 21 nt, Human
gcagugagcugagaucacacc

SEQ ID NO: 94116 - RNA, 23 nt, Human
ccugcugcuuucucuaccucaag

SEQ ID NO: 94117 - RNA, 27 nt, Human
accagccugaccaacauggagaaaccc

SEQ ID NO: 94118 - RNA, 26 nt, Human
uugccugccugggccucccaaagugc

SEQ ID NO: 94119 - RNA, 27 nt, Human
acucuucuguucccuuacuguuucacg

SEQ ID NO: 94120 - RNA, 23 nt, Human
cuucuccacucuccaccaugcag

SEQ ID NO: 94121 - RNA, 21 nt, Human
cauuccccaccucuucccagc

SEQ ID NO: 94122 - RNA, 27 nt, Human
gggagaagagaacauuagacucaggga

SEQ ID NO: 94123 - RNA, 22 nt, Human
uuccugagcuuuucaggcucua

SEQ ID NO: 94124 - RNA, 28 nt, Human
aguuuuaacagauuccugguuaggaacu

SEQ ID NO: 94125 - RNA, 31 nt, Human
uuugccagucaccucaaccagccaguuccac

SEQ ID NO: 94126 - RNA, 23 nt, Human
aaguugaggggagcaugcuuccc

SEQ ID NO: 94127 - RNA, 20 nt, Human
gccuagaguuuaccuuaugu

SEQ ID NO: 94128 - RNA, 20 nt, Human
ucagcugaauaaccaggggc

SEQ ID NO: 94129 - RNA, 22 nt, Human
cccuccccacaccucccuacuc

SEQ ID NO: 94130 - RNA, 21 nt, Human
ucugcucaggcugggaggcag

SEQ ID NO: 94131 - RNA, 23 nt, Human
cucaggggguggagguugcagug

SEQ ID NO: 94132 - RNA, 23 nt, Human
cccaggaggcggagguugcagua

SEQ ID NO: 94133 - RNA, 23 nt, Human
cccaggaggcggagauugcagug

SEQ ID NO: 94134 - RNA, 19 nt, Human
ccagcauuugcaucaccuc

SEQ ID NO: 94135 - RNA, 23 nt, Human
gccggccugccugccacagccgg

SEQ ID NO: 94136 - RNA, 24 nt, Human
cucucccucagcugggcugggguc

SEQ ID NO: 94137 - RNA, 26 nt, Human
guggccgccuccuccugcgcgcacca

SEQ ID NO: 94138 - RNA, 20 nt, Human
uuccuuuugcccucagugcc

SEQ ID NO: 94139 - RNA, 26 nt, Human
guguucucuggaccuauucuaaccac

SEQ ID NO: 94140 - RNA, 24 nt, Human
cccuaugggucuaggacacaguuc

SEQ ID NO: 94141 - RNA, 27 nt, Human
uuuuccccuaucauuuauuggaugggu

SEQ ID NO: 94142 - RNA, 29 nt, Human
ccacaggaagaaagggaaggagguagagg

SEQ ID NO: 94143 - RNA, 20 nt, Human
aggaugagagcgcagaggac

SEQ ID NO: 94144 - RNA, 21 nt, Human
guugcccagacuggucucgaa

SEQ ID NO: 94145 - RNA, 24 nt, Human
gcugcuggcuaagcauuuaucaaa

SEQ ID NO: 94146 - RNA, 25 nt, Human
ggugacuugaggcuggagcucccuc

SEQ ID NO: 94147 - RNA, 29 nt, Human
ccagaaacagacaucuugcaguguuucac

SEQ ID NO: 94148 - RNA, 17 nt, Human
ggagagggguggacggc

SEQ ID NO: 94149 - RNA, 21 nt, Human
gccauucaaggaggccugugg

SEQ ID NO: 94150 - RNA, 23 nt, Human
gugauuucucucccaccuccuuc

SEQ ID NO: 94151 - RNA, 23 nt, Human
uguagugaagucaaacuguuauu

SEQ ID NO: 94152 - RNA, 24 nt, Human
acuagggcacaucuggaugccuuc

SEQ ID NO: 94153 - RNA, 21 nt, Human
gcucaggcuucugggcucuga

SEQ ID NO: 94154 - RNA, 23 nt, Human
guugguggcagugacuucuuuug

SEQ ID NO: 94155 - RNA, 26 nt, Human
ucauucucaccucuuauggaaaaugg

SEQ ID NO: 94156 - RNA, 23 nt, Human
ugcugggacuugaacaaagacau

SEQ ID NO: 94157 - RNA, 29 nt, Human
ucccuaaaaauuccaccaggauuaaucuc

SEQ ID NO: 94158 - RNA, 22 nt, Human
cgccucccagguucaaguaauu

SEQ ID NO: 94159 - RNA, 30 nt, Human
caucguucagggaacccaggaaaaugggag

SEQ ID NO: 94160 - RNA, 25 nt, Human
uccaauacagaguucugguaaagau

SEQ ID NO: 94161 - RNA, 22 nt, Human
cuuuguaaucccaacacuuucu

SEQ ID NO: 94162 - RNA, 22 nt, Human
caggaggcagagcuugcaguga

SEQ ID NO: 94163 - RNA, 27 nt, Human
uuagaaaacaaaauuuuauuuugugcu

SEQ ID NO: 94164 - RNA, 21 nt, Human
agggggcagagucuucccuac

SEQ ID NO: 94165 - RNA, 20 nt, Human
aucuucuccccuucugagcc

SEQ ID NO: 94166 - RNA, 21 nt, Human
ccuauaaucccagcacuuugg

SEQ ID NO: 94167 - RNA, 22 nt, Human
uaaguuuguaguuacaugugaa

SEQ ID NO: 94168 - RNA, 27 nt, Human
ugcagcaccuccaggccuguugcuaua

SEQ ID NO: 94169 - RNA, 22 nt, Human
ucuccuggguuaggccccggcu

SEQ ID NO: 94170 - RNA, 27 nt, Human
aauaaagugccuucugggcuuuuucua

SEQ ID NO: 94171 - RNA, 25 nt, Human
guucugauggagaaaacagcacccc

SEQ ID NO: 94172 - RNA, 19 nt, Human
ccccauguccucuggaaca

SEQ ID NO: 94173 - RNA, 18 nt, Human
ggccacagagccaccuca

SEQ ID NO: 94174 - RNA, 20 nt, Human
agaagcaguauaagccuuuu

SEQ ID NO: 94175 - RNA, 26 nt, Human
uggaaaaccagcagccucccgcgacg

SEQ ID NO: 94176 - RNA, 20 nt, Human
gcucacugcaaccucugccu

SEQ ID NO: 94177 - RNA, 25 nt, Human
gcucuguugcuacuaagcagcuuuu

SEQ ID NO: 94178 - RNA, 22 nt, Human
ugcaaccuccaccucccagguu

SEQ ID NO: 94179 - RNA, 25 nt, Human
gcaggccucugggacccacagaacu

SEQ ID NO: 94180 - RNA, 27 nt, Human
cuccuguugugcaggcuggagugcagu

SEQ ID NO: 94181 - RNA, 22 nt, Human
agggaaaggguguuacaaggaa

SEQ ID NO: 94182 - RNA, 24 nt, Human
cucaguguacuuaaaauuuuacag

SEQ ID NO: 94183 - RNA, 24 nt, Human
uuuuguuucucugggcgguugugg

SEQ ID NO: 94184 - RNA, 23 nt, Human
ugccugaacuugaauuaauccac

SEQ ID NO: 94185 - RNA, 16 nt, Human
cuucccuuugcugcca

SEQ ID NO: 94186 - RNA, 21 nt, Human
aggguggaucaccugagguca

SEQ ID NO: 94187 - RNA, 23 nt, Human
gcuuaaaguuuuaccauuacaca

SEQ ID NO: 94188 - RNA, 18 nt, Human
accccggacacacacuca

SEQ ID NO: 94189 - RNA, 27 nt, Human
caggcuggagugcaguggcgaaauccc

SEQ ID NO: 94190 - RNA, 26 nt, Human
uagcacaaacguuuuuccagucuucu

SEQ ID NO: 94191 - RNA, 22 nt, Human
caccauggcuuugacauguugg

SEQ ID NO: 94192 - RNA, 22 nt, Human
agucgcccaggcuggagugcag

SEQ ID NO: 94193 - RNA, 21 nt, Human
ucugcagcuacccaacagucc

SEQ ID NO: 94194 - RNA, 22 nt, Human
ucugcaagugaggugugucaca

SEQ ID NO: 94195 - RNA, 17 nt, Human
cacaucccagcagccca

SEQ ID NO: 94196 - RNA, 18 nt, Human
cucucaucugcugcuccg

SEQ ID NO: 94197 - RNA, 20 nt, Human
accagaaugaaaaugccagg

SEQ ID NO: 94198 - RNA, 21 nt, Human
gaggaggagagaaguggccag

SEQ ID NO: 94199 - RNA, 18 nt, Human
ucucuuggccuguccuca

SEQ ID NO: 94200 - RNA, 21 nt, Human
gggcuuauccugggugcuuau

SEQ ID NO: 94201 - RNA, 23 nt, Human
ccugcucucugaucagcuggauc

SEQ ID NO: 94202 - RNA, 24 nt, Human
uuuuccuuuugcgauuuucacuga

SEQ ID NO: 94203 - RNA, 24 nt, Human
accaguaaggacuuuuuaauuaac

SEQ ID NO: 94204 - RNA, 21 nt, Human
acaggcaugaaucacugugcu

SEQ ID NO: 94205 - RNA, 26 nt, Human
caaaugcaaaugcagaagacuuaccu

SEQ ID NO: 94206 - RNA, 25 nt, Human
ugagacuacaggcagaugggacuaa

SEQ ID NO: 94207 - RNA, 25 nt, Human
ccucagccagagaacuagagcagaa

SEQ ID NO: 94208 - RNA, 22 nt, Human
ugguccucagcuuccuccauca

SEQ ID NO: 94209 - RNA, 28 nt, Human
uuggcaggacuuucugugccacaguaaa

SEQ ID NO: 94210 - RNA, 27 nt, Human
aaaacauugaaauauuaguuacuugcu

SEQ ID NO: 94211 - RNA, 25 nt, Human
gccagcccucccuggcugugagcag

SEQ ID NO: 94212 - RNA, 25 nt, Human
cucuccaggaaugccuccucccugg

SEQ ID NO: 94213 - RNA, 26 nt, Human
ggaggugggguggaaauagggugggc

SEQ ID NO: 94214 - RNA, 26 nt, Human
cauugcucucugggcuuuugguuugg

SEQ ID NO: 94215 - RNA, 23 nt, Human
cuucaucuucaauuuggguuuaa

SEQ ID NO: 94216 - RNA, 24 nt, Human
cuguuggcagacuggagugcaauc

SEQ ID NO: 94217 - RNA, 24 nt, Human
cccaucauaccugcacccacccca

SEQ ID NO: 94218 - RNA, 24 nt, Human
gcggagaggcgaggaagcugcagg

SEQ ID NO: 94219 - RNA, 26 nt, Human
guggguggggaaggaaggcgugucca

SEQ ID NO: 94220 - RNA, 27 nt, Human
ggggcccacaucugugugucgugacuu

SEQ ID NO: 94221 - RNA, 26 nt, Human
gccuguaaucccagcuacucagaagg

SEQ ID NO: 94222 - RNA, 23 nt, Human
uguugcccaggcuggagugcauu

SEQ ID NO: 94223 - RNA, 21 nt, Human
ccgccccacacccacccuccu

SEQ ID NO: 94224 - RNA, 27 nt, Human
ugcccugccuacuuuuaguugacucac

SEQ ID NO: 94225 - RNA, 27 nt, Human
ggaggcugaggcaggagaaucgcuaga

SEQ ID NO: 94226 - RNA, 19 nt, Human
gaggaagagguugcaguga

SEQ ID NO: 94227 - RNA, 22 nt, Human
uccagccugggcaacaagagcg

SEQ ID NO: 94228 - RNA, 19 nt, Human
ugauuccauggcuguugug

SEQ ID NO: 94229 - RNA, 27 nt, Human
gcuuggcagagaggaccccacuggacu

SEQ ID NO: 94230 - RNA, 22 nt, Human
uacuggcugucccugagccucu

SEQ ID NO: 94231 - RNA, 27 nt, Human
gagcggcuguggagaaacuuccucuuu

SEQ ID NO: 94232 - RNA, 26 nt, Human
agggucuuguucuagauuucauauug

SEQ ID NO: 94233 - RNA, 23 nt, Human
agaagacuaguagaguucugcca

SEQ ID NO: 94234 - RNA, 27 nt, Human
cuaguccacagauuaggcaaucaagga

SEQ ID NO: 94235 - RNA, 24 nt, Human
gcuuucucacaacgggguguguuu

SEQ ID NO: 94236 - RNA, 26 nt, Human
gagcagccacugggaguuggaguguu

SEQ ID NO: 94237 - RNA, 21 nt, Human
cccagccaggcagggggcagu

SEQ ID NO: 94238 - RNA, 23 nt, Human
cagcggcagccagagaacuguuu

SEQ ID NO: 94239 - RNA, 21 nt, Human
ccgcccaggcuggacugcagu

SEQ ID NO: 94240 - RNA, 21 nt, Human
uguuucuaugauaaaagcacu

SEQ ID NO: 94241 - RNA, 25 nt, Human
gguuucucccugcggcuccuggguu

SEQ ID NO: 94242 - RNA, 21 nt, Human
acucucucagcaugaacugca

SEQ ID NO: 94243 - RNA, 21 nt, Human
cugcugggcuaggccugcugc

SEQ ID NO: 94244 - RNA, 22 nt, Human
ugccccaggccaucaucucccc

SEQ ID NO: 94245 - RNA, 27 nt, Human
aagacuugcuugucuugggccugucac

SEQ ID NO: 94246 - RNA, 27 nt, Human
cccagcacugugccugcucucaagagc

SEQ ID NO: 94247 - RNA, 25 nt, Human
uggaaacauucccacaugccgugac

SEQ ID NO: 94248 - RNA, 24 nt, Human
aaacuauuucaaaugcauaccaca

SEQ ID NO: 94249 - RNA, 24 nt, Human
cccugggccucuccccaugcugcc

SEQ ID NO: 94250 - RNA, 22 nt, Human
ucugcuccuuccugcucacauc

SEQ ID NO: 94251 - RNA, 22 nt, Human
agcuaauuuuuguauuuuuaau

SEQ ID NO: 94252 - RNA, 22 nt, Human
agcugauuuuuguauuuuuagu

SEQ ID NO: 94253 - RNA, 17 nt, Human
agcucugggcuugggga

SEQ ID NO: 94254 - RNA, 27 nt, Human
ugcccugcacaucauggcacugccauu

SEQ ID NO: 94255 - RNA, 22 nt, Human
agaccagcuugggcaacauagg

SEQ ID NO: 94256 - RNA, 17 nt, Human
cuucccuuugccugcug

SEQ ID NO: 94257 - RNA, 25 nt, Human
uucaauggaaauuauuacaagcaga

SEQ ID NO: 94258 - RNA, 26 nt, Human
cucuguuguccuccccuugggcggcu

SEQ ID NO: 94259 - RNA, 22 nt, Human
uccaucuucugaaauucugaga

SEQ ID NO: 94260 - RNA, 22 nt, Human
caagucacaugucucucagacc

SEQ ID NO: 94261 - RNA, 21 nt, Human
agccccagaguagcuggaauu

SEQ ID NO: 94262 - RNA, 27 nt, Human
acuggcaggcaggcucccagggacacc

SEQ ID NO: 94263 - RNA, 27 nt, Human
cccaaagugcugggauuacagacauga

SEQ ID NO: 94264 - RNA, 20 nt, Human
aacaucacagaacauccugg

SEQ ID NO: 94265 - RNA, 20 nt, Human
agcuggagugcaguggugca

SEQ ID NO: 94266 - RNA, 25 nt, Human
ucuuuuccugagucuuuugaaugga

SEQ ID NO: 94267 - RNA, 19 nt, Human
ccuugggcucccuccugcc

SEQ ID NO: 94268 - RNA, 22 nt, Human
acuacagacguucucaggcugg

SEQ ID NO: 94269 - RNA, 23 nt, Human
cgugggccaggaugugcagaaca

SEQ ID NO: 94270 - RNA, 25 nt, Human
cuugucuuaaucguccugcugcugc

SEQ ID NO: 94271 - RNA, 26 nt, Human
aguaucuggggcgucaacauggggac

SEQ ID NO: 94272 - RNA, 20 nt, Human
gucaaugacaguuucuuuuu

SEQ ID NO: 94273 - RNA, 25 nt, Human
agugauuucccuguauuggguuuga

SEQ ID NO: 94274 - RNA, 23 nt, Human
uucuauucuaucaucuaaaacaa

SEQ ID NO: 94275 - RNA, 24 nt, Human
cgccugaggucaggaguucaagau

SEQ ID NO: 94276 - RNA, 22 nt, Human
ggaauuggucuuucugcucaag

SEQ ID NO: 94277 - RNA, 22 nt, Human
gacuagccuggccaacaucaug

SEQ ID NO: 94278 - RNA, 29 nt, Human
uuuugaacaauacagaugccuucccuugu

SEQ ID NO: 94279 - RNA, 27 nt, Human
gauaugaccucccuuucuuuaugugcu

SEQ ID NO: 94280 - RNA, 26 nt, Human
ccugccuguaccccgccaacagcuuc

SEQ ID NO: 94281 - RNA, 25 nt, Human
uguguggaggugaugguaccugcca

SEQ ID NO: 94282 - RNA, 21 nt, Human
gccaaucuucuccuucgggga

SEQ ID NO: 94283 - RNA, 22 nt, Human
acugcagucaacagugugccuc

SEQ ID NO: 94284 - RNA, 21 nt, Human
cucucugcugcuguugagguu

SEQ ID NO: 94285 - RNA, 23 nt, Human
ggucacaugccaucucuuccuga

SEQ ID NO: 94286 - RNA, 21 nt, Human
gagcuauuucagccacaugaa

SEQ ID NO: 94287 - RNA, 24 nt, Human
acaaucaguaaaucagauucuguc

SEQ ID NO: 94288 - RNA, 21 nt, Human
gaaggagaaagagugagggca

SEQ ID NO: 94289 - RNA, 22 nt, Human
caccucacucugcuaccuugcc

SEQ ID NO: 94290 - RNA, 22 nt, Human
cagacucccugaccccucccuc

SEQ ID NO: 94291 - RNA, 27 nt, Human
ggagagggaagugaauugcagagggga

SEQ ID NO: 94292 - RNA, 27 nt, Human
ugcugugggguuccugggagagcuuac

SEQ ID NO: 94293 - RNA, 30 nt, Human
caucccugccuggucacaggcaugccccgg

SEQ ID NO: 94294 - RNA, 26 nt, Human
gcucuggcucugagaugaggcagacg

SEQ ID NO: 94295 - RNA, 22 nt, Human
gcucaugccuguaaucccagga

SEQ ID NO: 94296 - RNA, 21 nt, Human
gccccgguccugcacagcccc

SEQ ID NO: 94297 - RNA, 22 nt, Human
gugagucuuugguucuaaggac

SEQ ID NO: 94298 - RNA, 19 nt, Human
agaaagaccuguugcuaga

SEQ ID NO: 94299 - RNA, 22 nt, Human
cgccuguaauccuagcacuuug

SEQ ID NO: 94300 - RNA, 24 nt, Human
ggucacccaaauagcugagugcag

SEQ ID NO: 94301 - RNA, 18 nt, Human
ugcccccucccaaaaaga

SEQ ID NO: 94302 - RNA, 27 nt, Human
cauuuuccuccuuccaggcccuccucg

SEQ ID NO: 94303 - RNA, 20 nt, Human
ucugagugaggacagcaggc

SEQ ID NO: 94304 - RNA, 29 nt, Human
gguggcaggcagagcaggaugcagaggca

SEQ ID NO: 94305 - RNA, 25 nt, Human
ccaggauaggcaagaagcugguuuc

SEQ ID NO: 94306 - RNA, 20 nt, Human
guuauuuuguggaaaaagaa

SEQ ID NO: 94307 - RNA, 24 nt, Human
accggugaccgcuacugcugccgg

SEQ ID NO: 94308 - RNA, 22 nt, Human
ggcaugccacuuccaagauuag

SEQ ID NO: 94309 - RNA, 22 nt, Human
uucaggugauucuccugccuca

SEQ ID NO: 94310 - RNA, 17 nt, Human
uuugcuuugacaucuca

SEQ ID NO: 94311 - RNA, 22 nt, Human
gaaggcugagugugaggcaccu

SEQ ID NO: 94312 - RNA, 26 nt, Human
uggggcuaggacugugggcuuuuagc

SEQ ID NO: 94313 - RNA, 22 nt, Human
ggauuguugcgccucugcucug

SEQ ID NO: 94314 - RNA, 23 nt, Human
cagguuccggagcaccaucccac

SEQ ID NO: 94315 - RNA, 27 nt, Human
cacaaccucucugaucuugugcucagc

SEQ ID NO: 94316 - RNA, 27 nt, Human
cucugccccagcucuggcuuccagaaa

SEQ ID NO: 94317 - RNA, 20 nt, Human
aggcacugcaauuuuauuuu

SEQ ID NO: 94318 - RNA, 22 nt, Human
uguuacacuggcugguguugaa

SEQ ID NO: 94319 - RNA, 27 nt, Human
uucaguuacauuucugcugauauucag

SEQ ID NO: 94320 - RNA, 25 nt, Human
ucugcugcuguccaucacuguccuu

SEQ ID NO: 94321 - RNA, 22 nt, Human
cggugggagaccugcugccgga

SEQ ID NO: 94322 - RNA, 29 nt, Human
aggguguggcuacccucgccaccccaaau

SEQ ID NO: 94323 - RNA, 18 nt, Human
ccucuuccuccugguuca

SEQ ID NO: 94324 - RNA, 26 nt, Human
cugcagccuccacccggcucucaccg

SEQ ID NO: 94325 - RNA, 20 nt, Human
ggcucucuggcagauuuccu

SEQ ID NO: 94326 - RNA, 21 nt, Human
cuacuuccaauucaauaaugg

SEQ ID NO: 94327 - RNA, 27 nt, Human
gucaucuuagcuuuccacaggagggag

SEQ ID NO: 94328 - RNA, 22 nt, Human
cccugcgugcacggccuaggag

SEQ ID NO: 94329 - RNA, 22 nt, Human
cugaggcaugaggaucucuuga

SEQ ID NO: 94330 - RNA, 22 nt, Human
cugaggcaggaggaucgcuuga

SEQ ID NO: 94331 - RNA, 22 nt, Human
ucacccccuaacccccaaaaaa

SEQ ID NO: 94332 - RNA, 24 nt, Human
cccaagacuauguccugacauaua

SEQ ID NO: 94333 - RNA, 21 nt, Human
gccugucccuuucacuccaca

SEQ ID NO: 94334 - RNA, 23 nt, Human
agcacagacuuacaaggauuuca

SEQ ID NO: 94335 - RNA, 22 nt, Human
ggcucacugcagccuugaacuc

SEQ ID NO: 94336 - RNA, 25 nt, Human
aggacauugccucaggguugcaaac

SEQ ID NO: 94337 - RNA, 27 nt, Human
ccaauuuuucugagagaaggaaauaac

SEQ ID NO: 94338 - RNA, 25 nt, Human
acauucuauacaaaacugugcugug

SEQ ID NO: 94339 - RNA, 21 nt, Human
cccguuuucacacugcuguua

SEQ ID NO: 94340 - RNA, 25 nt, Human
agcaagaagccacagauuggcauga

SEQ ID NO: 94341 - RNA, 30 nt, Human
ccucgcccgcuccccugggcucagcucgga

SEQ ID NO: 94342 - RNA, 21 nt, Human
ugcugguuccucugccugugu

SEQ ID NO: 94343 - RNA, 22 nt, Human
ugcaagcucugccucccagguu

SEQ ID NO: 94344 - RNA, 22 nt, Human
aggcugaggcacgagaaucgcu

SEQ ID NO: 94345 - RNA, 21 nt, Human
cagguauuugcuuuugcuugc

SEQ ID NO: 94346 - RNA, 20 nt, Human
ggggcccaagagucugggga

SEQ ID NO: 94347 - RNA, 18 nt, Human
accuccugaaugccugag

SEQ ID NO: 94348 - RNA, 24 nt, Human
aaguuggcaugaaauuuugguaaa

SEQ ID NO: 94349 - RNA, 23 nt, Human
gcuauucugcgcccccuccuacc

SEQ ID NO: 94350 - RNA, 19 nt, Human
agagaaacgcguguccccg

SEQ ID NO: 94351 - RNA, 27 nt, Human
ccccaaaacggcggcgcgccucgucgc

SEQ ID NO: 94352 - RNA, 22 nt, Human
cucuggcccccaccccauuacu

SEQ ID NO: 94353 - RNA, 21 nt, Human
cugauguugauuuggaaacau

SEQ ID NO: 94354 - RNA, 23 nt, Human
ugacaccauacaccaucuugguu

SEQ ID NO: 94355 - RNA, 19 nt, Human
uucuguguccugacaccac

SEQ ID NO: 94356 - RNA, 22 nt, Human
gugagaggugaacucagccugg

SEQ ID NO: 94357 - RNA, 19 nt, Human
aaacaaaaucaguuuugca

SEQ ID NO: 94358 - RNA, 27 nt, Human
acaaaucagcacgguucccaccagguu

SEQ ID NO: 94359 - RNA, 26 nt, Human
cagcacagucagcgggugaauuacag

SEQ ID NO: 94360 - RNA, 21 nt, Human
ggcuucagcccgggagagggg

SEQ ID NO: 94361 - RNA, 22 nt, Human
aggccaaggcaggaggaucguu

SEQ ID NO: 94362 - RNA, 22 nt, Human
aggcugaggcagggggaucgcu

SEQ ID NO: 94363 - RNA, 23 nt, Human
gggauaacuacuguuacagcuuu

SEQ ID NO: 94364 - RNA, 22 nt, Human
cccaccccaggucaugccagcg

SEQ ID NO: 94365 - RNA, 23 nt, Human
aacuguacugaauagguucccca

SEQ ID NO: 94366 - RNA, 27 nt, Human
gcacagcccuugucggugccccggccc

SEQ ID NO: 94367 - RNA, 27 nt, Human
uggcucaugccuguaauccaacauugg

SEQ ID NO: 94368 - RNA, 23 nt, Human
cugcccagguaugccuuccagug

SEQ ID NO: 94369 - RNA, 22 nt, Human
gauggcggaaaggaaggggcgu

SEQ ID NO: 94370 - RNA, 23 nt, Human
augugggcucagauccugggcau

SEQ ID NO: 94371 - RNA, 27 nt, Human
ggccagccugggcaacauaacaagauc

SEQ ID NO: 94372 - RNA, 23 nt, Human
ccuuugguggcugggauaugaug

SEQ ID NO: 94373 - RNA, 27 nt, Human
caggaauauuugcaagacucagccagc

SEQ ID NO: 94374 - RNA, 22 nt, Human
cggagggagcgcugggagcgag

SEQ ID NO: 94375 - RNA, 22 nt, Human
accacacacccagcccuccugg

SEQ ID NO: 94376 - RNA, 20 nt, Human
ccaggcccacccaacugaag

SEQ ID NO: 94377 - RNA, 27 nt, Human
aguuuccucugaugcagcugcuucucc

SEQ ID NO: 94378 - RNA, 18 nt, Human
gagagggaccagggcacc

SEQ ID NO: 94379 - RNA, 25 nt, Human
ucugagcuagaauuauucucuuaaa

SEQ ID NO: 94380 - RNA, 22 nt, Human
acacguguccaugcaccacaga

SEQ ID NO: 94381 - RNA, 25 nt, Human
uccucucccauccuuuucugcucca

SEQ ID NO: 94382 - RNA, 26 nt, Human
cguccuugacuuuauaaaagccccga

SEQ ID NO: 94383 - RNA, 19 nt, Human
cacugggccaagugcagug

SEQ ID NO: 94384 - RNA, 22 nt, Human
aggacacgaaagugaacuccac

SEQ ID NO: 94385 - RNA, 26 nt, Human
cuuguauguccaucagcauuuaucaa

SEQ ID NO: 94386 - RNA, 22 nt, Human
gugaguuauaugauuuacggag

SEQ ID NO: 94387 - RNA, 25 nt, Human
cgcccgaacagccucccagccuggg

SEQ ID NO: 94388 - RNA, 24 nt, Human
aacagguuucagugaugaggagga

SEQ ID NO: 94389 - RNA, 27 nt, Human
cagccucucuggcaaggcuuucuugag

SEQ ID NO: 94390 - RNA, 24 nt, Human
uaacauccuuauucagccuuaucc

SEQ ID NO: 94391 - RNA, 26 nt, Human
cagugcagagccuucucagaagcaca

SEQ ID NO: 94392 - RNA, 20 nt, Human
aauuuggggcaggaaauacu

SEQ ID NO: 94393 - RNA, 22 nt, Human
uggcccacaccuguggucccag

SEQ ID NO: 94394 - RNA, 28 nt, Human
cagcaggaaggccccucuguggagcgcc

SEQ ID NO: 94395 - RNA, 21 nt, Human
gccugacaggcauuuaaauca

SEQ ID NO: 94396 - RNA, 23 nt, Human
gcuacucugugccagagccuggg

SEQ ID NO: 94397 - RNA, 22 nt, Human
agcucccuccagugguggccgc

SEQ ID NO: 94398 - RNA, 23 nt, Human
cugcagcuuccuaaaauauuuua

SEQ ID NO: 94399 - RNA, 23 nt, Human
caguuugaauauccuuuguuuca

SEQ ID NO: 94400 - RNA, 23 nt, Human
auaagacaacaaucacacucaua

SEQ ID NO: 94401 - RNA, 23 nt, Human
cauucagaaggucucucaguuga

SEQ ID NO: 94402 - RNA, 22 nt, Human
agucugugcugguugccaccca

SEQ ID NO: 94403 - RNA, 20 nt, Human
ucagaacugggaaaacagug

SEQ ID NO: 94404 - RNA, 22 nt, Human
caggcagcuuaagugugaguuu

SEQ ID NO: 94405 - RNA, 17 nt, Human
ucucagccuagcccagc

SEQ ID NO: 94406 - RNA, 27 nt, Human
ccagguuccagcaauucuccugccuca

SEQ ID NO: 94407 - RNA, 27 nt, Human
ucaucccagcagccucgcacacucccu

SEQ ID NO: 94408 - RNA, 21 nt, Human
gcccugccuguuuugcaccug

SEQ ID NO: 94409 - RNA, 28 nt, Human
uuuccauuugcuaucaugucagugaacg

SEQ ID NO: 94410 - RNA, 20 nt, Human
uuuuuuccuguuuuaucuga

SEQ ID NO: 94411 - RNA, 20 nt, Human
aucucaguucacugguuuga

SEQ ID NO: 94412 - RNA, 23 nt, Human
aaccaguucucacaacuugcuau

SEQ ID NO: 94413 - RNA, 22 nt, Human
uauuucccaagcuggagugcag

SEQ ID NO: 94414 - RNA, 20 nt, Human
cuuuauauacuuagcuauau

SEQ ID NO: 94415 - RNA, 27 nt, Human
aacuucugucuuugacuuucccagcgu

SEQ ID NO: 94416 - RNA, 27 nt, Human
uggagacagagucucgcuauugucacc

SEQ ID NO: 94417 - RNA, 23 nt, Human
uucaacuuucagaagugccacuu

SEQ ID NO: 94418 - RNA, 17 nt, Human
gacagcaucagcucuga

SEQ ID NO: 94419 - RNA, 21 nt, Human
gggaauguuugucucauccca

SEQ ID NO: 94420 - RNA, 22 nt, Human
uccagggaaaaggaacuuguga

SEQ ID NO: 94421 - RNA, 20 nt, Human
ucaagagccgaaauuauuac

SEQ ID NO: 94422 - RNA, 24 nt, Human
ggcuucuccugccuuuuucaggga

SEQ ID NO: 94423 - RNA, 22 nt, Human
uacuggguggaggcuggggguc

SEQ ID NO: 94424 - RNA, 22 nt, Human
uuuaaaccauuuggugcuuggu

SEQ ID NO: 94425 - RNA, 23 nt, Human
uucacaguucuuugggccagaca

SEQ ID NO: 94426 - RNA, 21 nt, Human
gcuuucucauacauuaucaca

SEQ ID NO: 94427 - RNA, 27 nt, Human
uacucacugagucuuaacuuuucacca

SEQ ID NO: 94428 - RNA, 20 nt, Human
guucaacuguugacagagga

SEQ ID NO: 94429 - RNA, 25 nt, Human
gggaaauucacacugugcguuuuga

SEQ ID NO: 94430 - RNA, 27 nt, Human
uuuccacugcuauuagucauggucacu

SEQ ID NO: 94431 - RNA, 22 nt, Human
ccuacaugauggcguacucuga

SEQ ID NO: 94432 - RNA, 27 nt, Human
ccagugcacucccuaggaaauccggga

SEQ ID NO: 94433 - RNA, 21 nt, Human
ccugccucacuccuccgugag

SEQ ID NO: 94434 - RNA, 24 nt, Human
ggcacugcuuggaaauuguguuuu

SEQ ID NO: 94435 - RNA, 22 nt, Human
guugccagacuggagugcagug

SEQ ID NO: 94436 - RNA, 25 nt, Human
accagcaccaggcccacccucgucu

SEQ ID NO: 94437 - RNA, 27 nt, Human
cggaaggcagagcugcaaucuaguuaa

SEQ ID NO: 94438 - RNA, 19 nt, Human
uccaaauuuucagccacca

SEQ ID NO: 94439 - RNA, 26 nt, Human
gcuaacuuucuucuugucuagcuauu

SEQ ID NO: 94440 - RNA, 22 nt, Human
ucuccuggaggcugguucugcu

SEQ ID NO: 94441 - RNA, 28 nt, Human
uaacuugauccauuucuaauuauguagc

SEQ ID NO: 94442 - RNA, 22 nt, Human
gcacugggccagcauccuccgg

SEQ ID NO: 94443 - RNA, 24 nt, Human
agggugagggagacuggggccugg

SEQ ID NO: 94444 - RNA, 28 nt, Human
cccgucagugcucuccccgucguuugcc

SEQ ID NO: 94445 - RNA, 27 nt, Human
cccaaguagcugggauuacagaaagcc

SEQ ID NO: 94446 - RNA, 21 nt, Human
cugaccucaguugauccaccc

SEQ ID NO: 94447 - RNA, 18 nt, Human
agugccguggaacuggaa

SEQ ID NO: 94448 - RNA, 26 nt, Human
aaagaagaaaagguucuuacugcuug

SEQ ID NO: 94449 - RNA, 25 nt, Human
acccagcaugacauaacagugcagg

SEQ ID NO: 94450 - RNA, 24 nt, Human
uugguugagguggaagcccuccuu

SEQ ID NO: 94451 - RNA, 23 nt, Human
gaggccccgagcccccagcacuu

SEQ ID NO: 94452 - RNA, 25 nt, Human
aguccgcuggccacccagcugagag

SEQ ID NO: 94453 - RNA, 25 nt, Human
caagggaagagagaugaggaaccag

SEQ ID NO: 94454 - RNA, 26 nt, Human
gaagccguccagaagugucagagucu

SEQ ID NO: 94455 - RNA, 21 nt, Human
cacucgagggggaggauggua

SEQ ID NO: 94456 - RNA, 22 nt, Human
aagacuugcuucagccccaggu

SEQ ID NO: 94457 - RNA, 22 nt, Human
ccuagcuaaggucuauaaacau

SEQ ID NO: 94458 - RNA, 28 nt, Human
cuccuuucacagcuucuaagguguccag

SEQ ID NO: 94459 - RNA, 15 nt, Human
uucucaucuuuucca

SEQ ID NO: 94460 - RNA, 27 nt, Human
acuggauaaucuuuaugugcccuuucc

SEQ ID NO: 94461 - RNA, 23 nt, Human
aggguuccuguagaccuagggag

SEQ ID NO: 94462 - RNA, 23 nt, Human
ggaacucaaguggaauuuguuug

SEQ ID NO: 94463 - RNA, 22 nt, Human
aggcugaggcaggaggauugcu

SEQ ID NO: 94464 - RNA, 23 nt, Human
gggagcgaugcuuaucucucaca

SEQ ID NO: 94465 - RNA, 23 nt, Human
acuggcagccagccucuguuucu

SEQ ID NO: 94466 - RNA, 27 nt, Human
cccugcucccuguggacaaaagcacau

SEQ ID NO: 94467 - RNA, 23 nt, Human
acaaaacucuguucccacucccu

SEQ ID NO: 94468 - RNA, 27 nt, Human
gacuguaaaaccaccuuuucugcuuca

SEQ ID NO: 94469 - RNA, 25 nt, Human
aauucacuuacugaccggccugggc

SEQ ID NO: 94470 - RNA, 23 nt, Human
cucaggugauccaccugccucag

SEQ ID NO: 94471 - RNA, 26 nt, Human
uuuccaaccuucuccccaacccuugg

SEQ ID NO: 94472 - RNA, 26 nt, Human
guuuuaaauuggaacauaucuugccu

SEQ ID NO: 94473 - RNA, 27 nt, Human
aacuauguucuuugcuauuucuucacu

SEQ ID NO: 94474 - RNA, 27 nt, Human
ugggaccccugcucaggccuucucucu

SEQ ID NO: 94475 - RNA, 21 nt, Human
cuccugauggaagaacagugg

SEQ ID NO: 94476 - RNA, 23 nt, Human
ccacccuucuuagggcuggagga

SEQ ID NO: 94477 - RNA, 16 nt, Human
uucauucaaugccuua

SEQ ID NO: 94478 - RNA, 21 nt, Human
ggcguccuguccacacccagc

SEQ ID NO: 94479 - RNA, 24 nt, Human
cccacccucgucucugccugggug

SEQ ID NO: 94480 - RNA, 20 nt, Human
uuucccuuaccgaucggcau

SEQ ID NO: 94481 - RNA, 18 nt, Human
gagccuguugugucucag

SEQ ID NO: 94482 - RNA, 22 nt, Human
uugcuccccaccccuugcgaac

SEQ ID NO: 94483 - RNA, 25 nt, Human
ucuucuguauuccacaauaguacuu

SEQ ID NO: 94484 - RNA, 18 nt, Human
agguuaccuuugcugcua

SEQ ID NO: 94485 - RNA, 27 nt, Human
cugcccagcccugccuccuggccaugc

SEQ ID NO: 94486 - RNA, 22 nt, Human
uucauucuuuuuauguaguaaa

SEQ ID NO: 94487 - RNA, 20 nt, Human
ggccacaucuccccaccucu

SEQ ID NO: 94488 - RNA, 25 nt, Human
gcucauggccuccugcuucuugccu

SEQ ID NO: 94489 - RNA, 26 nt, Human
auacuagaguuuuauuuuuagcaaug

SEQ ID NO: 94490 - RNA, 21 nt, Human
auuaccuucccucccugggcc

SEQ ID NO: 94491 - RNA, 23 nt, Human
cacaccaggcugugggccucaag

SEQ ID NO: 94492 - RNA, 20 nt, Human
ucuggagaaaacagagugcc

SEQ ID NO: 94493 - RNA, 27 nt, Human
agcuuugaaagagcacuucccaacgcu

SEQ ID NO: 94494 - RNA, 22 nt, Human
cacaccuguaaucccagcacuu

SEQ ID NO: 94495 - RNA, 26 nt, Human
cugguuuuucaguuuuuaaaaggccu

SEQ ID NO: 94496 - RNA, 21 nt, Human
uuuucagucuucgccagguca

SEQ ID NO: 94497 - RNA, 22 nt, Human
ugugucaaagcaccucaugccu

SEQ ID NO: 94498 - RNA, 26 nt, Human
gagcagcuaggacugcaggugugcac

SEQ ID NO: 94499 - RNA, 23 nt, Human
ggcaggacuguggcgggccgggc

SEQ ID NO: 94500 - RNA, 20 nt, Human
gcacacggcucuucuuccca

SEQ ID NO: 94501 - RNA, 23 nt, Human
ccagcugcugcccacauuucugg

SEQ ID NO: 94502 - RNA, 22 nt, Human
aagucggcuccaugcucaccag

SEQ ID NO: 94503 - RNA, 18 nt, Human
cccacagaaaugaugaaa

SEQ ID NO: 94504 - RNA, 21 nt, Human
cccaggaagagagcaggcagc

SEQ ID NO: 94505 - RNA, 26 nt, Human
caaauacccacccauuuccaccaugg

SEQ ID NO: 94506 - RNA, 20 nt, Human
ccugcugcccuccagccggg

SEQ ID NO: 94507 - RNA, 27 nt, Human
gcugaaccuugugcuccagggguccuc

SEQ ID NO: 94508 - RNA, 18 nt, Human
ugccgaagcgccaccuca

SEQ ID NO: 94509 - RNA, 25 nt, Human
ucuucuuuccuccccucccauggac

SEQ ID NO: 94510 - RNA, 22 nt, Human
cacgaggucaggagaucgagac

SEQ ID NO: 94511 - RNA, 20 nt, Human
ugccuggaugcgguggugca

SEQ ID NO: 94512 - RNA, 27 nt, Human
gaauugcaugcaaacuagacugaaaug

SEQ ID NO: 94513 - RNA, 21 nt, Human
cggcggaggagguggcggcgg

SEQ ID NO: 94514 - RNA, 22 nt, Human
ggacccagacguggaguggagu

SEQ ID NO: 94515 - RNA, 21 nt, Human
acucacccggagaaacccagc

SEQ ID NO: 94516 - RNA, 22 nt, Human
caaauuauaaaaauuagucggg

SEQ ID NO: 94517 - RNA, 25 nt, Human
caguggaugguuccaggcacccugu

SEQ ID NO: 94518 - RNA, 19 nt, Human
auuuccauuucucccuguu

SEQ ID NO: 94519 - RNA, 23 nt, Human
uaaaucaagccauucauuuuggg

SEQ ID NO: 94520 - RNA, 19 nt, Human
cguuccccuuccucuauga

SEQ ID NO: 94521 - RNA, 26 nt, Human
ucaaaccuuacuugccucuggaacac

SEQ ID NO: 94522 - RNA, 21 nt, Human
auauaucaaccacacguggaa

SEQ ID NO: 94523 - RNA, 27 nt, Human
gcucaguuuauccaagguguaacucua

SEQ ID NO: 94524 - RNA, 27 nt, Human
uaccaugucguaguuacucucaggcau

SEQ ID NO: 94525 - RNA, 24 nt, Human
aagggaggguggcgagggggaagc

SEQ ID NO: 94526 - RNA, 20 nt, Human
gaaagaacacgcucucucca

SEQ ID NO: 94527 - RNA, 24 nt, Human
caguaacuuaucuuucuguccuuu

SEQ ID NO: 94528 - RNA, 25 nt, Human
auacaauuuccuacacuucauaccu

SEQ ID NO: 94529 - RNA, 21 nt, Human
uuucuggaacauucagucuag

SEQ ID NO: 94530 - RNA, 20 nt, Human
uucugaacagaacacuuugg

SEQ ID NO: 94531 - RNA, 21 nt, Human
guuauuucucauaaguaccca

SEQ ID NO: 94532 - RNA, 26 nt, Human
gccacucagaaaagacgcaccagccc

SEQ ID NO: 94533 - RNA, 20 nt, Human
cagagauacagcuucuuaua

SEQ ID NO: 94534 - RNA, 25 nt, Human
augccuggcugcuggaguacaugug

SEQ ID NO: 94535 - RNA, 24 nt, Human
uucucucuuugaagagagcaguca

SEQ ID NO: 94536 - RNA, 21 nt, Human
uuccauuccacacagaaugca

SEQ ID NO: 94537 - RNA, 26 nt, Human
cagggugaccuguucucuagcuguga

SEQ ID NO: 94538 - RNA, 22 nt, Human
ggggugagagguucaguccugg

SEQ ID NO: 94539 - RNA, 23 nt, Human
cucuaucagagaaaaacaggaaa

SEQ ID NO: 94540 - RNA, 26 nt, Human
caggggacccagaucuggagcuuuga

SEQ ID NO: 94541 - RNA, 26 nt, Human
agccuccucgugauccucccuagcau

SEQ ID NO: 94542 - RNA, 26 nt, Human
agcucuggcugucaguguguucgccc

SEQ ID NO: 94543 - RNA, 25 nt, Human
cugaguagcugggaauacagcaugc

SEQ ID NO: 94544 - RNA, 20 nt, Human
gcaaucuuaucuaaaagccu

SEQ ID NO: 94545 - RNA, 21 nt, Human
gcgagaacccucaacugacau

SEQ ID NO: 94546 - RNA, 24 nt, Human
cguuuccuagcuucaggcuacuug

SEQ ID NO: 94547 - RNA, 24 nt, Human
gagggaauagaggaauguguucgg

SEQ ID NO: 94548 - RNA, 24 nt, Human
augcagacacagauuauguuccug

SEQ ID NO: 94549 - RNA, 27 nt, Human
acuuauggauuuugacaagaaaggagg

SEQ ID NO: 94550 - RNA, 21 nt, Human
gagcucagcagacaccaggcc

SEQ ID NO: 94551 - RNA, 20 nt, Human
cuuagccugugauuuugccu

SEQ ID NO: 94552 - RNA, 22 nt, Human
gagcuagggugggggugcccga

SEQ ID NO: 94553 - RNA, 21 nt, Human
aauuccucuuuugcuuaaauc

SEQ ID NO: 94554 - RNA, 21 nt, Human
auuuuuguacaucccaaagga

SEQ ID NO: 94555 - RNA, 26 nt, Human
agacaaagccuggaaggguguggacc

SEQ ID NO: 94556 - RNA, 20 nt, Human
cgcaaaccacacaccugcca

SEQ ID NO: 94557 - RNA, 23 nt, Human
gaagugauaucuggucucaggga

SEQ ID NO: 94558 - RNA, 22 nt, Human
cucucucagugucaauagauga

SEQ ID NO: 94559 - RNA, 22 nt, Human
gcacuagaguuuaacugcagcg

SEQ ID NO: 94560 - RNA, 26 nt, Human
ggcccuccuggaacccaggcucuaaa

SEQ ID NO: 94561 - RNA, 23 nt, Human
gacagugcacaugaacugucuuu

SEQ ID NO: 94562 - RNA, 23 nt, Human
agacucgggggugucugaagggg

SEQ ID NO: 94563 - RNA, 25 nt, Human
gccuggccugaugaugguggguggg

SEQ ID NO: 94564 - RNA, 22 nt, Human
uucucauucucuuucauguucc

SEQ ID NO: 94565 - RNA, 29 nt, Human
gggcuacaggucugucacuaugcucucuu

SEQ ID NO: 94566 - RNA, 27 nt, Human
acggacggggcagccgugcucacagcu

SEQ ID NO: 94567 - RNA, 18 nt, Human
cucuaauccuccauuaag

SEQ ID NO: 94568 - RNA, 25 nt, Human
uguguaaauggagugcuguacagau

SEQ ID NO: 94569 - RNA, 28 nt, Human
guagaggcaugaacacacauggaugcac

SEQ ID NO: 94570 - RNA, 24 nt, Human
acuaauggaauaaacuguaauauu

SEQ ID NO: 94571 - RNA, 23 nt, Human
ugcucuauuaagauuggaaaugu

SEQ ID NO: 94572 - RNA, 22 nt, Human
agugaauuuuuguauuuuuagu

SEQ ID NO: 94573 - RNA, 23 nt, Human
caggcugagccaagcccacggcc

SEQ ID NO: 94574 - RNA, 27 nt, Human
gccacaucuuccucuaacaaaucucuc

SEQ ID NO: 94575 - RNA, 24 nt, Human
ugcucucuggcugggccagugggc

SEQ ID NO: 94576 - RNA, 24 nt, Human
gcaaucuuccuuaauagcauuuca

SEQ ID NO: 94577 - RNA, 20 nt, Human
acgauggcgaacacagcaga

SEQ ID NO: 94578 - RNA, 25 nt, Human
ggaaacgcucuccucgagcccuccc

SEQ ID NO: 94579 - RNA, 18 nt, Human
cuugcagagcgugucuau

SEQ ID NO: 94580 - RNA, 21 nt, Human
ggauugggccucaggccaggu

SEQ ID NO: 94581 - RNA, 20 nt, Human
guguguuugcauguaggaga

SEQ ID NO: 94582 - RNA, 22 nt, Human
auuucccacuuugguugugugg

SEQ ID NO: 94583 - RNA, 20 nt, Human
uccagccugggcaacgagug

SEQ ID NO: 94584 - RNA, 22 nt, Human
uucacucaggcuggaauguagu

SEQ ID NO: 94585 - RNA, 20 nt, Human
ugggaagagauuaccuagcc

SEQ ID NO: 94586 - RNA, 19 nt, Human
ccucuugcccucugcuuua

SEQ ID NO: 94587 - RNA, 22 nt, Human
gcucagcauuuccacaccaagc

SEQ ID NO: 94588 - RNA, 22 nt, Human
ucucagcccugccugcccuggc

SEQ ID NO: 94589 - RNA, 26 nt, Human
cgcuagugccugcuaggugcauggcc

SEQ ID NO: 94590 - RNA, 20 nt, Human
uguguauguauauguacauu

SEQ ID NO: 94591 - RNA, 21 nt, Human
ugcagucugcauuccugcacu

SEQ ID NO: 94592 - RNA, 23 nt, Human
uugcaguauuucacaguuauuau

SEQ ID NO: 94593 - RNA, 28 nt, Human
gccggacacggcuucacugaccagcggc

SEQ ID NO: 94594 - RNA, 22 nt, Human
ggcccaggcugagagcagcagg

SEQ ID NO: 94595 - RNA, 27 nt, Human
augggacuaauuauucccacuagccag

SEQ ID NO: 94596 - RNA, 23 nt, Human
aaauucuugguuauucugccaua

SEQ ID NO: 94597 - RNA, 20 nt, Human
uccaacaacaccacugcacc

SEQ ID NO: 94598 - RNA, 22 nt, Human
accaucuuugccaacaugguga

SEQ ID NO: 94599 - RNA, 27 nt, Human
auuuugggggaaaaaauccaaaacaca

SEQ ID NO: 94600 - RNA, 22 nt, Human
cguggcuccagaaugugcugcc

SEQ ID NO: 94601 - RNA, 23 nt, Human
ggccuagccuugagcaguguugc

SEQ ID NO: 94602 - RNA, 25 nt, Human
ccuuccagaccccaggaaguuggcc

SEQ ID NO: 94603 - RNA, 20 nt, Human
auugcuugugcucagggcug

SEQ ID NO: 94604 - RNA, 21 nt, Human
uuugccaggcuggugcaaagu

SEQ ID NO: 94605 - RNA, 22 nt, Human
ccugcugcagucucauuuccag

SEQ ID NO: 94606 - RNA, 23 nt, Human
agauccuaauauuuuauugaggg

SEQ ID NO: 94607 - RNA, 27 nt, Human
cggaaggcagaugcacuucuacagacu

SEQ ID NO: 94608 - RNA, 22 nt, Human
aggcugagccaggaagaacgcu

SEQ ID NO: 94609 - RNA, 25 nt, Human
aucaacaacaaggaagucugcucug

SEQ ID NO: 94610 - RNA, 26 nt, Human
ugccuguaaaucucauuuguauuuuc

SEQ ID NO: 94611 - RNA, 22 nt, Human
uugaggcagaggugccgaguga

SEQ ID NO: 94612 - RNA, 19 nt, Human
uggaaaggcuguguggaaa

SEQ ID NO: 94613 - RNA, 20 nt, Human
uugaaaaucauuuccagaca

SEQ ID NO: 94614 - RNA, 22 nt, Human
cucccacaugcacagcuuccug

SEQ ID NO: 94615 - RNA, 18 nt, Human
cucagggcucagaaggug

SEQ ID NO: 94616 - RNA, 27 nt, Human
aucucccauccuccccagcgccaucug

SEQ ID NO: 94617 - RNA, 21 nt, Human
gcaagcaagaaacacugggcu

SEQ ID NO: 94618 - RNA, 25 nt, Human
ggcucaaggcuggaauauuuaugcc

SEQ ID NO: 94619 - RNA, 23 nt, Human
gaauguucacuuacugauuacua

SEQ ID NO: 94620 - RNA, 22 nt, Human
aacucuggcuuucacugcgcuc

SEQ ID NO: 94621 - RNA, 21 nt, Human
ugagcucuaggguggcugguu

SEQ ID NO: 94622 - RNA, 19 nt, Human
uccuccaggagcaggcugg

SEQ ID NO: 94623 - RNA, 22 nt, Human
ggcucuccauuuccugccucuc

SEQ ID NO: 94624 - RNA, 22 nt, Human
auggcgugaacccaggaggcgg

SEQ ID NO: 94625 - RNA, 23 nt, Human
uggagccaucucaggcuccacuc

SEQ ID NO: 94626 - RNA, 22 nt, Human
aaaugauuuuaauaaaaucuug

SEQ ID NO: 94627 - RNA, 24 nt, Human
agggccugccaguucucaccagcu

SEQ ID NO: 94628 - RNA, 25 nt, Human
cuccaccuuguuacacauuauguua

SEQ ID NO: 94629 - RNA, 19 nt, Human
aagaggagggagaggguga

SEQ ID NO: 94630 - RNA, 27 nt, Human
aguggcugauucuccaauggugagcag

SEQ ID NO: 94631 - RNA, 20 nt, Human
uccccugauugagggugggu

SEQ ID NO: 94632 - RNA, 24 nt, Human
cuucacugacuccauugagucauu

SEQ ID NO: 94633 - RNA, 21 nt, Human
cccgcaggaucaggugacuuc

SEQ ID NO: 94634 - RNA, 19 nt, Human
aacauacauucuguguucc

SEQ ID NO: 94635 - RNA, 21 nt, Human
ucuccaucuggucauacucca

SEQ ID NO: 94636 - RNA, 27 nt, Human
gaucaguauuaggaauauuucuaaaga

SEQ ID NO: 94637 - RNA, 21 nt, Human
gaaaggguggaugagugaaug

SEQ ID NO: 94638 - RNA, 25 nt, Human
ccauauaauugcagaaaagauuuuc

SEQ ID NO: 94639 - RNA, 22 nt, Human
ccugcaaggugcaccugcccca

SEQ ID NO: 94640 - RNA, 22 nt, Human
uguuaggaacaguuuguacagu

SEQ ID NO: 94641 - RNA, 25 nt, Human
aggggaggggaauaguugagugugc

SEQ ID NO: 94642 - RNA, 25 nt, Human
ucuccugcuaccagucugugccuua

SEQ ID NO: 94643 - RNA, 27 nt, Human
ggcucugugcugggggacgauacuggc

SEQ ID NO: 94644 - RNA, 22 nt, Human
aaaccuacagcccagaaaccag

SEQ ID NO: 94645 - RNA, 24 nt, Human
aagaaaauauaguuugauucuuca

SEQ ID NO: 94646 - RNA, 21 nt, Human
gauugcacuccagccugggcg

SEQ ID NO: 94647 - RNA, 21 nt, Human
gaucgcacuccagccugggug

SEQ ID NO: 94648 - RNA, 24 nt, Human
ucucccaucuucucauauccuggc

SEQ ID NO: 94649 - RNA, 24 nt, Human
uucuguguuucccuuuaaaccaga

SEQ ID NO: 94650 - RNA, 25 nt, Human
acucacuucaguacuucagcucuuc

SEQ ID NO: 94651 - RNA, 27 nt, Human
ucagcacuuugggaggcugaggugggc

SEQ ID NO: 94652 - RNA, 17 nt, Human
uccauaaaaaugucagc

SEQ ID NO: 94653 - RNA, 22 nt, Human
uuccaauacucguuuugccucu

SEQ ID NO: 94654 - RNA, 20 nt, Human
ggcucuggacuggagcucuc

SEQ ID NO: 94655 - RNA, 22 nt, Human
gcaugagccacggcacccagcc

SEQ ID NO: 94656 - RNA, 18 nt, Human
aaggugcagucucagggg

SEQ ID NO: 94657 - RNA, 27 nt, Human
ugcccaacauggcaaaaccucgucucu

SEQ ID NO: 94658 - RNA, 22 nt, Human
caccucccagguucaagcaguu

SEQ ID NO: 94659 - RNA, 21 nt, Human
cugcaaccucugccucccggg

SEQ ID NO: 94660 - RNA, 30 nt, Human
uggcagaaguuuccagaaggaggucacuug

SEQ ID NO: 94661 - RNA, 24 nt, Human
ccugagugugccccugccugccag

SEQ ID NO: 94662 - RNA, 24 nt, Human
cggagaaggcagcgagcgcaguga

SEQ ID NO: 94663 - RNA, 23 nt, Human
cgcaccaggcugugggguuucuc

SEQ ID NO: 94664 - RNA, 26 nt, Human
auaacacuguaguggaacauucuucu

SEQ ID NO: 94665 - RNA, 26 nt, Human
gaugaccagauuugaucucagccuga

SEQ ID NO: 94666 - RNA, 22 nt, Human
cuuaagauucuguggugugaca

SEQ ID NO: 94667 - RNA, 27 nt, Human
gugcucaucuucucuugucauucaucc

SEQ ID NO: 94668 - RNA, 23 nt, Human
ucugcugcugugguuaucuccua

SEQ ID NO: 94669 - RNA, 26 nt, Human
cuuagcaaucaugucuuuuguauagg

SEQ ID NO: 94670 - RNA, 23 nt, Human
caggcauucuuagcugagacacc

SEQ ID NO: 94671 - RNA, 22 nt, Human
agccucccgaguggcugggauu

SEQ ID NO: 94672 - RNA, 27 nt, Human
ggucucaaacuccugggcucaagcgaa

SEQ ID NO: 94673 - RNA, 22 nt, Human
gggugaggccaggcaggccugg

SEQ ID NO: 94674 - RNA, 26 nt, Human
aggagagagaaaaauaauggcaaaac

SEQ ID NO: 94675 - RNA, 22 nt, Human
aggcugaggcaggaagauagcu

SEQ ID NO: 94676 - RNA, 26 nt, Human
cccaaaacaaaguaauagcgccucuu

SEQ ID NO: 94677 - RNA, 23 nt, Human
cugcacucccucccuugccugua

SEQ ID NO: 94678 - RNA, 23 nt, Human
uccaguuuucagcacuagucuua

SEQ ID NO: 94679 - RNA, 20 nt, Human
gcaugucagucagcacucug

SEQ ID NO: 94680 - RNA, 21 nt, Human
cugcuagaaaacauucuauug

SEQ ID NO: 94681 - RNA, 27 nt, Human
uacccuaggcuggauugcacucgccuu

SEQ ID NO: 94682 - RNA, 21 nt, Human
aaggaagugaugaauaaauac

SEQ ID NO: 94683 - RNA, 27 nt, Human
ugggagaucuugaguugcaguccacag

SEQ ID NO: 94684 - RNA, 26 nt, Human
gcauucuaucguccuguugugcucag

SEQ ID NO: 94685 - RNA, 22 nt, Human
acuguugccagaggcuuguacu

SEQ ID NO: 94686 - RNA, 19 nt, Human
uugcccaggcuggggugca

SEQ ID NO: 94687 - RNA, 20 nt, Human
uucuuuacaagaugauaccu

SEQ ID NO: 94688 - RNA, 27 nt, Human
ugaaaacagcacuucagcuuuagcuga

SEQ ID NO: 94689 - RNA, 24 nt, Human
aacugaaaauugccuccuccaucu

SEQ ID NO: 94690 - RNA, 23 nt, Human
ggcuuccagccaugcuguccuca

SEQ ID NO: 94691 - RNA, 21 nt, Human
cgcugcgccgccccugggcag

SEQ ID NO: 94692 - RNA, 27 nt, Human
cuaacaaacuucagccugggaagugag

SEQ ID NO: 94693 - RNA, 21 nt, Human
ugcuuggaguucuuuuugccu

SEQ ID NO: 94694 - RNA, 23 nt, Human
cuggguccuaaacugacugaaga

SEQ ID NO: 94695 - RNA, 27 nt, Human
ccacugcacuccggccuaggcaacgag

SEQ ID NO: 94696 - RNA, 20 nt, Human
ugcccaggcugaagugcagu

SEQ ID NO: 94697 - RNA, 21 nt, Human
ccacugauguauggacuugca

SEQ ID NO: 94698 - RNA, 21 nt, Human
caaagagauaaugucacagug

SEQ ID NO: 94699 - RNA, 21 nt, Human
uuugccugcccagucuuugga

SEQ ID NO: 94700 - RNA, 25 nt, Human
auuauuccugaauguacagacagaa

SEQ ID NO: 94701 - RNA, 20 nt, Human
ggguggugugggugauggga

SEQ ID NO: 94702 - RNA, 23 nt, Human
aggccacgagggccagggcuucu

SEQ ID NO: 94703 - RNA, 27 nt, Human
uccugcugggggccuagaacccugaga

SEQ ID NO: 94704 - RNA, 21 nt, Human
aaacccaggacaucugugcca

SEQ ID NO: 94705 - RNA, 22 nt, Human
gcaccugccaccauacccagcu

SEQ ID NO: 94706 - RNA, 19 nt, Human
uuuaggguaaaugcucauc

SEQ ID NO: 94707 - RNA, 20 nt, Human
uaaagcaacaacaagcuuca

SEQ ID NO: 94708 - RNA, 20 nt, Human
uugagacccaggccuguggc

SEQ ID NO: 94709 - RNA, 23 nt, Human
gaugggguuucuccauguuggcc

SEQ ID NO: 94710 - RNA, 25 nt, Human
cugggaggguacauggaugggcagg

SEQ ID NO: 94711 - RNA, 26 nt, Human
agggcuguagggggaggcagugcgag

SEQ ID NO: 94712 - RNA, 21 nt, Human
ccuuaaguuguauugucuacu

SEQ ID NO: 94713 - RNA, 24 nt, Human
cugccugggcugggugucuggugc

SEQ ID NO: 94714 - RNA, 21 nt, Human
cuucccuucaacaacucucca

SEQ ID NO: 94715 - RNA, 21 nt, Human
uuuagaaaugucugagaguaa

SEQ ID NO: 94716 - RNA, 23 nt, Human
ggacagguggggccucagccugg

SEQ ID NO: 94717 - RNA, 25 nt, Human
uucaagugcaauccauguaucugua

SEQ ID NO: 94718 - RNA, 23 nt, Human
auugcaccacugcauuccagccu

SEQ ID NO: 94719 - RNA, 29 nt, Human
ccagcuuuccagcuuuccucuggauuccg

SEQ ID NO: 94720 - RNA, 16 nt, Human
aucaucaaaugccuaa

SEQ ID NO: 94721 - RNA, 24 nt, Human
gccagguaguggaguaaaaaagga

SEQ ID NO: 94722 - RNA, 24 nt, Human
cacugccucuacugggcgugcugc

SEQ ID NO: 94723 - RNA, 20 nt, Human
gccuggcucccuguuggucu

SEQ ID NO: 94724 - RNA, 22 nt, Human
uugcuuuuucucuaccuuucuu

SEQ ID NO: 94725 - RNA, 19 nt, Human
uugcuucuguuucagugca

SEQ ID NO: 94726 - RNA, 22 nt, Human
gggagggagagaccggagcagc

SEQ ID NO: 94727 - RNA, 20 nt, Human
cucuuccggccauucuucac

SEQ ID NO: 94728 - RNA, 22 nt, Human
aacagaauuagaagaugaacau

SEQ ID NO: 94729 - RNA, 18 nt, Human
ucuccccucagcucggcu

SEQ ID NO: 94730 - RNA, 24 nt, Human
cugucacccagucuggagugcagu

SEQ ID NO: 94731 - RNA, 21 nt, Human
auuuggcuuuaccuucaucua

SEQ ID NO: 94732 - RNA, 23 nt, Human
cgggaaaccugcacugacuuuuu

SEQ ID NO: 94733 - RNA, 21 nt, Human
uugguaacagaagaugaagac

SEQ ID NO: 94734 - RNA, 23 nt, Human
guugccucccccgccuccaguca

SEQ ID NO: 94735 - RNA, 22 nt, Human
cugguuacagcccagugcucau

SEQ ID NO: 94736 - RNA, 22 nt, Human
gugugagccaccacaccaggcc

SEQ ID NO: 94737 - RNA, 19 nt, Human
uacuccuguugaugcagcu

SEQ ID NO: 94738 - RNA, 21 nt, Human
uuaacccuuauuccucccuca

SEQ ID NO: 94739 - RNA, 22 nt, Human
gguugggggcggggugggcagg

SEQ ID NO: 94740 - RNA, 22 nt, Human
uggauguguuuacguggagagg

SEQ ID NO: 94741 - RNA, 22 nt, Human
gcccucugggacccuauacgga

SEQ ID NO: 94742 - RNA, 23 nt, Human
uaguacccacuuucugcucuuug

SEQ ID NO: 94743 - RNA, 25 nt, Human
gccugacccucagcacuuucagccg

SEQ ID NO: 94744 - RNA, 20 nt, Human
uugcaaaaugagacuuucua

SEQ ID NO: 94745 - RNA, 25 nt, Human
augagauuuguuaacacacauuuuc

SEQ ID NO: 94746 - RNA, 24 nt, Human
cauugagaucuuccugcugagucc

SEQ ID NO: 94747 - RNA, 26 nt, Human
caaugccauuucaaugcauuacuaaa

SEQ ID NO: 94748 - RNA, 22 nt, Human
ucacacaccauccccacuguca

SEQ ID NO: 94749 - RNA, 20 nt, Human
aaacauccacuucucuuuca

SEQ ID NO: 94750 - RNA, 22 nt, Human
gccucccagguucacaccauuc

SEQ ID NO: 94751 - RNA, 22 nt, Human
ugugugccagaugcccuguugg

SEQ ID NO: 94752 - RNA, 27 nt, Human
ggcggccgggagagcgagugagcgagc

SEQ ID NO: 94753 - RNA, 26 nt, Human
gcccaggcuggagugcagugagcuau

SEQ ID NO: 94754 - RNA, 20 nt, Human
acucuuggcuccuguuacuc

SEQ ID NO: 94755 - RNA, 23 nt, Human
uucuuuacgagagggucucaccc

SEQ ID NO: 94756 - RNA, 27 nt, Human
uggcaugcaccuguagucucaccuacu

SEQ ID NO: 94757 - RNA, 20 nt, Human
ccagccuggcgacagaguga

SEQ ID NO: 94758 - RNA, 27 nt, Human
cauugcgcucuagccugggcaacaaca

SEQ ID NO: 94759 - RNA, 25 nt, Human
cucuuucuuaguauaugaaaggaca

SEQ ID NO: 94760 - RNA, 20 nt, Human
aucuucucuuucucuccuca

SEQ ID NO: 94761 - RNA, 21 nt, Human
aggccucaccagaggcuccuu

SEQ ID NO: 94762 - RNA, 19 nt, Human
aguuuuauuuguucacuua

SEQ ID NO: 94763 - RNA, 21 nt, Human
cacccaggaggagugggguca

SEQ ID NO: 94764 - RNA, 22 nt, Human
ucaugaaucaacaggguuucag

SEQ ID NO: 94765 - RNA, 20 nt, Human
gacacugcacugagcacuuu

SEQ ID NO: 94766 - RNA, 22 nt, Human
gaucucaccauuucaccaugca

SEQ ID NO: 94767 - RNA, 24 nt, Human
uuccaacaagaggauuucuuuuuc

SEQ ID NO: 94768 - RNA, 22 nt, Human
cuccccccagacuggagagcaa

SEQ ID NO: 94769 - RNA, 20 nt, Human
gcugaucuugaacuccuggg

SEQ ID NO: 94770 - RNA, 22 nt, Human
acucacugcaggcuccgccucc

SEQ ID NO: 94771 - RNA, 27 nt, Human
uggcucacaccuguaaucuuaacacug

SEQ ID NO: 94772 - RNA, 22 nt, Human
uuuguugcccaggcuggagcgc

SEQ ID NO: 94773 - RNA, 26 nt, Human
caguguggaauaugacccuaccagag

SEQ ID NO: 94774 - RNA, 26 nt, Human
ucuuucuccucuccuucugugacucc

SEQ ID NO: 94775 - RNA, 19 nt, Human
guagugcugcaucuuauga

SEQ ID NO: 94776 - RNA, 26 nt, Human
uccaauaaagugccuucugggcuuuu

SEQ ID NO: 94777 - RNA, 21 nt, Human
cuucagcugcauuucacaugc

SEQ ID NO: 94778 - RNA, 22 nt, Human
gaauacccuggccacagagcca

SEQ ID NO: 94779 - RNA, 22 nt, Human
ucauccugaacugccuuccucc

SEQ ID NO: 94780 - RNA, 21 nt, Human
ugaguuacagcucaggaaaag

SEQ ID NO: 94781 - RNA, 18 nt, Human
cccugcugcuccaggaca

SEQ ID NO: 94782 - RNA, 23 nt, Human
ccggcugccucugcugcaguuca

SEQ ID NO: 94783 - RNA, 26 nt, Human
ccuuucucaggagcuugggcagugcc

SEQ ID NO: 94784 - RNA, 26 nt, Human
ucacuaacccgcuuccgguccaguca

SEQ ID NO: 94785 - RNA, 21 nt, Human
gcugcagguuaagaugacgga

SEQ ID NO: 94786 - RNA, 22 nt, Human
cugaggcaggaggauugccuga

SEQ ID NO: 94787 - RNA, 25 nt, Human
ccugucucccugucucuagaagccu

SEQ ID NO: 94788 - RNA, 21 nt, Human
uagauucugagaucuucccau

SEQ ID NO: 94789 - RNA, 24 nt, Human
ugcacacacgugcauauacacauu

SEQ ID NO: 94790 - RNA, 20 nt, Human
agaaauaaaccaaggcucua

SEQ ID NO: 94791 - RNA, 25 nt, Human
cugcuuuccccacagacaugccuuc

SEQ ID NO: 94792 - RNA, 22 nt, Human
gaccucugggcucucuaggugg

SEQ ID NO: 94793 - RNA, 22 nt, Human
ugaggaaagaagaaaacuggag

SEQ ID NO: 94794 - RNA, 20 nt, Human
gccuccucugcuggcaugug

SEQ ID NO: 94795 - RNA, 32 nt, Human
uagcauuaaaucagcugugaaucgucaggggg

SEQ ID NO: 94796 - RNA, 22 nt, Human
caguuuuguuaacucucuuugg

SEQ ID NO: 94797 - RNA, 21 nt, Human
cuucucaaaugcuacucagua

SEQ ID NO: 94798 - RNA, 26 nt, Human
ccugugcaaaauggcaacucuuaagg

SEQ ID NO: 94799 - RNA, 26 nt, Human
caugaaucuguuuacuagcuuggugg

SEQ ID NO: 94800 - RNA, 24 nt, Human
guucuguguaauuguuuaguuuaa

SEQ ID NO: 94801 - RNA, 22 nt, Human
ccuucucacucucccuggagcu

SEQ ID NO: 94802 - RNA, 27 nt, Human
uccccgcagcugguuugcacagccucc

SEQ ID NO: 94803 - RNA, 32 nt, Human
cccagucaccaguucuccucuggacuggccac

SEQ ID NO: 94804 - RNA, 23 nt, Human
ugucccccaggcuggagugcagu

SEQ ID NO: 94805 - RNA, 23 nt, Human
ugucacccaggcuggagugccgu

SEQ ID NO: 94806 - RNA, 19 nt, Human
auggggaagguucaaucag

SEQ ID NO: 94807 - RNA, 25 nt, Human
acagcuuccuguccccaucugucgg

SEQ ID NO: 94808 - RNA, 25 nt, Human
ugcugccaggcucugcuccagggca

SEQ ID NO: 94809 - RNA, 20 nt, Human
uguaagcuuuaagcgcaaca

SEQ ID NO: 94810 - RNA, 25 nt, Human
ucuuuuuuaauguccaaaagugggg

SEQ ID NO: 94811 - RNA, 23 nt, Human
cugcuuguauuugugauauuuca

SEQ ID NO: 94812 - RNA, 31 nt, Human; identical to SEQ ID NO: 7302

SEQ ID NO: 94813 - RNA, 24 nt, Human
uucaccuggucauucugugaccac

SEQ ID NO: 94814 - RNA, 27 nt, Human
uacugccucuuguccuguauagcaacc

SEQ ID NO: 94815 - RNA, 21 nt, Human
ccuaugucugugccucccuuc

SEQ ID NO: 94816 - RNA, 22 nt, Human
guauucuugaaguauuguguuu

SEQ ID NO: 94817 - RNA, 21 nt, Human
gggguggcgggagggggaggc

SEQ ID NO: 94818 - RNA, 23 nt, Human
cagcauuuguccacccacuuagu

SEQ ID NO: 94819 - RNA, 24 nt, Human
uggaggaggccaguguagagccag

SEQ ID NO: 94820 - RNA, 25 nt, Human
cuaaaagcagagauguuugagguga

SEQ ID NO: 94821 - RNA, 22 nt, Human
auuguccaggcuagagugcagu

SEQ ID NO: 94822 - RNA, 20 nt, Human
cggcccagucccguccugca

SEQ ID NO: 94823 - RNA, 22 nt, Human
caggcuggggacccugggugca

SEQ ID NO: 94824 - RNA, 25 nt, Human
cccaguguucagccuccuucacucc

SEQ ID NO: 94825 - RNA, 26 nt, Human
cccucccacccuucaggcugcacugu

SEQ ID NO: 94826 - RNA, 21 nt, Human
ucuuuuggaagaaaugagaaa

SEQ ID NO: 94827 - RNA, 24 nt, Human
acucauuuaacaucaugaauuuau

SEQ ID NO: 94828 - RNA, 21 nt, Human
cugccccgcaccauggacuuu

SEQ ID NO: 94829 - RNA, 22 nt, Human
caccuugauuuugagcuggaau

SEQ ID NO: 94830 - RNA, 22 nt, Human
ggagagguggauguuugucuga

SEQ ID NO: 94831 - RNA, 21 nt, Human
cuguaucccaccuguuuucca

SEQ ID NO: 94832 - RNA, 27 nt, Human
caggaagggaaaauuugcuuucccuag

SEQ ID NO: 94833 - RNA, 22 nt, Human
acaaucagaugggccacauggc

SEQ ID NO: 94834 - RNA, 23 nt, Human
cuggggaggcagagguugcggug

SEQ ID NO: 94835 - RNA, 22 nt, Human
uucgagugugccuuuuuauuca

SEQ ID NO: 94836 - RNA, 27 nt, Human
ggguacccaucacacaccagcguuuug

SEQ ID NO: 94837 - RNA, 20 nt, Human
augucuuggcuaaauaguca

SEQ ID NO: 94838 - RNA, 23 nt, Human
gaaagaagagaagaaaacuagua

SEQ ID NO: 94839 - RNA, 21 nt, Human
cuucccuuucucuuuuggaca

SEQ ID NO: 94840 - RNA, 19 nt, Human
caggcagcgggugcuggcu

SEQ ID NO: 94841 - RNA, 27 nt, Human
uuuuaauaacaugcaugggucccucuc

SEQ ID NO: 94842 - RNA, 20 nt, Human
gccccuugccaggcuuccuu

SEQ ID NO: 94843 - RNA, 24 nt, Human
aguccaucugucacuugcauucca

SEQ ID NO: 94844 - RNA, 24 nt, Human
uuucugcugccgccaccgcccacu

SEQ ID NO: 94845 - RNA, 22 nt, Human
ggccucccaacgugcugggauu

SEQ ID NO: 94846 - RNA, 21 nt, Human
aaagggagggagaugagaagu

SEQ ID NO: 94847 - RNA, 26 nt, Human
gcugcucagugccugccucugacaaa

SEQ ID NO: 94848 - RNA, 22 nt, Human
augacacggaacgcucccacug

SEQ ID NO: 94849 - RNA, 24 nt, Human
uccucuccugcugucacagcugcc

SEQ ID NO: 94850 - RNA, 27 nt, Human
uccccacgccccgucucuuucucaccu

SEQ ID NO: 94851 - RNA, 26 nt, Human
uacuucagaggcugagguggaaggau

SEQ ID NO: 94852 - RNA, 22 nt, Human
cugcuagccucaaccuccuggg

SEQ ID NO: 94853 - RNA, 26 nt, Human
cuaacuugcccauauucuaaaucauc

SEQ ID NO: 94854 - RNA, 24 nt, Human
cugucaugcugccugcuuucugga

SEQ ID NO: 94855 - RNA, 23 nt, Human
ugcuggcacuucaggcucugccu

SEQ ID NO: 94856 - RNA, 27 nt, Human
gugcucugggugagcugggaaaauaca

SEQ ID NO: 94857 - RNA, 21 nt, Human
gcagacggagaaauggaggcc

SEQ ID NO: 94858 - RNA, 30 nt, Human; identical to SEQ ID NO: 6910

SEQ ID NO: 94859 - RNA, 22 nt, Human
agaaaaaggcuauuaauaucau

SEQ ID NO: 94860 - RNA, 21 nt, Human
cuacuuuacaauuucucucua

SEQ ID NO: 94861 - RNA, 26 nt, Human
aggcagcaggggguacagacuuccuu

SEQ ID NO: 94862 - RNA, 22 nt, Human
acaaguaacuacacuaccucau

SEQ ID NO: 94863 - RNA, 22 nt, Human
agacacgaugccgagaccucaa

SEQ ID NO: 94864 - RNA, 25 nt, Human
uguucuucuccccuuucaaauugcc

SEQ ID NO: 94865 - RNA, 22 nt, Human
cccucccucccuuccuugggca

SEQ ID NO: 94866 - RNA, 18 nt, Human
ggcagccugugccugccu

SEQ ID NO: 94867 - RNA, 22 nt, Human
uuugggaaaggcagggcccuga

SEQ ID NO: 94868 - RNA, 23 nt, Human
auaaauuuaugguucucaggccu

SEQ ID NO: 94869 - RNA, 21 nt, Human
ccccaaaccaccaucucuuua

SEQ ID NO: 94870 - RNA, 25 nt, Human
gucuccuuuucccccucagagggca

SEQ ID NO: 94871 - RNA, 19 nt, Human
uacaaaaugacuaggauaa

SEQ ID NO: 94872 - RNA, 20 nt, Human
ucaguauuuccuauuggaaa

SEQ ID NO: 94873 - RNA, 26 nt, Human
agcccugcuagaggcuacagcacuuu

SEQ ID NO: 94874 - RNA, 24 nt, Human
ggcugguggacacagauacuguuc

SEQ ID NO: 94875 - RNA, 21 nt, Human
uuugcccaguguuugugcaag

SEQ ID NO: 94876 - RNA, 21 nt, Human
accaaaaagccaaguguggug

SEQ ID NO: 94877 - RNA, 20 nt, Human
ugcccugcaguuaguucuga

SEQ ID NO: 94878 - RNA, 22 nt, Human
ggaaggaagagguugcagugag

SEQ ID NO: 94879 - RNA, 21 nt, Human
cuuuggguuucuugcugcugc

SEQ ID NO: 94880 - RNA, 22 nt, Human
gccuuggagggaucccaggaag

SEQ ID NO: 94881 - RNA, 22 nt, Human
ugcucacuccagguuacugcaa

SEQ ID NO: 94882 - RNA, 19 nt, Human
ugcccuggggggcuuggaa

SEQ ID NO: 94883 - RNA, 24 nt, Human
cuguuccucuucccagagacaucg

SEQ ID NO: 94884 - RNA, 21 nt, Human
uaguaagccagaaaauauuca

SEQ ID NO: 94885 - RNA, 21 nt, Human
caagagugggcuuuguggaaa

SEQ ID NO: 94886 - RNA, 22 nt, Human
gggauugggguuuuccccuccc

SEQ ID NO: 94887 - RNA, 25 nt, Human
uaaauguugcuaugugccuuauguu

SEQ ID NO: 94888 - RNA, 20 nt, Human
agcucuauccauauuuuacu

SEQ ID NO: 94889 - RNA, 22 nt, Human
auccuaaucccuuccucuccca

SEQ ID NO: 94890 - RNA, 24 nt, Human
ucuagggcugggaaacacuccuug

SEQ ID NO: 94891 - RNA, 32 nt, Human
ggcucacugcaucuccggcuccuggacucaag

SEQ ID NO: 94892 - RNA, 27 nt, Human
uugagacaggcuggaguccagagccuu

SEQ ID NO: 94893 - RNA, 22 nt, Human
aauugaagaggugcugccaagg

SEQ ID NO: 94894 - RNA, 29 nt, Human
uagcugauuauuggcuuuauuugaugaau

SEQ ID NO: 94895 - RNA, 21 nt, Human
agaauugcucaaagaaaauua

SEQ ID NO: 94896 - RNA, 22 nt, Human
gggcagagcagaggggcagcga

SEQ ID NO: 94897 - RNA, 22 nt, Human
acagagcagugauaacuaccug

SEQ ID NO: 94898 - RNA, 22 nt, Human
cuucaucuacacugggauuugu

SEQ ID NO: 94899 - RNA, 22 nt, Human
aguuugauccaugaaccuggcu

SEQ ID NO: 94900 - RNA, 21 nt, Human
cccuaaccccucagcacuguc

SEQ ID NO: 94901 - RNA, 21 nt, Human
gucacuccucucuagggcaga

SEQ ID NO: 94902 - RNA, 22 nt, Human
agugcggauccgggaggaggag

SEQ ID NO: 94903 - RNA, 27 nt, Human
uugugguuucucucuuucugguucugu

SEQ ID NO: 94904 - RNA, 25 nt, Human
agcucacuguccucuggaucugcug

SEQ ID NO: 94905 - RNA, 22 nt, Human
augggggucucaccauguugcc

SEQ ID NO: 94906 - RNA, 21 nt, Human
guucaaagauuaaugccaacu

SEQ ID NO: 94907 - RNA, 24 nt, Human
uuuagugcucccugcaccaaccuc

SEQ ID NO: 94908 - RNA, 18 nt, Human
gucaucugauauacacau

SEQ ID NO: 94909 - RNA, 27 nt, Human
ugcuguugccucccugugaccuggagg

SEQ ID NO: 94910 - RNA, 24 nt, Human
cacaacaguauuuauaaaugagua

SEQ ID NO: 94911 - RNA, 22 nt, Human
agcauucugccucaauggccug

SEQ ID NO: 94912 - RNA, 23 nt, Human
ggugggggcuucagagggugggg

SEQ ID NO: 94913 - RNA, 22 nt, Human
caacucaagauagaccaugaga

SEQ ID NO: 94914 - RNA, 25 nt, Human
ggggugagcgugugugacagucuac

SEQ ID NO: 94915 - RNA, 27 nt, Human
aaaacauuuguuuuauagagucaguag

SEQ ID NO: 94916 - RNA, 20 nt, Human
cagaaaacagugccccaaau

SEQ ID NO: 94917 - RNA, 21 nt, Human
ucugccuggacuguugcgggc

SEQ ID NO: 94918 - RNA, 27 nt, Human
ggcucacugcaagcucugcccuccccg

SEQ ID NO: 94919 - RNA, 22 nt, Human
ucagaucuuuguauaugcuaag

SEQ ID NO: 94920 - RNA, 25 nt, Human
uagguggaaagagaaaugaugugaa

SEQ ID NO: 94921 - RNA, 23 nt, Human
uguugccauggugaugguguagc

SEQ ID NO: 94922 - RNA, 26 nt, Human
uggagacggccaagugaaggagccag

SEQ ID NO: 94923 - RNA, 25 nt, Human
gcugguuugugugugaacggacacu

SEQ ID NO: 94924 - RNA, 22 nt, Human
uccugcucuccagcaggggauc

SEQ ID NO: 94925 - RNA, 23 nt, Human
cuagaagugugaagugcagauga

SEQ ID NO: 94926 - RNA, 21 nt, Human
gucuccaacuccugaccucag

SEQ ID NO: 94927 - RNA, 25 nt, Human
uucuuaaggcuaugcuucaguuuuu

SEQ ID NO: 94928 - RNA, 21 nt, Human
uccccuugccagcugugccca

SEQ ID NO: 94929 - RNA, 24 nt, Human
gugcucucagcuggcagugcaaug

SEQ ID NO: 94930 - RNA, 24 nt, Human
cuaacacggugaaaccccuuaucu

SEQ ID NO: 94931 - RNA, 25 nt, Human
ugguggaguguagccuccaccugau

SEQ ID NO: 94932 - RNA, 21 nt, Human
agucugcuccguggcuccugu

SEQ ID NO: 94933 - RNA, 20 nt, Human
guagguccccuccauggccc

SEQ ID NO: 94934 - RNA, 22 nt, Human
uugaguauuuauauauugugca

SEQ ID NO: 94935 - RNA, 22 nt, Human
uuucuuaggcuggagugcagug

SEQ ID NO: 94936 - RNA, 21 nt, Human
aggagacggagguugcaguga

SEQ ID NO: 94937 - RNA, 27 nt, Human
cgcuuuccgcaucacucuccuuccucg

SEQ ID NO: 94938 - RNA, 23 nt, Human
aaaacagauccugcaaaaguucc

SEQ ID NO: 94939 - RNA, 27 nt, Human
augcauggccaucucccccucccuuuu

SEQ ID NO: 94940 - RNA, 27 nt, Human
aacagccuuacacugggcacauggagg

SEQ ID NO: 94941 - RNA, 21 nt, Human
cgccuguagucccagcacuuu

SEQ ID NO: 94942 - RNA, 20 nt, Human
ccacugugccccacuuucug

SEQ ID NO: 94943 - RNA, 23 nt, Human
ucugugggaggccaguccacauc

SEQ ID NO: 94944 - RNA, 18 nt, Human
gagcagccacauugccuu

SEQ ID NO: 94945 - RNA, 25 nt, Human
gccuguccgucccugucccgggcug

SEQ ID NO: 94946 - RNA, 27 nt, Human
aauggcugaaaagaguugugagcuuuu

SEQ ID NO: 94947 - RNA, 25 nt, Human
caccacugcgcccuucucccugagg

SEQ ID NO: 94948 - RNA, 26 nt, Human
cugcuccccgcccucucugcucgcug

SEQ ID NO: 94949 - RNA, 26 nt, Human
gaauccagaaggccuuucugcugaca

SEQ ID NO: 94950 - RNA, 22 nt, Human
gagacaaaacuccuacucucaa

SEQ ID NO: 94951 - RNA, 23 nt, Human
acccuuuauuuuuagcaaguuug

SEQ ID NO: 94952 - RNA, 27 nt, Human
ugauuguaauaaaacuguggcaccuua

SEQ ID NO: 94953 - RNA, 27 nt, Human
gugggagaauuaccugagcccaggaag

SEQ ID NO: 94954 - RNA, 22 nt, Human
ccggcgcgagcgcgaggcugca

SEQ ID NO: 94955 - RNA, 21 nt, Human
augucacccaggcuguggugc

SEQ ID NO: 94956 - RNA, 28 nt, Human
ucauggucucuaaccacuugacaccaga

SEQ ID NO: 94957 - RNA, 24 nt, Human
ucuuuuacuuaccuaucugucuac

SEQ ID NO: 94958 - RNA, 27 nt, Human
ggccugccacccagagccaagagggug

SEQ ID NO: 94959 - RNA, 24 nt, Human
gguaggaaaaguugcuguucuauu

SEQ ID NO: 94960 - RNA, 21 nt, Human
gucccaaaggccagucauccc

SEQ ID NO: 94961 - RNA, 27 nt, Human
gagcccaaccuucuuucacugacaccc

SEQ ID NO: 94962 - RNA, 23 nt, Human
gcugcaggaacccagcuagcugg

SEQ ID NO: 94963 - RNA, 24 nt, Human
ucuaagucucaacugcucuuuuau

SEQ ID NO: 94964 - RNA, 30 nt, Human
gacaaacaaacagccccaacuguguucggg

SEQ ID NO: 94965 - RNA, 25 nt, Human
uacauacauuagucuucaagguucu

SEQ ID NO: 94966 - RNA, 22 nt, Human
ucaugucucucccagugugaau

SEQ ID NO: 94967 - RNA, 20 nt, Human
ugucaagaguguuacuguag

SEQ ID NO: 94968 - RNA, 19 nt, Human
ccuguugccaucagugccc

SEQ ID NO: 94969 - RNA, 21 nt, Human
gucucccaggaagcugugggg

SEQ ID NO: 94970 - RNA, 22 nt, Human
gaacccaggccuggggggcggu

SEQ ID NO: 94971 - RNA, 23 nt, Human
guuguugccagguugcagcugcu

SEQ ID NO: 94972 - RNA, 21 nt, Human
gucuccaaaaugccuguccca

SEQ ID NO: 94973 - RNA, 21 nt, Human
acauagcaaagagaacaggcu

SEQ ID NO: 94974 - RNA, 26 nt, Human
gacucagagaggagacuuaccugaug

SEQ ID NO: 94975 - RNA, 20 nt, Human
uaagcugcuuccuggaaagc

SEQ ID NO: 94976 - RNA, 22 nt, Human
ggaagcugaggugggaggauca

SEQ ID NO: 94977 - RNA, 26 nt, Human
aaugggacugagucccaggaaacagu

SEQ ID NO: 94978 - RNA, 23 nt, Human
cccugccucccaaaccccauuag

SEQ ID NO: 94979 - RNA, 20 nt, Human
gguagagaagagacaguuua

SEQ ID NO: 94980 - RNA, 23 nt, Human
gucucuucagcuucucugaugcu

SEQ ID NO: 94981 - RNA, 20 nt, Human
ccugaaucaggaugagggag

SEQ ID NO: 94982 - RNA, 22 nt, Human
gcgcuugcauccaugcccagcc

SEQ ID NO: 94983 - RNA, 24 nt, Human
uuugcucacauguuucccugcuga

SEQ ID NO: 94984 - RNA, 26 nt, Human
gugugggaagcaggaccgcguccucc

SEQ ID NO: 94985 - RNA, 22 nt, Human
ucucuugaagacuugagaagcu

SEQ ID NO: 94986 - RNA, 21 nt, Human
uauacucacuuaucucaucca

SEQ ID NO: 94987 - RNA, 26 nt, Human
cuccagccucagaccugagacagggc

SEQ ID NO: 94988 - RNA, 21 nt, Human
agccauuuguaaugaauuugu

SEQ ID NO: 94989 - RNA, 18 nt, Human
gacuagguauugucuacu

SEQ ID NO: 94990 - RNA, 19 nt, Human
cuuaaguuuucaaccaagg

SEQ ID NO: 94991 - RNA, 24 nt, Human
aaggcuggucccacacuuaucagc

SEQ ID NO: 94992 - RNA, 22 nt, Human
cucucuacguugcccaggcugg

SEQ ID NO: 94993 - RNA, 26 nt, Human
cugucauuuaaaauucaugcauucca

SEQ ID NO: 94994 - RNA, 23 nt, Human
acaaguccuggauguugugugua

SEQ ID NO: 94995 - RNA, 24 nt, Human
cagugccuguaaucccagcuauuu

SEQ ID NO: 94996 - RNA, 21 nt, Human
uuuugugguuucucugaguca

SEQ ID NO: 94997 - RNA, 22 nt, Human
uuccuuucuucagacuccgucc

SEQ ID NO: 94998 - RNA, 26 nt, Human
guggggcgccuuccuggaggugacac

SEQ ID NO: 94999 - RNA, 26 nt, Human
ggggaauguuugggcagaagggagaa

SEQ ID NO: 95000 - RNA, 27 nt, Human
ggcucuuggagaaagcgugagcagggg

SEQ ID NO: 95001 - RNA, 24 nt, Human
gcaccagaaucucagaauuuacca

SEQ ID NO: 95002 - RNA, 22 nt, Human
ggggcggugccugcuguggaaa

SEQ ID NO: 95003 - RNA, 24 nt, Human
gugccuggcauccacuacugcugc

SEQ ID NO: 95004 - RNA, 26 nt, Human
uugcccaggugagggaaggagacagg

SEQ ID NO: 95005 - RNA, 22 nt, Human
uuucucacucucauccccacca

SEQ ID NO: 95006 - RNA, 21 nt, Human
aauucagcaaccucguaccuc

SEQ ID NO: 95007 - RNA, 24 nt, Human
ggcugcaauauuccguccugggug

SEQ ID NO: 95008 - RNA, 21 nt, Human
cucggagcuugugcuuugucu

SEQ ID NO: 95009 - RNA, 21 nt, Human
agccagccagcccuuccuccu

SEQ ID NO: 95010 - RNA, 27 nt, Human
gcuggucuaagaaugacgaugccuuca

SEQ ID NO: 95011 - RNA, 25 nt, Human
guaacaucuuugguugugguagucc

SEQ ID NO: 95012 - RNA, 27 nt, Human
cacagccgccugaaagccacaaugaga

SEQ ID NO: 95013 - RNA, 20 nt, Human
guuccucuggugggagggag

SEQ ID NO: 95014 - RNA, 22 nt, Human
ucccacaggcccuuccucucca

SEQ ID NO: 95015 - RNA, 22 nt, Human
cuccuuuucacaccuuauuuca

SEQ ID NO: 95016 - RNA, 25 nt, Human
uucagaaauuugguggguuuuuugu

SEQ ID NO: 95017 - RNA, 20 nt, Human
uccagccucacuucuagggu

SEQ ID NO: 95018 - RNA, 27 nt, Human
gacacaugcaaauguauguuuuaaaca

SEQ ID NO: 95019 - RNA, 24 nt, Human
gguuuuauucauuguaugaaaauu

SEQ ID NO: 95020 - RNA, 26 nt, Human
uucuugugauugacuuuuuggcucau

SEQ ID NO: 95021 - RNA, 27 nt, Human
ggcucaccgcaaccuccgcccccuggg

SEQ ID NO: 95022 - RNA, 19 nt, Human
cacccagcaaaaaugaaga

SEQ ID NO: 95023 - RNA, 21 nt, Human
gguccucaggucagcugggag

SEQ ID NO: 95024 - RNA, 25 nt, Human
ggugauuggccacacacugaguugc

SEQ ID NO: 95025 - RNA, 27 nt, Human
cugugugaccuugggcaaguuccuuuc

SEQ ID NO: 95026 - RNA, 28 nt, Human
cugcuuggcacagucucugccugcuugc

SEQ ID NO: 95027 - RNA, 24 nt, Human
acucuuugguggcuuugcauuuua

SEQ ID NO: 95028 - RNA, 24 nt, Human
agugaaaugccucucagucuuagg

SEQ ID NO: 95029 - RNA, 27 nt, Human
aggcauguuccagaaaggucucugagg

SEQ ID NO: 95030 - RNA, 24 nt, Human
cuuccauugaggagcccaggcugg

SEQ ID NO: 95031 - RNA, 21 nt, Human
ugggaccugguucucuucuaa

SEQ ID NO: 95032 - RNA, 17 nt, Human
guugguuccuagaggca

SEQ ID NO: 95033 - RNA, 23 nt, Human
aguugggaucuugugcucuguca

SEQ ID NO: 95034 - RNA, 22 nt, Human
cucaucugucccugaccucuaa

SEQ ID NO: 95035 - RNA, 24 nt, Human
ugagagaagagaguauggugcugg

SEQ ID NO: 95036 - RNA, 20 nt, Human
guugguuuccaacaguccuu

SEQ ID NO: 95037 - RNA, 24 nt, Human
ucaguuugagcugcugcuguuaug

SEQ ID NO: 95038 - RNA, 20 nt, Human
cuccaucucaaaaaagaaaa

SEQ ID NO: 95039 - RNA, 21 nt, Human
uuuuuaucuuugccugucuac

SEQ ID NO: 95040 - RNA, 21 nt, Human
uuagaagcagcgagugcaugg

SEQ ID NO: 95041 - RNA, 27 nt, Human
gccagugcuuuauuuggggaauucagg

SEQ ID NO: 95042 - RNA, 22 nt, Human
ugucuuuuuaugaccuguuugc

SEQ ID NO: 95043 - RNA, 21 nt, Human
ggucucaaaagucaccugccu

SEQ ID NO: 95044 - RNA, 28 nt, Human
uacaaaaacuuauuuauacuguucuuau

SEQ ID NO: 95045 - RNA, 23 nt, Human
uaacugcagcccucagaacuuua

SEQ ID NO: 95046 - RNA, 27 nt, Human
cauugcacuccagccugggcaacgaga

SEQ ID NO: 95047 - RNA, 27 nt, Human
auggggacagugggcucugccagggcu

SEQ ID NO: 95048 - RNA, 25 nt, Human
gcugguggccuucaaccucugccug

SEQ ID NO: 95049 - RNA, 22 nt, Human
auucccacuccccuccucucag

SEQ ID NO: 95050 - RNA, 17 nt, Human
ggcuuauccugggugcu

SEQ ID NO: 95051 - RNA, 24 nt, Human
aagcuacagggaacuccagguccu

SEQ ID NO: 95052 - RNA, 18 nt, Human
ggccacaaugaccucuuu

SEQ ID NO: 95053 - RNA, 27 nt, Human
ccugggucuuagcauugaucagugaca

SEQ ID NO: 95054 - RNA, 20 nt, Human
gggacuucuucgcugauuca

SEQ ID NO: 95055 - RNA, 26 nt, Human
uucaguccuggcuggaggagccacag

SEQ ID NO: 95056 - RNA, 23 nt, Human
acacuucaggggggcggguggcg

SEQ ID NO: 95057 - RNA, 22 nt, Human
cgcuugagccugggaggcagag

SEQ ID NO: 95058 - RNA, 25 nt, Human
caugcacagagcgccuucccccaca

SEQ ID NO: 95059 - RNA, 20 nt, Human
agcacagacucacauaugga

SEQ ID NO: 95060 - RNA, 22 nt, Human
uccagcaccuauugaauuacca

SEQ ID NO: 95061 - RNA, 27 nt, Human
cuccagccaucaagagacugagucaag

SEQ ID NO: 95062 - RNA, 22 nt, Human
gcacuugggagaaggcuuagaa

SEQ ID NO: 95063 - RNA, 19 nt, Human
uuccaauaaagcagccuca

SEQ ID NO: 95064 - RNA, 22 nt, Human
ucucuugccaaugcugcauucc

SEQ ID NO: 95065 - RNA, 22 nt, Human
gccugguggccuuccuuucaca

SEQ ID NO: 95066 - RNA, 24 nt, Human
aaaaggaggcgcucuuaauaacuc

SEQ ID NO: 95067 - RNA, 22 nt, Human
aucacuuggaccugggaggcag

SEQ ID NO: 95068 - RNA, 24 nt, Human
cauucuuaccauccuucucucaca

SEQ ID NO: 95069 - RNA, 19 nt, Human
aaacaacaguccuaacuuu

SEQ ID NO: 95070 - RNA, 20 nt, Human
ccacugcacugcagccugag

SEQ ID NO: 95071 - RNA, 19 nt, Human
agcuuuaugauaucaaaga

SEQ ID NO: 95072 - RNA, 27 nt, Human
ccuacuuccugaagggcccucccaagg

SEQ ID NO: 95073 - RNA, 22 nt, Human
acucgaccggauccaacccagu

SEQ ID NO: 95074 - RNA, 23 nt, Human
gaugggaagggcuuaucuagcca

SEQ ID NO: 95075 - RNA, 26 nt, Human
cucagggggaaggcagcucucuccag

SEQ ID NO: 95076 - RNA, 22 nt, Human
cacucagagcaggugguuuuuu

SEQ ID NO: 95077 - RNA, 28 nt, Human
uuuggccagaugucacuucagccagggu

SEQ ID NO: 95078 - RNA, 27 nt, Human
cacucuuaaaaagcuucuuucucuuca

SEQ ID NO: 95079 - RNA, 23 nt, Human
cguuuccuuggccuuccaggguc

SEQ ID NO: 95080 - RNA, 27 nt, Human
ucaaggcagacuuccugcccccugcac

SEQ ID NO: 95081 - RNA, 22 nt, Human
ggagccgccugcgcccgccgag

SEQ ID NO: 95082 - RNA, 23 nt, Human
ggcgcugugccgaggauucgggg

SEQ ID NO: 95083 - RNA, 21 nt, Human
uucgucucuggcuccuccucc

SEQ ID NO: 95084 - RNA, 21 nt, Human
uguuaggcuuuucugccugcu

SEQ ID NO: 95085 - RNA, 22 nt, Human
cugcccuccugugccugauguc

SEQ ID NO: 95086 - RNA, 22 nt, Human
ccgccugcugccuggacugcuc

SEQ ID NO: 95087 - RNA, 26 nt, Human
ccccgucgaggucaagaucaagaucc

SEQ ID NO: 95088 - RNA, 27 nt, Human
gacuguacuccuuucuaggaaugcuga

SEQ ID NO: 95089 - RNA, 27 nt, Human
ccauuguacuccagccugggcaacaag

SEQ ID NO: 95090 - RNA, 22 nt, Human
gguauucucaugagcucaucca

SEQ ID NO: 95091 - RNA, 27 nt, Human
ccgacuuugauagauuucuacacugag

SEQ ID NO: 95092 - RNA, 21 nt, Human
cuuccuccucuucaguguggu

SEQ ID NO: 95093 - RNA, 23 nt, Human
cuacaggcaugagccaccaugcc

SEQ ID NO: 95094 - RNA, 22 nt, Human
ggggugaguugaguguggcugg

SEQ ID NO: 95095 - RNA, 25 nt, Human
accagugaccuugcuuccuuccccc

SEQ ID NO: 95096 - RNA, 20 nt, Human
gggaggaggggcuggaaccc

SEQ ID NO: 95097 - RNA, 21 nt, Human
agcacagcaggcuucugggag

SEQ ID NO: 95098 - RNA, 23 nt, Human
gccuggagauaccauuguggacc

SEQ ID NO: 95099 - RNA, 22 nt, Human
ccugagccagccgagggggcca

SEQ ID NO: 95100 - RNA, 27 nt, Human
cuugcauuucaaaaugguaacuuuaca

SEQ ID NO: 95101 - RNA, 29 nt, Human
cugcucuuuguccacccaaaaagaugucc

SEQ ID NO: 95102 - RNA, 18 nt, Human
ugauuuguacugcuuuau

SEQ ID NO: 95103 - RNA, 25 nt, Human
agaauugaaaaugcauuagggaaaa

SEQ ID NO: 95104 - RNA, 22 nt, Human
aacuucuguauccuuccuuccc

SEQ ID NO: 95105 - RNA, 32 nt, Human
uaccucuucaguguuuuccuccagucccggga

SEQ ID NO: 95106 - RNA, 25 nt, Human
ugagaugagaagaggaaugagccau

SEQ ID NO: 95107 - RNA, 25 nt, Human
gggccucacuggugggagcugccuc

SEQ ID NO: 95108 - RNA, 23 nt, Human
gagcaagcccugacccaauaaag

SEQ ID NO: 95109 - RNA, 21 nt, Human
guccucaccaucacagcuguu

SEQ ID NO: 95110 - RNA, 22 nt, Human
accgguccccgccuccuccgcu

SEQ ID NO: 95111 - RNA, 22 nt, Human
aagguguaauuacuucaagccu

SEQ ID NO: 95112 - RNA, 22 nt, Human
ccugaguagcugggauuucagg

SEQ ID NO: 95113 - RNA, 27 nt, Human
caugccuuuuggguuugccuuaauucu

SEQ ID NO: 95114 - RNA, 22 nt, Human
gugccaugauugauuagcaaug

SEQ ID NO: 95115 - RNA, 21 nt, Human
cucugugccugcucucuccag

SEQ ID NO: 95116 - RNA, 24 nt, Human
ccugccuccugccugccccucucc

SEQ ID NO: 95117 - RNA, 26 nt, Human
gagggcaagggaaaguuacccugauc

SEQ ID NO: 95118 - RNA, 23 nt, Human
ggaaaauucagauauuuucuuag

SEQ ID NO: 95119 - RNA, 22 nt, Human
caggcaugccuguacucucuuu

SEQ ID NO: 95120 - RNA, 22 nt, Human
gcuggggugucugcacgaaguc

SEQ ID NO: 95121 - RNA, 20 nt, Human
uccaggagucaacaugccaa

SEQ ID NO: 95122 - RNA, 21 nt, Human
gggaaccagcccugccaccac

SEQ ID NO: 95123 - RNA, 19 nt, Human
gccacccuuccuguccgca

SEQ ID NO: 95124 - RNA, 25 nt, Human
gcucuugaacuccugaccucaggua

SEQ ID NO: 95125 - RNA, 22 nt, Human
ugguuggcaccuguagucccag

SEQ ID NO: 95126 - RNA, 25 nt, Human
ccuugcucuccccugcccugcugcc

SEQ ID NO: 95127 - RNA, 20 nt, Human
ccauguacccuccuuccuca

SEQ ID NO: 95128 - RNA, 24 nt, Human
cccaccccaacaccacugccacca

SEQ ID NO: 95129 - RNA, 24 nt, Human
ucuuggagauaauuucuuaccuca

SEQ ID NO: 95130 - RNA, 27 nt, Human
ucagcacuuucagccgccccaagucug

SEQ ID NO: 95131 - RNA, 22 nt, Human
ggaggaaagcagcugugagcgg

SEQ ID NO: 95132 - RNA, 20 nt, Human
uucugucugcuuuuuucuua

SEQ ID NO: 95133 - RNA, 26 nt, Human
uguaaaccauggcuguguggauacaa

SEQ ID NO: 95134 - RNA, 26 nt, Human
ccaauaauguuuuauacaucauuguc

SEQ ID NO: 95135 - RNA, 27 nt, Human
uucccacaugugucucccaagccugcu

SEQ ID NO: 95136 - RNA, 20 nt, Human
ggcauacaaccugagccuuu

SEQ ID NO: 95137 - RNA, 24 nt, Human
caguauucaagaagcaaccagcac

SEQ ID NO: 95138 - RNA, 26 nt, Human
agggguggggaggggggcgaggagac

SEQ ID NO: 95139 - RNA, 22 nt, Human
caucaucgccacugaaaaccag

SEQ ID NO: 95140 - RNA, 29 nt, Human
ccucuccugaccccugccuguuggcagcc

SEQ ID NO: 95141 - RNA, 18 nt, Human
cauguaaauaaagaucuu

SEQ ID NO: 95142 - RNA, 19 nt, Human
gccucucccugcaugucuu

SEQ ID NO: 95143 - RNA, 27 nt, Human
acacagacaggcagaggauuacaacac

SEQ ID NO: 95144 - RNA, 27 nt, Human
ccucacugcacccccagcccugcaccc

SEQ ID NO: 95145 - RNA, 21 nt, Human
agucagguuguccaucccauu

SEQ ID NO: 95146 - RNA, 18 nt, Human
ccaccuuuccuccagagg

SEQ ID NO: 95147 - RNA, 25 nt, Human
acacaggaaguuggagcaguaggug

SEQ ID NO: 95148 - RNA, 27 nt, Human
uguuuguaaucuccuagauacuauuac

SEQ ID NO: 95149 - RNA, 24 nt, Human
cuucugcucugucgucucuccaca

SEQ ID NO: 95150 - RNA, 21 nt, Human
aggcagcagcggcuggagcgg

SEQ ID NO: 95151 - RNA, 27 nt, Human
uucacuacuuuguucaauuauccaguc

SEQ ID NO: 95152 - RNA, 28 nt, Human
cuccuugcuccccaccccuugcgaacag

SEQ ID NO: 95153 - RNA, 21 nt, Human
cuccaucuguggaaugggaga

SEQ ID NO: 95154 - RNA, 23 nt, Human
aguuccucugcuggaguucaucc

SEQ ID NO: 95155 - RNA, 22 nt, Human
uucauagcugccuuucuuacca

SEQ ID NO: 95156 - RNA, 22 nt, Human
ucacccagacuggaaugcagug

SEQ ID NO: 95157 - RNA, 21 nt, Human
cauuaugaagcugcagugaua

SEQ ID NO: 95158 - RNA, 27 nt, Human
ccuccugugcugaccucaggguggucu

SEQ ID NO: 95159 - RNA, 31 nt, Human
auuuuuauauugaauggcaagaaugagaacu

SEQ ID NO: 95160 - RNA, 22 nt, Human
gagcaagacgccaucucaaaaa

SEQ ID NO: 95161 - RNA, 27 nt, Human
ggagcagugggaccaccugaugcugaa

SEQ ID NO: 95162 - RNA, 21 nt, Human
ccaagaccccaaaggcccagg

SEQ ID NO: 95163 - RNA, 22 nt, Human
acuccugccuccaccugggguc

SEQ ID NO: 95164 - RNA, 25 nt, Human
acauuuccuuacagaacuacuucuu

SEQ ID NO: 95165 - RNA, 21 nt, Human
uuccuuuaguaauuuauuguu

SEQ ID NO: 95166 - RNA, 22 nt, Human
caugauuguguucucugccucu

SEQ ID NO: 95167 - RNA, 27 nt, Human
ugguggagaagcagaaggagcaaucaa

SEQ ID NO: 95168 - RNA, 22 nt, Human
cagaagccugggguaccuaguc

SEQ ID NO: 95169 - RNA, 19 nt, Human
gagacaguauuuugcugaa

SEQ ID NO: 95170 - RNA, 21 nt, Human
cugugcuguggcauagacaug

SEQ ID NO: 95171 - RNA, 20 nt, Human
uacuaggugggaggauaugg

SEQ ID NO: 95172 - RNA, 22 nt, Human
cgggagguggaggcugcaauga

SEQ ID NO: 95173 - RNA, 27 nt, Human
gcuuccaagaaguugauggaacccacc

SEQ ID NO: 95174 - RNA, 20 nt, Human
ucacauugugcacagaucug

SEQ ID NO: 95175 - RNA, 22 nt, Human
ccgccucccugguucaagcaau

SEQ ID NO: 95176 - RNA, 26 nt, Human
cccaggcuggucgugaacuccugggc

SEQ ID NO: 95177 - RNA, 20 nt, Human
ggucauacuauuuaccaaau

SEQ ID NO: 95178 - RNA, 26 nt, Human
ggggugaggcuauuccagcgagcugg

SEQ ID NO: 95179 - RNA, 20 nt, Human
aaaaguaaugcuucaaucag

SEQ ID NO: 95180 - RNA, 21 nt, Human
augcguucucauucuuccuuu

SEQ ID NO: 95181 - RNA, 27 nt, Human
caaaccuggaaccuccugaucaguuug

SEQ ID NO: 95182 - RNA, 23 nt, Human
ucuuauagaaaaaggaaagguga

SEQ ID NO: 95183 - RNA, 22 nt, Human
uuccucuggcuccuuggaugua

SEQ ID NO: 95184 - RNA, 22 nt, Human
agaaugagacacugucucaaga

SEQ ID NO: 95185 - RNA, 20 nt, Human
ggcugagcuccaagugccug

SEQ ID NO: 95186 - RNA, 22 nt, Human
ucauuugagcccaggaggcuga

SEQ ID NO: 95187 - RNA, 30 nt, Human
uccauuugcaacaggaagacacuggcuuua

SEQ ID NO: 95188 - RNA, 23 nt, Human
ccuccuccuggguucauguugua

SEQ ID NO: 95189 - RNA, 22 nt, Human
cuauugcacuccagccugggcg

SEQ ID NO: 95190 - RNA, 20 nt, Human
gcacaaaauuauuguuuuca

SEQ ID NO: 95191 - RNA, 26 nt, Human
cccaccccacaccugcagugccagcu

SEQ ID NO: 95192 - RNA, 26 nt, Human
aagcaaguccugcaaccaaacuccca

SEQ ID NO: 95193 - RNA, 22 nt, Human
gaguuuauguagaaagcauuga

SEQ ID NO: 95194 - RNA, 27 nt, Human
cccccagcuucccgggcgcacugaccg

SEQ ID NO: 95195 - RNA, 21 nt, Human
ccaagcuuuccugcucagugu

SEQ ID NO: 95196 - RNA, 19 nt, Human
gcccccugggccugaggcc

SEQ ID NO: 95197 - RNA, 19 nt, Human
aaaggugaaacccaggagg

SEQ ID NO: 95198 - RNA, 28 nt, Human
ugggcuggugucaccugaagacucauuc

SEQ ID NO: 95199 - RNA, 24 nt, Human
ccuccugcuggcuccuccugccca

SEQ ID NO: 95200 - RNA, 21 nt, Human
agcagguuucacugcuucauu

SEQ ID NO: 95201 - RNA, 26 nt, Human
cccucgggccgggcaccacccccagu

SEQ ID NO: 95202 - RNA, 27 nt, Human
cuccuccagccgccgccgaaucauguc

SEQ ID NO: 95203 - RNA, 25 nt, Human
aacauccaaaagcacauuucauuuc

SEQ ID NO: 95204 - RNA, 22 nt, Human
cuauuuuuaucaugaauucccu

SEQ ID NO: 95205 - RNA, 21 nt, Human
ggagaucuuggccaacgugaa

SEQ ID NO: 95206 - RNA, 27 nt, Human
guacagccacgugucuaccuauguguc

SEQ ID NO: 95207 - RNA, 25 nt, Human
ggagaguggaaggagggagcuguuu

SEQ ID NO: 95208 - RNA, 20 nt, Human
acugaagaggagcaagaaca

SEQ ID NO: 95209 - RNA, 22 nt, Human
aguaacuggaguagcugggauu

SEQ ID NO: 95210 - RNA, 21 nt, Human
aucgcccaggcuggagugcag

SEQ ID NO: 95211 - RNA, 21 nt, Human
uuaagcaaugguaauugugaa

SEQ ID NO: 95212 - RNA, 22 nt, Human
gggaggagaagggaccugccuu

SEQ ID NO: 95213 - RNA, 22 nt, Human
aggguggagugcagugguagcg

SEQ ID NO: 95214 - RNA, 30 nt, Human
aacucgcacaucucuccugucuguuaguaa

SEQ ID NO: 95215 - RNA, 26 nt, Human
uuccuuuauucaguacaaucuuuuca

SEQ ID NO: 95216 - RNA, 20 nt, Human
agagaccacaggcaagggaa

SEQ ID NO: 95217 - RNA, 21 nt, Human
ucuagugccauuauuucuacc

SEQ ID NO: 95218 - RNA, 27 nt, Human
gaaugucccuuccauuucugagaacaa

SEQ ID NO: 95219 - RNA, 22 nt, Human
uccuggaggugggguugauggg

SEQ ID NO: 95220 - RNA, 27 nt, Human
ccccucggggcagguaauuucaugcuc

SEQ ID NO: 95221 - RNA, 21 nt, Human
ucuagaggcagacuccugagu

SEQ ID NO: 95222 - RNA, 22 nt, Human
agagccacagggcggccucucc

SEQ ID NO: 95223 - RNA, 24 nt, Human
gcggguggggugcagggagggaga

SEQ ID NO: 95224 - RNA, 22 nt, Human
gaaagagaagcuggggauugga

SEQ ID NO: 95225 - RNA, 24 nt, Human
aggaaaccagaggaauggauuuga

SEQ ID NO: 95226 - RNA, 26 nt, Human
uuucuucuuugggagucgaauguaau

SEQ ID NO: 95227 - RNA, 20 nt, Human
cuuuuugcuuucuucuuucc

SEQ ID NO: 95228 - RNA, 27 nt, Human
aucuuucccaccucuaaauucuguaaa

SEQ ID NO: 95229 - RNA, 31 nt, Human
ucugcuuccugggcccugccagcaucucugg

SEQ ID NO: 95230 - RNA, 21 nt, Human
aggcuggagugcaguggagca

SEQ ID NO: 95231 - RNA, 23 nt, Human
agagaacaacaggaauugaagaa

SEQ ID NO: 95232 - RNA, 24 nt, Human
uuucugcugcaggaaccucucauc

SEQ ID NO: 95233 - RNA, 21 nt, Human
cuucuacugcucuccuccacc

SEQ ID NO: 95234 - RNA, 21 nt, Human
gguucacugcagcuccuguca

SEQ ID NO: 95235 - RNA, 28 nt, Human
uacauguuuucacuuauuuagguuuucu

SEQ ID NO: 95236 - RNA, 22 nt, Human
acugaguguaaaauaugugcca

SEQ ID NO: 95237 - RNA, 20 nt, Human
gauugugaggucacugugaa

SEQ ID NO: 95238 - RNA, 26 nt, Human
aggucugcaagggaauucuugugugc

SEQ ID NO: 95239 - RNA, 25 nt, Human
cccaagcucagaggcgcacugugac

SEQ ID NO: 95240 - RNA, 26 nt, Human
gagcuagguccucggagugggccgga

SEQ ID NO: 95241 - RNA, 20 nt, Human
uuuuuauagcuuagcauuag

SEQ ID NO: 95242 - RNA, 24 nt, Human
guuaucuccccacaacccccagcc

SEQ ID NO: 95243 - RNA, 19 nt, Human
aagcagaaaccuaacucac

SEQ ID NO: 95244 - RNA, 22 nt, Human
cuuugcagagguccaaaugaua

SEQ ID NO: 95245 - RNA, 24 nt, Human
cauguaaagugucagaaggagcua

SEQ ID NO: 95246 - RNA, 27 nt, Human
acuuuaaggucauuucuaauacacauu

SEQ ID NO: 95247 - RNA, 22 nt, Human
ucugacauggauuauggacuuc

SEQ ID NO: 95248 - RNA, 22 nt, Human
ccucacugccccacugugcucc

SEQ ID NO: 95249 - RNA, 27 nt, Human
cugcccagggacaaagcagagugcagg

SEQ ID NO: 95250 - RNA, 23 nt, Human
uaggguagcaugggauuacaggg

SEQ ID NO: 95251 - RNA, 24 nt, Human
ggucuggccagggcuuccucaaau

SEQ ID NO: 95252 - RNA, 23 nt, Human
ugcugcccuggcuauggucacag

SEQ ID NO: 95253 - RNA, 29 nt, Human
ucgcguggagcauccuuagucccaccugu

SEQ ID NO: 95254 - RNA, 25 nt, Human
ugaaaggagcagaggcuggaacuac

SEQ ID NO: 95255 - RNA, 23 nt, Human
gccaugguucaucaggugcucua

SEQ ID NO: 95256 - RNA, 26 nt, Human
gaggggagagggugcgaccaagcccu

SEQ ID NO: 95257 - RNA, 27 nt, Human
gggcugccccugcucagcaccccgccu

SEQ ID NO: 95258 - RNA, 27 nt, Human
gcacuccucaauugggaguguugugac

SEQ ID NO: 95259 - RNA, 22 nt, Human
acuaagaugugcagcauuucac

SEQ ID NO: 95260 - RNA, 18 nt, Human
ggucucaaguaggccuca

SEQ ID NO: 95261 - RNA, 27 nt, Human
ccaagcccuccuaccuaccaagauaua

SEQ ID NO: 95262 - RNA, 21 nt, Human
cccaauccucugcuuuagaca

SEQ ID NO: 95263 - RNA, 23 nt, Human
cauuaaauuugguuuguuuugcu

SEQ ID NO: 95264 - RNA, 26 nt, Human
aaauaaauaaggccaugucugacuuc

SEQ ID NO: 95265 - RNA, 23 nt, Human
uaugcccacgcuggagugcagug

SEQ ID NO: 95266 - RNA, 29 nt, Human
gugguuuucugcaggaaaugggauggacc

SEQ ID NO: 95267 - RNA, 22 nt, Human
uagaggauuaguaagaucucuu

SEQ ID NO: 95268 - RNA, 25 nt, Human
uuccuuuggccgauaaucaggauuu

SEQ ID NO: 95269 - RNA, 19 nt, Human
cuccaaaugaugaguucua

SEQ ID NO: 95270 - RNA, 19 nt, Human
ccaggcuggagugcggugg

SEQ ID NO: 95271 - RNA, 21 nt, Human
gcagugagccaagaucgcacc

SEQ ID NO: 95272 - RNA, 21 nt, Human
ugagucuggcucugucaccca

SEQ ID NO: 95273 - RNA, 22 nt, Human
agcaggagaacaggcaagccaa

SEQ ID NO: 95274 - RNA, 24 nt, Human
uguggaauauuggggggcucggcu

SEQ ID NO: 95275 - RNA, 24 nt, Human
acucgaaagggaaggugcugacca

SEQ ID NO: 95276 - RNA, 22 nt, Human
gagagggaugcauggagauagc

SEQ ID NO: 95277 - RNA, 27 nt, Human
gaaugucaagaaaaggagucaagaaca

SEQ ID NO: 95278 - RNA, 22 nt, Human
ugcagauucagaguguccugaa

SEQ ID NO: 95279 - RNA, 24 nt, Human
ucugccuacccacgugccugcuua

SEQ ID NO: 95280 - RNA, 24 nt, Human
ccgucugccaacuccagcaucucu

SEQ ID NO: 95281 - RNA, 19 nt, Human
ggugaauuugaccucucug

SEQ ID NO: 95282 - RNA, 22 nt, Human
gaagguugagacaaaggggauc

SEQ ID NO: 95283 - RNA, 22 nt, Human
gcucuggggcuaccucagggcc

SEQ ID NO: 95284 - RNA, 26 nt, Human
ccaguauuguuauuauuccauuuauu

SEQ ID NO: 95285 - RNA, 27 nt, Human
aaguagcugggauuacaggcaccuacc

SEQ ID NO: 95286 - RNA, 27 nt, Human
uccuccaggaaaugaaucugcugccga

SEQ ID NO: 95287 - RNA, 27 nt, Human
caucuuuguaacuuccugugaauuuau

SEQ ID NO: 95288 - RNA, 27 nt, Human
uccugcagggaaaugcugccuagagcu

SEQ ID NO: 95289 - RNA, 20 nt, Human
ggauguuucugccacugcug

SEQ ID NO: 95290 - RNA, 19 nt, Human
acaaguguuguccuacaga

SEQ ID NO: 95291 - RNA, 21 nt, Human
ugguucuaagaaacccucugu

SEQ ID NO: 95292 - RNA, 27 nt, Human
uucuggugugauuuguaauguuucuua

SEQ ID NO: 95293 - RNA, 21 nt, Human
gggggcucaguucuggacugu

SEQ ID NO: 95294 - RNA, 21 nt, Human
agcuaauucaggucauuuugu

SEQ ID NO: 95295 - RNA, 21 nt, Human
uuccucuuggucucagcacug

SEQ ID NO: 95296 - RNA, 18 nt, Human
caccaauggauauacaaa

SEQ ID NO: 95297 - RNA, 26 nt, Human
acacauuuagaaacuaagcuauguua

SEQ ID NO: 95298 - RNA, 21 nt, Human
cugguggcagcgcagagccca

SEQ ID NO: 95299 - RNA, 17 nt, Human
accacacacacucagag

SEQ ID NO: 95300 - RNA, 21 nt, Human
aggaggcagagguugcagcga

SEQ ID NO: 95301 - RNA, 22 nt, Human
ugcaacaaaaagucauuuuucu

SEQ ID NO: 95302 - RNA, 20 nt, Human
uggaagccacggguacgguu

SEQ ID NO: 95303 - RNA, 20 nt, Human
uccccugggggcuagcagaa

SEQ ID NO: 95304 - RNA, 21 nt, Human
uuguucaaaguggaccccagg

SEQ ID NO: 95305 - RNA, 23 nt, Human
agagaggcaagcucaggagcagc

SEQ ID NO: 95306 - RNA, 19 nt, Human
uccagccugggugacagug

SEQ ID NO: 95307 - RNA, 22 nt, Human
caguucaguccacaggcaugga

SEQ ID NO: 95308 - RNA, 23 nt, Human
gguucuuggaaaagcagaaggaa

SEQ ID NO: 95309 - RNA, 20 nt, Human
uucuuucuguuuucuuuuac

SEQ ID NO: 95310 - RNA, 22 nt, Human
uacagcccuuuuuaggaaccca

SEQ ID NO: 95311 - RNA, 23 nt, Human
gaggagccggaccgauguggaaa

SEQ ID NO: 95312 - RNA, 27 nt, Human
gguguuuucacacgucuuuuuauaguu

SEQ ID NO: 95313 - RNA, 21 nt, Human
aagaacaucucgaauacaguu

SEQ ID NO: 95314 - RNA, 22 nt, Human
gcuggggucuuagcguccagcg

SEQ ID NO: 95315 - RNA, 22 nt, Human
caaugccaaauaaguacaguca

SEQ ID NO: 95316 - RNA, 22 nt, Human
caggcuggagugcagugaugcg

SEQ ID NO: 95317 - RNA, 22 nt, Human
caggcuggaaugcaguggugcg

SEQ ID NO: 95318 - RNA, 20 nt, Human
cuccugcccaugagcaccac

SEQ ID NO: 95319 - RNA, 19 nt, Human
accaccccaagugccguuu

SEQ ID NO: 95320 - RNA, 23 nt, Human
agcucaguauuuaaacaucaucu

SEQ ID NO: 95321 - RNA, 21 nt, Human
acacaggauccuggccugaga

SEQ ID NO: 95322 - RNA, 22 nt, Human
ggcugggcugccuucuucuaca

SEQ ID NO: 95323 - RNA, 24 nt, Human
agaaugcccuguucaugcugagca

SEQ ID NO: 95324 - RNA, 25 nt, Human
uauuaauaaaacuuuggaaauugcu

SEQ ID NO: 95325 - RNA, 21 nt, Human
gcucaugccuuaaucccagca

SEQ ID NO: 95326 - RNA, 25 nt, Human
ugugcagcaguguuuuugccccugc

SEQ ID NO: 95327 - RNA, 27 nt, Human
ugcuaccucuaauaguccugucuccca

SEQ ID NO: 95328 - RNA, 23 nt, Human
cccuccaggcagcccuuggcugg

SEQ ID NO: 95329 - RNA, 22 nt, Human
agcaggaggaucgcuugagccc

SEQ ID NO: 95330 - RNA, 22 nt, Human
ggcaggagaaucgcuugagccc

SEQ ID NO: 95331 - RNA, 28 nt, Human
ugcuuccaaaaauguuguuuguuugcaa

SEQ ID NO: 95332 - RNA, 27 nt, Human
agcagaauguaggagagggauucuucc

SEQ ID NO: 95333 - RNA, 21 nt, Human
uugcccaggauggucucgauc

SEQ ID NO: 95334 - RNA, 23 nt, Human
uagcuuauuuaaaaagcaccuua

SEQ ID NO: 95335 - RNA, 25 nt, Human
cccauccuucauuuuacucauauua

SEQ ID NO: 95336 - RNA, 22 nt, Human
cgccauugcacucccgccuggg

SEQ ID NO: 95337 - RNA, 21 nt, Human
ucauaccggcccuuccccucg

SEQ ID NO: 95338 - RNA, 27 nt, Human
gcaggaggccagugguggggacgcaga

SEQ ID NO: 95339 - RNA, 22 nt, Human
gcgccaggcuccugggaaagga

SEQ ID NO: 95340 - RNA, 22 nt, Human
ggaaccaaggccagugaauaag

SEQ ID NO: 95341 - RNA, 23 nt, Human
ugcaucuggcuacuuuuucaugu

SEQ ID NO: 95342 - RNA, 22 nt, Human
auugcccaggcuggagugcaau

SEQ ID NO: 95343 - RNA, 22 nt, Human
guugcccaagcuggagugcaau

SEQ ID NO: 95344 - RNA, 23 nt, Human
gguucuagguuugguucuugccu

SEQ ID NO: 95345 - RNA, 26 nt, Human
cuuccucugugcccccauagcacugu

SEQ ID NO: 95346 - RNA, 22 nt, Human
cgaacuccugaccuuaggugau

SEQ ID NO: 95347 - RNA, 26 nt, Human
uuucgagguggguuuguaccuuccuu

SEQ ID NO: 95348 - RNA, 20 nt, Human
uuccgcccuccuguccauca

SEQ ID NO: 95349 - RNA, 27 nt, Human
cucuccaggaucucugcugucucuugg

SEQ ID NO: 95350 - RNA, 19 nt, Human
ggucccucuucccuugaaa

SEQ ID NO: 95351 - RNA, 24 nt, Human
uggguggaaagcgguuuggaugaa

SEQ ID NO: 95352 - RNA, 23 nt, Human
aucaugaaaagaggaacaggugg

SEQ ID NO: 95353 - RNA, 22 nt, Human
cgggaggcagagggaguaguga

SEQ ID NO: 95354 - RNA, 28 nt, Human
cucaucauuucccaucuggaccugguac

SEQ ID NO: 95355 - RNA, 19 nt, Human
gucagggagaggaggcggc

SEQ ID NO: 95356 - RNA, 27 nt, Human
ccaagccccacacccgcagacccuccu

SEQ ID NO: 95357 - RNA, 19 nt, Human
gugggaaagagaaccaccc

SEQ ID NO: 95358 - RNA, 23 nt, Human
acugcuccugaggccaaauaaau

SEQ ID NO: 95359 - RNA, 20 nt, Human
cacugcugaggaaugauccu

SEQ ID NO: 95360 - RNA, 21 nt, Human
cgcggcggagguguaguuuga

SEQ ID NO: 95361 - RNA, 20 nt, Human
gcaggagaaaggaggguggu

SEQ ID NO: 95362 - RNA, 29 nt, Human
ccgcucgcucucccccucgagggacaaac

SEQ ID NO: 95363 - RNA, 26 nt, Human
ccgccuggcccuccccuaccaggcug

SEQ ID NO: 95364 - RNA, 26 nt, Human
agaugauguuuccagauuacacucca

SEQ ID NO: 95365 - RNA, 22 nt, Human
ccccgggugggugaaacucacu

SEQ ID NO: 95366 - RNA, 20 nt, Human
uauguauguacuuuaucaca

SEQ ID NO: 95367 - RNA, 25 nt, Human
ccucagccucggcccugcgcugcgc

SEQ ID NO: 95368 - RNA, 21 nt, Human
agguuaucaaaauuaaccuca

SEQ ID NO: 95369 - RNA, 24 nt, Human
acagaaccagugacuuugcugcua

SEQ ID NO: 95370 - RNA, 20 nt, Human
uaaagggaaauugagcugcu

SEQ ID NO: 95371 - RNA, 26 nt, Human
aaaccagcacagggaacuuagguuag

SEQ ID NO: 95372 - RNA, 23 nt, Human
cgcccggcgccuggccuccaggc

SEQ ID NO: 95373 - RNA, 25 nt, Human
guugcccaggcuggucuugaacucc

SEQ ID NO: 95374 - RNA, 22 nt, Human
ucucuccugggucccaggaucg

SEQ ID NO: 95375 - RNA, 24 nt, Human
cuccaaauaaacauggacuuuuac

SEQ ID NO: 95376 - RNA, 17 nt, Human
aggagggagagugcagc

SEQ ID NO: 95377 - RNA, 20 nt, Human
cugccuccccuucucccugc

SEQ ID NO: 95378 - RNA, 20 nt, Human
gaaucuucuucuuggcagcu

SEQ ID NO: 95379 - RNA, 21 nt, Human
aaauggagucauuugagucuc

SEQ ID NO: 95380 - RNA, 23 nt, Human
ggggguauuugacauauuuuaca

SEQ ID NO: 95381 - RNA, 22 nt, Human
uagaauugucucucaacucugc

SEQ ID NO: 95382 - RNA, 20 nt, Human
ugcuuugugaaaugugcaaa

SEQ ID NO: 95383 - RNA, 19 nt, Human
uccucccaggccucccucc

SEQ ID NO: 95384 - RNA, 23 nt, Human
guccuguccugguccugaugccc

SEQ ID NO: 95385 - RNA, 22 nt, Human
ccuccagccugggugacagagu

SEQ ID NO: 95386 - RNA, 22 nt, Human
agacuucuaggaggaugcugug

SEQ ID NO: 95387 - RNA, 27 nt, Human
ccagucagcugacuuccucgugcaaug

SEQ ID NO: 95388 - RNA, 20 nt, Human
ccucucuccccuuggcgucu

SEQ ID NO: 95389 - RNA, 22 nt, Human
guggucaagcccuugcccagag

SEQ ID NO: 95390 - RNA, 24 nt, Human
uaagaucccucacaggacccagaa

SEQ ID NO: 95391 - RNA, 20 nt, Human
ugcccccuuucuggcucuca

SEQ ID NO: 95392 - RNA, 19 nt, Human
aagauggagacaccucugg

SEQ ID NO: 95393 - RNA, 22 nt, Human
caguauuuccacuuguucucag

SEQ ID NO: 95394 - RNA, 27 nt, Human
caguguugcaguccggcucacugcagu

SEQ ID NO: 95395 - RNA, 30 nt, Human
cccuaacauccucagagaaccuucguuucu

SEQ ID NO: 95396 - RNA, 20 nt, Human
ccuuacuccaaugauggccc

SEQ ID NO: 95397 - RNA, 26 nt, Human
uggagccgggggaaggguggggaggg

SEQ ID NO: 95398 - RNA, 22 nt, Human
ucucuuucgcaccugccucuca

SEQ ID NO: 95399 - RNA, 21 nt, Human
guuguugccaguuucuguauu

SEQ ID NO: 95400 - RNA, 21 nt, Human
cugacuauaaguucucagccu

SEQ ID NO: 95401 - RNA, 30 nt, Human
cuucuccgguagccucucccaccuaaccuc

SEQ ID NO: 95402 - RNA, 21 nt, Human
uagaaggccucggccucucug

SEQ ID NO: 95403 - RNA, 24 nt, Human
ccucugacccacccauggugccag

SEQ ID NO: 95404 - RNA, 23 nt, Human
uagaggacaagaaacaaucugua

SEQ ID NO: 95405 - RNA, 20 nt, Human
cagaaauuauuuuuugcacu

SEQ ID NO: 95406 - RNA, 24 nt, Human
agauucucuccucucccaucccag

SEQ ID NO: 95407 - RNA, 21 nt, Human
gccuguaaucccagcaauuug

SEQ ID NO: 95408 - RNA, 19 nt, Human
uguuuaaaaacccuuccug

SEQ ID NO: 95409 - RNA, 20 nt, Human
ggagccgcuguugccuccca

SEQ ID NO: 95410 - RNA, 25 nt, Human
gcucacgagguacaaggaagcacaa

SEQ ID NO: 95411 - RNA, 22 nt, Human
gcuccucagaauugaagaggag

SEQ ID NO: 95412 - RNA, 26 nt, Human
agcuggagaguaaggcuguaggaucu

SEQ ID NO: 95413 - RNA, 24 nt, Human
ggcuuauuuacugaauaaauacaa

SEQ ID NO: 95414 - RNA, 22 nt, Human
agauggucagcguggagcgcaa

SEQ ID NO: 95415 - RNA, 18 nt, Human
cuggcccacagagagagu

SEQ ID NO: 95416 - RNA, 20 nt, Human
uuuguagacucucccugaua

SEQ ID NO: 95417 - RNA, 20 nt, Human
ggaggcggagauugcaguga

SEQ ID NO: 95418 - RNA, 24 nt, Human
uccucuagggacucuucagucuca

SEQ ID NO: 95419 - RNA, 18 nt, Human
gcccagccugccuguccu

SEQ ID NO: 95420 - RNA, 27 nt, Human
gucccuuaaggcacagugggagcugag

SEQ ID NO: 95421 - RNA, 25 nt, Human
auuuuccucucccugcauuguuuuu

SEQ ID NO: 95422 - RNA, 18 nt, Human
ccagcugcuggagauaug

SEQ ID NO: 95423 - RNA, 27 nt, Human
uuuucacugcuaggacaagcucagcug

SEQ ID NO: 95424 - RNA, 25 nt, Human
gcagcucagccccugcagucaucuc

SEQ ID NO: 95425 - RNA, 20 nt, Human
caccagacuuggccuccagc

SEQ ID NO: 95426 - RNA, 25 nt, Human
gugcgguuaccucuuucacagcccu

SEQ ID NO: 95427 - RNA, 23 nt, Human
aacaucugcuuugcugccgagcc

SEQ ID NO: 95428 - RNA, 19 nt, Human
agagacaccucugucucug

SEQ ID NO: 95429 - RNA, 20 nt, Human
ucucacuuccuucuucugga

SEQ ID NO: 95430 - RNA, 22 nt, Human
cucuccucucucuuccaacaca

SEQ ID NO: 95431 - RNA, 25 nt, Human
ccaggaggagaccagguugcagugg

SEQ ID NO: 95432 - RNA, 20 nt, Human
ggcgugcuguuuucuaccuc

SEQ ID NO: 95433 - RNA, 27 nt, Human
agagagggaagaaaagaucuuuugccc

SEQ ID NO: 95434 - RNA, 30 nt, Human
ccagccugaccaacauggagauauccuguc

SEQ ID NO: 95435 - RNA, 22 nt, Human
uccggaacgggaggcugaaaug

SEQ ID NO: 95436 - RNA, 19 nt, Human
ccauagcacacacauacac

SEQ ID NO: 95437 - RNA, 20 nt, Human
uauucuaccacuugcacuua

SEQ ID NO: 95438 - RNA, 26 nt, Human
ccucgccauagaguuccagacauauu

SEQ ID NO: 95439 - RNA, 23 nt, Human
agcaggagaauggcccaaaccug

SEQ ID NO: 95440 - RNA, 20 nt, Human
acucuuguugcccaggcugg

SEQ ID NO: 95441 - RNA, 24 nt, Human
ucugcuuugucuguguuuugaguc

SEQ ID NO: 95442 - RNA, 22 nt, Human
gugugagccacagugcccagcu

SEQ ID NO: 95443 - RNA, 22 nt, Human
uccuggauggaggcuugagggc

SEQ ID NO: 95444 - RNA, 25 nt, Human
gaucauaaauuaugcauaucuauga

SEQ ID NO: 95445 - RNA, 23 nt, Human
uguugugcaggcuggagugcagu

SEQ ID NO: 95446 - RNA, 24 nt, Human
aagccuccucuggagaaucuuaca

SEQ ID NO: 95447 - RNA, 22 nt, Human
cucuaguauaagugaauuacua

SEQ ID NO: 95448 - RNA, 22 nt, Human
cagggugugagguuucaccucc

SEQ ID NO: 95449 - RNA, 26 nt, Human
gaucuccagcccaagaugauuccagc

SEQ ID NO: 95450 - RNA, 26 nt, Human
uccucuuggagccucaguuuccucau

SEQ ID NO: 95451 - RNA, 27 nt, Human
ccugguauggacggaugcgcaggauuu

SEQ ID NO: 95452 - RNA, 22 nt, Human
guaagcaacuagcugggcacag

SEQ ID NO: 95453 - RNA, 22 nt, Human
aagaaaacugcugcuuucagca

SEQ ID NO: 95454 - RNA, 21 nt, Human
gcaaagauuuuuggcacuuug

SEQ ID NO: 95455 - RNA, 31 nt, Human
uggcuuggccaggcaggaugggcuguguccg

SEQ ID NO: 95456 - RNA, 21 nt, Human
uuucugauguguuccaugaga

SEQ ID NO: 95457 - RNA, 23 nt, Human
aagcagucaaguagaugauuuaa

SEQ ID NO: 95458 - RNA, 21 nt, Human
gaucauuuucuuaucuucugc

SEQ ID NO: 95459 - RNA, 24 nt, Human
ugggcagcagcagggaucuggugg

SEQ ID NO: 95460 - RNA, 20 nt, Human
ugcgaggcccaggccugugg

SEQ ID NO: 95461 - RNA, 26 nt, Human
guauuuuuauauauguguucauauau

SEQ ID NO: 95462 - RNA, 21 nt, Human
gugggguggaaauaggguggg

SEQ ID NO: 95463 - RNA, 27 nt, Human
ccaggcuggucuuaagcucaagcgauc

SEQ ID NO: 95464 - RNA, 22 nt, Human
gaguuccccguggacagagcca

SEQ ID NO: 95465 - RNA, 20 nt, Human
agugacuguuguagcauuuu

SEQ ID NO: 95466 - RNA, 20 nt, Human
cgggagcagagguucuauga

SEQ ID NO: 95467 - RNA, 19 nt, Human
cacuuccuggggagcuaca

SEQ ID NO: 95468 - RNA, 25 nt, Human
ucaaggaguauuuauuaauggcugc

SEQ ID NO: 95469 - RNA, 20 nt, Human
cacuccucaccccagcucaa

SEQ ID NO: 95470 - RNA, 22 nt, Human
aaagugcugggauugugggcau

SEQ ID NO: 95471 - RNA, 25 nt, Human
cucccagggucucccuaucuugauc

SEQ ID NO: 95472 - RNA, 26 nt, Human
agucuuuuuauaauuuggauuguauc

SEQ ID NO: 95473 - RNA, 27 nt, Human
aaauguucuuagaggaccagccuccug

SEQ ID NO: 95474 - RNA, 27 nt, Human
uucuccuccucugucuuuuggagaacc

SEQ ID NO: 95475 - RNA, 18 nt, Human
aggagacacucagaugcu

SEQ ID NO: 95476 - RNA, 27 nt, Human
agguccccaggagcugcugcuggcgag

SEQ ID NO: 95477 - RNA, 22 nt, Human
uauuugauacugugcuugcugu

SEQ ID NO: 95478 - RNA, 29 nt, Human
gagggagggagaauaagucagucaugcau

SEQ ID NO: 95479 - RNA, 19 nt, Human
uggacagucugcucuagau

SEQ ID NO: 95480 - RNA, 27 nt, Human
ucaucauuacuguggacauggcaguug

SEQ ID NO: 95481 - RNA, 22 nt, Human
ggcagggggagaaugggaggcu

SEQ ID NO: 95482 - RNA, 22 nt, Human
ggcggggauccuggugccaggu

SEQ ID NO: 95483 - RNA, 22 nt, Human
uagguaggaggggagcagagga

SEQ ID NO: 95484 - RNA, 27 nt, Human
ccagaaacaucucuggcccagaaagcc

SEQ ID NO: 95485 - RNA, 21 nt, Human
cacccuucccuggaaucugcu

SEQ ID NO: 95486 - RNA, 22 nt, Human
ggcuucgccgggauccucuugg

SEQ ID NO: 95487 - RNA, 31 nt, Human
ggucuugaacuccugaccuugugauccgcuc

SEQ ID NO: 95488 - RNA, 19 nt, Human
guucugccuccauccccau

SEQ ID NO: 95489 - RNA, 26 nt, Human
ucuuucucccccaccucuugcgagau

SEQ ID NO: 95490 - RNA, 26 nt, Human
auugguuuguuuguuuuuaacuguag

SEQ ID NO: 95491 - RNA, 24 nt, Human
ugauagugaacauuuugagauugg

SEQ ID NO: 95492 - RNA, 23 nt, Human
uucccugcuguguugcugcccag

SEQ ID NO: 95493 - RNA, 28 nt, Human
gcuuucccucucugggccucagucuguu

SEQ ID NO: 95494 - RNA, 21 nt, Human
ccaaggagggggaucgcuuga

SEQ ID NO: 95495 - RNA, 21 nt, Human
uaaaagcuacagaaccaggcc

SEQ ID NO: 95496 - RNA, 21 nt, Human
ggcaaagcauuuugauggaau

SEQ ID NO: 95497 - RNA, 27 nt, Human
uuaccucuucguuugcucaaacaugag

SEQ ID NO: 95498 - RNA, 22 nt, Human
caggcuggaauccaagaguggg

SEQ ID NO: 95499 - RNA, 20 nt, Human
aaguaugaagcagcuguuac

SEQ ID NO: 95500 - RNA, 22 nt, Human
ggguuguuggccagacaagucc

SEQ ID NO: 95501 - RNA, 26 nt, Human
gcgggaggggaggaagaagaguguuu

SEQ ID NO: 95502 - RNA, 23 nt, Human
caggaggugggcuggcgcggagg

SEQ ID NO: 95503 - RNA, 21 nt, Human
cagacaccgugugaggggaca

SEQ ID NO: 95504 - RNA, 22 nt, Human
ccuccucugcuggcuuaggguc

SEQ ID NO: 95505 - RNA, 21 nt, Human
cgcuggguauuaccauguaaa

SEQ ID NO: 95506 - RNA, 27 nt, Human
gaggaagaugugugaguuaaggccuga

SEQ ID NO: 95507 - RNA, 25 nt, Human
gcccaggcuggagugcaauggcacg

SEQ ID NO: 95508 - RNA, 24 nt, Human
uucagucuugacggugaauggaag

SEQ ID NO: 95509 - RNA, 20 nt, Human
ucaucaggccgggugcagug

SEQ ID NO: 95510 - RNA, 22 nt, Human
uacuaucacagguuccagggag

SEQ ID NO: 95511 - RNA, 22 nt, Human
gugggugaugcuuuugcugcug

SEQ ID NO: 95512 - RNA, 27 nt, Human
uuuuuauuuucuuuuguaaauguuuag

SEQ ID NO: 95513 - RNA, 21 nt, Human
aaauguucucgacagcaaguu

SEQ ID NO: 95514 - RNA, 21 nt, Human
cugacuagcugugccacucug

SEQ ID NO: 95515 - RNA, 20 nt, Human
ggcagggucaggagaggggc

SEQ ID NO: 95516 - RNA, 23 nt, Human
cauacuccacgcucccccagcgu

SEQ ID NO: 95517 - RNA, 23 nt, Human
ccagaaauuauggaaacaggguc

SEQ ID NO: 95518 - RNA, 23 nt, Human
uaaaaguuuugauauuuauuuuu

SEQ ID NO: 95519 - RNA, 29 nt, Human
ugcuguuuuccuaugucauuucugcuuca

SEQ ID NO: 95520 - RNA, 22 nt, Human
ccugucuguagugccugcuguu

SEQ ID NO: 95521 - RNA, 19 nt, Human
ccagugucugcuauuuuga

SEQ ID NO: 95522 - RNA, 23 nt, Human
ggguuacaccugcuccuuccugg

SEQ ID NO: 95523 - RNA, 20 nt, Human
gggaguaugcuggaggcaga

SEQ ID NO: 95524 - RNA, 24 nt, Human
aguggcuggcccugcuggcccugc

SEQ ID NO: 95525 - RNA, 24 nt, Human
gcaagggcugccaugggauacagc

SEQ ID NO: 95526 - RNA, 27 nt, Human
gcucugucaccuaggcuggagugcagu

SEQ ID NO: 95527 - RNA, 23 nt, Human
gauuucuccuuguuuuugugagu

SEQ ID NO: 95528 - RNA, 27 nt, Human
gagccucaauuuugguuuuucucauuu

SEQ ID NO: 95529 - RNA, 27 nt, Human
cucucgccuccuccuccugggaagaag

SEQ ID NO: 95530 - RNA, 21 nt, Human
gggaggcggccggggcagggg

SEQ ID NO: 95531 - RNA, 20 nt, Human
gcaguucuggugaauguuca

SEQ ID NO: 95532 - RNA, 19 nt, Human
gcgagugaauguguuccug

SEQ ID NO: 95533 - RNA, 18 nt, Human
cugagcaaugacuguguu

SEQ ID NO: 95534 - RNA, 20 nt, Human
uaaagacugauaugaaucag

SEQ ID NO: 95535 - RNA, 27 nt, Human
gcucaaaucucuguuacuccauuacug

SEQ ID NO: 95536 - RNA, 22 nt, Human
gcacgcaucuguaguuccagcu

SEQ ID NO: 95537 - RNA, 18 nt, Human
ggugaagacccagaggaa

SEQ ID NO: 95538 - RNA, 22 nt, Human
uuuggacgggauuuuagguuuc

SEQ ID NO: 95539 - RNA, 23 nt, Human
cacacacaaacgccuucuucccg

SEQ ID NO: 95540 - RNA, 22 nt, Human
cucugucucaguuuaccgaccu

SEQ ID NO: 95541 - RNA, 25 nt, Human
gucuccucccugggcuaagcagggg

SEQ ID NO: 95542 - RNA, 22 nt, Human
ccgcgguugccucuuggugcug

SEQ ID NO: 95543 - RNA, 24 nt, Human
ccucuaucugcuaccaucuguguu

SEQ ID NO: 95544 - RNA, 23 nt, Human
acaggguagggaaaucuccauac

SEQ ID NO: 95545 - RNA, 23 nt, Human
aaaauugaaaaagaauucucagu

SEQ ID NO: 95546 - RNA, 22 nt, Human
uccucuuggagcugagaugagc

SEQ ID NO: 95547 - RNA, 22 nt, Human
cacugcacuccagccugggaga

SEQ ID NO: 95548 - RNA, 22 nt, Human
cacugcacuccaaccugggaaa

SEQ ID NO: 95549 - RNA, 24 nt, Human
ggccgaaguauugcgaagcauuug

SEQ ID NO: 95550 - RNA, 20 nt, Human
gaggugaggucgagagccag

SEQ ID NO: 95551 - RNA, 27 nt, Human
caugcuuauuucaaacguccaguguug

SEQ ID NO: 95552 - RNA, 22 nt, Human
caggggcuucuuucuuuucgaa

SEQ ID NO: 95553 - RNA, 28 nt, Human
gucuguggaacuccugacgucugaagcu

SEQ ID NO: 95554 - RNA, 22 nt, Human
ugcaaacuuucuucaacuuucc

SEQ ID NO: 95555 - RNA, 19 nt, Human
guccaguuuucucucuucc

SEQ ID NO: 95556 - RNA, 23 nt, Human
gaaggcugaguccacacugcaag

SEQ ID NO: 95557 - RNA, 22 nt, Human
aaagucaggaaaagucuuggcu

SEQ ID NO: 95558 - RNA, 23 nt, Human
agaugucccuucuauucagauuu

SEQ ID NO: 95559 - RNA, 20 nt, Human
cuccgaucuucaucuugaag

SEQ ID NO: 95560 - RNA, 22 nt, Human
gugaucaugguccagucuucgg

SEQ ID NO: 95561 - RNA, 19 nt, Human
cuacaguuccuucucucca

SEQ ID NO: 95562 - RNA, 20 nt, Human
aaucauuuguauuucuugaa

SEQ ID NO: 95563 - RNA, 21 nt, Human
ugcucccugauuaaaaugaga

SEQ ID NO: 95564 - RNA, 22 nt, Human
cuccacugggggcuuacgggag

SEQ ID NO: 95565 - RNA, 22 nt, Human
gcacaggcuggagugcaguggc

SEQ ID NO: 95566 - RNA, 24 nt, Human
ccccacugccagccugagugggca

SEQ ID NO: 95567 - RNA, 18 nt, Human
agcgggaaaugugugaga

SEQ ID NO: 95568 - RNA, 20 nt, Human
cuggugaaguggcccaggga

SEQ ID NO: 95569 - RNA, 22 nt, Human
agaccagccagggcaacaugau

SEQ ID NO: 95570 - RNA, 21 nt, Human
gcagccuggcaacggcggugg

SEQ ID NO: 95571 - RNA, 24 nt, Human
uuuggcuuccuuuuguaugauagg

SEQ ID NO: 95572 - RNA, 24 nt, Human
gccucaguggagcugugguucucu

SEQ ID NO: 95573 - RNA, 18 nt, Human
uguuugucacugccaaag

SEQ ID NO: 95574 - RNA, 21 nt, Human
ugcaaaaacuacaaccaaugg

SEQ ID NO: 95575 - RNA, 27 nt, Human
ucugcagcuccacguggaauccaggug

SEQ ID NO: 95576 - RNA, 19 nt, Human
uggcuucucccuuaagaag

SEQ ID NO: 95577 - RNA, 21 nt, Human
uugcaacuacagcuggguuau

SEQ ID NO: 95578 - RNA, 20 nt, Human
cccuacugcugguuucugcc

SEQ ID NO: 95579 - RNA, 21 nt, Human
guuuaugggcauccucucugg

SEQ ID NO: 95580 - RNA, 21 nt, Human
cugggcuugugcuguucuugg

SEQ ID NO: 95581 - RNA, 18 nt, Human
acagauugaucaucugcc

SEQ ID NO: 95582 - RNA, 26 nt, Human
cggggcugcaagagccgggccuggcc

SEQ ID NO: 95583 - RNA, 23 nt, Human
augguggaguguagccuccaccu

SEQ ID NO: 95584 - RNA, 21 nt, Human
ggcauacaacccucugcuuuc

SEQ ID NO: 95585 - RNA, 22 nt, Human
aacaaccuccuucuuaucugug

SEQ ID NO: 95586 - RNA, 24 nt, Human
accaaaguaacugaauuauuucag

SEQ ID NO: 95587 - RNA, 23 nt, Human
gccaucugcagccaggugugugc

SEQ ID NO: 95588 - RNA, 21 nt, Human
gaucuagcccaucuuacucca

SEQ ID NO: 95589 - RNA, 24 nt, Human
gcaggguggagagggcggugggag

SEQ ID NO: 95590 - RNA, 22 nt, Human
caguugaaguguuuugaugugc

SEQ ID NO: 95591 - RNA, 20 nt, Human
ccaacuugugacugcucacu

SEQ ID NO: 95592 - RNA, 27 nt, Human
cuguucccagcuccagcucuaaccucg

SEQ ID NO: 95593 - RNA, 21 nt, Human
gcgacccuuuucaguucggca

SEQ ID NO: 95594 - RNA, 28 nt, Human
ccugauuccuuucugccugcagggggcu

SEQ ID NO: 95595 - RNA, 27 nt, Human
caggcuggagugcaaugccgugaucuc

SEQ ID NO: 95596 - RNA, 20 nt, Human
auagccugaauguucgcuuu

SEQ ID NO: 95597 - RNA, 19 nt, Human
cugccggcuggagggaggu

SEQ ID NO: 95598 - RNA, 21 nt, Human
ggaccugcccuacacacucag

SEQ ID NO: 95599 - RNA, 27 nt, Human
cccugcagccgggcccagcucuucugu

SEQ ID NO: 95600 - RNA, 27 nt, Human
caggcuggaauguaguggagagaucau

SEQ ID NO: 95601 - RNA, 27 nt, Human
gaggcucccagagcagccucugucacc

SEQ ID NO: 95602 - RNA, 24 nt, Human
gcagggagagaggaggccggaaga

SEQ ID NO: 95603 - RNA, 21 nt, Human
uucucuuuauaaaugcauguc

SEQ ID NO: 95604 - RNA, 21 nt, Human
cugccaccacggcugggacac

SEQ ID NO: 95605 - RNA, 26 nt, Human
ucugcagccaucagcaaggaggacca

SEQ ID NO: 95606 - RNA, 23 nt, Human
ccaggggcucuguggcaaaaaga

SEQ ID NO: 95607 - RNA, 27 nt, Human
agcucugucauaaucugcaucuuccca

SEQ ID NO: 95608 - RNA, 24 nt, Human
uucucagggcuggagccuggggug

SEQ ID NO: 95609 - RNA, 21 nt, Human
ccccaacuucauuugcuucuc

SEQ ID NO: 95610 - RNA, 24 nt, Human
ggagaggggcccugcuucccacac

SEQ ID NO: 95611 - RNA, 20 nt, Human
uacucagauaagaggcucca

SEQ ID NO: 95612 - RNA, 22 nt, Human
uuuccuucaaucuaccuagcau

SEQ ID NO: 95613 - RNA, 22 nt, Human
ugacuucugucuaggcucaugg

SEQ ID NO: 95614 - RNA, 22 nt, Human
acuccucuuuuccacugugaga

SEQ ID NO: 95615 - RNA, 26 nt, Human
agagugagcaagggggcccgaaucga

SEQ ID NO: 95616 - RNA, 27 nt, Human
aaauguucacuggcauuuugaaggcau

SEQ ID NO: 95617 - RNA, 22 nt, Human
auuuuuccuuaggauacacauc

SEQ ID NO: 95618 - RNA, 20 nt, Human
ccaucagagucuagaggaua

SEQ ID NO: 95619 - RNA, 22 nt, Human
accuuauuaacucacagcaggc

SEQ ID NO: 95620 - RNA, 21 nt, Human
acccuacagccugcucucuca

SEQ ID NO: 95621 - RNA, 28 nt, Human
ucucgaauuccugaccucaggugaucca

SEQ ID NO: 95622 - RNA, 21 nt, Human
gcauucucuauagccucugca

SEQ ID NO: 95623 - RNA, 21 nt, Human
accauaaaacgcuaugcagaa

SEQ ID NO: 95624 - RNA, 21 nt, Human
agcggggacaccaauggcugc

SEQ ID NO: 95625 - RNA, 23 nt, Human
cuacagacaugcagaacaugcac

SEQ ID NO: 95626 - RNA, 21 nt, Human
acugcacuuucugaccaggag

SEQ ID NO: 95627 - RNA, 23 nt, Human
uuugacuuuuccuuucuuuuuug

SEQ ID NO: 95628 - RNA, 26 nt, Human
agugaucgccuccaacagcaucaucu

SEQ ID NO: 95629 - RNA, 29 nt, Human
acccugcccuuccucuuugaauucuuccg

SEQ ID NO: 95630 - RNA, 18 nt, Human
ccugccugccaucgcugu

SEQ ID NO: 95631 - RNA, 23 nt, Human
cagcagcugcuccuaaaccaguc

SEQ ID NO: 95632 - RNA, 22 nt, Human
cuggguggaggggcagggaggc

SEQ ID NO: 95633 - RNA, 23 nt, Human
acaacugaguccuuaaacagggc

SEQ ID NO: 95634 - RNA, 23 nt, Human
cagcauucacucucccugucuuu

SEQ ID NO: 95635 - RNA, 24 nt, Human
ggggcagcucuggaggggguuugc

SEQ ID NO: 95636 - RNA, 21 nt, Human
aaaccccagggcagggaaacu

SEQ ID NO: 95637 - RNA, 22 nt, Human
gagggagcagagauacccauac

SEQ ID NO: 95638 - RNA, 26 nt, Human
cuccccucaccaggagaggcaccugc

SEQ ID NO: 95639 - RNA, 25 nt, Human
cugcccaggcugugcagcgcagcug

SEQ ID NO: 95640 - RNA, 23 nt, Human
aucauucuuccccuccuccagcu

SEQ ID NO: 95641 - RNA, 22 nt, Human
ucugacauccugcaguccccac

SEQ ID NO: 95642 - RNA, 20 nt, Human
uacuuaaacagaaagcaauu

SEQ ID NO: 95643 - RNA, 23 nt, Human
cgcacacgcacacacccgccgcg

SEQ ID NO: 95644 - RNA, 21 nt, Human
uuguugcccaggcuagagugc

SEQ ID NO: 95645 - RNA, 18 nt, Human
auuacaguggaaugagua

SEQ ID NO: 95646 - RNA, 27 nt, Human
agcaagauggagcaauggagagaagac

SEQ ID NO: 95647 - RNA, 20 nt, Human
acauaaauuagaggucucca

SEQ ID NO: 95648 - RNA, 21 nt, Human
uuacaacuagcauugccucaa

SEQ ID NO: 95649 - RNA, 18 nt, Human
cucaccccacccccaccu

SEQ ID NO: 95650 - RNA, 25 nt, Human
ggggguuggagguggggacucugga

SEQ ID NO: 95651 - RNA, 20 nt, Human
gugcagccacacccugcccu

SEQ ID NO: 95652 - RNA, 27 nt, Human
uccggcgcagucuucaaugagcagcgc

SEQ ID NO: 95653 - RNA, 26 nt, Human
gaggcagaugaucauggucugccuca

SEQ ID NO: 95654 - RNA, 24 nt, Human
ccggagcucagcagacaccaggcc

SEQ ID NO: 95655 - RNA, 26 nt, Human
gcuuguggaaaccagcagguaaaaug

SEQ ID NO: 95656 - RNA, 23 nt, Human
aggaccaccugcaaaagccaggg

SEQ ID NO: 95657 - RNA, 21 nt, Human
gguagaccaggauuucuaauc

SEQ ID NO: 95658 - RNA, 25 nt, Human
uagagguuaauuuaaucaaaaugag

SEQ ID NO: 95659 - RNA, 23 nt, Human
agagagggagagugggcccuggc

SEQ ID NO: 95660 - RNA, 22 nt, Human
acuggucucgaacuccugggcu

SEQ ID NO: 95661 - RNA, 19 nt, Human
guggccucuccuuguggcc

SEQ ID NO: 95662 - RNA, 21 nt, Human
caccuccuggguucaagcgau

SEQ ID NO: 95663 - RNA, 19 nt, Human
gcugguuccucugccugug

SEQ ID NO: 95664 - RNA, 21 nt, Human
cgugaagccgcgcucuguuuu

SEQ ID NO: 95665 - RNA, 22 nt, Human
cuggacgcagaggugacagugg

SEQ ID NO: 95666 - RNA, 22 nt, Human
uugccucaugggcagggccaca

SEQ ID NO: 95667 - RNA, 22 nt, Human
ucuccaccaucccuagcaugcc

SEQ ID NO: 95668 - RNA, 21 nt, Human
aguguucagaacaacugcaaa

SEQ ID NO: 95669 - RNA, 24 nt, Human
uuuuaauaaaacgccaaaaauauc

SEQ ID NO: 95670 - RNA, 22 nt, Human
gggauuacaggugggagccaca

SEQ ID NO: 95671 - RNA, 22 nt, Human
guucacugcaaccuccgccucu

SEQ ID NO: 95672 - RNA, 21 nt, Human
gccguucaguucuccugggcu

SEQ ID NO: 95673 - RNA, 19 nt, Human
ugcaccuguaaagugccuu

SEQ ID NO: 95674 - RNA, 24 nt, Human
ucgccaaguuggagcuugcaguga

SEQ ID NO: 95675 - RNA, 27 nt, Human
cccuccgucucucggguucaagcaauu

SEQ ID NO: 95676 - RNA, 22 nt, Human
cgccaggcuggagugcaguggc

SEQ ID NO: 95677 - RNA, 20 nt, Human
gccacaggaacaucauuccu

SEQ ID NO: 95678 - RNA, 27 nt, Human
caggcagcagaggcgacugcggacagc

SEQ ID NO: 95679 - RNA, 24 nt, Human
gcagaugcuucuaauaaaaggcuc

SEQ ID NO: 95680 - RNA, 21 nt, Human
uuuaaauauacaauucaguga

SEQ ID NO: 95681 - RNA, 28 nt, Human
ccugccugcugccucagucugcaaccua

SEQ ID NO: 95682 - RNA, 23 nt, Human
ccauugauaucucccagagguac

SEQ ID NO: 95683 - RNA, 22 nt, Human
ccagcauggugaaaccccgucu

SEQ ID NO: 95684 - RNA, 22 nt, Human
ccaacauggcggaacccugucu

SEQ ID NO: 95685 - RNA, 22 nt, Human
agaccagccugggcaacacagu

SEQ ID NO: 95686 - RNA, 24 nt, Human
gggggaugucaauauugcauaccu

SEQ ID NO: 95687 - RNA, 22 nt, Human
aaggcggcacuucuggccaggu

SEQ ID NO: 95688 - RNA, 21 nt, Human
gucacggcaaaggaagacgug

SEQ ID NO: 95689 - RNA, 21 nt, Human
aggaggcagagguugcaauga

SEQ ID NO: 95690 - RNA, 22 nt, Human
cccaaagugccaggauuacagg

SEQ ID NO: 95691 - RNA, 21 nt, Human
agcucacugcaaccuccgcau

SEQ ID NO: 95692 - RNA, 21 nt, Human
agcucacugcacccuccgccu

SEQ ID NO: 95693 - RNA, 22 nt, Human
agaagcugauaaaaaagcuuug

SEQ ID NO: 95694 - RNA, 22 nt, Human
uggccaacaugaugaaacccua

SEQ ID NO: 95695 - RNA, 22 nt, Human
cugaggcacaagaaucgcuuga

SEQ ID NO: 95696 - RNA, 25 nt, Human
gcagccgccuacaccaaggcaacag

SEQ ID NO: 95697 - RNA, 21 nt, Human
cacauuuacacauccacacac

SEQ ID NO: 95698 - RNA, 27 nt, Human
ugggaggcggagguugcggucagcuga

SEQ ID NO: 95699 - RNA, 20 nt, Human
ugugugaccaucagcagugg

SEQ ID NO: 95700 - RNA, 19 nt, Human
gucagagagucccuucuga

SEQ ID NO: 95701 - RNA, 23 nt, Human
gccuguaauucaguguauuucag

SEQ ID NO: 95702 - RNA, 23 nt, Human
ggcaggagaaucacuggaaccug

SEQ ID NO: 95703 - RNA, 20 nt, Human
aaggaagagagugcauggca

SEQ ID NO: 95704 - RNA, 26 nt, Human
ggagaggggcgcagcuaagacugggg

SEQ ID NO: 95705 - RNA, 22 nt, Human
ccaagaucgcgccccugcacuc

SEQ ID NO: 95706 - RNA, 22 nt, Human
ugcagugagccaugacugugcc

SEQ ID NO: 95707 - RNA, 18 nt, Human
ggagccugucccaaaaag

SEQ ID NO: 95708 - RNA, 22 nt, Human
cuguuccuuuggcuuucucuug

SEQ ID NO: 95709 - RNA, 22 nt, Human
aaagacucuucacuccaaaaag

SEQ ID NO: 95710 - RNA, 19 nt, Human
caggcagcggucccagagc

SEQ ID NO: 95711 - RNA, 17 nt, Human
agguaaaauauuuucca

SEQ ID NO: 95712 - RNA, 24 nt, Human
gcuaccucuaggugaaaugagcgg

SEQ ID NO: 95713 - RNA, 21 nt, Human
cuuccguggguuuguuccugg

SEQ ID NO: 95714 - RNA, 30 nt, Human
agcuucgguggggguggagugagggcugug

SEQ ID NO: 95715 - RNA, 23 nt, Human
ugccuguaaucccagcuacuagg

SEQ ID NO: 95716 - RNA, 27 nt, Human
uuaccuuucuuuuuuaggucaaucaag

SEQ ID NO: 95717 - RNA, 28 nt, Human
gggcaggggcaggggcagcucuccuuua

SEQ ID NO: 95718 - RNA, 23 nt, Human
augcaguuaccugugccuuuuuc

SEQ ID NO: 95719 - RNA, 22 nt, Human
acgaucgcggcucacugcaacc

SEQ ID NO: 95720 - RNA, 20 nt, Human
uaacugcauuagaaaccaug

SEQ ID NO: 95721 - RNA, 22 nt, Human
agauagcuucagcagaugugau

SEQ ID NO: 95722 - RNA, 22 nt, Human
ucuggccaggcccugcuuaggc

SEQ ID NO: 95723 - RNA, 21 nt, Human
guugccucucuugccccuugu

SEQ ID NO: 95724 - RNA, 21 nt, Human
gcagaccucuucaagugacac

SEQ ID NO: 95725 - RNA, 22 nt, Human
cccagaccccgcagcacgccuc

SEQ ID NO: 95726 - RNA, 22 nt, Human
ccugaguggcugggauugcagg

SEQ ID NO: 95727 - RNA, 20 nt, Human
caggaagggggcaguuucug

SEQ ID NO: 95728 - RNA, 22 nt, Human
cccuggucauccccucagucug

SEQ ID NO: 95729 - RNA, 27 nt, Human
ccagggaacccaguccagccuccuggc

SEQ ID NO: 95730 - RNA, 21 nt, Human
acugguguacauuaauuagau

SEQ ID NO: 95731 - RNA, 22 nt, Human
caggcuggaguggaguggcacg

SEQ ID NO: 95732 - RNA, 22 nt, Human
caggcuggagugcaguggcagg

SEQ ID NO: 95733 - RNA, 27 nt, Human
ugccuguuaucucagcuacuugggaag

SEQ ID NO: 95734 - RNA, 27 nt, Human
cucuggcccaagcuucuguaguagcuc

SEQ ID NO: 95735 - RNA, 21 nt, Human
ccagagaaaacacagucucug

SEQ ID NO: 95736 - RNA, 22 nt, Human
agccuuccgaguagcugggauu

SEQ ID NO: 95737 - RNA, 21 nt, Human
cucuccugccuuccaacgcca

SEQ ID NO: 95738 - RNA, 22 nt, Human
cccacaccucaagccuggacca

SEQ ID NO: 95739 - RNA, 25 nt, Human
uucugggauaacuggaacaucagaa

SEQ ID NO: 95740 - RNA, 28 nt, Human
ggccccaccuggccaagaguagcagcca

SEQ ID NO: 95741 - RNA, 27 nt, Human
ccucaccucucugcccuucccugcccg

SEQ ID NO: 95742 - RNA, 21 nt, Human
uaacaguuacagacauuucug

SEQ ID NO: 95743 - RNA, 23 nt, Human
aggccagacgccugagcuuuuuu

SEQ ID NO: 95744 - RNA, 25 nt, Human
ucugaacaugccucucucuugcuua

SEQ ID NO: 95745 - RNA, 22 nt, Human
ccgagaucgcgccaucgcacuc

SEQ ID NO: 95746 - RNA, 22 nt, Human
ccgagauugcgccauugcacuc

SEQ ID NO: 95747 - RNA, 23 nt, Human
uaucugaaggaccccagguaaga

SEQ ID NO: 95748 - RNA, 21 nt, Human
ggacgcagcaguuacagcacc

SEQ ID NO: 95749 - RNA, 26 nt, Human
acuuaacuccagcccugaacaggcac

SEQ ID NO: 95750 - RNA, 24 nt, Human
ggguuuagucucaauuuugguuau

SEQ ID NO: 95751 - RNA, 22 nt, Human
cguccacagcuuccugucccca

SEQ ID NO: 95752 - RNA, 22 nt, Human
ucaacagcaaguugguucuuca

SEQ ID NO: 95753 - RNA, 24 nt, Human
ugugaccauagcccacugcagccu

SEQ ID NO: 95754 - RNA, 25 nt, Human
cucagccucagauauccgcaccggc

SEQ ID NO: 95755 - RNA, 18 nt, Human
cuucugcugcaucugcag

SEQ ID NO: 95756 - RNA, 20 nt, Human
gcugagcugcaacuucuuac

SEQ ID NO: 95757 - RNA, 23 nt, Human
aacuuccugacguccugucccca

SEQ ID NO: 95758 - RNA, 25 nt, Human
caucuagagaaaaacaaaaauagaa

SEQ ID NO: 95759 - RNA, 24 nt, Human
gcguuuuucucccaugcacuugca

SEQ ID NO: 95760 - RNA, 25 nt, Human
aggaagcauguguucugugagguug

SEQ ID NO: 95761 - RNA, 25 nt, Human
ggcuauaaaccacuagcugcuucaa

SEQ ID NO: 95762 - RNA, 24 nt, Human
ggccuaaggagauuccacacaugc

SEQ ID NO: 95763 - RNA, 29 nt, Human
cugcacgggcucugaggccagcgucacac

SEQ ID NO: 95764 - RNA, 24 nt, Human
ggagagagaggggaagggggucuc

SEQ ID NO: 95765 - RNA, 22 nt, Human
gcugccugggcccugugguugc

SEQ ID NO: 95766 - RNA, 22 nt, Human
uguguuuuaacagcaugacuuc

SEQ ID NO: 95767 - RNA, 20 nt, Human
caaaugggacuuuuucguuu

SEQ ID NO: 95768 - RNA, 20 nt, Human
cccucucccccaccucuucc

SEQ ID NO: 95769 - RNA, 26 nt, Human
ucugccacgaggggccugcuguuugc

SEQ ID NO: 95770 - RNA, 18 nt, Human
gacuccauuugugccucu

SEQ ID NO: 95771 - RNA, 25 nt, Human
cgcgccgccuccccgcgccgcucgg

SEQ ID NO: 95772 - RNA, 22 nt, Human
cacccaggcuggaguggagugg

SEQ ID NO: 95773 - RNA, 22 nt, Human
ucuuccauguugcccaggcugg

SEQ ID NO: 95774 - RNA, 21 nt, Human
agggagccaggaugggaacca

SEQ ID NO: 95775 - RNA, 27 nt, Human
ucuuccuccuuuuuuccaaugugcuug

SEQ ID NO: 95776 - RNA, 27 nt, Human
agagcugggccagggaggacacgcucc

SEQ ID NO: 95777 - RNA, 21 nt, Human
ggcucacugcaagcucugccu

SEQ ID NO: 95778 - RNA, 18 nt, Human
ccauagcuucauccacug

SEQ ID NO: 95779 - RNA, 26 nt, Human
ccagaacuucgacccuuucucugaga

SEQ ID NO: 95780 - RNA, 22 nt, Human
uguccucuggugagaagguggu

SEQ ID NO: 95781 - RNA, 25 nt, Human
ggcagaggggaaggguggucagggu

SEQ ID NO: 95782 - RNA, 22 nt, Human
aucgcuugaacccgggaggugg

SEQ ID NO: 95783 - RNA, 20 nt, Human
ucauuccuguuuaauacuca

SEQ ID NO: 95784 - RNA, 31 nt, Human
cacuguugggggcaucuucgccuaaagccac

SEQ ID NO: 95785 - RNA, 21 nt, Human
uuuuaaaauggacauuuucaa

SEQ ID NO: 95786 - RNA, 25 nt, Human
aggaucucaggcuggagugcagugg

SEQ ID NO: 95787 - RNA, 21 nt, Human
gccacugcacuccagacuggg

SEQ ID NO: 95788 - RNA, 20 nt, Human
gcgucacugcacuccaaccu

SEQ ID NO: 95789 - RNA, 21 nt, Human
uuaucagcaauuuagcacuuu

SEQ ID NO: 95790 - RNA, 26 nt, Human
accacugccgaguuucugccuggagc

SEQ ID NO: 95791 - RNA, 28 nt, Human
gcaguucugccucacacggcucaaguca

SEQ ID NO: 95792 - RNA, 23 nt, Human
ggcucagccuggcaggcuuugug

SEQ ID NO: 95793 - RNA, 27 nt, Human
ccacguggauuugguagagaaaccccg

SEQ ID NO: 95794 - RNA, 28 nt, Human
gcuucugcacuaguaacugacagugcua

SEQ ID NO: 95795 - RNA, 23 nt, Human
ccuuggcauggccgccucaggcc

SEQ ID NO: 95796 - RNA, 22 nt, Human
uccugccaugugccugcacucc

SEQ ID NO: 95797 - RNA, 24 nt, Human
cagccccagcuuaucuccuccucc

SEQ ID NO: 95798 - RNA, 27 nt, Human
augccccagggaugggagguaugggcu

SEQ ID NO: 95799 - RNA, 23 nt, Human
ccuuggagguggagguuguggug

SEQ ID NO: 95800 - RNA, 24 nt, Human
uucuccaggacaaccugcuggaac

SEQ ID NO: 95801 - RNA, 20 nt, Human
cagauggaguuaaaaagagc

SEQ ID NO: 95802 - RNA, 20 nt, Human
aggaccacugcauccugucu

SEQ ID NO: 95803 - RNA, 27 nt, Human
gggcuguaggucgcugugcugugugau

SEQ ID NO: 95804 - RNA, 22 nt, Human
uguaggcuuagccaguuuauuu

SEQ ID NO: 95805 - RNA, 22 nt, Human
ucacccagccucugagagcagu

SEQ ID NO: 95806 - RNA, 22 nt, Human
auuuucucaucacgacagcaac

SEQ ID NO: 95807 - RNA, 22 nt, Human
cgccuaggcuggagugcagugg

SEQ ID NO: 95808 - RNA, 21 nt, Human
cagaacacuuucucaugucca

SEQ ID NO: 95809 - RNA, 23 nt, Human
ggauucaucaguucugaggcuuu

SEQ ID NO: 95810 - RNA, 25 nt, Human
ggccaaagacuaacaacugccuugg

SEQ ID NO: 95811 - RNA, 27 nt, Human
gguacguauucucuagcacagucugag

SEQ ID NO: 95812 - RNA, 24 nt, Human
gcgccggggcccauguggggagga

SEQ ID NO: 95813 - RNA, 24 nt, Human
ggaggugaggaccuccuugguucc

SEQ ID NO: 95814 - RNA, 20 nt, Human
gcagcagcggaggaguagga

SEQ ID NO: 95815 - RNA, 18 nt, Human
agaaguuuuaaacagggc

SEQ ID NO: 95816 - RNA, 21 nt, Human
ccuguaaucccagcuauuugg

SEQ ID NO: 95817 - RNA, 24 nt, Human
gaaagccuauuccaucaacuguga

SEQ ID NO: 95818 - RNA, 20 nt, Human
uucuaugaucauuacuccaa

SEQ ID NO: 95819 - RNA, 24 nt, Human
uacugccuugggagucucaagucc

SEQ ID NO: 95820 - RNA, 22 nt, Human
agggcaagaagaggaggcucca

SEQ ID NO: 95821 - RNA, 22 nt, Human
gaccagccuggccaucauggug

SEQ ID NO: 95822 - RNA, 23 nt, Human
ugugcaaaaucuguuauagcuuu

SEQ ID NO: 95823 - RNA, 18 nt, Human
aagcaaaccugcuuugac

SEQ ID NO: 95824 - RNA, 22 nt, Human
ugcacaccaccacacucagcua

SEQ ID NO: 95825 - RNA, 22 nt, Human
aaacccagcugacuuguuuccu

SEQ ID NO: 95826 - RNA, 27 nt, Human
uugcuaccucaauugcagguguuuguu

SEQ ID NO: 95827 - RNA, 18 nt, Human
aagugguucucugccuuu

SEQ ID NO: 95828 - RNA, 17 nt, Human
ggccuauccuguggucc

SEQ ID NO: 95829 - RNA, 24 nt, Human
gcuccccaggguggcaggagcuga

SEQ ID NO: 95830 - RNA, 21 nt, Human
gacacauugcugaccuuggcc

SEQ ID NO: 95831 - RNA, 25 nt, Human
acuccucuuccuccgccauccucau

SEQ ID NO: 95832 - RNA, 22 nt, Human
gagcagccugggcaacauggug

SEQ ID NO: 95833 - RNA, 24 nt, Human
cuggaccaguguugaucuguaaug

SEQ ID NO: 95834 - RNA, 27 nt, Human
uguugcccaggcuggucuugaacuccu

SEQ ID NO: 95835 - RNA, 21 nt, Human
ucagagauacagcuucuuaua

SEQ ID NO: 95836 - RNA, 20 nt, Human
guggguucaaacacauuuca

SEQ ID NO: 95837 - RNA, 24 nt, Human
gugcaaccuaauuaguaacuuucc

SEQ ID NO: 95838 - RNA, 26 nt, Human
cucuggaccaccucccgcugcguuuc

SEQ ID NO: 95839 - RNA, 20 nt, Human
aagcaaaggcuucaaggcuc

SEQ ID NO: 95840 - RNA, 21 nt, Human
ccuucccagccacuccugcug

SEQ ID NO: 95841 - RNA, 29 nt, Human
ccugucuccagcugcucugcacacaugga

SEQ ID NO: 95842 - RNA, 20 nt, Human
gagcaaaaaacaaaaacucu

SEQ ID NO: 95843 - RNA, 28 nt, Human
ccaggaggcagagguugcagugcgcuga

SEQ ID NO: 95844 - RNA, 21 nt, Human
ccugcagccaccagcacugcc

SEQ ID NO: 95845 - RNA, 23 nt, Human
gcagagaaaagcuccauucuucc

SEQ ID NO: 95846 - RNA, 28 nt, Human
uucuggcuuccuucucucaauaugcuua

SEQ ID NO: 95847 - RNA, 23 nt, Human
ccucacugcagccagcguggucc

SEQ ID NO: 95848 - RNA, 23 nt, Human
gccgccgccucccucccgcccag

SEQ ID NO: 95849 - RNA, 24 nt, Human
aagaggaggagagggaggcugcag

SEQ ID NO: 95850 - RNA, 23 nt, Human
auguuucugcuggacagugacca

SEQ ID NO: 95851 - RNA, 21 nt, Human
caggaggcagagguugcagug

SEQ ID NO: 95852 - RNA, 22 nt, Human
ucugcaguuuccagaaaaugga

SEQ ID NO: 95853 - RNA, 22 nt, Human
cucugucucuguagucucucca

SEQ ID NO: 95854 - RNA, 26 nt, Human
gcaguaauaucaacacugcuauauca

SEQ ID NO: 95855 - RNA, 20 nt, Human
uuuaggcagagucagucacu

SEQ ID NO: 95856 - RNA, 19 nt, Human
ccaugggcugcugcuguca

SEQ ID NO: 95857 - RNA, 22 nt, Human
caaacuccugggcuccagugau

SEQ ID NO: 95858 - RNA, 23 nt, Human
aguuuuaaauacuuaucuugccu

SEQ ID NO: 95859 - RNA, 21 nt, Human
uauagcucauuacagcuuuga

SEQ ID NO: 95860 - RNA, 27 nt, Human
uuaugugaacaugcgcugugugcugcu

SEQ ID NO: 95861 - RNA, 24 nt, Human
ccugccuuuuagggggcucuuguc

SEQ ID NO: 95862 - RNA, 21 nt, Human
gccuuaaucccagcacuuugg

SEQ ID NO: 95863 - RNA, 21 nt, Human
uuacuuugaaccuggaggcag

SEQ ID NO: 95864 - RNA, 21 nt, Human
augggacucccaacaggggua

SEQ ID NO: 95865 - RNA, 16 nt, Human
acucccuuacuggccu

SEQ ID NO: 95866 - RNA, 20 nt, Human
uggcacaccuggacuccuug

SEQ ID NO: 95867 - RNA, 26 nt, Human
cagcacuuuaaacucuuugugugggu

SEQ ID NO: 95868 - RNA, 25 nt, Human
aaccaaaacauauucaaagcagcag

SEQ ID NO: 95869 - RNA, 23 nt, Human
uuccuauauuugguggggugggu

SEQ ID NO: 95870 - RNA, 26 nt, Human
gccucucuucauuucauuauuauugg

SEQ ID NO: 95871 - RNA, 21 nt, Human
gcugccucuuugcugcuuugu

SEQ ID NO: 95872 - RNA, 27 nt, Human
augugggaaauucuucauccuaguucu

SEQ ID NO: 95873 - RNA, 23 nt, Human
ggccucucccugauggcacacaa

SEQ ID NO: 95874 - RNA, 22 nt, Human
uaccacugcacuccagcucggg

SEQ ID NO: 95875 - RNA, 21 nt, Human
ucccacauauucacauacgug

SEQ ID NO: 95876 - RNA, 20 nt, Human
ucauuuguaggaaacuggga

SEQ ID NO: 95877 - RNA, 21 nt, Human
gauguaggugguuccagcuuu

SEQ ID NO: 95878 - RNA, 21 nt, Human
gcacuccugccucccagccca

SEQ ID NO: 95879 - RNA, 27 nt, Human
gggacaugauguaagggaaaaggccuc

SEQ ID NO: 95880 - RNA, 27 nt, Human
cauugcauuccagccugggagacggag

SEQ ID NO: 95881 - RNA, 22 nt, Human
gauuacaggcgcguaucaccau

SEQ ID NO: 95882 - RNA, 24 nt, Human
uuggcgugcuggagggcauccugg

SEQ ID NO: 95883 - RNA, 23 nt, Human
gaucaauuuuucuuccuagcuuc

SEQ ID NO: 95884 - RNA, 18 nt, Human
agcuaaauugcugaucca

SEQ ID NO: 95885 - RNA, 24 nt, Human
ggcucacugcagccuccuucuccu

SEQ ID NO: 95886 - RNA, 22 nt, Human
ugcagugagccaugaucgagcc

SEQ ID NO: 95887 - RNA, 20 nt, Human
cugcuuguccgcuaucauca

SEQ ID NO: 95888 - RNA, 27 nt, Human
aggguuggggucugcauuggaggugcc

SEQ ID NO: 95889 - RNA, 27 nt, Human
cccugccauuuuaccacaaaagcagca

SEQ ID NO: 95890 - RNA, 24 nt, Human
uggucucaggcuccugcaguccca

SEQ ID NO: 95891 - RNA, 22 nt, Human
gcugggagaagaaauagacuug

SEQ ID NO: 95892 - RNA, 23 nt, Human
cugggagguauguacccaucuca

SEQ ID NO: 95893 - RNA, 27 nt, Human
gaccuauacugaaagaucucugucaca

SEQ ID NO: 95894 - RNA, 19 nt, Human
gaugucauccugcaugccu

SEQ ID NO: 95895 - RNA, 22 nt, Human
uuuguaaaaaugaaaaugugac

SEQ ID NO: 95896 - RNA, 21 nt, Human
gcacuguuaugcucagucaua

SEQ ID NO: 95897 - RNA, 27 nt, Human
gguccccagaaagcaggacagaaagaa

SEQ ID NO: 95898 - RNA, 20 nt, Human
ucugcacagucugugaugau

SEQ ID NO: 95899 - RNA, 23 nt, Human
agcaggagggaggccugagcaca

SEQ ID NO: 95900 - RNA, 19 nt, Human
uuuguaaaguuugccuuca

SEQ ID NO: 95901 - RNA, 21 nt, Human
gacauguguaacacuuuucag

SEQ ID NO: 95902 - RNA, 22 nt, Human
cuggauccccuuaguuuugaaa

SEQ ID NO: 95903 - RNA, 22 nt, Human
cagcacuucagcuuuagcugau

SEQ ID NO: 95904 - RNA, 21 nt, Human
ugcuuuuaauguuugcacuga

SEQ ID NO: 95905 - RNA, 21 nt, Human
ugucaugucucugguggugcu

SEQ ID NO: 95906 - RNA, 20 nt, Human
ccauuuccacccaaugagag

SEQ ID NO: 95907 - RNA, 23 nt, Human
ucucaagcuaaaacaaaaauaaa

SEQ ID NO: 95908 - RNA, 22 nt, Human
gcuggaaggcugcgucucugcu

SEQ ID NO: 95909 - RNA, 27 nt, Human
cccaaguagcugggauuacaccaccau

SEQ ID NO: 95910 - RNA, 20 nt, Human
ugcauuuggaauuuuugcuu

SEQ ID NO: 95911 - RNA, 28 nt, Human
ggcuccucagcccucucuugccaaaaag

SEQ ID NO: 95912 - RNA, 21 nt, Human
aucccggagaaggaaaaagaa

SEQ ID NO: 95913 - RNA, 19 nt, Human
aacauccugccagccccac

SEQ ID NO: 95914 - RNA, 22 nt, Human
uguugacacuucuuuuuuccua

SEQ ID NO: 95915 - RNA, 27 nt, Human
gcugugaauucuuucuucauccccgca

SEQ ID NO: 95916 - RNA, 21 nt, Human
agcaauuggaaaguuaguaag

SEQ ID NO: 95917 - RNA, 27 nt, Human
cuuauuucucauugccucuucuacuug

SEQ ID NO: 95918 - RNA, 23 nt, Human
cugggaccucaguuuuaucauuu

SEQ ID NO: 95919 - RNA, 23 nt, Human
ccuggguucuagucccugcucug

SEQ ID NO: 95920 - RNA, 27 nt, Human
gggcccugcuggcagggacuugcagug

SEQ ID NO: 95921 - RNA, 19 nt, Human
ccgcugcaggaaacauuug

SEQ ID NO: 95922 - RNA, 22 nt, Human
cagaagagguugggcuuccaug

SEQ ID NO: 95923 - RNA, 25 nt, Human
gcucuugcugucugcccugccucac

SEQ ID NO: 95924 - RNA, 30 nt, Human
ccugaguccuggcccuccugggaucugggg

SEQ ID NO: 95925 - RNA, 29 nt, Human
ggcuugaaagcaucaagauuccacucaau

SEQ ID NO: 95926 - RNA, 27 nt, Human
ucugcuuacaauucccugcugucgucu

SEQ ID NO: 95927 - RNA, 26 nt, Human
gggguuggggacagagcaggugcaga

SEQ ID NO: 95928 - RNA, 23 nt, Human
uccaggaggcagaggcuguggug

SEQ ID NO: 95929 - RNA, 23 nt, Human
ggaccuauaaacuucccaccuca

SEQ ID NO: 95930 - RNA, 19 nt, Human
auuugucgccugucugacu

SEQ ID NO: 95931 - RNA, 22 nt, Human
uguuggaccucuuucacucccu

SEQ ID NO: 95932 - RNA, 20 nt, Human
gcagugucaagacaguaagg

SEQ ID NO: 95933 - RNA, 23 nt, Human
cagggcugcgcgcccaggucugc

SEQ ID NO: 95934 - RNA, 31 nt, Human
ggcugggagccugagccccuucagcuuugag

SEQ ID NO: 95935 - RNA, 23 nt, Human
aggguguugcuaagcuguaaccg

SEQ ID NO: 95936 - RNA, 20 nt, Human
uuaugcaucuauauacauau

SEQ ID NO: 95937 - RNA, 25 nt, Human
aaguuggccaagccauagggcacag

SEQ ID NO: 95938 - RNA, 21 nt, Human
cugaguaaccacccaaaaaag

SEQ ID NO: 95939 - RNA, 21 nt, Human
ccauacagagauguagaaaga

SEQ ID NO: 95940 - RNA, 22 nt, Human
uuuccaaacacugaaggauuua

SEQ ID NO: 95941 - RNA, 19 nt, Human
ggauggaauuagagaauac

SEQ ID NO: 95942 - RNA, 21 nt, Human
cuggggcaggaggggagugag

SEQ ID NO: 95943 - RNA, 18 nt, Human
ucuccaccccaucauguu

SEQ ID NO: 95944 - RNA, 26 nt, Human
cuucucuuuaaaggucucaucccaca

SEQ ID NO: 95945 - RNA, 23 nt, Human
gcuagcacaugauuauccuucug

SEQ ID NO: 95946 - RNA, 22 nt, Human
auguuacaggcuugauuggugu

SEQ ID NO: 95947 - RNA, 22 nt, Human
uccgccuugaccggugccacca

SEQ ID NO: 95948 - RNA, 26 nt, Human
ggcuuacagaacauguugaaacuuuu

SEQ ID NO: 95949 - RNA, 26 nt, Human
uuaaagucuucagucuccacauuccc

SEQ ID NO: 95950 - RNA, 21 nt, Human
uucacaguguuucuuauuccc

SEQ ID NO: 95951 - RNA, 27 nt, Human
cccaggagauugaggcugcagugagcc

SEQ ID NO: 95952 - RNA, 24 nt, Human
ccaugaucaaauguagucucuguu

SEQ ID NO: 95953 - RNA, 22 nt, Human
gcuggcuguugagaugggugga

SEQ ID NO: 95954 - RNA, 19 nt, Human
ucucugucuuccucucuua

SEQ ID NO: 95955 - RNA, 23 nt, Human
ggcccaggcggggaaguggggug

SEQ ID NO: 95956 - RNA, 21 nt, Human
cuuuaaguagggauguuuagg

SEQ ID NO: 95957 - RNA, 32 nt, Human
cccugcugcccugggcucaggcugcuaccucu

SEQ ID NO: 95958 - RNA, 20 nt, Human
ggagaggcccucugaguugg

SEQ ID NO: 95959 - RNA, 21 nt, Human
gcauaggcuguugcaggacag

SEQ ID NO: 95960 - RNA, 24 nt, Human
ccccucgggccaggcaacagaacu

SEQ ID NO: 95961 - RNA, 20 nt, Human
ccugccuguccuuccugggc

SEQ ID NO: 95962 - RNA, 22 nt, Human
caccuggccugguugugugcac

SEQ ID NO: 95963 - RNA, 21 nt, Human
uggaagcuguuuggaaaagac

SEQ ID NO: 95964 - RNA, 21 nt, Human
agcuaaaaauccugugauacu

SEQ ID NO: 95965 - RNA, 20 nt, Human
ccuucauucuuacuaguuuc

SEQ ID NO: 95966 - RNA, 21 nt, Human
uccuaaggauuuugcugcaaa

SEQ ID NO: 95967 - RNA, 20 nt, Human
auauccgaacuacuguuaua

SEQ ID NO: 95968 - RNA, 17 nt, Human
caaaaagugugcauugg

SEQ ID NO: 95969 - RNA, 22 nt, Human
gugugagccaccaggcucagcc

SEQ ID NO: 95970 - RNA, 22 nt, Human
uccauccacagagcagugcagu

SEQ ID NO: 95971 - RNA, 20 nt, Human
uugauuucauuucuaaccau

SEQ ID NO: 95972 - RNA, 22 nt, Human
gaaagcagugcaguacucagua

SEQ ID NO: 95973 - RNA, 22 nt, Human
cguucgguccuccuuggcugac

SEQ ID NO: 95974 - RNA, 23 nt, Human
gucuaaggucacacaguauuaag

SEQ ID NO: 95975 - RNA, 27 nt, Human
uggcuggcagaggcagccagcgggugg

SEQ ID NO: 95976 - RNA, 22 nt, Human
agggccaccugcagauccugcu

SEQ ID NO: 95977 - RNA, 22 nt, Human
ggguacccaucacacaccagcg

SEQ ID NO: 95978 - RNA, 21 nt, Human
ucauagugauagagugcagug

SEQ ID NO: 95979 - RNA, 24 nt, Human
cucuucucugauccuucuuccuua

SEQ ID NO: 95980 - RNA, 25 nt, Human
cuccaaaugucaggguguuugccca

SEQ ID NO: 95981 - RNA, 26 nt, Human
ugggaagaaagaaugcaagaguggac

SEQ ID NO: 95982 - RNA, 20 nt, Human
ccauacagacagcacaaggu

SEQ ID NO: 95983 - RNA, 21 nt, Human
cugcucucagggaaacugggc

SEQ ID NO: 95984 - RNA, 20 nt, Human
uccaguuaauucaugccuua

SEQ ID NO: 95985 - RNA, 22 nt, Human
ugccuauauucccugcacuuug

SEQ ID NO: 95986 - RNA, 23 nt, Human
agccauucuuugcagcagaagau

SEQ ID NO: 95987 - RNA, 21 nt, Human
ugggcacuuugcugcuucuuu

SEQ ID NO: 95988 - RNA, 27 nt, Human
caugccuuucuccacguccgccuccuc

SEQ ID NO: 95989 - RNA, 19 nt, Human
cauggacccacagguccca

SEQ ID NO: 95990 - RNA, 27 nt, Human
ugguggagggaggcaguggggagaaag

SEQ ID NO: 95991 - RNA, 27 nt, Human
aggagcagcagccagcaccaccuacac

SEQ ID NO: 95992 - RNA, 21 nt, Human
ccuaucucaccugcccagccc

SEQ ID NO: 95993 - RNA, 27 nt, Human
gaccaaccugggcaacauagcaacacc

SEQ ID NO: 95994 - RNA, 22 nt, Human
ucgcccaggcuggagugcaacg

SEQ ID NO: 95995 - RNA, 23 nt, Human
cauugcacuccagccuugggcga

SEQ ID NO: 95996 - RNA, 21 nt, Human
uuaaaaaagcaacuaagagaa

SEQ ID NO: 95997 - RNA, 27 nt, Human
gucuugguguuuguaugaaauucugag

SEQ ID NO: 95998 - RNA, 21 nt, Human
gccagcccccgccccuccucc

SEQ ID NO: 95999 - RNA, 21 nt, Human
caggcuggagugcaaugggca

SEQ ID NO: 96000 - RNA, 21 nt, Human
agauuucaggcuaggugcggu

SEQ ID NO: 96001 - RNA, 22 nt, Human
ggaaagggaauguucugcuggu

SEQ ID NO: 96002 - RNA, 27 nt, Human
ggggacggaggggcaggagcccugggc

SEQ ID NO: 96003 - RNA, 22 nt, Human
cucacuuccugcacagcugucu

SEQ ID NO: 96004 - RNA, 24 nt, Human
ccucggccaugcggccccugcugc

SEQ ID NO: 96005 - RNA, 26 nt, Human
ccucccgcugccccgacgcggcccuc

SEQ ID NO: 96006 - RNA, 21 nt, Human
cgcagguugcagauacggugg

SEQ ID NO: 96007 - RNA, 28 nt, Human
ucugagugugucuggcucugagagaguc

SEQ ID NO: 96008 - RNA, 20 nt, Human
cugggcuuucccagcuccga

SEQ ID NO: 96009 - RNA, 25 nt, Human
ggccgcgggauccccaggcgaccuu

SEQ ID NO: 96010 - RNA, 21 nt, Human
aucucaggaaccucaggcccu

SEQ ID NO: 96011 - RNA, 23 nt, Human
agacccguaguuuccucagugga

SEQ ID NO: 96012 - RNA, 24 nt, Human
ggcagcccccuccccacaccaguu

SEQ ID NO: 96013 - RNA, 27 nt, Human
gagagagagucuuacucugccgcccaa

SEQ ID NO: 96014 - RNA, 25 nt, Human
auucuuuguauaugcauucuuuuca

SEQ ID NO: 96015 - RNA, 27 nt, Human
gggguucccugcuuuuugguagcaagg

SEQ ID NO: 96016 - RNA, 22 nt, Human
uauucccuguucaucucuguuu

SEQ ID NO: 96017 - RNA, 21 nt, Human
ggaacucaaggugguggcugg

SEQ ID NO: 96018 - RNA, 21 nt, Human
aauggcugagccucgugucca

SEQ ID NO: 96019 - RNA, 25 nt, Human
uuacaccucccagugcccuucugaa

SEQ ID NO: 96020 - RNA, 22 nt, Human
gcaggagucccagcaccaucgg

SEQ ID NO: 96021 - RNA, 22 nt, Human
ccucauucaucacuuggacaca

SEQ ID NO: 96022 - RNA, 24 nt, Human
cacccaggcgggaguggugcaaug

SEQ ID NO: 96023 - RNA, 21 nt, Human
ugugcucaggcuggggaacag

SEQ ID NO: 96024 - RNA, 20 nt, Human
cagauguuuacugcacaccu

SEQ ID NO: 96025 - RNA, 23 nt, Human
ccccaacagaugcuuuucugucu

SEQ ID NO: 96026 - RNA, 32 nt, Human
uggaucuucugucugugacacaguggccauug

SEQ ID NO: 96027 - RNA, 22 nt, Human
cucagccucccaaaauucuggg

SEQ ID NO: 96028 - RNA, 24 nt, Human
aacaguuagccacugcugguguuu

SEQ ID NO: 96029 - RNA, 20 nt, Human
acucucgcucuccugcccca

SEQ ID NO: 96030 - RNA, 21 nt, Human
uauuuucucccuuugccaagg

SEQ ID NO: 96031 - RNA, 25 nt, Human
gacgcucagccucagggcucagaag

SEQ ID NO: 96032 - RNA, 20 nt, Human
ccccauggggcucucuugug

SEQ ID NO: 96033 - RNA, 21 nt, Human
aguucuucaggcugauuuccc

SEQ ID NO: 96034 - RNA, 22 nt, Human
caggcuggagugcaguggcgug

SEQ ID NO: 96035 - RNA, 22 nt, Human
caggcuggaguguaguggcgcg

SEQ ID NO: 96036 - RNA, 24 nt, Human
cccacaccaucuggcccaggcugg

SEQ ID NO: 96037 - RNA, 21 nt, Human
uggccucaccgcugccgccuc

SEQ ID NO: 96038 - RNA, 23 nt, Human
uccugcuguucucuuaagaaaga

SEQ ID NO: 96039 - RNA, 22 nt, Human
ggcucacugcagccuccuucuc

SEQ ID NO: 96040 - RNA, 19 nt, Human
uuaugcugucuuagcaaua

SEQ ID NO: 96041 - RNA, 27 nt, Human
uucaaacacuacuccuauuacauuuuc

SEQ ID NO: 96042 - RNA, 27 nt, Human
ucagaagcagauuccaguguaaaaacg

SEQ ID NO: 96043 - RNA, 18 nt, Human
acaauucaaaaucaugca

SEQ ID NO: 96044 - RNA, 19 nt, Human
uguaccugacuggggucau

SEQ ID NO: 96045 - RNA, 26 nt, Human
ggaggcacguguucagagagcugcug

SEQ ID NO: 96046 - RNA, 27 nt, Human
agggcacacaggacagcagaagauccc

SEQ ID NO: 96047 - RNA, 22 nt, Human
ggucagacuccuggguucauga

SEQ ID NO: 96048 - RNA, 23 nt, Human
ucugggaaauccaacucucucca

SEQ ID NO: 96049 - RNA, 22 nt, Human
gcugaauucagacuccugggcu

SEQ ID NO: 96050 - RNA, 24 nt, Human
uaaaccuguaaaauuaugaugauu

SEQ ID NO: 96051 - RNA, 21 nt, Human
ggaaauuuaucuguuuuaaaa

SEQ ID NO: 96052 - RNA, 24 nt, Human
gucuucccagccagugagccacuu

SEQ ID NO: 96053 - RNA, 21 nt, Human
uucucuccuuuuaauuuuggu

SEQ ID NO: 96054 - RNA, 24 nt, Human
ccaccggcgggagugcagcggcca

SEQ ID NO: 96055 - RNA, 32 nt, Human
acaagccuccauuaaagccacagcagugcuac

SEQ ID NO: 96056 - RNA, 21 nt, Human
agccuuugccuugcucuguca

SEQ ID NO: 96057 - RNA, 25 nt, Human
uguggagccgcggaggcaagggacg

SEQ ID NO: 96058 - RNA, 20 nt, Human
cauuuugcugucaagcaaug

SEQ ID NO: 96059 - RNA, 28 nt, Human
ggguuaaagaggaaugagccuuuuaauu

SEQ ID NO: 96060 - RNA, 22 nt, Human
gcauguggagccauguggcaca

SEQ ID NO: 96061 - RNA, 24 nt, Human
ggagggcguccggggcguccccuc

SEQ ID NO: 96062 - RNA, 21 nt, Human
gaccacacgcccucucagcca

SEQ ID NO: 96063 - RNA, 22 nt, Human
ggcccaggcuagagugcagugg

SEQ ID NO: 96064 - RNA, 22 nt, Human
accuguaaugccagcccuuugg

SEQ ID NO: 96065 - RNA, 25 nt, Human
ugaugccaacaagacaggugaguua

SEQ ID NO: 96066 - RNA, 17 nt, Human
aaacuccugcgucgguc

SEQ ID NO: 96067 - RNA, 27 nt, Human
ccacuacugcugcagccagccacaggu

SEQ ID NO: 96068 - RNA, 22 nt, Human
ccccaagagggaauggacugua

SEQ ID NO: 96069 - RNA, 20 nt, Human
cuccuuggcuggaggcagug

SEQ ID NO: 96070 - RNA, 22 nt, Human
aggcugaggugguaggaucacc

SEQ ID NO: 96071 - RNA, 23 nt, Human
gguugauguuuuugggggccaag

SEQ ID NO: 96072 - RNA, 21 nt, Human
caaaaaguuaaaaggcaccag

SEQ ID NO: 96073 - RNA, 23 nt, Human
uuuccuaaggcccugcugucugc

SEQ ID NO: 96074 - RNA, 21 nt, Human
gguagucccuguuuuugcagu

SEQ ID NO: 96075 - RNA, 19 nt, Human
ucaggagucugaacacugg

SEQ ID NO: 96076 - RNA, 24 nt, Human
guucucugaugugucucaguaucu

SEQ ID NO: 96077 - RNA, 22 nt, Human
aaacuccugggcucaggcgauc

SEQ ID NO: 96078 - RNA, 22 nt, Human
cuuguuccuguucagugacuga

SEQ ID NO: 96079 - RNA, 31 nt, Human
ccaggccaggcccucaggaauucccugguuu

SEQ ID NO: 96080 - RNA, 24 nt, Human
cccgcugugugcauaugugugugc

SEQ ID NO: 96081 - RNA, 18 nt, Human
uuggaagcaguuuccuuu

SEQ ID NO: 96082 - RNA, 21 nt, Human
ggaaaaacagaggaugcugaa

SEQ ID NO: 96083 - RNA, 23 nt, Human
gagagcaucugcucugagacgga

SEQ ID NO: 96084 - RNA, 25 nt, Human
gcauuucagcagugccuucuggggu

SEQ ID NO: 96085 - RNA, 20 nt, Human
cagcuggccccggagccaga

SEQ ID NO: 96086 - RNA, 22 nt, Human
gggcuguuguugaugcaugggc

SEQ ID NO: 96087 - RNA, 21 nt, Human
gcucccuguagcucugccucc

SEQ ID NO: 96088 - RNA, 27 nt, Human
aguuuacauuuuguuucaaauauugcu

SEQ ID NO: 96089 - RNA, 21 nt, Human
aagguuuaggaaagccucuuu

SEQ ID NO: 96090 - RNA, 22 nt, Human
cuacugcacuccagccugggug

SEQ ID NO: 96091 - RNA, 29 nt, Human
cacaagcucuggcccugggcacccaccuc

SEQ ID NO: 96092 - RNA, 21 nt, Human
uuugccucuguccugccuggu

SEQ ID NO: 96093 - RNA, 22 nt, Human
gcagagcugcggcacagggccu

SEQ ID NO: 96094 - RNA, 23 nt, Human
gccagcccuggcuggagagcggg

SEQ ID NO: 96095 - RNA, 26 nt, Human
cgcugccgguuacguaaagaugaggg

SEQ ID NO: 96096 - RNA, 22 nt, Human
cuccacacgugcaugcuuuccc

SEQ ID NO: 96097 - RNA, 27 nt, Human
cacugcacuccggccuaggcaacgaga

SEQ ID NO: 96098 - RNA, 27 nt, Human
auggaugcauggggcucugggggaaug

SEQ ID NO: 96099 - RNA, 20 nt, Human
uuaucagcuuagaguguuca

SEQ ID NO: 96100 - RNA, 22 nt, Human
uguugcccaggcugaagugcag

SEQ ID NO: 96101 - RNA, 23 nt, Human
uuuagucuagacacaauuucauu

SEQ ID NO: 96102 - RNA, 23 nt, Human
ggaguuucucuugugagaguucc

SEQ ID NO: 96103 - RNA, 19 nt, Human
ggagguucuggaugaaggc

SEQ ID NO: 96104 - RNA, 23 nt, Human
guugccugggcuggagaacagug

SEQ ID NO: 96105 - RNA, 22 nt, Human
ucacugaagacacagguccaca

SEQ ID NO: 96106 - RNA, 24 nt, Human
caggaccuguucaagaaggugucu

SEQ ID NO: 96107 - RNA, 20 nt, Human
agguggguggagggagggag

SEQ ID NO: 96108 - RNA, 26 nt, Human
gccauuucucccagcaguuuuaaagg

SEQ ID NO: 96109 - RNA, 27 nt, Human
ccucaguagcuggggcuuuaggugggc

SEQ ID NO: 96110 - RNA, 23 nt, Human
ucaggugcuuguucuguccucuu

SEQ ID NO: 96111 - RNA, 23 nt, Human
gcuaggaaaagcuuuugcaugug

SEQ ID NO: 96112 - RNA, 20 nt, Human
guaauuucuuugccuguuca

SEQ ID NO: 96113 - RNA, 21 nt, Human
uggaagcguccaaaccugcuu

SEQ ID NO: 96114 - RNA, 24 nt, Human
cacccuggcuggaggaacugggug

SEQ ID NO: 96115 - RNA, 25 nt, Human
gaugccauugacaagguguuucucu

SEQ ID NO: 96116 - RNA, 21 nt, Human
gguuuuguuuuuguuuuugcc

SEQ ID NO: 96117 - RNA, 21 nt, Human
gcgcuaguccagcacgcccag

SEQ ID NO: 96118 - RNA, 21 nt, Human
ucugaccuggauaugaaccag

SEQ ID NO: 96119 - RNA, 26 nt, Human
cagccagcauccuuaucugccacuga

SEQ ID NO: 96120 - RNA, 21 nt, Human
ggguuugaaauauagcuguuc

SEQ ID NO: 96121 - RNA, 21 nt, Human
uagggaggagccuguggcagc

SEQ ID NO: 96122 - RNA, 22 nt, Human
caccauugcccuccagccuggg

SEQ ID NO: 96123 - RNA, 19 nt, Human
ccugcagccuuaacauucu

SEQ ID NO: 96124 - RNA, 24 nt, Human
gggaccugccacugcacaccagcc

SEQ ID NO: 96125 - RNA, 25 nt, Human
acccacccacuccaggaacccagag

SEQ ID NO: 96126 - RNA, 23 nt, Human
uuacucugcacuauagccauuug

SEQ ID NO: 96127 - RNA, 19 nt, Human
cagaggagggagcaauuga

SEQ ID NO: 96128 - RNA, 22 nt, Human
uucagcuugcacauuugguaau

SEQ ID NO: 96129 - RNA, 21 nt, Human
gggccugcccacccacccccu

SEQ ID NO: 96130 - RNA, 24 nt, Human
cugugcucuccccuccuuggggcg

SEQ ID NO: 96131 - RNA, 21 nt, Human
gcuguguguucaccugggcag

SEQ ID NO: 96132 - RNA, 23 nt, Human
accgcccaggcuggagugcagug

SEQ ID NO: 96133 - RNA, 22 nt, Human
ccugcagugugaaacugaagga

SEQ ID NO: 96134 - RNA, 27 nt, Human
uacaaguggccuuauuccaacuccaga

SEQ ID NO: 96135 - RNA, 22 nt, Human
cacaagguauuuuggucaagaa

SEQ ID NO: 96136 - RNA, 23 nt, Human
acuggaagcuuuugcucgcaguu

SEQ ID NO: 96137 - RNA, 24 nt, Human
cacaggcuuagggacaggacccca

SEQ ID NO: 96138 - RNA, 25 nt, Human
gggaucagugguucucccauaucac

SEQ ID NO: 96139 - RNA, 23 nt, Human
gaugaaugaaugcuaaaaggguu

SEQ ID NO: 96140 - RNA, 23 nt, Human
cauagcagcgggcgggcacuuug

SEQ ID NO: 96141 - RNA, 24 nt, Human
auggucaaguuacaacaacugaau

SEQ ID NO: 96142 - RNA, 24 nt, Human
cgcagccgccgcccgcggagccag

SEQ ID NO: 96143 - RNA, 20 nt, Human
cauggagagguguguaaagg

SEQ ID NO: 96144 - RNA, 22 nt, Human
agaccaccccucuuugggcgac

SEQ ID NO: 96145 - RNA, 23 nt, Human
gaugcuggcggcgcaucuugcgg

SEQ ID NO: 96146 - RNA, 28 nt, Human
cggcauggagcaggacacugccgcagug

SEQ ID NO: 96147 - RNA, 22 nt, Human
ggucuuugacagauuugacugu

SEQ ID NO: 96148 - RNA, 19 nt, Human
uuccuaccauguaacccug

SEQ ID NO: 96149 - RNA, 23 nt, Human
gcaggcaccuguaaucccagcug

SEQ ID NO: 96150 - RNA, 23 nt, Human
ccuaugccagagcagugccaacu

SEQ ID NO: 96151 - RNA, 22 nt, Human
cucaaguacccauucuguuuuc

SEQ ID NO: 96152 - RNA, 21 nt, Human
ucacaguuuuuccuggaauug

SEQ ID NO: 96153 - RNA, 22 nt, Human
ggauuucaggcugaguguggug

SEQ ID NO: 96154 - RNA, 18 nt, Human
gugcuuguauuuaucuua

SEQ ID NO: 96155 - RNA, 25 nt, Human
uaaaacugaagcaccacugugugag

SEQ ID NO: 96156 - RNA, 22 nt, Human
ccacccauagcccugcugcugc

SEQ ID NO: 96157 - RNA, 21 nt, Human
ugucgcccaggcuggagguua

SEQ ID NO: 96158 - RNA, 27 nt, Human
gaguagcugggacuacaggcacccgcc

SEQ ID NO: 96159 - RNA, 22 nt, Human
uggcccaggguaggggagggug

SEQ ID NO: 96160 - RNA, 26 nt, Human
cucagccagcccuggaggcuggaugg

SEQ ID NO: 96161 - RNA, 23 nt, Human
agcuaauuuuuuguauuuuuagu

SEQ ID NO: 96162 - RNA, 20 nt, Human
gcccggcaccggacugggac

SEQ ID NO: 96163 - RNA, 23 nt, Human
cuggggagacagaaacugugguu

SEQ ID NO: 96164 - RNA, 22 nt, Human
cugcucccccucauccccuuca

SEQ ID NO: 96165 - RNA, 22 nt, Human
gccacugccauaacuuguuugu

SEQ ID NO: 96166 - RNA, 23 nt, Human
ugcucaucuacagcuuucuugga

SEQ ID NO: 96167 - RNA, 28 nt, Human
uuuugggagcuccuccaucuccaauggc

SEQ ID NO: 96168 - RNA, 25 nt, Human
uugucaccgaggcuggagugcaaug

SEQ ID NO: 96169 - RNA, 26 nt, Human
caugccuuuuggucugaagcuccgcc

SEQ ID NO: 96170 - RNA, 22 nt, Human
cacaacaaugcagaaagcggua

SEQ ID NO: 96171 - RNA, 25 nt, Human
uauuucuuuguuaucaaacuucagc

SEQ ID NO: 96172 - RNA, 20 nt, Human
agguugaugcuggaggcaga

SEQ ID NO: 96173 - RNA, 27 nt, Human
cauaugcuaacccccaaauacucugaa

SEQ ID NO: 96174 - RNA, 27 nt, Human
acuuucuccaauagucacauuggcaaa

SEQ ID NO: 96175 - RNA, 24 nt, Human
cuugaucccaggcccugccuaagc

SEQ ID NO: 96176 - RNA, 22 nt, Human
ucugggagcugagcacuugucu

SEQ ID NO: 96177 - RNA, 30 nt, Human
uccccucagaaggcaggagugcugcccucu

SEQ ID NO: 96178 - RNA, 23 nt, Human
aaacgcauucagaugcaucagcc

SEQ ID NO: 96179 - RNA, 22 nt, Human
guuuuauguguuuaauagauga

SEQ ID NO: 96180 - RNA, 22 nt, Human
ccccaucucguugguguggcuc

SEQ ID NO: 96181 - RNA, 23 nt, Human
uagagagccuuucuccagcccau

SEQ ID NO: 96182 - RNA, 23 nt, Human
gacagaagaagucagagaaguga

SEQ ID NO: 96183 - RNA, 23 nt, Human
accugcuaacgcauuagcauuag

SEQ ID NO: 96184 - RNA, 22 nt, Human
ucauucaggcuggagugcagug

SEQ ID NO: 96185 - RNA, 22 nt, Human
acauguguauauaagacagugg

SEQ ID NO: 96186 - RNA, 27 nt, Human
gaaaugaggccuguacaaggcugauaa

SEQ ID NO: 96187 - RNA, 28 nt, Human
uaucacugacacuccagacuaaagcaga

SEQ ID NO: 96188 - RNA, 24 nt, Human
ccugcagcugccccaagccauggc

SEQ ID NO: 96189 - RNA, 22 nt, Human
uccguauguucuucauagagag

SEQ ID NO: 96190 - RNA, 25 nt, Human
gccugcuucugcccccuccugauuu

SEQ ID NO: 96191 - RNA, 25 nt, Human
gccaagcugugugagagggccaccg

SEQ ID NO: 96192 - RNA, 25 nt, Human
ucucccuuucugcuugcucuucugu

SEQ ID NO: 96193 - RNA, 22 nt, Human
gcagugucgugaucaagguuca

SEQ ID NO: 96194 - RNA, 22 nt, Human
uuucucucauugcuuuuucuaa

SEQ ID NO: 96195 - RNA, 27 nt, Human
gcagagcugcugauuguggggcuggga

SEQ ID NO: 96196 - RNA, 24 nt, Human
cugguccuuuggcgugguacucug

SEQ ID NO: 96197 - RNA, 19 nt, Human
auugccuggaacaccagcu

SEQ ID NO: 96198 - RNA, 21 nt, Human
gguuaccacagucuccauggg

SEQ ID NO: 96199 - RNA, 22 nt, Human
cggaaagagagagacacucagg

SEQ ID NO: 96200 - RNA, 21 nt, Human
cuguauuuucuugcagugugc

SEQ ID NO: 96201 - RNA, 23 nt, Human
ugcucagugccugccucugacaa

SEQ ID NO: 96202 - RNA, 23 nt, Human
gggaagagcugucaaaagacugg

SEQ ID NO: 96203 - RNA, 31 nt, Human
caaagugccucagaagaacucauagaaucau

SEQ ID NO: 96204 - RNA, 22 nt, Human
cuuccaucugcacacaccccca

SEQ ID NO: 96205 - RNA, 19 nt, Human
uauggugauauauuuacaa

SEQ ID NO: 96206 - RNA, 29 nt, Human
uuucaaaacaaaaagagauugggggagug

SEQ ID NO: 96207 - RNA, 20 nt, Human
uugagccuugggacgugccc

SEQ ID NO: 96208 - RNA, 27 nt, Human
cugcaccaguuguuuuaccccugccga

SEQ ID NO: 96209 - RNA, 22 nt, Human
ugauaaauuuaaaugaccucag

SEQ ID NO: 96210 - RNA, 20 nt, Human
ggaagguggagcugcauugg

SEQ ID NO: 96211 - RNA, 25 nt, Human
uucucagagauugcaaaggauuuuu

SEQ ID NO: 96212 - RNA, 27 nt, Human
ggagaugggaucauggauuuucugggc

SEQ ID NO: 96213 - RNA, 27 nt, Human
aaugccacagcccagaauucugggcaa

SEQ ID NO: 96214 - RNA, 24 nt, Human
aaauucuccuggcucuccugggcu

SEQ ID NO: 96215 - RNA, 27 nt, Human
acaacaugucccagcccauucuccguu

SEQ ID NO: 96216 - RNA, 25 nt, Human
gcugccuccagcccgggccuguguc

SEQ ID NO: 96217 - RNA, 20 nt, Human
uuuccuggccugugccugga

SEQ ID NO: 96218 - RNA, 19 nt, Human
cuucugcucucccagcgca

SEQ ID NO: 96219 - RNA, 21 nt, Human
gugaguguaaggaugcagugg

SEQ ID NO: 96220 - RNA, 22 nt, Human
cccccagccugacaaauauugu

SEQ ID NO: 96221 - RNA, 23 nt, Human
agagagaagagagucagcaacag

SEQ ID NO: 96222 - RNA, 21 nt, Human
cugccagggccccucucccca

SEQ ID NO: 96223 - RNA, 25 nt, Human
aguaucuugaaauaaugaucugacc

SEQ ID NO: 96224 - RNA, 24 nt, Human
uaacaaaauaucacagacugagua

SEQ ID NO: 96225 - RNA, 21 nt, Human
ggacuucucugauggcgagag

SEQ ID NO: 96226 - RNA, 23 nt, Human
gcaccaucccucucccccaggcc

SEQ ID NO: 96227 - RNA, 20 nt, Human
uuuguucugaacuggcaguu

SEQ ID NO: 96228 - RNA, 27 nt, Human
ugggaggugggagggccaggccaacug

SEQ ID NO: 96229 - RNA, 26 nt, Human
ucugggacuguuugcguuccuaaaac

SEQ ID NO: 96230 - RNA, 22 nt, Human
gcuguguucuucuguugaccca

SEQ ID NO: 96231 - RNA, 21 nt, Human
agcguggaggggaaggguagg

SEQ ID NO: 96232 - RNA, 23 nt, Human
ggagagggagaggaaaggguucu

SEQ ID NO: 96233 - RNA, 21 nt, Human
caggaggcggagguugcagug

SEQ ID NO: 96234 - RNA, 22 nt, Human
gggguucagaccugcagaggaa

SEQ ID NO: 96235 - RNA, 21 nt, Human
aauacaucugcuucaaaauga

SEQ ID NO: 96236 - RNA, 19 nt, Human
cuacuucccuuccucccgg

SEQ ID NO: 96237 - RNA, 21 nt, Human
aacacaucccagacauuagga

SEQ ID NO: 96238 - RNA, 25 nt, Human
ucccucuucccagaaaaccagucug

SEQ ID NO: 96239 - RNA, 27 nt, Human
ucaggaaguugccaugggaaacaaaua

SEQ ID NO: 96240 - RNA, 27 nt, Human
cuccaucugucaagauggcaggggccg

SEQ ID NO: 96241 - RNA, 19 nt, Human
cugcauuuggcuuucuacc

SEQ ID NO: 96242 - RNA, 21 nt, Human
gaggggcuguaaaauggaggc

SEQ ID NO: 96243 - RNA, 23 nt, Human
ucagcaccaagcauguccaggca

SEQ ID NO: 96244 - RNA, 21 nt, Human
cccaucucagggcagaggcca

SEQ ID NO: 96245 - RNA, 23 nt, Human
gcauucaacugugcucugugagg

SEQ ID NO: 96246 - RNA, 21 nt, Human
cuuuaaaauggaaaacaguca

SEQ ID NO: 96247 - RNA, 21 nt, Human
cauucacuacagccuggauga

SEQ ID NO: 96248 - RNA, 22 nt, Human
cuuucuccagcauuuccaguac

SEQ ID NO: 96249 - RNA, 22 nt, Human
gcauccagcagcagcacuuaga

SEQ ID NO: 96250 - RNA, 23 nt, Human
gggaguaagaagugcuguggaaa

SEQ ID NO: 96251 - RNA, 24 nt, Human
uguccauguggcucuaucuuuuaa

SEQ ID NO: 96252 - RNA, 22 nt, Human
aggcugaggcaggugguucacu

SEQ ID NO: 96253 - RNA, 26 nt, Human
gguggagaguggagugugcugggacg

SEQ ID NO: 96254 - RNA, 27 nt, Human
guccuccugggucagggagaacgcggg

SEQ ID NO: 96255 - RNA, 18 nt, Human
ccugcagcucacuguguc

SEQ ID NO: 96256 - RNA, 22 nt, Human
ugcaaccucugccucccgaguu

SEQ ID NO: 96257 - RNA, 21 nt, Human
auauuuuaaacagaggauauc

SEQ ID NO: 96258 - RNA, 27 nt, Human
cucugggucuguucugaccauucccua

SEQ ID NO: 96259 - RNA, 27 nt, Human
ugaccaacguuaaguaaccccgucuuu

SEQ ID NO: 96260 - RNA, 24 nt, Human
gcccaggcuggagugcaauggcac

SEQ ID NO: 96261 - RNA, 25 nt, Human
uugcauguucaaaacggaaaccauu

SEQ ID NO: 96262 - RNA, 22 nt, Human
uuucucuguuuuaugcucuugu

SEQ ID NO: 96263 - RNA, 26 nt, Human
gcaggugucccugagaacccaaacuu

SEQ ID NO: 96264 - RNA, 22 nt, Human
ucccccagccgcaacucagguc

SEQ ID NO: 96265 - RNA, 23 nt, Human
acuucugucuuccuucauuauuu

SEQ ID NO: 96266 - RNA, 22 nt, Human
ucuccugugcaccugacuuugg

SEQ ID NO: 96267 - RNA, 26 nt, Human
cucugccccugccucagucgagcacu

SEQ ID NO: 96268 - RNA, 26 nt, Human
ccgggcaaggguccucuuuuccuggc

SEQ ID NO: 96269 - RNA, 21 nt, Human
uugaaguuuuaacagauuccu

SEQ ID NO: 96270 - RNA, 22 nt, Human
gaucccgucuccgaagaaaaga

SEQ ID NO: 96271 - RNA, 22 nt, Human
cccaaagcgcugggauuauagg

SEQ ID NO: 96272 - RNA, 22 nt, Human
cuucagcuguauuuccacagau

SEQ ID NO: 96273 - RNA, 22 nt, Human
aaccugagcccucuccauucag

SEQ ID NO: 96274 - RNA, 24 nt, Human
ggcgccauuucacuccagccuggg

SEQ ID NO: 96275 - RNA, 23 nt, Human
uccucauaucagcugaagucugc

SEQ ID NO: 96276 - RNA, 22 nt, Human
caccccguccuccagcccgcaa

SEQ ID NO: 96277 - RNA, 22 nt, Human
auucucucaugggacaauguug

SEQ ID NO: 96278 - RNA, 24 nt, Human
ggucaucucggugauuuuuguaac

SEQ ID NO: 96279 - RNA, 19 nt, Human
cacaggcaccagcauacac

SEQ ID NO: 96280 - RNA, 26 nt, Human
aagggagcuuggguaggggccaggcu

SEQ ID NO: 96281 - RNA, 23 nt, Human
gcugagcccgcucgccauggccc

SEQ ID NO: 96282 - RNA, 14 nt, Human
gcuggagugcaaug

SEQ ID NO: 96283 - RNA, 21 nt, Human
uccugcuggaaccucagcugc

SEQ ID NO: 96284 - RNA, 22 nt, Human
aaggaugaacuagaucaugcac

SEQ ID NO: 96285 - RNA, 21 nt, Human
gguucugauuuauuuucagcc

SEQ ID NO: 96286 - RNA, 23 nt, Human
ucucauagugagugucuucacuc

SEQ ID NO: 96287 - RNA, 21 nt, Human
cagcaaacgccugagugcugc

SEQ ID NO: 96288 - RNA, 20 nt, Human
cagcucaggcuggagcaggc

SEQ ID NO: 96289 - RNA, 22 nt, Human
ccugccucagcugcugccugcc

SEQ ID NO: 96290 - RNA, 21 nt, Human
cagggaaccgugcagugugca

SEQ ID NO: 96291 - RNA, 26 nt, Human
ggggcugcuuucuccccucccuucuu

SEQ ID NO: 96292 - RNA, 24 nt, Human
ggucuagcaaaagcuaagccugga

SEQ ID NO: 96293 - RNA, 20 nt, Human
gggcucaugggcaaugugau

SEQ ID NO: 96294 - RNA, 24 nt, Human
uagagggagauaaagagggcuagu

SEQ ID NO: 96295 - RNA, 21 nt, Human
uccauuaucugcacaggaacu

SEQ ID NO: 96296 - RNA, 22 nt, Human
ccagccuuuaaaauaucauguc

SEQ ID NO: 96297 - RNA, 24 nt, Human
caaaccugcaggcauaucauuggc

SEQ ID NO: 96298 - RNA, 21 nt, Human
acacauuauguaucuuaguua

SEQ ID NO: 96299 - RNA, 20 nt, Human
uuggaagcugcccugcccau

SEQ ID NO: 96300 - RNA, 27 nt, Human
ugaccugcuggguccuccggugcagug

SEQ ID NO: 96301 - RNA, 21 nt, Human
gagauggaugaauggaaggac

SEQ ID NO: 96302 - RNA, 23 nt, Human
uaggccuuuuccugucugccuuu

SEQ ID NO: 96303 - RNA, 25 nt, Human
ccggaauucuuuaauagucaccuuc

SEQ ID NO: 96304 - RNA, 26 nt, Human
ggggagaagcauagagggccugugag

SEQ ID NO: 96305 - RNA, 27 nt, Human
guuaggggaggcccuacugccuucuca

SEQ ID NO: 96306 - RNA, 19 nt, Human
guuuuuuaggcuggacagc

SEQ ID NO: 96307 - RNA, 23 nt, Human
cauaucuggacgacugugcaaug

SEQ ID NO: 96308 - RNA, 22 nt, Human
gagauuuuccucuagugcucaa

SEQ ID NO: 96309 - RNA, 21 nt, Human
gggguguccuggaucucauga

SEQ ID NO: 96310 - RNA, 27 nt, Human
cuguggaaugcauugugaacuguaaaa

SEQ ID NO: 96311 - RNA, 24 nt, Human
ggagaagagagcgggagccgcgga

SEQ ID NO: 96312 - RNA, 25 nt, Human
caggcagcuccuguguuuucuugag

SEQ ID NO: 96313 - RNA, 19 nt, Human
cugcuuguaugagcaacaa

SEQ ID NO: 96314 - RNA, 22 nt, Human
ggagcacacggcccugccccau

SEQ ID NO: 96315 - RNA, 22 nt, Human
guccucuggcuuauugccucag

SEQ ID NO: 96316 - RNA, 22 nt, Human
gggggcagcucuggaggggguu

SEQ ID NO: 96317 - RNA, 23 nt, Human
cuggagugcggugguggaaucau

SEQ ID NO: 96318 - RNA, 27 nt, Human
augauaguuuuggauauuugcuugcug

SEQ ID NO: 96319 - RNA, 26 nt, Human
cacagcugggguggggaccucaggcc

SEQ ID NO: 96320 - RNA, 22 nt, Human
ugaauaguggacaacugcccau

SEQ ID NO: 96321 - RNA, 22 nt, Human
agaccagccuggucaacauugc

SEQ ID NO: 96322 - RNA, 24 nt, Human
uucuaaaaaauggaaauuuaacaa

SEQ ID NO: 96323 - RNA, 21 nt, Human
uuagagcacaggaagugacaa

SEQ ID NO: 96324 - RNA, 21 nt, Human
gauuacaucugagccguuuga

SEQ ID NO: 96325 - RNA, 24 nt, Human
ucuccuggacaccuggccauuguu

SEQ ID NO: 96326 - RNA, 25 nt, Human
gaggaagaggggacguguguuugca

SEQ ID NO: 96327 - RNA, 32 nt, Human
gggcugacucugcugccccaaccuuucaagga

SEQ ID NO: 96328 - RNA, 22 nt, Human
ugcucauaucuuacucaacauc

SEQ ID NO: 96329 - RNA, 21 nt, Human
uuucuuuugauuucucuuuau

SEQ ID NO: 96330 - RNA, 21 nt, Human
uugccucacugcaacgccugc

SEQ ID NO: 96331 - RNA, 16 nt, Human
uuucagcuuguuucua

SEQ ID NO: 96332 - RNA, 23 nt, Human
ccaacauggugaaaacccugucu

SEQ ID NO: 96333 - RNA, 25 nt, Human
aauuccuuaccucucccaaggaggg

SEQ ID NO: 96334 - RNA, 21 nt, Human
gagccaguguuuguacaauca

SEQ ID NO: 96335 - RNA, 21 nt, Human
ccaaaaucacaucaccaggcc

SEQ ID NO: 96336 - RNA, 27 nt, Human
cuucucugccuuucucuaugcccuuaa

SEQ ID NO: 96337 - RNA, 23 nt, Human
uuuucuuugccaucucugcucca

SEQ ID NO: 96338 - RNA, 22 nt, Human
gaggcugaagcaagcagaucac

SEQ ID NO: 96339 - RNA, 22 nt, Human
caggaucuugcucugucaccca

SEQ ID NO: 96340 - RNA, 25 nt, Human
uguguucgcuguggacgcuguagag

SEQ ID NO: 96341 - RNA, 22 nt, Human
uucuguuaguuugagaucauua

SEQ ID NO: 96342 - RNA, 21 nt, Human
gccauccugugcugugcucaa

SEQ ID NO: 96343 - RNA, 22 nt, Human
cuccuguuucccgcagggugcu

SEQ ID NO: 96344 - RNA, 23 nt, Human
aaugaucuuggaccaugguagaa

SEQ ID NO: 96345 - RNA, 21 nt, Human
guguccggaggcaugggugag

SEQ ID NO: 96346 - RNA, 22 nt, Human
aaggcauuuucaucuuuccuuc

SEQ ID NO: 96347 - RNA, 21 nt, Human
gccagccacacuuggagucug

SEQ ID NO: 96348 - RNA, 22 nt, Human
acgaggaauguguugccuccaa

SEQ ID NO: 96349 - RNA, 22 nt, Human
aggaagcagaaguucaagguga

SEQ ID NO: 96350 - RNA, 23 nt, Human
ucugaagcccagcugacuccacu

SEQ ID NO: 96351 - RNA, 20 nt, Human
auguuaccuguccucuuccc

SEQ ID NO: 96352 - RNA, 27 nt, Human
aggcucucuucuaugauuuaccuucug

SEQ ID NO: 96353 - RNA, 30 nt, Human
ugguauucuguucuggaggaaagggaggag

SEQ ID NO: 96354 - RNA, 16 nt, Human
gaaacgcaaaugagua

SEQ ID NO: 96355 - RNA, 25 nt, Human
ggcuccccuuuuucuuccucacccu

SEQ ID NO: 96356 - RNA, 27 nt, Human
agggucugagccaagccccucgacucc

SEQ ID NO: 96357 - RNA, 25 nt, Human
gggauuacaggugugagccuccaca

SEQ ID NO: 96358 - RNA, 23 nt, Human
ggauuaguaagaucucuuucuaa

SEQ ID NO: 96359 - RNA, 27 nt, Human
ucccgacgaucuuccuggcuccaacac

SEQ ID NO: 96360 - RNA, 21 nt, Human
ggagcuggaccugccugcugc

SEQ ID NO: 96361 - RNA, 25 nt, Human
uggacaucaacaaggcuagaagggu

SEQ ID NO: 96362 - RNA, 25 nt, Human
uugauuagggcaauggagugcauaa

SEQ ID NO: 96363 - RNA, 22 nt, Human
ggagugagcuaucaucagugcu

SEQ ID NO: 96364 - RNA, 24 nt, Human
acaaaccuguguuguuuuuguaua

SEQ ID NO: 96365 - RNA, 21 nt, Human
cacaguuugcucugucaccca

SEQ ID NO: 96366 - RNA, 27 nt, Human
uuugccuggcaguucugcauugcaucu

SEQ ID NO: 96367 - RNA, 23 nt, Human
aguauagcucuuuuccuaccuga

SEQ ID NO: 96368 - RNA, 20 nt, Human
aucucuguacaguguauuua

SEQ ID NO: 96369 - RNA, 27 nt, Human
agggaaagcaagcccuuggugggggaa

SEQ ID NO: 96370 - RNA, 27 nt, Human
ccucugccuggccaccugccuggacca

SEQ ID NO: 96371 - RNA, 22 nt, Human
uuuucucuaccauccuuuccag

SEQ ID NO: 96372 - RNA, 22 nt, Human
ccugcagccgcaccuacuggcc

SEQ ID NO: 96373 - RNA, 25 nt, Human
uuguguauuauaacucuuuauuuuu

SEQ ID NO: 96374 - RNA, 22 nt, Human
gugagggaugugaauugccugc

SEQ ID NO: 96375 - RNA, 21 nt, Human
aaauugugccuuucucacuca

SEQ ID NO: 96376 - RNA, 18 nt, Human
ccaguguccagcaacaga

SEQ ID NO: 96377 - RNA, 26 nt, Human
aaaugucccuccucagaaacaggcuc

SEQ ID NO: 96378 - RNA, 20 nt, Human
uaccucugucucacgcccag

SEQ ID NO: 96379 - RNA, 22 nt, Human
cugcaaccuccgcaucccgggu

SEQ ID NO: 96380 - RNA, 21 nt, Human
ugggcagaucacuugagguca

SEQ ID NO: 96381 - RNA, 25 nt, Human
caguggaagagguugcacuucuccg

SEQ ID NO: 96382 - RNA, 23 nt, Human
ugacaccuuuaagcuggugcaca

SEQ ID NO: 96383 - RNA, 27 nt, Human
uggagagaauguugauuggcaaaagca

SEQ ID NO: 96384 - RNA, 22 nt, Human
gggauuacaggggugagccacc

SEQ ID NO: 96385 - RNA, 22 nt, Human
cacgaacuuccggucucuuagg

SEQ ID NO: 96386 - RNA, 26 nt, Human
ucuguuagcaucuuccuuuucauggg

SEQ ID NO: 96387 - RNA, 27 nt, Human
cauagcugccugcacucugucucucca

SEQ ID NO: 96388 - RNA, 22 nt, Human
ccaucucccucacauguuaucc

SEQ ID NO: 96389 - RNA, 19 nt, Human
gauacucccagucuuguca

SEQ ID NO: 96390 - RNA, 24 nt, Human
ccagcccacccagccaaaaauaca

SEQ ID NO: 96391 - RNA, 26 nt, Human
cuucauuuuuaauuguuuucuaaaaa

SEQ ID NO: 96392 - RNA, 21 nt, Human
ggaggcggagguuacagugag

SEQ ID NO: 96393 - RNA, 21 nt, Human
caccguccuuuccuuucuccc

SEQ ID NO: 96394 - RNA, 21 nt, Human
cugcucccuauugcuucuguu

SEQ ID NO: 96395 - RNA, 23 nt, Human
uggcauccacuacugcugccuuu

SEQ ID NO: 96396 - RNA, 27 nt, Human
caggaaggggugugcugaguucuauaa

SEQ ID NO: 96397 - RNA, 24 nt, Human
guccucucccuucuucccuaaccc

SEQ ID NO: 96398 - RNA, 25 nt, Human
uugagacacaguuugcucugucacc

SEQ ID NO: 96399 - RNA, 23 nt, Human
uaugccuguaauucaguguauuu

SEQ ID NO: 96400 - RNA, 26 nt, Human
acucacugacucuucuaugcaguuac

SEQ ID NO: 96401 - RNA, 21 nt, Human
guucauuuaagcacaguuuuu

SEQ ID NO: 96402 - RNA, 22 nt, Human
cgucugucccuagcagucuuuc

SEQ ID NO: 96403 - RNA, 25 nt, Human
acgauuucacugacacugcgaacuc

SEQ ID NO: 96404 - RNA, 22 nt, Human
acugcugauuccagugucgagg

SEQ ID NO: 96405 - RNA, 22 nt, Human
gcucaggccuguaaucccagca

SEQ ID NO: 96406 - RNA, 22 nt, Human
acaugauagagggacagagcca

SEQ ID NO: 96407 - RNA, 20 nt, Human
gcuugagacugggaggcaga

SEQ ID NO: 96408 - RNA, 17 nt, Human
cgcgucucuagugccuu

SEQ ID NO: 96409 - RNA, 20 nt, Human
aucacaggcgucccccacca

SEQ ID NO: 96410 - RNA, 21 nt, Human
uugcuucucuuucucuucuca

SEQ ID NO: 96411 - RNA, 23 nt, Human
cgugugcccgccaugcccgcgcc

SEQ ID NO: 96412 - RNA, 23 nt, Human
acuuccucuccuuccaccccuca

SEQ ID NO: 96413 - RNA, 27 nt, Human
uucuacaaguaauuuugcacagacauc

SEQ ID NO: 96414 - RNA, 21 nt, Human
ucuguguccuaagcccuuuca

SEQ ID NO: 96415 - RNA, 22 nt, Human
gcuccuuuuccguucuguucug

SEQ ID NO: 96416 - RNA, 22 nt, Human
uguacgcgccaccgagugccuu

SEQ ID NO: 96417 - RNA, 27 nt, Human
gaggggcuuuuucucucugugccccag

SEQ ID NO: 96418 - RNA, 24 nt, Human
cuuguuuuauauugaucuguuuua

SEQ ID NO: 96419 - RNA, 23 nt, Human
guuguuuuucauccuuggcagcu

SEQ ID NO: 96420 - RNA, 22 nt, Human
ucccgcagcucuccugccccug

SEQ ID NO: 96421 - RNA, 22 nt, Human
ugcagugagcuauuacagugcc

SEQ ID NO: 96422 - RNA, 27 nt, Human
caggcagcaguggcgccuggugucagg

SEQ ID NO: 96423 - RNA, 21 nt, Human
ggugagagaacaagaucucuu

SEQ ID NO: 96424 - RNA, 20 nt, Human
aaaaugugugugaucuuuaa

SEQ ID NO: 96425 - RNA, 29 nt, Human
gaagggucagggcuucuguggaacuugga

SEQ ID NO: 96426 - RNA, 21 nt, Human
agcaggacaggggccugggga

SEQ ID NO: 96427 - RNA, 22 nt, Human
uccuccagggagucucagcuuc

SEQ ID NO: 96428 - RNA, 22 nt, Human
acuucuauuaccauguuguuuu

SEQ ID NO: 96429 - RNA, 22 nt, Human
cugcaaccuucaccuccagguu

SEQ ID NO: 96430 - RNA, 23 nt, Human
uucuuccuauuguaaucgugugc

SEQ ID NO: 96431 - RNA, 21 nt, Human
auccugggcuuuuguuuugcu

SEQ ID NO: 96432 - RNA, 21 nt, Human
agccugcacaauaaaaauguu

SEQ ID NO: 96433 - RNA, 21 nt, Human
ugugagucaggcgggagacca

SEQ ID NO: 96434 - RNA, 21 nt, Human
cacuguacuccagcccggcac

SEQ ID NO: 96435 - RNA, 25 nt, Human
ggcaacauagggggaucccaucucu

SEQ ID NO: 96436 - RNA, 18 nt, Human
gcaguggagcccaggagu

SEQ ID NO: 96437 - RNA, 23 nt, Human
ggagagggaaauacaaggagggc

SEQ ID NO: 96438 - RNA, 21 nt, Human
ccuccuucccugucucugccu

SEQ ID NO: 96439 - RNA, 23 nt, Human
ccuaauccccacuucccugcaga

SEQ ID NO: 96440 - RNA, 27 nt, Human
ucccucccucccuggaguguugagggg

SEQ ID NO: 96441 - RNA, 21 nt, Human
gccauugcacuucagccuggg

SEQ ID NO: 96442 - RNA, 22 nt, Human
aauauuccuacugucuuuggaa

SEQ ID NO: 96443 - RNA, 20 nt, Human
uugguuaaauauaauuucca

SEQ ID NO: 96444 - RNA, 25 nt, Human
cucaugcuucacccucacacucacu

SEQ ID NO: 96445 - RNA, 15 nt, Human
caggauuuacagugc

SEQ ID NO: 96446 - RNA, 26 nt, Human
cccauucugguucccguucaaguuca

SEQ ID NO: 96447 - RNA, 14 nt, Human
aacugauuuugcua

SEQ ID NO: 96448 - RNA, 28 nt, Human
augcugacagaagaaccaaagcuuucag

SEQ ID NO: 96449 - RNA, 21 nt, Human
uccagccugagcaacagagug

SEQ ID NO: 96450 - RNA, 22 nt, Human
agagcagccugggcaacauggu

SEQ ID NO: 96451 - RNA, 24 nt, Human
gaggggcggcggcagcuguggaag

SEQ ID NO: 96452 - RNA, 26 nt, Human
ccagccucugucccucuuugccugug

SEQ ID NO: 96453 - RNA, 23 nt, Human
cgcugcccucucuggcucagggg

SEQ ID NO: 96454 - RNA, 23 nt, Human
uuucuucagaaucaugaaguucu

SEQ ID NO: 96455 - RNA, 22 nt, Human
auuuuucucuccaacauauuuu

SEQ ID NO: 96456 - RNA, 27 nt, Human
uguggcuuuugucaagcacuuagaugg

SEQ ID NO: 96457 - RNA, 20 nt, Human
cagacauuugauuucuuuau

SEQ ID NO: 96458 - RNA, 20 nt, Human
caguuggcaaccuugcccug

SEQ ID NO: 96459 - RNA, 25 nt, Human
guguuuuauuuugugaucucuuguc

SEQ ID NO: 96460 - RNA, 22 nt, Human
uuguuagcuuugcuuuucuccc

SEQ ID NO: 96461 - RNA, 21 nt, Human
uccugcucuccuccguggaca

SEQ ID NO: 96462 - RNA, 22 nt, Human
ggcgccacccuucuucaggccc

SEQ ID NO: 96463 - RNA, 20 nt, Human
ugggaggaaaggcagaguug

SEQ ID NO: 96464 - RNA, 23 nt, Human
auucauaucccauagaucuagua

SEQ ID NO: 96465 - RNA, 22 nt, Human
gggcugagguuggaggccuacu

SEQ ID NO: 96466 - RNA, 26 nt, Human
gaagaggggcagugggagcagaggag

SEQ ID NO: 96467 - RNA, 20 nt, Human
cuggcagcugcuccucggcu

SEQ ID NO: 96468 - RNA, 22 nt, Human
ccuuuuggccacacaguuuaca

SEQ ID NO: 96469 - RNA, 27 nt, Human
acauugaauugcauguuaaggugcaga

SEQ ID NO: 96470 - RNA, 24 nt, Human
agaggaaccucucgccaugaucag

SEQ ID NO: 96471 - RNA, 18 nt, Human
ggccuuuccucaguccug

SEQ ID NO: 96472 - RNA, 28 nt, Human
agcccaaaaacaaaugguuaggcugcag

SEQ ID NO: 96473 - RNA, 18 nt, Human
caggagacgcgggcugug

SEQ ID NO: 96474 - RNA, 21 nt, Human
uugacuauucuguaucuuuca

SEQ ID NO: 96475 - RNA, 25 nt, Human
ugguggcacuucucuguaaucucag

SEQ ID NO: 96476 - RNA, 25 nt, Human
gcuggguucugggccuguaucgaau

SEQ ID NO: 96477 - RNA, 28 nt, Human
uagccaaguucuggagcaaauaaaaggc

SEQ ID NO: 96478 - RNA, 21 nt, Human
gccagcgaagcuuccuccucc

SEQ ID NO: 96479 - RNA, 25 nt, Human
gugucauccagagcuggagugcagc

SEQ ID NO: 96480 - RNA, 24 nt, Human
uucaaagcuauggacagcaucuag

SEQ ID NO: 96481 - RNA, 22 nt, Human
ucuuagaaccaagggaaauacu

SEQ ID NO: 96482 - RNA, 28 nt, Human
gaccuuagcagaccagagauuuuauuuu

SEQ ID NO: 96483 - RNA, 27 nt, Human
ggcuuuggcgcugaccacaaugcugag

SEQ ID NO: 96484 - RNA, 21 nt, Human
cagcuuccaucaggaacaugg

SEQ ID NO: 96485 - RNA, 22 nt, Human
ucacaccauugcacugcagccu

SEQ ID NO: 96486 - RNA, 19 nt, Human
cuugacuauuuugaagauu

SEQ ID NO: 96487 - RNA, 27 nt, Human
cagacuggagugcaguggugggaucgc

SEQ ID NO: 96488 - RNA, 20 nt, Human
gaagagccuuuauagauuau

SEQ ID NO: 96489 - RNA, 20 nt, Human
ugggacaugcacacacacuc

SEQ ID NO: 96490 - RNA, 19 nt, Human
ugggaaaguauuuuugaaa

SEQ ID NO: 96491 - RNA, 25 nt, Human
ccuccauugcccucauggaacagag

SEQ ID NO: 96492 - RNA, 22 nt, Human
gggguagcggcccugagcuugc

SEQ ID NO: 96493 - RNA, 22 nt, Human
acacaggaggauggcuuugggc

SEQ ID NO: 96494 - RNA, 22 nt, Human
gaggccuugucuaacugccuuu

SEQ ID NO: 96495 - RNA, 22 nt, Human
augugaaaagaaaaaugagccu

SEQ ID NO: 96496 - RNA, 22 nt, Human
agaauuacuuacagacacucuu

SEQ ID NO: 96497 - RNA, 20 nt, Human
acuccugaugcccucuucuc

SEQ ID NO: 96498 - RNA, 27 nt, Human
cauaggucccugacauuuaguugauua

SEQ ID NO: 96499 - RNA, 22 nt, Human
agaagucacccaaauccugcca

SEQ ID NO: 96500 - RNA, 19 nt, Human
ggucccccuugccuucaca

SEQ ID NO: 96501 - RNA, 31 nt, Human; identical to SEQ ID NO: 7395

SEQ ID NO: 96502 - RNA, 23 nt, Human
ucuuuuaaaucaaggaggcugua

SEQ ID NO: 96503 - RNA, 26 nt, Human
aaucugaggcccagagagguugggga

SEQ ID NO: 96504 - RNA, 25 nt, Human
ccauucuucaucauuuguaaguuca

SEQ ID NO: 96505 - RNA, 21 nt, Human
cucauuucuuugucuuuuucc

SEQ ID NO: 96506 - RNA, 21 nt, Human
caagaucauuuauuccgcugc

SEQ ID NO: 96507 - RNA, 24 nt, Human
gccuguaggaaaccaaagauggga

SEQ ID NO: 96508 - RNA, 22 nt, Human
augcccgccagccagggccuaa

SEQ ID NO: 96509 - RNA, 24 nt, Human
caguggcaacugaaaugcauuuca

SEQ ID NO: 96510 - RNA, 27 nt, Human
uuaugaucuuacaaaccugcaaaugga

SEQ ID NO: 96511 - RNA, 21 nt, Human
ggacagggaagaagaccccag

SEQ ID NO: 96512 - RNA, 22 nt, Human
aggugggcagaucacgagguca

SEQ ID NO: 96513 - RNA, 25 nt, Human
agccucgggacaaaacaaugacuca

SEQ ID NO: 96514 - RNA, 20 nt, Human
agagucuauguaugucucug

SEQ ID NO: 96515 - RNA, 20 nt, Human
auaaacaaaaagcaugugaa

SEQ ID NO: 96516 - RNA, 27 nt, Human
uggggucaggacaggcugcggaugcuu

SEQ ID NO: 96517 - RNA, 23 nt, Human
agaggaggagagggaggcugcag

SEQ ID NO: 96518 - RNA, 22 nt, Human
uuggacugagcacacaucugag

SEQ ID NO: 96519 - RNA, 20 nt, Human
uuggaaagaccagauaagaa

SEQ ID NO: 96520 - RNA, 24 nt, Human
gggagcacaggugucugccuagau

SEQ ID NO: 96521 - RNA, 22 nt, Human
agaucagccugggcaauauagu

SEQ ID NO: 96522 - RNA, 23 nt, Human
ccagugcucuccccaggcuggcc

SEQ ID NO: 96523 - RNA, 25 nt, Human
caugguuuccaucuguccugagcaa

SEQ ID NO: 96524 - RNA, 23 nt, Human
uuccaaauguaauaaacuuuaau

SEQ ID NO: 96525 - RNA, 27 nt, Human
augaugaauuggauggcugcagaccgg

SEQ ID NO: 96526 - RNA, 20 nt, Human
gacuguacuggccaguguca

SEQ ID NO: 96527 - RNA, 21 nt, Human
ggcacucuuaagcccaccucc

SEQ ID NO: 96528 - RNA, 22 nt, Human
gguggaggugugggcagaggag

SEQ ID NO: 96529 - RNA, 21 nt, Human
uaggcugucaugaauguguac

SEQ ID NO: 96530 - RNA, 21 nt, Human
ugcuggaguaacaaaauaucu

SEQ ID NO: 96531 - RNA, 20 nt, Human
cacaaggugggcagggaggc

SEQ ID NO: 96532 - RNA, 20 nt, Human
uguauugcuugaggccaggu

SEQ ID NO: 96533 - RNA, 21 nt, Human
uuaugggaauucuuuacaaua

SEQ ID NO: 96534 - RNA, 27 nt, Human
cuucugcucagaccgagcgugugccac

SEQ ID NO: 96535 - RNA, 21 nt, Human
cuuaaaaucaaaaacuaccua

SEQ ID NO: 96536 - RNA, 31 nt, Human
ggagccaggacucccagaaccucuaagugcu

SEQ ID NO: 96537 - RNA, 21 nt, Human
gcuguucuuuucuaguuacau

SEQ ID NO: 96538 - RNA, 25 nt, Human
ccuguuucggaucugugguuccuuu

SEQ ID NO: 96539 - RNA, 19 nt, Human
ggacaauuggaaagguaga

SEQ ID NO: 96540 - RNA, 27 nt, Human
ucagcacuaaaaguucuagucucugcg

SEQ ID NO: 96541 - RNA, 20 nt, Human
ugucauugucuacuccuaga

SEQ ID NO: 96542 - RNA, 20 nt, Human
uucucaugccuuucccucca

SEQ ID NO: 96543 - RNA, 21 nt, Human
ggagaaagugccagcccugaa

SEQ ID NO: 96544 - RNA, 19 nt, Human
gaaucuccuuucuguucua

SEQ ID NO: 96545 - RNA, 26 nt, Human
gagcuuugggugcugaagggccaaac

SEQ ID NO: 96546 - RNA, 20 nt, Human
ggagaaucacuugcacuccg

SEQ ID NO: 96547 - RNA, 32 nt, Human
cacccgcacugcagucuccagccugagccaug

SEQ ID NO: 96548 - RNA, 21 nt, Human
gcuggcccugcuggcccugcc

SEQ ID NO: 96549 - RNA, 26 nt, Human
ugcagccuguggauguccugcagccc

SEQ ID NO: 96550 - RNA, 19 nt, Human
acagugagcugagagugcc

SEQ ID NO: 96551 - RNA, 25 nt, Human
cuucugcucuuuccaucuuuuugcu

SEQ ID NO: 96552 - RNA, 23 nt, Human
uuguuucucugggcgguuguggc

SEQ ID NO: 96553 - RNA, 21 nt, Human
gcccucacacucugcgccucc

SEQ ID NO: 96554 - RNA, 22 nt, Human
ggaaguuggcaaaaacagccuu

SEQ ID NO: 96555 - RNA, 27 nt, Human
ugcuagugccaucgugguguguggcag

SEQ ID NO: 96556 - RNA, 23 nt, Human
gcugggagggggagggagauaga

SEQ ID NO: 96557 - RNA, 22 nt, Human
acucaugccuguaaucccagua

SEQ ID NO: 96558 - RNA, 26 nt, Human
ugcuucuguuaucaaacaccaacaua

SEQ ID NO: 96559 - RNA, 19 nt, Human
gaaaggcaugucucacaug

SEQ ID NO: 96560 - RNA, 22 nt, Human
cauuccuguccuuaaggcacag

SEQ ID NO: 96561 - RNA, 23 nt, Human
caagggguagggagagggaggag

SEQ ID NO: 96562 - RNA, 21 nt, Human
cauccuggcuggagaaugugg

SEQ ID NO: 96563 - RNA, 24 nt, Human
ugcaauaaagaagcacauuauuuu

SEQ ID NO: 96564 - RNA, 22 nt, Human
cgggaagcggagguugcaggga

SEQ ID NO: 96565 - RNA, 23 nt, Human
aaaauugaagaauugaauuaagg

SEQ ID NO: 96566 - RNA, 18 nt, Human
ucugucuucacuauucag

SEQ ID NO: 96567 - RNA, 23 nt, Human
aagcaaaaaacuccuguaacccu

SEQ ID NO: 96568 - RNA, 21 nt, Human
cucgccaggcuggaguguagu

SEQ ID NO: 96569 - RNA, 23 nt, Human
ucgcccaggccugggaugcagug

SEQ ID NO: 96570 - RNA, 21 nt, Human
ucacugcagcuucuaggaccc

SEQ ID NO: 96571 - RNA, 20 nt, Human
uuagguugguuauaccagcu

SEQ ID NO: 96572 - RNA, 26 nt, Human
uggucuggagucccacccggacaggu

SEQ ID NO: 96573 - RNA, 28 nt, Human
ccagcuggacuccagccugucccucuua

SEQ ID NO: 96574 - RNA, 23 nt, Human
ugugucgggcucauuuugcucaa

SEQ ID NO: 96575 - RNA, 24 nt, Human
uccagugaggaggcuggcgcaugu

SEQ ID NO: 96576 - RNA, 27 nt, Human
auuucagggauacccaggacgcgugaa

SEQ ID NO: 96577 - RNA, 25 nt, Human
caaugagagcugcacucuggcuggg

SEQ ID NO: 96578 - RNA, 25 nt, Human
uuugaguuguugaguauauuugaga

SEQ ID NO: 96579 - RNA, 28 nt, Human
aggccuggagcccacaaccuucggcucc

SEQ ID NO: 96580 - RNA, 21 nt, Human
acacaacagguuucuacucuc

SEQ ID NO: 96581 - RNA, 21 nt, Human
cuugggggccuccuuucaucu

SEQ ID NO: 96582 - RNA, 20 nt, Human
uucccagguuuaaugaaaga

SEQ ID NO: 96583 - RNA, 21 nt, Human
aaccauucccaccaaguggaa

SEQ ID NO: 96584 - RNA, 21 nt, Human
ccauaguccagaggaggcauc

SEQ ID NO: 96585 - RNA, 27 nt, Human
cagccaucugcugcuucuuauugauag

SEQ ID NO: 96586 - RNA, 23 nt, Human
gugaaguuuguuuucucccacug

SEQ ID NO: 96587 - RNA, 21 nt, Human
ccgcagcugcagugacauguc

SEQ ID NO: 96588 - RNA, 23 nt, Human
ccucuuggggcuuuccucaggcc

SEQ ID NO: 96589 - RNA, 22 nt, Human
ggugaagccuagcagcuaugag

SEQ ID NO: 96590 - RNA, 25 nt, Human
agugguaauguaauaccuuaccuca

SEQ ID NO: 96591 - RNA, 21 nt, Human
uuacucucugccuaccugccu

SEQ ID NO: 96592 - RNA, 21 nt, Human
ggacacuuuggauacugugaa

SEQ ID NO: 96593 - RNA, 24 nt, Human
gcaugugguucaaagagaagcagg

SEQ ID NO: 96594 - RNA, 21 nt, Human
gcuguauagcugcuuccagug

SEQ ID NO: 96595 - RNA, 22 nt, Human
uuuccauuguugcaucuugaau

SEQ ID NO: 96596 - RNA, 26 nt, Human
ucuccacucuccucugggcuccuccu

SEQ ID NO: 96597 - RNA, 21 nt, Human
agcucacugguggcuguuccu

SEQ ID NO: 96598 - RNA, 21 nt, Human
ugcaguauuuaagaguuaaca

SEQ ID NO: 96599 - RNA, 19 nt, Human
cugucucccaccucccggg

SEQ ID NO: 96600 - RNA, 26 nt, Human
cuccaccccuccaucucaaagaaaua

SEQ ID NO: 96601 - RNA, 23 nt, Human
ugaaacaccucccaggggcucca

SEQ ID NO: 96602 - RNA, 20 nt, Human
uuaguccauuucugcugcua

SEQ ID NO: 96603 - RNA, 27 nt, Human
cccaacaacagggacagaagacucacg

SEQ ID NO: 96604 - RNA, 26 nt, Human
agcuugagcuaaugaguccuccgugg

SEQ ID NO: 96605 - RNA, 23 nt, Human
gugggugcucucucggggugggg

SEQ ID NO: 96606 - RNA, 25 nt, Human
agaaggcaaagaauaaacauuugau

SEQ ID NO: 96607 - RNA, 20 nt, Human
uguccaggcuggagugcaau

SEQ ID NO: 96608 - RNA, 20 nt, Human
uguccaggcuagagugcagu

SEQ ID NO: 96609 - RNA, 23 nt, Human
gagcgaggcccugccugcggggc

SEQ ID NO: 96610 - RNA, 26 nt, Human
caguccugugugucuggggacaaggc

SEQ ID NO: 96611 - RNA, 27 nt, Human
uuccaagaucauagacuuacuaaagag

SEQ ID NO: 96612 - RNA, 28 nt, Human
agaggccaccuccacuccuacaaaauca

SEQ ID NO: 96613 - RNA, 20 nt, Human
aagugauccgcccaccuugg

SEQ ID NO: 96614 - RNA, 21 nt, Human
ucucccaggcugcuggagugc

SEQ ID NO: 96615 - RNA, 24 nt, Human
agaucacauuucucacugccuucu

SEQ ID NO: 96616 - RNA, 22 nt, Human
gagcggagccucaggagccggc

SEQ ID NO: 96617 - RNA, 27 nt, Human
ugucuucuuugguucugggagggguga

SEQ ID NO: 96618 - RNA, 21 nt, Human
uuacagccucucaauuucagg

SEQ ID NO: 96619 - RNA, 17 nt, Human
uuagaagaaaagcagca

SEQ ID NO: 96620 - RNA, 24 nt, Human
gaaaguagaucauguucacugcaa

SEQ ID NO: 96621 - RNA, 21 nt, Human
gcaucuuccugcugggcacag

SEQ ID NO: 96622 - RNA, 22 nt, Human
uucguguaaaugugaacacuga

SEQ ID NO: 96623 - RNA, 23 nt, Human
ucuccccaccuucuuuggagcaa

SEQ ID NO: 96624 - RNA, 20 nt, Human
ugggcuggagaguuggugcu

SEQ ID NO: 96625 - RNA, 22 nt, Human
auauguguagauaaaacugcuu

SEQ ID NO: 96626 - RNA, 22 nt, Human
ccaccuccuggguucaggcgau

SEQ ID NO: 96627 - RNA, 27 nt, Human
agaacucagguggaggcuugagaaggc

SEQ ID NO: 96628 - RNA, 22 nt, Human
cugcagcuguaguacagugcug

SEQ ID NO: 96629 - RNA, 32 nt, Human
gccuaaauuaguauauaaaaacaaaaaugcua

SEQ ID NO: 96630 - RNA, 23 nt, Human
agaguaagaccuguuguuuugga

SEQ ID NO: 96631 - RNA, 20 nt, Human
ggacacuuugcuccacacac

SEQ ID NO: 96632 - RNA, 19 nt, Human
ccuuucucaucauaagacu

SEQ ID NO: 96633 - RNA, 26 nt, Human
gaggcugaggcaggagaauugcuuga

SEQ ID NO: 96634 - RNA, 18 nt, Human
guuuuuaaucucacuuug

SEQ ID NO: 96635 - RNA, 22 nt, Human
cagcccaggcaaauuguauuua

SEQ ID NO: 96636 - RNA, 21 nt, Human
gggaucuggauuccugguucc

SEQ ID NO: 96637 - RNA, 19 nt, Human
ccccaccaagugacuuugg

SEQ ID NO: 96638 - RNA, 18 nt, Human
gcagguggccacagcagg

SEQ ID NO: 96639 - RNA, 22 nt, Human
gcccggccuggcugggccucuc

SEQ ID NO: 96640 - RNA, 21 nt, Human
gcuguccuuggguaacagcuc

SEQ ID NO: 96641 - RNA, 21 nt, Human
aggccaguuucucugccuucu

SEQ ID NO: 96642 - RNA, 20 nt, Human
gggccagaacaguggcaggg

SEQ ID NO: 96643 - RNA, 22 nt, Human
cguucgacaaaagcaguggaga

SEQ ID NO: 96644 - RNA, 26 nt, Human
cacuucagaagagugaauaacugauu

SEQ ID NO: 96645 - RNA, 25 nt, Human
acugccucuuccucccucauuccac

SEQ ID NO: 96646 - RNA, 24 nt, Human
cacacugcuuuuaccagcuguaac

SEQ ID NO: 96647 - RNA, 25 nt, Human
aacugauuuuuuaagacugugucug

SEQ ID NO: 96648 - RNA, 20 nt, Human
uuaugucacuuuaagaaaua

SEQ ID NO: 96649 - RNA, 24 nt, Human
agagguggggacaggggcaggggc

SEQ ID NO: 96650 - RNA, 23 nt, Human
cagggucuccgggaccucccuug

SEQ ID NO: 96651 - RNA, 22 nt, Human
gagaugggggguuggauagcau

SEQ ID NO: 96652 - RNA, 20 nt, Human
aucaaaccaccaggcauccg

SEQ ID NO: 96653 - RNA, 21 nt, Human
ugguagcaaccaaagauucca

SEQ ID NO: 96654 - RNA, 24 nt, Human
augucaggaaagcccuaaacugaa

SEQ ID NO: 96655 - RNA, 25 nt, Human
guccuccucgcuauguuggaaaugu

SEQ ID NO: 96656 - RNA, 21 nt, Human
aaccaaaaagcuuuugucuuu

SEQ ID NO: 96657 - RNA, 21 nt, Human
cugggggagggagagaucuga

SEQ ID NO: 96658 - RNA, 23 nt, Human
caggaucccagggcucccugcca

SEQ ID NO: 96659 - RNA, 22 nt, Human
aguuuaugccccucccuugcaa

SEQ ID NO: 96660 - RNA, 26 nt, Human
gaggaagacggaaaagacugccugcc

SEQ ID NO: 96661 - RNA, 20 nt, Human
caaauagucuuuuuguuguu

SEQ ID NO: 96662 - RNA, 23 nt, Human
augauucuucaagacagagacuc

SEQ ID NO: 96663 - RNA, 22 nt, Human
uucuggcuucauuuuauacuac

SEQ ID NO: 96664 - RNA, 26 nt, Human
uguuuuuauuguuuucuauuuaugcc

SEQ ID NO: 96665 - RNA, 21 nt, Human
gcaguccacagcagucuggcu

SEQ ID NO: 96666 - RNA, 27 nt, Human
aacccaugaaggcuggaaggcagcagg

SEQ ID NO: 96667 - RNA, 20 nt, Human
ggggggugccuggugaugag

SEQ ID NO: 96668 - RNA, 23 nt, Human
gugaacaauuuauaaguguccca

SEQ ID NO: 96669 - RNA, 24 nt, Human
agagugaggagggcccagagcaga

SEQ ID NO: 96670 - RNA, 19 nt, Human
uuucuuauccccgccaagg

SEQ ID NO: 96671 - RNA, 22 nt, Human
gccuguaauccuggcacuuugg

SEQ ID NO: 96672 - RNA, 21 nt, Human
gugaucauacccugagcacga

SEQ ID NO: 96673 - RNA, 21 nt, Human
cuugccccuggucccugcccc

SEQ ID NO: 96674 - RNA, 20 nt, Human
uugggaccuggggguuggug

SEQ ID NO: 96675 - RNA, 23 nt, Human
cccucacuggaugaaauaacucc

SEQ ID NO: 96676 - RNA, 21 nt, Human
caguguuggauauucugugau

SEQ ID NO: 96677 - RNA, 25 nt, Human
uugguuccugugauacauuucugaa

SEQ ID NO: 96678 - RNA, 20 nt, Human
acucacugcaaccuucgccu

SEQ ID NO: 96679 - RNA, 26 nt, Human
agcccaaaaaccuacuucuccuugug

SEQ ID NO: 96680 - RNA, 19 nt, Human
cagcugcugugccuguguc

SEQ ID NO: 96681 - RNA, 23 nt, Human
ugugccucuguccuuagguugua

SEQ ID NO: 96682 - RNA, 21 nt, Human
ucuaaacaaaugcauaugaua

SEQ ID NO: 96683 - RNA, 25 nt, Human
uccuccagggcauuuuuaggaaagg

SEQ ID NO: 96684 - RNA, 20 nt, Human
cuccaucuagauggggggcu

SEQ ID NO: 96685 - RNA, 20 nt, Human
ggcaaagcugcucccaaggc

SEQ ID NO: 96686 - RNA, 24 nt, Human
ccccugccagacccccuggagacu

SEQ ID NO: 96687 - RNA, 22 nt, Human
gccagggguauuugcauucaua

SEQ ID NO: 96688 - RNA, 23 nt, Human
gugugugugaacugggcacagau

SEQ ID NO: 96689 - RNA, 28 nt, Human
uuucauuauuacagcagcacuguauaua

SEQ ID NO: 96690 - RNA, 22 nt, Human
gguccaaagaggagagcuguuc

SEQ ID NO: 96691 - RNA, 19 nt, Human
cauuacuguaauuggcucu

SEQ ID NO: 96692 - RNA, 25 nt, Human
auuauuaauuuuauuaggcuuuugg

SEQ ID NO: 96693 - RNA, 24 nt, Human
gcagggggugguggugucuuccca

SEQ ID NO: 96694 - RNA, 23 nt, Human
uggcccaggucuccucuccaguc

SEQ ID NO: 96695 - RNA, 28 nt, Human
ugcccugaccccuccuuucugaaaauca

SEQ ID NO: 96696 - RNA, 23 nt, Human
augcagaaauaacuacaagggcc

SEQ ID NO: 96697 - RNA, 20 nt, Human
cugccccuaguugcugucuc

SEQ ID NO: 96698 - RNA, 30 nt, Human
ucccuccggccgcagaaccagcaucgggug

SEQ ID NO: 96699 - RNA, 20 nt, Human
augguaagagaaaagagaga

SEQ ID NO: 96700 - RNA, 27 nt, Human
cugggcccugcccuuggcucaccuuuc

SEQ ID NO: 96701 - RNA, 23 nt, Human
caccacugccauuuccuccuggg

SEQ ID NO: 96702 - RNA, 20 nt, Human
gguuccuuccacuucugggg

SEQ ID NO: 96703 - RNA, 22 nt, Human
uacagcguucgaaacaaucaua

SEQ ID NO: 96704 - RNA, 19 nt, Human
ugaaaacugcaaugcuggg

SEQ ID NO: 96705 - RNA, 20 nt, Human
ccacagccaaguggagcucu

SEQ ID NO: 96706 - RNA, 26 nt, Human
ccagaagaagacaggaagaaucaaga

SEQ ID NO: 96707 - RNA, 27 nt, Human
ccccucggaagcuaguuaccauggagg

SEQ ID NO: 96708 - RNA, 23 nt, Human
gauuauacuuagccuccuccucc

SEQ ID NO: 96709 - RNA, 23 nt, Human
ccgcucucccccgggcgugggcc

SEQ ID NO: 96710 - RNA, 22 nt, Human
gugcuggacuguauggcugagg

SEQ ID NO: 96711 - RNA, 21 nt, Human
aacucugucuuucucaguuga

SEQ ID NO: 96712 - RNA, 22 nt, Human
cuccuggguuaggggcuuugcu

SEQ ID NO: 96713 - RNA, 20 nt, Human
agcaaccucgccccuugcaa

SEQ ID NO: 96714 - RNA, 22 nt, Human
aggcugaggcugggggauugcu

SEQ ID NO: 96715 - RNA, 22 nt, Human
ccacugcacuucagucugugug

SEQ ID NO: 96716 - RNA, 24 nt, Human
cugucccaggauggucccagcgga

SEQ ID NO: 96717 - RNA, 26 nt, Human
acaagugucugcuacagucgccaaau

SEQ ID NO: 96718 - RNA, 17 nt, Human
ggcuccagauuacuugg

SEQ ID NO: 96719 - RNA, 17 nt, Human
aucaaacuacugcccag

SEQ ID NO: 96720 - RNA, 24 nt, Human
caccuggggucaggaguucaagac

SEQ ID NO: 96721 - RNA, 28 nt, Human
gaguccuuaccgccucccuacccagcgg

SEQ ID NO: 96722 - RNA, 27 nt, Human
auccagagauuaaaaacagaaauaugg

SEQ ID NO: 96723 - RNA, 26 nt, Human
cugccucuuuucucuccccagccugc

SEQ ID NO: 96724 - RNA, 22 nt, Human
aagaccccauuaagccuaaagg

SEQ ID NO: 96725 - RNA, 22 nt, Human
acuugcugggacagugugggug

SEQ ID NO: 96726 - RNA, 22 nt, Human
cuucgaggcuuuacaguguaaa

SEQ ID NO: 96727 - RNA, 21 nt, Human
uauuagccaccaugccugucc

SEQ ID NO: 96728 - RNA, 23 nt, Human
gguguugggaggagccccgguga

SEQ ID NO: 96729 - RNA, 24 nt, Human
gggacagcugugugacauuuggag

SEQ ID NO: 96730 - RNA, 20 nt, Human
cucaucucacacuguacucu

SEQ ID NO: 96731 - RNA, 22 nt, Human
auccccacucgaacagggggcc

SEQ ID NO: 96732 - RNA, 19 nt, Human
gcacccaugucaguauuag

SEQ ID NO: 96733 - RNA, 25 nt, Human
cuccgcggcuggagcgaagccuucu

SEQ ID NO: 96734 - RNA, 23 nt, Human
agggcagccucccccggcucuac

SEQ ID NO: 96735 - RNA, 20 nt, Human
agaguauccacaaaauaguu

SEQ ID NO: 96736 - RNA, 23 nt, Human
ggcagugggugagccccuggugc

SEQ ID NO: 96737 - RNA, 22 nt, Human
ugggauuacaggcaugagccac

SEQ ID NO: 96738 - RNA, 20 nt, Human
uuccuagugggccaccccua

SEQ ID NO: 96739 - RNA, 20 nt, Human
uuacauacuguaacauucag

SEQ ID NO: 96740 - RNA, 21 nt, Human
ggguuuugagagagggggaag

SEQ ID NO: 96741 - RNA, 25 nt, Human
gcuccuccucucuuccuauagaaca

SEQ ID NO: 96742 - RNA, 22 nt, Human
aaugaagccucccggggugggg

SEQ ID NO: 96743 - RNA, 23 nt, Human
cgagcggugucuccuggggcucc

SEQ ID NO: 96744 - RNA, 23 nt, Human
gaggguucccgcagcuggggggu

SEQ ID NO: 96745 - RNA, 19 nt, Human
gaucuuccugaagaucucu

SEQ ID NO: 96746 - RNA, 21 nt, Human
ggccuagauuuggagacuuug

SEQ ID NO: 96747 - RNA, 22 nt, Human
caucccucaucaggguugccag

SEQ ID NO: 96748 - RNA, 22 nt, Human
cauuucacugugaugugcacau

SEQ ID NO: 96749 - RNA, 29 nt, Human
uaguauucuaauaaaagcauuuugaucgg

SEQ ID NO: 96750 - RNA, 26 nt, Human
gccucacagccaaggcuggacugggu

SEQ ID NO: 96751 - RNA, 26 nt, Human
ccgccucccccauccugggcgccccu

SEQ ID NO: 96752 - RNA, 23 nt, Human
ugacaagagcaaaacuccaucuc

SEQ ID NO: 96753 - RNA, 21 nt, Human
gcaguuucacugccaacuuuu

SEQ ID NO: 96754 - RNA, 16 nt, Human
guguaaaauggugcug

SEQ ID NO: 96755 - RNA, 20 nt, Human
ccuccacuccccucugaccc

SEQ ID NO: 96756 - RNA, 21 nt, Human
aagaacaucuggauuucaucc

SEQ ID NO: 96757 - RNA, 20 nt, Human
uuaagauuacaguucuguuu

SEQ ID NO: 96758 - RNA, 21 nt, Human
ugcuuucauuguuuuauuucu

SEQ ID NO: 96759 - RNA, 26 nt, Human
ccucugggcggccuucuuuccuuucu

SEQ ID NO: 96760 - RNA, 25 nt, Human
gugggcuccccucuuccucuugacc

SEQ ID NO: 96761 - RNA, 25 nt, Human
auuccuggaaccuggaccccagccu

SEQ ID NO: 96762 - RNA, 25 nt, Human
cccaucugccucugcugcacacaca

SEQ ID NO: 96763 - RNA, 29 nt, Human
uggacacucucugcccugccucccucugc

SEQ ID NO: 96764 - RNA, 22 nt, Human
caaacagacaagcaggcaggca

SEQ ID NO: 96765 - RNA, 26 nt, Human
aauuuaguucaaacaagacgccaaca

SEQ ID NO: 96766 - RNA, 27 nt, Human
ugcucuuggccacugugcucccauuuc

SEQ ID NO: 96767 - RNA, 22 nt, Human
ccaaggugggaggauugcuuga

SEQ ID NO: 96768 - RNA, 26 nt, Human
uccagaaggaaaagugugucagggca

SEQ ID NO: 96769 - RNA, 22 nt, Human
gcugagcagucccccuuugcca

SEQ ID NO: 96770 - RNA, 25 nt, Human
cguauuagccaggauggucuugauc

SEQ ID NO: 96771 - RNA, 20 nt, Human
ucuggauaggaagaaauaua

SEQ ID NO: 96772 - RNA, 20 nt, Human
ucagcacuguuuugauagau

SEQ ID NO: 96773 - RNA, 26 nt, Human
ugcuuuguuuaucaaccuugauuuua

SEQ ID NO: 96774 - RNA, 27 nt, Human
ucugggaggcagagguugcagugagcc

SEQ ID NO: 96775 - RNA, 24 nt, Human
ccugucuugucuguguggcuucuc

SEQ ID NO: 96776 - RNA, 28 nt, Human
gucagcucaggcuggagcaggcauauga

SEQ ID NO: 96777 - RNA, 19 nt, Human
aucuucagaaguugaagua

SEQ ID NO: 96778 - RNA, 27 nt, Human
gccuaucuccagauugucugauuucug

SEQ ID NO: 96779 - RNA, 21 nt, Human
cccucugccuccugcuuugcu

SEQ ID NO: 96780 - RNA, 25 nt, Human
ucccucuguccccagggccucccuu

SEQ ID NO: 96781 - RNA, 25 nt, Human
gucucccacccugagauugggcaug

SEQ ID NO: 96782 - RNA, 27 nt, Human
acacaggugcaacagacuugaaugcua

SEQ ID NO: 96783 - RNA, 23 nt, Human
ugcagcucuggaaagaggguuua

SEQ ID NO: 96784 - RNA, 20 nt, Human
cccgggcccauacaggacca

SEQ ID NO: 96785 - RNA, 19 nt, Human
uuucucaaacugagcuuca

SEQ ID NO: 96786 - RNA, 22 nt, Human
cagcuccagggccugggccacu

SEQ ID NO: 96787 - RNA, 21 nt, Human
ccuugcuacagccucugcccu

SEQ ID NO: 96788 - RNA, 27 nt, Human
gaccccugcccaggcucaggcccauga

SEQ ID NO: 96789 - RNA, 26 nt, Human
gucgcccagcacccuggagaagcaug

SEQ ID NO: 96790 - RNA, 27 nt, Human
auacauuuaauaaaacugcgaggacau

SEQ ID NO: 96791 - RNA, 22 nt, Human
ugggcacauuagccuaugugca

SEQ ID NO: 96792 - RNA, 19 nt, Human
aagauuaaaugaaugaaua

SEQ ID NO: 96793 - RNA, 25 nt, Human
agggagggagagaacauucagcagc

SEQ ID NO: 96794 - RNA, 22 nt, Human
agaccagccuguccaacauggu

SEQ ID NO: 96795 - RNA, 23 nt, Human
uuauuaaaaaacauuguguaucu

SEQ ID NO: 96796 - RNA, 25 nt, Human
gguggcaggcagagcaggaugcaga

SEQ ID NO: 96797 - RNA, 20 nt, Human
uucucauaacuauguccacc

SEQ ID NO: 96798 - RNA, 26 nt, Human
aacugcacuccagccugggcaacaua

SEQ ID NO: 96799 - RNA, 22 nt, Human
cggcaggcguguguuacagugg

SEQ ID NO: 96800 - RNA, 21 nt, Human
uggagcccagguugcaggugg

SEQ ID NO: 96801 - RNA, 27 nt, Human
ucccacaugugucaccuccccaucauc

SEQ ID NO: 96802 - RNA, 24 nt, Human
cggaguaggagcacuggggugggg

SEQ ID NO: 96803 - RNA, 22 nt, Human
ugcagugagcugugaugacacc

SEQ ID NO: 96804 - RNA, 22 nt, Human
agcucugcucaggccccuucag

SEQ ID NO: 96805 - RNA, 24 nt, Human
uccccacucugggcuugugcacac

SEQ ID NO: 96806 - RNA, 25 nt, Human
cuucagguucucaugauaccaccuu

SEQ ID NO: 96807 - RNA, 23 nt, Human
agcccuagcugucccauggggaa

SEQ ID NO: 96808 - RNA, 21 nt, Human
cgcccaggcuggacugcagug

SEQ ID NO: 96809 - RNA, 22 nt, Human
cugaggugggagaauugccuga

SEQ ID NO: 96810 - RNA, 24 nt, Human
ccucuggauucauugucucucaca

SEQ ID NO: 96811 - RNA, 21 nt, Human
gcccagcccacccacauacca

SEQ ID NO: 96812 - RNA, 21 nt, Human
caauccucgucugaaucaucc

SEQ ID NO: 96813 - RNA, 20 nt, Human
acaggagaccuggcacugga

SEQ ID NO: 96814 - RNA, 20 nt, Human
ucagcucaggcuggagcagg

SEQ ID NO: 96815 - RNA, 27 nt, Human
uuccacccuccccauuuggagucugca

SEQ ID NO: 96816 - RNA, 24 nt, Human
cauuccccugacccuuuccccaca

SEQ ID NO: 96817 - RNA, 27 nt, Human
ugcuguugccgaauacucaggacggac

SEQ ID NO: 96818 - RNA, 26 nt, Human
acugggggcaggauggcggaaaggaa

SEQ ID NO: 96819 - RNA, 20 nt, Human
ccacaaacaugagguucaca

SEQ ID NO: 96820 - RNA, 22 nt, Human
caaacuccuggacucaugcaau

SEQ ID NO: 96821 - RNA, 22 nt, Human
caggagguggaggcugcgguga

SEQ ID NO: 96822 - RNA, 27 nt, Human
gaguaguugggauuacaggugacugcc

SEQ ID NO: 96823 - RNA, 22 nt, Human
agcaaauuuuuguauuuuuagu

SEQ ID NO: 96824 - RNA, 22 nt, Human
agcuaauuuuuguauuuuuugu

SEQ ID NO: 96825 - RNA, 20 nt, Human
cauggcagagaagcccaagc

SEQ ID NO: 96826 - RNA, 20 nt, Human
ggaggcggcggcugcagcgg

SEQ ID NO: 96827 - RNA, 20 nt, Human
ugaacaaagcacaucuuucc

SEQ ID NO: 96828 - RNA, 19 nt, Human
gaaccuggcccaccugucu

SEQ ID NO: 96829 - RNA, 23 nt, Human
cacuggcacugccuucucugccg

SEQ ID NO: 96830 - RNA, 21 nt, Human
gugcuuaaauggcacagcauu

SEQ ID NO: 96831 - RNA, 23 nt, Human
gccugucaccuccugaaaggcug

SEQ ID NO: 96832 - RNA, 20 nt, Human
uuccuggugugaagguccug

SEQ ID NO: 96833 - RNA, 18 nt, Human
uucuccucugccucaucc

SEQ ID NO: 96834 - RNA, 23 nt, Human
gaaaacugaauagcaacacugaa

SEQ ID NO: 96835 - RNA, 23 nt, Human
gccuuuuucucauucaagaaggc

SEQ ID NO: 96836 - RNA, 24 nt, Human
gccagcucaaggugggcacggggg

SEQ ID NO: 96837 - RNA, 17 nt, Human
cgcagccgcccggccag

SEQ ID NO: 96838 - RNA, 18 nt, Human
cccacaagcaccugcuca

SEQ ID NO: 96839 - RNA, 22 nt, Human
gcagaugccacaccugcuccuu

SEQ ID NO: 96840 - RNA, 25 nt, Human
gcaggaggguggcagagcugggaca

SEQ ID NO: 96841 - RNA, 19 nt, Human
gcacccaccaccacacccg

SEQ ID NO: 96842 - RNA, 22 nt, Human
gguaaaugcuugccgcuuuaga

SEQ ID NO: 96843 - RNA, 28 nt, Human
gaucagauaccugcuccaguaguuguga

SEQ ID NO: 96844 - RNA, 22 nt, Human
ucaucuaauaaaucagugaacu

SEQ ID NO: 96845 - RNA, 22 nt, Human
uugcccaggcuggagugcagua

SEQ ID NO: 96846 - RNA, 22 nt, Human
uugcccaggcuggggugcagug

SEQ ID NO: 96847 - RNA, 32 nt, Human
uguuuauuuuccaaucaagugaagauaucucc

SEQ ID NO: 96848 - RNA, 16 nt, Human
uccaacuaaugccuua

SEQ ID NO: 96849 - RNA, 21 nt, Human
ugcaguguucugugaauagca

SEQ ID NO: 96850 - RNA, 24 nt, Human
aggaugcacgguggcuagagccag

SEQ ID NO: 96851 - RNA, 27 nt, Human
ucaacuucucuaccccaaagaaaagau

SEQ ID NO: 96852 - RNA, 25 nt, Human
ucaccuugcccucauugucuucccu

SEQ ID NO: 96853 - RNA, 23 nt, Human
ccugcagccgcccagucccggcc

SEQ ID NO: 96854 - RNA, 25 nt, Human
ugaaaucccaugagccccgcugccc

SEQ ID NO: 96855 - RNA, 20 nt, Human
aaacugaaggcccgaugaga

SEQ ID NO: 96856 - RNA, 20 nt, Human
aggaacacuucuuuuggcca

SEQ ID NO: 96857 - RNA, 23 nt, Human
aucguaccgcugcacuccagccu

SEQ ID NO: 96858 - RNA, 19 nt, Human
ccuacuuccuuacccccga

SEQ ID NO: 96859 - RNA, 25 nt, Human
caguggggcucucugaguccuggcc

SEQ ID NO: 96860 - RNA, 21 nt, Human
uuuggcucuggcugggugugg

SEQ ID NO: 96861 - RNA, 24 nt, Human
ggaggaaagcaaagaccuccauuu

SEQ ID NO: 96862 - RNA, 22 nt, Human
ugcaagaaguaagagcauuugu

SEQ ID NO: 96863 - RNA, 26 nt, Human
aaccuauacuucauaugcugcuuuag

SEQ ID NO: 96864 - RNA, 21 nt, Human
caggccucccgaaguccugaa

SEQ ID NO: 96865 - RNA, 22 nt, Human
ccaagauucuucagucuggacu

SEQ ID NO: 96866 - RNA, 26 nt, Human
ucuccuuagaaguggaaguaguggag

SEQ ID NO: 96867 - RNA, 23 nt, Human
caccgaggcuggagugcaguggc

SEQ ID NO: 96868 - RNA, 20 nt, Human
ccacgcauccuuccucacca

SEQ ID NO: 96869 - RNA, 20 nt, Human
auggcagcagaaagaggugg

SEQ ID NO: 96870 - RNA, 27 nt, Human
uuucauaucccuuuacaaugaauuuuu

SEQ ID NO: 96871 - RNA, 24 nt, Human
aucuuagguggagcuacuccccac

SEQ ID NO: 96872 - RNA, 23 nt, Human
ggaggcggcaguggcgagcuggg

SEQ ID NO: 96873 - RNA, 22 nt, Human
guuucaggcgcucguguuuucc

SEQ ID NO: 96874 - RNA, 27 nt, Human
uuucuugccaaaggcgguuccacccuc

SEQ ID NO: 96875 - RNA, 20 nt, Human
gagggaacccaggaauugug

SEQ ID NO: 96876 - RNA, 27 nt, Human
uggaaagugggacugagagggagucag

SEQ ID NO: 96877 - RNA, 19 nt, Human
gggagagagcagcagcaag

SEQ ID NO: 96878 - RNA, 23 nt, Human
gagucucaguucugaaauuuuga

SEQ ID NO: 96879 - RNA, 27 nt, Human
agcucacucaggaauucacacccgccu

SEQ ID NO: 96880 - RNA, 21 nt, Human
aggggcuuucagggaggcugg

SEQ ID NO: 96881 - RNA, 21 nt, Human
gguaacacugaaaaacaaaac

SEQ ID NO: 96882 - RNA, 24 nt, Human
ccucugcuccugcuccugccugca

SEQ ID NO: 96883 - RNA, 21 nt, Human
aggagguccugacaacaggug

SEQ ID NO: 96884 - RNA, 23 nt, Human
auacuuaccuacauacacugcau

SEQ ID NO: 96885 - RNA, 21 nt, Human
ucuggcugaaggggugggcau

SEQ ID NO: 96886 - RNA, 25 nt, Human
cugccucccucucuggcccugggag

SEQ ID NO: 96887 - RNA, 26 nt, Human
ucuccucucugggugauugcgcgggc

SEQ ID NO: 96888 - RNA, 24 nt, Human
cgugagccagaggggagggggccg

SEQ ID NO: 96889 - RNA, 26 nt, Human
uuguauaauguaaauuuauuucucca

SEQ ID NO: 96890 - RNA, 28 nt, Human
uguuaauuuugaauacagcaaguguagg

SEQ ID NO: 96891 - RNA, 15 nt, Human
accauaaaacccuug

SEQ ID NO: 96892 - RNA, 17 nt, Human
ucuuuugacaggugccu

SEQ ID NO: 96893 - RNA, 27 nt, Human
uaaccaaaaggcaaaaauuacaaucgg

SEQ ID NO: 96894 - RNA, 22 nt, Human
auucauauaucuuauuucaaag

SEQ ID NO: 96895 - RNA, 22 nt, Human
ccgcccaccugccccugccucu

SEQ ID NO: 96896 - RNA, 27 nt, Human
ugaccgccauggagacgaagcugcccc

SEQ ID NO: 96897 - RNA, 22 nt, Human
gccaggcccacuguaacugccg

SEQ ID NO: 96898 - RNA, 19 nt, Human
gcuacccuugugaucuaca

SEQ ID NO: 96899 - RNA, 21 nt, Human
ggauugagucuugcugcucug

SEQ ID NO: 96900 - RNA, 21 nt, Human
uuuccacuugcaggccagcuu

SEQ ID NO: 96901 - RNA, 22 nt, Human
uucugcauucagcagcuauuua

SEQ ID NO: 96902 - RNA, 24 nt, Human
gagauuuccugugacaggccaagu

SEQ ID NO: 96903 - RNA, 22 nt, Human
aaaccugaaaugccucuuuagc

SEQ ID NO: 96904 - RNA, 19 nt, Human
augcuggguacaaugcuuc

SEQ ID NO: 96905 - RNA, 19 nt, Human
ccucuucuaccucuuccag

SEQ ID NO: 96906 - RNA, 24 nt, Human
uugcaaccucaccuuccugugggu

SEQ ID NO: 96907 - RNA, 27 nt, Human
guuacaacccaguaugcugagugccaa

SEQ ID NO: 96908 - RNA, 20 nt, Human
ggaggcagagguugcagcga

SEQ ID NO: 96909 - RNA, 27 nt, Human
cuccagccccugaccccaugucuccug

SEQ ID NO: 96910 - RNA, 22 nt, Human
aacuacccaugucuuucuggaa

SEQ ID NO: 96911 - RNA, 26 nt, Human
ucauucucugcagcagcugccugggc

SEQ ID NO: 96912 - RNA, 21 nt, Human
ucguuucuaaaaacaguugac

SEQ ID NO: 96913 - RNA, 24 nt, Human
cucucccugcuccagcaaggacca

SEQ ID NO: 96914 - RNA, 24 nt, Human
ugggauuuuaaaaacaugagaaau

SEQ ID NO: 96915 - RNA, 23 nt, Human
aggcuggagugcaguagcacgau

SEQ ID NO: 96916 - RNA, 23 nt, Human
aggcuggggugcaguggcacgau

SEQ ID NO: 96917 - RNA, 24 nt, Human
ucuguauugcuggcaucugugcua

SEQ ID NO: 96918 - RNA, 25 nt, Human
caguuucaguucacuccugccaagu

SEQ ID NO: 96919 - RNA, 23 nt, Human
ugucuucagacagcccugacagc

SEQ ID NO: 96920 - RNA, 22 nt, Human
cacuggguccagccuugaucag

SEQ ID NO: 96921 - RNA, 25 nt, Human
gggccugggaacugcuggcucuaag

SEQ ID NO: 96922 - RNA, 20 nt, Human
uguuagcuaaaggaucuuag

SEQ ID NO: 96923 - RNA, 22 nt, Human
cugcagccuugaacuccuggcc

SEQ ID NO: 96924 - RNA, 21 nt, Human
ucugaggcuggaagcugggaa

SEQ ID NO: 96925 - RNA, 20 nt, Human
uccuugugguuccucucuac

SEQ ID NO: 96926 - RNA, 24 nt, Human
ccaacuugaaaccauuuugucaca

SEQ ID NO: 96927 - RNA, 22 nt, Human
gcucugagagaggcggcagcgg

SEQ ID NO: 96928 - RNA, 27 nt, Human
uguuccuccacacauguaaaggcacag

SEQ ID NO: 96929 - RNA, 21 nt, Human
gcucacugcaaccuccaccuc

SEQ ID NO: 96930 - RNA, 21 nt, Human
ggagaugagagagggugagag

SEQ ID NO: 96931 - RNA, 21 nt, Human
ucuagaaagaaaacauuggaa

SEQ ID NO: 96932 - RNA, 22 nt, Human
auuaggggaucaguuguauuua

SEQ ID NO: 96933 - RNA, 26 nt, Human
cccggcgugucccuaccuccuccucu

SEQ ID NO: 96934 - RNA, 23 nt, Human
cugcccgccuccagcucucgggg

SEQ ID NO: 96935 - RNA, 22 nt, Human
cgcagcuccagccgccuccucc

SEQ ID NO: 96936 - RNA, 19 nt, Human
uguguucuucaagccagcu

SEQ ID NO: 96937 - RNA, 22 nt, Human
guucugaagaagaugguaccac

SEQ ID NO: 96938 - RNA, 21 nt, Human
aacuccucuuucuucauaguc

SEQ ID NO: 96939 - RNA, 21 nt, Human
cuucuuucccuaccgccccac

SEQ ID NO: 96940 - RNA, 21 nt, Human
ucugucaggcaaagaugagga

SEQ ID NO: 96941 - RNA, 21 nt, Human
agcuguguguuccugggcuug

SEQ ID NO: 96942 - RNA, 24 nt, Human
cucggcaccagugccucagugcug

SEQ ID NO: 96943 - RNA, 26 nt, Human
ugucuuugugucucugugacucucau

SEQ ID NO: 96944 - RNA, 23 nt, Human
uuuaccuccauucccucuaccca

SEQ ID NO: 96945 - RNA, 24 nt, Human
agccccauucugccugcccaggcc

SEQ ID NO: 96946 - RNA, 23 nt, Human
cuuuaacuugucuucuaguuuag

SEQ ID NO: 96947 - RNA, 24 nt, Human
cagcaccccacuccagccucgagg

SEQ ID NO: 96948 - RNA, 23 nt, Human
ccuuucccucuuugcaguucagu

SEQ ID NO: 96949 - RNA, 24 nt, Human
ccuguucucuguccggaccagcca

SEQ ID NO: 96950 - RNA, 26 nt, Human
gcacagcccgcacugccccacgccgc

SEQ ID NO: 96951 - RNA, 26 nt, Human
ccagucucacaggagucagcauuggu

SEQ ID NO: 96952 - RNA, 17 nt, Human
cuccccucucccugcca

SEQ ID NO: 96953 - RNA, 27 nt, Human
uauguaucuuaguuacauuucuaucag

SEQ ID NO: 96954 - RNA, 25 nt, Human
auggcuuccuccucccuccugccga

SEQ ID NO: 96955 - RNA, 24 nt, Human
gcccagcuacauuccucagcugcc

SEQ ID NO: 96956 - RNA, 27 nt, Human
gagcccaaauggccaacuccacagggc

SEQ ID NO: 96957 - RNA, 26 nt, Human
ggaguauucuaauaagcuaguugaau

SEQ ID NO: 96958 - RNA, 22 nt, Human
acauauguagcaaauuuuguga

SEQ ID NO: 96959 - RNA, 24 nt, Human
cacucacucaugcauuuuuauuuc

SEQ ID NO: 96960 - RNA, 26 nt, Human
cccuccagauugccuggugaucuauu

SEQ ID NO: 96961 - RNA, 23 nt, Human
cccaccccguccaggagccaaca

SEQ ID NO: 96962 - RNA, 19 nt, Human
aacuaaaacuacuacuuac

SEQ ID NO: 96963 - RNA, 20 nt, Human
aaauaagauaacuccaucuc

SEQ ID NO: 96964 - RNA, 27 nt, Human
cuggucccugcucucaguucacugucu

SEQ ID NO: 96965 - RNA, 27 nt, Human
guauucucuucaccugaggcuuuccgu

SEQ ID NO: 96966 - RNA, 24 nt, Human
accucccuagagggagggagggag

SEQ ID NO: 96967 - RNA, 22 nt, Human
uugcccagucaauucagugauu

SEQ ID NO: 96968 - RNA, 26 nt, Human
uaaguugaaaaaggaaauauucuuuc

SEQ ID NO: 96969 - RNA, 21 nt, Human
gccauuacacuccagccuggg

SEQ ID NO: 96970 - RNA, 21 nt, Human
gccacugcacucuaaccuggg

SEQ ID NO: 96971 - RNA, 29 nt, Human
augggaggaucacuugaggccaagaguuu

SEQ ID NO: 96972 - RNA, 21 nt, Human
ugaauaauuccugcugcagca

SEQ ID NO: 96973 - RNA, 20 nt, Human
aaaaacaauaaauacuaugc

SEQ ID NO: 96974 - RNA, 23 nt, Human
ccccucgggcaccagccugcaua

SEQ ID NO: 96975 - RNA, 22 nt, Human
ccauuucuccccacccuggggc

SEQ ID NO: 96976 - RNA, 22 nt, Human
cccaccauguugcccaggcugg

SEQ ID NO: 96977 - RNA, 26 nt, Human
cacaaaccagguguuucugucucuuu

SEQ ID NO: 96978 - RNA, 27 nt, Human
cuaccugcccaacugugaccaacuaaa

SEQ ID NO: 96979 - RNA, 21 nt, Human
gcgccagcgaccucucugccu

SEQ ID NO: 96980 - RNA, 22 nt, Human
uucccauggccccuugcauuuc

SEQ ID NO: 96981 - RNA, 21 nt, Human
cauucucuuauuaauucuuua

SEQ ID NO: 96982 - RNA, 22 nt, Human
ucuguaggcuaaaaauauucau

SEQ ID NO: 96983 - RNA, 22 nt, Human
gcauuagugccugguuacuggg

SEQ ID NO: 96984 - RNA, 22 nt, Human
agcuuaaagcgcgucuuugccg

SEQ ID NO: 96985 - RNA, 25 nt, Human
aggugcuugaugaucaauaguuggu

SEQ ID NO: 96986 - RNA, 22 nt, Human
cgccacccauggcugcagugga

SEQ ID NO: 96987 - RNA, 27 nt, Human
gucuggguuugagaaaugaaauauugu

SEQ ID NO: 96988 - RNA, 22 nt, Human
ucugacauuuauccaagaccug

SEQ ID NO: 96989 - RNA, 27 nt, Human
gaggaaacgcccgcugugggcggagcc

SEQ ID NO: 96990 - RNA, 20 nt, Human
cccagccucaucuucuaggc

SEQ ID NO: 96991 - RNA, 23 nt, Human
aagucagaacucagaacacugcc

SEQ ID NO: 96992 - RNA, 28 nt, Human
aggccgucacccugggagcagucggcac

SEQ ID NO: 96993 - RNA, 22 nt, Human
agccucccuaguagcugggacu

SEQ ID NO: 96994 - RNA, 23 nt, Human
augaucugaaagguguggaaaga

SEQ ID NO: 96995 - RNA, 20 nt, Human
aguccuaagaaguggggcag

SEQ ID NO: 96996 - RNA, 27 nt, Human
ggcucaugccuguaaucccagcauuuu

SEQ ID NO: 96997 - RNA, 24 nt, Human
guuacuguacacagaagugugugc

SEQ ID NO: 96998 - RNA, 27 nt, Human
ccuuugucccuaucauacuagaugcua

SEQ ID NO: 96999 - RNA, 24 nt, Human
ccgacuuggaaaugugaacgcaag

SEQ ID NO: 97000 - RNA, 20 nt, Human
aguuuucuagagacuugaag

SEQ ID NO: 97001 - RNA, 19 nt, Human
aaagugacaugaaaauuac

SEQ ID NO: 97002 - RNA, 31 nt, Human
ucaccagacggggcuggagugugaggguccu

SEQ ID NO: 97003 - RNA, 22 nt, Human
aacugaagaccauuuucaagag

SEQ ID NO: 97004 - RNA, 26 nt, Human
ugaagcugccuucaccacugccuacc

SEQ ID NO: 97005 - RNA, 20 nt, Human
gguauuugguaacuugcugu

SEQ ID NO: 97006 - RNA, 20 nt, Human
ccacugcaccuggaaaggag

SEQ ID NO: 97007 - RNA, 22 nt, Human
uuugaggccauuguggagccag

SEQ ID NO: 97008 - RNA, 22 nt, Human
caggagauggaaguugcaguga

SEQ ID NO: 97009 - RNA, 24 nt, Human
uucuuucucccacuuucuaggauc

SEQ ID NO: 97010 - RNA, 27 nt, Human
ugccuguaaauuucagcaagccguguu

SEQ ID NO: 97011 - RNA, 27 nt, Human
uacacuggagugcuuuauuuagcaaua

SEQ ID NO: 97012 - RNA, 22 nt, Human
cacgaguucaggagaucgagac

SEQ ID NO: 97013 - RNA, 27 nt, Human
gccaggcaugugggugugggugcaaug

SEQ ID NO: 97014 - RNA, 22 nt, Human
ugccuccaaggacugucuggca

SEQ ID NO: 97015 - RNA, 23 nt, Human
gauaccaccuuuacugugcuuau

SEQ ID NO: 97016 - RNA, 22 nt, Human
ggguggaaugaggaacaucuuc

SEQ ID NO: 97017 - RNA, 24 nt, Human
ggaaauguuuucuucuacauggaa

SEQ ID NO: 97018 - RNA, 22 nt, Human
gcgaagugccuuaugcuaugag

SEQ ID NO: 97019 - RNA, 21 nt, Human
ucauuauuuugcuuuauuaaa

SEQ ID NO: 97020 - RNA, 26 nt, Human
uuuauugcucaucuacuucgggccag

SEQ ID NO: 97021 - RNA, 25 nt, Human
gcccucaggugauccacccaccuca

SEQ ID NO: 97022 - RNA, 24 nt, Human
gcacuguacauaccugcccccuca

SEQ ID NO: 97023 - RNA, 23 nt, Human
gcucacccaggcugagggugccu

SEQ ID NO: 97024 - RNA, 19 nt, Human
uuuccccucuguguccucu

SEQ ID NO: 97025 - RNA, 22 nt, Human
ccuccugcagggccugugagcu

SEQ ID NO: 97026 - RNA, 18 nt, Human
acaauacuguugugcgca

SEQ ID NO: 97027 - RNA, 22 nt, Human
cugcaagcuacuacucauucca

SEQ ID NO: 97028 - RNA, 22 nt, Human
aaacuccuggauuuaagcucag

SEQ ID NO: 97029 - RNA, 27 nt, Human
uguuuuuaaaaaccuauuuugaaaggu

SEQ ID NO: 97030 - RNA, 22 nt, Human
accuguaauccuugcauuuugg

SEQ ID NO: 97031 - RNA, 25 nt, Human
acuggguacagccugggugcaguua

SEQ ID NO: 97032 - RNA, 19 nt, Human
ucugugggcuucagcacuu

SEQ ID NO: 97033 - RNA, 20 nt, Human
cacugcgucugggccugaga

SEQ ID NO: 97034 - RNA, 20 nt, Human
gccaaucucagcccuccacg

SEQ ID NO: 97035 - RNA, 21 nt, Human
uuuaaaccauuguuguugagu

SEQ ID NO: 97036 - RNA, 24 nt, Human
caggaccucaggugagaagcagag

SEQ ID NO: 97037 - RNA, 23 nt, Human
acacauuuaaguuuacaaaucag

SEQ ID NO: 97038 - RNA, 23 nt, Human
auccuuuauuaauucagccagug

SEQ ID NO: 97039 - RNA, 22 nt, Human
cccaaaauggugggauuacagg

SEQ ID NO: 97040 - RNA, 23 nt, Human
ccuacuaaccuguuccuuggaua

SEQ ID NO: 97041 - RNA, 22 nt, Human
aagcugaggcaggaggaucacc

SEQ ID NO: 97042 - RNA, 21 nt, Human
ccuguaauccuagcuacuugg

SEQ ID NO: 97043 - RNA, 27 nt, Human
cccaccccacggcggggacagaugcgg

SEQ ID NO: 97044 - RNA, 22 nt, Human
gcaagggcaguagcuuaaauac

SEQ ID NO: 97045 - RNA, 25 nt, Human
uuuucccaaccuccugugggccuca

SEQ ID NO: 97046 - RNA, 25 nt, Human
uucugaaaaacauccuuuuuuccag

SEQ ID NO: 97047 - RNA, 24 nt, Human
cuugguggcccuggaucuuguggc

SEQ ID NO: 97048 - RNA, 23 nt, Human
gcucauaccuguaaaucccagca

SEQ ID NO: 97049 - RNA, 19 nt, Human
aggaggcagaaauggaagc

SEQ ID NO: 97050 - RNA, 27 nt, Human
acuccaucagccaggcuggagugcagu

SEQ ID NO: 97051 - RNA, 26 nt, Human
acucgagacagggacagcgggaggcu

SEQ ID NO: 97052 - RNA, 25 nt, Human
guggcccucauaacuggaguagagu

SEQ ID NO: 97053 - RNA, 26 nt, Human
guggggcaguggaugggugcuuagua

SEQ ID NO: 97054 - RNA, 26 nt, Human
gagucuaagagagagggugucuguaa

SEQ ID NO: 97055 - RNA, 21 nt, Human
cccaaugcagaaagcuggugg

SEQ ID NO: 97056 - RNA, 26 nt, Human
cuuccuggucaccaaggcagugcaug

SEQ ID NO: 97057 - RNA, 21 nt, Human
acacauuuggugcacacuaca

SEQ ID NO: 97058 - RNA, 27 nt, Human
agguacaaugccugccaucauggguca

SEQ ID NO: 97059 - RNA, 20 nt, Human
acuguuuuucucacagcaga

SEQ ID NO: 97060 - RNA, 20 nt, Human
agcuuccagggcuugggugg

SEQ ID NO: 97061 - RNA, 21 nt, Human
gucccuuucugucccagcuca

SEQ ID NO: 97062 - RNA, 21 nt, Human
acaggaagaaagggaaggagg

SEQ ID NO: 97063 - RNA, 25 nt, Human
ucagauacagcuucaccuaugugcc

SEQ ID NO: 97064 - RNA, 22 nt, Human
uggcaggugccuguaauccuag

SEQ ID NO: 97065 - RNA, 22 nt, Human
uaggcuugguggccuguggaaa

SEQ ID NO: 97066 - RNA, 22 nt, Human
aagcaugcauacuuuaacuucu

SEQ ID NO: 97067 - RNA, 27 nt, Human
ccaaugccuccaccucuuggaccaggu

SEQ ID NO: 97068 - RNA, 19 nt, Human
ucuuuucuauaaguuuaca

SEQ ID NO: 97069 - RNA, 20 nt, Human
caggcagcugagggccagga

SEQ ID NO: 97070 - RNA, 26 nt, Human
aacacaaaaucuuguaggucauugca

SEQ ID NO: 97071 - RNA, 27 nt, Human
gaccugccuggccaacauggcaacacc

SEQ ID NO: 97072 - RNA, 21 nt, Human
uguguacaaacauuuuaaugu

SEQ ID NO: 97073 - RNA, 19 nt, Human
ccaucucccuccgugcucc

SEQ ID NO: 97074 - RNA, 25 nt, Human
cagcaggggaggcagcuugcaugcc

SEQ ID NO: 97075 - RNA, 23 nt, Human
ugcacacaccgaagugcucgagg

SEQ ID NO: 97076 - RNA, 19 nt, Human
agaaaacaauaugguguuu

SEQ ID NO: 97077 - RNA, 20 nt, Human
ggagagaagggggacguuuc

SEQ ID NO: 97078 - RNA, 23 nt, Human
ggccuguaauuccagcuacucug

SEQ ID NO: 97079 - RNA, 24 nt, Human
cacugguucuggccuuuccugccu

SEQ ID NO: 97080 - RNA, 21 nt, Human
aacucuauucauuccuugcca

SEQ ID NO: 97081 - RNA, 21 nt, Human
guuuuuaguauuuccuaaaac

SEQ ID NO: 97082 - RNA, 22 nt, Human
auuuuguuugguauuguauuua

SEQ ID NO: 97083 - RNA, 26 nt, Human
ugcccaggcuggagugcaguagcacg

SEQ ID NO: 97084 - RNA, 26 nt, Human
ccuccuucgccuuaccuccuggagcu

SEQ ID NO: 97085 - RNA, 22 nt, Human
ccggaguagcugggaccacagg

SEQ ID NO: 97086 - RNA, 21 nt, Human
gaccuuuuaaucagagcccag

SEQ ID NO: 97087 - RNA, 22 nt, Human
gcccauucagagcuauggugcu

SEQ ID NO: 97088 - RNA, 25 nt, Human
guggagcugagcaacugaaccugaa

SEQ ID NO: 97089 - RNA, 21 nt, Human
gcuggucuugaauuccugggc

SEQ ID NO: 97090 - RNA, 22 nt, Human
agccccaucuccgggcguguca

SEQ ID NO: 97091 - RNA, 22 nt, Human
ccccucucccugcauggcaucc

SEQ ID NO: 97092 - RNA, 23 nt, Human
aaagggggaaagaaacaccugag

SEQ ID NO: 97093 - RNA, 27 nt, Human
cugcugcacuccagccugcgggacaga

SEQ ID NO: 97094 - RNA, 21 nt, Human
uggucacauuacaucucucca

SEQ ID NO: 97095 - RNA, 23 nt, Human
auccuacugacuaccucuugcuu

SEQ ID NO: 97096 - RNA, 27 nt, Human
ccugugcagaagggcuacugccccuua

SEQ ID NO: 97097 - RNA, 27 nt, Human
uugaggagagcgccucccguccgaggc

SEQ ID NO: 97098 - RNA, 19 nt, Human
gggauuacagguggugacu

SEQ ID NO: 97099 - RNA, 20 nt, Human
caaugaucuuaacaccggaa

SEQ ID NO: 97100 - RNA, 21 nt, Human
uagccuguuaauuuucuugaa

SEQ ID NO: 97101 - RNA, 17 nt, Human
agaaauucugcaguggc

SEQ ID NO: 97102 - RNA, 26 nt, Human
ucacagucuacugacuuuucccauuc

SEQ ID NO: 97103 - RNA, 24 nt, Human
acauuauccagcugguuguguaca

SEQ ID NO: 97104 - RNA, 20 nt, Human
guguuuuuauaacugucacc

SEQ ID NO: 97105 - RNA, 24 nt, Human
uuugccugcccugccuugcuuggc

SEQ ID NO: 97106 - RNA, 22 nt, Human
gcccagucucgguuccaguucu

SEQ ID NO: 97107 - RNA, 23 nt, Human
uuguuucuguucuuauguaaaua

SEQ ID NO: 97108 - RNA, 26 nt, Human
agcuggacugcauugaaggcgaggcu

SEQ ID NO: 97109 - RNA, 26 nt, Human
uuccuaauucacacagagcgucagaa

SEQ ID NO: 97110 - RNA, 18 nt, Human
ugcaagcaguggggaagg

SEQ ID NO: 97111 - RNA, 20 nt, Human
aagcacacauuuuauucaca

SEQ ID NO: 97112 - RNA, 21 nt, Human
aaugccugcaacccagggcag

SEQ ID NO: 97113 - RNA, 25 nt, Human
agaaguuaagcagccuuucugugga

SEQ ID NO: 97114 - RNA, 26 nt, Human
agacaucucaucagccacuuguguga

SEQ ID NO: 97115 - RNA, 26 nt, Human
acccagcaugacauaacagugcaggg

SEQ ID NO: 97116 - RNA, 22 nt, Human
ugggaagugcagguugcaguga

SEQ ID NO: 97117 - RNA, 26 nt, Human
gaugcaaggucuaucucucccaucag

SEQ ID NO: 97118 - RNA, 20 nt, Human
cagacuguuucucaguuauu

SEQ ID NO: 97119 - RNA, 19 nt, Human
gaauggagagugauguggg

SEQ ID NO: 97120 - RNA, 25 nt, Human
gguauugcuugccacuaagccauga

SEQ ID NO: 97121 - RNA, 21 nt, Human
gcucccucccccuccuucccc

SEQ ID NO: 97122 - RNA, 21 nt, Human
ggcuuacugcaaccuccgccu

SEQ ID NO: 97123 - RNA, 21 nt, Human
gacucacugcaaucuccaccu

SEQ ID NO: 97124 - RNA, 21 nt, Human
cuucugcugaggauuaccauu

SEQ ID NO: 97125 - RNA, 21 nt, Human
uuauuuuuugggaugaugcca

SEQ ID NO: 97126 - RNA, 22 nt, Human
cacugcacuccagcucggggaa

SEQ ID NO: 97127 - RNA, 20 nt, Human
uggcccccacccaccuuccu

SEQ ID NO: 97128 - RNA, 21 nt, Human
gauuaaaacaugacccaccau

SEQ ID NO: 97129 - RNA, 20 nt, Human
caaugagagaucugugaaga

SEQ ID NO: 97130 - RNA, 20 nt, Human
acugaccauggaccugcacu

SEQ ID NO: 97131 - RNA, 26 nt, Human
ggccaucuuccagguggggugaggca

SEQ ID NO: 97132 - RNA, 21 nt, Human
ucugaaagcuugcccugccgc

SEQ ID NO: 97133 - RNA, 22 nt, Human
ugaaaaguuugaugcauuuuga

SEQ ID NO: 97134 - RNA, 22 nt, Human
uucuuugaaggcaaccagugca

SEQ ID NO: 97135 - RNA, 22 nt, Human
uguugcccaggcuggagggcaa

SEQ ID NO: 97136 - RNA, 22 nt, Human
uguugcccaugcuggagugcaa

SEQ ID NO: 97137 - RNA, 27 nt, Human
gaguagcugggaucgcaggcgccugcc

SEQ ID NO: 97138 - RNA, 21 nt, Human
gacugcacuccagccugggug

SEQ ID NO: 97139 - RNA, 25 nt, Human
cccuggauauguccagucauccugc

SEQ ID NO: 97140 - RNA, 23 nt, Human
aggaggacgugucaagacugcuu

SEQ ID NO: 97141 - RNA, 21 nt, Human
uuaggcugaguuggguggaga

SEQ ID NO: 97142 - RNA, 21 nt, Human
auuucuaauuuaucacuguac

SEQ ID NO: 97143 - RNA, 21 nt, Human
uugcucugucuccucaguuaa

SEQ ID NO: 97144 - RNA, 24 nt, Human
uuaagacgacaucuccgcgaacgc

SEQ ID NO: 97145 - RNA, 30 nt, Human
uagugcccucucucugggcccagggcugug

SEQ ID NO: 97146 - RNA, 26 nt, Human
uggaaagaguaaaaugauaacuuacc

SEQ ID NO: 97147 - RNA, 26 nt, Human
uaacccacagauagaucaaccuaaga

SEQ ID NO: 97148 - RNA, 21 nt, Human
acccucuccuggggguggcag

SEQ ID NO: 97149 - RNA, 20 nt, Human
caccacugucccuucacugc

SEQ ID NO: 97150 - RNA, 27 nt, Human
gugaguuguugugacaaccacaagcac

SEQ ID NO: 97151 - RNA, 23 nt, Human
aaaucacugugauuugaagccuu

SEQ ID NO: 97152 - RNA, 25 nt, Human
gcacagucggcugggcggugcaaug

SEQ ID NO: 97153 - RNA, 23 nt, Human
cuccugggcagggccugccuccu

SEQ ID NO: 97154 - RNA, 24 nt, Human
gcugacucuugaaaacagugcaaa

SEQ ID NO: 97155 - RNA, 21 nt, Human
gggagcuggggcagggacuac

SEQ ID NO: 97156 - RNA, 23 nt, Human
accacgcccggcuaauuuuuucu

SEQ ID NO: 97157 - RNA, 23 nt, Human
ggaugucaucugaggugagacca

SEQ ID NO: 97158 - RNA, 23 nt, Human
uccugucauccccuacacuuugg

SEQ ID NO: 97159 - RNA, 26 nt, Human
cuggaugugucggggcuggggcugaa

SEQ ID NO: 97160 - RNA, 21 nt, Human
ggacucaggcuggaggcagau

SEQ ID NO: 97161 - RNA, 24 nt, Human
acuauuggacuggacucaggcugg

SEQ ID NO: 97162 - RNA, 27 nt, Human
gaguagcugggauuacaggugccugcc

SEQ ID NO: 97163 - RNA, 21 nt, Human
ugggaggccaagaugggagga

SEQ ID NO: 97164 - RNA, 21 nt, Human
gcccgcgagguggcccccagg

SEQ ID NO: 97165 - RNA, 22 nt, Human
ugagagaugggaaaaaccugaa

SEQ ID NO: 97166 - RNA, 22 nt, Human
acagccugcugguuuuacauua

SEQ ID NO: 97167 - RNA, 29 nt, Human
ggcagucugggcacuuuucugcaagucca

SEQ ID NO: 97168 - RNA, 23 nt, Human
ccccugccucuaccuucauucca

SEQ ID NO: 97169 - RNA, 19 nt, Human
gcccaggauagauguaaua

SEQ ID NO: 97170 - RNA, 27 nt, Human
agauugcacacugcacuccagccuggg

SEQ ID NO: 97171 - RNA, 23 nt, Human
ugcaugugaacaccaucaugccu

SEQ ID NO: 97172 - RNA, 17 nt, Human
accacugcaauaucuuc

SEQ ID NO: 97173 - RNA, 26 nt, Human
cccuugccugugccaggugaggucag

SEQ ID NO: 97174 - RNA, 23 nt, Human
aggccuuucccaucuggagagaa

SEQ ID NO: 97175 - RNA, 21 nt, Human
uucuccucuccccaggaugcu

SEQ ID NO: 97176 - RNA, 25 nt, Human
gccugggacaacugcucccaccucc

SEQ ID NO: 97177 - RNA, 20 nt, Human
ucagucuucccaucuguaca

SEQ ID NO: 97178 - RNA, 21 nt, Human
gcucccgcccagccugugugg

SEQ ID NO: 97179 - RNA, 25 nt, Human
uuaagagucaauuuaauaaguuuaa

SEQ ID NO: 97180 - RNA, 22 nt, Human
gguuucauauaaacuauggaca

SEQ ID NO: 97181 - RNA, 26 nt, Human
aauuccagaguacuguccucuacucu

SEQ ID NO: 97182 - RNA, 25 nt, Human
gacacuccuugcagggacugagcug

SEQ ID NO: 97183 - RNA, 22 nt, Human
agaccagcccagccaacauggu

SEQ ID NO: 97184 - RNA, 23 nt, Human
gccccaggugggcagcuguggca

SEQ ID NO: 97185 - RNA, 21 nt, Human
aguggcgggacuggcuucacu

SEQ ID NO: 97186 - RNA, 20 nt, Human
agcaagcccuggucaauggc

SEQ ID NO: 97187 - RNA, 24 nt, Human
cuucugcucacauucccucucauc

SEQ ID NO: 97188 - RNA, 24 nt, Human
uccucaguccagucgcuccuuagc

SEQ ID NO: 97189 - RNA, 22 nt, Human
uaugcugugcuggaauauuguu

SEQ ID NO: 97190 - RNA, 31 nt, Human
ggcuggugucaaacuccugggcucagucagu

SEQ ID NO: 97191 - RNA, 22 nt, Human
agucuuuacggaaagcacgcuc

SEQ ID NO: 97192 - RNA, 23 nt, Human
gggugggcggaggaagcgguuag

SEQ ID NO: 97193 - RNA, 28 nt, Human
gggauaagagaauaguuuccuggaagau

SEQ ID NO: 97194 - RNA, 23 nt, Human
cccugagaaagcugguacggggc

SEQ ID NO: 97195 - RNA, 23 nt, Human
gccuguaaucgcagcuacucagg

SEQ ID NO: 97196 - RNA, 20 nt, Human
acaggcugacauagaaaaua

SEQ ID NO: 97197 - RNA, 23 nt, Human
agagaggcuugcuugggauauag

SEQ ID NO: 97198 - RNA, 23 nt, Human
uugcaaccuuuccuucugcuagg

SEQ ID NO: 97199 - RNA, 22 nt, Human
cauuguacuccagcuugggcaa

SEQ ID NO: 97200 - RNA, 20 nt, Human
guuugaguccagccugggug

SEQ ID NO: 97201 - RNA, 25 nt, Human
caccuugcccuggugucuuuuucca

SEQ ID NO: 97202 - RNA, 27 nt, Human
guuauuuuucuuuuuaagagauacuua

SEQ ID NO: 97203 - RNA, 21 nt, Human
ugacugcacuggugggccggc

SEQ ID NO: 97204 - RNA, 24 nt, Human
aucacacaaaugauguuauuuugg

SEQ ID NO: 97205 - RNA, 22 nt, Human
cccaaaguguugggauuauagg

SEQ ID NO: 97206 - RNA, 22 nt, Human
caacacagugaaacuccaucuc

SEQ ID NO: 97207 - RNA, 23 nt, Human
gagaggaagggaagaauuggggg

SEQ ID NO: 97208 - RNA, 23 nt, Human
gugggaugcacacggaugacaga

SEQ ID NO: 97209 - RNA, 22 nt, Human
caguacugcaagaaaagaaguc

SEQ ID NO: 97210 - RNA, 19 nt, Human
ggcuguagaucagagguuc

SEQ ID NO: 97211 - RNA, 27 nt, Human
ugccauccugcugccuucccagugggg

SEQ ID NO: 97212 - RNA, 21 nt, Human
cugucccagguggcuuacaga

SEQ ID NO: 97213 - RNA, 27 nt, Human
uuguuucuguucuaaauggauaauuug

SEQ ID NO: 97214 - RNA, 26 nt, Human
cuaggagccucacagcgcagaucagg

SEQ ID NO: 97215 - RNA, 20 nt, Human
gcugggacuacagauguggg

SEQ ID NO: 97216 - RNA, 23 nt, Human
caguugcugcaaaguccuggauc

SEQ ID NO: 97217 - RNA, 22 nt, Human
uuuuuaaaaucaguacuuuuua

SEQ ID NO: 97218 - RNA, 28 nt, Human
cgagggagagagaggacaccgaagccgg

SEQ ID NO: 97219 - RNA, 21 nt, Human
ucccauaaaugggaacaaaua

SEQ ID NO: 97220 - RNA, 25 nt, Human
gagagugagagagagugagagcaca

SEQ ID NO: 97221 - RNA, 27 nt, Human
uccuccagggggcgcugucucccuccu

SEQ ID NO: 97222 - RNA, 21 nt, Human
cggcucggccugacugcucca

SEQ ID NO: 97223 - RNA, 21 nt, Human
agucauuccuucuccuuucca

SEQ ID NO: 97224 - RNA, 23 nt, Human
agccuagccagggcuuacuccag

SEQ ID NO: 97225 - RNA, 24 nt, Human
ucuccaauguuacgcucgcuugcc

SEQ ID NO: 97226 - RNA, 26 nt, Human
cagugucccgugaaauacauuuuguu

SEQ ID NO: 97227 - RNA, 26 nt, Human
ugcucaggcuggggaacagagaggca

SEQ ID NO: 97228 - RNA, 20 nt, Human
uucagccugggggauacagu

SEQ ID NO: 97229 - RNA, 23 nt, Human
acucuacugugccuaugcuuuua

SEQ ID NO: 97230 - RNA, 19 nt, Human
aaagguuucccaaaccacu

SEQ ID NO: 97231 - RNA, 20 nt, Human
cucacaucuuucacacuucc

SEQ ID NO: 97232 - RNA, 17 nt, Human
agccaaaacaaacacag

SEQ ID NO: 97233 - RNA, 21 nt, Human
gcucacugcaagcucugccuc

SEQ ID NO: 97234 - RNA, 22 nt, Human
ccuccucucuccucugugcuca

SEQ ID NO: 97235 - RNA, 21 nt, Human
cuaugcuuucucuccuaggag

SEQ ID NO: 97236 - RNA, 20 nt, Human
ugaggagggaaaucuggaca

SEQ ID NO: 97237 - RNA, 21 nt, Human
ccucauuugccuucccuaccu

SEQ ID NO: 97238 - RNA, 24 nt, Human
ugacuauucagaaacaauaaucca

SEQ ID NO: 97239 - RNA, 23 nt, Human
gaagaauugaggcugcuugggag

SEQ ID NO: 97240 - RNA, 24 nt, Human
ucuuagcaacauuuucuuuuucuu

SEQ ID NO: 97241 - RNA, 21 nt, Human
gagaauugcuguggagaguua

SEQ ID NO: 97242 - RNA, 25 nt, Human
acaaucagcucuuucugcaugugcu

SEQ ID NO: 97243 - RNA, 23 nt, Human
gguggggcaucaccaccucacug

SEQ ID NO: 97244 - RNA, 16 nt, Human
ucuccuccauuuuggu

SEQ ID NO: 97245 - RNA, 22 nt, Human
ggaccagccugggcaacauagg

SEQ ID NO: 97246 - RNA, 24 nt, Human
ugucacugcagcugccccugcccu

SEQ ID NO: 97247 - RNA, 22 nt, Human
ugccguuuuuacccugcccugg

SEQ ID NO: 97248 - RNA, 22 nt, Human
cuccaaagcgcccucccgccuc

SEQ ID NO: 97249 - RNA, 24 nt, Human
gguuagguugcauuucuaccccau

SEQ ID NO: 97250 - RNA, 24 nt, Human
cucuucuggccuccuuggccucau

SEQ ID NO: 97251 - RNA, 27 nt, Human
gggaggaagaggauggcagggccacgc

SEQ ID NO: 97252 - RNA, 21 nt, Human
gaggcugcaggaugaugcggu

SEQ ID NO: 97253 - RNA, 27 nt, Human
agaagcagcaguggcagcuugggaaau

SEQ ID NO: 97254 - RNA, 20 nt, Human
ccaggagaaggggcuuugug

SEQ ID NO: 97255 - RNA, 19 nt, Human
gcuggagagaaacuaguga

SEQ ID NO: 97256 - RNA, 24 nt, Human
ccagggaagacccugaccguguac

SEQ ID NO: 97257 - RNA, 28 nt, Human
ugcccaguaucauacguugauaguuuac

SEQ ID NO: 97258 - RNA, 27 nt, Human
caugccuuguugauaaagguucagacu

SEQ ID NO: 97259 - RNA, 22 nt, Human
gucgccuaggcuggagugcagu

SEQ ID NO: 97260 - RNA, 22 nt, Human
cagauccucucuggggcugugu

SEQ ID NO: 97261 - RNA, 21 nt, Human
agggaaagacauucagaccca

SEQ ID NO: 97262 - RNA, 15 nt, Human
cuuagaagcuucgaa

SEQ ID NO: 97263 - RNA, 26 nt, Human
ccaccuccuccagccuagguuguccu

SEQ ID NO: 97264 - RNA, 27 nt, Human
ggcuggguuuaguguacugaucuagaa

SEQ ID NO: 97265 - RNA, 19 nt, Human
ugggucucacgcagaggaa

SEQ ID NO: 97266 - RNA, 25 nt, Human
cacugcuccagccucagccagggca

SEQ ID NO: 97267 - RNA, 21 nt, Human
ucauacauagacagcacuugu

SEQ ID NO: 97268 - RNA, 27 nt, Human
ccaaacaacaguccaagauuaccauuu

SEQ ID NO: 97269 - RNA, 21 nt, Human
ugcagacacgccuuccccuca

SEQ ID NO: 97270 - RNA, 25 nt, Human
cucuugugacgcggaccucagugcc

SEQ ID NO: 97271 - RNA, 22 nt, Human
gucuggaucccagcaucuucuc

SEQ ID NO: 97272 - RNA, 22 nt, Human
cccucauuuaucacucugaccu

SEQ ID NO: 97273 - RNA, 19 nt, Human
agcccuucucuccuugcag

SEQ ID NO: 97274 - RNA, 23 nt, Human
uuuucagaaagugagaggaggga

SEQ ID NO: 97275 - RNA, 19 nt, Human
agaaguuaaacaucuggga

SEQ ID NO: 97276 - RNA, 22 nt, Human
aaguggugggcgauccacugag

SEQ ID NO: 97277 - RNA, 22 nt, Human
agagccacaaaacgugauuccu

SEQ ID NO: 97278 - RNA, 21 nt, Human
cccuacagcaguucaggcugu

SEQ ID NO: 97279 - RNA, 20 nt, Human
cucccucccuccaccgggga

SEQ ID NO: 97280 - RNA, 29 nt, Human
gacaaacuuuccgauagggcucaguagga

SEQ ID NO: 97281 - RNA, 20 nt, Human
ggcuucuuguagcugggaua

SEQ ID NO: 97282 - RNA, 21 nt, Human
aucccuguucccucucugucu

SEQ ID NO: 97283 - RNA, 21 nt, Human
uguggagcuauucuugcugau

SEQ ID NO: 97284 - RNA, 18 nt, Human
cucucuggaccucagguu

SEQ ID NO: 97285 - RNA, 20 nt, Human
gcaggaugugccuguggcau

SEQ ID NO: 97286 - RNA, 24 nt, Human
auuccugauaugccuauauuuuuc

SEQ ID NO: 97287 - RNA, 21 nt, Human
gaaguaagaggccuguggaau

SEQ ID NO: 97288 - RNA, 26 nt, Human
gucuaccauuuuuaauuuaugguuca

SEQ ID NO: 97289 - RNA, 23 nt, Human
ugcuguugcuguuaaguuuggaa

SEQ ID NO: 97290 - RNA, 24 nt, Human
caggcuggagugcaaugccgugau

SEQ ID NO: 97291 - RNA, 22 nt, Human
gguuucaaacuccugaccucag

SEQ ID NO: 97292 - RNA, 23 nt, Human
caaggucaugugacuuuucugua

SEQ ID NO: 97293 - RNA, 21 nt, Human
uggcucagcuucuaaucccag

SEQ ID NO: 97294 - RNA, 26 nt, Human
auuuuuaaaaaguaccacauuccaug

SEQ ID NO: 97295 - RNA, 25 nt, Human
guccugggugccuccuacuagggcu

SEQ ID NO: 97296 - RNA, 23 nt, Human
guccccguucugcacagcauccc

SEQ ID NO: 97297 - RNA, 23 nt, Human
ugcaguugugcacagaugucuuu

SEQ ID NO: 97298 - RNA, 27 nt, Human
cagguucuggaauaacucuuacagcuu

SEQ ID NO: 97299 - RNA, 21 nt, Human
agaaggcaguggucuacucca

SEQ ID NO: 97300 - RNA, 27 nt, Human
cugccaacguagcucugccugccuguc

SEQ ID NO: 97301 - RNA, 20 nt, Human
aauuuugcucuauguuugcc

SEQ ID NO: 97302 - RNA, 23 nt, Human
caccaguaaucccagcuacucgg

SEQ ID NO: 97303 - RNA, 27 nt, Human
uggaaacauggcggugccggcucggac

SEQ ID NO: 97304 - RNA, 22 nt, Human
cacacucaaacuuuguguauaa

SEQ ID NO: 97305 - RNA, 27 nt, Human
gggaaaggcgagcagcuggcagagagc

SEQ ID NO: 97306 - RNA, 21 nt, Human
agcugagaaguuguaauagac

SEQ ID NO: 97307 - RNA, 21 nt, Human
ucuggcagaguugaagacaga

SEQ ID NO: 97308 - RNA, 23 nt, Human
aauuuuaauaaaucagcuggaac

SEQ ID NO: 97309 - RNA, 20 nt, Human
guaaacuuuuuguucugguc

SEQ ID NO: 97310 - RNA, 21 nt, Human
ugccaggauuaaaaguccaug

SEQ ID NO: 97311 - RNA, 26 nt, Human
caccuugcaggacguuuuccccaacc

SEQ ID NO: 97312 - RNA, 22 nt, Human
caacauagcaaaaucucaucuc

SEQ ID NO: 97313 - RNA, 26 nt, Human
cagacaccugcccuaauccucagccu

SEQ ID NO: 97314 - RNA, 26 nt, Human
caggaggugggggaagagcugaaucu

SEQ ID NO: 97315 - RNA, 19 nt, Human
acucccucagggccugugu

SEQ ID NO: 97316 - RNA, 29 nt, Human
uguucauccguucaucuugcugagagacu

SEQ ID NO: 97317 - RNA, 21 nt, Human
augcaaccucugccccccggg

SEQ ID NO: 97318 - RNA, 25 nt, Human
auagcaaccuauuacuaaagauauu

SEQ ID NO: 97319 - RNA, 26 nt, Human
caaaccacagauaguaccaaacucca

SEQ ID NO: 97320 - RNA, 19 nt, Human
ugagcacgggccgcuccgc

SEQ ID NO: 97321 - RNA, 24 nt, Human
cagcuggaucaguucucacaggag

SEQ ID NO: 97322 - RNA, 27 nt, Human
cuucccaagccuucuagcgcagggccu

SEQ ID NO: 97323 - RNA, 23 nt, Human
ccuucucugauuucccaccuccc

SEQ ID NO: 97324 - RNA, 23 nt, Human
gucagggcgacuuccacagcagc

SEQ ID NO: 97325 - RNA, 22 nt, Human
gccuuucuggcccaccuggaca

SEQ ID NO: 97326 - RNA, 19 nt, Human
agcaggagaugcaaguuuc

SEQ ID NO: 97327 - RNA, 21 nt, Human
caccuugcacuauuggacuuu

SEQ ID NO: 97328 - RNA, 20 nt, Human
cuucugagugaauguuaaca

SEQ ID NO: 97329 - RNA, 21 nt, Human
gacccuacuacugaacuccag

SEQ ID NO: 97330 - RNA, 21 nt, Human
cccaagacuucauugucccuc

SEQ ID NO: 97331 - RNA, 27 nt, Human
uggggugcccggguuccucucguuuuu

SEQ ID NO: 97332 - RNA, 22 nt, Human
uugugggcagcuaaaugcagcu

SEQ ID NO: 97333 - RNA, 22 nt, Human
ucugguaacaauguagcuuuga

SEQ ID NO: 97334 - RNA, 22 nt, Human
ucaggaaacacaggaauuagua

SEQ ID NO: 97335 - RNA, 28 nt, Human
ccuguagagugaggagccaucucuagcg

SEQ ID NO: 97336 - RNA, 17 nt, Human
guuauagaaaugccuuu

SEQ ID NO: 97337 - RNA, 22 nt, Human
uccugcucucuggguauagaca

SEQ ID NO: 97338 - RNA, 23 nt, Human
ucccuagcacacuggccuugcca

SEQ ID NO: 97339 - RNA, 27 nt, Human
gcguccucagagcccgcuggaggcucg

SEQ ID NO: 97340 - RNA, 20 nt, Human
gcuggagcuguggacuuuug

SEQ ID NO: 97341 - RNA, 21 nt, Human
caccucccagguucaagcaau

SEQ ID NO: 97342 - RNA, 20 nt, Human
uggcugcugcuuucugccca

SEQ ID NO: 97343 - RNA, 20 nt, Human
cgguaagucucuccagguag

SEQ ID NO: 97344 - RNA, 20 nt, Human
ccuccacuccucccaacucu

SEQ ID NO: 97345 - RNA, 20 nt, Human
gaccaaaacacugcacacag

SEQ ID NO: 97346 - RNA, 20 nt, Human
acagucgcgagccacacuuu

SEQ ID NO: 97347 - RNA, 22 nt, Human
augacagauucuguugucacgu

SEQ ID NO: 97348 - RNA, 27 nt, Human
auguaaggauauuaaguuauuaagcua

SEQ ID NO: 97349 - RNA, 21 nt, Human
uccacccacucuucacaggcu

SEQ ID NO: 97350 - RNA, 21 nt, Human
ggucuccaagccccaaaugag

SEQ ID NO: 97351 - RNA, 19 nt, Human
ggaaggaaggagcaguugg

SEQ ID NO: 97352 - RNA, 20 nt, Human
ccguucccuccuagucucug

SEQ ID NO: 97353 - RNA, 22 nt, Human
ccgugcugcuccuggacuggcc

SEQ ID NO: 97354 - RNA, 27 nt, Human
agccugucaucugccccuuccguguug

SEQ ID NO: 97355 - RNA, 17 nt, Human
ggugaagccuggccagg

SEQ ID NO: 97356 - RNA, 21 nt, Human
uggaaccuuuggaaccugcug

SEQ ID NO: 97357 - RNA, 23 nt, Human
ggaccucuuaauuacuaaccuca

SEQ ID NO: 97358 - RNA, 23 nt, Human
ccagggcauugcccaccugggug

SEQ ID NO: 97359 - RNA, 24 nt, Human
agccucucccuacucccaucccau

SEQ ID NO: 97360 - RNA, 21 nt, Human
ugcuuggaauggauugggccu

SEQ ID NO: 97361 - RNA, 24 nt, Human
uggaaagauucgaagugucacaga

SEQ ID NO: 97362 - RNA, 25 nt, Human
uaaaaagacuugaaaguucacuggg

SEQ ID NO: 97363 - RNA, 19 nt, Human
gcuagcacaucuuucucua

SEQ ID NO: 97364 - RNA, 22 nt, Human
acccuccucgucugcaugguaa

SEQ ID NO: 97365 - RNA, 21 nt, Human
gcccucggggccuccagcgcc

SEQ ID NO: 97366 - RNA, 23 nt, Human
guugcacuugcaacuuuuaaaaa

SEQ ID NO: 97367 - RNA, 21 nt, Human
cuaagugcugggauugcaggc

SEQ ID NO: 97368 - RNA, 22 nt, Human
uaccgcccaggcuggagugcag

SEQ ID NO: 97369 - RNA, 22 nt, Human
ccaaguagcugggauuacacca

SEQ ID NO: 97370 - RNA, 23 nt, Human
aucuacucucacauggaucacag

SEQ ID NO: 97371 - RNA, 22 nt, Human
ggaucuguccagcgcugcucug

SEQ ID NO: 97372 - RNA, 22 nt, Human
agcucacuguaaccucaaacuc

SEQ ID NO: 97373 - RNA, 24 nt, Human
cucuuaucaguaaaacaaaggacu

SEQ ID NO: 97374 - RNA, 26 nt, Human
gcuccagccacaggggccacagccca

SEQ ID NO: 97375 - RNA, 24 nt, Human
cucgaugcugccucaucuuccuca

SEQ ID NO: 97376 - RNA, 20 nt, Human
caaaucucccuuucucuuca

SEQ ID NO: 97377 - RNA, 26 nt, Human
cagguauuauaccauuuuucuauucu

SEQ ID NO: 97378 - RNA, 17 nt, Human
uccucugcuucuuugcc

SEQ ID NO: 97379 - RNA, 19 nt, Human
aggcuacaucugcccuagg

SEQ ID NO: 97380 - RNA, 22 nt, Human
acuacucacaaugguaggggaa

SEQ ID NO: 97381 - RNA, 16 nt, Human
accauaaaaugucagc

SEQ ID NO: 97382 - RNA, 21 nt, Human
gguuuagcuaugaaauuuggg

SEQ ID NO: 97383 - RNA, 26 nt, Human
gcguuuuagccagucuggacagagcu

SEQ ID NO: 97384 - RNA, 22 nt, Human
uuuuuugacacugggaacuggg

SEQ ID NO: 97385 - RNA, 21 nt, Human
acuuuucuccccgccugcucc

SEQ ID NO: 97386 - RNA, 27 nt, Human
cacugguuuguuauuugguauucuauc

SEQ ID NO: 97387 - RNA, 21 nt, Human
uauuucacaacagccugacaa

SEQ ID NO: 97388 - RNA, 21 nt, Human
cccaggaggugcaguggaggg

SEQ ID NO: 97389 - RNA, 26 nt, Human
gggcuagaaaccuaacugauucuucu

SEQ ID NO: 97390 - RNA, 20 nt, Human
ugaugcuggggacacagcau

SEQ ID NO: 97391 - RNA, 22 nt, Human
aggaaugggggacagggggagg

SEQ ID NO: 97392 - RNA, 26 nt, Human
cucuacugcugggacuuacagaagug

SEQ ID NO: 97393 - RNA, 23 nt, Human
aaaugauuucaaaaugauauuca

SEQ ID NO: 97394 - RNA, 20 nt, Human
ggagggguggggaggaagcc

SEQ ID NO: 97395 - RNA, 20 nt, Human
cccaggcuggaguguagugg

SEQ ID NO: 97396 - RNA, 24 nt, Human
ggggguuucccacaugcaguguca

SEQ ID NO: 97397 - RNA, 22 nt, Human
cugcaaccuccgccucccgggu

SEQ ID NO: 97398 - RNA, 21 nt, Human
ggaaagggaggcacugccauu

SEQ ID NO: 97399 - RNA, 26 nt, Human
agcaaauucucuuguuaaaccggagu

SEQ ID NO: 97400 - RNA, 27 nt, Human
gcucugucucccaggcuggagugcagu

SEQ ID NO: 97401 - RNA, 29 nt, Human
cacuggcaaugcuucuguccucgugucuu

SEQ ID NO: 97402 - RNA, 22 nt, Human
aaacucaaaagggauagcugag

SEQ ID NO: 97403 - RNA, 21 nt, Human
gucuagaauggauuuuucccg

SEQ ID NO: 97404 - RNA, 27 nt, Human
acugccucugaacacucugguuucccc

SEQ ID NO: 97405 - RNA, 19 nt, Human
aacaagaggugaccaccuu

SEQ ID NO: 97406 - RNA, 19 nt, Human
gaacucggcucaagugauc

SEQ ID NO: 97407 - RNA, 27 nt, Human
cuuauuucucagcuuuucuaugccucc

SEQ ID NO: 97408 - RNA, 26 nt, Human
ggacaacagggcagcaacuuggaggg

SEQ ID NO: 97409 - RNA, 25 nt, Human
aaugaccucuucuaaaacauaacug

SEQ ID NO: 97410 - RNA, 26 nt, Human
cccuccagagcuccaagauauaagcc

SEQ ID NO: 97411 - RNA, 27 nt, Human
gcggguuugauauuugacaaauugauc

SEQ ID NO: 97412 - RNA, 23 nt, Human
accugcuacagugagcugccauu

SEQ ID NO: 97413 - RNA, 20 nt, Human
ugggguggaaacagcauuaa

SEQ ID NO: 97414 - RNA, 14 nt, Human
uccucugcuuugcu

SEQ ID NO: 97415 - RNA, 24 nt, Human
aacuuuagacaacuuacuacuuug

SEQ ID NO: 97416 - RNA, 21 nt, Human
auuucaggggggucaggagag

SEQ ID NO: 97417 - RNA, 25 nt, Human
uagaaaaauauguguaaaauaggga

SEQ ID NO: 97418 - RNA, 21 nt, Human
cuuaacuguuugggagcugga

SEQ ID NO: 97419 - RNA, 27 nt, Human
cauagauucucugcagcuuucucaagg

SEQ ID NO: 97420 - RNA, 25 nt, Human
ucucacugccacugcucuugccucu

SEQ ID NO: 97421 - RNA, 27 nt, Human
gagcaggugcuuguggacaaggcucca

SEQ ID NO: 97422 - RNA, 20 nt, Human
ugggauuauuccaaaaguuu

SEQ ID NO: 97423 - RNA, 22 nt, Human
ucaacuccugaccucaagcaau

SEQ ID NO: 97424 - RNA, 24 nt, Human
ggcgcuggcaggcuggagcuggga

SEQ ID NO: 97425 - RNA, 21 nt, Human
agccuguuucucucugcccuc

SEQ ID NO: 97426 - RNA, 19 nt, Human
gccuuuuaaaacaaaagca

SEQ ID NO: 97427 - RNA, 22 nt, Human
gauuacaggcgugagccaccga

SEQ ID NO: 97428 - RNA, 22 nt, Human
gaucacaugccccucuuagaag

SEQ ID NO: 97429 - RNA, 27 nt, Human
uucauuugauaugugaaugcucauaaa

SEQ ID NO: 97430 - RNA, 24 nt, Human
uccuuccggagcugagauccagcc

SEQ ID NO: 97431 - RNA, 27 nt, Human
uaaaaucaagauauuucuuugcugaag

SEQ ID NO: 97432 - RNA, 24 nt, Human
gugauuugaaaaauacucauucug

SEQ ID NO: 97433 - RNA, 19 nt, Human
uccagccccuaguaauacu

SEQ ID NO: 97434 - RNA, 26 nt, Human
gcaggaggcucaggugaucuguuuga

SEQ ID NO: 97435 - RNA, 25 nt, Human
gucaucuguaaauacuuaccuacau

SEQ ID NO: 97436 - RNA, 20 nt, Human
uaacucuugaagacuccagu

SEQ ID NO: 97437 - RNA, 22 nt, Human
aauggagauaugcauucaagag

SEQ ID NO: 97438 - RNA, 22 nt, Human
gcuuccaaacuccugcgcgcgg

SEQ ID NO: 97439 - RNA, 20 nt, Human
cauuauacuccguguguucu

SEQ ID NO: 97440 - RNA, 24 nt, Human
cucagcgcuaacaucagcagcagc

SEQ ID NO: 97441 - RNA, 27 nt, Human
agggcauaaagcauguuucauucucug

SEQ ID NO: 97442 - RNA, 27 nt, Human
uggcuaacaaggugaaaccccgucucu

SEQ ID NO: 97443 - RNA, 25 nt, Human
gcccggcacuccagccuggcgacaa

SEQ ID NO: 97444 - RNA, 23 nt, Human
cccaccccagcaaggcccugcca

SEQ ID NO: 97445 - RNA, 26 nt, Human
gcucacugccagcugcggccugggca

SEQ ID NO: 97446 - RNA, 17 nt, Human
cuucccuugguucgcca

SEQ ID NO: 97447 - RNA, 22 nt, Human
cauuccagcaucuuaccuucau

SEQ ID NO: 97448 - RNA, 26 nt, Human
aagucaaacauugcucaguaaaaugc

SEQ ID NO: 97449 - RNA, 25 nt, Human
uaauuagcucacaugcucugcucuc

SEQ ID NO: 97450 - RNA, 22 nt, Human
agaucaaagacaaaaucugauc

SEQ ID NO: 97451 - RNA, 19 nt, Human
caguuaggcaggagccggg

SEQ ID NO: 97452 - RNA, 21 nt, Human
uggcggcugcacaacagcccu

SEQ ID NO: 97453 - RNA, 27 nt, Human
auguucucagaaggggguggauuuaaa

SEQ ID NO: 97454 - RNA, 19 nt, Human
aucuaaucucagcagcaca

SEQ ID NO: 97455 - RNA, 22 nt, Human
caucaaguaauaaauauacaga

SEQ ID NO: 97456 - RNA, 22 nt, Human
ggcauaaccuuuaacuauuuuc

SEQ ID NO: 97457 - RNA, 22 nt, Human
gcaaagcagagauuaucaguga

SEQ ID NO: 97458 - RNA, 26 nt, Human
cauucugagacuucuuucuuccuucc

SEQ ID NO: 97459 - RNA, 26 nt, Human
uccuuuguauuuugcuacuuugcagu

SEQ ID NO: 97460 - RNA, 25 nt, Human
guggggaggggguaagggagccagc

SEQ ID NO: 97461 - RNA, 21 nt, Human
ucugccaccauucccauauca

SEQ ID NO: 97462 - RNA, 23 nt, Human
ggccucuuguuccuuccuuucuu

SEQ ID NO: 97463 - RNA, 19 nt, Human
ccugugcugcuauccugcc

SEQ ID NO: 97464 - RNA, 23 nt, Human
aaggaauauuagaggaaacuuga

SEQ ID NO: 97465 - RNA, 21 nt, Human
uguuuucuuuaggagucuacc

SEQ ID NO: 97466 - RNA, 28 nt, Human
ggaggaaaggaaaaaacaucggccaacc

SEQ ID NO: 97467 - RNA, 26 nt, Human
ggccgccagccccagccccagcccca

SEQ ID NO: 97468 - RNA, 22 nt, Human
aacaaaagaagugacaucuuca

SEQ ID NO: 97469 - RNA, 24 nt, Human
caucagagaauccauacuaaagag

SEQ ID NO: 97470 - RNA, 22 nt, Human
ccugccugccugccugccugag

SEQ ID NO: 97471 - RNA, 19 nt, Human
augggaaagcaugccacag

SEQ ID NO: 97472 - RNA, 16 nt, Human
gcccaaaaaugcuugc

SEQ ID NO: 97473 - RNA, 22 nt, Human
cuucucucuggacuucgguguc

SEQ ID NO: 97474 - RNA, 21 nt, Human
aacccgaagcccagcuggggc

SEQ ID NO: 97475 - RNA, 22 nt, Human
agcuuuuauucuuuaauaauga

SEQ ID NO: 97476 - RNA, 22 nt, Human
uuggaccuuggagcacccccac

SEQ ID NO: 97477 - RNA, 19 nt, Human
cagcccagucccagcugag

SEQ ID NO: 97478 - RNA, 23 nt, Human
gaagcucaugugcaauuggugca

SEQ ID NO: 97479 - RNA, 21 nt, Human
uucccucucugggccucaguc

SEQ ID NO: 97480 - RNA, 18 nt, Human
auuuacaccacacuuuca

SEQ ID NO: 97481 - RNA, 17 nt, Human
aaggagucugggccaag

SEQ ID NO: 97482 - RNA, 27 nt, Human
ggagaguauauaauucacuggcucucu

SEQ ID NO: 97483 - RNA, 26 nt, Human
aggcuggaguggggguguguuauagc

SEQ ID NO: 97484 - RNA, 20 nt, Human
cuccaggauccuucuccuug

SEQ ID NO: 97485 - RNA, 27 nt, Human
ggaauaagagaccuguuuuaaaaagga

SEQ ID NO: 97486 - RNA, 24 nt, Human
gcucgucuccaacuccugaccuca

SEQ ID NO: 97487 - RNA, 21 nt, Human
cugugaugauggcugcagucc

SEQ ID NO: 97488 - RNA, 23 nt, Human
ggaaguucuucaagaggaaaggc

SEQ ID NO: 97489 - RNA, 23 nt, Human
uccaaugcauuuggcuccagaaa

SEQ ID NO: 97490 - RNA, 23 nt, Human
ggcaggacuggauggagcuguuc

SEQ ID NO: 97491 - RNA, 22 nt, Human
cacuggauuuuuaucucucuca

SEQ ID NO: 97492 - RNA, 26 nt, Human
gccacugcacccggcccugagaauau

SEQ ID NO: 97493 - RNA, 23 nt, Human
gguacuggaagaaacucucccau

SEQ ID NO: 97494 - RNA, 20 nt, Human
uucuagagugagauuugugu

SEQ ID NO: 97495 - RNA, 18 nt, Human
acucuuuccuccuugcca

SEQ ID NO: 97496 - RNA, 27 nt, Human
ucacuuugacagaggagaagauugagg

SEQ ID NO: 97497 - RNA, 26 nt, Human
aaaauuuaaaaaauuagccauggugg

SEQ ID NO: 97498 - RNA, 19 nt, Human
agcuggagggagauaaaag

SEQ ID NO: 97499 - RNA, 24 nt, Human
uuaccuuuuguuuaccaagggccc

SEQ ID NO: 97500 - RNA, 17 nt, Human
gcacucuccucuggacc

SEQ ID NO: 97501 - RNA, 23 nt, Human
cggggaggggcggauggaggggc

SEQ ID NO: 97502 - RNA, 19 nt, Human
agccugcugcuucucuguc

SEQ ID NO: 97503 - RNA, 21 nt, Human
aggaguacuuacuauugguca

SEQ ID NO: 97504 - RNA, 22 nt, Human
agccuguuccaugaaggcagag

SEQ ID NO: 97505 - RNA, 26 nt, Human
ccugucucucuggcaggagugccugu

SEQ ID NO: 97506 - RNA, 24 nt, Human
cuuggcagagaccuugcugcccag

SEQ ID NO: 97507 - RNA, 25 nt, Human
gcagucucauccugcccuugccauc

SEQ ID NO: 97508 - RNA, 23 nt, Human
cccaggaguccagccccuccucc

SEQ ID NO: 97509 - RNA, 26 nt, Human
cuuuucuguggcaacacagccucuua

SEQ ID NO: 97510 - RNA, 24 nt, Human
ugucucccaggcuggagugcaaug

SEQ ID NO: 97511 - RNA, 24 nt, Human
ugucacccaggcuggagugcuaug

SEQ ID NO: 97512 - RNA, 26 nt, Human
acauggucuguccugacagcacuccu

SEQ ID NO: 97513 - RNA, 30 nt, Human
gucuggggcuugaggaagaugaguuuguug

SEQ ID NO: 97514 - RNA, 21 nt, Human
gugagguggagcuugcaguga

SEQ ID NO: 97515 - RNA, 24 nt, Human
ccuuucuggcccucuuccuguagc

SEQ ID NO: 97516 - RNA, 22 nt, Human
gcaugauucacacccagucccu

SEQ ID NO: 97517 - RNA, 23 nt, Human
cugggaaagcggaaacaaaaccu

SEQ ID NO: 97518 - RNA, 21 nt, Human
ucucucgcuugcucucucuca

SEQ ID NO: 97519 - RNA, 22 nt, Human
agucaucuuaaaaaccuggaug

SEQ ID NO: 97520 - RNA, 25 nt, Human
cuggggggagggugggcagggauac

SEQ ID NO: 97521 - RNA, 20 nt, Human
gguacuuccuucaaagcuga

SEQ ID NO: 97522 - RNA, 26 nt, Human
uccuuggcuggaggcagugcugaggc

SEQ ID NO: 97523 - RNA, 25 nt, Human
cuugucuccccggcuggagugcagu

SEQ ID NO: 97524 - RNA, 20 nt, Human
ucugaagugguucagucuag

SEQ ID NO: 97525 - RNA, 23 nt, Human
uucaugaccaguaaaggcugcug

SEQ ID NO: 97526 - RNA, 22 nt, Human
gcaugagccaccaugcccagcu

SEQ ID NO: 97527 - RNA, 22 nt, Human
gcaugagccaccacgcccagcc

SEQ ID NO: 97528 - RNA, 22 nt, Human
gcgugagccaccaugcccggcu

SEQ ID NO: 97529 - RNA, 22 nt, Human
cuugcagaauggucaccucacc

SEQ ID NO: 97530 - RNA, 27 nt, Human
cacuaggcacuguggcucugcaugaca

SEQ ID NO: 97531 - RNA, 24 nt, Human
ucaguucccccauccucuuccucc

SEQ ID NO: 97532 - RNA, 21 nt, Human
gcuucucccuggacugggccc

SEQ ID NO: 97533 - RNA, 20 nt, Human
gugccuggaaauagccugag

SEQ ID NO: 97534 - RNA, 23 nt, Human
uggggccaaugacaccuaccuca

SEQ ID NO: 97535 - RNA, 31 nt, Human
ggaguguuuuugcuggaucugcucccucucg

SEQ ID NO: 97536 - RNA, 26 nt, Human
uacacuuguauaaguaccguuuacuu

SEQ ID NO: 97537 - RNA, 22 nt, Human
uuugaacuucugacuacuuguu

SEQ ID NO: 97538 - RNA, 28 nt, Human
uggcccccauaggccucuguggcugcaa

SEQ ID NO: 97539 - RNA, 20 nt, Human
ggauuaaaaaagucagcccu

SEQ ID NO: 97540 - RNA, 24 nt, Human
gggaaagagagguggggggagagc

SEQ ID NO: 97541 - RNA, 27 nt, Human
acugccuccccuucucccugccuccag

SEQ ID NO: 97542 - RNA, 22 nt, Human
gccacacgcagcucagccuggg

SEQ ID NO: 97543 - RNA, 24 nt, Human
cccgcaggaucgccgcuuccucca

SEQ ID NO: 97544 - RNA, 27 nt, Human
uuauuugcacuauugagucuucauguu

SEQ ID NO: 97545 - RNA, 22 nt, Human
ggaggaagauauuguucuuuug

SEQ ID NO: 97546 - RNA, 21 nt, Human
guggccugcauguacuguaua

SEQ ID NO: 97547 - RNA, 25 nt, Human
auuuauucaacuacuaaaagucuca

SEQ ID NO: 97548 - RNA, 24 nt, Human
ccuugucccuuccuccucccagca

SEQ ID NO: 97549 - RNA, 25 nt, Human
aaggggaaagggaagggugccacgu

SEQ ID NO: 97550 - RNA, 23 nt, Human
aaauugcugggauuuacaggcau

SEQ ID NO: 97551 - RNA, 24 nt, Human
cugccugccuucuuucuuuucuuu

SEQ ID NO: 97552 - RNA, 25 nt, Human
ggccacaccacaucuuccaugggac

SEQ ID NO: 97553 - RNA, 21 nt, Human
acaguagagagaacauggagc

SEQ ID NO: 97554 - RNA, 23 nt, Human
augugggaaaauuaaaauucuca

SEQ ID NO: 97555 - RNA, 23 nt, Human
acugccucgcugccccaccuccc

SEQ ID NO: 97556 - RNA, 23 nt, Human
uugcaaccucucuuccucuggga

SEQ ID NO: 97557 - RNA, 15 nt, Human
agggaagcagaggau

SEQ ID NO: 97558 - RNA, 30 nt, Human
cugcuuugggaccacauggucaguaggcac

SEQ ID NO: 97559 - RNA, 19 nt, Human
acugacacaagaauggucu

SEQ ID NO: 97560 - RNA, 20 nt, Human
ccugcucuccugcacugacc

SEQ ID NO: 97561 - RNA, 30 nt, Human
accacugaauucacuccagucaacagauuc

SEQ ID NO: 97562 - RNA, 20 nt, Human
cagccgccaugcuccuggcc

SEQ ID NO: 97563 - RNA, 25 nt, Human
uucaaacccagacaugcugcugcug

SEQ ID NO: 97564 - RNA, 28 nt, Human
cugcauucacagcgccuccuggaccuga

SEQ ID NO: 97565 - RNA, 22 nt, Human
aguugggagcacuggagugcag

SEQ ID NO: 97566 - RNA, 25 nt, Human
aguaugugccaggacauguuucuug

SEQ ID NO: 97567 - RNA, 22 nt, Human
gggcagguuccaagccacagac

SEQ ID NO: 97568 - RNA, 25 nt, Human
uuauaaauaaaaggaacaucagauc

SEQ ID NO: 97569 - RNA, 22 nt, Human
aucccagagcuucccaggaucc

SEQ ID NO: 97570 - RNA, 23 nt, Human
ucgagggagcaggagcaucaggc

SEQ ID NO: 97571 - RNA, 21 nt, Human
aggccuccucucccugcuggc

SEQ ID NO: 97572 - RNA, 25 nt, Human
agaagccagcaggcaccacuuuucu

SEQ ID NO: 97573 - RNA, 27 nt, Human
cagcuggagagaucugugugacacaag

SEQ ID NO: 97574 - RNA, 22 nt, Human
cucuccucugcuguguccucaa

SEQ ID NO: 97575 - RNA, 20 nt, Human
cuccaggcuggagugcagug

SEQ ID NO: 97576 - RNA, 21 nt, Human
cacugcgcccagccugaauca

SEQ ID NO: 97577 - RNA, 23 nt, Human
ggacugagggcacccagccuucu

SEQ ID NO: 97578 - RNA, 22 nt, Human
gucuuggcaaaauaguggagaa

SEQ ID NO: 97579 - RNA, 22 nt, Human
agcgugaacccgggaggcggag

SEQ ID NO: 97580 - RNA, 28 nt, Human
ggcuuggggucgggagugcaggaggcga

SEQ ID NO: 97581 - RNA, 21 nt, Human
ggagagaugccuuccaggcag

SEQ ID NO: 97582 - RNA, 19 nt, Human
aagugaugcagagagccca

SEQ ID NO: 97583 - RNA, 24 nt, Human
uucugucucaaaagcaaacuaaca

SEQ ID NO: 97584 - RNA, 22 nt, Human
ugucacugcacuccagcuuggg

SEQ ID NO: 97585 - RNA, 28 nt, Human
ggaggugaggagcagagcaggcaauuuc

SEQ ID NO: 97586 - RNA, 22 nt, Human
cugaggcaagcagguuguuuga

SEQ ID NO: 97587 - RNA, 22 nt, Human
ucugcugaucgguguugcagug

SEQ ID NO: 97588 - RNA, 22 nt, Human
gagcccggggaggggcggggag

SEQ ID NO: 97589 - RNA, 19 nt, Human
acucacaggugaccugcua

SEQ ID NO: 97590 - RNA, 21 nt, Human
gaccagccuggccacauggug

SEQ ID NO: 97591 - RNA, 26 nt, Human
ucuucccugaacuuccugcuuccuca

SEQ ID NO: 97592 - RNA, 24 nt, Human
ugauuaguauaauauuucuuaauu

SEQ ID NO: 97593 - RNA, 23 nt, Human
uugaugaauucaaacaaauggcu

SEQ ID NO: 97594 - RNA, 31 nt, Human
ccuggggugcugccucucacacauuucugcc

SEQ ID NO: 97595 - RNA, 20 nt, Human
cccaccccacaguucucccu

SEQ ID NO: 97596 - RNA, 22 nt, Human
auacagacaugcacacacagac

SEQ ID NO: 97597 - RNA, 25 nt, Human
gcaauuagguagcacagcacuuugg

SEQ ID NO: 97598 - RNA, 22 nt, Human
gggauuacaggcacccaccaca

SEQ ID NO: 97599 - RNA, 21 nt, Human
auacuuuggugacaacuuggg

SEQ ID NO: 97600 - RNA, 24 nt, Human
aacacaaacaaaaacagacuccca

SEQ ID NO: 97601 - RNA, 28 nt, Human
uucuggucuucuuuaccaauauaaucau

SEQ ID NO: 97602 - RNA, 27 nt, Human
cucuggccuggcugaguucacagccca

SEQ ID NO: 97603 - RNA, 22 nt, Human
cagucucuuuauuuuuauuuau

SEQ ID NO: 97604 - RNA, 25 nt, Human
gagagccacacauuuaaauacagac

SEQ ID NO: 97605 - RNA, 28 nt, Human
gggguuaccacauggagagauuuuccau

SEQ ID NO: 97606 - RNA, 27 nt, Human
cccaucaugacaugguccccaggcugg

SEQ ID NO: 97607 - RNA, 26 nt, Human
agccauuccagucaugaugaggugga

SEQ ID NO: 97608 - RNA, 24 nt, Human
ugggaugucagaacauccaaguca

SEQ ID NO: 97609 - RNA, 26 nt, Human
ucucucuuggaauuagauguuauauc

SEQ ID NO: 97610 - RNA, 24 nt, Human
ucagcacuaaccuaugagggugag

SEQ ID NO: 97611 - RNA, 21 nt, Human
gccucaaccuccuggggcagg

SEQ ID NO: 97612 - RNA, 21 nt, Human
ugccagcucugcccaugccug

SEQ ID NO: 97613 - RNA, 22 nt, Human
gcaggcaagcauuaugcugcua

SEQ ID NO: 97614 - RNA, 20 nt, Human
ggcugcugagccaggagcua

SEQ ID NO: 97615 - RNA, 22 nt, Human
caggacccucaggaauucagug

SEQ ID NO: 97616 - RNA, 21 nt, Human
aaaguugaaccauuauacuuu

SEQ ID NO: 97617 - RNA, 19 nt, Human
acagugcuuguagcuuuga

SEQ ID NO: 97618 - RNA, 24 nt, Human
uguuucuugaacaagucuugaaga

SEQ ID NO: 97619 - RNA, 24 nt, Human
cuccucucugcugccacucauucc

SEQ ID NO: 97620 - RNA, 21 nt, Human
ccugccucugcugaguguacc

SEQ ID NO: 97621 - RNA, 21 nt, Human
caguuuuucucccacuggguc

SEQ ID NO: 97622 - RNA, 21 nt, Human
uuuuggcuucuguacugcuua

SEQ ID NO: 97623 - RNA, 32 nt, Human
cucaugugaggcucgcggcacagcguucucug

SEQ ID NO: 97624 - RNA, 23 nt, Human
cuccccaccuucaauuccugggc

SEQ ID NO: 97625 - RNA, 24 nt, Human
aaagggagaagacagcagaggggu

SEQ ID NO: 97626 - RNA, 23 nt, Human
ggacuuugggggacgggcuuccc

SEQ ID NO: 97627 - RNA, 21 nt, Human
gccugccuccccuccgcagca

SEQ ID NO: 97628 - RNA, 21 nt, Human
gcacaccauugaugaauucaa

SEQ ID NO: 97629 - RNA, 23 nt, Human
acacuccuauaaggagaguucaa

SEQ ID NO: 97630 - RNA, 21 nt, Human
caggccuguuccuggcagcug

SEQ ID NO: 97631 - RNA, 28 nt, Human
ugccagcucugugcuguggcaaguuacu

SEQ ID NO: 97632 - RNA, 21 nt, Human
aaucccucaccuucugaguac

SEQ ID NO: 97633 - RNA, 27 nt, Human
gggaggcaucuuggccugcaguaagcg

SEQ ID NO: 97634 - RNA, 22 nt, Human
ggugcuugcugcugaaauaaau

SEQ ID NO: 97635 - RNA, 19 nt, Human
ugucugccaaaaugcaaca

SEQ ID NO: 97636 - RNA, 21 nt, Human
acuccuucacuuacuaauuuu

SEQ ID NO: 97637 - RNA, 27 nt, Human
auugagcaccuacuaugugcccagccc

SEQ ID NO: 97638 - RNA, 21 nt, Human
ggagauugucuuucugccaca

SEQ ID NO: 97639 - RNA, 27 nt, Human
ucccaaaacagcauuuuccugcuccuu

SEQ ID NO: 97640 - RNA, 24 nt, Human
cugucccagggccuaugggcaacu

SEQ ID NO: 97641 - RNA, 23 nt, Human
gccagguaggaggaagggcuggg

SEQ ID NO: 97642 - RNA, 22 nt, Human
ggacuccugggacaguccucca

SEQ ID NO: 97643 - RNA, 23 nt, Human
uacagaagauagaagugauuuaa

SEQ ID NO: 97644 - RNA, 26 nt, Human
uaucgggaagauuucuaaauaaaagu

SEQ ID NO: 97645 - RNA, 27 nt, Human
uuucugcugaucaaagaugaucaagcu

SEQ ID NO: 97646 - RNA, 22 nt, Human
ucuuaaauuugggagacucaaa

SEQ ID NO: 97647 - RNA, 24 nt, Human
ggcuugcuccuacuuucaggaagg

SEQ ID NO: 97648 - RNA, 22 nt, Human
cuuugcaggccccaccuguccu

SEQ ID NO: 97649 - RNA, 21 nt, Human
cggccuuucaggagcugccuc

SEQ ID NO: 97650 - RNA, 24 nt, Human
ucucucuccuaucugcagcacugg

SEQ ID NO: 97651 - RNA, 24 nt, Human
uggcugagagaguggcauuggcag

SEQ ID NO: 97652 - RNA, 20 nt, Human
caucccagccccaauuuucu

SEQ ID NO: 97653 - RNA, 23 nt, Human
gggucugugguaucugacacugu

SEQ ID NO: 97654 - RNA, 23 nt, Human
gagguggaggccacggaggcagg

SEQ ID NO: 97655 - RNA, 16 nt, Human
ccccaaugcauucaua

SEQ ID NO: 97656 - RNA, 21 nt, Human
gucagagaguucuuaagcaga

SEQ ID NO: 97657 - RNA, 22 nt, Human
cagauuaccauggaaaugguag

SEQ ID NO: 97658 - RNA, 26 nt, Human
ggccucccugccucuacuaggcgccu

SEQ ID NO: 97659 - RNA, 25 nt, Human
aucagagguucuaguucccuuuccc

SEQ ID NO: 97660 - RNA, 26 nt, Human
gcagggugucugcccccuccugaguu

SEQ ID NO: 97661 - RNA, 21 nt, Human
ccugauggugcugcucaggcc

SEQ ID NO: 97662 - RNA, 22 nt, Human
cucucugagagcaaacaggaac

SEQ ID NO: 97663 - RNA, 27 nt, Human
ucauggaagaagagagaccucuacuuc

SEQ ID NO: 97664 - RNA, 26 nt, Human
gagauucugugccugcuuuaucugug

SEQ ID NO: 97665 - RNA, 20 nt, Human
cucauucgcacauccauuuc

SEQ ID NO: 97666 - RNA, 24 nt, Human
cgcccuggcccuggcugggcgggg

SEQ ID NO: 97667 - RNA, 28 nt, Human
aagacuucaccauaaggccaggagcagu

SEQ ID NO: 97668 - RNA, 27 nt, Human
cggcggcuggagagcgaggaggagcgg

SEQ ID NO: 97669 - RNA, 25 nt, Human
uguggacccugucuucugggcacag

SEQ ID NO: 97670 - RNA, 23 nt, Human
agcuggggccuccuuccuucuca

SEQ ID NO: 97671 - RNA, 21 nt, Human
caugguagccaggugggugaa

SEQ ID NO: 97672 - RNA, 18 nt, Human
ugcucugcaguccuggcc

SEQ ID NO: 97673 - RNA, 17 nt, Human
ggaggcggaggcggggg

SEQ ID NO: 97674 - RNA, 22 nt, Human
aguuauuuaaaaauauucuuca

SEQ ID NO: 97675 - RNA, 26 nt, Human
accuuuauuauugcuauaucuuugug

SEQ ID NO: 97676 - RNA, 20 nt, Human
gugccaggaccucaggcugg

SEQ ID NO: 97677 - RNA, 30 nt, Human
ccucuuccugugggcaaccacaccacugcc

SEQ ID NO: 97678 - RNA, 24 nt, Human
ccugcugucuugugaucacuuagc

SEQ ID NO: 97679 - RNA, 24 nt, Human
cucacacaaguuuuagccuuuuuc

SEQ ID NO: 97680 - RNA, 21 nt, Human
agaccauccuggacuguggcc

SEQ ID NO: 97681 - RNA, 19 nt, Human
acuuguaauuagcacuugg

SEQ ID NO: 97682 - RNA, 24 nt, Human
gcucugugggucgguccucuccgg

SEQ ID NO: 97683 - RNA, 22 nt, Human
uuagagagcacacagguguuca

SEQ ID NO: 97684 - RNA, 23 nt, Human
cggcugagaggagcugcgcgugc

SEQ ID NO: 97685 - RNA, 24 nt, Human
ggauucaugacugugcagcauuuu

SEQ ID NO: 97686 - RNA, 19 nt, Human
gaccuuccuggaaguuguu

SEQ ID NO: 97687 - RNA, 26 nt, Human
cagcgcaguggaagagguugcacuuc

SEQ ID NO: 97688 - RNA, 18 nt, Human
ccucagcccaugcccagc

SEQ ID NO: 97689 - RNA, 20 nt, Human
uuccuuuggcuccugcugag

SEQ ID NO: 97690 - RNA, 22 nt, Human
ugggccagaaguagagggggug

SEQ ID NO: 97691 - RNA, 23 nt, Human
aucacgccacugcacucaagccu

SEQ ID NO: 97692 - RNA, 31 nt, Human
ccugcgcuccuccacagccugggccgggccg

SEQ ID NO: 97693 - RNA, 24 nt, Human
uccacuuacuccaccuuccauucc

SEQ ID NO: 97694 - RNA, 23 nt, Human
aagacuaaaugcacauuuuaugg

SEQ ID NO: 97695 - RNA, 22 nt, Human
cugugcaggaagaagcuaucug

SEQ ID NO: 97696 - RNA, 22 nt, Human
gaagagugagaagcagagggcc

SEQ ID NO: 97697 - RNA, 22 nt, Human
gcuaccuuccuguguaugcuga

SEQ ID NO: 97698 - RNA, 20 nt, Human
caccuggaggagguggugca

SEQ ID NO: 97699 - RNA, 21 nt, Human
gagagggacagcucacgaggc

SEQ ID NO: 97700 - RNA, 27 nt, Human
ccaccgcacuccagccugggcaacaga

SEQ ID NO: 97701 - RNA, 27 nt, Human
ccacugcacuccagccuggguaacaga

SEQ ID NO: 97702 - RNA, 24 nt, Human
uaacauuucugagguuuggagauu

SEQ ID NO: 97703 - RNA, 22 nt, Human
uccacacaucuuuggacuuuuc

SEQ ID NO: 97704 - RNA, 23 nt, Human
gcucccuuccugccacugccgcc

SEQ ID NO: 97705 - RNA, 20 nt, Human
gugaccuaguuggugcagug

SEQ ID NO: 97706 - RNA, 21 nt, Human
cuucgagcauggcuuuuggcu

SEQ ID NO: 97707 - RNA, 27 nt, Human
gaaagaagccaggguuugccacuguga

SEQ ID NO: 97708 - RNA, 21 nt, Human
uggguaugaacuucugccuuc

SEQ ID NO: 97709 - RNA, 22 nt, Human
acuaucuccccuuccucugucc

SEQ ID NO: 97710 - RNA, 22 nt, Human
uguucccuacaaugggaaaugu

SEQ ID NO: 97711 - RNA, 22 nt, Human
caccuguaauuccagcacuuca

SEQ ID NO: 97712 - RNA, 21 nt, Human
ugcugagcuggcccuugggga

SEQ ID NO: 97713 - RNA, 18 nt, Human
uaaacuucuggugugaua

SEQ ID NO: 97714 - RNA, 21 nt, Human
aaaugcugggauuacagacau

SEQ ID NO: 97715 - RNA, 19 nt, Human
gcggggguuucaccaugcc

SEQ ID NO: 97716 - RNA, 22 nt, Human
gcucccugccccuccucaugcc

SEQ ID NO: 97717 - RNA, 22 nt, Human
cgcuauugcacuccagucuggg

SEQ ID NO: 97718 - RNA, 23 nt, Human
cacagccugggggagagugcggc

SEQ ID NO: 97719 - RNA, 21 nt, Human
ugugugccaguugcuggcugu

SEQ ID NO: 97720 - RNA, 21 nt, Human
ccacuccucgggcuggcucuc

SEQ ID NO: 97721 - RNA, 20 nt, Human
gucuccaaaagucuaguaug

SEQ ID NO: 97722 - RNA, 24 nt, Human
auuguccuagaugcuggagugaga

SEQ ID NO: 97723 - RNA, 20 nt, Human
agcccaggcugcugggcugu

SEQ ID NO: 97724 - RNA, 16 nt, Human
ucaaaguuuuuauccu

SEQ ID NO: 97725 - RNA, 18 nt, Human
caaguccccagcccaggg

SEQ ID NO: 97726 - RNA, 22 nt, Human
acagaugggcaaauuaaggcau

SEQ ID NO: 97727 - RNA, 25 nt, Human
aucucuaccuucuccccagcuccca

SEQ ID NO: 97728 - RNA, 24 nt, Human
gcauguuucaggaucagaucaaua

SEQ ID NO: 97729 - RNA, 21 nt, Human
gaaagcuccggugcuuggacc

SEQ ID NO: 97730 - RNA, 21 nt, Human
cagaccuagggcccagcacuu

SEQ ID NO: 97731 - RNA, 23 nt, Human
gucuccccagaagacacaggaaa

SEQ ID NO: 97732 - RNA, 19 nt, Human
ccccaaaaccuaccacucg

SEQ ID NO: 97733 - RNA, 23 nt, Human
cuuguucuacauuccacagucuu

SEQ ID NO: 97734 - RNA, 21 nt, Human
gagcuacagcgagcugcauua

SEQ ID NO: 97735 - RNA, 26 nt, Human
ucacaucaaaaagagugaauguggua

SEQ ID NO: 97736 - RNA, 22 nt, Human
gcuacugcauguugauuguuuu

SEQ ID NO: 97737 - RNA, 20 nt, Human
aggaagggaaaagucuuuug

SEQ ID NO: 97738 - RNA, 23 nt, Human
uuucugacuccugccuguuuuag

SEQ ID NO: 97739 - RNA, 26 nt, Human
ggagagaacagggaugcuaucucgcu

SEQ ID NO: 97740 - RNA, 27 nt, Human
cagcaucaauaaaaugacaccaaaaau

SEQ ID NO: 97741 - RNA, 27 nt, Human
ucccugccucgccccgagggcgucacg

SEQ ID NO: 97742 - RNA, 25 nt, Human
uagagaggcagaggagaaggguuuc

SEQ ID NO: 97743 - RNA, 25 nt, Human
ccgacuuccuguuguuugaggccgg

SEQ ID NO: 97744 - RNA, 23 nt, Human
agcucacugcagccucauacucc

SEQ ID NO: 97745 - RNA, 27 nt, Human
ggcagaagugcuuuuuugaucaacugg

SEQ ID NO: 97746 - RNA, 19 nt, Human
accugccuuaugcaccuua

SEQ ID NO: 97747 - RNA, 20 nt, Human
uguaauaaacuuuaauauaa

SEQ ID NO: 97748 - RNA, 20 nt, Human
cacagccguagccuccccgg

SEQ ID NO: 97749 - RNA, 21 nt, Human
uuggccggauccaggggcggu

SEQ ID NO: 97750 - RNA, 21 nt, Human
caccuccuggguuuaagcgau

SEQ ID NO: 97751 - RNA, 21 nt, Human
gcgggucgggcugggccagcu

SEQ ID NO: 97752 - RNA, 21 nt, Human
uguauaauacauaaccacagc

SEQ ID NO: 97753 - RNA, 29 nt, Human
ccugcauacaggcauacacaugcacgcuu

SEQ ID NO: 97754 - RNA, 25 nt, Human
ggcugcugagcauccugcugagcaa

SEQ ID NO: 97755 - RNA, 22 nt, Human
gcuggcugaagcugccugugca

SEQ ID NO: 97756 - RNA, 23 nt, Human
gcaccaugcaaagauaacuugca

SEQ ID NO: 97757 - RNA, 22 nt, Human
ccugccuggcacuuacuggucc

SEQ ID NO: 97758 - RNA, 21 nt, Human
ugacaugcagaggaacugaga

SEQ ID NO: 97759 - RNA, 18 nt, Human
gccuuugccagcauccua

SEQ ID NO: 97760 - RNA, 27 nt, Human
gggaggccaagauggaggauugcuuga

SEQ ID NO: 97761 - RNA, 25 nt, Human
accuagcuccugaauucuuccuauc

SEQ ID NO: 97762 - RNA, 26 nt, Human
gcauauacaacuacaaauccaagcag

SEQ ID NO: 97763 - RNA, 21 nt, Human
gggaagccucggggcugcggg

SEQ ID NO: 97764 - RNA, 29 nt, Human
ggcccucgggcuaccugaccuggugcuuu

SEQ ID NO: 97765 - RNA, 22 nt, Human
cugggaggugaagguugcugug

SEQ ID NO: 97766 - RNA, 23 nt, Human
gaacucauacugucuacacauca

SEQ ID NO: 97767 - RNA, 25 nt, Human
ucacucuguugccaggcuggagugc

SEQ ID NO: 97768 - RNA, 21 nt, Human
uucauuucccaccccugcucc

SEQ ID NO: 97769 - RNA, 20 nt, Human
ucuggguccuuaaagaaaca

SEQ ID NO: 97770 - RNA, 26 nt, Human
accagcuuauacugcuccaucuuccc

SEQ ID NO: 97771 - RNA, 26 nt, Human
uaguucuuacagguuucguuguguuu

SEQ ID NO: 97772 - RNA, 17 nt, Human
gguagugcagauuauga

SEQ ID NO: 97773 - RNA, 25 nt, Human
uugagccuugcuggacaagugguuu

SEQ ID NO: 97774 - RNA, 27 nt, Human
uuccuugauccuugccacccgcgacug

SEQ ID NO: 97775 - RNA, 22 nt, Human
ccucuuuuuccuccuggacaca

SEQ ID NO: 97776 - RNA, 20 nt, Human
caguuuuucuucucuucuuu

SEQ ID NO: 97777 - RNA, 21 nt, Human
ggagcuggaggagcaggcagu

SEQ ID NO: 97778 - RNA, 20 nt, Human
uggaggcuaaggugggagga

SEQ ID NO: 97779 - RNA, 24 nt, Human
acagccccaauggcccccaaaaag

SEQ ID NO: 97780 - RNA, 22 nt, Human
aggaagacggaaaagacugccu

SEQ ID NO: 97781 - RNA, 23 nt, Human
caagggguaacagaccgcuggaa

SEQ ID NO: 97782 - RNA, 21 nt, Human
uagaagaugaugacacaaaaa

SEQ ID NO: 97783 - RNA, 22 nt, Human
uaguauccuaagcaucuguaaa

SEQ ID NO: 97784 - RNA, 21 nt, Human
ccuguugcuuuucaccaggaa

SEQ ID NO: 97785 - RNA, 27 nt, Human
gaggguucacgaccccuccagcaaagg

SEQ ID NO: 97786 - RNA, 26 nt, Human
cacagcccuuugggggguacaaacaa

SEQ ID NO: 97787 - RNA, 23 nt, Human
ccuccucccccuucaccaaugcc

SEQ ID NO: 97788 - RNA, 23 nt, Human
caauggauuaaacuggcauuuca

SEQ ID NO: 97789 - RNA, 27 nt, Human
cacugccuaucgcuugucuucuauuca

SEQ ID NO: 97790 - RNA, 20 nt, Human
uguuuuucaacuugcuuuau

SEQ ID NO: 97791 - RNA, 27 nt, Human
uccaacauacauccugcauuacaugaa

SEQ ID NO: 97792 - RNA, 19 nt, Human
uuagauagucaugcugcua

SEQ ID NO: 97793 - RNA, 22 nt, Human
cucaugaugagguuuucuuaac

SEQ ID NO: 97794 - RNA, 25 nt, Human
agcuagcacaugauuauccuucugu

SEQ ID NO: 97795 - RNA, 21 nt, Human
gaugacugaaaccacucugaa

SEQ ID NO: 97796 - RNA, 25 nt, Human
uucaauacaagauaaaaaggauagu

SEQ ID NO: 97797 - RNA, 19 nt, Human
uauuucuugcaauucccgu

SEQ ID NO: 97798 - RNA, 23 nt, Human
uggaagucaacacagugugguuu

SEQ ID NO: 97799 - RNA, 27 nt, Human
ccacugcgcuccagccugggggagggg

SEQ ID NO: 97800 - RNA, 28 nt, Human
gcaguggacucaaaagcauuuucaggca

SEQ ID NO: 97801 - RNA, 26 nt, Human
acauggucacucaguaccgccugcag

SEQ ID NO: 97802 - RNA, 26 nt, Human
agagccgcuguuccucuccugccuuu

SEQ ID NO: 97803 - RNA, 21 nt, Human
uaccuucucugggccuugguu

SEQ ID NO: 97804 - RNA, 20 nt, Human
caaguggugaaugacacgcc

SEQ ID NO: 97805 - RNA, 23 nt, Human
aaaccagcuuguucugggcucag

SEQ ID NO: 97806 - RNA, 22 nt, Human
cugccuggggucucaccugccu

SEQ ID NO: 97807 - RNA, 26 nt, Human
accaguacucuguaaagcaucaucau

SEQ ID NO: 97808 - RNA, 27 nt, Human
ugcauaucaguaaucucuuggacuuug

SEQ ID NO: 97809 - RNA, 24 nt, Human
uuucugcuuugagauguuguuagc

SEQ ID NO: 97810 - RNA, 21 nt, Human
gcuccugggccugcugccugc

SEQ ID NO: 97811 - RNA, 20 nt, Human
auccucucugugggcuguuc

SEQ ID NO: 97812 - RNA, 27 nt, Human
agggauauaaauuuccaggaaugugua

SEQ ID NO: 97813 - RNA, 21 nt, Human
cagucacugguguuucuugaa

SEQ ID NO: 97814 - RNA, 24 nt, Human
gcugcggcacugugccuacaggug

SEQ ID NO: 97815 - RNA, 23 nt, Human
agcagccucuucccauggaucca

SEQ ID NO: 97816 - RNA, 21 nt, Human
ggaauuggaggcggcagugag

SEQ ID NO: 97817 - RNA, 22 nt, Human
guuauugugcucuuuucuguua

SEQ ID NO: 97818 - RNA, 23 nt, Human
uucgauguucaaaacaaacuaca

SEQ ID NO: 97819 - RNA, 23 nt, Human
aggcacgaucuguuccuccuggg

SEQ ID NO: 97820 - RNA, 20 nt, Human
ggcccuuccugucacccagg

SEQ ID NO: 97821 - RNA, 23 nt, Human
ucuugcccaggcuggagugcaau

SEQ ID NO: 97822 - RNA, 16 nt, Human
gugcagcugcugugcc

SEQ ID NO: 97823 - RNA, 20 nt, Human
uuuucacauuuucucucugc

SEQ ID NO: 97824 - RNA, 27 nt, Human
cucacuggucccugccucuggggcuuu

SEQ ID NO: 97825 - RNA, 31 nt, Human
gggggaagaagaagagauuucggaggccauc

SEQ ID NO: 97826 - RNA, 22 nt, Human
gcucauuuggaggacagcagug

SEQ ID NO: 97827 - RNA, 28 nt, Human
guccagucuggcugcuguuguggaggca

SEQ ID NO: 97828 - RNA, 26 nt, Human
acuguguauacagacagaaaaaucac

SEQ ID NO: 97829 - RNA, 24 nt, Human
cucugcuguccccuuggcaggucc

SEQ ID NO: 97830 - RNA, 25 nt, Human
gauggccaucacaaugcagcuuugg

SEQ ID NO: 97831 - RNA, 22 nt, Human
acucaugccagcucauuacagc

SEQ ID NO: 97832 - RNA, 24 nt, Human
ggcgguggggcaugggaggaagga

SEQ ID NO: 97833 - RNA, 20 nt, Human
gcuggggacagagguggccc

SEQ ID NO: 97834 - RNA, 24 nt, Human
aguaauacguuuugacauaagaug

SEQ ID NO: 97835 - RNA, 27 nt, Human
uuuauucuucuagaguucagaguccuu

SEQ ID NO: 97836 - RNA, 19 nt, Human
agagacuuuagucuuuggg

SEQ ID NO: 97837 - RNA, 28 nt, Human
ucuguccacuccccuuuuguggggguga

SEQ ID NO: 97838 - RNA, 22 nt, Human
gcccaagaaacauaaacauaua

SEQ ID NO: 97839 - RNA, 25 nt, Human
aauagccagggucuguaggcaucac

SEQ ID NO: 97840 - RNA, 26 nt, Human
uuaguacuacuaguaucugccuuauu

SEQ ID NO: 97841 - RNA, 23 nt, Human
aggcuggagugcauuggcgcgau

SEQ ID NO: 97842 - RNA, 23 nt, Human
gaagcugccgaugaggugugugc

SEQ ID NO: 97843 - RNA, 27 nt, Human
uccaguucagcuccugcacaguugcuc

SEQ ID NO: 97844 - RNA, 25 nt, Human
aucauacaucuuggagaaccuuucu

SEQ ID NO: 97845 - RNA, 27 nt, Human
uuuuccuuggccccuccaguuuuggug

SEQ ID NO: 97846 - RNA, 23 nt, Human
cugaggcaggagaauuugcuuga

SEQ ID NO: 97847 - RNA, 23 nt, Human
aauuuaaaaaacuccugucuugc

SEQ ID NO: 97848 - RNA, 25 nt, Human
uacaggaccugcagcuuuguuacau

SEQ ID NO: 97849 - RNA, 23 nt, Human
acccuuuagaucuugauuucuug

SEQ ID NO: 97850 - RNA, 25 nt, Human
agcggcagcagccuccguggccucc

SEQ ID NO: 97851 - RNA, 23 nt, Human
aaccaagcaguuccucauucaca

SEQ ID NO: 97852 - RNA, 21 nt, Human
cucuccucaccacauuauacc

SEQ ID NO: 97853 - RNA, 26 nt, Human
cuguuuugguuuugcucacaaaaguc

SEQ ID NO: 97854 - RNA, 26 nt, Human
ccaucugcaucuuaacaugcucucua

SEQ ID NO: 97855 - RNA, 22 nt, Human
gauacgggaagcguuugaaggc

SEQ ID NO: 97856 - RNA, 21 nt, Human
auggaaaugcaaacugggcug

SEQ ID NO: 97857 - RNA, 22 nt, Human
gauuaaguuuguucauucucug

SEQ ID NO: 97858 - RNA, 18 nt, Human
guucaacccacaccucca

SEQ ID NO: 97859 - RNA, 26 nt, Human
cgcagcccagaggcgcccagaggaag

SEQ ID NO: 97860 - RNA, 25 nt, Human
guuuugcuccuggguucaaguagua

SEQ ID NO: 97861 - RNA, 24 nt, Human
ccacaguuuuaauauauuauucuu

SEQ ID NO: 97862 - RNA, 27 nt, Human
ccgggaagcggagguugcagggagccg

SEQ ID NO: 97863 - RNA, 23 nt, Human
gaggcugaggccauggcaggaca

SEQ ID NO: 97864 - RNA, 21 nt, Human
ggauaucuuggcuuugccaca

SEQ ID NO: 97865 - RNA, 21 nt, Human
uccccugaagcuccucuccgg

SEQ ID NO: 97866 - RNA, 27 nt, Human
cugugcacaccugcucucuccucucuc

SEQ ID NO: 97867 - RNA, 27 nt, Human
caguuggguucuguggaguguccagag

SEQ ID NO: 97868 - RNA, 29 nt, Human
cuuacccuccacuuccuccuccuguuugg

SEQ ID NO: 97869 - RNA, 22 nt, Human
ucuuguucccguagaagaaaga

SEQ ID NO: 97870 - RNA, 20 nt, Human
auuauuccucuugcugguca

SEQ ID NO: 97871 - RNA, 26 nt, Human
ggagacacuggcaggagaugugcugu

SEQ ID NO: 97872 - RNA, 26 nt, Human
cugccucugugcgaagcuuacgggag

SEQ ID NO: 97873 - RNA, 26 nt, Human
caucacagcgccagcccuguuuuuag

SEQ ID NO: 97874 - RNA, 26 nt, Human
cacggcacccagccuagcucucagau

SEQ ID NO: 97875 - RNA, 21 nt, Human
cccacugacgggcacugagcc

SEQ ID NO: 97876 - RNA, 22 nt, Human
gaacuccuggccucagguguga

SEQ ID NO: 97877 - RNA, 24 nt, Human
gucuuugguuccucauggcuguua

SEQ ID NO: 97878 - RNA, 25 nt, Human
ucucccauccucucucaggaagcuu

SEQ ID NO: 97879 - RNA, 27 nt, Human
cuugacagcucucccucugugcugggc

SEQ ID NO: 97880 - RNA, 19 nt, Human
uguggaauuguugcacaug

SEQ ID NO: 97881 - RNA, 23 nt, Human
cccaggaggaggaggcugcagug

SEQ ID NO: 97882 - RNA, 26 nt, Human
gggucaggaacacuacacugcacagg

SEQ ID NO: 97883 - RNA, 25 nt, Human
cucucacaggacaugcuuugugcca

SEQ ID NO: 97884 - RNA, 24 nt, Human
aggaagaggccucgcgcagaggag

SEQ ID NO: 97885 - RNA, 25 nt, Human
uaaauuaaccacaagaaaauaaucc

SEQ ID NO: 97886 - RNA, 21 nt, Human
auuuuucugauuuuuaaacuc

SEQ ID NO: 97887 - RNA, 27 nt, Human
gcucccaaucuuccuucuuuugcuucu

SEQ ID NO: 97888 - RNA, 17 nt, Human
auuuucuccaugucugu

SEQ ID NO: 97889 - RNA, 28 nt, Human
guguacauucuucaccuccuggugcccu

SEQ ID NO: 97890 - RNA, 22 nt, Human
cugaggcagaaggaucgcuuga

SEQ ID NO: 97891 - RNA, 27 nt, Human
gugccgauuucaugcauucuagugcag

SEQ ID NO: 97892 - RNA, 25 nt, Human
gcccaggcuggagugcaguggcgaa

SEQ ID NO: 97893 - RNA, 24 nt, Human
aguuuuugcuaauuuuuaggcuga

SEQ ID NO: 97894 - RNA, 23 nt, Human
uagugauugugucugcauuguua

SEQ ID NO: 97895 - RNA, 23 nt, Human
agcacuugccuuuacgaccaugu

SEQ ID NO: 97896 - RNA, 21 nt, Human
uccugcucucuucaggaggcc

SEQ ID NO: 97897 - RNA, 22 nt, Human
ggcugcuggagcugcugccucu

SEQ ID NO: 97898 - RNA, 20 nt, Human
guugagugaaaggaaggagg

SEQ ID NO: 97899 - RNA, 21 nt, Human
uucaauacugucccacuucuc

SEQ ID NO: 97900 - RNA, 22 nt, Human
cauggccgccucaggccuccau

SEQ ID NO: 97901 - RNA, 24 nt, Human
cuguugcccaggcugaagugcagu

SEQ ID NO: 97902 - RNA, 21 nt, Human
guuauuuucugagugugcaga

SEQ ID NO: 97903 - RNA, 25 nt, Human
agauucucaaaggagcgagcauguc

SEQ ID NO: 97904 - RNA, 25 nt, Human
aaugcccuuuucuggaguggccagu

SEQ ID NO: 97905 - RNA, 25 nt, Human
uugcccuuuuccauguauuuuuucc

SEQ ID NO: 97906 - RNA, 18 nt, Human
ucccuggccaccagcaca

SEQ ID NO: 97907 - RNA, 23 nt, Human
agagacacagcaugggcagugcc

SEQ ID NO: 97908 - RNA, 25 nt, Human
gaaacaaaaaguggaaacuauucua

SEQ ID NO: 97909 - RNA, 25 nt, Human
ggcuggaguaaggcuugcuguggga

SEQ ID NO: 97910 - RNA, 22 nt, Human
caccacuacacuccagccuggg

SEQ ID NO: 97911 - RNA, 22 nt, Human
caccacugcacuccaaccuggg

SEQ ID NO: 97912 - RNA, 29 nt, Human
cccugucucugugcccuccagcaagaagc

SEQ ID NO: 97913 - RNA, 22 nt, Human
gguaacuuaacagagugucaga

SEQ ID NO: 97914 - RNA, 26 nt, Human
uuuuacaaauuuaauuuugcagauua

SEQ ID NO: 97915 - RNA, 22 nt, Human
ugacuccguuuccuuuuguagg

SEQ ID NO: 97916 - RNA, 23 nt, Human
ccagccaguucgcuuuuucuccu

SEQ ID NO: 97917 - RNA, 17 nt, Human
auuaaugucacuccuuu

SEQ ID NO: 97918 - RNA, 25 nt, Human
ugaagcaacugugaauucauucugg

SEQ ID NO: 97919 - RNA, 22 nt, Human
auccuguuggcuuuggguuucc

SEQ ID NO: 97920 - RNA, 22 nt, Human
ugggcgaugucacucagccccu

SEQ ID NO: 97921 - RNA, 23 nt, Human
uguuuggaaucgugccacugcug

SEQ ID NO: 97922 - RNA, 23 nt, Human
uggaacuccauaaggaggggcca

SEQ ID NO: 97923 - RNA, 20 nt, Human
ccugccccucgcccugcaga

SEQ ID NO: 97924 - RNA, 22 nt, Human
ggcuuagagcuuggaacaaggg

SEQ ID NO: 97925 - RNA, 24 nt, Human
cacucacugcagagcugcugccug

SEQ ID NO: 97926 - RNA, 22 nt, Human
ucuuacuugccacaaaauaaca

SEQ ID NO: 97927 - RNA, 20 nt, Human
acugggaaccccuccuggcc

SEQ ID NO: 97928 - RNA, 25 nt, Human
acugagagcugccuccuggucucuu

SEQ ID NO: 97929 - RNA, 23 nt, Human
ggggccagggaaacaaaauuuua

SEQ ID NO: 97930 - RNA, 25 nt, Human
ccccucuccccucauggagaaacau

SEQ ID NO: 97931 - RNA, 22 nt, Human
ggcccagaaacagcagcuuaaa

SEQ ID NO: 97932 - RNA, 22 nt, Human
gaguagcugggacuacaggcau

SEQ ID NO: 97933 - RNA, 21 nt, Human
augauucuccugccucagccu

SEQ ID NO: 97934 - RNA, 22 nt, Human
aaaaugcuagaaaaccaagcau

SEQ ID NO: 97935 - RNA, 19 nt, Human
auaaaugcagcuugggguu

SEQ ID NO: 97936 - RNA, 23 nt, Human
acaauucuaagaaauugugcaaa

SEQ ID NO: 97937 - RNA, 27 nt, Human
uuggcuugugauggaggcgucuuuggg

SEQ ID NO: 97938 - RNA, 21 nt, Human
ugacuggaguucaguggugca

SEQ ID NO: 97939 - RNA, 21 nt, Human
acucacugcaggcuccgccuc

SEQ ID NO: 97940 - RNA, 23 nt, Human
ccuccacugcugcucccgggucc

SEQ ID NO: 97941 - RNA, 22 nt, Human
ucccugguggagcugaccccca

SEQ ID NO: 97942 - RNA, 23 nt, Human
ccuccaucugcuugcugucauaa

SEQ ID NO: 97943 - RNA, 20 nt, Human
gcucgcccagcucgcccagc

SEQ ID NO: 97944 - RNA, 20 nt, Human
ccuugcccugccucaguuua

SEQ ID NO: 97945 - RNA, 23 nt, Human
aggcuauuccuaggccucaggcc

SEQ ID NO: 97946 - RNA, 27 nt, Human
ucagcccaccauuucuccucaccuggg

SEQ ID NO: 97947 - RNA, 19 nt, Human
gcagacaacccuguccuca

SEQ ID NO: 97948 - RNA, 22 nt, Human
acuugcaugcagcagcuuuuga

SEQ ID NO: 97949 - RNA, 21 nt, Human
uaacuggaaaagauguuaaca

SEQ ID NO: 97950 - RNA, 20 nt, Human
ccccaaaauaugcagaccuu

SEQ ID NO: 97951 - RNA, 22 nt, Human
ucucuguaccucuaacuggcag

SEQ ID NO: 97952 - RNA, 27 nt, Human
uuagcuuuguguuguaugcuaguuuaa

SEQ ID NO: 97953 - RNA, 21 nt, Human
uuucugcucaaucuguuaaca

SEQ ID NO: 97954 - RNA, 19 nt, Human
ccaguucuuccucuuuuac

SEQ ID NO: 97955 - RNA, 23 nt, Human
uuaccucaauucuuacuguagua

SEQ ID NO: 97956 - RNA, 25 nt, Human
ugucuguagccaaaacuuguuucca

SEQ ID NO: 97957 - RNA, 24 nt, Human
cuucuuuggaucucaggcucuagg

SEQ ID NO: 97958 - RNA, 22 nt, Human
uggaagggaagugguugcugug

SEQ ID NO: 97959 - RNA, 18 nt, Human
ucugaacuauaucuugac

SEQ ID NO: 97960 - RNA, 23 nt, Human
uuacuguuucugucaggagagca

SEQ ID NO: 97961 - RNA, 21 nt, Human
ccaaaugcuauacugugucau

SEQ ID NO: 97962 - RNA, 19 nt, Human
uccuuaucuuccucuuuca

SEQ ID NO: 97963 - RNA, 24 nt, Human
agcagaccaccccgccugcccuca

SEQ ID NO: 97964 - RNA, 21 nt, Human
ccaguauuaugcauauauaag

SEQ ID NO: 97965 - RNA, 21 nt, Human
guugcauucaaagacuguugu

SEQ ID NO: 97966 - RNA, 27 nt, Human
agcuagcacaugauuauccuucuguuc

SEQ ID NO: 97967 - RNA, 26 nt, Human
ugauuacuauauuuuguucacacuaa

SEQ ID NO: 97968 - RNA, 22 nt, Human
ugggaggcggagaguacaguga

SEQ ID NO: 97969 - RNA, 27 nt, Human
accagccuucccaacaugccuccugcc

SEQ ID NO: 97970 - RNA, 20 nt, Human
gagcaagacugucucaaaaa

SEQ ID NO: 97971 - RNA, 21 nt, Human
ggggugcucaggccugccuuu

SEQ ID NO: 97972 - RNA, 26 nt, Human
acacccacgcugguuucugugcagug

SEQ ID NO: 97973 - RNA, 23 nt, Human
gcccugggccugcaccucuccag

SEQ ID NO: 97974 - RNA, 25 nt, Human
cacgaugaccacagacucaaugugc

SEQ ID NO: 97975 - RNA, 21 nt, Human
guccaguuaagugaucaccaa

SEQ ID NO: 97976 - RNA, 28 nt, Human
ggguuccccacaguuucagagguggucc

SEQ ID NO: 97977 - RNA, 23 nt, Human
aggcaagagugcagugguaugau

SEQ ID NO: 97978 - RNA, 29 nt, Human
ucuugccgcccgcaccugcagccccgcac

SEQ ID NO: 97979 - RNA, 26 nt, Human
ccugacucccuguggggguggccauc

SEQ ID NO: 97980 - RNA, 27 nt, Human
agcuggauaugucuaauggguauuuaa

SEQ ID NO: 97981 - RNA, 24 nt, Human
ccuuugaagaguucaaguucugua

SEQ ID NO: 97982 - RNA, 22 nt, Human
augugucccaucaugcuuucca

SEQ ID NO: 97983 - RNA, 22 nt, Human
cccuaccccuccuccaugggcc

SEQ ID NO: 97984 - RNA, 26 nt, Human
uccuccucgcaggagggaccaggcgg

SEQ ID NO: 97985 - RNA, 21 nt, Human
caugccuccuggaauucucca

SEQ ID NO: 97986 - RNA, 24 nt, Human
acccccagcucugccagugcucuc

SEQ ID NO: 97987 - RNA, 23 nt, Human
ucaugccagguuugcaccagccu

SEQ ID NO: 97988 - RNA, 27 nt, Human
gcugcaaccuguugauagcaagugaau

SEQ ID NO: 97989 - RNA, 26 nt, Human
ccuugggcuuuucagcaguaagggga

SEQ ID NO: 97990 - RNA, 22 nt, Human
ccaaacacaccucaaauuggcu

SEQ ID NO: 97991 - RNA, 28 nt, Human
cccccagucagaucucaggcuugucccc

SEQ ID NO: 97992 - RNA, 22 nt, Human
gccuggccccucccccucuacc

SEQ ID NO: 97993 - RNA, 25 nt, Human
guccuaggcuggaugggaggguggc

SEQ ID NO: 97994 - RNA, 21 nt, Human
ugacaguugggauacuuuaau

SEQ ID NO: 97995 - RNA, 20 nt, Human
gcugagcucuucaccugcau

SEQ ID NO: 97996 - RNA, 23 nt, Human
gccuuuuguagcugucauggugc

SEQ ID NO: 97997 - RNA, 22 nt, Human
ccagcaucugcaccuaaaccca

SEQ ID NO: 97998 - RNA, 25 nt, Human
ccugaaaaauaccagcacuuuuuca

SEQ ID NO: 97999 - RNA, 27 nt, Human
uuagaaaauauguagcugucaucauuu

SEQ ID NO: 98000 - RNA, 20 nt, Human
ggcugcacucucaccuggag

SEQ ID NO: 98001 - RNA, 20 nt, Human
aggaaacaaaaaggaaauga

SEQ ID NO: 98002 - RNA, 25 nt, Human
uguucgcuggcugaucauugcagua

SEQ ID NO: 98003 - RNA, 27 nt, Human
cccaggaggagagagagcugggcucag

SEQ ID NO: 98004 - RNA, 18 nt, Human
cuucugcuaaauuucacu

SEQ ID NO: 98005 - RNA, 27 nt, Human
ugaccaacauggugagacccugucucu

SEQ ID NO: 98006 - RNA, 21 nt, Human
cccccaggcucacagcagugg

SEQ ID NO: 98007 - RNA, 23 nt, Human
uaagauuuauaccauugaucuuu

SEQ ID NO: 98008 - RNA, 23 nt, Human
aguggccucuuugucuaaaacaa

SEQ ID NO: 98009 - RNA, 21 nt, Human
cucuuccgcuaguugugaaag

SEQ ID NO: 98010 - RNA, 21 nt, Human
aauccagcauuguugagcugu

SEQ ID NO: 98011 - RNA, 24 nt, Human
ccucuucagauccuggucugcacc

SEQ ID NO: 98012 - RNA, 19 nt, Human
uaaauguuagaccacagaa

SEQ ID NO: 98013 - RNA, 22 nt, Human
cugauucccaacacucacuuuc

SEQ ID NO: 98014 - RNA, 24 nt, Human
gcugccucugcuuccagcuuugug

SEQ ID NO: 98015 - RNA, 22 nt, Human
ugaaaagagaaaaauaagcuga

SEQ ID NO: 98016 - RNA, 27 nt, Human
ggcacuggaugacucuccaggugcagg

SEQ ID NO: 98017 - RNA, 23 nt, Human
gaucuuuccucuccuccuuccca

SEQ ID NO: 98018 - RNA, 23 nt, Human
agcugaggaggcaccuacacuca

SEQ ID NO: 98019 - RNA, 23 nt, Human
gauuacuaacccuuccugauccu

SEQ ID NO: 98020 - RNA, 23 nt, Human
ccuuucucuccuggcucggggua

SEQ ID NO: 98021 - RNA, 23 nt, Human
auucuaugucugguuaaauguuc

SEQ ID NO: 98022 - RNA, 27 nt, Human
gaauguaugccauagcuuucuuugcua

SEQ ID NO: 98023 - RNA, 22 nt, Human
gggggagcugaaagggagcccc

SEQ ID NO: 98024 - RNA, 26 nt, Human
ggcaggagaugcugcaggcagguguc

SEQ ID NO: 98025 - RNA, 27 nt, Human
ggugaucuccuguggcucaucggugga

SEQ ID NO: 98026 - RNA, 27 nt, Human
aggauuuaucuuuaggccaggcuugcc

SEQ ID NO: 98027 - RNA, 21 nt, Human
gcagaguucuuguugugggua

SEQ ID NO: 98028 - RNA, 25 nt, Human
gccucggggucgggcuccggcugcg

SEQ ID NO: 98029 - RNA, 27 nt, Human
ccuugcaggaaugagucacucuuacuu

SEQ ID NO: 98030 - RNA, 23 nt, Human
gaugcggcggggcggcagccuga

SEQ ID NO: 98031 - RNA, 27 nt, Human
cucuagugggaaaccucagguagcucc

SEQ ID NO: 98032 - RNA, 27 nt, Human
acugccuccugcccuucucuccugucu

SEQ ID NO: 98033 - RNA, 22 nt, Human
ccacuacacuccagccugggag

SEQ ID NO: 98034 - RNA, 20 nt, Human
ugagggaggggcaggagagc

SEQ ID NO: 98035 - RNA, 25 nt, Human
cagaagcuacagcugccaggucaug

SEQ ID NO: 98036 - RNA, 26 nt, Human
agccauugcaacuucuuuuucuucag

SEQ ID NO: 98037 - RNA, 29 nt, Human
gucaugcccagcuuggagugccacauggc

SEQ ID NO: 98038 - RNA, 22 nt, Human
guugccuauucaguguuacaga

SEQ ID NO: 98039 - RNA, 20 nt, Human
ucacagcuggacugggucug

SEQ ID NO: 98040 - RNA, 22 nt, Human
ucgccuguaaucccagcacuuu

SEQ ID NO: 98041 - RNA, 21 nt, Human
ggaguaggaggagacggagga

SEQ ID NO: 98042 - RNA, 22 nt, Human
ugcgaggccaggagaucaagac

SEQ ID NO: 98043 - RNA, 22 nt, Human
cacgaggucaggagacugagac

SEQ ID NO: 98044 - RNA, 22 nt, Human
cuucauacuauccauccauacc

SEQ ID NO: 98045 - RNA, 25 nt, Human
gcccuccagcuccccuccaguuacc

SEQ ID NO: 98046 - RNA, 25 nt, Human
acacuccugcucaaaugguguuauu

SEQ ID NO: 98047 - RNA, 24 nt, Human
cacaaaaugcccggcgaagccaca

SEQ ID NO: 98048 - RNA, 27 nt, Human
gcaagacaguggucaacaggaagaccc

SEQ ID NO: 98049 - RNA, 27 nt, Human
gccacagugcuuagagacaggccacug

SEQ ID NO: 98050 - RNA, 21 nt, Human
agagcgacgaacugagcugua

SEQ ID NO: 98051 - RNA, 24 nt, Human
uuguuuauuuaaaauauuccugca

SEQ ID NO: 98052 - RNA, 24 nt, Human
caccaguguuccugaagcugcugu

SEQ ID NO: 98053 - RNA, 24 nt, Human
uccuugccguucagccacugugaa

SEQ ID NO: 98054 - RNA, 23 nt, Human
cacugcugggcuccacuuggcuc

SEQ ID NO: 98055 - RNA, 19 nt, Human
ucaguuccuucugcagccu

SEQ ID NO: 98056 - RNA, 24 nt, Human
ucaccagggguccgucaguaguca

SEQ ID NO: 98057 - RNA, 21 nt, Human
ggcuguugcgcucccaccuca

SEQ ID NO: 98058 - RNA, 27 nt, Human
aaauguucauaaaagccaggugugguu

SEQ ID NO: 98059 - RNA, 18 nt, Human
guuuuuaagaauuucuug

SEQ ID NO: 98060 - RNA, 18 nt, Human
uuuauugguaacagguga

SEQ ID NO: 98061 - RNA, 27 nt, Human
cucuccaggagaccuacccuccacagg

SEQ ID NO: 98062 - RNA, 23 nt, Human
ugaaaacaaggagaccuggggug

SEQ ID NO: 98063 - RNA, 19 nt, Human
ggggaggugggguuuggug

SEQ ID NO: 98064 - RNA, 19 nt, Human
aaccaaaauuauuuuacag

SEQ ID NO: 98065 - RNA, 22 nt, Human
cugaggcaggagaauugcuuga

SEQ ID NO: 98066 - RNA, 31 nt, Human
ggccugcacccagccccugcccacaaaaccc

SEQ ID NO: 98067 - RNA, 22 nt, Human
cuguucucuuucccugccacgu

SEQ ID NO: 98068 - RNA, 22 nt, Human
cagaaccuuacuggcacugugg

SEQ ID NO: 98069 - RNA, 22 nt, Human
cuuggagcagcugugggugcgg

SEQ ID NO: 98070 - RNA, 21 nt, Human
uuagcacugcaccucuacauc

SEQ ID NO: 98071 - RNA, 27 nt, Human
ggaggcugaagggacgcucggguaggc

SEQ ID NO: 98072 - RNA, 22 nt, Human
guugcccaagcuggagugaagu

SEQ ID NO: 98073 - RNA, 25 nt, Human
aacuuagccauuuuucaaagcaauu

SEQ ID NO: 98074 - RNA, 23 nt, Human
uccccaugacaccaccugaacgu

SEQ ID NO: 98075 - RNA, 22 nt, Human
gcuuauuccuguaaucccaaca

SEQ ID NO: 98076 - RNA, 21 nt, Human
uuucucugggggccguggggu

SEQ ID NO: 98077 - RNA, 25 nt, Human
gcuccuggcaccgccagcugcuacu

SEQ ID NO: 98078 - RNA, 20 nt, Human
aguguaguucuucaauagag

SEQ ID NO: 98079 - RNA, 25 nt, Human
cuggcagcagagccugggcagguga

SEQ ID NO: 98080 - RNA, 23 nt, Human
uggcucuugagacccacacauau

SEQ ID NO: 98081 - RNA, 21 nt, Human
cucucauccgcucuggcccca

SEQ ID NO: 98082 - RNA, 19 nt, Human
uagccaugccuuucuugga

SEQ ID NO: 98083 - RNA, 20 nt, Human
cacccaccacuguucagccu

SEQ ID NO: 98084 - RNA, 27 nt, Human
ggugaaugugugaaggucuugccugaa

SEQ ID NO: 98085 - RNA, 19 nt, Human
cugcccagggcccgcagug

SEQ ID NO: 98086 - RNA, 26 nt, Human
cuucugcuuccucaucucagcccacu

SEQ ID NO: 98087 - RNA, 26 nt, Human
gggagcacagccagguucccccagac

SEQ ID NO: 98088 - RNA, 20 nt, Human
gcaaggcucuuccugggaac

SEQ ID NO: 98089 - RNA, 24 nt, Human
gagcccuucuucccaucaaaaagg

SEQ ID NO: 98090 - RNA, 22 nt, Human
ucugacauuaacaguuuuccau

SEQ ID NO: 98091 - RNA, 21 nt, Human
aguagcugcaacaacaggcac

SEQ ID NO: 98092 - RNA, 26 nt, Human
ugcccagguccuggggugguggcagc

SEQ ID NO: 98093 - RNA, 24 nt, Human
uucaaagcaacaccaccaccacug

SEQ ID NO: 98094 - RNA, 26 nt, Human
ccuccugccgcugccugccauugaca

SEQ ID NO: 98095 - RNA, 25 nt, Human
ucugucacccagacuggagugcagu

SEQ ID NO: 98096 - RNA, 26 nt, Human
cuucacccucuuuaauuucacaacau

SEQ ID NO: 98097 - RNA, 19 nt, Human
ggaauccugccugccuuca

SEQ ID NO: 98098 - RNA, 24 nt, Human
cuguuuuuaagguuauucuaaauu

SEQ ID NO: 98099 - RNA, 21 nt, Human
uguaggaaagagcagaccaaa

SEQ ID NO: 98100 - RNA, 24 nt, Human
auugcaaaugaucuguacuuuagg

SEQ ID NO: 98101 - RNA, 27 nt, Human
gcugccucugccuuuauccugggagau

SEQ ID NO: 98102 - RNA, 26 nt, Human
cacuccucaaacucgcagcaguaauu

SEQ ID NO: 98103 - RNA, 17 nt, Human
cuucccuuauaaagcaa

SEQ ID NO: 98104 - RNA, 32 nt, Human
ugacacaugguacaggcuuggagcuugcaggu

SEQ ID NO: 98105 - RNA, 26 nt, Human
ucucuagccacccccuuguccccagu

SEQ ID NO: 98106 - RNA, 22 nt, Human
accacaacuuuauauggauaua

SEQ ID NO: 98107 - RNA, 23 nt, Human
gcccccagcauuccagugcucuc

SEQ ID NO: 98108 - RNA, 23 nt, Human
uccuggccacauucaccaaccaa

SEQ ID NO: 98109 - RNA, 21 nt, Human
ccugggccucuacacugggca

SEQ ID NO: 98110 - RNA, 23 nt, Human
accagugauuucuccuguuucuu

SEQ ID NO: 98111 - RNA, 21 nt, Human
ccaaaacuccuucuuuugucu

SEQ ID NO: 98112 - RNA, 23 nt, Human
gucaggggagguuguacagguga

SEQ ID NO: 98113 - RNA, 22 nt, Human
acuccaguuaauggcacugcuc

SEQ ID NO: 98114 - RNA, 27 nt, Human
cugcuacuuggagcucagaagccacuu

SEQ ID NO: 98115 - RNA, 20 nt, Human
cuuccugcaccucaggaugg

SEQ ID NO: 98116 - RNA, 21 nt, Human
cacacaccaccuuuuggcuua

SEQ ID NO: 98117 - RNA, 23 nt, Human
gggauguugggcuuccucucuca

SEQ ID NO: 98118 - RNA, 24 nt, Human
cuagggaaaugaagaaaucacgca

SEQ ID NO: 98119 - RNA, 21 nt, Human
gcaggcuggauuuaaucugua

SEQ ID NO: 98120 - RNA, 25 nt, Human
cugcuuucuccauuguaaaccacaa

SEQ ID NO: 98121 - RNA, 21 nt, Human
guuacccaggcuggucucaac

SEQ ID NO: 98122 - RNA, 21 nt, Human
gaaauaagugcauuucugcaa

SEQ ID NO: 98123 - RNA, 21 nt, Human
ugccuuacacccagagcgucc

SEQ ID NO: 98124 - RNA, 21 nt, Human
uggacucaggcuggaggcaga

SEQ ID NO: 98125 - RNA, 22 nt, Human
ugcuuggaauaaauacuugccu

SEQ ID NO: 98126 - RNA, 27 nt, Human
cucccucccgccucaguggaucaugcc

SEQ ID NO: 98127 - RNA, 23 nt, Human
ggcaaaguccucuguguccuaaa

SEQ ID NO: 98128 - RNA, 20 nt, Human
uccccacucugggcuugugc

SEQ ID NO: 98129 - RNA, 23 nt, Human
uuuaaggcuuuaaugguacugau

SEQ ID NO: 98130 - RNA, 20 nt, Human
uuuagccuggaccaaaggga

SEQ ID NO: 98131 - RNA, 27 nt, Human
aggcugggagagguugggugcucuccu

SEQ ID NO: 98132 - RNA, 21 nt, Human
aacacagccuuaggucuucaa

SEQ ID NO: 98133 - RNA, 22 nt, Human
cugggaucuucaguggcaggag

SEQ ID NO: 98134 - RNA, 20 nt, Human
auguucacugcaaugcugga

SEQ ID NO: 98135 - RNA, 17 nt, Human
cuucccuuuuauaguuc

SEQ ID NO: 98136 - RNA, 23 nt, Human
caaacagccacaccccuccucca

SEQ ID NO: 98137 - RNA, 17 nt, Human
cugccucugccucuguu

SEQ ID NO: 98138 - RNA, 22 nt, Human
uauuucaagccucuuauacuua

SEQ ID NO: 98139 - RNA, 21 nt, Human
aagguuggauggaugggugga

SEQ ID NO: 98140 - RNA, 22 nt, Human
cuccaugaagcuuggacauaua

SEQ ID NO: 98141 - RNA, 23 nt, Human
ucucagcagcucaacugcccagc

SEQ ID NO: 98142 - RNA, 19 nt, Human
acugugcuaauggaagcac

SEQ ID NO: 98143 - RNA, 22 nt, Human
agacggagcaagacuccaucuc

SEQ ID NO: 98144 - RNA, 22 nt, Human
aucuuguacuccauccugggcc

SEQ ID NO: 98145 - RNA, 23 nt, Human
caggugcagcccccacugccuuu

SEQ ID NO: 98146 - RNA, 22 nt, Human
aacauggggaaacagaugccuc

SEQ ID NO: 98147 - RNA, 22 nt, Human
ccuauccuguucuuuuaauuga

SEQ ID NO: 98148 - RNA, 27 nt, Human
cgccugccccuuucugcagccuaggcg

SEQ ID NO: 98149 - RNA, 22 nt, Human
aaccaacaaccucaacugccua

SEQ ID NO: 98150 - RNA, 21 nt, Human
uucuggaauugauuuuuccca

SEQ ID NO: 98151 - RNA, 27 nt, Human
ccugguggccaugcuccucuuccccag

SEQ ID NO: 98152 - RNA, 25 nt, Human
uugcucuucaccaguguuuuucuuc

SEQ ID NO: 98153 - RNA, 23 nt, Human
augaucaauguauuucucugccu

SEQ ID NO: 98154 - RNA, 24 nt, Human
ggugagcaggugaugccccaggga

SEQ ID NO: 98155 - RNA, 21 nt, Human
gucugagaccagccugggcaa

SEQ ID NO: 98156 - RNA, 22 nt, Human
aguccccagagugaagcuguug

SEQ ID NO: 98157 - RNA, 22 nt, Human
uaugcuuguaauaaaagcaaaa

SEQ ID NO: 98158 - RNA, 21 nt, Human
acuacgagaucagauuuugga

SEQ ID NO: 98159 - RNA, 22 nt, Human
cccgauuagcugggaucacagg

SEQ ID NO: 98160 - RNA, 22 nt, Human
gaaaaagaagaaaagauucuuu

SEQ ID NO: 98161 - RNA, 26 nt, Human
ggggcccaggggaggccugagcuugg

SEQ ID NO: 98162 - RNA, 23 nt, Human
ggagucccucaugcuugaguccc

SEQ ID NO: 98163 - RNA, 21 nt, Human
gaaggugggaagcagaugacu

SEQ ID NO: 98164 - RNA, 21 nt, Human
uuaguaaauuauuagaaucca

SEQ ID NO: 98165 - RNA, 22 nt, Human
acugcacccuccgccucucggg

SEQ ID NO: 98166 - RNA, 17 nt, Human
agcaccacuuaccaaau

SEQ ID NO: 98167 - RNA, 27 nt, Human
uugagcccaggagauugaggcugcagu

SEQ ID NO: 98168 - RNA, 23 nt, Human
agauuggaauuaguuuucuguuu

SEQ ID NO: 98169 - RNA, 28 nt, Human
gggaggcugaggugggaaaaugacuuga

SEQ ID NO: 98170 - RNA, 22 nt, Human
agcccacugcuaguuugacuuu

SEQ ID NO: 98171 - RNA, 26 nt, Human
cccacauuccuccggccccaggagca

SEQ ID NO: 98172 - RNA, 24 nt, Human
cccuccagaagcugcaagagcuuc

SEQ ID NO: 98173 - RNA, 23 nt, Human
gucgcccaggcuggagugcaaug

SEQ ID NO: 98174 - RNA, 18 nt, Human
uggaguguuggcuucuca

SEQ ID NO: 98175 - RNA, 22 nt, Human
uucuggagacagaagucaaaag

SEQ ID NO: 98176 - RNA, 24 nt, Human
gguggccugcuccuuuucugggcc

SEQ ID NO: 98177 - RNA, 26 nt, Human
aaaugagagccugggcuuggugucga

SEQ ID NO: 98178 - RNA, 24 nt, Human
ccucccuccccaccccccaaaaaa

SEQ ID NO: 98179 - RNA, 20 nt, Human
caguucugaaacauguggcu

SEQ ID NO: 98180 - RNA, 22 nt, Human
uguuuguaaucccagcacuuug

SEQ ID NO: 98181 - RNA, 23 nt, Human
uuucacccucuauuuccaaagcc

SEQ ID NO: 98182 - RNA, 27 nt, Human
gcccagccgagcagccugcuugucagc

SEQ ID NO: 98183 - RNA, 22 nt, Human
ccaugaagugaggagaugguua

SEQ ID NO: 98184 - RNA, 22 nt, Human
aaaguucaauacucuugaaaug

SEQ ID NO: 98185 - RNA, 21 nt, Human
auuuggcucugagcuaugaca

SEQ ID NO: 98186 - RNA, 21 nt, Human
cuaccuuccuguguaugcuga

SEQ ID NO: 98187 - RNA, 22 nt, Human
gcugccucuguaaauucaugua

SEQ ID NO: 98188 - RNA, 20 nt, Human
uuaagaugcugggcagcagu

SEQ ID NO: 98189 - RNA, 21 nt, Human
ggaccguacugaggacaugua

SEQ ID NO: 98190 - RNA, 19 nt, Human
cguccugugggcugcacag

SEQ ID NO: 98191 - RNA, 23 nt, Human
cggagagaaaggaauguuuagca

SEQ ID NO: 98192 - RNA, 26 nt, Human
ccaggugcagagcuccacagcucucu

SEQ ID NO: 98193 - RNA, 22 nt, Human
ggagaggccuggggugggacag

SEQ ID NO: 98194 - RNA, 20 nt, Human
caaagagaugugcugcagga

SEQ ID NO: 98195 - RNA, 21 nt, Human
ccuuucucuguauauugggcu

SEQ ID NO: 98196 - RNA, 24 nt, Human
gugcugucuuaaaaacaacugaag

SEQ ID NO: 98197 - RNA, 22 nt, Human
uugcuaggaggccuuagcaaua

SEQ ID NO: 98198 - RNA, 24 nt, Human
agugaggacuguccugcugggaca

SEQ ID NO: 98199 - RNA, 27 nt, Human
gcccagccugaaccuccgcaaaacccc

SEQ ID NO: 98200 - RNA, 22 nt, Human
gggucucuuuuaugaccucuuu

SEQ ID NO: 98201 - RNA, 27 nt, Human
guggaaagaaccagugacaccaucacu

SEQ ID NO: 98202 - RNA, 22 nt, Human
agccuccugaguagcuggauua

SEQ ID NO: 98203 - RNA, 22 nt, Human
gggggugggguggggagaaauc

SEQ ID NO: 98204 - RNA, 22 nt, Human
gagugguucacugcacugugaa

SEQ ID NO: 98205 - RNA, 22 nt, Human
aggcuggagugcgguggcuauu

SEQ ID NO: 98206 - RNA, 21 nt, Human
gcugcaccugugcauucucca

SEQ ID NO: 98207 - RNA, 26 nt, Human
cagccucuuaugucuuugucuuuaau

SEQ ID NO: 98208 - RNA, 21 nt, Human
ggguacccgggcacaccagcc

SEQ ID NO: 98209 - RNA, 23 nt, Human
aagcuguuuuuacuuuuucgccu

SEQ ID NO: 98210 - RNA, 25 nt, Human
aggggguggagggguguggcagugg

SEQ ID NO: 98211 - RNA, 23 nt, Human
guggggaggggaugggcuggagc

SEQ ID NO: 98212 - RNA, 20 nt, Human
cccaccccaucaggucagcu

SEQ ID NO: 98213 - RNA, 22 nt, Human
aacgggugccuggucagaaggc

SEQ ID NO: 98214 - RNA, 21 nt, Human
agcucuggccaccagcugggc

SEQ ID NO: 98215 - RNA, 20 nt, Human
caggcugcuggagugcagug

SEQ ID NO: 98216 - RNA, 20 nt, Human
aggucucaggauggagagaa

SEQ ID NO: 98217 - RNA, 23 nt, Human
ugcuuacaaagaaagcacuucuu

SEQ ID NO: 98218 - RNA, 21 nt, Human
gagagggagagugacagcagc

SEQ ID NO: 98219 - RNA, 24 nt, Human
gcaaacacaccuuucugcuuugcc

SEQ ID NO: 98220 - RNA, 23 nt, Human
agaaggagggcccaggcacuuuc

SEQ ID NO: 98221 - RNA, 20 nt, Human
ugcccaggcuggagugcaga

SEQ ID NO: 98222 - RNA, 20 nt, Human
aggugaaugugccaccucca

SEQ ID NO: 98223 - RNA, 21 nt, Human
gaggugccucaacauggagcc

SEQ ID NO: 98224 - RNA, 22 nt, Human
agccucccaaguagcugggacu

SEQ ID NO: 98225 - RNA, 27 nt, Human
agcaguuuucagccuccucuacccuac

SEQ ID NO: 98226 - RNA, 24 nt, Human
auauauuugacauuuuacauuuca

SEQ ID NO: 98227 - RNA, 26 nt, Human
gugcuccuuggagcuggugugcagug

SEQ ID NO: 98228 - RNA, 20 nt, Human
augcaaagacacagcgcugc

SEQ ID NO: 98229 - RNA, 24 nt, Human
uucuuuucuuccccuuguguuucc

SEQ ID NO: 98230 - RNA, 22 nt, Human
ggccucccaaagugcugggaug

SEQ ID NO: 98231 - RNA, 22 nt, Human
ggccucccaaaguucugggauu

SEQ ID NO: 98232 - RNA, 22 nt, Human
ccccacacuccuccuugcgcac

SEQ ID NO: 98233 - RNA, 26 nt, Human
ccucagcccgcuccugcccgcccagc

SEQ ID NO: 98234 - RNA, 22 nt, Human
acccaaccauacacacauacaa

SEQ ID NO: 98235 - RNA, 21 nt, Human
aauuaaaaugccacauuucug

SEQ ID NO: 98236 - RNA, 23 nt, Human
ggccaaagugcagggugggugaa

SEQ ID NO: 98237 - RNA, 17 nt, Human
ccgccucuccaccagcc

SEQ ID NO: 98238 - RNA, 22 nt, Human
uuguccaggcuggagugcaaug

SEQ ID NO: 98239 - RNA, 22 nt, Human
uuguccaggcuagagugcagug

SEQ ID NO: 98240 - RNA, 24 nt, Human
aacaggcaugacaaaaauauuuau

SEQ ID NO: 98241 - RNA, 25 nt, Human
uguuugugacaagacuaagcauuaa

SEQ ID NO: 98242 - RNA, 20 nt, Human
gcuguugcaacacugccuca

SEQ ID NO: 98243 - RNA, 21 nt, Human
gccaucccagccucacccugc

SEQ ID NO: 98244 - RNA, 27 nt, Human
ggaggcugaaguaggaggaucgucuug

SEQ ID NO: 98245 - RNA, 23 nt, Human
agcuaauuuuuguauuuuuuagu

SEQ ID NO: 98246 - RNA, 25 nt, Human
gcucgggagcggaaacagcggcagc

SEQ ID NO: 98247 - RNA, 23 nt, Human
cucuuuggucaguaacaagugca

SEQ ID NO: 98248 - RNA, 20 nt, Human
ucuccaccugaaccauggcu

SEQ ID NO: 98249 - RNA, 23 nt, Human
ggugagaagaaucagaaaaagaa

SEQ ID NO: 98250 - RNA, 23 nt, Human
ggcuuuauuugaugaauauugcu

SEQ ID NO: 98251 - RNA, 22 nt, Human
gugagcggaucaccugagguca

SEQ ID NO: 98252 - RNA, 22 nt, Human
agucacugugcauuuauucuca

SEQ ID NO: 98253 - RNA, 16 nt, Human
acuccugaaaccucaa

SEQ ID NO: 98254 - RNA, 23 nt, Human
cugaagacccgcaacggaguggg

SEQ ID NO: 98255 - RNA, 29 nt, Human
agguguguccuugaacugaggcccuguga

SEQ ID NO: 98256 - RNA, 19 nt, Human
aaggcggaacaugggugaa

SEQ ID NO: 98257 - RNA, 26 nt, Human
ucauaaggcacccgcgcgucuagccc

SEQ ID NO: 98258 - RNA, 27 nt, Human
cuccuucaggauuaaagauuuugcgga

SEQ ID NO: 98259 - RNA, 23 nt, Human
caggaauaugacacaaaggugga

SEQ ID NO: 98260 - RNA, 19 nt, Human
uggccucuguaagccugug

SEQ ID NO: 98261 - RNA, 20 nt, Human
gcccuggaugguggccagaa

SEQ ID NO: 98262 - RNA, 20 nt, Human
auagcuccuggaccuguguc

SEQ ID NO: 98263 - RNA, 23 nt, Human
ggaucucaggcuggagugcagug

SEQ ID NO: 98264 - RNA, 27 nt, Human
agauuguugauauauaccuucuguaaa

SEQ ID NO: 98265 - RNA, 25 nt, Human
cccugccugugcacagugggugggu

SEQ ID NO: 98266 - RNA, 26 nt, Human
ccugucucugccucugggucaugagu

SEQ ID NO: 98267 - RNA, 18 nt, Human
guggggaguucacuguga

SEQ ID NO: 98268 - RNA, 26 nt, Human
guauuuuuagaacuaucucaucauag

SEQ ID NO: 98269 - RNA, 21 nt, Human
ggaggccagaggacagagcag

SEQ ID NO: 98270 - RNA, 22 nt, Human
uccuccaggaaccuccacaucu

SEQ ID NO: 98271 - RNA, 25 nt, Human
uguugugauuaacaucaucaggcuu

SEQ ID NO: 98272 - RNA, 20 nt, Human
uuuaaaauugguuuaccuca

SEQ ID NO: 98273 - RNA, 26 nt, Human
ucagcacuuugggaggcugagguggg

SEQ ID NO: 98274 - RNA, 24 nt, Human
uuggucccuaugccaccccuggag

SEQ ID NO: 98275 - RNA, 22 nt, Human
gggcaaccccaccccugggagg

SEQ ID NO: 98276 - RNA, 19 nt, Human
uguugaagaauugaccuca

SEQ ID NO: 98277 - RNA, 21 nt, Human
ccaggccgccucacagccagg

SEQ ID NO: 98278 - RNA, 21 nt, Human
uuuucauuccuccugcaacua

SEQ ID NO: 98279 - RNA, 22 nt, Human
gagccccggcuccgccugcugu

SEQ ID NO: 98280 - RNA, 21 nt, Human
cacucacacuccaguuuguaa

SEQ ID NO: 98281 - RNA, 26 nt, Human
cagcacuccagcauuuuucuucaugu

SEQ ID NO: 98282 - RNA, 22 nt, Human
ccuccuccccagcccagccugc

SEQ ID NO: 98283 - RNA, 18 nt, Human
agcaauccgccuaccuca

SEQ ID NO: 98284 - RNA, 24 nt, Human
gccacugucuucucuuccuccucc

SEQ ID NO: 98285 - RNA, 26 nt, Human
gccaccaugcccagcugauuuuuugu

SEQ ID NO: 98286 - RNA, 22 nt, Human
uaggcagcaaauacuugauuga

SEQ ID NO: 98287 - RNA, 20 nt, Human
ccaguauuggguuuuauuga

SEQ ID NO: 98288 - RNA, 21 nt, Human
uucuaauucaccaugucacag

SEQ ID NO: 98289 - RNA, 24 nt, Human
gguuucuugaauaucugccccagu

SEQ ID NO: 98290 - RNA, 22 nt, Human
gaucaagauccaggucuauuuc

SEQ ID NO: 98291 - RNA, 25 nt, Human
gaugcauuuuaagguggaguacagu

SEQ ID NO: 98292 - RNA, 22 nt, Human
gccaugagcagccggcucgggg

SEQ ID NO: 98293 - RNA, 20 nt, Human
agcuaccucacuaugcugcu

SEQ ID NO: 98294 - RNA, 21 nt, Human
ggcaaggcacugcccucucug

SEQ ID NO: 98295 - RNA, 21 nt, Human
ccugggguugcugcuuuugcu

SEQ ID NO: 98296 - RNA, 27 nt, Human
agagacacaccugaccagccccucccc

SEQ ID NO: 98297 - RNA, 26 nt, Human
uuggacucuagcuauaugacauacug

SEQ ID NO: 98298 - RNA, 21 nt, Human
ccccucacuccacacuggcac

SEQ ID NO: 98299 - RNA, 23 nt, Human
aguugaguggagugggaagggaa

SEQ ID NO: 98300 - RNA, 24 nt, Human
acccccacgcugaacccagcugcc

SEQ ID NO: 98301 - RNA, 25 nt, Human
auagugguaacuuuucaaacagccc

SEQ ID NO: 98302 - RNA, 19 nt, Human
cugccucugagucugaauc

SEQ ID NO: 98303 - RNA, 27 nt, Human
ucuccaccauuucuucugcacaaagau

SEQ ID NO: 98304 - RNA, 20 nt, Human
gcuguguguucuguuaaguu

SEQ ID NO: 98305 - RNA, 24 nt, Human
cauguccucgucagccggcagcgg

SEQ ID NO: 98306 - RNA, 22 nt, Human
gcaugggucagagugggagguu

SEQ ID NO: 98307 - RNA, 24 nt, Human
uccaucaucagaaucacagugcuc

SEQ ID NO: 98308 - RNA, 20 nt, Human
augugggaagaacuggcuaa

SEQ ID NO: 98309 - RNA, 22 nt, Human
gcgugagccaccgugcccaacc

SEQ ID NO: 98310 - RNA, 21 nt, Human
ccauuuuuauaccaaaggugc

SEQ ID NO: 98311 - RNA, 27 nt, Human
accauguacugaauuuuuacauccuga

SEQ ID NO: 98312 - RNA, 21 nt, Human
cagacaacauggaaaugagug

SEQ ID NO: 98313 - RNA, 23 nt, Human
uguggucucuccccuggcuugcu

SEQ ID NO: 98314 - RNA, 20 nt, Human
uagagugcuguaaacuugcu

SEQ ID NO: 98315 - RNA, 21 nt, Human
uacuauacugaaaucugugcu

SEQ ID NO: 98316 - RNA, 23 nt, Human
gggguguucugcccugccuccac

SEQ ID NO: 98317 - RNA, 20 nt, Human
guuguguccucgaauggcag

SEQ ID NO: 98318 - RNA, 28 nt, Human
ucacucucugggggagugcaggguggac

SEQ ID NO: 98319 - RNA, 26 nt, Human
ugagccaagauugcgccguuguacuc

SEQ ID NO: 98320 - RNA, 21 nt, Human
uagcuuuagggcaauauugcc

SEQ ID NO: 98321 - RNA, 24 nt, Human
uccuucaaccccgccucuuccucc

SEQ ID NO: 98322 - RNA, 22 nt, Human
augccuguagucccagcacuuu

SEQ ID NO: 98323 - RNA, 26 nt, Human
ucauagaaaacauuaguuuucuccug

SEQ ID NO: 98324 - RNA, 25 nt, Human
ugcucugccacugugcuccagcacc

SEQ ID NO: 98325 - RNA, 22 nt, Human
uuuucucuccccgcguggcucc

SEQ ID NO: 98326 - RNA, 27 nt, Human
aaguuguggucugaucaguuaauuugu

SEQ ID NO: 98327 - RNA, 23 nt, Human
gugacaggaauggggaaaaagag

SEQ ID NO: 98328 - RNA, 22 nt, Human
guggauucucccugggccucag

SEQ ID NO: 98329 - RNA, 23 nt, Human
uuuccauucugggaaaagcccaa

SEQ ID NO: 98330 - RNA, 26 nt, Human
agagugagugagggggcaaggcucug

SEQ ID NO: 98331 - RNA, 20 nt, Human
gagcuaacuuaacuacugua

SEQ ID NO: 98332 - RNA, 24 nt, Human
cuggagcuuggagaaucgcucugg

SEQ ID NO: 98333 - RNA, 19 nt, Human
gcuagcacaucuugaucug

SEQ ID NO: 98334 - RNA, 27 nt, Human
uuccaucucagccccaggacucaguac

SEQ ID NO: 98335 - RNA, 20 nt, Human
ggagcagagucauuugcuuc

SEQ ID NO: 98336 - RNA, 20 nt, Human
gcgaucccagcacugcagcc

SEQ ID NO: 98337 - RNA, 27 nt, Human
ccuguauucccccucccagggcagccc

SEQ ID NO: 98338 - RNA, 21 nt, Human
agcuccagcuuccaguugccu

SEQ ID NO: 98339 - RNA, 25 nt, Human
agaaauuuucuaaauuuuaguaaga

SEQ ID NO: 98340 - RNA, 21 nt, Human
ccagcaggugaggcucggcuu

SEQ ID NO: 98341 - RNA, 22 nt, Human
ucauagaagauguaucauaaca

SEQ ID NO: 98342 - RNA, 24 nt, Human
guagagacaggauuucacuguguu

SEQ ID NO: 98343 - RNA, 27 nt, Human
caccacugaguccagccuauauucuug

SEQ ID NO: 98344 - RNA, 28 nt, Human
gucgcagccugugggacuacugcuaggu

SEQ ID NO: 98345 - RNA, 25 nt, Human
uggcugaagaggcaggaggaacagu

SEQ ID NO: 98346 - RNA, 21 nt, Human
ccgccaccuggggaagagcag

SEQ ID NO: 98347 - RNA, 22 nt, Human
gggaucugcuuggaguuuucug

SEQ ID NO: 98348 - RNA, 20 nt, Human
gcgccugccuuuagccuggg

SEQ ID NO: 98349 - RNA, 20 nt, Human
gcaaaacuuuccugcugccg

SEQ ID NO: 98350 - RNA, 19 nt, Human
cgugccaccaugucuggcu

SEQ ID NO: 98351 - RNA, 24 nt, Human
cauugccuugggccugggaaucua

SEQ ID NO: 98352 - RNA, 19 nt, Human
ugagccaaaauuugcucaa

SEQ ID NO: 98353 - RNA, 25 nt, Human
cagauggggguggaguggaggacac

SEQ ID NO: 98354 - RNA, 20 nt, Human
ccauuccacuuccuccuucc

SEQ ID NO: 98355 - RNA, 29 nt, Human
cuccggagccucagcccccuggaaaguga

SEQ ID NO: 98356 - RNA, 26 nt, Human
cagaugaagacaaaagcggaugguga

SEQ ID NO: 98357 - RNA, 22 nt, Human
cagcuggugugggaggaaaggc

SEQ ID NO: 98358 - RNA, 23 nt, Human
auucagucaagugaggugacacu

SEQ ID NO: 98359 - RNA, 26 nt, Human
uccugcuccaagggccuccugcauga

SEQ ID NO: 98360 - RNA, 19 nt, Human
ucucuuccuuacaggugug

SEQ ID NO: 98361 - RNA, 22 nt, Human
uagaauuacuacaauucugcaa

SEQ ID NO: 98362 - RNA, 22 nt, Human
gucgcccaggcuggaaugcagu

SEQ ID NO: 98363 - RNA, 23 nt, Human
caggagcugagggcaccacccag

SEQ ID NO: 98364 - RNA, 29 nt, Human
cacucccuagggcggggccugugcaugcu

SEQ ID NO: 98365 - RNA, 25 nt, Human
aacacugugauuuaucuuucaagag

SEQ ID NO: 98366 - RNA, 21 nt, Human
auucgagaccagccuagguga

SEQ ID NO: 98367 - RNA, 25 nt, Human
aaaaaguugccuucuccaguggcag

SEQ ID NO: 98368 - RNA, 23 nt, Human
aauccucuucuucauccucauau

SEQ ID NO: 98369 - RNA, 23 nt, Human
uuaugcccacgcuggagugcagu

SEQ ID NO: 98370 - RNA, 23 nt, Human
ugggucaaagugcggcugccauu

SEQ ID NO: 98371 - RNA, 22 nt, Human
ugaggucuggggaaaagggagg

SEQ ID NO: 98372 - RNA, 27 nt, Human
ccugggauccuauuuugggccuggggu

SEQ ID NO: 98373 - RNA, 19 nt, Human
ucuauuccaucaucugccc

SEQ ID NO: 98374 - RNA, 22 nt, Human
gagugagacucuguuucuaaau

SEQ ID NO: 98375 - RNA, 19 nt, Human
uggagcgagagggaggcag

SEQ ID NO: 98376 - RNA, 20 nt, Human
uggcuacaguuucaguuacu

SEQ ID NO: 98377 - RNA, 21 nt, Human
ccccucccuugcucagugccu

SEQ ID NO: 98378 - RNA, 22 nt, Human
ccucuugccagcucugugaguc

SEQ ID NO: 98379 - RNA, 24 nt, Human
ggucccaccgcccucacagccaau

SEQ ID NO: 98380 - RNA, 21 nt, Human
ccacuugccaguuuaauucca

SEQ ID NO: 98381 - RNA, 27 nt, Human
augugaagccucucuugaauuucuagu

SEQ ID NO: 98382 - RNA, 26 nt, Human
uccuguugugcaggcuguagugcagu

SEQ ID NO: 98383 - RNA, 24 nt, Human
aacaaaagaagugacaucuucagc

SEQ ID NO: 98384 - RNA, 20 nt, Human
guccuguuugguuuucuucc

SEQ ID NO: 98385 - RNA, 22 nt, Human
ucuguuuccucuuugguccuga

SEQ ID NO: 98386 - RNA, 22 nt, Human
aagcucaggaguuugagaccag

SEQ ID NO: 98387 - RNA, 20 nt, Human
auauuuauacuacaagguga

SEQ ID NO: 98388 - RNA, 21 nt, Human
gcuaaaaguuacaagugugca

SEQ ID NO: 98389 - RNA, 25 nt, Human
ccauguccugcugcccgacuuccuu

SEQ ID NO: 98390 - RNA, 20 nt, Human
uuucuuuuggauugcacuga

SEQ ID NO: 98391 - RNA, 23 nt, Human
ccuggcacaucacucaacuacua

SEQ ID NO: 98392 - RNA, 21 nt, Human
aaagcacauuuagugaaaugu

SEQ ID NO: 98393 - RNA, 22 nt, Human
cccuaggcuacccuugccaagg

SEQ ID NO: 98394 - RNA, 22 nt, Human
aggccgaggcaggagaauugcu

SEQ ID NO: 98395 - RNA, 25 nt, Human
cccucuugaacugaaucagaccaac

SEQ ID NO: 98396 - RNA, 24 nt, Human
uaauuucucuugaaaauaauuucc

SEQ ID NO: 98397 - RNA, 19 nt, Human
gcagcaccugguagaccca

SEQ ID NO: 98398 - RNA, 24 nt, Human
cagcaugcgguauuuuaacuuucu

SEQ ID NO: 98399 - RNA, 27 nt, Human
caaugagccuuacuguauuuagugugg

SEQ ID NO: 98400 - RNA, 19 nt, Human
ccuauuucccccuccuccc

SEQ ID NO: 98401 - RNA, 22 nt, Human
aacccuuuaaugaacuuaucug

SEQ ID NO: 98402 - RNA, 21 nt, Human
gcccguguguauaauaugaag

SEQ ID NO: 98403 - RNA, 25 nt, Human
auuguauauuuucuuccauucuugu

SEQ ID NO: 98404 - RNA, 27 nt, Human
cccaacaacuccaggcccugcccccuc

SEQ ID NO: 98405 - RNA, 31 nt, Human
cuggucuagggcugugaggccaccuccuugc

SEQ ID NO: 98406 - RNA, 26 nt, Human
gugccuggccuccgaugccuggccug

SEQ ID NO: 98407 - RNA, 18 nt, Human
ccugauaaccacugagaa

SEQ ID NO: 98408 - RNA, 22 nt, Human
gucgcucagccuggagugcagu

SEQ ID NO: 98409 - RNA, 25 nt, Human
uccugaaguagaugguugagauaug

SEQ ID NO: 98410 - RNA, 24 nt, Human
uccucucucucccucuuucuagcc

SEQ ID NO: 98411 - RNA, 20 nt, Human
gcaaaguuacaggccaguuu

SEQ ID NO: 98412 - RNA, 23 nt, Human
cauaauuaguuucucagcuuuga

SEQ ID NO: 98413 - RNA, 21 nt, Human
gccuguaaaguaguauuuuug

SEQ ID NO: 98414 - RNA, 21 nt, Human
ccugccuuccuccugccugua

SEQ ID NO: 98415 - RNA, 21 nt, Human
augccauuuucuaaacuuauu

SEQ ID NO: 98416 - RNA, 27 nt, Human
ccuauacccaaauguucccucccccga

SEQ ID NO: 98417 - RNA, 23 nt, Human
ccugacaccugcugccugcaggc

SEQ ID NO: 98418 - RNA, 24 nt, Human
acuaccuggugauuccuacuucag

SEQ ID NO: 98419 - RNA, 20 nt, Human
uugcagugagcagugcagug

SEQ ID NO: 98420 - RNA, 23 nt, Human
gucaccuaggcuggagugcagug

SEQ ID NO: 98421 - RNA, 22 nt, Human
cccagaggcagagguugcagug

SEQ ID NO: 98422 - RNA, 22 nt, Human
cccaugucucaaaacaaacaca

SEQ ID NO: 98423 - RNA, 20 nt, Human
uuuguuuguuucuucacuua

SEQ ID NO: 98424 - RNA, 24 nt, Human
aaagcuguacauuugugggaguug

SEQ ID NO: 98425 - RNA, 26 nt, Human
ucagucuuugccuuuguuugcacugu

SEQ ID NO: 98426 - RNA, 24 nt, Human
cuaccugacuaugcuuucucuccu

SEQ ID NO: 98427 - RNA, 25 nt, Human
accucggucucccaaaaugcuggga

SEQ ID NO: 98428 - RNA, 24 nt, Human
ucagcagcagagagcccuggguga

SEQ ID NO: 98429 - RNA, 24 nt, Human
ggcucagccccagccuuucugaag

SEQ ID NO: 98430 - RNA, 25 nt, Human
augacuucccuuguaaacagaagca

SEQ ID NO: 98431 - RNA, 21 nt, Human
ccacaucuccucaguugcuga

SEQ ID NO: 98432 - RNA, 31 nt, Human
gccugugcuaauugggagcacuugaacaauu

SEQ ID NO: 98433 - RNA, 25 nt, Human
gguggucagagagaggaaggggcac

SEQ ID NO: 98434 - RNA, 21 nt, Human
ccucccuuuccccaccucuua

SEQ ID NO: 98435 - RNA, 23 nt, Human
cggggcuggagugugaggguccu

SEQ ID NO: 98436 - RNA, 25 nt, Human
ugggaagcuugagccucccccaaag

SEQ ID NO: 98437 - RNA, 21 nt, Human
gggcccggcaccuccugcugc

SEQ ID NO: 98438 - RNA, 22 nt, Human
guaccugauuuguucucugacc

SEQ ID NO: 98439 - RNA, 22 nt, Human
ccucaagggcagagaacugucu

SEQ ID NO: 98440 - RNA, 20 nt, Human
acaguuacauguggcccuca

SEQ ID NO: 98441 - RNA, 22 nt, Human
uucuuagcacuuuaauuccugu

SEQ ID NO: 98442 - RNA, 26 nt, Human
cauuucuacaccucaauccuccauuu

SEQ ID NO: 98443 - RNA, 21 nt, Human
gcagguaccugccccccuuca

SEQ ID NO: 98444 - RNA, 25 nt, Human
ccugcugcugccaccugcccugcug

SEQ ID NO: 98445 - RNA, 18 nt, Human
aguguuugcuguuucccc

SEQ ID NO: 98446 - RNA, 22 nt, Human
ugauugaaccugcucaucucca

SEQ ID NO: 98447 - RNA, 22 nt, Human
aggugaggcugagcugaaggaa

SEQ ID NO: 98448 - RNA, 23 nt, Human
uuuguauagguagauguucagau

SEQ ID NO: 98449 - RNA, 22 nt, Human
ucacccaggcuggacugcaaug

SEQ ID NO: 98450 - RNA, 22 nt, Human
gccuuuauuuugugucauucua

SEQ ID NO: 98451 - RNA, 23 nt, Human
agacaguggugguccgguggagg

SEQ ID NO: 98452 - RNA, 19 nt, Human
cuccagcacauaaaggaca

SEQ ID NO: 98453 - RNA, 25 nt, Human
uggggccccucaccuacuuacccag

SEQ ID NO: 98454 - RNA, 26 nt, Human
cacugggugugagaaugaucaaggau

SEQ ID NO: 98455 - RNA, 20 nt, Human
uccucgggcuucauuuucuc

SEQ ID NO: 98456 - RNA, 22 nt, Human
ucugcugcuguuuacauucugg

SEQ ID NO: 98457 - RNA, 22 nt, Human
aguggcauaaucacagcucacu

SEQ ID NO: 98458 - RNA, 22 nt, Human
gaccagccugcccaacauagug

SEQ ID NO: 98459 - RNA, 22 nt, Human
gaccagccugaccaacaucgug

SEQ ID NO: 98460 - RNA, 27 nt, Human
gggcuaaaucccaagugucucuugacu

SEQ ID NO: 98461 - RNA, 21 nt, Human
uuagaaaauuagaggcccccu

SEQ ID NO: 98462 - RNA, 26 nt, Human
ugagcccaggcgguugaggcugcagu

SEQ ID NO: 98463 - RNA, 23 nt, Human
gcacagcucgugggccugggcgg

SEQ ID NO: 98464 - RNA, 26 nt, Human
ccuccagguacgccgcagcugcccag

SEQ ID NO: 98465 - RNA, 25 nt, Human
gcugcggcagcagguagcaaaguga

SEQ ID NO: 98466 - RNA, 27 nt, Human
ucccagccacagccaagauucccaaag

SEQ ID NO: 98467 - RNA, 28 nt, Human
cucuuaacacaacagaauucugcugucu

SEQ ID NO: 98468 - RNA, 25 nt, Human
gucaagacagaugacaccagcacuu

SEQ ID NO: 98469 - RNA, 27 nt, Human
ucuccugccucagcuuccuaaguagcu

SEQ ID NO: 98470 - RNA, 26 nt, Human
aagacucugacauuccuggcugucau

SEQ ID NO: 98471 - RNA, 23 nt, Human
ccuacuacagucuggaguggggu

SEQ ID NO: 98472 - RNA, 21 nt, Human
uuguugcccaggcuggaguac

SEQ ID NO: 98473 - RNA, 21 nt, Human
ggagagggggugggguggggu

SEQ ID NO: 98474 - RNA, 23 nt, Human
uccaacaggaagguuauucuucc

SEQ ID NO: 98475 - RNA, 25 nt, Human
auacuccaaacuguuucugaugugu

SEQ ID NO: 98476 - RNA, 26 nt, Human
ccuuucucuucuuuuaucuccaaggu

SEQ ID NO: 98477 - RNA, 19 nt, Human
uuuguaacccagauuuugc

SEQ ID NO: 98478 - RNA, 27 nt, Human
ggagagggagagagcgaacacccacgc

SEQ ID NO: 98479 - RNA, 22 nt, Human
cacaucaccagcucaccucugg

SEQ ID NO: 98480 - RNA, 24 nt, Human
gcuuucuccuuuacuuggaaggcu

SEQ ID NO: 98481 - RNA, 26 nt, Human
agacagaccuggauucaaaucugcca

SEQ ID NO: 98482 - RNA, 21 nt, Human
ggcuuuuuaaucugauuuucu

SEQ ID NO: 98483 - RNA, 22 nt, Human
uccuccuccagggacugcugug

SEQ ID NO: 98484 - RNA, 21 nt, Human
gauugagaggggcugagggaa

SEQ ID NO: 98485 - RNA, 22 nt, Human
uauccuggccagacccugcugc

SEQ ID NO: 98486 - RNA, 21 nt, Human
cgccccggaacguguccagga

SEQ ID NO: 98487 - RNA, 23 nt, Human
gacgggguuucaacauguugacc

SEQ ID NO: 98488 - RNA, 27 nt, Human
ccucggucccuccugcaccugcugccu

SEQ ID NO: 98489 - RNA, 20 nt, Human
ggggacaccucggcacgcag

SEQ ID NO: 98490 - RNA, 27 nt, Human
gugcuauagacacguggcagagcugua

SEQ ID NO: 98491 - RNA, 23 nt, Human
ggccuguccgcugcacaccagcu

SEQ ID NO: 98492 - RNA, 22 nt, Human
aggaggagaagagaccuuugcu

SEQ ID NO: 98493 - RNA, 24 nt, Human
uggcuaacauggugaaaccccauc

SEQ ID NO: 98494 - RNA, 22 nt, Human
gugagguaccgucuacauuuca

SEQ ID NO: 98495 - RNA, 21 nt, Human
agcgacaccuccaggcuuccg

SEQ ID NO: 98496 - RNA, 21 nt, Human
auacucuacuacacucagccu

SEQ ID NO: 98497 - RNA, 25 nt, Human
cuguaauuggcagcagaaauccaaa

SEQ ID NO: 98498 - RNA, 25 nt, Human
cugucuagcacuuccuugccagucu

SEQ ID NO: 98499 - RNA, 24 nt, Human
agaacgaggaagagaacacaagga

SEQ ID NO: 98500 - RNA, 20 nt, Human
ucuugaacuuccugagucac

SEQ ID NO: 98501 - RNA, 21 nt, Human
ucacugcaucuccggcuccug

SEQ ID NO: 98502 - RNA, 27 nt, Human
aggagcagcagcaaauucacauauuuu

SEQ ID NO: 98503 - RNA, 25 nt, Human
uugggaccugguucucuucuaaccc

SEQ ID NO: 98504 - RNA, 21 nt, Human
ccuccgcagucccuccagaga

SEQ ID NO: 98505 - RNA, 21 nt, Human
uucaguaauaacguauugcaa

SEQ ID NO: 98506 - RNA, 25 nt, Human
cuucaacuccugggcucaagcaguc

SEQ ID NO: 98507 - RNA, 21 nt, Human
uugcccaaggucagagccacu

SEQ ID NO: 98508 - RNA, 23 nt, Human
agccuggcgguagaaucuuccca

SEQ ID NO: 98509 - RNA, 20 nt, Human
ugaauuauagaagcuacuuu

SEQ ID NO: 98510 - RNA, 23 nt, Human
uaggcgugguagugcacaccugu

SEQ ID NO: 98511 - RNA, 23 nt, Human
cugggcccuggcugugggcagag

SEQ ID NO: 98512 - RNA, 21 nt, Human
ccuuugguuuuagcaguucuu

SEQ ID NO: 98513 - RNA, 18 nt, Human
gcuuuuaaaaauguccug

SEQ ID NO: 98514 - RNA, 25 nt, Human
ggaggugggcagggaaggggagggc

SEQ ID NO: 98515 - RNA, 22 nt, Human
agguuagagaaaauagagauga

SEQ ID NO: 98516 - RNA, 21 nt, Human
gcaguuuaagguggucucagc

SEQ ID NO: 98517 - RNA, 28 nt, Human
gcagccccaagcaucuuuccaguggggc

SEQ ID NO: 98518 - RNA, 23 nt, Human
uguccaucuguccccucccuccg

SEQ ID NO: 98519 - RNA, 21 nt, Human
acaagugucugccucugaaga

SEQ ID NO: 98520 - RNA, 25 nt, Human
gggcgggaaagccagugacuccagg

SEQ ID NO: 98521 - RNA, 28 nt, Human
ccagccacugcuuagcuaucauagucac

SEQ ID NO: 98522 - RNA, 22 nt, Human
aucaccauacacaguggcaccu

SEQ ID NO: 98523 - RNA, 19 nt, Human
uccacuaaguaucuuguua

SEQ ID NO: 98524 - RNA, 20 nt, Human
gggcaugcccuuccccaaca

SEQ ID NO: 98525 - RNA, 20 nt, Human
gcuuguaggauuuuuaagag

SEQ ID NO: 98526 - RNA, 23 nt, Human
ggugaggcccuggggaggcaggg

SEQ ID NO: 98527 - RNA, 20 nt, Human
cccuggcccccgccugggcc

SEQ ID NO: 98528 - RNA, 27 nt, Human
uucagaagaagguguccaaggagcuga

SEQ ID NO: 98529 - RNA, 21 nt, Human
aaccuguacaaugacaacccu

SEQ ID NO: 98530 - RNA, 19 nt, Human
ggaacuccauuccaccuga

SEQ ID NO: 98531 - RNA, 23 nt, Human
gcccuguuucccccuccucggcc

SEQ ID NO: 98532 - RNA, 22 nt, Human
augccuguaauccgagcacuuu

SEQ ID NO: 98533 - RNA, 25 nt, Human
ucucccuuucuccauccaaucgguc

SEQ ID NO: 98534 - RNA, 22 nt, Human
uuucuaugcccgcaaguuucag

SEQ ID NO: 98535 - RNA, 21 nt, Human
cuugaaaauaauuuccucaaa

SEQ ID NO: 98536 - RNA, 27 nt, Human
ccuuacgggggcaucuugaguccagcu

SEQ ID NO: 98537 - RNA, 22 nt, Human
ugugaucacagcuacucgggag

SEQ ID NO: 98538 - RNA, 29 nt, Human
ugccuuucuuuuaaauuaauuauagacag

SEQ ID NO: 98539 - RNA, 22 nt, Human
cuuagugggcuucagccagcuu

SEQ ID NO: 98540 - RNA, 23 nt, Human
caaacucacuaugaagguaaagg

SEQ ID NO: 98541 - RNA, 23 nt, Human
ccaggaggcagcuguugcaguga

SEQ ID NO: 98542 - RNA, 22 nt, Human
ucaagugccuagggaaaauucc

SEQ ID NO: 98543 - RNA, 23 nt, Human
ugccacacacagcuaauauucua

SEQ ID NO: 98544 - RNA, 20 nt, Human
aggcuaagcagucucuguuu

SEQ ID NO: 98545 - RNA, 21 nt, Human
agagugagaaccaccaaccga

SEQ ID NO: 98546 - RNA, 22 nt, Human
guuguugcuguuggacuaaaua

SEQ ID NO: 98547 - RNA, 26 nt, Human
auuaaagucccugaagaucauauacc

SEQ ID NO: 98548 - RNA, 19 nt, Human
ccucaccuccaucccccuc

SEQ ID NO: 98549 - RNA, 25 nt, Human
acaucuguaacuucuuuuuccaggu

SEQ ID NO: 98550 - RNA, 19 nt, Human
agguccuaugaagaaagau

SEQ ID NO: 98551 - RNA, 18 nt, Human
guguaggccaggcugguc

SEQ ID NO: 98552 - RNA, 19 nt, Human
gggaggcagccagccaaga

SEQ ID NO: 98553 - RNA, 24 nt, Human
cuauguggaaagugggacucugaa

SEQ ID NO: 98554 - RNA, 21 nt, Human
ggaauugcagucugaggauca

SEQ ID NO: 98555 - RNA, 22 nt, Human
gagaugcugggcaggaaggugu

SEQ ID NO: 98556 - RNA, 29 nt, Human
aaaugaguacugaauuguacuggucuguc

SEQ ID NO: 98557 - RNA, 24 nt, Human
cuuucaacaaugucuuuuuuccca

SEQ ID NO: 98558 - RNA, 25 nt, Human
ggaagauggagucagcuauugaagu

SEQ ID NO: 98559 - RNA, 23 nt, Human
aaaagaccaacccaguucuguuu

SEQ ID NO: 98560 - RNA, 23 nt, Human
cccauccccaccccuccuggucu

SEQ ID NO: 98561 - RNA, 22 nt, Human
accagccucagcuggcgcagcg

SEQ ID NO: 98562 - RNA, 21 nt, Human
cauugguuuacucugcagccu

SEQ ID NO: 98563 - RNA, 24 nt, Human
ucuugcugacuggggacugcugag

SEQ ID NO: 98564 - RNA, 22 nt, Human
gaaggagaaacuucuauaagac

SEQ ID NO: 98565 - RNA, 24 nt, Human
gcuccuccuccguucauuuucugc

SEQ ID NO: 98566 - RNA, 26 nt, Human
cuucauuuuacauucugucuguuuuu

SEQ ID NO: 98567 - RNA, 20 nt, Human
gcccucugcuuuucuuccca

SEQ ID NO: 98568 - RNA, 27 nt, Human
guaagugagagagggggauguuuccua

SEQ ID NO: 98569 - RNA, 22 nt, Human
ccaacguggugaaacccugucu

SEQ ID NO: 98570 - RNA, 19 nt, Human
ugaggcuauaaugagccau

SEQ ID NO: 98571 - RNA, 25 nt, Human
ugcccugcugucaccgcggagcuga

SEQ ID NO: 98572 - RNA, 20 nt, Human
guugcaucgcccuccacaga

SEQ ID NO: 98573 - RNA, 22 nt, Human
uacauacaugcuuugaaguuuc

SEQ ID NO: 98574 - RNA, 22 nt, Human
cggucuuauucguugugcucaa

SEQ ID NO: 98575 - RNA, 19 nt, Human
gagauccagcccuacuucu

SEQ ID NO: 98576 - RNA, 24 nt, Human
ggagaaucgcgaggcagagcggga

SEQ ID NO: 98577 - RNA, 22 nt, Human
gaguagcugggaccacaggcau

SEQ ID NO: 98578 - RNA, 26 nt, Human
acugccucucuuuuugggcuuucaua

SEQ ID NO: 98579 - RNA, 18 nt, Human
gucaugccucaaacccga

SEQ ID NO: 98580 - RNA, 20 nt, Human
cggauacaauaaaagacuuu

SEQ ID NO: 98581 - RNA, 20 nt, Human
ggaaaucagaguuugaaaua

SEQ ID NO: 98582 - RNA, 23 nt, Human
cuucagugcaugucuuaguugcu

SEQ ID NO: 98583 - RNA, 22 nt, Human
ggaaagcucuuccgaaucgcua

SEQ ID NO: 98584 - RNA, 20 nt, Human
aaccaacggccgacugccug

SEQ ID NO: 98585 - RNA, 26 nt, Human
ucuugucacugagcugaacuguagau

SEQ ID NO: 98586 - RNA, 24 nt, Human
ugacccauauacgccaaauucccu

SEQ ID NO: 98587 - RNA, 23 nt, Human
aaaugaucacuucauuugauacu

SEQ ID NO: 98588 - RNA, 22 nt, Human
ucagcacugccggcccagugac

SEQ ID NO: 98589 - RNA, 18 nt, Human
aggaagagguugcaguga

SEQ ID NO: 98590 - RNA, 22 nt, Human
ggccucugugcugcugggguca

SEQ ID NO: 98591 - RNA, 21 nt, Human
ugucuggaguguaggauggca

SEQ ID NO: 98592 - RNA, 27 nt, Human
uacaugguuaagguaaaguaagucucc

SEQ ID NO: 98593 - RNA, 23 nt, Human
caguguuagaggaggagauggga

SEQ ID NO: 98594 - RNA, 21 nt, Human
ccugggaggggagggaggcgc

SEQ ID NO: 98595 - RNA, 24 nt, Human
agagucucuccugcccucccuccu

SEQ ID NO: 98596 - RNA, 25 nt, Human
uacugucuacaugcuuucucauuca

SEQ ID NO: 98597 - RNA, 21 nt, Human
aauaccugaaauucaguagua

SEQ ID NO: 98598 - RNA, 20 nt, Human
aggcacauuccucuccaucu

SEQ ID NO: 98599 - RNA, 22 nt, Human
ucacaccacuacacuccagccu

SEQ ID NO: 98600 - RNA, 20 nt, Human
gaggacagggaggugacccc

SEQ ID NO: 98601 - RNA, 27 nt, Human
ugggugguggaggcugcgagggugcac

SEQ ID NO: 98602 - RNA, 26 nt, Human
gugggugggauuguggcguugugguc

SEQ ID NO: 98603 - RNA, 24 nt, Human
cuuuauucucccaagugucaugaa

SEQ ID NO: 98604 - RNA, 27 nt, Human
cuuaaagcucacuaucucuggccauuc

SEQ ID NO: 98605 - RNA, 22 nt, Human
ugggguggaaaggaagagugag

SEQ ID NO: 98606 - RNA, 24 nt, Human
auuccuaguuggugagaaaccugu

SEQ ID NO: 98607 - RNA, 22 nt, Human
accagccuggccaaugugauga

SEQ ID NO: 98608 - RNA, 28 nt, Human
acggcacuaggacccagggaaguccccg

SEQ ID NO: 98609 - RNA, 20 nt, Human
acacauuuaugaaaaucuac

SEQ ID NO: 98610 - RNA, 21 nt, Human
aggaggaggaggcugcaguga

SEQ ID NO: 98611 - RNA, 22 nt, Human
uucccagguuaugcucuuuucu

SEQ ID NO: 98612 - RNA, 24 nt, Human
ugucgcucaggcuggagugcagug

SEQ ID NO: 98613 - RNA, 23 nt, Human
gacaucauugccauuaacuuucu

SEQ ID NO: 98614 - RNA, 18 nt, Human
uuugcagcugccagugcu

SEQ ID NO: 98615 - RNA, 22 nt, Human
uugcaaccucaccuuccugugg

SEQ ID NO: 98616 - RNA, 21 nt, Human
uuuggcccucgucauccugcc

SEQ ID NO: 98617 - RNA, 22 nt, Human
gggccuuuuuaucuucccacug

SEQ ID NO: 98618 - RNA, 24 nt, Human
uuccaggggucccccagacaugaa

SEQ ID NO: 98619 - RNA, 22 nt, Human
uugccccaggcuggucucgaac

SEQ ID NO: 98620 - RNA, 18 nt, Human
accgugccucacagggcc

SEQ ID NO: 98621 - RNA, 20 nt, Human
uccuugccuagugcuuuuca

SEQ ID NO: 98622 - RNA, 25 nt, Human
ucacccaggcugccaggcuggagug

SEQ ID NO: 98623 - RNA, 20 nt, Human
gccguaguuugucuccuggg

SEQ ID NO: 98624 - RNA, 21 nt, Human
gaucuguccucagccuugcca

SEQ ID NO: 98625 - RNA, 27 nt, Human
gcgcugacagaacgugauucucgugcc

SEQ ID NO: 98626 - RNA, 26 nt, Human
cuagaagaaagggcaagaaggaaaua

SEQ ID NO: 98627 - RNA, 22 nt, Human
aucuagugccauuauuucuacc

SEQ ID NO: 98628 - RNA, 22 nt, Human
acguggauaagcacucugugau

SEQ ID NO: 98629 - RNA, 23 nt, Human
ccuaccccuuccuguccugccuc

SEQ ID NO: 98630 - RNA, 22 nt, Human
uauuaaaguauagauguauguc

SEQ ID NO: 98631 - RNA, 20 nt, Human
uagcaucuauguuacacucu

SEQ ID NO: 98632 - RNA, 23 nt, Human
acuuaggaaaguagaugggugga

SEQ ID NO: 98633 - RNA, 26 nt, Human
cuguucucccccuuugggacauguua

SEQ ID NO: 98634 - RNA, 25 nt, Human
cuccugcacaccuggccuccugggc

SEQ ID NO: 98635 - RNA, 23 nt, Human
accacuguucuguucauuuccua

SEQ ID NO: 98636 - RNA, 20 nt, Human
acuguuccacccaggaggag

SEQ ID NO: 98637 - RNA, 22 nt, Human
ucaucccucaacugagggccag

SEQ ID NO: 98638 - RNA, 18 nt, Human
uugguccacaucaccaga

SEQ ID NO: 98639 - RNA, 17 nt, Human
uuccaguuugcuuugcc

SEQ ID NO: 98640 - RNA, 31 nt, Human
cugggauccuauuuugggccuggggugggua

SEQ ID NO: 98641 - RNA, 26 nt, Human
cccaccuggcccucucugaaggaggc

SEQ ID NO: 98642 - RNA, 22 nt, Human
uguccgcccaggcugggugcag

SEQ ID NO: 98643 - RNA, 25 nt, Human
gugggggaaguguuuucacacccac

SEQ ID NO: 98644 - RNA, 21 nt, Human
caggcagcaaaaacagcugga

SEQ ID NO: 98645 - RNA, 22 nt, Human
cacuucauaccacauucacauc

SEQ ID NO: 98646 - RNA, 21 nt, Human
cuccugaguccucugcuaguu

SEQ ID NO: 98647 - RNA, 21 nt, Human
gggcuuuuagagagggggaag

SEQ ID NO: 98648 - RNA, 21 nt, Human
ucucccuagagccagggcccu

SEQ ID NO: 98649 - RNA, 20 nt, Human
ccugcagcucagcagcugcc

SEQ ID NO: 98650 - RNA, 21 nt, Human
ccgagcgaagcugcccccagg

SEQ ID NO: 98651 - RNA, 22 nt, Human
aagucacagaccauugccucag

SEQ ID NO: 98652 - RNA, 22 nt, Human
cuaagcugguccucacaggggc

SEQ ID NO: 98653 - RNA, 23 nt, Human
gcagcuuccccacccaggacaag

SEQ ID NO: 98654 - RNA, 18 nt, Human
cgggaggucgaggcagga

SEQ ID NO: 98655 - RNA, 22 nt, Human
uugaccagaguuuuuccaugug

SEQ ID NO: 98656 - RNA, 26 nt, Human
cccaaaaccucaugacagccagagcc

SEQ ID NO: 98657 - RNA, 21 nt, Human
cuucccuuuuacugcuggcug

SEQ ID NO: 98658 - RNA, 23 nt, Human
augauuucaaaauaaaguugauu

SEQ ID NO: 98659 - RNA, 21 nt, Human
cucaucuucucuuucucuccu

SEQ ID NO: 98660 - RNA, 26 nt, Human
cugcugucugcuuuucuguggagacu

SEQ ID NO: 98661 - RNA, 19 nt, Human
ggcuucugaauuauucugg

SEQ ID NO: 98662 - RNA, 21 nt, Human
ccggggguggagccagcgggu

SEQ ID NO: 98663 - RNA, 27 nt, Human
ucccuccagacaguuaggaaucugaaa

SEQ ID NO: 98664 - RNA, 20 nt, Human
caaugccauuucuugaccac

SEQ ID NO: 98665 - RNA, 31 nt, Human; identical to SEQ ID NO: 4840

SEQ ID NO: 98666 - RNA, 23 nt, Human
gcaaacggaggacugaacugggg

SEQ ID NO: 98667 - RNA, 22 nt, Human
gccucucugaagauuacccaaa

SEQ ID NO: 98668 - RNA, 20 nt, Human
augccuggcugcuggaguac

SEQ ID NO: 98669 - RNA, 24 nt, Human
aggagaaccacauucucccaggga

SEQ ID NO: 98670 - RNA, 26 nt, Human
aguauacauuuuauaaugaugaacuu

SEQ ID NO: 98671 - RNA, 22 nt, Human
ugcagauaugggacacagcagg

SEQ ID NO: 98672 - RNA, 25 nt, Human
cugcuucuuccccucugcggcuuuc

SEQ ID NO: 98673 - RNA, 21 nt, Human
caagucacagugcuuccuuaa

SEQ ID NO: 98674 - RNA, 25 nt, Human
uccacccuucuccccucagagagga

SEQ ID NO: 98675 - RNA, 26 nt, Human
cccuccagggggaccccacagccugg

SEQ ID NO: 98676 - RNA, 21 nt, Human
ccugcucucccucccugccca

SEQ ID NO: 98677 - RNA, 20 nt, Human
uacuaccuucaggcauuugg

SEQ ID NO: 98678 - RNA, 17 nt, Human
ccugacccugucauccc

SEQ ID NO: 98679 - RNA, 20 nt, Human
gacauuucacacagguacca

SEQ ID NO: 98680 - RNA, 19 nt, Human
ucaaacauucaucaacauc

SEQ ID NO: 98681 - RNA, 22 nt, Human
gcuuugucuccucagcacucug

SEQ ID NO: 98682 - RNA, 21 nt, Human
cucucagacuccugaucucag

SEQ ID NO: 98683 - RNA, 20 nt, Human
guucucuuugccauuuuaga

SEQ ID NO: 98684 - RNA, 26 nt, Human
ucugggcugggacggacaggagaggc

SEQ ID NO: 98685 - RNA, 26 nt, Human
auagauuugaccuacaaaucaaucac

SEQ ID NO: 98686 - RNA, 28 nt, Human
agucuuuuccuguuuagggucuuauccu

SEQ ID NO: 98687 - RNA, 27 nt, Human
ccagaagcagacgcuggcaccgugcug

SEQ ID NO: 98688 - RNA, 21 nt, Human
uccccgcccugucccucucug

SEQ ID NO: 98689 - RNA, 19 nt, Human
augcagccuaccuccuggg

SEQ ID NO: 98690 - RNA, 22 nt, Human
ugguuuaguuuucaaaaaacuu

SEQ ID NO: 98691 - RNA, 27 nt, Human
cuaccugcccucucucaguuauucaga

SEQ ID NO: 98692 - RNA, 26 nt, Human
aggcagcaguggguucaggcccauca

SEQ ID NO: 98693 - RNA, 29 nt, Human
uagacaauuccuccagagacacugagcca

SEQ ID NO: 98694 - RNA, 21 nt, Human
cacacacauaauggcagcuca

SEQ ID NO: 98695 - RNA, 21 nt, Human
uugaucuugcaacucuguaaa

SEQ ID NO: 98696 - RNA, 21 nt, Human
uaguggcuuguguucagggag

SEQ ID NO: 98697 - RNA, 18 nt, Human
caccuccaagaagcaauu

SEQ ID NO: 98698 - RNA, 20 nt, Human
uucuuucucucagccuuaca

SEQ ID NO: 98699 - RNA, 17 nt, Human
agcauuuucaaaacuca

SEQ ID NO: 98700 - RNA, 27 nt, Human
cuguuuguacuguucuauacuauucag

SEQ ID NO: 98701 - RNA, 20 nt, Human
acuguacacacaucauucua

SEQ ID NO: 98702 - RNA, 23 nt, Human
gaguguguauuguucccagugac

SEQ ID NO: 98703 - RNA, 25 nt, Human
gguaaagccucauuugaauguguga

SEQ ID NO: 98704 - RNA, 22 nt, Human
acugagaaaaugaaagcucacu

SEQ ID NO: 98705 - RNA, 27 nt, Human
uacaagugcuguugagcauaauuaaau

SEQ ID NO: 98706 - RNA, 25 nt, Human
gcucauugcuaaccacugucugucc

SEQ ID NO: 98707 - RNA, 21 nt, Human
cagccucuucccuagggccuu

SEQ ID NO: 98708 - RNA, 19 nt, Human
cagcaggcucuccaggcag

SEQ ID NO: 98709 - RNA, 27 nt, Human
auccucucccccacaagagccccaaag

SEQ ID NO: 98710 - RNA, 21 nt, Human
cgccuguaaucccagcacuuu

SEQ ID NO: 98711 - RNA, 22 nt, Human
uaaaaaguuuggacaguauuua

SEQ ID NO: 98712 - RNA, 23 nt, Human
ugccuguaaucgcagcuacucag

SEQ ID NO: 98713 - RNA, 19 nt, Human
ccucugggcuccugccuca

SEQ ID NO: 98714 - RNA, 26 nt, Human
gucaucugccaccacaccuggcuaau

SEQ ID NO: 98715 - RNA, 21 nt, Human
accaucaaggggaagaaagug

SEQ ID NO: 98716 - RNA, 22 nt, Human
gaggcuccagaguugagcuugu

SEQ ID NO: 98717 - RNA, 24 nt, Human
cuggggccagcagguucugcugag

SEQ ID NO: 98718 - RNA, 22 nt, Human
cgcauuucucaugcuuuucuau

SEQ ID NO: 98719 - RNA, 21 nt, Human
cacccacgcuggagugcugug

SEQ ID NO: 98720 - RNA, 23 nt, Human
gcacagccaccucagccagcccc

SEQ ID NO: 98721 - RNA, 24 nt, Human
cucaguucucagccuccuuccuca

SEQ ID NO: 98722 - RNA, 24 nt, Human
gcccagacuggagagcaguggcca

SEQ ID NO: 98723 - RNA, 23 nt, Human
gggcugaggcaccugcagucacc

SEQ ID NO: 98724 - RNA, 21 nt, Human
ugggagguaugggcugggggc

SEQ ID NO: 98725 - RNA, 22 nt, Human
auccacccucuggcacccagcc

SEQ ID NO: 98726 - RNA, 23 nt, Human
gcccccaucgccccuccugcgcu

SEQ ID NO: 98727 - RNA, 27 nt, Human
ccaucaucuguugcccauauuuucaca

SEQ ID NO: 98728 - RNA, 26 nt, Human
cccugcucuccgcacccgcuuccucc

SEQ ID NO: 98729 - RNA, 18 nt, Human
agaacuuuuacucacuug

SEQ ID NO: 98730 - RNA, 23 nt, Human
uuuccuucucucucaauuuucgg

SEQ ID NO: 98731 - RNA, 27 nt, Human
acuguaacuaaccccuucuguccuucc

SEQ ID NO: 98732 - RNA, 22 nt, Human
cugaaccauguggcagaaggga

SEQ ID NO: 98733 - RNA, 21 nt, Human
uggcccuggcuggaguucagu

SEQ ID NO: 98734 - RNA, 19 nt, Human
aaaauauuacauuuuaagg

SEQ ID NO: 98735 - RNA, 27 nt, Human
ugcgucugcucuacugaguacuuucug

SEQ ID NO: 98736 - RNA, 22 nt, Human
ucauuuuggggagaaccuuaaa

SEQ ID NO: 98737 - RNA, 23 nt, Human
cgcagaugaggucucugaaggug

SEQ ID NO: 98738 - RNA, 22 nt, Human
uuuuuggggggagggauauacu

SEQ ID NO: 98739 - RNA, 27 nt, Human
ucccucacuacccccaggagauauuca

SEQ ID NO: 98740 - RNA, 20 nt, Human
uccaucucagcaucaacaca

SEQ ID NO: 98741 - RNA, 20 nt, Human
gaguguucaguuagcauuaa

SEQ ID NO: 98742 - RNA, 22 nt, Human
cuuccaaagagggauguuugga

SEQ ID NO: 98743 - RNA, 20 nt, Human
aaucugggguaaggagcugc

SEQ ID NO: 98744 - RNA, 23 nt, Human
auuggccuggccagaccagguga

SEQ ID NO: 98745 - RNA, 23 nt, Human
acuuugcugaauucucugaaaua

SEQ ID NO: 98746 - RNA, 22 nt, Human
gacuuaggcagaacaugccuuc

SEQ ID NO: 98747 - RNA, 27 nt, Human
aagguugagacaaaggggaucgcuuga

SEQ ID NO: 98748 - RNA, 21 nt, Human
ccaugauuuaauccagaucug

SEQ ID NO: 98749 - RNA, 26 nt, Human
agcaaucggacauagaguuggagggg

SEQ ID NO: 98750 - RNA, 23 nt, Human
cuuuuccucccuuuuccuguaca

SEQ ID NO: 98751 - RNA, 28 nt, Human
ucucucccuuuuccccaggaaugaaccg

SEQ ID NO: 98752 - RNA, 23 nt, Human
auuguggaucuuuucauucucau

SEQ ID NO: 98753 - RNA, 22 nt, Human
uucuacugcucuuuuuucucca

SEQ ID NO: 98754 - RNA, 26 nt, Human
ugcccaggcugaggcaagagaaggcc

SEQ ID NO: 98755 - RNA, 22 nt, Human
caugggaauuuuaacuuuuggg

SEQ ID NO: 98756 - RNA, 22 nt, Human
acaguuucagcacucaaccuca

SEQ ID NO: 98757 - RNA, 15 nt, Human
cuucccuugcuguca

SEQ ID NO: 98758 - RNA, 21 nt, Human
cuagggucucaguauugagaa

SEQ ID NO: 98759 - RNA, 25 nt, Human
caguuucagauacuucauaauaccu

SEQ ID NO: 98760 - RNA, 23 nt, Human
cagacuccuaagaaguuuuccuu

SEQ ID NO: 98761 - RNA, 30 nt, Human
cccaaaggcaugcuccagacauaaauagcu

SEQ ID NO: 98762 - RNA, 27 nt, Human
ugcagucugggaguggggaagugaucu

SEQ ID NO: 98763 - RNA, 21 nt, Human
gcacagccaggcuggagucag

SEQ ID NO: 98764 - RNA, 17 nt, Human
aggacccaacucacuug

SEQ ID NO: 98765 - RNA, 23 nt, Human
ccucgguuggcuccucuggaaca

SEQ ID NO: 98766 - RNA, 22 nt, Human
cagaaauuucucuguuugcuuu

SEQ ID NO: 98767 - RNA, 27 nt, Human
ugccuccaggugcagagguacccuggg

SEQ ID NO: 98768 - RNA, 21 nt, Human
aagugcugggauuacagaugu

SEQ ID NO: 98769 - RNA, 20 nt, Human
ucucuuaaaauagaguuuga

SEQ ID NO: 98770 - RNA, 23 nt, Human
caaguguuuugacgauauacucc

SEQ ID NO: 98771 - RNA, 21 nt, Human
ucccucacugcuggacuggag

SEQ ID NO: 98772 - RNA, 21 nt, Human
aaaagcaguccucuuauuccu

SEQ ID NO: 98773 - RNA, 23 nt, Human
auuauuuuaaaucauuaggaauu

SEQ ID NO: 98774 - RNA, 23 nt, Human
ggauggcccggauuuuauggcau

SEQ ID NO: 98775 - RNA, 23 nt, Human
ucugggucucagagcuucaggcc

SEQ ID NO: 98776 - RNA, 24 nt, Human
gggugcagugauagcuccuccuca

SEQ ID NO: 98777 - RNA, 23 nt, Human
uugcccagggcacuuggagcaca

SEQ ID NO: 98778 - RNA, 21 nt, Human
caauaaaauauucuuuucuac

SEQ ID NO: 98779 - RNA, 26 nt, Human
ccagugcugucccugcacacuuuggu

SEQ ID NO: 98780 - RNA, 25 nt, Human
ggaaaguuuuacauugucuguuuuu

SEQ ID NO: 98781 - RNA, 25 nt, Human
ccagucgccuagcuagggccaauca

SEQ ID NO: 98782 - RNA, 22 nt, Human
gcacaguguccagggcagcugg

SEQ ID NO: 98783 - RNA, 29 nt, Human
guuguuguugcuagaaauggauugaauua

SEQ ID NO: 98784 - RNA, 25 nt, Human
uuuggaauuuuccugggaccuacag

SEQ ID NO: 98785 - RNA, 26 nt, Human
agacaaccaacggccgacugccugug

SEQ ID NO: 98786 - RNA, 26 nt, Human
aacugcacuugcaagaccauuaucaa

SEQ ID NO: 98787 - RNA, 24 nt, Human
agugagaaacugggaucccagggg

SEQ ID NO: 98788 - RNA, 23 nt, Human
uuguuugagcccaggaauuugag

SEQ ID NO: 98789 - RNA, 32 nt, Human
ggaagcggauaauauguaggcacuuuguaaau

SEQ ID NO: 98790 - RNA, 23 nt, Human
ccagcuuugugucuucucucaau

SEQ ID NO: 98791 - RNA, 19 nt, Human
uucauuucuaccggucucu

SEQ ID NO: 98792 - RNA, 21 nt, Human
uuauuaaaaagcuacugacuu

SEQ ID NO: 98793 - RNA, 23 nt, Human
ccugccugggcucugcccuuagu

SEQ ID NO: 98794 - RNA, 20 nt, Human
cgcacaggcuggagugcagu

SEQ ID NO: 98795 - RNA, 30 nt, Human
caggccaagagcagaggcagcgaguugugg

SEQ ID NO: 98796 - RNA, 22 nt, Human
uuucuuucuuucuuucuuuuua

SEQ ID NO: 98797 - RNA, 21 nt, Human
ucugacaugcccaggguucuc

SEQ ID NO: 98798 - RNA, 21 nt, Human
cuaccaccucgagaacuggaa

SEQ ID NO: 98799 - RNA, 26 nt, Human
ucccgccaggagguccuccucucucu

SEQ ID NO: 98800 - RNA, 23 nt, Human
auuugcucaggccccugaugccu

SEQ ID NO: 98801 - RNA, 18 nt, Human
cuaccugccagggccuuc

SEQ ID NO: 98802 - RNA, 24 nt, Human
auguacaaggacagccccuccucc

SEQ ID NO: 98803 - RNA, 22 nt, Human
gggacccucucccuggcugccu

SEQ ID NO: 98804 - RNA, 22 nt, Human
cacucaucugacucauucuuua

SEQ ID NO: 98805 - RNA, 24 nt, Human
uuguggcuuuuuguaguuuacuua

SEQ ID NO: 98806 - RNA, 24 nt, Human
cugucgcccaggcuggagugcaau

SEQ ID NO: 98807 - RNA, 22 nt, Human
cacaggcuaaagaagagcagua

SEQ ID NO: 98808 - RNA, 22 nt, Human
agaaaacaaaaguccucuggau

SEQ ID NO: 98809 - RNA, 23 nt, Human
ccugccuguuucuucuccucuuc

SEQ ID NO: 98810 - RNA, 20 nt, Human
uccuuucuccccuuuggaug

SEQ ID NO: 98811 - RNA, 19 nt, Human
gaaauacccacuaacaaag

SEQ ID NO: 98812 - RNA, 20 nt, Human
uguaucaguggauuucccau

SEQ ID NO: 98813 - RNA, 25 nt, Human
cagagcccaaucauuccaaccaaag

SEQ ID NO: 98814 - RNA, 21 nt, Human
caggucaugcaguuccuggcc

SEQ ID NO: 98815 - RNA, 24 nt, Human
cagccaccagcacugccuggcucc

SEQ ID NO: 98816 - RNA, 22 nt, Human
ugccugagcccucacuccacag

SEQ ID NO: 98817 - RNA, 23 nt, Human
ugucccuucugcuggcucaggga

SEQ ID NO: 98818 - RNA, 19 nt, Human
caagaggaguuuuuaguga

SEQ ID NO: 98819 - RNA, 21 nt, Human
uuggccuggcugggugcagug

SEQ ID NO: 98820 - RNA, 23 nt, Human
augaaagucccugacaugaagcu

SEQ ID NO: 98821 - RNA, 20 nt, Human
cugagaggaccugaucaugu

SEQ ID NO: 98822 - RNA, 22 nt, Human
gggaauuuauuuauguucucaa

SEQ ID NO: 98823 - RNA, 19 nt, Human
ccugccuggguccuggugc

SEQ ID NO: 98824 - RNA, 20 nt, Human
caacuguauguucacccucu

SEQ ID NO: 98825 - RNA, 27 nt, Human
ggaggcugaggugggagaauugcucga

SEQ ID NO: 98826 - RNA, 22 nt, Human
cuucaaggagcaccuucauuag

SEQ ID NO: 98827 - RNA, 21 nt, Human
cuggcuaggaccccucugccu

SEQ ID NO: 98828 - RNA, 23 nt, Human
ggguaggcaaaacuucuuuucua

SEQ ID NO: 98829 - RNA, 21 nt, Human
aaaaacacagcuaggcuaagu

SEQ ID NO: 98830 - RNA, 26 nt, Human
cagcacucugcagaaaugccuccuca

SEQ ID NO: 98831 - RNA, 24 nt, Human
uaaucaucuggacuuuaagaagga

SEQ ID NO: 98832 - RNA, 26 nt, Human
uaugcaaauauuuuaccaccagucaa

SEQ ID NO: 98833 - RNA, 27 nt, Human
uccuuguaguacagguacagugaagga

SEQ ID NO: 98834 - RNA, 25 nt, Human
uacuacuguacuuguuggcucuuca

SEQ ID NO: 98835 - RNA, 19 nt, Human
cuagagaccgccacuguga

SEQ ID NO: 98836 - RNA, 19 nt, Human
ccaucucauucaucaugug

SEQ ID NO: 98837 - RNA, 25 nt, Human
agacccugggaaccuccucuggucu

SEQ ID NO: 98838 - RNA, 27 nt, Human
uuaagccccaggcugaauacucaggga

SEQ ID NO: 98839 - RNA, 23 nt, Human
uuuggugccugcagccucuuguc

SEQ ID NO: 98840 - RNA, 24 nt, Human
cucaaucuaugccagcucucuggc

SEQ ID NO: 98841 - RNA, 21 nt, Human
agcaugcucaugaccaacaca

SEQ ID NO: 98842 - RNA, 23 nt, Human
aguuugaagagaccacauggggc

SEQ ID NO: 98843 - RNA, 25 nt, Human
uuuccacugcuaaaacugaagcacc

SEQ ID NO: 98844 - RNA, 18 nt, Human
ucucucucgagcgcacca

SEQ ID NO: 98845 - RNA, 24 nt, Human
ugagagggagcaagcaagguuagc

SEQ ID NO: 98846 - RNA, 20 nt, Human
uaagauagcagaucaucuca

SEQ ID NO: 98847 - RNA, 23 nt, Human
cuuucuuccccagacuccaggau

SEQ ID NO: 98848 - RNA, 25 nt, Human
aaaugccaccaaugccaagugcccc

SEQ ID NO: 98849 - RNA, 23 nt, Human
uuuuguuucucaaccacuuuaua

SEQ ID NO: 98850 - RNA, 21 nt, Human
aggccagcccacccccagaag

SEQ ID NO: 98851 - RNA, 22 nt, Human
gaccagccugggcuacauagug

SEQ ID NO: 98852 - RNA, 21 nt, Human
ccugucucuuccugccugugu

SEQ ID NO: 98853 - RNA, 17 nt, Human
ucuuuugucuauuuucc

SEQ ID NO: 98854 - RNA, 20 nt, Human
ccccucgggagcaccccacc

SEQ ID NO: 98855 - RNA, 20 nt, Human
cuguacaacaggaagacuug

SEQ ID NO: 98856 - RNA, 24 nt, Human
gucuauacuacucggccauggccc

SEQ ID NO: 98857 - RNA, 27 nt, Human
gguucucucuguguguccuacaggagu

SEQ ID NO: 98858 - RNA, 21 nt, Human
cgggcggaucaccugagguga

SEQ ID NO: 98859 - RNA, 20 nt, Human
aguucauccaugaucucacu

SEQ ID NO: 98860 - RNA, 19 nt, Human
aggaaaggaaauaauggua

SEQ ID NO: 98861 - RNA, 21 nt, Human
cauuugacaaaucagagcugu

SEQ ID NO: 98862 - RNA, 22 nt, Human
gugugggaaaaaacacagcuuc

SEQ ID NO: 98863 - RNA, 21 nt, Human
caccaaggcuuagugcaguga

SEQ ID NO: 98864 - RNA, 22 nt, Human
gaacccaggaggcagagauugc

SEQ ID NO: 98865 - RNA, 25 nt, Human
agcucccuuccccucucuggcugcc

SEQ ID NO: 98866 - RNA, 22 nt, Human
uucuccagcccacaccccucca

SEQ ID NO: 98867 - RNA, 25 nt, Human
uuguugcagccaucuacugcugcug

SEQ ID NO: 98868 - RNA, 19 nt, Human
gcccucgggaccccacucg

SEQ ID NO: 98869 - RNA, 21 nt, Human
gggagggcuaccuccuccucc

SEQ ID NO: 98870 - RNA, 22 nt, Human
caggcuggggugcaguggcgcg

SEQ ID NO: 98871 - RNA, 22 nt, Human
caggcuggagugcaguagcgcg

SEQ ID NO: 98872 - RNA, 20 nt, Human
cccccacacccucaggcuca

SEQ ID NO: 98873 - RNA, 18 nt, Human
ccugcugugcuuuugggc

SEQ ID NO: 98874 - RNA, 27 nt, Human
ccuuggcccuaaaacagccaccaggaa

SEQ ID NO: 98875 - RNA, 27 nt, Human
ggaggcugaggcaggauaauuuugcuu

SEQ ID NO: 98876 - RNA, 26 nt, Human
ccacugcacccccuccugcugcagag

SEQ ID NO: 98877 - RNA, 23 nt, Human
agccauuucucaaacccaccucg

SEQ ID NO: 98878 - RNA, 20 nt, Human
gguacuuccucucuggcuga

SEQ ID NO: 98879 - RNA, 30 nt, Human
ccugggcuuccuuuuucccugccuaaucuc

SEQ ID NO: 98880 - RNA, 25 nt, Human
ucagggcugauuuauagagacccuu

SEQ ID NO: 98881 - RNA, 26 nt, Human
ugcuccagagacaaagguggggaggg

SEQ ID NO: 98882 - RNA, 26 nt, Human
cugccucucccugggcucugcagcca

SEQ ID NO: 98883 - RNA, 22 nt, Human
cugaggugggagaaucgcuuga

SEQ ID NO: 98884 - RNA, 29 nt, Human
agcuguguuuagugaaaugagcucaagua

SEQ ID NO: 98885 - RNA, 25 nt, Human
cguccauccucuuccuccccagucg

SEQ ID NO: 98886 - RNA, 31 nt, Human
caucugaauguguugggggcucugcacuuga

SEQ ID NO: 98887 - RNA, 17 nt, Human
ugcauuguuuuguguuu

SEQ ID NO: 98888 - RNA, 26 nt, Human
caccuugccaagcuuucuucuacaac

SEQ ID NO: 98889 - RNA, 22 nt, Human
agagaaaccugcagcagagaua

SEQ ID NO: 98890 - RNA, 26 nt, Human
ucucugagggacuggagggaagccgu

SEQ ID NO: 98891 - RNA, 22 nt, Human
gucaguaggagaggaugcacag

SEQ ID NO: 98892 - RNA, 23 nt, Human
agguaacuggcaaugcacuugau

SEQ ID NO: 98893 - RNA, 24 nt, Human
uuugggaaggguacauguuacacu

SEQ ID NO: 98894 - RNA, 26 nt, Human
uuaaaaaacuauuuuauguucagaaa

SEQ ID NO: 98895 - RNA, 23 nt, Human
cccucccuguccuccucggauca

SEQ ID NO: 98896 - RNA, 22 nt, Human
agacugcugggacuggccaggu

SEQ ID NO: 98897 - RNA, 22 nt, Human
cagcauuugaagguuauuguuu

SEQ ID NO: 98898 - RNA, 21 nt, Human
uccaggccauuugacacacca

SEQ ID NO: 98899 - RNA, 24 nt, Human
ggucucaggguucugaucuugccu

SEQ ID NO: 98900 - RNA, 21 nt, Human
gcugcggcacugggagggaga

SEQ ID NO: 98901 - RNA, 23 nt, Human
gcuaguacuuuguccauuuuaug

SEQ ID NO: 98902 - RNA, 22 nt, Human
ugcugcucuacucgcugccauu

SEQ ID NO: 98903 - RNA, 21 nt, Human
ucuuuugggugcaguggcuca

SEQ ID NO: 98904 - RNA, 22 nt, Human
ccuccucccuuucaucucagca

SEQ ID NO: 98905 - RNA, 19 nt, Human
ggguagcgagguugcagga

SEQ ID NO: 98906 - RNA, 21 nt, Human
caagcagacacuggugguccc

SEQ ID NO: 98907 - RNA, 24 nt, Human
gcccuuucacccauacacauuugg

SEQ ID NO: 98908 - RNA, 20 nt, Human
cugcaccuucucaacugaga

SEQ ID NO: 98909 - RNA, 21 nt, Human
ccuguucugcucucucaguca

SEQ ID NO: 98910 - RNA, 21 nt, Human
agcacacccccacccccaaau

SEQ ID NO: 98911 - RNA, 25 nt, Human
ccugcucuucuguuugcacacccag

SEQ ID NO: 98912 - RNA, 22 nt, Human
gaccagccugggcaacacagug

SEQ ID NO: 98913 - RNA, 26 nt, Human
cuccauucuuggcuuuuucauucaua

SEQ ID NO: 98914 - RNA, 22 nt, Human
ggagacacccccggagguucca

SEQ ID NO: 98915 - RNA, 19 nt, Human
uuaggcuggagugcagugg

SEQ ID NO: 98916 - RNA, 19 nt, Human
cuaggcuggagugcagcgg

SEQ ID NO: 98917 - RNA, 22 nt, Human
gugcucugccugccagugcagu

SEQ ID NO: 98918 - RNA, 27 nt, Human
cucugcccuuuugccuguccucaggcc

SEQ ID NO: 98919 - RNA, 24 nt, Human
aaguugugaauugcucaugccuau

SEQ ID NO: 98920 - RNA, 22 nt, Human
agcauuuuaucaacaaauuuca

SEQ ID NO: 98921 - RNA, 26 nt, Human
ccagccgccaucagcccaacggaagc

SEQ ID NO: 98922 - RNA, 21 nt, Human
ugaaggcuucugcagcuuugg

SEQ ID NO: 98923 - RNA, 23 nt, Human
cccagcacccccuugcucacucu

SEQ ID NO: 98924 - RNA, 24 nt, Human
cgccaccugcacucaccccccuca

SEQ ID NO: 98925 - RNA, 24 nt, Human
agugauuucuccuguuucuuggug

SEQ ID NO: 98926 - RNA, 28 nt, Human
gcuuggcuggcaucaccugcaauuaccu

SEQ ID NO: 98927 - RNA, 22 nt, Human
uccuacugacuaccucuugcuu

SEQ ID NO: 98928 - RNA, 22 nt, Human
cuucacugcagagccuugccuu

SEQ ID NO: 98929 - RNA, 22 nt, Human
ucacccacgcuggagugcugug

SEQ ID NO: 98930 - RNA, 28 nt, Human
guguuuauaucccuacguuaacuuugcc

SEQ ID NO: 98931 - RNA, 21 nt, Human
ggagcagucacugggagaggu

SEQ ID NO: 98932 - RNA, 20 nt, Human
gagagcugaccugcaccgaa

SEQ ID NO: 98933 - RNA, 25 nt, Human
gccacaagccaccauguaaccccuc

SEQ ID NO: 98934 - RNA, 25 nt, Human
auuugcguauguaaacauucauauu

SEQ ID NO: 98935 - RNA, 24 nt, Human
gcaaguguccuuaagucaaauagg

SEQ ID NO: 98936 - RNA, 23 nt, Human
augggauaauuagcaggcugguc

SEQ ID NO: 98937 - RNA, 22 nt, Human
cucccucugcugggaugagguc

SEQ ID NO: 98938 - RNA, 21 nt, Human
ucacuucaggaagcaaccaga

SEQ ID NO: 98939 - RNA, 22 nt, Human
uucgggccagcuuucugccucu

SEQ ID NO: 98940 - RNA, 23 nt, Human
gccuauaaucccagcuacugggg

SEQ ID NO: 98941 - RNA, 21 nt, Human
auuuucucauuuugaaauauu

SEQ ID NO: 98942 - RNA, 30 nt, Human
guaggguggaggggagagaagaagaugcug

SEQ ID NO: 98943 - RNA, 23 nt, Human
ccuucaaagcagcuccuggaguc

SEQ ID NO: 98944 - RNA, 27 nt, Human
accuaaagaggcuauauucauucuuua

SEQ ID NO: 98945 - RNA, 23 nt, Human
ucuucuagcuguuucacuauugg

SEQ ID NO: 98946 - RNA, 27 nt, Human
ugucccuugacgcccugcauccuccuc

SEQ ID NO: 98947 - RNA, 25 nt, Human
aagugugagacacuggaaggcaaga

SEQ ID NO: 98948 - RNA, 25 nt, Human
cuacaucuucccugcuuacucucug

SEQ ID NO: 98949 - RNA, 23 nt, Human
aaaccucuuaguaugcucagccu

SEQ ID NO: 98950 - RNA, 22 nt, Human
gacaaccaaaguaaaugcugcu

SEQ ID NO: 98951 - RNA, 26 nt, Human
gcucacaacuuggguucuucucagcg

SEQ ID NO: 98952 - RNA, 27 nt, Human
uuugcagaacugaugucaccccagaug

SEQ ID NO: 98953 - RNA, 24 nt, Human
uccuccacucugggaacagcucac

SEQ ID NO: 98954 - RNA, 23 nt, Human
uggagaaauucguggcugugcua

SEQ ID NO: 98955 - RNA, 24 nt, Human
uaaagcauuuucaaaacucaguau

SEQ ID NO: 98956 - RNA, 24 nt, Human
uuuaucccuucuugccugugagga

SEQ ID NO: 98957 - RNA, 26 nt, Human
ucagugcuucuuacuauuaagcagua

SEQ ID NO: 98958 - RNA, 27 nt, Human
gccagugcuuuaauggcaugucagaca

SEQ ID NO: 98959 - RNA, 23 nt, Human
aggugcuugcagguuuacagugu

SEQ ID NO: 98960 - RNA, 24 nt, Human
aguagcuaaugaucagagagauuu

SEQ ID NO: 98961 - RNA, 22 nt, Human
uuaucuucuuugccugccugua

SEQ ID NO: 98962 - RNA, 22 nt, Human
agccaccgggguggcucuguca

SEQ ID NO: 98963 - RNA, 22 nt, Human
ggagaaucugcuccaaaaagcu

SEQ ID NO: 98964 - RNA, 30 nt, Human
ucuuuguaucucacacagugccuugcuaau

SEQ ID NO: 98965 - RNA, 20 nt, Human
acucacaauauucucucuca

SEQ ID NO: 98966 - RNA, 21 nt, Human
ucaagcuggauaugucuaaug

SEQ ID NO: 98967 - RNA, 24 nt, Human
gcauugccuguacuacaguauuuu

SEQ ID NO: 98968 - RNA, 21 nt, Human
cacuuaauugcuuugcugcua

SEQ ID NO: 98969 - RNA, 23 nt, Human
guuuccuuauccagacagugggg

SEQ ID NO: 98970 - RNA, 24 nt, Human
caaaacaaauucaagaaugcagua

SEQ ID NO: 98971 - RNA, 26 nt, Human
gcugcugccgucagacuccugccuca

SEQ ID NO: 98972 - RNA, 27 nt, Human
ccguggucuccuugcacuuucucaguu

SEQ ID NO: 98973 - RNA, 21 nt, Human
uugccggcugcugggagccag

SEQ ID NO: 98974 - RNA, 22 nt, Human
aggcugaggcgggcagaucacc

SEQ ID NO: 98975 - RNA, 19 nt, Human
cccaggcuggagugcagug

SEQ ID NO: 98976 - RNA, 22 nt, Human
gugccuggcacucugggugcuc

SEQ ID NO: 98977 - RNA, 26 nt, Human
uccuggugccuccaucagacucuccc

SEQ ID NO: 98978 - RNA, 16 nt, Human
ucccucugcugugcca

SEQ ID NO: 98979 - RNA, 21 nt, Human
caagaucaaaacagcauaccu

SEQ ID NO: 98980 - RNA, 19 nt, Human
gccucucuuuguuuuucuu

SEQ ID NO: 98981 - RNA, 22 nt, Human
auuagguggugguagagaagca

SEQ ID NO: 98982 - RNA, 22 nt, Human
agcaccaccagggcuccaggag

SEQ ID NO: 98983 - RNA, 22 nt, Human
ugccuguagucccagcacuuug

SEQ ID NO: 98984 - RNA, 24 nt, Human
ggggaguucuccugggacaguggg

SEQ ID NO: 98985 - RNA, 27 nt, Human
ggucucaaacuccugaccucagaugau

SEQ ID NO: 98986 - RNA, 25 nt, Human
ccucuugccagcucugugagucugg

SEQ ID NO: 98987 - RNA, 20 nt, Human
acuguagaagaugaggaauc

SEQ ID NO: 98988 - RNA, 23 nt, Human
guuuuaguuucaaaauguuaaca

SEQ ID NO: 98989 - RNA, 26 nt, Human
aaggcucuucuguucccaucuguuga

SEQ ID NO: 98990 - RNA, 26 nt, Human
uacucuucuuacucuaacaagccaca

SEQ ID NO: 98991 - RNA, 26 nt, Human
ggaccugggaagguuugcagcacuuu

SEQ ID NO: 98992 - RNA, 22 nt, Human
ccgaguaccugggauuacaggc

SEQ ID NO: 98993 - RNA, 20 nt, Human
ggaaugauuuguaaugagua

SEQ ID NO: 98994 - RNA, 20 nt, Human
auggaaauucuuuguggcag

SEQ ID NO: 98995 - RNA, 32 nt, Human; identical to SEQ ID NO: 7352

SEQ ID NO: 98996 - RNA, 26 nt, Human
uggagguugguuuuguaguucugccu

SEQ ID NO: 98997 - RNA, 22 nt, Human
gccacccaggcuggaguacagu

SEQ ID NO: 98998 - RNA, 22 nt, Human
ggagccacagagagggguccag

SEQ ID NO: 98999 - RNA, 27 nt, Human
aaaugccaaagaugaauccuucacugc

SEQ ID NO: 99000 - RNA, 22 nt, Human
guuucguuuccuucugccuccg

SEQ ID NO: 99001 - RNA, 22 nt, Human
auaaaugcugggggccagcccu

SEQ ID NO: 99002 - RNA, 20 nt, Human
uuuuguuuucuuuaauuggg

SEQ ID NO: 99003 - RNA, 26 nt, Human
uaguuggcuguauuucuuacuuuauc

SEQ ID NO: 99004 - RNA, 21 nt, Human
cacagccccagcuucgcacag

SEQ ID NO: 99005 - RNA, 27 nt, Human
aggagcuguguuaggcacuuuauauac

SEQ ID NO: 99006 - RNA, 27 nt, Human
ccugccugggacuccuaugauggccug

SEQ ID NO: 99007 - RNA, 24 nt, Human
aggaccaccuccgccuacuucucc

SEQ ID NO: 99008 - RNA, 25 nt, Human
gacaggcuggcucucaguggaggcc

SEQ ID NO: 99009 - RNA, 20 nt, Human
ggaugcugggauucuugccu

SEQ ID NO: 99010 - RNA, 26 nt, Human
cccuucccaguccaaugccaucuccc

SEQ ID NO: 99011 - RNA, 22 nt, Human
agcacauggaguagcugagguu

SEQ ID NO: 99012 - RNA, 21 nt, Human
acugccucugagucauugugu

SEQ ID NO: 99013 - RNA, 22 nt, Human
cccaccauucuccucuguacuu

SEQ ID NO: 99014 - RNA, 22 nt, Human
cugaguguuagggacuuuggca

SEQ ID NO: 99015 - RNA, 27 nt, Human
gccagcucugggggagucuuaggaacu

SEQ ID NO: 99016 - RNA, 21 nt, Human
ccugagcugagggcauugcuu

SEQ ID NO: 99017 - RNA, 22 nt, Human
gcuacacauuuuuaauaguuua

SEQ ID NO: 99018 - RNA, 21 nt, Human
guuuuucugaauaaauuccau

SEQ ID NO: 99019 - RNA, 26 nt, Human
acuuggagccccagugccaagcacag

SEQ ID NO: 99020 - RNA, 22 nt, Human
agcaaggauagggaaggggaau

SEQ ID NO: 99021 - RNA, 23 nt, Human
uccucugcuucaguuucauuguu

SEQ ID NO: 99022 - RNA, 23 nt, Human
gacugcaaagugaggccccccgg

SEQ ID NO: 99023 - RNA, 26 nt, Human
cccaaaacaaauaauuacuugaauau

SEQ ID NO: 99024 - RNA, 22 nt, Human
ccgccuccuggguucaagcgau

SEQ ID NO: 99025 - RNA, 25 nt, Human
aacagcuuuaaacacuuccaaugag

SEQ ID NO: 99026 - RNA, 19 nt, Human
ggaaaucaucuuuguaaua

SEQ ID NO: 99027 - RNA, 23 nt, Human
gcuccuccuuucaacauucaaca

SEQ ID NO: 99028 - RNA, 19 nt, Human
uucaaauuauuaccaguga

SEQ ID NO: 99029 - RNA, 23 nt, Human
ugaaaacagcacugccuuccgcg

SEQ ID NO: 99030 - RNA, 19 nt, Human
ugauagccacugacccacu

SEQ ID NO: 99031 - RNA, 27 nt, Human
agggcccagcagagaguccguaggcuu

SEQ ID NO: 99032 - RNA, 26 nt, Human
ccaaguucgcuccuggugaucacucg

SEQ ID NO: 99033 - RNA, 22 nt, Human
ggccucccauagugcugggauu

SEQ ID NO: 99034 - RNA, 21 nt, Human
uuuugucuccccuaguccccc

SEQ ID NO: 99035 - RNA, 24 nt, Human
ugaaagggaagcaggaaggcccau

SEQ ID NO: 99036 - RNA, 20 nt, Human
aagaaaacugugccuggacc

SEQ ID NO: 99037 - RNA, 22 nt, Human
ugagccuuuuuggauaauuaau

SEQ ID NO: 99038 - RNA, 25 nt, Human
gggacaagauaacauagcagaggaa

SEQ ID NO: 99039 - RNA, 22 nt, Human
guugcccaggcuggagggcaau

SEQ ID NO: 99040 - RNA, 22 nt, Human
guugcccaugcuggagugcaau

SEQ ID NO: 99041 - RNA, 26 nt, Human
caguguccaaagcagggucugggcag

SEQ ID NO: 99042 - RNA, 27 nt, Human
ucauccaggucaagacuaaguauguug

SEQ ID NO: 99043 - RNA, 24 nt, Human
acaaucagccaugucauccaggcc

SEQ ID NO: 99044 - RNA, 23 nt, Human
gcggucccagcggaacucaggga

SEQ ID NO: 99045 - RNA, 23 nt, Human
cagggaugucaacgucaauauca

SEQ ID NO: 99046 - RNA, 24 nt, Human
agagggacagggacuggggcuugg

SEQ ID NO: 99047 - RNA, 21 nt, Human
gccugcauuaaaauaaaaaua

SEQ ID NO: 99048 - RNA, 19 nt, Human
cuccccuccgcuuguggcc

SEQ ID NO: 99049 - RNA, 20 nt, Human
cuucaagugaccaccaggag

SEQ ID NO: 99050 - RNA, 19 nt, Human
acugugguuuaaagcacaa

SEQ ID NO: 99051 - RNA, 20 nt, Human
gcuaacuguggucuuugugg

SEQ ID NO: 99052 - RNA, 19 nt, Human
aauccaggcugguguucug

SEQ ID NO: 99053 - RNA, 22 nt, Human
gccugucacaagccucagugug

SEQ ID NO: 99054 - RNA, 22 nt, Human
ccuccuugccaacgcccccuuu

SEQ ID NO: 99055 - RNA, 27 nt, Human
ugucuucaugcagggaaguuggaaaug

SEQ ID NO: 99056 - RNA, 24 nt, Human
uucucagauuugaaaaaggcucua

SEQ ID NO: 99057 - RNA, 24 nt, Human
gucuuaaaaauguacacagaccuc

SEQ ID NO: 99058 - RNA, 21 nt, Human
gcugccacucugcugccugua

SEQ ID NO: 99059 - RNA, 22 nt, Human
caggccucccugccaguagggu

SEQ ID NO: 99060 - RNA, 26 nt, Human
ccuuuacagguuacaucauugcaguc

SEQ ID NO: 99061 - RNA, 28 nt, Human
ucucgaacuccugaccucaggugaucca

SEQ ID NO: 99062 - RNA, 22 nt, Human
ccuuacuaagggcacaugucuu

SEQ ID NO: 99063 - RNA, 20 nt, Human
cuguaucucuuuguacucug

SEQ ID NO: 99064 - RNA, 22 nt, Human
gcaucacauccuggggcucaga

SEQ ID NO: 99065 - RNA, 22 nt, Human
ugcuugaaccugggaggcagag

SEQ ID NO: 99066 - RNA, 22 nt, Human
uguuugaacccgggaggcagag

SEQ ID NO: 99067 - RNA, 26 nt, Human
cugccuggcccucagugucuaccuuc

SEQ ID NO: 99068 - RNA, 26 nt, Human
ugucaaugcuuugagagcugguugac

SEQ ID NO: 99069 - RNA, 21 nt, Human
ccagaagagacaguaucugca

SEQ ID NO: 99070 - RNA, 21 nt, Human
cucugccccucuccaggcgcc

SEQ ID NO: 99071 - RNA, 24 nt, Human
cagauauugucagaguucugcucu

SEQ ID NO: 99072 - RNA, 20 nt, Human
aguggggccuccuugcccag

SEQ ID NO: 99073 - RNA, 19 nt, Human
cucuguugagagcauuuca

SEQ ID NO: 99074 - RNA, 23 nt, Human
gccccacgguaaacaauauggaa

SEQ ID NO: 99075 - RNA, 22 nt, Human
ccaaaauggugggauuacaggu

SEQ ID NO: 99076 - RNA, 22 nt, Human
ugccuccuggguuuaagcaauu

SEQ ID NO: 99077 - RNA, 20 nt, Human
ugcagguagugagaauugaa

SEQ ID NO: 99078 - RNA, 25 nt, Human
caggcuggagggcggcuggagagcg

SEQ ID NO: 99079 - RNA, 20 nt, Human
cuucagaccuuaccuggguu

SEQ ID NO: 99080 - RNA, 23 nt, Human
cccauuuccucagucccugggcc

SEQ ID NO: 99081 - RNA, 28 nt, Human
uuuccuacagcuucuccccaucuuucaa

SEQ ID NO: 99082 - RNA, 22 nt, Human
uacugaagugucaacacauuag

SEQ ID NO: 99083 - RNA, 21 nt, Human
ggaggcgguccugguagggag

SEQ ID NO: 99084 - RNA, 21 nt, Human
aaaguguuacuguucaaauca

SEQ ID NO: 99085 - RNA, 26 nt, Human
cacagcccaggcucaccccaagaacu

SEQ ID NO: 99086 - RNA, 20 nt, Human
uacucuguguaccugcucca

SEQ ID NO: 99087 - RNA, 21 nt, Human
auucaaggcaagcaccaccuu

SEQ ID NO: 99088 - RNA, 26 nt, Human
ucccauuccuccacucuguaucuaug

SEQ ID NO: 99089 - RNA, 26 nt, Human
agucaaauucagaucauuccuggcuc

SEQ ID NO: 99090 - RNA, 20 nt, Human
gcaugaucuuacacgaagaa

SEQ ID NO: 99091 - RNA, 22 nt, Human
cggggcccgccucacaccccag

SEQ ID NO: 99092 - RNA, 22 nt, Human
cuuccucugccaugucuuuucc

SEQ ID NO: 99093 - RNA, 23 nt, Human
ucagcacuccgucaguguugcca

SEQ ID NO: 99094 - RNA, 19 nt, Human
acaaucaguuugagcugcu

SEQ ID NO: 99095 - RNA, 21 nt, Human
uguuccacaaauugugccucu

SEQ ID NO: 99096 - RNA, 22 nt, Human
ggaggcugaggagggaggauua

SEQ ID NO: 99097 - RNA, 26 nt, Human
cugggcccugcucaaugccaccuguc

SEQ ID NO: 99098 - RNA, 23 nt, Human
guggggaaaacuaaucccaggga

SEQ ID NO: 99099 - RNA, 27 nt, Human
cucaugccaccacgccagcuaauuuuu

SEQ ID NO: 99100 - RNA, 16 nt, Human
ccugggugggagggga

SEQ ID NO: 99101 - RNA, 23 nt, Human
ugcaaaugaugacagcacuucug

SEQ ID NO: 99102 - RNA, 20 nt, Human
cccaauugacacagguucua

SEQ ID NO: 99103 - RNA, 22 nt, Human
gucucuggguggaagugugugc

SEQ ID NO: 99104 - RNA, 21 nt, Human
cuggugauuguuccuucccuc

SEQ ID NO: 99105 - RNA, 25 nt, Human
gucuuuugaggcugugaaagcuguc

SEQ ID NO: 99106 - RNA, 19 nt, Human
gucucuauuucauuuuuug

SEQ ID NO: 99107 - RNA, 27 nt, Human
ccagaagcagaugaucaugacgcaguc

SEQ ID NO: 99108 - RNA, 27 nt, Human
cucuguccucauucccugcccuuccuu

SEQ ID NO: 99109 - RNA, 25 nt, Human
aggucucugacaguggguccaggac

SEQ ID NO: 99110 - RNA, 30 nt, Human
cggcgcgaggcggagcuuggcaguuccguc

SEQ ID NO: 99111 - RNA, 22 nt, Human
ccucaauuccaacacugauuuc

SEQ ID NO: 99112 - RNA, 19 nt, Human
gggggagaggggagaaugg

SEQ ID NO: 99113 - RNA, 20 nt, Human
cagggguuugcuuacaguga

SEQ ID NO: 99114 - RNA, 24 nt, Human
cuuugugaaaauucaucacuguga

SEQ ID NO: 99115 - RNA, 26 nt, Human
ccuccgccuccuggguucaagcgauu

SEQ ID NO: 99116 - RNA, 26 nt, Human
ucuccaggaguuuggaagugagcuga

SEQ ID NO: 99117 - RNA, 23 nt, Human
ccugccugggccccuccugggac

SEQ ID NO: 99118 - RNA, 18 nt, Human
guacuguaacugugucau

SEQ ID NO: 99119 - RNA, 23 nt, Human
ugaugacacaaaaugaauauuaa

SEQ ID NO: 99120 - RNA, 23 nt, Human
cgccuuguggcugagaacuggac

SEQ ID NO: 99121 - RNA, 23 nt, Human
cucuggcaggaacucugaugcac

SEQ ID NO: 99122 - RNA, 27 nt, Human
ucuuaaccuugagcauagugacuuaga

SEQ ID NO: 99123 - RNA, 19 nt, Human
agacacugguuuacacuuu

SEQ ID NO: 99124 - RNA, 21 nt, Human
agccugcuccuuuuacucuag

SEQ ID NO: 99125 - RNA, 25 nt, Human
cauuccccucccauuucagcccuua

SEQ ID NO: 99126 - RNA, 23 nt, Human
gcaccuggguccaucagagaagg

SEQ ID NO: 99127 - RNA, 22 nt, Human
ugaaaacaacaaaacacuacua

SEQ ID NO: 99128 - RNA, 27 nt, Human
aguauuuuucuccccauuuuccaggga

SEQ ID NO: 99129 - RNA, 26 nt, Human
gagauaaggaaaaauauuuugcacag

SEQ ID NO: 99130 - RNA, 21 nt, Human
aguaacugggauuacaggcau

SEQ ID NO: 99131 - RNA, 17 nt, Human
caagcauuuucugugau

SEQ ID NO: 99132 - RNA, 24 nt, Human
ugagaaacacuuuccuggagcugc

SEQ ID NO: 99133 - RNA, 22 nt, Human
gguguuuuggcaccugccugua

SEQ ID NO: 99134 - RNA, 23 nt, Human
uucuuccggcucggccgugcugc

SEQ ID NO: 99135 - RNA, 26 nt, Human
ucaugccuaacuacugggugcacaua

SEQ ID NO: 99136 - RNA, 21 nt, Human
ucugugucgccccgcccagcc

SEQ ID NO: 99137 - RNA, 22 nt, Human
cuccugagcccccagcuuccag

SEQ ID NO: 99138 - RNA, 32 nt, Human
ggcacccugaggcggagguuucagaguagaag

SEQ ID NO: 99139 - RNA, 21 nt, Human
uacugcccuggucuaguggga

SEQ ID NO: 99140 - RNA, 27 nt, Human
auugcaaauaguuaacuuuucaucaug

SEQ ID NO: 99141 - RNA, 19 nt, Human
gucaucugcaaauacagac

SEQ ID NO: 99142 - RNA, 27 nt, Human
gcccuucaugcauuugcacuacuggaa

SEQ ID NO: 99143 - RNA, 23 nt, Human
ucucacacuggccugggcuuggg

SEQ ID NO: 99144 - RNA, 27 nt, Human
gcauccucugaugaacucacacaugcc

SEQ ID NO: 99145 - RNA, 20 nt, Human
cauacauguugcagcuuuga

SEQ ID NO: 99146 - RNA, 22 nt, Human
gguuauacaacuugccucaaau

SEQ ID NO: 99147 - RNA, 26 nt, Human
gagcgugagacccugucucaaagaag

SEQ ID NO: 99148 - RNA, 24 nt, Human
aagugagagcacgccuguacuaga

SEQ ID NO: 99149 - RNA, 23 nt, Human
ugcuuuaucuuugaaauuuugca

SEQ ID NO: 99150 - RNA, 30 nt, Human
cuuccuuucugugccucaucaugcaaggau

SEQ ID NO: 99151 - RNA, 23 nt, Human
aacacaaucugcuaggaacuugg

SEQ ID NO: 99152 - RNA, 27 nt, Human
ccugcuguuugcaucuugagagcagca

SEQ ID NO: 99153 - RNA, 21 nt, Human
aggagguggaaguugcuuuga

SEQ ID NO: 99154 - RNA, 22 nt, Human
caugaggucaggaguucgagac

SEQ ID NO: 99155 - RNA, 20 nt, Human
ggagccagaggagggaagug

SEQ ID NO: 99156 - RNA, 25 nt, Human
ugggaccccgcccccucauccugcc

SEQ ID NO: 99157 - RNA, 20 nt, Human
auugguuccugcaaaagaca

SEQ ID NO: 99158 - RNA, 20 nt, Human
ugcaaguucauaggucucca

SEQ ID NO: 99159 - RNA, 20 nt, Human
gaccccuccuuucuuccucc

SEQ ID NO: 99160 - RNA, 22 nt, Human
aucucuguucuuuucccgccuc

SEQ ID NO: 99161 - RNA, 17 nt, Human
aauauaggguuuuguuu

SEQ ID NO: 99162 - RNA, 20 nt, Human
ucuugagaggggucagucua

SEQ ID NO: 99163 - RNA, 25 nt, Human
aagcaagacccucccuccaaagaaa

SEQ ID NO: 99164 - RNA, 27 nt, Human
agagaaggcagcaggcggccuuuguug

SEQ ID NO: 99165 - RNA, 26 nt, Human
ucuggcuucuaacuuucuguauguau

SEQ ID NO: 99166 - RNA, 20 nt, Human
uuacauaaaauaggagcugc

SEQ ID NO: 99167 - RNA, 20 nt, Human
gaaauauaucagcccauguu

SEQ ID NO: 99168 - RNA, 24 nt, Human
ggcuucccuccuccuccccugcag

SEQ ID NO: 99169 - RNA, 23 nt, Human
uuaguagagaugggguuucucca

SEQ ID NO: 99170 - RNA, 20 nt, Human
gaccagguuuuuuguuuucc

SEQ ID NO: 99171 - RNA, 21 nt, Human
cuccacugacugucgggcuuu

SEQ ID NO: 99172 - RNA, 21 nt, Human
cauucacacaaggcacugccu

SEQ ID NO: 99173 - RNA, 28 nt, Human
ccgccugccucugccucccaaagugcug

SEQ ID NO: 99174 - RNA, 22 nt, Human
uagggagguuggugucagaggc

SEQ ID NO: 99175 - RNA, 22 nt, Human
ugaacaaaaauugagagcuuua

SEQ ID NO: 99176 - RNA, 21 nt, Human
augagccaugauuucccacug

SEQ ID NO: 99177 - RNA, 21 nt, Human
cacuacacuccagccuggcga

SEQ ID NO: 99178 - RNA, 22 nt, Human
ucucuagcuaauuuuguggcca

SEQ ID NO: 99179 - RNA, 23 nt, Human
uuaagccuaugauguaaaaugaa

SEQ ID NO: 99180 - RNA, 22 nt, Human
caggcuggagugcaauggcgca

SEQ ID NO: 99181 - RNA, 22 nt, Human
caggcuagagugcgguggcgcg

SEQ ID NO: 99182 - RNA, 24 nt, Human
ccuuuauuuccacugugcagguuc

SEQ ID NO: 99183 - RNA, 22 nt, Human
cccccuggcucuucucucucaa

SEQ ID NO: 99184 - RNA, 21 nt, Human
aggccuaggaccucaggcggg

SEQ ID NO: 99185 - RNA, 26 nt, Human
ucagcugauuugcagaaguugcccau

SEQ ID NO: 99186 - RNA, 21 nt, Human
gcaucccaccagccugagcaa

SEQ ID NO: 99187 - RNA, 27 nt, Human
uaaauugauuuguuaugguuacauauu

SEQ ID NO: 99188 - RNA, 24 nt, Human
cugggcuucggggcacuggcagag

SEQ ID NO: 99189 - RNA, 26 nt, Human
cugugucugcccccgucuucucucca

SEQ ID NO: 99190 - RNA, 24 nt, Human
aaguuggcuagagcuucuguauuu

SEQ ID NO: 99191 - RNA, 23 nt, Human
acuguucuucauuagauguuuau

SEQ ID NO: 99192 - RNA, 19 nt, Human
cuaaacauuacggcaauuu

SEQ ID NO: 99193 - RNA, 26 nt, Human
agcuaaaugugauccugccuugcugu

SEQ ID NO: 99194 - RNA, 22 nt, Human
ggucgaggcuguagugagcccu

SEQ ID NO: 99195 - RNA, 22 nt, Human
acuuaaaaccuuugacugccug

SEQ ID NO: 99196 - RNA, 19 nt, Human
accugccucccuucaugca

SEQ ID NO: 99197 - RNA, 21 nt, Human
agggagccauguuucacaagg

SEQ ID NO: 99198 - RNA, 23 nt, Human
ugugcaugcucucccaugacauc

SEQ ID NO: 99199 - RNA, 26 nt, Human
cugcuaggugugugggguguuucgcc

SEQ ID NO: 99200 - RNA, 22 nt, Human
auacauauaucuacacauacag

SEQ ID NO: 99201 - RNA, 26 nt, Human
caggccacuacggcugcucggcagga

SEQ ID NO: 99202 - RNA, 25 nt, Human
uucaaaagaauaaaauaaccaauga

SEQ ID NO: 99203 - RNA, 23 nt, Human
ggagcugugcaccggagcuguuc

SEQ ID NO: 99204 - RNA, 25 nt, Human
aagccaggcuggaggggccugagug

SEQ ID NO: 99205 - RNA, 22 nt, Human
ggagagaaacagagacucaggg

SEQ ID NO: 99206 - RNA, 22 nt, Human
caggaggcagagguugcagcga

SEQ ID NO: 99207 - RNA, 26 nt, Human
ggaauucccuggucagggagauggag

SEQ ID NO: 99208 - RNA, 23 nt, Human
acaacaaucucccugcuacuucu

SEQ ID NO: 99209 - RNA, 25 nt, Human
acuagugccuuuuaguacaauuuua

SEQ ID NO: 99210 - RNA, 18 nt, Human
aacauccucacaacuccc

SEQ ID NO: 99211 - RNA, 23 nt, Human
aacguggacguuguuuucugccu

SEQ ID NO: 99212 - RNA, 20 nt, Human
ccugcucccugcugcugagc

SEQ ID NO: 99213 - RNA, 18 nt, Human
accuuaaaaaaugcuuua

SEQ ID NO: 99214 - RNA, 27 nt, Human
gucaaguuuuaaauacuuaucuugccu

SEQ ID NO: 99215 - RNA, 21 nt, Human
ggcugggcuucaguggcagcu

SEQ ID NO: 99216 - RNA, 26 nt, Human
gggugaggcaagcuggcgcgccgcgg

SEQ ID NO: 99217 - RNA, 19 nt, Human
cuccagaggcucucaggcc

SEQ ID NO: 99218 - RNA, 26 nt, Human
gccagucccuggugcccuccuggccc

SEQ ID NO: 99219 - RNA, 27 nt, Human
aucucuaguugucacuuuccucuucca

SEQ ID NO: 99220 - RNA, 25 nt, Human
cugcccccacggggccagggcuacc

SEQ ID NO: 99221 - RNA, 22 nt, Human
cucugcuucuccccugugggaa

SEQ ID NO: 99222 - RNA, 24 nt, Human
ucuuugccaucucugcuccaaccg

SEQ ID NO: 99223 - RNA, 20 nt, Human
ccgaggagcaccaccaggcc

SEQ ID NO: 99224 - RNA, 26 nt, Human
gaggaagaugcucaucugagccagca

SEQ ID NO: 99225 - RNA, 21 nt, Human
uggcacccccuaccucuguuc

SEQ ID NO: 99226 - RNA, 25 nt, Human
uacaagugugucccaacacaguccu

SEQ ID NO: 99227 - RNA, 22 nt, Human
uggcuagcugcggugcuccuug

SEQ ID NO: 99228 - RNA, 21 nt, Human
uuauuaggauuucuguauuug

SEQ ID NO: 99229 - RNA, 28 nt, Human
aaaagccgaguccucugauggcucccuu

SEQ ID NO: 99230 - RNA, 27 nt, Human
gcugcacccuuagcagccacugccacc

SEQ ID NO: 99231 - RNA, 20 nt, Human
cugggagguggagguugcug

SEQ ID NO: 99232 - RNA, 20 nt, Human
auuucuauuuguaaauucuu

SEQ ID NO: 99233 - RNA, 24 nt, Human
ccguuuguuuugugcuuucuaguu

SEQ ID NO: 99234 - RNA, 27 nt, Human
uccuagagcggaggaaccgggucgugc

SEQ ID NO: 99235 - RNA, 25 nt, Human
cacucuuauuauguuaaaacaaaug

SEQ ID NO: 99236 - RNA, 22 nt, Human
gcuccgacgccguuccccacca

SEQ ID NO: 99237 - RNA, 27 nt, Human
cuugugagcaaauugaguuaucagaau

SEQ ID NO: 99238 - RNA, 25 nt, Human
auggcaucaccuccaccauacucca

SEQ ID NO: 99239 - RNA, 24 nt, Human
ggugcugagaaauuccacacauga

SEQ ID NO: 99240 - RNA, 25 nt, Human
cugaguauuaaguaguaaucuguca

SEQ ID NO: 99241 - RNA, 22 nt, Human
ccggaacaacagcggcuuuccc

SEQ ID NO: 99242 - RNA, 30 nt, Human
agcucacugcaaccuccgccucuuggguuc

SEQ ID NO: 99243 - RNA, 25 nt, Human
cgacucguccagcugggucgcguua

SEQ ID NO: 99244 - RNA, 21 nt, Human
ucucuuucgcaccugccucuc

SEQ ID NO: 99245 - RNA, 22 nt, Human
gagguccgcagggagccuagcg

SEQ ID NO: 99246 - RNA, 24 nt, Human
ggcccaagugauacucccaccucu

SEQ ID NO: 99247 - RNA, 22 nt, Human
ugggccuguauucccagagcuu

SEQ ID NO: 99248 - RNA, 26 nt, Human
ggugucccugccuucacugugcucca

SEQ ID NO: 99249 - RNA, 26 nt, Human
uggcccaucaggguaggcuggaguua

SEQ ID NO: 99250 - RNA, 21 nt, Human
cguucacugcaaucucugccu

SEQ ID NO: 99251 - RNA, 25 nt, Human
gccaugaccuuacauuuccugggcc

SEQ ID NO: 99252 - RNA, 21 nt, Human
aaggcauuuauugcugaguua

SEQ ID NO: 99253 - RNA, 31 nt, Human
gccuucagaaugcuccugagugguguaggug

SEQ ID NO: 99254 - RNA, 27 nt, Human
uuccgcguccaagaaguuuacuuccua

SEQ ID NO: 99255 - RNA, 23 nt, Human
ccuccacuccagcucugagaccc

SEQ ID NO: 99256 - RNA, 27 nt, Human
ucauggacugaggcaaaggcugggcca

SEQ ID NO: 99257 - RNA, 21 nt, Human
aauguguucuuaacugggugg

SEQ ID NO: 99258 - RNA, 26 nt, Human
guagcacaggcugagugcaggcccac

SEQ ID NO: 99259 - RNA, 27 nt, Human
ugggagccacugccugagggcaggccg

SEQ ID NO: 99260 - RNA, 22 nt, Human
cucaagugauucuccugccuca

SEQ ID NO: 99261 - RNA, 18 nt, Human
gcccuugucucagucauu

SEQ ID NO: 99262 - RNA, 23 nt, Human
uuuagagaaagagaaugggagca

SEQ ID NO: 99263 - RNA, 22 nt, Human
cucauuucuuagcagccucucu

SEQ ID NO: 99264 - RNA, 23 nt, Human
cuguauccugugcuuuuucugug

SEQ ID NO: 99265 - RNA, 27 nt, Human
ccaacuugcugcugucaccaccaaacu

SEQ ID NO: 99266 - RNA, 22 nt, Human
ccuucacugcuagggaugcuca

SEQ ID NO: 99267 - RNA, 24 nt, Human
aagaacauauuauaaaaagaauac

SEQ ID NO: 99268 - RNA, 23 nt, Human
cugccucucacagcugaguuguu

SEQ ID NO: 99269 - RNA, 21 nt, Human
agaaguacaugaagagcagcu

SEQ ID NO: 99270 - RNA, 18 nt, Human
aaauguguauuucugugu

SEQ ID NO: 99271 - RNA, 20 nt, Human
acuccagaggcucucaggcc

SEQ ID NO: 99272 - RNA, 27 nt, Human
caucccauuccaggcagccucugucag

SEQ ID NO: 99273 - RNA, 23 nt, Human
uuaguaaagacaggguuucacca

SEQ ID NO: 99274 - RNA, 26 nt, Human
uucaaacuuuugggagcacggacugu

SEQ ID NO: 99275 - RNA, 22 nt, Human
gggaccaccugugcugcagucc

SEQ ID NO: 99276 - RNA, 27 nt, Human
aucuccuucuuuccuggacuuaacucu

SEQ ID NO: 99277 - RNA, 24 nt, Human
cacugugucucucuggcucucugg

SEQ ID NO: 99278 - RNA, 25 nt, Human
cuccagauagacuccuggggaagca

SEQ ID NO: 99279 - RNA, 22 nt, Human
gaccagccugaccaaaauggug

SEQ ID NO: 99280 - RNA, 22 nt, Human
gaccagccuggccaaaauagug

SEQ ID NO: 99281 - RNA, 23 nt, Human
uugcaguuuuuuaaauguguucc

SEQ ID NO: 99282 - RNA, 24 nt, Human
gguuccaucaacacccaccuucca

SEQ ID NO: 99283 - RNA, 23 nt, Human
gcccgccaccaccacgcagccgc

SEQ ID NO: 99284 - RNA, 22 nt, Human
uauacucaauagcuuaaacuca

SEQ ID NO: 99285 - RNA, 27 nt, Human
cugcuggcugcaagcuguggguucuuu

SEQ ID NO: 99286 - RNA, 23 nt, Human
aaggcauggaaguucucugugau

SEQ ID NO: 99287 - RNA, 21 nt, Human
gagcgggcccaggcucuguga

SEQ ID NO: 99288 - RNA, 19 nt, Human
uccucaagcuucaggugac

SEQ ID NO: 99289 - RNA, 20 nt, Human
gcuugaagguuuguccaggc

SEQ ID NO: 99290 - RNA, 29 nt, Human
cccacauccacuucauugugcuguucacu

SEQ ID NO: 99291 - RNA, 20 nt, Human
aacuccauauguguuccucu

SEQ ID NO: 99292 - RNA, 27 nt, Human
cccugcaggaggccugggagggcaagg

SEQ ID NO: 99293 - RNA, 16 nt, Human
uauuaaaauauaucca

SEQ ID NO: 99294 - RNA, 22 nt, Human
auaguguaauauauacagagua

SEQ ID NO: 99295 - RNA, 24 nt, Human
ucagcauuuucuucucugcacuua

SEQ ID NO: 99296 - RNA, 28 nt, Human
ucccuguggggcaggagugccaggacca

SEQ ID NO: 99297 - RNA, 21 nt, Human
uuuaggacagauucucagaug

SEQ ID NO: 99298 - RNA, 21 nt, Human
uuccagccacagggcagccuu

SEQ ID NO: 99299 - RNA, 24 nt, Human
ucauggacucacuaggcugcugag

SEQ ID NO: 99300 - RNA, 21 nt, Human
ccaggagguuguggauacagu

SEQ ID NO: 99301 - RNA, 28 nt, Human
aacaaggccagccccaaccuuccaaacc

SEQ ID NO: 99302 - RNA, 26 nt, Human
uauggauacacauguguauaucugua

SEQ ID NO: 99303 - RNA, 23 nt, Human
gagccccaggcuggagcagcaug

SEQ ID NO: 99304 - RNA, 28 nt, Human
ucuggcuggagcuugaggacgcaaggag

SEQ ID NO: 99305 - RNA, 19 nt, Human
ucggcucccugucgcgccc

SEQ ID NO: 99306 - RNA, 19 nt, Human
acuucauucccuuagucuu

SEQ ID NO: 99307 - RNA, 26 nt, Human
uucacacauuaauuuuaucucagucu

SEQ ID NO: 99308 - RNA, 27 nt, Human
gccucuggaugagguugaguucuccac

SEQ ID NO: 99309 - RNA, 23 nt, Human
gugccuuucuguaccccaagcca

SEQ ID NO: 99310 - RNA, 27 nt, Human
uggcuggggcaggauuggguuuacaac

SEQ ID NO: 99311 - RNA, 22 nt, Human
gcaucccagccaucacucuucc

SEQ ID NO: 99312 - RNA, 21 nt, Human
ucucacccccucacaggacag

SEQ ID NO: 99313 - RNA, 24 nt, Human
agaggcagcaucugccauucuaac

SEQ ID NO: 99314 - RNA, 22 nt, Human
gagguggcagcggcagcagcug

SEQ ID NO: 99315 - RNA, 22 nt, Human
cugcuuuccugccugccccacc

SEQ ID NO: 99316 - RNA, 25 nt, Human
cuguaaaauauuuaaaagguuaaaa

SEQ ID NO: 99317 - RNA, 20 nt, Human
caggcuggagugcaauagcu

SEQ ID NO: 99318 - RNA, 22 nt, Human
gguccacaccccgggagcugag

SEQ ID NO: 99319 - RNA, 21 nt, Human
uaucuucuaccugaaccuucu

SEQ ID NO: 99320 - RNA, 21 nt, Human
ucacuagccucuaacucccug

SEQ ID NO: 99321 - RNA, 23 nt, Human
uuaggaaucauugccccaaaaag

SEQ ID NO: 99322 - RNA, 22 nt, Human
cccccagccaugauuaacccug

SEQ ID NO: 99323 - RNA, 27 nt, Human
uuuucuuucuuuucuuuuuuaaaguaa

SEQ ID NO: 99324 - RNA, 26 nt, Human
gccuaucuuagguagucaugcugugc

SEQ ID NO: 99325 - RNA, 21 nt, Human
cugccuggcucugucccaggc

SEQ ID NO: 99326 - RNA, 25 nt, Human
ugggaaagagauggauguuggggag

SEQ ID NO: 99327 - RNA, 21 nt, Human
gagagauuuaagacaaagggu

SEQ ID NO: 99328 - RNA, 22 nt, Human
gaaucaggcaccggagugcagg

SEQ ID NO: 99329 - RNA, 27 nt, Human
agcucacuggccacaauacccaccucu

SEQ ID NO: 99330 - RNA, 23 nt, Human
auccucucccccuccuccaggga

SEQ ID NO: 99331 - RNA, 22 nt, Human
cuccaccuuguuccugcccuuu

SEQ ID NO: 99332 - RNA, 20 nt, Human
uuuaacuacaucugccucgg

SEQ ID NO: 99333 - RNA, 24 nt, Human
gaauguucucuaugacuaacaguu

SEQ ID NO: 99334 - RNA, 25 nt, Human
ggccucaggugauccacccaccuca

SEQ ID NO: 99335 - RNA, 30 nt, Human
ccuguaguguaaaguggccacuaugaaucc

SEQ ID NO: 99336 - RNA, 27 nt, Human
ccacugcacuccagccuggggcugaca

SEQ ID NO: 99337 - RNA, 24 nt, Human
ugcauaccuagucuggaguuguga

SEQ ID NO: 99338 - RNA, 22 nt, Human
acccaggcuggaguacagugac

SEQ ID NO: 99339 - RNA, 26 nt, Human
gucccuugacuuuuguauucugacuc

SEQ ID NO: 99340 - RNA, 22 nt, Human
gugaaauuuacaguuacugccu

SEQ ID NO: 99341 - RNA, 24 nt, Human
cccaucaccaggaacugucacugg

SEQ ID NO: 99342 - RNA, 21 nt, Human
ccacugcacuugccaccugag

SEQ ID NO: 99343 - RNA, 18 nt, Human
cucuccaaucccgggaag

SEQ ID NO: 99344 - RNA, 23 nt, Human
uucacaauucagcuucuaugacc

SEQ ID NO: 99345 - RNA, 22 nt, Human
gaugcuggggcccagucugccc

SEQ ID NO: 99346 - RNA, 27 nt, Human
cacagccgccuuuggguuccaucuugc

SEQ ID NO: 99347 - RNA, 22 nt, Human
ccaggggaaggagaaagagaca

SEQ ID NO: 99348 - RNA, 17 nt, Human
cacauuggaaugccuug

SEQ ID NO: 99349 - RNA, 22 nt, Human
auaucaguccccuucacugcag

SEQ ID NO: 99350 - RNA, 27 nt, Human
accugcgguuuucucauugcuuuugcu

SEQ ID NO: 99351 - RNA, 20 nt, Human
guaggcaggauuggggaaga

SEQ ID NO: 99352 - RNA, 22 nt, Human
acacauaccauguauuauuuua

SEQ ID NO: 99353 - RNA, 20 nt, Human
uguguucucugccucugguu

SEQ ID NO: 99354 - RNA, 25 nt, Human
uggggaccacgggcuggagcaggug

SEQ ID NO: 99355 - RNA, 23 nt, Human
gggggccagcagcagguaggugc

SEQ ID NO: 99356 - RNA, 20 nt, Human
uaucccacugggagcacuuu

SEQ ID NO: 99357 - RNA, 21 nt, Human
gcucaggaugagggaaaagaa

SEQ ID NO: 99358 - RNA, 26 nt, Human
cugggagcucugcggaaucugagcca

SEQ ID NO: 99359 - RNA, 20 nt, Human
guggcaggcaggccucaguu

SEQ ID NO: 99360 - RNA, 22 nt, Human
caucugaggauguucaggcugg

SEQ ID NO: 99361 - RNA, 19 nt, Human
gcauccugugcugugcaca

SEQ ID NO: 99362 - RNA, 22 nt, Human
accacaacaaggccagguucuu

SEQ ID NO: 99363 - RNA, 27 nt, Human
agcauuuucaaacucaaauuccuguuu

SEQ ID NO: 99364 - RNA, 22 nt, Human
aggcuggagggcggcuggagag

SEQ ID NO: 99365 - RNA, 20 nt, Human
cugugaucccagcacuuugg

SEQ ID NO: 99366 - RNA, 21 nt, Human
auuggcagaggggaccaaggg

SEQ ID NO: 99367 - RNA, 22 nt, Human
agauguaugcaguauguggcca

SEQ ID NO: 99368 - RNA, 20 nt, Human
aaacugccauuucauucaca

SEQ ID NO: 99369 - RNA, 24 nt, Human
ccuuuccccaucccugccuccugc

SEQ ID NO: 99370 - RNA, 23 nt, Human
cccaggaggaagagguugcagug

SEQ ID NO: 99371 - RNA, 22 nt, Human
aucacuugagcccaggaggucg

SEQ ID NO: 99372 - RNA, 23 nt, Human
ugccacucugggcaaaugcucuu

SEQ ID NO: 99373 - RNA, 25 nt, Human
ccaggaggccugggagaugcagcug

SEQ ID NO: 99374 - RNA, 27 nt, Human
ucccugagagaaguuagcgucccuggc

SEQ ID NO: 99375 - RNA, 21 nt, Human
auuguuuaagguuuccucaaa

SEQ ID NO: 99376 - RNA, 27 nt, Human
ccccacccucaugacugggaaggaagc

SEQ ID NO: 99377 - RNA, 19 nt, Human
ggcugagagagucggagac

SEQ ID NO: 99378 - RNA, 19 nt, Human
guucuuucuuuaauagugg

SEQ ID NO: 99379 - RNA, 22 nt, Human
cugcacguuucuuucucucuug

SEQ ID NO: 99380 - RNA, 25 nt, Human
gaggcagagagcggucucaggcugg

SEQ ID NO: 99381 - RNA, 20 nt, Human
cccauuuaguagucauagaa

SEQ ID NO: 99382 - RNA, 21 nt, Human
uauuuguuuuggaaucccacu

SEQ ID NO: 99383 - RNA, 21 nt, Human
ggccccagccaccugcaacuu

SEQ ID NO: 99384 - RNA, 20 nt, Human
ggagcccaggcgggagcggu

SEQ ID NO: 99385 - RNA, 21 nt, Human
uggcguccagcaguccaggac

SEQ ID NO: 99386 - RNA, 24 nt, Human
gcccucugguuugccgguggugca

SEQ ID NO: 99387 - RNA, 21 nt, Human
gcucuccaucuuccacgaaau

SEQ ID NO: 99388 - RNA, 22 nt, Human
ucacacaccagcguuuugacca

SEQ ID NO: 99389 - RNA, 26 nt, Human
ugagaaauuguaaacaaaaacugaca

SEQ ID NO: 99390 - RNA, 24 nt, Human
uaaguuuuaggccaaaaugaguga

SEQ ID NO: 99391 - RNA, 26 nt, Human
cuucauacuuacagcaaugaaucuga

SEQ ID NO: 99392 - RNA, 19 nt, Human
guacucugggugacucaga

SEQ ID NO: 99393 - RNA, 22 nt, Human
gugguuucagcacagaaccuga

SEQ ID NO: 99394 - RNA, 22 nt, Human
auccaggucacggggcaccaaa

SEQ ID NO: 99395 - RNA, 21 nt, Human
ccuguccaauuuuagcagguu

SEQ ID NO: 99396 - RNA, 22 nt, Human
gucacucugggaaccuggauuu

SEQ ID NO: 99397 - RNA, 24 nt, Human
auguuuuugaggcuuucuguugcc

SEQ ID NO: 99398 - RNA, 26 nt, Human
gcugcacuccagccugcgggacagag

SEQ ID NO: 99399 - RNA, 20 nt, Human
gguucuguucacugcugaaa

SEQ ID NO: 99400 - RNA, 20 nt, Human
uaagcuggagugugguggca

SEQ ID NO: 99401 - RNA, 22 nt, Human
cugaggcagaagaauggcauga

SEQ ID NO: 99402 - RNA, 24 nt, Human
agccagugccccuggaucuugccu

SEQ ID NO: 99403 - RNA, 25 nt, Human
gugaggcagcugugaguuggacagg

SEQ ID NO: 99404 - RNA, 22 nt, Human
auaaaccugcucagauaggaca

SEQ ID NO: 99405 - RNA, 26 nt, Human
ugacugaugaagugcaccuuucaaaa

SEQ ID NO: 99406 - RNA, 23 nt, Human
uaguuugugcuuggaauaugacu

SEQ ID NO: 99407 - RNA, 27 nt, Human
aaguagcugggauuacagucaggcacc

SEQ ID NO: 99408 - RNA, 21 nt, Human
aggaagaagacaaaugacaga

SEQ ID NO: 99409 - RNA, 22 nt, Human
aaggcauuuuccacuaguuuuu

SEQ ID NO: 99410 - RNA, 22 nt, Human
gggagcugcacuugcuccgucg

SEQ ID NO: 99411 - RNA, 20 nt, Human
uagaagccuggccuccugau

SEQ ID NO: 99412 - RNA, 23 nt, Human
cccaggagacagcacaccaccag

SEQ ID NO: 99413 - RNA, 22 nt, Human
ggcaggcgggcagcugcaggga

SEQ ID NO: 99414 - RNA, 21 nt, Human
ccagccuggugccaucuugaa

SEQ ID NO: 99415 - RNA, 21 nt, Human
agcugugccaauacugccuac

SEQ ID NO: 99416 - RNA, 28 nt, Human
ccugggcugggcuggcucuggauggagc

SEQ ID NO: 99417 - RNA, 21 nt, Human
cccucagcaaggacagcagag

SEQ ID NO: 99418 - RNA, 22 nt, Human
ugaggcuuuuaggauguuuaua

SEQ ID NO: 99419 - RNA, 23 nt, Human
guggaggugugggcagaggaggg

SEQ ID NO: 99420 - RNA, 22 nt, Human
uauuuucugauugauaggcuuu

SEQ ID NO: 99421 - RNA, 26 nt, Human
guuccccaggcccagugggguggccg

SEQ ID NO: 99422 - RNA, 22 nt, Human
ccuucccuccucucaccugcag

SEQ ID NO: 99423 - RNA, 23 nt, Human
gggaagagaaggggcauguggua

SEQ ID NO: 99424 - RNA, 21 nt, Human
uuacaucucuguaguuuuauu

SEQ ID NO: 99425 - RNA, 22 nt, Human
uuuuggcauucuuuucccauug

SEQ ID NO: 99426 - RNA, 26 nt, Human
aucuggaggagagaauaaugauguac

SEQ ID NO: 99427 - RNA, 27 nt, Human
cucagauucauuucaaaaggacaguga

SEQ ID NO: 99428 - RNA, 24 nt, Human
ccuggcagaggugaaggacaugga

SEQ ID NO: 99429 - RNA, 21 nt, Human
ggaucugaggcccagaguggg

SEQ ID NO: 99430 - RNA, 23 nt, Human
caucugucugucuauauuugucu

SEQ ID NO: 99431 - RNA, 20 nt, Human
auucacaucugcauucugug

SEQ ID NO: 99432 - RNA, 24 nt, Human
ucgggaggcugaggcaggagaauc

SEQ ID NO: 99433 - RNA, 23 nt, Human
cgcucgcucaaccucuuuuguuc

SEQ ID NO: 99434 - RNA, 24 nt, Human
cccggccccugagcugccuccucc

SEQ ID NO: 99435 - RNA, 24 nt, Human
gcuggggcuguauuaucagcacag

SEQ ID NO: 99436 - RNA, 24 nt, Human
guugcaagccuuugucuuacucuu

SEQ ID NO: 99437 - RNA, 20 nt, Human
gcuuucuccuguucuggacc

SEQ ID NO: 99438 - RNA, 23 nt, Human
ccccauccuccccuucccugcaa

SEQ ID NO: 99439 - RNA, 19 nt, Human
agaaaugcaaaggcucaua

SEQ ID NO: 99440 - RNA, 24 nt, Human
cacggggugucaggagggagagac

SEQ ID NO: 99441 - RNA, 25 nt, Human
ggccagaaaggcccucgaggcagag

SEQ ID NO: 99442 - RNA, 23 nt, Human
cagaagucccuucaauuucuagu

SEQ ID NO: 99443 - RNA, 27 nt, Human
cauuuauuuaaaaagauaaaacaagau

SEQ ID NO: 99444 - RNA, 27 nt, Human
uucaguuuuaagaaaacaugaaugaac

SEQ ID NO: 99445 - RNA, 24 nt, Human
gcauauaaccuuuacuuugaugga

SEQ ID NO: 99446 - RNA, 22 nt, Human
guucugacaguacgaugagcug

SEQ ID NO: 99447 - RNA, 27 nt, Human
aaagcagcuggagugaagcacucauuu

SEQ ID NO: 99448 - RNA, 24 nt, Human
uguauaugccaugcauuaccaugc

SEQ ID NO: 99449 - RNA, 25 nt, Human
gcaccaggcaggagaugcugcaggc

SEQ ID NO: 99450 - RNA, 19 nt, Human
aaccuaccugaauguauua

SEQ ID NO: 99451 - RNA, 24 nt, Human
uccauuccacacagaaugcaacca

SEQ ID NO: 99452 - RNA, 23 nt, Human
acuaggacuuggucaucaugccu

SEQ ID NO: 99453 - RNA, 24 nt, Human
ucagcauuuuucuuuagucauuua

SEQ ID NO: 99454 - RNA, 21 nt, Human
ggcucacacccccgcccacac

SEQ ID NO: 99455 - RNA, 21 nt, Human
ggacgaggcagggcgggcggg

SEQ ID NO: 99456 - RNA, 21 nt, Human
cccagcccacccugcuccucc

SEQ ID NO: 99457 - RNA, 22 nt, Human
gccuggcuucaacauugggcca

SEQ ID NO: 99458 - RNA, 29 nt, Human
gggcacagugaagaagggagcccaccacc

SEQ ID NO: 99459 - RNA, 22 nt, Human
ugacaggcuccacagagcucca

SEQ ID NO: 99460 - RNA, 20 nt, Human
ccagcacuucugcucugucg

SEQ ID NO: 99461 - RNA, 21 nt, Human
uccuaguauuuuucuuuaccu

SEQ ID NO: 99462 - RNA, 27 nt, Human
uccaugugugugccugcauuacaugug

SEQ ID NO: 99463 - RNA, 30 nt, Human
gggaggcagcagacagggagccaccagcag

SEQ ID NO: 99464 - RNA, 22 nt, Human
gcugggcaagggcugcuucggc

SEQ ID NO: 99465 - RNA, 20 nt, Human
uuaaagcucuuguagugcuu

SEQ ID NO: 99466 - RNA, 21 nt, Human
gaggccugggcccucagugga

SEQ ID NO: 99467 - RNA, 22 nt, Human
cagacguguaugcaaaugagug

SEQ ID NO: 99468 - RNA, 19 nt, Human
acacauuuuuaagaugcau

SEQ ID NO: 99469 - RNA, 31 nt, Human
cugccuccguggucccugccuggcugaggug

SEQ ID NO: 99470 - RNA, 22 nt, Human
cacgucuguaaucccagcgcuu

SEQ ID NO: 99471 - RNA, 23 nt, Human
caaaguguuagaauuacaagcau

SEQ ID NO: 99472 - RNA, 21 nt, Human
uggauuucuuuggaugcugaa

SEQ ID NO: 99473 - RNA, 24 nt, Human
uccgcuccgcccgcagugccaacc

SEQ ID NO: 99474 - RNA, 19 nt, Human
aagagccggcuggcacauu

SEQ ID NO: 99475 - RNA, 26 nt, Human
cagaaaguugaauuguuuucugccua

SEQ ID NO: 99476 - RNA, 21 nt, Human
aaggaagaggaucaccuucca

SEQ ID NO: 99477 - RNA, 27 nt, Human
ccagaaacuuguucuuccaaagcagag

SEQ ID NO: 99478 - RNA, 24 nt, Human
gugucuggaacuauugguucuaag

SEQ ID NO: 99479 - RNA, 21 nt, Human
uucuugaaagaauaacagaaa

SEQ ID NO: 99480 - RNA, 27 nt, Human
ggaaagagacuucucccauagcaaaga

SEQ ID NO: 99481 - RNA, 25 nt, Human
aguuuccaaagcuuuacuacucuua

SEQ ID NO: 99482 - RNA, 21 nt, Human
auaggaggauggaaggucugg

SEQ ID NO: 99483 - RNA, 24 nt, Human
ggcugggaucagagcaggagcauc

SEQ ID NO: 99484 - RNA, 20 nt, Human
gugaccucagcagggugggg

SEQ ID NO: 99485 - RNA, 27 nt, Human
acacuucaggaguccucagcuagugac

SEQ ID NO: 99486 - RNA, 23 nt, Human
ugcagugcuuucuuaauuuuaug

SEQ ID NO: 99487 - RNA, 24 nt, Human
ucuguguccaggcuugcuccuggc

SEQ ID NO: 99488 - RNA, 23 nt, Human
ucgccacccuccgcagccauguc

SEQ ID NO: 99489 - RNA, 23 nt, Human
aacacccucuggcuaccuaggga

SEQ ID NO: 99490 - RNA, 21 nt, Human
uccuguuagauggcaagagca

SEQ ID NO: 99491 - RNA, 23 nt, Human
gggaggagggagagggaggucac

SEQ ID NO: 99492 - RNA, 24 nt, Human
caaucagcugugggaccuuuuucc

SEQ ID NO: 99493 - RNA, 22 nt, Human
gaggggcgagcugggaggcagg

SEQ ID NO: 99494 - RNA, 22 nt, Human
gccucucuuugacaccuguuuu

SEQ ID NO: 99495 - RNA, 19 nt, Human
cacuuucucccccucugcc

SEQ ID NO: 99496 - RNA, 26 nt, Human
accaaggagcaaaaacaaauuuuaaa

SEQ ID NO: 99497 - RNA, 21 nt, Human
caacaaaucaucucgcuaaag

SEQ ID NO: 99498 - RNA, 23 nt, Human
uagauguguaaccucuucaccuu

SEQ ID NO: 99499 - RNA, 29 nt, Human
cuggcauaagauuauauaacuuaauguua

SEQ ID NO: 99500 - RNA, 26 nt, Human
gggaaagggaaaaaacagaauuguaa

SEQ ID NO: 99501 - RNA, 20 nt, Human
caagauaugcugacacuguc

SEQ ID NO: 99502 - RNA, 20 nt, Human
cacuccaguccacuccugac

SEQ ID NO: 99503 - RNA, 27 nt, Human
gccucagacuccuggguucaagcaauc

SEQ ID NO: 99504 - RNA, 27 nt, Human
uuagaaaauguguccuaucuaucuucc

SEQ ID NO: 99505 - RNA, 22 nt, Human
acuccagccugggcaacagugu

SEQ ID NO: 99506 - RNA, 22 nt, Human
ugaacuccugaccucaggugau

SEQ ID NO: 99507 - RNA, 23 nt, Human
ccgggaggcggagguugcaguga

SEQ ID NO: 99508 - RNA, 23 nt, Human
cagccaccuggagaacuucauaa

SEQ ID NO: 99509 - RNA, 24 nt, Human
gauuuuuuguuuccacuguggaaa

SEQ ID NO: 99510 - RNA, 22 nt, Human
ccccucuugcacuuucucucca

SEQ ID NO: 99511 - RNA, 26 nt, Human
ggagaaaccugagucucagagcaggg

SEQ ID NO: 99512 - RNA, 24 nt, Human
acugugucuggccagaaaaggcau

SEQ ID NO: 99513 - RNA, 26 nt, Human
augcuauacuggauacucugcuccgg

SEQ ID NO: 99514 - RNA, 21 nt, Human
acugcugcuuucccuccuggg

SEQ ID NO: 99515 - RNA, 22 nt, Human
ggaacacaaggggagucucagc

SEQ ID NO: 99516 - RNA, 23 nt, Human
ucuuccaugugaacagcauaagu

SEQ ID NO: 99517 - RNA, 22 nt, Human
acaguuucacucgaggaggcag

SEQ ID NO: 99518 - RNA, 25 nt, Human
ccugccuggcucccugccaggcucc

SEQ ID NO: 99519 - RNA, 23 nt, Human
uauuucuucucaaaccuccaaau

SEQ ID NO: 99520 - RNA, 19 nt, Human
uugguaaaauacuucuuga

SEQ ID NO: 99521 - RNA, 20 nt, Human
cucggcagguggcuguggga

SEQ ID NO: 99522 - RNA, 23 nt, Human
agugcucguauuuguauucucca

SEQ ID NO: 99523 - RNA, 22 nt, Human
cggggcugacuuugagaucuuu

SEQ ID NO: 99524 - RNA, 27 nt, Human
cugccuaaaucacuuuucucgcagaag

SEQ ID NO: 99525 - RNA, 22 nt, Human
ggcuaauuuuuggauuuuuagu

SEQ ID NO: 99526 - RNA, 27 nt, Human
cucccagcccccuccaucccaucggaa

SEQ ID NO: 99527 - RNA, 22 nt, Human
gcugggagaaagaaccggcucc

SEQ ID NO: 99528 - RNA, 24 nt, Human
agauguucuuaauccagggcuguu

SEQ ID NO: 99529 - RNA, 26 nt, Human
ccacggcacccagccuagcucucaga

SEQ ID NO: 99530 - RNA, 22 nt, Human
accugugaucccagcuacuugg

SEQ ID NO: 99531 - RNA, 27 nt, Human
ugaggccuuccagaaagcaggagcagc

SEQ ID NO: 99532 - RNA, 20 nt, Human
cccggggcugggauugcgcg

SEQ ID NO: 99533 - RNA, 23 nt, Human
aucaccauuagcaaauggaaauu

SEQ ID NO: 99534 - RNA, 19 nt, Human
gcugaauccuuucugggga

SEQ ID NO: 99535 - RNA, 21 nt, Human
uggcccccacagaaagacuga

SEQ ID NO: 99536 - RNA, 26 nt, Human
cccuugcccaugccuccagcuacaaa

SEQ ID NO: 99537 - RNA, 23 nt, Human
gcucaaccucucgugacugccug

SEQ ID NO: 99538 - RNA, 22 nt, Human
uuuucauucuuccuccucucca

SEQ ID NO: 99539 - RNA, 21 nt, Human
cccaggcugcuggagugcagu

SEQ ID NO: 99540 - RNA, 22 nt, Human
gggaccccucccugccccuggc

SEQ ID NO: 99541 - RNA, 22 nt, Human
ugaauggcuuggagugcacuga

SEQ ID NO: 99542 - RNA, 23 nt, Human
ggaggccaaacccaagaaggucu

SEQ ID NO: 99543 - RNA, 27 nt, Human
aacuguacuggaaacuguguugcucua

SEQ ID NO: 99544 - RNA, 22 nt, Human
ugaacuccuggccuuaagugau

SEQ ID NO: 99545 - RNA, 27 nt, Human
aaacucauuacuuuuccauucccaauc

SEQ ID NO: 99546 - RNA, 27 nt, Human
uuuugcugccugucucuucuccauuuu

SEQ ID NO: 99547 - RNA, 21 nt, Human
caaguugaauacauuggugca

SEQ ID NO: 99548 - RNA, 21 nt, Human
ggagguugaggcugcagugag

SEQ ID NO: 99549 - RNA, 19 nt, Human
aagaucaagaccauccugg

SEQ ID NO: 99550 - RNA, 16 nt, Human
cuucccuucuggacca

SEQ ID NO: 99551 - RNA, 28 nt, Human
agcucuugggaaggacuugcugggaggc

SEQ ID NO: 99552 - RNA, 21 nt, Human
guucuuggcauauuauuguac

SEQ ID NO: 99553 - RNA, 18 nt, Human
uagccucuguguucccgu

SEQ ID NO: 99554 - RNA, 23 nt, Human
uuaccuuucuccuucccaaaaag

SEQ ID NO: 99555 - RNA, 25 nt, Human
ugguacuuuuaugauguauauuuau

SEQ ID NO: 99556 - RNA, 22 nt, Human
ucuauaauggggaaaaaggaca

SEQ ID NO: 99557 - RNA, 23 nt, Human
cagaaccagugacuuugcugcua

SEQ ID NO: 99558 - RNA, 24 nt, Human
ugcugggcucaggccugggugcug

SEQ ID NO: 99559 - RNA, 27 nt, Human
uucuucaguccagagaauuccuccugg

SEQ ID NO: 99560 - RNA, 21 nt, Human
gcagccuccuucuccuggguc

SEQ ID NO: 99561 - RNA, 22 nt, Human
aguuccaucugcaacuuuaguu

SEQ ID NO: 99562 - RNA, 20 nt, Human
ucugagucugcuuccagaaa

SEQ ID NO: 99563 - RNA, 26 nt, Human
gucucaucucuguauucccaaaugcc

SEQ ID NO: 99564 - RNA, 25 nt, Human
agccaaauuugggucagaacacaaa

SEQ ID NO: 99565 - RNA, 23 nt, Human
cuuccaucugccugaccccuuca

SEQ ID NO: 99566 - RNA, 21 nt, Human
ucagugagccaagaucgcacc

SEQ ID NO: 99567 - RNA, 22 nt, Human
guugugcugguauuuggcucau

SEQ ID NO: 99568 - RNA, 22 nt, Human
aagaggggccaccuguucucaa

SEQ ID NO: 99569 - RNA, 18 nt, Human
uaucacagcccucuuuuc

SEQ ID NO: 99570 - RNA, 22 nt, Human
cacuuccugugugccugcaguu

SEQ ID NO: 99571 - RNA, 25 nt, Human
ucugucucccaggcugcuggagugc

SEQ ID NO: 99572 - RNA, 20 nt, Human
gaaacauuugcauauucagg

SEQ ID NO: 99573 - RNA, 22 nt, Human
aaccauggugagaaauugacga

SEQ ID NO: 99574 - RNA, 19 nt, Human
ucucucuucuucauucaua

SEQ ID NO: 99575 - RNA, 21 nt, Human
aguccauguacccuccuuccu

SEQ ID NO: 99576 - RNA, 22 nt, Human
uuaucuuguugucacagggcua

SEQ ID NO: 99577 - RNA, 28 nt, Human
gcacagcagaugaucccugagcagcuga

SEQ ID NO: 99578 - RNA, 21 nt, Human
aaaauguuuuuacaaugcuuc

SEQ ID NO: 99579 - RNA, 26 nt, Human
gcucacugugcugcuuuuccaugagc

SEQ ID NO: 99580 - RNA, 26 nt, Human
ugucauggaccagugagcuggagaug

SEQ ID NO: 99581 - RNA, 27 nt, Human
augagaaggcagccaccagcgaaugcu

SEQ ID NO: 99582 - RNA, 27 nt, Human
gccuuucuucccuccgcgacccgggcc

SEQ ID NO: 99583 - RNA, 22 nt, Human
gagaccucgucucuacaaaaaa

SEQ ID NO: 99584 - RNA, 22 nt, Human
cagccccucgucgcggguucag

SEQ ID NO: 99585 - RNA, 22 nt, Human
gcaguccaagaggcccagaagc

SEQ ID NO: 99586 - RNA, 22 nt, Human
gauuuaucuccuccuguccccc

SEQ ID NO: 99587 - RNA, 22 nt, Human
gacauuuucuggauucugggag

SEQ ID NO: 99588 - RNA, 23 nt, Human
caugugcucccugucauuguucc

SEQ ID NO: 99589 - RNA, 26 nt, Human
ccagggucuuugccucuaucuguggu

SEQ ID NO: 99590 - RNA, 26 nt, Human
caggagguggugggcucgcaggaagg

SEQ ID NO: 99591 - RNA, 27 nt, Human
auuugggcccugugcugccugccucau

SEQ ID NO: 99592 - RNA, 23 nt, Human
cccugaagauuucagaggcugca

SEQ ID NO: 99593 - RNA, 23 nt, Human
cugagaaugaaaagaauguaaca

SEQ ID NO: 99594 - RNA, 18 nt, Human
uagaaaacauagcuucuu

SEQ ID NO: 99595 - RNA, 22 nt, Human
gucucgaacuccuggccucagg

SEQ ID NO: 99596 - RNA, 21 nt, Human
uagacugcguaagaagaaaua

SEQ ID NO: 99597 - RNA, 27 nt, Human
uugucccaaacccuucuuguucucucc

SEQ ID NO: 99598 - RNA, 25 nt, Human
agggaaaguaaaggguuuaaaggaa

SEQ ID NO: 99599 - RNA, 23 nt, Human
uccuugcccuagaugagcccagc

SEQ ID NO: 99600 - RNA, 24 nt, Human
acuuaacauguugagucucugaga

SEQ ID NO: 99601 - RNA, 27 nt, Human
gccuaaaccagugucuacgcaggcgga

SEQ ID NO: 99602 - RNA, 21 nt, Human
gccuguagucccagcacuuug

SEQ ID NO: 99603 - RNA, 21 nt, Human
gccuguaaucccagcgcuuug

SEQ ID NO: 99604 - RNA, 23 nt, Human
acaaaccauuaugauuuaugcua

SEQ ID NO: 99605 - RNA, 22 nt, Human
aacuguacuguuuucugggcca

SEQ ID NO: 99606 - RNA, 22 nt, Human
gcuaagcuacugcuguucuucu

SEQ ID NO: 99607 - RNA, 29 nt, Human
cacagccuccccacccaggaugaccccug

SEQ ID NO: 99608 - RNA, 27 nt, Human
guggaaagaggaggaugcuguuuaucu

SEQ ID NO: 99609 - RNA, 27 nt, Human
ugauggccagggugggguguccagcac

SEQ ID NO: 99610 - RNA, 20 nt, Human
cagggacuggcuucucuuuc

SEQ ID NO: 99611 - RNA, 23 nt, Human
ugucaccgaggcuggagugcagu

SEQ ID NO: 99612 - RNA, 21 nt, Human
cauuaaacugaaccuuuuacu

SEQ ID NO: 99613 - RNA, 27 nt, Human
gccgggccuggccagagaagcaacaca

SEQ ID NO: 99614 - RNA, 25 nt, Human
ggaggcggaggcugcagucaaccaa

SEQ ID NO: 99615 - RNA, 21 nt, Human
aguuugaacccuugucaaugc

SEQ ID NO: 99616 - RNA, 24 nt, Human
cugcuuugcacuaucguuugcuug

SEQ ID NO: 99617 - RNA, 22 nt, Human
cagagccggugccaucuguggg

SEQ ID NO: 99618 - RNA, 22 nt, Human
ucgcccaggcuggagugcaggg

SEQ ID NO: 99619 - RNA, 26 nt, Human
uuaugcuguuauuacaggagaaguga

SEQ ID NO: 99620 - RNA, 24 nt, Human
ggcacccuggcuggcugcaagcag

SEQ ID NO: 99621 - RNA, 21 nt, Human
gggaggcagagcuugcaguga

SEQ ID NO: 99622 - RNA, 23 nt, Human
uacccuuuguugucuugcuguug

SEQ ID NO: 99623 - RNA, 19 nt, Human
cugcccaccaguuguucuc

SEQ ID NO: 99624 - RNA, 18 nt, Human
gggaaagacauagaagaa

SEQ ID NO: 99625 - RNA, 20 nt, Human
gccgcucgcucucccccucg

SEQ ID NO: 99626 - RNA, 22 nt, Human
ucaccugcuggagucuucggug

SEQ ID NO: 99627 - RNA, 24 nt, Human
gcauaccgaaauaaaagcaauuca

SEQ ID NO: 99628 - RNA, 23 nt, Human
uaagaaaacucuuagcugaaaug

SEQ ID NO: 99629 - RNA, 21 nt, Human
cuggggaaggcaggaggcaga

SEQ ID NO: 99630 - RNA, 21 nt, Human
uucuaaacugaccuuuccccg

SEQ ID NO: 99631 - RNA, 19 nt, Human
ccugguguguuuccagauc

SEQ ID NO: 99632 - RNA, 21 nt, Human
gccucucucaguucugggagg

SEQ ID NO: 99633 - RNA, 26 nt, Human
guccccggacuggagaagacgcgggu

SEQ ID NO: 99634 - RNA, 22 nt, Human
ucuccucccuuucuucccuaca

SEQ ID NO: 99635 - RNA, 22 nt, Human
gaacucgggaggcagagguugc

SEQ ID NO: 99636 - RNA, 20 nt, Human
ggggaugugagcaaaauucg

SEQ ID NO: 99637 - RNA, 20 nt, Human
aacuaaggauuuuucaagag

SEQ ID NO: 99638 - RNA, 22 nt, Human
cgguuuguuuuuauuuaucucu

SEQ ID NO: 99639 - RNA, 20 nt, Human
gcugcagccacuuucugcca

SEQ ID NO: 99640 - RNA, 22 nt, Human
gccagccacauccaacccccca

SEQ ID NO: 99641 - RNA, 27 nt, Human
ggucucgaacuccugaccucgugauuu

SEQ ID NO: 99642 - RNA, 20 nt, Human
ucugucugucugugggcuuc

SEQ ID NO: 99643 - RNA, 27 nt, Human
gugaggguggcacauggaacuucacgg

SEQ ID NO: 99644 - RNA, 22 nt, Human
uaagaagugaccauuauacugu

SEQ ID NO: 99645 - RNA, 26 nt, Human
gcuugcuuuugaaccugcagcaacua

SEQ ID NO: 99646 - RNA, 21 nt, Human
uuucuggcuacagcaggacag

SEQ ID NO: 99647 - RNA, 20 nt, Human
gccucuguauuuguuuccua

SEQ ID NO: 99648 - RNA, 24 nt, Human
uuuucagguaaaccucagcucagg

SEQ ID NO: 99649 - RNA, 30 nt, Human
cccucuccaucucccaaggcugccagacau

SEQ ID NO: 99650 - RNA, 26 nt, Human
cccaaguagcugagacugcaggcacg

SEQ ID NO: 99651 - RNA, 22 nt, Human
cgccgcugagccaagugggcca

SEQ ID NO: 99652 - RNA, 20 nt, Human
ggcugagaagggaccaggga

SEQ ID NO: 99653 - RNA, 20 nt, Human
uccauucucaccuauccaca

SEQ ID NO: 99654 - RNA, 22 nt, Human
aaaauguucugacagcauuuca

SEQ ID NO: 99655 - RNA, 20 nt, Human
ugcgcagggccaagugccca

SEQ ID NO: 99656 - RNA, 21 nt, Human
ccccgcucucccugucacgcu

SEQ ID NO: 99657 - RNA, 23 nt, Human
cugcuggaauuugcugugcagag

SEQ ID NO: 99658 - RNA, 26 nt, Human
cuacacugcuauggaaacuuagcuuc

SEQ ID NO: 99659 - RNA, 27 nt, Human
gaugccuucgacaaaccagagaagcca

SEQ ID NO: 99660 - RNA, 21 nt, Human
cuaaaucaaggaccucagccu

SEQ ID NO: 99661 - RNA, 24 nt, Human
agccccaucagaaccugagcuauu

SEQ ID NO: 99662 - RNA, 20 nt, Human
cccagaccucugucuugcau

SEQ ID NO: 99663 - RNA, 21 nt, Human
cugagaacuggacaguggcag

SEQ ID NO: 99664 - RNA, 20 nt, Human
ccacagucuuuaccguuuua

SEQ ID NO: 99665 - RNA, 20 nt, Human
gcuccaccugcaucuucuca

SEQ ID NO: 99666 - RNA, 26 nt, Human
uugcucugucgcccaggcuggagugc

SEQ ID NO: 99667 - RNA, 22 nt, Human
auugucauaaaauauuguauga

SEQ ID NO: 99668 - RNA, 29 nt, Human
uguguuaucaaggaauuguacugugcuac

SEQ ID NO: 99669 - RNA, 22 nt, Human
gcauuucucuucucagcucuuc

SEQ ID NO: 99670 - RNA, 22 nt, Human
cuguggcucaguuugccuuccu

SEQ ID NO: 99671 - RNA, 22 nt, Human
ggcggaaaccuugcagcauuuu

SEQ ID NO: 99672 - RNA, 26 nt, Human
uacccucccuuccucacauuguuacg

SEQ ID NO: 99673 - RNA, 20 nt, Human
uugguuccuggcuucuggga

SEQ ID NO: 99674 - RNA, 28 nt, Human
cacauacauaccuauauacucacuuucu

SEQ ID NO: 99675 - RNA, 22 nt, Human
cggcacccaugcuuucuuugag

SEQ ID NO: 99676 - RNA, 23 nt, Human
ggcagguggggaagcaguuuggc

SEQ ID NO: 99677 - RNA, 21 nt, Human
gacgggcacagugagagcagc

SEQ ID NO: 99678 - RNA, 22 nt, Human
cuccugggucagacuccugggu

SEQ ID NO: 99679 - RNA, 22 nt, Human
ggucgggcagccagcagagggg

SEQ ID NO: 99680 - RNA, 27 nt, Human
agccaagaacacccuuucuuuguucca

SEQ ID NO: 99681 - RNA, 19 nt, Human
ucccucgggcccgagcgca

SEQ ID NO: 99682 - RNA, 23 nt, Human
aagaagggcuagaaccuggaggg

SEQ ID NO: 99683 - RNA, 21 nt, Human
gcaggauguuagggcagcagc

SEQ ID NO: 99684 - RNA, 22 nt, Human
gagaagcagcaauaagcauuag

SEQ ID NO: 99685 - RNA, 26 nt, Human
caacagcaacaaugccuuugcaggca

SEQ ID NO: 99686 - RNA, 23 nt, Human
uagcggggagagcacgggguagc

SEQ ID NO: 99687 - RNA, 23 nt, Human
aggaacuggaugggcugcaguga

SEQ ID NO: 99688 - RNA, 22 nt, Human
aaggugagguggugaaguggcc

SEQ ID NO: 99689 - RNA, 21 nt, Human
ugaaggaaaggaauugagaga

SEQ ID NO: 99690 - RNA, 25 nt, Human
uuccugcacaaugggaagaggagaa

SEQ ID NO: 99691 - RNA, 22 nt, Human
gaucugucuuaugccauaaucu

SEQ ID NO: 99692 - RNA, 22 nt, Human
ucugcccugcccucagccuguu

SEQ ID NO: 99693 - RNA, 22 nt, Human
cagugguuuuuaaacaaagcug

SEQ ID NO: 99694 - RNA, 20 nt, Human
aauccucgucugaaucaucc

SEQ ID NO: 99695 - RNA, 26 nt, Human
gcggccgccuccgcccucucugcugc

SEQ ID NO: 99696 - RNA, 21 nt, Human
gaagaacugguucuguggaau

SEQ ID NO: 99697 - RNA, 22 nt, Human
ggaggugggacugaggagcgac

SEQ ID NO: 99698 - RNA, 22 nt, Human
ccaggcgguggacagaugggua

SEQ ID NO: 99699 - RNA, 21 nt, Human
acuacagaccacagcauucag

SEQ ID NO: 99700 - RNA, 18 nt, Human
caguuuuaguuggugcug

SEQ ID NO: 99701 - RNA, 21 nt, Human
gccugucccgcgccauggccc

SEQ ID NO: 99702 - RNA, 23 nt, Human
aucagccaggcuggagugcagug

SEQ ID NO: 99703 - RNA, 22 nt, Human
ccaauguggugaaacccugucu

SEQ ID NO: 99704 - RNA, 20 nt, Human
aaaauuucaaaacaaaaaca

SEQ ID NO: 99705 - RNA, 23 nt, Human
ugggagguguagcgcggcucuga

SEQ ID NO: 99706 - RNA, 22 nt, Human
ccugcagucugugcuguguguc

SEQ ID NO: 99707 - RNA, 26 nt, Human
ccuccaccuccuggguucaagcaauu

SEQ ID NO: 99708 - RNA, 19 nt, Human
acacaaaagcagaccugcg

SEQ ID NO: 99709 - RNA, 25 nt, Human
ugggaaaucuuguuuugccaauuuu

SEQ ID NO: 99710 - RNA, 21 nt, Human
gcagcuuccagccugggucag

SEQ ID NO: 99711 - RNA, 22 nt, Human
gagggagguauuauuauacucc

SEQ ID NO: 99712 - RNA, 25 nt, Human
ccugccuguagcccacucugcucgc

SEQ ID NO: 99713 - RNA, 24 nt, Human
guggcuuugugauugcugcccuaa

SEQ ID NO: 99714 - RNA, 21 nt, Human
aucauuucuuauaucuuauuc

SEQ ID NO: 99715 - RNA, 21 nt, Human
gcuacacugcaacuuccgucc

SEQ ID NO: 99716 - RNA, 18 nt, Human
agugacugcaagcauuuu

SEQ ID NO: 99717 - RNA, 22 nt, Human
agccuuccaaguagcugggacu

SEQ ID NO: 99718 - RNA, 22 nt, Human
agccucccaaguagcugggacc

SEQ ID NO: 99719 - RNA, 26 nt, Human
ggagagaagacgugcagggaccccgc

SEQ ID NO: 99720 - RNA, 26 nt, Human
ccugccugauucucugagcucugggc

SEQ ID NO: 99721 - RNA, 23 nt, Human
uuuuguagucuuucuuaaaacaa

SEQ ID NO: 99722 - RNA, 24 nt, Human
cagggcugacuaggguuaguuugg

SEQ ID NO: 99723 - RNA, 23 nt, Human
cgugugugaguucaccauguacu

SEQ ID NO: 99724 - RNA, 20 nt, Human
ugggggagggagagaucuga

SEQ ID NO: 99725 - RNA, 27 nt, Human
ccccugcccugggucccacuccugccc

SEQ ID NO: 99726 - RNA, 17 nt, Human
cugcuagagaaggggga

SEQ ID NO: 99727 - RNA, 21 nt, Human
uucccccagugccagccggac

SEQ ID NO: 99728 - RNA, 23 nt, Human
acugcaggauguguuuacuucuc

SEQ ID NO: 99729 - RNA, 23 nt, Human
ucugugcuccagggaaccccuuu

SEQ ID NO: 99730 - RNA, 22 nt, Human
aaacuccugaccucaagugauc

SEQ ID NO: 99731 - RNA, 27 nt, Human
ggcaacuuguacugaaaaucuggugcu

SEQ ID NO: 99732 - RNA, 23 nt, Human
ucgagcaccaccaccaccaccac

SEQ ID NO: 99733 - RNA, 27 nt, Human
aggccugcagccccacugaucaucuuc

SEQ ID NO: 99734 - RNA, 26 nt, Human
accagaucuaacaucuugaauacucu

SEQ ID NO: 99735 - RNA, 23 nt, Human
gguuuucugagaaacaaggcuuu

SEQ ID NO: 99736 - RNA, 21 nt, Human
accccccaggcugaagugcag

SEQ ID NO: 99737 - RNA, 18 nt, Human
gcagccacccugcagcca

SEQ ID NO: 99738 - RNA, 19 nt, Human
uguggggguguccaggcag

SEQ ID NO: 99739 - RNA, 23 nt, Human
ccaggaggcggagguugcaguga

SEQ ID NO: 99740 - RNA, 26 nt, Human
gguccccacagcaaagaaaaggaaua

SEQ ID NO: 99741 - RNA, 20 nt, Human
uacagcaaucuguguacuga

SEQ ID NO: 99742 - RNA, 18 nt, Human
uuggguugcagcuuauga

SEQ ID NO: 99743 - RNA, 23 nt, Human
ucaccuugccccaagcuuucccc

SEQ ID NO: 99744 - RNA, 23 nt, Human
cccaaauuuuaaucggcuccugg

SEQ ID NO: 99745 - RNA, 22 nt, Human
aucaaaauugccuuuuucucua

SEQ ID NO: 99746 - RNA, 16 nt, Human
cugcccuucugcagcc

SEQ ID NO: 99747 - RNA, 27 nt, Human
ggugaucucacaaaacugguaaguuuc

SEQ ID NO: 99748 - RNA, 20 nt, Human
aaagaacaaaacuuuugcug

SEQ ID NO: 99749 - RNA, 20 nt, Human
acaaaacguuccuggaacuc

SEQ ID NO: 99750 - RNA, 26 nt, Human
acacagaugaccucuacgggagucug

SEQ ID NO: 99751 - RNA, 19 nt, Human
caucaccucuaucugccuc

SEQ ID NO: 99752 - RNA, 22 nt, Human
caaccucucugaucuugugcuc

SEQ ID NO: 99753 - RNA, 24 nt, Human
ccuagugaccugguuggucugggc

SEQ ID NO: 99754 - RNA, 24 nt, Human
accccagcaaccauguccaaggga

SEQ ID NO: 99755 - RNA, 23 nt, Human
caugccugcaaucccagcuacuu

SEQ ID NO: 99756 - RNA, 21 nt, Human
cacaggcgaagccauuggaag

SEQ ID NO: 99757 - RNA, 26 nt, Human
cauggccuucagcccuggcugagcaa

SEQ ID NO: 99758 - RNA, 26 nt, Human
uuuccaagccucucuggcacuuugag

SEQ ID NO: 99759 - RNA, 25 nt, Human
ggccucccguccccuucccaggccu

SEQ ID NO: 99760 - RNA, 20 nt, Human
aauagggauuuaaaaaacuu

SEQ ID NO: 99761 - RNA, 27 nt, Human
auccuguuugcuauugcuuguugugcu

SEQ ID NO: 99762 - RNA, 21 nt, Human
aguguucuguuugaaacuaau

SEQ ID NO: 99763 - RNA, 25 nt, Human
uuccuuuaguuggguuuauuuccag

SEQ ID NO: 99764 - RNA, 25 nt, Human
agucaagagcuaaggagggagggag

SEQ ID NO: 99765 - RNA, 25 nt, Human
agggcagcagggagucuugaaguga

SEQ ID NO: 99766 - RNA, 28 nt, Human
cacuuucugacugcaacuucugucccuu

SEQ ID NO: 99767 - RNA, 27 nt, Human
ggagguugaagccaaguggggugcugg

SEQ ID NO: 99768 - RNA, 22 nt, Human
cagccucucuugggcuuucuua

SEQ ID NO: 99769 - RNA, 22 nt, Human
accagccucgccaacaugguga

SEQ ID NO: 99770 - RNA, 25 nt, Human
ggaugaaggacaaagaccagggcag

SEQ ID NO: 99771 - RNA, 25 nt, Human
agugaagccgagucacaggacccgg

SEQ ID NO: 99772 - RNA, 30 nt, Human
gccaucuacccuccgcuccugggcgcgcuc

SEQ ID NO: 99773 - RNA, 21 nt, Human
ccugcaggaagcugaacuuug

SEQ ID NO: 99774 - RNA, 22 nt, Human
acuaaagauugcagcauuuaug

SEQ ID NO: 99775 - RNA, 25 nt, Human
uuggggugagaggaggcccaggagg

SEQ ID NO: 99776 - RNA, 18 nt, Human
cucaggcuggagugcagu

SEQ ID NO: 99777 - RNA, 20 nt, Human
ucugugccuugccacauuaa

SEQ ID NO: 99778 - RNA, 21 nt, Human
auagcaaagaauugacugggg

SEQ ID NO: 99779 - RNA, 24 nt, Human
agcucuuaguuuuuaaaaaggccu

SEQ ID NO: 99780 - RNA, 24 nt, Human
cuccaucuaaaaucuccaaggaag

SEQ ID NO: 99781 - RNA, 23 nt, Human
ccagaaaaauuuggcaccaggca

SEQ ID NO: 99782 - RNA, 27 nt, Human
ccugcugcugucuccaguacccuccgc

SEQ ID NO: 99783 - RNA, 22 nt, Human
cuccccucaccugucgguugcc

SEQ ID NO: 99784 - RNA, 24 nt, Human
aggguccucacagauuuuuccuga

SEQ ID NO: 99785 - RNA, 22 nt, Human
uuccauagugggcucuggcuuu

SEQ ID NO: 99786 - RNA, 21 nt, Human
aaaaugcauuuaaagaaaaau

SEQ ID NO: 99787 - RNA, 22 nt, Human
uccaagcguccugcacgugucc

SEQ ID NO: 99788 - RNA, 32 nt, Human
ccuugguuuuugacuuuuucuggacccuggug

SEQ ID NO: 99789 - RNA, 22 nt, Human
gcagcauccugugagcauuucc

SEQ ID NO: 99790 - RNA, 22 nt, Human
ucauucuccuaaacugaacaca

SEQ ID NO: 99791 - RNA, 22 nt, Human
ccuccccacagauggagaaggu

SEQ ID NO: 99792 - RNA, 26 nt, Human
acaagccacuuagccaguuuuuguaa

SEQ ID NO: 99793 - RNA, 21 nt, Human
cacugcaccucugucucccaa

SEQ ID NO: 99794 - RNA, 26 nt, Human
gcaguuucccacuugccaaagauccc

SEQ ID NO: 99795 - RNA, 22 nt, Human
ucgccaggcuggagugcagugg

SEQ ID NO: 99796 - RNA, 22 nt, Human
gguugcuagcaggaaauggcag

SEQ ID NO: 99797 - RNA, 22 nt, Human
uggcccuggcuggaguucagug

SEQ ID NO: 99798 - RNA, 25 nt, Human
cccuucgacauccugcuugcucccu

SEQ ID NO: 99799 - RNA, 22 nt, Human
gcuuaucucccugcuucauauc

SEQ ID NO: 99800 - RNA, 19 nt, Human
uucaaccugugugcugcga

SEQ ID NO: 99801 - RNA, 21 nt, Human
uggcccaggcuagagugcagu

SEQ ID NO: 99802 - RNA, 22 nt, Human
cacgccuguaauucuagcacuu

SEQ ID NO: 99803 - RNA, 22 nt, Human
cacgccuguaauccuagcaccu

SEQ ID NO: 99804 - RNA, 22 nt, Human
gucacacagccugugugcagug

SEQ ID NO: 99805 - RNA, 21 nt, Human
uacuauacugaaaucugugcc

SEQ ID NO: 99806 - RNA, 27 nt, Human
aaggacugguacgguagucuguggaaa

SEQ ID NO: 99807 - RNA, 22 nt, Human
acauugcucauuucacacucuu

SEQ ID NO: 99808 - RNA, 27 nt, Human
uucuggagcauuucucuaacguuuauu

SEQ ID NO: 99809 - RNA, 22 nt, Human
acgggagccuccucugcuugca

SEQ ID NO: 99810 - RNA, 26 nt, Human
ccuuucuccuucucugaggaaauuuu

SEQ ID NO: 99811 - RNA, 26 nt, Human
ccgugauucaucuucugaagcuggga

SEQ ID NO: 99812 - RNA, 23 nt, Human
gcccaggcuauggggacaaaggc

SEQ ID NO: 99813 - RNA, 27 nt, Human
cacugccucucgcccuguaucugucaa

SEQ ID NO: 99814 - RNA, 21 nt, Human
gccaggauuucuaaugcacuc

SEQ ID NO: 99815 - RNA, 21 nt, Human
caucagcaggaguggagggug

SEQ ID NO: 99816 - RNA, 21 nt, Human
gggucgccuggcuuauuccca

SEQ ID NO: 99817 - RNA, 21 nt, Human
gcuggggucugcagugcagca

SEQ ID NO: 99818 - RNA, 21 nt, Human
acccaggcuugaggcagcggc

SEQ ID NO: 99819 - RNA, 27 nt, Human
ggaggcugagguuggaggauugcuuga

SEQ ID NO: 99820 - RNA, 24 nt, Human
cccagggcugugaaggcagagggg

SEQ ID NO: 99821 - RNA, 22 nt, Human
gcuuuucuucccagcugggccu

SEQ ID NO: 99822 - RNA, 21 nt, Human
gcacagccggcccccggccca

SEQ ID NO: 99823 - RNA, 21 nt, Human
gcacuucuauuuguuuuugug

SEQ ID NO: 99824 - RNA, 22 nt, Human
gaggaccauuggcuugccaaga

SEQ ID NO: 99825 - RNA, 18 nt, Human
uuguuuccaccuccuggg

SEQ ID NO: 99826 - RNA, 22 nt, Human
gugugcaugcuccuacacaaua

SEQ ID NO: 99827 - RNA, 27 nt, Human
cugcgccuccugucauuucccugcugg

SEQ ID NO: 99828 - RNA, 22 nt, Human
ucacccagguucgaguucagug

SEQ ID NO: 99829 - RNA, 26 nt, Human
gcucacugcccagccggggccccggg

SEQ ID NO: 99830 - RNA, 22 nt, Human
cuggggguggcagacgagccca

SEQ ID NO: 99831 - RNA, 27 nt, Human
caccacugcucuccagccuggcgacag

SEQ ID NO: 99832 - RNA, 26 nt, Human
gcuacugccacuaggcagcuagccca

SEQ ID NO: 99833 - RNA, 22 nt, Human
aagaacauuaagaaugagaugc

SEQ ID NO: 99834 - RNA, 22 nt, Human
agacgaaacacaaacugaagua

SEQ ID NO: 99835 - RNA, 20 nt, Human
ccuaccugcgugaggauugg

SEQ ID NO: 99836 - RNA, 27 nt, Human
gcgggccgcucaccugacauguggacc

SEQ ID NO: 99837 - RNA, 22 nt, Human
guaauggccccaccucuguuau

SEQ ID NO: 99838 - RNA, 27 nt, Human
gccuuucuggcccaccuggacagugca

SEQ ID NO: 99839 - RNA, 26 nt, Human
ccuuccuucugcucccaccccagaaa

SEQ ID NO: 99840 - RNA, 26 nt, Human
ucuuugugcucucuuuguuuuuucuu

SEQ ID NO: 99841 - RNA, 23 nt, Human
aaguccagcagacugugcaugcu

SEQ ID NO: 99842 - RNA, 27 nt, Human
ggcucacugcaacccccaucucccagg

SEQ ID NO: 99843 - RNA, 19 nt, Human
cacugcacugagcacuuua

SEQ ID NO: 99844 - RNA, 18 nt, Human
cacacuggcgcccaguaa

SEQ ID NO: 99845 - RNA, 19 nt, Human
gggaaauucagcuuuugca

SEQ ID NO: 99846 - RNA, 30 nt, Human
ccuauuuuucccuguucccuggugccacag

SEQ ID NO: 99847 - RNA, 22 nt, Human
ugucuucaagcauugaccaagu

SEQ ID NO: 99848 - RNA, 22 nt, Human
uccuccucaaaaacugauucag

SEQ ID NO: 99849 - RNA, 21 nt, Human
gccccaggcccuuccccaccg

SEQ ID NO: 99850 - RNA, 21 nt, Human
guggccuuucguacagugggu

SEQ ID NO: 99851 - RNA, 23 nt, Human
cugcuucaugacgaugcugccug

SEQ ID NO: 99852 - RNA, 20 nt, Human
cuuaaagcacacaguucugg

SEQ ID NO: 99853 - RNA, 21 nt, Human
cuuggagugcugcagcuuugg

SEQ ID NO: 99854 - RNA, 21 nt, Human
ccaacuccaguaccuggagcu

SEQ ID NO: 99855 - RNA, 20 nt, Human
ggcagcccaagguugcaugg

SEQ ID NO: 99856 - RNA, 19 nt, Human
ucgaugaucaccaagcagg

SEQ ID NO: 99857 - RNA, 23 nt, Human
gagccagcugagcccgagcccag

SEQ ID NO: 99858 - RNA, 22 nt, Human
gcugaggugggaggacugcuua

SEQ ID NO: 99859 - RNA, 22 nt, Human
gcccaggcuggagugcagugcc

SEQ ID NO: 99860 - RNA, 24 nt, Human
gccugggcucccccucucugugcc

SEQ ID NO: 99861 - RNA, 24 nt, Human
uguugccagagcuggcagugugag

SEQ ID NO: 99862 - RNA, 23 nt, Human
aaggaagacccaggaaaggugug

SEQ ID NO: 99863 - RNA, 28 nt, Human
uaguuucuucccagacaugaauuuccug

SEQ ID NO: 99864 - RNA, 26 nt, Human
caagggcagguuucuggagacucccu

SEQ ID NO: 99865 - RNA, 26 nt, Human
uugagauggagucucucucugucacc

SEQ ID NO: 99866 - RNA, 28 nt, Human
uuuguagacucauuguuauuuuucaauc

SEQ ID NO: 99867 - RNA, 19 nt, Human
auugguauauuuuuacuua

SEQ ID NO: 99868 - RNA, 26 nt, Human
acccuugccaugugcuaguaauugga

SEQ ID NO: 99869 - RNA, 22 nt, Human
ccaccaguccccuuacagcccu

SEQ ID NO: 99870 - RNA, 23 nt, Human
gaguucauggagagagcaugugu

SEQ ID NO: 99871 - RNA, 25 nt, Human
cuguaaucuuaaccaagaaauugaa

SEQ ID NO: 99872 - RNA, 22 nt, Human
ucguuggugccaucagugauuu

SEQ ID NO: 99873 - RNA, 21 nt, Human
ucauuucuugggcccuccuga

SEQ ID NO: 99874 - RNA, 21 nt, Human
caguauuucaagacugccuuu

SEQ ID NO: 99875 - RNA, 23 nt, Human
agacauuaacucauuagacugga

SEQ ID NO: 99876 - RNA, 26 nt, Human
ggagucugacagggucaccuccucca

SEQ ID NO: 99877 - RNA, 22 nt, Human
gaccaguccugccucuguugua

SEQ ID NO: 99878 - RNA, 23 nt, Human
uauauuuggaaagagaccagcac

SEQ ID NO: 99879 - RNA, 20 nt, Human
caagccccacccuccuugag

SEQ ID NO: 99880 - RNA, 21 nt, Human
agucuaaaccuuucugauccu

SEQ ID NO: 99881 - RNA, 25 nt, Human
ugacuugaugguugccaaaucccuu

SEQ ID NO: 99882 - RNA, 25 nt, Human
agcugguuagaaaugcagaauccua

SEQ ID NO: 99883 - RNA, 27 nt, Human
aggaccaggaagagaggaacucggagg

SEQ ID NO: 99884 - RNA, 21 nt, Human
gggagggaauugagagucaca

SEQ ID NO: 99885 - RNA, 19 nt, Human
ugagugugugugagguaua

SEQ ID NO: 99886 - RNA, 22 nt, Human
guccugagcccuucugcguugu

SEQ ID NO: 99887 - RNA, 20 nt, Human
ccccccagcagacaauggcc

SEQ ID NO: 99888 - RNA, 23 nt, Human
ggccccucucuccucccaccugg

SEQ ID NO: 99889 - RNA, 21 nt, Human
cccaaggcauguuuugcccac

SEQ ID NO: 99890 - RNA, 22 nt, Human
gaaaaccauuaguuugcuguua

SEQ ID NO: 99891 - RNA, 28 nt, Human
uugguauaaauucauaauuucuaaacca

SEQ ID NO: 99892 - RNA, 23 nt, Human
gccagugcacagggaagggcuug

SEQ ID NO: 99893 - RNA, 25 nt, Human
ugaguguccaucuacauucugcugc

SEQ ID NO: 99894 - RNA, 24 nt, Human
cugcugugggaagacugugcaaug

SEQ ID NO: 99895 - RNA, 23 nt, Human
aaguuucuuugaaaauaguuauu

SEQ ID NO: 99896 - RNA, 26 nt, Human
cacugcucagugcaaccucugccucc

SEQ ID NO: 99897 - RNA, 19 nt, Human
uagaaaguuugugcacauu

SEQ ID NO: 99898 - RNA, 21 nt, Human
cagucuaagcaacauaaugag

SEQ ID NO: 99899 - RNA, 20 nt, Human
uuggcugcucuccaucucuu

SEQ ID NO: 99900 - RNA, 22 nt, Human
ccgaggcaaagagaaaagccac

SEQ ID NO: 99901 - RNA, 22 nt, Human
agucucccaaguagcugggauu

SEQ ID NO: 99902 - RNA, 20 nt, Human
guggcugaguagcucugccu

SEQ ID NO: 99903 - RNA, 26 nt, Human
gcagccccaaaccccaggacccuauc

SEQ ID NO: 99904 - RNA, 21 nt, Human
gugcucacaguguggcuggga

SEQ ID NO: 99905 - RNA, 25 nt, Human
uguuuccuccccucaaaguucugcc

SEQ ID NO: 99906 - RNA, 26 nt, Human
cugcuugggccgcgagggaaggugag

SEQ ID NO: 99907 - RNA, 24 nt, Human
ccguccugcugaugugguaggcua

SEQ ID NO: 99908 - RNA, 23 nt, Human
guaaguuucaggugacaugugaa

SEQ ID NO: 99909 - RNA, 27 nt, Human
cucacuguucccucugcuccuggagcc

SEQ ID NO: 99910 - RNA, 26 nt, Human
caccccacuccagccucgaggaagcu

SEQ ID NO: 99911 - RNA, 24 nt, Human
acccugugguccugauagcuccug

SEQ ID NO: 99912 - RNA, 19 nt, Human
ggaaugagagaaccgagga

SEQ ID NO: 99913 - RNA, 21 nt, Human
cauggggcagaggcuuccgug

SEQ ID NO: 99914 - RNA, 27 nt, Human
cucauuucuuccuucuagaacacagaa

SEQ ID NO: 99915 - RNA, 20 nt, Human
ggcaaagcgugucccauaga

SEQ ID NO: 99916 - RNA, 25 nt, Human
acccaggcuggaaugcaguggcaca

SEQ ID NO: 99917 - RNA, 21 nt, Human
cuuggaauucuuagucacaaa

SEQ ID NO: 99918 - RNA, 20 nt, Human
cagcccagcccccaccuuug

SEQ ID NO: 99919 - RNA, 19 nt, Human
uguaugugucugugugucu

SEQ ID NO: 99920 - RNA, 21 nt, Human
guacccaagcaugguccugaa

SEQ ID NO: 99921 - RNA, 22 nt, Human
gugugagacccugucucaaaaa

SEQ ID NO: 99922 - RNA, 21 nt, Human
ucugccucugacucgcugugu

SEQ ID NO: 99923 - RNA, 23 nt, Human
uuuccacugcuguggaaaccucc

SEQ ID NO: 99924 - RNA, 20 nt, Human
acagggcuggagaguacuuu

SEQ ID NO: 99925 - RNA, 27 nt, Human
cuaccugcacacccaccagaagagcac

SEQ ID NO: 99926 - RNA, 27 nt, Human
ucagagcaaauuuggggguuucucaaa

SEQ ID NO: 99927 - RNA, 24 nt, Human
guggcacagggcccugcccgucac

SEQ ID NO: 99928 - RNA, 26 nt, Human
aguuauuuuauaaucaaugaauuugu

SEQ ID NO: 99929 - RNA, 24 nt, Human
ugcuguugccgaauacucaggacg

SEQ ID NO: 99930 - RNA, 27 nt, Human
acuccugaaaugccaagugccugcuua

SEQ ID NO: 99931 - RNA, 21 nt, Human
ggaccuccauuccacucaucu

SEQ ID NO: 99932 - RNA, 22 nt, Human
gucugcugcccuccuccuggcc

SEQ ID NO: 99933 - RNA, 32 nt, Human
ggagagagaaaggggcauugacugggacccac

SEQ ID NO: 99934 - RNA, 26 nt, Human
aaacugacauggcuaacugcaagaau

SEQ ID NO: 99935 - RNA, 19 nt, Human
ucuuccccucuccucggcc

SEQ ID NO: 99936 - RNA, 28 nt, Human
caguaccuagcuggcucugugagggugc

SEQ ID NO: 99937 - RNA, 25 nt, Human
ucuggaggcagacagggugggcugg

SEQ ID NO: 99938 - RNA, 26 nt, Human
cauugaacauuccagaugugugagau

SEQ ID NO: 99939 - RNA, 25 nt, Human
gccauugcaacuucuuuuucuucag

SEQ ID NO: 99940 - RNA, 25 nt, Human
ccugccuguugccucuugugagcuc

SEQ ID NO: 99941 - RNA, 18 nt, Human
ccaacagcaacacagcca

SEQ ID NO: 99942 - RNA, 18 nt, Human
ccacuaaguaucuuguua

SEQ ID NO: 99943 - RNA, 21 nt, Human
uaaagacugagcagaacugaa

SEQ ID NO: 99944 - RNA, 22 nt, Human
gcccaggcuggaguacaauggu

SEQ ID NO: 99945 - RNA, 22 nt, Human
aaagugcugagauuacagacau

SEQ ID NO: 99946 - RNA, 27 nt, Human
auagcagcgggcgggcacuuugcacug

SEQ ID NO: 99947 - RNA, 23 nt, Human
gucuaacugucagaguuguugca

SEQ ID NO: 99948 - RNA, 22 nt, Human
ugcaguauuuaagaaaaugaca

SEQ ID NO: 99949 - RNA, 24 nt, Human
gaaaaucuuguguaaauccugcca

SEQ ID NO: 99950 - RNA, 26 nt, Human
ugaccggggcagggaucgacaggcac

SEQ ID NO: 99951 - RNA, 19 nt, Human
ccuugugccaguccugguc

SEQ ID NO: 99952 - RNA, 22 nt, Human
gaccccgccagccccggucucu

SEQ ID NO: 99953 - RNA, 27 nt, Human
cuuccuucccuucccuguccuggguca

SEQ ID NO: 99954 - RNA, 20 nt, Human
cuuaauccaugagcauugga

SEQ ID NO: 99955 - RNA, 24 nt, Human
uucccagaccuccuuaucuauuuu

SEQ ID NO: 99956 - RNA, 26 nt, Human
gagcuuaggacucggaagcggccggg

SEQ ID NO: 99957 - RNA, 24 nt, Human
uggcuucucaggagaguguggcua

SEQ ID NO: 99958 - RNA, 21 nt, Human
ucacugcaacuuccaccucug

SEQ ID NO: 99959 - RNA, 24 nt, Human
uccagcacuggugaacugagcugg

SEQ ID NO: 99960 - RNA, 23 nt, Human
gcuuuaaucuuucugucauuuaa

SEQ ID NO: 99961 - RNA, 19 nt, Human
aauuuagcuugucuuucug

SEQ ID NO: 99962 - RNA, 22 nt, Human
ccuguggcccuggcucugcugu

SEQ ID NO: 99963 - RNA, 25 nt, Human
cugccuucuuccuccacuuguguca

SEQ ID NO: 99964 - RNA, 22 nt, Human
caggaccugcugugugaaaucg

SEQ ID NO: 99965 - RNA, 25 nt, Human
gaggacguggugacuuccugaacau

SEQ ID NO: 99966 - RNA, 22 nt, Human
caggaaguggagacugcaguga

SEQ ID NO: 99967 - RNA, 25 nt, Human
gaccauaaguuuacugaaucuucaa

SEQ ID NO: 99968 - RNA, 21 nt, Human
ccugggcuuaggguggagaug

SEQ ID NO: 99969 - RNA, 19 nt, Human
ccaggcugcccacucuggg

SEQ ID NO: 99970 - RNA, 25 nt, Human
uccuggauuuagaacauggacuaca

SEQ ID NO: 99971 - RNA, 24 nt, Human
cuaguuccuuccuuugauucuccu

SEQ ID NO: 99972 - RNA, 22 nt, Human
auggcuauaaucccagguacuu

SEQ ID NO: 99973 - RNA, 20 nt, Human
ggcccucgggaacccacuca

SEQ ID NO: 99974 - RNA, 27 nt, Human
cugggcaacaagagugaaacuccaucu

SEQ ID NO: 99975 - RNA, 31 nt, Human
ccuagacuuugcuuccaaugguuucuuccag

SEQ ID NO: 99976 - RNA, 27 nt, Human
cuggacuugccuccagagacugcucca

SEQ ID NO: 99977 - RNA, 25 nt, Human
accucuaguuugaacuagcuggaau

SEQ ID NO: 99978 - RNA, 19 nt, Human
cugggccucaguucaaccu

SEQ ID NO: 99979 - RNA, 20 nt, Human
auacaaaauauaauucuuua

SEQ ID NO: 99980 - RNA, 29 nt, Human
acugauuaaaaugucaauguaaucuaaaa

SEQ ID NO: 99981 - RNA, 22 nt, Human
accauuucuucucccugucucc

SEQ ID NO: 99982 - RNA, 20 nt, Human
aagagggagagaggggaggc

SEQ ID NO: 99983 - RNA, 23 nt, Human
gccccaggcuccccgcagcugcc

SEQ ID NO: 99984 - RNA, 27 nt, Human
gagacagggaagaccggggcccuccuc

SEQ ID NO: 99985 - RNA, 23 nt, Human
uuuuguguagacacagguugcag

SEQ ID NO: 99986 - RNA, 21 nt, Human
aaaguuuaaaaauuagcuugg

SEQ ID NO: 99987 - RNA, 25 nt, Human
ugacuucuuucaccuccaaaauucc

SEQ ID NO: 99988 - RNA, 21 nt, Human
gccccgaauggagugcccagg

SEQ ID NO: 99989 - RNA, 24 nt, Human
caucaccacggcucacugcagccu

SEQ ID NO: 99990 - RNA, 25 nt, Human
cucuggcuucucucuugaaugcuca

SEQ ID NO: 99991 - RNA, 27 nt, Human
gggccugggagggaggagcuuggugca

SEQ ID NO: 99992 - RNA, 22 nt, Human
aggcugccuccagccagccuuu

SEQ ID NO: 99993 - RNA, 27 nt, Human
gaccauccuggccaacauuguaaaacc

SEQ ID NO: 99994 - RNA, 24 nt, Human
cugaggcagggggauuugguagga

SEQ ID NO: 99995 - RNA, 22 nt, Human
cauugcacuccagccugggaaa

SEQ ID NO: 99996 - RNA, 28 nt, Human
cuguuaacccuccaccuccucucuugga

SEQ ID NO: 99997 - RNA, 26 nt, Human
ucucauugcccaggcuggagugcagu

SEQ ID NO: 99998 - RNA, 27 nt, Human
uggcagggaucuuucuggaggaaaagc

SEQ ID NO: 99999 - RNA, 22 nt, Human
ucuuucuccuucaaacuugcuc

SEQ ID NO: 100000 - RNA, 26 nt, Human
gguauggaaucugagggaagauuuau

SEQ ID NO: 100001 - RNA, 26 nt, Human
cauggccgccgguacugcagcugccu

SEQ ID NO: 100002 - RNA, 24 nt, Human
caggaaauuacugcccacuuguca

SEQ ID NO: 100003 - RNA, 25 nt, Human
cccucaccuccucuaagguugggca

SEQ ID NO: 100004 - RNA, 21 nt, Human
ugugagccaccgugccuggcc

SEQ ID NO: 100005 - RNA, 19 nt, Human
cuccacccuccagcauguu

SEQ ID NO: 100006 - RNA, 28 nt, Human
ccacuccaggaacccagagccacauuag

SEQ ID NO: 100007 - RNA, 24 nt, Human
gggagguucacauguuugcaguga

SEQ ID NO: 100008 - RNA, 24 nt, Human
aggugcgugccaccacaccaggcu

SEQ ID NO: 100009 - RNA, 21 nt, Human
cguuaaggcuggaggcacaug

SEQ ID NO: 100010 - RNA, 22 nt, Human
caacguaguaaaaccucaucua

SEQ ID NO: 100011 - RNA, 25 nt, Human
acugucacccaggcuggagugcagu

SEQ ID NO: 100012 - RNA, 22 nt, Human
ccaacguuaaaagacaguggau

SEQ ID NO: 100013 - RNA, 27 nt, Human
acaauuccuuccaauuucugcggcucc

SEQ ID NO: 100014 - RNA, 27 nt, Human
caaugauucuacuuccugggcuaucac

SEQ ID NO: 100015 - RNA, 27 nt, Human
caaaacaacacaaaagcccaccaggcu

SEQ ID NO: 100016 - RNA, 22 nt, Human
cagcuccgccuuucuugcucug

SEQ ID NO: 100017 - RNA, 22 nt, Human
gggauuacaggcgugagccacu

SEQ ID NO: 100018 - RNA, 22 nt, Human
gggauuacaggcgcgagccacc

SEQ ID NO: 100019 - RNA, 25 nt, Human
aacaucaguguccuucuagcuuuag

SEQ ID NO: 100020 - RNA, 22 nt, Human
aacuguauaaaugaauguagag

SEQ ID NO: 100021 - RNA, 22 nt, Human
ccccgccuccucccacugggac

SEQ ID NO: 100022 - RNA, 25 nt, Human
gccaguauccagcaguaucuggacc

SEQ ID NO: 100023 - RNA, 21 nt, Human
gagucucagauccagaaggag

SEQ ID NO: 100024 - RNA, 19 nt, Human
cuuuucccuaccucuguca

SEQ ID NO: 100025 - RNA, 23 nt, Human
ucuccuccccuuauucccgaggc

SEQ ID NO: 100026 - RNA, 21 nt, Human
uuuuggggguacuuagcuucc

SEQ ID NO: 100027 - RNA, 20 nt, Human
aaguuaagggauuugcugaa

SEQ ID NO: 100028 - RNA, 22 nt, Human
gucuucucucaauuacauagca

SEQ ID NO: 100029 - RNA, 24 nt, Human
gcagugagcuauggacuuucuucc

SEQ ID NO: 100030 - RNA, 21 nt, Human
uugcaauuauuuguuuuucua

SEQ ID NO: 100031 - RNA, 20 nt, Human
uccccuggcaauucuugauc

SEQ ID NO: 100032 - RNA, 26 nt, Human
gacuauacauuugcuacuggugauuc

SEQ ID NO: 100033 - RNA, 23 nt, Human
ugcgcccaggcugguaugcaguc

SEQ ID NO: 100034 - RNA, 22 nt, Human
uccuguaaucccaacacugugg

SEQ ID NO: 100035 - RNA, 21 nt, Human
cacugcugcaaaccuuaguua

SEQ ID NO: 100036 - RNA, 29 nt, Human
cuuccuaccccacucuccccguccccuuu

SEQ ID NO: 100037 - RNA, 22 nt, Human
ggucucgaacuccuggccucag

SEQ ID NO: 100038 - RNA, 22 nt, Human
aguuuccugaaacaacuggaaa

SEQ ID NO: 100039 - RNA, 21 nt, Human
guaauuccuuauggaucuuuu

SEQ ID NO: 100040 - RNA, 23 nt, Human
uguuuuguuaauuuauguuuuuc

SEQ ID NO: 100041 - RNA, 25 nt, Human
gcugcuucccucugccugucccucu

SEQ ID NO: 100042 - RNA, 22 nt, Human
uuuucauuccuucucccuaucu

SEQ ID NO: 100043 - RNA, 21 nt, Human
ccuccccucccaccugccccu

SEQ ID NO: 100044 - RNA, 24 nt, Human
ggugcucggcucccucccaccuag

SEQ ID NO: 100045 - RNA, 22 nt, Human
aaaguuugaguguuacaggcuc

SEQ ID NO: 100046 - RNA, 20 nt, Human
cuucccuucucgcuugggaa

SEQ ID NO: 100047 - RNA, 22 nt, Human
aacacccugcuucucccgggga

SEQ ID NO: 100048 - RNA, 19 nt, Human
ucgugcucaucugcagccu

SEQ ID NO: 100049 - RNA, 22 nt, Human
gaacccaggaagcggagguugu

SEQ ID NO: 100050 - RNA, 23 nt, Human
agacguguuuuguuuggacuuca

SEQ ID NO: 100051 - RNA, 26 nt, Human
ccugcugcuuccuaacuuauugccug

SEQ ID NO: 100052 - RNA, 24 nt, Human
uccugcaggugggacucucagcug

SEQ ID NO: 100053 - RNA, 28 nt, Human
ugcaugcuucuggcuggagcaccucccu

SEQ ID NO: 100054 - RNA, 22 nt, Human
uuuccaaaacuguccagggcgg

SEQ ID NO: 100055 - RNA, 28 nt, Human
ugcuucuucaggugagugcaggccaagg

SEQ ID NO: 100056 - RNA, 20 nt, Human
guguuuguuuuuugccaaaa

SEQ ID NO: 100057 - RNA, 24 nt, Human
ugucucaaaaaauguucuuugcca

SEQ ID NO: 100058 - RNA, 19 nt, Human
auuggauuaugcaauagga

SEQ ID NO: 100059 - RNA, 21 nt, Human
ggggugaagaauggagggagg

SEQ ID NO: 100060 - RNA, 22 nt, Human
aagaaccuuggguuacaugugg

SEQ ID NO: 100061 - RNA, 26 nt, Human
uguaaacgccauaaacaguuuugcuu

SEQ ID NO: 100062 - RNA, 21 nt, Human
ccgggacucugcccacuucca

SEQ ID NO: 100063 - RNA, 21 nt, Human
aacuauucacuucuuaauuua

SEQ ID NO: 100064 - RNA, 20 nt, Human
ugaggugaggcuacaagggg

SEQ ID NO: 100065 - RNA, 21 nt, Human
gugcccagcuccaaggcucua

SEQ ID NO: 100066 - RNA, 21 nt, Human
ucaggugcggcgcuguggcag

SEQ ID NO: 100067 - RNA, 21 nt, Human
ugcgaggccaaggugggagga

SEQ ID NO: 100068 - RNA, 25 nt, Human
cugccaccaugugggucagauguac

SEQ ID NO: 100069 - RNA, 27 nt, Human
ccauuaggcuccugagaguuauuucuc

SEQ ID NO: 100070 - RNA, 19 nt, Human
ugaagucauuuugcuucag

SEQ ID NO: 100071 - RNA, 18 nt, Human
uugccaccacaaguccac

SEQ ID NO: 100072 - RNA, 20 nt, Human
ucuagcuaauguaauaacug

SEQ ID NO: 100073 - RNA, 22 nt, Human
ugucucuggagagucuggucau

SEQ ID NO: 100074 - RNA, 20 nt, Human
uucucauuuuucuaaaagaa

SEQ ID NO: 100075 - RNA, 20 nt, Human
agaaucugcucagcuuucug

SEQ ID NO: 100076 - RNA, 27 nt, Human
aacuguacugggccauguugugccucc

SEQ ID NO: 100077 - RNA, 21 nt, Human
aaaauacaaaaaauuagcugg

SEQ ID NO: 100078 - RNA, 21 nt, Human
ucaucccucugucagggucag

SEQ ID NO: 100079 - RNA, 22 nt, Human
ccuuccucuuuuuauuuaguuc

SEQ ID NO: 100080 - RNA, 20 nt, Human
uuuuccaggcuggaacaaua

SEQ ID NO: 100081 - RNA, 21 nt, Human
cugguggcggggguggugcug

SEQ ID NO: 100082 - RNA, 26 nt, Human
aaacuaaggcaacuggaaaauacaug

SEQ ID NO: 100083 - RNA, 17 nt, Human
guccuuuuucuccugcu

SEQ ID NO: 100084 - RNA, 23 nt, Human
cuugccuggccugggcuaggggc

SEQ ID NO: 100085 - RNA, 27 nt, Human
cacugcacucugcucaucacgggagga

SEQ ID NO: 100086 - RNA, 27 nt, Human
gggcacaccuccucccacugcccacug

SEQ ID NO: 100087 - RNA, 21 nt, Human
cauugcucucugggcuuuugg

SEQ ID NO: 100088 - RNA, 19 nt, Human
ccauuuuucccaggguaau

SEQ ID NO: 100089 - RNA, 25 nt, Human
cagccugauccuggaagagacucgg

SEQ ID NO: 100090 - RNA, 26 nt, Human
gcaaagugaccugcaugccucaccuu

SEQ ID NO: 100091 - RNA, 26 nt, Human
cugccucuuuccaggggccucuggga

SEQ ID NO: 100092 - RNA, 21 nt, Human
cagaauuaaaacugcccuuaa

SEQ ID NO: 100093 - RNA, 20 nt, Human
ugccugccccuuccucccag

SEQ ID NO: 100094 - RNA, 24 nt, Human
gguggagcugccucauaaucugcu

SEQ ID NO: 100095 - RNA, 22 nt, Human
uaaugaguuuuccauggugcua

SEQ ID NO: 100096 - RNA, 21 nt, Human
cccuaucacuggccucaggcc

SEQ ID NO: 100097 - RNA, 21 nt, Human
agaagcuuuugaaaugcugaa

SEQ ID NO: 100098 - RNA, 25 nt, Human
uuuguucuugcagauguucuucuau

SEQ ID NO: 100099 - RNA, 19 nt, Human
uugagaagagagaacugua

SEQ ID NO: 100100 - RNA, 25 nt, Human
guaaaauuugcacaugugauuguga

SEQ ID NO: 100101 - RNA, 20 nt, Human
ccggucagacccaggauggg

SEQ ID NO: 100102 - RNA, 26 nt, Human
uauccugaacacuugacaccuugagg

SEQ ID NO: 100103 - RNA, 22 nt, Human
cuuuguugcucagcaggggacu

SEQ ID NO: 100104 - RNA, 24 nt, Human
aagaguugagaggccagggcccuu

SEQ ID NO: 100105 - RNA, 19 nt, Human
agacggugucuccacugag

SEQ ID NO: 100106 - RNA, 22 nt, Human
ccuccacccugccuccucgggc

SEQ ID NO: 100107 - RNA, 21 nt, Human
uccaguaccuugcuucuuacu

SEQ ID NO: 100108 - RNA, 21 nt, Human
uuaucugaaccaaucaaaggu

SEQ ID NO: 100109 - RNA, 22 nt, Human
ggccccuggcugagaaggggag

SEQ ID NO: 100110 - RNA, 30 nt, Human
ucagaacagcucagcaaccccugauuugac

SEQ ID NO: 100111 - RNA, 21 nt, Human
cgcugaccucggccuaggagg

SEQ ID NO: 100112 - RNA, 22 nt, Human
agcacaaauacacuacauagag

SEQ ID NO: 100113 - RNA, 22 nt, Human
ggccucugaccugcugucuacu

SEQ ID NO: 100114 - RNA, 25 nt, Human
ccaccaaggucuucagccaucaaca

SEQ ID NO: 100115 - RNA, 20 nt, Human
ucuuuauuuaguuugcauga

SEQ ID NO: 100116 - RNA, 24 nt, Human
cuuggagaaggcccacugggcagg

SEQ ID NO: 100117 - RNA, 27 nt, Human
agaggagccugagaagaggcagaggaa

SEQ ID NO: 100118 - RNA, 22 nt, Human
cuacaaaccaagggagucgacg

SEQ ID NO: 100119 - RNA, 26 nt, Human
cccugccggagccucagacacacugg

SEQ ID NO: 100120 - RNA, 22 nt, Human
ggcucgagcaguccugccucag

SEQ ID NO: 100121 - RNA, 19 nt, Human
gcacccugggucauagugu

SEQ ID NO: 100122 - RNA, 27 nt, Human
cccacuucauagcauuguaugaugauu

SEQ ID NO: 100123 - RNA, 27 nt, Human
augucagauaaggcaacugggcugguc

SEQ ID NO: 100124 - RNA, 27 nt, Human
ccugugugauuuaaaaaguuauagcuu

SEQ ID NO: 100125 - RNA, 25 nt, Human
ugaccuugcccuuggcagugcccca

SEQ ID NO: 100126 - RNA, 25 nt, Human
uugugguguuccugaagcaaauggg

SEQ ID NO: 100127 - RNA, 21 nt, Human
ucagcauuuguaccugaaguc

SEQ ID NO: 100128 - RNA, 23 nt, Human
cauggacucggacgccagccugg

SEQ ID NO: 100129 - RNA, 20 nt, Human
auagagugucucagggugca

SEQ ID NO: 100130 - RNA, 22 nt, Human
cuggguggggagagcgagcugg

SEQ ID NO: 100131 - RNA, 27 nt, Human
uccagcagaacagagacauugccaacc

SEQ ID NO: 100132 - RNA, 22 nt, Human
uuucauguccugucuauucauu

SEQ ID NO: 100133 - RNA, 22 nt, Human
gcuggaaugauuucagcucacu

SEQ ID NO: 100134 - RNA, 19 nt, Human
auaauccugaacauuagaa

SEQ ID NO: 100135 - RNA, 25 nt, Human
ucugcaauuccccucugcugcuguc

SEQ ID NO: 100136 - RNA, 21 nt, Human
ugucaacagacuggaguccuu

SEQ ID NO: 100137 - RNA, 23 nt, Human
uucucucuccaaaauaaaguuca

SEQ ID NO: 100138 - RNA, 21 nt, Human
agacgcugaaggaccuuuaca

SEQ ID NO: 100139 - RNA, 17 nt, Human
ggcacugggccaccuca

SEQ ID NO: 100140 - RNA, 21 nt, Human
caaaccucaagccagccuugc

SEQ ID NO: 100141 - RNA, 20 nt, Human
uucacaagccaucucuuuca

SEQ ID NO: 100142 - RNA, 23 nt, Human
cuaccugcauuucaauuaacuau

SEQ ID NO: 100143 - RNA, 22 nt, Human
cccccacgucucucugccugcu

SEQ ID NO: 100144 - RNA, 18 nt, Human
gaacaggaagaaaaagaa

SEQ ID NO: 100145 - RNA, 19 nt, Human
cgcagccgccgccgcccac

SEQ ID NO: 100146 - RNA, 22 nt, Human
accugcuccagaagaugccagc

SEQ ID NO: 100147 - RNA, 19 nt, Human
cagcuuccuccuucuguca

SEQ ID NO: 100148 - RNA, 24 nt, Human
gccauuuuuaaaguguagcauuuc

SEQ ID NO: 100149 - RNA, 21 nt, Human
cucacauccugcccaggaucu

SEQ ID NO: 100150 - RNA, 22 nt, Human
ccucacugguacugccugcugu

SEQ ID NO: 100151 - RNA, 27 nt, Human
ccacuguacuccagccuggaugacaga

SEQ ID NO: 100152 - RNA, 27 nt, Human
ccacugcacuccagucuggaugacaga

SEQ ID NO: 100153 - RNA, 21 nt, Human
cuuuccaggaugcagaaagaa

SEQ ID NO: 100154 - RNA, 21 nt, Human
guggccacaugggugcuggug

SEQ ID NO: 100155 - RNA, 23 nt, Human
cccucgucuucagcugcauuuca

SEQ ID NO: 100156 - RNA, 22 nt, Human
cuuguugggaguaagugccuug

SEQ ID NO: 100157 - RNA, 24 nt, Human
ucuaaucacuggaaaccaugugau

SEQ ID NO: 100158 - RNA, 25 nt, Human
guuaugugcauuucuagaaauacau

SEQ ID NO: 100159 - RNA, 16 nt, Human
ggccucuccuggaacc

SEQ ID NO: 100160 - RNA, 20 nt, Human
agaccauuggguaacccuca

SEQ ID NO: 100161 - RNA, 24 nt, Human
uggcucucaaacucucuaacuuau

SEQ ID NO: 100162 - RNA, 22 nt, Human
aguuuggggagugggcugcaag

SEQ ID NO: 100163 - RNA, 21 nt, Human
ucuccaccccuucagcgugga

SEQ ID NO: 100164 - RNA, 27 nt, Human
ugaccucauggcuccaaucccaccugc

SEQ ID NO: 100165 - RNA, 21 nt, Human
agcauccauccauccauccau

SEQ ID NO: 100166 - RNA, 26 nt, Human
cugucauccuaacguuugucauucca

SEQ ID NO: 100167 - RNA, 22 nt, Human
gagaaaaaacacagaaucuugg

SEQ ID NO: 100168 - RNA, 20 nt, Human
uuuguauuuuuguccagaaa

SEQ ID NO: 100169 - RNA, 19 nt, Human
aacagucacaaacccaaug

SEQ ID NO: 100170 - RNA, 21 nt, Human
ucucuagcugugaucuuacca

SEQ ID NO: 100171 - RNA, 23 nt, Human
caccucgggcugaccccaccucc

SEQ ID NO: 100172 - RNA, 21 nt, Human
ccacugcacuccagccuggug

SEQ ID NO: 100173 - RNA, 26 nt, Human
cacugcgcccagccugaaucauuucu

SEQ ID NO: 100174 - RNA, 19 nt, Human
ucugccucugggcucaugu

SEQ ID NO: 100175 - RNA, 23 nt, Human
acauuggguuaaaauucauuagc

SEQ ID NO: 100176 - RNA, 22 nt, Human
gcugggacucgucuuugaagga

SEQ ID NO: 100177 - RNA, 27 nt, Human
ugcuucgugccaucaugauccuugccu

SEQ ID NO: 100178 - RNA, 27 nt, Human
agacgcuggcuaggccgcccuccccac

SEQ ID NO: 100179 - RNA, 24 nt, Human
gcucucugcuuuuccugucugacu

SEQ ID NO: 100180 - RNA, 22 nt, Human
ucuguaaucccagcuacucugg

SEQ ID NO: 100181 - RNA, 23 nt, Human
gcuucuuugauuaagugcuagga

SEQ ID NO: 100182 - RNA, 20 nt, Human
gugcccaggcaaggugcuug

SEQ ID NO: 100183 - RNA, 18 nt, Human
acaguauuucuuuacaga

SEQ ID NO: 100184 - RNA, 27 nt, Human
gcucucauaguucuauccucuaauucc

SEQ ID NO: 100185 - RNA, 22 nt, Human
cauugcacuccagccuagauaa

SEQ ID NO: 100186 - RNA, 27 nt, Human
agaccuccuggccaaguccugcccucu

SEQ ID NO: 100187 - RNA, 23 nt, Human
cugccucucgcccuguaucuguc

SEQ ID NO: 100188 - RNA, 31 nt, Human
gcugccaaaauuauauuaauagugaguuuca

SEQ ID NO: 100189 - RNA, 18 nt, Human
aggggagccucacuguga

SEQ ID NO: 100190 - RNA, 22 nt, Human
cgagcagccgccuugacugggg

SEQ ID NO: 100191 - RNA, 25 nt, Human
ccaaguggauaagaggagcggccug

SEQ ID NO: 100192 - RNA, 21 nt, Human
uuacccuggccccucucccuu

SEQ ID NO: 100193 - RNA, 21 nt, Human
aaauguagccauuugagaaac

SEQ ID NO: 100194 - RNA, 21 nt, Human
uauuccccuucaccucccagu

SEQ ID NO: 100195 - RNA, 20 nt, Human
uaccucaggaaaaacaaaua

SEQ ID NO: 100196 - RNA, 21 nt, Human
gcucacugcaaccucgccucc

SEQ ID NO: 100197 - RNA, 27 nt, Human
auugcaaccuccgccuccugcguucgg

SEQ ID NO: 100198 - RNA, 21 nt, Human
agguucuuuuacugaaggaug

SEQ ID NO: 100199 - RNA, 23 nt, Human
cugaguucuccaguugcugccuc

SEQ ID NO: 100200 - RNA, 23 nt, Human
ucccugggucuccuccucucugg

SEQ ID NO: 100201 - RNA, 21 nt, Human
ucugaauaaaacagccaugcu

SEQ ID NO: 100202 - RNA, 27 nt, Human
cuugcccaaaaggcuggagagggcagg

SEQ ID NO: 100203 - RNA, 21 nt, Human
cucccucugaccagcaaccag

SEQ ID NO: 100204 - RNA, 26 nt, Human
cagcacucugagccaucauaccucuu

SEQ ID NO: 100205 - RNA, 21 nt, Human
gccccucagagaggcauguga

SEQ ID NO: 100206 - RNA, 24 nt, Human
cccugcauugaggccuuguggacc

SEQ ID NO: 100207 - RNA, 19 nt, Human
ccuccuuauguauucucaa

SEQ ID NO: 100208 - RNA, 20 nt, Human
ggagacucccaggugcccca

SEQ ID NO: 100209 - RNA, 22 nt, Human
gaagggagaagacacugcagug

SEQ ID NO: 100210 - RNA, 23 nt, Human
uugacccuggaugucagaguuga

SEQ ID NO: 100211 - RNA, 27 nt, Human
ccucaguuucccuaucugcaaaauggg

SEQ ID NO: 100212 - RNA, 24 nt, Human
uucagcuuucuaaaaggcauauau

SEQ ID NO: 100213 - RNA, 22 nt, Human
gauggcucucaucccagacuug

SEQ ID NO: 100214 - RNA, 27 nt, Human
ggaggcugaagcaggaaaaucgcuuga

SEQ ID NO: 100215 - RNA, 22 nt, Human
cuucaaaacaaaacaaaaaaca

SEQ ID NO: 100216 - RNA, 19 nt, Human
cauguuugucugugugucu

SEQ ID NO: 100217 - RNA, 26 nt, Human
uccaucuccccagugaaggaccuacu

SEQ ID NO: 100218 - RNA, 29 nt, Human
uggcuaaugaaagccuccucaccucuucc

SEQ ID NO: 100219 - RNA, 21 nt, Human
uugcccaggcugaauucagac

SEQ ID NO: 100220 - RNA, 20 nt, Human
uucaaaugcuguaucuuuca

SEQ ID NO: 100221 - RNA, 24 nt, Human
cucugccuuuguggugaauggagg

SEQ ID NO: 100222 - RNA, 22 nt, Human
cgccacugcacuauagccuagg

SEQ ID NO: 100223 - RNA, 25 nt, Human
gcacaugaacaggugucuuaaugca

SEQ ID NO: 100224 - RNA, 27 nt, Human
ggguuuccaguaccaucuggaugcccu

SEQ ID NO: 100225 - RNA, 22 nt, Human
ugguucacacuccauuucccag

SEQ ID NO: 100226 - RNA, 22 nt, Human
cucugaccgggcuuccucccuc

SEQ ID NO: 100227 - RNA, 21 nt, Human
ccaguagaaauuuaagaaaga

SEQ ID NO: 100228 - RNA, 29 nt, Human
augcucuugaaccggaaacccagggaugg

SEQ ID NO: 100229 - RNA, 27 nt, Human
gucagccaagaaauaaaaguuuaccuc

SEQ ID NO: 100230 - RNA, 24 nt, Human
ccugcagccaagcaaaugccugcc

SEQ ID NO: 100231 - RNA, 17 nt, Human
augccucccuugcagca

SEQ ID NO: 100232 - RNA, 22 nt, Human
ugcaaccuccaccucccugguu

SEQ ID NO: 100233 - RNA, 23 nt, Human
gaauguuaguuguuaucacauac

SEQ ID NO: 100234 - RNA, 27 nt, Human
acagccacuacugcugcagccagccac

SEQ ID NO: 100235 - RNA, 20 nt, Human
cuacuaugccuuauaaaaca

SEQ ID NO: 100236 - RNA, 24 nt, Human
acuguaucuacugaauucuucuaa

SEQ ID NO: 100237 - RNA, 17 nt, Human
ugucugagagcuggggc

SEQ ID NO: 100238 - RNA, 20 nt, Human
auguaccugcucuucuguuu

SEQ ID NO: 100239 - RNA, 25 nt, Human
acacgccuucagguuugcucagggg

SEQ ID NO: 100240 - RNA, 20 nt, Human
accagucuuuaagguuuugc

SEQ ID NO: 100241 - RNA, 27 nt, Human
agagcaucucuuugcugcuacuguuuu

SEQ ID NO: 100242 - RNA, 26 nt, Human
gggcugggacuggagcuggagcaggc

SEQ ID NO: 100243 - RNA, 22 nt, Human
uucuucucugcugcauuuggac

SEQ ID NO: 100244 - RNA, 23 nt, Human
ccugucuuccaauuuaaccaaag

SEQ ID NO: 100245 - RNA, 24 nt, Human
caggaaaggcugccugcagaggac

SEQ ID NO: 100246 - RNA, 23 nt, Human
gacuugcgcuucucugcaccuua

SEQ ID NO: 100247 - RNA, 23 nt, Human
cccacuccacuccaggcugccgg

SEQ ID NO: 100248 - RNA, 26 nt, Human
cccaggcugcucuugaauuccugggc

SEQ ID NO: 100249 - RNA, 20 nt, Human
cagacuuuagcuuacaguca

SEQ ID NO: 100250 - RNA, 22 nt, Human
uaacaaacaggcugauaucuuc

SEQ ID NO: 100251 - RNA, 21 nt, Human
agaccuccuucccucccuccu

SEQ ID NO: 100252 - RNA, 22 nt, Human
ucgcccaggcuagaguggauug

SEQ ID NO: 100253 - RNA, 20 nt, Human
agaaaaagaggaaaucuauc

SEQ ID NO: 100254 - RNA, 20 nt, Human
guuauugcacuaugaaaauc

SEQ ID NO: 100255 - RNA, 22 nt, Human
cucauuucacuuuacacgcuca

SEQ ID NO: 100256 - RNA, 22 nt, Human
gcaaagugcugaacuggcugaa

SEQ ID NO: 100257 - RNA, 22 nt, Human
gagcaagcucaccacagaggag

SEQ ID NO: 100258 - RNA, 21 nt, Human
gccugucccagccuccuggcc

SEQ ID NO: 100259 - RNA, 20 nt, Human
ccuuccaucuggcagugggg

SEQ ID NO: 100260 - RNA, 23 nt, Human
cucagaggaaaaaugggagccag

SEQ ID NO: 100261 - RNA, 20 nt, Human
augaggguguggaggacugu

SEQ ID NO: 100262 - RNA, 21 nt, Human
caacaaugacauuuuacugua

SEQ ID NO: 100263 - RNA, 27 nt, Human
ucaggaggcugaggcaggagaaucgcu

SEQ ID NO: 100264 - RNA, 27 nt, Human
uaaagaaggaacaucaggcaugcuaaa

SEQ ID NO: 100265 - RNA, 25 nt, Human
ugguaugucuuguuuggaaaagugg

SEQ ID NO: 100266 - RNA, 29 nt, Human
cugccagggacugcucacucugcagagcc

SEQ ID NO: 100267 - RNA, 21 nt, Human
aacucuccagcucugaaugga

SEQ ID NO: 100268 - RNA, 22 nt, Human
ccguggcaccacacaccuccca

SEQ ID NO: 100269 - RNA, 24 nt, Human
gggggcagggggacggugggggag

SEQ ID NO: 100270 - RNA, 23 nt, Human
uaucaccuaggcuggagugcagc

SEQ ID NO: 100271 - RNA, 22 nt, Human
caacauaguaagaccucaucuc

SEQ ID NO: 100272 - RNA, 24 nt, Human
ccaucuggaugcccugccuguuga

SEQ ID NO: 100273 - RNA, 22 nt, Human
cuggaaagaguaaaaugauaac

SEQ ID NO: 100274 - RNA, 19 nt, Human
uuugccaggcuggugcaaa

SEQ ID NO: 100275 - RNA, 23 nt, Human
cuggcucuucggaugucuucuag

SEQ ID NO: 100276 - RNA, 26 nt, Human
caguaaucauuaguggcaaugaugac

SEQ ID NO: 100277 - RNA, 22 nt, Human
agggguuugagccccuuguuca

SEQ ID NO: 100278 - RNA, 19 nt, Human
acacuguccccacagcagg

SEQ ID NO: 100279 - RNA, 24 nt, Human
uuguaacccagcacuuugggaagc

SEQ ID NO: 100280 - RNA, 19 nt, Human
cugaggcagaauugcuuga

SEQ ID NO: 100281 - RNA, 30 nt, Human
aggacaaaucuacuccagccacgaugagaa

SEQ ID NO: 100282 - RNA, 21 nt, Human
cauggagcaaaagagacaggg

SEQ ID NO: 100283 - RNA, 20 nt, Human
cugggccucaguucuauuug

SEQ ID NO: 100284 - RNA, 23 nt, Human
gccugugugugccacuguuugcu

SEQ ID NO: 100285 - RNA, 22 nt, Human
uucaaagcuuauucuuaauuag

SEQ ID NO: 100286 - RNA, 25 nt, Human
guugcccaggcuguuauggaacucc

SEQ ID NO: 100287 - RNA, 23 nt, Human
caccucacucucuugccauacgg

SEQ ID NO: 100288 - RNA, 26 nt, Human
ugggaggcagggcaaugcaggaucca

SEQ ID NO: 100289 - RNA, 23 nt, Human
gcgaucucagcucacugcaagcu

SEQ ID NO: 100290 - RNA, 23 nt, Human
acgaucucggcucacugcaagcu

SEQ ID NO: 100291 - RNA, 18 nt, Human
acuauguaaacuacuucu

SEQ ID NO: 100292 - RNA, 21 nt, Human
uuucuguaccauugccaauca

SEQ ID NO: 100293 - RNA, 22 nt, Human
augccauuuuaucacucugccu

SEQ ID NO: 100294 - RNA, 21 nt, Human
cacagccuccaacuccugggc

SEQ ID NO: 100295 - RNA, 21 nt, Human
cuaaggaagugcagucuuuga

SEQ ID NO: 100296 - RNA, 20 nt, Human
cugccucacaucagcccugu

SEQ ID NO: 100297 - RNA, 19 nt, Human
gcaagacguccuggaauga

SEQ ID NO: 100298 - RNA, 21 nt, Human
aagacacaucccuacaaaaaa

SEQ ID NO: 100299 - RNA, 23 nt, Human
cauuaccaaucgcgaaaccgcuc

SEQ ID NO: 100300 - RNA, 22 nt, Human
uggcuucaggaguggagugaga

SEQ ID NO: 100301 - RNA, 27 nt, Human
ggcucccuccucccggcgacauucacg

SEQ ID NO: 100302 - RNA, 21 nt, Human
uuuuucagguuuuacugauga

SEQ ID NO: 100303 - RNA, 19 nt, Human
uucuauuuugagaucauug

SEQ ID NO: 100304 - RNA, 24 nt, Human
aguagacuugaagacaaguuuuaa

SEQ ID NO: 100305 - RNA, 21 nt, Human
aacaaauuuaagagacagagc

SEQ ID NO: 100306 - RNA, 25 nt, Human
ucacguaggcgucaugaggucuccg

SEQ ID NO: 100307 - RNA, 31 nt, Human
gagagcaagccuguguguggggaugucaggu

SEQ ID NO: 100308 - RNA, 21 nt, Human
ggauagcuucagaaaucagaa

SEQ ID NO: 100309 - RNA, 27 nt, Human
gucacccaggcuggagugcaaugguga

SEQ ID NO: 100310 - RNA, 22 nt, Human
aguuaugaguuugguugcagug

SEQ ID NO: 100311 - RNA, 27 nt, Human
uugcuaccauucuaaugcauguauucg

SEQ ID NO: 100312 - RNA, 19 nt, Human
aagagcagcuuggccaggu

SEQ ID NO: 100313 - RNA, 19 nt, Human
gcugugacacaacugugug

SEQ ID NO: 100314 - RNA, 27 nt, Human
cugggagggaggguugugucaggcuug

SEQ ID NO: 100315 - RNA, 25 nt, Human
ugcgcauaggaacccauuacuuaau

SEQ ID NO: 100316 - RNA, 21 nt, Human
agugggacgucuuuuuuccua

SEQ ID NO: 100317 - RNA, 23 nt, Human
guugcucaaaucacuagcacaga

SEQ ID NO: 100318 - RNA, 26 nt, Human
guccugaguguucaugcuuuguacca

SEQ ID NO: 100319 - RNA, 21 nt, Human
ccccaacacaugacgccaucu

SEQ ID NO: 100320 - RNA, 20 nt, Human
aaaugauugcuucagucuuu

SEQ ID NO: 100321 - RNA, 22 nt, Human
gaucuccuccuccuucaugcag

SEQ ID NO: 100322 - RNA, 24 nt, Human
aagacaacagggugcacugcugcc

SEQ ID NO: 100323 - RNA, 26 nt, Human
ucucacugccuucugucugcccaguu

SEQ ID NO: 100324 - RNA, 24 nt, Human
cuauucugguucauucagcacuuu

SEQ ID NO: 100325 - RNA, 26 nt, Human
acaacaaaauucuucauaaagauauu

SEQ ID NO: 100326 - RNA, 21 nt, Human
cuccugagucccggccugaag

SEQ ID NO: 100327 - RNA, 29 nt, Human
cugaguccuaagacugcagucaaagccag

SEQ ID NO: 100328 - RNA, 22 nt, Human
agaguaaguaggcagcacuuuu

SEQ ID NO: 100329 - RNA, 23 nt, Human
cacccagggcguggagaugacca

SEQ ID NO: 100330 - RNA, 20 nt, Human
caguguccccagcacuuuua

SEQ ID NO: 100331 - RNA, 20 nt, Human
uccuggagccccugugucgg

SEQ ID NO: 100332 - RNA, 21 nt, Human
cuuuuuaaaaaguacucuuua

SEQ ID NO: 100333 - RNA, 24 nt, Human
uucuaguguuugcuucuuaguaac

SEQ ID NO: 100334 - RNA, 25 nt, Human
ccaagacccaggcaauuuugccccu

SEQ ID NO: 100335 - RNA, 18 nt, Human
gcuaacgaccacaggguc

SEQ ID NO: 100336 - RNA, 27 nt, Human
ggucuugaacuccugacccucaaguga

SEQ ID NO: 100337 - RNA, 21 nt, Human
uagccucagauucuucaucug

SEQ ID NO: 100338 - RNA, 27 nt, Human
gauggcugaacaucaggguguggcauu

SEQ ID NO: 100339 - RNA, 25 nt, Human
acuucuuauuuuuagaaaguggagg

SEQ ID NO: 100340 - RNA, 21 nt, Human
ucugugauuugaaugagggag

SEQ ID NO: 100341 - RNA, 17 nt, Human
uggggaaggcagaggcu

SEQ ID NO: 100342 - RNA, 24 nt, Human
ggcagagggagugagcaggggaga

SEQ ID NO: 100343 - RNA, 26 nt, Human
ucuccugcucaugugucagugucuac

SEQ ID NO: 100344 - RNA, 22 nt, Human
cuaccaauauucuguugcuguu

SEQ ID NO: 100345 - RNA, 21 nt, Human
uucagccugggggauacagug

SEQ ID NO: 100346 - RNA, 27 nt, Human
uccagaagacaaggaagaccggcuggu

SEQ ID NO: 100347 - RNA, 22 nt, Human
caaguuaacuuuuucuuauuuu

SEQ ID NO: 100348 - RNA, 21 nt, Human
acagucagagaacaguggagg

SEQ ID NO: 100349 - RNA, 22 nt, Human
gcgugagccacugagcccagcc

SEQ ID NO: 100350 - RNA, 22 nt, Human
gcucacugaaagcuccgccucc

SEQ ID NO: 100351 - RNA, 27 nt, Human
aaaaccaacaacaauuagccauaguuc

SEQ ID NO: 100352 - RNA, 27 nt, Human
gagcccaacacuuuaauuuauucuuuc

SEQ ID NO: 100353 - RNA, 26 nt, Human
caaaccugggaaggccagccuuguac

SEQ ID NO: 100354 - RNA, 26 nt, Human
gcacccugcuuaggugcacagcuguu

SEQ ID NO: 100355 - RNA, 24 nt, Human
ugggaggaggcgggaucugcucug

SEQ ID NO: 100356 - RNA, 25 nt, Human
caaucaggaaugagucaaucagccu

SEQ ID NO: 100357 - RNA, 26 nt, Human
ccuccucagcccucccccacccacag

SEQ ID NO: 100358 - RNA, 25 nt, Human
uggguggaaaacagggugcuaaagc

SEQ ID NO: 100359 - RNA, 24 nt, Human
uacucaacuugcuguuauuccagu

SEQ ID NO: 100360 - RNA, 22 nt, Human
caguguacaggaagaggcaggc

SEQ ID NO: 100361 - RNA, 22 nt, Human
gugucugccacauuaacuacac

SEQ ID NO: 100362 - RNA, 22 nt, Human
ugcagugucuuaguuugaauga

SEQ ID NO: 100363 - RNA, 27 nt, Human
cccaaagugcugggauuacuggcauga

SEQ ID NO: 100364 - RNA, 20 nt, Human
ugggaggcagguggggcuug

SEQ ID NO: 100365 - RNA, 22 nt, Human
agucauucagaagugguuugag

SEQ ID NO: 100366 - RNA, 26 nt, Human
cagaucuuuuguucucuguaaugagg

SEQ ID NO: 100367 - RNA, 22 nt, Human
caacauagggggaucccaucuc

SEQ ID NO: 100368 - RNA, 23 nt, Human
cuggggaagggggcguucgcugc

SEQ ID NO: 100369 - RNA, 20 nt, Human
ugcacacauucuuauuagga

SEQ ID NO: 100370 - RNA, 26 nt, Human
gggucauuugaaagcuucagucucgg

SEQ ID NO: 100371 - RNA, 21 nt, Human
uucucaucuaaaauuuuucua

SEQ ID NO: 100372 - RNA, 24 nt, Human
cagagaggcagagguggcacagga

SEQ ID NO: 100373 - RNA, 24 nt, Human
acauuuaugagggucagucccaca

SEQ ID NO: 100374 - RNA, 28 nt, Human
cuuucacucugcuggcuucucccaggcc

SEQ ID NO: 100375 - RNA, 21 nt, Human
uugagacuuuuucuuugcuug

SEQ ID NO: 100376 - RNA, 23 nt, Human
uggucucaauuuaaaaugaucca

SEQ ID NO: 100377 - RNA, 21 nt, Human
uuguuuuucaacuugcuuuau

SEQ ID NO: 100378 - RNA, 27 nt, Human
ucaggaggcugaggcagaagaauugaa

SEQ ID NO: 100379 - RNA, 26 nt, Human
acuuuaauguacuucuaucacugcau

SEQ ID NO: 100380 - RNA, 22 nt, Human
ggcugcaccccuuccucuucuc

SEQ ID NO: 100381 - RNA, 21 nt, Human
ccauuuuuauaucgaucucuu

SEQ ID NO: 100382 - RNA, 26 nt, Human
ugaggugaggggccggaggagcaagg

SEQ ID NO: 100383 - RNA, 29 nt, Human
uuccaggggucccccagacaugaaagagg

SEQ ID NO: 100384 - RNA, 23 nt, Human
gcugcugcugcucugcaaaauuc

SEQ ID NO: 100385 - RNA, 20 nt, Human
uuuauuacaguaaaaggaca

SEQ ID NO: 100386 - RNA, 23 nt, Human
aguucuagucuguugaucugccu

SEQ ID NO: 100387 - RNA, 23 nt, Human
ugccauuuuuaauucauucuggu

SEQ ID NO: 100388 - RNA, 23 nt, Human
cccucauccuuccucugggacca

SEQ ID NO: 100389 - RNA, 22 nt, Human
ggcucagauauaaaggaaaggu

SEQ ID NO: 100390 - RNA, 25 nt, Human
cgugagccccaucuucacccaggcc

SEQ ID NO: 100391 - RNA, 22 nt, Human
auuuuucuuauaauuggacccu

SEQ ID NO: 100392 - RNA, 21 nt, Human
ugccuugguggggccuguguc

SEQ ID NO: 100393 - RNA, 22 nt, Human
cuccucucccugcuuucuugaa

SEQ ID NO: 100394 - RNA, 23 nt, Human
cucucugagaugccccucugccu

SEQ ID NO: 100395 - RNA, 20 nt, Human
uguuguauuuaaaaaauaca

SEQ ID NO: 100396 - RNA, 26 nt, Human
ccaccugucuguccuggccuaaugcc

SEQ ID NO: 100397 - RNA, 21 nt, Human
cugugugaggggagggggccg

SEQ ID NO: 100398 - RNA, 24 nt, Human
ccugaacuugcuauuuuaaacaaa

SEQ ID NO: 100399 - RNA, 22 nt, Human
uauguaauuuuauuuacauucu

SEQ ID NO: 100400 - RNA, 24 nt, Human
gccuaggcuggagugcagugaggc

SEQ ID NO: 100401 - RNA, 23 nt, Human
cuguucccccaggcucucagugc

SEQ ID NO: 100402 - RNA, 26 nt, Human
agaaacuggaggcugcaacaggaggg

SEQ ID NO: 100403 - RNA, 20 nt, Human
uuaguaaaguaacaguccca

SEQ ID NO: 100404 - RNA, 23 nt, Human
agccagggacauagccagggagg

SEQ ID NO: 100405 - RNA, 25 nt, Human
aacacccuucucggaggcucagguc

SEQ ID NO: 100406 - RNA, 22 nt, Human
ugaggggaacaagcgcagccag

SEQ ID NO: 100407 - RNA, 21 nt, Human
gggaggcagagguugugguga

SEQ ID NO: 100408 - RNA, 20 nt, Human
ggcaauccuggauguccugg

SEQ ID NO: 100409 - RNA, 21 nt, Human
uucggcaccuuccccugagga

SEQ ID NO: 100410 - RNA, 22 nt, Human
aauacagacuacuucuucccca

SEQ ID NO: 100411 - RNA, 22 nt, Human
guuucauggcaacacuggauaa

SEQ ID NO: 100412 - RNA, 17 nt, Human
gaaugauuuacucugaa

SEQ ID NO: 100413 - RNA, 21 nt, Human
ggaaacuccuuuguuuaggga

SEQ ID NO: 100414 - RNA, 22 nt, Human
agcugcuguuccaacagacagg

SEQ ID NO: 100415 - RNA, 19 nt, Human
ccagcaaccaccaaucugc

SEQ ID NO: 100416 - RNA, 26 nt, Human
ggccuccagaccagaccccaaaccag

SEQ ID NO: 100417 - RNA, 21 nt, Human
gauaauuauaauguaucugua

SEQ ID NO: 100418 - RNA, 21 nt, Human
gacuauacauuugcuacuggu

SEQ ID NO: 100419 - RNA, 20 nt, Human
ugaauagaagguagugaaga

SEQ ID NO: 100420 - RNA, 27 nt, Human
agggacugauccacagagaggaugaga

SEQ ID NO: 100421 - RNA, 26 nt, Human
ccaccgccaccaugcccaacuucgcc

SEQ ID NO: 100422 - RNA, 23 nt, Human
gccgcuaccccuccugcucggcc

SEQ ID NO: 100423 - RNA, 21 nt, Human
auaagccucaguuuuccaucu

SEQ ID NO: 100424 - RNA, 20 nt, Human
acaugcacacugucagggcu

SEQ ID NO: 100425 - RNA, 22 nt, Human
acugcagccuugaccuccuggg

SEQ ID NO: 100426 - RNA, 21 nt, Human
ccagcccagcaugcaccagcu

SEQ ID NO: 100427 - RNA, 22 nt, Human
aggaaagcuugaaaaaugaaga

SEQ ID NO: 100428 - RNA, 20 nt, Human
cuuaguuuuuaaaaaggccu

SEQ ID NO: 100429 - RNA, 19 nt, Human
uccaugguuuauagauuaa

SEQ ID NO: 100430 - RNA, 22 nt, Human
auaggcaucaugagagugcugg

SEQ ID NO: 100431 - RNA, 23 nt, Human
ugggaacacaggcucucacaaga

SEQ ID NO: 100432 - RNA, 21 nt, Human
cuuccucuggguccuggagua

SEQ ID NO: 100433 - RNA, 22 nt, Human
ggaggcugagucaggagaauca

SEQ ID NO: 100434 - RNA, 27 nt, Human
cggguccagagaccacaccacuaacca

SEQ ID NO: 100435 - RNA, 20 nt, Human
acaagauuagcucaagcaga

SEQ ID NO: 100436 - RNA, 22 nt, Human
ccgagaucgcgccaucacacuc

SEQ ID NO: 100437 - RNA, 22 nt, Human
ccuccuaccccucccagcugac

SEQ ID NO: 100438 - RNA, 21 nt, Human
aauguacaccuguggucccag

SEQ ID NO: 100439 - RNA, 27 nt, Human
ggcagauuccuuaccugucugcccuca

SEQ ID NO: 100440 - RNA, 26 nt, Human
cuagaaguagcuuuuugaaaaccacu

SEQ ID NO: 100441 - RNA, 22 nt, Human
uucaaguagccuauuuuauaug

SEQ ID NO: 100442 - RNA, 22 nt, Human
acuccaccuguuacuacuucuu

SEQ ID NO: 100443 - RNA, 20 nt, Human
gcuacuuauucucauggccu

SEQ ID NO: 100444 - RNA, 21 nt, Human
cuacagugagcugccauucca

SEQ ID NO: 100445 - RNA, 21 nt, Human
aggcugagucagaaacacacu

SEQ ID NO: 100446 - RNA, 19 nt, Human
gagaagccaaaaauccaga

SEQ ID NO: 100447 - RNA, 24 nt, Human
uaaccuuuauacagaaucuuccca

SEQ ID NO: 100448 - RNA, 25 nt, Human
agccggaggaagcacauuuugaacc

SEQ ID NO: 100449 - RNA, 17 nt, Human
cacuuccuucagcaucu

SEQ ID NO: 100450 - RNA, 27 nt, Human
ggaggcugaggugguuguauugcuuga

SEQ ID NO: 100451 - RNA, 22 nt, Human
auuugccagacagagaucagaa

SEQ ID NO: 100452 - RNA, 27 nt, Human
cucccaugacugcccagcucugaggcc

SEQ ID NO: 100453 - RNA, 21 nt, Human
uugacaugaagaagcagcagc

SEQ ID NO: 100454 - RNA, 25 nt, Human
gcugcuguuucggcgcgggucggcu

SEQ ID NO: 100455 - RNA, 22 nt, Human
aaauucaggacuaccccuccuc

SEQ ID NO: 100456 - RNA, 20 nt, Human
cagggaggaggagaaaggaa

SEQ ID NO: 100457 - RNA, 19 nt, Human
cuuuuguguucugucacca

SEQ ID NO: 100458 - RNA, 22 nt, Human
ugucgccaggcuagagugcggu

SEQ ID NO: 100459 - RNA, 26 nt, Human
agggguggggauugggggacaugggc

SEQ ID NO: 100460 - RNA, 22 nt, Human
cuaacacggugaaaccccaucu

SEQ ID NO: 100461 - RNA, 20 nt, Human
ucuguugccaccaucagauu

SEQ ID NO: 100462 - RNA, 20 nt, Human
gcacagccugucacugcucu

SEQ ID NO: 100463 - RNA, 27 nt, Human
ucuguacaggccaguuucucugccuuc

SEQ ID NO: 100464 - RNA, 18 nt, Human
aggaaaggaagaaaggca

SEQ ID NO: 100465 - RNA, 26 nt, Human
ucugcagcuguuucaaaguugggguc

SEQ ID NO: 100466 - RNA, 20 nt, Human
cgcaggagcugcagcucugc

SEQ ID NO: 100467 - RNA, 27 nt, Human
uugucauggaagccagggagccuggga

SEQ ID NO: 100468 - RNA, 22 nt, Human
gcucacuacaaccucugccucc

SEQ ID NO: 100469 - RNA, 24 nt, Human
gccaccucuucacugaaaguuacc

SEQ ID NO: 100470 - RNA, 26 nt, Human
ggguuuuguugaaucaacaaugugau

SEQ ID NO: 100471 - RNA, 21 nt, Human
agugggaagugagagacacug

SEQ ID NO: 100472 - RNA, 19 nt, Human
aaagagguuuuugaaaugc

SEQ ID NO: 100473 - RNA, 21 nt, Human
gugccugggucugugucaccu

SEQ ID NO: 100474 - RNA, 20 nt, Human
cucugaaaacuuuaccaucu

SEQ ID NO: 100475 - RNA, 25 nt, Human
ccuacuucucuuguaaaacuguugc

SEQ ID NO: 100476 - RNA, 20 nt, Human
ccuucccagcucagcucagu

SEQ ID NO: 100477 - RNA, 25 nt, Human
gacccauucuuauuucaauuucucc

SEQ ID NO: 100478 - RNA, 27 nt, Human
caccauuguacuccagccugugugaca

SEQ ID NO: 100479 - RNA, 22 nt, Human
ccugcugcucucagguccccug

SEQ ID NO: 100480 - RNA, 26 nt, Human
gcucagccuugcacacccacugcccc

SEQ ID NO: 100481 - RNA, 26 nt, Human
uuuaaccuugaaggguucaccagguc

SEQ ID NO: 100482 - RNA, 22 nt, Human
gggcuucucgagggcuuggggg

SEQ ID NO: 100483 - RNA, 27 nt, Human
uucuggcuugugcaguuuuuauugucu

SEQ ID NO: 100484 - RNA, 25 nt, Human
ucuucucucaaccccuuuguaaugg

SEQ ID NO: 100485 - RNA, 20 nt, Human
gcuuagagaggcucacagcu

SEQ ID NO: 100486 - RNA, 21 nt, Human
cacaggggauggugugcauuc

SEQ ID NO: 100487 - RNA, 30 nt, Human
ggcagggaauggggacgguguauggagggg

SEQ ID NO: 100488 - RNA, 16 nt, Human
aucaaaacacagauaa

SEQ ID NO: 100489 - RNA, 24 nt, Human
acccacccucucucugaucucccc

SEQ ID NO: 100490 - RNA, 21 nt, Human
ccugcugcuccgcaccuccuc

SEQ ID NO: 100491 - RNA, 23 nt, Human
uuuggacuucucgacuugagugc

SEQ ID NO: 100492 - RNA, 19 nt, Human
caagagagcuuugccugaa

SEQ ID NO: 100493 - RNA, 22 nt, Human
ugucggggagcagccugguguc

SEQ ID NO: 100494 - RNA, 25 nt, Human
uggacugauuugcuggaguucaggg

SEQ ID NO: 100495 - RNA, 23 nt, Human
ugacuucuguuccuugcuuuuag

SEQ ID NO: 100496 - RNA, 26 nt, Human
ucacagccaggcgcuagcacagcucc

SEQ ID NO: 100497 - RNA, 22 nt, Human
cauguguguggccucagucuca

SEQ ID NO: 100498 - RNA, 23 nt, Human
uaaugugauuacagguagaggcc

SEQ ID NO: 100499 - RNA, 22 nt, Human
gugccucaggccagggcucacc

SEQ ID NO: 100500 - RNA, 29 nt, Human
agcgcugcgguuggcaccuccuuccucac

SEQ ID NO: 100501 - RNA, 21 nt, Human
aagaaaggaaacagauuugca

SEQ ID NO: 100502 - RNA, 17 nt, Human
uagcacagcagaugugu

SEQ ID NO: 100503 - RNA, 24 nt, Human
ccagcgagggagaggucgugaggc

SEQ ID NO: 100504 - RNA, 22 nt, Human
aggcugaggacuuaaaauauuc

SEQ ID NO: 100505 - RNA, 29 nt, Human
agcugaaccaaagccucuucaaaaagcag

SEQ ID NO: 100506 - RNA, 29 nt, Human
acaaucagaagacaggagcugcagaacag

SEQ ID NO: 100507 - RNA, 20 nt, Human
agcuggagacuggagguuuc

SEQ ID NO: 100508 - RNA, 24 nt, Human
aaaacucccagacacgcacugccu

SEQ ID NO: 100509 - RNA, 23 nt, Human
uguugcccaggcuggagcgcagu

SEQ ID NO: 100510 - RNA, 19 nt, Human
gagggagggauggacaagu

SEQ ID NO: 100511 - RNA, 25 nt, Human
ggacucugccuguguccuguguucc

SEQ ID NO: 100512 - RNA, 23 nt, Human
gauggaaaccauuuccuacauca

SEQ ID NO: 100513 - RNA, 21 nt, Human
ucuuauuauaaagaacuauuu

SEQ ID NO: 100514 - RNA, 25 nt, Human
agcauuuuguaccaucugcucccca

SEQ ID NO: 100515 - RNA, 22 nt, Human
cugggccucagugugcccaucu

SEQ ID NO: 100516 - RNA, 22 nt, Human
gugcagcugcugugccuguguc

SEQ ID NO: 100517 - RNA, 20 nt, Human
cgcacacacacuugcauuca

SEQ ID NO: 100518 - RNA, 23 nt, Human
ucuucaacuugcucucuuuccca

SEQ ID NO: 100519 - RNA, 26 nt, Human
ggguguccggggugggagagcuguug

SEQ ID NO: 100520 - RNA, 23 nt, Human
cagcugcccuaugggccugccgg

SEQ ID NO: 100521 - RNA, 19 nt, Human
ggcuugccuguaggauuua

SEQ ID NO: 100522 - RNA, 27 nt, Human
uugggaggcugaggugggaggguugcu

SEQ ID NO: 100523 - RNA, 19 nt, Human
gucuuagcuucaauccugg

SEQ ID NO: 100524 - RNA, 23 nt, Human
cuuucaccugggaugacuuucga

SEQ ID NO: 100525 - RNA, 21 nt, Human
aaucucaaacuucuauuuuua

SEQ ID NO: 100526 - RNA, 19 nt, Human
uuuaaaccaauugcugcua

SEQ ID NO: 100527 - RNA, 26 nt, Human
agcaccugcaugugcugucacgcaca

SEQ ID NO: 100528 - RNA, 26 nt, Human
aagugcuaugaacacugaucaaguag

SEQ ID NO: 100529 - RNA, 19 nt, Human
ucauaguuauuaaugugau

SEQ ID NO: 100530 - RNA, 27 nt, Human
cccugcaguaaucuccaggccugguua

SEQ ID NO: 100531 - RNA, 17 nt, Human
gcccugcucagcccagc

SEQ ID NO: 100532 - RNA, 26 nt, Human
ccuggccuggugggagaggagcuuug

SEQ ID NO: 100533 - RNA, 20 nt, Human
gugagagugacagagcugug

SEQ ID NO: 100534 - RNA, 22 nt, Human
ggccuccuaaagugcugggauu

SEQ ID NO: 100535 - RNA, 22 nt, Human
ugcccaggcuggugugcaaugg

SEQ ID NO: 100536 - RNA, 23 nt, Human
ccucacgugccugaucugugccc

SEQ ID NO: 100537 - RNA, 22 nt, Human
caggcuggaaugcaguggcaca

SEQ ID NO: 100538 - RNA, 24 nt, Human
ggacacagccagccccuuccugcu

SEQ ID NO: 100539 - RNA, 21 nt, Human
gccccuuuaggaaauucaaag

SEQ ID NO: 100540 - RNA, 27 nt, Human
gucgcccuggcuggagugcaauggugu

SEQ ID NO: 100541 - RNA, 23 nt, Human
aaagcaauacuaggcugaaggag

SEQ ID NO: 100542 - RNA, 23 nt, Human
ggagauugaagccauagaacuca

SEQ ID NO: 100543 - RNA, 23 nt, Human
gcucaacaagaacgauucaccug

SEQ ID NO: 100544 - RNA, 27 nt, Human
cccuccuggcacaacgcucuacccugc

SEQ ID NO: 100545 - RNA, 23 nt, Human
ccucucugagaggagcagcagau

SEQ ID NO: 100546 - RNA, 24 nt, Human
ggugaguggguacagacuaggagg

SEQ ID NO: 100547 - RNA, 22 nt, Human
cugcuuugauuuuugaaguugg

SEQ ID NO: 100548 - RNA, 27 nt, Human
auaccugaggcaggaggugcagcgugu

SEQ ID NO: 100549 - RNA, 23 nt, Human
gccuuguuucaacaguuuuugcu

SEQ ID NO: 100550 - RNA, 21 nt, Human
cccaccccaccccugcuccca

SEQ ID NO: 100551 - RNA, 27 nt, Human
cgagaguuucuuccugggacuuuucgg

SEQ ID NO: 100552 - RNA, 21 nt, Human
acgccggccuagagugcggcg

SEQ ID NO: 100553 - RNA, 20 nt, Human
cucuaaugcaccugccucag

SEQ ID NO: 100554 - RNA, 19 nt, Human
ggcugccaggcugcagccu

SEQ ID NO: 100555 - RNA, 21 nt, Human
cauagcccagacacagaagag

SEQ ID NO: 100556 - RNA, 21 nt, Human
agucucccaagccaaaauuuu

SEQ ID NO: 100557 - RNA, 20 nt, Human
ggagauugaggcugcaguga

SEQ ID NO: 100558 - RNA, 26 nt, Human
agccgucagccaaauguaauugaaua

SEQ ID NO: 100559 - RNA, 27 nt, Human
caggcuggagugcaguggugccaucac

SEQ ID NO: 100560 - RNA, 22 nt, Human
gggaagggagggaggucuguuc

SEQ ID NO: 100561 - RNA, 20 nt, Human
cauaguuuguuaguacucug

SEQ ID NO: 100562 - RNA, 27 nt, Human
uuacccaggcuggucuucaacucuugg

SEQ ID NO: 100563 - RNA, 26 nt, Human
agggaaagacaagaugcaacuaggaa

SEQ ID NO: 100564 - RNA, 25 nt, Human
ggugugggagcagaggaauggaaac

SEQ ID NO: 100565 - RNA, 23 nt, Human
agaucagcuagacacacccagcc

SEQ ID NO: 100566 - RNA, 22 nt, Human
ccugcugcauuuuacccucauc

SEQ ID NO: 100567 - RNA, 28 nt, Human
uccggcauugagcugaguuggccucgcc

SEQ ID NO: 100568 - RNA, 21 nt, Human
agugucuucuuccugcccuca

SEQ ID NO: 100569 - RNA, 21 nt, Human
caacaaauuacauuagguuga

SEQ ID NO: 100570 - RNA, 22 nt, Human
acuguuggaaguucacacuggg

SEQ ID NO: 100571 - RNA, 21 nt, Human
gugcagcuuggauguggugcu

SEQ ID NO: 100572 - RNA, 21 nt, Human
gguuggaccccagagauuccc

SEQ ID NO: 100573 - RNA, 27 nt, Human
ccugguuuccugcccugggaggcagug

SEQ ID NO: 100574 - RNA, 22 nt, Human
cacgccuguggucucagcacuu

SEQ ID NO: 100575 - RNA, 20 nt, Human
uucaaggcaagcaccaccuu

SEQ ID NO: 100576 - RNA, 24 nt, Human
cucuagcuccucugugacucagag

SEQ ID NO: 100577 - RNA, 22 nt, Human
acggcacgcuccgccucccggg

SEQ ID NO: 100578 - RNA, 17 nt, Human
cuccuguuucugagguu

SEQ ID NO: 100579 - RNA, 21 nt, Human
gugaagccaaaagggaccagg

SEQ ID NO: 100580 - RNA, 26 nt, Human
agagugagaaagccgcgggcggcgac

SEQ ID NO: 100581 - RNA, 23 nt, Human
ucauuugauuuugcuugugcaga

SEQ ID NO: 100582 - RNA, 20 nt, Human
ugucucaaaauaaaaccaga

SEQ ID NO: 100583 - RNA, 21 nt, Human
cugcuuugaugugacauguga

SEQ ID NO: 100584 - RNA, 21 nt, Human
cuuucccucucccugugugcc

SEQ ID NO: 100585 - RNA, 24 nt, Human
cucauguguguagcuaagcuaccu

SEQ ID NO: 100586 - RNA, 26 nt, Human
aggagguggagguugcaguaagcuga

SEQ ID NO: 100587 - RNA, 23 nt, Human
cuacuucaaaccuuccucuagca

SEQ ID NO: 100588 - RNA, 25 nt, Human
gaccaaauccugccucauuaauuca

SEQ ID NO: 100589 - RNA, 19 nt, Human
ggcuuugcugagugaagga

SEQ ID NO: 100590 - RNA, 26 nt, Human
gaguuucuuucaguauguuauacaaa

SEQ ID NO: 100591 - RNA, 21 nt, Human
agaaauuuauaaaauguaaau

SEQ ID NO: 100592 - RNA, 21 nt, Human
uuuccugccaguucaggagag

SEQ ID NO: 100593 - RNA, 22 nt, Human
cugcuuguccaacaggguguca

SEQ ID NO: 100594 - RNA, 27 nt, Human
gcuugcugcuccugugcugcccuggcc

SEQ ID NO: 100595 - RNA, 19 nt, Human
gcucagccuccuucuuugc

SEQ ID NO: 100596 - RNA, 25 nt, Human
gucaacugacaguccaaaggcucca

SEQ ID NO: 100597 - RNA, 23 nt, Human
gucacucaaucuggaaugcagug

SEQ ID NO: 100598 - RNA, 26 nt, Human
cccaaguagcugggaccacaggcaug

SEQ ID NO: 100599 - RNA, 24 nt, Human
gcgcggccgaguccaucuccuggg

SEQ ID NO: 100600 - RNA, 26 nt, Human
gcucacugcaugaagacuggcuuguc

SEQ ID NO: 100601 - RNA, 26 nt, Human
uggcauagaguccuggcuucccgcag

SEQ ID NO: 100602 - RNA, 21 nt, Human
ggccucccgggcgcuuggauc

SEQ ID NO: 100603 - RNA, 20 nt, Human
gagcuuuccucuccucucuc

SEQ ID NO: 100604 - RNA, 25 nt, Human
uacugagucccuggcaagaccgucu

SEQ ID NO: 100605 - RNA, 24 nt, Human
ccccugccugggucuuagcauuga

SEQ ID NO: 100606 - RNA, 20 nt, Human
acuccugguccugcugucuu

SEQ ID NO: 100607 - RNA, 21 nt, Human
ucacagcaacucaccaugcca

SEQ ID NO: 100608 - RNA, 23 nt, Human
cauccgcaucuggagcaccaagg

SEQ ID NO: 100609 - RNA, 20 nt, Human
aguacuucuaagagcauaga

SEQ ID NO: 100610 - RNA, 21 nt, Human
ggaaaggggucggcugaccau

SEQ ID NO: 100611 - RNA, 24 nt, Human
gccgggucucccgcuuccuccucc

SEQ ID NO: 100612 - RNA, 26 nt, Human
auuaucucccccuaguuagagacagu

SEQ ID NO: 100613 - RNA, 20 nt, Human
cuccugagugcuugcuuuuc

SEQ ID NO: 100614 - RNA, 19 nt, Human
ugccaacucaaagugccuu

SEQ ID NO: 100615 - RNA, 25 nt, Human
ucugucucugcuuaucaccucucuu

SEQ ID NO: 100616 - RNA, 27 nt, Human
ccucuacuuuaacugugcucucaggug

SEQ ID NO: 100617 - RNA, 22 nt, Human
cgaccacagggucugcacucua

SEQ ID NO: 100618 - RNA, 23 nt, Human
caugcuguucugauagugaguga

SEQ ID NO: 100619 - RNA, 22 nt, Human
uagcucuggccaccagcugggc

SEQ ID NO: 100620 - RNA, 23 nt, Human
ggggaagagaaagcaggagccgu

SEQ ID NO: 100621 - RNA, 23 nt, Human
ugguuggugcuuucgcuuuugug

SEQ ID NO: 100622 - RNA, 22 nt, Human
ggagagaccuuuucugccugga

SEQ ID NO: 100623 - RNA, 26 nt, Human
uuugugcucaucagagaccccagccu

SEQ ID NO: 100624 - RNA, 24 nt, Human
ugccugagggauuaaaauggcagc

SEQ ID NO: 100625 - RNA, 23 nt, Human
gaugcuuagagacaggacaccug

SEQ ID NO: 100626 - RNA, 21 nt, Human
gggccuacucucagcugccua

SEQ ID NO: 100627 - RNA, 25 nt, Human
cauaaccuuuugggucaacuguugg

SEQ ID NO: 100628 - RNA, 20 nt, Human
uuacagaggcuggagcggug

SEQ ID NO: 100629 - RNA, 24 nt, Human
agagugcuggacuguuccaggccc

SEQ ID NO: 100630 - RNA, 19 nt, Human
cccugcucucucccgggcc

SEQ ID NO: 100631 - RNA, 27 nt, Human
gccuucucgcauuuucucuagcugauc

SEQ ID NO: 100632 - RNA, 23 nt, Human
gcggucugggcccaacacugcau

SEQ ID NO: 100633 - RNA, 22 nt, Human
auggaaacugaagcccagagag

SEQ ID NO: 100634 - RNA, 27 nt, Human
cccauaaguguaaaauaaaaguuuaca

SEQ ID NO: 100635 - RNA, 22 nt, Human
ucuccacugccuucgauacacc

SEQ ID NO: 100636 - RNA, 24 nt, Human
caaacaauguagcauaaaguggua

SEQ ID NO: 100637 - RNA, 20 nt, Human
gggggccuccugccugggca

SEQ ID NO: 100638 - RNA, 23 nt, Human
ggagacagaagucaggugucauc

SEQ ID NO: 100639 - RNA, 21 nt, Human
cuguaaaauauaaugaagcug

SEQ ID NO: 100640 - RNA, 17 nt, Human
auuauaaaaaugucaga

SEQ ID NO: 100641 - RNA, 20 nt, Human
agaaggagcacuaaauagcu

SEQ ID NO: 100642 - RNA, 25 nt, Human
gggccuuccauccuucauuguugaa

SEQ ID NO: 100643 - RNA, 22 nt, Human
agcuuuucuccucaugagcuga

SEQ ID NO: 100644 - RNA, 22 nt, Human
ccugugcagaccucccugcagg

SEQ ID NO: 100645 - RNA, 23 nt, Human
gcugcuuggcauaaugagccuca

SEQ ID NO: 100646 - RNA, 25 nt, Human
gcccaggcuggagugcaggggcgca

SEQ ID NO: 100647 - RNA, 21 nt, Human
ugugcaggcuguagugcagug

SEQ ID NO: 100648 - RNA, 21 nt, Human
uuccucacugaaggcugugag

SEQ ID NO: 100649 - RNA, 20 nt, Human
aacaaccagagaugacugaa

SEQ ID NO: 100650 - RNA, 20 nt, Human
ucggcuuccauaucuuccag

SEQ ID NO: 100651 - RNA, 26 nt, Human
gcugcucugugcucugcgugucccac

SEQ ID NO: 100652 - RNA, 21 nt, Human
auagcaucuauguuacacucu

SEQ ID NO: 100653 - RNA, 24 nt, Human
gacucuggacacugaacugacuuu

SEQ ID NO: 100654 - RNA, 23 nt, Human
gcucacucugcaaccuccacuuc

SEQ ID NO: 100655 - RNA, 26 nt, Human
agagaaacuucaaaguuaaugggaug

SEQ ID NO: 100656 - RNA, 23 nt, Human
ccaucaugccacaccgguacccu

SEQ ID NO: 100657 - RNA, 19 nt, Human
ccugcuuggcuucucugca

SEQ ID NO: 100658 - RNA, 18 nt, Human
ccccggggcauggcugcu

SEQ ID NO: 100659 - RNA, 21 nt, Human
cuauacugcugaguucugguc

SEQ ID NO: 100660 - RNA, 24 nt, Human
gaugaucuuugucugaauguaaua

SEQ ID NO: 100661 - RNA, 22 nt, Human
cacucugggcugggcugugaug

SEQ ID NO: 100662 - RNA, 25 nt, Human
cguucagcagacugguuugcaguga

SEQ ID NO: 100663 - RNA, 19 nt, Human
gccuguaauccaacauugg

SEQ ID NO: 100664 - RNA, 25 nt, Human
uuccacucccugcauggucaccuca

SEQ ID NO: 100665 - RNA, 23 nt, Human
ucauccagagcuggagugcagcg

SEQ ID NO: 100666 - RNA, 22 nt, Human
agaccagccugaccaacaugga

SEQ ID NO: 100667 - RNA, 23 nt, Human
cagaugggaagacaugaaugcac

SEQ ID NO: 100668 - RNA, 21 nt, Human
cagaagcagaguggguggugg

SEQ ID NO: 100669 - RNA, 27 nt, Human
ccuacuucuuuuauuccuccuuuuggu

SEQ ID NO: 100670 - RNA, 28 nt, Human
agggccacuggaugucugccuucuuggg

SEQ ID NO: 100671 - RNA, 22 nt, Human
uacaaguccccauugcuguggu

SEQ ID NO: 100672 - RNA, 22 nt, Human
uuuuccaggaaccuucuccugg

SEQ ID NO: 100673 - RNA, 24 nt, Human
gucucaugaaaaucaguacaauca

SEQ ID NO: 100674 - RNA, 21 nt, Human
accuggaggagagcaggcuag

SEQ ID NO: 100675 - RNA, 21 nt, Human
acucucugcugaccuccggcu

SEQ ID NO: 100676 - RNA, 22 nt, Human
ucaagauggugaaacuccgucu

SEQ ID NO: 100677 - RNA, 22 nt, Human
cacagcugcaggccacgcccag

SEQ ID NO: 100678 - RNA, 28 nt, Human
ugcuacacuccccucgcuaagacaguaa

SEQ ID NO: 100679 - RNA, 22 nt, Human
ggauccuaggcuuaucuccaca

SEQ ID NO: 100680 - RNA, 22 nt, Human
ggagggaauugagagucacaga

SEQ ID NO: 100681 - RNA, 25 nt, Human
cccacauuggcuggcaguagacaug

SEQ ID NO: 100682 - RNA, 23 nt, Human
ucccuguggccccacagcccccg

SEQ ID NO: 100683 - RNA, 24 nt, Human
cacauggaguuagucaaagcacaa

SEQ ID NO: 100684 - RNA, 22 nt, Human
uaggcagggacagucacaggaa

SEQ ID NO: 100685 - RNA, 30 nt, Human
gcuccccugcugaagguggggauugcccau

SEQ ID NO: 100686 - RNA, 23 nt, Human
cugccuggguccuggcgccuggc

SEQ ID NO: 100687 - RNA, 23 nt, Human
ggccucccaaaauugcugggauu

SEQ ID NO: 100688 - RNA, 22 nt, Human
gaguuguuucaauaaaggggcc

SEQ ID NO: 100689 - RNA, 26 nt, Human
gcaagcugaccgcacagcagucuggc

SEQ ID NO: 100690 - RNA, 17 nt, Human
acucuaaaaauguucua

SEQ ID NO: 100691 - RNA, 25 nt, Human
uagagaaguagugaccagaacaggg

SEQ ID NO: 100692 - RNA, 20 nt, Human
guuacccagggcucugcagc

SEQ ID NO: 100693 - RNA, 25 nt, Human
ggagguggcagcugugggaggaggc

SEQ ID NO: 100694 - RNA, 20 nt, Human
gcccccacuguccccaggcc

SEQ ID NO: 100695 - RNA, 25 nt, Human
uaggaaugaacugucugugaaaugu

SEQ ID NO: 100696 - RNA, 23 nt, Human
guuuucuggcccaggaguggggu

SEQ ID NO: 100697 - RNA, 22 nt, Human
ucgcuucuuugauacuuguagc

SEQ ID NO: 100698 - RNA, 22 nt, Human
cgcugcacuccagccuggggga

SEQ ID NO: 100699 - RNA, 23 nt, Human
aauucagagaaauggaguguuca

SEQ ID NO: 100700 - RNA, 26 nt, Human
gaggaggagccgugacccuguggaag

SEQ ID NO: 100701 - RNA, 26 nt, Human
cgcccgcggcucugaagccugagcgg

SEQ ID NO: 100702 - RNA, 24 nt, Human
gggugccuguaaucccaguuacuu

SEQ ID NO: 100703 - RNA, 22 nt, Human
gcuugugcgaggucucaggccu

SEQ ID NO: 100704 - RNA, 27 nt, Human
gccuccaccuccugugugauacuuggg

SEQ ID NO: 100705 - RNA, 21 nt, Human
guggggaagcaucauguaucu

SEQ ID NO: 100706 - RNA, 27 nt, Human
cuuacuuccucggggccugccuccccu

SEQ ID NO: 100707 - RNA, 26 nt, Human
uucuacccucuccuuaaacaucagaa

SEQ ID NO: 100708 - RNA, 22 nt, Human
aaaucagaguuaggaucuugua

SEQ ID NO: 100709 - RNA, 20 nt, Human
aguacaguucccaugaauuc

SEQ ID NO: 100710 - RNA, 23 nt, Human
cgcgcucugugggccucugaggg

SEQ ID NO: 100711 - RNA, 22 nt, Human
aggugggcggaucacgagguca

SEQ ID NO: 100712 - RNA, 25 nt, Human
gguucccaagacuucaguccugguc

SEQ ID NO: 100713 - RNA, 21 nt, Human
ugccuaugauaaauucacaua

SEQ ID NO: 100714 - RNA, 22 nt, Human
aaacccaagggcaggggccacu

SEQ ID NO: 100715 - RNA, 21 nt, Human
guauuauccuucuuauauuau

SEQ ID NO: 100716 - RNA, 19 nt, Human
accuggaauggaguccagu

SEQ ID NO: 100717 - RNA, 21 nt, Human
guuggguggaggauggacgag

SEQ ID NO: 100718 - RNA, 26 nt, Human
aaccaggucucucaaaagaaaggaca

SEQ ID NO: 100719 - RNA, 26 nt, Human
ucaccuaggcgcuagcaaacuucugc

SEQ ID NO: 100720 - RNA, 22 nt, Human
cgccuaggagugcugaccguga

SEQ ID NO: 100721 - RNA, 20 nt, Human
aagccucugccucccuagcu

SEQ ID NO: 100722 - RNA, 25 nt, Human
ggaucugaggcacaccagcagcaug

SEQ ID NO: 100723 - RNA, 21 nt, Human
ccagugcuuuccagccggguu

SEQ ID NO: 100724 - RNA, 25 nt, Human
guucuccaugugucggcaugucucu

SEQ ID NO: 100725 - RNA, 22 nt, Human
agcaucauuuccccaacagggc

SEQ ID NO: 100726 - RNA, 27 nt, Human
gcugcugcugcugcugccaguggccuc

SEQ ID NO: 100727 - RNA, 21 nt, Human
gccgcggccgccuccuccucc

SEQ ID NO: 100728 - RNA, 23 nt, Human
aacuuuuuuaugucucuuagagg

SEQ ID NO: 100729 - RNA, 28 nt, Human
gccaauccaagcauuuucuccugggacc

SEQ ID NO: 100730 - RNA, 27 nt, Human
uugcccaggcuggagugcaacggcacg

SEQ ID NO: 100731 - RNA, 20 nt, Human
gcauguauguacacucugaa

SEQ ID NO: 100732 - RNA, 21 nt, Human
cccuggagaaaauaaagagaa

SEQ ID NO: 100733 - RNA, 19 nt, Human
ugucuucuggaguugugac

SEQ ID NO: 100734 - RNA, 23 nt, Human
uucagcaaacucuuuucccacug

SEQ ID NO: 100735 - RNA, 25 nt, Human
gucauuuuucuuuaccuugaagaac

SEQ ID NO: 100736 - RNA, 22 nt, Human
gugagcagcaugggcuuugagg

SEQ ID NO: 100737 - RNA, 21 nt, Human
uggccuuugacugaaucagcc

SEQ ID NO: 100738 - RNA, 24 nt, Human
acagaggggagaggggccagggaa

SEQ ID NO: 100739 - RNA, 24 nt, Human
aucuuucaauaucauuacuaacuu

SEQ ID NO: 100740 - RNA, 23 nt, Human
cagugcuucccagagugagcuug

SEQ ID NO: 100741 - RNA, 26 nt, Human
auuguucaaaaauaaccuuuuugucu

SEQ ID NO: 100742 - RNA, 22 nt, Human
ugagugucccugaaaccauggc

SEQ ID NO: 100743 - RNA, 25 nt, Human
cgagggcggcugggagagcggucgg

SEQ ID NO: 100744 - RNA, 27 nt, Human
uuuaaggcuuuaaugguacugauuucu

SEQ ID NO: 100745 - RNA, 22 nt, Human
cacgccuguaaucccagcauuu

SEQ ID NO: 100746 - RNA, 22 nt, Human
ucacagaaaaaccaucccaccg

SEQ ID NO: 100747 - RNA, 24 nt, Human
uccccuuccauuagcagaaacucu

SEQ ID NO: 100748 - RNA, 20 nt, Human
cccugcccucuccuuccuua

SEQ ID NO: 100749 - RNA, 22 nt, Human
uggggcaccuugcuccuccuuc

SEQ ID NO: 100750 - RNA, 21 nt, Human
uugaagccugcuccuucccuu

SEQ ID NO: 100751 - RNA, 21 nt, Human
uucaaugcuaauuauagcucu

SEQ ID NO: 100752 - RNA, 22 nt, Human
cugccucucuaggaccaugguu

SEQ ID NO: 100753 - RNA, 22 nt, Human
ugcucuucucaaggugcacuga

SEQ ID NO: 100754 - RNA, 28 nt, Human
acccacaggcccagccuccucggucucc

SEQ ID NO: 100755 - RNA, 24 nt, Human
ucguuucuuuuaaaaaugauuugg

SEQ ID NO: 100756 - RNA, 25 nt, Human
cuucugcacucuggggaagaaggag

SEQ ID NO: 100757 - RNA, 20 nt, Human
uaaaugauguagaagguuua

SEQ ID NO: 100758 - RNA, 23 nt, Human
gccucucuuggacccugggagug

SEQ ID NO: 100759 - RNA, 25 nt, Human
uuacaagauccagacuugggccgag

SEQ ID NO: 100760 - RNA, 21 nt, Human
aaggaugcugaacuucuuuuc

SEQ ID NO: 100761 - RNA, 20 nt, Human
uguggugagcugggcgagcu

SEQ ID NO: 100762 - RNA, 22 nt, Human
gguuguuggagugguuggauuu

SEQ ID NO: 100763 - RNA, 17 nt, Human
cuucccuugcacaguuu

SEQ ID NO: 100764 - RNA, 22 nt, Human
ccuccaucuuggcccugauuca

SEQ ID NO: 100765 - RNA, 20 nt, Human
cuugguguguuugacagacu

SEQ ID NO: 100766 - RNA, 29 nt, Human
gcacacaguagaguaggugcucaauaaau

SEQ ID NO: 100767 - RNA, 22 nt, Human
aggccaaggcaggaggaucacu

SEQ ID NO: 100768 - RNA, 22 nt, Human
cucucacugucgcccaggcugg

SEQ ID NO: 100769 - RNA, 17 nt, Human
accaccuccagccuggg

SEQ ID NO: 100770 - RNA, 21 nt, Human
caguaagauuucucucaaaac

SEQ ID NO: 100771 - RNA, 21 nt, Human
accacaccagagccucagccu

SEQ ID NO: 100772 - RNA, 20 nt, Human
uuuccaaacuagcacauuug

SEQ ID NO: 100773 - RNA, 26 nt, Human
ucugguucuccucuuguacaccccuc

SEQ ID NO: 100774 - RNA, 22 nt, Human
ucugucccccaggcuggagugc

SEQ ID NO: 100775 - RNA, 23 nt, Human
aggugcaagcaggcacagaggug

SEQ ID NO: 100776 - RNA, 24 nt, Human
agcucugccucuggcuuuccgguc

SEQ ID NO: 100777 - RNA, 26 nt, Human
gucuugaauuccugaccuccugaccu

SEQ ID NO: 100778 - RNA, 26 nt, Human
ccuccagguuccuuaagcuuuuugcu

SEQ ID NO: 100779 - RNA, 21 nt, Human
ucuuauuaccucaauuuugga

SEQ ID NO: 100780 - RNA, 26 nt, Human
uugcccagggagaggcugcggcuccu

SEQ ID NO: 100781 - RNA, 26 nt, Human
ugagccaagaucgcaccauugcacuc

SEQ ID NO: 100782 - RNA, 21 nt, Human
accuuccgggcucaagcgauu

SEQ ID NO: 100783 - RNA, 23 nt, Human
ccgggagauggcgcuugcaguga

SEQ ID NO: 100784 - RNA, 21 nt, Human
agcuuacucaaccucugccuc

SEQ ID NO: 100785 - RNA, 20 nt, Human
gcgguauccaugauuuggcc

SEQ ID NO: 100786 - RNA, 22 nt, Human
gugggggccguguuuuguuugc

SEQ ID NO: 100787 - RNA, 24 nt, Human
aaaggagcugcaugcuucacugga

SEQ ID NO: 100788 - RNA, 23 nt, Human
cacaucccugaggccagagguca

SEQ ID NO: 100789 - RNA, 21 nt, Human
cccgccuuaugccucagucua

SEQ ID NO: 100790 - RNA, 26 nt, Human
guccguacuggaggcuagcucuuguc

SEQ ID NO: 100791 - RNA, 23 nt, Human
ccuuuggaggcaugguggaugaa

SEQ ID NO: 100792 - RNA, 27 nt, Human
ggagccccacagucagaauguuacuau

SEQ ID NO: 100793 - RNA, 27 nt, Human
ccauugcacuccagccugggcaacgag

SEQ ID NO: 100794 - RNA, 24 nt, Human
aagugcuuuugcuuacagcagaua

SEQ ID NO: 100795 - RNA, 26 nt, Human
aacaaccacauggauuuuuuauagga

SEQ ID NO: 100796 - RNA, 22 nt, Human
ugggcucugugcagucacugga

SEQ ID NO: 100797 - RNA, 23 nt, Human
cuucucuuagacuccuugucugc

SEQ ID NO: 100798 - RNA, 26 nt, Human
gcagaagacuuccuacaauggaaugc

SEQ ID NO: 100799 - RNA, 20 nt, Human
guuaauguucccaaaccaga

SEQ ID NO: 100800 - RNA, 26 nt, Human
agccugggugacagaaugaaacucca

SEQ ID NO: 100801 - RNA, 26 nt, Human
gcugcagagccugggcucagccccag

SEQ ID NO: 100802 - RNA, 19 nt, Human
auuaucuacaugauguuua

SEQ ID NO: 100803 - RNA, 22 nt, Human
cccaaacaguccacagguccca

SEQ ID NO: 100804 - RNA, 24 nt, Human
agggaggguggcagagacaguggg

SEQ ID NO: 100805 - RNA, 22 nt, Human
ugcuagugccaucguggugugu

SEQ ID NO: 100806 - RNA, 20 nt, Human
aaaaagaguauguguaccac

SEQ ID NO: 100807 - RNA, 27 nt, Human
agcaggaggagcaccgggcuugggcuu

SEQ ID NO: 100808 - RNA, 23 nt, Human
ggccagcauuagcagaacauaua

SEQ ID NO: 100809 - RNA, 22 nt, Human
ggaggggggccuggugccuggg

SEQ ID NO: 100810 - RNA, 29 nt, Human
gcuggcuaaccuccacuuccacauuccag

SEQ ID NO: 100811 - RNA, 28 nt, Human
ucucaaacuccugaccucaggcaaucug

SEQ ID NO: 100812 - RNA, 22 nt, Human
uugcucaggcuggaguacagug

SEQ ID NO: 100813 - RNA, 22 nt, Human
gacucacaaauccaaguucuua

SEQ ID NO: 100814 - RNA, 20 nt, Human
agggaauggcgauugaaaug

SEQ ID NO: 100815 - RNA, 27 nt, Human
gcuacagaucucucugcucaucaugcc

SEQ ID NO: 100816 - RNA, 20 nt, Human
cuccacccacccaccgggcu

SEQ ID NO: 100817 - RNA, 23 nt, Human
uuccucaagcugcaugcuuuuca

SEQ ID NO: 100818 - RNA, 20 nt, Human
ucacaugguuauuuuuuaaa

SEQ ID NO: 100819 - RNA, 24 nt, Human
ucacauuuucagaagccucuggaa

SEQ ID NO: 100820 - RNA, 22 nt, Human
gaagaugguggugagcugcaaa

SEQ ID NO: 100821 - RNA, 22 nt, Human
auuguggauaucuucugccuuc

SEQ ID NO: 100822 - RNA, 22 nt, Human
gacaagcuuuguagugaaguau

SEQ ID NO: 100823 - RNA, 24 nt, Human
cuucaaaacagagagccuuaaucu

SEQ ID NO: 100824 - RNA, 20 nt, Human
cugcugucuuggugccuguc

SEQ ID NO: 100825 - RNA, 21 nt, Human
ucccauuccucagcuucuuca

SEQ ID NO: 100826 - RNA, 26 nt, Human
acaggccaccuuccuucuggcaggga

SEQ ID NO: 100827 - RNA, 21 nt, Human
ugcugccuggacacacacuuc

SEQ ID NO: 100828 - RNA, 21 nt, Human
gaagggagaccuggcagugga

SEQ ID NO: 100829 - RNA, 26 nt, Human
auggguauuuaaacaauaaaugugca

SEQ ID NO: 100830 - RNA, 23 nt, Human
uugaauuuccuagaacagaagca

SEQ ID NO: 100831 - RNA, 18 nt, Human
agaaaaaauacauaaagg

SEQ ID NO: 100832 - RNA, 21 nt, Human
ucucuagcgccaauauuccca

SEQ ID NO: 100833 - RNA, 24 nt, Human
ccugcuucugcugcccugaugcgu

SEQ ID NO: 100834 - RNA, 23 nt, Human
cggcaucagaggauggagugguc

SEQ ID NO: 100835 - RNA, 21 nt, Human
cauuaugcaaaagcacaaaga

SEQ ID NO: 100836 - RNA, 27 nt, Human
gacucacaagcugguccuuggccaggu

SEQ ID NO: 100837 - RNA, 20 nt, Human
uuggccauauauuugcucaa

SEQ ID NO: 100838 - RNA, 27 nt, Human
cagaucucaucacuuugauuucuaauc

SEQ ID NO: 100839 - RNA, 24 nt, Human
ucacuuucuucuagcugagcuuua

SEQ ID NO: 100840 - RNA, 23 nt, Human
uccaggcccccagccccuccucc

SEQ ID NO: 100841 - RNA, 20 nt, Human
aggggggccuggugccuggg

SEQ ID NO: 100842 - RNA, 25 nt, Human
uugacucuugccugccuaacaaaau

SEQ ID NO: 100843 - RNA, 23 nt, Human
aaccugggaaagccaugaccuug

SEQ ID NO: 100844 - RNA, 23 nt, Human
cuacaaaaagaaggaguuuguga

SEQ ID NO: 100845 - RNA, 21 nt, Human
cuucccugacucccgagggcu

SEQ ID NO: 100846 - RNA, 26 nt, Human
cagacugccuggguccuggcgccugg

SEQ ID NO: 100847 - RNA, 21 nt, Human
aggcucugaaauagccacuuu

SEQ ID NO: 100848 - RNA, 27 nt, Human
uguuuuuauauuauacauuuucccacc

SEQ ID NO: 100849 - RNA, 28 nt, Human
ccauuagcauucugguuuugacaucagc

SEQ ID NO: 100850 - RNA, 24 nt, Human
ucagaacgcguggauucucuuuca

SEQ ID NO: 100851 - RNA, 22 nt, Human
aguggggcugcaggcaggcggc

SEQ ID NO: 100852 - RNA, 22 nt, Human
gcggguggaucaccugaggcca

SEQ ID NO: 100853 - RNA, 22 nt, Human
uaugccuuuugagcugucuuga

SEQ ID NO: 100854 - RNA, 20 nt, Human
accuggauaaaugauaaaaa

SEQ ID NO: 100855 - RNA, 24 nt, Human
uucuguccucuugccuuuuacuua

SEQ ID NO: 100856 - RNA, 21 nt, Human
gggaguggcguuuggcuugca

SEQ ID NO: 100857 - RNA, 24 nt, Human
cuguuaauagugguuuucugcagg

SEQ ID NO: 100858 - RNA, 27 nt, Human
uuucauaaccugccuccuuugcuuggc

SEQ ID NO: 100859 - RNA, 19 nt, Human
cucccacugcuacuacuuu

SEQ ID NO: 100860 - RNA, 22 nt, Human
cucuuucccucuccccgcugcc

SEQ ID NO: 100861 - RNA, 22 nt, Human
gacuacaggugcacgccaccac

SEQ ID NO: 100862 - RNA, 22 nt, Human
gacuacaggugcaugccaccau

SEQ ID NO: 100863 - RNA, 24 nt, Human
agguugagaaugcagugagcuugu

SEQ ID NO: 100864 - RNA, 20 nt, Human
uuuauugguuaaacuccuuu

SEQ ID NO: 100865 - RNA, 27 nt, Human
gagcccauggggccugaaaggcaucug

SEQ ID NO: 100866 - RNA, 25 nt, Human
augggagaugucugugcuuggaggu

SEQ ID NO: 100867 - RNA, 25 nt, Human
ccaggcauccaucuuggaagaaagg

SEQ ID NO: 100868 - RNA, 21 nt, Human
gacauaguggccucugggcug

SEQ ID NO: 100869 - RNA, 21 nt, Human
cucaaacaaaucagauuuauu

SEQ ID NO: 100870 - RNA, 26 nt, Human
gucugcacugcaacuucuguauccuu

SEQ ID NO: 100871 - RNA, 22 nt, Human
ugacugccucuaugauugcggc

SEQ ID NO: 100872 - RNA, 21 nt, Human
uuccaagaagccaaccaccuu

SEQ ID NO: 100873 - RNA, 24 nt, Human
uuguccagcuuuuuauuccaguca

SEQ ID NO: 100874 - RNA, 26 nt, Human
guucccaggcuggggaugcuuugccu

SEQ ID NO: 100875 - RNA, 32 nt, Human
cccaggcuggagugcaguagugcagucguggc

SEQ ID NO: 100876 - RNA, 23 nt, Human
gcacaggcaagacuugcuucagc

SEQ ID NO: 100877 - RNA, 21 nt, Human
agucaggacugcucccggggg

SEQ ID NO: 100878 - RNA, 22 nt, Human
gcucacgccuguaauccaagca

SEQ ID NO: 100879 - RNA, 20 nt, Human
cgaggccaggaaggccgggc

SEQ ID NO: 100880 - RNA, 20 nt, Human
agacagucuucuacuuucua

SEQ ID NO: 100881 - RNA, 27 nt, Human
ggcaaagcuuuuaaccuaucuuacaac

SEQ ID NO: 100882 - RNA, 27 nt, Human
ggcagaagcugggagccucccuucccu

SEQ ID NO: 100883 - RNA, 22 nt, Human
ugggagggacagggcuugggga

SEQ ID NO: 100884 - RNA, 25 nt, Human
cuuuccuauucucaggcuguucuga

SEQ ID NO: 100885 - RNA, 19 nt, Human
caccacugagcagcauggg

SEQ ID NO: 100886 - RNA, 28 nt, Human
ccugccccucaccugccugcccuccccu

SEQ ID NO: 100887 - RNA, 22 nt, Human
ggcuuggggugucauucugccu

SEQ ID NO: 100888 - RNA, 24 nt, Human
cucaaacucccaggcucaagggau

SEQ ID NO: 100889 - RNA, 24 nt, Human
ucacuaaaauguuaucuucaagag

SEQ ID NO: 100890 - RNA, 20 nt, Human
cuauuuuuccuuucucugua

SEQ ID NO: 100891 - RNA, 20 nt, Human
acuaacacucccccuccucc

SEQ ID NO: 100892 - RNA, 17 nt, Human
cuuacccccucuucuau

SEQ ID NO: 100893 - RNA, 22 nt, Human
caccauugcacugcagccuggg

SEQ ID NO: 100894 - RNA, 23 nt, Human
cugaggggacagggaggagcaga

SEQ ID NO: 100895 - RNA, 23 nt, Human
gauggccggggaaggcucuagaa

SEQ ID NO: 100896 - RNA, 26 nt, Human
agaggugcuuuuuaaaaauccaauag

SEQ ID NO: 100897 - RNA, 28 nt, Human
gggggcauuaugggcccugccuccccau

SEQ ID NO: 100898 - RNA, 23 nt, Human
gccaccccaugcugcugcugccu

SEQ ID NO: 100899 - RNA, 20 nt, Human
cugccuuccuccugccugua

SEQ ID NO: 100900 - RNA, 19 nt, Human
ccuaggcuggagugcagug

SEQ ID NO: 100901 - RNA, 27 nt, Human
gugccuggagugauguuuaagccaaug

SEQ ID NO: 100902 - RNA, 20 nt, Human
ccuucagauuaaugacuggc

SEQ ID NO: 100903 - RNA, 20 nt, Human
cgcagccgccggccggccag

SEQ ID NO: 100904 - RNA, 26 nt, Human
ucuucuuuuugcuguuguuucuaaac

SEQ ID NO: 100905 - RNA, 27 nt, Human
guaacauccuccucuggauaacuugac

SEQ ID NO: 100906 - RNA, 27 nt, Human
uuucccaggacucuccccaucuccaga

SEQ ID NO: 100907 - RNA, 27 nt, Human
agcacuuucauggcugcccucuggcag

SEQ ID NO: 100908 - RNA, 23 nt, Human
gcucuuugacucccagaagguac

SEQ ID NO: 100909 - RNA, 23 nt, Human
ugaguagcugggauuacaggcuc

SEQ ID NO: 100910 - RNA, 21 nt, Human
aagaugaugcauaaagcugug

SEQ ID NO: 100911 - RNA, 22 nt, Human
caacaaagugagacuccaucuc

SEQ ID NO: 100912 - RNA, 24 nt, Human
cuuauuucucaaaaaagagggaca

SEQ ID NO: 100913 - RNA, 22 nt, Human
cugaugccauugugugcugccu

SEQ ID NO: 100914 - RNA, 22 nt, Human
cccggugaccgcgcggauucag

SEQ ID NO: 100915 - RNA, 23 nt, Human
cugucuccagcucucuccaggac

SEQ ID NO: 100916 - RNA, 19 nt, Human
ccaauuuacugacacuguc

SEQ ID NO: 100917 - RNA, 24 nt, Human
uccaaauagccauacuuagccuca

SEQ ID NO: 100918 - RNA, 24 nt, Human
gacauguucuuuggucaacagcca

SEQ ID NO: 100919 - RNA, 22 nt, Human
gaaccuguuucuuacagcuuuu

SEQ ID NO: 100920 - RNA, 21 nt, Human
agcuggcauccugagcuccuc

SEQ ID NO: 100921 - RNA, 23 nt, Human
ccgcugcucgcccgcccugggug

SEQ ID NO: 100922 - RNA, 23 nt, Human
uucugcuggacagauaaugggcc

SEQ ID NO: 100923 - RNA, 21 nt, Human
acacacagacuccuacuccau

SEQ ID NO: 100924 - RNA, 20 nt, Human
ggcggaggagguugcaguga

SEQ ID NO: 100925 - RNA, 26 nt, Human
cuucaguuccccaggagggcaauggc

SEQ ID NO: 100926 - RNA, 23 nt, Human
aaccuugacagaaaacuacuuug

SEQ ID NO: 100927 - RNA, 27 nt, Human
auauacugcuauuuacacuauuauuuc

SEQ ID NO: 100928 - RNA, 26 nt, Human
ugcuccugccuaugcuccugggauac

SEQ ID NO: 100929 - RNA, 21 nt, Human
caugccccuccuaacuccaca

SEQ ID NO: 100930 - RNA, 26 nt, Human
uuaaggcuucucccaacccauggcgc

SEQ ID NO: 100931 - RNA, 21 nt, Human
ugucuuggcugucauaacuuu

SEQ ID NO: 100932 - RNA, 20 nt, Human
gcuucuuucugggcagccag

SEQ ID NO: 100933 - RNA, 27 nt, Human
ggccagccugggaaacauggcaaaauc

SEQ ID NO: 100934 - RNA, 21 nt, Human
ggagguggcggcggcagcggc

SEQ ID NO: 100935 - RNA, 23 nt, Human
ucuccacccacucacauuccguc

SEQ ID NO: 100936 - RNA, 23 nt, Human
cccgagcuaccaggagagcccug

SEQ ID NO: 100937 - RNA, 20 nt, Human
cugguacauuggagaaaaau

SEQ ID NO: 100938 - RNA, 27 nt, Human
gaaacauuuaaauuuuacccuuuagac

SEQ ID NO: 100939 - RNA, 26 nt, Human
ugcaguuaucauagagcacagucccu

SEQ ID NO: 100940 - RNA, 25 nt, Human
guggggagggggcagaccugggggc

SEQ ID NO: 100941 - RNA, 30 nt, Human
aucccuguccccagggagggugggagccgu

SEQ ID NO: 100942 - RNA, 20 nt, Human
cugugguuugucacucugaa

SEQ ID NO: 100943 - RNA, 22 nt, Human
gcauuucucaagaccugacuua

SEQ ID NO: 100944 - RNA, 26 nt, Human
ccagccugggcagcauagugugagac

SEQ ID NO: 100945 - RNA, 22 nt, Human
ggccagaagcaggagugugagg

SEQ ID NO: 100946 - RNA, 23 nt, Human
agucagcuuggaucauucaccuu

SEQ ID NO: 100947 - RNA, 24 nt, Human
cucuguuugcugccuuccuggcca

SEQ ID NO: 100948 - RNA, 27 nt, Human
ccacugugcuccagccugggcaacaaa

SEQ ID NO: 100949 - RNA, 27 nt, Human
ccauggagaaagcugacuuggcuggug

SEQ ID NO: 100950 - RNA, 22 nt, Human
ccuuaauggacaucaucggcug

SEQ ID NO: 100951 - RNA, 23 nt, Human
cucucugccuccuccugccuguc

SEQ ID NO: 100952 - RNA, 20 nt, Human
agaagccaggaaggcugugc

SEQ ID NO: 100953 - RNA, 17 nt, Human
aggucucucucuucuug

SEQ ID NO: 100954 - RNA, 23 nt, Human
cugagucuauccaagaggcuuug

SEQ ID NO: 100955 - RNA, 22 nt, Human
ucacaaaccacaggacgcugca

SEQ ID NO: 100956 - RNA, 21 nt, Human
cagggguccagggugcaguga

SEQ ID NO: 100957 - RNA, 21 nt, Human
auucagaaaaccugugucaca

SEQ ID NO: 100958 - RNA, 22 nt, Human
guugggggaaaauagcauuuaa

SEQ ID NO: 100959 - RNA, 24 nt, Human
uucuacuguccucuuccccuuggc

SEQ ID NO: 100960 - RNA, 23 nt, Human
cucggaggcucaggucaagugca

SEQ ID NO: 100961 - RNA, 21 nt, Human
aggguccagucauucaccagc

SEQ ID NO: 100962 - RNA, 22 nt, Human
gcccaggcuggagugcauuggc

SEQ ID NO: 100963 - RNA, 22 nt, Human
caccuccuggguugaagugauu

SEQ ID NO: 100964 - RNA, 27 nt, Human
cagguaccuagcagaggcugucagucc

SEQ ID NO: 100965 - RNA, 23 nt, Human
uuugcuagauuucuaaagaaugu

SEQ ID NO: 100966 - RNA, 22 nt, Human
caguccuucuacuguccuggcu

SEQ ID NO: 100967 - RNA, 23 nt, Human
cuccagccuaggugguucaccuu

SEQ ID NO: 100968 - RNA, 26 nt, Human
uugagacuuauuuuugcccuaaaacg

SEQ ID NO: 100969 - RNA, 25 nt, Human
cggagccuccucucucaaacugggg

SEQ ID NO: 100970 - RNA, 21 nt, Human
gauacuuucugucaaaaauca

SEQ ID NO: 100971 - RNA, 20 nt, Human
gggcucugcagaacauauca

SEQ ID NO: 100972 - RNA, 21 nt, Human
agccucugcuggagugcagug

SEQ ID NO: 100973 - RNA, 21 nt, Human
gacccuggguuuugcucucag

SEQ ID NO: 100974 - RNA, 24 nt, Human
gccuuucuugugaccaucagggcc

SEQ ID NO: 100975 - RNA, 24 nt, Human
gcucuccguggaguggacucgagu

SEQ ID NO: 100976 - RNA, 27 nt, Human
acugaccuaugcucuaaaacaugaaug

SEQ ID NO: 100977 - RNA, 27 nt, Human
ccacugcacuccagccugggcagcuga

SEQ ID NO: 100978 - RNA, 20 nt, Human
ggccaaaaagccugaccuca

SEQ ID NO: 100979 - RNA, 19 nt, Human
gagagugaaagagaaaaga

SEQ ID NO: 100980 - RNA, 24 nt, Human
agcaugcccagguuccuugcugac

SEQ ID NO: 100981 - RNA, 26 nt, Human
aggaugugugaaguuuggaaaaauau

SEQ ID NO: 100982 - RNA, 22 nt, Human
cagagguggguauggcaauuag

SEQ ID NO: 100983 - RNA, 23 nt, Human
uuauuaaaucacuguucucccca

SEQ ID NO: 100984 - RNA, 18 nt, Human
ggggguagaaggcaguga

SEQ ID NO: 100985 - RNA, 23 nt, Human
cauugagaggugggaggaagucc

SEQ ID NO: 100986 - RNA, 23 nt, Human
cagguggagguugcuagucuagu

SEQ ID NO: 100987 - RNA, 26 nt, Human
caggaggcaugggauagcaggucugg

SEQ ID NO: 100988 - RNA, 27 nt, Human
gagcccaggccuugcuaugaagcagug

SEQ ID NO: 100989 - RNA, 22 nt, Human
ccagcauggcgaaaccccaucu

SEQ ID NO: 100990 - RNA, 21 nt, Human
ucuuuuuucuuuuugugagac

SEQ ID NO: 100991 - RNA, 20 nt, Human
ucucaauaaaaagaaaaugu

SEQ ID NO: 100992 - RNA, 23 nt, Human
ucuuuauuuucuuauucauuugc

SEQ ID NO: 100993 - RNA, 26 nt, Human
uccuuugacaggcgacaaacuacugu

SEQ ID NO: 100994 - RNA, 19 nt, Human
agugaaagcugugguagag

SEQ ID NO: 100995 - RNA, 27 nt, Human
ucacucucugggggagugcagggugga

SEQ ID NO: 100996 - RNA, 18 nt, Human
cauuucugggccaccuca

SEQ ID NO: 100997 - RNA, 23 nt, Human
aaauguuuagaguguuuuaguuu

SEQ ID NO: 100998 - RNA, 22 nt, Human
gcuacagagcagggaagggaag

SEQ ID NO: 100999 - RNA, 25 nt, Human
cccaccuugaaagcagcauacaggg

SEQ ID NO: 101000 - RNA, 23 nt, Human
aguucugaauucccaagcugccu

SEQ ID NO: 101001 - RNA, 19 nt, Human
cucuucucauccuuccuca

SEQ ID NO: 101002 - RNA, 26 nt, Human
ucuccugccucagcuccugaguagcu

SEQ ID NO: 101003 - RNA, 28 nt, Human
cucugcuucuccccugugggaaguuguc

SEQ ID NO: 101004 - RNA, 23 nt, Human
agguucuggaaagaaagagagag

SEQ ID NO: 101005 - RNA, 22 nt, Human
acugcucucccucagcugggcu

SEQ ID NO: 101006 - RNA, 22 nt, Human
gaaccagggagguagagguugc

SEQ ID NO: 101007 - RNA, 21 nt, Human
gcaaacacauuucauugugag

SEQ ID NO: 101008 - RNA, 21 nt, Human
guggcagaaaggucugaacag

SEQ ID NO: 101009 - RNA, 21 nt, Human
agucucaggccacaauggggu

SEQ ID NO: 101010 - RNA, 25 nt, Human
agaugccaacuucacagacacgucu

SEQ ID NO: 101011 - RNA, 22 nt, Human
gagcauguuuaauaaguuuacu

SEQ ID NO: 101012 - RNA, 22 nt, Human
ggcucgcugcaaccucugacuc

SEQ ID NO: 101013 - RNA, 21 nt, Human
ucacaggugucagccauugca

SEQ ID NO: 101014 - RNA, 27 nt, Human
gagauccaaguugaaauucagaagccu

SEQ ID NO: 101015 - RNA, 24 nt, Human
gauggcuguaucucccuucacugu

SEQ ID NO: 101016 - RNA, 22 nt, Human
gaacuucugagcucaagcgauc

SEQ ID NO: 101017 - RNA, 22 nt, Human
caguucugcugacacuuuggcc

SEQ ID NO: 101018 - RNA, 25 nt, Human
uaccuauaccuaugugaaacucuau

SEQ ID NO: 101019 - RNA, 24 nt, Human
auaaaugcucagugcucaggaucu

SEQ ID NO: 101020 - RNA, 18 nt, Human
ccgcagucucacucugaa

SEQ ID NO: 101021 - RNA, 27 nt, Human
gaaacauuuguugauuuugugugaaug

SEQ ID NO: 101022 - RNA, 22 nt, Human
cacguagcugcucacaccagcc

SEQ ID NO: 101023 - RNA, 24 nt, Human
ggcucuucugauuggccgguguac

SEQ ID NO: 101024 - RNA, 23 nt, Human
uuccugacuauuaaaaauaaaua

SEQ ID NO: 101025 - RNA, 21 nt, Human
agaggauccaucacagacgga

SEQ ID NO: 101026 - RNA, 20 nt, Human
ccuaccgcuggcccugccgu

SEQ ID NO: 101027 - RNA, 27 nt, Human
uccugcaggaggauguagcgccucagu

SEQ ID NO: 101028 - RNA, 24 nt, Human
agucuuacagaggcuggagcggug

SEQ ID NO: 101029 - RNA, 18 nt, Human
ugaguauugagacugagg

SEQ ID NO: 101030 - RNA, 20 nt, Human
ucucccugcaaccuccgccu

SEQ ID NO: 101031 - RNA, 20 nt, Human
gucaaugaauuuugcuuggu

SEQ ID NO: 101032 - RNA, 21 nt, Human
ggcucaccacaaccucugccu

SEQ ID NO: 101033 - RNA, 22 nt, Human
uggcggcagugacaggaggcgc

SEQ ID NO: 101034 - RNA, 22 nt, Human
cgccuguaaucccagcaauuug

SEQ ID NO: 101035 - RNA, 25 nt, Human
uccgaacaucguggagcugaaggag

SEQ ID NO: 101036 - RNA, 21 nt, Human
aacaugggcagcuuccuucag

SEQ ID NO: 101037 - RNA, 23 nt, Human
aauuagggguccuucagucuugg

SEQ ID NO: 101038 - RNA, 20 nt, Human
ccuccaccccagccugcugc

SEQ ID NO: 101039 - RNA, 23 nt, Human
ugggggagggggacggugaaggc

SEQ ID NO: 101040 - RNA, 25 nt, Human
gggguggugggggucagguggacuc

SEQ ID NO: 101041 - RNA, 20 nt, Human
gggcucagguauugagccug

SEQ ID NO: 101042 - RNA, 27 nt, Human
ccaaccaagagcacauucuuaaaggaa

SEQ ID NO: 101043 - RNA, 31 nt, Human
cauccauucggcuucaccugcagccaacggc

SEQ ID NO: 101044 - RNA, 22 nt, Human
acuugcugugugaccucaggcc

SEQ ID NO: 101045 - RNA, 23 nt, Human
gucgcccaggcuggggugcagug

SEQ ID NO: 101046 - RNA, 20 nt, Human
auacucuucucaguuuguga

SEQ ID NO: 101047 - RNA, 22 nt, Human
gccuguggccccaggcacuuug

SEQ ID NO: 101048 - RNA, 23 nt, Human
agccucccuuugugcuugggauu

SEQ ID NO: 101049 - RNA, 24 nt, Human
aguaagcuagccagaguuuucuca

SEQ ID NO: 101050 - RNA, 22 nt, Human
auuacaguuuacguccauucca

SEQ ID NO: 101051 - RNA, 24 nt, Human
cucugccucaguaaguaucuggag

SEQ ID NO: 101052 - RNA, 21 nt, Human
auccugagcuuuucuccucau

SEQ ID NO: 101053 - RNA, 22 nt, Human
ggggccugggcaggagggaggu

SEQ ID NO: 101054 - RNA, 21 nt, Human
ggccuauuaaacaugacguua

SEQ ID NO: 101055 - RNA, 27 nt, Human
gcauccucuaccucucagcugcugaaa

SEQ ID NO: 101056 - RNA, 31 nt, Human
uuuucuaggaguuacacauacauuuuauccu

SEQ ID NO: 101057 - RNA, 22 nt, Human
uguccaucaggaaauucacaca

SEQ ID NO: 101058 - RNA, 23 nt, Human
ggaaccucacaagccucagcaaa

SEQ ID NO: 101059 - RNA, 22 nt, Human
cuuuccgguaucuauuuuugcc

SEQ ID NO: 101060 - RNA, 22 nt, Human
gcucacugcagccuccaucucc

SEQ ID NO: 101061 - RNA, 16 nt, Human
accuaaaaauguugua

SEQ ID NO: 101062 - RNA, 26 nt, Human
cuacuuucuuuuucccugagaauaaa

SEQ ID NO: 101063 - RNA, 24 nt, Human
aggcagcggaaggcggcagaggcu

SEQ ID NO: 101064 - RNA, 22 nt, Human
cagacccuuuggcuuugcugag

SEQ ID NO: 101065 - RNA, 19 nt, Human
ucauggcucacugcagccu

SEQ ID NO: 101066 - RNA, 19 nt, Human
ugcugaauucuguuccacu

SEQ ID NO: 101067 - RNA, 21 nt, Human
ccuugaaaguauuauccacug

SEQ ID NO: 101068 - RNA, 21 nt, Human
gugucuggagaauagucucau

SEQ ID NO: 101069 - RNA, 24 nt, Human
uuuuuuauuggagugaauucucgu

SEQ ID NO: 101070 - RNA, 23 nt, Human
gccuuucuaucuguccgucgguc

SEQ ID NO: 101071 - RNA, 22 nt, Human
caaauuucgagcauaagaaaua

SEQ ID NO: 101072 - RNA, 21 nt, Human
aagcggaaacaaaaccuucac

SEQ ID NO: 101073 - RNA, 25 nt, Human
ccggugucuugggagcagugccccg

SEQ ID NO: 101074 - RNA, 23 nt, Human
agggaggagaagagggacuccag

SEQ ID NO: 101075 - RNA, 26 nt, Human
cagcucccagccuaggcccuuaaucu

SEQ ID NO: 101076 - RNA, 27 nt, Human
ucuuccagcaaggaacgcaccgaaaag

SEQ ID NO: 101077 - RNA, 21 nt, Human
ugggcugacugggcagaggaa

SEQ ID NO: 101078 - RNA, 32 nt, Human
ggcccauggccuugggcucugauuggcuggau

SEQ ID NO: 101079 - RNA, 21 nt, Human
ggcaggaugaaggcagagcgu

SEQ ID NO: 101080 - RNA, 22 nt, Human
cagccucuuccucggcuucucc

SEQ ID NO: 101081 - RNA, 21 nt, Human
uuguaaccacccuuuucuaac

SEQ ID NO: 101082 - RNA, 20 nt, Human
cccuauacauccacaggguu

SEQ ID NO: 101083 - RNA, 24 nt, Human
ccuggugcuugcccagcuuuuuga

SEQ ID NO: 101084 - RNA, 21 nt, Human
ugaugccugcaaaagccauuu

SEQ ID NO: 101085 - RNA, 27 nt, Human
ggaauucugccuaaguugucugccuuu

SEQ ID NO: 101086 - RNA, 19 nt, Human
uaggaccuguggcagacca

SEQ ID NO: 101087 - RNA, 27 nt, Human
ucacagaugcuaucauagcacacuaca

SEQ ID NO: 101088 - RNA, 27 nt, Human
agcuagcgucccuacugccucccgacu

SEQ ID NO: 101089 - RNA, 22 nt, Human
ugggcacaggcccucaagagcc

SEQ ID NO: 101090 - RNA, 18 nt, Human
gggcucgggauccgccca

SEQ ID NO: 101091 - RNA, 27 nt, Human
ugcccugccucaguuuaccugcacaug

SEQ ID NO: 101092 - RNA, 21 nt, Human
uuugcaucauuacugccuuca

SEQ ID NO: 101093 - RNA, 25 nt, Human
gcagcuuccagccugggucagaagg

SEQ ID NO: 101094 - RNA, 22 nt, Human
cgcccaacaugcagaacaugaa

SEQ ID NO: 101095 - RNA, 20 nt, Human
ggaggcugaggggaggauca

SEQ ID NO: 101096 - RNA, 18 nt, Human
agaugaucuucuacugaa

SEQ ID NO: 101097 - RNA, 24 nt, Human
ggcauguaggagggaggugggugg

SEQ ID NO: 101098 - RNA, 21 nt, Human
uucaggucacaaacugucuuu

SEQ ID NO: 101099 - RNA, 24 nt, Human
ucuuggcuccucuccccuuguucc

SEQ ID NO: 101100 - RNA, 27 nt, Human
augccccaguucuaagcccuguggcca

SEQ ID NO: 101101 - RNA, 22 nt, Human
gucuuagcucacaugcacugag

SEQ ID NO: 101102 - RNA, 20 nt, Human
uaaugguuaaccugauagaa

SEQ ID NO: 101103 - RNA, 21 nt, Human
cugucucuacuaaaaaugcaa

SEQ ID NO: 101104 - RNA, 32 nt, Human
ccgugccuuagucuucuccacucugcacccua

SEQ ID NO: 101105 - RNA, 22 nt, Human
ccccagucuuuggguggugcug

SEQ ID NO: 101106 - RNA, 27 nt, Human
cucuggcccgauuuaucauaucccuuu

SEQ ID NO: 101107 - RNA, 23 nt, Human
uggucaguuugaggggagccgcu

SEQ ID NO: 101108 - RNA, 20 nt, Human
uuuuaaagccucuucaucca

SEQ ID NO: 101109 - RNA, 26 nt, Human
gccuguaauccaagcacuuggggagg

SEQ ID NO: 101110 - RNA, 22 nt, Human
ccguugugcuccagccugggcg

SEQ ID NO: 101111 - RNA, 19 nt, Human
cccauaccagaaaaauuac

SEQ ID NO: 101112 - RNA, 22 nt, Human
gcccggcugauaaagcacuuuc

SEQ ID NO: 101113 - RNA, 20 nt, Human
cacagaauaaucaggaaaag

SEQ ID NO: 101114 - RNA, 23 nt, Human
agccaccucuccauccuggggcc

SEQ ID NO: 101115 - RNA, 27 nt, Human
caugcacgcauacucugaacauccuug

SEQ ID NO: 101116 - RNA, 21 nt, Human
ccuguaguguaccauucucag

SEQ ID NO: 101117 - RNA, 22 nt, Human
agccuccuucacucccuuguuu

SEQ ID NO: 101118 - RNA, 20 nt, Human
agcaggcucagacucugggu

SEQ ID NO: 101119 - RNA, 23 nt, Human
cccuccucugaaagccuggacug

SEQ ID NO: 101120 - RNA, 26 nt, Human
uccaggcgugagaguguucucuuggg

SEQ ID NO: 101121 - RNA, 26 nt, Human
guggggugccugggacgcugcuugcc

SEQ ID NO: 101122 - RNA, 23 nt, Human
uggccaggcugguggugagcucc

SEQ ID NO: 101123 - RNA, 23 nt, Human
aaucaugguuguagugauguugu

SEQ ID NO: 101124 - RNA, 22 nt, Human
cucuucuguggucucuccccug

SEQ ID NO: 101125 - RNA, 22 nt, Human
uugguuuuguuuuaaaauagcu

SEQ ID NO: 101126 - RNA, 21 nt, Human
uccgcaccggguuccuccucc

SEQ ID NO: 101127 - RNA, 21 nt, Human
cucagcuucccgaguaacuga

SEQ ID NO: 101128 - RNA, 26 nt, Human
cauggaacuaauuuccccaacaguga

SEQ ID NO: 101129 - RNA, 27 nt, Human
ccuaaaaugauagccacaagcagauua

SEQ ID NO: 101130 - RNA, 27 nt, Human
cucagauggaaggacaagugaugggga

SEQ ID NO: 101131 - RNA, 23 nt, Human
uguugacauucugaaugcuucua

SEQ ID NO: 101132 - RNA, 24 nt, Human
gagauacagacagggcggucugga

SEQ ID NO: 101133 - RNA, 27 nt, Human
uuaucugaaacuucccaacuucccuga

SEQ ID NO: 101134 - RNA, 23 nt, Human
uuucagcuccucuccacucugcu

SEQ ID NO: 101135 - RNA, 24 nt, Human
gcucuggugcugcaguauguugcc

SEQ ID NO: 101136 - RNA, 23 nt, Human
gcugugguaugaauucacccgaa

SEQ ID NO: 101137 - RNA, 22 nt, Human
gacuagggggagggggcuuccc

SEQ ID NO: 101138 - RNA, 21 nt, Human
uccucauuccuuuugagaaca

SEQ ID NO: 101139 - RNA, 20 nt, Human
cugagccuugcaucucucca

SEQ ID NO: 101140 - RNA, 27 nt, Human
agcaguuucaaacucuaccauggauaa

SEQ ID NO: 101141 - RNA, 23 nt, Human
uccaggggacacagcucccccuc

SEQ ID NO: 101142 - RNA, 23 nt, Human
acugggaaggccagguaacucua

SEQ ID NO: 101143 - RNA, 18 nt, Human
uccuggcuaagaucaugu

SEQ ID NO: 101144 - RNA, 25 nt, Human
uugggcucaggaacugcagggacgu

SEQ ID NO: 101145 - RNA, 21 nt, Human
agcuggguuuacugugauuca

SEQ ID NO: 101146 - RNA, 21 nt, Human
cagugacuccggcagcggcga

SEQ ID NO: 101147 - RNA, 26 nt, Human
ugagccaagaucacgccauugcacuc

SEQ ID NO: 101148 - RNA, 27 nt, Human
gaaugucacguuuuugagaagauaguc

SEQ ID NO: 101149 - RNA, 23 nt, Human
ugaagaagaaacugagcaguuga

SEQ ID NO: 101150 - RNA, 25 nt, Human
uucacaccaccugcuuuucuauuca

SEQ ID NO: 101151 - RNA, 24 nt, Human
cauguaaacagcuaacuguuuuug

SEQ ID NO: 101152 - RNA, 22 nt, Human
uccaaaagccaccuccuccucc

SEQ ID NO: 101153 - RNA, 27 nt, Human
cuugcagcuuucccuacuccugcccca

SEQ ID NO: 101154 - RNA, 22 nt, Human
guacauacuagaaaauacagcu

SEQ ID NO: 101155 - RNA, 20 nt, Human
agcauugacagaauaucuua

SEQ ID NO: 101156 - RNA, 26 nt, Human
aggaagagacuacuuggugccauggg

SEQ ID NO: 101157 - RNA, 23 nt, Human
auccucuucucaaagcugggauu

SEQ ID NO: 101158 - RNA, 20 nt, Human
augggcagaggagacaggaa

SEQ ID NO: 101159 - RNA, 21 nt, Human
ugcuaacuguggucuuugugg

SEQ ID NO: 101160 - RNA, 27 nt, Human
ccugguggcagaggucccucagcugcg

SEQ ID NO: 101161 - RNA, 22 nt, Human
uaacuucucaauuaugccaaag

SEQ ID NO: 101162 - RNA, 26 nt, Human
ccccgccucugcccucauccucccuc

SEQ ID NO: 101163 - RNA, 22 nt, Human
ggguguagagagaauggagggg

SEQ ID NO: 101164 - RNA, 26 nt, Human
cauccaggcugguuucgaacuccuga

SEQ ID NO: 101165 - RNA, 21 nt, Human
ccccuguggauguaaccccuu

SEQ ID NO: 101166 - RNA, 25 nt, Human
ggcagugccugguacaugggagcca

SEQ ID NO: 101167 - RNA, 27 nt, Human
gaggcucccucccagccaccgcccccc

SEQ ID NO: 101168 - RNA, 28 nt, Human
ucgcccagucuucagucuccugacuuag

SEQ ID NO: 101169 - RNA, 17 nt, Human
ggggugaggcagguuuc

SEQ ID NO: 101170 - RNA, 27 nt, Human
aagcccacagacacugaagggcuugag

SEQ ID NO: 101171 - RNA, 22 nt, Human
uacagauacaggcauaugucau

SEQ ID NO: 101172 - RNA, 24 nt, Human
gcugccucugcugccgggccugga

SEQ ID NO: 101173 - RNA, 26 nt, Human
gccccuuucccguccugggcaccccg

SEQ ID NO: 101174 - RNA, 22 nt, Human
ccccaccccacccuccaggguu

SEQ ID NO: 101175 - RNA, 23 nt, Human
gccuuuuaacacuccccgagcug

SEQ ID NO: 101176 - RNA, 27 nt, Human
uccgccugcgccuccauccaucugucc

SEQ ID NO: 101177 - RNA, 27 nt, Human
cucagcagggauggcucagcagggaug

SEQ ID NO: 101178 - RNA, 22 nt, Human
cuugaggucaggaguucgagac

SEQ ID NO: 101179 - RNA, 20 nt, Human
ccaaauacauccugcggaag

SEQ ID NO: 101180 - RNA, 26 nt, Human
cucugccucccggguucaagcaauuu

SEQ ID NO: 101181 - RNA, 25 nt, Human
aagcuggguccucuggaggaggggc

SEQ ID NO: 101182 - RNA, 25 nt, Human
ucuuucauguuccgucugugucucu

SEQ ID NO: 101183 - RNA, 23 nt, Human
ugaccaugaagcuugucaacauc

SEQ ID NO: 101184 - RNA, 26 nt, Human
gcccagcccugccuccuggccaugcc

SEQ ID NO: 101185 - RNA, 22 nt, Human
aacccagaaacaaaucucaaag

SEQ ID NO: 101186 - RNA, 17 nt, Human
ccuacuucccccgcuuu

SEQ ID NO: 101187 - RNA, 27 nt, Human
cuggcccucccuugcaggucgguuugg

SEQ ID NO: 101188 - RNA, 21 nt, Human
agaccagccuggccacauggu

SEQ ID NO: 101189 - RNA, 22 nt, Human
gccacgagccauaggcauuuca

SEQ ID NO: 101190 - RNA, 22 nt, Human
ucuccaucugcagauuauuccc

SEQ ID NO: 101191 - RNA, 27 nt, Human
uuccaguaucauacuuacuaguugauu

SEQ ID NO: 101192 - RNA, 18 nt, Human
uccagucuucggguuuca

SEQ ID NO: 101193 - RNA, 22 nt, Human
uucuuaaugucaaccaucuuua

SEQ ID NO: 101194 - RNA, 25 nt, Human
uugacucccagaucagucagagccc

SEQ ID NO: 101195 - RNA, 24 nt, Human
ucucagcuugguugccaacccagu

SEQ ID NO: 101196 - RNA, 26 nt, Human
agcaucagaaagaccugcuucccagc

SEQ ID NO: 101197 - RNA, 20 nt, Human
cuucccuuucacugaaguga

SEQ ID NO: 101198 - RNA, 21 nt, Human
acuccuuggcuggaggcagug

SEQ ID NO: 101199 - RNA, 27 nt, Human
cagucucuucagacucauggauugguc

SEQ ID NO: 101200 - RNA, 29 nt, Human
ccuagauuuuguugaccucaacaauggca

SEQ ID NO: 101201 - RNA, 21 nt, Human
cugccucugagucauuguguu

SEQ ID NO: 101202 - RNA, 27 nt, Human
cuguuuaaaccucaggauggcucgcuu

SEQ ID NO: 101203 - RNA, 26 nt, Human
ucccuccuaaccccaggaccagggga

SEQ ID NO: 101204 - RNA, 21 nt, Human
gggaagccucgcauggccgcu

SEQ ID NO: 101205 - RNA, 21 nt, Human
aaucugaauauugcugcagca

SEQ ID NO: 101206 - RNA, 21 nt, Human
acaagaggccacucccaggga

SEQ ID NO: 101207 - RNA, 26 nt, Human
ugaaggcccauugaaugacuaaucca

SEQ ID NO: 101208 - RNA, 21 nt, Human
ucuuaauuuuguauuuuuucc

SEQ ID NO: 101209 - RNA, 26 nt, Human
uggauggggaaaguaagcucccuccu

SEQ ID NO: 101210 - RNA, 26 nt, Human
ggucacugcauuuuuaccugaaccaa

SEQ ID NO: 101211 - RNA, 22 nt, Human
gagagcccugugagccaaaaag

SEQ ID NO: 101212 - RNA, 22 nt, Human
agagacaaagauccaggaaagg

SEQ ID NO: 101213 - RNA, 27 nt, Human
aagacuccacauaaguccauuaacugc

SEQ ID NO: 101214 - RNA, 22 nt, Human
uauuuugucaguucauaguuga

SEQ ID NO: 101215 - RNA, 26 nt, Human
ugagccaagauugcacuacuacacuc

SEQ ID NO: 101216 - RNA, 21 nt, Human
cagcugggaggaaaggcagag

SEQ ID NO: 101217 - RNA, 20 nt, Human
ccccagccaggaucuggucg

SEQ ID NO: 101218 - RNA, 22 nt, Human
cacugaacuccagccugggcca

SEQ ID NO: 101219 - RNA, 24 nt, Human
ggcagagagcggucucaggcuggu

SEQ ID NO: 101220 - RNA, 25 nt, Human
uacauucuagccuuaagacauuuga

SEQ ID NO: 101221 - RNA, 20 nt, Human
acuguuguucugcuuuuccu

SEQ ID NO: 101222 - RNA, 22 nt, Human
uucaccacugccuaccuguuca

SEQ ID NO: 101223 - RNA, 20 nt, Human
aucugucagauccaguguau

SEQ ID NO: 101224 - RNA, 22 nt, Human
guucuuuuccaacaaaauagca

SEQ ID NO: 101225 - RNA, 24 nt, Human
ccccugaugucugcuccagagaca

SEQ ID NO: 101226 - RNA, 25 nt, Human
caccaggagucuggagugcaauggc

SEQ ID NO: 101227 - RNA, 26 nt, Human
uggcaaaagcagcacaguauuaauau

SEQ ID NO: 101228 - RNA, 16 nt, Human
uaaugggcugcuguca

SEQ ID NO: 101229 - RNA, 22 nt, Human
caagaucaugccacugcacucc

SEQ ID NO: 101230 - RNA, 21 nt, Human
cgcccaggcuggagugcaggg

SEQ ID NO: 101231 - RNA, 26 nt, Human
ucuugucucaucuucugagaggugcc

SEQ ID NO: 101232 - RNA, 26 nt, Human
ccuccuggcccaggccuugcugacuc

SEQ ID NO: 101233 - RNA, 26 nt, Human
ucaggcuggggucugcagugcagcau

SEQ ID NO: 101234 - RNA, 30 nt, Human; identical to SEQ ID NO: 6131

SEQ ID NO: 101235 - RNA, 22 nt, Human
cccuccaguaccuucugccaga

SEQ ID NO: 101236 - RNA, 22 nt, Human
auuucacucuccucuagcuauc

SEQ ID NO: 101237 - RNA, 21 nt, Human
ugauacuguuucuugcacuga

SEQ ID NO: 101238 - RNA, 20 nt, Human
aacacagcagcaucucucca

SEQ ID NO: 101239 - RNA, 21 nt, Human
gcagcucaaguuagcauuuca

SEQ ID NO: 101240 - RNA, 22 nt, Human
aauuaagaguuuuaugagcugu

SEQ ID NO: 101241 - RNA, 21 nt, Human
gcagacaucucaacacuuugg

SEQ ID NO: 101242 - RNA, 28 nt, Human
ugagauguagccccucuccuggaagugc

SEQ ID NO: 101243 - RNA, 27 nt, Human
gucacauuggcaaagggagaacugggg

SEQ ID NO: 101244 - RNA, 19 nt, Human
acccaggcuggagugcagu

SEQ ID NO: 101245 - RNA, 19 nt, Human
gcccaggcuggagugcggu

SEQ ID NO: 101246 - RNA, 17 nt, Human
ggccacaaccucuguuu

SEQ ID NO: 101247 - RNA, 23 nt, Human
uuccucauauggcaugcuuuucu

SEQ ID NO: 101248 - RNA, 27 nt, Human
ccacugcacaccagucuggagacagag

SEQ ID NO: 101249 - RNA, 26 nt, Human
cuugagccacccuucccaccccagcc

SEQ ID NO: 101250 - RNA, 19 nt, Human
cucauuucagucccaucua

SEQ ID NO: 101251 - RNA, 23 nt, Human
aagugaccugagugggaugcauu

SEQ ID NO: 101252 - RNA, 21 nt, Human
ugaugaggaccuguaaaauac

SEQ ID NO: 101253 - RNA, 20 nt, Human
ccaaggcuggagugcagugg

SEQ ID NO: 101254 - RNA, 25 nt, Human
ccccucgggggccagcccccggccg

SEQ ID NO: 101255 - RNA, 20 nt, Human
cacacacaugcauacuuaca

SEQ ID NO: 101256 - RNA, 23 nt, Human
agugauauugaagaaaagacuga

SEQ ID NO: 101257 - RNA, 25 nt, Human
gagcucuccuauauuaucauacuca

SEQ ID NO: 101258 - RNA, 21 nt, Human
agucgggagggagggagcgag

SEQ ID NO: 101259 - RNA, 27 nt, Human
cccugcaggaacgcgccgaggucuccc

SEQ ID NO: 101260 - RNA, 25 nt, Human
ccuugaaaugcuuagacucuugaag

SEQ ID NO: 101261 - RNA, 22 nt, Human
aacaacaaaagcauuuguugac

SEQ ID NO: 101262 - RNA, 21 nt, Human
ccagcaguccacuaucugcca

SEQ ID NO: 101263 - RNA, 21 nt, Human
uccucaccaucuccauccgcu

SEQ ID NO: 101264 - RNA, 22 nt, Human
uuguagcccaauccccucucuu

SEQ ID NO: 101265 - RNA, 21 nt, Human
ucaauacuggugcucuuguca

SEQ ID NO: 101266 - RNA, 21 nt, Human
augcugggauucuugccugua

SEQ ID NO: 101267 - RNA, 27 nt, Human
cuaugcaacaggaagucauuacgaucc

SEQ ID NO: 101268 - RNA, 22 nt, Human
caugccuguaauuccagcacuu

SEQ ID NO: 101269 - RNA, 22 nt, Human
caugucuguaaucccagcacuu

SEQ ID NO: 101270 - RNA, 20 nt, Human
agcagcucuggcucugccuc

SEQ ID NO: 101271 - RNA, 21 nt, Human
cugggcuggaggugggggugg

SEQ ID NO: 101272 - RNA, 20 nt, Human
cgucaucaguuguucuugaa

SEQ ID NO: 101273 - RNA, 24 nt, Human
aaagagcagagugacugugggucu

SEQ ID NO: 101274 - RNA, 24 nt, Human
ccacuucgcuuuaaagacucugaa

SEQ ID NO: 101275 - RNA, 27 nt, Human
gaaauauuguguaaaaugggugcugcc

SEQ ID NO: 101276 - RNA, 20 nt, Human
ugcugcuucacccuugggga

SEQ ID NO: 101277 - RNA, 24 nt, Human
gucgccuguaaugccagcgcuuug

SEQ ID NO: 101278 - RNA, 23 nt, Human
agaaaaauucacccaccaugccg

SEQ ID NO: 101279 - RNA, 19 nt, Human
agugaacuucugaucuaga

SEQ ID NO: 101280 - RNA, 20 nt, Human
gggucuccccucaccccugc

SEQ ID NO: 101281 - RNA, 21 nt, Human
ucugccuggccuguuuggacu

SEQ ID NO: 101282 - RNA, 27 nt, Human
ggcucagagcggaggggagacugaccg

SEQ ID NO: 101283 - RNA, 23 nt, Human
ggcauuuucccccuuggcucuca

SEQ ID NO: 101284 - RNA, 18 nt, Human
caaaggaaaucacuguga

SEQ ID NO: 101285 - RNA, 24 nt, Human
agacuggggggaucagcugcccau

SEQ ID NO: 101286 - RNA, 22 nt, Human
gggggcgcggagguuggagaga

SEQ ID NO: 101287 - RNA, 22 nt, Human
gagggucucuuucuuuucucuu

SEQ ID NO: 101288 - RNA, 19 nt, Human
acuugugccuggcugcagu

SEQ ID NO: 101289 - RNA, 19 nt, Human
uucagaagaaaaagaagca

SEQ ID NO: 101290 - RNA, 18 nt, Human
ggcgcgcuccagccggug

SEQ ID NO: 101291 - RNA, 27 nt, Human
ccccugccccgcuccaaucgguaccau

SEQ ID NO: 101292 - RNA, 22 nt, Human
gggaacuuggagagggagcuug

SEQ ID NO: 101293 - RNA, 20 nt, Human
cgccgccccucaggccccgu

SEQ ID NO: 101294 - RNA, 27 nt, Human
uugcugcacuccagccuaggcaacaua

SEQ ID NO: 101295 - RNA, 24 nt, Human
ugucacccaggcugggaauugcag

SEQ ID NO: 101296 - RNA, 22 nt, Human
acuggaaaaguguuccuugcuc

SEQ ID NO: 101297 - RNA, 20 nt, Human
uuccuguccuggaauuaguu

SEQ ID NO: 101298 - RNA, 23 nt, Human
auagguuacgucagccuacugug

SEQ ID NO: 101299 - RNA, 22 nt, Human
cagggaggggcuaguguuggua

SEQ ID NO: 101300 - RNA, 20 nt, Human
cccacucagagaugcauuug

SEQ ID NO: 101301 - RNA, 26 nt, Human
ccucauucucuguccagaauguggac

SEQ ID NO: 101302 - RNA, 23 nt, Human
cccugcaguccuacuacagucug

SEQ ID NO: 101303 - RNA, 22 nt, Human
uuuuaugucaaguaaaaccauc

SEQ ID NO: 101304 - RNA, 17 nt, Human
ucaccccuccucccucu

SEQ ID NO: 101305 - RNA, 24 nt, Human
gcggggcugggggcgcccagaaga

SEQ ID NO: 101306 - RNA, 23 nt, Human
uccuccagcaauagcauccaagg

SEQ ID NO: 101307 - RNA, 22 nt, Human
cuacguguacaucauuaauccc

SEQ ID NO: 101308 - RNA, 21 nt, Human
cagccuucagugaauauuggu

SEQ ID NO: 101309 - RNA, 22 nt, Human
gucuccaacuccugagcucagg

SEQ ID NO: 101310 - RNA, 23 nt, Human
ugacuccugccuguuuuagucca

SEQ ID NO: 101311 - RNA, 22 nt, Human
cgcaccggguccccgcuggaac

SEQ ID NO: 101312 - RNA, 15 nt, Human
uaaacuucgaugauc

SEQ ID NO: 101313 - RNA, 23 nt, Human
ccuuccccaaacccagggaaaag

SEQ ID NO: 101314 - RNA, 26 nt, Human
cugcucuguucccuggcauguugguc

SEQ ID NO: 101315 - RNA, 24 nt, Human
ugccugccugccccacugugcugg

SEQ ID NO: 101316 - RNA, 26 nt, Human
caccaagcugguggcucugugugcuc

SEQ ID NO: 101317 - RNA, 24 nt, Human
ucuccagugaggagugaacagugg

SEQ ID NO: 101318 - RNA, 22 nt, Human
gcucacugcaacguccgccucc

SEQ ID NO: 101319 - RNA, 27 nt, Human
uaggcaugugagaaaaucagccuagca

SEQ ID NO: 101320 - RNA, 20 nt, Human
ggagcccuagcccugcucca

SEQ ID NO: 101321 - RNA, 26 nt, Human
ccuuuucaggcuggguucccuguggg

SEQ ID NO: 101322 - RNA, 18 nt, Human
agaucagcuagaccugcu

SEQ ID NO: 101323 - RNA, 18 nt, Human
ugucccucucagugccuu

SEQ ID NO: 101324 - RNA, 25 nt, Human
accauccuggagacauuuugcaggg

SEQ ID NO: 101325 - RNA, 27 nt, Human
ggguaaauguggagggagccacagaga

SEQ ID NO: 101326 - RNA, 21 nt, Human
gcccaucuccccuuccgugcc

SEQ ID NO: 101327 - RNA, 26 nt, Human
gcuccugcucccuccuggaaugugcg

SEQ ID NO: 101328 - RNA, 22 nt, Human
gggucaccgggacaguguacuc

SEQ ID NO: 101329 - RNA, 22 nt, Human
accuuuccauccuuuacuccaa

SEQ ID NO: 101330 - RNA, 22 nt, Human
ugccaggccucagaacugugug

SEQ ID NO: 101331 - RNA, 24 nt, Human
uggcuaacacggugaaaccccuua

SEQ ID NO: 101332 - RNA, 30 nt, Human
agccaggaauacagguuuucuugaugauuu

SEQ ID NO: 101333 - RNA, 32 nt, Human
cugccaacguagcucugccugccugucaaccc

SEQ ID NO: 101334 - RNA, 21 nt, Human
uccugaauuccccuugccacc

SEQ ID NO: 101335 - RNA, 20 nt, Human
cuguguucccucauaugcau

SEQ ID NO: 101336 - RNA, 26 nt, Human
gagggaggggcguggggaaggcggcg

SEQ ID NO: 101337 - RNA, 20 nt, Human
uguuccacgcccuugcagug

SEQ ID NO: 101338 - RNA, 29 nt, Human
ccaaaucuugccauuuguauacuuuuggu

SEQ ID NO: 101339 - RNA, 20 nt, Human
ccugccuggacgccagcugu

SEQ ID NO: 101340 - RNA, 23 nt, Human
gaggaaugagaggguccaggcag

SEQ ID NO: 101341 - RNA, 23 nt, Human
ccccaaaauguggaaugcaucca

SEQ ID NO: 101342 - RNA, 21 nt, Human
auaaaguguuuaagaaucuac

SEQ ID NO: 101343 - RNA, 30 nt, Human
ggcugauggugaagccuccugacccucccc

SEQ ID NO: 101344 - RNA, 22 nt, Human
ugcuggcauuuugcuguguccu

SEQ ID NO: 101345 - RNA, 21 nt, Human
uuauuaaaaacugagugacuc

SEQ ID NO: 101346 - RNA, 23 nt, Human
ucuguaacgcagcuucuguaagc

SEQ ID NO: 101347 - RNA, 25 nt, Human
uuuggagaaggaauuuguggcugcu

SEQ ID NO: 101348 - RNA, 24 nt, Human
uccugcuccaugcagacuguuagc

SEQ ID NO: 101349 - RNA, 22 nt, Human
ccaaaguguuaggauuacaggc

SEQ ID NO: 101350 - RNA, 22 nt, Human
gcaccuaagccugucucugccu

SEQ ID NO: 101351 - RNA, 27 nt, Human
cuuucugagagccuccccaccccgaga

SEQ ID NO: 101352 - RNA, 23 nt, Human
uuuggacugcugcuucucuuagc

SEQ ID NO: 101353 - RNA, 19 nt, Human
aggcugaggcagcauugcu

SEQ ID NO: 101354 - RNA, 23 nt, Human
caaggcugaggcaggagaaucgc

SEQ ID NO: 101355 - RNA, 23 nt, Human
aucaauugaggggaaagugcagu

SEQ ID NO: 101356 - RNA, 24 nt, Human
gcuauuuggguauccuggguuuga

SEQ ID NO: 101357 - RNA, 18 nt, Human
ugaaccagcagagcugug

SEQ ID NO: 101358 - RNA, 22 nt, Human
gcaguauugcauucauuacaaa

SEQ ID NO: 101359 - RNA, 23 nt, Human
gcccaggcucggaggacccugga

SEQ ID NO: 101360 - RNA, 15 nt, Human
ugggaaagagaggag

SEQ ID NO: 101361 - RNA, 27 nt, Human
cuggaguagcugggauuuacuaguagu

SEQ ID NO: 101362 - RNA, 23 nt, Human
ggaaaggaagaaaaaaggccuug

SEQ ID NO: 101363 - RNA, 21 nt, Human
caccaugugcaaacugaucca

SEQ ID NO: 101364 - RNA, 27 nt, Human
ugcugugugacccugggcaagucacuu

SEQ ID NO: 101365 - RNA, 30 nt, Human
cuggagaaucgcuugaggcuagugagcugu

SEQ ID NO: 101366 - RNA, 23 nt, Human
gcagguagcagucccuggccucu

SEQ ID NO: 101367 - RNA, 22 nt, Human
gguucacaguuuguuuuucuag

SEQ ID NO: 101368 - RNA, 22 nt, Human
gcacacgccuguaaucccagcu

SEQ ID NO: 101369 - RNA, 22 nt, Human
accaguauuuugagcuggcaaa

SEQ ID NO: 101370 - RNA, 24 nt, Human
uuccacccuuccugauuauucacc

SEQ ID NO: 101371 - RNA, 27 nt, Human
ucucuacuguacucccucagcaucaga

SEQ ID NO: 101372 - RNA, 24 nt, Human
ccucauuagacugggaugccuuca

SEQ ID NO: 101373 - RNA, 24 nt, Human
ugugcaguuguugccuuuugucug

SEQ ID NO: 101374 - RNA, 27 nt, Human
uaauccuucugaagcaaagcaccacga

SEQ ID NO: 101375 - RNA, 20 nt, Human
uuccuagugcuacuuguuuu

SEQ ID NO: 101376 - RNA, 21 nt, Human
aucuucuuugcauccuaagga

SEQ ID NO: 101377 - RNA, 23 nt, Human
cacacaaagcaccgcuuccucca

SEQ ID NO: 101378 - RNA, 21 nt, Human
uccagaucuugccuccagaga

SEQ ID NO: 101379 - RNA, 22 nt, Human
auugucucugacugcagguuug

SEQ ID NO: 101380 - RNA, 27 nt, Human
aacucacagcccucccuuuuccuguag

SEQ ID NO: 101381 - RNA, 23 nt, Human
guccacgauggugguggaaggug

SEQ ID NO: 101382 - RNA, 21 nt, Human
ugucaugaccucaggaaauaa

SEQ ID NO: 101383 - RNA, 22 nt, Human
ugccuucagagugacagguaga

SEQ ID NO: 101384 - RNA, 21 nt, Human
uccugcacuccagaauccaca

SEQ ID NO: 101385 - RNA, 27 nt, Human
gccagccuggcagcuggaagccucccc

SEQ ID NO: 101386 - RNA, 24 nt, Human
aauuuggacuggugugcucucuuu

SEQ ID NO: 101387 - RNA, 24 nt, Human
aucagcaucuggccaacauagugg

SEQ ID NO: 101388 - RNA, 23 nt, Human
gcacagccacaagucucaucucu

SEQ ID NO: 101389 - RNA, 27 nt, Human
agaaauguuagaaagcagcagcaauua

SEQ ID NO: 101390 - RNA, 26 nt, Human
ccuccccggcuccuccggaccuccuc

SEQ ID NO: 101391 - RNA, 18 nt, Human
uacagauauaucaaauca

SEQ ID NO: 101392 - RNA, 25 nt, Human
agacucugacauuccuggcugucau

SEQ ID NO: 101393 - RNA, 28 nt, Human
gcuuccagguaucuccaggauugaagag

SEQ ID NO: 101394 - RNA, 21 nt, Human
ccucagcagagcuccugggcc

SEQ ID NO: 101395 - RNA, 21 nt, Human
ucuuccuuggccgcccaccgc

SEQ ID NO: 101396 - RNA, 27 nt, Human
ucugggagcugcgccggacagaguggg

SEQ ID NO: 101397 - RNA, 22 nt, Human
gagcaggauugagggagccagg

SEQ ID NO: 101398 - RNA, 22 nt, Human
ugggauuauaggcaugagccau

SEQ ID NO: 101399 - RNA, 25 nt, Human
gguaccauuucacaccagcaggugu

SEQ ID NO: 101400 - RNA, 25 nt, Human
ggcucgggauggaggcuggacaccu

SEQ ID NO: 101401 - RNA, 25 nt, Human
uacuauauguggguugagcuaugca

SEQ ID NO: 101402 - RNA, 20 nt, Human
gaguagaggugugugucaca

SEQ ID NO: 101403 - RNA, 25 nt, Human
ccucccgccgccagcuccugccucg

SEQ ID NO: 101404 - RNA, 22 nt, Human
aaggguuuucagauccaaggaa

SEQ ID NO: 101405 - RNA, 23 nt, Human
cccaugggcuguggcguauguca

SEQ ID NO: 101406 - RNA, 21 nt, Human
ucagaauccuggugccuugaa

SEQ ID NO: 101407 - RNA, 24 nt, Human
uccacagauguaugugcggccagu

SEQ ID NO: 101408 - RNA, 21 nt, Human
cguacauguuuauggcaauuu

SEQ ID NO: 101409 - RNA, 22 nt, Human
aacaagaaaaguacauucuuua

SEQ ID NO: 101410 - RNA, 23 nt, Human
gucagcccaggcugcugggcugu

SEQ ID NO: 101411 - RNA, 25 nt, Human
cccucauuuccccugcuguuugccc

SEQ ID NO: 101412 - RNA, 23 nt, Human
aagcaaacacuuucauguccugu

SEQ ID NO: 101413 - RNA, 21 nt, Human
cccuuuuccauuucuuuugua

SEQ ID NO: 101414 - RNA, 25 nt, Human
uugccgucguuuucucuccccgcgu

SEQ ID NO: 101415 - RNA, 23 nt, Human
gacuuaagugagccucccgccuc

SEQ ID NO: 101416 - RNA, 22 nt, Human
cacuguugcugacuacuacucu

SEQ ID NO: 101417 - RNA, 21 nt, Human
ggguucaaccacuuuagccag

SEQ ID NO: 101418 - RNA, 27 nt, Human
uaugcucagaugucagauccucuuguu

SEQ ID NO: 101419 - RNA, 20 nt, Human
ucugugguucuuuuguacuu

SEQ ID NO: 101420 - RNA, 20 nt, Human
gugaaagguguuuauacaag

SEQ ID NO: 101421 - RNA, 24 nt, Human
cccaaccacugagguucucuaugc

SEQ ID NO: 101422 - RNA, 22 nt, Human
caccucuuauguucaagcaauu

SEQ ID NO: 101423 - RNA, 24 nt, Human
uuguaacauuguaaaguaugugag

SEQ ID NO: 101424 - RNA, 19 nt, Human
agagugaggggugggugga

SEQ ID NO: 101425 - RNA, 25 nt, Human
cucaaacacaauaaacaugcuccug

SEQ ID NO: 101426 - RNA, 20 nt, Human
gccaugaggaguucccauga

SEQ ID NO: 101427 - RNA, 20 nt, Human
gcuuggguaaugagcaggaa

SEQ ID NO: 101428 - RNA, 24 nt, Human
ucuucucucucuuuuaauuuucuu

SEQ ID NO: 101429 - RNA, 26 nt, Human
uguuuaauauuuuuguuuuuaaacau

SEQ ID NO: 101430 - RNA, 22 nt, Human
accaaauuauaauaucuaaugg

SEQ ID NO: 101431 - RNA, 21 nt, Human
cccuguacuccagccugggug

SEQ ID NO: 101432 - RNA, 26 nt, Human
guaggcccucacaggaggccaccuuc

SEQ ID NO: 101433 - RNA, 21 nt, Human
accuccuccuccuccuggccc

SEQ ID NO: 101434 - RNA, 26 nt, Human
aacagccuggacauggcaucagagau

SEQ ID NO: 101435 - RNA, 24 nt, Human
cacaagcuuuuguucucucaguac

SEQ ID NO: 101436 - RNA, 22 nt, Human
gggcccucagcuccuggggacc

SEQ ID NO: 101437 - RNA, 24 nt, Human
caugaucauagcucacugcagccu

SEQ ID NO: 101438 - RNA, 24 nt, Human
uccucuccucccuguccugagccu

SEQ ID NO: 101439 - RNA, 21 nt, Human
uaucugaagaccuaccaggga

SEQ ID NO: 101440 - RNA, 24 nt, Human
uccucacaaccaccucaguccucc

SEQ ID NO: 101441 - RNA, 21 nt, Human
aaagguggagguugcaguaag

SEQ ID NO: 101442 - RNA, 21 nt, Human
uucucucuucgggagaugaua

SEQ ID NO: 101443 - RNA, 18 nt, Human
cuaggagucccugccccu

SEQ ID NO: 101444 - RNA, 22 nt, Human
acaucuugcuuuagcacaugua

SEQ ID NO: 101445 - RNA, 22 nt, Human
aggguccuggccauuuuggugg

SEQ ID NO: 101446 - RNA, 20 nt, Human
ggcguagggugggggcagug

SEQ ID NO: 101447 - RNA, 20 nt, Human
gggugggaugguggagcagc

SEQ ID NO: 101448 - RNA, 21 nt, Human
gucccggcugaagugcagugg

SEQ ID NO: 101449 - RNA, 17 nt, Human
ugugugcgagugugugc

SEQ ID NO: 101450 - RNA, 25 nt, Human
cucuguccacuggguuuauuucuug

SEQ ID NO: 101451 - RNA, 26 nt, Human
agccccaucaggcuuguguuaaggca

SEQ ID NO: 101452 - RNA, 24 nt, Human
uguucuuucucaagugcucaggga

SEQ ID NO: 101453 - RNA, 26 nt, Human
gcaccucaucuccuugccccuucaca

SEQ ID NO: 101454 - RNA, 27 nt, Human
cccugcccaccgacgccagccugcuug

SEQ ID NO: 101455 - RNA, 24 nt, Human
ggccaggcagaugaccucguacuc

SEQ ID NO: 101456 - RNA, 27 nt, Human
cugucucuugaaaaaugcccauuugcc

SEQ ID NO: 101457 - RNA, 22 nt, Human
ccugggcugccagccucaggca

SEQ ID NO: 101458 - RNA, 29 nt, Human
gcaguaagccacacaccugccacuuagcc

SEQ ID NO: 101459 - RNA, 22 nt, Human
cucagccaggagccaguggcag

SEQ ID NO: 101460 - RNA, 23 nt, Human
gugauccuuaaguuuucuccccu

SEQ ID NO: 101461 - RNA, 21 nt, Human
ggcuccgacaggccugcucca

SEQ ID NO: 101462 - RNA, 24 nt, Human
gugaggcuuagaggagcccagggc

SEQ ID NO: 101463 - RNA, 21 nt, Human
auucccacucuguucucugcc

SEQ ID NO: 101464 - RNA, 27 nt, Human
uuguuaggcuuuucugccugcuccugc

SEQ ID NO: 101465 - RNA, 21 nt, Human
cuacaucugccucggcucaca

SEQ ID NO: 101466 - RNA, 24 nt, Human
agggagaauccaguguuucugcuu

SEQ ID NO: 101467 - RNA, 20 nt, Human
guggccuuugaauucuguuu

SEQ ID NO: 101468 - RNA, 28 nt, Human
cugccauguaccuccccugccuugcugu

SEQ ID NO: 101469 - RNA, 21 nt, Human
uaaaugaugacagugguccca

SEQ ID NO: 101470 - RNA, 19 nt, Human
ccugaggccugugccuguc

SEQ ID NO: 101471 - RNA, 27 nt, Human
ccacugcauuccagccuggcgacagag

SEQ ID NO: 101472 - RNA, 22 nt, Human
aagguuuugaccauuuuguuau

SEQ ID NO: 101473 - RNA, 27 nt, Human
guuguccaggcuggagugcaauggcac

SEQ ID NO: 101474 - RNA, 20 nt, Human
auacacaguucagcagcuac

SEQ ID NO: 101475 - RNA, 20 nt, Human
uaaagugcaucacagccaga

SEQ ID NO: 101476 - RNA, 24 nt, Human
agcuguguuuagugaaaugagcuc

SEQ ID NO: 101477 - RNA, 27 nt, Human
cacugcacuccaauuuccucgggcagc

SEQ ID NO: 101478 - RNA, 21 nt, Human
uuuuuagcugucaacucauuu

SEQ ID NO: 101479 - RNA, 27 nt, Human
aacaaaauucuggugaaauaacugggc

SEQ ID NO: 101480 - RNA, 21 nt, Human
cugccucacgguugcuguugc

SEQ ID NO: 101481 - RNA, 24 nt, Human
acugcugcuuucccuccugggcuc

SEQ ID NO: 101482 - RNA, 23 nt, Human
cggccgccucaggaggaucccuu

SEQ ID NO: 101483 - RNA, 20 nt, Human
ccugcugucucuguccuguc

SEQ ID NO: 101484 - RNA, 22 nt, Human
cugcacaggccagaaagucugc

SEQ ID NO: 101485 - RNA, 21 nt, Human
ugcuccucucccuccuaagga

SEQ ID NO: 101486 - RNA, 23 nt, Human
ccaaucucucaaaggcagcagau

SEQ ID NO: 101487 - RNA, 21 nt, Human
acaguauuuaucaccuacgga

SEQ ID NO: 101488 - RNA, 17 nt, Human
ccuacuucuccuacugg

SEQ ID NO: 101489 - RNA, 24 nt, Human
gcccagcuuggagugccacauggc

SEQ ID NO: 101490 - RNA, 27 nt, Human
ugaaagggcagguugucuucaaacucu

SEQ ID NO: 101491 - RNA, 26 nt, Human
gaguccuggcccaaagaagcaaggaa

SEQ ID NO: 101492 - RNA, 24 nt, Human
ucccagguugacaccauucuccug

SEQ ID NO: 101493 - RNA, 22 nt, Human
cugggcaagugcacaagucuuu

SEQ ID NO: 101494 - RNA, 24 nt, Human
uuagcuaucauugcuuccuccucc

SEQ ID NO: 101495 - RNA, 17 nt, Human
auaaaugauuauacaaa

SEQ ID NO: 101496 - RNA, 27 nt, Human
cccaggaaacagccucagcucaagcgg

SEQ ID NO: 101497 - RNA, 25 nt, Human
ggccugagagagggggucacaguga

SEQ ID NO: 101498 - RNA, 21 nt, Human
aaacauccuucuugaugcuuu

SEQ ID NO: 101499 - RNA, 19 nt, Human
ucucucgcucucucucggu

SEQ ID NO: 101500 - RNA, 27 nt, Human
ccaggagagguggauguuugucugaga

SEQ ID NO: 101501 - RNA, 23 nt, Human
gaggugugggcagaggagggagg

SEQ ID NO: 101502 - RNA, 26 nt, Human
gugacuucguccaguuacaaacccaa

SEQ ID NO: 101503 - RNA, 23 nt, Human
uguacaguagcuuuucaaacugc

SEQ ID NO: 101504 - RNA, 18 nt, Human
cacccaggucgggcggug

SEQ ID NO: 101505 - RNA, 25 nt, Human
aaaaggcuucaucuuauaaagugaa

SEQ ID NO: 101506 - RNA, 19 nt, Human
gaaauggcuccagaggucu

SEQ ID NO: 101507 - RNA, 20 nt, Human
uugccaggcuggaugcuguc

SEQ ID NO: 101508 - RNA, 22 nt, Human
gggaggccucacaaaccacagg

SEQ ID NO: 101509 - RNA, 26 nt, Human
cccaccccgcccagggagcuccgccc

SEQ ID NO: 101510 - RNA, 23 nt, Human
accaugccugacuaauuuuuugu

SEQ ID NO: 101511 - RNA, 24 nt, Human
uuuucaagguggcaauuggggcgg

SEQ ID NO: 101512 - RNA, 21 nt, Human
ccucaggcacaggcagaggug

SEQ ID NO: 101513 - RNA, 25 nt, Human
aaaugugcuaaguuauuugagacuu

SEQ ID NO: 101514 - RNA, 29 nt, Human
uagaaaagucacauuucuacaagguaauu

SEQ ID NO: 101515 - RNA, 27 nt, Human
ucauccagcugagcggacugcuccaag

SEQ ID NO: 101516 - RNA, 26 nt, Human
ccugcucuauuuuccugggcagguuu

SEQ ID NO: 101517 - RNA, 27 nt, Human
ccagguggcggggcugcaagagccggg

SEQ ID NO: 101518 - RNA, 23 nt, Human
gcugggagaggcagcccaggaag

SEQ ID NO: 101519 - RNA, 24 nt, Human
cucaaaucuccaggaguaucugga

SEQ ID NO: 101520 - RNA, 25 nt, Human
aucagagggaagaucuuuuuccuca

SEQ ID NO: 101521 - RNA, 26 nt, Human
caugcuguuuucccuuugccacacug

SEQ ID NO: 101522 - RNA, 22 nt, Human
ugcagcucccccaaggugcagg

SEQ ID NO: 101523 - RNA, 22 nt, Human
ugucuucauuuugggaugcagc

SEQ ID NO: 101524 - RNA, 23 nt, Human
agggacuauuagagauggcaucu

SEQ ID NO: 101525 - RNA, 30 nt, Human
ggcuuggccaugccuuucugugccuuuaau

SEQ ID NO: 101526 - RNA, 27 nt, Human
ggaaucagagaauuuccaaacuuguuu

SEQ ID NO: 101527 - RNA, 27 nt, Human
ccuggucaccguuucaccaucaugcuu

SEQ ID NO: 101528 - RNA, 22 nt, Human
acugcagucccauccucuuguc

SEQ ID NO: 101529 - RNA, 27 nt, Human
ugaggcaguuggcaaacuucucaggac

SEQ ID NO: 101530 - RNA, 19 nt, Human
ggaaacaccacaggcugaa

SEQ ID NO: 101531 - RNA, 21 nt, Human
uaauuaguuaugacagccauu

SEQ ID NO: 101532 - RNA, 31 nt, Human
cuuuuuuguuuucuuuuugaaagaucauucg

SEQ ID NO: 101533 - RNA, 22 nt, Human
agcacuccucugggcugcucuc

SEQ ID NO: 101534 - RNA, 19 nt, Human
ugccuccaggucucaucuu

SEQ ID NO: 101535 - RNA, 21 nt, Human
uuuccauggacucuccuggca

SEQ ID NO: 101536 - RNA, 20 nt, Human
acacuaugucuucaauccca

SEQ ID NO: 101537 - RNA, 23 nt, Human
uucagauacuuuuuccugccuca

SEQ ID NO: 101538 - RNA, 23 nt, Human
uaugcuguuagauguggcuguga

SEQ ID NO: 101539 - RNA, 21 nt, Human
ggcucacugcaccucugucuc

SEQ ID NO: 101540 - RNA, 22 nt, Human
ucuuaggcuggagugcaguggc

SEQ ID NO: 101541 - RNA, 25 nt, Human
gcugcucagagaugaucuuuauucu

SEQ ID NO: 101542 - RNA, 22 nt, Human
gcucacugcaaccuccgcaucc

SEQ ID NO: 101543 - RNA, 23 nt, Human
aaaagugaccgcucuugcucuug

SEQ ID NO: 101544 - RNA, 26 nt, Human
accagcaccacuuccuugcuuuuucc

SEQ ID NO: 101545 - RNA, 21 nt, Human
uaaauauugauuucugccuuc

SEQ ID NO: 101546 - RNA, 21 nt, Human
uuugccacaaccagccuuugc

SEQ ID NO: 101547 - RNA, 20 nt, Human
gauucuggaucuccugcugc

SEQ ID NO: 101548 - RNA, 22 nt, Human
aggagacuccaucacagccagg

SEQ ID NO: 101549 - RNA, 24 nt, Human
cugcgaguuuaaauguguuugucc

SEQ ID NO: 101550 - RNA, 19 nt, Human
ucacuguccagccuggagg

SEQ ID NO: 101551 - RNA, 22 nt, Human
uuuccagguggcuggaagaagg

SEQ ID NO: 101552 - RNA, 25 nt, Human
cccugaaacugagcacauuucugac

SEQ ID NO: 101553 - RNA, 22 nt, Human
agaaaacaaaauuaucuuccuu

SEQ ID NO: 101554 - RNA, 27 nt, Human
ccaccgccucugccuccaggccgcccg

SEQ ID NO: 101555 - RNA, 20 nt, Human
cccaacaauaaaauugaaga

SEQ ID NO: 101556 - RNA, 24 nt, Human
acaaaaagauauuaaauauacaga

SEQ ID NO: 101557 - RNA, 27 nt, Human
ggcccugaugauuuuuguauuuuuagu

SEQ ID NO: 101558 - RNA, 19 nt, Human
agagagggaguaggagaga

SEQ ID NO: 101559 - RNA, 25 nt, Human
uggggaaaguagcauuccuccaccu

SEQ ID NO: 101560 - RNA, 23 nt, Human
uuauuuuuaauuauuauuucccc

SEQ ID NO: 101561 - RNA, 27 nt, Human
cauugcgaggacccagaaauucauacu

SEQ ID NO: 101562 - RNA, 30 nt, Human
ggcagccagggagagcccaggagcuccccu

SEQ ID NO: 101563 - RNA, 21 nt, Human
agccucuacuuucuucuugcc

SEQ ID NO: 101564 - RNA, 24 nt, Human
ccaaccuggugaaaccccgucucu

SEQ ID NO: 101565 - RNA, 22 nt, Human
ucaugaucugcuugacugugag

SEQ ID NO: 101566 - RNA, 24 nt, Human
ggcugcauauucaugaauagaguu

SEQ ID NO: 101567 - RNA, 21 nt, Human
gcacaguacacauacgugcau

SEQ ID NO: 101568 - RNA, 18 nt, Human
aaguaaaaugucuuucca

SEQ ID NO: 101569 - RNA, 22 nt, Human
aaaggaagaggcugacaauaag

SEQ ID NO: 101570 - RNA, 21 nt, Human
ugugcauuugggcugaagaca

SEQ ID NO: 101571 - RNA, 20 nt, Human
caggacucgugcugcaguga

SEQ ID NO: 101572 - RNA, 32 nt, Human
gauggggcggggcuuggaaggagcagggagcc

SEQ ID NO: 101573 - RNA, 28 nt, Human
uuggaagggaaauggcucugggcuggaa

SEQ ID NO: 101574 - RNA, 22 nt, Human
uguagggacggacauugcaguu

SEQ ID NO: 101575 - RNA, 24 nt, Human
gugggggagggagcgccuggagga

SEQ ID NO: 101576 - RNA, 25 nt, Human
ugucgcggggcgcgccgccaccuca

SEQ ID NO: 101577 - RNA, 23 nt, Human
gcugggagcgggguugugacugc

SEQ ID NO: 101578 - RNA, 20 nt, Human
uccucauucauucuuuauca

SEQ ID NO: 101579 - RNA, 27 nt, Human
cugccuggccacugagcacuggccgag

SEQ ID NO: 101580 - RNA, 21 nt, Human
acuguauuguauaaaaugcug

SEQ ID NO: 101581 - RNA, 26 nt, Human
acaaguguccagagaucguagccaga

SEQ ID NO: 101582 - RNA, 22 nt, Human
gggaaagagaauguuccuggua

SEQ ID NO: 101583 - RNA, 19 nt, Human
uauaguuauuaauacugua

SEQ ID NO: 101584 - RNA, 21 nt, Human
ucagccccagcccagacaaag

SEQ ID NO: 101585 - RNA, 22 nt, Human
gcccccaccccagcacagcucc

SEQ ID NO: 101586 - RNA, 22 nt, Human
uucuuuagcaagauauucuggu

SEQ ID NO: 101587 - RNA, 26 nt, Human
ggacccccucccccacccaccucucu

SEQ ID NO: 101588 - RNA, 20 nt, Human
cugcaccugccugccgcugc

SEQ ID NO: 101589 - RNA, 25 nt, Human
guggcccagcuggcuggaguccagg

SEQ ID NO: 101590 - RNA, 26 nt, Human
acgcaggacacuuagagcucucuaga

SEQ ID NO: 101591 - RNA, 22 nt, Human
ggaagagggccaucugccugaa

SEQ ID NO: 101592 - RNA, 23 nt, Human
cuguacucccagcuacucgggug

SEQ ID NO: 101593 - RNA, 28 nt, Human
aguaguuuucaauuccgguugauuuuug

SEQ ID NO: 101594 - RNA, 21 nt, Human
ugggagccucguggguggggc

SEQ ID NO: 101595 - RNA, 21 nt, Human
ccuccugaaacaucagcccug

SEQ ID NO: 101596 - RNA, 22 nt, Human
gcucggcuccgccacugccgcc

SEQ ID NO: 101597 - RNA, 22 nt, Human
uuuuauuugcaaaacaaggaaa

SEQ ID NO: 101598 - RNA, 22 nt, Human
ucccacauuauuugucuccaug

SEQ ID NO: 101599 - RNA, 25 nt, Human
agcuccccucggagaagagcuguuc

SEQ ID NO: 101600 - RNA, 23 nt, Human
uccuguaaguauucuggagcuuu

SEQ ID NO: 101601 - RNA, 25 nt, Human
ccacacacaugcacacauaucuagc

SEQ ID NO: 101602 - RNA, 22 nt, Human
cccaccuucuugggacugcugu

SEQ ID NO: 101603 - RNA, 22 nt, Human
ucuuccuccuuagccuauuuuc

SEQ ID NO: 101604 - RNA, 18 nt, Human
ucuuacauucuuuuucuu

SEQ ID NO: 101605 - RNA, 24 nt, Human
ugugcuucaaggcccaggagggag

SEQ ID NO: 101606 - RNA, 29 nt, Human
guaccccaucccuuccuccccagucuacg

SEQ ID NO: 101607 - RNA, 20 nt, Human
gccagccacgacguuuccuc

SEQ ID NO: 101608 - RNA, 21 nt, Human
ccgggagggcuuccuggacac

SEQ ID NO: 101609 - RNA, 27 nt, Human
gcuuuugccaacacaucuuguaacuua

SEQ ID NO: 101610 - RNA, 18 nt, Human
caggcuggagugcaguga

SEQ ID NO: 101611 - RNA, 26 nt, Human
caggagggaaacccuauggcugcagu

SEQ ID NO: 101612 - RNA, 21 nt, Human
ugcagugaugugaucauagcu

SEQ ID NO: 101613 - RNA, 23 nt, Human
cacugucucauccacauaagcac

SEQ ID NO: 101614 - RNA, 20 nt, Human
cuccaguaucccucauucca

SEQ ID NO: 101615 - RNA, 21 nt, Human
uccuuauuccucccccgaccu

SEQ ID NO: 101616 - RNA, 27 nt, Human
uuauugagaucuaagucugucuugccu

SEQ ID NO: 101617 - RNA, 26 nt, Human
cucccagcugcucuucuacagaugcc

SEQ ID NO: 101618 - RNA, 25 nt, Human
ccugccaucuggcccuucccuuugu

SEQ ID NO: 101619 - RNA, 23 nt, Human
ccaggagucccuguagccuggcu

SEQ ID NO: 101620 - RNA, 26 nt, Human
agcuggagagagagugaagugaaugc

SEQ ID NO: 101621 - RNA, 21 nt, Human
agggagaccccuccuuuugua

SEQ ID NO: 101622 - RNA, 27 nt, Human
auugcuugagcucaggaguucaaggcu

SEQ ID NO: 101623 - RNA, 24 nt, Human
caccucacaggcuguugugaggac

SEQ ID NO: 101624 - RNA, 22 nt, Human
ugcagugagcucagauugcguc

SEQ ID NO: 101625 - RNA, 27 nt, Human
ucaccuuuucgcuuuuuccaagauggc

SEQ ID NO: 101626 - RNA, 21 nt, Human
ucuccucuacagauuuuugcu

SEQ ID NO: 101627 - RNA, 18 nt, Human
gccgggcgugguggcaca

SEQ ID NO: 101628 - RNA, 26 nt, Human
uccaauaaauuauauaccugccuaag

SEQ ID NO: 101629 - RNA, 26 nt, Human
ucucucucugaacacccccauucucc

SEQ ID NO: 101630 - RNA, 25 nt, Human
cucugucugugccgaguguauuaua

SEQ ID NO: 101631 - RNA, 25 nt, Human
ugcaaaugcacagagaaaauaaaac

SEQ ID NO: 101632 - RNA, 25 nt, Human
ucauuagcugugugacucuggguga

SEQ ID NO: 101633 - RNA, 32 nt, Human; identical to SEQ ID NO: 8273

SEQ ID NO: 101634 - RNA, 22 nt, Human
ggcauuuuccugaugaucuuua

SEQ ID NO: 101635 - RNA, 22 nt, Human
acugcagccucaaacuccuggg

SEQ ID NO: 101636 - RNA, 27 nt, Human
cucaaaguacugggauuauauaggcau

SEQ ID NO: 101637 - RNA, 25 nt, Human
aucuguguuuuacuuuauuguguuu

SEQ ID NO: 101638 - RNA, 22 nt, Human
cugccagaaccuuggggaugug

SEQ ID NO: 101639 - RNA, 21 nt, Human
aguccacaagguccggauguc

SEQ ID NO: 101640 - RNA, 22 nt, Human
ccacaaaccucaacaugugcca

SEQ ID NO: 101641 - RNA, 21 nt, Human
gcucugaaggaggagcaggug

SEQ ID NO: 101642 - RNA, 23 nt, Human
ugucccccugucagcugccucca

SEQ ID NO: 101643 - RNA, 24 nt, Human
cccagcccccuccuggugccaccu

SEQ ID NO: 101644 - RNA, 23 nt, Human
uaccacagacauacuaaccagca

SEQ ID NO: 101645 - RNA, 25 nt, Human
gccuuucucucagccucuggaagcc

SEQ ID NO: 101646 - RNA, 24 nt, Human
gagacagacccacccccaagcagg

SEQ ID NO: 101647 - RNA, 25 nt, Human
gcuacuuccucgguucccuccccga

SEQ ID NO: 101648 - RNA, 23 nt, Human
ucccuccguauguaccccugucu

SEQ ID NO: 101649 - RNA, 27 nt, Human
gccguuuacaguuuugcacagugaucu

SEQ ID NO: 101650 - RNA, 22 nt, Human
gaauggggccuuguugugucau

SEQ ID NO: 101651 - RNA, 22 nt, Human
aagcauccuucuaagacauucu

SEQ ID NO: 101652 - RNA, 26 nt, Human
aggacuguucuucccacugcaaucug

SEQ ID NO: 101653 - RNA, 22 nt, Human
ccccacccacuccaucaucucc

SEQ ID NO: 101654 - RNA, 23 nt, Human
uuucaacagguggaaguguuggu

SEQ ID NO: 101655 - RNA, 25 nt, Human
acucugcccacacuucccugccuag

SEQ ID NO: 101656 - RNA, 24 nt, Human
ucugagaaguugaggcaaaucagu

SEQ ID NO: 101657 - RNA, 20 nt, Human
gaaagcuuuuagcacaguau

SEQ ID NO: 101658 - RNA, 23 nt, Human
ccuucugcugcccaaccugacuu

SEQ ID NO: 101659 - RNA, 22 nt, Human
ugccauugcacuccaaccuggg

SEQ ID NO: 101660 - RNA, 24 nt, Human
cugggagcagagguggcuuugucu

SEQ ID NO: 101661 - RNA, 22 nt, Human
acagggagaccggugcgauggc

SEQ ID NO: 101662 - RNA, 22 nt, Human
accgccaccuccgccccccggg

SEQ ID NO: 101663 - RNA, 22 nt, Human
cucaccauguugcccaggcugg

SEQ ID NO: 101664 - RNA, 24 nt, Human
cuccuggcucaagaauuacuccga

SEQ ID NO: 101665 - RNA, 24 nt, Human
ucugcugcuggauuucaugucuuc

SEQ ID NO: 101666 - RNA, 23 nt, Human
gucguaggggauggagugacagc

SEQ ID NO: 101667 - RNA, 22 nt, Human
ugcccaggcuggagugcaguag

SEQ ID NO: 101668 - RNA, 22 nt, Human
ugcccaggcuggggugcagugg

SEQ ID NO: 101669 - RNA, 23 nt, Human
ccaugcaggaucacucaggauuu

SEQ ID NO: 101670 - RNA, 24 nt, Human
uaucuguuuccccuuccuugucag

SEQ ID NO: 101671 - RNA, 24 nt, Human
uuugucaccaggcuggagugcagu

SEQ ID NO: 101672 - RNA, 19 nt, Human
aacuuccccccaaaaaagg

SEQ ID NO: 101673 - RNA, 23 nt, Human
uggugccccucacaagccgcagc

SEQ ID NO: 101674 - RNA, 26 nt, Human
aggaagagggcugagcugagcuucgg

SEQ ID NO: 101675 - RNA, 21 nt, Human
ggucccagggaacccagucca

SEQ ID NO: 101676 - RNA, 21 nt, Human
uccgcccaggcugcagugcag

SEQ ID NO: 101677 - RNA, 22 nt, Human
gagaggccugaagggacugccu

SEQ ID NO: 101678 - RNA, 22 nt, Human
ugguucgugccuguaaucccag

SEQ ID NO: 101679 - RNA, 21 nt, Human
caggccucaggcccagcaccc

SEQ ID NO: 101680 - RNA, 22 nt, Human
uuuucaacauguagggcaagag

SEQ ID NO: 101681 - RNA, 25 nt, Human
uugcccagaguucaguccuggcugg

SEQ ID NO: 101682 - RNA, 26 nt, Human
gcaaguguccucugacagccgugucc

SEQ ID NO: 101683 - RNA, 22 nt, Human
ggucccugcugagugcgcugcc

SEQ ID NO: 101684 - RNA, 27 nt, Human
gggagugagcucucaaccacagauagc

SEQ ID NO: 101685 - RNA, 25 nt, Human
uuccaccucuccaguauugcaggac

SEQ ID NO: 101686 - RNA, 21 nt, Human
gcauauggacuacaaagacac

SEQ ID NO: 101687 - RNA, 23 nt, Human
gauuaaaaucaaagauacuucua

SEQ ID NO: 101688 - RNA, 23 nt, Human
gggaaucccagaaugucaagcca

SEQ ID NO: 101689 - RNA, 22 nt, Human
aaaaucuaggccgggugcagug

SEQ ID NO: 101690 - RNA, 21 nt, Human
gugccaggcugaauuacagug

SEQ ID NO: 101691 - RNA, 25 nt, Human
uacuccacuucgcuucucugcucca

SEQ ID NO: 101692 - RNA, 19 nt, Human
cuccaccugggucaucucc

SEQ ID NO: 101693 - RNA, 22 nt, Human
ugcccugggcucaucagccuuc

SEQ ID NO: 101694 - RNA, 22 nt, Human
uucaaaacauugaaacacucuu

SEQ ID NO: 101695 - RNA, 20 nt, Human
gcagcugcaauacacagugu

SEQ ID NO: 101696 - RNA, 21 nt, Human
gggaagcagaggcuggaggau

SEQ ID NO: 101697 - RNA, 23 nt, Human
gggaugggaacaggcugugcauc

SEQ ID NO: 101698 - RNA, 23 nt, Human
gcccuuccccuucuguuucuccc

SEQ ID NO: 101699 - RNA, 27 nt, Human
uuuucacauuucuuccucuucguggcu

SEQ ID NO: 101700 - RNA, 27 nt, Human
ucuagggucugaugcuguuuuuguucc

SEQ ID NO: 101701 - RNA, 22 nt, Human
cccaccccacguuuggacauuu

SEQ ID NO: 101702 - RNA, 21 nt, Human
agguauaauaaggaaaggauc

SEQ ID NO: 101703 - RNA, 26 nt, Human
acaaauucuuaauagguucaaaagca

SEQ ID NO: 101704 - RNA, 26 nt, Human
gccuugaacucugggcucaagcaauc

SEQ ID NO: 101705 - RNA, 22 nt, Human
cccucugccccuuccucucugc

SEQ ID NO: 101706 - RNA, 22 nt, Human
aaugagcugcaauaacaggaac

SEQ ID NO: 101707 - RNA, 22 nt, Human
auuucuggaacauucagucuag

SEQ ID NO: 101708 - RNA, 27 nt, Human
ccacacccuccccauucagacacuuca

SEQ ID NO: 101709 - RNA, 22 nt, Human
ugggcaagauggugaaacccca

SEQ ID NO: 101710 - RNA, 16 nt, Human
ucauucuucucuccca

SEQ ID NO: 101711 - RNA, 19 nt, Human
cgaccccauggagcuguau

SEQ ID NO: 101712 - RNA, 25 nt, Human
ugacuucuucccgacccagaaagca

SEQ ID NO: 101713 - RNA, 22 nt, Human
uggcuuaugcuuguaaucccag

SEQ ID NO: 101714 - RNA, 18 nt, Human
agacauuuuaagcauuuu

SEQ ID NO: 101715 - RNA, 22 nt, Human
aaagugcugcgauuacaggcau

SEQ ID NO: 101716 - RNA, 22 nt, Human
acaagcagauaccgauugcuuc

SEQ ID NO: 101717 - RNA, 18 nt, Human
cgggaagaggcagaggga

SEQ ID NO: 101718 - RNA, 26 nt, Human
gggagguggaaggacccugugcccuc

SEQ ID NO: 101719 - RNA, 32 nt, Human
cuguuuggagucuggcuggcucugagcauugc

SEQ ID NO: 101720 - RNA, 19 nt, Human
gugauucaagauauuuaca

SEQ ID NO: 101721 - RNA, 19 nt, Human
caguucuguggugcugcuc

SEQ ID NO: 101722 - RNA, 27 nt, Human
cugccccucucacacauguggggccgg

SEQ ID NO: 101723 - RNA, 22 nt, Human
ggggagugacagguccacacac

SEQ ID NO: 101724 - RNA, 26 nt, Human
ccuccaggagugcaaggaugaugcug

SEQ ID NO: 101725 - RNA, 20 nt, Human
cagauuuccuggugagguug

SEQ ID NO: 101726 - RNA, 27 nt, Human
cuucccaagugagucucucugggccuu

SEQ ID NO: 101727 - RNA, 21 nt, Human
agucuccaauauugcagguuu

SEQ ID NO: 101728 - RNA, 24 nt, Human
uuacagcaagauucuaacuaacua

SEQ ID NO: 101729 - RNA, 20 nt, Human
uuucauguuuugugacuaua

SEQ ID NO: 101730 - RNA, 21 nt, Human
uuugcugucuugucuccuggg

SEQ ID NO: 101731 - RNA, 19 nt, Human
cuuccaauuaggaucuuau

SEQ ID NO: 101732 - RNA, 21 nt, Human
uugcagugagcagugcagugg

SEQ ID NO: 101733 - RNA, 22 nt, Human
uggcuaguaguuucuucauuug

SEQ ID NO: 101734 - RNA, 22 nt, Human
uugagguaggagaauugcuuga

SEQ ID NO: 101735 - RNA, 30 nt, Human
uuucccagaaaaucaguauuauuuuuuaaa

SEQ ID NO: 101736 - RNA, 19 nt, Human
gccugcagucucauccugc

SEQ ID NO: 101737 - RNA, 23 nt, Human
ucagcacuugggggaucuguugu

SEQ ID NO: 101738 - RNA, 23 nt, Human
ggcagggggaggggagugugagg

SEQ ID NO: 101739 - RNA, 20 nt, Human
uaugugugcauguguguaua

SEQ ID NO: 101740 - RNA, 25 nt, Human
ggaggcggaggaggaggcggaggag

SEQ ID NO: 101741 - RNA, 24 nt, Human
agaaggacagcagcaagcauaggc

SEQ ID NO: 101742 - RNA, 26 nt, Human
aauuaugcuaccuacugauaaccacu

SEQ ID NO: 101743 - RNA, 24 nt, Human
acugucccggaggagguugggagg

SEQ ID NO: 101744 - RNA, 26 nt, Human
gucaauguacacuuccuccuuauugg

SEQ ID NO: 101745 - RNA, 22 nt, Human
gaacucgugaccgcaagcgauu

SEQ ID NO: 101746 - RNA, 20 nt, Human
uucauucuguugaugguuua

SEQ ID NO: 101747 - RNA, 23 nt, Human
gcucugaaagcuaauugcuucaa

SEQ ID NO: 101748 - RNA, 20 nt, Human
gucugcaggcaccaggcugg

SEQ ID NO: 101749 - RNA, 23 nt, Human
cagcugccacuccaucuccagcu

SEQ ID NO: 101750 - RNA, 19 nt, Human
gguaaaaugucucaggcaa

SEQ ID NO: 101751 - RNA, 25 nt, Human
gcacuagaaaacagcucaucuauug

SEQ ID NO: 101752 - RNA, 23 nt, Human
uuugagauacaaacauguuccug

SEQ ID NO: 101753 - RNA, 21 nt, Human
gagccucccgguguauuugaa

SEQ ID NO: 101754 - RNA, 30 nt, Human
ucuacgauuuucuucuacauucauugaugc

SEQ ID NO: 101755 - RNA, 20 nt, Human
ccuccacuuccccacacuuc

SEQ ID NO: 101756 - RNA, 27 nt, Human
acagagccugccuaaccaggcccagcc

SEQ ID NO: 101757 - RNA, 27 nt, Human
ccagccaggaaccucucagagcugaag

SEQ ID NO: 101758 - RNA, 27 nt, Human
uugacuuguauuuuuaaaaauugcuca

SEQ ID NO: 101759 - RNA, 20 nt, Human
uucaaacccacauguggcuc

SEQ ID NO: 101760 - RNA, 26 nt, Human
ugagugccucaggaagcagcugggcc

SEQ ID NO: 101761 - RNA, 21 nt, Human
aguccacaagggguauaucuu

SEQ ID NO: 101762 - RNA, 22 nt, Human
auccugugcugugcacaccugc

SEQ ID NO: 101763 - RNA, 21 nt, Human
ugcagugagcugugaugugcc

SEQ ID NO: 101764 - RNA, 23 nt, Human
ugcuuuccauccagcugggaguc

SEQ ID NO: 101765 - RNA, 22 nt, Human
agcuaauuuuugcauuuuuagu

SEQ ID NO: 101766 - RNA, 27 nt, Human
cccacuuucauucaaucaaccugcacu

SEQ ID NO: 101767 - RNA, 22 nt, Human
cauuccggaagaacugcagcuu

SEQ ID NO: 101768 - RNA, 16 nt, Human
gagacaccacauucca

SEQ ID NO: 101769 - RNA, 21 nt, Human
cuagcuuucaaaaauuaguga

SEQ ID NO: 101770 - RNA, 24 nt, Human
gcagcaggugugugcagguaucuu

SEQ ID NO: 101771 - RNA, 20 nt, Human
guagaggugauuaaaaccaa

SEQ ID NO: 101772 - RNA, 22 nt, Human
uuccugugguuguaugcacuga

SEQ ID NO: 101773 - RNA, 21 nt, Human
cuggggcacuuuaaaucugag

SEQ ID NO: 101774 - RNA, 24 nt, Human
ggagguacugagacagggugcuga

SEQ ID NO: 101775 - RNA, 22 nt, Human
aggcugaggugggaggaucgcu

SEQ ID NO: 101776 - RNA, 27 nt, Human
ccuucauuagacguuugcucuugucuu

SEQ ID NO: 101777 - RNA, 22 nt, Human
ccugcugcugcucugaggacuc

SEQ ID NO: 101778 - RNA, 21 nt, Human
agaaaugucaaccccuaggaa

SEQ ID NO: 101779 - RNA, 23 nt, Human
gccacccaggcuggaguacagug

SEQ ID NO: 101780 - RNA, 26 nt, Human
guuucauauucucagaugggcugaua

SEQ ID NO: 101781 - RNA, 22 nt, Human
uaucugaagguuacaaauuaga

SEQ ID NO: 101782 - RNA, 18 nt, Human
ccucuugccacugccuuc

SEQ ID NO: 101783 - RNA, 22 nt, Human
gggauuacaagcgugagccacu

SEQ ID NO: 101784 - RNA, 14 nt, Human
uacauacauuuucc

SEQ ID NO: 101785 - RNA, 22 nt, Human
ugaacuccugacgucaagugau

SEQ ID NO: 101786 - RNA, 22 nt, Human
gguuuguaguugaauauuggcc

SEQ ID NO: 101787 - RNA, 21 nt, Human
agcugguuucaugugcuuuau

SEQ ID NO: 101788 - RNA, 21 nt, Human
cgccugcaaucccagcacuuu

SEQ ID NO: 101789 - RNA, 20 nt, Human
cugagccuuggaccagccac

SEQ ID NO: 101790 - RNA, 21 nt, Human
ggagacggugguugcagugag

SEQ ID NO: 101791 - RNA, 23 nt, Human
gauuaccuuucugcuccugaauc

SEQ ID NO: 101792 - RNA, 23 nt, Human
cuugcaccauuuuauuccauucc

SEQ ID NO: 101793 - RNA, 23 nt, Human
agcuuaagggaggcuucuugccu

SEQ ID NO: 101794 - RNA, 21 nt, Human
uaggggaauguauuaguccaa

SEQ ID NO: 101795 - RNA, 22 nt, Human
guggcggggcagcaggagcggu

SEQ ID NO: 101796 - RNA, 22 nt, Human
uaccacauggagagauuuucca

SEQ ID NO: 101797 - RNA, 22 nt, Human
aggauuacaggugccugccacc

SEQ ID NO: 101798 - RNA, 27 nt, Human
uuaguaaauaaucauuuuaguuuuucu

SEQ ID NO: 101799 - RNA, 21 nt, Human
ccauugucaccuaacucugaa

SEQ ID NO: 101800 - RNA, 21 nt, Human
uagccccagccaccagccugu

SEQ ID NO: 101801 - RNA, 26 nt, Human
auaagccucaggcccugggaaaccuc

SEQ ID NO: 101802 - RNA, 24 nt, Human
ggaaugcucaguuucauuugccaa

SEQ ID NO: 101803 - RNA, 20 nt, Human
cuaggaagaccagaucaaua

SEQ ID NO: 101804 - RNA, 27 nt, Human
ggagcacccucccugcccgucuugucc

SEQ ID NO: 101805 - RNA, 23 nt, Human
ugagcccuagcugugggcuagaa

SEQ ID NO: 101806 - RNA, 21 nt, Human
ucuuucucccuauccugggcc

SEQ ID NO: 101807 - RNA, 21 nt, Human
cacugcacaccagcccagcuc

SEQ ID NO: 101808 - RNA, 26 nt, Human
ccaggauauggaggcaaggggaacaa

SEQ ID NO: 101809 - RNA, 25 nt, Human
uggaauaacugcaagggcucugcug

SEQ ID NO: 101810 - RNA, 27 nt, Human
gggaccggggcugggcgcuggagccag

SEQ ID NO: 101811 - RNA, 24 nt, Human
ugugaacuguuucucuucugcaga

SEQ ID NO: 101812 - RNA, 26 nt, Human
aucuuaguucuucauuacugcauuga

SEQ ID NO: 101813 - RNA, 29 nt, Human
cagagagacaccucugucucugaaaaaac

SEQ ID NO: 101814 - RNA, 26 nt, Human
aaccaaaaccccaagcacccauuaaa

SEQ ID NO: 101815 - RNA, 20 nt, Human
ggucaucuggaccaucguac

SEQ ID NO: 101816 - RNA, 26 nt, Human
uucugaguucacagagcaaauuagga

SEQ ID NO: 101817 - RNA, 23 nt, Human
uccugcacacgugcacauucaug

SEQ ID NO: 101818 - RNA, 28 nt, Human
acccugcgugucgccagccucugggcaa

SEQ ID NO: 101819 - RNA, 27 nt, Human
ggacccccgggauugacuagagaccgg

SEQ ID NO: 101820 - RNA, 21 nt, Human
ggugccacugccuccucaaau

SEQ ID NO: 101821 - RNA, 23 nt, Human
ccagcucaccaguuaucaacuga

SEQ ID NO: 101822 - RNA, 23 nt, Human
uaaaccaaguauuguaaaauaaa

SEQ ID NO: 101823 - RNA, 28 nt, Human
gcuagcaaacaaauggcuuacuuacaaa

SEQ ID NO: 101824 - RNA, 17 nt, Human
agggaggcgugccugag

SEQ ID NO: 101825 - RNA, 24 nt, Human
ccccucugaccccugccugugggc

SEQ ID NO: 101826 - RNA, 23 nt, Human
ugagaaaaggauuguuugcucaa

SEQ ID NO: 101827 - RNA, 22 nt, Human
ugucacccaggcugcaguguag

SEQ ID NO: 101828 - RNA, 22 nt, Human
cugcccaggggacguggcgcug

SEQ ID NO: 101829 - RNA, 24 nt, Human
ggggugagccccaaaccuuacugg

SEQ ID NO: 101830 - RNA, 26 nt, Human
cugggcucgccgggagacggagaagc

SEQ ID NO: 101831 - RNA, 21 nt, Human
cacaguccuggacuccugcca

SEQ ID NO: 101832 - RNA, 21 nt, Human
ugggggcaaacuuuccucuug

SEQ ID NO: 101833 - RNA, 21 nt, Human
uuuacuuccuuccccuguugu

SEQ ID NO: 101834 - RNA, 21 nt, Human
caguguugcgcgucacaagag

SEQ ID NO: 101835 - RNA, 26 nt, Human
ccuguccuuuccagaggcccugccga

SEQ ID NO: 101836 - RNA, 19 nt, Human
aaaaucacuuuaacuuuuc

SEQ ID NO: 101837 - RNA, 25 nt, Human
cugagcauagugagagcaguggugg

SEQ ID NO: 101838 - RNA, 20 nt, Human
auguaagaagaaacugcuua

SEQ ID NO: 101839 - RNA, 26 nt, Human
gcucccucucccuucuaucuuucuuu

SEQ ID NO: 101840 - RNA, 27 nt, Human
uucuccucuguacagacagcugaguca

SEQ ID NO: 101841 - RNA, 24 nt, Human
ggcgagggagagcccccggccggc

SEQ ID NO: 101842 - RNA, 22 nt, Human
ucuccuccgcugucaugccugc

SEQ ID NO: 101843 - RNA, 23 nt, Human
auacauuuaaaauggaaaugcag

SEQ ID NO: 101844 - RNA, 21 nt, Human
agacagccacaugaggggaca

SEQ ID NO: 101845 - RNA, 22 nt, Human
gaggcguuggauaagccugggg

SEQ ID NO: 101846 - RNA, 24 nt, Human
acucuguugaucagaaccugugga

SEQ ID NO: 101847 - RNA, 28 nt, Human
ggauguaaagccacagaaugggauuuau

SEQ ID NO: 101848 - RNA, 23 nt, Human
cagagccagaagccagagggcca

SEQ ID NO: 101849 - RNA, 29 nt, Human
ggcuagagguggaggaggcaguccuggga

SEQ ID NO: 101850 - RNA, 27 nt, Human
uugccuuacucauuucuaagugcaaua

SEQ ID NO: 101851 - RNA, 23 nt, Human
ucccagcccagucaaagcaccgc

SEQ ID NO: 101852 - RNA, 22 nt, Human
gggagguggagguugcagugag

SEQ ID NO: 101853 - RNA, 24 nt, Human
cuguggacuucaugauuguuguug

SEQ ID NO: 101854 - RNA, 22 nt, Human
gcucgcugcagccacugccucc

SEQ ID NO: 101855 - RNA, 19 nt, Human
ucaucuccaugcucuuuca

SEQ ID NO: 101856 - RNA, 22 nt, Human
ugcuuuugagucacauggggaa

SEQ ID NO: 101857 - RNA, 22 nt, Human
ccucuacugcuucucugauacc

SEQ ID NO: 101858 - RNA, 26 nt, Human
gcaaccagcucugggcucaguuuccu

SEQ ID NO: 101859 - RNA, 25 nt, Human
acucacugcggagaaccuugugccu

SEQ ID NO: 101860 - RNA, 21 nt, Human
auuccugauaaugugcuucug

SEQ ID NO: 101861 - RNA, 23 nt, Human
acaggggagaugugcaccuuuca

SEQ ID NO: 101862 - RNA, 20 nt, Human
ccuuucuccaggaccaauaa

SEQ ID NO: 101863 - RNA, 26 nt, Human
aacuguacauuaguacauacucagua

SEQ ID NO: 101864 - RNA, 27 nt, Human
ugccagacccacugaaaugaccaagac

SEQ ID NO: 101865 - RNA, 23 nt, Human
caagauuuugaaggaaaugagug

SEQ ID NO: 101866 - RNA, 22 nt, Human
augaauagcugggauuacaggu

SEQ ID NO: 101867 - RNA, 25 nt, Human
agucucccaagccaaaauuuugaca

SEQ ID NO: 101868 - RNA, 24 nt, Human
agccaggccucuccugggagccac

SEQ ID NO: 101869 - RNA, 21 nt, Human
gggcuggggcucugagccaga

SEQ ID NO: 101870 - RNA, 26 nt, Human
gagcaucuccuccuuaucccucgaug

SEQ ID NO: 101871 - RNA, 24 nt, Human
gcagaccuugugaggacuagagga

SEQ ID NO: 101872 - RNA, 26 nt, Human
gcacucugcaaccaguguugccugcc

SEQ ID NO: 101873 - RNA, 22 nt, Human
ccagagcacugguugcagggga

SEQ ID NO: 101874 - RNA, 22 nt, Human
ccuccacuccuuccaucucuuc

SEQ ID NO: 101875 - RNA, 26 nt, Human
ugccuccagccccaccuuccccggga

SEQ ID NO: 101876 - RNA, 22 nt, Human
ccauuguacuccagccugugug

SEQ ID NO: 101877 - RNA, 21 nt, Human
aaacuguauacauuacaauca

SEQ ID NO: 101878 - RNA, 23 nt, Human
accuucuccaacauacauccugc

SEQ ID NO: 101879 - RNA, 25 nt, Human
ucuuuacugcugagauccuugggaa

SEQ ID NO: 101880 - RNA, 26 nt, Human
uucucccauauuggcauggauuucug

SEQ ID NO: 101881 - RNA, 23 nt, Human
ccagaaauuuggaaggcuguaga

SEQ ID NO: 101882 - RNA, 22 nt, Human
uuucaccguaaccucugccucc

SEQ ID NO: 101883 - RNA, 25 nt, Human
uggcuggcagagguuucuagggugg

SEQ ID NO: 101884 - RNA, 23 nt, Human
agaggaagaacauguugcgauug

SEQ ID NO: 101885 - RNA, 20 nt, Human
ugaaugaguuugacacugcc

SEQ ID NO: 101886 - RNA, 20 nt, Human
augcacccaguacugcuaca

SEQ ID NO: 101887 - RNA, 22 nt, Human
cccugcucccucucucuguccc

SEQ ID NO: 101888 - RNA, 23 nt, Human
gcauguagccaguuaaggaaaga

SEQ ID NO: 101889 - RNA, 21 nt, Human
ugugaccccuccuggggccag

SEQ ID NO: 101890 - RNA, 19 nt, Human
uuggucagcaaaaccaaga

SEQ ID NO: 101891 - RNA, 23 nt, Human
ccucucgcucucucacuccacua

SEQ ID NO: 101892 - RNA, 27 nt, Human
acugcaacuggcuguuccugaagucug

SEQ ID NO: 101893 - RNA, 27 nt, Human
cagucucuuaauccguuaaugcuuuug

SEQ ID NO: 101894 - RNA, 19 nt, Human
aagaaguuugaacauuugg

SEQ ID NO: 101895 - RNA, 24 nt, Human
uguacuaucagguucacaaacuuc

SEQ ID NO: 101896 - RNA, 27 nt, Human
gcucugucgcccaugcuggagugcagu

SEQ ID NO: 101897 - RNA, 27 nt, Human
cguccgccggcgccucagguuuccccc

SEQ ID NO: 101898 - RNA, 20 nt, Human
cccuccucccuucucauggg

SEQ ID NO: 101899 - RNA, 20 nt, Human
acucuaccauguccagugga

SEQ ID NO: 101900 - RNA, 23 nt, Human
uuuuaauaacauaucuaaaguca

SEQ ID NO: 101901 - RNA, 21 nt, Human
ugcagugccauguaaaucccc

SEQ ID NO: 101902 - RNA, 20 nt, Human
ugaaaaugugaauugcauga

SEQ ID NO: 101903 - RNA, 26 nt, Human
uuugcuucuagaccagccucugucua

SEQ ID NO: 101904 - RNA, 23 nt, Human
aucccugcacugcuccugaggcc

SEQ ID NO: 101905 - RNA, 22 nt, Human
gccucuuuuuccuucuucagca

SEQ ID NO: 101906 - RNA, 24 nt, Human
gcacuauauuucaucuuugaggcu

SEQ ID NO: 101907 - RNA, 20 nt, Human
acuaaauuuaagguuuuguu

SEQ ID NO: 101908 - RNA, 19 nt, Human
ccugcugcuacagaauguu

SEQ ID NO: 101909 - RNA, 23 nt, Human
ugccuuugucacagagcagggug

SEQ ID NO: 101910 - RNA, 23 nt, Human
gucgcccaggcuggaguacagug

SEQ ID NO: 101911 - RNA, 23 nt, Human
gucgcccagacuggagugcagug

SEQ ID NO: 101912 - RNA, 27 nt, Human
aggguucccucaagaggaagugagcgg

SEQ ID NO: 101913 - RNA, 26 nt, Human
cugggcggggaagcuggggugaggga

SEQ ID NO: 101914 - RNA, 31 nt, Human
agguuuuugagcaugaaugagcuuaaagcuu

SEQ ID NO: 101915 - RNA, 26 nt, Human
uuauuucucacuguucauucuauuug

SEQ ID NO: 101916 - RNA, 31 nt, Human
gccugggcuaagcuccugggcugugcgucca

SEQ ID NO: 101917 - RNA, 22 nt, Human
cuccacccuccccguuuuugcu

SEQ ID NO: 101918 - RNA, 26 nt, Human
ccucugccuccugggcucaagcaauc

SEQ ID NO: 101919 - RNA, 22 nt, Human
uuuacacccuguaauuuauuca

SEQ ID NO: 101920 - RNA, 26 nt, Human
uucccucccuaucuaacccucccaug

SEQ ID NO: 101921 - RNA, 27 nt, Human
ccaagccccuagucuuagagauacccu

SEQ ID NO: 101922 - RNA, 21 nt, Human
ggcuacuguaaugcugccuca

SEQ ID NO: 101923 - RNA, 23 nt, Human
gucccugcccccuccccuucaca

SEQ ID NO: 101924 - RNA, 27 nt, Human
cagcccauccugagcuccaguccugag

SEQ ID NO: 101925 - RNA, 25 nt, Human
agucaauuaaacaccuuuacucuua

SEQ ID NO: 101926 - RNA, 27 nt, Human
uaguaguugggauuacaggcacaugcc

SEQ ID NO: 101927 - RNA, 26 nt, Human
cacugcacuccaauuuccucgggcag

SEQ ID NO: 101928 - RNA, 22 nt, Human
cauccucccauccugcacuuua

SEQ ID NO: 101929 - RNA, 21 nt, Human
gcccucuccugucugcccuag

SEQ ID NO: 101930 - RNA, 23 nt, Human
caaguagcugggauuacaggcau

SEQ ID NO: 101931 - RNA, 25 nt, Human
gucacuuuauuacucccagaacaac

SEQ ID NO: 101932 - RNA, 23 nt, Human
uaaaccaagagacaauugauguu

SEQ ID NO: 101933 - RNA, 20 nt, Human
cacauacauaaugacuuucu

SEQ ID NO: 101934 - RNA, 22 nt, Human
uccuggcgaagccucucuucua

SEQ ID NO: 101935 - RNA, 27 nt, Human
ccagccuggccaacaugcugaaaccuc

SEQ ID NO: 101936 - RNA, 28 nt, Human
gcugcauugccaaagugucuucauacca

SEQ ID NO: 101937 - RNA, 22 nt, Human
aggcagggcuuuccagacacau

SEQ ID NO: 101938 - RNA, 23 nt, Human
gccuuucuccacaaccuuguucu

SEQ ID NO: 101939 - RNA, 27 nt, Human
caguaccaguaauuagauguagaaucu

SEQ ID NO: 101940 - RNA, 18 nt, Human
uauguuuauuugagacuu

SEQ ID NO: 101941 - RNA, 26 nt, Human
agcucuacucuuuuggaccaaagcaa

SEQ ID NO: 101942 - RNA, 22 nt, Human
cgguucuuccuggaaguugacu

SEQ ID NO: 101943 - RNA, 27 nt, Human
ggagacaccucagagccccgcaaaacc

SEQ ID NO: 101944 - RNA, 23 nt, Human
cuguaaccagcuggucugggugu

SEQ ID NO: 101945 - RNA, 23 nt, Human
aaggugaggagaaagagcgcuag

SEQ ID NO: 101946 - RNA, 22 nt, Human
ccuggagacagagguugcagug

SEQ ID NO: 101947 - RNA, 23 nt, Human
ucuugcccaacuggaccuuuacu

SEQ ID NO: 101948 - RNA, 20 nt, Human
accucacugcaaauuuccuc

SEQ ID NO: 101949 - RNA, 24 nt, Human
cccugcagcacgcggccuugucug

SEQ ID NO: 101950 - RNA, 20 nt, Human
ggaccacccaggcuugaggc

SEQ ID NO: 101951 - RNA, 22 nt, Human
cacaucccuauuaacagaggca

SEQ ID NO: 101952 - RNA, 23 nt, Human
ccuucuggcccucagucuguucc

SEQ ID NO: 101953 - RNA, 19 nt, Human
aaaacauuucauuaugagg

SEQ ID NO: 101954 - RNA, 27 nt, Human
ggggagggagauaggcugccagggaca

SEQ ID NO: 101955 - RNA, 19 nt, Human
agggcggccagugcaguga

SEQ ID NO: 101956 - RNA, 22 nt, Human
ccuuugucuuacauuggcuuuu

SEQ ID NO: 101957 - RNA, 22 nt, Human
cagucaggaucucccaaagaag

SEQ ID NO: 101958 - RNA, 26 nt, Human
gcugaacaucauagccgaucuugccu

SEQ ID NO: 101959 - RNA, 21 nt, Human
uuugggguuuuaguauguguc

SEQ ID NO: 101960 - RNA, 26 nt, Human
gcagguuuauauugggaagcuguaga

SEQ ID NO: 101961 - RNA, 23 nt, Human
aauucccuccccagauaucauuu

SEQ ID NO: 101962 - RNA, 22 nt, Human
gcuacuucuugcauccuucaca

SEQ ID NO: 101963 - RNA, 26 nt, Human
uaccagccaaguacacacgaugauag

SEQ ID NO: 101964 - RNA, 23 nt, Human
cuacaucugggacugacuuuccg

SEQ ID NO: 101965 - RNA, 24 nt, Human
ccccacagccucugcugaugcaca

SEQ ID NO: 101966 - RNA, 27 nt, Human
ggggagaagcggggcagaggguucucu

SEQ ID NO: 101967 - RNA, 27 nt, Human
ggaggcugagguaggagaauugcuuga

SEQ ID NO: 101968 - RNA, 19 nt, Human
uucccugucuucugagccc

SEQ ID NO: 101969 - RNA, 21 nt, Human
agaacuccucuuguguggcca

SEQ ID NO: 101970 - RNA, 22 nt, Human
agacccaugugcuuccuugcuc

SEQ ID NO: 101971 - RNA, 20 nt, Human
ccgccucaccgccggccucc

SEQ ID NO: 101972 - RNA, 22 nt, Human
aacaaaccaaaaauguucuuca

SEQ ID NO: 101973 - RNA, 20 nt, Human
agcaaagacacacaucauca

SEQ ID NO: 101974 - RNA, 20 nt, Human
ugaaaugagugauccugccu

SEQ ID NO: 101975 - RNA, 22 nt, Human
ggcuagaugagagggaacccag

SEQ ID NO: 101976 - RNA, 22 nt, Human
guauucaaauaguaaaggccac

SEQ ID NO: 101977 - RNA, 26 nt, Human
acuauaaacaugaugucaacuuccuu

SEQ ID NO: 101978 - RNA, 25 nt, Human
cguauugaauguugccugucugccu

SEQ ID NO: 101979 - RNA, 28 nt, Human
aaucuuaaucgaugaauguaaacucggg

SEQ ID NO: 101980 - RNA, 20 nt, Human
uuagucuaucauguuuucug

SEQ ID NO: 101981 - RNA, 24 nt, Human
ugccugccacugaggguucccagc

SEQ ID NO: 101982 - RNA, 24 nt, Human
ccugggcuuucugcucccugccca

SEQ ID NO: 101983 - RNA, 24 nt, Human
uucaccccaguggccacucagcuu

SEQ ID NO: 101984 - RNA, 21 nt, Human
cacugcacuccagucuggcaa

SEQ ID NO: 101985 - RNA, 21 nt, Human
cuguuccuuuucuuuucuucu

SEQ ID NO: 101986 - RNA, 20 nt, Human
accauuuaacugcaguguaa

SEQ ID NO: 101987 - RNA, 20 nt, Human
gugacagaugguccugcagu

SEQ ID NO: 101988 - RNA, 21 nt, Human
aaucaguuauuuuuagcuuuu

SEQ ID NO: 101989 - RNA, 19 nt, Human
gcuucugcauuacuauuaa

SEQ ID NO: 101990 - RNA, 22 nt, Human
gucagagucucgcucucuuguc

SEQ ID NO: 101991 - RNA, 21 nt, Human
cuucccacuccagcaccccag

SEQ ID NO: 101992 - RNA, 20 nt, Human
agugucugaaccacccugga

SEQ ID NO: 101993 - RNA, 24 nt, Human
uguagaacuaggcucaucagaauc

SEQ ID NO: 101994 - RNA, 22 nt, Human
gucugccucagccacugccucc

SEQ ID NO: 101995 - RNA, 29 nt, Human
aggaagggaccuguggcagcucacaggca

SEQ ID NO: 101996 - RNA, 28 nt, Human
ccagucaccucugucuucagcacccuca

SEQ ID NO: 101997 - RNA, 29 nt, Human
uccaaaaaacaaaaacagaaaaacccuuu

SEQ ID NO: 101998 - RNA, 26 nt, Human
uugauuagccaugaacuugccaauca

SEQ ID NO: 101999 - RNA, 21 nt, Human
ugagaccacacagggguagcc

SEQ ID NO: 102000 - RNA, 18 nt, Human
gcacagccaggcggcccc

SEQ ID NO: 102001 - RNA, 22 nt, Human
gucugugugccccuccugcccc

SEQ ID NO: 102002 - RNA, 23 nt, Human
agauaaacucaacuaucucuugg

SEQ ID NO: 102003 - RNA, 22 nt, Human
uaaaagacugaaucuaccugcc

SEQ ID NO: 102004 - RNA, 25 nt, Human
caagaauccaguccuucacacucac

SEQ ID NO: 102005 - RNA, 23 nt, Human
aggacggcaggaguguccuggcu

SEQ ID NO: 102006 - RNA, 21 nt, Human
cuguggaaguuccaguguucu

SEQ ID NO: 102007 - RNA, 21 nt, Human
caccaacccgggcagaggagg

SEQ ID NO: 102008 - RNA, 21 nt, Human
cucguuccuaccuggcuggag

SEQ ID NO: 102009 - RNA, 22 nt, Human
uucagcacucagcacagugccu

SEQ ID NO: 102010 - RNA, 20 nt, Human
ucuggaggcaucacaugcug

SEQ ID NO: 102011 - RNA, 25 nt, Human
auuucagaaggagaaggaaaaagaa

SEQ ID NO: 102012 - RNA, 24 nt, Human
auuaaucucaacagcauuaaacag

SEQ ID NO: 102013 - RNA, 23 nt, Human
uccucccaccaucaccucccuca

SEQ ID NO: 102014 - RNA, 21 nt, Human
cuuuucggggaaaacuucauu

SEQ ID NO: 102015 - RNA, 23 nt, Human
ccuccaccuccucuccaccugcu

SEQ ID NO: 102016 - RNA, 24 nt, Human
ccugcauuugccaacaccuuuuua

SEQ ID NO: 102017 - RNA, 20 nt, Human
ugaacuuuuaugugugcaaa

SEQ ID NO: 102018 - RNA, 24 nt, Human
uucuaugaccaggccuuaagggaa

SEQ ID NO: 102019 - RNA, 30 nt, Human
ucuuucauucaugcuuugcuuaauguacuc

SEQ ID NO: 102020 - RNA, 22 nt, Human
accuguaauaccagcaguuuga

SEQ ID NO: 102021 - RNA, 22 nt, Human
acaggagguggagguugcagug

SEQ ID NO: 102022 - RNA, 26 nt, Human
cugggagcuugaggcucauuggaaga

SEQ ID NO: 102023 - RNA, 20 nt, Human
ccacuucuguggcaccagau

SEQ ID NO: 102024 - RNA, 25 nt, Human
cacuagugaagagauacugucuauu

SEQ ID NO: 102025 - RNA, 23 nt, Human
ugcuaccuuuugugggccugucc

SEQ ID NO: 102026 - RNA, 22 nt, Human
auuuuucuaugcacugggcauc

SEQ ID NO: 102027 - RNA, 22 nt, Human
uugcccaggguccugugccugg

SEQ ID NO: 102028 - RNA, 21 nt, Human
acugcccccauucauccuggc

SEQ ID NO: 102029 - RNA, 19 nt, Human
uugaagcccaccuucucuu

SEQ ID NO: 102030 - RNA, 21 nt, Human
gggauuugguaacaaaggaca

SEQ ID NO: 102031 - RNA, 21 nt, Human
ggacucaaacuccugcuacau

SEQ ID NO: 102032 - RNA, 21 nt, Human
cacacaaaaagcauacuugca

SEQ ID NO: 102033 - RNA, 20 nt, Human
caguuucagauuuacucuga

SEQ ID NO: 102034 - RNA, 25 nt, Human
ccuccacccacaccugcccgcuccc

SEQ ID NO: 102035 - RNA, 22 nt, Human
caauccguucccuucugccacc

SEQ ID NO: 102036 - RNA, 23 nt, Human
uuaugacucuuaacccccuagaa

SEQ ID NO: 102037 - RNA, 20 nt, Human
ucuuccauaugaccucaugc

SEQ ID NO: 102038 - RNA, 21 nt, Human
cuggguggcaggggggcugug

SEQ ID NO: 102039 - RNA, 21 nt, Human
ggggaggcagagguugcggug

SEQ ID NO: 102040 - RNA, 20 nt, Human
uuccuaccacagauucuuua

SEQ ID NO: 102041 - RNA, 26 nt, Human
uaggagucuuaauuuauuucuuaacc

SEQ ID NO: 102042 - RNA, 21 nt, Human
aguucagucaaacuagccaua

SEQ ID NO: 102043 - RNA, 24 nt, Human
gggagucugaggcagaggauggca

SEQ ID NO: 102044 - RNA, 23 nt, Human
ggagaugaggaguaaaauucagu

SEQ ID NO: 102045 - RNA, 20 nt, Human
ucccacucccucucuugccg

SEQ ID NO: 102046 - RNA, 22 nt, Human
ggaugagggugaaacugcuauu

SEQ ID NO: 102047 - RNA, 22 nt, Human
gacccugcaagaccacggaggg

SEQ ID NO: 102048 - RNA, 21 nt, Human
acacauuuuguauaauuguau

SEQ ID NO: 102049 - RNA, 18 nt, Human
ccacaugucucagaucug

SEQ ID NO: 102050 - RNA, 28 nt, Human
ugcaacccuggggaggaccccaacucac

SEQ ID NO: 102051 - RNA, 22 nt, Human
gauccugggaggcagagguugu

SEQ ID NO: 102052 - RNA, 23 nt, Human
uucauucuggcuaauugauuaca

SEQ ID NO: 102053 - RNA, 21 nt, Human
uguaguugggccuaaauaaau

SEQ ID NO: 102054 - RNA, 22 nt, Human
agaccagccugaccaacguuaa

SEQ ID NO: 102055 - RNA, 24 nt, Human
ugguaaacuuuugguuuucagaua

SEQ ID NO: 102056 - RNA, 26 nt, Human
guauauguuauuuaccuucagaucua

SEQ ID NO: 102057 - RNA, 23 nt, Human
aauacugacuaccaucacuguga

SEQ ID NO: 102058 - RNA, 19 nt, Human
uugaauaacaugcaucuga

SEQ ID NO: 102059 - RNA, 25 nt, Human
gguuuuguuaauuaugauucuuuau

SEQ ID NO: 102060 - RNA, 30 nt, Human
guauauuggauaccaccucuugagaguccu

SEQ ID NO: 102061 - RNA, 27 nt, Human
gauuagguggagaggcaguuggggggc

SEQ ID NO: 102062 - RNA, 24 nt, Human
gagacuccagcauuuucggacuuc

SEQ ID NO: 102063 - RNA, 28 nt, Human
gaugcuuagaauaucaguauuuuggaug

SEQ ID NO: 102064 - RNA, 30 nt, Human
ggaugaaggcaaaaacuguacuguguuucg

SEQ ID NO: 102065 - RNA, 18 nt, Human
gaaaucaaggaucuuugg

SEQ ID NO: 102066 - RNA, 19 nt, Human
uuucuaauguuuugcagug

SEQ ID NO: 102067 - RNA, 21 nt, Human
acgccucucggggccugugcc

SEQ ID NO: 102068 - RNA, 26 nt, Human
ccuaaggcugucugguauuucuuuuc

SEQ ID NO: 102069 - RNA, 23 nt, Human
cugccaccaaaggccagggucac

SEQ ID NO: 102070 - RNA, 27 nt, Human
ggacucccguguaggaaccugcacacg

SEQ ID NO: 102071 - RNA, 24 nt, Human
ccacauacuaggugcucaauucau

SEQ ID NO: 102072 - RNA, 26 nt, Human
agcucuuacuuuuaaaugcaaucucu

SEQ ID NO: 102073 - RNA, 24 nt, Human
cacaucuuccuucucugaagucca

SEQ ID NO: 102074 - RNA, 22 nt, Human
uaucaagaucauuuugagacuc

SEQ ID NO: 102075 - RNA, 21 nt, Human
auagcuaguucccaaagugau

SEQ ID NO: 102076 - RNA, 29 nt, Human
cacaaccaccuccagccugggagauaggc

SEQ ID NO: 102077 - RNA, 21 nt, Human
ccugaucuuaaaacaccugca

SEQ ID NO: 102078 - RNA, 21 nt, Human
ccacaaccuccaccuccuggg

SEQ ID NO: 102079 - RNA, 22 nt, Human
agaaacuguuucugcagagcca

SEQ ID NO: 102080 - RNA, 19 nt, Human
agggaaagggacagauagc

SEQ ID NO: 102081 - RNA, 24 nt, Human
cccaggaguuugaggcugcaguga

SEQ ID NO: 102082 - RNA, 22 nt, Human
aaugccagccagggcccgggag

SEQ ID NO: 102083 - RNA, 22 nt, Human
cgcuccgcgcagcucaggcugg

SEQ ID NO: 102084 - RNA, 21 nt, Human
caguaugacauauagaauuaa

SEQ ID NO: 102085 - RNA, 23 nt, Human
ccugugcucgcccugcccaacgc

SEQ ID NO: 102086 - RNA, 25 nt, Human
ccugugaacuaggcccugccucugu

SEQ ID NO: 102087 - RNA, 27 nt, Human
cugucucuuuggaugaugccuaggccc

SEQ ID NO: 102088 - RNA, 21 nt, Human
ccuaggaaaaaauacuuccua

SEQ ID NO: 102089 - RNA, 26 nt, Human
agaacaauagucaaaacucacaugga

SEQ ID NO: 102090 - RNA, 21 nt, Human
uuucuuuugauucuuccuaac

SEQ ID NO: 102091 - RNA, 25 nt, Human
gugcaccugucaccgcaguccuggg

SEQ ID NO: 102092 - RNA, 20 nt, Human
uaggaagccacaaauuugua

SEQ ID NO: 102093 - RNA, 21 nt, Human
ccaccaugcuggccucaggga

SEQ ID NO: 102094 - RNA, 26 nt, Human
cugggagcagaaggcagccucggucu

SEQ ID NO: 102095 - RNA, 21 nt, Human
ucaucuguguuaagugaugag

SEQ ID NO: 102096 - RNA, 28 nt, Human
ccaggcagcagaggcgacugcggacagc

SEQ ID NO: 102097 - RNA, 26 nt, Human
gccagccugggucaaagaagucaaag

SEQ ID NO: 102098 - RNA, 22 nt, Human
aacaacaaaaguauacucuacc

SEQ ID NO: 102099 - RNA, 21 nt, Human
cccagccaggccaacauggug

SEQ ID NO: 102100 - RNA, 24 nt, Human
uuuguauagguccugugcuuaaag

SEQ ID NO: 102101 - RNA, 21 nt, Human
accagaggcuggagugggggu

SEQ ID NO: 102102 - RNA, 27 nt, Human
uucucucuuaauuaauaacacagacac

SEQ ID NO: 102103 - RNA, 22 nt, Human
gugcaaccuccgccuccugggu

SEQ ID NO: 102104 - RNA, 26 nt, Human
gccuuucuuuaacugccuuccuggcu

SEQ ID NO: 102105 - RNA, 23 nt, Human
aguaugccgcugcacuccagccu

SEQ ID NO: 102106 - RNA, 23 nt, Human
aauucaaugcaugaacuugugug

SEQ ID NO: 102107 - RNA, 26 nt, Human
uccagcuggacaacguugucccaaga

SEQ ID NO: 102108 - RNA, 19 nt, Human
agcagucaaggaugagcac

SEQ ID NO: 102109 - RNA, 22 nt, Human
aaacuccacuguaguuuacuuu

SEQ ID NO: 102110 - RNA, 21 nt, Human
cccuggagccccacuuauuga

SEQ ID NO: 102111 - RNA, 28 nt, Human
ggcagagggaggcagccagcggggcgug

SEQ ID NO: 102112 - RNA, 21 nt, Human
aaggcagcuucacuuccucuu

SEQ ID NO: 102113 - RNA, 20 nt, Human
gaaucacugcagccccccuc

SEQ ID NO: 102114 - RNA, 20 nt, Human
accaaugucauaaugcacag

SEQ ID NO: 102115 - RNA, 24 nt, Human
cagaagcagcaggggauggcgugg

SEQ ID NO: 102116 - RNA, 21 nt, Human
guugccaagcuggacggcacg

SEQ ID NO: 102117 - RNA, 21 nt, Human
cccugcugggaccuuguggcu

SEQ ID NO: 102118 - RNA, 26 nt, Human
accucuucucccccaccucccggguc

SEQ ID NO: 102119 - RNA, 22 nt, Human
agcuuugauccaaaccuucucc

SEQ ID NO: 102120 - RNA, 23 nt, Human
ccccucccuccgacgaucgggga

SEQ ID NO: 102121 - RNA, 26 nt, Human
caggccucucugccuguggccuuccg

SEQ ID NO: 102122 - RNA, 26 nt, Human
uagggaacugccuaguguaacaauga

SEQ ID NO: 102123 - RNA, 20 nt, Human
uuaaaaaauaucaccaaaga

SEQ ID NO: 102124 - RNA, 23 nt, Human
ggaaaaggaaaauucuucugcuu

SEQ ID NO: 102125 - RNA, 20 nt, Human
uuagcaguugcucacauguc

SEQ ID NO: 102126 - RNA, 19 nt, Human
ucaguaugugauguuuaua

SEQ ID NO: 102127 - RNA, 20 nt, Human
uuugacuacaagugggccgu

SEQ ID NO: 102128 - RNA, 29 nt, Human
ugucucugccuggagcaggggugguuucu

SEQ ID NO: 102129 - RNA, 28 nt, Human
uccaauuuggcugggauuauucaaagua

SEQ ID NO: 102130 - RNA, 19 nt, Human
aacaggcacagaugucaug

SEQ ID NO: 102131 - RNA, 22 nt, Human
gaacuccuggccucaagucauu

SEQ ID NO: 102132 - RNA, 24 nt, Human
ccugcagcaccgucccaccucugc

SEQ ID NO: 102133 - RNA, 22 nt, Human
caugccuguaaucccaguacuc

SEQ ID NO: 102134 - RNA, 20 nt, Human
uacccgcggaagagcgaggg

SEQ ID NO: 102135 - RNA, 22 nt, Human
cuuuuucuggacucuggacuuu

SEQ ID NO: 102136 - RNA, 24 nt, Human
caucugucuguguuaaaauaauca

SEQ ID NO: 102137 - RNA, 23 nt, Human
ggccaggccagagggagugacag

SEQ ID NO: 102138 - RNA, 24 nt, Human
guguuugggccucucuugcuguca

SEQ ID NO: 102139 - RNA, 23 nt, Human
uugucucaaccagccggcuccuc

SEQ ID NO: 102140 - RNA, 24 nt, Human
auuuuucucuaaauaaaagaaguc

SEQ ID NO: 102141 - RNA, 22 nt, Human
ccuuggcuggugcuggugccau

SEQ ID NO: 102142 - RNA, 21 nt, Human
gcauuccugugcccaccuacg

SEQ ID NO: 102143 - RNA, 27 nt, Human
uucccaucugcacccugcagcaucucu

SEQ ID NO: 102144 - RNA, 27 nt, Human
ugcccugcuuccuccuccacuccuggc

SEQ ID NO: 102145 - RNA, 19 nt, Human
ccuguuaguccaguuugau

SEQ ID NO: 102146 - RNA, 24 nt, Human
gcagcgggaagugugccaaggaag

SEQ ID NO: 102147 - RNA, 20 nt, Human
cuguaggacagcggcccgaa

SEQ ID NO: 102148 - RNA, 25 nt, Human
uacaggcuccugccaccacgcccag

SEQ ID NO: 102149 - RNA, 25 nt, Human
ugacuucagcacugaaaaccucucc

SEQ ID NO: 102150 - RNA, 28 nt, Human
cuaccacagacauuaauagcugagcagg

SEQ ID NO: 102151 - RNA, 22 nt, Human
cuuccccugggaaaaaacccaa

SEQ ID NO: 102152 - RNA, 19 nt, Human
cuucgguuuugacuauugu

SEQ ID NO: 102153 - RNA, 26 nt, Human
ggccuccaugaccugcgcucucagcu

SEQ ID NO: 102154 - RNA, 24 nt, Human
agcaggcugcagcaggcagaggag

SEQ ID NO: 102155 - RNA, 27 nt, Human
ggcucacugcagccuugaacucccaga

SEQ ID NO: 102156 - RNA, 22 nt, Human
gguucauuaucugauuggcugc

SEQ ID NO: 102157 - RNA, 29 nt, Human
ccucagcugugggggccucaggcaggucc

SEQ ID NO: 102158 - RNA, 27 nt, Human
guggucucuacacccaaauagugguau

SEQ ID NO: 102159 - RNA, 20 nt, Human
uuugagacuagccuaggcaa

SEQ ID NO: 102160 - RNA, 29 nt, Human
gcccacuccgauccgccugggcucagcua

SEQ ID NO: 102161 - RNA, 26 nt, Human
ccacacugaaaccucuucgguugucu

SEQ ID NO: 102162 - RNA, 20 nt, Human
caaguuaaguguuuccuucc

SEQ ID NO: 102163 - RNA, 23 nt, Human
uucgguucccugucuccuccucc

SEQ ID NO: 102164 - RNA, 19 nt, Human
acucugaaauguugcagug

SEQ ID NO: 102165 - RNA, 23 nt, Human
ggaaaacaaagaauguuuugaga

SEQ ID NO: 102166 - RNA, 24 nt, Human
aacuauguuauaguccagucuacu

SEQ ID NO: 102167 - RNA, 22 nt, Human
aaauccugggauaagagaauag

SEQ ID NO: 102168 - RNA, 22 nt, Human
ugccaccucugggcacggccuc

SEQ ID NO: 102169 - RNA, 22 nt, Human
cacguuaugccuuucaguguua

SEQ ID NO: 102170 - RNA, 22 nt, Human
ggcagaguccccaucacguggc

SEQ ID NO: 102171 - RNA, 30 nt, Human
gccccacgcccucuccucccccuccuaggg

SEQ ID NO: 102172 - RNA, 22 nt, Human
gguuggguuuagaaagaucuca

SEQ ID NO: 102173 - RNA, 20 nt, Human
ggauguaagccuggagcuaa

SEQ ID NO: 102174 - RNA, 25 nt, Human
gcagggcugugagcugggcuucugu

SEQ ID NO: 102175 - RNA, 20 nt, Human
auuuguuaaagcuccagguc

SEQ ID NO: 102176 - RNA, 23 nt, Human
ucuccaucuguuucuugccauua

SEQ ID NO: 102177 - RNA, 26 nt, Human
uuucucagccuaacuccauccccacc

SEQ ID NO: 102178 - RNA, 26 nt, Human
uaugcaauacuuucccccuuuuugcu

SEQ ID NO: 102179 - RNA, 23 nt, Human
gggacuacccagauuacuccagg

SEQ ID NO: 102180 - RNA, 23 nt, Human
acuuuucucccugugucuggguc

SEQ ID NO: 102181 - RNA, 20 nt, Human
caaagugcuggcuaccugcu

SEQ ID NO: 102182 - RNA, 24 nt, Human
ccugccgggcugagggccugcugg

SEQ ID NO: 102183 - RNA, 22 nt, Human
gacuucugcuuuuguuguuguu

SEQ ID NO: 102184 - RNA, 27 nt, Human
cauugcacuccagccugggcaacaaga

SEQ ID NO: 102185 - RNA, 21 nt, Human
uuuacauuuguuuuuuacuuc

SEQ ID NO: 102186 - RNA, 23 nt, Human
cucccccagcccaucuguugcac

SEQ ID NO: 102187 - RNA, 27 nt, Human
cuaucagaagccaaguaugauucuuua

SEQ ID NO: 102188 - RNA, 21 nt, Human
ccuagcuccuccuccugggcu

SEQ ID NO: 102189 - RNA, 16 nt, Human
ggccuuucccaccugg

SEQ ID NO: 102190 - RNA, 26 nt, Human
ugagacaaaucuaugccacucagaau

SEQ ID NO: 102191 - RNA, 22 nt, Human
ggccuagaaagccaagugcaaa

SEQ ID NO: 102192 - RNA, 26 nt, Human
aggcuuuugcuuguuuguugccaucc

SEQ ID NO: 102193 - RNA, 23 nt, Human
gccgccacaagugccugcuuuua

SEQ ID NO: 102194 - RNA, 24 nt, Human
ucuacugcugcuguacccuaggaa

SEQ ID NO: 102195 - RNA, 24 nt, Human
uagcuucccuucccucccccuuca

SEQ ID NO: 102196 - RNA, 18 nt, Human
gggacugcuuucugucug

SEQ ID NO: 102197 - RNA, 22 nt, Human
ugcccuagcugggcaaacccuu

SEQ ID NO: 102198 - RNA, 29 nt, Human
uucccuggccguuucuccccagagcugcc

SEQ ID NO: 102199 - RNA, 24 nt, Human
caucgggaccagaaaccugggaga

SEQ ID NO: 102200 - RNA, 22 nt, Human
cgcucgccgucggcucuaccug

SEQ ID NO: 102201 - RNA, 20 nt, Human
agugggugugacauauuuca

SEQ ID NO: 102202 - RNA, 22 nt, Human
aacaacaaauaggaauuguuuu

SEQ ID NO: 102203 - RNA, 23 nt, Human
aagucaaacugccuguguccuca

SEQ ID NO: 102204 - RNA, 22 nt, Human
aaaucugggauuaugacgguau

SEQ ID NO: 102205 - RNA, 26 nt, Human
ucugcuccagccccuuugccucuguc

SEQ ID NO: 102206 - RNA, 22 nt, Human
gacacaggucagggcucagagu

SEQ ID NO: 102207 - RNA, 20 nt, Human
caccacacaguggugcaggc

SEQ ID NO: 102208 - RNA, 22 nt, Human
gaggcugggccaagauggcguc

SEQ ID NO: 102209 - RNA, 22 nt, Human
ugucgccuaagcuggagugugg

SEQ ID NO: 102210 - RNA, 27 nt, Human
gaacuccugggcuuucuaaagaggcug

SEQ ID NO: 102211 - RNA, 22 nt, Human
cuuccagugcaguugugcugcu

SEQ ID NO: 102212 - RNA, 25 nt, Human
cugggcaaagccacaaggcuggcca

SEQ ID NO: 102213 - RNA, 22 nt, Human
cucacccuuggcccgccuuugc

SEQ ID NO: 102214 - RNA, 20 nt, Human
gccuuccacuucagucuuag

SEQ ID NO: 102215 - RNA, 24 nt, Human
ucccccacuggagugauuucagug

SEQ ID NO: 102216 - RNA, 21 nt, Human
agugaagcccgcggcgccuag

SEQ ID NO: 102217 - RNA, 22 nt, Human
ucccgccucagcaccgcgagca

SEQ ID NO: 102218 - RNA, 26 nt, Human
ggagagaagaaaugaagggacacuua

SEQ ID NO: 102219 - RNA, 22 nt, Human
ccugcuggccucuuguggagcc

SEQ ID NO: 102220 - RNA, 16 nt, Human
ugcuagugcccugccc

SEQ ID NO: 102221 - RNA, 19 nt, Human
gaggaagagaggccuucug

SEQ ID NO: 102222 - RNA, 19 nt, Human
gguacgguaucucucucca

SEQ ID NO: 102223 - RNA, 23 nt, Human
ucuuagaacauaguuggugccag

SEQ ID NO: 102224 - RNA, 20 nt, Human
ccacugcacucuagccggag

SEQ ID NO: 102225 - RNA, 23 nt, Human
gaucaaauacuccuggcccaugg

SEQ ID NO: 102226 - RNA, 17 nt, Human
ucacaugcggauccaca

SEQ ID NO: 102227 - RNA, 23 nt, Human
gccacugccuucgcuucuugccu

SEQ ID NO: 102228 - RNA, 26 nt, Human
ucucccaccaccucaccaguuuccag

SEQ ID NO: 102229 - RNA, 25 nt, Human
ugggcagccugcuggucagcacucc

SEQ ID NO: 102230 - RNA, 21 nt, Human
aggaguuuaaggcugcaguga

SEQ ID NO: 102231 - RNA, 26 nt, Human
agagccagaagcaggguucugggaau

SEQ ID NO: 102232 - RNA, 23 nt, Human
ugagccgcugggcucucagcggc

SEQ ID NO: 102233 - RNA, 27 nt, Human
ggaccugccugacaggccacaggagca

SEQ ID NO: 102234 - RNA, 21 nt, Human
gcauucuauggagaccccagg

SEQ ID NO: 102235 - RNA, 27 nt, Human
uuucuuugcaaggccuuauucuugccu

SEQ ID NO: 102236 - RNA, 22 nt, Human
aagagggagaaacuucugcuca

SEQ ID NO: 102237 - RNA, 22 nt, Human
ucccacccucuauguucuuacc

SEQ ID NO: 102238 - RNA, 22 nt, Human
gguaaaugauguggugccugag

SEQ ID NO: 102239 - RNA, 22 nt, Human
agagugagcgcgggguggggga

SEQ ID NO: 102240 - RNA, 22 nt, Human
cuguggcuagagaguuugagga

SEQ ID NO: 102241 - RNA, 26 nt, Human
ugguaccuuuuugucaggacaauuag

SEQ ID NO: 102242 - RNA, 26 nt, Human
gacugcuucagccuuucccugugcug

SEQ ID NO: 102243 - RNA, 26 nt, Human
augaaugaauuugguugguuuuggug

SEQ ID NO: 102244 - RNA, 27 nt, Human
aaaacauuugaaauacuaccauauuug

SEQ ID NO: 102245 - RNA, 18 nt, Human
ggagugugucaaguuaca

SEQ ID NO: 102246 - RNA, 21 nt, Human
auggugcagagaagcuggacu

SEQ ID NO: 102247 - RNA, 26 nt, Human
cugagacaaaacaguacucacugagu

SEQ ID NO: 102248 - RNA, 30 nt, Human
gugcucagccaggcuggaggcggcaggcgg

SEQ ID NO: 102249 - RNA, 24 nt, Human
gcccccagccuuaccucucaaccu

SEQ ID NO: 102250 - RNA, 21 nt, Human
uuuucucucugggccuguauc

SEQ ID NO: 102251 - RNA, 22 nt, Human
ggucuugaacuccuaaccucgg

SEQ ID NO: 102252 - RNA, 23 nt, Human
aggguuauaaaguaacagaggaa

SEQ ID NO: 102253 - RNA, 20 nt, Human
ucacccaggcgggaguggug

SEQ ID NO: 102254 - RNA, 22 nt, Human
gaaagagauaagugcaucauga

SEQ ID NO: 102255 - RNA, 21 nt, Human
cgguuauccaccaaaagugau

SEQ ID NO: 102256 - RNA, 26 nt, Human
guccucucccuucuucccuaacccuu

SEQ ID NO: 102257 - RNA, 19 nt, Human
uucuuuacaagaugggucc

SEQ ID NO: 102258 - RNA, 26 nt, Human
cagcucuucugaggaggcucugcccu

SEQ ID NO: 102259 - RNA, 23 nt, Human
gccugcccccuccuggacgugcc

SEQ ID NO: 102260 - RNA, 23 nt, Human
acuggaauuugauggaaagaagg

SEQ ID NO: 102261 - RNA, 28 nt, Human
gcuguaucucccuguggcagauuuguag

SEQ ID NO: 102262 - RNA, 24 nt, Human
gcugccgccucccagccugggggg

SEQ ID NO: 102263 - RNA, 26 nt, Human
uuguccaucuuaguaaauaaaagaua

SEQ ID NO: 102264 - RNA, 31 nt, Human
cuuuuugugugcuaccucaucuugccacugc

SEQ ID NO: 102265 - RNA, 23 nt, Human
aggguccacgcccauguaccuga

SEQ ID NO: 102266 - RNA, 21 nt, Human
aacagauggaguuacugugaa

SEQ ID NO: 102267 - RNA, 22 nt, Human
gccccaaauuccugggcugggg

SEQ ID NO: 102268 - RNA, 21 nt, Human
ucugagaucucccuccaggga

SEQ ID NO: 102269 - RNA, 14 nt, Human
auaccuagcacuuu

SEQ ID NO: 102270 - RNA, 22 nt, Human
ucuuucuccccgacuccacccc

SEQ ID NO: 102271 - RNA, 19 nt, Human
ccucccaggcuggggcagu

SEQ ID NO: 102272 - RNA, 21 nt, Human
cucuuucuggcuauuuuuugu

SEQ ID NO: 102273 - RNA, 22 nt, Human
cauaggagcccccucccugcug

SEQ ID NO: 102274 - RNA, 22 nt, Human
cagcagccuggcuucacugaau

SEQ ID NO: 102275 - RNA, 17 nt, Human
auuuuuaaaauauccug

SEQ ID NO: 102276 - RNA, 25 nt, Human
cucagccugguuucugggugcuaga

SEQ ID NO: 102277 - RNA, 27 nt, Human
aacaacaagaaaauguacaguuagucc

SEQ ID NO: 102278 - RNA, 27 nt, Human
cgcuggggucugggaggaauggacaga

SEQ ID NO: 102279 - RNA, 27 nt, Human
cuucuacugcuaucuacuacaaacuuc

SEQ ID NO: 102280 - RNA, 21 nt, Human
gaggcccugaucccagcucau

SEQ ID NO: 102281 - RNA, 25 nt, Human
cccuccagaggauuugagggacagg

SEQ ID NO: 102282 - RNA, 22 nt, Human
ugguccagagccuccacccaca

SEQ ID NO: 102283 - RNA, 22 nt, Human
ggugggguacacugcagaggag

SEQ ID NO: 102284 - RNA, 27 nt, Human
ugcagcucaaggaaaggccugaaagga

SEQ ID NO: 102285 - RNA, 20 nt, Human
cagccucuucucucacuauc

SEQ ID NO: 102286 - RNA, 25 nt, Human
aggagauguaggaggggaacuaggu

SEQ ID NO: 102287 - RNA, 20 nt, Human
agauaauugcauucucucca

SEQ ID NO: 102288 - RNA, 24 nt, Human
aaagucuggccaacagagcaguag

SEQ ID NO: 102289 - RNA, 22 nt, Human
auucuaaaagauaaguguguuu

SEQ ID NO: 102290 - RNA, 22 nt, Human
aucaccuaacuuggacugcuug

SEQ ID NO: 102291 - RNA, 21 nt, Human
agacuagccugggcaacguga

SEQ ID NO: 102292 - RNA, 24 nt, Human
acccugacaaauaguuuuagacag

SEQ ID NO: 102293 - RNA, 27 nt, Human
aggggagaguccucaucugcuggcauu

SEQ ID NO: 102294 - RNA, 20 nt, Human
accagcaaagugcacugaug

SEQ ID NO: 102295 - RNA, 18 nt, Human
cugcuuugaaugaguuga

SEQ ID NO: 102296 - RNA, 27 nt, Human
ggagagggagaagcaccguacuuucaa

SEQ ID NO: 102297 - RNA, 22 nt, Human
cucucuuuuugcccucgggaaa

SEQ ID NO: 102298 - RNA, 22 nt, Human
agcauaaauauacuucuuuuug

SEQ ID NO: 102299 - RNA, 22 nt, Human
acagauggaaagaaugaggcuc

SEQ ID NO: 102300 - RNA, 19 nt, Human
ccauaacaacagcuacuca

SEQ ID NO: 102301 - RNA, 24 nt, Human
agucccaggauuggcuccaggcag

SEQ ID NO: 102302 - RNA, 20 nt, Human
uacaugguggugauguccaa

SEQ ID NO: 102303 - RNA, 21 nt, Human
ugcuuuuguugaaaccacagc

SEQ ID NO: 102304 - RNA, 20 nt, Human
cugccuccuuccuccgcgca

SEQ ID NO: 102305 - RNA, 24 nt, Human
ggagaggccgcgugugggagcgug

SEQ ID NO: 102306 - RNA, 27 nt, Human
gaaaugagaacguauugguguuuguac

SEQ ID NO: 102307 - RNA, 21 nt, Human
gcaaccuccgccuccuggguu

SEQ ID NO: 102308 - RNA, 22 nt, Human
uggcucaugcuuguaaucccag

SEQ ID NO: 102309 - RNA, 22 nt, Human
uggcucaugccuguaaucucag

SEQ ID NO: 102310 - RNA, 22 nt, Human
ucagauguggaggcccagggaa

SEQ ID NO: 102311 - RNA, 22 nt, Human
acgcgggccucugacacugcuu

SEQ ID NO: 102312 - RNA, 21 nt, Human
ugacuucuugcuggccugugg

SEQ ID NO: 102313 - RNA, 26 nt, Human
ucccucucauccccaggguucguccc

SEQ ID NO: 102314 - RNA, 22 nt, Human
agaauaaauaucugcugcucug

SEQ ID NO: 102315 - RNA, 18 nt, Human
uguggguggaagagggag

SEQ ID NO: 102316 - RNA, 22 nt, Human
gucacccaggcugcagugcaau

SEQ ID NO: 102317 - RNA, 23 nt, Human
cugccugccacccuaggcaggga

SEQ ID NO: 102318 - RNA, 25 nt, Human
cccugaacugcaaccaucuuagagc

SEQ ID NO: 102319 - RNA, 20 nt, Human
cauguucuaaagaaaucugu

SEQ ID NO: 102320 - RNA, 27 nt, Human
cugggccuggccucuguaagccugugu

SEQ ID NO: 102321 - RNA, 22 nt, Human
aaauguccuguauucugggauc

SEQ ID NO: 102322 - RNA, 22 nt, Human
acauuuauguuuaaaaguaaga

SEQ ID NO: 102323 - RNA, 19 nt, Human
ucuuccauucugugucaca

SEQ ID NO: 102324 - RNA, 23 nt, Human
augaccagaaauggugagaugua

SEQ ID NO: 102325 - RNA, 25 nt, Human
gggaaagacagagguuacagaggag

SEQ ID NO: 102326 - RNA, 32 nt, Human
gccucaucucagcagccugggcucggcauucc

SEQ ID NO: 102327 - RNA, 21 nt, Human
aaggucggcagagguggaccc

SEQ ID NO: 102328 - RNA, 22 nt, Human
gggggagggagggagggaaagc

SEQ ID NO: 102329 - RNA, 25 nt, Human
gcugugcagggcaggaaagcuccau

SEQ ID NO: 102330 - RNA, 21 nt, Human
cacgcgccaccaugcccggcu

SEQ ID NO: 102331 - RNA, 24 nt, Human
agcucacugcagccuggaacuccu

SEQ ID NO: 102332 - RNA, 24 nt, Human
auuucguuccuccugaggagacca

SEQ ID NO: 102333 - RNA, 25 nt, Human
acaaguguucacucacaucuguaaa

SEQ ID NO: 102334 - RNA, 22 nt, Human
gguugcagaagaucaugggcau

SEQ ID NO: 102335 - RNA, 24 nt, Human
cucuuccuccugguucaagcgauu

SEQ ID NO: 102336 - RNA, 21 nt, Human
cugccagacacccccugcugc

SEQ ID NO: 102337 - RNA, 20 nt, Human
cuuccccugacuccccaccg

SEQ ID NO: 102338 - RNA, 26 nt, Human
aggaggucaagagagagcucaguuuc

SEQ ID NO: 102339 - RNA, 19 nt, Human
ugaggcugcaaugagccau

SEQ ID NO: 102340 - RNA, 25 nt, Human
ccccacugcugaugacgaacuaucu

SEQ ID NO: 102341 - RNA, 22 nt, Human
gugcuacgaccugucucagaac

SEQ ID NO: 102342 - RNA, 27 nt, Human
uggaaacagcugguacugauguucacc

SEQ ID NO: 102343 - RNA, 22 nt, Human
cuagucuuucuccaagaagaac

SEQ ID NO: 102344 - RNA, 22 nt, Human
uuuugcauuggcuuuaauuggg

SEQ ID NO: 102345 - RNA, 23 nt, Human
ggugcccaggugguggcugcaag

SEQ ID NO: 102346 - RNA, 26 nt, Human
ccuuucucucuucaguuccuccaggu

SEQ ID NO: 102347 - RNA, 26 nt, Human
uugcuuaaccuggagugaagagguag

SEQ ID NO: 102348 - RNA, 23 nt, Human
cccggcaaccacgagcccagcca

SEQ ID NO: 102349 - RNA, 21 nt, Human
ugcuucucacccagcugccuc

SEQ ID NO: 102350 - RNA, 23 nt, Human
caccauuccauauuuaaguggag

SEQ ID NO: 102351 - RNA, 21 nt, Human
aggccgggcuucuugagcugu

SEQ ID NO: 102352 - RNA, 20 nt, Human
ugcaggcauucucacucaca

SEQ ID NO: 102353 - RNA, 24 nt, Human
cucugaauacuccauucugccuca

SEQ ID NO: 102354 - RNA, 24 nt, Human
gccaggcugcucagacuccugggu

SEQ ID NO: 102355 - RNA, 20 nt, Human
agaccugacguacucugguu

SEQ ID NO: 102356 - RNA, 27 nt, Human
uguuauugagcaggccuaucucuuuca

SEQ ID NO: 102357 - RNA, 23 nt, Human
gugcgccuacgccuucugcucca

SEQ ID NO: 102358 - RNA, 20 nt, Human
agguuugcccugccugcagc

SEQ ID NO: 102359 - RNA, 21 nt, Human
uucacguagcugaagugcaaa

SEQ ID NO: 102360 - RNA, 23 nt, Human
gacauauucuuggagaacuuucc

SEQ ID NO: 102361 - RNA, 20 nt, Human
cugugaggacaacagccugg

SEQ ID NO: 102362 - RNA, 20 nt, Human
ucucacuauguugccaaggc

SEQ ID NO: 102363 - RNA, 32 nt, Human
cuguucgacagucagccgcaucuucuuuugcg

SEQ ID NO: 102364 - RNA, 21 nt, Human
cugucuagcacuuccuugcca

SEQ ID NO: 102365 - RNA, 21 nt, Human
aucuaaaacacuuaucuaacc

SEQ ID NO: 102366 - RNA, 21 nt, Human
ugggccauugccuucaugccg

SEQ ID NO: 102367 - RNA, 22 nt, Human
aacucugcuuucugcccaccuu

SEQ ID NO: 102368 - RNA, 22 nt, Human
cacaggaacgacagacauguau

SEQ ID NO: 102369 - RNA, 27 nt, Human
uucauuugugaguuuggauauagagca

SEQ ID NO: 102370 - RNA, 25 nt, Human
ugucuauagguuuaugggcuauuac

SEQ ID NO: 102371 - RNA, 23 nt, Human
cgguaccuccggggcugaagggg

SEQ ID NO: 102372 - RNA, 26 nt, Human
ccucaaacucccaggcucaagggauc

SEQ ID NO: 102373 - RNA, 22 nt, Human
ucugucuggcccuaaauguauc

SEQ ID NO: 102374 - RNA, 26 nt, Human
gaggaagaguacaaauagaccuaaau

SEQ ID NO: 102375 - RNA, 21 nt, Human
augcugugcuggaauauuguu

SEQ ID NO: 102376 - RNA, 25 nt, Human
caccuccucucuccucugugcucag

SEQ ID NO: 102377 - RNA, 23 nt, Human
agacacacuuuucaugaccucaa

SEQ ID NO: 102378 - RNA, 21 nt, Human
gaugcacacauuacaggagag

SEQ ID NO: 102379 - RNA, 23 nt, Human
ggcuggacuucuaccugcccuca

SEQ ID NO: 102380 - RNA, 20 nt, Human
ucaguaggaggcuggauugg

SEQ ID NO: 102381 - RNA, 22 nt, Human
ccaacaacagcaccucaaucug

SEQ ID NO: 102382 - RNA, 24 nt, Human
uuccucaaugaaugggaugucuaa

SEQ ID NO: 102383 - RNA, 23 nt, Human
ccaccuuggagcagagagccaag

SEQ ID NO: 102384 - RNA, 21 nt, Human
aaaacuucugauuucucuuca

SEQ ID NO: 102385 - RNA, 19 nt, Human
gggagucacaaaccugcuc

SEQ ID NO: 102386 - RNA, 21 nt, Human
aaacagaucagaccaagcaga

SEQ ID NO: 102387 - RNA, 27 nt, Human
guggaaacauuauuugcacucugagau

SEQ ID NO: 102388 - RNA, 19 nt, Human
cucccucuuggacugagca

SEQ ID NO: 102389 - RNA, 20 nt, Human
agcacagcaaagaucugcca

SEQ ID NO: 102390 - RNA, 20 nt, Human
auuugaaaacaguuucaucg

SEQ ID NO: 102391 - RNA, 23 nt, Human
ggaguagcugggauugcaggcac

SEQ ID NO: 102392 - RNA, 21 nt, Human
aacuccaaaugagccauagga

SEQ ID NO: 102393 - RNA, 19 nt, Human
ugaaauugguggcuucauu

SEQ ID NO: 102394 - RNA, 21 nt, Human
ugcccuaaaaugucucuggca

SEQ ID NO: 102395 - RNA, 22 nt, Human
ugccgcccaggcuggagugcag

SEQ ID NO: 102396 - RNA, 22 nt, Human
uggacucuaaagaccaaacuuc

SEQ ID NO: 102397 - RNA, 19 nt, Human
cagcaguugaaccauucca

SEQ ID NO: 102398 - RNA, 22 nt, Human
cgccaaggcuggagugcagugg

SEQ ID NO: 102399 - RNA, 23 nt, Human
acuaggcugccccacgugcuccc

SEQ ID NO: 102400 - RNA, 24 nt, Human
accaacaacuuuuguauuacucua

SEQ ID NO: 102401 - RNA, 21 nt, Human
aaccaacugccuuaaccuucu

SEQ ID NO: 102402 - RNA, 23 nt, Human
caggaggucugggguaccagugg

SEQ ID NO: 102403 - RNA, 22 nt, Human
ucauuacagggcacaggccaug

SEQ ID NO: 102404 - RNA, 26 nt, Human
cuucaggcugcacagaggcaaggacc

SEQ ID NO: 102405 - RNA, 22 nt, Human
aacuguacauuuaaaauugcua

SEQ ID NO: 102406 - RNA, 23 nt, Human
cccagacccugcaguuugagauc

SEQ ID NO: 102407 - RNA, 21 nt, Human
uguuuuuaauuaaacuccaag

SEQ ID NO: 102408 - RNA, 27 nt, Human
caggcugggggcaguggacagggaauu

SEQ ID NO: 102409 - RNA, 24 nt, Human
uccuuucccccuccuccgggggcc

SEQ ID NO: 102410 - RNA, 22 nt, Human
uggcucaugcuuguaauccuag

SEQ ID NO: 102411 - RNA, 22 nt, Human
ucagggguagugaagcugcaga

SEQ ID NO: 102412 - RNA, 24 nt, Human
ugaaagagagcaagaacaugugga

SEQ ID NO: 102413 - RNA, 20 nt, Human
gcuugcugguagcacuugcu

SEQ ID NO: 102414 - RNA, 24 nt, Human
uacugcugagagggcugcugacca

SEQ ID NO: 102415 - RNA, 23 nt, Human
gcugcuuuuggggaaugagggga

SEQ ID NO: 102416 - RNA, 21 nt, Human
gacaggcccucccugucucca

SEQ ID NO: 102417 - RNA, 23 nt, Human
gaucuccuccuccuuuccagcag

SEQ ID NO: 102418 - RNA, 22 nt, Human
ggcaagucacucucccucucug

SEQ ID NO: 102419 - RNA, 24 nt, Human
ccucuccgcgcgccccaccuccuc

SEQ ID NO: 102420 - RNA, 21 nt, Human
uggggaggggguggcggccgc

SEQ ID NO: 102421 - RNA, 26 nt, Human
caucauuauuggcaguuucuccuuau

SEQ ID NO: 102422 - RNA, 16 nt, Human
ucauucuuacuaucca

SEQ ID NO: 102423 - RNA, 26 nt, Human
cuucuuuccucuuccccuugcccuug

SEQ ID NO: 102424 - RNA, 23 nt, Human
caucuauggugucccaggcacag

SEQ ID NO: 102425 - RNA, 27 nt, Human
guaagaggcaaagaaucaacagccaaa

SEQ ID NO: 102426 - RNA, 22 nt, Human
caccucaaggucaggaugcgaa

SEQ ID NO: 102427 - RNA, 27 nt, Human
ggcucacugcaaccaccaucucccagg

SEQ ID NO: 102428 - RNA, 22 nt, Human
ggucacucugggaaccuggauu

SEQ ID NO: 102429 - RNA, 21 nt, Human
caggcaggaagaugaagguuc

SEQ ID NO: 102430 - RNA, 19 nt, Human
gggggugagaggcuggugg

SEQ ID NO: 102431 - RNA, 26 nt, Human
aguguucugcuuauaauuaaacugaa

SEQ ID NO: 102432 - RNA, 21 nt, Human
uuccuguuugcuuucaguuuu

SEQ ID NO: 102433 - RNA, 23 nt, Human
uucauucauguugcacaguggcu

SEQ ID NO: 102434 - RNA, 24 nt, Human
cucccaggcugcuggagugcagug

SEQ ID NO: 102435 - RNA, 21 nt, Human
gcucccaucuuccuccccaca

SEQ ID NO: 102436 - RNA, 21 nt, Human
ccagccugggugacagaguga

SEQ ID NO: 102437 - RNA, 21 nt, Human
guaaaucuuuuaucacuuucu

SEQ ID NO: 102438 - RNA, 23 nt, Human
gcucccuuccaccugucauuccc

SEQ ID NO: 102439 - RNA, 22 nt, Human
aaaauacuuaauaaaucugcca

SEQ ID NO: 102440 - RNA, 22 nt, Human
accagccuggccaaccugguga

SEQ ID NO: 102441 - RNA, 21 nt, Human
cuucugcuuggcuuuccggcu

SEQ ID NO: 102442 - RNA, 23 nt, Human
ggaggggagaccuggccaaggga

SEQ ID NO: 102443 - RNA, 23 nt, Human
ucuugaauuccugaccucaggug

SEQ ID NO: 102444 - RNA, 27 nt, Human
agccuccugcucaucccuccuucuuua

SEQ ID NO: 102445 - RNA, 20 nt, Human
ggucaucuguuuccagaguu

SEQ ID NO: 102446 - RNA, 23 nt, Human
uugagccuuggcugccuuggugc

SEQ ID NO: 102447 - RNA, 27 nt, Human
uuuauguuaaucucauuacaucuuuaa

SEQ ID NO: 102448 - RNA, 22 nt, Human
acuagcacagagcugaucucug

SEQ ID NO: 102449 - RNA, 26 nt, Human
uccuguugugcaggcuggagugcagu

SEQ ID NO: 102450 - RNA, 23 nt, Human
acugcagcugcccuguaaauguu

SEQ ID NO: 102451 - RNA, 23 nt, Human
aguauuuugugcaaugaagcccu

SEQ ID NO: 102452 - RNA, 23 nt, Human
cuccugccucugcccccugagca

SEQ ID NO: 102453 - RNA, 19 nt, Human
aagacauuugaauugccgg

SEQ ID NO: 102454 - RNA, 20 nt, Human
auuuacuugaauuugucaua

SEQ ID NO: 102455 - RNA, 18 nt, Human
gaccaaaaaacuugcucu

SEQ ID NO: 102456 - RNA, 19 nt, Human
uuaccugcaguggcacccu

SEQ ID NO: 102457 - RNA, 28 nt, Human
cgacuuauggacuuucucucaccacuaa

SEQ ID NO: 102458 - RNA, 20 nt, Human
ugugugcugacaggagaccc

SEQ ID NO: 102459 - RNA, 22 nt, Human
uuucaagacuagaauaggggga

SEQ ID NO: 102460 - RNA, 26 nt, Human
ggaaugccugugugagcaagcauuua

SEQ ID NO: 102461 - RNA, 25 nt, Human
ccaccucuaucccagugucuccguc

SEQ ID NO: 102462 - RNA, 29 nt, Human
ugccagaccagaaggucugcuaaagguca

SEQ ID NO: 102463 - RNA, 23 nt, Human
gaggaagagugaucaggaaagca

SEQ ID NO: 102464 - RNA, 22 nt, Human
cccugcuccagcagcugucauc

SEQ ID NO: 102465 - RNA, 17 nt, Human
uagucccagcacuuuga

SEQ ID NO: 102466 - RNA, 22 nt, Human
uagauuuagcagagagauuuac

SEQ ID NO: 102467 - RNA, 20 nt, Human
cagagaacauucauguguca

SEQ ID NO: 102468 - RNA, 27 nt, Human
ccaagcccuaaaggaaagcaucccauu

SEQ ID NO: 102469 - RNA, 29 nt, Human
cccaaaguccucugcuccagcaacugccc

SEQ ID NO: 102470 - RNA, 21 nt, Human
uggaucucccccucauccaac

SEQ ID NO: 102471 - RNA, 19 nt, Human
gucucugaguaacccuuug

SEQ ID NO: 102472 - RNA, 24 nt, Human
ucugccuccuccugccugucugca

SEQ ID NO: 102473 - RNA, 22 nt, Human
cccuguacuccagccuggguga

SEQ ID NO: 102474 - RNA, 22 nt, Human
cccaggaggggccagugggggc

SEQ ID NO: 102475 - RNA, 27 nt, Human
uucauuucuccugucaccuuccgggga

SEQ ID NO: 102476 - RNA, 22 nt, Human
cugcaaccuccacauccugggu

SEQ ID NO: 102477 - RNA, 22 nt, Human
ucucccuggccgcagggggagc

SEQ ID NO: 102478 - RNA, 22 nt, Human
cugaguagcugggauuacaggu

SEQ ID NO: 102479 - RNA, 24 nt, Human
agaaccagauaugcuuugucuuga

SEQ ID NO: 102480 - RNA, 24 nt, Human
ggacaagaaaggggcugugugaga

SEQ ID NO: 102481 - RNA, 27 nt, Human
agccccgcucugggcaccaccugccuu

SEQ ID NO: 102482 - RNA, 29 nt, Human
cgcccuccauccuccccacaucccugcag

SEQ ID NO: 102483 - RNA, 23 nt, Human
gccuggugguauggcacagcaga

SEQ ID NO: 102484 - RNA, 25 nt, Human
agcaguggcagccacucagugugag

SEQ ID NO: 102485 - RNA, 19 nt, Human
uucucuguggcuguaugug

SEQ ID NO: 102486 - RNA, 20 nt, Human
cacuccguaaccucuccccu

SEQ ID NO: 102487 - RNA, 26 nt, Human
cagaguugguaccugcuuuaagaaac

SEQ ID NO: 102488 - RNA, 26 nt, Human
gcaauguggggagaccccaucucuac

SEQ ID NO: 102489 - RNA, 19 nt, Human
ccugagacagaggcagcag

SEQ ID NO: 102490 - RNA, 23 nt, Human
agacuaauuuuuguauuuuuagu

SEQ ID NO: 102491 - RNA, 19 nt, Human
auacuauacauuuaaagca

SEQ ID NO: 102492 - RNA, 23 nt, Human
gcugcagcugcccacugagggcu

SEQ ID NO: 102493 - RNA, 23 nt, Human
caguacauaucuuucugucuuua

SEQ ID NO: 102494 - RNA, 25 nt, Human
cacgguacaagacaauugcauuuaa

SEQ ID NO: 102495 - RNA, 22 nt, Human
uuucucggcagagcagcucuuc

SEQ ID NO: 102496 - RNA, 25 nt, Human
ccuaucccccugccccacccuccuc

SEQ ID NO: 102497 - RNA, 24 nt, Human
ccagcacugccccagacucgcugg

SEQ ID NO: 102498 - RNA, 27 nt, Human
aaauaccaauuauuuuccuacagcccu

SEQ ID NO: 102499 - RNA, 27 nt, Human
cuccacaucacagcauuuagacauaug

SEQ ID NO: 102500 - RNA, 23 nt, Human
cagggcaggagcugcuguggugu

SEQ ID NO: 102501 - RNA, 20 nt, Human
cucugcaaaccaacaggcua

SEQ ID NO: 102502 - RNA, 22 nt, Human
ggugcugccgguggagcuucag

SEQ ID NO: 102503 - RNA, 24 nt, Human
ggcuggcauucuagauuacuuuuc

SEQ ID NO: 102504 - RNA, 24 nt, Human
auaacaacugugaauaagauuauc

SEQ ID NO: 102505 - RNA, 22 nt, Human
accccaggugggccuggcagga

SEQ ID NO: 102506 - RNA, 21 nt, Human
cccggaggggacaccccaagc

SEQ ID NO: 102507 - RNA, 18 nt, Human
augaaguuucgggccaag

SEQ ID NO: 102508 - RNA, 25 nt, Human
cucccauccucucucaggaagcuuc

SEQ ID NO: 102509 - RNA, 22 nt, Human
cucaugccuugcuguccccucc

SEQ ID NO: 102510 - RNA, 25 nt, Human
acaucucuguuauuguuuccaguca

SEQ ID NO: 102511 - RNA, 25 nt, Human
cugucacccaaguuggagugcagug

SEQ ID NO: 102512 - RNA, 30 nt, Human
ccucucuggucacccugccuagcuagagga

SEQ ID NO: 102513 - RNA, 26 nt, Human
ucuuccuccuccuccuucccugacuc

SEQ ID NO: 102514 - RNA, 22 nt, Human
aaguagugucuggaucaguaaa

SEQ ID NO: 102515 - RNA, 21 nt, Human
uucaagacaaagaagaaaaau

SEQ ID NO: 102516 - RNA, 23 nt, Human
caguaucaucuccaucauaugcc

SEQ ID NO: 102517 - RNA, 30 nt, Human
gagcuggugauuccagaagggugacccgga

SEQ ID NO: 102518 - RNA, 20 nt, Human
ucugaccuuguaccucucuu

SEQ ID NO: 102519 - RNA, 25 nt, Human
uugggauucuaggaaacccaaggaa

SEQ ID NO: 102520 - RNA, 22 nt, Human
ucucccaggcugaagugcagug

SEQ ID NO: 102521 - RNA, 20 nt, Human
gugccgcaggcugggcggga

SEQ ID NO: 102522 - RNA, 24 nt, Human
ccuugcauuggugcgccucaggcc

SEQ ID NO: 102523 - RNA, 22 nt, Human
guaggcucauuuccauuugcac

SEQ ID NO: 102524 - RNA, 23 nt, Human
ucaaacacaguuacacuugugca

SEQ ID NO: 102525 - RNA, 21 nt, Human
augcauucuagcacaacaaga

SEQ ID NO: 102526 - RNA, 20 nt, Human
ucuguucuguuucuguggga

SEQ ID NO: 102527 - RNA, 24 nt, Human
aggaauagaaacaaauuuuuauga

SEQ ID NO: 102528 - RNA, 22 nt, Human
uuccuccguccuccugcccaag

SEQ ID NO: 102529 - RNA, 20 nt, Human
acuguacaacuucaagccuc

SEQ ID NO: 102530 - RNA, 24 nt, Human
ugugucuugguuucugccugcugc

SEQ ID NO: 102531 - RNA, 27 nt, Human
ugagacgcagucuggcucucugucgcc

SEQ ID NO: 102532 - RNA, 24 nt, Human
cuguucauuuuaaggaaaccuacu

SEQ ID NO: 102533 - RNA, 24 nt, Human
cucucuugguuccuuccuuggaag

SEQ ID NO: 102534 - RNA, 27 nt, Human
ggguccccagaagccuacaggugagua

SEQ ID NO: 102535 - RNA, 27 nt, Human
uccugguguucucugagacacucuuug

SEQ ID NO: 102536 - RNA, 26 nt, Human
gaucaguaaauaaaauugauguaaua

SEQ ID NO: 102537 - RNA, 25 nt, Human
ggcagaggagaccucagcaucaucu

SEQ ID NO: 102538 - RNA, 22 nt, Human
ccaacugaguucaagggcugua

SEQ ID NO: 102539 - RNA, 26 nt, Human
gagagggagggagaauccuggaugcu

SEQ ID NO: 102540 - RNA, 22 nt, Human
uagaccugcacuguccaguaca

SEQ ID NO: 102541 - RNA, 25 nt, Human
cccaucccacugcucccccaacaca

SEQ ID NO: 102542 - RNA, 26 nt, Human
gggagcugggggagaaugaagacugu

SEQ ID NO: 102543 - RNA, 21 nt, Human
ccugcagugcugagaggcagc

SEQ ID NO: 102544 - RNA, 20 nt, Human
ucgaagcguuccuggagccc

SEQ ID NO: 102545 - RNA, 27 nt, Human
gugccucucccauggcuuugugcugcu

SEQ ID NO: 102546 - RNA, 22 nt, Human
guucaguuuugugcagcauugc

SEQ ID NO: 102547 - RNA, 27 nt, Human
acugcaacuucugccucccgaguucaa

SEQ ID NO: 102548 - RNA, 22 nt, Human
ugggagguggagguugcaguga

SEQ ID NO: 102549 - RNA, 19 nt, Human
uucuaaauuucucucucca

SEQ ID NO: 102550 - RNA, 22 nt, Human
caggcuggagugcaguggcgaa

SEQ ID NO: 102551 - RNA, 22 nt, Human
uuaagugcuuuaccuaaguguu

SEQ ID NO: 102552 - RNA, 22 nt, Human
ugggcagcccccuccacuccac

SEQ ID NO: 102553 - RNA, 20 nt, Human
caggcaggcagcugcaggcg

SEQ ID NO: 102554 - RNA, 23 nt, Human
gaacuccuggagcuacagggaca

SEQ ID NO: 102555 - RNA, 24 nt, Human
agggucugggacgcaguugggagu

SEQ ID NO: 102556 - RNA, 20 nt, Human
cccuucauccugaacugccu

SEQ ID NO: 102557 - RNA, 22 nt, Human
gccagugcuuuaauggcauguc

SEQ ID NO: 102558 - RNA, 23 nt, Human
aaagcuuuuuaauuuuucuuuac

SEQ ID NO: 102559 - RNA, 20 nt, Human
gccgucugcccucauggccu

SEQ ID NO: 102560 - RNA, 27 nt, Human
ucucuaauccuguaucuuucugacugu

SEQ ID NO: 102561 - RNA, 27 nt, Human
uguuggccaggcugguggugagcuccu

SEQ ID NO: 102562 - RNA, 22 nt, Human
ggucuugaacuccuggcucaag

SEQ ID NO: 102563 - RNA, 21 nt, Human
uacuauucaacccauagcaca

SEQ ID NO: 102564 - RNA, 20 nt, Human
uuggagaauguaaaccgccu

SEQ ID NO: 102565 - RNA, 24 nt, Human
ggucaaggugacccgggaggagag

SEQ ID NO: 102566 - RNA, 19 nt, Human
cuauuuuuauaaauucguu

SEQ ID NO: 102567 - RNA, 20 nt, Human
agggagauggcccagccuga

SEQ ID NO: 102568 - RNA, 25 nt, Human
uuccugccugccccaccugccucau

SEQ ID NO: 102569 - RNA, 21 nt, Human
cgcagcgcugggccucguguc

SEQ ID NO: 102570 - RNA, 22 nt, Human
cuccaccuuucagcccacguca

SEQ ID NO: 102571 - RNA, 20 nt, Human
gggcuccagcuucugcucag

SEQ ID NO: 102572 - RNA, 21 nt, Human
uccugcucuuccauuucuucc

SEQ ID NO: 102573 - RNA, 22 nt, Human
gauaccacuuuaaccacaguua

SEQ ID NO: 102574 - RNA, 26 nt, Human
acgggugcaugaaaccacuggaacau

SEQ ID NO: 102575 - RNA, 21 nt, Human
caguggucucacauggugcua

SEQ ID NO: 102576 - RNA, 24 nt, Human
cacuuccucuucuucauugcaguu

SEQ ID NO: 102577 - RNA, 26 nt, Human
aaggcccucuauuucucucuuucuug

SEQ ID NO: 102578 - RNA, 23 nt, Human
ccuccucuccccugcuaagcucc

SEQ ID NO: 102579 - RNA, 26 nt, Human
gcacagccuggucgccuuccaccucu

SEQ ID NO: 102580 - RNA, 26 nt, Human
gccuguaaucccagcuacucaggagg

SEQ ID NO: 102581 - RNA, 27 nt, Human
gcagaagagcugccaggcagugucuua

SEQ ID NO: 102582 - RNA, 22 nt, Human
uuuucucucuguauaucacuuc

SEQ ID NO: 102583 - RNA, 23 nt, Human
guugcuuccuguugccagcauga

SEQ ID NO: 102584 - RNA, 29 nt, Human
agagaaaccccuccagaacucccacccug

SEQ ID NO: 102585 - RNA, 24 nt, Human
agacuuggggaccagaggugacag

SEQ ID NO: 102586 - RNA, 22 nt, Human
aaacuccugcccucaggugauc

SEQ ID NO: 102587 - RNA, 20 nt, Human
acugccagcugggccuggag

SEQ ID NO: 102588 - RNA, 22 nt, Human
ccgccaucagggacauccucug

SEQ ID NO: 102589 - RNA, 24 nt, Human
ggacgaagaaggcuucaaaaaguc

SEQ ID NO: 102590 - RNA, 22 nt, Human
uaggacuaccggcgugcaccac

SEQ ID NO: 102591 - RNA, 24 nt, Human
cgaguggagggaggcaaaggccag

SEQ ID NO: 102592 - RNA, 22 nt, Human
gcucugcauucugcacagagcc

SEQ ID NO: 102593 - RNA, 23 nt, Human
cucagccucccaaaguguuagga

SEQ ID NO: 102594 - RNA, 18 nt, Human
uccacauuccuguuugua

SEQ ID NO: 102595 - RNA, 20 nt, Human
acaacaacaaaugcugcuua

SEQ ID NO: 102596 - RNA, 23 nt, Human
ugugagccacaccuccuagcucu

SEQ ID NO: 102597 - RNA, 25 nt, Human
cgaacuucccucauuucucucugca

SEQ ID NO: 102598 - RNA, 19 nt, Human
uagggacugacuuucuuaa

SEQ ID NO: 102599 - RNA, 23 nt, Human
caaaguugagaacagagcuggug

SEQ ID NO: 102600 - RNA, 23 nt, Human
cauggccgucgcccgguuccgcg

SEQ ID NO: 102601 - RNA, 21 nt, Human
ugaggagaggaaagcagggag

SEQ ID NO: 102602 - RNA, 22 nt, Human
cccaaguaggugggauuacagg

SEQ ID NO: 102603 - RNA, 26 nt, Human
ccucauucuccucuggccucuaauag

SEQ ID NO: 102604 - RNA, 26 nt, Human
uggacucugugagauggagagccaau

SEQ ID NO: 102605 - RNA, 21 nt, Human
ggcucacugccuccuguucca

SEQ ID NO: 102606 - RNA, 21 nt, Human
cauugccuuuugccuaggcug

SEQ ID NO: 102607 - RNA, 27 nt, Human
cuggcuucgaggccuugcuuuucucuc

SEQ ID NO: 102608 - RNA, 24 nt, Human
cuguaggaaacagcagagaccagg

SEQ ID NO: 102609 - RNA, 22 nt, Human
auuguguuauuacuaugaguca

SEQ ID NO: 102610 - RNA, 24 nt, Human
cgcuguuguucuccugcugagcaa

SEQ ID NO: 102611 - RNA, 24 nt, Human
acagucccuuuaaagaaacauggu

SEQ ID NO: 102612 - RNA, 20 nt, Human
uuauacucucaccauuugga

SEQ ID NO: 102613 - RNA, 27 nt, Human
ucugggcacugcuggccagucccaaaa

SEQ ID NO: 102614 - RNA, 28 nt, Human
gcuggaacuacaggcucaugccacugcg

SEQ ID NO: 102615 - RNA, 24 nt, Human
gcuagauguccuaugggcaauuag

SEQ ID NO: 102616 - RNA, 24 nt, Human
gcuuugcauguauuagcucacuga

SEQ ID NO: 102617 - RNA, 22 nt, Human
cugccugcacucccuggccuug

SEQ ID NO: 102618 - RNA, 21 nt, Human
guuuuuaaaagucaauuugua

SEQ ID NO: 102619 - RNA, 28 nt, Human
auuauaccagcauuaauagugaaaauau

SEQ ID NO: 102620 - RNA, 21 nt, Human
ccugaaauagacucucuuaga

SEQ ID NO: 102621 - RNA, 18 nt, Human
cagucacugcauuugccu

SEQ ID NO: 102622 - RNA, 26 nt, Human
cucuccucuccgcccucccgcucgcc

SEQ ID NO: 102623 - RNA, 26 nt, Human
acaccacccucacacacuggcuccag

SEQ ID NO: 102624 - RNA, 23 nt, Human
gcauaugcuuuuuccacgagugu

SEQ ID NO: 102625 - RNA, 23 nt, Human
uacugcucagggugaaugcagcu

SEQ ID NO: 102626 - RNA, 28 nt, Human
ggacuggacaccuucacuccagcuggac

SEQ ID NO: 102627 - RNA, 23 nt, Human
ggguggagucccagagcugcaca

SEQ ID NO: 102628 - RNA, 22 nt, Human
gcugcuuccuguuuucuucuga

SEQ ID NO: 102629 - RNA, 21 nt, Human
uuuucuuucuucuucuucuac

SEQ ID NO: 102630 - RNA, 26 nt, Human
ugaugaaguugcaaauggcagugugc

SEQ ID NO: 102631 - RNA, 20 nt, Human
ccccugagguugugcuuucu

SEQ ID NO: 102632 - RNA, 18 nt, Human
ggcccuuuccuggaccgg

SEQ ID NO: 102633 - RNA, 26 nt, Human
gcuuuguugccaggcuggagugcagu

SEQ ID NO: 102634 - RNA, 21 nt, Human
gaggggauacuguggagcagc

SEQ ID NO: 102635 - RNA, 20 nt, Human
uggucuuaugauuuuauuac

SEQ ID NO: 102636 - RNA, 22 nt, Human
cagguccuagcucuagcacuua

SEQ ID NO: 102637 - RNA, 24 nt, Human
gggucucuguaucucauguagaac

SEQ ID NO: 102638 - RNA, 21 nt, Human
ccaaugccacggccaccagcu

SEQ ID NO: 102639 - RNA, 21 nt, Human
gagguuaggaguagauauuga

SEQ ID NO: 102640 - RNA, 20 nt, Human
ucugaaccaacaguucccuu

SEQ ID NO: 102641 - RNA, 27 nt, Human
gcucugucacacaggcuggagugcagu

SEQ ID NO: 102642 - RNA, 24 nt, Human
gaguuagucuaucucucuuugccu

SEQ ID NO: 102643 - RNA, 25 nt, Human
guaugaucucagcucacugcagccu

SEQ ID NO: 102644 - RNA, 25 nt, Human
gcgugaucuuggcucacugcagccu

SEQ ID NO: 102645 - RNA, 22 nt, Human
ccgaguaacugagauuacaggc

SEQ ID NO: 102646 - RNA, 28 nt, Human
ccugcaccaacagccucaguguuacuuc

SEQ ID NO: 102647 - RNA, 27 nt, Human
ggaggcugaggugggaggaucccagga

SEQ ID NO: 102648 - RNA, 20 nt, Human
augaagugccuagaaccacc

SEQ ID NO: 102649 - RNA, 23 nt, Human
ggacccugagaggcagagugugg

SEQ ID NO: 102650 - RNA, 24 nt, Human
ucaugacagcuacuaaccuggaga

SEQ ID NO: 102651 - RNA, 25 nt, Human
uagcuggagagagaguucucacauu

SEQ ID NO: 102652 - RNA, 22 nt, Human
gaacuccugggcuuaagugacc

SEQ ID NO: 102653 - RNA, 21 nt, Human
ugggcagcggcuucaagagcc

SEQ ID NO: 102654 - RNA, 27 nt, Human
ugggcacagaggguccugacacucugg

SEQ ID NO: 102655 - RNA, 22 nt, Human
gcucucauguuuucaacugcca

SEQ ID NO: 102656 - RNA, 24 nt, Human
uguacucucaguuugauuuucuuc

SEQ ID NO: 102657 - RNA, 27 nt, Human
uuugccucacuguaaccagacaacuag

SEQ ID NO: 102658 - RNA, 22 nt, Human
uagucucuuucucugacacugu

SEQ ID NO: 102659 - RNA, 27 nt, Human
gucucccaggcuggagugcuauggugc

SEQ ID NO: 102660 - RNA, 20 nt, Human
auccccaggcuuggggcaau

SEQ ID NO: 102661 - RNA, 22 nt, Human
ugcaaccuccgccuccagguuc

SEQ ID NO: 102662 - RNA, 21 nt, Human
uucacccaggaggaguggggu

SEQ ID NO: 102663 - RNA, 23 nt, Human
gcucaaguugaugaaucaugggg

SEQ ID NO: 102664 - RNA, 24 nt, Human
ugcuguguucgugucuugcacugg

SEQ ID NO: 102665 - RNA, 27 nt, Human
augggaaaguguaaauguuuuucaugg

SEQ ID NO: 102666 - RNA, 23 nt, Human
gccagaacugccuucuucauuuc

SEQ ID NO: 102667 - RNA, 27 nt, Human
guggcaccuccauccuccugcccagcc

SEQ ID NO: 102668 - RNA, 17 nt, Human
agcaguaucagugucau

SEQ ID NO: 102669 - RNA, 26 nt, Human
cacaguuacaaaagcgacagucuucu

SEQ ID NO: 102670 - RNA, 27 nt, Human
ucuccaaucucauguccauuuuggugu

SEQ ID NO: 102671 - RNA, 22 nt, Human
cuucuuucucuuuccguccaac

SEQ ID NO: 102672 - RNA, 22 nt, Human
gcgugagccccugcgcccggcc

SEQ ID NO: 102673 - RNA, 18 nt, Human
gcuugguggaugagggag

SEQ ID NO: 102674 - RNA, 22 nt, Human
agccucccaaguagcuggaauu

SEQ ID NO: 102675 - RNA, 22 nt, Human
agccucccaaauagcugggauu

SEQ ID NO: 102676 - RNA, 20 nt, Human
uugacaucuggucuugcucc

SEQ ID NO: 102677 - RNA, 22 nt, Human
ucuucuuuguauauuuggugac

SEQ ID NO: 102678 - RNA, 18 nt, Human
caaguugauuuggaacac

SEQ ID NO: 102679 - RNA, 22 nt, Human
acucuucagcuccccucuggca

SEQ ID NO: 102680 - RNA, 21 nt, Human
uuuaguuuuuuaguauuguaa

SEQ ID NO: 102681 - RNA, 27 nt, Human
accagucuggccaauauggagaaaccu

SEQ ID NO: 102682 - RNA, 20 nt, Human
gauuaagucuaccaaagaac

SEQ ID NO: 102683 - RNA, 27 nt, Human
cacugggaguagacacaugaacaagac

SEQ ID NO: 102684 - RNA, 24 nt, Human
cgggcgcccacccuguccuccucc

SEQ ID NO: 102685 - RNA, 22 nt, Human
ccacaccucccccugcugcugc

SEQ ID NO: 102686 - RNA, 23 nt, Human
cagcuguagugagguugcaguga

SEQ ID NO: 102687 - RNA, 27 nt, Human
aagcucugggccccuccucccugcugc

SEQ ID NO: 102688 - RNA, 24 nt, Human
ggccuagagucucaggaacaagac

SEQ ID NO: 102689 - RNA, 20 nt, Human
ucuuguucuuggucuuguca

SEQ ID NO: 102690 - RNA, 20 nt, Human
gcuccuuucugcugacagcc

SEQ ID NO: 102691 - RNA, 19 nt, Human
gcuccagcccucuccagcc

SEQ ID NO: 102692 - RNA, 24 nt, Human
cccgagccaggaacccagguccgg

SEQ ID NO: 102693 - RNA, 25 nt, Human
cugucacucaggcuggaguacagug

SEQ ID NO: 102694 - RNA, 22 nt, Human
uggccaauauggugaaacccca

SEQ ID NO: 102695 - RNA, 27 nt, Human
ccugccugccccaccugccucauauug

SEQ ID NO: 102696 - RNA, 20 nt, Human
ucaaggaaucauagcucucu

SEQ ID NO: 102697 - RNA, 26 nt, Human
uaugcuguuucuugucacuggccuug

SEQ ID NO: 102698 - RNA, 26 nt, Human
gucuggaacuccugagcucaagcagu

SEQ ID NO: 102699 - RNA, 22 nt, Human
gcucagccaggcuggaggcggc

SEQ ID NO: 102700 - RNA, 25 nt, Human
caacaaaucauaaacccggcggagc

SEQ ID NO: 102701 - RNA, 24 nt, Human
ucagaucuucuuuucuaauagcca

SEQ ID NO: 102702 - RNA, 26 nt, Human
gguuuuggugaaauucuuuaauuugu

SEQ ID NO: 102703 - RNA, 23 nt, Human
auugguaagaaugagcuuucaac

SEQ ID NO: 102704 - RNA, 25 nt, Human
gggagguugaagcagaauugcuuga

SEQ ID NO: 102705 - RNA, 24 nt, Human
gccuggaucucaccagcacuuucc

SEQ ID NO: 102706 - RNA, 18 nt, Human
uccagcccagcauccagc

SEQ ID NO: 102707 - RNA, 22 nt, Human
gacuacagacgugugccaccac

SEQ ID NO: 102708 - RNA, 22 nt, Human
acacuuggggaaaagugaggcc

SEQ ID NO: 102709 - RNA, 24 nt, Human
cuccugagaggucgcgggcagugc

SEQ ID NO: 102710 - RNA, 22 nt, Human
cgcuggcagagccgcggguuga

SEQ ID NO: 102711 - RNA, 22 nt, Human
aguguggggcguggcagggggg

SEQ ID NO: 102712 - RNA, 22 nt, Human
agcuucccaaguagcugcaaca

SEQ ID NO: 102713 - RNA, 27 nt, Human
uuucugcuguucucccaugauccaacu

SEQ ID NO: 102714 - RNA, 21 nt, Human
gcuuauaaucccagccagugg

SEQ ID NO: 102715 - RNA, 21 nt, Human
ucacauuuuauaagguugauu

SEQ ID NO: 102716 - RNA, 23 nt, Human
agcaacagcuacaacaaugaaga

SEQ ID NO: 102717 - RNA, 21 nt, Human
cuauagaucuuaaaaaaugaa

SEQ ID NO: 102718 - RNA, 25 nt, Human
gcugggaaaauacaagaaccaagga

SEQ ID NO: 102719 - RNA, 20 nt, Human
ggggccagugccugcagccu

SEQ ID NO: 102720 - RNA, 22 nt, Human
cugugucacucagcagugggac

SEQ ID NO: 102721 - RNA, 22 nt, Human
uaaacuucuuguuaagacuguu

SEQ ID NO: 102722 - RNA, 23 nt, Human
ucuggaggggguuugcuggggaa

SEQ ID NO: 102723 - RNA, 19 nt, Human
auguuacauguagaaaaau

SEQ ID NO: 102724 - RNA, 22 nt, Human
acacccaggcuggagugcagug

SEQ ID NO: 102725 - RNA, 20 nt, Human
uucaaggguaaaagagugca

SEQ ID NO: 102726 - RNA, 20 nt, Human
agugaacacacugauuaggu

SEQ ID NO: 102727 - RNA, 27 nt, Human
cagcacagauucuauuaaaaauaaaug

SEQ ID NO: 102728 - RNA, 26 nt, Human
auucagacuccugggcuuaagggauc

SEQ ID NO: 102729 - RNA, 22 nt, Human
ggcauggagucccaaaggcccu

SEQ ID NO: 102730 - RNA, 22 nt, Human
gucccagguaaguuuccacgcu

SEQ ID NO: 102731 - RNA, 21 nt, Human
gugccccaggccgggcucagu

SEQ ID NO: 102732 - RNA, 19 nt, Human
auccugguuucauaacuuc

SEQ ID NO: 102733 - RNA, 22 nt, Human
ugugugggcugauaguugauca

SEQ ID NO: 102734 - RNA, 23 nt, Human
uccccugguagccuacuuccuua

SEQ ID NO: 102735 - RNA, 22 nt, Human
aguuaauuuuuguauuuuuaga

SEQ ID NO: 102736 - RNA, 22 nt, Human
ccucagccucugccacugugaa

SEQ ID NO: 102737 - RNA, 24 nt, Human
aggcaaugauuguuaauuuacagc

SEQ ID NO: 102738 - RNA, 25 nt, Human
gaagauagccgcuguggcagcuguc

SEQ ID NO: 102739 - RNA, 18 nt, Human
uucugguugagaucaugu

SEQ ID NO: 102740 - RNA, 23 nt, Human
cuugagcugcuccugcauagauc

SEQ ID NO: 102741 - RNA, 25 nt, Human
ggccacacuuugcauuucaacacuc

SEQ ID NO: 102742 - RNA, 22 nt, Human
gcggucuuggcucacugcaacc

SEQ ID NO: 102743 - RNA, 23 nt, Human
guccaguccccuguugcgccgcg

SEQ ID NO: 102744 - RNA, 22 nt, Human
ucagagaagaggccucugugcc

SEQ ID NO: 102745 - RNA, 21 nt, Human
ccgccgcagcgcccucaggcc

SEQ ID NO: 102746 - RNA, 24 nt, Human
gauuaaaauauggacauauuuuug

SEQ ID NO: 102747 - RNA, 26 nt, Human
gcuuuuccugucuuuugugcaugggc

SEQ ID NO: 102748 - RNA, 20 nt, Human
ccacuggucccugaggcucu

SEQ ID NO: 102749 - RNA, 26 nt, Human
uuauccagacugugccggggagaaau

SEQ ID NO: 102750 - RNA, 22 nt, Human
cccuccagaaccugacgacugg

SEQ ID NO: 102751 - RNA, 22 nt, Human
auguagauguaugcacacacau

SEQ ID NO: 102752 - RNA, 20 nt, Human
agggaaagggcaccgggggg

SEQ ID NO: 102753 - RNA, 22 nt, Human
cagauucugccacugcauccuu

SEQ ID NO: 102754 - RNA, 17 nt, Human
acaauaaaaauguuuug

SEQ ID NO: 102755 - RNA, 27 nt, Human
gccuuucucuaugcccuuaagggguga

SEQ ID NO: 102756 - RNA, 21 nt, Human
aguccugugcugaauguggac

SEQ ID NO: 102757 - RNA, 21 nt, Human
uaacuggauuaauucacaggc

SEQ ID NO: 102758 - RNA, 20 nt, Human
uggacagcugauaaauuuaa

SEQ ID NO: 102759 - RNA, 23 nt, Human
uccacacacauacauuacauaua

SEQ ID NO: 102760 - RNA, 24 nt, Human
aggcuggagugcaaugacgcaauc

SEQ ID NO: 102761 - RNA, 23 nt, Human
acacuccuuucacuguagcuuga

SEQ ID NO: 102762 - RNA, 25 nt, Human
cccuccaggaaaggccugaggaugu

SEQ ID NO: 102763 - RNA, 23 nt, Human
uguuuucagaggcuggagggcgg

SEQ ID NO: 102764 - RNA, 25 nt, Human
ugccgcggcgggccugugggagcgg

SEQ ID NO: 102765 - RNA, 21 nt, Human
guccuguguucuucccgcucc

SEQ ID NO: 102766 - RNA, 25 nt, Human
uccugagagauagcaaacaugccca

SEQ ID NO: 102767 - RNA, 25 nt, Human
uucauuaaucauucacaccuucagg

SEQ ID NO: 102768 - RNA, 21 nt, Human
ucucuguucuguucccuccau

SEQ ID NO: 102769 - RNA, 20 nt, Human
gaccacuuauccucauugcu

SEQ ID NO: 102770 - RNA, 21 nt, Human
gcugcagcugcagcgcgagcc

SEQ ID NO: 102771 - RNA, 24 nt, Human
agaauaaagcaaggcucccgaaaa

SEQ ID NO: 102772 - RNA, 21 nt, Human
gagaaggcugccugaucagag

SEQ ID NO: 102773 - RNA, 21 nt, Human
ggcucaaugcaaccucugccc

SEQ ID NO: 102774 - RNA, 23 nt, Human
ccucuccuggcccuggaaguugc

SEQ ID NO: 102775 - RNA, 27 nt, Human
aggcagaggaggagaaauugaaggucc

SEQ ID NO: 102776 - RNA, 21 nt, Human
ccugcagccccagacucugcu

SEQ ID NO: 102777 - RNA, 19 nt, Human
cagcccaggaagucuugga

SEQ ID NO: 102778 - RNA, 21 nt, Human
ggagacggaggggaguagaga

SEQ ID NO: 102779 - RNA, 21 nt, Human
guuuuuaaaaaauaaagcuua

SEQ ID NO: 102780 - RNA, 22 nt, Human
gaugagaauagaagaguaccug

SEQ ID NO: 102781 - RNA, 22 nt, Human
gcagaugacccccaggccuugg

SEQ ID NO: 102782 - RNA, 24 nt, Human
guccucauucccuucuguaugaca

SEQ ID NO: 102783 - RNA, 18 nt, Human
gccuaucugucaucgccu

SEQ ID NO: 102784 - RNA, 22 nt, Human
ucagagaaccuguugaaaugug

SEQ ID NO: 102785 - RNA, 24 nt, Human
agaggaguccaugauggaggcaga

SEQ ID NO: 102786 - RNA, 24 nt, Human
ucaagauacauuucaucugcugcu

SEQ ID NO: 102787 - RNA, 19 nt, Human
uuucuccuccauccguacc

SEQ ID NO: 102788 - RNA, 24 nt, Human
gucugcguggguuuuuguauccag

SEQ ID NO: 102789 - RNA, 22 nt, Human
cacgccuguaauccuagcaguu

SEQ ID NO: 102790 - RNA, 22 nt, Human
ggaaagcucuuccuaaucgcua

SEQ ID NO: 102791 - RNA, 21 nt, Human
aacagaacauucuccagguag

SEQ ID NO: 102792 - RNA, 26 nt, Human
cggaggcagaggaagagggagcggga

SEQ ID NO: 102793 - RNA, 21 nt, Human
acaguugggaaaaguaguuug

SEQ ID NO: 102794 - RNA, 24 nt, Human
guagcugaauuugauucuccagcc

SEQ ID NO: 102795 - RNA, 27 nt, Human
uuuguucugcccucaucuggcccuggc

SEQ ID NO: 102796 - RNA, 22 nt, Human
ucagagaucugggaggucucca

SEQ ID NO: 102797 - RNA, 21 nt, Human
gcuggggcugggccaucacca

SEQ ID NO: 102798 - RNA, 25 nt, Human
uggaaggcaggggacugcgagcugg

SEQ ID NO: 102799 - RNA, 20 nt, Human
uggcaacacuggagugcaca

SEQ ID NO: 102800 - RNA, 22 nt, Human
cugaagcaggauaaucgcuuga

SEQ ID NO: 102801 - RNA, 22 nt, Human
aaacccacacacaacugaaaau

SEQ ID NO: 102802 - RNA, 22 nt, Human
aggcugaggcaggagaauugcu

SEQ ID NO: 102803 - RNA, 22 nt, Human
uuuggaauaccaaagauuaaau

SEQ ID NO: 102804 - RNA, 20 nt, Human
uucuuggaauuggcucucuu

SEQ ID NO: 102805 - RNA, 23 nt, Human
agggggcagaggcaggggcggga

SEQ ID NO: 102806 - RNA, 22 nt, Human
cauugucauuguuauugugaca

SEQ ID NO: 102807 - RNA, 22 nt, Human
ggccgugggccgggaggcagug

SEQ ID NO: 102808 - RNA, 24 nt, Human
guugagccuuccuuucuguuuggg

SEQ ID NO: 102809 - RNA, 18 nt, Human
ucacccaggcuggaguac

SEQ ID NO: 102810 - RNA, 27 nt, Human
uuguccacucugcuuucggaagugcug

SEQ ID NO: 102811 - RNA, 23 nt, Human
cguaaccucugccguucaggaac

SEQ ID NO: 102812 - RNA, 23 nt, Human
cauccaggcugcccguguguugc

SEQ ID NO: 102813 - RNA, 25 nt, Human
ccccguccugccuccuuucuuucuc

SEQ ID NO: 102814 - RNA, 26 nt, Human
agacaagcugaccugacaaguacuau

SEQ ID NO: 102815 - RNA, 23 nt, Human
aggacugaauuacucuccaaguu

SEQ ID NO: 102816 - RNA, 19 nt, Human
caggcuggagugcaaugca

SEQ ID NO: 102817 - RNA, 22 nt, Human
uuuuucuccacugcuuggauau

SEQ ID NO: 102818 - RNA, 22 nt, Human
cugagccucccaaagugcuggg

SEQ ID NO: 102819 - RNA, 29 nt, Human
cauucuuaucuccagccugggaaaaguuc

SEQ ID NO: 102820 - RNA, 25 nt, Human
ggacggaggccgggagccaugggug

SEQ ID NO: 102821 - RNA, 22 nt, Human
auacugcaucuugguuauuucu

SEQ ID NO: 102822 - RNA, 25 nt, Human
agaaacacaguuuuaucuguuaguc

SEQ ID NO: 102823 - RNA, 23 nt, Human
guguauguguaucucacacucau

SEQ ID NO: 102824 - RNA, 21 nt, Human
agccccggcggccagcaggga

SEQ ID NO: 102825 - RNA, 23 nt, Human
guggauuugcaggccagggagaa

SEQ ID NO: 102826 - RNA, 20 nt, Human
cacgcgggcaagccuaggag

SEQ ID NO: 102827 - RNA, 21 nt, Human
gcucacugcaaccuccaucuc

SEQ ID NO: 102828 - RNA, 19 nt, Human
agaccuuuuggagacugga

SEQ ID NO: 102829 - RNA, 27 nt, Human
uuuucuagcccucucccucaguccuuu

SEQ ID NO: 102830 - RNA, 23 nt, Human
ggggauaccugccugucaccuca

SEQ ID NO: 102831 - RNA, 23 nt, Human
ccacacucgccaucuccugggcc

SEQ ID NO: 102832 - RNA, 23 nt, Human
cuguggggaaaaauuauugagcc

SEQ ID NO: 102833 - RNA, 21 nt, Human
gacuauguaaacuacuucucu

SEQ ID NO: 102834 - RNA, 24 nt, Human
cacucccucucugcucuccugucc

SEQ ID NO: 102835 - RNA, 25 nt, Human
gggucaaaucagcuccuucucucca

SEQ ID NO: 102836 - RNA, 20 nt, Human
cucugugagggucacugcug

SEQ ID NO: 102837 - RNA, 20 nt, Human
aggaacgggucccugcagcc

SEQ ID NO: 102838 - RNA, 27 nt, Human
ccuccaggaccauucaggcuguugaca

SEQ ID NO: 102839 - RNA, 21 nt, Human
cucaccccacaccugacacag

SEQ ID NO: 102840 - RNA, 26 nt, Human
ccagccuggccccaagcauggaaacg

SEQ ID NO: 102841 - RNA, 19 nt, Human
gcacagcccucacagcuca

SEQ ID NO: 102842 - RNA, 27 nt, Human
gggcuuaaaucaugggcuaucucucca

SEQ ID NO: 102843 - RNA, 22 nt, Human
uuuaaggacaucuguucuucca

SEQ ID NO: 102844 - RNA, 21 nt, Human
ggugguuugucuucuuuguua

SEQ ID NO: 102845 - RNA, 24 nt, Human
ccugcugcagcgcaacggcuccuu

SEQ ID NO: 102846 - RNA, 23 nt, Human
accaugccuggcuaauuuugugu

SEQ ID NO: 102847 - RNA, 23 nt, Human
accuguaaucccagcuacucugg

SEQ ID NO: 102848 - RNA, 22 nt, Human
ugugcucaggcuggggaacaga

SEQ ID NO: 102849 - RNA, 22 nt, Human
ggucuccuaaaguacugggauu

SEQ ID NO: 102850 - RNA, 22 nt, Human
agcuucucaagggauuguguuu

SEQ ID NO: 102851 - RNA, 26 nt, Human
guugcacuccgugcuuugcacaaagc

SEQ ID NO: 102852 - RNA, 21 nt, Human
gggcugggugcaguggcucac

SEQ ID NO: 102853 - RNA, 26 nt, Human
gaguuucugugaugauuuguugagcc

SEQ ID NO: 102854 - RNA, 20 nt, Human
ggacucaggcuggaggcaga

SEQ ID NO: 102855 - RNA, 24 nt, Human
cugaggaagcugggguucaugaca

SEQ ID NO: 102856 - RNA, 23 nt, Human
cucccaggacucugcugccucag

SEQ ID NO: 102857 - RNA, 21 nt, Human
ggcugcuucuggggccugugu

SEQ ID NO: 102858 - RNA, 17 nt, Human
acugugacugacaggua

SEQ ID NO: 102859 - RNA, 26 nt, Human
cucuggacacagacagauccugggga

SEQ ID NO: 102860 - RNA, 23 nt, Human
gagaacaucuauccuaugaauaa

SEQ ID NO: 102861 - RNA, 25 nt, Human
ucucccacugaccucuuucucguuu

SEQ ID NO: 102862 - RNA, 20 nt, Human
agguauuucaaaaaugggaa

SEQ ID NO: 102863 - RNA, 23 nt, Human
guucaucauuggcccucauucca

SEQ ID NO: 102864 - RNA, 21 nt, Human
caggaaggggcggggagaagc

SEQ ID NO: 102865 - RNA, 21 nt, Human
aguggaugacaaaaagagggg

SEQ ID NO: 102866 - RNA, 21 nt, Human
agccgaggcuggagcacaggg

SEQ ID NO: 102867 - RNA, 21 nt, Human
ggcucacugcaagcucugcuu

SEQ ID NO: 102868 - RNA, 22 nt, Human
ggggguguucagccacugaggg

SEQ ID NO: 102869 - RNA, 27 nt, Human
ucugccgugggcccuccagauagcuca

SEQ ID NO: 102870 - RNA, 23 nt, Human
aagccuucuuuuuucucuuuuac

SEQ ID NO: 102871 - RNA, 25 nt, Human
cugucacucaggcuggagcacagug

SEQ ID NO: 102872 - RNA, 23 nt, Human
cacucacugucaaugauuauuuu

SEQ ID NO: 102873 - RNA, 19 nt, Human
uguucaaaacucugcagca

SEQ ID NO: 102874 - RNA, 17 nt, Human
cgcccaggguuacuuga

SEQ ID NO: 102875 - RNA, 23 nt, Human
agcaaggagaaggcaggaacauu

SEQ ID NO: 102876 - RNA, 22 nt, Human
aaccauucugaaguuacuggag

SEQ ID NO: 102877 - RNA, 32 nt, Human
ggaggaagaggaagaagggacagugcucagcu

SEQ ID NO: 102878 - RNA, 21 nt, Human
uuugcagaaccuuuaauugga

SEQ ID NO: 102879 - RNA, 27 nt, Human
aggaacccugcuccucucuguccugcc

SEQ ID NO: 102880 - RNA, 26 nt, Human
ucauucuucccuaaucuuccacuuga

SEQ ID NO: 102881 - RNA, 25 nt, Human
aacucguaacccuguccuucaaaaa

SEQ ID NO: 102882 - RNA, 22 nt, Human
gugaacaaucauuaauucuucg

SEQ ID NO: 102883 - RNA, 27 nt, Human
gccuaggaggccuucucgcauuuucuc

SEQ ID NO: 102884 - RNA, 21 nt, Human
cucuguauuagacucacacac

SEQ ID NO: 102885 - RNA, 21 nt, Human
aaaaaauaaacaagaaauauu

SEQ ID NO: 102886 - RNA, 26 nt, Human
uucccuuucaucugugcucauacuuu

SEQ ID NO: 102887 - RNA, 26 nt, Human
uugccucagggccaagccggcccaac

SEQ ID NO: 102888 - RNA, 20 nt, Human
gaggcuggagugggggugug

SEQ ID NO: 102889 - RNA, 20 nt, Human
gucuggagacagagugagag

SEQ ID NO: 102890 - RNA, 26 nt, Human
gagggagcuuggagaacucacugugg

SEQ ID NO: 102891 - RNA, 23 nt, Human
cugcugccuuugccuccagugca

SEQ ID NO: 102892 - RNA, 21 nt, Human
cuccugucacucacugaggcc

SEQ ID NO: 102893 - RNA, 24 nt, Human
acuguuagaguugggggcucugcu

SEQ ID NO: 102894 - RNA, 18 nt, Human
ucucauuuuccuguuuac

SEQ ID NO: 102895 - RNA, 24 nt, Human
gggaagaugggagguuguggguga

SEQ ID NO: 102896 - RNA, 24 nt, Human
uggccucaagcaauccaccugccu

SEQ ID NO: 102897 - RNA, 22 nt, Human
cuccacacugcacaauaacucc

SEQ ID NO: 102898 - RNA, 22 nt, Human
accagccuggucaacauaguga

SEQ ID NO: 102899 - RNA, 27 nt, Human
ccaggacuggcuugcgagccccggggg

SEQ ID NO: 102900 - RNA, 32 nt, Human
ggucucgaucuccugaccuugugauccaccuc

SEQ ID NO: 102901 - RNA, 25 nt, Human
uucacagucuucuauuguuggacca

SEQ ID NO: 102902 - RNA, 21 nt, Human
cuucccuuucugcuuguguua

SEQ ID NO: 102903 - RNA, 27 nt, Human
gcuuguuuuucuucagcauuuacuuga

SEQ ID NO: 102904 - RNA, 22 nt, Human
uaccaacauuggaaaacagcca

SEQ ID NO: 102905 - RNA, 24 nt, Human
aaccuauaguuauauaaucugacu

SEQ ID NO: 102906 - RNA, 27 nt, Human
cccugcucucaccuacucacagacggg

SEQ ID NO: 102907 - RNA, 17 nt, Human
ugcuaucacuauuucca

SEQ ID NO: 102908 - RNA, 23 nt, Human
uauggugacagugucucuccaug

SEQ ID NO: 102909 - RNA, 23 nt, Human
acugcagcagagcuuguagcugg

SEQ ID NO: 102910 - RNA, 24 nt, Human
agcguuucuguguagaaacuggaa

SEQ ID NO: 102911 - RNA, 19 nt, Human
ggccaccccacucuaccuc

SEQ ID NO: 102912 - RNA, 23 nt, Human
uuaaaacuaaauguaagaaaaau

SEQ ID NO: 102913 - RNA, 20 nt, Human
uagcacugcaccucuacauc

SEQ ID NO: 102914 - RNA, 21 nt, Human
gggcuugugaacucaacccca

SEQ ID NO: 102915 - RNA, 31 nt, Human
ggggagggaagggaguguuccgaagaugcug

SEQ ID NO: 102916 - RNA, 26 nt, Human
ugaaggagaggagggcggggaaguuu

SEQ ID NO: 102917 - RNA, 27 nt, Human
caacuuuguuagcugcgugcgugcuuu

SEQ ID NO: 102918 - RNA, 23 nt, Human
cugaggauugcucuuuuuuccua

SEQ ID NO: 102919 - RNA, 23 nt, Human
gucuucuggucuccuuggagaaa

SEQ ID NO: 102920 - RNA, 31 nt, Human
gaaccacaggccugagccacugugcccagcc

SEQ ID NO: 102921 - RNA, 21 nt, Human
aaaaggagaagaacaucugag

SEQ ID NO: 102922 - RNA, 20 nt, Human
guccaaaaucacacaacuug

SEQ ID NO: 102923 - RNA, 22 nt, Human
accuuucaaggaggaaaccaga

SEQ ID NO: 102924 - RNA, 25 nt, Human
auuuuucuaaacgcuuacagauucc

SEQ ID NO: 102925 - RNA, 25 nt, Human
uucagaauaaauuuuuugugcuuau

SEQ ID NO: 102926 - RNA, 21 nt, Human
cacagcucacugcagcuuuga

SEQ ID NO: 102927 - RNA, 21 nt, Human
aucuuauguuucuagucuuuc

SEQ ID NO: 102928 - RNA, 21 nt, Human
cugugaucccagcuacucggg

SEQ ID NO: 102929 - RNA, 20 nt, Human
auuucauuucaaaggugcua

SEQ ID NO: 102930 - RNA, 22 nt, Human
ccauccgggggcaaccaugccg

SEQ ID NO: 102931 - RNA, 28 nt, Human
gacggaacuucagccgcugccucuguuc

SEQ ID NO: 102932 - RNA, 22 nt, Human
ccuaaugagaacggggagcugc

SEQ ID NO: 102933 - RNA, 23 nt, Human
cccagugcccuuccccuugggcu

SEQ ID NO: 102934 - RNA, 21 nt, Human
ccuuucucccccaacaggauc

SEQ ID NO: 102935 - RNA, 26 nt, Human
gcccaggcaggagggagcgccucggc

SEQ ID NO: 102936 - RNA, 27 nt, Human
ucauagaauaauuuuuuauagaguaua

SEQ ID NO: 102937 - RNA, 21 nt, Human
aggauuuggccacacuggggc

SEQ ID NO: 102938 - RNA, 22 nt, Human
ugcaaaauggggauggggaagg

SEQ ID NO: 102939 - RNA, 21 nt, Human
accuugaaucugccugcuggc

SEQ ID NO: 102940 - RNA, 19 nt, Human
cuuggagccugcggggugc

SEQ ID NO: 102941 - RNA, 27 nt, Human
ccagcacuuugggaggcugagcuggau

SEQ ID NO: 102942 - RNA, 21 nt, Human
cagcugagcccagcccacggg

SEQ ID NO: 102943 - RNA, 24 nt, Human
uuguuuuguuuugguuuuccagcg

SEQ ID NO: 102944 - RNA, 19 nt, Human
cauuggauguggagcuccu

SEQ ID NO: 102945 - RNA, 23 nt, Human
cucuccuccgcucaaacucagcu

SEQ ID NO: 102946 - RNA, 21 nt, Human
cuccaaaggugcaaaaaggaa

SEQ ID NO: 102947 - RNA, 20 nt, Human
cuccuuucugggccucauuu

SEQ ID NO: 102948 - RNA, 24 nt, Human
ugucugcugacuguuucauucacu

SEQ ID NO: 102949 - RNA, 25 nt, Human
uucuuugucaauucauuuuuuccca

SEQ ID NO: 102950 - RNA, 20 nt, Human
uuccuaaugauuagcacuua

SEQ ID NO: 102951 - RNA, 23 nt, Human
cuccuccagcccagcggcccucu

SEQ ID NO: 102952 - RNA, 26 nt, Human
ccucacugcugagcgccccucgacgg

SEQ ID NO: 102953 - RNA, 18 nt, Human
acuaagcugaggguccac

SEQ ID NO: 102954 - RNA, 25 nt, Human
cauuuccuaccuuccuuccuccucu

SEQ ID NO: 102955 - RNA, 24 nt, Human
gccauucuuuuuguucacuuucua

SEQ ID NO: 102956 - RNA, 21 nt, Human
cagacaaacuugauuucuucu

SEQ ID NO: 102957 - RNA, 22 nt, Human
cuucugcugauucauaaccauu

SEQ ID NO: 102958 - RNA, 23 nt, Human
aggcuggagugcagugccaugau

SEQ ID NO: 102959 - RNA, 21 nt, Human
ggcuaugugggggguggugca

SEQ ID NO: 102960 - RNA, 22 nt, Human
caacuccugggcucaagcaguc

SEQ ID NO: 102961 - RNA, 27 nt, Human
cuuucucuuggacauuguaaacguauu

SEQ ID NO: 102962 - RNA, 25 nt, Human
ccccugccaccucuagcucggagcg

SEQ ID NO: 102963 - RNA, 23 nt, Human
ccuuuuaggagcuuuauguuuag

SEQ ID NO: 102964 - RNA, 22 nt, Human
uugcccaggcaagagugcagug

SEQ ID NO: 102965 - RNA, 22 nt, Human
ugucacccacuccugggugcgu

SEQ ID NO: 102966 - RNA, 20 nt, Human
gggagcuggaggguggcugc

SEQ ID NO: 102967 - RNA, 22 nt, Human
uggcucucgccuguaaucccag

SEQ ID NO: 102968 - RNA, 27 nt, Human
ccacugcacuccagccugggcagcaga

SEQ ID NO: 102969 - RNA, 20 nt, Human
cucuaauuuuauuauuuugg

SEQ ID NO: 102970 - RNA, 21 nt, Human
gcccccauuuccuccuucauc

SEQ ID NO: 102971 - RNA, 21 nt, Human
cccagcacuggggaggcgcca

SEQ ID NO: 102972 - RNA, 24 nt, Human
uaagcuuccauagaaauacacuuu

SEQ ID NO: 102973 - RNA, 26 nt, Human
ugauggucaacaauaagccacgucaa

SEQ ID NO: 102974 - RNA, 26 nt, Human
ucucuagcggccgccuggcugcagca

SEQ ID NO: 102975 - RNA, 24 nt, Human
agaggggugggucagagcagugga

SEQ ID NO: 102976 - RNA, 21 nt, Human
agaacaacagagucucaggga

SEQ ID NO: 102977 - RNA, 17 nt, Human
cuuacauuccuucuucc

SEQ ID NO: 102978 - RNA, 21 nt, Human
gcuucuaggacaagagccagg

SEQ ID NO: 102979 - RNA, 22 nt, Human
ccacaaaacaucaaguauucca

SEQ ID NO: 102980 - RNA, 21 nt, Human
auuuuuuaauaauuguauuua

SEQ ID NO: 102981 - RNA, 27 nt, Human
uguccaguagccgcaaucccaggcugg

SEQ ID NO: 102982 - RNA, 25 nt, Human
ccacacacacccacacacucgcccg

SEQ ID NO: 102983 - RNA, 25 nt, Human
ggaucaguagaggcuugcacugccu

SEQ ID NO: 102984 - RNA, 24 nt, Human
ccgcggcucuccccuuccccagcc

SEQ ID NO: 102985 - RNA, 24 nt, Human
ucucauucugucacccagacugga

SEQ ID NO: 102986 - RNA, 27 nt, Human
gaggcaguaaaugaaguuacaggcuag

SEQ ID NO: 102987 - RNA, 19 nt, Human
acacggcaccucugaguca

SEQ ID NO: 102988 - RNA, 23 nt, Human
ccuucuggcccccugccuggagc

SEQ ID NO: 102989 - RNA, 27 nt, Human
caaccuagaaguaacuggugauauauc

SEQ ID NO: 102990 - RNA, 19 nt, Human
gaauccacagaucagaaau

SEQ ID NO: 102991 - RNA, 21 nt, Human
gacggaggggaguagagaagu

SEQ ID NO: 102992 - RNA, 22 nt, Human
ugcaaccuccgccuccuggguu

SEQ ID NO: 102993 - RNA, 16 nt, Human
accaaaaaaugcaugu

SEQ ID NO: 102994 - RNA, 21 nt, Human
gaagguagcacgacacuguga

SEQ ID NO: 102995 - RNA, 25 nt, Human
aaccccucucggccgggugcagugg

SEQ ID NO: 102996 - RNA, 26 nt, Human
cuuucugaugcucucaaacugcaucu

SEQ ID NO: 102997 - RNA, 22 nt, Human
gaaucacugcaggcuguguucu

SEQ ID NO: 102998 - RNA, 23 nt, Human
ggaggcagcagcauugcacagcc

SEQ ID NO: 102999 - RNA, 21 nt, Human
cugaggcacagaggagcuaaa

SEQ ID NO: 103000 - RNA, 22 nt, Human
aaugggguagggaauacuggag

SEQ ID NO: 103001 - RNA, 27 nt, Human
aacuauggucagagcguauuuggauau

SEQ ID NO: 103002 - RNA, 25 nt, Human
caguguuaagacucugucucaaaua

SEQ ID NO: 103003 - RNA, 21 nt, Human
cugccgacccugccugagcgc

SEQ ID NO: 103004 - RNA, 22 nt, Human
guucacugcagucuugaccucc

SEQ ID NO: 103005 - RNA, 26 nt, Human
guuccucucccuucccuucccucacc

SEQ ID NO: 103006 - RNA, 19 nt, Human
gcugguuuccccuccuucc

SEQ ID NO: 103007 - RNA, 21 nt, Human
cccacacccugcccuccuugu

SEQ ID NO: 103008 - RNA, 27 nt, Human
agugagcagagaucacaacauugcacu

SEQ ID NO: 103009 - RNA, 23 nt, Human
cuugcaggcugugguggagcuga

SEQ ID NO: 103010 - RNA, 24 nt, Human
acccaggcuggagugcaaugaugc

SEQ ID NO: 103011 - RNA, 26 nt, Human
ccuucaaggaggguucccgcagcugg

SEQ ID NO: 103012 - RNA, 26 nt, Human
gauugaaugugagcagguugaccuca

SEQ ID NO: 103013 - RNA, 27 nt, Human
agagacugguagcaucguuucucucuc

SEQ ID NO: 103014 - RNA, 19 nt, Human
ccagguugaaaccccacua

SEQ ID NO: 103015 - RNA, 22 nt, Human
acugcaacgucugccuccuggg

SEQ ID NO: 103016 - RNA, 22 nt, Human
cuuggccucccaaagugcugaa

SEQ ID NO: 103017 - RNA, 21 nt, Human
aucagccugggagacgcggug

SEQ ID NO: 103018 - RNA, 20 nt, Human
ggccaucacaccugcccugu

SEQ ID NO: 103019 - RNA, 26 nt, Human
ugcccaggcgcuauggcgagugcggu

SEQ ID NO: 103020 - RNA, 21 nt, Human
aaagugagaggugggggacag

SEQ ID NO: 103021 - RNA, 20 nt, Human
gcacagccuggccaugccca

SEQ ID NO: 103022 - RNA, 25 nt, Human
ccccccacucugaacucaagucacc

SEQ ID NO: 103023 - RNA, 21 nt, Human
gggugguggaggcaguaggga

SEQ ID NO: 103024 - RNA, 22 nt, Human
ugaaugucuuuuuucaaacuuu

SEQ ID NO: 103025 - RNA, 22 nt, Human
ccaaguagcugggauaacaggc

SEQ ID NO: 103026 - RNA, 32 nt, Human; identical to SEQ ID NO: 5478

SEQ ID NO: 103027 - RNA, 29 nt, Human
cuggggccacuggcuucacauucugggcu

SEQ ID NO: 103028 - RNA, 22 nt, Human
uuauauuuuugguuucucucua

SEQ ID NO: 103029 - RNA, 20 nt, Human
cccagcacuuugagaggcca

SEQ ID NO: 103030 - RNA, 27 nt, Human
uggguucaagcaauucuccugccucag

SEQ ID NO: 103031 - RNA, 20 nt, Human
cuagggagcaagguccuccc

SEQ ID NO: 103032 - RNA, 24 nt, Human
ucucuguccugucuucccugcucc

SEQ ID NO: 103033 - RNA, 25 nt, Human
ggcuugccuguaggauuuaauauuu

SEQ ID NO: 103034 - RNA, 26 nt, Human
ucuguauguccuucuguucugccuuc

SEQ ID NO: 103035 - RNA, 21 nt, Human
ugcagcaggaaggaacaaaga

SEQ ID NO: 103036 - RNA, 24 nt, Human
agccuuuuauacugauuauucuuu

SEQ ID NO: 103037 - RNA, 25 nt, Human
acuuccuauaauacaaauacacaau

SEQ ID NO: 103038 - RNA, 19 nt, Human
agcuucaaagcugcuuuau

SEQ ID NO: 103039 - RNA, 27 nt, Human
cuuucauuccuucagauuuggcuugac

SEQ ID NO: 103040 - RNA, 17 nt, Human
ggccucggccuaugcga

SEQ ID NO: 103041 - RNA, 22 nt, Human
guacuuuucacauuuugauuua

SEQ ID NO: 103042 - RNA, 27 nt, Human
aagcauuugcuucuguuuucccuaccu

SEQ ID NO: 103043 - RNA, 22 nt, Human
cugccaguuucuccauccagcu

SEQ ID NO: 103044 - RNA, 27 nt, Human
agagacacauccucucauacucccuga

SEQ ID NO: 103045 - RNA, 22 nt, Human
gcuacuuacauggaucaucgag

SEQ ID NO: 103046 - RNA, 22 nt, Human
augaucugggcucacugcaacc

SEQ ID NO: 103047 - RNA, 22 nt, Human
cugugaaauaaggacuccaccu

SEQ ID NO: 103048 - RNA, 21 nt, Human
gugaacaaagggaaaauucua

SEQ ID NO: 103049 - RNA, 21 nt, Human
cuacaucuguuuucuucugua

SEQ ID NO: 103050 - RNA, 21 nt, Human
ucucuuaaagaaauuaugaaa

SEQ ID NO: 103051 - RNA, 21 nt, Human
uggaggguuuuaaauggagga

SEQ ID NO: 103052 - RNA, 20 nt, Human
ucuuugcugccccucucccc

SEQ ID NO: 103053 - RNA, 21 nt, Human
aaagugcugggauuacagcau

SEQ ID NO: 103054 - RNA, 27 nt, Human
ggcugaaaauuauugugcuguucuagg

SEQ ID NO: 103055 - RNA, 22 nt, Human
aagacucuuauccaucugugaa

SEQ ID NO: 103056 - RNA, 23 nt, Human
gugcucaugguucugucauucuu

SEQ ID NO: 103057 - RNA, 25 nt, Human
ugccauggccgggugcaguggcuca

SEQ ID NO: 103058 - RNA, 22 nt, Human
gagcucccccaucccugcuaca

SEQ ID NO: 103059 - RNA, 23 nt, Human
cuuauguguacaugcauuuuucu

SEQ ID NO: 103060 - RNA, 22 nt, Human
cgaacuccugggcucaaacagu

SEQ ID NO: 103061 - RNA, 21 nt, Human
gucacucacauccauucuucc

SEQ ID NO: 103062 - RNA, 28 nt, Human
gguuuccaucugaaaguagagguuguau

SEQ ID NO: 103063 - RNA, 23 nt, Human
ucagugacccaggaaaaugaagc

SEQ ID NO: 103064 - RNA, 22 nt, Human
guucaacuuuuauccugcagca

SEQ ID NO: 103065 - RNA, 21 nt, Human
ucaucccggcagacaccaaga

SEQ ID NO: 103066 - RNA, 22 nt, Human
cuucauuuccuccgucaccuca

SEQ ID NO: 103067 - RNA, 27 nt, Human
ggaggcuggagaaagggaaguggaagg

SEQ ID NO: 103068 - RNA, 21 nt, Human
gauggcugugccagagguucg

SEQ ID NO: 103069 - RNA, 31 nt, Human
gccuuccuuucucucuccugugaagaacugc

SEQ ID NO: 103070 - RNA, 20 nt, Human
uucucucuccaucuaccuuc

SEQ ID NO: 103071 - RNA, 20 nt, Human
cccccauugccucaggcugg

SEQ ID NO: 103072 - RNA, 27 nt, Human
caccaaaauauaguuugcacuuuuuaa

SEQ ID NO: 103073 - RNA, 22 nt, Human
gggcugguugcugcugcaguga

SEQ ID NO: 103074 - RNA, 22 nt, Human
aagaggugguucucugcaguga

SEQ ID NO: 103075 - RNA, 22 nt, Human
ugcaccaugcugcuggggaaga

SEQ ID NO: 103076 - RNA, 29 nt, Human
gcugcccuucugccccugccugggaacac

SEQ ID NO: 103077 - RNA, 19 nt, Human
uggccuuaccccugccuuu

SEQ ID NO: 103078 - RNA, 22 nt, Human
ccuuggauggccucaggccagg

SEQ ID NO: 103079 - RNA, 27 nt, Human
guugacuccugagcauauuuaaaacaa

SEQ ID NO: 103080 - RNA, 30 nt, Human
ccuccucugcucuugaucuguguuucaaua

SEQ ID NO: 103081 - RNA, 21 nt, Human
gccagagcaucccccuccucc

SEQ ID NO: 103082 - RNA, 23 nt, Human
ccuuuuuguuccuuaccagcaug

SEQ ID NO: 103083 - RNA, 20 nt, Human
cugcaucuucccagcagccu

SEQ ID NO: 103084 - RNA, 22 nt, Human
acugggaguucucaagugaaug

SEQ ID NO: 103085 - RNA, 23 nt, Human
uugcacagggagugcaggaggug

SEQ ID NO: 103086 - RNA, 24 nt, Human
gcacgagccaccacacccagcuaa

SEQ ID NO: 103087 - RNA, 22 nt, Human
gcucacgccucuaaucccagga

SEQ ID NO: 103088 - RNA, 16 nt, Human
cuucccuuggcuuaca

SEQ ID NO: 103089 - RNA, 27 nt, Human
cuagcuccccuccucuccccuccacug

SEQ ID NO: 103090 - RNA, 28 nt, Human
gcuccugccacacccacagggcagccuc

SEQ ID NO: 103091 - RNA, 25 nt, Human
gaacaauguauacaaugcacuuuua

SEQ ID NO: 103092 - RNA, 23 nt, Human
agauaccaggcaauccagagcca

SEQ ID NO: 103093 - RNA, 27 nt, Human
cccuccagggcuuucagggaagcgcca

SEQ ID NO: 103094 - RNA, 22 nt, Human
gcgugagccaccgcguccggcc

SEQ ID NO: 103095 - RNA, 22 nt, Human
auguagggugaugagcacucac

SEQ ID NO: 103096 - RNA, 20 nt, Human
aucucagaauguccccacca

SEQ ID NO: 103097 - RNA, 26 nt, Human
gagaugggguuucacuguguuggcca

SEQ ID NO: 103098 - RNA, 22 nt, Human
uccuaagucagggacugucugu

SEQ ID NO: 103099 - RNA, 22 nt, Human
caagggcaaaaagucuacauac

SEQ ID NO: 103100 - RNA, 23 nt, Human
uugcccaggcuggucgugaacuc

SEQ ID NO: 103101 - RNA, 19 nt, Human
cccagcgccccuccucccu

SEQ ID NO: 103102 - RNA, 18 nt, Human
ccaaggcagagacuguga

SEQ ID NO: 103103 - RNA, 19 nt, Human
uuccacccuugccagagcc

SEQ ID NO: 103104 - RNA, 23 nt, Human
gcccaaggaaugaacauguaaua

SEQ ID NO: 103105 - RNA, 21 nt, Human
ccugcccucugucugucuucu

SEQ ID NO: 103106 - RNA, 21 nt, Human
gucuugaauuccugaccucag

SEQ ID NO: 103107 - RNA, 22 nt, Human
accagccuaggugacauaguga

SEQ ID NO: 103108 - RNA, 20 nt, Human
aaaauacacaaauuagcuag

SEQ ID NO: 103109 - RNA, 22 nt, Human
gcaugagccacugugcccaguc

SEQ ID NO: 103110 - RNA, 25 nt, Human
gcgagagcucccagaucaugaggaa

SEQ ID NO: 103111 - RNA, 31 nt, Human
ccugccugccugccugccugagguccccgcu

SEQ ID NO: 103112 - RNA, 26 nt, Human
gcuuucccuccugggcucaagcaguu

SEQ ID NO: 103113 - RNA, 25 nt, Human
uugguuuucugucuagccaggucca

SEQ ID NO: 103114 - RNA, 18 nt, Human
gccaucuccccaguuucc

SEQ ID NO: 103115 - RNA, 22 nt, Human
uggugcaugcauucccauagau

SEQ ID NO: 103116 - RNA, 22 nt, Human
aauuuuauaucuaugcuuucag

SEQ ID NO: 103117 - RNA, 22 nt, Human
aauuccacaagaagcaccaggg

SEQ ID NO: 103118 - RNA, 26 nt, Human
uucuagaggacaacaagugccagggc

SEQ ID NO: 103119 - RNA, 24 nt, Human
cuugcacacauuuuugaagugcgg

SEQ ID NO: 103120 - RNA, 21 nt, Human
cuuccaggaauuaaagacuca

SEQ ID NO: 103121 - RNA, 28 nt, Human
cgcuccuccugggugcuauuugacaauu

SEQ ID NO: 103122 - RNA, 22 nt, Human
ugcacaucuggcugaacuggga

SEQ ID NO: 103123 - RNA, 22 nt, Human
ccagugccccuggaucuugccu

SEQ ID NO: 103124 - RNA, 20 nt, Human
caugaaaagauuucugugga

SEQ ID NO: 103125 - RNA, 25 nt, Human
gggccgccuggaggcaguggcugag

SEQ ID NO: 103126 - RNA, 23 nt, Human
cuguagcugaauccacagaccca

SEQ ID NO: 103127 - RNA, 21 nt, Human
uacuguuuucugggccaguga

SEQ ID NO: 103128 - RNA, 22 nt, Human
aaccccuggccagucgcugggc

SEQ ID NO: 103129 - RNA, 26 nt, Human
aagugaccugaaguuucugugcaaca

SEQ ID NO: 103130 - RNA, 22 nt, Human
aacaauguguuuucuagugugu

SEQ ID NO: 103131 - RNA, 25 nt, Human
agcuggagaaaacauuggguggaga

SEQ ID NO: 103132 - RNA, 20 nt, Human
aauaagaaauguucaggaga

SEQ ID NO: 103133 - RNA, 18 nt, Human
uucuccagauuagccaca

SEQ ID NO: 103134 - RNA, 21 nt, Human
aaauaguugcuucuagugcag

SEQ ID NO: 103135 - RNA, 19 nt, Human
acgcagcccugggggccag

SEQ ID NO: 103136 - RNA, 24 nt, Human
ugcuauuuugugcccacugucucu

SEQ ID NO: 103137 - RNA, 22 nt, Human
ugcauggcuggggacuucucac

SEQ ID NO: 103138 - RNA, 21 nt, Human
acugcgccagccuccccgccc

SEQ ID NO: 103139 - RNA, 24 nt, Human
gcccagcuguugugcugggcacag

SEQ ID NO: 103140 - RNA, 22 nt, Human
guuaguguugaaggugggaaga

SEQ ID NO: 103141 - RNA, 22 nt, Human
acuuaguaaacaagaaaauacu

SEQ ID NO: 103142 - RNA, 22 nt, Human
uguggggucagcacuguacucc

SEQ ID NO: 103143 - RNA, 26 nt, Human
uugggaggcugaggcaggagaauugc

SEQ ID NO: 103144 - RNA, 20 nt, Human
cugcaaccucaauccugggc

SEQ ID NO: 103145 - RNA, 25 nt, Human
uauuaaaauguaugcauguugucua

SEQ ID NO: 103146 - RNA, 22 nt, Human
ugaaaacaucauuuguggagug

SEQ ID NO: 103147 - RNA, 20 nt, Human
ggcaucuccuguccugggcc

SEQ ID NO: 103148 - RNA, 22 nt, Human
gucugcagcaggacauggacaa

SEQ ID NO: 103149 - RNA, 22 nt, Human
ugcagcuucagcaccugcccca

SEQ ID NO: 103150 - RNA, 19 nt, Human
auuuucucaugaucucacc

SEQ ID NO: 103151 - RNA, 20 nt, Human
cugggaggaaaccaggcugg

SEQ ID NO: 103152 - RNA, 21 nt, Human
ccagugcucaccagcccugca

SEQ ID NO: 103153 - RNA, 21 nt, Human
agccucuucucuaaaugcuuc

SEQ ID NO: 103154 - RNA, 24 nt, Human
uucgcaccuugcugugugaccuga

SEQ ID NO: 103155 - RNA, 21 nt, Human
ugaaccaagaucacaccacug

SEQ ID NO: 103156 - RNA, 21 nt, Human
uacucaacagcuuugaaagag

SEQ ID NO: 103157 - RNA, 23 nt, Human
uuaaagcucaucuuaaaguccaa

SEQ ID NO: 103158 - RNA, 21 nt, Human
cugugcaauaugcccccuggg

SEQ ID NO: 103159 - RNA, 24 nt, Human
aaaugauucaguguuucuuuucua

SEQ ID NO: 103160 - RNA, 24 nt, Human
guugcuauuuguauuucucuuguc

SEQ ID NO: 103161 - RNA, 21 nt, Human
ugacuuggaggguaguuuuag

SEQ ID NO: 103162 - RNA, 22 nt, Human
cuuaccuguaauccuagcacuu

SEQ ID NO: 103163 - RNA, 28 nt, Human
aucagccgauaucaacacuuguaucugg

SEQ ID NO: 103164 - RNA, 19 nt, Human
uaguuucuuucaugcuauu

SEQ ID NO: 103165 - RNA, 23 nt, Human
ccccucccacuggagugcgggga

SEQ ID NO: 103166 - RNA, 27 nt, Human
caggcuggagugcaauagcucgaucuc

SEQ ID NO: 103167 - RNA, 21 nt, Human
cuccccucugacccucaggcu

SEQ ID NO: 103168 - RNA, 21 nt, Human
guuuuccugcuuccuaccuca

SEQ ID NO: 103169 - RNA, 24 nt, Human
agaucugaccacuguucuccagca

SEQ ID NO: 103170 - RNA, 22 nt, Human
agccucccaaguagcuggaacu

SEQ ID NO: 103171 - RNA, 22 nt, Human
agccucccaaauagcugggacu

SEQ ID NO: 103172 - RNA, 20 nt, Human
gaaguuguuuggugaaggaa

SEQ ID NO: 103173 - RNA, 21 nt, Human
ucauuugagcccaggaauugg

SEQ ID NO: 103174 - RNA, 21 nt, Human
uggagcagagguugucucuga

SEQ ID NO: 103175 - RNA, 22 nt, Human
uuccacugcuucuuaugguggu

SEQ ID NO: 103176 - RNA, 19 nt, Human
gcgccgccucugugcccag

SEQ ID NO: 103177 - RNA, 17 nt, Human
gaucaaauaaucagaga

SEQ ID NO: 103178 - RNA, 21 nt, Human
uaggggguagaaaggagcagu

SEQ ID NO: 103179 - RNA, 22 nt, Human
aauacaugaucacagaaaugca

SEQ ID NO: 103180 - RNA, 22 nt, Human
cccaaauuuaauuaaagccuua

SEQ ID NO: 103181 - RNA, 21 nt, Human
uggugucauaaacuuucucca

SEQ ID NO: 103182 - RNA, 20 nt, Human
ucugcucccugucuucuguc

SEQ ID NO: 103183 - RNA, 21 nt, Human
gaaacaaacaagauagcuuca

SEQ ID NO: 103184 - RNA, 22 nt, Human
agaaagauaacgacgggaagag

SEQ ID NO: 103185 - RNA, 21 nt, Human
gggaaaggaguagaaaaagca

SEQ ID NO: 103186 - RNA, 22 nt, Human
uccaugaaagaccugaauacca

SEQ ID NO: 103187 - RNA, 25 nt, Human
cccugucgccaggcuggaguguagu

SEQ ID NO: 103188 - RNA, 22 nt, Human
cugcguguccaucaucagcuga

SEQ ID NO: 103189 - RNA, 22 nt, Human
ucccaaaaccagcugcuacccu

SEQ ID NO: 103190 - RNA, 18 nt, Human
ccaugaaggaaaggccaa

SEQ ID NO: 103191 - RNA, 27 nt, Human
acugcuauccuccccuuggaaucuacc

SEQ ID NO: 103192 - RNA, 22 nt, Human
agcugguggaacuuacucuuuc

SEQ ID NO: 103193 - RNA, 27 nt, Human
agguauucucugccacucuugcuguga

SEQ ID NO: 103194 - RNA, 26 nt, Human
guucugcugggaguucuagaaccacu

SEQ ID NO: 103195 - RNA, 22 nt, Human
aaggcccuagaugccucaggga

SEQ ID NO: 103196 - RNA, 23 nt, Human
cuuuccuuucaaauuuuuacuga

SEQ ID NO: 103197 - RNA, 25 nt, Human
accugggcauucagccuccugcucu

SEQ ID NO: 103198 - RNA, 22 nt, Human
ucaugcagagaucccugauccu

SEQ ID NO: 103199 - RNA, 26 nt, Human
ccuucagcagcagcucacacccuacc

SEQ ID NO: 103200 - RNA, 24 nt, Human
guuugugcaaccuucaucugcacu

SEQ ID NO: 103201 - RNA, 24 nt, Human
gccaagugagacacucauccaaga

SEQ ID NO: 103202 - RNA, 24 nt, Human
uacucugaauuucucucccuaccu

SEQ ID NO: 103203 - RNA, 22 nt, Human
augaucauagcucacugcagcc

SEQ ID NO: 103204 - RNA, 22 nt, Human
gcauauaaaauuuucccccuua

SEQ ID NO: 103205 - RNA, 20 nt, Human
ggggggccuggcugggccag

SEQ ID NO: 103206 - RNA, 27 nt, Human
agcuagauuuggucauuccacaaugua

SEQ ID NO: 103207 - RNA, 21 nt, Human
gacuuuucuuuuccucuggau

SEQ ID NO: 103208 - RNA, 21 nt, Human
ccgguggagaagcugagguca

SEQ ID NO: 103209 - RNA, 30 nt, Human
agcuucagugacaaagacuuaaaucucucu

SEQ ID NO: 103210 - RNA, 21 nt, Human
cucuccuaggagcacaggaaa

SEQ ID NO: 103211 - RNA, 27 nt, Human
ccacuguacuccagccugggagauaga

SEQ ID NO: 103212 - RNA, 20 nt, Human
gucagccucuucaauggcgu

SEQ ID NO: 103213 - RNA, 21 nt, Human
agcaaacuaccacaauacagu

SEQ ID NO: 103214 - RNA, 20 nt, Human
cugccccucucugccuguuc

SEQ ID NO: 103215 - RNA, 23 nt, Human
cucuuuuuucucccucuggauca

SEQ ID NO: 103216 - RNA, 20 nt, Human
uuagaaucugaaaaccagaa

SEQ ID NO: 103217 - RNA, 22 nt, Human
gaacuuuggaggcuuggcucgu

SEQ ID NO: 103218 - RNA, 23 nt, Human
ccacccacucuccucugccucag

SEQ ID NO: 103219 - RNA, 26 nt, Human
cgcaucucaaaacagagggcugcauu

SEQ ID NO: 103220 - RNA, 21 nt, Human
agaggaagagaagaaacaugg

SEQ ID NO: 103221 - RNA, 22 nt, Human
aagaucagagggugacugauga

SEQ ID NO: 103222 - RNA, 29 nt, Human
uccauuuagauucaaauggagcuaaaauu

SEQ ID NO: 103223 - RNA, 20 nt, Human
aggguaggaaugagcaaguu

SEQ ID NO: 103224 - RNA, 24 nt, Human
ggguauuguccugccucugccuuu

SEQ ID NO: 103225 - RNA, 24 nt, Human
uggcgaugguggaggugauaggga

SEQ ID NO: 103226 - RNA, 27 nt, Human
uccucauucucuuuuaaaacccgcuuc

SEQ ID NO: 103227 - RNA, 23 nt, Human
caggcgugaguggagcccagucc

SEQ ID NO: 103228 - RNA, 18 nt, Human
uuugacauccaagaacuc

SEQ ID NO: 103229 - RNA, 30 nt, Human
agcuaucaaccacuuaauaacuggcaaagu

SEQ ID NO: 103230 - RNA, 24 nt, Human
ccugccugggccuuggcaagcggc

SEQ ID NO: 103231 - RNA, 18 nt, Human
gcauuuauaagcauuuua

SEQ ID NO: 103232 - RNA, 20 nt, Human
uuugguuuuaaaauacugua

SEQ ID NO: 103233 - RNA, 27 nt, Human
auggaaaggagaaugaacaaauguggg

SEQ ID NO: 103234 - RNA, 27 nt, Human
cccugcacuccgccgccucagagccau

SEQ ID NO: 103235 - RNA, 22 nt, Human
ucacagucauucauccaggcca

SEQ ID NO: 103236 - RNA, 27 nt, Human
uugcccaggguguguuugcugaguguc

SEQ ID NO: 103237 - RNA, 28 nt, Human
guccccuauuaggcaggaguuacaaagu

SEQ ID NO: 103238 - RNA, 20 nt, Human
ucauugccucacucucuauu

SEQ ID NO: 103239 - RNA, 27 nt, Human
cugggaggucaaagcugcagucagcca

SEQ ID NO: 103240 - RNA, 22 nt, Human
ccuguaaucccagcacuuuugg

SEQ ID NO: 103241 - RNA, 26 nt, Human
uugcccaggcuggucuucuggcuucu

SEQ ID NO: 103242 - RNA, 24 nt, Human
gaacagugucugugggcugcugug

SEQ ID NO: 103243 - RNA, 21 nt, Human
ugacuccuggguucuagggua

SEQ ID NO: 103244 - RNA, 21 nt, Human
aguggcuuucagcaaaccuca

SEQ ID NO: 103245 - RNA, 26 nt, Human
ugcuaucuggaggccuuccagcugcu

SEQ ID NO: 103246 - RNA, 18 nt, Human
auugaggccuuucuguga

SEQ ID NO: 103247 - RNA, 26 nt, Human
gcaccaacauguaaccggcauguuuc

SEQ ID NO: 103248 - RNA, 22 nt, Human
agaguguuguuuccaucccacu

SEQ ID NO: 103249 - RNA, 26 nt, Human
cugccugccuuucaccauuuucuccc

SEQ ID NO: 103250 - RNA, 24 nt, Human
cucuagacacugccacacaggguc

SEQ ID NO: 103251 - RNA, 22 nt, Human
gcuagaguugcaacuacagcug

SEQ ID NO: 103252 - RNA, 27 nt, Human
uucagcuuuccugagcugaagugccuu

SEQ ID NO: 103253 - RNA, 28 nt, Human
ugagcuugggcuuaggcuugggcucagc

SEQ ID NO: 103254 - RNA, 24 nt, Human
ggggugagcggcggcagcggccgg

SEQ ID NO: 103255 - RNA, 21 nt, Human
cuucuccucccaagguuugag

SEQ ID NO: 103256 - RNA, 20 nt, Human
gcauccuccuuuccuccucc

SEQ ID NO: 103257 - RNA, 20 nt, Human
uucuaaauguacaaauucuu

SEQ ID NO: 103258 - RNA, 20 nt, Human
aaaaguuggacuaaaugccu

SEQ ID NO: 103259 - RNA, 22 nt, Human
uuccagcaauucuccugccuca

SEQ ID NO: 103260 - RNA, 18 nt, Human
cuggggcaaaggccugaa

SEQ ID NO: 103261 - RNA, 23 nt, Human
gaucuuuuugcagacuagcuaau

SEQ ID NO: 103262 - RNA, 19 nt, Human
ccuucugaaccucuacacc

SEQ ID NO: 103263 - RNA, 22 nt, Human
ucguacuucuuuaauugaucua

SEQ ID NO: 103264 - RNA, 22 nt, Human
gcacauggauucaguuucuaaa

SEQ ID NO: 103265 - RNA, 21 nt, Human
accccuucgaggacacacugc

SEQ ID NO: 103266 - RNA, 21 nt, Human
uuuacauccuugauuacuucc

SEQ ID NO: 103267 - RNA, 24 nt, Human
gcagcugucacacgcuaguauugg

SEQ ID NO: 103268 - RNA, 25 nt, Human
ugcaggugaguuugcaaugagggaa

SEQ ID NO: 103269 - RNA, 25 nt, Human
uuaccuuaaauuaguacagcacuuu

SEQ ID NO: 103270 - RNA, 23 nt, Human
aggugcuuucaucacagcuaaac

SEQ ID NO: 103271 - RNA, 19 nt, Human
cccgucugucuguccuguc

SEQ ID NO: 103272 - RNA, 22 nt, Human
cuacaaccccagccuccugagg

SEQ ID NO: 103273 - RNA, 22 nt, Human
uuccugagcuggccugucugcg

SEQ ID NO: 103274 - RNA, 23 nt, Human
ggaagugcugccuuuucacacca

SEQ ID NO: 103275 - RNA, 16 nt, Human
ucccacugcaaugccu

SEQ ID NO: 103276 - RNA, 23 nt, Human
uuguuucagugaauaugccugua

SEQ ID NO: 103277 - RNA, 22 nt, Human
aggaaaaagagaucgagucaca

SEQ ID NO: 103278 - RNA, 21 nt, Human
uggggccagcaucucccacug

SEQ ID NO: 103279 - RNA, 24 nt, Human
ucuuccucauuuggauuugcuuuc

SEQ ID NO: 103280 - RNA, 19 nt, Human
ccacaggcacaggucccca

SEQ ID NO: 103281 - RNA, 22 nt, Human
ccucuugcuucuccuugcauga

SEQ ID NO: 103282 - RNA, 20 nt, Human
gacuucagaaagguggggca

SEQ ID NO: 103283 - RNA, 24 nt, Human
agcaggggaggcggaaaaauagag

SEQ ID NO: 103284 - RNA, 22 nt, Human
ugcuagugcuuuuauucuaacu

SEQ ID NO: 103285 - RNA, 26 nt, Human
ggaugauucuucaagagacccuucaa

SEQ ID NO: 103286 - RNA, 22 nt, Human
aucaucagaaauuucaccagaa

SEQ ID NO: 103287 - RNA, 22 nt, Human
ccucccuggcccccgccugggc

SEQ ID NO: 103288 - RNA, 24 nt, Human
uggaagagaauauuccuacuugca

SEQ ID NO: 103289 - RNA, 23 nt, Human
gcuaggcugauggggaagggggc

SEQ ID NO: 103290 - RNA, 21 nt, Human
gauggcugacccggcugcggg

SEQ ID NO: 103291 - RNA, 22 nt, Human
uauuucuucucaaaccuccaaa

SEQ ID NO: 103292 - RNA, 19 nt, Human
ccucgcaaccacugcuuug

SEQ ID NO: 103293 - RNA, 24 nt, Human
cuccaucauccugauuagcauguu

SEQ ID NO: 103294 - RNA, 25 nt, Human
aguaaagccucugagaccuuccuga

SEQ ID NO: 103295 - RNA, 20 nt, Human
gcagcaucuuuucuaguuga

SEQ ID NO: 103296 - RNA, 22 nt, Human
cgggaggcggagcuugcagcga

SEQ ID NO: 103297 - RNA, 19 nt, Human
ugauucucccuuuaugaag

SEQ ID NO: 103298 - RNA, 24 nt, Human
ggccagguggagaaagugagggcc

SEQ ID NO: 103299 - RNA, 20 nt, Human
uuuugguauuacacuguauu

SEQ ID NO: 103300 - RNA, 26 nt, Human
cauagaacaugugucuaucugcuuuu

SEQ ID NO: 103301 - RNA, 27 nt, Human
ccugggcagcuucccccugccuuuugc

SEQ ID NO: 103302 - RNA, 22 nt, Human
aggcucaggugucuggaggggg

SEQ ID NO: 103303 - RNA, 27 nt, Human
gccacgccuccauucaccaggccacgc

SEQ ID NO: 103304 - RNA, 23 nt, Human
uccccauucgguguggugcagug

SEQ ID NO: 103305 - RNA, 23 nt, Human
acaggcuugcugcuuccuccucc

SEQ ID NO: 103306 - RNA, 17 nt, Human
ggaggcaccagcgagga

SEQ ID NO: 103307 - RNA, 20 nt, Human
ggggggagggaguggguuga

SEQ ID NO: 103308 - RNA, 25 nt, Human
gcaagggcaaaccauuucaaauggc

SEQ ID NO: 103309 - RNA, 27 nt, Human
uggugcaugccuguaaucccaucaucu

SEQ ID NO: 103310 - RNA, 32 nt, Human
gcagguucuucuuccugaagcugaggcucagg

SEQ ID NO: 103311 - RNA, 21 nt, Human
ggcugagaaaucauccccuga

SEQ ID NO: 103312 - RNA, 22 nt, Human
uguccugccagcaccgagggcu

SEQ ID NO: 103313 - RNA, 25 nt, Human
agaaagggccucucuggcagcagag

SEQ ID NO: 103314 - RNA, 25 nt, Human
uguuugugacaaacucuuugcaaua

SEQ ID NO: 103315 - RNA, 26 nt, Human
cuuugguacaagaacugugaccccca

SEQ ID NO: 103316 - RNA, 21 nt, Human
uuuaaacaaaauuacaucauu

SEQ ID NO: 103317 - RNA, 26 nt, Human
guaccaaagaccugggaaaacuaacc

SEQ ID NO: 103318 - RNA, 24 nt, Human
ucugucaccaggcuggagugcagu

SEQ ID NO: 103319 - RNA, 24 nt, Human
gaugauaacauuaaagacucugaa

SEQ ID NO: 103320 - RNA, 20 nt, Human
gugaacagggaaugggugaa

SEQ ID NO: 103321 - RNA, 21 nt, Human
gggacuguucugucucauguu

SEQ ID NO: 103322 - RNA, 21 nt, Human
cugccucuccgccccugagcc

SEQ ID NO: 103323 - RNA, 24 nt, Human
acagaguucauguuugccgcccuc

SEQ ID NO: 103324 - RNA, 22 nt, Human
ucugccauuguuccaccuccug

SEQ ID NO: 103325 - RNA, 27 nt, Human
uucaguuaucacaugugaaagcuuuug

SEQ ID NO: 103326 - RNA, 20 nt, Human
gcagccuucuuuauuaucua

SEQ ID NO: 103327 - RNA, 27 nt, Human
gggaggcaucaccauugcaaucacuuc

SEQ ID NO: 103328 - RNA, 22 nt, Human
acuuugcuuaaacuacaaacac

SEQ ID NO: 103329 - RNA, 20 nt, Human
ugagccagaaacacacugug

SEQ ID NO: 103330 - RNA, 21 nt, Human
ucucuggguguccgugccagu

SEQ ID NO: 103331 - RNA, 27 nt, Human
agcaguuuuaccgcgaccuccggaggc

SEQ ID NO: 103332 - RNA, 27 nt, Human
guguguggauaccucugucucacgccc

SEQ ID NO: 103333 - RNA, 21 nt, Human
agucacugugcuauccuugug

SEQ ID NO: 103334 - RNA, 26 nt, Human
gcugggcagcagcuuucugcugagga

SEQ ID NO: 103335 - RNA, 27 nt, Human
ugacucaacauggagucucacuggcca

SEQ ID NO: 103336 - RNA, 24 nt, Human
cugagauauuuuucuacagcuuca

SEQ ID NO: 103337 - RNA, 27 nt, Human
ccaucacacuccagccugcucuucccg

SEQ ID NO: 103338 - RNA, 27 nt, Human
ccacugcucuccagccuggggaacaga

SEQ ID NO: 103339 - RNA, 27 nt, Human
uauauuuguaauagugaaaccuguacu

SEQ ID NO: 103340 - RNA, 22 nt, Human
gcagguccuaaauggcauuguu

SEQ ID NO: 103341 - RNA, 27 nt, Human
ccagcagcucucuggagauuuaguucu

SEQ ID NO: 103342 - RNA, 27 nt, Human
cugcaaccuuuuguaccuuucuuuggg

SEQ ID NO: 103343 - RNA, 22 nt, Human
cucucauuccucccacccuccg

SEQ ID NO: 103344 - RNA, 22 nt, Human
guucuucccaaugucauaucca

SEQ ID NO: 103345 - RNA, 27 nt, Human
gcgucuggcgcgaucucugccugcuua

SEQ ID NO: 103346 - RNA, 27 nt, Human
uuaacuugcccuuucaguuuuaucuuu

SEQ ID NO: 103347 - RNA, 22 nt, Human
uaauaagaaauccauucaagag

SEQ ID NO: 103348 - RNA, 21 nt, Human
ucagccaggcuggaggcggca

SEQ ID NO: 103349 - RNA, 26 nt, Human
cugugagcuugcggaagucaguucag

SEQ ID NO: 103350 - RNA, 18 nt, Human
aaagcccauuuguguaca

SEQ ID NO: 103351 - RNA, 29 nt, Human
ucuggcuucucuguugaggauuuugagga

SEQ ID NO: 103352 - RNA, 30 nt, Human
gucauaguguaggcuagaguuaaggcacug

SEQ ID NO: 103353 - RNA, 23 nt, Human
gaccucaugauccacccaccuca

SEQ ID NO: 103354 - RNA, 23 nt, Human
gaccucgugauccacccaccucg

SEQ ID NO: 103355 - RNA, 26 nt, Human
ugcaguaucaugcccugugcaaccuc

SEQ ID NO: 103356 - RNA, 24 nt, Human
uucucucucacucacauuuucuca

SEQ ID NO: 103357 - RNA, 22 nt, Human
ucuccggcucuagcucucucca

SEQ ID NO: 103358 - RNA, 22 nt, Human
ugucugucugcuucacaugucc

SEQ ID NO: 103359 - RNA, 23 nt, Human
ccaugcccagagaaucagggcag

SEQ ID NO: 103360 - RNA, 18 nt, Human
uuuccacugcuguucuuc

SEQ ID NO: 103361 - RNA, 26 nt, Human
caucuaccucuguuuuuaauuuucuu

SEQ ID NO: 103362 - RNA, 27 nt, Human
aagccacauaaacucaagcaagaaaua

SEQ ID NO: 103363 - RNA, 25 nt, Human
cuguggcuccaggaggcccuuggga

SEQ ID NO: 103364 - RNA, 27 nt, Human
ucuuugguggcuuugcauuuuaaaaau

SEQ ID NO: 103365 - RNA, 20 nt, Human
gagguagaugauaagaaaua

SEQ ID NO: 103366 - RNA, 27 nt, Human
gggagagaggaggagagaaguggccag

SEQ ID NO: 103367 - RNA, 26 nt, Human
agcugacucuagaggggaaggcagag

SEQ ID NO: 103368 - RNA, 26 nt, Human
ugggugggugggaugaguacccccuc

SEQ ID NO: 103369 - RNA, 24 nt, Human
agguacugugaggaagagcaggca

SEQ ID NO: 103370 - RNA, 27 nt, Human
gcuaugggaagugccaucaggguggcc

SEQ ID NO: 103371 - RNA, 22 nt, Human
gagagaagagagucagcaacag

SEQ ID NO: 103372 - RNA, 21 nt, Human
ggagacugaaggauugguuua

SEQ ID NO: 103373 - RNA, 26 nt, Human
uuggguacuguacaacuucaagccuc

SEQ ID NO: 103374 - RNA, 26 nt, Human
uagaaaaccuguaagcuuugauguuc

SEQ ID NO: 103375 - RNA, 19 nt, Human
cucuccucggccacucccc

SEQ ID NO: 103376 - RNA, 26 nt, Human
ccauuuuuaaaguagaagaggguuuu

SEQ ID NO: 103377 - RNA, 25 nt, Human
ugcuacuuggagaagagauuuagaa

SEQ ID NO: 103378 - RNA, 27 nt, Human
cuuuauaaucaagacaaguguuuauua

SEQ ID NO: 103379 - RNA, 24 nt, Human
ggauguggggaccaggagaaaguc

SEQ ID NO: 103380 - RNA, 22 nt, Human
gugaucauagcucacuguaacc

SEQ ID NO: 103381 - RNA, 24 nt, Human
auccucuauuaauuacugugugug

SEQ ID NO: 103382 - RNA, 27 nt, Human
agcucuggcaacauugagucaaagcaa

SEQ ID NO: 103383 - RNA, 21 nt, Human
cucccuugacucuggcuccug

SEQ ID NO: 103384 - RNA, 21 nt, Human
agauuucucaguucuucuuua

SEQ ID NO: 103385 - RNA, 21 nt, Human
uugcuuguaaaagagaaauua

SEQ ID NO: 103386 - RNA, 22 nt, Human
cuagaugaugauucuuccugua

SEQ ID NO: 103387 - RNA, 21 nt, Human
agguggcggcgggcagaggug

SEQ ID NO: 103388 - RNA, 22 nt, Human
agccucccaacguacugggauu

SEQ ID NO: 103389 - RNA, 24 nt, Human
gaaucagccuggcagcagcauugu

SEQ ID NO: 103390 - RNA, 23 nt, Human
acgguuauuuugcuucuugcgaa

SEQ ID NO: 103391 - RNA, 26 nt, Human
ccagcagccccagacugcccaaaaac

SEQ ID NO: 103392 - RNA, 21 nt, Human
cccgcccgggcuggaggcgcc

SEQ ID NO: 103393 - RNA, 23 nt, Human
gauuucuggccucccccuggguu

SEQ ID NO: 103394 - RNA, 22 nt, Human
gacacagccacugcggagucca

SEQ ID NO: 103395 - RNA, 21 nt, Human
cggagggacuuucuguuagca

SEQ ID NO: 103396 - RNA, 21 nt, Human
gucacgcuucugaaccaauga

SEQ ID NO: 103397 - RNA, 20 nt, Human
cccaacucccuuccaggguu

SEQ ID NO: 103398 - RNA, 22 nt, Human
ucucccaccucuugcucuucaa

SEQ ID NO: 103399 - RNA, 21 nt, Human
cuccccuccgcuucucauccc

SEQ ID NO: 103400 - RNA, 22 nt, Human
gcguggggaggggguaagggag

SEQ ID NO: 103401 - RNA, 29 nt, Human
cuuauccugucccuccuccagguagagag

SEQ ID NO: 103402 - RNA, 22 nt, Human
ggaggucgaggcaggaggauca

SEQ ID NO: 103403 - RNA, 25 nt, Human
uccauggaugcagaaaugagugaua

SEQ ID NO: 103404 - RNA, 32 nt, Human
cuccauggagccuucagucuccugggaagcug

SEQ ID NO: 103405 - RNA, 27 nt, Human
ucacauuaggcuguugguucaaacuuu

SEQ ID NO: 103406 - RNA, 23 nt, Human
ggcaacuuauugcagugugggag

SEQ ID NO: 103407 - RNA, 22 nt, Human
ggcucccuccccauggggcagc

SEQ ID NO: 103408 - RNA, 25 nt, Human
acucaaucuggaaugcaguggcaca

SEQ ID NO: 103409 - RNA, 25 nt, Human
ccuccucccucccucccgacucaca

SEQ ID NO: 103410 - RNA, 27 nt, Human
ggaggcugaggugggagaauugcuuca

SEQ ID NO: 103411 - RNA, 22 nt, Human
ggcugagagucagaaauaaauc

SEQ ID NO: 103412 - RNA, 21 nt, Human
augauaccuuaauuacacucc

SEQ ID NO: 103413 - RNA, 21 nt, Human
aagcuggguuugcacaucugu

SEQ ID NO: 103414 - RNA, 23 nt, Human
ccucaugugccauuuuguccuca

SEQ ID NO: 103415 - RNA, 27 nt, Human
uuuguuuuuaguaggugauauucauuc

SEQ ID NO: 103416 - RNA, 27 nt, Human
uaacugcaccugaauccuuuguguacu

SEQ ID NO: 103417 - RNA, 22 nt, Human
ggcaggagaaucgcuuaaaccc

SEQ ID NO: 103418 - RNA, 23 nt, Human
ccugcugcacccugcgccuccag

SEQ ID NO: 103419 - RNA, 24 nt, Human
cccuucaguacccucucaugcucc

SEQ ID NO: 103420 - RNA, 22 nt, Human
guugcccaggcuagagugcaau

SEQ ID NO: 103421 - RNA, 22 nt, Human
guugcccaggcuggagugcagu

SEQ ID NO: 103422 - RNA, 22 nt, Human
gucgcccaggcuggaguguagu

SEQ ID NO: 103423 - RNA, 22 nt, Human
guugcccaugcuggagggcagu

SEQ ID NO: 103424 - RNA, 22 nt, Human
ugaauccuggcaagaaagcuug

SEQ ID NO: 103425 - RNA, 25 nt, Human
acucagagagggaagagauucagcc

SEQ ID NO: 103426 - RNA, 22 nt, Human
cagcugccacuccaucuccagc

SEQ ID NO: 103427 - RNA, 22 nt, Human
caugccuguaagcccagcacuu

SEQ ID NO: 103428 - RNA, 22 nt, Human
cauuccuguaaucccagcacuu

SEQ ID NO: 103429 - RNA, 22 nt, Human
caggcuggagugcaguggcucg

SEQ ID NO: 103430 - RNA, 22 nt, Human
gcucaggaagcugaggcuggga

SEQ ID NO: 103431 - RNA, 24 nt, Human
cuugcuuuuaauaacaaagguaca

SEQ ID NO: 103432 - RNA, 21 nt, Human
ucuccugcuguuccaucccag

SEQ ID NO: 103433 - RNA, 23 nt, Human
aaccugcaucuuuagugcuuucu

SEQ ID NO: 103434 - RNA, 26 nt, Human
cacugccuguuccccacugccugugu

SEQ ID NO: 103435 - RNA, 21 nt, Human
gaucuaugccuuucaacuaga

SEQ ID NO: 103436 - RNA, 20 nt, Human
gggacgccacucccugugga

SEQ ID NO: 103437 - RNA, 22 nt, Human
auggcucuccuccauuuugguu

SEQ ID NO: 103438 - RNA, 22 nt, Human
cugucucuuggcuauuuuaacc

SEQ ID NO: 103439 - RNA, 26 nt, Human
uacuaccugaauucuaccugcauuuc

SEQ ID NO: 103440 - RNA, 21 nt, Human
gcgcgcccugcccuggcgcag

SEQ ID NO: 103441 - RNA, 27 nt, Human
gaccagccuggccaacauagcaaaacc

SEQ ID NO: 103442 - RNA, 21 nt, Human
guuuaagcuaugaacugugug

SEQ ID NO: 103443 - RNA, 21 nt, Human
gcccuuuuucuccaguaguac

SEQ ID NO: 103444 - RNA, 22 nt, Human
agacagucauuugcugcugcug

SEQ ID NO: 103445 - RNA, 27 nt, Human
gggcugugcagcccauccugagcucca

SEQ ID NO: 103446 - RNA, 18 nt, Human
uuuagugccaacuucccc

SEQ ID NO: 103447 - RNA, 23 nt, Human
agcaugcgguauuuuaacuuucu

SEQ ID NO: 103448 - RNA, 20 nt, Human
auggcuccgaucuucaucuu

SEQ ID NO: 103449 - RNA, 21 nt, Human
acuuuugucauucagccuggg

SEQ ID NO: 103450 - RNA, 29 nt, Human
gccauucagagacuggagugagauuuggg

SEQ ID NO: 103451 - RNA, 22 nt, Human
uggggugaugcagggaggaggg

SEQ ID NO: 103452 - RNA, 26 nt, Human
ucugucauucaggcuggagugcagug

SEQ ID NO: 103453 - RNA, 22 nt, Human
caaaacuggacagaaacaggaa

SEQ ID NO: 103454 - RNA, 20 nt, Human
ucuuuuaaaauguuuuccua

SEQ ID NO: 103455 - RNA, 23 nt, Human
cccucucucacacaucacauucc

SEQ ID NO: 103456 - RNA, 21 nt, Human
aacauccuuauucagccuuau

SEQ ID NO: 103457 - RNA, 21 nt, Human
cccugucucccuucuuguaca

SEQ ID NO: 103458 - RNA, 24 nt, Human
cccaacauucugcaauggcagcau

SEQ ID NO: 103459 - RNA, 24 nt, Human
gguggaggcccaggaaugggcggg

SEQ ID NO: 103460 - RNA, 23 nt, Human
ccucucaccucugugccucuguc

SEQ ID NO: 103461 - RNA, 23 nt, Human
ugggaugaagaggguagaguggg

SEQ ID NO: 103462 - RNA, 27 nt, Human
cccucuguugacuggucaucuggacca

SEQ ID NO: 103463 - RNA, 26 nt, Human
gacaccuuuucagguuggagugcauu

SEQ ID NO: 103464 - RNA, 23 nt, Human
acugcugcugugauaaccucucc

SEQ ID NO: 103465 - RNA, 21 nt, Human
gagcugccugugccuuuugcc

SEQ ID NO: 103466 - RNA, 22 nt, Human
ggaaaauacuuucagaaguuaa

SEQ ID NO: 103467 - RNA, 24 nt, Human
aagguucagaaaauuaaacuacag

SEQ ID NO: 103468 - RNA, 21 nt, Human
ugccagcucuggcacugcccc

SEQ ID NO: 103469 - RNA, 23 nt, Human
aacaucauuccuuuuuauuuaua

SEQ ID NO: 103470 - RNA, 23 nt, Human
aggcugaggugggcagaucaacu

SEQ ID NO: 103471 - RNA, 20 nt, Human
uucaagaugcuucauucaua

SEQ ID NO: 103472 - RNA, 22 nt, Human
ugcucacaguucuuaccuucaa

SEQ ID NO: 103473 - RNA, 32 nt, Human
ucuguucuguucuguucuccuaauaccaucuc

SEQ ID NO: 103474 - RNA, 24 nt, Human
cccugguauaagaaguacucugaa

SEQ ID NO: 103475 - RNA, 27 nt, Human
ucaucaucuucuuagcagcucaucagc

SEQ ID NO: 103476 - RNA, 24 nt, Human
agggggaaaagacugcuggaagac

SEQ ID NO: 103477 - RNA, 24 nt, Human
aacugugaugugucuucuuuguaa

SEQ ID NO: 103478 - RNA, 22 nt, Human
guagaguuucuguguguacaga

SEQ ID NO: 103479 - RNA, 20 nt, Human
caggccauucaccugccucc

SEQ ID NO: 103480 - RNA, 21 nt, Human
cuccugcgcuccugccgccgg

SEQ ID NO: 103481 - RNA, 25 nt, Human
ucaucagauuggcuucccagauuug

SEQ ID NO: 103482 - RNA, 19 nt, Human
ccaggaguucaaagcugua

SEQ ID NO: 103483 - RNA, 22 nt, Human
agaucacugcaaaccugccuca

SEQ ID NO: 103484 - RNA, 23 nt, Human
gcucacaucaguucaucauggug

SEQ ID NO: 103485 - RNA, 22 nt, Human
gccccagcaaagccauggcuuc

SEQ ID NO: 103486 - RNA, 22 nt, Human
auucggauuuccugcuggacca

SEQ ID NO: 103487 - RNA, 18 nt, Human
guccccaauugagaaugu

SEQ ID NO: 103488 - RNA, 22 nt, Human
caucuggauaucaagguggaaa

SEQ ID NO: 103489 - RNA, 21 nt, Human
uuguccaggcuagagugcagu

SEQ ID NO: 103490 - RNA, 21 nt, Human
uuguccaggcuggagugcaau

SEQ ID NO: 103491 - RNA, 20 nt, Human
guugcccaggcuggucuuga

SEQ ID NO: 103492 - RNA, 31 nt, Human
aggagucucuugucuacaggcagcaucgggg

SEQ ID NO: 103493 - RNA, 27 nt, Human
uggagagaggcgauuggacgaaguccc

SEQ ID NO: 103494 - RNA, 21 nt, Human
ugggcacagucucuuacuccc

SEQ ID NO: 103495 - RNA, 22 nt, Human
uuauuuguuuuggaaucccacu

SEQ ID NO: 103496 - RNA, 22 nt, Human
agcuaauuuuuguauuuuagua

SEQ ID NO: 103497 - RNA, 27 nt, Human
uuuugggccucacccggccaacagcuc

SEQ ID NO: 103498 - RNA, 19 nt, Human
aaaaagagagaauuagcau

SEQ ID NO: 103499 - RNA, 21 nt, Human
acaccuauuaucccagcugcc

SEQ ID NO: 103500 - RNA, 25 nt, Human
cuucuccccuccucuugccucccuc

SEQ ID NO: 103501 - RNA, 19 nt, Human
ccauagugugcaucauguu

SEQ ID NO: 103502 - RNA, 27 nt, Human
ucuccugccucaggcuucugaguagcu

SEQ ID NO: 103503 - RNA, 23 nt, Human
cacugugguauggccauugaaaa

SEQ ID NO: 103504 - RNA, 23 nt, Human
guccuaugugggcuuccuggagc

SEQ ID NO: 103505 - RNA, 25 nt, Human
aagagggaggguacagagccucugc

SEQ ID NO: 103506 - RNA, 21 nt, Human
uccagccuggaugacagagug

SEQ ID NO: 103507 - RNA, 21 nt, Human
ccagcccagccccagcaugag

SEQ ID NO: 103508 - RNA, 20 nt, Human
gcuucuuaugaaaguggcca

SEQ ID NO: 103509 - RNA, 27 nt, Human
ggggaauucacuucucuuccucccuca

SEQ ID NO: 103510 - RNA, 20 nt, Human
gcagcaggaucgacgcccag

SEQ ID NO: 103511 - RNA, 22 nt, Human
ggaacuguagacccguccuguc

SEQ ID NO: 103512 - RNA, 24 nt, Human
cuuggcuuucugugccagccuggc

SEQ ID NO: 103513 - RNA, 27 nt, Human
uucaagaccaaagcagaaaagaaaggc

SEQ ID NO: 103514 - RNA, 20 nt, Human
gacuagaaauauauacagua

SEQ ID NO: 103515 - RNA, 24 nt, Human
uucucaaugugcugcugcuuuccc

SEQ ID NO: 103516 - RNA, 24 nt, Human
gggagacgccuagaagauggaggc

SEQ ID NO: 103517 - RNA, 20 nt, Human
uccagccgccgcgcucccag

SEQ ID NO: 103518 - RNA, 18 nt, Human
ccaaagcaucaauacaac

SEQ ID NO: 103519 - RNA, 21 nt, Human
guucuggucuguugcugccac

SEQ ID NO: 103520 - RNA, 22 nt, Human
uuauucuuuuucucauaaguac

SEQ ID NO: 103521 - RNA, 25 nt, Human
uguguucaaagaugaagaccccuca

SEQ ID NO: 103522 - RNA, 22 nt, Human
ucuuaugagggagauggugacu

SEQ ID NO: 103523 - RNA, 23 nt, Human
cuuugguuugaacacaauucguu

SEQ ID NO: 103524 - RNA, 26 nt, Human
gucuuucuccagcauuuccaguacau

SEQ ID NO: 103525 - RNA, 22 nt, Human
acugcaaccucugccucccagg

SEQ ID NO: 103526 - RNA, 24 nt, Human
agaagguugagaccagcagagacu

SEQ ID NO: 103527 - RNA, 20 nt, Human
uaguuuucugaucuguguua

SEQ ID NO: 103528 - RNA, 20 nt, Human
auuuuguccuuaacauuuac

SEQ ID NO: 103529 - RNA, 24 nt, Human
aacaacaaaaguuuagguucuaau

SEQ ID NO: 103530 - RNA, 21 nt, Human
gagcgggagagggaggagagc

SEQ ID NO: 103531 - RNA, 23 nt, Human
uucaguggucccauuguuaacuc

SEQ ID NO: 103532 - RNA, 21 nt, Human
caauccaagaaggagguuaug

SEQ ID NO: 103533 - RNA, 17 nt, Human
uguggagguggcugguc

SEQ ID NO: 103534 - RNA, 25 nt, Human
gcuagugccugcuaggugcauggcc

SEQ ID NO: 103535 - RNA, 24 nt, Human
uggcgcuccggugaaguaggcgcc

SEQ ID NO: 103536 - RNA, 24 nt, Human
gcuggggcauggcaggcuggguga

SEQ ID NO: 103537 - RNA, 22 nt, Human
cugcaguaauuguaugaucuca

SEQ ID NO: 103538 - RNA, 25 nt, Human
aucaggaugaacccaggacgcuucu

SEQ ID NO: 103539 - RNA, 27 nt, Human
cuuuguuguuuauggaaaagcccagau

SEQ ID NO: 103540 - RNA, 23 nt, Human
gcuggcagagguuucuagggugg

SEQ ID NO: 103541 - RNA, 20 nt, Human
guuuuuaagaagguuaacua

SEQ ID NO: 103542 - RNA, 25 nt, Human
ucugucucccaggcuggaggucagu

SEQ ID NO: 103543 - RNA, 26 nt, Human
agaaccucacugaauccuucacucca

SEQ ID NO: 103544 - RNA, 27 nt, Human
uucucucugccacccacauucccacau

SEQ ID NO: 103545 - RNA, 25 nt, Human
cucuccugcugucacagcugccauc

SEQ ID NO: 103546 - RNA, 20 nt, Human
ucuuugggggcaauguguca

SEQ ID NO: 103547 - RNA, 18 nt, Human
cugcccaggcuggaguac

SEQ ID NO: 103548 - RNA, 30 nt, Human
uugcuugccuacaguucccugcaguaauug

SEQ ID NO: 103549 - RNA, 20 nt, Human
aaaauuuuaaaauuagcugg

SEQ ID NO: 103550 - RNA, 25 nt, Human
ccagucagcagauggucagcagguu

SEQ ID NO: 103551 - RNA, 21 nt, Human
gacaaaagcaguuucucucca

SEQ ID NO: 103552 - RNA, 20 nt, Human
ugauuuuucuuagcaccuua

SEQ ID NO: 103553 - RNA, 21 nt, Human
gcacacacaauggugccugaa

SEQ ID NO: 103554 - RNA, 21 nt, Human
gugcauacaucgucugcgucu

SEQ ID NO: 103555 - RNA, 23 nt, Human
cucuccuccccagguuugaaagg

SEQ ID NO: 103556 - RNA, 22 nt, Human
gcuagcaacaacuuacuaaauc

SEQ ID NO: 103557 - RNA, 20 nt, Human
ccugucacugugaauacuug

SEQ ID NO: 103558 - RNA, 19 nt, Human
cagaagcacaugaugguga

SEQ ID NO: 103559 - RNA, 25 nt, Human
ggucaucugcuccuuuuccaucccc

SEQ ID NO: 103560 - RNA, 26 nt, Human
ccagggcagagagagacuggacuugg

SEQ ID NO: 103561 - RNA, 18 nt, Human
cuuuguauuggcacuuug

SEQ ID NO: 103562 - RNA, 22 nt, Human
uuuugauacaguuauacuuuua

SEQ ID NO: 103563 - RNA, 22 nt, Human
aagcaagagaccagagucccgg

SEQ ID NO: 103564 - RNA, 23 nt, Human
aggggaagcugggguuugcagug

SEQ ID NO: 103565 - RNA, 28 nt, Human
ccuuccccacccccuccugggaagugcc

SEQ ID NO: 103566 - RNA, 21 nt, Human
gcaacaacaaaaugugcucua

SEQ ID NO: 103567 - RNA, 22 nt, Human
ucucccacccagccuggacuug

SEQ ID NO: 103568 - RNA, 22 nt, Human
ccuccuccccacacagacucca

SEQ ID NO: 103569 - RNA, 22 nt, Human
gaacuccugaugucaggugauu

SEQ ID NO: 103570 - RNA, 26 nt, Human
agccugggugacagaacgagacucca

SEQ ID NO: 103571 - RNA, 21 nt, Human
cuugcccaggucuucugcgau

SEQ ID NO: 103572 - RNA, 23 nt, Human
acagagcaguagaaucccaggcu

SEQ ID NO: 103573 - RNA, 21 nt, Human
uuugaggcccaagucaugggg

SEQ ID NO: 103574 - RNA, 18 nt, Human
guauccuuaccuugguca

SEQ ID NO: 103575 - RNA, 27 nt, Human
agcaggaccgcccaggcugcggagggg

SEQ ID NO: 103576 - RNA, 27 nt, Human
ccauagcuguauuaacagauuaugguu

SEQ ID NO: 103577 - RNA, 26 nt, Human
cuccccuaagccgccgccaucaugcu

SEQ ID NO: 103578 - RNA, 27 nt, Human
cauauuccuuuaugaauguguaauggg

SEQ ID NO: 103579 - RNA, 22 nt, Human
uucuagaugccuucucucucca

SEQ ID NO: 103580 - RNA, 26 nt, Human
gcaucccagcaccugccuccucguuc

SEQ ID NO: 103581 - RNA, 23 nt, Human
aacuugucacaccuuuuguuuca

SEQ ID NO: 103582 - RNA, 20 nt, Human
uuuauuuauacagugccuug

SEQ ID NO: 103583 - RNA, 29 nt, Human
accgcaucccaccuccugcccuccauacc

SEQ ID NO: 103584 - RNA, 22 nt, Human
acauggcagaagacaucaugcg

SEQ ID NO: 103585 - RNA, 26 nt, Human
gucagacuuugcugcauuuuacacau

SEQ ID NO: 103586 - RNA, 20 nt, Human
agcagcaucuuuaacacagc

SEQ ID NO: 103587 - RNA, 20 nt, Human
caguucuguaaucuguauua

SEQ ID NO: 103588 - RNA, 26 nt, Human
acccagcuccuggaggcaguggcugu

SEQ ID NO: 103589 - RNA, 27 nt, Human
gucaccuaggcaagagugcaauggcac

SEQ ID NO: 103590 - RNA, 18 nt, Human
ucgcccaggcuggggugc

SEQ ID NO: 103591 - RNA, 22 nt, Human
gcacagccaagccaagcgcuca

SEQ ID NO: 103592 - RNA, 27 nt, Human
aaacuauuaacaacuugucuauuaccu

SEQ ID NO: 103593 - RNA, 22 nt, Human
gguuucugccacuaucaaaguu

SEQ ID NO: 103594 - RNA, 19 nt, Human
ggagcuggacagagcugug

SEQ ID NO: 103595 - RNA, 30 nt, Human
guccaccucucauugcugaucaauuucuca

SEQ ID NO: 103596 - RNA, 22 nt, Human
gcugcccaggacacagugcagg

SEQ ID NO: 103597 - RNA, 23 nt, Human
cgugaucugcuggcccucaggcu

SEQ ID NO: 103598 - RNA, 27 nt, Human
ggaggcugggucugggggugcgugacc

SEQ ID NO: 103599 - RNA, 21 nt, Human
cuuguauauguaucuuccuca

SEQ ID NO: 103600 - RNA, 26 nt, Human
ggcuuccugcaauuuucuaagcaauu

SEQ ID NO: 103601 - RNA, 26 nt, Human
gacucugcucccugaccacacaucgg

SEQ ID NO: 103602 - RNA, 26 nt, Human
ccaaguucuuaaccuguggcacugaa

SEQ ID NO: 103603 - RNA, 27 nt, Human
caggcuggagugcuauggcucgaucuu

SEQ ID NO: 103604 - RNA, 22 nt, Human
gucgcgaacuccugagcucagg

SEQ ID NO: 103605 - RNA, 17 nt, Human
cuaccugcuguuacuua

SEQ ID NO: 103606 - RNA, 23 nt, Human
uacuuccagggcuacgcgcgcuc

SEQ ID NO: 103607 - RNA, 31 nt, Human
gccugcauuucucccaggacuuggggguggg

SEQ ID NO: 103608 - RNA, 21 nt, Human
agaauuaguccucacagccua

SEQ ID NO: 103609 - RNA, 27 nt, Human
ucaauagccacuaaccuugccugguac

SEQ ID NO: 103610 - RNA, 20 nt, Human
cucccucugcucauccaucc

SEQ ID NO: 103611 - RNA, 22 nt, Human
uuuccaagagaucaccccacca

SEQ ID NO: 103612 - RNA, 28 nt, Human
ugagcccaggaagcagagauuccaguga

SEQ ID NO: 103613 - RNA, 21 nt, Human
cucagcucccaaggcucugag

SEQ ID NO: 103614 - RNA, 23 nt, Human
uucugcauguaacauacaauaca

SEQ ID NO: 103615 - RNA, 27 nt, Human
ggacgcuggucgccggccuccuagggc

SEQ ID NO: 103616 - RNA, 24 nt, Human
caguucugaaucaccuaccuucac

SEQ ID NO: 103617 - RNA, 21 nt, Human
cuuccugacguccaucccagc

SEQ ID NO: 103618 - RNA, 23 nt, Human
gagaagcccggagguugcgcugg

SEQ ID NO: 103619 - RNA, 29 nt, Human
cuucucuccugcuuccuccagggaaccca

SEQ ID NO: 103620 - RNA, 26 nt, Human
cuguggcuacuuuaaaucacucugag

SEQ ID NO: 103621 - RNA, 20 nt, Human
aucucucuuauuaauagaga

SEQ ID NO: 103622 - RNA, 22 nt, Human
caauugucacuugaugauauaa

SEQ ID NO: 103623 - RNA, 15 nt, Human
cuucccuucuggccc

SEQ ID NO: 103624 - RNA, 21 nt, Human
ugugucagcuccagccauuuu

SEQ ID NO: 103625 - RNA, 26 nt, Human
acauggucccaccugugcgagacccc

SEQ ID NO: 103626 - RNA, 27 nt, Human
ccgagccggagggaggcgcaucuggcg

SEQ ID NO: 103627 - RNA, 22 nt, Human
aagugcuuggccacagucgcag

SEQ ID NO: 103628 - RNA, 26 nt, Human
augcucuccccucccuuuuuaaacaa

SEQ ID NO: 103629 - RNA, 23 nt, Human
caaggugggggcuucagagggug

SEQ ID NO: 103630 - RNA, 20 nt, Human
gaaaccaagccauuaaugag

SEQ ID NO: 103631 - RNA, 22 nt, Human
uuucaagugauccucccgccuc

SEQ ID NO: 103632 - RNA, 27 nt, Human
gcagagcgcguucagcacugacuuuug

SEQ ID NO: 103633 - RNA, 20 nt, Human
agucucaaaagaccaucuua

SEQ ID NO: 103634 - RNA, 25 nt, Human
caugacguaaaauuuuaugugcuuc

SEQ ID NO: 103635 - RNA, 22 nt, Human
uaaucagccccagagugcuuua

SEQ ID NO: 103636 - RNA, 21 nt, Human
ugggggagcaugaugggcagg

SEQ ID NO: 103637 - RNA, 25 nt, Human
cccugauguuggaaccaaguuuuug

SEQ ID NO: 103638 - RNA, 26 nt, Human
gggacucacguggcuucaacagcuuu

SEQ ID NO: 103639 - RNA, 21 nt, Human
gugauuucuucucccuccucc

SEQ ID NO: 103640 - RNA, 18 nt, Human
uaccaugguugugcacau

SEQ ID NO: 103641 - RNA, 24 nt, Human
ccucauccaugcugugcuguguua

SEQ ID NO: 103642 - RNA, 19 nt, Human
cucuaccccuaacuccagg

SEQ ID NO: 103643 - RNA, 19 nt, Human
gcccacgcuggagugcagu

SEQ ID NO: 103644 - RNA, 23 nt, Human
gcaaaguccagcucagucucagc

SEQ ID NO: 103645 - RNA, 24 nt, Human
uaagggugguaggaacccaggagg

SEQ ID NO: 103646 - RNA, 28 nt, Human
ugcccuucuuccccuucccugacugcag

SEQ ID NO: 103647 - RNA, 22 nt, Human
caaaacuggauaaacuucagaa

SEQ ID NO: 103648 - RNA, 23 nt, Human
acaccuugaguauaaaacuugca

SEQ ID NO: 103649 - RNA, 26 nt, Human
uucucccacuuucuaggaucauuuuu

SEQ ID NO: 103650 - RNA, 17 nt, Human
ugaaacugagaugugaa

SEQ ID NO: 103651 - RNA, 18 nt, Human
cuggggcagaggacuggg

SEQ ID NO: 103652 - RNA, 21 nt, Human
cacgugcuugaugcugagcaa

SEQ ID NO: 103653 - RNA, 23 nt, Human
cucaugcagcugugggugcccgg

SEQ ID NO: 103654 - RNA, 21 nt, Human
uguugccaggggugaggccgu

SEQ ID NO: 103655 - RNA, 20 nt, Human
caacauggccgccacugccu

SEQ ID NO: 103656 - RNA, 27 nt, Human
cagugguuuguauguucucucugucac

SEQ ID NO: 103657 - RNA, 24 nt, Human
ugguuuuuccugcuccugggguaa

SEQ ID NO: 103658 - RNA, 21 nt, Human
ucuuuuaaaaauauuaucuug

SEQ ID NO: 103659 - RNA, 23 nt, Human
gcuguaaagaacaacacuuguuu

SEQ ID NO: 103660 - RNA, 24 nt, Human
augcucuugcuuccucaacuuucc

SEQ ID NO: 103661 - RNA, 21 nt, Human
uauuguccuccaccuccauca

SEQ ID NO: 103662 - RNA, 24 nt, Human
uaggggugauggagggggagaagc

SEQ ID NO: 103663 - RNA, 22 nt, Human
gaccagccuggacaacauagug

SEQ ID NO: 103664 - RNA, 24 nt, Human
gacaccgccacauggcuuccuccu

SEQ ID NO: 103665 - RNA, 22 nt, Human
cugugagguucccagaacugua

SEQ ID NO: 103666 - RNA, 28 nt, Human
agccuggcuuuguaugcuccuggcagca

SEQ ID NO: 103667 - RNA, 23 nt, Human
gacccacaaguauugcccuuuaa

SEQ ID NO: 103668 - RNA, 23 nt, Human
uauuccccuccuaaccuggguuu

SEQ ID NO: 103669 - RNA, 23 nt, Human
guuguuuugcauaacgucugccu

SEQ ID NO: 103670 - RNA, 26 nt, Human
cccugcaaccucggggagugccacuu

SEQ ID NO: 103671 - RNA, 25 nt, Human
guagauguugccuggugcaaagugc

SEQ ID NO: 103672 - RNA, 22 nt, Human
caggcuggagugcagugcugcg

SEQ ID NO: 103673 - RNA, 24 nt, Human
cuggagacgagaauaaacuggacu

SEQ ID NO: 103674 - RNA, 25 nt, Human
cugggagcaaugggguugcagcuga

SEQ ID NO: 103675 - RNA, 22 nt, Human
aagcacuuacccuccacuuccu

SEQ ID NO: 103676 - RNA, 27 nt, Human
guuacccaggguggauugcagcugauc

SEQ ID NO: 103677 - RNA, 22 nt, Human
cagauuucucacuugcucuuca

SEQ ID NO: 103678 - RNA, 27 nt, Human
uucaguuaauaaguauuaaaugcugcc

SEQ ID NO: 103679 - RNA, 21 nt, Human
guuugcugacuugagcauuuu

SEQ ID NO: 103680 - RNA, 22 nt, Human
acgagccgcagccuccuucucu

SEQ ID NO: 103681 - RNA, 23 nt, Human
uccagcuuccagcccuccucccc

SEQ ID NO: 103682 - RNA, 22 nt, Human
gagcucaggugaugccggccac

SEQ ID NO: 103683 - RNA, 26 nt, Human
ccugucccucucaggcaugccugugu

SEQ ID NO: 103684 - RNA, 20 nt, Human
gucgggcuagaggggccaag

SEQ ID NO: 103685 - RNA, 21 nt, Human
gcgugagcaggggggagggag

SEQ ID NO: 103686 - RNA, 22 nt, Human
ugggaugugugaugcaaaugcu

SEQ ID NO: 103687 - RNA, 22 nt, Human
aaccugggcuggagugaggugg

SEQ ID NO: 103688 - RNA, 23 nt, Human
cuacaaaucaaucacagcuugua

SEQ ID NO: 103689 - RNA, 26 nt, Human
cuucaggacuaguuaaccagaggggc

SEQ ID NO: 103690 - RNA, 19 nt, Human
agcuaauuuucugguuugu

SEQ ID NO: 103691 - RNA, 25 nt, Human
gcuaauuuugucaagcacagcugug

SEQ ID NO: 103692 - RNA, 21 nt, Human
gcgaggaagcugcaggaaggg

SEQ ID NO: 103693 - RNA, 22 nt, Human
gccuguaauccaacuacccagg

SEQ ID NO: 103694 - RNA, 23 nt, Human
ucucaaggagcuuuaaagucuua

SEQ ID NO: 103695 - RNA, 24 nt, Human
augcuagaauucuuugaagcagug

SEQ ID NO: 103696 - RNA, 26 nt, Human
ucucacugugcuguggucuguccuca

SEQ ID NO: 103697 - RNA, 22 nt, Human
ugcacacaaucuagcaggaauc

SEQ ID NO: 103698 - RNA, 26 nt, Human
agcucucuccacaaccucuugggccc

SEQ ID NO: 103699 - RNA, 27 nt, Human
aaggcauuuucaucuuuccuucggguu

SEQ ID NO: 103700 - RNA, 22 nt, Human
ucuccaccuacaccccugugcu

SEQ ID NO: 103701 - RNA, 23 nt, Human
ccuguucugggcauuucauguca

SEQ ID NO: 103702 - RNA, 23 nt, Human
cuuuuuuaaaaaugcaaauccua

SEQ ID NO: 103703 - RNA, 22 nt, Human
uauuuuguauaaagaacaaaua

SEQ ID NO: 103704 - RNA, 22 nt, Human
aucacuugaacccaggaggcag

SEQ ID NO: 103705 - RNA, 20 nt, Human
auuauuuucaccuguuuuua

SEQ ID NO: 103706 - RNA, 28 nt, Human
gccacugcaccuggcggggucuugcuua

SEQ ID NO: 103707 - RNA, 27 nt, Human
ggaaggcaaaggcugauuuguuugcug

SEQ ID NO: 103708 - RNA, 22 nt, Human
ucccgggucucaggccuccagc

SEQ ID NO: 103709 - RNA, 22 nt, Human
aggaaccugcuuuaguggggga

SEQ ID NO: 103710 - RNA, 19 nt, Human
uccugugucacaccaccuu

SEQ ID NO: 103711 - RNA, 25 nt, Human
ugcuccagccucugccgcugccaug

SEQ ID NO: 103712 - RNA, 24 nt, Human
gggcugugaugugaagacaccugc

SEQ ID NO: 103713 - RNA, 22 nt, Human
gcuguccuuuguuuuacaggua

SEQ ID NO: 103714 - RNA, 22 nt, Human
cucagucucccaaguagcaggg

SEQ ID NO: 103715 - RNA, 23 nt, Human
ccuggcuaauuuuuuaaaaauau

SEQ ID NO: 103716 - RNA, 25 nt, Human
ugagcagcgccagcccagcucuccc

SEQ ID NO: 103717 - RNA, 24 nt, Human
ucuaugccaauuuugaaaaaacua

SEQ ID NO: 103718 - RNA, 23 nt, Human
uaaacacuccuucuuagcacuuc

SEQ ID NO: 103719 - RNA, 22 nt, Human
auggaaagacucuuaaugcaga

SEQ ID NO: 103720 - RNA, 25 nt, Human
gggagcuggaguccagccaggcucc

SEQ ID NO: 103721 - RNA, 22 nt, Human
uugcauugagcuacugggggua

SEQ ID NO: 103722 - RNA, 22 nt, Human
agugggugggaagacuagugaa

SEQ ID NO: 103723 - RNA, 21 nt, Human
guuggcagacuggagugcaau

SEQ ID NO: 103724 - RNA, 23 nt, Human
ggccucgcccagccugcgcugga

SEQ ID NO: 103725 - RNA, 22 nt, Human
uuaagcccugcaggcuucugcc

SEQ ID NO: 103726 - RNA, 22 nt, Human
ggcauggaagaaagacuggaaa

SEQ ID NO: 103727 - RNA, 23 nt, Human
uuuuacacagagaaauacaaaau

SEQ ID NO: 103728 - RNA, 23 nt, Human
gcccagcacuccugggucucggg

SEQ ID NO: 103729 - RNA, 22 nt, Human
gcucagccaagaaacuuucccg

SEQ ID NO: 103730 - RNA, 24 nt, Human
uuucaauucuggaauaucuguguc

SEQ ID NO: 103731 - RNA, 20 nt, Human
gaagagcccaccuguggaag

SEQ ID NO: 103732 - RNA, 21 nt, Human
ccccugcccccgcaccaacca

SEQ ID NO: 103733 - RNA, 19 nt, Human
ucacugcccucucccugcc

SEQ ID NO: 103734 - RNA, 23 nt, Human
gaaagacucuucacuccaaaaag

SEQ ID NO: 103735 - RNA, 27 nt, Human
cucaaaccagugacaccacaggaaaga

SEQ ID NO: 103736 - RNA, 23 nt, Human
gauuucccuucuucugucaucua

SEQ ID NO: 103737 - RNA, 26 nt, Human
ccucuucuccccaggaccccagggcc

SEQ ID NO: 103738 - RNA, 22 nt, Human
ugaaccccuggccucaagcaau

SEQ ID NO: 103739 - RNA, 20 nt, Human
agaaaaauguggaggcucca

SEQ ID NO: 103740 - RNA, 22 nt, Human
cgaauuccuggacucaagcagu

SEQ ID NO: 103741 - RNA, 27 nt, Human
gugggggagggagggacagagacccag

SEQ ID NO: 103742 - RNA, 24 nt, Human
ccuggauucugcugccacgugcca

SEQ ID NO: 103743 - RNA, 27 nt, Human
aggcuuagggacaggaccccagcucug

SEQ ID NO: 103744 - RNA, 26 nt, Human
gagaacaaacaccuccccagccccca

SEQ ID NO: 103745 - RNA, 21 nt, Human
gguggccugacacugugccag

SEQ ID NO: 103746 - RNA, 26 nt, Human
cauggacugaaacuucacacaugugg

SEQ ID NO: 103747 - RNA, 20 nt, Human
ucugacauaacaguguucac

SEQ ID NO: 103748 - RNA, 22 nt, Human
ccaacguggugaaaccccaucu

SEQ ID NO: 103749 - RNA, 20 nt, Human
acuguucuuguauuucucau

SEQ ID NO: 103750 - RNA, 23 nt, Human
cagggugcgagaugccagcucug

SEQ ID NO: 103751 - RNA, 18 nt, Human
cuuuuuaaaaagcaccua

SEQ ID NO: 103752 - RNA, 26 nt, Human
gagagggaguaggagagaagaaacau

SEQ ID NO: 103753 - RNA, 27 nt, Human
ccauucuuaaccaaggcugccucuucc

SEQ ID NO: 103754 - RNA, 27 nt, Human
uggcucacaucuguaaucccagcacuu

SEQ ID NO: 103755 - RNA, 24 nt, Human
uaccuaacuugaacauuagaggga

SEQ ID NO: 103756 - RNA, 23 nt, Human
ccucuacugcgaggccuggggag

SEQ ID NO: 103757 - RNA, 26 nt, Human
gccccucggagcuagggagugugugc

SEQ ID NO: 103758 - RNA, 22 nt, Human
agugugcuaaaaaugagcuuga

SEQ ID NO: 103759 - RNA, 22 nt, Human
acgaguagcuggaauuacaggc

SEQ ID NO: 103760 - RNA, 22 nt, Human
uggucucaaucuccugaccuca

SEQ ID NO: 103761 - RNA, 26 nt, Human
ccuccucaccagcuagucugggguuu

SEQ ID NO: 103762 - RNA, 21 nt, Human
cugaccaccuuuguuucuccc

SEQ ID NO: 103763 - RNA, 26 nt, Human
aggcauucuguuauugucuuggauug

SEQ ID NO: 103764 - RNA, 20 nt, Human
gguggacaggaugguucggc

SEQ ID NO: 103765 - RNA, 20 nt, Human
cccuuuuccaaccuaccuca

SEQ ID NO: 103766 - RNA, 20 nt, Human
cugcccuugucucugaggcu

SEQ ID NO: 103767 - RNA, 24 nt, Human
cugcuguuccuagacugagcauug

SEQ ID NO: 103768 - RNA, 24 nt, Human
agcacacacuguuccagcccaucu

SEQ ID NO: 103769 - RNA, 22 nt, Human
ucugucacccaggcuggacugc

SEQ ID NO: 103770 - RNA, 20 nt, Human
guuuguugagcuacauucuu

SEQ ID NO: 103771 - RNA, 21 nt, Human
ccugugcugccccgacucaca

SEQ ID NO: 103772 - RNA, 22 nt, Human
caacauagugaaacuccgucuc

SEQ ID NO: 103773 - RNA, 23 nt, Human
gagcaaggugggucugggaggua

SEQ ID NO: 103774 - RNA, 23 nt, Human
gucucccacccucacugaucacg

SEQ ID NO: 103775 - RNA, 21 nt, Human
acauccagagucugcagucca

SEQ ID NO: 103776 - RNA, 22 nt, Human
cuacacacuuuaucauccacuc

SEQ ID NO: 103777 - RNA, 21 nt, Human
ccucucuugggucuguguccu

SEQ ID NO: 103778 - RNA, 22 nt, Human
aucacuugaaccuaggaggcgg

SEQ ID NO: 103779 - RNA, 25 nt, Human
guaggguggaggggagagaagaaga

SEQ ID NO: 103780 - RNA, 22 nt, Human
ccccagugcccuugaccaggaa

SEQ ID NO: 103781 - RNA, 28 nt, Human
gcgucccuccaggccuugccuccugcgg

SEQ ID NO: 103782 - RNA, 19 nt, Human
ggagcugggcuucucucca

SEQ ID NO: 103783 - RNA, 19 nt, Human
gaggacagggcauuguccu

SEQ ID NO: 103784 - RNA, 20 nt, Human
guugcccaggcuggucucga

SEQ ID NO: 103785 - RNA, 23 nt, Human
ggugaaauagaauucuaaccucg

SEQ ID NO: 103786 - RNA, 29 nt, Human
uggcuaacuagguugagaaaccggcgcca

SEQ ID NO: 103787 - RNA, 19 nt, Human
guaaaaucaguaaugugau

SEQ ID NO: 103788 - RNA, 21 nt, Human
cacgcuaccccgucccccucc

SEQ ID NO: 103789 - RNA, 26 nt, Human
gagcuacagccucuuuccuaacuucc

SEQ ID NO: 103790 - RNA, 21 nt, Human
aucuggaggaggaggaaaaag

SEQ ID NO: 103791 - RNA, 22 nt, Human
aaacucuggggcucaagcaguu

SEQ ID NO: 103792 - RNA, 22 nt, Human
cuguggagaaaaauggugaaga

SEQ ID NO: 103793 - RNA, 21 nt, Human
ccaggauaugcuaaaggacga

SEQ ID NO: 103794 - RNA, 19 nt, Human
aguuaggguuuaggcauca

SEQ ID NO: 103795 - RNA, 25 nt, Human
ucccacuggaggcaugugaugagag

SEQ ID NO: 103796 - RNA, 22 nt, Human
ccaggauaggugaaaggguuaa

SEQ ID NO: 103797 - RNA, 26 nt, Human
gaggcccaguaagacacucauguggc

SEQ ID NO: 103798 - RNA, 26 nt, Human
ggucaguuucaguugauaccuccuca

SEQ ID NO: 103799 - RNA, 19 nt, Human
acacggaaccccaaagcaa

SEQ ID NO: 103800 - RNA, 22 nt, Human
uucuuagcugucaccugccgag

SEQ ID NO: 103801 - RNA, 28 nt, Human
ccgucugcgcuccagccuucgccuggca

SEQ ID NO: 103802 - RNA, 26 nt, Human
cuccgacugugccugcuugcaccagc

SEQ ID NO: 103803 - RNA, 24 nt, Human
aggaggaagaagcggaggaggcgg

SEQ ID NO: 103804 - RNA, 22 nt, Human
agaauagaagcuaagguuuaga

SEQ ID NO: 103805 - RNA, 20 nt, Human
uucucucuccagggugcuua

SEQ ID NO: 103806 - RNA, 22 nt, Human
uuaguagucuucaauauaacca

SEQ ID NO: 103807 - RNA, 17 nt, Human
cuauccucugcuuugcc

SEQ ID NO: 103808 - RNA, 19 nt, Human
ggugcucuccuuuugggcu

SEQ ID NO: 103809 - RNA, 23 nt, Human
guguguaguuguuuggagcacac

SEQ ID NO: 103810 - RNA, 23 nt, Human
ccccagccaggcuacagggaucg

SEQ ID NO: 103811 - RNA, 24 nt, Human
uaccucucccugcuccuggugccu

SEQ ID NO: 103812 - RNA, 29 nt, Human
aacaguggaaaaugcaaagugugugcaag

SEQ ID NO: 103813 - RNA, 21 nt, Human
ggcuuauccuggcaauggggu

SEQ ID NO: 103814 - RNA, 25 nt, Human
gggagauuauauccccaacuccagg

SEQ ID NO: 103815 - RNA, 18 nt, Human
ccauuuugcugccacaaa

SEQ ID NO: 103816 - RNA, 21 nt, Human
caggcugggcagaggucagga

SEQ ID NO: 103817 - RNA, 21 nt, Human
ccccuucccucccagaguaac

SEQ ID NO: 103818 - RNA, 21 nt, Human
guggguggagaguggagugug

SEQ ID NO: 103819 - RNA, 26 nt, Human
cccugcacuccaccuggggacggccc

SEQ ID NO: 103820 - RNA, 22 nt, Human
cgggacugaaggaaggccaagc

SEQ ID NO: 103821 - RNA, 26 nt, Human
cuuccgucuuacccacuucuuccuca

SEQ ID NO: 103822 - RNA, 22 nt, Human
uucaaucgauucuccugccuca

SEQ ID NO: 103823 - RNA, 23 nt, Human
ccucagaaaguguauaauaagaa

SEQ ID NO: 103824 - RNA, 27 nt, Human
ugggcaacauggcaaaacccugucucu

SEQ ID NO: 103825 - RNA, 20 nt, Human
cuggagcaugggcagaggag

SEQ ID NO: 103826 - RNA, 27 nt, Human
acacagccuucggcugccccccacuaa

SEQ ID NO: 103827 - RNA, 20 nt, Human
cguuggugccaucagugauu

SEQ ID NO: 103828 - RNA, 24 nt, Human
cuuugcagggaucugcagacuccu

SEQ ID NO: 103829 - RNA, 21 nt, Human
aagccuuaccacucucugcuu

SEQ ID NO: 103830 - RNA, 27 nt, Human
ugcacacauguagcccaucaggacagc

SEQ ID NO: 103831 - RNA, 21 nt, Human
aggagagucuggccugggcaa

SEQ ID NO: 103832 - RNA, 23 nt, Human
ggccucgggucgccggggccggg

SEQ ID NO: 103833 - RNA, 22 nt, Human
gaacuccugacaucaggugauc

SEQ ID NO: 103834 - RNA, 22 nt, Human
aaacuccuggccucaugugauc

SEQ ID NO: 103835 - RNA, 23 nt, Human
guuggggcucugcaggaugagga

SEQ ID NO: 103836 - RNA, 26 nt, Human
gggacuuuuuuauuuuuauuuuuugc

SEQ ID NO: 103837 - RNA, 27 nt, Human
ggcccaggaggagccucaggagccgga

SEQ ID NO: 103838 - RNA, 23 nt, Human
agcauuuucauagugugcucauu

SEQ ID NO: 103839 - RNA, 23 nt, Human
gccaccccaccagaagugccccu

SEQ ID NO: 103840 - RNA, 24 nt, Human
gcuggaagcacugaaccuaccuca

SEQ ID NO: 103841 - RNA, 24 nt, Human
uuaacuugccacaucccagucaca

SEQ ID NO: 103842 - RNA, 27 nt, Human
gcuuucuagggucagaaucguggagag

SEQ ID NO: 103843 - RNA, 25 nt, Human
ccuccucugcucuugaucuguguuu

SEQ ID NO: 103844 - RNA, 24 nt, Human
agcucuggccuagggaccuugccg

SEQ ID NO: 103845 - RNA, 22 nt, Human
ucagccuggcuucaaauuguaa

SEQ ID NO: 103846 - RNA, 23 nt, Human
cugguguaauuacuucaagccuc

SEQ ID NO: 103847 - RNA, 21 nt, Human
ggaugaaguaaggugccugaa

SEQ ID NO: 103848 - RNA, 24 nt, Human
uauugauuucugccuuccuugcua

SEQ ID NO: 103849 - RNA, 18 nt, Human
gcuuuucugaguaccaug

SEQ ID NO: 103850 - RNA, 27 nt, Human
accucaaguucuaugaagcaggccuag

SEQ ID NO: 103851 - RNA, 25 nt, Human
agcuacucagggacuucucuugccu

SEQ ID NO: 103852 - RNA, 25 nt, Human
aggcuacaaccacuagcacggcuga

SEQ ID NO: 103853 - RNA, 20 nt, Human
caacgugcugcuuacacucc

SEQ ID NO: 103854 - RNA, 23 nt, Human
uucucuguuaauuccuggaacug

SEQ ID NO: 103855 - RNA, 22 nt, Human
ccaaaacaagcccuuccuggcu

SEQ ID NO: 103856 - RNA, 21 nt, Human
gcaagggaacaacaggggcuc

SEQ ID NO: 103857 - RNA, 21 nt, Human
cucacacaggaaacuucccua

SEQ ID NO: 103858 - RNA, 27 nt, Human
accgugucauuaaaagcagauccugcg

SEQ ID NO: 103859 - RNA, 20 nt, Human
aaaacauccuucucagugaa

SEQ ID NO: 103860 - RNA, 24 nt, Human
aaagcuacagcuccaggagcccag

SEQ ID NO: 103861 - RNA, 26 nt, Human
uucucucucccucuggcaugcaugcu

SEQ ID NO: 103862 - RNA, 21 nt, Human
ggaguuggagcuggguauugu

SEQ ID NO: 103863 - RNA, 20 nt, Human
cccaggcugaagugcaguga

SEQ ID NO: 103864 - RNA, 19 nt, Human
ccugcuguuugcuuuuggu

SEQ ID NO: 103865 - RNA, 23 nt, Human
ugccaagugccauaaccaugagc

SEQ ID NO: 103866 - RNA, 28 nt, Human
gguuuauuuauucuuuaacugucuguuu

SEQ ID NO: 103867 - RNA, 20 nt, Human
gacuucucuuuagucagggc

SEQ ID NO: 103868 - RNA, 22 nt, Human
ggcuguggacgucuuuggaauu

SEQ ID NO: 103869 - RNA, 25 nt, Human
ggugagccugccuuuccuaucuuca

SEQ ID NO: 103870 - RNA, 24 nt, Human
uccugugucuguguauauuacaag

SEQ ID NO: 103871 - RNA, 23 nt, Human
ccagggcagagagagacuggacu

SEQ ID NO: 103872 - RNA, 22 nt, Human
gagcaagaccuugucucaaaaa

SEQ ID NO: 103873 - RNA, 19 nt, Human
gaagaauuggaguuggaag

SEQ ID NO: 103874 - RNA, 22 nt, Human
ugggacgcaguugggagugcaa

SEQ ID NO: 103875 - RNA, 22 nt, Human
acccaggcuggaguggaguggc

SEQ ID NO: 103876 - RNA, 27 nt, Human
ugccucccuccuccagcuguaaccaug

SEQ ID NO: 103877 - RNA, 25 nt, Human
gcccaagcuggagugcaauggcgcg

SEQ ID NO: 103878 - RNA, 22 nt, Human
ggaauccugcacggugccaccu

SEQ ID NO: 103879 - RNA, 19 nt, Human
uauaucuuucaucuguaaa

SEQ ID NO: 103880 - RNA, 20 nt, Human
ccacagcuggccuggaacug

SEQ ID NO: 103881 - RNA, 19 nt, Human
uuuucucacagcagaggaa

SEQ ID NO: 103882 - RNA, 20 nt, Human
auaauuccuuauagccaaua

SEQ ID NO: 103883 - RNA, 20 nt, Human
aaaaccagagacauugccag

SEQ ID NO: 103884 - RNA, 21 nt, Human
cucauuucucaggagaacuua

SEQ ID NO: 103885 - RNA, 23 nt, Human
gugcuaaguugucuuacacuucu

SEQ ID NO: 103886 - RNA, 23 nt, Human
gacauucccaaaaccaaaggaca

SEQ ID NO: 103887 - RNA, 19 nt, Human
ccagcaauaccccacuuca

SEQ ID NO: 103888 - RNA, 21 nt, Human
uggaaauguaacuuucacuga

SEQ ID NO: 103889 - RNA, 25 nt, Human
gggaagcugugccugucuggcucug

SEQ ID NO: 103890 - RNA, 22 nt, Human
acccaggcugcaguucacuggu

SEQ ID NO: 103891 - RNA, 23 nt, Human
agcuuaaucuccucuucucucca

SEQ ID NO: 103892 - RNA, 22 nt, Human
uccuccccccuccucugaaaca

SEQ ID NO: 103893 - RNA, 20 nt, Human
gccuuccugccucuacucca

SEQ ID NO: 103894 - RNA, 25 nt, Human
cuggagcaagguggagggugcagag

SEQ ID NO: 103895 - RNA, 23 nt, Human
gcuggguuuuugggaagggugug

SEQ ID NO: 103896 - RNA, 22 nt, Human
aauuuggguucugccugccagc

SEQ ID NO: 103897 - RNA, 22 nt, Human
ucuucucuuuuuacuuuuugcc

SEQ ID NO: 103898 - RNA, 25 nt, Human
caacagaccugucuucacccuuggg

SEQ ID NO: 103899 - RNA, 20 nt, Human
ggcggcacagagggagacag

SEQ ID NO: 103900 - RNA, 24 nt, Human
ggccgucucucccacccgcagcag

SEQ ID NO: 103901 - RNA, 18 nt, Human
cagaaaacauguuucccu

SEQ ID NO: 103902 - RNA, 26 nt, Human
gaggaugguucucucuggucauagcc

SEQ ID NO: 103903 - RNA, 19 nt, Human
gcauuuccuggggccaggu

SEQ ID NO: 103904 - RNA, 21 nt, Human
uuguaaaauaaaaaacugcua

SEQ ID NO: 103905 - RNA, 23 nt, Human
acaugugugccucucacagcagu

SEQ ID NO: 103906 - RNA, 20 nt, Human
aacguuaguggacacuugua

SEQ ID NO: 103907 - RNA, 26 nt, Human
uguguagugucagcaaaugcauguua

SEQ ID NO: 103908 - RNA, 24 nt, Human
uugacuggacugcuuggggugggg

SEQ ID NO: 103909 - RNA, 22 nt, Human
cauaccugugaccacucuuggg

SEQ ID NO: 103910 - RNA, 27 nt, Human
gucaccuaggggaaaugcaaaaaccug

SEQ ID NO: 103911 - RNA, 24 nt, Human
uuagguucccaaaccuucaggaaa

SEQ ID NO: 103912 - RNA, 24 nt, Human
aaugccagagauuugggguugggg

SEQ ID NO: 103913 - RNA, 27 nt, Human
agaaaacaaaaugcuggaguuucucua

SEQ ID NO: 103914 - RNA, 22 nt, Human
aggaagagagcacuguauggua

SEQ ID NO: 103915 - RNA, 25 nt, Human
guguagccacaccaggauagagacu

SEQ ID NO: 103916 - RNA, 22 nt, Human
guggaguugguggauggguggg

SEQ ID NO: 103917 - RNA, 22 nt, Human
aaaugaacacuuucugcuuucc

SEQ ID NO: 103918 - RNA, 21 nt, Human
agugaaugacguugcaggguc

SEQ ID NO: 103919 - RNA, 27 nt, Human
cacugccgcuccagccuuccuggcagg

SEQ ID NO: 103920 - RNA, 22 nt, Human
ggcucugcuuccucagcccuag

SEQ ID NO: 103921 - RNA, 22 nt, Human
aaauucuauuuaguagcaugca

SEQ ID NO: 103922 - RNA, 22 nt, Human
cgcaccaccuccugcugccuuc

SEQ ID NO: 103923 - RNA, 26 nt, Human
cacuccucgggcuggcucuccugagg

SEQ ID NO: 103924 - RNA, 21 nt, Human
aagaauugggggugggggaga

SEQ ID NO: 103925 - RNA, 22 nt, Human
cuuacugugcgcgugugugugc

SEQ ID NO: 103926 - RNA, 19 nt, Human
uauugcuuuguagcuuuga

SEQ ID NO: 103927 - RNA, 21 nt, Human
ccuuuaaaaaccuacuucccc

SEQ ID NO: 103928 - RNA, 17 nt, Human
gaggaaggaggggaagc

SEQ ID NO: 103929 - RNA, 19 nt, Human
ucugaagugguucagucua

SEQ ID NO: 103930 - RNA, 23 nt, Human
aucgugcuacugcacuccagccu

SEQ ID NO: 103931 - RNA, 26 nt, Human
accagccuggccgggacccggcugug

SEQ ID NO: 103932 - RNA, 21 nt, Human
uggcucaugccuuaaucccag

SEQ ID NO: 103933 - RNA, 32 nt, Human
uccuggccuaaauuccccuuggaggacaggga

SEQ ID NO: 103934 - RNA, 23 nt, Human
aacgggguuucaccauguuggcc

SEQ ID NO: 103935 - RNA, 24 nt, Human
augcacuacuuauuucgaauuacu

SEQ ID NO: 103936 - RNA, 22 nt, Human
ggcucacugcauccuccgccuc

SEQ ID NO: 103937 - RNA, 18 nt, Human
auuuuauaaauguauuua

SEQ ID NO: 103938 - RNA, 22 nt, Human
cuaucauuacucgaugcuguug

SEQ ID NO: 103939 - RNA, 17 nt, Human
agcgcgcucagcccagc

SEQ ID NO: 103940 - RNA, 22 nt, Human
cccacaggccaucagcagcuag

SEQ ID NO: 103941 - RNA, 22 nt, Human
caucaucugcuauuucugccac

SEQ ID NO: 103942 - RNA, 21 nt, Human
gccucucccucucccccagcu

SEQ ID NO: 103943 - RNA, 27 nt, Human
ccuugcaggaaaccagucucagugucc

SEQ ID NO: 103944 - RNA, 22 nt, Human
ggaugagaggcgaaagccacuu

SEQ ID NO: 103945 - RNA, 21 nt, Human
agaaguacauggaggccaggc

SEQ ID NO: 103946 - RNA, 22 nt, Human
aagaagccuggagcagccucuc

SEQ ID NO: 103947 - RNA, 25 nt, Human
acccagucuggagugcaguggugug

SEQ ID NO: 103948 - RNA, 26 nt, Human
gcucacugcuuagaaaggccgcaucc

SEQ ID NO: 103949 - RNA, 23 nt, Human
agcuuuugccugcacucuugccu

SEQ ID NO: 103950 - RNA, 22 nt, Human
ucaugcauaauuuuaagagaca

SEQ ID NO: 103951 - RNA, 27 nt, Human
ccugggcaacagagcgagacuccgucu

SEQ ID NO: 103952 - RNA, 27 nt, Human
ccugggcaacagagcaagacuccaucu

SEQ ID NO: 103953 - RNA, 27 nt, Human
ccugggcaacagagugagacucugucu

SEQ ID NO: 103954 - RNA, 23 nt, Human
ccaaccagcaaccagaaauguuc

SEQ ID NO: 103955 - RNA, 17 nt, Human
cuucccuugacuggguu

SEQ ID NO: 103956 - RNA, 27 nt, Human
ugccuguagagccagccuugguuggac

SEQ ID NO: 103957 - RNA, 26 nt, Human
ccuuucucucuccccggacagcauga

SEQ ID NO: 103958 - RNA, 25 nt, Human
ugggaccccaaaccccacacugcgc

SEQ ID NO: 103959 - RNA, 21 nt, Human
ccugucuccuccccaccuccc

SEQ ID NO: 103960 - RNA, 22 nt, Human
aguaggaguuaucuccucucug

SEQ ID NO: 103961 - RNA, 21 nt, Human
uguggaggagcagcugagaca

SEQ ID NO: 103962 - RNA, 31 nt, Human
cacucccggcacuccaugcuuagucacugcc

SEQ ID NO: 103963 - RNA, 20 nt, Human
cgggaagggaaggcagccug

SEQ ID NO: 103964 - RNA, 21 nt, Human
caauucuuggcacaggcauua

SEQ ID NO: 103965 - RNA, 25 nt, Human
ggauccugauuuaguaucaagaacc

SEQ ID NO: 103966 - RNA, 21 nt, Human
cuaugauugagaaaaguucau

SEQ ID NO: 103967 - RNA, 20 nt, Human
gguccagguuaucagcucuu

SEQ ID NO: 103968 - RNA, 23 nt, Human
ccguaucucccuggagaagcacc

SEQ ID NO: 103969 - RNA, 27 nt, Human
ugaaucccaucaggcuguuauuaugaa

SEQ ID NO: 103970 - RNA, 21 nt, Human
ggcaggacuccagaugaggac

SEQ ID NO: 103971 - RNA, 26 nt, Human
cgcgcaggcugggcugcaggcucucg

SEQ ID NO: 103972 - RNA, 19 nt, Human
ccagauccuggagacagug

SEQ ID NO: 103973 - RNA, 22 nt, Human
cucuccucugaaacccuccucc

SEQ ID NO: 103974 - RNA, 23 nt, Human
cuuuuuagagugcacugagugca

SEQ ID NO: 103975 - RNA, 20 nt, Human
aggggcaucuuccuggauac

SEQ ID NO: 103976 - RNA, 25 nt, Human
agcauccggcaugagggcugagaug

SEQ ID NO: 103977 - RNA, 21 nt, Human
ccaaguuggagcuugcaguga

SEQ ID NO: 103978 - RNA, 26 nt, Human
cacgaguuugagaccagccugaccaa

SEQ ID NO: 103979 - RNA, 25 nt, Human
ucuccugcccucccuccuuccugca

SEQ ID NO: 103980 - RNA, 26 nt, Human
ccugguguccuucuuagagaugaaga

SEQ ID NO: 103981 - RNA, 26 nt, Human
cucuuggacuccucuggaugacccgu

SEQ ID NO: 103982 - RNA, 22 nt, Human
ccccuccuggguucaagcgauu

SEQ ID NO: 103983 - RNA, 25 nt, Human
gagacuccaagguugacuuuaguuu

SEQ ID NO: 103984 - RNA, 23 nt, Human
cuuugcagaaacgcccuuguccc

SEQ ID NO: 103985 - RNA, 20 nt, Human
uuccaacauuccucauucua

SEQ ID NO: 103986 - RNA, 21 nt, Human
ccuccagcucaugacacuguu

SEQ ID NO: 103987 - RNA, 20 nt, Human
ccccaaaccugcaugaagca

SEQ ID NO: 103988 - RNA, 22 nt, Human
gccauuuuuaucuuggaagaac

SEQ ID NO: 103989 - RNA, 20 nt, Human
cgcucuucuugaaucaugcu

SEQ ID NO: 103990 - RNA, 23 nt, Human
cgcuucgccuccggccaagucga

SEQ ID NO: 103991 - RNA, 21 nt, Human
aggaggcagagcuugcaguga

SEQ ID NO: 103992 - RNA, 21 nt, Human
uugcccaggcuggagugcaau

SEQ ID NO: 103993 - RNA, 22 nt, Human
gcugggcucugaacgaggaccu

SEQ ID NO: 103994 - RNA, 25 nt, Human
uuauacuagauaaaauguuguuaca

SEQ ID NO: 103995 - RNA, 22 nt, Human
cacugcacuccaaccugggcag

SEQ ID NO: 103996 - RNA, 27 nt, Human
ccccucggaggcccccacccccagacg

SEQ ID NO: 103997 - RNA, 22 nt, Human
caggcugucaguguuuggugca

SEQ ID NO: 103998 - RNA, 22 nt, Human
uucacuuuauaaaugacaagug

SEQ ID NO: 103999 - RNA, 29 nt, Human
uuguccuagaugcuggagugagauuauau

SEQ ID NO: 104000 - RNA, 21 nt, Human
gcaguauuuaaaucuugcaag

SEQ ID NO: 104001 - RNA, 22 nt, Human
cgggcuguuuguuuuacagugu

SEQ ID NO: 104002 - RNA, 23 nt, Human
uagggccucguggggaguuccag

SEQ ID NO: 104003 - RNA, 20 nt, Human
gguccccccaucacacucac

SEQ ID NO: 104004 - RNA, 25 nt, Human
gggaaagagagaggaaugggaugga

SEQ ID NO: 104005 - RNA, 22 nt, Human
aguaaauccacaggcuccuguu

SEQ ID NO: 104006 - RNA, 22 nt, Human
ucaucccaaauaaaugccuugg

SEQ ID NO: 104007 - RNA, 23 nt, Human
cggcugaggaggugaaaguuucu

SEQ ID NO: 104008 - RNA, 25 nt, Human
gcacccuagaaacaacauacuuguc

SEQ ID NO: 104009 - RNA, 21 nt, Human
uccauaccccuuccucucucc

SEQ ID NO: 104010 - RNA, 22 nt, Human
ccucaucugcuggcauuuugug

SEQ ID NO: 104011 - RNA, 27 nt, Human
augggguuuaccuguuuuacuuuuggg

SEQ ID NO: 104012 - RNA, 21 nt, Human
uuugcucuugucgcucagccu

SEQ ID NO: 104013 - RNA, 22 nt, Human
acgaucucgacucacugcaacc

SEQ ID NO: 104014 - RNA, 22 nt, Human
gaaugauuggggugccuggccu

SEQ ID NO: 104015 - RNA, 20 nt, Human
cacauguccuauccaaagga

SEQ ID NO: 104016 - RNA, 17 nt, Human
cccaacaagagcucucu

SEQ ID NO: 104017 - RNA, 21 nt, Human
uuccuucuucuuuuuuaagca

SEQ ID NO: 104018 - RNA, 19 nt, Human
uuucacccauuugcaugga

SEQ ID NO: 104019 - RNA, 18 nt, Human
cuuuucugaaccuagccu

SEQ ID NO: 104020 - RNA, 21 nt, Human
gcuccauuucugcugccuccc

SEQ ID NO: 104021 - RNA, 24 nt, Human
gggaggagaggaaagcuggaaguc

SEQ ID NO: 104022 - RNA, 24 nt, Human
ggcugcauuugccuucuucugcca

SEQ ID NO: 104023 - RNA, 22 nt, Human
cagcauuccuggcuuucugggg

SEQ ID NO: 104024 - RNA, 19 nt, Human
aauuuguauggauauuuca

SEQ ID NO: 104025 - RNA, 22 nt, Human
cuuuugauugcugaccuguguc

SEQ ID NO: 104026 - RNA, 27 nt, Human
gaggaagaagagcgcaggccugggcga

SEQ ID NO: 104027 - RNA, 27 nt, Human
uuccugccuccaugccacuccagacug

SEQ ID NO: 104028 - RNA, 25 nt, Human
ucccuccaaucuugagauuggguuu

SEQ ID NO: 104029 - RNA, 20 nt, Human
gaggcggagucagggcgccc

SEQ ID NO: 104030 - RNA, 25 nt, Human
gucauuucugaaucuuuccacauua

SEQ ID NO: 104031 - RNA, 23 nt, Human
gucucaaacuccugaccuuguga

SEQ ID NO: 104032 - RNA, 21 nt, Human
cuggguguguuggcacaugcc

SEQ ID NO: 104033 - RNA, 24 nt, Human
ucaguacuguuuugcaaauacuca

SEQ ID NO: 104034 - RNA, 21 nt, Human
cguuccccuccucuuccgagc

SEQ ID NO: 104035 - RNA, 23 nt, Human
gagacaaaagcaguuucucucca

SEQ ID NO: 104036 - RNA, 21 nt, Human
auaaaugcaauauuaaugccu

SEQ ID NO: 104037 - RNA, 29 nt, Human
acagggugcuuuuuccuuucagggacauu

SEQ ID NO: 104038 - RNA, 21 nt, Human
ccuuggggcagcuccugaguu

SEQ ID NO: 104039 - RNA, 25 nt, Human
accuaggcuggagugcaguggcaca

SEQ ID NO: 104040 - RNA, 22 nt, Human
gcugaucgugguaauaagccau

SEQ ID NO: 104041 - RNA, 23 nt, Human
agauagauggcuuaauaaaauag

SEQ ID NO: 104042 - RNA, 24 nt, Human
ggaacucgugucuggcacagccug

SEQ ID NO: 104043 - RNA, 24 nt, Human
uccugggccucagcaagccaugcc

SEQ ID NO: 104044 - RNA, 22 nt, Human
auugcccagaauguuuuguaaa

SEQ ID NO: 104045 - RNA, 22 nt, Human
ucuucugauugcuccuggggaa

SEQ ID NO: 104046 - RNA, 26 nt, Human
acgguauuucagaaggucaucagauu

SEQ ID NO: 104047 - RNA, 22 nt, Human
cacaggcaaaguccagcucagu

SEQ ID NO: 104048 - RNA, 26 nt, Human
uccaccagguccucacaacuucucug

SEQ ID NO: 104049 - RNA, 21 nt, Human
gucucacugcaaccuccgccu

SEQ ID NO: 104050 - RNA, 21 nt, Human
ggcucacugcaaccuccuccu

SEQ ID NO: 104051 - RNA, 22 nt, Human
aagaauugaaacugugcaguca

SEQ ID NO: 104052 - RNA, 25 nt, Human
gucaaaguaaaacuugcugccugaa

SEQ ID NO: 104053 - RNA, 23 nt, Human
guagggauuauugaaucauuuca

SEQ ID NO: 104054 - RNA, 24 nt, Human
uguuguuguuguuuuuucaugccc

SEQ ID NO: 104055 - RNA, 20 nt, Human
uggugcugaagagaggauca

SEQ ID NO: 104056 - RNA, 21 nt, Human
aaaggugagaaggacaagaag

SEQ ID NO: 104057 - RNA, 26 nt, Human
uauagcaaccucucucuacccuaguu

SEQ ID NO: 104058 - RNA, 21 nt, Human
cauugccuaacuacuaguuuu

SEQ ID NO: 104059 - RNA, 22 nt, Human
augaucucggcucacugcaauc

SEQ ID NO: 104060 - RNA, 27 nt, Human
aaucacuuccuuuaggacugaaagcua

SEQ ID NO: 104061 - RNA, 22 nt, Human
acuuuguaaacuuaaacacagc

SEQ ID NO: 104062 - RNA, 22 nt, Human
gucauuuuucuuaaagacgagc

SEQ ID NO: 104063 - RNA, 23 nt, Human
uaaaacaauacuucgggugaguc

SEQ ID NO: 104064 - RNA, 20 nt, Human
gcuagagaaggaccagaaaa

SEQ ID NO: 104065 - RNA, 28 nt, Human
cugcuggcuaggcugggcugugccucug

SEQ ID NO: 104066 - RNA, 23 nt, Human
cagguagcugggauuacaggcau

SEQ ID NO: 104067 - RNA, 24 nt, Human
uggcauagagugauucaaccaccu

SEQ ID NO: 104068 - RNA, 23 nt, Human
auuuuauacuucaaauagccaca

SEQ ID NO: 104069 - RNA, 21 nt, Human
cccaagugcugggauuacagg

SEQ ID NO: 104070 - RNA, 21 nt, Human
gggugcuggaagagaucggga

SEQ ID NO: 104071 - RNA, 22 nt, Human
cugaguagcugggacuagaggc

SEQ ID NO: 104072 - RNA, 26 nt, Human
cuguacccaguguuacccucguuauu

SEQ ID NO: 104073 - RNA, 24 nt, Human
cggagcuggcugugccugcuucug

SEQ ID NO: 104074 - RNA, 26 nt, Human
uacugaggggggagugcagcaguugg

SEQ ID NO: 104075 - RNA, 21 nt, Human
caucccuucaagaguccugaa

SEQ ID NO: 104076 - RNA, 24 nt, Human
ugauuuuauagccacaaugcugca

SEQ ID NO: 104077 - RNA, 22 nt, Human
ggauggagguggacugauggga

SEQ ID NO: 104078 - RNA, 26 nt, Human
gggcuguaguuggugacuggguguuc

SEQ ID NO: 104079 - RNA, 24 nt, Human
gggaggaggaagaaaaagucccau

SEQ ID NO: 104080 - RNA, 26 nt, Human
ggcucacaccuguaauccuugcauuu

SEQ ID NO: 104081 - RNA, 19 nt, Human
augaaaggaaaaaacagca

SEQ ID NO: 104082 - RNA, 23 nt, Human
ccugccugugggggucaugcugc

SEQ ID NO: 104083 - RNA, 19 nt, Human
uaguuuucuaaaaagccuu

SEQ ID NO: 104084 - RNA, 18 nt, Human
ccuccccuuuuuacuuua

SEQ ID NO: 104085 - RNA, 22 nt, Human
cggugggcugggguggugccac

SEQ ID NO: 104086 - RNA, 21 nt, Human
uuggcucuucccagagggcag

SEQ ID NO: 104087 - RNA, 25 nt, Human
uucagcucaucaccuucaccugccu

SEQ ID NO: 104088 - RNA, 23 nt, Human
cucugccaagccuauggcgcuuu

SEQ ID NO: 104089 - RNA, 26 nt, Human
cagagcaagacccuguuucaaaaaga

SEQ ID NO: 104090 - RNA, 21 nt, Human
cccauaggaagagaucugcca

SEQ ID NO: 104091 - RNA, 31 nt, Human
uggccaaauucaaacuauaaacaugauguca

SEQ ID NO: 104092 - RNA, 22 nt, Human
ucagaaauggggaaauugcaga

SEQ ID NO: 104093 - RNA, 24 nt, Human
agaccugauuuugaugcuucaagg

SEQ ID NO: 104094 - RNA, 23 nt, Human
gcagccccgcagcuggugcucug

SEQ ID NO: 104095 - RNA, 21 nt, Human
uggguugccggucagagcuua

SEQ ID NO: 104096 - RNA, 21 nt, Human
uaggcuaaguuggggaggcuc

SEQ ID NO: 104097 - RNA, 23 nt, Human
ccacugcaccucuagucugggug

SEQ ID NO: 104098 - RNA, 22 nt, Human
gcaggagccccgccacagccuu

SEQ ID NO: 104099 - RNA, 25 nt, Human
ugguggcgggcaccuguaaucccag

SEQ ID NO: 104100 - RNA, 22 nt, Human
gauucuuguaagcacuggacug

SEQ ID NO: 104101 - RNA, 29 nt, Human
guagggggaggggcuggggaagaucuguc

SEQ ID NO: 104102 - RNA, 20 nt, Human
ggauaaauuaaaaucugagg

SEQ ID NO: 104103 - RNA, 21 nt, Human
ggcgcgugggcagugugcagg

SEQ ID NO: 104104 - RNA, 20 nt, Human
ugguccuggaagggaaagaa

SEQ ID NO: 104105 - RNA, 21 nt, Human
auauuggcaaugaagcacuuu

SEQ ID NO: 104106 - RNA, 22 nt, Human
uaccaacccagcuccacccagc

SEQ ID NO: 104107 - RNA, 22 nt, Human
gaggaggcgugcucaaguaucg

SEQ ID NO: 104108 - RNA, 27 nt, Human
cccaaggugcugggauugcagacguga

SEQ ID NO: 104109 - RNA, 21 nt, Human
gcccaccucuccagugcugcc

SEQ ID NO: 104110 - RNA, 22 nt, Human
uggccaucuuagugggugugaa

SEQ ID NO: 104111 - RNA, 22 nt, Human
gcccagcccagcucagcucagc

SEQ ID NO: 104112 - RNA, 26 nt, Human
gaucaucuugaaaauauuccucuuua

SEQ ID NO: 104113 - RNA, 24 nt, Human
acuauuuucacacuuuuaaucuca

SEQ ID NO: 104114 - RNA, 27 nt, Human
uaguagaaauguuuauccugguaucuc

SEQ ID NO: 104115 - RNA, 23 nt, Human
uguugcccaggcuggucugaagc

SEQ ID NO: 104116 - RNA, 23 nt, Human
ggaucuucaaugaacugugcuuu

SEQ ID NO: 104117 - RNA, 26 nt, Human
ugcccaggcuggagugcaguagugca

SEQ ID NO: 104118 - RNA, 21 nt, Human
uaagaaaagagaauuagccag

SEQ ID NO: 104119 - RNA, 25 nt, Human
cagggcagacggcggcaggagaagc

SEQ ID NO: 104120 - RNA, 21 nt, Human
cacagugucuuccucugagga

SEQ ID NO: 104121 - RNA, 21 nt, Human
gguucgcgggugcagcgcaca

SEQ ID NO: 104122 - RNA, 22 nt, Human
aggcauucgaguuuuugucuuu

SEQ ID NO: 104123 - RNA, 23 nt, Human
ccacuacaagugauccucaggca

SEQ ID NO: 104124 - RNA, 22 nt, Human
uggccaacaugguaaaacucca

SEQ ID NO: 104125 - RNA, 26 nt, Human
gaaaccagcuagaggcagagggaggu

SEQ ID NO: 104126 - RNA, 27 nt, Human
gguucacaugauucuccugccucagcu

SEQ ID NO: 104127 - RNA, 29 nt, Human
ccuaaaauuaaaggaggcagccuccuagu

SEQ ID NO: 104128 - RNA, 27 nt, Human
cugaguguuuuucagauguuuugccau

SEQ ID NO: 104129 - RNA, 23 nt, Human
ugccucuguuuuuucaaugagag

SEQ ID NO: 104130 - RNA, 22 nt, Human
augccaggcugacggguccagu

SEQ ID NO: 104131 - RNA, 22 nt, Human
ggaggcucaggugggaggauca

SEQ ID NO: 104132 - RNA, 25 nt, Human
uuuaaaaaauucaguugcuuuuugg

SEQ ID NO: 104133 - RNA, 22 nt, Human
uuaccuuugucucuaaagauca

SEQ ID NO: 104134 - RNA, 22 nt, Human
gagaaggccagccccaaaggua

SEQ ID NO: 104135 - RNA, 26 nt, Human
gcuccuccuuuacuuccucucuccuc

SEQ ID NO: 104136 - RNA, 18 nt, Human
caccuaagucucugggaa

SEQ ID NO: 104137 - RNA, 27 nt, Human
ccaggagguggaaacugcagagaguca

SEQ ID NO: 104138 - RNA, 25 nt, Human
gucucccaggcuggagugcaauggu

SEQ ID NO: 104139 - RNA, 22 nt, Human
agaguguucuugcugaugcucg

SEQ ID NO: 104140 - RNA, 26 nt, Human
ggagaggggagcaaaugguuuugggc

SEQ ID NO: 104141 - RNA, 23 nt, Human
acuuugacaaaucaugcugcugu

SEQ ID NO: 104142 - RNA, 18 nt, Human
ucagaaggaaaaagagca

SEQ ID NO: 104143 - RNA, 22 nt, Human
gucauucaggcuggagugcagu

SEQ ID NO: 104144 - RNA, 23 nt, Human
cauuggagcacucaguucagcag

SEQ ID NO: 104145 - RNA, 25 nt, Human
cggaccccucccugccuccuagagu

SEQ ID NO: 104146 - RNA, 21 nt, Human
cacucacugcaucgggacuuu

SEQ ID NO: 104147 - RNA, 20 nt, Human
cuaccugcccggccgacuua

SEQ ID NO: 104148 - RNA, 19 nt, Human
ggacuugccaugguucaca

SEQ ID NO: 104149 - RNA, 25 nt, Human
acaugacagaaccaauuuacacuca

SEQ ID NO: 104150 - RNA, 21 nt, Human
gcuaauagggccacagucccu

SEQ ID NO: 104151 - RNA, 23 nt, Human
ggguguagagggagcaggggccu

SEQ ID NO: 104152 - RNA, 27 nt, Human
ucccuccagagccucccuccggacaau

SEQ ID NO: 104153 - RNA, 28 nt, Human
cuuccaaaugccucuccucuauugauuc

SEQ ID NO: 104154 - RNA, 23 nt, Human
uuuccacugcaugccuugacuuc

SEQ ID NO: 104155 - RNA, 27 nt, Human
uuaaaaaaguguaaauaaaaucaaaga

SEQ ID NO: 104156 - RNA, 24 nt, Human
agagaagaaagaacaacaucagca

SEQ ID NO: 104157 - RNA, 22 nt, Human
cgucucuucaucagucuccccc

SEQ ID NO: 104158 - RNA, 23 nt, Human
acugaacaauggcccuguagcca

SEQ ID NO: 104159 - RNA, 21 nt, Human
ucaguuucagcagcuaccaug

SEQ ID NO: 104160 - RNA, 26 nt, Human
ccugccagaccacacagcccacaccu

SEQ ID NO: 104161 - RNA, 21 nt, Human
cgggggcagcggcagauuuga

SEQ ID NO: 104162 - RNA, 23 nt, Human
uuuugggauaguuaggagcuagg

SEQ ID NO: 104163 - RNA, 22 nt, Human
gcggguggaucaccugagguca

SEQ ID NO: 104164 - RNA, 22 nt, Human
gcgggcggaucacuugagguca

SEQ ID NO: 104165 - RNA, 25 nt, Human
aggaccaagaggugaagcugcagcc

SEQ ID NO: 104166 - RNA, 24 nt, Human
gugacacacagguguucaaagacg

SEQ ID NO: 104167 - RNA, 20 nt, Human
auauauacaguuacacuuuu

SEQ ID NO: 104168 - RNA, 23 nt, Human
ccuucuguuuguucauacacuua

SEQ ID NO: 104169 - RNA, 21 nt, Human
cugccacccugggccuggcag

SEQ ID NO: 104170 - RNA, 23 nt, Human
aggcccucagggucaaggccuug

SEQ ID NO: 104171 - RNA, 22 nt, Human
uggcgggugccuguaaucccag

SEQ ID NO: 104172 - RNA, 22 nt, Human
uggugggugccuguaauccuag

SEQ ID NO: 104173 - RNA, 21 nt, Human
gcggggcagcagcacagcgug

SEQ ID NO: 104174 - RNA, 23 nt, Human
uggcaacugucaggcagaggaaa

SEQ ID NO: 104175 - RNA, 26 nt, Human
gagagcaggggagggaaggaggcagc

SEQ ID NO: 104176 - RNA, 22 nt, Human
cccuugggggagaagcagcauu

SEQ ID NO: 104177 - RNA, 27 nt, Human
cugguuuuuagaaacaugguuuugaaa

SEQ ID NO: 104178 - RNA, 26 nt, Human
uccaagguauugagacauauuacugg

SEQ ID NO: 104179 - RNA, 25 nt, Human
ucucuucccagugcagauccacuca

SEQ ID NO: 104180 - RNA, 19 nt, Human
ugugccagcugggugggag

SEQ ID NO: 104181 - RNA, 23 nt, Human
gggaggcaucugggggccaaagg

SEQ ID NO: 104182 - RNA, 24 nt, Human
ggcaucgauggcaugaccaccuca

SEQ ID NO: 104183 - RNA, 25 nt, Human
ccucacucugacaugacaguauuuu

SEQ ID NO: 104184 - RNA, 27 nt, Human
gcgcaguguccaucaguaucagugccu

SEQ ID NO: 104185 - RNA, 19 nt, Human
ccagagggaagaugcccau

SEQ ID NO: 104186 - RNA, 21 nt, Human
aagaaggggucucacaaaaag

SEQ ID NO: 104187 - RNA, 22 nt, Human
cccuccccccaccuuuuuugcu

SEQ ID NO: 104188 - RNA, 18 nt, Human
aagagcagcaccuccuca

SEQ ID NO: 104189 - RNA, 26 nt, Human
gggcaggaggccagugguggggacgc

SEQ ID NO: 104190 - RNA, 25 nt, Human
gugccuggcccgagcccugcuccgc

SEQ ID NO: 104191 - RNA, 26 nt, Human
ugugugacccuuggcaagucaguuaa

SEQ ID NO: 104192 - RNA, 21 nt, Human
uggaacccaggaacucugguc

SEQ ID NO: 104193 - RNA, 23 nt, Human
ggauuugacuucagccaggugaa

SEQ ID NO: 104194 - RNA, 29 nt, Human
cuuugugugcaugggucagucaccauaug

SEQ ID NO: 104195 - RNA, 27 nt, Human
ugggaggugucucugggggugggguga

SEQ ID NO: 104196 - RNA, 23 nt, Human
aagggcgugggggguugcagcug

SEQ ID NO: 104197 - RNA, 23 nt, Human
cccgcccucuccccgccucggcc

SEQ ID NO: 104198 - RNA, 24 nt, Human
ccacagcugauagugauugccuug

SEQ ID NO: 104199 - RNA, 20 nt, Human
aggagccuucuucaccagcu

SEQ ID NO: 104200 - RNA, 23 nt, Human
uggacacacacuuccagacacac

SEQ ID NO: 104201 - RNA, 22 nt, Human
ugaaaacaaagacccuucggug

SEQ ID NO: 104202 - RNA, 22 nt, Human
gugagacuauuagacaaaguau

SEQ ID NO: 104203 - RNA, 22 nt, Human
cucacucuggauuccacacugc

SEQ ID NO: 104204 - RNA, 20 nt, Human
gcggaaaccuggugccggaa

SEQ ID NO: 104205 - RNA, 22 nt, Human
uggggauuguacacgggaccag

SEQ ID NO: 104206 - RNA, 24 nt, Human
cucuuccuaaauuucauuguguug

SEQ ID NO: 104207 - RNA, 22 nt, Human
ugccucccaggaucaagcaauu

SEQ ID NO: 104208 - RNA, 25 nt, Human
cagccuuucuccucuucucuucuug

SEQ ID NO: 104209 - RNA, 21 nt, Human
gcuguaaaugauaauguguac

SEQ ID NO: 104210 - RNA, 22 nt, Human
gccgagcacaagcuccagcauc

SEQ ID NO: 104211 - RNA, 24 nt, Human
aaacuucacauaucauaauuagca

SEQ ID NO: 104212 - RNA, 26 nt, Human
uaggcuuuuccccucugugacuggca

SEQ ID NO: 104213 - RNA, 21 nt, Human
ugagcugagaucacaccauug

SEQ ID NO: 104214 - RNA, 20 nt, Human
ucuagugccucauugaguuc

SEQ ID NO: 104215 - RNA, 26 nt, Human
cacuacuguucauuucugauuccuca

SEQ ID NO: 104216 - RNA, 23 nt, Human
uuaaaaaauucauuuugcagaaa

SEQ ID NO: 104217 - RNA, 23 nt, Human
gccuugcacaacaucagagaguu

SEQ ID NO: 104218 - RNA, 27 nt, Human
auacauacucuggguuuccauuucacc

SEQ ID NO: 104219 - RNA, 20 nt, Human
cauguucagcuuuguggacc

SEQ ID NO: 104220 - RNA, 20 nt, Human
cugcuugccauucucuugca

SEQ ID NO: 104221 - RNA, 21 nt, Human
guuuucaaaccaacacugaaa

SEQ ID NO: 104222 - RNA, 24 nt, Human
gggugcuggcuccaaucugcgucc

SEQ ID NO: 104223 - RNA, 21 nt, Human
uggcaaugugagggugauacu

SEQ ID NO: 104224 - RNA, 20 nt, Human
ggcgcuccgcacccaccucc

SEQ ID NO: 104225 - RNA, 23 nt, Human
uagugcuuucuugucaguggcgu

SEQ ID NO: 104226 - RNA, 21 nt, Human
gaagggcccuuuaguuuuuau

SEQ ID NO: 104227 - RNA, 28 nt, Human
gcagugagccaugauucacagcacugca

SEQ ID NO: 104228 - RNA, 21 nt, Human
uugagugcugagggucugugg

SEQ ID NO: 104229 - RNA, 21 nt, Human
uuaagggacgggcacauuuuu

SEQ ID NO: 104230 - RNA, 28 nt, Human
uuucugggcuccuggggcucagccuagu

SEQ ID NO: 104231 - RNA, 25 nt, Human
ggggguggggaaagaaagagggaac

SEQ ID NO: 104232 - RNA, 28 nt, Human
ggcggaaaggaaggggcgugguggcuag

SEQ ID NO: 104233 - RNA, 27 nt, Human
aagaaguaucccugauuuauucuggug

SEQ ID NO: 104234 - RNA, 20 nt, Human
gcugccagccacuucauccc

SEQ ID NO: 104235 - RNA, 19 nt, Human
aaaaauguguuucaggccu

SEQ ID NO: 104236 - RNA, 27 nt, Human
cagcagcagaaacgacaaggcacuuca

SEQ ID NO: 104237 - RNA, 26 nt, Human
agauacaaagcaaggagcuggugagc

SEQ ID NO: 104238 - RNA, 23 nt, Human
gaacccaggaacucuggucuccu

SEQ ID NO: 104239 - RNA, 27 nt, Human
uuagcauuuuaauuagauguaauuguu

SEQ ID NO: 104240 - RNA, 23 nt, Human
ccaccacacaucagugucuccuc

SEQ ID NO: 104241 - RNA, 22 nt, Human
uuuugggcucuuuuuucucccu

SEQ ID NO: 104242 - RNA, 23 nt, Human
gccgcagacccuggugcaaugcu

SEQ ID NO: 104243 - RNA, 24 nt, Human
uacuauuaauuacacuugcaguug

SEQ ID NO: 104244 - RNA, 19 nt, Human
gcaucuggggagccacaga

SEQ ID NO: 104245 - RNA, 24 nt, Human
ugggggaaagauggaguuccuauc

SEQ ID NO: 104246 - RNA, 24 nt, Human
ggcuuaaacgauucucccaccuca

SEQ ID NO: 104247 - RNA, 27 nt, Human
guuauguuguaaacaggaagcauuuca

SEQ ID NO: 104248 - RNA, 26 nt, Human
cucggcgcgacucgcuucuuucgguu

SEQ ID NO: 104249 - RNA, 22 nt, Human
uguccaggcuagagugcagugg

SEQ ID NO: 104250 - RNA, 22 nt, Human
uguccaggcuggagugcaaugg

SEQ ID NO: 104251 - RNA, 27 nt, Human
gccuguaccgcucccgcuggucaucuc

SEQ ID NO: 104252 - RNA, 20 nt, Human
uacuaaauggccucucucca

SEQ ID NO: 104253 - RNA, 27 nt, Human
cgccacugcauuccagccugugcgaca

SEQ ID NO: 104254 - RNA, 21 nt, Human
ggugaagcggagcagcccgag

SEQ ID NO: 104255 - RNA, 26 nt, Human
gcucacugcggccucuaagaagguga

SEQ ID NO: 104256 - RNA, 23 nt, Human
cacccggacgccgcugugcagug

SEQ ID NO: 104257 - RNA, 22 nt, Human
auugccccaggcuggucucgaa

SEQ ID NO: 104258 - RNA, 23 nt, Human
uuaagcguggagaaauguaugcg

SEQ ID NO: 104259 - RNA, 21 nt, Human
ccuccugccacgugcugggug

SEQ ID NO: 104260 - RNA, 25 nt, Human
cugcuuugggaauuggcacagugga

SEQ ID NO: 104261 - RNA, 20 nt, Human
ccaguccacuccacucuggg

SEQ ID NO: 104262 - RNA, 20 nt, Human
uuuuaaaaaauguuaugcag

SEQ ID NO: 104263 - RNA, 23 nt, Human
ccugguccacuaaaugcagccug

SEQ ID NO: 104264 - RNA, 23 nt, Human
gcagagcagaggagacccaggca

SEQ ID NO: 104265 - RNA, 21 nt, Human
cagcccaguaggagucaugua

SEQ ID NO: 104266 - RNA, 21 nt, Human
uuaggcuccugagaguuauuu

SEQ ID NO: 104267 - RNA, 22 nt, Human
uauccagcaagagugaccgggg

SEQ ID NO: 104268 - RNA, 19 nt, Human
guaccaaugcuacucugcu

SEQ ID NO: 104269 - RNA, 21 nt, Human
cuccagccucuccaagucgcu

SEQ ID NO: 104270 - RNA, 21 nt, Human
ucaaggaagagaaaccaggcc

SEQ ID NO: 104271 - RNA, 23 nt, Human
ggucugucuguuaccauaagucu

SEQ ID NO: 104272 - RNA, 26 nt, Human
uuuugggaacuauuucucuuuauuua

SEQ ID NO: 104273 - RNA, 26 nt, Human
augcccagcagauaccucucugacug

SEQ ID NO: 104274 - RNA, 22 nt, Human
agugcccaggcucaggugcagc

SEQ ID NO: 104275 - RNA, 24 nt, Human
ugguggcagugccuguaaucccag

SEQ ID NO: 104276 - RNA, 21 nt, Human
gaugaaugaggucccaggcag

SEQ ID NO: 104277 - RNA, 27 nt, Human
gcucugucacccagucuggagugcagu

SEQ ID NO: 104278 - RNA, 23 nt, Human
gucccgccacugcacuccagccu

SEQ ID NO: 104279 - RNA, 24 nt, Human
ccugcaggacaguauuccugccga

SEQ ID NO: 104280 - RNA, 22 nt, Human
gugguauaguagaaaggccagc

SEQ ID NO: 104281 - RNA, 23 nt, Human
ugcauuuuaagguggaguacagu

SEQ ID NO: 104282 - RNA, 23 nt, Human
auugcaacaggcugggcuucagu

SEQ ID NO: 104283 - RNA, 22 nt, Human
guuacccaggcuggucuucaac

SEQ ID NO: 104284 - RNA, 22 nt, Human
gauugugagcuccuugagggaa

SEQ ID NO: 104285 - RNA, 22 nt, Human
aacuuguuucucaggggacuug

SEQ ID NO: 104286 - RNA, 20 nt, Human
ugcaguauuauaaaagucau

SEQ ID NO: 104287 - RNA, 30 nt, Human
agcagcagcagcagcagcaguuugugaucu

SEQ ID NO: 104288 - RNA, 25 nt, Human
cgagaugccggaguuccuggaagac

SEQ ID NO: 104289 - RNA, 22 nt, Human
uguuuuuaaaaaucauaaacug

SEQ ID NO: 104290 - RNA, 27 nt, Human
cugccacugcuccucauuacucgcugg

SEQ ID NO: 104291 - RNA, 22 nt, Human
gccaaaacaguguugccauuuu

SEQ ID NO: 104292 - RNA, 19 nt, Human
ucuuccauguugcccaggc

SEQ ID NO: 104293 - RNA, 29 nt, Human
cugccacugcucuugccucuugugauguc

SEQ ID NO: 104294 - RNA, 23 nt, Human
cuucaaaaacaacuaaaggauga

SEQ ID NO: 104295 - RNA, 24 nt, Human
aagaggcagaccauccaccaggcc

SEQ ID NO: 104296 - RNA, 25 nt, Human
cugcagccuccaccucgccgcuggg

SEQ ID NO: 104297 - RNA, 27 nt, Human
uguuuuuaaaagcauauaccaccuuag

SEQ ID NO: 104298 - RNA, 21 nt, Human
cacuaguggccagcaucccca

SEQ ID NO: 104299 - RNA, 22 nt, Human
cuucugggcucccuuugcugac

SEQ ID NO: 104300 - RNA, 32 nt, Human
gcccuucccuucuugguuuccaaaggcauuua

SEQ ID NO: 104301 - RNA, 28 nt, Human
gcgcggccccagccugggcacccugauu

SEQ ID NO: 104302 - RNA, 22 nt, Human
ugacaccucccgaaguggacca

SEQ ID NO: 104303 - RNA, 19 nt, Human
augcaguuuauacuguauu

SEQ ID NO: 104304 - RNA, 19 nt, Human
ugcauucucuccagcugca

SEQ ID NO: 104305 - RNA, 20 nt, Human
cuucuuucuucugccucgac

SEQ ID NO: 104306 - RNA, 19 nt, Human
gccaucagagacacugcug

SEQ ID NO: 104307 - RNA, 25 nt, Human
uaucagaucugcgggaaaacuauuu

SEQ ID NO: 104308 - RNA, 27 nt, Human
ggaggcuggugugacagaggggcuggg

SEQ ID NO: 104309 - RNA, 22 nt, Human
ugagacaaauuuacauguauug

SEQ ID NO: 104310 - RNA, 24 nt, Human
aggaguagagaaaaucgaugaaga

SEQ ID NO: 104311 - RNA, 15 nt, Human
guugggguuucugcc

SEQ ID NO: 104312 - RNA, 22 nt, Human
cacggcacuccagccuggguga

SEQ ID NO: 104313 - RNA, 27 nt, Human
aaaacucaagaaggaccaagaaguuuu

SEQ ID NO: 104314 - RNA, 23 nt, Human
cucuggaucguuuuaugcgguuc

SEQ ID NO: 104315 - RNA, 26 nt, Human
aaggcuugauagcagagguuuggugg

SEQ ID NO: 104316 - RNA, 27 nt, Human
ggggugaggccgggcugucucguggug

SEQ ID NO: 104317 - RNA, 19 nt, Human
guagaggccucacagcccu

SEQ ID NO: 104318 - RNA, 25 nt, Human
ucaggucacuucccauggcugcagu

SEQ ID NO: 104319 - RNA, 21 nt, Human
accacgccagcuaauuuuugu

SEQ ID NO: 104320 - RNA, 21 nt, Human
uugcucccccugcucacucuc

SEQ ID NO: 104321 - RNA, 27 nt, Human
guugccgggccuggacuguccuaggug

SEQ ID NO: 104322 - RNA, 23 nt, Human
ccagggauuaggagcagcucuuc

SEQ ID NO: 104323 - RNA, 19 nt, Human
agcugccuccugagggugu

SEQ ID NO: 104324 - RNA, 19 nt, Human
ugcuguugcuugcugaacu

SEQ ID NO: 104325 - RNA, 27 nt, Human
aggacuugccucaggaggaaggacagc

SEQ ID NO: 104326 - RNA, 25 nt, Human
ggaggaaagacaugcccaagaggaa

SEQ ID NO: 104327 - RNA, 22 nt, Human
uuguucuugccguuuucuagcc

SEQ ID NO: 104328 - RNA, 20 nt, Human
uaugggagggcaugagggaa

SEQ ID NO: 104329 - RNA, 27 nt, Human
ccagaaacacagaugugucuaaagaaa

SEQ ID NO: 104330 - RNA, 20 nt, Human
cgaccuucccuuccuuuuca

SEQ ID NO: 104331 - RNA, 27 nt, Human
aaguguuccaaauacaauuugcacuaa

SEQ ID NO: 104332 - RNA, 27 nt, Human
uacaugguaucagucccagcaggcauc

SEQ ID NO: 104333 - RNA, 20 nt, Human
ugagaguuuaugcugaaaug

SEQ ID NO: 104334 - RNA, 23 nt, Human
agcaggggauccccacaaccuca

SEQ ID NO: 104335 - RNA, 25 nt, Human
aaccaucaccuugucccucauuccu

SEQ ID NO: 104336 - RNA, 23 nt, Human
cccacccccacacacaaccuccc

SEQ ID NO: 104337 - RNA, 23 nt, Human
ccagaagcuggaggggugcugga

SEQ ID NO: 104338 - RNA, 22 nt, Human
cgcagccgccgcgagccuccgg

SEQ ID NO: 104339 - RNA, 23 nt, Human
agauggugccacugcacuccagc

SEQ ID NO: 104340 - RNA, 21 nt, Human
gucuucauggggugcuagagc

SEQ ID NO: 104341 - RNA, 22 nt, Human
cggacccccauucgcaucuaac

SEQ ID NO: 104342 - RNA, 22 nt, Human
cugcacccaccaagucaagcag

SEQ ID NO: 104343 - RNA, 21 nt, Human
cacugcauuccagccuggcga

SEQ ID NO: 104344 - RNA, 22 nt, Human
uacuuaagugccauguugauga

SEQ ID NO: 104345 - RNA, 23 nt, Human
accacagcaaggaggugcauggc

SEQ ID NO: 104346 - RNA, 23 nt, Human
ucugucuucucuuuggccaucuc

SEQ ID NO: 104347 - RNA, 22 nt, Human
guucuucugaagugcugcucca

SEQ ID NO: 104348 - RNA, 26 nt, Human
agugugggggaaagccuacgcuucuc

SEQ ID NO: 104349 - RNA, 27 nt, Human
ggugguuccugcccagcaugcccagcu

SEQ ID NO: 104350 - RNA, 25 nt, Human
auggagagagaaaaggaacaguucc

SEQ ID NO: 104351 - RNA, 22 nt, Human
ucacagcaaggaaauucaccuu

SEQ ID NO: 104352 - RNA, 21 nt, Human
ccugccucugaagccaggugu

SEQ ID NO: 104353 - RNA, 20 nt, Human
acauuuucagaaaucuuuca

SEQ ID NO: 104354 - RNA, 32 nt, Human
cuucaaaugcugugcagccaucuugccucaac

SEQ ID NO: 104355 - RNA, 26 nt, Human
agcacagcacaggggcucagccuggg

SEQ ID NO: 104356 - RNA, 24 nt, Human
gucaugagagaaucaaauaauaga

SEQ ID NO: 104357 - RNA, 21 nt, Human
ucucucagugaaaggcugcuu

SEQ ID NO: 104358 - RNA, 26 nt, Human
gcucacugauguuuugcacuuuaaaa

SEQ ID NO: 104359 - RNA, 24 nt, Human
gagagcuucaguucuucugcagaa

SEQ ID NO: 104360 - RNA, 27 nt, Human
ugcagugagucaugauuguaugacugc

SEQ ID NO: 104361 - RNA, 26 nt, Human
ccuugugccuuaaaaaaccugccuuc

SEQ ID NO: 104362 - RNA, 23 nt, Human
aggcuggagugcaaugccgugau

SEQ ID NO: 104363 - RNA, 24 nt, Human
uugcaaccuccuccugagccggga

SEQ ID NO: 104364 - RNA, 21 nt, Human
gcagugagccaagaucgugcc

SEQ ID NO: 104365 - RNA, 26 nt, Human
uucuggcuuuuuaucuucuuagcuca

SEQ ID NO: 104366 - RNA, 18 nt, Human
cgagugagacagacuaga

SEQ ID NO: 104367 - RNA, 26 nt, Human
gauccagguggaaauauuuuuacuau

SEQ ID NO: 104368 - RNA, 21 nt, Human
cuucucucagccuccccacca

SEQ ID NO: 104369 - RNA, 23 nt, Human
uuccuccccacaacugugcucag

SEQ ID NO: 104370 - RNA, 23 nt, Human
caugccuucaggguaggcucuga

SEQ ID NO: 104371 - RNA, 22 nt, Human
cccagucugguaggagagagug

SEQ ID NO: 104372 - RNA, 19 nt, Human
ucuccccugcccugcugcc

SEQ ID NO: 104373 - RNA, 20 nt, Human
agugcaggacaacaucagcu

SEQ ID NO: 104374 - RNA, 25 nt, Human
aaggaaagagaaaaauuaaguuagg

SEQ ID NO: 104375 - RNA, 21 nt, Human
uauggucuucuccauccucac

SEQ ID NO: 104376 - RNA, 22 nt, Human
uuucauguugaagaaaaucagu

SEQ ID NO: 104377 - RNA, 25 nt, Human
cuuucuuggguuucuuucaggauuu

SEQ ID NO: 104378 - RNA, 21 nt, Human
uuuucuuuuucuuucucuugc

SEQ ID NO: 104379 - RNA, 24 nt, Human
cgccgccgccucuccuugcugcag

SEQ ID NO: 104380 - RNA, 21 nt, Human
gcccagccaccauguccaucc

SEQ ID NO: 104381 - RNA, 23 nt, Human
accccuuccacccccacaucuuc

SEQ ID NO: 104382 - RNA, 27 nt, Human
cugggcccggugaccgcaggccucagc

SEQ ID NO: 104383 - RNA, 28 nt, Human
ccgggaggcagagguugcagccggcuga

SEQ ID NO: 104384 - RNA, 23 nt, Human
gaacgcccucuuuuuaaaaaaga

SEQ ID NO: 104385 - RNA, 21 nt, Human
uugggaggcagagaugggagg

SEQ ID NO: 104386 - RNA, 28 nt, Human
ccuccaccuagacugccugcugaggggg

SEQ ID NO: 104387 - RNA, 23 nt, Human
ggaucacucacuuucccccuaca

SEQ ID NO: 104388 - RNA, 25 nt, Human
ggaggccuccaucuggaaaugggag

SEQ ID NO: 104389 - RNA, 27 nt, Human
aacagcaugaagugccguggaacugga

SEQ ID NO: 104390 - RNA, 26 nt, Human
cuggagguggaggcaguacccuggac

SEQ ID NO: 104391 - RNA, 23 nt, Human
auuaauaauacuuaccuaccuca

SEQ ID NO: 104392 - RNA, 26 nt, Human
uaucacuuugggguucggccuguguc

SEQ ID NO: 104393 - RNA, 30 nt, Human
aagaggaauaagaauggagcaguacauggg

SEQ ID NO: 104394 - RNA, 18 nt, Human
gaccuaguuggugcagug

SEQ ID NO: 104395 - RNA, 20 nt, Human
gcugcuggccauggcugcuu

SEQ ID NO: 104396 - RNA, 30 nt, Human
cccagaucccagggaccucagucggcuuaa

SEQ ID NO: 104397 - RNA, 21 nt, Human
aauccauuaaaaagcaaucuc

SEQ ID NO: 104398 - RNA, 21 nt, Human
cacuugaaccugggagaugga

SEQ ID NO: 104399 - RNA, 32 nt, Human
gaaguggucuaagagaccuggaacugccagag

SEQ ID NO: 104400 - RNA, 22 nt, Human
ccaggagguuguggcugcagug

SEQ ID NO: 104401 - RNA, 23 nt, Human
gcucaagccauccuucugccuca

SEQ ID NO: 104402 - RNA, 27 nt, Human
cucaggccuccagcuccugggauccgg

SEQ ID NO: 104403 - RNA, 23 nt, Human
gcccccacuucccaguggcugcu

SEQ ID NO: 104404 - RNA, 23 nt, Human
ccagagcagaggacacauggccu

SEQ ID NO: 104405 - RNA, 25 nt, Human
augguggggagacucggugggugaa

SEQ ID NO: 104406 - RNA, 27 nt, Human
ccuccaacucuucuucauccuccuagc

SEQ ID NO: 104407 - RNA, 22 nt, Human
ccuugcacauaggaaacuuuug

SEQ ID NO: 104408 - RNA, 24 nt, Human
ccucccacucuuucauggccgugg

SEQ ID NO: 104409 - RNA, 24 nt, Human
ucacagccagacuggcacaguuuu

SEQ ID NO: 104410 - RNA, 22 nt, Human
uccugugaaugccacugccuuc

SEQ ID NO: 104411 - RNA, 26 nt, Human
cacuccgcgccccggccuagaagcuc

SEQ ID NO: 104412 - RNA, 20 nt, Human
ucacaucuucgcucuggcca

SEQ ID NO: 104413 - RNA, 21 nt, Human
uagauguuuugucuucucuuu

SEQ ID NO: 104414 - RNA, 25 nt, Human
uucucuugccaccucaggggcuugg

SEQ ID NO: 104415 - RNA, 21 nt, Human
ggcuguagagcagaacacuuc

SEQ ID NO: 104416 - RNA, 21 nt, Human
uguggggagugcagggccaga

SEQ ID NO: 104417 - RNA, 20 nt, Human
uuucuguugguuaguagaca

SEQ ID NO: 104418 - RNA, 18 nt, Human
gaugaagcuuugcagccu

SEQ ID NO: 104419 - RNA, 26 nt, Human
gccuguaaucccaucaucuacucagg

SEQ ID NO: 104420 - RNA, 24 nt, Human
augcugccacuuuuaauggguccu

SEQ ID NO: 104421 - RNA, 24 nt, Human
guggugguuucuauacaugaauca

SEQ ID NO: 104422 - RNA, 20 nt, Human
gucucccccaucuguuacac

SEQ ID NO: 104423 - RNA, 26 nt, Human
aacugauuugcaauaaaaaugauacu

SEQ ID NO: 104424 - RNA, 21 nt, Human
aggggagcugcuccuccaucu

SEQ ID NO: 104425 - RNA, 21 nt, Human
aaccccaggcuggagugcagu

SEQ ID NO: 104426 - RNA, 22 nt, Human
aagggacaccagaaaauuugua

SEQ ID NO: 104427 - RNA, 21 nt, Human
aaugauuucaguagauacuca

SEQ ID NO: 104428 - RNA, 27 nt, Human
cucuacuccaccuccaucccuggacuu

SEQ ID NO: 104429 - RNA, 20 nt, Human
gagcccaggcggagcccagu

SEQ ID NO: 104430 - RNA, 22 nt, Human
caugaggucaggagaucgcgac

SEQ ID NO: 104431 - RNA, 23 nt, Human
cagaagcaggaaggugacucuga

SEQ ID NO: 104432 - RNA, 20 nt, Human
cuguuccugucacacauucc

SEQ ID NO: 104433 - RNA, 23 nt, Human
cccccacugcuguuuucacaucc

SEQ ID NO: 104434 - RNA, 23 nt, Human
gcaguccuacuacagucuggagu

SEQ ID NO: 104435 - RNA, 22 nt, Human
agacuuuuagcgguuugcaaac

SEQ ID NO: 104436 - RNA, 21 nt, Human
caugggaaugaggcccuccga

SEQ ID NO: 104437 - RNA, 22 nt, Human
guuuaccagcacacggcucuuc

SEQ ID NO: 104438 - RNA, 26 nt, Human
uuuguuguuuuucuguguaugggccu

SEQ ID NO: 104439 - RNA, 22 nt, Human
ccggcgggacacagcaggcugg

SEQ ID NO: 104440 - RNA, 21 nt, Human
gucucacuauguugcugaggc

SEQ ID NO: 104441 - RNA, 23 nt, Human
ucagaaauucaggagccagugag

SEQ ID NO: 104442 - RNA, 25 nt, Human
ggaggagguugugucacugacucag

SEQ ID NO: 104443 - RNA, 27 nt, Human
uagcaaacaucccuggcgauaccuugg

SEQ ID NO: 104444 - RNA, 20 nt, Human
ccucuggcccugccagcugc

SEQ ID NO: 104445 - RNA, 27 nt, Human
agaaaacaaggcagcagcgcaccugcc

SEQ ID NO: 104446 - RNA, 22 nt, Human
ggaucaugaagccaggaguucg

SEQ ID NO: 104447 - RNA, 21 nt, Human
agaaaacaaagcagcugacug

SEQ ID NO: 104448 - RNA, 21 nt, Human
gauucuggaaugcagaaggag

SEQ ID NO: 104449 - RNA, 21 nt, Human
uuggagccucuccuacucaga

SEQ ID NO: 104450 - RNA, 24 nt, Human
agggggagcugucugcggagccag

SEQ ID NO: 104451 - RNA, 24 nt, Human
cucucugccugugagccagucuag

SEQ ID NO: 104452 - RNA, 21 nt, Human
uuucugcugcucauggccaag

SEQ ID NO: 104453 - RNA, 21 nt, Human
gaggagucaucccccaaaaag

SEQ ID NO: 104454 - RNA, 22 nt, Human
uucaauugacaauucugccucc

SEQ ID NO: 104455 - RNA, 27 nt, Human
uuuaguauuuugucuuuguaauuuaca

SEQ ID NO: 104456 - RNA, 22 nt, Human
aggacugccugugauccuggcc

SEQ ID NO: 104457 - RNA, 26 nt, Human
ugcugguucucauaauuucuagagua

SEQ ID NO: 104458 - RNA, 24 nt, Human
gcaguagcacgaucucggcucacu

SEQ ID NO: 104459 - RNA, 27 nt, Human
uugcccaggcuggucucaaacuccugg

SEQ ID NO: 104460 - RNA, 25 nt, Human
ugacuucuauuuuccuuaaucaaac

SEQ ID NO: 104461 - RNA, 21 nt, Human
aaguaguggauccaucuugcu

SEQ ID NO: 104462 - RNA, 23 nt, Human
cauucaucucucaaacuuaguuu

SEQ ID NO: 104463 - RNA, 29 nt, Human
gccaagaauguacguccagccugccccgg

SEQ ID NO: 104464 - RNA, 26 nt, Human
uuccaaaauaacuaggaucugcauuu

SEQ ID NO: 104465 - RNA, 20 nt, Human
uuccccagcaggcuguaguu

SEQ ID NO: 104466 - RNA, 23 nt, Human
ccgaagacacuccuuccccaagu

SEQ ID NO: 104467 - RNA, 27 nt, Human
uggcacgaucacagcucacugcagccu

SEQ ID NO: 104468 - RNA, 24 nt, Human
acacuucagaguaagacaaaugca

SEQ ID NO: 104469 - RNA, 26 nt, Human
ccucaaggaucugcauucaggccugc

SEQ ID NO: 104470 - RNA, 23 nt, Human
gaucugggagugaggguggagag

SEQ ID NO: 104471 - RNA, 19 nt, Human
cccagcacccccuugcuca

SEQ ID NO: 104472 - RNA, 23 nt, Human
ccugccuguaaucucagcuacuc

SEQ ID NO: 104473 - RNA, 27 nt, Human
agcgcugugcuaaggugaucgaggacc

SEQ ID NO: 104474 - RNA, 21 nt, Human
uggagacagagguugcaguga

SEQ ID NO: 104475 - RNA, 26 nt, Human
ggcgccuguaaucccagauacucagg

SEQ ID NO: 104476 - RNA, 23 nt, Human
cuuccccagggugcacagcgagu

SEQ ID NO: 104477 - RNA, 19 nt, Human
agccucuccaagucgcugu

SEQ ID NO: 104478 - RNA, 23 nt, Human
aggcagaacugcucacaccagcu

SEQ ID NO: 104479 - RNA, 24 nt, Human
acugacauuccuccauguccucac

SEQ ID NO: 104480 - RNA, 27 nt, Human
gccaaucugcaauuucuacuacaggca

SEQ ID NO: 104481 - RNA, 22 nt, Human
aagucucuucucucuuaggucu

SEQ ID NO: 104482 - RNA, 21 nt, Human
cgcuggugggagagaugaggg

SEQ ID NO: 104483 - RNA, 21 nt, Human
cccagcacagggggauucuga

SEQ ID NO: 104484 - RNA, 20 nt, Human
cgaaugucacuaucccaaga

SEQ ID NO: 104485 - RNA, 26 nt, Human
uugcugucucuugccaugcacuugug

SEQ ID NO: 104486 - RNA, 26 nt, Human
uuucuuucuuuugcccuucacagugu

SEQ ID NO: 104487 - RNA, 31 nt, Human
ggauuguauaggcagaaaaaugauuguagga

SEQ ID NO: 104488 - RNA, 21 nt, Human
ggcucacugcagccuccgccu

SEQ ID NO: 104489 - RNA, 20 nt, Human
ccuacugacuagcugugcca

SEQ ID NO: 104490 - RNA, 23 nt, Human
ccugcugcccguccugccaccuc

SEQ ID NO: 104491 - RNA, 24 nt, Human
aguuucuauuacccccucccugcc

SEQ ID NO: 104492 - RNA, 20 nt, Human
cuuccacugcuaguagcuag

SEQ ID NO: 104493 - RNA, 24 nt, Human
gcuaagcuggcagaaagauugcau

SEQ ID NO: 104494 - RNA, 19 nt, Human
gaggacgacuucaggaugc

SEQ ID NO: 104495 - RNA, 27 nt, Human
ucacccaggaugcuggggcacuuuaaa

SEQ ID NO: 104496 - RNA, 21 nt, Human
cuguccagccccucaguauua

SEQ ID NO: 104497 - RNA, 27 nt, Human
acugccucugucccucuggucagcgug

SEQ ID NO: 104498 - RNA, 22 nt, Human
ugagccaagcccacggccaugc

SEQ ID NO: 104499 - RNA, 21 nt, Human
uucucguuaauauucuuuugg

SEQ ID NO: 104500 - RNA, 27 nt, Human
ccagcucccuuggaucagcccagagga

SEQ ID NO: 104501 - RNA, 25 nt, Human
cccacccccacccacagugcugcac

SEQ ID NO: 104502 - RNA, 25 nt, Human
cuuauugacgaaauauuuaggauaa

SEQ ID NO: 104503 - RNA, 18 nt, Human
ccugccaccugcugcugc

SEQ ID NO: 104504 - RNA, 24 nt, Human
uuguuuuucagcaguugcuguuuu

SEQ ID NO: 104505 - RNA, 26 nt, Human
ucacauuuuuacaaauagguagaguc

SEQ ID NO: 104506 - RNA, 19 nt, Human
acguaugcuucaggggccu

SEQ ID NO: 104507 - RNA, 21 nt, Human
ugagguggggauggagaagac

SEQ ID NO: 104508 - RNA, 22 nt, Human
aggcugagguugcaggaucgcu

SEQ ID NO: 104509 - RNA, 22 nt, Human
cauugcugcugccucugccucg

SEQ ID NO: 104510 - RNA, 24 nt, Human
ccccggggcaacccgucggcuaug

SEQ ID NO: 104511 - RNA, 27 nt, Human
ugacugcacugccaggagccaaggccu

SEQ ID NO: 104512 - RNA, 21 nt, Human
ucugcugccuggugaggccca

SEQ ID NO: 104513 - RNA, 19 nt, Human
uuuucuagauuagaccagu

SEQ ID NO: 104514 - RNA, 22 nt, Human
uuugacagcauuuccccaguug

SEQ ID NO: 104515 - RNA, 22 nt, Human
acagauuggauagauguguaca

SEQ ID NO: 104516 - RNA, 22 nt, Human
aguuacuggucaugccugcugu

SEQ ID NO: 104517 - RNA, 17 nt, Human
ucccacaugcauuuaug

SEQ ID NO: 104518 - RNA, 22 nt, Human
aauggugacuuuucuuucacga

SEQ ID NO: 104519 - RNA, 23 nt, Human
uguuggccaggcuggucuccaac

SEQ ID NO: 104520 - RNA, 24 nt, Human
cuaaugcucacgcucccaacacaa

SEQ ID NO: 104521 - RNA, 23 nt, Human
gccuaaaaucccagcuacucggg

SEQ ID NO: 104522 - RNA, 25 nt, Human
uuuucucucuccuuuugcuuagaua

SEQ ID NO: 104523 - RNA, 22 nt, Human
gcaaggagaaggucuguacuaa

SEQ ID NO: 104524 - RNA, 21 nt, Human
aagcucaggugagaggcacag

SEQ ID NO: 104525 - RNA, 27 nt, Human
ccugaaccuugagcaaauuaguugguu

SEQ ID NO: 104526 - RNA, 22 nt, Human
gucauguucucugaaguggaau

SEQ ID NO: 104527 - RNA, 26 nt, Human
auaucacugcagccugcuuugugcuu

SEQ ID NO: 104528 - RNA, 25 nt, Human
ccuccacuccccucugagauuggcc

SEQ ID NO: 104529 - RNA, 21 nt, Human
ccuguaauccuaacacuuugg

SEQ ID NO: 104530 - RNA, 24 nt, Human
aaauucuugccuuuccuuguuuca

SEQ ID NO: 104531 - RNA, 21 nt, Human
ugggagccuuucccacccccu

SEQ ID NO: 104532 - RNA, 22 nt, Human
uguccugcugcccgacuuccuu

SEQ ID NO: 104533 - RNA, 22 nt, Human
aaagugcugggauuccaggugu

SEQ ID NO: 104534 - RNA, 23 nt, Human
ugucacccaaguuggagugcagu

SEQ ID NO: 104535 - RNA, 22 nt, Human
cugcugcacuccagccugcggg

SEQ ID NO: 104536 - RNA, 22 nt, Human
cccagcacuuggcaggugucca

SEQ ID NO: 104537 - RNA, 20 nt, Human
ugcugggacaaagaugggga

SEQ ID NO: 104538 - RNA, 22 nt, Human
cuggugaagagcuggaggcaga

SEQ ID NO: 104539 - RNA, 21 nt, Human
aggugcuucgggagggggaga

SEQ ID NO: 104540 - RNA, 23 nt, Human
cugccacaccugagccagccugc

SEQ ID NO: 104541 - RNA, 25 nt, Human
uccagagagagucaugcuggaggag

SEQ ID NO: 104542 - RNA, 26 nt, Human
gcuguccuuugggaugauacuuggau

SEQ ID NO: 104543 - RNA, 19 nt, Human
aguuuccucugaugcagcu

SEQ ID NO: 104544 - RNA, 27 nt, Human
uggccaacauggcaaaaccccuuauuu

SEQ ID NO: 104545 - RNA, 22 nt, Human
uccucuggcugacaagaaguuc

SEQ ID NO: 104546 - RNA, 22 nt, Human
gucuauagcuauaaaucuuuaa

SEQ ID NO: 104547 - RNA, 26 nt, Human
uggcaaaaagggcaagacaaggugaa

SEQ ID NO: 104548 - RNA, 20 nt, Human
ggaggcgaagauugcaguga

SEQ ID NO: 104549 - RNA, 19 nt, Human
ugcuucucucaacccuuca

SEQ ID NO: 104550 - RNA, 16 nt, Human
ccucuucucccugccc

SEQ ID NO: 104551 - RNA, 19 nt, Human
ggauuucugcuuccuaaua

SEQ ID NO: 104552 - RNA, 26 nt, Human
ucugccgcccaggcuggagugcagug

SEQ ID NO: 104553 - RNA, 21 nt, Human
agcugcugccuggcugggauu

SEQ ID NO: 104554 - RNA, 25 nt, Human
guucucaccucuaccugucauucca

SEQ ID NO: 104555 - RNA, 21 nt, Human
cgcgcuucucugggccagagc

SEQ ID NO: 104556 - RNA, 28 nt, Human
ucuauuugcacagguucccuggcacugg

SEQ ID NO: 104557 - RNA, 23 nt, Human
acgcccagguugguaggggcgug

SEQ ID NO: 104558 - RNA, 26 nt, Human
ggaggcggaggcugcagucaaccaag

SEQ ID NO: 104559 - RNA, 23 nt, Human
ugaucugggucucuguguggucu

SEQ ID NO: 104560 - RNA, 22 nt, Human
gaggcuggagugcaguggcgcg

SEQ ID NO: 104561 - RNA, 20 nt, Human
uucauuucuuccacuucucc

SEQ ID NO: 104562 - RNA, 24 nt, Human
cccugccaggacuccucugggcuu

SEQ ID NO: 104563 - RNA, 27 nt, Human
ccucuacugugcaucuccuugacugcc

SEQ ID NO: 104564 - RNA, 24 nt, Human
gaauucgggggcucagcccuccuc

SEQ ID NO: 104565 - RNA, 31 nt, Human
cucucuguucacagaacucaggcugccucca

SEQ ID NO: 104566 - RNA, 24 nt, Human
caacucauauuuucaugcuguuca

SEQ ID NO: 104567 - RNA, 27 nt, Human
ucccggguucaugccauucugccucag

SEQ ID NO: 104568 - RNA, 22 nt, Human
guucacugcagccucaaccucu

SEQ ID NO: 104569 - RNA, 22 nt, Human
gucauuuaggcuggaaaaaagu

SEQ ID NO: 104570 - RNA, 22 nt, Human
uugccuuucugugccuggauua

SEQ ID NO: 104571 - RNA, 26 nt, Human
caggucccucuccccaaaauauuccc

SEQ ID NO: 104572 - RNA, 27 nt, Human
ucauaauuuacaaaggaggaacggaag

SEQ ID NO: 104573 - RNA, 25 nt, Human
cccuugcuuagccugugcuggacca

SEQ ID NO: 104574 - RNA, 22 nt, Human
cgcacccccggccuccagcguu

SEQ ID NO: 104575 - RNA, 23 nt, Human
gcgggccuguuuggugaggaccu

SEQ ID NO: 104576 - RNA, 22 nt, Human
ucaggaagguggagcugcauug

SEQ ID NO: 104577 - RNA, 21 nt, Human
gcaccugcuagcacagcuguc

SEQ ID NO: 104578 - RNA, 23 nt, Human
aucacaccauugcacuccagccu

SEQ ID NO: 104579 - RNA, 23 nt, Human
aucacaccacugcacucuagccu

SEQ ID NO: 104580 - RNA, 27 nt, Human
cucucagcuggucuuguguuacacauc

SEQ ID NO: 104581 - RNA, 20 nt, Human
gcccaggcuggggaagucgc

SEQ ID NO: 104582 - RNA, 21 nt, Human
uccucuguaaucuauuuuucc

SEQ ID NO: 104583 - RNA, 20 nt, Human
ggggagcugccucacguucu

SEQ ID NO: 104584 - RNA, 21 nt, Human
ccaccuagaggccaggaaagg

SEQ ID NO: 104585 - RNA, 25 nt, Human
ucgaagcaaucagcaaacacaauaa

SEQ ID NO: 104586 - RNA, 26 nt, Human
gcuugcagcucagguuucggggugcu

SEQ ID NO: 104587 - RNA, 18 nt, Human
gggagcugggggagcugu

SEQ ID NO: 104588 - RNA, 22 nt, Human
ccucuccuccgcugucaugccu

SEQ ID NO: 104589 - RNA, 22 nt, Human
ugcaguauuuauauuggaucau

SEQ ID NO: 104590 - RNA, 26 nt, Human
guggguggaguggggacaagcggugg

SEQ ID NO: 104591 - RNA, 23 nt, Human
uuucucccucuucaccccugcgc

SEQ ID NO: 104592 - RNA, 23 nt, Human
aaccuuuuauaaucuggagagaa

SEQ ID NO: 104593 - RNA, 22 nt, Human
cagccaucccggccauucugag

SEQ ID NO: 104594 - RNA, 26 nt, Human
cucccuuuuauaaacauugcuaaugu

SEQ ID NO: 104595 - RNA, 24 nt, Human
uuuaauccuucuuuguaauacuuu

SEQ ID NO: 104596 - RNA, 28 nt, Human
caccuggcagugagggacagagcuagug

SEQ ID NO: 104597 - RNA, 22 nt, Human
aaucaacccucuccugucugcc

SEQ ID NO: 104598 - RNA, 32 nt, Human
uguggcugggccauggaagcugugacuccucu

SEQ ID NO: 104599 - RNA, 25 nt, Human
gcuguagccugaagaagacaagauu

SEQ ID NO: 104600 - RNA, 23 nt, Human
ccacaaccugccaggaauuuuua

SEQ ID NO: 104601 - RNA, 26 nt, Human
aggagcugugcccacccuguacacuu

SEQ ID NO: 104602 - RNA, 22 nt, Human
uccaaguagcugggucuacagg

SEQ ID NO: 104603 - RNA, 23 nt, Human
gcacauaaggcaccaaacagccc

SEQ ID NO: 104604 - RNA, 21 nt, Human
agagggucugaggaauccaga

SEQ ID NO: 104605 - RNA, 22 nt, Human
caacagagagggagaaacccca

SEQ ID NO: 104606 - RNA, 19 nt, Human
guuacuuccuuccugcccc

SEQ ID NO: 104607 - RNA, 25 nt, Human
acgacuucccggggcgacaggagca

SEQ ID NO: 104608 - RNA, 22 nt, Human
cuguauucccagcuacuuggga

SEQ ID NO: 104609 - RNA, 23 nt, Human
ccagccccagcuaccaccuccuc

SEQ ID NO: 104610 - RNA, 27 nt, Human
ccuugggagccacgggauuguacugga

SEQ ID NO: 104611 - RNA, 22 nt, Human
ccggcgccaccaccgcggucac

SEQ ID NO: 104612 - RNA, 20 nt, Human
cacaggcauggaagcuguga

SEQ ID NO: 104613 - RNA, 27 nt, Human
ucugccuccucuucaacugaccagccu

SEQ ID NO: 104614 - RNA, 20 nt, Human
ucccucucugggccucaguc

SEQ ID NO: 104615 - RNA, 23 nt, Human
uggaagccucccaggcgcgcgag

SEQ ID NO: 104616 - RNA, 26 nt, Human
ugccaaauaaugaauucauccuagga

SEQ ID NO: 104617 - RNA, 21 nt, Human
acaaugacgugccuaccucuu

SEQ ID NO: 104618 - RNA, 26 nt, Human
uggguagauauacagcugucacaaga

SEQ ID NO: 104619 - RNA, 26 nt, Human
ccugcucucccucccugcccaauaca

SEQ ID NO: 104620 - RNA, 17 nt, Human
ugguaggcggagaguga

SEQ ID NO: 104621 - RNA, 20 nt, Human
ugaacuugauagcuaauaaa

SEQ ID NO: 104622 - RNA, 30 nt, Human
uccaaaacauguuuaauguuguauauuauc

SEQ ID NO: 104623 - RNA, 21 nt, Human
guucuuucuguagaucuuuaa

SEQ ID NO: 104624 - RNA, 19 nt, Human
gacuguuuuuacaaaugua

SEQ ID NO: 104625 - RNA, 19 nt, Human
ucccucccaguccaccuca

SEQ ID NO: 104626 - RNA, 20 nt, Human
gcaggcgagaguaguacugg

SEQ ID NO: 104627 - RNA, 21 nt, Human
guaccuccucucaagccaaga

SEQ ID NO: 104628 - RNA, 23 nt, Human
ggcuggcccuggcucgggcaggg

SEQ ID NO: 104629 - RNA, 20 nt, Human
agaggcagcagcacauaucu

SEQ ID NO: 104630 - RNA, 20 nt, Human
gaacagcuccuuacucugag

SEQ ID NO: 104631 - RNA, 20 nt, Human
ugccaaggcuggagugcagg

SEQ ID NO: 104632 - RNA, 19 nt, Human
uuaguaaaugcaaaguaau

SEQ ID NO: 104633 - RNA, 26 nt, Human
aggagguggaguucuuccaugcagga

SEQ ID NO: 104634 - RNA, 24 nt, Human
aaguuauucaacuuaugaaauuca

SEQ ID NO: 104635 - RNA, 22 nt, Human
agucgccagcgccgggcgcagu

SEQ ID NO: 104636 - RNA, 23 nt, Human
auguaugugaaaguguaaaauag

SEQ ID NO: 104637 - RNA, 28 nt, Human
accuguuacagugaggagaucacagugu

SEQ ID NO: 104638 - RNA, 21 nt, Human
aaacaagugucucauacaaca

SEQ ID NO: 104639 - RNA, 21 nt, Human
ggccuuugcuuuacagcacug

SEQ ID NO: 104640 - RNA, 21 nt, Human
uacucagaguauuuuuauuaa

SEQ ID NO: 104641 - RNA, 24 nt, Human
cggucucaaucuaaaagcacuuca

SEQ ID NO: 104642 - RNA, 24 nt, Human
acugccucucgcccuguaucuguc

SEQ ID NO: 104643 - RNA, 18 nt, Human
gcaggauggcuggaacac

SEQ ID NO: 104644 - RNA, 24 nt, Human
ggauccagggaacgcuuuugucca

SEQ ID NO: 104645 - RNA, 23 nt, Human
cagaauggaaaugacaagaaaua

SEQ ID NO: 104646 - RNA, 22 nt, Human
ugaacuccuggccucaagugau

SEQ ID NO: 104647 - RNA, 21 nt, Human
uggugauguuuggaagacuga

SEQ ID NO: 104648 - RNA, 32 nt, Human
gcggaggacacgccugcccugccugccaucug

SEQ ID NO: 104649 - RNA, 23 nt, Human
aagauaguugauucuugccuugu

SEQ ID NO: 104650 - RNA, 24 nt, Human
ucuuuaguuuucuauuugccucca

SEQ ID NO: 104651 - RNA, 23 nt, Human
gggagagaagggaaaagaucccc

SEQ ID NO: 104652 - RNA, 26 nt, Human
ggcuuggcugucuguucugggcacug

SEQ ID NO: 104653 - RNA, 22 nt, Human
ugcagcucgggacuucggccug

SEQ ID NO: 104654 - RNA, 20 nt, Human
aguaaucauguuggcugguc

SEQ ID NO: 104655 - RNA, 28 nt, Human
cuuaggauucacugcucucuccuacagc

SEQ ID NO: 104656 - RNA, 22 nt, Human
accuaggcuggagugcaguggg

SEQ ID NO: 104657 - RNA, 25 nt, Human
uauugauuuggauuauauucacauu

SEQ ID NO: 104658 - RNA, 22 nt, Human
ucuacauccuccugugcugcug

SEQ ID NO: 104659 - RNA, 19 nt, Human
cauguauguacacucugaa

SEQ ID NO: 104660 - RNA, 22 nt, Human
uguucccucucuaacuucugau

SEQ ID NO: 104661 - RNA, 19 nt, Human
cuccuccucuccaggggcc

SEQ ID NO: 104662 - RNA, 23 nt, Human
gugcccccagaguguagggggcc

SEQ ID NO: 104663 - RNA, 23 nt, Human
cgcaccuguaaucccagcuacuu

SEQ ID NO: 104664 - RNA, 23 nt, Human
cacaccugugaucccagcuacuu

SEQ ID NO: 104665 - RNA, 26 nt, Human
ggagauaccagcagagagggaguagg

SEQ ID NO: 104666 - RNA, 25 nt, Human
ucacaccuguaaucccagaacuuug

SEQ ID NO: 104667 - RNA, 27 nt, Human
cgccgccucucuugggaccuggccugg

SEQ ID NO: 104668 - RNA, 21 nt, Human
uggaaucaaggaauccugagu

SEQ ID NO: 104669 - RNA, 25 nt, Human
uucuacagaaaaacaaaugguaaca

SEQ ID NO: 104670 - RNA, 25 nt, Human
cugcuacagcugcuccccucccgcc

SEQ ID NO: 104671 - RNA, 21 nt, Human
ccuggagggucuuuguggacu

SEQ ID NO: 104672 - RNA, 22 nt, Human
ggagaggggagccagagccggu

SEQ ID NO: 104673 - RNA, 20 nt, Human
ggggaugggggcagggugga

SEQ ID NO: 104674 - RNA, 21 nt, Human
aggcggacucugugaggaaac

SEQ ID NO: 104675 - RNA, 22 nt, Human
gccccuuccuuuaaaaaacuua

SEQ ID NO: 104676 - RNA, 23 nt, Human
caauagaagacauuuucacugga

SEQ ID NO: 104677 - RNA, 20 nt, Human
gggugagcagagggcacugg

SEQ ID NO: 104678 - RNA, 20 nt, Human
uccacagugguaauguaaua

SEQ ID NO: 104679 - RNA, 18 nt, Human
agcuaauuuauuuuuugu

SEQ ID NO: 104680 - RNA, 26 nt, Human
ggagagugggcuugacugggcagagc

SEQ ID NO: 104681 - RNA, 21 nt, Human
ccaaaacacgcacacccugcc

SEQ ID NO: 104682 - RNA, 26 nt, Human
augcucaauauucccagaauaguuuu

SEQ ID NO: 104683 - RNA, 20 nt, Human
gcuugggcccccuccgggcc

SEQ ID NO: 104684 - RNA, 24 nt, Human
uucagacggcugcaggcacaggga

SEQ ID NO: 104685 - RNA, 22 nt, Human
ugcugcaucuuauagcacuuug

SEQ ID NO: 104686 - RNA, 24 nt, Human
cuccccaugugccugcaccaggag

SEQ ID NO: 104687 - RNA, 22 nt, Human
aggcugagguaggaggauugau

SEQ ID NO: 104688 - RNA, 26 nt, Human
augagaaugagguugaaauguaugca

SEQ ID NO: 104689 - RNA, 22 nt, Human
uugcuuucuucaugcccucccc

SEQ ID NO: 104690 - RNA, 24 nt, Human
ccuggcugcugcuucuugcuuccc

SEQ ID NO: 104691 - RNA, 22 nt, Human
cucagcccacucugaaaaugug

SEQ ID NO: 104692 - RNA, 23 nt, Human
gcagaaaagaagggcugggcaag

SEQ ID NO: 104693 - RNA, 23 nt, Human
gcugggcucccagacuccugggu

SEQ ID NO: 104694 - RNA, 26 nt, Human
ucagaagagaaaaauggaauaucaga

SEQ ID NO: 104695 - RNA, 21 nt, Human
cugcccuucucuugcugccuc

SEQ ID NO: 104696 - RNA, 27 nt, Human
ccccaaaaccaaacacacuccugcuca

SEQ ID NO: 104697 - RNA, 20 nt, Human
cagcccagcuaaguccggag

SEQ ID NO: 104698 - RNA, 23 nt, Human
caccgaggcuggagugcaaugac

SEQ ID NO: 104699 - RNA, 21 nt, Human
ggcugcagccucagcagugua

SEQ ID NO: 104700 - RNA, 21 nt, Human
acugugacaacuuaauaucuc

SEQ ID NO: 104701 - RNA, 22 nt, Human
ucugugcugccccauccaccua

SEQ ID NO: 104702 - RNA, 20 nt, Human
auucagucaggcacugggau

SEQ ID NO: 104703 - RNA, 27 nt, Human
cugccagggaggcucaggcugccaugg

SEQ ID NO: 104704 - RNA, 24 nt, Human
cuguguuuuuaaaaaacauugacc

SEQ ID NO: 104705 - RNA, 27 nt, Human
uugcccaggcuggagugcagaggugcg

SEQ ID NO: 104706 - RNA, 28 nt, Human
ucucgaucuccugaccucgugaugggcc

SEQ ID NO: 104707 - RNA, 22 nt, Human
aaguagcugggguuacaggcau

SEQ ID NO: 104708 - RNA, 23 nt, Human
cucacaccugcucccugcugcug

SEQ ID NO: 104709 - RNA, 23 nt, Human
uguucugguggggagacgccaga

SEQ ID NO: 104710 - RNA, 20 nt, Human
aacuacauauuugugccucc

SEQ ID NO: 104711 - RNA, 27 nt, Human
ggcucacugcaauuugcgucucccaag

SEQ ID NO: 104712 - RNA, 24 nt, Human
gcuacucuuaacuguucuauucaa

SEQ ID NO: 104713 - RNA, 22 nt, Human
gacuacaggcgcccaccaccau

SEQ ID NO: 104714 - RNA, 21 nt, Human
guuaguucuauuuagcagguu

SEQ ID NO: 104715 - RNA, 17 nt, Human
guuguugcuguuggacu

SEQ ID NO: 104716 - RNA, 25 nt, Human
cagcaggaacacuggcccauugccc

SEQ ID NO: 104717 - RNA, 21 nt, Human
cccuccagagcaggagacugg

SEQ ID NO: 104718 - RNA, 21 nt, Human
guguggaccaccuccaccaag

SEQ ID NO: 104719 - RNA, 28 nt, Human
uuauaggacaguuuuucuacugccauuc

SEQ ID NO: 104720 - RNA, 22 nt, Human
ucacugcagccuugaccuccug

SEQ ID NO: 104721 - RNA, 19 nt, Human
uuuuaaggaaaaaugcaga

SEQ ID NO: 104722 - RNA, 20 nt, Human
ucacguaaguaguaaugauu

SEQ ID NO: 104723 - RNA, 21 nt, Human
cuugauacauuugauuuuuca

SEQ ID NO: 104724 - RNA, 20 nt, Human
gcagaacagcuucauguucc

SEQ ID NO: 104725 - RNA, 22 nt, Human
ccacaaacauugcuauuauuca

SEQ ID NO: 104726 - RNA, 25 nt, Human
cauuguccagccaggaaaaauagca

SEQ ID NO: 104727 - RNA, 22 nt, Human
ugagcacggccccugcccgagc

SEQ ID NO: 104728 - RNA, 26 nt, Human
cucagccucugguuuuucagcacuug

SEQ ID NO: 104729 - RNA, 23 nt, Human
caucugcuccuuuuccauccccu

SEQ ID NO: 104730 - RNA, 27 nt, Human
ugcugccucucccguggucuggaguuc

SEQ ID NO: 104731 - RNA, 21 nt, Human
aagccauugcuaacuacuuca

SEQ ID NO: 104732 - RNA, 25 nt, Human
ucugucacccgagcuggagugcagu

SEQ ID NO: 104733 - RNA, 23 nt, Human
uucauucugccacuccaucuuca

SEQ ID NO: 104734 - RNA, 26 nt, Human
gagagggaacuagggcaccccuuguu

SEQ ID NO: 104735 - RNA, 27 nt, Human
ggguaccugcuuacaucuggacuuuag

SEQ ID NO: 104736 - RNA, 22 nt, Human
cugaggugggagggucgcuuga

SEQ ID NO: 104737 - RNA, 24 nt, Human
ggagauggggugaagggacacagu

SEQ ID NO: 104738 - RNA, 19 nt, Human
aaguucagcacuugucuca

SEQ ID NO: 104739 - RNA, 21 nt, Human
uguggaauggauagccuccca

SEQ ID NO: 104740 - RNA, 21 nt, Human
caucuccagggccccaccuca

SEQ ID NO: 104741 - RNA, 26 nt, Human
ucucgaacuccugaccucaagugauc

SEQ ID NO: 104742 - RNA, 22 nt, Human
cuuacuuccuaguccuacuuga

SEQ ID NO: 104743 - RNA, 22 nt, Human
ccccaaaaccuggcacccagaa

SEQ ID NO: 104744 - RNA, 23 nt, Human
ggagccaggugaggaggagccag

SEQ ID NO: 104745 - RNA, 22 nt, Human
aaggguagugugugagggagcu

SEQ ID NO: 104746 - RNA, 26 nt, Human
ucugcccucccuggccucacgcccag

SEQ ID NO: 104747 - RNA, 24 nt, Human
caggagucaucaauucauccauaa

SEQ ID NO: 104748 - RNA, 21 nt, Human
agacaaguaaucacuaacccg

SEQ ID NO: 104749 - RNA, 31 nt, Human
cuauagcagaagucugauucuaagagcagua

SEQ ID NO: 104750 - RNA, 25 nt, Human
gccucagggcuuagaucccacuuga

SEQ ID NO: 104751 - RNA, 20 nt, Human
cugaggccucucauuccaga

SEQ ID NO: 104752 - RNA, 27 nt, Human
ggucucgauaucugaucucgugauccg

SEQ ID NO: 104753 - RNA, 21 nt, Human
aggcagugucuuagaugugag

SEQ ID NO: 104754 - RNA, 21 nt, Human
gcccucccuuccugcggcgca

SEQ ID NO: 104755 - RNA, 23 nt, Human
cccagcaccuagguggggccugg

SEQ ID NO: 104756 - RNA, 24 nt, Human
ggccaagcucuucgccaugcugaa

SEQ ID NO: 104757 - RNA, 21 nt, Human
agauguaccuuuguaaaauag

SEQ ID NO: 104758 - RNA, 23 nt, Human
auugcccaggucugggcugaaua

SEQ ID NO: 104759 - RNA, 23 nt, Human
cucaguucugaauguugauauga

SEQ ID NO: 104760 - RNA, 23 nt, Human
ugucucacucucugucuuuauag

SEQ ID NO: 104761 - RNA, 22 nt, Human
gcccugcaccuuccccaaagga

SEQ ID NO: 104762 - RNA, 20 nt, Human
aaaaugcaaaaauuagccag

SEQ ID NO: 104763 - RNA, 25 nt, Human
gagcccaggagcuggcggagggcgu

SEQ ID NO: 104764 - RNA, 20 nt, Human
acaagcuaaaggaacuugca

SEQ ID NO: 104765 - RNA, 22 nt, Human
aaguuggcacuaccuugugccu

SEQ ID NO: 104766 - RNA, 21 nt, Human
caggagaccgugugauuugug

SEQ ID NO: 104767 - RNA, 22 nt, Human
ccguccucccccuucccaggcc

SEQ ID NO: 104768 - RNA, 23 nt, Human
agucaucuguuuaauuuacacac

SEQ ID NO: 104769 - RNA, 20 nt, Human
cuguuagaacucaggacagg

SEQ ID NO: 104770 - RNA, 20 nt, Human
gcauuucuggagcaucugcu

SEQ ID NO: 104771 - RNA, 22 nt, Human
uuaacuuaagcagaccaaaaau

SEQ ID NO: 104772 - RNA, 22 nt, Human
guacauccccuugcacagcccu

SEQ ID NO: 104773 - RNA, 27 nt, Human
gaugaaugaaugcuaaaaggguucuug

SEQ ID NO: 104774 - RNA, 22 nt, Human
uuuaugaauauaaugaaugagg

SEQ ID NO: 104775 - RNA, 23 nt, Human
gggagggugagcuggugccugcu

SEQ ID NO: 104776 - RNA, 20 nt, Human
aagugugugccaccaugccu

SEQ ID NO: 104777 - RNA, 21 nt, Human
gugcaaccucugcuucccagg

SEQ ID NO: 104778 - RNA, 20 nt, Human
auccucucuggggcuguguu

SEQ ID NO: 104779 - RNA, 29 nt, Human
cuucccuuuccucucucccccucggugaa

SEQ ID NO: 104780 - RNA, 27 nt, Human
ccuggcccuuccuaaggucccugccug

SEQ ID NO: 104781 - RNA, 20 nt, Human
cauuggucccagagcccugg

SEQ ID NO: 104782 - RNA, 22 nt, Human
ggcucacugcaagcucggccuc

SEQ ID NO: 104783 - RNA, 21 nt, Human
ccucuugcuaccuccaccucc

SEQ ID NO: 104784 - RNA, 23 nt, Human
cucuuucuccaccaccucgggcc

SEQ ID NO: 104785 - RNA, 23 nt, Human
aauaaaccacacuuaguccugau

SEQ ID NO: 104786 - RNA, 25 nt, Human
gugauucccugcacaccagagacaa

SEQ ID NO: 104787 - RNA, 22 nt, Human
gauuauauccccaacuccaggg

SEQ ID NO: 104788 - RNA, 22 nt, Human
agccuccgccuggucucuggug

SEQ ID NO: 104789 - RNA, 20 nt, Human
cgccgcccgcccccaggguu

SEQ ID NO: 104790 - RNA, 21 nt, Human
cccaccccauggcuuccaucu

SEQ ID NO: 104791 - RNA, 20 nt, Human
gccgaggccaccaagaggca

SEQ ID NO: 104792 - RNA, 28 nt, Human
uucccuuagguuuuuccccaccucaauu

SEQ ID NO: 104793 - RNA, 22 nt, Human
uuugcuucucgcccaccucuuc

SEQ ID NO: 104794 - RNA, 30 nt, Human
agcuggauuuuuuagaaaagaaauggauac

SEQ ID NO: 104795 - RNA, 24 nt, Human
ugucuuuucuuccacugccugaaa

SEQ ID NO: 104796 - RNA, 29 nt, Human
ugggacagcgguggaggccgagguggugg

SEQ ID NO: 104797 - RNA, 21 nt, Human
cuguucaagucaauguuaaua

SEQ ID NO: 104798 - RNA, 20 nt, Human
gcuguguugcugggccuggu

SEQ ID NO: 104799 - RNA, 27 nt, Human
uaaacuuucaauuacuaaaugaugauu

SEQ ID NO: 104800 - RNA, 19 nt, Human
uggcucggccucugccuuu

SEQ ID NO: 104801 - RNA, 21 nt, Human
ggcugagagagggagggcgac

SEQ ID NO: 104802 - RNA, 21 nt, Human
gguuguauuuucugaucauug

SEQ ID NO: 104803 - RNA, 26 nt, Human
augugagcaggauggugauggggguu

SEQ ID NO: 104804 - RNA, 19 nt, Human
augucauucaaaaaggccu

SEQ ID NO: 104805 - RNA, 17 nt, Human
aaagcccccacgcccag

SEQ ID NO: 104806 - RNA, 24 nt, Human
ugggaccccucucagccccucccu

SEQ ID NO: 104807 - RNA, 21 nt, Human
gugguguggucucggcucacc

SEQ ID NO: 104808 - RNA, 21 nt, Human
auggugugaucuuggcucacu

SEQ ID NO: 104809 - RNA, 22 nt, Human
uuucauggucacauuuauuaaa

SEQ ID NO: 104810 - RNA, 24 nt, Human
cugcagcuccccaggccacccacc

SEQ ID NO: 104811 - RNA, 20 nt, Human
guguuagccaggaugguguc

SEQ ID NO: 104812 - RNA, 23 nt, Human
gaccccuggccggaaacugagcc

SEQ ID NO: 104813 - RNA, 22 nt, Human
gagaagaauccugagacugccu

SEQ ID NO: 104814 - RNA, 25 nt, Human
caggguuguugugaggaucaaguaa

SEQ ID NO: 104815 - RNA, 22 nt, Human
uuuggagaaggucuguggugca

SEQ ID NO: 104816 - RNA, 30 nt, Human
cccagaugcucuccccuccucggaggauga

SEQ ID NO: 104817 - RNA, 27 nt, Human
gagagugcagggaggcgcagcucaggc

SEQ ID NO: 104818 - RNA, 19 nt, Human
gugauuucuagcucagccu

SEQ ID NO: 104819 - RNA, 20 nt, Human
uuccccaaaguuuaagaugu

SEQ ID NO: 104820 - RNA, 25 nt, Human
ggagcggcggcagcagcgacugggg

SEQ ID NO: 104821 - RNA, 27 nt, Human
uaaguagauuuaauuugggaacugaca

SEQ ID NO: 104822 - RNA, 26 nt, Human
ggucuggaacuauaauagcaggguca

SEQ ID NO: 104823 - RNA, 18 nt, Human
auggaggcgguggcggug

SEQ ID NO: 104824 - RNA, 27 nt, Human
ccgaggaggaagagguugauggcggcg

SEQ ID NO: 104825 - RNA, 26 nt, Human
guguauuaacuuauuuaugugcugcu

SEQ ID NO: 104826 - RNA, 23 nt, Human
acaaucugugcggaaguagcuug

SEQ ID NO: 104827 - RNA, 22 nt, Human
uuggcauggagucccaaaggcc

SEQ ID NO: 104828 - RNA, 22 nt, Human
ugugcugcugcuuucccuucuc

SEQ ID NO: 104829 - RNA, 27 nt, Human
ccccugccauccccccaaccuccucau

SEQ ID NO: 104830 - RNA, 21 nt, Human
uuccucugguuugaaagccuc

SEQ ID NO: 104831 - RNA, 21 nt, Human
uucagacucaaaacacucauu

SEQ ID NO: 104832 - RNA, 26 nt, Human
gaggccuguuaucauagaagucauuu

SEQ ID NO: 104833 - RNA, 19 nt, Human
acaccuuuuacucuucuua

SEQ ID NO: 104834 - RNA, 21 nt, Human
cccugcucuccgcgcucggcc

SEQ ID NO: 104835 - RNA, 22 nt, Human
guuucaggauuugggugucaca

SEQ ID NO: 104836 - RNA, 24 nt, Human
uuugcugcugccgcuguucucuuu

SEQ ID NO: 104837 - RNA, 22 nt, Human
ucucucucccaacugcugcuua

SEQ ID NO: 104838 - RNA, 24 nt, Human
cagcaggacgacuggcuguccucc

SEQ ID NO: 104839 - RNA, 20 nt, Human
aaaugagacacauuaaaggg

SEQ ID NO: 104840 - RNA, 22 nt, Human
uuggaaggcacugccuucagcu

SEQ ID NO: 104841 - RNA, 26 nt, Human
aacucagaauaaaaaugaaaaagcua

SEQ ID NO: 104842 - RNA, 19 nt, Human
aggaaaaccugaagacuga

SEQ ID NO: 104843 - RNA, 20 nt, Human
gcugcccuuccuccuccucc

SEQ ID NO: 104844 - RNA, 24 nt, Human
aaggaucuaauaacuucaagccag

SEQ ID NO: 104845 - RNA, 26 nt, Human
auugacaaacuuuuccuggacacuuu

SEQ ID NO: 104846 - RNA, 21 nt, Human
ccaaaaacauguuucugccuu

SEQ ID NO: 104847 - RNA, 23 nt, Human
gucauuguauuuuuaacaccaga

SEQ ID NO: 104848 - RNA, 27 nt, Human
cuugcugucugcccugccucacccugc

SEQ ID NO: 104849 - RNA, 24 nt, Human
cagucuaaggcuggaaguuuaaug

SEQ ID NO: 104850 - RNA, 20 nt, Human
cuuuuguuccuccuguccca

SEQ ID NO: 104851 - RNA, 23 nt, Human
ucauagguaaauaaauuagggaa

SEQ ID NO: 104852 - RNA, 21 nt, Human
ugagccaggccugggucugug

SEQ ID NO: 104853 - RNA, 20 nt, Human
gccauuuucaaacagucccu

SEQ ID NO: 104854 - RNA, 24 nt, Human
ggaaauucaaagagucuccugcca

SEQ ID NO: 104855 - RNA, 22 nt, Human
uguuggaugaugaaacauucau

SEQ ID NO: 104856 - RNA, 21 nt, Human
uacgagaccucugaauuugua

SEQ ID NO: 104857 - RNA, 24 nt, Human
augauaccuuuugcuuugccuugu

SEQ ID NO: 104858 - RNA, 23 nt, Human
gggaggggcaggagagcagugag

SEQ ID NO: 104859 - RNA, 27 nt, Human
uucuuaugggaccaaauuuaagcaauu

SEQ ID NO: 104860 - RNA, 22 nt, Human
aucgaauucuccugggagccag

SEQ ID NO: 104861 - RNA, 21 nt, Human
cucgccugaagccagccucuc

SEQ ID NO: 104862 - RNA, 24 nt, Human
aggaaagagagacacagcugcaga

SEQ ID NO: 104863 - RNA, 27 nt, Human
gugucucccucuucuaucaccucucuc

SEQ ID NO: 104864 - RNA, 26 nt, Human
ucccagggccuucaccaccugaccaa

SEQ ID NO: 104865 - RNA, 23 nt, Human
ccucagaagauguucccugcuga

SEQ ID NO: 104866 - RNA, 23 nt, Human
uacuacugauauaugcuaguuuu

SEQ ID NO: 104867 - RNA, 24 nt, Human
cucaggaaaccacaaccuugcagu

SEQ ID NO: 104868 - RNA, 26 nt, Human
acaggcaguuuucuguccugugcaca

SEQ ID NO: 104869 - RNA, 23 nt, Human
augacucucugggaccuugccac

SEQ ID NO: 104870 - RNA, 22 nt, Human
cccagcccagggcuccugcacu

SEQ ID NO: 104871 - RNA, 28 nt, Human
guggcuucugggagaugggugucacuuu

SEQ ID NO: 104872 - RNA, 27 nt, Human
caggcuggaggugccggugggccugug

SEQ ID NO: 104873 - RNA, 19 nt, Human
ucuuagcagccucuucccu

SEQ ID NO: 104874 - RNA, 21 nt, Human
uuuacuugguaaagugcagug

SEQ ID NO: 104875 - RNA, 18 nt, Human
ugucugcugccuggugag

SEQ ID NO: 104876 - RNA, 21 nt, Human
aggagaauuggaaauacauau

SEQ ID NO: 104877 - RNA, 21 nt, Human
uuggguggcuggauuuugaaa

SEQ ID NO: 104878 - RNA, 21 nt, Human
ucgccccuucuccaucguccc

SEQ ID NO: 104879 - RNA, 27 nt, Human
cccuccugggcagccagggcagccagg

SEQ ID NO: 104880 - RNA, 20 nt, Human
ggacccuucagggugcccca

SEQ ID NO: 104881 - RNA, 20 nt, Human
gggagcuggcgcagggcucu

SEQ ID NO: 104882 - RNA, 28 nt, Human
uuuuauucuuucuucuucauguauucac

SEQ ID NO: 104883 - RNA, 27 nt, Human
uggccaacauagugaaaccccgucucu

SEQ ID NO: 104884 - RNA, 27 nt, Human
ugaccaacaucgugaaaugccgucuuu

SEQ ID NO: 104885 - RNA, 23 nt, Human
gccucuauuuauugcauucuggu

SEQ ID NO: 104886 - RNA, 22 nt, Human
augcaaccucugccccccgggu

SEQ ID NO: 104887 - RNA, 27 nt, Human
uuuucuggggagaagguucaagagauu

SEQ ID NO: 104888 - RNA, 26 nt, Human
ucccgcggggacaccagcacugagcc

SEQ ID NO: 104889 - RNA, 24 nt, Human
cuggugaugaagagaaaagguuaa

SEQ ID NO: 104890 - RNA, 21 nt, Human
uuugaacuucauuuugggggg

SEQ ID NO: 104891 - RNA, 21 nt, Human
uucagucuugcagaggaggaa

SEQ ID NO: 104892 - RNA, 27 nt, Human
acuuuuugacacacuugccaugacgug

SEQ ID NO: 104893 - RNA, 20 nt, Human
uagugcucccuuccuccuca

SEQ ID NO: 104894 - RNA, 22 nt, Human
uggaugggucugauuucuuggc

SEQ ID NO: 104895 - RNA, 26 nt, Human
aguuuauuucagguuccuucuugccu

SEQ ID NO: 104896 - RNA, 24 nt, Human
uuuauuggaagucucucccugccu

SEQ ID NO: 104897 - RNA, 21 nt, Human
aauuuuuaaaagggacuuuaa

SEQ ID NO: 104898 - RNA, 20 nt, Human
ccuccccuuuguucuucuau

SEQ ID NO: 104899 - RNA, 22 nt, Human
ugaacagagcauuucuauagca

SEQ ID NO: 104900 - RNA, 25 nt, Human
acccaggcuggaggacaggaccagc

SEQ ID NO: 104901 - RNA, 16 nt, Human
uguggaaugucgcaga

SEQ ID NO: 104902 - RNA, 18 nt, Human
gaaggggcugggagccag

SEQ ID NO: 104903 - RNA, 26 nt, Human
agagaaaauacuuuuaaaaaaugcag

SEQ ID NO: 104904 - RNA, 24 nt, Human
agaggccugcucuccucacacauu

SEQ ID NO: 104905 - RNA, 22 nt, Human
auuuauuccauaggguuucucu

SEQ ID NO: 104906 - RNA, 26 nt, Human
acucagggcguuguuaacagggagug

SEQ ID NO: 104907 - RNA, 30 nt, Human
ccugcacucuagugacccugggugccgcca

SEQ ID NO: 104908 - RNA, 24 nt, Human
gagugaugugagaaacuucuuuuc

SEQ ID NO: 104909 - RNA, 27 nt, Human
ugaccaacauggugaaacccugucucu

SEQ ID NO: 104910 - RNA, 23 nt, Human
uaaguagcuggguuuacaggcac

SEQ ID NO: 104911 - RNA, 20 nt, Human
aaucagcuugugaaaaauca

SEQ ID NO: 104912 - RNA, 24 nt, Human
cagacuccaggaugacuuugcacg

SEQ ID NO: 104913 - RNA, 20 nt, Human
ucugaucucuuauuaccuca

SEQ ID NO: 104914 - RNA, 20 nt, Human
cccacccccuucccugcuga

SEQ ID NO: 104915 - RNA, 22 nt, Human
cccacagaucaacuguguaauc

SEQ ID NO: 104916 - RNA, 23 nt, Human
guagcccaggcuggagugcaaug

SEQ ID NO: 104917 - RNA, 22 nt, Human
cccugcaauauaacaugcacag

SEQ ID NO: 104918 - RNA, 27 nt, Human
ucugcuuucugugccuaguugaacggc

SEQ ID NO: 104919 - RNA, 29 nt, Human
ucuucccugucugauccuuagcaaaagua

SEQ ID NO: 104920 - RNA, 27 nt, Human
ugaguagaaaucuggugaccuaaggcu

SEQ ID NO: 104921 - RNA, 21 nt, Human
ugauauucuggacauuuuagg

SEQ ID NO: 104922 - RNA, 27 nt, Human
guuucaaacuccugaccucaguugauc

SEQ ID NO: 104923 - RNA, 19 nt, Human
ugagagagggagggaacag

SEQ ID NO: 104924 - RNA, 28 nt, Human
cagccugaagccuggauuccagcaguga

SEQ ID NO: 104925 - RNA, 22 nt, Human
uuccucgccucuccagauuguc

SEQ ID NO: 104926 - RNA, 27 nt, Human
agaugucaaguuggguucacuugccau

SEQ ID NO: 104927 - RNA, 17 nt, Human
guagguguccaugcaga

SEQ ID NO: 104928 - RNA, 20 nt, Human
ucuggcucauuaaaaaauuu

SEQ ID NO: 104929 - RNA, 25 nt, Human
ucucccaggcuggagugcuauggug

SEQ ID NO: 104930 - RNA, 22 nt, Human
ucacagcugaguuaugaagcug

SEQ ID NO: 104931 - RNA, 25 nt, Human
uccugcuccaugacuggcugucugc

SEQ ID NO: 104932 - RNA, 25 nt, Human
gaaagaacauggucuguggugcugu

SEQ ID NO: 104933 - RNA, 21 nt, Human
agcacuggcuuuucuuuucag

SEQ ID NO: 104934 - RNA, 20 nt, Human
cccccaggcugggagaaggg

SEQ ID NO: 104935 - RNA, 22 nt, Human
cauuugaggggaaaacaccaua

SEQ ID NO: 104936 - RNA, 20 nt, Human
ugcccaggcuggagugcauu

SEQ ID NO: 104937 - RNA, 23 nt, Human
acucuugggagugcugcagucuu

SEQ ID NO: 104938 - RNA, 25 nt, Human
caggagcccucguccccugccuugu

SEQ ID NO: 104939 - RNA, 17 nt, Human
guucuuucauuuccucc

SEQ ID NO: 104940 - RNA, 22 nt, Human
cccagaggcuagucucuucuca

SEQ ID NO: 104941 - RNA, 22 nt, Human
ccaaagugcugggauuacagac

SEQ ID NO: 104942 - RNA, 22 nt, Human
ccaaagugcuggaauuacaggc

SEQ ID NO: 104943 - RNA, 21 nt, Human
aacgcaugaauguauguagug

SEQ ID NO: 104944 - RNA, 25 nt, Human
ccugccuggagguucucccuggggu

SEQ ID NO: 104945 - RNA, 22 nt, Human
caucuguguaggagcuaaagca

SEQ ID NO: 104946 - RNA, 20 nt, Human
agggaucugccugcauccug

SEQ ID NO: 104947 - RNA, 25 nt, Human
acaggggaguuuuguugaaguugca

SEQ ID NO: 104948 - RNA, 20 nt, Human
ucucucugcuguggcguucu

SEQ ID NO: 104949 - RNA, 23 nt, Human
ggaucucauuacaagagccacag

SEQ ID NO: 104950 - RNA, 21 nt, Human
ucuuacccagugaaucauucu

SEQ ID NO: 104951 - RNA, 22 nt, Human
ucacuugcuguuacaggcacag

SEQ ID NO: 104952 - RNA, 22 nt, Human
ucuaauucauuuucucuuuagu

SEQ ID NO: 104953 - RNA, 24 nt, Human
ugcuguugugaaaaauguuuuacc

SEQ ID NO: 104954 - RNA, 20 nt, Human
gcugcaccccuuccugggca

SEQ ID NO: 104955 - RNA, 20 nt, Human
ggccucggaccccaggcucc

SEQ ID NO: 104956 - RNA, 20 nt, Human
gggaauagaaagcagcucug

SEQ ID NO: 104957 - RNA, 29 nt, Human
gaaguagguaaagagugcuccucagcuuc

SEQ ID NO: 104958 - RNA, 22 nt, Human
cacauccccagccagggagcuu

SEQ ID NO: 104959 - RNA, 26 nt, Human
uccaugaauggaaggaaugugggaga

SEQ ID NO: 104960 - RNA, 21 nt, Human
caucuguaaccccagcacuuu

SEQ ID NO: 104961 - RNA, 24 nt, Human
agcgggaagaggagaugacaggaa

SEQ ID NO: 104962 - RNA, 25 nt, Human
ggaagacauggauuuccuggaagac

SEQ ID NO: 104963 - RNA, 23 nt, Human
acauuuguugcaggaaugcagga

SEQ ID NO: 104964 - RNA, 21 nt, Human
uaguuuaugguucugcaguca

SEQ ID NO: 104965 - RNA, 21 nt, Human
cuccagugcccaccugccuca

SEQ ID NO: 104966 - RNA, 20 nt, Human
acgucgucaaaaaugauuua

SEQ ID NO: 104967 - RNA, 25 nt, Human
cgcauuauccagguggcuaguggca

SEQ ID NO: 104968 - RNA, 23 nt, Human
ccuccugcugaccccugacagcg

SEQ ID NO: 104969 - RNA, 19 nt, Human
uggcaaauaguacuuuaau

SEQ ID NO: 104970 - RNA, 21 nt, Human
aagcagugucugucagcugug

SEQ ID NO: 104971 - RNA, 22 nt, Human
agcacccaccugccagcccugc

SEQ ID NO: 104972 - RNA, 24 nt, Human
ggcucucuucuuucuuccucaucc

SEQ ID NO: 104973 - RNA, 22 nt, Human
ugcuuuuaggauuaaaaucaaa

SEQ ID NO: 104974 - RNA, 23 nt, Human
cacugggugaccagcuggcagac

SEQ ID NO: 104975 - RNA, 22 nt, Human
uagaggcagagccacccacgcc

SEQ ID NO: 104976 - RNA, 25 nt, Human
gggcgagccacgcacgcagaggguu

SEQ ID NO: 104977 - RNA, 21 nt, Human
caguucagucccuuauucugc

SEQ ID NO: 104978 - RNA, 27 nt, Human
uuaucuagauuuuuguccacaguauau

SEQ ID NO: 104979 - RNA, 18 nt, Human
uggcggaucuggaggagc

SEQ ID NO: 104980 - RNA, 22 nt, Human
acaacagcaacaaaaucuguuu

SEQ ID NO: 104981 - RNA, 27 nt, Human
ccuaaggcuggaugggaaagugcaguc

SEQ ID NO: 104982 - RNA, 22 nt, Human
uaugggagaaaaagaguaagag

SEQ ID NO: 104983 - RNA, 20 nt, Human
ucguggacuacaaagcacaa

SEQ ID NO: 104984 - RNA, 27 nt, Human
uugagauacuauuuucauuuuugugag

SEQ ID NO: 104985 - RNA, 22 nt, Human
uuaucugaaguaugacaagauu

SEQ ID NO: 104986 - RNA, 20 nt, Human
ggcugacagaggcggccuca

SEQ ID NO: 104987 - RNA, 23 nt, Human
cuucugagagagcccagccugau

SEQ ID NO: 104988 - RNA, 23 nt, Human
ugagacuacagguguguguccau

SEQ ID NO: 104989 - RNA, 19 nt, Human
ggaaggcaaagucuuggcu

SEQ ID NO: 104990 - RNA, 21 nt, Human
gcuuaauagcccucccccuca

SEQ ID NO: 104991 - RNA, 21 nt, Human
ucacccgagcuggagugcagu

SEQ ID NO: 104992 - RNA, 19 nt, Human
uucucaugucuaccaggaa

SEQ ID NO: 104993 - RNA, 22 nt, Human
cuuaccucccagcuaccucuca

SEQ ID NO: 104994 - RNA, 21 nt, Human
ccuguaaucucagcacuuugg

SEQ ID NO: 104995 - RNA, 21 nt, Human
ccuguaaucccagcacucugg

SEQ ID NO: 104996 - RNA, 21 nt, Human
cuuguaaucccagcacuuugg

SEQ ID NO: 104997 - RNA, 24 nt, Human
ugucacccacgcuggagugcugug

SEQ ID NO: 104998 - RNA, 23 nt, Human
ccagccuggcccugagcugcugg

SEQ ID NO: 104999 - RNA, 22 nt, Human
cccaccccacgccugacucccc

SEQ ID NO: 105000 - RNA, 22 nt, Human
guuuucuguuuucuacuuucuu

SEQ ID NO: 105001 - RNA, 22 nt, Human
ccccaacagaaguguucacagu

SEQ ID NO: 105002 - RNA, 25 nt, Human
auaguuacagcaguggaauaaguau

SEQ ID NO: 105003 - RNA, 24 nt, Human
uucugucuugaagggcaggugcuu

SEQ ID NO: 105004 - RNA, 24 nt, Human
cacagccgcgccaugaccacccag

SEQ ID NO: 105005 - RNA, 28 nt, Human
agguugcgccacugcacuccagccuggg

SEQ ID NO: 105006 - RNA, 21 nt, Human
ccuccaaacacugggcucuga

SEQ ID NO: 105007 - RNA, 20 nt, Human
ccuccuccucuucaccaggu

SEQ ID NO: 105008 - RNA, 22 nt, Human
ccaaucagaaucacagaaaaau

SEQ ID NO: 105009 - RNA, 18 nt, Human
uggagaagagguugcuga

SEQ ID NO: 105010 - RNA, 25 nt, Human
ugaucacuuuguuaaaaauauuuuc

SEQ ID NO: 105011 - RNA, 22 nt, Human
agcaggcggcgggaugcggcgg

SEQ ID NO: 105012 - RNA, 27 nt, Human
ccccaacaaaacccauaccuaucaagc

SEQ ID NO: 105013 - RNA, 22 nt, Human
ucuccaccccuccgccaauggc

SEQ ID NO: 105014 - RNA, 22 nt, Human
aaacauucagaccagggaacgg

SEQ ID NO: 105015 - RNA, 26 nt, Human
uuccaacuuuugucugccucauucua

SEQ ID NO: 105016 - RNA, 22 nt, Human
accagccuggccaaugugguga

SEQ ID NO: 105017 - RNA, 22 nt, Human
uuuuccauauagagcacuaugu

SEQ ID NO: 105018 - RNA, 19 nt, Human
gucaccuccucagugcagu

SEQ ID NO: 105019 - RNA, 21 nt, Human
gaggaagagggagucugagca

SEQ ID NO: 105020 - RNA, 21 nt, Human
ccaguauuuguaauaaucgag

SEQ ID NO: 105021 - RNA, 23 nt, Human
uuaguaaagacaggguuuugcca

SEQ ID NO: 105022 - RNA, 23 nt, Human
uuaguaaagaugggguuucacca

SEQ ID NO: 105023 - RNA, 18 nt, Human
cgacugugcaaugcugug

SEQ ID NO: 105024 - RNA, 20 nt, Human
auggcucugucuuauuguuu

SEQ ID NO: 105025 - RNA, 21 nt, Human
cugcaccugcugucagccugg

SEQ ID NO: 105026 - RNA, 23 nt, Human
ugcuucacagcgcccaccugucu

SEQ ID NO: 105027 - RNA, 25 nt, Human
cucucucugccccaggaugaucuuc

SEQ ID NO: 105028 - RNA, 21 nt, Human
auuuggacugauucuccauuu

SEQ ID NO: 105029 - RNA, 20 nt, Human
ggaggccggcguggggaaga

SEQ ID NO: 105030 - RNA, 22 nt, Human
cugguccugcgacccacugucu

SEQ ID NO: 105031 - RNA, 20 nt, Human
ccucauaagcauaaaaagaa

SEQ ID NO: 105032 - RNA, 30 nt, Human
augucucuagcagugaguacucauaaagga

SEQ ID NO: 105033 - RNA, 27 nt, Human
uuaguaaauaaaauuaaugcauuucua

SEQ ID NO: 105034 - RNA, 18 nt, Human
gcugagcgcucucuuagg

SEQ ID NO: 105035 - RNA, 18 nt, Human
gcucacugcugcugccuc

SEQ ID NO: 105036 - RNA, 28 nt, Human
ggcagagguagagcaggucucucugcag

SEQ ID NO: 105037 - RNA, 20 nt, Human
gguaagacagaaucucucug

SEQ ID NO: 105038 - RNA, 27 nt, Human
ugcuguugucugaggaaugguuuggug

SEQ ID NO: 105039 - RNA, 26 nt, Human
aggcagagaucaggugggcagaggcu

SEQ ID NO: 105040 - RNA, 20 nt, Human
aauaggaauugauucauucu

SEQ ID NO: 105041 - RNA, 22 nt, Human
auuuucucccacccucucggcu

SEQ ID NO: 105042 - RNA, 22 nt, Human
cuuggauuucucguuccagaaa

SEQ ID NO: 105043 - RNA, 18 nt, Human
uucccaagcucccuuccg

SEQ ID NO: 105044 - RNA, 22 nt, Human
ugccuguaauccgagcacuuug

SEQ ID NO: 105045 - RNA, 25 nt, Human
aguccuagcuacucgggaggcugag

SEQ ID NO: 105046 - RNA, 24 nt, Human
accgcaacccauccagugccagcu

SEQ ID NO: 105047 - RNA, 20 nt, Human
guugcuucagccagugcagu

SEQ ID NO: 105048 - RNA, 27 nt, Human
gggaggcggacagcagugaccaccucc

SEQ ID NO: 105049 - RNA, 20 nt, Human
uuucacugagagcugccucc

SEQ ID NO: 105050 - RNA, 25 nt, Human
cacuguuuucaauaaaugcaccuua

SEQ ID NO: 105051 - RNA, 24 nt, Human
ugggagggggacaggcauuguugc

SEQ ID NO: 105052 - RNA, 20 nt, Human
ggcugguggagauguaggaa

SEQ ID NO: 105053 - RNA, 27 nt, Human
cugagacugaacacugagggcaggagc

SEQ ID NO: 105054 - RNA, 21 nt, Human
aggucaaggaaggaaaauacu

SEQ ID NO: 105055 - RNA, 24 nt, Human
aggcugagaagcagccacaccguu

SEQ ID NO: 105056 - RNA, 21 nt, Human
uacuguaauacuucuuuguua

SEQ ID NO: 105057 - RNA, 21 nt, Human
ggcaacugucaggcagaggaa

SEQ ID NO: 105058 - RNA, 19 nt, Human
uugacaucucuugccuugu

SEQ ID NO: 105059 - RNA, 24 nt, Human
gugcuucauuaaggugaacucauc

SEQ ID NO: 105060 - RNA, 26 nt, Human
ucuuucuccccaaggagggacgucuu

SEQ ID NO: 105061 - RNA, 22 nt, Human
ccaggagguuguggauacagug

SEQ ID NO: 105062 - RNA, 23 nt, Human
cugggagauggaaguugcaguga

SEQ ID NO: 105063 - RNA, 22 nt, Human
ugauuguaccacugcacuccag

SEQ ID NO: 105064 - RNA, 23 nt, Human
uuucuccucccccuugcuugcau

SEQ ID NO: 105065 - RNA, 20 nt, Human
caaaacaacugguacauguu

SEQ ID NO: 105066 - RNA, 24 nt, Human
uuguagccccuccuacccccuccc

SEQ ID NO: 105067 - RNA, 19 nt, Human
ccaugaacaucauggacug

SEQ ID NO: 105068 - RNA, 20 nt, Human
ugugagaugaauacuuccug

SEQ ID NO: 105069 - RNA, 21 nt, Human
accucacugcaaccuccgccu

SEQ ID NO: 105070 - RNA, 21 nt, Human
uaccccuggggcaucguggaa

SEQ ID NO: 105071 - RNA, 21 nt, Human
cugccaccgcuggggaggcac

SEQ ID NO: 105072 - RNA, 22 nt, Human
agccuccuguguagcugggauu

SEQ ID NO: 105073 - RNA, 22 nt, Human
cauacaccacugcaaaaugucu

SEQ ID NO: 105074 - RNA, 23 nt, Human
caucgacgacuucccggggcgac

SEQ ID NO: 105075 - RNA, 27 nt, Human
ccccaagaauacuuaaggggugggucc

SEQ ID NO: 105076 - RNA, 20 nt, Human
gacagucuagaccaggguuu

SEQ ID NO: 105077 - RNA, 20 nt, Human
ucacuuuccaagugccaaag

SEQ ID NO: 105078 - RNA, 22 nt, Human
cauuaugagcuaaaagcugugg

SEQ ID NO: 105079 - RNA, 26 nt, Human
cugcaaccuccgccuccuggauucca

SEQ ID NO: 105080 - RNA, 27 nt, Human
uucugccccucuucagacaguccuuca

SEQ ID NO: 105081 - RNA, 21 nt, Human
ucacccaggcuugagugcagu

SEQ ID NO: 105082 - RNA, 22 nt, Human
uguucuucauuaccucagugag

SEQ ID NO: 105083 - RNA, 23 nt, Human
uccuaugcuccccuugcccugcc

SEQ ID NO: 105084 - RNA, 29 nt, Human
aaauaucccuuggacauuuuaugucuuuc

SEQ ID NO: 105085 - RNA, 27 nt, Human
gcacagcccuguaacugcacgugccuu

SEQ ID NO: 105086 - RNA, 23 nt, Human
cggccagagucacacacgguccu

SEQ ID NO: 105087 - RNA, 19 nt, Human
gguuucaucauguuggcca

SEQ ID NO: 105088 - RNA, 21 nt, Human
cagauguuugcauauaugccu

SEQ ID NO: 105089 - RNA, 21 nt, Human
uuaaaaaacaacuuguaaaaa

SEQ ID NO: 105090 - RNA, 25 nt, Human
auccaguuaccaccuccugccucag

SEQ ID NO: 105091 - RNA, 21 nt, Human
aaagggagacuauuucaaagc

SEQ ID NO: 105092 - RNA, 20 nt, Human
aaaaucuugcaguuuuguaa

SEQ ID NO: 105093 - RNA, 28 nt, Human
uugaugcugaggagaaauggaagugggc

SEQ ID NO: 105094 - RNA, 23 nt, Human
uccuuucaagacagaaagagaca

SEQ ID NO: 105095 - RNA, 20 nt, Human
ccugugcagggcccucuggg

SEQ ID NO: 105096 - RNA, 20 nt, Human
cagauuuuuacuuuuuccca

SEQ ID NO: 105097 - RNA, 22 nt, Human
uguggugacauugcauuagucu

SEQ ID NO: 105098 - RNA, 21 nt, Human
ucuguucucccucccugccau

SEQ ID NO: 105099 - RNA, 23 nt, Human
cacaucccagcucugcauggccc

SEQ ID NO: 105100 - RNA, 24 nt, Human
gaaagaaaaaggaccagaaccgug

SEQ ID NO: 105101 - RNA, 24 nt, Human
agcauccaggcuggccagugcugc

SEQ ID NO: 105102 - RNA, 27 nt, Human
acugucaccaguuagccacuguuuaaa

SEQ ID NO: 105103 - RNA, 20 nt, Human
gcauauaggauguuugggag

SEQ ID NO: 105104 - RNA, 26 nt, Human
ccaugucuuuauuuucucaauaaaga

SEQ ID NO: 105105 - RNA, 20 nt, Human
auguaacaaaguuugcugaa

SEQ ID NO: 105106 - RNA, 28 nt, Human
ugacagucucuggagaaaucccuuagga

SEQ ID NO: 105107 - RNA, 26 nt, Human
gccuuugccagcauguucaacagcuc

SEQ ID NO: 105108 - RNA, 22 nt, Human
agaagggcugaagcuggaagac

SEQ ID NO: 105109 - RNA, 22 nt, Human
ccgagaucaggccauugcacuu

SEQ ID NO: 105110 - RNA, 25 nt, Human
aaucagucuuaagaaaauguugaca

SEQ ID NO: 105111 - RNA, 24 nt, Human
ggcaguguagacagcaggaggagc

SEQ ID NO: 105112 - RNA, 23 nt, Human
uauuacagcuaacacaguaaaga

SEQ ID NO: 105113 - RNA, 22 nt, Human
ggcugcugggcucuccaccuca

SEQ ID NO: 105114 - RNA, 26 nt, Human
cuuccucccuuccuuucacagccggu

SEQ ID NO: 105115 - RNA, 23 nt, Human
caccgcuucuccucacaccccag

SEQ ID NO: 105116 - RNA, 21 nt, Human
agaaaacuuguuuacagcucc

SEQ ID NO: 105117 - RNA, 25 nt, Human
agcugaauacaacccaaaugucuau

SEQ ID NO: 105118 - RNA, 23 nt, Human
cagguauuauaccauuuuucuau

SEQ ID NO: 105119 - RNA, 23 nt, Human
cucacccaggcacugggcaagug

SEQ ID NO: 105120 - RNA, 27 nt, Human
uuuccacccugucuaggcacauguggu

SEQ ID NO: 105121 - RNA, 23 nt, Human
cagccccgccuccgcccccuggg

SEQ ID NO: 105122 - RNA, 27 nt, Human
cccuccugcuccucuacgcugccucag

SEQ ID NO: 105123 - RNA, 20 nt, Human
uauacuagaaaacaaaaaga

SEQ ID NO: 105124 - RNA, 24 nt, Human
uauagcaaagauauauauucacca

SEQ ID NO: 105125 - RNA, 25 nt, Human
ccuacucccagcucccaaggagacu

SEQ ID NO: 105126 - RNA, 23 nt, Human
auaccuguaaaucccagcacuuu

SEQ ID NO: 105127 - RNA, 21 nt, Human
cugggauuugccggugcucaa

SEQ ID NO: 105128 - RNA, 25 nt, Human
cccaggcuggagugcagugagcuau

SEQ ID NO: 105129 - RNA, 22 nt, Human
guaugcuacuauugcuacuucu

SEQ ID NO: 105130 - RNA, 18 nt, Human
ugguauuugcucugugau

SEQ ID NO: 105131 - RNA, 23 nt, Human
uccaucuugcagagaaguuuaca

SEQ ID NO: 105132 - RNA, 24 nt, Human
aggaacacuuuauauaaaugagug

SEQ ID NO: 105133 - RNA, 18 nt, Human
auuaaacguuucugcacu

SEQ ID NO: 105134 - RNA, 22 nt, Human
ccaugauuuugcuagaaauaga

SEQ ID NO: 105135 - RNA, 22 nt, Human
gggaggguauacagggagcccc

SEQ ID NO: 105136 - RNA, 21 nt, Human
uccuuugaucuauuuuugguc

SEQ ID NO: 105137 - RNA, 21 nt, Human
aguauagcucauuacagcuuu

SEQ ID NO: 105138 - RNA, 21 nt, Human
cuucuuucuggccaucuugac

SEQ ID NO: 105139 - RNA, 19 nt, Human
ccccaaaagaugccgcguc

SEQ ID NO: 105140 - RNA, 22 nt, Human
gagcaacagccccagagccugg

SEQ ID NO: 105141 - RNA, 22 nt, Human
guugcccaaccuggagugcagu

SEQ ID NO: 105142 - RNA, 27 nt, Human
cagucuggagugcaguggugugaucau

SEQ ID NO: 105143 - RNA, 18 nt, Human
ucugggagaggccgcucu

SEQ ID NO: 105144 - RNA, 22 nt, Human
uacccuuaccagccacugguaa

SEQ ID NO: 105145 - RNA, 23 nt, Human
uuuaaaauauuaauuugcugcua

SEQ ID NO: 105146 - RNA, 23 nt, Human
ugcacgcauguauaugcaucacc

SEQ ID NO: 105147 - RNA, 21 nt, Human
auucacacuauaauacauguc

SEQ ID NO: 105148 - RNA, 23 nt, Human
uuugguguuuggcccugcagucc

SEQ ID NO: 105149 - RNA, 23 nt, Human
cccuacccuuguuaguuauuuua

SEQ ID NO: 105150 - RNA, 21 nt, Human
gcugucauucugucauugcug

SEQ ID NO: 105151 - RNA, 21 nt, Human
aguguccacaggggcuuggga

SEQ ID NO: 105152 - RNA, 26 nt, Human
uaaaauucugggaaacagggacugag

SEQ ID NO: 105153 - RNA, 25 nt, Human
gcgcuccagggcccagggcgccgca

SEQ ID NO: 105154 - RNA, 19 nt, Human
cccaggcuggcgugcagug

SEQ ID NO: 105155 - RNA, 23 nt, Human
uuacuuaaaagacuuucaguuaa

SEQ ID NO: 105156 - RNA, 19 nt, Human
gaaaccauauuuugguuaa

SEQ ID NO: 105157 - RNA, 22 nt, Human
ggauacuuaggugguuucuuca

SEQ ID NO: 105158 - RNA, 23 nt, Human
uuugguuuuccuuucuuuacuua

SEQ ID NO: 105159 - RNA, 22 nt, Human
gcggguggauccauugagguca

SEQ ID NO: 105160 - RNA, 25 nt, Human
gccuaaaccucaguuauuacaugua

SEQ ID NO: 105161 - RNA, 21 nt, Human
cccagugccugagauugaaaa

SEQ ID NO: 105162 - RNA, 19 nt, Human
cuggucucuucaccacugu

SEQ ID NO: 105163 - RNA, 21 nt, Human
uccaccuauuuugcaaacaaa

SEQ ID NO: 105164 - RNA, 19 nt, Human
ugacccaggcugggcaagg

SEQ ID NO: 105165 - RNA, 21 nt, Human
agaugccaaccagacaccucc

SEQ ID NO: 105166 - RNA, 26 nt, Human
ucccgaugccucccuugaggguuuga

SEQ ID NO: 105167 - RNA, 28 nt, Human
ugagggccaccuccacacccacccccuc

SEQ ID NO: 105168 - RNA, 27 nt, Human
ccuggaggcagagaugcaguuaccuac

SEQ ID NO: 105169 - RNA, 21 nt, Human
gggucguucuggcuuuuuguu

SEQ ID NO: 105170 - RNA, 24 nt, Human
guuuagaagaaaagaaagcucuau

SEQ ID NO: 105171 - RNA, 22 nt, Human
uucuugcugccuuuuucaccca

SEQ ID NO: 105172 - RNA, 28 nt, Human
gaaaucauuugaauuuuguuuuuguacg

SEQ ID NO: 105173 - RNA, 21 nt, Human
uguuccuuuaguuuguuuugg

SEQ ID NO: 105174 - RNA, 24 nt, Human
gggaaagagauggauguuggggag

SEQ ID NO: 105175 - RNA, 23 nt, Human
uuucuuucagccacaguguguaa

SEQ ID NO: 105176 - RNA, 21 nt, Human
gaaucugaaccauguggcaga

SEQ ID NO: 105177 - RNA, 19 nt, Human
gcaguuucagggccccucc

SEQ ID NO: 105178 - RNA, 26 nt, Human
ucgcccaggcuggagugcaaugccgu

SEQ ID NO: 105179 - RNA, 25 nt, Human
aagagauguagacaaaugaacaagc

SEQ ID NO: 105180 - RNA, 21 nt, Human
guuagaacauuuuaaguggca

SEQ ID NO: 105181 - RNA, 26 nt, Human
cacgugcucaccugucccccuccucg

SEQ ID NO: 105182 - RNA, 24 nt, Human
uuguaccugcuuugacugaugcug

SEQ ID NO: 105183 - RNA, 23 nt, Human
auuuuauucuugaucaguaguuu

SEQ ID NO: 105184 - RNA, 30 nt, Human
gauuuuagcugcagaacuguauugguccag

SEQ ID NO: 105185 - RNA, 21 nt, Human
uggucucaaacuccugacucg

SEQ ID NO: 105186 - RNA, 22 nt, Human
aguuguuucaaugcuguaagua

SEQ ID NO: 105187 - RNA, 23 nt, Human
cugguauuuggagcaagugacau

SEQ ID NO: 105188 - RNA, 26 nt, Human
cugccuggugugucugaugagaagcg

SEQ ID NO: 105189 - RNA, 20 nt, Human
cuucacccaggaggaguggg

SEQ ID NO: 105190 - RNA, 24 nt, Human
agagguaaaguaauuuccccaagg

SEQ ID NO: 105191 - RNA, 20 nt, Human
accaaaaucucagcuucaca

SEQ ID NO: 105192 - RNA, 28 nt, Human
agcauauugagaaccucuucagugaccu

SEQ ID NO: 105193 - RNA, 22 nt, Human
aacccugucuuccuccaguucu

SEQ ID NO: 105194 - RNA, 26 nt, Human
ucaggacugaacgccacaccucagga

SEQ ID NO: 105195 - RNA, 22 nt, Human
ggucucgaacuccuggccuagg

SEQ ID NO: 105196 - RNA, 22 nt, Human
uucugugucuucacauuuuucu

SEQ ID NO: 105197 - RNA, 21 nt, Human
ucugggaguugcuguuaaucu

SEQ ID NO: 105198 - RNA, 22 nt, Human
augccuggccccuugacacauc

SEQ ID NO: 105199 - RNA, 32 nt, Human
ugcuuuguauuaaaccucuuugucuacacaug

SEQ ID NO: 105200 - RNA, 26 nt, Human
ugcacguuucaggguguguuugcaua

SEQ ID NO: 105201 - RNA, 26 nt, Human
cuuacacacuugcuguuccaccuucc

SEQ ID NO: 105202 - RNA, 22 nt, Human
cuuuuuaaaauuuaauuuucua

SEQ ID NO: 105203 - RNA, 27 nt, Human
aaauguccuguauucugggaucaauuu

SEQ ID NO: 105204 - RNA, 26 nt, Human
caggaggcggaggcggaggcggaggg

SEQ ID NO: 105205 - RNA, 23 nt, Human
uugggugcuggaguuggaggagg

SEQ ID NO: 105206 - RNA, 24 nt, Human
caugcucuugugccuucccccucu

SEQ ID NO: 105207 - RNA, 21 nt, Human
cugugaucuuaccacuucaaa

SEQ ID NO: 105208 - RNA, 22 nt, Human
caauuccacaaccaccuugacg

SEQ ID NO: 105209 - RNA, 28 nt, Human
ccucacgugccugaucugugcccuuggu

SEQ ID NO: 105210 - RNA, 24 nt, Human
aauuccuacuuccugauuggauug

SEQ ID NO: 105211 - RNA, 23 nt, Human
ccaagccccacacccgcagaccc

SEQ ID NO: 105212 - RNA, 27 nt, Human
uagcugcagagcuggauuagcuguuga

SEQ ID NO: 105213 - RNA, 21 nt, Human
cucucuugucucccaggcugg

SEQ ID NO: 105214 - RNA, 23 nt, Human
ggaauuugccauucugcuguaca

SEQ ID NO: 105215 - RNA, 24 nt, Human
ggacuuguuuuuuauccugccuca

SEQ ID NO: 105216 - RNA, 27 nt, Human
acccuccucccacuucuuucucugcac

SEQ ID NO: 105217 - RNA, 24 nt, Human
ugcugcugcugccugggucucugc

SEQ ID NO: 105218 - RNA, 20 nt, Human
ccucccaaugugcugggauu

SEQ ID NO: 105219 - RNA, 19 nt, Human
gugagaccacgugcugcug

SEQ ID NO: 105220 - RNA, 20 nt, Human
cacucugcucaguccuacag

SEQ ID NO: 105221 - RNA, 19 nt, Human
gauaccauucuauucucca

SEQ ID NO: 105222 - RNA, 27 nt, Human
gagcagggcuggagggaaggagccagg

SEQ ID NO: 105223 - RNA, 21 nt, Human
ugccuuuuucaccucugacag

SEQ ID NO: 105224 - RNA, 21 nt, Human
auaaauaucuaaaauacauau

SEQ ID NO: 105225 - RNA, 20 nt, Human
agcuacauucacacacucac

SEQ ID NO: 105226 - RNA, 21 nt, Human
uguaguaaaccuuuaaaacuc

SEQ ID NO: 105227 - RNA, 23 nt, Human
gcagagggagcaggaagaguugc

SEQ ID NO: 105228 - RNA, 27 nt, Human
uucauuugggcaaaaauugagccucac

SEQ ID NO: 105229 - RNA, 22 nt, Human
cacccaggcuagagugcagugg

SEQ ID NO: 105230 - RNA, 22 nt, Human
cacccaggcuggagugcaaugg

SEQ ID NO: 105231 - RNA, 22 nt, Human
cucccaggcuggagugcuaugg

SEQ ID NO: 105232 - RNA, 22 nt, Human
cuacuucuaagacaauguagag

SEQ ID NO: 105233 - RNA, 27 nt, Human
cccuggcuucccccuuccucugggcag

SEQ ID NO: 105234 - RNA, 22 nt, Human
agcuaauauucuauguuuaauu

SEQ ID NO: 105235 - RNA, 26 nt, Human
gugggacacugggcgccuccuccucc

SEQ ID NO: 105236 - RNA, 26 nt, Human
uguguaguguaaggucggguccaguu

SEQ ID NO: 105237 - RNA, 21 nt, Human
cucagcuuaacauggaaauga

SEQ ID NO: 105238 - RNA, 24 nt, Human
cauguuugaagugcaaaucugugg

SEQ ID NO: 105239 - RNA, 22 nt, Human
gucgcccaggcuggagcgcagu

SEQ ID NO: 105240 - RNA, 23 nt, Human
gucgcucagccuggagugcagug

SEQ ID NO: 105241 - RNA, 22 nt, Human
caaaaguaaauguucucuuugc

SEQ ID NO: 105242 - RNA, 21 nt, Human
ucccugaaggaaccaaagcga

SEQ ID NO: 105243 - RNA, 27 nt, Human
cagauugcuuaaaagcauuuuuauuau

SEQ ID NO: 105244 - RNA, 26 nt, Human
gcugcuuguccuguucaaguugcugg

SEQ ID NO: 105245 - RNA, 27 nt, Human
ucuccuuccucuuccucaugaaugggc

SEQ ID NO: 105246 - RNA, 27 nt, Human
ugccuguaaagcucucagcauuggcuu

SEQ ID NO: 105247 - RNA, 20 nt, Human
gauuauauccccaacuccag

SEQ ID NO: 105248 - RNA, 26 nt, Human
gacaacaaagaggacaccauuuuucc

SEQ ID NO: 105249 - RNA, 20 nt, Human
ggugccccucauagugcagu

SEQ ID NO: 105250 - RNA, 27 nt, Human
cuacuauuugaaaaaagaagaggauau

SEQ ID NO: 105251 - RNA, 31 nt, Human
cccucccgccacucagcucaggcugaugaga

SEQ ID NO: 105252 - RNA, 24 nt, Human
agaaaacaaaacucuccaucgcug

SEQ ID NO: 105253 - RNA, 24 nt, Human
cuguugcccaggcuggagugcaga

SEQ ID NO: 105254 - RNA, 22 nt, Human
auggcucuuuuuaagauugaua

SEQ ID NO: 105255 - RNA, 23 nt, Human
agccuccucuucguaccucguuu

SEQ ID NO: 105256 - RNA, 27 nt, Human
uccucaaggaaucucuuaaguuuugcc

SEQ ID NO: 105257 - RNA, 27 nt, Human
acugccaccuccgccucucuaguucaa

SEQ ID NO: 105258 - RNA, 23 nt, Human
guaauacaaguaacuacacuacc

SEQ ID NO: 105259 - RNA, 20 nt, Human
gcuaggacaggaagccaggc

SEQ ID NO: 105260 - RNA, 20 nt, Human
aaucugaagaacagccccau

SEQ ID NO: 105261 - RNA, 24 nt, Human
ggaccgaggcacagaggugcggug

SEQ ID NO: 105262 - RNA, 27 nt, Human
ccccugcccuagugcaacaggcauugc

SEQ ID NO: 105263 - RNA, 22 nt, Human
guggugggggguagugguggca

SEQ ID NO: 105264 - RNA, 27 nt, Human
gcgcacaccuauaaucucagcuacuca

SEQ ID NO: 105265 - RNA, 18 nt, Human
cucuucccucuccuggcu

SEQ ID NO: 105266 - RNA, 24 nt, Human
ugccuaacuaucaaaggauuauag

SEQ ID NO: 105267 - RNA, 23 nt, Human
cccugucuccagcugccugggcc

SEQ ID NO: 105268 - RNA, 27 nt, Human
gaccagccugggcaacaggguaagguc

SEQ ID NO: 105269 - RNA, 20 nt, Human
ugcugcuggacgcagagcca

SEQ ID NO: 105270 - RNA, 22 nt, Human
aacugauuauauagaagaguug

SEQ ID NO: 105271 - RNA, 22 nt, Human
gccagacggcacgaggucucca

SEQ ID NO: 105272 - RNA, 21 nt, Human
aaauucacaucucaaggaggg

SEQ ID NO: 105273 - RNA, 21 nt, Human
cgcugcccugggcacgagguc

SEQ ID NO: 105274 - RNA, 22 nt, Human
uugauccuguuuuuccucucug

SEQ ID NO: 105275 - RNA, 23 nt, Human
uagccauuaugguuuuuccuuuc

SEQ ID NO: 105276 - RNA, 29 nt, Human
ggcuauagaucuuggccuucuucccugaa

SEQ ID NO: 105277 - RNA, 25 nt, Human
uucugaucuugccuucauguggacc

SEQ ID NO: 105278 - RNA, 24 nt, Human
uugcugucugcggagccagugugc

SEQ ID NO: 105279 - RNA, 21 nt, Human
cuugcacuagcugugccuuca

SEQ ID NO: 105280 - RNA, 21 nt, Human
uccuggagccucauggaacag

SEQ ID NO: 105281 - RNA, 24 nt, Human
cugggagcaaugggguugcagcug

SEQ ID NO: 105282 - RNA, 27 nt, Human
ugguucacaucuuguuuccuauagaaa

SEQ ID NO: 105283 - RNA, 27 nt, Human
ggaagcagcacuaaagcacucugaguc

SEQ ID NO: 105284 - RNA, 20 nt, Human
ggugccccccucaccuugau

SEQ ID NO: 105285 - RNA, 24 nt, Human
augcucugcaccucuuccuugcaa

SEQ ID NO: 105286 - RNA, 21 nt, Human
gucuccucccccucccccguc

SEQ ID NO: 105287 - RNA, 19 nt, Human
cuggaggcggaggcagcug

SEQ ID NO: 105288 - RNA, 23 nt, Human
agacuggagugcaguggcacgau

SEQ ID NO: 105289 - RNA, 22 nt, Human
cucuucagauccuggucugcac

SEQ ID NO: 105290 - RNA, 23 nt, Human
aggcuggagugcaguggcgcgau

SEQ ID NO: 105291 - RNA, 23 nt, Human
agguuggagugcaguggcgugau

SEQ ID NO: 105292 - RNA, 22 nt, Human
gcccaggcucacuucaguguug

SEQ ID NO: 105293 - RNA, 19 nt, Human
cccgggcgcuccuccccag

SEQ ID NO: 105294 - RNA, 26 nt, Human
agccuccucgucacccuucuccuuuu

SEQ ID NO: 105295 - RNA, 27 nt, Human
agagaggcgccuccucgcucccgccac

SEQ ID NO: 105296 - RNA, 27 nt, Human
cagcccaguuaccauuuauaagauuug

SEQ ID NO: 105297 - RNA, 22 nt, Human
uggaagcugccuccaguagaca

SEQ ID NO: 105298 - RNA, 21 nt, Human
acuuugggguuugcuuugcca

SEQ ID NO: 105299 - RNA, 20 nt, Human
cccugcacgcucugcgggga

SEQ ID NO: 105300 - RNA, 27 nt, Human
caggaaggaugaggaagaccaggcucu

SEQ ID NO: 105301 - RNA, 23 nt, Human
cugguccuuucucagccucucuc

SEQ ID NO: 105302 - RNA, 20 nt, Human
cgggcggcagguugcagugg

SEQ ID NO: 105303 - RNA, 22 nt, Human
aaagugcagggauuacaggcac

SEQ ID NO: 105304 - RNA, 21 nt, Human
acacaccuuggcugggucugg

SEQ ID NO: 105305 - RNA, 19 nt, Human
cccuuccaggucauccugc

SEQ ID NO: 105306 - RNA, 23 nt, Human
ccacggcccaggucuccucacuc

SEQ ID NO: 105307 - RNA, 22 nt, Human
ucggguggcaguugacuuggug

SEQ ID NO: 105308 - RNA, 27 nt, Human
ggcuacugacccuaaauuucugaagca

SEQ ID NO: 105309 - RNA, 22 nt, Human
gcugaacaaagagcauggcuug

SEQ ID NO: 105310 - RNA, 27 nt, Human
cuugccucccuuauaagcagaaacaau

SEQ ID NO: 105311 - RNA, 24 nt, Human
gacuaggaagaaaacaugacuuua

SEQ ID NO: 105312 - RNA, 25 nt, Human
ccgccagacccgccugcugagcccc

SEQ ID NO: 105313 - RNA, 21 nt, Human
guuuguaaauucuggaaaugu

SEQ ID NO: 105314 - RNA, 22 nt, Human
gaauuccugggcucaagcaguc

SEQ ID NO: 105315 - RNA, 23 nt, Human
uaagcaaugcagccuagaagcaa

SEQ ID NO: 105316 - RNA, 21 nt, Human
uccccuucccucacacccugc

SEQ ID NO: 105317 - RNA, 22 nt, Human
gcacagcccggcccgcggcccc

SEQ ID NO: 105318 - RNA, 22 nt, Human
ggcaccucacucccucagcucu

SEQ ID NO: 105319 - RNA, 26 nt, Human
gcucacugcuugcuugucagaaacac

SEQ ID NO: 105320 - RNA, 24 nt, Human
gcuugguauuuuuaauuuacuuca

SEQ ID NO: 105321 - RNA, 22 nt, Human
cagcuuguucugggcucaggga

SEQ ID NO: 105322 - RNA, 22 nt, Human
accaugccuggcuaauuuuugu

SEQ ID NO: 105323 - RNA, 27 nt, Human
aaacuauuccuaaucaacauggagugg

SEQ ID NO: 105324 - RNA, 23 nt, Human
uccccauacccuucagugcagug

SEQ ID NO: 105325 - RNA, 25 nt, Human
caacuguuauuucucucugaucauu

SEQ ID NO: 105326 - RNA, 22 nt, Human
ucuucuccccacccauccuggc

SEQ ID NO: 105327 - RNA, 20 nt, Human
ugccuucaguaaucagggug

SEQ ID NO: 105328 - RNA, 19 nt, Human
aaucuagauuuuguuuuca

SEQ ID NO: 105329 - RNA, 24 nt, Human
ggaaaucacugugauuuguacaua

SEQ ID NO: 105330 - RNA, 20 nt, Human
aaccucagauaagugcagug

SEQ ID NO: 105331 - RNA, 27 nt, Human
uucuccuggaccaaggcuugggaaaga

SEQ ID NO: 105332 - RNA, 23 nt, Human
uuuucuuuuacccauaaauaaca

SEQ ID NO: 105333 - RNA, 21 nt, Human
uuaauuuccauuucucugaug

SEQ ID NO: 105334 - RNA, 26 nt, Human
uugcccagcgacacugcuggacagga

SEQ ID NO: 105335 - RNA, 23 nt, Human
gggagagcagcuuccagccuggg

SEQ ID NO: 105336 - RNA, 27 nt, Human
cccuccagagccgggguuuguaaaccg

SEQ ID NO: 105337 - RNA, 19 nt, Human
acuuagcaagcucuuuuau

SEQ ID NO: 105338 - RNA, 22 nt, Human
ucugcccuugcugcccgcggga

SEQ ID NO: 105339 - RNA, 22 nt, Human
gguggaauuccugaggugcuuc

SEQ ID NO: 105340 - RNA, 22 nt, Human
cucgaaucaucccacuuccuca

SEQ ID NO: 105341 - RNA, 25 nt, Human
agccuagcagaggacuuuuuagcug

SEQ ID NO: 105342 - RNA, 22 nt, Human
ucucccacacucccacccacug

SEQ ID NO: 105343 - RNA, 27 nt, Human
gaucuaggcaccugcugucugaaggga

SEQ ID NO: 105344 - RNA, 26 nt, Human
augggcaauguggcgaaacuccaucu

SEQ ID NO: 105345 - RNA, 23 nt, Human
cuuuuauuauuucucuguauguu

SEQ ID NO: 105346 - RNA, 21 nt, Human
ggcugcaggcugagcucuaac

SEQ ID NO: 105347 - RNA, 20 nt, Human
uggaacguucucuaccuuca

SEQ ID NO: 105348 - RNA, 24 nt, Human
gaagaauuucgugccauguggaaa

SEQ ID NO: 105349 - RNA, 24 nt, Human
cugcaaccuugcauccaucugggc

SEQ ID NO: 105350 - RNA, 27 nt, Human
cucccacagggucccccuugccccagc

SEQ ID NO: 105351 - RNA, 25 nt, Human
ggcuguaucucccuucacugucucu

SEQ ID NO: 105352 - RNA, 21 nt, Human
cacugugugaaaagauaaaaa

SEQ ID NO: 105353 - RNA, 22 nt, Human
gucuccaccccucucauauuua

SEQ ID NO: 105354 - RNA, 21 nt, Human
gugaugauucugaaauccagg

SEQ ID NO: 105355 - RNA, 20 nt, Human
ggaaguggagacugcaguga

SEQ ID NO: 105356 - RNA, 21 nt, Human
uguccagcugauaguaguuag

SEQ ID NO: 105357 - RNA, 25 nt, Human
cugggguugcaucauuuccccaagu

SEQ ID NO: 105358 - RNA, 21 nt, Human
ugcuucuguucagguugcaca

SEQ ID NO: 105359 - RNA, 24 nt, Human
cacauuccacccuugccagagcca

SEQ ID NO: 105360 - RNA, 27 nt, Human
gucucgaacuccuggcaucaagcgauc

SEQ ID NO: 105361 - RNA, 27 nt, Human
gucucaaacuccuaggaucaagccauc

SEQ ID NO: 105362 - RNA, 22 nt, Human
uuugcuugaacccaggaggcag

SEQ ID NO: 105363 - RNA, 22 nt, Human
caaacuccugaccugaggcgau

SEQ ID NO: 105364 - RNA, 21 nt, Human
cuugcaaagcaaguugccugu

SEQ ID NO: 105365 - RNA, 23 nt, Human
uauacucuuaggguauuauuuua

SEQ ID NO: 105366 - RNA, 21 nt, Human
ggugcagcuggaggccugugu

SEQ ID NO: 105367 - RNA, 24 nt, Human
ccccgcaguccaugccucagucgg

SEQ ID NO: 105368 - RNA, 20 nt, Human
aaauagggcuccucucuccu

SEQ ID NO: 105369 - RNA, 20 nt, Human
gaagauagccgcuguggcag

SEQ ID NO: 105370 - RNA, 21 nt, Human
ggaaggagguggagcagcugg

SEQ ID NO: 105371 - RNA, 22 nt, Human
ggaaggcggaguucaggcugag

SEQ ID NO: 105372 - RNA, 27 nt, Human
aggagcugaagagucuggguagcuugu

SEQ ID NO: 105373 - RNA, 28 nt, Human
gggccuccugccuuccucccaggccccc

SEQ ID NO: 105374 - RNA, 21 nt, Human
cuugggcacagggaaguucug

SEQ ID NO: 105375 - RNA, 27 nt, Human
ggagagggagguggucauagagucagg

SEQ ID NO: 105376 - RNA, 22 nt, Human
uggagucuugcucugucaccca

SEQ ID NO: 105377 - RNA, 22 nt, Human
cagagucuugcucuguugccca

SEQ ID NO: 105378 - RNA, 22 nt, Human
cagagucucgcucugucgccca

SEQ ID NO: 105379 - RNA, 22 nt, Human
cagagucucacucugucaccca

SEQ ID NO: 105380 - RNA, 22 nt, Human
auagcauaaagcuuuaguuugg

SEQ ID NO: 105381 - RNA, 20 nt, Human
aacuuauuucaagggugcug

SEQ ID NO: 105382 - RNA, 21 nt, Human
cuaagcugcgccuccugucau

SEQ ID NO: 105383 - RNA, 26 nt, Human
uuguccuaacaguccacaguccugcc

SEQ ID NO: 105384 - RNA, 22 nt, Human
aacaaagcugugaaucacugca

SEQ ID NO: 105385 - RNA, 22 nt, Human
ucauugcagccucagacuccug

SEQ ID NO: 105386 - RNA, 22 nt, Human
cacaugaaguccaagcauuuag

SEQ ID NO: 105387 - RNA, 22 nt, Human
aagaagccuuuguucaggucuc

SEQ ID NO: 105388 - RNA, 24 nt, Human
aaaagaaccacacuagggucucca

SEQ ID NO: 105389 - RNA, 27 nt, Human
ugaggcugccuuggauggccucaggcc

SEQ ID NO: 105390 - RNA, 22 nt, Human
uuuaguauuuugucuuuguaau

SEQ ID NO: 105391 - RNA, 26 nt, Human
aaaaguucuuaguaaacugcagccag

SEQ ID NO: 105392 - RNA, 21 nt, Human
cccuugcucuuuccucucuua

SEQ ID NO: 105393 - RNA, 22 nt, Human
acagacaccagcaaagcaaugu

SEQ ID NO: 105394 - RNA, 19 nt, Human
agagccccaaaaaucgaaa

SEQ ID NO: 105395 - RNA, 24 nt, Human
uugguaugcaguguuaaugcucag

SEQ ID NO: 105396 - RNA, 22 nt, Human
accccuucccugcuugcacccu

SEQ ID NO: 105397 - RNA, 27 nt, Human
acaggcgagcucaggugaugccggcca

SEQ ID NO: 105398 - RNA, 24 nt, Human
cacagccagcagauagaggaaaag

SEQ ID NO: 105399 - RNA, 20 nt, Human
auuuaugacagugcauaauu

SEQ ID NO: 105400 - RNA, 28 nt, Human
uugggacccgcuaugcagguccuggcaa

SEQ ID NO: 105401 - RNA, 21 nt, Human
cuucccuuuguuccuuaguca

SEQ ID NO: 105402 - RNA, 20 nt, Human
uccucucucacccacacuca

SEQ ID NO: 105403 - RNA, 21 nt, Human
uagaggcggaguuugcaguga

SEQ ID NO: 105404 - RNA, 21 nt, Human
gagcaaagguuaauuuaagga

SEQ ID NO: 105405 - RNA, 28 nt, Human
uguguuccccauggaugaagacucugcu

SEQ ID NO: 105406 - RNA, 20 nt, Human
gauuaggaggagaaaaagag

SEQ ID NO: 105407 - RNA, 26 nt, Human
uacagucccuggaguggggcaggcga

SEQ ID NO: 105408 - RNA, 22 nt, Human
ugaggggcagaggcacaggugg

SEQ ID NO: 105409 - RNA, 24 nt, Human
aacuguuagaugcacacuguugau

SEQ ID NO: 105410 - RNA, 21 nt, Human
acccaggucaggauuuucaag

SEQ ID NO: 105411 - RNA, 23 nt, Human
gucccucuucaacacugccacau

SEQ ID NO: 105412 - RNA, 23 nt, Human
cacccagcagagcuucucagugg

SEQ ID NO: 105413 - RNA, 23 nt, Human
gccacagggcagcuauauagggg

SEQ ID NO: 105414 - RNA, 27 nt, Human
uccagagagaagucgaggaagagagag

SEQ ID NO: 105415 - RNA, 23 nt, Human
ugaauucuguugacccgcacuuu

SEQ ID NO: 105416 - RNA, 25 nt, Human
ucaauggacuuccugagaaggacag

SEQ ID NO: 105417 - RNA, 22 nt, Human
uggguuuauuuucauucugcca

SEQ ID NO: 105418 - RNA, 22 nt, Human
ccaagagguggagguuacagug

SEQ ID NO: 105419 - RNA, 20 nt, Human
ugggauaggaaaaaugagua

SEQ ID NO: 105420 - RNA, 26 nt, Human
uguuuaagaagaaaaaugaaaccaga

SEQ ID NO: 105421 - RNA, 26 nt, Human
ccugcagcuguuuuaagauagagacc

SEQ ID NO: 105422 - RNA, 23 nt, Human
caugccuguaaucccagcuacua

SEQ ID NO: 105423 - RNA, 24 nt, Human
cccagcucucucaggauucagcag

SEQ ID NO: 105424 - RNA, 27 nt, Human
ggcaucccucccugccggccucaggga

SEQ ID NO: 105425 - RNA, 23 nt, Human
acugauuuucaaggcagggucua

SEQ ID NO: 105426 - RNA, 26 nt, Human
ccugcagccccaucccaucuccugcc

SEQ ID NO: 105427 - RNA, 20 nt, Human
cuguguggcagcagagcucc

SEQ ID NO: 105428 - RNA, 22 nt, Human
ccacaagaauaagcagcaaaua

SEQ ID NO: 105429 - RNA, 21 nt, Human
gugaugagcagacauccucug

SEQ ID NO: 105430 - RNA, 25 nt, Human
cacagcucagcuugcucacgcccag

SEQ ID NO: 105431 - RNA, 20 nt, Human
agauagugacuuugagauag

SEQ ID NO: 105432 - RNA, 21 nt, Human
accuacucucagguuuuugag

SEQ ID NO: 105433 - RNA, 21 nt, Human
gugcucaggcuggugccagcc

SEQ ID NO: 105434 - RNA, 23 nt, Human
gacuugacagaacacugucuuga

SEQ ID NO: 105435 - RNA, 27 nt, Human
gggaacuuggagaggugugccuaaggu

SEQ ID NO: 105436 - RNA, 29 nt, Human
ugagaugagguuuuggaaaacccugacac

SEQ ID NO: 105437 - RNA, 23 nt, Human
cacaagaagaccagacuguggag

SEQ ID NO: 105438 - RNA, 22 nt, Human
uugcccagaguugggggcuagg

SEQ ID NO: 105439 - RNA, 22 nt, Human
gcucaggcuggaguacaguggc

SEQ ID NO: 105440 - RNA, 23 nt, Human
auguuugcaugggguuauugaga

SEQ ID NO: 105441 - RNA, 19 nt, Human
uauuuccccucccucucuc

SEQ ID NO: 105442 - RNA, 25 nt, Human
uggcuuugugcuuaugucauuucuu

SEQ ID NO: 105443 - RNA, 21 nt, Human
uucucaucuuuuaucuaacua

SEQ ID NO: 105444 - RNA, 22 nt, Human
aggagcuguguuaggcacuuua

SEQ ID NO: 105445 - RNA, 27 nt, Human
gagcagccuggaccacaagcccagugg

SEQ ID NO: 105446 - RNA, 25 nt, Human
gcaaucucccuuguccuccuucaaa

SEQ ID NO: 105447 - RNA, 24 nt, Human
cuguuaagguggcguguugcagug

SEQ ID NO: 105448 - RNA, 28 nt, Human
gcuguccucuccccucgcgcacagggcu

SEQ ID NO: 105449 - RNA, 24 nt, Human
cgcacacacagaugcucagucuca

SEQ ID NO: 105450 - RNA, 24 nt, Human
ugggaugauauggagguucaauga

SEQ ID NO: 105451 - RNA, 17 nt, Human
cagggcuucuggaacac

SEQ ID NO: 105452 - RNA, 22 nt, Human
uguucaccuuuuccuugcugau

SEQ ID NO: 105453 - RNA, 22 nt, Human
ugggcaacacggugaaacccca

SEQ ID NO: 105454 - RNA, 19 nt, Human
agcaucugccuaagccaga

SEQ ID NO: 105455 - RNA, 27 nt, Human
cguuguacuccagcuugggcaacagag

SEQ ID NO: 105456 - RNA, 18 nt, Human
ggaagucgaggcugcagu

SEQ ID NO: 105457 - RNA, 22 nt, Human
guuggccucccaacgugcuggg

SEQ ID NO: 105458 - RNA, 28 nt, Human
cuuuguuagccaccuccccacccacaua

SEQ ID NO: 105459 - RNA, 26 nt, Human
gccuuucucccucacaucaggaggua

SEQ ID NO: 105460 - RNA, 20 nt, Human
aauggguggaaaggugugag

SEQ ID NO: 105461 - RNA, 27 nt, Human
ucuuuacugcugagauccuugggaaca

SEQ ID NO: 105462 - RNA, 22 nt, Human
ccaagauuaagaggccaggaag

SEQ ID NO: 105463 - RNA, 24 nt, Human
auuuggcugcccugucccucuguu

SEQ ID NO: 105464 - RNA, 22 nt, Human
guucggcucagcucaacauggc

SEQ ID NO: 105465 - RNA, 20 nt, Human
uuguuuguuuuugcuuucug

SEQ ID NO: 105466 - RNA, 19 nt, Human
caaguuucuagcucucaca

SEQ ID NO: 105467 - RNA, 16 nt, Human
ccugcuccuugcccau

SEQ ID NO: 105468 - RNA, 23 nt, Human
gaagcauauuuugcugguuugaa

SEQ ID NO: 105469 - RNA, 21 nt, Human
aggaggcagcuguugcaguga

SEQ ID NO: 105470 - RNA, 21 nt, Human
aaggagcuucaguauuguggg

SEQ ID NO: 105471 - RNA, 23 nt, Human
ucucguguaacacuuguugcuug

SEQ ID NO: 105472 - RNA, 26 nt, Human
uguacauuccucauuuuacauucauu

SEQ ID NO: 105473 - RNA, 20 nt, Human
gggaaagagaaaguggaaga

SEQ ID NO: 105474 - RNA, 22 nt, Human
gcaacuccaagguccuacucuc

SEQ ID NO: 105475 - RNA, 24 nt, Human
gaagcuguacacacuguguagggu

SEQ ID NO: 105476 - RNA, 21 nt, Human
acuguauguaccucccucacu

SEQ ID NO: 105477 - RNA, 19 nt, Human
ccccagcccugaggagccg

SEQ ID NO: 105478 - RNA, 22 nt, Human
uggcucauuccuguaaucccag

SEQ ID NO: 105479 - RNA, 21 nt, Human
accucauugcaaccuccgccu

SEQ ID NO: 105480 - RNA, 20 nt, Human
agccucaucuuccugucucu

SEQ ID NO: 105481 - RNA, 21 nt, Human
uagugcauuaagccugagcca

SEQ ID NO: 105482 - RNA, 12 nt, Human
accaaugccuuc

SEQ ID NO: 105483 - RNA, 20 nt, Human
ccugccugguuuuucucuuc

SEQ ID NO: 105484 - RNA, 21 nt, Human
uggcccugaagaacagccaaa

SEQ ID NO: 105485 - RNA, 25 nt, Human
ggaucucaaacuugauuaaauguua

SEQ ID NO: 105486 - RNA, 20 nt, Human
ucugacaucaugguguuuuc

SEQ ID NO: 105487 - RNA, 20 nt, Human
ugaagggauauuuuucuuau

SEQ ID NO: 105488 - RNA, 21 nt, Human
aauuuuuuaagcaacuggaaa

SEQ ID NO: 105489 - RNA, 24 nt, Human
aauaucguuuuccauacagcagug

SEQ ID NO: 105490 - RNA, 23 nt, Human
ccagccggcugcaaguuuuguaa

SEQ ID NO: 105491 - RNA, 19 nt, Human
uagauggggagaaaaacac

SEQ ID NO: 105492 - RNA, 26 nt, Human
gaucuuuuuaaaugcauuauggcuca

SEQ ID NO: 105493 - RNA, 20 nt, Human
uacauucauuuucuuuucag

SEQ ID NO: 105494 - RNA, 21 nt, Human
ccaaacaccuuucccuuugcc

SEQ ID NO: 105495 - RNA, 19 nt, Human
uauuaagccugaauaggug

SEQ ID NO: 105496 - RNA, 22 nt, Human
acacacauguguguuguguaua

SEQ ID NO: 105497 - RNA, 24 nt, Human
cccagaaccuggcuccagccaggg

SEQ ID NO: 105498 - RNA, 23 nt, Human
aaaugauugaugcaaauuugcac

SEQ ID NO: 105499 - RNA, 26 nt, Human
cacucccggcacuccaugcuuaguca

SEQ ID NO: 105500 - RNA, 24 nt, Human
uucuaggugauucugaugcacaug

SEQ ID NO: 105501 - RNA, 27 nt, Human
ucccuauaccauccacccucauggugu

SEQ ID NO: 105502 - RNA, 26 nt, Human
gcuaauacuaucaucauugucauugu

SEQ ID NO: 105503 - RNA, 27 nt, Human
uggcucacgccuguaauccuaacacuu

SEQ ID NO: 105504 - RNA, 21 nt, Human
ucuuagcacccuuuccucaca

SEQ ID NO: 105505 - RNA, 26 nt, Human
gucugucaucucagcucuuuuguaac

SEQ ID NO: 105506 - RNA, 22 nt, Human
aaacagugucuugagcucuaaa

SEQ ID NO: 105507 - RNA, 21 nt, Human
aagaaaacaagcuaaaccuuu

SEQ ID NO: 105508 - RNA, 26 nt, Human
aggcuggagugcaguaaguggcacaa

SEQ ID NO: 105509 - RNA, 27 nt, Human
cacccagggauaaaaacagagaucauu

SEQ ID NO: 105510 - RNA, 23 nt, Human
ccuggaggacagugugugccaug

SEQ ID NO: 105511 - RNA, 25 nt, Human
gcccgcggccggcggcuccuccucc

SEQ ID NO: 105512 - RNA, 24 nt, Human
gccacaccucaggauuccuccucc

SEQ ID NO: 105513 - RNA, 25 nt, Human
accaguacccuuacauauaacacug

SEQ ID NO: 105514 - RNA, 27 nt, Human
guugcccaggucaggaguguuuucuug

SEQ ID NO: 105515 - RNA, 18 nt, Human
uguuuuuuguuacuguag

SEQ ID NO: 105516 - RNA, 26 nt, Human
gaggcugagacaggagaaucgcuuga

SEQ ID NO: 105517 - RNA, 19 nt, Human
uaugugccaagcuguuugg

SEQ ID NO: 105518 - RNA, 23 nt, Human
acgggcguccgcugucuccuggg

SEQ ID NO: 105519 - RNA, 27 nt, Human
gugcgcagguuugcacacucaaguucu

SEQ ID NO: 105520 - RNA, 22 nt, Human
caccucccggguucaaucaauu

SEQ ID NO: 105521 - RNA, 21 nt, Human
auaguauuuagugcccugaua

SEQ ID NO: 105522 - RNA, 22 nt, Human
ggcucagugcaaccuccgccuc

SEQ ID NO: 105523 - RNA, 19 nt, Human
uuucugcugauauucagca

SEQ ID NO: 105524 - RNA, 27 nt, Human
ugcccuauuuaguuuguggcuaaugug

SEQ ID NO: 105525 - RNA, 26 nt, Human
ccaugugaaccuggagagaccauccu

SEQ ID NO: 105526 - RNA, 26 nt, Human
uugucucuucugguggagcugugccu

SEQ ID NO: 105527 - RNA, 22 nt, Human
uguauauuuaagugucauagaa

SEQ ID NO: 105528 - RNA, 21 nt, Human
caauaauccuguuucacuuga

SEQ ID NO: 105529 - RNA, 24 nt, Human
ugaaaccuacaggaaucucugauu

SEQ ID NO: 105530 - RNA, 25 nt, Human
cccaacaacuuagcggaaacuucuc

SEQ ID NO: 105531 - RNA, 25 nt, Human
ugguggcaguugccuguaauccuag

SEQ ID NO: 105532 - RNA, 22 nt, Human
gguaggcagagguugcagugag

SEQ ID NO: 105533 - RNA, 23 nt, Human
cucugcaaauggcuuagcuacuu

SEQ ID NO: 105534 - RNA, 27 nt, Human
uugggaggcuggggcgagaggauugcu

SEQ ID NO: 105535 - RNA, 31 nt, Human
acucaucucugcacaaccucucugugccaug

SEQ ID NO: 105536 - RNA, 26 nt, Human
cucagcucacugcagccuccacuucc

SEQ ID NO: 105537 - RNA, 27 nt, Human
aucggccuggcccucacgguguccgcc

SEQ ID NO: 105538 - RNA, 27 nt, Human
cuucccaaucuucuuuuucaggcucgc

SEQ ID NO: 105539 - RNA, 18 nt, Human
ccaggcuggagugcaaug

SEQ ID NO: 105540 - RNA, 20 nt, Human
aaguguucucaguacccuuu

SEQ ID NO: 105541 - RNA, 21 nt, Human
ccugaacuuuaaaaauguaga

SEQ ID NO: 105542 - RNA, 25 nt, Human
agaaacugcuccagcuuuugcagcc

SEQ ID NO: 105543 - RNA, 22 nt, Human
guuaggcuuuuucauacaguau

SEQ ID NO: 105544 - RNA, 22 nt, Human
gugaucuccccucacacuuugc

SEQ ID NO: 105545 - RNA, 19 nt, Human
ucagcagacccagcaagag

SEQ ID NO: 105546 - RNA, 17 nt, Human
uuuuugcccaucccaaa

SEQ ID NO: 105547 - RNA, 23 nt, Human
uguugcccaggcugaagugcagu

SEQ ID NO: 105548 - RNA, 22 nt, Human
ccuccucggggcuccaggcugg

SEQ ID NO: 105549 - RNA, 26 nt, Human
caugguuauggcuggguaccaccaaa

SEQ ID NO: 105550 - RNA, 22 nt, Human
uaugucuucuguggaguuacag

SEQ ID NO: 105551 - RNA, 28 nt, Human
cggccuggaggagggagguugugguugg

SEQ ID NO: 105552 - RNA, 25 nt, Human
agaccugaggaacuuuacacugacc

SEQ ID NO: 105553 - RNA, 22 nt, Human
aagguggauggccccagcacag

SEQ ID NO: 105554 - RNA, 25 nt, Human
ccuuggauuuccuccagaguucgga

SEQ ID NO: 105555 - RNA, 29 nt, Human
ggaugcaauaaccaacaaagcugcuaagu

SEQ ID NO: 105556 - RNA, 20 nt, Human
ggggugcuggguguggggau

SEQ ID NO: 105557 - RNA, 21 nt, Human
gccacugugccugguuuuggg

SEQ ID NO: 105558 - RNA, 23 nt, Human
gaaacuugacaaguaucucucca

SEQ ID NO: 105559 - RNA, 21 nt, Human
uacugaacuccaguuuugauc

SEQ ID NO: 105560 - RNA, 21 nt, Human
cucucucuuuuucagugaaua

SEQ ID NO: 105561 - RNA, 22 nt, Human
gcaggcagaucaccugggguca

SEQ ID NO: 105562 - RNA, 22 nt, Human
ugcagugagucaagauugagcc

SEQ ID NO: 105563 - RNA, 23 nt, Human
guuucccgaggcugcuccaggga

SEQ ID NO: 105564 - RNA, 26 nt, Human
ugcuuuuuguuuuugccauuguguuu

SEQ ID NO: 105565 - RNA, 19 nt, Human
cuuccugguucaaucuugg

SEQ ID NO: 105566 - RNA, 23 nt, Human
ucuucucccuucacucccgucca

SEQ ID NO: 105567 - RNA, 22 nt, Human
gugcccaggcuggagugcaaua

SEQ ID NO: 105568 - RNA, 22 nt, Human
gggccacgggaacuuggagagg

SEQ ID NO: 105569 - RNA, 27 nt, Human
cuggugcaaaacaucugacuguagccg

SEQ ID NO: 105570 - RNA, 27 nt, Human
gcuccugcucgcaaccucgcgguuccu

SEQ ID NO: 105571 - RNA, 28 nt, Human
agagaccucccuguucaaggccccugac

SEQ ID NO: 105572 - RNA, 25 nt, Human
gaaugcuaaagaauguucaaacuuu

SEQ ID NO: 105573 - RNA, 23 nt, Human
gcaauuaauuuguaaacacugcc

SEQ ID NO: 105574 - RNA, 21 nt, Human
ccaccacaccuggcuuuagag

SEQ ID NO: 105575 - RNA, 28 nt, Human
cucaaggucaaugacaccccuggccuga

SEQ ID NO: 105576 - RNA, 23 nt, Human
ccuguaagugucuugggcucagg

SEQ ID NO: 105577 - RNA, 25 nt, Human
gcagcgcccuggccgggccaagcag

SEQ ID NO: 105578 - RNA, 23 nt, Human
gguuuggacaugaaauguaagaa

SEQ ID NO: 105579 - RNA, 27 nt, Human
ucugggaaguagggguuagcuugggga

SEQ ID NO: 105580 - RNA, 18 nt, Human
ugguaaugacuccagaac

SEQ ID NO: 105581 - RNA, 27 nt, Human
auuaccuaggcugagguuagagagauu

SEQ ID NO: 105582 - RNA, 22 nt, Human
gaugcccaggcucacuucagug

SEQ ID NO: 105583 - RNA, 22 nt, Human
ggcucaccacaaccucugccua

SEQ ID NO: 105584 - RNA, 20 nt, Human
cauuuuguaacagcuggacc

SEQ ID NO: 105585 - RNA, 23 nt, Human
agaaguuaaaauacccuuaagga

SEQ ID NO: 105586 - RNA, 23 nt, Human
uuaaacaauguaugaaagaugua

SEQ ID NO: 105587 - RNA, 26 nt, Human
ggugucaggaaacagacuaaaaagaa

SEQ ID NO: 105588 - RNA, 19 nt, Human
ucagaaaauaacacaaaaa

SEQ ID NO: 105589 - RNA, 21 nt, Human
ucagggcagcugcucugugac

SEQ ID NO: 105590 - RNA, 20 nt, Human
ggcagaggagggagcaucag

SEQ ID NO: 105591 - RNA, 21 nt, Human
aagcuccccucacucuguuuc

SEQ ID NO: 105592 - RNA, 21 nt, Human
gugcagcugcacaacacaguc

SEQ ID NO: 105593 - RNA, 25 nt, Human
ugguggcaggugcuuguaaucccag

SEQ ID NO: 105594 - RNA, 26 nt, Human
caggaaggagcccaggagcagaggaa

SEQ ID NO: 105595 - RNA, 22 nt, Human
uagguuuucaugucucuaguca

SEQ ID NO: 105596 - RNA, 22 nt, Human
ccuggacgcagaggugacagug

SEQ ID NO: 105597 - RNA, 22 nt, Human
aauucagaaugaucugcaagaa

SEQ ID NO: 105598 - RNA, 22 nt, Human
caccgucccucccuuuucuccu

SEQ ID NO: 105599 - RNA, 23 nt, Human
ugcgcugugcugagaagcugaau

SEQ ID NO: 105600 - RNA, 22 nt, Human
guuuuuagcaaaagcguccaga

SEQ ID NO: 105601 - RNA, 20 nt, Human
cagcuggugcccugcuuuca

SEQ ID NO: 105602 - RNA, 23 nt, Human
accugccucuggcuucucaggcc

SEQ ID NO: 105603 - RNA, 21 nt, Human
ucaucccuaggacaagcauag

SEQ ID NO: 105604 - RNA, 23 nt, Human
ccauguugcccaggagggucucg

SEQ ID NO: 105605 - RNA, 22 nt, Human
ucaggacaacugccugcugcua

SEQ ID NO: 105606 - RNA, 31 nt, Human
ucucauggcuugggcuggagugggcucucug

SEQ ID NO: 105607 - RNA, 26 nt, Human
ggugggccuggcccugcuuucuacgc

SEQ ID NO: 105608 - RNA, 28 nt, Human
ugaggaaggaagggguugcuguccagug

SEQ ID NO: 105609 - RNA, 26 nt, Human
uugugcaaagucaccugcccaauaaa

SEQ ID NO: 105610 - RNA, 27 nt, Human
ucauaaagaaaaaucaguuuuugacug

SEQ ID NO: 105611 - RNA, 21 nt, Human
cgcccaggcuagaguggauug

SEQ ID NO: 105612 - RNA, 23 nt, Human
ccugucuuccugucccuugucug

SEQ ID NO: 105613 - RNA, 24 nt, Human
aggcuggagugcagugccgcaauc

SEQ ID NO: 105614 - RNA, 22 nt, Human
cacccaggccguggggccaggg

SEQ ID NO: 105615 - RNA, 23 nt, Human
ccaucguccauuaaccaccuggu

SEQ ID NO: 105616 - RNA, 21 nt, Human
ggcucacugcaaccucgccuc

SEQ ID NO: 105617 - RNA, 25 nt, Human
aaccuggagaugguggaugaucccc

SEQ ID NO: 105618 - RNA, 24 nt, Human
aacuucauuagcauauuauggaac

SEQ ID NO: 105619 - RNA, 23 nt, Human
gaagaaggagagguggcaguuua

SEQ ID NO: 105620 - RNA, 21 nt, Human
uaacuggauuuuuucuggggc

SEQ ID NO: 105621 - RNA, 23 nt, Human
agcgguguccacccuugcccuca

SEQ ID NO: 105622 - RNA, 20 nt, Human
agccuuuucuuccuaucucu

SEQ ID NO: 105623 - RNA, 26 nt, Human
ucugcuuccugggcccugccagcauc

SEQ ID NO: 105624 - RNA, 20 nt, Human
gaacucucgcuuucuuuuua

SEQ ID NO: 105625 - RNA, 22 nt, Human
ggagagggagagagcgaacacc

SEQ ID NO: 105626 - RNA, 20 nt, Human
agccucuaacucccuguguc

SEQ ID NO: 105627 - RNA, 23 nt, Human
cagcugucauucaggaccccaac

SEQ ID NO: 105628 - RNA, 22 nt, Human
ccggguccuggggcuugcagag

SEQ ID NO: 105629 - RNA, 26 nt, Human
ucauccuccagcagugcaauuucuuc

SEQ ID NO: 105630 - RNA, 23 nt, Human
ggagcagaaggagcugugagagc

SEQ ID NO: 105631 - RNA, 19 nt, Human
uggcucauucugcaccuuu

SEQ ID NO: 105632 - RNA, 21 nt, Human
aaucugaaggccuucguugga

SEQ ID NO: 105633 - RNA, 23 nt, Human
cgacaaaaacgaaacuccaucuu

SEQ ID NO: 105634 - RNA, 21 nt, Human
agaagcagcagcggcuagggc

SEQ ID NO: 105635 - RNA, 17 nt, Human
uuggcugcacuaacuuu

SEQ ID NO: 105636 - RNA, 24 nt, Human
gacucuggcuuccagagcuuuccc

SEQ ID NO: 105637 - RNA, 23 nt, Human
gcuucagccgugguccuccuggg

SEQ ID NO: 105638 - RNA, 27 nt, Human
uguucugaauucuauucaguuuguuua

SEQ ID NO: 105639 - RNA, 22 nt, Human
gucccagguggcagcgguugag

SEQ ID NO: 105640 - RNA, 25 nt, Human
auucauggcacagagcaguggcagg

SEQ ID NO: 105641 - RNA, 19 nt, Human
gcagggagggggcagaggc

SEQ ID NO: 105642 - RNA, 21 nt, Human
uuccaggcugaacugaggcag

SEQ ID NO: 105643 - RNA, 19 nt, Human
aguuaugaugaacugcaaa

SEQ ID NO: 105644 - RNA, 22 nt, Human
cuuagcaaauucuguuuuucua

SEQ ID NO: 105645 - RNA, 23 nt, Human
ccugcuguccuuuccuguuugcu

SEQ ID NO: 105646 - RNA, 20 nt, Human
uuauacagcuucauuuuaga

SEQ ID NO: 105647 - RNA, 21 nt, Human
cauuccccaaaccuugugaag

SEQ ID NO: 105648 - RNA, 23 nt, Human
acugaagaggaaagacugucuug

SEQ ID NO: 105649 - RNA, 27 nt, Human
aaccuguuuauuuauauucuuuggcuu

SEQ ID NO: 105650 - RNA, 23 nt, Human
cgcagcccugccacuggacacag

SEQ ID NO: 105651 - RNA, 22 nt, Human
cuuuggaucaaaauggugcauu

SEQ ID NO: 105652 - RNA, 23 nt, Human
uguacucuuagauggauucucca

SEQ ID NO: 105653 - RNA, 26 nt, Human
uuagcaaaucauauauucuucugugg

SEQ ID NO: 105654 - RNA, 21 nt, Human
caucaucuguagauccuaguc

SEQ ID NO: 105655 - RNA, 25 nt, Human
gagauggaaucguaauaaaccacgc

SEQ ID NO: 105656 - RNA, 24 nt, Human
cuucugcuagguuaaacuuuuacu

SEQ ID NO: 105657 - RNA, 24 nt, Human
guggguggcaggacugaacuugaa

SEQ ID NO: 105658 - RNA, 22 nt, Human
gcccgcucuucccuccugggcc

SEQ ID NO: 105659 - RNA, 23 nt, Human
agcauuuucugcaucuccacuug

SEQ ID NO: 105660 - RNA, 21 nt, Human
ucauuucuaauuuaguuguca

SEQ ID NO: 105661 - RNA, 23 nt, Human
gugggaaagaaagagcuuuauuu

SEQ ID NO: 105662 - RNA, 22 nt, Human
uggggccaccggguugaugcca

SEQ ID NO: 105663 - RNA, 25 nt, Human
ucuguuacccaggcuggagugcagu

SEQ ID NO: 105664 - RNA, 25 nt, Human
ucugucacccagguuggagugcagu

SEQ ID NO: 105665 - RNA, 21 nt, Human
aacuaauuuuguauuuuuagu

SEQ ID NO: 105666 - RNA, 21 nt, Human
uguaagccaguuccagcacac

SEQ ID NO: 105667 - RNA, 24 nt, Human
ccucccaucccuucccccuuuacu

SEQ ID NO: 105668 - RNA, 27 nt, Human
uccuccagggacucuggggcccuuugg

SEQ ID NO: 105669 - RNA, 27 nt, Human
aucaugguucacugcagucuugaccuc

SEQ ID NO: 105670 - RNA, 19 nt, Human
ggguugugauuuugucugc

SEQ ID NO: 105671 - RNA, 23 nt, Human
aguaaacaugagacaaguuuagg

SEQ ID NO: 105672 - RNA, 24 nt, Human
uguguugcuucaaauuggucugaa

SEQ ID NO: 105673 - RNA, 20 nt, Human
caaacacaaaauaagagauu

SEQ ID NO: 105674 - RNA, 19 nt, Human
auuguauguauuuggugcu

SEQ ID NO: 105675 - RNA, 21 nt, Human
ucacagucuuaaaccgugcca

SEQ ID NO: 105676 - RNA, 24 nt, Human
gccagccaaggggauuuauucuaa

SEQ ID NO: 105677 - RNA, 25 nt, Human
ugcccugcuaucuccagcugcugag

SEQ ID NO: 105678 - RNA, 20 nt, Human
caggaugaaugcaagacuga

SEQ ID NO: 105679 - RNA, 22 nt, Human
uugcacaugcucgugcuggugu

SEQ ID NO: 105680 - RNA, 20 nt, Human
ugaccaccucagagagggug

SEQ ID NO: 105681 - RNA, 23 nt, Human
gcucacugcagccccucugcccc

SEQ ID NO: 105682 - RNA, 25 nt, Human
ugaguugggaaaaacugaccgagua

SEQ ID NO: 105683 - RNA, 22 nt, Human
uggcucacgccuguaaucccag

SEQ ID NO: 105684 - RNA, 22 nt, Human
cuuuaaaacuguguagcuaccu

SEQ ID NO: 105685 - RNA, 21 nt, Human
caccauccaccuucccuucua

SEQ ID NO: 105686 - RNA, 24 nt, Human
gcacaggauauuucccugcaccag

SEQ ID NO: 105687 - RNA, 21 nt, Human
accccagcgcugagggugggu

SEQ ID NO: 105688 - RNA, 21 nt, Human
gccaugaagcaccuuccuaac

SEQ ID NO: 105689 - RNA, 22 nt, Human
gagaauccagccucacaaaagg

SEQ ID NO: 105690 - RNA, 21 nt, Human
cugccuaaauccacucugcag

SEQ ID NO: 105691 - RNA, 23 nt, Human
uauucaaaugagaauauuuuccc

SEQ ID NO: 105692 - RNA, 23 nt, Human
ugcuacuauaagggaauucuggc

SEQ ID NO: 105693 - RNA, 22 nt, Human
cccccacagaguggcccgcggg

SEQ ID NO: 105694 - RNA, 21 nt, Human
guggccaggauggggugcgca

SEQ ID NO: 105695 - RNA, 21 nt, Human
ccauccagcuuuggugcaaug

SEQ ID NO: 105696 - RNA, 25 nt, Human
gggaagcugccucacagcauggaac

SEQ ID NO: 105697 - RNA, 25 nt, Human
cagagaacuugcuuaaucuuccaua

SEQ ID NO: 105698 - RNA, 25 nt, Human
ggccaggaguuugaggcugcaguga

SEQ ID NO: 105699 - RNA, 23 nt, Human
cuaccugcgacagcuugaacuuu

SEQ ID NO: 105700 - RNA, 27 nt, Human
cccuccagaaugguacuucagugccua

SEQ ID NO: 105701 - RNA, 22 nt, Human
uaucuuuuugaaaauguuuaca

SEQ ID NO: 105702 - RNA, 22 nt, Human
acuccugacacuuccccuuccc

SEQ ID NO: 105703 - RNA, 22 nt, Human
agcuucccaaguagcugagauu

SEQ ID NO: 105704 - RNA, 23 nt, Human
gggcgggguacucgugagccaga

SEQ ID NO: 105705 - RNA, 25 nt, Human
cuuuccaagccccaggagcugugcc

SEQ ID NO: 105706 - RNA, 22 nt, Human
uccagccugggcaacgagagug

SEQ ID NO: 105707 - RNA, 24 nt, Human
cgccacucagccauuucccccucc

SEQ ID NO: 105708 - RNA, 22 nt, Human
uuguguaaagacuaugaucuca

SEQ ID NO: 105709 - RNA, 19 nt, Human
gaggauggggacagaaagc

SEQ ID NO: 105710 - RNA, 27 nt, Human
aagagucugcaucaagagauuuguccu

SEQ ID NO: 105711 - RNA, 21 nt, Human
gggugucaggccacagggcag

SEQ ID NO: 105712 - RNA, 21 nt, Human
ggcuucgggauuucugccuuc

SEQ ID NO: 105713 - RNA, 22 nt, Human
ucagccaggcuggagcaaggua

SEQ ID NO: 105714 - RNA, 21 nt, Human
uuuuuuaaauuuaacuuucug

SEQ ID NO: 105715 - RNA, 22 nt, Human
gugccccagagacaggagcaca

SEQ ID NO: 105716 - RNA, 23 nt, Human
aaauacuucagaaggaugcagcu

SEQ ID NO: 105717 - RNA, 26 nt, Human
ugggguuccuggacagaggaggacua

SEQ ID NO: 105718 - RNA, 22 nt, Human
gggucucaaacuccugaccuca

SEQ ID NO: 105719 - RNA, 22 nt, Human
ucaagauagaaagggugcugcc

SEQ ID NO: 105720 - RNA, 21 nt, Human
auuguuccuccaccgucccac

SEQ ID NO: 105721 - RNA, 27 nt, Human
gcaaaccugagcagcgcguccuaagca

SEQ ID NO: 105722 - RNA, 25 nt, Human
cccaaugucucuggaagugccaccu

SEQ ID NO: 105723 - RNA, 27 nt, Human
uauugguuuguuauucuuuuccagaaa

SEQ ID NO: 105724 - RNA, 19 nt, Human
gucacccucugggcacauu

SEQ ID NO: 105725 - RNA, 23 nt, Human
ucuguguguggugugaccaaugg

SEQ ID NO: 105726 - RNA, 19 nt, Human
acacggcagcugcuggcug

SEQ ID NO: 105727 - RNA, 21 nt, Human
acucuccacuuucucucacag

SEQ ID NO: 105728 - RNA, 25 nt, Human
auuguuuguucuguuuucaggcuuu

SEQ ID NO: 105729 - RNA, 22 nt, Human
cuccaccuuccaaaggaccuac

SEQ ID NO: 105730 - RNA, 27 nt, Human
agguauuccugcuccccugaagaauga

SEQ ID NO: 105731 - RNA, 22 nt, Human
agguuuacugugccugcccgug

SEQ ID NO: 105732 - RNA, 22 nt, Human
uugcagcuacccucucugaccu

SEQ ID NO: 105733 - RNA, 23 nt, Human
ggugaagacagggccagcaggag

SEQ ID NO: 105734 - RNA, 21 nt, Human
agccuccucuagccucugaug

SEQ ID NO: 105735 - RNA, 23 nt, Human
cucccuuuuaaaaggagcacauu

SEQ ID NO: 105736 - RNA, 27 nt, Human
aauccaggcuuuccuuggaaguggcug

SEQ ID NO: 105737 - RNA, 22 nt, Human
cccccuagugcuuccuggagcu

SEQ ID NO: 105738 - RNA, 21 nt, Human
gccaaguuuggucugaguugu

SEQ ID NO: 105739 - RNA, 22 nt, Human
agguauuucaggugugaaagaa

SEQ ID NO: 105740 - RNA, 21 nt, Human
cuuacuaaggaauaaaaacuu

SEQ ID NO: 105741 - RNA, 17 nt, Human
uuaccugcagguauuuu

SEQ ID NO: 105742 - RNA, 28 nt, Human
acuuauuucccuccuguccuagaauuug

SEQ ID NO: 105743 - RNA, 24 nt, Human
uccaggcccucagaacaccugccc

SEQ ID NO: 105744 - RNA, 24 nt, Human
ucucccaguuccuucacagcugcc

SEQ ID NO: 105745 - RNA, 20 nt, Human
ucuguucuguggcugagcua

SEQ ID NO: 105746 - RNA, 22 nt, Human
acaggcaggaggugggggaaga

SEQ ID NO: 105747 - RNA, 25 nt, Human
augggaggggagcuggcgggagggu

SEQ ID NO: 105748 - RNA, 20 nt, Human
augcucacaacuuaguguaa

SEQ ID NO: 105749 - RNA, 26 nt, Human
agugggacuagccaggaaugagggag

SEQ ID NO: 105750 - RNA, 20 nt, Human
cugugcagauuuucccacug

SEQ ID NO: 105751 - RNA, 22 nt, Human
gcgggguuucaccaugcugguc

SEQ ID NO: 105752 - RNA, 22 nt, Human
uucuaggucacauuggguuaag

SEQ ID NO: 105753 - RNA, 23 nt, Human
acauuuauacuuggccuaugugc

SEQ ID NO: 105754 - RNA, 26 nt, Human
ucuggagaaggccuggaagagcugag

SEQ ID NO: 105755 - RNA, 22 nt, Human
cgcaaccuccaccuuccugguu

SEQ ID NO: 105756 - RNA, 25 nt, Human
uccuaugugucacauucaucacagg

SEQ ID NO: 105757 - RNA, 21 nt, Human
ccuccucugcuuucaaaaguc

SEQ ID NO: 105758 - RNA, 25 nt, Human
uggccucucccugcccugacacuug

SEQ ID NO: 105759 - RNA, 28 nt, Human
uuaggugaccaugagaauugcuguuuga

SEQ ID NO: 105760 - RNA, 22 nt, Human
ccucccucuuuggccucugaaa

SEQ ID NO: 105761 - RNA, 26 nt, Human
gccagccuggaccauacacugccugg

SEQ ID NO: 105762 - RNA, 27 nt, Human
ugcaguucugggcagcauccucccaag

SEQ ID NO: 105763 - RNA, 22 nt, Human
cugccguccugcgggagccugc

SEQ ID NO: 105764 - RNA, 26 nt, Human
ggcgccuguaaucccaguuacucggg

SEQ ID NO: 105765 - RNA, 25 nt, Human
aaacaggcuuuccaccccugcucug

SEQ ID NO: 105766 - RNA, 22 nt, Human
ccaggagguggaaguugcuuug

SEQ ID NO: 105767 - RNA, 20 nt, Human
ucccugcaauaaaauggguu

SEQ ID NO: 105768 - RNA, 25 nt, Human
ccugccugggccccauguggaaggc

SEQ ID NO: 105769 - RNA, 25 nt, Human
gugcuggcugcuggcccacagcucu

SEQ ID NO: 105770 - RNA, 21 nt, Human
aauauguuacagaacaugcac

SEQ ID NO: 105771 - RNA, 28 nt, Human
aaccccuuaggacucugaaggguaugga

SEQ ID NO: 105772 - RNA, 25 nt, Human
ggggagggagaggccggacacaagc

SEQ ID NO: 105773 - RNA, 21 nt, Human
ccucgcgcuccuccugagcag

SEQ ID NO: 105774 - RNA, 19 nt, Human
ugaacaacauacaaaguuu

SEQ ID NO: 105775 - RNA, 27 nt, Human
gcagugcuguguggcagcagagcuccu

SEQ ID NO: 105776 - RNA, 24 nt, Human
ggagagggaagggagggaaacagu

SEQ ID NO: 105777 - RNA, 21 nt, Human
cuugcagccucuccagauguu

SEQ ID NO: 105778 - RNA, 27 nt, Human
ggucucgaacuucugagcucaagcgau

SEQ ID NO: 105779 - RNA, 19 nt, Human
uguacgauauucaaacuuu

SEQ ID NO: 105780 - RNA, 27 nt, Human
auucuuugccuuccuggagcucccagc

SEQ ID NO: 105781 - RNA, 27 nt, Human
ucuucuuuguaguccuucuucccaccc

SEQ ID NO: 105782 - RNA, 19 nt, Human
gccagugcaccagcaguuu

SEQ ID NO: 105783 - RNA, 26 nt, Human
cccugccuaaccucuaccaucaauga

SEQ ID NO: 105784 - RNA, 26 nt, Human
aucugacagagcaucagaaccagagg

SEQ ID NO: 105785 - RNA, 23 nt, Human
guccuaagcccacaaucaugccu

SEQ ID NO: 105786 - RNA, 25 nt, Human
ucaucuauuuuaacucugugucuuu

SEQ ID NO: 105787 - RNA, 32 nt, Human
cugagcauuucuuuugcccuccagggugccaa

SEQ ID NO: 105788 - RNA, 23 nt, Human
uagaauuggacuggcaggggaaa

SEQ ID NO: 105789 - RNA, 27 nt, Human
ugugugccuuauuuacacuuuauuguc

SEQ ID NO: 105790 - RNA, 25 nt, Human
ccuuagugaacuucuguuguccuca

SEQ ID NO: 105791 - RNA, 27 nt, Human
uaaacaguauauuaagauuaccuucac

SEQ ID NO: 105792 - RNA, 27 nt, Human
ucagcccugaaaucaggcacaucuguu

SEQ ID NO: 105793 - RNA, 31 nt, Human
gucaccagacggggcuggagugugagggucc

SEQ ID NO: 105794 - RNA, 24 nt, Human
auuuagaaaacauucauccaguug

SEQ ID NO: 105795 - RNA, 22 nt, Human
ucuuuuaggugauacaccagag

SEQ ID NO: 105796 - RNA, 24 nt, Human
guggaaagaggggaccaggguggc

SEQ ID NO: 105797 - RNA, 19 nt, Human
ugggaggcggacagcagug

SEQ ID NO: 105798 - RNA, 21 nt, Human
uucagccugccuggggugaga

SEQ ID NO: 105799 - RNA, 23 nt, Human
aguuagcaacacuguuuucuuua

SEQ ID NO: 105800 - RNA, 23 nt, Human
auguccccugucuuccuccaucu

SEQ ID NO: 105801 - RNA, 27 nt, Human
gacucacuguauggugcccucuccaaa

SEQ ID NO: 105802 - RNA, 18 nt, Human
gcgcguggaggcugcagu

SEQ ID NO: 105803 - RNA, 21 nt, Human
cuucugcugcccaaccugacu

SEQ ID NO: 105804 - RNA, 20 nt, Human
aauucuuugagcuccaggac

SEQ ID NO: 105805 - RNA, 23 nt, Human
ggggaccccggagagggagucag

SEQ ID NO: 105806 - RNA, 22 nt, Human
agcccagucuggagugcagugg

SEQ ID NO: 105807 - RNA, 24 nt, Human
cccucugcaauaucacuuuuugug

SEQ ID NO: 105808 - RNA, 24 nt, Human
cuauggguggagggugaguuugaa

SEQ ID NO: 105809 - RNA, 19 nt, Human
auaauuccuucugccuaac

SEQ ID NO: 105810 - RNA, 27 nt, Human
guggcuguggacuucacccaggaggag

SEQ ID NO: 105811 - RNA, 23 nt, Human
gaugauuuugccaaaaugaguug

SEQ ID NO: 105812 - RNA, 20 nt, Human
aggugugcaccaccaugccc

SEQ ID NO: 105813 - RNA, 18 nt, Human
caggugaaucacagcuga

SEQ ID NO: 105814 - RNA, 21 nt, Human
gccaguguaaaaauguccuua

SEQ ID NO: 105815 - RNA, 26 nt, Human
ccugcucuccagccucuggaggaacu

SEQ ID NO: 105816 - RNA, 25 nt, Human
ccugcuuucuggucacauguggacc

SEQ ID NO: 105817 - RNA, 27 nt, Human
aggccagaauaacagagcuuucuuagu

SEQ ID NO: 105818 - RNA, 28 nt, Human
ccugcuacugcugaccaaauucccagga

SEQ ID NO: 105819 - RNA, 21 nt, Human
ggcugaaaacagcagcauuuu

SEQ ID NO: 105820 - RNA, 21 nt, Human
ugucacuaugcucucuugccu

SEQ ID NO: 105821 - RNA, 22 nt, Human
ugccaggcuggaguggaguggc

SEQ ID NO: 105822 - RNA, 19 nt, Human
acuucuguaauuuuuugcc

SEQ ID NO: 105823 - RNA, 27 nt, Human
uuucugcugugcugcuucccucccaaa

SEQ ID NO: 105824 - RNA, 22 nt, Human
ucucagauucuaauaacugaga

SEQ ID NO: 105825 - RNA, 23 nt, Human
aguguacauauaugaaaauaaau

SEQ ID NO: 105826 - RNA, 19 nt, Human
ccccucggggcacggcgua

SEQ ID NO: 105827 - RNA, 19 nt, Human
guggagguggaagacagug

SEQ ID NO: 105828 - RNA, 27 nt, Human
agcuuugacaaaggaccaggcuugccu

SEQ ID NO: 105829 - RNA, 27 nt, Human
aggccccggacaggaggcagugccgcu

SEQ ID NO: 105830 - RNA, 22 nt, Human
caugcuggagugcaguggcgcg

SEQ ID NO: 105831 - RNA, 25 nt, Human
ccggcaacaccagugccaggaaaag

SEQ ID NO: 105832 - RNA, 26 nt, Human
ucucaucuuuuguccuccuuagcaca

SEQ ID NO: 105833 - RNA, 27 nt, Human
ccuacuucuucuguacuuuuaccugua

SEQ ID NO: 105834 - RNA, 24 nt, Human
cgagucagggucugaguccucguc

SEQ ID NO: 105835 - RNA, 19 nt, Human
uguggagguugcugguaca

SEQ ID NO: 105836 - RNA, 28 nt, Human
cgcuuaccaagaacugugcuuacauacc

SEQ ID NO: 105837 - RNA, 22 nt, Human
aaaaagcuguuuucuucagcuu

SEQ ID NO: 105838 - RNA, 21 nt, Human
gacucuggugagcauccguca

SEQ ID NO: 105839 - RNA, 26 nt, Human
ucucucucaccaugugacacacuggc

SEQ ID NO: 105840 - RNA, 21 nt, Human
agguuggacuggaaaaucucu

SEQ ID NO: 105841 - RNA, 21 nt, Human
auuuuuaaagaguaagugcua

SEQ ID NO: 105842 - RNA, 23 nt, Human
ugccccuagagggccaaugcccu

SEQ ID NO: 105843 - RNA, 19 nt, Human
uaugaucuuaaaugaugaa

SEQ ID NO: 105844 - RNA, 26 nt, Human
cugggagcuggcaggguccuuccaga

SEQ ID NO: 105845 - RNA, 26 nt, Human
aggggccgcugacuucuuucacaagu

SEQ ID NO: 105846 - RNA, 27 nt, Human
ccugccugggagucucccugccucacu

SEQ ID NO: 105847 - RNA, 22 nt, Human
cauucccaccacccugugcccc

SEQ ID NO: 105848 - RNA, 26 nt, Human
ggcagccaaaucuugccugugcuggg

SEQ ID NO: 105849 - RNA, 22 nt, Human
gaacccgggaggcagagguagu

SEQ ID NO: 105850 - RNA, 20 nt, Human
uccaaauugaaucaccuuua

SEQ ID NO: 105851 - RNA, 27 nt, Human
uucauucugugaucauuuauuuuaagc

SEQ ID NO: 105852 - RNA, 23 nt, Human
auggauacuuauauggaaauucu

SEQ ID NO: 105853 - RNA, 27 nt, Human
uucauccucaccccacccuccaggguu

SEQ ID NO: 105854 - RNA, 27 nt, Human
uugcccaggccuggacuuuuugcauca

SEQ ID NO: 105855 - RNA, 22 nt, Human
cagaaucugggcuucuucaccc

SEQ ID NO: 105856 - RNA, 22 nt, Human
aggcugaggcaugagaauugcu

SEQ ID NO: 105857 - RNA, 26 nt, Human
ggcugagggagaugaggggagcuggc

SEQ ID NO: 105858 - RNA, 25 nt, Human
uguuuaguaaucauauuguuacugg

SEQ ID NO: 105859 - RNA, 22 nt, Human
agucccugcuccuccucuuccc

SEQ ID NO: 105860 - RNA, 27 nt, Human
uuguaugucugugguaucuugauuuuc

SEQ ID NO: 105861 - RNA, 23 nt, Human
cccucucuccccaucucuggucu

SEQ ID NO: 105862 - RNA, 22 nt, Human
uuugggaaagccuucacacagc

SEQ ID NO: 105863 - RNA, 26 nt, Human
cugggagccugagguccucaccuucc

SEQ ID NO: 105864 - RNA, 27 nt, Human
ucugcucccagaugccuucuagauuca

SEQ ID NO: 105865 - RNA, 27 nt, Human
ccugccuguacauacacaugcacaccc

SEQ ID NO: 105866 - RNA, 20 nt, Human
uccugugugucagagcuagg

SEQ ID NO: 105867 - RNA, 23 nt, Human
aaauggggguucuggaccagaug

SEQ ID NO: 105868 - RNA, 21 nt, Human
ggugggauuauuccacaaaga

SEQ ID NO: 105869 - RNA, 27 nt, Human
ugguacaaauugcuucaacuugcacua

SEQ ID NO: 105870 - RNA, 21 nt, Human
acagugugaagugcgugguau

SEQ ID NO: 105871 - RNA, 25 nt, Human
uuuuuggauuuaauaaucuugcugu

SEQ ID NO: 105872 - RNA, 18 nt, Human
ggauguaccaccaacuac

SEQ ID NO: 105873 - RNA, 25 nt, Human
aacugacagaggagggcgugacuca

SEQ ID NO: 105874 - RNA, 18 nt, Human
aagccuucuguacuugaa

SEQ ID NO: 105875 - RNA, 23 nt, Human
aaguauguuuuuacacuuuucuu

SEQ ID NO: 105876 - RNA, 20 nt, Human
ugagugucggguggggaagg

SEQ ID NO: 105877 - RNA, 20 nt, Human
uugcccuugugcuccaguca

SEQ ID NO: 105878 - RNA, 22 nt, Human
gcagagcagcuggcacgugacu

SEQ ID NO: 105879 - RNA, 23 nt, Human
cccuugaauaucugccugggggc

SEQ ID NO: 105880 - RNA, 21 nt, Human
cucgaauugaagcaagugagg

SEQ ID NO: 105881 - RNA, 24 nt, Human
cucagcaucucuuaaaguugccug

SEQ ID NO: 105882 - RNA, 20 nt, Human
ucuccacccuucuuagggcu

SEQ ID NO: 105883 - RNA, 22 nt, Human
ccuggaaguggagguggcugug

SEQ ID NO: 105884 - RNA, 25 nt, Human
uucauucucuaccauaccacuugug

SEQ ID NO: 105885 - RNA, 26 nt, Human
uuaaaaaauauauaccaacagaacua

SEQ ID NO: 105886 - RNA, 20 nt, Human
ggccagacucucaucuugau

SEQ ID NO: 105887 - RNA, 28 nt, Human
cagcggcaucaggcuuucuuaaagugag

SEQ ID NO: 105888 - RNA, 21 nt, Human
auagugaccuugaaaaccacu

SEQ ID NO: 105889 - RNA, 23 nt, Human
cccgcucccgccgccaccuccuc

SEQ ID NO: 105890 - RNA, 24 nt, Human
auacagcauauuucauuugggcuu

SEQ ID NO: 105891 - RNA, 26 nt, Human
gcagcucuggccacagggaccucugc

SEQ ID NO: 105892 - RNA, 22 nt, Human
guuauaucccucuuuacaucac

SEQ ID NO: 105893 - RNA, 19 nt, Human
ucauuguaugaauauauca

SEQ ID NO: 105894 - RNA, 20 nt, Human
guuuauuuuucaugaaaauu

SEQ ID NO: 105895 - RNA, 25 nt, Human
uugguuugauccugacugcugucau

SEQ ID NO: 105896 - RNA, 32 nt, Human
guuggaggggcuaaggaggagugcagagggga

SEQ ID NO: 105897 - RNA, 21 nt, Human
aucuccaggcugcugggcagc

SEQ ID NO: 105898 - RNA, 23 nt, Human
cauguaguagagguguaugaaga

SEQ ID NO: 105899 - RNA, 21 nt, Human
uggaaaacacauuuggaauga

SEQ ID NO: 105900 - RNA, 19 nt, Human
ugccccaaguaccaccuca

SEQ ID NO: 105901 - RNA, 27 nt, Human
uugcccaggcuggagugcaguggugca

SEQ ID NO: 105902 - RNA, 27 nt, Human
uugcccaggcuggagugcgguggugcg

SEQ ID NO: 105903 - RNA, 24 nt, Human
gugcuuuagcagcguggcugccuc

SEQ ID NO: 105904 - RNA, 20 nt, Human
cugucuucugauaucugcag

SEQ ID NO: 105905 - RNA, 24 nt, Human
cagcgaucuucccacaucagccuc

SEQ ID NO: 105906 - RNA, 20 nt, Human
aagcaccauggaaucaaaga

SEQ ID NO: 105907 - RNA, 26 nt, Human
augcaggcccuuugaagccucagcua

SEQ ID NO: 105908 - RNA, 27 nt, Human
ugaaguuucgaccugggcucaagcaau

SEQ ID NO: 105909 - RNA, 24 nt, Human
gcccugugguugcugggccuccca

SEQ ID NO: 105910 - RNA, 27 nt, Human
aauucaccuguggauguuuuugaguaa

SEQ ID NO: 105911 - RNA, 22 nt, Human
uaaccuguuuaagaugacucag

SEQ ID NO: 105912 - RNA, 23 nt, Human
uaguaguucauacccacucagag

SEQ ID NO: 105913 - RNA, 16 nt, Human
caguucugugugcgcu

SEQ ID NO: 105914 - RNA, 26 nt, Human
ccaggugccguggagcagcaggcugg

SEQ ID NO: 105915 - RNA, 27 nt, Human
ucccugccugugagccacaccuccuag

SEQ ID NO: 105916 - RNA, 19 nt, Human
gcuacaacgggaaaaagag

SEQ ID NO: 105917 - RNA, 24 nt, Human
gcugggagggugaggcgccgcgcu

SEQ ID NO: 105918 - RNA, 27 nt, Human
gaagucaguuucaggggaaggauguga

SEQ ID NO: 105919 - RNA, 24 nt, Human
aaaugucuuugcuccuuggcagcu

SEQ ID NO: 105920 - RNA, 20 nt, Human
gcuuucacacccuggucugg

SEQ ID NO: 105921 - RNA, 21 nt, Human
guugcccaggcuggucucaaa

SEQ ID NO: 105922 - RNA, 24 nt, Human
ccuugguuuuuuaaaaucuguaaa

SEQ ID NO: 105923 - RNA, 29 nt, Human
agagcagcccuacacucccuacaccacac

SEQ ID NO: 105924 - RNA, 20 nt, Human
ugccucggcuuuucucagcu

SEQ ID NO: 105925 - RNA, 24 nt, Human
cucuuaccugcuucugccuugcug

SEQ ID NO: 105926 - RNA, 22 nt, Human
cuuucauuugacacacagacua

SEQ ID NO: 105927 - RNA, 22 nt, Human
cucuaauuuaacuuauugcuag

SEQ ID NO: 105928 - RNA, 22 nt, Human
cagggaggggacaucugagggc

SEQ ID NO: 105929 - RNA, 22 nt, Human
gaucuuagauucucugugucua

SEQ ID NO: 105930 - RNA, 26 nt, Human
acuucacugcgaagacccucuugccc

SEQ ID NO: 105931 - RNA, 25 nt, Human
cuguucccaggcccugcugcuccca

SEQ ID NO: 105932 - RNA, 23 nt, Human
cacaugccaagcacugugcucag

SEQ ID NO: 105933 - RNA, 22 nt, Human
uugagccagguggauguuuacc

SEQ ID NO: 105934 - RNA, 20 nt, Human
uucccuacuccuccccacca

SEQ ID NO: 105935 - RNA, 22 nt, Human
gaggauuaaaugaaucaaaaga

SEQ ID NO: 105936 - RNA, 27 nt, Human
ccugccuggcuagcccugaaccuuuca

SEQ ID NO: 105937 - RNA, 22 nt, Human
ucugccauggcccuguggaugc

SEQ ID NO: 105938 - RNA, 26 nt, Human
gugcugucuguuucuuguacugggac

SEQ ID NO: 105939 - RNA, 29 nt, Human
accagccauggucuggacugugaguuuac

SEQ ID NO: 105940 - RNA, 22 nt, Human
gcgaucucagcucacugcaacc

SEQ ID NO: 105941 - RNA, 22 nt, Human
acgaucucggcucacugcaacc

SEQ ID NO: 105942 - RNA, 20 nt, Human
cuguuuaaaaaaguuuccua

SEQ ID NO: 105943 - RNA, 19 nt, Human
ccuacuuccuccuagcaac

SEQ ID NO: 105944 - RNA, 22 nt, Human
acaaacccacauugaguuagaa

SEQ ID NO: 105945 - RNA, 23 nt, Human
auuugcugcuugaaucugcucca

SEQ ID NO: 105946 - RNA, 25 nt, Human
ggaaucacuggggaugguggcacag

SEQ ID NO: 105947 - RNA, 23 nt, Human
cagcugcuuauaaaagcaucuua

SEQ ID NO: 105948 - RNA, 20 nt, Human
cccagcaggaagccaggcug

SEQ ID NO: 105949 - RNA, 22 nt, Human
gaagaagauagaaggacgcccg

SEQ ID NO: 105950 - RNA, 22 nt, Human
ggcaggcaccuuuuggacuggg

SEQ ID NO: 105951 - RNA, 27 nt, Human
gauaucucaucucuucuuuuaaaccau

SEQ ID NO: 105952 - RNA, 21 nt, Human
gagggagagaucgaagacuga

SEQ ID NO: 105953 - RNA, 20 nt, Human
gcauaugccauuugaagccu

SEQ ID NO: 105954 - RNA, 20 nt, Human
cuguguacauucuuaugcaa

SEQ ID NO: 105955 - RNA, 27 nt, Human
ucauuugcucaccugagcaaugaagug

SEQ ID NO: 105956 - RNA, 23 nt, Human
caugccucccuucucccagcuca

SEQ ID NO: 105957 - RNA, 20 nt, Human
ugggcaauuccuuaccaaau

SEQ ID NO: 105958 - RNA, 25 nt, Human
uuacuaacagcaacagcaagaaaua

SEQ ID NO: 105959 - RNA, 22 nt, Human
uggcucacgccugcaaucccag

SEQ ID NO: 105960 - RNA, 22 nt, Human
gguguugcgcggggcugggauu

SEQ ID NO: 105961 - RNA, 25 nt, Human
cugccaggcugggguguuuucggua

SEQ ID NO: 105962 - RNA, 23 nt, Human
uauggcuguaucagagggcuuug

SEQ ID NO: 105963 - RNA, 22 nt, Human
ucacccagacuggagugcaggg

SEQ ID NO: 105964 - RNA, 27 nt, Human
gcccagccugugcccgccaugccgccc

SEQ ID NO: 105965 - RNA, 24 nt, Human
ccuccacucccuuuuuguaacucc

SEQ ID NO: 105966 - RNA, 24 nt, Human
cgcuugaggucaggaguucgagac

SEQ ID NO: 105967 - RNA, 24 nt, Human
ggccuccccuuccccucccugccc

SEQ ID NO: 105968 - RNA, 20 nt, Human
ucaacaaaagucagaauucc

SEQ ID NO: 105969 - RNA, 22 nt, Human
cauugccgccuccugccaccag

SEQ ID NO: 105970 - RNA, 20 nt, Human
guaaacugugacucuaccuc

SEQ ID NO: 105971 - RNA, 24 nt, Human
ccuccacuccuggccgccuucucc

SEQ ID NO: 105972 - RNA, 24 nt, Human
ccaagccccucagggcccagaccu

SEQ ID NO: 105973 - RNA, 22 nt, Human
gcagugaguuaugguggugguc

SEQ ID NO: 105974 - RNA, 23 nt, Human
ccucccuacucccauaccuccuc

SEQ ID NO: 105975 - RNA, 30 nt, Human
caccauuuuguccaagccugggcaugggug

SEQ ID NO: 105976 - RNA, 22 nt, Human
gccaaaccugcccugccauugu

SEQ ID NO: 105977 - RNA, 19 nt, Human
gguugcagugagccuggau

SEQ ID NO: 105978 - RNA, 22 nt, Human
cgccacugcacuccagccaggg

SEQ ID NO: 105979 - RNA, 19 nt, Human
ccuccacugcgcuuacucc

SEQ ID NO: 105980 - RNA, 21 nt, Human
cauguuguauucuauaacaca

SEQ ID NO: 105981 - RNA, 25 nt, Human
gggggugucuugugggcagugaggg

SEQ ID NO: 105982 - RNA, 22 nt, Human
ugcaaaccaccauuggaaucua

SEQ ID NO: 105983 - RNA, 20 nt, Human
agucugagaaaaggcagaag

SEQ ID NO: 105984 - RNA, 25 nt, Human
cucauuucccgcaccccauuucuug

SEQ ID NO: 105985 - RNA, 21 nt, Human
cuuagcugggccucugaggcc

SEQ ID NO: 105986 - RNA, 22 nt, Human
aguaauaaucagggauuuuauu

SEQ ID NO: 105987 - RNA, 22 nt, Human
ggccuccucuccuacuuuggga

SEQ ID NO: 105988 - RNA, 20 nt, Human
uaucugucuacuccauuucu

SEQ ID NO: 105989 - RNA, 19 nt, Human
uaagggcuaggccacccag

SEQ ID NO: 105990 - RNA, 22 nt, Human
cuuggacuggcacagggacccu

SEQ ID NO: 105991 - RNA, 27 nt, Human
caggcuggagcauaguggcaagaucau

SEQ ID NO: 105992 - RNA, 29 nt, Human
ccucuaccccgccccaccuugccccacua

SEQ ID NO: 105993 - RNA, 27 nt, Human
ggguccccacaacgccauggggcagag

SEQ ID NO: 105994 - RNA, 22 nt, Human
ccaccucccaggcucaagcagu

SEQ ID NO: 105995 - RNA, 21 nt, Human
cuuuuauaccuuccucacugg

SEQ ID NO: 105996 - RNA, 20 nt, Human
acuuaauuacugcuaguuuu

SEQ ID NO: 105997 - RNA, 21 nt, Human
cugaucucaguuuccuggcuu

SEQ ID NO: 105998 - RNA, 24 nt, Human
agaaacugagaaaugaaugcugag

SEQ ID NO: 105999 - RNA, 23 nt, Human
augaagcccuuaguccuucuagu

SEQ ID NO: 106000 - RNA, 27 nt, Human
caggcagcguggaggggaaggguaggg

SEQ ID NO: 106001 - RNA, 23 nt, Human
ccuuaugucuccagucuggugcc

SEQ ID NO: 106002 - RNA, 21 nt, Human
uucuacaaucuauuuauugga

SEQ ID NO: 106003 - RNA, 24 nt, Human
gcuaaagcaguccuccagccucgg

SEQ ID NO: 106004 - RNA, 22 nt, Human
gggauuacaggcaugagcuacu

SEQ ID NO: 106005 - RNA, 25 nt, Human
uccaucuuggaacauacuuuuugca

SEQ ID NO: 106006 - RNA, 24 nt, Human
uccuccagggacuugccuggcccu

SEQ ID NO: 106007 - RNA, 21 nt, Human
ugugccaggaccucaggcugg

SEQ ID NO: 106008 - RNA, 24 nt, Human
ggcugcugggaucccauggccuga

SEQ ID NO: 106009 - RNA, 21 nt, Human
cugagugugguggcacaugcc

SEQ ID NO: 106010 - RNA, 26 nt, Human
ggucagaaucaaagugacauucuaag

SEQ ID NO: 106011 - RNA, 22 nt, Human
aacuguuuugacaaaugagcac

SEQ ID NO: 106012 - RNA, 18 nt, Human
cauuucagaagaacggca

SEQ ID NO: 106013 - RNA, 21 nt, Human
gaccugagccccgggucucgg

SEQ ID NO: 106014 - RNA, 22 nt, Human
uggccgccucuccuugccaggc

SEQ ID NO: 106015 - RNA, 27 nt, Human
cugagauaucaauugguuuccccuucu

SEQ ID NO: 106016 - RNA, 23 nt, Human
gacuuuccacccccucccuggcc

SEQ ID NO: 106017 - RNA, 22 nt, Human
uugucuguuuauuuacgcuuuu

SEQ ID NO: 106018 - RNA, 21 nt, Human
gucugugagggauugguucca

SEQ ID NO: 106019 - RNA, 22 nt, Human
uacccaggguggagugcagugg

SEQ ID NO: 106020 - RNA, 21 nt, Human
uuucauuauauacucuaccuu

SEQ ID NO: 106021 - RNA, 22 nt, Human
uuauccacauacacaugugcac

SEQ ID NO: 106022 - RNA, 19 nt, Human
ggggaaagagauccaggaa

SEQ ID NO: 106023 - RNA, 22 nt, Human
ccaggauauuaauaaaguauau

SEQ ID NO: 106024 - RNA, 21 nt, Human
aaguucaguaauaagcuaacu

SEQ ID NO: 106025 - RNA, 23 nt, Human
cgagucucccauguuguaguaca

SEQ ID NO: 106026 - RNA, 22 nt, Human
aguggcacaaucucggcucacu

SEQ ID NO: 106027 - RNA, 17 nt, Human
guuguaaaaaugucuuu

SEQ ID NO: 106028 - RNA, 27 nt, Human
uggaccuguccagacaguuacacucca

SEQ ID NO: 106029 - RNA, 19 nt, Human
uuuuugugaaaagcuccau

SEQ ID NO: 106030 - RNA, 21 nt, Human
aaacuauuguccauuaacaug

SEQ ID NO: 106031 - RNA, 21 nt, Human
uggaacacaggaaguuggagc

SEQ ID NO: 106032 - RNA, 20 nt, Human
cccggccaggccuccucccc

SEQ ID NO: 106033 - RNA, 22 nt, Human
cucagccucccaaguagcuggg

SEQ ID NO: 106034 - RNA, 20 nt, Human
gcugcucugcucccugccgg

SEQ ID NO: 106035 - RNA, 25 nt, Human
uacauacaaucuccuugaaucuucu

SEQ ID NO: 106036 - RNA, 23 nt, Human
agcacuccucugucucugcucuu

SEQ ID NO: 106037 - RNA, 24 nt, Human
uaaagugaauguuuuucucuucag

SEQ ID NO: 106038 - RNA, 22 nt, Human
ugggcacaaaggcagcgcugcu

SEQ ID NO: 106039 - RNA, 22 nt, Human
ggcucugugggcugcacuugug

SEQ ID NO: 106040 - RNA, 20 nt, Human
cacucacuggucuuugcauc

SEQ ID NO: 106041 - RNA, 25 nt, Human
ccuuucucccacucuacugaaaccc

SEQ ID NO: 106042 - RNA, 22 nt, Human
acgaucauagcucacugaaguu

SEQ ID NO: 106043 - RNA, 25 nt, Human
acucacugauuuacuucuagcaaua

SEQ ID NO: 106044 - RNA, 23 nt, Human
aauccagacaccagccuuuaggg

SEQ ID NO: 106045 - RNA, 23 nt, Human
cucgcccaggauggagaggcggg

SEQ ID NO: 106046 - RNA, 27 nt, Human
caggcuggaggcggcagcgguuggagg

SEQ ID NO: 106047 - RNA, 22 nt, Human
accaaauaaaaauauuguguug

SEQ ID NO: 106048 - RNA, 17 nt, Human
ggcuggugguuggugaa

SEQ ID NO: 106049 - RNA, 23 nt, Human
gucuuuuagcucucucagauucu

SEQ ID NO: 106050 - RNA, 27 nt, Human
agagagaagagccccacucucagaggc

SEQ ID NO: 106051 - RNA, 27 nt, Human
cucaggagguugaggcagcagaauugc

SEQ ID NO: 106052 - RNA, 30 nt, Human
uuggcauucuuuaagccuacagaaugugau

SEQ ID NO: 106053 - RNA, 20 nt, Human
uugugguccugccucuuuuc

SEQ ID NO: 106054 - RNA, 26 nt, Human
agccuuuucacacagcacuccccuca

SEQ ID NO: 106055 - RNA, 27 nt, Human
uccugcaggagucagcguucaaucuug

SEQ ID NO: 106056 - RNA, 26 nt, Human
aaaacaaugcaagcaugugucaucca

SEQ ID NO: 106057 - RNA, 22 nt, Human
ccagagucuaagacugcaguga

SEQ ID NO: 106058 - RNA, 20 nt, Human
gccugggcccaggcccagcc

SEQ ID NO: 106059 - RNA, 21 nt, Human
aaacuauuuaacuugagcuuu

SEQ ID NO: 106060 - RNA, 24 nt, Human
ccuguggagcugccgccauggccc

SEQ ID NO: 106061 - RNA, 27 nt, Human
ggccagacgugguagcucacaccugua

SEQ ID NO: 106062 - RNA, 27 nt, Human
ucaugccaccacgccagcuaauuuuug

SEQ ID NO: 106063 - RNA, 22 nt, Human
uaguaaucauuggaugcaugau

SEQ ID NO: 106064 - RNA, 21 nt, Human
gucgacugucuagaaaggagg

SEQ ID NO: 106065 - RNA, 17 nt, Human
gacuauacagugucacu

SEQ ID NO: 106066 - RNA, 21 nt, Human
ccuaggccccuguuccccuga

SEQ ID NO: 106067 - RNA, 21 nt, Human
ugguuccuggaaaguaaaggu

SEQ ID NO: 106068 - RNA, 23 nt, Human
ggagggcugccuaccauggucug

SEQ ID NO: 106069 - RNA, 27 nt, Human
agggucugaguucuagcaggguccugg

SEQ ID NO: 106070 - RNA, 21 nt, Human
uucaugcaggcagaagcaguu

SEQ ID NO: 106071 - RNA, 22 nt, Human
gcucacuguaaccucaaacucc

SEQ ID NO: 106072 - RNA, 22 nt, Human
cagccacauaauguuccagaca

SEQ ID NO: 106073 - RNA, 26 nt, Human
acacauggcuugaaaauggaagacac

SEQ ID NO: 106074 - RNA, 31 nt, Human
cauuggguuucucucuggguuuggacaugaa

SEQ ID NO: 106075 - RNA, 21 nt, Human
ucugcagcucuauuccgagcc

SEQ ID NO: 106076 - RNA, 26 nt, Human
ggcuaaaucaguuuuauuguccucug

SEQ ID NO: 106077 - RNA, 22 nt, Human
ucauacgcuaaaaugauauugg

SEQ ID NO: 106078 - RNA, 26 nt, Human
cuccggcgagcgcauucauucacaua

SEQ ID NO: 106079 - RNA, 27 nt, Human
cacugccuccugugacgugaggcccau

SEQ ID NO: 106080 - RNA, 25 nt, Human
ggcggccucugaccugcugucuacu

SEQ ID NO: 106081 - RNA, 20 nt, Human
acugccucugucccucuggu

SEQ ID NO: 106082 - RNA, 23 nt, Human
gcaaaacuguccagcaaaaugaa

SEQ ID NO: 106083 - RNA, 25 nt, Human
cucaucugcaggcgcucacaaccua

SEQ ID NO: 106084 - RNA, 21 nt, Human
uguaggccaggcuggucucga

SEQ ID NO: 106085 - RNA, 25 nt, Human
cauagaaacauaauaaauauacaag

SEQ ID NO: 106086 - RNA, 26 nt, Human
cgaaauucacuugucuuuugcuaaua

SEQ ID NO: 106087 - RNA, 25 nt, Human
ucucaaucuccugaccucauauucc

SEQ ID NO: 106088 - RNA, 26 nt, Human
ugucugugccaugggcugagugccac

SEQ ID NO: 106089 - RNA, 22 nt, Human
uuaccugaacugaggggugaua

SEQ ID NO: 106090 - RNA, 24 nt, Human
auuugaaaacauguuuauuuuucu

SEQ ID NO: 106091 - RNA, 21 nt, Human
uagcuaauuguuaauuauaau

SEQ ID NO: 106092 - RNA, 20 nt, Human
ggcacaucuccaggucucca

SEQ ID NO: 106093 - RNA, 27 nt, Human
uggcucaugccuguaaucccaccacuu

SEQ ID NO: 106094 - RNA, 21 nt, Human
gggcuguacuguccgcuguuu

SEQ ID NO: 106095 - RNA, 22 nt, Human
cccgaggucaggaguugaagac

SEQ ID NO: 106096 - RNA, 30 nt, Human
uuugcggaaugaaugaacacccugucugca

SEQ ID NO: 106097 - RNA, 23 nt, Human
uuuuccaaggacucugugucuuc

SEQ ID NO: 106098 - RNA, 22 nt, Human
acucccaugugucuucagcuuu

SEQ ID NO: 106099 - RNA, 21 nt, Human
gccucuccccuccuaccugcc

SEQ ID NO: 106100 - RNA, 22 nt, Human
acacaaaggcaugcuggaguac

SEQ ID NO: 106101 - RNA, 20 nt, Human
gcucccucagacuggggcaa

SEQ ID NO: 106102 - RNA, 26 nt, Human
uguuguagacuggacucuggcugcgc

SEQ ID NO: 106103 - RNA, 24 nt, Human
cuccugcuccacccccaucccacu

SEQ ID NO: 106104 - RNA, 21 nt, Human
ugaaacuuacugcucuucugu

SEQ ID NO: 106105 - RNA, 24 nt, Human
cugcucuggcaggucuaggcggaa

SEQ ID NO: 106106 - RNA, 23 nt, Human
ugucacugucucccugccuguca

SEQ ID NO: 106107 - RNA, 21 nt, Human
ugaugauuuggggauuuucug

SEQ ID NO: 106108 - RNA, 24 nt, Human
aaaucacuuucaaaggaguuccca

SEQ ID NO: 106109 - RNA, 21 nt, Human
ucaugaaauuugggcagcagg

SEQ ID NO: 106110 - RNA, 20 nt, Human
ccuccccaccccacuucuau

SEQ ID NO: 106111 - RNA, 22 nt, Human
guuaggaacugcauuaaagucc

SEQ ID NO: 106112 - RNA, 22 nt, Human
ucuacagcccagcucauccaga

SEQ ID NO: 106113 - RNA, 24 nt, Human
gagaggacaagugaggucugcuca

SEQ ID NO: 106114 - RNA, 23 nt, Human
uccuuuugcaugaaacaauuaug

SEQ ID NO: 106115 - RNA, 20 nt, Human
cacuuucucccugucuggcc

SEQ ID NO: 106116 - RNA, 24 nt, Human
gcuccacccccucccgucccagcc

SEQ ID NO: 106117 - RNA, 22 nt, Human
gcuaagguugcugccaugguaa

SEQ ID NO: 106118 - RNA, 22 nt, Human
cuggcugaacagugcucugccu

SEQ ID NO: 106119 - RNA, 19 nt, Human
aacaaaugcuguacuccaa

SEQ ID NO: 106120 - RNA, 21 nt, Human
aacuucauauauguauucuua

SEQ ID NO: 106121 - RNA, 21 nt, Human
cuucugccaccacuuggcuau

SEQ ID NO: 106122 - RNA, 21 nt, Human
cccuguaaucucagcacuuug

SEQ ID NO: 106123 - RNA, 18 nt, Human
ugcuggggugaaggugag

SEQ ID NO: 106124 - RNA, 20 nt, Human
ccuuaggaguccaggcugca

SEQ ID NO: 106125 - RNA, 30 nt, Human
cccagguuugcucuccccaaguuugggguc

SEQ ID NO: 106126 - RNA, 19 nt, Human
aucacuccugaauacagag

SEQ ID NO: 106127 - RNA, 22 nt, Human
auuuuucuguugggcaggccaa

SEQ ID NO: 106128 - RNA, 23 nt, Human
agagagcuaagauuaucugggga

SEQ ID NO: 106129 - RNA, 25 nt, Human
gcauccaaagccacaccacagucgg

SEQ ID NO: 106130 - RNA, 27 nt, Human
cauggaaaaggacagcccucugcugca

SEQ ID NO: 106131 - RNA, 21 nt, Human
ccccacucugcccuccaaaaa

SEQ ID NO: 106132 - RNA, 24 nt, Human
ccgggaagcagagccuggucguga

SEQ ID NO: 106133 - RNA, 25 nt, Human
gcgcccagagccccagucugaggcu

SEQ ID NO: 106134 - RNA, 21 nt, Human
uagugaauauuaagguaguua

SEQ ID NO: 106135 - RNA, 27 nt, Human
cccgccuggcccugggacucugacccu

SEQ ID NO: 106136 - RNA, 22 nt, Human
uaucuaugaagacaucuuccca

SEQ ID NO: 106137 - RNA, 26 nt, Human
gcugguugguuuuuccugcuccuggg

SEQ ID NO: 106138 - RNA, 22 nt, Human
ugauucucagaagcagaaagca

SEQ ID NO: 106139 - RNA, 21 nt, Human
gccugcucugccccuuggagc

SEQ ID NO: 106140 - RNA, 21 nt, Human
uuuuggguaggagaacuggga

SEQ ID NO: 106141 - RNA, 20 nt, Human
gaagugagugaaggagccag

SEQ ID NO: 106142 - RNA, 20 nt, Human
uccuccugccucaccgcccg

SEQ ID NO: 106143 - RNA, 20 nt, Human
acaaaaugcuucuaguccag

SEQ ID NO: 106144 - RNA, 25 nt, Human
gggucuagaaugggaacuggagagg

SEQ ID NO: 106145 - RNA, 28 nt, Human
cuuugccaaggcucuccccucucgcccc

SEQ ID NO: 106146 - RNA, 26 nt, Human
gucaaugucauucucuucucugccau

SEQ ID NO: 106147 - RNA, 22 nt, Human
uguggguggaaagaucaaauua

SEQ ID NO: 106148 - RNA, 24 nt, Human
uaucggcucgguacucaacacaac

SEQ ID NO: 106149 - RNA, 25 nt, Human
acacccagaccuccaggagagacca

SEQ ID NO: 106150 - RNA, 20 nt, Human
gggcucuggcuuuucuugaa

SEQ ID NO: 106151 - RNA, 19 nt, Human
aggaaagaauaaggcagca

SEQ ID NO: 106152 - RNA, 20 nt, Human
cuguauaagacaaagccaag

SEQ ID NO: 106153 - RNA, 22 nt, Human
ugcuugaacccgggaggcggag

SEQ ID NO: 106154 - RNA, 23 nt, Human
ccucugcugccgggccuggacca

SEQ ID NO: 106155 - RNA, 22 nt, Human
uucucagauacagaccguuuua

SEQ ID NO: 106156 - RNA, 25 nt, Human
cuagauggauguugaugcacuggag

SEQ ID NO: 106157 - RNA, 23 nt, Human
caggcauggcaagguugcauaug

SEQ ID NO: 106158 - RNA, 19 nt, Human
ggggugaguaccgggcacu

SEQ ID NO: 106159 - RNA, 27 nt, Human
gcucugugcuuuccagcaggcgcuccu

SEQ ID NO: 106160 - RNA, 16 nt, Human
cgcuuuucccaccucu

SEQ ID NO: 106161 - RNA, 19 nt, Human
aaaaaugaucaaaaacaaa

SEQ ID NO: 106162 - RNA, 19 nt, Human
cauagugggcuauuacagg

SEQ ID NO: 106163 - RNA, 26 nt, Human
gugaagcuccccaaggcuccugaggu

SEQ ID NO: 106164 - RNA, 21 nt, Human
uuggggcagggagagagggaa

SEQ ID NO: 106165 - RNA, 21 nt, Human
gaagugcuguauuacagaaca

SEQ ID NO: 106166 - RNA, 19 nt, Human
ccugcuuccaacacuuguu

SEQ ID NO: 106167 - RNA, 22 nt, Human
aaggucugaaaagcaagggaau

SEQ ID NO: 106168 - RNA, 27 nt, Human
aaucuaggcccaagagggaaaggccac

SEQ ID NO: 106169 - RNA, 27 nt, Human
agcccuaggucccagagguccgcucag

SEQ ID NO: 106170 - RNA, 22 nt, Human
cagccccuuccuggaugaagga

SEQ ID NO: 106171 - RNA, 24 nt, Human
ccagcccuucaucagccugggcag

SEQ ID NO: 106172 - RNA, 19 nt, Human
aaugauguaacagugcaag

SEQ ID NO: 106173 - RNA, 23 nt, Human
ccaaugccauacauaugguaggc

SEQ ID NO: 106174 - RNA, 19 nt, Human
gcgggaggagggaguggag

SEQ ID NO: 106175 - RNA, 27 nt, Human
ggcccucaggaagaagauagucacaug

SEQ ID NO: 106176 - RNA, 21 nt, Human
ccgcggguggaggccggggug

SEQ ID NO: 106177 - RNA, 20 nt, Human
aaaguuaauuauaucaguuu

SEQ ID NO: 106178 - RNA, 27 nt, Human
uuuguugcccaggcuggaguggagugg

SEQ ID NO: 106179 - RNA, 22 nt, Human
cauuuuuaagcuaauacucuua

SEQ ID NO: 106180 - RNA, 25 nt, Human
uugcacuuucagccuguguagggca

SEQ ID NO: 106181 - RNA, 21 nt, Human
auacaguaagcugaccuggaa

SEQ ID NO: 106182 - RNA, 22 nt, Human
guccuguuucauuucucgugac

SEQ ID NO: 106183 - RNA, 23 nt, Human
caaaggagaauauauaucuugug

SEQ ID NO: 106184 - RNA, 20 nt, Human
aaccaaaaugaggaguacag

SEQ ID NO: 106185 - RNA, 23 nt, Human
augaagagacuucugcuuuucaa

SEQ ID NO: 106186 - RNA, 23 nt, Human
aggcuggggugcaguggcgcgau

SEQ ID NO: 106187 - RNA, 23 nt, Human
aggcuggagugcaguagcgcgau

SEQ ID NO: 106188 - RNA, 24 nt, Human
cgucacccaaaagcacaaaaugga

SEQ ID NO: 106189 - RNA, 20 nt, Human
uaccccuggccaaggaagau

SEQ ID NO: 106190 - RNA, 27 nt, Human
ugcagcuccgggaaacaagugaauuca

SEQ ID NO: 106191 - RNA, 21 nt, Human
caaacucaguucgaccaaacu

SEQ ID NO: 106192 - RNA, 19 nt, Human
aagguuagaaacauuuuga

SEQ ID NO: 106193 - RNA, 15 nt, Human
uuagcccuucaccuc

SEQ ID NO: 106194 - RNA, 23 nt, Human
ccucuuucccugucccaaucccc

SEQ ID NO: 106195 - RNA, 27 nt, Human
gcagaaaagguagugaccggcccggcg

SEQ ID NO: 106196 - RNA, 26 nt, Human
acagaagucccccagugccugccagg

SEQ ID NO: 106197 - RNA, 24 nt, Human
guccacugcuccauuuauaacccc

SEQ ID NO: 106198 - RNA, 21 nt, Human
gcuacugcuacugcugcugcu

SEQ ID NO: 106199 - RNA, 22 nt, Human
gaaccuagagcccaagguucag

SEQ ID NO: 106200 - RNA, 23 nt, Human
agcagugcacuccagucugcagg

SEQ ID NO: 106201 - RNA, 21 nt, Human
uuccuuuauaaaugucuaguu

SEQ ID NO: 106202 - RNA, 24 nt, Human
ccuccacuccggcaucagcagcca

SEQ ID NO: 106203 - RNA, 24 nt, Human
agcuuugacaaggaacuuuccuaa

SEQ ID NO: 106204 - RNA, 21 nt, Human
caggagacggugguugcagug

SEQ ID NO: 106205 - RNA, 19 nt, Human
uauuccugccuuucuucca

SEQ ID NO: 106206 - RNA, 25 nt, Human
gcgcuuuccccuccucagccugggc

SEQ ID NO: 106207 - RNA, 25 nt, Human
ccagguggcccgggagcugcaggug

SEQ ID NO: 106208 - RNA, 24 nt, Human
uucaacaacaaaacauuugcucug

SEQ ID NO: 106209 - RNA, 22 nt, Human
gaauuugggagaggugggauuc

SEQ ID NO: 106210 - RNA, 19 nt, Human
aggcuggcugaaaaucacu

SEQ ID NO: 106211 - RNA, 19 nt, Human
ucaguacuaccaccaccac

SEQ ID NO: 106212 - RNA, 22 nt, Human
uccuggcaguggggacugccug

SEQ ID NO: 106213 - RNA, 22 nt, Human
uacagauauacagauauacaaa

SEQ ID NO: 106214 - RNA, 22 nt, Human
uacagauauacaaauauacaga

SEQ ID NO: 106215 - RNA, 23 nt, Human
ggcugguaucccaaacucugguu

SEQ ID NO: 106216 - RNA, 26 nt, Human
guuaaaaaacagagagggaugcuugg

SEQ ID NO: 106217 - RNA, 27 nt, Human
uuuauuucccuuccacagugugguuuc

SEQ ID NO: 106218 - RNA, 27 nt, Human
gcucaggccacacagagacacauacuu

SEQ ID NO: 106219 - RNA, 20 nt, Human
uuguccccaaaggggugggu

SEQ ID NO: 106220 - RNA, 23 nt, Human
gacauuuguucucccaaaacuga

SEQ ID NO: 106221 - RNA, 27 nt, Human
caggcuggccagcauggugaaaccccg

SEQ ID NO: 106222 - RNA, 25 nt, Human
agaaacacugggacagugguuugaa

SEQ ID NO: 106223 - RNA, 22 nt, Human
uggagugcucacaguguggcug

SEQ ID NO: 106224 - RNA, 27 nt, Human
uugcuuucuucuuaaccuauuuauuuc

SEQ ID NO: 106225 - RNA, 21 nt, Human
ucacccaggcuggaguacagu

SEQ ID NO: 106226 - RNA, 21 nt, Human
ucacccagacuggagugcagu

SEQ ID NO: 106227 - RNA, 21 nt, Human
cugcuuuguuuuccuccugau

SEQ ID NO: 106228 - RNA, 23 nt, Human
uccuguaaucccagcuacuuagg

SEQ ID NO: 106229 - RNA, 20 nt, Human
cacaccagccacugucccca

SEQ ID NO: 106230 - RNA, 21 nt, Human
cucauuggccgaccauccugu

SEQ ID NO: 106231 - RNA, 23 nt, Human
aaaagauguaggggcuuggaggu

SEQ ID NO: 106232 - RNA, 24 nt, Human
aacaaugcuccuucauuuuacuac

SEQ ID NO: 106233 - RNA, 27 nt, Human
aggccaucaauaucacaauagauuucu

SEQ ID NO: 106234 - RNA, 27 nt, Human
agccggacgugguggugccugccugua

SEQ ID NO: 106235 - RNA, 26 nt, Human
cgccucagccucccaaagugcuagga

SEQ ID NO: 106236 - RNA, 26 nt, Human
ggugcugcugcuccugcagcugccuu

SEQ ID NO: 106237 - RNA, 26 nt, Human
ccuccaccuccuggguuuaagcgauu

SEQ ID NO: 106238 - RNA, 22 nt, Human
accauuuuaaaguaaacaauuc

SEQ ID NO: 106239 - RNA, 24 nt, Human
uacagccacaagccugccuccucc

SEQ ID NO: 106240 - RNA, 25 nt, Human
agucauccuggagcacagcucuucc

SEQ ID NO: 106241 - RNA, 19 nt, Human
cucgcacuuccagccuugg

SEQ ID NO: 106242 - RNA, 19 nt, Human
ucauccagaagcacuguga

SEQ ID NO: 106243 - RNA, 24 nt, Human
uggcuaacacagugaaaccccguc

SEQ ID NO: 106244 - RNA, 25 nt, Human
auaaagguuuuuggagcugcacuga

SEQ ID NO: 106245 - RNA, 26 nt, Human
ucauucuucuguacgucugacaggca

SEQ ID NO: 106246 - RNA, 26 nt, Human
gugaaugucacaaaugccuucuaugu

SEQ ID NO: 106247 - RNA, 27 nt, Human
cacagccgucacaugguccuccugaag

SEQ ID NO: 106248 - RNA, 26 nt, Human
ggagggcugcugggagccucuccugu

SEQ ID NO: 106249 - RNA, 27 nt, Human
ccuaggcaacagagugagacuuugucu

SEQ ID NO: 106250 - RNA, 21 nt, Human
gccuauacacccagcacuuug

SEQ ID NO: 106251 - RNA, 27 nt, Human
cucgcugcauugugguguucucuucuc

SEQ ID NO: 106252 - RNA, 26 nt, Human
acgccccagagggcucaugugggccc

SEQ ID NO: 106253 - RNA, 20 nt, Human
ucacaugccuacauuuuaca

SEQ ID NO: 106254 - RNA, 23 nt, Human
uguugaccaggcuggagugaagu

SEQ ID NO: 106255 - RNA, 23 nt, Human
guccagucaauguugguuacuaa

SEQ ID NO: 106256 - RNA, 23 nt, Human
cuauaaaccacagcuguccccca

SEQ ID NO: 106257 - RNA, 27 nt, Human
ugaccaacauggagaaaccucgucucu

SEQ ID NO: 106258 - RNA, 22 nt, Human
aauaaaucuauauuuuugugaa

SEQ ID NO: 106259 - RNA, 20 nt, Human
cugggaggggagggaggcgc

SEQ ID NO: 106260 - RNA, 22 nt, Human
agugggugggaggcacggggaa

SEQ ID NO: 106261 - RNA, 22 nt, Human
agaagcagcguuagggacuuug

SEQ ID NO: 106262 - RNA, 19 nt, Human
agugauuauucuaaaauaa

SEQ ID NO: 106263 - RNA, 22 nt, Human
ugggguagcugggguguggggu

SEQ ID NO: 106264 - RNA, 24 nt, Human
uuaauuauuguuauacacagcuuu

SEQ ID NO: 106265 - RNA, 22 nt, Human
aggaguuacaaaguuugcaaag

SEQ ID NO: 106266 - RNA, 19 nt, Human
ucccacccuccaucuaccc

SEQ ID NO: 106267 - RNA, 20 nt, Human
acauugccuugagcuuuuca

SEQ ID NO: 106268 - RNA, 20 nt, Human
aucauagaagucauuuuaga

SEQ ID NO: 106269 - RNA, 19 nt, Human
agagcauuuguuucaucuu

SEQ ID NO: 106270 - RNA, 22 nt, Human
accagccuagccaagaugguga

SEQ ID NO: 106271 - RNA, 23 nt, Human
cuccaagcugggagcuccugggc

SEQ ID NO: 106272 - RNA, 24 nt, Human
auuguucagaccucagcuccuggg

SEQ ID NO: 106273 - RNA, 21 nt, Human
cugcaaccucugccccccggg

SEQ ID NO: 106274 - RNA, 27 nt, Human
acuguaacuaccaaucuucuacuuggu

SEQ ID NO: 106275 - RNA, 21 nt, Human
gugugaugcaauuacugcugu

SEQ ID NO: 106276 - RNA, 27 nt, Human
guccucuccuggccuccagucuccccu

SEQ ID NO: 106277 - RNA, 21 nt, Human
ggaguggauucugggagccuc

SEQ ID NO: 106278 - RNA, 23 nt, Human
ccucugcccagcuugggcccagc

SEQ ID NO: 106279 - RNA, 22 nt, Human
ugucaacuugaaacuaaaacau

SEQ ID NO: 106280 - RNA, 24 nt, Human
uccaauaacucgugcucaucugca

SEQ ID NO: 106281 - RNA, 23 nt, Human
ggggaagaaaggagggcugugag

SEQ ID NO: 106282 - RNA, 21 nt, Human
cccagcugcuggggggcugag

SEQ ID NO: 106283 - RNA, 23 nt, Human
ugcuacaucaaugcagcaaaaac

SEQ ID NO: 106284 - RNA, 20 nt, Human
cacagacagagacagagcca

SEQ ID NO: 106285 - RNA, 27 nt, Human
ggacuccugugugccuccugccauccc

SEQ ID NO: 106286 - RNA, 20 nt, Human
ccagaaaggggaaaguugca

SEQ ID NO: 106287 - RNA, 25 nt, Human
uacugcugugggcugggguuggggg

SEQ ID NO: 106288 - RNA, 23 nt, Human
guccccggggccuggaguaaaga

SEQ ID NO: 106289 - RNA, 20 nt, Human
aaggagggcaacuucuacuc

SEQ ID NO: 106290 - RNA, 24 nt, Human
gcuaauccucaucugucauaucca

SEQ ID NO: 106291 - RNA, 22 nt, Human
cagaagugcaagagccuaagcc

SEQ ID NO: 106292 - RNA, 24 nt, Human
uguuagugguugugucugcuuuaa

SEQ ID NO: 106293 - RNA, 18 nt, Human
acucccaccaucugcagg

SEQ ID NO: 106294 - RNA, 27 nt, Human
cccuccugugccccagcugccaggugg

SEQ ID NO: 106295 - RNA, 26 nt, Human
ugcaugaaaaaacaucuuuauuuucu

SEQ ID NO: 106296 - RNA, 23 nt, Human
gcagcccagcucuguggcaggag

SEQ ID NO: 106297 - RNA, 22 nt, Human
gcccagacuggagagcaguggc

SEQ ID NO: 106298 - RNA, 23 nt, Human
aaggguugagaagaaagagaaau

SEQ ID NO: 106299 - RNA, 22 nt, Human
uaauccuuggcagggcucagca

SEQ ID NO: 106300 - RNA, 26 nt, Human
ggagagaaggggacacucgaguccag

SEQ ID NO: 106301 - RNA, 26 nt, Human
ucuccaggaacucccagcacgcagaa

SEQ ID NO: 106302 - RNA, 20 nt, Human
acaggcagauacaggaaaag

SEQ ID NO: 106303 - RNA, 27 nt, Human
cagaacaaccagcuggaucaguucuca

SEQ ID NO: 106304 - RNA, 20 nt, Human
aaucugucuguuuagaaucu

SEQ ID NO: 106305 - RNA, 23 nt, Human
ucccuuaccgaucggcauucaua

SEQ ID NO: 106306 - RNA, 21 nt, Human
uuucaguaaaauuuguccuca

SEQ ID NO: 106307 - RNA, 22 nt, Human
ggggaaggggcggugcccacac

SEQ ID NO: 106308 - RNA, 23 nt, Human
ccucuacuggggucguucuggcu

SEQ ID NO: 106309 - RNA, 27 nt, Human
ccaacagcgacauagcccaucccugcc

SEQ ID NO: 106310 - RNA, 23 nt, Human
ggccaggaccaagggcagagggg

SEQ ID NO: 106311 - RNA, 27 nt, Human
ucauccaggcaugggcugccagguuuu

SEQ ID NO: 106312 - RNA, 22 nt, Human
uagauuuccacuaaugugucuu

SEQ ID NO: 106313 - RNA, 27 nt, Human
ugacugccguuggaccguaggcccugg

SEQ ID NO: 106314 - RNA, 22 nt, Human
uuuaucucuuucaaguagacca

SEQ ID NO: 106315 - RNA, 19 nt, Human
acggcaagacuccaucuca

SEQ ID NO: 106316 - RNA, 24 nt, Human
uaacccacaggcagguugguuuac

SEQ ID NO: 106317 - RNA, 24 nt, Human
ugggcacagguggccccugcugcu

SEQ ID NO: 106318 - RNA, 26 nt, Human
ccacuucuccccgcccacccugccgg

SEQ ID NO: 106319 - RNA, 19 nt, Human
ucuacugucucaguuuaca

SEQ ID NO: 106320 - RNA, 26 nt, Human
ucugcacucuucagucuuugcaggca

SEQ ID NO: 106321 - RNA, 22 nt, Human
ccuguuccuggcccgcagccgc

SEQ ID NO: 106322 - RNA, 27 nt, Human
ccucugccucucucuuauaaggacacu

SEQ ID NO: 106323 - RNA, 24 nt, Human
aggacuugguaggccaggaagaaa

SEQ ID NO: 106324 - RNA, 24 nt, Human
uaagaacaacagcaacaaaaggcu

SEQ ID NO: 106325 - RNA, 22 nt, Human
gggauuacaggcaugagccacc

SEQ ID NO: 106326 - RNA, 22 nt, Human
aggauuacaggcaugaaccacc

SEQ ID NO: 106327 - RNA, 21 nt, Human
agccaugugucauguaauacu

SEQ ID NO: 106328 - RNA, 19 nt, Human
uguauuuucccugcccuca

SEQ ID NO: 106329 - RNA, 18 nt, Human
ugcccuuucccagcucuu

SEQ ID NO: 106330 - RNA, 19 nt, Human
gaaacuuuguaugugcaca

SEQ ID NO: 106331 - RNA, 22 nt, Human
ccuuuucccuguugugccacca

SEQ ID NO: 106332 - RNA, 22 nt, Human
gcccucuggggcucagcucuga

SEQ ID NO: 106333 - RNA, 17 nt, Human
uaacugcacgugccuuc

SEQ ID NO: 106334 - RNA, 21 nt, Human
accgaggaggagggagccuag

SEQ ID NO: 106335 - RNA, 21 nt, Human
aaggauuugagauguucucaa

SEQ ID NO: 106336 - RNA, 26 nt, Human
cccuccaggcugauccugaggccugg

SEQ ID NO: 106337 - RNA, 25 nt, Human
gcugugggcugggccuguggugccu

SEQ ID NO: 106338 - RNA, 23 nt, Human
ucccucugccccucccaccugca

SEQ ID NO: 106339 - RNA, 18 nt, Human
ggaauuacauuugcucaa

SEQ ID NO: 106340 - RNA, 21 nt, Human
aggauuacaaaauguguucca

SEQ ID NO: 106341 - RNA, 26 nt, Human
cugcuucaauauuuguaagugcugcu

SEQ ID NO: 106342 - RNA, 20 nt, Human
cagccgggagcgggggcgca

SEQ ID NO: 106343 - RNA, 20 nt, Human
ggucccucugucccuguguc

SEQ ID NO: 106344 - RNA, 22 nt, Human
cuagaagaaaagauaaugagua

SEQ ID NO: 106345 - RNA, 26 nt, Human
ggcaucuucgcuucuccuaggaggug

SEQ ID NO: 106346 - RNA, 22 nt, Human
auuacugucugucugugucuuu

SEQ ID NO: 106347 - RNA, 22 nt, Human
cggcaggcggcggcgguggugg

SEQ ID NO: 106348 - RNA, 31 nt, Human
uuuugcacauuggaagccucaaaaacagucc

SEQ ID NO: 106349 - RNA, 27 nt, Human
aacuguacuggccaauuuuugaaauaa

SEQ ID NO: 106350 - RNA, 21 nt, Human
gggcugggacuggagcuggag

SEQ ID NO: 106351 - RNA, 26 nt, Human
ggagaauacuuugcuucauaguauug

SEQ ID NO: 106352 - RNA, 22 nt, Human
agagugcacagcaaaggggauc

SEQ ID NO: 106353 - RNA, 22 nt, Human
ucaaaacaacagaggaaaugcu

SEQ ID NO: 106354 - RNA, 23 nt, Human
agcugugggguccagacuuguug

SEQ ID NO: 106355 - RNA, 21 nt, Human
ccugcaauuccagcacuuugg

SEQ ID NO: 106356 - RNA, 21 nt, Human
uucccaaacugaucuuuucau

SEQ ID NO: 106357 - RNA, 22 nt, Human
uccucauguucuugcauggccc

SEQ ID NO: 106358 - RNA, 21 nt, Human
agcccagucuggagugcagug

SEQ ID NO: 106359 - RNA, 22 nt, Human
ucacauggugagggugggggug

SEQ ID NO: 106360 - RNA, 26 nt, Human
ggcaaaucaggucugacuuugucacc

SEQ ID NO: 106361 - RNA, 21 nt, Human
uacguccccagguuucgggag

SEQ ID NO: 106362 - RNA, 25 nt, Human
ucaugaucucaccuaugacuuuggg

SEQ ID NO: 106363 - RNA, 19 nt, Human
ccugcucucacacacacca

SEQ ID NO: 106364 - RNA, 27 nt, Human
ccccaacaauugugugaauuaauuucu

SEQ ID NO: 106365 - RNA, 23 nt, Human
gagcugcacugaaacuuuacgac

SEQ ID NO: 106366 - RNA, 23 nt, Human
cuauuaaccuuuuuugucuuauu

SEQ ID NO: 106367 - RNA, 22 nt, Human
cuaaagcuauccauugugucau

SEQ ID NO: 106368 - RNA, 20 nt, Human
agaaggaccccuggagccag

SEQ ID NO: 106369 - RNA, 22 nt, Human
cacuauacagagagucugaacc

SEQ ID NO: 106370 - RNA, 21 nt, Human
ccugugaucccagcacuuugg

SEQ ID NO: 106371 - RNA, 22 nt, Human
cccaaacaccagucaccucguc

SEQ ID NO: 106372 - RNA, 21 nt, Human
uccuaaggagcaccaacucua

SEQ ID NO: 106373 - RNA, 24 nt, Human
cugccaagccacuugccaaagaag

SEQ ID NO: 106374 - RNA, 21 nt, Human
ccucguuccaaucccugccgu

SEQ ID NO: 106375 - RNA, 29 nt, Human
gggaagucgcuuuuggugccuggcugguu

SEQ ID NO: 106376 - RNA, 22 nt, Human
ccgugggccucagggcagccag

SEQ ID NO: 106377 - RNA, 28 nt, Human
caaaauaagcaacuaaaugagaccuaau

SEQ ID NO: 106378 - RNA, 23 nt, Human
gcugacagcucuagacacucaca

SEQ ID NO: 106379 - RNA, 23 nt, Human
cucuguauuccuagaaacugaca

SEQ ID NO: 106380 - RNA, 23 nt, Human
aucacccuagugccauguuuggu

SEQ ID NO: 106381 - RNA, 22 nt, Human
aggccuuuuccugucugccuuu

SEQ ID NO: 106382 - RNA, 26 nt, Human
ggagagagaagacguggagggaggga

SEQ ID NO: 106383 - RNA, 23 nt, Human
ucacaugccuccccucaaucaca

SEQ ID NO: 106384 - RNA, 25 nt, Human
ccugccugugucccagcuuggaggc

SEQ ID NO: 106385 - RNA, 22 nt, Human
uuccaaaauaaaacaaagggca

SEQ ID NO: 106386 - RNA, 27 nt, Human
ccugcugcauccugugcuccgcaggcu

SEQ ID NO: 106387 - RNA, 20 nt, Human
ggguuugagcaaugcuucuc

SEQ ID NO: 106388 - RNA, 23 nt, Human
ugucagcuacugcggaaaaggaa

SEQ ID NO: 106389 - RNA, 27 nt, Human
agacccaaccauuucuuccaccugcuu

SEQ ID NO: 106390 - RNA, 21 nt, Human
gauguagcuaaaauguuuuca

SEQ ID NO: 106391 - RNA, 21 nt, Human
uuucauuuucguguugccagc

SEQ ID NO: 106392 - RNA, 22 nt, Human
gaccagccuggacagcuuagug

SEQ ID NO: 106393 - RNA, 23 nt, Human
gucuucacucuuaggcacuuugg

SEQ ID NO: 106394 - RNA, 19 nt, Human
cugccucugucccccagug

SEQ ID NO: 106395 - RNA, 23 nt, Human
ccagccuuggcccuguuguaggc

SEQ ID NO: 106396 - RNA, 23 nt, Human
ccugcugcugccaccgcuuccug

SEQ ID NO: 106397 - RNA, 24 nt, Human
acuguucuguccucaaguacucaa

SEQ ID NO: 106398 - RNA, 19 nt, Human
ccaacagcauucacugcca

SEQ ID NO: 106399 - RNA, 22 nt, Human
ccaaugccacagccaagcccac

SEQ ID NO: 106400 - RNA, 22 nt, Human
aguggugccaucuuggcucacu

SEQ ID NO: 106401 - RNA, 24 nt, Human
agcacuccagucccaucaccugaa

SEQ ID NO: 106402 - RNA, 21 nt, Human
ccccaacagcuuuguauuucu

SEQ ID NO: 106403 - RNA, 21 nt, Human
cggcagcaguggucuguuuga

SEQ ID NO: 106404 - RNA, 22 nt, Human
cugccucuggccgcggccugug

SEQ ID NO: 106405 - RNA, 20 nt, Human
gcagccagugugacacugcu

SEQ ID NO: 106406 - RNA, 20 nt, Human
aagaacauacaaggacauuc

SEQ ID NO: 106407 - RNA, 27 nt, Human
ucugcugcugcccucucaucagaccuc

SEQ ID NO: 106408 - RNA, 17 nt, Human
acacauuuacaguauua

SEQ ID NO: 106409 - RNA, 22 nt, Human
guccugcugagauacucucuca

SEQ ID NO: 106410 - RNA, 22 nt, Human
gauuuggggggugccuggugau

SEQ ID NO: 106411 - RNA, 23 nt, Human
uccuccaaggcuggagugcagug

SEQ ID NO: 106412 - RNA, 22 nt, Human
ccagccugggcaacaagaguaa

SEQ ID NO: 106413 - RNA, 24 nt, Human
ggucaucuuugcaggucccgacac

SEQ ID NO: 106414 - RNA, 22 nt, Human
ggugcucugggaguccugugcu

SEQ ID NO: 106415 - RNA, 24 nt, Human
ucacaauccaucucuucuuaaguu

SEQ ID NO: 106416 - RNA, 22 nt, Human
cagaaacugaagcuguucucag

SEQ ID NO: 106417 - RNA, 26 nt, Human
gagggugagacagugggggugccugg

SEQ ID NO: 106418 - RNA, 26 nt, Human
guuuuuaaagaagggggcuuucuuuu

SEQ ID NO: 106419 - RNA, 22 nt, Human
cccgucauuccucacaggacag

SEQ ID NO: 106420 - RNA, 21 nt, Human
ccuuuuuaaccauuccaaucg

SEQ ID NO: 106421 - RNA, 22 nt, Human
ucaggaggggacagcugggggc

SEQ ID NO: 106422 - RNA, 22 nt, Human
agcgucccagagugcugggauu

SEQ ID NO: 106423 - RNA, 27 nt, Human
gcagagcccaggcuggggaagugaacu

SEQ ID NO: 106424 - RNA, 24 nt, Human
ucucaaccugcugacuuuuccuaa

SEQ ID NO: 106425 - RNA, 21 nt, Human
acuguagaaacccuccagaaa

SEQ ID NO: 106426 - RNA, 27 nt, Human
ccuuuauuuuacuguggaauaugugcu

SEQ ID NO: 106427 - RNA, 20 nt, Human
ccauucucuuuuucaucucg

SEQ ID NO: 106428 - RNA, 22 nt, Human
ccugcugcgccccaggccccgc

SEQ ID NO: 106429 - RNA, 26 nt, Human
ggugggggcaucaggagcaggggcag

SEQ ID NO: 106430 - RNA, 22 nt, Human
uauucugcucccagccugccag

SEQ ID NO: 106431 - RNA, 22 nt, Human
cacaccuguaauccuugcauuu

SEQ ID NO: 106432 - RNA, 20 nt, Human
cuagcgcaagugaauacuga

SEQ ID NO: 106433 - RNA, 27 nt, Human
gcagccacacauguacauauguguaca

SEQ ID NO: 106434 - RNA, 25 nt, Human
agagcuacagaccuauggggccugg

SEQ ID NO: 106435 - RNA, 26 nt, Human
ggggugaggagggaagugggguaugg

SEQ ID NO: 106436 - RNA, 21 nt, Human
cugcucccuccuuccucaucc

SEQ ID NO: 106437 - RNA, 27 nt, Human
agagcagccgucugaggggacgcagcc

SEQ ID NO: 106438 - RNA, 24 nt, Human
ccacugcacuccugggcaacagag

SEQ ID NO: 106439 - RNA, 26 nt, Human
ggacuugauuguaacuuacaccucag

SEQ ID NO: 106440 - RNA, 22 nt, Human
cuguuugcagauaugauugaug

SEQ ID NO: 106441 - RNA, 27 nt, Human
gaccugcuggguccuccggugcagugg

SEQ ID NO: 106442 - RNA, 22 nt, Human
gaucccucuucccaggcuccgu

SEQ ID NO: 106443 - RNA, 27 nt, Human
cauugcacuccagccuggucaacaaga

SEQ ID NO: 106444 - RNA, 27 nt, Human
ggcaggcaauggggguuagggagguug

SEQ ID NO: 106445 - RNA, 25 nt, Human
ggaaaugccagugacuuauuccaga

SEQ ID NO: 106446 - RNA, 23 nt, Human
cauagcuguuuauaucucuuuua

SEQ ID NO: 106447 - RNA, 26 nt, Human
agcccagcgccccgcacuuuucugag

SEQ ID NO: 106448 - RNA, 19 nt, Human
uuccucacaccuaacccug

SEQ ID NO: 106449 - RNA, 22 nt, Human
uaaaaucaagucuugguugugg

SEQ ID NO: 106450 - RNA, 23 nt, Human
aagaacauuuuuggaauagauau

SEQ ID NO: 106451 - RNA, 21 nt, Human
caccacacaccucccagcucu

SEQ ID NO: 106452 - RNA, 25 nt, Human
acagcucagcuaaugaaguacuaau

SEQ ID NO: 106453 - RNA, 20 nt, Human
ccagagcagccagcccagcc

SEQ ID NO: 106454 - RNA, 22 nt, Human
uuuaguagaauuguuuccuaaa

SEQ ID NO: 106455 - RNA, 21 nt, Human
aucucgagcuccugaccucag

SEQ ID NO: 106456 - RNA, 22 nt, Human
guagcacaggcugagugcaggc

SEQ ID NO: 106457 - RNA, 22 nt, Human
ucuccucccucuuucuucgggc

SEQ ID NO: 106458 - RNA, 24 nt, Human
uucaaugaaugguacgugugcggg

SEQ ID NO: 106459 - RNA, 25 nt, Human
augggcagagaagaaaaugaccagg

SEQ ID NO: 106460 - RNA, 23 nt, Human
cccaccccauggcacugccgcgu

SEQ ID NO: 106461 - RNA, 25 nt, Human
ucaauuucccacccaucuccaguag

SEQ ID NO: 106462 - RNA, 21 nt, Human
gagagauguuuuucccaccug

SEQ ID NO: 106463 - RNA, 26 nt, Human
uccucucucugaguuccucugggcug

SEQ ID NO: 106464 - RNA, 20 nt, Human
uucucucugcuguuuggguu

SEQ ID NO: 106465 - RNA, 26 nt, Human
cugggaggaggagucugcguaaugug

SEQ ID NO: 106466 - RNA, 23 nt, Human
cccuccugauuaaggcguggcuu

SEQ ID NO: 106467 - RNA, 21 nt, Human
ucuaagcggcgaucugugcua

SEQ ID NO: 106468 - RNA, 22 nt, Human
gcucacugcaagcucggccucc

SEQ ID NO: 106469 - RNA, 20 nt, Human
ccugcccugcccugccaccu

SEQ ID NO: 106470 - RNA, 17 nt, Human
ccugccuggcacaugcc

SEQ ID NO: 106471 - RNA, 22 nt, Human
acagagcucuggguugugcaca

SEQ ID NO: 106472 - RNA, 27 nt, Human
caggcuggggugcaguggcacgaucgc

SEQ ID NO: 106473 - RNA, 26 nt, Human
cugaaaacugugucuuccuggagacu

SEQ ID NO: 106474 - RNA, 22 nt, Human
gaauggugacucauuuggacuc

SEQ ID NO: 106475 - RNA, 27 nt, Human
aggagccucuuuguagggacugugccu

SEQ ID NO: 106476 - RNA, 24 nt, Human
cugagagcugguggugccugcugu

SEQ ID NO: 106477 - RNA, 27 nt, Human
ggagagggaugaggugcugggagggau

SEQ ID NO: 106478 - RNA, 27 nt, Human
caccacugagauccggcuugcuacaaa

SEQ ID NO: 106479 - RNA, 26 nt, Human
ccucuccugaucuaacucccugcugc

SEQ ID NO: 106480 - RNA, 27 nt, Human
gguuagaagugagggaguuugccccgu

SEQ ID NO: 106481 - RNA, 27 nt, Human
caggcuggaguggaguggcgugaucuu

SEQ ID NO: 106482 - RNA, 24 nt, Human
cgagugcuuccuggggcagagucu

SEQ ID NO: 106483 - RNA, 21 nt, Human
gcaaucagagcaccgcagcca

SEQ ID NO: 106484 - RNA, 19 nt, Human
gcucuuauuuaauguaaug

SEQ ID NO: 106485 - RNA, 20 nt, Human
ucccacauuaguguucuuua

SEQ ID NO: 106486 - RNA, 27 nt, Human
uguuaauagcaucucagcuuccucaga

SEQ ID NO: 106487 - RNA, 21 nt, Human
guguuuuuccugaccucucuu

SEQ ID NO: 106488 - RNA, 27 nt, Human
uguggggcaguggaugggugcuuagua

SEQ ID NO: 106489 - RNA, 21 nt, Human
acucuaccccgagacugccuu

SEQ ID NO: 106490 - RNA, 25 nt, Human
ugggaacaaauacagcuuucugcuu

SEQ ID NO: 106491 - RNA, 27 nt, Human
cuccaguguaucucaaaagaccgggcg

SEQ ID NO: 106492 - RNA, 19 nt, Human
gagagggaaacacagcagc

SEQ ID NO: 106493 - RNA, 20 nt, Human
cugccucuaccugccugguc

SEQ ID NO: 106494 - RNA, 20 nt, Human
cuugaccaucuccaucugcc

SEQ ID NO: 106495 - RNA, 19 nt, Human
gccuggagggcaggugccc

SEQ ID NO: 106496 - RNA, 17 nt, Human
uuaccugcagacacucc

SEQ ID NO: 106497 - RNA, 20 nt, Human
ucuucucuuccccaaggccu

SEQ ID NO: 106498 - RNA, 22 nt, Human
cccaucauucaugcuacugcca

SEQ ID NO: 106499 - RNA, 18 nt, Human
aggguuuuccacccugga

SEQ ID NO: 106500 - RNA, 23 nt, Human
cuguccuccuuuaccuuccucuc

SEQ ID NO: 106501 - RNA, 24 nt, Human
ccagggucacuucccgccuccucc

SEQ ID NO: 106502 - RNA, 26 nt, Human
ugaaaucaaacuuuucuauuucacug

SEQ ID NO: 106503 - RNA, 22 nt, Human
auccauguucuauuucagugcc

SEQ ID NO: 106504 - RNA, 27 nt, Human
gugugggguucucagugccggagcuug

SEQ ID NO: 106505 - RNA, 22 nt, Human
cggagucccccagaaaggucug

SEQ ID NO: 106506 - RNA, 22 nt, Human
gccaggauggcggaagauacgg

SEQ ID NO: 106507 - RNA, 23 nt, Human
aucacaccacugcaauccagccu

SEQ ID NO: 106508 - RNA, 26 nt, Human
ccgaauagcugggauuacagacaggc

SEQ ID NO: 106509 - RNA, 23 nt, Human
caggcuggagugcagugggugau

SEQ ID NO: 106510 - RNA, 27 nt, Human
uggauuagauuauuuugcucaccuuau

SEQ ID NO: 106511 - RNA, 20 nt, Human
cucacacacuugucugugcu

SEQ ID NO: 106512 - RNA, 26 nt, Human
uccauuugccucuaugaucuuagcuc

SEQ ID NO: 106513 - RNA, 24 nt, Human
cccuguacauccccuugcacagcc

SEQ ID NO: 106514 - RNA, 22 nt, Human
cuccuagcucaucugucaccga

SEQ ID NO: 106515 - RNA, 21 nt, Human
ggcucacugcaaccuccaccu

SEQ ID NO: 106516 - RNA, 21 nt, Human
gacucacugcaaccuccgccu

SEQ ID NO: 106517 - RNA, 28 nt, Human
gaggaaagagaauggauuuauagcuacc

SEQ ID NO: 106518 - RNA, 25 nt, Human
gccaaaacagauauacucgaaucag

SEQ ID NO: 106519 - RNA, 21 nt, Human
ggcucacugcaacuuccgccu

SEQ ID NO: 106520 - RNA, 28 nt, Human
ccuuugccugauccuccaacagcuguca

SEQ ID NO: 106521 - RNA, 22 nt, Human
ugcaggcuggggaggugcuggg

SEQ ID NO: 106522 - RNA, 28 nt, Human
cuuuuauauccuccucuccuugaguaau

SEQ ID NO: 106523 - RNA, 20 nt, Human
agcucugcgggucuacuuuc

SEQ ID NO: 106524 - RNA, 22 nt, Human
guugccuaggcuggaggacagu

SEQ ID NO: 106525 - RNA, 21 nt, Human
acucucaucuguugcuuucca

SEQ ID NO: 106526 - RNA, 21 nt, Human
ccugcucucucuccuccagcg

SEQ ID NO: 106527 - RNA, 21 nt, Human
uaaagagacagugauauugga

SEQ ID NO: 106528 - RNA, 26 nt, Human
ugacacuaacuuuucuuaagaugcug

SEQ ID NO: 106529 - RNA, 20 nt, Human
uucugcuguugaguccuggg

SEQ ID NO: 106530 - RNA, 20 nt, Human
gaaauugaagguaggcugag

SEQ ID NO: 106531 - RNA, 29 nt, Human
ggagggggaccucagaggagcaggaccag

SEQ ID NO: 106532 - RNA, 27 nt, Human
cccucauucagcacuucugcugggaac

SEQ ID NO: 106533 - RNA, 27 nt, Human
caccacuguacuccagccuggaugaca

SEQ ID NO: 106534 - RNA, 26 nt, Human
ccgggcagguggagcgcucgcggcug

SEQ ID NO: 106535 - RNA, 27 nt, Human
ccuacuuccugccagucuuucccaaag

SEQ ID NO: 106536 - RNA, 25 nt, Human
cuccucuccuuuccugcuucugcga

SEQ ID NO: 106537 - RNA, 19 nt, Human
guucccaccacugaagaug

SEQ ID NO: 106538 - RNA, 21 nt, Human
aaauacugugcuuacugugaa

SEQ ID NO: 106539 - RNA, 20 nt, Human
auauguauauuuaacuuugu

SEQ ID NO: 106540 - RNA, 20 nt, Human
ucuguccaucagugccauuu

SEQ ID NO: 106541 - RNA, 23 nt, Human
cugacuucucugaaucagaaaag

SEQ ID NO: 106542 - RNA, 23 nt, Human
ggugcucacgccuguaaucccag

SEQ ID NO: 106543 - RNA, 23 nt, Human
ucucaggccucccucaaccccac

SEQ ID NO: 106544 - RNA, 21 nt, Human
ugucuguuuccccacucucuu

SEQ ID NO: 106545 - RNA, 24 nt, Human
ggccucugcaacugcucagcucug

SEQ ID NO: 106546 - RNA, 30 nt, Human
ccucaauguugcugaccucaucugggggcu

SEQ ID NO: 106547 - RNA, 22 nt, Human
guugcccaagcuggucuuaaac

SEQ ID NO: 106548 - RNA, 26 nt, Human
ggaaguuaaaagguggcuuugaagga

SEQ ID NO: 106549 - RNA, 24 nt, Human
cuggcugccaggauccccggcagg

SEQ ID NO: 106550 - RNA, 22 nt, Human
gauucaucuacccugcugaccu

SEQ ID NO: 106551 - RNA, 18 nt, Human
guaaagucacacagcccu

SEQ ID NO: 106552 - RNA, 27 nt, Human
ucaccuaggcuggagugcagcggcaug

SEQ ID NO: 106553 - RNA, 22 nt, Human
uuggauuucggggcagggggcg

SEQ ID NO: 106554 - RNA, 22 nt, Human
gccccuccaccugggucaucuc

SEQ ID NO: 106555 - RNA, 22 nt, Human
uccgccagccuccucuggacgg

SEQ ID NO: 106556 - RNA, 26 nt, Human
guccuuguuuuuguguaaugcgggag

SEQ ID NO: 106557 - RNA, 23 nt, Human
ucugggugcucgcccacuugucc

SEQ ID NO: 106558 - RNA, 25 nt, Human
aauaacaauguuaaggaaacucuua

SEQ ID NO: 106559 - RNA, 22 nt, Human
guccucugcauguucugcucuu

SEQ ID NO: 106560 - RNA, 21 nt, Human
ucuaaaggggccgggagaagc

SEQ ID NO: 106561 - RNA, 21 nt, Human
cccgguaccggcuccuccugg

SEQ ID NO: 106562 - RNA, 25 nt, Human
ccaagaguuagggcagcagagugga

SEQ ID NO: 106563 - RNA, 20 nt, Human
cuggaaauggccuccaguca

SEQ ID NO: 106564 - RNA, 18 nt, Human
aggaacaagacugacugg

SEQ ID NO: 106565 - RNA, 21 nt, Human
uuguugcccaggcuggagggc

SEQ ID NO: 106566 - RNA, 26 nt, Human
acagaaguagcucuggugaccuugau

SEQ ID NO: 106567 - RNA, 19 nt, Human
gggaaagagaguuaccgga

SEQ ID NO: 106568 - RNA, 17 nt, Human
ucuucaauucagucuag

SEQ ID NO: 106569 - RNA, 24 nt, Human
cccacuggugcuauuuuuauuucc

SEQ ID NO: 106570 - RNA, 26 nt, Human
gcugggguuuccgaggaaguggggcc

SEQ ID NO: 106571 - RNA, 18 nt, Human
cugccccauccuccagca

SEQ ID NO: 106572 - RNA, 17 nt, Human
ucaucuguuuauacaag

SEQ ID NO: 106573 - RNA, 19 nt, Human
uuaaaaaccuaggucucca

SEQ ID NO: 106574 - RNA, 21 nt, Human
aacugcacuuccagacacccg

SEQ ID NO: 106575 - RNA, 18 nt, Human
ugucucucuccuggucau

SEQ ID NO: 106576 - RNA, 22 nt, Human
acgugcuguuugcugugcgugg

SEQ ID NO: 106577 - RNA, 25 nt, Human
gucuccuccccaccuugcaaaacaa

SEQ ID NO: 106578 - RNA, 23 nt, Human
acccaggcuggagugaucucagc

SEQ ID NO: 106579 - RNA, 20 nt, Human
gccccccgcacuccuucaua

SEQ ID NO: 106580 - RNA, 21 nt, Human
cagagcuggacgcuguggaaa

SEQ ID NO: 106581 - RNA, 21 nt, Human
gguucaggugagcaaaaagaa

SEQ ID NO: 106582 - RNA, 22 nt, Human
cuccaggugcucagacugccug

SEQ ID NO: 106583 - RNA, 23 nt, Human
uugcgcccaggcugguaugcagu

SEQ ID NO: 106584 - RNA, 21 nt, Human
auucaaaugucagcagcuuua

SEQ ID NO: 106585 - RNA, 21 nt, Human
augcugcaguacaaacuuucc

SEQ ID NO: 106586 - RNA, 22 nt, Human
cccaaagcgcugggauuacagg

SEQ ID NO: 106587 - RNA, 21 nt, Human
agaggguuggggguugguggg

SEQ ID NO: 106588 - RNA, 23 nt, Human
gaccgcgcucgccuuccuugcag

SEQ ID NO: 106589 - RNA, 20 nt, Human
agcucaagagguugaggcug

SEQ ID NO: 106590 - RNA, 26 nt, Human
gaaaaaugccuuucuguuccccucuc

SEQ ID NO: 106591 - RNA, 25 nt, Human
cucucuacaucacgguaaucaugcc

SEQ ID NO: 106592 - RNA, 22 nt, Human
auaggaugccauuucuuuuaua

SEQ ID NO: 106593 - RNA, 20 nt, Human
uguauuaccuggucauuuca

SEQ ID NO: 106594 - RNA, 27 nt, Human
agacaaccagaggcuggcauugaggcu

SEQ ID NO: 106595 - RNA, 24 nt, Human
cugggacuucuccaggccuguguu

SEQ ID NO: 106596 - RNA, 21 nt, Human
cugggggcugggauuccuggc

SEQ ID NO: 106597 - RNA, 21 nt, Human
gucaaaggcuggagggcagga

SEQ ID NO: 106598 - RNA, 20 nt, Human
augacugcugaaccugacag

SEQ ID NO: 106599 - RNA, 29 nt, Human
uguuuccagggucugagugcaaguucaug

SEQ ID NO: 106600 - RNA, 22 nt, Human
cugagccucaguuuccuuaugu

SEQ ID NO: 106601 - RNA, 23 nt, Human
ugcccugcugagucccaggcuga

SEQ ID NO: 106602 - RNA, 27 nt, Human
ccugccuccuugucccugccaggaauu

SEQ ID NO: 106603 - RNA, 22 nt, Human
aggagccauuguuaaaguuguc

SEQ ID NO: 106604 - RNA, 26 nt, Human
uuuguuguucugccuggagacaaggu

SEQ ID NO: 106605 - RNA, 19 nt, Human
auggcugagcauguguggg

SEQ ID NO: 106606 - RNA, 24 nt, Human
gggaagggaagggcuacugcagcu

SEQ ID NO: 106607 - RNA, 20 nt, Human
cugagucucugacagcugug

SEQ ID NO: 106608 - RNA, 27 nt, Human
ccugugcagagccccauccacugguuc

SEQ ID NO: 106609 - RNA, 27 nt, Human
cacagcccgcucccaggagcuaauggu

SEQ ID NO: 106610 - RNA, 26 nt, Human
ugagccaagaucgcggcauugcacuu

SEQ ID NO: 106611 - RNA, 22 nt, Human
acaggaaaagaagcuggaacac

SEQ ID NO: 106612 - RNA, 25 nt, Human
agcaggaggaaaaggggccauucuc

SEQ ID NO: 106613 - RNA, 28 nt, Human
gcaacccuacuucagacccagguguaag

SEQ ID NO: 106614 - RNA, 22 nt, Human
gaacacaugcacaugugcacac

SEQ ID NO: 106615 - RNA, 20 nt, Human
gcgggcacuggcaauuagaa

SEQ ID NO: 106616 - RNA, 21 nt, Human
ucaucuucaaaaugacgagga

SEQ ID NO: 106617 - RNA, 23 nt, Human
acugugcccccacccuccaggaa

SEQ ID NO: 106618 - RNA, 27 nt, Human
gagacuccaucacagccaggaccuuuc

SEQ ID NO: 106619 - RNA, 23 nt, Human
gugcucaguaaggcagugcaaua

SEQ ID NO: 106620 - RNA, 25 nt, Human
ucauuucugcuuuuuacuagugcag

SEQ ID NO: 106621 - RNA, 27 nt, Human
cuccugccucagccuccaaguagcugg

SEQ ID NO: 106622 - RNA, 26 nt, Human
ucaggacccaagucugcuucugugau

SEQ ID NO: 106623 - RNA, 27 nt, Human
ugccuguaaucccagcuacuugggagg

SEQ ID NO: 106624 - RNA, 30 nt, Human
guuccuuggaauguacccaucugaucaaau

SEQ ID NO: 106625 - RNA, 25 nt, Human
ggccacacccagccuucucacuccc

SEQ ID NO: 106626 - RNA, 28 nt, Human
ggggucucggaugacacccuggccugaa

SEQ ID NO: 106627 - RNA, 21 nt, Human
gcugugaaaaccucaucacug

SEQ ID NO: 106628 - RNA, 26 nt, Human
cugccucuuaaaggccugagcuagcu

SEQ ID NO: 106629 - RNA, 23 nt, Human
gaagcaggcggaucacgagguca

SEQ ID NO: 106630 - RNA, 17 nt, Human
gaaacaaaaguuuuucc

SEQ ID NO: 106631 - RNA, 24 nt, Human
gggccaucuugguuuucuucugga

SEQ ID NO: 106632 - RNA, 21 nt, Human
gugaaagucagaaaggccagc

SEQ ID NO: 106633 - RNA, 21 nt, Human
aguggugguagaaaugauuca

SEQ ID NO: 106634 - RNA, 26 nt, Human
cugcaaccuccuugacucuggccuga

SEQ ID NO: 106635 - RNA, 22 nt, Human
uggaucuccucucuucagugaa

SEQ ID NO: 106636 - RNA, 23 nt, Human
uugcaguguacuauuugcuucca

SEQ ID NO: 106637 - RNA, 21 nt, Human
ucugggauucuaagugaccug

SEQ ID NO: 106638 - RNA, 19 nt, Human
gguggcagagggggaggga

SEQ ID NO: 106639 - RNA, 22 nt, Human
ccugaguagcugggcugacagg

SEQ ID NO: 106640 - RNA, 23 nt, Human
acaagcuuagauucucuauguau

SEQ ID NO: 106641 - RNA, 21 nt, Human
aagauccuucaaaaauacauc

SEQ ID NO: 106642 - RNA, 22 nt, Human
gcugggagaagcggaguguugg

SEQ ID NO: 106643 - RNA, 22 nt, Human
ugguaaccucuucccuccuagg

SEQ ID NO: 106644 - RNA, 26 nt, Human
caguaucuuuuuuaaucaguucuccu

SEQ ID NO: 106645 - RNA, 22 nt, Human
ggcugguggaccaccuacccca

SEQ ID NO: 106646 - RNA, 22 nt, Human
auguuguaacauuucacaguau

SEQ ID NO: 106647 - RNA, 22 nt, Human
aacagaaggagaagcauuugug

SEQ ID NO: 106648 - RNA, 21 nt, Human
ccucugacucuagugcacuga

SEQ ID NO: 106649 - RNA, 23 nt, Human
agucuccucccuuuacuuuaucu

SEQ ID NO: 106650 - RNA, 21 nt, Human
cuaucccaacuuccuccugug

SEQ ID NO: 106651 - RNA, 28 nt, Human
ccccaacccuccccaggugggcagggcg

SEQ ID NO: 106652 - RNA, 26 nt, Human
acauaguguuucaagugcaugguagu

SEQ ID NO: 106653 - RNA, 20 nt, Human
gcaaucagguaguguugcuu

SEQ ID NO: 106654 - RNA, 22 nt, Human
ugauagugauacguuagagggu

SEQ ID NO: 106655 - RNA, 19 nt, Human
cuccagccucagccagggc

SEQ ID NO: 106656 - RNA, 22 nt, Human
accaaccuggccaacaugguga

SEQ ID NO: 106657 - RNA, 22 nt, Human
accagccuggccaacaugguaa

SEQ ID NO: 106658 - RNA, 24 nt, Human
acugggguuucggauugaguugca

SEQ ID NO: 106659 - RNA, 22 nt, Human
cagcuucugcuacuaaaauguu

SEQ ID NO: 106660 - RNA, 19 nt, Human
uccuauuuugcauaauaaa

SEQ ID NO: 106661 - RNA, 21 nt, Human
uccugacacugaauuuuucaa

SEQ ID NO: 106662 - RNA, 19 nt, Human
gcaccccugcaucuuccug

SEQ ID NO: 106663 - RNA, 22 nt, Human
ggcccagaugacaaccucuccu

SEQ ID NO: 106664 - RNA, 23 nt, Human
uuccaguuuuagccaggcauugg

SEQ ID NO: 106665 - RNA, 21 nt, Human
cccucuaagcacauuccaaac

SEQ ID NO: 106666 - RNA, 27 nt, Human
uguuuuuaaaagccaauucuuuuuuau

SEQ ID NO: 106667 - RNA, 26 nt, Human
cccgcacucccgcccugccuguucgc

SEQ ID NO: 106668 - RNA, 25 nt, Human
ggugcaggcacagggccacuguccu

SEQ ID NO: 106669 - RNA, 20 nt, Human
uuuucugccacccaggcugg

SEQ ID NO: 106670 - RNA, 22 nt, Human
gcccuuuucuggaguggccagu

SEQ ID NO: 106671 - RNA, 21 nt, Human
ucaaggauuauacagcucuuu

SEQ ID NO: 106672 - RNA, 27 nt, Human
caucgcuccucuccagcccugcagcua

SEQ ID NO: 106673 - RNA, 25 nt, Human
gacuggguagagacauuggagggaa

SEQ ID NO: 106674 - RNA, 25 nt, Human
ccgcuuccugcaucuugccccuggu

SEQ ID NO: 106675 - RNA, 28 nt, Human
agaucuuugcugccagccacuucauccc

SEQ ID NO: 106676 - RNA, 19 nt, Human
aaugguguuuuauuacaag

SEQ ID NO: 106677 - RNA, 19 nt, Human
gagauucugccucagccuc

SEQ ID NO: 106678 - RNA, 19 nt, Human
cucagcugcucgagccgcc

SEQ ID NO: 106679 - RNA, 24 nt, Human
gcucuguccgcugcccacagccua

SEQ ID NO: 106680 - RNA, 22 nt, Human
agggcacucgccuucugccuuc

SEQ ID NO: 106681 - RNA, 25 nt, Human
ucugcccuuuugaagcaggacuggc

SEQ ID NO: 106682 - RNA, 24 nt, Human
caggguggaagcgccaggagcagc

SEQ ID NO: 106683 - RNA, 22 nt, Human
ggcagacugcagucaacagugu

SEQ ID NO: 106684 - RNA, 19 nt, Human
cagauccuuuuauucucca

SEQ ID NO: 106685 - RNA, 20 nt, Human
ccuccuuccacaccugcugc

SEQ ID NO: 106686 - RNA, 22 nt, Human
cuuuuuguuaauuuugcucuau

SEQ ID NO: 106687 - RNA, 21 nt, Human
agagcagccuggccaaccugg

SEQ ID NO: 106688 - RNA, 23 nt, Human
aguaaacugaagacaagaacucu

SEQ ID NO: 106689 - RNA, 22 nt, Human
ucccaggcugagccucagucuc

SEQ ID NO: 106690 - RNA, 27 nt, Human
uuccuuagacagaggccagcagggacu

SEQ ID NO: 106691 - RNA, 23 nt, Human
uaaccugaaaucuucaaugacac

SEQ ID NO: 106692 - RNA, 27 nt, Human
auugagacgucagugauaaaugagcua

SEQ ID NO: 106693 - RNA, 19 nt, Human
cuguaauuaauaucuugcu

SEQ ID NO: 106694 - RNA, 21 nt, Human
caagauaaggagaaagaaagu

SEQ ID NO: 106695 - RNA, 22 nt, Human
acgaucacagcucacugcagcc

SEQ ID NO: 106696 - RNA, 23 nt, Human
ucuucaggagcuuggcaucaugg

SEQ ID NO: 106697 - RNA, 27 nt, Human
agggucugggcccugcucccuguccca

SEQ ID NO: 106698 - RNA, 22 nt, Human
augaaaacugggaggccgggca

SEQ ID NO: 106699 - RNA, 20 nt, Human
uggugccagagcugugcgga

SEQ ID NO: 106700 - RNA, 21 nt, Human
agcuucuuggauacagacaca

SEQ ID NO: 106701 - RNA, 21 nt, Human
ucacugcaaaucuaucugcuc

SEQ ID NO: 106702 - RNA, 23 nt, Human
acccccaccucccugcagcuuug

SEQ ID NO: 106703 - RNA, 25 nt, Human
cugugucuugggccugugagucaaa

SEQ ID NO: 106704 - RNA, 22 nt, Human
guccaaaaucacacaacuugua

SEQ ID NO: 106705 - RNA, 26 nt, Human
gggaacaucugcuacuacagccuugc

SEQ ID NO: 106706 - RNA, 19 nt, Human
aaccccggcgugugcagug

SEQ ID NO: 106707 - RNA, 25 nt, Human
uccuaacaugacaguauuccauuuc

SEQ ID NO: 106708 - RNA, 21 nt, Human
caacaccuagagcccaaaaau

SEQ ID NO: 106709 - RNA, 21 nt, Human
gucuuagaguccagacacaaa

SEQ ID NO: 106710 - RNA, 23 nt, Human
cguggugauauaauguggugcag

SEQ ID NO: 106711 - RNA, 27 nt, Human
uucaguagggcgcuaauguauacacau

SEQ ID NO: 106712 - RNA, 25 nt, Human
caacaacaguuucugaauugacuuu

SEQ ID NO: 106713 - RNA, 23 nt, Human
aagucucucugacuuuuuguguc

SEQ ID NO: 106714 - RNA, 21 nt, Human
ccucauguucuugcauggccc

SEQ ID NO: 106715 - RNA, 22 nt, Human
cugcagccuccaccuccugggc

SEQ ID NO: 106716 - RNA, 25 nt, Human
ucucgaacuccugaccucgugaucc

SEQ ID NO: 106717 - RNA, 25 nt, Human
gccccgcgccuccuuccuugcuguc

SEQ ID NO: 106718 - RNA, 28 nt, Human
acugcgaaggcagguuauuagaagaguc

SEQ ID NO: 106719 - RNA, 19 nt, Human
gaggaagagaggccaaguu

SEQ ID NO: 106720 - RNA, 19 nt, Human
accauaaaugaaacacuug

SEQ ID NO: 106721 - RNA, 24 nt, Human
cacaucccagugggcucugacccc

SEQ ID NO: 106722 - RNA, 26 nt, Human
cuacuuccuucccugccucccagcuc

SEQ ID NO: 106723 - RNA, 25 nt, Human
cuugcuacugcucacucuuuggguc

SEQ ID NO: 106724 - RNA, 27 nt, Human
ggggugaggaggaggcaucuaccccug

SEQ ID NO: 106725 - RNA, 22 nt, Human
agcaauagggucccgaggggag

SEQ ID NO: 106726 - RNA, 22 nt, Human
gggugcagcugggcuccagggu

SEQ ID NO: 106727 - RNA, 23 nt, Human
ggaguaacagccagacacagcca

SEQ ID NO: 106728 - RNA, 21 nt, Human
ucucugcuuggucaagguuug

SEQ ID NO: 106729 - RNA, 20 nt, Human
uggcaggaggcagacuugca

SEQ ID NO: 106730 - RNA, 27 nt, Human
ccugcccccuguccccugccucuuuuc

SEQ ID NO: 106731 - RNA, 23 nt, Human
guuccuugccagcacggcugcua

SEQ ID NO: 106732 - RNA, 21 nt, Human
aacuucugaagugcugucuuu

SEQ ID NO: 106733 - RNA, 24 nt, Human
uugggacccaguggcagggcacag

SEQ ID NO: 106734 - RNA, 25 nt, Human
cccaacucuugcacagucacugcuc

SEQ ID NO: 106735 - RNA, 26 nt, Human
ccagugcuuccacacccgggcucuga

SEQ ID NO: 106736 - RNA, 25 nt, Human
ccauacagaagaaacaacaaaccug

SEQ ID NO: 106737 - RNA, 21 nt, Human
aaagagguuccugggaguuag

SEQ ID NO: 106738 - RNA, 24 nt, Human
aggugccuguaaucccauguacuc

SEQ ID NO: 106739 - RNA, 23 nt, Human
ugaaagaauucuauuuugcugga

SEQ ID NO: 106740 - RNA, 19 nt, Human
agagcagagucugggccuc

SEQ ID NO: 106741 - RNA, 21 nt, Human
acauacacauacauacauauu

SEQ ID NO: 106742 - RNA, 23 nt, Human
aagagaacuuccuucuguacugu

SEQ ID NO: 106743 - RNA, 25 nt, Human
uaaagagcauauucacugguuuauu

SEQ ID NO: 106744 - RNA, 24 nt, Human
cacacacucacaugcucucacuca

SEQ ID NO: 106745 - RNA, 27 nt, Human
uuaacaaacgugaaacuacuuucuguu

SEQ ID NO: 106746 - RNA, 28 nt, Human
ucccugccucgggcucucacccuccucu

SEQ ID NO: 106747 - RNA, 21 nt, Human
cccaccccccagguucaaccu

SEQ ID NO: 106748 - RNA, 20 nt, Human
aaauauucuucuuuaccuuu

SEQ ID NO: 106749 - RNA, 23 nt, Human
auguauuuaacuguuaaaugcgc

SEQ ID NO: 106750 - RNA, 22 nt, Human
gcgaucauggcucacugcagcc

SEQ ID NO: 106751 - RNA, 27 nt, Human
gggccuggcccgcgucuagcuuaguuu

SEQ ID NO: 106752 - RNA, 24 nt, Human
gcuaaucccaggaauuugcugccc

SEQ ID NO: 106753 - RNA, 19 nt, Human
gcugcucaauaaaguacaa

SEQ ID NO: 106754 - RNA, 25 nt, Human
acauuaagaaauaaauucccccuca

SEQ ID NO: 106755 - RNA, 24 nt, Human
ccucacugccugcuuauugccucu

SEQ ID NO: 106756 - RNA, 26 nt, Human
gcuucaucuuccugggguuccccuca

SEQ ID NO: 106757 - RNA, 23 nt, Human
aagacaaaugcaacauuuuaagg

SEQ ID NO: 106758 - RNA, 26 nt, Human
gcccuugccaccuucccugcaccugc

SEQ ID NO: 106759 - RNA, 21 nt, Human
aaaagaaaaaauccacaaaag

SEQ ID NO: 106760 - RNA, 20 nt, Human
auggaaauaauagucaccaa

SEQ ID NO: 106761 - RNA, 27 nt, Human
aacucucuuuucucuuggcucuucuua

SEQ ID NO: 106762 - RNA, 27 nt, Human
ccugccugccccucucccgccagacug

SEQ ID NO: 106763 - RNA, 23 nt, Human
uucauucucuuauauaguauuca

SEQ ID NO: 106764 - RNA, 21 nt, Human
guuuacauucaucucauucca

SEQ ID NO: 106765 - RNA, 26 nt, Human
agaagcgaauuccucucuggaggccu

SEQ ID NO: 106766 - RNA, 21 nt, Human
gugagaauauuuuucccagga

SEQ ID NO: 106767 - RNA, 21 nt, Human
aacccuguuuuauugaguucu

SEQ ID NO: 106768 - RNA, 23 nt, Human
cacugugcggugccaaaaaagag

SEQ ID NO: 106769 - RNA, 20 nt, Human
ugagacuccuccaguggacc

SEQ ID NO: 106770 - RNA, 22 nt, Human
gcgcgcgucccccggugaccuc

SEQ ID NO: 106771 - RNA, 23 nt, Human
ucagccgccaccggcacggccag

SEQ ID NO: 106772 - RNA, 19 nt, Human
uugcucucuggccuuuucc

SEQ ID NO: 106773 - RNA, 19 nt, Human
ucugccuuggccucacuga

SEQ ID NO: 106774 - RNA, 27 nt, Human
ccacugcacccggcccugagaauauau

SEQ ID NO: 106775 - RNA, 24 nt, Human
ucgugccagcugcuggugcagccu

SEQ ID NO: 106776 - RNA, 22 nt, Human
caggcuggugugcaauggcgug

SEQ ID NO: 106777 - RNA, 22 nt, Human
ucagaaaauauuauguguuucc

SEQ ID NO: 106778 - RNA, 23 nt, Human
uucagcccuggcuggggcugcag

SEQ ID NO: 106779 - RNA, 21 nt, Human
cucgggcuccaaguauuucag

SEQ ID NO: 106780 - RNA, 22 nt, Human
cugagugcugggagugaguugg

SEQ ID NO: 106781 - RNA, 23 nt, Human
gccugucguuagggcauggcuua

SEQ ID NO: 106782 - RNA, 26 nt, Human
aguacaccccccugugaugccucuga

SEQ ID NO: 106783 - RNA, 26 nt, Human
cucucgaacuccugaccucaucgucc

SEQ ID NO: 106784 - RNA, 28 nt, Human
gcaguuggagaccagucugggcaacaug

SEQ ID NO: 106785 - RNA, 21 nt, Human
uugauguuguaauaaaaugaa

SEQ ID NO: 106786 - RNA, 23 nt, Human
gccucaguucuagacgagucaua

SEQ ID NO: 106787 - RNA, 21 nt, Human
gcugugggucauccuugcugu

SEQ ID NO: 106788 - RNA, 26 nt, Human
agggccaagaucgccccacugcacuc

SEQ ID NO: 106789 - RNA, 26 nt, Human
aggugucccuaauuugagaaguaacc

SEQ ID NO: 106790 - RNA, 20 nt, Human
cccagcacugggagccuucu

SEQ ID NO: 106791 - RNA, 22 nt, Human
cuucuggaauacugaaaaagaa

SEQ ID NO: 106792 - RNA, 22 nt, Human
cccaaaguucugggauuacagg

SEQ ID NO: 106793 - RNA, 22 nt, Human
cccaaagugcugggaugacagg

SEQ ID NO: 106794 - RNA, 25 nt, Human
gucacccagguccagaggcggcggu

SEQ ID NO: 106795 - RNA, 16 nt, Human
ccacuccagaaccuga

SEQ ID NO: 106796 - RNA, 19 nt, Human
ccugcucccagccugcuga

SEQ ID NO: 106797 - RNA, 22 nt, Human
agcuaguuuuuguauuuuuagu

SEQ ID NO: 106798 - RNA, 22 nt, Human
ggucuuuggggaaguccuggcu

SEQ ID NO: 106799 - RNA, 27 nt, Human
cugggcccagcuguggguccugaaggu

SEQ ID NO: 106800 - RNA, 20 nt, Human
ugcaguguccauuguggaga

SEQ ID NO: 106801 - RNA, 26 nt, Human
gugcccggccuccccugugucauuuu

SEQ ID NO: 106802 - RNA, 19 nt, Human
gccagccacaagcugcucu

SEQ ID NO: 106803 - RNA, 22 nt, Human
cuucccuugggcuuuucagcag

SEQ ID NO: 106804 - RNA, 26 nt, Human
aauaguucauuccuggcugggcgcgg

SEQ ID NO: 106805 - RNA, 21 nt, Human
gggagggacagggcuugggga

SEQ ID NO: 106806 - RNA, 21 nt, Human
ucuucuuucugucuuuaagac

SEQ ID NO: 106807 - RNA, 21 nt, Human
gcugcugcugcugcuacugcc

SEQ ID NO: 106808 - RNA, 18 nt, Human
cagauagguggugccagu

SEQ ID NO: 106809 - RNA, 21 nt, Human
ugcagcuuuuucucucagugu

SEQ ID NO: 106810 - RNA, 22 nt, Human
ccugcagcccagcuccgcccgc

SEQ ID NO: 106811 - RNA, 22 nt, Human
aucauuugagcccaggagguca

SEQ ID NO: 106812 - RNA, 26 nt, Human
cauggagaaaaggaauuuguuuaaau

SEQ ID NO: 106813 - RNA, 27 nt, Human
agacuggggccagggaggggcaguccu

SEQ ID NO: 106814 - RNA, 27 nt, Human
cccgcggugacuucugccugcgcuccu

SEQ ID NO: 106815 - RNA, 26 nt, Human
gaaccucaggcccugcuugacagugc

SEQ ID NO: 106816 - RNA, 28 nt, Human
uuacucugcacuauagccauuugcccca

SEQ ID NO: 106817 - RNA, 22 nt, Human
uggacuccaagacugacacccu

SEQ ID NO: 106818 - RNA, 25 nt, Human
gacuaaguggaacguucucuaccuu

SEQ ID NO: 106819 - RNA, 28 nt, Human
gcugauaauagaaucuucuguucauaca

SEQ ID NO: 106820 - RNA, 22 nt, Human
gccuccucaaacccagucucag

SEQ ID NO: 106821 - RNA, 25 nt, Human
gcauucuuaccauccuucucucaca

SEQ ID NO: 106822 - RNA, 23 nt, Human
ccacugcacuccagccugggcag

SEQ ID NO: 106823 - RNA, 23 nt, Human
agguaguuuugaauggcauuuca

SEQ ID NO: 106824 - RNA, 27 nt, Human
caauccuacuuuucgaacaccaaaaau

SEQ ID NO: 106825 - RNA, 19 nt, Human
ggcaagucugcuguucuau

SEQ ID NO: 106826 - RNA, 21 nt, Human
cucuggaggacaagcaguuag

SEQ ID NO: 106827 - RNA, 26 nt, Human
guccugcuuccagaauuuggaaaucc

SEQ ID NO: 106828 - RNA, 23 nt, Human
ucucgcccaggcuggagugcaac

SEQ ID NO: 106829 - RNA, 20 nt, Human
agcagcuuuaaacucaggga

SEQ ID NO: 106830 - RNA, 24 nt, Human
aguguauuugaucagaaguggcca

SEQ ID NO: 106831 - RNA, 26 nt, Human
uucagcucuggagaacagugguugcc

SEQ ID NO: 106832 - RNA, 27 nt, Human
ggggugagggugagcuuacucagggcc

SEQ ID NO: 106833 - RNA, 19 nt, Human
ugcaucucaucuggacuau

SEQ ID NO: 106834 - RNA, 21 nt, Human
acgcuguguuaaauguuaaca

SEQ ID NO: 106835 - RNA, 20 nt, Human
auggaaaggcuguguggaaa

SEQ ID NO: 106836 - RNA, 25 nt, Human
ugcucuccccucuguggcuuggacu

SEQ ID NO: 106837 - RNA, 22 nt, Human
ugggauuauaggcaugagccgc

SEQ ID NO: 106838 - RNA, 24 nt, Human
cuaggaggcaccgaggcagcggcg

SEQ ID NO: 106839 - RNA, 25 nt, Human
uauagggaguuguuuucucuugccu

SEQ ID NO: 106840 - RNA, 21 nt, Human
agcccgcggggccugaaggga

SEQ ID NO: 106841 - RNA, 24 nt, Human
ggaguuaaggaaugaugauacgga

SEQ ID NO: 106842 - RNA, 18 nt, Human
aauuccuuaccucuccca

SEQ ID NO: 106843 - RNA, 20 nt, Human
ugucacccagucuguugcug

SEQ ID NO: 106844 - RNA, 22 nt, Human
cgucccucguuccauggcccag

SEQ ID NO: 106845 - RNA, 21 nt, Human
uuagaaacaauuugacuuuug

SEQ ID NO: 106846 - RNA, 23 nt, Human
ccugggagcuugaggcucauugg

SEQ ID NO: 106847 - RNA, 29 nt, Human
ucuccugccucagcuucccgaguaacuga

SEQ ID NO: 106848 - RNA, 23 nt, Human
ggauuuccacugaauauugagaa

SEQ ID NO: 106849 - RNA, 23 nt, Human
cauggcggcaguccagcuggaac

SEQ ID NO: 106850 - RNA, 25 nt, Human
cagagggaggucaccugggggcagc

SEQ ID NO: 106851 - RNA, 27 nt, Human
gcccagccugagccccaacaacaacuu

SEQ ID NO: 106852 - RNA, 24 nt, Human
uuguguucucccuccuuuucucuc

SEQ ID NO: 106853 - RNA, 22 nt, Human
acuuaggacccccgcggcugga

SEQ ID NO: 106854 - RNA, 21 nt, Human
cgaccucucugggccucaguu

SEQ ID NO: 106855 - RNA, 23 nt, Human
gauuccauuugaccaugcagccu

SEQ ID NO: 106856 - RNA, 22 nt, Human
ccaaguaggugggauuacaggu

SEQ ID NO: 106857 - RNA, 21 nt, Human
cagcucuucugagauggcccc

SEQ ID NO: 106858 - RNA, 22 nt, Human
caccuaggcuggagugcagugg

SEQ ID NO: 106859 - RNA, 21 nt, Human
accaggaggcucagggcucug

SEQ ID NO: 106860 - RNA, 25 nt, Human
ccucccaucuuuccacuguuguaaa

SEQ ID NO: 106861 - RNA, 21 nt, Human
ggaggcggaggaggcuagugg

SEQ ID NO: 106862 - RNA, 19 nt, Human
gcagaaaaggccuagaacc

SEQ ID NO: 106863 - RNA, 21 nt, Human
gauucuggcugaaaaaggcca

SEQ ID NO: 106864 - RNA, 23 nt, Human
ugaaauccugggucucuuggccu

SEQ ID NO: 106865 - RNA, 22 nt, Human
cugagccucaauuuccucaucu

SEQ ID NO: 106866 - RNA, 26 nt, Human
caggaaacgugugggccucucugcug

SEQ ID NO: 106867 - RNA, 26 nt, Human
ccuccaggauccuugacugagggcgu

SEQ ID NO: 106868 - RNA, 22 nt, Human
agauuugagugcaguugguaca

SEQ ID NO: 106869 - RNA, 22 nt, Human
aaccagcuuuggagaaagccca

SEQ ID NO: 106870 - RNA, 22 nt, Human
cugcugugccuuucacacuuga

SEQ ID NO: 106871 - RNA, 31 nt, Human
gcuccagcacucaccggccugggcccuguca

SEQ ID NO: 106872 - RNA, 24 nt, Human
auggcauuaauuguuccuugcuuu

SEQ ID NO: 106873 - RNA, 26 nt, Human
ccuccugguccacugaaccuggaaac

SEQ ID NO: 106874 - RNA, 28 nt, Human
uaucuggaguaccugcucuguuuuuggc

SEQ ID NO: 106875 - RNA, 22 nt, Human
gucugcucuccucuuacccacc

SEQ ID NO: 106876 - RNA, 27 nt, Human
ucaugcugucuuuacaugggguuuuca

SEQ ID NO: 106877 - RNA, 22 nt, Human
uucucuuucuccaaagggcaag

SEQ ID NO: 106878 - RNA, 21 nt, Human
agugauuuuguuuauuuuaug

SEQ ID NO: 106879 - RNA, 27 nt, Human
ccugccugccgcugcaccugccugccg

SEQ ID NO: 106880 - RNA, 21 nt, Human
aacaggcuggaugggugggug

SEQ ID NO: 106881 - RNA, 20 nt, Human
cggagaucccaggauccugg

SEQ ID NO: 106882 - RNA, 27 nt, Human
uugcccaggcuggucuugaaccccugg

SEQ ID NO: 106883 - RNA, 27 nt, Human
uugcccaggcuggucucaaacccccag

SEQ ID NO: 106884 - RNA, 19 nt, Human
gcacccuaggcagccugca

SEQ ID NO: 106885 - RNA, 22 nt, Human
acugcuguccuggugacuuguc

SEQ ID NO: 106886 - RNA, 20 nt, Human
ggauacaggcugauguguac

SEQ ID NO: 106887 - RNA, 22 nt, Human
ugggacauugaggcugcaguga

SEQ ID NO: 106888 - RNA, 18 nt, Human
aagccauuaaaagccacu

SEQ ID NO: 106889 - RNA, 26 nt, Human
ccugcaggcagcuuggaaguuucuuc

SEQ ID NO: 106890 - RNA, 28 nt, Human
accaagaaaaugguuugcacgacuuuga

SEQ ID NO: 106891 - RNA, 23 nt, Human
gggacuucaaaaucacugugauu

SEQ ID NO: 106892 - RNA, 22 nt, Human
acccccagcugccaucgcucuc

SEQ ID NO: 106893 - RNA, 21 nt, Human
accuguaaucuuaacacugug

SEQ ID NO: 106894 - RNA, 27 nt, Human
gguuuccccugcucuucucucuugccu

SEQ ID NO: 106895 - RNA, 17 nt, Human
cuauucuuaccuagccu

SEQ ID NO: 106896 - RNA, 18 nt, Human
auuuaggacacuagcaga

SEQ ID NO: 106897 - RNA, 23 nt, Human
ucuccuuugguugaaucagcugu

SEQ ID NO: 106898 - RNA, 22 nt, Human
ugaaaccucugccucccggguu

SEQ ID NO: 106899 - RNA, 26 nt, Human
aaaugaugcgguguguccgcugcccc

SEQ ID NO: 106900 - RNA, 23 nt, Human
ucucucucagacaccaagcugca

SEQ ID NO: 106901 - RNA, 22 nt, Human
cagaagccucggcaccccuguc

SEQ ID NO: 106902 - RNA, 20 nt, Human
gcacuauagugagcuuuuca

SEQ ID NO: 106903 - RNA, 23 nt, Human
gugucuguggucaccauuuaggu

SEQ ID NO: 106904 - RNA, 24 nt, Human
gagcaagucagaaguuacucucau

SEQ ID NO: 106905 - RNA, 21 nt, Human
uugcccagacuacagggcuua

SEQ ID NO: 106906 - RNA, 25 nt, Human
cucuccccucagccucuccccugcc

SEQ ID NO: 106907 - RNA, 28 nt, Human
ggagacugagguccugacaagcgauaac

SEQ ID NO: 106908 - RNA, 24 nt, Human
cuggauacuuccagacauuuucca

SEQ ID NO: 106909 - RNA, 22 nt, Human
cacacucagaagccuuugggaa

SEQ ID NO: 106910 - RNA, 32 nt, Human
cacuccauagucucaaacugucccccuuauga

SEQ ID NO: 106911 - RNA, 21 nt, Human
ccgaggguccagccaccagcc

SEQ ID NO: 106912 - RNA, 29 nt, Human
ggggagcugguucccagaggauugucuac

SEQ ID NO: 106913 - RNA, 26 nt, Human
cuagaagcugauuccccaaagcauug

SEQ ID NO: 106914 - RNA, 21 nt, Human
aauuuggggugggaggaugga

SEQ ID NO: 106915 - RNA, 26 nt, Human
uggucucacauggugcuacgccugca

SEQ ID NO: 106916 - RNA, 23 nt, Human
ccccccaccuccacucugccauu

SEQ ID NO: 106917 - RNA, 27 nt, Human
ccuguguccugggccugggccugcugu

SEQ ID NO: 106918 - RNA, 24 nt, Human
guggggaggggggcgaggagaccc

SEQ ID NO: 106919 - RNA, 22 nt, Human
accuauaaucccagcacuaugg

SEQ ID NO: 106920 - RNA, 23 nt, Human
ccggcugccagcuuuucggggcc

SEQ ID NO: 106921 - RNA, 21 nt, Human
agagaugagaagcagagggcu

SEQ ID NO: 106922 - RNA, 27 nt, Human
gguauuccugccuccauauuuucuuua

SEQ ID NO: 106923 - RNA, 21 nt, Human
auuucuccggcagcccagaug

SEQ ID NO: 106924 - RNA, 26 nt, Human
cauacaccucaccugccuuggcaagc

SEQ ID NO: 106925 - RNA, 28 nt, Human
ugaauuugucucccuucuugccagaaag

SEQ ID NO: 106926 - RNA, 25 nt, Human
agaguggccugcccccgggagccaa

SEQ ID NO: 106927 - RNA, 28 nt, Human
ggcagagggagugagcaggggagaaaua

SEQ ID NO: 106928 - RNA, 26 nt, Human
uggcugugucacagugcccuuuucuc

SEQ ID NO: 106929 - RNA, 26 nt, Human
accucgggggcgaugcggcugcugcc

SEQ ID NO: 106930 - RNA, 19 nt, Human
auaaaacucucaguuguuu

SEQ ID NO: 106931 - RNA, 22 nt, Human
accacguucggcuaauuuuugu

SEQ ID NO: 106932 - RNA, 20 nt, Human
accauaaacuggguggauua

SEQ ID NO: 106933 - RNA, 26 nt, Human
gguggaggcggcggcggcagaggagu

SEQ ID NO: 106934 - RNA, 23 nt, Human
ucuucauuuuccuccuuccaggc

SEQ ID NO: 106935 - RNA, 18 nt, Human
cugcccuuugugauuccc

SEQ ID NO: 106936 - RNA, 25 nt, Human
cugauuuccagaggaaagcuagagg

SEQ ID NO: 106937 - RNA, 23 nt, Human
cacaggcagaaggcucggggcuc

SEQ ID NO: 106938 - RNA, 20 nt, Human
gcuugucaguuucugccucc

SEQ ID NO: 106939 - RNA, 27 nt, Human
aauaagaagguugaggcugaagaguga

SEQ ID NO: 106940 - RNA, 26 nt, Human
cgucuguuccaaggaccucagcucuu

SEQ ID NO: 106941 - RNA, 19 nt, Human
cuccacccccuccagcucc

SEQ ID NO: 106942 - RNA, 22 nt, Human
cuuaaggauccuucuagucaca

SEQ ID NO: 106943 - RNA, 23 nt, Human
aggugugaggcaggagagacagu

SEQ ID NO: 106944 - RNA, 25 nt, Human
ucccccagggaacucaguuuuccca

SEQ ID NO: 106945 - RNA, 23 nt, Human
aaaaagaggacauuuaaaaacgc

SEQ ID NO: 106946 - RNA, 27 nt, Human
gcuucaugguggaauuaauuucugcca

SEQ ID NO: 106947 - RNA, 22 nt, Human
agaugagcugugcgcugcucug

SEQ ID NO: 106948 - RNA, 24 nt, Human
gccauaauugcuacucuucauaca

SEQ ID NO: 106949 - RNA, 24 nt, Human
cugcagcugcucccggcgcguccc

SEQ ID NO: 106950 - RNA, 23 nt, Human
cccgagcuugccucagggccaag

SEQ ID NO: 106951 - RNA, 22 nt, Human
gcggaagccuuuuuucucccuu

SEQ ID NO: 106952 - RNA, 26 nt, Human
gcauggccuccccuccucugcuugcc

SEQ ID NO: 106953 - RNA, 24 nt, Human
cucugcggcccuccaggacggaca

SEQ ID NO: 106954 - RNA, 24 nt, Human
auuugcugacagcugaccuuuguc

SEQ ID NO: 106955 - RNA, 18 nt, Human
aagggugaaaaacugaca

SEQ ID NO: 106956 - RNA, 26 nt, Human
cugccucuguaguagcccugcacaaa

SEQ ID NO: 106957 - RNA, 24 nt, Human
ccccaagaauuaucauggaauguc

SEQ ID NO: 106958 - RNA, 20 nt, Human
acuugcucugcagcuaagga

SEQ ID NO: 106959 - RNA, 22 nt, Human
uucuacucuucaaccucuacug

SEQ ID NO: 106960 - RNA, 31 nt, Human
gcaggcccuguccugcccucccagcaauaac

SEQ ID NO: 106961 - RNA, 22 nt, Human
auuuggcuguuucugaguugua

SEQ ID NO: 106962 - RNA, 26 nt, Human
gcccugcuagggagucacuguacaca

SEQ ID NO: 106963 - RNA, 20 nt, Human
gccuuucuucugcuugggcu

SEQ ID NO: 106964 - RNA, 24 nt, Human
gcggacucaggcuggggucugcag

SEQ ID NO: 106965 - RNA, 23 nt, Human
uugaucuguaggauuaugccuuu

SEQ ID NO: 106966 - RNA, 26 nt, Human
uguaagauggagaauaauccucucug

SEQ ID NO: 106967 - RNA, 22 nt, Human
gccucuagccccaccauugcuc

SEQ ID NO: 106968 - RNA, 20 nt, Human
aaaacaaaaucaguuuugca

SEQ ID NO: 106969 - RNA, 21 nt, Human
gcugccgccagucucaugccc

SEQ ID NO: 106970 - RNA, 23 nt, Human
ggcaggagaaucucuugaaccug

SEQ ID NO: 106971 - RNA, 27 nt, Human
ugagcaaggacuuuugcccucuagaaa

SEQ ID NO: 106972 - RNA, 18 nt, Human
agggugauuucaccugga

SEQ ID NO: 106973 - RNA, 27 nt, Human
caccacacagacucuguguguguaugu

SEQ ID NO: 106974 - RNA, 21 nt, Human
ccuucauuuuagauuaagcuu

SEQ ID NO: 106975 - RNA, 24 nt, Human
gaucaaauuggcuacaaucuugga

SEQ ID NO: 106976 - RNA, 22 nt, Human
aguggcacaaucauagcucgcu

SEQ ID NO: 106977 - RNA, 27 nt, Human
ccccugccucuucccugaaccacuccu

SEQ ID NO: 106978 - RNA, 27 nt, Human
ccacugcacuccagccugggcaacaga

SEQ ID NO: 106979 - RNA, 21 nt, Human
auugucucuaaacaaugugug

SEQ ID NO: 106980 - RNA, 22 nt, Human
accugugaacugcaguggggca

SEQ ID NO: 106981 - RNA, 22 nt, Human
gcauuuaggaaagcagugcagu

SEQ ID NO: 106982 - RNA, 22 nt, Human
cugucauggguuugggauuugu

SEQ ID NO: 106983 - RNA, 27 nt, Human
ccuguucugugugugccgccgggcgac

SEQ ID NO: 106984 - RNA, 26 nt, Human
auagggucucacuuuguuacccaggc

SEQ ID NO: 106985 - RNA, 20 nt, Human
ugauagugaguguaaaaucu

SEQ ID NO: 106986 - RNA, 22 nt, Human
gggaccaagagaaagaagcaga

SEQ ID NO: 106987 - RNA, 31 nt, Human
ggacccccuggaaucagaaccucucugagga

SEQ ID NO: 106988 - RNA, 26 nt, Human
aggacggggagguugucaggggcuau

SEQ ID NO: 106989 - RNA, 27 nt, Human
ccaucauuccuugguuugugacugcau

SEQ ID NO: 106990 - RNA, 22 nt, Human
uucaggguaaauauauuuuaua

SEQ ID NO: 106991 - RNA, 21 nt, Human
ucuacuuugcuuuucucucca

SEQ ID NO: 106992 - RNA, 22 nt, Human
cuuugagugcugucuccauguu

SEQ ID NO: 106993 - RNA, 26 nt, Human
uacuaaucuagguccuauuacuaauc

SEQ ID NO: 106994 - RNA, 22 nt, Human
gcaucccggcgggaacccagaa

SEQ ID NO: 106995 - RNA, 27 nt, Human
cuccugugacggcggcgaggcuuggga

SEQ ID NO: 106996 - RNA, 22 nt, Human
gccuugcccagcuuucaaagga

SEQ ID NO: 106997 - RNA, 23 nt, Human
agaccccacaguagagcacuuuu

SEQ ID NO: 106998 - RNA, 27 nt, Human
cucucuaggccucuccaguuugcaccu

SEQ ID NO: 106999 - RNA, 21 nt, Human
agaguaccuguuacccuaccu

SEQ ID NO: 107000 - RNA, 20 nt, Human
cagaacaaugcaucugacau

SEQ ID NO: 107001 - RNA, 22 nt, Human
ccccucuguccccuuggcuucg

SEQ ID NO: 107002 - RNA, 27 nt, Human
uccuucuagaaggagcuuccugacugg

SEQ ID NO: 107003 - RNA, 25 nt, Human
ucaucuuauuuucaaaguaggcaaa

SEQ ID NO: 107004 - RNA, 20 nt, Human
ccugagguuccuguuaaauu

SEQ ID NO: 107005 - RNA, 22 nt, Human
ccaaagccaccacauuuagaac

SEQ ID NO: 107006 - RNA, 24 nt, Human
aggggaggggagggagcgaggggc

SEQ ID NO: 107007 - RNA, 26 nt, Human
ggcuuauccugggugcuuauaggaga

SEQ ID NO: 107008 - RNA, 26 nt, Human
gcuccacuccuuggcuggaggcagug

SEQ ID NO: 107009 - RNA, 23 nt, Human
gauugagccucacuggugccagg

SEQ ID NO: 107010 - RNA, 26 nt, Human
ugaacaacugugccuuguggaauuuu

SEQ ID NO: 107011 - RNA, 27 nt, Human
ccacugcucuccagccugggaggcaca

SEQ ID NO: 107012 - RNA, 20 nt, Human
ccauuuuaccgagguggauc

SEQ ID NO: 107013 - RNA, 28 nt, Human
aaaacuguuuuuagaaaauaugaugauu

SEQ ID NO: 107014 - RNA, 23 nt, Human
uaaacuucauauuuggguagguu

SEQ ID NO: 107015 - RNA, 19 nt, Human
augcuggaggcccucgagg

SEQ ID NO: 107016 - RNA, 25 nt, Human
aggggaggggcgggcagguaggugc

SEQ ID NO: 107017 - RNA, 21 nt, Human
gaauaaugcuaccaggaugcu

SEQ ID NO: 107018 - RNA, 22 nt, Human
cccugcagugcgcucuaggcug

SEQ ID NO: 107019 - RNA, 19 nt, Human
gcaggguggaagcugcaag

SEQ ID NO: 107020 - RNA, 24 nt, Human
ugcuuucagucuuguuacuauccu

SEQ ID NO: 107021 - RNA, 20 nt, Human
cugucucucuggcugauguc

SEQ ID NO: 107022 - RNA, 19 nt, Human
agauuaaaccuacuuucau

SEQ ID NO: 107023 - RNA, 21 nt, Human
gggggcggaggcuggcagggg

SEQ ID NO: 107024 - RNA, 22 nt, Human
cucagcugaccugacugagcca

SEQ ID NO: 107025 - RNA, 21 nt, Human
aggguuccuggcugugaggaa

SEQ ID NO: 107026 - RNA, 21 nt, Human
uuccuugccacaagcuuccca

SEQ ID NO: 107027 - RNA, 23 nt, Human
ggcuccggcuucaagaucaaagg

SEQ ID NO: 107028 - RNA, 29 nt, Human
guguuccucacugacaggguggggccuca

SEQ ID NO: 107029 - RNA, 22 nt, Human
gagcgagcaucccccaaaguuc

SEQ ID NO: 107030 - RNA, 17 nt, Human
uuacucagcagugcagu

SEQ ID NO: 107031 - RNA, 26 nt, Human
cuuacugcugaccuuuuuaucuugag

SEQ ID NO: 107032 - RNA, 25 nt, Human
cuguuugucuuucuuaaaacugaca

SEQ ID NO: 107033 - RNA, 22 nt, Human
aggcugaggcaggcagaucacg

SEQ ID NO: 107034 - RNA, 21 nt, Human
cugccaucgccuccaucagcc

SEQ ID NO: 107035 - RNA, 21 nt, Human
uugcagacuuucugagccagg

SEQ ID NO: 107036 - RNA, 27 nt, Human
ucugggaaagugaggccaccauggcuc

SEQ ID NO: 107037 - RNA, 26 nt, Human
agugcacccagaugcgcuucugucag

SEQ ID NO: 107038 - RNA, 22 nt, Human
ccuaaagugcugggauuacaug

SEQ ID NO: 107039 - RNA, 26 nt, Human
ccucagucaucaauaguuccugggga

SEQ ID NO: 107040 - RNA, 26 nt, Human
uuucuuucuucuccccuucuucccuc

SEQ ID NO: 107041 - RNA, 26 nt, Human
ggacuuuccuuccuccaucuccaaga

SEQ ID NO: 107042 - RNA, 21 nt, Human
ccuaguguauggcucaugccc

SEQ ID NO: 107043 - RNA, 27 nt, Human
acacagcccuggccucugcucaacuag

SEQ ID NO: 107044 - RNA, 26 nt, Human
uagaauuauugcuuaugucauuucuu

SEQ ID NO: 107045 - RNA, 22 nt, Human
ccagagguccaugguggaagac

SEQ ID NO: 107046 - RNA, 20 nt, Human
acucuccaggcuccuccucc

SEQ ID NO: 107047 - RNA, 22 nt, Human
gugggagguggauaggucggug

SEQ ID NO: 107048 - RNA, 23 nt, Human
caugugccgaggucgugugcuag

SEQ ID NO: 107049 - RNA, 25 nt, Human
ggaucugccuuuguccugcuugugu

SEQ ID NO: 107050 - RNA, 26 nt, Human
ucugccugcaggagcgguuauugugg

SEQ ID NO: 107051 - RNA, 27 nt, Human
acacagcccucuuuccccacugggcgu

SEQ ID NO: 107052 - RNA, 26 nt, Human
agguauccagggcaagagacauuuuu

SEQ ID NO: 107053 - RNA, 26 nt, Human
cccaacugcugcuuaaaaugcaagga

SEQ ID NO: 107054 - RNA, 19 nt, Human
accuugaauucagccuggg

SEQ ID NO: 107055 - RNA, 21 nt, Human
uucaaucuuauuacuaaucca

SEQ ID NO: 107056 - RNA, 23 nt, Human
gagggaacagacaggagaaaugc

SEQ ID NO: 107057 - RNA, 22 nt, Human
cacacuuguaaucccagcaauu

SEQ ID NO: 107058 - RNA, 22 nt, Human
caccccuguaaucucagcacuu

SEQ ID NO: 107059 - RNA, 21 nt, Human
ugaaggcagaagagauggugg

SEQ ID NO: 107060 - RNA, 24 nt, Human
gacgggauuuguugauucucucca

SEQ ID NO: 107061 - RNA, 20 nt, Human
cuugugagcuucuucccggg

SEQ ID NO: 107062 - RNA, 27 nt, Human
uacucaguaaggcagugcaguacucag

SEQ ID NO: 107063 - RNA, 21 nt, Human
acuguuauuuaagauguaaua

SEQ ID NO: 107064 - RNA, 27 nt, Human
uauaacacuguaguggaacauucuucu

SEQ ID NO: 107065 - RNA, 20 nt, Human
ccauccugccauccuugacu

SEQ ID NO: 107066 - RNA, 21 nt, Human
ggaaaccacagggaggggaag

SEQ ID NO: 107067 - RNA, 26 nt, Human
agcagccgccucccagcccugccuag

SEQ ID NO: 107068 - RNA, 22 nt, Human
acccaggcuggggcgcaauggc

SEQ ID NO: 107069 - RNA, 21 nt, Human
ucuuuuccuucuccaucaucu

SEQ ID NO: 107070 - RNA, 20 nt, Human
uauuaaaaugcauauuucua

SEQ ID NO: 107071 - RNA, 22 nt, Human
agagaaacaaaaaagugugaca

SEQ ID NO: 107072 - RNA, 27 nt, Human
gggcagggaagagagcgcccggcucag

SEQ ID NO: 107073 - RNA, 21 nt, Human
cugccaccacugggcaaacag

SEQ ID NO: 107074 - RNA, 25 nt, Human
gcccaggcuggagugcaguggcgag

SEQ ID NO: 107075 - RNA, 20 nt, Human
gcgcgcauguaaucccagcu

SEQ ID NO: 107076 - RNA, 27 nt, Human
uuuucuuuccuccuuuccuccucugac

SEQ ID NO: 107077 - RNA, 27 nt, Human
uucaauacaagugugguagggacuuaa

SEQ ID NO: 107078 - RNA, 20 nt, Human
ucauuguuuacacaugggga

SEQ ID NO: 107079 - RNA, 22 nt, Human
acauuuuucuuugcagcgaaac

SEQ ID NO: 107080 - RNA, 23 nt, Human
ugccuguaguccuagcuacuugg

SEQ ID NO: 107081 - RNA, 23 nt, Human
ugccuguagucccagcuacucgg

SEQ ID NO: 107082 - RNA, 18 nt, Human
cuuuugagagggcagcag

SEQ ID NO: 107083 - RNA, 23 nt, Human
gguguuuucaagcacaacccacc

SEQ ID NO: 107084 - RNA, 21 nt, Human
uugacaaaaucuaaggcucca

SEQ ID NO: 107085 - RNA, 22 nt, Human
cuaaguagcugggacuacaggu

SEQ ID NO: 107086 - RNA, 19 nt, Human
ugccuggagggugcaguga

SEQ ID NO: 107087 - RNA, 22 nt, Human
ucucuuuauuuuucuacuucuc

SEQ ID NO: 107088 - RNA, 16 nt, Human
uacauaaaaaaucuua

SEQ ID NO: 107089 - RNA, 20 nt, Human
ggaguuucucuaaagucacu

SEQ ID NO: 107090 - RNA, 20 nt, Human
ucugugaugugcauuuugga

SEQ ID NO: 107091 - RNA, 25 nt, Human
aagaagcuggcuugacaugcuguau

SEQ ID NO: 107092 - RNA, 21 nt, Human
gccauuuuguccucagagggc

SEQ ID NO: 107093 - RNA, 25 nt, Human
caggcuaacagcugugggaggcuuc

SEQ ID NO: 107094 - RNA, 22 nt, Human
gccccuucucagccucugagga

SEQ ID NO: 107095 - RNA, 28 nt, Human
gggcaccaccugccuuccagccccucca

SEQ ID NO: 107096 - RNA, 23 nt, Human
cgccgccgccuccacagccuggg

SEQ ID NO: 107097 - RNA, 26 nt, Human
caggugaucugccugccuuggcaucc

SEQ ID NO: 107098 - RNA, 24 nt, Human
acucgccuccagccucccaccucc

SEQ ID NO: 107099 - RNA, 27 nt, Human
aacaaauucagaauaucaacagaugau

SEQ ID NO: 107100 - RNA, 23 nt, Human
gagcauggggugcaggagccuuu

SEQ ID NO: 107101 - RNA, 21 nt, Human
aaggaaaaugaggcugaaaug

SEQ ID NO: 107102 - RNA, 20 nt, Human
uuguucuuugcaccucucuc

SEQ ID NO: 107103 - RNA, 26 nt, Human
ucuccuccuaugccaccugccugggc

SEQ ID NO: 107104 - RNA, 24 nt, Human
aagcauuugaauuauuuauuguau

SEQ ID NO: 107105 - RNA, 26 nt, Human
cugccgcugcaccugccugccgcugc

SEQ ID NO: 107106 - RNA, 21 nt, Human
gccugacacccccuccccgcc

SEQ ID NO: 107107 - RNA, 22 nt, Human
gagccgagucaggcucucucca

SEQ ID NO: 107108 - RNA, 22 nt, Human
aauuacccuuuugcaggcacca

SEQ ID NO: 107109 - RNA, 21 nt, Human
ucuggagaguaaucugggaca

SEQ ID NO: 107110 - RNA, 26 nt, Human
gcucacaaccauccuggucauucucg

SEQ ID NO: 107111 - RNA, 21 nt, Human
gcugaccuugaacuccugggc

SEQ ID NO: 107112 - RNA, 21 nt, Human
gacgccucucggggccugugc

SEQ ID NO: 107113 - RNA, 20 nt, Human
gcuuuaaucccagcacuuug

SEQ ID NO: 107114 - RNA, 27 nt, Human
caccacucugcucccugcuugccucca

SEQ ID NO: 107115 - RNA, 22 nt, Human
auccucuccucuucucgagcag

SEQ ID NO: 107116 - RNA, 17 nt, Human
uuaauaaaaauuucuua

SEQ ID NO: 107117 - RNA, 21 nt, Human
gaguccuguaaagaagaagaa

SEQ ID NO: 107118 - RNA, 22 nt, Human
uucuuucuucaccaccuugucu

SEQ ID NO: 107119 - RNA, 31 nt, Human
guauuuguuucauaagcaucuuccuguaauc

SEQ ID NO: 107120 - RNA, 21 nt, Human
aagugaguauuuguuccaaac

SEQ ID NO: 107121 - RNA, 23 nt, Human
ucagcugccacaauagacaucau

SEQ ID NO: 107122 - RNA, 21 nt, Human
cccucucugggccucagucug

SEQ ID NO: 107123 - RNA, 22 nt, Human
caguggccaccaccauggauac

SEQ ID NO: 107124 - RNA, 19 nt, Human
gcugucccacaucacaaga

SEQ ID NO: 107125 - RNA, 24 nt, Human
uucagugagcucuccuuuccuaag

SEQ ID NO: 107126 - RNA, 32 nt, Human
cccgccucccccggcacagccugcugagggga

SEQ ID NO: 107127 - RNA, 22 nt, Human
cugagugggcugggaucucgug

SEQ ID NO: 107128 - RNA, 21 nt, Human
uuguuuauucuuuaaaaugaa

SEQ ID NO: 107129 - RNA, 28 nt, Human
cgcggacucgcccccaggaaacgcucuc

SEQ ID NO: 107130 - RNA, 21 nt, Human
cuugccgcccugccacccugc

SEQ ID NO: 107131 - RNA, 23 nt, Human
cccacagacuccggccuguaauc

SEQ ID NO: 107132 - RNA, 23 nt, Human
uccagccaagaugauccuucuua

SEQ ID NO: 107133 - RNA, 22 nt, Human
cucgcaugacuguuacagcuuu

SEQ ID NO: 107134 - RNA, 25 nt, Human
gcauugucuugucacaccucccuca

SEQ ID NO: 107135 - RNA, 22 nt, Human
uuguuaaaguauuccacugaaa

SEQ ID NO: 107136 - RNA, 26 nt, Human
ggagguggauggggauggaagaugau

SEQ ID NO: 107137 - RNA, 22 nt, Human
agcugagaagcuggaagcugac

SEQ ID NO: 107138 - RNA, 26 nt, Human
uuuguagcauuuuucuaauagguacu

SEQ ID NO: 107139 - RNA, 23 nt, Human
gucccccaggcuggagugcagug

SEQ ID NO: 107140 - RNA, 23 nt, Human
gucacccaggcuggagugccgug

SEQ ID NO: 107141 - RNA, 19 nt, Human
gaccaggcuggagugcagu

SEQ ID NO: 107142 - RNA, 25 nt, Human
ggagagaaguggucggugucuguuu

SEQ ID NO: 107143 - RNA, 23 nt, Human
acucaaacugccuuggcuucagg

SEQ ID NO: 107144 - RNA, 27 nt, Human
uugaguccaggagguugaggcugcagu

SEQ ID NO: 107145 - RNA, 20 nt, Human
gucccaggcuggagugcagu

SEQ ID NO: 107146 - RNA, 23 nt, Human
gcuuugacaaaaugacuggcucc

SEQ ID NO: 107147 - RNA, 21 nt, Human
caucucucagcccucucagcu

SEQ ID NO: 107148 - RNA, 22 nt, Human
gaaaauacagugcccugccuuc

SEQ ID NO: 107149 - RNA, 22 nt, Human
ccaauuuccauggcagaaaaau

SEQ ID NO: 107150 - RNA, 22 nt, Human
gcgugagccaccgugccuggcc

SEQ ID NO: 107151 - RNA, 22 nt, Human
gugugagccaccgugcccggcc

SEQ ID NO: 107152 - RNA, 22 nt, Human
uguucuguugaguggcacuugc

SEQ ID NO: 107153 - RNA, 23 nt, Human
ucuggcaguugugccaagggagg

SEQ ID NO: 107154 - RNA, 21 nt, Human
ccugcagugguuggagacggg

SEQ ID NO: 107155 - RNA, 22 nt, Human
ccaacaucaugaaaccccgucu

SEQ ID NO: 107156 - RNA, 20 nt, Human
aaucgcuguuacuacuucuc

SEQ ID NO: 107157 - RNA, 23 nt, Human
cacaggcucucacaagaucagaa

SEQ ID NO: 107158 - RNA, 27 nt, Human
uuuaaaccauuguggacuaguggcugc

SEQ ID NO: 107159 - RNA, 22 nt, Human
acccaggucucccuggaucaga

SEQ ID NO: 107160 - RNA, 21 nt, Human
uugcuaagaaaaacagcccau

SEQ ID NO: 107161 - RNA, 27 nt, Human
uugggaggcugaggcgggcagaucacc

SEQ ID NO: 107162 - RNA, 20 nt, Human
agccucuccccugcucccgu

SEQ ID NO: 107163 - RNA, 23 nt, Human
agggagacaaauuauuugcaaaa

SEQ ID NO: 107164 - RNA, 27 nt, Human
gccuuucuuuuccccucccucccgguu

SEQ ID NO: 107165 - RNA, 21 nt, Human
acuccucacagccuacuuccc

SEQ ID NO: 107166 - RNA, 20 nt, Human
cuuaagaguagcugucucuc

SEQ ID NO: 107167 - RNA, 23 nt, Human
uccugguuucuccuccuggaguc

SEQ ID NO: 107168 - RNA, 18 nt, Human
gcacauguuuuucaagag

SEQ ID NO: 107169 - RNA, 22 nt, Human
cggaagguagaaauucugcuca

SEQ ID NO: 107170 - RNA, 22 nt, Human
acaauuauagcucacugcagcc

SEQ ID NO: 107171 - RNA, 24 nt, Human
ccuggucccucacccccauggccc

SEQ ID NO: 107172 - RNA, 25 nt, Human
uagaaauugaaguuucagagcuaca

SEQ ID NO: 107173 - RNA, 22 nt, Human
gaggcugggugucuggaagcau

SEQ ID NO: 107174 - RNA, 21 nt, Human
ugagccaaguucacaccacug

SEQ ID NO: 107175 - RNA, 27 nt, Human
ucaugauacuuagucugcagggcauau

SEQ ID NO: 107176 - RNA, 25 nt, Human
ucccuccaucaucuagacuugauuu

SEQ ID NO: 107177 - RNA, 20 nt, Human
cagcuuugugcuggcuuugu

SEQ ID NO: 107178 - RNA, 21 nt, Human
uuugcaaggaagccacagcug

SEQ ID NO: 107179 - RNA, 24 nt, Human
ccauacagcuguccacacugaaga

SEQ ID NO: 107180 - RNA, 22 nt, Human
cgggaggcagaaguugcaguga

SEQ ID NO: 107181 - RNA, 26 nt, Human
uugcccaggagagggaccaggggugc

SEQ ID NO: 107182 - RNA, 21 nt, Human
augugguggugguugugccca

SEQ ID NO: 107183 - RNA, 27 nt, Human
cuuuuagaaucaguguaucagugaccu

SEQ ID NO: 107184 - RNA, 24 nt, Human
ccgcgacgaauaccagcgcacgug

SEQ ID NO: 107185 - RNA, 21 nt, Human
gaccaggcuggccagcauggu

SEQ ID NO: 107186 - RNA, 24 nt, Human
ucacagacauaaauaaauaaauac

SEQ ID NO: 107187 - RNA, 19 nt, Human
gaggaggccgcugcgggcu

SEQ ID NO: 107188 - RNA, 22 nt, Human
ugcaaccuccacuucccagguu

SEQ ID NO: 107189 - RNA, 24 nt, Human
gcugcaaaccaauuugggcucaga

SEQ ID NO: 107190 - RNA, 29 nt, Human
acaaguggugggucaggugguccuaggac

SEQ ID NO: 107191 - RNA, 19 nt, Human
ugacugcacuccagccugg

SEQ ID NO: 107192 - RNA, 27 nt, Human
uaaagaauguuuuggaauaaacugucu

SEQ ID NO: 107193 - RNA, 22 nt, Human
aucgcuuucaauaggcuuuuca

SEQ ID NO: 107194 - RNA, 20 nt, Human
uacuuggucaucaaaaaagg

SEQ ID NO: 107195 - RNA, 25 nt, Human
ugacaugacuuggcuuucucaucca

SEQ ID NO: 107196 - RNA, 20 nt, Human
ucuggcccugcucuccugca

SEQ ID NO: 107197 - RNA, 23 nt, Human
uuaggcuguuacacaacugcugg

SEQ ID NO: 107198 - RNA, 26 nt, Human
accuggaugucacuggccacugagga

SEQ ID NO: 107199 - RNA, 26 nt, Human
ccaggcauugacuauuacaauuucau

SEQ ID NO: 107200 - RNA, 27 nt, Human
gcugccucugagcccucccugcuaaga

SEQ ID NO: 107201 - RNA, 24 nt, Human
uuagugcuugccaccaccagauga

SEQ ID NO: 107202 - RNA, 26 nt, Human
auggugucugugacauuuccuguugu

SEQ ID NO: 107203 - RNA, 23 nt, Human
ggcuaauuuuuugaauuuuuagu

SEQ ID NO: 107204 - RNA, 23 nt, Human
ggcuaauuuuuuggauuuuuaau

SEQ ID NO: 107205 - RNA, 24 nt, Human
aacaaacaaaaguacuguacucac

SEQ ID NO: 107206 - RNA, 22 nt, Human
cagaaauuuaguuaacaucuua

SEQ ID NO: 107207 - RNA, 22 nt, Human
uuucagaacccaaauguccuca

SEQ ID NO: 107208 - RNA, 25 nt, Human
gggggaaaaaacaguucaacugcuu

SEQ ID NO: 107209 - RNA, 22 nt, Human
gggacacuggcagcuguggaaa

SEQ ID NO: 107210 - RNA, 23 nt, Human
ugucaucugcaugucuacucagc

SEQ ID NO: 107211 - RNA, 21 nt, Human
uuaaucaaaacucaaauguga

SEQ ID NO: 107212 - RNA, 27 nt, Human
aagcuccuuucuucucuuucugcuuca

SEQ ID NO: 107213 - RNA, 20 nt, Human
cuuuccuccugcuucauggg

SEQ ID NO: 107214 - RNA, 19 nt, Human
ucuguucuuaauuuuuggg

SEQ ID NO: 107215 - RNA, 27 nt, Human
agagugagaacuuucccuaccguguuu

SEQ ID NO: 107216 - RNA, 22 nt, Human
ccugcugucagaccuucuucca

SEQ ID NO: 107217 - RNA, 20 nt, Human
ucccacacgauuagcuuuau

SEQ ID NO: 107218 - RNA, 22 nt, Human
gaaagcaggcuaggcaugugaa

SEQ ID NO: 107219 - RNA, 20 nt, Human
uaauuuaaacauuaaccuca

SEQ ID NO: 107220 - RNA, 25 nt, Human
gacuucaagaugccucuucuaccuc

SEQ ID NO: 107221 - RNA, 21 nt, Human
caccagccgcacgcgugguaa

SEQ ID NO: 107222 - RNA, 27 nt, Human
cccagaguauugggauuacagacauga

SEQ ID NO: 107223 - RNA, 22 nt, Human
uuuuuggggggaaaaguauuuu

SEQ ID NO: 107224 - RNA, 22 nt, Human
gggacgcagggguugcagugag

SEQ ID NO: 107225 - RNA, 22 nt, Human
gaguagacagucuucuacuuuc

SEQ ID NO: 107226 - RNA, 19 nt, Human
agcaagcuguguuacuuga

SEQ ID NO: 107227 - RNA, 22 nt, Human
uggaugcccuaucuaucugcua

SEQ ID NO: 107228 - RNA, 23 nt, Human
ccccaacacugagcaaguaugcu

SEQ ID NO: 107229 - RNA, 27 nt, Human
caggccuguucccugaggaccugcgca

SEQ ID NO: 107230 - RNA, 22 nt, Human
gcaguuuacugagggcauuuca

SEQ ID NO: 107231 - RNA, 20 nt, Human
ucccaccuccaccugcccca

SEQ ID NO: 107232 - RNA, 22 nt, Human
uccuagcuccuccuccugggcu

SEQ ID NO: 107233 - RNA, 24 nt, Human
uaaugggccaccuccccacaacag

SEQ ID NO: 107234 - RNA, 29 nt, Human
agaaauuuucccuguuuggaaaguuugcc

SEQ ID NO: 107235 - RNA, 24 nt, Human
gacuccuggauaggcagcuggacc

SEQ ID NO: 107236 - RNA, 20 nt, Human
ugcccaggcuggagugcaau

SEQ ID NO: 107237 - RNA, 20 nt, Human
ugcccaggcuagagugcagu

SEQ ID NO: 107238 - RNA, 22 nt, Human
ccugcaggaccagcaucaucug

SEQ ID NO: 107239 - RNA, 24 nt, Human
cugucucccaggcugaagugcagu

SEQ ID NO: 107240 - RNA, 27 nt, Human
gugucucaugccagcagcacgucgcca

SEQ ID NO: 107241 - RNA, 27 nt, Human
uuccagccucugccccucaggggaacc

SEQ ID NO: 107242 - RNA, 24 nt, Human
cccuccagugcuccuacugguucc

SEQ ID NO: 107243 - RNA, 22 nt, Human
aaacucuauuuagaugcauauu

SEQ ID NO: 107244 - RNA, 27 nt, Human
gggacggcgggauccggugggagccgg

SEQ ID NO: 107245 - RNA, 21 nt, Human
gccuaugcuguguugugggcu

SEQ ID NO: 107246 - RNA, 18 nt, Human
cuucccuuccccuggcau

SEQ ID NO: 107247 - RNA, 26 nt, Human
ggaggaaggagucgccgaggagcagc

SEQ ID NO: 107248 - RNA, 20 nt, Human
gcccacugggagccguggau

SEQ ID NO: 107249 - RNA, 27 nt, Human
ucuucucuccauccuuggaccuucaca

SEQ ID NO: 107250 - RNA, 26 nt, Human
ggcggagauggguccuggccuugugu

SEQ ID NO: 107251 - RNA, 20 nt, Human
uaucccucagcucugagucc

SEQ ID NO: 107252 - RNA, 24 nt, Human
cacauuuccuuucuacucuuucug

SEQ ID NO: 107253 - RNA, 27 nt, Human
caccugugccagcagcugaugccuccu

SEQ ID NO: 107254 - RNA, 25 nt, Human
gugugcaacuggcccccaacgcaau

SEQ ID NO: 107255 - RNA, 21 nt, Human
gccccgaagcugucccaggga

SEQ ID NO: 107256 - RNA, 25 nt, Human
caaguuaaauuuuugucauuuaucu

SEQ ID NO: 107257 - RNA, 21 nt, Human
ucuucauuuuugucaguguau

SEQ ID NO: 107258 - RNA, 21 nt, Human
gcgucuccccugcugcugucc

SEQ ID NO: 107259 - RNA, 26 nt, Human
ggagugcugggcuugugcacaggaag

SEQ ID NO: 107260 - RNA, 25 nt, Human
gagauuccugcaggccagaggccgg

SEQ ID NO: 107261 - RNA, 24 nt, Human
gucccugucuuccuccaggacaca

SEQ ID NO: 107262 - RNA, 27 nt, Human
cagcgaggaauuaacccuguguccuca

SEQ ID NO: 107263 - RNA, 20 nt, Human
ccuuuuaacuuccauggccc

SEQ ID NO: 107264 - RNA, 27 nt, Human
uucgguggcuagucaagcuccuccucc

SEQ ID NO: 107265 - RNA, 27 nt, Human
gucauguugguacccuggacagugccu

SEQ ID NO: 107266 - RNA, 22 nt, Human
ccugccugccuugccuuggggc

SEQ ID NO: 107267 - RNA, 21 nt, Human
aagacccuaagccuccuuuug

SEQ ID NO: 107268 - RNA, 19 nt, Human
uaacugguugcugugucau

SEQ ID NO: 107269 - RNA, 21 nt, Human
aucagccaggcuggagugcag

SEQ ID NO: 107270 - RNA, 22 nt, Human
cagugacauucaauugguucua

SEQ ID NO: 107271 - RNA, 23 nt, Human
ggaaugaagaacaacaacucuca

SEQ ID NO: 107272 - RNA, 20 nt, Human
cauguaauaaaaaguauaug

SEQ ID NO: 107273 - RNA, 22 nt, Human
gccacauccugcuaaacuggga

SEQ ID NO: 107274 - RNA, 23 nt, Human
uaaaaccagcuucauuuguugcu

SEQ ID NO: 107275 - RNA, 20 nt, Human
acacucaagauacuugccag

SEQ ID NO: 107276 - RNA, 19 nt, Human
uccauccugguucagagaa

SEQ ID NO: 107277 - RNA, 30 nt, Human; identical to SEQ ID NO: 5263

SEQ ID NO: 107278 - RNA, 22 nt, Human
gggugucagggaacaaaguuuu

SEQ ID NO: 107279 - RNA, 23 nt, Human
agcccucucucagagcugccauc

SEQ ID NO: 107280 - RNA, 27 nt, Human
acugagucuggaacaauaauacccuau

SEQ ID NO: 107281 - RNA, 24 nt, Human
uugugcccuccaccuaccugccgg

SEQ ID NO: 107282 - RNA, 27 nt, Human
caugccacugcacucuagccuggguga

SEQ ID NO: 107283 - RNA, 25 nt, Human
ccuagcuccauguuccuccuccucu

SEQ ID NO: 107284 - RNA, 22 nt, Human
cccuccagugggcugaugcugg

SEQ ID NO: 107285 - RNA, 27 nt, Human
gcuacccaggcccacccaucacgugug

SEQ ID NO: 107286 - RNA, 22 nt, Human
cuucccuuacccuaucacuggc

SEQ ID NO: 107287 - RNA, 30 nt, Human
agucccugccuucagagagcugaaaagggu

SEQ ID NO: 107288 - RNA, 22 nt, Human
uucaacacaucuauugaaagug

SEQ ID NO: 107289 - RNA, 22 nt, Human
ucagcacacucauucuuuguca

SEQ ID NO: 107290 - RNA, 21 nt, Human
accaggcccccaagugugguc

SEQ ID NO: 107291 - RNA, 21 nt, Human
cuuuuucuggagauaguuuuc

SEQ ID NO: 107292 - RNA, 22 nt, Human
ggcaggagaauugcuugagccc

SEQ ID NO: 107293 - RNA, 22 nt, Human
gugugcaccaccaugccugguu

SEQ ID NO: 107294 - RNA, 22 nt, Human
gcaugcaccaccaugcccaguu

SEQ ID NO: 107295 - RNA, 27 nt, Human
aggccuccuguccacaccagcgccccc

SEQ ID NO: 107296 - RNA, 20 nt, Human
ccuugauagagcaaaacuca

SEQ ID NO: 107297 - RNA, 24 nt, Human
cucaucugucccugaccucuaacc

SEQ ID NO: 107298 - RNA, 16 nt, Human
caguguugaaacagaa

SEQ ID NO: 107299 - RNA, 16 nt, Human
ggccuccugccugggc

SEQ ID NO: 107300 - RNA, 25 nt, Human
aucagcccugcagcuguaguacagu

SEQ ID NO: 107301 - RNA, 19 nt, Human
gaaccuuugggagugccuu

SEQ ID NO: 107302 - RNA, 17 nt, Human
augcccucagugcagug

SEQ ID NO: 107303 - RNA, 22 nt, Human
agcuccgcugcuaucuuugccu

SEQ ID NO: 107304 - RNA, 21 nt, Human
gguacuccugcccuugcuuga

SEQ ID NO: 107305 - RNA, 27 nt, Human
cugagauaguuccuaauucaucaacgu

SEQ ID NO: 107306 - RNA, 22 nt, Human
aaccucccaaguagcugggauu

SEQ ID NO: 107307 - RNA, 22 nt, Human
agccucccagguagcugggauu

SEQ ID NO: 107308 - RNA, 30 nt, Human
ccucuuaccuggaagaucaggcugaacgau

SEQ ID NO: 107309 - RNA, 20 nt, Human
ccugacugcuccuuuccgcu

SEQ ID NO: 107310 - RNA, 23 nt, Human
cugaaaacugcugccgccgcgcc

SEQ ID NO: 107311 - RNA, 22 nt, Human
agacugcagaauggaggggugg

SEQ ID NO: 107312 - RNA, 23 nt, Human
gugcucacccaggcugagggugc

SEQ ID NO: 107313 - RNA, 25 nt, Human
cugguuccuguuuagcuguucugaa

SEQ ID NO: 107314 - RNA, 26 nt, Human
uccccaggcugaaguguccucagguu

SEQ ID NO: 107315 - RNA, 22 nt, Human
uguugugcaggcuggagugcag

SEQ ID NO: 107316 - RNA, 26 nt, Human
gcagccgccagucccaccgccgccgc

SEQ ID NO: 107317 - RNA, 22 nt, Human
uugaccccauuuauguguagga

SEQ ID NO: 107318 - RNA, 25 nt, Human
aggcacccugcuuccuuugcuugca

SEQ ID NO: 107319 - RNA, 19 nt, Human
aaaacaaacacaaguuuca

SEQ ID NO: 107320 - RNA, 24 nt, Human
ggaggagacaaggagcugaaggag

SEQ ID NO: 107321 - RNA, 20 nt, Human
ccacgcauacacacaugccc

SEQ ID NO: 107322 - RNA, 20 nt, Human
caucagcuuaaaaucuguca

SEQ ID NO: 107323 - RNA, 27 nt, Human
uuucaccccagcuucucucuccuggcc

SEQ ID NO: 107324 - RNA, 21 nt, Human
ggcagaaauucggaacaagac

SEQ ID NO: 107325 - RNA, 25 nt, Human
gcaccaggggccaaccucaggcucc

SEQ ID NO: 107326 - RNA, 24 nt, Human
guagacaaauguuacaaggcugca

SEQ ID NO: 107327 - RNA, 21 nt, Human
gacauuucauaccugcccugg

SEQ ID NO: 107328 - RNA, 22 nt, Human
aggcuggagugcaguggcacca

SEQ ID NO: 107329 - RNA, 23 nt, Human
aaugcauaacuaggccuaggcag

SEQ ID NO: 107330 - RNA, 21 nt, Human
ggcucacugcuaccucuacca

SEQ ID NO: 107331 - RNA, 22 nt, Human
ugccuucagggcaaagaauaga

SEQ ID NO: 107332 - RNA, 20 nt, Human
auucaguuguuauugcagug

SEQ ID NO: 107333 - RNA, 24 nt, Human
ugccuccagggccucuccuuggaa

SEQ ID NO: 107334 - RNA, 21 nt, Human
ccguccgccgccaccacccac

SEQ ID NO: 107335 - RNA, 27 nt, Human
ggcaggcaggagguccucagaaggugu

SEQ ID NO: 107336 - RNA, 27 nt, Human
auuccuauacuggaugagcaaggagca

SEQ ID NO: 107337 - RNA, 22 nt, Human
cugaauagcugggaauacaggu

SEQ ID NO: 107338 - RNA, 27 nt, Human
ucucuccucagcuggaaugaggaaugu

SEQ ID NO: 107339 - RNA, 27 nt, Human
uugaagccuuuuguuucccuugcuuug

SEQ ID NO: 107340 - RNA, 23 nt, Human
ugggugccacagguaaccccaau

SEQ ID NO: 107341 - RNA, 20 nt, Human
guccuuuauaaguugcuuuc

SEQ ID NO: 107342 - RNA, 23 nt, Human
gggccuccucccaggcugcucca

SEQ ID NO: 107343 - RNA, 27 nt, Human
ucaucccugcggaugcaccgccguacc

SEQ ID NO: 107344 - RNA, 24 nt, Human
gcggccucucugugccgcuucauu

SEQ ID NO: 107345 - RNA, 28 nt, Human
ccugagccgcaacggcucugaggccucc

SEQ ID NO: 107346 - RNA, 22 nt, Human
gggaaauuaguaggcucauuua

SEQ ID NO: 107347 - RNA, 19 nt, Human
guuuggaaagagaaaaaag

SEQ ID NO: 107348 - RNA, 23 nt, Human
cugcucaacaggaaaugaaccua

SEQ ID NO: 107349 - RNA, 21 nt, Human
cggguucaugccauucugccu

SEQ ID NO: 107350 - RNA, 22 nt, Human
ccugcccagcccugccuccugg

SEQ ID NO: 107351 - RNA, 22 nt, Human
aaauaugcuuuucuaugggucu

SEQ ID NO: 107352 - RNA, 27 nt, Human
ccaggaggcggagguugcaguaagcca

SEQ ID NO: 107353 - RNA, 23 nt, Human
ccuuugagucaguuccauccugg

SEQ ID NO: 107354 - RNA, 23 nt, Human
uuggccagagauuuagauauguc

SEQ ID NO: 107355 - RNA, 23 nt, Human
uuaaaaaauaauguucauaagga

SEQ ID NO: 107356 - RNA, 23 nt, Human
ucccuccuccccucuccuugcac

SEQ ID NO: 107357 - RNA, 20 nt, Human
cugggccuuggcugcuguca

SEQ ID NO: 107358 - RNA, 27 nt, Human
uggggggaaugacauguuugggucuuu

SEQ ID NO: 107359 - RNA, 24 nt, Human
cugcagacaugagagacagcaggu

SEQ ID NO: 107360 - RNA, 24 nt, Human
cagucaaguucccuccugcagccu

SEQ ID NO: 107361 - RNA, 27 nt, Human
gagcccaggagucagugcuggugguug

SEQ ID NO: 107362 - RNA, 24 nt, Human
agagggaacccaggaauugugagg

SEQ ID NO: 107363 - RNA, 19 nt, Human
augcugcuaccucucuccu

SEQ ID NO: 107364 - RNA, 25 nt, Human
guuuccucugcggaguguagcagcc

SEQ ID NO: 107365 - RNA, 23 nt, Human
ucuguaacaguugcauugacugu

SEQ ID NO: 107366 - RNA, 22 nt, Human
aacccccaggcucacagcagug

SEQ ID NO: 107367 - RNA, 24 nt, Human
gggacugugcagcucgaggcucca

SEQ ID NO: 107368 - RNA, 19 nt, Human
ggaacuuggaacgugccag

SEQ ID NO: 107369 - RNA, 23 nt, Human
guggccuagaaguccucuguggu

SEQ ID NO: 107370 - RNA, 23 nt, Human
acaguuaagagaaaugagcuuga

SEQ ID NO: 107371 - RNA, 27 nt, Human
aaguagcugagauuacaggcgcacacc

SEQ ID NO: 107372 - RNA, 22 nt, Human
gcaagugccuuccuuggagcag

SEQ ID NO: 107373 - RNA, 20 nt, Human
aggcaggaucgcagugguca

SEQ ID NO: 107374 - RNA, 22 nt, Human
gcaaucauggcucacugcagcc

SEQ ID NO: 107375 - RNA, 20 nt, Human
gcuuguucccugucuugucc

SEQ ID NO: 107376 - RNA, 20 nt, Human
ccaugaucgcucauucuucu

SEQ ID NO: 107377 - RNA, 25 nt, Human
gccccacuguccacacacugccucc

SEQ ID NO: 107378 - RNA, 27 nt, Human
gccaugcguccuggucaggcuucccuc

SEQ ID NO: 107379 - RNA, 21 nt, Human
cacuucaccuucuguaauacu

SEQ ID NO: 107380 - RNA, 20 nt, Human
ccauuuuuccugaguagggc

SEQ ID NO: 107381 - RNA, 16 nt, Human
cgcuggggcuuggggg

SEQ ID NO: 107382 - RNA, 22 nt, Human
cucugccaaaaggaaucagaga

SEQ ID NO: 107383 - RNA, 24 nt, Human
ggcucagauggacugggaggaggg

SEQ ID NO: 107384 - RNA, 21 nt, Human
ccaacagcagcgccgcugcca

SEQ ID NO: 107385 - RNA, 19 nt, Human
caggcguguguuacagugg

SEQ ID NO: 107386 - RNA, 16 nt, Human
cccacagauuguauuu

SEQ ID NO: 107387 - RNA, 22 nt, Human
guggcuucccauccccaaaagg

SEQ ID NO: 107388 - RNA, 21 nt, Human
gcguguucuuauuacugacau

SEQ ID NO: 107389 - RNA, 24 nt, Human
cucgugauccaccccacucagccu

SEQ ID NO: 107390 - RNA, 16 nt, Human
caugaucuucuuugag

SEQ ID NO: 107391 - RNA, 21 nt, Human
ggcaggcaccguggugugagc

SEQ ID NO: 107392 - RNA, 23 nt, Human
ggccugggguccugguguugggc

SEQ ID NO: 107393 - RNA, 22 nt, Human
ccccaaaggacaaccaucuugu

SEQ ID NO: 107394 - RNA, 26 nt, Human
auuuucuuauuuuuaaucaaauaacu

SEQ ID NO: 107395 - RNA, 25 nt, Human
ucaucagaggaaaagggcaaaaaga

SEQ ID NO: 107396 - RNA, 25 nt, Human
cugauaguugaucacacauugugcu

SEQ ID NO: 107397 - RNA, 27 nt, Human
ugugccugaagucccagauacuugggg

SEQ ID NO: 107398 - RNA, 25 nt, Human
cgggcuggggagaaguugaaggguc

SEQ ID NO: 107399 - RNA, 24 nt, Human
cauuccccacucccaccuucaacu

SEQ ID NO: 107400 - RNA, 22 nt, Human
uguucaucugcugacuucuguc

SEQ ID NO: 107401 - RNA, 21 nt, Human
gcuuuucccuguccugacacc

SEQ ID NO: 107402 - RNA, 21 nt, Human
ggcagcccuggcaucccacag

SEQ ID NO: 107403 - RNA, 25 nt, Human
cuggugaaggccagaucagauuuca

SEQ ID NO: 107404 - RNA, 31 nt, Human
gcuggcggagcagaggugcagaagcaacuga

SEQ ID NO: 107405 - RNA, 19 nt, Human
guuuucauauuggaaaagu

SEQ ID NO: 107406 - RNA, 22 nt, Human
ggccucggcuuccuuaacugca

SEQ ID NO: 107407 - RNA, 27 nt, Human
aggccucugccaguguccccagcacuu

SEQ ID NO: 107408 - RNA, 22 nt, Human
cuccucugggcaggaccucaga

SEQ ID NO: 107409 - RNA, 21 nt, Human
cuucaaccuucaaaacuaucu

SEQ ID NO: 107410 - RNA, 25 nt, Human
uagucccagguacucaggaggcuga

SEQ ID NO: 107411 - RNA, 21 nt, Human
gcaguuucagccgcgacagca

SEQ ID NO: 107412 - RNA, 24 nt, Human
gggaggggccuagacaaggcucca

SEQ ID NO: 107413 - RNA, 23 nt, Human
gggaguuagagggguaaugggag

SEQ ID NO: 107414 - RNA, 18 nt, Human
cauaaagagaaggacggg

SEQ ID NO: 107415 - RNA, 27 nt, Human
cugagucucuaucauagcugaacccug

SEQ ID NO: 107416 - RNA, 26 nt, Human
gggaaaggcagggcccugaaauggcc

SEQ ID NO: 107417 - RNA, 23 nt, Human
uuaacauugcagcuuucucucca

SEQ ID NO: 107418 - RNA, 22 nt, Human
ccugcugcucagcuacuuuguc

SEQ ID NO: 107419 - RNA, 21 nt, Human
caagcauuagguaaacccacc

SEQ ID NO: 107420 - RNA, 25 nt, Human
cagauacaaagauaacaaaagcuuu

SEQ ID NO: 107421 - RNA, 23 nt, Human
uuuucuugaagagugugguugaa

SEQ ID NO: 107422 - RNA, 26 nt, Human
uugaaacuuugaggaaaugccaguga

SEQ ID NO: 107423 - RNA, 22 nt, Human
cugaucauagcucacugcagcu

SEQ ID NO: 107424 - RNA, 23 nt, Human
acagaaacacuuccugcgagcau

SEQ ID NO: 107425 - RNA, 21 nt, Human
cuucacccaggaggagugggg

SEQ ID NO: 107426 - RNA, 20 nt, Human
guggaggccaagauuguacc

SEQ ID NO: 107427 - RNA, 20 nt, Human
auuaggugugacugaauuuc

SEQ ID NO: 107428 - RNA, 20 nt, Human
uccagaaaucauauuacaag

SEQ ID NO: 107429 - RNA, 32 nt, Human
ccaccgcgcccgcucugcuccgacaccgcgcc

SEQ ID NO: 107430 - RNA, 24 nt, Human
auauuacaaucuuucaaagucgca

SEQ ID NO: 107431 - RNA, 27 nt, Human
uucauaaggacucuuaaaauaauccug

SEQ ID NO: 107432 - RNA, 22 nt, Human
uuauuauuauuucuuuuguuac

SEQ ID NO: 107433 - RNA, 25 nt, Human
ucuccgccucagcuuccuaguagcu

SEQ ID NO: 107434 - RNA, 20 nt, Human
cagcuuuguaacuguuuuca

SEQ ID NO: 107435 - RNA, 22 nt, Human
acagggugcuagugaguacuga

SEQ ID NO: 107436 - RNA, 26 nt, Human
uuuucuauuugugguauauguauaua

SEQ ID NO: 107437 - RNA, 22 nt, Human
acagaauauacacauuuuguaa

SEQ ID NO: 107438 - RNA, 24 nt, Human
gcugggugaauuccagccugggga

SEQ ID NO: 107439 - RNA, 25 nt, Human
uaaacuucaaaagguuuguaagauu

SEQ ID NO: 107440 - RNA, 26 nt, Human
cagccuggccagggccagaggccccu

SEQ ID NO: 107441 - RNA, 22 nt, Human
gaggcggaggagguugcaguga

SEQ ID NO: 107442 - RNA, 21 nt, Human
gaauacucucacaaguaggga

SEQ ID NO: 107443 - RNA, 23 nt, Human
uaggggcaguggagguagaauga

SEQ ID NO: 107444 - RNA, 26 nt, Human
ggcugucuuuaaggggccugcccuca

SEQ ID NO: 107445 - RNA, 19 nt, Human
ucagcaaucccccaucguu

SEQ ID NO: 107446 - RNA, 26 nt, Human
gacggcguuggcggggcugggcacag

SEQ ID NO: 107447 - RNA, 21 nt, Human
agccuccuuaccucccuucag

SEQ ID NO: 107448 - RNA, 22 nt, Human
agccucccaaguagcugagacu

SEQ ID NO: 107449 - RNA, 21 nt, Human
gauauaggugagucuuguggu

SEQ ID NO: 107450 - RNA, 22 nt, Human
ugaguauucagcgaggcagaua

SEQ ID NO: 107451 - RNA, 20 nt, Human
gccagacccugcucacauuc

SEQ ID NO: 107452 - RNA, 19 nt, Human
aagcgggugagcaggaggc

SEQ ID NO: 107453 - RNA, 22 nt, Human
ugugaagccagacagugaccuc

SEQ ID NO: 107454 - RNA, 19 nt, Human
auauguagcagaaaggcac

SEQ ID NO: 107455 - RNA, 24 nt, Human
caggacuacagcuuuccuauaucu

SEQ ID NO: 107456 - RNA, 21 nt, Human
agggaugcaaagguugcagug

SEQ ID NO: 107457 - RNA, 26 nt, Human
cacccugcaagccagccuggccagcu

SEQ ID NO: 107458 - RNA, 25 nt, Human
agcuuugacaauuccauauuguaaa

SEQ ID NO: 107459 - RNA, 27 nt, Human
gcccgggcugccugaauagccucagaa

SEQ ID NO: 107460 - RNA, 27 nt, Human
accuccgcccccuggguucaagcaauu

SEQ ID NO: 107461 - RNA, 21 nt, Human
cuugccagaaauggccagcuu

SEQ ID NO: 107462 - RNA, 21 nt, Human
gagcuuuucuccccggagagc

SEQ ID NO: 107463 - RNA, 22 nt, Human
agaguguugagugugguacauu

SEQ ID NO: 107464 - RNA, 23 nt, Human
caccauacaucugugcauuuucu

SEQ ID NO: 107465 - RNA, 22 nt, Human
cccucccacacacaggccagcu

SEQ ID NO: 107466 - RNA, 22 nt, Human
uucccuuugguaggugcaccug

SEQ ID NO: 107467 - RNA, 17 nt, Human
gguccgcucccaccugg

SEQ ID NO: 107468 - RNA, 23 nt, Human
ccaacaucuggguccugccuucg

SEQ ID NO: 107469 - RNA, 19 nt, Human
gugugugucugaagaaaga

SEQ ID NO: 107470 - RNA, 18 nt, Human
cggcagcagcagcagcga

SEQ ID NO: 107471 - RNA, 25 nt, Human
uguuuuugcuuauuuuucuaugcau

SEQ ID NO: 107472 - RNA, 22 nt, Human
uuucuuggcccucuucuugaau

SEQ ID NO: 107473 - RNA, 22 nt, Human
agcugagugcaagaugagggag

SEQ ID NO: 107474 - RNA, 24 nt, Human
ccugcgcuuuucaucgccauucca

SEQ ID NO: 107475 - RNA, 25 nt, Human
gacaagccuggcaacacaccuggug

SEQ ID NO: 107476 - RNA, 20 nt, Human
ugcagaagucccaagacccu

SEQ ID NO: 107477 - RNA, 27 nt, Human
ccucccuuccuuauuuauuccugcugc

SEQ ID NO: 107478 - RNA, 23 nt, Human
cugggcuuggacacuugccgugg

SEQ ID NO: 107479 - RNA, 23 nt, Human
cuccacccccucccgucccagcc

SEQ ID NO: 107480 - RNA, 21 nt, Human
ucauuaagacuuaugugcucu

SEQ ID NO: 107481 - RNA, 21 nt, Human
gcucaucccuccuucuuuagu

SEQ ID NO: 107482 - RNA, 21 nt, Human
auaucacaccacgucuuuuca

SEQ ID NO: 107483 - RNA, 24 nt, Human
cugccugccccugagcccuguguc

SEQ ID NO: 107484 - RNA, 22 nt, Human
cgcuugaacccgggaggcagag

SEQ ID NO: 107485 - RNA, 22 nt, Human
ccuccacuaccucacugacuuc

SEQ ID NO: 107486 - RNA, 24 nt, Human
uacacauuccaucuuacauuagug

SEQ ID NO: 107487 - RNA, 25 nt, Human
uugcauccccauggcauuugcuuca

SEQ ID NO: 107488 - RNA, 24 nt, Human
gugcacauuccacccuugccagag

SEQ ID NO: 107489 - RNA, 27 nt, Human
ucccaacaagguguacauauucugcgu

SEQ ID NO: 107490 - RNA, 20 nt, Human
acacaaaacagcaaacuuca

SEQ ID NO: 107491 - RNA, 22 nt, Human
aauguaagauuuuuacacuuuu

SEQ ID NO: 107492 - RNA, 22 nt, Human
gcccagccuggcagauuuuauu

SEQ ID NO: 107493 - RNA, 20 nt, Human
gugagucugguggaggagcu

SEQ ID NO: 107494 - RNA, 27 nt, Human
uuuuccuugguuuuguuaaaguuuccu

SEQ ID NO: 107495 - RNA, 22 nt, Human
uuguaacaaguggggguggggg

SEQ ID NO: 107496 - RNA, 20 nt, Human
aauaaucacagcucugggaa

SEQ ID NO: 107497 - RNA, 22 nt, Human
agccucccaaagagcugggauu

SEQ ID NO: 107498 - RNA, 21 nt, Human
uggcucacugucuuacaauca

SEQ ID NO: 107499 - RNA, 23 nt, Human
uaauuggagcagcuuuuggcugc

SEQ ID NO: 107500 - RNA, 22 nt, Human
cugaggcaggaggaucauuuga

SEQ ID NO: 107501 - RNA, 25 nt, Human
guggaucaaaugccaguugugacga

SEQ ID NO: 107502 - RNA, 23 nt, Human
uuaaauuuagucuuuacugugcc

SEQ ID NO: 107503 - RNA, 31 nt, Human
gggaggcccugagacagggauugugcuucau

SEQ ID NO: 107504 - RNA, 23 nt, Human
guccugaacuccuggcuuuccag

SEQ ID NO: 107505 - RNA, 21 nt, Human
augacagaccuccagcaucca

SEQ ID NO: 107506 - RNA, 20 nt, Human
aucugugucuuaaaacuuac

SEQ ID NO: 107507 - RNA, 22 nt, Human
aaagugcugauauuacaggcau

SEQ ID NO: 107508 - RNA, 22 nt, Human
cuucccucccuuucuccuaaag

SEQ ID NO: 107509 - RNA, 21 nt, Human
gacuguacuguuuaacuguca

SEQ ID NO: 107510 - RNA, 22 nt, Human
gcucacugcaauuugcgucucc

SEQ ID NO: 107511 - RNA, 25 nt, Human
gugcuuguacugcuagaagcacuuu

SEQ ID NO: 107512 - RNA, 19 nt, Human
ggaggccaaggugggagga

SEQ ID NO: 107513 - RNA, 24 nt, Human
ugaggagggaaugauugguagcaa

SEQ ID NO: 107514 - RNA, 29 nt, Human
gggacaguggugccagacacucccaaauc

SEQ ID NO: 107515 - RNA, 26 nt, Human
aaccugccugguaugaccucuccacc

SEQ ID NO: 107516 - RNA, 22 nt, Human
cagguauuacuucugcacuuac

SEQ ID NO: 107517 - RNA, 28 nt, Human
gccuccaggcacccccaggauucccaga

SEQ ID NO: 107518 - RNA, 21 nt, Human
ugcaguuacuucuggaaauua

SEQ ID NO: 107519 - RNA, 22 nt, Human
uuugguggguagaggccaggga

SEQ ID NO: 107520 - RNA, 22 nt, Human
gcgacuuccaaguccucucaca

SEQ ID NO: 107521 - RNA, 24 nt, Human
cuggggcuguguuuugagcagcag

SEQ ID NO: 107522 - RNA, 19 nt, Human
accaagcaaaagacauaua

SEQ ID NO: 107523 - RNA, 28 nt, Human
gaggugagcagaggaguccagggcggga

SEQ ID NO: 107524 - RNA, 21 nt, Human
cuugcugcugcuuauguucug

SEQ ID NO: 107525 - RNA, 20 nt, Human
uuuuaguuuugauguucuga

SEQ ID NO: 107526 - RNA, 27 nt, Human
guggggggugccccacaaggcccagcc

SEQ ID NO: 107527 - RNA, 23 nt, Human
uugagcugacauauacugggugg

SEQ ID NO: 107528 - RNA, 26 nt, Human
guauguauuauuuacauuuaauagac

SEQ ID NO: 107529 - RNA, 23 nt, Human
cccaccucccugucccuggacuc

SEQ ID NO: 107530 - RNA, 20 nt, Human
ccagggaguggcaaggccau

SEQ ID NO: 107531 - RNA, 27 nt, Human
gcaaucaggacucacagcucuucaagg

SEQ ID NO: 107532 - RNA, 23 nt, Human
cccagcuggcugggacugucuug

SEQ ID NO: 107533 - RNA, 22 nt, Human
cgccauugcacuccagccuggg

SEQ ID NO: 107534 - RNA, 22 nt, Human
cgccacugcacucuagccuggg

SEQ ID NO: 107535 - RNA, 25 nt, Human
aaccuuccagccuccuuugcuggca

SEQ ID NO: 107536 - RNA, 21 nt, Human
guguuaugauucaguauuaac

SEQ ID NO: 107537 - RNA, 23 nt, Human
aaccuuuauacagaaucuuccca

SEQ ID NO: 107538 - RNA, 30 nt, Human
aacuccuggccaggcccuguccuccccacg

SEQ ID NO: 107539 - RNA, 27 nt, Human
uucauuucucaggaugcuucuuaccug

SEQ ID NO: 107540 - RNA, 24 nt, Human
aaagaacaaucaggaauugaaaau

SEQ ID NO: 107541 - RNA, 20 nt, Human
ugucccggaagagucauggg

SEQ ID NO: 107542 - RNA, 21 nt, Human
gcagugagccaagauggcgcc

SEQ ID NO: 107543 - RNA, 23 nt, Human
cauggauuucuuuuuaaauccca

SEQ ID NO: 107544 - RNA, 21 nt, Human
gcagauccuggcacuaccuca

SEQ ID NO: 107545 - RNA, 25 nt, Human
gccagcugugugacagcugguuguu

SEQ ID NO: 107546 - RNA, 23 nt, Human
uguccccggcuggagcccagcgc

SEQ ID NO: 107547 - RNA, 18 nt, Human
cagccaacgguucuugaa

SEQ ID NO: 107548 - RNA, 24 nt, Human
ggggagcaccuguuucagacuggg

SEQ ID NO: 107549 - RNA, 22 nt, Human
gccaggauggccugggcucuga

SEQ ID NO: 107550 - RNA, 26 nt, Human
cacccaggccguggggccaggggccu

SEQ ID NO: 107551 - RNA, 20 nt, Human
gcgcucgccgccgcccagcc

SEQ ID NO: 107552 - RNA, 23 nt, Human
uucucagaugguggagggugcug

SEQ ID NO: 107553 - RNA, 19 nt, Human
gagucuccuuucugcucca

SEQ ID NO: 107554 - RNA, 20 nt, Human
cgccuagacucggcgcaggg

SEQ ID NO: 107555 - RNA, 27 nt, Human
auggaggugcagggcuuggguaacagc

SEQ ID NO: 107556 - RNA, 21 nt, Human
agggggaggggagggagaugu

SEQ ID NO: 107557 - RNA, 21 nt, Human
agaacagauuugguuaguuua

SEQ ID NO: 107558 - RNA, 22 nt, Human
ggaauaccacucccucagguac

SEQ ID NO: 107559 - RNA, 27 nt, Human
ugggcaugggaagaugggcucccuggc

SEQ ID NO: 107560 - RNA, 20 nt, Human
uucauuucuugaauuucuua

SEQ ID NO: 107561 - RNA, 26 nt, Human
gcacccaggcugcagggugaggccag

SEQ ID NO: 107562 - RNA, 27 nt, Human
gcgggcguguggccgcggguuucgcac

SEQ ID NO: 107563 - RNA, 23 nt, Human
gccuccugccuaugucuccucua

SEQ ID NO: 107564 - RNA, 31 nt, Human
gcaaugcuacaggaacaaaguuucaaugcug

SEQ ID NO: 107565 - RNA, 21 nt, Human
gaacucugggcucaagcaauc

SEQ ID NO: 107566 - RNA, 22 nt, Human
agagucacccaucucagcaagc

SEQ ID NO: 107567 - RNA, 22 nt, Human
aguauuuuuguugucaaacuuu

SEQ ID NO: 107568 - RNA, 18 nt, Human
cagaagcagagaugagga

SEQ ID NO: 107569 - RNA, 27 nt, Human
ucuugucucccccucaggaguauuuuu

SEQ ID NO: 107570 - RNA, 20 nt, Human
gggaaguagaggcugggagc

SEQ ID NO: 107571 - RNA, 24 nt, Human
cucuggaggaagccgcccaguccc

SEQ ID NO: 107572 - RNA, 26 nt, Human
ccggggcaaagaccuaagacacuuuu

SEQ ID NO: 107573 - RNA, 22 nt, Human
cacccaggcuagagugcaaugg

SEQ ID NO: 107574 - RNA, 26 nt, Human
aagugaugugauuuaugcauuuaugc

SEQ ID NO: 107575 - RNA, 22 nt, Human
ccgaguagcugagauuacaggu

SEQ ID NO: 107576 - RNA, 22 nt, Human
cacccaggcuggagugcagugg

SEQ ID NO: 107577 - RNA, 23 nt, Human
gugcauuuacaagguuaaagauu

SEQ ID NO: 107578 - RNA, 22 nt, Human
cugcucuuaacuacuaugcaga

SEQ ID NO: 107579 - RNA, 18 nt, Human
ggucucaauacuuucuca

SEQ ID NO: 107580 - RNA, 20 nt, Human
ggucaguaacaagugcaaug

SEQ ID NO: 107581 - RNA, 20 nt, Human
aguaacugucccugcuuucu

SEQ ID NO: 107582 - RNA, 27 nt, Human
ucaguugaccucagugaauucugugau

SEQ ID NO: 107583 - RNA, 25 nt, Human
cacuggaaccucccugggccugucu

SEQ ID NO: 107584 - RNA, 28 nt, Human
cugggacucguguggccuguguggugcc

SEQ ID NO: 107585 - RNA, 23 nt, Human
agaagcaccagcaauucucuuuc

SEQ ID NO: 107586 - RNA, 20 nt, Human
cucugcugcuucccaacaca

SEQ ID NO: 107587 - RNA, 31 nt, Human
uggccuuuauaauuuuacucacucacucuga

SEQ ID NO: 107588 - RNA, 22 nt, Human
ucuuuugcccacacuugggacg

SEQ ID NO: 107589 - RNA, 21 nt, Human
cauguagaucaguggucucca

SEQ ID NO: 107590 - RNA, 25 nt, Human
ucugcuccugcuccugccugcaugu

SEQ ID NO: 107591 - RNA, 27 nt, Human
gcaccgggaccugcugaugguggagaa

SEQ ID NO: 107592 - RNA, 25 nt, Human
cagggguguugugaggacugagaag

SEQ ID NO: 107593 - RNA, 20 nt, Human
gcccaguucuucccgcugug

SEQ ID NO: 107594 - RNA, 21 nt, Human
acgcagccacuucuucaagag

SEQ ID NO: 107595 - RNA, 24 nt, Human
agccaagccacguggacugagagu

SEQ ID NO: 107596 - RNA, 20 nt, Human
gugccaccacuggccaguac

SEQ ID NO: 107597 - RNA, 22 nt, Human
ggcagcgccagcccccuccucc

SEQ ID NO: 107598 - RNA, 20 nt, Human
guuaacugcauuuuacacau

SEQ ID NO: 107599 - RNA, 24 nt, Human
agaagcagcugcagcagcaguucc

SEQ ID NO: 107600 - RNA, 21 nt, Human
aaugaaugcuccaugaaaugc

SEQ ID NO: 107601 - RNA, 23 nt, Human
ucuauuucuuuuuaauuucugca

SEQ ID NO: 107602 - RNA, 22 nt, Human
ucauuuacacucagcugcucug

SEQ ID NO: 107603 - RNA, 21 nt, Human
ucugugggagucugcagauag

SEQ ID NO: 107604 - RNA, 22 nt, Human
accuguaaucccagcgcuuugg

SEQ ID NO: 107605 - RNA, 22 nt, Human
accuguagucccagcacuuugg

SEQ ID NO: 107606 - RNA, 25 nt, Human
uggugucucacacguuuaaucccag

SEQ ID NO: 107607 - RNA, 22 nt, Human
cuacagugaugauugaauucua

SEQ ID NO: 107608 - RNA, 21 nt, Human
gcaggugcaucaccuggauca

SEQ ID NO: 107609 - RNA, 27 nt, Human
ucagggcuccuaccagcaggacugccu

SEQ ID NO: 107610 - RNA, 20 nt, Human
uacagugagcugagagugcc

SEQ ID NO: 107611 - RNA, 22 nt, Human
cuccuauacuaacuuguuucaa

SEQ ID NO: 107612 - RNA, 23 nt, Human
cacggcugaccauuucugcuccg

SEQ ID NO: 107613 - RNA, 28 nt, Human
ugagaaaccaccacaguacuuuagaaua

SEQ ID NO: 107614 - RNA, 23 nt, Human
cugaagccugagcgggggccggg

SEQ ID NO: 107615 - RNA, 23 nt, Human
gcugugugccacagucuggugcc

SEQ ID NO: 107616 - RNA, 27 nt, Human
cauaugcguauauuuuucugugcuaua

SEQ ID NO: 107617 - RNA, 32 nt, Human
cccugaauccuccucugcuccagggcuggccu

SEQ ID NO: 107618 - RNA, 22 nt, Human
gcagacacagaacauaucauca

SEQ ID NO: 107619 - RNA, 21 nt, Human
ccuggacaaggucucuuccuu

SEQ ID NO: 107620 - RNA, 26 nt, Human
ccuuuugacagcuggucccugccucg

SEQ ID NO: 107621 - RNA, 20 nt, Human
ucuaccugccuaagggacuu

SEQ ID NO: 107622 - RNA, 20 nt, Human
ccuccucaugccuucccuga

SEQ ID NO: 107623 - RNA, 23 nt, Human
gcccgggagacagcaagauucug

SEQ ID NO: 107624 - RNA, 22 nt, Human
cccccaggcugaagugcagugg

SEQ ID NO: 107625 - RNA, 27 nt, Human
cggcaggcggcaggcagcaggcugugg

SEQ ID NO: 107626 - RNA, 20 nt, Human
uucaguaaauuccaauauga

SEQ ID NO: 107627 - RNA, 27 nt, Human
uugcccuuuagaaaaugaauuguucac

SEQ ID NO: 107628 - RNA, 21 nt, Human
ucuccucuuuuccuccucaaa

SEQ ID NO: 107629 - RNA, 21 nt, Human
uuuaugucuguguguuugaga

SEQ ID NO: 107630 - RNA, 21 nt, Human
cucauuucaggagcagccuca

SEQ ID NO: 107631 - RNA, 22 nt, Human
gaauguucauacugauguguug

SEQ ID NO: 107632 - RNA, 19 nt, Human
uugacaucuucagcuucca

SEQ ID NO: 107633 - RNA, 19 nt, Human
acaccccaggagggugagu

SEQ ID NO: 107634 - RNA, 24 nt, Human
ggagcugucucagcaagaggagac

SEQ ID NO: 107635 - RNA, 27 nt, Human
gagucuccugcccucccugccaccugg

SEQ ID NO: 107636 - RNA, 20 nt, Human
ucaccauuuguucaugcuuc

SEQ ID NO: 107637 - RNA, 19 nt, Human
gccuucuccuacuuaggga

SEQ ID NO: 107638 - RNA, 17 nt, Human
cagccuuucugucauca

SEQ ID NO: 107639 - RNA, 19 nt, Human
cuaggcuugcgugcugcua

SEQ ID NO: 107640 - RNA, 26 nt, Human
cuaagcccccugcucucuucugagcc

SEQ ID NO: 107641 - RNA, 20 nt, Human
ucccugcagucaucucuuug

SEQ ID NO: 107642 - RNA, 23 nt, Human
gcuuuauuuuuccacaucaugcu

SEQ ID NO: 107643 - RNA, 26 nt, Human
guaaauuuguauccacacaaauucag

SEQ ID NO: 107644 - RNA, 27 nt, Human
ucugcuccgcccucccugcuccccaua

SEQ ID NO: 107645 - RNA, 23 nt, Human
gccauuucuccuuuccuuccucc

SEQ ID NO: 107646 - RNA, 20 nt, Human
gggagagagaaaaagcugag

SEQ ID NO: 107647 - RNA, 24 nt, Human
cugccgggaaccucaucugccugg

SEQ ID NO: 107648 - RNA, 22 nt, Human
gccucucuggcaaggcuuucuu

SEQ ID NO: 107649 - RNA, 21 nt, Human
guggggacagagaugggugau

SEQ ID NO: 107650 - RNA, 22 nt, Human
uggaucuugagucccauuagcu

SEQ ID NO: 107651 - RNA, 23 nt, Human
ccagauuguggggugcagcuggg

SEQ ID NO: 107652 - RNA, 17 nt, Human
gcccuucuccccggguc

SEQ ID NO: 107653 - RNA, 20 nt, Human
cacccaggcuggaguacaau

SEQ ID NO: 107654 - RNA, 25 nt, Human
agccaaaaaugaaugcuaacuccuu

SEQ ID NO: 107655 - RNA, 23 nt, Human
augggcccuaggggucacuguac

SEQ ID NO: 107656 - RNA, 21 nt, Human
agagcaguuacagcccuccuu

SEQ ID NO: 107657 - RNA, 22 nt, Human
uggaugguuuguuguucugccu

SEQ ID NO: 107658 - RNA, 19 nt, Human
ggauccugaacuggaagaa

SEQ ID NO: 107659 - RNA, 21 nt, Human
uuccuggucuagggcugugag

SEQ ID NO: 107660 - RNA, 21 nt, Human
ccaucagcagagccaccaaga

SEQ ID NO: 107661 - RNA, 24 nt, Human
agcauauuuuauguaccaugguua

SEQ ID NO: 107662 - RNA, 23 nt, Human
ccuacuucucugucgcccgcggu

SEQ ID NO: 107663 - RNA, 19 nt, Human
gguucagacacagcucuuc

SEQ ID NO: 107664 - RNA, 22 nt, Human
gccgcugcaaggggaggagagc

SEQ ID NO: 107665 - RNA, 27 nt, Human
cccugcaggaagcuaaagggccuuuca

SEQ ID NO: 107666 - RNA, 26 nt, Human
gcccuuuaacucuauuuggcuaucug

SEQ ID NO: 107667 - RNA, 22 nt, Human
cgggaggugggaguuguaguga

SEQ ID NO: 107668 - RNA, 26 nt, Human
ccgacugcuguccggcuccugugcca

SEQ ID NO: 107669 - RNA, 22 nt, Human
agacuggagcagcgaacaggag

SEQ ID NO: 107670 - RNA, 21 nt, Human
caugcgccacguccugggugg

SEQ ID NO: 107671 - RNA, 25 nt, Human
ccacuucuuccaagggacagcgauc

SEQ ID NO: 107672 - RNA, 20 nt, Human
auagggucuucagcuauuaa

SEQ ID NO: 107673 - RNA, 26 nt, Human
aacagcccacuguuaggagguaguag

SEQ ID NO: 107674 - RNA, 21 nt, Human
uuggcugcugcuguuuucuuc

SEQ ID NO: 107675 - RNA, 22 nt, Human
ccagugcugcugacuucacccc

SEQ ID NO: 107676 - RNA, 27 nt, Human
caggcuggaguacaguggugccaucau

SEQ ID NO: 107677 - RNA, 26 nt, Human
aguuugagacaggagaccuggcacug

SEQ ID NO: 107678 - RNA, 26 nt, Human
ggccccggaaggcccuguggucaugu

SEQ ID NO: 107679 - RNA, 23 nt, Human
gugaaggacuacagaaucaccuc

SEQ ID NO: 107680 - RNA, 21 nt, Human
uccugucucucuggcugaugu

SEQ ID NO: 107681 - RNA, 27 nt, Human
uggguuucaucaucagguaccuccucc

SEQ ID NO: 107682 - RNA, 23 nt, Human
cucugccccacugccagccugag

SEQ ID NO: 107683 - RNA, 20 nt, Human
ccagucaggggaauccccuu

SEQ ID NO: 107684 - RNA, 22 nt, Human
uauuucagugaacugcuggaac

SEQ ID NO: 107685 - RNA, 21 nt, Human
gggagagaaggaggccgccag

SEQ ID NO: 107686 - RNA, 20 nt, Human
uucaggagcuguuguaggag

SEQ ID NO: 107687 - RNA, 24 nt, Human
cuuguccaguuccucacacacuuc

SEQ ID NO: 107688 - RNA, 15 nt, Human
cuucccuuucggccu

SEQ ID NO: 107689 - RNA, 24 nt, Human
cccugcucugcccaggcaaggaac

SEQ ID NO: 107690 - RNA, 27 nt, Human
cagaaggcaagcaccaggcucacagcu

SEQ ID NO: 107691 - RNA, 24 nt, Human
uauagcugaucaguuuuuucaccu

SEQ ID NO: 107692 - RNA, 25 nt, Human
ucuugcagaagaaguaagugaggaa

SEQ ID NO: 107693 - RNA, 27 nt, Human
uguguuuuuaauauucacacugagaca

SEQ ID NO: 107694 - RNA, 22 nt, Human
guuuuuaaauaagcauuaacua

SEQ ID NO: 107695 - RNA, 23 nt, Human
ucuguuugcugccuuccuggcca

SEQ ID NO: 107696 - RNA, 18 nt, Human
agcagucaccugacgucc

SEQ ID NO: 107697 - RNA, 23 nt, Human
ggcuggccgcagccacuguagcu

SEQ ID NO: 107698 - RNA, 20 nt, Human
aggagagagaaaauggcuga

SEQ ID NO: 107699 - RNA, 20 nt, Human
cccagcacugugaagaccca

SEQ ID NO: 107700 - RNA, 22 nt, Human
auuaggauugcaaaccaaggaa

SEQ ID NO: 107701 - RNA, 19 nt, Human
cugggaggcaggcgcagug

SEQ ID NO: 107702 - RNA, 27 nt, Human
aagagagagucaaagccggauguccca

SEQ ID NO: 107703 - RNA, 23 nt, Human
agcaccuggaaguggagugcagg

SEQ ID NO: 107704 - RNA, 22 nt, Human
cccggguggcugggauugcagg

SEQ ID NO: 107705 - RNA, 22 nt, Human
ggagguggggguugcuguugau

SEQ ID NO: 107706 - RNA, 21 nt, Human
ggcagagggaggagggaaggc

SEQ ID NO: 107707 - RNA, 22 nt, Human
cagggugggcaaacucucuaaa

SEQ ID NO: 107708 - RNA, 20 nt, Human
uucauuucuugccuuucauu

SEQ ID NO: 107709 - RNA, 22 nt, Human
gcucacuguaaccuccgccucc

SEQ ID NO: 107710 - RNA, 27 nt, Human
ugaacccguccauucagaaagcuucaa

SEQ ID NO: 107711 - RNA, 27 nt, Human
gguuucaaacuccugacuuugugaucc

SEQ ID NO: 107712 - RNA, 23 nt, Human
ugccaggacuggacaugggggga

SEQ ID NO: 107713 - RNA, 22 nt, Human
aggaaauaacccaguucugcac

SEQ ID NO: 107714 - RNA, 21 nt, Human
agcaagguugggugcuucauu

SEQ ID NO: 107715 - RNA, 26 nt, Human
caguguacuuaaaauuuuacaguuau

SEQ ID NO: 107716 - RNA, 21 nt, Human
cuucccguguguauuucuaag

SEQ ID NO: 107717 - RNA, 27 nt, Human
cauuggugacucacuucaaugugucau

SEQ ID NO: 107718 - RNA, 21 nt, Human
agagagcaaucaguguucuca

SEQ ID NO: 107719 - RNA, 23 nt, Human
cuguagcuucaguuauuggugag

SEQ ID NO: 107720 - RNA, 22 nt, Human
uugcaccuuucucuuuuucucu

SEQ ID NO: 107721 - RNA, 21 nt, Human
cuaugguuuugagagcacuuu

SEQ ID NO: 107722 - RNA, 24 nt, Human
uugaguauuauaagauagcuuaca

SEQ ID NO: 107723 - RNA, 18 nt, Human
caucauccucaucauguu

SEQ ID NO: 107724 - RNA, 26 nt, Human
caucacaguaaauauggcucaggcaa

SEQ ID NO: 107725 - RNA, 31 nt, Human
ggguucaagaucacugggaccaggccgugau

SEQ ID NO: 107726 - RNA, 24 nt, Human
acucccuugaggauggagagcagc

SEQ ID NO: 107727 - RNA, 20 nt, Human
aaaagagaauaauuuggccu

SEQ ID NO: 107728 - RNA, 31 nt, Human
uguauaguaauuauccagugccagaaaaacc

SEQ ID NO: 107729 - RNA, 23 nt, Human
gcuuccuccaagcugcugccucc

SEQ ID NO: 107730 - RNA, 27 nt, Human
cuucccucccuuccuucaagauaacug

SEQ ID NO: 107731 - RNA, 22 nt, Human
agaagcagauaaugguguuuuu

SEQ ID NO: 107732 - RNA, 26 nt, Human
aagacuccgacuccagcucugacuuu

SEQ ID NO: 107733 - RNA, 22 nt, Human
ccugcagcggcccccgccgguc

SEQ ID NO: 107734 - RNA, 21 nt, Human
ggcaaagcucuuccauuuuga

SEQ ID NO: 107735 - RNA, 21 nt, Human
cgccaaguuggagugcaaugg

SEQ ID NO: 107736 - RNA, 26 nt, Human
cagacaccuggcagcccugccucaua

SEQ ID NO: 107737 - RNA, 22 nt, Human
uguuugaagcuguuauuugcag

SEQ ID NO: 107738 - RNA, 20 nt, Human
uguuuucugacaguagccuc

SEQ ID NO: 107739 - RNA, 22 nt, Human
uacgccuauaaucccagcauuu

SEQ ID NO: 107740 - RNA, 22 nt, Human
uuaacagcaaacucuuucgcca

SEQ ID NO: 107741 - RNA, 24 nt, Human
ggaggcugaggcagcauugcuuga

SEQ ID NO: 107742 - RNA, 20 nt, Human
aaccugacauuccaggccca

SEQ ID NO: 107743 - RNA, 27 nt, Human
cccuaaccuuggaggcccgggagugga

SEQ ID NO: 107744 - RNA, 22 nt, Human
cacaggcugggauggagcacuu

SEQ ID NO: 107745 - RNA, 28 nt, Human
ggggcagcuguggccuaggcuaccucaa

SEQ ID NO: 107746 - RNA, 25 nt, Human
gcccacgccacauggacacagcccu

SEQ ID NO: 107747 - RNA, 22 nt, Human
uuagcugacagugguacugauu

SEQ ID NO: 107748 - RNA, 31 nt, Human
cugucccucucaggcaugccugugugacauc

SEQ ID NO: 107749 - RNA, 25 nt, Human
accaagaaggaggaggaauauggaa

SEQ ID NO: 107750 - RNA, 26 nt, Human
ccuccaccuccuggguucaagcgauu

SEQ ID NO: 107751 - RNA, 23 nt, Human
ucccauuccuccacucuguaucu

SEQ ID NO: 107752 - RNA, 24 nt, Human
aggcagcagcggcggcggcagugg

SEQ ID NO: 107753 - RNA, 26 nt, Human
ggucaucucaguuucuuuucucaccu

SEQ ID NO: 107754 - RNA, 22 nt, Human
gcuaacaugcaaccauuccuca

SEQ ID NO: 107755 - RNA, 21 nt, Human
ccaccauggagguugcaaugg

SEQ ID NO: 107756 - RNA, 19 nt, Human
ucaauucugauacagccuu

SEQ ID NO: 107757 - RNA, 20 nt, Human
cuuuccagcuccacuucaaa

SEQ ID NO: 107758 - RNA, 26 nt, Human
accggcgcggucauccagcacaguga

SEQ ID NO: 107759 - RNA, 22 nt, Human
gauauuuccauggaaaugucag

SEQ ID NO: 107760 - RNA, 19 nt, Human
agggagaccuggcagugga

SEQ ID NO: 107761 - RNA, 21 nt, Human
ccaacagcauuggccuggcca

SEQ ID NO: 107762 - RNA, 23 nt, Human
cuaauuccuguguuuaauagcau

SEQ ID NO: 107763 - RNA, 17 nt, Human
acuaucuccccgccacc

SEQ ID NO: 107764 - RNA, 23 nt, Human
gcuagcacaaaauauugucgcua

SEQ ID NO: 107765 - RNA, 22 nt, Human
ccaggaggcagcuguugcagug

SEQ ID NO: 107766 - RNA, 28 nt, Human
gucuaccagauaaaccaaaacugggaag

SEQ ID NO: 107767 - RNA, 27 nt, Human
ugccuguaauccagcuacucaggaggc

SEQ ID NO: 107768 - RNA, 24 nt, Human
cacguggagaagcugcagcucugg

SEQ ID NO: 107769 - RNA, 22 nt, Human
gguccaucuccagacucuacca

SEQ ID NO: 107770 - RNA, 23 nt, Human
ccugcaacaacagcccucuagcc

SEQ ID NO: 107771 - RNA, 22 nt, Human
auucuauuuauaauacagaauc

SEQ ID NO: 107772 - RNA, 22 nt, Human
gugggaagagaggaggccaggc

SEQ ID NO: 107773 - RNA, 25 nt, Human
ccccugagggacgguuuugcuuuau

SEQ ID NO: 107774 - RNA, 24 nt, Human
aggacuccacagaauggagcaaga

SEQ ID NO: 107775 - RNA, 22 nt, Human
aucuacaaucaguugacuuuaa

SEQ ID NO: 107776 - RNA, 23 nt, Human
cacagccgagacgacguguccag

SEQ ID NO: 107777 - RNA, 19 nt, Human
acaaagaguuuauaaacac

SEQ ID NO: 107778 - RNA, 20 nt, Human
cucaccugguccuguuguuu

SEQ ID NO: 107779 - RNA, 22 nt, Human
acgggcaccagccgucaucucc

SEQ ID NO: 107780 - RNA, 29 nt, Human
uccaucucacauacaggaaaccuuacgag

SEQ ID NO: 107781 - RNA, 21 nt, Human
ggagggcugagcccugugaca

SEQ ID NO: 107782 - RNA, 20 nt, Human
gauggacuggaggagcgcag

SEQ ID NO: 107783 - RNA, 18 nt, Human
ugagggagagagagccag

SEQ ID NO: 107784 - RNA, 22 nt, Human
ucuuguagcaagccucagacuc

SEQ ID NO: 107785 - RNA, 25 nt, Human
gcccaagacuauguccugacauaua

SEQ ID NO: 107786 - RNA, 24 nt, Human
cccucagccugcaaccucuauccu

SEQ ID NO: 107787 - RNA, 20 nt, Human
ugucuucugaguguuggagc

SEQ ID NO: 107788 - RNA, 27 nt, Human
aggccaucagcagcuagagguggcugg

SEQ ID NO: 107789 - RNA, 19 nt, Human
aggaaggaggaaugcuuga

SEQ ID NO: 107790 - RNA, 27 nt, Human
agcccacugcaacugcuaggacugaaa

SEQ ID NO: 107791 - RNA, 20 nt, Human
ugauugccagaggcuuuuca

SEQ ID NO: 107792 - RNA, 22 nt, Human
ccuucucugcugguacccaguc

SEQ ID NO: 107793 - RNA, 23 nt, Human
cccaguccugaagccccugcagu

SEQ ID NO: 107794 - RNA, 21 nt, Human
uguagccccagucauccugcc

SEQ ID NO: 107795 - RNA, 26 nt, Human
guauuuuucuccugugaaaccugaau

SEQ ID NO: 107796 - RNA, 21 nt, Human
ggcggugaggagggcagcugg

SEQ ID NO: 107797 - RNA, 27 nt, Human
ucagaaacaaaucucagaagacaagcu

SEQ ID NO: 107798 - RNA, 27 nt, Human
uacuaccuuguuuuccuaaugccagaa

SEQ ID NO: 107799 - RNA, 22 nt, Human
cuuuuuaaauuaugauuuccug

SEQ ID NO: 107800 - RNA, 26 nt, Human
ccuucccagcccagccucuuggggcu

SEQ ID NO: 107801 - RNA, 23 nt, Human
uuccaauuuuguugcaucauguu

SEQ ID NO: 107802 - RNA, 21 nt, Human
cugagcaggaagcagcagcug

SEQ ID NO: 107803 - RNA, 23 nt, Human
uccuaacaguuauuuccccgggu

SEQ ID NO: 107804 - RNA, 24 nt, Human
cuaagaaugaacaaauaugugaaa

SEQ ID NO: 107805 - RNA, 25 nt, Human
cuggagaagagaggagacaugucag

SEQ ID NO: 107806 - RNA, 22 nt, Human
uuuuugggggaaggggcauaug

SEQ ID NO: 107807 - RNA, 25 nt, Human
ccagucuuccucuuagccucuggau

SEQ ID NO: 107808 - RNA, 20 nt, Human
uccuaaggaggagauuggac

SEQ ID NO: 107809 - RNA, 18 nt, Human
ugucuuucuuucccugac

SEQ ID NO: 107810 - RNA, 21 nt, Human
uaaagaauuuuuggaucaagc

SEQ ID NO: 107811 - RNA, 19 nt, Human
ugaccccagagcucugugu

SEQ ID NO: 107812 - RNA, 23 nt, Human
uguaaccucugccucccaggcuc

SEQ ID NO: 107813 - RNA, 28 nt, Human
ucagaagcacccaggacuuccauuugcu

SEQ ID NO: 107814 - RNA, 20 nt, Human
uucccuggaaucaacuugua

SEQ ID NO: 107815 - RNA, 23 nt, Human
acuguucuugacuaaauuuucaa

SEQ ID NO: 107816 - RNA, 28 nt, Human
ccugggaaguuggagcaagaggggcaua

SEQ ID NO: 107817 - RNA, 27 nt, Human
ggucucgaacucugaccuugugaucca

SEQ ID NO: 107818 - RNA, 27 nt, Human
aacugauugcaacagacuguugaguua

SEQ ID NO: 107819 - RNA, 22 nt, Human
ugcagaggaaaggugggagaga

SEQ ID NO: 107820 - RNA, 22 nt, Human
ugcaaccuccgacucccugguu

SEQ ID NO: 107821 - RNA, 21 nt, Human
gaccaacaugaaaguacguca

SEQ ID NO: 107822 - RNA, 21 nt, Human
gaucagaaaucugacuagauu

SEQ ID NO: 107823 - RNA, 28 nt, Human
aacuugaagcuuucuugccugcagugaa

SEQ ID NO: 107824 - RNA, 23 nt, Human
gcgguggcugccccggccuccuc

SEQ ID NO: 107825 - RNA, 23 nt, Human
aggguccaguggaugccacagcc

SEQ ID NO: 107826 - RNA, 24 nt, Human
ccugucacuccccaccccugccgg

SEQ ID NO: 107827 - RNA, 26 nt, Human
gauguuguuuuccuauggaaauauau

SEQ ID NO: 107828 - RNA, 20 nt, Human
ugcaggggaaagagcaguga

SEQ ID NO: 107829 - RNA, 18 nt, Human
ccacaugaggccaucuca

SEQ ID NO: 107830 - RNA, 19 nt, Human
ggcugcugcuggucugacu

SEQ ID NO: 107831 - RNA, 27 nt, Human
ggaggcugaggcuggagaaucgcuuga

SEQ ID NO: 107832 - RNA, 26 nt, Human
ccucaaacuccuggacucaugcaauc

SEQ ID NO: 107833 - RNA, 25 nt, Human
gcccuugccaacuuuuacccuccca

SEQ ID NO: 107834 - RNA, 23 nt, Human
uuaccuccaccuuccugcacuca

SEQ ID NO: 107835 - RNA, 22 nt, Human
uacuuaaaaauuuauuagcccu

SEQ ID NO: 107836 - RNA, 26 nt, Human
ucuccccucguccugcgucccggacc

SEQ ID NO: 107837 - RNA, 21 nt, Human
caaguggcaaaagccugaaga

SEQ ID NO: 107838 - RNA, 21 nt, Human
ugggcacagggccucuuuggg

SEQ ID NO: 107839 - RNA, 21 nt, Human
guguagcuguugagaggugga

SEQ ID NO: 107840 - RNA, 21 nt, Human
augggaaaggugauaccagcu

SEQ ID NO: 107841 - RNA, 25 nt, Human
ccugcagcuccaaucugauucugcu

SEQ ID NO: 107842 - RNA, 26 nt, Human
ugcccagguugguuuccccugcacuc

SEQ ID NO: 107843 - RNA, 22 nt, Human
ugagacucugggaaguuaaaug

SEQ ID NO: 107844 - RNA, 21 nt, Human
cuaaugaucagucacucacua

SEQ ID NO: 107845 - RNA, 23 nt, Human
acuucuauuuccagaagugacag

SEQ ID NO: 107846 - RNA, 23 nt, Human
aauguagaaagcccuucaagugg

SEQ ID NO: 107847 - RNA, 24 nt, Human
ggcuuaagcagucuucccaccuca

SEQ ID NO: 107848 - RNA, 24 nt, Human
gcugccucucugcuccaccuugug

SEQ ID NO: 107849 - RNA, 24 nt, Human
ggugacucacgccuauaaucccag

SEQ ID NO: 107850 - RNA, 21 nt, Human
acuugccuucucccugggcag

SEQ ID NO: 107851 - RNA, 22 nt, Human
uuauguuuguccgauggagauu

SEQ ID NO: 107852 - RNA, 24 nt, Human
ugaacuccauggccccaaagcacc

SEQ ID NO: 107853 - RNA, 27 nt, Human
ccgggaggcagguuggaaggcaggcac

SEQ ID NO: 107854 - RNA, 23 nt, Human
caguggugccaucauugcugucu

SEQ ID NO: 107855 - RNA, 22 nt, Human
ggaagaccugcugagggaccag

SEQ ID NO: 107856 - RNA, 22 nt, Human
ccaagaagcggaaaacuaccua

SEQ ID NO: 107857 - RNA, 23 nt, Human
guugcccaagcuggagugaagug

SEQ ID NO: 107858 - RNA, 20 nt, Human
cuggacacccucaugugcca

SEQ ID NO: 107859 - RNA, 21 nt, Human
ggcagggggcgaagugcagug

SEQ ID NO: 107860 - RNA, 22 nt, Human
cucuucucuaaaugcuuccuca

SEQ ID NO: 107861 - RNA, 20 nt, Human
gucacaguccagcaauucca

SEQ ID NO: 107862 - RNA, 24 nt, Human
aggggccuuggaguugugacugcc

SEQ ID NO: 107863 - RNA, 27 nt, Human
gucgcccaggcugguuuugaacuccug

SEQ ID NO: 107864 - RNA, 27 nt, Human
uggaaggcagacagcaggcagcgccaa

SEQ ID NO: 107865 - RNA, 24 nt, Human
gguugcaaacuggcaaccuguggu

SEQ ID NO: 107866 - RNA, 22 nt, Human
agucacuccugagaauccacag

SEQ ID NO: 107867 - RNA, 21 nt, Human
cacucacaauauucucucuca

SEQ ID NO: 107868 - RNA, 27 nt, Human
aaugccauauauaaauucuaagccaua

SEQ ID NO: 107869 - RNA, 22 nt, Human
ucagaagcaucugcugucauga

SEQ ID NO: 107870 - RNA, 29 nt, Human
gcacugcagagauuucaucauggucuccc

SEQ ID NO: 107871 - RNA, 29 nt, Human
cuucugagguggccuccugcccugaucag

SEQ ID NO: 107872 - RNA, 26 nt, Human
ugagcagagaucacaacauugcacuu

SEQ ID NO: 107873 - RNA, 21 nt, Human
ccucauugccuccuguucugc

SEQ ID NO: 107874 - RNA, 18 nt, Human
agagacacaccugcucca

SEQ ID NO: 107875 - RNA, 20 nt, Human
cagauuuauuccuuuguuac

SEQ ID NO: 107876 - RNA, 27 nt, Human
ccccugccuggguucugucccagcucc

SEQ ID NO: 107877 - RNA, 19 nt, Human
ccagcacuucaggaggccg

SEQ ID NO: 107878 - RNA, 20 nt, Human
ccgcaggcuccugaagacug

SEQ ID NO: 107879 - RNA, 26 nt, Human
ucacccuccaggcugcugugagagug

SEQ ID NO: 107880 - RNA, 18 nt, Human
ucuguugccuccucucuc

SEQ ID NO: 107881 - RNA, 22 nt, Human
agccuaggaguacaguggagca

SEQ ID NO: 107882 - RNA, 22 nt, Human
cuucugcuuccacgguccuguu

SEQ ID NO: 107883 - RNA, 24 nt, Human
cugauucuaucacauuguaagaug

SEQ ID NO: 107884 - RNA, 25 nt, Human
ccuccaucaucuagacuugauuuua

SEQ ID NO: 107885 - RNA, 23 nt, Human
uuucaaaagacuaucauagcuuu

SEQ ID NO: 107886 - RNA, 20 nt, Human
agaacucccauuacaacuga

SEQ ID NO: 107887 - RNA, 27 nt, Human
gguguauuccuggaaggcaaggugcua

SEQ ID NO: 107888 - RNA, 20 nt, Human
acaggcaaccuacagaaugg

SEQ ID NO: 107889 - RNA, 27 nt, Human
uggccaacauacugaaaccccgucucu

SEQ ID NO: 107890 - RNA, 22 nt, Human
ggccccacuccccgagguugcc

SEQ ID NO: 107891 - RNA, 23 nt, Human
uccagcugagugagaggguuuga

SEQ ID NO: 107892 - RNA, 18 nt, Human
augauguaauucccacug

SEQ ID NO: 107893 - RNA, 21 nt, Human
aagccuccgcuauaaauugaa

SEQ ID NO: 107894 - RNA, 27 nt, Human
ucauuucucaucuuuuuacuaaacuca

SEQ ID NO: 107895 - RNA, 23 nt, Human
gcugggaggagagcagccucugg

SEQ ID NO: 107896 - RNA, 25 nt, Human
agcggaaccugcggggcagaggcgg

SEQ ID NO: 107897 - RNA, 21 nt, Human
ucucuccauaugcagccuuuc

SEQ ID NO: 107898 - RNA, 21 nt, Human
aaaagaagaaauaguucugug

SEQ ID NO: 107899 - RNA, 23 nt, Human
cagcaucugcuaauguuuuuguu

SEQ ID NO: 107900 - RNA, 23 nt, Human
auuugccuucaucuuccauauac

SEQ ID NO: 107901 - RNA, 22 nt, Human
uuuuuccauguuuauuguguua

SEQ ID NO: 107902 - RNA, 23 nt, Human
ggcagcuuucacuuugacuauga

SEQ ID NO: 107903 - RNA, 21 nt, Human
cugcccauacaccugucuccu

SEQ ID NO: 107904 - RNA, 30 nt, Human
aaguacugggaaggaagagaguuucacaga

SEQ ID NO: 107905 - RNA, 18 nt, Human
uacaacaacauguaccug

SEQ ID NO: 107906 - RNA, 24 nt, Human
aguguucuaguuccuggaauuagu

SEQ ID NO: 107907 - RNA, 21 nt, Human
gggcuucuguggacagcagau

SEQ ID NO: 107908 - RNA, 21 nt, Human
ccaauacaaaauaacaaaaau

SEQ ID NO: 107909 - RNA, 20 nt, Human
ugcacucauagggugcucug

SEQ ID NO: 107910 - RNA, 27 nt, Human
cacugcacuccagccucagcaauagag

SEQ ID NO: 107911 - RNA, 21 nt, Human
ugugccagagaguggcugguu

SEQ ID NO: 107912 - RNA, 20 nt, Human
cucuuagggcuuagcuauuu

SEQ ID NO: 107913 - RNA, 28 nt, Human
cagccacaccugccccugcucuggggcc

SEQ ID NO: 107914 - RNA, 23 nt, Human
cgggguuuugucauguugcucgg

SEQ ID NO: 107915 - RNA, 25 nt, Human
cuuggggugcugaucucgaguguua

SEQ ID NO: 107916 - RNA, 21 nt, Human
ugguuuucgucaucuucccug

SEQ ID NO: 107917 - RNA, 22 nt, Human
acucuccaggcuggagugcagu

SEQ ID NO: 107918 - RNA, 23 nt, Human
gguguggcaguuacagggcccag

SEQ ID NO: 107919 - RNA, 21 nt, Human
gaagcucugggccucggcuuu

SEQ ID NO: 107920 - RNA, 27 nt, Human
cccuccuggcuccugggcugggacaag

SEQ ID NO: 107921 - RNA, 24 nt, Human
gucaucucucaccuggacugcugu

SEQ ID NO: 107922 - RNA, 23 nt, Human
auucaauucaaagcuguguguuu

SEQ ID NO: 107923 - RNA, 20 nt, Human
ggaacccuggcgucucucca

SEQ ID NO: 107924 - RNA, 22 nt, Human
gaaccugaagaacuauuuuucg

SEQ ID NO: 107925 - RNA, 22 nt, Human
auugcuuaggagaaaccauugu

SEQ ID NO: 107926 - RNA, 23 nt, Human
guugcccaggcuggagugcggug

SEQ ID NO: 107927 - RNA, 23 nt, Human
guuacccaggcuggagugcagug

SEQ ID NO: 107928 - RNA, 23 nt, Human
gucacccaggcuggaguguagug

SEQ ID NO: 107929 - RNA, 23 nt, Human
gucacccagguuggagugcagug

SEQ ID NO: 107930 - RNA, 23 nt, Human
accagcaaacagcacaaggcgug

SEQ ID NO: 107931 - RNA, 24 nt, Human
gcauucuuauagaaacaaagcaca

SEQ ID NO: 107932 - RNA, 18 nt, Human
ccacagucagccauggca

SEQ ID NO: 107933 - RNA, 19 nt, Human
acucgaagaaaggcagaag

SEQ ID NO: 107934 - RNA, 20 nt, Human
cucagaagcaggaaacccuc

SEQ ID NO: 107935 - RNA, 22 nt, Human
gggaggcuggaguuggggcaga

SEQ ID NO: 107936 - RNA, 27 nt, Human
uccaacaauaaacaggaauuuuauuuu

SEQ ID NO: 107937 - RNA, 22 nt, Human
auugcccaggcuggaguacaau

SEQ ID NO: 107938 - RNA, 19 nt, Human
uugcccugccugccaggaa

SEQ ID NO: 107939 - RNA, 19 nt, Human
gggacugagaaaccagagu

SEQ ID NO: 107940 - RNA, 23 nt, Human
ucuguccuacuuacagcacuuug

SEQ ID NO: 107941 - RNA, 20 nt, Human
agggccaggaaagaugugaa

SEQ ID NO: 107942 - RNA, 18 nt, Human
acuuucucccccucugcc

SEQ ID NO: 107943 - RNA, 24 nt, Human
ggcauggguggaauuagaguggaa

SEQ ID NO: 107944 - RNA, 24 nt, Human
cuuccacugcaaauuucaaaagcc

SEQ ID NO: 107945 - RNA, 26 nt, Human
ggacucaggcuggaggcagauagaca

SEQ ID NO: 107946 - RNA, 21 nt, Human
ccagcugcugcucuccucgac

SEQ ID NO: 107947 - RNA, 20 nt, Human
gguggggaugggaggggaga

SEQ ID NO: 107948 - RNA, 21 nt, Human
agaaaguacucccucaguaaa

SEQ ID NO: 107949 - RNA, 21 nt, Human
gggucacugcaaacuccgccu

SEQ ID NO: 107950 - RNA, 25 nt, Human
cuaguaugguguucuguuuucagcu

SEQ ID NO: 107951 - RNA, 21 nt, Human
gcagugagccaauaucgugcc

SEQ ID NO: 107952 - RNA, 23 nt, Human
caggcugucgaagcauuggugcc

SEQ ID NO: 107953 - RNA, 18 nt, Human
acccaggcugugaccuca

SEQ ID NO: 107954 - RNA, 24 nt, Human
auguuccaguggaugagggccacc

SEQ ID NO: 107955 - RNA, 27 nt, Human
gauucacugcaggacuaccagagagaa

SEQ ID NO: 107956 - RNA, 22 nt, Human
gaagaaagaagaaagguguuug

SEQ ID NO: 107957 - RNA, 23 nt, Human
gccaguucccagcaggcauauaa

SEQ ID NO: 107958 - RNA, 21 nt, Human
cagcacugaaucccagcgcug

SEQ ID NO: 107959 - RNA, 19 nt, Human
ucaacuaucgggggagaaa

SEQ ID NO: 107960 - RNA, 21 nt, Human
ccccggcagugagcuauggac

SEQ ID NO: 107961 - RNA, 24 nt, Human
ccagcuucugucugucucacuguc

SEQ ID NO: 107962 - RNA, 24 nt, Human
aggucugcaagaaccugacucguc

SEQ ID NO: 107963 - RNA, 20 nt, Human
gguguucuccuccuauucag

SEQ ID NO: 107964 - RNA, 27 nt, Human
auucuuucugcuauauuaggccugugu

SEQ ID NO: 107965 - RNA, 21 nt, Human
uuucauuaaaugcagcacuug

SEQ ID NO: 107966 - RNA, 23 nt, Human
auuucaucuucucccuccaucca

SEQ ID NO: 107967 - RNA, 27 nt, Human
uguuuuuaagcaaagguauuuuugaag

SEQ ID NO: 107968 - RNA, 27 nt, Human
ugcccugcuugcaaauccacuagcacc

SEQ ID NO: 107969 - RNA, 28 nt, Human
ucucuaaaauaugaaaucagaguuugga

SEQ ID NO: 107970 - RNA, 19 nt, Human
acugacacaagccaccgcc

SEQ ID NO: 107971 - RNA, 21 nt, Human
gugaccagcagacagugagcu

SEQ ID NO: 107972 - RNA, 28 nt, Human
ggcccuguaauucucucucauuuacucu

SEQ ID NO: 107973 - RNA, 25 nt, Human
aggacgcuauaaaagacugucguag

SEQ ID NO: 107974 - RNA, 19 nt, Human
ucaauauugcuuuaaucac

SEQ ID NO: 107975 - RNA, 26 nt, Human
uuuaaaaaauauauaugcauaccugg

SEQ ID NO: 107976 - RNA, 28 nt, Human
ucucgaacuccugaccucaggugaucac

SEQ ID NO: 107977 - RNA, 25 nt, Human
ugagauacuuucaaaagacaaccaa

SEQ ID NO: 107978 - RNA, 24 nt, Human
caucaucuuaacuaacauucugaa

SEQ ID NO: 107979 - RNA, 18 nt, Human
auguauaaaaugggccua

SEQ ID NO: 107980 - RNA, 25 nt, Human
agguguucaaggccagccugggcaa

SEQ ID NO: 107981 - RNA, 24 nt, Human
gggaaagagauggggcuguauaga

SEQ ID NO: 107982 - RNA, 19 nt, Human
cacccugaaggggagggag

SEQ ID NO: 107983 - RNA, 21 nt, Human
gaagaagccuguaaacucucu

SEQ ID NO: 107984 - RNA, 21 nt, Human
cugcccuuucaaagaauaacc

SEQ ID NO: 107985 - RNA, 23 nt, Human
accgguggaggagcuccaggaag

SEQ ID NO: 107986 - RNA, 22 nt, Human
gaccagccuggguaacauagug

SEQ ID NO: 107987 - RNA, 19 nt, Human
aaauuuaccuuucucucca

SEQ ID NO: 107988 - RNA, 26 nt, Human
cuggcaaggggugacugccucugagu

SEQ ID NO: 107989 - RNA, 20 nt, Human
gaacuccuggccucgugauc

SEQ ID NO: 107990 - RNA, 21 nt, Human
uuauuauauacagguugagua

SEQ ID NO: 107991 - RNA, 23 nt, Human
aucacacaccauccccacuguca

SEQ ID NO: 107992 - RNA, 21 nt, Human
uuuuuaguuuuuagcuuuugc

SEQ ID NO: 107993 - RNA, 22 nt, Human
cugggacuagggggaaguucgc

SEQ ID NO: 107994 - RNA, 22 nt, Human
ggcuuuaaucccagcacuuugg

SEQ ID NO: 107995 - RNA, 22 nt, Human
ggcgcugggcucggaccugcca

SEQ ID NO: 107996 - RNA, 22 nt, Human
ugcccaggcugaagugcagugg

SEQ ID NO: 107997 - RNA, 31 nt, Human
gggaagcguuugagacggagcuguggaggcu

SEQ ID NO: 107998 - RNA, 20 nt, Human
ccuguagugagcacuuugua

SEQ ID NO: 107999 - RNA, 26 nt, Human
cgugucacccuaggccugauaagcga

SEQ ID NO: 108000 - RNA, 25 nt, Human
ggccucggacuccccaagaaggcca

SEQ ID NO: 108001 - RNA, 27 nt, Human
agagcaucuguguguccugcagccucc

SEQ ID NO: 108002 - RNA, 21 nt, Human
gggaagggagagcggggcagu

SEQ ID NO: 108003 - RNA, 21 nt, Human
gcaucaccaacccacagccaa

SEQ ID NO: 108004 - RNA, 20 nt, Human
uuggagugcugcagcuuugg

SEQ ID NO: 108005 - RNA, 21 nt, Human
aauaagaaauagcuacaguga

SEQ ID NO: 108006 - RNA, 18 nt, Human
agaguccuugguacucug

SEQ ID NO: 108007 - RNA, 21 nt, Human
gaucuucccuugggcuuuuca

SEQ ID NO: 108008 - RNA, 21 nt, Human
aacauuuucaauacuguccca

SEQ ID NO: 108009 - RNA, 22 nt, Human
ugucuguuuuguuaaugcagcu

SEQ ID NO: 108010 - RNA, 23 nt, Human
uauuccccuccgcguccuacaca

SEQ ID NO: 108011 - RNA, 25 nt, Human
uccuacaguacaaucagcagucuag

SEQ ID NO: 108012 - RNA, 20 nt, Human
ucaagucccugaauggaagu

SEQ ID NO: 108013 - RNA, 21 nt, Human
cuucagcccaaccuccccagc

SEQ ID NO: 108014 - RNA, 22 nt, Human
aagagcaacaacaaacugcuua

SEQ ID NO: 108015 - RNA, 27 nt, Human
ugauuuucucacugaacuccaccgacc

SEQ ID NO: 108016 - RNA, 25 nt, Human
ucugcuccccagcaucuucuguuuc

SEQ ID NO: 108017 - RNA, 23 nt, Human
gugcucaauaaggcagugcagug

SEQ ID NO: 108018 - RNA, 22 nt, Human
cugggaaaacgauguccugaaa

SEQ ID NO: 108019 - RNA, 22 nt, Human
ccauuccucaaauccauuuuaa

SEQ ID NO: 108020 - RNA, 25 nt, Human
gcugggguccugggagguggucgcc

SEQ ID NO: 108021 - RNA, 22 nt, Human
aaaaccagauguuuuccaccaa

SEQ ID NO: 108022 - RNA, 26 nt, Human
cuguaaccuucuauuuucuauaauug

SEQ ID NO: 108023 - RNA, 20 nt, Human
uucucacguucacaccuggu

SEQ ID NO: 108024 - RNA, 20 nt, Human
cucucacugcccucugcacc

SEQ ID NO: 108025 - RNA, 21 nt, Human
ccucaccccucuggagggccg

SEQ ID NO: 108026 - RNA, 27 nt, Human
aggucugcagggagcagcuggccauuu

SEQ ID NO: 108027 - RNA, 20 nt, Human
ccccagguucuccuccccac

SEQ ID NO: 108028 - RNA, 21 nt, Human
uccagccugggcagcauagug

SEQ ID NO: 108029 - RNA, 25 nt, Human
ggugguuccugaugggaaaaggaca

SEQ ID NO: 108030 - RNA, 18 nt, Human
gaucuauccuuuacuuga

SEQ ID NO: 108031 - RNA, 19 nt, Human
uagccuuaccgcagccugc

SEQ ID NO: 108032 - RNA, 17 nt, Human
caguuucagaguucuca

SEQ ID NO: 108033 - RNA, 21 nt, Human
uggaggagggacaguuucugg

SEQ ID NO: 108034 - RNA, 22 nt, Human
gcccaggcuggaguguaguggu

SEQ ID NO: 108035 - RNA, 20 nt, Human
aaaacagaguauuucuggca

SEQ ID NO: 108036 - RNA, 27 nt, Human
ccuaucucuuccugucuaacuugggga

SEQ ID NO: 108037 - RNA, 21 nt, Human
uccgguagccgccccuccucc

SEQ ID NO: 108038 - RNA, 25 nt, Human
agaacuauguaaacaaaaaagcuuu

SEQ ID NO: 108039 - RNA, 29 nt, Human
cccucauguacuugcuauauugaggauga

SEQ ID NO: 108040 - RNA, 22 nt, Human
cccuaaccaucauacacuuggc

SEQ ID NO: 108041 - RNA, 22 nt, Human
cgggccaggaggaugagguugu

SEQ ID NO: 108042 - RNA, 19 nt, Human
cauacucugcuacuauguc

SEQ ID NO: 108043 - RNA, 21 nt, Human
uugcccaauaaaaacgcuaca

SEQ ID NO: 108044 - RNA, 27 nt, Human
aacuguacauuccuucuuccucccccu

SEQ ID NO: 108045 - RNA, 25 nt, Human
cuguggcuucccaagaacuggguac

SEQ ID NO: 108046 - RNA, 26 nt, Human
cucccagaguccuccccacaguuccu

SEQ ID NO: 108047 - RNA, 22 nt, Human
gacgcacaggcuggagugcagu

SEQ ID NO: 108048 - RNA, 23 nt, Human
cccaggggccggccuccucugcc

SEQ ID NO: 108049 - RNA, 26 nt, Human
ggaaacagcaaucuuccuuaauagca

SEQ ID NO: 108050 - RNA, 26 nt, Human
ugguucuagcuuggucucuguuggcc

SEQ ID NO: 108051 - RNA, 22 nt, Human
uuucccuuaaauaacacuuaga

SEQ ID NO: 108052 - RNA, 24 nt, Human
ugggugggacauauuucaaacuuc

SEQ ID NO: 108053 - RNA, 25 nt, Human
cauggggaacugucugcacagggug

SEQ ID NO: 108054 - RNA, 22 nt, Human
cugcaaccuccgccucccagau

SEQ ID NO: 108055 - RNA, 22 nt, Human
gcugggguuacaggcauuugcc

SEQ ID NO: 108056 - RNA, 21 nt, Human
gugacaggaaaaucuguagag

SEQ ID NO: 108057 - RNA, 23 nt, Human
gcagggccucuggcuggggccag

SEQ ID NO: 108058 - RNA, 19 nt, Human
cagagcagaggggcagcga

SEQ ID NO: 108059 - RNA, 23 nt, Human
cccacaaucuuaaggggcagcuu

SEQ ID NO: 108060 - RNA, 27 nt, Human
gguuucaucauguuggccagggugguc

SEQ ID NO: 108061 - RNA, 26 nt, Human
ggauguguuguucgccauuucugugu

SEQ ID NO: 108062 - RNA, 27 nt, Human
uccuuguuauccuuguuuccuuagcuu

SEQ ID NO: 108063 - RNA, 26 nt, Human
aaagaaugagcuauuacggcagcagc

SEQ ID NO: 108064 - RNA, 22 nt, Human
gcagggacuggagucaguugga

SEQ ID NO: 108065 - RNA, 23 nt, Human
ucugaagucucuucucucuuagg

SEQ ID NO: 108066 - RNA, 20 nt, Human
ccacacacaccuuagagucg

SEQ ID NO: 108067 - RNA, 21 nt, Human
acaacagccaggagcuuccug

SEQ ID NO: 108068 - RNA, 23 nt, Human
caggagguggagccggccgggug

SEQ ID NO: 108069 - RNA, 19 nt, Human
uucaaugccagugcugcuc

SEQ ID NO: 108070 - RNA, 23 nt, Human
gaggaaacucgaauccugaaaug

SEQ ID NO: 108071 - RNA, 23 nt, Human
ggcaaagucuacuggcgccucaa

SEQ ID NO: 108072 - RNA, 22 nt, Human
gccgucccucguuccauggccc

SEQ ID NO: 108073 - RNA, 24 nt, Human
ucucccucuuucauacccagggga

SEQ ID NO: 108074 - RNA, 26 nt, Human
caggcaggcuggggcucucugcagac

SEQ ID NO: 108075 - RNA, 22 nt, Human
ugaacaaaucacauucugucca

SEQ ID NO: 108076 - RNA, 25 nt, Human
cgguaucuagcccuuucucuguaaa

SEQ ID NO: 108077 - RNA, 18 nt, Human
cucuggaucugcucguca

SEQ ID NO: 108078 - RNA, 19 nt, Human
cugccucugcucucuuguc

SEQ ID NO: 108079 - RNA, 27 nt, Human
gagggcauugcuuacacggaugccuuc

SEQ ID NO: 108080 - RNA, 25 nt, Human
cuucccucuguucuuccugccucca

SEQ ID NO: 108081 - RNA, 19 nt, Human
gagcucccaccguuauugc

SEQ ID NO: 108082 - RNA, 20 nt, Human
cugccucagggccacacacu

SEQ ID NO: 108083 - RNA, 22 nt, Human
gagcacaagaggaagagagaga

SEQ ID NO: 108084 - RNA, 21 nt, Human
acuacacaacuugcuacuuuc

SEQ ID NO: 108085 - RNA, 24 nt, Human
ucacugucccacuaugggucucca

SEQ ID NO: 108086 - RNA, 20 nt, Human
acuacuuccuucccugccuc

SEQ ID NO: 108087 - RNA, 20 nt, Human
auagaaaagggccaagaaaa

SEQ ID NO: 108088 - RNA, 20 nt, Human
uuuuggcugugucucccuuc

SEQ ID NO: 108089 - RNA, 21 nt, Human
gagucccagguccuggccuga

SEQ ID NO: 108090 - RNA, 21 nt, Human
agucuacagaccacacucuag

SEQ ID NO: 108091 - RNA, 23 nt, Human
gcccugucagccacccucucuca

SEQ ID NO: 108092 - RNA, 21 nt, Human
uggucccaacuacucagccua

SEQ ID NO: 108093 - RNA, 22 nt, Human
acauuuuucuccucaguagcau

SEQ ID NO: 108094 - RNA, 20 nt, Human
ugaccuaugccuaccuucuc

SEQ ID NO: 108095 - RNA, 24 nt, Human
caggaggagaccagguugcagugg

SEQ ID NO: 108096 - RNA, 25 nt, Human
ggacucgggaucuucaggacgccug

SEQ ID NO: 108097 - RNA, 17 nt, Human
cuuucucugucauccca

SEQ ID NO: 108098 - RNA, 22 nt, Human
gggaggccaaucagcccccuga

SEQ ID NO: 108099 - RNA, 20 nt, Human
ggcuuuuucugauuuuuuga

SEQ ID NO: 108100 - RNA, 27 nt, Human
cagucucccagugucugacucucggau

SEQ ID NO: 108101 - RNA, 21 nt, Human
ugagguggagcuugcagugag

SEQ ID NO: 108102 - RNA, 26 nt, Human
cccagccugugguuacagugcagaca

SEQ ID NO: 108103 - RNA, 22 nt, Human
caguuaaggguuaguuuacaau

SEQ ID NO: 108104 - RNA, 24 nt, Human
ggccuguaaucccagcuacuuggg

SEQ ID NO: 108105 - RNA, 21 nt, Human
ucaaauuauguggcuuucauu

SEQ ID NO: 108106 - RNA, 20 nt, Human
cuucuugccaguguggccca

SEQ ID NO: 108107 - RNA, 27 nt, Human
ccagcucccaguuuacuugguuucccu

SEQ ID NO: 108108 - RNA, 27 nt, Human
uugccccaggcuugagugacucacagc

SEQ ID NO: 108109 - RNA, 20 nt, Human
cgccucgccggccuccaggc

SEQ ID NO: 108110 - RNA, 27 nt, Human
ccuguguggcccugugaccugcaggua

SEQ ID NO: 108111 - RNA, 26 nt, Human
ugacuucacagcagccacuugacuaa

SEQ ID NO: 108112 - RNA, 20 nt, Human
gcuggggaccagaauccaaa

SEQ ID NO: 108113 - RNA, 25 nt, Human
aucugagagucauucaggugaccuc

SEQ ID NO: 108114 - RNA, 21 nt, Human
gguuucugcaagugugagguc

SEQ ID NO: 108115 - RNA, 21 nt, Human
gaaaugucuguuuauauauuu

SEQ ID NO: 108116 - RNA, 21 nt, Human
gugugggucagagauggagaa

SEQ ID NO: 108117 - RNA, 22 nt, Human
cugacccaggcuggaggacagg

SEQ ID NO: 108118 - RNA, 26 nt, Human
ugccuccgcccguguguccgucaagg

SEQ ID NO: 108119 - RNA, 22 nt, Human
ccaagaucgcgcuauugcacuc

SEQ ID NO: 108120 - RNA, 23 nt, Human
guugcccaggcuggugugcaaug

SEQ ID NO: 108121 - RNA, 26 nt, Human
guaggugccuacagagacuauagagc

SEQ ID NO: 108122 - RNA, 22 nt, Human
ccagcccgggggaaaaggcuga

SEQ ID NO: 108123 - RNA, 22 nt, Human
uaugaacuucccuguacuugga

SEQ ID NO: 108124 - RNA, 19 nt, Human
caguuacacucaaagcuuu

SEQ ID NO: 108125 - RNA, 22 nt, Human
agaauucuuuccuaagagcccu

SEQ ID NO: 108126 - RNA, 23 nt, Human
cugaccacaccaaccaggccuuc

SEQ ID NO: 108127 - RNA, 19 nt, Human
cccccucuccccuggggca

SEQ ID NO: 108128 - RNA, 22 nt, Human
ucauucucccuucugcccugca

SEQ ID NO: 108129 - RNA, 22 nt, Human
ugccucccuuaucccacccucg

SEQ ID NO: 108130 - RNA, 22 nt, Human
accagccuggccaucaugguga

SEQ ID NO: 108131 - RNA, 22 nt, Human
gggucucuugcccaucucuccg

SEQ ID NO: 108132 - RNA, 21 nt, Human
accaaaaccagugcugggaca

SEQ ID NO: 108133 - RNA, 22 nt, Human
cuccugcuguacagugccaccc

SEQ ID NO: 108134 - RNA, 23 nt, Human
cucugucucugcuuaucaccucu

SEQ ID NO: 108135 - RNA, 22 nt, Human
cucucacuccccagccugggcc

SEQ ID NO: 108136 - RNA, 20 nt, Human
ccucuacugugucucacauc

SEQ ID NO: 108137 - RNA, 24 nt, Human
acucuggggugaggccagccuucu

SEQ ID NO: 108138 - RNA, 20 nt, Human
gcugcuggaugaugagggag

SEQ ID NO: 108139 - RNA, 28 nt, Human
ugaccacaggcugguguguaggugguaa

SEQ ID NO: 108140 - RNA, 27 nt, Human
ggucucgaacuccugggcucaaacagu

SEQ ID NO: 108141 - RNA, 18 nt, Human
ccuaucucuccaugggac

SEQ ID NO: 108142 - RNA, 20 nt, Human
gaugugguaacuguuaaauu

SEQ ID NO: 108143 - RNA, 24 nt, Human
ucgucucaggccaguugcagccuu

SEQ ID NO: 108144 - RNA, 27 nt, Human
ggaggcugaggcagguggaucacugga

SEQ ID NO: 108145 - RNA, 20 nt, Human
aauucacagaagccuaggag

SEQ ID NO: 108146 - RNA, 17 nt, Human
ucaggcuuagaucaaug

SEQ ID NO: 108147 - RNA, 24 nt, Human
ucucccucuucaucccucccgaaa

SEQ ID NO: 108148 - RNA, 25 nt, Human
ugagccuucccauuuagauuaaaga

SEQ ID NO: 108149 - RNA, 26 nt, Human
aggaauaggggaggguuaauaagacu

SEQ ID NO: 108150 - RNA, 25 nt, Human
cacaucugaaaaggaaggugugaga

SEQ ID NO: 108151 - RNA, 21 nt, Human
ccacugcgacaaccucagugg

SEQ ID NO: 108152 - RNA, 22 nt, Human
gacuauauaaaguacuacugua

SEQ ID NO: 108153 - RNA, 28 nt, Human
cccugcauggucaccucaguccuggaca

SEQ ID NO: 108154 - RNA, 20 nt, Human
gcagcuuuuucucucagugu

SEQ ID NO: 108155 - RNA, 17 nt, Human
uaugacgccacucugaa

SEQ ID NO: 108156 - RNA, 25 nt, Human
cccugcuucucugcuccccugggug

SEQ ID NO: 108157 - RNA, 22 nt, Human
ccccaggcugaagugcaguggu

SEQ ID NO: 108158 - RNA, 22 nt, Human
ucuugaagacuauuuuccaggg

SEQ ID NO: 108159 - RNA, 23 nt, Human
ccaggaggaagccgguucccgug

SEQ ID NO: 108160 - RNA, 27 nt, Human
caccacugccugcucccuggaagguag

SEQ ID NO: 108161 - RNA, 26 nt, Human
gacuccgcuuuggcaccucugcuccg

SEQ ID NO: 108162 - RNA, 24 nt, Human
gucucuuguccuggacccuguagg

SEQ ID NO: 108163 - RNA, 22 nt, Human
cuagaugucuuuaggcagcagc

SEQ ID NO: 108164 - RNA, 23 nt, Human
uguccuagaucauuaccuuauuc

SEQ ID NO: 108165 - RNA, 26 nt, Human
accaugucgcucauggucgucagcau

SEQ ID NO: 108166 - RNA, 22 nt, Human
ccgcuccuugucccuccuggcc

SEQ ID NO: 108167 - RNA, 22 nt, Human
caagcuggagugcaauggcgcg

SEQ ID NO: 108168 - RNA, 30 nt, Human
uccugguuaguacauucucagaggauucug

SEQ ID NO: 108169 - RNA, 24 nt, Human
cccugagccagugccaggucucca

SEQ ID NO: 108170 - RNA, 23 nt, Human
aagccaccaggacucaggaggga

SEQ ID NO: 108171 - RNA, 19 nt, Human
auggagaagagguugcuga

SEQ ID NO: 108172 - RNA, 23 nt, Human
acucaguauuucacacagcugcc

SEQ ID NO: 108173 - RNA, 26 nt, Human
acuacuacuacuacuguucaguuuuu

SEQ ID NO: 108174 - RNA, 21 nt, Human
ucgcccaaauccuacucugcu

SEQ ID NO: 108175 - RNA, 23 nt, Human
acucaugcaaucuuccugccuca

SEQ ID NO: 108176 - RNA, 20 nt, Human
gcuagcuccccuccucuccc

SEQ ID NO: 108177 - RNA, 26 nt, Human
cuuucucguuuguggacaaagcagca

SEQ ID NO: 108178 - RNA, 19 nt, Human
cucuccaguccauccugaa

SEQ ID NO: 108179 - RNA, 26 nt, Human
gccuguaaucucacuacacaggaggc

SEQ ID NO: 108180 - RNA, 25 nt, Human
ggcuggucucaaacuccugcccuca

SEQ ID NO: 108181 - RNA, 21 nt, Human
gcuaaggaggagugcagaggg

SEQ ID NO: 108182 - RNA, 26 nt, Human
ugcccaggcuggagugcaguggugcc

SEQ ID NO: 108183 - RNA, 21 nt, Human
ugucaucaauccaggauguua

SEQ ID NO: 108184 - RNA, 18 nt, Human
ugaacaaccagagacuac

SEQ ID NO: 108185 - RNA, 22 nt, Human
cuggcuccccugccccccucuc

SEQ ID NO: 108186 - RNA, 23 nt, Human
ugagggaguuccaggaguacuua

SEQ ID NO: 108187 - RNA, 22 nt, Human
uuuuaccucuauucuuuagguu

SEQ ID NO: 108188 - RNA, 21 nt, Human
ugguguuuauuuucuuucuua

SEQ ID NO: 108189 - RNA, 25 nt, Human
cagagggugacaucauaggagcagc

SEQ ID NO: 108190 - RNA, 22 nt, Human
ugcugcugcugcuacugcuguu

SEQ ID NO: 108191 - RNA, 22 nt, Human
cuuuuuauugggacaaaaggca

SEQ ID NO: 108192 - RNA, 27 nt, Human
ccuccauccccaucggcccuguccccu

SEQ ID NO: 108193 - RNA, 22 nt, Human
uauucuacucaaacuuaugucu

SEQ ID NO: 108194 - RNA, 23 nt, Human
cucgaccucccaggugauccucc

SEQ ID NO: 108195 - RNA, 20 nt, Human
acaagugucagucauguauc

SEQ ID NO: 108196 - RNA, 21 nt, Human
ccgcucgggacaggagccgga

SEQ ID NO: 108197 - RNA, 24 nt, Human
cuugccagcugcugagccgcagag

SEQ ID NO: 108198 - RNA, 23 nt, Human
gccuuguaaucccagcacuuugg

SEQ ID NO: 108199 - RNA, 20 nt, Human
accgcucacccuccuccucc

SEQ ID NO: 108200 - RNA, 22 nt, Human
uucaguaggaauguugcuauga

SEQ ID NO: 108201 - RNA, 27 nt, Human
gucucaaacuccugggcuaaagcgauc

SEQ ID NO: 108202 - RNA, 20 nt, Human
ugccuucagcauugccuagg

SEQ ID NO: 108203 - RNA, 24 nt, Human
cauuugaagugggcagagaacauc

SEQ ID NO: 108204 - RNA, 22 nt, Human
cgcuauugcacuccagccuggg

SEQ ID NO: 108205 - RNA, 22 nt, Human
ugaacuccuggcuucaagcgau

SEQ ID NO: 108206 - RNA, 19 nt, Human
uaacaucccaugccgcucc

SEQ ID NO: 108207 - RNA, 22 nt, Human
aguggcucagaugcagaguguu

SEQ ID NO: 108208 - RNA, 18 nt, Human
ggucaucagugaccucag

SEQ ID NO: 108209 - RNA, 27 nt, Human
uguccccaaaauguggaaugcauccaa

SEQ ID NO: 108210 - RNA, 22 nt, Human
accucgauguccagcugcuguc

SEQ ID NO: 108211 - RNA, 20 nt, Human
ggggacauagcugugcuaug

SEQ ID NO: 108212 - RNA, 27 nt, Human
gccaggcccaccaagagauauugcccc

SEQ ID NO: 108213 - RNA, 22 nt, Human
auugcuugagcccaggaguuug

SEQ ID NO: 108214 - RNA, 23 nt, Human
agcccaugugcaccugcccccca

SEQ ID NO: 108215 - RNA, 21 nt, Human
ucucucccccuccuuucuccc

SEQ ID NO: 108216 - RNA, 22 nt, Human
acgagaaauuugaugagagagg

SEQ ID NO: 108217 - RNA, 21 nt, Human
uucugaaccuucuucaaacag

SEQ ID NO: 108218 - RNA, 28 nt, Human
ccaaaggcaucccagccugggggccagu

SEQ ID NO: 108219 - RNA, 22 nt, Human
uccugguguguguauuagaauc

SEQ ID NO: 108220 - RNA, 27 nt, Human
uccagagaggaaacuguggaauggaaa

SEQ ID NO: 108221 - RNA, 19 nt, Human
uucuucuuuguuuucagua

SEQ ID NO: 108222 - RNA, 25 nt, Human
gcucuuuagcugggugcagaaggcg

SEQ ID NO: 108223 - RNA, 20 nt, Human
cugacacguccagggccagg

SEQ ID NO: 108224 - RNA, 21 nt, Human
gcagcuuccuaaaauauuuua

SEQ ID NO: 108225 - RNA, 24 nt, Human
gucugcucugggcggaagagcuuu

SEQ ID NO: 108226 - RNA, 26 nt, Human
aggcugagaaucagagacauuucagc

SEQ ID NO: 108227 - RNA, 23 nt, Human
ucuguucugugacucucucccca

SEQ ID NO: 108228 - RNA, 23 nt, Human
gcuucuuguuugacaccuucaca

SEQ ID NO: 108229 - RNA, 20 nt, Human
gaaaccagcaaacaccggga

SEQ ID NO: 108230 - RNA, 22 nt, Human
uuguucacauaugcacauacac

SEQ ID NO: 108231 - RNA, 23 nt, Human
augcagcugagggcagggccagg

SEQ ID NO: 108232 - RNA, 20 nt, Human
cuuuuuaaaaaauguuguua

SEQ ID NO: 108233 - RNA, 25 nt, Human
acugcaaccuccgccucuuggguuc

SEQ ID NO: 108234 - RNA, 26 nt, Human
aaguugagccucagugauccuguggc

SEQ ID NO: 108235 - RNA, 20 nt, Human
uagauuucaaaauugagaaa

SEQ ID NO: 108236 - RNA, 18 nt, Human
ugccuggcuuucuuugag

SEQ ID NO: 108237 - RNA, 30 nt, Human
cacccccucccacuggagugcggggaccuc

SEQ ID NO: 108238 - RNA, 22 nt, Human
uuccaguuuaguuugcugcuau

SEQ ID NO: 108239 - RNA, 22 nt, Human
ccaccgccaccaccaccuccac

SEQ ID NO: 108240 - RNA, 22 nt, Human
uaacuucuccccaucccaggag

SEQ ID NO: 108241 - RNA, 21 nt, Human
ccucagcccucuccugcaucc

SEQ ID NO: 108242 - RNA, 23 nt, Human
gcucagggcagcugugcugggug

SEQ ID NO: 108243 - RNA, 25 nt, Human
uagaaguguccuuuauauuaccaga

SEQ ID NO: 108244 - RNA, 23 nt, Human
ucuugaacuccugaccucaggug

SEQ ID NO: 108245 - RNA, 23 nt, Human
ucucgaacucccgaccucaggug

SEQ ID NO: 108246 - RNA, 22 nt, Human
auagauuggguaaggcugcaaa

SEQ ID NO: 108247 - RNA, 22 nt, Human
acugcuugguguucccugagga

SEQ ID NO: 108248 - RNA, 26 nt, Human
cuguuuccuaccuugggcuugaguac

SEQ ID NO: 108249 - RNA, 24 nt, Human
uccagcucccaacuuuuguggacu

SEQ ID NO: 108250 - RNA, 20 nt, Human
cugacuuccccagcaaggau

SEQ ID NO: 108251 - RNA, 20 nt, Human
uagguugagcaauuuccccc

SEQ ID NO: 108252 - RNA, 22 nt, Human
caauugucaugucuagauuuaa

SEQ ID NO: 108253 - RNA, 16 nt, Human
uccaauaaaacgugcg

SEQ ID NO: 108254 - RNA, 27 nt, Human
ugacucuuggaauucugugcuguuaua

SEQ ID NO: 108255 - RNA, 25 nt, Human
gccaaggccgcccuccucccucucc

SEQ ID NO: 108256 - RNA, 19 nt, Human
ggagcgagagggaggcagg

SEQ ID NO: 108257 - RNA, 22 nt, Human
ggaagagggagcucuggagugc

SEQ ID NO: 108258 - RNA, 28 nt, Human
uccucccaggcuuccgugugggucagug

SEQ ID NO: 108259 - RNA, 26 nt, Human
gauguuuacucucugggcacuguugu

SEQ ID NO: 108260 - RNA, 21 nt, Human
uuuccaucugcugggccacca

SEQ ID NO: 108261 - RNA, 26 nt, Human
gcagcccgcccuucccccucccaucc

SEQ ID NO: 108262 - RNA, 22 nt, Human
ucuguaacucuuucugaggagc

SEQ ID NO: 108263 - RNA, 24 nt, Human
ggcguaggagggugggcuggcggu

SEQ ID NO: 108264 - RNA, 29 nt, Human
gagaucgagucacaaaaauucaggaagag

SEQ ID NO: 108265 - RNA, 21 nt, Human
ccugccuggcucgcuggucuc

SEQ ID NO: 108266 - RNA, 29 nt, Human
ggaaaaguguuccuugcucucuugggggg

SEQ ID NO: 108267 - RNA, 20 nt, Human
uuguucuugaaaauaguuga

SEQ ID NO: 108268 - RNA, 24 nt, Human
cagcccagccuugcccaccauuua

SEQ ID NO: 108269 - RNA, 21 nt, Human
gcgguagaugggagggaggcu

SEQ ID NO: 108270 - RNA, 27 nt, Human
gcccagccuguccgucccugucccggg

SEQ ID NO: 108271 - RNA, 20 nt, Human
aacucugcccuaccucccug

SEQ ID NO: 108272 - RNA, 20 nt, Human
aaggagaccaggaaggggug

SEQ ID NO: 108273 - RNA, 20 nt, Human
gaacuuccuguuggugcugg

SEQ ID NO: 108274 - RNA, 24 nt, Human
cuggcuguguucauccccgcugca

SEQ ID NO: 108275 - RNA, 22 nt, Human
acucaauaaagcuaagaugacu

SEQ ID NO: 108276 - RNA, 23 nt, Human
aauauuaaaacuuacuauuauuc

SEQ ID NO: 108277 - RNA, 23 nt, Human
ucaagacuuuggaagcagacaaa

SEQ ID NO: 108278 - RNA, 18 nt, Human
uugugcugggacugcuau

SEQ ID NO: 108279 - RNA, 21 nt, Human
auucauuggcuuccucuaccc

SEQ ID NO: 108280 - RNA, 27 nt, Human
accagcuugggcaacauggcaaaaccc

SEQ ID NO: 108281 - RNA, 26 nt, Human
uccagccuggucaacaagaguaaaac

SEQ ID NO: 108282 - RNA, 19 nt, Human
caucauuauuuauguauug

SEQ ID NO: 108283 - RNA, 21 nt, Human
uuuacuauguggaugguggua

SEQ ID NO: 108284 - RNA, 22 nt, Human
ucaggguguccuaaucagaauc

SEQ ID NO: 108285 - RNA, 18 nt, Human
cagacaccuccacgccca

SEQ ID NO: 108286 - RNA, 20 nt, Human
aaagggccuggccaccucuc

SEQ ID NO: 108287 - RNA, 17 nt, Human
uucucucuuuacgcuua

SEQ ID NO: 108288 - RNA, 22 nt, Human
uaugggagagauuagacacugg

SEQ ID NO: 108289 - RNA, 26 nt, Human
cgugagccuccagaccgccccuggcc

SEQ ID NO: 108290 - RNA, 29 nt, Human
ccugcuagggaccucgccugcuggggacc

SEQ ID NO: 108291 - RNA, 23 nt, Human
aucacaccauugcgcuucagccu

SEQ ID NO: 108292 - RNA, 19 nt, Human
ccggggagaggaagggugg

SEQ ID NO: 108293 - RNA, 22 nt, Human
agcaguauuuaaaucuugcaag

SEQ ID NO: 108294 - RNA, 20 nt, Human
aucagaccacucccuucccc

SEQ ID NO: 108295 - RNA, 22 nt, Human
uugccccaguguggucaagcag

SEQ ID NO: 108296 - RNA, 21 nt, Human
acacagacacccacagacccu

SEQ ID NO: 108297 - RNA, 22 nt, Human
augacucaccugaagugcaaua

SEQ ID NO: 108298 - RNA, 23 nt, Human
guccuacagauagauauggugug

SEQ ID NO: 108299 - RNA, 25 nt, Human
gccgucggugggcacuuguuauuuu

SEQ ID NO: 108300 - RNA, 23 nt, Human
auggggacuccacagccucucca

SEQ ID NO: 108301 - RNA, 27 nt, Human
cgggacuggagcaacaugaaccgugaa

SEQ ID NO: 108302 - RNA, 26 nt, Human
ccaggagacaguucaagaaagcuuca

SEQ ID NO: 108303 - RNA, 22 nt, Human
caagaacaauuuuuaugaaaug

SEQ ID NO: 108304 - RNA, 26 nt, Human
cucacccaguugguagaggagucagg

SEQ ID NO: 108305 - RNA, 22 nt, Human
ggauaaauauacaaaucugggg

SEQ ID NO: 108306 - RNA, 22 nt, Human
uuaucuaggaguuuguuuuuca

SEQ ID NO: 108307 - RNA, 19 nt, Human
ccacccuccagccaaggag

SEQ ID NO: 108308 - RNA, 20 nt, Human
acucccacucucaagacucc

SEQ ID NO: 108309 - RNA, 28 nt, Human
ccccuccucggcuuccuuccucucugca

SEQ ID NO: 108310 - RNA, 24 nt, Human
gucccauucuacuccucucauucc

SEQ ID NO: 108311 - RNA, 20 nt, Human
gcaccauuucauucuggacc

SEQ ID NO: 108312 - RNA, 21 nt, Human
ggacugcagccuuugcuucug

SEQ ID NO: 108313 - RNA, 21 nt, Human
cacugccaugucagggguuug

SEQ ID NO: 108314 - RNA, 26 nt, Human
cuucacugaauuucuucaaaaccauu

SEQ ID NO: 108315 - RNA, 22 nt, Human
uccccucagccagccugccugc

SEQ ID NO: 108316 - RNA, 22 nt, Human
ccauugcucugcuccuggcaua

SEQ ID NO: 108317 - RNA, 22 nt, Human
cuggcagcaggcgggcgcgugg

SEQ ID NO: 108318 - RNA, 22 nt, Human
aguugaagagcacauuucuuuc

SEQ ID NO: 108319 - RNA, 18 nt, Human
ccucaccuucccuggcuc

SEQ ID NO: 108320 - RNA, 18 nt, Human
guagugcuuggugcauga

SEQ ID NO: 108321 - RNA, 22 nt, Human
gcuccucaugcuggagugccuc

SEQ ID NO: 108322 - RNA, 27 nt, Human
ccaggagaggcgggaagauuuuugagc

SEQ ID NO: 108323 - RNA, 20 nt, Human
uugagaauaguuucaucuca

SEQ ID NO: 108324 - RNA, 21 nt, Human
aucuccaucugcacagagguc

SEQ ID NO: 108325 - RNA, 23 nt, Human
cccacauuguuugaacucgcgua

SEQ ID NO: 108326 - RNA, 30 nt, Human
ccaucucuggaaaacaucauuaucccauuc

SEQ ID NO: 108327 - RNA, 25 nt, Human
cagggcgggaaaggggccacuucug

SEQ ID NO: 108328 - RNA, 22 nt, Human
augcaaaccacaggguuucgca

SEQ ID NO: 108329 - RNA, 24 nt, Human
uuuaguauuuuguuucagugcacu

SEQ ID NO: 108330 - RNA, 21 nt, Human
accuaguccaucagaucaugu

SEQ ID NO: 108331 - RNA, 22 nt, Human
gcaaagauuuuuggcacuuugu

SEQ ID NO: 108332 - RNA, 24 nt, Human
cacaaaugugacccaggauacaga

SEQ ID NO: 108333 - RNA, 22 nt, Human
uuacuccaaacucuuagcagug

SEQ ID NO: 108334 - RNA, 26 nt, Human
cuccuuccugucuuccugcauucacc

SEQ ID NO: 108335 - RNA, 19 nt, Human
guauugcgucuuagcagug

SEQ ID NO: 108336 - RNA, 27 nt, Human
gccaggaugacgccuuucaugucccag

SEQ ID NO: 108337 - RNA, 22 nt, Human
gagcaauuaaaccacuauucca

SEQ ID NO: 108338 - RNA, 28 nt, Human
ucgacuugaucaguucagccaagcaacu

SEQ ID NO: 108339 - RNA, 22 nt, Human
aguacccaauggcaucucucca

SEQ ID NO: 108340 - RNA, 26 nt, Human
ccuugcccucuuuaaaagcggccucc

SEQ ID NO: 108341 - RNA, 25 nt, Human
cugggcuucaccauugugauuuugu

SEQ ID NO: 108342 - RNA, 23 nt, Human
agccaugagcagacggccugugg

SEQ ID NO: 108343 - RNA, 23 nt, Human
cacaggcuggggacagagguggc

SEQ ID NO: 108344 - RNA, 23 nt, Human
aauuucccuaaaguuacuaugag

SEQ ID NO: 108345 - RNA, 22 nt, Human
uguugaagaaaaucaguguugg

SEQ ID NO: 108346 - RNA, 21 nt, Human
ucuccucuccucugagcagcc

SEQ ID NO: 108347 - RNA, 22 nt, Human
cuagucagcuaacuaagugacu

SEQ ID NO: 108348 - RNA, 21 nt, Human
gcagcaucuccaccugccauc

SEQ ID NO: 108349 - RNA, 22 nt, Human
uaguuucccuggauuucacuga

SEQ ID NO: 108350 - RNA, 24 nt, Human
aggcuggagugcaaugacacaguc

SEQ ID NO: 108351 - RNA, 23 nt, Human
cugccaagccucgccuccuacca

SEQ ID NO: 108352 - RNA, 22 nt, Human
aguucaagaccagccugggcaa

SEQ ID NO: 108353 - RNA, 27 nt, Human
cugcuucugcauucacagcgccuccug

SEQ ID NO: 108354 - RNA, 27 nt, Human
ggcucacugcaaccucugcccccuggg

SEQ ID NO: 108355 - RNA, 19 nt, Human
acccaaagagugcaggcca

SEQ ID NO: 108356 - RNA, 22 nt, Human
gccucucugugggaccugggcc

SEQ ID NO: 108357 - RNA, 27 nt, Human
uucucuuuuacacuuuuguacuccuca

SEQ ID NO: 108358 - RNA, 19 nt, Human
uccugcucuacccucuucc

SEQ ID NO: 108359 - RNA, 21 nt, Human
uugggaauuuaaaauaauaca

SEQ ID NO: 108360 - RNA, 20 nt, Human
ccuuuccugagucauggccu

SEQ ID NO: 108361 - RNA, 24 nt, Human
uucuccucuggggaagaccuuguc

SEQ ID NO: 108362 - RNA, 22 nt, Human
agcacagacuuuaacacuaagc

SEQ ID NO: 108363 - RNA, 26 nt, Human
gaacaucuucucagaaucaggucuaa

SEQ ID NO: 108364 - RNA, 20 nt, Human
uaaggagucccugguucauu

SEQ ID NO: 108365 - RNA, 32 nt, Human
uuccagguuuucugggggagugcagggggaga

SEQ ID NO: 108366 - RNA, 19 nt, Human
uugcucccccugccuuguc

SEQ ID NO: 108367 - RNA, 22 nt, Human
ucuuccuuugucuuauacaugg

SEQ ID NO: 108368 - RNA, 22 nt, Human
cuguccugucuucccugcucca

SEQ ID NO: 108369 - RNA, 23 nt, Human
gguguuucccuuucaagaugcca

SEQ ID NO: 108370 - RNA, 23 nt, Human
uuuggagcugguuaugccaagga

SEQ ID NO: 108371 - RNA, 21 nt, Human
uccagccugggaacuauaacu

SEQ ID NO: 108372 - RNA, 20 nt, Human
uucaaggcucagaaggaaug

SEQ ID NO: 108373 - RNA, 20 nt, Human
ggcagguggggaggggaagc

SEQ ID NO: 108374 - RNA, 23 nt, Human
cccgccuggccacugcgucuggc

SEQ ID NO: 108375 - RNA, 25 nt, Human
uccacacaaccacaucugccuuuuc

SEQ ID NO: 108376 - RNA, 22 nt, Human
uccagcaaaacacagugcaaug

SEQ ID NO: 108377 - RNA, 21 nt, Human
acugccucugccugucgcaug

SEQ ID NO: 108378 - RNA, 23 nt, Human
uguuguccaggcuggagugcaau

SEQ ID NO: 108379 - RNA, 22 nt, Human
cccgccgccucacugcagccag

SEQ ID NO: 108380 - RNA, 23 nt, Human
agcuuucuuugaaggguaggaaa

SEQ ID NO: 108381 - RNA, 23 nt, Human
uuuggcuuuaguuuucuuuuccu

SEQ ID NO: 108382 - RNA, 18 nt, Human
cugccugccagggccucu

SEQ ID NO: 108383 - RNA, 20 nt, Human
ucccaugugugaccccucug

SEQ ID NO: 108384 - RNA, 19 nt, Human
gaccugggcucaagcaauc

SEQ ID NO: 108385 - RNA, 25 nt, Human
guccuguggaaugaaaccaucuccu

SEQ ID NO: 108386 - RNA, 26 nt, Human
cccugcugagccaaacccaguaggag

SEQ ID NO: 108387 - RNA, 20 nt, Human
ccuacuuccgguggugcugu

SEQ ID NO: 108388 - RNA, 29 nt, Human
gguccugcugaagccaggagggucuuccc

SEQ ID NO: 108389 - RNA, 30 nt, Human
gaauauaaacaggaucucaaacuugauuaa

SEQ ID NO: 108390 - RNA, 19 nt, Human
gaucuuaauccuguauuua

SEQ ID NO: 108391 - RNA, 30 nt, Human
ucucacucugugugcuccucuggaaggcca

SEQ ID NO: 108392 - RNA, 26 nt, Human
agcguaucacaucugcccucccugca

SEQ ID NO: 108393 - RNA, 29 nt, Human
uaacgucugccuucuuuccuuuacggucc

SEQ ID NO: 108394 - RNA, 20 nt, Human
gcuugccuguaaucccagca

SEQ ID NO: 108395 - RNA, 20 nt, Human
acucagaaagacuaaaggaa

SEQ ID NO: 108396 - RNA, 22 nt, Human
cugaguaugugguucaugcugu

SEQ ID NO: 108397 - RNA, 26 nt, Human
cuuuaaggacauuuaggguccccccu

SEQ ID NO: 108398 - RNA, 20 nt, Human
uugugcccauugcucuuuca

SEQ ID NO: 108399 - RNA, 21 nt, Human
guggggccugcacacagcccu

SEQ ID NO: 108400 - RNA, 22 nt, Human
ucugaacuggcaguuuaagagg

SEQ ID NO: 108401 - RNA, 26 nt, Human
uucuccucugcugaggaaacaguacc

SEQ ID NO: 108402 - RNA, 23 nt, Human
ggaugaauugugggaagagggug

SEQ ID NO: 108403 - RNA, 21 nt, Human
guggugagacuguauccuguu

SEQ ID NO: 108404 - RNA, 21 nt, Human
cucuuuauuucaccauccugg

SEQ ID NO: 108405 - RNA, 27 nt, Human
agaacuccaauacucacccuguuaugu

SEQ ID NO: 108406 - RNA, 22 nt, Human
cgccuccuggguucacaugauu

SEQ ID NO: 108407 - RNA, 24 nt, Human
cugcagucuuuacacccacagcuc

SEQ ID NO: 108408 - RNA, 26 nt, Human
acaucuuuucuaaucacaguguugca

SEQ ID NO: 108409 - RNA, 24 nt, Human
ucauaauccauugaugcucuuuca

SEQ ID NO: 108410 - RNA, 26 nt, Human
gccucgucucccuggggagguggucc

SEQ ID NO: 108411 - RNA, 26 nt, Human
aacguuuaugacuauagguaauauuu

SEQ ID NO: 108412 - RNA, 19 nt, Human
cccagggggccacuccuga

SEQ ID NO: 108413 - RNA, 19 nt, Human
gagcacuccucucucucca

SEQ ID NO: 108414 - RNA, 24 nt, Human
cgggagguacagcuggcagaggga

SEQ ID NO: 108415 - RNA, 24 nt, Human
ugcuggagguuggaucuugaugua

SEQ ID NO: 108416 - RNA, 22 nt, Human
cauggcgcgaucuuggcucacu

SEQ ID NO: 108417 - RNA, 23 nt, Human
gauugugaaacagggagcuauga

SEQ ID NO: 108418 - RNA, 21 nt, Human
gaggcucgaggggcucagggg

SEQ ID NO: 108419 - RNA, 21 nt, Human
ggaggugggguccuuggaagc

SEQ ID NO: 108420 - RNA, 22 nt, Human
cagugguucccaaaucuggcug

SEQ ID NO: 108421 - RNA, 21 nt, Human
agcauucuaaugccagguugc

SEQ ID NO: 108422 - RNA, 24 nt, Human
agccucucagugccuguccugacc

SEQ ID NO: 108423 - RNA, 26 nt, Human
cagcacuccgaggcuauggcuccagc

SEQ ID NO: 108424 - RNA, 21 nt, Human
auccugcaccuuccucuccca

SEQ ID NO: 108425 - RNA, 21 nt, Human
ggaagggagaguggauuuggc

SEQ ID NO: 108426 - RNA, 17 nt, Human
aggaagaguagcaggua

SEQ ID NO: 108427 - RNA, 20 nt, Human
cacuugcacuccggagguag

SEQ ID NO: 108428 - RNA, 18 nt, Human
ccuagagucccacuguga

SEQ ID NO: 108429 - RNA, 26 nt, Human
ugaauuuucauuuggacauuacauca

SEQ ID NO: 108430 - RNA, 21 nt, Human
uuauguagccaaagguaaacg

SEQ ID NO: 108431 - RNA, 20 nt, Human
gugcauggacccccugcugc

SEQ ID NO: 108432 - RNA, 21 nt, Human
gaacuauuugcuuucucuuca

SEQ ID NO: 108433 - RNA, 22 nt, Human
gaacacacaccuucagccacca

SEQ ID NO: 108434 - RNA, 23 nt, Human
gcuaaugaaacacuggacauaua

SEQ ID NO: 108435 - RNA, 22 nt, Human
ucauguggaacauaaacacuaa

SEQ ID NO: 108436 - RNA, 23 nt, Human
aggaugaagaaauggagcagcac

SEQ ID NO: 108437 - RNA, 24 nt, Human
accaucacgggcaugcacagcgug

SEQ ID NO: 108438 - RNA, 27 nt, Human
cuggaaguguugggcagguggugggag

SEQ ID NO: 108439 - RNA, 21 nt, Human
ccugcugucagugcuucucuc

SEQ ID NO: 108440 - RNA, 26 nt, Human
cccugcacucccgaccuuagcuuauu

SEQ ID NO: 108441 - RNA, 24 nt, Human
cuucucuccauccuucgaccuuca

SEQ ID NO: 108442 - RNA, 22 nt, Human
ugcuuccuccccuccuggcacc

SEQ ID NO: 108443 - RNA, 25 nt, Human
ucuucuuucuugguuugauccugac

SEQ ID NO: 108444 - RNA, 21 nt, Human
cugaaacaacaguaaccaucu

SEQ ID NO: 108445 - RNA, 27 nt, Human
uggcaccacgcacagugccuaacccua

SEQ ID NO: 108446 - RNA, 21 nt, Human
cugcccuccugucaguagugg

SEQ ID NO: 108447 - RNA, 20 nt, Human
ucuaguuccugauagcuacc

SEQ ID NO: 108448 - RNA, 26 nt, Human
ccacauacccugaccuggcccccuca

SEQ ID NO: 108449 - RNA, 21 nt, Human
uugcaauuuguugagguuuua

SEQ ID NO: 108450 - RNA, 26 nt, Human
agguucccugagcugugggauucugc

SEQ ID NO: 108451 - RNA, 25 nt, Human
ucacccaguuuagugggugguaggg

SEQ ID NO: 108452 - RNA, 21 nt, Human
caugcuacacacugcauguuu

SEQ ID NO: 108453 - RNA, 29 nt, Human
ggggagaugcggagcaggagcaauuccgg

SEQ ID NO: 108454 - RNA, 19 nt, Human
ucuguaaccugugcggugu

SEQ ID NO: 108455 - RNA, 23 nt, Human
uauuaaaauuuguacaauauuua

SEQ ID NO: 108456 - RNA, 25 nt, Human
gcuggugggcuugucauagccagug

SEQ ID NO: 108457 - RNA, 23 nt, Human
uuucauuaaggccucuacucugg

SEQ ID NO: 108458 - RNA, 21 nt, Human
ccguaaccuugaggcggcggc

SEQ ID NO: 108459 - RNA, 30 nt, Human
gcuacuucuugauuugggccuggugaccca

SEQ ID NO: 108460 - RNA, 15 nt, Human
cuucccuuauuucua

SEQ ID NO: 108461 - RNA, 26 nt, Human
ggauucaguuuugcuuauuguguguu

SEQ ID NO: 108462 - RNA, 26 nt, Human
gcugggugggagggugggccauggag

SEQ ID NO: 108463 - RNA, 23 nt, Human
aacgccuguaaucccaacuacuu

SEQ ID NO: 108464 - RNA, 20 nt, Human
caaaacugggaaggccaagu

SEQ ID NO: 108465 - RNA, 27 nt, Human
uggagagaugccuggcuggaccguagg

SEQ ID NO: 108466 - RNA, 22 nt, Human
gcagagcuguguuauauuuucu

SEQ ID NO: 108467 - RNA, 26 nt, Human
aagccuuugaauauaguuguuucccu

SEQ ID NO: 108468 - RNA, 23 nt, Human
ggggaaagauccccacagagcau

SEQ ID NO: 108469 - RNA, 21 nt, Human
ugcuaaaagagaucuuuucau

SEQ ID NO: 108470 - RNA, 21 nt, Human
cagugcugggauuacaggcgu

SEQ ID NO: 108471 - RNA, 26 nt, Human
gcccuugccagaauuuccugcgcugu

SEQ ID NO: 108472 - RNA, 26 nt, Human
ggccgccuccccucuccugggagcau

SEQ ID NO: 108473 - RNA, 22 nt, Human
gugcugcccucauccuccagca

SEQ ID NO: 108474 - RNA, 22 nt, Human
uucacuacccugauucuugauu

SEQ ID NO: 108475 - RNA, 24 nt, Human
caccagaggucagguguucaagac

SEQ ID NO: 108476 - RNA, 20 nt, Human
ccaccugggauucuccagcc

SEQ ID NO: 108477 - RNA, 21 nt, Human
gcucaagaucagccugggcaa

SEQ ID NO: 108478 - RNA, 22 nt, Human
gugccuggccccagucugggcc

SEQ ID NO: 108479 - RNA, 26 nt, Human
acucuguugccaggcuggagugcagu

SEQ ID NO: 108480 - RNA, 21 nt, Human
uguugccacugagaagcaggc

SEQ ID NO: 108481 - RNA, 23 nt, Human
ucuuaacaaaaaagaauguuuga

SEQ ID NO: 108482 - RNA, 23 nt, Human
ccacugcagccucagcccaggag

SEQ ID NO: 108483 - RNA, 23 nt, Human
uuuguguuuuuauuuuuauuuuu

SEQ ID NO: 108484 - RNA, 25 nt, Human
gcuggcaugagguucagucauucca

SEQ ID NO: 108485 - RNA, 21 nt, Human
cugccucuuugcugcuuuguu

SEQ ID NO: 108486 - RNA, 28 nt, Human
aacacuuugccagccacugguggucccu

SEQ ID NO: 108487 - RNA, 23 nt, Human
gccuuucuccucuucucuucuug

SEQ ID NO: 108488 - RNA, 22 nt, Human
ggccucccagagugcugggauu

SEQ ID NO: 108489 - RNA, 22 nt, Human
gaccucccaaagugcugggauu

SEQ ID NO: 108490 - RNA, 22 nt, Human
agccucccaaagugcuaagauu

SEQ ID NO: 108491 - RNA, 25 nt, Human
ucaacucuucagccucauucacugu

SEQ ID NO: 108492 - RNA, 27 nt, Human
uuucuaugccuacugaugucaguaugu

SEQ ID NO: 108493 - RNA, 26 nt, Human
ggacugcgggaaggcgcgggagccag

SEQ ID NO: 108494 - RNA, 22 nt, Human
ggagagggagagacggagcccc

SEQ ID NO: 108495 - RNA, 24 nt, Human
agggcccucacucaggaacccugg

SEQ ID NO: 108496 - RNA, 19 nt, Human
cuuuaaacaugauuaucuu

SEQ ID NO: 108497 - RNA, 27 nt, Human
auaauugcuuuuucacagucacugaug

SEQ ID NO: 108498 - RNA, 26 nt, Human
uuugucgcccaggcuggagcgcaguc

SEQ ID NO: 108499 - RNA, 25 nt, Human
agcuuugacaagaacucacggcuuc

SEQ ID NO: 108500 - RNA, 21 nt, Human
gaggucugcgggguccuggcc

SEQ ID NO: 108501 - RNA, 26 nt, Human
cucauaccuguaaugccagcacuuug

SEQ ID NO: 108502 - RNA, 22 nt, Human
gccccuguccccucugucaacc

SEQ ID NO: 108503 - RNA, 20 nt, Human
cucugaaccuacagucucaa

SEQ ID NO: 108504 - RNA, 27 nt, Human
gggaugggagagacgaaccgagucuag

SEQ ID NO: 108505 - RNA, 23 nt, Human
auuuaucugccaaaacaaggaca

SEQ ID NO: 108506 - RNA, 22 nt, Human
acaggggccauuucugccuugu

SEQ ID NO: 108507 - RNA, 27 nt, Human
ucagaaauuuggcagguccuuugcuuc

SEQ ID NO: 108508 - RNA, 20 nt, Human
uugcacacacaucccuguca

SEQ ID NO: 108509 - RNA, 22 nt, Human
aguuuacagaaaaagacuuuaa

SEQ ID NO: 108510 - RNA, 22 nt, Human
uuugugggcuucaccagugccc

SEQ ID NO: 108511 - RNA, 22 nt, Human
agcagccgccuccaugcccuag

SEQ ID NO: 108512 - RNA, 18 nt, Human
guguuggccaggcugguc

SEQ ID NO: 108513 - RNA, 23 nt, Human
gcaguucugccucacacggcuca

SEQ ID NO: 108514 - RNA, 23 nt, Human
auucggaggccucuugacuggga

SEQ ID NO: 108515 - RNA, 22 nt, Human
gguguucucagggcaaguucuu

SEQ ID NO: 108516 - RNA, 23 nt, Human
cagguaguacugggaauggaagg

SEQ ID NO: 108517 - RNA, 21 nt, Human
aaguccuagcuccuccuccug

SEQ ID NO: 108518 - RNA, 21 nt, Human
gugugcacuccagcuucggag

SEQ ID NO: 108519 - RNA, 24 nt, Human
uguggacacugucuuuccaggguu

SEQ ID NO: 108520 - RNA, 19 nt, Human
uggggcauugcagcuugga

SEQ ID NO: 108521 - RNA, 22 nt, Human
augaucaccauguauuuuguaa

SEQ ID NO: 108522 - RNA, 22 nt, Human
ccaaguagcucggacuacaggc

SEQ ID NO: 108523 - RNA, 25 nt, Human
gcucugagaggaggggacccgguuc

SEQ ID NO: 108524 - RNA, 27 nt, Human
cuacugcacuccagccugggggacaga

SEQ ID NO: 108525 - RNA, 23 nt, Human
ccaacauguuuauaucuugacuu

SEQ ID NO: 108526 - RNA, 22 nt, Human
uuguguacugguuaugggggug

SEQ ID NO: 108527 - RNA, 21 nt, Human
uaacaguguacuaugguuuua

SEQ ID NO: 108528 - RNA, 24 nt, Human
agacaggagaaacacuugaaccug

SEQ ID NO: 108529 - RNA, 20 nt, Human
acugcacuuccagacacccg

SEQ ID NO: 108530 - RNA, 20 nt, Human
uguuaaagaaaaauuacaga

SEQ ID NO: 108531 - RNA, 21 nt, Human
cauuuggagaaacaauaaaag

SEQ ID NO: 108532 - RNA, 20 nt, Human
auuccauuaagggacccucu

SEQ ID NO: 108533 - RNA, 24 nt, Human
guccuaagccuccccacaaggcga

SEQ ID NO: 108534 - RNA, 23 nt, Human
cuccugcucaccaccugccucua

SEQ ID NO: 108535 - RNA, 25 nt, Human
cuggcagcucagcugcaucuugccc

SEQ ID NO: 108536 - RNA, 24 nt, Human
gggaucggcggagcucccaccucc

SEQ ID NO: 108537 - RNA, 27 nt, Human
agagcaucuaugugccuucaucaagaa

SEQ ID NO: 108538 - RNA, 23 nt, Human
gacccuagggcaaggcuugagaa

SEQ ID NO: 108539 - RNA, 26 nt, Human
gcccaggcgcgggggcgacgacaggu

SEQ ID NO: 108540 - RNA, 21 nt, Human
ugaguagaagguggugaccuc

SEQ ID NO: 108541 - RNA, 16 nt, Human
gauagggagagguggc

SEQ ID NO: 108542 - RNA, 25 nt, Human
auacccuacccucaccugaugauaa

SEQ ID NO: 108543 - RNA, 22 nt, Human
aaaacuaaaaaugaaccaaagu

SEQ ID NO: 108544 - RNA, 22 nt, Human
aagguaggcagagguugcagug

SEQ ID NO: 108545 - RNA, 21 nt, Human
ugucuguugcugccuggugau

SEQ ID NO: 108546 - RNA, 29 nt, Human
acuaaagacagaaugaauguagaaaaggc

SEQ ID NO: 108547 - RNA, 22 nt, Human
ugagggaggcaggagagccugg

SEQ ID NO: 108548 - RNA, 24 nt, Human
aacuuaugggcauauuacuggagc

SEQ ID NO: 108549 - RNA, 24 nt, Human
acagggacgagggggucaggcuug

SEQ ID NO: 108550 - RNA, 20 nt, Human
gcucugaaaagguugacuau

SEQ ID NO: 108551 - RNA, 28 nt, Human
caguaugcuuccuuuuaugagguguacu

SEQ ID NO: 108552 - RNA, 26 nt, Human
cugccucuuugugugcgucacuguga

SEQ ID NO: 108553 - RNA, 19 nt, Human
aagccccgugguugcccau

SEQ ID NO: 108554 - RNA, 22 nt, Human
ccucuugcagggucuugcuuuc

SEQ ID NO: 108555 - RNA, 19 nt, Human
ggccucccaaagcgcuggg

SEQ ID NO: 108556 - RNA, 27 nt, Human
guagaaaagggaacugaacauuccaga

SEQ ID NO: 108557 - RNA, 18 nt, Human
uaaucagguccugcucag

SEQ ID NO: 108558 - RNA, 27 nt, Human
gaccagcccagccaacauggcaaaacc

SEQ ID NO: 108559 - RNA, 27 nt, Human
aagcgugccuccagccguggggacagg

SEQ ID NO: 108560 - RNA, 24 nt, Human
agaggagacccccaggcagagggg

SEQ ID NO: 108561 - RNA, 25 nt, Human
gaagaauucagcagcuaaguggaag

SEQ ID NO: 108562 - RNA, 23 nt, Human
cauuucccacacugucuuagaga

SEQ ID NO: 108563 - RNA, 25 nt, Human
ccugcgcuccuccacagccugggcc

SEQ ID NO: 108564 - RNA, 18 nt, Human
ugggaagacguggaggaa

SEQ ID NO: 108565 - RNA, 23 nt, Human
ccugcuguuguugccaaccaguc

SEQ ID NO: 108566 - RNA, 21 nt, Human
aaaauagaaaaauuagccggg

SEQ ID NO: 108567 - RNA, 25 nt, Human
cgggaccagguggaggcggcggcgg

SEQ ID NO: 108568 - RNA, 26 nt, Human
ggcugaaggaaacagugcaacagcac

SEQ ID NO: 108569 - RNA, 21 nt, Human
aguguucuagguuccagcaca

SEQ ID NO: 108570 - RNA, 22 nt, Human
aguauuucagucuugcagagga

SEQ ID NO: 108571 - RNA, 21 nt, Human
acugcaccuccaccuuccggg

SEQ ID NO: 108572 - RNA, 21 nt, Human
gagcuugggagcggagcccag

SEQ ID NO: 108573 - RNA, 24 nt, Human
uuaagugaucaccaaaggacugag

SEQ ID NO: 108574 - RNA, 21 nt, Human
cucugcucucucccgguaucc

SEQ ID NO: 108575 - RNA, 27 nt, Human
ggcuuaguguuuagacuguuaguagaa

SEQ ID NO: 108576 - RNA, 26 nt, Human
uucucccaagcugguggauaaugaaa

SEQ ID NO: 108577 - RNA, 25 nt, Human
gaaagagacgcaaacacaaaagugg

SEQ ID NO: 108578 - RNA, 22 nt, Human
agaucuccaguuguauccucug

SEQ ID NO: 108579 - RNA, 22 nt, Human
gucaagccuuucaccuuccuca

SEQ ID NO: 108580 - RNA, 21 nt, Human
ggccugugcugcccacugggu

SEQ ID NO: 108581 - RNA, 23 nt, Human
gaucaagaacacuuaacagcuuc

SEQ ID NO: 108582 - RNA, 25 nt, Human
cuggagugaaaauuuuguuuugaaa

SEQ ID NO: 108583 - RNA, 22 nt, Human
uggacuuugggaccugcuuugu

SEQ ID NO: 108584 - RNA, 27 nt, Human
gaguagcugggacuacaggcaccugcc

SEQ ID NO: 108585 - RNA, 21 nt, Human
ucgccuucccagaauauccuu

SEQ ID NO: 108586 - RNA, 23 nt, Human
ggcuggguggcugggccugggag

SEQ ID NO: 108587 - RNA, 19 nt, Human
guagaaagagcccagaagc

SEQ ID NO: 108588 - RNA, 20 nt, Human
ggccaaagugugugccugaa

SEQ ID NO: 108589 - RNA, 27 nt, Human
ccggguucaagcgauucuccuaccuca

SEQ ID NO: 108590 - RNA, 18 nt, Human
cugggaggggguguggug

SEQ ID NO: 108591 - RNA, 19 nt, Human
ugccccugugccucugucc

SEQ ID NO: 108592 - RNA, 22 nt, Human
gucagcagcaggggaggcagcu

SEQ ID NO: 108593 - RNA, 22 nt, Human
ugagcauggagcugucaccucu

SEQ ID NO: 108594 - RNA, 21 nt, Human
aacgauggcgaacacagcaga

SEQ ID NO: 108595 - RNA, 27 nt, Human
ggagcacaggugucugccuagauccac

SEQ ID NO: 108596 - RNA, 22 nt, Human
gccggugccucucuccuggguc

SEQ ID NO: 108597 - RNA, 26 nt, Human
ucugggacugagcaugaggccauaga

SEQ ID NO: 108598 - RNA, 21 nt, Human
uuucuggaauugauguuuaca

SEQ ID NO: 108599 - RNA, 23 nt, Human
aaacgccaacaaaaaaucagcag

SEQ ID NO: 108600 - RNA, 24 nt, Human
ugcucacugcagccccucugcccc

SEQ ID NO: 108601 - RNA, 21 nt, Human
uagccucugcuggagugcagu

SEQ ID NO: 108602 - RNA, 25 nt, Human
gccauggauaugguggaggucauuu

SEQ ID NO: 108603 - RNA, 21 nt, Human
ccuacccuugguccuacucua

SEQ ID NO: 108604 - RNA, 26 nt, Human
agucauuuucugcccaucucuggucg

SEQ ID NO: 108605 - RNA, 24 nt, Human
gccaugcgcccccuccgcccugcc

SEQ ID NO: 108606 - RNA, 21 nt, Human
cggucucacccccuaaccuca

SEQ ID NO: 108607 - RNA, 20 nt, Human
uucucucucugaaagcacca

SEQ ID NO: 108608 - RNA, 27 nt, Human
ccaauuauuccugcuuggauucuucca

SEQ ID NO: 108609 - RNA, 22 nt, Human
ccgaguagcuggaauuauaggc

SEQ ID NO: 108610 - RNA, 22 nt, Human
agcuagaacauggagagcuaga

SEQ ID NO: 108611 - RNA, 27 nt, Human
gggguuaaagaccugugauaaaccacu

SEQ ID NO: 108612 - RNA, 20 nt, Human
cccaggccacacagaggccg

SEQ ID NO: 108613 - RNA, 18 nt, Human
ucagcauagaucugugau

SEQ ID NO: 108614 - RNA, 25 nt, Human
ucuucuuuuuguggcugcuaauggc

SEQ ID NO: 108615 - RNA, 29 nt, Human
guggacuugugugggaugggugcaggucu

SEQ ID NO: 108616 - RNA, 27 nt, Human
cucuaucuauccaagugauacaauuca

SEQ ID NO: 108617 - RNA, 26 nt, Human
uguccugcuuaggggaaggugauugg

SEQ ID NO: 108618 - RNA, 23 nt, Human
uuccuucccaauaggugaucuua

SEQ ID NO: 108619 - RNA, 23 nt, Human
ccccaccucccucacuucacugc

SEQ ID NO: 108620 - RNA, 25 nt, Human
gaggaaagagaauggauuuauagcu

SEQ ID NO: 108621 - RNA, 23 nt, Human
gggcaggggucccugagcuguuc

SEQ ID NO: 108622 - RNA, 26 nt, Human
guuguccugaauucuacauuauuaga

SEQ ID NO: 108623 - RNA, 23 nt, Human
agaggaucuaauuugcagaggaa

SEQ ID NO: 108624 - RNA, 23 nt, Human
acugaacauuaaauaauugguua

SEQ ID NO: 108625 - RNA, 23 nt, Human
acagauugaggagacacuggacu

SEQ ID NO: 108626 - RNA, 23 nt, Human
ucauaauugccaaagcaguauuu

SEQ ID NO: 108627 - RNA, 26 nt, Human
uacaaaccaagagcuuuuacagaucc

SEQ ID NO: 108628 - RNA, 22 nt, Human
agaagcagcaguggcagcuugg

SEQ ID NO: 108629 - RNA, 18 nt, Human
agcacccgggcucaggga

SEQ ID NO: 108630 - RNA, 24 nt, Human
ugcccggugccaucuuccauaucc

SEQ ID NO: 108631 - RNA, 25 nt, Human
cuuguucuucagcaagaauguguca

SEQ ID NO: 108632 - RNA, 24 nt, Human
guuccuuuucuuguguuaauguac

SEQ ID NO: 108633 - RNA, 21 nt, Human
cacugcacugcagccugggug

SEQ ID NO: 108634 - RNA, 22 nt, Human
caccuuguucucuucugcucua

SEQ ID NO: 108635 - RNA, 22 nt, Human
cugacucucugguuuagugcuc

SEQ ID NO: 108636 - RNA, 23 nt, Human
uugcaaccucagccucgcuaugg

SEQ ID NO: 108637 - RNA, 27 nt, Human
gggagagaggaguagccccucagacuc

SEQ ID NO: 108638 - RNA, 26 nt, Human
uggagaugagaacuucuccuggaagc

SEQ ID NO: 108639 - RNA, 19 nt, Human
acauaaucacuccaugcgg

SEQ ID NO: 108640 - RNA, 22 nt, Human
guccucucccccgccccacccc

SEQ ID NO: 108641 - RNA, 22 nt, Human
ggcuaaauuuuguauuuuuagg

SEQ ID NO: 108642 - RNA, 27 nt, Human
acaaacacaucguucgcuguuaguguc

SEQ ID NO: 108643 - RNA, 23 nt, Human
gccaagaccagccuuuuuacuca

SEQ ID NO: 108644 - RNA, 22 nt, Human
guagaaucugaacacacugagg

SEQ ID NO: 108645 - RNA, 21 nt, Human
caauauacuaggucugccuuc

SEQ ID NO: 108646 - RNA, 28 nt, Human
acaggcccucccagcagcuuugccgccu

SEQ ID NO: 108647 - RNA, 24 nt, Human
ccugcucuccugccaucauggauu

SEQ ID NO: 108648 - RNA, 23 nt, Human
aauucagaggcgaggagauucug

SEQ ID NO: 108649 - RNA, 26 nt, Human
ggccuggaguaugagcucagcagaug

SEQ ID NO: 108650 - RNA, 23 nt, Human
auugcccaggcuggucuugaacc

SEQ ID NO: 108651 - RNA, 30 nt, Human
ccucagccucuccccugccugcccugguga

SEQ ID NO: 108652 - RNA, 27 nt, Human
cucagccaacagagauuguugauuugc

SEQ ID NO: 108653 - RNA, 23 nt, Human
uugcccaggaacuuagggugggu

SEQ ID NO: 108654 - RNA, 22 nt, Human
gcaagggcaggggucccugagc

SEQ ID NO: 108655 - RNA, 22 nt, Human
cagcuagucucuucucuucugu

SEQ ID NO: 108656 - RNA, 26 nt, Human
ccucagaaagggaaagaguuccaugg

SEQ ID NO: 108657 - RNA, 21 nt, Human
cucuuaugggcuucuaauuuu

SEQ ID NO: 108658 - RNA, 26 nt, Human
agccuugacaaacccaggcgcacugu

SEQ ID NO: 108659 - RNA, 21 nt, Human
ucuguaauccuagcacugugg

SEQ ID NO: 108660 - RNA, 21 nt, Human
aaugccagcuuucagacagag

SEQ ID NO: 108661 - RNA, 25 nt, Human
gcccuccacuccagcucugagaccc

SEQ ID NO: 108662 - RNA, 24 nt, Human
uggacagcagcuucccaucuggcc

SEQ ID NO: 108663 - RNA, 26 nt, Human
ucccugggagaaaggcgcugagcgug

SEQ ID NO: 108664 - RNA, 20 nt, Human
cuucccuucccacccagcug

SEQ ID NO: 108665 - RNA, 27 nt, Human
ccaggaagaguucuauccccaagcugg

SEQ ID NO: 108666 - RNA, 25 nt, Human
ccucuauggacuccaagacugacac

SEQ ID NO: 108667 - RNA, 22 nt, Human
gcaaucaggaaagcagcagccc

SEQ ID NO: 108668 - RNA, 23 nt, Human
agccuuuauugguaaauucuggu

SEQ ID NO: 108669 - RNA, 22 nt, Human
ccaggcuccuguggugcugcug

SEQ ID NO: 108670 - RNA, 19 nt, Human
gucacccaagcucuguuca

SEQ ID NO: 108671 - RNA, 21 nt, Human
cuacaguggcacaucaaccca

SEQ ID NO: 108672 - RNA, 22 nt, Human
caugccuauaaucccagcacuu

SEQ ID NO: 108673 - RNA, 24 nt, Human
ccuccgggucuuccuacucuucuc

SEQ ID NO: 108674 - RNA, 22 nt, Human
aggguuuuaccauguuggccag

SEQ ID NO: 108675 - RNA, 27 nt, Human
acuggguggggugaggaccacuccuua

SEQ ID NO: 108676 - RNA, 22 nt, Human
uuccuuugaacaaaggucuucu

SEQ ID NO: 108677 - RNA, 22 nt, Human
ccaaguagcugagacuacaggu

SEQ ID NO: 108678 - RNA, 21 nt, Human
gccuguaucccagcacuuugg

SEQ ID NO: 108679 - RNA, 22 nt, Human
gcucacugcagccucgaacucc

SEQ ID NO: 108680 - RNA, 25 nt, Human
aagaacauaaauguaaguuuauuac

SEQ ID NO: 108681 - RNA, 24 nt, Human
cccagcccacacauuguaccaucu

SEQ ID NO: 108682 - RNA, 28 nt, Human
aggcagugccucacaaagaaauuaagaa

SEQ ID NO: 108683 - RNA, 22 nt, Human
ucuguguuccuccuuaacauca

SEQ ID NO: 108684 - RNA, 20 nt, Human
auauauuuucuuucucuucc

SEQ ID NO: 108685 - RNA, 20 nt, Human
acucugcccaugugucagga

SEQ ID NO: 108686 - RNA, 24 nt, Human
ccugccugaacagcccucucucuc

SEQ ID NO: 108687 - RNA, 24 nt, Human
caguccugcugcaguugugcagca

SEQ ID NO: 108688 - RNA, 26 nt, Human
cccaaguagcuaggaccaggugcgcg

SEQ ID NO: 108689 - RNA, 27 nt, Human
gccuggcacagugucugguacauuugu

SEQ ID NO: 108690 - RNA, 23 nt, Human
ucccugcacacacauacacagau

SEQ ID NO: 108691 - RNA, 27 nt, Human
cagucacaaacggguccuggcagugag

SEQ ID NO: 108692 - RNA, 23 nt, Human
acuaccucugugccuugccacau

SEQ ID NO: 108693 - RNA, 25 nt, Human
ccugcacacuugguccauccauuuc

SEQ ID NO: 108694 - RNA, 22 nt, Human
auuuucgguauauuuguauuua

SEQ ID NO: 108695 - RNA, 22 nt, Human
uaagggagaaaccagaagaauu

SEQ ID NO: 108696 - RNA, 25 nt, Human
ggccucggggcuccugguggcagca

SEQ ID NO: 108697 - RNA, 21 nt, Human
ucucccaccacaagcccagag

SEQ ID NO: 108698 - RNA, 28 nt, Human
agaccuucagggccagagcccuggcgga

SEQ ID NO: 108699 - RNA, 23 nt, Human
uagugucaguacuaaggugacuu

SEQ ID NO: 108700 - RNA, 20 nt, Human
gguccgcccauuacuccuug

SEQ ID NO: 108701 - RNA, 27 nt, Human
acugacacauagaguaacuucuaguuc

SEQ ID NO: 108702 - RNA, 19 nt, Human
uccagaaaggagagcuuag

SEQ ID NO: 108703 - RNA, 22 nt, Human
acgaucuuggcucacugcaacc

SEQ ID NO: 108704 - RNA, 21 nt, Human
ucucauggcucgcacagggug

SEQ ID NO: 108705 - RNA, 24 nt, Human
agggugaggacuucacaauguugg

SEQ ID NO: 108706 - RNA, 22 nt, Human
uaccuguucugcuucaccagga

SEQ ID NO: 108707 - RNA, 22 nt, Human
cucuguggggcugaauugccag

SEQ ID NO: 108708 - RNA, 25 nt, Human
ccacccuggcuggaggaacugggug

SEQ ID NO: 108709 - RNA, 22 nt, Human
gcaggcccagccuccacucucc

SEQ ID NO: 108710 - RNA, 21 nt, Human
cuuucucucugacuauacuua

SEQ ID NO: 108711 - RNA, 22 nt, Human
uucccugacacauaucuugaau

SEQ ID NO: 108712 - RNA, 21 nt, Human
cuucucuggaaccucaggacc

SEQ ID NO: 108713 - RNA, 20 nt, Human
ugguucucugggccucaguu

SEQ ID NO: 108714 - RNA, 23 nt, Human
gauuacacuccagccugagucag

SEQ ID NO: 108715 - RNA, 20 nt, Human
aggaacccuccagaccucca

SEQ ID NO: 108716 - RNA, 27 nt, Human
gucagcagguucaaauugguuucacag

SEQ ID NO: 108717 - RNA, 23 nt, Human
cagcucaucaccuucaccugccu

SEQ ID NO: 108718 - RNA, 19 nt, Human
agcuccuuuacaaaaaaga

SEQ ID NO: 108719 - RNA, 19 nt, Human
caguucugcaaaaaugacc

SEQ ID NO: 108720 - RNA, 21 nt, Human
cuccgugcucuccugccucca

SEQ ID NO: 108721 - RNA, 26 nt, Human
cuacuuccaucccugcuuauuuuuaa

SEQ ID NO: 108722 - RNA, 25 nt, Human
ucuucucucugugcuggugggggcc

SEQ ID NO: 108723 - RNA, 20 nt, Human
gcauuugcaaaaugugcaaa

SEQ ID NO: 108724 - RNA, 20 nt, Human
augagauaccuggcauuuug

SEQ ID NO: 108725 - RNA, 23 nt, Human
cucugccagauccugagacgcuu

SEQ ID NO: 108726 - RNA, 23 nt, Human
ccaugagacacggcuugcagugg

SEQ ID NO: 108727 - RNA, 23 nt, Human
ugccuguaguuccagcuacuugg

SEQ ID NO: 108728 - RNA, 22 nt, Human
caggaagcggagguugugguga

SEQ ID NO: 108729 - RNA, 22 nt, Human
gagcccacagacagagcuguau

SEQ ID NO: 108730 - RNA, 20 nt, Human
ugggcagcauuccuccccag

SEQ ID NO: 108731 - RNA, 21 nt, Human
cugggagguggaguugcagug

SEQ ID NO: 108732 - RNA, 25 nt, Human
ugaggcaccccacuuccagugaaga

SEQ ID NO: 108733 - RNA, 22 nt, Human
ugcguuccaugaugcugggauu

SEQ ID NO: 108734 - RNA, 24 nt, Human
cuuugcagauaucuggaguguuuu

SEQ ID NO: 108735 - RNA, 21 nt, Human
gcaagcucggccuccuggguu

SEQ ID NO: 108736 - RNA, 20 nt, Human
cucuuucgccaccuucccca

SEQ ID NO: 108737 - RNA, 22 nt, Human
aaggucagguuaucugcuuuca

SEQ ID NO: 108738 - RNA, 26 nt, Human
caggcagcacccagguuuugcacucu

SEQ ID NO: 108739 - RNA, 23 nt, Human
ggcaaagugggagggagcugggg

SEQ ID NO: 108740 - RNA, 20 nt, Human
aggaagggggguugcagugg

SEQ ID NO: 108741 - RNA, 27 nt, Human
gccuguuuucuuuauuaguccaaagga

SEQ ID NO: 108742 - RNA, 23 nt, Human
gcgugggcucagcagggcugguc

SEQ ID NO: 108743 - RNA, 21 nt, Human
ugcucaaaaccagaaaaagaa

SEQ ID NO: 108744 - RNA, 26 nt, Human
cuccuuagcagcauuccaucuucccg

SEQ ID NO: 108745 - RNA, 22 nt, Human
ucugcagcuugccacaucagcu

SEQ ID NO: 108746 - RNA, 27 nt, Human
uuggggggcuggaguggguagaguauu

SEQ ID NO: 108747 - RNA, 25 nt, Human
caccacuacuccagcccagaaggaa

SEQ ID NO: 108748 - RNA, 22 nt, Human
gcaggcaggggagacucacaga

SEQ ID NO: 108749 - RNA, 23 nt, Human
acuguucuuguccccuuuuuuag

SEQ ID NO: 108750 - RNA, 21 nt, Human
ucauccaggcuggagugcggu

SEQ ID NO: 108751 - RNA, 21 nt, Human
ucguccaggcuggagugcagu

SEQ ID NO: 108752 - RNA, 32 nt, Human
ggacuccaaagguggagguugcaguaagcuga

SEQ ID NO: 108753 - RNA, 21 nt, Human
aacaacaaauuggccucuucc

SEQ ID NO: 108754 - RNA, 23 nt, Human
ucugcagcuucacuccugaagcc

SEQ ID NO: 108755 - RNA, 23 nt, Human
agagacacacugaagaagcacca

SEQ ID NO: 108756 - RNA, 21 nt, Human
cugaguccuggcccuccuggg

SEQ ID NO: 108757 - RNA, 26 nt, Human
ggaaagugccugguaggacugacggc

SEQ ID NO: 108758 - RNA, 19 nt, Human
accacaagacagacuugca

SEQ ID NO: 108759 - RNA, 25 nt, Human
aggagccuaagacagaaaugacaga

SEQ ID NO: 108760 - RNA, 22 nt, Human
uggccaucauggugaaacccca

SEQ ID NO: 108761 - RNA, 24 nt, Human
uauuugacuguguacauucuuaug

SEQ ID NO: 108762 - RNA, 24 nt, Human
ggggaugagugcagggcagaggug

SEQ ID NO: 108763 - RNA, 27 nt, Human
ugcuuagcuccccucacccugcacuga

SEQ ID NO: 108764 - RNA, 20 nt, Human
caaaauuaccaaauucuuaa

SEQ ID NO: 108765 - RNA, 17 nt, Human
cccucauuucagucucc

SEQ ID NO: 108766 - RNA, 21 nt, Human
uccacugagaacagucuguaa

SEQ ID NO: 108767 - RNA, 27 nt, Human
acacuccugccugcuguuccugacuac

SEQ ID NO: 108768 - RNA, 26 nt, Human
cugccuggaugugcagcuggcaacag

SEQ ID NO: 108769 - RNA, 22 nt, Human
uagccucuuuguguuuuuguug

SEQ ID NO: 108770 - RNA, 23 nt, Human
cuuuggggucagccagggccagg

SEQ ID NO: 108771 - RNA, 20 nt, Human
gcucaggacagggcugagga

SEQ ID NO: 108772 - RNA, 27 nt, Human
gcucucuuguccaggcuggagugcaau

SEQ ID NO: 108773 - RNA, 21 nt, Human
guuccucccugccccuugcca

SEQ ID NO: 108774 - RNA, 18 nt, Human
ccuccugccaaggcucuu

SEQ ID NO: 108775 - RNA, 22 nt, Human
agcacaugcaggcuccugguug

SEQ ID NO: 108776 - RNA, 24 nt, Human
uugcugaccagcuggagugagggc

SEQ ID NO: 108777 - RNA, 23 nt, Human
cgcccaggcuggagcuggccccg

SEQ ID NO: 108778 - RNA, 22 nt, Human
ucagaggagcaggaccagggag

SEQ ID NO: 108779 - RNA, 23 nt, Human
ggcgguaccuugugcccaggguu

SEQ ID NO: 108780 - RNA, 20 nt, Human
uguuguaaaaaaucuuuuug

SEQ ID NO: 108781 - RNA, 22 nt, Human
gcuguuuucuuccuccucuaua

SEQ ID NO: 108782 - RNA, 24 nt, Human
gcugccuccagcccgggccugugu

SEQ ID NO: 108783 - RNA, 23 nt, Human
aagccuccucccaggugcuugcc

SEQ ID NO: 108784 - RNA, 23 nt, Human
uagaaugaucauguauuuauaaa

SEQ ID NO: 108785 - RNA, 27 nt, Human
aauggcuggauuccucuguguucuuuc

SEQ ID NO: 108786 - RNA, 31 nt, Human
ugcuguuccaccuccccucagacuagcuuuc

SEQ ID NO: 108787 - RNA, 24 nt, Human
aagaaauguauaaauaaaaucuac

SEQ ID NO: 108788 - RNA, 19 nt, Human
ucuggggguggugggcagg

SEQ ID NO: 108789 - RNA, 21 nt, Human
gcgcccagggaggagucagua

SEQ ID NO: 108790 - RNA, 20 nt, Human
gugcaggccacaccagucug

SEQ ID NO: 108791 - RNA, 22 nt, Human
accucagccucccgaauagcug

SEQ ID NO: 108792 - RNA, 21 nt, Human
gcgggagcuccaccuccucgg

SEQ ID NO: 108793 - RNA, 22 nt, Human
ccuccauccagccuggcgucca

SEQ ID NO: 108794 - RNA, 21 nt, Human
accuguaaucccagcacuuug

SEQ ID NO: 108795 - RNA, 19 nt, Human
uaauugccccugcaccuuu

SEQ ID NO: 108796 - RNA, 22 nt, Human
acuccugaguugguugccucuc

SEQ ID NO: 108797 - RNA, 18 nt, Human
aucaaacuagaccaauga

SEQ ID NO: 108798 - RNA, 23 nt, Human
ucucgaauuccugaccucaggug

SEQ ID NO: 108799 - RNA, 28 nt, Human
cuggauuguccuuggaggaaacuuaaga

SEQ ID NO: 108800 - RNA, 23 nt, Human
ucugucugcaggcugucucucca

SEQ ID NO: 108801 - RNA, 26 nt, Human
uugaguuuaagucucugacucuugcc

SEQ ID NO: 108802 - RNA, 21 nt, Human
gagcccggccgagugcagcug

SEQ ID NO: 108803 - RNA, 21 nt, Human
aacucugcuuuuggucuugcu

SEQ ID NO: 108804 - RNA, 21 nt, Human
ccuuuucuauaacacucugaa

SEQ ID NO: 108805 - RNA, 20 nt, Human
aauuguauuugccuucucca

SEQ ID NO: 108806 - RNA, 27 nt, Human
acacaguauacacauacacaagugcac

SEQ ID NO: 108807 - RNA, 22 nt, Human
ucucuuugcaacuccuguaaua

SEQ ID NO: 108808 - RNA, 16 nt, Human
uuuuucuuaccuauca

SEQ ID NO: 108809 - RNA, 24 nt, Human
gggcugcaccucugccuugcacuu

SEQ ID NO: 108810 - RNA, 22 nt, Human
cugcauccggacccucucccca

SEQ ID NO: 108811 - RNA, 27 nt, Human
agggaaagacugaaagagaaagauagg

SEQ ID NO: 108812 - RNA, 26 nt, Human
gggccccacagacaaaagcgcuuuuc

SEQ ID NO: 108813 - RNA, 20 nt, Human
cuaagcugggccacaaccgc

SEQ ID NO: 108814 - RNA, 22 nt, Human
aaguagcugcaacaacaggcac

SEQ ID NO: 108815 - RNA, 20 nt, Human
uagcccugcagacaaaagcu

SEQ ID NO: 108816 - RNA, 23 nt, Human
guuacuugucauuucuacuuuca

SEQ ID NO: 108817 - RNA, 27 nt, Human
uggggggugccuggugaugaggagggg

SEQ ID NO: 108818 - RNA, 26 nt, Human
ucuccuccuccuucaugcagccagga

SEQ ID NO: 108819 - RNA, 24 nt, Human
ucaguuuauggugaauccaaauca

SEQ ID NO: 108820 - RNA, 23 nt, Human
cucauuucuucaacagauacuua

SEQ ID NO: 108821 - RNA, 26 nt, Human
ucuggcuucucucuugaaugcucacu

SEQ ID NO: 108822 - RNA, 26 nt, Human
aaaccaaacucuuauucucaguggaa

SEQ ID NO: 108823 - RNA, 23 nt, Human
aacacccuucccaggccacuggc

SEQ ID NO: 108824 - RNA, 21 nt, Human
uauucaugcucuuggcaauuu

SEQ ID NO: 108825 - RNA, 27 nt, Human
ccagccccuggccuggaagcaccagga

SEQ ID NO: 108826 - RNA, 26 nt, Human
gacuucguuucuggggcaacugagag

SEQ ID NO: 108827 - RNA, 20 nt, Human
guucacugcaaucucugccu

SEQ ID NO: 108828 - RNA, 21 nt, Human
aggaagagauuugugauagua

SEQ ID NO: 108829 - RNA, 24 nt, Human
agccccugcgccuuuuccuugcuc

SEQ ID NO: 108830 - RNA, 26 nt, Human
ccauauuuccaagucugugguacucc

SEQ ID NO: 108831 - RNA, 21 nt, Human
ugcuaacccauucauaguugg

SEQ ID NO: 108832 - RNA, 20 nt, Human
ucuuguucagaagcagccag

SEQ ID NO: 108833 - RNA, 21 nt, Human
gcggggagagaggaggagaga

SEQ ID NO: 108834 - RNA, 21 nt, Human
cucggcuuuacuccugcccag

SEQ ID NO: 108835 - RNA, 22 nt, Human
ccccugagcccgggcgccuggg

SEQ ID NO: 108836 - RNA, 22 nt, Human
gggucaacggcccuguuuauau

SEQ ID NO: 108837 - RNA, 25 nt, Human
cuuugcccuuaguuccacugcucca

SEQ ID NO: 108838 - RNA, 25 nt, Human
cagaugcagccacaguaaggcucca

SEQ ID NO: 108839 - RNA, 22 nt, Human
auccagauugcucacaugugcu

SEQ ID NO: 108840 - RNA, 22 nt, Human
aggaagagcugggccuuuggca

SEQ ID NO: 108841 - RNA, 26 nt, Human
gggggcuguguguggcuggaccaggu

SEQ ID NO: 108842 - RNA, 19 nt, Human
uccaugccuuccuuucucc

SEQ ID NO: 108843 - RNA, 23 nt, Human
gccacccauggcugcaguggagg

SEQ ID NO: 108844 - RNA, 19 nt, Human
ucuccaggugcuguuacuc

SEQ ID NO: 108845 - RNA, 25 nt, Human
guggaggcaggcuuaaguucagucc

SEQ ID NO: 108846 - RNA, 20 nt, Human
acuccucugccaaagauccc

SEQ ID NO: 108847 - RNA, 25 nt, Human
agcugguggccuucaaccucugccu

SEQ ID NO: 108848 - RNA, 26 nt, Human
acacacacuucuuccagggccucugg

SEQ ID NO: 108849 - RNA, 26 nt, Human
gggguaggacccacagaugucuugga

SEQ ID NO: 108850 - RNA, 26 nt, Human
gggaccccucugcgugcaccccugua

SEQ ID NO: 108851 - RNA, 25 nt, Human
ccugcagcccuccagacuuccugcc

SEQ ID NO: 108852 - RNA, 25 nt, Human
ccccucccuucucaccucuggagcu

SEQ ID NO: 108853 - RNA, 18 nt, Human
auuuacacugaauuccaa

SEQ ID NO: 108854 - RNA, 17 nt, Human
gaugccuucucucucca

SEQ ID NO: 108855 - RNA, 23 nt, Human
gauucccagccucacucccucug

SEQ ID NO: 108856 - RNA, 23 nt, Human
ggaaggaggcaggcugugguggg

SEQ ID NO: 108857 - RNA, 21 nt, Human
guuuuuucuucagccuccucu

SEQ ID NO: 108858 - RNA, 24 nt, Human
uugcccagucuucagcggagcagu

SEQ ID NO: 108859 - RNA, 19 nt, Human
cacuacaagcucugccucc

SEQ ID NO: 108860 - RNA, 22 nt, Human
caugaaaccaaaaagagacuga

SEQ ID NO: 108861 - RNA, 21 nt, Human
aaccaguaccucuguauagaa

SEQ ID NO: 108862 - RNA, 27 nt, Human
ugggacccccuccccgcccuucuuuug

SEQ ID NO: 108863 - RNA, 22 nt, Human
gcaccgccggcuuucagggcag

SEQ ID NO: 108864 - RNA, 24 nt, Human
ugaggugggagguuggagagccag

SEQ ID NO: 108865 - RNA, 24 nt, Human
aucucaaggagcuuuaaagucuua

SEQ ID NO: 108866 - RNA, 27 nt, Human
uuuaaggcccaccccaaguccagaaug

SEQ ID NO: 108867 - RNA, 20 nt, Human
aaguggugccuucagcacag

SEQ ID NO: 108868 - RNA, 24 nt, Human
gaccagccugugaccucucaguca

SEQ ID NO: 108869 - RNA, 20 nt, Human
gaauagucuucauguuucca

SEQ ID NO: 108870 - RNA, 27 nt, Human
cagguccugcuccgcugccuggaacac

SEQ ID NO: 108871 - RNA, 19 nt, Human
ccaggcccaggagaucagu

SEQ ID NO: 108872 - RNA, 27 nt, Human
cuucugcugacucucaacuuuuccugg

SEQ ID NO: 108873 - RNA, 21 nt, Human
ucacuggagacugaacacuag

SEQ ID NO: 108874 - RNA, 23 nt, Human
ugagcugagauugcacuccagcc

SEQ ID NO: 108875 - RNA, 21 nt, Human
uccuguuuggauuagaccaua

SEQ ID NO: 108876 - RNA, 22 nt, Human
caguucguggaauuuugcccau

SEQ ID NO: 108877 - RNA, 22 nt, Human
gugugcuuucucacaacggggu

SEQ ID NO: 108878 - RNA, 27 nt, Human
ucuccacaaauuccaucaucgagaaga

SEQ ID NO: 108879 - RNA, 23 nt, Human
agccuccuugcuucucucugucc

SEQ ID NO: 108880 - RNA, 19 nt, Human
uggcaaaaacagacuuccg

SEQ ID NO: 108881 - RNA, 27 nt, Human
gucuggaacuccugggcucaagggauc

SEQ ID NO: 108882 - RNA, 19 nt, Human
agcacuaucuguacuccaa

SEQ ID NO: 108883 - RNA, 22 nt, Human
acaguuuuauuuuccauuuuuc

SEQ ID NO: 108884 - RNA, 21 nt, Human
uaaaacugaaaacuaccuggg

SEQ ID NO: 108885 - RNA, 27 nt, Human
ccuucauuccucauagguacugggaag

SEQ ID NO: 108886 - RNA, 22 nt, Human
caaguguuuuuacaucaucuca

SEQ ID NO: 108887 - RNA, 22 nt, Human
agagacugagagugagcaacca

SEQ ID NO: 108888 - RNA, 22 nt, Human
gucauuuuucuuucaaaauugc

SEQ ID NO: 108889 - RNA, 25 nt, Human
ggagguggcggcgggcagaggugau

SEQ ID NO: 108890 - RNA, 22 nt, Human
ccugcagccuccuguacccgcc

SEQ ID NO: 108891 - RNA, 22 nt, Human
ggacuccuccuguccugggccg

SEQ ID NO: 108892 - RNA, 26 nt, Human
uuacugaggggggagugcagcaguug

SEQ ID NO: 108893 - RNA, 23 nt, Human
auuguucugcugaucuguagugg

SEQ ID NO: 108894 - RNA, 22 nt, Human
cugggcugggcacacuccaccu

SEQ ID NO: 108895 - RNA, 28 nt, Human
cucugcuuucaaaacaaaaagagauugg

SEQ ID NO: 108896 - RNA, 20 nt, Human
cagccucccuuugccagcca

SEQ ID NO: 108897 - RNA, 30 nt, Human
ccugcugggacccugaucugggccuuccug

SEQ ID NO: 108898 - RNA, 17 nt, Human
gcagcagccucugaggu

SEQ ID NO: 108899 - RNA, 27 nt, Human
ucugucuggcccuaaauguauccaugu

SEQ ID NO: 108900 - RNA, 24 nt, Human
acccacacugagaccaccugcccc

SEQ ID NO: 108901 - RNA, 23 nt, Human
uagguaguagaaucucagcacuu

SEQ ID NO: 108902 - RNA, 26 nt, Human
cauggccgccucggcgccgcccccac

SEQ ID NO: 108903 - RNA, 27 nt, Human
cccugcuccucucccagagggcacugc

SEQ ID NO: 108904 - RNA, 21 nt, Human
uccuuucucucaggcagugca

SEQ ID NO: 108905 - RNA, 22 nt, Human
ucacuccgccuucuccugggcu

SEQ ID NO: 108906 - RNA, 21 nt, Human
ccucccacuucccagccgcag

SEQ ID NO: 108907 - RNA, 22 nt, Human
ugucuaaagguagaugcaaauu

SEQ ID NO: 108908 - RNA, 23 nt, Human
ggacaaauggggacuuugccacc

SEQ ID NO: 108909 - RNA, 23 nt, Human
acacagcccaaccuauagugccc

SEQ ID NO: 108910 - RNA, 23 nt, Human
ggagggagagagauguacuuuuu

SEQ ID NO: 108911 - RNA, 25 nt, Human
cccugcaggagccccaucuugucgc

SEQ ID NO: 108912 - RNA, 22 nt, Human
cagacucccucauuuuaccauc

SEQ ID NO: 108913 - RNA, 21 nt, Human
gcacuaagggcugugccugag

SEQ ID NO: 108914 - RNA, 26 nt, Human
acucacugcauuuggggccuuuccca

SEQ ID NO: 108915 - RNA, 27 nt, Human
ucugggaagugcccuuucucucuuagg

SEQ ID NO: 108916 - RNA, 22 nt, Human
ggaaacgcagugagacugugcc

SEQ ID NO: 108917 - RNA, 19 nt, Human
cacccaggcacugggcaag

SEQ ID NO: 108918 - RNA, 22 nt, Human
uuugccuuuugaaaucacugua

SEQ ID NO: 108919 - RNA, 23 nt, Human
auaagaaaauucauacuuggaga

SEQ ID NO: 108920 - RNA, 21 nt, Human
uuuuccuguguggucuuuggg

SEQ ID NO: 108921 - RNA, 23 nt, Human
gaaaugagagauuaggagcuggg

SEQ ID NO: 108922 - RNA, 21 nt, Human
uugucugggguggguggagug

SEQ ID NO: 108923 - RNA, 22 nt, Human
cgugacugauuucaaagcccgg

SEQ ID NO: 108924 - RNA, 32 nt, Human
ucauuaaccuugcacccaucucuuuagauggc

SEQ ID NO: 108925 - RNA, 22 nt, Human
uuccgcccaggcugcagugcag

SEQ ID NO: 108926 - RNA, 21 nt, Human
uucaaagcuuccucuggccag

SEQ ID NO: 108927 - RNA, 21 nt, Human
cgggagauggcgcuugcagug

SEQ ID NO: 108928 - RNA, 18 nt, Human
acuauuguuaugcuuuau

SEQ ID NO: 108929 - RNA, 23 nt, Human
gguucugacaguacgaugagcug

SEQ ID NO: 108930 - RNA, 22 nt, Human
agaacacuugcucuucugugau

SEQ ID NO: 108931 - RNA, 22 nt, Human
ggcucacugcaacuucuaccuc

SEQ ID NO: 108932 - RNA, 22 nt, Human
ccaccugccaaucacagcuuua

SEQ ID NO: 108933 - RNA, 22 nt, Human
caggcuggagugcuauggugca

SEQ ID NO: 108934 - RNA, 21 nt, Human
uccugugggguguagguucuc

SEQ ID NO: 108935 - RNA, 22 nt, Human
acuuuuuugauguauuuuuugu

SEQ ID NO: 108936 - RNA, 24 nt, Human
agacaaccacauggucaggcucuu

SEQ ID NO: 108937 - RNA, 24 nt, Human
uugcacagaaaguuucugucuuua

SEQ ID NO: 108938 - RNA, 26 nt, Human
gcaggagcagacgcaccugacuuuuu

SEQ ID NO: 108939 - RNA, 27 nt, Human
auggagcaagugagcacugagggucug

SEQ ID NO: 108940 - RNA, 22 nt, Human
ccugcagcgacucggacccgcu

SEQ ID NO: 108941 - RNA, 22 nt, Human
ggucccugccuggccagugggg

SEQ ID NO: 108942 - RNA, 21 nt, Human
ugaggguggucacaccugagc

SEQ ID NO: 108943 - RNA, 20 nt, Human
cagucuucggguuucaccuc

SEQ ID NO: 108944 - RNA, 20 nt, Human
gcccuaagagacacugccuu

SEQ ID NO: 108945 - RNA, 29 nt, Human
gcacguuucaagcucaucaguaaagguuc

SEQ ID NO: 108946 - RNA, 20 nt, Human
aggcugccacugccccugau

SEQ ID NO: 108947 - RNA, 24 nt, Human
uacggcuacacugggccuaggugu

SEQ ID NO: 108948 - RNA, 24 nt, Human
ucccagccugggggccagugggga

SEQ ID NO: 108949 - RNA, 22 nt, Human
cgccuguaaucccagcacuggg

SEQ ID NO: 108950 - RNA, 23 nt, Human
ggccuaaagccagcauuuccuca

SEQ ID NO: 108951 - RNA, 21 nt, Human
aggaguuugaggcugcaguga

SEQ ID NO: 108952 - RNA, 29 nt, Human
auaggguuugcucugacaauuuuuaaagc

SEQ ID NO: 108953 - RNA, 28 nt, Human
aggugccucagagagagacaagucugga

SEQ ID NO: 108954 - RNA, 23 nt, Human
ucuuacagcagggugucucucca

SEQ ID NO: 108955 - RNA, 22 nt, Human
cuagcuuccugugcccuuucau

SEQ ID NO: 108956 - RNA, 21 nt, Human
cgucucucaucccugccucau

SEQ ID NO: 108957 - RNA, 25 nt, Human
acccaggcuggaguggaguggcacg

SEQ ID NO: 108958 - RNA, 22 nt, Human
gaacuccugggcucaagagauc

SEQ ID NO: 108959 - RNA, 25 nt, Human
gcgcaggugcaggcacagggccacu

SEQ ID NO: 108960 - RNA, 21 nt, Human
aaaugauucacagcucuggca

SEQ ID NO: 108961 - RNA, 20 nt, Human
aagaguauuuuaagaagaca

SEQ ID NO: 108962 - RNA, 20 nt, Human
cuguagcaaggcuugauagc

SEQ ID NO: 108963 - RNA, 24 nt, Human
ugagcccuguuugggcucaggaga

SEQ ID NO: 108964 - RNA, 22 nt, Human
ugccuguuucucucugugucuc

SEQ ID NO: 108965 - RNA, 26 nt, Human
acauccuugugugggcccauccucug

SEQ ID NO: 108966 - RNA, 21 nt, Human
acagagugagacuccaucuca

SEQ ID NO: 108967 - RNA, 23 nt, Human
ugagggagggaauagaaaggggc

SEQ ID NO: 108968 - RNA, 21 nt, Human
caguucuauaaaugugcucag

SEQ ID NO: 108969 - RNA, 23 nt, Human
gcugggcacgguggcucacagcu

SEQ ID NO: 108970 - RNA, 21 nt, Human
cuggcuucuuucucucagccu

SEQ ID NO: 108971 - RNA, 27 nt, Human
ccucucuucccagcacuucccugccuc

SEQ ID NO: 108972 - RNA, 19 nt, Human
ugccggggccuccccaccg

SEQ ID NO: 108973 - RNA, 27 nt, Human
gcaccgacuggagaggaaggcaacaga

SEQ ID NO: 108974 - RNA, 20 nt, Human
ccacagauuuccucucuaaa

SEQ ID NO: 108975 - RNA, 25 nt, Human
cuccacguguuuuuccauccaauca

SEQ ID NO: 108976 - RNA, 25 nt, Human
aagagccucuuguaacaaguauuca

SEQ ID NO: 108977 - RNA, 21 nt, Human
uagcuagcccacccugugcua

SEQ ID NO: 108978 - RNA, 26 nt, Human
gcucuguccuacuuacagcacuuugg

SEQ ID NO: 108979 - RNA, 18 nt, Human
caccuucccuucuuccca

SEQ ID NO: 108980 - RNA, 24 nt, Human
cacccuuguauccugggucuuaga

SEQ ID NO: 108981 - RNA, 22 nt, Human
ggagagagaaggaaggaggugg

SEQ ID NO: 108982 - RNA, 21 nt, Human
ucacuagcucgcuuucuugcu

SEQ ID NO: 108983 - RNA, 25 nt, Human
ccaauccuaugucauuucuacuuug

SEQ ID NO: 108984 - RNA, 22 nt, Human
gucacccacuccugggugcgug

SEQ ID NO: 108985 - RNA, 27 nt, Human
gucgggugaggcgcaaaaggauaaaaa

SEQ ID NO: 108986 - RNA, 21 nt, Human
gucaggccagcguccuccucc

SEQ ID NO: 108987 - RNA, 23 nt, Human
acauuuaugccucccuuuugugu

SEQ ID NO: 108988 - RNA, 24 nt, Human
ggcagaagcuccaccugugcuacc

SEQ ID NO: 108989 - RNA, 27 nt, Human
uguccccagggaugaagugggucccgg

SEQ ID NO: 108990 - RNA, 22 nt, Human
ugcccagaugccaucacauccc

SEQ ID NO: 108991 - RNA, 25 nt, Human
cuggacuuccaccuccagugccaga

SEQ ID NO: 108992 - RNA, 22 nt, Human
gacuggucagcuacuuccuccu

SEQ ID NO: 108993 - RNA, 24 nt, Human
guauacagaccaggugagagcccu

SEQ ID NO: 108994 - RNA, 21 nt, Human
uccgaaacuucacacagggug

SEQ ID NO: 108995 - RNA, 26 nt, Human
aaggacagauguguuuacaagggagg

SEQ ID NO: 108996 - RNA, 26 nt, Human
acaaguccuuguaaagcucacuccuc

SEQ ID NO: 108997 - RNA, 27 nt, Human
aaaugcacaaaaucuguacaugucucc

SEQ ID NO: 108998 - RNA, 24 nt, Human
cccacacucgccaucuccugggcc

SEQ ID NO: 108999 - RNA, 23 nt, Human
ccccugcuugcagucugcaagga

SEQ ID NO: 109000 - RNA, 24 nt, Human
auugcccaggaucaagggugcggu

SEQ ID NO: 109001 - RNA, 21 nt, Human
gggaagugcagguugcaguga

SEQ ID NO: 109002 - RNA, 23 nt, Human
aguuugggggaaggggaaucauu

SEQ ID NO: 109003 - RNA, 23 nt, Human
uguaaaauugauuguggggaaga

SEQ ID NO: 109004 - RNA, 22 nt, Human
accagccugggcaacaugguga

SEQ ID NO: 109005 - RNA, 22 nt, Human
accagccuggccaacaugcuga

SEQ ID NO: 109006 - RNA, 24 nt, Human
gucacagaaaauggagaaaacuuc

SEQ ID NO: 109007 - RNA, 21 nt, Human
ucuucccucugagcuucauuu

SEQ ID NO: 109008 - RNA, 23 nt, Human
auaauaucuugaagaauauuguu

SEQ ID NO: 109009 - RNA, 22 nt, Human
uccaaacaaaugaggcaucagu

SEQ ID NO: 109010 - RNA, 21 nt, Human
cccaaggugcuggauuacagg

SEQ ID NO: 109011 - RNA, 23 nt, Human
guuuuauuuuaaaauauuuugug

SEQ ID NO: 109012 - RNA, 27 nt, Human
gccuaucuucucugauagucauggaga

SEQ ID NO: 109013 - RNA, 23 nt, Human
aucauaggucacuucagguagca

SEQ ID NO: 109014 - RNA, 22 nt, Human
uguugaauggugagcacgugac

SEQ ID NO: 109015 - RNA, 24 nt, Human
gggaucugucacaccagccauacu

SEQ ID NO: 109016 - RNA, 24 nt, Human
gcaauacaaauauuucacauuuuu

SEQ ID NO: 109017 - RNA, 26 nt, Human
uuccacccucgugauuguauagggcu

SEQ ID NO: 109018 - RNA, 21 nt, Human
ugcucaguagcuuaagggaau

SEQ ID NO: 109019 - RNA, 22 nt, Human
uguaccuauuccuucagaaaga

SEQ ID NO: 109020 - RNA, 25 nt, Human
uccuaguccugaauuccuuucagaa

SEQ ID NO: 109021 - RNA, 23 nt, Human
gggauaaaaaagggcuugggaga

SEQ ID NO: 109022 - RNA, 22 nt, Human
cuggauuacaggcaugagccac

SEQ ID NO: 109023 - RNA, 19 nt, Human
gguccuuccuugcaaagua

SEQ ID NO: 109024 - RNA, 21 nt, Human
gcugccaaccuuuguguugga

SEQ ID NO: 109025 - RNA, 21 nt, Human
ggggugaggagugucugcugu

SEQ ID NO: 109026 - RNA, 19 nt, Human
agaucuagucuguuacacc

SEQ ID NO: 109027 - RNA, 20 nt, Human
uggagccauuccguagugcc

SEQ ID NO: 109028 - RNA, 29 nt, Human
gccccagcuggacuccagccugucccucu

SEQ ID NO: 109029 - RNA, 26 nt, Human
aggggcuucugugagaggcagagggg

SEQ ID NO: 109030 - RNA, 25 nt, Human
auucuuaugugucuuuugugucuua

SEQ ID NO: 109031 - RNA, 23 nt, Human
cacagauggcuguggaguucaaa

SEQ ID NO: 109032 - RNA, 20 nt, Human
gaucguuucuccagaagagc

SEQ ID NO: 109033 - RNA, 21 nt, Human
accguuuccagauguaauacu

SEQ ID NO: 109034 - RNA, 23 nt, Human
ucucucuuuucuucucaggauuu

SEQ ID NO: 109035 - RNA, 27 nt, Human
ccugccaggaagccagcaggcucucag

SEQ ID NO: 109036 - RNA, 21 nt, Human
gucuucacuuggucugacuug

SEQ ID NO: 109037 - RNA, 24 nt, Human
acugaccuugaugagcugugcaca

SEQ ID NO: 109038 - RNA, 25 nt, Human
cgauccuccugccucagucucucaa

SEQ ID NO: 109039 - RNA, 21 nt, Human
cccaccccccagcccccaccu

SEQ ID NO: 109040 - RNA, 25 nt, Human
gugacugcuuuaugaaaauaauagu

SEQ ID NO: 109041 - RNA, 23 nt, Human
ugagccaaggaaaauacucaugc

SEQ ID NO: 109042 - RNA, 20 nt, Human
ucugcugcuccccagcucuc

SEQ ID NO: 109043 - RNA, 22 nt, Human
auggugccaccacucaagcaac

SEQ ID NO: 109044 - RNA, 27 nt, Human
ugcagcucccgccgcggcuguugcuca

SEQ ID NO: 109045 - RNA, 25 nt, Human
aagaucacaucacugcacuccagcc

SEQ ID NO: 109046 - RNA, 23 nt, Human
ugggauuagcgaagcuguggaga

SEQ ID NO: 109047 - RNA, 20 nt, Human
ccugccugcucugcagucgu

SEQ ID NO: 109048 - RNA, 21 nt, Human
aaccuggugauaaaagcaguu

SEQ ID NO: 109049 - RNA, 20 nt, Human
gugagccagagggagcugug

SEQ ID NO: 109050 - RNA, 29 nt, Human
gcaaauuguggucaaauauacaucacauc

SEQ ID NO: 109051 - RNA, 25 nt, Human
gccucagcuucucaaaguacuggga

SEQ ID NO: 109052 - RNA, 21 nt, Human
cucuccaaaccaguuaguuag

SEQ ID NO: 109053 - RNA, 24 nt, Human
agccccuuucacacucuguccucc

SEQ ID NO: 109054 - RNA, 21 nt, Human
ccuuagacuuuaguaguuugu

SEQ ID NO: 109055 - RNA, 23 nt, Human
auccugccacugaggacuccgaa

SEQ ID NO: 109056 - RNA, 21 nt, Human
ugcuugagggagaauccuccc

SEQ ID NO: 109057 - RNA, 26 nt, Human
aguccccagagugugauauuccccuu

SEQ ID NO: 109058 - RNA, 23 nt, Human
ccuguggcuggacugccugcugc

SEQ ID NO: 109059 - RNA, 23 nt, Human
cucccuccgggucuuccuacucu

SEQ ID NO: 109060 - RNA, 23 nt, Human
ccauauaacuaagacauaugcau

SEQ ID NO: 109061 - RNA, 22 nt, Human
auauucagcaaaaguauuaaug

SEQ ID NO: 109062 - RNA, 24 nt, Human
ccgaguagcugggacuauagaugc

SEQ ID NO: 109063 - RNA, 29 nt, Human
gggcccuccccacccacacccacaggucg

SEQ ID NO: 109064 - RNA, 22 nt, Human
cccugcaggaagcuaaagggcc

SEQ ID NO: 109065 - RNA, 23 nt, Human
uuaagacuugacaguggaacuac

SEQ ID NO: 109066 - RNA, 24 nt, Human
ggcucugccuguggaucgcagucg

SEQ ID NO: 109067 - RNA, 21 nt, Human
ccacagacacacccacgacac

SEQ ID NO: 109068 - RNA, 27 nt, Human
gagacucugccucccuccuccucacug

SEQ ID NO: 109069 - RNA, 21 nt, Human
uccagccucccugcuucccuu

SEQ ID NO: 109070 - RNA, 21 nt, Human
cagcucuaauaaaacagcugu

SEQ ID NO: 109071 - RNA, 24 nt, Human
uucauucuggagucuacuaauuua

SEQ ID NO: 109072 - RNA, 24 nt, Human
gcagaagaguacaaaguguggaag

SEQ ID NO: 109073 - RNA, 20 nt, Human
ggucucccccuucccuucag

SEQ ID NO: 109074 - RNA, 19 nt, Human
ccagaaaggguugcuagcc

SEQ ID NO: 109075 - RNA, 23 nt, Human
uccccacacccuggaguggcaug

SEQ ID NO: 109076 - RNA, 22 nt, Human
ugggagccugaggcaggaggau

SEQ ID NO: 109077 - RNA, 26 nt, Human
guauuucuagaccugcccuucgccug

SEQ ID NO: 109078 - RNA, 22 nt, Human
uuugaaaaguucugccuugccc

SEQ ID NO: 109079 - RNA, 21 nt, Human
ucacugcagccuugacuucuc

SEQ ID NO: 109080 - RNA, 22 nt, Human
ucggccuccucuucaccccggc

SEQ ID NO: 109081 - RNA, 25 nt, Human
ccucccuggccuggcucaaccgagu

SEQ ID NO: 109082 - RNA, 22 nt, Human
ggaggcuaaggugggaggauca

SEQ ID NO: 109083 - RNA, 19 nt, Human
ccaaguccucuucccugcc

SEQ ID NO: 109084 - RNA, 24 nt, Human
ucaaugccacaucagacuuguucc

SEQ ID NO: 109085 - RNA, 19 nt, Human
uuccacugcaaauaaagcc

SEQ ID NO: 109086 - RNA, 21 nt, Human
ugcccaggcuagagugcagug

SEQ ID NO: 109087 - RNA, 21 nt, Human
acucguggcguggggcagcag

SEQ ID NO: 109088 - RNA, 22 nt, Human
agacucccgaauagcugggauu

SEQ ID NO: 109089 - RNA, 22 nt, Human
agccucccgaguagcuggcauu

SEQ ID NO: 109090 - RNA, 22 nt, Human
gcuucuuuauuuuuacacugag

SEQ ID NO: 109091 - RNA, 23 nt, Human
guccgguguccuuuucacuacac

SEQ ID NO: 109092 - RNA, 23 nt, Human
guuggauagggccauggcugguc

SEQ ID NO: 109093 - RNA, 21 nt, Human
gccuuucuauuuacuugaguc

SEQ ID NO: 109094 - RNA, 27 nt, Human
aacacaaaaccauuaauauaauuggca

SEQ ID NO: 109095 - RNA, 22 nt, Human
aaacuccugggcucaagcgauc

SEQ ID NO: 109096 - RNA, 22 nt, Human
cauuccacucagccugggacga

SEQ ID NO: 109097 - RNA, 24 nt, Human
caccugaggucaggaguucaagac

SEQ ID NO: 109098 - RNA, 21 nt, Human
uuguccuggagcaggggcgca

SEQ ID NO: 109099 - RNA, 22 nt, Human
ggucuaacuuguuaugcagcaa

SEQ ID NO: 109100 - RNA, 20 nt, Human
ccguucccugaacauaggaa

SEQ ID NO: 109101 - RNA, 27 nt, Human
ccauccaggcugggaggggaagagugc

SEQ ID NO: 109102 - RNA, 28 nt, Human
cugcuuuaaagggccugccuggccccuc

SEQ ID NO: 109103 - RNA, 26 nt, Human
cuccuggacacaaccagcagcuccug

SEQ ID NO: 109104 - RNA, 22 nt, Human
agaguguguguuugugugugca

SEQ ID NO: 109105 - RNA, 21 nt, Human
aaaugauucugcaacucucuu

SEQ ID NO: 109106 - RNA, 24 nt, Human
agcuuucuuccaaacuccugggcc

SEQ ID NO: 109107 - RNA, 23 nt, Human
uuuuugcaacaacaaaagcauuu

SEQ ID NO: 109108 - RNA, 21 nt, Human
aacaaaaaucacucacaagca

SEQ ID NO: 109109 - RNA, 22 nt, Human
cuggccgagcugaagaacuggg

SEQ ID NO: 109110 - RNA, 26 nt, Human
gcuuugugugucuguuaaaugaaugu

SEQ ID NO: 109111 - RNA, 20 nt, Human
ccuagagaaugcugcagucu

SEQ ID NO: 109112 - RNA, 23 nt, Human
ucuccacuguggugacugggucc

SEQ ID NO: 109113 - RNA, 20 nt, Human
uugugucugugugcauaguc

SEQ ID NO: 109114 - RNA, 25 nt, Human
cucaggguggauaacacgggucguu

SEQ ID NO: 109115 - RNA, 22 nt, Human
gcaggacagcauuugacuuuua

SEQ ID NO: 109116 - RNA, 23 nt, Human
ucaggauaacacauucuacaaau

SEQ ID NO: 109117 - RNA, 20 nt, Human
ucacuagcuugcggccaggu

SEQ ID NO: 109118 - RNA, 22 nt, Human
gccucuuuggcggggugugugc

SEQ ID NO: 109119 - RNA, 30 nt, Human
uuugaagcauuccagccaaaaugacggaca

SEQ ID NO: 109120 - RNA, 22 nt, Human
ugauucacacauucagaaaaga

SEQ ID NO: 109121 - RNA, 23 nt, Human
gccucuauucaauuuaauucuua

SEQ ID NO: 109122 - RNA, 22 nt, Human
gagaggcaagcucaggagcagc

SEQ ID NO: 109123 - RNA, 21 nt, Human
agcauuuucauucuucccaug

SEQ ID NO: 109124 - RNA, 29 nt, Human
agccaccuugccacccauucuucccguuc

SEQ ID NO: 109125 - RNA, 24 nt, Human
cuuguuuauuacacuggcucgugg

SEQ ID NO: 109126 - RNA, 21 nt, Human
ggcaggacugggggaacugga

SEQ ID NO: 109127 - RNA, 23 nt, Human
uugcccaauggaacucgcucaga

SEQ ID NO: 109128 - RNA, 25 nt, Human
ggagguggugggcucgcaggaaggu

SEQ ID NO: 109129 - RNA, 21 nt, Human
gcaugagccaccugcccagcc

SEQ ID NO: 109130 - RNA, 19 nt, Human
gaggggugacuucauccca

SEQ ID NO: 109131 - RNA, 20 nt, Human
uagucuucauaauuucuuca

SEQ ID NO: 109132 - RNA, 21 nt, Human
cuuacacaccugagaaugugc

SEQ ID NO: 109133 - RNA, 22 nt, Human
aagcccaugaagagauggugga

SEQ ID NO: 109134 - RNA, 19 nt, Human
ucuucuucaugcuuuugcu

SEQ ID NO: 109135 - RNA, 21 nt, Human
guuuuuaacugcaacuuucua

SEQ ID NO: 109136 - RNA, 22 nt, Human
gacuacaggcgcgugccaccac

SEQ ID NO: 109137 - RNA, 24 nt, Human
gaggcugcacaggccagggcucgg

SEQ ID NO: 109138 - RNA, 27 nt, Human
aagaucugauuuauaccauuauaccag

SEQ ID NO: 109139 - RNA, 22 nt, Human
ggcuuggaaacagaacuggaaa

SEQ ID NO: 109140 - RNA, 20 nt, Human
uagugauucugucuggucau

SEQ ID NO: 109141 - RNA, 21 nt, Human
ggcugcccugaagcugaugaa

SEQ ID NO: 109142 - RNA, 18 nt, Human
agcccugggaccaccuca

SEQ ID NO: 109143 - RNA, 21 nt, Human
acccagcuuugggguggugcu

SEQ ID NO: 109144 - RNA, 24 nt, Human
aagaggcuacagggccaaacgcug

SEQ ID NO: 109145 - RNA, 22 nt, Human
agccccaggcuggagcagcaug

SEQ ID NO: 109146 - RNA, 22 nt, Human
cgcauauucacacacccagaca

SEQ ID NO: 109147 - RNA, 29 nt, Human
aucauuuacuagaaaggcuuuuucuauaa

SEQ ID NO: 109148 - RNA, 21 nt, Human
cagaauuacugaguuuuuuau

SEQ ID NO: 109149 - RNA, 26 nt, Human
cugcccuauccuggaagaugggggcc

SEQ ID NO: 109150 - RNA, 24 nt, Human
cucccaggcuggagugcuauggug

SEQ ID NO: 109151 - RNA, 26 nt, Human
guuaauauaugcaaccaauuaaaaug

SEQ ID NO: 109152 - RNA, 20 nt, Human
aauagccucuucacugguau

SEQ ID NO: 109153 - RNA, 30 nt, Human
caggggauagaggaguaauuguuagugggc

SEQ ID NO: 109154 - RNA, 21 nt, Human
uuuuagguuuucccaggacag

SEQ ID NO: 109155 - RNA, 24 nt, Human
uucaaucaugauauucagaaaaau

SEQ ID NO: 109156 - RNA, 23 nt, Human
gacagaaagcaagaugucuaaua

SEQ ID NO: 109157 - RNA, 22 nt, Human
ccuuucucuuacgcuuaaggcu

SEQ ID NO: 109158 - RNA, 22 nt, Human
aggcagcagagcggacugguga

SEQ ID NO: 109159 - RNA, 27 nt, Human
uugcccaggcuggagugcaguggugcc

SEQ ID NO: 109160 - RNA, 21 nt, Human
ugaggggaagccauuuuccag

SEQ ID NO: 109161 - RNA, 20 nt, Human
ugcagagacagagcauuugc

SEQ ID NO: 109162 - RNA, 27 nt, Human
ugaguauguaaaacauucuuuugcauu

SEQ ID NO: 109163 - RNA, 25 nt, Human
uguccgggcugugauggcaccaagg

SEQ ID NO: 109164 - RNA, 21 nt, Human
ccugguguaccucucaguggc

SEQ ID NO: 109165 - RNA, 23 nt, Human
ggguuccugggugggaggacugu

SEQ ID NO: 109166 - RNA, 22 nt, Human
guugggccuggugaggguuagg

SEQ ID NO: 109167 - RNA, 19 nt, Human
acaccagcgguaacacugc

SEQ ID NO: 109168 - RNA, 23 nt, Human
caggugaaggaggcuccaggcag

SEQ ID NO: 109169 - RNA, 25 nt, Human
cuugcaaaugaaugccuuucaaaca

SEQ ID NO: 109170 - RNA, 26 nt, Human
aggccagauacugauugcuaguagag

SEQ ID NO: 109171 - RNA, 20 nt, Human
ccuguucuccaucugaacua

SEQ ID NO: 109172 - RNA, 25 nt, Human
gacucugcugccuucuccuuugucu

SEQ ID NO: 109173 - RNA, 19 nt, Human
uucaaacccaggcugucua

SEQ ID NO: 109174 - RNA, 27 nt, Human
cggccuauccauuacugggcaauagag

SEQ ID NO: 109175 - RNA, 23 nt, Human
guucuuaagagucccagcuccag

SEQ ID NO: 109176 - RNA, 24 nt, Human
gugauucuucuuugcucuuauuua

SEQ ID NO: 109177 - RNA, 27 nt, Human
gucaguugcugcuugucccagcaggug

SEQ ID NO: 109178 - RNA, 20 nt, Human
aggaaauauuaguucugcuu

SEQ ID NO: 109179 - RNA, 30 nt, Human
cucccugcagggcugggcuuuugcauggca

SEQ ID NO: 109180 - RNA, 22 nt, Human
cugaggcaggagaauagcguga

SEQ ID NO: 109181 - RNA, 22 nt, Human
aguggcaugaucauagcucacu

SEQ ID NO: 109182 - RNA, 22 nt, Human
agugguaugaucacagcucacu

SEQ ID NO: 109183 - RNA, 26 nt, Human
gauauugcuacuauuuuauagauuuc

SEQ ID NO: 109184 - RNA, 23 nt, Human
ucuugccccuuuuugcgucugac

SEQ ID NO: 109185 - RNA, 22 nt, Human
agggcagugucccucccuggcu

SEQ ID NO: 109186 - RNA, 27 nt, Human
aguauuuuuauaauuuuaucuguauaa

SEQ ID NO: 109187 - RNA, 24 nt, Human
ugggagcaaugggguugcagcuga

SEQ ID NO: 109188 - RNA, 26 nt, Human
cugcccgcccucccuccugccugcgc

SEQ ID NO: 109189 - RNA, 24 nt, Human
cuugacagacuccuggcugucagu

SEQ ID NO: 109190 - RNA, 24 nt, Human
cugccuggccacugcucccuaagc

SEQ ID NO: 109191 - RNA, 21 nt, Human
ucuuccucuagucgccagcuc

SEQ ID NO: 109192 - RNA, 21 nt, Human
gcccgauuuuaaccacuugaa

SEQ ID NO: 109193 - RNA, 23 nt, Human
cuucgucgccuccuuucucuccc

SEQ ID NO: 109194 - RNA, 19 nt, Human
guuacuuagaauucaugaa

SEQ ID NO: 109195 - RNA, 23 nt, Human
guggacccagacguggaguggag

SEQ ID NO: 109196 - RNA, 25 nt, Human
ucccaacgcccaaagcuuugcuuuu

SEQ ID NO: 109197 - RNA, 26 nt, Human
agcaggaagugcaggcagaguccgga

SEQ ID NO: 109198 - RNA, 22 nt, Human
acugagaagcuagacuuucaug

SEQ ID NO: 109199 - RNA, 20 nt, Human
cugcuuugguuuuagaguga

SEQ ID NO: 109200 - RNA, 29 nt, Human
cagucgccuuugcuacugcuuuaagagaa

SEQ ID NO: 109201 - RNA, 21 nt, Human
uuuccugaaaucaggucaucu

SEQ ID NO: 109202 - RNA, 20 nt, Human
ucuagaauucaguggcagaa

SEQ ID NO: 109203 - RNA, 27 nt, Human
ccggcucccagccucagcgcggcccuc

SEQ ID NO: 109204 - RNA, 20 nt, Human
gcccacacacgugcuggugu

SEQ ID NO: 109205 - RNA, 23 nt, Human
ugccuguagucccagguacucag

SEQ ID NO: 109206 - RNA, 25 nt, Human
cuuggggugguugugccagccugcc

SEQ ID NO: 109207 - RNA, 27 nt, Human
cucugaaugccuucgccuguauaaaga

SEQ ID NO: 109208 - RNA, 21 nt, Human
gcuuguaauccagcauguuuc

SEQ ID NO: 109209 - RNA, 19 nt, Human
uuuacaggcucccuucuca

SEQ ID NO: 109210 - RNA, 23 nt, Human
auugcauagccuuguccuccugu

SEQ ID NO: 109211 - RNA, 23 nt, Human
gcagccagcauccuuaucugcca

SEQ ID NO: 109212 - RNA, 26 nt, Human
auggaaagagcaacugaaguccuaga

SEQ ID NO: 109213 - RNA, 26 nt, Human
ggccugagacuugcagggaggcaaga

SEQ ID NO: 109214 - RNA, 27 nt, Human
uugggaggcugaggugggaggguugau

SEQ ID NO: 109215 - RNA, 28 nt, Human
ugcugguuuccccucuuggcaggguggg

SEQ ID NO: 109216 - RNA, 23 nt, Human
acccucuccccaacccccaagaa

SEQ ID NO: 109217 - RNA, 22 nt, Human
uucucucucauuuuaucccuca

SEQ ID NO: 109218 - RNA, 19 nt, Human
ucuuuucugcuguuuccca

SEQ ID NO: 109219 - RNA, 25 nt, Human
cucagccucaucauuugacuaccua

SEQ ID NO: 109220 - RNA, 26 nt, Human
ugugacuggacucuuccguucuggcu

SEQ ID NO: 109221 - RNA, 22 nt, Human
aauaagccugguuucaacccuc

SEQ ID NO: 109222 - RNA, 23 nt, Human
gcuuguuaccaccaugcucggcu

SEQ ID NO: 109223 - RNA, 21 nt, Human
gggacuguuguaauuucucau

SEQ ID NO: 109224 - RNA, 27 nt, Human
auaggcacuggguuuguguuacauauu

SEQ ID NO: 109225 - RNA, 26 nt, Human
uuuaucucccuaugguuauauccugc

SEQ ID NO: 109226 - RNA, 21 nt, Human
uaaucaccuucuuuguaaucc

SEQ ID NO: 109227 - RNA, 25 nt, Human
cacaucccugauggcagaacuccca

SEQ ID NO: 109228 - RNA, 22 nt, Human
uuauuuuuugaaacugaaggaa

SEQ ID NO: 109229 - RNA, 22 nt, Human
ccucuccuggcccugaaggugc

SEQ ID NO: 109230 - RNA, 21 nt, Human
aacugauguacugaauuccau

SEQ ID NO: 109231 - RNA, 20 nt, Human
ccaaauccagggaccaggcc

SEQ ID NO: 109232 - RNA, 21 nt, Human
gcccaggcuggagugcaaugc

SEQ ID NO: 109233 - RNA, 23 nt, Human
ccguuuauuucagaagcuuccug

SEQ ID NO: 109234 - RNA, 26 nt, Human
gaggaagugaaaugccuccacggcug

SEQ ID NO: 109235 - RNA, 20 nt, Human
ucauguuuauuuaagaaaug

SEQ ID NO: 109236 - RNA, 24 nt, Human
ccuaagucuguaagcuggugccau

SEQ ID NO: 109237 - RNA, 20 nt, Human
uggaauauuuggaaaaauuu

SEQ ID NO: 109238 - RNA, 18 nt, Human
ugcuaagcccucucucca

SEQ ID NO: 109239 - RNA, 23 nt, Human
ccucacaaccuguccuucaccua

SEQ ID NO: 109240 - RNA, 20 nt, Human
uguacagacucuauaucucu

SEQ ID NO: 109241 - RNA, 23 nt, Human
aucauuucuuauaccuucugaca

SEQ ID NO: 109242 - RNA, 25 nt, Human
uucauucuguuucuacuaaccuaua

SEQ ID NO: 109243 - RNA, 22 nt, Human
agcauuuucuucucugcacuua

SEQ ID NO: 109244 - RNA, 22 nt, Human
gggagcccugcccugcccaucc

SEQ ID NO: 109245 - RNA, 21 nt, Human
ucaggaaagaggagauaaugu

SEQ ID NO: 109246 - RNA, 24 nt, Human
aagaguuaaacuggguucauuuua

SEQ ID NO: 109247 - RNA, 22 nt, Human
gcagggauugcugccacuuuuu

SEQ ID NO: 109248 - RNA, 27 nt, Human
gccccuucuccuccuccuaccugggcc

SEQ ID NO: 109249 - RNA, 22 nt, Human
gguggagggaagcaggcgcagg

SEQ ID NO: 109250 - RNA, 21 nt, Human
ggggagaagagcauacgccag

SEQ ID NO: 109251 - RNA, 27 nt, Human
ggcucucugaguccuggcccaaagaag

SEQ ID NO: 109252 - RNA, 25 nt, Human
ugcuuuugguuuugcaccucuccgu

SEQ ID NO: 109253 - RNA, 24 nt, Human
ugugaucacacugacaccugagag

SEQ ID NO: 109254 - RNA, 22 nt, Human
ugggaggcagagguuacaguga

SEQ ID NO: 109255 - RNA, 21 nt, Human
acuggagucccugugaagacu

SEQ ID NO: 109256 - RNA, 26 nt, Human
gcuguucuucuuuaucauuuauucac

SEQ ID NO: 109257 - RNA, 24 nt, Human
agacuugauuuacaauuuaaugca

SEQ ID NO: 109258 - RNA, 22 nt, Human
auggaaaugcuuuuaguaguga

SEQ ID NO: 109259 - RNA, 20 nt, Human
cugccucaccccuuugucuc

SEQ ID NO: 109260 - RNA, 19 nt, Human
ccuuucuccuaaacugguc

SEQ ID NO: 109261 - RNA, 28 nt, Human
cccuccguuccuccucagccucccuuug

SEQ ID NO: 109262 - RNA, 23 nt, Human
gcccaggaguuccagacugccug

SEQ ID NO: 109263 - RNA, 28 nt, Human
ucucaagagcacuuacugccucgcaaau

SEQ ID NO: 109264 - RNA, 23 nt, Human
ugaacauucacuuagcuuccuca

SEQ ID NO: 109265 - RNA, 19 nt, Human
uaguucaagaguccuggaa

SEQ ID NO: 109266 - RNA, 25 nt, Human
gcugcgcuccuccugggugcuauuu

SEQ ID NO: 109267 - RNA, 21 nt, Human
ccugcacuccacgcuggccaa

SEQ ID NO: 109268 - RNA, 23 nt, Human
ucuuauaaugcuaccugauuucu

SEQ ID NO: 109269 - RNA, 19 nt, Human
cccugcugaacacaguguc

SEQ ID NO: 109270 - RNA, 23 nt, Human
cgugcagcugugagcgcguggcc

SEQ ID NO: 109271 - RNA, 19 nt, Human
gugucugaccucaggccuu

SEQ ID NO: 109272 - RNA, 22 nt, Human
uguucccucuucucucucuuca

SEQ ID NO: 109273 - RNA, 27 nt, Human
ggggccaucaaaaacaggcugaucacc

SEQ ID NO: 109274 - RNA, 17 nt, Human
gccacaaaaaugccuua

SEQ ID NO: 109275 - RNA, 25 nt, Human
uccucagaucccgggaaccucagca

SEQ ID NO: 109276 - RNA, 22 nt, Human
agaccagcuugggcaacauagu

SEQ ID NO: 109277 - RNA, 27 nt, Human
gguaccacacuauucacugcugcgucg

SEQ ID NO: 109278 - RNA, 23 nt, Human
ccaagagauagagcacagcaaag

SEQ ID NO: 109279 - RNA, 27 nt, Human
ccaagaggaaggagcaagacucaagac

SEQ ID NO: 109280 - RNA, 22 nt, Human
agccucccaaaauggugggauu

SEQ ID NO: 109281 - RNA, 16 nt, Human
auggagcaugcaguga

SEQ ID NO: 109282 - RNA, 23 nt, Human
ggacccgggaucagagugugugg

SEQ ID NO: 109283 - RNA, 22 nt, Human
uacagcugugaugucauuucug

SEQ ID NO: 109284 - RNA, 24 nt, Human
gcugcccccgccuccuccgccuga

SEQ ID NO: 109285 - RNA, 21 nt, Human
guguuuuccucacacuccuua

SEQ ID NO: 109286 - RNA, 25 nt, Human
gggcucaagcaauccucccaccuca

SEQ ID NO: 109287 - RNA, 21 nt, Human
gccuguaaauggugucauuga

SEQ ID NO: 109288 - RNA, 21 nt, Human
aagggagaccugcugugugga

SEQ ID NO: 109289 - RNA, 19 nt, Human
cuucccuuucccagagccc

SEQ ID NO: 109290 - RNA, 23 nt, Human
gaguuuauacucaccuuuuauga

SEQ ID NO: 109291 - RNA, 21 nt, Human
cacuuucacaauguagaggaa

SEQ ID NO: 109292 - RNA, 23 nt, Human
gcacacaggugaacuccagaaag

SEQ ID NO: 109293 - RNA, 24 nt, Human
cccugcucuuucugccucugggcu

SEQ ID NO: 109294 - RNA, 24 nt, Human
ccugcagccauagcccacauuccc

SEQ ID NO: 109295 - RNA, 23 nt, Human
ucucccacucuagguucccacgc

SEQ ID NO: 109296 - RNA, 20 nt, Human
gcuuucuccugacuuggggc

SEQ ID NO: 109297 - RNA, 27 nt, Human
uucucccuucucucuuuucuucucagg

SEQ ID NO: 109298 - RNA, 22 nt, Human
gcucacugcagccuccaccucc

SEQ ID NO: 109299 - RNA, 19 nt, Human
cuuguccccugcugccugc

SEQ ID NO: 109300 - RNA, 25 nt, Human
gcagggcugccuggaacaccgcugc

SEQ ID NO: 109301 - RNA, 24 nt, Human
accagauccugccaaauucuucca

SEQ ID NO: 109302 - RNA, 23 nt, Human
ugccuguagucucagcuacuuag

SEQ ID NO: 109303 - RNA, 27 nt, Human
gaggcugagaggucaagguugcaguga

SEQ ID NO: 109304 - RNA, 22 nt, Human
uugacauuuuaaaacuugccac

SEQ ID NO: 109305 - RNA, 26 nt, Human
ccugcaggcuguuuuaguauguuuug

SEQ ID NO: 109306 - RNA, 27 nt, Human
ugggaaagaugccaccgguguggggga

SEQ ID NO: 109307 - RNA, 22 nt, Human
uuaccuuuauguuagacaauca

SEQ ID NO: 109308 - RNA, 22 nt, Human
cucacaagaguggagacauaug

SEQ ID NO: 109309 - RNA, 22 nt, Human
gcaacauggugaaaccuugucu

SEQ ID NO: 109310 - RNA, 26 nt, Human
acccgagcuccugcagaaguggcccu

SEQ ID NO: 109311 - RNA, 21 nt, Human
uugguuguuggcaccaucuca

SEQ ID NO: 109312 - RNA, 23 nt, Human
ugauugcccuggaguuccugcca

SEQ ID NO: 109313 - RNA, 20 nt, Human
cuuccuccuccacuccuggc

SEQ ID NO: 109314 - RNA, 19 nt, Human
caggaagggaaggagucug

SEQ ID NO: 109315 - RNA, 22 nt, Human
aaaugcaugaguaugugcacca

SEQ ID NO: 109316 - RNA, 21 nt, Human
ucuccugugugccugccuccu

SEQ ID NO: 109317 - RNA, 26 nt, Human
uccuccagaaccucacaucugaacug

SEQ ID NO: 109318 - RNA, 21 nt, Human
uggaaugcagcauuaccugcu

SEQ ID NO: 109319 - RNA, 21 nt, Human
uuuguaaucaagaaaagugau

SEQ ID NO: 109320 - RNA, 26 nt, Human
caaaaagguaaaacuuuuuauauuuu

SEQ ID NO: 109321 - RNA, 20 nt, Human
uucuuggugcucaaaccaga

SEQ ID NO: 109322 - RNA, 18 nt, Human
uggagucuuguuuugaag

SEQ ID NO: 109323 - RNA, 21 nt, Human
uuuccugggcagguuuauguu

SEQ ID NO: 109324 - RNA, 22 nt, Human
uuuaaaccauuuccauuuguuu

SEQ ID NO: 109325 - RNA, 25 nt, Human
gguguccuuucaugcuucugcccug

SEQ ID NO: 109326 - RNA, 23 nt, Human
cuaccugagagaaugagcacccc

SEQ ID NO: 109327 - RNA, 27 nt, Human
gugcguucugggaaaguugcugggcca

SEQ ID NO: 109328 - RNA, 26 nt, Human
acugcccucucccugccugggggcua

SEQ ID NO: 109329 - RNA, 23 nt, Human
ggugaccccacauugcacuggua

SEQ ID NO: 109330 - RNA, 19 nt, Human
gcggcccuuuuuguuccca

SEQ ID NO: 109331 - RNA, 22 nt, Human
ggggauggagucucaggguggc

SEQ ID NO: 109332 - RNA, 22 nt, Human
ccccaaaagucugauuggccuu

SEQ ID NO: 109333 - RNA, 21 nt, Human
agcugagaagggagagcgagc

SEQ ID NO: 109334 - RNA, 20 nt, Human
acuacuuccaucccugcuua

SEQ ID NO: 109335 - RNA, 20 nt, Human
agcauucaagcacuuuuaca

SEQ ID NO: 109336 - RNA, 20 nt, Human
acuacugauauuugcuuuuc

SEQ ID NO: 109337 - RNA, 21 nt, Human
uuaccgcccaggcuggagugc

SEQ ID NO: 109338 - RNA, 22 nt, Human
gcuguuuuguuuuaauuuuugu

SEQ ID NO: 109339 - RNA, 22 nt, Human
cuuggacgaccugcucucuaca

SEQ ID NO: 109340 - RNA, 21 nt, Human
ucagcauuuauugugcaccua

SEQ ID NO: 109341 - RNA, 22 nt, Human
uuuggccuuucaaaauuuguga

SEQ ID NO: 109342 - RNA, 22 nt, Human
ggcuggagugccucucuggucu

SEQ ID NO: 109343 - RNA, 27 nt, Human
ugccagacucuccucugaacucgggcc

SEQ ID NO: 109344 - RNA, 23 nt, Human
caaguagcugggauuacagauug

SEQ ID NO: 109345 - RNA, 26 nt, Human
augacaccuaccucacugggucacca

SEQ ID NO: 109346 - RNA, 21 nt, Human
acagcuauauuguauuacaaa

SEQ ID NO: 109347 - RNA, 23 nt, Human
ugucaaccgggcuggagugcagu

SEQ ID NO: 109348 - RNA, 19 nt, Human
aggggagggggcagacagc

SEQ ID NO: 109349 - RNA, 27 nt, Human
ugcagugagccaagaucgcggcauugc

SEQ ID NO: 109350 - RNA, 25 nt, Human
acauuccagaggcucaggaagugga

SEQ ID NO: 109351 - RNA, 19 nt, Human
ccaccaccaucacugccac

SEQ ID NO: 109352 - RNA, 25 nt, Human
gcauccucccuccuugcuugucacc

SEQ ID NO: 109353 - RNA, 27 nt, Human
uggaaggcagggcggucucacucccag

SEQ ID NO: 109354 - RNA, 27 nt, Human
uagaaauguguuuaacaucauccagug

SEQ ID NO: 109355 - RNA, 19 nt, Human
acuuaccucauacgcagcu

SEQ ID NO: 109356 - RNA, 21 nt, Human
gccauguuuuaccagucugcu

SEQ ID NO: 109357 - RNA, 22 nt, Human
cugcaaccuccgccucucaggu

SEQ ID NO: 109358 - RNA, 22 nt, Human
cacccaggcugugaucuguccu

SEQ ID NO: 109359 - RNA, 21 nt, Human
caguuuaagccaaggaaaaua

SEQ ID NO: 109360 - RNA, 25 nt, Human
ugaaacacugguccaguccauugaa

SEQ ID NO: 109361 - RNA, 24 nt, Human
uucuccucuagauugaaguuuguu

SEQ ID NO: 109362 - RNA, 25 nt, Human
uggcagacuggagugcaaucauggc

SEQ ID NO: 109363 - RNA, 21 nt, Human
ggcugacgugcaucccaccca

SEQ ID NO: 109364 - RNA, 23 nt, Human
ggcagaauaagacaacaaucaca

SEQ ID NO: 109365 - RNA, 22 nt, Human
aagguauuaaugauauaguuau

SEQ ID NO: 109366 - RNA, 28 nt, Human
ggugcgucuccugggugugguaucucag

SEQ ID NO: 109367 - RNA, 23 nt, Human
caugacuaccugcagccgccagu

SEQ ID NO: 109368 - RNA, 27 nt, Human
uaacugcacuuucggcccuuuugcucg

SEQ ID NO: 109369 - RNA, 22 nt, Human
cccaucauccugcuuggagcaa

SEQ ID NO: 109370 - RNA, 22 nt, Human
ugggaaagaucugucagaggag

SEQ ID NO: 109371 - RNA, 20 nt, Human
ccuucaucccccugccucua

SEQ ID NO: 109372 - RNA, 27 nt, Human
uauugcacuccauccuggaugaaagag

SEQ ID NO: 109373 - RNA, 27 nt, Human
uacuacugccuuguacuuuucauuuug

SEQ ID NO: 109374 - RNA, 21 nt, Human
ucugagccuuuugagucuggg

SEQ ID NO: 109375 - RNA, 22 nt, Human
aacuaauuuuuguauuuuuagu

SEQ ID NO: 109376 - RNA, 27 nt, Human
ccagcaucuucucuaucuuaguugaau

SEQ ID NO: 109377 - RNA, 27 nt, Human
ccuugauacuaaaaguucuucuccaau

SEQ ID NO: 109378 - RNA, 22 nt, Human
uugucuauuucuaaaagccaau

SEQ ID NO: 109379 - RNA, 22 nt, Human
cuucagcuguggccucucgggc

SEQ ID NO: 109380 - RNA, 28 nt, Human
ugggaccccuguccacacccacccuauu

SEQ ID NO: 109381 - RNA, 21 nt, Human
ccuccccacccacacccacag

SEQ ID NO: 109382 - RNA, 22 nt, Human
auuuuguaucuugguugcagug

SEQ ID NO: 109383 - RNA, 25 nt, Human
ggcucacugcugcaaccucccccuc

SEQ ID NO: 109384 - RNA, 20 nt, Human
ggugcugugucacugggugg

SEQ ID NO: 109385 - RNA, 22 nt, Human
ccgggagguggcaguugcaggg

SEQ ID NO: 109386 - RNA, 21 nt, Human
ggggccauucguaugcagccu

SEQ ID NO: 109387 - RNA, 22 nt, Human
ccccaauuaaguugaucuuuga

SEQ ID NO: 109388 - RNA, 21 nt, Human
cuucgacuacauacugcagca

SEQ ID NO: 109389 - RNA, 20 nt, Human
aggguucccuggcaggggaa

SEQ ID NO: 109390 - RNA, 20 nt, Human
ucauccagaaagcaucauuu

SEQ ID NO: 109391 - RNA, 22 nt, Human
guccagccacauucaacaccca

SEQ ID NO: 109392 - RNA, 26 nt, Human
agacuugcucggagcccagcacuccu

SEQ ID NO: 109393 - RNA, 27 nt, Human
gucaccuauucacuagugcaggaaaua

SEQ ID NO: 109394 - RNA, 22 nt, Human
agcaccguugagguugcaguga

SEQ ID NO: 109395 - RNA, 21 nt, Human
gucacagaauaugauguaaua

SEQ ID NO: 109396 - RNA, 21 nt, Human
caccaccgcccgccugggcag

SEQ ID NO: 109397 - RNA, 29 nt, Human
uccucuuuguuuguucaaaggaccaguuu

SEQ ID NO: 109398 - RNA, 19 nt, Human
ggggaaagggaauauugca

SEQ ID NO: 109399 - RNA, 21 nt, Human
cagaagcugagggaccagcac

SEQ ID NO: 109400 - RNA, 27 nt, Human
cuccaucuuuuucuuggggugagggac

SEQ ID NO: 109401 - RNA, 19 nt, Human
cccccuuuuucccugcccc

SEQ ID NO: 109402 - RNA, 26 nt, Human
uaaguugagcaaaagaguuuuuaucu

SEQ ID NO: 109403 - RNA, 22 nt, Human
uacuccaugcauucaccugccc

SEQ ID NO: 109404 - RNA, 21 nt, Human
gccaggauaauauauuugcag

SEQ ID NO: 109405 - RNA, 23 nt, Human
acugcaucucagcccacaucuca

SEQ ID NO: 109406 - RNA, 25 nt, Human
cccauccuguggucacugacuggaa

SEQ ID NO: 109407 - RNA, 24 nt, Human
ggcuggaggagucagagugagagc

SEQ ID NO: 109408 - RNA, 24 nt, Human
cuccuauugacccuuacuuugaau

SEQ ID NO: 109409 - RNA, 21 nt, Human
auguacugccauacuacuucu

SEQ ID NO: 109410 - RNA, 20 nt, Human
agauucuuuaaucuccagcu

SEQ ID NO: 109411 - RNA, 27 nt, Human
uugcccaggcuggagugcaguggcacg

SEQ ID NO: 109412 - RNA, 19 nt, Human
agaacaacagcaaaacauc

SEQ ID NO: 109413 - RNA, 23 nt, Human
aaugguguuagggggaugagcau

SEQ ID NO: 109414 - RNA, 21 nt, Human
ggccuuucacaacuaggacug

SEQ ID NO: 109415 - RNA, 22 nt, Human
cucccaggcuggagugcaaucg

SEQ ID NO: 109416 - RNA, 23 nt, Human
gagguuagcagaaaaugaaauga

SEQ ID NO: 109417 - RNA, 17 nt, Human
caauuuucacacccuua

SEQ ID NO: 109418 - RNA, 21 nt, Human
auuaaauccaggcauuucgaa

SEQ ID NO: 109419 - RNA, 21 nt, Human
ugccuguagucccagcacuuu

SEQ ID NO: 109420 - RNA, 24 nt, Human
gccaagcccaggcuggggccaagg

SEQ ID NO: 109421 - RNA, 25 nt, Human
accaggaagggaucaacccaggaag

SEQ ID NO: 109422 - RNA, 24 nt, Human
accaaguauacuggugaaaucucg

SEQ ID NO: 109423 - RNA, 26 nt, Human
uuaauauuuuaucuuuacagauuucc

SEQ ID NO: 109424 - RNA, 21 nt, Human
acccugugagccgauuguccu

SEQ ID NO: 109425 - RNA, 20 nt, Human
gugcagcuuuucauuguguu

SEQ ID NO: 109426 - RNA, 19 nt, Human
ccaugccccacacucugag

SEQ ID NO: 109427 - RNA, 23 nt, Human
ucagaaccucucuggaauuugug

SEQ ID NO: 109428 - RNA, 26 nt, Human
ccuuccuccuccucuuccugacccuc

SEQ ID NO: 109429 - RNA, 21 nt, Human
gcugcugucuggugcccugug

SEQ ID NO: 109430 - RNA, 19 nt, Human
acuucaucuuacuugccac

SEQ ID NO: 109431 - RNA, 25 nt, Human
auuuuuguuuuguuuuguuuuugcc

SEQ ID NO: 109432 - RNA, 22 nt, Human
ggucaucuguacugauugcgcc

SEQ ID NO: 109433 - RNA, 27 nt, Human
ugggagguggagggaaagaacuacuau

SEQ ID NO: 109434 - RNA, 28 nt, Human
acuccuuuccuucaccuccugcccuucu

SEQ ID NO: 109435 - RNA, 19 nt, Human
acacucaagaauuugucag

SEQ ID NO: 109436 - RNA, 22 nt, Human
gcaucuggaacuuucucugccu

SEQ ID NO: 109437 - RNA, 26 nt, Human
ugaaaaaauauauccaaucagagcca

SEQ ID NO: 109438 - RNA, 24 nt, Human
uuccaaagaacuuaccucuugcca

SEQ ID NO: 109439 - RNA, 28 nt, Human
ucauuuucucucaucccuaccuauugug

SEQ ID NO: 109440 - RNA, 25 nt, Human
gauaaauccuuaacauuucucucca

SEQ ID NO: 109441 - RNA, 19 nt, Human
ugaggcaccuuucuagaga

SEQ ID NO: 109442 - RNA, 19 nt, Human
uguucugagguuugcuuug

SEQ ID NO: 109443 - RNA, 26 nt, Human
uucaguuauauucagcauguaccgca

SEQ ID NO: 109444 - RNA, 27 nt, Human
gcagcuuuccagccuugguggggaaga

SEQ ID NO: 109445 - RNA, 21 nt, Human
gccuggaagcccugaccucgg

SEQ ID NO: 109446 - RNA, 21 nt, Human
caccugggucuguugucacac

SEQ ID NO: 109447 - RNA, 22 nt, Human
cugccugaggacucaccugccu

SEQ ID NO: 109448 - RNA, 21 nt, Human
guugcagccaaagauuuugga

SEQ ID NO: 109449 - RNA, 22 nt, Human
gaacccgggaggcagaaguugc

SEQ ID NO: 109450 - RNA, 22 nt, Human
gccacaucuugaaaaugccacc

SEQ ID NO: 109451 - RNA, 26 nt, Human
ccacccagacuugggggcaggcgcca

SEQ ID NO: 109452 - RNA, 22 nt, Human
gggaagagaagaaacagaagcg

SEQ ID NO: 109453 - RNA, 21 nt, Human
acuagguuugaaugaucaugu

SEQ ID NO: 109454 - RNA, 20 nt, Human
cucauaauccuucugcaacu

SEQ ID NO: 109455 - RNA, 26 nt, Human
ugcccagcuuggagugccacguggcc

SEQ ID NO: 109456 - RNA, 21 nt, Human
uuugcugucucugucuuuguc

SEQ ID NO: 109457 - RNA, 27 nt, Human
ggucuggaacuccugaccucgugaucc

SEQ ID NO: 109458 - RNA, 26 nt, Human
ucacuggacaccgguucugagcauua

SEQ ID NO: 109459 - RNA, 21 nt, Human
ggggaaagacggauugagauu

SEQ ID NO: 109460 - RNA, 22 nt, Human
ccuccagcgccuaucauacgcc

SEQ ID NO: 109461 - RNA, 23 nt, Human
gcagggguggggcaacaugcggg

SEQ ID NO: 109462 - RNA, 22 nt, Human
cagaccccaguccagcccugaa

SEQ ID NO: 109463 - RNA, 26 nt, Human
aauugcuugaaccugugaggaagagg

SEQ ID NO: 109464 - RNA, 22 nt, Human
ugugacugaaccaugcccaguu

SEQ ID NO: 109465 - RNA, 21 nt, Human
ucacccagcaggucaacaaug

SEQ ID NO: 109466 - RNA, 27 nt, Human
cugggccucaguuucccuccucugcca

SEQ ID NO: 109467 - RNA, 19 nt, Human
ugcacacccacucagcucc

SEQ ID NO: 109468 - RNA, 22 nt, Human
agcugccugugaaugcacugcu

SEQ ID NO: 109469 - RNA, 19 nt, Human
ugccuguaguaguaaauug

SEQ ID NO: 109470 - RNA, 22 nt, Human
agaucuccuccuccuucaugca

SEQ ID NO: 109471 - RNA, 20 nt, Human
uaacauuccaucuccaucuc

SEQ ID NO: 109472 - RNA, 28 nt, Human
ucuugaacuccugaccucgugaucugcc

SEQ ID NO: 109473 - RNA, 20 nt, Human
ccuuucaaauuccugccuuc

SEQ ID NO: 109474 - RNA, 22 nt, Human
cccaccuguagucccagcacuu

SEQ ID NO: 109475 - RNA, 21 nt, Human
gacuauuuauuaaagugcaaa

SEQ ID NO: 109476 - RNA, 20 nt, Human
aaggggaccuggaagggagg

SEQ ID NO: 109477 - RNA, 27 nt, Human
acguauucucuagcacagucugagcaa

SEQ ID NO: 109478 - RNA, 22 nt, Human
ccaaguagccgggauugcaggc

SEQ ID NO: 109479 - RNA, 24 nt, Human
ccuacaagggcagaaaaggacaag

SEQ ID NO: 109480 - RNA, 24 nt, Human
cacaagcuuagauucucuauguau

SEQ ID NO: 109481 - RNA, 25 nt, Human
gggacccuccccgcuuuccugggcc

SEQ ID NO: 109482 - RNA, 24 nt, Human
cgggccccaccugcagcucccuca

SEQ ID NO: 109483 - RNA, 20 nt, Human
caggaguuuaaggcugcagu

SEQ ID NO: 109484 - RNA, 20 nt, Human
aagcucuggcccugcccugu

SEQ ID NO: 109485 - RNA, 22 nt, Human
cauuuucuuuuuuaauuuuuga

SEQ ID NO: 109486 - RNA, 24 nt, Human
ccugcagcgacucaacccuaugca

SEQ ID NO: 109487 - RNA, 21 nt, Human
uagagaaugagaaauggaaca

SEQ ID NO: 109488 - RNA, 23 nt, Human
ccaccaucugcucuaaccaugua

SEQ ID NO: 109489 - RNA, 23 nt, Human
cucagucaaaugauauguuaaua

SEQ ID NO: 109490 - RNA, 21 nt, Human
gcuguagugccuucugcgcca

SEQ ID NO: 109491 - RNA, 26 nt, Human
ccuggagcagcccuccagaccugggu

SEQ ID NO: 109492 - RNA, 24 nt, Human
cugauccacuuccauuuaagcucc

SEQ ID NO: 109493 - RNA, 23 nt, Human
ccagcccuuggcccugccauggc

SEQ ID NO: 109494 - RNA, 26 nt, Human
ucgccucgccuucauccgccucucuc

SEQ ID NO: 109495 - RNA, 21 nt, Human
gaaaggcuuauuuaagccaca

SEQ ID NO: 109496 - RNA, 22 nt, Human
cacgccuguaaucccagcucuu

SEQ ID NO: 109497 - RNA, 20 nt, Human
ccccuguggcagaagcaguu

SEQ ID NO: 109498 - RNA, 24 nt, Human
ugcaaaucuccccugugccugauc

SEQ ID NO: 109499 - RNA, 20 nt, Human
gggcugaggccucccaggga

SEQ ID NO: 109500 - RNA, 20 nt, Human
ugccucagcagcaccaguug

SEQ ID NO: 109501 - RNA, 22 nt, Human
ccaucugcuuuucuccauugcc

SEQ ID NO: 109502 - RNA, 26 nt, Human
ucaauggacuuccugagaaggacaga

SEQ ID NO: 109503 - RNA, 19 nt, Human
augagggcagauuccuuac

SEQ ID NO: 109504 - RNA, 22 nt, Human
gucgcccaggcuggagugcagg

SEQ ID NO: 109505 - RNA, 27 nt, Human
ugccuaacuaucaaaggauuauagcaa

SEQ ID NO: 109506 - RNA, 19 nt, Human
ucuuaauaaaacagauauu

SEQ ID NO: 109507 - RNA, 21 nt, Human
uggacaaacaauccagugccg

SEQ ID NO: 109508 - RNA, 22 nt, Human
cucuccucugcugagaaucccc

SEQ ID NO: 109509 - RNA, 29 nt, Human
ccuggccuuccugucuagucucuccugua

SEQ ID NO: 109510 - RNA, 23 nt, Human
gauccaggauggcuuccuuccuc

SEQ ID NO: 109511 - RNA, 22 nt, Human
agugguaugaucucagcucacu

SEQ ID NO: 109512 - RNA, 22 nt, Human
aguggcgugaucuuggcucacu

SEQ ID NO: 109513 - RNA, 22 nt, Human
gcucacugcagccucuaccucc

SEQ ID NO: 109514 - RNA, 29 nt, Human
ccaucuggaugcccugccuguugagcccc

SEQ ID NO: 109515 - RNA, 23 nt, Human
auugcccaggcuggagugcagug

SEQ ID NO: 109516 - RNA, 18 nt, Human
uagaagcuuagagagcca

SEQ ID NO: 109517 - RNA, 22 nt, Human
uccuagagugcagggauuacag

SEQ ID NO: 109518 - RNA, 21 nt, Human
cagugccaccaccgcagccgc

SEQ ID NO: 109519 - RNA, 24 nt, Human
cuucacugcacuuucuuccugccu

SEQ ID NO: 109520 - RNA, 26 nt, Human
accuccccgucuuccucugggugcca

SEQ ID NO: 109521 - RNA, 27 nt, Human
ggaggcugaggcaccagaauugcuuga

SEQ ID NO: 109522 - RNA, 22 nt, Human
cuuucugguauaaagcucucaa

SEQ ID NO: 109523 - RNA, 20 nt, Human
caccacaccuguuaacacac

SEQ ID NO: 109524 - RNA, 22 nt, Human
cagcaggucgccuccagccuga

SEQ ID NO: 109525 - RNA, 26 nt, Human
aggacucugugacagguugugaaugu

SEQ ID NO: 109526 - RNA, 21 nt, Human
aagcacaggcuccuguccuca

SEQ ID NO: 109527 - RNA, 20 nt, Human
uuaaccagagagggucugua

SEQ ID NO: 109528 - RNA, 26 nt, Human
uguucugcaagacuacuugguauucu

SEQ ID NO: 109529 - RNA, 21 nt, Human
ggcaacuucuggaugugcagc

SEQ ID NO: 109530 - RNA, 20 nt, Human
ucucugcugcugaugaagcu

SEQ ID NO: 109531 - RNA, 23 nt, Human
uacgagaaaaucugcauguuuga

SEQ ID NO: 109532 - RNA, 23 nt, Human
ggagagggggcuccgggagcggc

SEQ ID NO: 109533 - RNA, 22 nt, Human
ggcucacugcaaccucuaccuc

SEQ ID NO: 109534 - RNA, 23 nt, Human
ggagucccgccccugcccagaac

SEQ ID NO: 109535 - RNA, 22 nt, Human
cugaggcuaaacacaguuuguu

SEQ ID NO: 109536 - RNA, 22 nt, Human
cgcuguauuccaaggccuguga

SEQ ID NO: 109537 - RNA, 20 nt, Human
uuuauuguuuacauugggga

SEQ ID NO: 109538 - RNA, 26 nt, Human
ggcagagaaacugagagaaaagggau

SEQ ID NO: 109539 - RNA, 27 nt, Human
uaacugcauuuguugugauggugcauu

SEQ ID NO: 109540 - RNA, 21 nt, Human
agcucugccuucuuagggcua

SEQ ID NO: 109541 - RNA, 21 nt, Human
cuuuuccguccagugucggca

SEQ ID NO: 109542 - RNA, 27 nt, Human
gagagcaagucacucccggcugccuuu

SEQ ID NO: 109543 - RNA, 25 nt, Human
gcacugacuucguagaaaaccauaa

SEQ ID NO: 109544 - RNA, 22 nt, Human
gaaucauuuucuuucucucugc

SEQ ID NO: 109545 - RNA, 22 nt, Human
acaugugggcuggaacagcaga

SEQ ID NO: 109546 - RNA, 19 nt, Human
agcugggguaguuggugag

SEQ ID NO: 109547 - RNA, 22 nt, Human
ggcccagagagaagaaaaagac

SEQ ID NO: 109548 - RNA, 27 nt, Human
cuggggccuggcuuuucugagauuguc

SEQ ID NO: 109549 - RNA, 23 nt, Human
uccauucauacacaacguaauca

SEQ ID NO: 109550 - RNA, 25 nt, Human
uuuacaacacuugugaaagcaacuc

SEQ ID NO: 109551 - RNA, 20 nt, Human
gaaauaaacauuuguguaca

SEQ ID NO: 109552 - RNA, 25 nt, Human
uuuuucucccccacacuucgcggcu

SEQ ID NO: 109553 - RNA, 27 nt, Human
agaaugcugagguuacaggcaccauga

SEQ ID NO: 109554 - RNA, 25 nt, Human
ggguacuggcaucagagccuggugc

SEQ ID NO: 109555 - RNA, 22 nt, Human
gccaacuaagacacacuccuua

SEQ ID NO: 109556 - RNA, 26 nt, Human
aagcagcugugggcugcgggcagaca

SEQ ID NO: 109557 - RNA, 23 nt, Human
gcugcuugaggcaacucaucuua

SEQ ID NO: 109558 - RNA, 24 nt, Human
gccaggcaccaagcaugugugugc

SEQ ID NO: 109559 - RNA, 23 nt, Human
ugcuuguagcuccucacagcagg

SEQ ID NO: 109560 - RNA, 27 nt, Human
cacaggcagaucugcuuggggaagcua

SEQ ID NO: 109561 - RNA, 21 nt, Human
uccugcucucccucccugccc

SEQ ID NO: 109562 - RNA, 19 nt, Human
uuuaaagaggugagcuugg

SEQ ID NO: 109563 - RNA, 25 nt, Human
gggccaggccugggugaucugcugc

SEQ ID NO: 109564 - RNA, 23 nt, Human
cugcugucgccugcgccugcugc

SEQ ID NO: 109565 - RNA, 22 nt, Human
cacagcccuauucaggcaggag

SEQ ID NO: 109566 - RNA, 25 nt, Human
ugccuucuguuucacagcugccacc

SEQ ID NO: 109567 - RNA, 24 nt, Human
uuuggccuugggguccauccugga

SEQ ID NO: 109568 - RNA, 19 nt, Human
gcaugaacuccacucugag

SEQ ID NO: 109569 - RNA, 21 nt, Human
caccuucccaaagaaauuuua

SEQ ID NO: 109570 - RNA, 20 nt, Human
gugaucuuccugccuuggca

SEQ ID NO: 109571 - RNA, 18 nt, Human
guccucuuccuggcucau

SEQ ID NO: 109572 - RNA, 22 nt, Human
uccagugagccgagauggcgcu

SEQ ID NO: 109573 - RNA, 24 nt, Human
ucuucuuuuauuucuaggcuguac

SEQ ID NO: 109574 - RNA, 26 nt, Human
aggccuccugucucccuucaaaggga

SEQ ID NO: 109575 - RNA, 22 nt, Human
aacaacugggcuuaucacuggg

SEQ ID NO: 109576 - RNA, 21 nt, Human
agcuuccaggcuggcgugcag

SEQ ID NO: 109577 - RNA, 17 nt, Human
ccggcccucagcccagc

SEQ ID NO: 109578 - RNA, 19 nt, Human
acugggcauacuacaugua

SEQ ID NO: 109579 - RNA, 21 nt, Human
cuacgagagaaggaaagagcg

SEQ ID NO: 109580 - RNA, 22 nt, Human
gguucauccuuaccaguggcca

SEQ ID NO: 109581 - RNA, 20 nt, Human
ucucaaaguggagacuuuaa

SEQ ID NO: 109582 - RNA, 27 nt, Human
ccagguggcaggcagagcaggaugcag

SEQ ID NO: 109583 - RNA, 26 nt, Human
ccauuuuucuuccaggaugguguuac

SEQ ID NO: 109584 - RNA, 23 nt, Human
uaaccaccauccauggucaagac

SEQ ID NO: 109585 - RNA, 19 nt, Human
ucuccugaucccaggcugg

SEQ ID NO: 109586 - RNA, 26 nt, Human
caccuugcucagccaucccgucuucu

SEQ ID NO: 109587 - RNA, 21 nt, Human
cugccccugggcagggccaug

SEQ ID NO: 109588 - RNA, 26 nt, Human
ccucuaccuccuggguucaagggauu

SEQ ID NO: 109589 - RNA, 26 nt, Human
caaaguaaugguuuuucucucaguuc

SEQ ID NO: 109590 - RNA, 27 nt, Human
agagccuaagaaaaucaucuuggccac

SEQ ID NO: 109591 - RNA, 19 nt, Human
ugccuccagggcuggaauc

SEQ ID NO: 109592 - RNA, 24 nt, Human
caccugaggucaggaguuagaggc

SEQ ID NO: 109593 - RNA, 21 nt, Human
aucccgcugcaccucuuguuu

SEQ ID NO: 109594 - RNA, 24 nt, Human
agcuagagaaaauguuauuuagaa

SEQ ID NO: 109595 - RNA, 22 nt, Human
aguggggacggaagaugagcgc

SEQ ID NO: 109596 - RNA, 24 nt, Human
gggggagggggcaaaagaccaugc

SEQ ID NO: 109597 - RNA, 21 nt, Human
uccagccugggugacagaacg

SEQ ID NO: 109598 - RNA, 20 nt, Human
acuagcaauggcaaagcuuu

SEQ ID NO: 109599 - RNA, 26 nt, Human
aaagaggauugugauguaucacugga

SEQ ID NO: 109600 - RNA, 21 nt, Human
gggagagagaguuugagacag

SEQ ID NO: 109601 - RNA, 20 nt, Human
guggcauuuguuuucacuuu

SEQ ID NO: 109602 - RNA, 22 nt, Human
cuagcccugacccaggcacuag

SEQ ID NO: 109603 - RNA, 26 nt, Human
gcaugcgccgacgaugcccagaaucc

SEQ ID NO: 109604 - RNA, 24 nt, Human
ugaggcucuuuuuagaauugaauu

SEQ ID NO: 109605 - RNA, 25 nt, Human
ggacugggggacgggcggguacggc

SEQ ID NO: 109606 - RNA, 21 nt, Human
agucccugucauauuaccaac

SEQ ID NO: 109607 - RNA, 23 nt, Human
uuugugcuugggauuacaguugu

SEQ ID NO: 109608 - RNA, 25 nt, Human
ucagucucuaccauaucugguccca

SEQ ID NO: 109609 - RNA, 26 nt, Human
uuggcacaucaaaaauucucagucau

SEQ ID NO: 109610 - RNA, 23 nt, Human
ugaagaagugggagagccauugg

SEQ ID NO: 109611 - RNA, 24 nt, Human
agacaacaggcauuuucuuucuuu

SEQ ID NO: 109612 - RNA, 26 nt, Human
gaggcucuugcucaaguguuuucuga

SEQ ID NO: 109613 - RNA, 22 nt, Human
uccucucagaacaucagccuca

SEQ ID NO: 109614 - RNA, 24 nt, Human
aacugauuuuagaaaaagaagcuu

SEQ ID NO: 109615 - RNA, 18 nt, Human
cacugccuuauacugugu

SEQ ID NO: 109616 - RNA, 20 nt, Human
gucgccaggcaggaggccau

SEQ ID NO: 109617 - RNA, 24 nt, Human
cgauccgaccucgcagucucccca

SEQ ID NO: 109618 - RNA, 27 nt, Human
uggcucaggguggucucuucuuggggc

SEQ ID NO: 109619 - RNA, 20 nt, Human
agggagagaggcguccccca

SEQ ID NO: 109620 - RNA, 23 nt, Human
ggagugugugguguuagggugca

SEQ ID NO: 109621 - RNA, 24 nt, Human
gacuauuuguuuuacuuucuugga

SEQ ID NO: 109622 - RNA, 20 nt, Human
guauauguagggaccccaaa

SEQ ID NO: 109623 - RNA, 20 nt, Human
gcauuuggaacaacaaaucu

SEQ ID NO: 109624 - RNA, 24 nt, Human
ggagagaggggugugggaggaagc

SEQ ID NO: 109625 - RNA, 19 nt, Human
agaacccauguuguauaca

SEQ ID NO: 109626 - RNA, 19 nt, Human
ucugcaggcaccaggcugg

SEQ ID NO: 109627 - RNA, 21 nt, Human
auccaggagacaaaugacaga

SEQ ID NO: 109628 - RNA, 19 nt, Human
ggaacaaacugaaggcccg

SEQ ID NO: 109629 - RNA, 28 nt, Human
auuucaaucuucugccuccuggauaucu

SEQ ID NO: 109630 - RNA, 17 nt, Human
ccuuucuccccugggcu

SEQ ID NO: 109631 - RNA, 21 nt, Human
uucugggaaaagcgugccucc

SEQ ID NO: 109632 - RNA, 21 nt, Human
aggccuuggaagaguccggcc

SEQ ID NO: 109633 - RNA, 21 nt, Human
ccugcaaucccagcacuuugg

SEQ ID NO: 109634 - RNA, 22 nt, Human
cacaaagagcaggacuccagac

SEQ ID NO: 109635 - RNA, 28 nt, Human
cccauguguguggccucagucucagcau

SEQ ID NO: 109636 - RNA, 25 nt, Human
ccugcugucuucagcucuucuugac

SEQ ID NO: 109637 - RNA, 24 nt, Human
ccuacccucucccugccuggcaca

SEQ ID NO: 109638 - RNA, 27 nt, Human
guggcaaaaauaaugacauguagcaaa

SEQ ID NO: 109639 - RNA, 28 nt, Human
agauugcaccacugcacuccagccuggg

SEQ ID NO: 109640 - RNA, 22 nt, Human
gcagcugcuucuccaauggcuu

SEQ ID NO: 109641 - RNA, 32 nt, Human
gagaggaggaugggccucaggagcaucucaag

SEQ ID NO: 109642 - RNA, 23 nt, Human
cccugaagccuuugcauuuugga

SEQ ID NO: 109643 - RNA, 31 nt, Human
cccucccgucuuccuccuccccuggcaacug

SEQ ID NO: 109644 - RNA, 20 nt, Human
aucuuuguuuccccaccuca

SEQ ID NO: 109645 - RNA, 22 nt, Human
uggggugagcugagauugcgcc

SEQ ID NO: 109646 - RNA, 20 nt, Human
cuuacauuccuuuuuugaug

SEQ ID NO: 109647 - RNA, 20 nt, Human
auuccacccuuucugguguc

SEQ ID NO: 109648 - RNA, 27 nt, Human
agcugggggacacuggcuccugccauc

SEQ ID NO: 109649 - RNA, 20 nt, Human
gugacaaugcaagguaagua

SEQ ID NO: 109650 - RNA, 23 nt, Human
augauaguacaagacagagguug

SEQ ID NO: 109651 - RNA, 23 nt, Human
ucaguccacuuaagggcaguggg

SEQ ID NO: 109652 - RNA, 27 nt, Human
cucuguccccaucauucagucaccucc

SEQ ID NO: 109653 - RNA, 24 nt, Human
ucuguguccuaaggguaauuucuc

SEQ ID NO: 109654 - RNA, 23 nt, Human
ucaagaggaagaaaaaugaugga

SEQ ID NO: 109655 - RNA, 22 nt, Human
augauucucaagccagagacaa

SEQ ID NO: 109656 - RNA, 20 nt, Human
cuagcccggcuggagggcgg

SEQ ID NO: 109657 - RNA, 21 nt, Human
caccgcgcuccgccuccagcc

SEQ ID NO: 109658 - RNA, 21 nt, Human
uguuccacuuguuugcacugu

SEQ ID NO: 109659 - RNA, 22 nt, Human
ugacagucuucucuuuguacuc

SEQ ID NO: 109660 - RNA, 22 nt, Human
gcccagucucuucucuggaucu

SEQ ID NO: 109661 - RNA, 21 nt, Human
uuuguugugcuugcugguacu

SEQ ID NO: 109662 - RNA, 19 nt, Human
gucucucccucccuugcca

SEQ ID NO: 109663 - RNA, 21 nt, Human
cugccuaagccguucaguucu

SEQ ID NO: 109664 - RNA, 25 nt, Human
gucuucucucaauuccagucaucuc

SEQ ID NO: 109665 - RNA, 26 nt, Human
cauccuuuguucugagcauucgcugu

SEQ ID NO: 109666 - RNA, 25 nt, Human
ugguggacaggaugguucggcaaag

SEQ ID NO: 109667 - RNA, 22 nt, Human
cacccugucuccagcugcucug

SEQ ID NO: 109668 - RNA, 23 nt, Human
ggcauuuucacaacaaucucucc

SEQ ID NO: 109669 - RNA, 22 nt, Human
agaaaacaagcaaguucugaga

SEQ ID NO: 109670 - RNA, 27 nt, Human
ugaaagaaguuuuuaugagaauaacac

SEQ ID NO: 109671 - RNA, 19 nt, Human
gauggauguaaaguguggg

SEQ ID NO: 109672 - RNA, 24 nt, Human
gcccccacugugaaggggcuggcc

SEQ ID NO: 109673 - RNA, 27 nt, Human
cuaccugccuaagggacuuaacuuguu

SEQ ID NO: 109674 - RNA, 27 nt, Human
aaccugcccucggacgcuccuggagcu

SEQ ID NO: 109675 - RNA, 21 nt, Human
aucaucugcccuuuuauucac

SEQ ID NO: 109676 - RNA, 23 nt, Human
cagagauggugcccuugcuuuau

SEQ ID NO: 109677 - RNA, 21 nt, Human
ggagucuugcucugucgccca

SEQ ID NO: 109678 - RNA, 23 nt, Human
gucuuugcacuuccauccucucc

SEQ ID NO: 109679 - RNA, 27 nt, Human
ccaccucucuccuuugcugaggccucc

SEQ ID NO: 109680 - RNA, 22 nt, Human
ggaggguaguuucagucacuca

SEQ ID NO: 109681 - RNA, 27 nt, Human
cuugccguggcucuuccuccucccuca

SEQ ID NO: 109682 - RNA, 19 nt, Human
acaggcaagccagcucugg

SEQ ID NO: 109683 - RNA, 22 nt, Human
gaacuccagauuccugguucau

SEQ ID NO: 109684 - RNA, 20 nt, Human
ccagcucuccagccuggcag

SEQ ID NO: 109685 - RNA, 20 nt, Human
acucugcugcugggaucacc

SEQ ID NO: 109686 - RNA, 19 nt, Human
ggaaauguggcucucucca

SEQ ID NO: 109687 - RNA, 25 nt, Human
uggaagguggagcguucaccaguga

SEQ ID NO: 109688 - RNA, 21 nt, Human
ucuaaacaacccagaaugguc

SEQ ID NO: 109689 - RNA, 22 nt, Human
cgcccaggcuggaaugcagugg

SEQ ID NO: 109690 - RNA, 21 nt, Human
uugcgaguccaaggccagucc

SEQ ID NO: 109691 - RNA, 25 nt, Human
cagucuccagcagagcaggcaguca

SEQ ID NO: 109692 - RNA, 26 nt, Human
cugccccugugccucuguccuagacu

SEQ ID NO: 109693 - RNA, 27 nt, Human
agccaguaccagcuuugguaauguuag

SEQ ID NO: 109694 - RNA, 25 nt, Human
cucucagugcgguguucugugacau

SEQ ID NO: 109695 - RNA, 19 nt, Human
uuugcaaauauauuuugga

SEQ ID NO: 109696 - RNA, 21 nt, Human
ugaguccuggcucaagucaau

SEQ ID NO: 109697 - RNA, 23 nt, Human
ccucuucuuuuuuccaacuguga

SEQ ID NO: 109698 - RNA, 25 nt, Human
uucaccuaggugaggugugugcagc

SEQ ID NO: 109699 - RNA, 24 nt, Human
gucuuaguccuugcccugccucag

SEQ ID NO: 109700 - RNA, 19 nt, Human
cccugcucucccguucgcc

SEQ ID NO: 109701 - RNA, 23 nt, Human
ccuaugauggugccauugcacag

SEQ ID NO: 109702 - RNA, 20 nt, Human
uaauguguauuaugugccua

SEQ ID NO: 109703 - RNA, 27 nt, Human
auacauacauuuaggacugcaauuuuu

SEQ ID NO: 109704 - RNA, 24 nt, Human
cccuuucucccaucuuaaggggcu

SEQ ID NO: 109705 - RNA, 19 nt, Human
guucauuuuuucucuuuau

SEQ ID NO: 109706 - RNA, 21 nt, Human
cguugacuuguuggcugccag

SEQ ID NO: 109707 - RNA, 28 nt, Human
uuucucuguaaggcaaaauaaucuaaaa

SEQ ID NO: 109708 - RNA, 27 nt, Human
guuauguuugaugggaaagaccacuac

SEQ ID NO: 109709 - RNA, 27 nt, Human
caggcugaagugcaguggugugaucuc

SEQ ID NO: 109710 - RNA, 20 nt, Human
cuccucuggcugguaccaug

SEQ ID NO: 109711 - RNA, 24 nt, Human
ggucccugugggucaaauuggggg

SEQ ID NO: 109712 - RNA, 22 nt, Human
uucagaagucacacauuacaaa

SEQ ID NO: 109713 - RNA, 26 nt, Human
cgcuuucucaacacccuuccuugucc

SEQ ID NO: 109714 - RNA, 24 nt, Human
ggagacacagauguccagagugau

SEQ ID NO: 109715 - RNA, 30 nt, Human
gaguggauuccuggcuccagaaaaugggcu

SEQ ID NO: 109716 - RNA, 22 nt, Human
cauuuucucucugggccuguau

SEQ ID NO: 109717 - RNA, 22 nt, Human
uauaagggggagcuagccuccu

SEQ ID NO: 109718 - RNA, 21 nt, Human
cagaaagcaucugcaugugaa

SEQ ID NO: 109719 - RNA, 24 nt, Human
gagggcucacucagccacccugag

SEQ ID NO: 109720 - RNA, 25 nt, Human
ucacuguauuggacgggaguaguaa

SEQ ID NO: 109721 - RNA, 22 nt, Human
aggcugaggugggagaauuacc

SEQ ID NO: 109722 - RNA, 23 nt, Human
ccugccacaggcugggcucuugu

SEQ ID NO: 109723 - RNA, 25 nt, Human
auggcaagcacgggacaggaggggc

SEQ ID NO: 109724 - RNA, 24 nt, Human
uccugcagcccuccagacuuccug

SEQ ID NO: 109725 - RNA, 21 nt, Human
uccugcagguggcccggccug

SEQ ID NO: 109726 - RNA, 24 nt, Human
agcguccuguccaccaugcccuca

SEQ ID NO: 109727 - RNA, 22 nt, Human
cagccucuuaaagcugccugua

SEQ ID NO: 109728 - RNA, 27 nt, Human
ucccugccucuucccuaacuagacaau

SEQ ID NO: 109729 - RNA, 22 nt, Human
cuauguucacugccacucugaa

SEQ ID NO: 109730 - RNA, 23 nt, Human
gcuguuauuaaacugucauuucu

SEQ ID NO: 109731 - RNA, 24 nt, Human
gagggcaugaagcugcauaugaua

SEQ ID NO: 109732 - RNA, 21 nt, Human
gccuuccuuccagucugggcu

SEQ ID NO: 109733 - RNA, 22 nt, Human
uacuacacaacuugcuacuuuc

SEQ ID NO: 109734 - RNA, 27 nt, Human
ggcucagcgcaagaggaagcagaggga

SEQ ID NO: 109735 - RNA, 22 nt, Human
aacgggcggcagguugcagugg

SEQ ID NO: 109736 - RNA, 29 nt, Human
ugccaugguucacagcaaugugcuacgau

SEQ ID NO: 109737 - RNA, 22 nt, Human
auagccucugauucccucgcug

SEQ ID NO: 109738 - RNA, 25 nt, Human
acucugcagcauuaaacaacgugua

SEQ ID NO: 109739 - RNA, 29 nt, Human
gcgcggcuggaggugugaggauccgaacc

SEQ ID NO: 109740 - RNA, 21 nt, Human
ccuaagugccuggcagaugaa

SEQ ID NO: 109741 - RNA, 23 nt, Human
agcucacuaagucaguccuuccu

SEQ ID NO: 109742 - RNA, 20 nt, Human
ggauucuccuguuucaucug

SEQ ID NO: 109743 - RNA, 26 nt, Human
cccuuuccuugcuccaacuccuuguc

SEQ ID NO: 109744 - RNA, 22 nt, Human
ugaaguauuguauuuugcaaaa

SEQ ID NO: 109745 - RNA, 21 nt, Human
ccaaccucacccuccugaccc

SEQ ID NO: 109746 - RNA, 21 nt, Human
uucaucugugaaaugaagaaa

SEQ ID NO: 109747 - RNA, 22 nt, Human
agccacauggagggaguuucau

SEQ ID NO: 109748 - RNA, 21 nt, Human
uuucucucaccucaccuuuca

SEQ ID NO: 109749 - RNA, 23 nt, Human
ucuacaaagcaucugauuuugga

SEQ ID NO: 109750 - RNA, 26 nt, Human
cugcucccugguuccacucuggagag

SEQ ID NO: 109751 - RNA, 22 nt, Human
cacaggcuggaccagaugcugu

SEQ ID NO: 109752 - RNA, 23 nt, Human
aaggaaaaaggagcccagcaaga

SEQ ID NO: 109753 - RNA, 20 nt, Human
gacccugcaggguaaaagaa

SEQ ID NO: 109754 - RNA, 27 nt, Human
uuucccaaguucucccgccugcgucgg

SEQ ID NO: 109755 - RNA, 26 nt, Human
ucugccaggcugggguguuuucggua

SEQ ID NO: 109756 - RNA, 22 nt, Human
agugugcggacagaggagacca

SEQ ID NO: 109757 - RNA, 22 nt, Human
cagcucuuuccccucagcucuu

SEQ ID NO: 109758 - RNA, 21 nt, Human
acaucagaaaaagcaguauua

SEQ ID NO: 109759 - RNA, 21 nt, Human
cgggcccuggggcuaggccau

SEQ ID NO: 109760 - RNA, 22 nt, Human
guugugcaggcuguagugcagu

SEQ ID NO: 109761 - RNA, 27 nt, Human
uguccaaggcuuguccaggcuucuggg

SEQ ID NO: 109762 - RNA, 22 nt, Human
ggcuaaauccagaaucguuuca

SEQ ID NO: 109763 - RNA, 26 nt, Human
ugaauggcuaauauuuuggugcagug

SEQ ID NO: 109764 - RNA, 22 nt, Human
uguggacagccugagucaccug

SEQ ID NO: 109765 - RNA, 20 nt, Human
uucucuuguaagugauauga

SEQ ID NO: 109766 - RNA, 23 nt, Human
cuagaggcagagguugaagaugg

SEQ ID NO: 109767 - RNA, 23 nt, Human
cgggagggauggagggaggcagg

SEQ ID NO: 109768 - RNA, 24 nt, Human
aguaugugcuacuuuuuugucccu

SEQ ID NO: 109769 - RNA, 20 nt, Human
uucuggugacuugagcuuga

SEQ ID NO: 109770 - RNA, 23 nt, Human
ggugaagcugcagccuggccagg

SEQ ID NO: 109771 - RNA, 22 nt, Human
aucugugaccuccaggcagcag

SEQ ID NO: 109772 - RNA, 22 nt, Human
cacccagguugcugucggcagg

SEQ ID NO: 109773 - RNA, 22 nt, Human
gaaaguccagggcuauagggug

SEQ ID NO: 109774 - RNA, 21 nt, Human
gguuuuuuauaucaaacuaua

SEQ ID NO: 109775 - RNA, 28 nt, Human
cuggacuucccugggccuuucccugugg

SEQ ID NO: 109776 - RNA, 22 nt, Human
ucaguacugcagcgccacccag

SEQ ID NO: 109777 - RNA, 22 nt, Human
ugcucuaauacuguacugugua

SEQ ID NO: 109778 - RNA, 22 nt, Human
cuccucucccccuuccuaagaa

SEQ ID NO: 109779 - RNA, 27 nt, Human
uuguggaauauuugaguucuauuucca

SEQ ID NO: 109780 - RNA, 24 nt, Human
uguugcccaggcuggucgugaacu

SEQ ID NO: 109781 - RNA, 20 nt, Human
ggguagcgagguugcaggag

SEQ ID NO: 109782 - RNA, 20 nt, Human
cagugugugaacaaaucuuu

SEQ ID NO: 109783 - RNA, 19 nt, Human
cugcucccuccccuuuuuc

SEQ ID NO: 109784 - RNA, 21 nt, Human
uugaaucagauauuuuaucaa

SEQ ID NO: 109785 - RNA, 20 nt, Human
cagacagaguaccagguuuu

SEQ ID NO: 109786 - RNA, 22 nt, Human
ggcugaggacugcaagaggaga

SEQ ID NO: 109787 - RNA, 21 nt, Human
caggaaguggcaguugcagug

SEQ ID NO: 109788 - RNA, 24 nt, Human
ggagggcaggggcgcgcagagcca

SEQ ID NO: 109789 - RNA, 20 nt, Human
acagaugggaauaugagugc

SEQ ID NO: 109790 - RNA, 31 nt, Human
gcugccaguccucucugggccgcagcggacc

SEQ ID NO: 109791 - RNA, 24 nt, Human
guuacugguagaaaggcaguucag

SEQ ID NO: 109792 - RNA, 21 nt, Human
acagccuggguuagucucuua

SEQ ID NO: 109793 - RNA, 23 nt, Human
cuccuguuuuucucaucugugca

SEQ ID NO: 109794 - RNA, 23 nt, Human
gcugggcuuugggcuugccugcc

SEQ ID NO: 109795 - RNA, 22 nt, Human
guuucaggcccugguugggcag

SEQ ID NO: 109796 - RNA, 26 nt, Human
ucucuauacuguacacucacccauaa

SEQ ID NO: 109797 - RNA, 24 nt, Human
ccuccuggccccgcgguucugugc

SEQ ID NO: 109798 - RNA, 26 nt, Human
aacgugcacuuccuguccucgcugcu

SEQ ID NO: 109799 - RNA, 23 nt, Human
gaugggguuucuccauguugguc

SEQ ID NO: 109800 - RNA, 21 nt, Human
ggguuuaugcaaauacaauca

SEQ ID NO: 109801 - RNA, 22 nt, Human
aguggugcggucucggcucacu

SEQ ID NO: 109802 - RNA, 17 nt, Human
uggccucugcuggggcc

SEQ ID NO: 109803 - RNA, 28 nt, Human
cugugugcaggucuucauauaaacuuua

SEQ ID NO: 109804 - RNA, 24 nt, Human
augucaucccuaaugacacaugcc

SEQ ID NO: 109805 - RNA, 21 nt, Human
ggcggcggggccagaggcuca

SEQ ID NO: 109806 - RNA, 22 nt, Human
uccauccccaguccagccuggg

SEQ ID NO: 109807 - RNA, 21 nt, Human
ucuguaaccucccguugcguc

SEQ ID NO: 109808 - RNA, 22 nt, Human
uccagauguuugcacaguaucu

SEQ ID NO: 109809 - RNA, 21 nt, Human
ccggagguagagguuguggug

SEQ ID NO: 109810 - RNA, 22 nt, Human
agucucccaaguagcugggacu

SEQ ID NO: 109811 - RNA, 22 nt, Human
cuccaguuuucuccucugcuuc

SEQ ID NO: 109812 - RNA, 20 nt, Human
ucuccuccuuucaccucugc

SEQ ID NO: 109813 - RNA, 22 nt, Human
agucauuuucaguuguaccuua

SEQ ID NO: 109814 - RNA, 19 nt, Human
agccaagugcaguggcaug

SEQ ID NO: 109815 - RNA, 23 nt, Human
gguuuggugcggugaguccugcc

SEQ ID NO: 109816 - RNA, 27 nt, Human
ucccucgggggcuuugggaaagcaugg

SEQ ID NO: 109817 - RNA, 26 nt, Human
uagagugccuccaggguggucuuccu

SEQ ID NO: 109818 - RNA, 27 nt, Human
uaccauccuaauuuuacaggcaaggac

SEQ ID NO: 109819 - RNA, 27 nt, Human
agggaguccacggagaagaugcaguga

SEQ ID NO: 109820 - RNA, 24 nt, Human
guuuuguauauuuuaauagacuga

SEQ ID NO: 109821 - RNA, 20 nt, Human
uugggaagagagagggacag

SEQ ID NO: 109822 - RNA, 23 nt, Human
cuggugccucaguuuccccacau

SEQ ID NO: 109823 - RNA, 26 nt, Human
ucaguccuaggcuggaugggagggug

SEQ ID NO: 109824 - RNA, 23 nt, Human
gcuuccuuuggggaccagaggaa

SEQ ID NO: 109825 - RNA, 22 nt, Human
gcuccaagagaaagugccagga

SEQ ID NO: 109826 - RNA, 22 nt, Human
accagcuuaggccuccuccaua

SEQ ID NO: 109827 - RNA, 27 nt, Human
ggucucgaucucuugaccucgugaucu

SEQ ID NO: 109828 - RNA, 26 nt, Human
ucuccuccucgcgcgucuuggacaug

SEQ ID NO: 109829 - RNA, 27 nt, Human
cccagcauggcaggaucucuuccuguu

SEQ ID NO: 109830 - RNA, 19 nt, Human
ccagucuccccugcugucc

SEQ ID NO: 109831 - RNA, 26 nt, Human
cucucauccauucccauucauguccc

SEQ ID NO: 109832 - RNA, 22 nt, Human
ugcaugaugggagaaucaugaa

SEQ ID NO: 109833 - RNA, 27 nt, Human
uggcuguagcuuucucucauauauauc

SEQ ID NO: 109834 - RNA, 21 nt, Human
uucuugaacaguuuaugcagu

SEQ ID NO: 109835 - RNA, 18 nt, Human
agagaagaauccagggaa

SEQ ID NO: 109836 - RNA, 27 nt, Human
gggccuuuccucaguguucaugcaaaa

SEQ ID NO: 109837 - RNA, 21 nt, Human
gggaggcggugguccugggag

SEQ ID NO: 109838 - RNA, 24 nt, Human
aggaagacaguggcuucaccuguc

SEQ ID NO: 109839 - RNA, 23 nt, Human
ucacugcagccugcuuugugcuu

SEQ ID NO: 109840 - RNA, 23 nt, Human
ggagagggggcagccagagcggc

SEQ ID NO: 109841 - RNA, 21 nt, Human
ugccugucuucaagaucccag

SEQ ID NO: 109842 - RNA, 23 nt, Human
uauacugaaaucugugcucucaa

SEQ ID NO: 109843 - RNA, 23 nt, Human
uguuuggacuauguuuucuuuuc

SEQ ID NO: 109844 - RNA, 20 nt, Human
ucuguggguugcacuuacaa

SEQ ID NO: 109845 - RNA, 21 nt, Human
cuaucucauagggaugcugug

SEQ ID NO: 109846 - RNA, 22 nt, Human
cuccuuuccccuccugucuucc

SEQ ID NO: 109847 - RNA, 20 nt, Human
gcuaucucuuuuacuguacc

SEQ ID NO: 109848 - RNA, 26 nt, Human
ugaagugccuaagaugaccuauuugu

SEQ ID NO: 109849 - RNA, 22 nt, Human
gccucuccuuguggccugggcc

SEQ ID NO: 109850 - RNA, 17 nt, Human
ucuacaguuugcagugg

SEQ ID NO: 109851 - RNA, 25 nt, Human
cucuuccuugacaugcauuguaaau

SEQ ID NO: 109852 - RNA, 23 nt, Human
cacacugagagaguggagaguga

SEQ ID NO: 109853 - RNA, 22 nt, Human
gccuggcccagaagaaacuuau

SEQ ID NO: 109854 - RNA, 26 nt, Human
cugccucuccgucuuguaaugaguug

SEQ ID NO: 109855 - RNA, 20 nt, Human
accuauaucucaguggcaca

SEQ ID NO: 109856 - RNA, 23 nt, Human
cuuauuuaaaauuuaggagagaa

SEQ ID NO: 109857 - RNA, 22 nt, Human
gcucacugcaaccucugcuucc

SEQ ID NO: 109858 - RNA, 19 nt, Human
auuaccagcugacacugcu

SEQ ID NO: 109859 - RNA, 21 nt, Human
uacauacuguuccagacuuuu

SEQ ID NO: 109860 - RNA, 22 nt, Human
ccuguaaucccagcuacuaggg

SEQ ID NO: 109861 - RNA, 20 nt, Human
ggggugagccaagcccugcc

SEQ ID NO: 109862 - RNA, 22 nt, Human
uguaaucccaggagaauugcuu

SEQ ID NO: 109863 - RNA, 22 nt, Human
ggcuggaguacaguggugccau

SEQ ID NO: 109864 - RNA, 21 nt, Human
ugcaaacacacaagcccucug

SEQ ID NO: 109865 - RNA, 26 nt, Human
uagggaggcugaggcaggagaaucgc

SEQ ID NO: 109866 - RNA, 21 nt, Human
accagcugugcgaugcccgcu

SEQ ID NO: 109867 - RNA, 21 nt, Human
cacaauaacagaguacucuca

SEQ ID NO: 109868 - RNA, 21 nt, Human
gcuucuaaucccagcacuuug

SEQ ID NO: 109869 - RNA, 32 nt, Human
gcugggccuccacuucagccuagugaacaaaa

SEQ ID NO: 109870 - RNA, 21 nt, Human
uauuugacuuguuuuuucgaa

SEQ ID NO: 109871 - RNA, 26 nt, Human
cacccaggcagcggcucagaggcagc

SEQ ID NO: 109872 - RNA, 20 nt, Human
uauuguccugcuccccuguu

SEQ ID NO: 109873 - RNA, 19 nt, Human
agagagggagauccccagu

SEQ ID NO: 109874 - RNA, 22 nt, Human
ggccugcuccuuccuuagccuu

SEQ ID NO: 109875 - RNA, 22 nt, Human
gaguuguugcccacagcuguau

SEQ ID NO: 109876 - RNA, 25 nt, Human
cucacucagguacacagugccaaca

SEQ ID NO: 109877 - RNA, 23 nt, Human
cccacgcaccagcagccgccucc

SEQ ID NO: 109878 - RNA, 22 nt, Human
gggaggcagagcuugcagugag

SEQ ID NO: 109879 - RNA, 22 nt, Human
ucguagcuccacucugcagccu

SEQ ID NO: 109880 - RNA, 21 nt, Human
acagggagacuugucuaugac

SEQ ID NO: 109881 - RNA, 20 nt, Human
gccauaaaacaauagcuuuc

SEQ ID NO: 109882 - RNA, 23 nt, Human
cugauguuacaucacaguguuug

SEQ ID NO: 109883 - RNA, 29 nt, Human
ugcuuugcugugugaaauuuaaaaaaggg

SEQ ID NO: 109884 - RNA, 28 nt, Human
uagcuauccuuggcuuucugugccagcc

SEQ ID NO: 109885 - RNA, 21 nt, Human
uuuugauucuuuucccccuac

SEQ ID NO: 109886 - RNA, 20 nt, Human
auguucucucacccgcuuca

SEQ ID NO: 109887 - RNA, 21 nt, Human
gcugccugugccugccauggg

SEQ ID NO: 109888 - RNA, 22 nt, Human
cuaccucccucccucuccgcgg

SEQ ID NO: 109889 - RNA, 27 nt, Human
acugccucugggaccccugccggccag

SEQ ID NO: 109890 - RNA, 27 nt, Human
cauuuucucucugggccuguauccaug

SEQ ID NO: 109891 - RNA, 27 nt, Human
ggaggcugaggcaggaaaauggcguga

SEQ ID NO: 109892 - RNA, 20 nt, Human
aauaaaucagcaguuaugag

SEQ ID NO: 109893 - RNA, 25 nt, Human
uuggauucaucagcauuuggaccaa

SEQ ID NO: 109894 - RNA, 23 nt, Human
ugguggagaaagaagugggaagg

SEQ ID NO: 109895 - RNA, 27 nt, Human
gcuagugagcugugauuguaccacugc

SEQ ID NO: 109896 - RNA, 25 nt, Human
cccaaaggcaacaugacggaaccuu

SEQ ID NO: 109897 - RNA, 27 nt, Human
ccauugcacuccagccuggguaacaag

SEQ ID NO: 109898 - RNA, 23 nt, Human
cggaagccagagaaaaagguaga

SEQ ID NO: 109899 - RNA, 22 nt, Human
gcacugaauuaaccugcacuga

SEQ ID NO: 109900 - RNA, 25 nt, Human
ugccucuccuggcccugaaggugcc

SEQ ID NO: 109901 - RNA, 20 nt, Human
uucccaggcggccgucgcgu

SEQ ID NO: 109902 - RNA, 19 nt, Human
gauuuauuuauuguauuua

SEQ ID NO: 109903 - RNA, 21 nt, Human
acuccagccagaccugccuca

SEQ ID NO: 109904 - RNA, 21 nt, Human
aagccacuggggaaaacucga

SEQ ID NO: 109905 - RNA, 27 nt, Human
ucaggcgaagggugguuugcagaugug

SEQ ID NO: 109906 - RNA, 27 nt, Human
cggaccaccugcccagcguuggcgagg

SEQ ID NO: 109907 - RNA, 20 nt, Human
cuucgcugacuccaccgaag

SEQ ID NO: 109908 - RNA, 27 nt, Human
caggaggugggaggccgugggcuuugg

SEQ ID NO: 109909 - RNA, 28 nt, Human
aagauuaugccuacaucucuagaagacu

SEQ ID NO: 109910 - RNA, 29 nt, Human
gggccccuguaacccuacucuccucucuc

SEQ ID NO: 109911 - RNA, 22 nt, Human
cccaggcccgcgucaagagcug

SEQ ID NO: 109912 - RNA, 23 nt, Human
gcuguggucacagcggaggugug

SEQ ID NO: 109913 - RNA, 17 nt, Human
uuugaguaccugaugaa

SEQ ID NO: 109914 - RNA, 26 nt, Human
uaugauacauuacauauugugaaugu

SEQ ID NO: 109915 - RNA, 22 nt, Human
uggggagaagagcauacgccag

SEQ ID NO: 109916 - RNA, 23 nt, Human
gccgcccaaacuggagugcagug

SEQ ID NO: 109917 - RNA, 21 nt, Human
aaaucuguuugcaaggggaag

SEQ ID NO: 109918 - RNA, 30 nt, Human
acugcaccuucugugccucagccguucuug

SEQ ID NO: 109919 - RNA, 23 nt, Human
accucaacaggaacauugacuug

SEQ ID NO: 109920 - RNA, 26 nt, Human
cccugcugcugacccugcagagggaa

SEQ ID NO: 109921 - RNA, 20 nt, Human
ggcaaguugucucucagacu

SEQ ID NO: 109922 - RNA, 22 nt, Human
guacauauacauaacauacaca

SEQ ID NO: 109923 - RNA, 21 nt, Human
uggaaacaaaugguugaugga

SEQ ID NO: 109924 - RNA, 23 nt, Human
cuggacucaggcuggcagagggg

SEQ ID NO: 109925 - RNA, 22 nt, Human
gguucaagcaauucucuugccu

SEQ ID NO: 109926 - RNA, 20 nt, Human
ugcccugcagggaguaccga

SEQ ID NO: 109927 - RNA, 25 nt, Human
uuugcugucccauagucccugccac

SEQ ID NO: 109928 - RNA, 21 nt, Human
gucuguaaucacaucauaugg

SEQ ID NO: 109929 - RNA, 21 nt, Human
cacacagucugaaugcccuuu

SEQ ID NO: 109930 - RNA, 19 nt, Human
ucagacauaccucuguggc

SEQ ID NO: 109931 - RNA, 23 nt, Human
cccacaggaacaaaacacugccu

SEQ ID NO: 109932 - RNA, 21 nt, Human
gacaucucucagcccucucag

SEQ ID NO: 109933 - RNA, 24 nt, Human
gcaagucaggcccuucuggaacac

SEQ ID NO: 109934 - RNA, 22 nt, Human
gaguaagacucugucucaaaaa

SEQ ID NO: 109935 - RNA, 20 nt, Human
aacaacaauuaauuuccucu

SEQ ID NO: 109936 - RNA, 22 nt, Human
auuuguaaagauuaccuugcca

SEQ ID NO: 109937 - RNA, 21 nt, Human
uggcugugggggagaagguuc

SEQ ID NO: 109938 - RNA, 22 nt, Human
uucucucuuuucuuuaagcuua

SEQ ID NO: 109939 - RNA, 20 nt, Human
auccagccagucccucucug

SEQ ID NO: 109940 - RNA, 23 nt, Human
cacugcacacugcacuccauccu

SEQ ID NO: 109941 - RNA, 24 nt, Human
gggaggaagcgagagggaagccgc

SEQ ID NO: 109942 - RNA, 21 nt, Human
gcugaguguucccaccaggaa

SEQ ID NO: 109943 - RNA, 24 nt, Human
ccuggaucugcacaucugccucgc

SEQ ID NO: 109944 - RNA, 25 nt, Human
aaccuguauuacugaauaauaucaa

SEQ ID NO: 109945 - RNA, 22 nt, Human
gggggcuggagucauucuuagc

SEQ ID NO: 109946 - RNA, 21 nt, Human
cucauuucuaguccagccgca

SEQ ID NO: 109947 - RNA, 24 nt, Human
cauggaugcgaggaccacuuugga

SEQ ID NO: 109948 - RNA, 26 nt, Human
gcccugcuugccuggcccuguccugg

SEQ ID NO: 109949 - RNA, 24 nt, Human
cuuguagccagaaugcccuguuca

SEQ ID NO: 109950 - RNA, 22 nt, Human
cgccucaucucagcagccuggg

SEQ ID NO: 109951 - RNA, 19 nt, Human
uccugagugugugcacauu

SEQ ID NO: 109952 - RNA, 19 nt, Human
uccugaacuguuacuccaa

SEQ ID NO: 109953 - RNA, 24 nt, Human
auaccuucuuauuuaaucuuuucu

SEQ ID NO: 109954 - RNA, 27 nt, Human
aagcuaccacaugcaaacauacaagca

SEQ ID NO: 109955 - RNA, 19 nt, Human
ucauuaaaaaauucucccu

SEQ ID NO: 109956 - RNA, 25 nt, Human
ucuucucccuguguggcugcugacu

SEQ ID NO: 109957 - RNA, 26 nt, Human
ucuuagaauaucaaaaagaaaaagaa

SEQ ID NO: 109958 - RNA, 26 nt, Human
ccugcagcuacucuucagaucuggcu

SEQ ID NO: 109959 - RNA, 18 nt, Human
ggaauaaaggcucaggga

SEQ ID NO: 109960 - RNA, 28 nt, Human
ucaaauuccgagugcagaaaagaaaccg

SEQ ID NO: 109961 - RNA, 20 nt, Human
acuguaaauaaaauguguac

SEQ ID NO: 109962 - RNA, 22 nt, Human
ggcuaauuuguguauuuuuagu

SEQ ID NO: 109963 - RNA, 24 nt, Human
auugugccacugcacuccagacug

SEQ ID NO: 109964 - RNA, 17 nt, Human
aggauggagugcagugg

SEQ ID NO: 109965 - RNA, 27 nt, Human
uguggugagccaagaugacacaacugc

SEQ ID NO: 109966 - RNA, 22 nt, Human
gagaggaagaaagagagacaga

SEQ ID NO: 109967 - RNA, 21 nt, Human
ugcgggagggggagggggagu

SEQ ID NO: 109968 - RNA, 25 nt, Human
gcucugaccuucuucaugugggcac

SEQ ID NO: 109969 - RNA, 22 nt, Human
aggaaggaggaaugaggcugga

SEQ ID NO: 109970 - RNA, 27 nt, Human
ccuccuggccccgcgguucugugcacu

SEQ ID NO: 109971 - RNA, 16 nt, Human
uauccucugcuuugcc

SEQ ID NO: 109972 - RNA, 27 nt, Human
ccacuggagugcccggccaggucucca

SEQ ID NO: 109973 - RNA, 25 nt, Human
uuucucuccucuccccaugauguuu

SEQ ID NO: 109974 - RNA, 23 nt, Human
uugcuugagaggcaguguggcuu

SEQ ID NO: 109975 - RNA, 18 nt, Human
ccaaugaucuuuaaugga

SEQ ID NO: 109976 - RNA, 19 nt, Human
accgcaaaaagcaccggga

SEQ ID NO: 109977 - RNA, 27 nt, Human
uagaacaaugcuauaauauauaaugaa

SEQ ID NO: 109978 - RNA, 22 nt, Human
uggaagcccucuuuccccaaau

SEQ ID NO: 109979 - RNA, 22 nt, Human
uccagccugggugacaagagug

SEQ ID NO: 109980 - RNA, 23 nt, Human
uuacccaggguggauugcagcug

SEQ ID NO: 109981 - RNA, 26 nt, Human
uggaaagaauaguugcaguguuuaua

SEQ ID NO: 109982 - RNA, 23 nt, Human
gcgggacagcagccccuccaccu

SEQ ID NO: 109983 - RNA, 20 nt, Human
uaguaccuguaagcauuuua

SEQ ID NO: 109984 - RNA, 22 nt, Human
cagccuauaggccaaugcauga

SEQ ID NO: 109985 - RNA, 20 nt, Human
ucucuguugagagcauuuca

SEQ ID NO: 109986 - RNA, 20 nt, Human
ugcaggacuucacagagaga

SEQ ID NO: 109987 - RNA, 26 nt, Human
gcaacuugguccagauugaaaagugu

SEQ ID NO: 109988 - RNA, 21 nt, Human
uagauccucuagccugggcag

SEQ ID NO: 109989 - RNA, 23 nt, Human
agcucaguauucaugaugguggg

SEQ ID NO: 109990 - RNA, 22 nt, Human
caaguagaugauuuaaccagcc

SEQ ID NO: 109991 - RNA, 22 nt, Human
ugagcagagucaucaugucuuc

SEQ ID NO: 109992 - RNA, 24 nt, Human
cgcgggcgggcggacagaucggag

SEQ ID NO: 109993 - RNA, 22 nt, Human
uuacaaaccacacucauauucg

SEQ ID NO: 109994 - RNA, 26 nt, Human
caaaacaaauguggauuaaguguuua

SEQ ID NO: 109995 - RNA, 27 nt, Human
ucucuugccagcauuuucacauuuugc

SEQ ID NO: 109996 - RNA, 21 nt, Human
guuaucuggcugaaguagacc

SEQ ID NO: 109997 - RNA, 22 nt, Human
aggcauccucacaacaaagaag

SEQ ID NO: 109998 - RNA, 22 nt, Human
acagaagugacugauguucccu

SEQ ID NO: 109999 - RNA, 18 nt, Human
aucaaauuauuaaucuga

SEQ ID NO: 110000 - RNA, 22 nt, Human
agcugaagugggacugucuggc

SEQ ID NO: 110001 - RNA, 21 nt, Human
uuacuagcuaggcuacugagu

SEQ ID NO: 110002 - RNA, 27 nt, Human
uggagaaauguguguagugcuuuuguu

SEQ ID NO: 110003 - RNA, 21 nt, Human
accuguaauaccagcaguuug

SEQ ID NO: 110004 - RNA, 20 nt, Human
guccuccaggcuggggcagg

SEQ ID NO: 110005 - RNA, 24 nt, Human
ugaaaugaucagauaaccuauaaa

SEQ ID NO: 110006 - RNA, 21 nt, Human
ccguuuaacccacugugcuau

SEQ ID NO: 110007 - RNA, 21 nt, Human
agcacagaauucaaagcauuc

SEQ ID NO: 110008 - RNA, 21 nt, Human
ucuuuaaagcaggauucucaa

SEQ ID NO: 110009 - RNA, 20 nt, Human
auggauuuuauuuuuuccua

SEQ ID NO: 110010 - RNA, 21 nt, Human
cggagcugcccgcugugggag

SEQ ID NO: 110011 - RNA, 23 nt, Human
uugccaccaccuggggagagccu

SEQ ID NO: 110012 - RNA, 20 nt, Human
gaagucuccuuucuguuuca

SEQ ID NO: 110013 - RNA, 23 nt, Human
gagagcuaauuuaaggaugacuu

SEQ ID NO: 110014 - RNA, 22 nt, Human
gcaacaggcugggcuucagugg

SEQ ID NO: 110015 - RNA, 23 nt, Human
agaaauuugaaauuucaacaaga

SEQ ID NO: 110016 - RNA, 27 nt, Human
caugcucccagcauuuguccacccacu

SEQ ID NO: 110017 - RNA, 25 nt, Human
cucgccucuuccauccacgucuucc

SEQ ID NO: 110018 - RNA, 20 nt, Human
gcucacauucuagacuggga

SEQ ID NO: 110019 - RNA, 27 nt, Human
accuugugacacucaugcacagcagcc

SEQ ID NO: 110020 - RNA, 22 nt, Human
ccuccacuucugguauaauugu

SEQ ID NO: 110021 - RNA, 21 nt, Human
uugccaaacucugcauuucau

SEQ ID NO: 110022 - RNA, 21 nt, Human
gauugcaggcgugagccacuu

SEQ ID NO: 110023 - RNA, 26 nt, Human
cccccagaccccuccugggcaggcag

SEQ ID NO: 110024 - RNA, 26 nt, Human
caccuugcagcuuuucugcagugugg

SEQ ID NO: 110025 - RNA, 26 nt, Human
uguggacugagacccaccuuucuaga

SEQ ID NO: 110026 - RNA, 27 nt, Human
ggaauucugcuccgugcuuuuagcccu

SEQ ID NO: 110027 - RNA, 22 nt, Human
uaucccuggccaccugccaggc

SEQ ID NO: 110028 - RNA, 18 nt, Human
guauuaucugaaaggcua

SEQ ID NO: 110029 - RNA, 21 nt, Human
cugcaacuuccaccucuggga

SEQ ID NO: 110030 - RNA, 20 nt, Human
ccuucucaggcaagcuguau

SEQ ID NO: 110031 - RNA, 25 nt, Human
guucacauggggacccccuucuugg

SEQ ID NO: 110032 - RNA, 24 nt, Human
cuauaccugggaggacccuggcau

SEQ ID NO: 110033 - RNA, 20 nt, Human
gcaugcuccgacacagcagg

SEQ ID NO: 110034 - RNA, 22 nt, Human
cucagccucccaaaguacaggg

SEQ ID NO: 110035 - RNA, 26 nt, Human
cucuuggguucugucauauuuucccu

SEQ ID NO: 110036 - RNA, 23 nt, Human
ggagaggccucccuggcugccuc

SEQ ID NO: 110037 - RNA, 26 nt, Human
uuccauuuccuaaaguuuacuucauu

SEQ ID NO: 110038 - RNA, 32 nt, Human
cccagugugagcgggugacaccacccgguuag

SEQ ID NO: 110039 - RNA, 22 nt, Human
gggaagcugggguuugcagugg

SEQ ID NO: 110040 - RNA, 23 nt, Human
caggacauggaauuuggccucau

SEQ ID NO: 110041 - RNA, 22 nt, Human
uggaacuacgggaacaauauuc

SEQ ID NO: 110042 - RNA, 24 nt, Human
gcuuccuugugagccgcugccucc

SEQ ID NO: 110043 - RNA, 21 nt, Human
aaaaaucuuuagccugggcaa

SEQ ID NO: 110044 - RNA, 27 nt, Human
gggaggcggggggagacauggcucggc

SEQ ID NO: 110045 - RNA, 22 nt, Human
ugugggugauauggacagcaga

SEQ ID NO: 110046 - RNA, 24 nt, Human
gcauuucagccaccugacaaucuc

SEQ ID NO: 110047 - RNA, 22 nt, Human
cagccaccuggugccaccacag

SEQ ID NO: 110048 - RNA, 22 nt, Human
ccaacauggagaaaccucgucu

SEQ ID NO: 110049 - RNA, 21 nt, Human
aggagugucucaguucugcuu

SEQ ID NO: 110050 - RNA, 20 nt, Human
gauugcccaggaucaagggu

SEQ ID NO: 110051 - RNA, 24 nt, Human
uucucucuguaccacgugcacaug

SEQ ID NO: 110052 - RNA, 21 nt, Human
uuguacacacaagggccaggc

SEQ ID NO: 110053 - RNA, 23 nt, Human
accuccagccagccucuuccugc

SEQ ID NO: 110054 - RNA, 27 nt, Human
agaucucugccuacaugaaguccagcc

SEQ ID NO: 110055 - RNA, 19 nt, Human
aguuuagauuuucaguuaa

SEQ ID NO: 110056 - RNA, 25 nt, Human
aaagcuuguccaucacucuaguagg

SEQ ID NO: 110057 - RNA, 26 nt, Human
cagucauuuauuuuccauuuuguugc

SEQ ID NO: 110058 - RNA, 21 nt, Human
cccugcauuccagccuaggcg

SEQ ID NO: 110059 - RNA, 26 nt, Human
gcauuuucacaacauaucagacuuca

SEQ ID NO: 110060 - RNA, 22 nt, Human
agcauuuugccuaccuggguca

SEQ ID NO: 110061 - RNA, 20 nt, Human
cucagguggggcaggugcag

SEQ ID NO: 110062 - RNA, 25 nt, Human
gaaauuaauauuuugacuauuuuua

SEQ ID NO: 110063 - RNA, 23 nt, Human
aggaugcuuuggacacugugcgu

SEQ ID NO: 110064 - RNA, 20 nt, Human
agaaaccauauuuugguuaa

SEQ ID NO: 110065 - RNA, 25 nt, Human
uacagaacuuuuaguucugugcugu

SEQ ID NO: 110066 - RNA, 22 nt, Human
agaagaacuuacuucugaaaug

SEQ ID NO: 110067 - RNA, 20 nt, Human
acuguuucugcccuugugcc

SEQ ID NO: 110068 - RNA, 20 nt, Human
gagccaucugcuuuuuuggc

SEQ ID NO: 110069 - RNA, 24 nt, Human
ggacguaggauauuuucccuaccu

SEQ ID NO: 110070 - RNA, 26 nt, Human
gagcacagcuucucagaugugcuccu

SEQ ID NO: 110071 - RNA, 19 nt, Human
ugcuuucugaaauucacag

SEQ ID NO: 110072 - RNA, 22 nt, Human
uucuccucccuuacuucuauca

SEQ ID NO: 110073 - RNA, 22 nt, Human
cucaaagcugcuuaggaaucaa

SEQ ID NO: 110074 - RNA, 22 nt, Human
ucccggaggccuucccuuuaca

SEQ ID NO: 110075 - RNA, 23 nt, Human
gauuaaaauauuuuaauucuuca

SEQ ID NO: 110076 - RNA, 22 nt, Human
gagcccaggagguggagguugc

SEQ ID NO: 110077 - RNA, 26 nt, Human
ccagguuuguucuggaaaacacuagg

SEQ ID NO: 110078 - RNA, 22 nt, Human
gggcagugucucuuccaggggg

SEQ ID NO: 110079 - RNA, 23 nt, Human
ccacagccacacagccacgcccc

SEQ ID NO: 110080 - RNA, 25 nt, Human
ccuggggagugguuaggcagcaagc

SEQ ID NO: 110081 - RNA, 24 nt, Human
gcgcgugugggucucugggcacag

SEQ ID NO: 110082 - RNA, 20 nt, Human
gcgguccgaagucuugcugu

SEQ ID NO: 110083 - RNA, 22 nt, Human
acaccugugaucccagcacuuu

SEQ ID NO: 110084 - RNA, 21 nt, Human
cauccucccuccuugcuuguc

SEQ ID NO: 110085 - RNA, 22 nt, Human
ccaaguagcuggaacuacaggc

SEQ ID NO: 110086 - RNA, 22 nt, Human
ccaaauagcugggacuacaggc

SEQ ID NO: 110087 - RNA, 20 nt, Human
ccgcagcugcaaaugcagcu

SEQ ID NO: 110088 - RNA, 21 nt, Human
aacugauuucuggaugaucuu

SEQ ID NO: 110089 - RNA, 27 nt, Human
ggacuccuugccucucccuauggccug

SEQ ID NO: 110090 - RNA, 26 nt, Human
uuucugucugcuuuuuucuuaugucu

SEQ ID NO: 110091 - RNA, 24 nt, Human
agccugcaucccaggaugcugggu

SEQ ID NO: 110092 - RNA, 20 nt, Human
cagcucuucagagauguuau

SEQ ID NO: 110093 - RNA, 18 nt, Human
ggaaaggggggaacccac

SEQ ID NO: 110094 - RNA, 27 nt, Human
ugguuuaucuuggaagcuaaagggcau

SEQ ID NO: 110095 - RNA, 21 nt, Human
gcaaugagccgagaucacguc

SEQ ID NO: 110096 - RNA, 26 nt, Human
ucuucugcaagaggcugccuccuggu

SEQ ID NO: 110097 - RNA, 23 nt, Human
guugcccauggugggagcguggu

SEQ ID NO: 110098 - RNA, 22 nt, Human
cccuccagggcuuucagggaag

SEQ ID NO: 110099 - RNA, 26 nt, Human
guucacuuuuguuauuaugcucuuaa

SEQ ID NO: 110100 - RNA, 30 nt, Human
uccaaagggagaaagagcaguaugccacuu

SEQ ID NO: 110101 - RNA, 22 nt, Human
cauuuugauggacaaaguggca

SEQ ID NO: 110102 - RNA, 25 nt, Human
ugguucuuaaaagcauucuguacua

SEQ ID NO: 110103 - RNA, 22 nt, Human
cccaaagugcagggauuacagg

SEQ ID NO: 110104 - RNA, 23 nt, Human
uugcuguuaauuuaugcauuuga

SEQ ID NO: 110105 - RNA, 20 nt, Human
uucagggguucccacuagga

SEQ ID NO: 110106 - RNA, 26 nt, Human
uuccacugcucuagaaucuaaccaga

SEQ ID NO: 110107 - RNA, 23 nt, Human
uucucauaaggaaagcaaugacu

SEQ ID NO: 110108 - RNA, 21 nt, Human
uccagccugggcuacagagcg

SEQ ID NO: 110109 - RNA, 17 nt, Human
guccucucccccucgcc

SEQ ID NO: 110110 - RNA, 19 nt, Human
accacgcucacacgacaag

SEQ ID NO: 110111 - RNA, 18 nt, Human
ccccugccagcucuggca

SEQ ID NO: 110112 - RNA, 24 nt, Human
ccuccuaggaugaccucacccucc

SEQ ID NO: 110113 - RNA, 22 nt, Human
guuucauauuuuuccuuucacu

SEQ ID NO: 110114 - RNA, 20 nt, Human
cagcauccuggaaauuugug

SEQ ID NO: 110115 - RNA, 25 nt, Human
ccugccuggcugcccaaccagcucc

SEQ ID NO: 110116 - RNA, 23 nt, Human
gaugguggugaugaacagccuga

SEQ ID NO: 110117 - RNA, 21 nt, Human
gggguccgggauugggaaucc

SEQ ID NO: 110118 - RNA, 24 nt, Human
gauccuugugcauacaacugacuu

SEQ ID NO: 110119 - RNA, 21 nt, Human
auaaauaacugcacauucucc

SEQ ID NO: 110120 - RNA, 25 nt, Human
ccuaccgcuggcccugccguuuccc

SEQ ID NO: 110121 - RNA, 24 nt, Human
accuacugcuuccucagaugggcc

SEQ ID NO: 110122 - RNA, 25 nt, Human
cucuaacccaggucuugacaccagc

SEQ ID NO: 110123 - RNA, 21 nt, Human
guuuuucugagggcagagauu

SEQ ID NO: 110124 - RNA, 20 nt, Human
ccgcuuuuauuucuggacca

SEQ ID NO: 110125 - RNA, 20 nt, Human
agcuuggaauuccggcuccu

SEQ ID NO: 110126 - RNA, 22 nt, Human
ucacacacaggucugucuguca

SEQ ID NO: 110127 - RNA, 27 nt, Human
aucaaucaaaauguuuguaacuuaaaa

SEQ ID NO: 110128 - RNA, 21 nt, Human
augaugacugaaaauguguau

SEQ ID NO: 110129 - RNA, 22 nt, Human
cuggucaacaugaagaaguuac

SEQ ID NO: 110130 - RNA, 23 nt, Human
agagcugaaagcugguggcagag

SEQ ID NO: 110131 - RNA, 24 nt, Human
ucaggcagcugaaauucaccaaga

SEQ ID NO: 110132 - RNA, 20 nt, Human
ucccaagggcugauggcuua

SEQ ID NO: 110133 - RNA, 22 nt, Human
ugucgccaggcuggaguguagu

SEQ ID NO: 110134 - RNA, 29 nt, Human
uugcuuucucucuggccuggacauucucu

SEQ ID NO: 110135 - RNA, 20 nt, Human
ccucuggcccccaccuucuu

SEQ ID NO: 110136 - RNA, 20 nt, Human
aucucaguucagaggcaacg

SEQ ID NO: 110137 - RNA, 25 nt, Human
gcuagguuaauccaauuauaugaga

SEQ ID NO: 110138 - RNA, 21 nt, Human
cagcagccacuggggccugaa

SEQ ID NO: 110139 - RNA, 19 nt, Human
gagaugcucacaggccaca

SEQ ID NO: 110140 - RNA, 22 nt, Human
aacucaaggcuccucuggccca

SEQ ID NO: 110141 - RNA, 26 nt, Human
gcucagccacagccugacacagugcu

SEQ ID NO: 110142 - RNA, 22 nt, Human
ucacccaggccacaaggccaug

SEQ ID NO: 110143 - RNA, 22 nt, Human
caaaacaaucuuaaguugggca

SEQ ID NO: 110144 - RNA, 13 nt, Human
gacugauuugcug

SEQ ID NO: 110145 - RNA, 26 nt, Human
aacaaacaaaagcugaacacauuucc

SEQ ID NO: 110146 - RNA, 27 nt, Human
uuaguaaagucucuauuucuuccuuuu

SEQ ID NO: 110147 - RNA, 26 nt, Human
gccucuggcugucugcacuuuuguuc

SEQ ID NO: 110148 - RNA, 19 nt, Human
guuggaggcuggagcgcaa

SEQ ID NO: 110149 - RNA, 23 nt, Human
acuauuggugcgcuccagccggg

SEQ ID NO: 110150 - RNA, 26 nt, Human
cccaggcugaucuugaacuccugggc

SEQ ID NO: 110151 - RNA, 22 nt, Human
uauuucuugaaagaugguaagu

SEQ ID NO: 110152 - RNA, 20 nt, Human
gauucugcuuuuaccaugcc

SEQ ID NO: 110153 - RNA, 22 nt, Human
agcucacugcagccuggaacuc

SEQ ID NO: 110154 - RNA, 22 nt, Human
guucuuucuuccucugcugaag

SEQ ID NO: 110155 - RNA, 21 nt, Human
uuuuugccuuguaucuucuca

SEQ ID NO: 110156 - RNA, 20 nt, Human
gcccaggcuggggccaagga

SEQ ID NO: 110157 - RNA, 26 nt, Human
uccaaaaaauaauaauaacaaucauc

SEQ ID NO: 110158 - RNA, 25 nt, Human
uguccguggucagaaguggggucag

SEQ ID NO: 110159 - RNA, 27 nt, Human
uuaggaacuuuagcaugucaaaaugaa

SEQ ID NO: 110160 - RNA, 22 nt, Human
aaacucuccccuuucuuugcaa

SEQ ID NO: 110161 - RNA, 22 nt, Human
ccuauauauuuauauaacuuug

SEQ ID NO: 110162 - RNA, 25 nt, Human
uugagccucauuuuaauaggcauug

SEQ ID NO: 110163 - RNA, 21 nt, Human
cucucaucugcacaaucgugc

SEQ ID NO: 110164 - RNA, 22 nt, Human
gccuuucucucagccucuggaa

SEQ ID NO: 110165 - RNA, 22 nt, Human
gacuacaggugcacgcuaccau

SEQ ID NO: 110166 - RNA, 22 nt, Human
ugccacccaggcuggaguacag

SEQ ID NO: 110167 - RNA, 21 nt, Human
aaacuauuuucacagaucuca

SEQ ID NO: 110168 - RNA, 25 nt, Human
ucucccaggcugcuggagugcagug

SEQ ID NO: 110169 - RNA, 24 nt, Human
gcagggcuaggcggauuguucugg

SEQ ID NO: 110170 - RNA, 24 nt, Human
ggagacacacuggccaagcgcgga

SEQ ID NO: 110171 - RNA, 20 nt, Human
gccucgcucccuccuggccc

SEQ ID NO: 110172 - RNA, 23 nt, Human
ucggggcacagacuuccuuuuac

SEQ ID NO: 110173 - RNA, 20 nt, Human
ucgacuauagaaaacuccac

SEQ ID NO: 110174 - RNA, 25 nt, Human
aauucagacccuccuuccaccggca

SEQ ID NO: 110175 - RNA, 21 nt, Human
uucauuucaucuggcuccccc

SEQ ID NO: 110176 - RNA, 27 nt, Human
aauuucuucuuucugccaucuuuugga

SEQ ID NO: 110177 - RNA, 21 nt, Human
acauuuuaauagagaugaauc

SEQ ID NO: 110178 - RNA, 22 nt, Human
cccaaagcguugggauuauagg

SEQ ID NO: 110179 - RNA, 22 nt, Human
ggggaaagagugggauuaggcu

SEQ ID NO: 110180 - RNA, 20 nt, Human
ucucguauccccaagccaca

SEQ ID NO: 110181 - RNA, 26 nt, Human
gcccccaucccacugggacauuuagc

SEQ ID NO: 110182 - RNA, 25 nt, Human
gccuguucuccccucgucgguggcu

SEQ ID NO: 110183 - RNA, 16 nt, Human
aguacccaagugcagu

SEQ ID NO: 110184 - RNA, 18 nt, Human
acugugugccuucugcca

SEQ ID NO: 110185 - RNA, 20 nt, Human
auuuuucugcccaaggccuu

SEQ ID NO: 110186 - RNA, 22 nt, Human
cucucauggugaaaucugcucu

SEQ ID NO: 110187 - RNA, 20 nt, Human
agagcacuuuuaacaaaaaa

SEQ ID NO: 110188 - RNA, 23 nt, Human
ccaucuccugcucaccaccugcc

SEQ ID NO: 110189 - RNA, 25 nt, Human
ugcaugggcucgaagggagagccag

SEQ ID NO: 110190 - RNA, 22 nt, Human
uggcggcccagaaguaagccau

SEQ ID NO: 110191 - RNA, 20 nt, Human
ugggagcucucacacccugc

SEQ ID NO: 110192 - RNA, 22 nt, Human
ucauccagcacagcucucaggu

SEQ ID NO: 110193 - RNA, 18 nt, Human
gaacaauguagucacuug

SEQ ID NO: 110194 - RNA, 21 nt, Human
ucaaaacacauacacccagaa

SEQ ID NO: 110195 - RNA, 26 nt, Human
auaucugucaucugauugcgguggug

SEQ ID NO: 110196 - RNA, 25 nt, Human
cuccagccccauggcugcugcuggu

SEQ ID NO: 110197 - RNA, 27 nt, Human
cacacuuugcauuucaacacucagccc

SEQ ID NO: 110198 - RNA, 24 nt, Human
ccuucuccugggagguccugcugc

SEQ ID NO: 110199 - RNA, 25 nt, Human
uagugacuguauccagaaaagcuuu

SEQ ID NO: 110200 - RNA, 27 nt, Human
gacucacucagaacugucgcucaccug

SEQ ID NO: 110201 - RNA, 20 nt, Human
aaucuccagggcuccaaauc

SEQ ID NO: 110202 - RNA, 21 nt, Human
uucaguguuagaggugggccu

SEQ ID NO: 110203 - RNA, 19 nt, Human
aacucauagacaucaauca

SEQ ID NO: 110204 - RNA, 25 nt, Human
gaaaccaccauuugguauucaguca

SEQ ID NO: 110205 - RNA, 23 nt, Human
gcucggaaggcagaugcacuucu

SEQ ID NO: 110206 - RNA, 21 nt, Human
ccaugaauuacuucuccaucu

SEQ ID NO: 110207 - RNA, 27 nt, Human
ggcaggcaggggcaggcugaggaguug

SEQ ID NO: 110208 - RNA, 23 nt, Human
gcaucuccuagaagcagccggca

SEQ ID NO: 110209 - RNA, 16 nt, Human
acuaauaaaugccuuu

SEQ ID NO: 110210 - RNA, 23 nt, Human
uuguaaccugaacuucugugugg

SEQ ID NO: 110211 - RNA, 24 nt, Human
ggaaauucuuauuuccccuuucca

SEQ ID NO: 110212 - RNA, 23 nt, Human
guucaagcaaaucuccugccuca

SEQ ID NO: 110213 - RNA, 27 nt, Human
auauuugcuuauuuauauucagagaug

SEQ ID NO: 110214 - RNA, 22 nt, Human
uccccacccucacccaccugcc

SEQ ID NO: 110215 - RNA, 20 nt, Human
guagaggcccuggugcagaa

SEQ ID NO: 110216 - RNA, 20 nt, Human
cagccaggcugggccgcaag

SEQ ID NO: 110217 - RNA, 24 nt, Human
cugccccaggcccggggcaucgcc

SEQ ID NO: 110218 - RNA, 27 nt, Human
ccacugcacuucagucugugugacuga

SEQ ID NO: 110219 - RNA, 25 nt, Human
gcacggcccuggcguucggcacuag

SEQ ID NO: 110220 - RNA, 18 nt, Human
caguaagccauugagugc

SEQ ID NO: 110221 - RNA, 27 nt, Human
uuaagcauuugcaugacuauuagugcu

SEQ ID NO: 110222 - RNA, 23 nt, Human
gcaucuuauugauccuccagucg

SEQ ID NO: 110223 - RNA, 28 nt, Human
acaugugugccucucacagcaguuggcc

SEQ ID NO: 110224 - RNA, 22 nt, Human
gagacugggaggcagagguugc

SEQ ID NO: 110225 - RNA, 18 nt, Human
uuacccaggguggagugc

SEQ ID NO: 110226 - RNA, 20 nt, Human
cacugcuccagccucagcca

SEQ ID NO: 110227 - RNA, 21 nt, Human
ccucaaccuccuggguucaga

SEQ ID NO: 110228 - RNA, 22 nt, Human
ccagccugggugacaagaguga

SEQ ID NO: 110229 - RNA, 22 nt, Human
guuacccaggguggauugcagc

SEQ ID NO: 110230 - RNA, 27 nt, Human
gcccugucccugucccccuccccuccc

SEQ ID NO: 110231 - RNA, 26 nt, Human
aggaagaggaggaagcugagaagcug

SEQ ID NO: 110232 - RNA, 27 nt, Human
gcuguguuugcagcuguccgagucucc

SEQ ID NO: 110233 - RNA, 28 nt, Human
ggagccagaaucggaaccacgaugugac

SEQ ID NO: 110234 - RNA, 27 nt, Human
gggagagaggauaggaugggaaugcug

SEQ ID NO: 110235 - RNA, 26 nt, Human
aucucagcccacaucucagcccuucc

SEQ ID NO: 110236 - RNA, 22 nt, Human
gcuccucccauuccccuuaagg

SEQ ID NO: 110237 - RNA, 23 nt, Human
agauaaauagaacuaucugcauu

SEQ ID NO: 110238 - RNA, 27 nt, Human
uugcaacaggcugggcuucaguggcag

SEQ ID NO: 110239 - RNA, 24 nt, Human
uucaccauaauuuaauuuagugga

SEQ ID NO: 110240 - RNA, 22 nt, Human
aucccaaagccagccuccaucu

SEQ ID NO: 110241 - RNA, 26 nt, Human
uacuacugccuuguacuuuucauuuu

SEQ ID NO: 110242 - RNA, 23 nt, Human
aaggagucaacucaguugaaaaa

SEQ ID NO: 110243 - RNA, 26 nt, Human
ucccagacaugacagccaucaucaaa

SEQ ID NO: 110244 - RNA, 25 nt, Human
ccccauuccuuauauucagcaagca

SEQ ID NO: 110245 - RNA, 25 nt, Human
uguuuuugaaacagaaccauaaagc

SEQ ID NO: 110246 - RNA, 21 nt, Human
ggcuugccacccacuccuuug

SEQ ID NO: 110247 - RNA, 22 nt, Human
ccuggcugggaggaaggacugg

SEQ ID NO: 110248 - RNA, 27 nt, Human
ugugaaacuugaaaugaggaaaagcaa

SEQ ID NO: 110249 - RNA, 22 nt, Human
uggcgugugccuguaaucccag

SEQ ID NO: 110250 - RNA, 23 nt, Human
acuuauuuuauuuccaucauguc

SEQ ID NO: 110251 - RNA, 23 nt, Human
caccgugucacuucagucagcca

SEQ ID NO: 110252 - RNA, 20 nt, Human
ucucccugugucugggucca

SEQ ID NO: 110253 - RNA, 24 nt, Human
ccgcgcccucuccgcguccccgcc

SEQ ID NO: 110254 - RNA, 22 nt, Human
gucagaggcagcccccugcaca

SEQ ID NO: 110255 - RNA, 27 nt, Human
ugugggugacuacagguuaggagaccg

SEQ ID NO: 110256 - RNA, 22 nt, Human
acuuucucccuccuccuuuucc

SEQ ID NO: 110257 - RNA, 21 nt, Human
auugggguuggaacauuucag

SEQ ID NO: 110258 - RNA, 20 nt, Human
ccgcuggcagcugaggguua

SEQ ID NO: 110259 - RNA, 27 nt, Human
cuuuguuguuuuuaaaaagaaaaucag

SEQ ID NO: 110260 - RNA, 24 nt, Human
acgcugcgcucgcugggcagucgg

SEQ ID NO: 110261 - RNA, 23 nt, Human
gcacagccuggcagccuggcccu

SEQ ID NO: 110262 - RNA, 21 nt, Human
agacccauucugcacaguccc

SEQ ID NO: 110263 - RNA, 25 nt, Human
gcucaggcuggagugcagugaugca

SEQ ID NO: 110264 - RNA, 23 nt, Human
caggacauaacaagcuguggucu

SEQ ID NO: 110265 - RNA, 22 nt, Human
caggcagccuggaguuagucga

SEQ ID NO: 110266 - RNA, 18 nt, Human
uaagcauuucucugugaa

SEQ ID NO: 110267 - RNA, 21 nt, Human
ccucagugaggaucuucaugu

SEQ ID NO: 110268 - RNA, 22 nt, Human
auaaauauuguguugugcagca

SEQ ID NO: 110269 - RNA, 21 nt, Human
ugcuccucacaugaaugcacu

SEQ ID NO: 110270 - RNA, 23 nt, Human
caacauagggagacccccaucuu

SEQ ID NO: 110271 - RNA, 31 nt, Human
agacuguagagauuuuuauguguuuggaaca

SEQ ID NO: 110272 - RNA, 21 nt, Human
agauucacaacucauucagaa

SEQ ID NO: 110273 - RNA, 23 nt, Human
auucaauggcucacauucuuuca

SEQ ID NO: 110274 - RNA, 22 nt, Human
agucugcaguuuaaucucucca

SEQ ID NO: 110275 - RNA, 20 nt, Human
gcuugacagcccaacagcca

SEQ ID NO: 110276 - RNA, 21 nt, Human
ccuucccugccccaccuuguu

SEQ ID NO: 110277 - RNA, 22 nt, Human
gcagcccuccagaccugggugg

SEQ ID NO: 110278 - RNA, 22 nt, Human
ccuccugugccugcuucccugu

SEQ ID NO: 110279 - RNA, 19 nt, Human
cugaggcaggauugcuuga

SEQ ID NO: 110280 - RNA, 22 nt, Human
uugcuuguaaauccuaaucuua

SEQ ID NO: 110281 - RNA, 22 nt, Human
aucugaugcaugugcagcagug

SEQ ID NO: 110282 - RNA, 24 nt, Human
ccucucuuggcaauuccucuucau

SEQ ID NO: 110283 - RNA, 22 nt, Human
ucugggacccaggcuucagugu

SEQ ID NO: 110284 - RNA, 23 nt, Human
ccagcuacccacagcaaccaaag

SEQ ID NO: 110285 - RNA, 25 nt, Human
gccaucgucccggcugaagugcagu

SEQ ID NO: 110286 - RNA, 20 nt, Human
agggaagguuggcagaggga

SEQ ID NO: 110287 - RNA, 21 nt, Human
ggaaaaaauaucuuucgaaaa

SEQ ID NO: 110288 - RNA, 21 nt, Human
ucgcgcggcuacugcagcacu

SEQ ID NO: 110289 - RNA, 21 nt, Human
aguagcagaguccagugccuu

SEQ ID NO: 110290 - RNA, 29 nt, Human
ucccuggaccucugcuuccccaucuguua

SEQ ID NO: 110291 - RNA, 22 nt, Human
cacugcacuccaggcuggguaa

SEQ ID NO: 110292 - RNA, 24 nt, Human
gggggaagaggagccaaugacagg

SEQ ID NO: 110293 - RNA, 28 nt, Human
ugggaugccaucacuugguucaugcuca

SEQ ID NO: 110294 - RNA, 26 nt, Human
caacagcagcaguaccuacagcccuu

SEQ ID NO: 110295 - RNA, 27 nt, Human
ucuccaaugauacuaccaagucuuagu

SEQ ID NO: 110296 - RNA, 21 nt, Human
guuuguuucucccccugggcu

SEQ ID NO: 110297 - RNA, 22 nt, Human
ccaaguagcugggacuacaugc

SEQ ID NO: 110298 - RNA, 27 nt, Human
ccugccugccugucgugccuuggaccc

SEQ ID NO: 110299 - RNA, 22 nt, Human
ggagggagggagaggguuuaga

SEQ ID NO: 110300 - RNA, 21 nt, Human
ugucgccaaguuggagugcaa

SEQ ID NO: 110301 - RNA, 25 nt, Human
cccaaauuuaaagcucucaucuuua

SEQ ID NO: 110302 - RNA, 24 nt, Human
ucccccagccucaagucuuauuuc

SEQ ID NO: 110303 - RNA, 22 nt, Human
cccaaguagcuaggacugcagg

SEQ ID NO: 110304 - RNA, 23 nt, Human
ucauugaagaguugaggaugugg

SEQ ID NO: 110305 - RNA, 27 nt, Human
ccacugcacuccagccugggcaauaga

SEQ ID NO: 110306 - RNA, 19 nt, Human
aaagauggcaaauggggaa

SEQ ID NO: 110307 - RNA, 23 nt, Human
augcuguuuuuggcugggcgcgg

SEQ ID NO: 110308 - RNA, 24 nt, Human
accccugauauauuuuuauuuuua

SEQ ID NO: 110309 - RNA, 23 nt, Human
guguccugcuacuccugcugggg

SEQ ID NO: 110310 - RNA, 26 nt, Human
ucacauuuucugacuuggaggcccuc

SEQ ID NO: 110311 - RNA, 26 nt, Human
ccuccagguuccucaaaacaggccug

SEQ ID NO: 110312 - RNA, 26 nt, Human
ccuccaggggccuccaagcauaggau

SEQ ID NO: 110313 - RNA, 20 nt, Human
ccacagccaggagaggccuu

SEQ ID NO: 110314 - RNA, 20 nt, Human
cucuucaugccucauccugc

SEQ ID NO: 110315 - RNA, 22 nt, Human
aaccccaggcuggagugcagug

SEQ ID NO: 110316 - RNA, 19 nt, Human
ucccugccuuccucucuga

SEQ ID NO: 110317 - RNA, 23 nt, Human
cagugaacccuuggauuaccugg

SEQ ID NO: 110318 - RNA, 23 nt, Human
ucuagccucugcuggagugcagu

SEQ ID NO: 110319 - RNA, 26 nt, Human
gaguccugccuucuuccuugaggggc

SEQ ID NO: 110320 - RNA, 20 nt, Human
agcuuauaggaaucucucca

SEQ ID NO: 110321 - RNA, 24 nt, Human
gcgcuguggaucaagacacuuugg

SEQ ID NO: 110322 - RNA, 24 nt, Human
gggagggaggaggagcagacggca

SEQ ID NO: 110323 - RNA, 21 nt, Human
cuuugguggggggaccccaaa

SEQ ID NO: 110324 - RNA, 26 nt, Human
caaauuaaugcauaauuucagaugua

SEQ ID NO: 110325 - RNA, 21 nt, Human
uaaaacgccuacagcugccuc

SEQ ID NO: 110326 - RNA, 23 nt, Human
acagaauuucaugcacaauccaa

SEQ ID NO: 110327 - RNA, 21 nt, Human
cuccuccagcuccuucuuucu

SEQ ID NO: 110328 - RNA, 26 nt, Human
gucccugggcaggaggaugacccagu

SEQ ID NO: 110329 - RNA, 21 nt, Human
agcauuuuauacauacccucg

SEQ ID NO: 110330 - RNA, 27 nt, Human
acugccucuggccugcagcugaccugg

SEQ ID NO: 110331 - RNA, 17 nt, Human
uuguacaugcauucaua

SEQ ID NO: 110332 - RNA, 20 nt, Human
aaggcagugcucaccucuuc

SEQ ID NO: 110333 - RNA, 21 nt, Human
uucagacgugagaaaggcagc

SEQ ID NO: 110334 - RNA, 27 nt, Human
uugggaggcugcgugccagucaagaag

SEQ ID NO: 110335 - RNA, 21 nt, Human
auggacucugccuugcuuugc

SEQ ID NO: 110336 - RNA, 16 nt, Human
gcucugacaggcggug

SEQ ID NO: 110337 - RNA, 24 nt, Human
ggcaaaaggaaagcaacuaagaca

SEQ ID NO: 110338 - RNA, 27 nt, Human
acauguucauucuuguugagcugcauu

SEQ ID NO: 110339 - RNA, 23 nt, Human
cagccugaccuagcuccuggacu

SEQ ID NO: 110340 - RNA, 23 nt, Human
uuucucuacugucucaguuuaca

SEQ ID NO: 110341 - RNA, 20 nt, Human
agggacacuggcuuguuggg

SEQ ID NO: 110342 - RNA, 21 nt, Human
gucccugagcucuugcuaucu

SEQ ID NO: 110343 - RNA, 23 nt, Human
cuccccucugagcggcugcggcu

SEQ ID NO: 110344 - RNA, 22 nt, Human
ggggugugauuugugugcgugc

SEQ ID NO: 110345 - RNA, 22 nt, Human
aggaugaggcaggcccaguccu

SEQ ID NO: 110346 - RNA, 27 nt, Human
gcugggcugagccccuaccccacacca

SEQ ID NO: 110347 - RNA, 22 nt, Human
ggcacuuuuaccaggugugugu

SEQ ID NO: 110348 - RNA, 26 nt, Human
ucaggagacucaggaauggagcggua

SEQ ID NO: 110349 - RNA, 23 nt, Human
uccuuucccagaggugagugccc

SEQ ID NO: 110350 - RNA, 21 nt, Human
ugcccacgcuggagugcagug

SEQ ID NO: 110351 - RNA, 22 nt, Human
gggaccccaggcccacucaggg

SEQ ID NO: 110352 - RNA, 23 nt, Human
aauaaaucgacagugucucagaa

SEQ ID NO: 110353 - RNA, 26 nt, Human
uccaauaaaauacaaugauuaccuag

SEQ ID NO: 110354 - RNA, 20 nt, Human
gcggugagccaugauucgcc

SEQ ID NO: 110355 - RNA, 26 nt, Human
caguucugcuaggucugcuuccugcc

SEQ ID NO: 110356 - RNA, 22 nt, Human
cagccugccugccuugccuugg

SEQ ID NO: 110357 - RNA, 24 nt, Human
uuuggaaucucuugguuccuaaga

SEQ ID NO: 110358 - RNA, 22 nt, Human
ugacaugaggcccauucuucac

SEQ ID NO: 110359 - RNA, 22 nt, Human
ggacaguuguguuguuuuuugu

SEQ ID NO: 110360 - RNA, 25 nt, Human
ugugccaggcugaauuacagugaaa

SEQ ID NO: 110361 - RNA, 27 nt, Human
uggacacuguguacaccucuggauuca

SEQ ID NO: 110362 - RNA, 21 nt, Human
gagaagcucuuggcagccaaa

SEQ ID NO: 110363 - RNA, 27 nt, Human
ucuccacccuauauguaguauaaagaa

SEQ ID NO: 110364 - RNA, 18 nt, Human
gccuaccccuccugcgcu

SEQ ID NO: 110365 - RNA, 22 nt, Human
uucaguuaguuaaauaccugua

SEQ ID NO: 110366 - RNA, 22 nt, Human
uugccuaagcccuugccugcug

SEQ ID NO: 110367 - RNA, 23 nt, Human
uuuuccucugcguagagccaucc

SEQ ID NO: 110368 - RNA, 19 nt, Human
cuggacagggucucugcug

SEQ ID NO: 110369 - RNA, 21 nt, Human
ccuacuucuaccccuucccgu

SEQ ID NO: 110370 - RNA, 24 nt, Human
cccagcugaaaacggaauucuuug

SEQ ID NO: 110371 - RNA, 17 nt, Human
agggaauuucagaugcu

SEQ ID NO: 110372 - RNA, 20 nt, Human
gcaugggcuaauuaucauca

SEQ ID NO: 110373 - RNA, 21 nt, Human
cucugcggacccccauccugc

SEQ ID NO: 110374 - RNA, 26 nt, Human
uuuuagacucugaaguugguugugau

SEQ ID NO: 110375 - RNA, 26 nt, Human
gaggaagagcaaguagaaaaguggca

SEQ ID NO: 110376 - RNA, 27 nt, Human
acgcuggugucucacucaucucuuuua

SEQ ID NO: 110377 - RNA, 23 nt, Human
uuuuacucugcuuacauuuuaua

SEQ ID NO: 110378 - RNA, 21 nt, Human
agcucacucccccuccugcug

SEQ ID NO: 110379 - RNA, 21 nt, Human
ugcuucaaagauuaucugauu

SEQ ID NO: 110380 - RNA, 23 nt, Human
gaaggaggaugaaguaaugugug

SEQ ID NO: 110381 - RNA, 27 nt, Human
augaggaagagcugccugcaaagcuuu

SEQ ID NO: 110382 - RNA, 20 nt, Human
guucuugcuacacaggaugg

SEQ ID NO: 110383 - RNA, 21 nt, Human
cggguggaucgccugagguca

SEQ ID NO: 110384 - RNA, 26 nt, Human
ggacuugcccuaugggagaggggacg

SEQ ID NO: 110385 - RNA, 22 nt, Human
gugugcagccuccugugccuca

SEQ ID NO: 110386 - RNA, 21 nt, Human
gcagcaggaggccagaggaca

SEQ ID NO: 110387 - RNA, 23 nt, Human
aaaguauuuacaaaacagugaca

SEQ ID NO: 110388 - RNA, 20 nt, Human
ucuggggaaaaaauauuuac

SEQ ID NO: 110389 - RNA, 22 nt, Human
ugcagugagcugugauugugcc

SEQ ID NO: 110390 - RNA, 22 nt, Human
gcucagaagccuccugucucca

SEQ ID NO: 110391 - RNA, 23 nt, Human
ugccccuuucuggauuauucugg

SEQ ID NO: 110392 - RNA, 19 nt, Human
gccgccuaggcaagacagu

SEQ ID NO: 110393 - RNA, 21 nt, Human
ccugcaagccagccuggccag

SEQ ID NO: 110394 - RNA, 21 nt, Human
uggauaggaaaggacuuagca

SEQ ID NO: 110395 - RNA, 20 nt, Human
cugcuuucuuuccucaggac

SEQ ID NO: 110396 - RNA, 26 nt, Human
ccacagcucccagccuaggcccuuaa

SEQ ID NO: 110397 - RNA, 29 nt, Human
cucgucucucggccuuucucuccugccuu

SEQ ID NO: 110398 - RNA, 26 nt, Human
uccagcagacuccugcucucuaucca

SEQ ID NO: 110399 - RNA, 19 nt, Human
ucaaaaaccacaguccuca

SEQ ID NO: 110400 - RNA, 27 nt, Human
ccagaucuaugugucugucuguguguc

SEQ ID NO: 110401 - RNA, 23 nt, Human
aagcagcagaaggugaagcagga

SEQ ID NO: 110402 - RNA, 25 nt, Human
ucuacuuccccucuuucccuucuga

SEQ ID NO: 110403 - RNA, 22 nt, Human
agagaaauauacuaucucacca

SEQ ID NO: 110404 - RNA, 19 nt, Human
ucuguuucuuccuccucac

SEQ ID NO: 110405 - RNA, 23 nt, Human
cuucugcucuuucuucuuccaca

SEQ ID NO: 110406 - RNA, 21 nt, Human
aacucuggggagccugagcca

SEQ ID NO: 110407 - RNA, 23 nt, Human
cccaacaggaggccguggcucug

SEQ ID NO: 110408 - RNA, 22 nt, Human
aacaaguuacagaaauuaccgc

SEQ ID NO: 110409 - RNA, 23 nt, Human
ccaggcggcagagguugcaguga

SEQ ID NO: 110410 - RNA, 22 nt, Human
uuucuuucuuuugcccuucaca

SEQ ID NO: 110411 - RNA, 20 nt, Human
gcagagacacagagggcagu

SEQ ID NO: 110412 - RNA, 19 nt, Human
agacuauccuggagaagcc

SEQ ID NO: 110413 - RNA, 21 nt, Human
ccucaccuucucugauugugg

SEQ ID NO: 110414 - RNA, 24 nt, Human
cugcagugagccaugaucauucca

SEQ ID NO: 110415 - RNA, 22 nt, Human
auggacaacuguagugcaguga

SEQ ID NO: 110416 - RNA, 28 nt, Human
ugcauggcuggggacuucucacuucccc

SEQ ID NO: 110417 - RNA, 24 nt, Human
agcaggagagaggcccagaggcuc

SEQ ID NO: 110418 - RNA, 21 nt, Human
ugugaagcugugggugcagug

SEQ ID NO: 110419 - RNA, 21 nt, Human
ccaaugcccugguuuuccugc

SEQ ID NO: 110420 - RNA, 20 nt, Human
ggcugaggugggaggguuga

SEQ ID NO: 110421 - RNA, 27 nt, Human
ucuagcacaauuauggguuacuuccuu

SEQ ID NO: 110422 - RNA, 23 nt, Human
gagaacagccauuccacaugugu

SEQ ID NO: 110423 - RNA, 21 nt, Human
caaacucagcacagccaagaa

SEQ ID NO: 110424 - RNA, 23 nt, Human
ccggccagucggucgcuugccac

SEQ ID NO: 110425 - RNA, 22 nt, Human
aaagugcugugauuaccggugu

SEQ ID NO: 110426 - RNA, 22 nt, Human
gcugcccugcacuccugccucc

SEQ ID NO: 110427 - RNA, 26 nt, Human
ccuccaggaccauucaggcuguugac

SEQ ID NO: 110428 - RNA, 24 nt, Human
agaaacaaacuccauuacucugau

SEQ ID NO: 110429 - RNA, 27 nt, Human
ccuguucugcuguuguguccugccauu

SEQ ID NO: 110430 - RNA, 17 nt, Human
ucucaucuagaauuuau

SEQ ID NO: 110431 - RNA, 20 nt, Human
ccuccaccccccgcgcuggc

SEQ ID NO: 110432 - RNA, 20 nt, Human
cucaguagcugggaauuaug

SEQ ID NO: 110433 - RNA, 27 nt, Human
guccucucccuagcccuggugcaggcc

SEQ ID NO: 110434 - RNA, 20 nt, Human
cacccaggcuggagugcggu

SEQ ID NO: 110435 - RNA, 25 nt, Human
uccaagauauaagcccuccaaggga

SEQ ID NO: 110436 - RNA, 20 nt, Human
cgcccaggcuggagugcagu

SEQ ID NO: 110437 - RNA, 20 nt, Human
ugcccaggcuggaguguagu

SEQ ID NO: 110438 - RNA, 23 nt, Human
ugucuagguggugaaaugacaga

SEQ ID NO: 110439 - RNA, 26 nt, Human
ccuuuuccugugugguugccccugug

SEQ ID NO: 110440 - RNA, 26 nt, Human
cccacagagaugagaauagaucaugu

SEQ ID NO: 110441 - RNA, 18 nt, Human
gaggcuugcacugccuuu

SEQ ID NO: 110442 - RNA, 27 nt, Human
gacugggccauggacacagaugucucc

SEQ ID NO: 110443 - RNA, 22 nt, Human
cacuuucgucuuagcuuuugga

SEQ ID NO: 110444 - RNA, 22 nt, Human
ggcaggagaaucgcuugaacuc

SEQ ID NO: 110445 - RNA, 27 nt, Human
cagguucuggaacagcuuuuuguccug

SEQ ID NO: 110446 - RNA, 21 nt, Human
aucucccaaagugcugggaug

SEQ ID NO: 110447 - RNA, 23 nt, Human
uuucacuugccgggcuucacugc

SEQ ID NO: 110448 - RNA, 16 nt, Human
ugucucccccaccuca

SEQ ID NO: 110449 - RNA, 20 nt, Human
gugucguuuguaugaaaauc

SEQ ID NO: 110450 - RNA, 25 nt, Human
cuccaaauagccauacuuagccuca

SEQ ID NO: 110451 - RNA, 20 nt, Human
gcauuugaguugaaugguaa

SEQ ID NO: 110452 - RNA, 21 nt, Human
gcgcggugcguagucuggagc

SEQ ID NO: 110453 - RNA, 21 nt, Human
caaggcaggaggaucgcuuga

SEQ ID NO: 110454 - RNA, 21 nt, Human
gaucuuccucuucucccuugc

SEQ ID NO: 110455 - RNA, 27 nt, Human
uccugcaggaggacgccccuacagacc

SEQ ID NO: 110456 - RNA, 22 nt, Human
ccugccaaagaagaugaugauu

SEQ ID NO: 110457 - RNA, 22 nt, Human
agcuccguuuggcagugcaaug

SEQ ID NO: 110458 - RNA, 21 nt, Human
ggacuuugggaccugcuuugu

SEQ ID NO: 110459 - RNA, 21 nt, Human
ggcugagagcugggcacaggc

SEQ ID NO: 110460 - RNA, 27 nt, Human
guagggaggaccagggcagggccaggg

SEQ ID NO: 110461 - RNA, 24 nt, Human
gagccaggcagggccagggcagcu

SEQ ID NO: 110462 - RNA, 28 nt, Human
ccucgucgcacuccucaggcugagagca

SEQ ID NO: 110463 - RNA, 22 nt, Human
acuucagccugggugacagagu

SEQ ID NO: 110464 - RNA, 18 nt, Human
auuuaaaauauaacuuca

SEQ ID NO: 110465 - RNA, 22 nt, Human
gccuguaaucccaguacuuugg

SEQ ID NO: 110466 - RNA, 22 nt, Human
acugcaaccuccgccuccuugg

SEQ ID NO: 110467 - RNA, 22 nt, Human
ccaagcccacauuuccaaaguc

SEQ ID NO: 110468 - RNA, 21 nt, Human
guuuccaccuccugggccggg

SEQ ID NO: 110469 - RNA, 24 nt, Human
uuggacccaauccucagaugcacg

SEQ ID NO: 110470 - RNA, 23 nt, Human
aggcacugauuguggcagagggg

SEQ ID NO: 110471 - RNA, 27 nt, Human
uggugcaaucacagcucacugcagccu

SEQ ID NO: 110472 - RNA, 23 nt, Human
uuccaaauggacuauuuguucca

SEQ ID NO: 110473 - RNA, 20 nt, Human
aauuuuccucauuuugaauu

SEQ ID NO: 110474 - RNA, 21 nt, Human
uggaacacuggcaucucugag

SEQ ID NO: 110475 - RNA, 22 nt, Human
cuuuggaaauaaaagauaaaag

SEQ ID NO: 110476 - RNA, 21 nt, Human
cgcugcacauggccugagcau

SEQ ID NO: 110477 - RNA, 27 nt, Human
ggcucacgccuguaaucccagcauuuu

SEQ ID NO: 110478 - RNA, 20 nt, Human
acgcuuucuuaugcaaucua

SEQ ID NO: 110479 - RNA, 28 nt, Human
uuguacuuugcagucugccugucuaauc

SEQ ID NO: 110480 - RNA, 23 nt, Human
agggaagaaacaaaguugaaccg

SEQ ID NO: 110481 - RNA, 21 nt, Human
acccaggcugcagugccaugc

SEQ ID NO: 110482 - RNA, 26 nt, Human
cgacagcaacuuaaaaugccugggaa

SEQ ID NO: 110483 - RNA, 22 nt, Human
cgccuguaaucccaguacuugg

SEQ ID NO: 110484 - RNA, 24 nt, Human
cuucccaagcucuuuccacagcca

SEQ ID NO: 110485 - RNA, 26 nt, Human
acauguguccaucccagcggcuggug

SEQ ID NO: 110486 - RNA, 17 nt, Human
uacacaccuaagggaca

SEQ ID NO: 110487 - RNA, 28 nt, Human
gccacugacugccccuccugugugugcc

SEQ ID NO: 110488 - RNA, 22 nt, Human
acuuuucuugacagcauguugc

SEQ ID NO: 110489 - RNA, 22 nt, Human
gagaggcucagccacacaggaa

SEQ ID NO: 110490 - RNA, 27 nt, Human
gucucagauuccugggcuuaagcaguc

SEQ ID NO: 110491 - RNA, 29 nt, Human
acugcccuccugugccugauguccccagc

SEQ ID NO: 110492 - RNA, 25 nt, Human
ugccacucugggcagucuuuugugu

SEQ ID NO: 110493 - RNA, 23 nt, Human
augguucucagggauuccugcca

SEQ ID NO: 110494 - RNA, 19 nt, Human
aagauuuacccucccucuu

SEQ ID NO: 110495 - RNA, 27 nt, Human
ggugcagcuggguggggcagcacaccu

SEQ ID NO: 110496 - RNA, 25 nt, Human
acacagccaucuaacucauuaccuu

SEQ ID NO: 110497 - RNA, 22 nt, Human
ugcuacugcuacugcugcugcu

SEQ ID NO: 110498 - RNA, 25 nt, Human
accucuucccguggaagcacacucu

SEQ ID NO: 110499 - RNA, 21 nt, Human
ucaaagggaggacuugcuggg

SEQ ID NO: 110500 - RNA, 23 nt, Human
augagccccaguuuucugggcuu

SEQ ID NO: 110501 - RNA, 28 nt, Human
aacuguaagcccacacuuaaccuuguca

SEQ ID NO: 110502 - RNA, 23 nt, Human
uuucuggggccucaucacugugg

SEQ ID NO: 110503 - RNA, 22 nt, Human
cugcccucucugagucucaguu

SEQ ID NO: 110504 - RNA, 19 nt, Human
cugucuuccuuccuccuca

SEQ ID NO: 110505 - RNA, 15 nt, Human
ggcuuccccaccucu

SEQ ID NO: 110506 - RNA, 19 nt, Human
cccggcuggagugcagugg

SEQ ID NO: 110507 - RNA, 26 nt, Human
augagguccugccacaacggaaagag

SEQ ID NO: 110508 - RNA, 23 nt, Human
aauucuugccuuuccuuguuuca

SEQ ID NO: 110509 - RNA, 28 nt, Human
uaaacucaggccaacaagaaccucagca

SEQ ID NO: 110510 - RNA, 20 nt, Human
ucuucaauccuucaguccca

SEQ ID NO: 110511 - RNA, 24 nt, Human
cugucaccaaggcuuagugcagug

SEQ ID NO: 110512 - RNA, 22 nt, Human
uauaccagaugaacauuucaaa

SEQ ID NO: 110513 - RNA, 22 nt, Human
ggagccaagaagcacagagaca

SEQ ID NO: 110514 - RNA, 23 nt, Human
gcauacucucuguaauuccagug

SEQ ID NO: 110515 - RNA, 27 nt, Human
ugcucuugaauuccugggcucaagcag

SEQ ID NO: 110516 - RNA, 23 nt, Human
uccaggaggcggagguugcagug

SEQ ID NO: 110517 - RNA, 21 nt, Human
caggaccuuuccgaagcgucg

SEQ ID NO: 110518 - RNA, 23 nt, Human
cgcgguucguccucuagugccuu

SEQ ID NO: 110519 - RNA, 27 nt, Human
gcuucggagcugccuggcucauggccc

SEQ ID NO: 110520 - RNA, 20 nt, Human
aacacaaaucuagaauugca

SEQ ID NO: 110521 - RNA, 17 nt, Human
ccaugagucccugcacu

SEQ ID NO: 110522 - RNA, 20 nt, Human
gccugugccagcaccuuuga

SEQ ID NO: 110523 - RNA, 20 nt, Human
cggcaaaccuuucccccuua

SEQ ID NO: 110524 - RNA, 22 nt, Human
ugucacccaggcuugagugcag

SEQ ID NO: 110525 - RNA, 22 nt, Human
auuggcacugaaggcaccccag

SEQ ID NO: 110526 - RNA, 27 nt, Human
cccaaagugcugggauuacagcauccc

SEQ ID NO: 110527 - RNA, 24 nt, Human
ccacuucccagcaagacagcagcu

SEQ ID NO: 110528 - RNA, 20 nt, Human
gaaauugaacaaaggucagu

SEQ ID NO: 110529 - RNA, 26 nt, Human
cugccucugccucuguuuaauaagga

SEQ ID NO: 110530 - RNA, 21 nt, Human
ccucugccuccagcccggcag

SEQ ID NO: 110531 - RNA, 20 nt, Human
acccaacaacugucacccuc

SEQ ID NO: 110532 - RNA, 24 nt, Human
ucuguggcuaaaucuagagcugcu

SEQ ID NO: 110533 - RNA, 18 nt, Human
gggagcacccugcccacc

SEQ ID NO: 110534 - RNA, 22 nt, Human
ggucugcacuauaaaacauuuu

SEQ ID NO: 110535 - RNA, 22 nt, Human
auguuuugccguggcuugggga

SEQ ID NO: 110536 - RNA, 18 nt, Human
gcuuucuccccucccgcu

SEQ ID NO: 110537 - RNA, 22 nt, Human
caccgcacuucagccuggguga

SEQ ID NO: 110538 - RNA, 22 nt, Human
ucauccagcucuugcucaguga

SEQ ID NO: 110539 - RNA, 28 nt, Human
ggaggugagugacccugagacuaaugaa

SEQ ID NO: 110540 - RNA, 29 nt, Human
acacaucaccuugcaaaugacacuuugcc

SEQ ID NO: 110541 - RNA, 26 nt, Human
uuauuacaguccuucaagauuccauu

SEQ ID NO: 110542 - RNA, 27 nt, Human
gcaucccugucucagggacuucuucgc

SEQ ID NO: 110543 - RNA, 29 nt, Human
gcuggccagaagagacaucuuggguuccu

SEQ ID NO: 110544 - RNA, 22 nt, Human
ccagcauagugcuccuggacca

SEQ ID NO: 110545 - RNA, 18 nt, Human
ccugaguagcugggcacg

SEQ ID NO: 110546 - RNA, 25 nt, Human
gacuuccccagcaaggaucuuccca

SEQ ID NO: 110547 - RNA, 23 nt, Human
aauucuucaaccagaaaaaccua

SEQ ID NO: 110548 - RNA, 18 nt, Human
aaaaccugcuuguucaca

SEQ ID NO: 110549 - RNA, 27 nt, Human
acucuucauguggcagagucuucuaug

SEQ ID NO: 110550 - RNA, 25 nt, Human
cccagucgaguccucuuguggagcc

SEQ ID NO: 110551 - RNA, 24 nt, Human
cauggcucuucccagccuagggga

SEQ ID NO: 110552 - RNA, 21 nt, Human
gcagcggcugcuggagaucug

SEQ ID NO: 110553 - RNA, 19 nt, Human
ucaaggccugagcaaccaa

SEQ ID NO: 110554 - RNA, 27 nt, Human
uggcuguaucaguucuuaaaaucugca

SEQ ID NO: 110555 - RNA, 22 nt, Human
acaggggcagaguaauucaggc

SEQ ID NO: 110556 - RNA, 21 nt, Human
cagcacuuucuuucugaugau

SEQ ID NO: 110557 - RNA, 27 nt, Human
ggucucgagucuccugaccucgugauc

SEQ ID NO: 110558 - RNA, 23 nt, Human
uugcccaggucaggaguguuuuc

SEQ ID NO: 110559 - RNA, 26 nt, Human
aguccccagacucagcuggaagucua

SEQ ID NO: 110560 - RNA, 25 nt, Human
ggcgagccgaugccgagcugcucca

SEQ ID NO: 110561 - RNA, 27 nt, Human
cuccagccucggcgccuggggcagcgg

SEQ ID NO: 110562 - RNA, 24 nt, Human
cuccugagacaucuuugcugcaag

SEQ ID NO: 110563 - RNA, 22 nt, Human
cauuuacauuguuuacacuucu

SEQ ID NO: 110564 - RNA, 23 nt, Human
uucccuagauugugaaagugauc

SEQ ID NO: 110565 - RNA, 23 nt, Human
aagcagaguagacaucaucucug

SEQ ID NO: 110566 - RNA, 26 nt, Human
aaccaaaaucauaggcuuuuucugug

SEQ ID NO: 110567 - RNA, 21 nt, Human
ggaaacaccgcgagggccggg

SEQ ID NO: 110568 - RNA, 27 nt, Human
ugaaaggugacgugcaaaacugccuau

SEQ ID NO: 110569 - RNA, 22 nt, Human
gcugcucuucccuucuccucag

SEQ ID NO: 110570 - RNA, 24 nt, Human
ccauguagcugggauuacagcugc

SEQ ID NO: 110571 - RNA, 22 nt, Human
cuagacccggcgccaucaugcu

SEQ ID NO: 110572 - RNA, 21 nt, Human
acuuccauauggagcauuuuu

SEQ ID NO: 110573 - RNA, 21 nt, Human
ggcaacuuggaccagugcaag

SEQ ID NO: 110574 - RNA, 30 nt, Human
ucaugcuuugauuuacacucgaacucggga

SEQ ID NO: 110575 - RNA, 23 nt, Human
gacuaaagaccugcuguaauaaa

SEQ ID NO: 110576 - RNA, 21 nt, Human
ccuggugccuuuugcagccag

SEQ ID NO: 110577 - RNA, 25 nt, Human
caucuggagaaaauucaguuaaaag

SEQ ID NO: 110578 - RNA, 21 nt, Human
uagucuucucaagcaaugagg

SEQ ID NO: 110579 - RNA, 21 nt, Human
uguggauagaacgccacccag

SEQ ID NO: 110580 - RNA, 22 nt, Human
acacaccccacaccccagccca

SEQ ID NO: 110581 - RNA, 21 nt, Human
ggcucucugcaaccucugccu

SEQ ID NO: 110582 - RNA, 20 nt, Human
aaaacuaauaauaaugagua

SEQ ID NO: 110583 - RNA, 22 nt, Human
aguauucucauaggagacugcg

SEQ ID NO: 110584 - RNA, 23 nt, Human
ggcagugacacuguaggagcaua

SEQ ID NO: 110585 - RNA, 23 nt, Human
aacaugucacaauacaguaagua

SEQ ID NO: 110586 - RNA, 23 nt, Human
guuuccucaucuguccagugggu

SEQ ID NO: 110587 - RNA, 24 nt, Human
ucucagggccagaccagacagaug

SEQ ID NO: 110588 - RNA, 19 nt, Human
acaaaggcugaacuggauu

SEQ ID NO: 110589 - RNA, 22 nt, Human
uacuguugguauaacugagcuu

SEQ ID NO: 110590 - RNA, 21 nt, Human
cuuccccuggccagggccccu

SEQ ID NO: 110591 - RNA, 24 nt, Human
ccagcugccucuucuccuaaagca

SEQ ID NO: 110592 - RNA, 24 nt, Human
gauggaguuggucaaaugagggaa

SEQ ID NO: 110593 - RNA, 19 nt, Human
gcccaggcuggaguauaau

SEQ ID NO: 110594 - RNA, 25 nt, Human
gcuccuccauuuccauuuauucuca

SEQ ID NO: 110595 - RNA, 24 nt, Human
ccuccuguuccagcuccugcugcu

SEQ ID NO: 110596 - RNA, 21 nt, Human
gagaaccauaucaagacucuu

SEQ ID NO: 110597 - RNA, 26 nt, Human
guccccaaauaccugaaagcugucuu

SEQ ID NO: 110598 - RNA, 27 nt, Human
caguagaacuaugucggagcacucacu

SEQ ID NO: 110599 - RNA, 27 nt, Human
uuaacacuuuucacuugguucuuauac

SEQ ID NO: 110600 - RNA, 24 nt, Human
gacaggugggaagaugggaaugag

SEQ ID NO: 110601 - RNA, 23 nt, Human
uacuaccucuucuuucuguaggg

SEQ ID NO: 110602 - RNA, 20 nt, Human
acccaccagcacccuccguc

SEQ ID NO: 110603 - RNA, 20 nt, Human
gcucagcccaggcagccagc

SEQ ID NO: 110604 - RNA, 21 nt, Human
ucucccacccccuccccaaag

SEQ ID NO: 110605 - RNA, 28 nt, Human
ccuuccccucccccuucccggcgcacuc

SEQ ID NO: 110606 - RNA, 22 nt, Human
ucuagcuaauuuuuuaaaucuu

SEQ ID NO: 110607 - RNA, 21 nt, Human
gaggcgaggggacagcccagc

SEQ ID NO: 110608 - RNA, 24 nt, Human
gaagaauuuuucugucuuuggaga

SEQ ID NO: 110609 - RNA, 23 nt, Human
gaaugaguugaggccacuguguu

SEQ ID NO: 110610 - RNA, 22 nt, Human
ccgcuccagggccgggcugacc

SEQ ID NO: 110611 - RNA, 25 nt, Human
gggcagccggagcaccccaaggggu

SEQ ID NO: 110612 - RNA, 21 nt, Human
ccuguauuccugaccuccgcc

SEQ ID NO: 110613 - RNA, 26 nt, Human
uguuaugcauaaagucagugcccaac

SEQ ID NO: 110614 - RNA, 21 nt, Human
accaggacuagggcgagggca

SEQ ID NO: 110615 - RNA, 27 nt, Human
guagggagggcggcaggggccuggaga

SEQ ID NO: 110616 - RNA, 32 nt, Human
uacucuuggcaccuugacuugcacccucugag

SEQ ID NO: 110617 - RNA, 27 nt, Human
gugaccuggguauccccugccuccugc

SEQ ID NO: 110618 - RNA, 21 nt, Human
gucuggugauuucaguucugu

SEQ ID NO: 110619 - RNA, 24 nt, Human
ugcaguuuuugcuuaugauuugua

SEQ ID NO: 110620 - RNA, 24 nt, Human
gaggaagacggaaaagacugccug

SEQ ID NO: 110621 - RNA, 21 nt, Human
auuaucuugcuucauauauca

SEQ ID NO: 110622 - RNA, 22 nt, Human
aucauaauagaaaacucagccu

SEQ ID NO: 110623 - RNA, 26 nt, Human
cacagugucuguggggagcccaggaa

SEQ ID NO: 110624 - RNA, 28 nt, Human
cuuaaagaaccaucagcaucacccggga

SEQ ID NO: 110625 - RNA, 27 nt, Human
agcucacuccucuucucccugcccuga

SEQ ID NO: 110626 - RNA, 22 nt, Human
gccuauaaucuuagcacuuugg

SEQ ID NO: 110627 - RNA, 21 nt, Human
ucucacuugacauuuuagcua

SEQ ID NO: 110628 - RNA, 22 nt, Human
cccccugcucugugcagcugcc

SEQ ID NO: 110629 - RNA, 26 nt, Human
cacuauacucuaaaauggacauuuuc

SEQ ID NO: 110630 - RNA, 21 nt, Human
uagaaauuauguuaacuauga

SEQ ID NO: 110631 - RNA, 22 nt, Human
ccuccaggcugcugugagagug

SEQ ID NO: 110632 - RNA, 27 nt, Human
ugucauuguucuaguaaauuaguucca

SEQ ID NO: 110633 - RNA, 30 nt, Human
gugguauuuacaaugacauccuccuccucc

SEQ ID NO: 110634 - RNA, 21 nt, Human
cacuggaucagccgcuggaac

SEQ ID NO: 110635 - RNA, 24 nt, Human
gcugggagccaggcgggcggcugg

SEQ ID NO: 110636 - RNA, 26 nt, Human
ggaaggcucucgggugggggagccag

SEQ ID NO: 110637 - RNA, 21 nt, Human
uuaccuccuuaauuuuuaaca

SEQ ID NO: 110638 - RNA, 22 nt, Human
auuauuuccucuggcuuccuca

SEQ ID NO: 110639 - RNA, 18 nt, Human
gugaaguccagggccagg

SEQ ID NO: 110640 - RNA, 25 nt, Human
cccaccccuccuuccuugaccagca

SEQ ID NO: 110641 - RNA, 23 nt, Human
uucauauuccugccuuucuucca

SEQ ID NO: 110642 - RNA, 22 nt, Human
uuggcccagacacccaccugac

SEQ ID NO: 110643 - RNA, 22 nt, Human
gaaauccauauuuauuuuguaa

SEQ ID NO: 110644 - RNA, 26 nt, Human
ggccuggaggcuacuggcuggaugca

SEQ ID NO: 110645 - RNA, 22 nt, Human
gcugaacuugcucaaucuaagg

SEQ ID NO: 110646 - RNA, 22 nt, Human
aacaacaaacgugcuuuuuucc

SEQ ID NO: 110647 - RNA, 20 nt, Human
aggugucccuccuaugcaca

SEQ ID NO: 110648 - RNA, 25 nt, Human
uccugugccuccaucagcuaaacac

SEQ ID NO: 110649 - RNA, 22 nt, Human
uauauuuguaccacuuuugaga

SEQ ID NO: 110650 - RNA, 18 nt, Human
uggugucugcuuucucca

SEQ ID NO: 110651 - RNA, 21 nt, Human
cuccugagagaguagcagguu

SEQ ID NO: 110652 - RNA, 23 nt, Human
gucucccaaaccaccuucccuca

SEQ ID NO: 110653 - RNA, 24 nt, Human
uucucagaagcacagaauauuuuu

SEQ ID NO: 110654 - RNA, 24 nt, Human
agguuugccuacguuggugcaagu

SEQ ID NO: 110655 - RNA, 20 nt, Human
ugcagucagagacaguagac

SEQ ID NO: 110656 - RNA, 22 nt, Human
gcaaagcacaagcuugccugaa

SEQ ID NO: 110657 - RNA, 26 nt, Human
aaucuacagacaggaaugcccuucag

SEQ ID NO: 110658 - RNA, 23 nt, Human
cugccucuucuuuucccugcugc

SEQ ID NO: 110659 - RNA, 26 nt, Human
uuagaaagagaggaaggaugucugca

SEQ ID NO: 110660 - RNA, 27 nt, Human
aaaaugcuggguuuaagaaaggcaacc

SEQ ID NO: 110661 - RNA, 24 nt, Human
gugauuuccaaaagcagaggugug

SEQ ID NO: 110662 - RNA, 24 nt, Human
ccacguccaaaccccuuuaagaag

SEQ ID NO: 110663 - RNA, 19 nt, Human
uuuagaagaaagaauugua

SEQ ID NO: 110664 - RNA, 23 nt, Human
cuugucuugggccugucaccucc

SEQ ID NO: 110665 - RNA, 24 nt, Human
aagguaagaggaaucaaguucuga

SEQ ID NO: 110666 - RNA, 25 nt, Human
auauuguuaaauaaacugugugcaa

SEQ ID NO: 110667 - RNA, 24 nt, Human
gguuccuccugacccagcugccuc

SEQ ID NO: 110668 - RNA, 23 nt, Human
cgcccgaugcccagagcacucug

SEQ ID NO: 110669 - RNA, 22 nt, Human
uguccagcaaauacucuaauga

SEQ ID NO: 110670 - RNA, 27 nt, Human
gaggaagagaccaagaaauaaaccucc

SEQ ID NO: 110671 - RNA, 22 nt, Human
aacacaaauaucauaaaaggag

SEQ ID NO: 110672 - RNA, 23 nt, Human
ccaucuucuuuauacaaugacca

SEQ ID NO: 110673 - RNA, 22 nt, Human
cgccuaagcuggaguguggugg

SEQ ID NO: 110674 - RNA, 20 nt, Human
auucagcauuaaaauaaaug

SEQ ID NO: 110675 - RNA, 22 nt, Human
aacagcuuggcucuuuugggaa

SEQ ID NO: 110676 - RNA, 27 nt, Human
gaggaagagaaaaaauauuuuccugcc

SEQ ID NO: 110677 - RNA, 24 nt, Human
cuugggaggcugaggcagaauugc

SEQ ID NO: 110678 - RNA, 24 nt, Human
acaugguccuugucccaagcccag

SEQ ID NO: 110679 - RNA, 21 nt, Human
caggggcccugcuccucucug

SEQ ID NO: 110680 - RNA, 21 nt, Human
cggcgggcgggguggagcagc

SEQ ID NO: 110681 - RNA, 30 nt, Human
cugggggagagccggguucauucccugucc

SEQ ID NO: 110682 - RNA, 21 nt, Human
ugcccugcugagugucccuga

SEQ ID NO: 110683 - RNA, 31 nt, Human
cuguggucccucugugucugcucucauccau

SEQ ID NO: 110684 - RNA, 21 nt, Human
gaggcgcuggagcugaaggaa

SEQ ID NO: 110685 - RNA, 24 nt, Human
ccccaaaauauugaaguucaucug

SEQ ID NO: 110686 - RNA, 20 nt, Human
aucaggaaugaagauaaaag

SEQ ID NO: 110687 - RNA, 23 nt, Human
guggaccaguuaguuuugcccau

SEQ ID NO: 110688 - RNA, 26 nt, Human
uucauuucuucuguaugcucuuuucu

SEQ ID NO: 110689 - RNA, 21 nt, Human
ugagaggaaggggacaaguag

SEQ ID NO: 110690 - RNA, 20 nt, Human
gaccugucagccauggggga

SEQ ID NO: 110691 - RNA, 21 nt, Human
auuucuagugccuucugucca

SEQ ID NO: 110692 - RNA, 21 nt, Human
uuucaucuugaaugucuuugu

SEQ ID NO: 110693 - RNA, 22 nt, Human
gugcaggcugcagcgcccagcc

SEQ ID NO: 110694 - RNA, 17 nt, Human
auccuuuuguauacuuc

SEQ ID NO: 110695 - RNA, 20 nt, Human
gcacauaccacugcacccag

SEQ ID NO: 110696 - RNA, 24 nt, Human
guuaacauuuuuaaaaauacauau

SEQ ID NO: 110697 - RNA, 20 nt, Human
caugcugugauaccggcgga

SEQ ID NO: 110698 - RNA, 22 nt, Human
agcucucucaugacccaccuca

SEQ ID NO: 110699 - RNA, 22 nt, Human
gaaaguuuaucaccccaaagag

SEQ ID NO: 110700 - RNA, 22 nt, Human
cccauccugucuucuacuugaa

SEQ ID NO: 110701 - RNA, 22 nt, Human
acccaggcuggaaugcaauggc

SEQ ID NO: 110702 - RNA, 22 nt, Human
acccaggcuggagugcaaugac

SEQ ID NO: 110703 - RNA, 21 nt, Human
cuuuccaggaagucaggaugg

SEQ ID NO: 110704 - RNA, 19 nt, Human
aaaagagauuucuaggccu

SEQ ID NO: 110705 - RNA, 28 nt, Human
uagugguauaagaaagcauuucuuauga

SEQ ID NO: 110706 - RNA, 23 nt, Human
auuccuucaccgccuccuucauu

SEQ ID NO: 110707 - RNA, 27 nt, Human
caggcuggggaggccaguguugugggc

SEQ ID NO: 110708 - RNA, 23 nt, Human
cauuucgccugguaauccuccag

SEQ ID NO: 110709 - RNA, 20 nt, Human
aacaggcaaggaggcuuuga

SEQ ID NO: 110710 - RNA, 19 nt, Human
gcccagaugauucuaaauu

SEQ ID NO: 110711 - RNA, 25 nt, Human
cccagccugugguuacagugcagac

SEQ ID NO: 110712 - RNA, 22 nt, Human
ugugaacuguuucucuucugca

SEQ ID NO: 110713 - RNA, 22 nt, Human
cuaagcaaagugccccugcagg

SEQ ID NO: 110714 - RNA, 24 nt, Human
uccuuucucagccucucucgugcu

SEQ ID NO: 110715 - RNA, 17 nt, Human
agcuagagaaggucgga

SEQ ID NO: 110716 - RNA, 26 nt, Human
ccaccuccuguucgugaccugacagg

SEQ ID NO: 110717 - RNA, 26 nt, Human
cugucuuauuuggcagcugcugccuc

SEQ ID NO: 110718 - RNA, 28 nt, Human
uugacagaaucugaaagcaugaccugca

SEQ ID NO: 110719 - RNA, 27 nt, Human
ggcuacccaauguuacuacuuauuuuu

SEQ ID NO: 110720 - RNA, 27 nt, Human
ugggacacuuaacagaugcaaugugcu

SEQ ID NO: 110721 - RNA, 22 nt, Human
aucaggagcacugagcucacag

SEQ ID NO: 110722 - RNA, 24 nt, Human
uuugggaggugucugugaagcagu

SEQ ID NO: 110723 - RNA, 21 nt, Human
ucaccgaggaggagugagguc

SEQ ID NO: 110724 - RNA, 25 nt, Human
auuucccugacuccucuaagccacu

SEQ ID NO: 110725 - RNA, 22 nt, Human
acagccggcuguggagcagcag

SEQ ID NO: 110726 - RNA, 22 nt, Human
ucuugacucuaaaugcaguuuu

SEQ ID NO: 110727 - RNA, 21 nt, Human
aaaugcaugugauuggcagcu

SEQ ID NO: 110728 - RNA, 22 nt, Human
ccuauaaucccagcacuuuagg

SEQ ID NO: 110729 - RNA, 27 nt, Human
ucaauggucuuguuucuuugcuuucua

SEQ ID NO: 110730 - RNA, 26 nt, Human
guuguggcuguuccuuaacgucccca

SEQ ID NO: 110731 - RNA, 20 nt, Human
uccacuccagaaaucaugcu

SEQ ID NO: 110732 - RNA, 24 nt, Human
ccccccacucacucccuagcugug

SEQ ID NO: 110733 - RNA, 21 nt, Human
ggcauuuucagcagauccuca

SEQ ID NO: 110734 - RNA, 22 nt, Human
ugccauugcauuccagccuugg

SEQ ID NO: 110735 - RNA, 27 nt, Human
cccaacaacagaagccuguggccccaa

SEQ ID NO: 110736 - RNA, 22 nt, Human
cugcagcucuggaaagaggguu

SEQ ID NO: 110737 - RNA, 21 nt, Human
aaaugcacauuguguggaugg

SEQ ID NO: 110738 - RNA, 26 nt, Human
ucgcccaggcuggagugcaauggcac

SEQ ID NO: 110739 - RNA, 26 nt, Human
uggaauuuggcuucaagaugcccaag

SEQ ID NO: 110740 - RNA, 20 nt, Human
ugaaacuaucacaggugcug

SEQ ID NO: 110741 - RNA, 27 nt, Human
caggguguaauuggguugauggguggg

SEQ ID NO: 110742 - RNA, 20 nt, Human
ccucuccagcccaaucuucu

SEQ ID NO: 110743 - RNA, 27 nt, Human
gcuggaugaccccaugcuccgucauuu

SEQ ID NO: 110744 - RNA, 22 nt, Human
guuucaaauccuuuugaacacg

SEQ ID NO: 110745 - RNA, 23 nt, Human
gccucugcucccucuuccucuag

SEQ ID NO: 110746 - RNA, 22 nt, Human
aucuucacguguuguuguguuu

SEQ ID NO: 110747 - RNA, 23 nt, Human
auaauaaaccaaaacacuaccug

SEQ ID NO: 110748 - RNA, 21 nt, Human
ucuggggccucaccagcagga

SEQ ID NO: 110749 - RNA, 22 nt, Human
uagugcauuuccuccugccuuu

SEQ ID NO: 110750 - RNA, 22 nt, Human
gcggcccaggcggggugcgagu

SEQ ID NO: 110751 - RNA, 27 nt, Human
uggugcaaucaugguucacugcagucu

SEQ ID NO: 110752 - RNA, 23 nt, Human
uuaguuuuaaaagacaagauauu

SEQ ID NO: 110753 - RNA, 27 nt, Human
aaacagucagaaaauuagcaugaaagc

SEQ ID NO: 110754 - RNA, 22 nt, Human
gucgcccagucuguaaugcagu

SEQ ID NO: 110755 - RNA, 23 nt, Human
cuggaggaagggggguugcagug

SEQ ID NO: 110756 - RNA, 22 nt, Human
caguccaaagaagcauauugcc

SEQ ID NO: 110757 - RNA, 31 nt, Human
uacacacaauaaguuagcacauguuuauuug

SEQ ID NO: 110758 - RNA, 25 nt, Human
ugggcuaggagccagugugaggcug

SEQ ID NO: 110759 - RNA, 23 nt, Human
ugaggaaacaugcaaagcauuag

SEQ ID NO: 110760 - RNA, 22 nt, Human
ucuuucuccuccuggccuggcc

SEQ ID NO: 110761 - RNA, 24 nt, Human
ccugcuccccuucccccagugggg

SEQ ID NO: 110762 - RNA, 25 nt, Human
acucaccuccgccuccaggaagacc

SEQ ID NO: 110763 - RNA, 21 nt, Human
cugaguauguguaacaggaua

SEQ ID NO: 110764 - RNA, 21 nt, Human
aagcuccccucagcccaucuu

SEQ ID NO: 110765 - RNA, 22 nt, Human
acaccagaacacauacauauau

SEQ ID NO: 110766 - RNA, 27 nt, Human
gucagccagaucccaaaugagugccuu

SEQ ID NO: 110767 - RNA, 23 nt, Human
cuccaucucaaaaagaaaagaaa

SEQ ID NO: 110768 - RNA, 25 nt, Human
gcgcggcauggaggguggugugagu

SEQ ID NO: 110769 - RNA, 20 nt, Human
ggugaagccccggggccggc

SEQ ID NO: 110770 - RNA, 23 nt, Human
uugcaauucaucauugcugccug

SEQ ID NO: 110771 - RNA, 21 nt, Human
gugugggcugauaguugauca

SEQ ID NO: 110772 - RNA, 26 nt, Human
cagcuucacuugcuggagugccaagu

SEQ ID NO: 110773 - RNA, 22 nt, Human
ugguggacugcagccuucaucu

SEQ ID NO: 110774 - RNA, 18 nt, Human
agccugcagccauccccc

SEQ ID NO: 110775 - RNA, 23 nt, Human
ucagcgaccaggugcugcugcug

SEQ ID NO: 110776 - RNA, 26 nt, Human
ucacucugucgcucaggcuggagugc

SEQ ID NO: 110777 - RNA, 26 nt, Human
ucacccugucgcccaggcuggagugc

SEQ ID NO: 110778 - RNA, 21 nt, Human
ggcuaauccaggaauauuguu

SEQ ID NO: 110779 - RNA, 24 nt, Human
agggcuuccuuugguaucaaagua

SEQ ID NO: 110780 - RNA, 22 nt, Human
ugaaaucccagccgccuagcga

SEQ ID NO: 110781 - RNA, 20 nt, Human
uggguccggggucucaggga

SEQ ID NO: 110782 - RNA, 24 nt, Human
ccaagaaacacucuguacugugug

SEQ ID NO: 110783 - RNA, 23 nt, Human
ggagccagacuggcgagauucaa

SEQ ID NO: 110784 - RNA, 22 nt, Human
ggugggguggaaauaggguggg

SEQ ID NO: 110785 - RNA, 24 nt, Human
ggcgccuggagcggcuggagcagu

SEQ ID NO: 110786 - RNA, 21 nt, Human
ccuggucuaguuuccugggcc

SEQ ID NO: 110787 - RNA, 19 nt, Human
cccaguauuuuuauacgga

SEQ ID NO: 110788 - RNA, 21 nt, Human
augucuuuuccuucuccauca

SEQ ID NO: 110789 - RNA, 22 nt, Human
uagucucaaacuccugaccuca

SEQ ID NO: 110790 - RNA, 21 nt, Human
cacugcccugggcuccaggga

SEQ ID NO: 110791 - RNA, 22 nt, Human
aggcucucacucuguugcccau

SEQ ID NO: 110792 - RNA, 22 nt, Human
caucauauuuuguugugcacua

SEQ ID NO: 110793 - RNA, 15 nt, Human
caaucugcacuuuga

SEQ ID NO: 110794 - RNA, 25 nt, Human
agccaucaggcuggaggugacgaug

SEQ ID NO: 110795 - RNA, 20 nt, Human
caggaccugggacugcacag

SEQ ID NO: 110796 - RNA, 21 nt, Human
uuuccuggcccugucucugga

SEQ ID NO: 110797 - RNA, 20 nt, Human
uaccuugcccuuucuacuca

SEQ ID NO: 110798 - RNA, 22 nt, Human
gauggccaagcagauagguuau

SEQ ID NO: 110799 - RNA, 27 nt, Human
uuaguuuagccuaaagauuuaucugca

SEQ ID NO: 110800 - RNA, 29 nt, Human
ggagguaggcauagagggagcccuacccc

SEQ ID NO: 110801 - RNA, 24 nt, Human
uuaggaaauauugaguaauuugua

SEQ ID NO: 110802 - RNA, 27 nt, Human
acuauuuaaauaaggaggaauauuaug

SEQ ID NO: 110803 - RNA, 27 nt, Human
ccagaaacaaaaagccccauugggcau

SEQ ID NO: 110804 - RNA, 23 nt, Human
ucauuuucaccuuuaaacuacua

SEQ ID NO: 110805 - RNA, 26 nt, Human
gcucugugacuccaguauaucuuacc

SEQ ID NO: 110806 - RNA, 23 nt, Human
ucugaggcucuuucugggccaag

SEQ ID NO: 110807 - RNA, 19 nt, Human
cuccuagcauucaaacuuc

SEQ ID NO: 110808 - RNA, 15 nt, Human
guucccgccuagcca

SEQ ID NO: 110809 - RNA, 25 nt, Human
gggagccgccugcuucuucucucca

SEQ ID NO: 110810 - RNA, 23 nt, Human
ccugagaggcggagguugcagug

SEQ ID NO: 110811 - RNA, 22 nt, Human
gccuguaaucccaacacuuugg

SEQ ID NO: 110812 - RNA, 22 nt, Human
gccuguaaucccagcacuuuga

SEQ ID NO: 110813 - RNA, 22 nt, Human
cuccagcccaggacuucgaggc

SEQ ID NO: 110814 - RNA, 22 nt, Human
agccucccaaaguguuaggauu

SEQ ID NO: 110815 - RNA, 22 nt, Human
ggccucucaaagugcugggauu

SEQ ID NO: 110816 - RNA, 21 nt, Human
ugcaaagccuggugccccgag

SEQ ID NO: 110817 - RNA, 20 nt, Human
cuuggcucagccacucuggg

SEQ ID NO: 110818 - RNA, 26 nt, Human
guggagcagagaacaguuccucagcu

SEQ ID NO: 110819 - RNA, 25 nt, Human
accguggggaagggccccacucagg

SEQ ID NO: 110820 - RNA, 22 nt, Human
ggucuccaaaagugcugggauu

SEQ ID NO: 110821 - RNA, 23 nt, Human
cccccgccucaacgcccagcaca

SEQ ID NO: 110822 - RNA, 26 nt, Human
guccacccucuccuugaugcagcuug

SEQ ID NO: 110823 - RNA, 26 nt, Human
ucgcucugucauucaggcuggagugc

SEQ ID NO: 110824 - RNA, 22 nt, Human
gcagguggaucaccugaggucg

SEQ ID NO: 110825 - RNA, 18 nt, Human
agcuguggaaaugaauga

SEQ ID NO: 110826 - RNA, 23 nt, Human
uacgggagagugguagaacugga

SEQ ID NO: 110827 - RNA, 21 nt, Human
gggucaggcaggaaagcaacu

SEQ ID NO: 110828 - RNA, 21 nt, Human
accaagugccuccugucugaa

SEQ ID NO: 110829 - RNA, 22 nt, Human
gaccagccugggcagcauggug

SEQ ID NO: 110830 - RNA, 22 nt, Human
cuacaaauugucaccucacuua

SEQ ID NO: 110831 - RNA, 27 nt, Human
guccucccuucccugcagcuccaguca

SEQ ID NO: 110832 - RNA, 26 nt, Human
ccaaaacagcaagcauagggagagcc

SEQ ID NO: 110833 - RNA, 26 nt, Human
cugcuuguagauaucauuuuugcagu

SEQ ID NO: 110834 - RNA, 25 nt, Human
gcuugaagaguaaccaucagagcug

SEQ ID NO: 110835 - RNA, 21 nt, Human
cgugagagcugcgugggcagg

SEQ ID NO: 110836 - RNA, 21 nt, Human
gagaacgacugggggccaggc

SEQ ID NO: 110837 - RNA, 21 nt, Human
acccgagcuggagugcagugg

SEQ ID NO: 110838 - RNA, 25 nt, Human
cccugccguuuccccuccuuggguu

SEQ ID NO: 110839 - RNA, 22 nt, Human
cagcggauucggaaggagaagc

SEQ ID NO: 110840 - RNA, 19 nt, Human
gcucuccccuccugugacc

SEQ ID NO: 110841 - RNA, 22 nt, Human
cacgccuguaauuccagugcuu

SEQ ID NO: 110842 - RNA, 26 nt, Human
ugucugaccuuaauuacacuauucuu

SEQ ID NO: 110843 - RNA, 25 nt, Human
cuuccaaggagcuacuuaguuuuag

SEQ ID NO: 110844 - RNA, 22 nt, Human
gggcugcaccuggccuuauggg

SEQ ID NO: 110845 - RNA, 27 nt, Human
agccacagggaggcauggagugccaug

SEQ ID NO: 110846 - RNA, 21 nt, Human
gcagguggcacguggggaaga

SEQ ID NO: 110847 - RNA, 25 nt, Human
cugcaaccguuuccgccuccugcua

SEQ ID NO: 110848 - RNA, 23 nt, Human
gucucugagaguagagucacugg

SEQ ID NO: 110849 - RNA, 23 nt, Human
ccgggagggaggggugugcagga

SEQ ID NO: 110850 - RNA, 22 nt, Human
uggcacccugaugaguauuuaa

SEQ ID NO: 110851 - RNA, 24 nt, Human
uucugucuugccuucauguggacc

SEQ ID NO: 110852 - RNA, 27 nt, Human
uagccuggugguuuucaaccucuagaa

SEQ ID NO: 110853 - RNA, 18 nt, Human
uccuuucuccccugggcu

SEQ ID NO: 110854 - RNA, 26 nt, Human
gaagaauauauuucacugugccauaa

SEQ ID NO: 110855 - RNA, 25 nt, Human
ugccucuccuggcccuggaaguugc

SEQ ID NO: 110856 - RNA, 19 nt, Human
ccugcucuccaccuggacu

SEQ ID NO: 110857 - RNA, 21 nt, Human
gcagcucuaaaugucaaucag

SEQ ID NO: 110858 - RNA, 22 nt, Human
caggccuggacuuuuugcauca

SEQ ID NO: 110859 - RNA, 22 nt, Human
gcuucugcccugucaaaggucc

SEQ ID NO: 110860 - RNA, 22 nt, Human
ggaagguggagcuugcagugag

SEQ ID NO: 110861 - RNA, 20 nt, Human
gcaggccuaagacaugugag

SEQ ID NO: 110862 - RNA, 21 nt, Human
cugaccucaguuuucucacaa

SEQ ID NO: 110863 - RNA, 22 nt, Human
gacgggguuucaccguguugcc

SEQ ID NO: 110864 - RNA, 25 nt, Human
agaauauuuugugcuuucuuuagaa

SEQ ID NO: 110865 - RNA, 23 nt, Human
cuuugcaggcagccugcuccccu

SEQ ID NO: 110866 - RNA, 24 nt, Human
acgcaaucucggcucacugcaacc

SEQ ID NO: 110867 - RNA, 19 nt, Human
cuguauguacauacuggca

SEQ ID NO: 110868 - RNA, 19 nt, Human
uucacuuucaaaaacauga

SEQ ID NO: 110869 - RNA, 20 nt, Human
acacuauguuacauacucua

SEQ ID NO: 110870 - RNA, 20 nt, Human
caccaaaaaagagguacccu

SEQ ID NO: 110871 - RNA, 19 nt, Human
cucaccccgcgugccaccc

SEQ ID NO: 110872 - RNA, 27 nt, Human
gguuuucuccugggauggugaaaaugu

SEQ ID NO: 110873 - RNA, 25 nt, Human
aaagcuuacuuuaaacaggaggcag

SEQ ID NO: 110874 - RNA, 22 nt, Human
gucgaccaaaaggaaugugugg

SEQ ID NO: 110875 - RNA, 22 nt, Human
agccuccgaaguagcugggauu

SEQ ID NO: 110876 - RNA, 27 nt, Human
gucaccagacggggcuggagugugagg

SEQ ID NO: 110877 - RNA, 23 nt, Human
ugggucugcuuugguuuuugcug

SEQ ID NO: 110878 - RNA, 23 nt, Human
ccuggaucuuugcccaccucuuc

SEQ ID NO: 110879 - RNA, 21 nt, Human
ucaagucaguuccuggagccu

SEQ ID NO: 110880 - RNA, 21 nt, Human
aaauguaugcaaaugaugggg

SEQ ID NO: 110881 - RNA, 26 nt, Human
agaugagagacccuuauuuuggcugu

SEQ ID NO: 110882 - RNA, 25 nt, Human
aaaacucaagagcuucgagagccag

SEQ ID NO: 110883 - RNA, 23 nt, Human
augcauccagacacugugcuggg

SEQ ID NO: 110884 - RNA, 19 nt, Human
agggaaccuguccccaaau

SEQ ID NO: 110885 - RNA, 21 nt, Human
gcaggcgccucaccagccucc

SEQ ID NO: 110886 - RNA, 24 nt, Human
ucuauuuuuguuauccugugauua

SEQ ID NO: 110887 - RNA, 23 nt, Human
ugagaauaguggugaauuugauu

SEQ ID NO: 110888 - RNA, 23 nt, Human
cuguccucucuggcuggggagca

SEQ ID NO: 110889 - RNA, 19 nt, Human
acuguucucccuugugacu

SEQ ID NO: 110890 - RNA, 19 nt, Human
uuaguauuuucccaaccaa

SEQ ID NO: 110891 - RNA, 22 nt, Human
cguaaucauccccauccuccag

SEQ ID NO: 110892 - RNA, 24 nt, Human
ggccucccccuuuacccagcucuu

SEQ ID NO: 110893 - RNA, 19 nt, Human
uuucaguggcucucuuuga

SEQ ID NO: 110894 - RNA, 25 nt, Human
ggauggaaucaacaggcagggggcc

SEQ ID NO: 110895 - RNA, 24 nt, Human
uuugaacuuccuuucccacuuggu

SEQ ID NO: 110896 - RNA, 19 nt, Human
aagaagcucuugaccaagu

SEQ ID NO: 110897 - RNA, 27 nt, Human
agggacagaggcccagccucccugaag

SEQ ID NO: 110898 - RNA, 24 nt, Human
uuggcugcugccugccacagccuc

SEQ ID NO: 110899 - RNA, 21 nt, Human
ccucuagcccagcuccucggc

SEQ ID NO: 110900 - RNA, 25 nt, Human
acacuuuuuacuuuuacacacuuuc

SEQ ID NO: 110901 - RNA, 23 nt, Human
gaugggguuucacuguguuggcc

SEQ ID NO: 110902 - RNA, 22 nt, Human
gagggcggaaggugggaggagg

SEQ ID NO: 110903 - RNA, 22 nt, Human
ccccugccccgcccccggcacg

SEQ ID NO: 110904 - RNA, 26 nt, Human
aagaauuggccaggcaugguggcuca

SEQ ID NO: 110905 - RNA, 23 nt, Human
ggacucgugggggccaccugcca

SEQ ID NO: 110906 - RNA, 21 nt, Human
gcaaacccaaaaccucaugac

SEQ ID NO: 110907 - RNA, 20 nt, Human
aguccugcugcccuccagcc

SEQ ID NO: 110908 - RNA, 20 nt, Human
ccugcagccccgcaccugcc

SEQ ID NO: 110909 - RNA, 20 nt, Human
ucuucccagccgcagucuag

SEQ ID NO: 110910 - RNA, 20 nt, Human
uuuuagcucuggacaucauu

SEQ ID NO: 110911 - RNA, 25 nt, Human
aucuagaaacuucuacuaaacagag

SEQ ID NO: 110912 - RNA, 23 nt, Human
ucagccuuauuccccuucaccuc

SEQ ID NO: 110913 - RNA, 19 nt, Human
uaauaaggagucagaccua

SEQ ID NO: 110914 - RNA, 25 nt, Human
cacucuauccuggauaggcacuugg

SEQ ID NO: 110915 - RNA, 25 nt, Human
ucugcacugcaacuucuguauccuu

SEQ ID NO: 110916 - RNA, 27 nt, Human
ggaggcagcagcauugcacagccccag

SEQ ID NO: 110917 - RNA, 25 nt, Human
cucugccuguagccaggaugcagcu

SEQ ID NO: 110918 - RNA, 27 nt, Human
cuugcugucuguuguuguuugaaaucu

SEQ ID NO: 110919 - RNA, 20 nt, Human
acccccaccccacagcugcu

SEQ ID NO: 110920 - RNA, 22 nt, Human
uauaaaacaugaaaaucgcuuu

SEQ ID NO: 110921 - RNA, 21 nt, Human
ucguccuucuccacacccagc

SEQ ID NO: 110922 - RNA, 23 nt, Human
guggcccaggcuggagugcagug

SEQ ID NO: 110923 - RNA, 20 nt, Human
caaucaauaaaaauauuuua

SEQ ID NO: 110924 - RNA, 22 nt, Human
aggccuuuagccucugaaugau

SEQ ID NO: 110925 - RNA, 18 nt, Human
gaguuaacaaaacagagu

SEQ ID NO: 110926 - RNA, 23 nt, Human
aaugcuguugaaguuucugggaa

SEQ ID NO: 110927 - RNA, 27 nt, Human
aggaguuaaaggcacauaaagucuuaa

SEQ ID NO: 110928 - RNA, 21 nt, Human
cccaccccagcuggucugcuu

SEQ ID NO: 110929 - RNA, 19 nt, Human
agaaaugugacaaagcuuu

SEQ ID NO: 110930 - RNA, 20 nt, Human
uucuagauaggucagucuaa

SEQ ID NO: 110931 - RNA, 24 nt, Human
ccugcuggcaucaggucugggcaa

SEQ ID NO: 110932 - RNA, 19 nt, Human
gacugcaggcgugagccac

SEQ ID NO: 110933 - RNA, 25 nt, Human
cacagugcagcuuggugaagccaca

SEQ ID NO: 110934 - RNA, 22 nt, Human
cuaccacccaagggugccaugg

SEQ ID NO: 110935 - RNA, 24 nt, Human
accccuuccagggguuuacagucu

SEQ ID NO: 110936 - RNA, 24 nt, Human
gaacaaucuccccuaccuccuggg

SEQ ID NO: 110937 - RNA, 23 nt, Human
ucuggugucaauucgcuauucgc

SEQ ID NO: 110938 - RNA, 22 nt, Human
guuaauggguuuaauggagagg

SEQ ID NO: 110939 - RNA, 22 nt, Human
ccaaaacagaguggauugggcu

SEQ ID NO: 110940 - RNA, 22 nt, Human
uuuuaugcuacugaacugaaag

SEQ ID NO: 110941 - RNA, 24 nt, Human
ccaaacaguaugauggaacaguga

SEQ ID NO: 110942 - RNA, 22 nt, Human
aaaauuaaugugcucaccucgg

SEQ ID NO: 110943 - RNA, 31 nt, Human
cagccgcgaacuccggcucuagccucccgcu

SEQ ID NO: 110944 - RNA, 21 nt, Human
cuccugggcaggcaggugccu

SEQ ID NO: 110945 - RNA, 16 nt, Human
acuggacucucuuagc

SEQ ID NO: 110946 - RNA, 22 nt, Human
accucagggaaccucucccugg

SEQ ID NO: 110947 - RNA, 22 nt, Human
ugccacuccacuccagucuggg

SEQ ID NO: 110948 - RNA, 22 nt, Human
ugccacugcacuccacucuggg

SEQ ID NO: 110949 - RNA, 27 nt, Human
ccuguucucugaagauguuuugugacc

SEQ ID NO: 110950 - RNA, 20 nt, Human
accugcugagagagcugcca

SEQ ID NO: 110951 - RNA, 23 nt, Human
auaaaauguugauaaggcacugc

SEQ ID NO: 110952 - RNA, 26 nt, Human
uucuccagauuccuaaagauuagaga

SEQ ID NO: 110953 - RNA, 20 nt, Human
agcccugucuuccuaccuau

SEQ ID NO: 110954 - RNA, 27 nt, Human
ggugggcaugaggcaucacuguuccug

SEQ ID NO: 110955 - RNA, 22 nt, Human
aucauaucacuguaucuucuca

SEQ ID NO: 110956 - RNA, 20 nt, Human
gccugccuauuuccaaagga

SEQ ID NO: 110957 - RNA, 23 nt, Human
ccuuaggaugcagcaugccuuca

SEQ ID NO: 110958 - RNA, 19 nt, Human
uuguguaauccacucagaa

SEQ ID NO: 110959 - RNA, 21 nt, Human
cacuguaauccgaauacuuug

SEQ ID NO: 110960 - RNA, 26 nt, Human
gcacagccagaacugccuuuggcccu

SEQ ID NO: 110961 - RNA, 26 nt, Human
aaaaagagcccuugaagcuggaagac

SEQ ID NO: 110962 - RNA, 26 nt, Human
uguuugaaacgauuuuaaaaaauaag

SEQ ID NO: 110963 - RNA, 21 nt, Human
cccuggucagucaagucccaa

SEQ ID NO: 110964 - RNA, 19 nt, Human
gcaaucuccccucccuccc

SEQ ID NO: 110965 - RNA, 24 nt, Human
ucuacuuccccauuucagguguga

SEQ ID NO: 110966 - RNA, 26 nt, Human
aggcacgugugcaaaccucuugacuu

SEQ ID NO: 110967 - RNA, 26 nt, Human
ucacagucuguagccaucugauaucc

SEQ ID NO: 110968 - RNA, 26 nt, Human
ucgccucccccuaucuuguccgugug

SEQ ID NO: 110969 - RNA, 21 nt, Human
ccucagccauggccucgggcg

SEQ ID NO: 110970 - RNA, 20 nt, Human
uugaccuuccgagugcagug

SEQ ID NO: 110971 - RNA, 26 nt, Human
gccuguaaucccagugacuugggagg

SEQ ID NO: 110972 - RNA, 27 nt, Human
ccacuccacuccaggugggccacucca

SEQ ID NO: 110973 - RNA, 26 nt, Human
cacacacacccuuccccacucccgug

SEQ ID NO: 110974 - RNA, 23 nt, Human
ccuggcugcugcccccaccccgg

SEQ ID NO: 110975 - RNA, 27 nt, Human
uucugaccucgccugaagccagccucu

SEQ ID NO: 110976 - RNA, 23 nt, Human
ggcaccuuaagauuuugcaccug

SEQ ID NO: 110977 - RNA, 22 nt, Human
gugugagccacagcacucggcc

SEQ ID NO: 110978 - RNA, 20 nt, Human
aaacuaagugauagaaaaua

SEQ ID NO: 110979 - RNA, 26 nt, Human
aauaaauucagccaacaugugacuaa

SEQ ID NO: 110980 - RNA, 26 nt, Human
ggaggugagagaggcacagguauuuu

SEQ ID NO: 110981 - RNA, 19 nt, Human
uuuucccaacagcccaggc

SEQ ID NO: 110982 - RNA, 21 nt, Human
ucuccccuccagccuuuggcc

SEQ ID NO: 110983 - RNA, 26 nt, Human
guucuugucuugaugugucaccgggg

SEQ ID NO: 110984 - RNA, 22 nt, Human
gcuacugcaagucuuugcguuc

SEQ ID NO: 110985 - RNA, 21 nt, Human
aauaucucaaggcaggagaug

SEQ ID NO: 110986 - RNA, 23 nt, Human
cacauuucagccacugcucugag

SEQ ID NO: 110987 - RNA, 25 nt, Human
uccuaagcuggagugcaguggcauc

SEQ ID NO: 110988 - RNA, 24 nt, Human
uccucaaggaacaaguagaccugg

SEQ ID NO: 110989 - RNA, 25 nt, Human
gccacccucucccugccaggggccu

SEQ ID NO: 110990 - RNA, 20 nt, Human
uuguggucucucuuaacuug

SEQ ID NO: 110991 - RNA, 20 nt, Human
aaauguucuguauuugcguu

SEQ ID NO: 110992 - RNA, 21 nt, Human
augagcugcaauaacaggaac

SEQ ID NO: 110993 - RNA, 26 nt, Human
uuugccuauugccuaucgccucucuc

SEQ ID NO: 110994 - RNA, 22 nt, Human
ugccuuuuucucugagugccuu

SEQ ID NO: 110995 - RNA, 21 nt, Human
auuggagucuaaacuccaccu

SEQ ID NO: 110996 - RNA, 25 nt, Human
uaggcaaagagaaaaggacccaaga

SEQ ID NO: 110997 - RNA, 23 nt, Human
cccugaguggcugagcucaggcc

SEQ ID NO: 110998 - RNA, 24 nt, Human
guaucaguaccauuugaucugcca

SEQ ID NO: 110999 - RNA, 20 nt, Human
cacgggaggaggcugugaug

SEQ ID NO: 111000 - RNA, 26 nt, Human
acaagugugucccaacacaguccugg

SEQ ID NO: 111001 - RNA, 21 nt, Human
uuucugagcccuuugucaguu

SEQ ID NO: 111002 - RNA, 26 nt, Human
gugauuaaaaccaacaaggaguuuca

SEQ ID NO: 111003 - RNA, 27 nt, Human
ccugacccccaucgcucugagcauaug

SEQ ID NO: 111004 - RNA, 20 nt, Human
ggagcaucugccuugugccu

SEQ ID NO: 111005 - RNA, 22 nt, Human
gucacccaggcuggaguacagu

SEQ ID NO: 111006 - RNA, 22 nt, Human
gucacccagacuggagugcagu

SEQ ID NO: 111007 - RNA, 25 nt, Human
cacccacacugccagccuggguugg

SEQ ID NO: 111008 - RNA, 26 nt, Human
gcgaggggaggguggcaggugaccuu

SEQ ID NO: 111009 - RNA, 22 nt, Human
cagcucgaagaccauccuggcc

SEQ ID NO: 111010 - RNA, 18 nt, Human
auuccucugcuuaauguu

SEQ ID NO: 111011 - RNA, 24 nt, Human
cucuccucugcaauguguuauucu

SEQ ID NO: 111012 - RNA, 18 nt, Human
caguugaggccaggcuag

SEQ ID NO: 111013 - RNA, 24 nt, Human
uacaaagcaucucauucauauuac

SEQ ID NO: 111014 - RNA, 18 nt, Human
gugacagcaguggagauu

SEQ ID NO: 111015 - RNA, 14 nt, Human
caagaguguggaaa

SEQ ID NO: 111016 - RNA, 22 nt, Human
ugugagguggagcuugcaguga

SEQ ID NO: 111017 - RNA, 23 nt, Human
caguuuauauacagaaaaguuug

SEQ ID NO: 111018 - RNA, 29 nt, Human
gcagaauuuucacagcaggggcucuugga

SEQ ID NO: 111019 - RNA, 21 nt, Human
gggaggcagagguuucaguga

SEQ ID NO: 111020 - RNA, 20 nt, Human
agcucuggcugguucugccc

SEQ ID NO: 111021 - RNA, 21 nt, Human
ugggcgcuguagaaugacagg

SEQ ID NO: 111022 - RNA, 24 nt, Human
ccucuuccuucccugcugugaaag

SEQ ID NO: 111023 - RNA, 26 nt, Human
ugaaccugcagauaugcgcccagaga

SEQ ID NO: 111024 - RNA, 22 nt, Human
guaucuuggcacccggaggcag

SEQ ID NO: 111025 - RNA, 24 nt, Human
ccucccauuggccucuccuugcca

SEQ ID NO: 111026 - RNA, 21 nt, Human
cacuggggccuacagcuuuga

SEQ ID NO: 111027 - RNA, 24 nt, Human
uccgugacacagaauguucugggu

SEQ ID NO: 111028 - RNA, 22 nt, Human
uuccucugcaugccagccugaa

SEQ ID NO: 111029 - RNA, 23 nt, Human
uuauauuuacauugagaauuuca

SEQ ID NO: 111030 - RNA, 22 nt, Human
gacugggucagagagcagggag

SEQ ID NO: 111031 - RNA, 27 nt, Human
acaacucuucauggugcuacaaacuuc

SEQ ID NO: 111032 - RNA, 30 nt, Human
ugaccaggaagagggagaaacuucugcuca

SEQ ID NO: 111033 - RNA, 24 nt, Human
aguuagagaauauguaugccugca

SEQ ID NO: 111034 - RNA, 23 nt, Human
cuaauguucuuacacuguguuuu

SEQ ID NO: 111035 - RNA, 23 nt, Human
aaacaaggugcauccugggguug

SEQ ID NO: 111036 - RNA, 23 nt, Human
aucacgccacugcacuauagccu

SEQ ID NO: 111037 - RNA, 25 nt, Human
aaccuauacuaaaaauuaguuccau

SEQ ID NO: 111038 - RNA, 21 nt, Human
caggccaggacucugcagccu

SEQ ID NO: 111039 - RNA, 21 nt, Human
cagcccaggccacagccaggg

SEQ ID NO: 111040 - RNA, 22 nt, Human
accuguaaucucagcacuuugg

SEQ ID NO: 111041 - RNA, 28 nt, Human
cugaggaggcggcgggguccgcaggcgu

SEQ ID NO: 111042 - RNA, 25 nt, Human
uaccuccucccuuucaucucagcaa

SEQ ID NO: 111043 - RNA, 21 nt, Human
uugcccagggccagugccaug

SEQ ID NO: 111044 - RNA, 22 nt, Human
ugaccaacgggagggcuucuca

SEQ ID NO: 111045 - RNA, 26 nt, Human
uaggaaacuagcaugggaugcacugc

SEQ ID NO: 111046 - RNA, 22 nt, Human
gggaggcggagaguacagugag

SEQ ID NO: 111047 - RNA, 23 nt, Human
gaugaaauuuuucuuugagaacu

SEQ ID NO: 111048 - RNA, 24 nt, Human
ggagagaaguuaggcagguccuag

SEQ ID NO: 111049 - RNA, 27 nt, Human
acagauggguucuggaggccccugaac

SEQ ID NO: 111050 - RNA, 22 nt, Human
aaauuuaaaaaguugauuccua

SEQ ID NO: 111051 - RNA, 22 nt, Human
agaauaagccacagcaaugguu

SEQ ID NO: 111052 - RNA, 24 nt, Human
agagggcucuagucccugguucug

SEQ ID NO: 111053 - RNA, 22 nt, Human
ccuccucccuuucucauuucca

SEQ ID NO: 111054 - RNA, 27 nt, Human
gacugaagcccaggcucacugucuacc

SEQ ID NO: 111055 - RNA, 23 nt, Human
cucggagcccagcacuccugggu

SEQ ID NO: 111056 - RNA, 27 nt, Human
ugccuguaaucccagcuacuagggagg

SEQ ID NO: 111057 - RNA, 25 nt, Human
cugacuugugugggugaggcuugca

SEQ ID NO: 111058 - RNA, 19 nt, Human
agcauuuugggauccuuca

SEQ ID NO: 111059 - RNA, 27 nt, Human
acaaaccuacagcccagaaacccagaa

SEQ ID NO: 111060 - RNA, 25 nt, Human
ggagagggagagggggcugaggagg

SEQ ID NO: 111061 - RNA, 19 nt, Human
aaaccuuugacugccugua

SEQ ID NO: 111062 - RNA, 18 nt, Human
uuuagggagagcaagcgc

SEQ ID NO: 111063 - RNA, 21 nt, Human
uguuguacaggcuggucucaa

SEQ ID NO: 111064 - RNA, 27 nt, Human
uuugccuugcuacacauuaagagggcu

SEQ ID NO: 111065 - RNA, 21 nt, Human
caguucugcaccagcagcgcc

SEQ ID NO: 111066 - RNA, 32 nt, Human
guggacaccugcccugcccugccaccugucug

SEQ ID NO: 111067 - RNA, 21 nt, Human
uuauaguaaggauacauucaa

SEQ ID NO: 111068 - RNA, 21 nt, Human
ggcagcagcaguaggacuaua

SEQ ID NO: 111069 - RNA, 22 nt, Human
ccagaucuaugaaaugggugga

SEQ ID NO: 111070 - RNA, 22 nt, Human
uccuggcuccuucacugaacau

SEQ ID NO: 111071 - RNA, 27 nt, Human
cgaaccugaagccuagaaauaucuuug

SEQ ID NO: 111072 - RNA, 23 nt, Human
agcuugaguuuuacaaguuauuu

SEQ ID NO: 111073 - RNA, 30 nt, Human
ggggagggguucguacaggagcaauaaagg

SEQ ID NO: 111074 - RNA, 24 nt, Human
ccugcuugugcggcgaugaucugu

SEQ ID NO: 111075 - RNA, 20 nt, Human
agccuccugugccucaccca

SEQ ID NO: 111076 - RNA, 22 nt, Human
auccuaacaguauaauccagcu

SEQ ID NO: 111077 - RNA, 21 nt, Human
ccccagccgcgguaaacgccg

SEQ ID NO: 111078 - RNA, 23 nt, Human
cugagaaaggagaaaaagauggg

SEQ ID NO: 111079 - RNA, 24 nt, Human
cagaaaacuggcagugcaccucuc

SEQ ID NO: 111080 - RNA, 23 nt, Human
cacuuccuggggagguagcugca

SEQ ID NO: 111081 - RNA, 25 nt, Human
agcccaggacaugagugucucucca

SEQ ID NO: 111082 - RNA, 28 nt, Human
gaucgguguuugaaaauuugccauuuca

SEQ ID NO: 111083 - RNA, 26 nt, Human
cccugccugugagccacaccuccuag

SEQ ID NO: 111084 - RNA, 24 nt, Human
auccaucguauuaaaaaacaauua

SEQ ID NO: 111085 - RNA, 26 nt, Human
cagcuaauuuuugcauuuuuacuuga

SEQ ID NO: 111086 - RNA, 23 nt, Human
gaagcguuagguauuacagcaga

SEQ ID NO: 111087 - RNA, 20 nt, Human
gcaaggaccuucuggaacau

SEQ ID NO: 111088 - RNA, 20 nt, Human
gaauacgcccagccugggug

SEQ ID NO: 111089 - RNA, 25 nt, Human
uuguuuugucaugaauucuuaugcu

SEQ ID NO: 111090 - RNA, 20 nt, Human
cuuuuagguuauucugcuuu

SEQ ID NO: 111091 - RNA, 22 nt, Human
gcagccgccuccggagcuucgg

SEQ ID NO: 111092 - RNA, 20 nt, Human
guggccuguacccaguacau

SEQ ID NO: 111093 - RNA, 21 nt, Human
gguuucuggcauuuuccacac

SEQ ID NO: 111094 - RNA, 22 nt, Human
aggcuggagugcaguggcgcgg

SEQ ID NO: 111095 - RNA, 26 nt, Human
ggaaggggccucaggagcaggaaggg

SEQ ID NO: 111096 - RNA, 26 nt, Human
ucacccaggcuggagugcaauggcac

SEQ ID NO: 111097 - RNA, 21 nt, Human
aaggucaggaguucgagacca

SEQ ID NO: 111098 - RNA, 21 nt, Human
ggcauuuuccacuaguuuuug

SEQ ID NO: 111099 - RNA, 24 nt, Human
gauugguguugccaguuguccucc

SEQ ID NO: 111100 - RNA, 21 nt, Human
augggaaagcucacuucaguu

SEQ ID NO: 111101 - RNA, 26 nt, Human
ccagccccaaccuuccaaaccuccau

SEQ ID NO: 111102 - RNA, 21 nt, Human
cugucucucuggcguuccacc

SEQ ID NO: 111103 - RNA, 20 nt, Human
gcugugcagccaucuugccu

SEQ ID NO: 111104 - RNA, 23 nt, Human
cagaggacaauugguaauuugua

SEQ ID NO: 111105 - RNA, 23 nt, Human
aagaacaucguaauaacacaugg

SEQ ID NO: 111106 - RNA, 26 nt, Human
ugaaccuaguaacaggcuuuauuuuc

SEQ ID NO: 111107 - RNA, 25 nt, Human
gagccccgagagagcucagccuugc

SEQ ID NO: 111108 - RNA, 20 nt, Human
uggguggaugcaguggucca

SEQ ID NO: 111109 - RNA, 20 nt, Human
acucacugcucacccucuuc

SEQ ID NO: 111110 - RNA, 26 nt, Human
ccuccaccuccuggguucaagcaguu

SEQ ID NO: 111111 - RNA, 20 nt, Human
aagccucacuauuacuugaa

SEQ ID NO: 111112 - RNA, 18 nt, Human
ccauagcaacacucugag

SEQ ID NO: 111113 - RNA, 19 nt, Human
gccgcgcuguuguaauacu

SEQ ID NO: 111114 - RNA, 22 nt, Human
ccaagaauggauaaauguccuu

SEQ ID NO: 111115 - RNA, 23 nt, Human
ugguggagggggaggggagaagc

SEQ ID NO: 111116 - RNA, 27 nt, Human
acgauuuuaaagaaaaaaggaagaguu

SEQ ID NO: 111117 - RNA, 13 nt, Human
aacccauccagcu

SEQ ID NO: 111118 - RNA, 31 nt, Human
cccuuggaacucuugcuaucggggaagccag

SEQ ID NO: 111119 - RNA, 24 nt, Human
gcacaggcuccuacacacaugcac

SEQ ID NO: 111120 - RNA, 22 nt, Human
uguaaacauggcugguggaaaa

SEQ ID NO: 111121 - RNA, 20 nt, Human
gcaauaaaauugacacuguc

SEQ ID NO: 111122 - RNA, 22 nt, Human
ggagaggcccucuggccgccuc

SEQ ID NO: 111123 - RNA, 26 nt, Human
acaggagcauuuggagagaaggccau

SEQ ID NO: 111124 - RNA, 27 nt, Human
accaaaauggugaaaccuccucucuac

SEQ ID NO: 111125 - RNA, 20 nt, Human
cugccggcccugcagucggu

SEQ ID NO: 111126 - RNA, 20 nt, Human
uuuguguauucuucaaccuc

SEQ ID NO: 111127 - RNA, 22 nt, Human
gugcuuggaugggcagggagaa

SEQ ID NO: 111128 - RNA, 25 nt, Human
cccuccagaagacuugccugcuagg

SEQ ID NO: 111129 - RNA, 21 nt, Human
cccaggcgcagccaaugggaa

SEQ ID NO: 111130 - RNA, 21 nt, Human
uuccuauuugcaguuacuuga

SEQ ID NO: 111131 - RNA, 22 nt, Human
caaaaaguucacagucaaaugg

SEQ ID NO: 111132 - RNA, 21 nt, Human
cacacaggcuggcugcucugg

SEQ ID NO: 111133 - RNA, 22 nt, Human
gcuaaugauaauuuagcuuuau

SEQ ID NO: 111134 - RNA, 21 nt, Human
ccccucuucccuggaaaccuu

SEQ ID NO: 111135 - RNA, 27 nt, Human
aaagugcugggauuacaggcuugagcc

SEQ ID NO: 111136 - RNA, 25 nt, Human
uguuucucacuguuccaggaaauug

SEQ ID NO: 111137 - RNA, 25 nt, Human
uuaugucuucagccacucacuuaua

SEQ ID NO: 111138 - RNA, 22 nt, Human
ggcaggcaugggguguuugggc

SEQ ID NO: 111139 - RNA, 22 nt, Human
ggcuaauuuuuguauuuuuuau

SEQ ID NO: 111140 - RNA, 19 nt, Human
ucaagcccccagcuggaag

SEQ ID NO: 111141 - RNA, 17 nt, Human
auuggaucaugcugcua

SEQ ID NO: 111142 - RNA, 27 nt, Human
uucuccaggagccuggcacugcuuccu

SEQ ID NO: 111143 - RNA, 23 nt, Human
gcagguguagggagcccagggag

SEQ ID NO: 111144 - RNA, 22 nt, Human
gaaacaauguuaacauuuuugg

SEQ ID NO: 111145 - RNA, 21 nt, Human
augauaguguuauaaauacug

SEQ ID NO: 111146 - RNA, 27 nt, Human
agguucccagagaauaucugcugguau

SEQ ID NO: 111147 - RNA, 28 nt, Human
gaucacuguugaagguguucauggcaua

SEQ ID NO: 111148 - RNA, 29 nt, Human
ggcuccuaaucuccagcuuuccugucauu

SEQ ID NO: 111149 - RNA, 22 nt, Human
cagacuucuuaaaaggagcucg

SEQ ID NO: 111150 - RNA, 28 nt, Human
caggaagaagagaugcacuauauguuua

SEQ ID NO: 111151 - RNA, 22 nt, Human
cacugcacuccagcuuggguga

SEQ ID NO: 111152 - RNA, 23 nt, Human
aacacagcuguucuucuguucug

SEQ ID NO: 111153 - RNA, 23 nt, Human
uugaagcccggcaguccuuucgg

SEQ ID NO: 111154 - RNA, 20 nt, Human
gcuaggccaucaccaaccaa

SEQ ID NO: 111155 - RNA, 22 nt, Human
aggccagccugggcaacauaac

SEQ ID NO: 111156 - RNA, 24 nt, Human
ccacauggaagacucccaggauuu

SEQ ID NO: 111157 - RNA, 24 nt, Human
ggggucagggaagugggcuuccga

SEQ ID NO: 111158 - RNA, 22 nt, Human
cccacagacucaaaguuacucu

SEQ ID NO: 111159 - RNA, 23 nt, Human
caccacgagaugggaggaggaga

SEQ ID NO: 111160 - RNA, 23 nt, Human
caggggcuggggcugaacugggg

SEQ ID NO: 111161 - RNA, 22 nt, Human
acccagucuggagugcaguggu

SEQ ID NO: 111162 - RNA, 22 nt, Human
ccuuucuccauccaaucggucc

SEQ ID NO: 111163 - RNA, 22 nt, Human
ccucuacuugcugcucugggcc

SEQ ID NO: 111164 - RNA, 26 nt, Human
gcuuguugcucccugucgucugcacc

SEQ ID NO: 111165 - RNA, 22 nt, Human
ugccauccugcauuuuuaggaa

SEQ ID NO: 111166 - RNA, 22 nt, Human
ggaaagggugaggacuucacaa

SEQ ID NO: 111167 - RNA, 26 nt, Human
uccucucgcacaagaccagcuggaac

SEQ ID NO: 111168 - RNA, 27 nt, Human
aucacuacaagcuuuuaacuuuuuaag

SEQ ID NO: 111169 - RNA, 27 nt, Human
agaggcagcagcacuugguaaaaguuu

SEQ ID NO: 111170 - RNA, 20 nt, Human
cuggcuucucccuuaagaag

SEQ ID NO: 111171 - RNA, 22 nt, Human
gcuugggcuagagaugccaagg

SEQ ID NO: 111172 - RNA, 23 nt, Human
acuggggcccaagagucugggga

SEQ ID NO: 111173 - RNA, 30 nt, Human
ugcccagugucugcccucuagaaguaggcu

SEQ ID NO: 111174 - RNA, 19 nt, Human
uucaaaugaccacuccaua

SEQ ID NO: 111175 - RNA, 21 nt, Human
cugccucccggguucaugcca

SEQ ID NO: 111176 - RNA, 24 nt, Human
ccagagaaaauuaauuauauuucu

SEQ ID NO: 111177 - RNA, 26 nt, Human
ccugcagcauggucccugccuuaggc

SEQ ID NO: 111178 - RNA, 22 nt, Human
aagcaaagcugcugcuaaccca

SEQ ID NO: 111179 - RNA, 23 nt, Human
gaacagcuuuguauguuuaugaa

SEQ ID NO: 111180 - RNA, 21 nt, Human
uguuuacaacuguuuucucuu

SEQ ID NO: 111181 - RNA, 25 nt, Human
gcaggcaagccuggccacuguuggc

SEQ ID NO: 111182 - RNA, 22 nt, Human
auccaggcuggagugcgguggu

SEQ ID NO: 111183 - RNA, 22 nt, Human
guccaggcuggagugcaguggu

SEQ ID NO: 111184 - RNA, 22 nt, Human
cagcuggaccaagggagccagu

SEQ ID NO: 111185 - RNA, 23 nt, Human
gcaccugccaacuacuugcuuuc

SEQ ID NO: 111186 - RNA, 21 nt, Human
ggucugugcagaaguggggag

SEQ ID NO: 111187 - RNA, 27 nt, Human
ucaagacgcagcaguguccaggagcgg

SEQ ID NO: 111188 - RNA, 23 nt, Human
ccagggagucagagguuucagug

SEQ ID NO: 111189 - RNA, 21 nt, Human
gggguggaaaggaagagugag

SEQ ID NO: 111190 - RNA, 21 nt, Human
gcugggccuggggaagggguu

SEQ ID NO: 111191 - RNA, 21 nt, Human
uccaucaugagaugaaugagc

SEQ ID NO: 111192 - RNA, 24 nt, Human
agagucaccuccagacaacaucug

SEQ ID NO: 111193 - RNA, 27 nt, Human
ggaggcuggaguuggggcagaggagaa

SEQ ID NO: 111194 - RNA, 24 nt, Human
cuuaaauuuagcauugcauuucag

SEQ ID NO: 111195 - RNA, 21 nt, Human
ccccauacagagaacucagcu

SEQ ID NO: 111196 - RNA, 21 nt, Human
uucauucugaaaacaacaaca

SEQ ID NO: 111197 - RNA, 23 nt, Human
cuagaaaacagcuucuuacugcu

SEQ ID NO: 111198 - RNA, 24 nt, Human
caaaauaaauguaaaaaaugagug

SEQ ID NO: 111199 - RNA, 21 nt, Human
guugcucaggcuggucucaaa

SEQ ID NO: 111200 - RNA, 26 nt, Human
guuucugcauuuccuuuaaaaauagc

SEQ ID NO: 111201 - RNA, 20 nt, Human
gagcuagggcuggagcucug

SEQ ID NO: 111202 - RNA, 23 nt, Human
uuuucuuuuuuccuaccguuuca

SEQ ID NO: 111203 - RNA, 20 nt, Human
cccaggcuggagugcaguga

SEQ ID NO: 111204 - RNA, 24 nt, Human
guugcccaauucaacagugccagc

SEQ ID NO: 111205 - RNA, 20 nt, Human
acucacugcaggcuccgccu

SEQ ID NO: 111206 - RNA, 20 nt, Human
auauuuguacaccaguguuu

SEQ ID NO: 111207 - RNA, 21 nt, Human
ugagccuucucccaugcaaag

SEQ ID NO: 111208 - RNA, 22 nt, Human
gugauagaggcuggcggaucca

SEQ ID NO: 111209 - RNA, 22 nt, Human
acuaaaauacagagucuuccag

SEQ ID NO: 111210 - RNA, 24 nt, Human
uuucagaaggagaaggaaaaagaa

SEQ ID NO: 111211 - RNA, 23 nt, Human
ggugucugguggcaggccugugc

SEQ ID NO: 111212 - RNA, 22 nt, Human
gaacuccugagcucaggcaauc

SEQ ID NO: 111213 - RNA, 21 nt, Human
cggugaggaagcccggggugg

SEQ ID NO: 111214 - RNA, 22 nt, Human
cacauuucuaauaccaccaccc

SEQ ID NO: 111215 - RNA, 19 nt, Human
gucagcaagacugaagaug

SEQ ID NO: 111216 - RNA, 22 nt, Human
ucugcagccccacuccugggcc

SEQ ID NO: 111217 - RNA, 21 nt, Human
uguucugacucucuccuggug

SEQ ID NO: 111218 - RNA, 26 nt, Human
ucuguacugguucucuucuuuugcuc

SEQ ID NO: 111219 - RNA, 20 nt, Human
agaggcggagguugcaguga

SEQ ID NO: 111220 - RNA, 22 nt, Human
acggggauuuaaacaaaggagg

SEQ ID NO: 111221 - RNA, 21 nt, Human
auccuugucugaauguauuua

SEQ ID NO: 111222 - RNA, 23 nt, Human
uugucgccccuccuuuuucugau

SEQ ID NO: 111223 - RNA, 22 nt, Human
agccuccagggcccgggcgcgu

SEQ ID NO: 111224 - RNA, 25 nt, Human
uuucaagucagcagccgcuauuacc

SEQ ID NO: 111225 - RNA, 22 nt, Human
gaucgaggcuacagugagcuau

SEQ ID NO: 111226 - RNA, 21 nt, Human
auuauagggauuuuagcaaua

SEQ ID NO: 111227 - RNA, 23 nt, Human
ccuggcacgugugccacuugccc

SEQ ID NO: 111228 - RNA, 27 nt, Human
ccugcagccgccacuccugcgccugcc

SEQ ID NO: 111229 - RNA, 19 nt, Human
agcuuaaaccuacuaccuc

SEQ ID NO: 111230 - RNA, 23 nt, Human
cccaggagguugagaaugcagug

SEQ ID NO: 111231 - RNA, 23 nt, Human
uucaaaguugccuggugaaggaa

SEQ ID NO: 111232 - RNA, 20 nt, Human
ugaagaugacuuccugagcc

SEQ ID NO: 111233 - RNA, 21 nt, Human
gcccaggcagaggagaauggg

SEQ ID NO: 111234 - RNA, 21 nt, Human
gagaacaaaauagacaaauac

SEQ ID NO: 111235 - RNA, 23 nt, Human
gcgcccgaguccacaguucugaa

SEQ ID NO: 111236 - RNA, 27 nt, Human
uccaauacccuagaagaaaacccgagg

SEQ ID NO: 111237 - RNA, 22 nt, Human
cgcuugaacucgggaggcagag

SEQ ID NO: 111238 - RNA, 27 nt, Human
aaacuauucucccgccucaaccuccca

SEQ ID NO: 111239 - RNA, 21 nt, Human
agggaaagacugaaagagaaa

SEQ ID NO: 111240 - RNA, 27 nt, Human
gaggaaagugccacugggcaagguguc

SEQ ID NO: 111241 - RNA, 22 nt, Human
ugucaccaggcuggagugcagu

SEQ ID NO: 111242 - RNA, 20 nt, Human
uggaguuguuggaaaaacau

SEQ ID NO: 111243 - RNA, 19 nt, Human
uguggauguagaaacaggc

SEQ ID NO: 111244 - RNA, 19 nt, Human
augcccaggguuugccgug

SEQ ID NO: 111245 - RNA, 27 nt, Human
gacagaaaaaugucaucauauugaaaa

SEQ ID NO: 111246 - RNA, 26 nt, Human
cugugagcuugaugcuggccagggaa

SEQ ID NO: 111247 - RNA, 25 nt, Human
ucucuacaacccucucuccucagcg

SEQ ID NO: 111248 - RNA, 21 nt, Human
cuguaugauucccagccagac

SEQ ID NO: 111249 - RNA, 22 nt, Human
aucacuugaacccgggaggcag

SEQ ID NO: 111250 - RNA, 22 nt, Human
cacugcacuauagccuagguga

SEQ ID NO: 111251 - RNA, 28 nt, Human
cuccacagccucuccaaguucagaguga

SEQ ID NO: 111252 - RNA, 21 nt, Human
cugccguuuuuaaauacuacc

SEQ ID NO: 111253 - RNA, 21 nt, Human
aaccucauucuuugucugaga

SEQ ID NO: 111254 - RNA, 27 nt, Human
uuccuaagccuugggacagcugggaac

SEQ ID NO: 111255 - RNA, 23 nt, Human
ccagaagaccaaaaagugcucug

SEQ ID NO: 111256 - RNA, 31 nt, Human
ugguggagggaggcaguggggagaaaggucu

SEQ ID NO: 111257 - RNA, 21 nt, Human
aagugcuaggauuacaggcgu

SEQ ID NO: 111258 - RNA, 20 nt, Human
gcagaucacgaacucauuaa

SEQ ID NO: 111259 - RNA, 19 nt, Human
gcaaagugcggagugugga

SEQ ID NO: 111260 - RNA, 20 nt, Human
cucuccaagagggcagggga

SEQ ID NO: 111261 - RNA, 25 nt, Human
caagacaccagcccauacgcugcuc

SEQ ID NO: 111262 - RNA, 20 nt, Human
acucacugcaucgggacuuu

SEQ ID NO: 111263 - RNA, 22 nt, Human
gauuacaggcgcgagccaccgc

SEQ ID NO: 111264 - RNA, 23 nt, Human
guugaggugucagagaaaaugaa

SEQ ID NO: 111265 - RNA, 18 nt, Human
caauuuacugacacuguc

SEQ ID NO: 111266 - RNA, 20 nt, Human
cuccagccauccaggagugg

SEQ ID NO: 111267 - RNA, 22 nt, Human
ccagacacugggcuaggcugca

SEQ ID NO: 111268 - RNA, 22 nt, Human
aguaugcucacuuaaauuuaca

SEQ ID NO: 111269 - RNA, 15 nt, Human
ugugggugaagggga

SEQ ID NO: 111270 - RNA, 27 nt, Human
ccuacuuccgguggugcuguggucugc

SEQ ID NO: 111271 - RNA, 21 nt, Human
gcauguuugauuauaguauua

SEQ ID NO: 111272 - RNA, 22 nt, Human
acugccuuaccccugcugcugc

SEQ ID NO: 111273 - RNA, 27 nt, Human
ggggccuuguaaaaggccaggguaaaa

SEQ ID NO: 111274 - RNA, 20 nt, Human
uugagacaaauuuccucuug

SEQ ID NO: 111275 - RNA, 22 nt, Human
aaccuccaugucucaagcugac

SEQ ID NO: 111276 - RNA, 25 nt, Human
acagccagacccagggcggccccuc

SEQ ID NO: 111277 - RNA, 23 nt, Human
cuuuugugggcauggcauuucag

SEQ ID NO: 111278 - RNA, 18 nt, Human
uuaaccucucuuugccuc

SEQ ID NO: 111279 - RNA, 21 nt, Human
aucauuucuuauaccuucuga

SEQ ID NO: 111280 - RNA, 21 nt, Human
cuucucguggguuugugccgu

SEQ ID NO: 111281 - RNA, 22 nt, Human
uauuaauccagccucugccuuu

SEQ ID NO: 111282 - RNA, 22 nt, Human
uaggaagaagacaaaugacaga

SEQ ID NO: 111283 - RNA, 24 nt, Human
gcagaaacuuggaugucacugccu

SEQ ID NO: 111284 - RNA, 27 nt, Human
acucuucugucacuaucaguguccauc

SEQ ID NO: 111285 - RNA, 28 nt, Human
aagcuguacauaaaauuagccaaaugaa

SEQ ID NO: 111286 - RNA, 25 nt, Human
aacuguuccagugucaacugccaug

SEQ ID NO: 111287 - RNA, 24 nt, Human
augcccagcuuggagugccacgug

SEQ ID NO: 111288 - RNA, 29 nt, Human
gagugauucuagagggagacuuguucuag

SEQ ID NO: 111289 - RNA, 18 nt, Human
gcagguccccagcuuugg

SEQ ID NO: 111290 - RNA, 23 nt, Human
ucuguauuagacucacacacauc

SEQ ID NO: 111291 - RNA, 25 nt, Human
gggugucugaacugaggggcaguug

SEQ ID NO: 111292 - RNA, 27 nt, Human
gagagacugagacaggagucuuccgga

SEQ ID NO: 111293 - RNA, 27 nt, Human
ucauuugaugauuuucuagaguguagu

SEQ ID NO: 111294 - RNA, 19 nt, Human
ugagaacggaagcugcaga

SEQ ID NO: 111295 - RNA, 23 nt, Human
gccagaccaggcugagugugacc

SEQ ID NO: 111296 - RNA, 22 nt, Human
ugaaauggcaacaacaacucca

SEQ ID NO: 111297 - RNA, 27 nt, Human
aaaugcacucaucucuguagaacaucu

SEQ ID NO: 111298 - RNA, 21 nt, Human
acagcagcuggugccccaccu

SEQ ID NO: 111299 - RNA, 25 nt, Human
ggccucggggaguggcuuuuccagc

SEQ ID NO: 111300 - RNA, 23 nt, Human
acacagaccuaccuggcuugcau

SEQ ID NO: 111301 - RNA, 17 nt, Human
caucuccucuccuugga

SEQ ID NO: 111302 - RNA, 18 nt, Human
cugugucuggcuguggga

SEQ ID NO: 111303 - RNA, 20 nt, Human
cuccagccugggaacuauaa

SEQ ID NO: 111304 - RNA, 20 nt, Human
aaaaugugcugugcuuccca

SEQ ID NO: 111305 - RNA, 22 nt, Human
aucagccugggcaacaugguga

SEQ ID NO: 111306 - RNA, 23 nt, Human
uuuggacuggugugcucucuuua

SEQ ID NO: 111307 - RNA, 20 nt, Human
gccugccucacccacacccg

SEQ ID NO: 111308 - RNA, 21 nt, Human
aggcugagaggucaagguugc

SEQ ID NO: 111309 - RNA, 21 nt, Human
gggagcuggggagaggaaaga

SEQ ID NO: 111310 - RNA, 26 nt, Human
cugcagcaucccucagccuguaccgg

SEQ ID NO: 111311 - RNA, 23 nt, Human
ggcucagccccaccccagggcag

SEQ ID NO: 111312 - RNA, 16 nt, Human
aaaagagacgcaguga

SEQ ID NO: 111313 - RNA, 22 nt, Human
ugaguuuaaaaaagacuuucug

SEQ ID NO: 111314 - RNA, 21 nt, Human
gcccucgggggccgaagccca

SEQ ID NO: 111315 - RNA, 23 nt, Human
caggccugaucgccccugcacga

SEQ ID NO: 111316 - RNA, 23 nt, Human
uuugucuguuccagccugcuugc

SEQ ID NO: 111317 - RNA, 21 nt, Human
cgccaaggcuggagugcagug

SEQ ID NO: 111318 - RNA, 26 nt, Human
ccugccuguucccauucuugcauggc

SEQ ID NO: 111319 - RNA, 23 nt, Human
cagccucugcucuuaucuuugua

SEQ ID NO: 111320 - RNA, 24 nt, Human
agggcugugcugagagcacuggcc

SEQ ID NO: 111321 - RNA, 22 nt, Human
uaacaccaucggugaguuucau

SEQ ID NO: 111322 - RNA, 22 nt, Human
gcgagguggguuggagacucag

SEQ ID NO: 111323 - RNA, 27 nt, Human
aauuaaccauuuuauauuugccaccua

SEQ ID NO: 111324 - RNA, 25 nt, Human
guccugucugacugaccucagggcc

SEQ ID NO: 111325 - RNA, 26 nt, Human
caggauucuaaauagacggcccaggc

SEQ ID NO: 111326 - RNA, 21 nt, Human
cgcccuuuuggcucucugacc

SEQ ID NO: 111327 - RNA, 21 nt, Human
auguuguguggaguccuggcu

SEQ ID NO: 111328 - RNA, 22 nt, Human
uuucuagcuuccauccuuucuc

SEQ ID NO: 111329 - RNA, 22 nt, Human
auuugauauuucucugucuguu

SEQ ID NO: 111330 - RNA, 20 nt, Human
cugagcugcugguucacucu

SEQ ID NO: 111331 - RNA, 19 nt, Human
auuaaaaaauacugcuuca

SEQ ID NO: 111332 - RNA, 18 nt, Human
auagagcagaacugaacu

SEQ ID NO: 111333 - RNA, 27 nt, Human
accucaaguguccugaaagcuuacauu

SEQ ID NO: 111334 - RNA, 27 nt, Human
ccuuuuucggugaccucauccaaggcc

SEQ ID NO: 111335 - RNA, 20 nt, Human
gugcuggaaugcuguauuug

SEQ ID NO: 111336 - RNA, 20 nt, Human
ucucaggcugagggaggcag

SEQ ID NO: 111337 - RNA, 20 nt, Human
gcccagcuuuugccugcacu

SEQ ID NO: 111338 - RNA, 22 nt, Human
gaaccugggaggcagagguugc

SEQ ID NO: 111339 - RNA, 22 nt, Human
gaacccgggaggcagagguugu

SEQ ID NO: 111340 - RNA, 22 nt, Human
ccaacauggugaaaccccguca

SEQ ID NO: 111341 - RNA, 32 nt, Human
uuaccgcggaggcggcugagugcagcuacagc

SEQ ID NO: 111342 - RNA, 22 nt, Human
gccaagggcuaaacaugcaugu

SEQ ID NO: 111343 - RNA, 20 nt, Human
cugugcaguugugcacagau

SEQ ID NO: 111344 - RNA, 25 nt, Human
accucaaggccagcucaaugccugg

SEQ ID NO: 111345 - RNA, 25 nt, Human
guugcagggcaguaggagugcagac

SEQ ID NO: 111346 - RNA, 20 nt, Human
uagcucccaggacuguuuua

SEQ ID NO: 111347 - RNA, 20 nt, Human
uuugggaaccugcugugaga

SEQ ID NO: 111348 - RNA, 24 nt, Human
ggcacacuccaccuucccuaguca

SEQ ID NO: 111349 - RNA, 19 nt, Human
cguuccccaguggagggag

SEQ ID NO: 111350 - RNA, 28 nt, Human
gaaccugggagaccagaguccccuuuag

SEQ ID NO: 111351 - RNA, 24 nt, Human
uggcaagagaauuugcuuaaugua

SEQ ID NO: 111352 - RNA, 23 nt, Human
acagagaugcaggggccagggaa

SEQ ID NO: 111353 - RNA, 23 nt, Human
cuucugcccccuccugauuuccc

SEQ ID NO: 111354 - RNA, 31 nt, Human
cucguuugugcuuugcgccuuccuccuccgc

SEQ ID NO: 111355 - RNA, 29 nt, Human
gaucuugugaaaacacuguauuuucgacu

SEQ ID NO: 111356 - RNA, 18 nt, Human
cugcagcuucuaggaccc

SEQ ID NO: 111357 - RNA, 18 nt, Human
ucugauuuucucuuugga

SEQ ID NO: 111358 - RNA, 20 nt, Human
gccccucucuggguggagaa

SEQ ID NO: 111359 - RNA, 20 nt, Human
ugaggggaggaguuccacag

SEQ ID NO: 111360 - RNA, 21 nt, Human
uucuauuuccccucuucugcu

SEQ ID NO: 111361 - RNA, 19 nt, Human
aaagagccuugacugucac

SEQ ID NO: 111362 - RNA, 21 nt, Human
augagguauagaaaagagaua

SEQ ID NO: 111363 - RNA, 20 nt, Human
uuagcuucccuucuggacca

SEQ ID NO: 111364 - RNA, 24 nt, Human
uguuuuauaaacugcuuucuugga

SEQ ID NO: 111365 - RNA, 22 nt, Human
gucgccaggcuggaguguagug

SEQ ID NO: 111366 - RNA, 20 nt, Human
ggcagcucaaaaugauaugu

SEQ ID NO: 111367 - RNA, 24 nt, Human
ucuccaucuggccuucauccuucu

SEQ ID NO: 111368 - RNA, 16 nt, Human
cccagccccagaucug

SEQ ID NO: 111369 - RNA, 19 nt, Human
uuuuaaauuaugcuuucua

SEQ ID NO: 111370 - RNA, 23 nt, Human
aaaugaacauauguuugcuuaua

SEQ ID NO: 111371 - RNA, 23 nt, Human
aggcccagccuguguggcccugu

SEQ ID NO: 111372 - RNA, 24 nt, Human
ucucuagcuugcggccugugucua

SEQ ID NO: 111373 - RNA, 22 nt, Human
gagcucaggaguucgagaccag

SEQ ID NO: 111374 - RNA, 24 nt, Human
cagucucuuaggcuuccuucucau

SEQ ID NO: 111375 - RNA, 19 nt, Human
ggagaauuucucuuuugga

SEQ ID NO: 111376 - RNA, 21 nt, Human
cugaggcccacaggucuguca

SEQ ID NO: 111377 - RNA, 21 nt, Human
acugcaaccuccaccuccggg

SEQ ID NO: 111378 - RNA, 31 nt, Human
ucugccagugcucucugggccuggcucccag

SEQ ID NO: 111379 - RNA, 22 nt, Human
ucaggggagaauggaguacugu

SEQ ID NO: 111380 - RNA, 27 nt, Human
ucccucggggcccugaugcguggcggc

SEQ ID NO: 111381 - RNA, 23 nt, Human
cugagaauucacauuucccacug

SEQ ID NO: 111382 - RNA, 20 nt, Human
aaugccacuuuucuguuccu

SEQ ID NO: 111383 - RNA, 26 nt, Human
aacuacugccagaggaaguuuguuuu

SEQ ID NO: 111384 - RNA, 25 nt, Human
cugcccccugguggacaguccuggg

SEQ ID NO: 111385 - RNA, 22 nt, Human
ucccugccuaaggcccaaguca

SEQ ID NO: 111386 - RNA, 22 nt, Human
cuuccacccugcucgugcugcc

SEQ ID NO: 111387 - RNA, 21 nt, Human
uucucugcuccuuauucccag

SEQ ID NO: 111388 - RNA, 20 nt, Human
aacuaagaggaagacuugca

SEQ ID NO: 111389 - RNA, 24 nt, Human
ucaaagugaauuugauuuguacuu

SEQ ID NO: 111390 - RNA, 18 nt, Human
agagacacccggcaccca

SEQ ID NO: 111391 - RNA, 27 nt, Human
cagucucucgagguggccaguguggug

SEQ ID NO: 111392 - RNA, 22 nt, Human
uauuugcuuuugcuugcacuga

SEQ ID NO: 111393 - RNA, 21 nt, Human
gcagggcucacaggagacagg

SEQ ID NO: 111394 - RNA, 23 nt, Human
aauaguuaacauucaaaaaacuu

SEQ ID NO: 111395 - RNA, 26 nt, Human
uccauccuggaugaaagagccagacu

SEQ ID NO: 111396 - RNA, 22 nt, Human
ggcugucccugagggccugugu

SEQ ID NO: 111397 - RNA, 21 nt, Human
augccauccugacacacuuua

SEQ ID NO: 111398 - RNA, 18 nt, Human
augugaaaacucccacug

SEQ ID NO: 111399 - RNA, 23 nt, Human
cccugcucccuccuuccucaucc

SEQ ID NO: 111400 - RNA, 29 nt, Human
uacuuaaggcacuauggcacuuagcuuug

SEQ ID NO: 111401 - RNA, 26 nt, Human
cucagaucugaucaagaguccggauu

SEQ ID NO: 111402 - RNA, 22 nt, Human
cugccuggccagggccgggggc

SEQ ID NO: 111403 - RNA, 21 nt, Human
uuugauuuguaaauuuacuua

SEQ ID NO: 111404 - RNA, 18 nt, Human
agcucccugcuaguuugc

SEQ ID NO: 111405 - RNA, 26 nt, Human
ugcuaucucuauuauuggaaaggacc

SEQ ID NO: 111406 - RNA, 24 nt, Human
ugugcacgguggacccagacacau

SEQ ID NO: 111407 - RNA, 27 nt, Human
uguagauuuaccauggcuggacucuua

SEQ ID NO: 111408 - RNA, 20 nt, Human
uuucccgggggccuuuggaa

SEQ ID NO: 111409 - RNA, 24 nt, Human
cggucgggaguucucuccaggcgg

SEQ ID NO: 111410 - RNA, 20 nt, Human
uauauuuggcuuauauucua

SEQ ID NO: 111411 - RNA, 22 nt, Human
ucaggcugauugucuuuuauca

SEQ ID NO: 111412 - RNA, 23 nt, Human
auucuaauuuugcuauugaggua

SEQ ID NO: 111413 - RNA, 23 nt, Human
ugccuguaauuccagcugcuugg

SEQ ID NO: 111414 - RNA, 26 nt, Human
cccuucuccaccuccaaaggcccuaa

SEQ ID NO: 111415 - RNA, 23 nt, Human
ggcugucagucugcuuaagggaa

SEQ ID NO: 111416 - RNA, 27 nt, Human
gcugggauuacaccaccaugcccagcu

SEQ ID NO: 111417 - RNA, 21 nt, Human
ucucugagcgguuggugccgg

SEQ ID NO: 111418 - RNA, 25 nt, Human
auaccuuucuguucaacuuguauca

SEQ ID NO: 111419 - RNA, 23 nt, Human
ccacacuggcccugcagugaugc

SEQ ID NO: 111420 - RNA, 20 nt, Human
ugggcaguuagccagcccac

SEQ ID NO: 111421 - RNA, 17 nt, Human
gucuuggccacuccuag

SEQ ID NO: 111422 - RNA, 26 nt, Human
ggggagguagagcacugaugggugaa

SEQ ID NO: 111423 - RNA, 26 nt, Human
uccuguuccuccuuugcggcggcaug

SEQ ID NO: 111424 - RNA, 26 nt, Human
ccucacagcauggcccuuggcucuuc

SEQ ID NO: 111425 - RNA, 22 nt, Human
ugccuccaggguucaagcgauu

SEQ ID NO: 111426 - RNA, 23 nt, Human
cagagggagcgccuggcagcagc

SEQ ID NO: 111427 - RNA, 20 nt, Human
gugguaaagaaucuaccuca

SEQ ID NO: 111428 - RNA, 25 nt, Human
cucauguucacaccuaucuuucuca

SEQ ID NO: 111429 - RNA, 24 nt, Human
ccugaagucccgggugaagccucu

SEQ ID NO: 111430 - RNA, 26 nt, Human
cuccaccccucccuaucucaccugcc

SEQ ID NO: 111431 - RNA, 21 nt, Human
cuugauaaguuaugugcugcc

SEQ ID NO: 111432 - RNA, 23 nt, Human
gccugcaagccugucugagacuc

SEQ ID NO: 111433 - RNA, 24 nt, Human
ggcucaaggcauccucccaccuca

SEQ ID NO: 111434 - RNA, 25 nt, Human
ucccaugggggcuccagacauugua

SEQ ID NO: 111435 - RNA, 23 nt, Human
ggacccacucucugccuucacag

SEQ ID NO: 111436 - RNA, 21 nt, Human
caagaucaugcuuuuuauuau

SEQ ID NO: 111437 - RNA, 24 nt, Human
gcaaaacccucaucagcauuacaa

SEQ ID NO: 111438 - RNA, 26 nt, Human
ucugucuccuaagcuggagugcagug

SEQ ID NO: 111439 - RNA, 23 nt, Human
cuuucuuccugucacccugagga

SEQ ID NO: 111440 - RNA, 25 nt, Human
cuggguuuaugcaguuuucuuuuua

SEQ ID NO: 111441 - RNA, 22 nt, Human
agccccagccaguuuacuccag

SEQ ID NO: 111442 - RNA, 22 nt, Human
cucuugaauccaggaggcagag

SEQ ID NO: 111443 - RNA, 23 nt, Human
ggaaggccgaggcaggaggauca

SEQ ID NO: 111444 - RNA, 26 nt, Human
uuguaaccuuccaauuccugaucacc

SEQ ID NO: 111445 - RNA, 23 nt, Human
cuccucuguggucuugcccagua

SEQ ID NO: 111446 - RNA, 24 nt, Human
cuggucuucucacacuuucucuga

SEQ ID NO: 111447 - RNA, 19 nt, Human
aauuauauucacuacuuuu

SEQ ID NO: 111448 - RNA, 21 nt, Human
ugugaagccaucugcgccaag

SEQ ID NO: 111449 - RNA, 22 nt, Human
gucacauuuacaacuggaaaag

SEQ ID NO: 111450 - RNA, 20 nt, Human
auuccucuuggguucuugaa

SEQ ID NO: 111451 - RNA, 17 nt, Human
agggcccugccugcugc

SEQ ID NO: 111452 - RNA, 25 nt, Human
ccacccauuccccugccccuaggag

SEQ ID NO: 111453 - RNA, 25 nt, Human
ccugccugcuugcuucucuggcugc

SEQ ID NO: 111454 - RNA, 22 nt, Human
gccuuguuucuccccagaggcc

SEQ ID NO: 111455 - RNA, 21 nt, Human
uuucagugcugugucauucca

SEQ ID NO: 111456 - RNA, 22 nt, Human
gaacuccugggcucaagggauc

SEQ ID NO: 111457 - RNA, 22 nt, Human
uugaucugcaugucuguuuaca

SEQ ID NO: 111458 - RNA, 22 nt, Human
gagagguugagucucaaagugu

SEQ ID NO: 111459 - RNA, 25 nt, Human
uggugacaugugccuguaaucccag

SEQ ID NO: 111460 - RNA, 24 nt, Human
uagaaaugcucaaaagugcauaug

SEQ ID NO: 111461 - RNA, 25 nt, Human
uucuguauuccuguaaguauucugg

SEQ ID NO: 111462 - RNA, 23 nt, Human
ccugggggccaagccucacccug

SEQ ID NO: 111463 - RNA, 20 nt, Human
ggaggggggacggagaggaa

SEQ ID NO: 111464 - RNA, 23 nt, Human
agcggggagcccgggaggcggcc

SEQ ID NO: 111465 - RNA, 20 nt, Human
gccugugguuacagugcaga

SEQ ID NO: 111466 - RNA, 20 nt, Human
gcacaaauacuccgcaagag

SEQ ID NO: 111467 - RNA, 23 nt, Human
caguauugacuuucucuuacuug

SEQ ID NO: 111468 - RNA, 24 nt, Human
cugcugcaaacuucaauuggucac

SEQ ID NO: 111469 - RNA, 26 nt, Human
ggcuguaggcacuugggcugacugcc

SEQ ID NO: 111470 - RNA, 26 nt, Human
auccuguuuguaucauagcacugguc

SEQ ID NO: 111471 - RNA, 22 nt, Human
ccaagcccaaggcccagccugg

SEQ ID NO: 111472 - RNA, 22 nt, Human
ggcuauauacauggcuuuagua

SEQ ID NO: 111473 - RNA, 26 nt, Human
ccuccuggcccugccucuauuuauug

SEQ ID NO: 111474 - RNA, 25 nt, Human
uggcuuccgucuccuccaguggagg

SEQ ID NO: 111475 - RNA, 22 nt, Human
ugcaaaauguuaugugaaacaa

SEQ ID NO: 111476 - RNA, 20 nt, Human
caucuccagccugauccucu

SEQ ID NO: 111477 - RNA, 19 nt, Human
cacaucccaggcagugccg

SEQ ID NO: 111478 - RNA, 23 nt, Human
agucaucaacacuuugccaauua

SEQ ID NO: 111479 - RNA, 25 nt, Human
ugcaagaaacaggugcuuaacacua

SEQ ID NO: 111480 - RNA, 17 nt, Human
ggcccagacccaccucg

SEQ ID NO: 111481 - RNA, 26 nt, Human
ggguucuguugagaauuaagagcuaa

SEQ ID NO: 111482 - RNA, 26 nt, Human
agcccaaaguuccugcucugggcucu

SEQ ID NO: 111483 - RNA, 23 nt, Human
cccugcuccucucccagagggca

SEQ ID NO: 111484 - RNA, 20 nt, Human
agcccuuccaggcaugaucu

SEQ ID NO: 111485 - RNA, 23 nt, Human
cugugcuuuucccccuuguaacc

SEQ ID NO: 111486 - RNA, 17 nt, Human
uugagcagaaacaguga

SEQ ID NO: 111487 - RNA, 26 nt, Human
ccuuucucuacccccucgcuguugug

SEQ ID NO: 111488 - RNA, 21 nt, Human
ggggguccuuccagccugagg

SEQ ID NO: 111489 - RNA, 18 nt, Human
agugugcaaauggcagcu

SEQ ID NO: 111490 - RNA, 26 nt, Human
ggagagggauggaaauaacggguggc

SEQ ID NO: 111491 - RNA, 23 nt, Human
ggcacggaauggcuagugugaga

SEQ ID NO: 111492 - RNA, 25 nt, Human
uugacccaaguggauauuuucuuaa

SEQ ID NO: 111493 - RNA, 24 nt, Human
ggcaucuaucugugcuagguuaaa

SEQ ID NO: 111494 - RNA, 27 nt, Human
ugggcaacauggcaagacccugucucu

SEQ ID NO: 111495 - RNA, 21 nt, Human
gguagcugggauuacaagcac

SEQ ID NO: 111496 - RNA, 23 nt, Human
gagcuccauuucuggaaagccuu

SEQ ID NO: 111497 - RNA, 22 nt, Human
guugcccugacuggaguucagu

SEQ ID NO: 111498 - RNA, 22 nt, Human
aaauguccccucacugcagauc

SEQ ID NO: 111499 - RNA, 26 nt, Human
ccagucaggacuuuugcuauugcaaa

SEQ ID NO: 111500 - RNA, 23 nt, Human
uuuucucuggcuaauaaaggccu

SEQ ID NO: 111501 - RNA, 22 nt, Human
ugaacuccuagacucaagugau

SEQ ID NO: 111502 - RNA, 25 nt, Human
acccaggcuggagugcaguggcacc

SEQ ID NO: 111503 - RNA, 26 nt, Human
cugccucugaccagucuguuccgggg

SEQ ID NO: 111504 - RNA, 23 nt, Human
gucuugaacuccugaccucguga

SEQ ID NO: 111505 - RNA, 25 nt, Human
cugccucucuugagcacuucccugg

SEQ ID NO: 111506 - RNA, 23 nt, Human
ucagcguccugccccuucaccuu

SEQ ID NO: 111507 - RNA, 24 nt, Human
uuccuuuaauuuaaguggccacau

SEQ ID NO: 111508 - RNA, 28 nt, Human
gggaggucgucacuggggugggagaaga

SEQ ID NO: 111509 - RNA, 22 nt, Human
uuugacacaauuggaauugucu

SEQ ID NO: 111510 - RNA, 27 nt, Human
cuuacuuccuagucuaccugaggcugc

SEQ ID NO: 111511 - RNA, 21 nt, Human
cacaggaggguucagcuuugg

SEQ ID NO: 111512 - RNA, 28 nt, Human
gcauaaaauccuaaaacagacuucugua

SEQ ID NO: 111513 - RNA, 25 nt, Human
ccugccugcccuccagacugucugc

SEQ ID NO: 111514 - RNA, 25 nt, Human
cccccaucauccucuggcuuggcca

SEQ ID NO: 111515 - RNA, 19 nt, Human
ccuugcuguaucccuguug

SEQ ID NO: 111516 - RNA, 19 nt, Human
agcuguggagugcaggcca

SEQ ID NO: 111517 - RNA, 25 nt, Human
ccuccugccccuuccuucugccagg

SEQ ID NO: 111518 - RNA, 21 nt, Human
uuuacugaagcgucucugaca

SEQ ID NO: 111519 - RNA, 19 nt, Human
ugccuggaaauagccugag

SEQ ID NO: 111520 - RNA, 27 nt, Human
ugggcauuggguaagggacuccagaag

SEQ ID NO: 111521 - RNA, 22 nt, Human
aaucauggucauuccauggaga

SEQ ID NO: 111522 - RNA, 25 nt, Human
auuucuaccacaccuuugaacaaug

SEQ ID NO: 111523 - RNA, 23 nt, Human
cagggguugugggggcagagggg

SEQ ID NO: 111524 - RNA, 19 nt, Human
auuuuuccucuucacuggc

SEQ ID NO: 111525 - RNA, 20 nt, Human
ccagggccccaccaaucugu

SEQ ID NO: 111526 - RNA, 17 nt, Human
gcccuaaaaaugccagc

SEQ ID NO: 111527 - RNA, 27 nt, Human
agagacacuugcuuuccagggcagcac

SEQ ID NO: 111528 - RNA, 19 nt, Human
acgagcucaucaucaccga

SEQ ID NO: 111529 - RNA, 16 nt, Human
cauucaucucauucca

SEQ ID NO: 111530 - RNA, 22 nt, Human
ugaaugggccuuagugccucag

SEQ ID NO: 111531 - RNA, 27 nt, Human
gcagccuuugcuucuguguauuuugga

SEQ ID NO: 111532 - RNA, 20 nt, Human
gcagucagagcaucaugcuu

SEQ ID NO: 111533 - RNA, 29 nt, Human
gccucggccucucugucaugcugggaagu

SEQ ID NO: 111534 - RNA, 21 nt, Human
uuccugcccuuccucaguuua

SEQ ID NO: 111535 - RNA, 25 nt, Human
ucuaagauauauauuuacuaaaaga

SEQ ID NO: 111536 - RNA, 23 nt, Human
cacccaggcugugaccucagcug

SEQ ID NO: 111537 - RNA, 22 nt, Human
acaaagcuugcaaaauauuuua

SEQ ID NO: 111538 - RNA, 24 nt, Human
uuuccaaaccaucagcugcuuuua

SEQ ID NO: 111539 - RNA, 25 nt, Human
caaauguuuuuauaucaacauccuu

SEQ ID NO: 111540 - RNA, 19 nt, Human
gcauagccacaaaacagaa

SEQ ID NO: 111541 - RNA, 23 nt, Human
uucuucagccaccucucuuuuuc

SEQ ID NO: 111542 - RNA, 21 nt, Human
ggggaaguaggaauguggaaa

SEQ ID NO: 111543 - RNA, 21 nt, Human
gccuuugcugugaacugcagu

SEQ ID NO: 111544 - RNA, 21 nt, Human
aagagagagaugucccagaga

SEQ ID NO: 111545 - RNA, 21 nt, Human
gcucccuuuuuggguaaacca

SEQ ID NO: 111546 - RNA, 26 nt, Human
acuggcagacuguguaaaauguaaug

SEQ ID NO: 111547 - RNA, 22 nt, Human
uucuggccccagacacagggua

SEQ ID NO: 111548 - RNA, 22 nt, Human
uagccacccauccuuugccuua

SEQ ID NO: 111549 - RNA, 26 nt, Human
ggcaucaaauagauuagugugugaga

SEQ ID NO: 111550 - RNA, 23 nt, Human
cuuuucaguauaugauggguauu

SEQ ID NO: 111551 - RNA, 21 nt, Human
caugcuaaccuguaaucccag

SEQ ID NO: 111552 - RNA, 23 nt, Human
uucuuucagagaaaaacuggaaa

SEQ ID NO: 111553 - RNA, 21 nt, Human
ccaugauguagugccucuuuc

SEQ ID NO: 111554 - RNA, 22 nt, Human
gggagggcuuuccugugcugac

SEQ ID NO: 111555 - RNA, 22 nt, Human
cauuaucauuguuaaacuuugu

SEQ ID NO: 111556 - RNA, 26 nt, Human
ccagcgcuggcccugccuccgccugc

SEQ ID NO: 111557 - RNA, 23 nt, Human
ggcacgcgcuacacccuuuugcu

SEQ ID NO: 111558 - RNA, 20 nt, Human
ugccccuccccuuuuuguaa

SEQ ID NO: 111559 - RNA, 27 nt, Human
cuccugaccuugugaucugcccgccuc

SEQ ID NO: 111560 - RNA, 24 nt, Human
uaaagcaaaucugcauaaauggua

SEQ ID NO: 111561 - RNA, 23 nt, Human
aggccuggucaggcucuccaggu

SEQ ID NO: 111562 - RNA, 24 nt, Human
ggcacaaauacauuccuuuuagag

SEQ ID NO: 111563 - RNA, 23 nt, Human
ugucacccaggcuugagugcagu

SEQ ID NO: 111564 - RNA, 21 nt, Human
uucuguaauauacuguauuua

SEQ ID NO: 111565 - RNA, 21 nt, Human
ugguugaguuucacugcagca

SEQ ID NO: 111566 - RNA, 23 nt, Human
cugguaaaaagaaaaauguguau

SEQ ID NO: 111567 - RNA, 24 nt, Human
aucacuugaccccaggagacguag

SEQ ID NO: 111568 - RNA, 26 nt, Human
uacuccucaaauguugagggaagcuu

SEQ ID NO: 111569 - RNA, 26 nt, Human
guccuggcacagaagaggagucaagu

SEQ ID NO: 111570 - RNA, 21 nt, Human
aucaucccacugcauuuguuu

SEQ ID NO: 111571 - RNA, 26 nt, Human
aguuccuuuuuccuuccucuuuaucc

SEQ ID NO: 111572 - RNA, 23 nt, Human
augcagcuaagucauacauucau

SEQ ID NO: 111573 - RNA, 18 nt, Human
aacccaagaaauguaaua

SEQ ID NO: 111574 - RNA, 20 nt, Human
cccccucccugucaucaccc

SEQ ID NO: 111575 - RNA, 22 nt, Human
ccaggggccuggagacacucca

SEQ ID NO: 111576 - RNA, 22 nt, Human
aucugacagagacucggccugg

SEQ ID NO: 111577 - RNA, 21 nt, Human
gaggcuggugguugccucccg

SEQ ID NO: 111578 - RNA, 23 nt, Human
ucaggauuuagguuaggccagga

SEQ ID NO: 111579 - RNA, 25 nt, Human
ugcuauguugccaagguuguuuaca

SEQ ID NO: 111580 - RNA, 27 nt, Human
aaauguccuuucucagaggggccagcu

SEQ ID NO: 111581 - RNA, 24 nt, Human
ccuuccucccccucauugaggacu

SEQ ID NO: 111582 - RNA, 25 nt, Human
auauggucaggaagcaaggaagcga

SEQ ID NO: 111583 - RNA, 27 nt, Human
ggaagaagagugaaggccaguguuagg

SEQ ID NO: 111584 - RNA, 25 nt, Human
agcaacaaaauauuaauauugugcc

SEQ ID NO: 111585 - RNA, 27 nt, Human
gaauagcugggauuacaggugcccacc

SEQ ID NO: 111586 - RNA, 28 nt, Human
uaggaauggucuuagaacuccaagaugu

SEQ ID NO: 111587 - RNA, 21 nt, Human
cuguuaccugucuugcuccug

SEQ ID NO: 111588 - RNA, 24 nt, Human
ggauggccuggagggcaggugccc

SEQ ID NO: 111589 - RNA, 25 nt, Human
ccucuccaacuccucuuuggccauu

SEQ ID NO: 111590 - RNA, 22 nt, Human
agcauuuuuccaucugugugca

SEQ ID NO: 111591 - RNA, 22 nt, Human
agagaugcaacauacuacuuuu

SEQ ID NO: 111592 - RNA, 23 nt, Human
aguuguccaggaugcuggcuggu

SEQ ID NO: 111593 - RNA, 22 nt, Human
ggucacaaacuagcugugucaa

SEQ ID NO: 111594 - RNA, 18 nt, Human
gcauuguuuugugcucaa

SEQ ID NO: 111595 - RNA, 25 nt, Human
ugccucuccuggcccuggaaggugc

SEQ ID NO: 111596 - RNA, 21 nt, Human
acaagggcauacacucugcgc

SEQ ID NO: 111597 - RNA, 19 nt, Human
cagccguguuguagcuaau

SEQ ID NO: 111598 - RNA, 25 nt, Human
cuucacugcacuuucuuccugccuu

SEQ ID NO: 111599 - RNA, 26 nt, Human
acuaaauuggaggcuuuggaagggca

SEQ ID NO: 111600 - RNA, 26 nt, Human
uguauaaaucuaauuuauuaccaaau

SEQ ID NO: 111601 - RNA, 26 nt, Human
gaguaaaucacuggauuucuuuuguu

SEQ ID NO: 111602 - RNA, 18 nt, Human
cuucaucuuugaauucaa

SEQ ID NO: 111603 - RNA, 22 nt, Human
gggauuacaggggugagccgcu

SEQ ID NO: 111604 - RNA, 27 nt, Human
uugccaaggcuggagugcaggccgcga

SEQ ID NO: 111605 - RNA, 27 nt, Human
gggacuguggucucuccuggggcccgg

SEQ ID NO: 111606 - RNA, 27 nt, Human
uucaagccucagauuucugcucaugau

SEQ ID NO: 111607 - RNA, 21 nt, Human
ugggugugaccugacaccugc

SEQ ID NO: 111608 - RNA, 20 nt, Human
agcaguuuccuuauagcuca

SEQ ID NO: 111609 - RNA, 24 nt, Human
guuccccugggccaaacagugauu

SEQ ID NO: 111610 - RNA, 26 nt, Human
agcgguuguaucccaagcaucuuuug

SEQ ID NO: 111611 - RNA, 21 nt, Human
ccaagaauucagagaacagca

SEQ ID NO: 111612 - RNA, 20 nt, Human
ccuccucugccgccgcugcc

SEQ ID NO: 111613 - RNA, 27 nt, Human
uuguuuaagaagaaaaaugaaaccaga

SEQ ID NO: 111614 - RNA, 22 nt, Human
gggggugggacagggacucggg

SEQ ID NO: 111615 - RNA, 22 nt, Human
agccuccugaguagcuaggauu

SEQ ID NO: 111616 - RNA, 22 nt, Human
agccucccaaguagccgggauu

SEQ ID NO: 111617 - RNA, 22 nt, Human
ggccuccugaguagcugggauu

SEQ ID NO: 111618 - RNA, 20 nt, Human
caggccgccucacagccagg

SEQ ID NO: 111619 - RNA, 26 nt, Human
ggagcagcagcgccugggcaguccuc

SEQ ID NO: 111620 - RNA, 22 nt, Human
cucuuuggaacaacagcuaucu

SEQ ID NO: 111621 - RNA, 20 nt, Human
guaggguggggguggggaga

SEQ ID NO: 111622 - RNA, 22 nt, Human
gucacucaggcuggaguacagu

SEQ ID NO: 111623 - RNA, 26 nt, Human
agaccugaaacucuaccaacagccac

SEQ ID NO: 111624 - RNA, 23 nt, Human
aagagccuaguuuuuaauagcua

SEQ ID NO: 111625 - RNA, 20 nt, Human
gccacccuggaacaccagcu

SEQ ID NO: 111626 - RNA, 17 nt, Human
acagucuacacagcagg

SEQ ID NO: 111627 - RNA, 26 nt, Human
uucuuuaccucagguuuacuggacaa

SEQ ID NO: 111628 - RNA, 27 nt, Human
guggccuuugaguaugcagauuccugg

SEQ ID NO: 111629 - RNA, 26 nt, Human
ugggcaugguguucuccugcugcucc

SEQ ID NO: 111630 - RNA, 21 nt, Human
gcaaguuuuaucagcaagcaa

SEQ ID NO: 111631 - RNA, 27 nt, Human
aauuccucuuugcuuugcuuucugcuc

SEQ ID NO: 111632 - RNA, 23 nt, Human
acuguauauucuuugcuuuuagu

SEQ ID NO: 111633 - RNA, 24 nt, Human
accacgucuggcuaaucuuuuuau

SEQ ID NO: 111634 - RNA, 22 nt, Human
ggcuuggguaacagcugccuuc

SEQ ID NO: 111635 - RNA, 24 nt, Human
uagauuguaaguuauggacaugau

SEQ ID NO: 111636 - RNA, 21 nt, Human
acauuuuccuuccuccuguua

SEQ ID NO: 111637 - RNA, 22 nt, Human
uucuuucuuaucgaauuuugga

SEQ ID NO: 111638 - RNA, 21 nt, Human
uccauacauguuuuuguacuu

SEQ ID NO: 111639 - RNA, 21 nt, Human
cagaugcuaucacagacucug

SEQ ID NO: 111640 - RNA, 22 nt, Human
ggucccuuucuccacugcacug

SEQ ID NO: 111641 - RNA, 22 nt, Human
ccucucucaccucuccuacuca

SEQ ID NO: 111642 - RNA, 15 nt, Human
uggucucaaauccca

SEQ ID NO: 111643 - RNA, 23 nt, Human
uucauuucuccuuagucuccucc

SEQ ID NO: 111644 - RNA, 32 nt, Human
uggaguggcguagaguucaguguucgcagucg

SEQ ID NO: 111645 - RNA, 22 nt, Human
agaccagccuggccaucauggu

SEQ ID NO: 111646 - RNA, 22 nt, Human
cugggaggcagagguugcagug

SEQ ID NO: 111647 - RNA, 22 nt, Human
ccgggaggcagagguuguagug

SEQ ID NO: 111648 - RNA, 22 nt, Human
cuggaaggcagaaguugcagug

SEQ ID NO: 111649 - RNA, 26 nt, Human
cuucccugcacuaaagccagccugac

SEQ ID NO: 111650 - RNA, 21 nt, Human
uaagaguucuuaauuuauaac

SEQ ID NO: 111651 - RNA, 19 nt, Human
uaucuauccuggauucuga

SEQ ID NO: 111652 - RNA, 23 nt, Human
gugggcugcagaguaacaguccu

SEQ ID NO: 111653 - RNA, 22 nt, Human
acacagacacacacauguaugu

SEQ ID NO: 111654 - RNA, 27 nt, Human
gaggcagcagaacuagugccaggggug

SEQ ID NO: 111655 - RNA, 22 nt, Human
uuuccugacaccuguguccuga

SEQ ID NO: 111656 - RNA, 31 nt, Human
gcauauaggcuuggaaagugaggcagcaaug

SEQ ID NO: 111657 - RNA, 22 nt, Human
gcccugagcccucccucuucau

SEQ ID NO: 111658 - RNA, 30 nt, Human
ccccaaacucaccaccuggccguggacacc

SEQ ID NO: 111659 - RNA, 19 nt, Human
ccucucccuccaccuccuc

SEQ ID NO: 111660 - RNA, 24 nt, Human
acagauacuuucaaagugagcuga

SEQ ID NO: 111661 - RNA, 31 nt, Human
gaguguaggugaaaugaaugaauggcuugga

SEQ ID NO: 111662 - RNA, 20 nt, Human
uagcugaucagaucucucca

SEQ ID NO: 111663 - RNA, 19 nt, Human
ccuuuuucccugucuuccu

SEQ ID NO: 111664 - RNA, 22 nt, Human
uacccagacugccagagcccag

SEQ ID NO: 111665 - RNA, 25 nt, Human
ccaguuauuaggaagagcaagcuca

SEQ ID NO: 111666 - RNA, 23 nt, Human
ucgcccaggcugguuuugaacuc

SEQ ID NO: 111667 - RNA, 26 nt, Human
agagagaccguugcugcugucaugac

SEQ ID NO: 111668 - RNA, 25 nt, Human
uccaacgugguaaaccagacacaug

SEQ ID NO: 111669 - RNA, 27 nt, Human
ggccgagguaaauacagugaaguauuu

SEQ ID NO: 111670 - RNA, 24 nt, Human
cuccaggcuucaauccugccucuu

SEQ ID NO: 111671 - RNA, 23 nt, Human
guucgauuucuaccucagcagca

SEQ ID NO: 111672 - RNA, 26 nt, Human
acugguuuccccauguccucccauuc

SEQ ID NO: 111673 - RNA, 27 nt, Human
cucuggccaagccaccuccucucaugc

SEQ ID NO: 111674 - RNA, 22 nt, Human
uggaguguccguuauccugccu

SEQ ID NO: 111675 - RNA, 27 nt, Human
uuguacucugaauuucucucccuaccu

SEQ ID NO: 111676 - RNA, 22 nt, Human
gggauuucccugucucagagca

SEQ ID NO: 111677 - RNA, 23 nt, Human
ugucgcccagacuggagugcagu

SEQ ID NO: 111678 - RNA, 23 nt, Human
ugucgcccaggcuggaguacagu

SEQ ID NO: 111679 - RNA, 26 nt, Human
caugggcauuguucaagccugagugg

SEQ ID NO: 111680 - RNA, 18 nt, Human
aguaauacuuauuuuguu

SEQ ID NO: 111681 - RNA, 23 nt, Human
uugcagcucacugcugcugccuc

SEQ ID NO: 111682 - RNA, 28 nt, Human
ggggaaauggguaugagagacugaggcu

SEQ ID NO: 111683 - RNA, 29 nt, Human
uauagcugagcgguugaaaccacagugau

SEQ ID NO: 111684 - RNA, 25 nt, Human
ugaggcccugcaccuuccccaaagg

SEQ ID NO: 111685 - RNA, 25 nt, Human
cugcccagaguccuucaggggcacc

SEQ ID NO: 111686 - RNA, 23 nt, Human
ucagugcuuuccuccuucacugu

SEQ ID NO: 111687 - RNA, 20 nt, Human
uggaagugacuaaugcugaa

SEQ ID NO: 111688 - RNA, 26 nt, Human
gggcugggaagaagcugcacuuccag

SEQ ID NO: 111689 - RNA, 24 nt, Human
ccccuggugcugggucccugcugc

SEQ ID NO: 111690 - RNA, 22 nt, Human
uucauucuguuucuacuaaccu

SEQ ID NO: 111691 - RNA, 32 nt, Human
guuacucucaccucgugauauccacaaaugcu

SEQ ID NO: 111692 - RNA, 25 nt, Human
gcuccuccccugcuacugcugacca

SEQ ID NO: 111693 - RNA, 27 nt, Human
uccucauugccagcuucagggagcugg

SEQ ID NO: 111694 - RNA, 24 nt, Human
uugcuccugcacagacauggaguc

SEQ ID NO: 111695 - RNA, 25 nt, Human
gcagagccuggcugcugggcagaag

SEQ ID NO: 111696 - RNA, 18 nt, Human
gagcagccuggggccaag

SEQ ID NO: 111697 - RNA, 22 nt, Human
cccggggagagccgggagcugc

SEQ ID NO: 111698 - RNA, 25 nt, Human
uugccucaccagcccugggcuccgc

SEQ ID NO: 111699 - RNA, 22 nt, Human
cacggucaccuucaacgcccag

SEQ ID NO: 111700 - RNA, 19 nt, Human
agucacugcagcaacgccu

SEQ ID NO: 111701 - RNA, 23 nt, Human
auuaggauaguuagcaugcacau

SEQ ID NO: 111702 - RNA, 24 nt, Human
cccaguaaauauaauuucauuaac

SEQ ID NO: 111703 - RNA, 24 nt, Human
uucaaagcuccucggcuaugcuaa

SEQ ID NO: 111704 - RNA, 22 nt, Human
agcuaauuuuuguauuuuuagu

SEQ ID NO: 111705 - RNA, 26 nt, Human
gggcucagguuggguuagagagcugg

SEQ ID NO: 111706 - RNA, 24 nt, Human
cagagcccuggcuuugaccugcuc

SEQ ID NO: 111707 - RNA, 23 nt, Human
gaucuauuggcauauucgggagc

SEQ ID NO: 111708 - RNA, 24 nt, Human
gcuccucccucguucuccaccugc

SEQ ID NO: 111709 - RNA, 23 nt, Human
ccucagccccuggccuggcugag

SEQ ID NO: 111710 - RNA, 26 nt, Human
gguggagggauugaucggagagggca

SEQ ID NO: 111711 - RNA, 21 nt, Human
cgacagugucaggaucgcggg

SEQ ID NO: 111712 - RNA, 19 nt, Human
agggagaccccgccuagca

SEQ ID NO: 111713 - RNA, 23 nt, Human
ggauagagacuggaacacuagac

SEQ ID NO: 111714 - RNA, 24 nt, Human
cagaucugaaggacauuugggaga

SEQ ID NO: 111715 - RNA, 23 nt, Human
uucuccugccuaauuuugaacua

SEQ ID NO: 111716 - RNA, 27 nt, Human
cugacauugaauagaaaacagcucccu

SEQ ID NO: 111717 - RNA, 18 nt, Human
ugucccuuacagugguca

SEQ ID NO: 111718 - RNA, 27 nt, Human
ugcuagauuggaguggggaaguguguc

SEQ ID NO: 111719 - RNA, 22 nt, Human
ugcagugagccgacaucaugcc

SEQ ID NO: 111720 - RNA, 22 nt, Human
uuuucuccaacagaaaguggau

SEQ ID NO: 111721 - RNA, 22 nt, Human
ugccugugaucccagcacuuug

SEQ ID NO: 111722 - RNA, 22 nt, Human
ucacacagaauuggagugcugu

SEQ ID NO: 111723 - RNA, 22 nt, Human
gucaggaguuugaggccagccu

SEQ ID NO: 111724 - RNA, 21 nt, Human
ggauuuuaguaagugugucuu

SEQ ID NO: 111725 - RNA, 27 nt, Human
aagcauucaaaaugagcaaugcuaaug

SEQ ID NO: 111726 - RNA, 27 nt, Human
gcacccccuucuucauugcucucucca

SEQ ID NO: 111727 - RNA, 22 nt, Human
acaggaucagacccagaggcag

SEQ ID NO: 111728 - RNA, 21 nt, Human
ggccucagagccugaccugag

SEQ ID NO: 111729 - RNA, 26 nt, Human
caugcugguggcauuguuuacagcua

SEQ ID NO: 111730 - RNA, 22 nt, Human
aaacucuugggcucaagccauc

SEQ ID NO: 111731 - RNA, 22 nt, Human
agcacguggagguuagaauaga

SEQ ID NO: 111732 - RNA, 20 nt, Human
uucaguaagcacuccuuaac

SEQ ID NO: 111733 - RNA, 21 nt, Human
uauuccaggugguugcacauu

SEQ ID NO: 111734 - RNA, 21 nt, Human
ucuaaaaugugugccagaugc

SEQ ID NO: 111735 - RNA, 21 nt, Human
caacagagcuaacaccaccuu

SEQ ID NO: 111736 - RNA, 27 nt, Human
cgccacugcacuccagccuggugacag

SEQ ID NO: 111737 - RNA, 24 nt, Human
cuguuuuuauuaucaaaaaggaca

SEQ ID NO: 111738 - RNA, 27 nt, Human
uuccucuggauuccggccucuggucau

SEQ ID NO: 111739 - RNA, 26 nt, Human
agguacugaugaaaaucucuagugga

SEQ ID NO: 111740 - RNA, 22 nt, Human
gccucucucgugcuuuucuccu

SEQ ID NO: 111741 - RNA, 27 nt, Human
uguagaagucccucuauagucuaguau

SEQ ID NO: 111742 - RNA, 22 nt, Human
uccuaacccugcccuccggggg

SEQ ID NO: 111743 - RNA, 27 nt, Human
gcugaauuucaggcauuuuguucuaca

SEQ ID NO: 111744 - RNA, 20 nt, Human
ccacagugucaggcacuggg

SEQ ID NO: 111745 - RNA, 27 nt, Human
gcucaaccacuggaaaugccuccuggg

SEQ ID NO: 111746 - RNA, 26 nt, Human
gcugcgugccacaucgcuacgcccag

SEQ ID NO: 111747 - RNA, 19 nt, Human
gcauugugauguuuagggg

SEQ ID NO: 111748 - RNA, 26 nt, Human
aaauaccagagccuucaagugccaaa

SEQ ID NO: 111749 - RNA, 25 nt, Human
acugcacuccaggcugggugacaga

SEQ ID NO: 111750 - RNA, 27 nt, Human
cagguucugacaggaacagcauggauu

SEQ ID NO: 111751 - RNA, 26 nt, Human
caucuguaaacaacugggugccuucc

SEQ ID NO: 111752 - RNA, 24 nt, Human
gccuaucugcacuuccaggugccc

SEQ ID NO: 111753 - RNA, 27 nt, Human
uuauuuuuuagauuucucagucccaaa

SEQ ID NO: 111754 - RNA, 23 nt, Human
uagggaaggcucugucucuaagc

SEQ ID NO: 111755 - RNA, 21 nt, Human
cgaaggcagauggggcacuga

SEQ ID NO: 111756 - RNA, 25 nt, Human
auuauccuuuuaauuccucuuugaa

SEQ ID NO: 111757 - RNA, 21 nt, Human
cagaguguuacuguuacauca

SEQ ID NO: 111758 - RNA, 20 nt, Human
agcugucuccaaaaaugcua

SEQ ID NO: 111759 - RNA, 26 nt, Human
uacauacuucuuucaagaucuucaac

SEQ ID NO: 111760 - RNA, 22 nt, Human
uucuguguuauuuuaucuuuaa

SEQ ID NO: 111761 - RNA, 27 nt, Human
cucugcauuuuugaugaugguuuggaa

SEQ ID NO: 111762 - RNA, 22 nt, Human
uuaaaauucaaggccacaaaaa

SEQ ID NO: 111763 - RNA, 21 nt, Human
gggggugggguggggagccag

SEQ ID NO: 111764 - RNA, 22 nt, Human
uuccuuuaaaaacauuucaguu

SEQ ID NO: 111765 - RNA, 26 nt, Human
uuucuuucuuugacuccucuucugcc

SEQ ID NO: 111766 - RNA, 27 nt, Human
ugaugcacaccaccaacauucuuggca

SEQ ID NO: 111767 - RNA, 21 nt, Human
cucugccagaagauaccauuu

SEQ ID NO: 111768 - RNA, 23 nt, Human
cacugcuccuccagccccagcug

SEQ ID NO: 111769 - RNA, 21 nt, Human
aaaaccuaccaucucagugag

SEQ ID NO: 111770 - RNA, 19 nt, Human
acaucacagaugcaacuuc

SEQ ID NO: 111771 - RNA, 21 nt, Human
caaccaccugcgacgccacga

SEQ ID NO: 111772 - RNA, 26 nt, Human
agcgagugagcgagcggaggagcagc

SEQ ID NO: 111773 - RNA, 21 nt, Human
uguaguaguuucaguguuaga

SEQ ID NO: 111774 - RNA, 26 nt, Human
uguccucagauggggagggacagggu

SEQ ID NO: 111775 - RNA, 22 nt, Human
cuacagaaguacacacagauac

SEQ ID NO: 111776 - RNA, 20 nt, Human
guguccuggggaagaaagaa

SEQ ID NO: 111777 - RNA, 22 nt, Human
ccaggugggaacggcugaugug

SEQ ID NO: 111778 - RNA, 19 nt, Human
guuuucuuagucugaggcc

SEQ ID NO: 111779 - RNA, 24 nt, Human
guaguccugugaaugccacugccu

SEQ ID NO: 111780 - RNA, 22 nt, Human
ggggguggggagcugagcaggc

SEQ ID NO: 111781 - RNA, 26 nt, Human
agcgguccggguagcagcuccagggc

SEQ ID NO: 111782 - RNA, 22 nt, Human
agcuaauuuuuuaauuuuuagu

SEQ ID NO: 111783 - RNA, 20 nt, Human
agguggcaggauguccuggu

SEQ ID NO: 111784 - RNA, 22 nt, Human
gcagguggugaaggagcagguu

SEQ ID NO: 111785 - RNA, 21 nt, Human
uuucuugggacuuggagggag

SEQ ID NO: 111786 - RNA, 22 nt, Human
cgucuucuagagagcuuagugu

SEQ ID NO: 111787 - RNA, 21 nt, Human
gcugggcugugugguugacuu

SEQ ID NO: 111788 - RNA, 18 nt, Human
ccucccaggacaggcugg

SEQ ID NO: 111789 - RNA, 24 nt, Human
cuuuuagcaaccauaaaauuguca

SEQ ID NO: 111790 - RNA, 24 nt, Human
ucuccaauacuuguauuuuaugcu

SEQ ID NO: 111791 - RNA, 21 nt, Human
acuccagccuggugacagcgu

SEQ ID NO: 111792 - RNA, 22 nt, Human
gcuuuuauguaguuuaggcugg

SEQ ID NO: 111793 - RNA, 27 nt, Human
uuuucucucacauaauaugcauuugcu

SEQ ID NO: 111794 - RNA, 20 nt, Human
cucauagauucucugugggg

SEQ ID NO: 111795 - RNA, 21 nt, Human
acacagccauggacgggaagg

SEQ ID NO: 111796 - RNA, 21 nt, Human
gccaggcgugguggugugugc

SEQ ID NO: 111797 - RNA, 20 nt, Human
cacuacccggguauacucca

SEQ ID NO: 111798 - RNA, 24 nt, Human
gggugccuguaauuccagccacuc

SEQ ID NO: 111799 - RNA, 24 nt, Human
gggcgccuguaauuccagcuacuc

SEQ ID NO: 111800 - RNA, 22 nt, Human
cugucuuugguauuauaguuca

SEQ ID NO: 111801 - RNA, 24 nt, Human
cucacucccagguucaccuggcca

SEQ ID NO: 111802 - RNA, 27 nt, Human
cugcgugggcccugcacuugcugaggu

SEQ ID NO: 111803 - RNA, 29 nt, Human
ugcacuccaggcuggacgacagagcaaga

SEQ ID NO: 111804 - RNA, 24 nt, Human
ugcuuccucaagcuuuccuugccu

SEQ ID NO: 111805 - RNA, 26 nt, Human
cuggcucugcuuacacuuucucucca

SEQ ID NO: 111806 - RNA, 25 nt, Human
ugaugugaagaaauaaagaggcaga

SEQ ID NO: 111807 - RNA, 25 nt, Human
ccuggucccuuuuugaggcaguagc

SEQ ID NO: 111808 - RNA, 21 nt, Human
cacguccuucugccugggcaa

SEQ ID NO: 111809 - RNA, 25 nt, Human
ucugcccuuucccugccugaguugc

SEQ ID NO: 111810 - RNA, 21 nt, Human
aguggauaaaucagugcugcu

SEQ ID NO: 111811 - RNA, 29 nt, Human
gcacugccgagacugugcucuggccuccc

SEQ ID NO: 111812 - RNA, 22 nt, Human
caguauguuuuuaguuccccca

SEQ ID NO: 111813 - RNA, 22 nt, Human
gacuacaggcagaugggacuaa

SEQ ID NO: 111814 - RNA, 26 nt, Human
uccagccucagggccagggagccaag

SEQ ID NO: 111815 - RNA, 23 nt, Human
ccauaacaacagcuacucaaacu

SEQ ID NO: 111816 - RNA, 22 nt, Human
gcacgaccacacaggacaccca

SEQ ID NO: 111817 - RNA, 22 nt, Human
ggcagcaucugggggcagugga

SEQ ID NO: 111818 - RNA, 26 nt, Human
gagaugacacaagacacuccuaccac

SEQ ID NO: 111819 - RNA, 26 nt, Human
ccucauucuuaucuuucuucuguuuc

SEQ ID NO: 111820 - RNA, 27 nt, Human
ucccugccucuccaccugcacccugcu

SEQ ID NO: 111821 - RNA, 21 nt, Human
uucaguauuuuuaauuaucac

SEQ ID NO: 111822 - RNA, 26 nt, Human
aagccuuuugcuuuaugcuugaggga

SEQ ID NO: 111823 - RNA, 23 nt, Human
agagcagguguucucagccucac

SEQ ID NO: 111824 - RNA, 24 nt, Human
ucccuccaccccaggacgccacuc

SEQ ID NO: 111825 - RNA, 21 nt, Human
ugugcccuuauucaggaaaag

SEQ ID NO: 111826 - RNA, 25 nt, Human
uguaaguucuggggagcauuccaaa

SEQ ID NO: 111827 - RNA, 21 nt, Human
acugcugccucuccaucccuc

SEQ ID NO: 111828 - RNA, 23 nt, Human
aaauguucucaaggucucaggcu

SEQ ID NO: 111829 - RNA, 24 nt, Human
agcuucuuagcaguuccuggucug

SEQ ID NO: 111830 - RNA, 24 nt, Human
gagcuauuacuaaaggcuuugcca

SEQ ID NO: 111831 - RNA, 19 nt, Human
gcucaguuucucagucaca

SEQ ID NO: 111832 - RNA, 21 nt, Human
ggggugaggccagccuucuag

SEQ ID NO: 111833 - RNA, 21 nt, Human
uaauggcugcugucuccaguu

SEQ ID NO: 111834 - RNA, 30 nt, Human
gacaagcucaguuuucucugaaggagaagg

SEQ ID NO: 111835 - RNA, 19 nt, Human
gucccugcugagugcgcug

SEQ ID NO: 111836 - RNA, 25 nt, Human
uggugacucacaccuguaauuccag

SEQ ID NO: 111837 - RNA, 19 nt, Human
uuguaugauuaagguucuu

SEQ ID NO: 111838 - RNA, 21 nt, Human
uucugucacuugucauggucu

SEQ ID NO: 111839 - RNA, 21 nt, Human
acaggcagaguggucagggcu

SEQ ID NO: 111840 - RNA, 22 nt, Human
ccccuucuugggggccagagau

SEQ ID NO: 111841 - RNA, 21 nt, Human
gccagccugaccaacauggug

SEQ ID NO: 111842 - RNA, 23 nt, Human
gaugcagauggaccacacuuuga

SEQ ID NO: 111843 - RNA, 23 nt, Human
gagaccauuuaacaugcaacccg

SEQ ID NO: 111844 - RNA, 26 nt, Human
ccagcacuuugcuaucuacagccggg

SEQ ID NO: 111845 - RNA, 23 nt, Human
cucaucgggggcuccgggucaca

SEQ ID NO: 111846 - RNA, 19 nt, Human
ccuacuuugcuucucucca

SEQ ID NO: 111847 - RNA, 20 nt, Human
aucucuaaaccucagggugg

SEQ ID NO: 111848 - RNA, 27 nt, Human
acugccucauguggccccuuucccagu

SEQ ID NO: 111849 - RNA, 26 nt, Human
cccacauuuuuuaaaaaucauuuuau

SEQ ID NO: 111850 - RNA, 26 nt, Human
ucacacacgcacuccuucuccucaag

SEQ ID NO: 111851 - RNA, 22 nt, Human
cccuccaggucccuggugcuag

SEQ ID NO: 111852 - RNA, 20 nt, Human
ugcagugagcugagauugca

SEQ ID NO: 111853 - RNA, 28 nt, Human
aggacucaaucuacaggccagcaccuuu

SEQ ID NO: 111854 - RNA, 22 nt, Human
ggaaugcauuuccaucagugaa

SEQ ID NO: 111855 - RNA, 22 nt, Human
ugcaauuccagaaugcugggag

SEQ ID NO: 111856 - RNA, 26 nt, Human
ucugucaccuaggcuggagugcagug

SEQ ID NO: 111857 - RNA, 26 nt, Human
uuugucacccaggcuggagugcagug

SEQ ID NO: 111858 - RNA, 20 nt, Human
guuuccagcuugcauugauu

SEQ ID NO: 111859 - RNA, 27 nt, Human
ucauccagcauucuaaugccagguugc

SEQ ID NO: 111860 - RNA, 23 nt, Human
caaagcgauaggauuacaggcgu

SEQ ID NO: 111861 - RNA, 18 nt, Human
ugcaguccagccuaggca

SEQ ID NO: 111862 - RNA, 26 nt, Human
aggauugugccauugcacuccagccu

SEQ ID NO: 111863 - RNA, 18 nt, Human
ucaccggcaacaccaaga

SEQ ID NO: 111864 - RNA, 22 nt, Human
ccacugcacugcagccugagug

SEQ ID NO: 111865 - RNA, 21 nt, Human
gaguugugaccuguuuacugu

SEQ ID NO: 111866 - RNA, 22 nt, Human
ucccugccucuucucccaauca

SEQ ID NO: 111867 - RNA, 24 nt, Human
cuuggaguugugacugccggggcc

SEQ ID NO: 111868 - RNA, 23 nt, Human
ucuuucccccucuccugguuucc

SEQ ID NO: 111869 - RNA, 24 nt, Human
ccuccaggaugaggaugggggugg

SEQ ID NO: 111870 - RNA, 23 nt, Human
ucucugcagggguuuccucucca

SEQ ID NO: 111871 - RNA, 28 nt, Human
agcuggauuuaaucaucccugcccuaca

SEQ ID NO: 111872 - RNA, 27 nt, Human
gcagccaauuucacacgcgccugugug

SEQ ID NO: 111873 - RNA, 21 nt, Human
cuucugacaugugugccucag

SEQ ID NO: 111874 - RNA, 22 nt, Human
agaggggugagggauucugcuu

SEQ ID NO: 111875 - RNA, 22 nt, Human
acacagacgguucuguauaggc

SEQ ID NO: 111876 - RNA, 23 nt, Human
ggcaucagugccuucauaaucag

SEQ ID NO: 111877 - RNA, 19 nt, Human
aggguccagagagaaggga

SEQ ID NO: 111878 - RNA, 27 nt, Human
cacugcacuccagccuggggacagagc

SEQ ID NO: 111879 - RNA, 24 nt, Human
cauccagcucacucgucugcuucc

SEQ ID NO: 111880 - RNA, 21 nt, Human
uggcggguucauggccaguug

SEQ ID NO: 111881 - RNA, 25 nt, Human
ccuccaguggcugugguuguugagc

SEQ ID NO: 111882 - RNA, 23 nt, Human
ugcauuuauuuauacagugccuu

SEQ ID NO: 111883 - RNA, 19 nt, Human
aucauucuucgcuaauuug

SEQ ID NO: 111884 - RNA, 20 nt, Human
ggcucacugcaaacccgccu

SEQ ID NO: 111885 - RNA, 26 nt, Human
cucccauggcucuccccgcuucuccu

SEQ ID NO: 111886 - RNA, 26 nt, Human
uccuccucugggcacagggugugcgu

SEQ ID NO: 111887 - RNA, 24 nt, Human
accaugccaaugaaggaaguucag

SEQ ID NO: 111888 - RNA, 24 nt, Human
ggguaggcuggaguuagggacuga

SEQ ID NO: 111889 - RNA, 19 nt, Human
agccuccuguuccaccuca

SEQ ID NO: 111890 - RNA, 22 nt, Human
gccauuuuucuggggguaggau

SEQ ID NO: 111891 - RNA, 27 nt, Human
cucccugcccugcugaauccuaaagcu

SEQ ID NO: 111892 - RNA, 28 nt, Human
uguaguguggucugggcaggcagaccuu

SEQ ID NO: 111893 - RNA, 22 nt, Human
accacgcucggcuaauuuuugu

SEQ ID NO: 111894 - RNA, 22 nt, Human
ggacuguucccugaggugggag

SEQ ID NO: 111895 - RNA, 22 nt, Human
uagugcuuucagucaguggcaa

SEQ ID NO: 111896 - RNA, 26 nt, Human
caagcagaugacagagguuugaagga

SEQ ID NO: 111897 - RNA, 21 nt, Human
uuaggagggugcuaggcugca

SEQ ID NO: 111898 - RNA, 22 nt, Human
ggaaagugggcggcggagccag

SEQ ID NO: 111899 - RNA, 24 nt, Human
ccgcgccccgaggucuccgcgccc

SEQ ID NO: 111900 - RNA, 22 nt, Human
cccaccccagccaggugucccu

SEQ ID NO: 111901 - RNA, 22 nt, Human
cuggggccucuguucugcugug

SEQ ID NO: 111902 - RNA, 22 nt, Human
uggauugaagcuuagcuauuac

SEQ ID NO: 111903 - RNA, 18 nt, Human
cucauuaaaauccaaugu

SEQ ID NO: 111904 - RNA, 26 nt, Human
acuacugcauuuuaagcuuccuauuu

SEQ ID NO: 111905 - RNA, 26 nt, Human
aaacccaugaacgcuggggcugggga

SEQ ID NO: 111906 - RNA, 22 nt, Human
uuucaaaugaucuugaagauga

SEQ ID NO: 111907 - RNA, 21 nt, Human
ugaauucauugucucagugaa

SEQ ID NO: 111908 - RNA, 27 nt, Human
cuccugccucagccuccaaaguagcug

SEQ ID NO: 111909 - RNA, 27 nt, Human
ugauuguuucaaggaagugacaguucu

SEQ ID NO: 111910 - RNA, 25 nt, Human
cagggccuucagcagagucugagga

SEQ ID NO: 111911 - RNA, 25 nt, Human
ccauagaagggaacacagguuacca

SEQ ID NO: 111912 - RNA, 26 nt, Human
ucaaaccauuguggauaucuucugcc

SEQ ID NO: 111913 - RNA, 20 nt, Human
augucacauggauggcuguc

SEQ ID NO: 111914 - RNA, 27 nt, Human
ccgacacuccugggucagacuccuggg

SEQ ID NO: 111915 - RNA, 19 nt, Human
ucauagcugccuucugcgg

SEQ ID NO: 111916 - RNA, 19 nt, Human
cuucccuucuucuuggugg

SEQ ID NO: 111917 - RNA, 26 nt, Human
ccggggacucucuuccagccuccgac

SEQ ID NO: 111918 - RNA, 24 nt, Human
gugcugggaaaugcagaaaucacg

SEQ ID NO: 111919 - RNA, 21 nt, Human
gugaacaaaacccagacuuca

SEQ ID NO: 111920 - RNA, 24 nt, Human
ccaagagaaggggaagcacucgug

SEQ ID NO: 111921 - RNA, 20 nt, Human
uaccagguuucauuuugggc

SEQ ID NO: 111922 - RNA, 22 nt, Human
ggaccuaucuaggcagacccca

SEQ ID NO: 111923 - RNA, 20 nt, Human
ccuguucucugacuacgcca

SEQ ID NO: 111924 - RNA, 16 nt, Human
cauaggccgggcacag

SEQ ID NO: 111925 - RNA, 23 nt, Human
gggccgucucccuuggcccagag

SEQ ID NO: 111926 - RNA, 23 nt, Human
ccugcugcugucccagucuuggg

SEQ ID NO: 111927 - RNA, 21 nt, Human
auccuguuuuuccucucugcc

SEQ ID NO: 111928 - RNA, 27 nt, Human
agguauuucagaaggagaaggcuggag

SEQ ID NO: 111929 - RNA, 22 nt, Human
acccccacuacagcauugugcu

SEQ ID NO: 111930 - RNA, 26 nt, Human
gagagaggaggcaggagccccagggc

SEQ ID NO: 111931 - RNA, 25 nt, Human
accucaucagucaugcuccuccucc

SEQ ID NO: 111932 - RNA, 21 nt, Human
ucacccaaguuggagugcagu

SEQ ID NO: 111933 - RNA, 21 nt, Human
gcagggaaaaugcagcaggga

SEQ ID NO: 111934 - RNA, 22 nt, Human
gugucuagggcugggagccagg

SEQ ID NO: 111935 - RNA, 24 nt, Human
ccucauguucuuaauucuuagcuc

SEQ ID NO: 111936 - RNA, 22 nt, Human
auaaaaugaucagccaugugaa

SEQ ID NO: 111937 - RNA, 20 nt, Human
cccaugcuuaaauuuuauag

SEQ ID NO: 111938 - RNA, 25 nt, Human
cagauaagugaauugguaagaaaua

SEQ ID NO: 111939 - RNA, 22 nt, Human
cgcccaggcugguaugcaguca

SEQ ID NO: 111940 - RNA, 25 nt, Human
ggcccucccgaguuaaggugggccc

SEQ ID NO: 111941 - RNA, 20 nt, Human
ucaggcucacuccaccuaca

SEQ ID NO: 111942 - RNA, 21 nt, Human
aggccgggcugcgccugcugc

SEQ ID NO: 111943 - RNA, 22 nt, Human
ucuuucucccuauuagggaguu

SEQ ID NO: 111944 - RNA, 23 nt, Human
uaguacagcuuuucaggaagcuu

SEQ ID NO: 111945 - RNA, 27 nt, Human
uucaaaugacgccugauggugcugcuc

SEQ ID NO: 111946 - RNA, 22 nt, Human
cacuucccagguucaagcgauu

SEQ ID NO: 111947 - RNA, 26 nt, Human
gguucugcagcuugaguccucugguu

SEQ ID NO: 111948 - RNA, 22 nt, Human
gagucagugauaauuugcugaa

SEQ ID NO: 111949 - RNA, 22 nt, Human
ccccagccgagcccagccuagc

SEQ ID NO: 111950 - RNA, 20 nt, Human
uuucuuagagaacuaaagua

SEQ ID NO: 111951 - RNA, 15 nt, Human
gaagggcuguggaag

SEQ ID NO: 111952 - RNA, 24 nt, Human
cuuccuuccuguucuaacugccag

SEQ ID NO: 111953 - RNA, 22 nt, Human
ccaaguagcugagauuacaggc

SEQ ID NO: 111954 - RNA, 22 nt, Human
ccagguagcugggauuacaggc

SEQ ID NO: 111955 - RNA, 26 nt, Human
gagaaugcugugcuguggaugacugc

SEQ ID NO: 111956 - RNA, 27 nt, Human
gaccagccugaccaacguuaaguaacc

SEQ ID NO: 111957 - RNA, 21 nt, Human
ugguaugugggugacccugga

SEQ ID NO: 111958 - RNA, 27 nt, Human
cccaaagugcugggauuacagauguga

SEQ ID NO: 111959 - RNA, 25 nt, Human
auauguaucacauaugaugcagccu

SEQ ID NO: 111960 - RNA, 23 nt, Human
cgaguagcugggauuacaggcgc

SEQ ID NO: 111961 - RNA, 22 nt, Human
cuccagucucugccuaauuuuu

SEQ ID NO: 111962 - RNA, 25 nt, Human
agucugccuggaggccagggagcag

SEQ ID NO: 111963 - RNA, 18 nt, Human
aacugacagaugaccgca

SEQ ID NO: 111964 - RNA, 20 nt, Human
uccugguccugcaguguugc

SEQ ID NO: 111965 - RNA, 25 nt, Human
uagggauguugcuggucaagucuug

SEQ ID NO: 111966 - RNA, 21 nt, Human
uguuaauuuuuuguuuuuugu

SEQ ID NO: 111967 - RNA, 20 nt, Human
uuucucucugacuauacuua

SEQ ID NO: 111968 - RNA, 19 nt, Human
aacucacaaaguacccuua

SEQ ID NO: 111969 - RNA, 25 nt, Human
uuaagccccaacauguucagaaaag

SEQ ID NO: 111970 - RNA, 17 nt, Human
ccucuagccucuuguca

SEQ ID NO: 111971 - RNA, 24 nt, Human
aauaaauagcuagacuggugacug

SEQ ID NO: 111972 - RNA, 26 nt, Human
ucauuuuaaaaacgaggggaaaagac

SEQ ID NO: 111973 - RNA, 26 nt, Human
cagucagagcagggagccucuuccuc

SEQ ID NO: 111974 - RNA, 22 nt, Human
ccgauuagcugggaucacaggu

SEQ ID NO: 111975 - RNA, 27 nt, Human
gucucugagcgcgggaugacaggagca

SEQ ID NO: 111976 - RNA, 26 nt, Human
gcuucaacaucuucuggaaucagagg

SEQ ID NO: 111977 - RNA, 23 nt, Human
gggcgugggaggagggaggcggc

SEQ ID NO: 111978 - RNA, 23 nt, Human
aggaaguggaggcugguaaagag

SEQ ID NO: 111979 - RNA, 16 nt, Human
gauucucauacaaccg

SEQ ID NO: 111980 - RNA, 22 nt, Human
cugggcuuuucagauacucuga

SEQ ID NO: 111981 - RNA, 26 nt, Human
uucuaugccuguauuuccaacaaacu

SEQ ID NO: 111982 - RNA, 23 nt, Human
uggucucaccuauccugcccuca

SEQ ID NO: 111983 - RNA, 20 nt, Human
cacauuuucagaagccucug

SEQ ID NO: 111984 - RNA, 23 nt, Human
aguagguuuuaauaaauauuucu

SEQ ID NO: 111985 - RNA, 24 nt, Human
ccucagcugcucgcucuguggguc

SEQ ID NO: 111986 - RNA, 26 nt, Human
uuauuuuucuacuaaagaaauaagga

SEQ ID NO: 111987 - RNA, 21 nt, Human
auggaagaaugggcucaccug

SEQ ID NO: 111988 - RNA, 24 nt, Human
augagggagggaggggcauuguga

SEQ ID NO: 111989 - RNA, 19 nt, Human
aaguggagaggauccuucu

SEQ ID NO: 111990 - RNA, 20 nt, Human
uggccgcugugcugaaggag

SEQ ID NO: 111991 - RNA, 20 nt, Human
cccuucaggcccagcacugc

SEQ ID NO: 111992 - RNA, 20 nt, Human
guguguucuucaagccagcu

SEQ ID NO: 111993 - RNA, 26 nt, Human
uugugagccaccgcugccagcccaga

SEQ ID NO: 111994 - RNA, 20 nt, Human
cccaguuaaaguggggaaga

SEQ ID NO: 111995 - RNA, 21 nt, Human
gauacagcaguagacauuuua

SEQ ID NO: 111996 - RNA, 21 nt, Human
accacaagaaagugaaugaaa

SEQ ID NO: 111997 - RNA, 17 nt, Human
gccugcccucauggccc

SEQ ID NO: 111998 - RNA, 27 nt, Human
gggagugagacaggcuggguccugcca

SEQ ID NO: 111999 - RNA, 24 nt, Human
ggcagcaggaggcuagcaaagcuu

SEQ ID NO: 112000 - RNA, 22 nt, Human
ccuuucuacauuccagaagagc

SEQ ID NO: 112001 - RNA, 28 nt, Human
gagauuuugcguuugacauugugucugg

SEQ ID NO: 112002 - RNA, 24 nt, Human
caaaauacaauguuugauuuuaug

SEQ ID NO: 112003 - RNA, 22 nt, Human
cccagccgccgcccugcuccag

SEQ ID NO: 112004 - RNA, 22 nt, Human
cccugcucagugcuugggcucc

SEQ ID NO: 112005 - RNA, 22 nt, Human
ugcuugaacacaggaggcagag

SEQ ID NO: 112006 - RNA, 20 nt, Human
cuucuugcccuggggaucaa

SEQ ID NO: 112007 - RNA, 26 nt, Human
auaugcagaagggaugggugauacuu

SEQ ID NO: 112008 - RNA, 31 nt, Human
gcacucuccagccucucaccgcaaaauuaca

SEQ ID NO: 112009 - RNA, 27 nt, Human
uugcccaggcuggagugcaacggcaug

SEQ ID NO: 112010 - RNA, 21 nt, Human
gcccccuuccccuccugcccc

SEQ ID NO: 112011 - RNA, 25 nt, Human
uguucaccucaugguuguaucaguu

SEQ ID NO: 112012 - RNA, 24 nt, Human
cccuuugagccucaguuucucuag

SEQ ID NO: 112013 - RNA, 23 nt, Human
cauugacuaucaaacugaagcca

SEQ ID NO: 112014 - RNA, 22 nt, Human
cagaagcugcagcaagagguac

SEQ ID NO: 112015 - RNA, 20 nt, Human
uggaagugcauauaaaauag

SEQ ID NO: 112016 - RNA, 21 nt, Human
uuguucuuuuaaagggucagc

SEQ ID NO: 112017 - RNA, 22 nt, Human
agcucugcucccaccugauccu

SEQ ID NO: 112018 - RNA, 23 nt, Human
aacaucaccacuacuuaccucaa

SEQ ID NO: 112019 - RNA, 24 nt, Human
cuuuccagcucuccccaaagucca

SEQ ID NO: 112020 - RNA, 20 nt, Human
ggcugcugagcacugagcag

SEQ ID NO: 112021 - RNA, 21 nt, Human
ucacuguggugggauggugcc

SEQ ID NO: 112022 - RNA, 29 nt, Human
cucuagccucugcuggagugcagugagga

SEQ ID NO: 112023 - RNA, 21 nt, Human
uucauaccuugaaguaugugu

SEQ ID NO: 112024 - RNA, 24 nt, Human
ggagaauuaggaaggccauggggc

SEQ ID NO: 112025 - RNA, 19 nt, Human
ugcaaauaguuaacuuuuc

SEQ ID NO: 112026 - RNA, 27 nt, Human
gucacccaggcuggagugaucucagcu

SEQ ID NO: 112027 - RNA, 21 nt, Human
ucuguagccacccauccuuug

SEQ ID NO: 112028 - RNA, 27 nt, Human
gguuucauuuugggccuugcuaaauug

SEQ ID NO: 112029 - RNA, 25 nt, Human
auucuuuggccucuccuuggcuuua

SEQ ID NO: 112030 - RNA, 27 nt, Human
ucacccaggcuguggugcaguaagcca

SEQ ID NO: 112031 - RNA, 22 nt, Human
uggucucaaacucuuggccuca

SEQ ID NO: 112032 - RNA, 23 nt, Human
guuaucugugacagucaccagcu

SEQ ID NO: 112033 - RNA, 25 nt, Human
gcggaggcggggcgcgggggcagug

SEQ ID NO: 112034 - RNA, 19 nt, Human
agacagcaaccagaaguua

SEQ ID NO: 112035 - RNA, 26 nt, Human
augaacacagcaguucugcagaggac

SEQ ID NO: 112036 - RNA, 22 nt, Human
gggucacugcaaacuccgccuc

SEQ ID NO: 112037 - RNA, 24 nt, Human
gcuggcacccagccucccuucucc

SEQ ID NO: 112038 - RNA, 22 nt, Human
gagccagacucugucucaaaac

SEQ ID NO: 112039 - RNA, 23 nt, Human
gaggugcaggagaacagcucugu

SEQ ID NO: 112040 - RNA, 22 nt, Human
uggagcugcauuugaccugcuc

SEQ ID NO: 112041 - RNA, 26 nt, Human
cugggagccggaggcugcagugagcc

SEQ ID NO: 112042 - RNA, 22 nt, Human
ucaucccaagacugcuaauuua

SEQ ID NO: 112043 - RNA, 27 nt, Human
uugcacuagaugggccuguggucccaa

SEQ ID NO: 112044 - RNA, 20 nt, Human
caagagcagaggcuuaagga

SEQ ID NO: 112045 - RNA, 24 nt, Human
ucaaaguuacuccagagcaaccaa

SEQ ID NO: 112046 - RNA, 25 nt, Human
cccugcagaggaaugaaacuacuua

SEQ ID NO: 112047 - RNA, 19 nt, Human
gaagguugagagagaggug

SEQ ID NO: 112048 - RNA, 26 nt, Human
ugaggugaggaaggaagggguugcug

SEQ ID NO: 112049 - RNA, 20 nt, Human
cgggaggugaacagcagaga

SEQ ID NO: 112050 - RNA, 23 nt, Human
ccuaucuuccugugucuugugca

SEQ ID NO: 112051 - RNA, 26 nt, Human
gauucagagcacuugggauuguaagu

SEQ ID NO: 112052 - RNA, 27 nt, Human
ucuucugcuucagccucccgaguagcu

SEQ ID NO: 112053 - RNA, 24 nt, Human
aagcuauucaauucuuuuaacugu

SEQ ID NO: 112054 - RNA, 22 nt, Human
ugagccaagcucaucuucauug

SEQ ID NO: 112055 - RNA, 23 nt, Human
gacaaguuccaauuucuuuucaa

SEQ ID NO: 112056 - RNA, 27 nt, Human
ucagccccaacuauauaaccagguggg

SEQ ID NO: 112057 - RNA, 20 nt, Human
caacaaauaucuuguguugu

SEQ ID NO: 112058 - RNA, 22 nt, Human
aaucuggaaugcaguggcacaa

SEQ ID NO: 112059 - RNA, 22 nt, Human
cagagggaugucuguggacagu

SEQ ID NO: 112060 - RNA, 27 nt, Human
gcggugcaaucccggcucacugcagcc

SEQ ID NO: 112061 - RNA, 21 nt, Human
gucuguaaucccagcgcuuug

SEQ ID NO: 112062 - RNA, 24 nt, Human
cuagaaguggcagaacacuggauu

SEQ ID NO: 112063 - RNA, 21 nt, Human
acuucagaaccucagagcucc

SEQ ID NO: 112064 - RNA, 21 nt, Human
gcgugagccacugagccagcc

SEQ ID NO: 112065 - RNA, 21 nt, Human
cccacaccaccguccuccucg

SEQ ID NO: 112066 - RNA, 24 nt, Human
gcugggacuucuccaggccugugu

SEQ ID NO: 112067 - RNA, 24 nt, Human
gcuagaaggacucacuagacucag

SEQ ID NO: 112068 - RNA, 27 nt, Human
caaccuguuuugguagacacaccagcu

SEQ ID NO: 112069 - RNA, 21 nt, Human
ccccaccccacugucguggug

SEQ ID NO: 112070 - RNA, 21 nt, Human
cacugcacuccggccugauga

SEQ ID NO: 112071 - RNA, 20 nt, Human
ucauuuugaacccagaucug

SEQ ID NO: 112072 - RNA, 22 nt, Human
gggaggcauugguggccaagga

SEQ ID NO: 112073 - RNA, 26 nt, Human
uugcucugucucccaggcuggagugc

SEQ ID NO: 112074 - RNA, 22 nt, Human
guugggauacugcagggccagg

SEQ ID NO: 112075 - RNA, 27 nt, Human
uuuuccccuuugauuuuugaucuucgc

SEQ ID NO: 112076 - RNA, 26 nt, Human
ccaaccuccauuucuguucacuuugu

SEQ ID NO: 112077 - RNA, 26 nt, Human
gugccucacccagggccugaccccag

SEQ ID NO: 112078 - RNA, 20 nt, Human
gccuuaccagcccuagccuc

SEQ ID NO: 112079 - RNA, 25 nt, Human
ggcucuggcugggacccgaccgcug

SEQ ID NO: 112080 - RNA, 27 nt, Human
ggggaaaggauacaauuauagcuacaa

SEQ ID NO: 112081 - RNA, 21 nt, Human
gauugauggcagcugagggaa

SEQ ID NO: 112082 - RNA, 25 nt, Human
acuccaggugcucagacugccugug

SEQ ID NO: 112083 - RNA, 20 nt, Human
aagcccacagagaugagaau

SEQ ID NO: 112084 - RNA, 25 nt, Human
gcccaggcuggagugcagcagcaca

SEQ ID NO: 112085 - RNA, 24 nt, Human
uccaucuguuauauguaaaggaca

SEQ ID NO: 112086 - RNA, 24 nt, Human
cauugcacuccagcugggagacac

SEQ ID NO: 112087 - RNA, 21 nt, Human
agcacauguuacugcuucauu

SEQ ID NO: 112088 - RNA, 22 nt, Human
uaucuguggcaugauuaugcau

SEQ ID NO: 112089 - RNA, 27 nt, Human
gaauucguuucugacauaccuuagacu

SEQ ID NO: 112090 - RNA, 22 nt, Human
uuucccuuaaugauacaagucu

SEQ ID NO: 112091 - RNA, 26 nt, Human
ccuuacacuccagccuggauaacaga

SEQ ID NO: 112092 - RNA, 21 nt, Human
cccccuggcccacccuggggu

SEQ ID NO: 112093 - RNA, 20 nt, Human
ccuucccagaccaggaaagg

SEQ ID NO: 112094 - RNA, 24 nt, Human
gcuuggcacugccuuuuccuuucu

SEQ ID NO: 112095 - RNA, 25 nt, Human
auggaaagcagaaaagacaucacaa

SEQ ID NO: 112096 - RNA, 25 nt, Human
agaccuccagcauccacgcaucucu

SEQ ID NO: 112097 - RNA, 21 nt, Human
accugcaaucccagcacuuug

SEQ ID NO: 112098 - RNA, 26 nt, Human
aagcuccagagagcugccuuccacaa

SEQ ID NO: 112099 - RNA, 26 nt, Human
cccacugccucugccucccuggggca

SEQ ID NO: 112100 - RNA, 25 nt, Human
guucucuuggcugcaaauaaggaca

SEQ ID NO: 112101 - RNA, 22 nt, Human
ugaaggagaaagaagcauugug

SEQ ID NO: 112102 - RNA, 22 nt, Human
ggagcaccuggaggauguacca

SEQ ID NO: 112103 - RNA, 28 nt, Human
ggauaccacauauuaaaccauguauauc

SEQ ID NO: 112104 - RNA, 23 nt, Human
cuucuggguggcuccugccacug

SEQ ID NO: 112105 - RNA, 24 nt, Human
gcauuagcagcaccuaaguccuca

SEQ ID NO: 112106 - RNA, 23 nt, Human
aagauugaaaagggucagcuggg

SEQ ID NO: 112107 - RNA, 19 nt, Human
uacccagcaaaaaugagug

SEQ ID NO: 112108 - RNA, 22 nt, Human
uugcuaccaaagaaugcauguu

SEQ ID NO: 112109 - RNA, 21 nt, Human
cugucacccacauggucugcc

SEQ ID NO: 112110 - RNA, 27 nt, Human
gcaccagugcugucccugcacacuuug

SEQ ID NO: 112111 - RNA, 25 nt, Human
ggaggcugucagaggccgucucagc

SEQ ID NO: 112112 - RNA, 24 nt, Human
gcuuuuucucuggaccauccuggc

SEQ ID NO: 112113 - RNA, 24 nt, Human
acccaaaggagaaaaugcuaggau

SEQ ID NO: 112114 - RNA, 18 nt, Human
cccgcacuccguuucccg

SEQ ID NO: 112115 - RNA, 18 nt, Human
gugacuugauugccaagg

SEQ ID NO: 112116 - RNA, 29 nt, Human
aggguggggugugagaugggugccucccc

SEQ ID NO: 112117 - RNA, 21 nt, Human
ggaggcugcuccugauuggcu

SEQ ID NO: 112118 - RNA, 21 nt, Human
auauaugaugcucugcaaaac

SEQ ID NO: 112119 - RNA, 24 nt, Human
cgcggggaugggaggggaggaggg

SEQ ID NO: 112120 - RNA, 27 nt, Human
uccgccagccuccucuggacggcaggc

SEQ ID NO: 112121 - RNA, 22 nt, Human
gccaaggcuggacuggguuggc

SEQ ID NO: 112122 - RNA, 19 nt, Human
agggaaugccuuggaaggc

SEQ ID NO: 112123 - RNA, 27 nt, Human
ggcuggguuugggcaguggagagggga

SEQ ID NO: 112124 - RNA, 22 nt, Human
gcgcaugccuguaaucccagaa

SEQ ID NO: 112125 - RNA, 27 nt, Human
ucugccaacguagcucugccugccugu

SEQ ID NO: 112126 - RNA, 23 nt, Human
uggguagaacaaaaaguuguuaa

SEQ ID NO: 112127 - RNA, 23 nt, Human
gggaggaaggggaggcugcugca

SEQ ID NO: 112128 - RNA, 28 nt, Human
ucaggaagggaggcucaauguaaccuca

SEQ ID NO: 112129 - RNA, 20 nt, Human
ucucccaaaaaggaccaugg

SEQ ID NO: 112130 - RNA, 21 nt, Human
auaggggcggcccggagccag

SEQ ID NO: 112131 - RNA, 26 nt, Human
cacccaagccucaccuccccaccccu

SEQ ID NO: 112132 - RNA, 23 nt, Human
gacugggucugaccuggugggag

SEQ ID NO: 112133 - RNA, 20 nt, Human
cucccaggcccucaggcucc

SEQ ID NO: 112134 - RNA, 28 nt, Human
agccaggacagcuuccagccagccaggc

SEQ ID NO: 112135 - RNA, 21 nt, Human
caaaucaggggacuuccccac

SEQ ID NO: 112136 - RNA, 21 nt, Human
ggcggcagagguugcagugag

SEQ ID NO: 112137 - RNA, 20 nt, Human
uccugcugagcaagaagccg

SEQ ID NO: 112138 - RNA, 23 nt, Human
cucuccucggaagaacugcccag

SEQ ID NO: 112139 - RNA, 23 nt, Human
ccgcgucucucaggacagcaggc

SEQ ID NO: 112140 - RNA, 21 nt, Human
uuuccuccuuuccuccucuga

SEQ ID NO: 112141 - RNA, 23 nt, Human
cugcagcagagacgggcugggcu

SEQ ID NO: 112142 - RNA, 22 nt, Human
ggacugaggaggcaggggaggg

SEQ ID NO: 112143 - RNA, 21 nt, Human
ugcucacugcaaccucugccu

SEQ ID NO: 112144 - RNA, 24 nt, Human
gcccccugcccuggcacagcugca

SEQ ID NO: 112145 - RNA, 19 nt, Human
ccuacuuccuuccuguugg

SEQ ID NO: 112146 - RNA, 19 nt, Human
ugcccccaccucaguuauu

SEQ ID NO: 112147 - RNA, 19 nt, Human
aaguuguguuuuaagcagc

SEQ ID NO: 112148 - RNA, 23 nt, Human
ccagcgccaccaccguggagaac

SEQ ID NO: 112149 - RNA, 21 nt, Human
acagcaaaagcaauggacccc

SEQ ID NO: 112150 - RNA, 24 nt, Human
uucaugccccuggaccagccuuau

SEQ ID NO: 112151 - RNA, 20 nt, Human
uacugcugaccaaauuccca

SEQ ID NO: 112152 - RNA, 22 nt, Human
accacgcccggcuaauuuuugu

SEQ ID NO: 112153 - RNA, 20 nt, Human
aacuuaaguuuuuacuccau

SEQ ID NO: 112154 - RNA, 22 nt, Human
cugggggcucugggcuuguggc

SEQ ID NO: 112155 - RNA, 20 nt, Human
accgaggcuggagugcagug

SEQ ID NO: 112156 - RNA, 24 nt, Human
cuccuguccccucuccucccagcc

SEQ ID NO: 112157 - RNA, 29 nt, Human
gcacuaggcuugggguggggaggucccgu

SEQ ID NO: 112158 - RNA, 23 nt, Human
gauucugaugagguuucugggaa

SEQ ID NO: 112159 - RNA, 22 nt, Human
acugcucuucuguuuuauuuug

SEQ ID NO: 112160 - RNA, 23 nt, Human
cugcuacugcugcuaccgaggcu

SEQ ID NO: 112161 - RNA, 19 nt, Human
acacaaaaguauucaagag

SEQ ID NO: 112162 - RNA, 21 nt, Human
aaccagucaaggugguuuuag

SEQ ID NO: 112163 - RNA, 25 nt, Human
gagggggagggaggggagacagagc

SEQ ID NO: 112164 - RNA, 21 nt, Human
ugucggagaaaagcguggagg

SEQ ID NO: 112165 - RNA, 22 nt, Human
gggaggcggcggcggcggcagg

SEQ ID NO: 112166 - RNA, 23 nt, Human
agacaggagaaucgcuugaaccc

SEQ ID NO: 112167 - RNA, 25 nt, Human
cuuacauuccuagagagcagaaaua

SEQ ID NO: 112168 - RNA, 19 nt, Human
uguagugcccccucuaacc

SEQ ID NO: 112169 - RNA, 17 nt, Human
aaggcuuagugcaguga

SEQ ID NO: 112170 - RNA, 27 nt, Human
uucuuuuaaggaauaaaaacagguaaa

SEQ ID NO: 112171 - RNA, 22 nt, Human
uucagccucccaaauagcuggg

SEQ ID NO: 112172 - RNA, 26 nt, Human
gucacccaggcugccaggcuggagug

SEQ ID NO: 112173 - RNA, 25 nt, Human
cucuuccuguccacucccagccucc

SEQ ID NO: 112174 - RNA, 18 nt, Human
gggaggaacagggagaga

SEQ ID NO: 112175 - RNA, 27 nt, Human
auaguaaauacugcaacuaguagcuug

SEQ ID NO: 112176 - RNA, 20 nt, Human
caguucuggacgggcuggcc

SEQ ID NO: 112177 - RNA, 21 nt, Human
accaggcuaccaaguggaaua

SEQ ID NO: 112178 - RNA, 25 nt, Human
cugauguuuuguauuuuguguuccu

SEQ ID NO: 112179 - RNA, 19 nt, Human
guccucuggaucugcucgu

SEQ ID NO: 112180 - RNA, 21 nt, Human
guacacagaugcuacagacuu

SEQ ID NO: 112181 - RNA, 21 nt, Human
ccugaaauaaccuuucauaaa

SEQ ID NO: 112182 - RNA, 18 nt, Human
ggauguaaugcacuuugg

SEQ ID NO: 112183 - RNA, 23 nt, Human
ugucacccagucuggagugcagu

SEQ ID NO: 112184 - RNA, 22 nt, Human
cucuuuggagauaaaauucauu

SEQ ID NO: 112185 - RNA, 22 nt, Human
ucugcugucugggacuccuguc

SEQ ID NO: 112186 - RNA, 23 nt, Human
uuuggaauuuugacuggcugaau

SEQ ID NO: 112187 - RNA, 27 nt, Human
accucaaguucuuggaccaguuugcag

SEQ ID NO: 112188 - RNA, 17 nt, Human
cacuccucaaugcucaa

SEQ ID NO: 112189 - RNA, 20 nt, Human
gcgugagccacugcccagcu

SEQ ID NO: 112190 - RNA, 23 nt, Human
gcugaacugacaggccagugggg

SEQ ID NO: 112191 - RNA, 20 nt, Human
caguccaagauuaccauuuc

SEQ ID NO: 112192 - RNA, 26 nt, Human
gagucagcuggaacauaccacugccu

SEQ ID NO: 112193 - RNA, 21 nt, Human
ugaucagcuucucauguucca

SEQ ID NO: 112194 - RNA, 19 nt, Human
cuggagugcugcgggcagc

SEQ ID NO: 112195 - RNA, 22 nt, Human
gauuacaggcgugaagcaccac

SEQ ID NO: 112196 - RNA, 20 nt, Human
caccuuaaaagacagcuaga

SEQ ID NO: 112197 - RNA, 21 nt, Human
aggaagcagagggaaauggga

SEQ ID NO: 112198 - RNA, 22 nt, Human
cccagagcgaggaaaggauuuu

SEQ ID NO: 112199 - RNA, 26 nt, Human
agaacaauggcuauucaugugggaaa

SEQ ID NO: 112200 - RNA, 21 nt, Human
ccauccuuuuguuuacacauc

SEQ ID NO: 112201 - RNA, 27 nt, Human
gaacucuaagaaaaucaaccauuaauc

SEQ ID NO: 112202 - RNA, 24 nt, Human
gccucuccaccagcccccuccuca

SEQ ID NO: 112203 - RNA, 26 nt, Human
uucguuuaucauuucagaaauugcug

SEQ ID NO: 112204 - RNA, 21 nt, Human
gccagccacagguacagacca

SEQ ID NO: 112205 - RNA, 22 nt, Human
cggucaggaagcccuuccugaa

SEQ ID NO: 112206 - RNA, 23 nt, Human
gaggcacccuuccaucugauucc

SEQ ID NO: 112207 - RNA, 25 nt, Human
ucuggccguuggcccuggcuaaugu

SEQ ID NO: 112208 - RNA, 21 nt, Human
uuguugcccaggcuagcaugc

SEQ ID NO: 112209 - RNA, 19 nt, Human
cugcgauuuugccuguguc

SEQ ID NO: 112210 - RNA, 22 nt, Human
uggcucauaccuguaauccuag

SEQ ID NO: 112211 - RNA, 20 nt, Human
cuucccuuaguuaaugguua

SEQ ID NO: 112212 - RNA, 25 nt, Human
agcugucuaaaccuccuacuccuca

SEQ ID NO: 112213 - RNA, 23 nt, Human
aacaccaugguagacucuuuuug

SEQ ID NO: 112214 - RNA, 22 nt, Human
gugcccaggcuagggggcuaua

SEQ ID NO: 112215 - RNA, 21 nt, Human
ggggccugacccucagcacuu

SEQ ID NO: 112216 - RNA, 21 nt, Human
gaaagggcagaaguaggggaa

SEQ ID NO: 112217 - RNA, 25 nt, Human
ggugggagggggcagcaggcggggc

SEQ ID NO: 112218 - RNA, 26 nt, Human
aucucuaguuccccaccucaaucccg

SEQ ID NO: 112219 - RNA, 23 nt, Human
cuccccacucuguccugggugcu

SEQ ID NO: 112220 - RNA, 17 nt, Human
ccuacccuuuuccucca

SEQ ID NO: 112221 - RNA, 26 nt, Human
uccuucuguacuaaaguauuguguuu

SEQ ID NO: 112222 - RNA, 23 nt, Human
gccuguauggccccuuucaucaa

SEQ ID NO: 112223 - RNA, 22 nt, Human
ggcucacugcagccuggaccuc

SEQ ID NO: 112224 - RNA, 22 nt, Human
agcaaacgccugagugcugcug

SEQ ID NO: 112225 - RNA, 23 nt, Human
ccccucuccccucugucuugauc

SEQ ID NO: 112226 - RNA, 20 nt, Human
agccccauugggcaugauaa

SEQ ID NO: 112227 - RNA, 21 nt, Human
cuuaagagucauccagcucuu

SEQ ID NO: 112228 - RNA, 23 nt, Human
uuccugagcugucgcugccucca

SEQ ID NO: 112229 - RNA, 26 nt, Human
gugcugccagaacuaugaggguccuc

SEQ ID NO: 112230 - RNA, 22 nt, Human
gucaccuaggcuggagugcagu

SEQ ID NO: 112231 - RNA, 23 nt, Human
aacaucuucugaguaaacagggu

SEQ ID NO: 112232 - RNA, 27 nt, Human
caggcuggagugcagucgugccaucuc

SEQ ID NO: 112233 - RNA, 22 nt, Human
auugcgaaaucaagucugucaa

SEQ ID NO: 112234 - RNA, 21 nt, Human
gcccaugcuggagugcagugg

SEQ ID NO: 112235 - RNA, 21 nt, Human
guaaccucggggucugaggcc

SEQ ID NO: 112236 - RNA, 22 nt, Human
acaaucuauuuugagccacuuu

SEQ ID NO: 112237 - RNA, 27 nt, Human
uggaaugccauugauuguuccaugcac

SEQ ID NO: 112238 - RNA, 21 nt, Human
uaugccuuuugcaaaauuugg

SEQ ID NO: 112239 - RNA, 20 nt, Human
acuggcagggauaacaaaga

SEQ ID NO: 112240 - RNA, 22 nt, Human
gaaggaagaaacccggacugga

SEQ ID NO: 112241 - RNA, 22 nt, Human
cucacacaucuuugcguucucc

SEQ ID NO: 112242 - RNA, 22 nt, Human
aaccaucccuucccuuucuccc

SEQ ID NO: 112243 - RNA, 24 nt, Human
agugguuugaggauuauguguuuu

SEQ ID NO: 112244 - RNA, 22 nt, Human
gugaaguggaccaucuccgccg

SEQ ID NO: 112245 - RNA, 22 nt, Human
ucagcacucagcacagugccuu

SEQ ID NO: 112246 - RNA, 22 nt, Human
ugcaaccuccgccucuuggguu

SEQ ID NO: 112247 - RNA, 25 nt, Human
cugcuuaggaaucaaaauguuuuca

SEQ ID NO: 112248 - RNA, 19 nt, Human
cagcccagcccagccaggu

SEQ ID NO: 112249 - RNA, 18 nt, Human
ugaggcugagaagggugg

SEQ ID NO: 112250 - RNA, 21 nt, Human
ccgaacccgcggccauggccc

SEQ ID NO: 112251 - RNA, 27 nt, Human
uugaguauuacaauuuuugaacaacug

SEQ ID NO: 112252 - RNA, 20 nt, Human
ggcccuuaaccuuuaucuuu

SEQ ID NO: 112253 - RNA, 21 nt, Human
cuucucaucacucugccucag

SEQ ID NO: 112254 - RNA, 21 nt, Human
cccgcguagcuggcauacagg

SEQ ID NO: 112255 - RNA, 27 nt, Human
ccugugcagccugaugcccccucgugg

SEQ ID NO: 112256 - RNA, 19 nt, Human
auaguagaaaaugauguga

SEQ ID NO: 112257 - RNA, 26 nt, Human
gcacauuuucucuguuucucucuccg

SEQ ID NO: 112258 - RNA, 30 nt, Human
ccccgguccgggggcagccaggccucucgg

SEQ ID NO: 112259 - RNA, 22 nt, Human
cccagaggcuacucuugacuua

SEQ ID NO: 112260 - RNA, 21 nt, Human
gugccaugcuggugugcugca

SEQ ID NO: 112261 - RNA, 21 nt, Human
guaauguccuucuuuaucugu

SEQ ID NO: 112262 - RNA, 20 nt, Human
aaaacacaaaaauuagcugg

SEQ ID NO: 112263 - RNA, 21 nt, Human
uugaauagcaaaaaacugaua

SEQ ID NO: 112264 - RNA, 22 nt, Human
uuugccucacuuagucaugugc

SEQ ID NO: 112265 - RNA, 25 nt, Human
ccucgcuccccucuggaaucuuccc

SEQ ID NO: 112266 - RNA, 21 nt, Human
gcggggcagagccaccagggc

SEQ ID NO: 112267 - RNA, 20 nt, Human
guugguuccccucuuugacc

SEQ ID NO: 112268 - RNA, 24 nt, Human
cuuccucuuccucugcuuuuauuu

SEQ ID NO: 112269 - RNA, 22 nt, Human
uagcgagaccucaucucaaacc

SEQ ID NO: 112270 - RNA, 24 nt, Human
ccaacucgccaccacugcugccga

SEQ ID NO: 112271 - RNA, 19 nt, Human
aguaugucagaaaaaucag

SEQ ID NO: 112272 - RNA, 14 nt, Human
cccauaaaaccuuc

SEQ ID NO: 112273 - RNA, 26 nt, Human
aguaguucuguauuugaaagugccuu

SEQ ID NO: 112274 - RNA, 29 nt, Human
cacuggggcagaggacugggaaccgcggc

SEQ ID NO: 112275 - RNA, 28 nt, Human
gacucuguacugaauuuuaguuauuuca

SEQ ID NO: 112276 - RNA, 27 nt, Human
gaggauggcuugcgcucaggaggcaga

SEQ ID NO: 112277 - RNA, 21 nt, Human
gcugcugcccacaccgcgucg

SEQ ID NO: 112278 - RNA, 25 nt, Human
agcgaaagggacucucuaacagggc

SEQ ID NO: 112279 - RNA, 31 nt, Human
gugccucuuccacucuggagugaaguuaaug

SEQ ID NO: 112280 - RNA, 23 nt, Human
cuguuguaagcugaauguuaaca

SEQ ID NO: 112281 - RNA, 19 nt, Human
gaauacaccacacuuuuca

SEQ ID NO: 112282 - RNA, 23 nt, Human
ggccccccagccagggaucccag

SEQ ID NO: 112283 - RNA, 24 nt, Human
gaccugccaggagcacuuggccug

SEQ ID NO: 112284 - RNA, 27 nt, Human
ggaggcugagcaggccggaguggaugg

SEQ ID NO: 112285 - RNA, 24 nt, Human
uuccucggggguaaggaggggaca

SEQ ID NO: 112286 - RNA, 22 nt, Human
gggugcucccacagcggagcgg

SEQ ID NO: 112287 - RNA, 20 nt, Human
ucauugcacuccauccugag

SEQ ID NO: 112288 - RNA, 22 nt, Human
uuugcauaccuucauccauuuu

SEQ ID NO: 112289 - RNA, 21 nt, Human
ugguggaggacgccgggccgg

SEQ ID NO: 112290 - RNA, 27 nt, Human
uauuacuuuuguuuuuaauuuuaacca

SEQ ID NO: 112291 - RNA, 26 nt, Human
guucugcuguccugugccaccccauu

SEQ ID NO: 112292 - RNA, 21 nt, Human
gggaagauggaggugcagggc

SEQ ID NO: 112293 - RNA, 21 nt, Human
agcaugcccugggcugagaug

SEQ ID NO: 112294 - RNA, 19 nt, Human
caaaacaacauuuuaagua

SEQ ID NO: 112295 - RNA, 23 nt, Human
uauugcagugcaacuaaagagca

SEQ ID NO: 112296 - RNA, 28 nt, Human
ggaguggagacugcagagggagauaaag

SEQ ID NO: 112297 - RNA, 22 nt, Human
uuccugagcugaagugccuugu

SEQ ID NO: 112298 - RNA, 22 nt, Human
cuccacccugccuccucgggcu

SEQ ID NO: 112299 - RNA, 24 nt, Human
gcucccuuccccucucuggcugcc

SEQ ID NO: 112300 - RNA, 25 nt, Human
accauuuuuguaaagaguaagaguu

SEQ ID NO: 112301 - RNA, 23 nt, Human
cuucugcuaggcacgcguucacc

SEQ ID NO: 112302 - RNA, 22 nt, Human
ccaaagugcugggauuacaggc

SEQ ID NO: 112303 - RNA, 20 nt, Human
acucuugucgcucaggcugg

SEQ ID NO: 112304 - RNA, 21 nt, Human
uugggaggccaguuacuggaa

SEQ ID NO: 112305 - RNA, 20 nt, Human
cacuucuaggaccugccucu

SEQ ID NO: 112306 - RNA, 26 nt, Human
augccauucugggagugucccucgcu

SEQ ID NO: 112307 - RNA, 22 nt, Human
uauggcccugcuucuuccuccc

SEQ ID NO: 112308 - RNA, 19 nt, Human
gcgcuaggggacuugggga

SEQ ID NO: 112309 - RNA, 22 nt, Human
ucuagugacuuccuggugaggc

SEQ ID NO: 112310 - RNA, 25 nt, Human
ucgauacugcuggccaaucaguguc

SEQ ID NO: 112311 - RNA, 26 nt, Human
cacccaggacaggacgggggucagcc

SEQ ID NO: 112312 - RNA, 21 nt, Human
ggccaggucuugcuguuguau

SEQ ID NO: 112313 - RNA, 22 nt, Human
ucaugauaagaggaaugaacgu

SEQ ID NO: 112314 - RNA, 26 nt, Human
cccucgggggagagggcgccggagag

SEQ ID NO: 112315 - RNA, 23 nt, Human
gggcccaggcggggaaguggggu

SEQ ID NO: 112316 - RNA, 27 nt, Human
guuccugaaugcaccauaaucgcugua

SEQ ID NO: 112317 - RNA, 23 nt, Human
uucuccuuccugcuucauccggc

SEQ ID NO: 112318 - RNA, 23 nt, Human
ucugggacuccaggucuugagga

SEQ ID NO: 112319 - RNA, 20 nt, Human
ccucccaggcuggggcagug

SEQ ID NO: 112320 - RNA, 20 nt, Human
aauguauccaccaaccaagg

SEQ ID NO: 112321 - RNA, 19 nt, Human
agccaugaauaugcuuuau

SEQ ID NO: 112322 - RNA, 21 nt, Human
gguguaguguggaugcgaggc

SEQ ID NO: 112323 - RNA, 26 nt, Human
ggcucacugcauuugguuuucuuuuc

SEQ ID NO: 112324 - RNA, 27 nt, Human
uucuuguguguuuuuauagaaguggug

SEQ ID NO: 112325 - RNA, 26 nt, Human
uugccucucagugcuuauuuuagugg

SEQ ID NO: 112326 - RNA, 27 nt, Human
cuucccaaaauuucuccuccuccugug

SEQ ID NO: 112327 - RNA, 25 nt, Human
uccuuucacacauuugccuugacaa

SEQ ID NO: 112328 - RNA, 27 nt, Human
ucauccagaccaaagccaugccauugc

SEQ ID NO: 112329 - RNA, 20 nt, Human
aaggcaugcucccagcauuu

SEQ ID NO: 112330 - RNA, 25 nt, Human
cuucugcugguguuuuguucaaucu

SEQ ID NO: 112331 - RNA, 26 nt, Human
cucagcuuacucuucaggggauauga

SEQ ID NO: 112332 - RNA, 21 nt, Human
ugccaggccagccuccgagag

SEQ ID NO: 112333 - RNA, 26 nt, Human
uccaauaaugugguauacacuuugac

SEQ ID NO: 112334 - RNA, 20 nt, Human
aacauucguucucuaaccau

SEQ ID NO: 112335 - RNA, 28 nt, Human
agugaccccagagacuuugcuguaauua

SEQ ID NO: 112336 - RNA, 22 nt, Human
cugagcaccugcuucaugcuca

SEQ ID NO: 112337 - RNA, 26 nt, Human
gcugccuggccagcccacccuccugc

SEQ ID NO: 112338 - RNA, 22 nt, Human
ccugccuggccgggcguggugg

SEQ ID NO: 112339 - RNA, 29 nt, Human
ggccuucucaaacuuuacucuaagucucc

SEQ ID NO: 112340 - RNA, 26 nt, Human
gggaccccugacccaucccaaaacac

SEQ ID NO: 112341 - RNA, 22 nt, Human
gggggugggccagggaggaaaa

SEQ ID NO: 112342 - RNA, 27 nt, Human
ucaaaguauuuauugcacagacuugcg

SEQ ID NO: 112343 - RNA, 21 nt, Human
ccgaauacauccuaucugcca

SEQ ID NO: 112344 - RNA, 20 nt, Human
ggaaguguuuguaaucccag

SEQ ID NO: 112345 - RNA, 26 nt, Human
uuucccagccucuccacucccccgcc

SEQ ID NO: 112346 - RNA, 19 nt, Human
ccuuucucuucucuguucc

SEQ ID NO: 112347 - RNA, 25 nt, Human
acccugaaguucugcaccugcaccu

SEQ ID NO: 112348 - RNA, 23 nt, Human
acugugucuuugguuugugcuag

SEQ ID NO: 112349 - RNA, 22 nt, Human
gccccaggggagcagcucagcu

SEQ ID NO: 112350 - RNA, 26 nt, Human
ggagagggaggggauaagagaggugc

SEQ ID NO: 112351 - RNA, 22 nt, Human
cuccaccccaucccaucccacc

SEQ ID NO: 112352 - RNA, 20 nt, Human
gcuuuguggucaucauguuc

SEQ ID NO: 112353 - RNA, 24 nt, Human
gggagagaaggauggggaagcauu

SEQ ID NO: 112354 - RNA, 24 nt, Human
gcuuugaagaaacauacuguccau

SEQ ID NO: 112355 - RNA, 24 nt, Human
accaggggaccuuuuggugcagug

SEQ ID NO: 112356 - RNA, 22 nt, Human
auugcacacugcacuccagccu

SEQ ID NO: 112357 - RNA, 19 nt, Human
cauacccaggaaguacagu

SEQ ID NO: 112358 - RNA, 24 nt, Human
cucaccccacucccuucugccccu

SEQ ID NO: 112359 - RNA, 21 nt, Human
guacauccuuuucuuuucucc

SEQ ID NO: 112360 - RNA, 28 nt, Human
uaaagagaauguuauucaaucauuaaac

SEQ ID NO: 112361 - RNA, 22 nt, Human
ccugaaaauucaacauuugcuu

SEQ ID NO: 112362 - RNA, 21 nt, Human
agacagcacaccuaccuuuuc

SEQ ID NO: 112363 - RNA, 20 nt, Human
ugugcauuuguuucaacuga

SEQ ID NO: 112364 - RNA, 27 nt, Human
ggugauggggcagggcugggucucagu

SEQ ID NO: 112365 - RNA, 25 nt, Human
uugccaccuggaagaauucucucag

SEQ ID NO: 112366 - RNA, 21 nt, Human
guauauauacauaacagggua

SEQ ID NO: 112367 - RNA, 24 nt, Human
cacuuuauuuuuuauacacauuaa

SEQ ID NO: 112368 - RNA, 23 nt, Human
uugugagcuccuugagggaaagg

SEQ ID NO: 112369 - RNA, 23 nt, Human
agagggauccuguggcuggaagc

SEQ ID NO: 112370 - RNA, 20 nt, Human
acagcaaagaagugugcaag

SEQ ID NO: 112371 - RNA, 27 nt, Human
cuaacagcaacaucugcaagauuugug

SEQ ID NO: 112372 - RNA, 21 nt, Human
acucuaauuuuacuuuaagua

SEQ ID NO: 112373 - RNA, 25 nt, Human
gcccuugaaguggagugggcccaga

SEQ ID NO: 112374 - RNA, 22 nt, Human
aguagacauuucucuuacugca

SEQ ID NO: 112375 - RNA, 20 nt, Human
ccugcagcaggugcauaguc

SEQ ID NO: 112376 - RNA, 22 nt, Human
gcaccaauuaagaugugcucaa

SEQ ID NO: 112377 - RNA, 22 nt, Human
cugcugucacauuuuucuuguu

SEQ ID NO: 112378 - RNA, 26 nt, Human
aaagagacuguguguuacugaagaac

SEQ ID NO: 112379 - RNA, 23 nt, Human
caacuggagugcucucucagcac

SEQ ID NO: 112380 - RNA, 19 nt, Human
ucuuccgcuuccuccccac

SEQ ID NO: 112381 - RNA, 21 nt, Human
uuccacaucuguagugccaug

SEQ ID NO: 112382 - RNA, 24 nt, Human
guauggaggggagggaucuccugc

SEQ ID NO: 112383 - RNA, 20 nt, Human
uccuguucauacacuaacca

SEQ ID NO: 112384 - RNA, 22 nt, Human
ucucacuuuccccuuguggggu

SEQ ID NO: 112385 - RNA, 25 nt, Human
gccagccucgggggugcagccuggg

SEQ ID NO: 112386 - RNA, 27 nt, Human
ggaggcugaggcagaagaaucgcuuga

SEQ ID NO: 112387 - RNA, 22 nt, Human
uuccggguucacuccccgccuc

SEQ ID NO: 112388 - RNA, 19 nt, Human
gccuucuccuuuugaggga

SEQ ID NO: 112389 - RNA, 22 nt, Human
uucaguuaacaaauuauuugua

SEQ ID NO: 112390 - RNA, 18 nt, Human
ccuuccugcuccugcugc

SEQ ID NO: 112391 - RNA, 31 nt, Human
aaaugaacaggaauagaucugaauaaagcaa

SEQ ID NO: 112392 - RNA, 23 nt, Human
cuauaaugugaugauucuaaauu

SEQ ID NO: 112393 - RNA, 27 nt, Human
gaccaguacaucuguaaauacccggag

SEQ ID NO: 112394 - RNA, 22 nt, Human
guuuaugcagucaaggccaaag

SEQ ID NO: 112395 - RNA, 20 nt, Human
ccuucucccugaccuggcuc

SEQ ID NO: 112396 - RNA, 20 nt, Human
cugccucucuugagcacuuc

SEQ ID NO: 112397 - RNA, 24 nt, Human
uccaggagaaaccucacaaaccuu

SEQ ID NO: 112398 - RNA, 24 nt, Human
uuggggccaaacucuucugucacu

SEQ ID NO: 112399 - RNA, 22 nt, Human
cucgccgucugugaauuggacc

SEQ ID NO: 112400 - RNA, 27 nt, Human
ugcuucuuaucauugcuuuuccaucua

SEQ ID NO: 112401 - RNA, 23 nt, Human
agaacuccuuugcagaaacuggg

SEQ ID NO: 112402 - RNA, 22 nt, Human
augugguuggccaauaaagaua

SEQ ID NO: 112403 - RNA, 24 nt, Human
ggacuccuguuuacuucuagaccu

SEQ ID NO: 112404 - RNA, 27 nt, Human
ucauugccucgucacaucaaugcaaaa

SEQ ID NO: 112405 - RNA, 26 nt, Human
acugcucucccauuuucccuugcugg

SEQ ID NO: 112406 - RNA, 18 nt, Human
agacccacuggugcaaug

SEQ ID NO: 112407 - RNA, 21 nt, Human
ccaguuucaaaccccaaagau

SEQ ID NO: 112408 - RNA, 22 nt, Human
gcugagauugcaggcacaugcc

SEQ ID NO: 112409 - RNA, 23 nt, Human
uauuuaauguauaacuauagcau

SEQ ID NO: 112410 - RNA, 21 nt, Human
cacaggaaucgguggucucca

SEQ ID NO: 112411 - RNA, 27 nt, Human
aggugcuugugaccuacaagucagagu

SEQ ID NO: 112412 - RNA, 30 nt, Human
ggucaaggcaacaucuccacacagaaaauc

SEQ ID NO: 112413 - RNA, 25 nt, Human
ugacucagcagggaugauucagcag

SEQ ID NO: 112414 - RNA, 23 nt, Human
augccaggcugacggguccagug

SEQ ID NO: 112415 - RNA, 19 nt, Human
gucccaagcuucccugcca

SEQ ID NO: 112416 - RNA, 21 nt, Human
uccaguacuuuaaaaaugaca

SEQ ID NO: 112417 - RNA, 21 nt, Human
cgccuguaaucucagcacuuu

SEQ ID NO: 112418 - RNA, 21 nt, Human
cgcuuguaaucccagcacuuu

SEQ ID NO: 112419 - RNA, 23 nt, Human
ggcuccaccuuaacugugcucag

SEQ ID NO: 112420 - RNA, 20 nt, Human
uaugggcuaucaauauccau

SEQ ID NO: 112421 - RNA, 27 nt, Human
ucccugccucucaucaacugaaugagg

SEQ ID NO: 112422 - RNA, 22 nt, Human
agcauuuucaguuccuucuuca

SEQ ID NO: 112423 - RNA, 21 nt, Human
auggauccuaguccuuuucau

SEQ ID NO: 112424 - RNA, 21 nt, Human
ugggagguugagguagguaga

SEQ ID NO: 112425 - RNA, 20 nt, Human
cacuuccuuuucacucaguu

SEQ ID NO: 112426 - RNA, 26 nt, Human
ucacagccaccccagaggacuucccu

SEQ ID NO: 112427 - RNA, 22 nt, Human
agccucccgaguggcuggcauc

SEQ ID NO: 112428 - RNA, 22 nt, Human
cuucccuuuggaaauuuggcag

SEQ ID NO: 112429 - RNA, 20 nt, Human
gcuugcagagcaugaccuga

SEQ ID NO: 112430 - RNA, 23 nt, Human
guuauuuuucuuaguagggggcc

SEQ ID NO: 112431 - RNA, 23 nt, Human
ggcuaagugauccucccaccuca

SEQ ID NO: 112432 - RNA, 26 nt, Human
augcccucagaauuggggcaugggag

SEQ ID NO: 112433 - RNA, 19 nt, Human
ugccccugugcuuggagag

SEQ ID NO: 112434 - RNA, 24 nt, Human
ggagagauggagaagcuagaaggc

SEQ ID NO: 112435 - RNA, 27 nt, Human
ugguggagacggggccugggcucccgg

SEQ ID NO: 112436 - RNA, 26 nt, Human
cgcugccugcguugcaaacugggcuu

SEQ ID NO: 112437 - RNA, 24 nt, Human
ggggacagggagagcaagagguca

SEQ ID NO: 112438 - RNA, 22 nt, Human
aggccgaggcaggcagaucacu

SEQ ID NO: 112439 - RNA, 27 nt, Human
aggguaggcugagcuccccacccugga

SEQ ID NO: 112440 - RNA, 26 nt, Human
gcgcugaggugucuggccugagguca

SEQ ID NO: 112441 - RNA, 26 nt, Human
aucaggucagagcccaggaauucuca

SEQ ID NO: 112442 - RNA, 22 nt, Human
gcugggagagggcggaggggga

SEQ ID NO: 112443 - RNA, 24 nt, Human
ccugcagcugagcuuccacaagac

SEQ ID NO: 112444 - RNA, 20 nt, Human
uagccucugggaaaaaacaa

SEQ ID NO: 112445 - RNA, 27 nt, Human
ugcuguugcuguuaaguuuggaaaaca

SEQ ID NO: 112446 - RNA, 24 nt, Human
aagacuugaacguucugaccaggu

SEQ ID NO: 112447 - RNA, 28 nt, Human
gggguuuuguuggagaaaaauggacuga

SEQ ID NO: 112448 - RNA, 18 nt, Human
ggguuucugcuugcuccu

SEQ ID NO: 112449 - RNA, 24 nt, Human
gucuuaguguuuguucaguccugu

SEQ ID NO: 112450 - RNA, 26 nt, Human
gggguccacagcgggcuccacagcgg

SEQ ID NO: 112451 - RNA, 28 nt, Human
gcaauuuccauagucacaguuagguagc

SEQ ID NO: 112452 - RNA, 22 nt, Human
cccacaaguuugccccccaccu

SEQ ID NO: 112453 - RNA, 22 nt, Human
cagcccagggcacgccccuggc

SEQ ID NO: 112454 - RNA, 27 nt, Human
uaaaaccagagauuauuuguaugcuca

SEQ ID NO: 112455 - RNA, 25 nt, Human
cagaggaagcaaucaccaaaaugaa

SEQ ID NO: 112456 - RNA, 23 nt, Human
ggagagggugaaggaggucaggc

SEQ ID NO: 112457 - RNA, 23 nt, Human
acuccacacugcacaauaacucc

SEQ ID NO: 112458 - RNA, 23 nt, Human
ccuguucuuuccuccccugccga

SEQ ID NO: 112459 - RNA, 24 nt, Human
cagguuaaagaugguugcagcugg

SEQ ID NO: 112460 - RNA, 20 nt, Human
gugaugguggaugacaggcu

SEQ ID NO: 112461 - RNA, 22 nt, Human
aaauuuuuaucuuacuuuugga

SEQ ID NO: 112462 - RNA, 21 nt, Human
auaaagugccuucugggcuuu

SEQ ID NO: 112463 - RNA, 26 nt, Human
ggcugcagcggaggcacuuuggaaga

SEQ ID NO: 112464 - RNA, 23 nt, Human
gguaaagagcaggaccagaggaa

SEQ ID NO: 112465 - RNA, 21 nt, Human
agggagcuuuccagacaucug

SEQ ID NO: 112466 - RNA, 24 nt, Human
ggaccccugccuuuucauugcccg

SEQ ID NO: 112467 - RNA, 24 nt, Human
ucacagaaaaccuaauucaaacug

SEQ ID NO: 112468 - RNA, 27 nt, Human
gggacuaaagccaggaacagggaccag

SEQ ID NO: 112469 - RNA, 23 nt, Human
uggugguggccagcgugcaguga

SEQ ID NO: 112470 - RNA, 23 nt, Human
cagggagagucagguuaauuuuc

SEQ ID NO: 112471 - RNA, 26 nt, Human
uggcugaccccccucaggacccucgc

SEQ ID NO: 112472 - RNA, 27 nt, Human
aaguagcugggauuacaggugcccaac

SEQ ID NO: 112473 - RNA, 26 nt, Human
cuguucuggacugugccuguuaaguu

SEQ ID NO: 112474 - RNA, 22 nt, Human
ccacagccacauuucagaccug

SEQ ID NO: 112475 - RNA, 23 nt, Human
uugccuuuccugaaaguuucugg

SEQ ID NO: 112476 - RNA, 21 nt, Human
ccuggccaccacccaaccuau

SEQ ID NO: 112477 - RNA, 22 nt, Human
accuggggaagagacuaucaca

SEQ ID NO: 112478 - RNA, 21 nt, Human
aggcccaguccuccuccagaa

SEQ ID NO: 112479 - RNA, 23 nt, Human
auauaugcuguuuauuuacuuau

SEQ ID NO: 112480 - RNA, 25 nt, Human
uguagcaaccaggacgaaguugaga

SEQ ID NO: 112481 - RNA, 23 nt, Human
ugaggagaaugaauaccuuccaa

SEQ ID NO: 112482 - RNA, 26 nt, Human
uucugguucuguguccucugccuggg

SEQ ID NO: 112483 - RNA, 26 nt, Human
gucaguuuggugucaacaugaaacac

SEQ ID NO: 112484 - RNA, 27 nt, Human
aguuagaaauguuucuguucauauuac

SEQ ID NO: 112485 - RNA, 20 nt, Human
acuauuuaagcaaucuuuaa

SEQ ID NO: 112486 - RNA, 25 nt, Human
gacuagguuccaguuuucuccuaac

SEQ ID NO: 112487 - RNA, 20 nt, Human
uuuguugccaagguagcacu

SEQ ID NO: 112488 - RNA, 21 nt, Human
guuccuagaggcagagguuga

SEQ ID NO: 112489 - RNA, 27 nt, Human
gccagugcuuucaguaggaagagcuga

SEQ ID NO: 112490 - RNA, 22 nt, Human
gugggugggggcagggcaugag

SEQ ID NO: 112491 - RNA, 26 nt, Human
ccauugcuguauaggccuuguggguc

SEQ ID NO: 112492 - RNA, 20 nt, Human
agacuucucccauagcaaag

SEQ ID NO: 112493 - RNA, 27 nt, Human
ucacuucuucuucuagaauccccacag

SEQ ID NO: 112494 - RNA, 20 nt, Human
ggacuucagguucuuucuga

SEQ ID NO: 112495 - RNA, 27 nt, Human
cccgugccaccacaccgacgguaccau

SEQ ID NO: 112496 - RNA, 22 nt, Human
uacagugagccgagauggcgcc

SEQ ID NO: 112497 - RNA, 20 nt, Human
ugaaaccagaaucugcuuca

SEQ ID NO: 112498 - RNA, 26 nt, Human
ucaagucaguuccuggagccugaaug

SEQ ID NO: 112499 - RNA, 27 nt, Human
ugcagcucuggcuccuugucucccagg

SEQ ID NO: 112500 - RNA, 20 nt, Human
gcaugccacagccacucgcc

SEQ ID NO: 112501 - RNA, 23 nt, Human
gagaggcugccuuucugguucca

SEQ ID NO: 112502 - RNA, 23 nt, Human
uucuggcccaggauucgcucacu

SEQ ID NO: 112503 - RNA, 21 nt, Human
gggggcacuccacacuggggg

SEQ ID NO: 112504 - RNA, 26 nt, Human
caucgguuguuuggcagcagcuuuga

SEQ ID NO: 112505 - RNA, 20 nt, Human
caccagaacugagacuccua

SEQ ID NO: 112506 - RNA, 19 nt, Human
ugaacaaagggauucucca

SEQ ID NO: 112507 - RNA, 26 nt, Human
caaagacaacauuguuccuggaacgc

SEQ ID NO: 112508 - RNA, 28 nt, Human
uuccuggccucagagcuuccuggggacc

SEQ ID NO: 112509 - RNA, 23 nt, Human
ccugucugucugucucucuuuug

SEQ ID NO: 112510 - RNA, 24 nt, Human
agaggcaccucuggggagcaaaga

SEQ ID NO: 112511 - RNA, 21 nt, Human
accugugacaaugacagcaga

SEQ ID NO: 112512 - RNA, 22 nt, Human
cauugcauuccagccuuggcga

SEQ ID NO: 112513 - RNA, 21 nt, Human
uucuguuuuauaauuuuguga

SEQ ID NO: 112514 - RNA, 22 nt, Human
ggaggcugaggcaggugguuca

SEQ ID NO: 112515 - RNA, 22 nt, Human
guuccucccuucuucugaguga

SEQ ID NO: 112516 - RNA, 20 nt, Human
gguccuggaagcugacucau

SEQ ID NO: 112517 - RNA, 22 nt, Human
uuggugccacacuggggugggg

SEQ ID NO: 112518 - RNA, 26 nt, Human
auggagccaggcaucggcaagggcuc

SEQ ID NO: 112519 - RNA, 22 nt, Human
gaggaagagacccucccaugua

SEQ ID NO: 112520 - RNA, 21 nt, Human
ggagauggagguagggcuggc

SEQ ID NO: 112521 - RNA, 20 nt, Human
uuugacuuauucuucguauc

SEQ ID NO: 112522 - RNA, 22 nt, Human
uaucucucacacguauuuuaca

SEQ ID NO: 112523 - RNA, 25 nt, Human
uucauucuuucucacuuugccauca

SEQ ID NO: 112524 - RNA, 28 nt, Human
ucggcucgaggccucucugugagggacc

SEQ ID NO: 112525 - RNA, 22 nt, Human
cuuuuuucuuuuguauuuugau

SEQ ID NO: 112526 - RNA, 24 nt, Human
ugucaucugaguugagcacugguc

SEQ ID NO: 112527 - RNA, 27 nt, Human
aaagacuguuuuuaaaaaggugcuaca

SEQ ID NO: 112528 - RNA, 22 nt, Human
aaagcaugaagaaaccccauuu

SEQ ID NO: 112529 - RNA, 22 nt, Human
uggcaauaaauaccagacacgu

SEQ ID NO: 112530 - RNA, 24 nt, Human
gcucacagcaaccucucugccucc

SEQ ID NO: 112531 - RNA, 22 nt, Human
aaauuauaguuucaagccaacu

SEQ ID NO: 112532 - RNA, 21 nt, Human
ggguggggagagcgggccagg

SEQ ID NO: 112533 - RNA, 20 nt, Human
cagggaggccuggccuggag

SEQ ID NO: 112534 - RNA, 24 nt, Human
aucauuguccagagcugcuucccc

SEQ ID NO: 112535 - RNA, 20 nt, Human
ugaacuccuucucaaggaau

SEQ ID NO: 112536 - RNA, 32 nt, Human
ccacuccagcaccccagccagccugguacgca

SEQ ID NO: 112537 - RNA, 28 nt, Human
gcagagacagugugugagccgagcccug

SEQ ID NO: 112538 - RNA, 20 nt, Human
agacccaaccagaccccaac

SEQ ID NO: 112539 - RNA, 20 nt, Human
aucagggauccucucuccag

SEQ ID NO: 112540 - RNA, 21 nt, Human
gagagagggucaggagccaga

SEQ ID NO: 112541 - RNA, 27 nt, Human
uguguauggaggaucuagccuggguga

SEQ ID NO: 112542 - RNA, 23 nt, Human
aggcugagacaguccucauaucc

SEQ ID NO: 112543 - RNA, 19 nt, Human
gcccaggcuggaaugcagu

SEQ ID NO: 112544 - RNA, 32 nt, Human
ccgcugcagcuaaauccaaaucugcccuaggu

SEQ ID NO: 112545 - RNA, 23 nt, Human
uucaagggauucuccugccucag

SEQ ID NO: 112546 - RNA, 21 nt, Human
ggcugcagaaguucugccucu

SEQ ID NO: 112547 - RNA, 25 nt, Human
cgugucauccaggcuggagugcggu

SEQ ID NO: 112548 - RNA, 30 nt, Human
gguaauauauuguauuuccaccguacucug

SEQ ID NO: 112549 - RNA, 18 nt, Human
uccgcugcacaagcagug

SEQ ID NO: 112550 - RNA, 21 nt, Human
agaagaaaagcaacaugugag

SEQ ID NO: 112551 - RNA, 21 nt, Human
acgggaggagguggggcgagg

SEQ ID NO: 112552 - RNA, 22 nt, Human
gugacauccuuuauaggcaccu

SEQ ID NO: 112553 - RNA, 21 nt, Human
augcccaggaucgugugugug

SEQ ID NO: 112554 - RNA, 21 nt, Human
ggaagagggagaaggaucauu

SEQ ID NO: 112555 - RNA, 23 nt, Human
ccagggaugcaaagguugcagug

SEQ ID NO: 112556 - RNA, 22 nt, Human
gaccagccuagccaagauggug

SEQ ID NO: 112557 - RNA, 21 nt, Human
ugguauuuacaauuugcaaga

SEQ ID NO: 112558 - RNA, 22 nt, Human
ugugggaaggauuuauuuacag

SEQ ID NO: 112559 - RNA, 26 nt, Human
uucuucuucuuggaaauaguccucca

SEQ ID NO: 112560 - RNA, 27 nt, Human
gcccuugccugucggugaggcagguuu

SEQ ID NO: 112561 - RNA, 25 nt, Human
uacagcaauaagcacguccuccucc

SEQ ID NO: 112562 - RNA, 27 nt, Human
cccaaagugcugggauuacagacacga

SEQ ID NO: 112563 - RNA, 23 nt, Human
agagaggccgccaggagacccgg

SEQ ID NO: 112564 - RNA, 21 nt, Human
cauccagagcuggagugcagc

SEQ ID NO: 112565 - RNA, 22 nt, Human
uuggucccuccuauuauaguau

SEQ ID NO: 112566 - RNA, 24 nt, Human
gcgcccacucugcuucgauucucc

SEQ ID NO: 112567 - RNA, 20 nt, Human
ucccaggcuggagugcagug

SEQ ID NO: 112568 - RNA, 20 nt, Human
cuccugagccuccgccuucc

SEQ ID NO: 112569 - RNA, 27 nt, Human
ccaccagaaaaccaucgccaacuccug

SEQ ID NO: 112570 - RNA, 20 nt, Human
gccuaucugccugccggccu

SEQ ID NO: 112571 - RNA, 26 nt, Human
uacucagauagucacgguuauuuugc

SEQ ID NO: 112572 - RNA, 23 nt, Human
aauacuagaucaguagacauuca

SEQ ID NO: 112573 - RNA, 19 nt, Human
accagccgcuccucucugc

SEQ ID NO: 112574 - RNA, 25 nt, Human
gaaagggaaaaacugcaauuucucc

SEQ ID NO: 112575 - RNA, 21 nt, Human
agcugcuggcugaccugggcc

SEQ ID NO: 112576 - RNA, 23 nt, Human
ccuggaggccguggccacaugcc

SEQ ID NO: 112577 - RNA, 22 nt, Human
ggagagaaggagagccggucag

SEQ ID NO: 112578 - RNA, 21 nt, Human
ucuuuuuaaaaauauuuuuug

SEQ ID NO: 112579 - RNA, 23 nt, Human
cguacaaaggagggagaggucag

SEQ ID NO: 112580 - RNA, 20 nt, Human
cacgcccaggcgaugccagu

SEQ ID NO: 112581 - RNA, 27 nt, Human
ucucaacaaggaagagcagaccaaggu

SEQ ID NO: 112582 - RNA, 19 nt, Human
ucagggauuauuauucuua

SEQ ID NO: 112583 - RNA, 23 nt, Human
agcagccugugagggagugcaga

SEQ ID NO: 112584 - RNA, 23 nt, Human
agguaagaggaaucaaguucuga

SEQ ID NO: 112585 - RNA, 21 nt, Human
ucuaaaacugaccagaaaaau

SEQ ID NO: 112586 - RNA, 26 nt, Human
aggcauucacagaacccuucugauuc

SEQ ID NO: 112587 - RNA, 22 nt, Human
ugggcaacauggugagacccca

SEQ ID NO: 112588 - RNA, 27 nt, Human
uguaaaacuacacaucccuaaugugug

SEQ ID NO: 112589 - RNA, 24 nt, Human
cuccugauuucccaagacucucuu

SEQ ID NO: 112590 - RNA, 22 nt, Human
aagaucagggacaacugauuug

SEQ ID NO: 112591 - RNA, 22 nt, Human
ugcucagaaagucaagauagga

SEQ ID NO: 112592 - RNA, 24 nt, Human
ccuuuuaccuuuauuuucucaugu

SEQ ID NO: 112593 - RNA, 22 nt, Human
caaugcuggacacuacagguau

SEQ ID NO: 112594 - RNA, 21 nt, Human
ucucucaucuuuuguccuccu

SEQ ID NO: 112595 - RNA, 20 nt, Human
accaagcugcaaugcaguau

SEQ ID NO: 112596 - RNA, 19 nt, Human
aacacaaaaacucugaggg

SEQ ID NO: 112597 - RNA, 22 nt, Human
gccuuuacaagguacugggccc

SEQ ID NO: 112598 - RNA, 27 nt, Human
ggagagggaaugcugagcagauagccc

SEQ ID NO: 112599 - RNA, 23 nt, Human
ccugucugucugggcagcagguu

SEQ ID NO: 112600 - RNA, 23 nt, Human
gcacggcaagcccagcaucgccu

SEQ ID NO: 112601 - RNA, 22 nt, Human
gggauuacaggcaugugucacc

SEQ ID NO: 112602 - RNA, 26 nt, Human
cgugaagcucuuccuacccuccuccc

SEQ ID NO: 112603 - RNA, 27 nt, Human
ucuuagcaaucaauauuuuucugcauu

SEQ ID NO: 112604 - RNA, 21 nt, Human
caggagucugaacacugggcu

SEQ ID NO: 112605 - RNA, 24 nt, Human
uggcugcauuguugaauucugcca

SEQ ID NO: 112606 - RNA, 20 nt, Human
cucccaggaaccggagcugg

SEQ ID NO: 112607 - RNA, 28 nt, Human
uccccaacagggcaacuguagaaggcca

SEQ ID NO: 112608 - RNA, 24 nt, Human
cuucugcugaccucagauaccagc

SEQ ID NO: 112609 - RNA, 22 nt, Human
uucacuaccucagaucuaauca

SEQ ID NO: 112610 - RNA, 23 nt, Human
ccggggaggggcagagaggaagu

SEQ ID NO: 112611 - RNA, 24 nt, Human
agucuuuauucuguuuuucuugaa

SEQ ID NO: 112612 - RNA, 19 nt, Human
ggucugugcugagcuggag

SEQ ID NO: 112613 - RNA, 26 nt, Human
cuagcacaucauggcagugggaccaa

SEQ ID NO: 112614 - RNA, 21 nt, Human
ggcccagacugaagugcagug

SEQ ID NO: 112615 - RNA, 20 nt, Human
gcagaagaaaagcagaagcg

SEQ ID NO: 112616 - RNA, 24 nt, Human
gccacauuuaacuccagccuuggg

SEQ ID NO: 112617 - RNA, 18 nt, Human
cucuucgugguuguguuu

SEQ ID NO: 112618 - RNA, 24 nt, Human
cccuccaggggugcaguggggugg

SEQ ID NO: 112619 - RNA, 27 nt, Human
gucacugagucuggagugaaccacggg

SEQ ID NO: 112620 - RNA, 21 nt, Human
uggagugaagaccuggagagg

SEQ ID NO: 112621 - RNA, 21 nt, Human
uguaaugaaauaaaaugugau

SEQ ID NO: 112622 - RNA, 22 nt, Human
cugcccccaggacugggccacu

SEQ ID NO: 112623 - RNA, 22 nt, Human
gcccagcccugcccggaggcag

SEQ ID NO: 112624 - RNA, 20 nt, Human
uccacccuguggccugcacu

SEQ ID NO: 112625 - RNA, 19 nt, Human
caggaagcuugucacugga

SEQ ID NO: 112626 - RNA, 24 nt, Human
cgucggcccagacugaagugcagu

SEQ ID NO: 112627 - RNA, 22 nt, Human
uauuucuccuuuguguaaguga

SEQ ID NO: 112628 - RNA, 20 nt, Human
gcauaggaaacaaucuaccu

SEQ ID NO: 112629 - RNA, 20 nt, Human
uuggggcagugagggcuuag

SEQ ID NO: 112630 - RNA, 20 nt, Human
ugccuaggauguucugggcu

SEQ ID NO: 112631 - RNA, 21 nt, Human
auuguuuuguaacaaugucag

SEQ ID NO: 112632 - RNA, 27 nt, Human
uacaaguguuucuaguaacaguauuuc

SEQ ID NO: 112633 - RNA, 21 nt, Human
ccugguuggcccuggcuuugc

SEQ ID NO: 112634 - RNA, 22 nt, Human
ccagaagcaaaccuggagguga

SEQ ID NO: 112635 - RNA, 31 nt, Human
acagucccuaaugacacccacuccuagcccu

SEQ ID NO: 112636 - RNA, 23 nt, Human
cccaccccuguacccagccaccu

SEQ ID NO: 112637 - RNA, 21 nt, Human
cuggggcagggggaauaugca

SEQ ID NO: 112638 - RNA, 26 nt, Human
aggggugcugcagguggcagagugaa

SEQ ID NO: 112639 - RNA, 26 nt, Human
cacuguuuguucagucugucuucauc

SEQ ID NO: 112640 - RNA, 20 nt, Human
uucuuuugccuuuuuuagca

SEQ ID NO: 112641 - RNA, 22 nt, Human
agaagcuucagcaucugcuggg

SEQ ID NO: 112642 - RNA, 19 nt, Human
agacccaccucccacccca

SEQ ID NO: 112643 - RNA, 23 nt, Human
caggcacuaggacgucugccuuu

SEQ ID NO: 112644 - RNA, 22 nt, Human
cuuguuucuuuuccaucuauuc

SEQ ID NO: 112645 - RNA, 23 nt, Human
ccaggcaccguggucucauccgc

SEQ ID NO: 112646 - RNA, 22 nt, Human
uguacauuuuggauuucuuuau

SEQ ID NO: 112647 - RNA, 22 nt, Human
aguggcaugaucugggcucacu

SEQ ID NO: 112648 - RNA, 22 nt, Human
ucucaccuccuuucucugcagg

SEQ ID NO: 112649 - RNA, 26 nt, Human
cacccacgcugguuucugugcagugu

SEQ ID NO: 112650 - RNA, 32 nt, Human
gcgcagcccgagccgggcugggcgcuguccuc

SEQ ID NO: 112651 - RNA, 22 nt, Human
gcucucgccuguaaucccagca

SEQ ID NO: 112652 - RNA, 22 nt, Human
gcucccgccuguaaucccagua

SEQ ID NO: 112653 - RNA, 24 nt, Human
ggggcagaaggaucaggugaccuu

SEQ ID NO: 112654 - RNA, 27 nt, Human
ucugggagacuuugaagaccaguccug

SEQ ID NO: 112655 - RNA, 26 nt, Human
gugcacauaauaggugcucaauaaaa

SEQ ID NO: 112656 - RNA, 26 nt, Human
agagagggagggcgacgggggugaga

SEQ ID NO: 112657 - RNA, 28 nt, Human
agggcaggaguguuuauggcagagugaa

SEQ ID NO: 112658 - RNA, 21 nt, Human
agaucacugcaaaccugccuc

SEQ ID NO: 112659 - RNA, 21 nt, Human
cuuucuuuacuccaucauggc

SEQ ID NO: 112660 - RNA, 21 nt, Human
uuugggaggcugcgugccagu

SEQ ID NO: 112661 - RNA, 26 nt, Human
cccucugggaaccucccagaggucca

SEQ ID NO: 112662 - RNA, 21 nt, Human
uuuucuauuuauaagugacuu

SEQ ID NO: 112663 - RNA, 22 nt, Human
aagacaguggagaugaggucag

SEQ ID NO: 112664 - RNA, 25 nt, Human
cgcccagccucuccccgcucuggau

SEQ ID NO: 112665 - RNA, 18 nt, Human
auacuauaaaaugcagua

SEQ ID NO: 112666 - RNA, 23 nt, Human
cucaggaggcagagguugcaaug

SEQ ID NO: 112667 - RNA, 22 nt, Human
gcugcauugcgaggacccagaa

SEQ ID NO: 112668 - RNA, 24 nt, Human
ugcacucuuucuugcaagugcauc

SEQ ID NO: 112669 - RNA, 21 nt, Human
gaguuugagaggcgacacggc

SEQ ID NO: 112670 - RNA, 21 nt, Human
gcuugacaaauauuuucaugu

SEQ ID NO: 112671 - RNA, 26 nt, Human
aagggaggggagggagacccgaaccu

SEQ ID NO: 112672 - RNA, 23 nt, Human
gcccuguuggcauccucagugcc

SEQ ID NO: 112673 - RNA, 26 nt, Human
guguccccugacagggccagugcagu

SEQ ID NO: 112674 - RNA, 22 nt, Human
ccggaucucccccuccauggcu

SEQ ID NO: 112675 - RNA, 23 nt, Human
auuuaacuuacagcaauauucac

SEQ ID NO: 112676 - RNA, 22 nt, Human
caccgguggcccuggcugcagu

SEQ ID NO: 112677 - RNA, 24 nt, Human
uccuccaggccuggggacaggaaa

SEQ ID NO: 112678 - RNA, 25 nt, Human
uccucgagguugagcuucacuccac

SEQ ID NO: 112679 - RNA, 21 nt, Human
cucauuucuucccuuuguucc

SEQ ID NO: 112680 - RNA, 22 nt, Human
gaggaagaggaaaagcccucuu

SEQ ID NO: 112681 - RNA, 22 nt, Human
ggaggcugaggcggaagaauca

SEQ ID NO: 112682 - RNA, 22 nt, Human
gaguuucauucuccugccugua

SEQ ID NO: 112683 - RNA, 26 nt, Human
caucccucagccccacaggcacgauc

SEQ ID NO: 112684 - RNA, 25 nt, Human
ucccucccuguauuuuguucuugag

SEQ ID NO: 112685 - RNA, 23 nt, Human
ugauucuucuuugcucuuauuua

SEQ ID NO: 112686 - RNA, 25 nt, Human
uggggaggaggauggggaguaggac

SEQ ID NO: 112687 - RNA, 28 nt, Human
ggcaggcagcaucucugaggguccccaa

SEQ ID NO: 112688 - RNA, 26 nt, Human
aggaggcagagguugcagugcgcuga

SEQ ID NO: 112689 - RNA, 25 nt, Human
uuugguuuuuauuaaaaugaugugu

SEQ ID NO: 112690 - RNA, 27 nt, Human
cugggaggcgcaggggcugggcagcug

SEQ ID NO: 112691 - RNA, 26 nt, Human
ugguaaaauaaacuaguuuuucccau

SEQ ID NO: 112692 - RNA, 22 nt, Human
aaaaagcucauuucaugcucug

SEQ ID NO: 112693 - RNA, 17 nt, Human
cuucccuuugccugugg

SEQ ID NO: 112694 - RNA, 23 nt, Human
gcccguaguuguuuggauaagag

SEQ ID NO: 112695 - RNA, 20 nt, Human
uaagaagccuuaauuugcac

SEQ ID NO: 112696 - RNA, 23 nt, Human
uucaaccacagauuuauacaagg

SEQ ID NO: 112697 - RNA, 21 nt, Human
cuucccagcccucaucccacu

SEQ ID NO: 112698 - RNA, 22 nt, Human
aaguguucauugacaugcuaaa

SEQ ID NO: 112699 - RNA, 23 nt, Human
cggcgcggcugcuccuggaagcc

SEQ ID NO: 112700 - RNA, 21 nt, Human
cagaggcaacaauagagacac

SEQ ID NO: 112701 - RNA, 24 nt, Human
gggcaaagagaaaggagagccagg

SEQ ID NO: 112702 - RNA, 21 nt, Human
ccuaaucuggguggcucagcu

SEQ ID NO: 112703 - RNA, 24 nt, Human
caugaucugaggaccauucaugga

SEQ ID NO: 112704 - RNA, 25 nt, Human
gguggcugauuuaaaguugugcagg

SEQ ID NO: 112705 - RNA, 26 nt, Human
ccuccgccuccuggguucaagugauu

SEQ ID NO: 112706 - RNA, 19 nt, Human
gcagggacuuggcugcagu

SEQ ID NO: 112707 - RNA, 27 nt, Human
uuuucaccucuagugauggcccuacuc

SEQ ID NO: 112708 - RNA, 24 nt, Human
ugcuggagagguuaaggugcaaua

SEQ ID NO: 112709 - RNA, 24 nt, Human
gcucugacuuucauucucauucca

SEQ ID NO: 112710 - RNA, 22 nt, Human
guccaggcugcaggggcugggc

SEQ ID NO: 112711 - RNA, 21 nt, Human
ucgcugcagccccaucuacca

SEQ ID NO: 112712 - RNA, 22 nt, Human
aagucagggaccacuugcugaa

SEQ ID NO: 112713 - RNA, 19 nt, Human
gcuuucucaugcauagaca

SEQ ID NO: 112714 - RNA, 27 nt, Human
gcucugaagcaagagugauauacucca

SEQ ID NO: 112715 - RNA, 22 nt, Human
auacaaguuuccugaaacugcu

SEQ ID NO: 112716 - RNA, 23 nt, Human
uuacuagcgccuggccuugugug

SEQ ID NO: 112717 - RNA, 27 nt, Human
uagcccagugcacauacccaguccuua

SEQ ID NO: 112718 - RNA, 23 nt, Human
acagcacuucagcuuuagcugau

SEQ ID NO: 112719 - RNA, 23 nt, Human
ccugcccgccacacagaccacca

SEQ ID NO: 112720 - RNA, 23 nt, Human
ucuguuuuguuuaaaaaauucuu

SEQ ID NO: 112721 - RNA, 19 nt, Human
gguuuggggaucccccagu

SEQ ID NO: 112722 - RNA, 25 nt, Human
ugaacaaacgcagcaaagcaagcca

SEQ ID NO: 112723 - RNA, 19 nt, Human
aggauccucuuucugacca

SEQ ID NO: 112724 - RNA, 23 nt, Human
ccuccuuugcugauccuggguca

SEQ ID NO: 112725 - RNA, 22 nt, Human
uggccaacauggugaaacccca

SEQ ID NO: 112726 - RNA, 22 nt, Human
ugaccaacauagugaaacccca

SEQ ID NO: 112727 - RNA, 22 nt, Human
ucuccgugcucuccugccucca

SEQ ID NO: 112728 - RNA, 24 nt, Human
agaggugagaagagggccuggugg

SEQ ID NO: 112729 - RNA, 23 nt, Human
cccucacgccuccucucagucua

SEQ ID NO: 112730 - RNA, 22 nt, Human
cgccucuuggguucaagcaauu

SEQ ID NO: 112731 - RNA, 21 nt, Human
ccagcagaaucuggaugaaug

SEQ ID NO: 112732 - RNA, 21 nt, Human
auucucucacucuguguaugu

SEQ ID NO: 112733 - RNA, 22 nt, Human
ggcuuugggggcucuguuuuga

SEQ ID NO: 112734 - RNA, 22 nt, Human
cucgccgugucauccaggcugg

SEQ ID NO: 112735 - RNA, 22 nt, Human
ggagaauuagaguucagcucag

SEQ ID NO: 112736 - RNA, 27 nt, Human
gagccuccaaacuccuagcugucucau

SEQ ID NO: 112737 - RNA, 23 nt, Human
gccuggagggggccaaaccccca

SEQ ID NO: 112738 - RNA, 22 nt, Human
uguugauguacuuacagacaca

SEQ ID NO: 112739 - RNA, 20 nt, Human
cgccaaccgccgcuccuggg

SEQ ID NO: 112740 - RNA, 19 nt, Human
ccaagucacauuggaacac

SEQ ID NO: 112741 - RNA, 22 nt, Human
uccacccucaccugcccccuca

SEQ ID NO: 112742 - RNA, 27 nt, Human
aaacuuccagaccagcccucucaccac

SEQ ID NO: 112743 - RNA, 27 nt, Human
gcgguaggugcuggccucaaacagcca

SEQ ID NO: 112744 - RNA, 22 nt, Human
gguacugguacuauagcauuuu

SEQ ID NO: 112745 - RNA, 22 nt, Human
uugaggcaggaggauugcuuga

SEQ ID NO: 112746 - RNA, 26 nt, Human
acugggaggagaaugagcagcuuuga

SEQ ID NO: 112747 - RNA, 25 nt, Human
agcucagccacugacugccccuccu

SEQ ID NO: 112748 - RNA, 22 nt, Human
acccaccucagccuccugugua

SEQ ID NO: 112749 - RNA, 21 nt, Human
ucguuucucccuuguuguaag

SEQ ID NO: 112750 - RNA, 26 nt, Human
aaacuuagaggaaaaugaguauuugg

SEQ ID NO: 112751 - RNA, 26 nt, Human
agauuuccccuccuuuacccuuuccc

SEQ ID NO: 112752 - RNA, 23 nt, Human
aguaaccuauuuuuguucugguu

SEQ ID NO: 112753 - RNA, 18 nt, Human
uuuuuguauguuuaguag

SEQ ID NO: 112754 - RNA, 20 nt, Human
ggcgagcuuucucuccgacu

SEQ ID NO: 112755 - RNA, 22 nt, Human
agccucucccuccagccaauag

SEQ ID NO: 112756 - RNA, 20 nt, Human
cccgcggagugaccccaccu

SEQ ID NO: 112757 - RNA, 26 nt, Human
ccuaggcuugucuggaacuccugggc

SEQ ID NO: 112758 - RNA, 22 nt, Human
cugaggcacgagauucacuuga

SEQ ID NO: 112759 - RNA, 26 nt, Human
cucccugccuuagaggccagccuugg

SEQ ID NO: 112760 - RNA, 20 nt, Human
gccaucccugcacacagccu

SEQ ID NO: 112761 - RNA, 24 nt, Human
cugggguggguuuagcaggcugca

SEQ ID NO: 112762 - RNA, 20 nt, Human
uucuuuagcccacaagucca

SEQ ID NO: 112763 - RNA, 27 nt, Human
gggagucacuauuggaggcagagaggc

SEQ ID NO: 112764 - RNA, 20 nt, Human
ugcugcagccacagcuccuc

SEQ ID NO: 112765 - RNA, 27 nt, Human
cucucucuaccugugacaaaauggaaa

SEQ ID NO: 112766 - RNA, 23 nt, Human
uggcagugcugccucuuguaggu

SEQ ID NO: 112767 - RNA, 25 nt, Human
gggcuaaaucccaagugucucuuga

SEQ ID NO: 112768 - RNA, 19 nt, Human
cauuuagccaaaguugagg

SEQ ID NO: 112769 - RNA, 25 nt, Human
uucacuuucucucaugcuaccuuuu

SEQ ID NO: 112770 - RNA, 23 nt, Human
uuauuaaugccucucccgcacca

SEQ ID NO: 112771 - RNA, 27 nt, Human
cagcccaguuccucauucuaucagcgg

SEQ ID NO: 112772 - RNA, 25 nt, Human
uacgucuuggacgggaaucacuggg

SEQ ID NO: 112773 - RNA, 19 nt, Human
gaguaggugggggaacacu

SEQ ID NO: 112774 - RNA, 24 nt, Human
ccccuugccugccuuccucgccag

SEQ ID NO: 112775 - RNA, 27 nt, Human
ugguggagucggggcucccgggcaugg

SEQ ID NO: 112776 - RNA, 19 nt, Human
cucauaaggaggcagccau

SEQ ID NO: 112777 - RNA, 23 nt, Human
gcuccugcggaggaggugugguc

SEQ ID NO: 112778 - RNA, 24 nt, Human
ucccccacccccaggagguuauau

SEQ ID NO: 112779 - RNA, 25 nt, Human
guuucaacuguuuggagucuuuuau

SEQ ID NO: 112780 - RNA, 27 nt, Human
uguuuuuacacaaacuuucucaugguu

SEQ ID NO: 112781 - RNA, 26 nt, Human
cacccaggcuguggugcaguaagcca

SEQ ID NO: 112782 - RNA, 26 nt, Human
uuugggccuauuauagacaaaauaga

SEQ ID NO: 112783 - RNA, 20 nt, Human
ugauuguccuuuaaaaaaga

SEQ ID NO: 112784 - RNA, 20 nt, Human
aacuauacuuguacuccuua

SEQ ID NO: 112785 - RNA, 23 nt, Human
cuuuuaacauaggugguucugug

SEQ ID NO: 112786 - RNA, 23 nt, Human
caugucuuccugagucagugccu

SEQ ID NO: 112787 - RNA, 25 nt, Human
gccaucucauucaucaugugacugu

SEQ ID NO: 112788 - RNA, 26 nt, Human
guugccugucaaaggcuggagggcag

SEQ ID NO: 112789 - RNA, 21 nt, Human
ccccucuuuaauuagccgguc

SEQ ID NO: 112790 - RNA, 28 nt, Human
cccuaggcuuuuccuuguggacaacggg

SEQ ID NO: 112791 - RNA, 28 nt, Human
uaggacaaagcagagaguccaauuuauu

SEQ ID NO: 112792 - RNA, 27 nt, Human
ggacuauccccugcucaagcugugauu

SEQ ID NO: 112793 - RNA, 22 nt, Human
gcgaucucggcucacugcagcc

SEQ ID NO: 112794 - RNA, 22 nt, Human
gcggucucggcucacugcaacc

SEQ ID NO: 112795 - RNA, 24 nt, Human
cggucuaggaucgaaauguuaaca

SEQ ID NO: 112796 - RNA, 27 nt, Human
gugggcuucagguguuuucaagcacaa

SEQ ID NO: 112797 - RNA, 21 nt, Human
ggcacacaucuguaauccuag

SEQ ID NO: 112798 - RNA, 26 nt, Human
gagcugggacucaguucuuggccugc

SEQ ID NO: 112799 - RNA, 21 nt, Human
cucccacaggucauucuccug

SEQ ID NO: 112800 - RNA, 21 nt, Human
ugacuagggcccaacuuuaau

SEQ ID NO: 112801 - RNA, 26 nt, Human
caacuggccugccugagucucagugu

SEQ ID NO: 112802 - RNA, 22 nt, Human
cccagcacuucccacagugccu

SEQ ID NO: 112803 - RNA, 26 nt, Human
gggaccccugucuuagauucaaguug

SEQ ID NO: 112804 - RNA, 19 nt, Human
uaggcaguuucucuucuca

SEQ ID NO: 112805 - RNA, 25 nt, Human
uaaccagcacauuucuccuguuuac

SEQ ID NO: 112806 - RNA, 28 nt, Human
gggggcacugagccuccagacccugcua

SEQ ID NO: 112807 - RNA, 26 nt, Human
gcucacguccagguucaacccacagc

SEQ ID NO: 112808 - RNA, 25 nt, Human
caguuucaccaccucccucuuccag

SEQ ID NO: 112809 - RNA, 20 nt, Human
auuuggaccuuagcaaucau

SEQ ID NO: 112810 - RNA, 22 nt, Human
ccugcagcuguaguacagugcu

SEQ ID NO: 112811 - RNA, 23 nt, Human
guggaaccgcagacagggcccag

SEQ ID NO: 112812 - RNA, 21 nt, Human
auggcggggaaagcccuaguc

SEQ ID NO: 112813 - RNA, 27 nt, Human
uuuuauagaaaaggaacaguugcauuu

SEQ ID NO: 112814 - RNA, 22 nt, Human
uuagccagcccuggcuguugua

SEQ ID NO: 112815 - RNA, 21 nt, Human
uuucugcugggacaagacacu

SEQ ID NO: 112816 - RNA, 27 nt, Human
ggcuggguggaggacuacuggguuccc

SEQ ID NO: 112817 - RNA, 22 nt, Human
agacuggcuaguccuggcagaa

SEQ ID NO: 112818 - RNA, 21 nt, Human
ugccuguauuuucggacuuug

SEQ ID NO: 112819 - RNA, 20 nt, Human
aacaucuuccuucucuacca

SEQ ID NO: 112820 - RNA, 26 nt, Human
uuucccacccucucccugacccaagu

SEQ ID NO: 112821 - RNA, 27 nt, Human
augacaccucuggaggugucaagcucc

SEQ ID NO: 112822 - RNA, 20 nt, Human
acaguauuaugucucagucc

SEQ ID NO: 112823 - RNA, 24 nt, Human
gcguguuguggacucagcacuggg

SEQ ID NO: 112824 - RNA, 28 nt, Human
ccuuuuguucccccuccuucuuuuguaa

SEQ ID NO: 112825 - RNA, 27 nt, Human
uauggcagagggcagcggggaaguggu

SEQ ID NO: 112826 - RNA, 23 nt, Human
gcaagucuugaagucucuuccca

SEQ ID NO: 112827 - RNA, 24 nt, Human
gggcauuuagaggaagaaggcuga

SEQ ID NO: 112828 - RNA, 20 nt, Human
aaggaaacauguuacgccuu

SEQ ID NO: 112829 - RNA, 18 nt, Human
cagaggcagcaucugcca

SEQ ID NO: 112830 - RNA, 19 nt, Human
gaccccuucagagcaggga

SEQ ID NO: 112831 - RNA, 25 nt, Human
cuucucccucauuucaggagcagcc

SEQ ID NO: 112832 - RNA, 17 nt, Human
caaauccaaacccagag

SEQ ID NO: 112833 - RNA, 27 nt, Human
ggugccugcuccugugaggacaacagc

SEQ ID NO: 112834 - RNA, 22 nt, Human
cacgccuauaaucccagcacuu

SEQ ID NO: 112835 - RNA, 21 nt, Human
acucugagagaaacuaccaag

SEQ ID NO: 112836 - RNA, 20 nt, Human
agguuuuuaucaacuggaau

SEQ ID NO: 112837 - RNA, 20 nt, Human
gccacauuccuuccaucgug

SEQ ID NO: 112838 - RNA, 21 nt, Human
aguuggacuucagucuugccu

SEQ ID NO: 112839 - RNA, 21 nt, Human
uucuuccaguccuccuaggca

SEQ ID NO: 112840 - RNA, 22 nt, Human
uuuaaguucuguaagggcuaau

SEQ ID NO: 112841 - RNA, 22 nt, Human
ccaacaugaugaaaccuugucu

SEQ ID NO: 112842 - RNA, 19 nt, Human
cuuuacugcugauagugcu

SEQ ID NO: 112843 - RNA, 23 nt, Human
ucucuuuaccagacaggcagcag

SEQ ID NO: 112844 - RNA, 20 nt, Human
uucugccuuuucaguuugau

SEQ ID NO: 112845 - RNA, 23 nt, Human
ugaguagcugggauuauaggugc

SEQ ID NO: 112846 - RNA, 23 nt, Human
cgaguagcugggauuacaggugc

SEQ ID NO: 112847 - RNA, 23 nt, Human
ucauugaaucacaucauccacuu

SEQ ID NO: 112848 - RNA, 23 nt, Human
aacacuuguguuaugaagcauuu

SEQ ID NO: 112849 - RNA, 22 nt, Human
gcgcgagugccagagcccagcc

SEQ ID NO: 112850 - RNA, 27 nt, Human
uuuccacccuacaucaguauauugguu

SEQ ID NO: 112851 - RNA, 28 nt, Human
ugggaaagucggggguuguuaggcuuuu

SEQ ID NO: 112852 - RNA, 24 nt, Human
gagcccuccuuugccugcucccgc

SEQ ID NO: 112853 - RNA, 27 nt, Human
cucuggccaacggcuucacaccuuccc

SEQ ID NO: 112854 - RNA, 22 nt, Human
ggagacaaaacuacccccacug

SEQ ID NO: 112855 - RNA, 27 nt, Human
gccugacuccccucuggaaacugcagg

SEQ ID NO: 112856 - RNA, 22 nt, Human
caucucuggcccagaaagccuc

SEQ ID NO: 112857 - RNA, 21 nt, Human
cugacucccaugacugcccag

SEQ ID NO: 112858 - RNA, 24 nt, Human
cuccauugugaugaaagcacaugg

SEQ ID NO: 112859 - RNA, 21 nt, Human
aaauguagugaaauguuaaua

SEQ ID NO: 112860 - RNA, 21 nt, Human
ggggccuggucacucggccac

SEQ ID NO: 112861 - RNA, 25 nt, Human
uccugccugcccuccagacugucug

SEQ ID NO: 112862 - RNA, 22 nt, Human
aaaagcuguaaauguguguaca

SEQ ID NO: 112863 - RNA, 22 nt, Human
aaugccaguggggaugcggggg

SEQ ID NO: 112864 - RNA, 25 nt, Human
uaaagaagaaaaccagcaaacuaaa

SEQ ID NO: 112865 - RNA, 20 nt, Human
uccccccaauaaaagcucuu

SEQ ID NO: 112866 - RNA, 22 nt, Human
cuuggggaccuggcuucauucu

SEQ ID NO: 112867 - RNA, 22 nt, Human
agccuauacugcauuagcccaa

SEQ ID NO: 112868 - RNA, 24 nt, Human
gaacaaugcauuacuucuaccuua

SEQ ID NO: 112869 - RNA, 19 nt, Human
gggaaagagaggaggccau

SEQ ID NO: 112870 - RNA, 20 nt, Human
auuggggaaaacugggugaa

SEQ ID NO: 112871 - RNA, 21 nt, Human
uuccuacacagauucuuuucc

SEQ ID NO: 112872 - RNA, 27 nt, Human
gggauagagucuugcucuuucgccaag

SEQ ID NO: 112873 - RNA, 21 nt, Human
gguuuugaucucagcauccug

SEQ ID NO: 112874 - RNA, 22 nt, Human
uccaauaaugauugauaccuca

SEQ ID NO: 112875 - RNA, 25 nt, Human
gcccaggcuggaaugcaguggugcg

SEQ ID NO: 112876 - RNA, 24 nt, Human
ucuccagcacaguaagcaccagga

SEQ ID NO: 112877 - RNA, 32 nt, Human
ccuuaacuuucucuuuacccuuagcugaaaug

SEQ ID NO: 112878 - RNA, 29 nt, Human
gaucauuccagcuccucugggcucuggcc

SEQ ID NO: 112879 - RNA, 25 nt, Human
cagucuuacagaggcuggagcggug

SEQ ID NO: 112880 - RNA, 24 nt, Human
agucugugcugaggaccucaggga

SEQ ID NO: 112881 - RNA, 22 nt, Human
cucaacccucuccuggagcgcc

SEQ ID NO: 112882 - RNA, 22 nt, Human
ggucuuuagcaggccucuggca

SEQ ID NO: 112883 - RNA, 26 nt, Human
gcauggcucuugaagaaaugaagaga

SEQ ID NO: 112884 - RNA, 21 nt, Human
cucugccaucuuuagcgcugg

SEQ ID NO: 112885 - RNA, 23 nt, Human
guugaccaggcuggagugaagug

SEQ ID NO: 112886 - RNA, 23 nt, Human
caccauauuggccagucuggucu

SEQ ID NO: 112887 - RNA, 23 nt, Human
ggagugagacaggugauaaugga

SEQ ID NO: 112888 - RNA, 23 nt, Human
cgcaccuguaaucccagucacug

SEQ ID NO: 112889 - RNA, 22 nt, Human
uacuuuucuucaguccuccucu

SEQ ID NO: 112890 - RNA, 22 nt, Human
ucuucuguuuuuuaaaaauaag

SEQ ID NO: 112891 - RNA, 22 nt, Human
guuauucuccccuaugccuucc

SEQ ID NO: 112892 - RNA, 24 nt, Human
ugcuuuuucuucaaaggaguucag

SEQ ID NO: 112893 - RNA, 27 nt, Human
cgagauuccagaugcgaccacugugug

SEQ ID NO: 112894 - RNA, 23 nt, Human
aguauuuuggcauauuauucucc

SEQ ID NO: 112895 - RNA, 22 nt, Human
aaaaacgcugucgggcuuuguu

SEQ ID NO: 112896 - RNA, 22 nt, Human
ucuugccgucacuauucaucaa

SEQ ID NO: 112897 - RNA, 22 nt, Human
uuuauacuaauuaacccauuug

SEQ ID NO: 112898 - RNA, 18 nt, Human
caaucagcugaggguguc

SEQ ID NO: 112899 - RNA, 23 nt, Human
ccaugccaccaaacaucucccac

SEQ ID NO: 112900 - RNA, 24 nt, Human
ccaaaacuauugcuacuuugugug

SEQ ID NO: 112901 - RNA, 20 nt, Human
ggcagaaggaggggaaaaga

SEQ ID NO: 112902 - RNA, 25 nt, Human
cuuagcuaucauugcuuccuccucc

SEQ ID NO: 112903 - RNA, 24 nt, Human
ggacauagaagagaagggugugag

SEQ ID NO: 112904 - RNA, 22 nt, Human
gggcuauuccauccaucuggaa

SEQ ID NO: 112905 - RNA, 22 nt, Human
acaaagcucgacugaaggccag

SEQ ID NO: 112906 - RNA, 19 nt, Human
caggaauagaagaagccaa

SEQ ID NO: 112907 - RNA, 23 nt, Human
cucuuuagcagccaaacaggagc

SEQ ID NO: 112908 - RNA, 20 nt, Human
gcccagccugagccagcacu

SEQ ID NO: 112909 - RNA, 25 nt, Human
ccucuggccaggauggagggguggu

SEQ ID NO: 112910 - RNA, 20 nt, Human
guauauacaccagaaacuau

SEQ ID NO: 112911 - RNA, 23 nt, Human
accucugcuccuuuucauugcag

SEQ ID NO: 112912 - RNA, 20 nt, Human
gcaacuuuggcacaccagaa

SEQ ID NO: 112913 - RNA, 29 nt, Human
gcuaccacuguugaguuuuccugcuugga

SEQ ID NO: 112914 - RNA, 22 nt, Human
acacaggaggaugacacagaaa

SEQ ID NO: 112915 - RNA, 20 nt, Human
aaguugaggagaguucuuuu

SEQ ID NO: 112916 - RNA, 20 nt, Human
aauggccaucuguaaaccau

SEQ ID NO: 112917 - RNA, 21 nt, Human
aaaguaacuucaaauguguau

SEQ ID NO: 112918 - RNA, 20 nt, Human
accauaaagcauauguguug

SEQ ID NO: 112919 - RNA, 23 nt, Human
ucuagaucuugacucccugccgu

SEQ ID NO: 112920 - RNA, 19 nt, Human
uuguuucuaaguuguguuu

SEQ ID NO: 112921 - RNA, 21 nt, Human
uuauugcccaggcuggagugc

SEQ ID NO: 112922 - RNA, 20 nt, Human
cuccagccucugcacacaca

SEQ ID NO: 112923 - RNA, 24 nt, Human
caccggcgggagugcagcggccac

SEQ ID NO: 112924 - RNA, 22 nt, Human
ugacuacccucucacuagugcc

SEQ ID NO: 112925 - RNA, 31 nt, Human
ccagggagguggcccaggaaggugccuggcc

SEQ ID NO: 112926 - RNA, 22 nt, Human
uugccacauuuaguccuguacu

SEQ ID NO: 112927 - RNA, 19 nt, Human
gcuuaucucccugaggcug

SEQ ID NO: 112928 - RNA, 25 nt, Human
uugccucccugagugcagagguccu

SEQ ID NO: 112929 - RNA, 20 nt, Human
gccuacaucuucuuauucua

SEQ ID NO: 112930 - RNA, 24 nt, Human
gacuaugaguuuuaccagucucaa

SEQ ID NO: 112931 - RNA, 23 nt, Human
aacacccuuuagaaccuuaaaga

SEQ ID NO: 112932 - RNA, 22 nt, Human
cuucuucccugcuaccucucuu

SEQ ID NO: 112933 - RNA, 18 nt, Human
gcaguuucacuuauguua

SEQ ID NO: 112934 - RNA, 23 nt, Human
gucacccgagcuggagugcagug

SEQ ID NO: 112935 - RNA, 20 nt, Human
ucagcuuucagagccaguga

SEQ ID NO: 112936 - RNA, 26 nt, Human
ugucauuuaucucugauggcacuuug

SEQ ID NO: 112937 - RNA, 21 nt, Human
guaggugagaauaauuaguag

SEQ ID NO: 112938 - RNA, 24 nt, Human
ucauccaggcuggacaguucagug

SEQ ID NO: 112939 - RNA, 27 nt, Human
ccguuguacuccagccugggcaacaga

SEQ ID NO: 112940 - RNA, 28 nt, Human
ucucaauguuccauucagucugcagcua

SEQ ID NO: 112941 - RNA, 20 nt, Human
uuuacacacuuuccuguuca

SEQ ID NO: 112942 - RNA, 23 nt, Human
ugccaaauuuuuguauuuuuagu

SEQ ID NO: 112943 - RNA, 22 nt, Human
gagccucccuucuuuguuugaa

SEQ ID NO: 112944 - RNA, 22 nt, Human
uggucucaggguucugaucuug

SEQ ID NO: 112945 - RNA, 20 nt, Human
uccaacaaaagaaggucaaa

SEQ ID NO: 112946 - RNA, 19 nt, Human
aucaagcuaugcaacagga

SEQ ID NO: 112947 - RNA, 26 nt, Human
gcagaccgccccucaccaacccagag

SEQ ID NO: 112948 - RNA, 21 nt, Human
gggggcccuuccagauugggg

SEQ ID NO: 112949 - RNA, 24 nt, Human
ucugugcaucccaggcugcccugu

SEQ ID NO: 112950 - RNA, 30 nt, Human
ccucacugaggaagggagacauauucuugg

SEQ ID NO: 112951 - RNA, 23 nt, Human
agcaagauauucugguuucuaga

SEQ ID NO: 112952 - RNA, 27 nt, Human
cgcuaguggguuaucagcuaacacccg

SEQ ID NO: 112953 - RNA, 27 nt, Human
ccuccugccaguugugacccuguggga

SEQ ID NO: 112954 - RNA, 24 nt, Human
uggggugccaagagaaacagcagg

SEQ ID NO: 112955 - RNA, 20 nt, Human
uucaguaggguucaaggugg

SEQ ID NO: 112956 - RNA, 22 nt, Human
cugcccaggcuggaguacagug

SEQ ID NO: 112957 - RNA, 30 nt, Human
ccagcagcagcaaccuguucaggucgccug

SEQ ID NO: 112958 - RNA, 24 nt, Human
agaccuacagggggucuggcuggu

SEQ ID NO: 112959 - RNA, 21 nt, Human
cucugcugacagacacaggcc

SEQ ID NO: 112960 - RNA, 20 nt, Human
uuaucacugggaaaacacaa

SEQ ID NO: 112961 - RNA, 20 nt, Human
cugggagugaccucacagcu

SEQ ID NO: 112962 - RNA, 24 nt, Human
agccaggcuggagucagugucugc

SEQ ID NO: 112963 - RNA, 22 nt, Human
uuggucaguaacaagugcaaug

SEQ ID NO: 112964 - RNA, 26 nt, Human
uggugaagccaagagugaacugaugu

SEQ ID NO: 112965 - RNA, 19 nt, Human
uccccagacauugcaccug

SEQ ID NO: 112966 - RNA, 25 nt, Human
cauauuacucugaguugugcaaagc

SEQ ID NO: 112967 - RNA, 27 nt, Human
uugggcgacaaaaacgaaacuccaucu

SEQ ID NO: 112968 - RNA, 27 nt, Human
cccucccuauacuccucaggcuccugg

SEQ ID NO: 112969 - RNA, 24 nt, Human
ucagcacuuggacuaucauaggau

SEQ ID NO: 112970 - RNA, 27 nt, Human
acuguagccuuucuucuagaguaacaa

SEQ ID NO: 112971 - RNA, 26 nt, Human
aacaagucccuguaauuguuguuugu

SEQ ID NO: 112972 - RNA, 21 nt, Human
auaugcacagcccagcaaaga

SEQ ID NO: 112973 - RNA, 27 nt, Human
ucuccacugaagcugacuuagccggcc

SEQ ID NO: 112974 - RNA, 19 nt, Human
cccagccugugucuguucu

SEQ ID NO: 112975 - RNA, 25 nt, Human
cucacaccuguaaugccagcccuuu

SEQ ID NO: 112976 - RNA, 23 nt, Human
aaaaacacaaaaaggugaugggu

SEQ ID NO: 112977 - RNA, 23 nt, Human
aauaugcucagccacccuguggg

SEQ ID NO: 112978 - RNA, 22 nt, Human
gaagagggacguccacugugga

SEQ ID NO: 112979 - RNA, 27 nt, Human
ucacccaggccuugcagauaaauaaug

SEQ ID NO: 112980 - RNA, 32 nt, Human
ucacggugccugcucaccagugccauguucau

SEQ ID NO: 112981 - RNA, 17 nt, Human
gguccugcaagaaggcc

SEQ ID NO: 112982 - RNA, 21 nt, Human
agcaggagaaaucuaaaccgu

SEQ ID NO: 112983 - RNA, 26 nt, Human
uguaaucccaggacuuugguaggcca

SEQ ID NO: 112984 - RNA, 24 nt, Human
caugcuugucuuucugcaucucca

SEQ ID NO: 112985 - RNA, 24 nt, Human
uaaagagacucuggggugucugga

SEQ ID NO: 112986 - RNA, 27 nt, Human
gggcacagggaagagggagggugucuc

SEQ ID NO: 112987 - RNA, 23 nt, Human
ccccccucccucuccuccagucg

SEQ ID NO: 112988 - RNA, 27 nt, Human
agcaggaggaaaggguucacauaggcu

SEQ ID NO: 112989 - RNA, 22 nt, Human
gucagauggggaucccuucuug

SEQ ID NO: 112990 - RNA, 21 nt, Human
uauguggaauauucuuuuuaa

SEQ ID NO: 112991 - RNA, 23 nt, Human
cugccucugugugcgugcaugug

SEQ ID NO: 112992 - RNA, 26 nt, Human
gcaaucagcaaacacaauaagagucu

SEQ ID NO: 112993 - RNA, 22 nt, Human
uugugcaggcuguagugcagug

SEQ ID NO: 112994 - RNA, 23 nt, Human
agcagugcccugguacuugcugu

SEQ ID NO: 112995 - RNA, 30 nt, Human
gccuccuggaacuccuggcucaaucgaucc

SEQ ID NO: 112996 - RNA, 22 nt, Human
aggcuggagugcaguggccugg

SEQ ID NO: 112997 - RNA, 20 nt, Human
cuaacuucuguguaaacuca

SEQ ID NO: 112998 - RNA, 21 nt, Human
uuugcccaggcuggucucaaa

SEQ ID NO: 112999 - RNA, 26 nt, Human
caccugguuugcaccauuugccaauu

SEQ ID NO: 113000 - RNA, 20 nt, Human
aaaaugggacuucuuuucac

SEQ ID NO: 113001 - RNA, 25 nt, Human
cuucauaaccauugaaaaagaaucg

SEQ ID NO: 113002 - RNA, 27 nt, Human
cuguaaucccagcuauuuggcaggcug

SEQ ID NO: 113003 - RNA, 24 nt, Human
cccaucucucaguuuucaugacag

SEQ ID NO: 113004 - RNA, 25 nt, Human
ggauuggauuauuuaauaacauuac

SEQ ID NO: 113005 - RNA, 27 nt, Human
gcauuuuuucuccuggaagagaggugc

SEQ ID NO: 113006 - RNA, 20 nt, Human
accuuguuucaaucuuugcu

SEQ ID NO: 113007 - RNA, 25 nt, Human
gucauauucaaaacaaauguggaua

SEQ ID NO: 113008 - RNA, 22 nt, Human
uugauauacuauuuucaucucu

SEQ ID NO: 113009 - RNA, 23 nt, Human
gcaaccuugacaggccacugccu

SEQ ID NO: 113010 - RNA, 21 nt, Human
uggucacaccugagccuucag

SEQ ID NO: 113011 - RNA, 26 nt, Human
uuguguccuuuaaucacugcauuuca

SEQ ID NO: 113012 - RNA, 19 nt, Human
ccaaccacaacauucuucu

SEQ ID NO: 113013 - RNA, 24 nt, Human
gugggaaagcaugaaauucugcuc

SEQ ID NO: 113014 - RNA, 21 nt, Human
uauuucuucuauaucuccugu

SEQ ID NO: 113015 - RNA, 22 nt, Human
uuccaauaugaugacucccuua

SEQ ID NO: 113016 - RNA, 27 nt, Human
gcaggacugggaucgaggcccagaaaa

SEQ ID NO: 113017 - RNA, 23 nt, Human
cuuuucucccugugucugggucc

SEQ ID NO: 113018 - RNA, 25 nt, Human
ggccucucugcccuggcuuauguga

SEQ ID NO: 113019 - RNA, 22 nt, Human
uucuuucucccuauccugggcc

SEQ ID NO: 113020 - RNA, 22 nt, Human
ccacacugacggcaucuuccca

SEQ ID NO: 113021 - RNA, 27 nt, Human
cuggcuucuaugcgcuucuuuucucuc

SEQ ID NO: 113022 - RNA, 23 nt, Human
ccuuucucuggcccuguccaugu

SEQ ID NO: 113023 - RNA, 22 nt, Human
aggaagaaggaaugaccucugg

SEQ ID NO: 113024 - RNA, 27 nt, Human
cuugacagaacacugucuugaagacaa

SEQ ID NO: 113025 - RNA, 25 nt, Human
ccauuucuggagcaagagggucuuc

SEQ ID NO: 113026 - RNA, 27 nt, Human
cucuuucugacuccugccuguuuuagu

SEQ ID NO: 113027 - RNA, 22 nt, Human
guuuggugacauaaugccaagg

SEQ ID NO: 113028 - RNA, 20 nt, Human
cuuugacuccuucuccaucu

SEQ ID NO: 113029 - RNA, 20 nt, Human
uggggcuucaagacaguagg

SEQ ID NO: 113030 - RNA, 20 nt, Human
ggaugcaaagguugcaguga

SEQ ID NO: 113031 - RNA, 20 nt, Human
guuguucuaguaacaauaca

SEQ ID NO: 113032 - RNA, 20 nt, Human
guuaggggcaggcagagggc

SEQ ID NO: 113033 - RNA, 23 nt, Human
cacgccuguaaucccagcuacac

SEQ ID NO: 113034 - RNA, 25 nt, Human
cugccuggccagcccacccuccugc

SEQ ID NO: 113035 - RNA, 23 nt, Human
uguuuauuccuauugcugcagca

SEQ ID NO: 113036 - RNA, 23 nt, Human
uauuuugggaacuccugccuuau

SEQ ID NO: 113037 - RNA, 21 nt, Human
caccuuccgggcucaagcgau

SEQ ID NO: 113038 - RNA, 21 nt, Human
caucuguguguccugcagccu

SEQ ID NO: 113039 - RNA, 19 nt, Human
gucuuaaacuccuggccuc

SEQ ID NO: 113040 - RNA, 24 nt, Human
ccaagcccuggugaccagaccaag

SEQ ID NO: 113041 - RNA, 22 nt, Human
gaaugucccucucuugggacuu

SEQ ID NO: 113042 - RNA, 21 nt, Human
uguuuuuaaaaugaucaucua

SEQ ID NO: 113043 - RNA, 22 nt, Human
cggguccuggcagugaggcaga

SEQ ID NO: 113044 - RNA, 26 nt, Human
cgguacuacggcaucugcgucaagga

SEQ ID NO: 113045 - RNA, 22 nt, Human
cggcccgcucgcugcugcucag

SEQ ID NO: 113046 - RNA, 21 nt, Human
gcugcugcugcucuaucggcc

SEQ ID NO: 113047 - RNA, 20 nt, Human
agcaggacucuaaagaagga

SEQ ID NO: 113048 - RNA, 27 nt, Human
agggagagcaagcgcacagcagaggag

SEQ ID NO: 113049 - RNA, 23 nt, Human
ccaucauuacuggcuuaguuuug

SEQ ID NO: 113050 - RNA, 19 nt, Human
gcccaaggugcaccaccuu

SEQ ID NO: 113051 - RNA, 22 nt, Human
gugagucuaaggauccaaggcu

SEQ ID NO: 113052 - RNA, 20 nt, Human
acacuggaauacaaaugcau

SEQ ID NO: 113053 - RNA, 22 nt, Human
uuacaaugccuaccuggacuua

SEQ ID NO: 113054 - RNA, 21 nt, Human
accuguaaucucagcacuuug

SEQ ID NO: 113055 - RNA, 21 nt, Human
acuuguaaucccagcacuuug

SEQ ID NO: 113056 - RNA, 23 nt, Human
uugcuauuuguauuucucuuguc

SEQ ID NO: 113057 - RNA, 21 nt, Human
guuacccaggcuggucucaaa

SEQ ID NO: 113058 - RNA, 27 nt, Human
cccgcagccauggccgacaucaagacg

SEQ ID NO: 113059 - RNA, 21 nt, Human
uacacagcucuagacacugcc

SEQ ID NO: 113060 - RNA, 23 nt, Human
ggcuaauuuuuuguauuuuuagu

SEQ ID NO: 113061 - RNA, 20 nt, Human
agcagcaucugggugugaga

SEQ ID NO: 113062 - RNA, 21 nt, Human
aggaggaaugaggcuggauac

SEQ ID NO: 113063 - RNA, 23 nt, Human
gcccugccuaaggaacacacucu

SEQ ID NO: 113064 - RNA, 20 nt, Human
cuccacccucucccccagcc

SEQ ID NO: 113065 - RNA, 20 nt, Human
acaaaacuuugaggcagcgc

SEQ ID NO: 113066 - RNA, 21 nt, Human
uggacacccucaccacccaac

SEQ ID NO: 113067 - RNA, 26 nt, Human
acguuagaagaaaaauaaaagccaau

SEQ ID NO: 113068 - RNA, 21 nt, Human
gccuccccuccucugcuugcc

SEQ ID NO: 113069 - RNA, 20 nt, Human
acccugcccuuccucuuuga

SEQ ID NO: 113070 - RNA, 21 nt, Human
auauccccaaaaugagcucca

SEQ ID NO: 113071 - RNA, 19 nt, Human
cuucccuucaaaucugccu

SEQ ID NO: 113072 - RNA, 23 nt, Human
cuugaauuuuuccuuucuaaaga

SEQ ID NO: 113073 - RNA, 27 nt, Human
cuaaagguuacagcugagaucuuugga

SEQ ID NO: 113074 - RNA, 21 nt, Human
gcuucuccaggccucuugccu

SEQ ID NO: 113075 - RNA, 22 nt, Human
gacuaaagaaaauuuucaagag

SEQ ID NO: 113076 - RNA, 24 nt, Human
acuggccucugugccauggaugau

SEQ ID NO: 113077 - RNA, 21 nt, Human
uccugcauguuaauggguuua

SEQ ID NO: 113078 - RNA, 18 nt, Human
guaaugacagaugccuua

SEQ ID NO: 113079 - RNA, 21 nt, Human
cccaucuuaauuaagccuuac

SEQ ID NO: 113080 - RNA, 20 nt, Human
ccacaccuggugaauacuca

SEQ ID NO: 113081 - RNA, 23 nt, Human
agauagugccacugcacuccagc

SEQ ID NO: 113082 - RNA, 24 nt, Human
cuguugcccaggguggagugcagu

SEQ ID NO: 113083 - RNA, 22 nt, Human
uuucaugucccagagaccuguu

SEQ ID NO: 113084 - RNA, 20 nt, Human
cgucuuucuuuuauacugac

SEQ ID NO: 113085 - RNA, 23 nt, Human
guccccaagacaaucucgccaaa

SEQ ID NO: 113086 - RNA, 27 nt, Human
accucgaguacugugggcaauuuagaa

SEQ ID NO: 113087 - RNA, 21 nt, Human
cauugggcagaggaagcugug

SEQ ID NO: 113088 - RNA, 26 nt, Human
ugcucacauuucucuaauguacugca

SEQ ID NO: 113089 - RNA, 24 nt, Human
ggagguggagucccugggggagac

SEQ ID NO: 113090 - RNA, 20 nt, Human
aaaucugaaaccuaaauugc

SEQ ID NO: 113091 - RNA, 21 nt, Human
uauuguuucuuagcacaagca

SEQ ID NO: 113092 - RNA, 27 nt, Human
agucaucucuaguuccccaccucaauc

SEQ ID NO: 113093 - RNA, 26 nt, Human
ggccaacauggugaaacccugucucu

SEQ ID NO: 113094 - RNA, 22 nt, Human
aauccuggcucuaucgcuucgg

SEQ ID NO: 113095 - RNA, 21 nt, Human
ccuuucaggaacccuguaugg

SEQ ID NO: 113096 - RNA, 27 nt, Human
ccucugcugccgcccuuccuggaggcu

SEQ ID NO: 113097 - RNA, 26 nt, Human
gcccagccaugugggccaggugcauu

SEQ ID NO: 113098 - RNA, 23 nt, Human
cccacccuccggcagcucaggga

SEQ ID NO: 113099 - RNA, 21 nt, Human
ucauucuucuuuuaugauuca

SEQ ID NO: 113100 - RNA, 24 nt, Human
ugguucccuccagccgccgccguc

SEQ ID NO: 113101 - RNA, 23 nt, Human
gaggaaccugaggccugaaggag

SEQ ID NO: 113102 - RNA, 20 nt, Human
aauaacaaaaaguaauagga

SEQ ID NO: 113103 - RNA, 27 nt, Human
gaaagauuacuucugacauuccauugc

SEQ ID NO: 113104 - RNA, 21 nt, Human
cuguguugugcucaggacuca

SEQ ID NO: 113105 - RNA, 19 nt, Human
gucuuuuuauaguuacuuc

SEQ ID NO: 113106 - RNA, 26 nt, Human
guuucugccugugaucauuucuuuau

SEQ ID NO: 113107 - RNA, 27 nt, Human
gaccagccuggugccuuggcaucuccc

SEQ ID NO: 113108 - RNA, 21 nt, Human
uuccuuuauaggcggacaguu

SEQ ID NO: 113109 - RNA, 27 nt, Human
agacuggaagaagaaaccacuauuuca

SEQ ID NO: 113110 - RNA, 22 nt, Human
uuacagaugcauacaacuacua

SEQ ID NO: 113111 - RNA, 20 nt, Human
aggcauuuacaacucagauu

SEQ ID NO: 113112 - RNA, 24 nt, Human
uuuaaggagaaaaucuaaaaugaa

SEQ ID NO: 113113 - RNA, 20 nt, Human
cucuuauccaucugugaaac

SEQ ID NO: 113114 - RNA, 20 nt, Human
cagaauccaagauugucuuu

SEQ ID NO: 113115 - RNA, 23 nt, Human
ccugaaaaguucccagaaagccc

SEQ ID NO: 113116 - RNA, 27 nt, Human
uguuugugucugugguugcagucuuuc

SEQ ID NO: 113117 - RNA, 26 nt, Human
uugagacagggucucacacugucacc

SEQ ID NO: 113118 - RNA, 22 nt, Human
aaagugcuggaauuacaggcgu

SEQ ID NO: 113119 - RNA, 23 nt, Human
acucaagcgauucuccugccuca

SEQ ID NO: 113120 - RNA, 23 nt, Human
ucagauugcuuaaaagcauuuuu

SEQ ID NO: 113121 - RNA, 27 nt, Human
ggaggcuggagccaggggccacuucug

SEQ ID NO: 113122 - RNA, 25 nt, Human
caggcagccccaggcuuugcagaaa

SEQ ID NO: 113123 - RNA, 26 nt, Human
agauucacugagcauaaaagucaaua

SEQ ID NO: 113124 - RNA, 21 nt, Human
aaccaauaaaacaagaauacu

SEQ ID NO: 113125 - RNA, 24 nt, Human
gugccucuggcacagcccaggcac

SEQ ID NO: 113126 - RNA, 23 nt, Human
ggaggccaagggaggggagcagc

SEQ ID NO: 113127 - RNA, 18 nt, Human
gcacagccgcagagcuug

SEQ ID NO: 113128 - RNA, 21 nt, Human
uccacccgggaggaagggagc

SEQ ID NO: 113129 - RNA, 19 nt, Human
caaguguccgggauucaga

SEQ ID NO: 113130 - RNA, 24 nt, Human
cuccuguaauccuuguacuguucg

SEQ ID NO: 113131 - RNA, 26 nt, Human
uuucagccucaugucuacuguuaggu

SEQ ID NO: 113132 - RNA, 21 nt, Human
ugaggggcccucgguacucug

SEQ ID NO: 113133 - RNA, 24 nt, Human
uuuucugcuuuuuauucugaaguc

SEQ ID NO: 113134 - RNA, 21 nt, Human
acaguguccagcacaaacagg

SEQ ID NO: 113135 - RNA, 26 nt, Human
gcuugagaugucuguuaaacauccag

SEQ ID NO: 113136 - RNA, 24 nt, Human
ggcugguuuucuuguauuuuuagu

SEQ ID NO: 113137 - RNA, 27 nt, Human
caaccaaagguaauaacauauuuagac

SEQ ID NO: 113138 - RNA, 17 nt, Human
cccaacaagauugcuua

SEQ ID NO: 113139 - RNA, 25 nt, Human
uguuuuuaaaaagcaaaucuuucug

SEQ ID NO: 113140 - RNA, 19 nt, Human
agaugaugcaguuggccca

SEQ ID NO: 113141 - RNA, 20 nt, Human
ucuggggccucccacaugcc

SEQ ID NO: 113142 - RNA, 22 nt, Human
gccccucugaccccugccugug

SEQ ID NO: 113143 - RNA, 23 nt, Human
ucugcuuguugcauuuccagcug

SEQ ID NO: 113144 - RNA, 23 nt, Human
uucaguuuugugcagcauugcua

SEQ ID NO: 113145 - RNA, 27 nt, Human
cccugcucuucugcacuccuggacaca

SEQ ID NO: 113146 - RNA, 22 nt, Human
cagagggcuauggcuguggaga

SEQ ID NO: 113147 - RNA, 21 nt, Human
guccuggcccuucagucugcu

SEQ ID NO: 113148 - RNA, 22 nt, Human
caacuguccaucuguggcuggg

SEQ ID NO: 113149 - RNA, 22 nt, Human
cuacuuacaucuaacagacaca

SEQ ID NO: 113150 - RNA, 26 nt, Human
accaguuuuccugucaugacaagccu

SEQ ID NO: 113151 - RNA, 20 nt, Human
ggcugagaccgugacaagac

SEQ ID NO: 113152 - RNA, 22 nt, Human
uuagagcuacagcgagcugcau

SEQ ID NO: 113153 - RNA, 20 nt, Human
uauuucuuaacugcuauuug

SEQ ID NO: 113154 - RNA, 27 nt, Human
cuugccuggcucccagggcuaggguua

SEQ ID NO: 113155 - RNA, 25 nt, Human
gagguugcagggccaagaucgcccc

SEQ ID NO: 113156 - RNA, 26 nt, Human
ccguccagauccccaggauaagagac

SEQ ID NO: 113157 - RNA, 21 nt, Human
gcccugaaaauguauauugug

SEQ ID NO: 113158 - RNA, 22 nt, Human
agcucacugcaaccuccaccuc

SEQ ID NO: 113159 - RNA, 19 nt, Human
gugaggcgcacuguuccug

SEQ ID NO: 113160 - RNA, 19 nt, Human
acugccauuuccuccuggg

SEQ ID NO: 113161 - RNA, 26 nt, Human
ccuccgccuccuggguucaagcaauu

SEQ ID NO: 113162 - RNA, 26 nt, Human
ccucaagcucucuguggguagggguu

SEQ ID NO: 113163 - RNA, 24 nt, Human
augagauacagucgguuuaccuca

SEQ ID NO: 113164 - RNA, 19 nt, Human
ucccacauucccaugaaua

SEQ ID NO: 113165 - RNA, 21 nt, Human
cccuguauuccgucgcgcugg

SEQ ID NO: 113166 - RNA, 26 nt, Human
uccuggagauuccauuccauuuucaa

SEQ ID NO: 113167 - RNA, 21 nt, Human
gcuguacugcauacccugcca

SEQ ID NO: 113168 - RNA, 22 nt, Human
ugggacauauuuaaauacaaac

SEQ ID NO: 113169 - RNA, 19 nt, Human
acugccucuuggguuguca

SEQ ID NO: 113170 - RNA, 30 nt, Human
ccacggaacucaaguggaauuuguuuggau

SEQ ID NO: 113171 - RNA, 31 nt, Human
ucccagacccauuccuuagcuauuuaucccu

SEQ ID NO: 113172 - RNA, 21 nt, Human
ccacagaaaacacaaacaugu

SEQ ID NO: 113173 - RNA, 26 nt, Human
uuguaucuuucuuucucuaauguugu

SEQ ID NO: 113174 - RNA, 27 nt, Human
cgcugggacaagagggagacaauucua

SEQ ID NO: 113175 - RNA, 23 nt, Human
uucugagacggagucucagucug

SEQ ID NO: 113176 - RNA, 24 nt, Human
gggaucuggugguaugugaggugc

SEQ ID NO: 113177 - RNA, 21 nt, Human
ucauuccuacaacaaccaagg

SEQ ID NO: 113178 - RNA, 21 nt, Human
ggauggugggcuucagggcag

SEQ ID NO: 113179 - RNA, 25 nt, Human
aaaguugccuggugaaggaagauaa

SEQ ID NO: 113180 - RNA, 23 nt, Human
uggguagucuguguucuaguucc

SEQ ID NO: 113181 - RNA, 22 nt, Human
ggugucuuuauuuccacugcac

SEQ ID NO: 113182 - RNA, 27 nt, Human
cugcccaccggcccccggcagugcagu

SEQ ID NO: 113183 - RNA, 25 nt, Human
ugcgggaacucugagucagaacguu

SEQ ID NO: 113184 - RNA, 20 nt, Human
augucugccaaaaugcaaca

SEQ ID NO: 113185 - RNA, 27 nt, Human
cuaaggcaaaauagacgcuuagcugcu

SEQ ID NO: 113186 - RNA, 22 nt, Human
acgggggugggacagaguugug

SEQ ID NO: 113187 - RNA, 26 nt, Human
gcagccugaaggaucaguguaguaau

SEQ ID NO: 113188 - RNA, 24 nt, Human
gggcaaaagggcagcugugaugau

SEQ ID NO: 113189 - RNA, 23 nt, Human
agacugauguuuacucucugggc

SEQ ID NO: 113190 - RNA, 30 nt, Human
gaaggggaguacagcucucuggaacaugag

SEQ ID NO: 113191 - RNA, 22 nt, Human
cauaaaaucaacagggccucgg

SEQ ID NO: 113192 - RNA, 19 nt, Human
cugaagaaugugguugcua

SEQ ID NO: 113193 - RNA, 23 nt, Human
gggcuuggccaaaacaggcucag

SEQ ID NO: 113194 - RNA, 21 nt, Human
guggugugaucuuggcucacu

SEQ ID NO: 113195 - RNA, 24 nt, Human
cacaacccuggguuuuagauaauu

SEQ ID NO: 113196 - RNA, 22 nt, Human
auggaaaugaggaucccaccag

SEQ ID NO: 113197 - RNA, 21 nt, Human
acugucauggaggugcugaac

SEQ ID NO: 113198 - RNA, 21 nt, Human
ggcguauacugauuccuccaa

SEQ ID NO: 113199 - RNA, 23 nt, Human
uagaaaaugcuaaagaauccaua

SEQ ID NO: 113200 - RNA, 23 nt, Human
ggacaugagugucucuccagacu

SEQ ID NO: 113201 - RNA, 29 nt, Human
ccagcccuugagcuccccaaaaaccucac

SEQ ID NO: 113202 - RNA, 23 nt, Human
ucugcagcuguuuuaguuaaauu

SEQ ID NO: 113203 - RNA, 21 nt, Human
uucacaguggccagcucacca

SEQ ID NO: 113204 - RNA, 23 nt, Human
gcuuucuccggcuuccucuggcc

SEQ ID NO: 113205 - RNA, 26 nt, Human
gccauggaguuccagcaggucacucu

SEQ ID NO: 113206 - RNA, 19 nt, Human
ucucagucuugaagccaau

SEQ ID NO: 113207 - RNA, 23 nt, Human
uauuaaaaugcuugcauauuuua

SEQ ID NO: 113208 - RNA, 27 nt, Human
gcauggauuuaugaagacacucaugca

SEQ ID NO: 113209 - RNA, 21 nt, Human
uugccagacuggagugcagug

SEQ ID NO: 113210 - RNA, 18 nt, Human
agguggagguugcgguga

SEQ ID NO: 113211 - RNA, 21 nt, Human
ucuccagcccacaccccucca

SEQ ID NO: 113212 - RNA, 20 nt, Human
caacaguaucaacacuggcu

SEQ ID NO: 113213 - RNA, 26 nt, Human
ucagauagacaaccaggccaccaaga

SEQ ID NO: 113214 - RNA, 26 nt, Human
acacagugccuugcuaauaggugcuc

SEQ ID NO: 113215 - RNA, 22 nt, Human
gccggccggggcugaauggagg

SEQ ID NO: 113216 - RNA, 28 nt, Human
gucuggguuugagaaaugaaauauuguu

SEQ ID NO: 113217 - RNA, 19 nt, Human
caccuauuucuuucuugga

SEQ ID NO: 113218 - RNA, 26 nt, Human
ggcacuccgaaagugugcggcugccc

SEQ ID NO: 113219 - RNA, 22 nt, Human
uccgcauccugcuguguguccu

SEQ ID NO: 113220 - RNA, 21 nt, Human
uggcuuucucccucacccaag

SEQ ID NO: 113221 - RNA, 22 nt, Human
cagcaagccugagcccgggaag

SEQ ID NO: 113222 - RNA, 23 nt, Human
auuuaguuguauauauuuuuugu

SEQ ID NO: 113223 - RNA, 24 nt, Human
caucaucuuuucuaaauucaucuc

SEQ ID NO: 113224 - RNA, 21 nt, Human
uuuuaacuugccacaucccag

SEQ ID NO: 113225 - RNA, 22 nt, Human
accaacacuugcaccuuucucu

SEQ ID NO: 113226 - RNA, 26 nt, Human
cugugcaacaguagcccagagcaucc

SEQ ID NO: 113227 - RNA, 31 nt, Human; identical to SEQ ID NO: 8001

SEQ ID NO: 113228 - RNA, 26 nt, Human
gccauccugaaaugaaacuagucuaa

SEQ ID NO: 113229 - RNA, 18 nt, Human
uucuuguuuaucacacau

SEQ ID NO: 113230 - RNA, 27 nt, Human
cccaaguagcugggauuacagucaggc

SEQ ID NO: 113231 - RNA, 23 nt, Human
uucucucuacauacguauaugug

SEQ ID NO: 113232 - RNA, 26 nt, Human
uugccuuucuguguuuauucaaacug

SEQ ID NO: 113233 - RNA, 23 nt, Human
cugggguucuccuccucucccag

SEQ ID NO: 113234 - RNA, 24 nt, Human
ugcgcugacagaacgugauucucg

SEQ ID NO: 113235 - RNA, 20 nt, Human
uuuuccugugagucuugcga

SEQ ID NO: 113236 - RNA, 22 nt, Human
aucaugguuucaugagcauuaa

SEQ ID NO: 113237 - RNA, 21 nt, Human
agaacggaggaggcugcagcc

SEQ ID NO: 113238 - RNA, 25 nt, Human
ucuugaauuuaaucugggcacuuug

SEQ ID NO: 113239 - RNA, 28 nt, Human
gcugaguggacuggaguggagcauuggc

SEQ ID NO: 113240 - RNA, 22 nt, Human
uuaagacuuuagaugucuugua

SEQ ID NO: 113241 - RNA, 23 nt, Human
ucuggaguuucauuccaucccag

SEQ ID NO: 113242 - RNA, 23 nt, Human
cauugcccaggcuggagugcagu

SEQ ID NO: 113243 - RNA, 22 nt, Human
acugagcuccggguggcugguu

SEQ ID NO: 113244 - RNA, 20 nt, Human
aaacuucccugaauugcagu

SEQ ID NO: 113245 - RNA, 21 nt, Human
auucaaaaucagaucuauuug

SEQ ID NO: 113246 - RNA, 25 nt, Human
uaguuugcagaggagcaaauugagg

SEQ ID NO: 113247 - RNA, 20 nt, Human
aguauaaaccuuaugaacua

SEQ ID NO: 113248 - RNA, 21 nt, Human
cagaucuuguucuuugcugga

SEQ ID NO: 113249 - RNA, 23 nt, Human
cuccacccuggccaagaucugcc

SEQ ID NO: 113250 - RNA, 27 nt, Human
gguccucaccuggguccucucagugaa

SEQ ID NO: 113251 - RNA, 20 nt, Human
cucuccucucaggucagucc

SEQ ID NO: 113252 - RNA, 27 nt, Human
cacaggcuguucagggauaaucuaaau

SEQ ID NO: 113253 - RNA, 22 nt, Human
gcucacugcaaccucugccccc

SEQ ID NO: 113254 - RNA, 22 nt, Human
gcucacugcaaucucugccucc

SEQ ID NO: 113255 - RNA, 26 nt, Human
gggagcacugcccuaggagccuggac

SEQ ID NO: 113256 - RNA, 24 nt, Human
uuaugcacuggccacccaacagca

SEQ ID NO: 113257 - RNA, 23 nt, Human
uguguuuaauuucuucuuuggca

SEQ ID NO: 113258 - RNA, 20 nt, Human
cuuaaacugcugaauucacc

SEQ ID NO: 113259 - RNA, 19 nt, Human
gcaggaccucugaaacccu

SEQ ID NO: 113260 - RNA, 22 nt, Human
agucaucuauuuucuuuuacag

SEQ ID NO: 113261 - RNA, 23 nt, Human
agcuucuuccccaucaccgugcg

SEQ ID NO: 113262 - RNA, 25 nt, Human
ucacuucuagaucucagccauucua

SEQ ID NO: 113263 - RNA, 21 nt, Human
caucuccuccccuuucugccu

SEQ ID NO: 113264 - RNA, 26 nt, Human
cccugcccuccugaagccucaguccu

SEQ ID NO: 113265 - RNA, 30 nt, Human
agcaucaaucgcagaccugcccugccucag

SEQ ID NO: 113266 - RNA, 26 nt, Human
gcaugcaagcucagaaccaacacauu

SEQ ID NO: 113267 - RNA, 20 nt, Human
agacagcacacccaagcccg

SEQ ID NO: 113268 - RNA, 18 nt, Human
cgcggccacugccugugu

SEQ ID NO: 113269 - RNA, 25 nt, Human
acugagugccuggugcucucgugga

SEQ ID NO: 113270 - RNA, 23 nt, Human
agcugugauugcuguucugagua

SEQ ID NO: 113271 - RNA, 27 nt, Human
caaggcuagaaauggggcacagagcca

SEQ ID NO: 113272 - RNA, 22 nt, Human
augggaggcagugagucuugau

SEQ ID NO: 113273 - RNA, 27 nt, Human
cuguggcuggugggcguggccugccug

SEQ ID NO: 113274 - RNA, 20 nt, Human
aguagaaucucagcacuuug

SEQ ID NO: 113275 - RNA, 23 nt, Human
gccucugcaacagcucugccucc

SEQ ID NO: 113276 - RNA, 22 nt, Human
guccuguacuccaguuuugacu

SEQ ID NO: 113277 - RNA, 27 nt, Human
cuggagcugcccccuccaggccaguuu

SEQ ID NO: 113278 - RNA, 24 nt, Human
uuuccagaugcuaucacagacucu

SEQ ID NO: 113279 - RNA, 25 nt, Human
uguuggauucugaggguggggaggg

SEQ ID NO: 113280 - RNA, 24 nt, Human
gucuguuuuuauguucaguuugua

SEQ ID NO: 113281 - RNA, 24 nt, Human
cucugcguauacuacacacucauu

SEQ ID NO: 113282 - RNA, 26 nt, Human
cagaccuccaagacuuucuucuccac

SEQ ID NO: 113283 - RNA, 27 nt, Human
cacugcacaccagucuggagacagagu

SEQ ID NO: 113284 - RNA, 27 nt, Human
gcccuugccagaauuuccugcgcuguu

SEQ ID NO: 113285 - RNA, 21 nt, Human
ggcuuggucucccaggacaga

SEQ ID NO: 113286 - RNA, 25 nt, Human
agcggagguggauggggauggaaga

SEQ ID NO: 113287 - RNA, 20 nt, Human
uagagaaugaaaggagcagu

SEQ ID NO: 113288 - RNA, 22 nt, Human
gggagagaagggcagcagcuua

SEQ ID NO: 113289 - RNA, 27 nt, Human
ggucucuaacuccugggcuuaagugau

SEQ ID NO: 113290 - RNA, 21 nt, Human
augcccagggccacucugccu

SEQ ID NO: 113291 - RNA, 17 nt, Human
caaccucccugccagca

SEQ ID NO: 113292 - RNA, 23 nt, Human
agacacagacuuuaugauuauua

SEQ ID NO: 113293 - RNA, 18 nt, Human
caguugccaauuacuugg

SEQ ID NO: 113294 - RNA, 18 nt, Human
ggcaagcuggaguuaaua

SEQ ID NO: 113295 - RNA, 21 nt, Human
cuuuuccguuucaagcauuaa

SEQ ID NO: 113296 - RNA, 27 nt, Human
uuucaaaugauaaacucuagacauaua

SEQ ID NO: 113297 - RNA, 25 nt, Human
uugcaucagccuggagugaaccaug

SEQ ID NO: 113298 - RNA, 24 nt, Human
guugggagagggcgcaggccguga

SEQ ID NO: 113299 - RNA, 24 nt, Human
ugucugacaaaaugucuagcuucc

SEQ ID NO: 113300 - RNA, 22 nt, Human
uccugcucuggucacuggggcu

SEQ ID NO: 113301 - RNA, 23 nt, Human
agcauuucuuucucuccccauua

SEQ ID NO: 113302 - RNA, 21 nt, Human
uggggccaggcucaguguacu

SEQ ID NO: 113303 - RNA, 21 nt, Human
cuccuuccuguugagggucga

SEQ ID NO: 113304 - RNA, 22 nt, Human
uggaagcaaaggaauccugccu

SEQ ID NO: 113305 - RNA, 27 nt, Human
uucaguuauacacugaacuuuacugua

SEQ ID NO: 113306 - RNA, 23 nt, Human
ccggucgggcucucuccugggcu

SEQ ID NO: 113307 - RNA, 22 nt, Human
gugcucaauaaggcagugcagu

SEQ ID NO: 113308 - RNA, 23 nt, Human
ggcuggcuaagucccucccgcuc

SEQ ID NO: 113309 - RNA, 21 nt, Human
gaagaagauuaaaacugcuuu

SEQ ID NO: 113310 - RNA, 22 nt, Human
ucuugcuuugcuuuguugacuc

SEQ ID NO: 113311 - RNA, 28 nt, Human
cugccaccccuucuaccucaccacugcc

SEQ ID NO: 113312 - RNA, 22 nt, Human
caccugucuguucgccauuccu

SEQ ID NO: 113313 - RNA, 19 nt, Human
uuggagggaaaaaacagca

SEQ ID NO: 113314 - RNA, 21 nt, Human
cuccgccuugcugcaacagag

SEQ ID NO: 113315 - RNA, 26 nt, Human
cugugagccacaccuccuagcucugg

SEQ ID NO: 113316 - RNA, 27 nt, Human
gucucaaacuccugacucgaagugauc

SEQ ID NO: 113317 - RNA, 21 nt, Human
ugaggcuggggcucguaaaua

SEQ ID NO: 113318 - RNA, 20 nt, Human
aggagauucccaaccugcug

SEQ ID NO: 113319 - RNA, 23 nt, Human
ggcucacugcaacuucugccucu

SEQ ID NO: 113320 - RNA, 20 nt, Human
gcaaagccuggugccccgag

SEQ ID NO: 113321 - RNA, 19 nt, Human
acaaucagcuuagcaaauc

SEQ ID NO: 113322 - RNA, 23 nt, Human
cccuccaggaccccagcaagugg

SEQ ID NO: 113323 - RNA, 21 nt, Human
cugcucuucccaaagcugccc

SEQ ID NO: 113324 - RNA, 22 nt, Human
ccuuuuuauaaugcagagugag

SEQ ID NO: 113325 - RNA, 21 nt, Human
ucugucuaggugucaugguuc

SEQ ID NO: 113326 - RNA, 22 nt, Human
ugcuuuuaaugacucacuuuga

SEQ ID NO: 113327 - RNA, 22 nt, Human
aggguggucugacccuucccuc

SEQ ID NO: 113328 - RNA, 20 nt, Human
uuguuacucuuccucucuca

SEQ ID NO: 113329 - RNA, 19 nt, Human
uugguuuggggagggagaa

SEQ ID NO: 113330 - RNA, 22 nt, Human
cugaccuucacauuugcucuga

SEQ ID NO: 113331 - RNA, 22 nt, Human
ucugcccgccucgaccucucuc

SEQ ID NO: 113332 - RNA, 26 nt, Human
ugaaaaagcagggaaucucaaacuuu

SEQ ID NO: 113333 - RNA, 19 nt, Human
agagcuuggaaaaugcaga

SEQ ID NO: 113334 - RNA, 24 nt, Human
guuucauuaaggccucuacucugg

SEQ ID NO: 113335 - RNA, 24 nt, Human
ccuuucucccuuggcuguucaccc

SEQ ID NO: 113336 - RNA, 22 nt, Human
aaggcuggacuaaauggcugca

SEQ ID NO: 113337 - RNA, 19 nt, Human
uucagcuggcuggguacgg

SEQ ID NO: 113338 - RNA, 25 nt, Human
cacaugagaauuuaacuuuauaacc

SEQ ID NO: 113339 - RNA, 22 nt, Human
ggagccggcggcggggagcagc

SEQ ID NO: 113340 - RNA, 26 nt, Human
agaauuccaguuguuaggaagagaug

SEQ ID NO: 113341 - RNA, 19 nt, Human
ugugccucugccugucucc

SEQ ID NO: 113342 - RNA, 27 nt, Human
ggccagguggagaaagugagggccgua

SEQ ID NO: 113343 - RNA, 29 nt, Human
gacccaucacucuaccucuaccagcgcac

SEQ ID NO: 113344 - RNA, 23 nt, Human
ugcuucuuaauugccuucagcug

SEQ ID NO: 113345 - RNA, 23 nt, Human
uggaugucuaagcuucaccuuuc

SEQ ID NO: 113346 - RNA, 27 nt, Human
caguucuguguccucgcacugcccagg

SEQ ID NO: 113347 - RNA, 23 nt, Human
cgcuuccucccccaccaucgcag

SEQ ID NO: 113348 - RNA, 22 nt, Human
aaguuuuucuuucuacaucuua

SEQ ID NO: 113349 - RNA, 23 nt, Human
gcgugagcugcccggcgccugcc

SEQ ID NO: 113350 - RNA, 23 nt, Human
cagaaggcuucucuucuacagaa

SEQ ID NO: 113351 - RNA, 27 nt, Human
agcaguuuucacagugacuaccauuuc

SEQ ID NO: 113352 - RNA, 24 nt, Human
uucucugucucucuuccucagcag

SEQ ID NO: 113353 - RNA, 22 nt, Human
uggucucaaacuccugcccuca

SEQ ID NO: 113354 - RNA, 23 nt, Human
ggucacaauacuguugugcgcac

SEQ ID NO: 113355 - RNA, 27 nt, Human
gccuaucuuugugugacaugugagcau

SEQ ID NO: 113356 - RNA, 27 nt, Human
agagacagggaaaggucagcccguuuc

SEQ ID NO: 113357 - RNA, 31 nt, Human
ucauccuggcucaaaaagcacccccacugag

SEQ ID NO: 113358 - RNA, 21 nt, Human
guuucgccauguugcccaggc

SEQ ID NO: 113359 - RNA, 23 nt, Human
ggcuggcugagcccauuuucggc

SEQ ID NO: 113360 - RNA, 21 nt, Human
ccucuguccuggcucugcacc

SEQ ID NO: 113361 - RNA, 18 nt, Human
ugccuugauuaaaccaga

SEQ ID NO: 113362 - RNA, 27 nt, Human
ccucacaucacagugcugguagaaaug

SEQ ID NO: 113363 - RNA, 21 nt, Human
gagcuauuauucacuacuucu

SEQ ID NO: 113364 - RNA, 23 nt, Human
cuccauauguguaggaaaggaca

SEQ ID NO: 113365 - RNA, 18 nt, Human
cugagacccaggccuggc

SEQ ID NO: 113366 - RNA, 24 nt, Human
uuucccccucucccuccccaaugg

SEQ ID NO: 113367 - RNA, 27 nt, Human
acacuucagagagcugguaguuaguag

SEQ ID NO: 113368 - RNA, 27 nt, Human
cccugcaggaaucagugccucucuccc

SEQ ID NO: 113369 - RNA, 24 nt, Human
gaacaauguagcagccacugucau

SEQ ID NO: 113370 - RNA, 22 nt, Human
aggcugaggaaggaggaucgcu

SEQ ID NO: 113371 - RNA, 21 nt, Human
uggugaggagggugggccuag

SEQ ID NO: 113372 - RNA, 23 nt, Human
ccuccugagcugggauuacaggc

SEQ ID NO: 113373 - RNA, 21 nt, Human
agcugugccucuacugcccug

SEQ ID NO: 113374 - RNA, 22 nt, Human
cuccuccuccuuuccagcagug

SEQ ID NO: 113375 - RNA, 26 nt, Human
gggccuggccuugggguacugcuggc

SEQ ID NO: 113376 - RNA, 21 nt, Human
gacaagaaguuccauuugaug

SEQ ID NO: 113377 - RNA, 27 nt, Human
agagcaucacucuuccucacaccacaa

SEQ ID NO: 113378 - RNA, 21 nt, Human
cugcuucuuuugggugcagug

SEQ ID NO: 113379 - RNA, 22 nt, Human
cacgccugugaucccagcauuu

SEQ ID NO: 113380 - RNA, 27 nt, Human
gggagacgggggcagagagggacccuc

SEQ ID NO: 113381 - RNA, 23 nt, Human
ccggcaggcccugcaguguucgc

SEQ ID NO: 113382 - RNA, 20 nt, Human
ucuguaaccaagauggaugc

SEQ ID NO: 113383 - RNA, 24 nt, Human
gcagcugggaacaugugcaggcug

SEQ ID NO: 113384 - RNA, 22 nt, Human
uucagugagccaagaucgcacc

SEQ ID NO: 113385 - RNA, 22 nt, Human
ugcagugagcugagaucuugcc

SEQ ID NO: 113386 - RNA, 20 nt, Human
agcuuucugcagacuggcag

SEQ ID NO: 113387 - RNA, 20 nt, Human
cugguucuugcaaaugggag

SEQ ID NO: 113388 - RNA, 30 nt, Human
cgggcugacugccccccugccuugcucccc

SEQ ID NO: 113389 - RNA, 20 nt, Human
uucauacguaaaauuuugga

SEQ ID NO: 113390 - RNA, 23 nt, Human
cauccagagcuggagugcagcgg

SEQ ID NO: 113391 - RNA, 24 nt, Human
acaaguguuuacugucgcaguuuc

SEQ ID NO: 113392 - RNA, 20 nt, Human
uuagagcuugagagucaaag

SEQ ID NO: 113393 - RNA, 27 nt, Human
ccaucauucuauuuuuauccaaaagua

SEQ ID NO: 113394 - RNA, 21 nt, Human
gccagcacccccgcugccucc

SEQ ID NO: 113395 - RNA, 21 nt, Human
gugugaggacggcacggccag

SEQ ID NO: 113396 - RNA, 25 nt, Human
uagguucuagguuugaaacagaugc

SEQ ID NO: 113397 - RNA, 23 nt, Human
aaaccagccugccuggucacuga

SEQ ID NO: 113398 - RNA, 27 nt, Human
uuccugccucugcugccaccaucacug

SEQ ID NO: 113399 - RNA, 17 nt, Human
ccuuuuuccuucucccc

SEQ ID NO: 113400 - RNA, 22 nt, Human
cuguggucccagcuacagggga

SEQ ID NO: 113401 - RNA, 23 nt, Human
uuucauugaagcuggaagccauc

SEQ ID NO: 113402 - RNA, 26 nt, Human
caguaccuuauuuguguaucugugau

SEQ ID NO: 113403 - RNA, 27 nt, Human
ccauugcacuccagccugggaaacaag

SEQ ID NO: 113404 - RNA, 19 nt, Human
aaggcauucaucugccauu

SEQ ID NO: 113405 - RNA, 21 nt, Human
ggcugggcucaaagauaaaag

SEQ ID NO: 113406 - RNA, 21 nt, Human
uggguggagcuguggcagggg

SEQ ID NO: 113407 - RNA, 21 nt, Human
acuaagcuaaaacuagagcag

SEQ ID NO: 113408 - RNA, 26 nt, Human
aggcggccagguuugcagugcgggaa

SEQ ID NO: 113409 - RNA, 21 nt, Human
guacaaacccagaaaggguau

SEQ ID NO: 113410 - RNA, 26 nt, Human
cucagcaggacggugaaacaaugaua

SEQ ID NO: 113411 - RNA, 27 nt, Human
cccugcagcucucuuuccucuggggca

SEQ ID NO: 113412 - RNA, 23 nt, Human
uuaugugcaacuguagaaacccu

SEQ ID NO: 113413 - RNA, 25 nt, Human
ugucaacagacugggacagugucug

SEQ ID NO: 113414 - RNA, 24 nt, Human
ugccucgggcuaaucccucccucu

SEQ ID NO: 113415 - RNA, 20 nt, Human
auuucucuuucuucagggcc

SEQ ID NO: 113416 - RNA, 22 nt, Human
gcuaggggcccugaccuggggu

SEQ ID NO: 113417 - RNA, 19 nt, Human
ugaacaauguagucacuug

SEQ ID NO: 113418 - RNA, 23 nt, Human
gccagagaggggcugcucuccag

SEQ ID NO: 113419 - RNA, 21 nt, Human
gguguggagucaaaugugggu

SEQ ID NO: 113420 - RNA, 20 nt, Human
ccuugcccucacugcccacu

SEQ ID NO: 113421 - RNA, 22 nt, Human
cauggcugaguuuauuaguaca

SEQ ID NO: 113422 - RNA, 19 nt, Human
uguucuuugguggcgcuga

SEQ ID NO: 113423 - RNA, 27 nt, Human
uugggaggcugaggugggagaauugcu

SEQ ID NO: 113424 - RNA, 23 nt, Human
aggagcugggccuagggaccugu

SEQ ID NO: 113425 - RNA, 19 nt, Human
uaacgucaugugcaccuuu

SEQ ID NO: 113426 - RNA, 20 nt, Human
cagcucuuccuugagcagcc

SEQ ID NO: 113427 - RNA, 22 nt, Human
cuggggaaacauaacuccaucu

SEQ ID NO: 113428 - RNA, 21 nt, Human
ggaaccguguccagcacagaa

SEQ ID NO: 113429 - RNA, 21 nt, Human
ucccagacugaggacagggga

SEQ ID NO: 113430 - RNA, 30 nt, Human
agacugcggccaacgggaagaaauaaaggg

SEQ ID NO: 113431 - RNA, 27 nt, Human
cuugacagaagcugugacaaccagaaa

SEQ ID NO: 113432 - RNA, 21 nt, Human
aaaugauuuuguuaauucugu

SEQ ID NO: 113433 - RNA, 27 nt, Human
ccacugcagacucgcucuaggaagaac

SEQ ID NO: 113434 - RNA, 27 nt, Human
ccagccugacuagguacaggcaagcuu

SEQ ID NO: 113435 - RNA, 22 nt, Human
auucucacucugcuuugcaucc

SEQ ID NO: 113436 - RNA, 20 nt, Human
ccuguuguauuaaugauggc

SEQ ID NO: 113437 - RNA, 26 nt, Human
cccagcucccaccuccccuugggccc

SEQ ID NO: 113438 - RNA, 25 nt, Human
cugucucccaggcuggagugcuaug

SEQ ID NO: 113439 - RNA, 27 nt, Human
gagaaucacuugaaccugggaggcaga

SEQ ID NO: 113440 - RNA, 25 nt, Human
cuccaggguacaugcuuuaaaaccg

SEQ ID NO: 113441 - RNA, 27 nt, Human
guggauggggaaacagaggcaaaacug

SEQ ID NO: 113442 - RNA, 26 nt, Human
ccugcugcugcugcugcugccucccc

SEQ ID NO: 113443 - RNA, 21 nt, Human
gcaaugagccaagaucgcgcc

SEQ ID NO: 113444 - RNA, 23 nt, Human
ucauccagcugauacacaccuga

SEQ ID NO: 113445 - RNA, 23 nt, Human
acccccacuccucugcugcuguc

SEQ ID NO: 113446 - RNA, 24 nt, Human
cuuugcagacguccccggcguccu

SEQ ID NO: 113447 - RNA, 20 nt, Human
acagcauuuuccugcuccuu

SEQ ID NO: 113448 - RNA, 28 nt, Human
uuucaaaagggugagaacagucuuacau

SEQ ID NO: 113449 - RNA, 22 nt, Human
ucuuggccccugucucucucca

SEQ ID NO: 113450 - RNA, 24 nt, Human
gacccauuuacauggcauucucag

SEQ ID NO: 113451 - RNA, 26 nt, Human
gucuagcccgcuuuguucaguucgga

SEQ ID NO: 113452 - RNA, 29 nt, Human
ucuacuacccucucagucaccauguugca

SEQ ID NO: 113453 - RNA, 27 nt, Human
cagggcccagacucagccaggaaucaa

SEQ ID NO: 113454 - RNA, 26 nt, Human
aaaugauuguuuugcugguuaugcuu

SEQ ID NO: 113455 - RNA, 22 nt, Human
gcauuggaacaaaagagcauua

SEQ ID NO: 113456 - RNA, 22 nt, Human
auuggggggaggugcuguggga

SEQ ID NO: 113457 - RNA, 27 nt, Human
ccauccuggucccaguguuaggguagc

SEQ ID NO: 113458 - RNA, 22 nt, Human
gagcaucccacccacaugcccu

SEQ ID NO: 113459 - RNA, 16 nt, Human
gugaugaaaauggcag

SEQ ID NO: 113460 - RNA, 25 nt, Human
gcucuggcccaggcuagagugcagu

SEQ ID NO: 113461 - RNA, 24 nt, Human
ggcccagaugacaaccucuccuuc

SEQ ID NO: 113462 - RNA, 27 nt, Human
ccuguucugccccagcuguuccuccuc

SEQ ID NO: 113463 - RNA, 24 nt, Human
cccaccccacuucgccugccgcgg

SEQ ID NO: 113464 - RNA, 20 nt, Human
uuacuugguaaagugcagug

SEQ ID NO: 113465 - RNA, 25 nt, Human
ccugcugcugccgcaguccugccag

SEQ ID NO: 113466 - RNA, 24 nt, Human
cugaaaaaucugguucauucuuca

SEQ ID NO: 113467 - RNA, 22 nt, Human
caguguugagaacuaccuggau

SEQ ID NO: 113468 - RNA, 22 nt, Human
ggcccaggcugaucggugucgg

SEQ ID NO: 113469 - RNA, 19 nt, Human
caccgcaaccucugccucc

SEQ ID NO: 113470 - RNA, 20 nt, Human
auuuuucuuucuucuucuuc

SEQ ID NO: 113471 - RNA, 21 nt, Human
gaucccuucaauucuaaaggg

SEQ ID NO: 113472 - RNA, 22 nt, Human
gagcgggacgcaguucucggac

SEQ ID NO: 113473 - RNA, 21 nt, Human
gggagcugugguaaggguugg

SEQ ID NO: 113474 - RNA, 27 nt, Human
cccuucagucuuaauacuuuaugaugc

SEQ ID NO: 113475 - RNA, 22 nt, Human
cucccagagucucuuuagggau

SEQ ID NO: 113476 - RNA, 20 nt, Human
uccguugcagccucccuucc

SEQ ID NO: 113477 - RNA, 22 nt, Human
ucuaaaaugucagcaucaugca

SEQ ID NO: 113478 - RNA, 22 nt, Human
uggcagagacaggagagguaga

SEQ ID NO: 113479 - RNA, 22 nt, Human
caguauauugguugugcuuuau

SEQ ID NO: 113480 - RNA, 21 nt, Human
cugaaaacucuauguccggcu

SEQ ID NO: 113481 - RNA, 20 nt, Human
gcgggcuucucuugcucuga

SEQ ID NO: 113482 - RNA, 22 nt, Human
ggugcugcgaggggaaggaaaa

SEQ ID NO: 113483 - RNA, 18 nt, Human
cacguuaucucagggcuu

SEQ ID NO: 113484 - RNA, 21 nt, Human
gaguuugaaaccuaccuaggc

SEQ ID NO: 113485 - RNA, 22 nt, Human
gccucccagguugaagcgauuc

SEQ ID NO: 113486 - RNA, 20 nt, Human
cucccucccuccugccccgg

SEQ ID NO: 113487 - RNA, 22 nt, Human
cuuuucaggcucauuuguacuc

SEQ ID NO: 113488 - RNA, 23 nt, Human
uccacugcucgcugccucuccag

SEQ ID NO: 113489 - RNA, 23 nt, Human
aaagcugcaagaauggcacuuuu

SEQ ID NO: 113490 - RNA, 22 nt, Human
cucucaucgucuuuuaguucca

SEQ ID NO: 113491 - RNA, 23 nt, Human
uuccaauuucuuauugcauauca

SEQ ID NO: 113492 - RNA, 24 nt, Human
acgcagcuuccuucaaguacacug

SEQ ID NO: 113493 - RNA, 24 nt, Human
gggugccuguaaucccagcuacuc

SEQ ID NO: 113494 - RNA, 24 nt, Human
gggugccuguaauccuagcuacuu

SEQ ID NO: 113495 - RNA, 26 nt, Human
aucagcaacccuuccugcugcugcua

SEQ ID NO: 113496 - RNA, 26 nt, Human
ugggaggcgaagggggcaggccaggg

SEQ ID NO: 113497 - RNA, 25 nt, Human
augagagggugggagggcccaggga

SEQ ID NO: 113498 - RNA, 20 nt, Human
gcugccugccugucugucuc

SEQ ID NO: 113499 - RNA, 24 nt, Human
gcugaggcugccugggaggcccgg

SEQ ID NO: 113500 - RNA, 30 nt, Human
guggcugucacgaagcagaguuggcacaua

SEQ ID NO: 113501 - RNA, 23 nt, Human
gcucacauccuccugggugaaga

SEQ ID NO: 113502 - RNA, 20 nt, Human
guccucuggcagaacagaug

SEQ ID NO: 113503 - RNA, 20 nt, Human
augaagagcgcugugccagu

SEQ ID NO: 113504 - RNA, 26 nt, Human
uucaugguuuuuccugccaaaccaga

SEQ ID NO: 113505 - RNA, 22 nt, Human
acucuuugcaacagcacuugcu

SEQ ID NO: 113506 - RNA, 21 nt, Human
cugccuaccugggccuggcca

SEQ ID NO: 113507 - RNA, 21 nt, Human
ccucugccucaucucacacug

SEQ ID NO: 113508 - RNA, 23 nt, Human
uuacugcacuuucugaccaggag

SEQ ID NO: 113509 - RNA, 22 nt, Human
gagugagacccugucucaaaag

SEQ ID NO: 113510 - RNA, 24 nt, Human
agagaggugguggaauaggaccgc

SEQ ID NO: 113511 - RNA, 26 nt, Human
uugguuauccugauuugcaaagugau

SEQ ID NO: 113512 - RNA, 24 nt, Human
auuacugacuccgguuccacacac

SEQ ID NO: 113513 - RNA, 21 nt, Human
uucuauuuucuucuauuucag

SEQ ID NO: 113514 - RNA, 26 nt, Human
gccuucaugccuuccccacccuccag

SEQ ID NO: 113515 - RNA, 18 nt, Human
gcacagauacacauacac

SEQ ID NO: 113516 - RNA, 22 nt, Human
gagggcggggcauguugggaga

SEQ ID NO: 113517 - RNA, 26 nt, Human
ccuuucucccugcgggccaggcacug

SEQ ID NO: 113518 - RNA, 18 nt, Human
uuuggcauuucauucaua

SEQ ID NO: 113519 - RNA, 26 nt, Human
agcauuuucggcaaccgcugcuggca

SEQ ID NO: 113520 - RNA, 23 nt, Human
ccacaguccuucuuugacaccac

SEQ ID NO: 113521 - RNA, 21 nt, Human
gguugcuaagucaggugcaga

SEQ ID NO: 113522 - RNA, 17 nt, Human
guaacaacagagacuuu

SEQ ID NO: 113523 - RNA, 23 nt, Human
cuaccugcccuugggcucacuaa

SEQ ID NO: 113524 - RNA, 22 nt, Human
gugggcugagagguagagggug

SEQ ID NO: 113525 - RNA, 28 nt, Human
gcuguuugguuugcauauguuuuagcuu

SEQ ID NO: 113526 - RNA, 23 nt, Human
aaauguggcuccucuggagcuug

SEQ ID NO: 113527 - RNA, 19 nt, Human
cugcugccccgucucccac

SEQ ID NO: 113528 - RNA, 20 nt, Human
cucaaccucucgugacugcc

SEQ ID NO: 113529 - RNA, 20 nt, Human
ucugagccuccaucauuguc

SEQ ID NO: 113530 - RNA, 25 nt, Human
ucagcuccuagaguggaaccaggaa

SEQ ID NO: 113531 - RNA, 24 nt, Human
uagaagccugucucuguaccucua

SEQ ID NO: 113532 - RNA, 22 nt, Human
agagaaaccuggugauauugcc

SEQ ID NO: 113533 - RNA, 24 nt, Human
ccuguucucccaguuugcuuucca

SEQ ID NO: 113534 - RNA, 23 nt, Human
aaauagaaucagauuaucucuuu

SEQ ID NO: 113535 - RNA, 22 nt, Human
uucauuucauggugacugaccc

SEQ ID NO: 113536 - RNA, 23 nt, Human
aacacccuucuggcccucagucu

SEQ ID NO: 113537 - RNA, 23 nt, Human
gugaucauucaggguucaucuca

SEQ ID NO: 113538 - RNA, 23 nt, Human
cuucgucuucgcuuuucuuucua

SEQ ID NO: 113539 - RNA, 20 nt, Human
ugucuucuauggcauguaau

SEQ ID NO: 113540 - RNA, 24 nt, Human
cucuacuacuugaaugauuuugga

SEQ ID NO: 113541 - RNA, 26 nt, Human
uacagacuaaagauugcagcauuuau

SEQ ID NO: 113542 - RNA, 22 nt, Human
cacucacccucucugugcuguc

SEQ ID NO: 113543 - RNA, 22 nt, Human
ugauaacgcccguggugcccca

SEQ ID NO: 113544 - RNA, 21 nt, Human
aggcccagcccagagcugugu

SEQ ID NO: 113545 - RNA, 22 nt, Human
cagcacaaacauugcugccuuu

SEQ ID NO: 113546 - RNA, 26 nt, Human
cuucugucuguuuuuccuuccucuug

SEQ ID NO: 113547 - RNA, 24 nt, Human
aggacaaagucuccagcccacguu

SEQ ID NO: 113548 - RNA, 20 nt, Human
cucuuuauccuuagaagaac

SEQ ID NO: 113549 - RNA, 22 nt, Human
acugacucaagacacugagaua

SEQ ID NO: 113550 - RNA, 21 nt, Human
gggaggcggagguugcagcga

SEQ ID NO: 113551 - RNA, 22 nt, Human
guuuuaaaaacauagugucuuc

SEQ ID NO: 113552 - RNA, 21 nt, Human
gcguccacuuucuucuucgcc

SEQ ID NO: 113553 - RNA, 24 nt, Human
uuugccgauuuccuaagcuguugg

SEQ ID NO: 113554 - RNA, 20 nt, Human
aaaacugaauacacugcaaa

SEQ ID NO: 113555 - RNA, 32 nt, Human
gugggaggaugguggucagagccaggaguaug

SEQ ID NO: 113556 - RNA, 24 nt, Human
gcagucgcucuacaaccaccugcg

SEQ ID NO: 113557 - RNA, 25 nt, Human
gccuuacaguccaaccuuuuucugu

SEQ ID NO: 113558 - RNA, 20 nt, Human
ugucauuguuguugcccaga

SEQ ID NO: 113559 - RNA, 20 nt, Human
ggggcagccucugggcccac

SEQ ID NO: 113560 - RNA, 30 nt, Human
ccaacacagguuuuggcaucuuuugugcug

SEQ ID NO: 113561 - RNA, 26 nt, Human
ccagugcuacuugggccagcgggguu

SEQ ID NO: 113562 - RNA, 20 nt, Human
uauuccuuuacucaaaagau

SEQ ID NO: 113563 - RNA, 19 nt, Human
ccccugcccuccuggagcc

SEQ ID NO: 113564 - RNA, 23 nt, Human
cugaggcaaucaugauugauugu

SEQ ID NO: 113565 - RNA, 26 nt, Human
ggcuccuuagacgacagacuaccuca

SEQ ID NO: 113566 - RNA, 23 nt, Human
ccaggagauauuugggaaaugug

SEQ ID NO: 113567 - RNA, 22 nt, Human
uucugaccaaucacugagucag

SEQ ID NO: 113568 - RNA, 22 nt, Human
uauggggcugugggcagcagac

SEQ ID NO: 113569 - RNA, 21 nt, Human
uuccugagcccccacccccaa

SEQ ID NO: 113570 - RNA, 21 nt, Human
aaucuguuucuggccugauuc

SEQ ID NO: 113571 - RNA, 19 nt, Human
acagauuucaggcugcaaa

SEQ ID NO: 113572 - RNA, 24 nt, Human
gcuucuauuuuccacacuggacau

SEQ ID NO: 113573 - RNA, 24 nt, Human
auuguguuaucacucugccugugu

SEQ ID NO: 113574 - RNA, 20 nt, Human
caaucauugucuucauucca

SEQ ID NO: 113575 - RNA, 22 nt, Human
ggaagccgggguaggaggauca

SEQ ID NO: 113576 - RNA, 25 nt, Human
gaguuugcagggugcugagcuguau

SEQ ID NO: 113577 - RNA, 16 nt, Human
cugcagaauggucgca

SEQ ID NO: 113578 - RNA, 23 nt, Human
gauuuccuuucugcuucuguucc

SEQ ID NO: 113579 - RNA, 25 nt, Human
aagaugugauuugcaaacuccuugu

SEQ ID NO: 113580 - RNA, 19 nt, Human
cagaggaggggacggcagc

SEQ ID NO: 113581 - RNA, 26 nt, Human
acagaaguaccugaaacuaggucugg

SEQ ID NO: 113582 - RNA, 17 nt, Human
uuuuguaaucuacuuug

SEQ ID NO: 113583 - RNA, 22 nt, Human
uugcagaauggugccuguggca

SEQ ID NO: 113584 - RNA, 26 nt, Human
cugagccuuugucuauuguguuccug

SEQ ID NO: 113585 - RNA, 26 nt, Human
ggaccucgcuacacacccgacgacac

SEQ ID NO: 113586 - RNA, 21 nt, Human
cuaaaaugaagacucugcagu

SEQ ID NO: 113587 - RNA, 20 nt, Human
acuguaauacuucuuuguua

SEQ ID NO: 113588 - RNA, 21 nt, Human
ccucuuccuaaaauuaggcag

SEQ ID NO: 113589 - RNA, 22 nt, Human
ccuccucucucccugccucaca

SEQ ID NO: 113590 - RNA, 23 nt, Human
cuccugccucuguugccaacacg

SEQ ID NO: 113591 - RNA, 19 nt, Human
acccccacucugcauaccc

SEQ ID NO: 113592 - RNA, 21 nt, Human
ccuucucucaucucuuagcuc

SEQ ID NO: 113593 - RNA, 22 nt, Human
uucuccuucccaggaaggucuu

SEQ ID NO: 113594 - RNA, 27 nt, Human
gcacagcccuagcucaggccacugggc

SEQ ID NO: 113595 - RNA, 24 nt, Human
uauucauucuuuucugcuuuucca

SEQ ID NO: 113596 - RNA, 19 nt, Human
agagaacugcaacugaaug

SEQ ID NO: 113597 - RNA, 22 nt, Human
caaaccugcagacugcuuuuug

SEQ ID NO: 113598 - RNA, 19 nt, Human
cccugcucucuucugagcc

SEQ ID NO: 113599 - RNA, 26 nt, Human
auccagagugauucuaguugggagag

SEQ ID NO: 113600 - RNA, 26 nt, Human
ccaguuauucuuucugcaucuuguag

SEQ ID NO: 113601 - RNA, 22 nt, Human
ugugugccugacaccacgcugg

SEQ ID NO: 113602 - RNA, 22 nt, Human
ucaguuucagauccugaucuua

SEQ ID NO: 113603 - RNA, 27 nt, Human
agcauagugcugugucauccuggucca

SEQ ID NO: 113604 - RNA, 22 nt, Human
uuuaguuuugggauauuacaaa

SEQ ID NO: 113605 - RNA, 24 nt, Human
augguaccugcuccagugccgcgu

SEQ ID NO: 113606 - RNA, 21 nt, Human
gcucacugccuccugcccuuc

SEQ ID NO: 113607 - RNA, 28 nt, Human
aggaaaauagacagaaugauuuccaaaa

SEQ ID NO: 113608 - RNA, 26 nt, Human
ccaguuacacuugaauuaagaucugc

SEQ ID NO: 113609 - RNA, 22 nt, Human
gagcgagauucugucucaaaaa

SEQ ID NO: 113610 - RNA, 24 nt, Human
ccuacucuauucagauauucucca

SEQ ID NO: 113611 - RNA, 20 nt, Human
ccggcauccccaccugcugc

SEQ ID NO: 113612 - RNA, 21 nt, Human
guugggggagagaagggcagc

SEQ ID NO: 113613 - RNA, 25 nt, Human
ugcugcucuggagugcaagcccucu

SEQ ID NO: 113614 - RNA, 17 nt, Human
ccucauuccucacgccg

SEQ ID NO: 113615 - RNA, 25 nt, Human
ucucucuccccugcacuagcugucc

SEQ ID NO: 113616 - RNA, 23 nt, Human
uggacuuugaacauuuucugaac

SEQ ID NO: 113617 - RNA, 21 nt, Human
cuuacaccaguuugacugugc

SEQ ID NO: 113618 - RNA, 26 nt, Human
ugacuccagcagcaccagcugcucuc

SEQ ID NO: 113619 - RNA, 18 nt, Human
gcugcugcuuucugagcc

SEQ ID NO: 113620 - RNA, 20 nt, Human
ugcuucuccccuuugucauc

SEQ ID NO: 113621 - RNA, 21 nt, Human
ucgcccaccugcacagcuccc

SEQ ID NO: 113622 - RNA, 21 nt, Human
agacuuuuguacaucuggcuu

SEQ ID NO: 113623 - RNA, 22 nt, Human
uucuccucugcugcagcaugau

SEQ ID NO: 113624 - RNA, 22 nt, Human
ccgcuggcaggaaacaauucug

SEQ ID NO: 113625 - RNA, 21 nt, Human
cagaaauuggguuuugguuca

SEQ ID NO: 113626 - RNA, 22 nt, Human
ugugucccaggcuggagugcag

SEQ ID NO: 113627 - RNA, 21 nt, Human
uucucuugaauauguauuaaa

SEQ ID NO: 113628 - RNA, 22 nt, Human
ugcccaggcuggaguacaaugg

SEQ ID NO: 113629 - RNA, 29 nt, Human
gcgaucuggcaucuucucccacaagcccc

SEQ ID NO: 113630 - RNA, 24 nt, Human
uugcacuuucuguuaucagggccc

SEQ ID NO: 113631 - RNA, 23 nt, Human
ugaaugcugcuuucugcuuagua

SEQ ID NO: 113632 - RNA, 27 nt, Human
cccugccccuucuacacucuccugggc

SEQ ID NO: 113633 - RNA, 22 nt, Human
cuggcuucccgcagacgacuuu

SEQ ID NO: 113634 - RNA, 22 nt, Human
aacauugacaguccuccuggcu

SEQ ID NO: 113635 - RNA, 20 nt, Human
cuucuuucugcccuccagau

SEQ ID NO: 113636 - RNA, 21 nt, Human
uggaaauguguuuuucuucaa

SEQ ID NO: 113637 - RNA, 29 nt, Human
cugccuuuucugugccuaguuuuuggcuc

SEQ ID NO: 113638 - RNA, 20 nt, Human
cccagguugcaacaggaugg

SEQ ID NO: 113639 - RNA, 24 nt, Human
ucuucuuuuucuuggcuguggugc

SEQ ID NO: 113640 - RNA, 27 nt, Human
uggaaaaguuauuuuauaaauaugugc

SEQ ID NO: 113641 - RNA, 22 nt, Human
gaccucgugauccgcccgccuc

SEQ ID NO: 113642 - RNA, 21 nt, Human
gcuauaaaaagaacuguucca

SEQ ID NO: 113643 - RNA, 27 nt, Human
aacuugucacgaauuccaucuuguaaa

SEQ ID NO: 113644 - RNA, 26 nt, Human
cuuuguuguuucuuaauuuggaaacu

SEQ ID NO: 113645 - RNA, 15 nt, Human
uugccuggugcagug

SEQ ID NO: 113646 - RNA, 27 nt, Human
cagaucugucuccaagaccuuggccuc

SEQ ID NO: 113647 - RNA, 23 nt, Human
agacccuggguguucagacccca

SEQ ID NO: 113648 - RNA, 25 nt, Human
acgagggccagggcuucugccugaa

SEQ ID NO: 113649 - RNA, 21 nt, Human
aucugaagugguucagucuag

SEQ ID NO: 113650 - RNA, 26 nt, Human
ugcccacaccugccucugaacugcug

SEQ ID NO: 113651 - RNA, 27 nt, Human
ccgcugcacuccagccugggggacaga

SEQ ID NO: 113652 - RNA, 21 nt, Human
uuguccaggcuggucucgaac

SEQ ID NO: 113653 - RNA, 26 nt, Human
acucacugauuccuacacauugccaa

SEQ ID NO: 113654 - RNA, 28 nt, Human
ugggcaaggcccaggaaucuggagcauc

SEQ ID NO: 113655 - RNA, 21 nt, Human
cccucccagaaccucagcauu

SEQ ID NO: 113656 - RNA, 24 nt, Human
ugccccaccaggagcucagcucug

SEQ ID NO: 113657 - RNA, 23 nt, Human
ggaaaguuucagcucacugugaa

SEQ ID NO: 113658 - RNA, 20 nt, Human
ugccaggaaguauuuccaua

SEQ ID NO: 113659 - RNA, 27 nt, Human
gaccuccagggaaucagaaaggcacua

SEQ ID NO: 113660 - RNA, 23 nt, Human
uucuguuuguuuaagcugagcca

SEQ ID NO: 113661 - RNA, 20 nt, Human
ccgccacccuugcccccuca

SEQ ID NO: 113662 - RNA, 22 nt, Human
uauaaacacuggaaacgcuggg

SEQ ID NO: 113663 - RNA, 24 nt, Human
uuuugucuaaaaugccucagugua

SEQ ID NO: 113664 - RNA, 23 nt, Human
uguauuguucauccagcaaccag

SEQ ID NO: 113665 - RNA, 19 nt, Human
cucuuacauaauguauuua

SEQ ID NO: 113666 - RNA, 23 nt, Human
aguaacuguucccaucuccuuua

SEQ ID NO: 113667 - RNA, 18 nt, Human
cuaacaucccuuucuucc

SEQ ID NO: 113668 - RNA, 21 nt, Human
gcaccaacagguccagaguau

SEQ ID NO: 113669 - RNA, 24 nt, Human
cugaggauggcagggcuggaaggg

SEQ ID NO: 113670 - RNA, 24 nt, Human
ggaggcagaggaagagggagcggg

SEQ ID NO: 113671 - RNA, 24 nt, Human
gcucccucaaucuucacccacuag

SEQ ID NO: 113672 - RNA, 24 nt, Human
cuuggaaaccugcccugccugagg

SEQ ID NO: 113673 - RNA, 24 nt, Human
ugacugaguacaaacugguggugg

SEQ ID NO: 113674 - RNA, 22 nt, Human
acucucugcucugcuguuacuc

SEQ ID NO: 113675 - RNA, 25 nt, Human
ggaaggaagaagggagccgaggacg

SEQ ID NO: 113676 - RNA, 21 nt, Human
gugugcuaaaucucucugccu

SEQ ID NO: 113677 - RNA, 19 nt, Human
guagaaucucagcacuuug

SEQ ID NO: 113678 - RNA, 22 nt, Human
cucugcccucuccagaggugcc

SEQ ID NO: 113679 - RNA, 24 nt, Human
cagcaccaaaucaaaaucucucca

SEQ ID NO: 113680 - RNA, 22 nt, Human
ccccacggccccuacaggcugg

SEQ ID NO: 113681 - RNA, 21 nt, Human
aggacaggcaagccagcucug

SEQ ID NO: 113682 - RNA, 19 nt, Human
cugcaagcagaggugguga

SEQ ID NO: 113683 - RNA, 21 nt, Human
agcucacaccugaaaucuuag

SEQ ID NO: 113684 - RNA, 23 nt, Human
uuucuuucuuucuuucacaugac

SEQ ID NO: 113685 - RNA, 24 nt, Human
acucagcuguucuuucuagcucug

SEQ ID NO: 113686 - RNA, 23 nt, Human
accuggcacuuuacaaacaaaua

SEQ ID NO: 113687 - RNA, 25 nt, Human
gggcucaaaugauccucccaccuca

SEQ ID NO: 113688 - RNA, 27 nt, Human
ugucuuugcucuuucugaugcucucaa

SEQ ID NO: 113689 - RNA, 24 nt, Human
ugcugcguguccaucaucagcuga

SEQ ID NO: 113690 - RNA, 22 nt, Human
aacagcucugggucccuguuuu

SEQ ID NO: 113691 - RNA, 22 nt, Human
ucauauauauacacaccuacac

SEQ ID NO: 113692 - RNA, 28 nt, Human
cgugugggacucacagguguagucgccg

SEQ ID NO: 113693 - RNA, 25 nt, Human
cagagagaagggagugggugggcag

SEQ ID NO: 113694 - RNA, 22 nt, Human
cugaguaucucgaguuguggca

SEQ ID NO: 113695 - RNA, 23 nt, Human
aguucaaagcuguagugagcugu

SEQ ID NO: 113696 - RNA, 21 nt, Human
uacaucccacagagauaccca

SEQ ID NO: 113697 - RNA, 20 nt, Human
gcccagcugacuccacuacu

SEQ ID NO: 113698 - RNA, 21 nt, Human
augaacaucuauaaaauguau

SEQ ID NO: 113699 - RNA, 21 nt, Human
uuguauauacacacugcagca

SEQ ID NO: 113700 - RNA, 27 nt, Human
cacugcugccaccucucacacgcccca

SEQ ID NO: 113701 - RNA, 27 nt, Human
gggaggcggaggagguugcagugaacu

SEQ ID NO: 113702 - RNA, 21 nt, Human
gguggggaagaaaguguccau

SEQ ID NO: 113703 - RNA, 19 nt, Human
uuugccucccacugacugc

SEQ ID NO: 113704 - RNA, 22 nt, Human
aagcuacaguuccuucucucca

SEQ ID NO: 113705 - RNA, 27 nt, Human
gacgguugguugugugucugugcucgu

SEQ ID NO: 113706 - RNA, 22 nt, Human
cggaggguggaaggcagcuucc

SEQ ID NO: 113707 - RNA, 23 nt, Human
ucggcagccuuuggucaguuggc

SEQ ID NO: 113708 - RNA, 26 nt, Human
gcacagcccaggcaccuuaugguuau

SEQ ID NO: 113709 - RNA, 19 nt, Human
caaccaaaacaucaauguu

SEQ ID NO: 113710 - RNA, 21 nt, Human
cuggaguugugcacagcaccg

SEQ ID NO: 113711 - RNA, 23 nt, Human
cuucaacaacuuugugcuuuccu

SEQ ID NO: 113712 - RNA, 22 nt, Human
uuuccccucacccuccaagucc

SEQ ID NO: 113713 - RNA, 21 nt, Human
uuucuuuuuaaaugcaaaacc

SEQ ID NO: 113714 - RNA, 24 nt, Human
guugcuugaaccaaaggguugcau

SEQ ID NO: 113715 - RNA, 26 nt, Human
gcacaugcaauuuggguuuuagagaa

SEQ ID NO: 113716 - RNA, 23 nt, Human
auuuuucuaauuaaagaauccua

SEQ ID NO: 113717 - RNA, 24 nt, Human
caccuugccaaagcacuuacacca

SEQ ID NO: 113718 - RNA, 24 nt, Human
ccauggagacagguagcauuugua

SEQ ID NO: 113719 - RNA, 27 nt, Human
ggggaaagcaagagacuugcgcgcacg

SEQ ID NO: 113720 - RNA, 27 nt, Human
ggugcagaugccugcagugccauuaaa

SEQ ID NO: 113721 - RNA, 31 nt, Human
aggaaaguggcaccugucugcuccagcucug

SEQ ID NO: 113722 - RNA, 21 nt, Human
uccagggucucagaugguuag

SEQ ID NO: 113723 - RNA, 25 nt, Human
gcauaagggcuucuggaacccagaa

SEQ ID NO: 113724 - RNA, 20 nt, Human
uuucaauaaaagugaagaca

SEQ ID NO: 113725 - RNA, 22 nt, Human
gcugcugcucugcaaaauucag

SEQ ID NO: 113726 - RNA, 22 nt, Human
ggaggggcccagcagggccaac

SEQ ID NO: 113727 - RNA, 26 nt, Human
ucccaaaccuaauucuuguagaugca

SEQ ID NO: 113728 - RNA, 22 nt, Human
cccucuauuucucucuuucuug

SEQ ID NO: 113729 - RNA, 22 nt, Human
auaagcaaaaggaaacccagaa

SEQ ID NO: 113730 - RNA, 18 nt, Human
accuguauacagugcaga

SEQ ID NO: 113731 - RNA, 23 nt, Human
cagccucgggcccuccugccugc

SEQ ID NO: 113732 - RNA, 21 nt, Human
ugagccaauaucgugccacug

SEQ ID NO: 113733 - RNA, 21 nt, Human
aacuguggagauuugagggaa

SEQ ID NO: 113734 - RNA, 27 nt, Human
cagcgggaugugugccccuccuccucc

SEQ ID NO: 113735 - RNA, 27 nt, Human
ccgggcaugucugccuggagugcugug

SEQ ID NO: 113736 - RNA, 21 nt, Human
cgggagacagagguugcagug

SEQ ID NO: 113737 - RNA, 23 nt, Human
uuuggcuucaucuuucucuugug

SEQ ID NO: 113738 - RNA, 22 nt, Human
gccggcucccccagacucagag

SEQ ID NO: 113739 - RNA, 25 nt, Human
gugcuuugugaucuguucaguguca

SEQ ID NO: 113740 - RNA, 18 nt, Human
cuauuuuuauacucuucc

SEQ ID NO: 113741 - RNA, 24 nt, Human
gagggagccgcacgcggcccaggg

SEQ ID NO: 113742 - RNA, 23 nt, Human
agcaggaguugauacaccaccuu

SEQ ID NO: 113743 - RNA, 22 nt, Human
gcucacugcaaccuccaacucc

SEQ ID NO: 113744 - RNA, 30 nt, Human
gaguaugcaaugcuaucacugucuuugacu

SEQ ID NO: 113745 - RNA, 19 nt, Human
acguucuugucuguguaca

SEQ ID NO: 113746 - RNA, 17 nt, Human
aauaagaaacuuaggga

SEQ ID NO: 113747 - RNA, 20 nt, Human
guuucuugagcuagaccaag

SEQ ID NO: 113748 - RNA, 25 nt, Human
ccaaugccuccaccucuuggaccag

SEQ ID NO: 113749 - RNA, 25 nt, Human
cugagauaguuccuaauucaucaac

SEQ ID NO: 113750 - RNA, 29 nt, Human
uuucuguguacaguaaggcagcaugcuaa

SEQ ID NO: 113751 - RNA, 23 nt, Human
ccaugugaguccugcaacacuaa

SEQ ID NO: 113752 - RNA, 22 nt, Human
cugagggggugggggugcugcu

SEQ ID NO: 113753 - RNA, 24 nt, Human
acaccguuuccuguugcucaggga

SEQ ID NO: 113754 - RNA, 24 nt, Human
guuaggaguacggagauggagauu

SEQ ID NO: 113755 - RNA, 26 nt, Human
cccaagucgcagccaugaacuaccug

SEQ ID NO: 113756 - RNA, 27 nt, Human
gaaggggcuauccugggaccuccccag

SEQ ID NO: 113757 - RNA, 27 nt, Human
uugcccaggucaggaguguuuucuugg

SEQ ID NO: 113758 - RNA, 21 nt, Human
uacuuguaacccagcacuuug

SEQ ID NO: 113759 - RNA, 26 nt, Human
ggcgccggcggaggaggaggugguga

SEQ ID NO: 113760 - RNA, 26 nt, Human
ccucuaccuccuggguucaagcaaau

SEQ ID NO: 113761 - RNA, 21 nt, Human
agaugcugggugacagagcca

SEQ ID NO: 113762 - RNA, 27 nt, Human
ucccugccucugccgagaucaaaugga

SEQ ID NO: 113763 - RNA, 21 nt, Human
ccagaagagaggagugggaca

SEQ ID NO: 113764 - RNA, 25 nt, Human
aaaccuugaacauuuuacaagaagu

SEQ ID NO: 113765 - RNA, 22 nt, Human
ugcuguagugccuucugcgcca

SEQ ID NO: 113766 - RNA, 20 nt, Human
acccgcaaccuccuuccccg

SEQ ID NO: 113767 - RNA, 19 nt, Human
ggaugcacacggaugacag

SEQ ID NO: 113768 - RNA, 22 nt, Human
aggcugaggaguugcccuuugc

SEQ ID NO: 113769 - RNA, 23 nt, Human
ggauggacauaaaggaaaaagag

SEQ ID NO: 113770 - RNA, 23 nt, Human
ggaccgggagagagggggcgcgg

SEQ ID NO: 113771 - RNA, 26 nt, Human
ugcucucggaggccagggaagauggu

SEQ ID NO: 113772 - RNA, 21 nt, Human
cacauugccuugagcuuuuca

SEQ ID NO: 113773 - RNA, 21 nt, Human
cucgcgcgccucucccuacca

SEQ ID NO: 113774 - RNA, 21 nt, Human
ucaagagccuuaaaacaucau

SEQ ID NO: 113775 - RNA, 23 nt, Human
cuagagccccacccaguccgggg

SEQ ID NO: 113776 - RNA, 27 nt, Human
gggucacaucaaccgccagaaguggag

SEQ ID NO: 113777 - RNA, 24 nt, Human
ugagagacacaaggcuuuguuugc

SEQ ID NO: 113778 - RNA, 26 nt, Human
uccccaggcucacaguguagagacau

SEQ ID NO: 113779 - RNA, 20 nt, Human
cgacuuaaucauggcuguuc

SEQ ID NO: 113780 - RNA, 23 nt, Human
gucucccuuucccugucuggcuu

SEQ ID NO: 113781 - RNA, 26 nt, Human
aacagauuaacaaucaacugcauaaa

SEQ ID NO: 113782 - RNA, 21 nt, Human
ccauuuacgcaugcagcagga

SEQ ID NO: 113783 - RNA, 27 nt, Human
gccuuucucucgccugccuucugagcu

SEQ ID NO: 113784 - RNA, 26 nt, Human
cuaucuccagauacaugucaaaaaga

SEQ ID NO: 113785 - RNA, 29 nt, Human
uccagccaggcuucauuuaugcacuugug

SEQ ID NO: 113786 - RNA, 21 nt, Human
gcccuucccccucccucaucc

SEQ ID NO: 113787 - RNA, 26 nt, Human
aagaggccuuugaagagaccccuaag

SEQ ID NO: 113788 - RNA, 24 nt, Human
uguaauaaaggucuucugacauga

SEQ ID NO: 113789 - RNA, 19 nt, Human
ccaaagcaucccaaggaac

SEQ ID NO: 113790 - RNA, 23 nt, Human
ugcaccugcugucuucagcucuu

SEQ ID NO: 113791 - RNA, 27 nt, Human
aaugaugaguccucucuggucagacau

SEQ ID NO: 113792 - RNA, 20 nt, Human
ucuacuugaauacucucaca

SEQ ID NO: 113793 - RNA, 26 nt, Human
gcugccucucugcuccaccuugugac

SEQ ID NO: 113794 - RNA, 26 nt, Human
aaaggaagaagaaaagaaaagcugug

SEQ ID NO: 113795 - RNA, 21 nt, Human
uguuuuuagaccaauuuuuua

SEQ ID NO: 113796 - RNA, 25 nt, Human
guccccggcuggagcccagcgcccc

SEQ ID NO: 113797 - RNA, 25 nt, Human
ggcugcccugucaccucagcauucu

SEQ ID NO: 113798 - RNA, 22 nt, Human
gcaugagccacugugccuggcc

SEQ ID NO: 113799 - RNA, 22 nt, Human
gugugagccacugugcccagcc

SEQ ID NO: 113800 - RNA, 20 nt, Human
cucauucaagaaggcauaca

SEQ ID NO: 113801 - RNA, 21 nt, Human
acgacagcucuguaucugcca

SEQ ID NO: 113802 - RNA, 26 nt, Human
uuucucagucuugcugucuguuguug

SEQ ID NO: 113803 - RNA, 21 nt, Human
aaccccuggccucaagcaauc

SEQ ID NO: 113804 - RNA, 26 nt, Human
cucacgccauucuccugccucagccu

SEQ ID NO: 113805 - RNA, 26 nt, Human
guagggcugaaggccgcccgagguuc

SEQ ID NO: 113806 - RNA, 27 nt, Human
ggcugcggcugacaaagggcucgcgcc

SEQ ID NO: 113807 - RNA, 23 nt, Human
agccauguuaauguaaucugaug

SEQ ID NO: 113808 - RNA, 22 nt, Human
uuccguguguguccaguuuaca

SEQ ID NO: 113809 - RNA, 23 nt, Human
ccuacaugguugaaaccccaucu

SEQ ID NO: 113810 - RNA, 19 nt, Human
augauccuggaaauugcag

SEQ ID NO: 113811 - RNA, 26 nt, Human
gcuccuccugcccagcuuccuaugca

SEQ ID NO: 113812 - RNA, 23 nt, Human
ugaaaacagauauucuggcccag

SEQ ID NO: 113813 - RNA, 18 nt, Human
ccuacagcuacauugaga

SEQ ID NO: 113814 - RNA, 22 nt, Human
cgcuaucucccugccuccugcc

SEQ ID NO: 113815 - RNA, 17 nt, Human
agcuauucuacugccuc

SEQ ID NO: 113816 - RNA, 27 nt, Human
gacacccuucaugggcucgugagcaca

SEQ ID NO: 113817 - RNA, 27 nt, Human
gaggaagagaagcccagcucugggaac

SEQ ID NO: 113818 - RNA, 22 nt, Human
ggguccugaggccaagaaagaa

SEQ ID NO: 113819 - RNA, 21 nt, Human
ucuguccuucuucuggaagag

SEQ ID NO: 113820 - RNA, 21 nt, Human
cuguauccagccuuuccuugc

SEQ ID NO: 113821 - RNA, 24 nt, Human
uaggaaugcaugagagacccugga

SEQ ID NO: 113822 - RNA, 21 nt, Human
cagucugggcaacauggugaa

SEQ ID NO: 113823 - RNA, 21 nt, Human
ugagcccugggcuuaggaguc

SEQ ID NO: 113824 - RNA, 22 nt, Human
cacuuaaaaacucuauaaccuc

SEQ ID NO: 113825 - RNA, 22 nt, Human
ggcggaggugggcaggauguga

SEQ ID NO: 113826 - RNA, 22 nt, Human
acugcaaccucugccacccggg

SEQ ID NO: 113827 - RNA, 23 nt, Human
agcguggugggggauaaauaaau

SEQ ID NO: 113828 - RNA, 24 nt, Human
agacagcacccauugaaacagaua

SEQ ID NO: 113829 - RNA, 22 nt, Human
gcucccaccuccaccugcccca

SEQ ID NO: 113830 - RNA, 23 nt, Human
ccugccgaggugugaccccaccu

SEQ ID NO: 113831 - RNA, 24 nt, Human
aaacguaauucuuacauugugauu

SEQ ID NO: 113832 - RNA, 25 nt, Human
uuuagcaggggccuggaauguaaac

SEQ ID NO: 113833 - RNA, 26 nt, Human
uaaagugagaaguucagugccacuua

SEQ ID NO: 113834 - RNA, 23 nt, Human
ggccaucuugguuuuugcaagaa

SEQ ID NO: 113835 - RNA, 21 nt, Human
gcaguggcagagaauccaaac

SEQ ID NO: 113836 - RNA, 22 nt, Human
uucagccucccaaguggcuggg

SEQ ID NO: 113837 - RNA, 22 nt, Human
cagcagccuccuugcagaugug

SEQ ID NO: 113838 - RNA, 22 nt, Human
ucuauacaacaaauguuucuuc

SEQ ID NO: 113839 - RNA, 23 nt, Human
auggucugucauugucugccuuu

SEQ ID NO: 113840 - RNA, 20 nt, Human
cuucccuucauucuucgcca

SEQ ID NO: 113841 - RNA, 19 nt, Human
aggguccagauuuuaaagg

SEQ ID NO: 113842 - RNA, 20 nt, Human
ccaagacauuaaaucugcca

SEQ ID NO: 113843 - RNA, 22 nt, Human
uaguauuguuguugcacuugag

SEQ ID NO: 113844 - RNA, 20 nt, Human
uccucaccaugacccagcuc

SEQ ID NO: 113845 - RNA, 20 nt, Human
auuggccuggcugggugcag

SEQ ID NO: 113846 - RNA, 26 nt, Human
ugggugccagagugagacacagcagg

SEQ ID NO: 113847 - RNA, 21 nt, Human
agccuccccaaugcuggggag

SEQ ID NO: 113848 - RNA, 20 nt, Human
acacccuucaggaaggggga

SEQ ID NO: 113849 - RNA, 23 nt, Human
caggugauucuggccucuguggu

SEQ ID NO: 113850 - RNA, 25 nt, Human
cucauucccugcgcccccuuccucu

SEQ ID NO: 113851 - RNA, 22 nt, Human
aucacuugaaccugggaggcag

SEQ ID NO: 113852 - RNA, 24 nt, Human
ccuguuuuuccuguuucccgcaga

SEQ ID NO: 113853 - RNA, 27 nt, Human
ugcuggccaguccacccugccugccgu

SEQ ID NO: 113854 - RNA, 24 nt, Human
aggaaaucuagaaguaguccugaa

SEQ ID NO: 113855 - RNA, 24 nt, Human
ccuuucuccccugcccccaggacu

SEQ ID NO: 113856 - RNA, 22 nt, Human
cuccuucuucaacuccuggugu

SEQ ID NO: 113857 - RNA, 27 nt, Human
uuaccugcauuauuacauuaggcugag

SEQ ID NO: 113858 - RNA, 23 nt, Human
aggcccaggccaaccgugcacug

SEQ ID NO: 113859 - RNA, 22 nt, Human
cauuaauaccuuuuccuuccuc

SEQ ID NO: 113860 - RNA, 23 nt, Human
gccaauaacaaauuccuacuucg

SEQ ID NO: 113861 - RNA, 23 nt, Human
cugagaguccccucccuucuccc

SEQ ID NO: 113862 - RNA, 21 nt, Human
ccugccugucauuccugacuc

SEQ ID NO: 113863 - RNA, 23 nt, Human
uucugauguacaguauuuuuugu

SEQ ID NO: 113864 - RNA, 20 nt, Human
cccaguccccaaccugcacu

SEQ ID NO: 113865 - RNA, 20 nt, Human
cuaagagaccuccuucuggg

SEQ ID NO: 113866 - RNA, 22 nt, Human
ugauuuuggugcaggaaccuga

SEQ ID NO: 113867 - RNA, 22 nt, Human
ggcaugagcccgggaggcggag

SEQ ID NO: 113868 - RNA, 21 nt, Human
acuauuggcuacuuacccuca

SEQ ID NO: 113869 - RNA, 18 nt, Human
uaacugcaggucacuugu

SEQ ID NO: 113870 - RNA, 26 nt, Human
ccgagcuuuagccacugugcggcgcu

SEQ ID NO: 113871 - RNA, 21 nt, Human
aggagccggccaccagaugcu

SEQ ID NO: 113872 - RNA, 24 nt, Human
uuaagcugcuggcugggcaagugu

SEQ ID NO: 113873 - RNA, 21 nt, Human
uucuuuacaacuauuguucuc

SEQ ID NO: 113874 - RNA, 27 nt, Human
caaaauacuccugcaauuccagcugcc

SEQ ID NO: 113875 - RNA, 22 nt, Human
uuaguagagauggguuucucca

SEQ ID NO: 113876 - RNA, 25 nt, Human
gccucugccuccacccuccuccucu

SEQ ID NO: 113877 - RNA, 22 nt, Human
agcagggacccaggcacuguga

SEQ ID NO: 113878 - RNA, 23 nt, Human
ccauuuacauggcauucucagcu

SEQ ID NO: 113879 - RNA, 19 nt, Human
cccaagcuccaggucucca

SEQ ID NO: 113880 - RNA, 20 nt, Human
ccuuuccugcucccauacac

SEQ ID NO: 113881 - RNA, 26 nt, Human
acucagaagacagagcugaaaaagaa

SEQ ID NO: 113882 - RNA, 24 nt, Human
gcucaggcuggggaacagagaggc

SEQ ID NO: 113883 - RNA, 22 nt, Human
aguccagaacguagugagccuu

SEQ ID NO: 113884 - RNA, 21 nt, Human
auaucuugaguuuguagcuua

SEQ ID NO: 113885 - RNA, 21 nt, Human
gacugaacaccagcugcuauc

SEQ ID NO: 113886 - RNA, 26 nt, Human
gcgacuucucaggacgacgaaucuuc

SEQ ID NO: 113887 - RNA, 22 nt, Human
caucugaacaucuaaugugaga

SEQ ID NO: 113888 - RNA, 23 nt, Human
gggcuuuauuuucgcugaaggaa

SEQ ID NO: 113889 - RNA, 27 nt, Human
ugccuguaaucccagcuacacuggagg

SEQ ID NO: 113890 - RNA, 23 nt, Human
aauaacccacaaaagauucagga

SEQ ID NO: 113891 - RNA, 23 nt, Human
ccacccaggccuggagcugggau

SEQ ID NO: 113892 - RNA, 26 nt, Human
gacaaauuccugcuacuaagacaugc

SEQ ID NO: 113893 - RNA, 22 nt, Human
uuaggagcuuguaccacagucu

SEQ ID NO: 113894 - RNA, 22 nt, Human
ugucacccaggcuggagugcag

SEQ ID NO: 113895 - RNA, 22 nt, Human
ugucacccaggcuagagugcaa

SEQ ID NO: 113896 - RNA, 21 nt, Human
gccccuuucccguccugggca

SEQ ID NO: 113897 - RNA, 26 nt, Human
ggcugagaacccagcgauaagggggc

SEQ ID NO: 113898 - RNA, 26 nt, Human
cuuacauguagagauuugagugcagu

SEQ ID NO: 113899 - RNA, 20 nt, Human
uguccaucucuccaucuguc

SEQ ID NO: 113900 - RNA, 22 nt, Human
agcuaucccaguagcugagcuc

SEQ ID NO: 113901 - RNA, 21 nt, Human
uucugauuuugacauaauugg

SEQ ID NO: 113902 - RNA, 21 nt, Human
auucagaaagcugaggcagga

SEQ ID NO: 113903 - RNA, 25 nt, Human
ugcuucucuaaaacagcacuaucga

SEQ ID NO: 113904 - RNA, 22 nt, Human
gccucucuugggaccuggccug

SEQ ID NO: 113905 - RNA, 23 nt, Human
cacugcaccucuagucuggguga

SEQ ID NO: 113906 - RNA, 27 nt, Human
gccagugccuuauuacccaggaagauu

SEQ ID NO: 113907 - RNA, 26 nt, Human
agaccccagccuggggaacacgcugc

SEQ ID NO: 113908 - RNA, 22 nt, Human
ugauccuucuuuucacuuucug

SEQ ID NO: 113909 - RNA, 21 nt, Human
ucuaaacauauaaaugugaau

SEQ ID NO: 113910 - RNA, 19 nt, Human
auucgugacuuucccaaua

SEQ ID NO: 113911 - RNA, 21 nt, Human
gguggggugcuugcuguguga

SEQ ID NO: 113912 - RNA, 21 nt, Human
uacuauauuaugauaaaagca

SEQ ID NO: 113913 - RNA, 23 nt, Human
gucaccgaggcuggagugcaaug

SEQ ID NO: 113914 - RNA, 23 nt, Human
guuaggagagagaaaauaauugc

SEQ ID NO: 113915 - RNA, 27 nt, Human
cccugcucuaugcugacccuugucacu

SEQ ID NO: 113916 - RNA, 19 nt, Human
uacaaaugaucuuugcaaa

SEQ ID NO: 113917 - RNA, 22 nt, Human
augccuggcaaccuugccuuug

SEQ ID NO: 113918 - RNA, 21 nt, Human
ugagacugaauucuugcaaug

SEQ ID NO: 113919 - RNA, 27 nt, Human
cacugcacuccagucuggaugacagag

SEQ ID NO: 113920 - RNA, 27 nt, Human
cacuguacuccagccuggaugacagag

SEQ ID NO: 113921 - RNA, 22 nt, Human
ucuuuuuguuuuucuuuuagac

SEQ ID NO: 113922 - RNA, 26 nt, Human
caaaaucaaaagacuuagcuucuagg

SEQ ID NO: 113923 - RNA, 21 nt, Human
cucauuucuauucauuccuca

SEQ ID NO: 113924 - RNA, 20 nt, Human
aggggagacagggcuccagg

SEQ ID NO: 113925 - RNA, 26 nt, Human
gcccagcauagggcuagcaaauuuga

SEQ ID NO: 113926 - RNA, 20 nt, Human
ugccugggcuggagaacagu

SEQ ID NO: 113927 - RNA, 23 nt, Human
gaagaauugcuugaacuggggag

SEQ ID NO: 113928 - RNA, 21 nt, Human
cauccccuguucacuuucucu

SEQ ID NO: 113929 - RNA, 25 nt, Human
cugggucuguagguuguugcaguga

SEQ ID NO: 113930 - RNA, 19 nt, Human
gauccucuuccugcugaga

SEQ ID NO: 113931 - RNA, 20 nt, Human
ucucucgggggaaccggaca

SEQ ID NO: 113932 - RNA, 22 nt, Human
uggagagaccaccuucacuggc

SEQ ID NO: 113933 - RNA, 22 nt, Human
uggagccauuucaacaaggcau

SEQ ID NO: 113934 - RNA, 22 nt, Human
ucauucuuccccuccuccagcu

SEQ ID NO: 113935 - RNA, 18 nt, Human
agacaaugagagagggug

SEQ ID NO: 113936 - RNA, 22 nt, Human
gucacgcaggcugagugcacug

SEQ ID NO: 113937 - RNA, 27 nt, Human
caauugucauaauaaacuuaugucauu

SEQ ID NO: 113938 - RNA, 22 nt, Human
uuugcccaggcuggagugcagu

SEQ ID NO: 113939 - RNA, 20 nt, Human
gggucuuauccuggcauuga

SEQ ID NO: 113940 - RNA, 25 nt, Human
gaccacacuuccuguccagagagag

SEQ ID NO: 113941 - RNA, 19 nt, Human
ggcuugcaguaguguuaga

SEQ ID NO: 113942 - RNA, 27 nt, Human
uggggaacugggcaccaggagugccuu

SEQ ID NO: 113943 - RNA, 26 nt, Human
gcguggagaguccaccuccaguguag

SEQ ID NO: 113944 - RNA, 27 nt, Human
cacuuccuguuggucugucucuuccca

SEQ ID NO: 113945 - RNA, 20 nt, Human
ggguagccagcuguuuucag

SEQ ID NO: 113946 - RNA, 21 nt, Human
gcggaggcggaggcuugggug

SEQ ID NO: 113947 - RNA, 23 nt, Human
aggugacguggcuagcggaggac

SEQ ID NO: 113948 - RNA, 19 nt, Human
uugcccaggcuggagugca

SEQ ID NO: 113949 - RNA, 27 nt, Human
cuucaaaacauaggacaguacaucucu

SEQ ID NO: 113950 - RNA, 25 nt, Human
cgcgggggcugggauucacgcccag

SEQ ID NO: 113951 - RNA, 22 nt, Human
aaauaacauuucucuacugccu

SEQ ID NO: 113952 - RNA, 26 nt, Human
gacucgggcaaccucaccguggccag

SEQ ID NO: 113953 - RNA, 25 nt, Human
agcuccgccuuucuugcucugaaaa

SEQ ID NO: 113954 - RNA, 23 nt, Human
aaaccugugaaaccucuuuuuau

SEQ ID NO: 113955 - RNA, 27 nt, Human
uguucugagaucuuuugggugcaguuc

SEQ ID NO: 113956 - RNA, 26 nt, Human
ccugaggccuggccuuuagcugcugc

SEQ ID NO: 113957 - RNA, 25 nt, Human
acuccauguauuuuaccuacuucag

SEQ ID NO: 113958 - RNA, 24 nt, Human
cugccuaggagcugccugcacggc

SEQ ID NO: 113959 - RNA, 20 nt, Human
gcuccacccuccucagcgcc

SEQ ID NO: 113960 - RNA, 19 nt, Human
ccuacuaauguaacuaucu

SEQ ID NO: 113961 - RNA, 21 nt, Human
gacgguucguuugaauggagg

SEQ ID NO: 113962 - RNA, 24 nt, Human
acaaacuaaaucagugugcugcua

SEQ ID NO: 113963 - RNA, 21 nt, Human
uugaccuugguuuucucuucu

SEQ ID NO: 113964 - RNA, 21 nt, Human
aguguucuaugaacaacucca

SEQ ID NO: 113965 - RNA, 23 nt, Human
gcugcugccuuguuucaccuucc

SEQ ID NO: 113966 - RNA, 22 nt, Human
uggugcacaucuauaaucccag

SEQ ID NO: 113967 - RNA, 25 nt, Human
uggacaucugguugcuuuggccugc

SEQ ID NO: 113968 - RNA, 22 nt, Human
ccuccuugcgcucaccuugcca

SEQ ID NO: 113969 - RNA, 24 nt, Human
caccuccugggcucuccagcgauc

SEQ ID NO: 113970 - RNA, 22 nt, Human
ccuucccccugcuucaggcugc

SEQ ID NO: 113971 - RNA, 21 nt, Human
ccuuggccccagcgcccagcc

SEQ ID NO: 113972 - RNA, 27 nt, Human
uggcagggccuagcugcuacaaagaag

SEQ ID NO: 113973 - RNA, 31 nt, Human
gggagcgcggaggggaagggagcccccagcc

SEQ ID NO: 113974 - RNA, 27 nt, Human
gagccccggaggucgaggcuacaguga

SEQ ID NO: 113975 - RNA, 27 nt, Human
agcaguuacagagggugauaaaucucu

SEQ ID NO: 113976 - RNA, 18 nt, Human
acagccaguuauucuucc

SEQ ID NO: 113977 - RNA, 20 nt, Human
gcacuggcacccacagcagg

SEQ ID NO: 113978 - RNA, 24 nt, Human
ggguuuuccuugcuccugccagga

SEQ ID NO: 113979 - RNA, 21 nt, Human
ccucccugcuaagagcugugu

SEQ ID NO: 113980 - RNA, 23 nt, Human
cggcggcaacagcagacaugucg

SEQ ID NO: 113981 - RNA, 20 nt, Human
ucccaaccucagaucaguca

SEQ ID NO: 113982 - RNA, 27 nt, Human
acagguguggggacacagcagugagua

SEQ ID NO: 113983 - RNA, 20 nt, Human
uucaggggacagaagcuuuu

SEQ ID NO: 113984 - RNA, 30 nt, Human
cugccugccugucugucucuccaucuguuu

SEQ ID NO: 113985 - RNA, 27 nt, Human
cuggaaccuggcagaggccuuaggacc

SEQ ID NO: 113986 - RNA, 22 nt, Human
agcuguuccugcuuugaguuuc

SEQ ID NO: 113987 - RNA, 22 nt, Human
uucgcaauaauguauccauucc

SEQ ID NO: 113988 - RNA, 27 nt, Human
ccauacagacagcacaagguggcagca

SEQ ID NO: 113989 - RNA, 20 nt, Human
agccaagugugcuguaaacu

SEQ ID NO: 113990 - RNA, 25 nt, Human
acugccuggcucagcugcacgcugc

SEQ ID NO: 113991 - RNA, 25 nt, Human
ggaccugccuuaacugcuccuggcc

SEQ ID NO: 113992 - RNA, 18 nt, Human
uaucauuccagaaggaaa

SEQ ID NO: 113993 - RNA, 27 nt, Human
cuugcucaugggaugagcaaugcugug

SEQ ID NO: 113994 - RNA, 22 nt, Human
agaagcagcugguggcgccuga

SEQ ID NO: 113995 - RNA, 27 nt, Human
ccuacuuccugauuggauugguuuugc

SEQ ID NO: 113996 - RNA, 26 nt, Human
aauggacugagcauuggccaauuucc

SEQ ID NO: 113997 - RNA, 24 nt, Human
agguugagcccagaguggccgagg

SEQ ID NO: 113998 - RNA, 22 nt, Human
guacagaccgagaggccaguug

SEQ ID NO: 113999 - RNA, 22 nt, Human
uggggaggaacagucaagagca

SEQ ID NO: 114000 - RNA, 25 nt, Human
ccccuuuuccugcaccuaguggccu

SEQ ID NO: 114001 - RNA, 26 nt, Human
cacuguacuccagccugggugacagg

SEQ ID NO: 114002 - RNA, 25 nt, Human
gcacagcccgguuggcgugggccag

SEQ ID NO: 114003 - RNA, 25 nt, Human
ccuuuccuguucagcauucuuagcc

SEQ ID NO: 114004 - RNA, 23 nt, Human
guauccacuuugcacagcucucc

SEQ ID NO: 114005 - RNA, 20 nt, Human
gugcacaguccacagcugaa

SEQ ID NO: 114006 - RNA, 22 nt, Human
uguggagaagaaaaaaggugcu

SEQ ID NO: 114007 - RNA, 19 nt, Human
ugccuaggccugggcagug

SEQ ID NO: 114008 - RNA, 25 nt, Human
ggccaucacaccugcccugugcagc

SEQ ID NO: 114009 - RNA, 24 nt, Human
uucauucugugaguuaccaccuca

SEQ ID NO: 114010 - RNA, 23 nt, Human
agaacuccuaaggaggagauugg

SEQ ID NO: 114011 - RNA, 23 nt, Human
ggaaggggguggaaacugccugg

SEQ ID NO: 114012 - RNA, 22 nt, Human
agucuuuccccaccuggagcag

SEQ ID NO: 114013 - RNA, 21 nt, Human
ccuugauaucaguccccuuca

SEQ ID NO: 114014 - RNA, 21 nt, Human
ucacuuaaacuuccuccaaag

SEQ ID NO: 114015 - RNA, 20 nt, Human
cacuuaacggaccaaagcaa

SEQ ID NO: 114016 - RNA, 26 nt, Human
ugauuacuaccuuuuaaaauauuuua

SEQ ID NO: 114017 - RNA, 19 nt, Human
aagaguuguguaaaugucu

SEQ ID NO: 114018 - RNA, 19 nt, Human
cugcuuugguaaagucuga

SEQ ID NO: 114019 - RNA, 25 nt, Human
cugucaugagaguggggagacaggc

SEQ ID NO: 114020 - RNA, 26 nt, Human
caccacacccagccugggucucucua

SEQ ID NO: 114021 - RNA, 21 nt, Human
caccgaggcuggagugcagug

SEQ ID NO: 114022 - RNA, 21 nt, Human
gauuucagaagaaaggaaaca

SEQ ID NO: 114023 - RNA, 24 nt, Human
ccugcggcugcugcucuccuccga

SEQ ID NO: 114024 - RNA, 22 nt, Human
gccaccccaggaccugccacuu

SEQ ID NO: 114025 - RNA, 24 nt, Human
gaccuuauccuuccucuccuuccu

SEQ ID NO: 114026 - RNA, 26 nt, Human
gaggcauuccagaaggacugaggggg

SEQ ID NO: 114027 - RNA, 22 nt, Human
uguucuguuuaccuagugucuu

SEQ ID NO: 114028 - RNA, 21 nt, Human
uguuacccagccuggucucaa

SEQ ID NO: 114029 - RNA, 26 nt, Human
gggugagggcagaguguggugacagc

SEQ ID NO: 114030 - RNA, 25 nt, Human
cccccacuccuccuccugaguucca

SEQ ID NO: 114031 - RNA, 30 nt, Human
ucugcccuacaaaaugcucuucauugguug

SEQ ID NO: 114032 - RNA, 22 nt, Human
uggcauaguacuuuugguacau

SEQ ID NO: 114033 - RNA, 19 nt, Human
gcagucuucaucacagagg

SEQ ID NO: 114034 - RNA, 27 nt, Human
accugccuggccaacauggcaacaccc

SEQ ID NO: 114035 - RNA, 24 nt, Human
ggucuucccaguugagacugcugg

SEQ ID NO: 114036 - RNA, 21 nt, Human
ucagaucugacauuaccucuu

SEQ ID NO: 114037 - RNA, 21 nt, Human
aucuggagcaacagcuaggaa

SEQ ID NO: 114038 - RNA, 30 nt, Human
accaucugcauccagccuccugcuaacucc

SEQ ID NO: 114039 - RNA, 22 nt, Human
agccucccaaaguacagggauu

SEQ ID NO: 114040 - RNA, 27 nt, Human
ggggcauucaugccuggacuuaaacaa

SEQ ID NO: 114041 - RNA, 22 nt, Human
cauggacuggaagacacuccag

SEQ ID NO: 114042 - RNA, 25 nt, Human
ugccaugguacucaaagguagaaga

SEQ ID NO: 114043 - RNA, 27 nt, Human
agcaagucacaccugccagugcccuca

SEQ ID NO: 114044 - RNA, 19 nt, Human
guuuggcaggcaggugcca

SEQ ID NO: 114045 - RNA, 21 nt, Human
uugagauacaugauucucuua

SEQ ID NO: 114046 - RNA, 25 nt, Human
agagggcugauuaucacagcccucu

SEQ ID NO: 114047 - RNA, 19 nt, Human
ucuaucuccuuguugaucu

SEQ ID NO: 114048 - RNA, 22 nt, Human
gaaagccccacccaggccaggc

SEQ ID NO: 114049 - RNA, 22 nt, Human
uucccuggugcugcagcacuug

SEQ ID NO: 114050 - RNA, 23 nt, Human
ccugcacacagccgucugagcag

SEQ ID NO: 114051 - RNA, 26 nt, Human
cggaccagagguggaaggcgcggcgg

SEQ ID NO: 114052 - RNA, 30 nt, Human
uccagucuauggagucaguugguaccggug

SEQ ID NO: 114053 - RNA, 24 nt, Human
ccaaaacacuaccaugccccagcc

SEQ ID NO: 114054 - RNA, 22 nt, Human
agcucacugcaagcucugccuc

SEQ ID NO: 114055 - RNA, 22 nt, Human
augugggacuaaugaaugcuuc

SEQ ID NO: 114056 - RNA, 26 nt, Human
gcugggacucuggugagcauccguca

SEQ ID NO: 114057 - RNA, 24 nt, Human
ccugcugccccucccugccuccac

SEQ ID NO: 114058 - RNA, 23 nt, Human
gccagcagcugaugcuguacuaa

SEQ ID NO: 114059 - RNA, 23 nt, Human
auggcacugcugcacuccagccu

SEQ ID NO: 114060 - RNA, 26 nt, Human
ccugcucucuacauugcugggcaccu

SEQ ID NO: 114061 - RNA, 23 nt, Human
ugaggcagaaggggguucccugu

SEQ ID NO: 114062 - RNA, 19 nt, Human
uuagcacagcguuaugugu

SEQ ID NO: 114063 - RNA, 16 nt, Human
acaaucagagacuguc

SEQ ID NO: 114064 - RNA, 20 nt, Human
agagagagggcagggaacag

SEQ ID NO: 114065 - RNA, 22 nt, Human
ggcuggagugcaguggugccau

SEQ ID NO: 114066 - RNA, 24 nt, Human
acaaguguuggcauuaucaguuga

SEQ ID NO: 114067 - RNA, 22 nt, Human
ccugcugucccugucaggacac

SEQ ID NO: 114068 - RNA, 21 nt, Human
agagccuccagcaagaugcua

SEQ ID NO: 114069 - RNA, 25 nt, Human
ugucugaguccucaggugacugggg

SEQ ID NO: 114070 - RNA, 25 nt, Human
cucauuucuucaccuacaacccuuu

SEQ ID NO: 114071 - RNA, 22 nt, Human
caugaaacccuaggcagaggag

SEQ ID NO: 114072 - RNA, 23 nt, Human
uccuguguguguuuacaguauuc

SEQ ID NO: 114073 - RNA, 26 nt, Human
gagagaggagagccucaggaguuagg

SEQ ID NO: 114074 - RNA, 26 nt, Human
gugaagugccuggcacagugucuggu

SEQ ID NO: 114075 - RNA, 22 nt, Human
agaugacugaaaccacucugaa

SEQ ID NO: 114076 - RNA, 20 nt, Human
ugcuuuguuggcaguuuuca

SEQ ID NO: 114077 - RNA, 19 nt, Human
aggagggagagcaggcagc

SEQ ID NO: 114078 - RNA, 26 nt, Human
ccucauucuuuucugugacccuuucg

SEQ ID NO: 114079 - RNA, 21 nt, Human
uguuuacagaaguguguugag

SEQ ID NO: 114080 - RNA, 25 nt, Human
aucucugcucuggcuuuucuccaag

SEQ ID NO: 114081 - RNA, 20 nt, Human
gcuuagacaugggagcuaua

SEQ ID NO: 114082 - RNA, 22 nt, Human
ccacagaaacccuguuuuauug

SEQ ID NO: 114083 - RNA, 25 nt, Human
aacaacaaaauuccauuccccuucc

SEQ ID NO: 114084 - RNA, 17 nt, Human
caggagguguugcagug

SEQ ID NO: 114085 - RNA, 24 nt, Human
ucacaaauucucacacacauacau

SEQ ID NO: 114086 - RNA, 21 nt, Human
uguggugguugagauggagcu

SEQ ID NO: 114087 - RNA, 19 nt, Human
aaaugauuuugauaucuuu

SEQ ID NO: 114088 - RNA, 25 nt, Human
uggggcuuaaaugguacaauggaga

SEQ ID NO: 114089 - RNA, 23 nt, Human
ggugcacgcuaccaugcccggcu

SEQ ID NO: 114090 - RNA, 27 nt, Human
cuccagccucaguaguuggggguagaa

SEQ ID NO: 114091 - RNA, 27 nt, Human
uacagaagcugaaauugcguucuaaga

SEQ ID NO: 114092 - RNA, 22 nt, Human
cucccggauacuccugccucag

SEQ ID NO: 114093 - RNA, 27 nt, Human
caggcagcaucacacuggggucacuga

SEQ ID NO: 114094 - RNA, 27 nt, Human
uugcccaggcaaggaaagacagcagug

SEQ ID NO: 114095 - RNA, 22 nt, Human
agcuuagugaucaggugugaga

SEQ ID NO: 114096 - RNA, 24 nt, Human
uguucugacagcauuucagcugug

SEQ ID NO: 114097 - RNA, 25 nt, Human
gccgacuucuccccuuuccccagcc

SEQ ID NO: 114098 - RNA, 22 nt, Human
cuugcagcacucacacaggacc

SEQ ID NO: 114099 - RNA, 31 nt, Human
cacagccuggccaugcccaggaagacccacc

SEQ ID NO: 114100 - RNA, 22 nt, Human
gggugccacuggcaccacuggg

SEQ ID NO: 114101 - RNA, 26 nt, Human
ccagaagaacuaguagaagaagcuuu

SEQ ID NO: 114102 - RNA, 22 nt, Human
uauucccuacaaagccuccucu

SEQ ID NO: 114103 - RNA, 23 nt, Human
ugccuaaaagacuuuauuguucu

SEQ ID NO: 114104 - RNA, 22 nt, Human
gcuucccucccccuauagggcu

SEQ ID NO: 114105 - RNA, 22 nt, Human
cuccucggggaggggaagcacc

SEQ ID NO: 114106 - RNA, 22 nt, Human
ccuacccugcccugccugaagc

SEQ ID NO: 114107 - RNA, 25 nt, Human
caggcagcggcucagaggcagcugc

SEQ ID NO: 114108 - RNA, 23 nt, Human
ggccguacaccuucugcaucuca

SEQ ID NO: 114109 - RNA, 27 nt, Human
ggggugagaauauagacagugcccuug

SEQ ID NO: 114110 - RNA, 27 nt, Human
aggagccucuggcaaaugggugcucau

SEQ ID NO: 114111 - RNA, 22 nt, Human
cagcagcgccucaguccugguc

SEQ ID NO: 114112 - RNA, 24 nt, Human
cggcagugucacgaugcccagacu

SEQ ID NO: 114113 - RNA, 25 nt, Human
ugcuccuuggagcuggugugcagug

SEQ ID NO: 114114 - RNA, 22 nt, Human
cagggccggagguucugguggg

SEQ ID NO: 114115 - RNA, 19 nt, Human
gccaaaacaagucuagcag

SEQ ID NO: 114116 - RNA, 21 nt, Human
ccugugguuggacuucaccuc

SEQ ID NO: 114117 - RNA, 23 nt, Human
accucaugcuuaugcaaugggaa

SEQ ID NO: 114118 - RNA, 20 nt, Human
uucccaagcuggagugcagu

SEQ ID NO: 114119 - RNA, 22 nt, Human
aaucuguuucuacaaggacuag

SEQ ID NO: 114120 - RNA, 21 nt, Human
uguaggcacacuuugcacuga

SEQ ID NO: 114121 - RNA, 19 nt, Human
cacaaaugguggguacaaa

SEQ ID NO: 114122 - RNA, 22 nt, Human
ggagagggcggcgccggggcgc

SEQ ID NO: 114123 - RNA, 18 nt, Human
ucauucccugaauggcag

SEQ ID NO: 114124 - RNA, 21 nt, Human
cacacucuauugcucuucugu

SEQ ID NO: 114125 - RNA, 22 nt, Human
cucggccucccaaaguucuggg

SEQ ID NO: 114126 - RNA, 25 nt, Human
gagaggugguagagcaggaagcugc

SEQ ID NO: 114127 - RNA, 22 nt, Human
cagacagggaucaggagccgga

SEQ ID NO: 114128 - RNA, 21 nt, Human
ccccacuucuccaucgcagcc

SEQ ID NO: 114129 - RNA, 25 nt, Human
cuugcuggagucaugugccucuguc

SEQ ID NO: 114130 - RNA, 22 nt, Human
uuugcuugaacccaagaggucc

SEQ ID NO: 114131 - RNA, 21 nt, Human
cacacacauauauuauuugca

SEQ ID NO: 114132 - RNA, 23 nt, Human
gccaaagcucgccaacauggcgg

SEQ ID NO: 114133 - RNA, 21 nt, Human
cauucuauggagaggauccca

SEQ ID NO: 114134 - RNA, 25 nt, Human
ucucggucuucagcucacaccagcc

SEQ ID NO: 114135 - RNA, 26 nt, Human
cccagccuguguagcucuuccugcau

SEQ ID NO: 114136 - RNA, 21 nt, Human
uuuguguguuuuccuugaacu

SEQ ID NO: 114137 - RNA, 21 nt, Human
guucuaggaaccugagagugg

SEQ ID NO: 114138 - RNA, 23 nt, Human
uggaacgaguucauccugcagcc

SEQ ID NO: 114139 - RNA, 27 nt, Human
ccagcuccguguuucucuaaggaauua

SEQ ID NO: 114140 - RNA, 20 nt, Human
acagccaggcuggagucagu

SEQ ID NO: 114141 - RNA, 24 nt, Human
aggauguucacuauggaaaaacaa

SEQ ID NO: 114142 - RNA, 25 nt, Human
ggacagaccacacccaccgcaaccu

SEQ ID NO: 114143 - RNA, 28 nt, Human
gucucaaaggagcuuucucaaugucuuc

SEQ ID NO: 114144 - RNA, 29 nt, Human
gcgcagggaggaugccacagccccacagc

SEQ ID NO: 114145 - RNA, 21 nt, Human
cccugcaguaaggcugguuuc

SEQ ID NO: 114146 - RNA, 18 nt, Human
acugaccuuuuucugcga

SEQ ID NO: 114147 - RNA, 24 nt, Human
accggggcagagucagcucugugc

SEQ ID NO: 114148 - RNA, 27 nt, Human
gagcccaagcacacaugcauggcauuu

SEQ ID NO: 114149 - RNA, 27 nt, Human
gugugcauguguguauaagugcacaca

SEQ ID NO: 114150 - RNA, 21 nt, Human
ugaggcacagacucauuuguc

SEQ ID NO: 114151 - RNA, 26 nt, Human
uccauccugucaccaugacuuccuca

SEQ ID NO: 114152 - RNA, 21 nt, Human
caugaaaccaaaaagagacug

SEQ ID NO: 114153 - RNA, 20 nt, Human
gucuuccugugguuguaugc

SEQ ID NO: 114154 - RNA, 22 nt, Human
aaagggaagcccugacaacaac

SEQ ID NO: 114155 - RNA, 22 nt, Human
aacaccauccauuugggaaaga

SEQ ID NO: 114156 - RNA, 22 nt, Human
auugaguuucuuucucuuuagg

SEQ ID NO: 114157 - RNA, 23 nt, Human
caagaaacgugugaaaacucccu

SEQ ID NO: 114158 - RNA, 18 nt, Human
ggccucgggaccaacucu

SEQ ID NO: 114159 - RNA, 22 nt, Human
cagcucuucgaagguuugccuu

SEQ ID NO: 114160 - RNA, 26 nt, Human
auguucugcucuugugcccuucugag

SEQ ID NO: 114161 - RNA, 20 nt, Human
ccgcagcccaccucucgggg

SEQ ID NO: 114162 - RNA, 27 nt, Human
ccccacccuaccucagcuggggucagg

SEQ ID NO: 114163 - RNA, 20 nt, Human
ucacuaccaugagaauugca

SEQ ID NO: 114164 - RNA, 26 nt, Human
uaagcucaggaguuugagaccagccu

SEQ ID NO: 114165 - RNA, 24 nt, Human
cuaaggccgcagacuccuguccgc

SEQ ID NO: 114166 - RNA, 23 nt, Human
cagauuuucuguucaaauauuca

SEQ ID NO: 114167 - RNA, 21 nt, Human
gggagaagaaagagagaugua

SEQ ID NO: 114168 - RNA, 19 nt, Human
cuccaugagggcagggaca

SEQ ID NO: 114169 - RNA, 19 nt, Human
ggcuauuuggaagacacug

SEQ ID NO: 114170 - RNA, 22 nt, Human
cacaccuguaaucccaacauuu

SEQ ID NO: 114171 - RNA, 21 nt, Human
acuuauauuguaagaaauacu

SEQ ID NO: 114172 - RNA, 24 nt, Human
uuccagccugaggggcuucggagc

SEQ ID NO: 114173 - RNA, 22 nt, Human
cucagggugcccacaacucacu

SEQ ID NO: 114174 - RNA, 27 nt, Human
ucccacauaacuagacguucaaacagg

SEQ ID NO: 114175 - RNA, 23 nt, Human
cgugccucugugcuguguaugug

SEQ ID NO: 114176 - RNA, 21 nt, Human
gccacccaggcuggaguacag

SEQ ID NO: 114177 - RNA, 23 nt, Human
uucaaguauucaaauagaaaaau

SEQ ID NO: 114178 - RNA, 21 nt, Human
aaaacucuguagcuuaaacca

SEQ ID NO: 114179 - RNA, 23 nt, Human
augucaggcaaagugcugcugga

SEQ ID NO: 114180 - RNA, 21 nt, Human
cccgcgcgccacugugcagug

SEQ ID NO: 114181 - RNA, 21 nt, Human
ucccuucuucacaccuacuca

SEQ ID NO: 114182 - RNA, 25 nt, Human
gguggggaggggaagccauggaaau

SEQ ID NO: 114183 - RNA, 27 nt, Human
gcaucacaguuuugcaaccucugcucc

SEQ ID NO: 114184 - RNA, 23 nt, Human
cugucucuucuuuuuucuggacc

SEQ ID NO: 114185 - RNA, 27 nt, Human
ccucugcucccccuuuucccucggagu

SEQ ID NO: 114186 - RNA, 25 nt, Human
ggggucuuguccacccuggcuggau

SEQ ID NO: 114187 - RNA, 21 nt, Human
ccaggccacccuuccugggcu

SEQ ID NO: 114188 - RNA, 20 nt, Human
agggaggccuccaucuggaa

SEQ ID NO: 114189 - RNA, 29 nt, Human
ccuccuaccuccuccucggauuggcuacc

SEQ ID NO: 114190 - RNA, 25 nt, Human
gccuccugucucaacacugacagcu

SEQ ID NO: 114191 - RNA, 23 nt, Human
cugcuucuuauugauagauggca

SEQ ID NO: 114192 - RNA, 25 nt, Human
ugccucuguguaucucagcauuuuu

SEQ ID NO: 114193 - RNA, 22 nt, Human
cuuuggaguaauccugccuggg

SEQ ID NO: 114194 - RNA, 22 nt, Human
cuuugucccuggcaaaauuuuc

SEQ ID NO: 114195 - RNA, 27 nt, Human
cacuacccuucuccuuuccuucccagg

SEQ ID NO: 114196 - RNA, 21 nt, Human
gacacaggcugacacauucuu

SEQ ID NO: 114197 - RNA, 19 nt, Human
ucccuuuugauagcauuag

SEQ ID NO: 114198 - RNA, 23 nt, Human
gaugggguuuugccauguuugcc

SEQ ID NO: 114199 - RNA, 23 nt, Human
gggcucuggggccggagcugugu

SEQ ID NO: 114200 - RNA, 19 nt, Human
ugaagcagcuguuacuuuu

SEQ ID NO: 114201 - RNA, 18 nt, Human
gcccuugccauccuccca

SEQ ID NO: 114202 - RNA, 20 nt, Human
uugagauacuuuuucuuuug

SEQ ID NO: 114203 - RNA, 23 nt, Human
ccauauguucugugagaauagua

SEQ ID NO: 114204 - RNA, 23 nt, Human
cucugguucuugccugcuucacu

SEQ ID NO: 114205 - RNA, 23 nt, Human
cugagauacugguaaucauccug

SEQ ID NO: 114206 - RNA, 27 nt, Human
ugucauuguuuuucgcaauugagcuau

SEQ ID NO: 114207 - RNA, 21 nt, Human
ggccaccagagcccacuuggc

SEQ ID NO: 114208 - RNA, 21 nt, Human
uucaguuuuucuuuacuucuu

SEQ ID NO: 114209 - RNA, 25 nt, Human
guccacccucgguccucaugguccc

SEQ ID NO: 114210 - RNA, 26 nt, Human
ccugccuggccccucgccuguggagc

SEQ ID NO: 114211 - RNA, 22 nt, Human
uuuaccugaauaaaugguagua

SEQ ID NO: 114212 - RNA, 28 nt, Human
ugccugucaaaggcuggagggcaggagg

SEQ ID NO: 114213 - RNA, 22 nt, Human
uuugguuuuuccaaccaaggaa

SEQ ID NO: 114214 - RNA, 26 nt, Human
ccugaguagcugggacuagaggcacg

SEQ ID NO: 114215 - RNA, 20 nt, Human
agaccucuggcuuuccugga

SEQ ID NO: 114216 - RNA, 26 nt, Human
caugauacauuuaggguaugcagcuc

SEQ ID NO: 114217 - RNA, 22 nt, Human
acugacaauaguuaugccugua

SEQ ID NO: 114218 - RNA, 17 nt, Human
agucuguugccuguguc

SEQ ID NO: 114219 - RNA, 25 nt, Human
ccugcucuaccauuauuugcggucu

SEQ ID NO: 114220 - RNA, 22 nt, Human
ucuuuucugaagugucuuuggg

SEQ ID NO: 114221 - RNA, 22 nt, Human
ugcuaguaccuguaagcauuuu

SEQ ID NO: 114222 - RNA, 25 nt, Human
uucacucuucagcauuuaugaaaca

SEQ ID NO: 114223 - RNA, 27 nt, Human
ggcuuggaagguucagaccuaucuucc

SEQ ID NO: 114224 - RNA, 21 nt, Human
gccagccugggagcgaccacu

SEQ ID NO: 114225 - RNA, 26 nt, Human
auaagcuuuucccuguuuuuaguuuu

SEQ ID NO: 114226 - RNA, 22 nt, Human
cacucacuggcaucuuugcuau

SEQ ID NO: 114227 - RNA, 22 nt, Human
cacccaggcugcaguucacugg

SEQ ID NO: 114228 - RNA, 20 nt, Human
gagguugucucugaaccagg

SEQ ID NO: 114229 - RNA, 22 nt, Human
aaguugggaguguaguguagca

SEQ ID NO: 114230 - RNA, 25 nt, Human
ucugcagcuuuggcugcacgucacc

SEQ ID NO: 114231 - RNA, 21 nt, Human
uuuucuccucugcuucuuugc

SEQ ID NO: 114232 - RNA, 22 nt, Human
uguuuuuaauuguucauugcua

SEQ ID NO: 114233 - RNA, 27 nt, Human
aguucauuccaugaugcauauuacugg

SEQ ID NO: 114234 - RNA, 20 nt, Human
agcuagcaacauuuguuuua

SEQ ID NO: 114235 - RNA, 21 nt, Human
ucaguguaagagaaggcacau

SEQ ID NO: 114236 - RNA, 27 nt, Human
auacuauacugaaaucugugcucucaa

SEQ ID NO: 114237 - RNA, 21 nt, Human
uggaacagauauuuagcucug

SEQ ID NO: 114238 - RNA, 26 nt, Human
aggcccagaguacugugaggggugau

SEQ ID NO: 114239 - RNA, 22 nt, Human
acuacccccuaccuuaacucua

SEQ ID NO: 114240 - RNA, 27 nt, Human
cuccacuccagauuuuuuacagcugcc

SEQ ID NO: 114241 - RNA, 21 nt, Human
cauccagcuggguagccgggg

SEQ ID NO: 114242 - RNA, 21 nt, Human
aauucuguaucauacauugcu

SEQ ID NO: 114243 - RNA, 26 nt, Human
ggcagccagcucugucuccagggagg

SEQ ID NO: 114244 - RNA, 21 nt, Human
cugagcgcgggaugacaggag

SEQ ID NO: 114245 - RNA, 22 nt, Human
uuucaaacuguuaauucuguca

SEQ ID NO: 114246 - RNA, 25 nt, Human
gggggauggagucucaggguggcag

SEQ ID NO: 114247 - RNA, 26 nt, Human
cucuucugggcuacugccacugugug

SEQ ID NO: 114248 - RNA, 27 nt, Human
ggucaucugcuccuuuuccauccccug

SEQ ID NO: 114249 - RNA, 20 nt, Human
gguugugucaggcuuggggg

SEQ ID NO: 114250 - RNA, 20 nt, Human
cacuuccugaaucaguuauu

SEQ ID NO: 114251 - RNA, 20 nt, Human
gcauaaacugaggguguggg

SEQ ID NO: 114252 - RNA, 24 nt, Human
ccuggcuucucaguucuuugguug

SEQ ID NO: 114253 - RNA, 22 nt, Human
caggcugcugagucacucagaa

SEQ ID NO: 114254 - RNA, 22 nt, Human
aguguagagugcagaaaugugg

SEQ ID NO: 114255 - RNA, 22 nt, Human
agucccuggcguccccuguggc

SEQ ID NO: 114256 - RNA, 24 nt, Human
uucccucacuguuguaucuugaau

SEQ ID NO: 114257 - RNA, 20 nt, Human
cuucugcugcugcccccacc

SEQ ID NO: 114258 - RNA, 21 nt, Human
uggaacuuuucuuaggggaca

SEQ ID NO: 114259 - RNA, 22 nt, Human
agagcuucucugggcugaaugu

SEQ ID NO: 114260 - RNA, 22 nt, Human
ucaacuccugggcucaagcgau

SEQ ID NO: 114261 - RNA, 17 nt, Human
caaaaaguaugcaauga

SEQ ID NO: 114262 - RNA, 27 nt, Human
ggaggcugaggcagaagaauugaaccc

SEQ ID NO: 114263 - RNA, 24 nt, Human
cccucaggcuucccuugugucucc

SEQ ID NO: 114264 - RNA, 23 nt, Human
augugugugcuuuaucuuauuuu

SEQ ID NO: 114265 - RNA, 25 nt, Human
cgauccuccugccucagucucccaa

SEQ ID NO: 114266 - RNA, 23 nt, Human
gcuggcucacuuacugggggcca

SEQ ID NO: 114267 - RNA, 22 nt, Human
uuucaguuuuggcagcagcguc

SEQ ID NO: 114268 - RNA, 24 nt, Human
agagguuaacagauuuaucuaggg

SEQ ID NO: 114269 - RNA, 21 nt, Human
acuccuccccuuuuccacacg

SEQ ID NO: 114270 - RNA, 24 nt, Human
uccccccuguuuuuccaucuuguu

SEQ ID NO: 114271 - RNA, 23 nt, Human
gacacaaauacguuguuccagag

SEQ ID NO: 114272 - RNA, 27 nt, Human
gaggaauuggccgcugucacugcuugu

SEQ ID NO: 114273 - RNA, 27 nt, Human
acuccgagacagggaagaccggggccc

SEQ ID NO: 114274 - RNA, 26 nt, Human
gggggcuggaguggguagaguauuga

SEQ ID NO: 114275 - RNA, 24 nt, Human
caccccguccgcagccaggaaaag

SEQ ID NO: 114276 - RNA, 18 nt, Human
aucacuacaggcugguua

SEQ ID NO: 114277 - RNA, 24 nt, Human
cuguugugcaggcuguagugcagu

SEQ ID NO: 114278 - RNA, 24 nt, Human
acgguugggccuugccggcugucg

SEQ ID NO: 114279 - RNA, 23 nt, Human
uuucccaggcagcuggcuaguuc

SEQ ID NO: 114280 - RNA, 22 nt, Human
agggccuguaaucccagcauuu

SEQ ID NO: 114281 - RNA, 26 nt, Human
uuuagcaacacggcugaucuuucagu

SEQ ID NO: 114282 - RNA, 21 nt, Human
gagcggcuucagcacugcagc

SEQ ID NO: 114283 - RNA, 21 nt, Human
gcuacugcugcugcuacugcu

SEQ ID NO: 114284 - RNA, 21 nt, Human
cucuguggagggcagcugugg

SEQ ID NO: 114285 - RNA, 21 nt, Human
cgcccgcgccccuccccaccg

SEQ ID NO: 114286 - RNA, 22 nt, Human
aaguccuucuuguccuggucgu

SEQ ID NO: 114287 - RNA, 22 nt, Human
gugugagccacugugucuggcc

SEQ ID NO: 114288 - RNA, 25 nt, Human
gcccaaguggagcucaccucucccu

SEQ ID NO: 114289 - RNA, 27 nt, Human
ggcaggugcugaggugccugucuugga

SEQ ID NO: 114290 - RNA, 21 nt, Human
gcaggcuucucccuucuuucu

SEQ ID NO: 114291 - RNA, 20 nt, Human
cccagaaaacacauuucugg

SEQ ID NO: 114292 - RNA, 21 nt, Human
gcuggguuuagaacaagauua

SEQ ID NO: 114293 - RNA, 22 nt, Human
guggagcggagcaaggccaggc

SEQ ID NO: 114294 - RNA, 26 nt, Human
uaaucaggaaucaaguuucuuacugg

SEQ ID NO: 114295 - RNA, 26 nt, Human
cauacagagcaggccacgcucaggcc

SEQ ID NO: 114296 - RNA, 27 nt, Human
gcucauuuuuccguguccuccuuuauu

SEQ ID NO: 114297 - RNA, 27 nt, Human
gaguagcugggauuacgggcgcccgcc

SEQ ID NO: 114298 - RNA, 27 nt, Human
gaguagcugggauuacaggcgcccacc

SEQ ID NO: 114299 - RNA, 26 nt, Human
cugggcccuacacccccacaaugugu

SEQ ID NO: 114300 - RNA, 29 nt, Human
acaaggauuuggaguagaucaaucaccuu

SEQ ID NO: 114301 - RNA, 21 nt, Human
gccagagcuccugagaagaug

SEQ ID NO: 114302 - RNA, 22 nt, Human
acaagguuguagcugugcucag

SEQ ID NO: 114303 - RNA, 25 nt, Human
gaagagugggaggaagcagagggag

SEQ ID NO: 114304 - RNA, 19 nt, Human
agagcuucauuucagugaa

SEQ ID NO: 114305 - RNA, 21 nt, Human
caagcagcagagcaccuggga

SEQ ID NO: 114306 - RNA, 26 nt, Human
uccaagacccauucugcacagucccu

SEQ ID NO: 114307 - RNA, 27 nt, Human
ggccaaauagcaugugacacaggacag

SEQ ID NO: 114308 - RNA, 24 nt, Human
ggcagaauguggcaaagcauuuaa

SEQ ID NO: 114309 - RNA, 23 nt, Human
gccucacagccaaggcuggacug

SEQ ID NO: 114310 - RNA, 21 nt, Human
agaggaaggccagcccuccuc

SEQ ID NO: 114311 - RNA, 21 nt, Human
augauggggcccuaauucagc

SEQ ID NO: 114312 - RNA, 23 nt, Human
cacgccuguaaucccagcuacuc

SEQ ID NO: 114313 - RNA, 27 nt, Human
cagguguguaggccacagcagccgcag

SEQ ID NO: 114314 - RNA, 23 nt, Human
gcucucccaggaucaauuguauc

SEQ ID NO: 114315 - RNA, 24 nt, Human
ggggugaguguaguucuggccuag

SEQ ID NO: 114316 - RNA, 26 nt, Human
cuccugcugcugaccugaucaccucu

SEQ ID NO: 114317 - RNA, 22 nt, Human
caaagcaaaggcaggcacuuca

SEQ ID NO: 114318 - RNA, 27 nt, Human
ucucugcacaacgggcaaugugcagac

SEQ ID NO: 114319 - RNA, 24 nt, Human
gcagggaggggaggcagauggagc

SEQ ID NO: 114320 - RNA, 22 nt, Human
uuugccuggcucuguccauauu

SEQ ID NO: 114321 - RNA, 21 nt, Human
guccuccaggcuggggcaggu

SEQ ID NO: 114322 - RNA, 22 nt, Human
uugcuucucuggcugccugguc

SEQ ID NO: 114323 - RNA, 26 nt, Human
agggacuggaguuccaggcagaggga

SEQ ID NO: 114324 - RNA, 29 nt, Human
gcacucacucucccccuccucuucugguc

SEQ ID NO: 114325 - RNA, 20 nt, Human
ucugaacaauuucucuuaua

SEQ ID NO: 114326 - RNA, 23 nt, Human
ccccucuugacuuuccugguuau

SEQ ID NO: 114327 - RNA, 23 nt, Human
aggaagaggguugugccaaggua

SEQ ID NO: 114328 - RNA, 27 nt, Human
gccugucguuagggcauggcuuaugcu

SEQ ID NO: 114329 - RNA, 22 nt, Human
uggaugccacaugcugcuguuu

SEQ ID NO: 114330 - RNA, 21 nt, Human
ccgggagccgagcuugcagcg

SEQ ID NO: 114331 - RNA, 27 nt, Human
acagaggccugcccugccuggccgggc

SEQ ID NO: 114332 - RNA, 22 nt, Human
cucuguauuuaaaaaacuaaca

SEQ ID NO: 114333 - RNA, 23 nt, Human
uggagacggggcagggagggggg

SEQ ID NO: 114334 - RNA, 21 nt, Human
aucucgaacucuugaccucag

SEQ ID NO: 114335 - RNA, 23 nt, Human
caugaccguguuuucaacugugu

SEQ ID NO: 114336 - RNA, 27 nt, Human
acauucucguugccucugauuuucucc

SEQ ID NO: 114337 - RNA, 22 nt, Human
ucagucucugaauacacaguau

SEQ ID NO: 114338 - RNA, 20 nt, Human
cuugggcgaggaggagaccg

SEQ ID NO: 114339 - RNA, 27 nt, Human
ccugccugguuuuuguucagccugucu

SEQ ID NO: 114340 - RNA, 27 nt, Human
gaugagguggagagugggaagcaggag

SEQ ID NO: 114341 - RNA, 22 nt, Human
ccaacauggugaaaccuggccu

SEQ ID NO: 114342 - RNA, 24 nt, Human
uuuccacccucuuugagaucagcg

SEQ ID NO: 114343 - RNA, 22 nt, Human
cgggaggcggagguuccaguga

SEQ ID NO: 114344 - RNA, 22 nt, Human
ggccacagaccagcauccccac

SEQ ID NO: 114345 - RNA, 23 nt, Human
aggaagagacugcggccuuauca

SEQ ID NO: 114346 - RNA, 21 nt, Human
aagucacccagggacacucca

SEQ ID NO: 114347 - RNA, 26 nt, Human
cggucugaggccccugcccagcugga

SEQ ID NO: 114348 - RNA, 25 nt, Human
ccuguucuucacucccuucagccac

SEQ ID NO: 114349 - RNA, 20 nt, Human
ccggcaccuggcgaggcuca

SEQ ID NO: 114350 - RNA, 19 nt, Human
cagaaaccacaagugucca

SEQ ID NO: 114351 - RNA, 23 nt, Human
ucuggggagagaaugagcuggag

SEQ ID NO: 114352 - RNA, 20 nt, Human
ccauguugcugaucguggua

SEQ ID NO: 114353 - RNA, 21 nt, Human
uugaccccuggcccaccucuc

SEQ ID NO: 114354 - RNA, 20 nt, Human
ccuucucugcccacagucuu

SEQ ID NO: 114355 - RNA, 21 nt, Human
auguugaagaauugaccucag

SEQ ID NO: 114356 - RNA, 21 nt, Human
uacuguucaccggccuagcau

SEQ ID NO: 114357 - RNA, 26 nt, Human
gccuugaacuccuggccucaagggau

SEQ ID NO: 114358 - RNA, 22 nt, Human
ggccuccuagagugcugggauu

SEQ ID NO: 114359 - RNA, 22 nt, Human
gccugaacucuccuuuuuucuu

SEQ ID NO: 114360 - RNA, 21 nt, Human
ccaggggauagaggaguaauu

SEQ ID NO: 114361 - RNA, 23 nt, Human
uccuucuuucucccucuugaguc

SEQ ID NO: 114362 - RNA, 27 nt, Human
aggccagagucaccuuuucuguggcug

SEQ ID NO: 114363 - RNA, 22 nt, Human
cucucucugugugaacaggaaa

SEQ ID NO: 114364 - RNA, 22 nt, Human
caggcuggagugcaguggcgua

SEQ ID NO: 114365 - RNA, 26 nt, Human
ucuuuugaaaguagagcuagcugcca

SEQ ID NO: 114366 - RNA, 22 nt, Human
uuacaucacgacuuucucuuaa

SEQ ID NO: 114367 - RNA, 26 nt, Human
cugcagcuuuacaugcaauuuauuaa

SEQ ID NO: 114368 - RNA, 21 nt, Human
aagagccucuuucugcagccg

SEQ ID NO: 114369 - RNA, 25 nt, Human
uucagaugugccuuuuguuuuugca

SEQ ID NO: 114370 - RNA, 22 nt, Human
uaacugcagaaauagcaaauua

SEQ ID NO: 114371 - RNA, 22 nt, Human
agcccagccuguccgucccugu

SEQ ID NO: 114372 - RNA, 21 nt, Human
aagaucuguguguguugggga

SEQ ID NO: 114373 - RNA, 22 nt, Human
gggcugacccagugugugcuca

SEQ ID NO: 114374 - RNA, 21 nt, Human
ggaggcagagguugcagugag

SEQ ID NO: 114375 - RNA, 22 nt, Human
cgcggcgauuucaucaugcucc

SEQ ID NO: 114376 - RNA, 21 nt, Human
agccugugugcguguggugca

SEQ ID NO: 114377 - RNA, 24 nt, Human
ccccggcaguggggagcgccggau

SEQ ID NO: 114378 - RNA, 21 nt, Human
ggugggugggguggggugggg

SEQ ID NO: 114379 - RNA, 23 nt, Human
agcccacagcugagaauguggaa

SEQ ID NO: 114380 - RNA, 17 nt, Human
ggcaccugucugcucca

SEQ ID NO: 114381 - RNA, 19 nt, Human
acugcuuguuugugucucu

SEQ ID NO: 114382 - RNA, 18 nt, Human
ucuuaucuauuacuccaa

SEQ ID NO: 114383 - RNA, 21 nt, Human
uuucugcuggggauggccacu

SEQ ID NO: 114384 - RNA, 22 nt, Human
gcucacugcaaccucugccacc

SEQ ID NO: 114385 - RNA, 24 nt, Human
gggauuacaggugugggagccacc

SEQ ID NO: 114386 - RNA, 27 nt, Human
aggguaucuacccagccuagaaagcac

SEQ ID NO: 114387 - RNA, 20 nt, Human
ugaaggaauugacuuccuca

SEQ ID NO: 114388 - RNA, 24 nt, Human
caggcugggaauugcaguggcaca

SEQ ID NO: 114389 - RNA, 17 nt, Human
caggucucagcccaggg

SEQ ID NO: 114390 - RNA, 27 nt, Human
ucccuccagaggcucuagaggagaauc

SEQ ID NO: 114391 - RNA, 25 nt, Human
cugggcuucagauuuauugcuuaua

SEQ ID NO: 114392 - RNA, 22 nt, Human
gccucucucuucuuuauucccu

SEQ ID NO: 114393 - RNA, 21 nt, Human
ugcuccugccacuagguuuca

SEQ ID NO: 114394 - RNA, 19 nt, Human
cuucccuuccggaaagcuu

SEQ ID NO: 114395 - RNA, 20 nt, Human
ugcccaggcuggggugcagu

SEQ ID NO: 114396 - RNA, 21 nt, Human
cuacaaacgugcagccuccug

SEQ ID NO: 114397 - RNA, 20 nt, Human
ccugcagcggcacaaaugca

SEQ ID NO: 114398 - RNA, 22 nt, Human
gcugcggcgguaucugaccuca

SEQ ID NO: 114399 - RNA, 22 nt, Human
cacgcccagcuccgcccccuca

SEQ ID NO: 114400 - RNA, 25 nt, Human
ugccccaguucacauccaccugcuu

SEQ ID NO: 114401 - RNA, 21 nt, Human
aacuauacuugcaacucuuuu

SEQ ID NO: 114402 - RNA, 27 nt, Human
uuccaaacaacuuauacaugcuuuuua

SEQ ID NO: 114403 - RNA, 27 nt, Human
gcccaggcuggucugaagcugcugggc

SEQ ID NO: 114404 - RNA, 21 nt, Human
agguaauguggaaaucugaag

SEQ ID NO: 114405 - RNA, 28 nt, Human
ucuugaccucuuggcucucucugcacuu

SEQ ID NO: 114406 - RNA, 24 nt, Human
uaaugucuccuaagcuuuucucuc

SEQ ID NO: 114407 - RNA, 21 nt, Human
agaaaggcccuguucaaagca

SEQ ID NO: 114408 - RNA, 22 nt, Human
aauaaaggggaggacgcgcccu

SEQ ID NO: 114409 - RNA, 18 nt, Human
agagaauuucacaaacaa

SEQ ID NO: 114410 - RNA, 23 nt, Human
ucucugcuauaagaaaagcagac

SEQ ID NO: 114411 - RNA, 23 nt, Human
cguuacccaggguggagugcagu

SEQ ID NO: 114412 - RNA, 26 nt, Human
aggaggucugugccaaagaagaaucc

SEQ ID NO: 114413 - RNA, 21 nt, Human
aauggcugguugugugagagg

SEQ ID NO: 114414 - RNA, 22 nt, Human
ugggcagccuaugggggcucuc

SEQ ID NO: 114415 - RNA, 26 nt, Human
accugacauguauguccuccaggggg

SEQ ID NO: 114416 - RNA, 22 nt, Human
cuucaaucaacuccaucacuuc

SEQ ID NO: 114417 - RNA, 23 nt, Human
cagucucuaccauaucugguccc

SEQ ID NO: 114418 - RNA, 21 nt, Human
gcagccuccccucagucuucc

SEQ ID NO: 114419 - RNA, 18 nt, Human
cacagcuguccacgucug

SEQ ID NO: 114420 - RNA, 27 nt, Human
uagauuuggcaaaagaacaggagcagc

SEQ ID NO: 114421 - RNA, 22 nt, Human
ccuucucuuccucauccagaaa

SEQ ID NO: 114422 - RNA, 27 nt, Human
ccaggaggcaguggacaucguaggcag

SEQ ID NO: 114423 - RNA, 25 nt, Human
agcacagacacuccauuuucuaucu

SEQ ID NO: 114424 - RNA, 21 nt, Human
gcugagcucuguucucuccag

SEQ ID NO: 114425 - RNA, 23 nt, Human
uggucagccuuuuuggguaacac

SEQ ID NO: 114426 - RNA, 17 nt, Human
aggcugaggcuggcaca

SEQ ID NO: 114427 - RNA, 23 nt, Human
uguuauuacucagugacucucua

SEQ ID NO: 114428 - RNA, 26 nt, Human
cagucuugucggccagcugcccaggg

SEQ ID NO: 114429 - RNA, 19 nt, Human
ucuccugauuccuacuguc

SEQ ID NO: 114430 - RNA, 25 nt, Human
cuggagugcaguagugcagucgugg

SEQ ID NO: 114431 - RNA, 18 nt, Human
accaucccuauuuuguau

SEQ ID NO: 114432 - RNA, 27 nt, Human
aggaacgaguucacagauuagaaggga

SEQ ID NO: 114433 - RNA, 21 nt, Human
aaccuguugucauguuuuuuc

SEQ ID NO: 114434 - RNA, 20 nt, Human
aacaaugucauuugcugcua

SEQ ID NO: 114435 - RNA, 22 nt, Human
cugcaugggugccugcugcugc

SEQ ID NO: 114436 - RNA, 19 nt, Human
uuuguuucagccuuccuua

SEQ ID NO: 114437 - RNA, 22 nt, Human
uucugaccuaccacauaaacag

SEQ ID NO: 114438 - RNA, 21 nt, Human
acuccuaucuucugaauucua

SEQ ID NO: 114439 - RNA, 27 nt, Human
cucauuucccgcaccccauuucuugcu

SEQ ID NO: 114440 - RNA, 19 nt, Human
uccaccugcauccacacau

SEQ ID NO: 114441 - RNA, 20 nt, Human
gaaggaguccucuuaaguuu

SEQ ID NO: 114442 - RNA, 21 nt, Human
auguguguagauacuuccugc

SEQ ID NO: 114443 - RNA, 20 nt, Human
uuguuugcaucugaaagaga

SEQ ID NO: 114444 - RNA, 25 nt, Human
gcccaggguggagugcaguggcaug

SEQ ID NO: 114445 - RNA, 30 nt, Human
ggcucuuaggagagcggaaaggaccuccug

SEQ ID NO: 114446 - RNA, 26 nt, Human
cagucaugguacuaccccagccuggg

SEQ ID NO: 114447 - RNA, 21 nt, Human
agaagucuccuuucuguuuca

SEQ ID NO: 114448 - RNA, 21 nt, Human
ccaagcgcugagauuacaggu

SEQ ID NO: 114449 - RNA, 21 nt, Human
gggacaggggcuggcccaggg

SEQ ID NO: 114450 - RNA, 27 nt, Human
uucugagcccauauuucacuuaccuua

SEQ ID NO: 114451 - RNA, 18 nt, Human
uuguagguggcuugggga

SEQ ID NO: 114452 - RNA, 27 nt, Human
ugcucuaauuucuuuugcccauauaug

SEQ ID NO: 114453 - RNA, 22 nt, Human
cacccaggcugcaguguagugg

SEQ ID NO: 114454 - RNA, 27 nt, Human
gaggaagaggcaaagaacccuggccug

SEQ ID NO: 114455 - RNA, 22 nt, Human
auugcagccuuucuuuuccuau

SEQ ID NO: 114456 - RNA, 22 nt, Human
ggaaccuggccaggcauggugg

SEQ ID NO: 114457 - RNA, 22 nt, Human
guaaauguuggauguccaauag

SEQ ID NO: 114458 - RNA, 28 nt, Human
gcucugcugcccccuccugggcacgucc

SEQ ID NO: 114459 - RNA, 19 nt, Human
gggagagacaaagauccag

SEQ ID NO: 114460 - RNA, 20 nt, Human
ucaagccccuuucuggagag

SEQ ID NO: 114461 - RNA, 22 nt, Human
agagcuguacaguguguaaauc

SEQ ID NO: 114462 - RNA, 25 nt, Human
ggggccggcccugugcacaaggaug

SEQ ID NO: 114463 - RNA, 21 nt, Human
aucucaggcuggagugcagug

SEQ ID NO: 114464 - RNA, 20 nt, Human
caaacacuauaaaaugagua

SEQ ID NO: 114465 - RNA, 23 nt, Human
uaauuagaaaaauuaauauuuca

SEQ ID NO: 114466 - RNA, 24 nt, Human
ccaagagauccaggcugucaugug

SEQ ID NO: 114467 - RNA, 22 nt, Human
ugcccaggcaagagugcagugg

SEQ ID NO: 114468 - RNA, 27 nt, Human
ccaucaucucugccuuugaguguggga

SEQ ID NO: 114469 - RNA, 25 nt, Human
gagaaaacaaugauguaaauuccuu

SEQ ID NO: 114470 - RNA, 27 nt, Human
uugcaggggaggcugggucugggggug

SEQ ID NO: 114471 - RNA, 21 nt, Human
cucugcucuccucuauucucc

SEQ ID NO: 114472 - RNA, 22 nt, Human
gcuggagugaucucagcucacu

SEQ ID NO: 114473 - RNA, 26 nt, Human
gguuuuguuuguuaauucucuuuuau

SEQ ID NO: 114474 - RNA, 27 nt, Human
caaaacaaggaagugagcuaagauuca

SEQ ID NO: 114475 - RNA, 22 nt, Human
ggauugauuuugcucuccagga

SEQ ID NO: 114476 - RNA, 23 nt, Human
aagaagcuagacugagaacgccu

SEQ ID NO: 114477 - RNA, 21 nt, Human
uuggagaagagggaggaauag

SEQ ID NO: 114478 - RNA, 19 nt, Human
uggacucucucaacccagg

SEQ ID NO: 114479 - RNA, 21 nt, Human
ggaaaggcguuugggaugcca

SEQ ID NO: 114480 - RNA, 24 nt, Human
gagugagaucauuuucuuaucuuc

SEQ ID NO: 114481 - RNA, 22 nt, Human
ugcugcuccugcagcugccuuu

SEQ ID NO: 114482 - RNA, 21 nt, Human
gcaaccucuuccuccugguuc

SEQ ID NO: 114483 - RNA, 27 nt, Human
caggaggcuguuccaggaguccugccc

SEQ ID NO: 114484 - RNA, 19 nt, Human
guuuacuaaaguguguaaa

SEQ ID NO: 114485 - RNA, 22 nt, Human
ccgcuggaggaagccuucucug

SEQ ID NO: 114486 - RNA, 27 nt, Human
cucauuuccuucuuucuucuggcuuug

SEQ ID NO: 114487 - RNA, 23 nt, Human
cuucaaucaacuccaucacuucu

SEQ ID NO: 114488 - RNA, 25 nt, Human
uggagagaagaagcccuggcugggg

SEQ ID NO: 114489 - RNA, 20 nt, Human
cacauggucaguaggcacac

SEQ ID NO: 114490 - RNA, 26 nt, Human
acucacaaaggcuccaggccucccca

SEQ ID NO: 114491 - RNA, 23 nt, Human
ucuucucgagcaggagugauagu

SEQ ID NO: 114492 - RNA, 18 nt, Human
aguaugcugacaccagaa

SEQ ID NO: 114493 - RNA, 21 nt, Human
gacccagacccacuuccucca

SEQ ID NO: 114494 - RNA, 30 nt, Human
aggccagguacuucagaaccucagagcucc

SEQ ID NO: 114495 - RNA, 20 nt, Human
acagggcugccuucuggccu

SEQ ID NO: 114496 - RNA, 21 nt, Human
cacaggauagaggcagagcca

SEQ ID NO: 114497 - RNA, 25 nt, Human
guuuaaugaacuaccaucugauguu

SEQ ID NO: 114498 - RNA, 27 nt, Human
gaaugcaugugugggggcagagguuau

SEQ ID NO: 114499 - RNA, 18 nt, Human
cuucugcuagccuagcca

SEQ ID NO: 114500 - RNA, 24 nt, Human
caagcuauguggcugcugcugcca

SEQ ID NO: 114501 - RNA, 24 nt, Human
gaagaggagaggguauggggcggc

SEQ ID NO: 114502 - RNA, 22 nt, Human
ccagguaugacacccacucucc

SEQ ID NO: 114503 - RNA, 26 nt, Human
uuucauguuuuugaaacagaaccaua

SEQ ID NO: 114504 - RNA, 17 nt, Human
gcuaagcugguuaguau

SEQ ID NO: 114505 - RNA, 21 nt, Human
cugccucuuuguacuuugcuc

SEQ ID NO: 114506 - RNA, 22 nt, Human
ggcuuucccuuggccuuccuca

SEQ ID NO: 114507 - RNA, 23 nt, Human
acggggcaggggagggaauugag

SEQ ID NO: 114508 - RNA, 22 nt, Human
cugugcauacccagaagaaaga

SEQ ID NO: 114509 - RNA, 27 nt, Human
aaggcagcccugucugaaggacacuuc

SEQ ID NO: 114510 - RNA, 25 nt, Human
aagugggcaguauguucuuccccuu

SEQ ID NO: 114511 - RNA, 22 nt, Human
cuguaaaauaaaaacucagcug

SEQ ID NO: 114512 - RNA, 22 nt, Human
ucuccaccuuauaguuuaugaa

SEQ ID NO: 114513 - RNA, 27 nt, Human
cacugcagccucaaccuccugggcuca

SEQ ID NO: 114514 - RNA, 25 nt, Human
cuggggaggcugaggcaggagaauc

SEQ ID NO: 114515 - RNA, 27 nt, Human
agcacagacacuuucagccuuuauacu

SEQ ID NO: 114516 - RNA, 23 nt, Human
cucuccuucccccuaccugggcc

SEQ ID NO: 114517 - RNA, 27 nt, Human
caaguucucagcaccuacuuuugucaa

SEQ ID NO: 114518 - RNA, 20 nt, Human
uccaggugaaucacagcuga

SEQ ID NO: 114519 - RNA, 22 nt, Human
cguuuucuuugcugugccaaag

SEQ ID NO: 114520 - RNA, 25 nt, Human
ggagaggccccaaacagggagccac

SEQ ID NO: 114521 - RNA, 27 nt, Human
uccacccucucuccccuggaaaggaca

SEQ ID NO: 114522 - RNA, 23 nt, Human
cuucugcugccaggaagccagcu

SEQ ID NO: 114523 - RNA, 22 nt, Human
cuguaccuugcuggaauauuca

SEQ ID NO: 114524 - RNA, 22 nt, Human
gucccauucacacagauauuuu

SEQ ID NO: 114525 - RNA, 29 nt, Human
ccugccucccagcccugccagggggcugc

SEQ ID NO: 114526 - RNA, 21 nt, Human
cgaggcagucugggcacuuuu

SEQ ID NO: 114527 - RNA, 23 nt, Human
caguuucaguugauaccuccuca

SEQ ID NO: 114528 - RNA, 21 nt, Human
gcucacuguaggcuagccucu

SEQ ID NO: 114529 - RNA, 21 nt, Human
uuuuguucugaacuggcaguu

SEQ ID NO: 114530 - RNA, 23 nt, Human
caggggagagggucuggagaagc

SEQ ID NO: 114531 - RNA, 18 nt, Human
auuuuuaaagacuuuuug

SEQ ID NO: 114532 - RNA, 25 nt, Human
aacacaaaaagauaucagcauugua

SEQ ID NO: 114533 - RNA, 22 nt, Human
ucugcugcugcuuuaaaagcuc

SEQ ID NO: 114534 - RNA, 24 nt, Human
uuuccaaagagccaugugucaugu

SEQ ID NO: 114535 - RNA, 22 nt, Human
uucccuccugggcucaagcagu

SEQ ID NO: 114536 - RNA, 20 nt, Human
auuuuuuaacuaugaaaauc

SEQ ID NO: 114537 - RNA, 22 nt, Human
ugcuuugcccuugaauucuuuu

SEQ ID NO: 114538 - RNA, 20 nt, Human
uuuccacgcugauguuuaug

SEQ ID NO: 114539 - RNA, 26 nt, Human
ugggaaagcuuuucguuguaagucac

SEQ ID NO: 114540 - RNA, 27 nt, Human
ggaaugcugggaaaaugggcaagcaga

SEQ ID NO: 114541 - RNA, 18 nt, Human
aucaacaacagauugucu

SEQ ID NO: 114542 - RNA, 25 nt, Human
cacccggacuccgccgacuaggcaa

SEQ ID NO: 114543 - RNA, 22 nt, Human
acccugugaucuauaccaccuu

SEQ ID NO: 114544 - RNA, 23 nt, Human
guaggagcuaaagcaggucucca

SEQ ID NO: 114545 - RNA, 23 nt, Human
gaugggguuucaccguguuggcc

SEQ ID NO: 114546 - RNA, 27 nt, Human
gcugcaacccuggugugcugggcgaaa

SEQ ID NO: 114547 - RNA, 27 nt, Human
gggagagaggacgaagcgaggagaguu

SEQ ID NO: 114548 - RNA, 25 nt, Human
ccagccugggugacagagcaaguga

SEQ ID NO: 114549 - RNA, 21 nt, Human
uuuuuaaggagcugggggaag

SEQ ID NO: 114550 - RNA, 22 nt, Human
uggcucauaccuauaaucccag

SEQ ID NO: 114551 - RNA, 20 nt, Human
ugucugccuggagugcugug

SEQ ID NO: 114552 - RNA, 22 nt, Human
cuagcucaauaaacaucugcca

SEQ ID NO: 114553 - RNA, 25 nt, Human
gaucacccucuucgucgcuucggcc

SEQ ID NO: 114554 - RNA, 23 nt, Human
ccucgcgucugugccugccucaa

SEQ ID NO: 114555 - RNA, 24 nt, Human
ccauauauagggcuacaucuuguu

SEQ ID NO: 114556 - RNA, 27 nt, Human
gagacagaaauucagaaagggagccag

SEQ ID NO: 114557 - RNA, 22 nt, Human
ccugccugaccaucccaugagc

SEQ ID NO: 114558 - RNA, 23 nt, Human
uaaacccugaaauccaggaaaag

SEQ ID NO: 114559 - RNA, 25 nt, Human
ccauauagcuucaaaaacaaaaaca

SEQ ID NO: 114560 - RNA, 22 nt, Human
auuuaauuucuuuuguauuuua

SEQ ID NO: 114561 - RNA, 24 nt, Human
guacacagaaucagaaaagauuau

SEQ ID NO: 114562 - RNA, 22 nt, Human
aaacuccugggcuaaagcgauc

SEQ ID NO: 114563 - RNA, 24 nt, Human
gccucccucccuccugccccggca

SEQ ID NO: 114564 - RNA, 22 nt, Human
ucagcuucuaaucccagcacuu

SEQ ID NO: 114565 - RNA, 18 nt, Human
gcugucuugcugccugua

SEQ ID NO: 114566 - RNA, 21 nt, Human
agcaguuugagcaguauuucc

SEQ ID NO: 114567 - RNA, 21 nt, Human
auacugauguguagccuuuua

SEQ ID NO: 114568 - RNA, 23 nt, Human
uucauucuucuuuaaaguagccu

SEQ ID NO: 114569 - RNA, 23 nt, Human
ccagcucugggaccaagucacuu

SEQ ID NO: 114570 - RNA, 22 nt, Human
ggcuuuagcgccuuuucuggcg

SEQ ID NO: 114571 - RNA, 26 nt, Human
auuccucugcugaauuuuuaaauguu

SEQ ID NO: 114572 - RNA, 24 nt, Human
cggcaugcagucuaaucaugacaa

SEQ ID NO: 114573 - RNA, 18 nt, Human
ugcuuugcccagcauuuu

SEQ ID NO: 114574 - RNA, 21 nt, Human
uucucucuucucuuuguuuca

SEQ ID NO: 114575 - RNA, 22 nt, Human
cauuguacuccagccugggcaa

SEQ ID NO: 114576 - RNA, 23 nt, Human
ucucagccuuccugaccucugcc

SEQ ID NO: 114577 - RNA, 21 nt, Human
gagagggacgguucacaaagc

SEQ ID NO: 114578 - RNA, 22 nt, Human
gcccgagcuggugcauuacaga

SEQ ID NO: 114579 - RNA, 22 nt, Human
aucucacugcaaccucugccuc

SEQ ID NO: 114580 - RNA, 22 nt, Human
agacccugacauucaugaucca

SEQ ID NO: 114581 - RNA, 17 nt, Human
gauaccagauagcucaa

SEQ ID NO: 114582 - RNA, 22 nt, Human
aauguacuuuuucuuccagaaa

SEQ ID NO: 114583 - RNA, 27 nt, Human
aaaugucccaucaucgugggaggggag

SEQ ID NO: 114584 - RNA, 18 nt, Human
uaacuugccauccgcaca

SEQ ID NO: 114585 - RNA, 22 nt, Human
ucauugacuucauuuuauauuu

SEQ ID NO: 114586 - RNA, 23 nt, Human
gacaugcugcugcuacugcuaac

SEQ ID NO: 114587 - RNA, 22 nt, Human
ugacagcgcgagacuccaucuc

SEQ ID NO: 114588 - RNA, 20 nt, Human
ccaggcaaauucacuguuuc

SEQ ID NO: 114589 - RNA, 21 nt, Human
ugagccaagaucgcgccacug

SEQ ID NO: 114590 - RNA, 20 nt, Human
ccucuacuccaccuccaucc

SEQ ID NO: 114591 - RNA, 20 nt, Human
aagcuuauaucauguaaauu

SEQ ID NO: 114592 - RNA, 21 nt, Human
gcgagcuggagagaggacugu

SEQ ID NO: 114593 - RNA, 22 nt, Human
aauuccaaacagccucuaccuu

SEQ ID NO: 114594 - RNA, 27 nt, Human
uggccacuuauuucacuaucuucuuca

SEQ ID NO: 114595 - RNA, 19 nt, Human
accauaaauuagugcuaau

SEQ ID NO: 114596 - RNA, 21 nt, Human
uuuucuuuuuaauuuuuugau

SEQ ID NO: 114597 - RNA, 18 nt, Human
uuuuauuuccaucauguc

SEQ ID NO: 114598 - RNA, 18 nt, Human
caaucagguauuauguuu

SEQ ID NO: 114599 - RNA, 23 nt, Human
ggaccgugccucacagggcccac

SEQ ID NO: 114600 - RNA, 18 nt, Human
aacccugccuuuccuuua

SEQ ID NO: 114601 - RNA, 25 nt, Human
auugccuccagccugaguccuaggc

SEQ ID NO: 114602 - RNA, 24 nt, Human
ugguacaagccuuucucacccuac

SEQ ID NO: 114603 - RNA, 20 nt, Human
auugucaccccacagcugcc

SEQ ID NO: 114604 - RNA, 23 nt, Human
uuuggucggccauuucucucuca

SEQ ID NO: 114605 - RNA, 22 nt, Human
cugcuuugguaaucaacacgug

SEQ ID NO: 114606 - RNA, 21 nt, Human
gugaaaaccugucacuugcac

SEQ ID NO: 114607 - RNA, 21 nt, Human
caggcggcugcggcagcucug

SEQ ID NO: 114608 - RNA, 24 nt, Human
caaacaccuccuggaacgaagcuc

SEQ ID NO: 114609 - RNA, 27 nt, Human
caggcuggagugcgguggcaugaucuc

SEQ ID NO: 114610 - RNA, 22 nt, Human
uuugccucugccccaucccccc

SEQ ID NO: 114611 - RNA, 21 nt, Human
acccauggcugcaguggaggg

SEQ ID NO: 114612 - RNA, 25 nt, Human
uuaagagauaguggaggcagcaggg

SEQ ID NO: 114613 - RNA, 27 nt, Human
agaagagcaaacaggcacuuugaggaa

SEQ ID NO: 114614 - RNA, 22 nt, Human
gugccuguacucccagcacuuu

SEQ ID NO: 114615 - RNA, 28 nt, Human
ucgagacccaaacccccaaaauccaaaa

SEQ ID NO: 114616 - RNA, 22 nt, Human
aagagcucugagucuuaguggu

SEQ ID NO: 114617 - RNA, 21 nt, Human
cuguacugugagacuguggga

SEQ ID NO: 114618 - RNA, 20 nt, Human
caauugccuuuucuuguuau

SEQ ID NO: 114619 - RNA, 22 nt, Human
uguggaaugggagaguuggauu

SEQ ID NO: 114620 - RNA, 24 nt, Human
cucacacauuuuacuguacuuucc

SEQ ID NO: 114621 - RNA, 23 nt, Human
gaaucccuuucugaaauucucca

SEQ ID NO: 114622 - RNA, 20 nt, Human
uucaaacccccaagcuguga

SEQ ID NO: 114623 - RNA, 23 nt, Human
ucccugcacugguuaaagccauc

SEQ ID NO: 114624 - RNA, 22 nt, Human
gggacaccgguaaaaccuauca

SEQ ID NO: 114625 - RNA, 24 nt, Human
aaagacugcuccuggugcagggcc

SEQ ID NO: 114626 - RNA, 27 nt, Human
ccugugcuuuuucucccagcacugcgg

SEQ ID NO: 114627 - RNA, 21 nt, Human
ucucugcccucucccuguguu

SEQ ID NO: 114628 - RNA, 23 nt, Human
ugcucacugcaaccucugccucc

SEQ ID NO: 114629 - RNA, 21 nt, Human
aaacauuugcaccacuugugg

SEQ ID NO: 114630 - RNA, 23 nt, Human
ccaggaggaggaggcugcaguga

SEQ ID NO: 114631 - RNA, 21 nt, Human
ccauaucuuugcuacuguaaa

SEQ ID NO: 114632 - RNA, 23 nt, Human
cucaguaaaugacagaacuauuu

SEQ ID NO: 114633 - RNA, 21 nt, Human
auaaucagcuucagagauucc

SEQ ID NO: 114634 - RNA, 22 nt, Human
ccuguaaucccagcuacucagg

SEQ ID NO: 114635 - RNA, 22 nt, Human
caaccccugcuccaguccugga

SEQ ID NO: 114636 - RNA, 20 nt, Human
gcaucugguguuucagcaua

SEQ ID NO: 114637 - RNA, 21 nt, Human
gcacuauaugugacugugacu

SEQ ID NO: 114638 - RNA, 22 nt, Human
agaccuccaaguacaauauucu

SEQ ID NO: 114639 - RNA, 23 nt, Human
aaguggucaguuuggcugggcaa

SEQ ID NO: 114640 - RNA, 19 nt, Human
gguggcuuucaaagggguc

SEQ ID NO: 114641 - RNA, 28 nt, Human
cccugacuuuguuuuuguggacacacaa

SEQ ID NO: 114642 - RNA, 21 nt, Human
aggagccuccaaguauguggg

SEQ ID NO: 114643 - RNA, 24 nt, Human
uaguuuuugcuuucuguuuugcug

SEQ ID NO: 114644 - RNA, 21 nt, Human
uaaagaagauaaauaauugug

SEQ ID NO: 114645 - RNA, 20 nt, Human
gcucaccucuauauuaguuu

SEQ ID NO: 114646 - RNA, 26 nt, Human
gcuauguguauguuuuuaauuuugca

SEQ ID NO: 114647 - RNA, 20 nt, Human
ucagccgcugccucuguucu

SEQ ID NO: 114648 - RNA, 27 nt, Human
ggaggugggcaggaugugagagguggg

SEQ ID NO: 114649 - RNA, 20 nt, Human
gccaaggcuggagugcaggc

SEQ ID NO: 114650 - RNA, 26 nt, Human
auugaugagaacaagaguuaaugccc

SEQ ID NO: 114651 - RNA, 20 nt, Human
cuuuugagcuucauuucagg

SEQ ID NO: 114652 - RNA, 22 nt, Human
cguuugaacucaggaggcagag

SEQ ID NO: 114653 - RNA, 22 nt, Human
gguggaagaaaccaugggcagg

SEQ ID NO: 114654 - RNA, 18 nt, Human
cagugccaccaagcucac

SEQ ID NO: 114655 - RNA, 21 nt, Human
gggaugagcauggagcuggcc

SEQ ID NO: 114656 - RNA, 22 nt, Human
accugccuguccuuccugggcc

SEQ ID NO: 114657 - RNA, 20 nt, Human
gcuuauuuucuuuuguuuau

SEQ ID NO: 114658 - RNA, 21 nt, Human
ccgagggucucacugugucau

SEQ ID NO: 114659 - RNA, 21 nt, Human
agaaaagucuguuacaguugc

SEQ ID NO: 114660 - RNA, 22 nt, Human
uacagaagaaaaggauauuuau

SEQ ID NO: 114661 - RNA, 23 nt, Human
augaguagugaagggacuguguu

SEQ ID NO: 114662 - RNA, 21 nt, Human
ugagaaauguguagcugcaaa

SEQ ID NO: 114663 - RNA, 26 nt, Human
agaggcggucagccugggagucccgg

SEQ ID NO: 114664 - RNA, 17 nt, Human
gcccucuggccccucgu

SEQ ID NO: 114665 - RNA, 22 nt, Human
ugccaucuuagguugccaugag

SEQ ID NO: 114666 - RNA, 20 nt, Human
ugcccagggcgguggcugug

SEQ ID NO: 114667 - RNA, 23 nt, Human
accacgcccacgucaacgugagc

SEQ ID NO: 114668 - RNA, 22 nt, Human
acuaaguugcugagacaaggga

SEQ ID NO: 114669 - RNA, 26 nt, Human
gguccccaggaaggauggggugugcc

SEQ ID NO: 114670 - RNA, 26 nt, Human
ccucauucagccucuugggcuccuuu

SEQ ID NO: 114671 - RNA, 30 nt, Human
gccauuaaauuuucaaaauguaauuuaaaa

SEQ ID NO: 114672 - RNA, 20 nt, Human
gucugguaggaaugaccuca

SEQ ID NO: 114673 - RNA, 29 nt, Human
cccaagagguggagguuacagugagcaga

SEQ ID NO: 114674 - RNA, 23 nt, Human
ucuuauuuuacaguacagugggg

SEQ ID NO: 114675 - RNA, 24 nt, Human
ggcucacugcaguuucaaguuccu

SEQ ID NO: 114676 - RNA, 21 nt, Human
ggaaggaggaggaaacugugg

SEQ ID NO: 114677 - RNA, 27 nt, Human
gcaagcagagucaugaccagggacaca

SEQ ID NO: 114678 - RNA, 24 nt, Human
ugucacccaggcuugagugcagug

SEQ ID NO: 114679 - RNA, 22 nt, Human
ucugcccuuccuuucccugggg

SEQ ID NO: 114680 - RNA, 21 nt, Human
ucugccuggcauuuaggcagc

SEQ ID NO: 114681 - RNA, 20 nt, Human
aaacccacacccacuguccu

SEQ ID NO: 114682 - RNA, 26 nt, Human
aaacucaugucugugucccaugguca

SEQ ID NO: 114683 - RNA, 25 nt, Human
gucacccaaauagcugagugcaguc

SEQ ID NO: 114684 - RNA, 24 nt, Human
ggagggcagagggagaauccaagg

SEQ ID NO: 114685 - RNA, 21 nt, Human
uaaacucagugaacccaaacc

SEQ ID NO: 114686 - RNA, 22 nt, Human
ugucgcuuaugucuauaacucc

SEQ ID NO: 114687 - RNA, 22 nt, Human
ucucccaggcuggagugcaauc

SEQ ID NO: 114688 - RNA, 23 nt, Human
cucagugagcuuugauauggucc

SEQ ID NO: 114689 - RNA, 25 nt, Human
uugaacccagcugauaugcaagguc

SEQ ID NO: 114690 - RNA, 23 nt, Human
gccagggagaagcuccucucccc

SEQ ID NO: 114691 - RNA, 22 nt, Human
gucugaaaacauuuccccugcu

SEQ ID NO: 114692 - RNA, 24 nt, Human
ggagagggaaucggagggagcagc

SEQ ID NO: 114693 - RNA, 19 nt, Human
ccagacaccuccacgccca

SEQ ID NO: 114694 - RNA, 24 nt, Human
auucccacucucauuaauccauca

SEQ ID NO: 114695 - RNA, 20 nt, Human
uucaguuucauguaucuuug

SEQ ID NO: 114696 - RNA, 23 nt, Human
gccucugaaggccaguggcagca

SEQ ID NO: 114697 - RNA, 24 nt, Human
ggucugccacacuggugcaccuug

SEQ ID NO: 114698 - RNA, 25 nt, Human
ccugcaccuggccugggccacaccu

SEQ ID NO: 114699 - RNA, 24 nt, Human
uaauuagucuugacuuacuucauu

SEQ ID NO: 114700 - RNA, 27 nt, Human
gccuggaccuggcugggcuccaugaga

SEQ ID NO: 114701 - RNA, 20 nt, Human
gaaacccaucaauugcucaa

SEQ ID NO: 114702 - RNA, 21 nt, Human
gccgaggcuggacccuguggc

SEQ ID NO: 114703 - RNA, 23 nt, Human
ccauacaggaacaaaauaggagg

SEQ ID NO: 114704 - RNA, 23 nt, Human
cccugccucugagccuggacggg

SEQ ID NO: 114705 - RNA, 28 nt, Human
caccuacugcacuuucccccuucccgcc

SEQ ID NO: 114706 - RNA, 26 nt, Human
uacaguaguuccaguccuaacuuucu

SEQ ID NO: 114707 - RNA, 27 nt, Human
ccugcagcuccuucaucaugaacuggc

SEQ ID NO: 114708 - RNA, 31 nt, Human
ggcccagucgcugcaaccauccagcagccgc

SEQ ID NO: 114709 - RNA, 25 nt, Human
uggacuauggacucuuucaaaggga

SEQ ID NO: 114710 - RNA, 22 nt, Human
ggugaacacgcugacugugaac

SEQ ID NO: 114711 - RNA, 23 nt, Human
ggcuggcuccagaugcagggcag

SEQ ID NO: 114712 - RNA, 19 nt, Human
uuccucuccauuuugcugu

SEQ ID NO: 114713 - RNA, 19 nt, Human
cuguccuuuuaaguguacc

SEQ ID NO: 114714 - RNA, 27 nt, Human
uaucccuuuaaucugugaccauggggc

SEQ ID NO: 114715 - RNA, 22 nt, Human
aagaacauuuaugaaaucaagc

SEQ ID NO: 114716 - RNA, 25 nt, Human
caguucauucaccugauuacuuugg

SEQ ID NO: 114717 - RNA, 21 nt, Human
aaauacuuaauaaaucugcca

SEQ ID NO: 114718 - RNA, 25 nt, Human
ccagaaagugauuggcaaggcuuug

SEQ ID NO: 114719 - RNA, 15 nt, Human
ccauuucucuccuca

SEQ ID NO: 114720 - RNA, 19 nt, Human
uuagaauacugcaaaggau

SEQ ID NO: 114721 - RNA, 26 nt, Human
ggaaggcaggaggguggcagcguccc

SEQ ID NO: 114722 - RNA, 27 nt, Human
gugacagcugcugcccacgcaugugga

SEQ ID NO: 114723 - RNA, 22 nt, Human
ccuggccuguucuguuuugccu

SEQ ID NO: 114724 - RNA, 22 nt, Human
ccuucucccggccuccuucaca

SEQ ID NO: 114725 - RNA, 23 nt, Human
aacugguauucaaaaaugaauaa

SEQ ID NO: 114726 - RNA, 26 nt, Human
gguagcaaaugcaugauuucucugug

SEQ ID NO: 114727 - RNA, 27 nt, Human
ugaaaccaaaauauauuugcuucaucu

SEQ ID NO: 114728 - RNA, 27 nt, Human
uggucucaaucuccugaccuugugaac

SEQ ID NO: 114729 - RNA, 27 nt, Human
uggucucaaacuccugaccuugugauc

SEQ ID NO: 114730 - RNA, 25 nt, Human
gagagggagggaacagugcccaagc

SEQ ID NO: 114731 - RNA, 24 nt, Human
aacaugggggaaaaaacugacauu

SEQ ID NO: 114732 - RNA, 23 nt, Human
uccaugaagaccacugaaugaac

SEQ ID NO: 114733 - RNA, 27 nt, Human
ugccucuguuccugaauuacauaagaa

SEQ ID NO: 114734 - RNA, 20 nt, Human
gccacuggggaaaacuccac

SEQ ID NO: 114735 - RNA, 21 nt, Human
acaccuuuaacaauguauaug

SEQ ID NO: 114736 - RNA, 26 nt, Human
gcugcuugaugguguguacaaacuca

SEQ ID NO: 114737 - RNA, 22 nt, Human
ccaacguacugggauuacaggc

SEQ ID NO: 114738 - RNA, 25 nt, Human
ucccaggcuggagugcaaucgcgca

SEQ ID NO: 114739 - RNA, 23 nt, Human
uaaacuagaaaguguuagguaaa

SEQ ID NO: 114740 - RNA, 27 nt, Human
ugcuguugcuuauucugaaaggaaugu

SEQ ID NO: 114741 - RNA, 26 nt, Human
cgcuuccuggaaguccugaagcucuc

SEQ ID NO: 114742 - RNA, 20 nt, Human
cagaagccagccuaucucua

SEQ ID NO: 114743 - RNA, 20 nt, Human
ugggcagaaccagagagaug

SEQ ID NO: 114744 - RNA, 22 nt, Human
cuagaugccugagaagggagaa

SEQ ID NO: 114745 - RNA, 20 nt, Human
ugggucugagagucacugga

SEQ ID NO: 114746 - RNA, 21 nt, Human
auggggagggacagggucggc

SEQ ID NO: 114747 - RNA, 21 nt, Human
ccucacugcccgcacacccuc

SEQ ID NO: 114748 - RNA, 27 nt, Human
accucucugaacugcaacacuggauug

SEQ ID NO: 114749 - RNA, 24 nt, Human
gcuuucuuucuuuugcccuucaca

SEQ ID NO: 114750 - RNA, 24 nt, Human
ggagcucggaucccaguguggacc

SEQ ID NO: 114751 - RNA, 22 nt, Human
auugcuugagccugggaguuug

SEQ ID NO: 114752 - RNA, 22 nt, Human
auugcuugagcccaggaguuca

SEQ ID NO: 114753 - RNA, 19 nt, Human
ccuauagaagcaugcuuua

SEQ ID NO: 114754 - RNA, 16 nt, Human
aucuuccauuguguuu

SEQ ID NO: 114755 - RNA, 27 nt, Human
ucaugccagcucauuacagcaugagaa

SEQ ID NO: 114756 - RNA, 27 nt, Human
gccgguuuuucuuucucccugauggac

SEQ ID NO: 114757 - RNA, 19 nt, Human
ucuucuuucuuucuuuugc

SEQ ID NO: 114758 - RNA, 26 nt, Human
ggccucucaccucugugccucugucu

SEQ ID NO: 114759 - RNA, 22 nt, Human
auacaguuaucugauggucccu

SEQ ID NO: 114760 - RNA, 21 nt, Human
agccaacauggcaaaacccca

SEQ ID NO: 114761 - RNA, 27 nt, Human
cccuccaggugaagcuggcucaggugc

SEQ ID NO: 114762 - RNA, 27 nt, Human
gagcuuuuaccuuguagcagagcagua

SEQ ID NO: 114763 - RNA, 26 nt, Human
cccgcuuccgcccgcuguccugcugc

SEQ ID NO: 114764 - RNA, 25 nt, Human
uccauggaugacaccaccugcccau

SEQ ID NO: 114765 - RNA, 26 nt, Human
ccuccugguuuccaagcugguccauc

SEQ ID NO: 114766 - RNA, 23 nt, Human
aauucacuucucuuccucccuca

SEQ ID NO: 114767 - RNA, 20 nt, Human
gggcggcggcaggccuagca

SEQ ID NO: 114768 - RNA, 27 nt, Human
ucaagccccaagacauccccuuagaug

SEQ ID NO: 114769 - RNA, 21 nt, Human
cuuuucugugguugcagccug

SEQ ID NO: 114770 - RNA, 21 nt, Human
ggcucagugcaaccucugccu

SEQ ID NO: 114771 - RNA, 21 nt, Human
ggucaggaagagugggagaaa

SEQ ID NO: 114772 - RNA, 21 nt, Human
augagccuggagcaguaguac

SEQ ID NO: 114773 - RNA, 20 nt, Human
ccuucccagcccagcccagc

SEQ ID NO: 114774 - RNA, 23 nt, Human
agcccccgggagcuggagggugg

SEQ ID NO: 114775 - RNA, 22 nt, Human
agccacugcccaaagccaucuu

SEQ ID NO: 114776 - RNA, 27 nt, Human
ggcugagaaaucguagagcagugaggc

SEQ ID NO: 114777 - RNA, 22 nt, Human
cagcaagacucugucucaaaaa

SEQ ID NO: 114778 - RNA, 18 nt, Human
aaacaccuguuuauccca

SEQ ID NO: 114779 - RNA, 20 nt, Human
acacguguaugcacagcaga

SEQ ID NO: 114780 - RNA, 23 nt, Human
agaucugccagccccaggccucu

SEQ ID NO: 114781 - RNA, 24 nt, Human
gauacagaucucagggcucgggag

SEQ ID NO: 114782 - RNA, 27 nt, Human
cugcugcuucugggccugauggagagg

SEQ ID NO: 114783 - RNA, 19 nt, Human
gacagagagcagaucaaug

SEQ ID NO: 114784 - RNA, 24 nt, Human
uaacuucauuuuguaucuugcuua

SEQ ID NO: 114785 - RNA, 22 nt, Human
uucuccaugucggucaggcugg

SEQ ID NO: 114786 - RNA, 26 nt, Human
gcaugcugguaaaaccacuacccuca

SEQ ID NO: 114787 - RNA, 23 nt, Human
uuuguuaagagugcaguauugca

SEQ ID NO: 114788 - RNA, 22 nt, Human
ccaauuuauccuugaccaauaa

SEQ ID NO: 114789 - RNA, 23 nt, Human
acagucagggaaggugccucugg

SEQ ID NO: 114790 - RNA, 19 nt, Human
cccuuuacagcaccaccuu

SEQ ID NO: 114791 - RNA, 20 nt, Human
ggauuacaggcuugaaaguc

SEQ ID NO: 114792 - RNA, 27 nt, Human
cacugcacucuagccuggcaacagagc

SEQ ID NO: 114793 - RNA, 22 nt, Human
cacugugcacucuacucugcga

SEQ ID NO: 114794 - RNA, 22 nt, Human
cccucauucuuuucaugagccc

SEQ ID NO: 114795 - RNA, 20 nt, Human
accagaugccucuguccuca

SEQ ID NO: 114796 - RNA, 22 nt, Human
cugugugcagugaagguugcug

SEQ ID NO: 114797 - RNA, 20 nt, Human
ucagggaggguggucauugc

SEQ ID NO: 114798 - RNA, 25 nt, Human
aauguucuuucccuucugguuaucu

SEQ ID NO: 114799 - RNA, 21 nt, Human
cucaucugaaaagcccuccug

SEQ ID NO: 114800 - RNA, 22 nt, Human
ccuugcucagugccuccuggcc

SEQ ID NO: 114801 - RNA, 22 nt, Human
aggaggcagagucucuaguucc

SEQ ID NO: 114802 - RNA, 23 nt, Human
aggagacggcuccaggcacucag

SEQ ID NO: 114803 - RNA, 24 nt, Human
uguauucuaucccagaucacagga

SEQ ID NO: 114804 - RNA, 22 nt, Human
gcaauauagugaaaccccaucu

SEQ ID NO: 114805 - RNA, 27 nt, Human
agcuuucuaguucauuuccaguaacug

SEQ ID NO: 114806 - RNA, 21 nt, Human
uguggaauguuaaauaacgcu

SEQ ID NO: 114807 - RNA, 19 nt, Human
caggcuccaagaucuccug

SEQ ID NO: 114808 - RNA, 19 nt, Human
uaggagucaaaaagaaagg

SEQ ID NO: 114809 - RNA, 27 nt, Human
gcuuggguggggguugggugggaggga

SEQ ID NO: 114810 - RNA, 24 nt, Human
ggcuacuguucuguucuguauuuu

SEQ ID NO: 114811 - RNA, 24 nt, Human
uauuuugcguuucuuacugccuuc

SEQ ID NO: 114812 - RNA, 22 nt, Human
augcagccagaggagggcacag

SEQ ID NO: 114813 - RNA, 32 nt, Human
acugguuuuacuuacaaaaaugggaaaaauaa

SEQ ID NO: 114814 - RNA, 23 nt, Human
acacccugaagacacaacuugac

SEQ ID NO: 114815 - RNA, 28 nt, Human
gcuugaagugaugaaacccacagauccu

SEQ ID NO: 114816 - RNA, 22 nt, Human
aaagugcugggguuacaggugu

SEQ ID NO: 114817 - RNA, 21 nt, Human
ugaggggcggacggaggcggc

SEQ ID NO: 114818 - RNA, 22 nt, Human
gcccagguccuuguaucaugcc

SEQ ID NO: 114819 - RNA, 19 nt, Human
guauuauucucucuucucu

SEQ ID NO: 114820 - RNA, 25 nt, Human
cuggccucucuggcugggugcagug

SEQ ID NO: 114821 - RNA, 19 nt, Human
ucaguaauuguaaagugau

SEQ ID NO: 114822 - RNA, 24 nt, Human
ggaggaagagcgccugugcugugg

SEQ ID NO: 114823 - RNA, 20 nt, Human
uggacaacuguagugcagug

SEQ ID NO: 114824 - RNA, 23 nt, Human
gccuauuaucaguaaggggacuu

SEQ ID NO: 114825 - RNA, 22 nt, Human
uuauccuauguggaauccccca

SEQ ID NO: 114826 - RNA, 22 nt, Human
gcaugagccaccaugcccaguc

SEQ ID NO: 114827 - RNA, 20 nt, Human
ccccugccucccugaacaua

SEQ ID NO: 114828 - RNA, 21 nt, Human
uaaauuagcagagaagcucac

SEQ ID NO: 114829 - RNA, 21 nt, Human
gguaaaggaaaaaugcuguca

SEQ ID NO: 114830 - RNA, 22 nt, Human
ccgcgcagaugacaccaucaac

SEQ ID NO: 114831 - RNA, 24 nt, Human
cugccuccuccugccugucugcac

SEQ ID NO: 114832 - RNA, 24 nt, Human
gccaaaaacaacaaauagccacag

SEQ ID NO: 114833 - RNA, 23 nt, Human
cccgccuuugccccacccuacuc

SEQ ID NO: 114834 - RNA, 22 nt, Human
gggccccgccggcagagguccc

SEQ ID NO: 114835 - RNA, 23 nt, Human
gucacccaggcuggaguacacug

SEQ ID NO: 114836 - RNA, 21 nt, Human
ggggggcccucaccccaucac

SEQ ID NO: 114837 - RNA, 22 nt, Human
ggcuuggagcuugcaggucccu

SEQ ID NO: 114838 - RNA, 26 nt, Human
gaagccaggcuggaggggccugagug

SEQ ID NO: 114839 - RNA, 27 nt, Human
ugcucucugcacaccccauucuuaaac

SEQ ID NO: 114840 - RNA, 21 nt, Human
uccagcagugaggagacagcc

SEQ ID NO: 114841 - RNA, 20 nt, Human
ucauagccccugugcagccu

SEQ ID NO: 114842 - RNA, 22 nt, Human
aaagugcugagauuacagacgu

SEQ ID NO: 114843 - RNA, 19 nt, Human
acaggucacuaagcgucuc

SEQ ID NO: 114844 - RNA, 27 nt, Human
uugcuccuguugugcaggcuggagugc

SEQ ID NO: 114845 - RNA, 26 nt, Human
cauccagccuggcguccagguugccc

SEQ ID NO: 114846 - RNA, 25 nt, Human
caaacucaggacacuuuaacagggc

SEQ ID NO: 114847 - RNA, 19 nt, Human
acgggugcaugaaaccacu

SEQ ID NO: 114848 - RNA, 24 nt, Human
accaugccuggcuaauuuucuugu

SEQ ID NO: 114849 - RNA, 24 nt, Human
aacuguacuggccaauuuuugaaa

SEQ ID NO: 114850 - RNA, 27 nt, Human
uccugaaggaaggaagauucagucucc

SEQ ID NO: 114851 - RNA, 21 nt, Human
cacucacugcaggcuccgccu

SEQ ID NO: 114852 - RNA, 22 nt, Human
cgcuugaacccgggagguggag

SEQ ID NO: 114853 - RNA, 26 nt, Human
gcaugucuuauucaguuccagcucau

SEQ ID NO: 114854 - RNA, 27 nt, Human
ucaggccuccugaaaacagcacugccu

SEQ ID NO: 114855 - RNA, 27 nt, Human
auguggauucauuuugaauuggugcua

SEQ ID NO: 114856 - RNA, 20 nt, Human
gggacugucccaucagugaa

SEQ ID NO: 114857 - RNA, 21 nt, Human
cagguuaagauuuucugcucu

SEQ ID NO: 114858 - RNA, 21 nt, Human
ccccgcccgggccaagggagc

SEQ ID NO: 114859 - RNA, 30 nt, Human
uggcgcgaacacuggaaugcauauacuacu

SEQ ID NO: 114860 - RNA, 22 nt, Human
gagccuuggcccacacugaggc

SEQ ID NO: 114861 - RNA, 21 nt, Human
gaacgcauucggaaggcuuuu

SEQ ID NO: 114862 - RNA, 27 nt, Human
cgcagccgccgccgcccacgccggccu

SEQ ID NO: 114863 - RNA, 22 nt, Human
gaugaagcaaacccacacccua

SEQ ID NO: 114864 - RNA, 19 nt, Human
aguauaggcugcaucaucu

SEQ ID NO: 114865 - RNA, 20 nt, Human
ccugucucuauucuaggcaa

SEQ ID NO: 114866 - RNA, 22 nt, Human
gugggcggaucaccugaggucg

SEQ ID NO: 114867 - RNA, 24 nt, Human
guuuuccaugaauacagcauguau

SEQ ID NO: 114868 - RNA, 20 nt, Human
cgucugucugucgcccuucu

SEQ ID NO: 114869 - RNA, 22 nt, Human
ugggcagcccaacagcacuuuu

SEQ ID NO: 114870 - RNA, 21 nt, Human
gcugccuucugcccaguggga

SEQ ID NO: 114871 - RNA, 22 nt, Human
cuccguuuggcagugcaauggu

SEQ ID NO: 114872 - RNA, 27 nt, Human
ccugcagcuggcugcucaggagauggc

SEQ ID NO: 114873 - RNA, 27 nt, Human
ucuguuuccuguucucuuguauagcug

SEQ ID NO: 114874 - RNA, 23 nt, Human
gaggcagcacaaggaggauguga

SEQ ID NO: 114875 - RNA, 21 nt, Human
cuucgacacuguucuuagcuc

SEQ ID NO: 114876 - RNA, 23 nt, Human
gcauggaaagggagccugggagc

SEQ ID NO: 114877 - RNA, 24 nt, Human
agagggaaagcgagagggagacgg

SEQ ID NO: 114878 - RNA, 21 nt, Human
ggccuagguuaagugugcaag

SEQ ID NO: 114879 - RNA, 24 nt, Human
aggugggcggaucaccugaggucg

SEQ ID NO: 114880 - RNA, 19 nt, Human
uguccucuauaccuguguc

SEQ ID NO: 114881 - RNA, 21 nt, Human
agccgaguccccacuccggag

SEQ ID NO: 114882 - RNA, 21 nt, Human
ucuccugccgccuccuguguc

SEQ ID NO: 114883 - RNA, 20 nt, Human
cgugguuaaacucgcucacu

SEQ ID NO: 114884 - RNA, 22 nt, Human
cagccggcuguggagcagcagg

SEQ ID NO: 114885 - RNA, 21 nt, Human
ccuacuuccccgcccgcagga

SEQ ID NO: 114886 - RNA, 20 nt, Human
ugaggacaacagccugggcc

SEQ ID NO: 114887 - RNA, 26 nt, Human
gagacacccccgguccaagccucccc

SEQ ID NO: 114888 - RNA, 23 nt, Human
aucgccagucgucuucugccaca

SEQ ID NO: 114889 - RNA, 22 nt, Human
guucugggccucugaacccccu

SEQ ID NO: 114890 - RNA, 22 nt, Human
agaccagccugccaggcccucc

SEQ ID NO: 114891 - RNA, 27 nt, Human
gucggcucagcagccuccaacuucucc

SEQ ID NO: 114892 - RNA, 26 nt, Human
gcagccuggccuugccuucacagggc

SEQ ID NO: 114893 - RNA, 24 nt, Human
auugaaaagggucagcugggaaaa

SEQ ID NO: 114894 - RNA, 21 nt, Human
uguccgcccucagccuccugg

SEQ ID NO: 114895 - RNA, 23 nt, Human
aucauuccagagaaaagccacuu

SEQ ID NO: 114896 - RNA, 26 nt, Human
cccucaauugagaaccacuggucuag

SEQ ID NO: 114897 - RNA, 22 nt, Human
ugcugguggcagggaucuaucu

SEQ ID NO: 114898 - RNA, 21 nt, Human
aguagcugggauuacaagcac

SEQ ID NO: 114899 - RNA, 19 nt, Human
agagaauuuaagcacagaa

SEQ ID NO: 114900 - RNA, 18 nt, Human
gccauccccucuucuacc

SEQ ID NO: 114901 - RNA, 27 nt, Human
cuuuauggccuuuccaucauaguugcc

SEQ ID NO: 114902 - RNA, 20 nt, Human
agacacagggucagagaucu

SEQ ID NO: 114903 - RNA, 24 nt, Human
cccuccaggccucaguuucuucac

SEQ ID NO: 114904 - RNA, 23 nt, Human
cuuugggcuuaguauuucucagg

SEQ ID NO: 114905 - RNA, 20 nt, Human
ucuucuucuuucgcgguuca

SEQ ID NO: 114906 - RNA, 20 nt, Human
aucaagaauaaggaaauaua

SEQ ID NO: 114907 - RNA, 22 nt, Human
ucagcucuguggaguuuucccu

SEQ ID NO: 114908 - RNA, 23 nt, Human
uuguauuuuuaacaccagaaaga

SEQ ID NO: 114909 - RNA, 22 nt, Human
agguguguugagauuucugugu

SEQ ID NO: 114910 - RNA, 21 nt, Human
ccagugccauuugucugugca

SEQ ID NO: 114911 - RNA, 27 nt, Human
cccgaguagcugggauuccaggcgccc

SEQ ID NO: 114912 - RNA, 22 nt, Human
augucacuaaggauggcugauu

SEQ ID NO: 114913 - RNA, 23 nt, Human
cccaggagacggugguugcagug

SEQ ID NO: 114914 - RNA, 23 nt, Human
ggcuaauuuuuuguauuuuagua

SEQ ID NO: 114915 - RNA, 25 nt, Human
ugccuccagccagccuuugcccgcu

SEQ ID NO: 114916 - RNA, 24 nt, Human
uucauaucauuuauaaucuuguca

SEQ ID NO: 114917 - RNA, 21 nt, Human
cuuuccugaugguacaggaaa

SEQ ID NO: 114918 - RNA, 21 nt, Human
guauuuuuaaauucugcuccu

SEQ ID NO: 114919 - RNA, 20 nt, Human
ggugagccaagauggcacca

SEQ ID NO: 114920 - RNA, 27 nt, Human
ggcuggaccuaaauagauugauuucau

SEQ ID NO: 114921 - RNA, 22 nt, Human
gaacuccuggacucaagcaacc

SEQ ID NO: 114922 - RNA, 23 nt, Human
ucucccacugggcucccccaucc

SEQ ID NO: 114923 - RNA, 19 nt, Human
gguggcagaggugggauga

SEQ ID NO: 114924 - RNA, 23 nt, Human
ccugcuccuggagcuucacugga

SEQ ID NO: 114925 - RNA, 21 nt, Human
uuucuaugcuggaguauuuuc

SEQ ID NO: 114926 - RNA, 19 nt, Human
cguucacaccugguggcag

SEQ ID NO: 114927 - RNA, 20 nt, Human
gggcaaggacucacgccaaa

SEQ ID NO: 114928 - RNA, 20 nt, Human
aaacagugccaaaugcuggg

SEQ ID NO: 114929 - RNA, 22 nt, Human
ucccaacaacaugaaacugccu

SEQ ID NO: 114930 - RNA, 24 nt, Human
cauaugaccaugauguucagggcu

SEQ ID NO: 114931 - RNA, 26 nt, Human
gguguaggaggggcugcagcagaggc

SEQ ID NO: 114932 - RNA, 23 nt, Human
gcacugcagcauuucugcugcuc

SEQ ID NO: 114933 - RNA, 25 nt, Human
ggauucucauaaggaaagcaaugac

SEQ ID NO: 114934 - RNA, 25 nt, Human
ucucucuccccuuggagcucuugcc

SEQ ID NO: 114935 - RNA, 25 nt, Human
agugugccugcaacccaaguggccu

SEQ ID NO: 114936 - RNA, 22 nt, Human
uuuuguuuaaaaaugcaguuuu

SEQ ID NO: 114937 - RNA, 22 nt, Human
agcagugucuuucaaaaaauca

SEQ ID NO: 114938 - RNA, 22 nt, Human
ugggauggaaacaguguggccu

SEQ ID NO: 114939 - RNA, 24 nt, Human
gugcucucaccagcugcugcucug

SEQ ID NO: 114940 - RNA, 22 nt, Human
ccucacagccccugucauuccg

SEQ ID NO: 114941 - RNA, 24 nt, Human
agauggcuacaggccgcggaggag

SEQ ID NO: 114942 - RNA, 24 nt, Human
aaguaguacuucuucuguaauauu

SEQ ID NO: 114943 - RNA, 18 nt, Human
ccaaagcagaggcagugg

SEQ ID NO: 114944 - RNA, 21 nt, Human
caaggcaugagaaucgcuuga

SEQ ID NO: 114945 - RNA, 22 nt, Human
caguggcagagcgccaggcaga

SEQ ID NO: 114946 - RNA, 22 nt, Human
ugcaugucugccuaugcacuga

SEQ ID NO: 114947 - RNA, 26 nt, Human
ccugcccucgaccuucccaccuccuc

SEQ ID NO: 114948 - RNA, 26 nt, Human
cuggggugugggaugcacggccucgu

SEQ ID NO: 114949 - RNA, 26 nt, Human
uucucucuuucccccagacuauguca

SEQ ID NO: 114950 - RNA, 27 nt, Human
agcuuugagagaaggcugugacugcug

SEQ ID NO: 114951 - RNA, 21 nt, Human
caaucaggagugguggaaccu

SEQ ID NO: 114952 - RNA, 23 nt, Human
gcugcaagagcuucuuagcaguu

SEQ ID NO: 114953 - RNA, 27 nt, Human
cuguggacccugucuucugggcacagu

SEQ ID NO: 114954 - RNA, 22 nt, Human
cccccaucugcugccuuuucua

SEQ ID NO: 114955 - RNA, 25 nt, Human
uaaaacaauugggcaaaacuaccua

SEQ ID NO: 114956 - RNA, 24 nt, Human
ugagguacaaccuguucugcuuuc

SEQ ID NO: 114957 - RNA, 26 nt, Human
gcccucucgccaggcuggaguguagu

SEQ ID NO: 114958 - RNA, 17 nt, Human
gcagccuccucugugac

SEQ ID NO: 114959 - RNA, 21 nt, Human
agcuugugauuucuuccagcu

SEQ ID NO: 114960 - RNA, 25 nt, Human
uagggacauguauucauuuuguuau

SEQ ID NO: 114961 - RNA, 23 nt, Human
cugguguggaaccagggagcugu

SEQ ID NO: 114962 - RNA, 21 nt, Human
guagcucugugauucuuccag

SEQ ID NO: 114963 - RNA, 21 nt, Human
auuauuauuauuugcuuuuca

SEQ ID NO: 114964 - RNA, 25 nt, Human
gaccagccccuuccuggguauuuau

SEQ ID NO: 114965 - RNA, 26 nt, Human
guuucgagagaaaggagggcaacuuc

SEQ ID NO: 114966 - RNA, 22 nt, Human
caaaaucacuggcaccaaaaau

SEQ ID NO: 114967 - RNA, 27 nt, Human
cuuuaaucaugguuucaugagcauuaa

SEQ ID NO: 114968 - RNA, 22 nt, Human
ccaugggcucccacugcagccu

SEQ ID NO: 114969 - RNA, 26 nt, Human
uuuagcccucugcccccgcccuugcu

SEQ ID NO: 114970 - RNA, 21 nt, Human
cuugguuucccuugugcagcc

SEQ ID NO: 114971 - RNA, 21 nt, Human
cacagccaggcuggagucagu

SEQ ID NO: 114972 - RNA, 20 nt, Human
gcgagcgaggcucaccgucc

SEQ ID NO: 114973 - RNA, 24 nt, Human
ugcuauuccauggauccuagguca

SEQ ID NO: 114974 - RNA, 24 nt, Human
cucugcaucccuucugucccucca

SEQ ID NO: 114975 - RNA, 23 nt, Human
uccuguaacaagccagauuuuuu

SEQ ID NO: 114976 - RNA, 27 nt, Human
cagcccagcugacugugccuguucuga

SEQ ID NO: 114977 - RNA, 28 nt, Human
ucucugaggcccacacaaagcuggacac

SEQ ID NO: 114978 - RNA, 24 nt, Human
ccuguggcagcugcugccccagcc

SEQ ID NO: 114979 - RNA, 21 nt, Human
aagugaucaauaaaaugugau

SEQ ID NO: 114980 - RNA, 21 nt, Human
agugguuuuauacugaaggaa

SEQ ID NO: 114981 - RNA, 21 nt, Human
uuuuuguuugcuugcagugcu

SEQ ID NO: 114982 - RNA, 26 nt, Human
uuccucacucagacagcuggcuuugu

SEQ ID NO: 114983 - RNA, 23 nt, Human
auagaguuugaacaaauauuuua

SEQ ID NO: 114984 - RNA, 20 nt, Human
cuccuuuucugggccuccuc

SEQ ID NO: 114985 - RNA, 23 nt, Human
uggauaagagaauccuuuuagca

SEQ ID NO: 114986 - RNA, 23 nt, Human
aacacaaauaaaugcuugaggag

SEQ ID NO: 114987 - RNA, 27 nt, Human
ucauauuuauaugaggcuguugucuuu

SEQ ID NO: 114988 - RNA, 22 nt, Human
cuauugcccccaccaccaccac

SEQ ID NO: 114989 - RNA, 26 nt, Human
cggagaggcaggugagagggaggugg

SEQ ID NO: 114990 - RNA, 22 nt, Human
gaccagccagggcaacaugaug

SEQ ID NO: 114991 - RNA, 22 nt, Human
agugagccacccucggagaccc

SEQ ID NO: 114992 - RNA, 28 nt, Human
gucaccuuaaaauaagauuuuguuagcc

SEQ ID NO: 114993 - RNA, 21 nt, Human
auuugagaccagccugggcaa

SEQ ID NO: 114994 - RNA, 21 nt, Human
auuaccccugcuguacacauc

SEQ ID NO: 114995 - RNA, 22 nt, Human
aaaccuacgaacccagcucugg

SEQ ID NO: 114996 - RNA, 25 nt, Human
agcucuuggguuuagcaaaaguuca

SEQ ID NO: 114997 - RNA, 22 nt, Human
aauuaaaauauucuuuaauacu

SEQ ID NO: 114998 - RNA, 20 nt, Human
gcccucgggggcauggcgcg

SEQ ID NO: 114999 - RNA, 25 nt, Human
ccucacuucuuugauugaauacuua

SEQ ID NO: 115000 - RNA, 23 nt, Human
cuucauaauucuagaaaguuauu

SEQ ID NO: 115001 - RNA, 22 nt, Human
aaaaaguuuugaugaaauucuu

SEQ ID NO: 115002 - RNA, 22 nt, Human
agucacugugccaucuuccuga

SEQ ID NO: 115003 - RNA, 21 nt, Human
acuggguucagcuguggugcu

SEQ ID NO: 115004 - RNA, 27 nt, Human
gggacuccacauccuccagcccccaca

SEQ ID NO: 115005 - RNA, 21 nt, Human
uaagguagggaggaggaagau

SEQ ID NO: 115006 - RNA, 19 nt, Human
gcaguagaugguggcagcc

SEQ ID NO: 115007 - RNA, 22 nt, Human
uagaugaaugguuaacacgagc

SEQ ID NO: 115008 - RNA, 22 nt, Human
aaaaaaguuuuuccuccacuga

SEQ ID NO: 115009 - RNA, 17 nt, Human
cuccguugcugaccgcc

SEQ ID NO: 115010 - RNA, 22 nt, Human
ccuagaaaacagcuucuuacug

SEQ ID NO: 115011 - RNA, 27 nt, Human
cugggagggagggggcagcaggccccu

SEQ ID NO: 115012 - RNA, 27 nt, Human
aauuucugcuuuugcaucuuugggaca

SEQ ID NO: 115013 - RNA, 25 nt, Human
gugggcuccagggacuggaguguaa

SEQ ID NO: 115014 - RNA, 24 nt, Human
aaugagggguagagccacucuggg

SEQ ID NO: 115015 - RNA, 26 nt, Human
ccuccaggcccaaacaggcugaagcu

SEQ ID NO: 115016 - RNA, 20 nt, Human
gcccugcuucuucccauuga

SEQ ID NO: 115017 - RNA, 21 nt, Human
guccaccuucugauuauuuuu

SEQ ID NO: 115018 - RNA, 23 nt, Human
cacacaguguggagaucccacgu

SEQ ID NO: 115019 - RNA, 25 nt, Human
ccugguucccaccauucccugccuu

SEQ ID NO: 115020 - RNA, 24 nt, Human
agagacuccuccagacccacucag

SEQ ID NO: 115021 - RNA, 25 nt, Human
ucugcuguuuagaacuuuguggacu

SEQ ID NO: 115022 - RNA, 26 nt, Human
agugugcuugaaugcccuucuuucca

SEQ ID NO: 115023 - RNA, 27 nt, Human
caggcagcgggcggcggggagcagcau

SEQ ID NO: 115024 - RNA, 21 nt, Human
ugugcaggcuggagugcagug

SEQ ID NO: 115025 - RNA, 25 nt, Human
cucacgugcagacccugccaugcag

SEQ ID NO: 115026 - RNA, 21 nt, Human
accagugacccuguuuugugg

SEQ ID NO: 115027 - RNA, 22 nt, Human
ccaagaucgcaccauugcacuc

SEQ ID NO: 115028 - RNA, 22 nt, Human
ccgagaucgcgccauugcacuc

SEQ ID NO: 115029 - RNA, 18 nt, Human
ucaacaaaagauuggucc

SEQ ID NO: 115030 - RNA, 26 nt, Human
ugaacaaaagcucagguuuguccugg

SEQ ID NO: 115031 - RNA, 19 nt, Human
uuuggucccaaauauccau

SEQ ID NO: 115032 - RNA, 30 nt, Human
ccagcuacccacagcaaccaaagagacuuc

SEQ ID NO: 115033 - RNA, 21 nt, Human
auucucacucggaccugggga

SEQ ID NO: 115034 - RNA, 30 nt, Human
acugcuuucucugcucucuuugccuucuuu

SEQ ID NO: 115035 - RNA, 25 nt, Human
agucuaagucucguauuugcuuugc

SEQ ID NO: 115036 - RNA, 20 nt, Human
ucagcuuucaaaugagauga

SEQ ID NO: 115037 - RNA, 19 nt, Human
caugugcuuuauguguaua

SEQ ID NO: 115038 - RNA, 22 nt, Human
gguuggugacugaaacauucac

SEQ ID NO: 115039 - RNA, 19 nt, Human
uuguuuuucuccacugagc

SEQ ID NO: 115040 - RNA, 23 nt, Human
aguccccagcuggggcuuggugu

SEQ ID NO: 115041 - RNA, 25 nt, Human
uccucugcuucauucucguccagcc

SEQ ID NO: 115042 - RNA, 24 nt, Human
ucuuuauguagaauugcugucuau

SEQ ID NO: 115043 - RNA, 27 nt, Human
gaguuagaacaguuggauacaggagaa

SEQ ID NO: 115044 - RNA, 20 nt, Human
uggagacuccuaggcaggac

SEQ ID NO: 115045 - RNA, 23 nt, Human
gccuuugagaaaugaaugaagua

SEQ ID NO: 115046 - RNA, 20 nt, Human
agugcugucuguuucuugua

SEQ ID NO: 115047 - RNA, 22 nt, Human
uguugcccaggcuggugucaaa

SEQ ID NO: 115048 - RNA, 26 nt, Human
guucucuuuggugucauucagcggcu

SEQ ID NO: 115049 - RNA, 24 nt, Human
aaggaccccagagcccaccugugu

SEQ ID NO: 115050 - RNA, 19 nt, Human
ccccacagggccaggcugg

SEQ ID NO: 115051 - RNA, 22 nt, Human
ugauaguguauaugcuaacugg

SEQ ID NO: 115052 - RNA, 32 nt, Human
cccaggguuuuucacuucuccccacaucuccc

SEQ ID NO: 115053 - RNA, 27 nt, Human
uuccaagaauccucgacauggcaagga

SEQ ID NO: 115054 - RNA, 28 nt, Human
aaugcauggauaaacuugcugcaagccu

SEQ ID NO: 115055 - RNA, 25 nt, Human
ucuggagaggccuggagaccuagcu

SEQ ID NO: 115056 - RNA, 27 nt, Human
ccaguuuacauuuaggcauuauugcaa

SEQ ID NO: 115057 - RNA, 22 nt, Human
aggauuugaggccaggccaaag

SEQ ID NO: 115058 - RNA, 17 nt, Human
ucauuucucuuucuuca

SEQ ID NO: 115059 - RNA, 22 nt, Human
agccaaaaagcugcaggcagag

SEQ ID NO: 115060 - RNA, 20 nt, Human
ugggggcugccagcgucugu

SEQ ID NO: 115061 - RNA, 21 nt, Human
aauaucagugggcucucuuac

SEQ ID NO: 115062 - RNA, 19 nt, Human
aaaguucagaguugaaaug

SEQ ID NO: 115063 - RNA, 23 nt, Human
cccucucugccuguucuggacug

SEQ ID NO: 115064 - RNA, 27 nt, Human
gaguagcugggauuacaggugcgcacu

SEQ ID NO: 115065 - RNA, 22 nt, Human
ggaguuucauuaaaugcuaacu

SEQ ID NO: 115066 - RNA, 20 nt, Human
uaggggaugagguugcugug

SEQ ID NO: 115067 - RNA, 24 nt, Human
cuguaugaaucaguuuuauuaccu

SEQ ID NO: 115068 - RNA, 26 nt, Human
aagcagcuagguugcaagaacauucc

SEQ ID NO: 115069 - RNA, 25 nt, Human
ggcuggucuccaacuccugcccuca

SEQ ID NO: 115070 - RNA, 26 nt, Human
acugugauggcacaacugcauuucag

SEQ ID NO: 115071 - RNA, 22 nt, Human
uuucuuucuucagcuuucugac

SEQ ID NO: 115072 - RNA, 24 nt, Human
cucacccagccugguacugaaggu

SEQ ID NO: 115073 - RNA, 22 nt, Human
cucccucugcugucaccuugcu

SEQ ID NO: 115074 - RNA, 22 nt, Human
cagugggaaaaaaggagguuuu

SEQ ID NO: 115075 - RNA, 22 nt, Human
acugcagccuccuucuccuggg

SEQ ID NO: 115076 - RNA, 24 nt, Human
ucaaauguaauuauaaccaggggu

SEQ ID NO: 115077 - RNA, 27 nt, Human
cccugcagcugagccugucucucacgg

SEQ ID NO: 115078 - RNA, 23 nt, Human
ccugccuggcuaagacccguggc

SEQ ID NO: 115079 - RNA, 19 nt, Human
uccugcucuccguguagcc

SEQ ID NO: 115080 - RNA, 27 nt, Human
agucaucuccaguaggucuauuuuagu

SEQ ID NO: 115081 - RNA, 23 nt, Human
gacaggguuucaccauguuggcc

SEQ ID NO: 115082 - RNA, 23 nt, Human
gacgggguuucaccauguuagcc

SEQ ID NO: 115083 - RNA, 22 nt, Human
aggucgaggcaggaggaucacu

SEQ ID NO: 115084 - RNA, 21 nt, Human
cccaguggcuuaaaacaauag

SEQ ID NO: 115085 - RNA, 27 nt, Human
gcugccucuguucucagcgucagugcc

SEQ ID NO: 115086 - RNA, 22 nt, Human
ccaggggaggggagggagcgag

SEQ ID NO: 115087 - RNA, 22 nt, Human
ccaaagcgcugggauuacaggc

SEQ ID NO: 115088 - RNA, 21 nt, Human
caucugaaucuccuucagacc

SEQ ID NO: 115089 - RNA, 23 nt, Human
ggccgcgauucuuccagcaaggg

SEQ ID NO: 115090 - RNA, 26 nt, Human
agcccaaaccucagcauucugcaaua

SEQ ID NO: 115091 - RNA, 27 nt, Human
gaguauauauagaucucuaucucuuag

SEQ ID NO: 115092 - RNA, 29 nt, Human
gcagauggcccagaauggaagcuuccagu

SEQ ID NO: 115093 - RNA, 24 nt, Human
cagucuuccucuuagccucuggau

SEQ ID NO: 115094 - RNA, 27 nt, Human
ucuucuuucuuuuaagcagacccauac

SEQ ID NO: 115095 - RNA, 22 nt, Human
uagucucuaucauuaaaguucu

SEQ ID NO: 115096 - RNA, 21 nt, Human
uccuguacaaaacaucuuuaa

SEQ ID NO: 115097 - RNA, 19 nt, Human
auguguguagauuucaugc

SEQ ID NO: 115098 - RNA, 19 nt, Human
accaaauacucuuaugggg

SEQ ID NO: 115099 - RNA, 22 nt, Human
gaugaaugagagagggagggaa

SEQ ID NO: 115100 - RNA, 22 nt, Human
uccuacuaaagcuuuugucugg

SEQ ID NO: 115101 - RNA, 19 nt, Human
gcccagucuggagugcagu

SEQ ID NO: 115102 - RNA, 24 nt, Human
ucccugcacaacuaacauccagua

SEQ ID NO: 115103 - RNA, 26 nt, Human
gggugagggagggccaagccaggagg

SEQ ID NO: 115104 - RNA, 21 nt, Human
ccccacugagcaccuugagac

SEQ ID NO: 115105 - RNA, 21 nt, Human
ucuuaugagaaaugaaugaau

SEQ ID NO: 115106 - RNA, 24 nt, Human
ccugugugcccuguuccuugccca

SEQ ID NO: 115107 - RNA, 20 nt, Human
cccauuucuccuccucuuag

SEQ ID NO: 115108 - RNA, 26 nt, Human
acgcaugagaauuucuuuuuacauug

SEQ ID NO: 115109 - RNA, 25 nt, Human
gcagcuguauucuggagucuggaug

SEQ ID NO: 115110 - RNA, 21 nt, Human
gaagaaggcaggcuucuggcu

SEQ ID NO: 115111 - RNA, 25 nt, Human
ugguagugcaugccucuaaucccag

SEQ ID NO: 115112 - RNA, 27 nt, Human
ucacaugcucagggccaccugagacug

SEQ ID NO: 115113 - RNA, 25 nt, Human
gagagggacgaaccaggguggaagc

SEQ ID NO: 115114 - RNA, 27 nt, Human
gugaaggagcuugugaaggcagaggaa

SEQ ID NO: 115115 - RNA, 28 nt, Human
ucucccuccccucugccuuuuaaaccca

SEQ ID NO: 115116 - RNA, 22 nt, Human
uccaggucccagccccuccucc

SEQ ID NO: 115117 - RNA, 23 nt, Human
agacuggcugcugaugcaccuug

SEQ ID NO: 115118 - RNA, 24 nt, Human
cuggggcaggccgggcagucugcg

SEQ ID NO: 115119 - RNA, 22 nt, Human
cccagcaccaaccucugagccc

SEQ ID NO: 115120 - RNA, 26 nt, Human
uacuucagaggaagaauuaaggggca

SEQ ID NO: 115121 - RNA, 25 nt, Human
uccagcuucagacccacucuuugag

SEQ ID NO: 115122 - RNA, 24 nt, Human
cugaggggggagugcagcaguugg

SEQ ID NO: 115123 - RNA, 21 nt, Human
ccgcugcgcucccaccucgga

SEQ ID NO: 115124 - RNA, 19 nt, Human
ugccaugaaguagagcagu

SEQ ID NO: 115125 - RNA, 27 nt, Human
ccacucugccuggccuccugcugauga

SEQ ID NO: 115126 - RNA, 20 nt, Human
ggcucccgaguucugggcau

SEQ ID NO: 115127 - RNA, 26 nt, Human
cuugaugaagccugugccaccugcaa

SEQ ID NO: 115128 - RNA, 22 nt, Human
caccuaggcuggagugcagcgg

SEQ ID NO: 115129 - RNA, 21 nt, Human
ccaugcccccucccaaaaaga

SEQ ID NO: 115130 - RNA, 28 nt, Human
aguuguuuuggugccugccucugccaug

SEQ ID NO: 115131 - RNA, 29 nt, Human
gggcuggugggccuuucuguguccuacuc

SEQ ID NO: 115132 - RNA, 24 nt, Human
gcccaggcuggagugcaauggugc

SEQ ID NO: 115133 - RNA, 21 nt, Human
ggcugaugaccacuagugggg

SEQ ID NO: 115134 - RNA, 23 nt, Human
cccagugugcugggauuacaggc

SEQ ID NO: 115135 - RNA, 23 nt, Human
acgcuggagaucucugaggagug

SEQ ID NO: 115136 - RNA, 23 nt, Human
aucaggauauuuaacccuuuaag

SEQ ID NO: 115137 - RNA, 22 nt, Human
cgggcuccuggcuuugccucug

SEQ ID NO: 115138 - RNA, 21 nt, Human
cugugucuccuuccccuaccu

SEQ ID NO: 115139 - RNA, 25 nt, Human
cagggcuggaggcagccaaguaacg

SEQ ID NO: 115140 - RNA, 22 nt, Human
uaucuucugauccuugcaccuu

SEQ ID NO: 115141 - RNA, 24 nt, Human
uggagaaaaaacauugcccaggga

SEQ ID NO: 115142 - RNA, 20 nt, Human
uccaacugcuuauucuucca

SEQ ID NO: 115143 - RNA, 23 nt, Human
cagaaauuagaauuguguguuaa

SEQ ID NO: 115144 - RNA, 20 nt, Human
acacaaaaagcauacuugca

SEQ ID NO: 115145 - RNA, 25 nt, Human
cccgcagcugccucagucggcuacu

SEQ ID NO: 115146 - RNA, 26 nt, Human
ucugaacuguauccauauuuuaagga

SEQ ID NO: 115147 - RNA, 20 nt, Human
cagggagggggaagagaagu

SEQ ID NO: 115148 - RNA, 23 nt, Human
ucagcauguuggcuaggccgguc

SEQ ID NO: 115149 - RNA, 29 nt, Human
agcuccuacuggacccucuugcccagccg

SEQ ID NO: 115150 - RNA, 21 nt, Human
ucagcguaggagaaaggccac

SEQ ID NO: 115151 - RNA, 19 nt, Human
guaaaaggugaaggccagc

SEQ ID NO: 115152 - RNA, 20 nt, Human
gugcuauuauuucugguucu

SEQ ID NO: 115153 - RNA, 22 nt, Human
guaacaggucacuuccuuuuca

SEQ ID NO: 115154 - RNA, 18 nt, Human
acagggggaaauggguau

SEQ ID NO: 115155 - RNA, 21 nt, Human
ccacacagagugucaugggug

SEQ ID NO: 115156 - RNA, 20 nt, Human
cccucagccucaggcagugg

SEQ ID NO: 115157 - RNA, 26 nt, Human
caugccaccacgcacagcuacuuuuu

SEQ ID NO: 115158 - RNA, 22 nt, Human
guguaagccaccaugcccagcc

SEQ ID NO: 115159 - RNA, 22 nt, Human
gugugagccaccgugcccagcc

SEQ ID NO: 115160 - RNA, 22 nt, Human
ucuuuuaagggucccuuuugcu

SEQ ID NO: 115161 - RNA, 22 nt, Human
uucagugguuccuucuguuuug

SEQ ID NO: 115162 - RNA, 19 nt, Human
gcacaccuuccacaggguc

SEQ ID NO: 115163 - RNA, 28 nt, Human
gaggaagagagaccugcccuguagcgug

SEQ ID NO: 115164 - RNA, 27 nt, Human
caccacugcacuucagucugugugacu

SEQ ID NO: 115165 - RNA, 26 nt, Human
gcuugauucagacuggaguggauagg

SEQ ID NO: 115166 - RNA, 21 nt, Human
acugcccaggcaaagugcacc

SEQ ID NO: 115167 - RNA, 27 nt, Human
ucugggagaaugaacccgagguugguu

SEQ ID NO: 115168 - RNA, 21 nt, Human
ugccuaacugagcaguaggga

SEQ ID NO: 115169 - RNA, 32 nt, Human
cucaagguuccugggcagaccagcaccucugg

SEQ ID NO: 115170 - RNA, 22 nt, Human
ugaacuccugggcucaagccau

SEQ ID NO: 115171 - RNA, 22 nt, Human
ugggcuggagcaguuuggggca

SEQ ID NO: 115172 - RNA, 27 nt, Human
gggcuguaggcuagaaugcccgggcug

SEQ ID NO: 115173 - RNA, 23 nt, Human
cucuccucagcucucucaucucc

SEQ ID NO: 115174 - RNA, 22 nt, Human
agcuucccgaguaacugagauu

SEQ ID NO: 115175 - RNA, 27 nt, Human
cuuaccuccuagcuacuuauccaucuc

SEQ ID NO: 115176 - RNA, 25 nt, Human
accaaauccuccugucuuucguggc

SEQ ID NO: 115177 - RNA, 23 nt, Human
cugggucgggauucucaggucau

SEQ ID NO: 115178 - RNA, 21 nt, Human
cuaccugcauuaucucauucu

SEQ ID NO: 115179 - RNA, 21 nt, Human
guaaacaguagacacccagaa

SEQ ID NO: 115180 - RNA, 25 nt, Human
ugucaggguggagugauuccaagug

SEQ ID NO: 115181 - RNA, 20 nt, Human
guccucugguaggaggcaaa

SEQ ID NO: 115182 - RNA, 21 nt, Human
uuuuucuccuuuucucugaga

SEQ ID NO: 115183 - RNA, 22 nt, Human
gauuaaacaguuuucacuuaca

SEQ ID NO: 115184 - RNA, 26 nt, Human
uccaaaccacaugggagacaguuucc

SEQ ID NO: 115185 - RNA, 21 nt, Human
cuccuguucucucugugcucu

SEQ ID NO: 115186 - RNA, 23 nt, Human
uucuagaagcacauguguauuua

SEQ ID NO: 115187 - RNA, 25 nt, Human
aguuggucucuccccuucuacugcc

SEQ ID NO: 115188 - RNA, 23 nt, Human
cccaggccucugccccaagagca

SEQ ID NO: 115189 - RNA, 23 nt, Human
cuagugaaacucguuaauuugua

SEQ ID NO: 115190 - RNA, 27 nt, Human
guucuuccuuuuacauccuggaacaac

SEQ ID NO: 115191 - RNA, 24 nt, Human
cggcaggacuggauggagcuguuc

SEQ ID NO: 115192 - RNA, 22 nt, Human
ggccagugccagcaccugccca

SEQ ID NO: 115193 - RNA, 22 nt, Human
ucuaacaccacaacuaauuuca

SEQ ID NO: 115194 - RNA, 22 nt, Human
cugggaagcaaaacccaugccu

SEQ ID NO: 115195 - RNA, 22 nt, Human
gugcugggauugcaaacacuuu

SEQ ID NO: 115196 - RNA, 25 nt, Human
ccagcaaugugacuuuuucaugucu

SEQ ID NO: 115197 - RNA, 24 nt, Human
cugaauccucagaauuucaggccu

SEQ ID NO: 115198 - RNA, 21 nt, Human
ccccugcugccuucacuccuu

SEQ ID NO: 115199 - RNA, 26 nt, Human
agugagcuuucccauguuuuuauguc

SEQ ID NO: 115200 - RNA, 23 nt, Human
agauccucagugaaugacguugc

SEQ ID NO: 115201 - RNA, 21 nt, Human
gugagccagagcuggagcacg

SEQ ID NO: 115202 - RNA, 26 nt, Human
cuuucacaguccuguccucuggauca

SEQ ID NO: 115203 - RNA, 23 nt, Human
agcccuucuuacucucugaggcu

SEQ ID NO: 115204 - RNA, 26 nt, Human
gaagugagaggugaacucagccuggg

SEQ ID NO: 115205 - RNA, 28 nt, Human
uuaaacauugagaagugcugcucuccgu

SEQ ID NO: 115206 - RNA, 24 nt, Human
ggaaugauucccugggugccugaa

SEQ ID NO: 115207 - RNA, 20 nt, Human
aaucuaggccgggugcagug

SEQ ID NO: 115208 - RNA, 30 nt, Human
cuguccucucucuagccugccugggaauga

SEQ ID NO: 115209 - RNA, 22 nt, Human
ccggggcccuggccacagcauu

SEQ ID NO: 115210 - RNA, 23 nt, Human
agcaaggauagggaaggggaaug

SEQ ID NO: 115211 - RNA, 21 nt, Human
uaagcguggguggaggaagau

SEQ ID NO: 115212 - RNA, 27 nt, Human
uucuccaggaucaaggaacuggggcgg

SEQ ID NO: 115213 - RNA, 26 nt, Human
acuggcagauugcagugcaaccuuau

SEQ ID NO: 115214 - RNA, 26 nt, Human
uuuaggcuugaaaucuccauccuauc

SEQ ID NO: 115215 - RNA, 20 nt, Human
ggcuucugcuucauccugcu

SEQ ID NO: 115216 - RNA, 20 nt, Human
aaucuguuauagggaguugu

SEQ ID NO: 115217 - RNA, 22 nt, Human
caagaucauucaguguuuuucc

SEQ ID NO: 115218 - RNA, 21 nt, Human
auagccccaagcagagaaaag

SEQ ID NO: 115219 - RNA, 25 nt, Human
gaacaaugacucagcuauacauuua

SEQ ID NO: 115220 - RNA, 20 nt, Human
uucaguuucaucauuugcac

SEQ ID NO: 115221 - RNA, 23 nt, Human
caugcuuguaaucccagcuacuc

SEQ ID NO: 115222 - RNA, 19 nt, Human
cuccaaaacacgcccccau

SEQ ID NO: 115223 - RNA, 19 nt, Human
uggcagcuccgccucuggg

SEQ ID NO: 115224 - RNA, 21 nt, Human
cugcccaggcuagagugcagu

SEQ ID NO: 115225 - RNA, 19 nt, Human
uccagugggacauggugcc

SEQ ID NO: 115226 - RNA, 22 nt, Human
gcaugccaccacgcacagcuac

SEQ ID NO: 115227 - RNA, 27 nt, Human
gccacccuaggaggcgcggugccaccc

SEQ ID NO: 115228 - RNA, 23 nt, Human
ggacucucgggcaguucucagac

SEQ ID NO: 115229 - RNA, 20 nt, Human
cagggaggggaagagggggc

SEQ ID NO: 115230 - RNA, 21 nt, Human
uuccaccucuccaacauuguc

SEQ ID NO: 115231 - RNA, 27 nt, Human
ugcaaaugauccaaugcauacaguagu

SEQ ID NO: 115232 - RNA, 27 nt, Human
cgaguucaagcgauucuccugccucag

SEQ ID NO: 115233 - RNA, 19 nt, Human
gcagugccauugacugccc

SEQ ID NO: 115234 - RNA, 23 nt, Human
gcaguuucaaguuccugggcuca

SEQ ID NO: 115235 - RNA, 27 nt, Human
aggacuugccuucucccugggcaggga

SEQ ID NO: 115236 - RNA, 22 nt, Human
guccagaguuuagagaggggag

SEQ ID NO: 115237 - RNA, 23 nt, Human
ccuuaagaucacaucaucuacuc

SEQ ID NO: 115238 - RNA, 20 nt, Human
caggguuguugugaggauuu

SEQ ID NO: 115239 - RNA, 24 nt, Human
ccacaacaaccugugaaauagcug

SEQ ID NO: 115240 - RNA, 22 nt, Human
cuccgcguguggagggagccag

SEQ ID NO: 115241 - RNA, 20 nt, Human
augguuggcccugguguugu

SEQ ID NO: 115242 - RNA, 23 nt, Human
gggcuuacggcccugccuugggc

SEQ ID NO: 115243 - RNA, 22 nt, Human
auuuauuuuuuccuuuucuucu

SEQ ID NO: 115244 - RNA, 24 nt, Human
auauuuacagaagauguuugguug

SEQ ID NO: 115245 - RNA, 21 nt, Human
ggccucgggcugaggugcaag

SEQ ID NO: 115246 - RNA, 20 nt, Human
ggccuccucccauccugcca

SEQ ID NO: 115247 - RNA, 30 nt, Human
cgugaucuagauuacacugcaccauuccca

SEQ ID NO: 115248 - RNA, 22 nt, Human
cugagaucgcgccacugcacuc

SEQ ID NO: 115249 - RNA, 21 nt, Human
gacucacuuuaucaauaguuc

SEQ ID NO: 115250 - RNA, 21 nt, Human
cucuucuggaaacaaagggcu

SEQ ID NO: 115251 - RNA, 24 nt, Human
cugcagcugccccugcccugugcc

SEQ ID NO: 115252 - RNA, 21 nt, Human
ccggaagugaggaccagggau

SEQ ID NO: 115253 - RNA, 23 nt, Human
aaagacaacuacuuuugaaggaa

SEQ ID NO: 115254 - RNA, 21 nt, Human
guggaaagaggaggaugcugu

SEQ ID NO: 115255 - RNA, 21 nt, Human
ugucuugugcuuuauccugcc

SEQ ID NO: 115256 - RNA, 24 nt, Human
aacucuucuuccuucugugccucu

SEQ ID NO: 115257 - RNA, 18 nt, Human
accauaaaaacuuacuua

SEQ ID NO: 115258 - RNA, 27 nt, Human
acagcuguaaaauauucuaugauauga

SEQ ID NO: 115259 - RNA, 22 nt, Human
ggcaaguucugugguucugaga

SEQ ID NO: 115260 - RNA, 25 nt, Human
cuuacaugagugaaaggguugccuc

SEQ ID NO: 115261 - RNA, 25 nt, Human
ggucucagagagcaaccuccucccu

SEQ ID NO: 115262 - RNA, 21 nt, Human
auggguggaggggcuggggaa

SEQ ID NO: 115263 - RNA, 21 nt, Human
uggaaacagaguaaugaagaa

SEQ ID NO: 115264 - RNA, 26 nt, Human
cuuugccuuugcugggccuucugugc

SEQ ID NO: 115265 - RNA, 22 nt, Human
gcccuugcccagggcacuugga

SEQ ID NO: 115266 - RNA, 21 nt, Human
caggcuggggucugcagugca

SEQ ID NO: 115267 - RNA, 20 nt, Human
gugcagaugcagucaccugg

SEQ ID NO: 115268 - RNA, 23 nt, Human
agucguggggaacggaggaggac

SEQ ID NO: 115269 - RNA, 27 nt, Human
ucuuccuugggugguccucaugucgcu

SEQ ID NO: 115270 - RNA, 21 nt, Human
gugggugggaagacuagugaa

SEQ ID NO: 115271 - RNA, 22 nt, Human
cgccucccagguucaagcaauu

SEQ ID NO: 115272 - RNA, 25 nt, Human
agggaagaucugggggacagaggaa

SEQ ID NO: 115273 - RNA, 27 nt, Human
ggggaagagagagaccucggaccugca

SEQ ID NO: 115274 - RNA, 25 nt, Human
ugaggcagaaggauuaccugaggca

SEQ ID NO: 115275 - RNA, 24 nt, Human
cuaugaacuaggguuuucuccugc

SEQ ID NO: 115276 - RNA, 17 nt, Human
gcuaauugaaugccuug

SEQ ID NO: 115277 - RNA, 21 nt, Human
ggugaaugggguaagcauuuu

SEQ ID NO: 115278 - RNA, 24 nt, Human
aggaggaaggcaagagggggugga

SEQ ID NO: 115279 - RNA, 23 nt, Human
ggcuggagggagagggaagcaag

SEQ ID NO: 115280 - RNA, 23 nt, Human
ccucagguguggaaauuucuacu

SEQ ID NO: 115281 - RNA, 25 nt, Human
ggcgaccgcgaagaaggaaaaaggg

SEQ ID NO: 115282 - RNA, 27 nt, Human
cgcggccgccucggccucgacgccagc

SEQ ID NO: 115283 - RNA, 17 nt, Human
accacuaaaaugccucu

SEQ ID NO: 115284 - RNA, 21 nt, Human
cuggcucucuggcuccugugc

SEQ ID NO: 115285 - RNA, 26 nt, Human
aguuaauaaaguuguuauuuuuauaa

SEQ ID NO: 115286 - RNA, 23 nt, Human
gcacacuccaccuucccuaguca

SEQ ID NO: 115287 - RNA, 27 nt, Human
cgcuuccuggucuuaucauggacaauu

SEQ ID NO: 115288 - RNA, 19 nt, Human
ccuacccucucccugccug

SEQ ID NO: 115289 - RNA, 23 nt, Human
ggcugcuccagcuacugggcauu

SEQ ID NO: 115290 - RNA, 21 nt, Human
uccccacguggcaccuccuca

SEQ ID NO: 115291 - RNA, 21 nt, Human
cuauuuuaaaaagagaaguuc

SEQ ID NO: 115292 - RNA, 24 nt, Human
gcuucacacaagaaccaccucucc

SEQ ID NO: 115293 - RNA, 20 nt, Human
caucacccagccucugagag

SEQ ID NO: 115294 - RNA, 22 nt, Human
cuccaguucuuagaggcgcugu

SEQ ID NO: 115295 - RNA, 21 nt, Human
ucccucagagacaccaaacug

SEQ ID NO: 115296 - RNA, 22 nt, Human
augccuguaagcccagcacuuu

SEQ ID NO: 115297 - RNA, 22 nt, Human
auuccuguaaucccagcacuuu

SEQ ID NO: 115298 - RNA, 22 nt, Human
ccccaagccagcucaugcugcu

SEQ ID NO: 115299 - RNA, 26 nt, Human
ccaauacaagaaugccaaaggaggaa

SEQ ID NO: 115300 - RNA, 21 nt, Human
accccacuuucucccuccucc

SEQ ID NO: 115301 - RNA, 24 nt, Human
uaucugacucucagucugucccau

SEQ ID NO: 115302 - RNA, 24 nt, Human
ucuccucccuccucccccuucacc

SEQ ID NO: 115303 - RNA, 20 nt, Human
ccuccagggauccauggggg

SEQ ID NO: 115304 - RNA, 23 nt, Human
ggcagcccugagaucucaagagu

SEQ ID NO: 115305 - RNA, 22 nt, Human
ucugaacuuuggaagcugggga

SEQ ID NO: 115306 - RNA, 21 nt, Human
cugcccucacugccucuuugc

SEQ ID NO: 115307 - RNA, 20 nt, Human
gaccucucugggccucaguu

SEQ ID NO: 115308 - RNA, 22 nt, Human
cuggcacccaggccaggggucc

SEQ ID NO: 115309 - RNA, 20 nt, Human
agcuagcaauugcgaccuua

SEQ ID NO: 115310 - RNA, 28 nt, Human
gcugaaguuuuaagugaguauuuguucc

SEQ ID NO: 115311 - RNA, 25 nt, Human
gauuccugcaaccucaagagacuuc

SEQ ID NO: 115312 - RNA, 26 nt, Human
ccagccagggcccaggaagauggggc

SEQ ID NO: 115313 - RNA, 21 nt, Human
uccagcaugagguaucuaagg

SEQ ID NO: 115314 - RNA, 22 nt, Human
guguugaaacaacagaagucua

SEQ ID NO: 115315 - RNA, 21 nt, Human
accauucccaccaaguggaau

SEQ ID NO: 115316 - RNA, 26 nt, Human
gggaggggaaaggcaaaugcagauau

SEQ ID NO: 115317 - RNA, 22 nt, Human
aguaaaaugugcccauuuuaug

SEQ ID NO: 115318 - RNA, 27 nt, Human
uugcccaggcuggucucaaacucuuug

SEQ ID NO: 115319 - RNA, 20 nt, Human
uacagauaugugaacuucaa

SEQ ID NO: 115320 - RNA, 25 nt, Human
ccagauuuccaugugugcaguauua

SEQ ID NO: 115321 - RNA, 24 nt, Human
gcugccuggcccuccccacaaugc

SEQ ID NO: 115322 - RNA, 22 nt, Human
cgugaagucgaggcugcaguga

SEQ ID NO: 115323 - RNA, 19 nt, Human
ccccacccucuauucuguu

SEQ ID NO: 115324 - RNA, 25 nt, Human
acugagcuaacauaaaauaacucua

SEQ ID NO: 115325 - RNA, 27 nt, Human
ggacacccagccaggcagagcugggau

SEQ ID NO: 115326 - RNA, 23 nt, Human
cucauuucuacuuucugcccuca

SEQ ID NO: 115327 - RNA, 21 nt, Human
cacccaggcagggagcaagug

SEQ ID NO: 115328 - RNA, 21 nt, Human
gagaaguauugaauaagccau

SEQ ID NO: 115329 - RNA, 23 nt, Human
ugcugccugccgccaucaugucu

SEQ ID NO: 115330 - RNA, 22 nt, Human
aaucugauucucccuaggguca

SEQ ID NO: 115331 - RNA, 27 nt, Human
cccuaaccccuuguccgcaagggguga

SEQ ID NO: 115332 - RNA, 22 nt, Human
uccuccucauguagucuggagu

SEQ ID NO: 115333 - RNA, 24 nt, Human
aagcaugaagcaaagcuauuuuau

SEQ ID NO: 115334 - RNA, 22 nt, Human
agggaagccccacuugaaggaa

SEQ ID NO: 115335 - RNA, 23 nt, Human
auaggugugccuacaaaagucuu

SEQ ID NO: 115336 - RNA, 24 nt, Human
ugcuuuauaugagugucuucuggg

SEQ ID NO: 115337 - RNA, 23 nt, Human
gucgcccaggcugguuuugaacu

SEQ ID NO: 115338 - RNA, 27 nt, Human
cucccacccaguugccugaaucauccc

SEQ ID NO: 115339 - RNA, 22 nt, Human
uugcauagagagaaaugauuga

SEQ ID NO: 115340 - RNA, 28 nt, Human
auuaggaucuucaacccagguaacagga

SEQ ID NO: 115341 - RNA, 20 nt, Human
gagguccaaggcugcaguga

SEQ ID NO: 115342 - RNA, 25 nt, Human
guggcguggagaaguggugcuccaa

SEQ ID NO: 115343 - RNA, 23 nt, Human
ccgaugcaugcucuucucucaca

SEQ ID NO: 115344 - RNA, 19 nt, Human
cugccuuucgaucucucca

SEQ ID NO: 115345 - RNA, 23 nt, Human
cgaguaguugggauuacagguga

SEQ ID NO: 115346 - RNA, 26 nt, Human
cacccaggccgggaccugggggcucc

SEQ ID NO: 115347 - RNA, 23 nt, Human
guucaggccauucuccugccuca

SEQ ID NO: 115348 - RNA, 20 nt, Human
ggggagagagcugugguucu

SEQ ID NO: 115349 - RNA, 21 nt, Human
ccacccaccuggcuucauaca

SEQ ID NO: 115350 - RNA, 20 nt, Human
cguguuugugugugaugcca

SEQ ID NO: 115351 - RNA, 26 nt, Human
gugaagccugaagccgccgggugccg

SEQ ID NO: 115352 - RNA, 25 nt, Human
ugagagggagagcugugguacuggc

SEQ ID NO: 115353 - RNA, 22 nt, Human
ucagccugggcaacaagaguga

SEQ ID NO: 115354 - RNA, 20 nt, Human
uaagauaaagacuguggaaa

SEQ ID NO: 115355 - RNA, 27 nt, Human
agcucacucccccuccugcugcuaugc

SEQ ID NO: 115356 - RNA, 27 nt, Human
gaaacucaagaagaagcuuuugaaaca

SEQ ID NO: 115357 - RNA, 19 nt, Human
ggauauuagcugugaugag

SEQ ID NO: 115358 - RNA, 21 nt, Human
gugcuuuuuccuuuucaucug

SEQ ID NO: 115359 - RNA, 22 nt, Human
cagcccagcccacguugcugcu

SEQ ID NO: 115360 - RNA, 20 nt, Human
cuucuuuccuuccugccuuu

SEQ ID NO: 115361 - RNA, 20 nt, Human
ccuuugccagccucuuuuca

SEQ ID NO: 115362 - RNA, 26 nt, Human
ugagccaggcccugggcugggccucc

SEQ ID NO: 115363 - RNA, 18 nt, Human
uccuuucuccuuuggguu

SEQ ID NO: 115364 - RNA, 24 nt, Human
auggggaacugucugcacagggug

SEQ ID NO: 115365 - RNA, 27 nt, Human
uucucauaaguacccaauggcaucucu

SEQ ID NO: 115366 - RNA, 21 nt, Human
ccuaaaauggugaaucagagc

SEQ ID NO: 115367 - RNA, 23 nt, Human
gauugcuagccuuggcugcucca

SEQ ID NO: 115368 - RNA, 22 nt, Human
aggccucagcugggggaaaggc

SEQ ID NO: 115369 - RNA, 22 nt, Human
gagccugggaggcagagguugc

SEQ ID NO: 115370 - RNA, 21 nt, Human
ugcagaccccucuccuccucc

SEQ ID NO: 115371 - RNA, 21 nt, Human
accacugggccaagugcagug

SEQ ID NO: 115372 - RNA, 27 nt, Human
cuugacaggauguuuucauuacucagu

SEQ ID NO: 115373 - RNA, 26 nt, Human
auaugcagaaagaugguagggagcau

SEQ ID NO: 115374 - RNA, 22 nt, Human
gagagugaggagggaguguuau

SEQ ID NO: 115375 - RNA, 23 nt, Human
ccuuuucaccugaaaugccuuca

SEQ ID NO: 115376 - RNA, 26 nt, Human
gagaaucagagagagcuguaguguca

SEQ ID NO: 115377 - RNA, 22 nt, Human
uauagauacuuuaucauguuuu

SEQ ID NO: 115378 - RNA, 26 nt, Human
cugccucuguggcucugccuguggau

SEQ ID NO: 115379 - RNA, 22 nt, Human
accuguuauaccagcacuuugg

SEQ ID NO: 115380 - RNA, 21 nt, Human
gggaccccacacacauguggc

SEQ ID NO: 115381 - RNA, 27 nt, Human
agaaguacaaagguugcagugcugagc

SEQ ID NO: 115382 - RNA, 22 nt, Human
aauaacugcauuucguuugguu

SEQ ID NO: 115383 - RNA, 27 nt, Human
gagcccaaucacugccuauaccccuca

SEQ ID NO: 115384 - RNA, 21 nt, Human
ccacagcugagccuggaacug

SEQ ID NO: 115385 - RNA, 25 nt, Human
gccucacugcagccagcgugguccu

SEQ ID NO: 115386 - RNA, 24 nt, Human
ugggacugagugccccucuugccu

SEQ ID NO: 115387 - RNA, 25 nt, Human
cccucuaccccgccccaccuugccc

SEQ ID NO: 115388 - RNA, 24 nt, Human
uucauuucuugagguacucugcac

SEQ ID NO: 115389 - RNA, 21 nt, Human
agaaggcugaggcugggggau

SEQ ID NO: 115390 - RNA, 18 nt, Human
ucuaacaggcuggcaaug

SEQ ID NO: 115391 - RNA, 25 nt, Human
uucugauugcuaucagcaaugcccc

SEQ ID NO: 115392 - RNA, 22 nt, Human
ccgaggcagaagaauugcuuga

SEQ ID NO: 115393 - RNA, 23 nt, Human
aggcccgcccaccccaaccuucu

SEQ ID NO: 115394 - RNA, 24 nt, Human
ucugucacccaggcugggaauugc

SEQ ID NO: 115395 - RNA, 26 nt, Human
acauucauuuucaaaugcaaaugcag

SEQ ID NO: 115396 - RNA, 22 nt, Human
caggcuggaguacaauggcgug

SEQ ID NO: 115397 - RNA, 22 nt, Human
caggcuggagugcaauggcaug

SEQ ID NO: 115398 - RNA, 22 nt, Human
caggcuagagugcaguggcaug

SEQ ID NO: 115399 - RNA, 24 nt, Human
acagaucuguuugacuuuguuaua

SEQ ID NO: 115400 - RNA, 20 nt, Human
aucaacuuuuguauccacag

SEQ ID NO: 115401 - RNA, 25 nt, Human
agacuucagggagaccagagcccag

SEQ ID NO: 115402 - RNA, 27 nt, Human
guugccuaggcuggaaauaggauuuug

SEQ ID NO: 115403 - RNA, 20 nt, Human
cauggaaaccaaaaggccgu

SEQ ID NO: 115404 - RNA, 21 nt, Human
uaccagcccagcuuugccagc

SEQ ID NO: 115405 - RNA, 25 nt, Human
ugcugagacaggauggccuggcagg

SEQ ID NO: 115406 - RNA, 24 nt, Human
ugucacuacucaggcugacugggg

SEQ ID NO: 115407 - RNA, 26 nt, Human
cuuucuccagcagcugauuccagaac

SEQ ID NO: 115408 - RNA, 21 nt, Human
cuagugaugcauccugccuag

SEQ ID NO: 115409 - RNA, 21 nt, Human
cacccuccagcauccaaccca

SEQ ID NO: 115410 - RNA, 24 nt, Human
ccaccauggagguugcaaugguga

SEQ ID NO: 115411 - RNA, 19 nt, Human
cagggaggggucuagaggc

SEQ ID NO: 115412 - RNA, 21 nt, Human
auucgcagaggcaucagggcu

SEQ ID NO: 115413 - RNA, 28 nt, Human
gccuguucucccugucugaagagggaga

SEQ ID NO: 115414 - RNA, 27 nt, Human
agcucuaucaccugagcuccccugccc

SEQ ID NO: 115415 - RNA, 23 nt, Human
uucacaguauuucagagaagcca

SEQ ID NO: 115416 - RNA, 20 nt, Human
agcuuugguaaucucuguga

SEQ ID NO: 115417 - RNA, 26 nt, Human
uggucggaagugagugaaggagccag

SEQ ID NO: 115418 - RNA, 27 nt, Human
ugcacacaggaucacucacauauguac

SEQ ID NO: 115419 - RNA, 25 nt, Human
uggguggaagcagcggugccgcgga

SEQ ID NO: 115420 - RNA, 22 nt, Human
gagccuugaaugguggagggag

SEQ ID NO: 115421 - RNA, 22 nt, Human
gccugagccacugcgcccagcc

SEQ ID NO: 115422 - RNA, 27 nt, Human
uuuuccucucuucucuaucuguagcua

SEQ ID NO: 115423 - RNA, 20 nt, Human
gcucaaaaccagaaaaagaa

SEQ ID NO: 115424 - RNA, 24 nt, Human
acaagccaacacaaaaauaaagaa

SEQ ID NO: 115425 - RNA, 21 nt, Human
aaguuucuauuuuuauuuuua

SEQ ID NO: 115426 - RNA, 20 nt, Human
aaugccacucugggcagucu

SEQ ID NO: 115427 - RNA, 21 nt, Human
ccaaagguuuauuaauaacag

SEQ ID NO: 115428 - RNA, 22 nt, Human
ggacucaaacuccugaccuugu

SEQ ID NO: 115429 - RNA, 17 nt, Human
gccuccugccugcucca

SEQ ID NO: 115430 - RNA, 25 nt, Human
guggaugacggagacucucaggccu

SEQ ID NO: 115431 - RNA, 22 nt, Human
cccggagcugcuccugcugcug

SEQ ID NO: 115432 - RNA, 21 nt, Human
uggagaugcaguugagugaca

SEQ ID NO: 115433 - RNA, 24 nt, Human
ucuucccauuccccugcugucuau

SEQ ID NO: 115434 - RNA, 23 nt, Human
guagagaagcauacuggagaagc

SEQ ID NO: 115435 - RNA, 27 nt, Human
ggcuucuccuccucugucuuuuggaga

SEQ ID NO: 115436 - RNA, 23 nt, Human
aggcugcagugcaguggcaugau

SEQ ID NO: 115437 - RNA, 22 nt, Human
uagcuacuaaaaucagugaccu

SEQ ID NO: 115438 - RNA, 21 nt, Human
gcagugagccaaguucacacc

SEQ ID NO: 115439 - RNA, 22 nt, Human
gcuccuucacuguucccucugg

SEQ ID NO: 115440 - RNA, 20 nt, Human
agagaggcggcaggggccag

SEQ ID NO: 115441 - RNA, 24 nt, Human
gugugugccacaccccaugcaccu

SEQ ID NO: 115442 - RNA, 25 nt, Human
ggaggaugggaccuccuggacccag

SEQ ID NO: 115443 - RNA, 26 nt, Human
cagcaaaacaaacuuucaagucuuga

SEQ ID NO: 115444 - RNA, 28 nt, Human
ggccacaugugcuccugucauccuccac

SEQ ID NO: 115445 - RNA, 23 nt, Human
augggccacugcuuuucccuuug

SEQ ID NO: 115446 - RNA, 20 nt, Human
agaaaacacagucucugcua

SEQ ID NO: 115447 - RNA, 23 nt, Human
acaauugcauuuaacauuguuau

SEQ ID NO: 115448 - RNA, 19 nt, Human
ccucugcugucccugccag

SEQ ID NO: 115449 - RNA, 22 nt, Human
cucgcuugaaccugggaggcag

SEQ ID NO: 115450 - RNA, 19 nt, Human
aggaguggcccacccugga

SEQ ID NO: 115451 - RNA, 22 nt, Human
ugaggguaaccccaaaccucca

SEQ ID NO: 115452 - RNA, 23 nt, Human
uguccuguaaacuuuucucagug

SEQ ID NO: 115453 - RNA, 21 nt, Human
aggcuggagugcagugacgcg

SEQ ID NO: 115454 - RNA, 22 nt, Human
ucugagccaggguucccccagg

SEQ ID NO: 115455 - RNA, 20 nt, Human
uucuagcuuccauccuuucu

SEQ ID NO: 115456 - RNA, 28 nt, Human
ccgucugcaaaguguccccggcaagaag

SEQ ID NO: 115457 - RNA, 22 nt, Human
caacuccugggcucaagcgauc

SEQ ID NO: 115458 - RNA, 25 nt, Human
uggaccaaaagaugggugguugaau

SEQ ID NO: 115459 - RNA, 18 nt, Human
uccuccauuguaucuuca

SEQ ID NO: 115460 - RNA, 20 nt, Human
aaaguuccuggugaauaucg

SEQ ID NO: 115461 - RNA, 19 nt, Human
uuuucuauccccagucuuu

SEQ ID NO: 115462 - RNA, 26 nt, Human
acaggcagcgauggucucagaaacca

SEQ ID NO: 115463 - RNA, 23 nt, Human
ccuccuccuccucgucuuagggg

SEQ ID NO: 115464 - RNA, 20 nt, Human
cccaccccccacuaccacca

SEQ ID NO: 115465 - RNA, 20 nt, Human
gcaguaaggagcccagaagg

SEQ ID NO: 115466 - RNA, 18 nt, Human
gacuaucuccccgccacc

SEQ ID NO: 115467 - RNA, 26 nt, Human
cagacucuuuaguugauuuaaacucu

SEQ ID NO: 115468 - RNA, 23 nt, Human
aaguguccccuccuacuucuugc

SEQ ID NO: 115469 - RNA, 20 nt, Human
acugcauuugaaauucucca

SEQ ID NO: 115470 - RNA, 25 nt, Human
acuucuucauccauagacacaguau

SEQ ID NO: 115471 - RNA, 29 nt, Human
gcugggcauuuccaucauauagaccucug

SEQ ID NO: 115472 - RNA, 26 nt, Human
ugcccaggauggagaugagagagggu

SEQ ID NO: 115473 - RNA, 27 nt, Human
aauuguaucugacccuucuuuaaguua

SEQ ID NO: 115474 - RNA, 24 nt, Human
gccugcaggaagacgcccgguccc

SEQ ID NO: 115475 - RNA, 21 nt, Human
aacaagccaccaugucucgcc

SEQ ID NO: 115476 - RNA, 23 nt, Human
ucuuguauuuauuacaacucuau

SEQ ID NO: 115477 - RNA, 20 nt, Human
cccaaccaucuucacuggcu

SEQ ID NO: 115478 - RNA, 22 nt, Human
gugaggguggccugaccugggc

SEQ ID NO: 115479 - RNA, 19 nt, Human
aaaugagauccguguuaga

SEQ ID NO: 115480 - RNA, 21 nt, Human
cuucaguauugugaacaaaua

SEQ ID NO: 115481 - RNA, 22 nt, Human
cugggcaccgccuucugcuagg

SEQ ID NO: 115482 - RNA, 29 nt, Human
cuaaaacccacagcccaaccaaaccuuga

SEQ ID NO: 115483 - RNA, 29 nt, Human
ggaggguugggccagaggaggcgguccug

SEQ ID NO: 115484 - RNA, 28 nt, Human
ccagugaacacauuuuacucuagaggca

SEQ ID NO: 115485 - RNA, 25 nt, Human
ucuggacucuggacuuucucuaaua

SEQ ID NO: 115486 - RNA, 25 nt, Human
augggagguggaggguuguacugug

SEQ ID NO: 115487 - RNA, 22 nt, Human
ggcuuuggauuacaugcuuuua

SEQ ID NO: 115488 - RNA, 21 nt, Human
agcugggaguuucuguucucu

SEQ ID NO: 115489 - RNA, 20 nt, Human
ugcggcuccccucggccucc

SEQ ID NO: 115490 - RNA, 19 nt, Human
gcuguuguaaaaugccuuc

SEQ ID NO: 115491 - RNA, 21 nt, Human
guggcagaacaaacuccaccc

SEQ ID NO: 115492 - RNA, 22 nt, Human
aguuuccuccucagucuccucc

SEQ ID NO: 115493 - RNA, 22 nt, Human
uguugccaagcuggacggcacg

SEQ ID NO: 115494 - RNA, 23 nt, Human
gaggaaggucugcagggagcagc

SEQ ID NO: 115495 - RNA, 27 nt, Human
ucagauuucauagaaaggagcaaccaa

SEQ ID NO: 115496 - RNA, 24 nt, Human
cucacaccacugcugcucgagucu

SEQ ID NO: 115497 - RNA, 25 nt, Human
gaauuuaccagaaauauuugcucaa

SEQ ID NO: 115498 - RNA, 23 nt, Human
ggggagggagaguucggagccaa

SEQ ID NO: 115499 - RNA, 16 nt, Human
uuccucccccaccuca

SEQ ID NO: 115500 - RNA, 27 nt, Human
agcaggaggugccugaaagcugggagc

SEQ ID NO: 115501 - RNA, 27 nt, Human
auacuauaacauauguacauaaauugc

SEQ ID NO: 115502 - RNA, 22 nt, Human
cccugcaggagaagacagacug

SEQ ID NO: 115503 - RNA, 22 nt, Human
gcagccacagaagccuaggcag

SEQ ID NO: 115504 - RNA, 23 nt, Human
guggguacucaauguguacuuuu

SEQ ID NO: 115505 - RNA, 21 nt, Human
aagaaagagaagaaaugagug

SEQ ID NO: 115506 - RNA, 28 nt, Human
ugcuccugcuuaccuugcucuaggcugu

SEQ ID NO: 115507 - RNA, 19 nt, Human
gccagccaggugaccccug

SEQ ID NO: 115508 - RNA, 21 nt, Human
uccuccugccugucugcacua

SEQ ID NO: 115509 - RNA, 24 nt, Human
uuccccuuugcugauaacaccacc

SEQ ID NO: 115510 - RNA, 26 nt, Human
gagucaaacacccugccuacaaggag

SEQ ID NO: 115511 - RNA, 27 nt, Human
ggguucaucugagcaagagcuggcaaa

SEQ ID NO: 115512 - RNA, 21 nt, Human
ccugccuggaccagccucucc

SEQ ID NO: 115513 - RNA, 27 nt, Human
guggcuggaagcacugaaccuaccuca

SEQ ID NO: 115514 - RNA, 27 nt, Human
cugagguagcuugcagcaucuuuucua

SEQ ID NO: 115515 - RNA, 20 nt, Human
caggcccagcucuucaccag

SEQ ID NO: 115516 - RNA, 23 nt, Human
gggccugaaacccacuccuccau

SEQ ID NO: 115517 - RNA, 21 nt, Human
gcagaggccucugggaguugu

SEQ ID NO: 115518 - RNA, 24 nt, Human
uggagcuggaguggcuggaugugg

SEQ ID NO: 115519 - RNA, 23 nt, Human
cccuuucccucuggauaacaaca

SEQ ID NO: 115520 - RNA, 27 nt, Human
gguucagaaagaggaaugaagauguug

SEQ ID NO: 115521 - RNA, 26 nt, Human
cucuuuaaagacugagggaacagugg

SEQ ID NO: 115522 - RNA, 26 nt, Human
gccacugcaccuggccugacauucuu

SEQ ID NO: 115523 - RNA, 25 nt, Human
uucuuuccauuaugauucuuuguua

SEQ ID NO: 115524 - RNA, 26 nt, Human
ccuauucuagcauuuaaauuuaaauu

SEQ ID NO: 115525 - RNA, 19 nt, Human
uuuuaaaaaauuaggauag

SEQ ID NO: 115526 - RNA, 22 nt, Human
accgggaugcuaacuacaacau

SEQ ID NO: 115527 - RNA, 26 nt, Human
ucuccuccucuucuuccuguccaugc

SEQ ID NO: 115528 - RNA, 27 nt, Human
gagccccggagccgcggcgggagagga

SEQ ID NO: 115529 - RNA, 20 nt, Human
caggcuggacugcagugaca

SEQ ID NO: 115530 - RNA, 21 nt, Human
ucuaagcccagcaaggccagu

SEQ ID NO: 115531 - RNA, 22 nt, Human
cuacccccugcuccagcuugcc

SEQ ID NO: 115532 - RNA, 22 nt, Human
ccaucauggugaaaccccaucu

SEQ ID NO: 115533 - RNA, 25 nt, Human
cccuccaggacuccaccccggcucc

SEQ ID NO: 115534 - RNA, 27 nt, Human
ugaguacggagggucuagccuggguga

SEQ ID NO: 115535 - RNA, 24 nt, Human
auggccagagaugcuggacuugcc

SEQ ID NO: 115536 - RNA, 27 nt, Human
ucccugccucugccauucacacugacu

SEQ ID NO: 115537 - RNA, 25 nt, Human
ucgacuccucacuguguugacacuu

SEQ ID NO: 115538 - RNA, 24 nt, Human
uaccugggaauucugggcugccag

SEQ ID NO: 115539 - RNA, 23 nt, Human
gcacuuucagcaucggcucuuca

SEQ ID NO: 115540 - RNA, 26 nt, Human
agagugagcuauguugagguaaacug

SEQ ID NO: 115541 - RNA, 21 nt, Human
agaugccacagagaggcauca

SEQ ID NO: 115542 - RNA, 23 nt, Human
ggcagcuucacuuccucuuugag

SEQ ID NO: 115543 - RNA, 22 nt, Human
cauuauucuccagccuuaagau

SEQ ID NO: 115544 - RNA, 26 nt, Human
gcccaggcuggucuccaacaccuggg

SEQ ID NO: 115545 - RNA, 24 nt, Human
acuuuucucccuggcuuuugguuc

SEQ ID NO: 115546 - RNA, 21 nt, Human
cacaucucagcccuuccccau

SEQ ID NO: 115547 - RNA, 19 nt, Human
cuucccuugcccuggacuu

SEQ ID NO: 115548 - RNA, 24 nt, Human
ggcaggcagugcugguuccucugc

SEQ ID NO: 115549 - RNA, 21 nt, Human
ggaccccgggagagcggucag

SEQ ID NO: 115550 - RNA, 21 nt, Human
cuugccuggcguucccucugc

SEQ ID NO: 115551 - RNA, 21 nt, Human
caggaagguagcccagcacug

SEQ ID NO: 115552 - RNA, 27 nt, Human
uuucuaggcuaauuugucuugagcugu

SEQ ID NO: 115553 - RNA, 27 nt, Human
gccagccugucccauggacacuccagu

SEQ ID NO: 115554 - RNA, 21 nt, Human
caggggcccaucaucaugucu

SEQ ID NO: 115555 - RNA, 26 nt, Human
uuugacuguugaccuugguuuucucu

SEQ ID NO: 115556 - RNA, 25 nt, Human
ccugugcucccucugugcccagagc

SEQ ID NO: 115557 - RNA, 22 nt, Human
gggccagccuuuagaacacugu

SEQ ID NO: 115558 - RNA, 21 nt, Human
ucucccacucuuucuucauau

SEQ ID NO: 115559 - RNA, 19 nt, Human
ccuagguccucccugcccc

SEQ ID NO: 115560 - RNA, 22 nt, Human
agaguguucauacuggagagaa

SEQ ID NO: 115561 - RNA, 25 nt, Human
uuuccugccugccccaccugccuca

SEQ ID NO: 115562 - RNA, 23 nt, Human
ugcagagaagagaaccaugccag

SEQ ID NO: 115563 - RNA, 23 nt, Human
uucuaaguagauuuaauuuggga

SEQ ID NO: 115564 - RNA, 32 nt, Human
cgccgccaugcagcccuccagccuucugccgc

SEQ ID NO: 115565 - RNA, 27 nt, Human
ccagcacucaagccuugccaccgccga

SEQ ID NO: 115566 - RNA, 23 nt, Human
ccaggaggcggagauugcaguga

SEQ ID NO: 115567 - RNA, 21 nt, Human
uguuggccagacuggucucaa

SEQ ID NO: 115568 - RNA, 27 nt, Human
gucacccagcgagugcugagaccccau

SEQ ID NO: 115569 - RNA, 27 nt, Human
ucuguaaccuguaguaggcucugaccu

SEQ ID NO: 115570 - RNA, 22 nt, Human
gugcuugguauuucugucuuau

SEQ ID NO: 115571 - RNA, 21 nt, Human
gugagccucucggcuccuggg

SEQ ID NO: 115572 - RNA, 19 nt, Human
gcuguccauccauucucac

SEQ ID NO: 115573 - RNA, 27 nt, Human
ccccucggggacgcccccaccagcuca

SEQ ID NO: 115574 - RNA, 22 nt, Human
ggaccaaggagcuuccaucuag

SEQ ID NO: 115575 - RNA, 17 nt, Human
ccaggcaauaguguuga

SEQ ID NO: 115576 - RNA, 27 nt, Human
gcucucuugcccaggcuggagugcaau

SEQ ID NO: 115577 - RNA, 20 nt, Human
ucagcuacuaguucuuccag

SEQ ID NO: 115578 - RNA, 22 nt, Human
uccuucuggugacacauccugc

SEQ ID NO: 115579 - RNA, 22 nt, Human
uguaucuuguaaucaugauuga

SEQ ID NO: 115580 - RNA, 22 nt, Human
cugccuauuuaauguagcuaau

SEQ ID NO: 115581 - RNA, 25 nt, Human
cacacacaccccuguccuccagcac

SEQ ID NO: 115582 - RNA, 23 nt, Human
ccuccugcacagcggcugccgcc

SEQ ID NO: 115583 - RNA, 23 nt, Human
ccagguggucagagggcccagug

SEQ ID NO: 115584 - RNA, 20 nt, Human
ccuguaaucccagcacuugg

SEQ ID NO: 115585 - RNA, 26 nt, Human
gagcgagacuccaucucuuuaaaaac

SEQ ID NO: 115586 - RNA, 23 nt, Human
uacucacauucuguuguucaguu

SEQ ID NO: 115587 - RNA, 23 nt, Human
cugagacagagucucacucuguc

SEQ ID NO: 115588 - RNA, 24 nt, Human
ggcuaauauuuuguauuuuuuagu

SEQ ID NO: 115589 - RNA, 23 nt, Human
gggagagagugggaguuucccag

SEQ ID NO: 115590 - RNA, 25 nt, Human
ucauccauccacagagcagugcagu

SEQ ID NO: 115591 - RNA, 19 nt, Human
ccugcagcuguguagugcu

SEQ ID NO: 115592 - RNA, 31 nt, Human
ggagccagagggagcggagcggaaccugcgg

SEQ ID NO: 115593 - RNA, 21 nt, Human
cagcaguucugggcccuaugc

SEQ ID NO: 115594 - RNA, 27 nt, Human
cauaaguaaaugagccuuucugccuca

SEQ ID NO: 115595 - RNA, 24 nt, Human
agauuucccuugacuuugagaaac

SEQ ID NO: 115596 - RNA, 22 nt, Human
uuuuccucucucuaauuagcuu

SEQ ID NO: 115597 - RNA, 21 nt, Human
aagauagugauguucuguucu

SEQ ID NO: 115598 - RNA, 25 nt, Human
uuagccuuuuuuaaaaacuccauuu

SEQ ID NO: 115599 - RNA, 21 nt, Human
ugugaagccaguagcuauuuu

SEQ ID NO: 115600 - RNA, 20 nt, Human
cagcuuucaaccugcuuacu

SEQ ID NO: 115601 - RNA, 22 nt, Human
ugaggcggaucaccugagguca

SEQ ID NO: 115602 - RNA, 20 nt, Human
acugaaguaaaucauuucag

SEQ ID NO: 115603 - RNA, 19 nt, Human
ugggagaacaaaaagcuga

SEQ ID NO: 115604 - RNA, 27 nt, Human
gagccuacagaccuguccucaccaacu

SEQ ID NO: 115605 - RNA, 19 nt, Human
ucaucuggguucuaaaggg

SEQ ID NO: 115606 - RNA, 21 nt, Human
uuuuuaguuccuuuacacuca

SEQ ID NO: 115607 - RNA, 20 nt, Human
gagcacugucugaagaugag

SEQ ID NO: 115608 - RNA, 21 nt, Human
uuaugucaaauggauguaaua

SEQ ID NO: 115609 - RNA, 21 nt, Human
agggaagagauucagccagca

SEQ ID NO: 115610 - RNA, 18 nt, Human
uggaagagaagacuggca

SEQ ID NO: 115611 - RNA, 23 nt, Human
aaggaugaggccagaacucuucc

SEQ ID NO: 115612 - RNA, 23 nt, Human
cuuacuugguagugagugccuug

SEQ ID NO: 115613 - RNA, 24 nt, Human
agcaaugauagguuaaucacuggc

SEQ ID NO: 115614 - RNA, 19 nt, Human
ucagcggggccucugucuu

SEQ ID NO: 115615 - RNA, 22 nt, Human
uuuaaugccugaaauccaaguc

SEQ ID NO: 115616 - RNA, 24 nt, Human
gaaagcaacucuugccccuccucc

SEQ ID NO: 115617 - RNA, 22 nt, Human
aguccacccuucccagcucagc

SEQ ID NO: 115618 - RNA, 25 nt, Human
gugacuucacuuucaccugcuccag

SEQ ID NO: 115619 - RNA, 27 nt, Human
ugcuaaaagauaauacguuuauuuauu

SEQ ID NO: 115620 - RNA, 22 nt, Human
gcagauccuggcacuaccucac

SEQ ID NO: 115621 - RNA, 26 nt, Human
cugucaugcacauggggucccgcagc

SEQ ID NO: 115622 - RNA, 22 nt, Human
guguccucaccagcaaggcugc

SEQ ID NO: 115623 - RNA, 23 nt, Human
cacucccucucuuuccugcucca

SEQ ID NO: 115624 - RNA, 18 nt, Human
agaaguacaacucaggga

SEQ ID NO: 115625 - RNA, 22 nt, Human
uucaguuuuuuaaaaaucucaa

SEQ ID NO: 115626 - RNA, 26 nt, Human
gcauccuuaacaagaacuacgcugca

SEQ ID NO: 115627 - RNA, 20 nt, Human
cacagccgccacucccccag

SEQ ID NO: 115628 - RNA, 31 nt, Human
cacucacucuccaccagccugggaaaugaau

SEQ ID NO: 115629 - RNA, 24 nt, Human
ggaaguuaguuuuuaaucucucca

SEQ ID NO: 115630 - RNA, 26 nt, Human
ucauauagcaaaauggagaaaauuag

SEQ ID NO: 115631 - RNA, 26 nt, Human
aaaugagagauugcaaauguagugua

SEQ ID NO: 115632 - RNA, 25 nt, Human
gccggaacuuuuuguccauucccua

SEQ ID NO: 115633 - RNA, 22 nt, Human
ucauccuuugcuggagcagguu

SEQ ID NO: 115634 - RNA, 25 nt, Human
gcuuggaccggagagagauggcuca

SEQ ID NO: 115635 - RNA, 21 nt, Human
aagaugagaggcagaggcaga

SEQ ID NO: 115636 - RNA, 22 nt, Human
cccuguguguguuuuguggaca

SEQ ID NO: 115637 - RNA, 28 nt, Human
gcaugucucccacacccccuccuacccu

SEQ ID NO: 115638 - RNA, 20 nt, Human
uuuagccagcugcagggcgg

SEQ ID NO: 115639 - RNA, 27 nt, Human
ccaugucggcucugccugcagugacca

SEQ ID NO: 115640 - RNA, 22 nt, Human
aucucaggcuggagugcagugg

SEQ ID NO: 115641 - RNA, 19 nt, Human
uaaugauuucauaauuuuc

SEQ ID NO: 115642 - RNA, 21 nt, Human
gguggcugugccagaggugcg

SEQ ID NO: 115643 - RNA, 21 nt, Human
auggcuuccaugcaauugggc

SEQ ID NO: 115644 - RNA, 21 nt, Human
acuccacccauccuaucagcc

SEQ ID NO: 115645 - RNA, 22 nt, Human
agccugccgaguagcugggacu

SEQ ID NO: 115646 - RNA, 25 nt, Human
cuucaucuucucaaaucaucagagg

SEQ ID NO: 115647 - RNA, 23 nt, Human
guaaauacuacaaaaacuuauuu

SEQ ID NO: 115648 - RNA, 22 nt, Human
accauccugccaaugcccagga

SEQ ID NO: 115649 - RNA, 26 nt, Human
gcugggugugguggcucaugccugua

SEQ ID NO: 115650 - RNA, 25 nt, Human
acaguguccuaagauacugcuauca

SEQ ID NO: 115651 - RNA, 26 nt, Human
gucugggguucagccccuccucugcc

SEQ ID NO: 115652 - RNA, 23 nt, Human
ugcuguggaugggguagagcugg

SEQ ID NO: 115653 - RNA, 27 nt, Human
ccugccuggcccgcacagucugccugu

SEQ ID NO: 115654 - RNA, 21 nt, Human
cucuuccgucuaaucucucac

SEQ ID NO: 115655 - RNA, 26 nt, Human
agagugaggggguaaagcaguuccug

SEQ ID NO: 115656 - RNA, 21 nt, Human
ggcccuccauugagaaccuga

SEQ ID NO: 115657 - RNA, 27 nt, Human
ggaggcuggaagaggaagaugccuagc

SEQ ID NO: 115658 - RNA, 27 nt, Human
guaccauauuuaaguugaacugcucug

SEQ ID NO: 115659 - RNA, 21 nt, Human
agagugcaaaaaauuagccgg

SEQ ID NO: 115660 - RNA, 23 nt, Human
uucuucauucuuuacugcacuca

SEQ ID NO: 115661 - RNA, 27 nt, Human
cauauuauuauuaauuuugcaaaaaga

SEQ ID NO: 115662 - RNA, 22 nt, Human
acagacacuugacccuuggugu

SEQ ID NO: 115663 - RNA, 27 nt, Human
ugccaugaccucagaaugucacuggug

SEQ ID NO: 115664 - RNA, 22 nt, Human
uugugccgagaaaagcauuuua

SEQ ID NO: 115665 - RNA, 22 nt, Human
gccucaagaucccuuggaauug

SEQ ID NO: 115666 - RNA, 26 nt, Human
cgcccaggcugggugcagucacggcu

SEQ ID NO: 115667 - RNA, 26 nt, Human
gcugggacuugaagggagcacgaguc

SEQ ID NO: 115668 - RNA, 26 nt, Human
augggagcugaggccacacucagcac

SEQ ID NO: 115669 - RNA, 25 nt, Human
ggaagccaccugcucuuuugcucua

SEQ ID NO: 115670 - RNA, 27 nt, Human
ucugccuggaccccauugucugucugc

SEQ ID NO: 115671 - RNA, 24 nt, Human
uggagggacagggagcagggcaga

SEQ ID NO: 115672 - RNA, 26 nt, Human
gagagggagggcgacgggggugagaa

SEQ ID NO: 115673 - RNA, 23 nt, Human
ugggaauugugugauguuuaaca

SEQ ID NO: 115674 - RNA, 26 nt, Human
ucaugcuggagaccuuaacucccauc

SEQ ID NO: 115675 - RNA, 31 nt, Human
caaucaaaagauuaacaacacugcaugcggc

SEQ ID NO: 115676 - RNA, 26 nt, Human
uccucagaugcacggauucagucuuc

SEQ ID NO: 115677 - RNA, 24 nt, Human
cucauuaccacaacagugccacuu

SEQ ID NO: 115678 - RNA, 27 nt, Human
acugugcuacugaagggaacugccuuu

SEQ ID NO: 115679 - RNA, 22 nt, Human
accuaguuggugcaguggcuug

SEQ ID NO: 115680 - RNA, 23 nt, Human
ggcuguuuuuguuccugccuuua

SEQ ID NO: 115681 - RNA, 21 nt, Human
gcuacgccucuucauucccgu

SEQ ID NO: 115682 - RNA, 21 nt, Human
ccuggccuggcccugcccuga

SEQ ID NO: 115683 - RNA, 25 nt, Human
acaucacaugagacaauuuugcuuc

SEQ ID NO: 115684 - RNA, 22 nt, Human
agguaggcagagguugcaguga

SEQ ID NO: 115685 - RNA, 23 nt, Human
acuuucucaauuuaaaaaguucu

SEQ ID NO: 115686 - RNA, 19 nt, Human
aucugccuuuaucuuggau

SEQ ID NO: 115687 - RNA, 22 nt, Human
auugccugagcccaggaguuca

SEQ ID NO: 115688 - RNA, 26 nt, Human
uaggaggugggacgcguguugauuga

SEQ ID NO: 115689 - RNA, 22 nt, Human
acauccaagacaacagggugca

SEQ ID NO: 115690 - RNA, 27 nt, Human
ucaacagcagaaccuaccugcagccac

SEQ ID NO: 115691 - RNA, 27 nt, Human
ucccugccuugcugacaauaaagauau

SEQ ID NO: 115692 - RNA, 21 nt, Human
uuccuuuuaauagcaggauuu

SEQ ID NO: 115693 - RNA, 21 nt, Human
guagcagccuggggugaccuc

SEQ ID NO: 115694 - RNA, 23 nt, Human
ggucuugaacuccuagguugaag

SEQ ID NO: 115695 - RNA, 21 nt, Human
uugccuaggcuggaaauagga

SEQ ID NO: 115696 - RNA, 22 nt, Human
ucggaggccuccucccagccag

SEQ ID NO: 115697 - RNA, 21 nt, Human
auauuucuguuccuccaugca

SEQ ID NO: 115698 - RNA, 23 nt, Human
ggagggagaggaguccuuuuugu

SEQ ID NO: 115699 - RNA, 22 nt, Human
uggguuuaaaaagugcuuugug

SEQ ID NO: 115700 - RNA, 19 nt, Human
cuucaaauaccaucuaguu

SEQ ID NO: 115701 - RNA, 27 nt, Human
acacagcuucagcuauacuuacacugu

SEQ ID NO: 115702 - RNA, 21 nt, Human
gggagucagagguuucaguga

SEQ ID NO: 115703 - RNA, 21 nt, Human
uucggcugcguuucuguggga

SEQ ID NO: 115704 - RNA, 22 nt, Human
gcccaggcuggggaagugaacu

SEQ ID NO: 115705 - RNA, 22 nt, Human
uacuacauuauuaauggguuuu

SEQ ID NO: 115706 - RNA, 25 nt, Human
cgccaggcuggaguguaguggcaca

SEQ ID NO: 115707 - RNA, 24 nt, Human
gacugggugugcaacuugaggcug

SEQ ID NO: 115708 - RNA, 22 nt, Human
gggcagcuucagucucugcagu

SEQ ID NO: 115709 - RNA, 27 nt, Human
gaaccagaacaaccagagugcacuuuu

SEQ ID NO: 115710 - RNA, 25 nt, Human
uugggagggacagggcuuggggagc

SEQ ID NO: 115711 - RNA, 19 nt, Human
acuagcacgcugagcucug

SEQ ID NO: 115712 - RNA, 22 nt, Human
cugcuggaguguugcuguugca

SEQ ID NO: 115713 - RNA, 23 nt, Human
agagcaaauaaaucuuccucaga

SEQ ID NO: 115714 - RNA, 24 nt, Human
ggaugcuguuuaucugucaccucc

SEQ ID NO: 115715 - RNA, 23 nt, Human
accagccgccgcgcccgccucgg

SEQ ID NO: 115716 - RNA, 23 nt, Human
ccagguggcgggcggcuggagcg

SEQ ID NO: 115717 - RNA, 24 nt, Human
gguccagccguggagaaacauccg

SEQ ID NO: 115718 - RNA, 21 nt, Human
gcuggggucuaggcuguuucu

SEQ ID NO: 115719 - RNA, 22 nt, Human
cuuggccucccaaagugcucag

SEQ ID NO: 115720 - RNA, 22 nt, Human
aagugaccccaggcuuugcuca

SEQ ID NO: 115721 - RNA, 22 nt, Human
agaaggcccacuguggagccag

SEQ ID NO: 115722 - RNA, 20 nt, Human
uuccagccuaggccugcagc

SEQ ID NO: 115723 - RNA, 25 nt, Human
uuuccuuuucuuggcuuguuucuac

SEQ ID NO: 115724 - RNA, 24 nt, Human
cuuccccagggagccagggggacu

SEQ ID NO: 115725 - RNA, 24 nt, Human
cuugggaggcugaggcagcauugc

SEQ ID NO: 115726 - RNA, 22 nt, Human
cugcgccugugcuuuuucuccc

SEQ ID NO: 115727 - RNA, 20 nt, Human
cagucucuucauuuugucau

SEQ ID NO: 115728 - RNA, 22 nt, Human
auugcuugaacccaggaagcgg

SEQ ID NO: 115729 - RNA, 23 nt, Human
ccccuccuccuccuucuuugcca

SEQ ID NO: 115730 - RNA, 22 nt, Human
agccuguuucucucugcccucu

SEQ ID NO: 115731 - RNA, 22 nt, Human
ccuucaccucuggacaagucau

SEQ ID NO: 115732 - RNA, 22 nt, Human
uuauauuuuuaaaaaacugaca

SEQ ID NO: 115733 - RNA, 25 nt, Human
guaucauacuuacuaguugauuucu

SEQ ID NO: 115734 - RNA, 21 nt, Human
gcucuuugcaguguagugaca

SEQ ID NO: 115735 - RNA, 23 nt, Human
aacauuguauuacagaugccuuu

SEQ ID NO: 115736 - RNA, 22 nt, Human
uaggggaggggaccgaacuagc

SEQ ID NO: 115737 - RNA, 23 nt, Human
ccaggguggggacaggggcuggc

SEQ ID NO: 115738 - RNA, 23 nt, Human
uucauguuuuucauuugauacuu

SEQ ID NO: 115739 - RNA, 26 nt, Human
aggaagggacaccaagccuuggcucu

SEQ ID NO: 115740 - RNA, 24 nt, Human
cugagccuggauuuucacucaucc

SEQ ID NO: 115741 - RNA, 16 nt, Human
uuagcuccucuguggu

SEQ ID NO: 115742 - RNA, 27 nt, Human
uuaaugccaccuuccucugucugccau

SEQ ID NO: 115743 - RNA, 22 nt, Human
ucuuguuagcuuugcuuuucuc

SEQ ID NO: 115744 - RNA, 25 nt, Human
cugucuccuaagcuggagugcagug

SEQ ID NO: 115745 - RNA, 24 nt, Human
cugcccuggcccuccauacucugc

SEQ ID NO: 115746 - RNA, 21 nt, Human
uacuauauuaaaauacacaca

SEQ ID NO: 115747 - RNA, 22 nt, Human
guccacugucaaguguuuuacu

SEQ ID NO: 115748 - RNA, 20 nt, Human
agagaggaaagagcggagca

SEQ ID NO: 115749 - RNA, 20 nt, Human
gcaucacugcacuccagccu

SEQ ID NO: 115750 - RNA, 22 nt, Human
aauauccuuuagaaaugcucua

SEQ ID NO: 115751 - RNA, 22 nt, Human
cccaacgccgaggagagcuugu

SEQ ID NO: 115752 - RNA, 22 nt, Human
cuuucugugagaguccugaguc

SEQ ID NO: 115753 - RNA, 26 nt, Human
cuacucuggcuugagcacuucuauau

SEQ ID NO: 115754 - RNA, 23 nt, Human
uacuugaugauuuuuaacuuuuu

SEQ ID NO: 115755 - RNA, 17 nt, Human
auauuucuucuuccuca

SEQ ID NO: 115756 - RNA, 27 nt, Human
gcacagcccaccagagcacuacagccu

SEQ ID NO: 115757 - RNA, 21 nt, Human
uccucuuggggauggauuaug

SEQ ID NO: 115758 - RNA, 27 nt, Human
agaccuccugccuccgccucaguaaga

SEQ ID NO: 115759 - RNA, 19 nt, Human
uagcuuauauauuacuugu

SEQ ID NO: 115760 - RNA, 21 nt, Human
agcccagagcagggucucucu

SEQ ID NO: 115761 - RNA, 23 nt, Human
cuguaguguacaguauuauaguu

SEQ ID NO: 115762 - RNA, 22 nt, Human
agaccagccuggccaacaugau

SEQ ID NO: 115763 - RNA, 22 nt, Human
uuaaauguaccuauggcaauuu

SEQ ID NO: 115764 - RNA, 23 nt, Human
gaacccagggcuguuagaggggu

SEQ ID NO: 115765 - RNA, 27 nt, Human
cuggcaugagguucagucauuccagug

SEQ ID NO: 115766 - RNA, 19 nt, Human
ucucugagaggagcagcag

SEQ ID NO: 115767 - RNA, 21 nt, Human
ucacagccacaccacauccca

SEQ ID NO: 115768 - RNA, 27 nt, Human
guccuagaugcuggagugagauuauau

SEQ ID NO: 115769 - RNA, 27 nt, Human
gaguuugcagggugcugagcuguaugg

SEQ ID NO: 115770 - RNA, 25 nt, Human
gcccaaccuggagugcaguggugcg

SEQ ID NO: 115771 - RNA, 25 nt, Human
ucccaggcuggagugcaguggcgua

SEQ ID NO: 115772 - RNA, 23 nt, Human
caauugcuuguuaaaauauuuua

SEQ ID NO: 115773 - RNA, 22 nt, Human
ucuguggaaauuuggaaugaaa

SEQ ID NO: 115774 - RNA, 24 nt, Human
cagugacagauauaauuuacuaca

SEQ ID NO: 115775 - RNA, 25 nt, Human
ucacuggaagcuccaugacucucuu

SEQ ID NO: 115776 - RNA, 27 nt, Human
gucugugaugacaguggccaucccauu

SEQ ID NO: 115777 - RNA, 27 nt, Human
gaggaagaaaugggacucuuugguuau

SEQ ID NO: 115778 - RNA, 26 nt, Human
gcuguuccucacggccugugagacaa

SEQ ID NO: 115779 - RNA, 24 nt, Human
gaggaagaaagaaaggcagggcau

SEQ ID NO: 115780 - RNA, 29 nt, Human
ucacccuucucucacccguccucccugcu

SEQ ID NO: 115781 - RNA, 21 nt, Human
gaggaggugaggcuggagcgc

SEQ ID NO: 115782 - RNA, 20 nt, Human
caccuuggauuaaaacggga

SEQ ID NO: 115783 - RNA, 21 nt, Human
ccugggcaggugggagcugaa

SEQ ID NO: 115784 - RNA, 22 nt, Human
agauucucuaggaaaucuggug

SEQ ID NO: 115785 - RNA, 21 nt, Human
ccagaaucuguaucacagagg

SEQ ID NO: 115786 - RNA, 26 nt, Human
uuugagaaugaaguugucauucaggg

SEQ ID NO: 115787 - RNA, 23 nt, Human
uggcccuggcuggaguucagugg

SEQ ID NO: 115788 - RNA, 20 nt, Human
gaaagguuuugagcaugggu

SEQ ID NO: 115789 - RNA, 21 nt, Human
auagaaaauaagauauacaag

SEQ ID NO: 115790 - RNA, 26 nt, Human
uuagcucaugcugaauuauuuuugcc

SEQ ID NO: 115791 - RNA, 21 nt, Human
ggaaggggugaggagagcagc

SEQ ID NO: 115792 - RNA, 29 nt, Human
uagguacugucagaacaaagcuaccugga

SEQ ID NO: 115793 - RNA, 23 nt, Human
agcaugagcaaucauuccauucg

SEQ ID NO: 115794 - RNA, 26 nt, Human
uugcacccuccgccuucacuccggug

SEQ ID NO: 115795 - RNA, 26 nt, Human
uucuucuguggaguuauccuccuaca

SEQ ID NO: 115796 - RNA, 21 nt, Human
cgggagguugaggcugcagug

SEQ ID NO: 115797 - RNA, 23 nt, Human
gccugccucugguucuauaaaca

SEQ ID NO: 115798 - RNA, 27 nt, Human
uucugcucucauccugcaggugggacu

SEQ ID NO: 115799 - RNA, 26 nt, Human
cacaaaccagacagguuuaauagcga

SEQ ID NO: 115800 - RNA, 22 nt, Human
cgccaggcuggaguguaguggc

SEQ ID NO: 115801 - RNA, 21 nt, Human
agaggacucacuugcccacac

SEQ ID NO: 115802 - RNA, 22 nt, Human
cgucucccaaguucaagcgauu

SEQ ID NO: 115803 - RNA, 22 nt, Human
caucucccagguucaagcgauu

SEQ ID NO: 115804 - RNA, 21 nt, Human
gucagcuauugacacuuccug

SEQ ID NO: 115805 - RNA, 27 nt, Human
aaagacuguucuggccccagacacagg

SEQ ID NO: 115806 - RNA, 23 nt, Human
gaguaggaagaucaggagcuaga

SEQ ID NO: 115807 - RNA, 20 nt, Human
uaaagaaguuaugaacuuua

SEQ ID NO: 115808 - RNA, 22 nt, Human
gccccugggggauuagccagaa

SEQ ID NO: 115809 - RNA, 27 nt, Human
cuggggcagguucuuaguuugccugga

SEQ ID NO: 115810 - RNA, 26 nt, Human
cuugcacuccuacugaguuuguggua

SEQ ID NO: 115811 - RNA, 21 nt, Human
gaaggguuuaaccucacugga

SEQ ID NO: 115812 - RNA, 22 nt, Human
uggcucacaccuguaaugccag

SEQ ID NO: 115813 - RNA, 26 nt, Human
ccaccucucccugggggucucaggga

SEQ ID NO: 115814 - RNA, 21 nt, Human
uuugguuuugucaucuguaaa

SEQ ID NO: 115815 - RNA, 27 nt, Human
ugccugcagccugcccugccucucuca

SEQ ID NO: 115816 - RNA, 21 nt, Human
cacugcacucuagccuggcaa

SEQ ID NO: 115817 - RNA, 19 nt, Human
uagucacuuccugccuugu

SEQ ID NO: 115818 - RNA, 24 nt, Human
ugggggcagaguuucugcaguucc

SEQ ID NO: 115819 - RNA, 21 nt, Human
cugcuggaacucacacaugcc

SEQ ID NO: 115820 - RNA, 21 nt, Human
caucgcugcccagagccuggg

SEQ ID NO: 115821 - RNA, 24 nt, Human
uugaguugacacagggagcuccag

SEQ ID NO: 115822 - RNA, 22 nt, Human
gcugugagugggucucccaaga

SEQ ID NO: 115823 - RNA, 22 nt, Human
gcagggccacuuccugagguca

SEQ ID NO: 115824 - RNA, 21 nt, Human
ccagccgggcuggaggcugug

SEQ ID NO: 115825 - RNA, 19 nt, Human
ggggugaggaggaggcauc

SEQ ID NO: 115826 - RNA, 23 nt, Human
ugugucccaggcuggagugcagu

SEQ ID NO: 115827 - RNA, 23 nt, Human
ccugccugauuccauggcuguug

SEQ ID NO: 115828 - RNA, 23 nt, Human
gccccaggugggcaccaucagca

SEQ ID NO: 115829 - RNA, 23 nt, Human
acaaccacauuuuaauuuguuca

SEQ ID NO: 115830 - RNA, 23 nt, Human
augcagagagaaaaaguuaccga

SEQ ID NO: 115831 - RNA, 27 nt, Human
agccuccugcucuuaacugaauuggga

SEQ ID NO: 115832 - RNA, 19 nt, Human
aggcuuuucucuccaguca

SEQ ID NO: 115833 - RNA, 22 nt, Human
ccacacacucugccaugcacac

SEQ ID NO: 115834 - RNA, 25 nt, Human
uuggggaggggcggcaggagggagg

SEQ ID NO: 115835 - RNA, 26 nt, Human
gggaaagagggggcaggggcugcugg

SEQ ID NO: 115836 - RNA, 25 nt, Human
uugucaaggagagugcagucaacca

SEQ ID NO: 115837 - RNA, 20 nt, Human
acuugcaccuauacgcccag

SEQ ID NO: 115838 - RNA, 21 nt, Human
cccucauugcuguucagauua

SEQ ID NO: 115839 - RNA, 20 nt, Human
agcuggcauuuugcaucuca

SEQ ID NO: 115840 - RNA, 26 nt, Human
ucgugaaauaaaaaguccacucugga

SEQ ID NO: 115841 - RNA, 22 nt, Human
gagaagccucaugggagucagg

SEQ ID NO: 115842 - RNA, 22 nt, Human
ucuagugcccgcguggcauccu

SEQ ID NO: 115843 - RNA, 23 nt, Human
ugucacccaggcuggggcgcaau

SEQ ID NO: 115844 - RNA, 22 nt, Human
uaugcuuuucgccuggcaguua

SEQ ID NO: 115845 - RNA, 26 nt, Human
uaauccagaucugggauuauguagcu

SEQ ID NO: 115846 - RNA, 27 nt, Human
ccauugcauuccagccugggagacgga

SEQ ID NO: 115847 - RNA, 23 nt, Human
caugcuguggaugaagauaaaga

SEQ ID NO: 115848 - RNA, 26 nt, Human
acucacugcgggcuccugagccugcu

SEQ ID NO: 115849 - RNA, 27 nt, Human
ccagcucccuguuuugcugaggccugg

SEQ ID NO: 115850 - RNA, 21 nt, Human
uucuuuaugccacaccuacca

SEQ ID NO: 115851 - RNA, 21 nt, Human
ugccuucagcugaaaaucauu

SEQ ID NO: 115852 - RNA, 27 nt, Human
cugccccagggacaugggaagaccacg

SEQ ID NO: 115853 - RNA, 23 nt, Human
uuggcauaaauuauguuuugaaa

SEQ ID NO: 115854 - RNA, 21 nt, Human
ugccuguggacugagcccuuu

SEQ ID NO: 115855 - RNA, 21 nt, Human
uaugcuguuucuaugucgugg

SEQ ID NO: 115856 - RNA, 23 nt, Human
ugcuuuacgcaucagcugccuua

SEQ ID NO: 115857 - RNA, 21 nt, Human
cucauucuucuuggcucacca

SEQ ID NO: 115858 - RNA, 21 nt, Human
gcucccagcuccuuucaugcu

SEQ ID NO: 115859 - RNA, 20 nt, Human
cguuggucuccuaagggccu

SEQ ID NO: 115860 - RNA, 22 nt, Human
ucacugcagccuccuucuccug

SEQ ID NO: 115861 - RNA, 21 nt, Human
ucugaacuuuguuuccagaaa

SEQ ID NO: 115862 - RNA, 26 nt, Human
ccugcugcugccaccugcccugcugc

SEQ ID NO: 115863 - RNA, 22 nt, Human
gccaaggccccauaccugggcc

SEQ ID NO: 115864 - RNA, 23 nt, Human
acccagggaaccucucugaagug

SEQ ID NO: 115865 - RNA, 20 nt, Human
cccucaccggugaauaaaca

SEQ ID NO: 115866 - RNA, 22 nt, Human
cagccacccugcagccagccau

SEQ ID NO: 115867 - RNA, 19 nt, Human
gcugcaggaggaaaguuua

SEQ ID NO: 115868 - RNA, 21 nt, Human
uuuauccuauuuuuagcaaua

SEQ ID NO: 115869 - RNA, 22 nt, Human
ucaguguccagcgugcugguuc

SEQ ID NO: 115870 - RNA, 22 nt, Human
cucaaguaucuucuuugucccu

SEQ ID NO: 115871 - RNA, 24 nt, Human
cacagucacacacugcuguagucu

SEQ ID NO: 115872 - RNA, 24 nt, Human
uguuuuuaaaaaauacaguuccua

SEQ ID NO: 115873 - RNA, 22 nt, Human
gccuguaaucccagcuauuugg

SEQ ID NO: 115874 - RNA, 24 nt, Human
ccaggcacuuugagucucagucug

SEQ ID NO: 115875 - RNA, 20 nt, Human
uguguccuuggacagcagau

SEQ ID NO: 115876 - RNA, 28 nt, Human
aagguagaauagggcugaagcaucugau

SEQ ID NO: 115877 - RNA, 18 nt, Human
ggcugggcucccaccucc

SEQ ID NO: 115878 - RNA, 21 nt, Human
agcguaucacaucugcccucc

SEQ ID NO: 115879 - RNA, 21 nt, Human
gcuccucuguguguguccgua

SEQ ID NO: 115880 - RNA, 24 nt, Human
gucucaggcugggcucagcaaagg

SEQ ID NO: 115881 - RNA, 22 nt, Human
ucaucaaauacuccuuucagag

SEQ ID NO: 115882 - RNA, 25 nt, Human
uuucccauguguauccugugaccau

SEQ ID NO: 115883 - RNA, 25 nt, Human
aagaaugaagcaaguucacuuucaa

SEQ ID NO: 115884 - RNA, 20 nt, Human
cccccaagccugccccgcua

SEQ ID NO: 115885 - RNA, 29 nt, Human
accugggccuggccagcaggcagggcugc

SEQ ID NO: 115886 - RNA, 21 nt, Human
aggucucguucgucuccagcu

SEQ ID NO: 115887 - RNA, 21 nt, Human
ccuuucaccuccagugccaca

SEQ ID NO: 115888 - RNA, 22 nt, Human
agccucccgaguaccugggauu

SEQ ID NO: 115889 - RNA, 27 nt, Human
ucauugcauuccagccugggcaacaga

SEQ ID NO: 115890 - RNA, 27 nt, Human
ccauugcacuccagccugggcaacaga

SEQ ID NO: 115891 - RNA, 23 nt, Human
gcuuguaaucccagcuacuuggg

SEQ ID NO: 115892 - RNA, 22 nt, Human
auacaucuucaguuuuucucug

SEQ ID NO: 115893 - RNA, 22 nt, Human
cagcagccagcagcugcauggu

SEQ ID NO: 115894 - RNA, 21 nt, Human
agaugccacucugcucugccu

SEQ ID NO: 115895 - RNA, 25 nt, Human
uccugccaccuccugagcugccuuc

SEQ ID NO: 115896 - RNA, 23 nt, Human
cacugcccaggcuggagcauagu

SEQ ID NO: 115897 - RNA, 23 nt, Human
accgggucaugguaauuuuuggu

SEQ ID NO: 115898 - RNA, 21 nt, Human
aguuuacaaaucagauuucuu

SEQ ID NO: 115899 - RNA, 22 nt, Human
gucuccauucucccuccuaccc

SEQ ID NO: 115900 - RNA, 24 nt, Human
ggcagaguggagagggagagacgg

SEQ ID NO: 115901 - RNA, 19 nt, Human
uuggggcaggggggccaga

SEQ ID NO: 115902 - RNA, 24 nt, Human
ugagccaaucaggcuucuuaauuc

SEQ ID NO: 115903 - RNA, 21 nt, Human
ccucacugcagccccugcguc

SEQ ID NO: 115904 - RNA, 25 nt, Human
caugagccaauuuacagagcaugga

SEQ ID NO: 115905 - RNA, 21 nt, Human
cugguggagggggaggggaga

SEQ ID NO: 115906 - RNA, 19 nt, Human
aaucccuuaaacucaggga

SEQ ID NO: 115907 - RNA, 24 nt, Human
caccuucccaaccccaaacaauuc

SEQ ID NO: 115908 - RNA, 21 nt, Human
cggaagugguggcuguggaag

SEQ ID NO: 115909 - RNA, 24 nt, Human
uuccgucccugaggcaaaaggaca

SEQ ID NO: 115910 - RNA, 24 nt, Human
ugucaugcccagcuuggagugcca

SEQ ID NO: 115911 - RNA, 22 nt, Human
gagcugacugaauugcuccucg

SEQ ID NO: 115912 - RNA, 20 nt, Human
aaaaugcaaaaauuagccgg

SEQ ID NO: 115913 - RNA, 27 nt, Human
ucagcuuccagugcaguugugcugcug

SEQ ID NO: 115914 - RNA, 23 nt, Human
cuuaugagaugccugaagccagg

SEQ ID NO: 115915 - RNA, 25 nt, Human
gucucaccuucuccccacccuaccu

SEQ ID NO: 115916 - RNA, 21 nt, Human
gcccccagaggccaggagcuc

SEQ ID NO: 115917 - RNA, 26 nt, Human
uugcagaugaucugggcuuguuucug

SEQ ID NO: 115918 - RNA, 20 nt, Human
uguguuuguagacaaaaggc

SEQ ID NO: 115919 - RNA, 23 nt, Human
acugcccagguggaacagcacgu

SEQ ID NO: 115920 - RNA, 30 nt, Human
caucuccuagagaaacuguguucucccugc

SEQ ID NO: 115921 - RNA, 23 nt, Human
uccgauuucuccuccugccccag

SEQ ID NO: 115922 - RNA, 20 nt, Human
gaggagagaauaaugaugua

SEQ ID NO: 115923 - RNA, 20 nt, Human
gccuggcuggugcucacaua

SEQ ID NO: 115924 - RNA, 22 nt, Human
cgcagggcucugcagcaugugg

SEQ ID NO: 115925 - RNA, 21 nt, Human
cccaaagugcugggauuaccg

SEQ ID NO: 115926 - RNA, 27 nt, Human
cucugaaugccuuggagggaucccagg

SEQ ID NO: 115927 - RNA, 22 nt, Human
cagacucccugcuucucaucuc

SEQ ID NO: 115928 - RNA, 21 nt, Human
gggcagacuucaaaagcuacu

SEQ ID NO: 115929 - RNA, 23 nt, Human
ggucaccuugggaaggcuuggga

SEQ ID NO: 115930 - RNA, 20 nt, Human
cagaagcaugagguucauga

SEQ ID NO: 115931 - RNA, 24 nt, Human
ggcauggaaaagacuucuuuucau

SEQ ID NO: 115932 - RNA, 21 nt, Human
cucccauggaccccucggcac

SEQ ID NO: 115933 - RNA, 22 nt, Human
ucaugccauugcauuccagccu

SEQ ID NO: 115934 - RNA, 26 nt, Human
uacauggucaaguauuaacagcacaa

SEQ ID NO: 115935 - RNA, 21 nt, Human
aguccacccucuccuugaugc

SEQ ID NO: 115936 - RNA, 20 nt, Human
uuucuuucccuuuuuucugc

SEQ ID NO: 115937 - RNA, 26 nt, Human
ugagauucucaccaggacuucagguu

SEQ ID NO: 115938 - RNA, 26 nt, Human
uggacucucugaccuuggagagugua

SEQ ID NO: 115939 - RNA, 25 nt, Human
gugacuucuuuggugaggcaagaag

SEQ ID NO: 115940 - RNA, 27 nt, Human
cugugugacucugggcaagucacucuc

SEQ ID NO: 115941 - RNA, 20 nt, Human
cuggggaggggcagggggag

SEQ ID NO: 115942 - RNA, 23 nt, Human
cucaagugauccuccugccucag

SEQ ID NO: 115943 - RNA, 22 nt, Human
cguucagccuuuuccuccaggg

SEQ ID NO: 115944 - RNA, 25 nt, Human
agaccuacaggaggccagagugagg

SEQ ID NO: 115945 - RNA, 22 nt, Human
agccuccugaggagcugggacu

SEQ ID NO: 115946 - RNA, 21 nt, Human
ucuagggucuagacauguuca

SEQ ID NO: 115947 - RNA, 21 nt, Human
uccuaaaccucaacaaaugag

SEQ ID NO: 115948 - RNA, 29 nt, Human
gugcauggugcuuuuuaacuuucaucgag

SEQ ID NO: 115949 - RNA, 21 nt, Human
uaaagugccaaacaaaucccc

SEQ ID NO: 115950 - RNA, 20 nt, Human
gaaccucaguucugaaauuc

SEQ ID NO: 115951 - RNA, 24 nt, Human
agcaaggagauaggauuauagaua

SEQ ID NO: 115952 - RNA, 15 nt, Human
gaggcagcauaguga

SEQ ID NO: 115953 - RNA, 24 nt, Human
ggcugcuuagagucagccugggug

SEQ ID NO: 115954 - RNA, 22 nt, Human
uucugcguucccccaguucuuu

SEQ ID NO: 115955 - RNA, 26 nt, Human
uuaaaagaggugugggagcagaggaa

SEQ ID NO: 115956 - RNA, 27 nt, Human
cucaggguggcugugauacagguuccc

SEQ ID NO: 115957 - RNA, 27 nt, Human
cguccgcccccagugcugcguucuccc

SEQ ID NO: 115958 - RNA, 24 nt, Human
acacgugcacguacacacaugcau

SEQ ID NO: 115959 - RNA, 22 nt, Human
gguuucuagaucacugugcuua

SEQ ID NO: 115960 - RNA, 28 nt, Human
caggugccuguuccagcccaggcagaga

SEQ ID NO: 115961 - RNA, 27 nt, Human
augugaagccucugucucacugaggau

SEQ ID NO: 115962 - RNA, 26 nt, Human
ucauucucuuuaaaauaccaucucuc

SEQ ID NO: 115963 - RNA, 22 nt, Human
uuggaaacauuacuuugagugc

SEQ ID NO: 115964 - RNA, 19 nt, Human
gccauggugaaaggguuug

SEQ ID NO: 115965 - RNA, 22 nt, Human
ccuccacuccccccauaucuuu

SEQ ID NO: 115966 - RNA, 21 nt, Human
ccggggugggagagcuguuga

SEQ ID NO: 115967 - RNA, 25 nt, Human
gaaucuccuuucuguucuacuuuag

SEQ ID NO: 115968 - RNA, 27 nt, Human
uugaugaaagugcaaagugcccucauu

SEQ ID NO: 115969 - RNA, 22 nt, Human
cucuguccugccagcacugagg

SEQ ID NO: 115970 - RNA, 19 nt, Human
gugcugaacugaucucuua

SEQ ID NO: 115971 - RNA, 27 nt, Human
ggagagagugcagggaggcgcagcuca

SEQ ID NO: 115972 - RNA, 24 nt, Human
aagcuuuguuuguucuuguuuuua

SEQ ID NO: 115973 - RNA, 21 nt, Human
ugagccaagauggcaccacug

SEQ ID NO: 115974 - RNA, 27 nt, Human
uugcccaggcuggucgcgaacuccuga

SEQ ID NO: 115975 - RNA, 21 nt, Human
accugcaaagaucuguccuca

SEQ ID NO: 115976 - RNA, 21 nt, Human
cucccucagccucucagugcc

SEQ ID NO: 115977 - RNA, 21 nt, Human
cagggcugaagccuaagcuac

SEQ ID NO: 115978 - RNA, 19 nt, Human
ucuucaacaguagaccaag

SEQ ID NO: 115979 - RNA, 26 nt, Human
gcgcagucaggcugggcucuguagcg

SEQ ID NO: 115980 - RNA, 22 nt, Human
cuugagacagggucuggcucug

SEQ ID NO: 115981 - RNA, 24 nt, Human
gcccaggcuggagugcaauggcgu

SEQ ID NO: 115982 - RNA, 16 nt, Human
cacugcugugcagcca

SEQ ID NO: 115983 - RNA, 22 nt, Human
aaauuuguaaaaaauuaguuug

SEQ ID NO: 115984 - RNA, 27 nt, Human
guaaagugccuuacaggguaacugugc

SEQ ID NO: 115985 - RNA, 20 nt, Human
uauguaugugugggcuugcu

SEQ ID NO: 115986 - RNA, 22 nt, Human
cugaucuuuuuaaauuaugauu

SEQ ID NO: 115987 - RNA, 21 nt, Human
guggaggcugggaugggugag

SEQ ID NO: 115988 - RNA, 20 nt, Human
gggugucgggaucugaagag

SEQ ID NO: 115989 - RNA, 24 nt, Human
cagccugcccucccugccggagcc

SEQ ID NO: 115990 - RNA, 21 nt, Human
uucacaucucaaggagggaga

SEQ ID NO: 115991 - RNA, 26 nt, Human
cacuguacuccagccugggagauaga

SEQ ID NO: 115992 - RNA, 27 nt, Human
uucucuggggaacuuguuuuuaaaucc

SEQ ID NO: 115993 - RNA, 20 nt, Human
gacccaggcuggaggacagg

SEQ ID NO: 115994 - RNA, 24 nt, Human
gaucugccuggccagcagugagcc

SEQ ID NO: 115995 - RNA, 22 nt, Human
cugcaacccccaucucccaggu

SEQ ID NO: 115996 - RNA, 23 nt, Human
uguuccuuuuuccugcugccaua

SEQ ID NO: 115997 - RNA, 20 nt, Human
ugaaucaugccaugugccca

SEQ ID NO: 115998 - RNA, 21 nt, Human
cuucggcaguggcugggggac

SEQ ID NO: 115999 - RNA, 23 nt, Human
cuguaaauacucuggcuuucucc

SEQ ID NO: 116000 - RNA, 19 nt, Human
gagcaaguuuauuuacaaa

SEQ ID NO: 116001 - RNA, 24 nt, Human
ccuuccugcaaccuuugcggcucc

SEQ ID NO: 116002 - RNA, 25 nt, Human
cacccaggcuuugggugaauucugg

SEQ ID NO: 116003 - RNA, 23 nt, Human
agcucuuccuggacaggccaggu

SEQ ID NO: 116004 - RNA, 22 nt, Human
uuauuccucaaaauaacaucaa

SEQ ID NO: 116005 - RNA, 19 nt, Human
aggcuggauaggagaggaa

SEQ ID NO: 116006 - RNA, 23 nt, Human
cucuauuuuuguacauuguguuu

SEQ ID NO: 116007 - RNA, 29 nt, Human
gcacacugucuuggagcaucugccuugug

SEQ ID NO: 116008 - RNA, 27 nt, Human
ggccagguguggugauucaugccugaa

SEQ ID NO: 116009 - RNA, 21 nt, Human
cgggaagcagagguugcagug

SEQ ID NO: 116010 - RNA, 22 nt, Human
uuguggucucagccaaaaugag

SEQ ID NO: 116011 - RNA, 24 nt, Human
cugaagcugcucucaggcaccccc

SEQ ID NO: 116012 - RNA, 21 nt, Human
auuauuaauuacaauguaaua

SEQ ID NO: 116013 - RNA, 22 nt, Human
gggucaucggggcucacugccu

SEQ ID NO: 116014 - RNA, 24 nt, Human
ucugucuuugcaaaggacuguaag

SEQ ID NO: 116015 - RNA, 27 nt, Human
aacacccuuucaucucagaguccacug

SEQ ID NO: 116016 - RNA, 20 nt, Human
gcaucccccagcucugacag

SEQ ID NO: 116017 - RNA, 21 nt, Human
accuacaugucuuuucuucca

SEQ ID NO: 116018 - RNA, 20 nt, Human
gaaaucaccuguccaucguu

SEQ ID NO: 116019 - RNA, 24 nt, Human
ccuggggcuaaucaaauccaaugg

SEQ ID NO: 116020 - RNA, 23 nt, Human
cucugugucugaguggcuucacu

SEQ ID NO: 116021 - RNA, 22 nt, Human
gccgcccaaacuggagugcagu

SEQ ID NO: 116022 - RNA, 26 nt, Human
ugacucuucccccuccugcuccggcc

SEQ ID NO: 116023 - RNA, 27 nt, Human
ggaccuguuccagugggcacuguacuu

SEQ ID NO: 116024 - RNA, 27 nt, Human
gaccuagcagaccagagauuuuauuuu

SEQ ID NO: 116025 - RNA, 30 nt, Human
ggggguggaagcagccgcaggagcaagggc

SEQ ID NO: 116026 - RNA, 21 nt, Human
gagaccugugauuugccaagu

SEQ ID NO: 116027 - RNA, 23 nt, Human
uacucaguuaggcagugcaguac

SEQ ID NO: 116028 - RNA, 25 nt, Human
agugcucugccucagacguugccug

SEQ ID NO: 116029 - RNA, 21 nt, Human
gguccuguauauacagcacug

SEQ ID NO: 116030 - RNA, 21 nt, Human
aguugcccguggacagagcca

SEQ ID NO: 116031 - RNA, 20 nt, Human
uccaacauuccuuguuugua

SEQ ID NO: 116032 - RNA, 27 nt, Human
guucaucugcugacuucugucuaggcu

SEQ ID NO: 116033 - RNA, 19 nt, Human
ugagaaacgcagccugcca

SEQ ID NO: 116034 - RNA, 22 nt, Human
cugcccaggcuggagcauagug

SEQ ID NO: 116035 - RNA, 21 nt, Human
gcccugccuuccauacacucc

SEQ ID NO: 116036 - RNA, 21 nt, Human
gcccucccuucccccuaucca

SEQ ID NO: 116037 - RNA, 19 nt, Human
accaccccuuccuguccca

SEQ ID NO: 116038 - RNA, 23 nt, Human
cggcacaccacaaccuucaccuc

SEQ ID NO: 116039 - RNA, 23 nt, Human
cggguggcugggauugcaggcac

SEQ ID NO: 116040 - RNA, 22 nt, Human
ccuuucuccuucaugccaggcu

SEQ ID NO: 116041 - RNA, 23 nt, Human
cugcucguucuccuuuucuguuc

SEQ ID NO: 116042 - RNA, 27 nt, Human
ggagaaagggugccagaccauucucug

SEQ ID NO: 116043 - RNA, 21 nt, Human
aggaaugucaaaaauacauuu

SEQ ID NO: 116044 - RNA, 23 nt, Human
caugcugggguuagauguguuug

SEQ ID NO: 116045 - RNA, 24 nt, Human
uuguggagcaguguuuugaccuuu

SEQ ID NO: 116046 - RNA, 25 nt, Human
cggacugugugcagguugcagagga

SEQ ID NO: 116047 - RNA, 22 nt, Human
cugaggcaggaggaucacuuga

SEQ ID NO: 116048 - RNA, 25 nt, Human
cucaaauugggaaauccauuccauu

SEQ ID NO: 116049 - RNA, 28 nt, Human
cuccgacccucccaugcgggugcacacg

SEQ ID NO: 116050 - RNA, 20 nt, Human
gaggugggagggaucacgcc

SEQ ID NO: 116051 - RNA, 23 nt, Human
cuucgggcccagcuucacccugc

SEQ ID NO: 116052 - RNA, 23 nt, Human
aggcuggagugcaguggccugau

SEQ ID NO: 116053 - RNA, 26 nt, Human
agccuccagccucgaccucccgaggc

SEQ ID NO: 116054 - RNA, 21 nt, Human
ucguuucucguugccuaagau

SEQ ID NO: 116055 - RNA, 22 nt, Human
gccagugcccaggcauaggguu

SEQ ID NO: 116056 - RNA, 22 nt, Human
gagcuuuugugcaggagccagg

SEQ ID NO: 116057 - RNA, 27 nt, Human
cccugcucugggaucccuugugaggcu

SEQ ID NO: 116058 - RNA, 14 nt, Human
caucccccuagcca

SEQ ID NO: 116059 - RNA, 23 nt, Human
uaaguugcugggauuacaggugu

SEQ ID NO: 116060 - RNA, 22 nt, Human
cggggaguugcgagggagcgag

SEQ ID NO: 116061 - RNA, 25 nt, Human
ggugccaggccucagccucacccac

SEQ ID NO: 116062 - RNA, 20 nt, Human
cccccaguccuccuccacua

SEQ ID NO: 116063 - RNA, 27 nt, Human
cccaaaguucugggauuacaaguaaua

SEQ ID NO: 116064 - RNA, 22 nt, Human
guucgugccuguaaucccagcu

SEQ ID NO: 116065 - RNA, 21 nt, Human
ucuagaccuggugaucauucg

SEQ ID NO: 116066 - RNA, 21 nt, Human
gugauucucguaccucagccu

SEQ ID NO: 116067 - RNA, 26 nt, Human
ucacccaggcugcggagacucaccuu

SEQ ID NO: 116068 - RNA, 23 nt, Human
uauugcauuucaaaaacaugcua

SEQ ID NO: 116069 - RNA, 22 nt, Human
agugaugugaucauagcucacu

SEQ ID NO: 116070 - RNA, 17 nt, Human
ucacccuucaucuggga

SEQ ID NO: 116071 - RNA, 22 nt, Human
ucucugcccagcuuuucauugc

SEQ ID NO: 116072 - RNA, 15 nt, Human
cuucccuuguagcag

SEQ ID NO: 116073 - RNA, 19 nt, Human
aucugaaacuuuuuuguuu

SEQ ID NO: 116074 - RNA, 27 nt, Human
cccagucaccaguucuccucuggacug

SEQ ID NO: 116075 - RNA, 23 nt, Human
ucacagcccaggcucaccccaag

SEQ ID NO: 116076 - RNA, 20 nt, Human
cacauaccagagucuggagc

SEQ ID NO: 116077 - RNA, 22 nt, Human
cugugccuuuccuaucaccucg

SEQ ID NO: 116078 - RNA, 20 nt, Human
ggguuuuguuaauucuuuuc

SEQ ID NO: 116079 - RNA, 26 nt, Human
cuccugggcauguuugucugugugcu

SEQ ID NO: 116080 - RNA, 21 nt, Human
ccuguaaucccagcacuaugg

SEQ ID NO: 116081 - RNA, 27 nt, Human
agaucaugugacccuauacucuugccu

SEQ ID NO: 116082 - RNA, 22 nt, Human
cguaaccucugccuccugacuu

SEQ ID NO: 116083 - RNA, 22 nt, Human
cccaaguagcucggacuacagg

SEQ ID NO: 116084 - RNA, 21 nt, Human
augugguuugguuccucucug

SEQ ID NO: 116085 - RNA, 22 nt, Human
cugacuucgcgcagcgguggcu

SEQ ID NO: 116086 - RNA, 32 nt, Human
aauacauuuaacauugcuuucuuuuuagcaag

SEQ ID NO: 116087 - RNA, 26 nt, Human
ccuugcugcauuuccuccuuagacua

SEQ ID NO: 116088 - RNA, 30 nt, Human; identical to SEQ ID NO: 6960

SEQ ID NO: 116089 - RNA, 21 nt, Human
gaauguuugugucaccccaaa

SEQ ID NO: 116090 - RNA, 20 nt, Human
gugggcagaucaugagguca

SEQ ID NO: 116091 - RNA, 25 nt, Human
uucuugcaaagacuuuccucucuuu

SEQ ID NO: 116092 - RNA, 22 nt, Human
cuggggcaggaggggagugagg

SEQ ID NO: 116093 - RNA, 25 nt, Human
cguucaccgccuccagcugcugcuc

SEQ ID NO: 116094 - RNA, 26 nt, Human
aggaaggggaggcugcugcauugugg

SEQ ID NO: 116095 - RNA, 23 nt, Human
gucgcccaggcuggagguuaaug

SEQ ID NO: 116096 - RNA, 22 nt, Human
ucugugggcugggucaaugcag

SEQ ID NO: 116097 - RNA, 22 nt, Human
gaggcuuucuucagaacugaac

SEQ ID NO: 116098 - RNA, 19 nt, Human
uguuucagcauacauaacu

SEQ ID NO: 116099 - RNA, 22 nt, Human
agacccuugacaacugcugaga

SEQ ID NO: 116100 - RNA, 23 nt, Human
gaaauuccuugauuuguaauuca

SEQ ID NO: 116101 - RNA, 23 nt, Human
aggagguggcuccagcagaggaa

SEQ ID NO: 116102 - RNA, 26 nt, Human
uccauucaucagauccaguuuaugag

SEQ ID NO: 116103 - RNA, 20 nt, Human
cuugaggccagacugggcaa

SEQ ID NO: 116104 - RNA, 26 nt, Human
uuauauuuuucuuucucuuucagcua

SEQ ID NO: 116105 - RNA, 23 nt, Human
uacuguugccagaggcuuguacu

SEQ ID NO: 116106 - RNA, 23 nt, Human
cacagccugguuuuguccucaug

SEQ ID NO: 116107 - RNA, 23 nt, Human
aagaauauaaauaaauaaaauau

SEQ ID NO: 116108 - RNA, 27 nt, Human
cuccucggggucggagcaggaggcacg

SEQ ID NO: 116109 - RNA, 27 nt, Human
gcaggaacuuaagacaguuccuccugg

SEQ ID NO: 116110 - RNA, 21 nt, Human
gcucuauuuuuguacauugug

SEQ ID NO: 116111 - RNA, 23 nt, Human
ggcucagacgccgugagucaggg

SEQ ID NO: 116112 - RNA, 26 nt, Human
uccucaagaaccugaagauuccagug

SEQ ID NO: 116113 - RNA, 21 nt, Human
cucaccuucaucuacugugaa

SEQ ID NO: 116114 - RNA, 18 nt, Human
cacaaaccucaguauuca

SEQ ID NO: 116115 - RNA, 21 nt, Human
gccaggauauggacaucuugg

SEQ ID NO: 116116 - RNA, 24 nt, Human
uaaacuucuacugagcaaaugguu

SEQ ID NO: 116117 - RNA, 22 nt, Human
ccuuccccuaaaccccaagcuu

SEQ ID NO: 116118 - RNA, 24 nt, Human
acggccucagaaguuuggccggag

SEQ ID NO: 116119 - RNA, 24 nt, Human
auccaaaugcaugugcuuguucua

SEQ ID NO: 116120 - RNA, 20 nt, Human
uaggggguauuuucuguuca

SEQ ID NO: 116121 - RNA, 21 nt, Human
accauugccgcaucuacuucu

SEQ ID NO: 116122 - RNA, 27 nt, Human
cugcugguuggauuccggaaacccacu

SEQ ID NO: 116123 - RNA, 22 nt, Human
caggagaugggugcaacucccu

SEQ ID NO: 116124 - RNA, 19 nt, Human
uuuauggucccuuucuuug

SEQ ID NO: 116125 - RNA, 23 nt, Human
ugucgcccuggcuggagugcaau

SEQ ID NO: 116126 - RNA, 20 nt, Human
uuucagccaggcuggagcaa

SEQ ID NO: 116127 - RNA, 25 nt, Human
gcuaguggagaggcaggaaaaagga

SEQ ID NO: 116128 - RNA, 26 nt, Human
ugcagcucuuggguuuuuuguggcuu

SEQ ID NO: 116129 - RNA, 20 nt, Human
gaauugugccuacuaaauua

SEQ ID NO: 116130 - RNA, 27 nt, Human
ggcagucuuacagaggcuggagcggug

SEQ ID NO: 116131 - RNA, 26 nt, Human
ucuaccauuuuuaauuuaugguucaa

SEQ ID NO: 116132 - RNA, 21 nt, Human
acggcagcccugaaaugcauu

SEQ ID NO: 116133 - RNA, 28 nt, Human
ccuggccuggccccugguccuucacugg

SEQ ID NO: 116134 - RNA, 23 nt, Human
ugcggggaggagggggaggagga

SEQ ID NO: 116135 - RNA, 25 nt, Human
cugggaggcggaggagguugcagug

SEQ ID NO: 116136 - RNA, 27 nt, Human
cucuagccucugcuggagugcagugag

SEQ ID NO: 116137 - RNA, 21 nt, Human
gggcggugccugucucagaag

SEQ ID NO: 116138 - RNA, 26 nt, Human
guggguggagaagggaggguggccag

SEQ ID NO: 116139 - RNA, 24 nt, Human
ccagaccuuguucacacucucaca

SEQ ID NO: 116140 - RNA, 22 nt, Human
acuguugugaaucaccaaagga

SEQ ID NO: 116141 - RNA, 21 nt, Human
ugcccccaauaguagucucug

SEQ ID NO: 116142 - RNA, 23 nt, Human
agcagucuucagccuccucuacc

SEQ ID NO: 116143 - RNA, 23 nt, Human
gaggugagaauggggaggcaaga

SEQ ID NO: 116144 - RNA, 26 nt, Human
ggagguggaggaaggagcaggugcug

SEQ ID NO: 116145 - RNA, 20 nt, Human
agagcacgcaucagcaucgc

SEQ ID NO: 116146 - RNA, 22 nt, Human
aucugucgcaccccuguauuug

SEQ ID NO: 116147 - RNA, 22 nt, Human
caccccuuccuccccauacucc

SEQ ID NO: 116148 - RNA, 24 nt, Human
ccugccuugccccuuaccugccga

SEQ ID NO: 116149 - RNA, 22 nt, Human
ucccccagccgccggccagcuc

SEQ ID NO: 116150 - RNA, 27 nt, Human
cuuggccgaugucugauugggaccagg

SEQ ID NO: 116151 - RNA, 21 nt, Human
cuauuaccaccaccugcucac

SEQ ID NO: 116152 - RNA, 20 nt, Human
auauccaacaugccaaaaau

SEQ ID NO: 116153 - RNA, 22 nt, Human
ccaaagugcugggauuacuggc

SEQ ID NO: 116154 - RNA, 22 nt, Human
ucccaucucaggcagcaagaca

SEQ ID NO: 116155 - RNA, 22 nt, Human
uagagaugcugggacugagggu

SEQ ID NO: 116156 - RNA, 22 nt, Human
acugcucugccccacccuccaa

SEQ ID NO: 116157 - RNA, 24 nt, Human
gaacugcauucuuuuaaaguuuua

SEQ ID NO: 116158 - RNA, 25 nt, Human
gaaauugaagaguucuaaggcuuuc

SEQ ID NO: 116159 - RNA, 21 nt, Human
aggagucagagguuucaguga

SEQ ID NO: 116160 - RNA, 20 nt, Human
gaaguauuuacgaaauugca

SEQ ID NO: 116161 - RNA, 26 nt, Human
gaaggggaccuguuuucuucaaggga

SEQ ID NO: 116162 - RNA, 23 nt, Human
accccacccucucccagccugcc

SEQ ID NO: 116163 - RNA, 22 nt, Human
ccucaccgaccaccuguccugg

SEQ ID NO: 116164 - RNA, 23 nt, Human
gaggacaucgggacggaggcaga

SEQ ID NO: 116165 - RNA, 19 nt, Human
gcacucugugggugcucaa

SEQ ID NO: 116166 - RNA, 19 nt, Human
cuaacagcaacaucugcaa

SEQ ID NO: 116167 - RNA, 32 nt, Human
cccauucaccuuccacaaugcugguaccaucc

SEQ ID NO: 116168 - RNA, 25 nt, Human
cacgucucugucucugggccuuugu

SEQ ID NO: 116169 - RNA, 20 nt, Human
augaaagauuauuauacaaa

SEQ ID NO: 116170 - RNA, 21 nt, Human
cccuccagguccucagaguuu

SEQ ID NO: 116171 - RNA, 25 nt, Human
ucuguuaaaugaaacguguaucgua

SEQ ID NO: 116172 - RNA, 27 nt, Human
cgacggcugcagagcgagcugcccucg

SEQ ID NO: 116173 - RNA, 19 nt, Human
cgucugucugaccaucccu

SEQ ID NO: 116174 - RNA, 26 nt, Human
gggagcagaaaaaacccaacucagca

SEQ ID NO: 116175 - RNA, 22 nt, Human
aguucugugcugucucuuggag

SEQ ID NO: 116176 - RNA, 22 nt, Human
cagaaccucuucuuccuucuug

SEQ ID NO: 116177 - RNA, 23 nt, Human
uuuagccccuucccuuugcugcc

SEQ ID NO: 116178 - RNA, 20 nt, Human
uccccaggcucuagugcagg

SEQ ID NO: 116179 - RNA, 20 nt, Human
cuguuuguuucuccaagccu

SEQ ID NO: 116180 - RNA, 26 nt, Human
ugcuaccucugaucaaagcaccuuga

SEQ ID NO: 116181 - RNA, 23 nt, Human
gccaaacccccuaaaggucucca

SEQ ID NO: 116182 - RNA, 21 nt, Human
ggagguggggaggaaugagag

SEQ ID NO: 116183 - RNA, 23 nt, Human
guagacuuucagcagcaaucuca

SEQ ID NO: 116184 - RNA, 27 nt, Human
caggugacaucauaaauacuugcugaa

SEQ ID NO: 116185 - RNA, 21 nt, Human
ggccagccugagccagcagug

SEQ ID NO: 116186 - RNA, 22 nt, Human
gcuagaucuucagggugggcuu

SEQ ID NO: 116187 - RNA, 20 nt, Human
cggcuccccucggccuccuc

SEQ ID NO: 116188 - RNA, 25 nt, Human
agcagggccuggccuuuccuccucu

SEQ ID NO: 116189 - RNA, 20 nt, Human
accaagucucaacacuuacu

SEQ ID NO: 116190 - RNA, 25 nt, Human
acccaggcuggagugcaguggagca

SEQ ID NO: 116191 - RNA, 23 nt, Human
acauuugcuggggauuucuguga

SEQ ID NO: 116192 - RNA, 20 nt, Human
agccggccccccugccucgg

SEQ ID NO: 116193 - RNA, 27 nt, Human
uucauucucuagugucuaaaaccuggu

SEQ ID NO: 116194 - RNA, 26 nt, Human
accaugucccacacggucgcaggcgg

SEQ ID NO: 116195 - RNA, 22 nt, Human
cuguuaucugcuagaucuaguu

SEQ ID NO: 116196 - RNA, 21 nt, Human
cacgggcgagcuuucucuccg

SEQ ID NO: 116197 - RNA, 20 nt, Human
cauuacugguuguucuggcu

SEQ ID NO: 116198 - RNA, 24 nt, Human
aacuggaucuuaaggacuaaagca

SEQ ID NO: 116199 - RNA, 20 nt, Human
uucagugccauacauguuau

SEQ ID NO: 116200 - RNA, 18 nt, Human
uguugaaaauauuuacaa

SEQ ID NO: 116201 - RNA, 25 nt, Human
acccaggcgggaguggugcaauggc

SEQ ID NO: 116202 - RNA, 26 nt, Human
ccuccugccagcuucccccgucagcc

SEQ ID NO: 116203 - RNA, 22 nt, Human
agaccagccagagcaacacagu

SEQ ID NO: 116204 - RNA, 22 nt, Human
gccauugcagcuugaaaaagaa

SEQ ID NO: 116205 - RNA, 21 nt, Human
ucccagagccaaaaacaaaua

SEQ ID NO: 116206 - RNA, 22 nt, Human
acugagaaagggagaacauggu

SEQ ID NO: 116207 - RNA, 23 nt, Human
gggaguguuugugucugacucag

SEQ ID NO: 116208 - RNA, 27 nt, Human
cugcuggccgcucucuucucugccucu

SEQ ID NO: 116209 - RNA, 21 nt, Human
cucuucugggacccagccaug

SEQ ID NO: 116210 - RNA, 24 nt, Human
aggcugcacaccuagaaccccaau

SEQ ID NO: 116211 - RNA, 27 nt, Human
guuugugccuuuucuuuacuuugcuua

SEQ ID NO: 116212 - RNA, 20 nt, Human
cucauagaacauuuuaauag

SEQ ID NO: 116213 - RNA, 25 nt, Human
ucagcaguuuguuccuuuucauugc

SEQ ID NO: 116214 - RNA, 22 nt, Human
aaguugccugaaugauccuccu

SEQ ID NO: 116215 - RNA, 22 nt, Human
agggcccggcaccuccugcugc

SEQ ID NO: 116216 - RNA, 27 nt, Human
cuguuugcagacguccgugggagaccc

SEQ ID NO: 116217 - RNA, 25 nt, Human
gcacaacuaggaaaccccaaagccc

SEQ ID NO: 116218 - RNA, 24 nt, Human
agccuccucugacuuuucuuuugg

SEQ ID NO: 116219 - RNA, 19 nt, Human
gcccaggguggagugcagu

SEQ ID NO: 116220 - RNA, 19 nt, Human
gcccaggcuggaguggagu

SEQ ID NO: 116221 - RNA, 26 nt, Human
gugaaccuagaagcagagacucugug

SEQ ID NO: 116222 - RNA, 26 nt, Human
cacuuaaggcacucuguuauuuagac

SEQ ID NO: 116223 - RNA, 25 nt, Human
gcugcugcugcugcugcuaaucuuc

SEQ ID NO: 116224 - RNA, 22 nt, Human
uguggccagguguggucucggu

SEQ ID NO: 116225 - RNA, 19 nt, Human
agaaaccauugugcuucug

SEQ ID NO: 116226 - RNA, 22 nt, Human
ccgagauggcgcuauugcacuc

SEQ ID NO: 116227 - RNA, 20 nt, Human
agggaaacaaacacauacca

SEQ ID NO: 116228 - RNA, 27 nt, Human
gcccauccauaguaacugacaugauua

SEQ ID NO: 116229 - RNA, 27 nt, Human
ccaaauuccuguucccugaucaacuuc

SEQ ID NO: 116230 - RNA, 21 nt, Human
cucucaaugccuuuucacuua

SEQ ID NO: 116231 - RNA, 26 nt, Human
aucucaggccucccucaaccccacca

SEQ ID NO: 116232 - RNA, 23 nt, Human
cuguccccaaaauguggaaugca

SEQ ID NO: 116233 - RNA, 21 nt, Human
ccacagacacaauauguaugc

SEQ ID NO: 116234 - RNA, 20 nt, Human
uuuaaauaaucacacuugga

SEQ ID NO: 116235 - RNA, 20 nt, Human
cuucauuugcuucucucaac

SEQ ID NO: 116236 - RNA, 15 nt, Human
cauccagcuacagga

SEQ ID NO: 116237 - RNA, 25 nt, Human
ggucgcgaugaugggcuggagcagu

SEQ ID NO: 116238 - RNA, 23 nt, Human
aaaacauccaagagcacuaggau

SEQ ID NO: 116239 - RNA, 20 nt, Human
gggcugucaggaaaccuacc

SEQ ID NO: 116240 - RNA, 23 nt, Human
cacaacgccauggggcagagcca

SEQ ID NO: 116241 - RNA, 32 nt, Human
gggaggaggaggugguccucaggugcagcccc

SEQ ID NO: 116242 - RNA, 22 nt, Human
accccccaggcugaagugcagu

SEQ ID NO: 116243 - RNA, 22 nt, Human
auccaguuugcuuuauuuggcu

SEQ ID NO: 116244 - RNA, 21 nt, Human
ccaacaaaaauaauuacuucu

SEQ ID NO: 116245 - RNA, 20 nt, Human
gcacacagcuccacagguug

SEQ ID NO: 116246 - RNA, 26 nt, Human
cugcuuuccuacucuccuuuuaucuc

SEQ ID NO: 116247 - RNA, 19 nt, Human
ggcucuggcuuuucuugaa

SEQ ID NO: 116248 - RNA, 19 nt, Human
cugcugcugcucaagagcu

SEQ ID NO: 116249 - RNA, 21 nt, Human
cacccaggcuggagugcagua

SEQ ID NO: 116250 - RNA, 27 nt, Human
ucuucuuucaaaauuuccucuccaucu

SEQ ID NO: 116251 - RNA, 17 nt, Human
ugucuccaucuggucau

SEQ ID NO: 116252 - RNA, 19 nt, Human
uuaaucagcuugaacugcc

SEQ ID NO: 116253 - RNA, 24 nt, Human
guuucagcuuucuugaccuuagcu

SEQ ID NO: 116254 - RNA, 22 nt, Human
uaucacccaggcuggaguggag

SEQ ID NO: 116255 - RNA, 19 nt, Human
ugcucugggggcugggauu

SEQ ID NO: 116256 - RNA, 21 nt, Human
ggugcccucugcgccuccuua

SEQ ID NO: 116257 - RNA, 18 nt, Human
cucugucucucuuccuca

SEQ ID NO: 116258 - RNA, 26 nt, Human
cuuuagagaauguuacuuaguuaaac

SEQ ID NO: 116259 - RNA, 27 nt, Human
ccuuucaggcuggcauggagagcuuaa

SEQ ID NO: 116260 - RNA, 24 nt, Human
gucuucuccccagccccguccucc

SEQ ID NO: 116261 - RNA, 21 nt, Human
augccacauuucauuugaucu

SEQ ID NO: 116262 - RNA, 23 nt, Human
cuuuaaccuuguauaaauuauuc

SEQ ID NO: 116263 - RNA, 22 nt, Human
uaaacgaucugcaaccaccauc

SEQ ID NO: 116264 - RNA, 19 nt, Human
ccaccuccucuuccuuggc

SEQ ID NO: 116265 - RNA, 21 nt, Human
ccaccaggccauacugcucag

SEQ ID NO: 116266 - RNA, 27 nt, Human
agauguaccucauuuaacauagagaug

SEQ ID NO: 116267 - RNA, 26 nt, Human
gaagucauuuugauaauuuugcuuaa

SEQ ID NO: 116268 - RNA, 22 nt, Human
cacuugaacucgggaggcagag

SEQ ID NO: 116269 - RNA, 22 nt, Human
ugcuccugcucucucuccucca

SEQ ID NO: 116270 - RNA, 21 nt, Human
acauuaaacucuccuuccuca

SEQ ID NO: 116271 - RNA, 21 nt, Human
uccccaucuagaacugccauu

SEQ ID NO: 116272 - RNA, 20 nt, Human
gaaaccccuucuuuacuucc

SEQ ID NO: 116273 - RNA, 28 nt, Human
cuuguuacucccuguuauuuuucugccc

SEQ ID NO: 116274 - RNA, 19 nt, Human
augaccaucuguugcucaa

SEQ ID NO: 116275 - RNA, 25 nt, Human
gucguacuggauguaacuagucuac

SEQ ID NO: 116276 - RNA, 22 nt, Human
aauggcacugcuccauccuccc

SEQ ID NO: 116277 - RNA, 18 nt, Human
agaccuuccagcuccugu

SEQ ID NO: 116278 - RNA, 23 nt, Human
ggcagggagagaguagcugcagc

SEQ ID NO: 116279 - RNA, 21 nt, Human
ucacccaggcuggagugccgu

SEQ ID NO: 116280 - RNA, 23 nt, Human
uggccucacgccuguaaucccag

SEQ ID NO: 116281 - RNA, 24 nt, Human
ggccccggcucucuggaccuuguc

SEQ ID NO: 116282 - RNA, 27 nt, Human
uguccugccuugaugaagccugugcca

SEQ ID NO: 116283 - RNA, 18 nt, Human
gcauggucaaaggcucaa

SEQ ID NO: 116284 - RNA, 19 nt, Human
gcagggcugggacugcugu

SEQ ID NO: 116285 - RNA, 24 nt, Human
ggcucacugcugcaaccucccccu

SEQ ID NO: 116286 - RNA, 21 nt, Human
cacaaaggugacagcauuuaa

SEQ ID NO: 116287 - RNA, 28 nt, Human
gcguucugagaauaaacagaaccucugu

SEQ ID NO: 116288 - RNA, 22 nt, Human
ggcugcugccugcucauggccc

SEQ ID NO: 116289 - RNA, 27 nt, Human
gcucaauuucuuaggcuggagugcagu

SEQ ID NO: 116290 - RNA, 27 nt, Human
ccugcagcgcucggcacugugggcaga

SEQ ID NO: 116291 - RNA, 23 nt, Human
uaccaccugaccucuugcugcca

SEQ ID NO: 116292 - RNA, 27 nt, Human
ggucuccugcccuuguuccuggcagca

SEQ ID NO: 116293 - RNA, 22 nt, Human
cucgguucugcgccacuuccuu

SEQ ID NO: 116294 - RNA, 26 nt, Human
acccuuuacuaccuugaacuucagcg

SEQ ID NO: 116295 - RNA, 28 nt, Human
aucuugggagaaaaaauaauauuaggaa

SEQ ID NO: 116296 - RNA, 23 nt, Human
aguuaacuuggauuacauuuuga

SEQ ID NO: 116297 - RNA, 22 nt, Human
cucaaagcuuuuugaaaaccaa

SEQ ID NO: 116298 - RNA, 27 nt, Human
ggggugaggggcaggcagcaguuguag

SEQ ID NO: 116299 - RNA, 21 nt, Human
ugaauacuuuaaaaagugaua

SEQ ID NO: 116300 - RNA, 27 nt, Human
gguaucuguuuaacauuuccucaguca

SEQ ID NO: 116301 - RNA, 24 nt, Human
ccgacacagacucucaaucugccg

SEQ ID NO: 116302 - RNA, 23 nt, Human
cucagcagggcugcucagugccu

SEQ ID NO: 116303 - RNA, 27 nt, Human
ggaggaccccgagggcugaggagcagc

SEQ ID NO: 116304 - RNA, 21 nt, Human
gaugguuuguuugguccuuuu

SEQ ID NO: 116305 - RNA, 22 nt, Human
uuugucauggaggcagacauac

SEQ ID NO: 116306 - RNA, 22 nt, Human
cucuuucuccucccacaggguc

SEQ ID NO: 116307 - RNA, 24 nt, Human
gccccucuggcccugccagcugcc

SEQ ID NO: 116308 - RNA, 22 nt, Human
ugccuccucggcuuccuuggaa

SEQ ID NO: 116309 - RNA, 26 nt, Human
cgccucagucucccaaagugcugaga

SEQ ID NO: 116310 - RNA, 24 nt, Human
ggagaagagagagggagauaaaag

SEQ ID NO: 116311 - RNA, 22 nt, Human
guggauuauuucauuuuguaac

SEQ ID NO: 116312 - RNA, 27 nt, Human
auaaagugccaguaauccgccaagagg

SEQ ID NO: 116313 - RNA, 21 nt, Human
aacaaauugggaucugucuug

SEQ ID NO: 116314 - RNA, 27 nt, Human
ugcagugagcuaugauuguaccacugc

SEQ ID NO: 116315 - RNA, 22 nt, Human
aggcugaggaaggagaaucacu

SEQ ID NO: 116316 - RNA, 27 nt, Human
ucaccuugaugacuuccuauccauucu

SEQ ID NO: 116317 - RNA, 19 nt, Human
ggaggaagaggguagacag

SEQ ID NO: 116318 - RNA, 28 nt, Human
accauggccucagaucaccagacccagg

SEQ ID NO: 116319 - RNA, 21 nt, Human
acccaaguuggagugcagugg

SEQ ID NO: 116320 - RNA, 23 nt, Human
ucucgaucucuugaccucauguc

SEQ ID NO: 116321 - RNA, 23 nt, Human
gucgauuagacuggacagcuugu

SEQ ID NO: 116322 - RNA, 23 nt, Human
agcagaaccuugcgcgggcacag

SEQ ID NO: 116323 - RNA, 21 nt, Human
ccucccaccacccaugugcau

SEQ ID NO: 116324 - RNA, 21 nt, Human
caggaagagccagcaagagca

SEQ ID NO: 116325 - RNA, 18 nt, Human
gucucuauuucuuccuuu

SEQ ID NO: 116326 - RNA, 23 nt, Human
auuuggcugucugauauuaugau

SEQ ID NO: 116327 - RNA, 21 nt, Human
gaguccugcagccaggagggu

SEQ ID NO: 116328 - RNA, 26 nt, Human
gaaugucaaaaauacauuuuacuuua

SEQ ID NO: 116329 - RNA, 27 nt, Human
guuuucccacuuuuugguaauauauau

SEQ ID NO: 116330 - RNA, 28 nt, Human
cuugggcagagcuggcucugagcgccuc

SEQ ID NO: 116331 - RNA, 27 nt, Human
cacuaaauuuguucuuugauauuggaa

SEQ ID NO: 116332 - RNA, 27 nt, Human
uaccuugaaaagaagguuggagugcag

SEQ ID NO: 116333 - RNA, 27 nt, Human
gccacaucccccugucuaaaaauucag

SEQ ID NO: 116334 - RNA, 22 nt, Human
ucuacaacuuugaauaaaggga

SEQ ID NO: 116335 - RNA, 32 nt, Human
ggauggggcuucuucaacagggccccugcccu

SEQ ID NO: 116336 - RNA, 23 nt, Human
gugguccuaggacccaggggagg

SEQ ID NO: 116337 - RNA, 23 nt, Human
ucugacugcaacuucugucccuu

SEQ ID NO: 116338 - RNA, 26 nt, Human
cugcucagaauagagccaugaucuca

SEQ ID NO: 116339 - RNA, 22 nt, Human
auugagccucacuggugccagg

SEQ ID NO: 116340 - RNA, 27 nt, Human
gccugggaagaggggcaggaggccagu

SEQ ID NO: 116341 - RNA, 24 nt, Human
gaggagcagagguggccgccgugg

SEQ ID NO: 116342 - RNA, 21 nt, Human
cagacaagcagagagcucuau

SEQ ID NO: 116343 - RNA, 26 nt, Human
cccauugucuguguuuaguccuuguu

SEQ ID NO: 116344 - RNA, 26 nt, Human
ggaaggcagauccccuaguuggccaa

SEQ ID NO: 116345 - RNA, 23 nt, Human
cggccaggcccucuuagcccucu

SEQ ID NO: 116346 - RNA, 23 nt, Human
cuuggucauuuuaugacaaugga

SEQ ID NO: 116347 - RNA, 23 nt, Human
uguugcccaggcuggcgugcagu

SEQ ID NO: 116348 - RNA, 22 nt, Human
uuuggggauuacuuuuuacuua

SEQ ID NO: 116349 - RNA, 26 nt, Human
ggggcagcagucuugaggagcaggga

SEQ ID NO: 116350 - RNA, 27 nt, Human
uggucucacuacuugaccauucucacc

SEQ ID NO: 116351 - RNA, 24 nt, Human
ugggggaagagaaacuugcaguga

SEQ ID NO: 116352 - RNA, 27 nt, Human
caucuagcagaaggcccugugugugga

SEQ ID NO: 116353 - RNA, 22 nt, Human
aaugcuggugccauuguuguca

SEQ ID NO: 116354 - RNA, 27 nt, Human
ggaggcugaggugggcggauugcuuga

SEQ ID NO: 116355 - RNA, 22 nt, Human
cccugcacaggcacacagggcc

SEQ ID NO: 116356 - RNA, 23 nt, Human
guugaccaggcuggagugcagug

SEQ ID NO: 116357 - RNA, 21 nt, Human
gaguggaaggucuggagcuuu

SEQ ID NO: 116358 - RNA, 20 nt, Human
cuguucucuucucuacccug

SEQ ID NO: 116359 - RNA, 23 nt, Human
aaaugaacuucaguaagcuuuca

SEQ ID NO: 116360 - RNA, 22 nt, Human
cugacuuccggcagcagcugcu

SEQ ID NO: 116361 - RNA, 22 nt, Human
cugaggcuggagaaucgcuuga

SEQ ID NO: 116362 - RNA, 22 nt, Human
cuggccgcgcgccuuuucucuc

SEQ ID NO: 116363 - RNA, 23 nt, Human
gugccuaaagugcugcagccaaa

SEQ ID NO: 116364 - RNA, 22 nt, Human
gccagagcuggggaaacccaga

SEQ ID NO: 116365 - RNA, 22 nt, Human
uagcauccugagacauuuugaa

SEQ ID NO: 116366 - RNA, 26 nt, Human
cauccuuaccuccaaaagcacaggga

SEQ ID NO: 116367 - RNA, 19 nt, Human
gacccugcaccuggauggg

SEQ ID NO: 116368 - RNA, 23 nt, Human
ccaaaccguuucacugucuuguc

SEQ ID NO: 116369 - RNA, 22 nt, Human
cauccacuuggagugcugcggg

SEQ ID NO: 116370 - RNA, 21 nt, Human
cugccucaauuucuucaucug

SEQ ID NO: 116371 - RNA, 20 nt, Human
aaaaagauggcuacugugcc

SEQ ID NO: 116372 - RNA, 20 nt, Human
gaaggaggggacagaggagc

SEQ ID NO: 116373 - RNA, 21 nt, Human
augagccucagcuuccagggc

SEQ ID NO: 116374 - RNA, 25 nt, Human
gcaugaaacauuaacacagcucuuu

SEQ ID NO: 116375 - RNA, 23 nt, Human
ucugcaugucugugcucuuccuc

SEQ ID NO: 116376 - RNA, 22 nt, Human
gggaguggaaaaaacaggcggg

SEQ ID NO: 116377 - RNA, 25 nt, Human
aauauuaucuuucuuaacuuuuucc

SEQ ID NO: 116378 - RNA, 18 nt, Human
ccaaugcuacugucagcu

SEQ ID NO: 116379 - RNA, 27 nt, Human
agaaauucucugaucauuuaguucuau

SEQ ID NO: 116380 - RNA, 18 nt, Human
agaaacuucacaugugaa

SEQ ID NO: 116381 - RNA, 27 nt, Human
ugaaggaaacugaacuugagguggccu

SEQ ID NO: 116382 - RNA, 22 nt, Human
agcggcccugagcuugcagggu

SEQ ID NO: 116383 - RNA, 22 nt, Human
ugacuaguuucacaucucuuug

SEQ ID NO: 116384 - RNA, 26 nt, Human
ucuccugaaagggaagguggaagccg

SEQ ID NO: 116385 - RNA, 24 nt, Human
ucauuacaauugcaaaucuuuacu

SEQ ID NO: 116386 - RNA, 26 nt, Human
gucccgaacuccugaccucaagugau

SEQ ID NO: 116387 - RNA, 23 nt, Human
agaugccagggcaugcagggcag

SEQ ID NO: 116388 - RNA, 25 nt, Human
ccuccacucuggcccuaaaugcucc

SEQ ID NO: 116389 - RNA, 27 nt, Human
accagcacuaaucccccucugcccucc

SEQ ID NO: 116390 - RNA, 22 nt, Human
aguggcaugaucuuggcuuacu

SEQ ID NO: 116391 - RNA, 26 nt, Human
ucauucucggacccaucuuugcucau

SEQ ID NO: 116392 - RNA, 23 nt, Human
ugccauuguuuucuugaccuagu

SEQ ID NO: 116393 - RNA, 22 nt, Human
cuucccuuggcucugggggccg

SEQ ID NO: 116394 - RNA, 22 nt, Human
gagcccaaucucugcuggucag

SEQ ID NO: 116395 - RNA, 20 nt, Human
cgguuucuagccucugagau

SEQ ID NO: 116396 - RNA, 21 nt, Human
cuuacaaaaauauauuuugga

SEQ ID NO: 116397 - RNA, 23 nt, Human
ugucucccaggcuggagugcaau

SEQ ID NO: 116398 - RNA, 23 nt, Human
ugucacccaggcuggagugcuau

SEQ ID NO: 116399 - RNA, 21 nt, Human
augcagaaagcacagaaagga

SEQ ID NO: 116400 - RNA, 26 nt, Human
uuugggcaucagaaaacaggguccag

SEQ ID NO: 116401 - RNA, 23 nt, Human
agaagaaaagacacaggacugug

SEQ ID NO: 116402 - RNA, 20 nt, Human
cuuguuacugccuuuuguca

SEQ ID NO: 116403 - RNA, 20 nt, Human
ggagguugaggcugcaguga

SEQ ID NO: 116404 - RNA, 22 nt, Human
gaggggaggggacgggcagggu

SEQ ID NO: 116405 - RNA, 23 nt, Human
cuuauaagauauaaauggagauu

SEQ ID NO: 116406 - RNA, 20 nt, Human
accagaaauugguagaagga

SEQ ID NO: 116407 - RNA, 22 nt, Human
gguugcugggccucccaccuca

SEQ ID NO: 116408 - RNA, 26 nt, Human
cugggcuucaguggcagcugcuuuug

SEQ ID NO: 116409 - RNA, 22 nt, Human
auccagucagcagauggucagc

SEQ ID NO: 116410 - RNA, 24 nt, Human
gcgcaaucuuggcucacugcaacc

SEQ ID NO: 116411 - RNA, 21 nt, Human
cgcagccauagcaagugccug

SEQ ID NO: 116412 - RNA, 21 nt, Human
aucgaacacauucagugauaa

SEQ ID NO: 116413 - RNA, 26 nt, Human
agggcaagaucucagcagugaaguau

SEQ ID NO: 116414 - RNA, 22 nt, Human
gcaccuugcccuccccagggga

SEQ ID NO: 116415 - RNA, 25 nt, Human
gcauuuucacccauucugugguuca

SEQ ID NO: 116416 - RNA, 17 nt, Human
uuuggagcuacagugga

SEQ ID NO: 116417 - RNA, 26 nt, Human
ccuggccuggcccugcaguaagaagc

SEQ ID NO: 116418 - RNA, 22 nt, Human
cggcaccgccucccaaacaggg

SEQ ID NO: 116419 - RNA, 20 nt, Human
acuccuguaauuccuaccuc

SEQ ID NO: 116420 - RNA, 24 nt, Human
cugucucucuuccucagcagaccu

SEQ ID NO: 116421 - RNA, 22 nt, Human
caccacuguacuccagccuggg

SEQ ID NO: 116422 - RNA, 22 nt, Human
uaccacugcacuccagccuggg

SEQ ID NO: 116423 - RNA, 22 nt, Human
caccacugcacuccagucuggg

SEQ ID NO: 116424 - RNA, 22 nt, Human
cgccacugugcuccagccuggg

SEQ ID NO: 116425 - RNA, 24 nt, Human
ucgucaugacugccaaucucaaca

SEQ ID NO: 116426 - RNA, 26 nt, Human
uuaaugcucaugagacuauauuuaug

SEQ ID NO: 116427 - RNA, 20 nt, Human
gcucuguccuaaauaucuca

SEQ ID NO: 116428 - RNA, 25 nt, Human
aggaggggagagacaggcagcccag

SEQ ID NO: 116429 - RNA, 24 nt, Human
gguaguggccucucaaaggcuggg

SEQ ID NO: 116430 - RNA, 21 nt, Human
acgaaguuucagaauuggcug

SEQ ID NO: 116431 - RNA, 23 nt, Human
uuucaacucagcuuuuugagacc

SEQ ID NO: 116432 - RNA, 27 nt, Human
uuucuaugcuuguaacugucuucuagc

SEQ ID NO: 116433 - RNA, 25 nt, Human
ccccaaucucccacagggugcuggg

SEQ ID NO: 116434 - RNA, 18 nt, Human
ugagagggagagcugugg

SEQ ID NO: 116435 - RNA, 19 nt, Human
ggcugaggagaggagcagu

SEQ ID NO: 116436 - RNA, 26 nt, Human
uuuguauuuuuaguggagacaggauu

SEQ ID NO: 116437 - RNA, 22 nt, Human
gccacccugugcagaagggagc

SEQ ID NO: 116438 - RNA, 18 nt, Human
gcccccagccccagccuc

SEQ ID NO: 116439 - RNA, 27 nt, Human
gccaggcccauucccagcugcugcagu

SEQ ID NO: 116440 - RNA, 26 nt, Human
gcacagacacggugcaccuaggucac

SEQ ID NO: 116441 - RNA, 23 nt, Human
uaucacccaggcuggagugcagu

SEQ ID NO: 116442 - RNA, 27 nt, Human
uggacuuuuucauuccuguuuuucuug

SEQ ID NO: 116443 - RNA, 26 nt, Human
ucuccuggcccuguguugaggguagc

SEQ ID NO: 116444 - RNA, 22 nt, Human
cuugcagaaagagguugcugca

SEQ ID NO: 116445 - RNA, 22 nt, Human
uugucucuucaucuaauaugau

SEQ ID NO: 116446 - RNA, 22 nt, Human
acuaaaauggucaacuuuucau

SEQ ID NO: 116447 - RNA, 24 nt, Human
uggccacagggagcagagguuugu

SEQ ID NO: 116448 - RNA, 21 nt, Human
gcaagagccaccauaccaguu

SEQ ID NO: 116449 - RNA, 21 nt, Human
ccaggugggaggcugugugug

SEQ ID NO: 116450 - RNA, 19 nt, Human
uuuccagucaauauuuaca

SEQ ID NO: 116451 - RNA, 27 nt, Human
uuuccacccucuuugagaucagcguuc

SEQ ID NO: 116452 - RNA, 22 nt, Human
uacauauauacacauauacaaa

SEQ ID NO: 116453 - RNA, 26 nt, Human
cugcucucccauuucucucuuguuug

SEQ ID NO: 116454 - RNA, 25 nt, Human
caccaggcuggagugcaguggcaug

SEQ ID NO: 116455 - RNA, 20 nt, Human
cgcagaucuucgggcggcua

SEQ ID NO: 116456 - RNA, 26 nt, Human
aaccuccuccuccuggauucaagcaa

SEQ ID NO: 116457 - RNA, 16 nt, Human
gacucuggcugagccc

SEQ ID NO: 116458 - RNA, 20 nt, Human
ggcgcggguuccugccucuc

SEQ ID NO: 116459 - RNA, 18 nt, Human
ccacaguguauauaacca

SEQ ID NO: 116460 - RNA, 21 nt, Human
accuguaaucccagaacuuug

SEQ ID NO: 116461 - RNA, 24 nt, Human
gggaaacuaagagacaguucucug

SEQ ID NO: 116462 - RNA, 20 nt, Human
uccgaguccuugcagcuggu

SEQ ID NO: 116463 - RNA, 22 nt, Human
auuuucccauuauaauagcauu

SEQ ID NO: 116464 - RNA, 27 nt, Human
ccaagccccacugaggccccuacugag

SEQ ID NO: 116465 - RNA, 22 nt, Human
gcuauaauccaaacguuuuacu

SEQ ID NO: 116466 - RNA, 27 nt, Human
cacugcccuucuucugaguggcauugg

SEQ ID NO: 116467 - RNA, 23 nt, Human
agcccuguaucaccccuggcagu

SEQ ID NO: 116468 - RNA, 24 nt, Human
cguuagcuuuaaucaaucaugccc

SEQ ID NO: 116469 - RNA, 21 nt, Human
ccuguaagcccagcacuuugg

SEQ ID NO: 116470 - RNA, 23 nt, Human
ccgcagcccccgacgccugggug

SEQ ID NO: 116471 - RNA, 21 nt, Human
uugcccaggcuggagugcauu

SEQ ID NO: 116472 - RNA, 19 nt, Human
aaaccagcaaacaccggga

SEQ ID NO: 116473 - RNA, 21 nt, Human
ccuuccuugaccuuccucugg

SEQ ID NO: 116474 - RNA, 20 nt, Human
uucaacauuccauccuuucc

SEQ ID NO: 116475 - RNA, 21 nt, Human
agaccugccccggggccaggu

SEQ ID NO: 116476 - RNA, 21 nt, Human
cuuuuauguauccaucccauc

SEQ ID NO: 116477 - RNA, 22 nt, Human
uuucgccaaggcuggagugcag

SEQ ID NO: 116478 - RNA, 22 nt, Human
ugcucccagccugcagucuuug

SEQ ID NO: 116479 - RNA, 27 nt, Human
uucugcucugcugacuggggaagucau

SEQ ID NO: 116480 - RNA, 26 nt, Human
cugguguguggguguucaguucugug

SEQ ID NO: 116481 - RNA, 23 nt, Human
caggacuggaggaacaaagguuu

SEQ ID NO: 116482 - RNA, 22 nt, Human
gcacaggaacuaaaggaaaaag

SEQ ID NO: 116483 - RNA, 28 nt, Human
gcgggccuaacauguugugccuggacca

SEQ ID NO: 116484 - RNA, 27 nt, Human
accaaugauauuuuucuuuguaauacu

SEQ ID NO: 116485 - RNA, 21 nt, Human
uguauuucuuccccuuacucu

SEQ ID NO: 116486 - RNA, 21 nt, Human
accagccuuuggguccugggc

SEQ ID NO: 116487 - RNA, 26 nt, Human
cccagcacuggagacccacggacuca

SEQ ID NO: 116488 - RNA, 20 nt, Human
ccuccuuucauuucuugccu

SEQ ID NO: 116489 - RNA, 20 nt, Human
gcuccuccccucuccccacc

SEQ ID NO: 116490 - RNA, 21 nt, Human
gcgaguccaggagcucaggaa

SEQ ID NO: 116491 - RNA, 24 nt, Human
ucuccaccugucucccauucugug

SEQ ID NO: 116492 - RNA, 25 nt, Human
ucuguugcccaggcuggaguucagc

SEQ ID NO: 116493 - RNA, 22 nt, Human
gcucacugcagcuucaaacucu

SEQ ID NO: 116494 - RNA, 21 nt, Human
ucuccagcgcagacuuuugcu

SEQ ID NO: 116495 - RNA, 26 nt, Human
ccuagccccaaaccagcccagagcag

SEQ ID NO: 116496 - RNA, 21 nt, Human
aggaauugcagagaaaugcau

SEQ ID NO: 116497 - RNA, 24 nt, Human
ccucaaaccacccaacuucaucca

SEQ ID NO: 116498 - RNA, 22 nt, Human
agggaaagaccgcaacucggac

SEQ ID NO: 116499 - RNA, 23 nt, Human
uuugucuuuuuguuguaaaacaa

SEQ ID NO: 116500 - RNA, 21 nt, Human
aaauguucucccaaagaugcu

SEQ ID NO: 116501 - RNA, 23 nt, Human
cacuugaaccugggagguggugg

SEQ ID NO: 116502 - RNA, 20 nt, Human
caggcagccuggugguaugg

SEQ ID NO: 116503 - RNA, 27 nt, Human
ggaggcugaucccugagauccuuggga

SEQ ID NO: 116504 - RNA, 22 nt, Human
auuuacuguaacuucuuaaucu

SEQ ID NO: 116505 - RNA, 26 nt, Human
caggccgcccuggcugagcagcaccg

SEQ ID NO: 116506 - RNA, 24 nt, Human
gcuugggcuccauucccaucacug

SEQ ID NO: 116507 - RNA, 28 nt, Human
augagaaagccaucucccagggccacca

SEQ ID NO: 116508 - RNA, 21 nt, Human
uugaagccugaaguugcuaag

SEQ ID NO: 116509 - RNA, 20 nt, Human
acauaguacauucaucacug

SEQ ID NO: 116510 - RNA, 21 nt, Human
gcagggagagaagauggcuua

SEQ ID NO: 116511 - RNA, 22 nt, Human
ggugaguuggcuuaccuggccc

SEQ ID NO: 116512 - RNA, 25 nt, Human
ggagaguaguaagacgugaaaggaa

SEQ ID NO: 116513 - RNA, 23 nt, Human
ucucccacacggacaccuucugg

SEQ ID NO: 116514 - RNA, 27 nt, Human
uuaccuccccuuccuccacccuaagcc

SEQ ID NO: 116515 - RNA, 24 nt, Human
ucugacuuuucuucugcucucucu

SEQ ID NO: 116516 - RNA, 20 nt, Human
aacaguuacggagggaggac

SEQ ID NO: 116517 - RNA, 21 nt, Human
gucucacuauguugcccaggc

SEQ ID NO: 116518 - RNA, 22 nt, Human
aucgcccaggcucaagugauuc

SEQ ID NO: 116519 - RNA, 22 nt, Human
gcucacugcaaccuccaccucc

SEQ ID NO: 116520 - RNA, 22 nt, Human
acucacugcaaccuccgccucc

SEQ ID NO: 116521 - RNA, 24 nt, Human
accggaccaccaacaguugugauu

SEQ ID NO: 116522 - RNA, 23 nt, Human
aguagcacauuaaagugauuuua

SEQ ID NO: 116523 - RNA, 26 nt, Human
uugggugaagagaaaggaaguacaga

SEQ ID NO: 116524 - RNA, 25 nt, Human
ggggcaccggcugcccacagggaac

SEQ ID NO: 116525 - RNA, 23 nt, Human
acgugggacacagggcuugggga

SEQ ID NO: 116526 - RNA, 22 nt, Human
cugaguagcugggaugacaggc

SEQ ID NO: 116527 - RNA, 21 nt, Human
ugucucucuggcucucuggca

SEQ ID NO: 116528 - RNA, 27 nt, Human
ucugcaaaccuuuaguuuucugaugau

SEQ ID NO: 116529 - RNA, 29 nt, Human
ccccugugccucuguccuagacuucccgg

SEQ ID NO: 116530 - RNA, 22 nt, Human
ccugucccuacccacucuuugc

SEQ ID NO: 116531 - RNA, 27 nt, Human
uggcaugcagugcccucacagagaccc

SEQ ID NO: 116532 - RNA, 21 nt, Human
uggccagcccuggauuuugga

SEQ ID NO: 116533 - RNA, 20 nt, Human
uggcaggcugacagaggcgg

SEQ ID NO: 116534 - RNA, 22 nt, Human
uuugaugucugugucagcuguc

SEQ ID NO: 116535 - RNA, 31 nt, Human
cucuccaucucucaccaaggcugcgucaaag

SEQ ID NO: 116536 - RNA, 25 nt, Human
cguacaccuaaucccauggggccuc

SEQ ID NO: 116537 - RNA, 20 nt, Human
aggcagccuggggaacgugg

SEQ ID NO: 116538 - RNA, 22 nt, Human
acagugcugggauuacaggcgu

SEQ ID NO: 116539 - RNA, 23 nt, Human
gguucuagggcagggauacuccu

SEQ ID NO: 116540 - RNA, 22 nt, Human
uugugccucuaagcaguggacc

SEQ ID NO: 116541 - RNA, 32 nt, Human
ggcagauuuguggggaccucagccugcacccu

SEQ ID NO: 116542 - RNA, 21 nt, Human
ccaaagccaagaaagaaaaau

SEQ ID NO: 116543 - RNA, 23 nt, Human
gcauuucgccaaucagaaucuca

SEQ ID NO: 116544 - RNA, 22 nt, Human
aguccucccuccccaaccuccu

SEQ ID NO: 116545 - RNA, 21 nt, Human
cugaccaccugcagccuguug

SEQ ID NO: 116546 - RNA, 26 nt, Human
cuguuucucugggcuccugagcauac

SEQ ID NO: 116547 - RNA, 25 nt, Human
cucacccugggagccaguccuccac

SEQ ID NO: 116548 - RNA, 19 nt, Human
ugugcaacagacaaaaagg

SEQ ID NO: 116549 - RNA, 20 nt, Human
aaagagacuguuuuggggga

SEQ ID NO: 116550 - RNA, 21 nt, Human
gucuuuuucuccucuaugaau

SEQ ID NO: 116551 - RNA, 22 nt, Human
cgccccggagggaggccgaggg

SEQ ID NO: 116552 - RNA, 27 nt, Human
cacaggcuggggacagagguggcccug

SEQ ID NO: 116553 - RNA, 27 nt, Human
uuguagccgggaaugcugcugcugcug

SEQ ID NO: 116554 - RNA, 21 nt, Human
uagccacgucuggccuguguc

SEQ ID NO: 116555 - RNA, 23 nt, Human
aacugauugugcagaauauucua

SEQ ID NO: 116556 - RNA, 23 nt, Human
gagaaaaaucacccccaaaggag

SEQ ID NO: 116557 - RNA, 27 nt, Human
ugcagugagcugagauugcaccacugc

SEQ ID NO: 116558 - RNA, 22 nt, Human
cuguaaucccagcuacauggga

SEQ ID NO: 116559 - RNA, 22 nt, Human
cagauuccugggcuuaagcagu

SEQ ID NO: 116560 - RNA, 25 nt, Human
uaggguggaaggggcccugggcgag

SEQ ID NO: 116561 - RNA, 22 nt, Human
guccaggugaacuacuaaagcu

SEQ ID NO: 116562 - RNA, 22 nt, Human
acuguaaccucugccucccagg

SEQ ID NO: 116563 - RNA, 21 nt, Human
cacugcccugugaggaagggu

SEQ ID NO: 116564 - RNA, 22 nt, Human
cggagaucgcaucauugcacuc

SEQ ID NO: 116565 - RNA, 22 nt, Human
ccacugcgcuccagccuggggg

SEQ ID NO: 116566 - RNA, 25 nt, Human
ucggccucaguuaagccuuugugga

SEQ ID NO: 116567 - RNA, 26 nt, Human
agggccucuuugggacuucagaggaa

SEQ ID NO: 116568 - RNA, 25 nt, Human
cuccuacgcucccuugccuuccuca

SEQ ID NO: 116569 - RNA, 20 nt, Human
ccccaggccucagcaaggca

SEQ ID NO: 116570 - RNA, 21 nt, Human
ucuucccagcccuaaacccug

SEQ ID NO: 116571 - RNA, 28 nt, Human
cacaguuguuucagaaagagcucuccag

SEQ ID NO: 116572 - RNA, 22 nt, Human
guauguauuuauuuacaugaga

SEQ ID NO: 116573 - RNA, 23 nt, Human
uaaaaauugaauaaccaugugaa

SEQ ID NO: 116574 - RNA, 25 nt, Human
aaguuggccugaaacccugaagcug

SEQ ID NO: 116575 - RNA, 20 nt, Human
ugugugcuccccucgcgacc

SEQ ID NO: 116576 - RNA, 23 nt, Human
gcccuuguccugggccauggccc

SEQ ID NO: 116577 - RNA, 25 nt, Human
cccucacuucccauacccagucuag

SEQ ID NO: 116578 - RNA, 21 nt, Human
aggaaggugccugcacaugag

SEQ ID NO: 116579 - RNA, 26 nt, Human
ccugucuccucggcggagccugcugc

SEQ ID NO: 116580 - RNA, 23 nt, Human
accacaacuugacaagguugcua

SEQ ID NO: 116581 - RNA, 23 nt, Human
gcccugucccuguugcuguggcc

SEQ ID NO: 116582 - RNA, 28 nt, Human
cuuugcugccagcucucaggaccgugcc

SEQ ID NO: 116583 - RNA, 27 nt, Human
gaggagggaggugcugugagccuagcg

SEQ ID NO: 116584 - RNA, 26 nt, Human
ggaggcggaggaggcuaguggcagua

SEQ ID NO: 116585 - RNA, 23 nt, Human
accacaccuggcuaauuuuuugu

SEQ ID NO: 116586 - RNA, 22 nt, Human
gcaagccuggcugacacaggug

SEQ ID NO: 116587 - RNA, 29 nt, Human
ucacccacacugccagccuggguuggggc

SEQ ID NO: 116588 - RNA, 21 nt, Human
uaguucuaaauuaacagcuua

SEQ ID NO: 116589 - RNA, 23 nt, Human
cacuggagaaaaggcaguaagaa

SEQ ID NO: 116590 - RNA, 23 nt, Human
gaucuaccccagggagaaucuga

SEQ ID NO: 116591 - RNA, 21 nt, Human
gggcucaccccccuccccagc

SEQ ID NO: 116592 - RNA, 23 nt, Human
gggagagaagaggagagggcuug

SEQ ID NO: 116593 - RNA, 23 nt, Human
accacacccggcuaauuuuuugu

SEQ ID NO: 116594 - RNA, 26 nt, Human
cacugccgcuccagccuuccuggcag

SEQ ID NO: 116595 - RNA, 23 nt, Human
acugauuucugaaucauguucua

SEQ ID NO: 116596 - RNA, 26 nt, Human
gggaccccuucuccacccucucccug

SEQ ID NO: 116597 - RNA, 21 nt, Human
uguuuuuaaaaagggagacua

SEQ ID NO: 116598 - RNA, 22 nt, Human
ccuccuccccucuccuugcacc

SEQ ID NO: 116599 - RNA, 24 nt, Human
gauucagagagacaauucacucca

SEQ ID NO: 116600 - RNA, 22 nt, Human
ucacugcagccuggaacuccug

SEQ ID NO: 116601 - RNA, 24 nt, Human
uggccucucauuuccuuacacucu

SEQ ID NO: 116602 - RNA, 24 nt, Human
ugaccucaagugauccaccugccu

SEQ ID NO: 116603 - RNA, 27 nt, Human
caaagagaugucuucugggagccacug

SEQ ID NO: 116604 - RNA, 30 nt, Human
gucucagaggcuggagagcagagcaccaag

SEQ ID NO: 116605 - RNA, 21 nt, Human
ucagcccagucccagcugagg

SEQ ID NO: 116606 - RNA, 24 nt, Human
augagucugcuccauccauguguc

SEQ ID NO: 116607 - RNA, 25 nt, Human
ccucauccccaaacuacuugaaaag

SEQ ID NO: 116608 - RNA, 21 nt, Human
agggagaagacacugcaguga

SEQ ID NO: 116609 - RNA, 24 nt, Human
ggccccagccaagggacacaucuc

SEQ ID NO: 116610 - RNA, 21 nt, Human
guuccgcccuccuguccauca

SEQ ID NO: 116611 - RNA, 18 nt, Human
caaaaauugcacugugug

SEQ ID NO: 116612 - RNA, 22 nt, Human
gucagccuacauaacacauuuu

SEQ ID NO: 116613 - RNA, 18 nt, Human
uugaggccaagggccaag

SEQ ID NO: 116614 - RNA, 21 nt, Human
ggauuacagguguaagccacu

SEQ ID NO: 116615 - RNA, 23 nt, Human
uucaauagaaagagucugaggca

SEQ ID NO: 116616 - RNA, 21 nt, Human
uaucuggcaacuuagcuuaag

SEQ ID NO: 116617 - RNA, 31 nt, Human
ggugggcauggaacaggaugggcagagaaag

SEQ ID NO: 116618 - RNA, 22 nt, Human
uguugcugcugcuuaaauauug

SEQ ID NO: 116619 - RNA, 22 nt, Human
cucauccccagccuccaccucc

SEQ ID NO: 116620 - RNA, 19 nt, Human
agauacuuaauucuugccu

SEQ ID NO: 116621 - RNA, 27 nt, Human
auccucucccacuuccaucuggcaucc

SEQ ID NO: 116622 - RNA, 22 nt, Human
aucucuugaacccgggaggugg

SEQ ID NO: 116623 - RNA, 21 nt, Human
aaccauugauuuaauguaaua

SEQ ID NO: 116624 - RNA, 20 nt, Human
guuucagaacccacuuuggg

SEQ ID NO: 116625 - RNA, 21 nt, Human
acucugugaggagugagggaa

SEQ ID NO: 116626 - RNA, 21 nt, Human
cucuugguucaguguggagaa

SEQ ID NO: 116627 - RNA, 26 nt, Human
agguagcuucagcuagcuuuuaggaa

SEQ ID NO: 116628 - RNA, 22 nt, Human
ugccaucuccccucguccugcg

SEQ ID NO: 116629 - RNA, 21 nt, Human
ugcagccucaaccuccugggc

SEQ ID NO: 116630 - RNA, 27 nt, Human
ccaggauaaaaggggaaauaacugccu

SEQ ID NO: 116631 - RNA, 20 nt, Human
uggaguagaaaccaaaugug

SEQ ID NO: 116632 - RNA, 24 nt, Human
cccuggcucccaugucaagagucg

SEQ ID NO: 116633 - RNA, 21 nt, Human
ucuuuaaacuauucagucuua

SEQ ID NO: 116634 - RNA, 22 nt, Human
ucauucagaucuuccuuccucc

SEQ ID NO: 116635 - RNA, 21 nt, Human
gccagguaaaauuuaacuggu

SEQ ID NO: 116636 - RNA, 27 nt, Human
uuauuccuaguggaugacuguugauga

SEQ ID NO: 116637 - RNA, 28 nt, Human
guucuuuuuaaguuaauagauuuuuuca

SEQ ID NO: 116638 - RNA, 24 nt, Human
gcucugaagcuaggacagcuggcu

SEQ ID NO: 116639 - RNA, 21 nt, Human
acaaacaaaaagagccagugg

SEQ ID NO: 116640 - RNA, 23 nt, Human
cgcugucccccaacacugagcaa

SEQ ID NO: 116641 - RNA, 27 nt, Human
ccccugccucugcccaagugggccagc

SEQ ID NO: 116642 - RNA, 23 nt, Human
uucuaaaugugucccaucaugcu

SEQ ID NO: 116643 - RNA, 27 nt, Human
cacugcacuccagccuggugacagcgu

SEQ ID NO: 116644 - RNA, 21 nt, Human
cuucccaaaucugcuccagca

SEQ ID NO: 116645 - RNA, 21 nt, Human
uucagugauuuuucugccucg

SEQ ID NO: 116646 - RNA, 20 nt, Human
cuagccguuugugccucguc

SEQ ID NO: 116647 - RNA, 17 nt, Human
uaucaucugauaguguc

SEQ ID NO: 116648 - RNA, 23 nt, Human
agggaaagacugggcggagagaa

SEQ ID NO: 116649 - RNA, 18 nt, Human
uugcccaggcuggaaugc

SEQ ID NO: 116650 - RNA, 26 nt, Human
uguuaauuuuguuauauguuuuuugu

SEQ ID NO: 116651 - RNA, 22 nt, Human
ggcuuacugcaaccuccgccuu

SEQ ID NO: 116652 - RNA, 20 nt, Human
guggccuuagguagcugguu

SEQ ID NO: 116653 - RNA, 21 nt, Human
aggccaccacaggcagggguc

SEQ ID NO: 116654 - RNA, 24 nt, Human
cuuaaaccugcuugcuuccuacca

SEQ ID NO: 116655 - RNA, 26 nt, Human
gggaggugggccaugcagcuaaccca

SEQ ID NO: 116656 - RNA, 24 nt, Human
cacucacugugucugaucugucuc

SEQ ID NO: 116657 - RNA, 24 nt, Human
aguuugcaguaugcuccacguggu

SEQ ID NO: 116658 - RNA, 26 nt, Human
aguuagguugucuccaggccaugaug

SEQ ID NO: 116659 - RNA, 24 nt, Human
cccucugauuuguucuguuccugu

SEQ ID NO: 116660 - RNA, 27 nt, Human
aagcugugcacgucuccuguucugguc

SEQ ID NO: 116661 - RNA, 23 nt, Human
ucagaucuuuucaggaguguaag

SEQ ID NO: 116662 - RNA, 20 nt, Human
uauuugcaagaaaucccacu

SEQ ID NO: 116663 - RNA, 24 nt, Human
ucaucccucucaaguauggcucag

SEQ ID NO: 116664 - RNA, 23 nt, Human
cuucccucagccucgccugcugu

SEQ ID NO: 116665 - RNA, 21 nt, Human
ugugagccaccacguggagcu

SEQ ID NO: 116666 - RNA, 27 nt, Human
uugcccaauuaauacuagggugcagug

SEQ ID NO: 116667 - RNA, 22 nt, Human
caagugcugggauuacaggcgc

SEQ ID NO: 116668 - RNA, 20 nt, Human
gaucaaauguauucagaugg

SEQ ID NO: 116669 - RNA, 22 nt, Human
uggucucucugcuugcuuggcc

SEQ ID NO: 116670 - RNA, 26 nt, Human
ugaaacugagcacauuucugaccauu

SEQ ID NO: 116671 - RNA, 22 nt, Human
ccuaaagugcugggaucacagg

SEQ ID NO: 116672 - RNA, 29 nt, Human
aagcccuuuagacccagagcccaaggacc

SEQ ID NO: 116673 - RNA, 23 nt, Human
cugagugagaggggaggccaaga

SEQ ID NO: 116674 - RNA, 21 nt, Human
caggaggcggagcuggcagug

SEQ ID NO: 116675 - RNA, 27 nt, Human
gugcaggugaggcaaagugcugggacu

SEQ ID NO: 116676 - RNA, 23 nt, Human
uuuaagugucugaaucgagugag

SEQ ID NO: 116677 - RNA, 25 nt, Human
ccgccagcccugccugcggaucccc

SEQ ID NO: 116678 - RNA, 27 nt, Human
cccagcacuugaauuguuauuacuuua

SEQ ID NO: 116679 - RNA, 31 nt, Human
cucucagagccucagcuucugggggagacau

SEQ ID NO: 116680 - RNA, 21 nt, Human
gcucugggaagaaaagcccgu

SEQ ID NO: 116681 - RNA, 19 nt, Human
guacugaaccacuagccua

SEQ ID NO: 116682 - RNA, 20 nt, Human
ggugggggacccugggcagg

SEQ ID NO: 116683 - RNA, 20 nt, Human
ugguagugccagugugacuc

SEQ ID NO: 116684 - RNA, 21 nt, Human
gguugcagagcuccaaguccu

SEQ ID NO: 116685 - RNA, 27 nt, Human
uguugcccaagcuggagugaaguggua

SEQ ID NO: 116686 - RNA, 26 nt, Human
cucucuggccccauccaggcaaccaa

SEQ ID NO: 116687 - RNA, 20 nt, Human
ucucuggaguguaagcacaa

SEQ ID NO: 116688 - RNA, 22 nt, Human
ucugucgcccaggcuggagggc

SEQ ID NO: 116689 - RNA, 19 nt, Human
aguuccuuaguugcuuuau

SEQ ID NO: 116690 - RNA, 25 nt, Human
ccaguuuuaagaggagccacuuauc

SEQ ID NO: 116691 - RNA, 20 nt, Human
gcacagcccacggacgccac

SEQ ID NO: 116692 - RNA, 27 nt, Human
caccugagaguaguauaguagugcaaa

SEQ ID NO: 116693 - RNA, 22 nt, Human
acuuuauguagagaaaaggagg

SEQ ID NO: 116694 - RNA, 25 nt, Human
ggccauccaauuucucuuuacuuga

SEQ ID NO: 116695 - RNA, 25 nt, Human
ccggaggccacacaaauggucucca

SEQ ID NO: 116696 - RNA, 22 nt, Human
uuugacacccaggcuggagugc

SEQ ID NO: 116697 - RNA, 26 nt, Human
gacauuuuuagcuucucuccucccca

SEQ ID NO: 116698 - RNA, 22 nt, Human
ugguguacgccuguaaucccag

SEQ ID NO: 116699 - RNA, 28 nt, Human
gcgauggggacacagaaggucaccccag

SEQ ID NO: 116700 - RNA, 22 nt, Human
ggggaagagaugguugcaggca

SEQ ID NO: 116701 - RNA, 22 nt, Human
gcagggccguaugcauccugcc

SEQ ID NO: 116702 - RNA, 22 nt, Human
uggcacaugccuguaaucgcag

SEQ ID NO: 116703 - RNA, 25 nt, Human
gguugggacuggagguuguauaagg

SEQ ID NO: 116704 - RNA, 25 nt, Human
ccaacugcuccaaucugccuccuuc

SEQ ID NO: 116705 - RNA, 21 nt, Human
aaagggccuugacaucaguuc

SEQ ID NO: 116706 - RNA, 21 nt, Human
uccaauaacaggucaacuuca

SEQ ID NO: 116707 - RNA, 25 nt, Human
guucaucaccauuuccuccuuuacc

SEQ ID NO: 116708 - RNA, 22 nt, Human
cauggugauaugcacuauauuc

SEQ ID NO: 116709 - RNA, 26 nt, Human
gaggcagcagcugaggcccuguccaa

SEQ ID NO: 116710 - RNA, 23 nt, Human
ggcggcaccagcaccuucgcuuu

SEQ ID NO: 116711 - RNA, 23 nt, Human
uggagccaaguccagauuuacac

SEQ ID NO: 116712 - RNA, 20 nt, Human
auuuuuguuuuuggcugaag

SEQ ID NO: 116713 - RNA, 21 nt, Human
gacucugguagcaugauggcu

SEQ ID NO: 116714 - RNA, 23 nt, Human
cuccaaaucggacguucuuucua

SEQ ID NO: 116715 - RNA, 21 nt, Human
gcucacugcagcuucaaacuc

SEQ ID NO: 116716 - RNA, 27 nt, Human
gaagaaaagaagaaaaaaccaagcuua

SEQ ID NO: 116717 - RNA, 29 nt, Human
uacacuggaacaccuucuucuuuuuguca

SEQ ID NO: 116718 - RNA, 19 nt, Human
ggcuuccuaucccaccaau

SEQ ID NO: 116719 - RNA, 24 nt, Human
uuuauauaacauaguaagauuuca

SEQ ID NO: 116720 - RNA, 28 nt, Human
cuccauggcccaauucgguuucuucggu

SEQ ID NO: 116721 - RNA, 20 nt, Human
guugcagaaacugugucaga

SEQ ID NO: 116722 - RNA, 23 nt, Human
gcaaaaacugcaacucuguguuu

SEQ ID NO: 116723 - RNA, 27 nt, Human
ucagcacaccggcauccccaccugcug

SEQ ID NO: 116724 - RNA, 27 nt, Human
uuauuaaaaauacagguacuuugaccu

SEQ ID NO: 116725 - RNA, 25 nt, Human
gccuuaaguaaacaaacaagaaaug

SEQ ID NO: 116726 - RNA, 22 nt, Human
uugccuaggcuggcgucgagac

SEQ ID NO: 116727 - RNA, 23 nt, Human
ggaugggaugaagcacagaguaa

SEQ ID NO: 116728 - RNA, 26 nt, Human
aaauacaccugucacuaccagaacca

SEQ ID NO: 116729 - RNA, 25 nt, Human
agauucucguguaacacuuguugcu

SEQ ID NO: 116730 - RNA, 22 nt, Human
uuuccaaagaccccaguauuug

SEQ ID NO: 116731 - RNA, 22 nt, Human
ggagcuggcauggugguacaga

SEQ ID NO: 116732 - RNA, 23 nt, Human
uccagugagcucuggaugaagcu

SEQ ID NO: 116733 - RNA, 24 nt, Human
ugcgugaccuugggcaaguuacuu

SEQ ID NO: 116734 - RNA, 18 nt, Human
aagcuuuggaagagauua

SEQ ID NO: 116735 - RNA, 22 nt, Human
uuagaugaaacugcaaaguguu

SEQ ID NO: 116736 - RNA, 21 nt, Human
cuggcugucagcugugguucu

SEQ ID NO: 116737 - RNA, 24 nt, Human
gcuugguuccuugccuccuucugg

SEQ ID NO: 116738 - RNA, 25 nt, Human
agccuccugaguagcugggcugaca

SEQ ID NO: 116739 - RNA, 23 nt, Human
ggaaaguuugcugaagaggaucu

SEQ ID NO: 116740 - RNA, 19 nt, Human
acuuugagagagguuuucu

SEQ ID NO: 116741 - RNA, 27 nt, Human
gaccagccucggcaacauggcaaaauc

SEQ ID NO: 116742 - RNA, 22 nt, Human
uuaccuaaaagaaaccaaaaau

SEQ ID NO: 116743 - RNA, 23 nt, Human
gcacugcggggcuuuucugcaau

SEQ ID NO: 116744 - RNA, 20 nt, Human
gcugaugaaguuaagcacaa

SEQ ID NO: 116745 - RNA, 22 nt, Human
ggacccagguuccaggggcgca

SEQ ID NO: 116746 - RNA, 22 nt, Human
auacagucaacuuacggugcac

SEQ ID NO: 116747 - RNA, 21 nt, Human
auuucugcucuucaggaaauu

SEQ ID NO: 116748 - RNA, 19 nt, Human
gggguggcagcgggcagug

SEQ ID NO: 116749 - RNA, 22 nt, Human
uugcagaaaacaccggucccug

SEQ ID NO: 116750 - RNA, 22 nt, Human
cgucgcccaggcuggaaugcag

SEQ ID NO: 116751 - RNA, 24 nt, Human
uauccagauaauccugaacacugu

SEQ ID NO: 116752 - RNA, 23 nt, Human
cgcacaccccugcuccggcucac

SEQ ID NO: 116753 - RNA, 21 nt, Human
ggcucacuuucaaucaguuaa

SEQ ID NO: 116754 - RNA, 25 nt, Human
auuccugucuccuggacucuccugg

SEQ ID NO: 116755 - RNA, 21 nt, Human
caaaucaaaauaaaagaaaua

SEQ ID NO: 116756 - RNA, 24 nt, Human
gagucggauuaccaaaacacugcc

SEQ ID NO: 116757 - RNA, 31 nt, Human; identical to SEQ ID NO: 7471

SEQ ID NO: 116758 - RNA, 21 nt, Human
ggagguugagaaugcagugag

SEQ ID NO: 116759 - RNA, 21 nt, Human
aaaaguguccagugacaggga

SEQ ID NO: 116760 - RNA, 22 nt, Human
cagcccaggcuuuugcuagaug

SEQ ID NO: 116761 - RNA, 22 nt, Human
ccacagccacauuagugaaccu

SEQ ID NO: 116762 - RNA, 22 nt, Human
cugaggcaggagaaucgcuuga

SEQ ID NO: 116763 - RNA, 22 nt, Human
cugaggcaggaggaucgcuuaa

SEQ ID NO: 116764 - RNA, 27 nt, Human
caggcuggaguguaguggugugaucuc

SEQ ID NO: 116765 - RNA, 20 nt, Human
uacgggaagaggcagaggga

SEQ ID NO: 116766 - RNA, 22 nt, Human
ccaagcuacaggugggguggga

SEQ ID NO: 116767 - RNA, 24 nt, Human
uagcggcuuuguggagggaacacu

SEQ ID NO: 116768 - RNA, 19 nt, Human
gaccgcggagaagugcaaa

SEQ ID NO: 116769 - RNA, 24 nt, Human
aauuggagcacaggaauguuaaca

SEQ ID NO: 116770 - RNA, 25 nt, Human
gccucuucuccugccucauucccug

SEQ ID NO: 116771 - RNA, 22 nt, Human
cucaccccacgagcuuucacaa

SEQ ID NO: 116772 - RNA, 21 nt, Human
cauccaggcugggaggggaag

SEQ ID NO: 116773 - RNA, 20 nt, Human
ugugagccaagaucaugcca

SEQ ID NO: 116774 - RNA, 26 nt, Human
cuuucauagccuuccauuuuauuggc

SEQ ID NO: 116775 - RNA, 27 nt, Human
ucucuugugaccacaauuaucuugccu

SEQ ID NO: 116776 - RNA, 24 nt, Human
cuccucuccuccccuugcccucaa

SEQ ID NO: 116777 - RNA, 22 nt, Human
cuuuccuuaccucuaugugcca

SEQ ID NO: 116778 - RNA, 22 nt, Human
agccacagcucagagacuggga

SEQ ID NO: 116779 - RNA, 22 nt, Human
cugagaggucaagguugcagug

SEQ ID NO: 116780 - RNA, 27 nt, Human
acucaauaaauggugauuguuauuauc

SEQ ID NO: 116781 - RNA, 26 nt, Human
gcagggcugaggccuggggguaggag

SEQ ID NO: 116782 - RNA, 32 nt, Human
ugccauaggguccugaauguuucagaccacaa

SEQ ID NO: 116783 - RNA, 25 nt, Human
uuucugcauguuugucugugugucu

SEQ ID NO: 116784 - RNA, 27 nt, Human
aguucauccauggugccauguuaaaga

SEQ ID NO: 116785 - RNA, 22 nt, Human
ggaggagggagguugugguugg

SEQ ID NO: 116786 - RNA, 22 nt, Human
gcgcuggccuggcuggccgugg

SEQ ID NO: 116787 - RNA, 20 nt, Human
uggucacugaaaugagccug

SEQ ID NO: 116788 - RNA, 21 nt, Human
guggccuugaaguggcugaag

SEQ ID NO: 116789 - RNA, 26 nt, Human
ucgcucuguuguccaggcuggagugc

SEQ ID NO: 116790 - RNA, 24 nt, Human
auugauacaaggcugcugaggccu

SEQ ID NO: 116791 - RNA, 22 nt, Human
ggacccggcaccccaccugcau

SEQ ID NO: 116792 - RNA, 19 nt, Human
ucuaaaccuuacaugugua

SEQ ID NO: 116793 - RNA, 26 nt, Human
gggucugagaucggcccagcucugac

SEQ ID NO: 116794 - RNA, 25 nt, Human
uccccuacucccucuucacuguggc

SEQ ID NO: 116795 - RNA, 21 nt, Human
cgggagguggagauugcagug

SEQ ID NO: 116796 - RNA, 27 nt, Human
auaaagugaauguucaacaacaaugau

SEQ ID NO: 116797 - RNA, 22 nt, Human
auaauagcuaaugaaagaggcu

SEQ ID NO: 116798 - RNA, 26 nt, Human
ucuccaggagacucagggccugccag

SEQ ID NO: 116799 - RNA, 22 nt, Human
gccuguaauucuagcacuuugg

SEQ ID NO: 116800 - RNA, 22 nt, Human
gccuguaauccuagcaccuugg

SEQ ID NO: 116801 - RNA, 23 nt, Human
ugucacccaggcuguggugcagu

SEQ ID NO: 116802 - RNA, 27 nt, Human
ggcagucugucauuuuucuagcauuuu

SEQ ID NO: 116803 - RNA, 18 nt, Human
gacuguagaugcauuuua

SEQ ID NO: 116804 - RNA, 22 nt, Human
uucaugagaaaaaaucccaaga

SEQ ID NO: 116805 - RNA, 20 nt, Human
uguaauaaauguuaaagcca

SEQ ID NO: 116806 - RNA, 23 nt, Human
uuguucugcucauuguguuugug

SEQ ID NO: 116807 - RNA, 21 nt, Human
cauacguguucacaggcagag

SEQ ID NO: 116808 - RNA, 20 nt, Human
ucugggacuagaggccagga

SEQ ID NO: 116809 - RNA, 20 nt, Human
cucucugcucuguucuuguc

SEQ ID NO: 116810 - RNA, 28 nt, Human
gagccccaaacuccucggccucacuggg

SEQ ID NO: 116811 - RNA, 19 nt, Human
cuugcagaaucaccacacg

SEQ ID NO: 116812 - RNA, 30 nt, Human
gcccgcugaguggacuggaguggagcauug

SEQ ID NO: 116813 - RNA, 28 nt, Human
ggagugaaggcggagggagccugcuaca

SEQ ID NO: 116814 - RNA, 26 nt, Human
ccagccuggcuaagggaaccauuuca

SEQ ID NO: 116815 - RNA, 25 nt, Human
uuuucacagugccagccucuaccua

SEQ ID NO: 116816 - RNA, 28 nt, Human
ggaagggaggcggccucuggccccgacc

SEQ ID NO: 116817 - RNA, 23 nt, Human
aagagaucaguucuaaccugcuc

SEQ ID NO: 116818 - RNA, 21 nt, Human
gugacuucacccuagaagagg

SEQ ID NO: 116819 - RNA, 23 nt, Human
ucacgugagauggggagucagcc

SEQ ID NO: 116820 - RNA, 23 nt, Human
ggucuuggauugucugaccucag

SEQ ID NO: 116821 - RNA, 24 nt, Human
uaccuccaggguucaauagaaauc

SEQ ID NO: 116822 - RNA, 26 nt, Human
gauggccauccacaaagccuugguga

SEQ ID NO: 116823 - RNA, 26 nt, Human
ugugggaggggacgggcgggacgagc

SEQ ID NO: 116824 - RNA, 22 nt, Human
gcuuggauuuuauuagugcaaa

SEQ ID NO: 116825 - RNA, 23 nt, Human
acucaggauuuaaaaacuggaac

SEQ ID NO: 116826 - RNA, 24 nt, Human
gucauccaggcuggacaguucagu

SEQ ID NO: 116827 - RNA, 19 nt, Human
uuccaaaaguagauuuccu

SEQ ID NO: 116828 - RNA, 23 nt, Human
uucuggcuauuuuuuguuguuug

SEQ ID NO: 116829 - RNA, 23 nt, Human
cccugcaccuggccagaguguca

SEQ ID NO: 116830 - RNA, 21 nt, Human
cacuggugaugaccuaggcag

SEQ ID NO: 116831 - RNA, 25 nt, Human
ccuucucccuggagcggccgacaau

SEQ ID NO: 116832 - RNA, 25 nt, Human
auggggguagugagcaaaucugccc

SEQ ID NO: 116833 - RNA, 24 nt, Human
gucaucugguguuuguacuauaac

SEQ ID NO: 116834 - RNA, 22 nt, Human
uugcccaagguaaacaguuuga

SEQ ID NO: 116835 - RNA, 30 nt, Human
cacauucuacuugauuuacacuuccuaguc

SEQ ID NO: 116836 - RNA, 20 nt, Human
gcuagggaaaacagugcaaa

SEQ ID NO: 116837 - RNA, 22 nt, Human
ugggggaggcaguggcggcugg

SEQ ID NO: 116838 - RNA, 17 nt, Human
aguuaacagaacacuga

SEQ ID NO: 116839 - RNA, 22 nt, Human
agcgcugggcuggugugcagug

SEQ ID NO: 116840 - RNA, 20 nt, Human
aacuuucccuguucagagca

SEQ ID NO: 116841 - RNA, 23 nt, Human
aagauucaguucaagguccugaa

SEQ ID NO: 116842 - RNA, 25 nt, Human
cgguuucagcucccagccuccaccc

SEQ ID NO: 116843 - RNA, 23 nt, Human
ugcucaguguucaaaaccacagc

SEQ ID NO: 116844 - RNA, 23 nt, Human
cauuucaucuucucccuccaucc

SEQ ID NO: 116845 - RNA, 21 nt, Human
ucauauacauuaaguugagcc

SEQ ID NO: 116846 - RNA, 24 nt, Human
ccucuuaagacaacuccuguggca

SEQ ID NO: 116847 - RNA, 26 nt, Human
uuuaggacacauuuagaugcacuacc

SEQ ID NO: 116848 - RNA, 22 nt, Human
augcacauauagacacauacac

SEQ ID NO: 116849 - RNA, 20 nt, Human
gacuccaagguugacuuuag

SEQ ID NO: 116850 - RNA, 25 nt, Human
gacuucagaauugggaacuaaacca

SEQ ID NO: 116851 - RNA, 26 nt, Human
ucaccgccucagcuuccugaagugcu

SEQ ID NO: 116852 - RNA, 20 nt, Human
acuuauucaacaaguuuacc

SEQ ID NO: 116853 - RNA, 21 nt, Human
uccuuuaggaucucaggcuuc

SEQ ID NO: 116854 - RNA, 21 nt, Human
gccagugcacuccggccuggg

SEQ ID NO: 116855 - RNA, 26 nt, Human
ccuuguaucuucuccccuucugagcc

SEQ ID NO: 116856 - RNA, 28 nt, Human
aaagaaugccucagccagaugggaauac

SEQ ID NO: 116857 - RNA, 23 nt, Human
cgaguggcugggauuagcggcau

SEQ ID NO: 116858 - RNA, 20 nt, Human
gacugucucaaaacaaaaca

SEQ ID NO: 116859 - RNA, 22 nt, Human
uguggggccggcggggagcagc

SEQ ID NO: 116860 - RNA, 24 nt, Human
acccaggcggcagagguugcagug

SEQ ID NO: 116861 - RNA, 23 nt, Human
ccucagacuagcuuucagucuuc

SEQ ID NO: 116862 - RNA, 23 nt, Human
aucaugccacugcacuccacucu

SEQ ID NO: 116863 - RNA, 26 nt, Human
ggcagaggugaaggacauggagcagc

SEQ ID NO: 116864 - RNA, 30 nt, Human
ggagggcagggagagcaaggggcaaggucc

SEQ ID NO: 116865 - RNA, 23 nt, Human
gggggcgcccaggaggggugggg

SEQ ID NO: 116866 - RNA, 22 nt, Human
caagugcugggauuacaggcgu

SEQ ID NO: 116867 - RNA, 22 nt, Human
aggcucuggcccuugccuuugu

SEQ ID NO: 116868 - RNA, 23 nt, Human
uagagacggggcuucaccaucuu

SEQ ID NO: 116869 - RNA, 23 nt, Human
ugccuguagucccagcuacuucg

SEQ ID NO: 116870 - RNA, 27 nt, Human
cugguucaagcaauucuccugccucag

SEQ ID NO: 116871 - RNA, 23 nt, Human
ccuagauuuuugggaaaaaacuu

SEQ ID NO: 116872 - RNA, 21 nt, Human
uccucgggcucuucuggaccu

SEQ ID NO: 116873 - RNA, 22 nt, Human
caguaugggcuacacagcagcu

SEQ ID NO: 116874 - RNA, 26 nt, Human
ccuaacagagccucaacaacuaccug

SEQ ID NO: 116875 - RNA, 21 nt, Human
uuucccccucuccugguuucc

SEQ ID NO: 116876 - RNA, 26 nt, Human
gguaaucagcaaaaugguccuguggc

SEQ ID NO: 116877 - RNA, 22 nt, Human
uggagaacacuggacagcugaa

SEQ ID NO: 116878 - RNA, 24 nt, Human
gcucacccaccucuugugcaaggu

SEQ ID NO: 116879 - RNA, 30 nt, Human
cccugcacuaaagccagccugaccuuccuu

SEQ ID NO: 116880 - RNA, 27 nt, Human
caagccauuuucagaucagaacuccag

SEQ ID NO: 116881 - RNA, 22 nt, Human
gaucagcuuuacagauacaucg

SEQ ID NO: 116882 - RNA, 19 nt, Human
gccagcggccuacgcccag

SEQ ID NO: 116883 - RNA, 22 nt, Human
ucacccuggccauguguacuga

SEQ ID NO: 116884 - RNA, 20 nt, Human
caaaacaagacaaaugggga

SEQ ID NO: 116885 - RNA, 22 nt, Human
cucugccaggggugagguucuu

SEQ ID NO: 116886 - RNA, 22 nt, Human
ugaaaugcuaugucauuucaug

SEQ ID NO: 116887 - RNA, 23 nt, Human
ugccuagcuuuacgaauauugcu

SEQ ID NO: 116888 - RNA, 27 nt, Human
gcugacugugccuguucugagugagcc

SEQ ID NO: 116889 - RNA, 25 nt, Human
ggcuacuucuccccuccucuugccu

SEQ ID NO: 116890 - RNA, 22 nt, Human
aaacuccugaccucaggcaauc

SEQ ID NO: 116891 - RNA, 20 nt, Human
gaauuacaaaugagaagagu

SEQ ID NO: 116892 - RNA, 20 nt, Human
ggauuucagaaagagccaag

SEQ ID NO: 116893 - RNA, 24 nt, Human
acacuaauuaaaaaacaacuugua

SEQ ID NO: 116894 - RNA, 26 nt, Human
aagaucuugccucuuuccuccucaug

SEQ ID NO: 116895 - RNA, 21 nt, Human
gcuacaaaagaaacugucacu

SEQ ID NO: 116896 - RNA, 27 nt, Human
ccauggcaggucgcuccugcaguauua

SEQ ID NO: 116897 - RNA, 14 nt, Human
uccugagaucauug

SEQ ID NO: 116898 - RNA, 20 nt, Human
ugcccaggcucacuucagug

SEQ ID NO: 116899 - RNA, 21 nt, Human
cccacauuuuaauuuagcaug

SEQ ID NO: 116900 - RNA, 26 nt, Human
uaccuugccucuuauuccugcuacag

SEQ ID NO: 116901 - RNA, 21 nt, Human
gccuguaauccuaacacuuug

SEQ ID NO: 116902 - RNA, 22 nt, Human
cggucuucaaaggaaaagccug

SEQ ID NO: 116903 - RNA, 23 nt, Human
agaaauguuguucauuauuggag

SEQ ID NO: 116904 - RNA, 25 nt, Human
auauguauauuuaacuuuguauagc

SEQ ID NO: 116905 - RNA, 24 nt, Human
uacaguguuguccaucuuaguaaa

SEQ ID NO: 116906 - RNA, 27 nt, Human
cuuuugacuggggacuugcugguugaa

SEQ ID NO: 116907 - RNA, 22 nt, Human
ccagcccacacuagccugggug

SEQ ID NO: 116908 - RNA, 25 nt, Human
cauagaacuuuucuaagagaagaca

SEQ ID NO: 116909 - RNA, 27 nt, Human
gccacgaaugaguaacuccugucacca

SEQ ID NO: 116910 - RNA, 23 nt, Human
cacacacacgcacugcccuguca

SEQ ID NO: 116911 - RNA, 19 nt, Human
uuccacccuccugucugcu

SEQ ID NO: 116912 - RNA, 22 nt, Human
ccgagaucgcgccacugcacuc

SEQ ID NO: 116913 - RNA, 20 nt, Human
ccccacugcugucauuguca

SEQ ID NO: 116914 - RNA, 24 nt, Human
ggccucauccagggcccagcgguc

SEQ ID NO: 116915 - RNA, 26 nt, Human
uccggaggcugaggcaggagaaucgc

SEQ ID NO: 116916 - RNA, 25 nt, Human
gccgcugcuuccucuaccccuguau

SEQ ID NO: 116917 - RNA, 27 nt, Human
uguuuuuaaaagcauauguguguuucc

SEQ ID NO: 116918 - RNA, 20 nt, Human
cccucuguugcccaggcugg

SEQ ID NO: 116919 - RNA, 21 nt, Human
gccuuauguguuacauuauuc

SEQ ID NO: 116920 - RNA, 21 nt, Human
ugcaaaacacguuuuagauag

SEQ ID NO: 116921 - RNA, 22 nt, Human
gccccuggcuaggggcagaggg

SEQ ID NO: 116922 - RNA, 21 nt, Human
uguauaugaaucaaaacaaac

SEQ ID NO: 116923 - RNA, 20 nt, Human
uacugcugaaagaugagcag

SEQ ID NO: 116924 - RNA, 27 nt, Human
ucucacuccccagccugggcccaucuc

SEQ ID NO: 116925 - RNA, 24 nt, Human
ucuccccucagccucuccccugcc

SEQ ID NO: 116926 - RNA, 21 nt, Human
ccagaugcaagacacugugcc

SEQ ID NO: 116927 - RNA, 21 nt, Human
ggcucucugcaaccucugucu

SEQ ID NO: 116928 - RNA, 24 nt, Human
ccaauaaacuucauuucucuggca

SEQ ID NO: 116929 - RNA, 24 nt, Human
gcggucugaggccccugcccagcu

SEQ ID NO: 116930 - RNA, 27 nt, Human
gggcccugugguuggacuucaccucuc

SEQ ID NO: 116931 - RNA, 19 nt, Human
gcaucauccucaucauguu

SEQ ID NO: 116932 - RNA, 21 nt, Human
cuuggcuuucucauccagaaa

SEQ ID NO: 116933 - RNA, 26 nt, Human
agucucagucgcccaggcuggagugc

SEQ ID NO: 116934 - RNA, 22 nt, Human
agcaaccucggcgcccaggguc

SEQ ID NO: 116935 - RNA, 27 nt, Human
uucacaguauucaguuuucucaccucu

SEQ ID NO: 116936 - RNA, 25 nt, Human
ggccuggaaggaaccucuuaaaauc

SEQ ID NO: 116937 - RNA, 22 nt, Human
ugugcauaguuacucaguuuuu

SEQ ID NO: 116938 - RNA, 26 nt, Human
uugcucugucacccaggcuggaguac

SEQ ID NO: 116939 - RNA, 27 nt, Human
gugcugaaaucucagcaugaaagcauu

SEQ ID NO: 116940 - RNA, 21 nt, Human
ugauucucucccaaagaaaga

SEQ ID NO: 116941 - RNA, 23 nt, Human
ggaagaaagggagagagggccag

SEQ ID NO: 116942 - RNA, 21 nt, Human
cuuggagcuguccuccagagg

SEQ ID NO: 116943 - RNA, 18 nt, Human
gcgccugccccacacccu

SEQ ID NO: 116944 - RNA, 27 nt, Human
caggaagggaaggggggucagaagaga

SEQ ID NO: 116945 - RNA, 21 nt, Human
gcggcugucuugccucuuguc

SEQ ID NO: 116946 - RNA, 20 nt, Human
aagaaagagaggaaugcagg

SEQ ID NO: 116947 - RNA, 22 nt, Human
ugucucccaggcuggagugcaa

SEQ ID NO: 116948 - RNA, 22 nt, Human
ugucacccaggcuggagugcua

SEQ ID NO: 116949 - RNA, 19 nt, Human
ucuucuuauacccuaaaac

SEQ ID NO: 116950 - RNA, 19 nt, Human
caaccugaaauuuauucac

SEQ ID NO: 116951 - RNA, 30 nt, Human
uggcaucuuagaacccucccuacucccaua

SEQ ID NO: 116952 - RNA, 20 nt, Human
cuacuucuccagccuagagg

SEQ ID NO: 116953 - RNA, 22 nt, Human
cucauucauggggaaaggcagc

SEQ ID NO: 116954 - RNA, 22 nt, Human
guacauuuccacaaaucuaaga

SEQ ID NO: 116955 - RNA, 20 nt, Human
uuauucuccucuauccacag

SEQ ID NO: 116956 - RNA, 20 nt, Human
caggcggcaggcguggugca

SEQ ID NO: 116957 - RNA, 21 nt, Human
guuuuuaaaagauaaagacug

SEQ ID NO: 116958 - RNA, 22 nt, Human
cuggcugcugaucgccuucccc

SEQ ID NO: 116959 - RNA, 22 nt, Human
gaggcaguuccuuccaggugau

SEQ ID NO: 116960 - RNA, 21 nt, Human
ccuccaggaagaccagacucc

SEQ ID NO: 116961 - RNA, 22 nt, Human
aggagcagggaagagcaguaga

SEQ ID NO: 116962 - RNA, 20 nt, Human
uuaauucuguuacacaauau

SEQ ID NO: 116963 - RNA, 23 nt, Human
gcuagaaauaacagcaucuaaag

SEQ ID NO: 116964 - RNA, 26 nt, Human
gggacaccucagaaaacuuauuaaca

SEQ ID NO: 116965 - RNA, 21 nt, Human
auuuugaagaaaacacaacau

SEQ ID NO: 116966 - RNA, 25 nt, Human
uuauucucucgaagagcaacuuacg

SEQ ID NO: 116967 - RNA, 26 nt, Human
guuacccucccuuccucacauuguua

SEQ ID NO: 116968 - RNA, 27 nt, Human
acucagggguucugaaaggcaguuuga

SEQ ID NO: 116969 - RNA, 22 nt, Human
cgggggugccugggagccugga

SEQ ID NO: 116970 - RNA, 16 nt, Human
ggccucggcuacuugg

SEQ ID NO: 116971 - RNA, 20 nt, Human
aggaccacuucucuucaucu

SEQ ID NO: 116972 - RNA, 22 nt, Human
aacaacuagaaggagagagcca

SEQ ID NO: 116973 - RNA, 20 nt, Human
gcugaggcuccuguuaaauu

SEQ ID NO: 116974 - RNA, 25 nt, Human
caguuucagccuuccaugugcugcc

SEQ ID NO: 116975 - RNA, 24 nt, Human
cgacauccuucuccucaggucuuc

SEQ ID NO: 116976 - RNA, 27 nt, Human
ugccccuccuggagcagaaagugccuu

SEQ ID NO: 116977 - RNA, 28 nt, Human
acaggcaaggggguugcaguggccgccu

SEQ ID NO: 116978 - RNA, 27 nt, Human
uugcacagucggcugggcggugcaaug

SEQ ID NO: 116979 - RNA, 27 nt, Human
ggagaggggcgggaccuggagagaggc

SEQ ID NO: 116980 - RNA, 32 nt, Human
ccaccaucagucacgucacuccugggacugag

SEQ ID NO: 116981 - RNA, 17 nt, Human
uugaaauuuugcaccag

SEQ ID NO: 116982 - RNA, 24 nt, Human
ggccaucugcacuuuucccaaggc

SEQ ID NO: 116983 - RNA, 21 nt, Human
cuccuacgggggcagcacacu

SEQ ID NO: 116984 - RNA, 19 nt, Human
auacauacaccagcauucc

SEQ ID NO: 116985 - RNA, 23 nt, Human
gagcgugccucagguuacuugaa

SEQ ID NO: 116986 - RNA, 20 nt, Human
aaauacgagauaacugcaaa

SEQ ID NO: 116987 - RNA, 27 nt, Human
uugccuuuccaccugcuuucuccuggg

SEQ ID NO: 116988 - RNA, 23 nt, Human
uccuaaaacaugaaaauuaucuc

SEQ ID NO: 116989 - RNA, 28 nt, Human
caccuggaggcuggagccaggggccacu

SEQ ID NO: 116990 - RNA, 21 nt, Human
uugggauaguguucugcuccu

SEQ ID NO: 116991 - RNA, 25 nt, Human
gggaggaagugaggaagggucaagg

SEQ ID NO: 116992 - RNA, 24 nt, Human
auaacaagcauagacaaaugagug

SEQ ID NO: 116993 - RNA, 15 nt, Human
cugcagcuguguguc

SEQ ID NO: 116994 - RNA, 21 nt, Human
cauuaccuagauggcaccucc

SEQ ID NO: 116995 - RNA, 27 nt, Human
uaccaugucgcacacuuuguuaaugac

SEQ ID NO: 116996 - RNA, 21 nt, Human
ggggcuugagggguggggaau

SEQ ID NO: 116997 - RNA, 27 nt, Human
cagucucuggcaguucuggaauggaag

SEQ ID NO: 116998 - RNA, 14 nt, Human
accaaaaugccugu

SEQ ID NO: 116999 - RNA, 24 nt, Human
ccugacuaugcuuucucuccuagg

SEQ ID NO: 117000 - RNA, 23 nt, Human
cuccacugcccaauagugaccuc

SEQ ID NO: 117001 - RNA, 20 nt, Human
ucccaccagccuccuuuuua

SEQ ID NO: 117002 - RNA, 20 nt, Human
uucuguauuccagacuuggg

SEQ ID NO: 117003 - RNA, 22 nt, Human
ucuccugcccucuccugaucua

SEQ ID NO: 117004 - RNA, 19 nt, Human
aacuguaucaccuuugcca

SEQ ID NO: 117005 - RNA, 27 nt, Human
ugcaccaacagccguauguguacugug

SEQ ID NO: 117006 - RNA, 23 nt, Human
aacagguugaagaacuggagcga

SEQ ID NO: 117007 - RNA, 28 nt, Human
uucagugccccuugcagaaaaaauauua

SEQ ID NO: 117008 - RNA, 19 nt, Human
agcucacaguuucuugccu

SEQ ID NO: 117009 - RNA, 18 nt, Human
cuguuggcacccugcugc

SEQ ID NO: 117010 - RNA, 20 nt, Human
ggaccagauccuacucuucc

SEQ ID NO: 117011 - RNA, 23 nt, Human
uccugcucccagggagcuccagg

SEQ ID NO: 117012 - RNA, 24 nt, Human
guccuugugucccugccgcugaag

SEQ ID NO: 117013 - RNA, 20 nt, Human
acuuuaauuucucugcauca

SEQ ID NO: 117014 - RNA, 27 nt, Human
gcuuuuucucuaccugcccuugggcuc

SEQ ID NO: 117015 - RNA, 22 nt, Human
uuuagcugaucagaucucucca

SEQ ID NO: 117016 - RNA, 22 nt, Human
cugauugcuaguagagagacac

SEQ ID NO: 117017 - RNA, 27 nt, Human
cugagauacugguaaucauccugugaa

SEQ ID NO: 117018 - RNA, 21 nt, Human
gagccucccaccagagccggg

SEQ ID NO: 117019 - RNA, 27 nt, Human
acuuuccucuucuaugaccccucucuc

SEQ ID NO: 117020 - RNA, 24 nt, Human
caccugaggucaggaguucaaaac

SEQ ID NO: 117021 - RNA, 27 nt, Human
ccugggcaacagagugagacucuguuu

SEQ ID NO: 117022 - RNA, 21 nt, Human
cuaacaugguacacugcaucu

SEQ ID NO: 117023 - RNA, 25 nt, Human
cugucucuucagcuucucugaugcu

SEQ ID NO: 117024 - RNA, 22 nt, Human
aggacugugcuaaucaguauca

SEQ ID NO: 117025 - RNA, 25 nt, Human
gccgagccacacacccgcuccaccu

SEQ ID NO: 117026 - RNA, 20 nt, Human
gaaagagagagcagcuguua

SEQ ID NO: 117027 - RNA, 19 nt, Human
caccugucuguacauauuu

SEQ ID NO: 117028 - RNA, 23 nt, Human
gccugccuuuuugggacucagau

SEQ ID NO: 117029 - RNA, 18 nt, Human
uauaaaaauauauaagag

SEQ ID NO: 117030 - RNA, 24 nt, Human
agccuagagaccgccacugugauu

SEQ ID NO: 117031 - RNA, 26 nt, Human
agagugagccagugagggcaguccug

SEQ ID NO: 117032 - RNA, 20 nt, Human
gugcccauuccacucugccu

SEQ ID NO: 117033 - RNA, 27 nt, Human
ugccaugucagggguuugcuuacagug

SEQ ID NO: 117034 - RNA, 25 nt, Human
uugccaggcuggugcaaaguaauua

SEQ ID NO: 117035 - RNA, 22 nt, Human
cggaucccagcuuccugcagcc

SEQ ID NO: 117036 - RNA, 22 nt, Human
cuagggcugugaggccaccucc

SEQ ID NO: 117037 - RNA, 21 nt, Human
aaacuauuugcagaugacaca

SEQ ID NO: 117038 - RNA, 27 nt, Human
gcucgcaacccuaccuaccucucuccc

SEQ ID NO: 117039 - RNA, 21 nt, Human
cuuugaauuuaucuggcuccu

SEQ ID NO: 117040 - RNA, 17 nt, Human
uggggagggaggggagc

SEQ ID NO: 117041 - RNA, 25 nt, Human
cuccagccucaccaggcuccccggc

SEQ ID NO: 117042 - RNA, 31 nt, Human
agcucccugccagcuuccugucccugugcuc

SEQ ID NO: 117043 - RNA, 20 nt, Human
uuaaaaaagaacugcaaaga

SEQ ID NO: 117044 - RNA, 23 nt, Human
ucucuuccugugguuccauccga

SEQ ID NO: 117045 - RNA, 24 nt, Human
agaugauugugccaucuucuguag

SEQ ID NO: 117046 - RNA, 23 nt, Human
gauuaucguugccacugaagguu

SEQ ID NO: 117047 - RNA, 25 nt, Human
cccuccaggcuguuggcaggcggug

SEQ ID NO: 117048 - RNA, 26 nt, Human
ucauuucuaauacacauuuaccuaau

SEQ ID NO: 117049 - RNA, 20 nt, Human
auauauuguacacuacagca

SEQ ID NO: 117050 - RNA, 21 nt, Human
ggagggguuuaccuggaacau

SEQ ID NO: 117051 - RNA, 22 nt, Human
gggagggagagggacuuguggg

SEQ ID NO: 117052 - RNA, 21 nt, Human
uguuuuuuccccuuccuguaa

SEQ ID NO: 117053 - RNA, 19 nt, Human
uucuaugagggcagguaca

SEQ ID NO: 117054 - RNA, 29 nt, Human
uccacgcgcuaaggcgacccccucccccg

SEQ ID NO: 117055 - RNA, 18 nt, Human
ucagugcuugcuugaugg

SEQ ID NO: 117056 - RNA, 20 nt, Human
ggugagaaaucacaaugaga

SEQ ID NO: 117057 - RNA, 27 nt, Human
cuggagccuggccagcccucaccucuu

SEQ ID NO: 117058 - RNA, 24 nt, Human
cugcuccagggccucagggcccgg

SEQ ID NO: 117059 - RNA, 19 nt, Human
uucagcaguuucucuuggc

SEQ ID NO: 117060 - RNA, 20 nt, Human
cauccaggcuggggcaccuu

SEQ ID NO: 117061 - RNA, 22 nt, Human
cgcccaggcuggagguuaaugg

SEQ ID NO: 117062 - RNA, 24 nt, Human
auuucucuagccuuccuuuucugc

SEQ ID NO: 117063 - RNA, 23 nt, Human
guuucucuuccuugccuggacug

SEQ ID NO: 117064 - RNA, 22 nt, Human
gcagggcugcaggggauucugu

SEQ ID NO: 117065 - RNA, 26 nt, Human
uugcagaauggaaugcaugcuacuaa

SEQ ID NO: 117066 - RNA, 26 nt, Human
ccagugcuuccacagagauuagccug

SEQ ID NO: 117067 - RNA, 21 nt, Human
gaucacugcaaccucugccuc

SEQ ID NO: 117068 - RNA, 24 nt, Human
aucucugagauauguacacaguca

SEQ ID NO: 117069 - RNA, 21 nt, Human
ggcaggggcuggagaugggug

SEQ ID NO: 117070 - RNA, 21 nt, Human
cugagccuuggugugcuguau

SEQ ID NO: 117071 - RNA, 27 nt, Human
cugugcagagccccauccacugguucu

SEQ ID NO: 117072 - RNA, 22 nt, Human
gucacccaggccacaaggccau

SEQ ID NO: 117073 - RNA, 27 nt, Human
ggacuccugugcagcuucccucggccg

SEQ ID NO: 117074 - RNA, 27 nt, Human
caggcuggagugcagugccaugaucac

SEQ ID NO: 117075 - RNA, 23 nt, Human
acggaauagauaauuaagaguga

SEQ ID NO: 117076 - RNA, 29 nt, Human
gguccuggaggcagaugcgagggcccaga

SEQ ID NO: 117077 - RNA, 22 nt, Human
gcccaggcuugagugcaaugac

SEQ ID NO: 117078 - RNA, 27 nt, Human
ucccuccacggcccaggucuccucacu

SEQ ID NO: 117079 - RNA, 27 nt, Human
uccuucccucccugcucggcggcucca

SEQ ID NO: 117080 - RNA, 20 nt, Human
gucccagacacgucuuuuca

SEQ ID NO: 117081 - RNA, 20 nt, Human
caucugugaacugcuuucug

SEQ ID NO: 117082 - RNA, 30 nt, Human
gcauuugagcugugguugaggaaguggugu

SEQ ID NO: 117083 - RNA, 20 nt, Human
gguucucaauucugucucau

SEQ ID NO: 117084 - RNA, 22 nt, Human
gcauuuauauucucaaaaauga

SEQ ID NO: 117085 - RNA, 24 nt, Human
ggcuguaauuggagcagcuuuugg

SEQ ID NO: 117086 - RNA, 21 nt, Human
uugagggaagagggagacugg

SEQ ID NO: 117087 - RNA, 21 nt, Human
uuugcuagcuuuuaaauauau

SEQ ID NO: 117088 - RNA, 21 nt, Human
gucuuacuauguuguccaggc

SEQ ID NO: 117089 - RNA, 23 nt, Human
gugccaccuccacacucaccuca

SEQ ID NO: 117090 - RNA, 22 nt, Human
ugggcacagacucggggcugcc

SEQ ID NO: 117091 - RNA, 25 nt, Human
ggcaggagaaacugggccaggcugc

SEQ ID NO: 117092 - RNA, 20 nt, Human
ccgcagcugccgcccccgcc

SEQ ID NO: 117093 - RNA, 24 nt, Human
ugugugcugagcauagagcauaca

SEQ ID NO: 117094 - RNA, 23 nt, Human
ccuugauuucccugcugccucca

SEQ ID NO: 117095 - RNA, 23 nt, Human
uuguucuuuaaaagaaacugagg

SEQ ID NO: 117096 - RNA, 27 nt, Human
gucgccuagacuggauagugggggugg

SEQ ID NO: 117097 - RNA, 19 nt, Human
aggaaaagauuucauaagc

SEQ ID NO: 117098 - RNA, 25 nt, Human
acccaggcuggagugcaguggugca

SEQ ID NO: 117099 - RNA, 25 nt, Human
gcccaggcuggagugcaguggugcg

SEQ ID NO: 117100 - RNA, 25 nt, Human
gcccaggauggagugcaguggugag

SEQ ID NO: 117101 - RNA, 26 nt, Human
uggcuaacuuuuauuaucuucuauau

SEQ ID NO: 117102 - RNA, 26 nt, Human
guguccacacugcugcccgugcagug

SEQ ID NO: 117103 - RNA, 28 nt, Human
gucauuaaugggcaggcuuuucuguuga

SEQ ID NO: 117104 - RNA, 20 nt, Human
uguauaugaggguaucaaau

SEQ ID NO: 117105 - RNA, 27 nt, Human
aaacuauuuauugacuuuauucaucca

SEQ ID NO: 117106 - RNA, 26 nt, Human
gcucagaaauggaugaugaagacugu

SEQ ID NO: 117107 - RNA, 25 nt, Human
auccuuaucagagcuaagggugggu

SEQ ID NO: 117108 - RNA, 24 nt, Human
ugaguauggaagauuaugauuucc

SEQ ID NO: 117109 - RNA, 21 nt, Human
uccaguaucagcauagugacu

SEQ ID NO: 117110 - RNA, 21 nt, Human
cuguaaccucaaacucccagg

SEQ ID NO: 117111 - RNA, 21 nt, Human
gcuaguaccuguaagcauuuu

SEQ ID NO: 117112 - RNA, 21 nt, Human
uggguccacauccugcuaaga

SEQ ID NO: 117113 - RNA, 26 nt, Human
ucuuuuauauugauaacagcacugac

SEQ ID NO: 117114 - RNA, 27 nt, Human
ccauagaucucaguuugaucaaaaaga

SEQ ID NO: 117115 - RNA, 20 nt, Human
gccaaacuuuggaaauguua

SEQ ID NO: 117116 - RNA, 21 nt, Human
uucuucuucauaaauguaguu

SEQ ID NO: 117117 - RNA, 16 nt, Human
uucauuucaugccuua

SEQ ID NO: 117118 - RNA, 22 nt, Human
ugaagccccaggccgcaggggg

SEQ ID NO: 117119 - RNA, 23 nt, Human
ccucgauccugcaccuuccucuc

SEQ ID NO: 117120 - RNA, 21 nt, Human
uuacagaaaaauucuuaacug

SEQ ID NO: 117121 - RNA, 19 nt, Human
acugcuccaguuucaccuc

SEQ ID NO: 117122 - RNA, 19 nt, Human
agcugauucaugcuccucc

SEQ ID NO: 117123 - RNA, 23 nt, Human
agcaccaaauucaaccaucaucu

SEQ ID NO: 117124 - RNA, 18 nt, Human
uucugagcuuugcaucuc

SEQ ID NO: 117125 - RNA, 23 nt, Human
uaaaaugcaacauguguacuuaa

SEQ ID NO: 117126 - RNA, 24 nt, Human
caagaccucccuggaacccuucug

SEQ ID NO: 117127 - RNA, 22 nt, Human
uauuauuaauuacaauguaaua

SEQ ID NO: 117128 - RNA, 22 nt, Human
ucuugagcuuuuaauuuguuga

SEQ ID NO: 117129 - RNA, 23 nt, Human
ugccaccuccaccggacaccuca

SEQ ID NO: 117130 - RNA, 19 nt, Human
auguacacuuucugucuca

SEQ ID NO: 117131 - RNA, 19 nt, Human
gagccaucccagagccugg

SEQ ID NO: 117132 - RNA, 22 nt, Human
gucuuucuccucuccuacaucc

SEQ ID NO: 117133 - RNA, 25 nt, Human
gaaugagaagucauccuggagcaca

SEQ ID NO: 117134 - RNA, 25 nt, Human
aggaaaggggggcagcucaguggcc

SEQ ID NO: 117135 - RNA, 22 nt, Human
gaccuugagaagauucuuccca

SEQ ID NO: 117136 - RNA, 19 nt, Human
acucuguugaccaggcugg

SEQ ID NO: 117137 - RNA, 30 nt, Human
ucuguacuucaaccagccuacaagcuggca

SEQ ID NO: 117138 - RNA, 22 nt, Human
uuggggcuuuauuuuauuuuua

SEQ ID NO: 117139 - RNA, 21 nt, Human
acuuccaccuccagugccaga

SEQ ID NO: 117140 - RNA, 20 nt, Human
acaaguuuauuuuccucaga

SEQ ID NO: 117141 - RNA, 18 nt, Human
cagggagggggcagaggc

SEQ ID NO: 117142 - RNA, 23 nt, Human
acgucaauagucccucucucugc

SEQ ID NO: 117143 - RNA, 21 nt, Human
ccuguaaucccagcaauuugg

SEQ ID NO: 117144 - RNA, 20 nt, Human
cacugccaccaguagguuau

SEQ ID NO: 117145 - RNA, 22 nt, Human
gcagguggaucaccugagguca

SEQ ID NO: 117146 - RNA, 22 nt, Human
uggcucacaccuguaauaccag

SEQ ID NO: 117147 - RNA, 24 nt, Human
gccuggugugggccuggucucagc

SEQ ID NO: 117148 - RNA, 20 nt, Human
cucggccgccuccugcccgg

SEQ ID NO: 117149 - RNA, 22 nt, Human
gaacuccuggccucaagcaauc

SEQ ID NO: 117150 - RNA, 22 nt, Human
uccaaguuuccccuuguggaug

SEQ ID NO: 117151 - RNA, 26 nt, Human
cugucucucaccaacaagccaacugc

SEQ ID NO: 117152 - RNA, 18 nt, Human
cauacuaaaaaugcucug

SEQ ID NO: 117153 - RNA, 24 nt, Human
ugcuuggaaauuguguuuucccca

SEQ ID NO: 117154 - RNA, 27 nt, Human
guagggagccgcugagagcgagaagag

SEQ ID NO: 117155 - RNA, 27 nt, Human
gucuccaacaccugggcucaaguggcu

SEQ ID NO: 117156 - RNA, 22 nt, Human
agcgaggugucucccuagcucg

SEQ ID NO: 117157 - RNA, 22 nt, Human
guucucucugcuucugucuuga

SEQ ID NO: 117158 - RNA, 26 nt, Human
gcagcuucaacuuuucucuuuagugu

SEQ ID NO: 117159 - RNA, 25 nt, Human
aagacuuuagauuccucucugcggu

SEQ ID NO: 117160 - RNA, 20 nt, Human
gcagccccuccccaccagcu

SEQ ID NO: 117161 - RNA, 21 nt, Human
aguucuggcccuggacucugc

SEQ ID NO: 117162 - RNA, 27 nt, Human
cacugcacuccaaccuagguaacagag

SEQ ID NO: 117163 - RNA, 23 nt, Human
ccugccaccauggugucuugccg

SEQ ID NO: 117164 - RNA, 26 nt, Human
gcugguguccauccagcacugaccag

SEQ ID NO: 117165 - RNA, 21 nt, Human
ccacugucuguuccuuuugcu

SEQ ID NO: 117166 - RNA, 23 nt, Human
ucacaugcacauuugcuagccca

SEQ ID NO: 117167 - RNA, 27 nt, Human
ccacugcaguccagccuaggcaacaga

SEQ ID NO: 117168 - RNA, 20 nt, Human
cuuccaaguccaucccgacu

SEQ ID NO: 117169 - RNA, 26 nt, Human
uggcuggagugcaauggugugaucuc

SEQ ID NO: 117170 - RNA, 20 nt, Human
uguucuuccuucuuccucag

SEQ ID NO: 117171 - RNA, 22 nt, Human
uguuagugauccaccugccuca

SEQ ID NO: 117172 - RNA, 21 nt, Human
gcagaguggucccugcccuca

SEQ ID NO: 117173 - RNA, 22 nt, Human
uccacgcccuggaucagugaau

SEQ ID NO: 117174 - RNA, 23 nt, Human
uuggggaaaagugaggccagucu

SEQ ID NO: 117175 - RNA, 22 nt, Human
aaaaugcugggauuacaggcgu

SEQ ID NO: 117176 - RNA, 22 nt, Human
ggcaggagaggugugaaaucug

SEQ ID NO: 117177 - RNA, 21 nt, Human
gacaguaaagcugcagugauu

SEQ ID NO: 117178 - RNA, 23 nt, Human
accgcgcccggcuaauuuuuugu

SEQ ID NO: 117179 - RNA, 27 nt, Human
gccagugcuuuccaugugccucguaga

SEQ ID NO: 117180 - RNA, 25 nt, Human
acgcugcaucuucgcgugugcucag

SEQ ID NO: 117181 - RNA, 27 nt, Human
ucauguuuuccugcagcaggugcauag

SEQ ID NO: 117182 - RNA, 21 nt, Human
cugggaagagaaaucugaaga

SEQ ID NO: 117183 - RNA, 21 nt, Human
gaggagugaauuaaggaagag

SEQ ID NO: 117184 - RNA, 25 nt, Human
acaagauuuucuuaccucucaguug

SEQ ID NO: 117185 - RNA, 28 nt, Human
augccacuggagcuggaguggcuggaug

SEQ ID NO: 117186 - RNA, 26 nt, Human
gagaaagugaucugcagggaggugga

SEQ ID NO: 117187 - RNA, 26 nt, Human
gacauaucauuuuucuuuuuuguaaa

SEQ ID NO: 117188 - RNA, 25 nt, Human
ccuuucuccucccaggaucugggaa

SEQ ID NO: 117189 - RNA, 22 nt, Human
cugcugcaggucagcaacugug

SEQ ID NO: 117190 - RNA, 26 nt, Human
cacucccuuuuuguaacucccuuaca

SEQ ID NO: 117191 - RNA, 25 nt, Human
caguggauucacugugucagggaug

SEQ ID NO: 117192 - RNA, 27 nt, Human
ccuguucugcuccuaggagaccugagc

SEQ ID NO: 117193 - RNA, 26 nt, Human
gcucuaucuugcucuguaaucucguu

SEQ ID NO: 117194 - RNA, 23 nt, Human
agagaaacaccaagacucuagug

SEQ ID NO: 117195 - RNA, 26 nt, Human
ccuguuugccucugaaacgucugguu

SEQ ID NO: 117196 - RNA, 20 nt, Human
gggggcaggcugcagaggac

SEQ ID NO: 117197 - RNA, 19 nt, Human
guccaaaauugcagacuug

SEQ ID NO: 117198 - RNA, 25 nt, Human
augcagugucugccuguuacagcaa

SEQ ID NO: 117199 - RNA, 21 nt, Human
cuccaccucccacaaaggaga

SEQ ID NO: 117200 - RNA, 21 nt, Human
cuagugugcugagcaaaaaga

SEQ ID NO: 117201 - RNA, 25 nt, Human
uuuucacuuccucuccacaggagcc

SEQ ID NO: 117202 - RNA, 23 nt, Human
gaccuuaggccuuccucucucca

SEQ ID NO: 117203 - RNA, 24 nt, Human
gggcagacaggcagagggccagag

SEQ ID NO: 117204 - RNA, 27 nt, Human
acugcagccuggaccuccugguucaag

SEQ ID NO: 117205 - RNA, 25 nt, Human
ccugcuguuuucccugccuggaacu

SEQ ID NO: 117206 - RNA, 21 nt, Human
gagguuagugugaugaggugg

SEQ ID NO: 117207 - RNA, 24 nt, Human
uuucucauugucuccaucuuuguu

SEQ ID NO: 117208 - RNA, 26 nt, Human
agcugauuucuuugauucccuagcug

SEQ ID NO: 117209 - RNA, 20 nt, Human
ugccucugggccuuugcuuu

SEQ ID NO: 117210 - RNA, 21 nt, Human
ccauugcacuccagcugggag

SEQ ID NO: 117211 - RNA, 24 nt, Human
uaggcuuucaaaauaaggaugacu

SEQ ID NO: 117212 - RNA, 22 nt, Human
ugaggggacagugagucuccag

SEQ ID NO: 117213 - RNA, 24 nt, Human
uucaggucauuuugugaauacuau

SEQ ID NO: 117214 - RNA, 18 nt, Human
agaugauuugucauuuau

SEQ ID NO: 117215 - RNA, 22 nt, Human
ugguaugcaugaucguuguaau

SEQ ID NO: 117216 - RNA, 26 nt, Human
cuggcgacaagagugagacuccaccu

SEQ ID NO: 117217 - RNA, 22 nt, Human
uguguucucugaucugccccca

SEQ ID NO: 117218 - RNA, 25 nt, Human
gccggagaccucccuucccugggcc

SEQ ID NO: 117219 - RNA, 26 nt, Human
ccugaacuugaacauacaaagugggc

SEQ ID NO: 117220 - RNA, 18 nt, Human
ucuccacccugcugagcc

SEQ ID NO: 117221 - RNA, 22 nt, Human
uggcagcaccaccccagggcag

SEQ ID NO: 117222 - RNA, 24 nt, Human
agucaaggcuguaggagggcaugg

SEQ ID NO: 117223 - RNA, 22 nt, Human
ugcagugagccaagaucgcgcc

SEQ ID NO: 117224 - RNA, 22 nt, Human
uguagugagcugagaucgcacc

SEQ ID NO: 117225 - RNA, 22 nt, Human
ugcagugagcugagaucguacc

SEQ ID NO: 117226 - RNA, 22 nt, Human
uguggugagcugagaucgcgcc

SEQ ID NO: 117227 - RNA, 23 nt, Human
cacuuccugguugagaagcaacg

SEQ ID NO: 117228 - RNA, 21 nt, Human
gcgagacuccgucucaaggaa

SEQ ID NO: 117229 - RNA, 22 nt, Human
gccauuuucucaaacgagaguc

SEQ ID NO: 117230 - RNA, 25 nt, Human
caguuucagcaaccgcuagguuucu

SEQ ID NO: 117231 - RNA, 25 nt, Human
ucagaaguggcugauuggaagggga

SEQ ID NO: 117232 - RNA, 26 nt, Human
ugucuguuaguuauuucuccagggga

SEQ ID NO: 117233 - RNA, 22 nt, Human
guuuggcugugaugugcguggc

SEQ ID NO: 117234 - RNA, 22 nt, Human
ucagcggaaauguuccuuccuc

SEQ ID NO: 117235 - RNA, 29 nt, Human
ggcucucagccaucucuaaccucugcccu

SEQ ID NO: 117236 - RNA, 22 nt, Human
cccagacaggcuccaccaggag

SEQ ID NO: 117237 - RNA, 27 nt, Human
cccugcucaaccucuugcaggagggag

SEQ ID NO: 117238 - RNA, 20 nt, Human
auguagaucuucaaagugau

SEQ ID NO: 117239 - RNA, 21 nt, Human
cucuucucuuuccacuuuggg

SEQ ID NO: 117240 - RNA, 22 nt, Human
agcuuuucuuuuuuaauuucca

SEQ ID NO: 117241 - RNA, 21 nt, Human
uuggcaccgcuucucagccac

SEQ ID NO: 117242 - RNA, 27 nt, Human
ucugcuuccuguaacucccuccauccc

SEQ ID NO: 117243 - RNA, 23 nt, Human
uccucgucuccuccuccuuccca

SEQ ID NO: 117244 - RNA, 21 nt, Human
gcuggcuguguuugcagugca

SEQ ID NO: 117245 - RNA, 27 nt, Human
guguucuguuuguuaaaacuggcaucu

SEQ ID NO: 117246 - RNA, 20 nt, Human
uguaucacacuguuguauau

SEQ ID NO: 117247 - RNA, 20 nt, Human
aacagaaacacucccaggga

SEQ ID NO: 117248 - RNA, 25 nt, Human
ccugcccuguuccccguccugagcc

SEQ ID NO: 117249 - RNA, 23 nt, Human
cgcugggggcucugggcuugugg

SEQ ID NO: 117250 - RNA, 26 nt, Human
uguaaucccagcacuuuuggaggcca

SEQ ID NO: 117251 - RNA, 21 nt, Human
uuaagaucuuggcuuaauuua

SEQ ID NO: 117252 - RNA, 26 nt, Human
aacccauguggaucuaaggcaaauug

SEQ ID NO: 117253 - RNA, 20 nt, Human
cccgccgccaccuccucccc

SEQ ID NO: 117254 - RNA, 21 nt, Human
agggagccuuucuuggcccuc

SEQ ID NO: 117255 - RNA, 23 nt, Human
ugugugccaccacacccugcuaa

SEQ ID NO: 117256 - RNA, 22 nt, Human
aagaggaagaacagagaaacgg

SEQ ID NO: 117257 - RNA, 23 nt, Human
cagccuccuucuuucaccccuua

SEQ ID NO: 117258 - RNA, 22 nt, Human
ccccugagccagcagggcaucu

SEQ ID NO: 117259 - RNA, 23 nt, Human
cgcccccugcacuccagccuggg

SEQ ID NO: 117260 - RNA, 22 nt, Human
guacuuguuuguaaagcacuuu

SEQ ID NO: 117261 - RNA, 22 nt, Human
gaacccaggaggcagagguugg

SEQ ID NO: 117262 - RNA, 21 nt, Human
cuuugcaggagucaggucccu

SEQ ID NO: 117263 - RNA, 20 nt, Human
uuuuauguacaaugauuuau

SEQ ID NO: 117264 - RNA, 27 nt, Human
uccucaccuucuguuuuagaguugagc

SEQ ID NO: 117265 - RNA, 20 nt, Human
cucucuccaggacugccagg

SEQ ID NO: 117266 - RNA, 25 nt, Human
ugguucauaugauguaggcacuugc

SEQ ID NO: 117267 - RNA, 20 nt, Human
cuggaagcccacagagacag

SEQ ID NO: 117268 - RNA, 27 nt, Human
ccggccuggccuugccugcagacuaua

SEQ ID NO: 117269 - RNA, 25 nt, Human
ccacuacuccagcccagaaggaaag

SEQ ID NO: 117270 - RNA, 20 nt, Human
ggggacgggugggugcagug

SEQ ID NO: 117271 - RNA, 27 nt, Human
cacuccuucucagccugggcucccagc

SEQ ID NO: 117272 - RNA, 23 nt, Human
uaaaacacagcuuuacaacuucc

SEQ ID NO: 117273 - RNA, 22 nt, Human
ccugcagccgcucauggcggug

SEQ ID NO: 117274 - RNA, 22 nt, Human
gcaacauggugaaauccugucu

SEQ ID NO: 117275 - RNA, 27 nt, Human
uucuggccccagacacaggguagucuu

SEQ ID NO: 117276 - RNA, 22 nt, Human
ucuugacuugugccugccuuca

SEQ ID NO: 117277 - RNA, 22 nt, Human
ugguucagacaccuguucacag

SEQ ID NO: 117278 - RNA, 22 nt, Human
cguccuggggacguggagggug

SEQ ID NO: 117279 - RNA, 24 nt, Human
gccgcccgcccccuccagggggcu

SEQ ID NO: 117280 - RNA, 17 nt, Human
accauaaaaagguuaua

SEQ ID NO: 117281 - RNA, 26 nt, Human
caucuauugcucuaccucaggggucc

SEQ ID NO: 117282 - RNA, 22 nt, Human
cugcccgccacaugguguggcc

SEQ ID NO: 117283 - RNA, 22 nt, Human
uuggguccagagugcucaucau

SEQ ID NO: 117284 - RNA, 21 nt, Human
gagcccaggagguuguggcug

SEQ ID NO: 117285 - RNA, 26 nt, Human
aggguccacccuagccuagaacaagc

SEQ ID NO: 117286 - RNA, 20 nt, Human
aggcugagagcccaaacugc

SEQ ID NO: 117287 - RNA, 32 nt, Human
guggaugugugagcucugaggguggcccugcu

SEQ ID NO: 117288 - RNA, 23 nt, Human
auguuugcacacugaauugaaga

SEQ ID NO: 117289 - RNA, 23 nt, Human
acagagggcuauggcuguggaga

SEQ ID NO: 117290 - RNA, 30 nt, Human
acuaguaaaacugccuucccuuuguuccuu

SEQ ID NO: 117291 - RNA, 22 nt, Human
caccauugcacuccacccuggg

SEQ ID NO: 117292 - RNA, 23 nt, Human
uccuccagccaccacccacaauc

SEQ ID NO: 117293 - RNA, 23 nt, Human
ugaccaacacuacagagauccca

SEQ ID NO: 117294 - RNA, 19 nt, Human
agagccagaaguugaugug

SEQ ID NO: 117295 - RNA, 20 nt, Human
auuacaucucuaauuuugga

SEQ ID NO: 117296 - RNA, 24 nt, Human
acugaacauuugcuuuguuuucua

SEQ ID NO: 117297 - RNA, 25 nt, Human
ucagcuguuuuacaaaagcuuuuca

SEQ ID NO: 117298 - RNA, 24 nt, Human
guggugcauggcuguggagcucag

SEQ ID NO: 117299 - RNA, 22 nt, Human
cgaggcagugggcaggccaggc

SEQ ID NO: 117300 - RNA, 21 nt, Human
uuuugggcuaauagugacaua

SEQ ID NO: 117301 - RNA, 28 nt, Human
gcucuggccuagggaccuugccgcugac

SEQ ID NO: 117302 - RNA, 24 nt, Human
ccagaagucccugaaccccaaacu

SEQ ID NO: 117303 - RNA, 23 nt, Human
ucugcuugguuggcuggcagcug

SEQ ID NO: 117304 - RNA, 19 nt, Human
uagucagcauuuucuugag

SEQ ID NO: 117305 - RNA, 21 nt, Human
guuuugagcuuuagaccucag

SEQ ID NO: 117306 - RNA, 24 nt, Human
uuauagucuauagaacuggagauu

SEQ ID NO: 117307 - RNA, 23 nt, Human
uaaucagcuaaacagaaguuguu

SEQ ID NO: 117308 - RNA, 20 nt, Human
uuuucccucuuugcuggcac

SEQ ID NO: 117309 - RNA, 26 nt, Human
uugcuaaucuucuuaugcaauuuccu

SEQ ID NO: 117310 - RNA, 20 nt, Human
agaugcuaucacagacucug

SEQ ID NO: 117311 - RNA, 19 nt, Human
cgugugaccaugccaggcu

SEQ ID NO: 117312 - RNA, 23 nt, Human
uuccucauucucuuuuaaaaccc

SEQ ID NO: 117313 - RNA, 20 nt, Human
ugacucgcuuuucugcuugc

SEQ ID NO: 117314 - RNA, 21 nt, Human
aaggacuacuuugcaugugaa

SEQ ID NO: 117315 - RNA, 23 nt, Human
ggaaggcaggaggcugccggggc

SEQ ID NO: 117316 - RNA, 15 nt, Human
aucaaaccacuguua

SEQ ID NO: 117317 - RNA, 20 nt, Human
uucuucucucccugugacac

SEQ ID NO: 117318 - RNA, 22 nt, Human
gauaccccucagggcucagcua

SEQ ID NO: 117319 - RNA, 24 nt, Human
uuuacuguuauagaauagccuggg

SEQ ID NO: 117320 - RNA, 28 nt, Human
cccuagcugaggcacacagggagaccca

SEQ ID NO: 117321 - RNA, 21 nt, Human
ucacaugcccucugggugaca

SEQ ID NO: 117322 - RNA, 23 nt, Human
ggccucuccagccucagcccccu

SEQ ID NO: 117323 - RNA, 22 nt, Human
agugcuucugggauaacuggaa

SEQ ID NO: 117324 - RNA, 21 nt, Human
uuucuaugcuguuucuuguca

SEQ ID NO: 117325 - RNA, 22 nt, Human
uauucaacugacggugcaaaaa

SEQ ID NO: 117326 - RNA, 23 nt, Human
aaugucaggaacagaaggaugaa

SEQ ID NO: 117327 - RNA, 18 nt, Human
augggaaaacacgccccu

SEQ ID NO: 117328 - RNA, 18 nt, Human
ugaaggagaaaaggaugg

SEQ ID NO: 117329 - RNA, 24 nt, Human
agaugguaaaaugguucucaggga

SEQ ID NO: 117330 - RNA, 23 nt, Human
uccuccugguuauugguuuguuu

SEQ ID NO: 117331 - RNA, 27 nt, Human
ucucuucucagcuuaacauggaaauga

SEQ ID NO: 117332 - RNA, 22 nt, Human
cucggccucccaaaguacuggg

SEQ ID NO: 117333 - RNA, 19 nt, Human
aauugugcuauuacuccaa

SEQ ID NO: 117334 - RNA, 23 nt, Human
aacaauacugccauucccuucua

SEQ ID NO: 117335 - RNA, 27 nt, Human
ugcuuuaucaaaaugguuuauuuuagg

SEQ ID NO: 117336 - RNA, 31 nt, Human
acugcagcugucaauagccuaggcugaauuu

SEQ ID NO: 117337 - RNA, 26 nt, Human
acgacacuaauuuaccacauucuucu

SEQ ID NO: 117338 - RNA, 22 nt, Human
cagauguuuuccuuucuuccuu

SEQ ID NO: 117339 - RNA, 24 nt, Human
uccaacaaguggauaaaagucugu

SEQ ID NO: 117340 - RNA, 19 nt, Human
gcggcagcagcagcagcga

SEQ ID NO: 117341 - RNA, 27 nt, Human
acugucauccuaacguuugucauucca

SEQ ID NO: 117342 - RNA, 19 nt, Human
ccacucucuccccugcucc

SEQ ID NO: 117343 - RNA, 24 nt, Human
uagagacaaaacuuuauugcacug

SEQ ID NO: 117344 - RNA, 17 nt, Human
uuuuucuuaccuagccc

SEQ ID NO: 117345 - RNA, 25 nt, Human
cgcagccgccgccucagcugcucgc

SEQ ID NO: 117346 - RNA, 20 nt, Human
gucucaaccccuccccacca

SEQ ID NO: 117347 - RNA, 28 nt, Human
ucuaccuuccugucccugagguuaaacg

SEQ ID NO: 117348 - RNA, 24 nt, Human
ucccauuuagaauggugauuuuaa

SEQ ID NO: 117349 - RNA, 23 nt, Human
agguuuugucagccacaccuaca

SEQ ID NO: 117350 - RNA, 19 nt, Human
agccuauacuuuaggcuag

SEQ ID NO: 117351 - RNA, 22 nt, Human
caacauagggagacccugucuc

SEQ ID NO: 117352 - RNA, 23 nt, Human
cggcauggugccugggcugccgg

SEQ ID NO: 117353 - RNA, 22 nt, Human
ucucccuuaccuguuuuugcua

SEQ ID NO: 117354 - RNA, 21 nt, Human
uauuuuaaaaucuauuuccua

SEQ ID NO: 117355 - RNA, 18 nt, Human
ugaacaaaaccaagucca

SEQ ID NO: 117356 - RNA, 27 nt, Human
uuuagaagaaaagcaaaaugagaaaaa

SEQ ID NO: 117357 - RNA, 27 nt, Human
ucuacuuccuguccaccuaugucuuug

SEQ ID NO: 117358 - RNA, 19 nt, Human
auuuuugagacagugucuu

SEQ ID NO: 117359 - RNA, 21 nt, Human
agagcuaagagcaguacucug

SEQ ID NO: 117360 - RNA, 22 nt, Human
cuauuccaguuucaaagcuccu

SEQ ID NO: 117361 - RNA, 26 nt, Human
cugccucuuuccggcugugacccucc

SEQ ID NO: 117362 - RNA, 23 nt, Human
augugggaaaucucuguaccuuc

SEQ ID NO: 117363 - RNA, 20 nt, Human
uguggaaucuugggcaaguc

SEQ ID NO: 117364 - RNA, 22 nt, Human
cucaggugaucugccugccuca

SEQ ID NO: 117365 - RNA, 21 nt, Human
ccagugcuuuauguuguuguu

SEQ ID NO: 117366 - RNA, 23 nt, Human
cacccuuaagcuuccucugacgg

SEQ ID NO: 117367 - RNA, 26 nt, Human
gcuauccuggagacuuaauagacauu

SEQ ID NO: 117368 - RNA, 24 nt, Human
uuguacauccuuuucuuuucuccc

SEQ ID NO: 117369 - RNA, 27 nt, Human
caaaaucauaggcuuuuucugugcauu

SEQ ID NO: 117370 - RNA, 21 nt, Human
agggagcucaaggucacaaga

SEQ ID NO: 117371 - RNA, 21 nt, Human
caagccacauuguugccaaga

SEQ ID NO: 117372 - RNA, 19 nt, Human
ucccugggcauggccggcu

SEQ ID NO: 117373 - RNA, 21 nt, Human
auccuccucccuuucccacaa

SEQ ID NO: 117374 - RNA, 18 nt, Human
ucaagacgucuggaaaga

SEQ ID NO: 117375 - RNA, 21 nt, Human
caggagacccaacaaugagug

SEQ ID NO: 117376 - RNA, 21 nt, Human
ggccagcucuuaaccauucca

SEQ ID NO: 117377 - RNA, 21 nt, Human
cagccauuucucaaacccacc

SEQ ID NO: 117378 - RNA, 27 nt, Human
gccuuucuccucccaggaucugggaaa

SEQ ID NO: 117379 - RNA, 22 nt, Human
uuucacugauuuuaaucaugcu

SEQ ID NO: 117380 - RNA, 27 nt, Human
cccuagugccucuguuccugaauuaca

SEQ ID NO: 117381 - RNA, 22 nt, Human
guugugagccaagauuguaacc

SEQ ID NO: 117382 - RNA, 22 nt, Human
aguuuaaugacaguuuauguau

SEQ ID NO: 117383 - RNA, 26 nt, Human
gccucauauuuucuguccagucaaug

SEQ ID NO: 117384 - RNA, 22 nt, Human
uggagucucucucugucaccca

SEQ ID NO: 117385 - RNA, 23 nt, Human
caucugaagucccuuccauuguu

SEQ ID NO: 117386 - RNA, 23 nt, Human
aaauguuccuaaaccaggaagcu

SEQ ID NO: 117387 - RNA, 24 nt, Human
aggcuggagugcagugaggcaauc

SEQ ID NO: 117388 - RNA, 27 nt, Human
caggaaggagcaggagcuaagcagggu

SEQ ID NO: 117389 - RNA, 27 nt, Human
uaaacuaagcacagaagaguuggcguc

SEQ ID NO: 117390 - RNA, 24 nt, Human
ucgagggagcaggagcaucaggcg

SEQ ID NO: 117391 - RNA, 25 nt, Human
gagggacgccaugcggggaggcagg

SEQ ID NO: 117392 - RNA, 23 nt, Human
uuguagguguuucgugugcugcu

SEQ ID NO: 117393 - RNA, 21 nt, Human
ccccugaggagcggggcuggu

SEQ ID NO: 117394 - RNA, 24 nt, Human
uguagcccaggccagagugcagug

SEQ ID NO: 117395 - RNA, 24 nt, Human
agaaaaacguguugccuugaacca

SEQ ID NO: 117396 - RNA, 22 nt, Human
ccuuggcccucuccugucugcc

SEQ ID NO: 117397 - RNA, 19 nt, Human
agaggaauagacucaggga

SEQ ID NO: 117398 - RNA, 22 nt, Human
guauuauuuuauacaaaagccu

SEQ ID NO: 117399 - RNA, 25 nt, Human
cuugcuucuugagaucucccuggcu

SEQ ID NO: 117400 - RNA, 19 nt, Human
gaucuugugaaaacacugu

SEQ ID NO: 117401 - RNA, 26 nt, Human
gguggcugggauugcaggcacccacc

SEQ ID NO: 117402 - RNA, 22 nt, Human
gcucacugcaacuucugccucc

SEQ ID NO: 117403 - RNA, 22 nt, Human
gcucacugcaaccucuaccucc

SEQ ID NO: 117404 - RNA, 23 nt, Human
acuguaauccgaauacuuugcca

SEQ ID NO: 117405 - RNA, 21 nt, Human
gggagguggcggauggagugg

SEQ ID NO: 117406 - RNA, 23 nt, Human
ccaccagaugccaggaaucagug

SEQ ID NO: 117407 - RNA, 23 nt, Human
auuuuucuuaguaaauagauuau

SEQ ID NO: 117408 - RNA, 20 nt, Human
agcauuuucuaguuuucuua

SEQ ID NO: 117409 - RNA, 20 nt, Human
cagaugggggcagagagcac

SEQ ID NO: 117410 - RNA, 24 nt, Human
uuccugaccuccuccugcccuccc

SEQ ID NO: 117411 - RNA, 21 nt, Human
uuaauccuucuaguuucccac

SEQ ID NO: 117412 - RNA, 23 nt, Human
cuaguagcugggacuacaggcau

SEQ ID NO: 117413 - RNA, 19 nt, Human
aaucucccagcccaccuca

SEQ ID NO: 117414 - RNA, 20 nt, Human
gcagcauucagcacacccca

SEQ ID NO: 117415 - RNA, 20 nt, Human
gucacccagcgagugcugag

SEQ ID NO: 117416 - RNA, 19 nt, Human
uaucagcuuagaguguuca

SEQ ID NO: 117417 - RNA, 18 nt, Human
gccauguaaaaugccuuu

SEQ ID NO: 117418 - RNA, 20 nt, Human
cacacugaggggacugguug

SEQ ID NO: 117419 - RNA, 23 nt, Human
agguauuagaggaaagagaaggg

SEQ ID NO: 117420 - RNA, 21 nt, Human
ucugggcugggaaccagggag

SEQ ID NO: 117421 - RNA, 27 nt, Human
ggagucuccccauccuccuuugcuuuc

SEQ ID NO: 117422 - RNA, 23 nt, Human
ccuggagacagagguugcaguga

SEQ ID NO: 117423 - RNA, 17 nt, Human
cuucuuucccuuaguga

SEQ ID NO: 117424 - RNA, 22 nt, Human
ccagaggcagagguugcaguga

SEQ ID NO: 117425 - RNA, 19 nt, Human
uuauccgccgccaccaaga

SEQ ID NO: 117426 - RNA, 21 nt, Human
cccuucauccugcuuaauccu

SEQ ID NO: 117427 - RNA, 18 nt, Human
aaguucugcuuucucccc

SEQ ID NO: 117428 - RNA, 21 nt, Human
gugccuggcccugagcgaagc

SEQ ID NO: 117429 - RNA, 22 nt, Human
uaccaugucaggauauuuuuag

SEQ ID NO: 117430 - RNA, 20 nt, Human
accgagcagccuccuccucc

SEQ ID NO: 117431 - RNA, 19 nt, Human
gcaucuccugccucccuca

SEQ ID NO: 117432 - RNA, 20 nt, Human
cucucuguugcccaggcugg

SEQ ID NO: 117433 - RNA, 22 nt, Human
cucuggccuaauggaucuuacu

SEQ ID NO: 117434 - RNA, 25 nt, Human
gcucgugaacuaaggagaaaaagaa

SEQ ID NO: 117435 - RNA, 19 nt, Human
gcugcagcugcuuguuguc

SEQ ID NO: 117436 - RNA, 21 nt, Human
gggagguggaguugcagugag

SEQ ID NO: 117437 - RNA, 25 nt, Human
guggggcucccuugccagacuucag

SEQ ID NO: 117438 - RNA, 22 nt, Human
ucuucuuuuucucaugcccugc

SEQ ID NO: 117439 - RNA, 22 nt, Human
gagucugagcucugcugcaucu

SEQ ID NO: 117440 - RNA, 27 nt, Human
cuguucuaauaaaugcacggcuuuacc

SEQ ID NO: 117441 - RNA, 22 nt, Human
ggagggagggagggaggggagc

SEQ ID NO: 117442 - RNA, 27 nt, Human
ggucucgaucuccugaccucgugaucu

SEQ ID NO: 117443 - RNA, 19 nt, Human
ccaagugaaccaaccaaag

SEQ ID NO: 117444 - RNA, 26 nt, Human
gggagccggacccgucggcagaggag

SEQ ID NO: 117445 - RNA, 21 nt, Human
gagccugaagccgccggcucg

SEQ ID NO: 117446 - RNA, 19 nt, Human
agccuaucauuugauuuga

SEQ ID NO: 117447 - RNA, 19 nt, Human
uacuaguaauaauguaaua

SEQ ID NO: 117448 - RNA, 22 nt, Human
gguacaauuacuucaucuggaa

SEQ ID NO: 117449 - RNA, 25 nt, Human
caguuuucuuagcucccuggacccg

SEQ ID NO: 117450 - RNA, 24 nt, Human
aaucucuuaagccaaaaugggaca

SEQ ID NO: 117451 - RNA, 21 nt, Human
ggcacuggaucccaucaaaga

SEQ ID NO: 117452 - RNA, 20 nt, Human
agauuguaguuuagccauaa

SEQ ID NO: 117453 - RNA, 22 nt, Human
cuagaugacauagaaugacaug

SEQ ID NO: 117454 - RNA, 20 nt, Human
ggcuaccucagagcugagcu

SEQ ID NO: 117455 - RNA, 19 nt, Human
gcccaggcugaagugcagu

SEQ ID NO: 117456 - RNA, 23 nt, Human
cauagcacagaugaaccaaaaau

SEQ ID NO: 117457 - RNA, 23 nt, Human
cagugguccugcucugugccuca

SEQ ID NO: 117458 - RNA, 25 nt, Human
gcagacuccuguugugcagacuccu

SEQ ID NO: 117459 - RNA, 27 nt, Human
cugagacugaggaaaacgcgccaaguu

SEQ ID NO: 117460 - RNA, 27 nt, Human
uuugccuuugcugggccuucugugcag

SEQ ID NO: 117461 - RNA, 22 nt, Human
auucuuccugaauaauacauuc

SEQ ID NO: 117462 - RNA, 21 nt, Human
gcuggagagagagugaaguga

SEQ ID NO: 117463 - RNA, 20 nt, Human
aagaaauuauaaauaaauau

SEQ ID NO: 117464 - RNA, 24 nt, Human
cuggguuagagguaucacgugggg

SEQ ID NO: 117465 - RNA, 20 nt, Human
guucuaccuguauugucuga

SEQ ID NO: 117466 - RNA, 20 nt, Human
uaaaaugcauaugugcuguu

SEQ ID NO: 117467 - RNA, 26 nt, Human
gaauccucaguuuauuuuuccacuau

SEQ ID NO: 117468 - RNA, 20 nt, Human
gaggccuugauuccuacaug

SEQ ID NO: 117469 - RNA, 18 nt, Human
gggaggcggaggcaggag

SEQ ID NO: 117470 - RNA, 22 nt, Human
uggaacaaaaguauaaauauua

SEQ ID NO: 117471 - RNA, 24 nt, Human
aaguauggcaaaaauguuguauug

SEQ ID NO: 117472 - RNA, 21 nt, Human
uccugugcagccucagcccua

SEQ ID NO: 117473 - RNA, 23 nt, Human
gguuccuggacagaucaggcuag

SEQ ID NO: 117474 - RNA, 20 nt, Human
gcgaugggggcgcugccucc

SEQ ID NO: 117475 - RNA, 26 nt, Human
ccauuugucuguguuuucuucuugug

SEQ ID NO: 117476 - RNA, 22 nt, Human
ggccucucccccacaggaacaa

SEQ ID NO: 117477 - RNA, 23 nt, Human
cuguugcccaguguucuccuggu

SEQ ID NO: 117478 - RNA, 17 nt, Human
guauuuuccuacacucc

SEQ ID NO: 117479 - RNA, 21 nt, Human
ucaugggcuuuagguacuuca

SEQ ID NO: 117480 - RNA, 21 nt, Human
cccauggccaucaucaugucu

SEQ ID NO: 117481 - RNA, 23 nt, Human
cuguucucuggcccuuacugcgc

SEQ ID NO: 117482 - RNA, 20 nt, Human
uuugugaaagaacucugaga

SEQ ID NO: 117483 - RNA, 27 nt, Human
ggucucgaacuccugggcucaagccgu

SEQ ID NO: 117484 - RNA, 21 nt, Human
cccccuccuggggugcagugg

SEQ ID NO: 117485 - RNA, 21 nt, Human
uacaagugauccucaggcagg

SEQ ID NO: 117486 - RNA, 26 nt, Human
cccuugaagaccuuacauguuuuaug

SEQ ID NO: 117487 - RNA, 20 nt, Human
ucuucuuuuuaauuuaugga

SEQ ID NO: 117488 - RNA, 22 nt, Human
gagaggaaacaguggaggcagc

SEQ ID NO: 117489 - RNA, 26 nt, Human
gucauuucuucugcggaaccuccacc

SEQ ID NO: 117490 - RNA, 22 nt, Human
ucccaggcuggaggucaguggc

SEQ ID NO: 117491 - RNA, 20 nt, Human
gcccaggcuggaguauaaug

SEQ ID NO: 117492 - RNA, 22 nt, Human
gggagacaggcagggagggcuu

SEQ ID NO: 117493 - RNA, 22 nt, Human
cugggaccguuacauuuugaaa

SEQ ID NO: 117494 - RNA, 23 nt, Human
ucauauuacugucacagguauuu

SEQ ID NO: 117495 - RNA, 26 nt, Human
ccuggugcugcccuggcaucagccuc

SEQ ID NO: 117496 - RNA, 20 nt, Human
cuuuguucucaugcauuuca

SEQ ID NO: 117497 - RNA, 26 nt, Human
cugucucugugcccuccagcaagaag

SEQ ID NO: 117498 - RNA, 18 nt, Human
auaaaaaaugcacaaaaa

SEQ ID NO: 117499 - RNA, 21 nt, Human
aaccccugacccauucuggau

SEQ ID NO: 117500 - RNA, 22 nt, Human
ggagucucacugucugcuggca

SEQ ID NO: 117501 - RNA, 24 nt, Human
gaacaugcacuagaugacagauug

SEQ ID NO: 117502 - RNA, 20 nt, Human
ucuaauaucagcaagucucu

SEQ ID NO: 117503 - RNA, 20 nt, Human
ccauccugugcugugcucaa

SEQ ID NO: 117504 - RNA, 26 nt, Human
cuuccuucuguagagggcuguuuaca

SEQ ID NO: 117505 - RNA, 19 nt, Human
ccgggagguggaggcugca

SEQ ID NO: 117506 - RNA, 27 nt, Human
cugagacugacgcccgaccuggaaacc

SEQ ID NO: 117507 - RNA, 24 nt, Human
aaaccugaaauuaacuugugccac

SEQ ID NO: 117508 - RNA, 19 nt, Human
gcccuggcuggaguucagu

SEQ ID NO: 117509 - RNA, 25 nt, Human
cuccugagcuuucacucugcuggcu

SEQ ID NO: 117510 - RNA, 19 nt, Human
gaaugaguuugacacugcc

SEQ ID NO: 117511 - RNA, 22 nt, Human
uuccucgggaugaaaagccaua

SEQ ID NO: 117512 - RNA, 22 nt, Human
aggcugagaaacacugauagac

SEQ ID NO: 117513 - RNA, 24 nt, Human
gcuucccuuggauggagcugcccu

SEQ ID NO: 117514 - RNA, 20 nt, Human
cccugcucccucuggguucc

SEQ ID NO: 117515 - RNA, 24 nt, Human
cuuggauuugcucucuucccauuu

SEQ ID NO: 117516 - RNA, 19 nt, Human
gccacugccaccugccucc

SEQ ID NO: 117517 - RNA, 20 nt, Human
guccguggguuucccgccag

SEQ ID NO: 117518 - RNA, 27 nt, Human
ccaucauguuuaauuacaacaaggugg

SEQ ID NO: 117519 - RNA, 19 nt, Human
gcugcccgagaucacugga

SEQ ID NO: 117520 - RNA, 22 nt, Human
uuugucccaggcuuucuggugu

SEQ ID NO: 117521 - RNA, 21 nt, Human
cuuuuauuuucuacucuuuuc

SEQ ID NO: 117522 - RNA, 28 nt, Human
uccagucucagguagaucuuuauagagu

SEQ ID NO: 117523 - RNA, 20 nt, Human
gcuggguagagcauguugcu

SEQ ID NO: 117524 - RNA, 22 nt, Human
aagagguccaaggcugcaguga

SEQ ID NO: 117525 - RNA, 24 nt, Human
ugcuccuccagccccagcugcccu

SEQ ID NO: 117526 - RNA, 22 nt, Human
caguccuggaugggagagagag

SEQ ID NO: 117527 - RNA, 22 nt, Human
gcagaaaagagcacugagagca

SEQ ID NO: 117528 - RNA, 24 nt, Human
gccaucaaagaagaagaaaaagaa

SEQ ID NO: 117529 - RNA, 21 nt, Human
cuccucuucucccugcccuga

SEQ ID NO: 117530 - RNA, 20 nt, Human
gguucacuugagugugcaag

SEQ ID NO: 117531 - RNA, 27 nt, Human
ccuccugccugcuccaagaaaagggcu

SEQ ID NO: 117532 - RNA, 27 nt, Human
ugguagaagcuggcuaaccuccacuuc

SEQ ID NO: 117533 - RNA, 26 nt, Human
cagcccagggcuucagucuuccuuua

SEQ ID NO: 117534 - RNA, 17 nt, Human
cccucugccuguuuucc

SEQ ID NO: 117535 - RNA, 23 nt, Human
auccucucucaccacaaggacaa

SEQ ID NO: 117536 - RNA, 23 nt, Human
gauggugcucgccagaccuccuc

SEQ ID NO: 117537 - RNA, 24 nt, Human
cccucauuccuucaacuugugccu

SEQ ID NO: 117538 - RNA, 19 nt, Human
ccacagcuugcuaguucug

SEQ ID NO: 117539 - RNA, 20 nt, Human
ggaagaagagcagguaaagu

SEQ ID NO: 117540 - RNA, 24 nt, Human
uuugcucuccaccgcccugggcaa

SEQ ID NO: 117541 - RNA, 23 nt, Human
gguuaaauauuuugcuaacuggu

SEQ ID NO: 117542 - RNA, 32 nt, Human
uggcccugcuucuucccauugaaacuacucuu

SEQ ID NO: 117543 - RNA, 23 nt, Human
uucuggcugcgggucucagaacc

SEQ ID NO: 117544 - RNA, 21 nt, Human
ggcuuauccugguucucagcu

SEQ ID NO: 117545 - RNA, 23 nt, Human
guucucucccuuccucucuccuu

SEQ ID NO: 117546 - RNA, 23 nt, Human
cagacacaaugcauaugaaaguu

SEQ ID NO: 117547 - RNA, 23 nt, Human
gacuauguagcuuggauucuccu

SEQ ID NO: 117548 - RNA, 21 nt, Human
uuuaguaaauacaucacugua

SEQ ID NO: 117549 - RNA, 25 nt, Human
ccccuagaaauccugggaggcagga

SEQ ID NO: 117550 - RNA, 25 nt, Human
agucacagcuuccagaugagggggg

SEQ ID NO: 117551 - RNA, 23 nt, Human
ccgggucucccugucucagcacc

SEQ ID NO: 117552 - RNA, 22 nt, Human
caguggggaacuacugcuggaa

SEQ ID NO: 117553 - RNA, 28 nt, Human
cuugggcucugcugaguccgaccuggcc

SEQ ID NO: 117554 - RNA, 22 nt, Human
ccaaggcacgagaauugcuuga

SEQ ID NO: 117555 - RNA, 23 nt, Human
uuacuuuuuaccaggagugcagu

SEQ ID NO: 117556 - RNA, 22 nt, Human
acucaggaauguuugcuggggc

SEQ ID NO: 117557 - RNA, 21 nt, Human
caaaaucaaaaucaauuuagg

SEQ ID NO: 117558 - RNA, 23 nt, Human
gcugggagagcagagaaaagggg

SEQ ID NO: 117559 - RNA, 21 nt, Human
acuguccauuuucugagaccc

SEQ ID NO: 117560 - RNA, 22 nt, Human
ggucauagcagguucuggucau

SEQ ID NO: 117561 - RNA, 22 nt, Human
gaauguucaggaugcugaacag

SEQ ID NO: 117562 - RNA, 23 nt, Human
ccaaaaagggcaagagcugugga

SEQ ID NO: 117563 - RNA, 27 nt, Human
uugcccaggcugaauucagacuccugg

SEQ ID NO: 117564 - RNA, 27 nt, Human
caguucuucccaguucagacuagccac

SEQ ID NO: 117565 - RNA, 26 nt, Human
gcuaguucuuccuauuccauucucga

SEQ ID NO: 117566 - RNA, 25 nt, Human
agccccagagagaggauguggaaag

SEQ ID NO: 117567 - RNA, 26 nt, Human
cggucauauucuucuuuggcuucugg

SEQ ID NO: 117568 - RNA, 21 nt, Human
gccgggugucgcucacacaac

SEQ ID NO: 117569 - RNA, 23 nt, Human
ugccuccagaauggucuuucuaa

SEQ ID NO: 117570 - RNA, 27 nt, Human
cucuggcccaguuuccaaugaauaaag

SEQ ID NO: 117571 - RNA, 24 nt, Human
gcggucccuccagaggauuugagg

SEQ ID NO: 117572 - RNA, 21 nt, Human
uuuugcuacuaaguucacauu

SEQ ID NO: 117573 - RNA, 26 nt, Human
uaaaagucuuuuccacaaaccaccau

SEQ ID NO: 117574 - RNA, 19 nt, Human
ggggugagacaaggaagag

SEQ ID NO: 117575 - RNA, 24 nt, Human
ggaggaggaaaccggcggagcagc

SEQ ID NO: 117576 - RNA, 26 nt, Human
acuggcagggggagaaaguaaacaga

SEQ ID NO: 117577 - RNA, 22 nt, Human
caggcuggagugcaauggcgua

SEQ ID NO: 117578 - RNA, 27 nt, Human
ggaggcugaagcggguugggggaucug

SEQ ID NO: 117579 - RNA, 21 nt, Human
acuaggguccauaugagggaa

SEQ ID NO: 117580 - RNA, 19 nt, Human
cgcuggaugccucucucca

SEQ ID NO: 117581 - RNA, 18 nt, Human
ggccucgggaagaccuuc

SEQ ID NO: 117582 - RNA, 19 nt, Human
agcaggaagaacauugauu

SEQ ID NO: 117583 - RNA, 25 nt, Human
gucucugucccgguucaccuugccg

SEQ ID NO: 117584 - RNA, 25 nt, Human
auuguccuagaugcuggagugagau

SEQ ID NO: 117585 - RNA, 23 nt, Human
uccuauuuuaaaaccaugcagcu

SEQ ID NO: 117586 - RNA, 22 nt, Human
ucuacuuugaggaaaccaaagu

SEQ ID NO: 117587 - RNA, 22 nt, Human
ucuccacugugaacucugugau

SEQ ID NO: 117588 - RNA, 18 nt, Human
gaacaacauuccuaauuc

SEQ ID NO: 117589 - RNA, 19 nt, Human
cagccuauuuuauacuuuu

SEQ ID NO: 117590 - RNA, 22 nt, Human
uuguggccacuggguaugugug

SEQ ID NO: 117591 - RNA, 22 nt, Human
auguucuucaaaaucuugggga

SEQ ID NO: 117592 - RNA, 22 nt, Human
acacuauauacagaugcaagca

SEQ ID NO: 117593 - RNA, 24 nt, Human
cauuaagaucaugagcccuuuuuc

SEQ ID NO: 117594 - RNA, 25 nt, Human
gcucuguccuacuuacagcacuuug

SEQ ID NO: 117595 - RNA, 21 nt, Human
gacacugcccugcuuccucca

SEQ ID NO: 117596 - RNA, 26 nt, Human
gucuucucagcuucugaguugaauuu

SEQ ID NO: 117597 - RNA, 27 nt, Human
ggucucgaacuccugaccucaagcgau

SEQ ID NO: 117598 - RNA, 21 nt, Human
ccagccuggguggcagaguga

SEQ ID NO: 117599 - RNA, 23 nt, Human
uucauuugaugcauugacuuuaa

SEQ ID NO: 117600 - RNA, 22 nt, Human
ugggaggcggggaggagcagcg

SEQ ID NO: 117601 - RNA, 20 nt, Human
ugucaucaccauggaaacaa

SEQ ID NO: 117602 - RNA, 22 nt, Human
cagaauaauagauaaaugauuu

SEQ ID NO: 117603 - RNA, 24 nt, Human
gguguuuggaaacugggauauuuc

SEQ ID NO: 117604 - RNA, 27 nt, Human
gaggaagagggugucugcccuucacaa

SEQ ID NO: 117605 - RNA, 21 nt, Human
acucagcugccaugcccaguu

SEQ ID NO: 117606 - RNA, 26 nt, Human
guuuuuaaaaaauaaucuaggaaaug

SEQ ID NO: 117607 - RNA, 17 nt, Human
cccaaauaaaugccuug

SEQ ID NO: 117608 - RNA, 23 nt, Human
acauuuuucuucuaagauggaac

SEQ ID NO: 117609 - RNA, 26 nt, Human
gcaucccaccuccugcccuccauacc

SEQ ID NO: 117610 - RNA, 23 nt, Human
ggacgaucugucucucugcucca

SEQ ID NO: 117611 - RNA, 26 nt, Human
uagagggagcccuaccccuuccacaa

SEQ ID NO: 117612 - RNA, 19 nt, Human
guuuguaaaagagcuguuc

SEQ ID NO: 117613 - RNA, 25 nt, Human
uucucccguauuuguuaccuuccug

SEQ ID NO: 117614 - RNA, 18 nt, Human
agaugaggacagagcugg

SEQ ID NO: 117615 - RNA, 22 nt, Human
ugccaaacuguuuccaaagcau

SEQ ID NO: 117616 - RNA, 22 nt, Human
aacaagggguuagauguugcau

SEQ ID NO: 117617 - RNA, 26 nt, Human
ggcugcuggaggaaaacugagacuca

SEQ ID NO: 117618 - RNA, 21 nt, Human
gugggcgcuggcagucucagc

SEQ ID NO: 117619 - RNA, 23 nt, Human
ucgcugcagccuccaccgugcug

SEQ ID NO: 117620 - RNA, 22 nt, Human
uucugacccagggcugagacag

SEQ ID NO: 117621 - RNA, 26 nt, Human
cuuucugcuggaagcugucaggcugg

SEQ ID NO: 117622 - RNA, 24 nt, Human
agucauaguuuagaugaaaccauu

SEQ ID NO: 117623 - RNA, 20 nt, Human
uuagagacuaucaacucccu

SEQ ID NO: 117624 - RNA, 27 nt, Human
aggccagaguugcaaagaucuuuucca

SEQ ID NO: 117625 - RNA, 24 nt, Human
gugaagccgagucacaggacccgg

SEQ ID NO: 117626 - RNA, 20 nt, Human
uguauacacaugcugccuuc

SEQ ID NO: 117627 - RNA, 22 nt, Human
uagguuuuaacaagaaagcuuu

SEQ ID NO: 117628 - RNA, 22 nt, Human
gcaccucggccagcaucuccua

SEQ ID NO: 117629 - RNA, 23 nt, Human
ugugcuccugggcaccgcgcagu

SEQ ID NO: 117630 - RNA, 21 nt, Human
uucuucaaaaaugcuguuaua

SEQ ID NO: 117631 - RNA, 24 nt, Human
ucugccuggccuugagccgugacc

SEQ ID NO: 117632 - RNA, 27 nt, Human
accuccugcagggagccuucugccacc

SEQ ID NO: 117633 - RNA, 29 nt, Human
ucuccaucuggccuucauccuucucccuu

SEQ ID NO: 117634 - RNA, 23 nt, Human
aaguguguguuggggggaacagg

SEQ ID NO: 117635 - RNA, 21 nt, Human
auagggagacccugucucugc

SEQ ID NO: 117636 - RNA, 23 nt, Human
ucuguacuuaaucauauauucua

SEQ ID NO: 117637 - RNA, 21 nt, Human
uccagcccauaagacuaaggg

SEQ ID NO: 117638 - RNA, 20 nt, Human
agacuauucaaacagucuca

SEQ ID NO: 117639 - RNA, 27 nt, Human
cggagagagaagacguggagggaggga

SEQ ID NO: 117640 - RNA, 22 nt, Human
gccuugaccuccuggguuccgg

SEQ ID NO: 117641 - RNA, 22 nt, Human
augccuaugaauucuucuaaua

SEQ ID NO: 117642 - RNA, 21 nt, Human
gcuaacccuucguugugcaca

SEQ ID NO: 117643 - RNA, 24 nt, Human
ggcaggcagcaucacacugggguc

SEQ ID NO: 117644 - RNA, 21 nt, Human
augucugccuggagugcugug

SEQ ID NO: 117645 - RNA, 27 nt, Human
aaguccccaggagcuacacugauacug

SEQ ID NO: 117646 - RNA, 22 nt, Human
acagauuucugccuuguuuugc

SEQ ID NO: 117647 - RNA, 24 nt, Human
aacugcuuuggguaaacugagcag

SEQ ID NO: 117648 - RNA, 20 nt, Human
ucaaacccauggagacagaa

SEQ ID NO: 117649 - RNA, 18 nt, Human
uugcuaccucuucaaguu

SEQ ID NO: 117650 - RNA, 24 nt, Human
aggugauugugccaggcucugcgc

SEQ ID NO: 117651 - RNA, 21 nt, Human
uuucaggauuugggugucaca

SEQ ID NO: 117652 - RNA, 23 nt, Human
agugaguccuccuggccggccgg

SEQ ID NO: 117653 - RNA, 23 nt, Human
aaaugaugcuuauuucuuugcca

SEQ ID NO: 117654 - RNA, 20 nt, Human
ccuaguucuuucccugcuua

SEQ ID NO: 117655 - RNA, 20 nt, Human
ggccuagucaccccaccucg

SEQ ID NO: 117656 - RNA, 23 nt, Human
uucacaguguggcagcugcacua

SEQ ID NO: 117657 - RNA, 25 nt, Human
uguguucagagagaaugcaaugugu

SEQ ID NO: 117658 - RNA, 27 nt, Human
gcagagcuaggcugggaggagcccagg

SEQ ID NO: 117659 - RNA, 22 nt, Human
guauccagcagaggggagaaga

SEQ ID NO: 117660 - RNA, 21 nt, Human
ccucuguccccacaaccaaag

SEQ ID NO: 117661 - RNA, 19 nt, Human
agcuacaggugagcauuuu

SEQ ID NO: 117662 - RNA, 22 nt, Human
ucauguuuucaucaaucuaagg

SEQ ID NO: 117663 - RNA, 19 nt, Human
auucauccugauguccuca

SEQ ID NO: 117664 - RNA, 27 nt, Human
gaguagcugggauuucaggccaugaaa

SEQ ID NO: 117665 - RNA, 28 nt, Human
gacauccaguaaaauucacccuuuggaa

SEQ ID NO: 117666 - RNA, 26 nt, Human
uuccucucacauacaugcucugucuc

SEQ ID NO: 117667 - RNA, 26 nt, Human
gcugauaguugaucacacauugugcu

SEQ ID NO: 117668 - RNA, 21 nt, Human
cuuaauugcucuaugccucag

SEQ ID NO: 117669 - RNA, 24 nt, Human
uuacaggaaccaccuacucuuuca

SEQ ID NO: 117670 - RNA, 27 nt, Human
ccccagccauggugaggaagccccaag

SEQ ID NO: 117671 - RNA, 23 nt, Human
cggcuacagaaacagccuaaguu

SEQ ID NO: 117672 - RNA, 23 nt, Human
acucacugugucugaucugucuc

SEQ ID NO: 117673 - RNA, 22 nt, Human
cuaauaaucaucaccacaccgg

SEQ ID NO: 117674 - RNA, 19 nt, Human
gaaggucuuucuuuacuua

SEQ ID NO: 117675 - RNA, 26 nt, Human
gccagaccucacuggccuggcuggac

SEQ ID NO: 117676 - RNA, 21 nt, Human
aagcuccccucuuccucucuu

SEQ ID NO: 117677 - RNA, 29 nt, Human
aguuugcaaugucacaaccucucugaucu

SEQ ID NO: 117678 - RNA, 27 nt, Human
uacugccugcuguuuucuaagcauugc

SEQ ID NO: 117679 - RNA, 23 nt, Human
uucuuugcuuauuuuuuaacgcc

SEQ ID NO: 117680 - RNA, 20 nt, Human
aucgcaguauacuguauuua

SEQ ID NO: 117681 - RNA, 26 nt, Human
uagcuuaaucucuauguuucucucca

SEQ ID NO: 117682 - RNA, 23 nt, Human
gcaagcucaggagcagccucgug

SEQ ID NO: 117683 - RNA, 24 nt, Human
ggaccucgggaccuggacgccguc

SEQ ID NO: 117684 - RNA, 24 nt, Human
ggaggaaaagaaaaaacaaaggca

SEQ ID NO: 117685 - RNA, 21 nt, Human
ccuguuaucaguagugccuuu

SEQ ID NO: 117686 - RNA, 25 nt, Human
ggacucucggcucuucacugcuccu

SEQ ID NO: 117687 - RNA, 27 nt, Human
uuuucuuucuuuuuccgcgagggcugu

SEQ ID NO: 117688 - RNA, 28 nt, Human
uccagcagaaccuccucagucucaguac

SEQ ID NO: 117689 - RNA, 29 nt, Human
uguugcugaccagcuggagugagggccuc

SEQ ID NO: 117690 - RNA, 26 nt, Human
accacauucccauucacuuugauuuu

SEQ ID NO: 117691 - RNA, 21 nt, Human
cucuccaaagugaaagggaag

SEQ ID NO: 117692 - RNA, 23 nt, Human
gcccagaaugaggcugcuuucca

SEQ ID NO: 117693 - RNA, 24 nt, Human
agcagcagcagcagcagcacaaac

SEQ ID NO: 117694 - RNA, 21 nt, Human
ccuuccuaauuuccugcucca

SEQ ID NO: 117695 - RNA, 22 nt, Human
uccucaagaucauucaguguuu

SEQ ID NO: 117696 - RNA, 22 nt, Human
aucccaggucucauccuucagg

SEQ ID NO: 117697 - RNA, 19 nt, Human
cugggagggguggagcugc

SEQ ID NO: 117698 - RNA, 25 nt, Human
aaauuuauaucauuaacaaugugug

SEQ ID NO: 117699 - RNA, 24 nt, Human
cugauacuguaguucacuguagaa

SEQ ID NO: 117700 - RNA, 22 nt, Human
agccuccccaguagcugggauu

SEQ ID NO: 117701 - RNA, 18 nt, Human
cuaccaggugagcacuca

SEQ ID NO: 117702 - RNA, 25 nt, Human
ggagacuccggcgaacucagacacc

SEQ ID NO: 117703 - RNA, 23 nt, Human
agacugucccugaaaccuaguac

SEQ ID NO: 117704 - RNA, 24 nt, Human
aagcucucccucccuacucccugg

SEQ ID NO: 117705 - RNA, 21 nt, Human
aacccugucucagugcauuuu

SEQ ID NO: 117706 - RNA, 23 nt, Human
agugcacugucccaucuguacgc

SEQ ID NO: 117707 - RNA, 26 nt, Human
aauacugaaggacacagcagugguau

SEQ ID NO: 117708 - RNA, 23 nt, Human
gccaacucgccaccacugcugcc

SEQ ID NO: 117709 - RNA, 23 nt, Human
uggacuaucaccuguccagggga

SEQ ID NO: 117710 - RNA, 22 nt, Human
gucaagcaaccacagucuguua

SEQ ID NO: 117711 - RNA, 24 nt, Human
caccaggcuggugcccugcagcug

SEQ ID NO: 117712 - RNA, 22 nt, Human
gaucugggaaugggguggagag

SEQ ID NO: 117713 - RNA, 22 nt, Human
gugucuuggaaucuagccgaug

SEQ ID NO: 117714 - RNA, 20 nt, Human
gccaaggcuggagugcagug

SEQ ID NO: 117715 - RNA, 24 nt, Human
gcccaggcuuggaggccagcugga

SEQ ID NO: 117716 - RNA, 22 nt, Human
gggcgaggugacagcagaggag

SEQ ID NO: 117717 - RNA, 27 nt, Human
cacugcucuccagccuggcgacagagg

SEQ ID NO: 117718 - RNA, 21 nt, Human
acucuuuauuaaacacacucc

SEQ ID NO: 117719 - RNA, 20 nt, Human
aggagguugagaaugcagug

SEQ ID NO: 117720 - RNA, 20 nt, Human
uuuuagaugagagaucauua

SEQ ID NO: 117721 - RNA, 28 nt, Human
uaguguuuuaccaccaacugccuuucuu

SEQ ID NO: 117722 - RNA, 21 nt, Human
cccaccaaggcugagacagug

SEQ ID NO: 117723 - RNA, 23 nt, Human
ccugaguccgggaggcaccgucc

SEQ ID NO: 117724 - RNA, 22 nt, Human
gccaugagggcuggagaccaga

SEQ ID NO: 117725 - RNA, 21 nt, Human
cuuggagucaguccacucaua

SEQ ID NO: 117726 - RNA, 21 nt, Human
uggacaggagucagugucugg

SEQ ID NO: 117727 - RNA, 23 nt, Human
augccuggcccuauguguguuuu

SEQ ID NO: 117728 - RNA, 22 nt, Human
cuaagcugggcagacggagcac

SEQ ID NO: 117729 - RNA, 19 nt, Human
agcacugcaccugccucca

SEQ ID NO: 117730 - RNA, 20 nt, Human
gccggacccuccaccuggag

SEQ ID NO: 117731 - RNA, 23 nt, Human
uuuucugcaaugguuuaguggcu

SEQ ID NO: 117732 - RNA, 19 nt, Human
guagggcugcuaugccugu

SEQ ID NO: 117733 - RNA, 23 nt, Human
cuguuugcuggcucaggcugagg

SEQ ID NO: 117734 - RNA, 23 nt, Human
agagcuguucagcuuaccugcca

SEQ ID NO: 117735 - RNA, 20 nt, Human
caacaugaaaacuccauauu

SEQ ID NO: 117736 - RNA, 21 nt, Human
uguucacugcaaccucugccu

SEQ ID NO: 117737 - RNA, 21 nt, Human
aguucucugaggcagaagggg

SEQ ID NO: 117738 - RNA, 24 nt, Human
ugugaacugcuuucaagucugacu

SEQ ID NO: 117739 - RNA, 16 nt, Human
aagguuagaagccuga

SEQ ID NO: 117740 - RNA, 23 nt, Human
gcugcuuuguuguucugccuguc

SEQ ID NO: 117741 - RNA, 22 nt, Human
ucuagggacguucucucuccag

SEQ ID NO: 117742 - RNA, 27 nt, Human
ccaccgccucugcucguggcgugggaa

SEQ ID NO: 117743 - RNA, 23 nt, Human
uguuugacauuuucagcacuucc

SEQ ID NO: 117744 - RNA, 25 nt, Human
guggcuuucccugcagagccggugu

SEQ ID NO: 117745 - RNA, 26 nt, Human
ggacaaucgcaggcagauacgaggaa

SEQ ID NO: 117746 - RNA, 24 nt, Human
ugaggagaaugaauugguuaucag

SEQ ID NO: 117747 - RNA, 22 nt, Human
gccuaggcuggagugcaguggc

SEQ ID NO: 117748 - RNA, 22 nt, Human
uucaguauuuuuaaauuguaaa

SEQ ID NO: 117749 - RNA, 25 nt, Human
cucauuucauggagucuucugauca

SEQ ID NO: 117750 - RNA, 26 nt, Human
auuacagugccacugcaauccagccu

SEQ ID NO: 117751 - RNA, 25 nt, Human
cccacccccauacugguacugcugu

SEQ ID NO: 117752 - RNA, 24 nt, Human
aaccauggugcuauuauuaggcuu

SEQ ID NO: 117753 - RNA, 24 nt, Human
ccauccgcaucuggagcaccaagg

SEQ ID NO: 117754 - RNA, 23 nt, Human
ggccuggagagugccugucuggg

SEQ ID NO: 117755 - RNA, 19 nt, Human
cuggugucugccauccccc

SEQ ID NO: 117756 - RNA, 26 nt, Human
uagucccgggcuggcgggagugcagu

SEQ ID NO: 117757 - RNA, 25 nt, Human
ucaagccaggagacccugucugggg

SEQ ID NO: 117758 - RNA, 29 nt, Human
caccucgcucuaccccaggaaaaugugag

SEQ ID NO: 117759 - RNA, 22 nt, Human
gcagccucagccccaggcacag

SEQ ID NO: 117760 - RNA, 21 nt, Human
ugcccugccacuuugcauggu

SEQ ID NO: 117761 - RNA, 23 nt, Human
ccaaaacacacaguuaccugguu

SEQ ID NO: 117762 - RNA, 24 nt, Human
ccucaacuaugaccucaaccggcc

SEQ ID NO: 117763 - RNA, 24 nt, Human
ugacugucaguugccaaauaucuu

SEQ ID NO: 117764 - RNA, 24 nt, Human
auggcuugacaugugcaauuguga

SEQ ID NO: 117765 - RNA, 21 nt, Human
ggcugaauuucauuuuuucca

SEQ ID NO: 117766 - RNA, 27 nt, Human
agcggaguggauggcagaggugggcug

SEQ ID NO: 117767 - RNA, 22 nt, Human
cguaaucccuguuguccuccag

SEQ ID NO: 117768 - RNA, 22 nt, Human
uucgccccccucuugcgcccgc

SEQ ID NO: 117769 - RNA, 26 nt, Human
ccgugcagcugcccaggcgcuauggc

SEQ ID NO: 117770 - RNA, 17 nt, Human
acucccuaauacacauu

SEQ ID NO: 117771 - RNA, 27 nt, Human
gucuggcugagcccugcuugguugucu

SEQ ID NO: 117772 - RNA, 21 nt, Human
acucacauucucuucccagug

SEQ ID NO: 117773 - RNA, 22 nt, Human
cacuguuugagucucauagggc

SEQ ID NO: 117774 - RNA, 24 nt, Human
cagcuuccuguccccaucugucgg

SEQ ID NO: 117775 - RNA, 23 nt, Human
ccacuccuuggcuggaggcagug

SEQ ID NO: 117776 - RNA, 27 nt, Human
uuugaaaaguggauauuucuauaugcc

SEQ ID NO: 117777 - RNA, 26 nt, Human
ccugagcagaauacuggucucaggcc

SEQ ID NO: 117778 - RNA, 26 nt, Human
ggaaggagagagugcgccggagcagc

SEQ ID NO: 117779 - RNA, 22 nt, Human
ccaaguagcuaagaccacaggc

SEQ ID NO: 117780 - RNA, 23 nt, Human
cggggagacggagguugcaguga

SEQ ID NO: 117781 - RNA, 26 nt, Human
uggcccuuccccaucuagaacugcca

SEQ ID NO: 117782 - RNA, 23 nt, Human
accccaucucucucuuauaucac

SEQ ID NO: 117783 - RNA, 23 nt, Human
uuugcagccacacauguacauau

SEQ ID NO: 117784 - RNA, 25 nt, Human
ucagggcugugccucugggagccac

SEQ ID NO: 117785 - RNA, 21 nt, Human
uugaagcccccaggggugggg

SEQ ID NO: 117786 - RNA, 26 nt, Human
cagcagcaaccacuagccuccugccc

SEQ ID NO: 117787 - RNA, 25 nt, Human
aaugucugcaugauauuugugcaca

SEQ ID NO: 117788 - RNA, 21 nt, Human
cauuguuaauugccauccuuc

SEQ ID NO: 117789 - RNA, 21 nt, Human
acaucacaacaucugcucuuc

SEQ ID NO: 117790 - RNA, 23 nt, Human
ggcagggggagagccugggcuga

SEQ ID NO: 117791 - RNA, 21 nt, Human
uauacucuuguauaaauuucu

SEQ ID NO: 117792 - RNA, 20 nt, Human
uuuauucauaccuacucuga

SEQ ID NO: 117793 - RNA, 25 nt, Human
agggagggguggcagaggaucugca

SEQ ID NO: 117794 - RNA, 19 nt, Human
ccugccccagccuguguag

SEQ ID NO: 117795 - RNA, 27 nt, Human
ggacuccuuguucugcucuggcaagag

SEQ ID NO: 117796 - RNA, 20 nt, Human
ucacauggacccaagauaaa

SEQ ID NO: 117797 - RNA, 22 nt, Human
cccuaucucucacucuggaccc

SEQ ID NO: 117798 - RNA, 23 nt, Human
uacuuuguuagccauguguuuau

SEQ ID NO: 117799 - RNA, 20 nt, Human
gaacacaguugaguauuuga

SEQ ID NO: 117800 - RNA, 22 nt, Human
uggucucccuccagcuggaauu

SEQ ID NO: 117801 - RNA, 24 nt, Human
uggaaagaggacaaguuugagagg

SEQ ID NO: 117802 - RNA, 27 nt, Human
ugacucaugcagacaucuauuacaugg

SEQ ID NO: 117803 - RNA, 21 nt, Human
ucccccaaacucuacucuuau

SEQ ID NO: 117804 - RNA, 19 nt, Human
ucaggaaagaaauguugug

SEQ ID NO: 117805 - RNA, 20 nt, Human
ucaucccuggcuguggauag

SEQ ID NO: 117806 - RNA, 21 nt, Human
augaaaugccauaagacccaa

SEQ ID NO: 117807 - RNA, 21 nt, Human
gagagugagguaguggcgaga

SEQ ID NO: 117808 - RNA, 22 nt, Human
cacccccuccagccagaggcga

SEQ ID NO: 117809 - RNA, 23 nt, Human
ccucuugcuaccuccaccuccac

SEQ ID NO: 117810 - RNA, 24 nt, Human
ggacugagaggggagagagacugg

SEQ ID NO: 117811 - RNA, 24 nt, Human
cccggcugccucugcugcaguuca

SEQ ID NO: 117812 - RNA, 21 nt, Human
cagggagggaggcagcugcug

SEQ ID NO: 117813 - RNA, 23 nt, Human
cacaggcacacgaugcucuggga

SEQ ID NO: 117814 - RNA, 22 nt, Human
uggaucacgccuguaaucccag

SEQ ID NO: 117815 - RNA, 23 nt, Human
gaucacuggugugauaaacccca

SEQ ID NO: 117816 - RNA, 23 nt, Human
ccuuugucuccaaccuccauuuc

SEQ ID NO: 117817 - RNA, 22 nt, Human
augccugugaggagccgugcuu

SEQ ID NO: 117818 - RNA, 24 nt, Human
acuaacacaagagcuuccagugcc

SEQ ID NO: 117819 - RNA, 26 nt, Human
uuuuggcuucuuaaacuucauauuug

SEQ ID NO: 117820 - RNA, 21 nt, Human
cagguggcaccgguggcccug

SEQ ID NO: 117821 - RNA, 23 nt, Human
gcaaaaucaccacgacucuuuca

SEQ ID NO: 117822 - RNA, 30 nt, Human
ggcggagaagugccucaggaguccugacgc

SEQ ID NO: 117823 - RNA, 19 nt, Human
ugccuggugugguggugca

SEQ ID NO: 117824 - RNA, 23 nt, Human
cccaggccucagaguuucagggc

SEQ ID NO: 117825 - RNA, 29 nt, Human
guccaauuuacaggcuggagcagcagcug

SEQ ID NO: 117826 - RNA, 23 nt, Human
cuggugcuugcccagcuuuuuga

SEQ ID NO: 117827 - RNA, 24 nt, Human
ugcaggaggugggggagacacaaa

SEQ ID NO: 117828 - RNA, 23 nt, Human
cugggaguuagagguugcaguga

SEQ ID NO: 117829 - RNA, 20 nt, Human
agguuucuuuagcaaguucu

SEQ ID NO: 117830 - RNA, 27 nt, Human
ggucucgaucuccugaccuugugaucc

SEQ ID NO: 117831 - RNA, 22 nt, Human
ccagcuccuggccaucuguaga

SEQ ID NO: 117832 - RNA, 19 nt, Human
cucaguuaggcagugcagu

SEQ ID NO: 117833 - RNA, 22 nt, Human
gggaggaagcccuucugccuuu

SEQ ID NO: 117834 - RNA, 27 nt, Human
augagccuuacagacacacagagacac

SEQ ID NO: 117835 - RNA, 23 nt, Human
uccaugaaaaugacuuccagaaa

SEQ ID NO: 117836 - RNA, 23 nt, Human
cgaguagcugggauuacagguau

SEQ ID NO: 117837 - RNA, 19 nt, Human
gccaucacagagaacgucu

SEQ ID NO: 117838 - RNA, 24 nt, Human
agggaauaacugcaaacuggacag

SEQ ID NO: 117839 - RNA, 21 nt, Human
gcucacugcagccucaaacuc

SEQ ID NO: 117840 - RNA, 22 nt, Human
gugaucuuggcuuacugcagcc

SEQ ID NO: 117841 - RNA, 22 nt, Human
ccugaguagcugggacugcagg

SEQ ID NO: 117842 - RNA, 21 nt, Human
uacuuggggugggaggggaga

SEQ ID NO: 117843 - RNA, 19 nt, Human
ccagucuggagugcagugg

SEQ ID NO: 117844 - RNA, 20 nt, Human
gugucccagggcaagccacc

SEQ ID NO: 117845 - RNA, 24 nt, Human
uccagucaugaauucagaccagga

SEQ ID NO: 117846 - RNA, 22 nt, Human
agagaaggccuccugcagcugu

SEQ ID NO: 117847 - RNA, 20 nt, Human
uccaugucauauauggagug

SEQ ID NO: 117848 - RNA, 21 nt, Human
aagugguucagguuggugcag

SEQ ID NO: 117849 - RNA, 20 nt, Human
gaggaagagggagucuggca

SEQ ID NO: 117850 - RNA, 22 nt, Human
ugcagugagccaaguucacacc

SEQ ID NO: 117851 - RNA, 21 nt, Human
cuccaucggccaucucgacuc

SEQ ID NO: 117852 - RNA, 24 nt, Human
gaggcaggggacaagggaggcagu

SEQ ID NO: 117853 - RNA, 20 nt, Human
uaaaaauuauucacugugug

SEQ ID NO: 117854 - RNA, 21 nt, Human
ucugaugcagcugagaaaaau

SEQ ID NO: 117855 - RNA, 25 nt, Human
aacuauucagauuaugagagcauca

SEQ ID NO: 117856 - RNA, 24 nt, Human
ccagcugcuugggcuucauccucc

SEQ ID NO: 117857 - RNA, 27 nt, Human
cuuuguuguuugaauggaaauggaaaa

SEQ ID NO: 117858 - RNA, 21 nt, Human
uauugauuauagcaaugugau

SEQ ID NO: 117859 - RNA, 21 nt, Human
aggacccagacccacccuggg

SEQ ID NO: 117860 - RNA, 22 nt, Human
ccgugcguacuggcuguggacc

SEQ ID NO: 117861 - RNA, 21 nt, Human
uucuguugcucugaagccauc

SEQ ID NO: 117862 - RNA, 20 nt, Human
aggcccaccugccucugucu

SEQ ID NO: 117863 - RNA, 25 nt, Human
agcaaaggaugcaucuucccacagc

SEQ ID NO: 117864 - RNA, 21 nt, Human
ccugugaggacaacagccugg

SEQ ID NO: 117865 - RNA, 21 nt, Human
gcugccaaggguggacacggc

SEQ ID NO: 117866 - RNA, 19 nt, Human
guuuaaaaaucaacuggua

SEQ ID NO: 117867 - RNA, 21 nt, Human
cgcucacugccaccuccgccu

SEQ ID NO: 117868 - RNA, 24 nt, Human
gcccaggcuggagugcauuggcgc

SEQ ID NO: 117869 - RNA, 22 nt, Human
uuuaaacuuugaugcuuaguua

SEQ ID NO: 117870 - RNA, 22 nt, Human
acccucccauguagcugggauu

SEQ ID NO: 117871 - RNA, 23 nt, Human
gcuguggaugaacgaugauguca

SEQ ID NO: 117872 - RNA, 25 nt, Human
ccccaggcuggagugcaguggcaug

SEQ ID NO: 117873 - RNA, 17 nt, Human
acggaagucccuccacu

SEQ ID NO: 117874 - RNA, 22 nt, Human
ugcaguaagcugagaucgugcc

SEQ ID NO: 117875 - RNA, 20 nt, Human
uggaagcuuccaguccaauc

SEQ ID NO: 117876 - RNA, 21 nt, Human
gcucuuuccccugucacuccc

SEQ ID NO: 117877 - RNA, 22 nt, Human
ggacuugaaaaccacuagggca

SEQ ID NO: 117878 - RNA, 24 nt, Human
gagacuugcaccuuggacaagcca

SEQ ID NO: 117879 - RNA, 22 nt, Human
acgguaaccucugccucccagg

SEQ ID NO: 117880 - RNA, 22 nt, Human
ccccagacuucauagaauacuc

SEQ ID NO: 117881 - RNA, 29 nt, Human
gggagaauggggagagggaccuccuugug

SEQ ID NO: 117882 - RNA, 21 nt, Human
caccucccagguucaagcgau

SEQ ID NO: 117883 - RNA, 22 nt, Human
gaucucgaacuccuaaccucaa

SEQ ID NO: 117884 - RNA, 22 nt, Human
gaucucaaacuccugaccucaa

SEQ ID NO: 117885 - RNA, 22 nt, Human
cgggcgcaucaagaucuuccag

SEQ ID NO: 117886 - RNA, 24 nt, Human
aagaacucauggccacuguggaaa

SEQ ID NO: 117887 - RNA, 22 nt, Human
gcguugggaggagcagagccag

SEQ ID NO: 117888 - RNA, 18 nt, Human
cacuccucucaagcaagc

SEQ ID NO: 117889 - RNA, 27 nt, Human
gagagugaggcauugagggccaauagg

SEQ ID NO: 117890 - RNA, 22 nt, Human
ucugcugcccaggcuggaguac

SEQ ID NO: 117891 - RNA, 21 nt, Human
gcucacugcaagcuccaacuc

SEQ ID NO: 117892 - RNA, 22 nt, Human
gaaaggagggagcagcaacugg

SEQ ID NO: 117893 - RNA, 20 nt, Human
gcacacacccuuaauuuuua

SEQ ID NO: 117894 - RNA, 29 nt, Human
gggggccaggagagcaggaacagaacaga

SEQ ID NO: 117895 - RNA, 22 nt, Human
ugcugccuccccucaucgaucc

SEQ ID NO: 117896 - RNA, 22 nt, Human
uggugauuuuagauuucuuuga

SEQ ID NO: 117897 - RNA, 27 nt, Human
ccccaacaacaggaucacaagcuggag

SEQ ID NO: 117898 - RNA, 26 nt, Human
gccagccaacucggggaaacuucguu

SEQ ID NO: 117899 - RNA, 27 nt, Human
gcuccaaggcaguggaaauaaaaagaa

SEQ ID NO: 117900 - RNA, 22 nt, Human
uuuugucagaaaagagccacuu

SEQ ID NO: 117901 - RNA, 21 nt, Human
cccgcucucccugucacgcuc

SEQ ID NO: 117902 - RNA, 24 nt, Human
uaauccagcgcugccucugcugcc

SEQ ID NO: 117903 - RNA, 21 nt, Human
aaaauagaaaaauuagccagg

SEQ ID NO: 117904 - RNA, 21 nt, Human
aggagggagaggagggaaagu

SEQ ID NO: 117905 - RNA, 25 nt, Human
guguuuuggaaguaugcaugcaggc

SEQ ID NO: 117906 - RNA, 20 nt, Human
cagcagggguuucagccuga

SEQ ID NO: 117907 - RNA, 26 nt, Human
caagucaccagagggugguucuguag

SEQ ID NO: 117908 - RNA, 23 nt, Human
cuugcuggaaugaacagugugcu

SEQ ID NO: 117909 - RNA, 27 nt, Human
gcucacugcaagcucuaccucuugguu

SEQ ID NO: 117910 - RNA, 22 nt, Human
ccgagaucacaccacugcacuc

SEQ ID NO: 117911 - RNA, 23 nt, Human
cuccaucuacacggccuggggcg

SEQ ID NO: 117912 - RNA, 22 nt, Human
cccugguauuuggacacuccuc

SEQ ID NO: 117913 - RNA, 25 nt, Human
aggugggagaauugcuugagcuugg

SEQ ID NO: 117914 - RNA, 26 nt, Human
gaggaagaagaggggcagugggagca

SEQ ID NO: 117915 - RNA, 23 nt, Human
acccuugcccucagcaagagaga

SEQ ID NO: 117916 - RNA, 19 nt, Human
cccacucuccucugccuca

SEQ ID NO: 117917 - RNA, 23 nt, Human
acauuuaguuaacacacauauau

SEQ ID NO: 117918 - RNA, 21 nt, Human
cacucagaaagacuaaaggaa

SEQ ID NO: 117919 - RNA, 22 nt, Human
caaugacagcauaucaaacuuc

SEQ ID NO: 117920 - RNA, 20 nt, Human
gggugagguaggcgggaaag

SEQ ID NO: 117921 - RNA, 26 nt, Human
caucucaagcaagaauggcguugguu

SEQ ID NO: 117922 - RNA, 23 nt, Human
uacuauggaguauaauucucaca

SEQ ID NO: 117923 - RNA, 22 nt, Human
caugccuauagucccagcacuu

SEQ ID NO: 117924 - RNA, 20 nt, Human
auacaggcccccacagcccg

SEQ ID NO: 117925 - RNA, 23 nt, Human
ggcagacaacacacuagcauuuu

SEQ ID NO: 117926 - RNA, 21 nt, Human
uaaugauacugguucauuuua

SEQ ID NO: 117927 - RNA, 27 nt, Human
cgcaggagggagacagacuggccaggc

SEQ ID NO: 117928 - RNA, 21 nt, Human
uguuagucaggcuggucucga

SEQ ID NO: 117929 - RNA, 23 nt, Human
uuccaauaacccagcuugcgucc

SEQ ID NO: 117930 - RNA, 27 nt, Human
ucugucacccaggcgggaguggugcaa

SEQ ID NO: 117931 - RNA, 26 nt, Human
agcuccacuccuuggcuggaggcagu

SEQ ID NO: 117932 - RNA, 20 nt, Human
ugggaccacagugggcaauu

SEQ ID NO: 117933 - RNA, 22 nt, Human
ucccuagcccuuccagccuggg

SEQ ID NO: 117934 - RNA, 23 nt, Human
gcuagaggcugaccagcagcguu

SEQ ID NO: 117935 - RNA, 28 nt, Human
ccuaggggcagccugaaugccucccuca

SEQ ID NO: 117936 - RNA, 27 nt, Human
cagcccagcgugcccauuccagcgccc

SEQ ID NO: 117937 - RNA, 22 nt, Human
cggggaggagcaggagguggaa

SEQ ID NO: 117938 - RNA, 23 nt, Human
agcacuguuccagccugcccucu

SEQ ID NO: 117939 - RNA, 27 nt, Human
ccacuguacuccagccugaagagcgag

SEQ ID NO: 117940 - RNA, 23 nt, Human
ucacugcaguaucccaacugcag

SEQ ID NO: 117941 - RNA, 22 nt, Human
gcucgaccacaucaucaggucu

SEQ ID NO: 117942 - RNA, 25 nt, Human
ccccauucacuagaagcacugagag

SEQ ID NO: 117943 - RNA, 27 nt, Human
agaagcagcucaaacauuuugauaaaa

SEQ ID NO: 117944 - RNA, 23 nt, Human
agcaugaguacuacaggccaagu

SEQ ID NO: 117945 - RNA, 21 nt, Human
gaccagccugguaaaauagug

SEQ ID NO: 117946 - RNA, 23 nt, Human
gucacagggaggaaggcagcuag

SEQ ID NO: 117947 - RNA, 26 nt, Human
aaacuaagcucaguaacaagaaggca

SEQ ID NO: 117948 - RNA, 30 nt, Human
cugcuaggugugugggguguuucgccugca

SEQ ID NO: 117949 - RNA, 26 nt, Human
acugucccaccgccuccugccucucu

SEQ ID NO: 117950 - RNA, 27 nt, Human
gggagagaaagacaaggagaaaccuga

SEQ ID NO: 117951 - RNA, 27 nt, Human
aggcucucuuccuguucugcaccccuc

SEQ ID NO: 117952 - RNA, 27 nt, Human
uucccacauacuaggugcucaauucau

SEQ ID NO: 117953 - RNA, 23 nt, Human
ggacccaggcaguccaccugcac

SEQ ID NO: 117954 - RNA, 21 nt, Human
caggcaccuccaaccaccaca

SEQ ID NO: 117955 - RNA, 22 nt, Human
gaccagccuggccaaugugaug

SEQ ID NO: 117956 - RNA, 22 nt, Human
uucugcagguguucaagucuua

SEQ ID NO: 117957 - RNA, 25 nt, Human
aaaugauuuggggaacuugaucugu

SEQ ID NO: 117958 - RNA, 20 nt, Human
cgacugccccuccuucuggc

SEQ ID NO: 117959 - RNA, 21 nt, Human
uucagggcacuggcgaaggug

SEQ ID NO: 117960 - RNA, 21 nt, Human
uagcagucgcgagcacauguu

SEQ ID NO: 117961 - RNA, 27 nt, Human
ugccuguagugccagcuacucaggagg

SEQ ID NO: 117962 - RNA, 21 nt, Human
ucuccuggcuaagccucugcu

SEQ ID NO: 117963 - RNA, 27 nt, Human
ccaacuugucuuccuuucucucuuccc

SEQ ID NO: 117964 - RNA, 21 nt, Human
ucagugagccaugaucaugcc

SEQ ID NO: 117965 - RNA, 22 nt, Human
cacuacauaucuaaagcuuuga

SEQ ID NO: 117966 - RNA, 24 nt, Human
gggucugguggggaggagggaagc

SEQ ID NO: 117967 - RNA, 21 nt, Human
uccagccugggugacagagug

SEQ ID NO: 117968 - RNA, 21 nt, Human
uccagccugggcgacagagcg

SEQ ID NO: 117969 - RNA, 16 nt, Human
cuccacccuccuggcc

SEQ ID NO: 117970 - RNA, 25 nt, Human
acgcacuuuugcaggaugaccucag

SEQ ID NO: 117971 - RNA, 26 nt, Human
gaugggauuaugcagauggccuaugg

SEQ ID NO: 117972 - RNA, 22 nt, Human
gaagggagagacugagacugac

SEQ ID NO: 117973 - RNA, 25 nt, Human
ggcugaagcugccugugcacguuuc

SEQ ID NO: 117974 - RNA, 22 nt, Human
cauguuuaggaggaaaaccaga

SEQ ID NO: 117975 - RNA, 24 nt, Human
guugcccaccgaauuugagguagc

SEQ ID NO: 117976 - RNA, 21 nt, Human
cccaacaacauccauguccua

SEQ ID NO: 117977 - RNA, 25 nt, Human
cgcugguugcaggcagaguuuuggg

SEQ ID NO: 117978 - RNA, 22 nt, Human
uggacucaaacuccugcuacau

SEQ ID NO: 117979 - RNA, 28 nt, Human
gcaggcugcacaaguggaagcaacuaau

SEQ ID NO: 117980 - RNA, 27 nt, Human
gaccagccugggcuacagagcaagacc

SEQ ID NO: 117981 - RNA, 23 nt, Human
cgggucucucacuguugcagugg

SEQ ID NO: 117982 - RNA, 25 nt, Human
gucuuucuccauauuguccugcucc

SEQ ID NO: 117983 - RNA, 21 nt, Human
gcguuaaugucaccaguguuc

SEQ ID NO: 117984 - RNA, 22 nt, Human
acccucuguggccgaacccccu

SEQ ID NO: 117985 - RNA, 22 nt, Human
gugcacauuucuuugcauucca

SEQ ID NO: 117986 - RNA, 22 nt, Human
gucacccaggcuggaguguagu

SEQ ID NO: 117987 - RNA, 22 nt, Human
gucacccagguuggagugcagu

SEQ ID NO: 117988 - RNA, 22 nt, Human
guugcccaggcuggagugcggu

SEQ ID NO: 117989 - RNA, 22 nt, Human
guuacccaggcuggagugcagu

SEQ ID NO: 117990 - RNA, 23 nt, Human
gaccagcauuacuaaggcaggug

SEQ ID NO: 117991 - RNA, 22 nt, Human
ccccgugggcauggaccaccuu

SEQ ID NO: 117992 - RNA, 27 nt, Human
guugcccaggcuggucugaagcugcug

SEQ ID NO: 117993 - RNA, 26 nt, Human
ccuuugcugcuauccacugugauuuu

SEQ ID NO: 117994 - RNA, 25 nt, Human
gugccccagggaguccaggguuucu

SEQ ID NO: 117995 - RNA, 22 nt, Human
ccccaguagcugggauuacagg

SEQ ID NO: 117996 - RNA, 16 nt, Human
uauauguguguguaua

SEQ ID NO: 117997 - RNA, 24 nt, Human
gcugaugagagacagcgcaugcug

SEQ ID NO: 117998 - RNA, 22 nt, Human
gaacuccugacgucaagugauc

SEQ ID NO: 117999 - RNA, 20 nt, Human
uccugcucucacacacacca

SEQ ID NO: 118000 - RNA, 23 nt, Human
ugcuccacugccagccggccccc

SEQ ID NO: 118001 - RNA, 19 nt, Human
gcucuagccuuaguugcca

SEQ ID NO: 118002 - RNA, 22 nt, Human
aaaugauuuuguuuucugacug

SEQ ID NO: 118003 - RNA, 20 nt, Human
uuacagguuaaugcauguua

SEQ ID NO: 118004 - RNA, 27 nt, Human
gcugggccuuccgccucccuuggaugg

SEQ ID NO: 118005 - RNA, 25 nt, Human
cuucuuuggaaaccaucacuauuga

SEQ ID NO: 118006 - RNA, 22 nt, Human
ugugcagcugcacaacacaguc

SEQ ID NO: 118007 - RNA, 27 nt, Human
aggagcuagcagacacauccaguaucu

SEQ ID NO: 118008 - RNA, 21 nt, Human
cacccaccaccaugcccagcu

SEQ ID NO: 118009 - RNA, 20 nt, Human
cugucuuccuuguucuagcc

SEQ ID NO: 118010 - RNA, 21 nt, Human
uucuggcuggcgaacuccuac

SEQ ID NO: 118011 - RNA, 22 nt, Human
uuuaaaaaaugaaauagugaug

SEQ ID NO: 118012 - RNA, 22 nt, Human
uuuggaauuugccugcugggau

SEQ ID NO: 118013 - RNA, 21 nt, Human
auauacauuuauuuacacucu

SEQ ID NO: 118014 - RNA, 27 nt, Human
aaacucaucuucuuucaauauaauuga

SEQ ID NO: 118015 - RNA, 22 nt, Human
cugcucuauuccaaaaagguug

SEQ ID NO: 118016 - RNA, 26 nt, Human
aaaugcccaaauuugagaugcauuau

SEQ ID NO: 118017 - RNA, 27 nt, Human
guugcccucgugcccaucaagugcagu

SEQ ID NO: 118018 - RNA, 22 nt, Human
gcaccuugugaucauguuguua

SEQ ID NO: 118019 - RNA, 22 nt, Human
uuacacucuuuaagccauucca

SEQ ID NO: 118020 - RNA, 21 nt, Human
uuacccaggcuggagugcaau

SEQ ID NO: 118021 - RNA, 18 nt, Human
cacgagggagagcgcagc

SEQ ID NO: 118022 - RNA, 23 nt, Human
aucucugcauuauccuauaucau

SEQ ID NO: 118023 - RNA, 29 nt, Human
cuucccuccagccucuccuccauucccua

SEQ ID NO: 118024 - RNA, 22 nt, Human
acuuuauugugagucuuugcca

SEQ ID NO: 118025 - RNA, 24 nt, Human
uguaguauuccagaugagcugcag

SEQ ID NO: 118026 - RNA, 22 nt, Human
ccuuucucucaccccuggagcc

SEQ ID NO: 118027 - RNA, 25 nt, Human
cugauucuucucaguuuucucauuu

SEQ ID NO: 118028 - RNA, 25 nt, Human
ugccacaggcuguaugaaaggccac

SEQ ID NO: 118029 - RNA, 22 nt, Human
cuggcugcugcccaccucucuc

SEQ ID NO: 118030 - RNA, 22 nt, Human
ugggaggcggagauugcaguga

SEQ ID NO: 118031 - RNA, 22 nt, Human
uggggggcggagguugcaguga

SEQ ID NO: 118032 - RNA, 23 nt, Human
cugccccucgggcaccagccugc

SEQ ID NO: 118033 - RNA, 19 nt, Human
gcugaaaagugcuuugcug

SEQ ID NO: 118034 - RNA, 18 nt, Human
cuggcucaaaacuaccua

SEQ ID NO: 118035 - RNA, 26 nt, Human
acagucucacaucugguggggguggg

SEQ ID NO: 118036 - RNA, 26 nt, Human
gcuggggucacuucuuugcccacggg

SEQ ID NO: 118037 - RNA, 24 nt, Human
aacaaaaacuaaaaaccucuuagc

SEQ ID NO: 118038 - RNA, 24 nt, Human
gcucugucaaaagcacaaaaagaa

SEQ ID NO: 118039 - RNA, 19 nt, Human
ugcacucuggcuggggaag

SEQ ID NO: 118040 - RNA, 22 nt, Human
agcccuccagaccuggguggaa

SEQ ID NO: 118041 - RNA, 26 nt, Human
agcaucugagcuaacuuauauuuauu

SEQ ID NO: 118042 - RNA, 22 nt, Human
uggcaccugccuguaaucucag

SEQ ID NO: 118043 - RNA, 26 nt, Human
uugcccagagccaagcuggggcaagg

SEQ ID NO: 118044 - RNA, 18 nt, Human
aggcuuuucucuccaguc

SEQ ID NO: 118045 - RNA, 22 nt, Human
uagucuaccaucaaauauuuua

SEQ ID NO: 118046 - RNA, 23 nt, Human
uuucugcuggaagcugucaggcu

SEQ ID NO: 118047 - RNA, 21 nt, Human
gugccauguuggugugcugca

SEQ ID NO: 118048 - RNA, 23 nt, Human
acauucucgagaacugugcucag

SEQ ID NO: 118049 - RNA, 23 nt, Human
ccaggaggcgaagauugcaguga

SEQ ID NO: 118050 - RNA, 20 nt, Human
uucuucuuccaaaugcaguu

SEQ ID NO: 118051 - RNA, 20 nt, Human
agaguccacuucucagugac

SEQ ID NO: 118052 - RNA, 27 nt, Human
gaggaagaagggucuaaauccuggccu

SEQ ID NO: 118053 - RNA, 25 nt, Human
acugaggcauuuuuacuacuauucu

SEQ ID NO: 118054 - RNA, 24 nt, Human
cugcgggaaggcgcgggagccagg

SEQ ID NO: 118055 - RNA, 20 nt, Human
gggauuuccuuucucucuca

SEQ ID NO: 118056 - RNA, 27 nt, Human
cugcacaucacgacaucccagcccugu

SEQ ID NO: 118057 - RNA, 20 nt, Human
ugcuggacagagcagggcag

SEQ ID NO: 118058 - RNA, 21 nt, Human
gacuuggcaacagaagcaguu

SEQ ID NO: 118059 - RNA, 25 nt, Human
gcguaaggguuaucguuaagcacaa

SEQ ID NO: 118060 - RNA, 26 nt, Human
guucugcugacugaauuggaugcacu

SEQ ID NO: 118061 - RNA, 27 nt, Human
cccgccucccccggcacagccugcuga

SEQ ID NO: 118062 - RNA, 22 nt, Human
ucccuguuuagcauuuucuagu

SEQ ID NO: 118063 - RNA, 26 nt, Human
uaucagaaacuuuaaaauguaaaagu

SEQ ID NO: 118064 - RNA, 20 nt, Human
cuacccauacacccccucuu

SEQ ID NO: 118065 - RNA, 19 nt, Human
ccucuggcaccaccaccac

SEQ ID NO: 118066 - RNA, 24 nt, Human
caggcagaagcaguuggugguguc

SEQ ID NO: 118067 - RNA, 24 nt, Human
ugucacuguccagagucucuuuuu

SEQ ID NO: 118068 - RNA, 21 nt, Human
agcuguguagaguuucugugu

SEQ ID NO: 118069 - RNA, 24 nt, Human
acaugugugugucuacgugugugc

SEQ ID NO: 118070 - RNA, 22 nt, Human
cagcuuugugcuccggcuuucc

SEQ ID NO: 118071 - RNA, 26 nt, Human
cgagacugagcaaaauaucucaugua

SEQ ID NO: 118072 - RNA, 22 nt, Human
aacaacaauuagccauaguucu

SEQ ID NO: 118073 - RNA, 29 nt, Human
ugccuggaucucaccagcacuuucccucu

SEQ ID NO: 118074 - RNA, 19 nt, Human
agggguggagaugggugug

SEQ ID NO: 118075 - RNA, 20 nt, Human
cggcagcagcgauggcagga

SEQ ID NO: 118076 - RNA, 24 nt, Human
gugccuggccccuuccuguaaaau

SEQ ID NO: 118077 - RNA, 22 nt, Human
cuccacccuucuccagggaccc

SEQ ID NO: 118078 - RNA, 26 nt, Human
gcagugccuucccugccugugggggu

SEQ ID NO: 118079 - RNA, 21 nt, Human
uuugcuuguucacugcagucu

SEQ ID NO: 118080 - RNA, 27 nt, Human
gucacucagagaucaggaccagugcuu

SEQ ID NO: 118081 - RNA, 21 nt, Human
gagaagcaggcagcgcaguga

SEQ ID NO: 118082 - RNA, 27 nt, Human
gggagcacuccuugcccccuguuccug

SEQ ID NO: 118083 - RNA, 20 nt, Human
aggacagcaguucauuguua

SEQ ID NO: 118084 - RNA, 20 nt, Human
ccugugggcaccagcagcaa

SEQ ID NO: 118085 - RNA, 22 nt, Human
agaccagccuggcuaacauggu

SEQ ID NO: 118086 - RNA, 22 nt, Human
agaccagccuggccaacauggc

SEQ ID NO: 118087 - RNA, 21 nt, Human
uggucucuacccucacuaccu

SEQ ID NO: 118088 - RNA, 24 nt, Human
cggcaacucaucucaaguuuaugu

SEQ ID NO: 118089 - RNA, 27 nt, Human
gucgcccaggcuggaguacaguggugu

SEQ ID NO: 118090 - RNA, 19 nt, Human
gucggcccugcuuccugcc

SEQ ID NO: 118091 - RNA, 21 nt, Human
gggcugaagaagcaguuccac

SEQ ID NO: 118092 - RNA, 23 nt, Human
ggcgcugugcgcagcgcucgggc

SEQ ID NO: 118093 - RNA, 21 nt, Human
uagaggagcugaggugcuguc

SEQ ID NO: 118094 - RNA, 21 nt, Human
cccagccugggucucucuacu

SEQ ID NO: 118095 - RNA, 22 nt, Human
ucucagggugguccuaugggaa

SEQ ID NO: 118096 - RNA, 19 nt, Human
uccauauuuugcuuucaga

SEQ ID NO: 118097 - RNA, 27 nt, Human
cccugcacuguuuucccuccaccacag

SEQ ID NO: 118098 - RNA, 22 nt, Human
ggauggcagagagccagggcag

SEQ ID NO: 118099 - RNA, 28 nt, Human
cgcugcgugccaucacucaaccauaaca

SEQ ID NO: 118100 - RNA, 21 nt, Human
cucugggcugaauguauguca

SEQ ID NO: 118101 - RNA, 20 nt, Human
uuacugguacugcuuucuaa

SEQ ID NO: 118102 - RNA, 21 nt, Human
gcacaggaaguugaucugggu

SEQ ID NO: 118103 - RNA, 21 nt, Human
ugagccccaaaccuuacuggg

SEQ ID NO: 118104 - RNA, 27 nt, Human
ucaugccaccacauucgccagaaaugc

SEQ ID NO: 118105 - RNA, 24 nt, Human
aggugggcggaucacuugaggucg

SEQ ID NO: 118106 - RNA, 23 nt, Human
cguggagccugacgcacucugag

SEQ ID NO: 118107 - RNA, 21 nt, Human
uuuuuccuucaucugugagug

SEQ ID NO: 118108 - RNA, 22 nt, Human
aucauccugugaaagugguuuc

SEQ ID NO: 118109 - RNA, 18 nt, Human
cugucucuuuuuucagcu

SEQ ID NO: 118110 - RNA, 27 nt, Human
gcacuauauuaccaguauaugguuucc

SEQ ID NO: 118111 - RNA, 20 nt, Human
uucuggccuuguaucuugca

SEQ ID NO: 118112 - RNA, 23 nt, Human
gccuguaaucccagcuacgcagg

SEQ ID NO: 118113 - RNA, 19 nt, Human
cacagccuaaacugagcca

SEQ ID NO: 118114 - RNA, 24 nt, Human
aggaagggcuuauggacugagaaa

SEQ ID NO: 118115 - RNA, 21 nt, Human
gucucccuauguugcccaggc

SEQ ID NO: 118116 - RNA, 19 nt, Human
cuucccuuugucucagugg

SEQ ID NO: 118117 - RNA, 25 nt, Human
caccucugggagcuggaguccacug

SEQ ID NO: 118118 - RNA, 22 nt, Human
cacagcucuccagccugggcga

SEQ ID NO: 118119 - RNA, 23 nt, Human
ccaacagcacagcuaaauuucca

SEQ ID NO: 118120 - RNA, 27 nt, Human
gugcacaaacaauauaaaggcuugcau

SEQ ID NO: 118121 - RNA, 24 nt, Human
ugacauuuaauuuauuagcgcugc

SEQ ID NO: 118122 - RNA, 21 nt, Human
ucaugcauuuuuaaagacaga

SEQ ID NO: 118123 - RNA, 28 nt, Human
aggcuucaaccagccacuccagcuuugu

SEQ ID NO: 118124 - RNA, 16 nt, Human
gagcucggucucucca

SEQ ID NO: 118125 - RNA, 19 nt, Human
uaaucaagaaaauaugcca

SEQ ID NO: 118126 - RNA, 27 nt, Human
ggucucaaacucccgaccucaggugau

SEQ ID NO: 118127 - RNA, 26 nt, Human
uauggacacuacacuggggcccuuca

SEQ ID NO: 118128 - RNA, 21 nt, Human
cagaagaaauaagcccaugca

SEQ ID NO: 118129 - RNA, 26 nt, Human
aucuuucuaacauuccaucuccaucu

SEQ ID NO: 118130 - RNA, 24 nt, Human
ugccggcuccccucgacagcucuc

SEQ ID NO: 118131 - RNA, 20 nt, Human
cuuacaaaaagaaauauuga

SEQ ID NO: 118132 - RNA, 22 nt, Human
aggacagaacauugccuuccuc

SEQ ID NO: 118133 - RNA, 21 nt, Human
agcagcauacuuauuuuuugu

SEQ ID NO: 118134 - RNA, 21 nt, Human
gcgugagccacuuucccagcc

SEQ ID NO: 118135 - RNA, 24 nt, Human
uccuccucccccagaggggugggu

SEQ ID NO: 118136 - RNA, 21 nt, Human
ucaugucuuaaccuaccugga

SEQ ID NO: 118137 - RNA, 22 nt, Human
ucugucacccaggcuagagugc

SEQ ID NO: 118138 - RNA, 22 nt, Human
accucggcugcuccucucacag

SEQ ID NO: 118139 - RNA, 27 nt, Human
cguuguacuccagccugggcaacagag

SEQ ID NO: 118140 - RNA, 19 nt, Human
gcagcacuuguccugugga

SEQ ID NO: 118141 - RNA, 21 nt, Human
ccaggagcccagagggccaag

SEQ ID NO: 118142 - RNA, 18 nt, Human
uuuagcucaaaauguuga

SEQ ID NO: 118143 - RNA, 27 nt, Human
cucauuucuuacucuuuuucucuauau

SEQ ID NO: 118144 - RNA, 21 nt, Human
cgcccaggcuggagugcagug

SEQ ID NO: 118145 - RNA, 21 nt, Human
cacccaggcuggagugcggug

SEQ ID NO: 118146 - RNA, 20 nt, Human
ccagugccagcaccugccca

SEQ ID NO: 118147 - RNA, 21 nt, Human
guccccaggcuggccugagga

SEQ ID NO: 118148 - RNA, 27 nt, Human
uucauucugucuuucugguuccccaug

SEQ ID NO: 118149 - RNA, 27 nt, Human
caccacugucuuccccagucagcuccc

SEQ ID NO: 118150 - RNA, 21 nt, Human
gccugggcugcagaagccagg

SEQ ID NO: 118151 - RNA, 26 nt, Human
ucuuauacaagaguguauuuccccuu

SEQ ID NO: 118152 - RNA, 20 nt, Human
ucccacaggucauucuccug

SEQ ID NO: 118153 - RNA, 27 nt, Human
ccugugcacuguccuggcccccucuua

SEQ ID NO: 118154 - RNA, 26 nt, Human
gagagggagggggaagagcagaaguu

SEQ ID NO: 118155 - RNA, 27 nt, Human
gaaaggagagugaaacucuuauuugca

SEQ ID NO: 118156 - RNA, 22 nt, Human
uucuccuuguuggucaggcugg

SEQ ID NO: 118157 - RNA, 23 nt, Human
ccucauugccuccuguucugccc

SEQ ID NO: 118158 - RNA, 24 nt, Human
uucuggugagggucaaauauuuuu

SEQ ID NO: 118159 - RNA, 20 nt, Human
cucugcuucagacucugggu

SEQ ID NO: 118160 - RNA, 23 nt, Human
guugccuaggcuggaggacagug

SEQ ID NO: 118161 - RNA, 21 nt, Human
gggacagcuuguccuucccug

SEQ ID NO: 118162 - RNA, 25 nt, Human
acgccucucggggccugugccgcac

SEQ ID NO: 118163 - RNA, 26 nt, Human
uagugaaagcagauccuguacuagga

SEQ ID NO: 118164 - RNA, 22 nt, Human
cagaagccuccuugaaccaguc

SEQ ID NO: 118165 - RNA, 23 nt, Human
gcgagcuccaggagccccggguc

SEQ ID NO: 118166 - RNA, 21 nt, Human
cuccgcugcuccuuggcuuac

SEQ ID NO: 118167 - RNA, 21 nt, Human
ggacugggucugcccaccucu

SEQ ID NO: 118168 - RNA, 22 nt, Human
uugcagcuucaacuuuucucuu

SEQ ID NO: 118169 - RNA, 27 nt, Human
cauugcacuccagccuaggcaauaaga

SEQ ID NO: 118170 - RNA, 27 nt, Human
cacuggagcagucuguccuuaugccga

SEQ ID NO: 118171 - RNA, 21 nt, Human
ccaacaggaugaacgugugca

SEQ ID NO: 118172 - RNA, 21 nt, Human
aucucuagucuagucuagucu

SEQ ID NO: 118173 - RNA, 22 nt, Human
caugauguuuacaagauggcga

SEQ ID NO: 118174 - RNA, 27 nt, Human
ugccacugcacuuagcacuuucaggcu

SEQ ID NO: 118175 - RNA, 26 nt, Human
ccucagccuguugcccugccucccaa

SEQ ID NO: 118176 - RNA, 27 nt, Human
cuggaauuauagauacagcuuauuauu

SEQ ID NO: 118177 - RNA, 22 nt, Human
agcuauugcuccuucccacagc

SEQ ID NO: 118178 - RNA, 21 nt, Human
caaggaguucguggcugcaaa

SEQ ID NO: 118179 - RNA, 20 nt, Human
ccugcagcugacucaaagcc

SEQ ID NO: 118180 - RNA, 21 nt, Human
uggaacuacauuacuguacag

SEQ ID NO: 118181 - RNA, 23 nt, Human
uagaaagaaguccgcuggcaccc

SEQ ID NO: 118182 - RNA, 19 nt, Human
ugcuguccccucuugcccc

SEQ ID NO: 118183 - RNA, 24 nt, Human
ggaugcgcagaguucggcuggaaa

SEQ ID NO: 118184 - RNA, 20 nt, Human
ccgccugcccugccugggcc

SEQ ID NO: 118185 - RNA, 24 nt, Human
ccaguagcugggauuacaguguua

SEQ ID NO: 118186 - RNA, 25 nt, Human
ucuuggcucacagcaaccucuaccu

SEQ ID NO: 118187 - RNA, 23 nt, Human
gggaagagugcuguacaaaguca

SEQ ID NO: 118188 - RNA, 18 nt, Human
guggcagcaaaaccagga

SEQ ID NO: 118189 - RNA, 23 nt, Human
ccuggcuccaaacccucgaggcg

SEQ ID NO: 118190 - RNA, 21 nt, Human
acuucuauugaacaugacuca

SEQ ID NO: 118191 - RNA, 22 nt, Human
uuccaggagcuagaaccaggga

SEQ ID NO: 118192 - RNA, 22 nt, Human
cuuugggcccacagacccaaga

SEQ ID NO: 118193 - RNA, 26 nt, Human
gucagcccaggcugcugggcuguagc

SEQ ID NO: 118194 - RNA, 25 nt, Human
ucacaugcuuuucaagaaugucgca

SEQ ID NO: 118195 - RNA, 25 nt, Human
uagucccagcuacucgcgagacuga

SEQ ID NO: 118196 - RNA, 20 nt, Human
uuuagcuaauuaaaaagcac

SEQ ID NO: 118197 - RNA, 21 nt, Human
ccgcagccaugggcaaccgcg

SEQ ID NO: 118198 - RNA, 23 nt, Human
cgcaaaacugaaaggcaugugaa

SEQ ID NO: 118199 - RNA, 22 nt, Human
acugugacuuggggaggucagu

SEQ ID NO: 118200 - RNA, 23 nt, Human
gggagguacagcuggcagaggga

SEQ ID NO: 118201 - RNA, 21 nt, Human
gcagugagccaggauugugcc

SEQ ID NO: 118202 - RNA, 26 nt, Human
ugaguggccccaccuguguccccgau

SEQ ID NO: 118203 - RNA, 25 nt, Human
agagaggccuucugggacugcccag

SEQ ID NO: 118204 - RNA, 22 nt, Human
ccaggagguugaggcugcagug

SEQ ID NO: 118205 - RNA, 22 nt, Human
cugggaggucaaggcugcagug

SEQ ID NO: 118206 - RNA, 20 nt, Human
uucuucaauuaggacacaaa

SEQ ID NO: 118207 - RNA, 26 nt, Human
uugggaggcugaggcaggagaaucgc

SEQ ID NO: 118208 - RNA, 26 nt, Human
gcugcaccgaccucgacgucuugccu

SEQ ID NO: 118209 - RNA, 22 nt, Human
ucugcaggaacucucccgucug

SEQ ID NO: 118210 - RNA, 27 nt, Human
uggaauagaagcccuuguugcuguaga

SEQ ID NO: 118211 - RNA, 24 nt, Human
guagucauggauaacuacauuacc

SEQ ID NO: 118212 - RNA, 23 nt, Human
ugucacccaggcugcaguguagu

SEQ ID NO: 118213 - RNA, 21 nt, Human
ccacagccagugccaaguccu

SEQ ID NO: 118214 - RNA, 27 nt, Human
ggaggcugaggugggaggaucgcuuga

SEQ ID NO: 118215 - RNA, 24 nt, Human
cugucaucugccaggacguuuguu

SEQ ID NO: 118216 - RNA, 21 nt, Human
gaagggagagacugagacuga

SEQ ID NO: 118217 - RNA, 24 nt, Human
ugagcaugccaaggcucuguggga

SEQ ID NO: 118218 - RNA, 21 nt, Human
gaucaaaugcuguaauggugg

SEQ ID NO: 118219 - RNA, 23 nt, Human
gaggccuucucaaacuuuacucu

SEQ ID NO: 118220 - RNA, 23 nt, Human
cagccucagacuuuuucccacug

SEQ ID NO: 118221 - RNA, 19 nt, Human
gcugguugucauucauucu

SEQ ID NO: 118222 - RNA, 20 nt, Human
ugaccucauuuucugcuaug

SEQ ID NO: 118223 - RNA, 23 nt, Human
ccaguagcugggauuacaggcac

SEQ ID NO: 118224 - RNA, 21 nt, Human
gucaggagaucagaauuuuaa

SEQ ID NO: 118225 - RNA, 19 nt, Human
guuccauuucucucauuca

SEQ ID NO: 118226 - RNA, 20 nt, Human
cuggcuaccagacucagccc

SEQ ID NO: 118227 - RNA, 24 nt, Human
gaccaacgcaaccucuaguaccuu

SEQ ID NO: 118228 - RNA, 22 nt, Human
guuauuagggcuuuuccugaaa

SEQ ID NO: 118229 - RNA, 22 nt, Human
ggcgaggacgugaagccucccg

SEQ ID NO: 118230 - RNA, 28 nt, Human
ugagaagcguccguccucgagccaggcg

SEQ ID NO: 118231 - RNA, 25 nt, Human
ugagacagaauuuugcucuuguugc

SEQ ID NO: 118232 - RNA, 29 nt, Human
acaguuccuugcauguuguagcagugauu

SEQ ID NO: 118233 - RNA, 26 nt, Human
ccagcgucuccggcagccucuugguc

SEQ ID NO: 118234 - RNA, 24 nt, Human
ugucuucuuggcuggaccugucac

SEQ ID NO: 118235 - RNA, 23 nt, Human
uugauggccaucacaaugcagcu

SEQ ID NO: 118236 - RNA, 27 nt, Human
gaguagcugggauuacaggugcgcacc

SEQ ID NO: 118237 - RNA, 21 nt, Human
cuguccuaacagggccaauca

SEQ ID NO: 118238 - RNA, 22 nt, Human
ugccuguaauugagccucucug

SEQ ID NO: 118239 - RNA, 27 nt, Human
ucauccagccccaccaagugacuuugg

SEQ ID NO: 118240 - RNA, 25 nt, Human
ugcuaccugauggaauuccugcacu

SEQ ID NO: 118241 - RNA, 20 nt, Human
cacguaucuuuccuaggcag

SEQ ID NO: 118242 - RNA, 21 nt, Human
cugaggcucucccuacucccu

SEQ ID NO: 118243 - RNA, 20 nt, Human
cuagggaggccaggaggagc

SEQ ID NO: 118244 - RNA, 19 nt, Human
ugucugccuggagugcugu

SEQ ID NO: 118245 - RNA, 19 nt, Human
aaaugaacagcacauguau

SEQ ID NO: 118246 - RNA, 27 nt, Human
gauguuccuuccagugucauuucucau

SEQ ID NO: 118247 - RNA, 21 nt, Human
guucaugcuucuacugugaca

SEQ ID NO: 118248 - RNA, 19 nt, Human
aucauaaaaaacuguuuca

SEQ ID NO: 118249 - RNA, 22 nt, Human
aagaacauguauauaaacaugc

SEQ ID NO: 118250 - RNA, 20 nt, Human
uauguaaacaaaaacaacug

SEQ ID NO: 118251 - RNA, 20 nt, Human
acacggagcacaggucucug

SEQ ID NO: 118252 - RNA, 29 nt, Human
cccuccuccucugggcacagggugugcgu

SEQ ID NO: 118253 - RNA, 24 nt, Human
agaugccaagcacuagccaggagg

SEQ ID NO: 118254 - RNA, 22 nt, Human
ggaggcaagguucgacugcagc

SEQ ID NO: 118255 - RNA, 26 nt, Human
uacaucucaccugacugucuggcuga

SEQ ID NO: 118256 - RNA, 23 nt, Human
uguggggugagaggaugggugau

SEQ ID NO: 118257 - RNA, 22 nt, Human
uuuuaaggcuaacuucuuuuca

SEQ ID NO: 118258 - RNA, 22 nt, Human
cucggccucccaacgugcuggg

SEQ ID NO: 118259 - RNA, 19 nt, Human
ugcaagcuccccucagccc

SEQ ID NO: 118260 - RNA, 27 nt, Human
uccucaaguugcaggucuauggaaaug

SEQ ID NO: 118261 - RNA, 27 nt, Human
agcacaaaauaguacuuuguggaucau

SEQ ID NO: 118262 - RNA, 20 nt, Human
ugaaguuucaggauuugggu

SEQ ID NO: 118263 - RNA, 25 nt, Human
guaugggagggguuggaaaccaagu

SEQ ID NO: 118264 - RNA, 26 nt, Human
uucuacaaauuucacauuuccauggc

SEQ ID NO: 118265 - RNA, 22 nt, Human
augcuccugccuugcaccucca

SEQ ID NO: 118266 - RNA, 26 nt, Human
gagagggagagacagcgagaucuauc

SEQ ID NO: 118267 - RNA, 22 nt, Human
auuuucuccccacuuccaguga

SEQ ID NO: 118268 - RNA, 28 nt, Human
agcuacuuggcaugaaugccugggccgu

SEQ ID NO: 118269 - RNA, 21 nt, Human
cuccccucauuuucaguggca

SEQ ID NO: 118270 - RNA, 25 nt, Human
gacaaugguagaagugagagcuuug

SEQ ID NO: 118271 - RNA, 27 nt, Human
ccacuacacuccagccugggagacaga

SEQ ID NO: 118272 - RNA, 26 nt, Human
ucuguuucuccuccuuuacgcccauu

SEQ ID NO: 118273 - RNA, 27 nt, Human
cuggaaccugacuuuagauguuuuggg

SEQ ID NO: 118274 - RNA, 22 nt, Human
ccuuucuuucuccucgucggcc

SEQ ID NO: 118275 - RNA, 20 nt, Human
gagaccuggaauagaaacuu

SEQ ID NO: 118276 - RNA, 27 nt, Human
cgcggcaagcaacaaauccacagcccc

SEQ ID NO: 118277 - RNA, 24 nt, Human
uugcccaggaugacauagccaaug

SEQ ID NO: 118278 - RNA, 24 nt, Human
agggaaagcgagagggagacggac

SEQ ID NO: 118279 - RNA, 22 nt, Human
cggcccggaggaagcaauucca

SEQ ID NO: 118280 - RNA, 21 nt, Human
acaauuucaaaaugcauguga

SEQ ID NO: 118281 - RNA, 27 nt, Human
guggggagggggcuucgcagauccccg

SEQ ID NO: 118282 - RNA, 28 nt, Human
ccgggagccgucgcaggucucgguccaa

SEQ ID NO: 118283 - RNA, 24 nt, Human
ggggcagcacagagagggggccac

SEQ ID NO: 118284 - RNA, 23 nt, Human
uaauccagaugccuauuguugga

SEQ ID NO: 118285 - RNA, 23 nt, Human
aguggagggguuuaccuggaaca

SEQ ID NO: 118286 - RNA, 22 nt, Human
cauaccuguaaucccagcacuu

SEQ ID NO: 118287 - RNA, 22 nt, Human
guugggaggggcucugagcagu

SEQ ID NO: 118288 - RNA, 19 nt, Human
gcaagaauggagauaugca

SEQ ID NO: 118289 - RNA, 23 nt, Human
acuuaggaggcugagguggcaga

SEQ ID NO: 118290 - RNA, 22 nt, Human
ucucaauaauuugugaaauuuc

SEQ ID NO: 118291 - RNA, 27 nt, Human
cucuccaggagccucagcccaccgcca

SEQ ID NO: 118292 - RNA, 22 nt, Human
ugcacacauucuuauuaggauu

SEQ ID NO: 118293 - RNA, 21 nt, Human
gcugcugcuucuacuuuggcu

SEQ ID NO: 118294 - RNA, 22 nt, Human
uuauuagcuguagcauucucug

SEQ ID NO: 118295 - RNA, 22 nt, Human
caccucccugguucaagcgauu

SEQ ID NO: 118296 - RNA, 27 nt, Human
agggucugauggcuggaccugcagcag

SEQ ID NO: 118297 - RNA, 21 nt, Human
uaaagagaccaccagcaguga

SEQ ID NO: 118298 - RNA, 23 nt, Human
cgggcaauauaguauucugcuca

SEQ ID NO: 118299 - RNA, 23 nt, Human
ggauccugggguagggaggcagg

SEQ ID NO: 118300 - RNA, 28 nt, Human
gucagcucaggcuggagcagguauauga

SEQ ID NO: 118301 - RNA, 21 nt, Human
cacgccuguaucccagcacuu

SEQ ID NO: 118302 - RNA, 24 nt, Human
cucucccacuuccaucuggcaucc

SEQ ID NO: 118303 - RNA, 22 nt, Human
ggcugagacagugaauuugggc

SEQ ID NO: 118304 - RNA, 23 nt, Human
gccugaguucucccuguugucuc

SEQ ID NO: 118305 - RNA, 22 nt, Human
uugcuuuuguuaaaagcuuuau

SEQ ID NO: 118306 - RNA, 24 nt, Human
caucuuccccggaugugugucuca

SEQ ID NO: 118307 - RNA, 19 nt, Human
acuccccagaccucaggga

SEQ ID NO: 118308 - RNA, 26 nt, Human
cugucagcuaaagaccugcaguauug

SEQ ID NO: 118309 - RNA, 21 nt, Human
agcccaggcuggagugcagug

SEQ ID NO: 118310 - RNA, 20 nt, Human
cucucccuuuuucucccuca

SEQ ID NO: 118311 - RNA, 21 nt, Human
cuccauccucggcuccugggc

SEQ ID NO: 118312 - RNA, 21 nt, Human
aggaaacagauuuaagcaaga

SEQ ID NO: 118313 - RNA, 24 nt, Human
aagucugaccauacaucacuguga

SEQ ID NO: 118314 - RNA, 21 nt, Human
agaggccaugauuucacaaaa

SEQ ID NO: 118315 - RNA, 20 nt, Human
cacaucucccuuccaccuca

SEQ ID NO: 118316 - RNA, 26 nt, Human
ccucauccuccuccucauucagacca

SEQ ID NO: 118317 - RNA, 22 nt, Human
gacuacagguaugugccaccac

SEQ ID NO: 118318 - RNA, 23 nt, Human
ggagcaaaguuacaggccaguuu

SEQ ID NO: 118319 - RNA, 22 nt, Human
cccaggcugggaauugcagugg

SEQ ID NO: 118320 - RNA, 20 nt, Human
ccugacaucaggaauagcug

SEQ ID NO: 118321 - RNA, 22 nt, Human
guagagaggggacugggggacu

SEQ ID NO: 118322 - RNA, 23 nt, Human
acccguaaucccagcuacucagg

SEQ ID NO: 118323 - RNA, 26 nt, Human
aaggcauuggcccucuggacuccuuu

SEQ ID NO: 118324 - RNA, 26 nt, Human
cuuaaccuuggagugagagcccaggg

SEQ ID NO: 118325 - RNA, 22 nt, Human
cgccuccuggguucaagcaagu

SEQ ID NO: 118326 - RNA, 18 nt, Human
uucaaaccaaagcugccu

SEQ ID NO: 118327 - RNA, 27 nt, Human
agcucacugcagccucugccacccaga

SEQ ID NO: 118328 - RNA, 21 nt, Human
gccucguguccagacucagag

SEQ ID NO: 118329 - RNA, 17 nt, Human
aauugaaauuuucucca

SEQ ID NO: 118330 - RNA, 22 nt, Human
uggggccucaguuaauaucccu

SEQ ID NO: 118331 - RNA, 22 nt, Human
uaggccagcagagacuuaggga

SEQ ID NO: 118332 - RNA, 21 nt, Human
uggcagaggcagggucgcugg

SEQ ID NO: 118333 - RNA, 22 nt, Human
uucauucuuaauggaaaaucug

SEQ ID NO: 118334 - RNA, 24 nt, Human
aguuugaacguggugaaacagggu

SEQ ID NO: 118335 - RNA, 17 nt, Human
cuucccucugcugugcc

SEQ ID NO: 118336 - RNA, 26 nt, Human
cuguucugucucucgccugugcugga

SEQ ID NO: 118337 - RNA, 23 nt, Human
uuccacacucggugugugcauac

SEQ ID NO: 118338 - RNA, 27 nt, Human
gcuguuggcuggagcaugugucuagag

SEQ ID NO: 118339 - RNA, 26 nt, Human
ucuacaaccuggaaucagauuugcaa

SEQ ID NO: 118340 - RNA, 25 nt, Human
aggcugugagguugcagcaaaguuu

SEQ ID NO: 118341 - RNA, 27 nt, Human
gaaaugagugauccugccucugguccc

SEQ ID NO: 118342 - RNA, 21 nt, Human
uggauauccaugagcugcacu

SEQ ID NO: 118343 - RNA, 17 nt, Human
cgccucgggacgccucg

SEQ ID NO: 118344 - RNA, 24 nt, Human
ucaugcaagacuucacugcagccu

SEQ ID NO: 118345 - RNA, 23 nt, Human
gucggcccagacugaagugcagu

SEQ ID NO: 118346 - RNA, 17 nt, Human
ugccuccaucccaccca

SEQ ID NO: 118347 - RNA, 24 nt, Human
ucauccuugugugcugcucugcua

SEQ ID NO: 118348 - RNA, 31 nt, Human
ggcagagaacguucagcaccuuuguuccucc

SEQ ID NO: 118349 - RNA, 24 nt, Human
guuuaagacaggaagcugccgggu

SEQ ID NO: 118350 - RNA, 20 nt, Human
cuccaaagcaaauucacaug

SEQ ID NO: 118351 - RNA, 21 nt, Human
accacacaugcuaauuuuugu

SEQ ID NO: 118352 - RNA, 22 nt, Human
gaguucaaauccugccugggca

SEQ ID NO: 118353 - RNA, 21 nt, Human
gacugauuuuaagaucagcca

SEQ ID NO: 118354 - RNA, 18 nt, Human
agauguugcaguauuuca

SEQ ID NO: 118355 - RNA, 22 nt, Human
gaaaggagagaccaugguguga

SEQ ID NO: 118356 - RNA, 16 nt, Human
gagucaauuugcugaa

SEQ ID NO: 118357 - RNA, 21 nt, Human
aguaugagcguuaggacacua

SEQ ID NO: 118358 - RNA, 22 nt, Human
uggcucacaccuauaaucccag

SEQ ID NO: 118359 - RNA, 20 nt, Human
ucuggcagagcugagaaggg

SEQ ID NO: 118360 - RNA, 19 nt, Human
uuccugccuuccucccuuu

SEQ ID NO: 118361 - RNA, 21 nt, Human
ugacuucagcaugggagggag

SEQ ID NO: 118362 - RNA, 21 nt, Human
gcaauugcuucuccaaggccu

SEQ ID NO: 118363 - RNA, 27 nt, Human
uggagagaagauauucuggugacugaa

SEQ ID NO: 118364 - RNA, 25 nt, Human
ugacuucuacucugucaaucucuuu

SEQ ID NO: 118365 - RNA, 29 nt, Human
ucccccucucagaagaggguggaagauga

SEQ ID NO: 118366 - RNA, 20 nt, Human
ggcgcugauguaagcacuuu

SEQ ID NO: 118367 - RNA, 27 nt, Human
guugcccaggcuagucuggaacuccug

SEQ ID NO: 118368 - RNA, 20 nt, Human
acucucuuguuuaaguagca

SEQ ID NO: 118369 - RNA, 25 nt, Human
gcaugauuuuggcucacugcagccu

SEQ ID NO: 118370 - RNA, 27 nt, Human
uguuguccagcaccaauucuggcuguc

SEQ ID NO: 118371 - RNA, 20 nt, Human
ggagagaaggggggcccugc

SEQ ID NO: 118372 - RNA, 23 nt, Human
ugcaaccuccgccucccagauuc

SEQ ID NO: 118373 - RNA, 25 nt, Human
gugcgggcugacugucgcucugccu

SEQ ID NO: 118374 - RNA, 23 nt, Human
cucggcucucccacaggugggca

SEQ ID NO: 118375 - RNA, 20 nt, Human
uuuucuccaguaguacaggc

SEQ ID NO: 118376 - RNA, 26 nt, Human
gugagcagcaacaaggccacgugcug

SEQ ID NO: 118377 - RNA, 23 nt, Human
uucuuuacuagauauccuggccc

SEQ ID NO: 118378 - RNA, 23 nt, Human
uggaugucuuugaggacagacau

SEQ ID NO: 118379 - RNA, 22 nt, Human
aggccagcugcccagagcccag

SEQ ID NO: 118380 - RNA, 18 nt, Human
auuaacucugagugccuu

SEQ ID NO: 118381 - RNA, 19 nt, Human
auccaggcgugguggugca

SEQ ID NO: 118382 - RNA, 27 nt, Human
uacccuuuugaacauuccuuuucucau

SEQ ID NO: 118383 - RNA, 20 nt, Human
gggagcacccugggccacac

SEQ ID NO: 118384 - RNA, 21 nt, Human
gaccagacaaauagaugaugg

SEQ ID NO: 118385 - RNA, 18 nt, Human
ggggguggggaagaagac

SEQ ID NO: 118386 - RNA, 22 nt, Human
accuguaauccuagcacuuuga

SEQ ID NO: 118387 - RNA, 23 nt, Human
ugguauuacccuccuaauaguca

SEQ ID NO: 118388 - RNA, 27 nt, Human
caggcuggacugcagugacacaaucuc

SEQ ID NO: 118389 - RNA, 26 nt, Human
acauuuuucuucuaauaugauggaga

SEQ ID NO: 118390 - RNA, 23 nt, Human
aauucaguugacacgaggcacag

SEQ ID NO: 118391 - RNA, 23 nt, Human
uaucaauauuuucugcaauccaa

SEQ ID NO: 118392 - RNA, 18 nt, Human
cuucuggucuguugucaa

SEQ ID NO: 118393 - RNA, 24 nt, Human
cgccgccucucuugggaccuggcc

SEQ ID NO: 118394 - RNA, 20 nt, Human
aauauacuaggucugccuuc

SEQ ID NO: 118395 - RNA, 21 nt, Human
ccucaccuggcucugccuccc

SEQ ID NO: 118396 - RNA, 22 nt, Human
caaaacaagacauguaugugug

SEQ ID NO: 118397 - RNA, 25 nt, Human
uccucuauuuugguuuauuuuugcc

SEQ ID NO: 118398 - RNA, 23 nt, Human
ugggaaugcuguaucuguggaag

SEQ ID NO: 118399 - RNA, 26 nt, Human
ugaacaaagacaacauuguuccugga

SEQ ID NO: 118400 - RNA, 21 nt, Human
uccccaggcaggaguuggggu

SEQ ID NO: 118401 - RNA, 22 nt, Human
aggcuugccuaugugcuuaugu

SEQ ID NO: 118402 - RNA, 22 nt, Human
acuguaaucaaaaggaggaauu

SEQ ID NO: 118403 - RNA, 19 nt, Human
agacuuuaucaugugucuu

SEQ ID NO: 118404 - RNA, 23 nt, Human
agcagagaagcagaaaaggaggu

SEQ ID NO: 118405 - RNA, 28 nt, Human
ggaacuccugccuuauuuauccugcagu

SEQ ID NO: 118406 - RNA, 21 nt, Human
gaaguuaaacaaacauuggga

SEQ ID NO: 118407 - RNA, 21 nt, Human
ucuagcccuagauuuuggagu

SEQ ID NO: 118408 - RNA, 27 nt, Human
gggcugguuucaaacuccugaccucag

SEQ ID NO: 118409 - RNA, 20 nt, Human
ggcuggaccaauucucucca

SEQ ID NO: 118410 - RNA, 20 nt, Human
auucugagauggcuuuugcu

SEQ ID NO: 118411 - RNA, 26 nt, Human
ucaucccucuuguaugcugggccugg

SEQ ID NO: 118412 - RNA, 20 nt, Human
guaugauuuguuccauuuuu

SEQ ID NO: 118413 - RNA, 22 nt, Human
uuuggaaucauacugccuacug

SEQ ID NO: 118414 - RNA, 22 nt, Human
gccacccuuugggcucagagga

SEQ ID NO: 118415 - RNA, 27 nt, Human
cccugcaggccacacuccaagucucag

SEQ ID NO: 118416 - RNA, 21 nt, Human
ccacagcuggugaacagcuca

SEQ ID NO: 118417 - RNA, 19 nt, Human
uugcccagaagaggcaguu

SEQ ID NO: 118418 - RNA, 20 nt, Human
ccugccccugugccucuguc

SEQ ID NO: 118419 - RNA, 20 nt, Human
ucuuuuuucuuuuucuuuuc

SEQ ID NO: 118420 - RNA, 21 nt, Human
ugcugggccuggcaucugcag

SEQ ID NO: 118421 - RNA, 26 nt, Human
ggguguuacaggaacaguguggccuc

SEQ ID NO: 118422 - RNA, 21 nt, Human
cggaaucuguucacacccaac

SEQ ID NO: 118423 - RNA, 28 nt, Human
aucgggacuaugaaccggaaagcgcggc

SEQ ID NO: 118424 - RNA, 21 nt, Human
cagggaagaaacggaauagug

SEQ ID NO: 118425 - RNA, 19 nt, Human
ucuccuucucccuggagcu

SEQ ID NO: 118426 - RNA, 23 nt, Human
gggcagcggcuucaagagccaga

SEQ ID NO: 118427 - RNA, 23 nt, Human
cuuguuacugcugauucuuguaa

SEQ ID NO: 118428 - RNA, 24 nt, Human
agaacuauccgcugaggaaccugg

SEQ ID NO: 118429 - RNA, 22 nt, Human
uuuucagcaaacucuuuuccca

SEQ ID NO: 118430 - RNA, 23 nt, Human
agccccucaccgggacuugcugu

SEQ ID NO: 118431 - RNA, 22 nt, Human
gggccagcccaccgcaaagaau

SEQ ID NO: 118432 - RNA, 27 nt, Human
acugcaacuucugccucccaugcuuac

SEQ ID NO: 118433 - RNA, 24 nt, Human
ugugaucaguuugauucuguaaug

SEQ ID NO: 118434 - RNA, 17 nt, Human
ggugaacuucucuuagu

SEQ ID NO: 118435 - RNA, 27 nt, Human
uucuuuacaagcuuauuuuacauaccg

SEQ ID NO: 118436 - RNA, 21 nt, Human
auggaaaggagaaugaacaaa

SEQ ID NO: 118437 - RNA, 30 nt, Human
cccuggaaugggggcaagcagcuggguggg

SEQ ID NO: 118438 - RNA, 21 nt, Human
ggggagaaaagggaacaagau

SEQ ID NO: 118439 - RNA, 20 nt, Human
gguagcugcaugcacuggca

SEQ ID NO: 118440 - RNA, 25 nt, Human
cuucugcuguucugcuccucccaga

SEQ ID NO: 118441 - RNA, 25 nt, Human
ccucccagccaccaucguucaucug

SEQ ID NO: 118442 - RNA, 17 nt, Human
guuauacaacuugccuc

SEQ ID NO: 118443 - RNA, 21 nt, Human
uugagccaugcgugggugggg

SEQ ID NO: 118444 - RNA, 27 nt, Human
cucuccucgaaugacguuaugggcaca

SEQ ID NO: 118445 - RNA, 21 nt, Human
aaaccagcuauaucuguuuug

SEQ ID NO: 118446 - RNA, 20 nt, Human
gggggcugacccaaguguug

SEQ ID NO: 118447 - RNA, 20 nt, Human
uucacugcauuuccccacuc

SEQ ID NO: 118448 - RNA, 22 nt, Human
ugacagagugagacuccaucuc

SEQ ID NO: 118449 - RNA, 22 nt, Human
caacagagcaagacuccaucuc

SEQ ID NO: 118450 - RNA, 22 nt, Human
cgacagagcgagacuccaucuc

SEQ ID NO: 118451 - RNA, 27 nt, Human
cuacaucugcaauaucuuaauccuacu

SEQ ID NO: 118452 - RNA, 27 nt, Human
aaacucauguucuucuccaguccccug

SEQ ID NO: 118453 - RNA, 22 nt, Human
aggcugaggcgagaggaucacu

SEQ ID NO: 118454 - RNA, 26 nt, Human
uuaagccaccucuccauccuggggcc

SEQ ID NO: 118455 - RNA, 27 nt, Human
agucccugugauggccaggccagggga

SEQ ID NO: 118456 - RNA, 20 nt, Human
gauccgagcaggguuugucu

SEQ ID NO: 118457 - RNA, 23 nt, Human
agcagguuugcaggcacagugga

SEQ ID NO: 118458 - RNA, 18 nt, Human
uuuccugagcauaacucc

SEQ ID NO: 118459 - RNA, 31 nt, Human
agcauaggaaaccacacagacuugggcaggg

SEQ ID NO: 118460 - RNA, 27 nt, Human
accagccuggccaacauggagaaaccc

SEQ ID NO: 118461 - RNA, 20 nt, Human
cugaguagcuuuacacugcc

SEQ ID NO: 118462 - RNA, 22 nt, Human
gguggcacgaucacagcucacu

SEQ ID NO: 118463 - RNA, 19 nt, Human
ccugcuucuccccugggcu

SEQ ID NO: 118464 - RNA, 22 nt, Human
gggaagaggcagagggaggcag

SEQ ID NO: 118465 - RNA, 22 nt, Human
uaguauggcauaaugucaugau

SEQ ID NO: 118466 - RNA, 20 nt, Human
agcuucugucccgaggacca

SEQ ID NO: 118467 - RNA, 26 nt, Human
cuccauuuuugccuguggaaaggagg

SEQ ID NO: 118468 - RNA, 23 nt, Human
aggguucauuuuggaaacuacau

SEQ ID NO: 118469 - RNA, 19 nt, Human
gcuaaagccccucuauacc

SEQ ID NO: 118470 - RNA, 21 nt, Human
cacuuagguccaaggucucca

SEQ ID NO: 118471 - RNA, 24 nt, Human
gggggaggagugcucaacggggag

SEQ ID NO: 118472 - RNA, 22 nt, Human
uuagaugaucuaagaaaucaug

SEQ ID NO: 118473 - RNA, 21 nt, Human
gaagcagaacguggugaccuu

SEQ ID NO: 118474 - RNA, 25 nt, Human
ggacugcacuuagaacugcauuuug

SEQ ID NO: 118475 - RNA, 27 nt, Human
ccccugccuuuuguucaacucuauaaa

SEQ ID NO: 118476 - RNA, 28 nt, Human
cuguuugacaccucuuuuuucguuuguu

SEQ ID NO: 118477 - RNA, 19 nt, Human
agcacaacaggaaagccug

SEQ ID NO: 118478 - RNA, 23 nt, Human
uguccguugaacuggaguugcag

SEQ ID NO: 118479 - RNA, 22 nt, Human
uguuuuugccaaaaccaagauu

SEQ ID NO: 118480 - RNA, 22 nt, Human
ugggcagccugcuuuggccuuu

SEQ ID NO: 118481 - RNA, 22 nt, Human
ccuguucacauccuuugcccau

SEQ ID NO: 118482 - RNA, 22 nt, Human
uuucuaaagcacaagaaauagu

SEQ ID NO: 118483 - RNA, 26 nt, Human
ucauuccacucagccugggacgaugg

SEQ ID NO: 118484 - RNA, 25 nt, Human
ggaaugcuucaaaaguucugcugcc

SEQ ID NO: 118485 - RNA, 22 nt, Human
cccaaguaguugggagguguug

SEQ ID NO: 118486 - RNA, 22 nt, Human
ugagcccacagacagagcugua

SEQ ID NO: 118487 - RNA, 20 nt, Human
gccacgcucccccucgguuc

SEQ ID NO: 118488 - RNA, 22 nt, Human
ccucacgccacugccuggagcu

SEQ ID NO: 118489 - RNA, 23 nt, Human
ugaaaacacuguauuuucgacug

SEQ ID NO: 118490 - RNA, 25 nt, Human
ucaucccuccucuguguugccaugg

SEQ ID NO: 118491 - RNA, 24 nt, Human
ucccacucacuagcauuauuuaaa

SEQ ID NO: 118492 - RNA, 22 nt, Human
uacaaggacccagccugagaug

SEQ ID NO: 118493 - RNA, 23 nt, Human
gcacucugaauucaguggcagua

SEQ ID NO: 118494 - RNA, 25 nt, Human
ggaacacugucuuacacagcauuuu

SEQ ID NO: 118495 - RNA, 21 nt, Human
ccuuagaccugugguguccgc

SEQ ID NO: 118496 - RNA, 20 nt, Human
aagaccuggccacauggggc

SEQ ID NO: 118497 - RNA, 20 nt, Human
ggcuucuccuguuuuauaua

SEQ ID NO: 118498 - RNA, 21 nt, Human
agggcccacuuguauccucug

SEQ ID NO: 118499 - RNA, 27 nt, Human
uucauuucagccugaaugucugccuau

SEQ ID NO: 118500 - RNA, 27 nt, Human
agaccuccguccucugcuuuccgggca

SEQ ID NO: 118501 - RNA, 22 nt, Human
ugcagugagccgagauaucgcc

SEQ ID NO: 118502 - RNA, 29 nt, Human
uuaguacaaaccuuaauuucucagaaacg

SEQ ID NO: 118503 - RNA, 31 nt, Human
uaacgucaugugcaccuuuacacugugguua

SEQ ID NO: 118504 - RNA, 24 nt, Human
agcagguagugggugaauguguga

SEQ ID NO: 118505 - RNA, 20 nt, Human
cucuuggcugugaaaagagg

SEQ ID NO: 118506 - RNA, 25 nt, Human
ggucaaugcaagaguucucauuucc

SEQ ID NO: 118507 - RNA, 26 nt, Human
ggagcugguuagaacauuuuaagugg

SEQ ID NO: 118508 - RNA, 21 nt, Human
ucaguuccccucacacuucgg

SEQ ID NO: 118509 - RNA, 22 nt, Human
cugucucucaagccauuuugcc

SEQ ID NO: 118510 - RNA, 26 nt, Human
gccuguauuucuaccucuaguaaugg

SEQ ID NO: 118511 - RNA, 22 nt, Human
gcugggcucaaagauaaaagga

SEQ ID NO: 118512 - RNA, 20 nt, Human
gcucacugccaccuccgccu

SEQ ID NO: 118513 - RNA, 22 nt, Human
agccucccaaaguggugggauu

SEQ ID NO: 118514 - RNA, 27 nt, Human
ggagagggagaggaaaggguucugucc

SEQ ID NO: 118515 - RNA, 25 nt, Human
cagccuauuuccuuaauguacguga

SEQ ID NO: 118516 - RNA, 28 nt, Human
uccugccucucugcuccagagagaggau

SEQ ID NO: 118517 - RNA, 21 nt, Human
agaaagaauguuuaaagcuuu

SEQ ID NO: 118518 - RNA, 21 nt, Human
augcaaauaacacaaaugcuc

SEQ ID NO: 118519 - RNA, 21 nt, Human
ugcccccagcccagagcccgg

SEQ ID NO: 118520 - RNA, 22 nt, Human
gagcgagacacuucgccgaggc

SEQ ID NO: 118521 - RNA, 21 nt, Human
uggcucccagacucugucugu

SEQ ID NO: 118522 - RNA, 26 nt, Human
ccuccaggcauuggcucagggugaau

SEQ ID NO: 118523 - RNA, 22 nt, Human
cuuccugccagccccugccauu

SEQ ID NO: 118524 - RNA, 27 nt, Human
ggaggccaaagcaggaggaucgcuuga

SEQ ID NO: 118525 - RNA, 27 nt, Human
ucacaugcccucggucacugagucugg

SEQ ID NO: 118526 - RNA, 23 nt, Human
uuucaacugaauuuugguggugu

SEQ ID NO: 118527 - RNA, 23 nt, Human
auucacaaauacagggugcucug

SEQ ID NO: 118528 - RNA, 22 nt, Human
cugaggcaggagagucacuuga

SEQ ID NO: 118529 - RNA, 22 nt, Human
cugaggcaggagaaucacuugg

SEQ ID NO: 118530 - RNA, 21 nt, Human
gcaguuuucaaaagucuuuga

SEQ ID NO: 118531 - RNA, 21 nt, Human
aucccuuucuuccccccacca

SEQ ID NO: 118532 - RNA, 26 nt, Human
ucugccuuccugcugaaacuuguucc

SEQ ID NO: 118533 - RNA, 19 nt, Human
caggaaagaugcagaggaa

SEQ ID NO: 118534 - RNA, 22 nt, Human
aacacaaaaauaaagaacuuca

SEQ ID NO: 118535 - RNA, 26 nt, Human
gggugugggucagggaggggucuaga

SEQ ID NO: 118536 - RNA, 23 nt, Human
gagcaaauuacuugauuuaagug

SEQ ID NO: 118537 - RNA, 30 nt, Human; identical to SEQ ID NO: 7329

SEQ ID NO: 118538 - RNA, 21 nt, Human
cacagagauauccuggaagac

SEQ ID NO: 118539 - RNA, 22 nt, Human
cucuuacaagaugaaaaggaca

SEQ ID NO: 118540 - RNA, 26 nt, Human
ccagagguggaggccacggaggcagg

SEQ ID NO: 118541 - RNA, 22 nt, Human
cccugcucuucccaaagcugcc

SEQ ID NO: 118542 - RNA, 21 nt, Human
ugaauccuggccuggaauuug

SEQ ID NO: 118543 - RNA, 27 nt, Human
acugacuuucaaaaguuuugaaguuug

SEQ ID NO: 118544 - RNA, 23 nt, Human
acuucugcucuuuuuucuuuguu

SEQ ID NO: 118545 - RNA, 19 nt, Human
ucgagugcuuagaaacccc

SEQ ID NO: 118546 - RNA, 26 nt, Human
aucugccaggcugggguguuuucggu

SEQ ID NO: 118547 - RNA, 22 nt, Human
uacaacacaugcggaccaagag

SEQ ID NO: 118548 - RNA, 20 nt, Human
caucugaagucuuugugaag

SEQ ID NO: 118549 - RNA, 20 nt, Human
agaugguuauauuacaauca

SEQ ID NO: 118550 - RNA, 21 nt, Human
gggacuccaaucugguaaugg

SEQ ID NO: 118551 - RNA, 22 nt, Human
uucauuuugcaacuuggagauu

SEQ ID NO: 118552 - RNA, 19 nt, Human
ccgggguggagcuggggug

SEQ ID NO: 118553 - RNA, 23 nt, Human
cacccuguccuggaugccucuga

SEQ ID NO: 118554 - RNA, 22 nt, Human
aagcccacauccaaaccugccu

SEQ ID NO: 118555 - RNA, 23 nt, Human
gucucgaacuccugaccucguga

SEQ ID NO: 118556 - RNA, 23 nt, Human
gucacacaggcuggagugcagug

SEQ ID NO: 118557 - RNA, 22 nt, Human
uuuaagcgauucuucugccuca

SEQ ID NO: 118558 - RNA, 27 nt, Human
gucccgggaagaguuccuggcaaagag

SEQ ID NO: 118559 - RNA, 21 nt, Human
aaagaauguccaugguggugu

SEQ ID NO: 118560 - RNA, 22 nt, Human
gcucacaccuguaauccuugca

SEQ ID NO: 118561 - RNA, 23 nt, Human
uguuacccagcuccuggaggcag

SEQ ID NO: 118562 - RNA, 19 nt, Human
cagcauuugugacacguau

SEQ ID NO: 118563 - RNA, 21 nt, Human
ccugagcccugucccugcccu

SEQ ID NO: 118564 - RNA, 22 nt, Human
cuuauggaagaaaugggagaag

SEQ ID NO: 118565 - RNA, 22 nt, Human
cuaucauuauuuagccccaccu

SEQ ID NO: 118566 - RNA, 19 nt, Human
acauggagugccuguacaa

SEQ ID NO: 118567 - RNA, 26 nt, Human
gccacugcgaggggggcugggccagu

SEQ ID NO: 118568 - RNA, 26 nt, Human
uuagcauaaaauuuucuacucuuuuu

SEQ ID NO: 118569 - RNA, 27 nt, Human
augaagcggccacagaaacuguuggug

SEQ ID NO: 118570 - RNA, 22 nt, Human
ucucuggaggccuugcuuucua

SEQ ID NO: 118571 - RNA, 21 nt, Human
ggcccuuccuuccucauuguu

SEQ ID NO: 118572 - RNA, 22 nt, Human
acucaggcuggaguacaguggu

SEQ ID NO: 118573 - RNA, 27 nt, Human
uaccaugucuuaucaguggucccuguc

SEQ ID NO: 118574 - RNA, 22 nt, Human
gcugcccuggguccugccugca

SEQ ID NO: 118575 - RNA, 26 nt, Human
cgcagcccugacucgcgcacacgcug

SEQ ID NO: 118576 - RNA, 32 nt, Human
agguagugaauuuuuaaucaucuggacuuuaa

SEQ ID NO: 118577 - RNA, 21 nt, Human
uuauaaaaucacagauuggua

SEQ ID NO: 118578 - RNA, 23 nt, Human
uaugauggcuacuacccuuuucu

SEQ ID NO: 118579 - RNA, 22 nt, Human
ugcgaggccucggggggcgcag

SEQ ID NO: 118580 - RNA, 20 nt, Human
acaaaacccaaagcuuuuca

SEQ ID NO: 118581 - RNA, 21 nt, Human
cuguuuuucucaacaaggagc

SEQ ID NO: 118582 - RNA, 22 nt, Human
ccuucaugccugaccucaaccc

SEQ ID NO: 118583 - RNA, 23 nt, Human
gaccacggcagggcaugaccugg

SEQ ID NO: 118584 - RNA, 19 nt, Human
gucuucuguuagugccaug

SEQ ID NO: 118585 - RNA, 25 nt, Human
uguuuuuugugcuauuaggaaauuc

SEQ ID NO: 118586 - RNA, 19 nt, Human
gccguuucuccccugggcu

SEQ ID NO: 118587 - RNA, 22 nt, Human
ucuacugccugcuggccaggcu

SEQ ID NO: 118588 - RNA, 22 nt, Human
gugugagccacugcgcccggcc

SEQ ID NO: 118589 - RNA, 22 nt, Human
gcgugagccacugugccuggcu

SEQ ID NO: 118590 - RNA, 22 nt, Human
gcgugagccacugcgccuggcc

SEQ ID NO: 118591 - RNA, 22 nt, Human
cacugcacuccagccgggguga

SEQ ID NO: 118592 - RNA, 24 nt, Human
gccaugcccacggccuccuccugu

SEQ ID NO: 118593 - RNA, 26 nt, Human
gccaggggugagagggaggaaaccgg

SEQ ID NO: 118594 - RNA, 18 nt, Human
ccaacgcguccucucaca

SEQ ID NO: 118595 - RNA, 22 nt, Human
uccuccaggacggccaggccgu

SEQ ID NO: 118596 - RNA, 24 nt, Human
cucuuucagacaaacaguccauuu

SEQ ID NO: 118597 - RNA, 19 nt, Human
gugucccaggcuggagugc

SEQ ID NO: 118598 - RNA, 27 nt, Human
uagaaggcugccuucucaugcgcauug

SEQ ID NO: 118599 - RNA, 20 nt, Human
aauucuuuaaucuguccagu

SEQ ID NO: 118600 - RNA, 25 nt, Human
ggagagcgcacacccaggcagcccu

SEQ ID NO: 118601 - RNA, 24 nt, Human
caucccugggcgccacagacgagc

SEQ ID NO: 118602 - RNA, 20 nt, Human
cccuccagcagccugguuca

SEQ ID NO: 118603 - RNA, 25 nt, Human
ugucuuugggaaaccacaggaacaa

SEQ ID NO: 118604 - RNA, 25 nt, Human
aacaaacacugcauuauguauguua

SEQ ID NO: 118605 - RNA, 24 nt, Human
ucugucucaugugugcucuucuuc

SEQ ID NO: 118606 - RNA, 26 nt, Human
ucuggcuucucucuggacugggagcu

SEQ ID NO: 118607 - RNA, 25 nt, Human
agccuccacucucccagcuugcuuu

SEQ ID NO: 118608 - RNA, 23 nt, Human
agugcugugcuucgagccugacc

SEQ ID NO: 118609 - RNA, 27 nt, Human
ugugaagugugaaaaaguagguugcug

SEQ ID NO: 118610 - RNA, 22 nt, Human
aucaucucaaacacaauaaaca

SEQ ID NO: 118611 - RNA, 21 nt, Human
ugugaccugcacucacaauau

SEQ ID NO: 118612 - RNA, 21 nt, Human
accucuauauguugcugaaac

SEQ ID NO: 118613 - RNA, 24 nt, Human
cuccucucccaucccagaaaacaa

SEQ ID NO: 118614 - RNA, 27 nt, Human
ccgcugaacaucagccugggagacgcg

SEQ ID NO: 118615 - RNA, 23 nt, Human
ugaugugagugugugugauggga

SEQ ID NO: 118616 - RNA, 18 nt, Human
auuauugcuguuugguuu

SEQ ID NO: 118617 - RNA, 19 nt, Human
uguuguguccaucauaaga

SEQ ID NO: 118618 - RNA, 27 nt, Human
uugcccaggcuggucuugaacuccuaa

SEQ ID NO: 118619 - RNA, 21 nt, Human
uccagccugggugacagagcg

SEQ ID NO: 118620 - RNA, 21 nt, Human
uccagccugggcgacagagug

SEQ ID NO: 118621 - RNA, 22 nt, Human
ccaugauaagagcaaggcuguu

SEQ ID NO: 118622 - RNA, 22 nt, Human
agacuugguuuuggcuccagcc

SEQ ID NO: 118623 - RNA, 21 nt, Human
acauuuucgguucaggaaaag

SEQ ID NO: 118624 - RNA, 21 nt, Human
ggugcuguuauccauggggaa

SEQ ID NO: 118625 - RNA, 22 nt, Human
guccucugcgucagggagcacu

SEQ ID NO: 118626 - RNA, 24 nt, Human
uucagugggcucaaucugcgcagc

SEQ ID NO: 118627 - RNA, 23 nt, Human
cugacaccugccgcugcuugagu

SEQ ID NO: 118628 - RNA, 22 nt, Human
gcaugagccaccgcgcuuggcc

SEQ ID NO: 118629 - RNA, 23 nt, Human
cccucaggcuguccucuggggag

SEQ ID NO: 118630 - RNA, 28 nt, Human
gguuucugucucuuccugguucaaucuu

SEQ ID NO: 118631 - RNA, 20 nt, Human
acuugcguugacaaaggagg

SEQ ID NO: 118632 - RNA, 23 nt, Human
gcuaaugaagaaaacuucucuua

SEQ ID NO: 118633 - RNA, 25 nt, Human
uagcaucuacuuguuuuucccaucu

SEQ ID NO: 118634 - RNA, 26 nt, Human
ccugggucuguucccugccccagugc

SEQ ID NO: 118635 - RNA, 27 nt, Human
ucuccacccguguccagcaugacggug

SEQ ID NO: 118636 - RNA, 26 nt, Human
gagaagcaggaagagggugcagugcc

SEQ ID NO: 118637 - RNA, 27 nt, Human
accuuguuuucagaaggugacucaggu

SEQ ID NO: 118638 - RNA, 22 nt, Human
ccagcccagagcccuggaggag

SEQ ID NO: 118639 - RNA, 27 nt, Human
uaguaaagugauaauuucuggaauuag

SEQ ID NO: 118640 - RNA, 26 nt, Human
cagagcuggggcugagggauggacug

SEQ ID NO: 118641 - RNA, 28 nt, Human
ccaccagccauggucuaaggacauggau

SEQ ID NO: 118642 - RNA, 21 nt, Human
gggagguggagguugcuguga

SEQ ID NO: 118643 - RNA, 23 nt, Human
cuugcccuauuuuaauucugcua

SEQ ID NO: 118644 - RNA, 20 nt, Human
gggguuucagggugggcagg

SEQ ID NO: 118645 - RNA, 17 nt, Human
gcagaugugugaggccu

SEQ ID NO: 118646 - RNA, 27 nt, Human
aaacagcuuuauugcucacacaaagcc

SEQ ID NO: 118647 - RNA, 23 nt, Human
cugcagauucuaggaccuguguc

SEQ ID NO: 118648 - RNA, 20 nt, Human
aggacagcuguccucuucug

SEQ ID NO: 118649 - RNA, 23 nt, Human
aggcugagggcuccagcacucac

SEQ ID NO: 118650 - RNA, 20 nt, Human
gccgucuauuugccacacac

SEQ ID NO: 118651 - RNA, 22 nt, Human
agcuaacuuuuguauuuuuagu

SEQ ID NO: 118652 - RNA, 23 nt, Human
gucaggagacacuguucccaaag

SEQ ID NO: 118653 - RNA, 22 nt, Human
ccauugcacuucagccugggug

SEQ ID NO: 118654 - RNA, 21 nt, Human
cauuaaagaaaaagaaaaaag

SEQ ID NO: 118655 - RNA, 21 nt, Human
aacauugcacuccaggcuggg

SEQ ID NO: 118656 - RNA, 25 nt, Human
uggcugcagccgcucucagccucgc

SEQ ID NO: 118657 - RNA, 23 nt, Human
gcacccuggugugacucuaguga

SEQ ID NO: 118658 - RNA, 21 nt, Human
caccuggcugggccucccaaa

SEQ ID NO: 118659 - RNA, 25 nt, Human
gcugcugcugccugggucucugcuc

SEQ ID NO: 118660 - RNA, 22 nt, Human
gcucacgccuguaaucccagaa

SEQ ID NO: 118661 - RNA, 22 nt, Human
gcucccgccuguaaucccagca

SEQ ID NO: 118662 - RNA, 22 nt, Human
cauugcacuccagccuggguaa

SEQ ID NO: 118663 - RNA, 22 nt, Human
cauugcacuccaaccuggguga

SEQ ID NO: 118664 - RNA, 28 nt, Human
uuuguacucuuucucuuuauuucucaga

SEQ ID NO: 118665 - RNA, 20 nt, Human
uguagcucuggaccugucuc

SEQ ID NO: 118666 - RNA, 24 nt, Human
gcuuagcccucacagggccccaag

SEQ ID NO: 118667 - RNA, 27 nt, Human
ggucucgaucuccucaccucgugaucc

SEQ ID NO: 118668 - RNA, 23 nt, Human
accuauaaacaguuuagcauuaa

SEQ ID NO: 118669 - RNA, 27 nt, Human
cacuguuuuccagccugggcaauacag

SEQ ID NO: 118670 - RNA, 17 nt, Human
uuaauaaaaauuccuua

SEQ ID NO: 118671 - RNA, 22 nt, Human
uaauugcuugaaacaacuuuca

SEQ ID NO: 118672 - RNA, 20 nt, Human
gaacuccuagguugaaggga

SEQ ID NO: 118673 - RNA, 21 nt, Human
caagccccugcccaucuggga

SEQ ID NO: 118674 - RNA, 27 nt, Human
ucacaucgcuucuguguaucucuuuca

SEQ ID NO: 118675 - RNA, 25 nt, Human
ugugucccucggugcagaaacuacc

SEQ ID NO: 118676 - RNA, 21 nt, Human
gcgcaggggagggcugcccau

SEQ ID NO: 118677 - RNA, 24 nt, Human
uguggggcucaugaaugcccacag

SEQ ID NO: 118678 - RNA, 25 nt, Human
agggagacucaggcccacacuuggg

SEQ ID NO: 118679 - RNA, 20 nt, Human
ugggguacccacugcucugg

SEQ ID NO: 118680 - RNA, 24 nt, Human
guuaccuccaccuuccugcacuca

SEQ ID NO: 118681 - RNA, 30 nt, Human
ggcgcggaggcaggaggagcagucucauug

SEQ ID NO: 118682 - RNA, 21 nt, Human
uucuugauaaagaagauucug

SEQ ID NO: 118683 - RNA, 24 nt, Human
gacagagcaggucccugugucucc

SEQ ID NO: 118684 - RNA, 24 nt, Human
agauacuacugaccagacaagcug

SEQ ID NO: 118685 - RNA, 21 nt, Human
uguccccggcuggagcccagc

SEQ ID NO: 118686 - RNA, 23 nt, Human
gagcuggggacucagggaccggu

SEQ ID NO: 118687 - RNA, 26 nt, Human
uucccaaguuucuccuugguccuccu

SEQ ID NO: 118688 - RNA, 21 nt, Human
caggcagcugcgcgcggcugg

SEQ ID NO: 118689 - RNA, 22 nt, Human
cugcagcuacucuucagaucug

SEQ ID NO: 118690 - RNA, 23 nt, Human
cgaguagcugggaucgcaggcgc

SEQ ID NO: 118691 - RNA, 27 nt, Human
guccagccugggcaaccccaccccugg

SEQ ID NO: 118692 - RNA, 26 nt, Human
cugccucucaaucccugucccaagcc

SEQ ID NO: 118693 - RNA, 27 nt, Human
acuaagcuuuuguagcugacaaggaaa

SEQ ID NO: 118694 - RNA, 24 nt, Human
cacacugugugaggcugugucucu

SEQ ID NO: 118695 - RNA, 23 nt, Human
ucuagauauccaacagugagggu

SEQ ID NO: 118696 - RNA, 22 nt, Human
cccagccucugacuugcugugu

SEQ ID NO: 118697 - RNA, 23 nt, Human
ggaaagaauugcuccaaaaaucu

SEQ ID NO: 118698 - RNA, 18 nt, Human
ucuguacugauugcgcca

SEQ ID NO: 118699 - RNA, 21 nt, Human
uccaguguauaaauccaauau

SEQ ID NO: 118700 - RNA, 23 nt, Human
augaggaaccaccuccuccuacu

SEQ ID NO: 118701 - RNA, 22 nt, Human
ugggcccucugugcucuucucu

SEQ ID NO: 118702 - RNA, 21 nt, Human
ucucuuucuuuuucuuccgac

SEQ ID NO: 118703 - RNA, 21 nt, Human
ugagggaagaaagacccuuua

SEQ ID NO: 118704 - RNA, 21 nt, Human
gucaccuagcagauauguauu

SEQ ID NO: 118705 - RNA, 21 nt, Human
ccucccaguugaggcaguagc

SEQ ID NO: 118706 - RNA, 21 nt, Human
gaucauaccacuucauuccag

SEQ ID NO: 118707 - RNA, 24 nt, Human
gggcucaaugucuccuacuaucca

SEQ ID NO: 118708 - RNA, 19 nt, Human
cucccagcucaguauuuaa

SEQ ID NO: 118709 - RNA, 25 nt, Human
ugugauuuugcuaaaaugcaucacc

SEQ ID NO: 118710 - RNA, 21 nt, Human
gcggugguaggguggagggga

SEQ ID NO: 118711 - RNA, 25 nt, Human
uugcuugcacuauaggagucauaaa

SEQ ID NO: 118712 - RNA, 26 nt, Human
aacugaagaacauuuuuaauucuuua

SEQ ID NO: 118713 - RNA, 21 nt, Human
gcaguuugauuuuuauuuuua

SEQ ID NO: 118714 - RNA, 23 nt, Human
acucucucaguacaucaaaauca

SEQ ID NO: 118715 - RNA, 30 nt, Human
gcacuuagccaugggcugggcucaagaacc

SEQ ID NO: 118716 - RNA, 26 nt, Human
ccaccuugacaccaggcaauguaguu

SEQ ID NO: 118717 - RNA, 20 nt, Human
uuucagcauuaaauauuuca

SEQ ID NO: 118718 - RNA, 20 nt, Human
gaugccacucugcucugccu

SEQ ID NO: 118719 - RNA, 19 nt, Human
ggggcuucccaggaggcag

SEQ ID NO: 118720 - RNA, 15 nt, Human
cuucccuuccagcau

SEQ ID NO: 118721 - RNA, 22 nt, Human
agcucacugcaaccuccgccuc

SEQ ID NO: 118722 - RNA, 20 nt, Human
caggcagcaaaaucucaagg

SEQ ID NO: 118723 - RNA, 23 nt, Human
cacugcagucuccagccugagcc

SEQ ID NO: 118724 - RNA, 23 nt, Human
ggcugcacucuugaacugggcga

SEQ ID NO: 118725 - RNA, 21 nt, Human
ccaggcagcugggauucaauu

SEQ ID NO: 118726 - RNA, 27 nt, Human
uccacuaacaggaaacacuucucaccc

SEQ ID NO: 118727 - RNA, 18 nt, Human
uuugcaccucaucaugcc

SEQ ID NO: 118728 - RNA, 24 nt, Human
uuuguaugauccuaaugaaugcau

SEQ ID NO: 118729 - RNA, 27 nt, Human
ugggaggcagagggcacaaaccuuaua

SEQ ID NO: 118730 - RNA, 19 nt, Human
gagcaggagguggagcagc

SEQ ID NO: 118731 - RNA, 22 nt, Human
aacuacaggugugcaccaccau

SEQ ID NO: 118732 - RNA, 25 nt, Human
gccucucccccauucuguguguguc

SEQ ID NO: 118733 - RNA, 24 nt, Human
uuugggaagagaaaguuaucaaga

SEQ ID NO: 118734 - RNA, 27 nt, Human
uaauccuuucuuuagaaugcuguuuaa

SEQ ID NO: 118735 - RNA, 22 nt, Human
cuuccaaccauuuaucuugaag

SEQ ID NO: 118736 - RNA, 25 nt, Human
ggggugagaggaugggugauggggu

SEQ ID NO: 118737 - RNA, 22 nt, Human
cuacaaauacucuuaggaagag

SEQ ID NO: 118738 - RNA, 23 nt, Human
augccccaggcagcccgggcaca

SEQ ID NO: 118739 - RNA, 27 nt, Human
gauuacaucauguauuuugccucaugu

SEQ ID NO: 118740 - RNA, 26 nt, Human
cuaggaaagugccuacuuuuagguca

SEQ ID NO: 118741 - RNA, 22 nt, Human
aagucacagauauauuucucca

SEQ ID NO: 118742 - RNA, 27 nt, Human
ccggcucccagugucugcccggcuccc

SEQ ID NO: 118743 - RNA, 28 nt, Human
gcagugagccaccauggaggaccaagca

SEQ ID NO: 118744 - RNA, 22 nt, Human
caacccagggagucaaggacca

SEQ ID NO: 118745 - RNA, 24 nt, Human
ccagggauuagagaaaagagcagg

SEQ ID NO: 118746 - RNA, 22 nt, Human
uucaaagcuuuccuguuuccag

SEQ ID NO: 118747 - RNA, 23 nt, Human
uucuucugugggagaacuuaaug

SEQ ID NO: 118748 - RNA, 21 nt, Human
uaacauaguaaagacuuucua

SEQ ID NO: 118749 - RNA, 27 nt, Human
ugcacaccucaugagucuaccugagca

SEQ ID NO: 118750 - RNA, 20 nt, Human
aagcuuuacuacuguggaaa

SEQ ID NO: 118751 - RNA, 22 nt, Human
ggggagaagagggguggcgcag

SEQ ID NO: 118752 - RNA, 26 nt, Human
uauucuauguguauguauauguacau

SEQ ID NO: 118753 - RNA, 19 nt, Human
gcaaaacucuccccugucc

SEQ ID NO: 118754 - RNA, 27 nt, Human
ccccacccccaauccggcugaggggca

SEQ ID NO: 118755 - RNA, 20 nt, Human
ccagcagagcauguuggaca

SEQ ID NO: 118756 - RNA, 21 nt, Human
aaaagccccuuccauccugcu

SEQ ID NO: 118757 - RNA, 26 nt, Human
ggaccuugacucuuccacaccugccu

SEQ ID NO: 118758 - RNA, 24 nt, Human
ugucgcccaugcuggagugcagug

SEQ ID NO: 118759 - RNA, 23 nt, Human
ggaagaggaagggagaggcaagc

SEQ ID NO: 118760 - RNA, 19 nt, Human
cgaguuacagccugggcaa

SEQ ID NO: 118761 - RNA, 23 nt, Human
gguggcuucccauccccaaaagg

SEQ ID NO: 118762 - RNA, 27 nt, Human
ucugucugacucugggucagugacccu

SEQ ID NO: 118763 - RNA, 24 nt, Human
ucaguauuuacuggaaaauggaca

SEQ ID NO: 118764 - RNA, 23 nt, Human
agcacuguuggagcuacugcaaa

SEQ ID NO: 118765 - RNA, 23 nt, Human
uguuuucagguggucuggaggca

SEQ ID NO: 118766 - RNA, 22 nt, Human
uccagugaguugagaucaugcc

SEQ ID NO: 118767 - RNA, 24 nt, Human
cuuacccugggcuggagaguuggu

SEQ ID NO: 118768 - RNA, 22 nt, Human
cacugagaaagaaguagaagac

SEQ ID NO: 118769 - RNA, 21 nt, Human
caggaggaagagguugcagug

SEQ ID NO: 118770 - RNA, 27 nt, Human
gcuauuuuucuuauagaagagaaaaug

SEQ ID NO: 118771 - RNA, 25 nt, Human
gagccccgggagagaggagcgaaga

SEQ ID NO: 118772 - RNA, 19 nt, Human
gcaaugucucaggugugga

SEQ ID NO: 118773 - RNA, 22 nt, Human
gggauuacaggcgugcgccacu

SEQ ID NO: 118774 - RNA, 22 nt, Human
cacugcacucuagccggaguga

SEQ ID NO: 118775 - RNA, 23 nt, Human
accggcauguuuccagcagaaga

SEQ ID NO: 118776 - RNA, 21 nt, Human
acccagucuggucuggcuugc

SEQ ID NO: 118777 - RNA, 21 nt, Human
gcagaaggcaagcaccaggcu

SEQ ID NO: 118778 - RNA, 26 nt, Human
ugccauggccaggagcuaagugccuu

SEQ ID NO: 118779 - RNA, 21 nt, Human
ccugagccaccauaauaugcu

SEQ ID NO: 118780 - RNA, 24 nt, Human
ccuacuguaccucgugccugcugc

SEQ ID NO: 118781 - RNA, 20 nt, Human
agggaucugccagcacccug

SEQ ID NO: 118782 - RNA, 26 nt, Human
gucucuuggaauuaucugaccaugaa

SEQ ID NO: 118783 - RNA, 22 nt, Human
ccagccgccgcgcccgccucgg

SEQ ID NO: 118784 - RNA, 22 nt, Human
uuggggccagcaucucccacug

SEQ ID NO: 118785 - RNA, 21 nt, Human
ucuaauuuauaaggauccccc

SEQ ID NO: 118786 - RNA, 18 nt, Human
uacaaguccuuugucagu

SEQ ID NO: 118787 - RNA, 20 nt, Human
caacaccauugaaggcucau

SEQ ID NO: 118788 - RNA, 23 nt, Human
ucccuguucauuguaagcacuuu

SEQ ID NO: 118789 - RNA, 21 nt, Human
cucuuggaaguucaggcucgg

SEQ ID NO: 118790 - RNA, 24 nt, Human
cugggaguuguguuuugcuuuggc

SEQ ID NO: 118791 - RNA, 22 nt, Human
uggcucacaccugugaucccag

SEQ ID NO: 118792 - RNA, 21 nt, Human
cucuuguauaugaugaucugg

SEQ ID NO: 118793 - RNA, 17 nt, Human
gaguugagcagccuuuc

SEQ ID NO: 118794 - RNA, 27 nt, Human
agggacaagaggagcagaggacaggug

SEQ ID NO: 118795 - RNA, 22 nt, Human
ccuaggacccuaaauccaauag

SEQ ID NO: 118796 - RNA, 22 nt, Human
caaccuugggguaaacugaggu

SEQ ID NO: 118797 - RNA, 22 nt, Human
uacacuccuaucaucagcacuu

SEQ ID NO: 118798 - RNA, 22 nt, Human
aguucugacaguguuuuaggug

SEQ ID NO: 118799 - RNA, 19 nt, Human
gcacuuaaaugauguaaua

SEQ ID NO: 118800 - RNA, 23 nt, Human
ccaggaggucagggcugcaguga

SEQ ID NO: 118801 - RNA, 21 nt, Human
ccaggauagagacuggaacac

SEQ ID NO: 118802 - RNA, 24 nt, Human
aaccggagcugaauuaccuuucac

SEQ ID NO: 118803 - RNA, 19 nt, Human
uaaagaauguugguaaugc

SEQ ID NO: 118804 - RNA, 24 nt, Human
cuuaaaaaauguacuugcacaagg

SEQ ID NO: 118805 - RNA, 23 nt, Human
cuaaaauuucugagaacagugca

SEQ ID NO: 118806 - RNA, 21 nt, Human
ccuguaaucccagcccuuugg

SEQ ID NO: 118807 - RNA, 21 nt, Human
ccuguacucccagcacuuugg

SEQ ID NO: 118808 - RNA, 24 nt, Human
gcaaaaacuuccaucacaacaaga

SEQ ID NO: 118809 - RNA, 21 nt, Human
uuucugaaauguacuaucuua

SEQ ID NO: 118810 - RNA, 21 nt, Human
cuugcgcccguuccaccuccc

SEQ ID NO: 118811 - RNA, 22 nt, Human
gagagaagagaaggcagcagca

SEQ ID NO: 118812 - RNA, 24 nt, Human
aucagcuguugcuugaaaccuguu

SEQ ID NO: 118813 - RNA, 23 nt, Human
gauguucuuccagugaggcaucu

SEQ ID NO: 118814 - RNA, 22 nt, Human
uauucccucuuguccuuuaaua

SEQ ID NO: 118815 - RNA, 22 nt, Human
cucuaggaaaagagaacuuuuu

SEQ ID NO: 118816 - RNA, 23 nt, Human
gaggucaagaccagccugggcaa

SEQ ID NO: 118817 - RNA, 26 nt, Human
caugaucuugagcaaguuccuucugg

SEQ ID NO: 118818 - RNA, 27 nt, Human
ggcugcaggguaugugaggcugagcaa

SEQ ID NO: 118819 - RNA, 22 nt, Human
ugcaaccucugccuccuggguu

SEQ ID NO: 118820 - RNA, 22 nt, Human
cgcaaccucugccucccggguu

SEQ ID NO: 118821 - RNA, 20 nt, Human
ccuccgcucuccuguccucg

SEQ ID NO: 118822 - RNA, 24 nt, Human
agcauuuuuacguacuugagcuuu

SEQ ID NO: 118823 - RNA, 26 nt, Human
uuucuuucuguuuuuuaauaccuggu

SEQ ID NO: 118824 - RNA, 21 nt, Human
gugaacaucuuaugaauguac

SEQ ID NO: 118825 - RNA, 27 nt, Human
ugccaugagaucauagggguucccauu

SEQ ID NO: 118826 - RNA, 18 nt, Human
caguugcuguuuacuuga

SEQ ID NO: 118827 - RNA, 21 nt, Human
uucucagauauuaagaaguug

SEQ ID NO: 118828 - RNA, 25 nt, Human
aaagguggcuuugaaggaggaagac

SEQ ID NO: 118829 - RNA, 26 nt, Human
cccaucucaggccagagccaaggggc

SEQ ID NO: 118830 - RNA, 22 nt, Human
uucacguaagauacaaguuuca

SEQ ID NO: 118831 - RNA, 20 nt, Human
acacagccugggaggcgcag

SEQ ID NO: 118832 - RNA, 27 nt, Human
agauguugagaccuguuuggucuaaua

SEQ ID NO: 118833 - RNA, 24 nt, Human
ugggaguaagaagugcuguggaaa

SEQ ID NO: 118834 - RNA, 25 nt, Human
uggagguggcgggaggggucaguga

SEQ ID NO: 118835 - RNA, 21 nt, Human
aaccuaacuugaaucaugcga

SEQ ID NO: 118836 - RNA, 27 nt, Human
uccaaguagcuccaaaugcaauuuuua

SEQ ID NO: 118837 - RNA, 20 nt, Human
cugagacacaguuuucaucu

SEQ ID NO: 118838 - RNA, 25 nt, Human
ggaagcagcagcugcaggcccagug

SEQ ID NO: 118839 - RNA, 23 nt, Human
uugaugagagaggcgggccuccu

SEQ ID NO: 118840 - RNA, 19 nt, Human
ucugcaccuggauuuugga

SEQ ID NO: 118841 - RNA, 27 nt, Human
cuacugcacugccuggcucagcugcac

SEQ ID NO: 118842 - RNA, 26 nt, Human
ccugcagccgcagagauguugaugcc

SEQ ID NO: 118843 - RNA, 23 nt, Human
gaaggauuccugcaucacuguga

SEQ ID NO: 118844 - RNA, 27 nt, Human
uguuuuuaaaaaauuaaacaaggcuuu

SEQ ID NO: 118845 - RNA, 23 nt, Human
ggcuggaguuggggcagaggaga

SEQ ID NO: 118846 - RNA, 20 nt, Human
caccucugugcagggcacag

SEQ ID NO: 118847 - RNA, 25 nt, Human
ucgcuuugucaccaggcuggagugc

SEQ ID NO: 118848 - RNA, 24 nt, Human
cagacagagcuugugccggauuug

SEQ ID NO: 118849 - RNA, 29 nt, Human
gugggaaucaggcuuuucccgcagaaaac

SEQ ID NO: 118850 - RNA, 31 nt, Human
cagggguuacaccugcccuccguggucccuc

SEQ ID NO: 118851 - RNA, 21 nt, Human
ucgcccaggcuggaaugcagu

SEQ ID NO: 118852 - RNA, 26 nt, Human
cugcugucuauguggcuguaucuugu

SEQ ID NO: 118853 - RNA, 25 nt, Human
uugaugucaugugaggaaauaaugc

SEQ ID NO: 118854 - RNA, 21 nt, Human
ucacagaaaaacuguuuacuu

SEQ ID NO: 118855 - RNA, 25 nt, Human
gaaaaguuugcuugacauggugcuu

SEQ ID NO: 118856 - RNA, 26 nt, Human
ccccaacagucccucagcuucaccca

SEQ ID NO: 118857 - RNA, 22 nt, Human
auaccuguuauaccagcacuuu

SEQ ID NO: 118858 - RNA, 23 nt, Human
cuaucucaccaguauuugcucuc

SEQ ID NO: 118859 - RNA, 21 nt, Human
gggaaucagugaaguguuuag

SEQ ID NO: 118860 - RNA, 27 nt, Human
cuccacccuccccacccccucggggca

SEQ ID NO: 118861 - RNA, 20 nt, Human
uaaaaauauaaaaaggcaau

SEQ ID NO: 118862 - RNA, 21 nt, Human
agagggagguauggacugggg

SEQ ID NO: 118863 - RNA, 21 nt, Human
acauugggcugaacuaaucca

SEQ ID NO: 118864 - RNA, 22 nt, Human
guucagaaguuuggcugugaug

SEQ ID NO: 118865 - RNA, 23 nt, Human
gaggaagagaugcccaugaagca

SEQ ID NO: 118866 - RNA, 20 nt, Human
cauccuggcucagcucucaa

SEQ ID NO: 118867 - RNA, 23 nt, Human
gaacccaggccuggggggcggug

SEQ ID NO: 118868 - RNA, 22 nt, Human
cucuaccaauauacaaaaauua

SEQ ID NO: 118869 - RNA, 22 nt, Human
cagggaggggcaguccuuggca

SEQ ID NO: 118870 - RNA, 23 nt, Human
cgcacgaugcagaccucaugccc

SEQ ID NO: 118871 - RNA, 24 nt, Human
acaagcagaggggggaggacaguc

SEQ ID NO: 118872 - RNA, 22 nt, Human
ucacugcaagcucugcguccug

SEQ ID NO: 118873 - RNA, 22 nt, Human
cacaccuguaaucccagaacuu

SEQ ID NO: 118874 - RNA, 27 nt, Human
ggcccggacucuccuaugugacuuuag

SEQ ID NO: 118875 - RNA, 21 nt, Human
uaguaucuuagaugauuuuag

SEQ ID NO: 118876 - RNA, 24 nt, Human
aucaucgacgaggcgcacaaccug

SEQ ID NO: 118877 - RNA, 22 nt, Human
ccucuucucccugcccugauca

SEQ ID NO: 118878 - RNA, 22 nt, Human
gucacccagguucgaguucagu

SEQ ID NO: 118879 - RNA, 27 nt, Human
ccagcacuucuggaacugugcuucucu

SEQ ID NO: 118880 - RNA, 21 nt, Human
uuuguuucuucaccuugauuu

SEQ ID NO: 118881 - RNA, 26 nt, Human
gcucccucuccucacccuccugcacc

SEQ ID NO: 118882 - RNA, 20 nt, Human
acuuuuguugcccaggcugg

SEQ ID NO: 118883 - RNA, 27 nt, Human
cccgacauuccucgguauuuauugucu

SEQ ID NO: 118884 - RNA, 26 nt, Human
ggccaacaugacuaagcucucucaug

SEQ ID NO: 118885 - RNA, 20 nt, Human
cacugccugacauucacuuc

SEQ ID NO: 118886 - RNA, 25 nt, Human
uugagagaaggagaggaagauacag

SEQ ID NO: 118887 - RNA, 27 nt, Human
gggaggcggagauugcagugaaccaag

SEQ ID NO: 118888 - RNA, 20 nt, Human
aaggcaaaaucaauuuugua

SEQ ID NO: 118889 - RNA, 32 nt, Human
aggacaccauagcggagaacuccugacgccca

SEQ ID NO: 118890 - RNA, 22 nt, Human
aggcuggagugcaauggcaguu

SEQ ID NO: 118891 - RNA, 21 nt, Human
ugaaaagaguguggaucuucu

SEQ ID NO: 118892 - RNA, 22 nt, Human
cucgucgucgccaccuucccuc

SEQ ID NO: 118893 - RNA, 21 nt, Human
agcagauucuuuuccuucuca

SEQ ID NO: 118894 - RNA, 22 nt, Human
cuaugcucucccuccguguccc

SEQ ID NO: 118895 - RNA, 26 nt, Human
cuuacuuccucuauucucugagccgc

SEQ ID NO: 118896 - RNA, 30 nt, Human
gcuuaugcgguaaaaccucuaccaccccaa

SEQ ID NO: 118897 - RNA, 26 nt, Human
guuuuagucccuucuuaugguuggca

SEQ ID NO: 118898 - RNA, 20 nt, Human
ggggguggggauggcaaguc

SEQ ID NO: 118899 - RNA, 28 nt, Human
gagcuggggaugaaugcuuagugcccuc

SEQ ID NO: 118900 - RNA, 22 nt, Human
gaagauaaaaagacauucuucc

SEQ ID NO: 118901 - RNA, 25 nt, Human
cacuuugguuccagcauccugucca

SEQ ID NO: 118902 - RNA, 27 nt, Human
cugcacaagccaugcuggcucagucug

SEQ ID NO: 118903 - RNA, 22 nt, Human
gucacauucuauuuuggguauu

SEQ ID NO: 118904 - RNA, 22 nt, Human
aggagcagcagccagcaccacc

SEQ ID NO: 118905 - RNA, 21 nt, Human
uaugggcauccucucuggucu

SEQ ID NO: 118906 - RNA, 22 nt, Human
uagaugccaucuguguguccuc

SEQ ID NO: 118907 - RNA, 21 nt, Human
cuaaccucccuuaagcagcaa

SEQ ID NO: 118908 - RNA, 23 nt, Human
ugagccaaggacagggcuggcuc

SEQ ID NO: 118909 - RNA, 24 nt, Human
acaguugguugucuugucuuccag

SEQ ID NO: 118910 - RNA, 26 nt, Human
ccagcacugaggagcucgccugcugc

SEQ ID NO: 118911 - RNA, 25 nt, Human
uagagcccuggauggccccugagcc

SEQ ID NO: 118912 - RNA, 21 nt, Human
ugcaagugucaaauaugcaaa

SEQ ID NO: 118913 - RNA, 22 nt, Human
ucuuguccaggcuggagugcaa

SEQ ID NO: 118914 - RNA, 25 nt, Human
ccagagccggcauccuugccugucu

SEQ ID NO: 118915 - RNA, 27 nt, Human
uuaauggcucaucaacaaucacaacca

SEQ ID NO: 118916 - RNA, 32 nt, Human
agggguuucuggcaccuaccuaccugcuuccc

SEQ ID NO: 118917 - RNA, 22 nt, Human
cucaagcaauccuccugccuca

SEQ ID NO: 118918 - RNA, 20 nt, Human
ccuucaggcaucauucucaa

SEQ ID NO: 118919 - RNA, 27 nt, Human
uugcccaggguggagugcaguggcaug

SEQ ID NO: 118920 - RNA, 24 nt, Human
auguaguuuuguuuaugcauuugg

SEQ ID NO: 118921 - RNA, 23 nt, Human
ccgccugacgcuccucucugucu

SEQ ID NO: 118922 - RNA, 22 nt, Human
aaagauaacauguaggccaggc

SEQ ID NO: 118923 - RNA, 20 nt, Human
ugugucucguccugcccgca

SEQ ID NO: 118924 - RNA, 18 nt, Human
agcucuccuaccaccuca

SEQ ID NO: 118925 - RNA, 21 nt, Human
ccuuccccaugcuuccuugcc

SEQ ID NO: 118926 - RNA, 27 nt, Human
ggcaguggcuguuuuuagacuuucuua

SEQ ID NO: 118927 - RNA, 19 nt, Human
ugcuaucucccaugucauc

SEQ ID NO: 118928 - RNA, 23 nt, Human
ggaguucccuggccugggguccc

SEQ ID NO: 118929 - RNA, 24 nt, Human
gcauuagucucccuuucacuguuu

SEQ ID NO: 118930 - RNA, 17 nt, Human
gaaaauauuuugucuaa

SEQ ID NO: 118931 - RNA, 23 nt, Human
ccaaguagcagggacuacagagu

SEQ ID NO: 118932 - RNA, 26 nt, Human
agggcagcaggccugguugcagcugg

SEQ ID NO: 118933 - RNA, 22 nt, Human
augcccacgcuggagugcagug

SEQ ID NO: 118934 - RNA, 21 nt, Human
uuccagacugggggcccuggg

SEQ ID NO: 118935 - RNA, 20 nt, Human
ucaacagcauuaaacaguca

SEQ ID NO: 118936 - RNA, 21 nt, Human
ggcugagcuuguccugccuuc

SEQ ID NO: 118937 - RNA, 21 nt, Human
uaaagugcuugaggcuaccuc

SEQ ID NO: 118938 - RNA, 21 nt, Human
uagagcugucugccacagccu

SEQ ID NO: 118939 - RNA, 22 nt, Human
agagaauaugucacauuucuga

SEQ ID NO: 118940 - RNA, 23 nt, Human
accaugcuuggcuaauuuuuugg

SEQ ID NO: 118941 - RNA, 24 nt, Human
gcaaauuaucacuaacaggucuuu

SEQ ID NO: 118942 - RNA, 21 nt, Human
uuucucugguugucaguuucc

SEQ ID NO: 118943 - RNA, 21 nt, Human
uaaagugccuauugaaacucu

SEQ ID NO: 118944 - RNA, 27 nt, Human
agaagcagagaaggcacuugcauccua

SEQ ID NO: 118945 - RNA, 25 nt, Human
cacuccuguccaaacuguuguauaa

SEQ ID NO: 118946 - RNA, 21 nt, Human
ccuccuccuucaugcagccag

SEQ ID NO: 118947 - RNA, 28 nt, Human
uuagcuacucucaccugaggcuacugag

SEQ ID NO: 118948 - RNA, 21 nt, Human
aggccccagagcuugcugucc

SEQ ID NO: 118949 - RNA, 22 nt, Human
cacaucugccuuuuccacaagc

SEQ ID NO: 118950 - RNA, 22 nt, Human
aaaauuuaagacaaguucaaca

SEQ ID NO: 118951 - RNA, 27 nt, Human
gcgugagccaccgccccugacaugagc

SEQ ID NO: 118952 - RNA, 21 nt, Human
cugucucuuagggcaguauuu

SEQ ID NO: 118953 - RNA, 24 nt, Human
cugggguuuauuuaaacuguucug

SEQ ID NO: 118954 - RNA, 24 nt, Human
acgcauucacucggggcaguauua

SEQ ID NO: 118955 - RNA, 22 nt, Human
ggaaaggaaaccggcacugccu

SEQ ID NO: 118956 - RNA, 19 nt, Human
cagaacugagcccagugag

SEQ ID NO: 118957 - RNA, 22 nt, Human
cagguguccauccccgugcuga

SEQ ID NO: 118958 - RNA, 23 nt, Human
guagaaaucuauucacaauucag

SEQ ID NO: 118959 - RNA, 27 nt, Human
gggagagaaugagccccgggacccgcc

SEQ ID NO: 118960 - RNA, 22 nt, Human
caggcuggagugcaguggcaug

SEQ ID NO: 118961 - RNA, 22 nt, Human
caggcuggagcacaguggugug

SEQ ID NO: 118962 - RNA, 27 nt, Human
uuacagcuuccuuguaaccacagcccu

SEQ ID NO: 118963 - RNA, 18 nt, Human
ggcuuuggggccccuuag

SEQ ID NO: 118964 - RNA, 23 nt, Human
aaaaugaaagaaaaugagagcag

SEQ ID NO: 118965 - RNA, 22 nt, Human
cugugcugcuuuuccaugagcu

SEQ ID NO: 118966 - RNA, 22 nt, Human
ggggugagucagacaggucuga

SEQ ID NO: 118967 - RNA, 21 nt, Human
ccgcccaggcuggagugcagu

SEQ ID NO: 118968 - RNA, 20 nt, Human
gcagcgugaucacacuuacc

SEQ ID NO: 118969 - RNA, 21 nt, Human
agcucuuuuccagaucaaaga

SEQ ID NO: 118970 - RNA, 21 nt, Human
uccagccucuggggccuuggc

SEQ ID NO: 118971 - RNA, 21 nt, Human
ucaugaaccugccaauuugua

SEQ ID NO: 118972 - RNA, 19 nt, Human
agguaaaauaauuugcccg

SEQ ID NO: 118973 - RNA, 24 nt, Human
cuacuugccugggaaacauagcag

SEQ ID NO: 118974 - RNA, 20 nt, Human
agcuauuucaaaguguguug

SEQ ID NO: 118975 - RNA, 24 nt, Human
cugccaccacaccuggcuaauuuu

SEQ ID NO: 118976 - RNA, 20 nt, Human
gugccucugccugucucccc

SEQ ID NO: 118977 - RNA, 26 nt, Human
gaugagaaaacuaacacccagaaagg

SEQ ID NO: 118978 - RNA, 26 nt, Human
ccuaccuggccccugagcucuggagc

SEQ ID NO: 118979 - RNA, 24 nt, Human
ccagcuccucacaccacagccagg

SEQ ID NO: 118980 - RNA, 26 nt, Human
ccacacuccggcuccuaugucaccuu

SEQ ID NO: 118981 - RNA, 25 nt, Human
cagaaagagagacaucaugaccagg

SEQ ID NO: 118982 - RNA, 23 nt, Human
ugguacagcccucacagcucuuc

SEQ ID NO: 118983 - RNA, 26 nt, Human
acucauugauuggguuucuacuucuu

SEQ ID NO: 118984 - RNA, 22 nt, Human
ugaaaacacaagcccaggagug

SEQ ID NO: 118985 - RNA, 21 nt, Human
gacccaggcugucauuccagg

SEQ ID NO: 118986 - RNA, 18 nt, Human
cugcuaaaaauggucuua

SEQ ID NO: 118987 - RNA, 21 nt, Human
ccuccacuccacucugcuucc

SEQ ID NO: 118988 - RNA, 26 nt, Human
ugugaugaugucauugccauguagug

SEQ ID NO: 118989 - RNA, 20 nt, Human
auggcacguucucagcucac

SEQ ID NO: 118990 - RNA, 27 nt, Human
guugcccaugcuggagugcaauggcac

SEQ ID NO: 118991 - RNA, 26 nt, Human
ucaccauuuacaugaggggaaacacu

SEQ ID NO: 118992 - RNA, 21 nt, Human
gaaaugucaugauugccgggg

SEQ ID NO: 118993 - RNA, 21 nt, Human
cacccaggcuuugggugaauu

SEQ ID NO: 118994 - RNA, 29 nt, Human
gcaagcauuagcuaucacagcaaaggauu

SEQ ID NO: 118995 - RNA, 26 nt, Human
ugccuaggcuugggguggagcuucaa

SEQ ID NO: 118996 - RNA, 27 nt, Human
gagcuaaauugauuuaauuacacuuuc

SEQ ID NO: 118997 - RNA, 23 nt, Human
ucagcacucuggccuucaucacg

SEQ ID NO: 118998 - RNA, 20 nt, Human
ucucccacccuuaccuccau

SEQ ID NO: 118999 - RNA, 19 nt, Human
gucuuguuugcuucuugca

SEQ ID NO: 119000 - RNA, 22 nt, Human
cccgucccugccccgccaccuc

SEQ ID NO: 119001 - RNA, 19 nt, Human
uucuuagaaaauguguuua

SEQ ID NO: 119002 - RNA, 24 nt, Human
cacccgguuccaggcagcacagac

SEQ ID NO: 119003 - RNA, 22 nt, Human
agcgauucucccaugcucaugu

SEQ ID NO: 119004 - RNA, 20 nt, Human
ucuugucagaauucugagua

SEQ ID NO: 119005 - RNA, 27 nt, Human
uugcacagggauuuguccugggggcug

SEQ ID NO: 119006 - RNA, 27 nt, Human
ugucauuguuuucuugacuaugucucu

SEQ ID NO: 119007 - RNA, 21 nt, Human
ggucucuugcuaaauauugcu

SEQ ID NO: 119008 - RNA, 18 nt, Human
cgggaggugguggaguga

SEQ ID NO: 119009 - RNA, 25 nt, Human
ggacuuugaacauuuucugaacuaa

SEQ ID NO: 119010 - RNA, 24 nt, Human
ccugaagaaagggggccagcagca

SEQ ID NO: 119011 - RNA, 23 nt, Human
cuugccuggcagagaaccuguuc

SEQ ID NO: 119012 - RNA, 20 nt, Human
cucuugcuggucaccccaag

SEQ ID NO: 119013 - RNA, 25 nt, Human
uuugcacccacugcauuugcagccu

SEQ ID NO: 119014 - RNA, 21 nt, Human
ucgucccggcugaagugcagu

SEQ ID NO: 119015 - RNA, 22 nt, Human
uuuucuuuuuauaacucauggc

SEQ ID NO: 119016 - RNA, 23 nt, Human
ggccucccugaucgucucuggcc

SEQ ID NO: 119017 - RNA, 21 nt, Human
gcucaaggagauccccgcugg

SEQ ID NO: 119018 - RNA, 21 nt, Human
ugggaggcuucacuaaaugag

SEQ ID NO: 119019 - RNA, 27 nt, Human
uggaaacacugauuuuguaaaguugcc

SEQ ID NO: 119020 - RNA, 18 nt, Human
acuacagccaucaugccu

SEQ ID NO: 119021 - RNA, 23 nt, Human
agcaagucacugagaaugagcac

SEQ ID NO: 119022 - RNA, 22 nt, Human
ucagaugacccaccugccucgg

SEQ ID NO: 119023 - RNA, 22 nt, Human
cuagaaauaaugucauucucaa

SEQ ID NO: 119024 - RNA, 22 nt, Human
ugucuucagaauuaaaacugcc

SEQ ID NO: 119025 - RNA, 20 nt, Human
uccccaguuuucaucccagu

SEQ ID NO: 119026 - RNA, 23 nt, Human
caaagcccuccagccuguuugug

SEQ ID NO: 119027 - RNA, 20 nt, Human
uaauggguauugacacugcu

SEQ ID NO: 119028 - RNA, 26 nt, Human
ccagcagaagccugggguaccuaguc

SEQ ID NO: 119029 - RNA, 23 nt, Human
ggagccugaaaagaaggagcagc

SEQ ID NO: 119030 - RNA, 22 nt, Human
cuggaaggcauagaacacgguu

SEQ ID NO: 119031 - RNA, 27 nt, Human
cuagccauauuuaggacaacugaagaa

SEQ ID NO: 119032 - RNA, 21 nt, Human
ggagauugaggcugcagugag

SEQ ID NO: 119033 - RNA, 18 nt, Human
ucauuuguuuacauuuga

SEQ ID NO: 119034 - RNA, 28 nt, Human
acagguguaagccaucacaccuggcccu

SEQ ID NO: 119035 - RNA, 27 nt, Human
ggcgguccgcggcggagguucaugugg

SEQ ID NO: 119036 - RNA, 23 nt, Human
cucuucucccuucacucccgucc

SEQ ID NO: 119037 - RNA, 23 nt, Human
ggggacacaguggugcucugcug

SEQ ID NO: 119038 - RNA, 20 nt, Human
uucauucucuuacauuugug

SEQ ID NO: 119039 - RNA, 26 nt, Human
cuucaccucucagcuuuagcaggaca

SEQ ID NO: 119040 - RNA, 21 nt, Human
guguccaggcuggagugcagu

SEQ ID NO: 119041 - RNA, 21 nt, Human
gcuccagcaagagaaacggga

SEQ ID NO: 119042 - RNA, 24 nt, Human
guuauuacccuguguaccuugucc

SEQ ID NO: 119043 - RNA, 23 nt, Human
agcuaaauuauagucuuuugcca

SEQ ID NO: 119044 - RNA, 26 nt, Human
uuccugagucacacagaaagcaacug

SEQ ID NO: 119045 - RNA, 23 nt, Human
gagcaucacucuuccucacacca

SEQ ID NO: 119046 - RNA, 21 nt, Human
uagaaagaaagcuguucuuga

SEQ ID NO: 119047 - RNA, 22 nt, Human
agggaggaaugaacaacuccag

SEQ ID NO: 119048 - RNA, 28 nt, Human
gcugggaaggcaggcugauggggcacac

SEQ ID NO: 119049 - RNA, 22 nt, Human
aacugcacuccagcuugggcaa

SEQ ID NO: 119050 - RNA, 24 nt, Human
ggagaggccaggccugguggcuca

SEQ ID NO: 119051 - RNA, 20 nt, Human
acaauaugaaguacagcaga

SEQ ID NO: 119052 - RNA, 24 nt, Human
uccagaccccaugccuuacgaacc

SEQ ID NO: 119053 - RNA, 22 nt, Human
ggaggcugaggcaggagaauca

SEQ ID NO: 119054 - RNA, 22 nt, Human
ggaggcugaagcaggaggauca

SEQ ID NO: 119055 - RNA, 26 nt, Human
uacaucugcauuucuacauguuuuag

SEQ ID NO: 119056 - RNA, 21 nt, Human
cuucccccucucccaguuguc

SEQ ID NO: 119057 - RNA, 27 nt, Human
ugcuguugcugggcaggcguugggcgc

SEQ ID NO: 119058 - RNA, 27 nt, Human
gaguagcugggauuacaggugcaugcc

SEQ ID NO: 119059 - RNA, 28 nt, Human
cuccuucagacugggggcuuccugagga

SEQ ID NO: 119060 - RNA, 25 nt, Human
aucugaaaggaccuuuuuuccaaau

SEQ ID NO: 119061 - RNA, 21 nt, Human
gaacggcugggcucaaagaua

SEQ ID NO: 119062 - RNA, 25 nt, Human
aaccggccacuucagcaacagcccu

SEQ ID NO: 119063 - RNA, 21 nt, Human
ucccacccuccccuccugacc

SEQ ID NO: 119064 - RNA, 21 nt, Human
ccugcucccagccucuugcuc

SEQ ID NO: 119065 - RNA, 27 nt, Human
acuagcauuauuuaaaaguuucacauu

SEQ ID NO: 119066 - RNA, 18 nt, Human
ucugcucccaucucucuc

SEQ ID NO: 119067 - RNA, 21 nt, Human
cacaagucaggaguucgagac

SEQ ID NO: 119068 - RNA, 25 nt, Human
ugcccaggccuguggguagugggga

SEQ ID NO: 119069 - RNA, 20 nt, Human
aguggcuucuccauccuguu

SEQ ID NO: 119070 - RNA, 22 nt, Human
ccacuguacuccagccugggag

SEQ ID NO: 119071 - RNA, 27 nt, Human
acuaagcugaugcaaaacagcggcaga

SEQ ID NO: 119072 - RNA, 26 nt, Human
aaaugagugacaacacuacucugccu

SEQ ID NO: 119073 - RNA, 27 nt, Human
ccagaagcgccgggguuccucgaagca

SEQ ID NO: 119074 - RNA, 21 nt, Human
uuucccugggaaggcuggggg

SEQ ID NO: 119075 - RNA, 21 nt, Human
acacauuuggccacaaaacac

SEQ ID NO: 119076 - RNA, 18 nt, Human
gggcucccuccggggugc

SEQ ID NO: 119077 - RNA, 27 nt, Human
uccucaucagccuuucauccuuaguuu

SEQ ID NO: 119078 - RNA, 22 nt, Human
gcacacuccuguaaucccagcu

SEQ ID NO: 119079 - RNA, 27 nt, Human
guaaagugccuuauaggaauuugcgua

SEQ ID NO: 119080 - RNA, 27 nt, Human
agagacacccacuuagaaaguuaacug

SEQ ID NO: 119081 - RNA, 25 nt, Human
cuuccugcugacccugagagccucu

SEQ ID NO: 119082 - RNA, 20 nt, Human
ucauucuucuuggcucacca

SEQ ID NO: 119083 - RNA, 24 nt, Human
cucaugaauagcugggauuacagg

SEQ ID NO: 119084 - RNA, 28 nt, Human
ggccucuccuucgcuucucucuggcaag

SEQ ID NO: 119085 - RNA, 24 nt, Human
caguucuuauuugcaccuacuuca

SEQ ID NO: 119086 - RNA, 22 nt, Human
gcucacugcaguuuugaccucc

SEQ ID NO: 119087 - RNA, 22 nt, Human
uuuucucuuagaacauuguauu

SEQ ID NO: 119088 - RNA, 23 nt, Human
uuucuguguuuugccugccucug

SEQ ID NO: 119089 - RNA, 23 nt, Human
ugaacugaacaggcuuucauuuc

SEQ ID NO: 119090 - RNA, 25 nt, Human
uggggaauccuggugaauauagugc

SEQ ID NO: 119091 - RNA, 25 nt, Human
uucuaauucucauuuaauuuuagga

SEQ ID NO: 119092 - RNA, 26 nt, Human
gcugccucuugugccucuggcacagc

SEQ ID NO: 119093 - RNA, 27 nt, Human
ugucacccaggcuggaguacacuggca

SEQ ID NO: 119094 - RNA, 27 nt, Human
gggagauggaaguugcagugaaccaag

SEQ ID NO: 119095 - RNA, 26 nt, Human
uucaggccaacauggccgugcugcug

SEQ ID NO: 119096 - RNA, 23 nt, Human
ugccucgcuggggaggucuugga

SEQ ID NO: 119097 - RNA, 24 nt, Human
aggaucucauuuggaacagauuac

SEQ ID NO: 119098 - RNA, 22 nt, Human
guuaucgaaauaacaauguuaa

SEQ ID NO: 119099 - RNA, 23 nt, Human
gaaaaggcuaagcuucacuguaa

SEQ ID NO: 119100 - RNA, 23 nt, Human
aaccuguuuuuaaucagugacuc

SEQ ID NO: 119101 - RNA, 26 nt, Human
uagggcagggacaggauaagagggau

SEQ ID NO: 119102 - RNA, 22 nt, Human
cugcucugaugcaucagaaagg

SEQ ID NO: 119103 - RNA, 26 nt, Human
aucucgaacuccugaccucaagugau

SEQ ID NO: 119104 - RNA, 26 nt, Human
gguuuuguguuuaaacagucaucuuc

SEQ ID NO: 119105 - RNA, 29 nt, Human
auccuuccccagcacuugcauuacggucc

SEQ ID NO: 119106 - RNA, 21 nt, Human
ugucuuaaguuuauacucuua

SEQ ID NO: 119107 - RNA, 23 nt, Human
aaaggugcacuccagacucuggg

SEQ ID NO: 119108 - RNA, 21 nt, Human
acuaagagaggaugaaugaaa

SEQ ID NO: 119109 - RNA, 20 nt, Human
ugcuguuucugacacuucag

SEQ ID NO: 119110 - RNA, 23 nt, Human
uucauucuaaaucuuauuaaccg

SEQ ID NO: 119111 - RNA, 21 nt, Human
agcugcugagcagcugaggug

SEQ ID NO: 119112 - RNA, 23 nt, Human
agugagggugaaggcaagaagua

SEQ ID NO: 119113 - RNA, 27 nt, Human
uggagagcaaauuauggaaauguguau

SEQ ID NO: 119114 - RNA, 22 nt, Human
uacaguguucuguuuaauacuc

SEQ ID NO: 119115 - RNA, 23 nt, Human
gaucgugcccagcuuugcuuagc

SEQ ID NO: 119116 - RNA, 23 nt, Human
uguuguccauuguucauuguuau

SEQ ID NO: 119117 - RNA, 22 nt, Human
aucacaaacucacagaccagca

SEQ ID NO: 119118 - RNA, 20 nt, Human
ccuuccccaccgccugggcc

SEQ ID NO: 119119 - RNA, 26 nt, Human
cugccucucuccugggaccguggggu

SEQ ID NO: 119120 - RNA, 26 nt, Human
auauguggaauauucuuuuuaaaaac

SEQ ID NO: 119121 - RNA, 24 nt, Human
cacugccaggaucaagcaugaaag

SEQ ID NO: 119122 - RNA, 24 nt, Human
uugcucuuaaacuuuccuagcuau

SEQ ID NO: 119123 - RNA, 26 nt, Human
agccuuucacaccugugcuggcgcug

SEQ ID NO: 119124 - RNA, 19 nt, Human
ggacuccucuuuggcuccu

SEQ ID NO: 119125 - RNA, 16 nt, Human
accccuucacacggag

SEQ ID NO: 119126 - RNA, 19 nt, Human
gaaagagaauaguuuugga

SEQ ID NO: 119127 - RNA, 23 nt, Human
ggccagagcaaacagaaaaagaa

SEQ ID NO: 119128 - RNA, 22 nt, Human
ugccugccagagcccaagugcc

SEQ ID NO: 119129 - RNA, 27 nt, Human
uuacaacugaaauauauauaaccucag

SEQ ID NO: 119130 - RNA, 23 nt, Human
ccuccugcugccccagccuuaga

SEQ ID NO: 119131 - RNA, 22 nt, Human
ccacugcacaccggccugggug

SEQ ID NO: 119132 - RNA, 17 nt, Human
cggccccuuggcccagc

SEQ ID NO: 119133 - RNA, 22 nt, Human
gcuaucuguccuuacuuguggg

SEQ ID NO: 119134 - RNA, 21 nt, Human
acaguaaagaugguuuagcag

SEQ ID NO: 119135 - RNA, 27 nt, Human
uguuuuguaguguugcuuagcacuuug

SEQ ID NO: 119136 - RNA, 24 nt, Human
ggccuccucuccugucuucugcag

SEQ ID NO: 119137 - RNA, 18 nt, Human
agauugccucacaguugu

SEQ ID NO: 119138 - RNA, 21 nt, Human
uuccaauaaagauuuacuugg

SEQ ID NO: 119139 - RNA, 26 nt, Human
gcuagauuuggaagggcaccgaggga

SEQ ID NO: 119140 - RNA, 22 nt, Human
uuguguuguguggggucauaca

SEQ ID NO: 119141 - RNA, 24 nt, Human
ugcuauuacuccuaugcugccuuc

SEQ ID NO: 119142 - RNA, 21 nt, Human
gccucugacccagucuggucu

SEQ ID NO: 119143 - RNA, 20 nt, Human
aggaguuagagggaaguuga

SEQ ID NO: 119144 - RNA, 21 nt, Human
accauuuuauauuugccaccu

SEQ ID NO: 119145 - RNA, 26 nt, Human
ucuagaaagccuguuccccucacugg

SEQ ID NO: 119146 - RNA, 23 nt, Human
acagcauguagggugaugagcac

SEQ ID NO: 119147 - RNA, 21 nt, Human
aucuguggcuguccucuccuu

SEQ ID NO: 119148 - RNA, 21 nt, Human
aacugugguccaucuccagac

SEQ ID NO: 119149 - RNA, 22 nt, Human
gccuguaaucccagaacuuugg

SEQ ID NO: 119150 - RNA, 22 nt, Human
gccugucaucccagcacuuugg

SEQ ID NO: 119151 - RNA, 20 nt, Human
uaacaaaucucucaguaugc

SEQ ID NO: 119152 - RNA, 23 nt, Human
ggugccuggccuucggcuccugc

SEQ ID NO: 119153 - RNA, 23 nt, Human
caaguagcugggaccacaggcau

SEQ ID NO: 119154 - RNA, 23 nt, Human
caaguagcugggacuacaggcac

SEQ ID NO: 119155 - RNA, 22 nt, Human
uugaggugagggaucauuuugg

SEQ ID NO: 119156 - RNA, 18 nt, Human
cugauuuaaaaagugaga

SEQ ID NO: 119157 - RNA, 19 nt, Human
auaccacauucauuaugcu

SEQ ID NO: 119158 - RNA, 26 nt, Human
aucaaauuguaaaaucaguaauguga

SEQ ID NO: 119159 - RNA, 27 nt, Human
gcagguggaucaccugagguccggagu

SEQ ID NO: 119160 - RNA, 25 nt, Human
gccaggaaucccagugucacggugg

SEQ ID NO: 119161 - RNA, 19 nt, Human
augaggucacagggcccag

SEQ ID NO: 119162 - RNA, 22 nt, Human
auuccacacccaucacaugugg

SEQ ID NO: 119163 - RNA, 28 nt, Human
cuccagggugccuccaccugcacaaccg

SEQ ID NO: 119164 - RNA, 22 nt, Human
gcacccagaguagggguggagu

SEQ ID NO: 119165 - RNA, 21 nt, Human
acaguauuuuucucaaacaaa

SEQ ID NO: 119166 - RNA, 20 nt, Human
ugcuccaccccaguugaguu

SEQ ID NO: 119167 - RNA, 20 nt, Human
ccaggaggcagcgucgcgug

SEQ ID NO: 119168 - RNA, 20 nt, Human
gggagggagaggaggggagc

SEQ ID NO: 119169 - RNA, 25 nt, Human
ucaugggacugguaccucagaucug

SEQ ID NO: 119170 - RNA, 17 nt, Human
uacaggggcagugccuu

SEQ ID NO: 119171 - RNA, 18 nt, Human
ccaagagaugaagcggug

SEQ ID NO: 119172 - RNA, 19 nt, Human
acucccacucucaggugca

SEQ ID NO: 119173 - RNA, 22 nt, Human
cacaccuacgaucacagcacuu

SEQ ID NO: 119174 - RNA, 21 nt, Human
ggcagaccuccuuccugccgu

SEQ ID NO: 119175 - RNA, 24 nt, Human
gggagcauagcagaggggccaggc

SEQ ID NO: 119176 - RNA, 26 nt, Human
acugcacugccaggagccaaggccua

SEQ ID NO: 119177 - RNA, 22 nt, Human
auuuuucuuaagacagagucuu

SEQ ID NO: 119178 - RNA, 20 nt, Human
uuuagcaguuuaaaaaacaa

SEQ ID NO: 119179 - RNA, 23 nt, Human
ugccuguagucccagccacugaa

SEQ ID NO: 119180 - RNA, 21 nt, Human
ggugagccaccgugccuugcu

SEQ ID NO: 119181 - RNA, 24 nt, Human
gcugccuggccaugcugucccugc

SEQ ID NO: 119182 - RNA, 23 nt, Human
gggcucggcgcucgcccaccucu

SEQ ID NO: 119183 - RNA, 23 nt, Human
agagggcccagccgugauccagc

SEQ ID NO: 119184 - RNA, 19 nt, Human
acucacuggucuuugcauc

SEQ ID NO: 119185 - RNA, 22 nt, Human
gucacccuucugggcaaggggg

SEQ ID NO: 119186 - RNA, 24 nt, Human
uuccuuccagcauuccugcugcua

SEQ ID NO: 119187 - RNA, 19 nt, Human
gggagagggagggaggaag

SEQ ID NO: 119188 - RNA, 27 nt, Human
guccagccugugguguccacaaugccc

SEQ ID NO: 119189 - RNA, 21 nt, Human
uucauuucucagcuguccuuu

SEQ ID NO: 119190 - RNA, 22 nt, Human
uggggucuugcucugucgccca

SEQ ID NO: 119191 - RNA, 22 nt, Human
cagggucucgcucugucaccca

SEQ ID NO: 119192 - RNA, 23 nt, Human
cucuccucucggaagcugcagcc

SEQ ID NO: 119193 - RNA, 23 nt, Human
gacuguaaucccagcuacucagg

SEQ ID NO: 119194 - RNA, 27 nt, Human
cugcccagaugcuucaggggcccggcu

SEQ ID NO: 119195 - RNA, 22 nt, Human
augcucuaagagaacagccaga

SEQ ID NO: 119196 - RNA, 22 nt, Human
cagcaggcugacagauggacag

SEQ ID NO: 119197 - RNA, 20 nt, Human
cucaaagcucugacgaucua

SEQ ID NO: 119198 - RNA, 26 nt, Human
ccugcagcccucugcuccucccggcc

SEQ ID NO: 119199 - RNA, 28 nt, Human
gggcuuccugccugguuuuucucuucuc

SEQ ID NO: 119200 - RNA, 23 nt, Human
gggcucucucuucugccuucuca

SEQ ID NO: 119201 - RNA, 23 nt, Human
uccuauugaagauggcuucuaag

SEQ ID NO: 119202 - RNA, 27 nt, Human
gguauauaaauuuucccaaaacugaua

SEQ ID NO: 119203 - RNA, 22 nt, Human
ggacuccucucuuucuucacca

SEQ ID NO: 119204 - RNA, 22 nt, Human
uuuuuggggaaaaagguuuguu

SEQ ID NO: 119205 - RNA, 23 nt, Human
uucaugaaaaucugccacucagg

SEQ ID NO: 119206 - RNA, 19 nt, Human
aauucagguauuacugaau

SEQ ID NO: 119207 - RNA, 23 nt, Human
cucaaugcuugguguucuaguuc

SEQ ID NO: 119208 - RNA, 22 nt, Human
uagaaauugaguuguauuguca

SEQ ID NO: 119209 - RNA, 23 nt, Human
ucucuggccucuccaguccugcu

SEQ ID NO: 119210 - RNA, 25 nt, Human
uccuccaugaauuuuauauauugug

SEQ ID NO: 119211 - RNA, 22 nt, Human
acaggcauggaagcugugaggg

SEQ ID NO: 119212 - RNA, 24 nt, Human
cgcccaggcugggugcagucacgg

SEQ ID NO: 119213 - RNA, 20 nt, Human
ucauuuccuuacacucugac

SEQ ID NO: 119214 - RNA, 23 nt, Human
cccagcugagccuccuuaccucc

SEQ ID NO: 119215 - RNA, 21 nt, Human
agcagaaaguucuacucucgu

SEQ ID NO: 119216 - RNA, 23 nt, Human
ccuucauucuucaauucagucua

SEQ ID NO: 119217 - RNA, 23 nt, Human
ccgagguugagaggaaggagggu

SEQ ID NO: 119218 - RNA, 21 nt, Human
ucugcccucgagcccaccggg

SEQ ID NO: 119219 - RNA, 21 nt, Human
cgccuaggcuggagugcagug

SEQ ID NO: 119220 - RNA, 22 nt, Human
ccagaucuccaucuccaaaaag

SEQ ID NO: 119221 - RNA, 25 nt, Human
gcccaggcuggagugcaguggcacc

SEQ ID NO: 119222 - RNA, 25 nt, Human
acccaggcuggagugccguggcacg

SEQ ID NO: 119223 - RNA, 27 nt, Human
uggcucacaccuguauucccaacacuu

SEQ ID NO: 119224 - RNA, 30 nt, Human
uuugagccauucuauuguguucuacuucac

SEQ ID NO: 119225 - RNA, 22 nt, Human
agagaggccacacaggaguggg

SEQ ID NO: 119226 - RNA, 22 nt, Human
ccacugcacuccagccagggcg

SEQ ID NO: 119227 - RNA, 23 nt, Human
acaaagccuuacacagggcgagg

SEQ ID NO: 119228 - RNA, 27 nt, Human
aggacagcugcuucugugcauuugugu

SEQ ID NO: 119229 - RNA, 22 nt, Human
gggaagcggagguugcagggag

SEQ ID NO: 119230 - RNA, 23 nt, Human
ggcuuggaggcuuggcugcucuu

SEQ ID NO: 119231 - RNA, 26 nt, Human
ggggcugaggcccgcccagguaaggg

SEQ ID NO: 119232 - RNA, 29 nt, Human
uuucuucuacaacucauacacucguauga

SEQ ID NO: 119233 - RNA, 23 nt, Human
cagggugucgcaccagcccuggg

SEQ ID NO: 119234 - RNA, 27 nt, Human
uucuccuccucggccugcccaagaguc

SEQ ID NO: 119235 - RNA, 23 nt, Human
guccuccucacugggggcagggu

SEQ ID NO: 119236 - RNA, 27 nt, Human
uucuacauuccuaucuuauuguucguu

SEQ ID NO: 119237 - RNA, 21 nt, Human
ccucugugccugcucucucca

SEQ ID NO: 119238 - RNA, 27 nt, Human
cugggaggccgaggcaggaggaucccu

SEQ ID NO: 119239 - RNA, 21 nt, Human
gaacaccuggcaugugacccu

SEQ ID NO: 119240 - RNA, 22 nt, Human
ggaagcuugggguucugcuccu

SEQ ID NO: 119241 - RNA, 24 nt, Human
uugcccuuuugguaaagucucauu

SEQ ID NO: 119242 - RNA, 23 nt, Human
cuauuauuucugguucuaaugaa

SEQ ID NO: 119243 - RNA, 26 nt, Human
uucuucugugggaggccaguccacau

SEQ ID NO: 119244 - RNA, 19 nt, Human
ucaaucuuugccuaaucca

SEQ ID NO: 119245 - RNA, 19 nt, Human
gcuggagugcaauggugaa

SEQ ID NO: 119246 - RNA, 18 nt, Human
uaggcuggagugcaguga

SEQ ID NO: 119247 - RNA, 22 nt, Human
uuuuagugcauugacaagugua

SEQ ID NO: 119248 - RNA, 21 nt, Human
cucccagauccucugcugacu

SEQ ID NO: 119249 - RNA, 21 nt, Human
gaaccugaaccacuaacuucc

SEQ ID NO: 119250 - RNA, 24 nt, Human
auucauauguuuaugguaauaaag

SEQ ID NO: 119251 - RNA, 23 nt, Human
caucaaacauguuuagacuuccu

SEQ ID NO: 119252 - RNA, 19 nt, Human
caacaaaucaucacguaac

SEQ ID NO: 119253 - RNA, 25 nt, Human
gggggccgggacagggagguuggga

SEQ ID NO: 119254 - RNA, 26 nt, Human
gccagccuggccagcugcucagacca

SEQ ID NO: 119255 - RNA, 22 nt, Human
cugugaggaaugcucugugcca

SEQ ID NO: 119256 - RNA, 21 nt, Human
gguuauaucauaaaugcagcu

SEQ ID NO: 119257 - RNA, 23 nt, Human
aggcaucaggagaggucucguuc

SEQ ID NO: 119258 - RNA, 20 nt, Human
uauguauguaacugcucugu

SEQ ID NO: 119259 - RNA, 21 nt, Human
accaugucaggauauuuuuag

SEQ ID NO: 119260 - RNA, 24 nt, Human
gcugggagcuuggaaaccuggucu

SEQ ID NO: 119261 - RNA, 25 nt, Human
augagggcagguuccagggccugaa

SEQ ID NO: 119262 - RNA, 27 nt, Human
cccuccugggcccugggcuggcacagc

SEQ ID NO: 119263 - RNA, 17 nt, Human
gccugugaaauacaagg

SEQ ID NO: 119264 - RNA, 30 nt, Human
gugcccaacacccauucaucucaagugcuu

SEQ ID NO: 119265 - RNA, 22 nt, Human
ccuggagaagugcucagcuacu

SEQ ID NO: 119266 - RNA, 24 nt, Human
ccccuuccuaauuccacagcugcu

SEQ ID NO: 119267 - RNA, 19 nt, Human
aacuuguuucucagacuuc

SEQ ID NO: 119268 - RNA, 23 nt, Human
cucaucucacacccuuucccucu

SEQ ID NO: 119269 - RNA, 22 nt, Human
gcugcucugggauucucuucag

SEQ ID NO: 119270 - RNA, 19 nt, Human
ucuaagaugaaccaauaaa

SEQ ID NO: 119271 - RNA, 24 nt, Human
gugugcgugguggccccacccagg

SEQ ID NO: 119272 - RNA, 27 nt, Human
ggcucacugucuuacaaucacugcugu

SEQ ID NO: 119273 - RNA, 22 nt, Human
caauguggagagccugauggga

SEQ ID NO: 119274 - RNA, 18 nt, Human
uuuccgccuaagcacuuu

SEQ ID NO: 119275 - RNA, 23 nt, Human
ggacugggagcaguccaugggau

SEQ ID NO: 119276 - RNA, 21 nt, Human
gccagcucuggcuggucagag

SEQ ID NO: 119277 - RNA, 19 nt, Human
gccaucucaaagaggagca

SEQ ID NO: 119278 - RNA, 25 nt, Human
cacaucaggucaggggguuaaagac

SEQ ID NO: 119279 - RNA, 27 nt, Human
uaugaauaauuuugaaauaacucugaa

SEQ ID NO: 119280 - RNA, 27 nt, Human
ucggguucacgccauucuccugccuca

SEQ ID NO: 119281 - RNA, 30 nt, Human
gggagcagagaagaagcaaccaggggcccu

SEQ ID NO: 119282 - RNA, 22 nt, Human
cugcagcuucagacagggagcc

SEQ ID NO: 119283 - RNA, 21 nt, Human
uugguugggagaaucacagcu

SEQ ID NO: 119284 - RNA, 19 nt, Human
cucccucucugugcauuuu

SEQ ID NO: 119285 - RNA, 23 nt, Human
cuaauuuaaaccagcagaaaagu

SEQ ID NO: 119286 - RNA, 21 nt, Human
ccagccccaaaugccaauagg

SEQ ID NO: 119287 - RNA, 26 nt, Human
gcccucuccccugcccccugcaggaa

SEQ ID NO: 119288 - RNA, 27 nt, Human
uggccaacauggugaaaccuugucucu

SEQ ID NO: 119289 - RNA, 23 nt, Human
cagucaggcugggcucuguagcg

SEQ ID NO: 119290 - RNA, 26 nt, Human
aacagcccuggcugagggagcugcag

SEQ ID NO: 119291 - RNA, 29 nt, Human
ccagcaccgcugcucacucggacgacgcc

SEQ ID NO: 119292 - RNA, 28 nt, Human
cugcccuuggcccugcaagcacaucaug

SEQ ID NO: 119293 - RNA, 23 nt, Human
ccuacaguguaucaacaaaagga

SEQ ID NO: 119294 - RNA, 20 nt, Human
agagugagucacggcccaga

SEQ ID NO: 119295 - RNA, 22 nt, Human
ucagccugggcaacauggugaa

SEQ ID NO: 119296 - RNA, 26 nt, Human
gcugcacucugcuugggccuugaggu

SEQ ID NO: 119297 - RNA, 21 nt, Human
ccagcaucuuugcauugugaa

SEQ ID NO: 119298 - RNA, 24 nt, Human
uucaguuuucccacuuuuugguaa

SEQ ID NO: 119299 - RNA, 23 nt, Human
uucaaugauuguuuaauuguagg

SEQ ID NO: 119300 - RNA, 21 nt, Human
guccagccaccagcccccuca

SEQ ID NO: 119301 - RNA, 27 nt, Human
ggccacgacugccuguuggggacagga

SEQ ID NO: 119302 - RNA, 21 nt, Human
ucaaaauauaucuaagaaaga

SEQ ID NO: 119303 - RNA, 25 nt, Human
cuugcuugagccuuaaucaaugugg

SEQ ID NO: 119304 - RNA, 26 nt, Human
cuagauguacaacacugacucaucau

SEQ ID NO: 119305 - RNA, 21 nt, Human
cuccacccugucccaacagcu

SEQ ID NO: 119306 - RNA, 19 nt, Human
aggccugggcaggaacaua

SEQ ID NO: 119307 - RNA, 22 nt, Human
uggcaugcgccuguaaucccag

SEQ ID NO: 119308 - RNA, 22 nt, Human
ggagcuagcugaguaugcugaa

SEQ ID NO: 119309 - RNA, 23 nt, Human
ucuauguguacagaugaaugaua

SEQ ID NO: 119310 - RNA, 27 nt, Human
cuugcagauaucugcaugugucaugaa

SEQ ID NO: 119311 - RNA, 20 nt, Human
ccauucacagguuucucagc

SEQ ID NO: 119312 - RNA, 22 nt, Human
uagaugucauccuaaaaaacac

SEQ ID NO: 119313 - RNA, 23 nt, Human
ccugccugccccucacccgccgu

SEQ ID NO: 119314 - RNA, 26 nt, Human
augcuauucuuucugaugucuucuua

SEQ ID NO: 119315 - RNA, 22 nt, Human
auggggaggggacuagaugggc

SEQ ID NO: 119316 - RNA, 25 nt, Human
ucugucacccaggcuggagugcagu

SEQ ID NO: 119317 - RNA, 28 nt, Human
gcagagucuuccaggugccuggcccuug

SEQ ID NO: 119318 - RNA, 20 nt, Human
cucucugucgcccaggcugg

SEQ ID NO: 119319 - RNA, 22 nt, Human
agacuccugggcucaagcgauc

SEQ ID NO: 119320 - RNA, 21 nt, Human
aauaaauccuccagucuggau

SEQ ID NO: 119321 - RNA, 24 nt, Human
acagcucucccuuuacccuggacu

SEQ ID NO: 119322 - RNA, 28 nt, Human
gugagggagagggucagaagcacuuagc

SEQ ID NO: 119323 - RNA, 22 nt, Human
cggcccugaggacaguccugcc

SEQ ID NO: 119324 - RNA, 24 nt, Human
cuccucuccucacgaccgaggcag

SEQ ID NO: 119325 - RNA, 27 nt, Human
uacuacuguuaacuuuuuuaaaaaaga

SEQ ID NO: 119326 - RNA, 21 nt, Human
cuccccugugccugaucugug

SEQ ID NO: 119327 - RNA, 17 nt, Human
cugcuacugcuaaugcc

SEQ ID NO: 119328 - RNA, 28 nt, Human
ggaggugaggacaagccagagguccuug

SEQ ID NO: 119329 - RNA, 22 nt, Human
cuaucugagccauguaaucaaa

SEQ ID NO: 119330 - RNA, 20 nt, Human
cuucccuuuaaugcuugcag

SEQ ID NO: 119331 - RNA, 27 nt, Human
cuuuguugcuuucuuuucuauugaguc

SEQ ID NO: 119332 - RNA, 22 nt, Human
accuuuugauucccggcucccg

SEQ ID NO: 119333 - RNA, 23 nt, Human
ucuggagaaagcucauggcugug

SEQ ID NO: 119334 - RNA, 25 nt, Human
ugggagguagagguugcacugagcc

SEQ ID NO: 119335 - RNA, 26 nt, Human
ugagccagaagccaaggcccugaguu

SEQ ID NO: 119336 - RNA, 22 nt, Human
gggggacggggagggaggaggc

SEQ ID NO: 119337 - RNA, 21 nt, Human
uuguauugagggccagugaug

SEQ ID NO: 119338 - RNA, 24 nt, Human
uugcuggagcagguuugcaggcac

SEQ ID NO: 119339 - RNA, 23 nt, Human
auaucugaaaugaagaaaacaaa

SEQ ID NO: 119340 - RNA, 24 nt, Human
gcaccgagcugaugcaguauuugu

SEQ ID NO: 119341 - RNA, 26 nt, Human
gcaucaccaagaugacacuccacgcc

SEQ ID NO: 119342 - RNA, 21 nt, Human
uuccccacuagcagggccagg

SEQ ID NO: 119343 - RNA, 30 nt, Human
gagguugagaaugcagugagcuuguaauug

SEQ ID NO: 119344 - RNA, 27 nt, Human
aggagaggagcaaacaggaaaaugacu

SEQ ID NO: 119345 - RNA, 20 nt, Human
ccccuugccagcugugccca

SEQ ID NO: 119346 - RNA, 27 nt, Human
uucauucuuucucacuuugccaucaug

SEQ ID NO: 119347 - RNA, 19 nt, Human
cggacagcuguccucucug

SEQ ID NO: 119348 - RNA, 29 nt, Human
gggcggucacggcggccugcccagggcgc

SEQ ID NO: 119349 - RNA, 20 nt, Human
uuauuuuucucuucugggac

SEQ ID NO: 119350 - RNA, 27 nt, Human
guauguacauuuauugcuauccagugu

SEQ ID NO: 119351 - RNA, 27 nt, Human
gcuggaaggcagcaucccucugacagg

SEQ ID NO: 119352 - RNA, 24 nt, Human
augaugugccuguaaaccaaggag

SEQ ID NO: 119353 - RNA, 21 nt, Human
agcuucucuuucuuuaucuuu

SEQ ID NO: 119354 - RNA, 26 nt, Human
agccccggagccucauagaucauccc

SEQ ID NO: 119355 - RNA, 21 nt, Human
aggggaggggaccgaacuagc

SEQ ID NO: 119356 - RNA, 31 nt, Human
cacaaccuuuggagacccaggaacacccucc

SEQ ID NO: 119357 - RNA, 22 nt, Human
gcccccagcacuccucugucuc

SEQ ID NO: 119358 - RNA, 21 nt, Human
ggcccccgggaccccaccucu

SEQ ID NO: 119359 - RNA, 24 nt, Human
auggaaaugauucucauugacuaa

SEQ ID NO: 119360 - RNA, 17 nt, Human
agccccauugugcugcu

SEQ ID NO: 119361 - RNA, 27 nt, Human
ccaccucuugggcaugcucagcccuuc

SEQ ID NO: 119362 - RNA, 31 nt, Human
cuguccugaccauggucccugccuggcugug

SEQ ID NO: 119363 - RNA, 19 nt, Human
ccuccuauuccuaauccuc

SEQ ID NO: 119364 - RNA, 21 nt, Human
ugcuguugcuacuguuugccu

SEQ ID NO: 119365 - RNA, 23 nt, Human
uuaccuuuuuuauacauaaacaa

SEQ ID NO: 119366 - RNA, 28 nt, Human
auguccuacuaucacugaacaaacuaaa

SEQ ID NO: 119367 - RNA, 22 nt, Human
ggcauucucgcugccucugucu

SEQ ID NO: 119368 - RNA, 22 nt, Human
cggagucucgcucugucaucca

SEQ ID NO: 119369 - RNA, 27 nt, Human
ugaggggagccuacgccucaggcaugu

SEQ ID NO: 119370 - RNA, 22 nt, Human
agaccuggaaccagagccacag

SEQ ID NO: 119371 - RNA, 25 nt, Human
cccuuucccacaccuuuguuccuca

SEQ ID NO: 119372 - RNA, 23 nt, Human
guucaauaaaggagacaagugcu

SEQ ID NO: 119373 - RNA, 25 nt, Human
gcugaacucuccccuugucugcacu

SEQ ID NO: 119374 - RNA, 24 nt, Human
aaggugaggaaauugagguucugg

SEQ ID NO: 119375 - RNA, 26 nt, Human
cugccucuucuucgcccuguucugug

SEQ ID NO: 119376 - RNA, 21 nt, Human
gcucugaugguccagcuccac

SEQ ID NO: 119377 - RNA, 21 nt, Human
ggcuaguccggacccaccuca

SEQ ID NO: 119378 - RNA, 23 nt, Human
guaucauguggagaagagccaau

SEQ ID NO: 119379 - RNA, 30 nt, Human
uuccuguuacaauauuuagcauuauuaguu

SEQ ID NO: 119380 - RNA, 20 nt, Human
uucuaaaauauuuugaugcu

SEQ ID NO: 119381 - RNA, 27 nt, Human
gugacaccacuguccucaucuggagcc

SEQ ID NO: 119382 - RNA, 27 nt, Human
gaggcacucccuccaucuuuggaacac

SEQ ID NO: 119383 - RNA, 22 nt, Human
ugcagugagcugugauuaugcc

SEQ ID NO: 119384 - RNA, 27 nt, Human
auauuucagaagcuuuaacugaagugu

SEQ ID NO: 119385 - RNA, 24 nt, Human
gcugguggcccaggaccaucaucc

SEQ ID NO: 119386 - RNA, 22 nt, Human
acgcugaugggacuggagggag

SEQ ID NO: 119387 - RNA, 23 nt, Human
gugggaucaccuuuucccagcug

SEQ ID NO: 119388 - RNA, 16 nt, Human
agccagagaggcagag

SEQ ID NO: 119389 - RNA, 25 nt, Human
gcggcagcagcggcgguggcagugg

SEQ ID NO: 119390 - RNA, 24 nt, Human
ugcuuugacaaaaugacuggcucc

SEQ ID NO: 119391 - RNA, 27 nt, Human
aaguccgacaacaccguguccaaaaag

SEQ ID NO: 119392 - RNA, 24 nt, Human
cuugcucuccuuugcugauggauu

SEQ ID NO: 119393 - RNA, 19 nt, Human
agccaaaaucagagcugga

SEQ ID NO: 119394 - RNA, 21 nt, Human
aggagacaaaacaaccagcuu

SEQ ID NO: 119395 - RNA, 19 nt, Human
aagguggggauggaagcac

SEQ ID NO: 119396 - RNA, 23 nt, Human
ccaggaggucaaggcugcaguga

SEQ ID NO: 119397 - RNA, 26 nt, Human
ccugauggugucauucugccugcucc

SEQ ID NO: 119398 - RNA, 26 nt, Human
cccuccaccuccucucuuggacuccc

SEQ ID NO: 119399 - RNA, 22 nt, Human
gaggcccaagacccaggacaag

SEQ ID NO: 119400 - RNA, 23 nt, Human
gugcugaauucugcaauguuuuc

SEQ ID NO: 119401 - RNA, 21 nt, Human
cuugagaguauauggggacca

SEQ ID NO: 119402 - RNA, 27 nt, Human
guuucacugccuuccuacccucucuaa

SEQ ID NO: 119403 - RNA, 19 nt, Human
caguucugugaucuggguc

SEQ ID NO: 119404 - RNA, 26 nt, Human
ccacuggcaccuuccggauccccuua

SEQ ID NO: 119405 - RNA, 24 nt, Human
cuggaagagcugagaggccaggcu

SEQ ID NO: 119406 - RNA, 28 nt, Human
ccucauuuccuguuucaccuugauuuuc

SEQ ID NO: 119407 - RNA, 27 nt, Human
uaggcagcacuucccaaagugcacuga

SEQ ID NO: 119408 - RNA, 25 nt, Human
cacagcccugcucauuccucacgcc

SEQ ID NO: 119409 - RNA, 24 nt, Human
agugaagaucaaauccauauuacc

SEQ ID NO: 119410 - RNA, 27 nt, Human
uggccaacauggugaaacuccgucucu

SEQ ID NO: 119411 - RNA, 27 nt, Human
gcaggagaauggcgugaacccaggagg

SEQ ID NO: 119412 - RNA, 24 nt, Human
cccuuucguacuucauuuguguuc

SEQ ID NO: 119413 - RNA, 23 nt, Human
cccagggaguuucagaugccuuu

SEQ ID NO: 119414 - RNA, 26 nt, Human
gcagcugccucacaccgccccuugug

SEQ ID NO: 119415 - RNA, 22 nt, Human
ugguugcugcaaagcucaggcc

SEQ ID NO: 119416 - RNA, 24 nt, Human
gcaaaaacuaccuucugacuuggg

SEQ ID NO: 119417 - RNA, 23 nt, Human
caguuuggggacucaggaccaga

SEQ ID NO: 119418 - RNA, 20 nt, Human
cccucccaggaaccuguugg

SEQ ID NO: 119419 - RNA, 20 nt, Human
agccucccggauagcugccg

SEQ ID NO: 119420 - RNA, 21 nt, Human
uuggacuguuguucugcuuuu

SEQ ID NO: 119421 - RNA, 22 nt, Human
cuucccuugguccuucuggucc

SEQ ID NO: 119422 - RNA, 20 nt, Human
gggcauggaagaaagacugg

SEQ ID NO: 119423 - RNA, 22 nt, Human
ccaaagaaccuccucugcacua

SEQ ID NO: 119424 - RNA, 23 nt, Human
augucggcggucggggacuuuac

SEQ ID NO: 119425 - RNA, 23 nt, Human
gcuuggacgaccugcucucuaca

SEQ ID NO: 119426 - RNA, 21 nt, Human
guucuccaacuccugacuuca

SEQ ID NO: 119427 - RNA, 23 nt, Human
gagaaggacgaagacugagacug

SEQ ID NO: 119428 - RNA, 21 nt, Human
uuucuuucuuuauuucucagc

SEQ ID NO: 119429 - RNA, 21 nt, Human
agaggaagaaaaugaugaugg

SEQ ID NO: 119430 - RNA, 17 nt, Human
cugcagcagcagcugcc

SEQ ID NO: 119431 - RNA, 25 nt, Human
gggaggcaccauucaggaaccugga

SEQ ID NO: 119432 - RNA, 22 nt, Human
acuagcucuucagaaaaaucca

SEQ ID NO: 119433 - RNA, 23 nt, Human
ugcagugagccgacaucaugcca

SEQ ID NO: 119434 - RNA, 22 nt, Human
aaagaaggcucuuaggagccag

SEQ ID NO: 119435 - RNA, 22 nt, Human
ucacacacugagaaucucuuca

SEQ ID NO: 119436 - RNA, 21 nt, Human
guggcagggacuggagucagu

SEQ ID NO: 119437 - RNA, 23 nt, Human
ugcuaucucucucgaucacuccc

SEQ ID NO: 119438 - RNA, 27 nt, Human
acacuucagaguaagagggaauucagc

SEQ ID NO: 119439 - RNA, 20 nt, Human
uacaaaugaagaaagucaaa

SEQ ID NO: 119440 - RNA, 27 nt, Human
gcgucuuccuuccuccucccggucagc

SEQ ID NO: 119441 - RNA, 21 nt, Human
ggcuggaguaaggcuugcugu

SEQ ID NO: 119442 - RNA, 27 nt, Human
augccuggccccaauuuaaaaugugga

SEQ ID NO: 119443 - RNA, 27 nt, Human
cauugcugcacucugggggcuuggcau

SEQ ID NO: 119444 - RNA, 27 nt, Human
cgguuuugcaagagccgggaagaaacu

SEQ ID NO: 119445 - RNA, 22 nt, Human
aucgcccaggcuggagugcagu

SEQ ID NO: 119446 - RNA, 23 nt, Human
uugccuuauaccucuuucucucu

SEQ ID NO: 119447 - RNA, 22 nt, Human
cagccaggagccaguggcagga

SEQ ID NO: 119448 - RNA, 22 nt, Human
aaucacuggggaugguggcaca

SEQ ID NO: 119449 - RNA, 19 nt, Human
ucuuuccugggaaguuauu

SEQ ID NO: 119450 - RNA, 20 nt, Human
ccuccugcguaccaggagcu

SEQ ID NO: 119451 - RNA, 23 nt, Human
ggagcucgggacggauaguagac

SEQ ID NO: 119452 - RNA, 23 nt, Human
ugccaggaagaagauauuccagg

SEQ ID NO: 119453 - RNA, 28 nt, Human
uccugaaucuccccuucuuugugacagc

SEQ ID NO: 119454 - RNA, 21 nt, Human
ucugagcuggcugacuugcca

SEQ ID NO: 119455 - RNA, 21 nt, Human
agcucacugugccucuuguuu

SEQ ID NO: 119456 - RNA, 26 nt, Human
ccugcaggggguccugguuccuuuug

SEQ ID NO: 119457 - RNA, 19 nt, Human
cagaguguugcuguccuca

SEQ ID NO: 119458 - RNA, 24 nt, Human
uucacaccaccacauucccauuca

SEQ ID NO: 119459 - RNA, 23 nt, Human
auauuuacucuuucuaacuuucu

SEQ ID NO: 119460 - RNA, 25 nt, Human
uucuccuugggccucaggcaaauag

SEQ ID NO: 119461 - RNA, 22 nt, Human
ugggcuccagagucccucgguc

SEQ ID NO: 119462 - RNA, 23 nt, Human
gucacccaggcuggacugcaaug

SEQ ID NO: 119463 - RNA, 23 nt, Human
uucucagacacugaagaacucug

SEQ ID NO: 119464 - RNA, 23 nt, Human
aggaggcaccaugcaggagcugc

SEQ ID NO: 119465 - RNA, 20 nt, Human
auccugacugccucuugggu

SEQ ID NO: 119466 - RNA, 25 nt, Human
caucacccaaucuguugauucucca

SEQ ID NO: 119467 - RNA, 17 nt, Human
uaaaagaguuaaugaac

SEQ ID NO: 119468 - RNA, 22 nt, Human
gcuauaaucccagguacuuggg

SEQ ID NO: 119469 - RNA, 20 nt, Human
ccagaucuacuaucugcaac

SEQ ID NO: 119470 - RNA, 16 nt, Human
ugaagagacacuguga

SEQ ID NO: 119471 - RNA, 21 nt, Human
aaccuccagccucaagugugu

SEQ ID NO: 119472 - RNA, 26 nt, Human
gagccuggccugcucuugugggcugu

SEQ ID NO: 119473 - RNA, 27 nt, Human
uucuccuccuucauccuguaaagguca

SEQ ID NO: 119474 - RNA, 23 nt, Human
ggcgccuguaaucccagcuacuc

SEQ ID NO: 119475 - RNA, 22 nt, Human
cacccaggcacuuaagcacaag

SEQ ID NO: 119476 - RNA, 20 nt, Human
gugcuguggggaaaccccca

SEQ ID NO: 119477 - RNA, 22 nt, Human
ucagcacagcaguggagagugu

SEQ ID NO: 119478 - RNA, 23 nt, Human
uuccugccuccugccccacucag

SEQ ID NO: 119479 - RNA, 22 nt, Human
cccuucuccuccccugcucgcu

SEQ ID NO: 119480 - RNA, 23 nt, Human
cuugacuugaaugugcaccugag

SEQ ID NO: 119481 - RNA, 21 nt, Human
ggagaggcagagagugaggga

SEQ ID NO: 119482 - RNA, 27 nt, Human
gaggaagauucaauaauauuaacuagc

SEQ ID NO: 119483 - RNA, 23 nt, Human
gcugccucugagccaauccuggg

SEQ ID NO: 119484 - RNA, 21 nt, Human
cuggaagugcuaauuuugaaa

SEQ ID NO: 119485 - RNA, 31 nt, Human
ugccaucuugaaggcuggaggagucagagug

SEQ ID NO: 119486 - RNA, 24 nt, Human
cagggugcugucaacccucccuug

SEQ ID NO: 119487 - RNA, 23 nt, Human
ccugggucuucccaguugagacu

SEQ ID NO: 119488 - RNA, 19 nt, Human
ucauucucauuuauguaua

SEQ ID NO: 119489 - RNA, 22 nt, Human
agcucccaggcagacugccuuc

SEQ ID NO: 119490 - RNA, 27 nt, Human
cccaaagugcugggauuacaagaauga

SEQ ID NO: 119491 - RNA, 25 nt, Human
uuaacccugauucauacuccuuuug

SEQ ID NO: 119492 - RNA, 22 nt, Human
cugucaaccuagugccuguguu

SEQ ID NO: 119493 - RNA, 22 nt, Human
uagcaauguuauuucucuugga

SEQ ID NO: 119494 - RNA, 21 nt, Human
uggcagcuuauguccaaaggg

SEQ ID NO: 119495 - RNA, 22 nt, Human
uugugugaugcgccuugcugau

SEQ ID NO: 119496 - RNA, 22 nt, Human
ucucccaccucaucauaacaac

SEQ ID NO: 119497 - RNA, 21 nt, Human
ccucugcugucaccuugcuca

SEQ ID NO: 119498 - RNA, 20 nt, Human
uucuuuucuucuuuuagcca

SEQ ID NO: 119499 - RNA, 23 nt, Human
acucagaguugcaaccucagccu

SEQ ID NO: 119500 - RNA, 18 nt, Human
aagucuucucugccugua

SEQ ID NO: 119501 - RNA, 21 nt, Human
guggauaagaaaaaugcuuga

SEQ ID NO: 119502 - RNA, 21 nt, Human
gaggaguuaaccccaaaggug

SEQ ID NO: 119503 - RNA, 27 nt, Human
agaggaggaugcuguuuaucugucacc

SEQ ID NO: 119504 - RNA, 24 nt, Human
auuccugaucccauggccaggugg

SEQ ID NO: 119505 - RNA, 21 nt, Human
ccccaaagauauuacagggua

SEQ ID NO: 119506 - RNA, 23 nt, Human
cucugccucuuggguuucaguga

SEQ ID NO: 119507 - RNA, 24 nt, Human
gccauguguuggggagacaucaaa

SEQ ID NO: 119508 - RNA, 22 nt, Human
agggcacagacaccggcuugcu

SEQ ID NO: 119509 - RNA, 26 nt, Human
gggaagggaagcagaucuagggagga

SEQ ID NO: 119510 - RNA, 26 nt, Human
gcucagaaagcgcgggaaaggcacgc

SEQ ID NO: 119511 - RNA, 21 nt, Human
ggccgggaagcccccaccuca

SEQ ID NO: 119512 - RNA, 28 nt, Human
ggaauaguuggcugccaaucucccugcu

SEQ ID NO: 119513 - RNA, 20 nt, Human
agccgcauguugucuugccu

SEQ ID NO: 119514 - RNA, 21 nt, Human
ucauuuuucucuuccugggau

SEQ ID NO: 119515 - RNA, 21 nt, Human
uuugggugcauucuaguguag

SEQ ID NO: 119516 - RNA, 23 nt, Human
ugcuaggagauagcuggggaagg

SEQ ID NO: 119517 - RNA, 26 nt, Human
uccuuuuccuccuuggagccugggcc

SEQ ID NO: 119518 - RNA, 25 nt, Human
gguaggugucucauuuguucuggcc

SEQ ID NO: 119519 - RNA, 26 nt, Human
cccuccaggaccccagcaaguggauu

SEQ ID NO: 119520 - RNA, 20 nt, Human
gcugugucuuguucaugccc

SEQ ID NO: 119521 - RNA, 27 nt, Human
ugccuguagucccagccacugaagcca

SEQ ID NO: 119522 - RNA, 27 nt, Human
guggcuugggacaucaguggggccaag

SEQ ID NO: 119523 - RNA, 21 nt, Human
uuccucugugcuuucucagcu

SEQ ID NO: 119524 - RNA, 26 nt, Human
ccacagacuucuuugaaaauauacau

SEQ ID NO: 119525 - RNA, 20 nt, Human
ggaaguuuucugucacugga

SEQ ID NO: 119526 - RNA, 27 nt, Human
agcuguucagaguaacggauuacuagg

SEQ ID NO: 119527 - RNA, 21 nt, Human
auuaucuaugcagcauggggu

SEQ ID NO: 119528 - RNA, 26 nt, Human
aggucuuuuagccugcccuugcaugg

SEQ ID NO: 119529 - RNA, 23 nt, Human
cugucccgcggcacucagccugc

SEQ ID NO: 119530 - RNA, 22 nt, Human
ucuucuguuucuuccuccccgc

SEQ ID NO: 119531 - RNA, 23 nt, Human
caagcaccugggauuacaagcau

SEQ ID NO: 119532 - RNA, 21 nt, Human
acucgucccccuccugccuca

SEQ ID NO: 119533 - RNA, 22 nt, Human
ccaggaagauuucaaggcaggg

SEQ ID NO: 119534 - RNA, 26 nt, Human
gagagaaacgcagugggggaggcagg

SEQ ID NO: 119535 - RNA, 26 nt, Human
aauauuugcuaaauauuucuuuuuug

SEQ ID NO: 119536 - RNA, 24 nt, Human
aguucugugacaguacagaaggaa

SEQ ID NO: 119537 - RNA, 24 nt, Human
cuuaguucucacuguucccucugc

SEQ ID NO: 119538 - RNA, 21 nt, Human
ggucucaaacuccugaccuca

SEQ ID NO: 119539 - RNA, 21 nt, Human
aguauuuucuaauaauccugc

SEQ ID NO: 119540 - RNA, 23 nt, Human
guccucuggaucacagacacugc

SEQ ID NO: 119541 - RNA, 24 nt, Human
caggggaggggaaacgggaauagu

SEQ ID NO: 119542 - RNA, 24 nt, Human
cggcccuccgccuccuggcccugc

SEQ ID NO: 119543 - RNA, 20 nt, Human
gcccccagccacuguugcug

SEQ ID NO: 119544 - RNA, 22 nt, Human
ccaugccacuacucugaggccu

SEQ ID NO: 119545 - RNA, 23 nt, Human
ccaggugaggaauuugaagcuca

SEQ ID NO: 119546 - RNA, 28 nt, Human
agauggcuuuuguacuuccuguggacau

SEQ ID NO: 119547 - RNA, 27 nt, Human
gcacagccugggggagagugcggccca

SEQ ID NO: 119548 - RNA, 22 nt, Human
gcugccuggcucugucccaggc

SEQ ID NO: 119549 - RNA, 23 nt, Human
ggcaggagaaucacuugaaccua

SEQ ID NO: 119550 - RNA, 18 nt, Human
uugcccaggcuggaguac

SEQ ID NO: 119551 - RNA, 23 nt, Human
ucagcaucugcugggauaacugg

SEQ ID NO: 119552 - RNA, 23 nt, Human
ccauacagacaucgacagccagg

SEQ ID NO: 119553 - RNA, 20 nt, Human
aaucagaaaaggacuagauu

SEQ ID NO: 119554 - RNA, 26 nt, Human
ggauuuugggguucccagcaccccau

SEQ ID NO: 119555 - RNA, 19 nt, Human
uacagccccgggggcacag

SEQ ID NO: 119556 - RNA, 22 nt, Human
ugaacuccuaaccucgggugau

SEQ ID NO: 119557 - RNA, 22 nt, Human
cacugcacccggcccugagaau

SEQ ID NO: 119558 - RNA, 22 nt, Human
ugccguuguacuccagcuuggg

SEQ ID NO: 119559 - RNA, 27 nt, Human
gaagcagcugggccuggggcgcccacu

SEQ ID NO: 119560 - RNA, 19 nt, Human
uguuaucugaacuguggaa

SEQ ID NO: 119561 - RNA, 22 nt, Human
cgccuguggucucagcacuuug

SEQ ID NO: 119562 - RNA, 27 nt, Human
agaaggcagagaggcaguucugaauca

SEQ ID NO: 119563 - RNA, 24 nt, Human
cacgccccacgccuuccucuauaa

SEQ ID NO: 119564 - RNA, 29 nt, Human
ugcccccuucggggcuggaggucucagug

SEQ ID NO: 119565 - RNA, 24 nt, Human
ucacuguuuggaaaaacacauaga

SEQ ID NO: 119566 - RNA, 26 nt, Human
acucuggcagccacacuucucaggac

SEQ ID NO: 119567 - RNA, 26 nt, Human
cacucagcaaccacacggaucugaca

SEQ ID NO: 119568 - RNA, 23 nt, Human
gcugggggaaccucaccuggccc

SEQ ID NO: 119569 - RNA, 26 nt, Human
cagcacagcuacucagaucugcacuc

SEQ ID NO: 119570 - RNA, 21 nt, Human
cugucccucucuggcuugguc

SEQ ID NO: 119571 - RNA, 24 nt, Human
ggcugggugguugguagaggagau

SEQ ID NO: 119572 - RNA, 26 nt, Human
ucgggaggcuguggcaggagaaucgc

SEQ ID NO: 119573 - RNA, 23 nt, Human
aacaaaaagcugcccgacuugca

SEQ ID NO: 119574 - RNA, 21 nt, Human
ucuccucucauacaucaagcc

SEQ ID NO: 119575 - RNA, 23 nt, Human
gauuccagauaaccagcuguaac

SEQ ID NO: 119576 - RNA, 20 nt, Human
guaggaagggagccagagag

SEQ ID NO: 119577 - RNA, 22 nt, Human
ucuuccucuggagacugaacuu

SEQ ID NO: 119578 - RNA, 21 nt, Human
ggaaaggagccuaggccaggu

SEQ ID NO: 119579 - RNA, 22 nt, Human
acaugauuucaaaauaaaguug

SEQ ID NO: 119580 - RNA, 27 nt, Human
ccacugcacuccaaccugggcagcaga

SEQ ID NO: 119581 - RNA, 21 nt, Human
guucuggaugacaguagagga

SEQ ID NO: 119582 - RNA, 27 nt, Human
ugcccugccuugccccugcacuaugcu

SEQ ID NO: 119583 - RNA, 26 nt, Human
gaugugacagaaguccuuauacuuca

SEQ ID NO: 119584 - RNA, 20 nt, Human
caauucaagaaacuaguaag

SEQ ID NO: 119585 - RNA, 27 nt, Human
ccaugauggugcugaccucugguggcc

SEQ ID NO: 119586 - RNA, 26 nt, Human
guugagggagagagacagaauccugg

SEQ ID NO: 119587 - RNA, 25 nt, Human
cacacacagauuguccugguguuca

SEQ ID NO: 119588 - RNA, 18 nt, Human
gacugcccacugcauaua

SEQ ID NO: 119589 - RNA, 23 nt, Human
guuuuuaaagcaaaauuaucuug

SEQ ID NO: 119590 - RNA, 24 nt, Human
gcuuuucucccaccccuccuagca

SEQ ID NO: 119591 - RNA, 19 nt, Human
aucccucucuccuccagca

SEQ ID NO: 119592 - RNA, 22 nt, Human
ucaagcucauuagcaagacugg

SEQ ID NO: 119593 - RNA, 22 nt, Human
gaaaagcaucucucuuggcaac

SEQ ID NO: 119594 - RNA, 22 nt, Human
uaggaccugaugauggcuacua

SEQ ID NO: 119595 - RNA, 24 nt, Human
ccuucacucccugucauaguuacc

SEQ ID NO: 119596 - RNA, 21 nt, Human
gcagaaaacuagcuuguaaaa

SEQ ID NO: 119597 - RNA, 20 nt, Human
cagaagccuuugauauugcc

SEQ ID NO: 119598 - RNA, 23 nt, Human
ccuccugggaaggagggagcugc

SEQ ID NO: 119599 - RNA, 22 nt, Human
ccaccuccuggguuuaagcaau

SEQ ID NO: 119600 - RNA, 22 nt, Human
guagaaaauaugucccagaaau

SEQ ID NO: 119601 - RNA, 19 nt, Human
agcuaaccucuucuggacc

SEQ ID NO: 119602 - RNA, 26 nt, Human
gaaaauaccaguuuugcucucugugg

SEQ ID NO: 119603 - RNA, 20 nt, Human
caggcugggacagaggcaga

SEQ ID NO: 119604 - RNA, 21 nt, Human
uguagaggcccuggugcagaa

SEQ ID NO: 119605 - RNA, 28 nt, Human
cucuuggacccuccucuucacggaccca

SEQ ID NO: 119606 - RNA, 21 nt, Human
uuuccagccgcugaaucugcu

SEQ ID NO: 119607 - RNA, 18 nt, Human
aacuuucaggaguuuaca

SEQ ID NO: 119608 - RNA, 20 nt, Human
aagggaggggaaagcgcagc

SEQ ID NO: 119609 - RNA, 22 nt, Human
cgccucccauguucaagcgauu

SEQ ID NO: 119610 - RNA, 23 nt, Human
aauuguguaacuguucuuugcag

SEQ ID NO: 119611 - RNA, 27 nt, Human
cggaaggcagcuggcagcaggcccagg

SEQ ID NO: 119612 - RNA, 22 nt, Human
cgccauugcacuccagccuagg

SEQ ID NO: 119613 - RNA, 23 nt, Human
agacauugguuuacucugcagcc

SEQ ID NO: 119614 - RNA, 22 nt, Human
aggacuggcccugcucugcggc

SEQ ID NO: 119615 - RNA, 19 nt, Human
uucccuccccucuccagcu

SEQ ID NO: 119616 - RNA, 18 nt, Human
caggcaaaccucuguggu

SEQ ID NO: 119617 - RNA, 27 nt, Human
agagauaccugcugcuuccauugcuuu

SEQ ID NO: 119618 - RNA, 23 nt, Human
ccuaguuucuaccuaaucauguc

SEQ ID NO: 119619 - RNA, 21 nt, Human
ggacacugacauuucacucau

SEQ ID NO: 119620 - RNA, 21 nt, Human
agcccuccagcccuucuuuuu

SEQ ID NO: 119621 - RNA, 27 nt, Human
cucagucggggcaggccaggggagggg

SEQ ID NO: 119622 - RNA, 24 nt, Human
cucugcccuaaugcgcaggcuggc

SEQ ID NO: 119623 - RNA, 21 nt, Human
uacucuuccauaggggcaucu

SEQ ID NO: 119624 - RNA, 27 nt, Human
ugacugccacccacacgcccuccccag

SEQ ID NO: 119625 - RNA, 24 nt, Human
cugguggaugccugguucguuccg

SEQ ID NO: 119626 - RNA, 19 nt, Human
ccucuggcccugcuucuuc

SEQ ID NO: 119627 - RNA, 26 nt, Human
uucaagaucagucugggcaacacgau

SEQ ID NO: 119628 - RNA, 26 nt, Human
uccgggaaaagagcagaggaaagagg

SEQ ID NO: 119629 - RNA, 23 nt, Human
aacagaaaaacucagacuuggca

SEQ ID NO: 119630 - RNA, 22 nt, Human
gcaggcugcaaaugacccagaa

SEQ ID NO: 119631 - RNA, 27 nt, Human
uguauuccgucgcgcugggcucuccga

SEQ ID NO: 119632 - RNA, 22 nt, Human
uuguuagguuagacaacugaca

SEQ ID NO: 119633 - RNA, 26 nt, Human
gaagaauuaucauaaggcaauggaga

SEQ ID NO: 119634 - RNA, 23 nt, Human
ugucgccaaguuggagugcaaug

SEQ ID NO: 119635 - RNA, 22 nt, Human
uggcggccgugggcuccgggac

SEQ ID NO: 119636 - RNA, 22 nt, Human
gagcuaaaaccagaaauuucca

SEQ ID NO: 119637 - RNA, 25 nt, Human
uccacgcccugaccgcccagggaac

SEQ ID NO: 119638 - RNA, 23 nt, Human
ccaggccagacccaggagccaag

SEQ ID NO: 119639 - RNA, 20 nt, Human
gccagaggagggcagaggga

SEQ ID NO: 119640 - RNA, 26 nt, Human
ggucacucgggauccccugggccuaa

SEQ ID NO: 119641 - RNA, 21 nt, Human
aagaagaaauaccaauaacac

SEQ ID NO: 119642 - RNA, 17 nt, Human
ccaggagaccauuugua

SEQ ID NO: 119643 - RNA, 24 nt, Human
ccuucuuagcuaucauugcuuccu

SEQ ID NO: 119644 - RNA, 26 nt, Human
augugggaaacccuuuugcguggucc

SEQ ID NO: 119645 - RNA, 23 nt, Human
cccaaagccagacuaguccugaa

SEQ ID NO: 119646 - RNA, 19 nt, Human
caugggaaccaggucugaa

SEQ ID NO: 119647 - RNA, 23 nt, Human
ggagagggcgcggcgcggagcgc

SEQ ID NO: 119648 - RNA, 23 nt, Human
cuuacccaacuccuucccccuca

SEQ ID NO: 119649 - RNA, 22 nt, Human
caggagacggagguugcaguga

SEQ ID NO: 119650 - RNA, 27 nt, Human
cuaccucuucaguguuuuccuccaguc

SEQ ID NO: 119651 - RNA, 18 nt, Human
gucagucuugcuggauuu

SEQ ID NO: 119652 - RNA, 21 nt, Human
aagucucucugugccuuuuuc

SEQ ID NO: 119653 - RNA, 23 nt, Human
ucguuggaggcuggagcgcaaug

SEQ ID NO: 119654 - RNA, 21 nt, Human
cugaggcccagaauugcuaag

SEQ ID NO: 119655 - RNA, 21 nt, Human
ccuccacaccacaaccaccuu

SEQ ID NO: 119656 - RNA, 23 nt, Human
cacccgauccuggagagcuguga

SEQ ID NO: 119657 - RNA, 27 nt, Human
gguguuuuggcaccugccuguaaucuc

SEQ ID NO: 119658 - RNA, 24 nt, Human
uucccagggcacauuucuggauca

SEQ ID NO: 119659 - RNA, 22 nt, Human
caugccuguaaucccaggacuu

SEQ ID NO: 119660 - RNA, 20 nt, Human
uuuccucuucagauccuggu

SEQ ID NO: 119661 - RNA, 22 nt, Human
gucacccaggcugaagugcagu

SEQ ID NO: 119662 - RNA, 23 nt, Human
ggugggaggggcccacaggaagc

SEQ ID NO: 119663 - RNA, 18 nt, Human
caucauuuuagaauuuau

SEQ ID NO: 119664 - RNA, 22 nt, Human
gucugauucucuuuaacugugu

SEQ ID NO: 119665 - RNA, 22 nt, Human
uucaaacaauucuccugccuca

SEQ ID NO: 119666 - RNA, 23 nt, Human
aguugaacugcaggaagagagga

SEQ ID NO: 119667 - RNA, 24 nt, Human
aggccagaaaccgcccaccugcag

SEQ ID NO: 119668 - RNA, 21 nt, Human
accccuuccugggcacacgcu

SEQ ID NO: 119669 - RNA, 17 nt, Human
agaaaacaaaacugcau

SEQ ID NO: 119670 - RNA, 26 nt, Human
gaugguugacccagaggauccugaua

SEQ ID NO: 119671 - RNA, 23 nt, Human
gucauccaggcuggagugcggug

SEQ ID NO: 119672 - RNA, 23 nt, Human
gucguccaggcuggagugcagug

SEQ ID NO: 119673 - RNA, 27 nt, Human
ccagcucuuugauuugccauauauaaa

SEQ ID NO: 119674 - RNA, 27 nt, Human
cuccagccuccccuccccuggggacgc

SEQ ID NO: 119675 - RNA, 23 nt, Human
cuuuaguucugcuuucugccucu

SEQ ID NO: 119676 - RNA, 22 nt, Human
gaguccugggguuggggagggg

SEQ ID NO: 119677 - RNA, 22 nt, Human
caccacggcacuucagccuggg

SEQ ID NO: 119678 - RNA, 21 nt, Human
cugcgcccucucccuggcgcc

SEQ ID NO: 119679 - RNA, 21 nt, Human
uuucaauaaauaucaagcacu

SEQ ID NO: 119680 - RNA, 20 nt, Human
ucauuuuaacacuuguccug

SEQ ID NO: 119681 - RNA, 27 nt, Human
gagacuugccuuccuaagccuguggcu

SEQ ID NO: 119682 - RNA, 24 nt, Human
ucuuucaauguguuuaauuuugga

SEQ ID NO: 119683 - RNA, 22 nt, Human
aaaguggaaauauuuugaaaug

SEQ ID NO: 119684 - RNA, 21 nt, Human
uucccuguucuccugccucac

SEQ ID NO: 119685 - RNA, 23 nt, Human
uucacacugcgcaggucucuucu

SEQ ID NO: 119686 - RNA, 19 nt, Human
ccaggcugaagugcaguga

SEQ ID NO: 119687 - RNA, 27 nt, Human
ggugcaccgccugccucucagcaggau

SEQ ID NO: 119688 - RNA, 22 nt, Human
ggcuaauuuuuguauuuuuaau

SEQ ID NO: 119689 - RNA, 22 nt, Human
ggcugauuuuuguauuuuuagu

SEQ ID NO: 119690 - RNA, 27 nt, Human
ggaugauugugugacuauucauggcua

SEQ ID NO: 119691 - RNA, 27 nt, Human
aagugcuuccuacaaagacgcaaggug

SEQ ID NO: 119692 - RNA, 26 nt, Human
aggacagacacagauuuccugcuggg

SEQ ID NO: 119693 - RNA, 24 nt, Human
ucacgccguuauguugccucaaau

SEQ ID NO: 119694 - RNA, 19 nt, Human
cugcccccuccuuuuccca

SEQ ID NO: 119695 - RNA, 25 nt, Human
agauuucucuuuuauaccuuccuca

SEQ ID NO: 119696 - RNA, 26 nt, Human
ugagaaaacaauggccucaagggagg

SEQ ID NO: 119697 - RNA, 25 nt, Human
ucuucucugcuuugucuguguuuug

SEQ ID NO: 119698 - RNA, 23 nt, Human
gaaugccugggcauuuuacaaaa

SEQ ID NO: 119699 - RNA, 27 nt, Human
guugcccaggcuggucucaaacuccug

SEQ ID NO: 119700 - RNA, 22 nt, Human
aaccugccugugcaugaccuga

SEQ ID NO: 119701 - RNA, 21 nt, Human
ggcaaagugggagggagcugg

SEQ ID NO: 119702 - RNA, 21 nt, Human
gugcccaucaucucugccuuu

SEQ ID NO: 119703 - RNA, 22 nt, Human
caggcuggaguacaauggugcg

SEQ ID NO: 119704 - RNA, 21 nt, Human
cucuguuguaaauuagugguu

SEQ ID NO: 119705 - RNA, 23 nt, Human
aacucacaagccauugcucccca

SEQ ID NO: 119706 - RNA, 19 nt, Human
cuggcugccggcaccgccc

SEQ ID NO: 119707 - RNA, 22 nt, Human
accgcuuguacccaggaggugg

SEQ ID NO: 119708 - RNA, 23 nt, Human
guguucucuucccucucucccaa

SEQ ID NO: 119709 - RNA, 26 nt, Human
ucucuauacuuugucucugugucuua

SEQ ID NO: 119710 - RNA, 27 nt, Human
cgggccuuugucccugccuuggcuuuu

SEQ ID NO: 119711 - RNA, 22 nt, Human
ccaaguagcugagacugcaggc

SEQ ID NO: 119712 - RNA, 19 nt, Human
gcacagcaaagaucugcca

SEQ ID NO: 119713 - RNA, 22 nt, Human
ccaaaauacugggauuacaggc

SEQ ID NO: 119714 - RNA, 22 nt, Human
gcugggguugaaguuuggaguc

SEQ ID NO: 119715 - RNA, 24 nt, Human
gucauucaaguggaagcuuucaca

SEQ ID NO: 119716 - RNA, 23 nt, Human
uaccaugagaagagggccugugg

SEQ ID NO: 119717 - RNA, 27 nt, Human
cuuacuuccugccucagucugcuuucu

SEQ ID NO: 119718 - RNA, 31 nt, Human
aggugaagccuagcagaggacgcggccaggc

SEQ ID NO: 119719 - RNA, 23 nt, Human
cuuuuccucugcaucuccagucu

SEQ ID NO: 119720 - RNA, 25 nt, Human
ccaacccaaaccaugagaauuugca

SEQ ID NO: 119721 - RNA, 22 nt, Human
caagcuggagugcaguggugcg

SEQ ID NO: 119722 - RNA, 21 nt, Human
cagcuuccaaugccucuuguc

SEQ ID NO: 119723 - RNA, 22 nt, Human
gagcucuucagagaucauaaga

SEQ ID NO: 119724 - RNA, 26 nt, Human
cagcacagguauuucaggugugaaag

SEQ ID NO: 119725 - RNA, 27 nt, Human
caaagagacuguguguuacugaagaac

SEQ ID NO: 119726 - RNA, 28 nt, Human
ccuuuguuucucccccauguucuguccc

SEQ ID NO: 119727 - RNA, 21 nt, Human
agagcaguaucagcaucaucu

SEQ ID NO: 119728 - RNA, 20 nt, Human
ggaagacggaucccaccucc

SEQ ID NO: 119729 - RNA, 22 nt, Human
ucacccaggcuggaguacaaua

SEQ ID NO: 119730 - RNA, 21 nt, Human
ucacccugguggugguaggca

SEQ ID NO: 119731 - RNA, 22 nt, Human
ucacugcacuccagcuugggug

SEQ ID NO: 119732 - RNA, 22 nt, Human
cucuggccccaguucguuuccu

SEQ ID NO: 119733 - RNA, 24 nt, Human
ccaguagaaagcauaacaaaaaga

SEQ ID NO: 119734 - RNA, 21 nt, Human
ugccuggaguguaugacugca

SEQ ID NO: 119735 - RNA, 16 nt, Human
uacccaggcaguggug

SEQ ID NO: 119736 - RNA, 21 nt, Human
uccuuucuccccauccgggaa

SEQ ID NO: 119737 - RNA, 23 nt, Human
gaugcuguucuucagugcugaaa

SEQ ID NO: 119738 - RNA, 20 nt, Human
cuguccccucuggcugccuc

SEQ ID NO: 119739 - RNA, 22 nt, Human
aauaaggcuuucaaaagccaaa

SEQ ID NO: 119740 - RNA, 24 nt, Human
guuucaggggaaaaugcccacauu

SEQ ID NO: 119741 - RNA, 22 nt, Human
cguggaaauugaggaagggcgg

SEQ ID NO: 119742 - RNA, 27 nt, Human
ggucucaaacuccugggcucaagugau

SEQ ID NO: 119743 - RNA, 25 nt, Human
acagucccucccugagagacauggu

SEQ ID NO: 119744 - RNA, 20 nt, Human
ggaugcuggggcacuuuaaa

SEQ ID NO: 119745 - RNA, 20 nt, Human
uucaugcucauguacuucaa

SEQ ID NO: 119746 - RNA, 31 nt, Human; identical to SEQ ID NO: 5613

SEQ ID NO: 119747 - RNA, 22 nt, Human
cucugcucuccucuauucucca

SEQ ID NO: 119748 - RNA, 21 nt, Human
gcuuguucuguccucuugccu

SEQ ID NO: 119749 - RNA, 28 nt, Human
ccuucuguuccuaggucugccaagccag

SEQ ID NO: 119750 - RNA, 20 nt, Human
caacaggcugggcuucagug

SEQ ID NO: 119751 - RNA, 22 nt, Human
cagaccacugcaauaagaaaua

SEQ ID NO: 119752 - RNA, 22 nt, Human
guaauuuccuacuuuacacucu

SEQ ID NO: 119753 - RNA, 24 nt, Human
ggccuucaguccccuuaacguggc

SEQ ID NO: 119754 - RNA, 24 nt, Human
agucuuucaucuuuacugcugaga

SEQ ID NO: 119755 - RNA, 25 nt, Human
aggagaaugauggaaggaagggagg

SEQ ID NO: 119756 - RNA, 30 nt, Human
aaaugcuaaagacucacacugcagcaauca

SEQ ID NO: 119757 - RNA, 23 nt, Human
ccagaaggcagagguugcaguga

SEQ ID NO: 119758 - RNA, 19 nt, Human
uuaaucccucuuuuuguga

SEQ ID NO: 119759 - RNA, 27 nt, Human
ggcccagagagaagaaaaagacaggaa

SEQ ID NO: 119760 - RNA, 21 nt, Human
ccuggcucacccuccugagcu

SEQ ID NO: 119761 - RNA, 26 nt, Human
gccccuucccuucuucaucccgaccc

SEQ ID NO: 119762 - RNA, 25 nt, Human
ccugcuucucugcuccccuggguga

SEQ ID NO: 119763 - RNA, 21 nt, Human
uuugaacccagaucugaacag

SEQ ID NO: 119764 - RNA, 18 nt, Human
agaagcagguugcaguga

SEQ ID NO: 119765 - RNA, 23 nt, Human
cagucaggaagccuccugcugag

SEQ ID NO: 119766 - RNA, 26 nt, Human
uccauucagaaagcuucaaauuauag

SEQ ID NO: 119767 - RNA, 21 nt, Human
gaggcugggccagccugcugc

SEQ ID NO: 119768 - RNA, 25 nt, Human
ucacaugcauacuacauugguuuug

SEQ ID NO: 119769 - RNA, 22 nt, Human
ucaaguagcugggacuacagau

SEQ ID NO: 119770 - RNA, 22 nt, Human
cauaccuguaaugccagcacuu

SEQ ID NO: 119771 - RNA, 20 nt, Human
uacaugguuuaaagucacag

SEQ ID NO: 119772 - RNA, 26 nt, Human
gaggaaaaugguaaaaacuugaaaug

SEQ ID NO: 119773 - RNA, 22 nt, Human
gccugccggcgccaccugggcc

SEQ ID NO: 119774 - RNA, 21 nt, Human
aggaucagcuuccuccuucug

SEQ ID NO: 119775 - RNA, 26 nt, Human
gaccaaaaaauucaaugucuuaaaaa

SEQ ID NO: 119776 - RNA, 23 nt, Human
cacuguuaaaaucuuacuacuuc

SEQ ID NO: 119777 - RNA, 21 nt, Human
uaucuuuuucuccucucagcu

SEQ ID NO: 119778 - RNA, 26 nt, Human
aggaagagacacaccugaccagcccc

SEQ ID NO: 119779 - RNA, 22 nt, Human
gcucugaacugcacccaggagg

SEQ ID NO: 119780 - RNA, 27 nt, Human
cuccaucuccugggacguagcaggaaa

SEQ ID NO: 119781 - RNA, 23 nt, Human
uccugguguuuguguuccaguuc

SEQ ID NO: 119782 - RNA, 23 nt, Human
ugggagggagagaccggagcagc

SEQ ID NO: 119783 - RNA, 25 nt, Human
acagccuguucuacguaguggcucg

SEQ ID NO: 119784 - RNA, 19 nt, Human
cccauccuggggucaggaa

SEQ ID NO: 119785 - RNA, 23 nt, Human
agcucacaaccaccauucaguca

SEQ ID NO: 119786 - RNA, 21 nt, Human
agggagguggcggauggagug

SEQ ID NO: 119787 - RNA, 22 nt, Human
agacaaccacauggucaggcuc

SEQ ID NO: 119788 - RNA, 23 nt, Human
gaauuagacuuguauaucccacu

SEQ ID NO: 119789 - RNA, 27 nt, Human
cugggagggucgggggagcaaaaggcg

SEQ ID NO: 119790 - RNA, 23 nt, Human
ugucacucaggcuggaguacagu

SEQ ID NO: 119791 - RNA, 21 nt, Human
auccuaaauggcauggcuuug

SEQ ID NO: 119792 - RNA, 32 nt, Human
ugugguuuauuuuauuuucuucauuuuguucu

SEQ ID NO: 119793 - RNA, 27 nt, Human
aggaaugucaggagaaacuccaggcag

SEQ ID NO: 119794 - RNA, 22 nt, Human
gcagaaaagggagcccagaaaa

SEQ ID NO: 119795 - RNA, 27 nt, Human
uugucacucacccaaacugaccaauaa

SEQ ID NO: 119796 - RNA, 20 nt, Human
uguguuguaaguaaacuaca

SEQ ID NO: 119797 - RNA, 27 nt, Human
acacggcagccuucccgaaacauagua

SEQ ID NO: 119798 - RNA, 20 nt, Human
aagaggagaaggaaauuguc

SEQ ID NO: 119799 - RNA, 21 nt, Human
agauggcccucuucccaccac

SEQ ID NO: 119800 - RNA, 26 nt, Human
ccugccuggagguucucccugggggu

SEQ ID NO: 119801 - RNA, 20 nt, Human
auaguauuuuuauauuuaaa

SEQ ID NO: 119802 - RNA, 20 nt, Human
gguaaaaagaagaaaaagaa

SEQ ID NO: 119803 - RNA, 24 nt, Human
caagugcagcaacccagcccaugg

SEQ ID NO: 119804 - RNA, 20 nt, Human
uuuaucaggaaauacugccu

SEQ ID NO: 119805 - RNA, 25 nt, Human
gugaccaauauguucauauuaagca

SEQ ID NO: 119806 - RNA, 24 nt, Human
gggucccaguccagcugcugccuc

SEQ ID NO: 119807 - RNA, 21 nt, Human
gggagagcggccuccuccucc

SEQ ID NO: 119808 - RNA, 27 nt, Human
ggucuugaacuccugaccucgugaccc

SEQ ID NO: 119809 - RNA, 22 nt, Human
uugcaguuucuuauguuuugag

SEQ ID NO: 119810 - RNA, 29 nt, Human
aacccuugcaaugaagaugagcagaucca

SEQ ID NO: 119811 - RNA, 20 nt, Human
aaggaaagacaacuggggaa

SEQ ID NO: 119812 - RNA, 20 nt, Human
aaaauacaaaaauuagaugg

SEQ ID NO: 119813 - RNA, 22 nt, Human
uggagcuccaguuuucuuaccu

SEQ ID NO: 119814 - RNA, 19 nt, Human
ccaauauuccuuauuaaua

SEQ ID NO: 119815 - RNA, 22 nt, Human
uuuuacuucuaagucauucaua

SEQ ID NO: 119816 - RNA, 27 nt, Human
agcaaaugaguuugcaaaaugcccuca

SEQ ID NO: 119817 - RNA, 17 nt, Human
ugggggcagcacugggc

SEQ ID NO: 119818 - RNA, 21 nt, Human
cccucccccuccucuccacca

SEQ ID NO: 119819 - RNA, 20 nt, Human
ggaggcgguggcgcagggag

SEQ ID NO: 119820 - RNA, 27 nt, Human
agaccuccacuccacaucugcaucacu

SEQ ID NO: 119821 - RNA, 22 nt, Human
cgccuccuggguugaagcgauu

SEQ ID NO: 119822 - RNA, 23 nt, Human
ucaccuacuggaagacaaaugca

SEQ ID NO: 119823 - RNA, 21 nt, Human
uaccuguaaucccagcacuuu

SEQ ID NO: 119824 - RNA, 27 nt, Human
ucucucaauuacauagcaauuucuccu

SEQ ID NO: 119825 - RNA, 20 nt, Human
agcugucugcgcgucugacu

SEQ ID NO: 119826 - RNA, 21 nt, Human
ccucggggagaugcuggugag

SEQ ID NO: 119827 - RNA, 27 nt, Human
gaguggcgggacuggcuucacuuccuc

SEQ ID NO: 119828 - RNA, 25 nt, Human
uuggucagaagugcuaaaucugcua

SEQ ID NO: 119829 - RNA, 19 nt, Human
ucaagaaugaagcagagca

SEQ ID NO: 119830 - RNA, 23 nt, Human
guucgugcuggaguuuuguuggu

SEQ ID NO: 119831 - RNA, 24 nt, Human
gcucgcaaccucgcgguuccuggg

SEQ ID NO: 119832 - RNA, 23 nt, Human
uggguccugggagggugggugaa

SEQ ID NO: 119833 - RNA, 22 nt, Human
gucacagaacgucagagcugga

SEQ ID NO: 119834 - RNA, 25 nt, Human
ugcguagugcauucugauauuuuug

SEQ ID NO: 119835 - RNA, 19 nt, Human
uuuuaauucaguugagugc

SEQ ID NO: 119836 - RNA, 26 nt, Human
uaaauacccucuuugucaaccagaaa

SEQ ID NO: 119837 - RNA, 23 nt, Human
agcgccugugcugaggacucccg

SEQ ID NO: 119838 - RNA, 27 nt, Human
ccaaugcccaacugccugccuuagggu

SEQ ID NO: 119839 - RNA, 19 nt, Human
caaggcucuuccugggaac

SEQ ID NO: 119840 - RNA, 22 nt, Human
ccgcagccauggagcagcuucg

SEQ ID NO: 119841 - RNA, 24 nt, Human
acacuaaagaaggugugggccaga

SEQ ID NO: 119842 - RNA, 22 nt, Human
auucuacgggggcaguagcuca

SEQ ID NO: 119843 - RNA, 22 nt, Human
ugggacccucagcagcucuggc

SEQ ID NO: 119844 - RNA, 22 nt, Human
guuguccaggcuggagugcaau

SEQ ID NO: 119845 - RNA, 27 nt, Human
cuggccaucaaacauaauucucucaca

SEQ ID NO: 119846 - RNA, 21 nt, Human
uccaauaagcacauauugagc

SEQ ID NO: 119847 - RNA, 22 nt, Human
aauucagauacacguguguaau

SEQ ID NO: 119848 - RNA, 23 nt, Human
gagagagacucugggcucuuggc

SEQ ID NO: 119849 - RNA, 25 nt, Human
aaucucacauacugaauacuaguca

SEQ ID NO: 119850 - RNA, 22 nt, Human
ccacggcacuccagccugggcg

SEQ ID NO: 119851 - RNA, 20 nt, Human
ucucuuuucccagagaccuu

SEQ ID NO: 119852 - RNA, 22 nt, Human
ggugcucugucucccuggguga

SEQ ID NO: 119853 - RNA, 17 nt, Human
cucggcgggcugugggg

SEQ ID NO: 119854 - RNA, 22 nt, Human
cuaggcuggagugcaguggcac

SEQ ID NO: 119855 - RNA, 22 nt, Human
cccgaguagcuggcauuacagg

SEQ ID NO: 119856 - RNA, 21 nt, Human
cccccaucccuugcaggcugg

SEQ ID NO: 119857 - RNA, 27 nt, Human
ggggaaaggacaaaggaaaccuuaagu

SEQ ID NO: 119858 - RNA, 23 nt, Human
ugacaacuaaacaaggcauucag

SEQ ID NO: 119859 - RNA, 21 nt, Human
uucgaaauaacuuuuuucuca

SEQ ID NO: 119860 - RNA, 25 nt, Human
cgggguggggacagguagaccaggu

SEQ ID NO: 119861 - RNA, 22 nt, Human
uaaggccugacccugaaaugac

SEQ ID NO: 119862 - RNA, 31 nt, Human
cacucagaaccucucuggaauuugugccuga

SEQ ID NO: 119863 - RNA, 22 nt, Human
cagccgugucuguguuuuuguc

SEQ ID NO: 119864 - RNA, 21 nt, Human
gacuccccugcaccuuugcca

SEQ ID NO: 119865 - RNA, 21 nt, Human
acauucauacuacuaccaucu

SEQ ID NO: 119866 - RNA, 24 nt, Human
ccugacagcagguguacacaugcc

SEQ ID NO: 119867 - RNA, 21 nt, Human
ucuccugggucucccugcugc

SEQ ID NO: 119868 - RNA, 20 nt, Human
ccugucuccccucagcaguc

SEQ ID NO: 119869 - RNA, 22 nt, Human
cuggaaggaagagguugcagug

SEQ ID NO: 119870 - RNA, 20 nt, Human
acaaaugcuucuucaaaccu

SEQ ID NO: 119871 - RNA, 21 nt, Human
gccuuggggaaauguggagaa

SEQ ID NO: 119872 - RNA, 23 nt, Human
aucggcugaagagagcgggccca

SEQ ID NO: 119873 - RNA, 22 nt, Human
caucagcugcucagaucccacu

SEQ ID NO: 119874 - RNA, 26 nt, Human
caaauaaaguaguaaaagaagaaaua

SEQ ID NO: 119875 - RNA, 21 nt, Human
cgggaggaucaguugagguca

SEQ ID NO: 119876 - RNA, 24 nt, Human
gggcuggguggcugucucaaggac

SEQ ID NO: 119877 - RNA, 23 nt, Human
gcacagccaagcccuaccucucg

SEQ ID NO: 119878 - RNA, 23 nt, Human
accagcacucagccucauucagc

SEQ ID NO: 119879 - RNA, 24 nt, Human
gccccuugagcagcccauggcuua

SEQ ID NO: 119880 - RNA, 22 nt, Human
gaacagugugugaucaagugug

SEQ ID NO: 119881 - RNA, 29 nt, Human
uucuacauauuucugcucuucugaacaac

SEQ ID NO: 119882 - RNA, 20 nt, Human
ucccuccaucauugccaccu

SEQ ID NO: 119883 - RNA, 24 nt, Human
cccuugggcucccuccugccuccu

SEQ ID NO: 119884 - RNA, 27 nt, Human
cggaaggcguggcagggaggcagucgc

SEQ ID NO: 119885 - RNA, 22 nt, Human
uacaacucaucugcagcuccgg

SEQ ID NO: 119886 - RNA, 23 nt, Human
cccaaaauguuggguacaggggu

SEQ ID NO: 119887 - RNA, 31 nt, Human
ucuuaacuacaguggcugaauagcuucucca

SEQ ID NO: 119888 - RNA, 21 nt, Human
uucaugaaaauagcucuuuca

SEQ ID NO: 119889 - RNA, 22 nt, Human
acaccugccucaugucaguuua

SEQ ID NO: 119890 - RNA, 27 nt, Human
gagcuucucuuugggugccaucaaaga

SEQ ID NO: 119891 - RNA, 19 nt, Human
guauucuucuguauuucua

SEQ ID NO: 119892 - RNA, 21 nt, Human
gcauucagugcaccugccuca

SEQ ID NO: 119893 - RNA, 22 nt, Human
uggauucauauuucuucaucug

SEQ ID NO: 119894 - RNA, 26 nt, Human
ucgucuuuaccugaggauuucuagcc

SEQ ID NO: 119895 - RNA, 21 nt, Human
acugcucguggccaaaaguuu

SEQ ID NO: 119896 - RNA, 19 nt, Human
agguacccccuccccagcu

SEQ ID NO: 119897 - RNA, 26 nt, Human
ggaggcggggccugcagcuggcuugg

SEQ ID NO: 119898 - RNA, 20 nt, Human
cacugcugcgcgcugggcag

SEQ ID NO: 119899 - RNA, 25 nt, Human
ccauucucuacccauccuuaguaca

SEQ ID NO: 119900 - RNA, 22 nt, Human
cauuccccccuccacaccaucc

SEQ ID NO: 119901 - RNA, 24 nt, Human
gccagugcaccagcaguuuaggug

SEQ ID NO: 119902 - RNA, 30 nt, Human
ggugacucacaccuguaauuccagcacuuc

SEQ ID NO: 119903 - RNA, 22 nt, Human
aaccucaccuugcacagcucac

SEQ ID NO: 119904 - RNA, 17 nt, Human
cuuucuagccauuaaua

SEQ ID NO: 119905 - RNA, 25 nt, Human
auuuuauagcccacuuaccaugcau

SEQ ID NO: 119906 - RNA, 25 nt, Human
ugcggcaccuggaaugaucaacuca

SEQ ID NO: 119907 - RNA, 20 nt, Human
ccucaccucagccuccgcuc

SEQ ID NO: 119908 - RNA, 21 nt, Human
auccuccuguacccgcaacga

SEQ ID NO: 119909 - RNA, 25 nt, Human
caguuuaggccuuggcuugauggaa

SEQ ID NO: 119910 - RNA, 27 nt, Human
augacugccacgcauuuacagauuggu

SEQ ID NO: 119911 - RNA, 24 nt, Human
uccaaaagcauuuaaaaucaauag

SEQ ID NO: 119912 - RNA, 24 nt, Human
uagcaaugcuguguuauuacuuga

SEQ ID NO: 119913 - RNA, 19 nt, Human
acccaggcuagagugcagu

SEQ ID NO: 119914 - RNA, 22 nt, Human
auacuccugggcucaagcaauc

SEQ ID NO: 119915 - RNA, 22 nt, Human
gaauguucauucauauucauuu

SEQ ID NO: 119916 - RNA, 21 nt, Human
cuagagagaagucauccacac

SEQ ID NO: 119917 - RNA, 22 nt, Human
gaacccaggaggcggagcuugc

SEQ ID NO: 119918 - RNA, 18 nt, Human
agcucacaccuguccuuc

SEQ ID NO: 119919 - RNA, 21 nt, Human
gaccagcaauugcagcacuua

SEQ ID NO: 119920 - RNA, 21 nt, Human
ccaaaucuuggcugggcacgg

SEQ ID NO: 119921 - RNA, 22 nt, Human
guaacaucguugcaaccacugc

SEQ ID NO: 119922 - RNA, 27 nt, Human
gcacgccugugaucacagcuacucggg

SEQ ID NO: 119923 - RNA, 19 nt, Human
uuccaauaauccuguuuca

SEQ ID NO: 119924 - RNA, 19 nt, Human
uacauacuaggugccuuuu

SEQ ID NO: 119925 - RNA, 26 nt, Human
cugccuuuuccuuucucaggccaaug

SEQ ID NO: 119926 - RNA, 24 nt, Human
uggagccuugcucucugggcacag

SEQ ID NO: 119927 - RNA, 19 nt, Human
ugaauauuuaaauuagaca

SEQ ID NO: 119928 - RNA, 23 nt, Human
uggaucucccugcaugacagucc

SEQ ID NO: 119929 - RNA, 22 nt, Human
gguuaccauuaauagguuuagg

SEQ ID NO: 119930 - RNA, 22 nt, Human
cugcuacugccccucuccgaaa

SEQ ID NO: 119931 - RNA, 21 nt, Human
cugagaauauuaauuguggua

SEQ ID NO: 119932 - RNA, 21 nt, Human
aguucugccagaaccagugcu

SEQ ID NO: 119933 - RNA, 23 nt, Human
uggaggcccugaccucugcugca

SEQ ID NO: 119934 - RNA, 21 nt, Human
aaggauuugauaauacaguga

SEQ ID NO: 119935 - RNA, 21 nt, Human
caguaaacaaugaauaguuuu

SEQ ID NO: 119936 - RNA, 29 nt, Human
guaagggggugguugucccaggaggcagc

SEQ ID NO: 119937 - RNA, 22 nt, Human
ucuccccuuauccuucuggucc

SEQ ID NO: 119938 - RNA, 23 nt, Human
gacuauucagaaacaauaaucca

SEQ ID NO: 119939 - RNA, 22 nt, Human
gagggugggacagggaccuuuu

SEQ ID NO: 119940 - RNA, 23 nt, Human
gccgccagcugggagcacuggug

SEQ ID NO: 119941 - RNA, 21 nt, Human
gcaucaaagggaggcugaaga

SEQ ID NO: 119942 - RNA, 21 nt, Human
aauugugccuucugugggcca

SEQ ID NO: 119943 - RNA, 23 nt, Human
ccuccuccucggaauccuggguu

SEQ ID NO: 119944 - RNA, 21 nt, Human
cacugucuuuugucuuggagg

SEQ ID NO: 119945 - RNA, 27 nt, Human
agagacacgcuggcgacacacuccguc

SEQ ID NO: 119946 - RNA, 21 nt, Human
caugccucucguaaaacuggg

SEQ ID NO: 119947 - RNA, 22 nt, Human
cuucauugacuaaacaguauua

SEQ ID NO: 119948 - RNA, 21 nt, Human
gagcaguuuccccacuguguc

SEQ ID NO: 119949 - RNA, 22 nt, Human
aagacuccuuuccugcaucuuu

SEQ ID NO: 119950 - RNA, 23 nt, Human
aaggggcagcaggaggaguggaa

SEQ ID NO: 119951 - RNA, 27 nt, Human
gcuugagccaccacacccggcacaucu

SEQ ID NO: 119952 - RNA, 21 nt, Human
uccccuggcgacugccuggac

SEQ ID NO: 119953 - RNA, 21 nt, Human
gcucaccucguuccacagcuc

SEQ ID NO: 119954 - RNA, 22 nt, Human
aucgccaaccuuucccccacca

SEQ ID NO: 119955 - RNA, 25 nt, Human
uaaacaaagggaaaccuauauuuau

SEQ ID NO: 119956 - RNA, 27 nt, Human
acuaagcuaaaacuagagcaguuugau

SEQ ID NO: 119957 - RNA, 22 nt, Human
ggccuuccucccuuccuuucac

SEQ ID NO: 119958 - RNA, 22 nt, Human
gcugaaaaguggccaagggcca

SEQ ID NO: 119959 - RNA, 24 nt, Human
ugaauagugguguucucuguugcu

SEQ ID NO: 119960 - RNA, 30 nt, Human
ugcugcugcugcuacugcuguuuccagggg

SEQ ID NO: 119961 - RNA, 23 nt, Human
agagaaacugugaauguaaggug

SEQ ID NO: 119962 - RNA, 18 nt, Human
acucaagcaagaaauaug

SEQ ID NO: 119963 - RNA, 27 nt, Human
ucuuaacucagcuuuugcuacuuuggc

SEQ ID NO: 119964 - RNA, 18 nt, Human
auguuagccaggcugguc

SEQ ID NO: 119965 - RNA, 22 nt, Human
cagccuucgucacccagccugu

SEQ ID NO: 119966 - RNA, 23 nt, Human
caagcuagaaccuggagggaaug

SEQ ID NO: 119967 - RNA, 21 nt, Human
accaguauuuucuaguuuaaa

SEQ ID NO: 119968 - RNA, 22 nt, Human
ggccauggggcagccuccaguc

SEQ ID NO: 119969 - RNA, 22 nt, Human
gccugaauuuguucucuuuuug

SEQ ID NO: 119970 - RNA, 21 nt, Human
ccacacccagugagcauugga

SEQ ID NO: 119971 - RNA, 21 nt, Human
caauguccaggucacaggcau

SEQ ID NO: 119972 - RNA, 21 nt, Human
agcaguuuuauccuggccuug

SEQ ID NO: 119973 - RNA, 23 nt, Human
ccagcuuggugggaaagugcaga

SEQ ID NO: 119974 - RNA, 21 nt, Human
ucccagaacaugacaaauuau

SEQ ID NO: 119975 - RNA, 21 nt, Human
agccuaguccccaaggcgggg

SEQ ID NO: 119976 - RNA, 23 nt, Human
auuguccaggcuggucuugaauu

SEQ ID NO: 119977 - RNA, 23 nt, Human
ucuaagauggauuaaacaaguau

SEQ ID NO: 119978 - RNA, 25 nt, Human
cccaccccacgccuuagcugcaggc

SEQ ID NO: 119979 - RNA, 29 nt, Human
ucugccccacugccagccugagugggcaa

SEQ ID NO: 119980 - RNA, 29 nt, Human
uggaacuaaacaguugagugguuugggau

SEQ ID NO: 119981 - RNA, 26 nt, Human
cugccucucugcuccaccuugugacc

SEQ ID NO: 119982 - RNA, 23 nt, Human
cuaccuugccuccuuuuuucuua

SEQ ID NO: 119983 - RNA, 20 nt, Human
cacuggcuuguuuguucccu

SEQ ID NO: 119984 - RNA, 21 nt, Human
aaguuggguggauaagcuauc

SEQ ID NO: 119985 - RNA, 23 nt, Human
aacuucucugggaugcugggauu

SEQ ID NO: 119986 - RNA, 21 nt, Human
gacucugguuuccauuagucu

SEQ ID NO: 119987 - RNA, 20 nt, Human
cuuuccuuucauauccacag

SEQ ID NO: 119988 - RNA, 23 nt, Human
ccagaccaugcugaugaccucaa

SEQ ID NO: 119989 - RNA, 22 nt, Human
cauugcacugcagccuggguga

SEQ ID NO: 119990 - RNA, 23 nt, Human
uagaaaugccuuuaacauucaua

SEQ ID NO: 119991 - RNA, 27 nt, Human
aaccugacaagucuaucucuaagagcc

SEQ ID NO: 119992 - RNA, 21 nt, Human
gugauguggcaggagggcagu

SEQ ID NO: 119993 - RNA, 23 nt, Human
gguggcaugacugucaggaggug

SEQ ID NO: 119994 - RNA, 25 nt, Human
uauccuguucugaaucaucaucgcu

SEQ ID NO: 119995 - RNA, 21 nt, Human
cugagcacuccucucucucca

SEQ ID NO: 119996 - RNA, 26 nt, Human
ggcgggaugagagggagccaucgggc

SEQ ID NO: 119997 - RNA, 21 nt, Human
gucaguuucccggcacuggca

SEQ ID NO: 119998 - RNA, 23 nt, Human
uccagugaccugcuggguaaacu

SEQ ID NO: 119999 - RNA, 21 nt, Human
acgagggagagcuggaggggc

SEQ ID NO: 120000 - RNA, 21 nt, Human
uauugaauuagacacuuuaga

SEQ ID NO: 120001 - RNA, 26 nt, Human
ucuugccucugcuccgacgccguucc

SEQ ID NO: 120002 - RNA, 27 nt, Human
caccucaaagcgguuuaaccacauuaa

SEQ ID NO: 120003 - RNA, 24 nt, Human
ccagggcugcagggucgguacuga

SEQ ID NO: 120004 - RNA, 26 nt, Human
cugucucuuccugccuguguaccucg

SEQ ID NO: 120005 - RNA, 20 nt, Human
ccccuucccuguccuugccc

SEQ ID NO: 120006 - RNA, 21 nt, Human
ccuuccuuuagcucaggcucc

SEQ ID NO: 120007 - RNA, 21 nt, Human
caccuugggaucccugccaca

SEQ ID NO: 120008 - RNA, 23 nt, Human
agcaguuugaagcccaaucugca

SEQ ID NO: 120009 - RNA, 22 nt, Human
gccuaugauacugucucuccag

SEQ ID NO: 120010 - RNA, 22 nt, Human
agaaagccugggugacauuugg

SEQ ID NO: 120011 - RNA, 22 nt, Human
agcucugcaucuccugucuuuu

SEQ ID NO: 120012 - RNA, 21 nt, Human
ccugucacaagccucagugug

SEQ ID NO: 120013 - RNA, 22 nt, Human
cucugguaccaccucugaguca

SEQ ID NO: 120014 - RNA, 23 nt, Human
aaaugacuggggagacaccugaa

SEQ ID NO: 120015 - RNA, 25 nt, Human
uucaguauuuuaucucaaguagaua

SEQ ID NO: 120016 - RNA, 22 nt, Human
ugucagauguacacaacuuccu

SEQ ID NO: 120017 - RNA, 28 nt, Human
aagaaugaagaauggaaauggaaaaggg

SEQ ID NO: 120018 - RNA, 22 nt, Human
gcgagggagcgaggucgcagug

SEQ ID NO: 120019 - RNA, 23 nt, Human
aucucaccacugcacuccagccu

SEQ ID NO: 120020 - RNA, 21 nt, Human
ggcucacugcaagcuccgccu

SEQ ID NO: 120021 - RNA, 29 nt, Human
gcugggaucuuucucucugacuauacuua

SEQ ID NO: 120022 - RNA, 23 nt, Human
acaaguguuuaucaaacugaagg

SEQ ID NO: 120023 - RNA, 22 nt, Human
acacacgcauacacacauauaa

SEQ ID NO: 120024 - RNA, 27 nt, Human
uaccauguagcgcugagugauaaaguu

SEQ ID NO: 120025 - RNA, 22 nt, Human
aagaaauugccauuugaaacaa

SEQ ID NO: 120026 - RNA, 23 nt, Human
ccuuagacuuuaauuaggguuau

SEQ ID NO: 120027 - RNA, 23 nt, Human
agagacaaaacuuuauugcacug

SEQ ID NO: 120028 - RNA, 26 nt, Human
ggugaagccuagacaaagccgccagg

SEQ ID NO: 120029 - RNA, 26 nt, Human
cugagccuugggcccuguagugacau

SEQ ID NO: 120030 - RNA, 24 nt, Human
auucuaaaugugucccaucaugcu

SEQ ID NO: 120031 - RNA, 22 nt, Human
uuguccucugcugccaucugcc

SEQ ID NO: 120032 - RNA, 20 nt, Human
aucauucucugccauauaca

SEQ ID NO: 120033 - RNA, 21 nt, Human
cgcccaggcuggaguacagug

SEQ ID NO: 120034 - RNA, 21 nt, Human
cgcccagacuggagugcagug

SEQ ID NO: 120035 - RNA, 23 nt, Human
agcucuuaccuuuauuacugaau

SEQ ID NO: 120036 - RNA, 22 nt, Human
uugaguauugccuuguuugaca

SEQ ID NO: 120037 - RNA, 25 nt, Human
uuuuagggcccuccccacccacacc

SEQ ID NO: 120038 - RNA, 21 nt, Human
cauauguuuguaugggagaaa

SEQ ID NO: 120039 - RNA, 26 nt, Human
cgggcuuauaauuugccauuugugaa

SEQ ID NO: 120040 - RNA, 27 nt, Human
ugaggagcccugcugaggucacugugg

SEQ ID NO: 120041 - RNA, 27 nt, Human
acuuacauuguuuacuacuuuacuaau

SEQ ID NO: 120042 - RNA, 23 nt, Human
ggaggcaccagaccuugaaaaga

SEQ ID NO: 120043 - RNA, 24 nt, Human
cuggggcagggggugaagaacccu

SEQ ID NO: 120044 - RNA, 20 nt, Human
aucucuucuauuuuguuguc

SEQ ID NO: 120045 - RNA, 24 nt, Human
gggccuggaaugucagaagcagca

SEQ ID NO: 120046 - RNA, 27 nt, Human
ggccaguaccuuuccuaagucuuugcu

SEQ ID NO: 120047 - RNA, 18 nt, Human
caccugcacagguauuuu

SEQ ID NO: 120048 - RNA, 22 nt, Human
aggaagaaaucagguggaugga

SEQ ID NO: 120049 - RNA, 27 nt, Human
uuuccaaaacagcaagcauagggagag

SEQ ID NO: 120050 - RNA, 22 nt, Human
acacauuuuuuaggaaauguuu

SEQ ID NO: 120051 - RNA, 28 nt, Human
uaagagcagcagcacuuucagauucagu

SEQ ID NO: 120052 - RNA, 20 nt, Human
guggggaggggauggggugc

SEQ ID NO: 120053 - RNA, 22 nt, Human
ugagccaagcuagaauucccuc

SEQ ID NO: 120054 - RNA, 22 nt, Human
ccaaagugcugggaugaccagc

SEQ ID NO: 120055 - RNA, 22 nt, Human
aaaauuauaaaaauuagccggg

SEQ ID NO: 120056 - RNA, 20 nt, Human
cugcagccccacuccugggc

SEQ ID NO: 120057 - RNA, 22 nt, Human
cccaggagagaguggucuggug

SEQ ID NO: 120058 - RNA, 23 nt, Human
ucuuagcagccucucuacauaca

SEQ ID NO: 120059 - RNA, 18 nt, Human
ccucuucccuccuugcca

SEQ ID NO: 120060 - RNA, 25 nt, Human
gacucuucucauccuuccucauuug

SEQ ID NO: 120061 - RNA, 21 nt, Human
ggcucacugcaagcucugccc

SEQ ID NO: 120062 - RNA, 22 nt, Human
gcacagcccacggggaucacag

SEQ ID NO: 120063 - RNA, 25 nt, Human
cuccucugagccugcccugccuccu

SEQ ID NO: 120064 - RNA, 21 nt, Human
cagucucuguuuccagcacug

SEQ ID NO: 120065 - RNA, 22 nt, Human
cucugauggcccuccucucugc

SEQ ID NO: 120066 - RNA, 23 nt, Human
uguguauccugacagcgccaugu

SEQ ID NO: 120067 - RNA, 22 nt, Human
uguuucuucucaggcucaggga

SEQ ID NO: 120068 - RNA, 20 nt, Human
ugacuucugccauuucaaag

SEQ ID NO: 120069 - RNA, 23 nt, Human
cugcuccucccugggccugaaag

SEQ ID NO: 120070 - RNA, 21 nt, Human
ucagcgcucuggugcugcagu

SEQ ID NO: 120071 - RNA, 20 nt, Human
agaauuucgugaacagccuu

SEQ ID NO: 120072 - RNA, 21 nt, Human
cagcgguuggagguuguagga

SEQ ID NO: 120073 - RNA, 20 nt, Human
ggaggcggagcuugcaguga

SEQ ID NO: 120074 - RNA, 20 nt, Human
ggcggcggagauugcaguga

SEQ ID NO: 120075 - RNA, 26 nt, Human
gcucugcccaugccugaggugguccu

SEQ ID NO: 120076 - RNA, 22 nt, Human
cuaggauggugaaauuccaaag

SEQ ID NO: 120077 - RNA, 21 nt, Human
uguugaguugacggguuccuu

SEQ ID NO: 120078 - RNA, 21 nt, Human
cugcugaacugugagugcagu

SEQ ID NO: 120079 - RNA, 26 nt, Human
auuucuguacguuuguucagucucua

SEQ ID NO: 120080 - RNA, 23 nt, Human
ccgccugccucgacuuccccaca

SEQ ID NO: 120081 - RNA, 26 nt, Human
cuccaucucgcugcugcugaaggccg

SEQ ID NO: 120082 - RNA, 27 nt, Human
uccucuuggagcauucucccagacccu

SEQ ID NO: 120083 - RNA, 23 nt, Human
ugcccugcccaauuuugcaggga

SEQ ID NO: 120084 - RNA, 22 nt, Human
ccaaugaaaacauuuguuauug

SEQ ID NO: 120085 - RNA, 19 nt, Human
guacacuguuucaaacuuu

SEQ ID NO: 120086 - RNA, 22 nt, Human
cucaaccggcuccaucacaucc

SEQ ID NO: 120087 - RNA, 23 nt, Human
gcuagcacaugcccuaaugucug

SEQ ID NO: 120088 - RNA, 22 nt, Human
ccucagccccagcaccaccagc

SEQ ID NO: 120089 - RNA, 30 nt, Human
gcaucaagccccucgcugggcaccucgcac

SEQ ID NO: 120090 - RNA, 25 nt, Human
acccaggcuggagugcaguggcgug

SEQ ID NO: 120091 - RNA, 25 nt, Human
acccaggcuggaguacaguggcaug

SEQ ID NO: 120092 - RNA, 23 nt, Human
guuuuucugaaugaccagaugua

SEQ ID NO: 120093 - RNA, 19 nt, Human
aagaggcagaguuuauccc

SEQ ID NO: 120094 - RNA, 25 nt, Human
cugugcuuucauguuuaagaaauga

SEQ ID NO: 120095 - RNA, 21 nt, Human
aggugggaaaggagagcacug

SEQ ID NO: 120096 - RNA, 23 nt, Human
ugggagcuuuguucucuugcucu

SEQ ID NO: 120097 - RNA, 21 nt, Human
cacugcaugaacaucuauaca

SEQ ID NO: 120098 - RNA, 28 nt, Human
uuccugcagcccuccagacuuccugccc

SEQ ID NO: 120099 - RNA, 26 nt, Human
aagggaaagcaagaaacuagaugccu

SEQ ID NO: 120100 - RNA, 26 nt, Human
ucuuccuaugguuuuagauguuugau

SEQ ID NO: 120101 - RNA, 26 nt, Human
uaagugcauuuucaucacagaaaaga

SEQ ID NO: 120102 - RNA, 24 nt, Human
aaagguucuccaaaugucaacugu

SEQ ID NO: 120103 - RNA, 16 nt, Human
ugccgccaccaccuca

SEQ ID NO: 120104 - RNA, 21 nt, Human
cccggcuaauuuuuugaauuu

SEQ ID NO: 120105 - RNA, 24 nt, Human
aguucuccugugucagucuugccu

SEQ ID NO: 120106 - RNA, 22 nt, Human
ugcuucuccaggccucuugccu

SEQ ID NO: 120107 - RNA, 26 nt, Human
gcgcacacugacacgcguacacgcac

SEQ ID NO: 120108 - RNA, 22 nt, Human
acuaugcacucagaaaaaucca

SEQ ID NO: 120109 - RNA, 26 nt, Human
acagcccagagcagccugagugcagu

SEQ ID NO: 120110 - RNA, 22 nt, Human
uucacuacucaaugauguguca

SEQ ID NO: 120111 - RNA, 26 nt, Human
cgagagccaccauacaagguucaucu

SEQ ID NO: 120112 - RNA, 22 nt, Human
ugaaauaugucuauaugcugaa

SEQ ID NO: 120113 - RNA, 20 nt, Human
acugaggacuaguuugggaa

SEQ ID NO: 120114 - RNA, 23 nt, Human
uggagaagaaaaaaggugcugua

SEQ ID NO: 120115 - RNA, 20 nt, Human
uuucugcugauuaucacaca

SEQ ID NO: 120116 - RNA, 21 nt, Human
gaagaaacccacccacuguga

SEQ ID NO: 120117 - RNA, 21 nt, Human
cuggggccuagcccugcuaga

SEQ ID NO: 120118 - RNA, 22 nt, Human
ccuugggccagcucuuggcuaa

SEQ ID NO: 120119 - RNA, 27 nt, Human
aagcccauggguuacagaaugcuaggg

SEQ ID NO: 120120 - RNA, 22 nt, Human
uaauaggucaucucagcuuaua

SEQ ID NO: 120121 - RNA, 26 nt, Human
cuggaaaacagcugcuguuagauguc

SEQ ID NO: 120122 - RNA, 21 nt, Human
cccacugcacuccagccuggg

SEQ ID NO: 120123 - RNA, 20 nt, Human
ccaggcuggacaguucagug

SEQ ID NO: 120124 - RNA, 22 nt, Human
cccagccauccucccauccugc

SEQ ID NO: 120125 - RNA, 25 nt, Human
gugggagggggcuaggguacuuggc

SEQ ID NO: 120126 - RNA, 25 nt, Human
ucuccauuuucugaccucuggacua

SEQ ID NO: 120127 - RNA, 27 nt, Human
caccacugcugcucgagucuccugcac

SEQ ID NO: 120128 - RNA, 27 nt, Human
uuaaaaaauauauaccaacagaacuac

SEQ ID NO: 120129 - RNA, 23 nt, Human
uacagcuuugaagggucaagggu

SEQ ID NO: 120130 - RNA, 27 nt, Human
gccuaucucuguuuacaugcauagcuu

SEQ ID NO: 120131 - RNA, 20 nt, Human
cccugaagugucuccagcag

SEQ ID NO: 120132 - RNA, 19 nt, Human
cacuccaggaaggggcugg

SEQ ID NO: 120133 - RNA, 19 nt, Human
uuuaucugagugcugucua

SEQ ID NO: 120134 - RNA, 23 nt, Human
cggugcugcaagacucucuggua

SEQ ID NO: 120135 - RNA, 24 nt, Human
auccuuuaacacuaagguaacaug

SEQ ID NO: 120136 - RNA, 23 nt, Human
guguggcaucuccaccucaaggg

SEQ ID NO: 120137 - RNA, 21 nt, Human
cugcagccaggcugggcagag

SEQ ID NO: 120138 - RNA, 27 nt, Human
uccaucaucaaaacaccaaagacucaa

SEQ ID NO: 120139 - RNA, 21 nt, Human
uuggaaccugcaggaaaugga

SEQ ID NO: 120140 - RNA, 22 nt, Human
gucuuuuccuucugagccugcc

SEQ ID NO: 120141 - RNA, 25 nt, Human
ugagcugggugaauuccagccuggg

SEQ ID NO: 120142 - RNA, 22 nt, Human
aggcugccggcgaguggcaggc

SEQ ID NO: 120143 - RNA, 25 nt, Human
cccuaaccaucuuggaugcugggcu

SEQ ID NO: 120144 - RNA, 27 nt, Human
ucucagccugggagacuccugccaagc

SEQ ID NO: 120145 - RNA, 22 nt, Human
agccuagaaccucccaguagag

SEQ ID NO: 120146 - RNA, 20 nt, Human
acaaucagggugagacugcu

SEQ ID NO: 120147 - RNA, 22 nt, Human
ugaaggaggcggggcucuagga

SEQ ID NO: 120148 - RNA, 25 nt, Human
caguuucagcagcuaccaugacagc

SEQ ID NO: 120149 - RNA, 23 nt, Human
acuguccuguggacagacggggu

SEQ ID NO: 120150 - RNA, 27 nt, Human
cacaggcaucuucaguuauugcuuguc

SEQ ID NO: 120151 - RNA, 23 nt, Human
acuucauuccuguaaauacucuu

SEQ ID NO: 120152 - RNA, 20 nt, Human
uggggacucgggggcugguc

SEQ ID NO: 120153 - RNA, 22 nt, Human
cagccuaugaugaaguauuuga

SEQ ID NO: 120154 - RNA, 22 nt, Human
ucacccaggcuugagugcagug

SEQ ID NO: 120155 - RNA, 22 nt, Human
gaugcacgguuucuguucugcc

SEQ ID NO: 120156 - RNA, 27 nt, Human
auccccuuuuuguucuuccuggaccug

SEQ ID NO: 120157 - RNA, 20 nt, Human
aacacaaacagaauauugca

SEQ ID NO: 120158 - RNA, 20 nt, Human
aaccuauaaauuaacucaac

SEQ ID NO: 120159 - RNA, 28 nt, Human
ggaucugaacauacagagcccacauuuc

SEQ ID NO: 120160 - RNA, 25 nt, Human
cuaggaaaucacaggcuucugagca

SEQ ID NO: 120161 - RNA, 24 nt, Human
cugccuacuccaaaauguugguca

SEQ ID NO: 120162 - RNA, 23 nt, Human
ucuuuuaucugugucuguguauc

SEQ ID NO: 120163 - RNA, 23 nt, Human
uccucuuuaucacaaguuuucca

SEQ ID NO: 120164 - RNA, 26 nt, Human
cuggaggaccugccccuaccugcugc

SEQ ID NO: 120165 - RNA, 25 nt, Human
ggcuucuggcugaggccuuacgcau

SEQ ID NO: 120166 - RNA, 24 nt, Human
ucugcaucccagcaccugccuccu

SEQ ID NO: 120167 - RNA, 21 nt, Human
uggggggugcugagucaucuc

SEQ ID NO: 120168 - RNA, 23 nt, Human
ccacugcacgcuggugcugggag

SEQ ID NO: 120169 - RNA, 22 nt, Human
gugauguuuuuaugauaucccu

SEQ ID NO: 120170 - RNA, 22 nt, Human
acuuucuuuacuccaucauggc

SEQ ID NO: 120171 - RNA, 23 nt, Human
aucacagucauucauccaggcca

SEQ ID NO: 120172 - RNA, 27 nt, Human
gcuguuuuugugccuguuugaagcuac

SEQ ID NO: 120173 - RNA, 21 nt, Human
cggcuccucggaguccuggcc

SEQ ID NO: 120174 - RNA, 23 nt, Human
uaaaaaguuugggggugcaauau

SEQ ID NO: 120175 - RNA, 21 nt, Human
ucuuccuuccaguuuuauuag

SEQ ID NO: 120176 - RNA, 26 nt, Human
gugccugcccaugccagcacuuccuu

SEQ ID NO: 120177 - RNA, 28 nt, Human
ggagagggaggagguugcaaaaagccag

SEQ ID NO: 120178 - RNA, 21 nt, Human
cuucugaaaaaugaauguaaa

SEQ ID NO: 120179 - RNA, 27 nt, Human
accagccuggccaacauagcaaaaccc

SEQ ID NO: 120180 - RNA, 22 nt, Human
gacgcuucacguugaggggagg

SEQ ID NO: 120181 - RNA, 26 nt, Human
uguuggccaggcuggucucgagcucc

SEQ ID NO: 120182 - RNA, 18 nt, Human
aauguaugcuacucugaa

SEQ ID NO: 120183 - RNA, 20 nt, Human
cucagccaguggggaugagg

SEQ ID NO: 120184 - RNA, 23 nt, Human
guuuuauuuuguaaaaugcauuc

SEQ ID NO: 120185 - RNA, 22 nt, Human
guuauucaagauugaguucuca

SEQ ID NO: 120186 - RNA, 23 nt, Human
cugccuggcuggcuccgggccgc

SEQ ID NO: 120187 - RNA, 22 nt, Human
ugccauauaacacuugcacaug

SEQ ID NO: 120188 - RNA, 22 nt, Human
ucugagaguuuaguuguagcag

SEQ ID NO: 120189 - RNA, 26 nt, Human
cgacagucugccugggccacagcccu

SEQ ID NO: 120190 - RNA, 25 nt, Human
ggggaaaggaaguggcuuugaggca

SEQ ID NO: 120191 - RNA, 28 nt, Human
cuggggaggugggaggccaggcgagccu

SEQ ID NO: 120192 - RNA, 27 nt, Human
uucagaagagaaaaauggaauaucaga

SEQ ID NO: 120193 - RNA, 27 nt, Human
acuguuacaaaccccugcacagugccu

SEQ ID NO: 120194 - RNA, 22 nt, Human
cacccaggcuggcagaucaugg

SEQ ID NO: 120195 - RNA, 26 nt, Human
cagaacauuugucaggcucucuguca

SEQ ID NO: 120196 - RNA, 26 nt, Human
uguguugucucucuaaacccaaauaa

SEQ ID NO: 120197 - RNA, 21 nt, Human
aaccaguauuugauuuaagcu

SEQ ID NO: 120198 - RNA, 23 nt, Human
uacaagggagaagacaacagaaa

SEQ ID NO: 120199 - RNA, 22 nt, Human
aguaacaccuuuaucuugguau

SEQ ID NO: 120200 - RNA, 21 nt, Human
ggagucguggcugagcagaac

SEQ ID NO: 120201 - RNA, 27 nt, Human
ccccagccauggaagagcucacggcuu

SEQ ID NO: 120202 - RNA, 22 nt, Human
auucagucuguuauuuuguaca

SEQ ID NO: 120203 - RNA, 20 nt, Human
cgccuguaauccagcacuuu

SEQ ID NO: 120204 - RNA, 24 nt, Human
ugcuuuuuagaacaaaucuggaua

SEQ ID NO: 120205 - RNA, 23 nt, Human
cuccuaagcuggagugcaguggc

SEQ ID NO: 120206 - RNA, 26 nt, Human
ccuaucucccugggucauauggagac

SEQ ID NO: 120207 - RNA, 27 nt, Human
cagaaggcaacauucccugaacauacu

SEQ ID NO: 120208 - RNA, 21 nt, Human
cuugaacuuccagccuccaga

SEQ ID NO: 120209 - RNA, 28 nt, Human
aaaguucugggcuaucuuagcuaacuua

SEQ ID NO: 120210 - RNA, 21 nt, Human
aggguccaaaccugagugagg

SEQ ID NO: 120211 - RNA, 22 nt, Human
aauuuuaaauuuaacucugccu

SEQ ID NO: 120212 - RNA, 32 nt, Human
gggggaagggaugcagggggaggcagcgcugc

SEQ ID NO: 120213 - RNA, 21 nt, Human
guuccuugagucuccacacac

SEQ ID NO: 120214 - RNA, 21 nt, Human
ccagcucuggacagaguucuu

SEQ ID NO: 120215 - RNA, 25 nt, Human
cccaucacucucagagaccacguuu

SEQ ID NO: 120216 - RNA, 22 nt, Human
cgccuguaaucccagcccuuug

SEQ ID NO: 120217 - RNA, 22 nt, Human
ugccuguaaucccagcucuuug

SEQ ID NO: 120218 - RNA, 20 nt, Human
gcauugacuucacucccaag

SEQ ID NO: 120219 - RNA, 22 nt, Human
uguugcccugacuggaguucag

SEQ ID NO: 120220 - RNA, 19 nt, Human
uccaguuggaguuuuuugu

SEQ ID NO: 120221 - RNA, 24 nt, Human
auucugcccccaucccaacccagc

SEQ ID NO: 120222 - RNA, 27 nt, Human
uguucucccucccugccauuguggacu

SEQ ID NO: 120223 - RNA, 26 nt, Human
augaagccagagucuccaggacuccu

SEQ ID NO: 120224 - RNA, 28 nt, Human
uucugcaugauuucucugggcuugcugu

SEQ ID NO: 120225 - RNA, 29 nt, Human
cuucuccauagucuuuccccaccuggagc

SEQ ID NO: 120226 - RNA, 25 nt, Human
aagagccugauuuuagaauucacca

SEQ ID NO: 120227 - RNA, 22 nt, Human
acauauauauacacacguguau

SEQ ID NO: 120228 - RNA, 19 nt, Human
uggcuugagugauccuccc

SEQ ID NO: 120229 - RNA, 21 nt, Human
agcuuauagucauauauauca

SEQ ID NO: 120230 - RNA, 24 nt, Human
ccagucaaagauuccacugauuga

SEQ ID NO: 120231 - RNA, 21 nt, Human
gagcuuugguaaucucuguga

SEQ ID NO: 120232 - RNA, 26 nt, Human
uuuucauuccugcaaacacagugcuc

SEQ ID NO: 120233 - RNA, 23 nt, Human
cugucucucucuucucucuaggu

SEQ ID NO: 120234 - RNA, 23 nt, Human
ccuguaucagcaguccucaucau

SEQ ID NO: 120235 - RNA, 21 nt, Human
gggucccacagccacguguuu

SEQ ID NO: 120236 - RNA, 20 nt, Human
aaacccagaaccugaaucca

SEQ ID NO: 120237 - RNA, 22 nt, Human
ggaaaguuuacagaaacaguuu

SEQ ID NO: 120238 - RNA, 23 nt, Human
accuguaauccuugcauuuugga

SEQ ID NO: 120239 - RNA, 26 nt, Human
caggcuggagugcaguguugcagucc

SEQ ID NO: 120240 - RNA, 22 nt, Human
ggcaguuucaguccauaucaau

SEQ ID NO: 120241 - RNA, 25 nt, Human
ggucccuuucuccacugcacuggag

SEQ ID NO: 120242 - RNA, 25 nt, Human
cucuugggcuuuugaacuguauuug

SEQ ID NO: 120243 - RNA, 21 nt, Human
uagcacucagaucuucguguc

SEQ ID NO: 120244 - RNA, 22 nt, Human
cugcuguuuugcuauucuuaaa

SEQ ID NO: 120245 - RNA, 22 nt, Human
aagcuuccacgccaguugccuc

SEQ ID NO: 120246 - RNA, 21 nt, Human
agagagaaacuaccuaccuca

SEQ ID NO: 120247 - RNA, 22 nt, Human
gugggcagaucaccugagguca

SEQ ID NO: 120248 - RNA, 22 nt, Human
cgcccaggcuggagugcagugc

SEQ ID NO: 120249 - RNA, 24 nt, Human
gucagucuuucuuagugccugugu

SEQ ID NO: 120250 - RNA, 32 nt, Human
agcucauucccuuuuggcuuuuuccuuguuug

SEQ ID NO: 120251 - RNA, 26 nt, Human
gggagcaaagcgcugagggagcucgg

SEQ ID NO: 120252 - RNA, 22 nt, Human
cagugcacuccaggcuggacga

SEQ ID NO: 120253 - RNA, 21 nt, Human
uucaaugcuguugggaaccag

SEQ ID NO: 120254 - RNA, 23 nt, Human
ggcccccggccuccugcgcuccu

SEQ ID NO: 120255 - RNA, 23 nt, Human
cacaucucagacccuuuagccaa

SEQ ID NO: 120256 - RNA, 24 nt, Human
cgucuugcucuguucacagucucu

SEQ ID NO: 120257 - RNA, 26 nt, Human
cggagcccaccaugccgcgcccggcc

SEQ ID NO: 120258 - RNA, 27 nt, Human
uggcucacaccuguaauccuugcauuu

SEQ ID NO: 120259 - RNA, 27 nt, Human
cugagacugaaaggagcagaggcugga

SEQ ID NO: 120260 - RNA, 25 nt, Human
uggacccccucccucaccgcacaac

SEQ ID NO: 120261 - RNA, 26 nt, Human
gcugcacucugggggcuuggcauggc

SEQ ID NO: 120262 - RNA, 24 nt, Human
cugagaggugcgguccugggggug

SEQ ID NO: 120263 - RNA, 22 nt, Human
cuggauggaggcacucaggccu

SEQ ID NO: 120264 - RNA, 21 nt, Human
aaccuguuuucuggaugcucc

SEQ ID NO: 120265 - RNA, 18 nt, Human
auaaauucuguuagcugc

SEQ ID NO: 120266 - RNA, 19 nt, Human
uucauuuacaucucucuua

SEQ ID NO: 120267 - RNA, 26 nt, Human
ggcugguggagaaacaggagacaauc

SEQ ID NO: 120268 - RNA, 21 nt, Human
cucuauucccccucugccucu

SEQ ID NO: 120269 - RNA, 20 nt, Human
cuguuagcagaggauuggug

SEQ ID NO: 120270 - RNA, 20 nt, Human
uaggcaggaaaaucagucua

SEQ ID NO: 120271 - RNA, 19 nt, Human
ucagcuauuagaagagaaa

SEQ ID NO: 120272 - RNA, 19 nt, Human
gagauguuuuaccauccuu

SEQ ID NO: 120273 - RNA, 20 nt, Human
gcgaagccucggggcccaag

SEQ ID NO: 120274 - RNA, 19 nt, Human
gcacaggcugggcagaggc

SEQ ID NO: 120275 - RNA, 22 nt, Human
cccacaggaagccugcaguccu

SEQ ID NO: 120276 - RNA, 23 nt, Human
agcucaguucuagucucucuggg

SEQ ID NO: 120277 - RNA, 23 nt, Human
ugucugugggcuucagcacuuua

SEQ ID NO: 120278 - RNA, 21 nt, Human
augucaggaaccuauggcugg

SEQ ID NO: 120279 - RNA, 31 nt, Human
acugaccuugaauucagccuggguguucagg

SEQ ID NO: 120280 - RNA, 27 nt, Human
cucauuacauuaaaaaggaauuuuaga

SEQ ID NO: 120281 - RNA, 22 nt, Human
cugcaaccucugccccccgggu

SEQ ID NO: 120282 - RNA, 20 nt, Human
uguaauaagcacuugccugg

SEQ ID NO: 120283 - RNA, 26 nt, Human
ugagccaggcagcagagcacucgcug

SEQ ID NO: 120284 - RNA, 27 nt, Human
ugcuauacuuaucacauuuuauuaaac

SEQ ID NO: 120285 - RNA, 25 nt, Human
gggcgugcuagagguugcagcauga

SEQ ID NO: 120286 - RNA, 20 nt, Human
acuguggcuucauaacucua

SEQ ID NO: 120287 - RNA, 25 nt, Human
cagaugcuggaugugcugcaggagc

SEQ ID NO: 120288 - RNA, 26 nt, Human
ugcucacacauuuuacuguacuuucc

SEQ ID NO: 120289 - RNA, 24 nt, Human
cggaccgggagagagggggcgcgg

SEQ ID NO: 120290 - RNA, 27 nt, Human
caggcuggagugaaguggugugauccc

SEQ ID NO: 120291 - RNA, 24 nt, Human
uuccuccaccccaggaccaauaug

SEQ ID NO: 120292 - RNA, 26 nt, Human
ugggucgugcuccugccccacugugc

SEQ ID NO: 120293 - RNA, 22 nt, Human
gcuugagccaccgcaccuggcc

SEQ ID NO: 120294 - RNA, 26 nt, Human
ugcuucagucucccaaguagcuugga

SEQ ID NO: 120295 - RNA, 27 nt, Human
ucuccccugggcucggaggcggaagcu

SEQ ID NO: 120296 - RNA, 20 nt, Human
ugcccgucugcugaugugcc

SEQ ID NO: 120297 - RNA, 22 nt, Human
ccccacugcucauuuggauccc

SEQ ID NO: 120298 - RNA, 23 nt, Human
auguuuuaaugccagggccugcu

SEQ ID NO: 120299 - RNA, 21 nt, Human
auuaaauuaugcaugcuaaga

SEQ ID NO: 120300 - RNA, 24 nt, Human
acaccuaggucggagcacugucgu

SEQ ID NO: 120301 - RNA, 24 nt, Human
agaaaacuauggacugugcugcug

SEQ ID NO: 120302 - RNA, 22 nt, Human
cccaagcagcugggauuacagg

SEQ ID NO: 120303 - RNA, 17 nt, Human
cccccaacaggaauucu

SEQ ID NO: 120304 - RNA, 21 nt, Human
aaaccugccugucccaaacca

SEQ ID NO: 120305 - RNA, 28 nt, Human
ugugcuguaaaguuucuucuuuccagua

SEQ ID NO: 120306 - RNA, 22 nt, Human
uucugagaaaacuguacaagac

SEQ ID NO: 120307 - RNA, 25 nt, Human
gccucugccucccaaagugcuggga

SEQ ID NO: 120308 - RNA, 25 nt, Human
uggaucucuacagugccgcguauga

SEQ ID NO: 120309 - RNA, 20 nt, Human
gcucugaacaaaagcuuuuc

SEQ ID NO: 120310 - RNA, 21 nt, Human
acugcaaacccgccucccagg

SEQ ID NO: 120311 - RNA, 24 nt, Human
uaccaugagaugagaugaccacca

SEQ ID NO: 120312 - RNA, 27 nt, Human
ggagaggagcagaaagaaacugccagu

SEQ ID NO: 120313 - RNA, 25 nt, Human
ccgcuccaggaugggacugccgagu

SEQ ID NO: 120314 - RNA, 25 nt, Human
cguguccagaacacucugauucaca

SEQ ID NO: 120315 - RNA, 22 nt, Human
aauuauuuuaaacugugcucaa

SEQ ID NO: 120316 - RNA, 21 nt, Human
ccaaugucauaaugcacagag

SEQ ID NO: 120317 - RNA, 26 nt, Human
ccacucccuccaccaccacagcacac

SEQ ID NO: 120318 - RNA, 21 nt, Human
cccugcagggccaucugacug

SEQ ID NO: 120319 - RNA, 21 nt, Human
gggauuacaggcgugagcaau

SEQ ID NO: 120320 - RNA, 20 nt, Human
gccccaccuucuaucuaaga

SEQ ID NO: 120321 - RNA, 18 nt, Human
acacugugacacacuaca

SEQ ID NO: 120322 - RNA, 28 nt, Human
acgccgcugacugccacccacacgcccu

SEQ ID NO: 120323 - RNA, 20 nt, Human
ggucagaggaucccacuucc

SEQ ID NO: 120324 - RNA, 22 nt, Human
uggccagcauggugaaacccca

SEQ ID NO: 120325 - RNA, 21 nt, Human
uucugacccagggcugagaca

SEQ ID NO: 120326 - RNA, 26 nt, Human
aggguccuggcccucuucuuauucau

SEQ ID NO: 120327 - RNA, 26 nt, Human
acccggcaggcuuaucugucuugggc

SEQ ID NO: 120328 - RNA, 20 nt, Human
aagccaggcuuuugagcugu

SEQ ID NO: 120329 - RNA, 19 nt, Human
gagcacgugcauacaaucg

SEQ ID NO: 120330 - RNA, 21 nt, Human
gccaccaccuccuccuccucc

SEQ ID NO: 120331 - RNA, 21 nt, Human
ucauuuuucaaccuaaacagc

SEQ ID NO: 120332 - RNA, 27 nt, Human
gcugccaugucuggggcaucuuccuca

SEQ ID NO: 120333 - RNA, 20 nt, Human
uuccaauaaucccuuaauca

SEQ ID NO: 120334 - RNA, 20 nt, Human
ugggaggagucccaccagcc

SEQ ID NO: 120335 - RNA, 23 nt, Human
gcuacaauuuucucccaggaagc

SEQ ID NO: 120336 - RNA, 29 nt, Human
aggcagcuuuugagguugcaauccuacug

SEQ ID NO: 120337 - RNA, 18 nt, Human
aggaagagguuagacgca

SEQ ID NO: 120338 - RNA, 22 nt, Human
uaauaagcaugcauacuuuaac

SEQ ID NO: 120339 - RNA, 32 nt, Human
gagcagaagcugggugggcugaagaggccugg

SEQ ID NO: 120340 - RNA, 22 nt, Human
gcugcugcuuccaccgccccuu

SEQ ID NO: 120341 - RNA, 22 nt, Human
ucugucuucauugacaggauuu

SEQ ID NO: 120342 - RNA, 18 nt, Human
gcuguuauuaaugccuuu

SEQ ID NO: 120343 - RNA, 22 nt, Human
cuggaugaagcggcuuccccgc

SEQ ID NO: 120344 - RNA, 25 nt, Human
ggagagggacuggcagagcugaggc

SEQ ID NO: 120345 - RNA, 26 nt, Human
gcuucaucuucucccuguaacugaga

SEQ ID NO: 120346 - RNA, 23 nt, Human
cugugaagcucaggaaauccaaa

SEQ ID NO: 120347 - RNA, 20 nt, Human
cagugcccugagccaggguc

SEQ ID NO: 120348 - RNA, 22 nt, Human
ugggcuuuuaugauguuuuagg

SEQ ID NO: 120349 - RNA, 20 nt, Human
gcgagucucccuuagcgcca

SEQ ID NO: 120350 - RNA, 24 nt, Human
cccgggcaggucccgagagcuggg

SEQ ID NO: 120351 - RNA, 22 nt, Human
ucuccacccucaucucucugcg

SEQ ID NO: 120352 - RNA, 21 nt, Human
ggcagccucaaccucccuggc

SEQ ID NO: 120353 - RNA, 23 nt, Human
cggcgccucacugggcacggggc

SEQ ID NO: 120354 - RNA, 22 nt, Human
uccugcuccaguugcggucauc

SEQ ID NO: 120355 - RNA, 25 nt, Human
gcaguaagcacagaucgcacugccu

SEQ ID NO: 120356 - RNA, 23 nt, Human
cucuaauuaguacacuuguguuu

SEQ ID NO: 120357 - RNA, 27 nt, Human
cuggugcccgagccucucagggccaga

SEQ ID NO: 120358 - RNA, 22 nt, Human
auucagacuggaguggauagga

SEQ ID NO: 120359 - RNA, 22 nt, Human
gcgugagccaccacgcccaacu

SEQ ID NO: 120360 - RNA, 23 nt, Human
agagaggccuucuguggauggag

SEQ ID NO: 120361 - RNA, 23 nt, Human
ccagcagacucuggaggccugug

SEQ ID NO: 120362 - RNA, 22 nt, Human
aagacuccccugccuccucaag

SEQ ID NO: 120363 - RNA, 21 nt, Human
acuggguggaggggcagggag

SEQ ID NO: 120364 - RNA, 21 nt, Human
cuccaguuuuuauagaccuga

SEQ ID NO: 120365 - RNA, 21 nt, Human
gucuccaggcugugugcucag

SEQ ID NO: 120366 - RNA, 19 nt, Human
cagaucaggagagcaaggu

SEQ ID NO: 120367 - RNA, 21 nt, Human
uucaguuuuuguguuuuggga

SEQ ID NO: 120368 - RNA, 19 nt, Human
uguuuuaacucacucucau

SEQ ID NO: 120369 - RNA, 22 nt, Human
ggaagcccugacaugcugcagu

SEQ ID NO: 120370 - RNA, 20 nt, Human
ggcuaaauauucuuucugua

SEQ ID NO: 120371 - RNA, 23 nt, Human
ggucacugccugugauacauucc

SEQ ID NO: 120372 - RNA, 22 nt, Human
cuaccugcuuuccagagccuuu

SEQ ID NO: 120373 - RNA, 20 nt, Human
agccgggguacccucuagau

SEQ ID NO: 120374 - RNA, 22 nt, Human
cccagccuuuaccagcagcgua

SEQ ID NO: 120375 - RNA, 20 nt, Human
ccagcgcacagccugggcag

SEQ ID NO: 120376 - RNA, 22 nt, Human
uaucaaguaaaacaaacaaaua

SEQ ID NO: 120377 - RNA, 27 nt, Human
cccuucuccacugcccccuccuguguc

SEQ ID NO: 120378 - RNA, 19 nt, Human
cuguggcugugaugugggg

SEQ ID NO: 120379 - RNA, 23 nt, Human
cuccagugacaccacuguccuca

SEQ ID NO: 120380 - RNA, 29 nt, Human
agcugaguucauuucaucucucccuuuuu

SEQ ID NO: 120381 - RNA, 27 nt, Human
cugcaugauuucucugggcuugcuguc

SEQ ID NO: 120382 - RNA, 19 nt, Human
cucuccccucucccauuuu

SEQ ID NO: 120383 - RNA, 20 nt, Human
caagugucaccgcagcaaga

SEQ ID NO: 120384 - RNA, 27 nt, Human
guggccagggaugaaccuugcccagcc

SEQ ID NO: 120385 - RNA, 23 nt, Human
acuucccaaaagcuccaggauuu

SEQ ID NO: 120386 - RNA, 22 nt, Human
gacuacaggugugcaccaccac

SEQ ID NO: 120387 - RNA, 22 nt, Human
uucugcccuggggucccagggu

SEQ ID NO: 120388 - RNA, 20 nt, Human
ugagccacauggccaucugc

SEQ ID NO: 120389 - RNA, 21 nt, Human
uucuaugauccuuuuuuguca

SEQ ID NO: 120390 - RNA, 19 nt, Human
uugcccagaguuugggcca

SEQ ID NO: 120391 - RNA, 26 nt, Human
ugcuucucugcugaucugagucugcc

SEQ ID NO: 120392 - RNA, 18 nt, Human
cccacccccgugcccccu

SEQ ID NO: 120393 - RNA, 26 nt, Human
agaacuccaggaaacaugaauucugg

SEQ ID NO: 120394 - RNA, 22 nt, Human
ccaaugugaugaaaccccgucu

SEQ ID NO: 120395 - RNA, 22 nt, Human
uaagcucuuuuuaauggcuuca

SEQ ID NO: 120396 - RNA, 23 nt, Human
guguauuuuucccuugcuuuugg

SEQ ID NO: 120397 - RNA, 24 nt, Human
gcuguuucugugugugaggaacuu

SEQ ID NO: 120398 - RNA, 18 nt, Human
uucccaagccccuggcca

SEQ ID NO: 120399 - RNA, 23 nt, Human
gucacccagguucgaguucagug

SEQ ID NO: 120400 - RNA, 20 nt, Human
aaggagggagagcaggcagc

SEQ ID NO: 120401 - RNA, 19 nt, Human
ggugucaccuucccugaga

SEQ ID NO: 120402 - RNA, 22 nt, Human
cagcgagacuccgucucaagga

SEQ ID NO: 120403 - RNA, 23 nt, Human
cccgcacugggggcaauugacuu

SEQ ID NO: 120404 - RNA, 22 nt, Human
uguucacacuuuauuaccaagc

SEQ ID NO: 120405 - RNA, 22 nt, Human
ucugcaaauaucucccucucuc

SEQ ID NO: 120406 - RNA, 24 nt, Human
gcucugucucccugggugacaccc

SEQ ID NO: 120407 - RNA, 23 nt, Human
uagaacacagauacaagagaagc

SEQ ID NO: 120408 - RNA, 21 nt, Human
gucuguguccgcucagucccu

SEQ ID NO: 120409 - RNA, 27 nt, Human
ccagaagcuuuagagguaugaggcugc

SEQ ID NO: 120410 - RNA, 20 nt, Human
auguugcugaccucaucugg

SEQ ID NO: 120411 - RNA, 22 nt, Human
agaagcagcagcaaacauuugc

SEQ ID NO: 120412 - RNA, 27 nt, Human
ugcacacaggcagacauaccucccauc

SEQ ID NO: 120413 - RNA, 25 nt, Human
gccuuuauuuuucuaauuaaagaau

SEQ ID NO: 120414 - RNA, 20 nt, Human
caucaggcauuaaaugaaug

SEQ ID NO: 120415 - RNA, 23 nt, Human
uccuugggguggcuucagugggg

SEQ ID NO: 120416 - RNA, 25 nt, Human
cugcagccacaacuucucugguccu

SEQ ID NO: 120417 - RNA, 18 nt, Human
gugugugccaucaugccu

SEQ ID NO: 120418 - RNA, 28 nt, Human
auaucaaauuauuccuucaaguuuccua

SEQ ID NO: 120419 - RNA, 18 nt, Human
ggaaaauuaaaccaauga

SEQ ID NO: 120420 - RNA, 23 nt, Human
ggggaggagagagcagcuucugc

SEQ ID NO: 120421 - RNA, 20 nt, Human
ggcucagaaaggagaagggc

SEQ ID NO: 120422 - RNA, 21 nt, Human
ggcucacugcaacuucuaccu

SEQ ID NO: 120423 - RNA, 23 nt, Human
ccccgcccacccucgucgacgug

SEQ ID NO: 120424 - RNA, 23 nt, Human
uccucaaguuaguuauguuguag

SEQ ID NO: 120425 - RNA, 22 nt, Human
cgccguguuacuguugcacuga

SEQ ID NO: 120426 - RNA, 23 nt, Human
uuuguuuuggugucaaaauaaca

SEQ ID NO: 120427 - RNA, 21 nt, Human
uggacuuuuauuuuguuuuaa

SEQ ID NO: 120428 - RNA, 23 nt, Human
ucauugugacuuccugguagccc

SEQ ID NO: 120429 - RNA, 26 nt, Human
cuccaucuugaaggaacucaaagacu

SEQ ID NO: 120430 - RNA, 23 nt, Human
ggaucagggguaggaauggaagg

SEQ ID NO: 120431 - RNA, 26 nt, Human
aguugaaagcagaguguaacaaggga

SEQ ID NO: 120432 - RNA, 27 nt, Human
uucuacccuguuuguugugucuugcua

SEQ ID NO: 120433 - RNA, 27 nt, Human
gcuagauuugaaaacaacuaagcgcuc

SEQ ID NO: 120434 - RNA, 21 nt, Human
ugacuucuaaggggcgcggau

SEQ ID NO: 120435 - RNA, 27 nt, Human
cccuccagggauggcucugagcucucg

SEQ ID NO: 120436 - RNA, 21 nt, Human
uucugagugagaagauaaaaa

SEQ ID NO: 120437 - RNA, 23 nt, Human
ggaggcugguguccagggucuca

SEQ ID NO: 120438 - RNA, 24 nt, Human
uagggaggaaggauauuauaaagu

SEQ ID NO: 120439 - RNA, 22 nt, Human
ccaacauggugaaacuccgucu

SEQ ID NO: 120440 - RNA, 27 nt, Human
ucaagacgaagcuuauuucugaggaua

SEQ ID NO: 120441 - RNA, 27 nt, Human
gaauagcugggauuacagacaggcacc

SEQ ID NO: 120442 - RNA, 26 nt, Human
gcggcccagacguccagggagccggc

SEQ ID NO: 120443 - RNA, 27 nt, Human
uacuacuguuagcaccacuacuaauua

SEQ ID NO: 120444 - RNA, 20 nt, Human
gcugcugccucucuccuggg

SEQ ID NO: 120445 - RNA, 23 nt, Human
cuccaaggcuggagugcagugac

SEQ ID NO: 120446 - RNA, 30 nt, Human
agagacauggaagagagagccaugaagcau

SEQ ID NO: 120447 - RNA, 22 nt, Human
acacauuuuacucuagaggcau

SEQ ID NO: 120448 - RNA, 22 nt, Human
cccgagugucgguucacugugg

SEQ ID NO: 120449 - RNA, 23 nt, Human
cccaggcggcgaggagagcggug

SEQ ID NO: 120450 - RNA, 20 nt, Human
gcucacugagaacccagcuu

SEQ ID NO: 120451 - RNA, 23 nt, Human
cggcucaucaaacacacuccuuu

SEQ ID NO: 120452 - RNA, 20 nt, Human
auagcauguacaggcaguuu

SEQ ID NO: 120453 - RNA, 22 nt, Human
ccacaggcggagguugcggugg

SEQ ID NO: 120454 - RNA, 22 nt, Human
cuggggcgagaggauugcuuga

SEQ ID NO: 120455 - RNA, 22 nt, Human
ucucuguacugugccugccuca

SEQ ID NO: 120456 - RNA, 22 nt, Human
gugcacagaccugaccggccgg

SEQ ID NO: 120457 - RNA, 21 nt, Human
gacaugggccagguuuuucaa

SEQ ID NO: 120458 - RNA, 25 nt, Human
ggaugguuucuuggcuuuaagucca

SEQ ID NO: 120459 - RNA, 26 nt, Human
gggggaccagagguugaccacugugg

SEQ ID NO: 120460 - RNA, 20 nt, Human
agccaggcuggagugcagug

SEQ ID NO: 120461 - RNA, 27 nt, Human
ccauuaauaaagagaacugcuccuagc

SEQ ID NO: 120462 - RNA, 28 nt, Human
cuuucugcggggcaucaggcugcugggg

SEQ ID NO: 120463 - RNA, 19 nt, Human
ugcccugccuaccuucuga

SEQ ID NO: 120464 - RNA, 23 nt, Human
auagguauuguaaauggaagcgc

SEQ ID NO: 120465 - RNA, 28 nt, Human
ucucaaacuccugaccucaggugaucug

SEQ ID NO: 120466 - RNA, 22 nt, Human
guaugggagccaggaguccugg

SEQ ID NO: 120467 - RNA, 20 nt, Human
uauugccuuugcagugcuuu

SEQ ID NO: 120468 - RNA, 21 nt, Human
ccaugccaucccugccugugc

SEQ ID NO: 120469 - RNA, 23 nt, Human
cuugcucucuaacuucugagccc

SEQ ID NO: 120470 - RNA, 23 nt, Human
aacggaagggagaauaugacaga

SEQ ID NO: 120471 - RNA, 23 nt, Human
gucaaugagggacuucuuuuuaa

SEQ ID NO: 120472 - RNA, 18 nt, Human
caaggucggauucugggg

SEQ ID NO: 120473 - RNA, 24 nt, Human
aucuggguuacagccacagcagga

SEQ ID NO: 120474 - RNA, 21 nt, Human
aagcuuggcacuagagcccag

SEQ ID NO: 120475 - RNA, 20 nt, Human
cuggaggcugggaaguucaa

SEQ ID NO: 120476 - RNA, 25 nt, Human
caagcagauucguggucuuuuccuc

SEQ ID NO: 120477 - RNA, 23 nt, Human
cugcugcuucugggccugaugga

SEQ ID NO: 120478 - RNA, 22 nt, Human
auaauuucuacccauguuggga

SEQ ID NO: 120479 - RNA, 29 nt, Human
guuagcuauugguauuauugccauauaga

SEQ ID NO: 120480 - RNA, 24 nt, Human
caggaagagaagagccguguggcc

SEQ ID NO: 120481 - RNA, 22 nt, Human
gcccacugcagccuccaccucc

SEQ ID NO: 120482 - RNA, 22 nt, Human
gcucacugcagccuccacuucc

SEQ ID NO: 120483 - RNA, 24 nt, Human
ccucgaggacugauacugcaguga

SEQ ID NO: 120484 - RNA, 25 nt, Human
ucugguauacuuccuuacuuuuaag

SEQ ID NO: 120485 - RNA, 25 nt, Human
acucagggguucugaaaggcaguuu

SEQ ID NO: 120486 - RNA, 23 nt, Human
cugcacgccgguccacagacaca

SEQ ID NO: 120487 - RNA, 18 nt, Human
ucuccuccucuccauccc

SEQ ID NO: 120488 - RNA, 23 nt, Human
agucucuccccuuccugaaguga

SEQ ID NO: 120489 - RNA, 27 nt, Human
ugaccaacacggagaaaccccgucucu

SEQ ID NO: 120490 - RNA, 19 nt, Human
ccuaaauuuaaagguauuu

SEQ ID NO: 120491 - RNA, 27 nt, Human
uaaugguaaaacaacauacaucugcca

SEQ ID NO: 120492 - RNA, 24 nt, Human
uacauguauuauauacaagcacaa

SEQ ID NO: 120493 - RNA, 26 nt, Human
aaggcugugugcccacacagcaucag

SEQ ID NO: 120494 - RNA, 20 nt, Human
uuccaagcuacuaguguuaa

SEQ ID NO: 120495 - RNA, 24 nt, Human
uucucagacgucaggagagugaug

SEQ ID NO: 120496 - RNA, 25 nt, Human
uggccucucccugcaugucuuaagu

SEQ ID NO: 120497 - RNA, 22 nt, Human
cuggaagguggagcuugcagug

SEQ ID NO: 120498 - RNA, 23 nt, Human
ccuccagugcccaccugccucac

SEQ ID NO: 120499 - RNA, 23 nt, Human
cccccugucuucccucuggagcu

SEQ ID NO: 120500 - RNA, 20 nt, Human
gccccggcccugggcucgga

SEQ ID NO: 120501 - RNA, 24 nt, Human
gggaagggaaggaagcaagccggc

SEQ ID NO: 120502 - RNA, 20 nt, Human
ccacccccaaacacaaaaca

SEQ ID NO: 120503 - RNA, 25 nt, Human
ucacuuuuuaaauggagaaaauuuc

SEQ ID NO: 120504 - RNA, 24 nt, Human
ucugugccuuccaucaugauuucc

SEQ ID NO: 120505 - RNA, 22 nt, Human
aaccuguuuuguuuuucgcuuu

SEQ ID NO: 120506 - RNA, 24 nt, Human
ugggaccacagagaaaugucagag

SEQ ID NO: 120507 - RNA, 20 nt, Human
uagcuaguucccaaagugau

SEQ ID NO: 120508 - RNA, 27 nt, Human
ucuguucugcucccagaugccuucuag

SEQ ID NO: 120509 - RNA, 28 nt, Human
gggccucuggggcaggaagcuugucacu

SEQ ID NO: 120510 - RNA, 24 nt, Human
agaggaaggaucagagggucgcgg

SEQ ID NO: 120511 - RNA, 29 nt, Human
cugccuccuguuccagcuccugcugcugc

SEQ ID NO: 120512 - RNA, 21 nt, Human
ggagggugaacgcugugggca

SEQ ID NO: 120513 - RNA, 27 nt, Human
guuccuuaaaauuaaguugaaaaagga

SEQ ID NO: 120514 - RNA, 21 nt, Human
cucaaaguuugaagucagugg

SEQ ID NO: 120515 - RNA, 22 nt, Human
cccagcugacaguccucuccac

SEQ ID NO: 120516 - RNA, 22 nt, Human
agaaauguugccauucuuggaa

SEQ ID NO: 120517 - RNA, 20 nt, Human
aguugguuucuguuuuuugu

SEQ ID NO: 120518 - RNA, 27 nt, Human
acugcaaccuccgccuucccagauuca

SEQ ID NO: 120519 - RNA, 23 nt, Human
ugccuguagucccagcuacuugg

SEQ ID NO: 120520 - RNA, 23 nt, Human
ggucggucgguuuaccacuggac

SEQ ID NO: 120521 - RNA, 21 nt, Human
ucaucagaaaguccucccuga

SEQ ID NO: 120522 - RNA, 22 nt, Human
gccuuuaaucccaacacuuugg

SEQ ID NO: 120523 - RNA, 28 nt, Human
ucccaucggggcugugcuggggcuuggg

SEQ ID NO: 120524 - RNA, 22 nt, Human
ucccaggcuggagugcaauggu

SEQ ID NO: 120525 - RNA, 22 nt, Human
ggcucacugcaaccuucaccuc

SEQ ID NO: 120526 - RNA, 22 nt, Human
gacucacugcaaccuucgccuc

SEQ ID NO: 120527 - RNA, 20 nt, Human
gccagucugaaauccugggc

SEQ ID NO: 120528 - RNA, 20 nt, Human
ucucagccugggcucccagc

SEQ ID NO: 120529 - RNA, 19 nt, Human
guaacaucauugccauucc

SEQ ID NO: 120530 - RNA, 23 nt, Human
gucuccuccucccgcugaacacg

SEQ ID NO: 120531 - RNA, 23 nt, Human
uugguuccuguguuuuauaucga

SEQ ID NO: 120532 - RNA, 24 nt, Human
ucgagccaacaggagaacuuucug

SEQ ID NO: 120533 - RNA, 25 nt, Human
cuucgagcucaucaugagaugccaa

SEQ ID NO: 120534 - RNA, 24 nt, Human
cucaaucuuugccuaauccaauga

SEQ ID NO: 120535 - RNA, 23 nt, Human
gaaguggccuccuggggggccag

SEQ ID NO: 120536 - RNA, 20 nt, Human
ucagcucugguagguuccag

SEQ ID NO: 120537 - RNA, 26 nt, Human
cccuccagacucugggagaggcuggu

SEQ ID NO: 120538 - RNA, 21 nt, Human
ggccucgggccacccacgagg

SEQ ID NO: 120539 - RNA, 23 nt, Human
aucuuuuaaauuggaaugcagua

SEQ ID NO: 120540 - RNA, 21 nt, Human
auuuggcuuauauucuaaguc

SEQ ID NO: 120541 - RNA, 21 nt, Human
cuucccaaaucugucucccca

SEQ ID NO: 120542 - RNA, 22 nt, Human
cucugccagcuggaagugcuug

SEQ ID NO: 120543 - RNA, 22 nt, Human
agccuccuucuuucaccccuua

SEQ ID NO: 120544 - RNA, 27 nt, Human
acugccucugugugccccuuugcgucc

SEQ ID NO: 120545 - RNA, 22 nt, Human
ucacauauacaccagacugaga

SEQ ID NO: 120546 - RNA, 23 nt, Human
gccuguauucccagcuacucagg

SEQ ID NO: 120547 - RNA, 23 nt, Human
cccggccuggccagggcggagcg

SEQ ID NO: 120548 - RNA, 23 nt, Human
ccuacuuccugucccacugccac

SEQ ID NO: 120549 - RNA, 27 nt, Human
ccuccuuccugugauugcucccuccug

SEQ ID NO: 120550 - RNA, 21 nt, Human
ucaucucgcucggcugcggga

SEQ ID NO: 120551 - RNA, 26 nt, Human
cccaccaggaaccugcuuuagugggg

SEQ ID NO: 120552 - RNA, 21 nt, Human
agauccaaaccaaggaggaaa

SEQ ID NO: 120553 - RNA, 21 nt, Human
ggcucagagcggaggggagac

SEQ ID NO: 120554 - RNA, 22 nt, Human
ccacugcacugcagccugggcg

SEQ ID NO: 120555 - RNA, 27 nt, Human
gaccagccggccagcgggagcccccuu

SEQ ID NO: 120556 - RNA, 23 nt, Human
gccugaaacccacuccuccaucu

SEQ ID NO: 120557 - RNA, 20 nt, Human
cuccaagggcuucccgucgg

SEQ ID NO: 120558 - RNA, 23 nt, Human
agcaagcccagcccagccucggc

SEQ ID NO: 120559 - RNA, 26 nt, Human
uacaucuucugcugguguuuuguuca

SEQ ID NO: 120560 - RNA, 21 nt, Human
uuuaaaaaauuguuugcuuga

SEQ ID NO: 120561 - RNA, 21 nt, Human
caacauagugaacccugucug

SEQ ID NO: 120562 - RNA, 22 nt, Human
gagggggagcgucucaaagaag

SEQ ID NO: 120563 - RNA, 21 nt, Human
gccuguaauccuagcacuuug

SEQ ID NO: 120564 - RNA, 21 nt, Human
aguacacuuuaaaauauuuua

SEQ ID NO: 120565 - RNA, 19 nt, Human
cauuuccugggaggggaga

SEQ ID NO: 120566 - RNA, 20 nt, Human
gucgcagcuacccucagccu

SEQ ID NO: 120567 - RNA, 27 nt, Human
caguuaaucuugcuuucuuuguuuggc

SEQ ID NO: 120568 - RNA, 24 nt, Human
gagacucaggcugauacaccagcu

SEQ ID NO: 120569 - RNA, 21 nt, Human
cucuggacuugccuccagaga

SEQ ID NO: 120570 - RNA, 25 nt, Human
guacccuccuuccucacuacaguca

SEQ ID NO: 120571 - RNA, 21 nt, Human
uauugucacugcccuguuuuu

SEQ ID NO: 120572 - RNA, 25 nt, Human
gcacgacuuuggcugggauuggcag

SEQ ID NO: 120573 - RNA, 22 nt, Human
uuggaccuugugccuccugugg

SEQ ID NO: 120574 - RNA, 24 nt, Human
cgagcgggcucccuggggagccag

SEQ ID NO: 120575 - RNA, 25 nt, Human
agaauguugauuacagugcagugcg

SEQ ID NO: 120576 - RNA, 27 nt, Human
aggccagagaugggccuccuucccugg

SEQ ID NO: 120577 - RNA, 21 nt, Human
cccuguucuccagccuaggug

SEQ ID NO: 120578 - RNA, 27 nt, Human
uuccaauaaaauacagugacuaccuga

SEQ ID NO: 120579 - RNA, 22 nt, Human
cgcccgcaucagcucagcccgc

SEQ ID NO: 120580 - RNA, 27 nt, Human
cagccucuucuguuauguuuugucuug

SEQ ID NO: 120581 - RNA, 21 nt, Human
ccccagccacagucugaggag

SEQ ID NO: 120582 - RNA, 22 nt, Human
gacacaauuggaauugucuuua

SEQ ID NO: 120583 - RNA, 23 nt, Human
gcagacaccauguacggauuugu

SEQ ID NO: 120584 - RNA, 23 nt, Human
auguguaacauucaaaugugugc

SEQ ID NO: 120585 - RNA, 23 nt, Human
aaaaacugaagaacauugaugag

SEQ ID NO: 120586 - RNA, 21 nt, Human
gguuuauucacugaacucuag

SEQ ID NO: 120587 - RNA, 24 nt, Human
acguagacacaccuggcugccuuc

SEQ ID NO: 120588 - RNA, 22 nt, Human
ugcccaagcuggagugcaaugg

SEQ ID NO: 120589 - RNA, 22 nt, Human
agauguaccucuguuacucuca

SEQ ID NO: 120590 - RNA, 25 nt, Human
ucucacuucuucuucuagaaucccc

SEQ ID NO: 120591 - RNA, 22 nt, Human
uuacccaggcuggucuucaacu

SEQ ID NO: 120592 - RNA, 22 nt, Human
cgccauuucacuccagccuggg

SEQ ID NO: 120593 - RNA, 23 nt, Human
cagauggcuucccauaucccaga

SEQ ID NO: 120594 - RNA, 21 nt, Human
acucagaacaugaaccucuuu

SEQ ID NO: 120595 - RNA, 23 nt, Human
caagcucagggugcucccuccuc

SEQ ID NO: 120596 - RNA, 21 nt, Human
cccagcccccacacuccacca

SEQ ID NO: 120597 - RNA, 22 nt, Human
cuccccacucucaucaggccaa

SEQ ID NO: 120598 - RNA, 27 nt, Human
cucuccaggaaggcagugaggggcugu

SEQ ID NO: 120599 - RNA, 22 nt, Human
ucccacuuuuggcuuuccugga

SEQ ID NO: 120600 - RNA, 25 nt, Human
uagagcuuccgagaauagcuccacu

SEQ ID NO: 120601 - RNA, 28 nt, Human
gcaggugacaaucucuguggauggcauu

SEQ ID NO: 120602 - RNA, 23 nt, Human
gacuccccgcacuccccaaaaag

SEQ ID NO: 120603 - RNA, 20 nt, Human
cugagaacguaaaacugagg

SEQ ID NO: 120604 - RNA, 27 nt, Human
uacccagcaucuggaguacaggacaua

SEQ ID NO: 120605 - RNA, 22 nt, Human
acccaggccagcugauucauca

SEQ ID NO: 120606 - RNA, 23 nt, Human
ucgggacaggcuaaccaggagga

SEQ ID NO: 120607 - RNA, 27 nt, Human
gcuagugcuuucuaugggagucaaaau

SEQ ID NO: 120608 - RNA, 21 nt, Human
ucauuuuuugcaucaguauua

SEQ ID NO: 120609 - RNA, 22 nt, Human
cccuccaaacagagcaacaaca

SEQ ID NO: 120610 - RNA, 19 nt, Human
uucugaacuccauuuugga

SEQ ID NO: 120611 - RNA, 22 nt, Human
aucaagcuuucuguguauugga

SEQ ID NO: 120612 - RNA, 21 nt, Human
aucaaguucuguguaaugagg

SEQ ID NO: 120613 - RNA, 22 nt, Human
cugaccuuugggcuuucuuuuc

SEQ ID NO: 120614 - RNA, 21 nt, Human
aggugagugcccgaagccagg

SEQ ID NO: 120615 - RNA, 22 nt, Human
ccugcccucggacgcuccugga

SEQ ID NO: 120616 - RNA, 22 nt, Human
gauaugaguucuucguacugga

SEQ ID NO: 120617 - RNA, 24 nt, Human
aaugugugcagguuaugugcugcu

SEQ ID NO: 120618 - RNA, 24 nt, Human
cugccaggcugggguguuuucggu

SEQ ID NO: 120619 - RNA, 20 nt, Human
uccaaaaccuuccucuucca

SEQ ID NO: 120620 - RNA, 22 nt, Human
guuuuuaaauauauauuuugua

SEQ ID NO: 120621 - RNA, 27 nt, Human
cuccucuugauuccugguuugacucag

SEQ ID NO: 120622 - RNA, 20 nt, Human
cagcaucuaaccuuuuacuu

SEQ ID NO: 120623 - RNA, 18 nt, Human
uuucaggacuuguuuuuu

SEQ ID NO: 120624 - RNA, 23 nt, Human
ccaguuucaaacuccugaccuca

SEQ ID NO: 120625 - RNA, 25 nt, Human
aggagcagagggcaggggugcugug

SEQ ID NO: 120626 - RNA, 20 nt, Human
ggaaggcagcccuggagugg

SEQ ID NO: 120627 - RNA, 24 nt, Human
cacacacagacuguugucccugca

SEQ ID NO: 120628 - RNA, 20 nt, Human
aaacucaacacaauuguaag

SEQ ID NO: 120629 - RNA, 24 nt, Human
gggagccugguuggaagcugcagg

SEQ ID NO: 120630 - RNA, 22 nt, Human
ggcucuuccugcacugcccuca

SEQ ID NO: 120631 - RNA, 23 nt, Human
ggugcugcugcuggaggagaggc

SEQ ID NO: 120632 - RNA, 22 nt, Human
gcguagcagcuaugcagcuuga

SEQ ID NO: 120633 - RNA, 26 nt, Human
cccuccacagccgcagccucccucug

SEQ ID NO: 120634 - RNA, 21 nt, Human
gggguggcagggccuggugug

SEQ ID NO: 120635 - RNA, 31 nt, Human
ggagucugaggcagaggauggcaugugccag

SEQ ID NO: 120636 - RNA, 21 nt, Human
ccuacuuccuacagaugcauc

SEQ ID NO: 120637 - RNA, 23 nt, Human
uuuccuuccaucggaaccguucu

SEQ ID NO: 120638 - RNA, 22 nt, Human
gguuauuuggaaaguguguauu

SEQ ID NO: 120639 - RNA, 19 nt, Human
aagaguuuuccuguaagua

SEQ ID NO: 120640 - RNA, 23 nt, Human
agagaggcagccugggcagucug

SEQ ID NO: 120641 - RNA, 24 nt, Human
ugcugccuacaccuccaccuccuu

SEQ ID NO: 120642 - RNA, 20 nt, Human
gagccugggggcaggugcca

SEQ ID NO: 120643 - RNA, 21 nt, Human
ggugucuagcauuaacuuauu

SEQ ID NO: 120644 - RNA, 17 nt, Human
guggcaaaauggagguu

SEQ ID NO: 120645 - RNA, 20 nt, Human
ggucucacccccuaaccuca

SEQ ID NO: 120646 - RNA, 24 nt, Human
aagaugcacugaaaacuuagccag

SEQ ID NO: 120647 - RNA, 27 nt, Human
guaaucacuuuuaacacugcuaauaga

SEQ ID NO: 120648 - RNA, 18 nt, Human
ucagcaacaaccaucuca

SEQ ID NO: 120649 - RNA, 19 nt, Human
uuuaaaacaaaaaccacag

SEQ ID NO: 120650 - RNA, 25 nt, Human
caccgcugccucagccucugccucc

SEQ ID NO: 120651 - RNA, 27 nt, Human
caggcuccuguuagacaaacacauuga

SEQ ID NO: 120652 - RNA, 25 nt, Human
uccuacugaguguaccacugccuuc

SEQ ID NO: 120653 - RNA, 22 nt, Human
augugggagcuucuuccgcucu

SEQ ID NO: 120654 - RNA, 23 nt, Human
ugaaggaaacuggggagucuuga

SEQ ID NO: 120655 - RNA, 22 nt, Human
gugguagaaacaaacuccauua

SEQ ID NO: 120656 - RNA, 20 nt, Human
guuucuuuuuguuucacugg

SEQ ID NO: 120657 - RNA, 25 nt, Human
gaauguuuguuccuggaaaggcugg

SEQ ID NO: 120658 - RNA, 26 nt, Human
cccugcgacucccuguuuccugggcu

SEQ ID NO: 120659 - RNA, 27 nt, Human
ggcucacgccuguaauuccagcauguu

SEQ ID NO: 120660 - RNA, 21 nt, Human
ugggcagccugccuggcccgc

SEQ ID NO: 120661 - RNA, 25 nt, Human
gaccuguuuuccuuugucuuauaua

SEQ ID NO: 120662 - RNA, 21 nt, Human
guguccuucgaggaacccacc

SEQ ID NO: 120663 - RNA, 23 nt, Human
ggaaacuccuuagagagcauuuu

SEQ ID NO: 120664 - RNA, 22 nt, Human
cccagcuggacagauggcuucc

SEQ ID NO: 120665 - RNA, 22 nt, Human
gcuaccaaagagacaaagcuuu

SEQ ID NO: 120666 - RNA, 23 nt, Human
caggguuagcaaaaagagccugg

SEQ ID NO: 120667 - RNA, 22 nt, Human
gugacuccuucccaguggccaa

SEQ ID NO: 120668 - RNA, 27 nt, Human
ucagcggguguaaacagccucugcggu

SEQ ID NO: 120669 - RNA, 21 nt, Human
cacagccguguaugcucccag

SEQ ID NO: 120670 - RNA, 23 nt, Human
ugcuucuucaauggcaccuucau

SEQ ID NO: 120671 - RNA, 19 nt, Human
augaagggaagugcaucug

SEQ ID NO: 120672 - RNA, 24 nt, Human
cucugccaguguccccagcacuuu

SEQ ID NO: 120673 - RNA, 25 nt, Human
gcuuuuuaucgcuaaaugacuugca

SEQ ID NO: 120674 - RNA, 26 nt, Human
acugacuuuuuaaaccauuguggacu

SEQ ID NO: 120675 - RNA, 26 nt, Human
aggagaacuaauagacacaggaguga

SEQ ID NO: 120676 - RNA, 31 nt, Human
guuuuuccaaccuauuuaauagacauuaaag

SEQ ID NO: 120677 - RNA, 20 nt, Human
cuuucaucuguaagggacua

SEQ ID NO: 120678 - RNA, 24 nt, Human
ggugcauggcuguggagcucaggg

SEQ ID NO: 120679 - RNA, 22 nt, Human
ccaggaggucaaggcuucagug

SEQ ID NO: 120680 - RNA, 27 nt, Human
ucccucuggauaacaacaaaagcaagc

SEQ ID NO: 120681 - RNA, 20 nt, Human
aguaguuugggcagugccuu

SEQ ID NO: 120682 - RNA, 21 nt, Human
ccuggugcugcccaccuuccc

SEQ ID NO: 120683 - RNA, 22 nt, Human
cuagaucaaggagcccagaaaa

SEQ ID NO: 120684 - RNA, 21 nt, Human
agcagccuggccaacauagug

SEQ ID NO: 120685 - RNA, 23 nt, Human
ccacgcguccgccagccuagcag

SEQ ID NO: 120686 - RNA, 21 nt, Human
ggagaaacugaagaggaaaga

SEQ ID NO: 120687 - RNA, 24 nt, Human
aagugauccuaaaagguagccucu

SEQ ID NO: 120688 - RNA, 22 nt, Human
auugcuugagcucgggaguuug

SEQ ID NO: 120689 - RNA, 21 nt, Human
aggacaaacaccgacguaggg

SEQ ID NO: 120690 - RNA, 23 nt, Human
auguuacacuggcugguguugaa

SEQ ID NO: 120691 - RNA, 20 nt, Human
cguccgccuccucgacccua

SEQ ID NO: 120692 - RNA, 21 nt, Human
guccuugccuguagauauuuu

SEQ ID NO: 120693 - RNA, 20 nt, Human
ucucucugcuccuucacugc

SEQ ID NO: 120694 - RNA, 20 nt, Human
aacucugcuuccuuggacag

SEQ ID NO: 120695 - RNA, 25 nt, Human
uuauuuaaaaagaauggauaaaugc

SEQ ID NO: 120696 - RNA, 27 nt, Human
uucuccucuauuggaagcuaauuagcc

SEQ ID NO: 120697 - RNA, 22 nt, Human
uaugacucgcgcacagcucugc

SEQ ID NO: 120698 - RNA, 20 nt, Human
aggcagcccacagugcugca

SEQ ID NO: 120699 - RNA, 26 nt, Human
ucuccagcuucagcucaacucacagc

SEQ ID NO: 120700 - RNA, 24 nt, Human
ggcacgagacccgggcaggcaucg

SEQ ID NO: 120701 - RNA, 22 nt, Human
caccaccucuuugggccuggcu

SEQ ID NO: 120702 - RNA, 25 nt, Human
ccauugauuuuugagacucaugcau

SEQ ID NO: 120703 - RNA, 22 nt, Human
cagcaccugcccuguguuuugu

SEQ ID NO: 120704 - RNA, 21 nt, Human
gugugugcaguggccccccgg

SEQ ID NO: 120705 - RNA, 23 nt, Human
gagcaagcucauuuccagaaaag

SEQ ID NO: 120706 - RNA, 20 nt, Human
agcccaaagauuagcuucau

SEQ ID NO: 120707 - RNA, 20 nt, Human
agaaaacacuacagugguuu

SEQ ID NO: 120708 - RNA, 22 nt, Human
ugaccuccuaggcucaagcgau

SEQ ID NO: 120709 - RNA, 22 nt, Human
uaaacuccuggccucaagcaau

SEQ ID NO: 120710 - RNA, 23 nt, Human
caucugcugucuuuucuuugcca

SEQ ID NO: 120711 - RNA, 26 nt, Human
gcgcuugaaggggcucagguuggguu

SEQ ID NO: 120712 - RNA, 20 nt, Human
cuccaugagggcagggaccg

SEQ ID NO: 120713 - RNA, 22 nt, Human
ggccuccucacccacccugugg

SEQ ID NO: 120714 - RNA, 26 nt, Human
gggugaggacggggacggggcguguc

SEQ ID NO: 120715 - RNA, 27 nt, Human
cucacugauggacaaggaggucugugc

SEQ ID NO: 120716 - RNA, 24 nt, Human
ugggguggggaugggagaugggau

SEQ ID NO: 120717 - RNA, 23 nt, Human
uaucugucuacuuucucuuguuu

SEQ ID NO: 120718 - RNA, 23 nt, Human
ugucagccagacuggacaggcaa

SEQ ID NO: 120719 - RNA, 28 nt, Human
ucuccgcaccucuccagcuccugcaccc

SEQ ID NO: 120720 - RNA, 32 nt, Human
gaggcaggauggucuccagacaccuucuugca

SEQ ID NO: 120721 - RNA, 20 nt, Human
guccuccggggugggugggu

SEQ ID NO: 120722 - RNA, 20 nt, Human
cucugccaugcacgcaccuc

SEQ ID NO: 120723 - RNA, 23 nt, Human
ggagaucuucuguucaaaguaca

SEQ ID NO: 120724 - RNA, 19 nt, Human
uuuggaauaaagucacaga

SEQ ID NO: 120725 - RNA, 27 nt, Human
cacuacacuccagccuggcgacagagc

SEQ ID NO: 120726 - RNA, 28 nt, Human
ucacauguuuucaaauggaguuggaguu

SEQ ID NO: 120727 - RNA, 24 nt, Human
uucuccguucucucucauuauucc

SEQ ID NO: 120728 - RNA, 26 nt, Human
ucaccuugcccuggugucuuuuucca

SEQ ID NO: 120729 - RNA, 23 nt, Human
ugggaacacugguggaggaugga

SEQ ID NO: 120730 - RNA, 18 nt, Human
uuucccuuauuacugcuu

SEQ ID NO: 120731 - RNA, 19 nt, Human
uagcucucagaaaagucug

SEQ ID NO: 120732 - RNA, 22 nt, Human
agccccucaaguagcugggacu

SEQ ID NO: 120733 - RNA, 27 nt, Human
gauucacugcaucauagcuaugccugu

SEQ ID NO: 120734 - RNA, 21 nt, Human
cagaucccuggauugcuggga

SEQ ID NO: 120735 - RNA, 22 nt, Human
accugcaaucccagcacuuugg

SEQ ID NO: 120736 - RNA, 23 nt, Human
agcccccucccugcugugguccu

SEQ ID NO: 120737 - RNA, 30 nt, Human
ggccccugcgcccuuccugggaucacuccg

SEQ ID NO: 120738 - RNA, 23 nt, Human
gggguccgucuucacacugcgca

SEQ ID NO: 120739 - RNA, 22 nt, Human
augccugugggccucucuggca

SEQ ID NO: 120740 - RNA, 25 nt, Human
gggcgcaagggugggagggagccgc

SEQ ID NO: 120741 - RNA, 21 nt, Human
uagugccucaugaauaaaguu

SEQ ID NO: 120742 - RNA, 21 nt, Human
gagccccgcagcauggaguac

SEQ ID NO: 120743 - RNA, 21 nt, Human
ggcccaggcugaagcucaggg

SEQ ID NO: 120744 - RNA, 25 nt, Human
gggaggugccaguuacagcagguga

SEQ ID NO: 120745 - RNA, 22 nt, Human
agcugggaaaagggaggcagag

SEQ ID NO: 120746 - RNA, 27 nt, Human
cccugcagcuagcaagucuuguguuua

SEQ ID NO: 120747 - RNA, 19 nt, Human
ucccgugugccaccaggag

SEQ ID NO: 120748 - RNA, 24 nt, Human
ugugguuuuccuaacugucugacu

SEQ ID NO: 120749 - RNA, 23 nt, Human
aaaaagaguuucgcuagcagcgc

SEQ ID NO: 120750 - RNA, 21 nt, Human
guccagaguuggugcuguggg

SEQ ID NO: 120751 - RNA, 23 nt, Human
cugaguauuuuucuaaucugacc

SEQ ID NO: 120752 - RNA, 20 nt, Human
uggagccaccaugcccagcu

SEQ ID NO: 120753 - RNA, 27 nt, Human
gugccugcaaccuucgccgcugccuuc

SEQ ID NO: 120754 - RNA, 23 nt, Human
caucuugucaucuuccagaaaac

SEQ ID NO: 120755 - RNA, 20 nt, Human
ugcccaggcuggcgugcagu

SEQ ID NO: 120756 - RNA, 16 nt, Human
agggcagcagcauuga

SEQ ID NO: 120757 - RNA, 24 nt, Human
caacaaauuuuuccagcaagcuga

SEQ ID NO: 120758 - RNA, 27 nt, Human
cgggaagggaaaugacuuguucuaauu

SEQ ID NO: 120759 - RNA, 22 nt, Human
aggaggcagaggguugcaguga

SEQ ID NO: 120760 - RNA, 24 nt, Human
gaaagagacacggucccccuggcu

SEQ ID NO: 120761 - RNA, 23 nt, Human
gguuagggucaagggugccuggg

SEQ ID NO: 120762 - RNA, 22 nt, Human
acacgagggccgcggugcagug

SEQ ID NO: 120763 - RNA, 23 nt, Human
gucuugaacuccugaccuuguga

SEQ ID NO: 120764 - RNA, 21 nt, Human
ugauauuauaucauggcauuu

SEQ ID NO: 120765 - RNA, 29 nt, Human
cacuucuccucucugggccuuggcuuggg

SEQ ID NO: 120766 - RNA, 22 nt, Human
cugaccaaggagaaugacuaca

SEQ ID NO: 120767 - RNA, 21 nt, Human
ggcaagggcuuuguguugcuu

SEQ ID NO: 120768 - RNA, 23 nt, Human
ucuugaggggaccaggagugggu

SEQ ID NO: 120769 - RNA, 22 nt, Human
gcaaaguucuucuagaauucca

SEQ ID NO: 120770 - RNA, 23 nt, Human
caauuauaccuucuguaacagug

SEQ ID NO: 120771 - RNA, 20 nt, Human
ggccaggccacaugacccca

SEQ ID NO: 120772 - RNA, 21 nt, Human
ccagggcuuagcagggccugg

SEQ ID NO: 120773 - RNA, 22 nt, Human
ugucuuuucuuuuucuuucuuu

SEQ ID NO: 120774 - RNA, 21 nt, Human
augauaaaguuccauaaauga

SEQ ID NO: 120775 - RNA, 24 nt, Human
cuuugccaccucuccauuuuugcc

SEQ ID NO: 120776 - RNA, 27 nt, Human
gcaccuugcaggcagccuucugaucag

SEQ ID NO: 120777 - RNA, 19 nt, Human
cagagugaccagaaacccu

SEQ ID NO: 120778 - RNA, 26 nt, Human
cuuugcucuccuugcgggugguugcc

SEQ ID NO: 120779 - RNA, 25 nt, Human
uuccucgggauuggcggguccacuu

SEQ ID NO: 120780 - RNA, 20 nt, Human
agcccaaaaaucaaucuuau

SEQ ID NO: 120781 - RNA, 21 nt, Human
gucuguaaucccagcacuuug

SEQ ID NO: 120782 - RNA, 21 nt, Human
gccuguaauuccagcacuuug

SEQ ID NO: 120783 - RNA, 23 nt, Human
gggcuguagcagagaggcuaguc

SEQ ID NO: 120784 - RNA, 23 nt, Human
gagccggccggggcugaauggag

SEQ ID NO: 120785 - RNA, 22 nt, Human
cuagagcaaggcccaccagguc

SEQ ID NO: 120786 - RNA, 20 nt, Human
ccuuccaccauaugaggacg

SEQ ID NO: 120787 - RNA, 21 nt, Human
gccugaggcaggguggucagg

SEQ ID NO: 120788 - RNA, 27 nt, Human
gacacagccccuauuuggaacccugau

SEQ ID NO: 120789 - RNA, 22 nt, Human
ucagauugcugaagugcugcug

SEQ ID NO: 120790 - RNA, 20 nt, Human
gggcuucaccagucugucua

SEQ ID NO: 120791 - RNA, 20 nt, Human
cguguucugcagcccagccu

SEQ ID NO: 120792 - RNA, 23 nt, Human
uugcccaaggugagccagcccug

SEQ ID NO: 120793 - RNA, 22 nt, Human
uagcccaggcaggagggagcgc

SEQ ID NO: 120794 - RNA, 24 nt, Human
cccagcuaauggauuaaaaaacug

SEQ ID NO: 120795 - RNA, 26 nt, Human
gacuccugucuuuuacccuccccucg

SEQ ID NO: 120796 - RNA, 26 nt, Human
accuacucugucaggcacugucauag

SEQ ID NO: 120797 - RNA, 24 nt, Human
gaguuugauacuauuaaaauaagc

SEQ ID NO: 120798 - RNA, 23 nt, Human
agccccaucugccacguguauuu

SEQ ID NO: 120799 - RNA, 25 nt, Human
cuguuucuccuccugcaccuguguc

SEQ ID NO: 120800 - RNA, 27 nt, Human
accaggauaagugacaccuaggaccca

SEQ ID NO: 120801 - RNA, 22 nt, Human
agcaucccaaagugcugggauu

SEQ ID NO: 120802 - RNA, 21 nt, Human
ccaaagugcuggauuacaggc

SEQ ID NO: 120803 - RNA, 21 nt, Human
cugcuguaacgagcgggcucg

SEQ ID NO: 120804 - RNA, 22 nt, Human
uuuccccucagcuuacaguucc

SEQ ID NO: 120805 - RNA, 22 nt, Human
aggcuggagugcaauggcgcaa

SEQ ID NO: 120806 - RNA, 22 nt, Human
aggcuggagugcaguggcgcag

SEQ ID NO: 120807 - RNA, 22 nt, Human
aggaaaggaagugggacuggca

SEQ ID NO: 120808 - RNA, 24 nt, Human
gaccggccaucuaaaaaucugcca

SEQ ID NO: 120809 - RNA, 28 nt, Human
ugugauuccguccugcgcgguuguucuc

SEQ ID NO: 120810 - RNA, 23 nt, Human
guugccaaggcuggagugcaggc

SEQ ID NO: 120811 - RNA, 22 nt, Human
aggcuggagugcaguggcucaa

SEQ ID NO: 120812 - RNA, 27 nt, Human
cugggcugccggguucuagucuccuuu

SEQ ID NO: 120813 - RNA, 26 nt, Human
aaacuuagcaaaauuagcaauauauu

SEQ ID NO: 120814 - RNA, 23 nt, Human
uuaacuucagagggaaaguaaau

SEQ ID NO: 120815 - RNA, 23 nt, Human
acauauacaaaagcaagacuucc

SEQ ID NO: 120816 - RNA, 24 nt, Human
auguccaagacacagcagaacaga

SEQ ID NO: 120817 - RNA, 27 nt, Human
cuuuguuguuuuuguugaaaacaaacu

SEQ ID NO: 120818 - RNA, 21 nt, Human
uguugcccaggcuggugucaa

SEQ ID NO: 120819 - RNA, 22 nt, Human
ccugcagucggcagaucauggg

SEQ ID NO: 120820 - RNA, 22 nt, Human
uugacccucuaugauaugugcu

SEQ ID NO: 120821 - RNA, 21 nt, Human
agggucuauucuuugccaaag

SEQ ID NO: 120822 - RNA, 28 nt, Human
agaauuacaaugaauaauaauuugcuuu

SEQ ID NO: 120823 - RNA, 23 nt, Human
ccuuuguaccuuaccacagucuu

SEQ ID NO: 120824 - RNA, 27 nt, Human
cacuggcagucguuggaaacaggacuc

SEQ ID NO: 120825 - RNA, 18 nt, Human
acugauuuuguagagcug

SEQ ID NO: 120826 - RNA, 23 nt, Human
ggacugccagcgggagcuccaga

SEQ ID NO: 120827 - RNA, 27 nt, Human
ccugggucucugcucuagcacccagag

SEQ ID NO: 120828 - RNA, 25 nt, Human
gcccagucuggagugcaguggugug

SEQ ID NO: 120829 - RNA, 23 nt, Human
gcugggauuacaggcaugagcua

SEQ ID NO: 120830 - RNA, 26 nt, Human
cuccaccccauccaguucaugagaau

SEQ ID NO: 120831 - RNA, 22 nt, Human
ucuugagccauuaauuuuuggg

SEQ ID NO: 120832 - RNA, 27 nt, Human
cccuuguucuaaugcugcacaccaguu

SEQ ID NO: 120833 - RNA, 22 nt, Human
aggugugggcuuacagacacau

SEQ ID NO: 120834 - RNA, 23 nt, Human
gccuggccaccagccucccuuuc

SEQ ID NO: 120835 - RNA, 23 nt, Human
auacuaguuguuuuacacucucu

SEQ ID NO: 120836 - RNA, 22 nt, Human
acaacagcaaucaacaccaaga

SEQ ID NO: 120837 - RNA, 23 nt, Human
ccgcggggcccaggaauggcgua

SEQ ID NO: 120838 - RNA, 21 nt, Human
uucucauaggggcucaugacc

SEQ ID NO: 120839 - RNA, 25 nt, Human
cucuuaucaaucccaaccauccucc

SEQ ID NO: 120840 - RNA, 27 nt, Human
ugcuaucugcucuguuucuaguuaaaa

SEQ ID NO: 120841 - RNA, 21 nt, Human
ucccucacugggcccccagag

SEQ ID NO: 120842 - RNA, 28 nt, Human
ucuucuccauuguugcucucuauacccg

SEQ ID NO: 120843 - RNA, 27 nt, Human
gcagaauaacaaaaacuuugcucagga

SEQ ID NO: 120844 - RNA, 23 nt, Human
gcggcgggcgcaccaugcccucc

SEQ ID NO: 120845 - RNA, 23 nt, Human
gaucacauucugcccuuuacuac

SEQ ID NO: 120846 - RNA, 22 nt, Human
accauggcuggcuaauuuuugu

SEQ ID NO: 120847 - RNA, 21 nt, Human
ugcccugccuugcugccuuca

SEQ ID NO: 120848 - RNA, 25 nt, Human
ggguauggagguuucuugaagaccu

SEQ ID NO: 120849 - RNA, 19 nt, Human
cuccucgggggaaagcaca

SEQ ID NO: 120850 - RNA, 24 nt, Human
ggcaagauacccauuaagcauuuc

SEQ ID NO: 120851 - RNA, 19 nt, Human
acacuauuuucacacuuuu

SEQ ID NO: 120852 - RNA, 22 nt, Human
caacaggcugggcuucaguggc

SEQ ID NO: 120853 - RNA, 20 nt, Human
ugugucugucgguugcagug

SEQ ID NO: 120854 - RNA, 27 nt, Human
agcagcagcagccuccgcagucccucc

SEQ ID NO: 120855 - RNA, 26 nt, Human
ugcuucuuauauugcaagcuccaucu

SEQ ID NO: 120856 - RNA, 28 nt, Human
cgcaucucagccaccuuccucaggcuca

SEQ ID NO: 120857 - RNA, 23 nt, Human
uugggcaugacuaauucccacug

SEQ ID NO: 120858 - RNA, 21 nt, Human
ucagccaggcuggagcaaggu

SEQ ID NO: 120859 - RNA, 22 nt, Human
caagugucugcuccacgucagg

SEQ ID NO: 120860 - RNA, 27 nt, Human
ccaugcugcugcccagcucuaccccuc

SEQ ID NO: 120861 - RNA, 26 nt, Human
uaguaauccugccaaaugugccuauu

SEQ ID NO: 120862 - RNA, 24 nt, Human
gccauagugucacuuccacacaau

SEQ ID NO: 120863 - RNA, 18 nt, Human
ugugagcucucaccgggc

SEQ ID NO: 120864 - RNA, 20 nt, Human
ugccuguugccucuugugag

SEQ ID NO: 120865 - RNA, 26 nt, Human
uucccgccauucuccugccucagccu

SEQ ID NO: 120866 - RNA, 20 nt, Human
cagcugacacaggagccaga

SEQ ID NO: 120867 - RNA, 23 nt, Human
ccuccugcugccuucccacccuc

SEQ ID NO: 120868 - RNA, 23 nt, Human
ugcccggaccacagaaggagagu

SEQ ID NO: 120869 - RNA, 22 nt, Human
ugugcuacugugagaacuggaa

SEQ ID NO: 120870 - RNA, 22 nt, Human
gagggcugcucuagaggacuca

SEQ ID NO: 120871 - RNA, 22 nt, Human
ggagggagaagaaacgccugcu

SEQ ID NO: 120872 - RNA, 18 nt, Human
ugccacccucuccaugcc

SEQ ID NO: 120873 - RNA, 22 nt, Human
aggcugaggugggaggauuguu

SEQ ID NO: 120874 - RNA, 27 nt, Human
agcggguggcuguggcuucagccgugg

SEQ ID NO: 120875 - RNA, 27 nt, Human
ucuuucuuacacagaaacauacacaua

SEQ ID NO: 120876 - RNA, 27 nt, Human
uaaaugaugaguauuaguucccugucu

SEQ ID NO: 120877 - RNA, 22 nt, Human
uuucuaugauaaaagcacuuuc

SEQ ID NO: 120878 - RNA, 22 nt, Human
gaaagagaagacauuucuaugg

SEQ ID NO: 120879 - RNA, 23 nt, Human
aaacccagagcuuucagacuccg

SEQ ID NO: 120880 - RNA, 21 nt, Human
gagggauuggccgcuuggcac

SEQ ID NO: 120881 - RNA, 27 nt, Human
cccucgcucuccccucccugcuuggcc

SEQ ID NO: 120882 - RNA, 22 nt, Human
ccaccgacuuuguuuucucagg

SEQ ID NO: 120883 - RNA, 20 nt, Human
acccuguggggcaaccucuc

SEQ ID NO: 120884 - RNA, 27 nt, Human
aacauagugucuucauuagugugcauc

SEQ ID NO: 120885 - RNA, 32 nt, Human
gcccaggcuggaguauaauggcaugucucgac

SEQ ID NO: 120886 - RNA, 23 nt, Human
uaauuuuuacuuuaucucucaca

SEQ ID NO: 120887 - RNA, 21 nt, Human
uccugcuccucugacucuagu

SEQ ID NO: 120888 - RNA, 24 nt, Human
ugccuccaggguggucuuccugua

SEQ ID NO: 120889 - RNA, 26 nt, Human
ccuguuucacaaucugugcggaagua

SEQ ID NO: 120890 - RNA, 15 nt, Human
ggcggaucccacucg

SEQ ID NO: 120891 - RNA, 23 nt, Human
cuacugggcauccggccugugcu

SEQ ID NO: 120892 - RNA, 22 nt, Human
cuggggagcugggcagguagag

SEQ ID NO: 120893 - RNA, 24 nt, Human
uuacccaggaugcagcaggugugu

SEQ ID NO: 120894 - RNA, 26 nt, Human
ggacugacggcugccuuuguccuccu

SEQ ID NO: 120895 - RNA, 21 nt, Human
aauccuucaccuuugcugaaa

SEQ ID NO: 120896 - RNA, 27 nt, Human
ugggacccagcccucaccucccccaga

SEQ ID NO: 120897 - RNA, 20 nt, Human
uggcccaggaggaggauugu

SEQ ID NO: 120898 - RNA, 19 nt, Human
ugugcucugggggucccuu

SEQ ID NO: 120899 - RNA, 24 nt, Human
gcccagcccuggcgauggcaacgg

SEQ ID NO: 120900 - RNA, 23 nt, Human
ggucuaacuuguaaugaagacag

SEQ ID NO: 120901 - RNA, 23 nt, Human
gucucccaggcugaagugcagug

SEQ ID NO: 120902 - RNA, 20 nt, Human
agugguuuauaugcccagcc

SEQ ID NO: 120903 - RNA, 23 nt, Human
caaguagcugggauuacagaaag

SEQ ID NO: 120904 - RNA, 21 nt, Human
gcugguggaccaccuacccca

SEQ ID NO: 120905 - RNA, 23 nt, Human
cgagugaggcccauggacugggg

SEQ ID NO: 120906 - RNA, 22 nt, Human
caccucuuacuuccugccucag

SEQ ID NO: 120907 - RNA, 23 nt, Human
auugcccugccuacuacaaggac

SEQ ID NO: 120908 - RNA, 24 nt, Human
uggcuuccuccucccuccugccga

SEQ ID NO: 120909 - RNA, 22 nt, Human
agaccaaccuggguaacaaagu

SEQ ID NO: 120910 - RNA, 26 nt, Human
gcugugaccucuccccuggaacuguc

SEQ ID NO: 120911 - RNA, 20 nt, Human
cuggaggaaccacgagcgag

SEQ ID NO: 120912 - RNA, 22 nt, Human
cgaacuccuggacucaagcaau

SEQ ID NO: 120913 - RNA, 26 nt, Human
ccaagucccauggacaugcugacagg

SEQ ID NO: 120914 - RNA, 20 nt, Human
uugaacacaaaggcucuaug

SEQ ID NO: 120915 - RNA, 29 nt, Human
gggaggcaagagacugggagccacuucuc

SEQ ID NO: 120916 - RNA, 21 nt, Human
acugcagcugccugcaccccc

SEQ ID NO: 120917 - RNA, 22 nt, Human
aagcuggagugcaguggcauca

SEQ ID NO: 120918 - RNA, 19 nt, Human
cacugugauuuguucuccu

SEQ ID NO: 120919 - RNA, 30 nt, Human
uccagugaugccacugagauggcaccuguc

SEQ ID NO: 120920 - RNA, 21 nt, Human
ggaaauucccuucaucuggaa

SEQ ID NO: 120921 - RNA, 22 nt, Human
acgaucauagguggcugcugug

SEQ ID NO: 120922 - RNA, 25 nt, Human
uccaucuccagcaagucuccuggcc

SEQ ID NO: 120923 - RNA, 22 nt, Human
ugaacuccugaugucaggugau

SEQ ID NO: 120924 - RNA, 19 nt, Human
acacauuuuuuaaaugcac

SEQ ID NO: 120925 - RNA, 25 nt, Human
acccaggcuggagugcaaugacgca

SEQ ID NO: 120926 - RNA, 24 nt, Human
cauuagcucacuuuuaaacaacua

SEQ ID NO: 120927 - RNA, 20 nt, Human
gacucauuacuacucagccu

SEQ ID NO: 120928 - RNA, 23 nt, Human
aauuguucaaacuuucugccuuc

SEQ ID NO: 120929 - RNA, 26 nt, Human
gggcaaggggcagcacugccugcugc

SEQ ID NO: 120930 - RNA, 27 nt, Human
uguccagccucuuccucagucccccaa

SEQ ID NO: 120931 - RNA, 24 nt, Human
ccccuggcuggcuuccuggaggcg

SEQ ID NO: 120932 - RNA, 26 nt, Human
ccuggccaggacucaggcuguuccug

SEQ ID NO: 120933 - RNA, 22 nt, Human
ucugggagccucuucccuuucu

SEQ ID NO: 120934 - RNA, 21 nt, Human
caggggggaaaggaggagcug

SEQ ID NO: 120935 - RNA, 23 nt, Human
uuuauaacgcacaacuucgugcu

SEQ ID NO: 120936 - RNA, 24 nt, Human
cccacagagccugaauuuguaagc

SEQ ID NO: 120937 - RNA, 20 nt, Human
gagaagacaggcuggaagau

SEQ ID NO: 120938 - RNA, 23 nt, Human
ugaccucaguggcugcagcucug

SEQ ID NO: 120939 - RNA, 22 nt, Human
ucacuggaggcuggaaugaaug

SEQ ID NO: 120940 - RNA, 20 nt, Human
ggggugagggauucugcuuu

SEQ ID NO: 120941 - RNA, 20 nt, Human
cugaagcccaggcucacugu

SEQ ID NO: 120942 - RNA, 19 nt, Human
guuucacucuccucucucc

SEQ ID NO: 120943 - RNA, 21 nt, Human
augggacucuuacagacucag

SEQ ID NO: 120944 - RNA, 22 nt, Human
aauuaacuaaggaaauauuuca

SEQ ID NO: 120945 - RNA, 23 nt, Human
ggccagugacagaaauggauucg

SEQ ID NO: 120946 - RNA, 24 nt, Human
gguucaguguuuugaaaauauuca

SEQ ID NO: 120947 - RNA, 21 nt, Human
aggagaaaaaaggcaguccug

SEQ ID NO: 120948 - RNA, 27 nt, Human
uuauuuggccaaaauguuauauuaaug

SEQ ID NO: 120949 - RNA, 19 nt, Human
ccacagacucaaugugcuc

SEQ ID NO: 120950 - RNA, 23 nt, Human
caucaucaggccgggugcagugg

SEQ ID NO: 120951 - RNA, 20 nt, Human
guugcccaggcuguuaugga

SEQ ID NO: 120952 - RNA, 22 nt, Human
cccuggcacacagggcuggcuc

SEQ ID NO: 120953 - RNA, 20 nt, Human
aaaaguuggcucaggagucu

SEQ ID NO: 120954 - RNA, 22 nt, Human
gaaggcgggugcuaggcuggcu

SEQ ID NO: 120955 - RNA, 25 nt, Human
auggggcugguugcugcugcaguga

SEQ ID NO: 120956 - RNA, 27 nt, Human
cugggcccuggccccagggaggagcac

SEQ ID NO: 120957 - RNA, 24 nt, Human
ucuucacagcugaacucagucuau

SEQ ID NO: 120958 - RNA, 24 nt, Human
ggacuccagaaagccugaaaagcu

SEQ ID NO: 120959 - RNA, 23 nt, Human
agcaccuguaaucccagcuacuc

SEQ ID NO: 120960 - RNA, 25 nt, Human
cuucauucucccucucccugcugcu

SEQ ID NO: 120961 - RNA, 22 nt, Human
gacuucucauuacugugcugaa

SEQ ID NO: 120962 - RNA, 20 nt, Human
uucuuagcuauccuuggcuu

SEQ ID NO: 120963 - RNA, 18 nt, Human
ccugcuguccuccagaaa

SEQ ID NO: 120964 - RNA, 25 nt, Human
cacugcugugcacauuugaauguua

SEQ ID NO: 120965 - RNA, 26 nt, Human
cuuaaaaacuacccaugucuuucugg

SEQ ID NO: 120966 - RNA, 24 nt, Human
agccucucugugcacuugcugucu

SEQ ID NO: 120967 - RNA, 27 nt, Human
aacuucugauacauuuccugcagcaag

SEQ ID NO: 120968 - RNA, 23 nt, Human
ccaaucuccaucugucaacaggg

SEQ ID NO: 120969 - RNA, 27 nt, Human
guggcaaagcagcaacuauucacaaaa

SEQ ID NO: 120970 - RNA, 22 nt, Human
ugcaaccucugcccccuggguu

SEQ ID NO: 120971 - RNA, 22 nt, Human
ugcaaucucugccuccuggguu

SEQ ID NO: 120972 - RNA, 25 nt, Human
cagggccuggagacccagcaaggag

SEQ ID NO: 120973 - RNA, 18 nt, Human
gugguggcgaugagcuca

SEQ ID NO: 120974 - RNA, 22 nt, Human
gaacuccugggcucaagccguu

SEQ ID NO: 120975 - RNA, 20 nt, Human
ugagguggggaaaggaaguc

SEQ ID NO: 120976 - RNA, 24 nt, Human
gugugcauggacgugccugagggg

SEQ ID NO: 120977 - RNA, 20 nt, Human
cucccaggcuggagugcaau

SEQ ID NO: 120978 - RNA, 20 nt, Human
cacccaggcuggagugcuau

SEQ ID NO: 120979 - RNA, 22 nt, Human
gcccaucucccugcuuuggucu

SEQ ID NO: 120980 - RNA, 20 nt, Human
cccagcuucauuaugcagcu

SEQ ID NO: 120981 - RNA, 20 nt, Human
agagaauauaaacugaaaaa

SEQ ID NO: 120982 - RNA, 24 nt, Human
gucagucuaaagagucuaaagggg

SEQ ID NO: 120983 - RNA, 26 nt, Human
ggggcccaugaaagaggacaggcuac

SEQ ID NO: 120984 - RNA, 21 nt, Human
ccuacuuccuuccagugccau

SEQ ID NO: 120985 - RNA, 22 nt, Human
ucaugcauuuaaaaagaagaga

SEQ ID NO: 120986 - RNA, 23 nt, Human
guaaacaaaugagcacaguuaug

SEQ ID NO: 120987 - RNA, 25 nt, Human
cuugauacaagaacuacugauuuca

SEQ ID NO: 120988 - RNA, 25 nt, Human
auacaaaacuuauuuccauguuucu

SEQ ID NO: 120989 - RNA, 24 nt, Human
uggaaaagaaacaaugaagacuga

SEQ ID NO: 120990 - RNA, 21 nt, Human
agcaguuaacuuuaagacuga

SEQ ID NO: 120991 - RNA, 19 nt, Human
gcccagggcuucagucuuc

SEQ ID NO: 120992 - RNA, 19 nt, Human
gagcucuuccaggagccac

SEQ ID NO: 120993 - RNA, 23 nt, Human
gaguccuggcuccagagccaucu

SEQ ID NO: 120994 - RNA, 20 nt, Human
agguuuuagaagcagaguca

SEQ ID NO: 120995 - RNA, 22 nt, Human
gcuuggguggugggugcuggag

SEQ ID NO: 120996 - RNA, 22 nt, Human
uucauguccauaaaagagacca

SEQ ID NO: 120997 - RNA, 26 nt, Human
gugccuggccaggccggccugucugc

SEQ ID NO: 120998 - RNA, 27 nt, Human
auccauuuguuuucacacugauacaua

SEQ ID NO: 120999 - RNA, 23 nt, Human
ggcuugcuccucuauucuaccuc

SEQ ID NO: 121000 - RNA, 31 nt, Human
ccaaaaugcagacagauacuaaaaacuucug

SEQ ID NO: 121001 - RNA, 26 nt, Human
gcauggugccuggaccugacuacaau

SEQ ID NO: 121002 - RNA, 20 nt, Human
uuccucugcccuuccugcag

SEQ ID NO: 121003 - RNA, 22 nt, Human
ugcagcuccuggaaggugucau

SEQ ID NO: 121004 - RNA, 22 nt, Human
gggcugcuccugucacccagcg

SEQ ID NO: 121005 - RNA, 26 nt, Human
gcccagucugcuguggcgugcgugcu

SEQ ID NO: 121006 - RNA, 22 nt, Human
ucccaugacauggagaccguga

SEQ ID NO: 121007 - RNA, 21 nt, Human
gggcuugugguggcugcucca

SEQ ID NO: 121008 - RNA, 20 nt, Human
ucuccaccuccccgucuucc

SEQ ID NO: 121009 - RNA, 26 nt, Human
gacuguacuccuuucuaggaaugcug

SEQ ID NO: 121010 - RNA, 21 nt, Human
ucacuugcuggagugccaagu

SEQ ID NO: 121011 - RNA, 26 nt, Human
acaaguuaagguaucugguaucugca

SEQ ID NO: 121012 - RNA, 23 nt, Human
uauuaucauugacauaccucugu

SEQ ID NO: 121013 - RNA, 25 nt, Human
uuguauuguauauuacaaugaucac

SEQ ID NO: 121014 - RNA, 22 nt, Human
caguacugguuuacagguguua

SEQ ID NO: 121015 - RNA, 22 nt, Human
cugaggagcugggacuacaggu

SEQ ID NO: 121016 - RNA, 25 nt, Human
gcuccuugccagcucccucuucccu

SEQ ID NO: 121017 - RNA, 22 nt, Human
accuccuugccuugcuggacug

SEQ ID NO: 121018 - RNA, 26 nt, Human
acucacaacuguccaggcugagauaa

SEQ ID NO: 121019 - RNA, 23 nt, Human
gagaaaagcugaguguugggaga

SEQ ID NO: 121020 - RNA, 27 nt, Human
gaaugucauaauugcagugacaggaca

SEQ ID NO: 121021 - RNA, 23 nt, Human
ggaaauacuuggaauauuuucca

SEQ ID NO: 121022 - RNA, 19 nt, Human
gggcagaagggcugaggaa

SEQ ID NO: 121023 - RNA, 24 nt, Human
acaaaauuaugaggcacccaauga

SEQ ID NO: 121024 - RNA, 29 nt, Human
cuauuucgauggcaaauguuaagccuucu

SEQ ID NO: 121025 - RNA, 23 nt, Human
uggaaaggcaaaaaugagaaaga

SEQ ID NO: 121026 - RNA, 23 nt, Human
uucaggacugggguuuguuugcu

SEQ ID NO: 121027 - RNA, 25 nt, Human
ugauucauucuuuuuugucauucca

SEQ ID NO: 121028 - RNA, 26 nt, Human
cugcaaccuuugcggcuccaacaugg

SEQ ID NO: 121029 - RNA, 24 nt, Human
ucaguuucucaaacugagcuucag

SEQ ID NO: 121030 - RNA, 23 nt, Human
cacucacugccccgucuguccaa

SEQ ID NO: 121031 - RNA, 22 nt, Human
uccuccaggagcuucuuguuuc

SEQ ID NO: 121032 - RNA, 24 nt, Human
ggaaggcaaaguccucuguguccu

SEQ ID NO: 121033 - RNA, 22 nt, Human
uucaccuaggugaggugugugc

SEQ ID NO: 121034 - RNA, 21 nt, Human
gcucugggcuggagcgagggc

SEQ ID NO: 121035 - RNA, 26 nt, Human
acagacagaugaggacagagcuggug

SEQ ID NO: 121036 - RNA, 23 nt, Human
cagauguuuuggacuugaucugu

SEQ ID NO: 121037 - RNA, 28 nt, Human
aguuuagaaagacaguccuggugaaugg

SEQ ID NO: 121038 - RNA, 22 nt, Human
aucagccaggcuggagugcagu

SEQ ID NO: 121039 - RNA, 20 nt, Human
gacauacucaccucuaccuc

SEQ ID NO: 121040 - RNA, 26 nt, Human
gucgguggccgggcugaagaagcagu

SEQ ID NO: 121041 - RNA, 22 nt, Human
cccuccucugccugaguguguc

SEQ ID NO: 121042 - RNA, 27 nt, Human
gggcccaggaguuugaggcugcaguga

SEQ ID NO: 121043 - RNA, 21 nt, Human
ccccugccgcugugccaggca

SEQ ID NO: 121044 - RNA, 22 nt, Human
aagcucucagaguuucugugau

SEQ ID NO: 121045 - RNA, 22 nt, Human
uucuggcuuagaacaaaggggc

SEQ ID NO: 121046 - RNA, 22 nt, Human
cuguuauuuugggccugaugug

SEQ ID NO: 121047 - RNA, 20 nt, Human
ccagaaaggucugggcugcg

SEQ ID NO: 121048 - RNA, 22 nt, Human
ggaagccgaagcaggaggauca

SEQ ID NO: 121049 - RNA, 25 nt, Human
cagcucaggcuggagcaggcauaug

SEQ ID NO: 121050 - RNA, 17 nt, Human
ccucagccaagcccagc

SEQ ID NO: 121051 - RNA, 27 nt, Human
acucuguauuugcucguuuacguguug

SEQ ID NO: 121052 - RNA, 26 nt, Human
acugcaggaaugucucgcaguuuuuc

SEQ ID NO: 121053 - RNA, 20 nt, Human
cccaauucagccuccugggc

SEQ ID NO: 121054 - RNA, 25 nt, Human
ugaucauuccagcuccucugggcuc

SEQ ID NO: 121055 - RNA, 24 nt, Human
ggggugaggaagagggagggaugg

SEQ ID NO: 121056 - RNA, 21 nt, Human
ggaagguacaucagcaauuaa

SEQ ID NO: 121057 - RNA, 21 nt, Human
ucucuugccagcauuuucaca

SEQ ID NO: 121058 - RNA, 21 nt, Human
caucacuucaaaacugccucu

SEQ ID NO: 121059 - RNA, 25 nt, Human
uaaacuucuuauggaugaaaugaua

SEQ ID NO: 121060 - RNA, 25 nt, Human
agauguaggggaagagauguuuaca

SEQ ID NO: 121061 - RNA, 24 nt, Human
gcuggcccuccuuccucccucagg

SEQ ID NO: 121062 - RNA, 22 nt, Human
ggggagaagcggggcagagggu

SEQ ID NO: 121063 - RNA, 27 nt, Human
augagaauaagagaaagaaaaugaaga

SEQ ID NO: 121064 - RNA, 21 nt, Human
aauuaguucagccauugugga

SEQ ID NO: 121065 - RNA, 24 nt, Human
gaaaugcgaaaaauuagauugagg

SEQ ID NO: 121066 - RNA, 20 nt, Human
aguggguggaggaccgggag

SEQ ID NO: 121067 - RNA, 22 nt, Human
aggcugaggcacaagaaucgcu

SEQ ID NO: 121068 - RNA, 27 nt, Human
ggacugccugacuccccuccccagacu

SEQ ID NO: 121069 - RNA, 27 nt, Human
gcagaggugaaagucccugucaucccu

SEQ ID NO: 121070 - RNA, 21 nt, Human
gcugaaucugcagugccaaca

SEQ ID NO: 121071 - RNA, 23 nt, Human
cugggaaggccacaggggugggg

SEQ ID NO: 121072 - RNA, 20 nt, Human
gaacucaggcucaagcaauc

SEQ ID NO: 121073 - RNA, 21 nt, Human
guucaacuguugauugcagga

SEQ ID NO: 121074 - RNA, 21 nt, Human
auaucauuaauucagcucuuc

SEQ ID NO: 121075 - RNA, 17 nt, Human
cccucaaggaggucugg

SEQ ID NO: 121076 - RNA, 22 nt, Human
aaacuauucuaucauaacuacc

SEQ ID NO: 121077 - RNA, 20 nt, Human
aaacuucugauuucucuuca

SEQ ID NO: 121078 - RNA, 22 nt, Human
ccucgcgcgagccccuggagcu

SEQ ID NO: 121079 - RNA, 26 nt, Human
aggggccaagcaggcacucuggggcu

SEQ ID NO: 121080 - RNA, 22 nt, Human
uccaggccagagucuuucucuc

SEQ ID NO: 121081 - RNA, 22 nt, Human
ucaaauaccagugaacuuaaag

SEQ ID NO: 121082 - RNA, 32 nt, Human
cucaguaauucacauuuuccuuccuccuguua

SEQ ID NO: 121083 - RNA, 29 nt, Human
ccagguguugccauuucucugcuuacccu

SEQ ID NO: 121084 - RNA, 22 nt, Human
ugcccaggcuggagugcagugg

SEQ ID NO: 121085 - RNA, 22 nt, Human
ugcccaggcuagagugcaaugg

SEQ ID NO: 121086 - RNA, 22 nt, Human
cgcccaggcuggaguguagugg

SEQ ID NO: 121087 - RNA, 27 nt, Human
caggcuggagugcagugucgugaucaa

SEQ ID NO: 121088 - RNA, 21 nt, Human
uuguuuuacuccuuuuuauuc

SEQ ID NO: 121089 - RNA, 29 nt, Human
cagucaggagacggcuccaggcacucagg

SEQ ID NO: 121090 - RNA, 19 nt, Human
gcccaggcuggaguguagu

SEQ ID NO: 121091 - RNA, 22 nt, Human
ccauacagaauuagcagagaaa

SEQ ID NO: 121092 - RNA, 23 nt, Human
uuaggggcucucagccaucucua

SEQ ID NO: 121093 - RNA, 23 nt, Human
gggggcgagggaggggagguggc

SEQ ID NO: 121094 - RNA, 29 nt, Human
caucucccaacaugcugugcuccauagcu

SEQ ID NO: 121095 - RNA, 22 nt, Human
gucacccaguccaugguacuuu

SEQ ID NO: 121096 - RNA, 26 nt, Human
caauacggucauuagauugggucauc

SEQ ID NO: 121097 - RNA, 25 nt, Human
accggcuaggcugggcgcgcccccc

SEQ ID NO: 121098 - RNA, 22 nt, Human
uucugcaggaaucccggcucca

SEQ ID NO: 121099 - RNA, 22 nt, Human
gguggaggccacggaggcaggg

SEQ ID NO: 121100 - RNA, 27 nt, Human
ugugaucugaaugucuccuuuuccccc

SEQ ID NO: 121101 - RNA, 21 nt, Human
uugcagcauccccaaaaugaa

SEQ ID NO: 121102 - RNA, 22 nt, Human
acugcaggagggcccucagcug

SEQ ID NO: 121103 - RNA, 19 nt, Human
ugccgccagccuaguagaa

SEQ ID NO: 121104 - RNA, 27 nt, Human
ggucuugaacuccugaccuugugaucu

SEQ ID NO: 121105 - RNA, 23 nt, Human
cuguuacaucauaacaacuucug

SEQ ID NO: 121106 - RNA, 22 nt, Human
agacauuucauaccugcccugg

SEQ ID NO: 121107 - RNA, 21 nt, Human
gggcucgggauccuggacucc

SEQ ID NO: 121108 - RNA, 24 nt, Human
gugguggcaggacaagagaaggca

SEQ ID NO: 121109 - RNA, 27 nt, Human
gugacaccuccgccuuggcagcccuga

SEQ ID NO: 121110 - RNA, 25 nt, Human
gggccuccuuggcaaugcauuugau

SEQ ID NO: 121111 - RNA, 23 nt, Human
ccugcagcugcucgcgcgcaguc

SEQ ID NO: 121112 - RNA, 22 nt, Human
guccagaguggcaguaaaggag

SEQ ID NO: 121113 - RNA, 21 nt, Human
augugauucuaaaagcuuuua

SEQ ID NO: 121114 - RNA, 21 nt, Human
ccuggcacccuggccugggug

SEQ ID NO: 121115 - RNA, 19 nt, Human
accauuuaaaaauguuagg

SEQ ID NO: 121116 - RNA, 22 nt, Human
gucuccucuggagcacucugcc

SEQ ID NO: 121117 - RNA, 24 nt, Human
uccuaggcuggaugggaggguggc

SEQ ID NO: 121118 - RNA, 24 nt, Human
ucuuuccuuccccuccucucucca

SEQ ID NO: 121119 - RNA, 24 nt, Human
gcagggggagagcacaggacuggc

SEQ ID NO: 121120 - RNA, 22 nt, Human
aggcugaggugggaggacugcu

SEQ ID NO: 121121 - RNA, 20 nt, Human
uaauacagcugcuaaaauga

SEQ ID NO: 121122 - RNA, 23 nt, Human
gauuucccacugcacuccagccu

SEQ ID NO: 121123 - RNA, 23 nt, Human
gugauugacaacugaagagacac

SEQ ID NO: 121124 - RNA, 28 nt, Human
gaugacagcagaguccucgagcaccugg

SEQ ID NO: 121125 - RNA, 24 nt, Human
cugcucuccgcaggcccacugucc

SEQ ID NO: 121126 - RNA, 25 nt, Human
ccagaaacauuucccagaaaauguu

SEQ ID NO: 121127 - RNA, 26 nt, Human
aggagcagagcaggcaauuucaccac

SEQ ID NO: 121128 - RNA, 22 nt, Human
uggagcuguggccugagggccu

SEQ ID NO: 121129 - RNA, 24 nt, Human
uuugccagcccuaauaagaagcau

SEQ ID NO: 121130 - RNA, 28 nt, Human
gccucgaaaaccaucacaugaccacaua

SEQ ID NO: 121131 - RNA, 21 nt, Human
cuggggagagggcagggaggc

SEQ ID NO: 121132 - RNA, 25 nt, Human
aagauucuuccagccacaugucacc

SEQ ID NO: 121133 - RNA, 22 nt, Human
cucuccaaagacuaagaugaag

SEQ ID NO: 121134 - RNA, 27 nt, Human
uggcucaugccuguaaucccgacacuu

SEQ ID NO: 121135 - RNA, 25 nt, Human
uucauuucucuuuuacacuuuugua

SEQ ID NO: 121136 - RNA, 23 nt, Human
aaauagaauuccuucuaguuuuu

SEQ ID NO: 121137 - RNA, 21 nt, Human
caccgccgccucggagcucag

SEQ ID NO: 121138 - RNA, 22 nt, Human
gucugaaaauaauauuccagau

SEQ ID NO: 121139 - RNA, 20 nt, Human
ugcccagccuccauguuuua

SEQ ID NO: 121140 - RNA, 27 nt, Human
cagcccagccugcauacuugccacuug

SEQ ID NO: 121141 - RNA, 20 nt, Human
accauucuucuuuuuuguaa

SEQ ID NO: 121142 - RNA, 21 nt, Human
auugaaauaaccaacauuaaa

SEQ ID NO: 121143 - RNA, 23 nt, Human
gcucaauaaggcagugcagugcu

SEQ ID NO: 121144 - RNA, 26 nt, Human
ugcccaggauagauguaauauuucuu

SEQ ID NO: 121145 - RNA, 21 nt, Human
cugaaaacuuugccucugacc

SEQ ID NO: 121146 - RNA, 21 nt, Human
auuuuucuaaacagaggcccu

SEQ ID NO: 121147 - RNA, 28 nt, Human
uuuacaaucgucuuaauuuuguacucag

SEQ ID NO: 121148 - RNA, 28 nt, Human
cgcgugccucugccuacaagaccugggg

SEQ ID NO: 121149 - RNA, 22 nt, Human
guccagccacagccccagccca

SEQ ID NO: 121150 - RNA, 27 nt, Human
uggacaacauggugagaccucgucucu

SEQ ID NO: 121151 - RNA, 22 nt, Human
ccaccauucuccucuguacuuc

SEQ ID NO: 121152 - RNA, 27 nt, Human
ugcgggccuggcgggaggugggggagg

SEQ ID NO: 121153 - RNA, 23 nt, Human
gcggagccagaucuggagugcga

SEQ ID NO: 121154 - RNA, 26 nt, Human
cauccagccaauaggagcccagccac

SEQ ID NO: 121155 - RNA, 22 nt, Human
cugccucccaguccgcacaccu

SEQ ID NO: 121156 - RNA, 26 nt, Human
guuuuuaaaaugcugcuuuguccagg

SEQ ID NO: 121157 - RNA, 22 nt, Human
ccuuucugcugacagcccagcc

SEQ ID NO: 121158 - RNA, 22 nt, Human
cucuguaaguucaauuguguuu

SEQ ID NO: 121159 - RNA, 24 nt, Human
cucuaaacuaccugagucuuucca

SEQ ID NO: 121160 - RNA, 22 nt, Human
uaacccuuccuagagcggagga

SEQ ID NO: 121161 - RNA, 26 nt, Human
ggggggcaguuggguagauggguggg

SEQ ID NO: 121162 - RNA, 22 nt, Human
ccauuucacuccagccugggcg

SEQ ID NO: 121163 - RNA, 21 nt, Human
gacacaaaaucuaggguggcu

SEQ ID NO: 121164 - RNA, 25 nt, Human
gguccuagcuccucgggaggcugag

SEQ ID NO: 121165 - RNA, 23 nt, Human
gaucacugcagcuucuaggaccc

SEQ ID NO: 121166 - RNA, 24 nt, Human
gguguccaaacugacaaugcugga

SEQ ID NO: 121167 - RNA, 23 nt, Human
agccaccgccagacagugccucg

SEQ ID NO: 121168 - RNA, 24 nt, Human
ucugcucucuuuguuuuaaaaauc

SEQ ID NO: 121169 - RNA, 29 nt, Human
cuccaagcuuucagacaagaaugugcacu

SEQ ID NO: 121170 - RNA, 22 nt, Human
gucuuccugagcaguggaagau

SEQ ID NO: 121171 - RNA, 22 nt, Human
augcugucuggacuuugcuguc

SEQ ID NO: 121172 - RNA, 19 nt, Human
guugucuuccuguagcuga

SEQ ID NO: 121173 - RNA, 22 nt, Human
ugccuccauggugccucuggag

SEQ ID NO: 121174 - RNA, 24 nt, Human
ucccacccugccagccuaugaguu

SEQ ID NO: 121175 - RNA, 23 nt, Human
gcagagucacccugacacuggug

SEQ ID NO: 121176 - RNA, 18 nt, Human
agcauuuucagucuuaca

SEQ ID NO: 121177 - RNA, 26 nt, Human
ggagcauuuggaaggaaaggaauaua

SEQ ID NO: 121178 - RNA, 30 nt, Human
gggucuuugugagagugagcuguaggugug

SEQ ID NO: 121179 - RNA, 22 nt, Human
ggacagcuugucugcugcucca

SEQ ID NO: 121180 - RNA, 26 nt, Human
cagaagccuggccuaggcagcuucaa

SEQ ID NO: 121181 - RNA, 19 nt, Human
uccagccuuugauuacaaa

SEQ ID NO: 121182 - RNA, 23 nt, Human
aagcuccauuucauaaaggggcu

SEQ ID NO: 121183 - RNA, 26 nt, Human
ggugauccagacgcaagauggcuguc

SEQ ID NO: 121184 - RNA, 23 nt, Human
ccuuucccaagcaucuguggcau

SEQ ID NO: 121185 - RNA, 27 nt, Human
acugcaaccucuuccuccugguucaag

SEQ ID NO: 121186 - RNA, 20 nt, Human
ucagugucauuuacuaacca

SEQ ID NO: 121187 - RNA, 22 nt, Human
gggcacccuuugagcugugggu

SEQ ID NO: 121188 - RNA, 21 nt, Human
auacagugauauacuuacuca

SEQ ID NO: 121189 - RNA, 22 nt, Human
uagggcuggcacaccucccucc

SEQ ID NO: 121190 - RNA, 20 nt, Human
uugagguggggacacaggag

SEQ ID NO: 121191 - RNA, 18 nt, Human
uuucugcagccacuauug

SEQ ID NO: 121192 - RNA, 20 nt, Human
ccggccgcugcccccucguc

SEQ ID NO: 121193 - RNA, 21 nt, Human
gcccggaccacacccgguccc

SEQ ID NO: 121194 - RNA, 20 nt, Human
ccgaagaguuuauaaagcac

SEQ ID NO: 121195 - RNA, 24 nt, Human
gcagaaaauucaugcuggagagaa

SEQ ID NO: 121196 - RNA, 22 nt, Human
gcuuccggccuccugucccuca

SEQ ID NO: 121197 - RNA, 24 nt, Human
agggaggaccugccugggagcuuu

SEQ ID NO: 121198 - RNA, 20 nt, Human
ggcagugucaucucugagaa

SEQ ID NO: 121199 - RNA, 20 nt, Human
uucuagccaugugcaaccaa

SEQ ID NO: 121200 - RNA, 27 nt, Human
uucauucuuuugagaauugcucauuca

SEQ ID NO: 121201 - RNA, 21 nt, Human
uucauaaccuuuauauuugcc

SEQ ID NO: 121202 - RNA, 23 nt, Human
gccagugaaagcugacaucugua

SEQ ID NO: 121203 - RNA, 22 nt, Human
cagcucucuuauuuuuuccuua

SEQ ID NO: 121204 - RNA, 22 nt, Human
aggagccucaguuuccucaucu

SEQ ID NO: 121205 - RNA, 20 nt, Human
uccugccgcugccugccauu

SEQ ID NO: 121206 - RNA, 23 nt, Human
aaauguccuugaguuuggagccu

SEQ ID NO: 121207 - RNA, 24 nt, Human
cuucuuccuccugugcugaccuca

SEQ ID NO: 121208 - RNA, 23 nt, Human
gagucugcacucuucaaggggcc

SEQ ID NO: 121209 - RNA, 24 nt, Human
gcacacaccaugccuccugucuca

SEQ ID NO: 121210 - RNA, 27 nt, Human
ccugccuggccaacauggcaacacccc

SEQ ID NO: 121211 - RNA, 23 nt, Human
uuguguauaauauuaauaugcaa

SEQ ID NO: 121212 - RNA, 19 nt, Human
gagcaggaagcucugugau

SEQ ID NO: 121213 - RNA, 29 nt, Human
ccacgaaaucugcuacuccguauuauguc

SEQ ID NO: 121214 - RNA, 22 nt, Human
ugccuauaaucccagcacuuug

SEQ ID NO: 121215 - RNA, 23 nt, Human
cugcaaccuccuugacucuggcc

SEQ ID NO: 121216 - RNA, 22 nt, Human
gcuacagcugugucccuuccug

SEQ ID NO: 121217 - RNA, 20 nt, Human
ggaaggacuccucucugccu

SEQ ID NO: 121218 - RNA, 18 nt, Human
gccacugcaauccagccu

SEQ ID NO: 121219 - RNA, 22 nt, Human
cagaucugaauggcaugggagg

SEQ ID NO: 121220 - RNA, 22 nt, Human
auuuuccagggcucaaaaaguu

SEQ ID NO: 121221 - RNA, 24 nt, Human
cuuagagcucucuagaaucccacu

SEQ ID NO: 121222 - RNA, 22 nt, Human
gaaggauauacuaguugaaaag

SEQ ID NO: 121223 - RNA, 21 nt, Human
gcugggagagauggacucugu

SEQ ID NO: 121224 - RNA, 27 nt, Human
gcagcugauggaagaugagccccaacu

SEQ ID NO: 121225 - RNA, 21 nt, Human
agaaagggaaggaaaucccau

SEQ ID NO: 121226 - RNA, 24 nt, Human
cucuucaaggccaaggaacagugg

SEQ ID NO: 121227 - RNA, 23 nt, Human
guuuguuaccaguugcuguacuu

SEQ ID NO: 121228 - RNA, 21 nt, Human
ggucaucuuuguuuuuaaagc

SEQ ID NO: 121229 - RNA, 22 nt, Human
ugaggccucuggaaagcaaagg

SEQ ID NO: 121230 - RNA, 25 nt, Human
aaaacuggcccugcccugccccugc

SEQ ID NO: 121231 - RNA, 22 nt, Human
gcucacugcaaccuucaccucc

SEQ ID NO: 121232 - RNA, 22 nt, Human
acucacugcaaccuucgccucc

SEQ ID NO: 121233 - RNA, 27 nt, Human
gaccagccuuaccaacauggagaaacc

SEQ ID NO: 121234 - RNA, 26 nt, Human
uguuaccucaugaugucauaauuugc

SEQ ID NO: 121235 - RNA, 25 nt, Human
ugagguggggaaggagggacuuggc

SEQ ID NO: 121236 - RNA, 22 nt, Human
cggagcuucaaaaacaugugag

SEQ ID NO: 121237 - RNA, 22 nt, Human
uuguuuuucuccuggugagaau

SEQ ID NO: 121238 - RNA, 22 nt, Human
aaacuauuuaaaauuggcacca

SEQ ID NO: 121239 - RNA, 20 nt, Human
gguuugccugaggcuguaac

SEQ ID NO: 121240 - RNA, 26 nt, Human
gccuguaaucccagcacuuuaagagg

SEQ ID NO: 121241 - RNA, 22 nt, Human
uguaagcuuuccguggcaugcg

SEQ ID NO: 121242 - RNA, 27 nt, Human
gagggauggggugggaggcacccccuc

SEQ ID NO: 121243 - RNA, 24 nt, Human
gccaaggccagcccacacagcccg

SEQ ID NO: 121244 - RNA, 20 nt, Human
caaugcugcgugugaggccu

SEQ ID NO: 121245 - RNA, 23 nt, Human
ggaaugaaugucagugugacuga

SEQ ID NO: 121246 - RNA, 21 nt, Human
ccucacugggguccuggggcc

SEQ ID NO: 121247 - RNA, 23 nt, Human
ucuuuauuucuuuucaaccuauc

SEQ ID NO: 121248 - RNA, 24 nt, Human
cccuacucccucuucacuguggcc

SEQ ID NO: 121249 - RNA, 24 nt, Human
ucugccuacacuccugccugcugu

SEQ ID NO: 121250 - RNA, 21 nt, Human
aacagcuuuaggggugguggg

SEQ ID NO: 121251 - RNA, 22 nt, Human
ugcagccagcccugaaggaugg

SEQ ID NO: 121252 - RNA, 21 nt, Human
cuggcugccguuguccugucc

SEQ ID NO: 121253 - RNA, 22 nt, Human
acauguccucucugcuuggugu

SEQ ID NO: 121254 - RNA, 25 nt, Human
gguacagcuauuaaaacaagguagg

SEQ ID NO: 121255 - RNA, 19 nt, Human
auagguuuuucucauguau

SEQ ID NO: 121256 - RNA, 22 nt, Human
cacucugucccuuccugggcaa

SEQ ID NO: 121257 - RNA, 22 nt, Human
ggaaggcagugaggggcuguga

SEQ ID NO: 121258 - RNA, 19 nt, Human
uccuaaggugcuuaccuca

SEQ ID NO: 121259 - RNA, 18 nt, Human
ccaccucuucacucugaa

SEQ ID NO: 121260 - RNA, 23 nt, Human
ugcugaccuuccaaagcacuuuu

SEQ ID NO: 121261 - RNA, 26 nt, Human
cccaccccacucaggggaccccacuc

SEQ ID NO: 121262 - RNA, 21 nt, Human
aucauuugcauagacaccucu

SEQ ID NO: 121263 - RNA, 21 nt, Human
ucucgccaggcuggaguguag

SEQ ID NO: 121264 - RNA, 22 nt, Human
agacggaggggaguagagaagu

SEQ ID NO: 121265 - RNA, 21 nt, Human
ggcaugcccacaucucuuucg

SEQ ID NO: 121266 - RNA, 26 nt, Human
cuguucugugguuccucugcucaccg

SEQ ID NO: 121267 - RNA, 24 nt, Human
gggaucugcauuuagcaaugugau

SEQ ID NO: 121268 - RNA, 21 nt, Human
agcuugauuucugcuggugac

SEQ ID NO: 121269 - RNA, 19 nt, Human
uuaagccacauguuuguaa

SEQ ID NO: 121270 - RNA, 20 nt, Human
gcgcacacacucgcacccgc

SEQ ID NO: 121271 - RNA, 27 nt, Human
gcuguguuuugagcagcagguagccug

SEQ ID NO: 121272 - RNA, 21 nt, Human
acugccucaguguuucacgua

SEQ ID NO: 121273 - RNA, 29 nt, Human
uggagcagcacuggcaggagcugcagcuu

SEQ ID NO: 121274 - RNA, 22 nt, Human
gacuccugcccuguuguguaua

SEQ ID NO: 121275 - RNA, 21 nt, Human
uccuggagcccugcaggucaa

SEQ ID NO: 121276 - RNA, 28 nt, Human
aaaugcuagagaccugggcccugaaccc

SEQ ID NO: 121277 - RNA, 22 nt, Human
ccugagcgcgaggagccugagu

SEQ ID NO: 121278 - RNA, 24 nt, Human
aggagguagagagagggcagccgg

SEQ ID NO: 121279 - RNA, 21 nt, Human
uggacacccucucccucuguc

SEQ ID NO: 121280 - RNA, 20 nt, Human
cuuauuuuugacaguguuga

SEQ ID NO: 121281 - RNA, 23 nt, Human
cgaaacaguuugaaagggacuga

SEQ ID NO: 121282 - RNA, 23 nt, Human
gaaccuuucacaccucuuucuca

SEQ ID NO: 121283 - RNA, 21 nt, Human
uagucauccuggaauaucucc

SEQ ID NO: 121284 - RNA, 19 nt, Human
uuucagaaagcuucaagaa

SEQ ID NO: 121285 - RNA, 19 nt, Human
caaucucugcuggucaguc

SEQ ID NO: 121286 - RNA, 22 nt, Human
gacaugucguugcucagugccu

SEQ ID NO: 121287 - RNA, 22 nt, Human
caccucccagguucaagcaauu

SEQ ID NO: 121288 - RNA, 20 nt, Human
uggcucucuuuucaucuuug

SEQ ID NO: 121289 - RNA, 23 nt, Human
ugcaggagccgcacagugcacug

SEQ ID NO: 121290 - RNA, 21 nt, Human
aagaacaucucgaauacaauu

SEQ ID NO: 121291 - RNA, 26 nt, Human
acuauacaauucaguacugauuauuc

SEQ ID NO: 121292 - RNA, 26 nt, Human
cugucuacuaauccacaguccuagaa

SEQ ID NO: 121293 - RNA, 24 nt, Human
aggcaugcaccaccacaccaggcu

SEQ ID NO: 121294 - RNA, 27 nt, Human
agucacauuaguguguugucucuuucc

SEQ ID NO: 121295 - RNA, 21 nt, Human
cuuucccaaccccaggaaagg

SEQ ID NO: 121296 - RNA, 24 nt, Human
cuaaauuaugugaauuuugccaua

SEQ ID NO: 121297 - RNA, 25 nt, Human
gcucuaaguucuggaaggugugugc

SEQ ID NO: 121298 - RNA, 23 nt, Human
cacaguuguuucagaaagagcuc

SEQ ID NO: 121299 - RNA, 21 nt, Human
uuucaccucugcaccuaguuu

SEQ ID NO: 121300 - RNA, 22 nt, Human
agucccuucucgcucucuuucc

SEQ ID NO: 121301 - RNA, 19 nt, Human
aauuccucucuuuguacuc

SEQ ID NO: 121302 - RNA, 21 nt, Human
ggcaaauuuuuauuuuuuagu

SEQ ID NO: 121303 - RNA, 23 nt, Human
ccacaggcugguguguagguggu

SEQ ID NO: 121304 - RNA, 21 nt, Human
ucuccucccuuacuucuauca

SEQ ID NO: 121305 - RNA, 23 nt, Human
gugguggccgugccugagcugca

SEQ ID NO: 121306 - RNA, 21 nt, Human
ugugauaaaccaaacagggaa

SEQ ID NO: 121307 - RNA, 28 nt, Human
acucuccuguuuauucaccagacugggg

SEQ ID NO: 121308 - RNA, 28 nt, Human
guggugggagggagagcggccuccuccu

SEQ ID NO: 121309 - RNA, 22 nt, Human
uugcccaggcuggaaugcagug

SEQ ID NO: 121310 - RNA, 26 nt, Human
uaaaagcauacauuuucagcaaccag

SEQ ID NO: 121311 - RNA, 23 nt, Human
acuguuuucaauaacaaagcaca

SEQ ID NO: 121312 - RNA, 18 nt, Human
uucuagugaggauuaugg

SEQ ID NO: 121313 - RNA, 22 nt, Human
uaauccagagauaauugccauu

SEQ ID NO: 121314 - RNA, 16 nt, Human
cuuugcucucccgacc

SEQ ID NO: 121315 - RNA, 19 nt, Human
uugucucucuggcuccacc

SEQ ID NO: 121316 - RNA, 27 nt, Human
uguauaugauguguccaguaaguauuc

SEQ ID NO: 121317 - RNA, 22 nt, Human
gccgcucuggcuuuuccucuca

SEQ ID NO: 121318 - RNA, 20 nt, Human
uuuuaaacuuaaauuuuggg

SEQ ID NO: 121319 - RNA, 20 nt, Human
ccauccugucuacuaaucca

SEQ ID NO: 121320 - RNA, 23 nt, Human
gugcguggcuccugaccugcugc

SEQ ID NO: 121321 - RNA, 26 nt, Human
ucaggauaugaacacagguacaguca

SEQ ID NO: 121322 - RNA, 24 nt, Human
agcuccaccugcaucuucucauca

SEQ ID NO: 121323 - RNA, 27 nt, Human
agucaucugacaggcuuaucauucucu

SEQ ID NO: 121324 - RNA, 21 nt, Human
aauuauguaucuuuugguuca

SEQ ID NO: 121325 - RNA, 24 nt, Human
accuugaagugggggaucaguaga

SEQ ID NO: 121326 - RNA, 26 nt, Human
gccuucaguuuccauccccaggaucc

SEQ ID NO: 121327 - RNA, 24 nt, Human
uuuucgcccccgccuccuuguggc

SEQ ID NO: 121328 - RNA, 21 nt, Human
uggcccugcggccaggguccu

SEQ ID NO: 121329 - RNA, 21 nt, Human
ccugaauaaaacaacaauauu

SEQ ID NO: 121330 - RNA, 26 nt, Human
ucucagccggcagcacauuccgucgc

SEQ ID NO: 121331 - RNA, 22 nt, Human
uacuaguccaucauagccuaga

SEQ ID NO: 121332 - RNA, 21 nt, Human
cacgcuccagcccucugggaa

SEQ ID NO: 121333 - RNA, 20 nt, Human
ucugggcugaauguauguca

SEQ ID NO: 121334 - RNA, 21 nt, Human
gaaauacaaaaaauuagcugg

SEQ ID NO: 121335 - RNA, 23 nt, Human
gggccuggcccugcuuucuacgc

SEQ ID NO: 121336 - RNA, 22 nt, Human
caccccuccccagccuccugac

SEQ ID NO: 121337 - RNA, 25 nt, Human
ggcauccacuucgacugcucaggga

SEQ ID NO: 121338 - RNA, 22 nt, Human
ggaugcauggggcucuggggga

SEQ ID NO: 121339 - RNA, 26 nt, Human
ugggaaaauauugaaaaggacagagu

SEQ ID NO: 121340 - RNA, 22 nt, Human
agcuaauuuucaaauuuuuugu

SEQ ID NO: 121341 - RNA, 18 nt, Human
accucucaaaacgaaaca

SEQ ID NO: 121342 - RNA, 26 nt, Human
gagguuagaaggcacagguggcgaga

SEQ ID NO: 121343 - RNA, 24 nt, Human
uagcucaucuaguuccucuucuua

SEQ ID NO: 121344 - RNA, 26 nt, Human
ucucauaaauguggaauaacauuugu

SEQ ID NO: 121345 - RNA, 24 nt, Human
uggaaacacuggagucagaacuga

SEQ ID NO: 121346 - RNA, 19 nt, Human
gcagggcucccagggcugu

SEQ ID NO: 121347 - RNA, 26 nt, Human
uugcagaaagagcgucaguuucaccu

SEQ ID NO: 121348 - RNA, 20 nt, Human
ccacagaaaaccauucuuua

SEQ ID NO: 121349 - RNA, 22 nt, Human
aucauuucuuauaucuuauuca

SEQ ID NO: 121350 - RNA, 24 nt, Human
gugcuuugaaaugcagaaguuuau

SEQ ID NO: 121351 - RNA, 19 nt, Human
gacaagugcuuugaaaugc

SEQ ID NO: 121352 - RNA, 23 nt, Human
ccuuugccaccauaauggcccac

SEQ ID NO: 121353 - RNA, 24 nt, Human
ccuccaucugguccguacccucgc

SEQ ID NO: 121354 - RNA, 20 nt, Human
ucaggcugagcugaauguag

SEQ ID NO: 121355 - RNA, 21 nt, Human
cuggcaugguggauguuuuca

SEQ ID NO: 121356 - RNA, 22 nt, Human
aucuguucccagccccuccucc

SEQ ID NO: 121357 - RNA, 23 nt, Human
ucuggucccaggacauucuacca

SEQ ID NO: 121358 - RNA, 19 nt, Human
gcaugcaccagcucuuuca

SEQ ID NO: 121359 - RNA, 21 nt, Human
cacagcccuuccuacaagcac

SEQ ID NO: 121360 - RNA, 20 nt, Human
aaaacucagagaaucaaaga

SEQ ID NO: 121361 - RNA, 19 nt, Human
agagagaaacgguccuuug

SEQ ID NO: 121362 - RNA, 22 nt, Human
ggaggagaaugagcagcuuuga

SEQ ID NO: 121363 - RNA, 26 nt, Human
gcacagcccugcauguacuagcaccu

SEQ ID NO: 121364 - RNA, 23 nt, Human
cgaccacgcugucccaggcacag

SEQ ID NO: 121365 - RNA, 19 nt, Human
ccagaagcucaaggcugca

SEQ ID NO: 121366 - RNA, 21 nt, Human
cgggaccuggcuucauuugga

SEQ ID NO: 121367 - RNA, 24 nt, Human
gaaaugacacagaaggcuuuaagu

SEQ ID NO: 121368 - RNA, 28 nt, Human
ccaggacagaacuuuccccaauuacagg

SEQ ID NO: 121369 - RNA, 23 nt, Human
cugauguuuuuuaaaaagggaua

SEQ ID NO: 121370 - RNA, 22 nt, Human
acaacauggugcuacuucuucu

SEQ ID NO: 121371 - RNA, 22 nt, Human
ggggaauaaaugggucacugga

SEQ ID NO: 121372 - RNA, 27 nt, Human
uuggccaggcuggagugcaguaagugg

SEQ ID NO: 121373 - RNA, 23 nt, Human
cauguauaccuggauuugcuugg

SEQ ID NO: 121374 - RNA, 25 nt, Human
cccaggugaugucuggucaacuggc

SEQ ID NO: 121375 - RNA, 21 nt, Human
uuccugcgcuguuccaccuca

SEQ ID NO: 121376 - RNA, 20 nt, Human
cuuccagccaccugccucaa

SEQ ID NO: 121377 - RNA, 24 nt, Human
aggagggagacagacuggccaggc

SEQ ID NO: 121378 - RNA, 21 nt, Human
uguacuccucuuuacacuggc

SEQ ID NO: 121379 - RNA, 17 nt, Human
agagugagaccagcaga

SEQ ID NO: 121380 - RNA, 22 nt, Human
aggcugaggcagguggaucacu

SEQ ID NO: 121381 - RNA, 22 nt, Human
aggcugaggcaggaggaucaca

SEQ ID NO: 121382 - RNA, 22 nt, Human
aggcugaggcaggcggaucacc

SEQ ID NO: 121383 - RNA, 21 nt, Human
uuuuccucugcuuugaaagcc

SEQ ID NO: 121384 - RNA, 22 nt, Human
gcuuccucucucaggagcaggg

SEQ ID NO: 121385 - RNA, 19 nt, Human
uguggucugcaagugcuuc

SEQ ID NO: 121386 - RNA, 22 nt, Human
cucaggcuggugccagccuuuc

SEQ ID NO: 121387 - RNA, 23 nt, Human
uggggagacagagaccaagagca

SEQ ID NO: 121388 - RNA, 20 nt, Human
uucuuucuucagcuuucuga

SEQ ID NO: 121389 - RNA, 27 nt, Human
uuguacagauguuugugccuuuucuuu

SEQ ID NO: 121390 - RNA, 29 nt, Human
ggcuggggugcuggggcuugggguggccc

SEQ ID NO: 121391 - RNA, 21 nt, Human
uauuccucaaaauaacaucaa

SEQ ID NO: 121392 - RNA, 21 nt, Human
uuuuucuguuaucauaauuuu

SEQ ID NO: 121393 - RNA, 21 nt, Human
aguaaggccaguugagcauug

SEQ ID NO: 121394 - RNA, 21 nt, Human
cacgccuguaauccagcacuu

SEQ ID NO: 121395 - RNA, 25 nt, Human
caguuucauugauugacucuaccuc

SEQ ID NO: 121396 - RNA, 22 nt, Human
uuuuguuguuuuguuauuuacu

SEQ ID NO: 121397 - RNA, 24 nt, Human
ccccggaaccucaggggcugccga

SEQ ID NO: 121398 - RNA, 27 nt, Human
ugacauuuugccacuggaacacuaaac

SEQ ID NO: 121399 - RNA, 21 nt, Human
ucauacagcacaagagaaaac

SEQ ID NO: 121400 - RNA, 22 nt, Human
aaggcaggguuuguauugucag

SEQ ID NO: 121401 - RNA, 23 nt, Human
ggcauaagguugaaaagcauuuu

SEQ ID NO: 121402 - RNA, 18 nt, Human
cauauuucaagugcucaa

SEQ ID NO: 121403 - RNA, 25 nt, Human
uugaccgagagcaggcuggagcagc

SEQ ID NO: 121404 - RNA, 17 nt, Human
cacuuccuagagcaucu

SEQ ID NO: 121405 - RNA, 22 nt, Human
ugaacuccugagcucaagugau

SEQ ID NO: 121406 - RNA, 28 nt, Human
gugaccacaggcugguguguagguggua

SEQ ID NO: 121407 - RNA, 25 nt, Human
uacaggucuuuaucuuuaauauuuu

SEQ ID NO: 121408 - RNA, 16 nt, Human
cuucccuuugaugccc

SEQ ID NO: 121409 - RNA, 22 nt, Human
acuuaggaccauuugagcuugu

SEQ ID NO: 121410 - RNA, 22 nt, Human
ucccaggcuggagugcaguggc

SEQ ID NO: 121411 - RNA, 20 nt, Human
ggauguguaaauggagcuug

SEQ ID NO: 121412 - RNA, 22 nt, Human
ccuuucucuuaugcuuaaggcu

SEQ ID NO: 121413 - RNA, 21 nt, Human
ugucccuucccaucaguuuga

SEQ ID NO: 121414 - RNA, 21 nt, Human
ucuuuguuuaucucugagaca

SEQ ID NO: 121415 - RNA, 25 nt, Human
gauuccagcuuucugcuuccugagg

SEQ ID NO: 121416 - RNA, 17 nt, Human
uauuuaugauguuaaca

SEQ ID NO: 121417 - RNA, 21 nt, Human
uuucuuucuuucuuuuuugau

SEQ ID NO: 121418 - RNA, 24 nt, Human
gguuuuuaacagaacguguauuua

SEQ ID NO: 121419 - RNA, 21 nt, Human
ggucacugcauuuuuaccuga

SEQ ID NO: 121420 - RNA, 22 nt, Human
uuguauauacaguuauuuugga

SEQ ID NO: 121421 - RNA, 26 nt, Human
ucauucucacccauuuggcuaaucca

SEQ ID NO: 121422 - RNA, 23 nt, Human
ugcaaaaaaugcuuuguuugccc

SEQ ID NO: 121423 - RNA, 20 nt, Human
cggcaagcccagcgaggagg

SEQ ID NO: 121424 - RNA, 23 nt, Human
agcaacaaaauauuuauucuacu

SEQ ID NO: 121425 - RNA, 22 nt, Human
uugccaccauaauggcccacac

SEQ ID NO: 121426 - RNA, 19 nt, Human
uaucacuuaauuguuaaca

SEQ ID NO: 121427 - RNA, 18 nt, Human
aauuuuguuuaagcaauu

SEQ ID NO: 121428 - RNA, 19 nt, Human
cacuaguaaaacugccuuc

SEQ ID NO: 121429 - RNA, 24 nt, Human
aauguauuugauguauucugugau

SEQ ID NO: 121430 - RNA, 23 nt, Human
cuucauagaccacugaguucuag

SEQ ID NO: 121431 - RNA, 23 nt, Human
ggggcagccacgggccgggggua

SEQ ID NO: 121432 - RNA, 23 nt, Human
cacaaggucacuagauggcgagc

SEQ ID NO: 121433 - RNA, 18 nt, Human
agcucagucccaucagag

SEQ ID NO: 121434 - RNA, 21 nt, Human
ugggugagacagagggaaagg

SEQ ID NO: 121435 - RNA, 22 nt, Human
aauucccagggaagugcucuga

SEQ ID NO: 121436 - RNA, 21 nt, Human
gcuuaucaaucccaaacucug

SEQ ID NO: 121437 - RNA, 24 nt, Human
cuaaccuuugagaucacucagcuc

SEQ ID NO: 121438 - RNA, 23 nt, Human
cccaccccugacagcccccaccc

SEQ ID NO: 121439 - RNA, 24 nt, Human
ugugaacaccaucaugccuuuaua

SEQ ID NO: 121440 - RNA, 22 nt, Human
uauguuuugcucaucuaacuuc

SEQ ID NO: 121441 - RNA, 23 nt, Human
ucuaaaacaguccuucaaacuuc

SEQ ID NO: 121442 - RNA, 15 nt, Human
gcccagcacagccuu

SEQ ID NO: 121443 - RNA, 21 nt, Human
ugcgagugcagagaagguggg

SEQ ID NO: 121444 - RNA, 24 nt, Human
augaucuuggcucacugcaacguc

SEQ ID NO: 121445 - RNA, 21 nt, Human
cagggggagggggagagagca

SEQ ID NO: 121446 - RNA, 21 nt, Human
gcccccuccugcacagccacc

SEQ ID NO: 121447 - RNA, 22 nt, Human
ccaaguaguugggauugcaggc

SEQ ID NO: 121448 - RNA, 26 nt, Human
cuacccuugugagagucaaggcacag

SEQ ID NO: 121449 - RNA, 21 nt, Human
caguccggcucacugcaguuu

SEQ ID NO: 121450 - RNA, 22 nt, Human
cuuugcaguucagucuaagucu

SEQ ID NO: 121451 - RNA, 27 nt, Human
cuguguaccacuucugugggcauggcc

SEQ ID NO: 121452 - RNA, 24 nt, Human
agaccucccugaccccgcccuuuu

SEQ ID NO: 121453 - RNA, 17 nt, Human
ggccucggagcaccagu

SEQ ID NO: 121454 - RNA, 24 nt, Human
ggaaccuacuuucugcucagugag

SEQ ID NO: 121455 - RNA, 24 nt, Human
ggcugucauuucaaaaguggaaua

SEQ ID NO: 121456 - RNA, 26 nt, Human
cuggcacccacugcuacacucagccu

SEQ ID NO: 121457 - RNA, 22 nt, Human
gggaggcagagccagcaggugg

SEQ ID NO: 121458 - RNA, 23 nt, Human
ugaguagcugggauuacaggcac

SEQ ID NO: 121459 - RNA, 23 nt, Human
auuugugauugaaagcacuuuag

SEQ ID NO: 121460 - RNA, 32 nt, Human
uggcagaacugggccgccucucugguugacaa

SEQ ID NO: 121461 - RNA, 20 nt, Human
uuugcagcugcaccuauggg

SEQ ID NO: 121462 - RNA, 21 nt, Human
uauggaaucuauuucugucug

SEQ ID NO: 121463 - RNA, 20 nt, Human
uuucagucauucacuguuuu

SEQ ID NO: 121464 - RNA, 21 nt, Human
gugcucucaugggcucaccug

SEQ ID NO: 121465 - RNA, 21 nt, Human
auuucucgaugugcacuguga

SEQ ID NO: 121466 - RNA, 25 nt, Human
uggguggauuaauuuggaaaaagaa

SEQ ID NO: 121467 - RNA, 26 nt, Human
cuguggacuucuggaauuaccaacag

SEQ ID NO: 121468 - RNA, 23 nt, Human
ugccuguaaauuucagcaagccg

SEQ ID NO: 121469 - RNA, 19 nt, Human
cuucucaccugcuccucua

SEQ ID NO: 121470 - RNA, 25 nt, Human
gcuccaguauguguaccaucuugua

SEQ ID NO: 121471 - RNA, 20 nt, Human
uccaagugcagcaacccagc

SEQ ID NO: 121472 - RNA, 27 nt, Human
ggccagccuggcccugagcugcuggau

SEQ ID NO: 121473 - RNA, 20 nt, Human
ugggagccaugggggagcuc

SEQ ID NO: 121474 - RNA, 24 nt, Human
cacucacucgcagucauuuauuua

SEQ ID NO: 121475 - RNA, 22 nt, Human
gauacuuggaugcagcucuugg

SEQ ID NO: 121476 - RNA, 25 nt, Human
gaaucaaccggaccuguugcuagca

SEQ ID NO: 121477 - RNA, 21 nt, Human
ccaagccccgcccucagaaag

SEQ ID NO: 121478 - RNA, 23 nt, Human
gccauggccgaagggggagaagg

SEQ ID NO: 121479 - RNA, 23 nt, Human
cuggccuggcccggccccgccgc

SEQ ID NO: 121480 - RNA, 27 nt, Human
gcagccgccacauucaacaggcagcag

SEQ ID NO: 121481 - RNA, 23 nt, Human
gccauucuguuagauacuauccu

SEQ ID NO: 121482 - RNA, 22 nt, Human
aucacaccccauuuccuccucu

SEQ ID NO: 121483 - RNA, 24 nt, Human
uaaguauuuuaaaaauaaauggca

SEQ ID NO: 121484 - RNA, 23 nt, Human
ggagagaagagcucaggagaugg

SEQ ID NO: 121485 - RNA, 24 nt, Human
ugguacagcuguguggugcuucug

SEQ ID NO: 121486 - RNA, 32 nt, Human
guuucuucacugacaauacugaauaaacaucu

SEQ ID NO: 121487 - RNA, 24 nt, Human
ccauuucccauuuccuuuucuucc

SEQ ID NO: 121488 - RNA, 27 nt, Human
uagcacugaacaaacaaaaaacaaaac

SEQ ID NO: 121489 - RNA, 27 nt, Human
ucuccaauuuucuuguauucccuacaa

SEQ ID NO: 121490 - RNA, 19 nt, Human
uccccugggagcuucuuag

SEQ ID NO: 121491 - RNA, 26 nt, Human
gggaccagggcuuuagggcucacgga

SEQ ID NO: 121492 - RNA, 21 nt, Human
aguuggggaggcucaaaccau

SEQ ID NO: 121493 - RNA, 20 nt, Human
gcaugaaucacugugcucag

SEQ ID NO: 121494 - RNA, 24 nt, Human
agacccccugacucccaugcugug

SEQ ID NO: 121495 - RNA, 28 nt, Human
ccgcuacaauucugcagaaaaagaaugu

SEQ ID NO: 121496 - RNA, 25 nt, Human
gugcucuggcuuuccauuggcuucc

SEQ ID NO: 121497 - RNA, 20 nt, Human
ucuccuuuuucuugugcugc

SEQ ID NO: 121498 - RNA, 23 nt, Human
agacaaaagugguuuugcaccaa

SEQ ID NO: 121499 - RNA, 20 nt, Human
gcaaaacuauuuauugacuu

SEQ ID NO: 121500 - RNA, 22 nt, Human
gugccccagcacaagaggcacu

SEQ ID NO: 121501 - RNA, 20 nt, Human
auuauuuaauucuuaagaug

SEQ ID NO: 121502 - RNA, 23 nt, Human
uuccccuucagugucucagagga

SEQ ID NO: 121503 - RNA, 19 nt, Human
gcuuucacuggucugcacc

SEQ ID NO: 121504 - RNA, 19 nt, Human
gugcccaucaagugcaguc

SEQ ID NO: 121505 - RNA, 21 nt, Human
uggcccagucgcuggccugag

SEQ ID NO: 121506 - RNA, 28 nt, Human
ccucuucccagguucccuggccccuucg

SEQ ID NO: 121507 - RNA, 24 nt, Human
cgcugggagccggaggcgcgggga

SEQ ID NO: 121508 - RNA, 23 nt, Human
ccguccugucagcuccuugaccu

SEQ ID NO: 121509 - RNA, 20 nt, Human
uccccaaggccucucucugc

SEQ ID NO: 121510 - RNA, 20 nt, Human
auuucaggcagguguaacag

SEQ ID NO: 121511 - RNA, 20 nt, Human
ucucugcugccuccuuccuu

SEQ ID NO: 121512 - RNA, 27 nt, Human
gcaauaacugagcuugauggggguggg

SEQ ID NO: 121513 - RNA, 22 nt, Human
cccuaucaucaguuaggauuag

SEQ ID NO: 121514 - RNA, 25 nt, Human
uugcuuuaauuccaugaauguuccu

SEQ ID NO: 121515 - RNA, 20 nt, Human
gccucaagggagcuggcugg

SEQ ID NO: 121516 - RNA, 27 nt, Human
ccauauuccaucaccuuccuccucugc

SEQ ID NO: 121517 - RNA, 21 nt, Human
auuaucuccccugcaaagccc

SEQ ID NO: 121518 - RNA, 21 nt, Human
auuucaggauuauuguauuua

SEQ ID NO: 121519 - RNA, 21 nt, Human
aaaacaauaaaauaguaugua

SEQ ID NO: 121520 - RNA, 24 nt, Human
gggcagcagggugugugcauauga

SEQ ID NO: 121521 - RNA, 22 nt, Human
cuccccaggcagccuggggaac

SEQ ID NO: 121522 - RNA, 21 nt, Human
aagggagggggagagggcugc

SEQ ID NO: 121523 - RNA, 19 nt, Human
uccccagccagcaucccca

SEQ ID NO: 121524 - RNA, 26 nt, Human
uuaggcugaaguggcuuagaaggccu

SEQ ID NO: 121525 - RNA, 20 nt, Human
cuguuuucauuuccuguugg

SEQ ID NO: 121526 - RNA, 20 nt, Human
cucaggaggcugagguagga

SEQ ID NO: 121527 - RNA, 22 nt, Human
uuagcuuucagaaagcuaauga

SEQ ID NO: 121528 - RNA, 26 nt, Human
ucacccaggcugccaggcuggagugg

SEQ ID NO: 121529 - RNA, 30 nt, Human
ccuaccccuuccuguccugccuccucauca

SEQ ID NO: 121530 - RNA, 18 nt, Human
acuugccaccaccgucac

SEQ ID NO: 121531 - RNA, 21 nt, Human
ggucaagcaucuucggccgau

SEQ ID NO: 121532 - RNA, 22 nt, Human
uuagaaaugagaaaaauacaga

SEQ ID NO: 121533 - RNA, 25 nt, Human
ccucuuucuucauaguccucaggcu

SEQ ID NO: 121534 - RNA, 21 nt, Human
gacucacugcaaaaucugccu

SEQ ID NO: 121535 - RNA, 23 nt, Human
agaaauucugaauaucaaaggca

SEQ ID NO: 121536 - RNA, 27 nt, Human
caagugacugagcacuuccuggggagc

SEQ ID NO: 121537 - RNA, 21 nt, Human
aacuucugagcucaagcgauc

SEQ ID NO: 121538 - RNA, 26 nt, Human
gguggcugagccccugucuagagagg

SEQ ID NO: 121539 - RNA, 22 nt, Human
cccaaagcuccccaagcaucaa

SEQ ID NO: 121540 - RNA, 22 nt, Human
gacacuuuuauaucuucuuuau

SEQ ID NO: 121541 - RNA, 24 nt, Human
agauaugggacauuuuugacuccc

SEQ ID NO: 121542 - RNA, 27 nt, Human
cucaacaacaggaaaggcagguccuuu

SEQ ID NO: 121543 - RNA, 19 nt, Human
cuucccuucaugccuauca

SEQ ID NO: 121544 - RNA, 25 nt, Human
gugggaccagggccaggguuccaaa

SEQ ID NO: 121545 - RNA, 20 nt, Human
gucuuacaaaugugaagaau

SEQ ID NO: 121546 - RNA, 22 nt, Human
caguucugcaggcuguauggga

SEQ ID NO: 121547 - RNA, 20 nt, Human
aagcuucaagagaucuagga

SEQ ID NO: 121548 - RNA, 20 nt, Human
uacuccugccacacagcccg

SEQ ID NO: 121549 - RNA, 23 nt, Human
aaaaacaaaaacaucaaugagua

SEQ ID NO: 121550 - RNA, 21 nt, Human
aggcuggaagaaaggacagaa

SEQ ID NO: 121551 - RNA, 26 nt, Human
ccaugcaggacagggucuccugcugc

SEQ ID NO: 121552 - RNA, 26 nt, Human
ugggguaggaggaugggcucgcccac

SEQ ID NO: 121553 - RNA, 25 nt, Human
ugguggcgggcaccuguagucgcag

SEQ ID NO: 121554 - RNA, 21 nt, Human
cacaggcagaauagcuuucga

SEQ ID NO: 121555 - RNA, 29 nt, Human
ggcuccuccucccacucugcuccuccucu

SEQ ID NO: 121556 - RNA, 21 nt, Human
ucagaaauucaaaaacucaga

SEQ ID NO: 121557 - RNA, 21 nt, Human
ugcuccacccccaucccacuc

SEQ ID NO: 121558 - RNA, 26 nt, Human
acuguacuguguagugugucuccgua

SEQ ID NO: 121559 - RNA, 18 nt, Human
cccugcagccugggucug

SEQ ID NO: 121560 - RNA, 21 nt, Human
cugaggagacguggagaggag

SEQ ID NO: 121561 - RNA, 22 nt, Human
ggccuguggaguaggucccucu

SEQ ID NO: 121562 - RNA, 20 nt, Human
auguuaaccaggauggucuc

SEQ ID NO: 121563 - RNA, 20 nt, Human
cccagcaccuggacaucucu

SEQ ID NO: 121564 - RNA, 23 nt, Human
aggcuguagugcaguggcacgau

SEQ ID NO: 121565 - RNA, 25 nt, Human
guaggggaggggcgucuggagagga

SEQ ID NO: 121566 - RNA, 29 nt, Human
aggguuugagaagcccaccccucuaauuc

SEQ ID NO: 121567 - RNA, 20 nt, Human
ccucacugcgcaugcuccuu

SEQ ID NO: 121568 - RNA, 18 nt, Human
aaccuauaccacauccaa

SEQ ID NO: 121569 - RNA, 23 nt, Human
gaccuccaccuucaacccccgag

SEQ ID NO: 121570 - RNA, 24 nt, Human
ucaguccuucaccuaccucgccac

SEQ ID NO: 121571 - RNA, 22 nt, Human
gaacuccuggcaucaagcgauc

SEQ ID NO: 121572 - RNA, 20 nt, Human
guggcugcagagccugcugc

SEQ ID NO: 121573 - RNA, 22 nt, Human
cccugagagggaaucuggugag

SEQ ID NO: 121574 - RNA, 21 nt, Human
accacccaggcuugaggcagc

SEQ ID NO: 121575 - RNA, 23 nt, Human
uaggcuaagcaaaaagaugcugg

SEQ ID NO: 121576 - RNA, 21 nt, Human
uaaccagcuaaucauuuaucc

SEQ ID NO: 121577 - RNA, 20 nt, Human
guuguuuccccuccuuccca

SEQ ID NO: 121578 - RNA, 28 nt, Human
gcaggccucugcugcagcuuuuucucuc

SEQ ID NO: 121579 - RNA, 25 nt, Human
agaggcuuggaaagccuugugucuu

SEQ ID NO: 121580 - RNA, 23 nt, Human
aaguggauauacaaccucagcaa

SEQ ID NO: 121581 - RNA, 27 nt, Human
ucccuccaagcccccgaugcggagcua

SEQ ID NO: 121582 - RNA, 22 nt, Human
uguauagacaucugcccugacu

SEQ ID NO: 121583 - RNA, 27 nt, Human
caggcuggagugcaguggcaugaucau

SEQ ID NO: 121584 - RNA, 27 nt, Human
caugcuggagggcagugguaugaucac

SEQ ID NO: 121585 - RNA, 23 nt, Human
cauugccauuuuuaauucauucu

SEQ ID NO: 121586 - RNA, 21 nt, Human
gacuugcccaucuagcacuuu

SEQ ID NO: 121587 - RNA, 21 nt, Human
cuugcuuucaagaugaugacc

SEQ ID NO: 121588 - RNA, 23 nt, Human
ccaucugcacagagguccuggcu

SEQ ID NO: 121589 - RNA, 21 nt, Human
caugcaaaugcaaauggucaa

SEQ ID NO: 121590 - RNA, 19 nt, Human
ggaagaggaagagugcaaa

SEQ ID NO: 121591 - RNA, 24 nt, Human
caugccaccuaugccacagugccu

SEQ ID NO: 121592 - RNA, 22 nt, Human
guggggagacucggugggugaa

SEQ ID NO: 121593 - RNA, 20 nt, Human
ccagagauugccuggaacac

SEQ ID NO: 121594 - RNA, 26 nt, Human
ccuuucucccaccaguugguggaggc

SEQ ID NO: 121595 - RNA, 22 nt, Human
ggcuuagcagacuugcgcugca

SEQ ID NO: 121596 - RNA, 25 nt, Human
ucagaagaaaggagcaaguuuugcg

SEQ ID NO: 121597 - RNA, 23 nt, Human
cccugcuccccacacggaggacc

SEQ ID NO: 121598 - RNA, 25 nt, Human
gacaguuuuuccggcaaaauuugua

SEQ ID NO: 121599 - RNA, 25 nt, Human
uugcccagguuucuggucucuaggc

SEQ ID NO: 121600 - RNA, 22 nt, Human
caccuauaaccccagcacuuug

SEQ ID NO: 121601 - RNA, 19 nt, Human
gggcucucccuuugcuucu

SEQ ID NO: 121602 - RNA, 25 nt, Human
aaaauacaaaaauuagccuggcgug

SEQ ID NO: 121603 - RNA, 22 nt, Human
cccucugcauccucuggagcca

SEQ ID NO: 121604 - RNA, 27 nt, Human
cgcgccgcggaccucacaccugcgcag

SEQ ID NO: 121605 - RNA, 29 nt, Human
ugccccaucuccccgcagcugcggcgcug

SEQ ID NO: 121606 - RNA, 22 nt, Human
cugaaccucccaaguagcuggg

SEQ ID NO: 121607 - RNA, 19 nt, Human
acccccacucacagucacc

SEQ ID NO: 121608 - RNA, 22 nt, Human
gacgggguuucagcauguuggc

SEQ ID NO: 121609 - RNA, 22 nt, Human
gacgggguuucaccauguugcc

SEQ ID NO: 121610 - RNA, 23 nt, Human
guuacccaggguggagugcagug

SEQ ID NO: 121611 - RNA, 27 nt, Human
gugucucucgcuauuucugcugcuguu

SEQ ID NO: 121612 - RNA, 25 nt, Human
cccaucucugcucccacccuugccu

SEQ ID NO: 121613 - RNA, 21 nt, Human
gcccaguuaauuugcacagaa

SEQ ID NO: 121614 - RNA, 25 nt, Human
gcugggagaggcugaggauggcagg

SEQ ID NO: 121615 - RNA, 23 nt, Human
ucugccugcccugcccuuggggc

SEQ ID NO: 121616 - RNA, 21 nt, Human
uuccauuugcugauugucuga

SEQ ID NO: 121617 - RNA, 17 nt, Human
caguuuucacaguuuca

SEQ ID NO: 121618 - RNA, 19 nt, Human
gggcagcaggagcgguaga

SEQ ID NO: 121619 - RNA, 21 nt, Human
aaggcuaguuuauuuuguuac

SEQ ID NO: 121620 - RNA, 23 nt, Human
ccaucuccugauuucucugaaca

SEQ ID NO: 121621 - RNA, 21 nt, Human
agccgcgagggcaucuugccu

SEQ ID NO: 121622 - RNA, 22 nt, Human
ugugauggggcagccuugggga

SEQ ID NO: 121623 - RNA, 23 nt, Human
gggguccaccccaagaagaaaga

SEQ ID NO: 121624 - RNA, 21 nt, Human
uggcccaggcuggagugcagu

SEQ ID NO: 121625 - RNA, 25 nt, Human
ggcagagcugcggcacagggccugg

SEQ ID NO: 121626 - RNA, 26 nt, Human
uccuccuagcuggagugccauggcug

SEQ ID NO: 121627 - RNA, 25 nt, Human
ggccucccacuccuguuccuugcua

SEQ ID NO: 121628 - RNA, 26 nt, Human
caauauuaucuuucuuaacuuuuucc

SEQ ID NO: 121629 - RNA, 21 nt, Human
agagucaccuaugacaaaaaa

SEQ ID NO: 121630 - RNA, 25 nt, Human
aaccgggcuggagugcaguggugca

SEQ ID NO: 121631 - RNA, 23 nt, Human
guggguggaaauauuccucugag

SEQ ID NO: 121632 - RNA, 27 nt, Human
gagaugagagaggugccuucucuguau

SEQ ID NO: 121633 - RNA, 20 nt, Human
ccaagaaccuguuuccugga

SEQ ID NO: 121634 - RNA, 24 nt, Human
auucauuuauugcuaucugaggcc

SEQ ID NO: 121635 - RNA, 25 nt, Human
cccgaccaccuccuccucugccuca

SEQ ID NO: 121636 - RNA, 22 nt, Human
ugggcaaacccuucucuucucc

SEQ ID NO: 121637 - RNA, 20 nt, Human
augacucucccugucugugg

SEQ ID NO: 121638 - RNA, 18 nt, Human
uuggcagcagcaguagga

SEQ ID NO: 121639 - RNA, 26 nt, Human
auggacaagugacacuguggacaaug

SEQ ID NO: 121640 - RNA, 24 nt, Human
gcaugcccucucugagucuggacu

SEQ ID NO: 121641 - RNA, 23 nt, Human
gaagcaguuacuuucuguggaag

SEQ ID NO: 121642 - RNA, 22 nt, Human
ccaagauggcgccauugcacuc

SEQ ID NO: 121643 - RNA, 27 nt, Human
cauggcagagaugaggagguuuggcac

SEQ ID NO: 121644 - RNA, 24 nt, Human
ucuuaaaccacaccgaggugucua

SEQ ID NO: 121645 - RNA, 17 nt, Human
uuuuccuuuccuagcca

SEQ ID NO: 121646 - RNA, 23 nt, Human
gccaggcuccaucucacuggcuc

SEQ ID NO: 121647 - RNA, 24 nt, Human
aucugccauggcaacaggcuuuaa

SEQ ID NO: 121648 - RNA, 25 nt, Human
gugaaugucauucacaacagaaaac

SEQ ID NO: 121649 - RNA, 26 nt, Human
gcauugaagccacagguggggcaagg

SEQ ID NO: 121650 - RNA, 27 nt, Human
ugccuguaaacauagauucgcuuucca

SEQ ID NO: 121651 - RNA, 19 nt, Human
gcacuaggaagugaauccc

SEQ ID NO: 121652 - RNA, 22 nt, Human
ccuauggucuucuccauccuca

SEQ ID NO: 121653 - RNA, 24 nt, Human
gucuagcuuaaaccuacuaccuca

SEQ ID NO: 121654 - RNA, 26 nt, Human
ugagccaagaucgcgcuauugcacuc

SEQ ID NO: 121655 - RNA, 23 nt, Human
agccccagaucgcuuuacuccag

SEQ ID NO: 121656 - RNA, 23 nt, Human
ucuauagucuaguauaguuuaca

SEQ ID NO: 121657 - RNA, 20 nt, Human
gccacaacugucuagggcuc

SEQ ID NO: 121658 - RNA, 22 nt, Human
uccagcaccugcggggcccucg

SEQ ID NO: 121659 - RNA, 20 nt, Human
guauugagacacugucaaga

SEQ ID NO: 121660 - RNA, 24 nt, Human
ccuuccugccccaccccauuccuu

SEQ ID NO: 121661 - RNA, 22 nt, Human
guaucaguauuuucacacguaa

SEQ ID NO: 121662 - RNA, 21 nt, Human
gcuuucugauguugccuuaau

SEQ ID NO: 121663 - RNA, 26 nt, Human
ccuguaaucccagcacuuuagaucac

SEQ ID NO: 121664 - RNA, 22 nt, Human
agaccagccugggcagcauggu

SEQ ID NO: 121665 - RNA, 27 nt, Human
ggggccucucuagcuugcggccugugu

SEQ ID NO: 121666 - RNA, 22 nt, Human
acaauaaaucugcagagauuga

SEQ ID NO: 121667 - RNA, 22 nt, Human
ccucagauaaguauuuguacuu

SEQ ID NO: 121668 - RNA, 21 nt, Human
cccuuguuugcacagcauuaa

SEQ ID NO: 121669 - RNA, 22 nt, Human
uuaagacugaagauggaaaaag

SEQ ID NO: 121670 - RNA, 26 nt, Human
uucucaucuugccucauuuugcuucc

SEQ ID NO: 121671 - RNA, 22 nt, Human
ucugcauggaccucuguggacc

SEQ ID NO: 121672 - RNA, 20 nt, Human
gaaagggagagaagauuggc

SEQ ID NO: 121673 - RNA, 22 nt, Human
cacugaugcugccucugccuuc

SEQ ID NO: 121674 - RNA, 21 nt, Human
agccuccccacagcugguaau

SEQ ID NO: 121675 - RNA, 28 nt, Human
uauccuguuaacacuguaauaucuuuaa

SEQ ID NO: 121676 - RNA, 23 nt, Human
cugagauacugaagugcagcuca

SEQ ID NO: 121677 - RNA, 25 nt, Human
ggcaauauaaggaaagugauccaaa

SEQ ID NO: 121678 - RNA, 24 nt, Human
ugaagccagaagcugugggcugug

SEQ ID NO: 121679 - RNA, 24 nt, Human
uccuuuuaggagaucaugguguca

SEQ ID NO: 121680 - RNA, 22 nt, Human
gguggaggcaggguagggcagg

SEQ ID NO: 121681 - RNA, 24 nt, Human
uacaugguguuucgaagccagcaa

SEQ ID NO: 121682 - RNA, 26 nt, Human
gcaagugucuugugauaggcaguccc

SEQ ID NO: 121683 - RNA, 21 nt, Human
uugcucuuguucuuaaauuau

SEQ ID NO: 121684 - RNA, 22 nt, Human
gagugugcaaaccuugacauua

SEQ ID NO: 121685 - RNA, 22 nt, Human
gggauuacaggccugagccacc

SEQ ID NO: 121686 - RNA, 26 nt, Human
ccugggaaaagacaguuacucacggg

SEQ ID NO: 121687 - RNA, 22 nt, Human
uucaagcuauucuacugccuca

SEQ ID NO: 121688 - RNA, 21 nt, Human
aaaacauauuugugacuuuaa

SEQ ID NO: 121689 - RNA, 24 nt, Human
cacacaguauuuauuguucccaca

SEQ ID NO: 121690 - RNA, 26 nt, Human
gcagucugugcugugugucugggccu

SEQ ID NO: 121691 - RNA, 20 nt, Human
gggcucugguggcugucacg

SEQ ID NO: 121692 - RNA, 22 nt, Human
gagcaccugaccaaaggcuuca

SEQ ID NO: 121693 - RNA, 21 nt, Human
uuuauuggaguguuuuuguuu

SEQ ID NO: 121694 - RNA, 28 nt, Human
uuuuauuugcaaaacaaggaaauaaagg

SEQ ID NO: 121695 - RNA, 24 nt, Human
ucccagcccaggagaacuaagagc

SEQ ID NO: 121696 - RNA, 27 nt, Human
uuuuccccuggcaguggacauggcugc

SEQ ID NO: 121697 - RNA, 26 nt, Human
cuggggccuuuuguuuuggauccugg

SEQ ID NO: 121698 - RNA, 25 nt, Human
gaggaguccgagugugugagcuuga

SEQ ID NO: 121699 - RNA, 20 nt, Human
cuugcuccuguucucagccu

SEQ ID NO: 121700 - RNA, 28 nt, Human
ccugcaguggaauggcuccuaaucaggg

SEQ ID NO: 121701 - RNA, 21 nt, Human
cccuuuuccagccucagccua

SEQ ID NO: 121702 - RNA, 20 nt, Human
aacccccagaaucagcucuu

SEQ ID NO: 121703 - RNA, 31 nt, Human
ucuucaaugcuuccuccuuggaagagggcga

SEQ ID NO: 121704 - RNA, 17 nt, Human
uuugccuccagugcagu

SEQ ID NO: 121705 - RNA, 27 nt, Human
acaacucagcaaugacacaagaagaga

SEQ ID NO: 121706 - RNA, 22 nt, Human
ccggcucuaagagaaaggccca

SEQ ID NO: 121707 - RNA, 26 nt, Human
cggccuaaaagccucuuuguggcuga

SEQ ID NO: 121708 - RNA, 22 nt, Human
caccuguaaucccagaacuuug

SEQ ID NO: 121709 - RNA, 28 nt, Human
cccuaggcaucacaugcucaaugacucu

SEQ ID NO: 121710 - RNA, 21 nt, Human
ccaucaccuucucaacuggga

SEQ ID NO: 121711 - RNA, 26 nt, Human
gcugucagugcuucucucacuccuua

SEQ ID NO: 121712 - RNA, 25 nt, Human
uuccaccaggagucuggagugcaau

SEQ ID NO: 121713 - RNA, 20 nt, Human
ccuccugccaguccuucgcc

SEQ ID NO: 121714 - RNA, 23 nt, Human
guucccaucucaucugucagcca

SEQ ID NO: 121715 - RNA, 24 nt, Human
aaagggagaacauggccaauaguc

SEQ ID NO: 121716 - RNA, 25 nt, Human
gagugacaguuuguuaaaaagcuuu

SEQ ID NO: 121717 - RNA, 21 nt, Human
ucagaccugcuguacaaccua

SEQ ID NO: 121718 - RNA, 20 nt, Human
cuggucuggaaguccuggcc

SEQ ID NO: 121719 - RNA, 25 nt, Human
uugcagaugugaagggccagugaac

SEQ ID NO: 121720 - RNA, 26 nt, Human
aacaggggcccagaugacaaccucuc

SEQ ID NO: 121721 - RNA, 20 nt, Human
caugugucuucauucugccu

SEQ ID NO: 121722 - RNA, 26 nt, Human
ccuuucaaauccccagggcagacaca

SEQ ID NO: 121723 - RNA, 27 nt, Human
cuaccauguaccccucucaggcugccu

SEQ ID NO: 121724 - RNA, 21 nt, Human
ucucccacucugccaggugcu

SEQ ID NO: 121725 - RNA, 23 nt, Human
agguaggaaugaacuugccagcc

SEQ ID NO: 121726 - RNA, 23 nt, Human
ugagcuccuuguuuuugccaaag

SEQ ID NO: 121727 - RNA, 20 nt, Human
gcacuccuccagggugucag

SEQ ID NO: 121728 - RNA, 21 nt, Human
ucuauacaauauacugaguuc

SEQ ID NO: 121729 - RNA, 22 nt, Human
aaagguugagaaaggaaugguu

SEQ ID NO: 121730 - RNA, 21 nt, Human
gucaagcccuauccuucucug

SEQ ID NO: 121731 - RNA, 23 nt, Human
aucaaaacuagcuuuuuucccca

SEQ ID NO: 121732 - RNA, 22 nt, Human
auccaggaguugcauuauagcc

SEQ ID NO: 121733 - RNA, 24 nt, Human
accaaggcaaagcagcacagugug

SEQ ID NO: 121734 - RNA, 18 nt, Human
uacuggccugcaccagaa

SEQ ID NO: 121735 - RNA, 23 nt, Human
uuugagacugaguaguauucuug

SEQ ID NO: 121736 - RNA, 22 nt, Human
uucuccucuccccucuaaggcc

SEQ ID NO: 121737 - RNA, 25 nt, Human
ccugccugaagccaugacccgcuuc

SEQ ID NO: 121738 - RNA, 22 nt, Human
gcucacgucuguaaucccagca

SEQ ID NO: 121739 - RNA, 19 nt, Human
aagaauugcaggccacuca

SEQ ID NO: 121740 - RNA, 21 nt, Human
gaaaccaggaauucauuucaa

SEQ ID NO: 121741 - RNA, 24 nt, Human
cuggggggcaccucuuucuggccu

SEQ ID NO: 121742 - RNA, 27 nt, Human
gcugacuugaaucauuuugagcaauuu

SEQ ID NO: 121743 - RNA, 23 nt, Human
accucacagaacaaauuagccca

SEQ ID NO: 121744 - RNA, 22 nt, Human
guucagaaugugaaccagugcu

SEQ ID NO: 121745 - RNA, 25 nt, Human
ccgaugcacgccaccaccaugccug

SEQ ID NO: 121746 - RNA, 21 nt, Human
uccagcugaguuucucuuggg

SEQ ID NO: 121747 - RNA, 27 nt, Human
cacugccucgcagaguggccugggcua

SEQ ID NO: 121748 - RNA, 24 nt, Human
uggagggagagguggggccccugc

SEQ ID NO: 121749 - RNA, 19 nt, Human
caaagagacaccacucugg

SEQ ID NO: 121750 - RNA, 21 nt, Human
ucccauuuccuggcacacucu

SEQ ID NO: 121751 - RNA, 22 nt, Human
gggaagaggcagggagggagcu

SEQ ID NO: 121752 - RNA, 22 nt, Human
auuuuucuugaagaggcagcuc

SEQ ID NO: 121753 - RNA, 20 nt, Human
auuugaugcuguugucuguc

SEQ ID NO: 121754 - RNA, 21 nt, Human
ucacgguacaagacaauugca

SEQ ID NO: 121755 - RNA, 24 nt, Human
ucuuacucugugccugaccuugug

SEQ ID NO: 121756 - RNA, 27 nt, Human
gaaaugagagacugaguaggcaucuca

SEQ ID NO: 121757 - RNA, 21 nt, Human
cauucugcucuuuuugagagc

SEQ ID NO: 121758 - RNA, 19 nt, Human
ugacuccuucuuccacccc

SEQ ID NO: 121759 - RNA, 22 nt, Human
aggcauucuuccagugugguuu

SEQ ID NO: 121760 - RNA, 22 nt, Human
ccugcugcgacccagauucuuc

SEQ ID NO: 121761 - RNA, 23 nt, Human
ggcaccuucagccucagagugga

SEQ ID NO: 121762 - RNA, 23 nt, Human
caucaucaguccuaccugagcaa

SEQ ID NO: 121763 - RNA, 22 nt, Human
gugugagccacagugccuggcc

SEQ ID NO: 121764 - RNA, 22 nt, Human
uucggauuuugaaccccuguau

SEQ ID NO: 121765 - RNA, 25 nt, Human
cgccccucugggccugccuguggcu

SEQ ID NO: 121766 - RNA, 26 nt, Human
cagaaauuugguggguuuuuuguugu

SEQ ID NO: 121767 - RNA, 23 nt, Human
aucugccacaaaaauguucacuu

SEQ ID NO: 121768 - RNA, 27 nt, Human
agccucaaacuccugggcucaagcgau

SEQ ID NO: 121769 - RNA, 20 nt, Human
cuagguagcuggcaccagga

SEQ ID NO: 121770 - RNA, 22 nt, Human
uuacccagggcuguaggaguga

SEQ ID NO: 121771 - RNA, 20 nt, Human
aaacuuccuguccuuguuga

SEQ ID NO: 121772 - RNA, 20 nt, Human
gaugcugggcucaucuucua

SEQ ID NO: 121773 - RNA, 27 nt, Human
gcggcugcggucccaggaaggucuuac

SEQ ID NO: 121774 - RNA, 21 nt, Human
gguccgccagcagcuggagcu

SEQ ID NO: 121775 - RNA, 21 nt, Human
gugcucacugaccugccugua

SEQ ID NO: 121776 - RNA, 24 nt, Human
cuccaccuugaugggucaaccuuu

SEQ ID NO: 121777 - RNA, 19 nt, Human
uuaggugaaggacaaguag

SEQ ID NO: 121778 - RNA, 27 nt, Human
agaaauguaacuuuuguaagacaaagg

SEQ ID NO: 121779 - RNA, 23 nt, Human
cuccaucucaguggaccaggaag

SEQ ID NO: 121780 - RNA, 26 nt, Human
ccagcugggccuggagacgcuggugg

SEQ ID NO: 121781 - RNA, 18 nt, Human
ccucacugcacucugcuc

SEQ ID NO: 121782 - RNA, 23 nt, Human
gcugcagacuccugaccugccga

SEQ ID NO: 121783 - RNA, 22 nt, Human
ccuucuaccuccuccucggcca

SEQ ID NO: 121784 - RNA, 21 nt, Human
ugggccucuguagcuccaucu

SEQ ID NO: 121785 - RNA, 22 nt, Human
gcccaggccuguggguaguggg

SEQ ID NO: 121786 - RNA, 26 nt, Human
ugucuggaggcacaggcacaaagcau

SEQ ID NO: 121787 - RNA, 20 nt, Human
aggcuucuacccucccuccu

SEQ ID NO: 121788 - RNA, 27 nt, Human
caggcuggagucagugucugccccuga

SEQ ID NO: 121789 - RNA, 20 nt, Human
cuguggucucaggcuugcgc

SEQ ID NO: 121790 - RNA, 15 nt, Human
uccuggucagucuag

SEQ ID NO: 121791 - RNA, 19 nt, Human
uggaggaacagcagcucug

SEQ ID NO: 121792 - RNA, 22 nt, Human
ucuuccagaaccuaggaggaug

SEQ ID NO: 121793 - RNA, 20 nt, Human
uugagccucaucucuggcuu

SEQ ID NO: 121794 - RNA, 26 nt, Human
cccuccaggaaaugacagcaggugcc

SEQ ID NO: 121795 - RNA, 20 nt, Human
uuuuacaggcugaguguugc

SEQ ID NO: 121796 - RNA, 30 nt, Human
gaaugagggguagagccacucuggggccca

SEQ ID NO: 121797 - RNA, 24 nt, Human
gccugcucuuccauaucauggccc

SEQ ID NO: 121798 - RNA, 21 nt, Human
gcuuagaggcagcagcacuug

SEQ ID NO: 121799 - RNA, 22 nt, Human
cuccacccacaucccccugguc

SEQ ID NO: 121800 - RNA, 22 nt, Human
aguggcacgaucauagcucacu

SEQ ID NO: 121801 - RNA, 25 nt, Human
cucuucuggaaugcaccacuccuuc

SEQ ID NO: 121802 - RNA, 21 nt, Human
cauauuuagagaaaauuggaa

SEQ ID NO: 121803 - RNA, 24 nt, Human
ucagccaccgugucacucugugac

SEQ ID NO: 121804 - RNA, 18 nt, Human
gaaaugagaccuggugga

SEQ ID NO: 121805 - RNA, 19 nt, Human
aggggacauggcagagaug

SEQ ID NO: 121806 - RNA, 22 nt, Human
cucucucacagauagugagggu

SEQ ID NO: 121807 - RNA, 27 nt, Human
acaagcacagucagguugaagaccuaa

SEQ ID NO: 121808 - RNA, 24 nt, Human
gcacacaccccgcuucccuuggaa

SEQ ID NO: 121809 - RNA, 29 nt, Human
cugcgcacacagcugcuugcucaggggcc

SEQ ID NO: 121810 - RNA, 27 nt, Human
ugaauccagcauuguugagcugucauc

SEQ ID NO: 121811 - RNA, 21 nt, Human
ucuguacgaccucacacagcc

SEQ ID NO: 121812 - RNA, 26 nt, Human
gggaccccacgcacauuccguugccu

SEQ ID NO: 121813 - RNA, 18 nt, Human
gagagggaggggugcagc

SEQ ID NO: 121814 - RNA, 22 nt, Human
cccucauuuuguuuccauucca

SEQ ID NO: 121815 - RNA, 22 nt, Human
ccaaagugcugggauuaccggc

SEQ ID NO: 121816 - RNA, 23 nt, Human
uucauauaaaugugcagaaagau

SEQ ID NO: 121817 - RNA, 27 nt, Human
gccagucaggacuuuugcuauugcaaa

SEQ ID NO: 121818 - RNA, 23 nt, Human
cuacaggcgugagccaccaugcc

SEQ ID NO: 121819 - RNA, 29 nt, Human
uaccucuguuacucucagccuggaauccc

SEQ ID NO: 121820 - RNA, 25 nt, Human
agugaacucucaaauccaaaauggu

SEQ ID NO: 121821 - RNA, 22 nt, Human
uguuuuuacagauuguauccug

SEQ ID NO: 121822 - RNA, 21 nt, Human
caggccagagucccagcuguc

SEQ ID NO: 121823 - RNA, 21 nt, Human
uuugggaagagacaauaaaga

SEQ ID NO: 121824 - RNA, 22 nt, Human
aaauccugaacuuucucccuca

SEQ ID NO: 121825 - RNA, 27 nt, Human
auauguuuucaguacaauuuugaacag

SEQ ID NO: 121826 - RNA, 22 nt, Human
ccaggcugaagugcaguggagc

SEQ ID NO: 121827 - RNA, 20 nt, Human
cuuuucucccugaaauacuc

SEQ ID NO: 121828 - RNA, 21 nt, Human
gucugugagggugggcuggca

SEQ ID NO: 121829 - RNA, 24 nt, Human
uaggaagagauaaggcaagagcua

SEQ ID NO: 121830 - RNA, 23 nt, Human
guucuggagcucuugugucauug

SEQ ID NO: 121831 - RNA, 25 nt, Human
ccuaguuugaccucacagugccccu

SEQ ID NO: 121832 - RNA, 23 nt, Human
gcuccaucugagcuugcucuuca

SEQ ID NO: 121833 - RNA, 21 nt, Human
aggcugaggacaaauaccugc

SEQ ID NO: 121834 - RNA, 26 nt, Human
ccagcagaauggaggcaggggacaag

SEQ ID NO: 121835 - RNA, 17 nt, Human
aaaacuaaauguguaca

SEQ ID NO: 121836 - RNA, 20 nt, Human
caaaugcaugaacaaguuuu

SEQ ID NO: 121837 - RNA, 19 nt, Human
cacaagucaggagcaaaac

SEQ ID NO: 121838 - RNA, 21 nt, Human
ucacccaggcgggaguggugc

SEQ ID NO: 121839 - RNA, 22 nt, Human
auggcggcucccguagagacac

SEQ ID NO: 121840 - RNA, 18 nt, Human
accauaaacauugccaaa

SEQ ID NO: 121841 - RNA, 27 nt, Human
gggagguugauuugcucucuaaacuuc

SEQ ID NO: 121842 - RNA, 22 nt, Human
gccacccaggacgaugagcggc

SEQ ID NO: 121843 - RNA, 23 nt, Human
cuuuugcaggaugaccucagggc

SEQ ID NO: 121844 - RNA, 18 nt, Human
ccugcucuccgcaggccc

SEQ ID NO: 121845 - RNA, 28 nt, Human
ucaccgccacuacugcagcucagugccc

SEQ ID NO: 121846 - RNA, 21 nt, Human
ccuaccucccucaagccuggg

SEQ ID NO: 121847 - RNA, 25 nt, Human
uugccuuugccccggcuugccugua

SEQ ID NO: 121848 - RNA, 27 nt, Human
gugagggugggagauuuagacaccuga

SEQ ID NO: 121849 - RNA, 27 nt, Human
uaguaucaaauauuagaugugauuuaa

SEQ ID NO: 121850 - RNA, 21 nt, Human
ccuuucucuuuagucuuuguc

SEQ ID NO: 121851 - RNA, 16 nt, Human
ccucuucucucaggcc

SEQ ID NO: 121852 - RNA, 25 nt, Human
gcagcagcuacaacaacagcugaga

SEQ ID NO: 121853 - RNA, 24 nt, Human
augauguuuugauauuuauuuccu

SEQ ID NO: 121854 - RNA, 22 nt, Human
caaauaggauccaacacaggca

SEQ ID NO: 121855 - RNA, 22 nt, Human
ucccacugaccuacucuugccu

SEQ ID NO: 121856 - RNA, 28 nt, Human
agcccugcccccaccugcccucccgggc

SEQ ID NO: 121857 - RNA, 19 nt, Human
ugacuucucugggcugagg

SEQ ID NO: 121858 - RNA, 27 nt, Human
gacauaguggccucugggcugccaugu

SEQ ID NO: 121859 - RNA, 25 nt, Human
caacuccaaaccccagccacuuccu

SEQ ID NO: 121860 - RNA, 22 nt, Human
ccugaggacgggggugccuuca

SEQ ID NO: 121861 - RNA, 25 nt, Human
uuggaccucaggccuuuucucacga

SEQ ID NO: 121862 - RNA, 22 nt, Human
gcgcagguagugucccugcacu

SEQ ID NO: 121863 - RNA, 22 nt, Human
cagagucaggagaccccaaggc

SEQ ID NO: 121864 - RNA, 22 nt, Human
ucggggguuucagcucacugcu

SEQ ID NO: 121865 - RNA, 21 nt, Human
ugauguuucugaaacugcuau

SEQ ID NO: 121866 - RNA, 21 nt, Human
cuugagacacggagcccagcc

SEQ ID NO: 121867 - RNA, 25 nt, Human
cgggcacacacaggaccgugccuca

SEQ ID NO: 121868 - RNA, 27 nt, Human
caggucacuuuaccucuguggaccugu

SEQ ID NO: 121869 - RNA, 27 nt, Human
caugccuuaccuaagagaagaggcugg

SEQ ID NO: 121870 - RNA, 25 nt, Human
gaagaauuggcaaaauaucuggacc

SEQ ID NO: 121871 - RNA, 27 nt, Human
cagcuagacccagaaauuuggaaggcu

SEQ ID NO: 121872 - RNA, 23 nt, Human
acuccugguuaguacauucucag

SEQ ID NO: 121873 - RNA, 21 nt, Human
aggugggaucaugaguuugcu

SEQ ID NO: 121874 - RNA, 22 nt, Human
ucuguucucacaccugugcgca

SEQ ID NO: 121875 - RNA, 25 nt, Human
ucugucuccuaagcuggagugcagu

SEQ ID NO: 121876 - RNA, 22 nt, Human
agaacaaacaaaauacauuuca

SEQ ID NO: 121877 - RNA, 21 nt, Human
gcugucagaugucacauaauu

SEQ ID NO: 121878 - RNA, 24 nt, Human
ugaacucgacaaggcuuccccuua

SEQ ID NO: 121879 - RNA, 27 nt, Human
ccuccugccagcucugucacccuggcc

SEQ ID NO: 121880 - RNA, 27 nt, Human
gucaugucuucucaaaaucuagcaaag

SEQ ID NO: 121881 - RNA, 27 nt, Human
cugggcccugggugagguaaaggacau

SEQ ID NO: 121882 - RNA, 24 nt, Human
cugucuguuuaaaccucaggaugg

SEQ ID NO: 121883 - RNA, 24 nt, Human
uccuccucccuuucugggcuucca

SEQ ID NO: 121884 - RNA, 22 nt, Human
caucugucugcaggcugucucu

SEQ ID NO: 121885 - RNA, 19 nt, Human
cuagcaccuaaaaccacgu

SEQ ID NO: 121886 - RNA, 22 nt, Human
caggugaaggacaggaaggggc

SEQ ID NO: 121887 - RNA, 27 nt, Human
gggagagaagacgagccucccggcugu

SEQ ID NO: 121888 - RNA, 27 nt, Human
uucagcuuucaaaaagagugcugccca

SEQ ID NO: 121889 - RNA, 23 nt, Human
gggucugcuuuguucuuguugcu

SEQ ID NO: 121890 - RNA, 19 nt, Human
caggcggagguugcggugg

SEQ ID NO: 121891 - RNA, 26 nt, Human
uccugacuugaacauagggugacuuu

SEQ ID NO: 121892 - RNA, 22 nt, Human
cucccaggaacagcuagguggg

SEQ ID NO: 121893 - RNA, 22 nt, Human
cccaguagcugggauuagaggc

SEQ ID NO: 121894 - RNA, 19 nt, Human
uuuugccacucgcuucccu

SEQ ID NO: 121895 - RNA, 27 nt, Human
ccuguucuccccgcucaggugcggcgc

SEQ ID NO: 121896 - RNA, 24 nt, Human
gcccaggcugggguucagaccugc

SEQ ID NO: 121897 - RNA, 27 nt, Human
ggagaaacugagaaaugaaugcugaga

SEQ ID NO: 121898 - RNA, 21 nt, Human
aucuguaacgcuagauauuga

SEQ ID NO: 121899 - RNA, 23 nt, Human
acuagcccucuuucucucugugu

SEQ ID NO: 121900 - RNA, 27 nt, Human
uuccuuugacacaguaaggcaaaggcc

SEQ ID NO: 121901 - RNA, 22 nt, Human
guagggaggcauccaguguggc

SEQ ID NO: 121902 - RNA, 20 nt, Human
ggaguuugaggcugcaguga

SEQ ID NO: 121903 - RNA, 22 nt, Human
aaacagugucuauuuuacagag

SEQ ID NO: 121904 - RNA, 25 nt, Human
caggcccaucucagaucuucacuau

SEQ ID NO: 121905 - RNA, 27 nt, Human
ccuauaauggugcuuaaagugugauug

SEQ ID NO: 121906 - RNA, 23 nt, Human
ucagcccaccauuucuccucacc

SEQ ID NO: 121907 - RNA, 24 nt, Human
guugcugaccagcuggagugaggg

SEQ ID NO: 121908 - RNA, 23 nt, Human
auuuuugaaaaauacaaugucua

SEQ ID NO: 121909 - RNA, 23 nt, Human
ccagcuauuacaacugugccucu

SEQ ID NO: 121910 - RNA, 24 nt, Human
agcggggccuccucggugggcucc

SEQ ID NO: 121911 - RNA, 24 nt, Human
uucuccucuucucuucuugggaca

SEQ ID NO: 121912 - RNA, 16 nt, Human
uucugaaaugaccuca

SEQ ID NO: 121913 - RNA, 26 nt, Human
aauuucugucuuucugcuaugugugg

SEQ ID NO: 121914 - RNA, 26 nt, Human
gggccacugguccccaacaaugugag

SEQ ID NO: 121915 - RNA, 25 nt, Human
cucugccauguccagagggcacaaa

SEQ ID NO: 121916 - RNA, 19 nt, Human
uggugaagacccagaggaa

SEQ ID NO: 121917 - RNA, 24 nt, Human
uccaaaccagaggagaucaauugu

SEQ ID NO: 121918 - RNA, 26 nt, Human
uucacauuccuguguuaagucauuuu

SEQ ID NO: 121919 - RNA, 25 nt, Human
guucugagaggaggcagcaauccag

SEQ ID NO: 121920 - RNA, 23 nt, Human
uucuucauuaccuuuuuuauuca

SEQ ID NO: 121921 - RNA, 25 nt, Human
cuugcugucuuuugugccucugcaa

SEQ ID NO: 121922 - RNA, 26 nt, Human
ucuagcccuggaucugccuuccugcu

SEQ ID NO: 121923 - RNA, 22 nt, Human
cugaggcagguggauugcuuga

SEQ ID NO: 121924 - RNA, 23 nt, Human
ggcucaggggacuguccaccuca

SEQ ID NO: 121925 - RNA, 27 nt, Human
ucagcacucccuaugcacuuuccugac

SEQ ID NO: 121926 - RNA, 23 nt, Human
cuuaauuuuguaucauccaguca

SEQ ID NO: 121927 - RNA, 21 nt, Human
cugggaggagggaggcuggga

SEQ ID NO: 121928 - RNA, 27 nt, Human
ccaagccccauguagccccagucaucc

SEQ ID NO: 121929 - RNA, 21 nt, Human
gaaaacuuacucucaacugga

SEQ ID NO: 121930 - RNA, 27 nt, Human
uggcucacguauguaaucccagcacuu

SEQ ID NO: 121931 - RNA, 24 nt, Human
cccugcuucucucaggguuaaggg

SEQ ID NO: 121932 - RNA, 24 nt, Human
ggagagggcggagggggaggcggc

SEQ ID NO: 121933 - RNA, 21 nt, Human
cuacaggugugcgcacaugcc

SEQ ID NO: 121934 - RNA, 21 nt, Human
cacucaggccuuucuggccca

SEQ ID NO: 121935 - RNA, 25 nt, Human
acgggcugaaccagcuuuguuccca

SEQ ID NO: 121936 - RNA, 22 nt, Human
gggcccaggaguucgaggugca

SEQ ID NO: 121937 - RNA, 23 nt, Human
caucaguauuuauagcaaaaaga

SEQ ID NO: 121938 - RNA, 23 nt, Human
ggagcaguuugggggcggccggc

SEQ ID NO: 121939 - RNA, 22 nt, Human
uaugaccccaggggcucugcug

SEQ ID NO: 121940 - RNA, 20 nt, Human
ccugcugcugcuaucugucc

SEQ ID NO: 121941 - RNA, 22 nt, Human
ugucauuguuuucagguacuga

SEQ ID NO: 121942 - RNA, 22 nt, Human
accagccuggccaauaugguga

SEQ ID NO: 121943 - RNA, 27 nt, Human
ugccuguaauccuagcuacucaggagg

SEQ ID NO: 121944 - RNA, 25 nt, Human
aaagacaacauuguuccuggaacgc

SEQ ID NO: 121945 - RNA, 17 nt, Human
acgaagucccugccgcu

SEQ ID NO: 121946 - RNA, 21 nt, Human
gguuuuaagcggaagauggag

SEQ ID NO: 121947 - RNA, 20 nt, Human
ccuggacucugccuuagcuc

SEQ ID NO: 121948 - RNA, 21 nt, Human
auucuugugucucagucuucc

SEQ ID NO: 121949 - RNA, 20 nt, Human
ugagaccaggaugagcuguc

SEQ ID NO: 121950 - RNA, 23 nt, Human
cugaucuaaccauuccccaguca

SEQ ID NO: 121951 - RNA, 27 nt, Human
gaguagcugggauuacagguggugacu

SEQ ID NO: 121952 - RNA, 21 nt, Human
gcucacugcaaccucugcuuc

SEQ ID NO: 121953 - RNA, 21 nt, Human
aguuuauucuaaccuaggcaa

SEQ ID NO: 121954 - RNA, 18 nt, Human
uguggagucccugccacu

SEQ ID NO: 121955 - RNA, 23 nt, Human
uggcccugagcacuugaaggugc

SEQ ID NO: 121956 - RNA, 21 nt, Human
ccuggugcugcagcacuugua

SEQ ID NO: 121957 - RNA, 19 nt, Human
ccaggcugggaggggaaga

SEQ ID NO: 121958 - RNA, 23 nt, Human
gucggugcccugcuuccuccucc

SEQ ID NO: 121959 - RNA, 30 nt, Human
uuuuguuuuuguuuucuggagacaaggucu

SEQ ID NO: 121960 - RNA, 25 nt, Human
aaagugcugccgugacacucggccc

SEQ ID NO: 121961 - RNA, 26 nt, Human
gcuucaagauccugcuaccauuuucu

SEQ ID NO: 121962 - RNA, 24 nt, Human
ggcugagaggcugcggcggcugac

SEQ ID NO: 121963 - RNA, 23 nt, Human
guuguccaggcuggagugcaaug

SEQ ID NO: 121964 - RNA, 19 nt, Human
agcugauaacaugaccugg

SEQ ID NO: 121965 - RNA, 24 nt, Human
ccuuugagcuucuccucugcucca

SEQ ID NO: 121966 - RNA, 24 nt, Human
cgacaucaucccuugguauacucc

SEQ ID NO: 121967 - RNA, 20 nt, Human
ggaaagggaagugauaucau

SEQ ID NO: 121968 - RNA, 24 nt, Human
ggcgugcgccugccaacaggcugg

SEQ ID NO: 121969 - RNA, 22 nt, Human
guugccaggcuagagugcagug

SEQ ID NO: 121970 - RNA, 27 nt, Human
ccggacacaagggucugcauugcgucc

SEQ ID NO: 121971 - RNA, 28 nt, Human
ucuugaacuccugaccucaggugaucca

SEQ ID NO: 121972 - RNA, 28 nt, Human
ucucgaacucccgaccucaggugaucca

SEQ ID NO: 121973 - RNA, 19 nt, Human
acugcccaauagugaccuc

SEQ ID NO: 121974 - RNA, 26 nt, Human
ccgagaucaugggacugcacuccagc

SEQ ID NO: 121975 - RNA, 21 nt, Human
cuucugcuuaauagucuuaua

SEQ ID NO: 121976 - RNA, 27 nt, Human
guucccuggcccgagcuggucuggggc

SEQ ID NO: 121977 - RNA, 22 nt, Human
aguggagagcccugaaaggagg

SEQ ID NO: 121978 - RNA, 24 nt, Human
ggaugggaucuuucugggagcugc

SEQ ID NO: 121979 - RNA, 22 nt, Human
ggacuccuccucauucccuuua

SEQ ID NO: 121980 - RNA, 23 nt, Human
aauagcuuuaguccuucucaccu

SEQ ID NO: 121981 - RNA, 20 nt, Human
accaggcuggagugcagugg

SEQ ID NO: 121982 - RNA, 26 nt, Human
gcugccucuaccggcuggcggcugua

SEQ ID NO: 121983 - RNA, 22 nt, Human
gacgcagccaccuuccucacca

SEQ ID NO: 121984 - RNA, 22 nt, Human
gcuauggagcaaauccaggaag

SEQ ID NO: 121985 - RNA, 26 nt, Human
cuuauugucucucaaaacuaaccuaa

SEQ ID NO: 121986 - RNA, 22 nt, Human
cacuacugcuacccucauuuca

SEQ ID NO: 121987 - RNA, 22 nt, Human
ccaacaucgugaaaccccaucu

SEQ ID NO: 121988 - RNA, 23 nt, Human
ugucacccaggcuggacugcaau

SEQ ID NO: 121989 - RNA, 26 nt, Human
cucggcucacugcagccuccuucucc

SEQ ID NO: 121990 - RNA, 24 nt, Human
aaguuggcccagcuuuggaaacug

SEQ ID NO: 121991 - RNA, 25 nt, Human
ucuggcucucccuucucugugaccc

SEQ ID NO: 121992 - RNA, 22 nt, Human
acaucuuaaaggacaacuuaaa

SEQ ID NO: 121993 - RNA, 22 nt, Human
uucugaccuuccccugaaguag

SEQ ID NO: 121994 - RNA, 21 nt, Human
ugaccuguucuguugacuggg

SEQ ID NO: 121995 - RNA, 23 nt, Human
aucaugccauugcauuccagccu

SEQ ID NO: 121996 - RNA, 22 nt, Human
ccucagugccugcucucaucca

SEQ ID NO: 121997 - RNA, 24 nt, Human
agaggccagaacacucuggaacau

SEQ ID NO: 121998 - RNA, 21 nt, Human
uuaaaaaauauuuuaagaaag

SEQ ID NO: 121999 - RNA, 27 nt, Human
ccacugcacuccagccugggcaacaua

SEQ ID NO: 122000 - RNA, 27 nt, Human
ccacugcacgccagccugggcaacaga

SEQ ID NO: 122001 - RNA, 29 nt, Human
ucucuguccugucuucccugcuccaacuc

SEQ ID NO: 122002 - RNA, 24 nt, Human
aucgcgccgagcucccuccauucc

SEQ ID NO: 122003 - RNA, 27 nt, Human
ggucacccagacagcucuguggaggca

SEQ ID NO: 122004 - RNA, 21 nt, Human
gacauuaagacacaccucugg

SEQ ID NO: 122005 - RNA, 21 nt, Human
uucauugaauaaugaaugaac

SEQ ID NO: 122006 - RNA, 27 nt, Human
ucuacuuccugaagaccugaacaccgc

SEQ ID NO: 122007 - RNA, 20 nt, Human
auccacaaaugcaguuuuag

SEQ ID NO: 122008 - RNA, 19 nt, Human
gauaaauuauguucaguga

SEQ ID NO: 122009 - RNA, 20 nt, Human
caccaugagcucacccgugu

SEQ ID NO: 122010 - RNA, 19 nt, Human
cuagagaaacaaggcugua

SEQ ID NO: 122011 - RNA, 20 nt, Human
cugacccucacccacugucc

SEQ ID NO: 122012 - RNA, 19 nt, Human
gucugauuuucucuuugga

SEQ ID NO: 122013 - RNA, 20 nt, Human
ggagagggaagcagccgugc

SEQ ID NO: 122014 - RNA, 21 nt, Human
uucuccucuguccaggaggcc

SEQ ID NO: 122015 - RNA, 21 nt, Human
uccugaccccgccaugcaugc

SEQ ID NO: 122016 - RNA, 21 nt, Human
ccaggcgagagagggggccag

SEQ ID NO: 122017 - RNA, 21 nt, Human
ucagaaagagccaagucugga

SEQ ID NO: 122018 - RNA, 20 nt, Human
uuucagaaaaaggaacgugg

SEQ ID NO: 122019 - RNA, 25 nt, Human
cuuuauuucaucuucauaagaauga

SEQ ID NO: 122020 - RNA, 21 nt, Human
caccuaaauccaucugacuac

SEQ ID NO: 122021 - RNA, 25 nt, Human
uucuccucuucuaauauaucagauc

SEQ ID NO: 122022 - RNA, 25 nt, Human
ugggcagcuucccccugccuuuugc

SEQ ID NO: 122023 - RNA, 21 nt, Human
accacaacugugauauauccu

SEQ ID NO: 122024 - RNA, 22 nt, Human
agcagcucugggaggcacagag

SEQ ID NO: 122025 - RNA, 22 nt, Human
caagaauccaauggcucagucc

SEQ ID NO: 122026 - RNA, 25 nt, Human
ucagaaucuaagaaaucaggcaagu

SEQ ID NO: 122027 - RNA, 23 nt, Human
augauccuugagucuccucucug

SEQ ID NO: 122028 - RNA, 20 nt, Human
cuucccaugcuucugagucu

SEQ ID NO: 122029 - RNA, 26 nt, Human
ucuauucuuagaagcagggugucagc

SEQ ID NO: 122030 - RNA, 27 nt, Human
ugcuucaaaggucaaacauuacaaaag

SEQ ID NO: 122031 - RNA, 27 nt, Human
ggagagggcagcucggguagagagggc

SEQ ID NO: 122032 - RNA, 26 nt, Human
ccugcaggaagacgcccggucccggg

SEQ ID NO: 122033 - RNA, 28 nt, Human
acacagggcagaggcauccauggcuggc

SEQ ID NO: 122034 - RNA, 20 nt, Human
auuacccuuugguuuaucua

SEQ ID NO: 122035 - RNA, 24 nt, Human
aaaaagacaguguaauaauaacau

SEQ ID NO: 122036 - RNA, 27 nt, Human
cuaguacuauugcuauuacuaguacua

SEQ ID NO: 122037 - RNA, 26 nt, Human
uucacuaagguccacuaacuaauaag

SEQ ID NO: 122038 - RNA, 22 nt, Human
ggguacuuggcuugcuuugcua

SEQ ID NO: 122039 - RNA, 26 nt, Human
acuaccugcuaauucuugccgcauuu

SEQ ID NO: 122040 - RNA, 21 nt, Human
guuacaucaggacaacuuuga

SEQ ID NO: 122041 - RNA, 22 nt, Human
uccugcucugucuuuuauuauc

SEQ ID NO: 122042 - RNA, 24 nt, Human
ucuccugccgccgcugcugcugcc

SEQ ID NO: 122043 - RNA, 27 nt, Human
acugggugugagaaugaucaaggaucu

SEQ ID NO: 122044 - RNA, 20 nt, Human
acuacuacuacuacuguuca

SEQ ID NO: 122045 - RNA, 22 nt, Human
gcagcccaggcuggagugcagu

SEQ ID NO: 122046 - RNA, 21 nt, Human
ggaggugaggugcccaggugg

SEQ ID NO: 122047 - RNA, 20 nt, Human
aacucugcuugauuuuugcc

SEQ ID NO: 122048 - RNA, 27 nt, Human
ucacugcacuccagccugggcaacaca

SEQ ID NO: 122049 - RNA, 23 nt, Human
ugccuguaaucccagcuacaugg

SEQ ID NO: 122050 - RNA, 22 nt, Human
ggccucugccuguuuucauuuc

SEQ ID NO: 122051 - RNA, 21 nt, Human
cccccagcagaggcaggcugg

SEQ ID NO: 122052 - RNA, 25 nt, Human
augccccauuaggccaggaucugcu

SEQ ID NO: 122053 - RNA, 24 nt, Human
ccucuacugucuccucccugggcu

SEQ ID NO: 122054 - RNA, 20 nt, Human
gcgcuggcuccagucucucc

SEQ ID NO: 122055 - RNA, 21 nt, Human
aaaaggagggagggacuuuga

SEQ ID NO: 122056 - RNA, 31 nt, Human
ggcucagaagguccagaaaucaggggaagga

SEQ ID NO: 122057 - RNA, 22 nt, Human
ccccagcccugcccgggggucg

SEQ ID NO: 122058 - RNA, 22 nt, Human
agauuucucacaaguuauuuca

SEQ ID NO: 122059 - RNA, 27 nt, Human
agaccuccagcauuggucauaaccuuc

SEQ ID NO: 122060 - RNA, 27 nt, Human
ugcccucucgccaggcuggaguguagu

SEQ ID NO: 122061 - RNA, 21 nt, Human
aggccuucagaauuuaagggu

SEQ ID NO: 122062 - RNA, 27 nt, Human
ccaguguuguccaagguugcuagcagg

SEQ ID NO: 122063 - RNA, 25 nt, Human
uggaaucccagagcuacucuugcua

SEQ ID NO: 122064 - RNA, 22 nt, Human
cacccaggcuggggcgcaaugg

SEQ ID NO: 122065 - RNA, 23 nt, Human
aacuuguccuaugagauguuuca

SEQ ID NO: 122066 - RNA, 25 nt, Human
uagucccagggaccugggucucugg

SEQ ID NO: 122067 - RNA, 20 nt, Human
caccagagucuuaaggguca

SEQ ID NO: 122068 - RNA, 24 nt, Human
agagggagggggaagagcagaagu

SEQ ID NO: 122069 - RNA, 19 nt, Human
uagccucuuugguuucugu

SEQ ID NO: 122070 - RNA, 26 nt, Human
gccauguacagacagagaauaugucu

SEQ ID NO: 122071 - RNA, 26 nt, Human
ccagccugcuuuuucucagcccugac

SEQ ID NO: 122072 - RNA, 27 nt, Human
cacugcugaggagaaacccaauggcua

SEQ ID NO: 122073 - RNA, 23 nt, Human
gccuccaaaucugaacagucacu

SEQ ID NO: 122074 - RNA, 26 nt, Human
uaaggaauagguaggaaaauuugguu

SEQ ID NO: 122075 - RNA, 27 nt, Human
ugagcgggagucagggaccugcugcuc

SEQ ID NO: 122076 - RNA, 21 nt, Human
cacccaggcuugagugcagug

SEQ ID NO: 122077 - RNA, 20 nt, Human
cggcuaggcgugguggugca

SEQ ID NO: 122078 - RNA, 26 nt, Human
acauggucuagacugaaguaccaacu

SEQ ID NO: 122079 - RNA, 25 nt, Human
ucagcuguugccauuuucuuucaau

SEQ ID NO: 122080 - RNA, 25 nt, Human
ugcggcugcuccgggcugggcgcgg

SEQ ID NO: 122081 - RNA, 26 nt, Human
acgccugggugcgccugccugccggc

SEQ ID NO: 122082 - RNA, 22 nt, Human
ugccaauuuucugauuuuuugu

SEQ ID NO: 122083 - RNA, 25 nt, Human
uccuuucucucccaggugcuggacc

SEQ ID NO: 122084 - RNA, 27 nt, Human
agcucacuuggccugcuugcccugccc

SEQ ID NO: 122085 - RNA, 27 nt, Human
cuuucuggaagucuccccaggcugacu

SEQ ID NO: 122086 - RNA, 20 nt, Human
uuauuaaaaaaguuaaauca

SEQ ID NO: 122087 - RNA, 23 nt, Human
agggccaggauuccucucucagg

SEQ ID NO: 122088 - RNA, 23 nt, Human
uuccaguuuuguaugaguucugc

SEQ ID NO: 122089 - RNA, 20 nt, Human
uauggcagaagugauggcau

SEQ ID NO: 122090 - RNA, 20 nt, Human
gggcucaggacaaguggcuc

SEQ ID NO: 122091 - RNA, 26 nt, Human
uccucucucuauccuagacauggaau

SEQ ID NO: 122092 - RNA, 22 nt, Human
uacagaauauagcucuacagca

SEQ ID NO: 122093 - RNA, 23 nt, Human
ugggcacaggaggagcagcugcu

SEQ ID NO: 122094 - RNA, 26 nt, Human
gauggcagaaacucagggaggggcuu

SEQ ID NO: 122095 - RNA, 23 nt, Human
auuauuuuaaagugacuggaauu

SEQ ID NO: 122096 - RNA, 19 nt, Human
ucugcagcuggguccugcc

SEQ ID NO: 122097 - RNA, 27 nt, Human
caggcagcaguuguaguuacugccgcg

SEQ ID NO: 122098 - RNA, 26 nt, Human
ucuccugguccugcaguguugcugua

SEQ ID NO: 122099 - RNA, 20 nt, Human
cauggcuguguuugcagccu

SEQ ID NO: 122100 - RNA, 21 nt, Human
ucaccgcacaacucucuuuca

SEQ ID NO: 122101 - RNA, 22 nt, Human
uucuuaggcuggagugcagugg

SEQ ID NO: 122102 - RNA, 21 nt, Human
aggagcagagcaggcaauuuc

SEQ ID NO: 122103 - RNA, 21 nt, Human
cgugugccagcacuagccuag

SEQ ID NO: 122104 - RNA, 22 nt, Human
acuggccacagcccagcccagc

SEQ ID NO: 122105 - RNA, 21 nt, Human
gaaaagaguauguaguggcuu

SEQ ID NO: 122106 - RNA, 19 nt, Human
cucccccaccuucaagcac

SEQ ID NO: 122107 - RNA, 27 nt, Human
acaccggccuggcugguccacgccagc

SEQ ID NO: 122108 - RNA, 21 nt, Human
aggcugagaggccucaggaaa

SEQ ID NO: 122109 - RNA, 22 nt, Human
uggcucaaaccuguaaucccag

SEQ ID NO: 122110 - RNA, 21 nt, Human
gagagaugagaagcagagggc

SEQ ID NO: 122111 - RNA, 20 nt, Human
accccaggcuggagugcagu

SEQ ID NO: 122112 - RNA, 19 nt, Human
gcucaggcuggaguacagu

SEQ ID NO: 122113 - RNA, 23 nt, Human
aagugaucucaagagguccaggg

SEQ ID NO: 122114 - RNA, 25 nt, Human
ggcuucuccuuucugucaagacuua

SEQ ID NO: 122115 - RNA, 21 nt, Human
ucacugcagcuucaaacucuu

SEQ ID NO: 122116 - RNA, 24 nt, Human
gcgccuccauuuucuaucugcacu

SEQ ID NO: 122117 - RNA, 26 nt, Human
aggcugagaggucaagguugcaguga

SEQ ID NO: 122118 - RNA, 26 nt, Human
ccaguauuuuugaauacaauacucau

SEQ ID NO: 122119 - RNA, 19 nt, Human
cggcuggggagggaagcac

SEQ ID NO: 122120 - RNA, 22 nt, Human
uuucuuguguguuuauugucaa

SEQ ID NO: 122121 - RNA, 25 nt, Human
ucggugcagcgggacagggcgaagc

SEQ ID NO: 122122 - RNA, 26 nt, Human
auuccuggucuagggcugugaggcca

SEQ ID NO: 122123 - RNA, 19 nt, Human
uuagugcuuuaggauaugg

SEQ ID NO: 122124 - RNA, 21 nt, Human
cuuccaucucucucagacacc

SEQ ID NO: 122125 - RNA, 22 nt, Human
gcaggcagaucaucugagguca

SEQ ID NO: 122126 - RNA, 23 nt, Human
aacucacagaacuauguacuuua

SEQ ID NO: 122127 - RNA, 22 nt, Human
uccaggcuggggcagguucuua

SEQ ID NO: 122128 - RNA, 18 nt, Human
uccuuuuuaugcaucaaa

SEQ ID NO: 122129 - RNA, 21 nt, Human
aaugcacacagaaaauauuag

SEQ ID NO: 122130 - RNA, 21 nt, Human
uccagccugggcgacagaccg

SEQ ID NO: 122131 - RNA, 20 nt, Human
agcaggggguggcagagggc

SEQ ID NO: 122132 - RNA, 29 nt, Human
cccugcccccuugcccuuccagcccuuuc

SEQ ID NO: 122133 - RNA, 18 nt, Human
ugcuacuuaccuagcaca

SEQ ID NO: 122134 - RNA, 18 nt, Human
acugugaaaaaugcucag

SEQ ID NO: 122135 - RNA, 22 nt, Human
accagacucgccaacaugguga

SEQ ID NO: 122136 - RNA, 26 nt, Human
uaccaugagcaauucuccugccucag

SEQ ID NO: 122137 - RNA, 25 nt, Human
ccuccccgucuuccucugggugcca

SEQ ID NO: 122138 - RNA, 20 nt, Human
ccugauuuuagagaugagga

SEQ ID NO: 122139 - RNA, 27 nt, Human
gugaagcuuccccuugccggcuuagcu

SEQ ID NO: 122140 - RNA, 22 nt, Human
ccaugccuggcuaaucuuuugc

SEQ ID NO: 122141 - RNA, 25 nt, Human
guccuccacagagggcgagccaggg

SEQ ID NO: 122142 - RNA, 21 nt, Human
gcagacuucccugaauguauu

SEQ ID NO: 122143 - RNA, 21 nt, Human
uguuggccaggcugguuucga

SEQ ID NO: 122144 - RNA, 28 nt, Human
gaccuguauuccacuuacuccaccuucc

SEQ ID NO: 122145 - RNA, 26 nt, Human
cacccaggcuggaguacaauagcgug

SEQ ID NO: 122146 - RNA, 24 nt, Human
uucuucaacugcuugcuuuuccca

SEQ ID NO: 122147 - RNA, 23 nt, Human
cucacagcaaccucucugccucc

SEQ ID NO: 122148 - RNA, 23 nt, Human
cuagugagcccucuggcucuggg

SEQ ID NO: 122149 - RNA, 22 nt, Human
cggccuccccaaagugcuggga

SEQ ID NO: 122150 - RNA, 32 nt, Human
ccuauuccuuccuagcuucccugcaauaaaau

SEQ ID NO: 122151 - RNA, 14 nt, Human
ggauacuugcucca

SEQ ID NO: 122152 - RNA, 27 nt, Human
accagagaaagaugaagaggaggaguu

SEQ ID NO: 122153 - RNA, 21 nt, Human
ggaggggccuccagggccagg

SEQ ID NO: 122154 - RNA, 27 nt, Human
gcuugaaauaugcacuuagcacuuugg

SEQ ID NO: 122155 - RNA, 30 nt, Human
uggaaagguaacuggcaaugcacuugaugu

SEQ ID NO: 122156 - RNA, 26 nt, Human
caccgaggcuggagugcaguggcgcg

SEQ ID NO: 122157 - RNA, 22 nt, Human
ugcagaagauaauugaauuugu

SEQ ID NO: 122158 - RNA, 21 nt, Human
ccacagcucagccacugugau

SEQ ID NO: 122159 - RNA, 20 nt, Human
ucaagcuggaaaacaagggg

SEQ ID NO: 122160 - RNA, 24 nt, Human
ggcaucugcacauuuccguguuac

SEQ ID NO: 122161 - RNA, 20 nt, Human
augccauuuuguacauguau

SEQ ID NO: 122162 - RNA, 26 nt, Human
ugcucucauaggaaaguuuucugcuu

SEQ ID NO: 122163 - RNA, 21 nt, Human
aucccauccuccuccuucaua

SEQ ID NO: 122164 - RNA, 22 nt, Human
gccuuuucucaccugucaucuc

SEQ ID NO: 122165 - RNA, 25 nt, Human
cacugcgucugggccugagacgugc

SEQ ID NO: 122166 - RNA, 22 nt, Human
agcuggcacugucucugcugca

SEQ ID NO: 122167 - RNA, 24 nt, Human
agaucaggaguucaagaccaggcu

SEQ ID NO: 122168 - RNA, 21 nt, Human
auaucugaucaaauguauaga

SEQ ID NO: 122169 - RNA, 23 nt, Human
cuuuuuaaaaaagccuguuucua

SEQ ID NO: 122170 - RNA, 26 nt, Human
aacagcaucugaagauggccggguga

SEQ ID NO: 122171 - RNA, 24 nt, Human
gcagcaaaagggaaaaucagaaga

SEQ ID NO: 122172 - RNA, 30 nt, Human
gacaacgaauaacuuccuucaacccaggaa

SEQ ID NO: 122173 - RNA, 24 nt, Human
uguacuuguuugguuugguauuaa

SEQ ID NO: 122174 - RNA, 22 nt, Human
cucacacaccacaccugauucc

SEQ ID NO: 122175 - RNA, 25 nt, Human
agcaaaucacuucucucccugcgcu

SEQ ID NO: 122176 - RNA, 21 nt, Human
agcaggaggggcccacaccuc

SEQ ID NO: 122177 - RNA, 21 nt, Human
guucauaucuaguguuugaag

SEQ ID NO: 122178 - RNA, 21 nt, Human
acuguggcacagcaccucgug

SEQ ID NO: 122179 - RNA, 24 nt, Human
caggugcagagguacccugggugu

SEQ ID NO: 122180 - RNA, 27 nt, Human
ggagaggggagcagagccggaguuggg

SEQ ID NO: 122181 - RNA, 26 nt, Human
gucugugcugaggccuuaucauucau

SEQ ID NO: 122182 - RNA, 20 nt, Human
aaggcucuuucucagcacau

SEQ ID NO: 122183 - RNA, 20 nt, Human
gccguacugccuuuuuuccc

SEQ ID NO: 122184 - RNA, 22 nt, Human
ucaaaacaauauaaauuaagcu

SEQ ID NO: 122185 - RNA, 22 nt, Human
aaucaaaacaacccccacacag

SEQ ID NO: 122186 - RNA, 21 nt, Human
acugucuggcccugaauuugc

SEQ ID NO: 122187 - RNA, 26 nt, Human
gcaaggaagggaauucccacagcccu

SEQ ID NO: 122188 - RNA, 27 nt, Human
caggcuagagugcaguggcuauucaca

SEQ ID NO: 122189 - RNA, 22 nt, Human
ucucugaaaacaagagacugcu

SEQ ID NO: 122190 - RNA, 17 nt, Human
gguagagugugccugaa

SEQ ID NO: 122191 - RNA, 17 nt, Human
ugccugugaccaccuca

SEQ ID NO: 122192 - RNA, 23 nt, Human
gccucuccuucucuuccuucacu

SEQ ID NO: 122193 - RNA, 19 nt, Human
guauauaugaucacuggua

SEQ ID NO: 122194 - RNA, 25 nt, Human
gggauuacaagugcgcacuaccaca

SEQ ID NO: 122195 - RNA, 24 nt, Human
uuuucuucucacagcuccaagcac

SEQ ID NO: 122196 - RNA, 22 nt, Human
uuuuacaggugugaaagucaca

SEQ ID NO: 122197 - RNA, 24 nt, Human
ugguaucuuuagauauuugccugu

SEQ ID NO: 122198 - RNA, 22 nt, Human
gcuggugaucuuucagcagguu

SEQ ID NO: 122199 - RNA, 19 nt, Human
auuugagacuucuccaucg

SEQ ID NO: 122200 - RNA, 23 nt, Human
caaagcugggacuccauccugcc

SEQ ID NO: 122201 - RNA, 24 nt, Human
gcggagcccagccugggagcccag

SEQ ID NO: 122202 - RNA, 26 nt, Human
cccucaccuccccuuucggcuggucc

SEQ ID NO: 122203 - RNA, 22 nt, Human
gccuguaaucccaguuacucgg

SEQ ID NO: 122204 - RNA, 21 nt, Human
caaaagacugguuuguuugcu

SEQ ID NO: 122205 - RNA, 24 nt, Human
ucaucccaaucacuuuuucagagg

SEQ ID NO: 122206 - RNA, 24 nt, Human
cugggcuuugucaugguguuuuac

SEQ ID NO: 122207 - RNA, 23 nt, Human
uaacuguacaucucaguggcugg

SEQ ID NO: 122208 - RNA, 21 nt, Human
gauuugacucuccugccuggg

SEQ ID NO: 122209 - RNA, 22 nt, Human
cgcuugaaccugggaggcagag

SEQ ID NO: 122210 - RNA, 22 nt, Human
ugcuugaaucugggaggcagag

SEQ ID NO: 122211 - RNA, 21 nt, Human
cuuucgcucuuguucuugccg

SEQ ID NO: 122212 - RNA, 21 nt, Human
ccccgucugacgcugccuccu

SEQ ID NO: 122213 - RNA, 21 nt, Human
ggacacagauaggauggggug

SEQ ID NO: 122214 - RNA, 21 nt, Human
ucagaaucuggucuacuuagg

SEQ ID NO: 122215 - RNA, 26 nt, Human
ggcccuacaagugugccuacugcguc

SEQ ID NO: 122216 - RNA, 21 nt, Human
aaccaggcaaccucugccuuc

SEQ ID NO: 122217 - RNA, 22 nt, Human
agggagcgagcgggaagggguc

SEQ ID NO: 122218 - RNA, 27 nt, Human
uguccaauugccaagaauauguuaaca

SEQ ID NO: 122219 - RNA, 25 nt, Human
agcuaaaauguuuucauaggcuauu

SEQ ID NO: 122220 - RNA, 21 nt, Human
cuccuggggugcaguggugag

SEQ ID NO: 122221 - RNA, 22 nt, Human
ggcuagacccaugaucaccacc

SEQ ID NO: 122222 - RNA, 23 nt, Human
gcuggguuucacgcacuggacuu

SEQ ID NO: 122223 - RNA, 23 nt, Human
uacaugauacuuggguagcucaa

SEQ ID NO: 122224 - RNA, 25 nt, Human
uccaaaacuauugcuacuuugugug

SEQ ID NO: 122225 - RNA, 22 nt, Human
gggggagggggacuggagaggc

SEQ ID NO: 122226 - RNA, 23 nt, Human
aaaaugaaaggaauacuaauaag

SEQ ID NO: 122227 - RNA, 28 nt, Human
cuucacaaauaucaaaacaaaauggagg

SEQ ID NO: 122228 - RNA, 24 nt, Human
ccugccugauuccauggcuguugu

SEQ ID NO: 122229 - RNA, 31 nt, Human
augcuugucuauuucuaaaagccaaucuaug

SEQ ID NO: 122230 - RNA, 20 nt, Human
gccagaaucaacagcuccag

SEQ ID NO: 122231 - RNA, 21 nt, Human
ggagucuauaccagugcugug

SEQ ID NO: 122232 - RNA, 22 nt, Human
acauaccuguauacacacacau

SEQ ID NO: 122233 - RNA, 15 nt, Human
uacauacaacauucu

SEQ ID NO: 122234 - RNA, 23 nt, Human
ugaggcgacggcuuccaucugcc

SEQ ID NO: 122235 - RNA, 23 nt, Human
auugcaaagauguuuacaucaaa

SEQ ID NO: 122236 - RNA, 24 nt, Human
cacagccgccgccacugcguccgu

SEQ ID NO: 122237 - RNA, 25 nt, Human
gggcucucuuacaccgcacucaggg

SEQ ID NO: 122238 - RNA, 25 nt, Human
cuuugccuuggaaguugcauggcau

SEQ ID NO: 122239 - RNA, 23 nt, Human
uccucuugcacaugggagcugga

SEQ ID NO: 122240 - RNA, 23 nt, Human
aguccacuucgacugcucaggga

SEQ ID NO: 122241 - RNA, 27 nt, Human
ccugccugcccugccuacugagaagac

SEQ ID NO: 122242 - RNA, 25 nt, Human
caaaauaaucuauauuaaaugaggg

SEQ ID NO: 122243 - RNA, 25 nt, Human
uaaauguuaacccguaauaauggga

SEQ ID NO: 122244 - RNA, 20 nt, Human
accagccagcuaauuuuugu

SEQ ID NO: 122245 - RNA, 22 nt, Human
cccccgcccuccagcccagggg

SEQ ID NO: 122246 - RNA, 21 nt, Human
uccuagagauacugaagaugu

SEQ ID NO: 122247 - RNA, 24 nt, Human
uaaggaagaaacauuaagauuguu

SEQ ID NO: 122248 - RNA, 20 nt, Human
caaagggauguucacuguau

SEQ ID NO: 122249 - RNA, 22 nt, Human
agcuuuuacacugaauuucuaa

SEQ ID NO: 122250 - RNA, 20 nt, Human
gauauuuauuuaaccaauga

SEQ ID NO: 122251 - RNA, 22 nt, Human
ccgccgccaccaccaccgccau

SEQ ID NO: 122252 - RNA, 29 nt, Human
ccuagagcgcggcuggcucuguggagggg

SEQ ID NO: 122253 - RNA, 26 nt, Human
ccuccugccgacuccuggguugagcu

SEQ ID NO: 122254 - RNA, 21 nt, Human
cugucaggagggcuuccuggg

SEQ ID NO: 122255 - RNA, 27 nt, Human
cagagagggaaaaggcaggugcuuuug

SEQ ID NO: 122256 - RNA, 23 nt, Human
gcccaggcuggagugcagugagc

SEQ ID NO: 122257 - RNA, 23 nt, Human
cuuaccucauuugcauccuaucg

SEQ ID NO: 122258 - RNA, 20 nt, Human
uggcauaguuccaggugcgu

SEQ ID NO: 122259 - RNA, 25 nt, Human
gcgcagcccuggcccaggaaggcag

SEQ ID NO: 122260 - RNA, 24 nt, Human
ccuuaggcccagcuuucaaccugc

SEQ ID NO: 122261 - RNA, 21 nt, Human
agaaucaguuagguuccucac

SEQ ID NO: 122262 - RNA, 20 nt, Human
ccgcagaggcugccugcugc

SEQ ID NO: 122263 - RNA, 22 nt, Human
cccgaguagcugagacuucagg

SEQ ID NO: 122264 - RNA, 23 nt, Human
ugcacuccaggcuggguaacaga

SEQ ID NO: 122265 - RNA, 21 nt, Human
ggaggugggagugaggagccc

SEQ ID NO: 122266 - RNA, 23 nt, Human
caggccuuucucucagccucugg

SEQ ID NO: 122267 - RNA, 22 nt, Human
ugcuuuuuucuuugcugaacuu

SEQ ID NO: 122268 - RNA, 21 nt, Human
cucccagaaccugucuggagg

SEQ ID NO: 122269 - RNA, 21 nt, Human
ucuucauuuugcuagcuuugc

SEQ ID NO: 122270 - RNA, 20 nt, Human
ucucaaucuucccugcccag

SEQ ID NO: 122271 - RNA, 20 nt, Human
gcuccccuuuuucuuccuca

SEQ ID NO: 122272 - RNA, 22 nt, Human
acuuaaccuugucaauagguuc

SEQ ID NO: 122273 - RNA, 27 nt, Human
cucucuccaacugcuucagcaucuggc

SEQ ID NO: 122274 - RNA, 27 nt, Human
guucucugggucgucuaaggacaguug

SEQ ID NO: 122275 - RNA, 22 nt, Human
acugcaaccuccgccucccagg

SEQ ID NO: 122276 - RNA, 25 nt, Human
ugcccgcgcuccuccgcagccuggg

SEQ ID NO: 122277 - RNA, 26 nt, Human
aaaugguuaucuuugagaccauccau

SEQ ID NO: 122278 - RNA, 19 nt, Human
accuucaguuccaggauuu

SEQ ID NO: 122279 - RNA, 21 nt, Human
aggugcuuuuggcagagacca

SEQ ID NO: 122280 - RNA, 21 nt, Human
uuccaaaaccuuccucuucca

SEQ ID NO: 122281 - RNA, 24 nt, Human
aaguuuauaauuugccacaccugg

SEQ ID NO: 122282 - RNA, 27 nt, Human
uugucuaccucaggccuugugcauuug

SEQ ID NO: 122283 - RNA, 20 nt, Human
aggaguggaacggacaauca

SEQ ID NO: 122284 - RNA, 23 nt, Human
guuugccaucaucuaagccacug

SEQ ID NO: 122285 - RNA, 20 nt, Human
caagcuagcagaaacuccau

SEQ ID NO: 122286 - RNA, 19 nt, Human
ugaagccagcuguuggagg

SEQ ID NO: 122287 - RNA, 20 nt, Human
ugaaggcaggggcucagugg

SEQ ID NO: 122288 - RNA, 25 nt, Human
acuucuauuuuaaagacaauguuaa

SEQ ID NO: 122289 - RNA, 22 nt, Human
acuaggcccugccucugucacc

SEQ ID NO: 122290 - RNA, 24 nt, Human
ccuuucucgcuccccccauccugg

SEQ ID NO: 122291 - RNA, 19 nt, Human
cucuguccccuccuugccc

SEQ ID NO: 122292 - RNA, 26 nt, Human
uaucccccuuccucugcaauucucca

SEQ ID NO: 122293 - RNA, 27 nt, Human
uuccaucuggcugccuuugcuuaagcc

SEQ ID NO: 122294 - RNA, 22 nt, Human
ggcugcugcugaccggaguguc

SEQ ID NO: 122295 - RNA, 22 nt, Human
ggaggcugaggcaggcggauca

SEQ ID NO: 122296 - RNA, 27 nt, Human
ggggauuagagugauuaugggagcagc

SEQ ID NO: 122297 - RNA, 24 nt, Human
ccccuuugaugauuaauucaccuu

SEQ ID NO: 122298 - RNA, 18 nt, Human
ccagccgccgccguccag

SEQ ID NO: 122299 - RNA, 25 nt, Human
cuccgcaucucagccaccuuccuca

SEQ ID NO: 122300 - RNA, 24 nt, Human
uauuuuguguauaaugugcuuuau

SEQ ID NO: 122301 - RNA, 27 nt, Human
acuguaagcccacacuuaaccuuguca

SEQ ID NO: 122302 - RNA, 20 nt, Human
aggggaggugggguuuggug

SEQ ID NO: 122303 - RNA, 24 nt, Human
guuccccaggcucacaguguagag

SEQ ID NO: 122304 - RNA, 22 nt, Human
uaccauucccuucucaaaggaa

SEQ ID NO: 122305 - RNA, 21 nt, Human
gaaaucaagauacacaagugg

SEQ ID NO: 122306 - RNA, 23 nt, Human
ucucgaacucuugaccucaggug

SEQ ID NO: 122307 - RNA, 22 nt, Human
cauaggaggugggggaacugga

SEQ ID NO: 122308 - RNA, 24 nt, Human
gagcugggccuacucucagcugcc

SEQ ID NO: 122309 - RNA, 23 nt, Human
uguugaccaggcuggagugcagu

SEQ ID NO: 122310 - RNA, 26 nt, Human
aacauuuuuggggcucagccacuagu

SEQ ID NO: 122311 - RNA, 23 nt, Human
gggagcuggggauuggcgacucc

SEQ ID NO: 122312 - RNA, 22 nt, Human
agaugucccuugugacuguccc

SEQ ID NO: 122313 - RNA, 21 nt, Human
acucagcuugagacuguacua

SEQ ID NO: 122314 - RNA, 26 nt, Human
cuugcgcaccugcucucuuacacaca

SEQ ID NO: 122315 - RNA, 26 nt, Human
cauuguacuccagccugggcaauaag

SEQ ID NO: 122316 - RNA, 23 nt, Human
uucacaguuauaaacuguauuca

SEQ ID NO: 122317 - RNA, 27 nt, Human
ugagguguccggguucccuucgcccag

SEQ ID NO: 122318 - RNA, 21 nt, Human
cauuuucucuggcccucuacc

SEQ ID NO: 122319 - RNA, 19 nt, Human
cugcucccauuccucccuc

SEQ ID NO: 122320 - RNA, 17 nt, Human
accauaaauuggcuuuu

SEQ ID NO: 122321 - RNA, 21 nt, Human
cuauugcaguuucaucccauu

SEQ ID NO: 122322 - RNA, 19 nt, Human
uugucucuucugaggaccg

SEQ ID NO: 122323 - RNA, 23 nt, Human
gucuggaacuccugaccucguga

SEQ ID NO: 122324 - RNA, 26 nt, Human
ugagugccuugaaaacugaucuuccu

SEQ ID NO: 122325 - RNA, 22 nt, Human
caauuucagucuucacagggau

SEQ ID NO: 122326 - RNA, 22 nt, Human
ucugaacugcucuacuuugaga

SEQ ID NO: 122327 - RNA, 21 nt, Human
accauuuccucagacucuaag

SEQ ID NO: 122328 - RNA, 21 nt, Human
ggggcaacaggaaggggccug

SEQ ID NO: 122329 - RNA, 27 nt, Human
uucacagugacagcccuccccuacaau

SEQ ID NO: 122330 - RNA, 25 nt, Human
ggccuggcuucucacugccaccuca

SEQ ID NO: 122331 - RNA, 14 nt, Human
cuucccuuaggcag

SEQ ID NO: 122332 - RNA, 21 nt, Human
uauucaugcuucuuccuuacc

SEQ ID NO: 122333 - RNA, 20 nt, Human
gcugagaccgguggcucucu

SEQ ID NO: 122334 - RNA, 28 nt, Human
cuccgagcggcugcuucccgguugccuc

SEQ ID NO: 122335 - RNA, 23 nt, Human
cccaggagguggagguugcagug

SEQ ID NO: 122336 - RNA, 22 nt, Human
guuucuuuuauuuucauuucua

SEQ ID NO: 122337 - RNA, 24 nt, Human
gcucucauuuuuugauuuauuuuu

SEQ ID NO: 122338 - RNA, 23 nt, Human
cugccugcacuggaacccacaga

SEQ ID NO: 122339 - RNA, 21 nt, Human
gcuuugcuaugaccucagucc

SEQ ID NO: 122340 - RNA, 21 nt, Human
ccucccucuccccugcccacc

SEQ ID NO: 122341 - RNA, 20 nt, Human
gccucauucuccucuggccu

SEQ ID NO: 122342 - RNA, 26 nt, Human
gccugacagugacaaugacaucccag

SEQ ID NO: 122343 - RNA, 21 nt, Human
agcaguuucugcauuauuugu

SEQ ID NO: 122344 - RNA, 15 nt, Human
accauaucacaugcc

SEQ ID NO: 122345 - RNA, 21 nt, Human
ucuuccacucuggagugaagu

SEQ ID NO: 122346 - RNA, 21 nt, Human
gugcgucgggccagggccaca

SEQ ID NO: 122347 - RNA, 26 nt, Human
gcaggaucgggagaccccaacucccc

SEQ ID NO: 122348 - RNA, 22 nt, Human
uauaauauauuguaaacaaaac

SEQ ID NO: 122349 - RNA, 23 nt, Human
aggguccaaccagaccuggaaga

SEQ ID NO: 122350 - RNA, 27 nt, Human
cacuguacuccagccugggagauagag

SEQ ID NO: 122351 - RNA, 21 nt, Human
cacccaggcugcaguguagug

SEQ ID NO: 122352 - RNA, 23 nt, Human
ggcgggguggaggugcgcgcuga

SEQ ID NO: 122353 - RNA, 23 nt, Human
cuucaguguguguauuuguguaa

SEQ ID NO: 122354 - RNA, 21 nt, Human
uaacauaacuaacuccauuuu

SEQ ID NO: 122355 - RNA, 22 nt, Human
aggcuggaucccuggggcaggc

SEQ ID NO: 122356 - RNA, 22 nt, Human
ggcugggcacgguggcucacag

SEQ ID NO: 122357 - RNA, 23 nt, Human
ucugaauaaggucauugcauuua

SEQ ID NO: 122358 - RNA, 19 nt, Human
cuucuccaagacucaggcc

SEQ ID NO: 122359 - RNA, 24 nt, Human
agagaacaucagaugauugaaaug

SEQ ID NO: 122360 - RNA, 21 nt, Human
gccuauaucccagcacuuugg

SEQ ID NO: 122361 - RNA, 24 nt, Human
guaaacccacugggcaccacagag

SEQ ID NO: 122362 - RNA, 25 nt, Human
ggcugagaggucaagguugcaguga

SEQ ID NO: 122363 - RNA, 22 nt, Human
cuaccugaaauguguagcuuua

SEQ ID NO: 122364 - RNA, 23 nt, Human
acuguucuuaugucauuuguuau

SEQ ID NO: 122365 - RNA, 22 nt, Human
gcuccuucccuucccccuggcc

SEQ ID NO: 122366 - RNA, 21 nt, Human
cacccaggcuggaguacaaua

SEQ ID NO: 122367 - RNA, 20 nt, Human
ucguguucauacugcagcuu

SEQ ID NO: 122368 - RNA, 21 nt, Human
acccugugucacgaacccccg

SEQ ID NO: 122369 - RNA, 23 nt, Human
acugcugcuuucccuccugggcu

SEQ ID NO: 122370 - RNA, 23 nt, Human
gcccagacuuggguguuacagga

SEQ ID NO: 122371 - RNA, 25 nt, Human
ugcuggagcuacacgacuggaugug

SEQ ID NO: 122372 - RNA, 26 nt, Human
caugccaccacgcccagcuaauauuu

SEQ ID NO: 122373 - RNA, 19 nt, Human
cugaaaaaggaacuaccua

SEQ ID NO: 122374 - RNA, 27 nt, Human
aagaggaaggaugaagggcuucaggcu

SEQ ID NO: 122375 - RNA, 24 nt, Human
cgggcagccgccuucugagccccc

SEQ ID NO: 122376 - RNA, 24 nt, Human
agagaaacugagagaaaagggaug

SEQ ID NO: 122377 - RNA, 25 nt, Human
gcuccaggauuugugugcuguugcc

SEQ ID NO: 122378 - RNA, 27 nt, Human
uucacaguggucccauuuauaucugcu

SEQ ID NO: 122379 - RNA, 24 nt, Human
ccacacgcauacacacaugaacac

SEQ ID NO: 122380 - RNA, 24 nt, Human
aacugcaugaugaauagcaccuua

SEQ ID NO: 122381 - RNA, 21 nt, Human
ggagggcgcacaucagggcag

SEQ ID NO: 122382 - RNA, 23 nt, Human
ucacgagccagguccugggggua

SEQ ID NO: 122383 - RNA, 21 nt, Human
aagaacaacagaaauuaucug

SEQ ID NO: 122384 - RNA, 22 nt, Human
cagccucuuccuguccuuuaga

SEQ ID NO: 122385 - RNA, 22 nt, Human
gcucacgccuguaauccuagca

SEQ ID NO: 122386 - RNA, 22 nt, Human
guucacgccuguaaucccagca

SEQ ID NO: 122387 - RNA, 26 nt, Human
acucaggaagacaacuucugcagggu

SEQ ID NO: 122388 - RNA, 25 nt, Human
gagggagggacugggcagggacugc

SEQ ID NO: 122389 - RNA, 27 nt, Human
ggaaggggccucaggagcaggaagggc

SEQ ID NO: 122390 - RNA, 23 nt, Human
gggacagaugaguuuuccagaua

SEQ ID NO: 122391 - RNA, 22 nt, Human
ucgcccaggcuggggugcagug

SEQ ID NO: 122392 - RNA, 22 nt, Human
uucuccauguuggucaggcugc

SEQ ID NO: 122393 - RNA, 27 nt, Human
gcucucaugccuugcuguccccucccc

SEQ ID NO: 122394 - RNA, 20 nt, Human
gguuccucugguucuugccu

SEQ ID NO: 122395 - RNA, 20 nt, Human
cuguuucagcugcuacuuca

SEQ ID NO: 122396 - RNA, 28 nt, Human
ucucaguaaaaaaggauugccacagucc

SEQ ID NO: 122397 - RNA, 23 nt, Human
guuaccuccccuuccuccacccu

SEQ ID NO: 122398 - RNA, 23 nt, Human
ggccugugaaacaugacacugca

SEQ ID NO: 122399 - RNA, 20 nt, Human
auuccuuuggggaaaauugu

SEQ ID NO: 122400 - RNA, 23 nt, Human
ccuacuuccaccuaaucuguuua

SEQ ID NO: 122401 - RNA, 26 nt, Human
uacacaccaaaugaguccaaacugga

SEQ ID NO: 122402 - RNA, 27 nt, Human
ucuguccccucuccccucauggagaaa

SEQ ID NO: 122403 - RNA, 27 nt, Human
guugcucuuccuuguuuuuguuuuguu

SEQ ID NO: 122404 - RNA, 24 nt, Human
caaauguuaugcauaaagucagug

SEQ ID NO: 122405 - RNA, 21 nt, Human
cuggcgucuguuucaagccag

SEQ ID NO: 122406 - RNA, 28 nt, Human
ucuuucuagugaggagauacauaucaga

SEQ ID NO: 122407 - RNA, 17 nt, Human
ggaacgggcccaccuca

SEQ ID NO: 122408 - RNA, 27 nt, Human
cacacugagacaugugccuuaaacaga

SEQ ID NO: 122409 - RNA, 24 nt, Human
ccacucauuccuucucgugcacug

SEQ ID NO: 122410 - RNA, 25 nt, Human
cagugaaugucucuuggcaugggag

SEQ ID NO: 122411 - RNA, 21 nt, Human
ugaggaaggacuugacugggg

SEQ ID NO: 122412 - RNA, 21 nt, Human
accagcugaggaccucaggcu

SEQ ID NO: 122413 - RNA, 23 nt, Human
caccuucgccucuuuccuucaca

SEQ ID NO: 122414 - RNA, 22 nt, Human
uuucuagcuugccaccguucau

SEQ ID NO: 122415 - RNA, 20 nt, Human
cagccaggcccggcccaggg

SEQ ID NO: 122416 - RNA, 21 nt, Human
uccuuaaaaugugagugaccu

SEQ ID NO: 122417 - RNA, 20 nt, Human
acuucauuccacccagucuc

SEQ ID NO: 122418 - RNA, 25 nt, Human
aaaaagagacucuguuaggugacau

SEQ ID NO: 122419 - RNA, 21 nt, Human
aggaagagaaggagcacaggc

SEQ ID NO: 122420 - RNA, 19 nt, Human
guugcucaaaucuauucag

SEQ ID NO: 122421 - RNA, 27 nt, Human
ugggggguaggacccacagaugucuug

SEQ ID NO: 122422 - RNA, 21 nt, Human
aggaggugggggauugaggga

SEQ ID NO: 122423 - RNA, 27 nt, Human
ggggguucccuguucccagagucugca

SEQ ID NO: 122424 - RNA, 22 nt, Human
uucacuacuuuguaucaaucca

SEQ ID NO: 122425 - RNA, 20 nt, Human
cgcugagaaagggagaagac

SEQ ID NO: 122426 - RNA, 22 nt, Human
gcggcgguaucacaggcucucc

SEQ ID NO: 122427 - RNA, 22 nt, Human
ggagacuaacaaaguuuucaug

SEQ ID NO: 122428 - RNA, 22 nt, Human
aggcucucuuccaacucacucu

SEQ ID NO: 122429 - RNA, 26 nt, Human
gaacuugccucuuuuaccugcugcuu

SEQ ID NO: 122430 - RNA, 20 nt, Human
aaaauacaaaaauuagccgg

SEQ ID NO: 122431 - RNA, 22 nt, Human
cugugcuaauugggagcacuug

SEQ ID NO: 122432 - RNA, 26 nt, Human
aaagagugggccgcuguguuuggaga

SEQ ID NO: 122433 - RNA, 24 nt, Human
cggacucaggcuggggucugcagu

SEQ ID NO: 122434 - RNA, 27 nt, Human
cuaacucaaggaggagagcuauguaca

SEQ ID NO: 122435 - RNA, 27 nt, Human
acugcaaccucugccuaccggauucaa

SEQ ID NO: 122436 - RNA, 22 nt, Human
gacuacaggcaccugccaccau

SEQ ID NO: 122437 - RNA, 20 nt, Human
auuauguuuucacuugccau

SEQ ID NO: 122438 - RNA, 22 nt, Human
ggcacccaccaccacacccagc

SEQ ID NO: 122439 - RNA, 25 nt, Human
ugcccucccggguagagcugggaug

SEQ ID NO: 122440 - RNA, 26 nt, Human
ucaggagagggagcaagaggaguuuu

SEQ ID NO: 122441 - RNA, 20 nt, Human
cuggugaauauagugcugcu

SEQ ID NO: 122442 - RNA, 22 nt, Human
ccucauuucugugccaaauguu

SEQ ID NO: 122443 - RNA, 22 nt, Human
cuccucacugucuaccugagag

SEQ ID NO: 122444 - RNA, 25 nt, Human
aagagugggccgcuguguuuggaga

SEQ ID NO: 122445 - RNA, 25 nt, Human
uucuuccaaugugucuuccuaggca

SEQ ID NO: 122446 - RNA, 23 nt, Human
gcucaacaucuguuaccccauag

SEQ ID NO: 122447 - RNA, 20 nt, Human
uguacggguucccaugaauc

SEQ ID NO: 122448 - RNA, 26 nt, Human
gagagggaggcaagcccuguugacac

SEQ ID NO: 122449 - RNA, 23 nt, Human
auugcaccacugcucuccagccu

SEQ ID NO: 122450 - RNA, 19 nt, Human
acuccuggcuccugggacu

SEQ ID NO: 122451 - RNA, 28 nt, Human
caaggcucaucuugagaagcaggcgggu

SEQ ID NO: 122452 - RNA, 21 nt, Human
cuggugcauuauuucagcugu

SEQ ID NO: 122453 - RNA, 22 nt, Human
uuuguuugcauaggugaucuca

SEQ ID NO: 122454 - RNA, 20 nt, Human
caauguucacaucugcacuc

SEQ ID NO: 122455 - RNA, 24 nt, Human
cucccagaccuagggauccugaaa

SEQ ID NO: 122456 - RNA, 26 nt, Human
ucaguuacaccucccagugcccuucu

SEQ ID NO: 122457 - RNA, 22 nt, Human
cuggauccugcgccucuggacg

SEQ ID NO: 122458 - RNA, 24 nt, Human
aaacagugugaugcaauuacugcu

SEQ ID NO: 122459 - RNA, 22 nt, Human
gaggguggaagaggagagggug

SEQ ID NO: 122460 - RNA, 22 nt, Human
agccucccaaguagcugggguu

SEQ ID NO: 122461 - RNA, 22 nt, Human
gccucggccaccaugucccgcc

SEQ ID NO: 122462 - RNA, 21 nt, Human
auccuguggaacccgccccau

SEQ ID NO: 122463 - RNA, 23 nt, Human
gccccccgcccuccagcccaggg

SEQ ID NO: 122464 - RNA, 26 nt, Human
uagcccugugggauaggcaguuaggg

SEQ ID NO: 122465 - RNA, 19 nt, Human
ucugcagcugucugcugcu

SEQ ID NO: 122466 - RNA, 20 nt, Human
gguccugcauuuuauaagac

SEQ ID NO: 122467 - RNA, 19 nt, Human
ucagcacuuccuuuggugu

SEQ ID NO: 122468 - RNA, 22 nt, Human
ccuugguuuccccaucuguaga

SEQ ID NO: 122469 - RNA, 19 nt, Human
agagcaagaccccaucuca

SEQ ID NO: 122470 - RNA, 23 nt, Human
cuuucaagcuguguauuuuugcc

SEQ ID NO: 122471 - RNA, 15 nt, Human
gcaaaggugugcaaa

SEQ ID NO: 122472 - RNA, 21 nt, Human
cgugagcauguucaucauguu

SEQ ID NO: 122473 - RNA, 24 nt, Human
ucaagacgcugaggugguggcugc

SEQ ID NO: 122474 - RNA, 22 nt, Human
uggaucaugucuguaauccuag

SEQ ID NO: 122475 - RNA, 25 nt, Human
caggcagccaacaagcaauuaagag

SEQ ID NO: 122476 - RNA, 24 nt, Human
ugaacaaauuacggcaaaguuuua

SEQ ID NO: 122477 - RNA, 24 nt, Human
gccaacaacauggggcucaggucu

SEQ ID NO: 122478 - RNA, 22 nt, Human
gggggaggaggggaaaaaagca

SEQ ID NO: 122479 - RNA, 23 nt, Human
uuuguuauuuucaguauuuugga

SEQ ID NO: 122480 - RNA, 26 nt, Human
gucccauucccucucuguagggcuuc

SEQ ID NO: 122481 - RNA, 21 nt, Human
acucgguacucucugaagaug

SEQ ID NO: 122482 - RNA, 20 nt, Human
aucuccugucaccaccagaa

SEQ ID NO: 122483 - RNA, 26 nt, Human
ccuucucuuucuucguucccugccca

SEQ ID NO: 122484 - RNA, 32 nt, Human
gcggguuccagcggaccucacagcagccccag

SEQ ID NO: 122485 - RNA, 18 nt, Human
ucucucagcugugcagug

SEQ ID NO: 122486 - RNA, 22 nt, Human
ugggcugggcccucucuucuca

SEQ ID NO: 122487 - RNA, 23 nt, Human
cuggcaggcuuccauccccgucc

SEQ ID NO: 122488 - RNA, 26 nt, Human
ucaguaaucacccauguguaucugca

SEQ ID NO: 122489 - RNA, 27 nt, Human
cuuugggccagacaugccacaaggacu

SEQ ID NO: 122490 - RNA, 29 nt, Human
ggaaaaucuauagauuauuuauaagagaa

SEQ ID NO: 122491 - RNA, 22 nt, Human
acuaugcugcaggaauccugag

SEQ ID NO: 122492 - RNA, 22 nt, Human
gccccacucagccuccuccugc

SEQ ID NO: 122493 - RNA, 22 nt, Human
gcccaaaccucagcauucugca

SEQ ID NO: 122494 - RNA, 21 nt, Human
cagguggguguacucuggccu

SEQ ID NO: 122495 - RNA, 20 nt, Human
aaagcaggcuaggugaccuu

SEQ ID NO: 122496 - RNA, 23 nt, Human
cccaaagugcugggauuaaggcg

SEQ ID NO: 122497 - RNA, 27 nt, Human
ccucgcgcucugccucagucaguggcg

SEQ ID NO: 122498 - RNA, 22 nt, Human
gguauggcacccugggagcccg

SEQ ID NO: 122499 - RNA, 20 nt, Human
ggcccuccccucccaccucc

SEQ ID NO: 122500 - RNA, 22 nt, Human
gaccauagugaccaacauagug

SEQ ID NO: 122501 - RNA, 21 nt, Human
ccuguaaucccaacacuuggg

SEQ ID NO: 122502 - RNA, 21 nt, Human
aaagcuguacauguauauaua

SEQ ID NO: 122503 - RNA, 22 nt, Human
ugccuggacaagcacauagcaa

SEQ ID NO: 122504 - RNA, 22 nt, Human
ggugagggcaggauggagacca

SEQ ID NO: 122505 - RNA, 28 nt, Human
guggaguguguuacagaaauuggcagca

SEQ ID NO: 122506 - RNA, 27 nt, Human
cucucccugaauccagagcgcugcagu

SEQ ID NO: 122507 - RNA, 22 nt, Human
gcagccaagggagccaaacaca

SEQ ID NO: 122508 - RNA, 21 nt, Human
gggagcugagugggggaucac

SEQ ID NO: 122509 - RNA, 25 nt, Human
uuuagcugguaccagguugauauga

SEQ ID NO: 122510 - RNA, 22 nt, Human
cuagcuuaaucaaaauguuuga

SEQ ID NO: 122511 - RNA, 27 nt, Human
cagguuggggagaggacggaggguggc

SEQ ID NO: 122512 - RNA, 18 nt, Human
ccuacaaaugugaagaau

SEQ ID NO: 122513 - RNA, 25 nt, Human
cuugggagcucugugccaggcccac

SEQ ID NO: 122514 - RNA, 24 nt, Human
cugcugaauuuuuaaauguucacu

SEQ ID NO: 122515 - RNA, 23 nt, Human
uugcaggcagaguuuuggggacc

SEQ ID NO: 122516 - RNA, 23 nt, Human
uuuuaaagccucuucauccaggu

SEQ ID NO: 122517 - RNA, 23 nt, Human
cugcaggaugggugaaaccacau

SEQ ID NO: 122518 - RNA, 21 nt, Human
ccaaagaaugaggcuggagac

SEQ ID NO: 122519 - RNA, 21 nt, Human
uugaagccagaauuuucuuug

SEQ ID NO: 122520 - RNA, 23 nt, Human
gggcucuacaaccagcuccuuca

SEQ ID NO: 122521 - RNA, 22 nt, Human
cuccaccucccaaagugcuagg

SEQ ID NO: 122522 - RNA, 23 nt, Human
ccacaugaggggacagugcagcu

SEQ ID NO: 122523 - RNA, 20 nt, Human
uuuucaucugaagccugcua

SEQ ID NO: 122524 - RNA, 21 nt, Human
guuaggaggcugcaugcucug

SEQ ID NO: 122525 - RNA, 21 nt, Human
ucacugcagcugccagcacuu

SEQ ID NO: 122526 - RNA, 22 nt, Human
cgguccugccucgcugccuuca

SEQ ID NO: 122527 - RNA, 25 nt, Human
cuguuuccagccgcugaaucugcug

SEQ ID NO: 122528 - RNA, 22 nt, Human
gggccaaaggucaguggcaggg

SEQ ID NO: 122529 - RNA, 22 nt, Human
ccacagugcugggauuaccggc

SEQ ID NO: 122530 - RNA, 26 nt, Human
gcucacugcgugcaccuggcgcugcc

SEQ ID NO: 122531 - RNA, 22 nt, Human
cagugaagaaucaaccggaccu

SEQ ID NO: 122532 - RNA, 21 nt, Human
ugacccacagauggcgucaau

SEQ ID NO: 122533 - RNA, 29 nt, Human
uagccaaaaaguggaaacaacccaaaugu

SEQ ID NO: 122534 - RNA, 26 nt, Human
ugucagcaggcugcagggagugcaca

SEQ ID NO: 122535 - RNA, 28 nt, Human
ccgugacaacaggccaccacauaccuca

SEQ ID NO: 122536 - RNA, 22 nt, Human
gcccagacuacagggcuuagga

SEQ ID NO: 122537 - RNA, 22 nt, Human
ugcugcaccugugcauucucca

SEQ ID NO: 122538 - RNA, 27 nt, Human
gcuuaacucugucagacaaacuggaaa

SEQ ID NO: 122539 - RNA, 21 nt, Human
uucgccaaggcuggagugcag

SEQ ID NO: 122540 - RNA, 24 nt, Human
cuugcuuucauuuuaauuagucca

SEQ ID NO: 122541 - RNA, 20 nt, Human
auugaaucagaaugccuuca

SEQ ID NO: 122542 - RNA, 22 nt, Human
uaacauccagcuuuccugcccc

SEQ ID NO: 122543 - RNA, 22 nt, Human
agggaaauugacugcaggugau

SEQ ID NO: 122544 - RNA, 26 nt, Human
ggagcugccuccugccggcgggccgg

SEQ ID NO: 122545 - RNA, 25 nt, Human
cuuaacuacugagcgcaaugcugag

SEQ ID NO: 122546 - RNA, 24 nt, Human
aggaaaugcaguguguugcagugg

SEQ ID NO: 122547 - RNA, 22 nt, Human
caacugacccugaaggcuuuca

SEQ ID NO: 122548 - RNA, 18 nt, Human
gaacaaauuguuuacaua

SEQ ID NO: 122549 - RNA, 19 nt, Human
guuuguguaccuguauuug

SEQ ID NO: 122550 - RNA, 28 nt, Human
aggaauguguggccugcacagugaagug

SEQ ID NO: 122551 - RNA, 20 nt, Human
cuucccuuaucuuacuguca

SEQ ID NO: 122552 - RNA, 26 nt, Human
uugcaaccuccgcugccgucgccgca

SEQ ID NO: 122553 - RNA, 23 nt, Human
uguugauaauuucagggaaauua

SEQ ID NO: 122554 - RNA, 20 nt, Human
ucaaagguacgggccagcuu

SEQ ID NO: 122555 - RNA, 21 nt, Human
aaauuauuacuguaagaaaua

SEQ ID NO: 122556 - RNA, 22 nt, Human
ccaggauggugaagggggaccu

SEQ ID NO: 122557 - RNA, 20 nt, Human
gggagggcagcagaggcaga

SEQ ID NO: 122558 - RNA, 27 nt, Human
cucauuucuucaccuacaacccuuugu

SEQ ID NO: 122559 - RNA, 26 nt, Human
ugucuuguuaguuugcaguuagccaa

SEQ ID NO: 122560 - RNA, 20 nt, Human
ugucaacaggggcgugaggu

SEQ ID NO: 122561 - RNA, 22 nt, Human
cuauuaauguauuuuuauuuau

SEQ ID NO: 122562 - RNA, 23 nt, Human
ggagcagucaucuguggugaggc

SEQ ID NO: 122563 - RNA, 23 nt, Human
ggcaggagaauggcgugaaccug

SEQ ID NO: 122564 - RNA, 22 nt, Human
uguggggugugggugucccuua

SEQ ID NO: 122565 - RNA, 21 nt, Human
gacuccuggguucaagcaauc

SEQ ID NO: 122566 - RNA, 25 nt, Human
aggagucugugcugugcacccuggg

SEQ ID NO: 122567 - RNA, 23 nt, Human
cuucugcugcuagcgccggagcu

SEQ ID NO: 122568 - RNA, 21 nt, Human
aggcgagcccuccuucagggg

SEQ ID NO: 122569 - RNA, 27 nt, Human
uuaucuagagccuucguuccuggccau

SEQ ID NO: 122570 - RNA, 21 nt, Human
cacacugcacuccauccuggg

SEQ ID NO: 122571 - RNA, 26 nt, Human
gccugagccccagggaagcaggcuag

SEQ ID NO: 122572 - RNA, 26 nt, Human
uuuuucuccccuugcucuuccuggcc

SEQ ID NO: 122573 - RNA, 23 nt, Human
uucuuagcuguuucccuuccucu

SEQ ID NO: 122574 - RNA, 20 nt, Human
uccaccuccucuccaccugc

SEQ ID NO: 122575 - RNA, 23 nt, Human
ucaggauaacagagaaugguggu

SEQ ID NO: 122576 - RNA, 18 nt, Human
ccuucauucugcagugag

SEQ ID NO: 122577 - RNA, 23 nt, Human
ggacagaaagcauggacaaggga

SEQ ID NO: 122578 - RNA, 24 nt, Human
ccagaucauugugaaauuauucau

SEQ ID NO: 122579 - RNA, 21 nt, Human
gaugggugcugaaauauuuua

SEQ ID NO: 122580 - RNA, 22 nt, Human
aauuccaccaucauacagauca

SEQ ID NO: 122581 - RNA, 22 nt, Human
uauuuucuguucacauuuaucu

SEQ ID NO: 122582 - RNA, 22 nt, Human
caggcuugagugcaguggugcg

SEQ ID NO: 122583 - RNA, 17 nt, Human
gccuguguccccaccac

SEQ ID NO: 122584 - RNA, 27 nt, Human
cugguucaagcgauucucuugccucag

SEQ ID NO: 122585 - RNA, 25 nt, Human
gcuguuaaucauuucagagaagaac

SEQ ID NO: 122586 - RNA, 21 nt, Human
ggagguggggugggggagugg

SEQ ID NO: 122587 - RNA, 18 nt, Human
gcuguguuuuaucuuuaa

SEQ ID NO: 122588 - RNA, 20 nt, Human
aaaguugauuuaaggccagg

SEQ ID NO: 122589 - RNA, 24 nt, Human
cucccgcuggcccaggucuccucu

SEQ ID NO: 122590 - RNA, 23 nt, Human
ugcucccuccucggauuugauug

SEQ ID NO: 122591 - RNA, 21 nt, Human
gaagcuauuuaggagauauga

SEQ ID NO: 122592 - RNA, 24 nt, Human
ccuuccuggcccuugcauggaugc

SEQ ID NO: 122593 - RNA, 20 nt, Human
aggagccccccugggugggg

SEQ ID NO: 122594 - RNA, 28 nt, Human
ccucuguuaccaccaccucuaaugccuc

SEQ ID NO: 122595 - RNA, 27 nt, Human
cucccaggcugagggcggguguucugg

SEQ ID NO: 122596 - RNA, 26 nt, Human
gucccuuggaaaguucagccagaauc

SEQ ID NO: 122597 - RNA, 23 nt, Human
ccaccgcacccaguccugagggg

SEQ ID NO: 122598 - RNA, 19 nt, Human
gucaagcaucuggcacagc

SEQ ID NO: 122599 - RNA, 23 nt, Human
cagggaacagcagagagcaguug

SEQ ID NO: 122600 - RNA, 20 nt, Human
ccagaaacuccagacuugua

SEQ ID NO: 122601 - RNA, 23 nt, Human
uauguauguauuuaggcuauucu

SEQ ID NO: 122602 - RNA, 26 nt, Human
uucaggccauucuccugccucagccu

SEQ ID NO: 122603 - RNA, 21 nt, Human
gcuggucucaaacuccugggc

SEQ ID NO: 122604 - RNA, 24 nt, Human
ggucgccuagacuggauagugggg

SEQ ID NO: 122605 - RNA, 26 nt, Human
cccuccagcgagucccaggagaguga

SEQ ID NO: 122606 - RNA, 23 nt, Human
gcccccuacugagaaacuuccuu

SEQ ID NO: 122607 - RNA, 22 nt, Human
ugcccaggcuggagugcaauga

SEQ ID NO: 122608 - RNA, 24 nt, Human
ggucugggagccccaagcuggccu

SEQ ID NO: 122609 - RNA, 24 nt, Human
uuuauuaaaauucugaauuuuggg

SEQ ID NO: 122610 - RNA, 21 nt, Human
cuguucucugacuaacgccau

SEQ ID NO: 122611 - RNA, 20 nt, Human
uguuuacaauaggcacucuc

SEQ ID NO: 122612 - RNA, 32 nt, Human
ugcacacuggcucugggacuugcagaaggccu

SEQ ID NO: 122613 - RNA, 25 nt, Human
cccccuucccuucuuccccugccgg

SEQ ID NO: 122614 - RNA, 21 nt, Human
gagggggucagagaaggggaa

SEQ ID NO: 122615 - RNA, 23 nt, Human
ccuggcccugcuucccauccucc

SEQ ID NO: 122616 - RNA, 22 nt, Human
agcaggagacuggcaagagcuc

SEQ ID NO: 122617 - RNA, 21 nt, Human
cuguuugcugccuuccuggcc

SEQ ID NO: 122618 - RNA, 22 nt, Human
ccuccagcccagccucgcuagc

SEQ ID NO: 122619 - RNA, 23 nt, Human
cuguuguagcuuuggagugcaga

SEQ ID NO: 122620 - RNA, 22 nt, Human
augagggcagagcucacguugc

SEQ ID NO: 122621 - RNA, 23 nt, Human
cuuggaaagugaggcagcaaugc

SEQ ID NO: 122622 - RNA, 25 nt, Human
caggcagcagaagucugggcagagu

SEQ ID NO: 122623 - RNA, 24 nt, Human
uaguucaagaguccuggaaucuuu

SEQ ID NO: 122624 - RNA, 20 nt, Human
cugggcgcggggcaggggag

SEQ ID NO: 122625 - RNA, 26 nt, Human
gggagcacuggagugcagggaggaga

SEQ ID NO: 122626 - RNA, 27 nt, Human
auucauucuaggcaugacuccuauaua

SEQ ID NO: 122627 - RNA, 26 nt, Human
ucgcccaggcuggagugcaacgguac

SEQ ID NO: 122628 - RNA, 20 nt, Human
ggguagaagaaaacagcugu

SEQ ID NO: 122629 - RNA, 27 nt, Human
cagccugggcuccucugcaucuugcuc

SEQ ID NO: 122630 - RNA, 19 nt, Human
cuuucuacuuucuccauca

SEQ ID NO: 122631 - RNA, 26 nt, Human
ccagccuggcacaaauggaugcauac

SEQ ID NO: 122632 - RNA, 19 nt, Human
uuccaauacugcuuaauua

SEQ ID NO: 122633 - RNA, 22 nt, Human
ugcaguuacacaguuuccugua

SEQ ID NO: 122634 - RNA, 23 nt, Human
uuccuguuucuguccaucuuguu

SEQ ID NO: 122635 - RNA, 27 nt, Human
gugagccagaggagcacaggcgggcag

SEQ ID NO: 122636 - RNA, 21 nt, Human
cccugcccucccucuggaccc

SEQ ID NO: 122637 - RNA, 22 nt, Human
acagagugcaagacagcacugg

SEQ ID NO: 122638 - RNA, 26 nt, Human
agagucggauuaccaaaacacugccu

SEQ ID NO: 122639 - RNA, 27 nt, Human
uauccagcauuauuugaaaacacugcu

SEQ ID NO: 122640 - RNA, 22 nt, Human
acugaggucaacuacaagccac

SEQ ID NO: 122641 - RNA, 24 nt, Human
gccuuguuuucugucaagacacca

SEQ ID NO: 122642 - RNA, 21 nt, Human
gggacagaucuaggcaguuuc

SEQ ID NO: 122643 - RNA, 16 nt, Human
uccccacuaguuuaca

SEQ ID NO: 122644 - RNA, 22 nt, Human
cucgccuacaaaaaugauaaga

SEQ ID NO: 122645 - RNA, 26 nt, Human
ugcccaggugguguggucagagagug

SEQ ID NO: 122646 - RNA, 22 nt, Human
agcucugguguaugcuacagca

SEQ ID NO: 122647 - RNA, 22 nt, Human
gucugcagaauggaaugcagcu

SEQ ID NO: 122648 - RNA, 26 nt, Human
ggcuggagacuggaccgcugacugca

SEQ ID NO: 122649 - RNA, 21 nt, Human
guggccucuuuuggggugggg

SEQ ID NO: 122650 - RNA, 21 nt, Human
guaacaucauaauuacauucc

SEQ ID NO: 122651 - RNA, 19 nt, Human
cacaugccaccacgcccag

SEQ ID NO: 122652 - RNA, 25 nt, Human
caguacacaggaagaggagccaggc

SEQ ID NO: 122653 - RNA, 23 nt, Human
ugucgcccaggcuggggugcagu

SEQ ID NO: 122654 - RNA, 24 nt, Human
aguccaggcugcuagaggugcuca

SEQ ID NO: 122655 - RNA, 22 nt, Human
aucuguaaccccagcacuuugg

SEQ ID NO: 122656 - RNA, 23 nt, Human
augacgguauaacacaucuacug

SEQ ID NO: 122657 - RNA, 22 nt, Human
cccaguagcugggacuacagac

SEQ ID NO: 122658 - RNA, 20 nt, Human
uggggugugccucaguuguu

SEQ ID NO: 122659 - RNA, 29 nt, Human
guugcugaccagcuggagugagggccuca

SEQ ID NO: 122660 - RNA, 22 nt, Human
gaccagccuggccaacauggcg

SEQ ID NO: 122661 - RNA, 22 nt, Human
gaccagccuggcuaacauggug

SEQ ID NO: 122662 - RNA, 20 nt, Human
agaaguagcuuugcacuuuu

SEQ ID NO: 122663 - RNA, 22 nt, Human
ccacagaaugcauuagaaucug

SEQ ID NO: 122664 - RNA, 23 nt, Human
ccuucucuuuagcuccuggauau

SEQ ID NO: 122665 - RNA, 27 nt, Human
gugugagccacugugcccagcaguuuc

SEQ ID NO: 122666 - RNA, 22 nt, Human
cauccaggcugcccguguguug

SEQ ID NO: 122667 - RNA, 22 nt, Human
uaucacccaggcuggagugcag

SEQ ID NO: 122668 - RNA, 23 nt, Human
agagauuaaaugagguucugcuc

SEQ ID NO: 122669 - RNA, 21 nt, Human
uggggggugccugggagaugg

SEQ ID NO: 122670 - RNA, 22 nt, Human
cuaagaugaaugaaguguauaa

SEQ ID NO: 122671 - RNA, 26 nt, Human
cccaagacaugacauucuuagcugua

SEQ ID NO: 122672 - RNA, 21 nt, Human
gacccagggcgacucacgccc

SEQ ID NO: 122673 - RNA, 28 nt, Human
cacaaaacccacacagauugucuuauua

SEQ ID NO: 122674 - RNA, 22 nt, Human
caugcuccucccgcaauuguca

SEQ ID NO: 122675 - RNA, 22 nt, Human
ggcucaccgcaaccuccgccuc

SEQ ID NO: 122676 - RNA, 26 nt, Human
gacagauugcuuacacagugucuacu

SEQ ID NO: 122677 - RNA, 27 nt, Human
cccucauuucuuauaauacccugaucc

SEQ ID NO: 122678 - RNA, 19 nt, Human
gccacuucuucacugagau

SEQ ID NO: 122679 - RNA, 29 nt, Human
ggcagcuguggcauccacuguggcaucuc

SEQ ID NO: 122680 - RNA, 31 nt, Human
ugcggcacugggagggagaccccacaguggc

SEQ ID NO: 122681 - RNA, 17 nt, Human
aacauccugaaucggga

SEQ ID NO: 122682 - RNA, 20 nt, Human
cagacagaggggcggaugca

SEQ ID NO: 122683 - RNA, 23 nt, Human
cuugaaaaaguagagaacaguca

SEQ ID NO: 122684 - RNA, 28 nt, Human
ucucuucugcacacauaucacacaucag

SEQ ID NO: 122685 - RNA, 26 nt, Human
ccugccugcccugccuacugagaaga

SEQ ID NO: 122686 - RNA, 26 nt, Human
cuuaaaauguuuagagcaaguauagc

SEQ ID NO: 122687 - RNA, 27 nt, Human
accagccuggccaauacggcaaaaccu

SEQ ID NO: 122688 - RNA, 25 nt, Human
cggagcggugaccagcuguggucag

SEQ ID NO: 122689 - RNA, 27 nt, Human
gcucaguaccuggcguugguacacagg

SEQ ID NO: 122690 - RNA, 21 nt, Human
gcaaauguccuuuguggugcu

SEQ ID NO: 122691 - RNA, 23 nt, Human
guguuaccucacuuguggugcug

SEQ ID NO: 122692 - RNA, 24 nt, Human
gucagucaccuugcuccucuccag

SEQ ID NO: 122693 - RNA, 22 nt, Human
caaccgggcuggagugcagugg

SEQ ID NO: 122694 - RNA, 24 nt, Human
cccuccagggacuaugcgugcggg

SEQ ID NO: 122695 - RNA, 32 nt, Human
gcugguguaaggagcggggcuugggaucggug

SEQ ID NO: 122696 - RNA, 27 nt, Human
cuccagccucuccagugcugggagaga

SEQ ID NO: 122697 - RNA, 26 nt, Human
acaccaacaguguacauguuuacugu

SEQ ID NO: 122698 - RNA, 29 nt, Human
gggcuuguucucacccaucugguuuggcc

SEQ ID NO: 122699 - RNA, 27 nt, Human
ucugccugcccuuuguccuccugcugc

SEQ ID NO: 122700 - RNA, 23 nt, Human
aaacucaucaccacaugccuuca

SEQ ID NO: 122701 - RNA, 23 nt, Human
gaggucuggggaaaagggaggac

SEQ ID NO: 122702 - RNA, 22 nt, Human
agccucccagugugcugggauu

SEQ ID NO: 122703 - RNA, 24 nt, Human
ccccugaggguggcugccuccucu

SEQ ID NO: 122704 - RNA, 22 nt, Human
ccuccccaggcucaccuugcca

SEQ ID NO: 122705 - RNA, 27 nt, Human
ucauagaacucuuuacauuguagugac

SEQ ID NO: 122706 - RNA, 25 nt, Human
ucucaaggcacaggucucuuccugg

SEQ ID NO: 122707 - RNA, 20 nt, Human
uacuuccucucuggcugauu

SEQ ID NO: 122708 - RNA, 21 nt, Human
gggagcuagccagaggacugu

SEQ ID NO: 122709 - RNA, 20 nt, Human
acucuucucucagugcagug

SEQ ID NO: 122710 - RNA, 24 nt, Human
aagucagaacaggauggcuggguc

SEQ ID NO: 122711 - RNA, 20 nt, Human
ggcuccugccucuagcccca

SEQ ID NO: 122712 - RNA, 24 nt, Human
agguuacuggggaaacagcucagc

SEQ ID NO: 122713 - RNA, 21 nt, Human
gugggaacucauucauucuug

SEQ ID NO: 122714 - RNA, 18 nt, Human
gucggucggcaauggagg

SEQ ID NO: 122715 - RNA, 20 nt, Human
gaaggaagacccaggaaagg

SEQ ID NO: 122716 - RNA, 23 nt, Human
ucucuguuuuuuccauccccacu

SEQ ID NO: 122717 - RNA, 19 nt, Human
aggauagaaaaaugacuga

SEQ ID NO: 122718 - RNA, 24 nt, Human
uuaacagagcguggaaggggggca

SEQ ID NO: 122719 - RNA, 23 nt, Human
acagcaauauguucacuauguua

SEQ ID NO: 122720 - RNA, 21 nt, Human
ggcucgauuucuccaggauuu

SEQ ID NO: 122721 - RNA, 21 nt, Human
ucccuggucacauccauggaa

SEQ ID NO: 122722 - RNA, 19 nt, Human
uguucaugcuucaguuugg

SEQ ID NO: 122723 - RNA, 24 nt, Human
guugauucucuccauuuugguguc

SEQ ID NO: 122724 - RNA, 25 nt, Human
gggcuucaccaucuuggccaggcug

SEQ ID NO: 122725 - RNA, 25 nt, Human
uuaagcaaugcuuuucucuugugag

SEQ ID NO: 122726 - RNA, 19 nt, Human
ccuucgccugaauaacucc

SEQ ID NO: 122727 - RNA, 21 nt, Human
ugggccuuugaacaacugggg

SEQ ID NO: 122728 - RNA, 23 nt, Human
uuggagccaggaguuugagacca

SEQ ID NO: 122729 - RNA, 21 nt, Human
agagaccuucucuuaggacag

SEQ ID NO: 122730 - RNA, 24 nt, Human
caacuuugugugcuuauguguaca

SEQ ID NO: 122731 - RNA, 22 nt, Human
cuccacugaugcaggagcugcc

SEQ ID NO: 122732 - RNA, 22 nt, Human
ccgccuccuggguugaagcgau

SEQ ID NO: 122733 - RNA, 22 nt, Human
cccuucugggggcuggagggag

SEQ ID NO: 122734 - RNA, 20 nt, Human
cuaccauagcuacaucaguu

SEQ ID NO: 122735 - RNA, 18 nt, Human
gcgacaccucccagccca

SEQ ID NO: 122736 - RNA, 27 nt, Human
agcccaguaauggagagccccaaaaag

SEQ ID NO: 122737 - RNA, 21 nt, Human
cuucaggcugcacccgggcag

SEQ ID NO: 122738 - RNA, 27 nt, Human
cccaaguagcugggacugcaagugugu

SEQ ID NO: 122739 - RNA, 24 nt, Human
ggagaggggagagggacgcacagc

SEQ ID NO: 122740 - RNA, 26 nt, Human
aguuuucccuccuacucucgaucuuc

SEQ ID NO: 122741 - RNA, 22 nt, Human
ugucuagcccaucauccugcuu

SEQ ID NO: 122742 - RNA, 25 nt, Human
agagaaacagcaggauguugaauug

SEQ ID NO: 122743 - RNA, 27 nt, Human
guggcuaggaggcucaaaggacuguga

SEQ ID NO: 122744 - RNA, 20 nt, Human
uugcuguuucuucucaggcu

SEQ ID NO: 122745 - RNA, 21 nt, Human
cacagccaagauucagagcca

SEQ ID NO: 122746 - RNA, 22 nt, Human
ucccgcaggcuucucccaccug

SEQ ID NO: 122747 - RNA, 22 nt, Human
auaaaaaaggucucccagaaaa

SEQ ID NO: 122748 - RNA, 22 nt, Human
cuauuuucucccuuugccaagg

SEQ ID NO: 122749 - RNA, 22 nt, Human
accagcuugcuagaaaaauacu

SEQ ID NO: 122750 - RNA, 21 nt, Human
uccacaccacaaccaccuuca

SEQ ID NO: 122751 - RNA, 19 nt, Human
uccccaccuccucauuuua

SEQ ID NO: 122752 - RNA, 20 nt, Human
ggacugucugugugucuguc

SEQ ID NO: 122753 - RNA, 25 nt, Human
cgccucugacaugaguccagggaga

SEQ ID NO: 122754 - RNA, 22 nt, Human
ccugucuuccuccaguucucaa

SEQ ID NO: 122755 - RNA, 20 nt, Human
gauuucaggggcaccucugg

SEQ ID NO: 122756 - RNA, 21 nt, Human
uacaaugaucauaauugcaga

SEQ ID NO: 122757 - RNA, 21 nt, Human
gcuuuauucucuccauguggc

SEQ ID NO: 122758 - RNA, 21 nt, Human
caggcuggagugcagugagcu

SEQ ID NO: 122759 - RNA, 22 nt, Human
gaccccuggcaugcaugcuggc

SEQ ID NO: 122760 - RNA, 24 nt, Human
agacccagcuaaagucaccugccu

SEQ ID NO: 122761 - RNA, 22 nt, Human
ccacaucuuuacucaggcaagg

SEQ ID NO: 122762 - RNA, 26 nt, Human
cucagcccuuuuuggcauuauugcaa

SEQ ID NO: 122763 - RNA, 27 nt, Human
ccugccagcugugccuugcuugcccuc

SEQ ID NO: 122764 - RNA, 21 nt, Human
ucugggacugaaagguuaaga

SEQ ID NO: 122765 - RNA, 23 nt, Human
gcauucauacaccucaccugccu

SEQ ID NO: 122766 - RNA, 18 nt, Human
cugcugcccccuccuggg

SEQ ID NO: 122767 - RNA, 27 nt, Human
ccuuuccucccccucccaugcguaaga

SEQ ID NO: 122768 - RNA, 27 nt, Human
uuugcagcuguaucucacacuaugauu

SEQ ID NO: 122769 - RNA, 24 nt, Human
acauagcaugacauuucuuugugc

SEQ ID NO: 122770 - RNA, 28 nt, Human
ccacuccaggaccuaggcccagccccuc

SEQ ID NO: 122771 - RNA, 26 nt, Human
aacuuuucaagaaauguaauuauaaa

SEQ ID NO: 122772 - RNA, 21 nt, Human
gcucacugcagccuggaacuc

SEQ ID NO: 122773 - RNA, 20 nt, Human
ucugcucugcccugcccugc

SEQ ID NO: 122774 - RNA, 27 nt, Human
acaccacacuguacuuuuucccccugc

SEQ ID NO: 122775 - RNA, 22 nt, Human
auggaacacucugagacucgcg

SEQ ID NO: 122776 - RNA, 25 nt, Human
gauccuggggcaggcaggaggcagu

SEQ ID NO: 122777 - RNA, 23 nt, Human
aggaaaguagaaggcagcugcug

SEQ ID NO: 122778 - RNA, 21 nt, Human
ccaagugucaccgcagcaaga

SEQ ID NO: 122779 - RNA, 19 nt, Human
ccucagacugauggugccc

SEQ ID NO: 122780 - RNA, 21 nt, Human
acaucagcauuauaaaaagug

SEQ ID NO: 122781 - RNA, 21 nt, Human
ucugcagcuauuucaacuucc

SEQ ID NO: 122782 - RNA, 24 nt, Human
gggucuccccuggcaauucuugau

SEQ ID NO: 122783 - RNA, 24 nt, Human
cccaucuguccauccuccucucca

SEQ ID NO: 122784 - RNA, 22 nt, Human
gaaaaugaaucagaagcuuuau

SEQ ID NO: 122785 - RNA, 26 nt, Human
cagacagcugcccuggcguugccguc

SEQ ID NO: 122786 - RNA, 26 nt, Human
acuacccuauuuuucccuguucccug

SEQ ID NO: 122787 - RNA, 23 nt, Human
ggcgacgguggcgccccuccuca

SEQ ID NO: 122788 - RNA, 21 nt, Human
guaauucuuggcugggcaugg

SEQ ID NO: 122789 - RNA, 29 nt, Human
acacuugguaauuguacuaaagccaaaca

SEQ ID NO: 122790 - RNA, 24 nt, Human
aggcgggcggaucaccugagguca

SEQ ID NO: 122791 - RNA, 25 nt, Human
cuugcagacggccuguugugggaca

SEQ ID NO: 122792 - RNA, 21 nt, Human
cuacauccccaggucucucca

SEQ ID NO: 122793 - RNA, 28 nt, Human
auguggaaccaggacuugguauuaagcc

SEQ ID NO: 122794 - RNA, 24 nt, Human
cacaucucauggcagcuaagccac

SEQ ID NO: 122795 - RNA, 28 nt, Human
caucaagagaaaacucacauaugacagg

SEQ ID NO: 122796 - RNA, 25 nt, Human
cccaacaaaaugcaauuucuagugc

SEQ ID NO: 122797 - RNA, 18 nt, Human
gugggugggugggaugag

SEQ ID NO: 122798 - RNA, 21 nt, Human
agucucaaacuccugaccuca

SEQ ID NO: 122799 - RNA, 25 nt, Human
cuggagugcugggcuugugcacagg

SEQ ID NO: 122800 - RNA, 23 nt, Human
caguuuuggguuuagguuguaau

SEQ ID NO: 122801 - RNA, 26 nt, Human
agcccagccuugcugcugguuuuuuc

SEQ ID NO: 122802 - RNA, 22 nt, Human
cugggaguuagagguugcagug

SEQ ID NO: 122803 - RNA, 22 nt, Human
cacccuguauuucuuuagcccu

SEQ ID NO: 122804 - RNA, 22 nt, Human
accauaaaucaauucauguuua

SEQ ID NO: 122805 - RNA, 29 nt, Human
cuggcucccaggauggcggugguggcagc

SEQ ID NO: 122806 - RNA, 27 nt, Human
accauuuuagagguagagaagacagac

SEQ ID NO: 122807 - RNA, 25 nt, Human
guaucucauucugucaucagaucca

SEQ ID NO: 122808 - RNA, 30 nt, Human
ucucuccagccuuuccccaggcaggaguug

SEQ ID NO: 122809 - RNA, 24 nt, Human
ucucuuauccaacaucaacaucuu

SEQ ID NO: 122810 - RNA, 22 nt, Human
gcucacugcagccuggaccucc

SEQ ID NO: 122811 - RNA, 21 nt, Human
cucucugagcccccuuuucag

SEQ ID NO: 122812 - RNA, 29 nt, Human
accuuccaaaagcaaaaacaaaaaacaaa

SEQ ID NO: 122813 - RNA, 28 nt, Human
gggcaagggaagaggccacacccugccc

SEQ ID NO: 122814 - RNA, 26 nt, Human
gcaguuucagagaacuuuuugcaugc

SEQ ID NO: 122815 - RNA, 25 nt, Human
ccucagcugcucccacacuugugcc

SEQ ID NO: 122816 - RNA, 24 nt, Human
ccuguucccucucugucuaggugu

SEQ ID NO: 122817 - RNA, 23 nt, Human
guacucaguaagacagugcagug

SEQ ID NO: 122818 - RNA, 22 nt, Human
gggcuaccgcgccuuugcuucc

SEQ ID NO: 122819 - RNA, 20 nt, Human
acagaguuuuaguauugcua

SEQ ID NO: 122820 - RNA, 23 nt, Human
gcuguagaaagugcaccaggugu

SEQ ID NO: 122821 - RNA, 23 nt, Human
agaggggagagagggcaggacag

SEQ ID NO: 122822 - RNA, 27 nt, Human
gguuaugugugccaggcuggcuggcag

SEQ ID NO: 122823 - RNA, 22 nt, Human
uucauucucucgcacauuucca

SEQ ID NO: 122824 - RNA, 24 nt, Human
ucccgucuucuccaacaccaccuc

SEQ ID NO: 122825 - RNA, 26 nt, Human
cggaagccuuuuuccccaaagucuua

SEQ ID NO: 122826 - RNA, 24 nt, Human
acccuagucuucgaaauguuaaua

SEQ ID NO: 122827 - RNA, 22 nt, Human
ucugggaaaagcgugccuccag

SEQ ID NO: 122828 - RNA, 21 nt, Human
cugucucucuccauguuggcc

SEQ ID NO: 122829 - RNA, 21 nt, Human
ccccagcuggggccaggcugg

SEQ ID NO: 122830 - RNA, 17 nt, Human
cuuugggcuuggcuaga

SEQ ID NO: 122831 - RNA, 19 nt, Human
cuucccuuggauggagcug

SEQ ID NO: 122832 - RNA, 21 nt, Human
uacuaaacaaccacuacucca

SEQ ID NO: 122833 - RNA, 22 nt, Human
caggcuggagugccguggcacg

SEQ ID NO: 122834 - RNA, 18 nt, Human
uuagaaaaauaacucccu

SEQ ID NO: 122835 - RNA, 18 nt, Human
guagauguggguuuauga

SEQ ID NO: 122836 - RNA, 27 nt, Human
gcacagcccucauucuuuucaugagcc

SEQ ID NO: 122837 - RNA, 20 nt, Human
ccucuauccuggaaccuguc

SEQ ID NO: 122838 - RNA, 22 nt, Human
uucuggcuggucuuucuccuug

SEQ ID NO: 122839 - RNA, 24 nt, Human
ccaccgcacccagcuugcauugaa

SEQ ID NO: 122840 - RNA, 25 nt, Human
aggcuccuuguaagauuucacugga

SEQ ID NO: 122841 - RNA, 22 nt, Human
ugccuaacuugaguaagggauu

SEQ ID NO: 122842 - RNA, 25 nt, Human
ccccccucugcuccagcccucccga

SEQ ID NO: 122843 - RNA, 25 nt, Human
acauaaggagugccugaauagcuug

SEQ ID NO: 122844 - RNA, 23 nt, Human
acccguaguuccagcuacuuggg

SEQ ID NO: 122845 - RNA, 27 nt, Human
ccuggguagcugggauuacaagcaccc

SEQ ID NO: 122846 - RNA, 26 nt, Human
gggaucagggguaggaauggaaggau

SEQ ID NO: 122847 - RNA, 18 nt, Human
gggaaaagagcagaggaa

SEQ ID NO: 122848 - RNA, 29 nt, Human
ccagagaccccucaauccccaaagguccg

SEQ ID NO: 122849 - RNA, 26 nt, Human
aaacuaagaccagaaaagagaagauu

SEQ ID NO: 122850 - RNA, 25 nt, Human
ggggauaggaagaaagauuuguuac

SEQ ID NO: 122851 - RNA, 23 nt, Human
guugccuggcccugccucgaugc

SEQ ID NO: 122852 - RNA, 20 nt, Human
agauuaugccuaugugucuu

SEQ ID NO: 122853 - RNA, 20 nt, Human
ucaguucccucaucuguaaa

SEQ ID NO: 122854 - RNA, 20 nt, Human
cgcugcuggagugcuggaug

SEQ ID NO: 122855 - RNA, 21 nt, Human
cuccgcugcuaucuuugccuc

SEQ ID NO: 122856 - RNA, 22 nt, Human
guguuuuuaaggaaacaaaacu

SEQ ID NO: 122857 - RNA, 27 nt, Human
acagguugccuaauuagcagcuuuugg

SEQ ID NO: 122858 - RNA, 21 nt, Human
ccuguaaugccagcacuuugg

SEQ ID NO: 122859 - RNA, 20 nt, Human
cuccugcugcugacggcgcc

SEQ ID NO: 122860 - RNA, 20 nt, Human
gagcugagagaggggggcag

SEQ ID NO: 122861 - RNA, 22 nt, Human
cacggcacuucagccuggguga

SEQ ID NO: 122862 - RNA, 26 nt, Human
uuuaucucauccaugcaaacuaccau

SEQ ID NO: 122863 - RNA, 24 nt, Human
gcuuccugccuccuuccucugugg

SEQ ID NO: 122864 - RNA, 22 nt, Human
ugcacacacacccauaccucuc

SEQ ID NO: 122865 - RNA, 21 nt, Human
cucagcugggggaaaggcagu

SEQ ID NO: 122866 - RNA, 27 nt, Human
uuguaacauugauggaacagcugggag

SEQ ID NO: 122867 - RNA, 23 nt, Human
aaacccaguuaacuaaugaugcu

SEQ ID NO: 122868 - RNA, 21 nt, Human
cuccccaggcugaaguguccu

SEQ ID NO: 122869 - RNA, 27 nt, Human
gcccucugucacauuuuucuucaucca

SEQ ID NO: 122870 - RNA, 21 nt, Human
ccaggucugugccaccuccuc

SEQ ID NO: 122871 - RNA, 22 nt, Human
agccuccugaguagcuaggacu

SEQ ID NO: 122872 - RNA, 21 nt, Human
uagugcacucugucuuaaaaa

SEQ ID NO: 122873 - RNA, 27 nt, Human
cugccuccccucuccuuccuguguguc

SEQ ID NO: 122874 - RNA, 27 nt, Human
gcaaaucuccccugugccugaucugug

SEQ ID NO: 122875 - RNA, 19 nt, Human
uacgauuguaaaugagcua

SEQ ID NO: 122876 - RNA, 26 nt, Human
cuguauagacaagcuuuguagugaag

SEQ ID NO: 122877 - RNA, 22 nt, Human
cacaggcuggggaggagaaaac

SEQ ID NO: 122878 - RNA, 26 nt, Human
cugccucuccugccagucccccugcc

SEQ ID NO: 122879 - RNA, 21 nt, Human
ucugaccuggcuagguaggga

SEQ ID NO: 122880 - RNA, 22 nt, Human
ucuugagaccuuuucacugugg

SEQ ID NO: 122881 - RNA, 20 nt, Human
aaguguuucagcuaagggaa

SEQ ID NO: 122882 - RNA, 20 nt, Human
ggcuaucuaauuccacacuc

SEQ ID NO: 122883 - RNA, 19 nt, Human
aggugcccagagcugcacc

SEQ ID NO: 122884 - RNA, 27 nt, Human
gguucucucagcuuguucuugccuaag

SEQ ID NO: 122885 - RNA, 23 nt, Human
uugcaguauuggacaaagagcau

SEQ ID NO: 122886 - RNA, 22 nt, Human
gcuuuuucugacuccagugggg

SEQ ID NO: 122887 - RNA, 25 nt, Human
uugggauagcaaacuccagguuccu

SEQ ID NO: 122888 - RNA, 26 nt, Human
ucucauuccuuucuguuccccagugc

SEQ ID NO: 122889 - RNA, 21 nt, Human
ccuguugcagcuucaccugcc

SEQ ID NO: 122890 - RNA, 21 nt, Human
ggccucagcucggaggcagug

SEQ ID NO: 122891 - RNA, 24 nt, Human
uauaucuugcacauaccagcauac

SEQ ID NO: 122892 - RNA, 26 nt, Human
ccuuguuccgagaguggcccagcugg

SEQ ID NO: 122893 - RNA, 19 nt, Human
cacugccaaaggccugugu

SEQ ID NO: 122894 - RNA, 26 nt, Human
gugaagccacauugccaaacuugcag

SEQ ID NO: 122895 - RNA, 21 nt, Human
uggauccaacagauuuuguaa

SEQ ID NO: 122896 - RNA, 24 nt, Human
uugcagaaugauacagauaguaca

SEQ ID NO: 122897 - RNA, 27 nt, Human
ucauagaacaccaaaaaugauguucag

SEQ ID NO: 122898 - RNA, 22 nt, Human
gcucaccccuguaaucucagca

SEQ ID NO: 122899 - RNA, 21 nt, Human
ucgcucagccuggagugcagu

SEQ ID NO: 122900 - RNA, 19 nt, Human
ucagcaccuggggaucugg

SEQ ID NO: 122901 - RNA, 18 nt, Human
acccuccgcaugcaccug

SEQ ID NO: 122902 - RNA, 18 nt, Human
cccugcuccccugagacc

SEQ ID NO: 122903 - RNA, 20 nt, Human
cagcuuccugugccucugug

SEQ ID NO: 122904 - RNA, 23 nt, Human
cuuaccucagguuucuuuagugu

SEQ ID NO: 122905 - RNA, 23 nt, Human
cccacuguggagccagccucccu

SEQ ID NO: 122906 - RNA, 25 nt, Human
uuauuuuucuuuaaaaauaaaggau

SEQ ID NO: 122907 - RNA, 20 nt, Human
cucuccucagguugccuguc

SEQ ID NO: 122908 - RNA, 21 nt, Human
aacuguacaguuucuucccca

SEQ ID NO: 122909 - RNA, 22 nt, Human
ccaacaagcugaaaccccaucu

SEQ ID NO: 122910 - RNA, 27 nt, Human
ccagcacuuuaaacucuuugugugggu

SEQ ID NO: 122911 - RNA, 22 nt, Human
ggcaggagauggcuuaaauaaa

SEQ ID NO: 122912 - RNA, 20 nt, Human
augugggaagaaacaaaccc

SEQ ID NO: 122913 - RNA, 23 nt, Human
cacaggcaggucccaggguuuga

SEQ ID NO: 122914 - RNA, 18 nt, Human
ccugccugccgucugugc

SEQ ID NO: 122915 - RNA, 24 nt, Human
cuucaagcaauucuccugccucag

SEQ ID NO: 122916 - RNA, 20 nt, Human
aggauccaggcacucacuug

SEQ ID NO: 122917 - RNA, 23 nt, Human
gguuuggccuggugcgggccaag

SEQ ID NO: 122918 - RNA, 27 nt, Human
cagauggguagaggcagcucaggugaa

SEQ ID NO: 122919 - RNA, 22 nt, Human
caguuucucaauuucuacaaaa

SEQ ID NO: 122920 - RNA, 26 nt, Human
gagaauggguuauauaaagacugccu

SEQ ID NO: 122921 - RNA, 21 nt, Human
ggagagaaguagcaggaccag

SEQ ID NO: 122922 - RNA, 20 nt, Human
cuguauuuucuuucucuacu

SEQ ID NO: 122923 - RNA, 24 nt, Human
cagcaggaggaaaggguucacaua

SEQ ID NO: 122924 - RNA, 24 nt, Human
agcacguuucacaccucccccuuc

SEQ ID NO: 122925 - RNA, 21 nt, Human
ccucacugcaggcuccccucc

SEQ ID NO: 122926 - RNA, 26 nt, Human
gcacagccacgggggacugacgccag

SEQ ID NO: 122927 - RNA, 20 nt, Human
cugcagcugcugcagcugcu

SEQ ID NO: 122928 - RNA, 22 nt, Human
uuucccuccucucacccgacag

SEQ ID NO: 122929 - RNA, 27 nt, Human
gggguuuucuaugugaaacacaugcca

SEQ ID NO: 122930 - RNA, 21 nt, Human
acacagacauaaaaauagcug

SEQ ID NO: 122931 - RNA, 22 nt, Human
uugcucauacaaacagaucagc

SEQ ID NO: 122932 - RNA, 20 nt, Human
cucuccccucugucuugauc

SEQ ID NO: 122933 - RNA, 21 nt, Human
cauugcugucugcagccuuga

SEQ ID NO: 122934 - RNA, 27 nt, Human
gcacugacacucauuaccgucugugau

SEQ ID NO: 122935 - RNA, 22 nt, Human
gggacgccugcccugcccaggu

SEQ ID NO: 122936 - RNA, 21 nt, Human
cguggguccgucugcccagcc

SEQ ID NO: 122937 - RNA, 22 nt, Human
aguagagacauuggucucacug

SEQ ID NO: 122938 - RNA, 24 nt, Human
ggagccaagacacucaugccacuc

SEQ ID NO: 122939 - RNA, 21 nt, Human
cccucagucuucaccguuuua

SEQ ID NO: 122940 - RNA, 19 nt, Human
uccagcaacacagccuggg

SEQ ID NO: 122941 - RNA, 22 nt, Human
ccauccccucccugccugcucc

SEQ ID NO: 122942 - RNA, 27 nt, Human
gucuuccugcagugccuggaaaacagg

SEQ ID NO: 122943 - RNA, 26 nt, Human
auuaaaacaugacccaccaugaaacc

SEQ ID NO: 122944 - RNA, 26 nt, Human
ccucauucacuguccuggcuuuuauu

SEQ ID NO: 122945 - RNA, 26 nt, Human
gcagaaaucagcgguacugacuugua

SEQ ID NO: 122946 - RNA, 23 nt, Human
guacauacauuuuuguauguuua

SEQ ID NO: 122947 - RNA, 22 nt, Human
gucccuugccaggcucuuccac

SEQ ID NO: 122948 - RNA, 22 nt, Human
aagcgucuguccguuuacucca

SEQ ID NO: 122949 - RNA, 24 nt, Human
agcuccgccucuguccucgcucca

SEQ ID NO: 122950 - RNA, 21 nt, Human
cuuacacaucucccucagccu

SEQ ID NO: 122951 - RNA, 20 nt, Human
uggaaacagcaguauuugaa

SEQ ID NO: 122952 - RNA, 19 nt, Human
cccuccaaaagcacuuacg

SEQ ID NO: 122953 - RNA, 28 nt, Human
gaggaaaaggaaagagucucagagugga

SEQ ID NO: 122954 - RNA, 26 nt, Human
ggcuucuauuuuuggccaaaugagaa

SEQ ID NO: 122955 - RNA, 26 nt, Human
uguguccuccacaggggccccccgaa

SEQ ID NO: 122956 - RNA, 21 nt, Human
uaaauguggagaaacuguagu

SEQ ID NO: 122957 - RNA, 25 nt, Human
acgcacagcacaccacugucccuuc

SEQ ID NO: 122958 - RNA, 24 nt, Human
ugucaacugcuuaguaaucagugg

SEQ ID NO: 122959 - RNA, 24 nt, Human
aagugauucccuggucuacuugaa

SEQ ID NO: 122960 - RNA, 24 nt, Human
cucaaccugccagguugaagugag

SEQ ID NO: 122961 - RNA, 23 nt, Human
uccucugcucuccucuauucucc

SEQ ID NO: 122962 - RNA, 22 nt, Human
cugggaggcagagguuacagug

SEQ ID NO: 122963 - RNA, 26 nt, Human
aaauguuucuggucugaacaaaacca

SEQ ID NO: 122964 - RNA, 27 nt, Human
uugcaguauuuaaagcuuaagcuuuca

SEQ ID NO: 122965 - RNA, 27 nt, Human
ugcuguuggccaggacugugcuggcac

SEQ ID NO: 122966 - RNA, 22 nt, Human
ugagguuaggagagcgagacca

SEQ ID NO: 122967 - RNA, 22 nt, Human
cccuccaaaccccgaagugaaa

SEQ ID NO: 122968 - RNA, 19 nt, Human
gucacacuugcaaccauga

SEQ ID NO: 122969 - RNA, 17 nt, Human
cugccucuuggguuguc

SEQ ID NO: 122970 - RNA, 22 nt, Human
caccucccaggcucaagggauc

SEQ ID NO: 122971 - RNA, 24 nt, Human
gucuguccgcagacugggaugagu

SEQ ID NO: 122972 - RNA, 23 nt, Human
gcaguuucaucagcauuacuugg

SEQ ID NO: 122973 - RNA, 20 nt, Human
uacucugugaggugcaagac

SEQ ID NO: 122974 - RNA, 23 nt, Human
augucagggaaaccuaaacugag

SEQ ID NO: 122975 - RNA, 26 nt, Human
ccauuaaugagcagucuucaguauua

SEQ ID NO: 122976 - RNA, 22 nt, Human
agccccagacuggaggagaggu

SEQ ID NO: 122977 - RNA, 26 nt, Human
accaguacauuauauguuguaauauu

SEQ ID NO: 122978 - RNA, 26 nt, Human
gccauuuugcuaagagacacagucuu

SEQ ID NO: 122979 - RNA, 21 nt, Human
gugugaaguguaguggcaucc

SEQ ID NO: 122980 - RNA, 22 nt, Human
uccuggcucacugagcaucaaa

SEQ ID NO: 122981 - RNA, 23 nt, Human
cacugcaccaucaggcuuggccc

SEQ ID NO: 122982 - RNA, 22 nt, Human
uaggaauagaagugcaagcugg

SEQ ID NO: 122983 - RNA, 23 nt, Human
uguuuaugccugggguggggaga

SEQ ID NO: 122984 - RNA, 27 nt, Human
ccagaaacaauggccuccagugcauac

SEQ ID NO: 122985 - RNA, 23 nt, Human
ccuguuuugagauagucacugga

SEQ ID NO: 122986 - RNA, 19 nt, Human
caucuccuuccccucugca

SEQ ID NO: 122987 - RNA, 26 nt, Human
cacaucucaagugcaucuauucccac

SEQ ID NO: 122988 - RNA, 27 nt, Human
gcaaugccaccagagaacgugauguca

SEQ ID NO: 122989 - RNA, 23 nt, Human
ggcagccuggaaaguugugucuu

SEQ ID NO: 122990 - RNA, 18 nt, Human
ucuaagagaagacagaca

SEQ ID NO: 122991 - RNA, 22 nt, Human
cucgccuguaaucucagcacuu

SEQ ID NO: 122992 - RNA, 24 nt, Human
uuuggccguuuccaagaucugcag

SEQ ID NO: 122993 - RNA, 27 nt, Human
aaucccugcuuggagcugcagaagggu

SEQ ID NO: 122994 - RNA, 21 nt, Human
ucacugcagucuuaagaaaga

SEQ ID NO: 122995 - RNA, 23 nt, Human
auucagucacucguagcuuuauu

SEQ ID NO: 122996 - RNA, 22 nt, Human
cuucccucccuuccuucaagau

SEQ ID NO: 122997 - RNA, 27 nt, Human
ugagcaaaggaggagucaacuaaugaa

SEQ ID NO: 122998 - RNA, 27 nt, Human
cgccacugcacaccagucuggagacag

SEQ ID NO: 122999 - RNA, 25 nt, Human
gugcuggaguucuguccccaaacca

SEQ ID NO: 123000 - RNA, 27 nt, Human
ggaggcugaggcaagagaguugcuuga

SEQ ID NO: 123001 - RNA, 19 nt, Human
ggccccaucuuucguugcc

SEQ ID NO: 123002 - RNA, 29 nt, Human
agguuucugggaagagaucaaaauggagu

SEQ ID NO: 123003 - RNA, 27 nt, Human
ucagcaugugggaccugguucucucca

SEQ ID NO: 123004 - RNA, 24 nt, Human
uuuguggagcauuagagucacagu

SEQ ID NO: 123005 - RNA, 26 nt, Human
cccucgccucugcgagaaugaacaua

SEQ ID NO: 123006 - RNA, 23 nt, Human
cuuagcccgacccucgcuccucc

SEQ ID NO: 123007 - RNA, 26 nt, Human
uacuuugccagcacugccuuugccag

SEQ ID NO: 123008 - RNA, 26 nt, Human
cuaacaacagaaucuaaucuucauuu

SEQ ID NO: 123009 - RNA, 21 nt, Human
cugcacaccuggccuccuggg

SEQ ID NO: 123010 - RNA, 22 nt, Human
cacagccgcccucaccgcccgg

SEQ ID NO: 123011 - RNA, 21 nt, Human
ugagugaggacagcaggcagg

SEQ ID NO: 123012 - RNA, 23 nt, Human
uguucgagcuuaccuacucuucc

SEQ ID NO: 123013 - RNA, 16 nt, Human
uuccugagguggauuu

SEQ ID NO: 123014 - RNA, 21 nt, Human
uagcaguucuagagcacaggu

SEQ ID NO: 123015 - RNA, 23 nt, Human
ugaaguaaaaaggaauacuguga

SEQ ID NO: 123016 - RNA, 27 nt, Human
auagggugcucugaggucaauaaagca

SEQ ID NO: 123017 - RNA, 23 nt, Human
gcugagcccagccuccccccucc

SEQ ID NO: 123018 - RNA, 22 nt, Human
aucgcuugaacccaggaggcgg

SEQ ID NO: 123019 - RNA, 20 nt, Human
gugcgccgccaugcugccua

SEQ ID NO: 123020 - RNA, 22 nt, Human
ucauuucucaaccugaggugca

SEQ ID NO: 123021 - RNA, 21 nt, Human
ggcucacugcaacgucugccu

SEQ ID NO: 123022 - RNA, 27 nt, Human
gcccagccuguggugcuugaaacguuu

SEQ ID NO: 123023 - RNA, 20 nt, Human
uuuuguucuccccuucugcc

SEQ ID NO: 123024 - RNA, 22 nt, Human
gagugagacccugucucaaaaa

SEQ ID NO: 123025 - RNA, 24 nt, Human
ucaagaaagaucagaggaauuuga

SEQ ID NO: 123026 - RNA, 19 nt, Human
uugcccaggcugggagggc

SEQ ID NO: 123027 - RNA, 31 nt, Human
gcccccugccccccagccucuggcauuagaa

SEQ ID NO: 123028 - RNA, 21 nt, Human
cccuccagccuuuggccuugg

SEQ ID NO: 123029 - RNA, 26 nt, Human
ucuaccccgagacugccuucugcccu

SEQ ID NO: 123030 - RNA, 26 nt, Human
auggaccuugcccugcuguucacagc

SEQ ID NO: 123031 - RNA, 16 nt, Human
guuggcacuuuacuug

SEQ ID NO: 123032 - RNA, 25 nt, Human
ggaugacuaucccuuucugugucua

SEQ ID NO: 123033 - RNA, 25 nt, Human
gggggcgggcggugaggaugcaggu

SEQ ID NO: 123034 - RNA, 20 nt, Human
aaccauucuuucuugucaua

SEQ ID NO: 123035 - RNA, 18 nt, Human
uacacaaagcaugccuua

SEQ ID NO: 123036 - RNA, 24 nt, Human
ucgggaggcugaagcaggagaauc

SEQ ID NO: 123037 - RNA, 22 nt, Human
cuucagccuucagugaaugugc

SEQ ID NO: 123038 - RNA, 22 nt, Human
agaccagccuggccaacauagc

SEQ ID NO: 123039 - RNA, 22 nt, Human
agaccagccugggcaacauacc

SEQ ID NO: 123040 - RNA, 22 nt, Human
ucccgccccaggaaaccugcca

SEQ ID NO: 123041 - RNA, 19 nt, Human
uuagcugaacagucacccc

SEQ ID NO: 123042 - RNA, 22 nt, Human
augauuucagcucacugcaacc

SEQ ID NO: 123043 - RNA, 23 nt, Human
acugagaaggcaggccuccgucu

SEQ ID NO: 123044 - RNA, 22 nt, Human
gugcagcuccugcggcaccauu

SEQ ID NO: 123045 - RNA, 24 nt, Human
accugcugaccagccuacuccugc

SEQ ID NO: 123046 - RNA, 21 nt, Human
caggggagacagggcuccagg

SEQ ID NO: 123047 - RNA, 27 nt, Human
gggaaacaaaacagggaucuuuuucug

SEQ ID NO: 123048 - RNA, 21 nt, Human
ggucuccugccuagcugccua

SEQ ID NO: 123049 - RNA, 22 nt, Human
gguguccugccugucugcccca

SEQ ID NO: 123050 - RNA, 21 nt, Human
augccccaagguggggagacu

SEQ ID NO: 123051 - RNA, 20 nt, Human
caaaggcagaguggggcuga

SEQ ID NO: 123052 - RNA, 22 nt, Human
cacgccuguaaucccaacacuu

SEQ ID NO: 123053 - RNA, 21 nt, Human
ugccugcaaucccagcacuuu

SEQ ID NO: 123054 - RNA, 23 nt, Human
guugcuacugggucacucagccu

SEQ ID NO: 123055 - RNA, 21 nt, Human
cacuaauuuggcuuucacauu

SEQ ID NO: 123056 - RNA, 27 nt, Human
ggguggguguggggacgcgggagccag

SEQ ID NO: 123057 - RNA, 21 nt, Human
aaacucauuuaacuaaaguua

SEQ ID NO: 123058 - RNA, 21 nt, Human
agucucucugucucucuuucu

SEQ ID NO: 123059 - RNA, 22 nt, Human
agagggauggagguggacugau

SEQ ID NO: 123060 - RNA, 27 nt, Human
gacucacugguuuuacuuacaaaaaug

SEQ ID NO: 123061 - RNA, 19 nt, Human
gugcaagguggccuuugug

SEQ ID NO: 123062 - RNA, 22 nt, Human
cggccuggaggagggagguugu

SEQ ID NO: 123063 - RNA, 25 nt, Human
aauggcugcuuccaagacccagggg

SEQ ID NO: 123064 - RNA, 25 nt, Human
uagaaauugaauuuuuccuuguagu

SEQ ID NO: 123065 - RNA, 24 nt, Human
ggucucaaagacuuggugacccca

SEQ ID NO: 123066 - RNA, 31 nt, Human
ugggcugugagcuguguucuguccuuccucc

SEQ ID NO: 123067 - RNA, 21 nt, Human
uucauguccauuauagcauug

SEQ ID NO: 123068 - RNA, 22 nt, Human
uuuacucuuguaaaucauagaa

SEQ ID NO: 123069 - RNA, 24 nt, Human
gcuucagcuuccaacuacaaagac

SEQ ID NO: 123070 - RNA, 24 nt, Human
uccugucugacugaccucagggcc

SEQ ID NO: 123071 - RNA, 22 nt, Human
gcagcaucuucaccuccacaau

SEQ ID NO: 123072 - RNA, 23 nt, Human
cuacuucuaagguagcugcagau

SEQ ID NO: 123073 - RNA, 27 nt, Human
gucucuagcacacaacugugaaugucc

SEQ ID NO: 123074 - RNA, 25 nt, Human
cacccgccccucugggccugccugu

SEQ ID NO: 123075 - RNA, 21 nt, Human
guacuccucuuuacacuggcc

SEQ ID NO: 123076 - RNA, 26 nt, Human
guuacugccuguaaauggugucauug

SEQ ID NO: 123077 - RNA, 22 nt, Human
ugcucacgccuuguaaucccag

SEQ ID NO: 123078 - RNA, 26 nt, Human
ccucaaggauaaucacuaaauucugc

SEQ ID NO: 123079 - RNA, 18 nt, Human
gugacuucuucccuaaaa

SEQ ID NO: 123080 - RNA, 25 nt, Human
acugauuaaaaugucaauguaaucu

SEQ ID NO: 123081 - RNA, 27 nt, Human
ccccugccuccuccagaccccccuccc

SEQ ID NO: 123082 - RNA, 20 nt, Human
aaucuauggagcauucucaa

SEQ ID NO: 123083 - RNA, 26 nt, Human
ucucuccucugcugcagcuacugaua

SEQ ID NO: 123084 - RNA, 22 nt, Human
cugagccucgguuuccccaucu

SEQ ID NO: 123085 - RNA, 24 nt, Human
ccgggacuccuccuguccugggcc

SEQ ID NO: 123086 - RNA, 21 nt, Human
uugcaguauauuauagaauau

SEQ ID NO: 123087 - RNA, 22 nt, Human
cacguuuccaucaagcuuuuca

SEQ ID NO: 123088 - RNA, 22 nt, Human
gccucagggcuccuugugggcc

SEQ ID NO: 123089 - RNA, 22 nt, Human
cauuuauauugaaaaacaaaug

SEQ ID NO: 123090 - RNA, 18 nt, Human
ccuucucucuuccuugcu

SEQ ID NO: 123091 - RNA, 27 nt, Human
acauguuaagaguaauuuggauguggg

SEQ ID NO: 123092 - RNA, 27 nt, Human
uuugcagaagugaaguuuuucuguuau

SEQ ID NO: 123093 - RNA, 26 nt, Human
ggcggggagggaggauccuguuuccc

SEQ ID NO: 123094 - RNA, 21 nt, Human
cuugggaggcugaggcagagc

SEQ ID NO: 123095 - RNA, 21 nt, Human
aaucauaaaaugaaguuggug

SEQ ID NO: 123096 - RNA, 22 nt, Human
caggagaccugauucccugugg

SEQ ID NO: 123097 - RNA, 21 nt, Human
ggggccguaacuggguacaau

SEQ ID NO: 123098 - RNA, 22 nt, Human
uacauacagauuuuaccuaucc

SEQ ID NO: 123099 - RNA, 25 nt, Human
cgcccaaauccuacucugcugggaa

SEQ ID NO: 123100 - RNA, 22 nt, Human
ggugggguggaagcuuggggaa

SEQ ID NO: 123101 - RNA, 21 nt, Human
ggaagaaggugcuuucugcuu

SEQ ID NO: 123102 - RNA, 23 nt, Human
acaaaauuguauuacaaaugcau

SEQ ID NO: 123103 - RNA, 24 nt, Human
ugaaggccaugauauuuuguuuuu

SEQ ID NO: 123104 - RNA, 22 nt, Human
gcucaugccuguaaucccacca

SEQ ID NO: 123105 - RNA, 25 nt, Human
cauucagaucuuccuuccucccaag

SEQ ID NO: 123106 - RNA, 20 nt, Human
gcugggagcgagcaagcuga

SEQ ID NO: 123107 - RNA, 23 nt, Human
uguugcaaaugcucuuuaucccu

SEQ ID NO: 123108 - RNA, 19 nt, Human
gggaaaggggaagaaugca

SEQ ID NO: 123109 - RNA, 23 nt, Human
cagagcuaguugcgucccaggga

SEQ ID NO: 123110 - RNA, 25 nt, Human
cgcuggguugcuccuucuucgggag

SEQ ID NO: 123111 - RNA, 27 nt, Human
cuucugcucagggaagacucugagucc

SEQ ID NO: 123112 - RNA, 26 nt, Human
ggacaccuccugguccccugcaccuc

SEQ ID NO: 123113 - RNA, 20 nt, Human
uuuguuguguuccuagggcu

SEQ ID NO: 123114 - RNA, 21 nt, Human
uccucagagaaaaagauucug

SEQ ID NO: 123115 - RNA, 27 nt, Human
uguuuuuacaaugcuucuaaauguuac

SEQ ID NO: 123116 - RNA, 23 nt, Human
ggcuaauuuuuuggauuuuuagu

SEQ ID NO: 123117 - RNA, 23 nt, Human
uuucacaucuuaaugaaauaaca

SEQ ID NO: 123118 - RNA, 22 nt, Human
gcagguggaucaccugacguca

SEQ ID NO: 123119 - RNA, 23 nt, Human
ggacaccugaugcucaccugccc

SEQ ID NO: 123120 - RNA, 27 nt, Human
ccacagcugucccccaggaucccacuc

SEQ ID NO: 123121 - RNA, 19 nt, Human
ggggaguuuauuuuuccua

SEQ ID NO: 123122 - RNA, 24 nt, Human
agguaucuguuuaacauuuccuca

SEQ ID NO: 123123 - RNA, 26 nt, Human
acagccgccugacgaaauggaaacac

SEQ ID NO: 123124 - RNA, 27 nt, Human
acccuugcugguguccagaugucugcg

SEQ ID NO: 123125 - RNA, 28 nt, Human
agaggcuuccugaacugggagcagggua

SEQ ID NO: 123126 - RNA, 22 nt, Human
ccggagagcugggagcacaggu

SEQ ID NO: 123127 - RNA, 27 nt, Human
ggaggcugcaccuacugaggaugucgg

SEQ ID NO: 123128 - RNA, 27 nt, Human
ucauugcacuccauccugagccacaag

SEQ ID NO: 123129 - RNA, 26 nt, Human
aacaaauuuugcuucugaaauauggu

SEQ ID NO: 123130 - RNA, 23 nt, Human
gagaaaacauguuauagauccuu

SEQ ID NO: 123131 - RNA, 19 nt, Human
aucuaaaaaauguuuauag

SEQ ID NO: 123132 - RNA, 30 nt, Human
gcccccacuuucaccaguuucugcggccuu

SEQ ID NO: 123133 - RNA, 19 nt, Human
acaacaacaaaacaaucug

SEQ ID NO: 123134 - RNA, 24 nt, Human
uucuguccuucuugucaugccucc

SEQ ID NO: 123135 - RNA, 19 nt, Human
cucgcucacaccuuguuug

SEQ ID NO: 123136 - RNA, 21 nt, Human
aaccuggauuuucugccucag

SEQ ID NO: 123137 - RNA, 26 nt, Human
ugggaggcugaggugggagaauugcu

SEQ ID NO: 123138 - RNA, 20 nt, Human
ccuuuccccaucccugccuc

SEQ ID NO: 123139 - RNA, 21 nt, Human
caaucagaaaauagacaggua

SEQ ID NO: 123140 - RNA, 21 nt, Human
cgggugcugaggucucaggga

SEQ ID NO: 123141 - RNA, 20 nt, Human
uuguguuuguaaaagcuuga

SEQ ID NO: 123142 - RNA, 27 nt, Human
cagaaaacacacagcuuccacaacuuc

SEQ ID NO: 123143 - RNA, 21 nt, Human
uucacugcaaccucugccuuc

SEQ ID NO: 123144 - RNA, 20 nt, Human
gguacuuguaauuagcacuu

SEQ ID NO: 123145 - RNA, 22 nt, Human
aacuauucuuuggaauucuccu

SEQ ID NO: 123146 - RNA, 22 nt, Human
agauuguguucuuccucucuca

SEQ ID NO: 123147 - RNA, 24 nt, Human
aaugcaugauuaacuacucucuca

SEQ ID NO: 123148 - RNA, 22 nt, Human
agccucguaaagugcugggauu

SEQ ID NO: 123149 - RNA, 22 nt, Human
cucgcacccacccacccccuca

SEQ ID NO: 123150 - RNA, 20 nt, Human
aagaauugucuugcaaguua

SEQ ID NO: 123151 - RNA, 23 nt, Human
uauucccuacucaaaucucagcc

SEQ ID NO: 123152 - RNA, 19 nt, Human
uucagccuugcugaccucc

SEQ ID NO: 123153 - RNA, 21 nt, Human
ucaagagguugaggcugcagu

SEQ ID NO: 123154 - RNA, 23 nt, Human
cucuguaucccagcauacuuugu

SEQ ID NO: 123155 - RNA, 21 nt, Human
ucagcccagccccuccaaagg

SEQ ID NO: 123156 - RNA, 21 nt, Human
accaagguuaccaacuaccua

SEQ ID NO: 123157 - RNA, 20 nt, Human
cugucucucccggacacccu

SEQ ID NO: 123158 - RNA, 23 nt, Human
cacauuucaggccccaagcaauc

SEQ ID NO: 123159 - RNA, 21 nt, Human
ccuccagcugcuguccuugcc

SEQ ID NO: 123160 - RNA, 23 nt, Human
cugcagcuuucauuacagauucc

SEQ ID NO: 123161 - RNA, 26 nt, Human
cccuacugcucauaugcacgcuggcu

SEQ ID NO: 123162 - RNA, 22 nt, Human
cgcuccgcuccgggccugggug

SEQ ID NO: 123163 - RNA, 21 nt, Human
aggaggucagggcugcaguga

SEQ ID NO: 123164 - RNA, 23 nt, Human
aguuaacuaacccuuccuuguau

SEQ ID NO: 123165 - RNA, 20 nt, Human
aucucaucugcuguauuuua

SEQ ID NO: 123166 - RNA, 22 nt, Human
aaaguucugggauuacaaguaa

SEQ ID NO: 123167 - RNA, 23 nt, Human
gcauuuggcaaaaugucuuaaca

SEQ ID NO: 123168 - RNA, 25 nt, Human
gaugcauuuuauagaaugugucaca

SEQ ID NO: 123169 - RNA, 27 nt, Human
ggaggcugaggugggaggacugcuuaa

SEQ ID NO: 123170 - RNA, 22 nt, Human
cugggcagggacucacugugcu

SEQ ID NO: 123171 - RNA, 26 nt, Human
aaagaagccuguuucagcugccugaa

SEQ ID NO: 123172 - RNA, 21 nt, Human
ugaaaugcuacauuauuuaua

SEQ ID NO: 123173 - RNA, 22 nt, Human
cucagccucccaaaauguuggg

SEQ ID NO: 123174 - RNA, 24 nt, Human
guucuuaaugucaaccaucuuuaa

SEQ ID NO: 123175 - RNA, 22 nt, Human
agccucccaaagugcugggauu

SEQ ID NO: 123176 - RNA, 23 nt, Human
ccagcacuaugcccaucuuacug

SEQ ID NO: 123177 - RNA, 20 nt, Human
guuacccaggaugcagcagg

SEQ ID NO: 123178 - RNA, 22 nt, Human
ccagacacgucuuuucauucca

SEQ ID NO: 123179 - RNA, 22 nt, Human
ggagccauuugguggcgcugcu

SEQ ID NO: 123180 - RNA, 28 nt, Human
ggggaguuacagauuuccuguagcaggu

SEQ ID NO: 123181 - RNA, 23 nt, Human
gugcuagaagacagacaucugug

SEQ ID NO: 123182 - RNA, 19 nt, Human
uggaggcagaauccuggcc

SEQ ID NO: 123183 - RNA, 25 nt, Human
ccauuggugaccugcggcaguaugu

SEQ ID NO: 123184 - RNA, 23 nt, Human
ugugugccaggcuggcuggcagg

SEQ ID NO: 123185 - RNA, 20 nt, Human
cucuccucuuguagcaagcc

SEQ ID NO: 123186 - RNA, 21 nt, Human
gguuccccuccgugcucuucg

SEQ ID NO: 123187 - RNA, 24 nt, Human
ccugggccuggcccagguggcugu

SEQ ID NO: 123188 - RNA, 31 nt, Human
caccaaugaaccccagccagccuggaccccu

SEQ ID NO: 123189 - RNA, 26 nt, Human
aagaauuggucuuaauguugaaugua

SEQ ID NO: 123190 - RNA, 26 nt, Human
cuagaaauuacaagcauauaacuuua

SEQ ID NO: 123191 - RNA, 20 nt, Human
gaugugagaggcagaggcag

SEQ ID NO: 123192 - RNA, 26 nt, Human
cucuuagaacauuguauuacagaugc

SEQ ID NO: 123193 - RNA, 27 nt, Human
ggccuagcaucacuuaaacuuccucca

SEQ ID NO: 123194 - RNA, 23 nt, Human
gcugauugccucuccaaacgccu

SEQ ID NO: 123195 - RNA, 22 nt, Human
uacuaacaacagaaucuaaucu

SEQ ID NO: 123196 - RNA, 27 nt, Human
ccagaccaaagccaugccauugcgcug

SEQ ID NO: 123197 - RNA, 27 nt, Human
aaagugcuggaauuacaggcgaaccuu

SEQ ID NO: 123198 - RNA, 22 nt, Human
agagucuucuugugcugccuuu

SEQ ID NO: 123199 - RNA, 21 nt, Human
ucucaguucuacacugauaca

SEQ ID NO: 123200 - RNA, 29 nt, Human
cagaggggagagagggcaggacaggccag

SEQ ID NO: 123201 - RNA, 23 nt, Human
cacagccgcaggugcaccuccag

SEQ ID NO: 123202 - RNA, 21 nt, Human
gcaguguagguccuggggcag

SEQ ID NO: 123203 - RNA, 21 nt, Human
agagaugcacuguucaauucg

SEQ ID NO: 123204 - RNA, 21 nt, Human
uagccucccuuugugcuuggg

SEQ ID NO: 123205 - RNA, 23 nt, Human
ccuccaucugcguugaugcucag

SEQ ID NO: 123206 - RNA, 23 nt, Human
aaaaauucauaguaauccugcca

SEQ ID NO: 123207 - RNA, 27 nt, Human
gacaccaugagagcccucacacuccuc

SEQ ID NO: 123208 - RNA, 27 nt, Human
ugcacacaccgaagugcucgagggaga

SEQ ID NO: 123209 - RNA, 22 nt, Human
ugucagcagcagugaccacagc

SEQ ID NO: 123210 - RNA, 25 nt, Human
cccagugacaccuccgccuuggcag

SEQ ID NO: 123211 - RNA, 26 nt, Human
ugccaacauggugaaacccugucucu

SEQ ID NO: 123212 - RNA, 27 nt, Human
ucagugccaccacccccggcaggccuu

SEQ ID NO: 123213 - RNA, 23 nt, Human
cucggccucccaaaauugcuggg

SEQ ID NO: 123214 - RNA, 22 nt, Human
ucauaauucauuuaagacaaga

SEQ ID NO: 123215 - RNA, 20 nt, Human
gcagaaaagggacuggaacc

SEQ ID NO: 123216 - RNA, 22 nt, Human
uguuugucuuucuacuguuuca

SEQ ID NO: 123217 - RNA, 22 nt, Human
uucuguuuucuguccauggccc

SEQ ID NO: 123218 - RNA, 24 nt, Human
cuggaaguuuucuagcaacugaac

SEQ ID NO: 123219 - RNA, 25 nt, Human
acacaugggcaucuaugggagagug

SEQ ID NO: 123220 - RNA, 25 nt, Human
ggaggcggagguugcaguaagccaa

SEQ ID NO: 123221 - RNA, 22 nt, Human
gcagcuuagagaaaauguggag

SEQ ID NO: 123222 - RNA, 20 nt, Human
aucuccugugaucugugcua

SEQ ID NO: 123223 - RNA, 23 nt, Human
uccuagcuccuccuccugggcua

SEQ ID NO: 123224 - RNA, 21 nt, Human
ugcgcgcggagcggugcaaug

SEQ ID NO: 123225 - RNA, 21 nt, Human
gggaaggggcugggagccagg

SEQ ID NO: 123226 - RNA, 21 nt, Human
ggaugcuucuggccagagcca

SEQ ID NO: 123227 - RNA, 22 nt, Human
ccgccucccagguucaagcaau

SEQ ID NO: 123228 - RNA, 32 nt, Human
agaagaaauugaaaagcaggcacuugagaagu

SEQ ID NO: 123229 - RNA, 24 nt, Human
guauggucagcuaauaauauauca

SEQ ID NO: 123230 - RNA, 24 nt, Human
cuuccuccaaggcuggagugcagu

SEQ ID NO: 123231 - RNA, 21 nt, Human
uuccauguggacgcucuuuca

SEQ ID NO: 123232 - RNA, 25 nt, Human
ccagugcuaggauuauuugcagguu

SEQ ID NO: 123233 - RNA, 23 nt, Human
ucucuggccugcugcucucucaa

SEQ ID NO: 123234 - RNA, 24 nt, Human
gccuccucuucugcacagaaugcu

SEQ ID NO: 123235 - RNA, 20 nt, Human
agccccugaauuaagcagaa

SEQ ID NO: 123236 - RNA, 21 nt, Human
gaaagagacgcugcccaggga

SEQ ID NO: 123237 - RNA, 23 nt, Human
aaagcccagaauggcaggagagg

SEQ ID NO: 123238 - RNA, 26 nt, Human
ucacccaggcuggagugaucucagcu

SEQ ID NO: 123239 - RNA, 20 nt, Human
ucccaagcuggagugcagug

SEQ ID NO: 123240 - RNA, 22 nt, Human
agugcuucuuguugcuggguga

SEQ ID NO: 123241 - RNA, 25 nt, Human
gcgcuuuccccuccucccugggaug

SEQ ID NO: 123242 - RNA, 22 nt, Human
guuuuaaacuccuaggcccagg

SEQ ID NO: 123243 - RNA, 22 nt, Human
auggcaugaaccugggaggcag

SEQ ID NO: 123244 - RNA, 24 nt, Human
cugggcugcuggaggccagacugg

SEQ ID NO: 123245 - RNA, 19 nt, Human
uuucuucuuugacuauaac

SEQ ID NO: 123246 - RNA, 21 nt, Human
acuguucuucaucauugacac

SEQ ID NO: 123247 - RNA, 22 nt, Human
auucaccaacacguggccaaga

SEQ ID NO: 123248 - RNA, 21 nt, Human
agauuuugguaaugauguuga

SEQ ID NO: 123249 - RNA, 26 nt, Human
uuacgauggcacccagugagcacucc

SEQ ID NO: 123250 - RNA, 22 nt, Human
gagagggagagugggcccuggc

SEQ ID NO: 123251 - RNA, 21 nt, Human
aucugauuuuguguuuuuugu

SEQ ID NO: 123252 - RNA, 27 nt, Human
cagacuaagccagcaccggaccagccu

SEQ ID NO: 123253 - RNA, 29 nt, Human
ucucugccaugguccccaggaaggauggg

SEQ ID NO: 123254 - RNA, 23 nt, Human
agcucacuucaaccuaacagcua

SEQ ID NO: 123255 - RNA, 22 nt, Human
gauuacaggcgucagccaccgc

SEQ ID NO: 123256 - RNA, 19 nt, Human
ccggccgccuccacccggg

SEQ ID NO: 123257 - RNA, 27 nt, Human
gucacccaggcugcagugcaauggcgc

SEQ ID NO: 123258 - RNA, 22 nt, Human
ccacccaggcuggaguacagug

SEQ ID NO: 123259 - RNA, 20 nt, Human
gccuagugccagaaaugucc

SEQ ID NO: 123260 - RNA, 27 nt, Human
gcugccucuaccugccugguccagcug

SEQ ID NO: 123261 - RNA, 19 nt, Human
ugaaagcucucaauuaagu

SEQ ID NO: 123262 - RNA, 27 nt, Human
gcucagggcccagcagagaguccguag

SEQ ID NO: 123263 - RNA, 22 nt, Human
gaccagccugaccaacaugggg

SEQ ID NO: 123264 - RNA, 22 nt, Human
ggucagugcugcaugcacugca

SEQ ID NO: 123265 - RNA, 24 nt, Human
uuggcuucugugccugacucugug

SEQ ID NO: 123266 - RNA, 22 nt, Human
gaggcccuggaauaaggaagag

SEQ ID NO: 123267 - RNA, 23 nt, Human
gugagacuucccagaccccggag

SEQ ID NO: 123268 - RNA, 17 nt, Human
acugguauuuuuacuua

SEQ ID NO: 123269 - RNA, 22 nt, Human
cugcagcucugaccgucccgcc

SEQ ID NO: 123270 - RNA, 27 nt, Human
ugguggagggggaggggagaagccaag

SEQ ID NO: 123271 - RNA, 20 nt, Human
ggcuccagggagcaggcugg

SEQ ID NO: 123272 - RNA, 20 nt, Human
agaacugaugaaugagcaaa

SEQ ID NO: 123273 - RNA, 24 nt, Human
uuauucauuuauccuguacaauca

SEQ ID NO: 123274 - RNA, 24 nt, Human
cugccuccagcccgggccuguguc

SEQ ID NO: 123275 - RNA, 22 nt, Human
augacuugccauuucauuuaca

SEQ ID NO: 123276 - RNA, 20 nt, Human
cuggcagccuuucaggucac

SEQ ID NO: 123277 - RNA, 22 nt, Human
ccaacacaggcuucagcacuuc

SEQ ID NO: 123278 - RNA, 22 nt, Human
ugccaaggguggacaggcgcug

SEQ ID NO: 123279 - RNA, 23 nt, Human
cuacacuuugcuccucuggccca

SEQ ID NO: 123280 - RNA, 22 nt, Human
agagguuguucaacugaaggaa

SEQ ID NO: 123281 - RNA, 20 nt, Human
ccuccguacugggugcaaug

SEQ ID NO: 123282 - RNA, 24 nt, Human
uucuaauggggacacagaucaugg

SEQ ID NO: 123283 - RNA, 22 nt, Human
cgaguaccugcuccaucaugcu

SEQ ID NO: 123284 - RNA, 21 nt, Human
ccagugagaggagagggcugg

SEQ ID NO: 123285 - RNA, 18 nt, Human
aagaggaagagagagugg

SEQ ID NO: 123286 - RNA, 22 nt, Human
ggcuucucugucucuguggaaa

SEQ ID NO: 123287 - RNA, 24 nt, Human
ucccuccucuccucacauccuggu

SEQ ID NO: 123288 - RNA, 19 nt, Human
cuccacccuccucagcgcc

SEQ ID NO: 123289 - RNA, 19 nt, Human
cugugcacacacccccuca

SEQ ID NO: 123290 - RNA, 22 nt, Human
gccuguaaucucacuacacagg

SEQ ID NO: 123291 - RNA, 23 nt, Human
cuccacccacccuccugccucac

SEQ ID NO: 123292 - RNA, 24 nt, Human
ccaggccagguggggaggcuuugg

SEQ ID NO: 123293 - RNA, 26 nt, Human
gcugcccgugcagugggaccagauuc

SEQ ID NO: 123294 - RNA, 22 nt, Human
gugcacacuaccuucccaccca

SEQ ID NO: 123295 - RNA, 24 nt, Human
auuggccugguauggcugcagucc

SEQ ID NO: 123296 - RNA, 25 nt, Human
cccacagucagccuccugucccugc

SEQ ID NO: 123297 - RNA, 22 nt, Human
cuugugacuuugagacuauuca

SEQ ID NO: 123298 - RNA, 23 nt, Human
ugucuccaugcaaacauucaaag

SEQ ID NO: 123299 - RNA, 26 nt, Human
gcaaguguccuuugaaaguugugaga

SEQ ID NO: 123300 - RNA, 26 nt, Human
agcucuguccuacuuacagcacuuug

SEQ ID NO: 123301 - RNA, 28 nt, Human
gcaaaaucuccaauccacacauauuguu

SEQ ID NO: 123302 - RNA, 22 nt, Human
ucugguuacacauauggaagua

SEQ ID NO: 123303 - RNA, 22 nt, Human
uucagcaccuguuugaugcagu

SEQ ID NO: 123304 - RNA, 23 nt, Human
aaacccagagaugccugauuuca

SEQ ID NO: 123305 - RNA, 20 nt, Human
guauaauuauaauguugccc

SEQ ID NO: 123306 - RNA, 22 nt, Human
caccucccggguucaagcaauu

SEQ ID NO: 123307 - RNA, 24 nt, Human
ggcguagggaagggggcuggaagc

SEQ ID NO: 123308 - RNA, 26 nt, Human
uucuccgucugucccaagagggucug

SEQ ID NO: 123309 - RNA, 22 nt, Human
ucucucccucuccugaaagacc

SEQ ID NO: 123310 - RNA, 20 nt, Human
aaaugauuuuuaacauuaug

SEQ ID NO: 123311 - RNA, 22 nt, Human
auugccucccuuccuccgcucc

SEQ ID NO: 123312 - RNA, 19 nt, Human
gccccuccuccucugggca

SEQ ID NO: 123313 - RNA, 23 nt, Human
cuguugccaggcuagagugcagu

SEQ ID NO: 123314 - RNA, 20 nt, Human
cugcguggugcaguggaaca

SEQ ID NO: 123315 - RNA, 21 nt, Human
aagccuccugcccccugccgg

SEQ ID NO: 123316 - RNA, 20 nt, Human
ccucaaaccaaggguacaga

SEQ ID NO: 123317 - RNA, 21 nt, Human
ggacccuagaggagacucuca

SEQ ID NO: 123318 - RNA, 22 nt, Human
gggaggcagagguugcggugag

SEQ ID NO: 123319 - RNA, 22 nt, Human
cuggccuuugcgccucuagagg

SEQ ID NO: 123320 - RNA, 20 nt, Human
uguacccgcugcucucagcu

SEQ ID NO: 123321 - RNA, 22 nt, Human
cacaaggucaggagauugagac

SEQ ID NO: 123322 - RNA, 21 nt, Human
gcucacugcagccuccaucuc

SEQ ID NO: 123323 - RNA, 22 nt, Human
cgcaaccuccgccucccggauu

SEQ ID NO: 123324 - RNA, 22 nt, Human
ugcaaccuccgccuccuggauu

SEQ ID NO: 123325 - RNA, 21 nt, Human
ggccgaggcugugcgugcgag

SEQ ID NO: 123326 - RNA, 31 nt, Human
augaaacuugguuaggauggcuggggguaca

SEQ ID NO: 123327 - RNA, 23 nt, Human
cggaagagcaggucuccagggga

SEQ ID NO: 123328 - RNA, 27 nt, Human
cauugaaaacagagcuuuuaggccagg

SEQ ID NO: 123329 - RNA, 22 nt, Human
ucauuacauuguucaggcuacg

SEQ ID NO: 123330 - RNA, 23 nt, Human
gccuguaaucccauguacucugg

SEQ ID NO: 123331 - RNA, 21 nt, Human
uaguauuccagaccugaagaa

SEQ ID NO: 123332 - RNA, 19 nt, Human
cugaguuuuaaaaaugaaa

SEQ ID NO: 123333 - RNA, 17 nt, Human
ggacuucucuccugaag

SEQ ID NO: 123334 - RNA, 23 nt, Human
ugacaggcgcauaaacugaaaug

SEQ ID NO: 123335 - RNA, 25 nt, Human
gauguuggcugacccccuuccuccc

SEQ ID NO: 123336 - RNA, 21 nt, Human
ggcgcugucccuucucuuucc

SEQ ID NO: 123337 - RNA, 26 nt, Human
cacaugcucaucuacagcuuucuugg

SEQ ID NO: 123338 - RNA, 18 nt, Human
ugagaaaguacaaacuuc

SEQ ID NO: 123339 - RNA, 26 nt, Human
cuagaaguccaaaauggcuagccauu

SEQ ID NO: 123340 - RNA, 23 nt, Human
aacacaauuuaagggcucagcau

SEQ ID NO: 123341 - RNA, 19 nt, Human
auguucugcgugcuccugu

SEQ ID NO: 123342 - RNA, 21 nt, Human
cuggauuugguuacugugcca

SEQ ID NO: 123343 - RNA, 24 nt, Human
gcccugagaccccacugcugucau

SEQ ID NO: 123344 - RNA, 23 nt, Human
ggaaagcaagaaggcuggaggga

SEQ ID NO: 123345 - RNA, 24 nt, Human
ugguaaagagaaggcuaugguuga

SEQ ID NO: 123346 - RNA, 23 nt, Human
cacucugcaaccuccacuuccca

SEQ ID NO: 123347 - RNA, 18 nt, Human
ucuggacuuucucuugga

SEQ ID NO: 123348 - RNA, 27 nt, Human
acuccugaaauaucaguuacucagccc

SEQ ID NO: 123349 - RNA, 21 nt, Human
caggggccuggagacacucca

SEQ ID NO: 123350 - RNA, 25 nt, Human
uaguucucuucuacaccuacucugu

SEQ ID NO: 123351 - RNA, 26 nt, Human
cugcuuuucucccagaaggcuggguc

SEQ ID NO: 123352 - RNA, 27 nt, Human
gaccagccuggccaacauggcaaaacc

SEQ ID NO: 123353 - RNA, 26 nt, Human
ccuaccccuguucccuccccaaaccc

SEQ ID NO: 123354 - RNA, 25 nt, Human
uuacaauuacaaacagccucuuuca

SEQ ID NO: 123355 - RNA, 29 nt, Human
cagcucuguucccuccugcuuugguuuua

SEQ ID NO: 123356 - RNA, 23 nt, Human
gcugccaccgcuuccugccuguc

SEQ ID NO: 123357 - RNA, 26 nt, Human
cccacaguugcccuggugaugacuua

SEQ ID NO: 123358 - RNA, 21 nt, Human
guucuugaacuccuggccuca

SEQ ID NO: 123359 - RNA, 23 nt, Human
cuccacccccacccccaagugcc

SEQ ID NO: 123360 - RNA, 24 nt, Human
uacugcugacuaacaugaugcaca

SEQ ID NO: 123361 - RNA, 23 nt, Human
uaaauucucuccuaaugaugacu

SEQ ID NO: 123362 - RNA, 22 nt, Human
cuuuggucaguaacaagugcaa

SEQ ID NO: 123363 - RNA, 23 nt, Human
gcauuuuucucauggggaaggau

SEQ ID NO: 123364 - RNA, 22 nt, Human
aguccacagcauucacauucuc

SEQ ID NO: 123365 - RNA, 26 nt, Human
guuuuuaagaaguauuuaaaaaucuu

SEQ ID NO: 123366 - RNA, 29 nt, Human
ccauaaaaacacauugaucccuagcaaga

SEQ ID NO: 123367 - RNA, 20 nt, Human
ccuuguuccucagcaccccu

SEQ ID NO: 123368 - RNA, 20 nt, Human
gccagaaacguaacugugug

SEQ ID NO: 123369 - RNA, 27 nt, Human
ggagcaguuagaaaggaagcgggagcg

SEQ ID NO: 123370 - RNA, 21 nt, Human
accacacaaacccagccuggg

SEQ ID NO: 123371 - RNA, 23 nt, Human
ggagugcaguggcgagaucucag

SEQ ID NO: 123372 - RNA, 25 nt, Human
gagagcaguggcagugggaggcauc

SEQ ID NO: 123373 - RNA, 21 nt, Human
ugucuauguauuaccuuccuu

SEQ ID NO: 123374 - RNA, 21 nt, Human
gcggcugccagcuccugagcu

SEQ ID NO: 123375 - RNA, 23 nt, Human
cguucacauccucuuuguuuccu

SEQ ID NO: 123376 - RNA, 22 nt, Human
uggaaaagagaaaaacaaugga

SEQ ID NO: 123377 - RNA, 21 nt, Human
aucucagagcaggagaaguug

SEQ ID NO: 123378 - RNA, 27 nt, Human
uuccugccucugcacgccaccccgugc

SEQ ID NO: 123379 - RNA, 21 nt, Human
auggagaggaccaggagccag

SEQ ID NO: 123380 - RNA, 20 nt, Human
cuauuaagcacuuguuaaca

SEQ ID NO: 123381 - RNA, 20 nt, Human
ccuucugcccuccugccaaa

SEQ ID NO: 123382 - RNA, 21 nt, Human
ccugcgcugccccagagccug

SEQ ID NO: 123383 - RNA, 22 nt, Human
cccugcuccugcagcauggucc

SEQ ID NO: 123384 - RNA, 27 nt, Human
gcugcaacccuauggccucuuggagac

SEQ ID NO: 123385 - RNA, 28 nt, Human
gagggaggacucgggacagggaauuggc

SEQ ID NO: 123386 - RNA, 22 nt, Human
uucuuauuugcugaugcugcua

SEQ ID NO: 123387 - RNA, 21 nt, Human
gggcuuguggacucucugccu

SEQ ID NO: 123388 - RNA, 27 nt, Human
agagcugcgugggcagggcugcagugg

SEQ ID NO: 123389 - RNA, 20 nt, Human
gggaggaagagaggagaugg

SEQ ID NO: 123390 - RNA, 22 nt, Human
aaaugcaaacuuaaacauauuc

SEQ ID NO: 123391 - RNA, 25 nt, Human
uguauuccuuuucucuaaugcagcu

SEQ ID NO: 123392 - RNA, 27 nt, Human
ugcucaguaaggcagugcaauacucag

SEQ ID NO: 123393 - RNA, 27 nt, Human
uugcccaggcuggagugcaguggcgcc

SEQ ID NO: 123394 - RNA, 21 nt, Human
caggaggcggagcuugcagug

SEQ ID NO: 123395 - RNA, 22 nt, Human
gcccccaggugccaguuauggc

SEQ ID NO: 123396 - RNA, 20 nt, Human
uuuaguauuccuguaauacu

SEQ ID NO: 123397 - RNA, 22 nt, Human
cccaacaaugcuugguuuauuu

SEQ ID NO: 123398 - RNA, 30 nt, Human
gccuagaacccuugccccuccucauagacc

SEQ ID NO: 123399 - RNA, 25 nt, Human
gaggagaagugaaguuucacugugg

SEQ ID NO: 123400 - RNA, 20 nt, Human
gaucugaagaacagcuucua

SEQ ID NO: 123401 - RNA, 25 nt, Human
ugaacuguuucugggcucagucaga

SEQ ID NO: 123402 - RNA, 21 nt, Human
ucuaggguauauauguaugua

SEQ ID NO: 123403 - RNA, 22 nt, Human
agcuagcaauugggcucccuuu

SEQ ID NO: 123404 - RNA, 22 nt, Human
cagaaauucauuaugcugcuaa

SEQ ID NO: 123405 - RNA, 23 nt, Human
cuguccguggcuacaauucaaag

SEQ ID NO: 123406 - RNA, 30 nt, Human
ugacuucucagaaauugccaacuagcaggc

SEQ ID NO: 123407 - RNA, 23 nt, Human
acugccucggccuccugguauag

SEQ ID NO: 123408 - RNA, 20 nt, Human
uccugccagccccugccauu

SEQ ID NO: 123409 - RNA, 27 nt, Human
ugaaaccagaaucugcuucacagaaaa

SEQ ID NO: 123410 - RNA, 22 nt, Human
ugggacagaggcuacaucugcc

SEQ ID NO: 123411 - RNA, 20 nt, Human
ucucuugucucacaugcuag

SEQ ID NO: 123412 - RNA, 23 nt, Human
accucauuguuuacuuagcuuuu

SEQ ID NO: 123413 - RNA, 21 nt, Human
cuacaggugcacaaucuaaga

SEQ ID NO: 123414 - RNA, 27 nt, Human
gcuuuaucuuugguaacuuuuacuuga

SEQ ID NO: 123415 - RNA, 26 nt, Human
gggaguccccuuucugaagcuguggu

SEQ ID NO: 123416 - RNA, 22 nt, Human
accccaggauucucauucuuug

SEQ ID NO: 123417 - RNA, 22 nt, Human
gcuguugaagcucagagcugga

SEQ ID NO: 123418 - RNA, 26 nt, Human
cugggugacagagugagacuccaccu

SEQ ID NO: 123419 - RNA, 26 nt, Human
gccuguaaucccagcacacugggagg

SEQ ID NO: 123420 - RNA, 22 nt, Human
uucccauaagacaaugacauac

SEQ ID NO: 123421 - RNA, 21 nt, Human
ugaaggugagaggaaauguug

SEQ ID NO: 123422 - RNA, 22 nt, Human
aggguccaaaggccagcgguga

SEQ ID NO: 123423 - RNA, 26 nt, Human
gggccugccagcaggccagggacuca

SEQ ID NO: 123424 - RNA, 21 nt, Human
ccuguaaucccagcacuuuca

SEQ ID NO: 123425 - RNA, 26 nt, Human
aagugauucuucuuugcucuuauuua

SEQ ID NO: 123426 - RNA, 22 nt, Human
gcuguccuuccuauggcaggag

SEQ ID NO: 123427 - RNA, 22 nt, Human
cugucccuugcagacacaugcc

SEQ ID NO: 123428 - RNA, 23 nt, Human
aaagucacuuuauuccuccauca

SEQ ID NO: 123429 - RNA, 23 nt, Human
cuuagcacauccucuguucucua

SEQ ID NO: 123430 - RNA, 27 nt, Human
accauuuuggaggaagaaaagcacccu

SEQ ID NO: 123431 - RNA, 22 nt, Human
gggacggauuccacagacggga

SEQ ID NO: 123432 - RNA, 22 nt, Human
caucuuuaugaaacaggcacag

SEQ ID NO: 123433 - RNA, 26 nt, Human
ggccagugccuggugcucuggccccu

SEQ ID NO: 123434 - RNA, 21 nt, Human
agcgcuucucacagacgugca

SEQ ID NO: 123435 - RNA, 24 nt, Human
gacacaaauggcguucugcaaggg

SEQ ID NO: 123436 - RNA, 27 nt, Human
ccuccucccuuuuuccuuguccccaca

SEQ ID NO: 123437 - RNA, 21 nt, Human
gggcucggaggcagcgguugg

SEQ ID NO: 123438 - RNA, 25 nt, Human
guggccacccagugcucugccuacc

SEQ ID NO: 123439 - RNA, 24 nt, Human
ucuaaaucuuccuuuucuuucaga

SEQ ID NO: 123440 - RNA, 22 nt, Human
ucugccugccugugucugcuga

SEQ ID NO: 123441 - RNA, 21 nt, Human
uacagaagaucaguuauuaaa

SEQ ID NO: 123442 - RNA, 23 nt, Human
gggaacucgccaccugcccacgc

SEQ ID NO: 123443 - RNA, 25 nt, Human
ggcugcgcggccccagccugggcac

SEQ ID NO: 123444 - RNA, 22 nt, Human
cuuacgcccuguucccuuccug

SEQ ID NO: 123445 - RNA, 21 nt, Human
gggucuacagggucauccuua

SEQ ID NO: 123446 - RNA, 22 nt, Human
gccucagccucaugaauagcug

SEQ ID NO: 123447 - RNA, 27 nt, Human
uuuuggggacuuuucucucuuuaccca

SEQ ID NO: 123448 - RNA, 21 nt, Human
cuguccuuggucacugaggcc

SEQ ID NO: 123449 - RNA, 24 nt, Human
cagggggaaauggaaugccccugc

SEQ ID NO: 123450 - RNA, 27 nt, Human
ccaucauguggccucuggacacugugg

SEQ ID NO: 123451 - RNA, 20 nt, Human
ucucagcccccauccccagc

SEQ ID NO: 123452 - RNA, 25 nt, Human
cuucuccacccucucccugagcaca

SEQ ID NO: 123453 - RNA, 23 nt, Human
acugaauuugggccucuuguaca

SEQ ID NO: 123454 - RNA, 17 nt, Human
uggacacucucuucucu

SEQ ID NO: 123455 - RNA, 26 nt, Human
gcucguuacccaggguggagugcagu

SEQ ID NO: 123456 - RNA, 25 nt, Human
guugcccaggcuggucuugaacucu

SEQ ID NO: 123457 - RNA, 22 nt, Human
uucaacaccuuuaacaauguau

SEQ ID NO: 123458 - RNA, 21 nt, Human
aucaaauugaauggccagaga

SEQ ID NO: 123459 - RNA, 21 nt, Human
caugaaugcuucugccucuuu

SEQ ID NO: 123460 - RNA, 27 nt, Human
cccgugcccuggugaaucaccuggcug

SEQ ID NO: 123461 - RNA, 24 nt, Human
ggcaggggugguggagagauggaa

SEQ ID NO: 123462 - RNA, 22 nt, Human
gggagagaucaaguugagacag

SEQ ID NO: 123463 - RNA, 23 nt, Human
agccuggcugggcucuggugggg

SEQ ID NO: 123464 - RNA, 27 nt, Human
gccaaucggcaucugagacugggccac

SEQ ID NO: 123465 - RNA, 23 nt, Human
ucucccauaugauggcugucugu

SEQ ID NO: 123466 - RNA, 22 nt, Human
ccuccacuggcgacacaacugc

SEQ ID NO: 123467 - RNA, 22 nt, Human
cagaggccaucgcagcuuuuga

SEQ ID NO: 123468 - RNA, 23 nt, Human
gaccaccuugugggaucaccuuu

SEQ ID NO: 123469 - RNA, 21 nt, Human
guuucucuguggcuccaggcc

SEQ ID NO: 123470 - RNA, 21 nt, Human
gccacuacacuccagccuggg

SEQ ID NO: 123471 - RNA, 23 nt, Human
gagaauuggugaugcuuuguuaa

SEQ ID NO: 123472 - RNA, 27 nt, Human
ccaacuugucuucucucccugaagcau

SEQ ID NO: 123473 - RNA, 27 nt, Human
uaucccuugguuuauuggcuucaacau

SEQ ID NO: 123474 - RNA, 22 nt, Human
ccuuguguuuuguccugccucu

SEQ ID NO: 123475 - RNA, 27 nt, Human
uucuccucuguggaaaugaaggcagca

SEQ ID NO: 123476 - RNA, 26 nt, Human
acaugugcagaagaugagguauuuua

SEQ ID NO: 123477 - RNA, 24 nt, Human
caaucgcaggaggcagacuguugg

SEQ ID NO: 123478 - RNA, 24 nt, Human
gcagcugucuguguuucuccuguu

SEQ ID NO: 123479 - RNA, 21 nt, Human
ugccuccacguggcuccggcu

SEQ ID NO: 123480 - RNA, 21 nt, Human
cuugccuagggccucugugau

SEQ ID NO: 123481 - RNA, 25 nt, Human
cgcugcacaucacaacauuuacuua

SEQ ID NO: 123482 - RNA, 22 nt, Human
cugcucccugcuccgucccgcc

SEQ ID NO: 123483 - RNA, 29 nt, Human
ggaggaaaaggaaagggccccagcguacu

SEQ ID NO: 123484 - RNA, 22 nt, Human
uuucacugcaccucuuuggauc

SEQ ID NO: 123485 - RNA, 21 nt, Human
ggcuucagauauuuugcacga

SEQ ID NO: 123486 - RNA, 21 nt, Human
cgcucugucaccugugccucu

SEQ ID NO: 123487 - RNA, 25 nt, Human
cagaaauuguauuuuuucuaugcca

SEQ ID NO: 123488 - RNA, 27 nt, Human
ggaccuccagcaccugcaggcagcuug

SEQ ID NO: 123489 - RNA, 22 nt, Human
cugacuuccuaauguaggaggu

SEQ ID NO: 123490 - RNA, 21 nt, Human
ucagaaagacaccaggcugca

SEQ ID NO: 123491 - RNA, 22 nt, Human
cugaggcacaagaaucacuuga

SEQ ID NO: 123492 - RNA, 21 nt, Human
caaagagacgcuucaaguggg

SEQ ID NO: 123493 - RNA, 26 nt, Human
cacgcuucaaggauauacugcagcuu

SEQ ID NO: 123494 - RNA, 20 nt, Human
caggggcugccagggacugc

SEQ ID NO: 123495 - RNA, 23 nt, Human
acagagggagggagcgagcgagc

SEQ ID NO: 123496 - RNA, 27 nt, Human
ggcucacaccuguaaugccagcccuuu

SEQ ID NO: 123497 - RNA, 22 nt, Human
uugcucucuuucccacuccuag

SEQ ID NO: 123498 - RNA, 23 nt, Human
acugccucuuauuuuaggcugua

SEQ ID NO: 123499 - RNA, 20 nt, Human
aggagcugaagagucugggu

SEQ ID NO: 123500 - RNA, 20 nt, Human
ugggaagagaaaucugaaga

SEQ ID NO: 123501 - RNA, 26 nt, Human
cugggagcuugccaggaacccagugg

SEQ ID NO: 123502 - RNA, 21 nt, Human
cgcugcacucgcggccggcga

SEQ ID NO: 123503 - RNA, 23 nt, Human
caaaaggaaaaaugggagcuaga

SEQ ID NO: 123504 - RNA, 21 nt, Human
gggccugacccucagcacuuu

SEQ ID NO: 123505 - RNA, 24 nt, Human
gauuaauaauacuuaccuaccuca

SEQ ID NO: 123506 - RNA, 21 nt, Human
cuuucuccugagcuccagucc

SEQ ID NO: 123507 - RNA, 27 nt, Human
cccugcaggggaagacuucucaggcuc

SEQ ID NO: 123508 - RNA, 22 nt, Human
uauuaaaaaacauaacuuucua

SEQ ID NO: 123509 - RNA, 26 nt, Human
cuguugucuuuuccuucugagccugc

SEQ ID NO: 123510 - RNA, 26 nt, Human
uauucccucucaacaaaacuuuauag

SEQ ID NO: 123511 - RNA, 22 nt, Human
uggcgcgcaccuguagucccag

SEQ ID NO: 123512 - RNA, 25 nt, Human
cugagggagacgcaggagguggagc

SEQ ID NO: 123513 - RNA, 22 nt, Human
cgggagaagcaugagcgagggg

SEQ ID NO: 123514 - RNA, 24 nt, Human
gcucuugggcuggaguaccguggu

SEQ ID NO: 123515 - RNA, 22 nt, Human
uagcucaucucacucacucuga

SEQ ID NO: 123516 - RNA, 22 nt, Human
ccugcucgaugcucacagggcc

SEQ ID NO: 123517 - RNA, 22 nt, Human
guccuguuuugucaauucccua

SEQ ID NO: 123518 - RNA, 21 nt, Human
cuaagguauacaaaucugucu

SEQ ID NO: 123519 - RNA, 21 nt, Human
ucccaggcugguggcaggagc

SEQ ID NO: 123520 - RNA, 29 nt, Human
ccugguccuggcccuggccuuucacucca

SEQ ID NO: 123521 - RNA, 21 nt, Human
aggggaaugugaaaaugguau

SEQ ID NO: 123522 - RNA, 22 nt, Human
ccucacugcaaccuccgccucc

SEQ ID NO: 123523 - RNA, 22 nt, Human
uugcagcuguuguuguaccgcc

SEQ ID NO: 123524 - RNA, 22 nt, Human
ccuuuugcuauaccacagucuu

SEQ ID NO: 123525 - RNA, 20 nt, Human
agugugguccagcugcauug

SEQ ID NO: 123526 - RNA, 21 nt, Human
uugcuucuuauuucucuuaua

SEQ ID NO: 123527 - RNA, 25 nt, Human
aucuuaugaaucauacauacacuca

SEQ ID NO: 123528 - RNA, 22 nt, Human
cacugcaugggacaaucgcagg

SEQ ID NO: 123529 - RNA, 22 nt, Human
ccuaaaaugaagugaaagcugc

SEQ ID NO: 123530 - RNA, 24 nt, Human
ccucuuccucacugaucuguaccg

SEQ ID NO: 123531 - RNA, 24 nt, Human
cuucucugcauaccgugaauuuau

SEQ ID NO: 123532 - RNA, 21 nt, Human
ccgaucuguguagccgguuuc

SEQ ID NO: 123533 - RNA, 25 nt, Human
uuccaaauuuggcugcacauucaua

SEQ ID NO: 123534 - RNA, 23 nt, Human
ugggcagcucaucucugucccac

SEQ ID NO: 123535 - RNA, 22 nt, Human
ccgccuccuggguucaagugau

SEQ ID NO: 123536 - RNA, 26 nt, Human
cacuccacucugggcugggcugugau

SEQ ID NO: 123537 - RNA, 28 nt, Human
cuaagguuuaacaccaaaauguuuuauu

SEQ ID NO: 123538 - RNA, 27 nt, Human
cuagucuguugaucugccuuuuguucu

SEQ ID NO: 123539 - RNA, 22 nt, Human
gcucaccgcccugcuucacugc

SEQ ID NO: 123540 - RNA, 22 nt, Human
gcuggagaaaaggugcccagcc

SEQ ID NO: 123541 - RNA, 22 nt, Human
gcuugucacuagcagcugcagu

SEQ ID NO: 123542 - RNA, 26 nt, Human
ucccaaaacaguuaagguuuuauuuu

SEQ ID NO: 123543 - RNA, 21 nt, Human
ccaacccacaaucucauugau

SEQ ID NO: 123544 - RNA, 25 nt, Human
aacucucucuccuuccuuccaccug

SEQ ID NO: 123545 - RNA, 21 nt, Human
aaacucacccaucacacuuug

SEQ ID NO: 123546 - RNA, 21 nt, Human
acuauauuuugcuuugacaga

SEQ ID NO: 123547 - RNA, 22 nt, Human
gcugcacgcucauuacuacccu

SEQ ID NO: 123548 - RNA, 19 nt, Human
uucuuccugugaguuccau

SEQ ID NO: 123549 - RNA, 25 nt, Human
ucugucuuuucuccuccgccugugu

SEQ ID NO: 123550 - RNA, 17 nt, Human
augauaaaaauauuuug

SEQ ID NO: 123551 - RNA, 21 nt, Human
ucugcaugccagccuggagga

SEQ ID NO: 123552 - RNA, 25 nt, Human
acccaggcuggagugcaguggcgcc

SEQ ID NO: 123553 - RNA, 20 nt, Human
cuacaguugccucuccgccu

SEQ ID NO: 123554 - RNA, 23 nt, Human
acuggacugacgacuugagugcu

SEQ ID NO: 123555 - RNA, 23 nt, Human
uguugcccaggcugggagggcaa

SEQ ID NO: 123556 - RNA, 21 nt, Human
guaacccucacccacagcccc

SEQ ID NO: 123557 - RNA, 22 nt, Human
ugcuucccagguucaagcgauu

SEQ ID NO: 123558 - RNA, 21 nt, Human
ugccuacaccacagaaaccuc

SEQ ID NO: 123559 - RNA, 25 nt, Human
ccccgcgaccucuccaucuucagcu

SEQ ID NO: 123560 - RNA, 20 nt, Human
aagucugaggaacaaugccu

SEQ ID NO: 123561 - RNA, 29 nt, Human
gggguugcgucugaggccugcccccuggg

SEQ ID NO: 123562 - RNA, 22 nt, Human
uuguugaaugcagccagugaag

SEQ ID NO: 123563 - RNA, 21 nt, Human
gaugagccaccaugccuggcu

SEQ ID NO: 123564 - RNA, 21 nt, Human
gcccaugcuggagugcaaugg

SEQ ID NO: 123565 - RNA, 21 nt, Human
cacguuccagccucuagguga

SEQ ID NO: 123566 - RNA, 22 nt, Human
aacguaaacacacuugcccuca

SEQ ID NO: 123567 - RNA, 23 nt, Human
gcagagagucuggugggguggag

SEQ ID NO: 123568 - RNA, 24 nt, Human
cacacacaacaccuuaguuccucu

SEQ ID NO: 123569 - RNA, 19 nt, Human
gauccugcaaguucaaggg

SEQ ID NO: 123570 - RNA, 22 nt, Human
uagcaagaguuguacccccucc

SEQ ID NO: 123571 - RNA, 20 nt, Human
ccaaaacaggccuaccaguc

SEQ ID NO: 123572 - RNA, 22 nt, Human
uggcucgggguggagcuagggu

SEQ ID NO: 123573 - RNA, 24 nt, Human
uuuuggguucugcauugagccaaa

SEQ ID NO: 123574 - RNA, 24 nt, Human
ugcacacaucaccaggugcaucug

SEQ ID NO: 123575 - RNA, 22 nt, Human
gcccaggcuggagugcaguggu

SEQ ID NO: 123576 - RNA, 30 nt, Human
cucucaggccuccucuuccucuaagacccu

SEQ ID NO: 123577 - RNA, 18 nt, Human
uuuaaaaaaugcaccuuu

SEQ ID NO: 123578 - RNA, 22 nt, Human
cacgaggucaggaguucaaaac

SEQ ID NO: 123579 - RNA, 22 nt, Human
cacaaggucaggaguucaagac

SEQ ID NO: 123580 - RNA, 22 nt, Human
cuccgaccaccgccucucggau

SEQ ID NO: 123581 - RNA, 21 nt, Human
ccugcugcccuuccccuuccc

SEQ ID NO: 123582 - RNA, 22 nt, Human
ucacccaggcuggagugcagug

SEQ ID NO: 123583 - RNA, 22 nt, Human
ucacccaggcuagagugcaaug

SEQ ID NO: 123584 - RNA, 22 nt, Human
aaagugcuaggauuauaggcuu

SEQ ID NO: 123585 - RNA, 20 nt, Human
aggaugcuagccugccuugu

SEQ ID NO: 123586 - RNA, 23 nt, Human
cggggccaccgggaggcacuuuu

SEQ ID NO: 123587 - RNA, 21 nt, Human
agaacaauuuauguucacauu

SEQ ID NO: 123588 - RNA, 26 nt, Human
cugccucugcuccugccugguggugu

SEQ ID NO: 123589 - RNA, 19 nt, Human
cucuucucuccccuuuucc

SEQ ID NO: 123590 - RNA, 25 nt, Human
agcagguucuggucauuccccaagc

SEQ ID NO: 123591 - RNA, 20 nt, Human
agugcaguggcaccaucuca

SEQ ID NO: 123592 - RNA, 27 nt, Human
ggguccccacauagugaaaguacucug

SEQ ID NO: 123593 - RNA, 22 nt, Human
gcccaggguggagugcaguggc

SEQ ID NO: 123594 - RNA, 22 nt, Human
gcccaggcuggaguggaguggc

SEQ ID NO: 123595 - RNA, 23 nt, Human
agcuguggagugugguuggagau

SEQ ID NO: 123596 - RNA, 27 nt, Human
ggacucucuggccaccuccuccaccgc

SEQ ID NO: 123597 - RNA, 23 nt, Human
aaggguggaacaggagggguggg

SEQ ID NO: 123598 - RNA, 20 nt, Human
ucacugguuauuagucuuuc

SEQ ID NO: 123599 - RNA, 27 nt, Human
uggcuaacacggugaaaccccgucuuu

SEQ ID NO: 123600 - RNA, 27 nt, Human
uggccaacauggugaaacccugucucu

SEQ ID NO: 123601 - RNA, 27 nt, Human
uggcuaacauggugaaaccccgucucu

SEQ ID NO: 123602 - RNA, 27 nt, Human
uggccaacauggcgaaaccccgucucu

SEQ ID NO: 123603 - RNA, 20 nt, Human
ugaaaugaguuauucaguag

SEQ ID NO: 123604 - RNA, 21 nt, Human
agagucuggccaaaacgguaa

SEQ ID NO: 123605 - RNA, 19 nt, Human
cccucauugcugggggcca

SEQ ID NO: 123606 - RNA, 22 nt, Human
cagaagccagcggacgccucug

SEQ ID NO: 123607 - RNA, 21 nt, Human
acuguccaccagaaaggacug

SEQ ID NO: 123608 - RNA, 22 nt, Human
caccuccuggguucaagcgauu

SEQ ID NO: 123609 - RNA, 23 nt, Human
uguugugcaggcuguagugcagu

SEQ ID NO: 123610 - RNA, 20 nt, Human
ucucaacucuugucgcccag

SEQ ID NO: 123611 - RNA, 15 nt, Human
cccacagaccugcuc

SEQ ID NO: 123612 - RNA, 24 nt, Human
ugcccagcugauuuuuguauuuuu

SEQ ID NO: 123613 - RNA, 24 nt, Human
cacagccgcagcaauggcgcugag

SEQ ID NO: 123614 - RNA, 19 nt, Human
agaacuuugcgucucucca

SEQ ID NO: 123615 - RNA, 20 nt, Human
auuucacacuggagugaaug

SEQ ID NO: 123616 - RNA, 23 nt, Human
ucuuuaacugccuuccuggcuua

SEQ ID NO: 123617 - RNA, 21 nt, Human
cuuugagugugaaugcagcag

SEQ ID NO: 123618 - RNA, 20 nt, Human
ccuuagcuuagaccucagcc

SEQ ID NO: 123619 - RNA, 23 nt, Human
cagaaggcuacauauacauaguu

SEQ ID NO: 123620 - RNA, 19 nt, Human
caacagcaaacaggugcua

SEQ ID NO: 123621 - RNA, 22 nt, Human
uuuuaagcaaaagcauccaaga

SEQ ID NO: 123622 - RNA, 22 nt, Human
uacacagucucacuuucccugc

SEQ ID NO: 123623 - RNA, 22 nt, Human
ucucaauaaaacuuugaaagca

SEQ ID NO: 123624 - RNA, 27 nt, Human
augcucucuuugucugccuguuucuaa

SEQ ID NO: 123625 - RNA, 23 nt, Human
ucauccaguaccuuaagcccuga

SEQ ID NO: 123626 - RNA, 22 nt, Human
cucucucugggucagaaccaga

SEQ ID NO: 123627 - RNA, 24 nt, Human
gcugggacuuggcuguggguggga

SEQ ID NO: 123628 - RNA, 25 nt, Human
aagagccucacaugagaaauuacca

SEQ ID NO: 123629 - RNA, 20 nt, Human
gccagcaaagaggagggguc

SEQ ID NO: 123630 - RNA, 21 nt, Human
ugucuguaaucacacucucuu

SEQ ID NO: 123631 - RNA, 24 nt, Human
ggauucucuucccacccucaccau

SEQ ID NO: 123632 - RNA, 26 nt, Human
gagucaaacgguucccggcccagucc

SEQ ID NO: 123633 - RNA, 23 nt, Human
ugaccucuguccagggcacuuug

SEQ ID NO: 123634 - RNA, 26 nt, Human
cccagaccuggugaggacaggcccuc

SEQ ID NO: 123635 - RNA, 26 nt, Human
aauucugcaaggguucuuggugaugc

SEQ ID NO: 123636 - RNA, 27 nt, Human
ugcugggacugaggguggagcagcaaa

SEQ ID NO: 123637 - RNA, 22 nt, Human
ccgagaucccagccaucauguc

SEQ ID NO: 123638 - RNA, 19 nt, Human
gcaguguccaggagcggca

SEQ ID NO: 123639 - RNA, 22 nt, Human
uggccaacauggagaaacccca

SEQ ID NO: 123640 - RNA, 22 nt, Human
ccgcugcacuccagccugggug

SEQ ID NO: 123641 - RNA, 22 nt, Human
ccacugcacuccagccugagug

SEQ ID NO: 123642 - RNA, 23 nt, Human
acagauggggcaaaaggaggccc

SEQ ID NO: 123643 - RNA, 26 nt, Human
gguuucuugaggauuggacucuugau

SEQ ID NO: 123644 - RNA, 23 nt, Human
caguucuggcuguaguuaugacc

SEQ ID NO: 123645 - RNA, 20 nt, Human
gccaucucaacagaaucgca

SEQ ID NO: 123646 - RNA, 19 nt, Human
uuugggaaaaacagacagu

SEQ ID NO: 123647 - RNA, 21 nt, Human
acauuucuaaaagacagugau

SEQ ID NO: 123648 - RNA, 26 nt, Human
cugccucucucauggcuugggcugga

SEQ ID NO: 123649 - RNA, 20 nt, Human
agagauuguuguuugccaua

SEQ ID NO: 123650 - RNA, 20 nt, Human
ucuccagcugcugagcagcu

SEQ ID NO: 123651 - RNA, 22 nt, Human
cagggaccaucacauggguagg

SEQ ID NO: 123652 - RNA, 26 nt, Human
ugcccugcuaggcaguuguaaucugg

SEQ ID NO: 123653 - RNA, 22 nt, Human
aguauuuuuguuaauaaaacuc

SEQ ID NO: 123654 - RNA, 26 nt, Human
uuguagcuuccuggggugggaggcac

SEQ ID NO: 123655 - RNA, 20 nt, Human
cugaguauugugugccugua

SEQ ID NO: 123656 - RNA, 26 nt, Human
caggaaggagaacggaugcuugucug

SEQ ID NO: 123657 - RNA, 20 nt, Human
gguggcucgcaccuguggga

SEQ ID NO: 123658 - RNA, 27 nt, Human
gcgggauguccaucgcuccagcuuggu

SEQ ID NO: 123659 - RNA, 25 nt, Human
aagacuugguucagcuggucacggu

SEQ ID NO: 123660 - RNA, 22 nt, Human
uucgcaucaaaaacaaacaaca

SEQ ID NO: 123661 - RNA, 26 nt, Human
ggagguggcuguggauggaggcaccg

SEQ ID NO: 123662 - RNA, 21 nt, Human
gccuuuucagcaucucaccca

SEQ ID NO: 123663 - RNA, 21 nt, Human
cugccucuuuccggcugugac

SEQ ID NO: 123664 - RNA, 25 nt, Human
acucgggaagggaagauggauguaa

SEQ ID NO: 123665 - RNA, 24 nt, Human
cagcccuggcccucugccugcucc

SEQ ID NO: 123666 - RNA, 22 nt, Human
cugaccaagccuuguggcacca

SEQ ID NO: 123667 - RNA, 21 nt, Human
gggaauguucuuucugcucua

SEQ ID NO: 123668 - RNA, 25 nt, Human
gcucagaaaaaugagggagagagaa

SEQ ID NO: 123669 - RNA, 21 nt, Human
ggccagcauuauaagcaggug

SEQ ID NO: 123670 - RNA, 19 nt, Human
gucucaguuuuuggucaca

SEQ ID NO: 123671 - RNA, 25 nt, Human
ggauauuugcacuauuuccacaugg

SEQ ID NO: 123672 - RNA, 23 nt, Human
ccuaccccuguggccauccugcc

SEQ ID NO: 123673 - RNA, 20 nt, Human
gucuacagccgaugaccuca

SEQ ID NO: 123674 - RNA, 17 nt, Human
cugaguauugaaugaua

SEQ ID NO: 123675 - RNA, 23 nt, Human
uccacaucugugcacucaagcuu

SEQ ID NO: 123676 - RNA, 18 nt, Human
gauccuugggaacacugu

SEQ ID NO: 123677 - RNA, 19 nt, Human
gggaguggaggugcagcga

SEQ ID NO: 123678 - RNA, 22 nt, Human
uacuugguuauccagugcagug

SEQ ID NO: 123679 - RNA, 19 nt, Human
acuccucugcugaccugcu

SEQ ID NO: 123680 - RNA, 21 nt, Human
aggaguaaaagagucaaguga

SEQ ID NO: 123681 - RNA, 22 nt, Human
uggcuggagauggaaaaucaca

SEQ ID NO: 123682 - RNA, 19 nt, Human
ccucacugcaaauuuccuc

SEQ ID NO: 123683 - RNA, 27 nt, Human
agccagaaucuguaucacagaggugca

SEQ ID NO: 123684 - RNA, 27 nt, Human
cccaacaagagcucucugccuccgguc

SEQ ID NO: 123685 - RNA, 23 nt, Human
cgcuguacccuuuaagauaucca

SEQ ID NO: 123686 - RNA, 29 nt, Human
uugugcaucaccuggcuugaguuccuugc

SEQ ID NO: 123687 - RNA, 22 nt, Human
gcucacgccuguaaucccagua

SEQ ID NO: 123688 - RNA, 20 nt, Human
gacaggugaagugaccagag

SEQ ID NO: 123689 - RNA, 24 nt, Human
ucaggcuggagugcagugaugcaa

SEQ ID NO: 123690 - RNA, 22 nt, Human
uguuaucccagcagaagggaau

SEQ ID NO: 123691 - RNA, 21 nt, Human
agggagcucuuggcugagcuu

SEQ ID NO: 123692 - RNA, 22 nt, Human
ugugcacacaugcaugugucug

SEQ ID NO: 123693 - RNA, 26 nt, Human
acucacuguacuuguauuugagacaa

SEQ ID NO: 123694 - RNA, 26 nt, Human
ucucucccucuccacuccugaaguau

SEQ ID NO: 123695 - RNA, 21 nt, Human
agccuaucugucaucgccuga

SEQ ID NO: 123696 - RNA, 19 nt, Human
cccaccccguggaccgcuu

SEQ ID NO: 123697 - RNA, 20 nt, Human
auuuaauaacauacuccuuu

SEQ ID NO: 123698 - RNA, 22 nt, Human
cugggaggcagagguuucagug

SEQ ID NO: 123699 - RNA, 20 nt, Human
aaugccucaguagcaucuca

SEQ ID NO: 123700 - RNA, 21 nt, Human
agaucuguaauuuuuauuuuc

SEQ ID NO: 123701 - RNA, 27 nt, Human
agcuuuaucuuuuuugacaauauacug

SEQ ID NO: 123702 - RNA, 26 nt, Human
gccgccgcaccccgacuccuggggcc

SEQ ID NO: 123703 - RNA, 22 nt, Human
ccacuccuuggcuggaggcagu

SEQ ID NO: 123704 - RNA, 21 nt, Human
gugacuauuauugcuccauca

SEQ ID NO: 123705 - RNA, 22 nt, Human
agcaacucuggccaaugcucug

SEQ ID NO: 123706 - RNA, 26 nt, Human
agaucacaaacuccuagagucuacau

SEQ ID NO: 123707 - RNA, 19 nt, Human
uccccggcuggagugcagu

SEQ ID NO: 123708 - RNA, 29 nt, Human
gucacacuguacaucuaucauaaugugcc

SEQ ID NO: 123709 - RNA, 19 nt, Human
gcgucuccccugcugcugu

SEQ ID NO: 123710 - RNA, 26 nt, Human
gcgagaucacccugcucugcccagcc

SEQ ID NO: 123711 - RNA, 22 nt, Human
uuaccugaaagcugcaguucac

SEQ ID NO: 123712 - RNA, 24 nt, Human
ugauagauaacuaacaaaauaguu

SEQ ID NO: 123713 - RNA, 22 nt, Human
aacuacaggugugcacuaccac

SEQ ID NO: 123714 - RNA, 19 nt, Human
ugggcacuguuuuuucucc

SEQ ID NO: 123715 - RNA, 20 nt, Human
gcuagauugcuaaggagcug

SEQ ID NO: 123716 - RNA, 19 nt, Human
gcuaccugcagcaagauag

SEQ ID NO: 123717 - RNA, 20 nt, Human
gcugcacucuggcuggggaa

SEQ ID NO: 123718 - RNA, 23 nt, Human
cuuucgucuccuuccuccgcugc

SEQ ID NO: 123719 - RNA, 21 nt, Human
augcugggcaggaaggugucu

SEQ ID NO: 123720 - RNA, 21 nt, Human
cuucccuuuuacauacugcug

SEQ ID NO: 123721 - RNA, 31 nt, Human
uagaagaaaggccugucuccagguccccgag

SEQ ID NO: 123722 - RNA, 23 nt, Human
uuuugaggaaaaacuacaguuug

SEQ ID NO: 123723 - RNA, 24 nt, Human
cugguggcaagugcacggggcaca

SEQ ID NO: 123724 - RNA, 22 nt, Human
uuccugguuuguuccucucucc

SEQ ID NO: 123725 - RNA, 21 nt, Human
ugaccugggaugcaguaguag

SEQ ID NO: 123726 - RNA, 26 nt, Human
cuucugcuaacauccagaaucucaua

SEQ ID NO: 123727 - RNA, 22 nt, Human
ccaaguagcugggacuacaggu

SEQ ID NO: 123728 - RNA, 27 nt, Human
ggaggcugccgggcagaguggagcagc

SEQ ID NO: 123729 - RNA, 18 nt, Human
cccgccgugcaagagucg

SEQ ID NO: 123730 - RNA, 26 nt, Human
aucuggcaacccuagucugcuagcca

SEQ ID NO: 123731 - RNA, 23 nt, Human
gggcgucgagacaggaaggcagg

SEQ ID NO: 123732 - RNA, 19 nt, Human
guucuuaucaggacacaaa

SEQ ID NO: 123733 - RNA, 26 nt, Human
uccugagugaggaaggcaugaccucu

SEQ ID NO: 123734 - RNA, 20 nt, Human
ggccccagggaacuaaaggg

SEQ ID NO: 123735 - RNA, 16 nt, Human
ucaaaccagucugcug

SEQ ID NO: 123736 - RNA, 22 nt, Human
aucagccuggcuaacauggcga

SEQ ID NO: 123737 - RNA, 24 nt, Human
cugucucuuuucccugggaucccu

SEQ ID NO: 123738 - RNA, 22 nt, Human
uacacacacgcagugguauuca

SEQ ID NO: 123739 - RNA, 23 nt, Human
ggcugcugagcggcgcggcgccg

SEQ ID NO: 123740 - RNA, 22 nt, Human
gcuggaagcugccugucaucuc

SEQ ID NO: 123741 - RNA, 25 nt, Human
acacgaccagcugugcucccagcag

SEQ ID NO: 123742 - RNA, 23 nt, Human
ccgggagacagagguugcaguga

SEQ ID NO: 123743 - RNA, 19 nt, Human
gcugucugcgcgucugacu

SEQ ID NO: 123744 - RNA, 19 nt, Human
cuguagcgaggcccccagg

SEQ ID NO: 123745 - RNA, 22 nt, Human
ugaacaugagugucaacuccag

SEQ ID NO: 123746 - RNA, 27 nt, Human
gccgggcaccgucccacagcaucuccu

SEQ ID NO: 123747 - RNA, 22 nt, Human
agaaguuagggguuuuguugga

SEQ ID NO: 123748 - RNA, 22 nt, Human
ugcagugagccgaggucgugcc

SEQ ID NO: 123749 - RNA, 22 nt, Human
aaucagaaaugugaauguagua

SEQ ID NO: 123750 - RNA, 22 nt, Human
uuucuuuauaaguuauccaaaa

SEQ ID NO: 123751 - RNA, 22 nt, Human
ggggucucaagacauucugccu

SEQ ID NO: 123752 - RNA, 19 nt, Human
uuugaacucuucuuugcca

SEQ ID NO: 123753 - RNA, 23 nt, Human
auucacuccuuugagucuuugga

SEQ ID NO: 123754 - RNA, 24 nt, Human
ucuccugccucagccucuugagug

SEQ ID NO: 123755 - RNA, 25 nt, Human
gggagguggcgcugggcgcgcggga

SEQ ID NO: 123756 - RNA, 22 nt, Human
uuguaacuaagaauuuauuucu

SEQ ID NO: 123757 - RNA, 19 nt, Human
acucguuuaaaaacaagua

SEQ ID NO: 123758 - RNA, 24 nt, Human
ccacaggccccuuccccagccuca

SEQ ID NO: 123759 - RNA, 21 nt, Human
ucugcuuccuccgccugcugc

SEQ ID NO: 123760 - RNA, 24 nt, Human
cggaguagcugggaucacagcugc

SEQ ID NO: 123761 - RNA, 19 nt, Human
cacugcaaucucugccucc

SEQ ID NO: 123762 - RNA, 22 nt, Human
cgcagccgccgggcaggccugc

SEQ ID NO: 123763 - RNA, 24 nt, Human
caguugguuucuuucuuucucuua

SEQ ID NO: 123764 - RNA, 30 nt, Human
gcagcuguauucuggagucuggauguugcu

SEQ ID NO: 123765 - RNA, 24 nt, Human
uauuugauaucuaaaauguuagga

SEQ ID NO: 123766 - RNA, 17 nt, Human
gcuagugcuguaauauu

SEQ ID NO: 123767 - RNA, 28 nt, Human
aaccaauacagaacaugagcccuuuuua

SEQ ID NO: 123768 - RNA, 23 nt, Human
auuuguugaguacuucuccaugc

SEQ ID NO: 123769 - RNA, 22 nt, Human
auuaauucucuuuccauccucc

SEQ ID NO: 123770 - RNA, 22 nt, Human
gacuagccuggccaacauguug

SEQ ID NO: 123771 - RNA, 22 nt, Human
gaccagccugggcaacauggug

SEQ ID NO: 123772 - RNA, 22 nt, Human
uuucccuuauggugaccugagu

SEQ ID NO: 123773 - RNA, 22 nt, Human
gaagcaguccuugagaaggcau

SEQ ID NO: 123774 - RNA, 22 nt, Human
ugaacaacuauuuauaaacuag

SEQ ID NO: 123775 - RNA, 24 nt, Human
uccucauucuugccuugaguucca

SEQ ID NO: 123776 - RNA, 20 nt, Human
cugugcagaggaaacuuaag

SEQ ID NO: 123777 - RNA, 24 nt, Human
acccaggcuggagugcaauggcgc

SEQ ID NO: 123778 - RNA, 21 nt, Human
gccaaguuggagugcaauggu

SEQ ID NO: 123779 - RNA, 23 nt, Human
cauggcagggauaugcagggcac

SEQ ID NO: 123780 - RNA, 27 nt, Human
ccuuaggugagcuucaaucuaagcauc

SEQ ID NO: 123781 - RNA, 27 nt, Human
ccccugccuauccucuccgaucaccaa

SEQ ID NO: 123782 - RNA, 23 nt, Human
ucucucuugggagcauauaaaca

SEQ ID NO: 123783 - RNA, 22 nt, Human
ggcaggagaaucgcuugaaccc

SEQ ID NO: 123784 - RNA, 24 nt, Human
ggagacacccauccgugaacccca

SEQ ID NO: 123785 - RNA, 21 nt, Human
guguggcggugcgugccugua

SEQ ID NO: 123786 - RNA, 21 nt, Human
aacuuacuacugaaucucuaa

SEQ ID NO: 123787 - RNA, 22 nt, Human
aggcuggagugcaguggugugg

SEQ ID NO: 123788 - RNA, 20 nt, Human
cucugcaggacacagaucug

SEQ ID NO: 123789 - RNA, 24 nt, Human
ggaaggcacggccggcggcggcgg

SEQ ID NO: 123790 - RNA, 15 nt, Human
ccuccacuucucucc

SEQ ID NO: 123791 - RNA, 19 nt, Human
gggaggccccugcccccac

SEQ ID NO: 123792 - RNA, 21 nt, Human
ccagccugggcaacguaguaa

SEQ ID NO: 123793 - RNA, 18 nt, Human
cugcucccauuuucuuuc

SEQ ID NO: 123794 - RNA, 25 nt, Human
ugcaguggugccaucaccacggcuc

SEQ ID NO: 123795 - RNA, 17 nt, Human
ugaggaauguacuuuua

SEQ ID NO: 123796 - RNA, 26 nt, Human
ucaagagcaaagguuaauuuaaggac

SEQ ID NO: 123797 - RNA, 22 nt, Human
ggguccuccuccucuaggacca

SEQ ID NO: 123798 - RNA, 17 nt, Human
caggccagcugcaguga

SEQ ID NO: 123799 - RNA, 29 nt, Human
aacugugaugugucuucuuuguaaaaguu

SEQ ID NO: 123800 - RNA, 21 nt, Human
aucauuccaagaggagcauuc

SEQ ID NO: 123801 - RNA, 20 nt, Human
ccuucccugcaccugcccug

SEQ ID NO: 123802 - RNA, 21 nt, Human
acacccuaguaaccucuugag

SEQ ID NO: 123803 - RNA, 23 nt, Human
gcauacagugucuggacacugcc

SEQ ID NO: 123804 - RNA, 22 nt, Human
cagaagcaaggggcugaaaaga

SEQ ID NO: 123805 - RNA, 23 nt, Human
gaaggcugguuagaacauguggg

SEQ ID NO: 123806 - RNA, 20 nt, Human
ugggcuuccugaugaugauu

SEQ ID NO: 123807 - RNA, 22 nt, Human
ccugggcucugggcccugcugc

SEQ ID NO: 123808 - RNA, 21 nt, Human
cacuccugcuucucucagcca

SEQ ID NO: 123809 - RNA, 21 nt, Human
cuggggagguacugaacugua

SEQ ID NO: 123810 - RNA, 22 nt, Human
agaccagccuggacaauauagu

SEQ ID NO: 123811 - RNA, 28 nt, Human
agcuguuccauuacaccacagcauugug

SEQ ID NO: 123812 - RNA, 23 nt, Human
acaagccccacagccccucaaag

SEQ ID NO: 123813 - RNA, 20 nt, Human
cgcccgcaucuagagcccgc

SEQ ID NO: 123814 - RNA, 22 nt, Human
uaacuccugggcucaagcaauc

SEQ ID NO: 123815 - RNA, 27 nt, Human
ccuauuccuuccuagcuucccugcaau

SEQ ID NO: 123816 - RNA, 21 nt, Human
cuuucaucuauaguuuggcca

SEQ ID NO: 123817 - RNA, 21 nt, Human
cuguggacaucacgguuccag

SEQ ID NO: 123818 - RNA, 21 nt, Human
ucugaauccuaagggcugguc

SEQ ID NO: 123819 - RNA, 22 nt, Human
cgcugccucuaccugccugguc

SEQ ID NO: 123820 - RNA, 23 nt, Human
uagaugguucuguccucaucccu

SEQ ID NO: 123821 - RNA, 22 nt, Human
guggaugacuguugaugaagua

SEQ ID NO: 123822 - RNA, 27 nt, Human
ucgucauuaccuggcagaggcaaagaa

SEQ ID NO: 123823 - RNA, 27 nt, Human
uucauucuccagauuuaugaacauuuu

SEQ ID NO: 123824 - RNA, 27 nt, Human
ucccucgggccccagcuccgccucugc

SEQ ID NO: 123825 - RNA, 26 nt, Human
caagggugagcaucucugcugagaca

SEQ ID NO: 123826 - RNA, 25 nt, Human
cugccucuuuggucaguuucagguc

SEQ ID NO: 123827 - RNA, 21 nt, Human
uuuuuugucucagcaucagua

SEQ ID NO: 123828 - RNA, 26 nt, Human
gcacuccucaagacuuugauccuugg

SEQ ID NO: 123829 - RNA, 22 nt, Human
agccucugcuggagugcaguga

SEQ ID NO: 123830 - RNA, 22 nt, Human
gcauagccuucggcacagcccc

SEQ ID NO: 123831 - RNA, 23 nt, Human
ugcaaccucugccucccagguca

SEQ ID NO: 123832 - RNA, 20 nt, Human
cacccucucugggccucagu

SEQ ID NO: 123833 - RNA, 22 nt, Human
gagccccagggaucucaucugg

SEQ ID NO: 123834 - RNA, 21 nt, Human
acagaggccucccccagccag

SEQ ID NO: 123835 - RNA, 20 nt, Human
cgaacucaggggguggaggu

SEQ ID NO: 123836 - RNA, 27 nt, Human
gucauuccuguuuaauacucacuguac

SEQ ID NO: 123837 - RNA, 23 nt, Human
ggccugguaagucccaggaacca

SEQ ID NO: 123838 - RNA, 23 nt, Human
ugugccuguaaucccagcuacuc

SEQ ID NO: 123839 - RNA, 22 nt, Human
uugccauggacuuuuccuguug

SEQ ID NO: 123840 - RNA, 27 nt, Human
ggaggcugaggcuaugauggcggccau

SEQ ID NO: 123841 - RNA, 26 nt, Human
aguuaaugccuaaccucuucagcacu

SEQ ID NO: 123842 - RNA, 21 nt, Human
cuugggguaaacugagguauu

SEQ ID NO: 123843 - RNA, 25 nt, Human
uuaagaaaaaugaagaaaaaacgca

SEQ ID NO: 123844 - RNA, 28 nt, Human
ggagugagcuggggcugaaguugucccc

SEQ ID NO: 123845 - RNA, 22 nt, Human
cccgaguagcugagacuacagg

SEQ ID NO: 123846 - RNA, 23 nt, Human
gugaccacaggcugguguguagg

SEQ ID NO: 123847 - RNA, 21 nt, Human
aacaagggccaguuguauucu

SEQ ID NO: 123848 - RNA, 21 nt, Human
ugcaagaccuuuggcucacag

SEQ ID NO: 123849 - RNA, 27 nt, Human
uauauacuaguuaauuucuuccauucc

SEQ ID NO: 123850 - RNA, 26 nt, Human
gggagagaaagacaaggagaaaccug

SEQ ID NO: 123851 - RNA, 22 nt, Human
agacagugugagggggugggga

SEQ ID NO: 123852 - RNA, 21 nt, Human
aauaaaucaguuagcuaugaa

SEQ ID NO: 123853 - RNA, 23 nt, Human
cugaguguugauggggguuacca

SEQ ID NO: 123854 - RNA, 22 nt, Human
ggacuccugacgucgugaucca

SEQ ID NO: 123855 - RNA, 22 nt, Human
aaagugcugagauuauaggcac

SEQ ID NO: 123856 - RNA, 27 nt, Human
cagccugguauucaguggccaccagaa

SEQ ID NO: 123857 - RNA, 22 nt, Human
gcugggaguggguagggacuga

SEQ ID NO: 123858 - RNA, 20 nt, Human
uuuauccauagacagggccc

SEQ ID NO: 123859 - RNA, 24 nt, Human
gagaauggggguggggaggcaaga

SEQ ID NO: 123860 - RNA, 20 nt, Human
aggcaggcccugggagggag

SEQ ID NO: 123861 - RNA, 21 nt, Human
aggagcagugcaggcacagua

SEQ ID NO: 123862 - RNA, 19 nt, Human
acaggacucgugcugcagu

SEQ ID NO: 123863 - RNA, 23 nt, Human
uuugggaagccaagguaagagga

SEQ ID NO: 123864 - RNA, 27 nt, Human
cagcccagccccagcuucucugcccac

SEQ ID NO: 123865 - RNA, 22 nt, Human
aaacucccaggcucaagggauc

SEQ ID NO: 123866 - RNA, 21 nt, Human
gguugaacccgggagguggag

SEQ ID NO: 123867 - RNA, 20 nt, Human
cuacagaugauucagccuga

SEQ ID NO: 123868 - RNA, 27 nt, Human
cugcuaccuguucuugggccucaggcu

SEQ ID NO: 123869 - RNA, 26 nt, Human
aaagcagagucagcuacugagagcuc

SEQ ID NO: 123870 - RNA, 24 nt, Human
gugacagagcaaggcucugucuca

SEQ ID NO: 123871 - RNA, 22 nt, Human
ccugccuggaacuggcugugaa

SEQ ID NO: 123872 - RNA, 21 nt, Human
gcaauauuuguuuauuccaaa

SEQ ID NO: 123873 - RNA, 27 nt, Human
gcuugcuuccuuccuccuggcugcaca

SEQ ID NO: 123874 - RNA, 23 nt, Human
gccaggugaagauuagggccagg

SEQ ID NO: 123875 - RNA, 22 nt, Human
ccugggagaggcagacgaguga

SEQ ID NO: 123876 - RNA, 24 nt, Human
acccugcguuccaucccaccauca

SEQ ID NO: 123877 - RNA, 23 nt, Human
cuucugcucucucagcaaccacu

SEQ ID NO: 123878 - RNA, 21 nt, Human
cagauuucaggcuguucuuaa

SEQ ID NO: 123879 - RNA, 28 nt, Human
uaaacuauugaaaggugcuuugaugauu

SEQ ID NO: 123880 - RNA, 23 nt, Human
cacugcugagugagguugagggg

SEQ ID NO: 123881 - RNA, 22 nt, Human
auugcaaccucugccucccagg

SEQ ID NO: 123882 - RNA, 26 nt, Human
gagcguugccccucccucucccaacu

SEQ ID NO: 123883 - RNA, 24 nt, Human
caggcagcggguagggcacaggga

SEQ ID NO: 123884 - RNA, 22 nt, Human
ugugagccaccgugcccggcca

SEQ ID NO: 123885 - RNA, 26 nt, Human
gcucucucaacaucacauacagcuuc

SEQ ID NO: 123886 - RNA, 26 nt, Human
gggugccuguccaggaagagcugugu

SEQ ID NO: 123887 - RNA, 21 nt, Human
gugacuauccuucuucacuua

SEQ ID NO: 123888 - RNA, 20 nt, Human
guccgcugcgucugcacuga

SEQ ID NO: 123889 - RNA, 22 nt, Human
cacaccuguaaucccagcacac

SEQ ID NO: 123890 - RNA, 23 nt, Human
aucacuuaccuucuucucuuuca

SEQ ID NO: 123891 - RNA, 25 nt, Human
ggcggccccagcaccucagccugca

SEQ ID NO: 123892 - RNA, 21 nt, Human
cucuagcccagcuacagcaga

SEQ ID NO: 123893 - RNA, 23 nt, Human
gccuguaaucccugcuacucagg

SEQ ID NO: 123894 - RNA, 22 nt, Human
uugcccaggcugaagugcagug

SEQ ID NO: 123895 - RNA, 20 nt, Human
accaaagagaaggcgacaga

SEQ ID NO: 123896 - RNA, 27 nt, Human
ucuguggguuucuaaagcugccagccg

SEQ ID NO: 123897 - RNA, 25 nt, Human
acacauuuacaauagauagaugugc

SEQ ID NO: 123898 - RNA, 22 nt, Human
uccagugaugugggaaguuacc

SEQ ID NO: 123899 - RNA, 27 nt, Human
ccucaauguucuuacucaagucaucuc

SEQ ID NO: 123900 - RNA, 24 nt, Human
gugcagauggcccuucaaucucga

SEQ ID NO: 123901 - RNA, 21 nt, Human
gagaaacuuggaggcauuuca

SEQ ID NO: 123902 - RNA, 25 nt, Human
gccuggcugcacagcauccuccucu

SEQ ID NO: 123903 - RNA, 22 nt, Human
gcgcgagccaccgcgcccagcc

SEQ ID NO: 123904 - RNA, 22 nt, Human
gcgugagccacugcgcccagcc

SEQ ID NO: 123905 - RNA, 25 nt, Human
gcugucucugccugccggauaaugc

SEQ ID NO: 123906 - RNA, 27 nt, Human
uauauuuucacaacuacuuucucucuc

SEQ ID NO: 123907 - RNA, 22 nt, Human
aagaagagucaacauugaucca

SEQ ID NO: 123908 - RNA, 22 nt, Human
auaguaauccucacugagugau

SEQ ID NO: 123909 - RNA, 22 nt, Human
ugggcaacauggugaaacccca

SEQ ID NO: 123910 - RNA, 19 nt, Human
uugcaaaccucaacaugcu

SEQ ID NO: 123911 - RNA, 22 nt, Human
gcugucauuucuccacuugcca

SEQ ID NO: 123912 - RNA, 23 nt, Human
aagcagucuuuauaugcauuccg

SEQ ID NO: 123913 - RNA, 24 nt, Human
cagauguugaaagaccguuuacaa

SEQ ID NO: 123914 - RNA, 23 nt, Human
ugccuguagcucucuuccuuuug

SEQ ID NO: 123915 - RNA, 21 nt, Human
ucaacucuuaaagacaucuua

SEQ ID NO: 123916 - RNA, 23 nt, Human
cagcaaaccacgcagguccuucu

SEQ ID NO: 123917 - RNA, 27 nt, Human
uuagcacagccauuuagauauaacauc

SEQ ID NO: 123918 - RNA, 30 nt, Human
gugaaggugaccucacaguacugguuaauu

SEQ ID NO: 123919 - RNA, 21 nt, Human
cuguuaaucuccuuuuuucuu

SEQ ID NO: 123920 - RNA, 15 nt, Human
agggaaagagaggag

SEQ ID NO: 123921 - RNA, 22 nt, Human
cuuuuagcuuucuuucaguuaa

SEQ ID NO: 123922 - RNA, 25 nt, Human
cgggauguguuggccacagggagag

SEQ ID NO: 123923 - RNA, 24 nt, Human
cuuacucuagguccucccugccua

SEQ ID NO: 123924 - RNA, 20 nt, Human
gccaucaacccgagugcagu

SEQ ID NO: 123925 - RNA, 21 nt, Human
caggaggcagagcuugcagug

SEQ ID NO: 123926 - RNA, 23 nt, Human
gagagugugcuuauuuucacugc

SEQ ID NO: 123927 - RNA, 24 nt, Human
gcaaacauuuucucuuuaggguau

SEQ ID NO: 123928 - RNA, 26 nt, Human
cugugcucuuuacuucuuuuucucca

SEQ ID NO: 123929 - RNA, 27 nt, Human
cuuacuuccuagacuuugauuucuccg

SEQ ID NO: 123930 - RNA, 18 nt, Human
cccccagagacaggcugg

SEQ ID NO: 123931 - RNA, 23 nt, Human
caggaauuuuagagauugaaaug

SEQ ID NO: 123932 - RNA, 23 nt, Human
ugcuggaccugaauucuacugag

SEQ ID NO: 123933 - RNA, 22 nt, Human
ccugccaggccucaggcccagg

SEQ ID NO: 123934 - RNA, 24 nt, Human
gccuaucuuuguccucucucuucc

SEQ ID NO: 123935 - RNA, 20 nt, Human
ucgcucuccccucccugcuu

SEQ ID NO: 123936 - RNA, 23 nt, Human
cuuaggcuggagugcaguggcac

SEQ ID NO: 123937 - RNA, 25 nt, Human
cagcaagcccaagauuccgaagaag

SEQ ID NO: 123938 - RNA, 25 nt, Human
ggggguggacuugggaacaggcugu

SEQ ID NO: 123939 - RNA, 21 nt, Human
gaauucuucuguuacuuacca

SEQ ID NO: 123940 - RNA, 23 nt, Human
auuucagaggcucugugugcccu

SEQ ID NO: 123941 - RNA, 22 nt, Human
caggcuggggaauuuugcugcu

SEQ ID NO: 123942 - RNA, 23 nt, Human
ggugauuggaaucagcccaucua

SEQ ID NO: 123943 - RNA, 27 nt, Human
auauugcaguguuucaaaggugucacu

SEQ ID NO: 123944 - RNA, 20 nt, Human
gcccuguggaugagcccuca

SEQ ID NO: 123945 - RNA, 22 nt, Human
aaugucaguggaaguuagggaa

SEQ ID NO: 123946 - RNA, 25 nt, Human
uuuauuuaaugaaaugucauggcuc

SEQ ID NO: 123947 - RNA, 17 nt, Human
uccccauccguucguau

SEQ ID NO: 123948 - RNA, 26 nt, Human
gauggccaccagaacccacuguucau

SEQ ID NO: 123949 - RNA, 27 nt, Human
gaggaagagaacuucguguggccugca

SEQ ID NO: 123950 - RNA, 23 nt, Human
ugucacccagacuggagugcagu

SEQ ID NO: 123951 - RNA, 23 nt, Human
ugucacccaggcuggaguacagu

SEQ ID NO: 123952 - RNA, 22 nt, Human
cucaaccucccaaguaggauua

SEQ ID NO: 123953 - RNA, 26 nt, Human
gccgugaugccucccuguugaagcuc

SEQ ID NO: 123954 - RNA, 22 nt, Human
ucgccacccucucuggacagcc

SEQ ID NO: 123955 - RNA, 24 nt, Human
ggagccaggggcugugacagcucc

SEQ ID NO: 123956 - RNA, 30 nt, Human
uccugaagaaauaagccucaguuuuccauc

SEQ ID NO: 123957 - RNA, 27 nt, Human
gucacccaggcuagagugcaauggcac

SEQ ID NO: 123958 - RNA, 26 nt, Human
ucugcccagauccccucucuuuucuc

SEQ ID NO: 123959 - RNA, 22 nt, Human
cucuacuggcugucccugagcc

SEQ ID NO: 123960 - RNA, 23 nt, Human
gaugggguuucaucauguuggcc

SEQ ID NO: 123961 - RNA, 27 nt, Human
aaggcugugcguuccugagggccaggu

SEQ ID NO: 123962 - RNA, 23 nt, Human
uuuguucugcccucaucuggccc

SEQ ID NO: 123963 - RNA, 23 nt, Human
ggaggugguggacggacuguaau

SEQ ID NO: 123964 - RNA, 21 nt, Human
uauuacaguuauaauuuugga

SEQ ID NO: 123965 - RNA, 20 nt, Human
ggagaggggaaggcagccgc

SEQ ID NO: 123966 - RNA, 17 nt, Human
gaaccauuccuuucaua

SEQ ID NO: 123967 - RNA, 24 nt, Human
aggaaugcaugagauuucaagaga

SEQ ID NO: 123968 - RNA, 19 nt, Human
gggugaagagaaccgagca

SEQ ID NO: 123969 - RNA, 24 nt, Human
agcuuccuccccuugcuacagccu

SEQ ID NO: 123970 - RNA, 21 nt, Human
gugggccuagaccccuccucc

SEQ ID NO: 123971 - RNA, 27 nt, Human
ccagcacuugcgcaccugggagggagc

SEQ ID NO: 123972 - RNA, 21 nt, Human
cacacuggcaucucccugacc

SEQ ID NO: 123973 - RNA, 26 nt, Human
ugggcacuuuguuuccuuggcccucc

SEQ ID NO: 123974 - RNA, 22 nt, Human
uaaaguauccaugcaugugcau

SEQ ID NO: 123975 - RNA, 23 nt, Human
ccccacugcuggcacugaugucc

SEQ ID NO: 123976 - RNA, 20 nt, Human
ccucaucucugcugccuccu

SEQ ID NO: 123977 - RNA, 22 nt, Human
aggcuggacugcagugacacaa

SEQ ID NO: 123978 - RNA, 23 nt, Human
gggaucugccuccugagcaaaga

SEQ ID NO: 123979 - RNA, 23 nt, Human
ggcaucgucucugggcccuccuu

SEQ ID NO: 123980 - RNA, 21 nt, Human
cuucugcuggccuguuuuauu

SEQ ID NO: 123981 - RNA, 19 nt, Human
gagcuacaaccuggccuuc

SEQ ID NO: 123982 - RNA, 26 nt, Human
ggggugagugcggggcgcgggccgag

SEQ ID NO: 123983 - RNA, 19 nt, Human
cuucugcuucgguucuaca

SEQ ID NO: 123984 - RNA, 20 nt, Human
agccucccucucccaccucu

SEQ ID NO: 123985 - RNA, 23 nt, Human
cccugcucugcccccaacuggcu

SEQ ID NO: 123986 - RNA, 26 nt, Human
ucaguuggaaauuuauaaccaaccaa

SEQ ID NO: 123987 - RNA, 20 nt, Human
aacagcaugcauugaacuga

SEQ ID NO: 123988 - RNA, 18 nt, Human
cugagcuuggagcagcac

SEQ ID NO: 123989 - RNA, 27 nt, Human
ugaggggaaaggguugucucucuccuu

SEQ ID NO: 123990 - RNA, 22 nt, Human
ugccccugcauuccagccuagg

SEQ ID NO: 123991 - RNA, 21 nt, Human
ccuguuccuauucaucuggaa

SEQ ID NO: 123992 - RNA, 24 nt, Human
gaaagagacaagaaauccuagugg

SEQ ID NO: 123993 - RNA, 22 nt, Human
uggaaugaccuuccucauucca

SEQ ID NO: 123994 - RNA, 20 nt, Human
gcugccuggcccccagcugu

SEQ ID NO: 123995 - RNA, 25 nt, Human
gugggaagacuucagcacaaaggaa

SEQ ID NO: 123996 - RNA, 20 nt, Human
gccucuauuuucuuucuuug

SEQ ID NO: 123997 - RNA, 28 nt, Human
cuugggcaaguuccuuucccucuuugga

SEQ ID NO: 123998 - RNA, 25 nt, Human
gcucaggcuggaguacaguggcaua

SEQ ID NO: 123999 - RNA, 22 nt, Human
cuccacagcaauccuaugaggu

SEQ ID NO: 124000 - RNA, 22 nt, Human
acagaguuuauuuuuaacaaau

SEQ ID NO: 124001 - RNA, 21 nt, Human
ccacagaagauggcauggcug

SEQ ID NO: 124002 - RNA, 22 nt, Human
gacccaggcagugucagcagug

SEQ ID NO: 124003 - RNA, 27 nt, Human
cuuuaugauagggaaggcuacuaccua

SEQ ID NO: 124004 - RNA, 18 nt, Human
uguccaggagaaaccuca

SEQ ID NO: 124005 - RNA, 19 nt, Human
agcccucaguuggagggag

SEQ ID NO: 124006 - RNA, 21 nt, Human
ugcagcucaaggaaaggccug

SEQ ID NO: 124007 - RNA, 22 nt, Human
acuagguuuaucucauuuaagc

SEQ ID NO: 124008 - RNA, 21 nt, Human
cugccaccucuccauccugcu

SEQ ID NO: 124009 - RNA, 27 nt, Human
cuaauccuuccaccaaucaaauaagcu

SEQ ID NO: 124010 - RNA, 21 nt, Human
agggugaucagugcuggcaga

SEQ ID NO: 124011 - RNA, 21 nt, Human
aaauguucuguauuuguaucu

SEQ ID NO: 124012 - RNA, 27 nt, Human
aagcacaaaucuuuuucuauauucuca

SEQ ID NO: 124013 - RNA, 22 nt, Human
ucucugccugaaauguuacaca

SEQ ID NO: 124014 - RNA, 20 nt, Human
ccugucuuccuuccuccuca

SEQ ID NO: 124015 - RNA, 29 nt, Human
agagaaaagcuggaccuuuucccuugcug

SEQ ID NO: 124016 - RNA, 21 nt, Human
cccaaggcuucccagagcgaa

SEQ ID NO: 124017 - RNA, 21 nt, Human
ugcccaggcuggagcauagug

SEQ ID NO: 124018 - RNA, 24 nt, Human
uuuuuucuggaccucaguuuccuc

SEQ ID NO: 124019 - RNA, 32 nt, Human
acaagcuuuggcuuuuuccaucucaaaaguau

SEQ ID NO: 124020 - RNA, 21 nt, Human
uguuaaauguuauuauuacca

SEQ ID NO: 124021 - RNA, 17 nt, Human
gcuucccugccugcugc

SEQ ID NO: 124022 - RNA, 25 nt, Human
auggauuugcacccacugcauuugc

SEQ ID NO: 124023 - RNA, 21 nt, Human
uuuuauuugaaaauauuaucg

SEQ ID NO: 124024 - RNA, 26 nt, Human
uuccaauaaaacgguuuacuaccuga

SEQ ID NO: 124025 - RNA, 22 nt, Human
ugguggacaccuguaaucccag

SEQ ID NO: 124026 - RNA, 21 nt, Human
aggagcaggaguugagcuugg

SEQ ID NO: 124027 - RNA, 18 nt, Human
cccugucgcccaggcugg

SEQ ID NO: 124028 - RNA, 22 nt, Human
uauuugggugggagggcuggga

SEQ ID NO: 124029 - RNA, 24 nt, Human
aaguuaugugauuuccuccucugu

SEQ ID NO: 124030 - RNA, 29 nt, Human
gcugcaggcucucuggccuuuggacccga

SEQ ID NO: 124031 - RNA, 24 nt, Human
ucuucauucuauucuuuuucucuc

SEQ ID NO: 124032 - RNA, 27 nt, Human
ugcccugcagauuagauuacuuagcac

SEQ ID NO: 124033 - RNA, 26 nt, Human
ggagcugagaagggaggcuuacguga

SEQ ID NO: 124034 - RNA, 25 nt, Human
gggcugaggguaggaaguagccgcu

SEQ ID NO: 124035 - RNA, 27 nt, Human
agaggauucagacgcucugggagccag

SEQ ID NO: 124036 - RNA, 21 nt, Human
cacgucagggaggguuccuuc

SEQ ID NO: 124037 - RNA, 26 nt, Human
cucugccauauacaaacaggcuguug

SEQ ID NO: 124038 - RNA, 21 nt, Human
acacauuuugcuaggauguca

SEQ ID NO: 124039 - RNA, 23 nt, Human
gguuucaaggaggggaaaaagaa

SEQ ID NO: 124040 - RNA, 21 nt, Human
ccuuucugcccuccugcucca

SEQ ID NO: 124041 - RNA, 23 nt, Human
cauccucagugcccaaugcugug

SEQ ID NO: 124042 - RNA, 22 nt, Human
uuucauguuuauauaagcugua

SEQ ID NO: 124043 - RNA, 26 nt, Human
gcugcaugggacccaugucuccuggg

SEQ ID NO: 124044 - RNA, 27 nt, Human
gccccagguagaaacuuuuaucuauuc

SEQ ID NO: 124045 - RNA, 21 nt, Human
ggaggugaggagcagagcagg

SEQ ID NO: 124046 - RNA, 21 nt, Human
uguccgcuguuuggggagacg

SEQ ID NO: 124047 - RNA, 20 nt, Human
cuguguccccaugcugccuc

SEQ ID NO: 124048 - RNA, 23 nt, Human
cucagccucccaaagugcuaggg

SEQ ID NO: 124049 - RNA, 21 nt, Human
ugcagcugcugugccuguguc

SEQ ID NO: 124050 - RNA, 26 nt, Human
aaaugauuuuccugguaugucuguua

SEQ ID NO: 124051 - RNA, 31 nt, Human
gccuucuauuaaauaguuugcacuuaagccu

SEQ ID NO: 124052 - RNA, 25 nt, Human
gcacacacccccugccuuaucucug

SEQ ID NO: 124053 - RNA, 20 nt, Human
gacugugacaacugucuaac

SEQ ID NO: 124054 - RNA, 21 nt, Human
gucuguuuugacagaaacuga

SEQ ID NO: 124055 - RNA, 23 nt, Human
ggcccccugcccugcccaccuca

SEQ ID NO: 124056 - RNA, 23 nt, Human
acauuuggugcacuuuucugugu

SEQ ID NO: 124057 - RNA, 23 nt, Human
cucuggaucuuaacuacugagcg

SEQ ID NO: 124058 - RNA, 22 nt, Human
aggagcugaaaagauugcagga

SEQ ID NO: 124059 - RNA, 26 nt, Human
uauuuccaggaaaauccggaaccuga

SEQ ID NO: 124060 - RNA, 24 nt, Human
ccgugcugcuguguucugcuccuc

SEQ ID NO: 124061 - RNA, 22 nt, Human
auguugugaggagacuaugaua

SEQ ID NO: 124062 - RNA, 24 nt, Human
cgagaagcccggagguugcgcugg

SEQ ID NO: 124063 - RNA, 28 nt, Human
agauaaaacucugugguuuuaaucuucu

SEQ ID NO: 124064 - RNA, 22 nt, Human
gcucaugucuguaaucccagca

SEQ ID NO: 124065 - RNA, 22 nt, Human
cuucagaugaaaacaaaucaca

SEQ ID NO: 124066 - RNA, 22 nt, Human
cuauggauucacuucuauuuau

SEQ ID NO: 124067 - RNA, 20 nt, Human
ccaaguagcuaggaccaggu

SEQ ID NO: 124068 - RNA, 25 nt, Human
gggaagggaugggacacagcuucug

SEQ ID NO: 124069 - RNA, 22 nt, Human
cccagcuucuccccugggggcc

SEQ ID NO: 124070 - RNA, 23 nt, Human
aacauuguaagagagaugagcac

SEQ ID NO: 124071 - RNA, 27 nt, Human
ggucuuaaacuccuggccucaagcaau

SEQ ID NO: 124072 - RNA, 22 nt, Human
gcugcucuugaauuccugggcu

SEQ ID NO: 124073 - RNA, 22 nt, Human
cccggcugaagugcaguggcac

SEQ ID NO: 124074 - RNA, 28 nt, Human
ggagaguggaaggagggagcuguuugcc

SEQ ID NO: 124075 - RNA, 23 nt, Human
ugcccccauucucccagucucug

SEQ ID NO: 124076 - RNA, 22 nt, Human
gggcgagcacccccaucugcca

SEQ ID NO: 124077 - RNA, 21 nt, Human
ucugcucuccuuccuggagcc

SEQ ID NO: 124078 - RNA, 26 nt, Human
gcugaggcuggcacaggacaugcggu

SEQ ID NO: 124079 - RNA, 24 nt, Human
cagccucucuugggcuuucuuaca

SEQ ID NO: 124080 - RNA, 30 nt, Human
acacagguugauuugcuguaauauaaaacu

SEQ ID NO: 124081 - RNA, 23 nt, Human
gagacaauauuuuuucaaacuuu

SEQ ID NO: 124082 - RNA, 25 nt, Human
gggauuacaggcaugagccaucaca

SEQ ID NO: 124083 - RNA, 23 nt, Human
acccagggugaguugguggagaa

SEQ ID NO: 124084 - RNA, 23 nt, Human
caacggucuccugacuggugcug

SEQ ID NO: 124085 - RNA, 18 nt, Human
agccagacagugaccuca

SEQ ID NO: 124086 - RNA, 26 nt, Human
gucucaacuccugggcucaagcgauc

SEQ ID NO: 124087 - RNA, 26 nt, Human
acagcaucuuggcugucugcuaaaaa

SEQ ID NO: 124088 - RNA, 19 nt, Human
caggccaacuccuggucau

SEQ ID NO: 124089 - RNA, 26 nt, Human
cugcuuguaaaggugcuccucuuuuu

SEQ ID NO: 124090 - RNA, 23 nt, Human
caggccugccgucuccagcacgg

SEQ ID NO: 124091 - RNA, 22 nt, Human
gaaacugcagagacucaggccu

SEQ ID NO: 124092 - RNA, 24 nt, Human
uacuuacugcuaucuacuaaguuu

SEQ ID NO: 124093 - RNA, 20 nt, Human
gguagugccugaucaaugag

SEQ ID NO: 124094 - RNA, 18 nt, Human
aguucauggcuuucugaa

SEQ ID NO: 124095 - RNA, 23 nt, Human
cuuaaugcuuaaaagaaggcuag

SEQ ID NO: 124096 - RNA, 22 nt, Human
gggaggaagaaacgaagacuga

SEQ ID NO: 124097 - RNA, 20 nt, Human
aaaggcagaggguggaggga

SEQ ID NO: 124098 - RNA, 21 nt, Human
cugccucucugggugggugag

SEQ ID NO: 124099 - RNA, 23 nt, Human
gcugacccaggcuggaggacagg

SEQ ID NO: 124100 - RNA, 20 nt, Human
ccaaauguauugauuacaaa

SEQ ID NO: 124101 - RNA, 15 nt, Human
agggaaagggaggau

SEQ ID NO: 124102 - RNA, 21 nt, Human
ugucuagcuugugucuuuuug

SEQ ID NO: 124103 - RNA, 24 nt, Human
gacuaccaaaucacaaugcaauug

SEQ ID NO: 124104 - RNA, 27 nt, Human
ucuccuggguaaauuuugaugucgcau

SEQ ID NO: 124105 - RNA, 18 nt, Human
ucuuucaaaagaaucacg

SEQ ID NO: 124106 - RNA, 22 nt, Human
uuugugagcaggcccggccggg

SEQ ID NO: 124107 - RNA, 21 nt, Human
gcauaugcuuugcaggugcuc

SEQ ID NO: 124108 - RNA, 30 nt, Human
ccucauuccuccuguucucccaguuugcuu

SEQ ID NO: 124109 - RNA, 19 nt, Human
ugcuguuuuauacauagua

SEQ ID NO: 124110 - RNA, 20 nt, Human
uccucaaggagccaguuaaa

SEQ ID NO: 124111 - RNA, 24 nt, Human
caacugaauucucuuucucucuca

SEQ ID NO: 124112 - RNA, 25 nt, Human
guuccuaagcuggagugcuuauccc

SEQ ID NO: 124113 - RNA, 27 nt, Human
gagaaucgcuugagacugggaggcaga

SEQ ID NO: 124114 - RNA, 26 nt, Human
agauggccuauuugaggaagagggug

SEQ ID NO: 124115 - RNA, 24 nt, Human
ggagcucccccugccuccuccucc

SEQ ID NO: 124116 - RNA, 18 nt, Human
cauccagcgccacaaaga

SEQ ID NO: 124117 - RNA, 20 nt, Human
agaugguccuucugugucuu

SEQ ID NO: 124118 - RNA, 27 nt, Human
cauugcacuccagccugggaaacaaga

SEQ ID NO: 124119 - RNA, 27 nt, Human
gcaaugccagggcacagcuggggaaga

SEQ ID NO: 124120 - RNA, 23 nt, Human
uuuucucccauccuuucccuuua

SEQ ID NO: 124121 - RNA, 26 nt, Human
ucucagccccuuuaaaucaccauagg

SEQ ID NO: 124122 - RNA, 22 nt, Human
gcuggguuaauaaauugccuca

SEQ ID NO: 124123 - RNA, 23 nt, Human
gggggaggggcagagcgcggggc

SEQ ID NO: 124124 - RNA, 24 nt, Human
uggccuccugggccuccagguaaa

SEQ ID NO: 124125 - RNA, 21 nt, Human
uauuucauuucaaaggugcua

SEQ ID NO: 124126 - RNA, 26 nt, Human
ccugccugauggggagugucggcugu

SEQ ID NO: 124127 - RNA, 21 nt, Human
agaccagcacggugacucugu

SEQ ID NO: 124128 - RNA, 23 nt, Human
gugguuggucaaaucaacugaau

SEQ ID NO: 124129 - RNA, 20 nt, Human
gccuuacccuccuccuggcc

SEQ ID NO: 124130 - RNA, 26 nt, Human
cgcaucucagcggggcgcacauguua

SEQ ID NO: 124131 - RNA, 22 nt, Human
cuugucauuggaaacacugccu

SEQ ID NO: 124132 - RNA, 21 nt, Human
cagagucuuggacucauggaa

SEQ ID NO: 124133 - RNA, 22 nt, Human
cagccaucuuuaaaauccagga

SEQ ID NO: 124134 - RNA, 22 nt, Human
ccaccucuuauguucaagcaau

SEQ ID NO: 124135 - RNA, 22 nt, Human
augaucucagcucacugcagcc

SEQ ID NO: 124136 - RNA, 27 nt, Human
cagggacauccucugucacuacggugg

SEQ ID NO: 124137 - RNA, 20 nt, Human
uauuacugcuaaguauuucc

SEQ ID NO: 124138 - RNA, 22 nt, Human
ucgcccaggcuggaguacagug

SEQ ID NO: 124139 - RNA, 22 nt, Human
ucgcccagacuggagugcagug

SEQ ID NO: 124140 - RNA, 21 nt, Human
uagcacuuacagcugugugau

SEQ ID NO: 124141 - RNA, 28 nt, Human
ccuggacccucccucuuggugggucugu

SEQ ID NO: 124142 - RNA, 22 nt, Human
cucaaccuccccccugccucgg

SEQ ID NO: 124143 - RNA, 21 nt, Human
ggcucaccgcaaccuccgccu

SEQ ID NO: 124144 - RNA, 23 nt, Human
guugcccaggcuggagggcaaug

SEQ ID NO: 124145 - RNA, 23 nt, Human
guugcccaugcuggagugcaaug

SEQ ID NO: 124146 - RNA, 23 nt, Human
gacaggcugggacagaggcagau

SEQ ID NO: 124147 - RNA, 22 nt, Human
ucuuguuccugagggaggccgg

SEQ ID NO: 124148 - RNA, 22 nt, Human
cagccuggagcauugguaagcg

SEQ ID NO: 124149 - RNA, 24 nt, Human
gcaaagcacauccaauaaaauagc

SEQ ID NO: 124150 - RNA, 23 nt, Human
agcaaacugaggcugaguaggga

SEQ ID NO: 124151 - RNA, 26 nt, Human
aggaacugcuccugacuucagugguu

SEQ ID NO: 124152 - RNA, 23 nt, Human
ugccaggagggaauguucuuucu

SEQ ID NO: 124153 - RNA, 23 nt, Human
agcuaucaaccacuuauaacuga

SEQ ID NO: 124154 - RNA, 23 nt, Human
cgccugggguugcugcuuuugcu

SEQ ID NO: 124155 - RNA, 31 nt, Human
gggagcuggaguccacugggguggccugacu

SEQ ID NO: 124156 - RNA, 26 nt, Human
gucaugagaguggggagacaggcagc

SEQ ID NO: 124157 - RNA, 24 nt, Human
acucuauccuggauaggcacuugg

SEQ ID NO: 124158 - RNA, 20 nt, Human
gaccccaggugggccuggca

SEQ ID NO: 124159 - RNA, 22 nt, Human
ggggaaggacguggcauccaag

SEQ ID NO: 124160 - RNA, 22 nt, Human
acauggucaagaccaggcagaa

SEQ ID NO: 124161 - RNA, 22 nt, Human
cauggccguggugucuuccagu

SEQ ID NO: 124162 - RNA, 23 nt, Human
gcuauuuauuuuucuccuucaca

SEQ ID NO: 124163 - RNA, 21 nt, Human
gaucuuccuauuugagucucu

SEQ ID NO: 124164 - RNA, 22 nt, Human
cuggggcagguccccaagugug

SEQ ID NO: 124165 - RNA, 22 nt, Human
cuucccuuggagagggccuggc

SEQ ID NO: 124166 - RNA, 22 nt, Human
gcaucucgcguggagggcuguc

SEQ ID NO: 124167 - RNA, 25 nt, Human
ucacuggagcagcucucuuaaggag

SEQ ID NO: 124168 - RNA, 22 nt, Human
uuugaauuugugccucuuuguu

SEQ ID NO: 124169 - RNA, 22 nt, Human
ccaaagugcugcgauuacaggc

SEQ ID NO: 124170 - RNA, 27 nt, Human
acucuaguugcccaugucugauugggg

SEQ ID NO: 124171 - RNA, 27 nt, Human
aaguaguggcagcagcccaggccaggc

SEQ ID NO: 124172 - RNA, 20 nt, Human
ucacuuuuuugcucuguaaa

SEQ ID NO: 124173 - RNA, 21 nt, Human
cagcuuauacugcuccaucuu

SEQ ID NO: 124174 - RNA, 22 nt, Human
uaauacuguauaaagaccucaa

SEQ ID NO: 124175 - RNA, 24 nt, Human
cugucacccaggcuugagugcagu

SEQ ID NO: 124176 - RNA, 26 nt, Human
agguuccaggaaaaagccuguuagua

SEQ ID NO: 124177 - RNA, 26 nt, Human
uguagguggggguggggaggcccaaa

SEQ ID NO: 124178 - RNA, 27 nt, Human
gguggggaagaagacacagaagccuuu

SEQ ID NO: 124179 - RNA, 22 nt, Human
ugcugucuccacuucacaauau

SEQ ID NO: 124180 - RNA, 24 nt, Human
agccucucccagcuccacuucuaa

SEQ ID NO: 124181 - RNA, 22 nt, Human
augagacaauuuugcuucacuu

SEQ ID NO: 124182 - RNA, 24 nt, Human
ucuauguauggauauguguguaua

SEQ ID NO: 124183 - RNA, 27 nt, Human
ccaggaggcaggcugcgggguaggaga

SEQ ID NO: 124184 - RNA, 21 nt, Human
cagcuuacagaaugggagaaa

SEQ ID NO: 124185 - RNA, 20 nt, Human
gggaccccucgcaacccugc

SEQ ID NO: 124186 - RNA, 28 nt, Human
ggcguccucucccacaaaaaaguccugc

SEQ ID NO: 124187 - RNA, 23 nt, Human
cucaagagauccuccugccuugg

SEQ ID NO: 124188 - RNA, 27 nt, Human
uaaagugucgaaugacuucuaguguag

SEQ ID NO: 124189 - RNA, 21 nt, Human
cuuucccuuuuugcuuaaccu

SEQ ID NO: 124190 - RNA, 21 nt, Human
guuuugaggcuuuaaaaagaa

SEQ ID NO: 124191 - RNA, 20 nt, Human
uccccaggcuggguguggag

SEQ ID NO: 124192 - RNA, 22 nt, Human
uggucccaggauuccauccuga

SEQ ID NO: 124193 - RNA, 23 nt, Human
aagcuuccuuggcuuuuacugaa

SEQ ID NO: 124194 - RNA, 21 nt, Human
accaggccuucauccuccucc

SEQ ID NO: 124195 - RNA, 22 nt, Human
auuguucuaguaaaacuggaaa

SEQ ID NO: 124196 - RNA, 20 nt, Human
ugugcagguuaugugcugcu

SEQ ID NO: 124197 - RNA, 22 nt, Human
gacggggucucccuguguuacc

SEQ ID NO: 124198 - RNA, 25 nt, Human
ggcuguuuaaucuuugaagcauuuu

SEQ ID NO: 124199 - RNA, 22 nt, Human
ucucuaaaacauuugaaauacu

SEQ ID NO: 124200 - RNA, 24 nt, Human
ggucccuauuccuccuucccuugc

SEQ ID NO: 124201 - RNA, 27 nt, Human
ggucuugaucuccugacuugugauccg

SEQ ID NO: 124202 - RNA, 26 nt, Human
uuguguuguaaguaaacuacagcuuu

SEQ ID NO: 124203 - RNA, 22 nt, Human
ugggagaaggggacauauuugu

SEQ ID NO: 124204 - RNA, 25 nt, Human
uucauuuccauuucacacacccuag

SEQ ID NO: 124205 - RNA, 22 nt, Human
ccugcagcgccucagcaccgcu

SEQ ID NO: 124206 - RNA, 27 nt, Human
uagguguuuguucaucuguaacucuaa

SEQ ID NO: 124207 - RNA, 22 nt, Human
cugcaaccuccgccucccuggu

SEQ ID NO: 124208 - RNA, 27 nt, Human
cucaacaacacaacuucacccaccgcc

SEQ ID NO: 124209 - RNA, 23 nt, Human
cccaccccagcacagcuccuccc

SEQ ID NO: 124210 - RNA, 20 nt, Human
uuaggcugcauaguuuauga

SEQ ID NO: 124211 - RNA, 22 nt, Human
gcacagcugccaggagugcucu

SEQ ID NO: 124212 - RNA, 21 nt, Human
aaaaucucaagaaauucccag

SEQ ID NO: 124213 - RNA, 26 nt, Human
caggugauggagaacacagaugacuc

SEQ ID NO: 124214 - RNA, 19 nt, Human
caaacauaucaucucuuca

SEQ ID NO: 124215 - RNA, 22 nt, Human
ucagaaauuuauaaaauguaaa

SEQ ID NO: 124216 - RNA, 23 nt, Human
ugagagagaagaaaaacuguuug

SEQ ID NO: 124217 - RNA, 23 nt, Human
cgccucaguccgccugcgcuccu

SEQ ID NO: 124218 - RNA, 26 nt, Human
uuccacugccagauuuaugggaugcc

SEQ ID NO: 124219 - RNA, 22 nt, Human
ugacucaccuugcucugccauc

SEQ ID NO: 124220 - RNA, 21 nt, Human
uacguauguuuuccuacuucu

SEQ ID NO: 124221 - RNA, 22 nt, Human
caggccugacucucagcagcua

SEQ ID NO: 124222 - RNA, 28 nt, Human
gcugucucucagaauuguuuucuuaccu

SEQ ID NO: 124223 - RNA, 25 nt, Human
gggcucaacggauccuuccaccuca

SEQ ID NO: 124224 - RNA, 27 nt, Human
ucuucuccucaacaucugaaucaugcc

SEQ ID NO: 124225 - RNA, 27 nt, Human
cuuaccucccuucagccaagccccacc

SEQ ID NO: 124226 - RNA, 19 nt, Human
ggucacuucuguaauagug

SEQ ID NO: 124227 - RNA, 20 nt, Human
gaagaauuaagcugugcaau

SEQ ID NO: 124228 - RNA, 19 nt, Human
ucacagcuuuacucuuuca

SEQ ID NO: 124229 - RNA, 21 nt, Human
aauagaaaugucucaaggcag

SEQ ID NO: 124230 - RNA, 21 nt, Human
uuuucugcucccuuucuccag

SEQ ID NO: 124231 - RNA, 25 nt, Human
cuuucccaugcugaauuauuuuguu

SEQ ID NO: 124232 - RNA, 22 nt, Human
gcagagcugucauagggucccu

SEQ ID NO: 124233 - RNA, 20 nt, Human
ugaagugagcugagauugca

SEQ ID NO: 124234 - RNA, 22 nt, Human
gggagaggagagaaagggcucc

SEQ ID NO: 124235 - RNA, 21 nt, Human
aauaugugccuucuagaauac

SEQ ID NO: 124236 - RNA, 23 nt, Human
uguggcgcucgggcgagugccuu

SEQ ID NO: 124237 - RNA, 19 nt, Human
guuuucucuucaccgccgu

SEQ ID NO: 124238 - RNA, 23 nt, Human
gcucccacucucagugggcugca

SEQ ID NO: 124239 - RNA, 25 nt, Human
uagcacaaauucucucuuaguucca

SEQ ID NO: 124240 - RNA, 22 nt, Human
cacugcauaccagccuagguga

SEQ ID NO: 124241 - RNA, 21 nt, Human
uucaggauuuacagugcagua

SEQ ID NO: 124242 - RNA, 23 nt, Human
ucauuaaaaauaaucagcggcau

SEQ ID NO: 124243 - RNA, 23 nt, Human
ggagccaccuccaccccuuuccg

SEQ ID NO: 124244 - RNA, 24 nt, Human
ggaggcaccggccgcgcggcggga

SEQ ID NO: 124245 - RNA, 22 nt, Human
ugcagagagcuaugaucauccc

SEQ ID NO: 124246 - RNA, 24 nt, Human
ugcacugagagggcaaggaagugg

SEQ ID NO: 124247 - RNA, 21 nt, Human
ggcugagagaguggcauuggc

SEQ ID NO: 124248 - RNA, 25 nt, Human
cugcccaggcagucuuugcucagug

SEQ ID NO: 124249 - RNA, 24 nt, Human
ucuuuccggauucugccucccucc

SEQ ID NO: 124250 - RNA, 20 nt, Human
aaagccacucucacaagaaa

SEQ ID NO: 124251 - RNA, 20 nt, Human
gugaagccuccaacccuaag

SEQ ID NO: 124252 - RNA, 27 nt, Human
cccagaggagcagcagcaacaggcugg

SEQ ID NO: 124253 - RNA, 20 nt, Human
gcuuugaaccugccaaagga

SEQ ID NO: 124254 - RNA, 23 nt, Human
uuagcagcccucuaaagugacua

SEQ ID NO: 124255 - RNA, 22 nt, Human
ccugcugcugcccaacuggcug

SEQ ID NO: 124256 - RNA, 22 nt, Human
cccugguucauguuuucaucaa

SEQ ID NO: 124257 - RNA, 22 nt, Human
auccuggcucugacggcugaag

SEQ ID NO: 124258 - RNA, 22 nt, Human
uuacagagcuugaaaacucacu

SEQ ID NO: 124259 - RNA, 24 nt, Human
ccaucuccagcaagucuccuggcc

SEQ ID NO: 124260 - RNA, 21 nt, Human
uggcaucuacccucccucccu

SEQ ID NO: 124261 - RNA, 21 nt, Human
acgcacaggcuggagugcagu

SEQ ID NO: 124262 - RNA, 25 nt, Human
ggcaagggagagcaggcugcacagc

SEQ ID NO: 124263 - RNA, 21 nt, Human
acccucuccccaucccagccu

SEQ ID NO: 124264 - RNA, 27 nt, Human
guagggaggggagaguaugaggagggu

SEQ ID NO: 124265 - RNA, 22 nt, Human
gguuucugucccucugaggcuc

SEQ ID NO: 124266 - RNA, 21 nt, Human
cgcuugcaucaaacaccccua

SEQ ID NO: 124267 - RNA, 23 nt, Human
gaauggguggagaagaagcagag

SEQ ID NO: 124268 - RNA, 23 nt, Human
ugcugugagccaagaucaugcca

SEQ ID NO: 124269 - RNA, 22 nt, Human
cugccucacucaucccuccugu

SEQ ID NO: 124270 - RNA, 20 nt, Human
uuuuaggacacugcguuaga

SEQ ID NO: 124271 - RNA, 27 nt, Human
gagguggguuugggaggaaagagaggc

SEQ ID NO: 124272 - RNA, 26 nt, Human
uuaguguaauuacaucucagcuuuga

SEQ ID NO: 124273 - RNA, 26 nt, Human
uuccaugcugugcagcacuucugucc

SEQ ID NO: 124274 - RNA, 27 nt, Human
aaguagcugagacuacaggcacacacc

SEQ ID NO: 124275 - RNA, 22 nt, Human
ugauucuuaccuuuucucaguu

SEQ ID NO: 124276 - RNA, 22 nt, Human
ugcauuucuucaguguuucucc

SEQ ID NO: 124277 - RNA, 25 nt, Human
ugcacuauaugaucaguguuacugc

SEQ ID NO: 124278 - RNA, 21 nt, Human
cacccagguguggcugucagg

SEQ ID NO: 124279 - RNA, 21 nt, Human
cuucauagguagaaacaaaua

SEQ ID NO: 124280 - RNA, 21 nt, Human
caucucaucugcuguauuuua

SEQ ID NO: 124281 - RNA, 25 nt, Human
gcccaggcuggagugcaguggcgcc

SEQ ID NO: 124282 - RNA, 21 nt, Human
ccauaaccuccgccucccagg

SEQ ID NO: 124283 - RNA, 22 nt, Human
auccucucccccaugcuuacua

SEQ ID NO: 124284 - RNA, 22 nt, Human
uucuguuugccuuuuguuuuca

SEQ ID NO: 124285 - RNA, 28 nt, Human
acucugauugucacuugcaucuucacaa

SEQ ID NO: 124286 - RNA, 22 nt, Human
gcucacugcaccuccaccuucc

SEQ ID NO: 124287 - RNA, 21 nt, Human
auguuaccugcuccacugcag

SEQ ID NO: 124288 - RNA, 26 nt, Human
cacuguacuccagccuggacaacagc

SEQ ID NO: 124289 - RNA, 20 nt, Human
ccaccugacauaaggguccc

SEQ ID NO: 124290 - RNA, 23 nt, Human
gugaaaacauguaacgucugccu

SEQ ID NO: 124291 - RNA, 26 nt, Human
uuggaagaggcugagacauucuucac

SEQ ID NO: 124292 - RNA, 21 nt, Human
ggcugcagcggaggcacuuug

SEQ ID NO: 124293 - RNA, 27 nt, Human
gccucagcugugggggccucaggcagg

SEQ ID NO: 124294 - RNA, 21 nt, Human
uccucugcuugucauucugcu

SEQ ID NO: 124295 - RNA, 24 nt, Human
ccugccugagccauguucaccugc

SEQ ID NO: 124296 - RNA, 25 nt, Human
uacaggugcccgccaccacgcccag

SEQ ID NO: 124297 - RNA, 23 nt, Human
gaacccaggaggcagaggguugc

SEQ ID NO: 124298 - RNA, 27 nt, Human
cagcucuucuaaggaaauggagaagcu

SEQ ID NO: 124299 - RNA, 27 nt, Human
uucauuucuuacguucuuucacuucaa

SEQ ID NO: 124300 - RNA, 23 nt, Human
agcagcaggcugggugucuuggu

SEQ ID NO: 124301 - RNA, 22 nt, Human
accuguaaucccaacacuuggg

SEQ ID NO: 124302 - RNA, 23 nt, Human
gacuaccguuaccuacuguuguc

SEQ ID NO: 124303 - RNA, 20 nt, Human
aaaguguugccaguuauuca

SEQ ID NO: 124304 - RNA, 26 nt, Human
caccaucuuggccagguuggucuuga

SEQ ID NO: 124305 - RNA, 17 nt, Human
gccaggcuaauuuuugu

SEQ ID NO: 124306 - RNA, 30 nt, Human
gggaguacgcgagagcagggauggggcagc

SEQ ID NO: 124307 - RNA, 29 nt, Human
ucuuccuuucuuuuuccucucuaagccuu

SEQ ID NO: 124308 - RNA, 20 nt, Human
ugagagcaggggggccaggc

SEQ ID NO: 124309 - RNA, 25 nt, Human
augugcgguuggcccccagcgcgcc

SEQ ID NO: 124310 - RNA, 24 nt, Human
gaaugagggguagagccacucugg

SEQ ID NO: 124311 - RNA, 22 nt, Human
gcagugagcuguguaagcaccu

SEQ ID NO: 124312 - RNA, 25 nt, Human
ccaggcaccucccggcucacgggga

SEQ ID NO: 124313 - RNA, 22 nt, Human
ggugagaacaguugacaguggu

SEQ ID NO: 124314 - RNA, 26 nt, Human
gcggacuuauuuaccaagcauuggag

SEQ ID NO: 124315 - RNA, 25 nt, Human
ccaacucccugccauuuuuuaagag

SEQ ID NO: 124316 - RNA, 22 nt, Human
ucugacauuccuggcugucaug

SEQ ID NO: 124317 - RNA, 27 nt, Human
gaccagccuggucaacauugcaaaacc

SEQ ID NO: 124318 - RNA, 19 nt, Human
acacuccuggcuaucucag

SEQ ID NO: 124319 - RNA, 22 nt, Human
gaggcagaaucuugcucuguca

SEQ ID NO: 124320 - RNA, 29 nt, Human
cgggcagagggcacgggcaggcggacguc

SEQ ID NO: 124321 - RNA, 22 nt, Human
auuuccauaguucccugcggcc

SEQ ID NO: 124322 - RNA, 23 nt, Human
cuaaguuucgagagaaaggaggg

SEQ ID NO: 124323 - RNA, 22 nt, Human
cucagcacuuggcaucuuguca

SEQ ID NO: 124324 - RNA, 25 nt, Human
gcccugacaggccuuccuccucuca

SEQ ID NO: 124325 - RNA, 24 nt, Human
ugauuaauguacuuuuuauugcau

SEQ ID NO: 124326 - RNA, 22 nt, Human
acuggugugaucucagcucacu

SEQ ID NO: 124327 - RNA, 25 nt, Human
ucuaccucucccugcuccuggugcc

SEQ ID NO: 124328 - RNA, 23 nt, Human
aaccuauauuucaauacugcuga

SEQ ID NO: 124329 - RNA, 29 nt, Human
gguacuaaacauuuauaauuacuguguaa

SEQ ID NO: 124330 - RNA, 26 nt, Human
cuccaccccuacucuauucuguaguu

SEQ ID NO: 124331 - RNA, 23 nt, Human
gauuaaaauuauguaagcaagga

SEQ ID NO: 124332 - RNA, 22 nt, Human
cacaccuguaaucccaacacuu

SEQ ID NO: 124333 - RNA, 26 nt, Human
cuuuuuguuuuccauugaguguacac

SEQ ID NO: 124334 - RNA, 21 nt, Human
gcccccagcacccagguucuu

SEQ ID NO: 124335 - RNA, 28 nt, Human
cuaaugggagaccaaaucuuuguccggg

SEQ ID NO: 124336 - RNA, 27 nt, Human
ggaggcacaacgcaccagacacucaca

SEQ ID NO: 124337 - RNA, 21 nt, Human
cccaggaggcugagggcaccc

SEQ ID NO: 124338 - RNA, 24 nt, Human
aaaggcggccagguuugcagugcg

SEQ ID NO: 124339 - RNA, 21 nt, Human
gggcaggucccaggagccaca

SEQ ID NO: 124340 - RNA, 21 nt, Human
ucuucuucuuuuccuuuuggc

SEQ ID NO: 124341 - RNA, 18 nt, Human
ugaguguguuugugugca

SEQ ID NO: 124342 - RNA, 20 nt, Human
agggugagggcaaaggcuga

SEQ ID NO: 124343 - RNA, 21 nt, Human
ccaagccccugcccuggggag

SEQ ID NO: 124344 - RNA, 20 nt, Human
gucuccugaguagcuggaac

SEQ ID NO: 124345 - RNA, 20 nt, Human
ucuaucuccccgucacaccc

SEQ ID NO: 124346 - RNA, 21 nt, Human
caggcuggauggguggguggu

SEQ ID NO: 124347 - RNA, 24 nt, Human
caccucuucccugagaagggcggg

SEQ ID NO: 124348 - RNA, 27 nt, Human
uaaccaaaagacaccagccacucagag

SEQ ID NO: 124349 - RNA, 24 nt, Human
uuuuguuguuuuguuauuuacuua

SEQ ID NO: 124350 - RNA, 23 nt, Human
uucaaugcuguuaaauaugccaa

SEQ ID NO: 124351 - RNA, 26 nt, Human
ugugguucuuggaaaagcagaaggaa

SEQ ID NO: 124352 - RNA, 24 nt, Human
guagggaggaccacaggugugagc

SEQ ID NO: 124353 - RNA, 23 nt, Human
ccagcacccacacugggucucca

SEQ ID NO: 124354 - RNA, 26 nt, Human
uuuguugccagaccaauguuugaugg

SEQ ID NO: 124355 - RNA, 27 nt, Human
ccugugccaaaguggccagagauuggg

SEQ ID NO: 124356 - RNA, 22 nt, Human
gccagccacagguacaagccac

SEQ ID NO: 124357 - RNA, 19 nt, Human
auuuucaucuuccauucua

SEQ ID NO: 124358 - RNA, 26 nt, Human
ccaacaacagggucuugagauaaccu

SEQ ID NO: 124359 - RNA, 17 nt, Human
uacugugggucuggacu

SEQ ID NO: 124360 - RNA, 25 nt, Human
gucagccagcucuggaauggucugg

SEQ ID NO: 124361 - RNA, 23 nt, Human
cccagagccuucuuagugugaca

SEQ ID NO: 124362 - RNA, 23 nt, Human
aaacgucuuccuucuuuauugcc

SEQ ID NO: 124363 - RNA, 22 nt, Human
ccggagguagagguugugguga

SEQ ID NO: 124364 - RNA, 22 nt, Human
ccaaagugcugggauuacaggg

SEQ ID NO: 124365 - RNA, 27 nt, Human
caacucauuucuuauaucauauuguua

SEQ ID NO: 124366 - RNA, 25 nt, Human
gcuuggcucccccuccuggcuggcc

SEQ ID NO: 124367 - RNA, 26 nt, Human
cacaguuuuuaaaaauguuuauugua

SEQ ID NO: 124368 - RNA, 19 nt, Human
gggcgcagccaucuugccg

SEQ ID NO: 124369 - RNA, 29 nt, Human
ggaguuggugagagcaggaggagaggugg

SEQ ID NO: 124370 - RNA, 21 nt, Human
cuuacagaugucaaaagcagu

SEQ ID NO: 124371 - RNA, 27 nt, Human
ugaugaagccaccagugcccugacaga

SEQ ID NO: 124372 - RNA, 19 nt, Human
aggccucucugccuguggc

SEQ ID NO: 124373 - RNA, 19 nt, Human
caacacugcaacaugggga

SEQ ID NO: 124374 - RNA, 19 nt, Human
ccacagcucagccuggaug

SEQ ID NO: 124375 - RNA, 24 nt, Human
gucauuucuagagacagcaaucaa

SEQ ID NO: 124376 - RNA, 25 nt, Human
aggugaggcugcugucauuucucca

SEQ ID NO: 124377 - RNA, 19 nt, Human
ggcugcacugccuuuguca

SEQ ID NO: 124378 - RNA, 21 nt, Human
cuuaucucccuucacugacuc

SEQ ID NO: 124379 - RNA, 23 nt, Human
ccuccgucucucuccauuguguu

SEQ ID NO: 124380 - RNA, 24 nt, Human
ccugccauuuccacccuccaguca

SEQ ID NO: 124381 - RNA, 26 nt, Human
ucuucuuccuccugugcugaccucag

SEQ ID NO: 124382 - RNA, 27 nt, Human
acuguacuaauucuuacacugccugua

SEQ ID NO: 124383 - RNA, 22 nt, Human
ggcucacugcagccuccgccuc

SEQ ID NO: 124384 - RNA, 26 nt, Human
uugcaaagucacagaccauugccuca

SEQ ID NO: 124385 - RNA, 23 nt, Human
uuuuccucucuucgcccugacac

SEQ ID NO: 124386 - RNA, 19 nt, Human
agaaauuuacuauguaaau

SEQ ID NO: 124387 - RNA, 22 nt, Human
ggguccucccugggaacagggu

SEQ ID NO: 124388 - RNA, 19 nt, Human
gcccuuuaaccuagaccug

SEQ ID NO: 124389 - RNA, 21 nt, Human
ccacaugucucagaucugcca

SEQ ID NO: 124390 - RNA, 20 nt, Human
ucucccacccucagucgcau

SEQ ID NO: 124391 - RNA, 23 nt, Human
gccuuuuccugaauuggaaagga

SEQ ID NO: 124392 - RNA, 27 nt, Human
cacagccggcgccgcgccaugcuccac

SEQ ID NO: 124393 - RNA, 27 nt, Human
caggcuggagugcaguggugugaucuu

SEQ ID NO: 124394 - RNA, 27 nt, Human
caggcuggagugcaguggcgugaucuc

SEQ ID NO: 124395 - RNA, 27 nt, Human
caggcuggaguacaguggcaugaucuc

SEQ ID NO: 124396 - RNA, 23 nt, Human
ccaggagguggagguugcaguga

SEQ ID NO: 124397 - RNA, 24 nt, Human
gccucugguuuuucagcacuuggg

SEQ ID NO: 124398 - RNA, 27 nt, Human
ccacacgccuguucccagcaagugcug

SEQ ID NO: 124399 - RNA, 21 nt, Human
gcgaugcuccugccucagccu

SEQ ID NO: 124400 - RNA, 27 nt, Human
uguggaggggagcugcuggccauggcu

SEQ ID NO: 124401 - RNA, 22 nt, Human
gauaagcuuuugauuuuuguau

SEQ ID NO: 124402 - RNA, 20 nt, Human
agucugguagcugagcguug

SEQ ID NO: 124403 - RNA, 25 nt, Human
cccacacauccccaguuguugguuu

SEQ ID NO: 124404 - RNA, 22 nt, Human
gcugugugauuucauauacaaa

SEQ ID NO: 124405 - RNA, 27 nt, Human
guaaaauggaaauaucuccaucuugcu

SEQ ID NO: 124406 - RNA, 27 nt, Human
ggguagcgugaggacccacggggcuga

SEQ ID NO: 124407 - RNA, 27 nt, Human
acugcaaccuucaccuccagguucaag

SEQ ID NO: 124408 - RNA, 19 nt, Human
ggcagaagaugacauuuaa

SEQ ID NO: 124409 - RNA, 27 nt, Human
ggccaucugccugaauguaaccugcua

SEQ ID NO: 124410 - RNA, 25 nt, Human
uuguccucaugaacaacucuggagc

SEQ ID NO: 124411 - RNA, 30 nt, Human
uugaccucaugucugccugccucagccucc

SEQ ID NO: 124412 - RNA, 22 nt, Human
agucuggggucugguuggugaa

SEQ ID NO: 124413 - RNA, 22 nt, Human
aacacaaauuuaugggcuuccu

SEQ ID NO: 124414 - RNA, 21 nt, Human
cagagagacagagguucaugg

SEQ ID NO: 124415 - RNA, 25 nt, Human
acacaucaccuuccugaauucuuua

SEQ ID NO: 124416 - RNA, 26 nt, Human
uuggggagcgauguuuugaauuuagu

SEQ ID NO: 124417 - RNA, 19 nt, Human
ccucccuuacccuccucca

SEQ ID NO: 124418 - RNA, 24 nt, Human
uggggacucucuugaccucccugc

SEQ ID NO: 124419 - RNA, 23 nt, Human
gacucucccuacugccugagcaa

SEQ ID NO: 124420 - RNA, 26 nt, Human
gcgcggcggcaagauggcagugcaaa

SEQ ID NO: 124421 - RNA, 22 nt, Human
caugaacauaagugcuuagcug

SEQ ID NO: 124422 - RNA, 21 nt, Human
uguaaguuccugggcaaccuu

SEQ ID NO: 124423 - RNA, 22 nt, Human
cagggcugaggguaaggaaaag

SEQ ID NO: 124424 - RNA, 25 nt, Human
uucccaggccgcaccauuucuguca

SEQ ID NO: 124425 - RNA, 25 nt, Human
aggcagacguggggaggguggaggg

SEQ ID NO: 124426 - RNA, 20 nt, Human
uuuuuacugcugcuuaguuu

SEQ ID NO: 124427 - RNA, 20 nt, Human
agacugggaggcagagguug

SEQ ID NO: 124428 - RNA, 22 nt, Human
cuuuguuguuauuuuuguugcu

SEQ ID NO: 124429 - RNA, 23 nt, Human
gaagacucuuauccaucugugaa

SEQ ID NO: 124430 - RNA, 23 nt, Human
aaccuguuaccuacuuugacuuu

SEQ ID NO: 124431 - RNA, 21 nt, Human
aggcugagacauugcgccugc

SEQ ID NO: 124432 - RNA, 20 nt, Human
ggccuccucagccucugcaa

SEQ ID NO: 124433 - RNA, 18 nt, Human
ucacccaggcuggagugc

SEQ ID NO: 124434 - RNA, 21 nt, Human
cagguuucagcacacaacuua

SEQ ID NO: 124435 - RNA, 18 nt, Human
uguuuguaaagcacuuug

SEQ ID NO: 124436 - RNA, 26 nt, Human
aaccauuucagccaaacuguagauga

SEQ ID NO: 124437 - RNA, 22 nt, Human
uuugcagcccaggcuggagugc

SEQ ID NO: 124438 - RNA, 23 nt, Human
gaccggcagccccagaccugccu

SEQ ID NO: 124439 - RNA, 22 nt, Human
gggaaggugcugaccagugggg

SEQ ID NO: 124440 - RNA, 22 nt, Human
gcccaaccuggagugcaguggu

SEQ ID NO: 124441 - RNA, 22 nt, Human
ugagcaacaugguaaaacccca

SEQ ID NO: 124442 - RNA, 22 nt, Human
uuuucucaaauccuggagagag

SEQ ID NO: 124443 - RNA, 19 nt, Human
ugcugcugccgcugcuuuu

SEQ ID NO: 124444 - RNA, 27 nt, Human
caucacggacuuccugugggacaagcg

SEQ ID NO: 124445 - RNA, 21 nt, Human
uuccaguuuugcuuuucaugg

SEQ ID NO: 124446 - RNA, 24 nt, Human
gacucugccaucuuccucagacgg

SEQ ID NO: 124447 - RNA, 24 nt, Human
aaguuuuagccuagcuguucucaa

SEQ ID NO: 124448 - RNA, 21 nt, Human
aauggcaucucguuguaagua

SEQ ID NO: 124449 - RNA, 23 nt, Human
gcucggcucuccacagggcuagg

SEQ ID NO: 124450 - RNA, 27 nt, Human
aaauguucauaacauuggauagucuag

SEQ ID NO: 124451 - RNA, 25 nt, Human
cagcauucagcacaccccaagggac

SEQ ID NO: 124452 - RNA, 23 nt, Human
gcuagaucccuccuuucauugcu

SEQ ID NO: 124453 - RNA, 22 nt, Human
aggaugaguauguguggcagag

SEQ ID NO: 124454 - RNA, 23 nt, Human
agcaggagaagucuaugggauuc

SEQ ID NO: 124455 - RNA, 25 nt, Human
guccaggcuggagugcaguggcacu

SEQ ID NO: 124456 - RNA, 23 nt, Human
aaaaggagaagacaacagugagc

SEQ ID NO: 124457 - RNA, 22 nt, Human
uuugggaaaagaguucuucaga

SEQ ID NO: 124458 - RNA, 20 nt, Human
ggucauggaauggcaggugu

SEQ ID NO: 124459 - RNA, 23 nt, Human
ggucugggcagccaugaccugca

SEQ ID NO: 124460 - RNA, 27 nt, Human
ucauagaaaauuucaucuguauaagca

SEQ ID NO: 124461 - RNA, 22 nt, Human
ggggugaggauaggacagaggg

SEQ ID NO: 124462 - RNA, 24 nt, Human
uguuuuuuaaaaagaugauugcug

SEQ ID NO: 124463 - RNA, 27 nt, Human
guguuccauuuuaguguaaagaugugu

SEQ ID NO: 124464 - RNA, 20 nt, Human
ucaagaaaauaaauguagcu

SEQ ID NO: 124465 - RNA, 23 nt, Human
cagaaccucucuagcuaaugugu

SEQ ID NO: 124466 - RNA, 24 nt, Human
acacuuuguccuagcaucuuucug

SEQ ID NO: 124467 - RNA, 26 nt, Human
ccagucaucccuccucuguguugcca

SEQ ID NO: 124468 - RNA, 20 nt, Human
ggaggcacuuaauaaaggga

SEQ ID NO: 124469 - RNA, 22 nt, Human
gcagaugggcuaaauaaaagcc

SEQ ID NO: 124470 - RNA, 22 nt, Human
gcccuacugccuucucaaagca

SEQ ID NO: 124471 - RNA, 21 nt, Human
ugcaacaaaauacauucuuuu

SEQ ID NO: 124472 - RNA, 26 nt, Human
uucuacugcuucccucaguaucugaa

SEQ ID NO: 124473 - RNA, 20 nt, Human
cugagucugccauaauucug

SEQ ID NO: 124474 - RNA, 22 nt, Human
uaucaugccugaauucccccgc

SEQ ID NO: 124475 - RNA, 23 nt, Human
caucaggucugcagagcugcagg

SEQ ID NO: 124476 - RNA, 26 nt, Human
aguccaccccugccugccuuguuuga

SEQ ID NO: 124477 - RNA, 22 nt, Human
cuccggccguucucacugcggc

SEQ ID NO: 124478 - RNA, 24 nt, Human
ucagugaagauuaaaugaaugaau

SEQ ID NO: 124479 - RNA, 22 nt, Human
uggaucuuuuaugauucuuuuu

SEQ ID NO: 124480 - RNA, 23 nt, Human
ccagaauggccccacucuguucc

SEQ ID NO: 124481 - RNA, 19 nt, Human
gcuuuugcuauucuuuuug

SEQ ID NO: 124482 - RNA, 22 nt, Human
auuuggcuguuggauuuuaagc

SEQ ID NO: 124483 - RNA, 28 nt, Human
ccgugcugcugggccauccccaacuccc

SEQ ID NO: 124484 - RNA, 27 nt, Human
cucuccaggacugccaggcugcuggag

SEQ ID NO: 124485 - RNA, 25 nt, Human
ccuguucccaguucccugggccucu

SEQ ID NO: 124486 - RNA, 24 nt, Human
ccagaagcagcagcuagaaagaga

SEQ ID NO: 124487 - RNA, 31 nt, Human
auucauguggcaggccccuguccuaggcccu

SEQ ID NO: 124488 - RNA, 23 nt, Human
aggaauauagaaugaaagacuga

SEQ ID NO: 124489 - RNA, 21 nt, Human
ugucugugaguaccuggucau

SEQ ID NO: 124490 - RNA, 26 nt, Human
gucaugggguuucaccgccuuccuca

SEQ ID NO: 124491 - RNA, 24 nt, Human
caugcacacacagacuccuacucc

SEQ ID NO: 124492 - RNA, 21 nt, Human
uagguucuaaaaugaagaugu

SEQ ID NO: 124493 - RNA, 22 nt, Human
caaacuccugggcucaagcgaa

SEQ ID NO: 124494 - RNA, 26 nt, Human
ucuccaggacccagagcuguuccugc

SEQ ID NO: 124495 - RNA, 24 nt, Human
cuuacugguuuuauucccugcuau

SEQ ID NO: 124496 - RNA, 25 nt, Human
ccgcggagugugcugggcuuggggg

SEQ ID NO: 124497 - RNA, 21 nt, Human
agcuagcagauuuacuccuuu

SEQ ID NO: 124498 - RNA, 21 nt, Human
gagcacgucgcuccgcaccgc

SEQ ID NO: 124499 - RNA, 21 nt, Human
aguggccaaucauagcuuacu

SEQ ID NO: 124500 - RNA, 22 nt, Human
aucccauucuuuauaauccucu

SEQ ID NO: 124501 - RNA, 20 nt, Human
aacaggagagaggaaugaaa

SEQ ID NO: 124502 - RNA, 22 nt, Human
ucagaccacagagguggcaaga

SEQ ID NO: 124503 - RNA, 21 nt, Human
ggagacuccaucacagccagg

SEQ ID NO: 124504 - RNA, 24 nt, Human
ggccggcgcugcaggcagcggcgg

SEQ ID NO: 124505 - RNA, 20 nt, Human
auuuaaaauauuuugcugcu

SEQ ID NO: 124506 - RNA, 18 nt, Human
ucuuugacagcaugcugu

SEQ ID NO: 124507 - RNA, 20 nt, Human
accccuggguggguggcaca

SEQ ID NO: 124508 - RNA, 22 nt, Human
ugagauuacaggcaugagccac

SEQ ID NO: 124509 - RNA, 19 nt, Human
ggcuaaaagggaaaaagga

SEQ ID NO: 124510 - RNA, 24 nt, Human
ggagagggacgcacagcacugccu

SEQ ID NO: 124511 - RNA, 25 nt, Human
cccgcacucugcgccucuccucgcc

SEQ ID NO: 124512 - RNA, 23 nt, Human
cacucauucaacacauacauuca

SEQ ID NO: 124513 - RNA, 24 nt, Human
gcucccaggaacaacugauggccu

SEQ ID NO: 124514 - RNA, 27 nt, Human
gaaaugagagugccauguauuucuuuc

SEQ ID NO: 124515 - RNA, 22 nt, Human
guugcccaggcuggugugcaau

SEQ ID NO: 124516 - RNA, 26 nt, Human
ucucucccucuccugcauugauuuuu

SEQ ID NO: 124517 - RNA, 23 nt, Human
cauuccccugccuugccccugag

SEQ ID NO: 124518 - RNA, 27 nt, Human
gcccccagccugugccuugcugccaca

SEQ ID NO: 124519 - RNA, 25 nt, Human
agcaucuaucgcugcccucccaccc

SEQ ID NO: 124520 - RNA, 26 nt, Human
guggggacagagaugggugauggaac

SEQ ID NO: 124521 - RNA, 22 nt, Human
cacccaggcuggaguacagugg

SEQ ID NO: 124522 - RNA, 21 nt, Human
caggcaggcgggucacaggga

SEQ ID NO: 124523 - RNA, 23 nt, Human
ggagaggggaacgugggaauagc

SEQ ID NO: 124524 - RNA, 26 nt, Human
aagucacaaccccugacugcuccuca

SEQ ID NO: 124525 - RNA, 24 nt, Human
guguaugguucaggaaugcugaau

SEQ ID NO: 124526 - RNA, 30 nt, Human
aggacagcugcagagguggcagugugugga

SEQ ID NO: 124527 - RNA, 27 nt, Human
uggccaacauggugaaaccccgucacu

SEQ ID NO: 124528 - RNA, 27 nt, Human
acuguuaugaauuuuucaucuacuucu

SEQ ID NO: 124529 - RNA, 27 nt, Human
agacaugcugaaauuauuucucucaca

SEQ ID NO: 124530 - RNA, 25 nt, Human
uccacuucaaauuccuuaaaauaua

SEQ ID NO: 124531 - RNA, 21 nt, Human
aggaagagaaggagcagagca

SEQ ID NO: 124532 - RNA, 30 nt, Human
cccuagggacaugagacaccacauuccauu

SEQ ID NO: 124533 - RNA, 27 nt, Human
cuccagccgccaugcuccuggcccacu

SEQ ID NO: 124534 - RNA, 21 nt, Human
gaggccaaggcaggaggauca

SEQ ID NO: 124535 - RNA, 23 nt, Human
ggggaagaggagccaaugacagg

SEQ ID NO: 124536 - RNA, 19 nt, Human
uggagcuggcuuugcucag

SEQ ID NO: 124537 - RNA, 31 nt, Human
accuuucccaugcugaauuauuuuguuguga

SEQ ID NO: 124538 - RNA, 23 nt, Human
uugaugaacccaucaugcugguu

SEQ ID NO: 124539 - RNA, 23 nt, Human
ggcagauagaaacugggacggau

SEQ ID NO: 124540 - RNA, 25 nt, Human
ucugucauuguuaaauacacauuau

SEQ ID NO: 124541 - RNA, 18 nt, Human
auaaaauguagcagcauc

SEQ ID NO: 124542 - RNA, 25 nt, Human
cccuuucucuucugacugguauacc

SEQ ID NO: 124543 - RNA, 21 nt, Human
gauauuuucuuaguagugcag

SEQ ID NO: 124544 - RNA, 26 nt, Human
cugugucgccuaggcuggagugcagu

SEQ ID NO: 124545 - RNA, 15 nt, Human
gggugggugggugga

SEQ ID NO: 124546 - RNA, 25 nt, Human
ggggaacugccucagugagaacggg

SEQ ID NO: 124547 - RNA, 19 nt, Human
ccuaguuuucuccucccag

SEQ ID NO: 124548 - RNA, 20 nt, Human
ccaaaaauguucccccaaau

SEQ ID NO: 124549 - RNA, 24 nt, Human
uacccaggcucuugagcaacagug

SEQ ID NO: 124550 - RNA, 22 nt, Human
ucuuggcuucuuuucucccuug

SEQ ID NO: 124551 - RNA, 19 nt, Human
gaggcccccauugugcaca

SEQ ID NO: 124552 - RNA, 22 nt, Human
aaugccagcuauagauuugggg

SEQ ID NO: 124553 - RNA, 31 nt, Human
gggagguggaggaggguugcagcucccaccu

SEQ ID NO: 124554 - RNA, 21 nt, Human
gguagccuuucgaauuuuaug

SEQ ID NO: 124555 - RNA, 27 nt, Human
ucucucaucuuuuucaagucuuuucca

SEQ ID NO: 124556 - RNA, 24 nt, Human
ugucacccagacuggagugcagug

SEQ ID NO: 124557 - RNA, 21 nt, Human
ucaugaaguucaacaaaauga

SEQ ID NO: 124558 - RNA, 20 nt, Human
ccuggugacgcuccucccag

SEQ ID NO: 124559 - RNA, 21 nt, Human
aaggucaggaguucaagacca

SEQ ID NO: 124560 - RNA, 23 nt, Human
gaaagagagcucugagcagguga

SEQ ID NO: 124561 - RNA, 22 nt, Human
agugugagugacacuugcuggg

SEQ ID NO: 124562 - RNA, 25 nt, Human
auggguauaguucaugucugcuauc

SEQ ID NO: 124563 - RNA, 20 nt, Human
gaaaaugcaauguaucugca

SEQ ID NO: 124564 - RNA, 27 nt, Human
caguauauuaaauauugauagaaaaau

SEQ ID NO: 124565 - RNA, 25 nt, Human
uacaggcgccugccaccacgcccag

SEQ ID NO: 124566 - RNA, 19 nt, Human
caguggacaucugcuuuau

SEQ ID NO: 124567 - RNA, 28 nt, Human
uccagcaagaaagaaaagauuguuaugc

SEQ ID NO: 124568 - RNA, 22 nt, Human
caggcugaagugcaguggugug

SEQ ID NO: 124569 - RNA, 26 nt, Human
aaagggagugccuaucuauauuuagc

SEQ ID NO: 124570 - RNA, 22 nt, Human
acugcagucagaugccaucuca

SEQ ID NO: 124571 - RNA, 20 nt, Human
ccagauuccaagugcugcua

SEQ ID NO: 124572 - RNA, 26 nt, Human
ggaggcuggggccacacugcgggaca

SEQ ID NO: 124573 - RNA, 25 nt, Human
ucccucuaccaccgggcacugagac

SEQ ID NO: 124574 - RNA, 21 nt, Human
augaagccucccggggugggg

SEQ ID NO: 124575 - RNA, 26 nt, Human
gugacugauucccagccuguggcagg

SEQ ID NO: 124576 - RNA, 25 nt, Human
uucccaggauuuauuuuacuuugca

SEQ ID NO: 124577 - RNA, 21 nt, Human
gucaaacagacuauccauucc

SEQ ID NO: 124578 - RNA, 23 nt, Human
ccgcccgccaccaccacucucac

SEQ ID NO: 124579 - RNA, 22 nt, Human
uagcgggacucagugagcuggg

SEQ ID NO: 124580 - RNA, 21 nt, Human
cacuucucuguaaucucagcu

SEQ ID NO: 124581 - RNA, 22 nt, Human
ggucucccaaagugcugggauu

SEQ ID NO: 124582 - RNA, 21 nt, Human
gaggcugagaccaggacagca

SEQ ID NO: 124583 - RNA, 25 nt, Human
cuucugcuggguccuaaguccucuc

SEQ ID NO: 124584 - RNA, 26 nt, Human
guguaauuuucguuguuuguuuuugu

SEQ ID NO: 124585 - RNA, 21 nt, Human
ugcugguuuuuaacuugggga

SEQ ID NO: 124586 - RNA, 22 nt, Human
guugggagagggggagggaggg

SEQ ID NO: 124587 - RNA, 22 nt, Human
caggacuucgaggcugcaauga

SEQ ID NO: 124588 - RNA, 21 nt, Human
aauauguauacauauuacaca

SEQ ID NO: 124589 - RNA, 21 nt, Human
aaacauacuaauccucuuuca

SEQ ID NO: 124590 - RNA, 30 nt, Human
gccacugugccuggccaacauaauguuuuc

SEQ ID NO: 124591 - RNA, 22 nt, Human
caccugucgccagguuacuuga

SEQ ID NO: 124592 - RNA, 24 nt, Human
aacacccugcuggccucuugugga

SEQ ID NO: 124593 - RNA, 20 nt, Human
acagaagccauccugaaaug

SEQ ID NO: 124594 - RNA, 20 nt, Human
cuaauacuggugaaaauuua

SEQ ID NO: 124595 - RNA, 26 nt, Human
cuggaaggcugaggcacacuucacca

SEQ ID NO: 124596 - RNA, 17 nt, Human
uaaucagaaaauauuca

SEQ ID NO: 124597 - RNA, 22 nt, Human
ccaguccugaguuugcuacuua

SEQ ID NO: 124598 - RNA, 22 nt, Human
uuuccauguauuuugacugggg

SEQ ID NO: 124599 - RNA, 25 nt, Human
gccguacugagagcccaggucguug

SEQ ID NO: 124600 - RNA, 21 nt, Human
ccaggcaggagagggggaaga

SEQ ID NO: 124601 - RNA, 25 nt, Human
acagauggguagauguggcaggcau

SEQ ID NO: 124602 - RNA, 27 nt, Human
agccaaaagauuggacaugccugcugu

SEQ ID NO: 124603 - RNA, 22 nt, Human
ucuguuuuuauauuucuguuaa

SEQ ID NO: 124604 - RNA, 22 nt, Human
cugggaacccagggaaguuuuu

SEQ ID NO: 124605 - RNA, 24 nt, Human
ucuugauaggacuuccuuaagcau

SEQ ID NO: 124606 - RNA, 22 nt, Human
guuuucuccuuuucuuuaaaga

SEQ ID NO: 124607 - RNA, 20 nt, Human
cacccaggcuggacugcaau

SEQ ID NO: 124608 - RNA, 23 nt, Human
gcagggcacgugcucacagcccu

SEQ ID NO: 124609 - RNA, 24 nt, Human
uacuggcaauacuccagccuggug

SEQ ID NO: 124610 - RNA, 20 nt, Human
guauuacaaaacagaaaaau

SEQ ID NO: 124611 - RNA, 22 nt, Human
gucaaugaaauauuugcuuauu

SEQ ID NO: 124612 - RNA, 28 nt, Human
accccauaagcccugagacucccgccuu

SEQ ID NO: 124613 - RNA, 20 nt, Human
auuccauuuauaauaccauc

SEQ ID NO: 124614 - RNA, 23 nt, Human
uuugcagggcggccagugcagug

SEQ ID NO: 124615 - RNA, 23 nt, Human
aggacagcggcaucacgguugca

SEQ ID NO: 124616 - RNA, 30 nt, Human
ugccgcuuugggcaaguugcuuaccugucu

SEQ ID NO: 124617 - RNA, 26 nt, Human
uuugugccuuuucuuuacuuugcuua

SEQ ID NO: 124618 - RNA, 22 nt, Human
uguauggcuuuguuuucagucu

SEQ ID NO: 124619 - RNA, 21 nt, Human
uuucucucuuucuucaguuca

SEQ ID NO: 124620 - RNA, 22 nt, Human
acugggguaaggggaugaauca

SEQ ID NO: 124621 - RNA, 16 nt, Human
cagaagcauugcuuga

SEQ ID NO: 124622 - RNA, 21 nt, Human
ggggagggugacuucucucca

SEQ ID NO: 124623 - RNA, 27 nt, Human
gccucagcguccugggcucaaaugauc

SEQ ID NO: 124624 - RNA, 21 nt, Human
gaugcaagcuguggggaggac

SEQ ID NO: 124625 - RNA, 22 nt, Human
gcagcccagggggcaggagaag

SEQ ID NO: 124626 - RNA, 27 nt, Human
cuguucccagccucccacagcagagcu

SEQ ID NO: 124627 - RNA, 20 nt, Human
gugguauuuugcauugcaag

SEQ ID NO: 124628 - RNA, 23 nt, Human
ccauggucggcgcccacagcccg

SEQ ID NO: 124629 - RNA, 22 nt, Human
ccaagccccucccccuaaggca

SEQ ID NO: 124630 - RNA, 21 nt, Human
cuccaguuuccaaguuccugc

SEQ ID NO: 124631 - RNA, 25 nt, Human
uugagugagaaauucagaagacuga

SEQ ID NO: 124632 - RNA, 22 nt, Human
ugagaauucuuuacagcaaaga

SEQ ID NO: 124633 - RNA, 20 nt, Human
gguaaagguuuuggcugguc

SEQ ID NO: 124634 - RNA, 24 nt, Human
ccauggccccaaagcaccagauga

SEQ ID NO: 124635 - RNA, 26 nt, Human
ugccucuuagugggagaaucagagag

SEQ ID NO: 124636 - RNA, 26 nt, Human
cuaccucccccuccaucucuagauaa

SEQ ID NO: 124637 - RNA, 23 nt, Human
aggccgggccaugggcacaugga

SEQ ID NO: 124638 - RNA, 24 nt, Human
uucugcagguacuuccucagucug

SEQ ID NO: 124639 - RNA, 21 nt, Human
uucucucuucacugcauccca

SEQ ID NO: 124640 - RNA, 25 nt, Human
gcaagauauugaucaaauauagaaa

SEQ ID NO: 124641 - RNA, 27 nt, Human
gggccugauuuaucuagcuguccagcc

SEQ ID NO: 124642 - RNA, 26 nt, Human
cggggaggggagccggacgggaggau

SEQ ID NO: 124643 - RNA, 19 nt, Human
ugcuucaguccacuucugc

SEQ ID NO: 124644 - RNA, 24 nt, Human
agugcucacggcucacugcaguuu

SEQ ID NO: 124645 - RNA, 22 nt, Human
gauggggaaugcauuucuucag

SEQ ID NO: 124646 - RNA, 23 nt, Human
gccacuuaccuuccccugaguca

SEQ ID NO: 124647 - RNA, 20 nt, Human
cacaucccaagugcaggccg

SEQ ID NO: 124648 - RNA, 20 nt, Human
uccagucuuccgacaaacua

SEQ ID NO: 124649 - RNA, 17 nt, Human
aggagggaaggagcagu

SEQ ID NO: 124650 - RNA, 23 nt, Human
ggggcagucuggaggggcauggc

SEQ ID NO: 124651 - RNA, 17 nt, Human
uuuuccacugugucucu

SEQ ID NO: 124652 - RNA, 22 nt, Human
cccaaaguggugggauuacagg

SEQ ID NO: 124653 - RNA, 27 nt, Human
ucucugagagagaugaucgugccuaua

SEQ ID NO: 124654 - RNA, 21 nt, Human
ugagguggggauggggagagc

SEQ ID NO: 124655 - RNA, 25 nt, Human
agcguaaaccucuuugccuuucucu

SEQ ID NO: 124656 - RNA, 24 nt, Human
uccaguucuauggaaugaauggag

SEQ ID NO: 124657 - RNA, 17 nt, Human
aggagguguugcaguga

SEQ ID NO: 124658 - RNA, 20 nt, Human
ugccuagacaucacauagcu

SEQ ID NO: 124659 - RNA, 24 nt, Human
guaaagugcuuugaggaucucccc

SEQ ID NO: 124660 - RNA, 21 nt, Human
uuugaccuucuccucgaccag

SEQ ID NO: 124661 - RNA, 20 nt, Human
auggguaacgccagcuuugg

SEQ ID NO: 124662 - RNA, 23 nt, Human
gucucgaacuccugaccuuguga

SEQ ID NO: 124663 - RNA, 23 nt, Human
guuucgaacuccugaccucguga

SEQ ID NO: 124664 - RNA, 23 nt, Human
gucucaaacuccuaaccuuguga

SEQ ID NO: 124665 - RNA, 23 nt, Human
uaagccugcaaccucuugaccuu

SEQ ID NO: 124666 - RNA, 27 nt, Human
uguggguggagaagggaggguggccag

SEQ ID NO: 124667 - RNA, 24 nt, Human
ugaagaggagaacaaaauguagca

SEQ ID NO: 124668 - RNA, 21 nt, Human
ugacccuggaugucagaguug

SEQ ID NO: 124669 - RNA, 22 nt, Human
cugccucugggagguuacuguc

SEQ ID NO: 124670 - RNA, 20 nt, Human
acaggcuggaugggugggug

SEQ ID NO: 124671 - RNA, 24 nt, Human
uggacccaagcucagcucagcguc

SEQ ID NO: 124672 - RNA, 21 nt, Human
ccuaaauggaaccagucccuu

SEQ ID NO: 124673 - RNA, 27 nt, Human
gggagcacguuggcuccgcccccuggc

SEQ ID NO: 124674 - RNA, 23 nt, Human
gcagggcuguaguuggugacugg

SEQ ID NO: 124675 - RNA, 19 nt, Human
agguugugcucagcugucg

SEQ ID NO: 124676 - RNA, 25 nt, Human
aaucuauugacugaauuaucuuuug

SEQ ID NO: 124677 - RNA, 23 nt, Human
agacuucauagaauacucaggga

SEQ ID NO: 124678 - RNA, 27 nt, Human
uccuccaggagucucuggugcagcugg

SEQ ID NO: 124679 - RNA, 27 nt, Human
cugggccacuggcaucucuggagugug

SEQ ID NO: 124680 - RNA, 27 nt, Human
aacuucugugcuguuccugugaaucuc

SEQ ID NO: 124681 - RNA, 23 nt, Human
gcaaagugccuugcucauuugaa

SEQ ID NO: 124682 - RNA, 20 nt, Human
cccugcuccuagcacccugg

SEQ ID NO: 124683 - RNA, 17 nt, Human
guuguagaaauggacca

SEQ ID NO: 124684 - RNA, 19 nt, Human
caguugucaucaaacauaa

SEQ ID NO: 124685 - RNA, 20 nt, Human
uggcuucaggacauggguuc

SEQ ID NO: 124686 - RNA, 21 nt, Human
aucaugggggauuuccuagca

SEQ ID NO: 124687 - RNA, 17 nt, Human
uagguccacacacaggu

SEQ ID NO: 124688 - RNA, 26 nt, Human
cagcacuuuaccucucugaaagcccc

SEQ ID NO: 124689 - RNA, 26 nt, Human
acugggcgugguggcucaugccugug

SEQ ID NO: 124690 - RNA, 26 nt, Human
agaaaugguggcaccuccagacaccc

SEQ ID NO: 124691 - RNA, 21 nt, Human
guugcccaggcuggugucaaa

SEQ ID NO: 124692 - RNA, 26 nt, Human
ucucugagacagacagggaucaggag

SEQ ID NO: 124693 - RNA, 29 nt, Human
cauauuccaucaccuuccuccucugcucu

SEQ ID NO: 124694 - RNA, 27 nt, Human
gggguucccuggcccaaggguccagcc

SEQ ID NO: 124695 - RNA, 23 nt, Human
uuugggaggccgagaugggugaa

SEQ ID NO: 124696 - RNA, 19 nt, Human
uuggacccaggguccuaca

SEQ ID NO: 124697 - RNA, 26 nt, Human
ccauuuuucacaagaggaaaccaucc

SEQ ID NO: 124698 - RNA, 25 nt, Human
ugagucugaaucucccaaagagaga

SEQ ID NO: 124699 - RNA, 17 nt, Human
cgggugaggccagcugg

SEQ ID NO: 124700 - RNA, 26 nt, Human
ucuccaccuuauaguuuaugaauguc

SEQ ID NO: 124701 - RNA, 24 nt, Human
ccgcuuccaccaccaugguguuug

SEQ ID NO: 124702 - RNA, 22 nt, Human
uugagacaaacguuuccuacau

SEQ ID NO: 124703 - RNA, 22 nt, Human
gcugccucuuugcugcuuuguu

SEQ ID NO: 124704 - RNA, 24 nt, Human
gaccacacucuaguuguuuuccau

SEQ ID NO: 124705 - RNA, 27 nt, Human
cucgaagcucauaaauucaacgugagg

SEQ ID NO: 124706 - RNA, 28 nt, Human
acuaguaaacuccaccuuuugccuguag

SEQ ID NO: 124707 - RNA, 25 nt, Human
ucugcuccucugccuguccucuccc

SEQ ID NO: 124708 - RNA, 23 nt, Human
ggcgcugauguaagcacuuuagg

SEQ ID NO: 124709 - RNA, 21 nt, Human
ggacuccugaaacugacugag

SEQ ID NO: 124710 - RNA, 26 nt, Human
ccccuggaugaugcugugcaguucaa

SEQ ID NO: 124711 - RNA, 26 nt, Human
acagaagucacacuugaacaaaaccc

SEQ ID NO: 124712 - RNA, 21 nt, Human
cagcauugcaaaaucuguaaa

SEQ ID NO: 124713 - RNA, 26 nt, Human
gagucuggcaccagccgcagccgggg

SEQ ID NO: 124714 - RNA, 23 nt, Human
cacccagggguggggaauguuug

SEQ ID NO: 124715 - RNA, 21 nt, Human
agcauagugcuccuggaccag

SEQ ID NO: 124716 - RNA, 26 nt, Human
acugaacacugagaucugcugcguca

SEQ ID NO: 124717 - RNA, 21 nt, Human
cacugccaccugggccuuugg

SEQ ID NO: 124718 - RNA, 22 nt, Human
ugcaggggggaggauucuuuuu

SEQ ID NO: 124719 - RNA, 22 nt, Human
gccagcaccaagagauuauuua

SEQ ID NO: 124720 - RNA, 22 nt, Human
uagcucaaaaugucagugguaa

SEQ ID NO: 124721 - RNA, 21 nt, Human
cauuguauacaacauagcccc

SEQ ID NO: 124722 - RNA, 21 nt, Human
cucuguaaguugcuuccuaac

SEQ ID NO: 124723 - RNA, 24 nt, Human
ccucucuuccucugggacuuuugc

SEQ ID NO: 124724 - RNA, 20 nt, Human
guauauguuauuuaccuuca

SEQ ID NO: 124725 - RNA, 22 nt, Human
uuuuuugcuuucuugucuuuuc

SEQ ID NO: 124726 - RNA, 21 nt, Human
caguuuucagcaugacacugu

SEQ ID NO: 124727 - RNA, 25 nt, Human
uucacacaccauauggauucuauuu

SEQ ID NO: 124728 - RNA, 26 nt, Human
uugagauggagucucacucugucacc

SEQ ID NO: 124729 - RNA, 26 nt, Human
uugagacagagucuugcucugucacc

SEQ ID NO: 124730 - RNA, 26 nt, Human
uugagacagagucucacucuguugcc

SEQ ID NO: 124731 - RNA, 21 nt, Human
cauacuccaaaagacugcuac

SEQ ID NO: 124732 - RNA, 24 nt, Human
ucuauuugucaggugcacaagauu

SEQ ID NO: 124733 - RNA, 21 nt, Human
ccacauggugaaacccugucu

SEQ ID NO: 124734 - RNA, 20 nt, Human
agaggguggacaguucaggc

SEQ ID NO: 124735 - RNA, 21 nt, Human
gucuuuuuugaucauucccuu

SEQ ID NO: 124736 - RNA, 21 nt, Human
cgcccgcauugccgcucccag

SEQ ID NO: 124737 - RNA, 23 nt, Human
cccugccccuaacuccugccuau

SEQ ID NO: 124738 - RNA, 27 nt, Human
ucaucaccucugucuaguuacaggacg

SEQ ID NO: 124739 - RNA, 22 nt, Human
cuacaguuuugaauacuacuga

SEQ ID NO: 124740 - RNA, 22 nt, Human
uaaguauuugaugaucaacuga

SEQ ID NO: 124741 - RNA, 26 nt, Human
gcuuuucuuagauguuuucuugcugu

SEQ ID NO: 124742 - RNA, 21 nt, Human
aggcugagccacucagcaucu

SEQ ID NO: 124743 - RNA, 24 nt, Human
gccccagguauucgcaaucugacc

SEQ ID NO: 124744 - RNA, 23 nt, Human
cauguugccagccauguugccca

SEQ ID NO: 124745 - RNA, 22 nt, Human
uuugccacugcuguauuuuuau

SEQ ID NO: 124746 - RNA, 24 nt, Human
agcucaggcuggagcaggcauaug

SEQ ID NO: 124747 - RNA, 20 nt, Human
ucacccaggaggaguggggu

SEQ ID NO: 124748 - RNA, 21 nt, Human
cgaccuacuagcacuguucug

SEQ ID NO: 124749 - RNA, 22 nt, Human
gugacuacuaaggaaaccuauu

SEQ ID NO: 124750 - RNA, 20 nt, Human
gacuucagaaaaucgaagca

SEQ ID NO: 124751 - RNA, 21 nt, Human
gccaggcaugcucacuggcgc

SEQ ID NO: 124752 - RNA, 27 nt, Human
caggcugggaugagcugugugcuugcg

SEQ ID NO: 124753 - RNA, 19 nt, Human
gggacgacuucacacucac

SEQ ID NO: 124754 - RNA, 23 nt, Human
caauugucaccauauggccaauu

SEQ ID NO: 124755 - RNA, 24 nt, Human
aacaacaaaaaugccaaguugucc

SEQ ID NO: 124756 - RNA, 27 nt, Human
ucucccacacucucccagagcucacug

SEQ ID NO: 124757 - RNA, 22 nt, Human
ggcuaauuuuuguguuuuaagu

SEQ ID NO: 124758 - RNA, 19 nt, Human
cugccugccuguuugcugu

SEQ ID NO: 124759 - RNA, 26 nt, Human
augccuuuuguagccaaaaccaggcg

SEQ ID NO: 124760 - RNA, 22 nt, Human
uguucauuuuauugcaguauua

SEQ ID NO: 124761 - RNA, 21 nt, Human
gcagaaaauucugugccuugu

SEQ ID NO: 124762 - RNA, 23 nt, Human
ccugcaugcuguuccuuuucuuu

SEQ ID NO: 124763 - RNA, 22 nt, Human
agggauuguggcaugcaccugu

SEQ ID NO: 124764 - RNA, 22 nt, Human
aggcuccaugcaccccccaccu

SEQ ID NO: 124765 - RNA, 22 nt, Human
ccacaucuucugaggcuuuaga

SEQ ID NO: 124766 - RNA, 23 nt, Human
acaggaccggguggaagggaugg

SEQ ID NO: 124767 - RNA, 25 nt, Human
cccccugcugccccugccacauccc

SEQ ID NO: 124768 - RNA, 24 nt, Human
ucucccauauguaugcuguaugcu

SEQ ID NO: 124769 - RNA, 22 nt, Human
uccuccccacaacugugcucag

SEQ ID NO: 124770 - RNA, 26 nt, Human
cugcacguuucuuucucucuugauuc

SEQ ID NO: 124771 - RNA, 24 nt, Human
ucccugauccccaggcuuggggca

SEQ ID NO: 124772 - RNA, 23 nt, Human
ucgccuaccugugccugcgugua

SEQ ID NO: 124773 - RNA, 25 nt, Human
cggcgcccgggcucccuagcccugu

SEQ ID NO: 124774 - RNA, 24 nt, Human
gggcagcagggagucuugaaguga

SEQ ID NO: 124775 - RNA, 21 nt, Human
ggugccucuuccacucuggag

SEQ ID NO: 124776 - RNA, 21 nt, Human
aucaugagagugcuggucaga

SEQ ID NO: 124777 - RNA, 20 nt, Human
uacagauauuuuauuaucau

SEQ ID NO: 124778 - RNA, 25 nt, Human
gcugauccaaaauaaaaacccagac

SEQ ID NO: 124779 - RNA, 21 nt, Human
gaggcugggagagguugggug

SEQ ID NO: 124780 - RNA, 21 nt, Human
ccuuugcccccucccacgacc

SEQ ID NO: 124781 - RNA, 23 nt, Human
cuugcuuccuaucugccucuuuc

SEQ ID NO: 124782 - RNA, 21 nt, Human
cugucucuuccugccugugua

SEQ ID NO: 124783 - RNA, 27 nt, Human
ucuagggucugugcaaggccugucaca

SEQ ID NO: 124784 - RNA, 21 nt, Human
ucaacuguccaucaggugagg

SEQ ID NO: 124785 - RNA, 23 nt, Human
aacuguacuaaauccuuuuucca

SEQ ID NO: 124786 - RNA, 18 nt, Human
cgcccgggauccagcuca

SEQ ID NO: 124787 - RNA, 20 nt, Human
cgugagccgcugcgcccacc

SEQ ID NO: 124788 - RNA, 22 nt, Human
gcacugccacuuguccccccac

SEQ ID NO: 124789 - RNA, 29 nt, Human
acugcuccuccuggccugccuaguucccc

SEQ ID NO: 124790 - RNA, 24 nt, Human
accagcucuccagccuggcaggaa

SEQ ID NO: 124791 - RNA, 19 nt, Human
uccauauaguacuacuuuu

SEQ ID NO: 124792 - RNA, 22 nt, Human
uguuucugauuguuuucauccu

SEQ ID NO: 124793 - RNA, 22 nt, Human
ggggugggguggcgagaugggc

SEQ ID NO: 124794 - RNA, 25 nt, Human
aggaguggcaggaaagagggagcag

SEQ ID NO: 124795 - RNA, 24 nt, Human
aaaaagaguaguuauuaguucugc

SEQ ID NO: 124796 - RNA, 19 nt, Human
gcucuucugugagaauaug

SEQ ID NO: 124797 - RNA, 24 nt, Human
ucuuagcagacugcagucaaucca

SEQ ID NO: 124798 - RNA, 25 nt, Human
cagggaggaaggcagcuagaaaugg

SEQ ID NO: 124799 - RNA, 23 nt, Human
cugccauguccucugaagaagga

SEQ ID NO: 124800 - RNA, 24 nt, Human
aucuuuguuuccccaccucaggcc

SEQ ID NO: 124801 - RNA, 21 nt, Human
cugaggaccaggcuugguugu

SEQ ID NO: 124802 - RNA, 22 nt, Human
acaggaaugaagagagaaagca

SEQ ID NO: 124803 - RNA, 20 nt, Human
ugugcuccuucucagcucac

SEQ ID NO: 124804 - RNA, 23 nt, Human
ccugcacagccagaacugccuuu

SEQ ID NO: 124805 - RNA, 21 nt, Human
acuugcauucccacugccuuu

SEQ ID NO: 124806 - RNA, 23 nt, Human
cagggcuggcccgccagguggcc

SEQ ID NO: 124807 - RNA, 23 nt, Human
gggagagaagcuggacugcagcu

SEQ ID NO: 124808 - RNA, 20 nt, Human
uuuuguguccugccaggcac

SEQ ID NO: 124809 - RNA, 22 nt, Human
agcaggaaucugaucagagguu

SEQ ID NO: 124810 - RNA, 21 nt, Human
agugaggaccuuagggcauga

SEQ ID NO: 124811 - RNA, 21 nt, Human
gauucuucuguagaaguauga

SEQ ID NO: 124812 - RNA, 27 nt, Human
ccaggagggagagugcagccaggcuca

SEQ ID NO: 124813 - RNA, 22 nt, Human
aucguuugaacucaggaggcag

SEQ ID NO: 124814 - RNA, 21 nt, Human
cacuguuuggccuuucuuggg

SEQ ID NO: 124815 - RNA, 21 nt, Human
agucuuuagcuauuacuggau

SEQ ID NO: 124816 - RNA, 19 nt, Human
agguacuguacaaccauua

SEQ ID NO: 124817 - RNA, 21 nt, Human
gguucugccuguggcuauuug

SEQ ID NO: 124818 - RNA, 22 nt, Human
ggaaagacugcuguaauaacac

SEQ ID NO: 124819 - RNA, 26 nt, Human
ccucaaggggcccagccacgucaaac

SEQ ID NO: 124820 - RNA, 22 nt, Human
cugauugcugagugucaucuca

SEQ ID NO: 124821 - RNA, 21 nt, Human
uacagugcuggguaguguugg

SEQ ID NO: 124822 - RNA, 22 nt, Human
guacauacagagguaacuauca

SEQ ID NO: 124823 - RNA, 18 nt, Human
gcuacaggugagcauuuu

SEQ ID NO: 124824 - RNA, 29 nt, Human
uucacuuucucucaugcuaccuuuugugg

SEQ ID NO: 124825 - RNA, 25 nt, Human
ugggcacagagggucagguccuguc

SEQ ID NO: 124826 - RNA, 27 nt, Human
gcuccccgccggucagucacuuagucg

SEQ ID NO: 124827 - RNA, 20 nt, Human
ccuguggaauuaugccuuca

SEQ ID NO: 124828 - RNA, 19 nt, Human
ccuucuccccgccuuggcc

SEQ ID NO: 124829 - RNA, 20 nt, Human
ccccucggucggccggugcg

SEQ ID NO: 124830 - RNA, 27 nt, Human
gggucuccacagccugaagaaugaaga

SEQ ID NO: 124831 - RNA, 27 nt, Human
uuugccucauaccccaccaaccccugc

SEQ ID NO: 124832 - RNA, 27 nt, Human
cauuguacuccagcuugggcaacagag

SEQ ID NO: 124833 - RNA, 20 nt, Human
acauaacauacacacaauau

SEQ ID NO: 124834 - RNA, 26 nt, Human
uugggagcuugggaauggauccugga

SEQ ID NO: 124835 - RNA, 19 nt, Human
augccuaaauauauuguua

SEQ ID NO: 124836 - RNA, 21 nt, Human
ucaucuaggcuaggugcagug

SEQ ID NO: 124837 - RNA, 22 nt, Human
uuccuggucuaguuuccugggc

SEQ ID NO: 124838 - RNA, 18 nt, Human
gcuuuguccaugaugucc

SEQ ID NO: 124839 - RNA, 27 nt, Human
cagcccagcggcccucuuuccugucug

SEQ ID NO: 124840 - RNA, 25 nt, Human
uguugcugcugggcaacaguguugg

SEQ ID NO: 124841 - RNA, 22 nt, Human
gcuccuguggccccacccuggg

SEQ ID NO: 124842 - RNA, 25 nt, Human
cuuauucuagcacagugccuugccu

SEQ ID NO: 124843 - RNA, 22 nt, Human
gcauuugccuaacagacuuuug

SEQ ID NO: 124844 - RNA, 15 nt, Human
cuucccuucuggugu

SEQ ID NO: 124845 - RNA, 24 nt, Human
agaauauaacauuuuaugucacua

SEQ ID NO: 124846 - RNA, 23 nt, Human
uucugucucugaugcucuucuuc

SEQ ID NO: 124847 - RNA, 23 nt, Human
ccgcuuaaacauuucccugcuga

SEQ ID NO: 124848 - RNA, 22 nt, Human
agggaucugggugggcauuuuu

SEQ ID NO: 124849 - RNA, 27 nt, Human
ccaggaggcagcucucugcagccgaag

SEQ ID NO: 124850 - RNA, 27 nt, Human
gcccuuguucuguguguaguuacuuga

SEQ ID NO: 124851 - RNA, 22 nt, Human
ucaucaguuuucugcuuaacuc

SEQ ID NO: 124852 - RNA, 20 nt, Human
aacaccaguggagacuugca

SEQ ID NO: 124853 - RNA, 25 nt, Human
gggaagaacaggacuccaggacugu

SEQ ID NO: 124854 - RNA, 26 nt, Human
ugagguagauuucauugaagcucucu

SEQ ID NO: 124855 - RNA, 23 nt, Human
agcauuuucacauuuugccuuuc

SEQ ID NO: 124856 - RNA, 22 nt, Human
augggauuagaaaaaugaaagc

SEQ ID NO: 124857 - RNA, 22 nt, Human
ugccaaaauaccacuaguggaa

SEQ ID NO: 124858 - RNA, 20 nt, Human
auggcucugucuucuugugu

SEQ ID NO: 124859 - RNA, 25 nt, Human
uuugucacccaggcuggagugcagu

SEQ ID NO: 124860 - RNA, 20 nt, Human
ccccaagaguggggcauggg

SEQ ID NO: 124861 - RNA, 20 nt, Human
acuuucauugccagugucuu

SEQ ID NO: 124862 - RNA, 23 nt, Human
ugacaguguuuuaggugccugga

SEQ ID NO: 124863 - RNA, 22 nt, Human
uccauccacacaguuuccaccc

SEQ ID NO: 124864 - RNA, 18 nt, Human
augcccaggaguuaaaug

SEQ ID NO: 124865 - RNA, 23 nt, Human
ggcccugcaaugucaagggaggg

SEQ ID NO: 124866 - RNA, 26 nt, Human
uccagccugggcaacguaguaaaacc

SEQ ID NO: 124867 - RNA, 25 nt, Human
cagccucccuuugaugauuauugga

SEQ ID NO: 124868 - RNA, 26 nt, Human
uagcccaggcccuggggaaucaggug

SEQ ID NO: 124869 - RNA, 20 nt, Human
aaacacaacauuuuaauaca

SEQ ID NO: 124870 - RNA, 21 nt, Human
ggggaugaagcgcuucuucua

SEQ ID NO: 124871 - RNA, 19 nt, Human
gccagcaggcuggugggga

SEQ ID NO: 124872 - RNA, 19 nt, Human
cccagcacgguggugccca

SEQ ID NO: 124873 - RNA, 22 nt, Human
agaggaaggacaacucuuuaca

SEQ ID NO: 124874 - RNA, 26 nt, Human
cacaugacagacaaguaacccccuca

SEQ ID NO: 124875 - RNA, 25 nt, Human
ccuaguucuuucccugcuuaaugaa

SEQ ID NO: 124876 - RNA, 25 nt, Human
acgcgcugcagccuccagcccgcgg

SEQ ID NO: 124877 - RNA, 22 nt, Human
agaagcagcauccuccacuugu

SEQ ID NO: 124878 - RNA, 22 nt, Human
cagccucuuggugcucugggua

SEQ ID NO: 124879 - RNA, 23 nt, Human
gccggccauggucauggaagugg

SEQ ID NO: 124880 - RNA, 22 nt, Human
acaacuuagcucaggugccuua

SEQ ID NO: 124881 - RNA, 24 nt, Human
uccagaccccccagccccuccucc

SEQ ID NO: 124882 - RNA, 19 nt, Human
ucucuagcuuagguaucug

SEQ ID NO: 124883 - RNA, 26 nt, Human
uaaaugaugcauaguauuuuagucua

SEQ ID NO: 124884 - RNA, 21 nt, Human
cagcuggcagagagcccagug

SEQ ID NO: 124885 - RNA, 25 nt, Human
ccugggucuucccucucccugccuc

SEQ ID NO: 124886 - RNA, 20 nt, Human
ucacagacuuuugcuacaaa

SEQ ID NO: 124887 - RNA, 24 nt, Human
cggccccucccgcccuuugcucca

SEQ ID NO: 124888 - RNA, 24 nt, Human
aaagagcugggaucccacagcccu

SEQ ID NO: 124889 - RNA, 22 nt, Human
gggaagagagagccaccuagca

SEQ ID NO: 124890 - RNA, 21 nt, Human
gccugcggacaggcccccagg

SEQ ID NO: 124891 - RNA, 23 nt, Human
gacgcuucuggggagugagggaa

SEQ ID NO: 124892 - RNA, 24 nt, Human
cugucacccaggcuggagugcaau

SEQ ID NO: 124893 - RNA, 24 nt, Human
cugucacccaggcuagagugcagu

SEQ ID NO: 124894 - RNA, 24 nt, Human
cugucucccaggcuggagugcuau

SEQ ID NO: 124895 - RNA, 22 nt, Human
cagccacugccuucugcugcca

SEQ ID NO: 124896 - RNA, 27 nt, Human
cccuuuccucaucuguagacacacuug

SEQ ID NO: 124897 - RNA, 19 nt, Human
ucacuccagcaucucccca

SEQ ID NO: 124898 - RNA, 22 nt, Human
ccuucaucugcacugggcccug

SEQ ID NO: 124899 - RNA, 23 nt, Human
ugugguaugggagaaaagguuau

SEQ ID NO: 124900 - RNA, 20 nt, Human
caucccaagucacagcugcc

SEQ ID NO: 124901 - RNA, 19 nt, Human
cugcuugcccugccaaugc

SEQ ID NO: 124902 - RNA, 27 nt, Human
ggagaggggaagucuuggcagggaaau

SEQ ID NO: 124903 - RNA, 26 nt, Human
cgcgcuucguauuucagaaggcgcug

SEQ ID NO: 124904 - RNA, 21 nt, Human
caucuaucagucuuacuccaa

SEQ ID NO: 124905 - RNA, 22 nt, Human
caccugccuuuccuucucccau

SEQ ID NO: 124906 - RNA, 26 nt, Human
ucugucacccagucuggagugcagug

SEQ ID NO: 124907 - RNA, 23 nt, Human
ucuggccagaggugugguauaga

SEQ ID NO: 124908 - RNA, 21 nt, Human
gaagagggacagggacugggg

SEQ ID NO: 124909 - RNA, 21 nt, Human
aaaacagagcugucuucagca

SEQ ID NO: 124910 - RNA, 22 nt, Human
gaagaagaccuguuggacugga

SEQ ID NO: 124911 - RNA, 21 nt, Human
cccagccucuccuccuugggc

SEQ ID NO: 124912 - RNA, 21 nt, Human
cucagguuccaaauucaguaa

SEQ ID NO: 124913 - RNA, 18 nt, Human
guugcguggaugagggag

SEQ ID NO: 124914 - RNA, 24 nt, Human
agcaauggaagcuggagugugacu

SEQ ID NO: 124915 - RNA, 27 nt, Human
acccucuauucucuugugucuguaagu

SEQ ID NO: 124916 - RNA, 22 nt, Human
caaacucagaucucaucagggu

SEQ ID NO: 124917 - RNA, 22 nt, Human
acaucucaguauauuucuguug

SEQ ID NO: 124918 - RNA, 20 nt, Human
acguuuguguuucuagaauc

SEQ ID NO: 124919 - RNA, 22 nt, Human
uaccacacuaucuucuguauca

SEQ ID NO: 124920 - RNA, 27 nt, Human
cucccagaucgcucccuuggcuuugag

SEQ ID NO: 124921 - RNA, 23 nt, Human
ucacaugccuuuucccugccaca

SEQ ID NO: 124922 - RNA, 22 nt, Human
cuaagaguucagaaauguccca

SEQ ID NO: 124923 - RNA, 21 nt, Human
accccuucacagacacgagca

SEQ ID NO: 124924 - RNA, 20 nt, Human
cgguucaaaaccuugcacag

SEQ ID NO: 124925 - RNA, 25 nt, Human
uuaaauacaucuuaauuaauuuuuu

SEQ ID NO: 124926 - RNA, 19 nt, Human
caggccugggaugcaguga

SEQ ID NO: 124927 - RNA, 21 nt, Human
gcucuguguucacuacacuca

SEQ ID NO: 124928 - RNA, 24 nt, Human
gcuuguaaucccagcuacuuggga

SEQ ID NO: 124929 - RNA, 26 nt, Human
cacgugccugugggccugggauaaug

SEQ ID NO: 124930 - RNA, 21 nt, Human
aacuauacaaugucuguuuau

SEQ ID NO: 124931 - RNA, 25 nt, Human
auagaagaagaaagaauaaagcuua

SEQ ID NO: 124932 - RNA, 26 nt, Human
gaacugaaagcacuagagcagccuug

SEQ ID NO: 124933 - RNA, 23 nt, Human
gaucucaggcucuaggugcaaug

SEQ ID NO: 124934 - RNA, 23 nt, Human
uaugcauguaucuacugcauccu

SEQ ID NO: 124935 - RNA, 23 nt, Human
gucaaagcugaaauggacuuuug

SEQ ID NO: 124936 - RNA, 20 nt, Human
caggcuggagguuaauggca

SEQ ID NO: 124937 - RNA, 22 nt, Human
ccagcgcuggcccugccuccgc

SEQ ID NO: 124938 - RNA, 26 nt, Human
cccaccaccaaaacugcuccuccucc

SEQ ID NO: 124939 - RNA, 20 nt, Human
gugaacaaacccccacuccg

SEQ ID NO: 124940 - RNA, 27 nt, Human
cuugcuugccgagccuaaugaaaggga

SEQ ID NO: 124941 - RNA, 23 nt, Human
gcauugcagaugauaucaggaug

SEQ ID NO: 124942 - RNA, 19 nt, Human
cuccuucagcagcuacuga

SEQ ID NO: 124943 - RNA, 28 nt, Human
ugaagagguaaaauuugcacugcaaguc

SEQ ID NO: 124944 - RNA, 22 nt, Human
uuauuauauacauacugcaucu

SEQ ID NO: 124945 - RNA, 26 nt, Human
acagaguuuugucuuuucuaauccuu

SEQ ID NO: 124946 - RNA, 22 nt, Human
ccugcagagucaggguggcuuu

SEQ ID NO: 124947 - RNA, 21 nt, Human
agcucuucucuuccuagaucu

SEQ ID NO: 124948 - RNA, 22 nt, Human
augaccucccgagacuugccau

SEQ ID NO: 124949 - RNA, 23 nt, Human
uggcugagaaaugcacaagaugc

SEQ ID NO: 124950 - RNA, 21 nt, Human
gcccacacgugcucucugcug

SEQ ID NO: 124951 - RNA, 26 nt, Human
caaagguggagguugcaguaagcuga

SEQ ID NO: 124952 - RNA, 20 nt, Human
gggcuacacagcagcuguuc

SEQ ID NO: 124953 - RNA, 19 nt, Human
agggaucuccugcgcccuu

SEQ ID NO: 124954 - RNA, 25 nt, Human
ucucuggcgguggccaccaguccuu

SEQ ID NO: 124955 - RNA, 24 nt, Human
acagggcagggcagccaccaggag

SEQ ID NO: 124956 - RNA, 20 nt, Human
aagaagaguuuuuauuacaa

SEQ ID NO: 124957 - RNA, 25 nt, Human
gccacucuucaaguuagauuggcug

SEQ ID NO: 124958 - RNA, 22 nt, Human
cagccuugaaaaacaagucuuu

SEQ ID NO: 124959 - RNA, 22 nt, Human
cccaccagccuugcucucuuca

SEQ ID NO: 124960 - RNA, 19 nt, Human
cugcccugccugccugccc

SEQ ID NO: 124961 - RNA, 27 nt, Human
augugaagccuggagcuuuccugauga

SEQ ID NO: 124962 - RNA, 27 nt, Human
ucugcugucuaacccugugccuugccu

SEQ ID NO: 124963 - RNA, 22 nt, Human
gugguccuaggacaggaggagc

SEQ ID NO: 124964 - RNA, 22 nt, Human
uugaggacuacaguucaucuca

SEQ ID NO: 124965 - RNA, 21 nt, Human
ggaguauuuuaagucuacaaa

SEQ ID NO: 124966 - RNA, 24 nt, Human
agcucuuuaccucuugcuauuuug

SEQ ID NO: 124967 - RNA, 27 nt, Human
gccucaaccuccugggcucaagccauc

SEQ ID NO: 124968 - RNA, 27 nt, Human
gccucaaacuucugggcuuaagcaauc

SEQ ID NO: 124969 - RNA, 27 nt, Human
gccucaaacuccugggcucaagcaauc

SEQ ID NO: 124970 - RNA, 25 nt, Human
agaggcuuugagaagccagugggcc

SEQ ID NO: 124971 - RNA, 24 nt, Human
uuucuuuuccauacacugugugcu

SEQ ID NO: 124972 - RNA, 26 nt, Human
uguaaaccaggauaagaaguugauga

SEQ ID NO: 124973 - RNA, 25 nt, Human
ccaggcgcugccccagcaccuucuc

SEQ ID NO: 124974 - RNA, 26 nt, Human
uggaaagagaaccaugaaaacaaugc

SEQ ID NO: 124975 - RNA, 22 nt, Human
cugcacgccugccugccagggc

SEQ ID NO: 124976 - RNA, 23 nt, Human
ucgcaggacguggaaccugggag

SEQ ID NO: 124977 - RNA, 17 nt, Human
uccucuggagaucaggu

SEQ ID NO: 124978 - RNA, 19 nt, Human
ucaauaaggcagugcagug

SEQ ID NO: 124979 - RNA, 17 nt, Human
acaacaacauguaccug

SEQ ID NO: 124980 - RNA, 19 nt, Human
gcgccuggcccugagcugu

SEQ ID NO: 124981 - RNA, 21 nt, Human
auauuuuuauauuucaccucc

SEQ ID NO: 124982 - RNA, 18 nt, Human
uccaggcccgucugucca

SEQ ID NO: 124983 - RNA, 20 nt, Human
agccugaggcaaaaacugcu

SEQ ID NO: 124984 - RNA, 22 nt, Human
aggcugaggcagaagaauugcu

SEQ ID NO: 124985 - RNA, 22 nt, Human
cucccaggcuggaggucagugg

SEQ ID NO: 124986 - RNA, 22 nt, Human
ugagguugugcuuucucaggga

SEQ ID NO: 124987 - RNA, 21 nt, Human
agcauuuuauaaaugauauca

SEQ ID NO: 124988 - RNA, 32 nt, Human
agcagcaaauuuucagcauuaagcuguuccug

SEQ ID NO: 124989 - RNA, 21 nt, Human
uugaaaacuuucuuucuaaua

SEQ ID NO: 124990 - RNA, 22 nt, Human
cuuccuggcccugugcuggggg

SEQ ID NO: 124991 - RNA, 23 nt, Human
uugugccucuggcugcuguaugu

SEQ ID NO: 124992 - RNA, 22 nt, Human
cuggugaaucuuuuauuacaaa

SEQ ID NO: 124993 - RNA, 21 nt, Human
cgcauugcuguugaaugguga

SEQ ID NO: 124994 - RNA, 25 nt, Human
ucuccaugcccucuccuucuguguc

SEQ ID NO: 124995 - RNA, 24 nt, Human
ugagugaggggacaaggggcaggu

SEQ ID NO: 124996 - RNA, 29 nt, Human
gauugcaauuugcaaccuccgcugccguc

SEQ ID NO: 124997 - RNA, 25 nt, Human
gacuuuauauuuuguauuaugucaa

SEQ ID NO: 124998 - RNA, 22 nt, Human
gggccuggagcuucccacuaaa

SEQ ID NO: 124999 - RNA, 21 nt, Human
acuaaagcaugagcuacuuuc

SEQ ID NO: 125000 - RNA, 24 nt, Human
accauccaggaaaacuugugcugg

SEQ ID NO: 125001 - RNA, 27 nt, Human
gcagcagucgcccaagcagacagcccu

SEQ ID NO: 125002 - RNA, 27 nt, Human
uuuagaagaaaagcaacaugugagacc

SEQ ID NO: 125003 - RNA, 26 nt, Human
ccggacgccccuccccuaucuugccg

SEQ ID NO: 125004 - RNA, 26 nt, Human
ccuggcauuuggccucuuguagucuu

SEQ ID NO: 125005 - RNA, 23 nt, Human
ccaggagguuguggcugcaguga

SEQ ID NO: 125006 - RNA, 19 nt, Human
caucuugaguauagcaaua

SEQ ID NO: 125007 - RNA, 21 nt, Human
cucccaggcuggaggucagug

SEQ ID NO: 125008 - RNA, 26 nt, Human
gucccaucuggucaugugguuggcac

SEQ ID NO: 125009 - RNA, 17 nt, Human
accauaaaauugucaua

SEQ ID NO: 125010 - RNA, 23 nt, Human
cucagcuuuccuuaaggauauca

SEQ ID NO: 125011 - RNA, 21 nt, Human
acauccaagaacucaccaaga

SEQ ID NO: 125012 - RNA, 22 nt, Human
acuagccuggccagcaugguga

SEQ ID NO: 125013 - RNA, 24 nt, Human
gucucuauuugaacaaauuccugg

SEQ ID NO: 125014 - RNA, 20 nt, Human
aagacacuuugcuccucauc

SEQ ID NO: 125015 - RNA, 23 nt, Human
cucccugagccgccuccccacca

SEQ ID NO: 125016 - RNA, 23 nt, Human
uuuuggugaaccugcuauuucgg

SEQ ID NO: 125017 - RNA, 28 nt, Human
cccuccccagauccccuuggagccucug

SEQ ID NO: 125018 - RNA, 17 nt, Human
ucuuuucugcugggcca

SEQ ID NO: 125019 - RNA, 21 nt, Human
uguccucugcugccaucugcc

SEQ ID NO: 125020 - RNA, 30 nt, Human
ccaguacaccaguuguuccucccccaccuc

SEQ ID NO: 125021 - RNA, 22 nt, Human
gacccaggcuuuguggggcagg

SEQ ID NO: 125022 - RNA, 21 nt, Human
uuccugggccccuccuugcca

SEQ ID NO: 125023 - RNA, 24 nt, Human
agugaaacauugaacucauaucug

SEQ ID NO: 125024 - RNA, 25 nt, Human
ggcuuaaagcauccuccuccuggac

SEQ ID NO: 125025 - RNA, 21 nt, Human
gcccuugcccagccuggggga

SEQ ID NO: 125026 - RNA, 20 nt, Human
ccugcaggccaggccagcuu

SEQ ID NO: 125027 - RNA, 27 nt, Human
gggagugagacagaaguaagugggguu

SEQ ID NO: 125028 - RNA, 23 nt, Human
uuucucaaaggcccucagugaga

SEQ ID NO: 125029 - RNA, 26 nt, Human
ugggaaaugacagggaaaaugacagg

SEQ ID NO: 125030 - RNA, 27 nt, Human
gucacccaggcuggaguacaauagcgu

SEQ ID NO: 125031 - RNA, 27 nt, Human
aucauuaaccaaaauuucacacucaua

SEQ ID NO: 125032 - RNA, 26 nt, Human
acugguuugucagugucccccaucga

SEQ ID NO: 125033 - RNA, 28 nt, Human
uguuuuugugggaaugacacuuuaucug

SEQ ID NO: 125034 - RNA, 26 nt, Human
cugcugcccucuacuuugcagauauu

SEQ ID NO: 125035 - RNA, 27 nt, Human
gccacugccucuuccucccucauucca

SEQ ID NO: 125036 - RNA, 18 nt, Human
ccuucggacagacauaua

SEQ ID NO: 125037 - RNA, 24 nt, Human
cggcagcgaagguagaggaugugu

SEQ ID NO: 125038 - RNA, 24 nt, Human
gcuggguggccacaacugggaugc

SEQ ID NO: 125039 - RNA, 26 nt, Human
cgcucaggcuggaggccagccagcuc

SEQ ID NO: 125040 - RNA, 22 nt, Human
agguaauuuuuguauuuuuagu

SEQ ID NO: 125041 - RNA, 27 nt, Human
cucccacagggcccagccccucucccc

SEQ ID NO: 125042 - RNA, 21 nt, Human
cggcggaauguggcagaugaa

SEQ ID NO: 125043 - RNA, 22 nt, Human
guauuggcauaaucagugacuu

SEQ ID NO: 125044 - RNA, 25 nt, Human
accaggcccaggagaucaguaauua

SEQ ID NO: 125045 - RNA, 22 nt, Human
ccagaaaggaaaaaagguuaug

SEQ ID NO: 125046 - RNA, 27 nt, Human
caaagagacauuuacaugguuuggcuu

SEQ ID NO: 125047 - RNA, 24 nt, Human
cuucaucuuauaaagugaaaucau

SEQ ID NO: 125048 - RNA, 26 nt, Human
ugcccagggccuggagcccaagcccu

SEQ ID NO: 125049 - RNA, 21 nt, Human
gcugggugcugggaagggagg

SEQ ID NO: 125050 - RNA, 24 nt, Human
ugucaccgaggcuggagugcagug

SEQ ID NO: 125051 - RNA, 27 nt, Human
uacuaaauuaugguaguuauucugccu

SEQ ID NO: 125052 - RNA, 22 nt, Human
gcccuuagccuuuggagcuaga

SEQ ID NO: 125053 - RNA, 20 nt, Human
ccagaagcaggugaagagca

SEQ ID NO: 125054 - RNA, 21 nt, Human
cccugacagcaucacgcugca

SEQ ID NO: 125055 - RNA, 27 nt, Human
uucuacaaauuucacauuuccauggca

SEQ ID NO: 125056 - RNA, 22 nt, Human
aaagugcuuggauuacaggugu

SEQ ID NO: 125057 - RNA, 24 nt, Human
ucauucuguugccuaggcuugucu

SEQ ID NO: 125058 - RNA, 26 nt, Human
ggccucugcuccugcuccugccugca

SEQ ID NO: 125059 - RNA, 30 nt, Human
agggcccucugaggcucagcccugagcugg

SEQ ID NO: 125060 - RNA, 21 nt, Human
guucagucacagcccucagcu

SEQ ID NO: 125061 - RNA, 26 nt, Human
cccuuccucccuagucgcggggaguc

SEQ ID NO: 125062 - RNA, 20 nt, Human
ucccaaaaccucauucccuu

SEQ ID NO: 125063 - RNA, 22 nt, Human
ucuccagcugcucacagacacc

SEQ ID NO: 125064 - RNA, 26 nt, Human
uugccucaccagcccugaggcuccgc

SEQ ID NO: 125065 - RNA, 19 nt, Human
uuauuuuucaaaauguaga

SEQ ID NO: 125066 - RNA, 23 nt, Human
acugcuuucuguuccaaauucag

SEQ ID NO: 125067 - RNA, 26 nt, Human
uggcaaaaacuagcgagggguagcag

SEQ ID NO: 125068 - RNA, 22 nt, Human
ucagcucccaguccuugugcuu

SEQ ID NO: 125069 - RNA, 22 nt, Human
uagacuucccgaguugugcaga

SEQ ID NO: 125070 - RNA, 26 nt, Human
gcccgacggcaucuaacccauaguaa

SEQ ID NO: 125071 - RNA, 22 nt, Human
cacuggccagacccagccaggg

SEQ ID NO: 125072 - RNA, 26 nt, Human
ggaaggagggagagcaggcagcccuu

SEQ ID NO: 125073 - RNA, 27 nt, Human
ggugugaggcaggagagacaguuggau

SEQ ID NO: 125074 - RNA, 20 nt, Human
acugcucuccccuggcuacu

SEQ ID NO: 125075 - RNA, 20 nt, Human
gcacuacggcuuccucucca

SEQ ID NO: 125076 - RNA, 29 nt, Human
ugcauauaguacacaggugcuuagcucaa

SEQ ID NO: 125077 - RNA, 20 nt, Human
aacgggaauuggccucucug

SEQ ID NO: 125078 - RNA, 25 nt, Human
acccaggcuggagugcuauggcucg

SEQ ID NO: 125079 - RNA, 27 nt, Human
gaaaugaguagaauugcugaaagucuc

SEQ ID NO: 125080 - RNA, 23 nt, Human
uaacaucccacuuagccgcaccc

SEQ ID NO: 125081 - RNA, 22 nt, Human
aagauucugaauggaagagugg

SEQ ID NO: 125082 - RNA, 25 nt, Human
uccugucauguucacucaucuuuaa

SEQ ID NO: 125083 - RNA, 27 nt, Human
cucaggggccucuccacaccuucucca

SEQ ID NO: 125084 - RNA, 27 nt, Human
aucauauuuucccauccaauuguuugg

SEQ ID NO: 125085 - RNA, 19 nt, Human
gaacggagaagaaguugua

SEQ ID NO: 125086 - RNA, 27 nt, Human
cacagccaaaugcuuccauuuguaauc

SEQ ID NO: 125087 - RNA, 23 nt, Human
ggucccucacuccacagagugag

SEQ ID NO: 125088 - RNA, 25 nt, Human
cggacuccggcagcuuuaucgccag

SEQ ID NO: 125089 - RNA, 19 nt, Human
ugagagggagaggagcaga

SEQ ID NO: 125090 - RNA, 27 nt, Human
ccgugaucccagcccacacuagccugg

SEQ ID NO: 125091 - RNA, 21 nt, Human
gcccccagacacugucauccu

SEQ ID NO: 125092 - RNA, 27 nt, Human
ggugaucuaccugcagcgggagauguc

SEQ ID NO: 125093 - RNA, 22 nt, Human
ccaggaugaagggaugcaguga

SEQ ID NO: 125094 - RNA, 23 nt, Human
aagcacgugauggaaucugugau

SEQ ID NO: 125095 - RNA, 20 nt, Human
ccaggcugggaauugcagug

SEQ ID NO: 125096 - RNA, 21 nt, Human
gcccaccagccaccucauccc

SEQ ID NO: 125097 - RNA, 26 nt, Human
cagauccuauccuguggaauuuaguu

SEQ ID NO: 125098 - RNA, 25 nt, Human
cccuucgucugugggcaccagcacu

SEQ ID NO: 125099 - RNA, 21 nt, Human
uccacuggacaguagaaaaau

SEQ ID NO: 125100 - RNA, 18 nt, Human
cuggggcaaggagcugag

SEQ ID NO: 125101 - RNA, 25 nt, Human
ccucuccugagaagccaccagcacc

SEQ ID NO: 125102 - RNA, 27 nt, Human
aauguuaggucaacuggcaaauuggaa

SEQ ID NO: 125103 - RNA, 28 nt, Human
guagaauucaugucccuuacagugguca

SEQ ID NO: 125104 - RNA, 25 nt, Human
auugcugugugaauccaggaggcag

SEQ ID NO: 125105 - RNA, 24 nt, Human
ucccucgggauggcuccgccugca

SEQ ID NO: 125106 - RNA, 21 nt, Human
acccacagcauagugaccuca

SEQ ID NO: 125107 - RNA, 26 nt, Human
gucuucugccuucugaguuggcucau

SEQ ID NO: 125108 - RNA, 23 nt, Human
guugcccaggcuagagugcaaug

SEQ ID NO: 125109 - RNA, 23 nt, Human
gucgcccaggcuggaguguagug

SEQ ID NO: 125110 - RNA, 23 nt, Human
guugcccaggcuggagugcagug

SEQ ID NO: 125111 - RNA, 22 nt, Human
caagaucacgccacugcacucc

SEQ ID NO: 125112 - RNA, 21 nt, Human
cugggagguugugguugcagu

SEQ ID NO: 125113 - RNA, 18 nt, Human
uacugaaccacuagccua

SEQ ID NO: 125114 - RNA, 22 nt, Human
acugcaaccuccgcaucccggg

SEQ ID NO: 125115 - RNA, 25 nt, Human
gguucaagcgauucuccugccucag

SEQ ID NO: 125116 - RNA, 20 nt, Human
gauuuuuuccuucugaagug

SEQ ID NO: 125117 - RNA, 27 nt, Human
ggcugacaccuguaaucccagcacuuu

SEQ ID NO: 125118 - RNA, 21 nt, Human
gcuugguuugcaguugagagg

SEQ ID NO: 125119 - RNA, 28 nt, Human
cagguaagggaaagccucagcuccuucc

SEQ ID NO: 125120 - RNA, 23 nt, Human
guuuuuauaaaaaauggugccug

SEQ ID NO: 125121 - RNA, 26 nt, Human
agugcuuccuuuucagcaugguuugc

SEQ ID NO: 125122 - RNA, 20 nt, Human
gaagccauuugugugccucu

SEQ ID NO: 125123 - RNA, 27 nt, Human
aaccuuuucugugccccuaucuucccg

SEQ ID NO: 125124 - RNA, 18 nt, Human
acaccccaacgugcucaa

SEQ ID NO: 125125 - RNA, 26 nt, Human
caugaauucaccuuccagcuuccuca

SEQ ID NO: 125126 - RNA, 27 nt, Human
guggcaaaacugccgcaagucugcagc

SEQ ID NO: 125127 - RNA, 24 nt, Human
guggaucaucucuuggaaaugcag

SEQ ID NO: 125128 - RNA, 23 nt, Human
cugucaucugccccuuccguguu

SEQ ID NO: 125129 - RNA, 22 nt, Human
ccaacaacagucagccagcuug

SEQ ID NO: 125130 - RNA, 22 nt, Human
gcagcugagccugucucucacg

SEQ ID NO: 125131 - RNA, 22 nt, Human
ucccucacuguggcaucaaggu

SEQ ID NO: 125132 - RNA, 19 nt, Human
auaaacaacagaaacuucu

SEQ ID NO: 125133 - RNA, 16 nt, Human
cccugcccuugugacc

SEQ ID NO: 125134 - RNA, 21 nt, Human
caugggcuuccugggucucca

SEQ ID NO: 125135 - RNA, 26 nt, Human
cccacccucccugggggacccucgaa

SEQ ID NO: 125136 - RNA, 25 nt, Human
auugagcaucuucuacauccuaggc

SEQ ID NO: 125137 - RNA, 27 nt, Human
agagaaaauaaccuggucucacugugg

SEQ ID NO: 125138 - RNA, 25 nt, Human
cacacuuaagcccucgugcacacac

SEQ ID NO: 125139 - RNA, 27 nt, Human
ucuagaaauuacaagcauauaacuuua

SEQ ID NO: 125140 - RNA, 21 nt, Human
gacuacagcguguguuuuuuc

SEQ ID NO: 125141 - RNA, 21 nt, Human
cagcccagggccuguuuugga

SEQ ID NO: 125142 - RNA, 22 nt, Human
uggaauuuagugcauuucaaaa

SEQ ID NO: 125143 - RNA, 27 nt, Human
cccugcaggcggaguuuucagaggaug

SEQ ID NO: 125144 - RNA, 15 nt, Human
acucccuuaccgccg

SEQ ID NO: 125145 - RNA, 19 nt, Human
ccaagcccagcccauggag

SEQ ID NO: 125146 - RNA, 23 nt, Human
augggauuggaaagcaucuacuu

SEQ ID NO: 125147 - RNA, 23 nt, Human
gugcucacaguuuuuuauuuuaa

SEQ ID NO: 125148 - RNA, 20 nt, Human
gugcaccccuccccauucac

SEQ ID NO: 125149 - RNA, 22 nt, Human
uccucuuaggaaccuggccugg

SEQ ID NO: 125150 - RNA, 21 nt, Human
uuccagagacaaauauuucua

SEQ ID NO: 125151 - RNA, 26 nt, Human
uuucauuccucgaugguaauacccgu

SEQ ID NO: 125152 - RNA, 22 nt, Human
ggcauauucuccucccaccuug

SEQ ID NO: 125153 - RNA, 25 nt, Human
ggggugaggcauggcgaugggggag

SEQ ID NO: 125154 - RNA, 21 nt, Human
aggaggaaucagauacccuuu

SEQ ID NO: 125155 - RNA, 23 nt, Human
cuucauuuauuuauugcuuuugc

SEQ ID NO: 125156 - RNA, 22 nt, Human
auacacagacccaggugaacac

SEQ ID NO: 125157 - RNA, 22 nt, Human
guccucuggugaacucagcgaa

SEQ ID NO: 125158 - RNA, 22 nt, Human
gaguguugcucauuugugagcc

SEQ ID NO: 125159 - RNA, 20 nt, Human
ucagaaaacugagcugcaau

SEQ ID NO: 125160 - RNA, 22 nt, Human
uguccuuccuggaccccauucu

SEQ ID NO: 125161 - RNA, 22 nt, Human
cagucaagggcuaaugauugcc

SEQ ID NO: 125162 - RNA, 22 nt, Human
ggagaggcccacuggcuaccag

SEQ ID NO: 125163 - RNA, 19 nt, Human
gguuucugaaaaguauuca

SEQ ID NO: 125164 - RNA, 26 nt, Human
ucuugucaaccgggcuggagugcagu

SEQ ID NO: 125165 - RNA, 23 nt, Human
caccaccuggagugaucaccucu

SEQ ID NO: 125166 - RNA, 22 nt, Human
aguccacagaagagguauucua

SEQ ID NO: 125167 - RNA, 24 nt, Human
acugauacaacaguagcuucuuca

SEQ ID NO: 125168 - RNA, 20 nt, Human
caaaacacagcuuuauuacc

SEQ ID NO: 125169 - RNA, 19 nt, Human
aagaaacauuuccucaaau

SEQ ID NO: 125170 - RNA, 20 nt, Human
uaacuucucuggagugcaau

SEQ ID NO: 125171 - RNA, 22 nt, Human
cugcaaccuccgacucccuggu

SEQ ID NO: 125172 - RNA, 23 nt, Human
gccagugagaugagggaugggcc

SEQ ID NO: 125173 - RNA, 23 nt, Human
cucagccuugggaccgugcccac

SEQ ID NO: 125174 - RNA, 27 nt, Human
cucuagccucaggcuccagccccagug

SEQ ID NO: 125175 - RNA, 20 nt, Human
caggaaaccaggcagaggag

SEQ ID NO: 125176 - RNA, 26 nt, Human
gggugcugugcucagcccugcccaug

SEQ ID NO: 125177 - RNA, 22 nt, Human
ccuuucuccugccccaagggcc

SEQ ID NO: 125178 - RNA, 27 nt, Human
uugcccaggcuggagugcaguagugca

SEQ ID NO: 125179 - RNA, 19 nt, Human
caaucuauccugugcuuga

SEQ ID NO: 125180 - RNA, 25 nt, Human
aggaccagaaccccugccuccaucu

SEQ ID NO: 125181 - RNA, 27 nt, Human
ugcuguugccucucuuugacaccuguu

SEQ ID NO: 125182 - RNA, 22 nt, Human
ccuggugaccuccugucacuca

SEQ ID NO: 125183 - RNA, 21 nt, Human
cuuucugcucuguugcaugcc

SEQ ID NO: 125184 - RNA, 25 nt, Human
cuucccaagguucuauccuguuccg

SEQ ID NO: 125185 - RNA, 23 nt, Human
cccagccugugaggguccugacu

SEQ ID NO: 125186 - RNA, 28 nt, Human
uuucuucauuuucuuuuggaggaccgac

SEQ ID NO: 125187 - RNA, 22 nt, Human
uguuggccaggcuggucuccaa

SEQ ID NO: 125188 - RNA, 20 nt, Human
gugcuuuauauuugccaaag

SEQ ID NO: 125189 - RNA, 24 nt, Human
uuucccauaaugcuucugagagcc

SEQ ID NO: 125190 - RNA, 26 nt, Human
uucacauuccucaguuucaccaccuc

SEQ ID NO: 125191 - RNA, 24 nt, Human
agggcagccugggggacagacugu

SEQ ID NO: 125192 - RNA, 27 nt, Human
gaugaauggcuggcugcuucuaggaau

SEQ ID NO: 125193 - RNA, 27 nt, Human
ggggacaggaaggagcaggagcuaagc

SEQ ID NO: 125194 - RNA, 24 nt, Human
ccaaaagaaaaacagccauaggcc

SEQ ID NO: 125195 - RNA, 26 nt, Human
gucuucaacuccugaccucaagcaau

SEQ ID NO: 125196 - RNA, 26 nt, Human
ucucugagggugauggggcugagcag

SEQ ID NO: 125197 - RNA, 27 nt, Human
ucugggagcuguucuggggcaggggga

SEQ ID NO: 125198 - RNA, 20 nt, Human
ccuuucucucuccucccgcc

SEQ ID NO: 125199 - RNA, 24 nt, Human
agccuugucccuuccuccucccag

SEQ ID NO: 125200 - RNA, 22 nt, Human
agccagaggagaagacaacccu

SEQ ID NO: 125201 - RNA, 25 nt, Human
aacuguacucuggccuacuuuucua

SEQ ID NO: 125202 - RNA, 22 nt, Human
caccuguaaucccaacacuuug

SEQ ID NO: 125203 - RNA, 24 nt, Human
ccaagcccuguguuccuggggaag

SEQ ID NO: 125204 - RNA, 27 nt, Human
ucauggacugaguuuauacucaccuuu

SEQ ID NO: 125205 - RNA, 21 nt, Human
gcaaaccccagagacucauuc

SEQ ID NO: 125206 - RNA, 27 nt, Human
gacccuuccccuccaggggugcagugg

SEQ ID NO: 125207 - RNA, 25 nt, Human
uccugcuguuaaguuucucaugguu

SEQ ID NO: 125208 - RNA, 23 nt, Human
gugaucauuuccugaggccucga

SEQ ID NO: 125209 - RNA, 24 nt, Human
gagguggaggcugcaaugagcuga

SEQ ID NO: 125210 - RNA, 21 nt, Human
auucacuaagcugccuagcca

SEQ ID NO: 125211 - RNA, 23 nt, Human
gcugagccacauggccaucugcu

SEQ ID NO: 125212 - RNA, 22 nt, Human
ucauugaauuuuauuuaaucau

SEQ ID NO: 125213 - RNA, 22 nt, Human
ugaggcugagauaaagcacagg

SEQ ID NO: 125214 - RNA, 25 nt, Human
gccgccgcccuaggcgaaguagggc

SEQ ID NO: 125215 - RNA, 29 nt, Human
gccuugugugaugauggguguggggcugc

SEQ ID NO: 125216 - RNA, 23 nt, Human
ugugacccguggcuaaccugcuu

SEQ ID NO: 125217 - RNA, 30 nt, Human
ucuucuucuuuccuuccaucaaaagaugua

SEQ ID NO: 125218 - RNA, 24 nt, Human
agaaggagaaggaaauguggggua

SEQ ID NO: 125219 - RNA, 24 nt, Human
uugugaucugguuaagaaguauua

SEQ ID NO: 125220 - RNA, 22 nt, Human
aaaggcugauggccucuaccuu

SEQ ID NO: 125221 - RNA, 23 nt, Human
ccuggugucuuuuuccagauuuc

SEQ ID NO: 125222 - RNA, 21 nt, Human
ucuggacuccuuucuccuuuu

SEQ ID NO: 125223 - RNA, 25 nt, Human
cccacaaucuggcuuagugccaccc

SEQ ID NO: 125224 - RNA, 21 nt, Human
uggaagugggguaggggaaga

SEQ ID NO: 125225 - RNA, 25 nt, Human
ggcagaugguggagucaaggguggg

SEQ ID NO: 125226 - RNA, 29 nt, Human
accuucaauauuugcuuguuguucauuua

SEQ ID NO: 125227 - RNA, 22 nt, Human
uccugcagugcucauucaucac

SEQ ID NO: 125228 - RNA, 22 nt, Human
ugggaggaaaaaagccguagua

SEQ ID NO: 125229 - RNA, 19 nt, Human
uuucauguuuaaaauguuu

SEQ ID NO: 125230 - RNA, 22 nt, Human
gcugcucuccaucucuuguacc

SEQ ID NO: 125231 - RNA, 25 nt, Human
ugcuuaauuauagcacuuuauuuuu

SEQ ID NO: 125232 - RNA, 20 nt, Human
gucuguuaaugucauggccu

SEQ ID NO: 125233 - RNA, 26 nt, Human
gugcgguuuuaggaagugccaacacc

SEQ ID NO: 125234 - RNA, 25 nt, Human
cucagaugccucaucuugccuuucc

SEQ ID NO: 125235 - RNA, 25 nt, Human
cuucugccuggcugaccucugagcc

SEQ ID NO: 125236 - RNA, 22 nt, Human
ccugccucggcacagccguagc

SEQ ID NO: 125237 - RNA, 26 nt, Human
ucccaugccuccucuggagccuucgc

SEQ ID NO: 125238 - RNA, 20 nt, Human
cuguuuguuaucauaguugg

SEQ ID NO: 125239 - RNA, 20 nt, Human
cagagcugccaguggggccu

SEQ ID NO: 125240 - RNA, 26 nt, Human
caggccgggugcaguggcuccuauaa

SEQ ID NO: 125241 - RNA, 27 nt, Human
uaugguaggggagggcaggcuugggga

SEQ ID NO: 125242 - RNA, 20 nt, Human
gauguucaaaacaaacuaca

SEQ ID NO: 125243 - RNA, 27 nt, Human
cuccaagauggagaagaucugccucca

SEQ ID NO: 125244 - RNA, 24 nt, Human
cuccaguuuucaguugaucacugg

SEQ ID NO: 125245 - RNA, 21 nt, Human
cuuucugcucuuccuuuuucu

SEQ ID NO: 125246 - RNA, 21 nt, Human
agacuugauuuuauuuguacc

SEQ ID NO: 125247 - RNA, 21 nt, Human
caugugccaagcagagguugg

SEQ ID NO: 125248 - RNA, 19 nt, Human
cacagcccugucagugcag

SEQ ID NO: 125249 - RNA, 30 nt, Human
uggaaauuguaaagcuuaaucaaaaagaau

SEQ ID NO: 125250 - RNA, 22 nt, Human
gcgucugagcugcgcagugggg

SEQ ID NO: 125251 - RNA, 23 nt, Human
gcauaacuaaaacccacagccca

SEQ ID NO: 125252 - RNA, 21 nt, Human
agccgcagccuccuucucugc

SEQ ID NO: 125253 - RNA, 23 nt, Human
cuucaaucuuaaaacaaauucau

SEQ ID NO: 125254 - RNA, 21 nt, Human
gucacccaggaggauggcaaa

SEQ ID NO: 125255 - RNA, 22 nt, Human
ugcaaccuccgccuccuugguu

SEQ ID NO: 125256 - RNA, 22 nt, Human
ugaccucaucguccaccugccu

SEQ ID NO: 125257 - RNA, 23 nt, Human
agccgucuguccuugaucugccc

SEQ ID NO: 125258 - RNA, 22 nt, Human
ucaucuaaagcaagucacugug

SEQ ID NO: 125259 - RNA, 23 nt, Human
guguuccucucccagcuccaucu

SEQ ID NO: 125260 - RNA, 28 nt, Human
ccuacuaaccuguuccuuggauaggcuu

SEQ ID NO: 125261 - RNA, 21 nt, Human
agaccuucuggucagcuguau

SEQ ID NO: 125262 - RNA, 22 nt, Human
augcuaaagggaaaaugugugc

SEQ ID NO: 125263 - RNA, 20 nt, Human
gucagcaaaggaaaguggaa

SEQ ID NO: 125264 - RNA, 26 nt, Human
gggcacacuggcagaggguaucugaa

SEQ ID NO: 125265 - RNA, 19 nt, Human
ccagcacugugucuugccu

SEQ ID NO: 125266 - RNA, 24 nt, Human
agacugguggagucggagggagga

SEQ ID NO: 125267 - RNA, 22 nt, Human
agacuugcaccuuaugucaugu

SEQ ID NO: 125268 - RNA, 26 nt, Human
gcuguugccaggggcuggaagcugga

SEQ ID NO: 125269 - RNA, 25 nt, Human
gccuuugcuucuugcacccaggccc

SEQ ID NO: 125270 - RNA, 23 nt, Human
agcuccguucacucucugccuuc

SEQ ID NO: 125271 - RNA, 27 nt, Human
gcgcugucacccaggcuggagugcagu

SEQ ID NO: 125272 - RNA, 19 nt, Human
ugcccucagccccacuucu

SEQ ID NO: 125273 - RNA, 24 nt, Human
uuugcccaggaacuuagggugggu

SEQ ID NO: 125274 - RNA, 19 nt, Human
gggacaugcuuuugcucag

SEQ ID NO: 125275 - RNA, 27 nt, Human
agcugggugaauuagaaaggcauaucc

SEQ ID NO: 125276 - RNA, 27 nt, Human
cucauuucuacuguucucuaacugugg

SEQ ID NO: 125277 - RNA, 29 nt, Human
uguucugaccucaugagugucaaacgugc

SEQ ID NO: 125278 - RNA, 22 nt, Human
cacauucugucagccuccacac

SEQ ID NO: 125279 - RNA, 24 nt, Human
agcauuccuggcuuucuggggucc

SEQ ID NO: 125280 - RNA, 24 nt, Human
cuccacugaggcuuccguaacacc

SEQ ID NO: 125281 - RNA, 27 nt, Human
ucauuagaaguuacagaaacuaaagca

SEQ ID NO: 125282 - RNA, 23 nt, Human
agcaucaaauauuugugcaagaa

SEQ ID NO: 125283 - RNA, 21 nt, Human
ccggucuaggacgcagcagau

SEQ ID NO: 125284 - RNA, 26 nt, Human
acuucuagcuuggaauagcuuguaca

SEQ ID NO: 125285 - RNA, 21 nt, Human
ggcucaccaaaaugugcucaa

SEQ ID NO: 125286 - RNA, 26 nt, Human
guggguaguaugauggguguuuuuag

SEQ ID NO: 125287 - RNA, 24 nt, Human
aagcacuuacccuccacuuccucc

SEQ ID NO: 125288 - RNA, 23 nt, Human
caguucuguaagcaucaggagcu

SEQ ID NO: 125289 - RNA, 23 nt, Human
uccucuugacagcuuugauugga

SEQ ID NO: 125290 - RNA, 20 nt, Human
cagcuuugccucuguauugu

SEQ ID NO: 125291 - RNA, 24 nt, Human
gaggaggaagacagcagccuggca

SEQ ID NO: 125292 - RNA, 21 nt, Human
agggucugggacgcaguuggg

SEQ ID NO: 125293 - RNA, 29 nt, Human
ccacagcuacagaugcagaagguuucucu

SEQ ID NO: 125294 - RNA, 28 nt, Human
ucagcuaugcuagaggcuuuuauuagaa

SEQ ID NO: 125295 - RNA, 26 nt, Human
aucccugcagcugaacccagcacuuu

SEQ ID NO: 125296 - RNA, 27 nt, Human
cgcagccgccggagccgcaaugccuaa

SEQ ID NO: 125297 - RNA, 18 nt, Human
aaagacuccuccaaaaag

SEQ ID NO: 125298 - RNA, 22 nt, Human
ucuucugcucuuucuucuucca

SEQ ID NO: 125299 - RNA, 28 nt, Human
uccaccccuuucagagacagcgcgauug

SEQ ID NO: 125300 - RNA, 27 nt, Human
acagauggcuggccaagugggagcaga

SEQ ID NO: 125301 - RNA, 20 nt, Human
auuaacuuauaaaauguuag

SEQ ID NO: 125302 - RNA, 27 nt, Human
acugcaaccuccaccucccugguucaa

SEQ ID NO: 125303 - RNA, 22 nt, Human
acugcaggcuccgccucccggg

SEQ ID NO: 125304 - RNA, 22 nt, Human
cagguucgaguucaguggugcc

SEQ ID NO: 125305 - RNA, 25 nt, Human
gucagagccuuaacaccagcaggug

SEQ ID NO: 125306 - RNA, 22 nt, Human
uuugucccuccggccugggcgg

SEQ ID NO: 125307 - RNA, 20 nt, Human
agaacaacaaggacaacuuu

SEQ ID NO: 125308 - RNA, 22 nt, Human
gucacuugaaccggggaggcgg

SEQ ID NO: 125309 - RNA, 21 nt, Human
ugcauaaaguaauauuuacag

SEQ ID NO: 125310 - RNA, 23 nt, Human
cccuggagcacucugccgcucaa

SEQ ID NO: 125311 - RNA, 27 nt, Human
agcaggagaaguugcagcuuacugauc

SEQ ID NO: 125312 - RNA, 26 nt, Human
uagcaggaagcuguacacacugugua

SEQ ID NO: 125313 - RNA, 24 nt, Human
cuguuggagucccagaauugcuga

SEQ ID NO: 125314 - RNA, 19 nt, Human
ccagacaacuuacauacac

SEQ ID NO: 125315 - RNA, 27 nt, Human
gcucuucuguggcaggaucaggucugu

SEQ ID NO: 125316 - RNA, 23 nt, Human
agcugauuuaaguuguuuuuugu

SEQ ID NO: 125317 - RNA, 26 nt, Human
cccuccaguccagucccugggauaga

SEQ ID NO: 125318 - RNA, 23 nt, Human
augacagucuggcccuccagaca

SEQ ID NO: 125319 - RNA, 27 nt, Human
cuccuccucaugcauuuccagccuuuc

SEQ ID NO: 125320 - RNA, 20 nt, Human
guaaugcucuuccacccugc

SEQ ID NO: 125321 - RNA, 27 nt, Human
ugcugugucaguuccuguuucuuccca

SEQ ID NO: 125322 - RNA, 24 nt, Human
aaauguuccuuuuaacggaugguu

SEQ ID NO: 125323 - RNA, 26 nt, Human
ccagggagacuggcauugacgagaac

SEQ ID NO: 125324 - RNA, 22 nt, Human
ugcagugagccgagaucaggcc

SEQ ID NO: 125325 - RNA, 26 nt, Human
gcagggaccacacccuguacuguucu

SEQ ID NO: 125326 - RNA, 20 nt, Human
ucagauacaaaaagaaaaau

SEQ ID NO: 125327 - RNA, 21 nt, Human
cuugagaguauauauuuuccc

SEQ ID NO: 125328 - RNA, 22 nt, Human
gcuggagacaguguuugucgug

SEQ ID NO: 125329 - RNA, 22 nt, Human
gcacuuguccagcugagcgcca

SEQ ID NO: 125330 - RNA, 22 nt, Human
agugacacaaucucggcucacu

SEQ ID NO: 125331 - RNA, 22 nt, Human
ccugucacucauggccaggaga

SEQ ID NO: 125332 - RNA, 25 nt, Human
acauucugauucgaaugacacuguu

SEQ ID NO: 125333 - RNA, 23 nt, Human
guuuugacggugggagggugaga

SEQ ID NO: 125334 - RNA, 22 nt, Human
uugugaauuucugucucaaaau

SEQ ID NO: 125335 - RNA, 27 nt, Human
ccugccugcucagagcccugcagggcu

SEQ ID NO: 125336 - RNA, 19 nt, Human
agaaaacacauuucugguu

SEQ ID NO: 125337 - RNA, 22 nt, Human
ccuauuucccuaccaaccaagg

SEQ ID NO: 125338 - RNA, 21 nt, Human
gccacugcacaccagccuggg

SEQ ID NO: 125339 - RNA, 22 nt, Human
acgaaagagagaauaugaaaga

SEQ ID NO: 125340 - RNA, 25 nt, Human
ccaagcuucccugcaucuugguccu

SEQ ID NO: 125341 - RNA, 21 nt, Human
gggaaaaaguuaauguggaaa

SEQ ID NO: 125342 - RNA, 23 nt, Human
ugaguagcugggacuacaggcac

SEQ ID NO: 125343 - RNA, 25 nt, Human
ucuccagcugcucugcacacaugga

SEQ ID NO: 125344 - RNA, 20 nt, Human
gccuuucuugaccuuaugcc

SEQ ID NO: 125345 - RNA, 24 nt, Human
agcugcuccuuccuuacagccuug

SEQ ID NO: 125346 - RNA, 24 nt, Human
ccucuacuuuguccccucaccucc

SEQ ID NO: 125347 - RNA, 20 nt, Human
guucauucuucuuucuugaa

SEQ ID NO: 125348 - RNA, 23 nt, Human
ucucuucccucucccaucguauu

SEQ ID NO: 125349 - RNA, 21 nt, Human
aagccccggagaacucagcgg

SEQ ID NO: 125350 - RNA, 23 nt, Human
uugggccaggugggauuacaggc

SEQ ID NO: 125351 - RNA, 25 nt, Human
uugcucugucgccaggcuggagugc

SEQ ID NO: 125352 - RNA, 22 nt, Human
cucugucuaggugucaugguuc

SEQ ID NO: 125353 - RNA, 22 nt, Human
ccuccugcugcucacucccgcu

SEQ ID NO: 125354 - RNA, 29 nt, Human
aagacuccagacuccagcuaacagucccu

SEQ ID NO: 125355 - RNA, 27 nt, Human
auguucucuaccauccuuuuccuuccc

SEQ ID NO: 125356 - RNA, 27 nt, Human
uaggcuggagugcaguggcacgaucau

SEQ ID NO: 125357 - RNA, 27 nt, Human
uuauuucucucacacuuuugcuugaau

SEQ ID NO: 125358 - RNA, 25 nt, Human
cccuccugugaaccaacacagacac

SEQ ID NO: 125359 - RNA, 23 nt, Human
ucuuucucuguccccuccuugcc

SEQ ID NO: 125360 - RNA, 21 nt, Human
ucauggacgcagaccucacgg

SEQ ID NO: 125361 - RNA, 21 nt, Human
uggagucaggacaaauggauc

SEQ ID NO: 125362 - RNA, 22 nt, Human
gugcaggcuggagugcaguggc

SEQ ID NO: 125363 - RNA, 21 nt, Human
gggguccacagagccgggagg

SEQ ID NO: 125364 - RNA, 21 nt, Human
aguauuuuugcagcauuccuu

SEQ ID NO: 125365 - RNA, 22 nt, Human
gcaccugcccagccccaccuca

SEQ ID NO: 125366 - RNA, 25 nt, Human
cgauucuccugccucagucucccga

SEQ ID NO: 125367 - RNA, 22 nt, Human
cagcccaggccagcuuucugca

SEQ ID NO: 125368 - RNA, 21 nt, Human
gagcuggagugcaguggugca

SEQ ID NO: 125369 - RNA, 21 nt, Human
gcagccgccuccaugcccuag

SEQ ID NO: 125370 - RNA, 22 nt, Human
ugucgcccaggcuggagcgcag

SEQ ID NO: 125371 - RNA, 24 nt, Human
ucuugagcccagagacaaggcagc

SEQ ID NO: 125372 - RNA, 22 nt, Human
cauugcauuccagccugggaga

SEQ ID NO: 125373 - RNA, 22 nt, Human
ggaaagaugguggugcaauggc

SEQ ID NO: 125374 - RNA, 22 nt, Human
gagcccaggagguugagaaugc

SEQ ID NO: 125375 - RNA, 21 nt, Human
ucagggagggggcaggaaaga

SEQ ID NO: 125376 - RNA, 26 nt, Human
agcccauuucuagaaugucauggaag

SEQ ID NO: 125377 - RNA, 23 nt, Human
uuuuguguaggugucugccuuca

SEQ ID NO: 125378 - RNA, 23 nt, Human
ggcaacaaaagaagcccggcucc

SEQ ID NO: 125379 - RNA, 21 nt, Human
acagguuuauuucacauccua

SEQ ID NO: 125380 - RNA, 20 nt, Human
ggagagaaagaacagaccag

SEQ ID NO: 125381 - RNA, 26 nt, Human
ggaggcagcacuuuucccucaugcug

SEQ ID NO: 125382 - RNA, 23 nt, Human
aggcuggagugcaguggcgagau

SEQ ID NO: 125383 - RNA, 19 nt, Human
acuccugaaaccucuuccu

SEQ ID NO: 125384 - RNA, 26 nt, Human
caguggcucguaucccaaaucuguca

SEQ ID NO: 125385 - RNA, 22 nt, Human
cccaaguagcuuggauuacagg

SEQ ID NO: 125386 - RNA, 22 nt, Human
gcugaaggcagcuuccacagcu

SEQ ID NO: 125387 - RNA, 23 nt, Human
gucgcccaggcuggagugcaggg

SEQ ID NO: 125388 - RNA, 26 nt, Human
guucuugcuuucucucucaugccucc

SEQ ID NO: 125389 - RNA, 24 nt, Human
cuaacagcaaauaacagucugaga

SEQ ID NO: 125390 - RNA, 21 nt, Human
cuucauuuggugcuggucuau

SEQ ID NO: 125391 - RNA, 27 nt, Human
agagccucgucccucccucacugaagg

SEQ ID NO: 125392 - RNA, 23 nt, Human
uuuauuuuucugcaccuuccuuu

SEQ ID NO: 125393 - RNA, 26 nt, Human
uucuggucuccagggacagugcugcu

SEQ ID NO: 125394 - RNA, 22 nt, Human
ccacugcacuccagucuggucg

SEQ ID NO: 125395 - RNA, 22 nt, Human
auucauacuuggagaaauccua

SEQ ID NO: 125396 - RNA, 20 nt, Human
cgcuccccagccucgggcga

SEQ ID NO: 125397 - RNA, 27 nt, Human
caugaacacacuguguccuggugcucu

SEQ ID NO: 125398 - RNA, 23 nt, Human
guguuggaacugccucuuauuuu

SEQ ID NO: 125399 - RNA, 23 nt, Human
agcuugaaaacuugcugaaaaac

SEQ ID NO: 125400 - RNA, 19 nt, Human
gguuuccaugggaaccuga

SEQ ID NO: 125401 - RNA, 26 nt, Human
auguagcuuccaccucauggauugcc

SEQ ID NO: 125402 - RNA, 27 nt, Human
cugaguguagggaaugggauauugaca

SEQ ID NO: 125403 - RNA, 24 nt, Human
ggccucucccuccuccaggaagcc

SEQ ID NO: 125404 - RNA, 23 nt, Human
uacaugguauccaguuugcauag

SEQ ID NO: 125405 - RNA, 24 nt, Human
ggcaugagccacugcacucaaccu

SEQ ID NO: 125406 - RNA, 21 nt, Human
gccauuuuucaguagcaggac

SEQ ID NO: 125407 - RNA, 21 nt, Human
aaaccugaacuuuuccugcac

SEQ ID NO: 125408 - RNA, 20 nt, Human
ggcuuccggggaaagcaauc

SEQ ID NO: 125409 - RNA, 25 nt, Human
ggagccuccccucccuguaucaccc

SEQ ID NO: 125410 - RNA, 21 nt, Human
uccucauucauuauuguacca

SEQ ID NO: 125411 - RNA, 22 nt, Human
gacccggacucccagcugggac

SEQ ID NO: 125412 - RNA, 22 nt, Human
uaaggcagugcaguacucagua

SEQ ID NO: 125413 - RNA, 18 nt, Human
uguacucaggggcugguc

SEQ ID NO: 125414 - RNA, 20 nt, Human
agcuuucgaaagugcccuca

SEQ ID NO: 125415 - RNA, 20 nt, Human
uaccuuugaagaaaaccaga

SEQ ID NO: 125416 - RNA, 27 nt, Human
gaguagcugggauuacaggcgcccguc

SEQ ID NO: 125417 - RNA, 24 nt, Human
ccccgaucaggucauugucaccac

SEQ ID NO: 125418 - RNA, 27 nt, Human
ccucauggcaucauccauucucucugc

SEQ ID NO: 125419 - RNA, 22 nt, Human
uuaugguuauguuuuucugugu

SEQ ID NO: 125420 - RNA, 26 nt, Human
cugagggcuggagagucucuguugac

SEQ ID NO: 125421 - RNA, 21 nt, Human
aacuucugcaucugccugauc

SEQ ID NO: 125422 - RNA, 20 nt, Human
uuagccaagagcacagacuu

SEQ ID NO: 125423 - RNA, 21 nt, Human
guccugcucccggcuucccuu

SEQ ID NO: 125424 - RNA, 25 nt, Human
ccugacauccagaaacaauggccuc

SEQ ID NO: 125425 - RNA, 23 nt, Human
cuccaccuugauauugcacuucc

SEQ ID NO: 125426 - RNA, 22 nt, Human
ugguaugacaauucacugauau

SEQ ID NO: 125427 - RNA, 26 nt, Human
cggcagcuaggggaggauggcggagu

SEQ ID NO: 125428 - RNA, 22 nt, Human
ggaagaggccuguuucgcuguc

SEQ ID NO: 125429 - RNA, 24 nt, Human
uuaaucuuucuuuaccugagacca

SEQ ID NO: 125430 - RNA, 22 nt, Human
agcaaguucuagaaggucucca

SEQ ID NO: 125431 - RNA, 21 nt, Human
ggcaguucuggugaauguuca

SEQ ID NO: 125432 - RNA, 22 nt, Human
aggaugagggggagggagccaa

SEQ ID NO: 125433 - RNA, 19 nt, Human
ugggaaagaaucccgggaa

SEQ ID NO: 125434 - RNA, 21 nt, Human
aggcagcuaggcagggagggg

SEQ ID NO: 125435 - RNA, 18 nt, Human
ucggccuuuauuuacuua

SEQ ID NO: 125436 - RNA, 24 nt, Human
ccaucuacugaaacagggucucca

SEQ ID NO: 125437 - RNA, 22 nt, Human
cagccccacucuccacuuucug

SEQ ID NO: 125438 - RNA, 21 nt, Human
auucuugucuguucugccuca

SEQ ID NO: 125439 - RNA, 20 nt, Human
agacgugguucccuccagcc

SEQ ID NO: 125440 - RNA, 21 nt, Human
cuaaguggauaaauauacaaa

SEQ ID NO: 125441 - RNA, 23 nt, Human
cgguguuuugcaguccugggcag

SEQ ID NO: 125442 - RNA, 23 nt, Human
ccugguugucugaacccaggcag

SEQ ID NO: 125443 - RNA, 27 nt, Human
cacuguacuccagccugaagagcgaga

SEQ ID NO: 125444 - RNA, 21 nt, Human
aaguuggcaaggagugcauuu

SEQ ID NO: 125445 - RNA, 21 nt, Human
gccuguaaucccagaacuuug

SEQ ID NO: 125446 - RNA, 21 nt, Human
gccugucaucccagcacuuug

SEQ ID NO: 125447 - RNA, 22 nt, Human
cacuugaacccgggaggcggag

SEQ ID NO: 125448 - RNA, 23 nt, Human
gcuggccagcacccucuccuggg

SEQ ID NO: 125449 - RNA, 22 nt, Human
cuuuugugcuaucaaugaguuc

SEQ ID NO: 125450 - RNA, 25 nt, Human
ggcuuccugccuccaugccacucca

SEQ ID NO: 125451 - RNA, 24 nt, Human
agauauaaccaaauaaacaaguca

SEQ ID NO: 125452 - RNA, 27 nt, Human
ccccuuccucugcuccuccaugaauga

SEQ ID NO: 125453 - RNA, 27 nt, Human
ucgcccaggcuagaguggauuggcgug

SEQ ID NO: 125454 - RNA, 29 nt, Human
ccagcgaacacacacagguguccugccgu

SEQ ID NO: 125455 - RNA, 27 nt, Human
gccagugcaccagcaguuuagguguga

SEQ ID NO: 125456 - RNA, 22 nt, Human
agccucccgaguagggaggacc

SEQ ID NO: 125457 - RNA, 21 nt, Human
cucagcuuuuaaauggguaga

SEQ ID NO: 125458 - RNA, 18 nt, Human
acagaguacgugaaaugc

SEQ ID NO: 125459 - RNA, 23 nt, Human
agaguauuaagaaauggagagaa

SEQ ID NO: 125460 - RNA, 27 nt, Human
ucaguuuugaccuugaugauuuuuugu

SEQ ID NO: 125461 - RNA, 20 nt, Human
gcagccccacccaggagcag

SEQ ID NO: 125462 - RNA, 21 nt, Human
gggagcuggaaagggggcgga

SEQ ID NO: 125463 - RNA, 23 nt, Human
ggaagaaaaaacaaacucugcuc

SEQ ID NO: 125464 - RNA, 31 nt, Human
uucucucuccauucagugcacgcguuacuuu

SEQ ID NO: 125465 - RNA, 23 nt, Human
uugcccagcaagcuucugcacua

SEQ ID NO: 125466 - RNA, 20 nt, Human
gggggaggggagggagaugu

SEQ ID NO: 125467 - RNA, 19 nt, Human
cuagacgacucuugguacc

SEQ ID NO: 125468 - RNA, 23 nt, Human
gagggccccagaguuccuuguau

SEQ ID NO: 125469 - RNA, 25 nt, Human
cuuccucaaaacaaacaagagaugg

SEQ ID NO: 125470 - RNA, 24 nt, Human
ucugucacccuuguccuugagugc

SEQ ID NO: 125471 - RNA, 18 nt, Human
ucuccacccccucuggcc

SEQ ID NO: 125472 - RNA, 24 nt, Human
uucuguacacugccuuugguuuua

SEQ ID NO: 125473 - RNA, 29 nt, Human
ccacugucauucagggccugggucuccag

SEQ ID NO: 125474 - RNA, 19 nt, Human
ccgcgcagccgcaaaaaga

SEQ ID NO: 125475 - RNA, 25 nt, Human
cuucagcugcuccuugauauuaacc

SEQ ID NO: 125476 - RNA, 26 nt, Human
ggagcgggagagcggccacaccaugc

SEQ ID NO: 125477 - RNA, 21 nt, Human
ggccacaggcccuccaccuca

SEQ ID NO: 125478 - RNA, 19 nt, Human
uuucugcugcuccccagcu

SEQ ID NO: 125479 - RNA, 22 nt, Human
gcccaugcuggagugcaauggc

SEQ ID NO: 125480 - RNA, 21 nt, Human
gccaggaggccggugcugggc

SEQ ID NO: 125481 - RNA, 21 nt, Human
aucagguugcaaaacggauga

SEQ ID NO: 125482 - RNA, 21 nt, Human
auggcuguccccugcaagugg

SEQ ID NO: 125483 - RNA, 22 nt, Human
aaagugcugggauuacaggugg

SEQ ID NO: 125484 - RNA, 23 nt, Human
aaccaaaacagugauauuuccag

SEQ ID NO: 125485 - RNA, 22 nt, Human
gcccaggcuggagugcaacggu

SEQ ID NO: 125486 - RNA, 18 nt, Human
ugguuuauugaaugugau

SEQ ID NO: 125487 - RNA, 27 nt, Human
ccacugcacuccggccugaugacagag

SEQ ID NO: 125488 - RNA, 28 nt, Human
cugaaagugaaauagggagcuggcuacc

SEQ ID NO: 125489 - RNA, 23 nt, Human
accuggagcacuuaccgcauuag

SEQ ID NO: 125490 - RNA, 19 nt, Human
cucucugaucuauuuuucc

SEQ ID NO: 125491 - RNA, 21 nt, Human
gcguuucagugaccuaccuua

SEQ ID NO: 125492 - RNA, 26 nt, Human
aagccugaaaccugaccccaauccuc

SEQ ID NO: 125493 - RNA, 27 nt, Human
ucagagucuggaguuaacagcuuuuca

SEQ ID NO: 125494 - RNA, 23 nt, Human
agcgcuccucacggaucccucuc

SEQ ID NO: 125495 - RNA, 26 nt, Human
uucaguaauauuuugcuguuuuuaag

SEQ ID NO: 125496 - RNA, 22 nt, Human
cugaguacaaguggucaccucc

SEQ ID NO: 125497 - RNA, 22 nt, Human
acucuucuuugucauuacugug

SEQ ID NO: 125498 - RNA, 20 nt, Human
ucuuauuguuucuaaaacaa

SEQ ID NO: 125499 - RNA, 22 nt, Human
gcucacgccuauaaucccagca

SEQ ID NO: 125500 - RNA, 26 nt, Human
gguccccacagacucagagagaaccc

SEQ ID NO: 125501 - RNA, 26 nt, Human
uggggagcggcuucagcacugcagcc

SEQ ID NO: 125502 - RNA, 20 nt, Human
uggguggaaugauggcagaa

SEQ ID NO: 125503 - RNA, 27 nt, Human
uucccacaucggguugacugucuuugu

SEQ ID NO: 125504 - RNA, 27 nt, Human
cucuaauuugccuccaaugucuauaug

SEQ ID NO: 125505 - RNA, 22 nt, Human
uucacagucucucuuccuucug

SEQ ID NO: 125506 - RNA, 22 nt, Human
uucauucuaccaagcugucaca

SEQ ID NO: 125507 - RNA, 23 nt, Human
uugaugucuagauaggaccucaa

SEQ ID NO: 125508 - RNA, 23 nt, Human
aggcuggagugcagugacaugau

SEQ ID NO: 125509 - RNA, 22 nt, Human
ccaaccuggacagacagccaaa

SEQ ID NO: 125510 - RNA, 27 nt, Human
ggccgcuguuuugguuugacaugacaa

SEQ ID NO: 125511 - RNA, 20 nt, Human
aacaagcuucacacgcaaca

SEQ ID NO: 125512 - RNA, 21 nt, Human
uggagaaauguauuauuucca

SEQ ID NO: 125513 - RNA, 20 nt, Human
ucaguauuugugguugggaa

SEQ ID NO: 125514 - RNA, 20 nt, Human
uucuccacucugcucagucc

SEQ ID NO: 125515 - RNA, 21 nt, Human
ccuguaaucccagaacuuugg

SEQ ID NO: 125516 - RNA, 21 nt, Human
ccugucaucccagcacuuugg

SEQ ID NO: 125517 - RNA, 23 nt, Human
cuagaaaaggcagcuaaaggaag

SEQ ID NO: 125518 - RNA, 27 nt, Human
cucacuguuucuaagccuccuggacca

SEQ ID NO: 125519 - RNA, 21 nt, Human
gaauccucuucuuuauacugu

SEQ ID NO: 125520 - RNA, 22 nt, Human
acugcaagcuccgccucccggg

SEQ ID NO: 125521 - RNA, 25 nt, Human
uggccccggcucucuggaccuuguc

SEQ ID NO: 125522 - RNA, 20 nt, Human
ucuuuccccucuccaaugcc

SEQ ID NO: 125523 - RNA, 21 nt, Human
uggcagcaggaugcucaguga

SEQ ID NO: 125524 - RNA, 20 nt, Human
ugcccugcuguuuauucugu

SEQ ID NO: 125525 - RNA, 22 nt, Human
ugccacugcuuuccagccuggg

SEQ ID NO: 125526 - RNA, 25 nt, Human
ccugcucggcccucagcccugccgc

SEQ ID NO: 125527 - RNA, 21 nt, Human
gaaauccuagcugcgcucuug

SEQ ID NO: 125528 - RNA, 22 nt, Human
auucaaagguauccaaugucgc

SEQ ID NO: 125529 - RNA, 20 nt, Human
gcagcucugagccgcgcuuu

SEQ ID NO: 125530 - RNA, 21 nt, Human
gccuguauagacagcacuugg

SEQ ID NO: 125531 - RNA, 26 nt, Human
ggcucacugcagcgcgcuccugaccc

SEQ ID NO: 125532 - RNA, 21 nt, Human
aaaaugcucaaucucagcuaa

SEQ ID NO: 125533 - RNA, 17 nt, Human
auuuuucugcugaugcc

SEQ ID NO: 125534 - RNA, 23 nt, Human
ggugcugguggaaccccugcaca

SEQ ID NO: 125535 - RNA, 24 nt, Human
aggcccaaaggcagaacagccaga

SEQ ID NO: 125536 - RNA, 25 nt, Human
caggcagcaguuguaguuacugccg

SEQ ID NO: 125537 - RNA, 26 nt, Human
accauccucuguuacccgcagauccu

SEQ ID NO: 125538 - RNA, 20 nt, Human
uggcucuagcgcauccuuug

SEQ ID NO: 125539 - RNA, 24 nt, Human
ucugccugguuuuguguguucugu

SEQ ID NO: 125540 - RNA, 23 nt, Human
ccuucuggccaggccugccuuca

SEQ ID NO: 125541 - RNA, 23 nt, Human
cagccuuuucagcaucucaccca

SEQ ID NO: 125542 - RNA, 27 nt, Human
guuaugcuggaaaugcuagaauauaau

SEQ ID NO: 125543 - RNA, 24 nt, Human
ggugccucucggaggagccugugu

SEQ ID NO: 125544 - RNA, 18 nt, Human
gaugccauaaaagccgcc

SEQ ID NO: 125545 - RNA, 23 nt, Human
uagaagccugacaacucauuuuc

SEQ ID NO: 125546 - RNA, 19 nt, Human
gcaccugcccuguguuuug

SEQ ID NO: 125547 - RNA, 21 nt, Human
uagcugcuaacaagacuggcu

SEQ ID NO: 125548 - RNA, 21 nt, Human
caaagcaaaacagacuguguu

SEQ ID NO: 125549 - RNA, 23 nt, Human
gcaccccacucucccaagccacc

SEQ ID NO: 125550 - RNA, 23 nt, Human
ccuccagcagacuccugcucucu

SEQ ID NO: 125551 - RNA, 22 nt, Human
ccugcaggcccagccuggacaa

SEQ ID NO: 125552 - RNA, 23 nt, Human
uuuccugaguucuuccucaaucc

SEQ ID NO: 125553 - RNA, 18 nt, Human
uugaugucauuaaaacau

SEQ ID NO: 125554 - RNA, 25 nt, Human
cugcagugcaugggggauguuucuu

SEQ ID NO: 125555 - RNA, 23 nt, Human
ccagcugcucacccugccaccuc

SEQ ID NO: 125556 - RNA, 25 nt, Human
cagggaggaguugaggccacuguuc

SEQ ID NO: 125557 - RNA, 21 nt, Human
aaaaccugcaggccgagcaca

SEQ ID NO: 125558 - RNA, 25 nt, Human
agccaguuggugagcgcuguaaucu

SEQ ID NO: 125559 - RNA, 23 nt, Human
gaggcggguaggaggagcccgag

SEQ ID NO: 125560 - RNA, 21 nt, Human
aucucuuaaaauggugaugga

SEQ ID NO: 125561 - RNA, 24 nt, Human
gucccaagcagccucuugccagca

SEQ ID NO: 125562 - RNA, 24 nt, Human
uggauccaagccuguugagagaaa

SEQ ID NO: 125563 - RNA, 30 nt, Human
cagggauuguggggacaggagugagacaac

SEQ ID NO: 125564 - RNA, 22 nt, Human
ucuucuuugucauuacugugac

SEQ ID NO: 125565 - RNA, 21 nt, Human
ucuuguccuguuugcauuuca

SEQ ID NO: 125566 - RNA, 26 nt, Human
uuuacugaccaaguucuuucugugcu

SEQ ID NO: 125567 - RNA, 22 nt, Human
aagcuccucaaacaggguucag

SEQ ID NO: 125568 - RNA, 26 nt, Human
ucgggaggcugaggcaggagaauugc

SEQ ID NO: 125569 - RNA, 23 nt, Human
ccacuucccacucuccugcccca

SEQ ID NO: 125570 - RNA, 19 nt, Human
cccaccccaccccccaccc

SEQ ID NO: 125571 - RNA, 21 nt, Human
uggugccucuuccacucugga

SEQ ID NO: 125572 - RNA, 23 nt, Human
gcugcugcugcaccgcccgccuu

SEQ ID NO: 125573 - RNA, 21 nt, Human
ggcucacugcaccuccaccuu

SEQ ID NO: 125574 - RNA, 19 nt, Human
gcuccagggagcaggcugg

SEQ ID NO: 125575 - RNA, 19 nt, Human
uuuauuuccagaccaauaa

SEQ ID NO: 125576 - RNA, 20 nt, Human
aucuucaaggcuacugaugg

SEQ ID NO: 125577 - RNA, 26 nt, Human
ggaagagggagucuggcaugaguugc

SEQ ID NO: 125578 - RNA, 20 nt, Human
gcccuugccacugucuccug

SEQ ID NO: 125579 - RNA, 21 nt, Human
ggggaaggcagaggcuggcac

SEQ ID NO: 125580 - RNA, 25 nt, Human
ccgggacuuuaaccccuugugggcu

SEQ ID NO: 125581 - RNA, 20 nt, Human
ccacccugccagccuaugag

SEQ ID NO: 125582 - RNA, 20 nt, Human
cugugcucugugucugcaug

SEQ ID NO: 125583 - RNA, 27 nt, Human
agcucacuuuuaaacaacuagggugcu

SEQ ID NO: 125584 - RNA, 21 nt, Human
acuuuuuguucugguccuuuu

SEQ ID NO: 125585 - RNA, 24 nt, Human
guuuauuucucaaaccagucauuu

SEQ ID NO: 125586 - RNA, 21 nt, Human
caaguccaagugguucccauu

SEQ ID NO: 125587 - RNA, 22 nt, Human
ugggaucugccccucccugcuu

SEQ ID NO: 125588 - RNA, 27 nt, Human
gcugacuuggaauugugugcugcuugc

SEQ ID NO: 125589 - RNA, 25 nt, Human
auccuggcccuccaccugccuccag

SEQ ID NO: 125590 - RNA, 23 nt, Human
aacagacaccgucuuuaugucaa

SEQ ID NO: 125591 - RNA, 23 nt, Human
ggauuaaggggauuagggagugu

SEQ ID NO: 125592 - RNA, 27 nt, Human
aauggcugaugucaaugcuauggacug

SEQ ID NO: 125593 - RNA, 21 nt, Human
caucucugguuccugcccugg

SEQ ID NO: 125594 - RNA, 21 nt, Human
aguagcugagacuacaagcac

SEQ ID NO: 125595 - RNA, 25 nt, Human
gggguucugucuucuuugauagcca

SEQ ID NO: 125596 - RNA, 22 nt, Human
ggguuacaccugcccuccgugg

SEQ ID NO: 125597 - RNA, 23 nt, Human
cuccuccauggcuucccagcuug

SEQ ID NO: 125598 - RNA, 27 nt, Human
ucugaauuaauuguccuuucuucuaaa

SEQ ID NO: 125599 - RNA, 20 nt, Human
ggccgccugccugucauucc

SEQ ID NO: 125600 - RNA, 26 nt, Human
aaaggcuggaagcagagcgaacuggg

SEQ ID NO: 125601 - RNA, 20 nt, Human
cucuuccccuccugcuuuag

SEQ ID NO: 125602 - RNA, 20 nt, Human
cugcagcucugcucucggga

SEQ ID NO: 125603 - RNA, 21 nt, Human
uccagaagggccagcugggca

SEQ ID NO: 125604 - RNA, 26 nt, Human
ccagaaaggguuuuaaagcccaugcc

SEQ ID NO: 125605 - RNA, 21 nt, Human
acugcacuucggcagaguuga

SEQ ID NO: 125606 - RNA, 27 nt, Human
ucugagcuuucuccugguuaccuccuc

SEQ ID NO: 125607 - RNA, 22 nt, Human
caacuccgggggcucaacggug

SEQ ID NO: 125608 - RNA, 27 nt, Human
ucauggacuggacaucucauccauucu

SEQ ID NO: 125609 - RNA, 22 nt, Human
caggcuguagugcaguggcacg

SEQ ID NO: 125610 - RNA, 22 nt, Human
cucuaaacugccccaccuccua

SEQ ID NO: 125611 - RNA, 21 nt, Human
cuccuccuaugucucuuuuca

SEQ ID NO: 125612 - RNA, 20 nt, Human
agccccaucgggccgcugcc

SEQ ID NO: 125613 - RNA, 27 nt, Human
uggcuaacacagugaaaccccgucucu

SEQ ID NO: 125614 - RNA, 22 nt, Human
ucagaaagguuuuacaauccaa

SEQ ID NO: 125615 - RNA, 22 nt, Human
caccugacagaugcacggccca

SEQ ID NO: 125616 - RNA, 22 nt, Human
uuacccaggcuggagugcaaug

SEQ ID NO: 125617 - RNA, 20 nt, Human
aggguccaacaagagcaagc

SEQ ID NO: 125618 - RNA, 28 nt, Human
gcucagugcuuugguagcacaaggugac

SEQ ID NO: 125619 - RNA, 22 nt, Human
agguccuuguuguuucuugccu

SEQ ID NO: 125620 - RNA, 24 nt, Human
ucccuccacuggauuccuuuguuu

SEQ ID NO: 125621 - RNA, 20 nt, Human
cuuaaggucuccaaaccaga

SEQ ID NO: 125622 - RNA, 24 nt, Human
aggguacggagaguccccucugug

SEQ ID NO: 125623 - RNA, 25 nt, Human
gccacuccaaggaggcccuggcugc

SEQ ID NO: 125624 - RNA, 21 nt, Human
uucuaccaguaugugcuacua

SEQ ID NO: 125625 - RNA, 21 nt, Human
guuuuggguuuuuuggcucau

SEQ ID NO: 125626 - RNA, 23 nt, Human
ccugccuguccucaugccucucc

SEQ ID NO: 125627 - RNA, 14 nt, Human
gccuaaaugccuua

SEQ ID NO: 125628 - RNA, 22 nt, Human
uuuguugugugugcagggaggg

SEQ ID NO: 125629 - RNA, 27 nt, Human
ucagaagcagaaacuggcaggccaugg

SEQ ID NO: 125630 - RNA, 21 nt, Human
aggcucugagauuucacaggu

SEQ ID NO: 125631 - RNA, 20 nt, Human
gcuaauucuucuccuccuuc

SEQ ID NO: 125632 - RNA, 22 nt, Human
cucagccucccaacguacuggg

SEQ ID NO: 125633 - RNA, 24 nt, Human
ggucuguaggguucccugccuccc

SEQ ID NO: 125634 - RNA, 23 nt, Human
uggcaccccccucccgucucagc

SEQ ID NO: 125635 - RNA, 21 nt, Human
gcauuuuaaaaucauggaauu

SEQ ID NO: 125636 - RNA, 27 nt, Human
ugcagugagcccagaucgcaccacugc

SEQ ID NO: 125637 - RNA, 19 nt, Human
cugccuggaugagcacacc

SEQ ID NO: 125638 - RNA, 28 nt, Human
cugugucuuucgcuuuguuugccucucc

SEQ ID NO: 125639 - RNA, 27 nt, Human
ugcuguugcucaaucuaaucuucgaug

SEQ ID NO: 125640 - RNA, 26 nt, Human
auucuuuuaaucagaguuaguaaugu

SEQ ID NO: 125641 - RNA, 23 nt, Human
uaucggccaggcuggagugcagu

SEQ ID NO: 125642 - RNA, 26 nt, Human
gucuucaugaacacuaauagggguac

SEQ ID NO: 125643 - RNA, 21 nt, Human
agaaccucaaucuuuaguucc

SEQ ID NO: 125644 - RNA, 25 nt, Human
ccacacugaggagaagcacucugaa

SEQ ID NO: 125645 - RNA, 24 nt, Human
cccagaccccacacacggccgccc

SEQ ID NO: 125646 - RNA, 20 nt, Human
gagggcgaguucagcaaaga

SEQ ID NO: 125647 - RNA, 25 nt, Human
uucuaaacugcucaauuuugacuca

SEQ ID NO: 125648 - RNA, 20 nt, Human
cucugcccucuccccacccc

SEQ ID NO: 125649 - RNA, 22 nt, Human
aauggacaaaaugucucuuaga

SEQ ID NO: 125650 - RNA, 24 nt, Human
ccuggcucugguucaacaaaaggg

SEQ ID NO: 125651 - RNA, 22 nt, Human
guccccacagauaacugaaaau

SEQ ID NO: 125652 - RNA, 23 nt, Human
cauucagguuggggagugaagug

SEQ ID NO: 125653 - RNA, 20 nt, Human
cugucucauccaaaaagucu

SEQ ID NO: 125654 - RNA, 23 nt, Human
agguccagcaaaagucaguaggg

SEQ ID NO: 125655 - RNA, 23 nt, Human
aucgcccaggcuggagugcaaug

SEQ ID NO: 125656 - RNA, 22 nt, Human
uuuguugcccaggcuggagugc

SEQ ID NO: 125657 - RNA, 25 nt, Human
ccccugccugcugccucagucugca

SEQ ID NO: 125658 - RNA, 24 nt, Human
guacauaggcuaauuaaugugagu

SEQ ID NO: 125659 - RNA, 20 nt, Human
cuucugacacacugacagug

SEQ ID NO: 125660 - RNA, 19 nt, Human
ggccucugccuuugcacca

SEQ ID NO: 125661 - RNA, 21 nt, Human
cucagacugacacacagccag

SEQ ID NO: 125662 - RNA, 21 nt, Human
ucugacuuuuaaaaacaacuu

SEQ ID NO: 125663 - RNA, 20 nt, Human
cucuuaaaaaucuugguuug

SEQ ID NO: 125664 - RNA, 25 nt, Human
aaugacacagauuuguagcgugaaa

SEQ ID NO: 125665 - RNA, 25 nt, Human
guccuacuacagucuggaguggggu

SEQ ID NO: 125666 - RNA, 22 nt, Human
uggccaggucauuagagcugag

SEQ ID NO: 125667 - RNA, 22 nt, Human
gcggcggcgggcaguugcagug

SEQ ID NO: 125668 - RNA, 22 nt, Human
cagcacugaaucccagcgcugc

SEQ ID NO: 125669 - RNA, 31 nt, Human
gccuccugacagcuccgucauggcacuuuuu

SEQ ID NO: 125670 - RNA, 27 nt, Human
ugucacccaggcgggaguggugcaaug

SEQ ID NO: 125671 - RNA, 22 nt, Human
gggcgggugugaggggaacagc

SEQ ID NO: 125672 - RNA, 23 nt, Human
gacggauuuucucuaaucagugu

SEQ ID NO: 125673 - RNA, 27 nt, Human
uucccauccaauuguuugguuucagug

SEQ ID NO: 125674 - RNA, 27 nt, Human
ggagagggucaaggaguacuccaagac

SEQ ID NO: 125675 - RNA, 17 nt, Human
accauucacagugcaag

SEQ ID NO: 125676 - RNA, 22 nt, Human
auuggcaccugccuccucuucg

SEQ ID NO: 125677 - RNA, 26 nt, Human
gccacugccacacgucugacccucuc

SEQ ID NO: 125678 - RNA, 20 nt, Human
cucagagaucucccuucuca

SEQ ID NO: 125679 - RNA, 22 nt, Human
gaaaggagaaugaacaaaugug

SEQ ID NO: 125680 - RNA, 27 nt, Human
acauuuaaacuguauuuaccaguguga

SEQ ID NO: 125681 - RNA, 27 nt, Human
gggaggcgggaguggaguggaagaaga

SEQ ID NO: 125682 - RNA, 22 nt, Human
ggccagccuggccaacauggcg

SEQ ID NO: 125683 - RNA, 24 nt, Human
aggguagguucucagacacugccg

SEQ ID NO: 125684 - RNA, 22 nt, Human
uccuccaggagucucagccuuu

SEQ ID NO: 125685 - RNA, 25 nt, Human
ggcacuguacauaccugcccccuca

SEQ ID NO: 125686 - RNA, 21 nt, Human
gaccuuggcugacauauguug

SEQ ID NO: 125687 - RNA, 20 nt, Human
accaguaguuuauuuuuugc

SEQ ID NO: 125688 - RNA, 21 nt, Human
gugccgauuucaugcauucua

SEQ ID NO: 125689 - RNA, 20 nt, Human
guuuuuaaacauuuuuccug

SEQ ID NO: 125690 - RNA, 24 nt, Human
ccacagccccugccugggucucca

SEQ ID NO: 125691 - RNA, 27 nt, Human
cuccaucuccucaaaauaguugcugac

SEQ ID NO: 125692 - RNA, 22 nt, Human
cucuucacucugcugaagcucc

SEQ ID NO: 125693 - RNA, 24 nt, Human
cacaggcuggagugcaguggugug

SEQ ID NO: 125694 - RNA, 21 nt, Human
uggguuuuggagccucccuuc

SEQ ID NO: 125695 - RNA, 27 nt, Human
ucuaugucauauuuugccacugccuuu

SEQ ID NO: 125696 - RNA, 24 nt, Human
aguuuggccagguggacuguggca

SEQ ID NO: 125697 - RNA, 22 nt, Human
uggugugugacuauaaucccag

SEQ ID NO: 125698 - RNA, 21 nt, Human
gguccaaauacugucugucaa

SEQ ID NO: 125699 - RNA, 21 nt, Human
gaacagcaaaucaaaacacca

SEQ ID NO: 125700 - RNA, 22 nt, Human
cuggaaguggagguugcaguga

SEQ ID NO: 125701 - RNA, 27 nt, Human
gucucugagccgagggcaugugagcug

SEQ ID NO: 125702 - RNA, 21 nt, Human
gggccugcagcuccuggaguu

SEQ ID NO: 125703 - RNA, 21 nt, Human
uucccaggcuugccuuuagug

SEQ ID NO: 125704 - RNA, 20 nt, Human
gugggugggacaggagugug

SEQ ID NO: 125705 - RNA, 24 nt, Human
gaguugcugagugugcacaccuuu

SEQ ID NO: 125706 - RNA, 27 nt, Human
uuucugcugguuacacgugucucucac

SEQ ID NO: 125707 - RNA, 19 nt, Human
ccucucucacccacacuca

SEQ ID NO: 125708 - RNA, 20 nt, Human
ggacagcuuccuuguguggg

SEQ ID NO: 125709 - RNA, 22 nt, Human
uuucccaagcuggagugcagug

SEQ ID NO: 125710 - RNA, 22 nt, Human
ucugccacccaggcuggaguac

SEQ ID NO: 125711 - RNA, 26 nt, Human
cccacacucccuauuuugggcccuca

SEQ ID NO: 125712 - RNA, 19 nt, Human
ugaggggaaaaaacuggga

SEQ ID NO: 125713 - RNA, 25 nt, Human
gcccagacugaagugcaguggcaca

SEQ ID NO: 125714 - RNA, 19 nt, Human
agcaagaauagaugugaga

SEQ ID NO: 125715 - RNA, 27 nt, Human
caggaggugguggggucugacgugucc

SEQ ID NO: 125716 - RNA, 26 nt, Human
gccagcacccaagugcccuccccuca

SEQ ID NO: 125717 - RNA, 23 nt, Human
cagaucagccccauagugcucag

SEQ ID NO: 125718 - RNA, 22 nt, Human
uguaauaaauauaggcaugcag

SEQ ID NO: 125719 - RNA, 22 nt, Human
cuuuucucccugugucuggguc

SEQ ID NO: 125720 - RNA, 19 nt, Human
uucaguuauuauauuuaca

SEQ ID NO: 125721 - RNA, 22 nt, Human
agcaguuuucgcugcugcuacg

SEQ ID NO: 125722 - RNA, 21 nt, Human
uuuuccaugugucuucauucu

SEQ ID NO: 125723 - RNA, 27 nt, Human
cguggguggccgaggaugcugcggggc

SEQ ID NO: 125724 - RNA, 22 nt, Human
gccugaccuccccuuggggacc

SEQ ID NO: 125725 - RNA, 21 nt, Human
gggagugauaucaaauacaaa

SEQ ID NO: 125726 - RNA, 21 nt, Human
ccccgacaaggagacugccuu

SEQ ID NO: 125727 - RNA, 24 nt, Human
ggaaguuggcugcacuugauguuu

SEQ ID NO: 125728 - RNA, 20 nt, Human
agccuguccuuccugacccg

SEQ ID NO: 125729 - RNA, 22 nt, Human
ccggauuucuaacagucccugc

SEQ ID NO: 125730 - RNA, 23 nt, Human
ugagacuguggcaauguguugag

SEQ ID NO: 125731 - RNA, 16 nt, Human
cuuauaaaaauauuua

SEQ ID NO: 125732 - RNA, 27 nt, Human
caggcuggaguguaguggcaugaucug

SEQ ID NO: 125733 - RNA, 18 nt, Human
ugugagugccuuuugcag

SEQ ID NO: 125734 - RNA, 20 nt, Human
ggugucuguuucccaccuca

SEQ ID NO: 125735 - RNA, 25 nt, Human
augccucugcugcuuuugcuuugua

SEQ ID NO: 125736 - RNA, 25 nt, Human
ucgggccaaaccccaagacagcuac

SEQ ID NO: 125737 - RNA, 21 nt, Human
cuuauuucucacugcggccca

SEQ ID NO: 125738 - RNA, 24 nt, Human
gauuagauucaucuauggagggca

SEQ ID NO: 125739 - RNA, 27 nt, Human
gacagagacugcagggguccacuguga

SEQ ID NO: 125740 - RNA, 22 nt, Human
gauggguggagaggaugaugaa

SEQ ID NO: 125741 - RNA, 20 nt, Human
gggagagaguagcugcagcc

SEQ ID NO: 125742 - RNA, 17 nt, Human
ucaagugguuggaacac

SEQ ID NO: 125743 - RNA, 26 nt, Human
ucucuagccaagccccaccuuuguua

SEQ ID NO: 125744 - RNA, 28 nt, Human
ccagaaguagcugggauuuguuugcaaa

SEQ ID NO: 125745 - RNA, 20 nt, Human
auguuuguccuucucugccu

SEQ ID NO: 125746 - RNA, 21 nt, Human
gcaagccacacgggcagucac

SEQ ID NO: 125747 - RNA, 22 nt, Human
cauguaaauaaauacauucuug

SEQ ID NO: 125748 - RNA, 23 nt, Human
accuccagaagucccuucaauuu

SEQ ID NO: 125749 - RNA, 21 nt, Human
ugcucugccccuugugcucag

SEQ ID NO: 125750 - RNA, 22 nt, Human
cuccccagcccccaguucucuc

SEQ ID NO: 125751 - RNA, 23 nt, Human
gaaagccuucaagaugucaaaua

SEQ ID NO: 125752 - RNA, 25 nt, Human
gguccugugacuugguaacauucua

SEQ ID NO: 125753 - RNA, 19 nt, Human
ugagccagcagcuguugua

SEQ ID NO: 125754 - RNA, 21 nt, Human
cuguguccugugaauggaagg

SEQ ID NO: 125755 - RNA, 25 nt, Human
uagcacugaauuccuucuucacugu

SEQ ID NO: 125756 - RNA, 27 nt, Human
agggagagagugcuauuguagagccag

SEQ ID NO: 125757 - RNA, 27 nt, Human
cggccuggaccuuggcccuacagcccu

SEQ ID NO: 125758 - RNA, 23 nt, Human
uauuaguuuucuaaaacucaacu

SEQ ID NO: 125759 - RNA, 21 nt, Human
uccagcucuuuauuacauagc

SEQ ID NO: 125760 - RNA, 20 nt, Human
gcugggguggggaagggagg

SEQ ID NO: 125761 - RNA, 20 nt, Human
cauaaaaggagaaccagcac

SEQ ID NO: 125762 - RNA, 27 nt, Human
uucacagucucucuuccuucugacuag

SEQ ID NO: 125763 - RNA, 23 nt, Human
aucacaccauugcccuccagccu

SEQ ID NO: 125764 - RNA, 24 nt, Human
auuuuucugaacacaauaaacuau

SEQ ID NO: 125765 - RNA, 26 nt, Human
cagcucgcucucagaaaaggaaccug

SEQ ID NO: 125766 - RNA, 23 nt, Human
aagagacagagucucacucuguc

SEQ ID NO: 125767 - RNA, 21 nt, Human
gccacugcacuccaucuuggg

SEQ ID NO: 125768 - RNA, 21 nt, Human
aaaaugaaagaacaccucugg

SEQ ID NO: 125769 - RNA, 20 nt, Human
cucccagguaaaauccaggg

SEQ ID NO: 125770 - RNA, 20 nt, Human
cuccaucucacuaaggguua

SEQ ID NO: 125771 - RNA, 25 nt, Human
uuagaaaaggcauagucuacuuguu

SEQ ID NO: 125772 - RNA, 22 nt, Human
ccuaguagcugggaugacaggc

SEQ ID NO: 125773 - RNA, 23 nt, Human
gggacagagacuggagcucaauc

SEQ ID NO: 125774 - RNA, 24 nt, Human
ccuuguuuguacuguaugccuuca

SEQ ID NO: 125775 - RNA, 24 nt, Human
gcacuugcugcugccuccugggcu

SEQ ID NO: 125776 - RNA, 23 nt, Human
cgcccugggccagccuccggcgg

SEQ ID NO: 125777 - RNA, 22 nt, Human
ggcccccugcccgcccaccucc

SEQ ID NO: 125778 - RNA, 22 nt, Human
cuugcaguucuugaguugcggc

SEQ ID NO: 125779 - RNA, 23 nt, Human
ucauccagcaaaguugccuggga

SEQ ID NO: 125780 - RNA, 21 nt, Human
gauccaugggagcauucucaa

SEQ ID NO: 125781 - RNA, 23 nt, Human
cuaucuguuuuuaaagcaccgag

SEQ ID NO: 125782 - RNA, 27 nt, Human
agugccucagagagaacuguacggggu

SEQ ID NO: 125783 - RNA, 29 nt, Human
gguuguugccagguugcagcugcucuugc

SEQ ID NO: 125784 - RNA, 24 nt, Human
gcaggguuacacaaaaaucuagcu

SEQ ID NO: 125785 - RNA, 23 nt, Human
gugucucccuagcucgcugccuc

SEQ ID NO: 125786 - RNA, 25 nt, Human
ucggcucgugcucaucauccugugc

SEQ ID NO: 125787 - RNA, 20 nt, Human
ucccccacugcaagguuguu

SEQ ID NO: 125788 - RNA, 24 nt, Human
cuuuucuuuacuuugcuuauauuc

SEQ ID NO: 125789 - RNA, 23 nt, Human
ggcgucagaaaauggaaaaagag

SEQ ID NO: 125790 - RNA, 19 nt, Human
gaccauccggucaccagaa

SEQ ID NO: 125791 - RNA, 20 nt, Human
ccugguggcaggcuucacug

SEQ ID NO: 125792 - RNA, 18 nt, Human
cucaaaccacauggacca

SEQ ID NO: 125793 - RNA, 27 nt, Human
caucacugcacucagaccagaaaucua

SEQ ID NO: 125794 - RNA, 20 nt, Human
aaaaagcuuggccaacgcuu

SEQ ID NO: 125795 - RNA, 25 nt, Human
uggcacuucaaacuauuaaaaugca

SEQ ID NO: 125796 - RNA, 25 nt, Human
gggccgagauucuccagcagaaaga

SEQ ID NO: 125797 - RNA, 20 nt, Human
uccaugugacaaguuugaca

SEQ ID NO: 125798 - RNA, 27 nt, Human
ugcacgcuggggaucccggaccucgau

SEQ ID NO: 125799 - RNA, 27 nt, Human
caggcugggguaagccgggguuccaca

SEQ ID NO: 125800 - RNA, 29 nt, Human
gcuaugcuacagucucuagcuaaauggaa

SEQ ID NO: 125801 - RNA, 22 nt, Human
cuuggccucccaaguagcuggg

SEQ ID NO: 125802 - RNA, 23 nt, Human
ccgcugccucuacccccgccacg

SEQ ID NO: 125803 - RNA, 23 nt, Human
gcagagcccugacccacagcugu

SEQ ID NO: 125804 - RNA, 20 nt, Human
ggaguuuaaggcugcaguga

SEQ ID NO: 125805 - RNA, 21 nt, Human
gagcgggacucuguccaacaa

SEQ ID NO: 125806 - RNA, 23 nt, Human
uuuugccauguuuauuaaauuuu

SEQ ID NO: 125807 - RNA, 23 nt, Human
aaggaugaagagguuccugucau

SEQ ID NO: 125808 - RNA, 24 nt, Human
gcugggagaagaggaagcgccuug

SEQ ID NO: 125809 - RNA, 26 nt, Human
cugccucuguguagccgcccugagag

SEQ ID NO: 125810 - RNA, 24 nt, Human
acccagaguucccucacugaagau

SEQ ID NO: 125811 - RNA, 24 nt, Human
auccaaauuguuuaaauucacaau

SEQ ID NO: 125812 - RNA, 22 nt, Human
ucaucuguuuucauagugugag

SEQ ID NO: 125813 - RNA, 22 nt, Human
uuucauguuauuucaaagcauu

SEQ ID NO: 125814 - RNA, 21 nt, Human
ggcucacugcaaacccgccuc

SEQ ID NO: 125815 - RNA, 22 nt, Human
augacugucaggaggugcuggc

SEQ ID NO: 125816 - RNA, 23 nt, Human
caggggugaacuguucacugugg

SEQ ID NO: 125817 - RNA, 23 nt, Human
ucaucuuaaugcaacuuccuuug

SEQ ID NO: 125818 - RNA, 20 nt, Human
acuuuagcaaaauguuuuca

SEQ ID NO: 125819 - RNA, 21 nt, Human
ugaguauuaauaaagaagaua

SEQ ID NO: 125820 - RNA, 23 nt, Human
cucagccuagacccuccuccucc

SEQ ID NO: 125821 - RNA, 23 nt, Human
uguacauuuuugaagugugcagg

SEQ ID NO: 125822 - RNA, 26 nt, Human
gagugagugugcccuucacacuguga

SEQ ID NO: 125823 - RNA, 21 nt, Human
cagaaauuacucaaugcugaa

SEQ ID NO: 125824 - RNA, 22 nt, Human
augaaugauacuuugcacuggg

SEQ ID NO: 125825 - RNA, 21 nt, Human
acugagugccuuuugguggag

SEQ ID NO: 125826 - RNA, 20 nt, Human
gggcauuugaacauaucagg

SEQ ID NO: 125827 - RNA, 20 nt, Human
aaucccuuaccaauuuguca

SEQ ID NO: 125828 - RNA, 22 nt, Human
uguggcccaggcuggagugcag

SEQ ID NO: 125829 - RNA, 22 nt, Human
ugucacccaggcgggaguggug

SEQ ID NO: 125830 - RNA, 23 nt, Human
agucaugugcauuuccacgucaa

SEQ ID NO: 125831 - RNA, 22 nt, Human
ggcuguguagauaaaauugugc

SEQ ID NO: 125832 - RNA, 20 nt, Human
acaaacuccagaacagcaga

SEQ ID NO: 125833 - RNA, 27 nt, Human
ugaccaacauggagaaacccugucucu

SEQ ID NO: 125834 - RNA, 23 nt, Human
ggucaggucgggcaccuacuaca

SEQ ID NO: 125835 - RNA, 20 nt, Human
ccuagcuuugauggcagcaa

SEQ ID NO: 125836 - RNA, 26 nt, Human
gcacacaagcuuguuaaccccaccuc

SEQ ID NO: 125837 - RNA, 25 nt, Human
gggcugcugcuuagcuugcaccuug

SEQ ID NO: 125838 - RNA, 21 nt, Human
guuuuucguuccuuguauuua

SEQ ID NO: 125839 - RNA, 23 nt, Human
aauuggucuuaaaaaugauguua

SEQ ID NO: 125840 - RNA, 23 nt, Human
cugaaacuauggaaaugcugcua

SEQ ID NO: 125841 - RNA, 27 nt, Human
ugcagcucuccgggcgaugccagaaua

SEQ ID NO: 125842 - RNA, 25 nt, Human
ugcagcuguagauucucacugugaa

SEQ ID NO: 125843 - RNA, 21 nt, Human
cggggagggggcacggcaggc

SEQ ID NO: 125844 - RNA, 21 nt, Human
caggagacggagguugcagug

SEQ ID NO: 125845 - RNA, 27 nt, Human
ggagagggaggaagaggauggcagggc

SEQ ID NO: 125846 - RNA, 21 nt, Human
gagugguucucauuuggucug

SEQ ID NO: 125847 - RNA, 27 nt, Human
cccgaguagcugggauuacaagugcgc

SEQ ID NO: 125848 - RNA, 20 nt, Human
gacacauccucucauacucc

SEQ ID NO: 125849 - RNA, 23 nt, Human
cgagggaggagagaggggcucgg

SEQ ID NO: 125850 - RNA, 26 nt, Human
guggaaagagcguccauaggagaagu

SEQ ID NO: 125851 - RNA, 26 nt, Human
uggucucaaacuccccagcuaaagca

SEQ ID NO: 125852 - RNA, 19 nt, Human
ucagugagucagaggcaga

SEQ ID NO: 125853 - RNA, 20 nt, Human
cccuuuauucguuuguacuc

SEQ ID NO: 125854 - RNA, 26 nt, Human
ccggaaggaggagcaagagccagggg

SEQ ID NO: 125855 - RNA, 20 nt, Human
guacuuuaccccacagcuua

SEQ ID NO: 125856 - RNA, 23 nt, Human
gccucagguggagugggcagagg

SEQ ID NO: 125857 - RNA, 21 nt, Human
uggcaucccagguuccugccc

SEQ ID NO: 125858 - RNA, 20 nt, Human
ggcgggguggagacccggaa

SEQ ID NO: 125859 - RNA, 27 nt, Human
ugugacuuugggcaagccaagugcccu

SEQ ID NO: 125860 - RNA, 21 nt, Human
aaacaccucccaggggcucca

SEQ ID NO: 125861 - RNA, 24 nt, Human
cuucugugacuccagugacucaga

SEQ ID NO: 125862 - RNA, 23 nt, Human
gggugugaaaucuucagcaaagg

SEQ ID NO: 125863 - RNA, 19 nt, Human
auuaucuuauuuaauuuuu

SEQ ID NO: 125864 - RNA, 21 nt, Human
ccuuuuuuaaaacacagucuu

SEQ ID NO: 125865 - RNA, 20 nt, Human
aggaagaguguuggucuuca

SEQ ID NO: 125866 - RNA, 21 nt, Human
aaaugaugcagcuggugcccg

SEQ ID NO: 125867 - RNA, 21 nt, Human
ucacccuguuggucagaaaga

SEQ ID NO: 125868 - RNA, 22 nt, Human
aucacacccuguaaucgggccc

SEQ ID NO: 125869 - RNA, 26 nt, Human
cauagcccugguacaugguacacaca

SEQ ID NO: 125870 - RNA, 19 nt, Human
gguguucuucuucccaguu

SEQ ID NO: 125871 - RNA, 22 nt, Human
uuaacucccuccaccagccugc

SEQ ID NO: 125872 - RNA, 18 nt, Human
guggaaaugccaaaccaa

SEQ ID NO: 125873 - RNA, 24 nt, Human
gggaguugacaggccagggagagg

SEQ ID NO: 125874 - RNA, 24 nt, Human
aaggaugagggguuaauuuaucag

SEQ ID NO: 125875 - RNA, 27 nt, Human
gucauugacuucgggcuggaccguugc

SEQ ID NO: 125876 - RNA, 26 nt, Human
cuuucucacuuacaggggagaaggaa

SEQ ID NO: 125877 - RNA, 27 nt, Human
cuuuugcccuuugucaucaccaacaca

SEQ ID NO: 125878 - RNA, 21 nt, Human
uuuagugcuuaaaacgaauag

SEQ ID NO: 125879 - RNA, 21 nt, Human
ucauagaauuucuugcugcca

SEQ ID NO: 125880 - RNA, 21 nt, Human
uuccccaaauaauuguugugu

SEQ ID NO: 125881 - RNA, 20 nt, Human
ucuacuccucuuuccguggc

SEQ ID NO: 125882 - RNA, 26 nt, Human
cuggaccuggcuggaaggaaaagaag

SEQ ID NO: 125883 - RNA, 19 nt, Human
caguuccucagcuggucau

SEQ ID NO: 125884 - RNA, 20 nt, Human
uucucaccuccucuuagccc

SEQ ID NO: 125885 - RNA, 27 nt, Human
aaacagcuaugugauuaaaauauuuua

SEQ ID NO: 125886 - RNA, 27 nt, Human
uucccaauugcuuuaccuuuuuucuua

SEQ ID NO: 125887 - RNA, 21 nt, Human
cacugcaccuggccuuauaaa

SEQ ID NO: 125888 - RNA, 24 nt, Human
guugcucagagugaagagugaaga

SEQ ID NO: 125889 - RNA, 27 nt, Human
gggagagaugacuggggagcgacccag

SEQ ID NO: 125890 - RNA, 27 nt, Human
uuggggaccuggcuucauucugcucuc

SEQ ID NO: 125891 - RNA, 23 nt, Human
ucuggucuccuuggagaaagguu

SEQ ID NO: 125892 - RNA, 21 nt, Human
gacccugugugaaauuaaaag

SEQ ID NO: 125893 - RNA, 24 nt, Human
ggcauuguggccagcucugccucu

SEQ ID NO: 125894 - RNA, 17 nt, Human
ugcuaucugccgcugcu

SEQ ID NO: 125895 - RNA, 27 nt, Human
cucagcuuuacaaaugccuugguaugu

SEQ ID NO: 125896 - RNA, 23 nt, Human
cugggcuaggggacaucagaggu

SEQ ID NO: 125897 - RNA, 22 nt, Human
auuuugaagaaaacacaacauu

SEQ ID NO: 125898 - RNA, 20 nt, Human
acuuuugcuguuugaaaauc

SEQ ID NO: 125899 - RNA, 19 nt, Human
aaaccucccuuccccagca

SEQ ID NO: 125900 - RNA, 22 nt, Human
gaaccugugaggaagagguugc

SEQ ID NO: 125901 - RNA, 24 nt, Human
ccuccauccggcuccugucauccc

SEQ ID NO: 125902 - RNA, 20 nt, Human
gucaagaauaaaaguaugua

SEQ ID NO: 125903 - RNA, 25 nt, Human
ucaucccagcacaggcagcgcaugg

SEQ ID NO: 125904 - RNA, 22 nt, Human
ggaauagaggaauguguucggg

SEQ ID NO: 125905 - RNA, 24 nt, Human
ggagucagaaagcaagaccaggaa

SEQ ID NO: 125906 - RNA, 22 nt, Human
cagcagugccuucuucauccuu

SEQ ID NO: 125907 - RNA, 25 nt, Human
ggcccagcacaggcacuuucuagau

SEQ ID NO: 125908 - RNA, 19 nt, Human
agaugucccuuugauggcc

SEQ ID NO: 125909 - RNA, 26 nt, Human
uuccuggucacaucauuaacugcuaa

SEQ ID NO: 125910 - RNA, 21 nt, Human
gccuuccuggccagccaggug

SEQ ID NO: 125911 - RNA, 20 nt, Human
ccccucuccugcccaccucg

SEQ ID NO: 125912 - RNA, 22 nt, Human
cccugguuguguggacuccuua

SEQ ID NO: 125913 - RNA, 24 nt, Human
cggaacucuucaucuuaaacuaca

SEQ ID NO: 125914 - RNA, 22 nt, Human
uauugacuguguuuucuucuua

SEQ ID NO: 125915 - RNA, 26 nt, Human
gaauaaauuaugaagcauacuaauga

SEQ ID NO: 125916 - RNA, 22 nt, Human
caaggagcagcccugcccaggg

SEQ ID NO: 125917 - RNA, 26 nt, Human
cccacaccccuccuugcuggaaugug

SEQ ID NO: 125918 - RNA, 25 nt, Human
ugauccacaaacaagaggagcacca

SEQ ID NO: 125919 - RNA, 23 nt, Human
uucucugaauccucuucacuggc

SEQ ID NO: 125920 - RNA, 20 nt, Human
uucaguuugucucuuugcaa

SEQ ID NO: 125921 - RNA, 20 nt, Human
uggugaggacagcaggaggg

SEQ ID NO: 125922 - RNA, 24 nt, Human
ugggacccacuucccaugcuggau

SEQ ID NO: 125923 - RNA, 27 nt, Human
gcggggccgccucccucuucucuccag

SEQ ID NO: 125924 - RNA, 25 nt, Human
aaaugauguacuguacugcuguuua

SEQ ID NO: 125925 - RNA, 27 nt, Human
gccucaacuuccugggcucaagugacc

SEQ ID NO: 125926 - RNA, 26 nt, Human
cacccuaccugugccugacccuacuu

SEQ ID NO: 125927 - RNA, 20 nt, Human
gcagaaauuuugaagccaga

SEQ ID NO: 125928 - RNA, 23 nt, Human
ggcuggagucuggcucaaaacuc

SEQ ID NO: 125929 - RNA, 20 nt, Human
agccccaccuccagcccauc

SEQ ID NO: 125930 - RNA, 22 nt, Human
ucaugccauugcacuccaaccu

SEQ ID NO: 125931 - RNA, 22 nt, Human
cugaggcaugagaaucacuuga

SEQ ID NO: 125932 - RNA, 21 nt, Human
gugcagcuguagaaaagugcu

SEQ ID NO: 125933 - RNA, 21 nt, Human
ugaguugcaauuucucucggg

SEQ ID NO: 125934 - RNA, 23 nt, Human
ucgccugcggacucggugcagug

SEQ ID NO: 125935 - RNA, 23 nt, Human
acuacuacuacuacuguucaguu

SEQ ID NO: 125936 - RNA, 20 nt, Human
cuacagugacuauuuuucuc

SEQ ID NO: 125937 - RNA, 25 nt, Human
gguuccagaccaagaguacaggaaa

SEQ ID NO: 125938 - RNA, 23 nt, Human
gggcuggacuucuggagcugcua

SEQ ID NO: 125939 - RNA, 27 nt, Human
cccugcuuccuccuccacuccuggccg

SEQ ID NO: 125940 - RNA, 26 nt, Human
ggagaacuucucccacauaauauaua

SEQ ID NO: 125941 - RNA, 26 nt, Human
gcuggcuggguccucuucugccccca

SEQ ID NO: 125942 - RNA, 19 nt, Human
uguccuuuuucuugcugau

SEQ ID NO: 125943 - RNA, 23 nt, Human
cacugagugccuacucuuugcca

SEQ ID NO: 125944 - RNA, 25 nt, Human
caacccucugaggauggaaggcagu

SEQ ID NO: 125945 - RNA, 21 nt, Human
acauuuauaauuacuguguaa

SEQ ID NO: 125946 - RNA, 20 nt, Human
gcugcucucccuggacgacc

SEQ ID NO: 125947 - RNA, 21 nt, Human
uugggaggcagaguugggagg

SEQ ID NO: 125948 - RNA, 23 nt, Human
ccuuaagcugcuuuuuucuucua

SEQ ID NO: 125949 - RNA, 23 nt, Human
aauagggucagagaccauuucag

SEQ ID NO: 125950 - RNA, 22 nt, Human
cacugcugacccagaggggcug

SEQ ID NO: 125951 - RNA, 22 nt, Human
acaccuguagauauuacuguac

SEQ ID NO: 125952 - RNA, 20 nt, Human
gggagccaggagaccugcuc

SEQ ID NO: 125953 - RNA, 22 nt, Human
ccugccugguugggcuuccugg

SEQ ID NO: 125954 - RNA, 27 nt, Human
ccugccuccaccugcccccaccugcuc

SEQ ID NO: 125955 - RNA, 20 nt, Human
uccuacuuaugcagaaaaau

SEQ ID NO: 125956 - RNA, 23 nt, Human
gcacagccgagcuuuuacucccu

SEQ ID NO: 125957 - RNA, 22 nt, Human
gugucucucuggcucucuggca

SEQ ID NO: 125958 - RNA, 22 nt, Human
gacccuggcaccugugucuacu

SEQ ID NO: 125959 - RNA, 21 nt, Human
agcccacccucuccuggugcu

SEQ ID NO: 125960 - RNA, 20 nt, Human
cagaauauuagugaccucag

SEQ ID NO: 125961 - RNA, 20 nt, Human
aacucccucagggccugugu

SEQ ID NO: 125962 - RNA, 25 nt, Human
acaguggcaacugaaaugcauuuca

SEQ ID NO: 125963 - RNA, 19 nt, Human
gcccaggcugcagugcagu

SEQ ID NO: 125964 - RNA, 23 nt, Human
augugguugaaagggcacuggac

SEQ ID NO: 125965 - RNA, 27 nt, Human
cuccaucuaaaaucuccaaggaagcaa

SEQ ID NO: 125966 - RNA, 23 nt, Human
cuaccgcuuucgcuuucccuucg

SEQ ID NO: 125967 - RNA, 27 nt, Human
ugggaggcaugggaaacagugcaguga

SEQ ID NO: 125968 - RNA, 18 nt, Human
cccauccuguucucgggg

SEQ ID NO: 125969 - RNA, 26 nt, Human
gccuuuugacggccuucuugguuuca

SEQ ID NO: 125970 - RNA, 22 nt, Human
caggcuagagugcaguggcuau

SEQ ID NO: 125971 - RNA, 22 nt, Human
gaacuccuggacuuagacgauc

SEQ ID NO: 125972 - RNA, 20 nt, Human
agauauaguaaaugcaucuc

SEQ ID NO: 125973 - RNA, 26 nt, Human
ugaaaccguaugaaugcagcgaaugu

SEQ ID NO: 125974 - RNA, 25 nt, Human
gcugcugccuugcaguuugaucuca

SEQ ID NO: 125975 - RNA, 25 nt, Human
auccaggcuggagugcaguggcaug

SEQ ID NO: 125976 - RNA, 21 nt, Human
gcccucucccuggcgccgccu

SEQ ID NO: 125977 - RNA, 21 nt, Human
ccugacccuccugcugccuuc

SEQ ID NO: 125978 - RNA, 23 nt, Human
acucaugaucugcuugacuguga

SEQ ID NO: 125979 - RNA, 21 nt, Human
ugagccaagaucaugccacuc

SEQ ID NO: 125980 - RNA, 15 nt, Human
aucaaaccagcucug

SEQ ID NO: 125981 - RNA, 22 nt, Human
cucuggagagaaacaauaaaga

SEQ ID NO: 125982 - RNA, 22 nt, Human
cugcuucugccguugcugccag

SEQ ID NO: 125983 - RNA, 23 nt, Human
agagcucccaguccccgaggcuu

SEQ ID NO: 125984 - RNA, 21 nt, Human
uuuuguuuuugaacugucuca

SEQ ID NO: 125985 - RNA, 22 nt, Human
ugcuuaacugucuaauauugcc

SEQ ID NO: 125986 - RNA, 23 nt, Human
guggcucucgccuguaaucccag

SEQ ID NO: 125987 - RNA, 24 nt, Human
agcuccagcaaagacuuucacugu

SEQ ID NO: 125988 - RNA, 23 nt, Human
cuucugcugcugcuuuaaaagcu

SEQ ID NO: 125989 - RNA, 21 nt, Human
caaggugggaggaucgcuuga

SEQ ID NO: 125990 - RNA, 23 nt, Human
ggaaaagaagcuggaacacagaa

SEQ ID NO: 125991 - RNA, 27 nt, Human
ggagcccugccuuuuucuacugguucc

SEQ ID NO: 125992 - RNA, 27 nt, Human
ccccugccuccucuauaccccaggcuc

SEQ ID NO: 125993 - RNA, 22 nt, Human
ugccuguaauggugagacuuug

SEQ ID NO: 125994 - RNA, 21 nt, Human
agaggccgagcccagcaaagg

SEQ ID NO: 125995 - RNA, 13 nt, Human
gccacaugccuua

SEQ ID NO: 125996 - RNA, 27 nt, Human
guccgugggugugcagugcccagcacg

SEQ ID NO: 125997 - RNA, 19 nt, Human
gaugccauuaacauucauc

SEQ ID NO: 125998 - RNA, 26 nt, Human
acucuagccccgaacccuccugcccc

SEQ ID NO: 125999 - RNA, 23 nt, Human
augucguccuggauaagguggca

SEQ ID NO: 126000 - RNA, 21 nt, Human
uucuuuucuccccuugagguc

SEQ ID NO: 126001 - RNA, 28 nt, Human
guggggacuugggggacaguaaucaagu

SEQ ID NO: 126002 - RNA, 21 nt, Human
augggggguggagggagguga

SEQ ID NO: 126003 - RNA, 19 nt, Human
gccccuccuucuccggggu

SEQ ID NO: 126004 - RNA, 20 nt, Human
uggaaggcauuguccuguga

SEQ ID NO: 126005 - RNA, 27 nt, Human
ggucucgaacuccugaccuggugauuu

SEQ ID NO: 126006 - RNA, 24 nt, Human
guugaucugcauauuucuguauau

SEQ ID NO: 126007 - RNA, 27 nt, Human
ugcuugaaauuuaacacuuuucacuug

SEQ ID NO: 126008 - RNA, 24 nt, Human
agauagacgugaagcacaugguua

SEQ ID NO: 126009 - RNA, 27 nt, Human
gcccuguggagcaaggcuguguuuccu

SEQ ID NO: 126010 - RNA, 19 nt, Human
ucagaauugcuauuucaaa

SEQ ID NO: 126011 - RNA, 20 nt, Human
ggcggaauguggcagaugaa

SEQ ID NO: 126012 - RNA, 16 nt, Human
acuaguaucuaccuca

SEQ ID NO: 126013 - RNA, 27 nt, Human
uugagccuauuaguuggaggcugcagu

SEQ ID NO: 126014 - RNA, 20 nt, Human
uauuccaugacucaggauuu

SEQ ID NO: 126015 - RNA, 19 nt, Human
ugcccccaacuuggcucgg

SEQ ID NO: 126016 - RNA, 25 nt, Human
cgcccuuaacugcauccagccuggg

SEQ ID NO: 126017 - RNA, 20 nt, Human
gggcugcugcuucugcucca

SEQ ID NO: 126018 - RNA, 23 nt, Human
agguacuagaaugcuuacggcca

SEQ ID NO: 126019 - RNA, 24 nt, Human
ccugcagcgagagcaccgcagcau

SEQ ID NO: 126020 - RNA, 24 nt, Human
agcagguaaagcagucacugugaa

SEQ ID NO: 126021 - RNA, 18 nt, Human
gggcuagaagagcgagaa

SEQ ID NO: 126022 - RNA, 23 nt, Human
gucacccagccuggcuuugcccc

SEQ ID NO: 126023 - RNA, 18 nt, Human
cccagaacccucucucca

SEQ ID NO: 126024 - RNA, 23 nt, Human
gcuugcccugcucguccugaucc

SEQ ID NO: 126025 - RNA, 26 nt, Human
cugccagugcucucugggccuggcuc

SEQ ID NO: 126026 - RNA, 25 nt, Human
acugaacuucgguguuuucuugaga

SEQ ID NO: 126027 - RNA, 24 nt, Human
ugcugcugugauaaccucuccuuu

SEQ ID NO: 126028 - RNA, 30 nt, Human
ccuuggaggcugugagguugcagcaaaguu

SEQ ID NO: 126029 - RNA, 21 nt, Human
uuaaagugcaucacagccaga

SEQ ID NO: 126030 - RNA, 20 nt, Human
cucuccucgaaaagucaucu

SEQ ID NO: 126031 - RNA, 21 nt, Human
caacaaauuauugauagcuga

SEQ ID NO: 126032 - RNA, 24 nt, Human
ugucgcccuggcuggagugcaaug

SEQ ID NO: 126033 - RNA, 21 nt, Human
agccucccaguagcugggauu

SEQ ID NO: 126034 - RNA, 18 nt, Human
uccaagaaaaacuaccuc

SEQ ID NO: 126035 - RNA, 27 nt, Human
gagcgcaagcccccaccauacaagcac

SEQ ID NO: 126036 - RNA, 27 nt, Human
gccacugaacaucccuucucugcucca

SEQ ID NO: 126037 - RNA, 22 nt, Human
aucagugaccauuuguuggcag

SEQ ID NO: 126038 - RNA, 25 nt, Human
cuucugcuccucagagagcccggcu

SEQ ID NO: 126039 - RNA, 19 nt, Human
ccuguauccauucaugccc

SEQ ID NO: 126040 - RNA, 18 nt, Human
cuugcagauacauucaug

SEQ ID NO: 126041 - RNA, 22 nt, Human
ugccuucagggagacaggcagg

SEQ ID NO: 126042 - RNA, 17 nt, Human
agcuauuugauguaaua

SEQ ID NO: 126043 - RNA, 21 nt, Human
aaugcaguaacauucuacuug

SEQ ID NO: 126044 - RNA, 23 nt, Human
gccauccugaggauagggcagag

SEQ ID NO: 126045 - RNA, 21 nt, Human
ucagguuggggugccccagca

SEQ ID NO: 126046 - RNA, 24 nt, Human
aucuacugcuggcaauugggaacc

SEQ ID NO: 126047 - RNA, 20 nt, Human
ugaacuccugaccucgugau

SEQ ID NO: 126048 - RNA, 15 nt, Human
ggccucggccccuca

SEQ ID NO: 126049 - RNA, 26 nt, Human
accaugucgcucacggucgucagcau

SEQ ID NO: 126050 - RNA, 27 nt, Human
ucugcuccccucagccucccaaagugc

SEQ ID NO: 126051 - RNA, 25 nt, Human
gcuucagcccuggcugcagcugcag

SEQ ID NO: 126052 - RNA, 23 nt, Human
ggcucacugcauccucugccucc

SEQ ID NO: 126053 - RNA, 25 nt, Human
ccucuucugcgcacccaccugcugc

SEQ ID NO: 126054 - RNA, 23 nt, Human
auagaacgacaacaaaauaaaug

SEQ ID NO: 126055 - RNA, 17 nt, Human
caaagacgacuugauac

SEQ ID NO: 126056 - RNA, 17 nt, Human
acugcuucccucaguau

SEQ ID NO: 126057 - RNA, 18 nt, Human
uccaggaccucagcugca

SEQ ID NO: 126058 - RNA, 24 nt, Human
gcagggccgacggccgaguacugc

SEQ ID NO: 126059 - RNA, 21 nt, Human
ccuguaaucccagcucuuugg

SEQ ID NO: 126060 - RNA, 23 nt, Human
uucuacuuguaaacuauggugcu

SEQ ID NO: 126061 - RNA, 23 nt, Human
ccaggacugccccuuccugggcc

SEQ ID NO: 126062 - RNA, 23 nt, Human
auauaugaaaacuauacaacaaa

SEQ ID NO: 126063 - RNA, 18 nt, Human
cugcuuugguuuguuuga

SEQ ID NO: 126064 - RNA, 23 nt, Human
cggggccucggggcagcagugag

SEQ ID NO: 126065 - RNA, 18 nt, Human
ccccgacuucauucacuc

SEQ ID NO: 126066 - RNA, 26 nt, Human
ccgcccagcggcccugcgucuuccca

SEQ ID NO: 126067 - RNA, 24 nt, Human
aaugggaaaauaauuaguuacagu

SEQ ID NO: 126068 - RNA, 27 nt, Human
agccuccaggcccaaacaggcugaagc

SEQ ID NO: 126069 - RNA, 22 nt, Human
uauugaaaaauguuacagacaa

SEQ ID NO: 126070 - RNA, 20 nt, Human
ggaagaaugaacacagcuuu

SEQ ID NO: 126071 - RNA, 23 nt, Human
caagucaggcccuucuggaacac

SEQ ID NO: 126072 - RNA, 22 nt, Human
uccaggcgagagagggggccag

SEQ ID NO: 126073 - RNA, 21 nt, Human
cuugcacugccuucugcgcua

SEQ ID NO: 126074 - RNA, 21 nt, Human
cugaauuuaaaaaguuauaca

SEQ ID NO: 126075 - RNA, 18 nt, Human
ggcccuggagaaacuuca

SEQ ID NO: 126076 - RNA, 27 nt, Human
cugcaauuucccaccuccugcccaucc

SEQ ID NO: 126077 - RNA, 21 nt, Human
gcuguugccuuauuaaugauu

SEQ ID NO: 126078 - RNA, 24 nt, Human
ucuccugcucaccaccugccucua

SEQ ID NO: 126079 - RNA, 24 nt, Human
gggcuguggcuccgacccugcugc

SEQ ID NO: 126080 - RNA, 22 nt, Human
ucgccauggucuccaucguucu

SEQ ID NO: 126081 - RNA, 24 nt, Human
gcucugaggugguggaggcggcgg

SEQ ID NO: 126082 - RNA, 25 nt, Human
ccuugcuagcugaccuggagaugcu

SEQ ID NO: 126083 - RNA, 22 nt, Human
gcgugagccaccaugcucagcc

SEQ ID NO: 126084 - RNA, 22 nt, Human
ucuuccuuaggaauuuugaugg

SEQ ID NO: 126085 - RNA, 20 nt, Human
caacuucagcaccugccccg

SEQ ID NO: 126086 - RNA, 20 nt, Human
ccugcacacagccuggggag

SEQ ID NO: 126087 - RNA, 24 nt, Human
gucacccaggcuggaguacacugg

SEQ ID NO: 126088 - RNA, 22 nt, Human
gggauuacaguugugagccacu

SEQ ID NO: 126089 - RNA, 20 nt, Human
cacuuucuccucccucugcc

SEQ ID NO: 126090 - RNA, 22 nt, Human
gcucaugccuauaaucccagug

SEQ ID NO: 126091 - RNA, 25 nt, Human
gauuaaaaugaguuuauauuuuuuc

SEQ ID NO: 126092 - RNA, 21 nt, Human
gacccgcuucagggccaggag

SEQ ID NO: 126093 - RNA, 19 nt, Human
gagagggaagcgccgcggc

SEQ ID NO: 126094 - RNA, 27 nt, Human
auucuucuguggcaguuaucuuaccuu

SEQ ID NO: 126095 - RNA, 21 nt, Human
agcuaaaaucauuuugcugcu

SEQ ID NO: 126096 - RNA, 22 nt, Human
agaauuagcagagaaaauacac

SEQ ID NO: 126097 - RNA, 22 nt, Human
gcucggagagagaagacgugga

SEQ ID NO: 126098 - RNA, 24 nt, Human
uccuugaggaccuccaccugggag

SEQ ID NO: 126099 - RNA, 21 nt, Human
ucacaaacucacagaccagca

SEQ ID NO: 126100 - RNA, 23 nt, Human
uauuccccuuccuguguccaugu

SEQ ID NO: 126101 - RNA, 27 nt, Human
gguuggucaaggagggaugugagggaa

SEQ ID NO: 126102 - RNA, 21 nt, Human
agaaauguaaagauaacagga

SEQ ID NO: 126103 - RNA, 27 nt, Human
gaggccggcgugacaggcucugucacu

SEQ ID NO: 126104 - RNA, 22 nt, Human
ggccaggcagaucccacuugca

SEQ ID NO: 126105 - RNA, 24 nt, Human
aagaggaagugggaagagaggugg

SEQ ID NO: 126106 - RNA, 27 nt, Human
cuguaugacccuaugcaaguccuccuc

SEQ ID NO: 126107 - RNA, 23 nt, Human
accccuucucugugacccacuuc

SEQ ID NO: 126108 - RNA, 19 nt, Human
auuaucucccuuaguaauc

SEQ ID NO: 126109 - RNA, 22 nt, Human
guucccaggcuggggaugcuuu

SEQ ID NO: 126110 - RNA, 20 nt, Human
auauuuuucagugagccaag

SEQ ID NO: 126111 - RNA, 27 nt, Human
accuugaaaagaagguuggagugcagc

SEQ ID NO: 126112 - RNA, 26 nt, Human
gcauuucucguucuuuacugggucua

SEQ ID NO: 126113 - RNA, 27 nt, Human
gggaggauggaggacggagcugcagac

SEQ ID NO: 126114 - RNA, 21 nt, Human
ugcuccucaaguauuagucaa

SEQ ID NO: 126115 - RNA, 22 nt, Human
uuggugccucaguuucucuguc

SEQ ID NO: 126116 - RNA, 26 nt, Human
ugcaaugucacaaccucucugaucuu

SEQ ID NO: 126117 - RNA, 23 nt, Human
gcggcgcgcugcaggcgcgggga

SEQ ID NO: 126118 - RNA, 23 nt, Human
cuucgccuuugcugauugccucu

SEQ ID NO: 126119 - RNA, 26 nt, Human
accagccugccccauggccccggcuc

SEQ ID NO: 126120 - RNA, 23 nt, Human
cucucaguucaaacugaaggaca

SEQ ID NO: 126121 - RNA, 24 nt, Human
uuaccuuucugucucucgggaccc

SEQ ID NO: 126122 - RNA, 25 nt, Human
ggugguggguggcuuggcauugccc

SEQ ID NO: 126123 - RNA, 25 nt, Human
gggaggaagcagagggagggacugg

SEQ ID NO: 126124 - RNA, 30 nt, Human
ccaggugaggugggagguuggagagccagg

SEQ ID NO: 126125 - RNA, 20 nt, Human
uggucaggcugaucuggaac

SEQ ID NO: 126126 - RNA, 14 nt, Human
ccauccagaagaac

SEQ ID NO: 126127 - RNA, 18 nt, Human
gaauccucacuggugugc

SEQ ID NO: 126128 - RNA, 26 nt, Human
uguccaccauccccagcugguggccc

SEQ ID NO: 126129 - RNA, 26 nt, Human
agggguguugauggugauaagggagg

SEQ ID NO: 126130 - RNA, 26 nt, Human
ugcccaggccauggccggcaacguga

SEQ ID NO: 126131 - RNA, 25 nt, Human
agagaggccgcaaggggaccgcccc

SEQ ID NO: 126132 - RNA, 23 nt, Human
aguccacaccaggcacagauggg

SEQ ID NO: 126133 - RNA, 23 nt, Human
gggauacugugcccagagccucg

SEQ ID NO: 126134 - RNA, 21 nt, Human
ccucagaccacacaguagcca

SEQ ID NO: 126135 - RNA, 20 nt, Human
ucucaucugcacaaucgugc

SEQ ID NO: 126136 - RNA, 19 nt, Human
ucuguaaccuguuuugugc

SEQ ID NO: 126137 - RNA, 24 nt, Human
gaggaacgcccacccacgaaggcc

SEQ ID NO: 126138 - RNA, 19 nt, Human
aaugucugcauaauguuag

SEQ ID NO: 126139 - RNA, 21 nt, Human
ugagacuccuggggaaugacg

SEQ ID NO: 126140 - RNA, 23 nt, Human
caggaagaggcagcugguguucu

SEQ ID NO: 126141 - RNA, 21 nt, Human
ucgggaacuuggcuguguugu

SEQ ID NO: 126142 - RNA, 23 nt, Human
ugccucugggcccucccagcaca

SEQ ID NO: 126143 - RNA, 20 nt, Human
cauugacaaaagcacaguga

SEQ ID NO: 126144 - RNA, 26 nt, Human
uccuacuccuuuccacacauacgcac

SEQ ID NO: 126145 - RNA, 22 nt, Human
cucccuuggggccuaugcagag

SEQ ID NO: 126146 - RNA, 21 nt, Human
uucuguauaaauagcuuauag

SEQ ID NO: 126147 - RNA, 21 nt, Human
cguaggcuggggugaggagug

SEQ ID NO: 126148 - RNA, 21 nt, Human
aaucccugcuacucaggaggc

SEQ ID NO: 126149 - RNA, 23 nt, Human
gggagccguggagguccagguga

SEQ ID NO: 126150 - RNA, 23 nt, Human
ccuccugagugccccacuucugg

SEQ ID NO: 126151 - RNA, 31 nt, Human
cccugccugcucugcagucguggguggggcc

SEQ ID NO: 126152 - RNA, 28 nt, Human
uuuguauuuugcuacugaucugugauca

SEQ ID NO: 126153 - RNA, 26 nt, Human
agccaagagcacagacuuggauuccu

SEQ ID NO: 126154 - RNA, 25 nt, Human
gcauuaggugggcauuuuucugugu

SEQ ID NO: 126155 - RNA, 27 nt, Human
ccuacuucuaccccuucccguccccaa

SEQ ID NO: 126156 - RNA, 22 nt, Human
auugcuugaggccaggaguuug

SEQ ID NO: 126157 - RNA, 22 nt, Human
uagcaauugacugucacuguuc

SEQ ID NO: 126158 - RNA, 22 nt, Human
ggcggggcaagggucucccagc

SEQ ID NO: 126159 - RNA, 20 nt, Human
gacaccuccauuucucucca

SEQ ID NO: 126160 - RNA, 26 nt, Human
uuuaaguaaaaacaaaaugaugcauu

SEQ ID NO: 126161 - RNA, 27 nt, Human
ccccuggaccugccuugguugugucau

SEQ ID NO: 126162 - RNA, 26 nt, Human
gcgggcugggacugcucggccgccuc

SEQ ID NO: 126163 - RNA, 25 nt, Human
ggcagcaagacaacuucuuuuacag

SEQ ID NO: 126164 - RNA, 24 nt, Human
uuuaaaaaauguauuuauggcugg

SEQ ID NO: 126165 - RNA, 21 nt, Human
gccuccugcacagcggcugcc

SEQ ID NO: 126166 - RNA, 27 nt, Human
gggucaugaguaccacccugccugccu

SEQ ID NO: 126167 - RNA, 24 nt, Human
gugaggccuggugccagagcugug

SEQ ID NO: 126168 - RNA, 20 nt, Human
ucagcucuacuguuuacuag

SEQ ID NO: 126169 - RNA, 26 nt, Human
cgccucaccccggcuggagucaugug

SEQ ID NO: 126170 - RNA, 30 nt, Human
cuucuuccuggagcgucccugccuagagcu

SEQ ID NO: 126171 - RNA, 21 nt, Human
augugggagaaaaagugagga

SEQ ID NO: 126172 - RNA, 32 nt, Human
ccuggagaggacggcccugccugccucuuggc

SEQ ID NO: 126173 - RNA, 21 nt, Human
guuguuuucugacuaggcuga

SEQ ID NO: 126174 - RNA, 29 nt, Human
uguugcagaagacugaacuguuuuggaau

SEQ ID NO: 126175 - RNA, 27 nt, Human
gggaggcggagguugcgacccaaagcu

SEQ ID NO: 126176 - RNA, 22 nt, Human
aauugcucuccccucuguggcu

SEQ ID NO: 126177 - RNA, 21 nt, Human
ggguacccagagcucuuagcg

SEQ ID NO: 126178 - RNA, 17 nt, Human
gcuugacccucuugcuu

SEQ ID NO: 126179 - RNA, 21 nt, Human
caaaccugucagugcuccaca

SEQ ID NO: 126180 - RNA, 24 nt, Human
guguccucuucuugucgcuuuuug

SEQ ID NO: 126181 - RNA, 21 nt, Human
cucauuaaugaauacuuccua

SEQ ID NO: 126182 - RNA, 22 nt, Human
ggaacuccugggaucaagccug

SEQ ID NO: 126183 - RNA, 21 nt, Human
ccugccugcccugccuacuga

SEQ ID NO: 126184 - RNA, 27 nt, Human
caguauguugccaagagcccgucugcu

SEQ ID NO: 126185 - RNA, 24 nt, Human
aaauuugaaagaaauuacuuccug

SEQ ID NO: 126186 - RNA, 26 nt, Human
uuguuuugauuugcucuguuuuauuc

SEQ ID NO: 126187 - RNA, 22 nt, Human
agcuucucaaaguacugggauu

SEQ ID NO: 126188 - RNA, 22 nt, Human
gaccauccuggccaacacagug

SEQ ID NO: 126189 - RNA, 22 nt, Human
agguuggguuagagagcuggga

SEQ ID NO: 126190 - RNA, 22 nt, Human
uggcccaugccuguaaucucag

SEQ ID NO: 126191 - RNA, 21 nt, Human
ccccgccucccccugccucag

SEQ ID NO: 126192 - RNA, 24 nt, Human
acuccuccgucgcugcccuucaca

SEQ ID NO: 126193 - RNA, 22 nt, Human
ggcaggagaaaggcaugaaucc

SEQ ID NO: 126194 - RNA, 22 nt, Human
gucuuuacccacuucucaguuu

SEQ ID NO: 126195 - RNA, 26 nt, Human
uggaggagggaguggaguaagaugcc

SEQ ID NO: 126196 - RNA, 29 nt, Human
guaaaauacccaggaaggcaaauguucau

SEQ ID NO: 126197 - RNA, 22 nt, Human
auccaggcuggagugcagugau

SEQ ID NO: 126198 - RNA, 22 nt, Human
cuuugauugucauucuccuggg

SEQ ID NO: 126199 - RNA, 21 nt, Human
uaacagcaccuucccccugca

SEQ ID NO: 126200 - RNA, 25 nt, Human
acuuguugccaggaaggugaccuca

SEQ ID NO: 126201 - RNA, 26 nt, Human
ggcugaugguccuccucagggucuca

SEQ ID NO: 126202 - RNA, 27 nt, Human
cacccagcugccgaggcaaaaaggagc

SEQ ID NO: 126203 - RNA, 22 nt, Human
cucuccaaaacuaaauuugaac

SEQ ID NO: 126204 - RNA, 24 nt, Human
auugggucaagaagugaucuuuag

SEQ ID NO: 126205 - RNA, 27 nt, Human
agggagaccggugcgauggcagagcgc

SEQ ID NO: 126206 - RNA, 24 nt, Human
uuguuucuuucuuucuuuauuuug

SEQ ID NO: 126207 - RNA, 21 nt, Human
cacgagccaccacacccagcu

SEQ ID NO: 126208 - RNA, 23 nt, Human
gauccuugggcccaucacuguau

SEQ ID NO: 126209 - RNA, 25 nt, Human
aguuuauugagugggagacaggcgg

SEQ ID NO: 126210 - RNA, 24 nt, Human
ugccugagugggcucuacugccuu

SEQ ID NO: 126211 - RNA, 23 nt, Human
cuaacacgggugaaaccccgucu

SEQ ID NO: 126212 - RNA, 24 nt, Human
ccauucuaacauguucccagggga

SEQ ID NO: 126213 - RNA, 26 nt, Human
aucugagcacccauugcucaccauca

SEQ ID NO: 126214 - RNA, 29 nt, Human
gucuugcccaggcccuccugggaggggga

SEQ ID NO: 126215 - RNA, 21 nt, Human
gagcccaagcccuguguuccu

SEQ ID NO: 126216 - RNA, 21 nt, Human
gguguuguuggguggcagcug

SEQ ID NO: 126217 - RNA, 24 nt, Human
gcccccaggccaaaguccuuucuc

SEQ ID NO: 126218 - RNA, 21 nt, Human
ccuggcuaauuuuuuguacuu

SEQ ID NO: 126219 - RNA, 22 nt, Human
gcuuccuuucacaaaugagcug

SEQ ID NO: 126220 - RNA, 22 nt, Human
cuaugauugggaaaaauuauaa

SEQ ID NO: 126221 - RNA, 29 nt, Human
ccggcggggacccagggagugguuugggg

SEQ ID NO: 126222 - RNA, 26 nt, Human
ucaagacgucacccuccauucugcac

SEQ ID NO: 126223 - RNA, 24 nt, Human
gcauaccggacuugucacacggac

SEQ ID NO: 126224 - RNA, 21 nt, Human
auagcaggguaggacgcccag

SEQ ID NO: 126225 - RNA, 22 nt, Human
gaccuugacuggagaaacucca

SEQ ID NO: 126226 - RNA, 25 nt, Human
ccuuuccccgggccugcugugcugc

SEQ ID NO: 126227 - RNA, 23 nt, Human
auccucuccuggcaugaaaauaa

SEQ ID NO: 126228 - RNA, 27 nt, Human
ggggugagggacgaguccacgggacac

SEQ ID NO: 126229 - RNA, 24 nt, Human
cccuccuucuccccuaaagggacu

SEQ ID NO: 126230 - RNA, 22 nt, Human
caucgggucuggugcuccagac

SEQ ID NO: 126231 - RNA, 14 nt, Human
uccaauaugccuua

SEQ ID NO: 126232 - RNA, 19 nt, Human
auguaaaaaauguuaacag

SEQ ID NO: 126233 - RNA, 28 nt, Human
gcaccugugaauaacugcacuccagccu

SEQ ID NO: 126234 - RNA, 22 nt, Human
ggccuggacccacccaucuuug

SEQ ID NO: 126235 - RNA, 20 nt, Human
auaagcaguuaugugaccuc

SEQ ID NO: 126236 - RNA, 23 nt, Human
cucugccgccuuuccuccauucc

SEQ ID NO: 126237 - RNA, 22 nt, Human
acucucggcuuccuggcaacgc

SEQ ID NO: 126238 - RNA, 18 nt, Human
uuagaaaauaaauugccu

SEQ ID NO: 126239 - RNA, 24 nt, Human
gccucaaauucuugugaaugugga

SEQ ID NO: 126240 - RNA, 21 nt, Human
gaccagcccagagcuaugcca

SEQ ID NO: 126241 - RNA, 18 nt, Human
agguggcggcaagcacag

SEQ ID NO: 126242 - RNA, 26 nt, Human
cccuacagcaguucaggcuguguggu

SEQ ID NO: 126243 - RNA, 20 nt, Human
ccggaggaggcgggagcagc

SEQ ID NO: 126244 - RNA, 20 nt, Human
ucucgccccuucccucucuc

SEQ ID NO: 126245 - RNA, 20 nt, Human
acauguugauguugauggga

SEQ ID NO: 126246 - RNA, 26 nt, Human
ggcaggccuggcugcgcagggcgcgg

SEQ ID NO: 126247 - RNA, 26 nt, Human
aaaggcauguaauugcuuguuagcaa

SEQ ID NO: 126248 - RNA, 20 nt, Human
gaggcagagucagaggccuc

SEQ ID NO: 126249 - RNA, 27 nt, Human
ggccccucuaguagcugugugcuggau

SEQ ID NO: 126250 - RNA, 27 nt, Human
ccugccugccccuuccucccagcuucc

SEQ ID NO: 126251 - RNA, 20 nt, Human
ccagguggugguaggcggug

SEQ ID NO: 126252 - RNA, 26 nt, Human
gggaggcggagguugcggucagcuga

SEQ ID NO: 126253 - RNA, 18 nt, Human
ccaaacaucuuccaauuu

SEQ ID NO: 126254 - RNA, 18 nt, Human
aagagcugucacaagcac

SEQ ID NO: 126255 - RNA, 27 nt, Human
uggccuuguucugucaccaauguaccc

SEQ ID NO: 126256 - RNA, 23 nt, Human
uuuucauagucauuacucuuuac

SEQ ID NO: 126257 - RNA, 21 nt, Human
gaauuucuuuaaaaaguuuuc

SEQ ID NO: 126258 - RNA, 18 nt, Human
ggccucucccacagcccu

SEQ ID NO: 126259 - RNA, 22 nt, Human
ggagaagagagauggggguucc

SEQ ID NO: 126260 - RNA, 24 nt, Human
cuuucaucuuaccuguaauccuag

SEQ ID NO: 126261 - RNA, 27 nt, Human
ggugaagcucugggccucggcuuuugg

SEQ ID NO: 126262 - RNA, 23 nt, Human
caugacaacugaaggcaaccugg

SEQ ID NO: 126263 - RNA, 22 nt, Human
ugaccuccuuuugaaggggaca

SEQ ID NO: 126264 - RNA, 23 nt, Human
cuguauccacaugguacaagccu

SEQ ID NO: 126265 - RNA, 22 nt, Human
uuucauguucuugcagucauca

SEQ ID NO: 126266 - RNA, 26 nt, Human
gcuggguggggcuggggacacaacaa

SEQ ID NO: 126267 - RNA, 22 nt, Human
ucaggucagcuggaugaugcca

SEQ ID NO: 126268 - RNA, 24 nt, Human
uuugggaaauauagacaagcugga

SEQ ID NO: 126269 - RNA, 21 nt, Human
gugcuucucccuucuccauga

SEQ ID NO: 126270 - RNA, 24 nt, Human
ccaucaccgaacuuccccuccucc

SEQ ID NO: 126271 - RNA, 22 nt, Human
ccauucuucuggugcuacucca

SEQ ID NO: 126272 - RNA, 21 nt, Human
cagcagaaauccaaauuugua

SEQ ID NO: 126273 - RNA, 27 nt, Human
guugcccaggcuggucuugaacuccgg

SEQ ID NO: 126274 - RNA, 22 nt, Human
accuaggcaagagugcaauggc

SEQ ID NO: 126275 - RNA, 21 nt, Human
ccuaagucacagaccucaguc

SEQ ID NO: 126276 - RNA, 26 nt, Human
ggaacugacccugcucucuccuuucc

SEQ ID NO: 126277 - RNA, 25 nt, Human
ucaagccccuggcccuggcccagag

SEQ ID NO: 126278 - RNA, 26 nt, Human
ucuguguauuuugagauaaugucaaa

SEQ ID NO: 126279 - RNA, 20 nt, Human
ucucuguaccuuccucucca

SEQ ID NO: 126280 - RNA, 21 nt, Human
guaauuugggcccagugccuu

SEQ ID NO: 126281 - RNA, 21 nt, Human
ugcucagucccucuggguggg

SEQ ID NO: 126282 - RNA, 26 nt, Human
guuuuuaaaaauucccuuuaugcacc

SEQ ID NO: 126283 - RNA, 22 nt, Human
uacuggauaucccagcucugcu

SEQ ID NO: 126284 - RNA, 22 nt, Human
aucagccccauaacccaggaag

SEQ ID NO: 126285 - RNA, 20 nt, Human
cccuacuuccccuuggggcu

SEQ ID NO: 126286 - RNA, 22 nt, Human
ccaagauugcgccauugcacuc

SEQ ID NO: 126287 - RNA, 26 nt, Human
agauucuucuuugaauccucuagucc

SEQ ID NO: 126288 - RNA, 21 nt, Human
cacucacucauuccuucacuc

SEQ ID NO: 126289 - RNA, 25 nt, Human
ccucagcugcuucucccacuuggcc

SEQ ID NO: 126290 - RNA, 20 nt, Human
guugcccaggcuggugucaa

SEQ ID NO: 126291 - RNA, 21 nt, Human
gcagaggaucugcagcccugg

SEQ ID NO: 126292 - RNA, 24 nt, Human
aguguucuaugguuuaaauuagca

SEQ ID NO: 126293 - RNA, 22 nt, Human
cugcaaccucugccucccgagu

SEQ ID NO: 126294 - RNA, 20 nt, Human
ucuaaugguuuaauuuaggg

SEQ ID NO: 126295 - RNA, 25 nt, Human
gggcucugcguucugcucugggccg

SEQ ID NO: 126296 - RNA, 23 nt, Human
gauccuuagcaaaaguaggaagg

SEQ ID NO: 126297 - RNA, 22 nt, Human
ggcaggcaccuguaaucccagc

SEQ ID NO: 126298 - RNA, 21 nt, Human
aaugcuuucucauuuggaccc

SEQ ID NO: 126299 - RNA, 29 nt, Human
ccgccgaggcgcgagguugcggcgcgcag

SEQ ID NO: 126300 - RNA, 23 nt, Human
cccaccccacauaggaauagccu

SEQ ID NO: 126301 - RNA, 20 nt, Human
uuaggagguugaggcacagc

SEQ ID NO: 126302 - RNA, 27 nt, Human
cuguucccagcuguaggcccuuccacc

SEQ ID NO: 126303 - RNA, 27 nt, Human
ugccuguagucucagcuacuugggagg

SEQ ID NO: 126304 - RNA, 21 nt, Human
cgcaauaacagaguacucuca

SEQ ID NO: 126305 - RNA, 19 nt, Human
cuaacagcaaagcaugcca

SEQ ID NO: 126306 - RNA, 21 nt, Human
ucaacuccaaaccccagagag

SEQ ID NO: 126307 - RNA, 22 nt, Human
uuccuuaaguggcugugauuaa

SEQ ID NO: 126308 - RNA, 26 nt, Human
cucauugggccacugcagucgagccu

SEQ ID NO: 126309 - RNA, 22 nt, Human
cccuaaauugacacucucucca

SEQ ID NO: 126310 - RNA, 18 nt, Human
cccgcucuccccgcggcu

SEQ ID NO: 126311 - RNA, 20 nt, Human
ccuacuccaggacucucaca

SEQ ID NO: 126312 - RNA, 23 nt, Human
cugccugcugcucagagaugauc

SEQ ID NO: 126313 - RNA, 20 nt, Human
ugcacuccaggcugggcagc

SEQ ID NO: 126314 - RNA, 22 nt, Human
ccauuacacuccagccugggcg

SEQ ID NO: 126315 - RNA, 22 nt, Human
ccacugcacucuaaccugggcg

SEQ ID NO: 126316 - RNA, 21 nt, Human
gcagcugccgaaagugucaga

SEQ ID NO: 126317 - RNA, 22 nt, Human
guuuugguuugcuucuguccca

SEQ ID NO: 126318 - RNA, 22 nt, Human
ugauagugauugccuugaauaa

SEQ ID NO: 126319 - RNA, 21 nt, Human
gggccaucugcacuuuuccca

SEQ ID NO: 126320 - RNA, 25 nt, Human
gagagugaugaugcgggugugcugg

SEQ ID NO: 126321 - RNA, 23 nt, Human
aacuggagaguguggggaauggg

SEQ ID NO: 126322 - RNA, 21 nt, Human
guugccuaggcuggaaauagg

SEQ ID NO: 126323 - RNA, 22 nt, Human
ccauagaguccucucucugccu

SEQ ID NO: 126324 - RNA, 21 nt, Human
agagcugacacaaaccugccu

SEQ ID NO: 126325 - RNA, 25 nt, Human
uccagugggauuuguaauccaaugc

SEQ ID NO: 126326 - RNA, 24 nt, Human
gggauuacaggugugugggccacc

SEQ ID NO: 126327 - RNA, 28 nt, Human
cagauggccaugcccaaccaauaacgag

SEQ ID NO: 126328 - RNA, 22 nt, Human
ggcaggagaugguccaaguguc

SEQ ID NO: 126329 - RNA, 18 nt, Human
cgcaggcaggcagggggg

SEQ ID NO: 126330 - RNA, 19 nt, Human
gucagugcuugaagcuguu

SEQ ID NO: 126331 - RNA, 27 nt, Human
ggaggcugggagccggcggcaggauua

SEQ ID NO: 126332 - RNA, 20 nt, Human
uggcuguaaaggaaaaacac

SEQ ID NO: 126333 - RNA, 23 nt, Human
cucuguaaucucagcuucucagg

SEQ ID NO: 126334 - RNA, 19 nt, Human
agcuuggggaacuugcugu

SEQ ID NO: 126335 - RNA, 27 nt, Human
uggacuuuugcauuauuucauugugca

SEQ ID NO: 126336 - RNA, 21 nt, Human
gaaaagaguguauaugugaac

SEQ ID NO: 126337 - RNA, 20 nt, Human
cugacaugcucacacauuac

SEQ ID NO: 126338 - RNA, 22 nt, Human
acaugccuuuuaaaaguucuuu

SEQ ID NO: 126339 - RNA, 26 nt, Human
uaaucaggaggcaucauugaggccag

SEQ ID NO: 126340 - RNA, 21 nt, Human
cucucuggcugcccucugcuc

SEQ ID NO: 126341 - RNA, 21 nt, Human
guccccgggggacuucuucac

SEQ ID NO: 126342 - RNA, 19 nt, Human
ucauugucaucaaucaugg

SEQ ID NO: 126343 - RNA, 21 nt, Human
cccucauucuccuuucguuca

SEQ ID NO: 126344 - RNA, 22 nt, Human
ugucaucaaauacaggugguua

SEQ ID NO: 126345 - RNA, 22 nt, Human
gaguucagguuaccagaaccag

SEQ ID NO: 126346 - RNA, 22 nt, Human
uuggagguccugaggccagccu

SEQ ID NO: 126347 - RNA, 22 nt, Human
ccucuccccuguaccugugcca

SEQ ID NO: 126348 - RNA, 22 nt, Human
agagaggcacucagugagccuc

SEQ ID NO: 126349 - RNA, 20 nt, Human
agaacaauuuuuauugcuuu

SEQ ID NO: 126350 - RNA, 23 nt, Human
cagauuugaauuuuuucuguucu

SEQ ID NO: 126351 - RNA, 22 nt, Human
caccuggcuucuauaacaaaua

SEQ ID NO: 126352 - RNA, 21 nt, Human
cagcucuugucaaaaggucua

SEQ ID NO: 126353 - RNA, 24 nt, Human
uuaaugccaccacacguguuccgc

SEQ ID NO: 126354 - RNA, 26 nt, Human
gaagaucauuaaccacuguauacuuu

SEQ ID NO: 126355 - RNA, 27 nt, Human
ugggagguggucgcccugcagugcaag

SEQ ID NO: 126356 - RNA, 26 nt, Human
ggccagcuucacccuuccuaaguccg

SEQ ID NO: 126357 - RNA, 20 nt, Human
ucauuacuuucaaaggaaca

SEQ ID NO: 126358 - RNA, 20 nt, Human
uaggugucauuuaaaaauag

SEQ ID NO: 126359 - RNA, 21 nt, Human
cucucaucugugacaacucca

SEQ ID NO: 126360 - RNA, 25 nt, Human
aaccucgggggccaggaccggcgcu

SEQ ID NO: 126361 - RNA, 19 nt, Human
gcucacugaagaagcuucu

SEQ ID NO: 126362 - RNA, 31 nt, Human
gcugucccuggaccuggagcugcaggcauca

SEQ ID NO: 126363 - RNA, 19 nt, Human
aacucgcacccacugugga

SEQ ID NO: 126364 - RNA, 27 nt, Human
acacuccucuugaugugacuaaagcuu

SEQ ID NO: 126365 - RNA, 21 nt, Human
ucuagacugggaaacauacac

SEQ ID NO: 126366 - RNA, 27 nt, Human
agccuguuuccccaauuccucugugcu

SEQ ID NO: 126367 - RNA, 20 nt, Human
uggcaucucaggggaacaca

SEQ ID NO: 126368 - RNA, 20 nt, Human
uuucccccuuugugcacauu

SEQ ID NO: 126369 - RNA, 22 nt, Human
uggugguuuauggcuccagagc

SEQ ID NO: 126370 - RNA, 27 nt, Human
ucaucaucuaguguuccucauguguuc

SEQ ID NO: 126371 - RNA, 18 nt, Human
uuuccaaaaugagccuua

SEQ ID NO: 126372 - RNA, 22 nt, Human
uugacuguuuaaaaaauugagc

SEQ ID NO: 126373 - RNA, 21 nt, Human
ugcuuguaauccuagcacuuu

SEQ ID NO: 126374 - RNA, 21 nt, Human
auuccacaagaagcaccaggg

SEQ ID NO: 126375 - RNA, 20 nt, Human
ccacaagcugagcaggacag

SEQ ID NO: 126376 - RNA, 22 nt, Human
ccgaccaugcccagccugcugc

SEQ ID NO: 126377 - RNA, 24 nt, Human
uuggggcaguggugacgagcugug

SEQ ID NO: 126378 - RNA, 27 nt, Human
cacccaaggcuggauguuugugcuccg

SEQ ID NO: 126379 - RNA, 20 nt, Human
uauccuuuucagagcacuuc

SEQ ID NO: 126380 - RNA, 23 nt, Human
ggguguacuaguuacacaucuuc

SEQ ID NO: 126381 - RNA, 26 nt, Human
ccucuuugcaguucagucuaagucuc

SEQ ID NO: 126382 - RNA, 25 nt, Human
guggugccagagaaaaguagccaga

SEQ ID NO: 126383 - RNA, 22 nt, Human
aacuccauuucugucacccuuu

SEQ ID NO: 126384 - RNA, 21 nt, Human
uaaggaagcauuuucccauug

SEQ ID NO: 126385 - RNA, 24 nt, Human
uguuugacugguuugacuaccaug

SEQ ID NO: 126386 - RNA, 23 nt, Human
gcugggagccggaggcgcgggga

SEQ ID NO: 126387 - RNA, 22 nt, Human
ugcucaaagcuugggguuucuu

SEQ ID NO: 126388 - RNA, 21 nt, Human
uuaccuuuuuguuccuuacca

SEQ ID NO: 126389 - RNA, 25 nt, Human
ucccagcaccccaagccaacccagc

SEQ ID NO: 126390 - RNA, 23 nt, Human
ggacaaaguuagaauugccugaa

SEQ ID NO: 126391 - RNA, 22 nt, Human
ggcccuccuccccuccuugcac

SEQ ID NO: 126392 - RNA, 21 nt, Human
cauuuucuccuucuuucuccc

SEQ ID NO: 126393 - RNA, 22 nt, Human
auuaagaauuaccuuucauuuu

SEQ ID NO: 126394 - RNA, 29 nt, Human
ggaaggagcagugccccucgagcagccag

SEQ ID NO: 126395 - RNA, 29 nt, Human
guggcuuggggucgggagugcaggaggcg

SEQ ID NO: 126396 - RNA, 23 nt, Human
caagccuggccacuguuggcugc

SEQ ID NO: 126397 - RNA, 22 nt, Human
uaggagaagcauuuuguggagg

SEQ ID NO: 126398 - RNA, 22 nt, Human
uucauucuuuuauaccgcugca

SEQ ID NO: 126399 - RNA, 23 nt, Human
ucauccaguugggaaacccagga

SEQ ID NO: 126400 - RNA, 28 nt, Human
aacccugauuugugugacuuuaccauug

SEQ ID NO: 126401 - RNA, 27 nt, Human
ugcacaggcuggcugcguguucuugaa

SEQ ID NO: 126402 - RNA, 23 nt, Human
aucuuaagauuacaagauaaaaa

SEQ ID NO: 126403 - RNA, 27 nt, Human
aaggaagaggcuugguucuagccuggc

SEQ ID NO: 126404 - RNA, 26 nt, Human
cucuuucucaccuuuacaccugucuu

SEQ ID NO: 126405 - RNA, 27 nt, Human
cucuucuacagcuucugagaauugugu

SEQ ID NO: 126406 - RNA, 26 nt, Human
ggcagaggagggaggcaaguguccuu

SEQ ID NO: 126407 - RNA, 24 nt, Human
gugcgggccuggggguugcaugug

SEQ ID NO: 126408 - RNA, 19 nt, Human
auggauaucacacauauca

SEQ ID NO: 126409 - RNA, 20 nt, Human
guggggagccaagagguccc

SEQ ID NO: 126410 - RNA, 22 nt, Human
uauuuugggaacuccugccuua

SEQ ID NO: 126411 - RNA, 25 nt, Human
gugacugcagcuugccaaaucuuug

SEQ ID NO: 126412 - RNA, 22 nt, Human
uaaacauaguauuucucucugc

SEQ ID NO: 126413 - RNA, 18 nt, Human
ggugcuuggaugggcagg

SEQ ID NO: 126414 - RNA, 22 nt, Human
ccaaguagcugggauuacuggu

SEQ ID NO: 126415 - RNA, 23 nt, Human
cagaaaugugaagugcuagcuga

SEQ ID NO: 126416 - RNA, 21 nt, Human
uuuuagggccauacuaaaggg

SEQ ID NO: 126417 - RNA, 26 nt, Human
ucacucuuguggauguuuuaauucca

SEQ ID NO: 126418 - RNA, 30 nt, Human; identical to SEQ ID NO: 6894

SEQ ID NO: 126419 - RNA, 19 nt, Human
ugcuuuuuaaaugaaugga

SEQ ID NO: 126420 - RNA, 32 nt, Human
ccugcagaguccuuccagccuaggccugcagc

SEQ ID NO: 126421 - RNA, 27 nt, Human
cccuccugguggauguguguguuuauu

SEQ ID NO: 126422 - RNA, 23 nt, Human
aagugccucuuugcauagcacca

SEQ ID NO: 126423 - RNA, 19 nt, Human
caggcugaaaggugaccuc

SEQ ID NO: 126424 - RNA, 24 nt, Human
uucaguggccucaucagcagcucu

SEQ ID NO: 126425 - RNA, 28 nt, Human
agagcagccagaugggcugaaaguggaa

SEQ ID NO: 126426 - RNA, 27 nt, Human
ggcauauuaacaccugccuucuggcuu

SEQ ID NO: 126427 - RNA, 23 nt, Human
gcugccucugagcccucccugcu

SEQ ID NO: 126428 - RNA, 26 nt, Human
caucaugagcugaggugggaccacag

SEQ ID NO: 126429 - RNA, 22 nt, Human
cugggccucaguuuccccaucu

SEQ ID NO: 126430 - RNA, 22 nt, Human
gagcccaggagguuguggcugc

SEQ ID NO: 126431 - RNA, 22 nt, Human
cucagguuccaagacucagcug

SEQ ID NO: 126432 - RNA, 19 nt, Human
ucauaccucauugcagccu

SEQ ID NO: 126433 - RNA, 21 nt, Human
gcugggagguggacaagguga

SEQ ID NO: 126434 - RNA, 21 nt, Human
cugaugugggaaguguuuaca

SEQ ID NO: 126435 - RNA, 25 nt, Human
uagugcagacagaaaacugcaguga

SEQ ID NO: 126436 - RNA, 23 nt, Human
uuuugcccugaguccaagagggu

SEQ ID NO: 126437 - RNA, 28 nt, Human
uucugcugucugggacuccugucuaggu

SEQ ID NO: 126438 - RNA, 27 nt, Human
gacuucugcuuuccacaccugcacugc

SEQ ID NO: 126439 - RNA, 22 nt, Human
ucuguggguaaaaucagcccuu

SEQ ID NO: 126440 - RNA, 23 nt, Human
agcuuuacugaaagacuugguua

SEQ ID NO: 126441 - RNA, 24 nt, Human
caguucugaugaggcacgccugcc

SEQ ID NO: 126442 - RNA, 22 nt, Human
cacagccgauucaccugagcag

SEQ ID NO: 126443 - RNA, 20 nt, Human
uugggugcuguuuugccagc

SEQ ID NO: 126444 - RNA, 25 nt, Human
aggauaauggugaacauuuuaaugg

SEQ ID NO: 126445 - RNA, 20 nt, Human
agauacagaggcagaggaaa

SEQ ID NO: 126446 - RNA, 23 nt, Human
accuguauucccaacacuuuugg

SEQ ID NO: 126447 - RNA, 18 nt, Human
uacucaggcagugcaaua

SEQ ID NO: 126448 - RNA, 22 nt, Human
caggcuggagugcaaucgcgca

SEQ ID NO: 126449 - RNA, 22 nt, Human
uuucuaaaccucucuucccucu

SEQ ID NO: 126450 - RNA, 24 nt, Human
aagcaccgugucugaaccguugcu

SEQ ID NO: 126451 - RNA, 20 nt, Human
aauggugacuuaauccguag

SEQ ID NO: 126452 - RNA, 24 nt, Human
caaagcccuccagccuguuugugg

SEQ ID NO: 126453 - RNA, 21 nt, Human
ugggccagaaguagaggggug

SEQ ID NO: 126454 - RNA, 21 nt, Human
agaggggucucuggaggcaga

SEQ ID NO: 126455 - RNA, 23 nt, Human
caguguugugggcacauuuaguu

SEQ ID NO: 126456 - RNA, 26 nt, Human
gaggccuugcugcuguggauacggaa

SEQ ID NO: 126457 - RNA, 20 nt, Human
agaaguuaggguuaaggaga

SEQ ID NO: 126458 - RNA, 23 nt, Human
caaguagcugggauuacaggcac

SEQ ID NO: 126459 - RNA, 20 nt, Human
ggaguuucuccagaagcucc

SEQ ID NO: 126460 - RNA, 20 nt, Human
uuccuuucauacugaugcug

SEQ ID NO: 126461 - RNA, 20 nt, Human
cuuuucauuaccccuccucc

SEQ ID NO: 126462 - RNA, 25 nt, Human
gguguuccacaggguagcugggagu

SEQ ID NO: 126463 - RNA, 24 nt, Human
gaucaagaucacugaugaccccgc

SEQ ID NO: 126464 - RNA, 26 nt, Human
acuauccugaaugaucgcggucaggg

SEQ ID NO: 126465 - RNA, 23 nt, Human
acaaagugcuuuuucacugccua

SEQ ID NO: 126466 - RNA, 21 nt, Human
aagagcugggauuacaggugu

SEQ ID NO: 126467 - RNA, 23 nt, Human
guugugccccuaaaaguguuuga

SEQ ID NO: 126468 - RNA, 21 nt, Human
ugcucuauuucugacucucau

SEQ ID NO: 126469 - RNA, 23 nt, Human
ucuuaccauggccguuuuauauu

SEQ ID NO: 126470 - RNA, 27 nt, Human
ccugcuguguggagccucuucugggac

SEQ ID NO: 126471 - RNA, 29 nt, Human
ccaggugagguggagcauuccuuguauuc

SEQ ID NO: 126472 - RNA, 26 nt, Human
cucuccuguauaaccccaccuugcca

SEQ ID NO: 126473 - RNA, 21 nt, Human
uaauccuucugaagcaaagca

SEQ ID NO: 126474 - RNA, 22 nt, Human
gagcagacaccagcagcccugu

SEQ ID NO: 126475 - RNA, 21 nt, Human
gcuuuuaggagaaaguguauu

SEQ ID NO: 126476 - RNA, 19 nt, Human
cugcagaaaaggugucaca

SEQ ID NO: 126477 - RNA, 20 nt, Human
ccuuguucugguggagcugg

SEQ ID NO: 126478 - RNA, 26 nt, Human
uugguuaguauuuaacuacaucugcc

SEQ ID NO: 126479 - RNA, 27 nt, Human
agcauuuuacuacuuguuaccuuuccc

SEQ ID NO: 126480 - RNA, 23 nt, Human
cgaguccccuagagagaggcauu

SEQ ID NO: 126481 - RNA, 21 nt, Human
ugggcugggagggggagggag

SEQ ID NO: 126482 - RNA, 25 nt, Human
ugguggcgggcaccuguauucccag

SEQ ID NO: 126483 - RNA, 18 nt, Human
acagaugggcagaugcac

SEQ ID NO: 126484 - RNA, 20 nt, Human
uaacguaugagaauucuagg

SEQ ID NO: 126485 - RNA, 19 nt, Human
gccucccgggacauugauu

SEQ ID NO: 126486 - RNA, 25 nt, Human
gugccuuagaagacagugaaaggua

SEQ ID NO: 126487 - RNA, 22 nt, Human
ggaccucauggcuaaugccacu

SEQ ID NO: 126488 - RNA, 25 nt, Human
cuguccccucuugcuucuccuugca

SEQ ID NO: 126489 - RNA, 20 nt, Human
cucuccuccguggacauuuc

SEQ ID NO: 126490 - RNA, 22 nt, Human
gcacacagacggccuaggggug

SEQ ID NO: 126491 - RNA, 20 nt, Human
cccacccuccugggcccagg

SEQ ID NO: 126492 - RNA, 24 nt, Human
aauaccuaagaggaacacuguaaa

SEQ ID NO: 126493 - RNA, 21 nt, Human
cuuuaaaacaugauaguccuu

SEQ ID NO: 126494 - RNA, 21 nt, Human
cucgguucuucccccuccucc

SEQ ID NO: 126495 - RNA, 24 nt, Human
uucuccucugcuucauucucgucc

SEQ ID NO: 126496 - RNA, 22 nt, Human
ucaggcuggagugccauggcgc

SEQ ID NO: 126497 - RNA, 22 nt, Human
aaaccuggccauuugcugccuc

SEQ ID NO: 126498 - RNA, 21 nt, Human
uuuggauuuuaaccucuuaga

SEQ ID NO: 126499 - RNA, 19 nt, Human
cauuucccacccuccaucu

SEQ ID NO: 126500 - RNA, 26 nt, Human
gcugagguccuggugccaggggccca

SEQ ID NO: 126501 - RNA, 24 nt, Human
ccaacuuacucuaggucaguauua

SEQ ID NO: 126502 - RNA, 22 nt, Human
ugggacuauuuugcaugcugaa

SEQ ID NO: 126503 - RNA, 19 nt, Human
auuucugaaucgagcuaga

SEQ ID NO: 126504 - RNA, 20 nt, Human
ugugaauuucacuggcaguu

SEQ ID NO: 126505 - RNA, 19 nt, Human
gcuccucuuuuuucuuguc

SEQ ID NO: 126506 - RNA, 21 nt, Human
cucuggagagaggggggugag

SEQ ID NO: 126507 - RNA, 27 nt, Human
acugaggaugggccucagucucuaagg

SEQ ID NO: 126508 - RNA, 23 nt, Human
ucugaaccucuuagacucuuaga

SEQ ID NO: 126509 - RNA, 27 nt, Human
guucacguuucauguaauccucaagaa

SEQ ID NO: 126510 - RNA, 21 nt, Human
agagacaaaaucucuauacug

SEQ ID NO: 126511 - RNA, 20 nt, Human
auugauuucacagucagcug

SEQ ID NO: 126512 - RNA, 20 nt, Human
uggcccagggaauccagcca

SEQ ID NO: 126513 - RNA, 23 nt, Human
aaaugcacuaaacauuugggugg

SEQ ID NO: 126514 - RNA, 19 nt, Human
auaaugaucagcaaaaaga

SEQ ID NO: 126515 - RNA, 25 nt, Human
aggaagcagccucagaguggucgag

SEQ ID NO: 126516 - RNA, 22 nt, Human
cugagucucaguuuuuccauuu

SEQ ID NO: 126517 - RNA, 20 nt, Human
acggagcaucuucucagaau

SEQ ID NO: 126518 - RNA, 22 nt, Human
cacccagggaacagugugcgug

SEQ ID NO: 126519 - RNA, 25 nt, Human
acagcaggugccagugacuacuucu

SEQ ID NO: 126520 - RNA, 21 nt, Human
aacucacagccuuuuuacuuu

SEQ ID NO: 126521 - RNA, 25 nt, Human
gguugaagaccuaaccagggccaga

SEQ ID NO: 126522 - RNA, 24 nt, Human
uuuugcagaaaucacaauuuuccu

SEQ ID NO: 126523 - RNA, 22 nt, Human
cucucagcuggcagugcaaugc

SEQ ID NO: 126524 - RNA, 21 nt, Human
aguuggcaggaguggagacca

SEQ ID NO: 126525 - RNA, 18 nt, Human
acuuaggaagccugggga

SEQ ID NO: 126526 - RNA, 19 nt, Human
ggcccgcaucccacccucc

SEQ ID NO: 126527 - RNA, 26 nt, Human
ucaccucugugccugaguucucccug

SEQ ID NO: 126528 - RNA, 22 nt, Human
cuaguuccuggaacagacucac

SEQ ID NO: 126529 - RNA, 23 nt, Human
gaucaaauaguucaucaaaauga

SEQ ID NO: 126530 - RNA, 22 nt, Human
caauuuuaaaaauacuuccuca

SEQ ID NO: 126531 - RNA, 23 nt, Human
gaaagagaagacuuucauugacg

SEQ ID NO: 126532 - RNA, 28 nt, Human
uccuccuuuccuccucugacuuggggac

SEQ ID NO: 126533 - RNA, 19 nt, Human
gacuacaguugugcaccac

SEQ ID NO: 126534 - RNA, 27 nt, Human
cccugcauccuccucccugacucgcag

SEQ ID NO: 126535 - RNA, 21 nt, Human
caucucaaacacugcuuaagg

SEQ ID NO: 126536 - RNA, 19 nt, Human
ucaggcugggcucuggcag

SEQ ID NO: 126537 - RNA, 26 nt, Human
cucacauuccuuaaauuaggagaaau

SEQ ID NO: 126538 - RNA, 24 nt, Human
gguugacaccauuuuccugccuca

SEQ ID NO: 126539 - RNA, 22 nt, Human
cuuaaggauuguauaauucauu

SEQ ID NO: 126540 - RNA, 22 nt, Human
agguuucucaugggaauaugcu

SEQ ID NO: 126541 - RNA, 22 nt, Human
cagggagcagagucuucucauc

SEQ ID NO: 126542 - RNA, 26 nt, Human
uuauccguuaaggcuggaggcacaug

SEQ ID NO: 126543 - RNA, 22 nt, Human
ccacugcacccuggguugggug

SEQ ID NO: 126544 - RNA, 18 nt, Human
aagcccaggagugcagac

SEQ ID NO: 126545 - RNA, 29 nt, Human
gauacagaucucagggcucgggagccaug

SEQ ID NO: 126546 - RNA, 21 nt, Human
accccaggcuggagugcagug

SEQ ID NO: 126547 - RNA, 21 nt, Human
cuuaugugcuaucagauaucc

SEQ ID NO: 126548 - RNA, 20 nt, Human
cccuuuuucucucucagggc

SEQ ID NO: 126549 - RNA, 20 nt, Human
acuguggagauuugagggaa

SEQ ID NO: 126550 - RNA, 25 nt, Human
cccggguucaagccauucugccuca

SEQ ID NO: 126551 - RNA, 23 nt, Human
cacaucccaacaggaacgacuca

SEQ ID NO: 126552 - RNA, 23 nt, Human
ggagggacagggagcagggcaga

SEQ ID NO: 126553 - RNA, 26 nt, Human
ugcucagaucucucaggaaaaccagu

SEQ ID NO: 126554 - RNA, 20 nt, Human
uuucucuggcccucuaccuu

SEQ ID NO: 126555 - RNA, 27 nt, Human
ccuuugaguuuccucaggcugcuggag

SEQ ID NO: 126556 - RNA, 18 nt, Human
uggaagagauuauuggca

SEQ ID NO: 126557 - RNA, 19 nt, Human
ccccacccucuccccugcc

SEQ ID NO: 126558 - RNA, 24 nt, Human
gaggaggccugggggcagggagag

SEQ ID NO: 126559 - RNA, 20 nt, Human
gggccaggcuggaggcaggg

SEQ ID NO: 126560 - RNA, 26 nt, Human
aauccuuccauuucuucugcacaucu

SEQ ID NO: 126561 - RNA, 24 nt, Human
cugagucuaccuaauauguuaagg

SEQ ID NO: 126562 - RNA, 22 nt, Human
aucucugcucuggcuuuucucc

SEQ ID NO: 126563 - RNA, 22 nt, Human
aaaaugugaagcugaacccccu

SEQ ID NO: 126564 - RNA, 20 nt, Human
ggguuucagcucauaucuua

SEQ ID NO: 126565 - RNA, 21 nt, Human
ccugcugcagcccacugccug

SEQ ID NO: 126566 - RNA, 21 nt, Human
gggccgcugcacccaccgcca

SEQ ID NO: 126567 - RNA, 22 nt, Human
ggagcgcgcccugcccuggcgc

SEQ ID NO: 126568 - RNA, 20 nt, Human
ugacuucuuuucugauggag

SEQ ID NO: 126569 - RNA, 26 nt, Human
aacuacaaccucgauugucugggcaa

SEQ ID NO: 126570 - RNA, 22 nt, Human
acuucccagcuaggagugcacu

SEQ ID NO: 126571 - RNA, 28 nt, Human
caggagaggggaaggcagccgcuuucac

SEQ ID NO: 126572 - RNA, 24 nt, Human
gcgucugcucugggacaccccaaa

SEQ ID NO: 126573 - RNA, 23 nt, Human
gcucugagaggacgcggcggcag

SEQ ID NO: 126574 - RNA, 23 nt, Human
agacccagcaggcgucugaggcc

SEQ ID NO: 126575 - RNA, 24 nt, Human
gcugucauucucccagggcagaac

SEQ ID NO: 126576 - RNA, 19 nt, Human
cccaguacccucagugccu

SEQ ID NO: 126577 - RNA, 20 nt, Human
agggaagagaaugggcagca

SEQ ID NO: 126578 - RNA, 21 nt, Human
ccagaggguggaaggagccag

SEQ ID NO: 126579 - RNA, 22 nt, Human
ccacaccccucuuuccucucuc

SEQ ID NO: 126580 - RNA, 20 nt, Human
cucaaagcccaggcagaaaa

SEQ ID NO: 126581 - RNA, 26 nt, Human
gaagcagcaugaagcagcaugacuga

SEQ ID NO: 126582 - RNA, 22 nt, Human
ucuaaauacaggaaauuucuua

SEQ ID NO: 126583 - RNA, 29 nt, Human
guguggcagccaggaugacuagauccugg

SEQ ID NO: 126584 - RNA, 21 nt, Human
agguugagaaaccggcgccac

SEQ ID NO: 126585 - RNA, 21 nt, Human
ucucaaggccuggggcucaga

SEQ ID NO: 126586 - RNA, 22 nt, Human
ccugcaguuugggagacaugga

SEQ ID NO: 126587 - RNA, 22 nt, Human
ucauccaggcgggggguugggg

SEQ ID NO: 126588 - RNA, 24 nt, Human
cuuccacugcagccaugucacucc

SEQ ID NO: 126589 - RNA, 18 nt, Human
ucugguggcauuacccug

SEQ ID NO: 126590 - RNA, 22 nt, Human
uguggguccccauugcccagcu

SEQ ID NO: 126591 - RNA, 22 nt, Human
cacaccuauaaccccagcacuu

SEQ ID NO: 126592 - RNA, 26 nt, Human
cacccacccuugggggagcaugaugg

SEQ ID NO: 126593 - RNA, 23 nt, Human
cugcucccaggaagcugugcgga

SEQ ID NO: 126594 - RNA, 22 nt, Human
gacucuggcugccaagauaccu

SEQ ID NO: 126595 - RNA, 22 nt, Human
ggugggagugaggagaugaggg

SEQ ID NO: 126596 - RNA, 21 nt, Human
cgcuccccuccauccccaucg

SEQ ID NO: 126597 - RNA, 23 nt, Human
ccugcugagggggcagugccagg

SEQ ID NO: 126598 - RNA, 24 nt, Human
cugcucaccuggguuuacugauga

SEQ ID NO: 126599 - RNA, 22 nt, Human
gagauucacccagcgcgaggag

SEQ ID NO: 126600 - RNA, 27 nt, Human
guggaggugcgcaguggacucacagcu

SEQ ID NO: 126601 - RNA, 27 nt, Human
uaccaagcaaggggaauggagcacuuu

SEQ ID NO: 126602 - RNA, 28 nt, Human
gagguuaaucuaggaaugacucguuuaa

SEQ ID NO: 126603 - RNA, 25 nt, Human
ggggcugagcuuguccugccuucgu

SEQ ID NO: 126604 - RNA, 25 nt, Human
cucauuucaauuuauaacguucuca

SEQ ID NO: 126605 - RNA, 24 nt, Human
aguugcaacuuggacuuguccuca

SEQ ID NO: 126606 - RNA, 27 nt, Human
cuacuauuugaaaauuggagggggaag

SEQ ID NO: 126607 - RNA, 25 nt, Human
uagccucuccaguuucagcaaccgc

SEQ ID NO: 126608 - RNA, 20 nt, Human
uuucuucuuuucccuguggc

SEQ ID NO: 126609 - RNA, 21 nt, Human
gaaagauugagaaacauugua

SEQ ID NO: 126610 - RNA, 22 nt, Human
uacucagcuccuucaaacucag

SEQ ID NO: 126611 - RNA, 22 nt, Human
gguucugugaccacugcuggac

SEQ ID NO: 126612 - RNA, 23 nt, Human
cccucccucuguucccuggacca

SEQ ID NO: 126613 - RNA, 26 nt, Human
uccuggagcgccugugagauggucag

SEQ ID NO: 126614 - RNA, 32 nt, Human
ggcuucgccugucccuuucacuccacacccuc

SEQ ID NO: 126615 - RNA, 25 nt, Human
cucaggauaaacaugcuugucucca

SEQ ID NO: 126616 - RNA, 22 nt, Human
gcucugaacuaaaagcauccgu

SEQ ID NO: 126617 - RNA, 21 nt, Human
cagcuuucugagaaaagcuag

SEQ ID NO: 126618 - RNA, 25 nt, Human
ggaguguaggccuuccagugcagga

SEQ ID NO: 126619 - RNA, 22 nt, Human
gaguugguuugggagcugccag

SEQ ID NO: 126620 - RNA, 20 nt, Human
ugcuugggaaacaagcuccu

SEQ ID NO: 126621 - RNA, 22 nt, Human
caggacugagcacacaggugaa

SEQ ID NO: 126622 - RNA, 21 nt, Human
uuucuuuauuucucagccugc

SEQ ID NO: 126623 - RNA, 23 nt, Human
cucauuuccaaacaucucacuca

SEQ ID NO: 126624 - RNA, 20 nt, Human
gaccugacaggacaaccuag

SEQ ID NO: 126625 - RNA, 24 nt, Human
uggucaccguuucaccaucaugcu

SEQ ID NO: 126626 - RNA, 23 nt, Human
uuucugcugaugccguacccuca

SEQ ID NO: 126627 - RNA, 22 nt, Human
acccuguuucucucuuugcuuu

SEQ ID NO: 126628 - RNA, 20 nt, Human
gucugcagagccucaguuac

SEQ ID NO: 126629 - RNA, 20 nt, Human
uuggggguagccaaaaugag

SEQ ID NO: 126630 - RNA, 26 nt, Human
ugcaguauuacagauauucagcaaaa

SEQ ID NO: 126631 - RNA, 27 nt, Human
cugaggagagggagcugugggccacgc

SEQ ID NO: 126632 - RNA, 23 nt, Human
cggaugcucugucagucuccucc

SEQ ID NO: 126633 - RNA, 27 nt, Human
caggcuggagugcaauggcaggaucuc

SEQ ID NO: 126634 - RNA, 21 nt, Human
gaaggugccaaggaggaaggc

SEQ ID NO: 126635 - RNA, 22 nt, Human
cgggaccuucucucaauuuuca

SEQ ID NO: 126636 - RNA, 22 nt, Human
gcgaaacagcuuuccacacaau

SEQ ID NO: 126637 - RNA, 24 nt, Human
gcaguggcguaaucucggcucacu

SEQ ID NO: 126638 - RNA, 21 nt, Human
aggaggagacagggacgcagg

SEQ ID NO: 126639 - RNA, 30 nt, Human
ccaccuccccuuuuguuucucaguaacauu

SEQ ID NO: 126640 - RNA, 21 nt, Human
aaccuguuuuguuaaugcucu

SEQ ID NO: 126641 - RNA, 27 nt, Human
cacugcacuucagcguggcccaccugc

SEQ ID NO: 126642 - RNA, 22 nt, Human
ggaggccaagccagauggauca

SEQ ID NO: 126643 - RNA, 23 nt, Human
cuagagcagacuacagcuggggu

SEQ ID NO: 126644 - RNA, 27 nt, Human
ucagcacagaaauagauguggacuuuc

SEQ ID NO: 126645 - RNA, 27 nt, Human
gagcccaauuauucauucucccuuuau

SEQ ID NO: 126646 - RNA, 26 nt, Human
cccugccucuguuugacaaaccucua

SEQ ID NO: 126647 - RNA, 21 nt, Human
aaacagaguaaugaagaaaua

SEQ ID NO: 126648 - RNA, 22 nt, Human
ggcgagccuggccaacauggug

SEQ ID NO: 126649 - RNA, 22 nt, Human
gacuacuaaauauuauguaaua

SEQ ID NO: 126650 - RNA, 22 nt, Human
ucuuuguccagucuuuuguuuu

SEQ ID NO: 126651 - RNA, 22 nt, Human
acccagacuggagugcaggggg

SEQ ID NO: 126652 - RNA, 22 nt, Human
uuuaucauccuguguucuguuu

SEQ ID NO: 126653 - RNA, 24 nt, Human
ugcaugcaauuagcucccuccucc

SEQ ID NO: 126654 - RNA, 21 nt, Human
uuuaauugagccuuuuauuaa

SEQ ID NO: 126655 - RNA, 18 nt, Human
ucaucccaugccucauca

SEQ ID NO: 126656 - RNA, 26 nt, Human
ugguuaguggcuucaaaggcccagcu

SEQ ID NO: 126657 - RNA, 21 nt, Human
agcucacugcagccuuguccu

SEQ ID NO: 126658 - RNA, 31 nt, Human
ggaguugagagucuaagaaccucugaaauuu

SEQ ID NO: 126659 - RNA, 24 nt, Human
ccauguguaaacuucacccccagg

SEQ ID NO: 126660 - RNA, 26 nt, Human
auguggacguggaugaauguaggacc

SEQ ID NO: 126661 - RNA, 21 nt, Human
aauuguaaaagcacucuuguc

SEQ ID NO: 126662 - RNA, 21 nt, Human
uuuaagccagaaaguccugag

SEQ ID NO: 126663 - RNA, 19 nt, Human
ucuggagguggaggcagua

SEQ ID NO: 126664 - RNA, 24 nt, Human
cagaagccuggagcuuugguuuga

SEQ ID NO: 126665 - RNA, 27 nt, Human
ucugggagcgagaugcguguagcuagc

SEQ ID NO: 126666 - RNA, 26 nt, Human
ucucuugccauuuguagcuuugccca

SEQ ID NO: 126667 - RNA, 27 nt, Human
cugcuucugguuuucgaagacuauuua

SEQ ID NO: 126668 - RNA, 22 nt, Human
ccgagaucgucccacugcacuc

SEQ ID NO: 126669 - RNA, 27 nt, Human
ccuaaccugcuccucugugccuaggcc

SEQ ID NO: 126670 - RNA, 25 nt, Human
cgaucguuucacaucuguauaucag

SEQ ID NO: 126671 - RNA, 23 nt, Human
gcuucggugucccugucgggcuu

SEQ ID NO: 126672 - RNA, 21 nt, Human
uaaacaaucagcucacaggca

SEQ ID NO: 126673 - RNA, 22 nt, Human
gaauugugacaggcagagggug

SEQ ID NO: 126674 - RNA, 23 nt, Human
acauguguaaagguuucauguuc

SEQ ID NO: 126675 - RNA, 22 nt, Human
ccugcacuuuccuccaccuccc

SEQ ID NO: 126676 - RNA, 23 nt, Human
accccauucucuuuuucaucucg

SEQ ID NO: 126677 - RNA, 24 nt, Human
ggggacugaggcgagcccccucag

SEQ ID NO: 126678 - RNA, 22 nt, Human
caacauagugggacccugucuc

SEQ ID NO: 126679 - RNA, 27 nt, Human
ccccagccaacuucaugggucacuuuu

SEQ ID NO: 126680 - RNA, 21 nt, Human
agggcacugguuuucuuucca

SEQ ID NO: 126681 - RNA, 28 nt, Human
cuucuagaggagcuuagaguuuauugca

SEQ ID NO: 126682 - RNA, 26 nt, Human
cccaggcacugauuguggcagagggg

SEQ ID NO: 126683 - RNA, 23 nt, Human
uggucucccaucccuuugcuugu

SEQ ID NO: 126684 - RNA, 20 nt, Human
acagucaccacugugcucaa

SEQ ID NO: 126685 - RNA, 16 nt, Human
gagguuagaaguuuga

SEQ ID NO: 126686 - RNA, 22 nt, Human
guggaugaagagcauuuuuuau

SEQ ID NO: 126687 - RNA, 21 nt, Human
cccugcagaggaaugaaacua

SEQ ID NO: 126688 - RNA, 18 nt, Human
ucgggaggugguggagug

SEQ ID NO: 126689 - RNA, 22 nt, Human
gcugcucuccaccucgcagacu

SEQ ID NO: 126690 - RNA, 24 nt, Human
uuaccuuuuuguuaaauaaaauuu

SEQ ID NO: 126691 - RNA, 22 nt, Human
uacaggucuauacuuaagggaa

SEQ ID NO: 126692 - RNA, 24 nt, Human
ucacagcacaguacacacaaaaac

SEQ ID NO: 126693 - RNA, 25 nt, Human
gcucugccacaccaccgcgcgcccc

SEQ ID NO: 126694 - RNA, 21 nt, Human
cuggagccuggcuccccucuu

SEQ ID NO: 126695 - RNA, 22 nt, Human
agccuccuuccucaugccucca

SEQ ID NO: 126696 - RNA, 20 nt, Human
cccugccuccgucccaacca

SEQ ID NO: 126697 - RNA, 24 nt, Human
cuucuguucauccccaccuugcua

SEQ ID NO: 126698 - RNA, 19 nt, Human
gaagaguuuuuauuacaaa

SEQ ID NO: 126699 - RNA, 18 nt, Human
ggcauccuggugccugca

SEQ ID NO: 126700 - RNA, 24 nt, Human
gcauuugcagcauucuaaaagccu

SEQ ID NO: 126701 - RNA, 23 nt, Human
gaaugugcuucucucuggcagcu

SEQ ID NO: 126702 - RNA, 20 nt, Human
uuugcucucccgcuguugcc

SEQ ID NO: 126703 - RNA, 26 nt, Human
cucugccucccagguucaagcgauuc

SEQ ID NO: 126704 - RNA, 21 nt, Human
gaacccaggaguucaagacca

SEQ ID NO: 126705 - RNA, 20 nt, Human
uauacauuuauuuacacucu

SEQ ID NO: 126706 - RNA, 22 nt, Human
ugugcugguaaaauguuuaaca

SEQ ID NO: 126707 - RNA, 21 nt, Human
acugacaucuaugcuacauau

SEQ ID NO: 126708 - RNA, 27 nt, Human
gucucaaacucuaaggucggcacuuga

SEQ ID NO: 126709 - RNA, 28 nt, Human
ugcccacaggcugguguaaggagcgggg

SEQ ID NO: 126710 - RNA, 23 nt, Human
ccagggagguagagguugcagug

SEQ ID NO: 126711 - RNA, 24 nt, Human
aacuccgucucaaaaaagaaaaga

SEQ ID NO: 126712 - RNA, 21 nt, Human
gagucaauacauagugcugcu

SEQ ID NO: 126713 - RNA, 22 nt, Human
uuuccuauuugcaguuacuuga

SEQ ID NO: 126714 - RNA, 23 nt, Human
cagucguagcaagagucucgacc

SEQ ID NO: 126715 - RNA, 22 nt, Human
cuagccucugcuggagugcagu

SEQ ID NO: 126716 - RNA, 20 nt, Human
gcuucucuguucauucuuca

SEQ ID NO: 126717 - RNA, 23 nt, Human
gaggaagaggaaggacuaacgca

SEQ ID NO: 126718 - RNA, 19 nt, Human
uuccucgggagauauuuca

SEQ ID NO: 126719 - RNA, 25 nt, Human
acucccuccaccagccugcugacag

SEQ ID NO: 126720 - RNA, 23 nt, Human
ccuggagaccgaagcgcuucacu

SEQ ID NO: 126721 - RNA, 21 nt, Human
auuagaguguguuuguugucu

SEQ ID NO: 126722 - RNA, 19 nt, Human
uugcccagguacaaggcca

SEQ ID NO: 126723 - RNA, 21 nt, Human
uuggugaggacagcaggaggg

SEQ ID NO: 126724 - RNA, 23 nt, Human
ugucacccagaacuggaugguac

SEQ ID NO: 126725 - RNA, 22 nt, Human
aguacaguuuuaucuagccaca

SEQ ID NO: 126726 - RNA, 24 nt, Human
auuuauaacuucuagaaagccauu

SEQ ID NO: 126727 - RNA, 26 nt, Human
cauuuugacagcaucuuccucccucc

SEQ ID NO: 126728 - RNA, 24 nt, Human
gggguaguggccgcuuaguguuga

SEQ ID NO: 126729 - RNA, 27 nt, Human
gccuucuucccugcuaccucucuuccu

SEQ ID NO: 126730 - RNA, 22 nt, Human
cugcaaccuucacccuucaccu

SEQ ID NO: 126731 - RNA, 24 nt, Human
ccucagcugugggggccucaggca

SEQ ID NO: 126732 - RNA, 23 nt, Human
aaggaacuuuccuucuacugccu

SEQ ID NO: 126733 - RNA, 21 nt, Human
ucuuacuuuucuuguuacuac

SEQ ID NO: 126734 - RNA, 23 nt, Human
aguuuguucauucucugcuuuau

SEQ ID NO: 126735 - RNA, 21 nt, Human
aggcggaugcaggaaaucaug

SEQ ID NO: 126736 - RNA, 17 nt, Human
gucccagguggcagcgg

SEQ ID NO: 126737 - RNA, 25 nt, Human
ucuccccuaaagcaucucaguuucc

SEQ ID NO: 126738 - RNA, 19 nt, Human
uccuacucucacagaaggg

SEQ ID NO: 126739 - RNA, 24 nt, Human
ggauacuuuguggaaaguguuaaa

SEQ ID NO: 126740 - RNA, 25 nt, Human
gcccacgcuggagugcagugagccg

SEQ ID NO: 126741 - RNA, 30 nt, Human
caaguagcaggcuguaggcacuugggcuga

SEQ ID NO: 126742 - RNA, 22 nt, Human
uucuaguauuguuuccccacuu

SEQ ID NO: 126743 - RNA, 27 nt, Human
ggaaccuuguuuuggacaguuuaccag

SEQ ID NO: 126744 - RNA, 22 nt, Human
gaauccucaaaccugucacuuu

SEQ ID NO: 126745 - RNA, 28 nt, Human
agugucagaaucagaaucauggagaaaa

SEQ ID NO: 126746 - RNA, 25 nt, Human
guggccagagauugggcugccugug

SEQ ID NO: 126747 - RNA, 22 nt, Human
gcaaaugcuguacugacuuugu

SEQ ID NO: 126748 - RNA, 23 nt, Human
accuguaaucccagcacuuuugg

SEQ ID NO: 126749 - RNA, 27 nt, Human
caggaggugaggagguuucgacauggc

SEQ ID NO: 126750 - RNA, 23 nt, Human
cucuaucucaaaaauaaauaaau

SEQ ID NO: 126751 - RNA, 27 nt, Human
auuuacccuuuuuuaucuauuacucua

SEQ ID NO: 126752 - RNA, 28 nt, Human
ucuauguuaauuacaacugcuauauaga

SEQ ID NO: 126753 - RNA, 22 nt, Human
ucgcccaggcuggagguuaaug

SEQ ID NO: 126754 - RNA, 27 nt, Human
uggccaaacguguagccaaccugcugc

SEQ ID NO: 126755 - RNA, 21 nt, Human
gaacguuucccccacuguguu

SEQ ID NO: 126756 - RNA, 22 nt, Human
gugggagggguagucgaagagc

SEQ ID NO: 126757 - RNA, 21 nt, Human
cuccuccccacccucaugacu

SEQ ID NO: 126758 - RNA, 22 nt, Human
gaguuggcaugacucuugacuc

SEQ ID NO: 126759 - RNA, 22 nt, Human
gggaagucccggccccucucug

SEQ ID NO: 126760 - RNA, 22 nt, Human
ucucuugcccaggcuggagugc

SEQ ID NO: 126761 - RNA, 25 nt, Human
gcugguuaccaccagccuuucuucc

SEQ ID NO: 126762 - RNA, 26 nt, Human
ccugccuguguucugugcccuguguc

SEQ ID NO: 126763 - RNA, 20 nt, Human
uguuuuuucuccuggacuug

SEQ ID NO: 126764 - RNA, 27 nt, Human
gccuuacagcagaugcugaaggcagag

SEQ ID NO: 126765 - RNA, 23 nt, Human
gcucgucccgcucgucauggccu

SEQ ID NO: 126766 - RNA, 23 nt, Human
caguggcuucaagaguccuuacu

SEQ ID NO: 126767 - RNA, 20 nt, Human
aacaagugccuucagggcug

SEQ ID NO: 126768 - RNA, 25 nt, Human
agcuccauuuucuuauugcgcugcu

SEQ ID NO: 126769 - RNA, 27 nt, Human
cacuccaggcuggacgacagagcaaga

SEQ ID NO: 126770 - RNA, 27 nt, Human
cacuccaggcuggguaacagaaugaga

SEQ ID NO: 126771 - RNA, 25 nt, Human
cuggggugggggagcaggagaaagc

SEQ ID NO: 126772 - RNA, 23 nt, Human
auacucuuuugucuuucucuuua

SEQ ID NO: 126773 - RNA, 23 nt, Human
ggcucacugcaaccucugccucc

SEQ ID NO: 126774 - RNA, 24 nt, Human
uugagucuaaagaugcagugccug

SEQ ID NO: 126775 - RNA, 21 nt, Human
uucugccaaggcuacuuccuu

SEQ ID NO: 126776 - RNA, 21 nt, Human
cagguuguccaucccauuggg

SEQ ID NO: 126777 - RNA, 18 nt, Human
gccagugcuuggcaggug

SEQ ID NO: 126778 - RNA, 22 nt, Human
gcucacugcagccuggaacucc

SEQ ID NO: 126779 - RNA, 22 nt, Human
gggcugauguguaaagcuguuc

SEQ ID NO: 126780 - RNA, 22 nt, Human
accgcccaggcuggagugcagu

SEQ ID NO: 126781 - RNA, 23 nt, Human
uugcccaaggccacacagcaaaa

SEQ ID NO: 126782 - RNA, 23 nt, Human
cacaaccacaucccuucccccca

SEQ ID NO: 126783 - RNA, 21 nt, Human
gguucuuguuggugcacagca

SEQ ID NO: 126784 - RNA, 21 nt, Human
uuuucauagcauuccuugugu

SEQ ID NO: 126785 - RNA, 23 nt, Human
ggcugagccacugggcugugggg

SEQ ID NO: 126786 - RNA, 20 nt, Human
ggccuggcugggugcagugg

SEQ ID NO: 126787 - RNA, 24 nt, Human
cagacccgcgagauggcaccaagg

SEQ ID NO: 126788 - RNA, 24 nt, Human
uccacaugggugcauuuguagcuc

SEQ ID NO: 126789 - RNA, 22 nt, Human
gacuagauucucaccugccuuc

SEQ ID NO: 126790 - RNA, 27 nt, Human
uacugguuugcaguuuuguuuucugga

SEQ ID NO: 126791 - RNA, 22 nt, Human
gcccuacuucccaucccacaca

SEQ ID NO: 126792 - RNA, 20 nt, Human
uggaucacagcugcuuucug

SEQ ID NO: 126793 - RNA, 24 nt, Human
gcccagguucaggucacuucggac

SEQ ID NO: 126794 - RNA, 24 nt, Human
gcgugugucccugugguacccugg

SEQ ID NO: 126795 - RNA, 19 nt, Human
uugagucucugagagugca

SEQ ID NO: 126796 - RNA, 21 nt, Human
gacagauacuuggcugugaug

SEQ ID NO: 126797 - RNA, 22 nt, Human
ucuugaccuugaagaugggaag

SEQ ID NO: 126798 - RNA, 23 nt, Human
cagguauuuguuaguuuagcuac

SEQ ID NO: 126799 - RNA, 23 nt, Human
ugaagcaucucagacuccuuggc

SEQ ID NO: 126800 - RNA, 17 nt, Human
ggcugaagagaucaaga

SEQ ID NO: 126801 - RNA, 21 nt, Human
ugaagcagaagaauaagccau

SEQ ID NO: 126802 - RNA, 22 nt, Human
aaacuccugggcucaagcgaac

SEQ ID NO: 126803 - RNA, 22 nt, Human
cuauuuuaugaaccuagagaag

SEQ ID NO: 126804 - RNA, 21 nt, Human
aggaaaauguauccagaggaa

SEQ ID NO: 126805 - RNA, 19 nt, Human
gcacuuggcuccagucacc

SEQ ID NO: 126806 - RNA, 29 nt, Human
ggcgggcagaggagagggaggccgcggaa

SEQ ID NO: 126807 - RNA, 23 nt, Human
uacaucucagccuuccugaccuc

SEQ ID NO: 126808 - RNA, 27 nt, Human
uacuuaauaacacuucaccuucuguaa

SEQ ID NO: 126809 - RNA, 22 nt, Human
uggaggccuggcuggugcucac

SEQ ID NO: 126810 - RNA, 24 nt, Human
guauuuuuauuauguuuguuucuu

SEQ ID NO: 126811 - RNA, 20 nt, Human
ucaccuagggauguguuugu

SEQ ID NO: 126812 - RNA, 17 nt, Human
cugcuuacucucugccu

SEQ ID NO: 126813 - RNA, 22 nt, Human
uuuguugauguuugugaagcaa

SEQ ID NO: 126814 - RNA, 22 nt, Human
cucaguuuaccugcacaugcuu

SEQ ID NO: 126815 - RNA, 20 nt, Human
uuacuucuugguucucagcu

SEQ ID NO: 126816 - RNA, 21 nt, Human
acugaacugugaaacuguuuc

SEQ ID NO: 126817 - RNA, 24 nt, Human
uuccugccucagcccagcucugca

SEQ ID NO: 126818 - RNA, 26 nt, Human
ggcuuuguuuccuucuuuagcugccg

SEQ ID NO: 126819 - RNA, 26 nt, Human
ucuccucucuuggaaugcaugaacuu

SEQ ID NO: 126820 - RNA, 19 nt, Human
uucuuuggacaacaggaag

SEQ ID NO: 126821 - RNA, 21 nt, Human
agcgugccucagguuacuuga

SEQ ID NO: 126822 - RNA, 22 nt, Human
guaggaggggagcagaggaauu

SEQ ID NO: 126823 - RNA, 24 nt, Human
cuacauacuuuuuacacagauucu

SEQ ID NO: 126824 - RNA, 24 nt, Human
cucucucccaaguauaugucuggu

SEQ ID NO: 126825 - RNA, 21 nt, Human
uggacccaggaauccuuacca

SEQ ID NO: 126826 - RNA, 23 nt, Human
ucaccagaagaacaggucucaca

SEQ ID NO: 126827 - RNA, 23 nt, Human
aacuguuuccccucucugcugcu

SEQ ID NO: 126828 - RNA, 26 nt, Human
cggcuuuuucauuacagaaaagaaca

SEQ ID NO: 126829 - RNA, 25 nt, Human
acucugugcccccagucuggaaucc

SEQ ID NO: 126830 - RNA, 28 nt, Human
ucauagacaugcgccaccuccacgugag

SEQ ID NO: 126831 - RNA, 23 nt, Human
cggagccacugggccugcgcgcc

SEQ ID NO: 126832 - RNA, 27 nt, Human
ccauugcacuccagcugggagacacag

SEQ ID NO: 126833 - RNA, 31 nt, Human
cuguucuguucuguuccuuguguaacugugu

SEQ ID NO: 126834 - RNA, 23 nt, Human
uguuuuauaaaucaaaaccuggu

SEQ ID NO: 126835 - RNA, 21 nt, Human
gaggcagcuucuuugccaaga

SEQ ID NO: 126836 - RNA, 22 nt, Human
uguggauaugaaacuuaggaag

SEQ ID NO: 126837 - RNA, 25 nt, Human
ucucuucucggucuuuccucucuga

SEQ ID NO: 126838 - RNA, 26 nt, Human
ucccagcuaggagugcacuuuauggg

SEQ ID NO: 126839 - RNA, 23 nt, Human
aaguaauccuagggaaggguggu

SEQ ID NO: 126840 - RNA, 20 nt, Human
gcugcagcugcaugggugcc

SEQ ID NO: 126841 - RNA, 18 nt, Human
ucuccgccccucgcccac

SEQ ID NO: 126842 - RNA, 22 nt, Human
uggcagcagggugaugaccuga

SEQ ID NO: 126843 - RNA, 27 nt, Human
gaggaagagcugauaagaaacaugccc

SEQ ID NO: 126844 - RNA, 23 nt, Human
gucacccagacuggagugcaggg

SEQ ID NO: 126845 - RNA, 23 nt, Human
uguuguucuuagacaagugccuc

SEQ ID NO: 126846 - RNA, 22 nt, Human
gcucacugcaacuuccgccucc

SEQ ID NO: 126847 - RNA, 26 nt, Human
agcaugagcuccuacuucgucaaccc

SEQ ID NO: 126848 - RNA, 22 nt, Human
uagggguuaguguaggagacca

SEQ ID NO: 126849 - RNA, 20 nt, Human
aagcucaggauauggcuuag

SEQ ID NO: 126850 - RNA, 25 nt, Human
cagaaagcugcaaagaucuucccuu

SEQ ID NO: 126851 - RNA, 21 nt, Human
cucgcccaggcuggagugcaa

SEQ ID NO: 126852 - RNA, 24 nt, Human
ugucgcccaggcuggagugcagug

SEQ ID NO: 126853 - RNA, 24 nt, Human
ugucacccaggcuggagugcggug

SEQ ID NO: 126854 - RNA, 30 nt, Human
gauguauguuaaagccacagagauagagcu

SEQ ID NO: 126855 - RNA, 23 nt, Human
uucauugcagccugaaauuuuaa

SEQ ID NO: 126856 - RNA, 21 nt, Human
cggaagccugccucacccgac

SEQ ID NO: 126857 - RNA, 23 nt, Human
cugugggcaggugggagcuugau

SEQ ID NO: 126858 - RNA, 27 nt, Human
gcugagcgaggcugucuggcuuggggg

SEQ ID NO: 126859 - RNA, 21 nt, Human
ggcggguggagacuuugggau

SEQ ID NO: 126860 - RNA, 24 nt, Human
acauguguaaucaaggcucugugc

SEQ ID NO: 126861 - RNA, 27 nt, Human
cuguaguaggcauuuuuaccaucacug

SEQ ID NO: 126862 - RNA, 27 nt, Human
cucuggcuuuccuggaacacagauguc

SEQ ID NO: 126863 - RNA, 19 nt, Human
ucugaccuuacucuagcag

SEQ ID NO: 126864 - RNA, 23 nt, Human
cggggcugacagcucaggagugu

SEQ ID NO: 126865 - RNA, 20 nt, Human
ucaagucccaaacacugagu

SEQ ID NO: 126866 - RNA, 21 nt, Human
ugagcagagaucacaccacug

SEQ ID NO: 126867 - RNA, 20 nt, Human
ucuguuaggaagccauucua

SEQ ID NO: 126868 - RNA, 25 nt, Human
cacuccacgcauccuuccucaccaa

SEQ ID NO: 126869 - RNA, 22 nt, Human
cucucacucuucugucuuugca

SEQ ID NO: 126870 - RNA, 27 nt, Human
cacuacacuccagccugagcaacagag

SEQ ID NO: 126871 - RNA, 20 nt, Human
aaggcuccgcucacaaaaga

SEQ ID NO: 126872 - RNA, 23 nt, Human
ucaucauuguuguggugcugcua

SEQ ID NO: 126873 - RNA, 19 nt, Human
gccacugugccuggcugag

SEQ ID NO: 126874 - RNA, 25 nt, Human
gccagaccucaaaacgacgggggca

SEQ ID NO: 126875 - RNA, 27 nt, Human
agcuggguuuacauaccagucccauuc

SEQ ID NO: 126876 - RNA, 26 nt, Human
uggggcgugagagcggggguuaggug

SEQ ID NO: 126877 - RNA, 20 nt, Human
uggggaggagggggcugguc

SEQ ID NO: 126878 - RNA, 22 nt, Human
agggucugauggcuucuaggga

SEQ ID NO: 126879 - RNA, 23 nt, Human
acggugcuuauuauuguuuauga

SEQ ID NO: 126880 - RNA, 17 nt, Human
ucaacaaaagaaugucc

SEQ ID NO: 126881 - RNA, 22 nt, Human
accagccuggccaacaugguga

SEQ ID NO: 126882 - RNA, 22 nt, Human
gucuucacucuuaggcacuuug

SEQ ID NO: 126883 - RNA, 25 nt, Human
ugcuuucuccccuuccccccagcau

SEQ ID NO: 126884 - RNA, 27 nt, Human
cuucccaagucucccuuucccugucug

SEQ ID NO: 126885 - RNA, 22 nt, Human
gcgggcugaucgcuugagguca

SEQ ID NO: 126886 - RNA, 26 nt, Human
guuuuuaaaaaugucauuacuuucaa

SEQ ID NO: 126887 - RNA, 22 nt, Human
gcccucccuuccuuccucugcc

SEQ ID NO: 126888 - RNA, 21 nt, Human
cauuaucauaaccucuccucu

SEQ ID NO: 126889 - RNA, 26 nt, Human
acugcagccucaaccuccugggcuca

SEQ ID NO: 126890 - RNA, 26 nt, Human
gggcuucugaguuucauuuccaguca

SEQ ID NO: 126891 - RNA, 21 nt, Human
guggccaaaucugagaacaau

SEQ ID NO: 126892 - RNA, 23 nt, Human
gcuuucauuucugucacauuuca

SEQ ID NO: 126893 - RNA, 22 nt, Human
uacuauacauugaaaugccugc

SEQ ID NO: 126894 - RNA, 23 nt, Human
ucuccgcccagcuccaguccugu

SEQ ID NO: 126895 - RNA, 21 nt, Human
uugcccagaguugggggcuag

SEQ ID NO: 126896 - RNA, 17 nt, Human
agcuugucuccaccuca

SEQ ID NO: 126897 - RNA, 20 nt, Human
cuuuuccuagaacaaaggca

SEQ ID NO: 126898 - RNA, 29 nt, Human
acucaugcccugcuccugucuugugcuuu

SEQ ID NO: 126899 - RNA, 24 nt, Human
agaggcagggggcgaagugcagug

SEQ ID NO: 126900 - RNA, 21 nt, Human
gccuuggcccuguuguaggcu

SEQ ID NO: 126901 - RNA, 22 nt, Human
gaacccaggaggcggagauugc

SEQ ID NO: 126902 - RNA, 22 nt, Human
cgcugcacucuagccuggguga

SEQ ID NO: 126903 - RNA, 21 nt, Human
uugauuuauugauucuguaaa

SEQ ID NO: 126904 - RNA, 19 nt, Human
ggcaaagguauuauguaaa

SEQ ID NO: 126905 - RNA, 22 nt, Human
gaccagcccagcucccuccagc

SEQ ID NO: 126906 - RNA, 23 nt, Human
cugggggucuauccuuucauggu

SEQ ID NO: 126907 - RNA, 27 nt, Human
gcugagcgccaggauggaacacggcca

SEQ ID NO: 126908 - RNA, 23 nt, Human
ucgacccucagcccucuggugcc

SEQ ID NO: 126909 - RNA, 22 nt, Human
augcucacuugagauuuugcag

SEQ ID NO: 126910 - RNA, 27 nt, Human
uugcccaggcuggucuugaacucuugg

SEQ ID NO: 126911 - RNA, 26 nt, Human
agcuaaauuacaacuuuuacauaugg

SEQ ID NO: 126912 - RNA, 27 nt, Human
aacuauacaaugucuguuuauuaaauu

SEQ ID NO: 126913 - RNA, 27 nt, Human
gggggagaagagggcaccccucaucuu

SEQ ID NO: 126914 - RNA, 23 nt, Human
gccugugaucccagcuacucagg

SEQ ID NO: 126915 - RNA, 23 nt, Human
gccuguaaucccagcuacucaga

SEQ ID NO: 126916 - RNA, 24 nt, Human
accuccagggagccuagaagcugg

SEQ ID NO: 126917 - RNA, 22 nt, Human
ucuccccaaacuuucucuuucu

SEQ ID NO: 126918 - RNA, 23 nt, Human
cuuaagaguuuaucuuuucucug

SEQ ID NO: 126919 - RNA, 29 nt, Human
ggaauggaaacguguguguuccuccaaau

SEQ ID NO: 126920 - RNA, 27 nt, Human
agaaaacagaccagcauaguucugcaa

SEQ ID NO: 126921 - RNA, 23 nt, Human
cuacagcuguuugugggauguug

SEQ ID NO: 126922 - RNA, 21 nt, Human
gcaggcugagugcacuggcag

SEQ ID NO: 126923 - RNA, 27 nt, Human
ccccagacucugcucucccagcacuga

SEQ ID NO: 126924 - RNA, 21 nt, Human
gcaucccaggcugguggcagg

SEQ ID NO: 126925 - RNA, 21 nt, Human
aaagcuguaugaguguaccua

SEQ ID NO: 126926 - RNA, 20 nt, Human
uuugcacaccuguucuguag

SEQ ID NO: 126927 - RNA, 18 nt, Human
acacagagacacauacac

SEQ ID NO: 126928 - RNA, 23 nt, Human
aaaggaagaacaucuggauuuca

SEQ ID NO: 126929 - RNA, 26 nt, Human
acccuuuaguuugcuugaacuuuagu

SEQ ID NO: 126930 - RNA, 22 nt, Human
cuugcagcugguggcggcggcu

SEQ ID NO: 126931 - RNA, 20 nt, Human
ugagcagaguuuacagcucc

SEQ ID NO: 126932 - RNA, 24 nt, Human
gagcuagucccagaaaggauccuu

SEQ ID NO: 126933 - RNA, 22 nt, Human
ugugaagcugugggugcagugg

SEQ ID NO: 126934 - RNA, 24 nt, Human
cugaguaggugggauuacagaugc

SEQ ID NO: 126935 - RNA, 22 nt, Human
uccaaggagggagggagcgcag

SEQ ID NO: 126936 - RNA, 22 nt, Human
cccgaguagcugggaccacagg

SEQ ID NO: 126937 - RNA, 22 nt, Human
uccgaguagcugggacuacagg

SEQ ID NO: 126938 - RNA, 24 nt, Human
gggguggguggggaggcccuccuc

SEQ ID NO: 126939 - RNA, 26 nt, Human
ucacccaguugguagaggagucagga

SEQ ID NO: 126940 - RNA, 27 nt, Human
agggaaaggggugcuuuuauagaggcu

SEQ ID NO: 126941 - RNA, 21 nt, Human
caccccggcuggagucaugug

SEQ ID NO: 126942 - RNA, 26 nt, Human
aggacuagagggggcucgcucgugga

SEQ ID NO: 126943 - RNA, 22 nt, Human
agacccacagcuugagggggca

SEQ ID NO: 126944 - RNA, 27 nt, Human
ucuccccuucguuuuugagggggucau

SEQ ID NO: 126945 - RNA, 20 nt, Human
gacgugagagggacgguuca

SEQ ID NO: 126946 - RNA, 24 nt, Human
cacguuaauccugguggcuucucu

SEQ ID NO: 126947 - RNA, 29 nt, Human
aaauuuacauggcaaagagcccauaaauc

SEQ ID NO: 126948 - RNA, 27 nt, Human
agauccauacaccacaggacacuacua

SEQ ID NO: 126949 - RNA, 24 nt, Human
cuuuccucucuuugagauugccuc

SEQ ID NO: 126950 - RNA, 20 nt, Human
aaaaagaguaucuuauacau

SEQ ID NO: 126951 - RNA, 27 nt, Human
agaccagccugaccaacauggugagac

SEQ ID NO: 126952 - RNA, 21 nt, Human
cuccuucacuguucccucugg

SEQ ID NO: 126953 - RNA, 21 nt, Human
uggaagagaaggugaggagca

SEQ ID NO: 126954 - RNA, 21 nt, Human
gccgguccaccaaguguguuc

SEQ ID NO: 126955 - RNA, 22 nt, Human
ucaguguccaguugcagcugga

SEQ ID NO: 126956 - RNA, 19 nt, Human
gggauuacaggugcgcacu

SEQ ID NO: 126957 - RNA, 22 nt, Human
agaccagccuggccaacauaau

SEQ ID NO: 126958 - RNA, 20 nt, Human
ucucaaagcaggaacagugg

SEQ ID NO: 126959 - RNA, 27 nt, Human
gagucaagcaucuagcccaggacauga

SEQ ID NO: 126960 - RNA, 21 nt, Human
gagggagggcuggugaggggc

SEQ ID NO: 126961 - RNA, 21 nt, Human
ccuccaggagcuaguggaggg

SEQ ID NO: 126962 - RNA, 21 nt, Human
cuaaugccaccaucuccccuc

SEQ ID NO: 126963 - RNA, 26 nt, Human
gaucgcuaugugcaauacuguauuua

SEQ ID NO: 126964 - RNA, 24 nt, Human
uaaauugaggaacauggaaaaugg

SEQ ID NO: 126965 - RNA, 22 nt, Human
ugguaaucaggcacaugaugaa

SEQ ID NO: 126966 - RNA, 23 nt, Human
auguucucucgucuugccaccau

SEQ ID NO: 126967 - RNA, 26 nt, Human
gggaaaacuggcaacaugcuaguuac

SEQ ID NO: 126968 - RNA, 20 nt, Human
cccucgggggccgaagccca

SEQ ID NO: 126969 - RNA, 23 nt, Human
ccuccuggcccaggccuugcuga

SEQ ID NO: 126970 - RNA, 27 nt, Human
uggcugcccgggcgacaguacgcccag

SEQ ID NO: 126971 - RNA, 28 nt, Human
agaaccuccacucccuccgcugccauga

SEQ ID NO: 126972 - RNA, 24 nt, Human
ugucuuuucucucaaagcuguaau

SEQ ID NO: 126973 - RNA, 20 nt, Human
ggagagaccuucucuuagga

SEQ ID NO: 126974 - RNA, 26 nt, Human
ucuaagggaggaaggcagcauugggg

SEQ ID NO: 126975 - RNA, 19 nt, Human
gcuuccccacugccucugu

SEQ ID NO: 126976 - RNA, 20 nt, Human
ggguagcagaucaauuucca

SEQ ID NO: 126977 - RNA, 20 nt, Human
aacaacaaaguuccacuucc

SEQ ID NO: 126978 - RNA, 24 nt, Human
gcgugccuccaucccagugccccg

SEQ ID NO: 126979 - RNA, 27 nt, Human
ugcugggauuacaggcgugagcaaucg

SEQ ID NO: 126980 - RNA, 21 nt, Human
agggcagggguugaggggcca

SEQ ID NO: 126981 - RNA, 24 nt, Human
guuugugaggaccuuugcacuuug

SEQ ID NO: 126982 - RNA, 23 nt, Human
cuggguucuagucccugcucugc

SEQ ID NO: 126983 - RNA, 25 nt, Human
gccuuucucaccaccucccugcucc

SEQ ID NO: 126984 - RNA, 18 nt, Human
agcuccaaccuacacuuc

SEQ ID NO: 126985 - RNA, 23 nt, Human
uuugcugcuggcuaccacucuuc

SEQ ID NO: 126986 - RNA, 23 nt, Human
gccuuucucugcccucugugaca

SEQ ID NO: 126987 - RNA, 22 nt, Human
cuccuuccccaccccaccacaa

SEQ ID NO: 126988 - RNA, 23 nt, Human
uccacagccuucagccuguucua

SEQ ID NO: 126989 - RNA, 19 nt, Human
cagccucucccugccaaag

SEQ ID NO: 126990 - RNA, 29 nt, Human
ucuuuacguguguuuuuuagagcuugguu

SEQ ID NO: 126991 - RNA, 25 nt, Human
guguguguuuaacauucacagccca

SEQ ID NO: 126992 - RNA, 27 nt, Human
uuauuugcauccucucaguuacuccug

SEQ ID NO: 126993 - RNA, 26 nt, Human
cacugccucuuuccaggggccucugg

SEQ ID NO: 126994 - RNA, 17 nt, Human
ucaaggcaccacacaac

SEQ ID NO: 126995 - RNA, 21 nt, Human
accaacaaccucaacugccua

SEQ ID NO: 126996 - RNA, 22 nt, Human
ucgacuuugugucucuguuguc

SEQ ID NO: 126997 - RNA, 27 nt, Human
caugaagagaugggcucugcucugaga

SEQ ID NO: 126998 - RNA, 27 nt, Human
aacacccuucucggaggcucaggucaa

SEQ ID NO: 126999 - RNA, 20 nt, Human
ccaggagagccgccucugug

SEQ ID NO: 127000 - RNA, 25 nt, Human
ggagggugugggugucaggccagcu

SEQ ID NO: 127001 - RNA, 21 nt, Human
caaccaguuuauccaccaaga

SEQ ID NO: 127002 - RNA, 19 nt, Human
guacuuccucucuggcuga

SEQ ID NO: 127003 - RNA, 23 nt, Human
ccgggcgcuccugaagcagcagu

SEQ ID NO: 127004 - RNA, 20 nt, Human
gcccuucccucuccucagcc

SEQ ID NO: 127005 - RNA, 25 nt, Human
acuacugccagaggaaguuuguuuu

SEQ ID NO: 127006 - RNA, 27 nt, Human
uaagaacuaguuuugggaaauguagcc

SEQ ID NO: 127007 - RNA, 27 nt, Human
ggcagaggacccggugccugccuggca

SEQ ID NO: 127008 - RNA, 23 nt, Human
aaugguuuacugucauuguguuu

SEQ ID NO: 127009 - RNA, 23 nt, Human
cccagguuuccuggugaguucca

SEQ ID NO: 127010 - RNA, 21 nt, Human
agagggugguggacaccaggc

SEQ ID NO: 127011 - RNA, 25 nt, Human
acacagccguguaugcucccagcag

SEQ ID NO: 127012 - RNA, 20 nt, Human
ccauuugggauacuuccuca

SEQ ID NO: 127013 - RNA, 22 nt, Human
aauaaauccgggugugccugaa

SEQ ID NO: 127014 - RNA, 23 nt, Human
cucucauccuacuuagccuaccu

SEQ ID NO: 127015 - RNA, 26 nt, Human
cugggagcucagguacucuuuuaguc

SEQ ID NO: 127016 - RNA, 14 nt, Human
agaaacuugcucaa

SEQ ID NO: 127017 - RNA, 27 nt, Human
gguuucucuugagaugaaaauguucua

SEQ ID NO: 127018 - RNA, 26 nt, Human
ccccucuucugcuccuuagacaccug

SEQ ID NO: 127019 - RNA, 24 nt, Human
gggaagggagcugggggaggcagu

SEQ ID NO: 127020 - RNA, 21 nt, Human
ggcacccuccuuucugcccca

SEQ ID NO: 127021 - RNA, 26 nt, Human
uggucaggaaccaacuuuacuggcaa

SEQ ID NO: 127022 - RNA, 23 nt, Human
ucugucugagcccugcccucacu

SEQ ID NO: 127023 - RNA, 14 nt, Human
cuucccuucuuuca

SEQ ID NO: 127024 - RNA, 27 nt, Human
ggcuagauuugaugacauauuacccgc

SEQ ID NO: 127025 - RNA, 26 nt, Human
gggugaggggugacacucggcucugg

SEQ ID NO: 127026 - RNA, 23 nt, Human
aagaagccacagcucuucuuggc

SEQ ID NO: 127027 - RNA, 21 nt, Human
ugcucacugcaagcuccgccu

SEQ ID NO: 127028 - RNA, 22 nt, Human
auuggaaagggggaaggaucuu

SEQ ID NO: 127029 - RNA, 19 nt, Human
acuccugaggaugcuacuc

SEQ ID NO: 127030 - RNA, 27 nt, Human
gcgggcuggguguggucuccacugggg

SEQ ID NO: 127031 - RNA, 24 nt, Human
acacugggcccuggcugggaguag

SEQ ID NO: 127032 - RNA, 23 nt, Human
agcaccaaaucaaaaucucucca

SEQ ID NO: 127033 - RNA, 21 nt, Human
cguccgcugcgucugcacuga

SEQ ID NO: 127034 - RNA, 22 nt, Human
aaagugccaggauuacaggcau

SEQ ID NO: 127035 - RNA, 21 nt, Human
aggccugacggaagagcccag

SEQ ID NO: 127036 - RNA, 23 nt, Human
cacagcccagaauucugggcaag

SEQ ID NO: 127037 - RNA, 20 nt, Human
ggggucugaggcacauggga

SEQ ID NO: 127038 - RNA, 25 nt, Human
caaaugcaaaucuuuaacuucaucu

SEQ ID NO: 127039 - RNA, 19 nt, Human
cugaguggggauuacaggc

SEQ ID NO: 127040 - RNA, 24 nt, Human
aaaugacucgcuuuucugcuugca

SEQ ID NO: 127041 - RNA, 28 nt, Human
cccuggccuuucacuccaguucugggug

SEQ ID NO: 127042 - RNA, 22 nt, Human
uuucuuuauaaaauuuacuguc

SEQ ID NO: 127043 - RNA, 20 nt, Human
ggccuaggaccucaggcggg

SEQ ID NO: 127044 - RNA, 19 nt, Human
gcgccaccacgucacgcac

SEQ ID NO: 127045 - RNA, 22 nt, Human
gcauguuccaagacaguauggg

SEQ ID NO: 127046 - RNA, 21 nt, Human
aggcugggacucagaguuauu

SEQ ID NO: 127047 - RNA, 23 nt, Human
guuucuuauguguucccuaaaac

SEQ ID NO: 127048 - RNA, 23 nt, Human
ucgccucaccuggcgcaggugga

SEQ ID NO: 127049 - RNA, 20 nt, Human
cuacugcacugcccaaggug

SEQ ID NO: 127050 - RNA, 26 nt, Human
aggaagagaacaggacgucugagugu

SEQ ID NO: 127051 - RNA, 24 nt, Human
agagguggcggcgggcagagggug

SEQ ID NO: 127052 - RNA, 20 nt, Human
gggcagugguggagcuggac

SEQ ID NO: 127053 - RNA, 29 nt, Human
ugugcagcugacugucucagccaaaccac

SEQ ID NO: 127054 - RNA, 20 nt, Human
cauccagccuggggcugagg

SEQ ID NO: 127055 - RNA, 22 nt, Human
uuugcuccuggguucaaguagu

SEQ ID NO: 127056 - RNA, 29 nt, Human
uaccacuuccugaaucaguuauuauuucu

SEQ ID NO: 127057 - RNA, 22 nt, Human
cccagccaguggcagaacuggg

SEQ ID NO: 127058 - RNA, 23 nt, Human
agcccacccugcaccucauucca

SEQ ID NO: 127059 - RNA, 22 nt, Human
cuccugaacugcuuuccauucc

SEQ ID NO: 127060 - RNA, 20 nt, Human
ccucaauuaugaaccaccuu

SEQ ID NO: 127061 - RNA, 21 nt, Human
ccuacuuguauauuucuuuac

SEQ ID NO: 127062 - RNA, 30 nt, Human; identical to SEQ ID NO: 5048

SEQ ID NO: 127063 - RNA, 19 nt, Human
aauccuucuaaauauuuga

SEQ ID NO: 127064 - RNA, 27 nt, Human
ccugccugcccugccuccgucccaacc

SEQ ID NO: 127065 - RNA, 24 nt, Human
ucgccucuuuccuucacacuccca

SEQ ID NO: 127066 - RNA, 25 nt, Human
agcucucuaaauugacucagcucca

SEQ ID NO: 127067 - RNA, 27 nt, Human
uugagccagguggauguuuaccgugug

SEQ ID NO: 127068 - RNA, 26 nt, Human
ucagcucugcaucagguguuuucuga

SEQ ID NO: 127069 - RNA, 21 nt, Human
ccccugccccugcccgagagc

SEQ ID NO: 127070 - RNA, 19 nt, Human
acuuguacgugcacuuugg

SEQ ID NO: 127071 - RNA, 18 nt, Human
cuccccuuaccccaguca

SEQ ID NO: 127072 - RNA, 21 nt, Human
cacagccggcccccggcccac

SEQ ID NO: 127073 - RNA, 27 nt, Human
auuacaucuggucucuuccuucacugc

SEQ ID NO: 127074 - RNA, 21 nt, Human
uuuuauagcuuuaauuugugu

SEQ ID NO: 127075 - RNA, 21 nt, Human
gugcagacuucaggagaacuc

SEQ ID NO: 127076 - RNA, 26 nt, Human
cgggaugggccaccgccgaauuugua

SEQ ID NO: 127077 - RNA, 21 nt, Human
aucugaaaucaucucuagucu

SEQ ID NO: 127078 - RNA, 21 nt, Human
uggaggugggauccacacagc

SEQ ID NO: 127079 - RNA, 23 nt, Human
gagaccccccuccccaucccagc

SEQ ID NO: 127080 - RNA, 23 nt, Human
gcucauuuuuugucucagugaua

SEQ ID NO: 127081 - RNA, 27 nt, Human
cagucucucccuggcucucccuccauc

SEQ ID NO: 127082 - RNA, 29 nt, Human
agguuggaccgggaggcaguggcuuggag

SEQ ID NO: 127083 - RNA, 27 nt, Human
aggacugcgggaaggcgcgggagccag

SEQ ID NO: 127084 - RNA, 22 nt, Human
guccugccugagguugcaguga

SEQ ID NO: 127085 - RNA, 18 nt, Human
ggcauuugagugugcaaa

SEQ ID NO: 127086 - RNA, 25 nt, Human
ggcugcgcauguccagaagcauuuc

SEQ ID NO: 127087 - RNA, 22 nt, Human
caggccuguaaucccagcacuu

SEQ ID NO: 127088 - RNA, 22 nt, Human
uaucugugcuuugcccacaugc

SEQ ID NO: 127089 - RNA, 20 nt, Human
gcuuugguuuucauuccuuu

SEQ ID NO: 127090 - RNA, 23 nt, Human
cagggaccugacuuccaccucuc

SEQ ID NO: 127091 - RNA, 23 nt, Human
guguauugaaccuuuuacugcaa

SEQ ID NO: 127092 - RNA, 20 nt, Human
auuagugccaguuagugccu

SEQ ID NO: 127093 - RNA, 26 nt, Human
gaugggauuaugcacuucccaauugg

SEQ ID NO: 127094 - RNA, 26 nt, Human
ugaaagguugggggaggcugggagag

SEQ ID NO: 127095 - RNA, 22 nt, Human
ccucaccuucuaaggucagcuc

SEQ ID NO: 127096 - RNA, 21 nt, Human
guucuuacagaguaucuuuaa

SEQ ID NO: 127097 - RNA, 27 nt, Human
agaagcagccgagacgccacuuggaua

SEQ ID NO: 127098 - RNA, 27 nt, Human
ugcagcuccagggcuggugcucuagca

SEQ ID NO: 127099 - RNA, 21 nt, Human
uccucuugauaaauaaacaau

SEQ ID NO: 127100 - RNA, 24 nt, Human
gcuacuucuguggaaguagcuuug

SEQ ID NO: 127101 - RNA, 22 nt, Human
ccacguguauguauucuuuuug

SEQ ID NO: 127102 - RNA, 20 nt, Human
gcuggucucaacuccugggc

SEQ ID NO: 127103 - RNA, 19 nt, Human
guggguaaauuaacugaac

SEQ ID NO: 127104 - RNA, 23 nt, Human
ugccacccagaaccugagugcgg

SEQ ID NO: 127105 - RNA, 21 nt, Human
cucaccaguucugcugccuca

SEQ ID NO: 127106 - RNA, 25 nt, Human
cuucuuucuuuaaaacaaacaaaca

SEQ ID NO: 127107 - RNA, 21 nt, Human
ggccccucuuggccucugucc

SEQ ID NO: 127108 - RNA, 21 nt, Human
cuuggucugucugucucuguc

SEQ ID NO: 127109 - RNA, 22 nt, Human
ccucaaaccacaauaggaacca

SEQ ID NO: 127110 - RNA, 19 nt, Human
aggggcagauuucauaaca

SEQ ID NO: 127111 - RNA, 23 nt, Human
acugcagauaagaaucacuuggg

SEQ ID NO: 127112 - RNA, 20 nt, Human
augccaacauggccagguca

SEQ ID NO: 127113 - RNA, 23 nt, Human
ggcggugaggacggacagucacc

SEQ ID NO: 127114 - RNA, 20 nt, Human
cccgcacgcucucuggacca

SEQ ID NO: 127115 - RNA, 21 nt, Human
cucuacugcccgucccggacg

SEQ ID NO: 127116 - RNA, 20 nt, Human
ucugccucuuggaguuuggu

SEQ ID NO: 127117 - RNA, 26 nt, Human
accaaucucuguggcuucacucauga

SEQ ID NO: 127118 - RNA, 21 nt, Human
ucagucucagagaggcuggca

SEQ ID NO: 127119 - RNA, 21 nt, Human
ggccacacuccuuccuugccc

SEQ ID NO: 127120 - RNA, 24 nt, Human
uuugaacuucccaaccuuguuuga

SEQ ID NO: 127121 - RNA, 23 nt, Human
ggaugacauggcccugccugagc

SEQ ID NO: 127122 - RNA, 26 nt, Human
cugccucucuggggagaugcuggagg

SEQ ID NO: 127123 - RNA, 22 nt, Human
acacagacacuugccuauacag

SEQ ID NO: 127124 - RNA, 21 nt, Human
ugugugcuggcccugugcuag

SEQ ID NO: 127125 - RNA, 20 nt, Human
ggccuggagucagguuuggg

SEQ ID NO: 127126 - RNA, 18 nt, Human
uaaaacugcucugccuuu

SEQ ID NO: 127127 - RNA, 21 nt, Human
ccuguaaucccgguacuuugg

SEQ ID NO: 127128 - RNA, 20 nt, Human
cgggcacaguggcucaugcc

SEQ ID NO: 127129 - RNA, 20 nt, Human
ugggcacaguggcucacgcc

SEQ ID NO: 127130 - RNA, 23 nt, Human
cuccacccucaucucucugcgua

SEQ ID NO: 127131 - RNA, 21 nt, Human
accaagagguagcccuggggg

SEQ ID NO: 127132 - RNA, 25 nt, Human
ccuccucccccuccucucuggcagg

SEQ ID NO: 127133 - RNA, 27 nt, Human
uggccaacauagugaaacccccucucu

SEQ ID NO: 127134 - RNA, 25 nt, Human
uucaucagcugugugcauuucagga

SEQ ID NO: 127135 - RNA, 23 nt, Human
ggaucuagagaugcucucugcuu

SEQ ID NO: 127136 - RNA, 26 nt, Human
cccucuuacuuuuucucuuguggaac

SEQ ID NO: 127137 - RNA, 18 nt, Human
cuggugcauggcugccuc

SEQ ID NO: 127138 - RNA, 18 nt, Human
aggcccugagaucaauga

SEQ ID NO: 127139 - RNA, 22 nt, Human
aacaaccucugcuauuuaagga

SEQ ID NO: 127140 - RNA, 27 nt, Human
gcuguaacccucacccacagccugcug

SEQ ID NO: 127141 - RNA, 28 nt, Human
uuccagaucagcccaaguuuacuauaga

SEQ ID NO: 127142 - RNA, 21 nt, Human
cucacagacauuucucuuuca

SEQ ID NO: 127143 - RNA, 25 nt, Human
ugcggccugagauauuuuucuacag

SEQ ID NO: 127144 - RNA, 24 nt, Human
gagcagcugcucacacaggaggcc

SEQ ID NO: 127145 - RNA, 21 nt, Human
acuauuuuaaagugagaaguu

SEQ ID NO: 127146 - RNA, 21 nt, Human
gaagagucuguuuuuaaucau

SEQ ID NO: 127147 - RNA, 23 nt, Human
aguguuauuuucugauuguggug

SEQ ID NO: 127148 - RNA, 21 nt, Human
cacccugggcuuccugagcca

SEQ ID NO: 127149 - RNA, 24 nt, Human
ucaagccccauuggucccagagua

SEQ ID NO: 127150 - RNA, 23 nt, Human
ggcucacugcaagcucugcccuc

SEQ ID NO: 127151 - RNA, 24 nt, Human
cauauuggggaagcagugauuuua

SEQ ID NO: 127152 - RNA, 25 nt, Human
gaagggauugcuucacugguuuaau

SEQ ID NO: 127153 - RNA, 21 nt, Human
aagcacacaggcuuuagaguc

SEQ ID NO: 127154 - RNA, 22 nt, Human
agaccuccaggauuauuucucu

SEQ ID NO: 127155 - RNA, 24 nt, Human
uacauggugggcacugagagacaa

SEQ ID NO: 127156 - RNA, 26 nt, Human
cccugccucuuuuccccaugaacucu

SEQ ID NO: 127157 - RNA, 20 nt, Human
cguggagguccugccuagau

SEQ ID NO: 127158 - RNA, 22 nt, Human
ggccccuugcuggagucaugug

SEQ ID NO: 127159 - RNA, 21 nt, Human
ugauaaccacagccugggcug

SEQ ID NO: 127160 - RNA, 24 nt, Human
uuuugaauccacuaucucuuucca

SEQ ID NO: 127161 - RNA, 30 nt, Human
ggggguggacuugggaacaggcuguguguu

SEQ ID NO: 127162 - RNA, 22 nt, Human
agucucuucuauuucuuucuuu

SEQ ID NO: 127163 - RNA, 19 nt, Human
uuaccaccuggggacccaa

SEQ ID NO: 127164 - RNA, 27 nt, Human
ccuuucccaauaggaaaccccaacagg

SEQ ID NO: 127165 - RNA, 25 nt, Human
agauggacuccagccugccuggcag

SEQ ID NO: 127166 - RNA, 21 nt, Human
auugauacccuguagugcaaa

SEQ ID NO: 127167 - RNA, 25 nt, Human
auuucuccaguggauucccagggac

SEQ ID NO: 127168 - RNA, 22 nt, Human
cagguaagaggggaacagcugc

SEQ ID NO: 127169 - RNA, 18 nt, Human
gaagaacccacagaccag

SEQ ID NO: 127170 - RNA, 22 nt, Human
caccucccgggcucaagcgauu

SEQ ID NO: 127171 - RNA, 21 nt, Human
gaagguuggagguggggaagg

SEQ ID NO: 127172 - RNA, 17 nt, Human
gugaucaggauguaaua

SEQ ID NO: 127173 - RNA, 18 nt, Human
ccauuaaccagaucuagu

SEQ ID NO: 127174 - RNA, 22 nt, Human
caagccuguauagacagcacuu

SEQ ID NO: 127175 - RNA, 25 nt, Human
cuguugccuaucuuuguccucucuc

SEQ ID NO: 127176 - RNA, 23 nt, Human
ggaauacaucuugacccuuuucc

SEQ ID NO: 127177 - RNA, 23 nt, Human
acauugugauuuguacuaucuac

SEQ ID NO: 127178 - RNA, 26 nt, Human
gccccugcguggccugaguccugguc

SEQ ID NO: 127179 - RNA, 22 nt, Human
uaaauugaaaugggaacaauau

SEQ ID NO: 127180 - RNA, 21 nt, Human
ggcuucaucuaccuccaggcu

SEQ ID NO: 127181 - RNA, 26 nt, Human
caggcucucuuguauucuuucaccuc

SEQ ID NO: 127182 - RNA, 21 nt, Human
guuuugcugacucauuccaua

SEQ ID NO: 127183 - RNA, 22 nt, Human
guccccacccuccacucagcug

SEQ ID NO: 127184 - RNA, 20 nt, Human
acauuuucaauacuguccca

SEQ ID NO: 127185 - RNA, 27 nt, Human
uccaaguuuccccuuguggaugcgcgg

SEQ ID NO: 127186 - RNA, 26 nt, Human
auagauaaacuuuuugccacuauaug

SEQ ID NO: 127187 - RNA, 24 nt, Human
agcaucagcagggucucuacccau

SEQ ID NO: 127188 - RNA, 23 nt, Human
ucuggucugaccgaugugucucc

SEQ ID NO: 127189 - RNA, 20 nt, Human
gcugccucuaccugccuggu

SEQ ID NO: 127190 - RNA, 20 nt, Human
agugaauguuuaucuaucuu

SEQ ID NO: 127191 - RNA, 22 nt, Human
ggcgacaacuuccaucauucca

SEQ ID NO: 127192 - RNA, 22 nt, Human
ccagccuggucaacaagaguaa

SEQ ID NO: 127193 - RNA, 20 nt, Human
agaucacugcauggagauca

SEQ ID NO: 127194 - RNA, 23 nt, Human
aguccuccucccuuucugggcuu

SEQ ID NO: 127195 - RNA, 25 nt, Human
cauauuccucucaguccuucuuggg

SEQ ID NO: 127196 - RNA, 28 nt, Human
gggcuuucucagugucagcacucaggua

SEQ ID NO: 127197 - RNA, 19 nt, Human
uaaagcaagucacugugcc

SEQ ID NO: 127198 - RNA, 22 nt, Human
caucccucgugguccccaacag

SEQ ID NO: 127199 - RNA, 23 nt, Human
ucuuggcugcacaagauauccau

SEQ ID NO: 127200 - RNA, 23 nt, Human
agcuucgugaggggucucuggcc

SEQ ID NO: 127201 - RNA, 27 nt, Human
aaauccaauuggauacgacaacuugca

SEQ ID NO: 127202 - RNA, 28 nt, Human
ccugcauccagcuucccugccaaacuca

SEQ ID NO: 127203 - RNA, 24 nt, Human
agaggaagacuauuuggacuuuuu

SEQ ID NO: 127204 - RNA, 19 nt, Human
gcuucuaaaggcagucuag

SEQ ID NO: 127205 - RNA, 21 nt, Human
uaauccuuguguaaagcagca

SEQ ID NO: 127206 - RNA, 28 nt, Human
ucucaaacuccugaccucaggcgaucca

SEQ ID NO: 127207 - RNA, 22 nt, Human
uucucuaauaaaaaagccacuu

SEQ ID NO: 127208 - RNA, 18 nt, Human
gugccucuggcugcugua

SEQ ID NO: 127209 - RNA, 23 nt, Human
agugacgccucuguguucugggg

SEQ ID NO: 127210 - RNA, 32 nt, Human
uccagugggaaagaaagagcuuuauuuacaga

SEQ ID NO: 127211 - RNA, 23 nt, Human
cccugcauggucaccucaguccu

SEQ ID NO: 127212 - RNA, 22 nt, Human
ccgccucccuccagcccuggag

SEQ ID NO: 127213 - RNA, 22 nt, Human
uguuacugccuaucagcauuuu

SEQ ID NO: 127214 - RNA, 22 nt, Human
aggugggcggaucacgaggucu

SEQ ID NO: 127215 - RNA, 22 nt, Human
agccuugacacuccccuugcaa

SEQ ID NO: 127216 - RNA, 20 nt, Human
agcacagccagguuccccca

SEQ ID NO: 127217 - RNA, 22 nt, Human
gcugggagaaaagcaugauucc

SEQ ID NO: 127218 - RNA, 23 nt, Human
uggaaagaaaaugacauuuaaau

SEQ ID NO: 127219 - RNA, 27 nt, Human
cacuacccugauucuugauuccuggcu

SEQ ID NO: 127220 - RNA, 26 nt, Human
cccauaccucagccucaggcgagugg

SEQ ID NO: 127221 - RNA, 21 nt, Human
cauauuccgcacugggcacag

SEQ ID NO: 127222 - RNA, 20 nt, Human
cugccuuucugccaggauca

SEQ ID NO: 127223 - RNA, 20 nt, Human
guguugcccaggcuggucgc

SEQ ID NO: 127224 - RNA, 26 nt, Human
uucacaguccuggacuccugccacca

SEQ ID NO: 127225 - RNA, 22 nt, Human
gacgggguuuugucauguugcu

SEQ ID NO: 127226 - RNA, 23 nt, Human
gccccgccacccccuccucagcu

SEQ ID NO: 127227 - RNA, 23 nt, Human
ucugggccgucuaacuggcagcu

SEQ ID NO: 127228 - RNA, 23 nt, Human
gucucgaacuccugaccuaguga

SEQ ID NO: 127229 - RNA, 23 nt, Human
gcccaggcugggagggcaauggc

SEQ ID NO: 127230 - RNA, 27 nt, Human
gcaccacgggcuuuuaauuuuaauccu

SEQ ID NO: 127231 - RNA, 24 nt, Human
gcacagccaaccauaaucagcaug

SEQ ID NO: 127232 - RNA, 20 nt, Human
guacacccacccacauaucu

SEQ ID NO: 127233 - RNA, 26 nt, Human
ugccuucagggcaucuugaaaugucc

SEQ ID NO: 127234 - RNA, 22 nt, Human
uuagcacauguguaagacacug

SEQ ID NO: 127235 - RNA, 25 nt, Human
ggauagaggccacauugacugaggg

SEQ ID NO: 127236 - RNA, 24 nt, Human
ucucccacccucacugaucacgcc

SEQ ID NO: 127237 - RNA, 21 nt, Human
auucacugcccccagcucuuc

SEQ ID NO: 127238 - RNA, 20 nt, Human
uucucucccacacccugccc

SEQ ID NO: 127239 - RNA, 18 nt, Human
agacaaggccagagggug

SEQ ID NO: 127240 - RNA, 22 nt, Human
aggggcccccagcuguggcucu

SEQ ID NO: 127241 - RNA, 21 nt, Human
cagcugcucagcaccauuuca

SEQ ID NO: 127242 - RNA, 28 nt, Human
cucugauuuuugccucuggauaguagau

SEQ ID NO: 127243 - RNA, 23 nt, Human
uuccuggcaauaguguguucuga

SEQ ID NO: 127244 - RNA, 32 nt, Human
gcagugucccugaauggcaagugauguaccuu

SEQ ID NO: 127245 - RNA, 27 nt, Human
gaucaaauuaagauucucugcccagcc

SEQ ID NO: 127246 - RNA, 21 nt, Human
uucagaagaacggcaugaaca

SEQ ID NO: 127247 - RNA, 20 nt, Human
cuguucugugaucuaaaaca

SEQ ID NO: 127248 - RNA, 20 nt, Human
ucccuucaagacgaggggca

SEQ ID NO: 127249 - RNA, 21 nt, Human
accaccuucccuccucuccag

SEQ ID NO: 127250 - RNA, 20 nt, Human
aggcuggcccgggaggggag

SEQ ID NO: 127251 - RNA, 21 nt, Human
ggauagcuccuccuugagugu

SEQ ID NO: 127252 - RNA, 26 nt, Human
cccuccgcgcucuccgcuuguggaua

SEQ ID NO: 127253 - RNA, 24 nt, Human
cuguccgugcccaugcaucuggaa

SEQ ID NO: 127254 - RNA, 22 nt, Human
aguggagcuuucugauuucuug

SEQ ID NO: 127255 - RNA, 24 nt, Human
gcacccaccccugcccugacuugu

SEQ ID NO: 127256 - RNA, 22 nt, Human
uggcugaggccggaggaucgag

SEQ ID NO: 127257 - RNA, 22 nt, Human
ucacauguuuuucuuccuuguc

SEQ ID NO: 127258 - RNA, 26 nt, Human
acuuguuuacaucugaucaaagcacu

SEQ ID NO: 127259 - RNA, 22 nt, Human
aaauguucuuaaacuaugaguu

SEQ ID NO: 127260 - RNA, 20 nt, Human
gugauucccucccuuucacu

SEQ ID NO: 127261 - RNA, 21 nt, Human
uacccuggcugugggggcauc

SEQ ID NO: 127262 - RNA, 20 nt, Human
ggagcaggaggaggaaaggu

SEQ ID NO: 127263 - RNA, 19 nt, Human
cuaggaggucgaggcugca

SEQ ID NO: 127264 - RNA, 19 nt, Human
ccaggagguugaggcugca

SEQ ID NO: 127265 - RNA, 18 nt, Human
ucugcagcuccacgugga

SEQ ID NO: 127266 - RNA, 21 nt, Human
gguccuuucauuuccauuuau

SEQ ID NO: 127267 - RNA, 26 nt, Human
cccagccugggcuccucugcaucuug

SEQ ID NO: 127268 - RNA, 21 nt, Human
uucauuauacuuuucucucca

SEQ ID NO: 127269 - RNA, 27 nt, Human
ggucucaaacuccugggcucaagcgau

SEQ ID NO: 127270 - RNA, 19 nt, Human
cacauauagacacauacac

SEQ ID NO: 127271 - RNA, 24 nt, Human
cgggaggugcugccugccagggga

SEQ ID NO: 127272 - RNA, 24 nt, Human
acugaagcugcaucuauaugucac

SEQ ID NO: 127273 - RNA, 21 nt, Human
ucacccaggcugccaggcugg

SEQ ID NO: 127274 - RNA, 23 nt, Human
caggcuggaggaggguuugggca

SEQ ID NO: 127275 - RNA, 23 nt, Human
aggaagagucugggaggcaggcg

SEQ ID NO: 127276 - RNA, 22 nt, Human
gcucaugccuauaaucccagca

SEQ ID NO: 127277 - RNA, 20 nt, Human
acuuucucccucgcagcgcc

SEQ ID NO: 127278 - RNA, 22 nt, Human
cagaggggcugggcccaggcaa

SEQ ID NO: 127279 - RNA, 23 nt, Human
ccuggaauuguucuguaccucuu

SEQ ID NO: 127280 - RNA, 27 nt, Human
ucccaggguggucccagcuggugggag

SEQ ID NO: 127281 - RNA, 21 nt, Human
ggaggacugcaaacuuggaua

SEQ ID NO: 127282 - RNA, 29 nt, Human
cuaagucauuauucucucaguuacuccau

SEQ ID NO: 127283 - RNA, 23 nt, Human
gggccauucucauuugauguucc

SEQ ID NO: 127284 - RNA, 20 nt, Human
caggcggcagaggugcugga

SEQ ID NO: 127285 - RNA, 26 nt, Human
uggaauagcaguguuccaguguguga

SEQ ID NO: 127286 - RNA, 24 nt, Human
cugguggagggggaggggagaagc

SEQ ID NO: 127287 - RNA, 23 nt, Human
ccuccugccuuccccugugggca

SEQ ID NO: 127288 - RNA, 24 nt, Human
cugcccaagugaaaagcaaccaag

SEQ ID NO: 127289 - RNA, 27 nt, Human
guccaaaacaaaaaauggcaucaccug

SEQ ID NO: 127290 - RNA, 24 nt, Human
gaaagggagagcagagauggcagc

SEQ ID NO: 127291 - RNA, 21 nt, Human
cagagugcugggaucacaggc

SEQ ID NO: 127292 - RNA, 24 nt, Human
gagcaaaugcuauuugauaacagu

SEQ ID NO: 127293 - RNA, 21 nt, Human
gucaccuagggguucauagaa

SEQ ID NO: 127294 - RNA, 22 nt, Human
aggcugagggcggagaggcgca

SEQ ID NO: 127295 - RNA, 24 nt, Human
cccugcucccacuuugugagagcc

SEQ ID NO: 127296 - RNA, 27 nt, Human
uggucucaaagccagucccagccugac

SEQ ID NO: 127297 - RNA, 27 nt, Human
ucacugcacucagaccagaaaucuaga

SEQ ID NO: 127298 - RNA, 22 nt, Human
gccuguaaucccagcuacuugg

SEQ ID NO: 127299 - RNA, 27 nt, Human
caggaccuugguggacacuguguacac

SEQ ID NO: 127300 - RNA, 23 nt, Human
gcagcccaggcuggagugcagug

SEQ ID NO: 127301 - RNA, 19 nt, Human
ucucccucguacagcacag

SEQ ID NO: 127302 - RNA, 24 nt, Human
ucaggaagaaguguggaggcaugg

SEQ ID NO: 127303 - RNA, 23 nt, Human
uggcaggcgauacggcagcucug

SEQ ID NO: 127304 - RNA, 21 nt, Human
ccuuugucauuauuagucuuc

SEQ ID NO: 127305 - RNA, 23 nt, Human
ccuuggcucccuguccugcuccc

SEQ ID NO: 127306 - RNA, 27 nt, Human
ucugggagccaguuccuaguccucaac

SEQ ID NO: 127307 - RNA, 22 nt, Human
aacagccuugggguaguggcaa

SEQ ID NO: 127308 - RNA, 21 nt, Human
gaugcagucucccaggagagg

SEQ ID NO: 127309 - RNA, 25 nt, Human
uucucucuuaagacucugagauuca

SEQ ID NO: 127310 - RNA, 20 nt, Human
gcugcuucuccucugcccag

SEQ ID NO: 127311 - RNA, 21 nt, Human
cagcagcugcuacccacagcc

SEQ ID NO: 127312 - RNA, 23 nt, Human
cuggccaggggagaaggagcugc

SEQ ID NO: 127313 - RNA, 25 nt, Human
uuucauguguaagaaaaggcccauu

SEQ ID NO: 127314 - RNA, 21 nt, Human
ccugcuccucugccuggacca

SEQ ID NO: 127315 - RNA, 26 nt, Human
ccucugucugcaccgcgccagcccca

SEQ ID NO: 127316 - RNA, 19 nt, Human
gaguaaguuucucauccca

SEQ ID NO: 127317 - RNA, 19 nt, Human
uacauacuauggaauuucu

SEQ ID NO: 127318 - RNA, 23 nt, Human
ggugacuaugccuccucuucugc

SEQ ID NO: 127319 - RNA, 21 nt, Human
acacuccuccaccugucucaa

SEQ ID NO: 127320 - RNA, 23 nt, Human
cccaaguagcugggaguacagcg

SEQ ID NO: 127321 - RNA, 26 nt, Human
gcauguuggucauagucugcacuuug

SEQ ID NO: 127322 - RNA, 21 nt, Human
agaccccuuaccacugcucug

SEQ ID NO: 127323 - RNA, 27 nt, Human
gcgcuggaaggcuguggccucuugcuc

SEQ ID NO: 127324 - RNA, 27 nt, Human
gucuaccugaugaaccugagcgggugc

SEQ ID NO: 127325 - RNA, 22 nt, Human
aggcugagauaggagaaucgcu

SEQ ID NO: 127326 - RNA, 26 nt, Human
aauacuccuagggcucaggacaagug

SEQ ID NO: 127327 - RNA, 28 nt, Human
uccccaucagacuggaugugccuuuauc

SEQ ID NO: 127328 - RNA, 25 nt, Human
cuggggcagaggggggagggaggga

SEQ ID NO: 127329 - RNA, 28 nt, Human
gcuuacauguucaucucuugccaaauaa

SEQ ID NO: 127330 - RNA, 25 nt, Human
gagggagguaacagaaagacucuuu

SEQ ID NO: 127331 - RNA, 25 nt, Human
ccggccccuggccccugccugcccu

SEQ ID NO: 127332 - RNA, 21 nt, Human
ugcuauagagaacauucuucc

SEQ ID NO: 127333 - RNA, 27 nt, Human
uccuccagggacaauggcgucucuugg

SEQ ID NO: 127334 - RNA, 23 nt, Human
caccggugcaaggagaugucuga

SEQ ID NO: 127335 - RNA, 20 nt, Human
cuuuaaaaucaguacauuua

SEQ ID NO: 127336 - RNA, 21 nt, Human
acacuccugccugcuguuccu

SEQ ID NO: 127337 - RNA, 24 nt, Human
gccugccuguagcggcguuguugc

SEQ ID NO: 127338 - RNA, 28 nt, Human
gggucucaaacuccugaccucaggcgau

SEQ ID NO: 127339 - RNA, 23 nt, Human
gaagaagaugagagaccugcaaa

SEQ ID NO: 127340 - RNA, 21 nt, Human
aucaugguuauaauuuuucuc

SEQ ID NO: 127341 - RNA, 23 nt, Human
cuuugcucuccccucuaggcaca

SEQ ID NO: 127342 - RNA, 27 nt, Human
aauagcaaauucauguuagaaaaacuu

SEQ ID NO: 127343 - RNA, 21 nt, Human
ucucgaacuccugaccucagg

SEQ ID NO: 127344 - RNA, 23 nt, Human
cuuacugcaaccuccaccuccug

SEQ ID NO: 127345 - RNA, 29 nt, Human
guguaugcgaauguuucagugccucagac

SEQ ID NO: 127346 - RNA, 26 nt, Human
acaggcugaccaggaucaccaggaag

SEQ ID NO: 127347 - RNA, 19 nt, Human
cccaggcaagagugcagug

SEQ ID NO: 127348 - RNA, 25 nt, Human
gggcugucuugccucacacuccuca

SEQ ID NO: 127349 - RNA, 27 nt, Human
cccucauuuccccugcuguuugccccu

SEQ ID NO: 127350 - RNA, 22 nt, Human
aaaguguugggauuacaggugu

SEQ ID NO: 127351 - RNA, 19 nt, Human
uggaguaaaguugcagugg

SEQ ID NO: 127352 - RNA, 26 nt, Human
cucaucugcaucuuucacaccuccca

SEQ ID NO: 127353 - RNA, 23 nt, Human
cugaggcaggaggaucacaguga

SEQ ID NO: 127354 - RNA, 24 nt, Human
auggaaagggagggaaagacaaga

SEQ ID NO: 127355 - RNA, 21 nt, Human
ugcaugucuguuuacacuucu

SEQ ID NO: 127356 - RNA, 24 nt, Human
ggugcucucuuucugucuucuaca

SEQ ID NO: 127357 - RNA, 21 nt, Human
uucuugaacauacuugguuca

SEQ ID NO: 127358 - RNA, 24 nt, Human
cauguuugcaugagugucagggcu

SEQ ID NO: 127359 - RNA, 25 nt, Human
cuccaccuuccugcacucauucuca

SEQ ID NO: 127360 - RNA, 25 nt, Human
ucuggcccuggcccuuacuugcuuc

SEQ ID NO: 127361 - RNA, 23 nt, Human
uucuugugguaagagcaagugca

SEQ ID NO: 127362 - RNA, 27 nt, Human
gucucaaacucuuuggcucaagccauc

SEQ ID NO: 127363 - RNA, 22 nt, Human
uggacugagaaauuauacuuac

SEQ ID NO: 127364 - RNA, 21 nt, Human
ggccucuccauuugcucuuca

SEQ ID NO: 127365 - RNA, 20 nt, Human
cuccagccaguacuccaggu

SEQ ID NO: 127366 - RNA, 30 nt, Human
gccuugggcucuggugucucccagucugcu

SEQ ID NO: 127367 - RNA, 21 nt, Human
cucaaagcccagaauccccaa

SEQ ID NO: 127368 - RNA, 21 nt, Human
aucuucuuugcuucuccaacc

SEQ ID NO: 127369 - RNA, 27 nt, Human
gguuagugcucgagugaaaaccucuuu

SEQ ID NO: 127370 - RNA, 20 nt, Human
caguuuuggagguugggagg

SEQ ID NO: 127371 - RNA, 24 nt, Human
ugucauuguuuucacagcacuuuu

SEQ ID NO: 127372 - RNA, 19 nt, Human
agcuucucuugccaccuca

SEQ ID NO: 127373 - RNA, 21 nt, Human
acuuacuaaaggcacuuccuu

SEQ ID NO: 127374 - RNA, 25 nt, Human
ucugacccuucuacauuugagggcc

SEQ ID NO: 127375 - RNA, 23 nt, Human
aggcuggaguacagugacacgac

SEQ ID NO: 127376 - RNA, 23 nt, Human
uguaacccaggcuggaaugcaau

SEQ ID NO: 127377 - RNA, 22 nt, Human
ggcaugguucauuaucaugcca

SEQ ID NO: 127378 - RNA, 26 nt, Human
ggcuacgccuguaaucccagcacuuu

SEQ ID NO: 127379 - RNA, 22 nt, Human
ggagugggucuggaggaccugc

SEQ ID NO: 127380 - RNA, 27 nt, Human
cguuggugccaucagugauuuacaaac

SEQ ID NO: 127381 - RNA, 27 nt, Human
ccacugcaccuggcggggucuugcuua

SEQ ID NO: 127382 - RNA, 22 nt, Human
acugugagucccuaucccaaga

SEQ ID NO: 127383 - RNA, 25 nt, Human
ugagggaggggcaggagagcaguga

SEQ ID NO: 127384 - RNA, 24 nt, Human
gguuuauaauccuugaauauuguu

SEQ ID NO: 127385 - RNA, 22 nt, Human
uguugaugucagguauuuacag

SEQ ID NO: 127386 - RNA, 22 nt, Human
gugguauagggaaaaggcucca

SEQ ID NO: 127387 - RNA, 23 nt, Human
cuguacuuuugauagcugugcca

SEQ ID NO: 127388 - RNA, 27 nt, Human
augguaccugcucaugguuaugaagcu

SEQ ID NO: 127389 - RNA, 20 nt, Human
aggaagaggaucaccuucca

SEQ ID NO: 127390 - RNA, 26 nt, Human
gccccugggucagucuggugggagga

SEQ ID NO: 127391 - RNA, 21 nt, Human
aaaaggcagugcuaagcacaa

SEQ ID NO: 127392 - RNA, 24 nt, Human
ugaguguguuuuauaaacuuucug

SEQ ID NO: 127393 - RNA, 23 nt, Human
gugugagccaccacgccugggcc

SEQ ID NO: 127394 - RNA, 24 nt, Human
gucuuccuggguucugaaguaacg

SEQ ID NO: 127395 - RNA, 22 nt, Human
uuaccuuuuuccuuccuuauca

SEQ ID NO: 127396 - RNA, 21 nt, Human
agggucugaaagguuggggga

SEQ ID NO: 127397 - RNA, 24 nt, Human
guuuccccucaguccuccuuugcu

SEQ ID NO: 127398 - RNA, 25 nt, Human
ccacuacuucccagggacucucaca

SEQ ID NO: 127399 - RNA, 22 nt, Human
ugucacucaggcuggaguacag

SEQ ID NO: 127400 - RNA, 25 nt, Human
guguuuuugugcccuccuggggacc

SEQ ID NO: 127401 - RNA, 21 nt, Human
uauuaaaauggaauaauacua

SEQ ID NO: 127402 - RNA, 31 nt, Human
ggagaggagagaaucuggacauggcuuugga

SEQ ID NO: 127403 - RNA, 21 nt, Human
agagcacagucccauccaggc

SEQ ID NO: 127404 - RNA, 26 nt, Human
ucuucauaaagaugaguaaagucuca

SEQ ID NO: 127405 - RNA, 24 nt, Human
ccaauccugugcugcuauccugcc

SEQ ID NO: 127406 - RNA, 22 nt, Human
agaccagccugaccgacaugga

SEQ ID NO: 127407 - RNA, 20 nt, Human
ccugcagcucucaugcugcc

SEQ ID NO: 127408 - RNA, 23 nt, Human
aggagcaccagaccuccucuugg

SEQ ID NO: 127409 - RNA, 23 nt, Human
cacccuucucuauugucuggacc

SEQ ID NO: 127410 - RNA, 27 nt, Human
aaauacuguaacacuguauaacauuua

SEQ ID NO: 127411 - RNA, 19 nt, Human
aagguguucauuuugucac

SEQ ID NO: 127412 - RNA, 26 nt, Human
cugguucuaucacaaugaaacggcug

SEQ ID NO: 127413 - RNA, 21 nt, Human
uuugcagcuguuuucaaagcc

SEQ ID NO: 127414 - RNA, 24 nt, Human
gcccccagccccagcuaccaccuc

SEQ ID NO: 127415 - RNA, 22 nt, Human
uggaauucugccugaauugacc

SEQ ID NO: 127416 - RNA, 21 nt, Human
ggccugagcccucucccccgg

SEQ ID NO: 127417 - RNA, 21 nt, Human
auagauguuuauuuauuuuua

SEQ ID NO: 127418 - RNA, 27 nt, Human
uagcuggaaauacuuggaauauuuucc

SEQ ID NO: 127419 - RNA, 26 nt, Human
gccaucgucauagugcacagugacuu

SEQ ID NO: 127420 - RNA, 22 nt, Human
gccggaauccugcacggugcca

SEQ ID NO: 127421 - RNA, 27 nt, Human
aaagcgaggaccuggagauaaacgcug

SEQ ID NO: 127422 - RNA, 26 nt, Human
acaagucccucccuguauuuuguucu

SEQ ID NO: 127423 - RNA, 25 nt, Human
ccugcugaggcugccccauauuuua

SEQ ID NO: 127424 - RNA, 22 nt, Human
agaaauucaggauguaaagcca

SEQ ID NO: 127425 - RNA, 23 nt, Human
aguauaucucuagaugcaaauac

SEQ ID NO: 127426 - RNA, 25 nt, Human
uggggagggcaguuuuguaaaauag

SEQ ID NO: 127427 - RNA, 20 nt, Human
ugaguauucagcgaggcaga

SEQ ID NO: 127428 - RNA, 26 nt, Human
auauagagaaaucuggcuggcuacag

SEQ ID NO: 127429 - RNA, 21 nt, Human
ggaagguaagauucagggcaa

SEQ ID NO: 127430 - RNA, 22 nt, Human
cacgagggccgcggugcagugu

SEQ ID NO: 127431 - RNA, 22 nt, Human
cccaccagccacagugcccaug

SEQ ID NO: 127432 - RNA, 26 nt, Human
ugacccaagaaugugucugugucuuc

SEQ ID NO: 127433 - RNA, 20 nt, Human
gcaauccccaaauuuuaugg

SEQ ID NO: 127434 - RNA, 24 nt, Human
gggcuuggcaggggucccugcugc

SEQ ID NO: 127435 - RNA, 23 nt, Human
cucugccagcuggaagugcuugg

SEQ ID NO: 127436 - RNA, 21 nt, Human
agaucaagaucagcuucacuc

SEQ ID NO: 127437 - RNA, 27 nt, Human
ggcaguugugaggccacagagugccuu

SEQ ID NO: 127438 - RNA, 22 nt, Human
ccgcaaggaccuggagauugug

SEQ ID NO: 127439 - RNA, 23 nt, Human
ggugcacgcuaccaugccuggcu

SEQ ID NO: 127440 - RNA, 27 nt, Human
cugggcucaguggcacugcugagcugc

SEQ ID NO: 127441 - RNA, 22 nt, Human
gcuaugauuaaaaccauucaua

SEQ ID NO: 127442 - RNA, 22 nt, Human
ccugcagcaacuagucuuagcc

SEQ ID NO: 127443 - RNA, 22 nt, Human
cucaggaacugacuuuuauuuu

SEQ ID NO: 127444 - RNA, 24 nt, Human
cucauuucuucccuuuguuccuua

SEQ ID NO: 127445 - RNA, 19 nt, Human
uggggaggggugguguggu

SEQ ID NO: 127446 - RNA, 25 nt, Human
ggcucuuggaaccugggaggcagca

SEQ ID NO: 127447 - RNA, 24 nt, Human
ucugaccuccucugggcccugucg

SEQ ID NO: 127448 - RNA, 24 nt, Human
ggaaggugggguacuggagcagac

SEQ ID NO: 127449 - RNA, 24 nt, Human
agcaguuugccacugugacugucu

SEQ ID NO: 127450 - RNA, 23 nt, Human
accaguccuagccgcgugugaca

SEQ ID NO: 127451 - RNA, 21 nt, Human
uuuaucuuucaaaauguauua

SEQ ID NO: 127452 - RNA, 26 nt, Human
aaaugcugggcucaggccugggugcu

SEQ ID NO: 127453 - RNA, 22 nt, Human
auuuuuaaacaaguauuuguua

SEQ ID NO: 127454 - RNA, 22 nt, Human
ugaaggagggucaccgcaugga

SEQ ID NO: 127455 - RNA, 21 nt, Human
cauccugacuguggaguuggg

SEQ ID NO: 127456 - RNA, 22 nt, Human
ggcagaagugccugugcuagag

SEQ ID NO: 127457 - RNA, 22 nt, Human
ugccuguaagcccagcacuuug

SEQ ID NO: 127458 - RNA, 22 nt, Human
uuccuguaaucccagcacuuug

SEQ ID NO: 127459 - RNA, 18 nt, Human
ccaccucuucucucaguu

SEQ ID NO: 127460 - RNA, 25 nt, Human
aaaauacaaaaauuagccaagugca

SEQ ID NO: 127461 - RNA, 27 nt, Human
ggggacaccucaggcacugggacaguu

SEQ ID NO: 127462 - RNA, 22 nt, Human
aucagccugaccaacaugguga

SEQ ID NO: 127463 - RNA, 25 nt, Human
aguauuucucauuccugccuccuca

SEQ ID NO: 127464 - RNA, 24 nt, Human
ccgucgccauugccagaaagagcg

SEQ ID NO: 127465 - RNA, 27 nt, Human
cgggaggggaaaggcugccgaggaccc

SEQ ID NO: 127466 - RNA, 20 nt, Human
aacagcuuaauaucacuggc

SEQ ID NO: 127467 - RNA, 24 nt, Human
ccagccccucacaccacagccaag

SEQ ID NO: 127468 - RNA, 25 nt, Human
uuguuuuuaaucauauguuccaaac

SEQ ID NO: 127469 - RNA, 22 nt, Human
cagucucccaccaccuacccca

SEQ ID NO: 127470 - RNA, 23 nt, Human
uguuacagcuaugcacuguaaau

SEQ ID NO: 127471 - RNA, 26 nt, Human
gccuugagcagucagcauugcaccug

SEQ ID NO: 127472 - RNA, 24 nt, Human
augaguguccagucgugugcauga

SEQ ID NO: 127473 - RNA, 20 nt, Human
aucuacccugcugaccuccc

SEQ ID NO: 127474 - RNA, 22 nt, Human
uuaauggaggcggaggagcagc

SEQ ID NO: 127475 - RNA, 26 nt, Human
aagcaggagaugcaccccacagcucu

SEQ ID NO: 127476 - RNA, 25 nt, Human
agcucuccugaggaccucucuguca

SEQ ID NO: 127477 - RNA, 27 nt, Human
cagcccagcccgcugcucacuuuccac

SEQ ID NO: 127478 - RNA, 21 nt, Human
aacaaccagccaaucacgaga

SEQ ID NO: 127479 - RNA, 23 nt, Human
agcagagaggggugaauggaaga

SEQ ID NO: 127480 - RNA, 24 nt, Human
caaugcauaacuaggccuaggcag

SEQ ID NO: 127481 - RNA, 21 nt, Human
cggcagcagcggcagcagcga

SEQ ID NO: 127482 - RNA, 25 nt, Human
gcaggccaggauggagcccagggua

SEQ ID NO: 127483 - RNA, 20 nt, Human
ucaugaaauauaagucucca

SEQ ID NO: 127484 - RNA, 21 nt, Human
caucaaagaagaagaaaaaga

SEQ ID NO: 127485 - RNA, 19 nt, Human
uuugauagagucaccguuu

SEQ ID NO: 127486 - RNA, 23 nt, Human
ucuguugucaccuucaccuccuu

SEQ ID NO: 127487 - RNA, 27 nt, Human
cgccgugccgccuggcccucuccccca

SEQ ID NO: 127488 - RNA, 23 nt, Human
augcuuuuuaucuuuaacuuuuu

SEQ ID NO: 127489 - RNA, 21 nt, Human
gcagccucuguccuggcugug

SEQ ID NO: 127490 - RNA, 22 nt, Human
uagagcugaggaguccuguguu

SEQ ID NO: 127491 - RNA, 20 nt, Human
gcauaugccuuucauuuaua

SEQ ID NO: 127492 - RNA, 22 nt, Human
gcugacaccuguaaucccagca

SEQ ID NO: 127493 - RNA, 21 nt, Human
cugcuuuguuuaugguuuugu

SEQ ID NO: 127494 - RNA, 20 nt, Human
cccugccuggagcacacuuu

SEQ ID NO: 127495 - RNA, 27 nt, Human
cgcgcaucuccagccuaaggguugucc

SEQ ID NO: 127496 - RNA, 22 nt, Human
ucccaaacgcuuagucuuugua

SEQ ID NO: 127497 - RNA, 25 nt, Human
aaaugaguaguuuuuaaacauuuuu

SEQ ID NO: 127498 - RNA, 27 nt, Human
uugagcccgggagguugaggcugcagu

SEQ ID NO: 127499 - RNA, 21 nt, Human
cagccaggcuggagucagugu

SEQ ID NO: 127500 - RNA, 24 nt, Human
ccuccaggagcagcaggagcaugg

SEQ ID NO: 127501 - RNA, 20 nt, Human
gacccugcguugcagcaggg

SEQ ID NO: 127502 - RNA, 23 nt, Human
gcagguggcuucuuaacagcccu

SEQ ID NO: 127503 - RNA, 27 nt, Human
acgggcuuauaauuugccauuugugaa

SEQ ID NO: 127504 - RNA, 23 nt, Human
cugcgcuuuucaucgccauucca

SEQ ID NO: 127505 - RNA, 22 nt, Human
ucuuccuuuuuccucucacucc

SEQ ID NO: 127506 - RNA, 27 nt, Human
guuaagaauucucuagcaaacaacaga

SEQ ID NO: 127507 - RNA, 27 nt, Human
ugggucuuuugcuacuaaguucacauu

SEQ ID NO: 127508 - RNA, 25 nt, Human
cccugcaaccuccgccuccuggguu

SEQ ID NO: 127509 - RNA, 27 nt, Human
gcgugagccgggacuguacccacagcu

SEQ ID NO: 127510 - RNA, 23 nt, Human
agcagaaacgacaaggcacuuca

SEQ ID NO: 127511 - RNA, 26 nt, Human
gacuccugcucgccuccgugcaguug

SEQ ID NO: 127512 - RNA, 22 nt, Human
uggcacaugccuguaaugccag

SEQ ID NO: 127513 - RNA, 24 nt, Human
ggagcuggcccugcacauccauac

SEQ ID NO: 127514 - RNA, 22 nt, Human
gggaggucaaggcugcagugag

SEQ ID NO: 127515 - RNA, 20 nt, Human
cagugcuggagguccuggca

SEQ ID NO: 127516 - RNA, 22 nt, Human
ugucugacccggucacguucuu

SEQ ID NO: 127517 - RNA, 23 nt, Human
guuaggugcuucgucugaaagug

SEQ ID NO: 127518 - RNA, 27 nt, Human
uacuuccuguaaugaggacguucaaca

SEQ ID NO: 127519 - RNA, 20 nt, Human
cggggaggagaaggaggagu

SEQ ID NO: 127520 - RNA, 18 nt, Human
acagauuuuauuaaucac

SEQ ID NO: 127521 - RNA, 24 nt, Human
ccugcugccgccucccagccuggg

SEQ ID NO: 127522 - RNA, 21 nt, Human
ggaggccagagagggcguggg

SEQ ID NO: 127523 - RNA, 22 nt, Human
cugccugcacucuaagcgcucu

SEQ ID NO: 127524 - RNA, 30 nt, Human
ccugugugcuggcccuggccuggauuagaa

SEQ ID NO: 127525 - RNA, 26 nt, Human
uuuaccucucugucaugugcagauga

SEQ ID NO: 127526 - RNA, 20 nt, Human
caggcuucaagaacagcugc

SEQ ID NO: 127527 - RNA, 24 nt, Human
agaggccaaacccagucaaggucu

SEQ ID NO: 127528 - RNA, 18 nt, Human
uacuuccugcgagcauau

SEQ ID NO: 127529 - RNA, 21 nt, Human
cacauacauugccaauuuucc

SEQ ID NO: 127530 - RNA, 21 nt, Human
uggagccgccucccggcucgg

SEQ ID NO: 127531 - RNA, 22 nt, Human
uguuuucaguuccauguaacaa

SEQ ID NO: 127532 - RNA, 25 nt, Human
cucauggcaccuccaagugaagaga

SEQ ID NO: 127533 - RNA, 27 nt, Human
cuaccugcagaguuacuaacuucucca

SEQ ID NO: 127534 - RNA, 20 nt, Human
ggcugcaggaacuuaauuua

SEQ ID NO: 127535 - RNA, 21 nt, Human
gcuggccaugcaggaguucau

SEQ ID NO: 127536 - RNA, 21 nt, Human
agugaggcauugagggccaau

SEQ ID NO: 127537 - RNA, 23 nt, Human
uuguuccauagucaaaaguauaa

SEQ ID NO: 127538 - RNA, 23 nt, Human
agauggguuucaccauguuggcc

SEQ ID NO: 127539 - RNA, 23 nt, Human
ccauaaauauuacaaaugagauu

SEQ ID NO: 127540 - RNA, 22 nt, Human
gcaacucuguccaaaaagguuu

SEQ ID NO: 127541 - RNA, 27 nt, Human
cccagcaccuggacaucucuuccagag

SEQ ID NO: 127542 - RNA, 22 nt, Human
aagagggggcaagucacauggg

SEQ ID NO: 127543 - RNA, 26 nt, Human
cagagggaggguuaaggcgccugggc

SEQ ID NO: 127544 - RNA, 27 nt, Human
agcuccuggaacuugcucaggcuccgg

SEQ ID NO: 127545 - RNA, 26 nt, Human
uuuggcaccuugauaccuuuaggugu

SEQ ID NO: 127546 - RNA, 24 nt, Human
gccacagcacauggggugccaccu

SEQ ID NO: 127547 - RNA, 21 nt, Human
auccagacauacagucaacac

SEQ ID NO: 127548 - RNA, 21 nt, Human
auaagugucccauggggcaga

SEQ ID NO: 127549 - RNA, 18 nt, Human
gccgcaauccagccuggg

SEQ ID NO: 127550 - RNA, 32 nt, Human
acuaccacuuccgccaggccugggugccgcug

SEQ ID NO: 127551 - RNA, 20 nt, Human
aguguuuggcuuauuuucca

SEQ ID NO: 127552 - RNA, 25 nt, Human
cugugggcccuccugcuggagccag

SEQ ID NO: 127553 - RNA, 27 nt, Human
uuccauaugucuauaacaaaagcaaua

SEQ ID NO: 127554 - RNA, 27 nt, Human
uacaagugcaucacugguacaauuuua

SEQ ID NO: 127555 - RNA, 22 nt, Human
aaaauauauaaaaauuagccgg

SEQ ID NO: 127556 - RNA, 23 nt, Human
gcccuaagaauguuuugcacuga

SEQ ID NO: 127557 - RNA, 22 nt, Human
gcccccacucucccgggccgcc

SEQ ID NO: 127558 - RNA, 25 nt, Human
uaaacagaggagaaagggaaagagu

SEQ ID NO: 127559 - RNA, 24 nt, Human
cuaugucaacaggccaaacagcca

SEQ ID NO: 127560 - RNA, 27 nt, Human
gcagccgcgccggcgccccacagcucu

SEQ ID NO: 127561 - RNA, 31 nt, Human
ggaaguucauugaagagucugaaauuaggga

SEQ ID NO: 127562 - RNA, 21 nt, Human
ccaggagcaaccacucuggua

SEQ ID NO: 127563 - RNA, 21 nt, Human
gggcauccccuuucugcugca

SEQ ID NO: 127564 - RNA, 22 nt, Human
cccagcccaccucaacccagag

SEQ ID NO: 127565 - RNA, 22 nt, Human
gcgaucuugacucacugcaauc

SEQ ID NO: 127566 - RNA, 21 nt, Human
uccucaucuuguauaguucca

SEQ ID NO: 127567 - RNA, 22 nt, Human
cuuuaacugggaacacaggcuc

SEQ ID NO: 127568 - RNA, 22 nt, Human
uccccggcuggagugcaguggc

SEQ ID NO: 127569 - RNA, 23 nt, Human
aggggaggggcaggagucccagc

SEQ ID NO: 127570 - RNA, 21 nt, Human
uuuucaugucuuugcuucauc

SEQ ID NO: 127571 - RNA, 21 nt, Human
uuguagcccacccaugagaag

SEQ ID NO: 127572 - RNA, 18 nt, Human
caagagacuucacacaac

SEQ ID NO: 127573 - RNA, 20 nt, Human
cacugcacaucuuuugguga

SEQ ID NO: 127574 - RNA, 22 nt, Human
gucccugcuugaaggcaaugga

SEQ ID NO: 127575 - RNA, 20 nt, Human
ugccccguuucuccccauca

SEQ ID NO: 127576 - RNA, 23 nt, Human
ugccaauaaaauauucaccaggg

SEQ ID NO: 127577 - RNA, 17 nt, Human
aagccaccucucugccu

SEQ ID NO: 127578 - RNA, 27 nt, Human
cuccaucucucagggagacaaagaacc

SEQ ID NO: 127579 - RNA, 20 nt, Human
gucagcaguggaaugaaggg

SEQ ID NO: 127580 - RNA, 20 nt, Human
cugccuccccuccaucagcc

SEQ ID NO: 127581 - RNA, 23 nt, Human
acuuaguuuuucucuuccuuguc

SEQ ID NO: 127582 - RNA, 20 nt, Human
ucauccaguauagacuaugg

SEQ ID NO: 127583 - RNA, 23 nt, Human
guugggagagacggagcggaccu

SEQ ID NO: 127584 - RNA, 21 nt, Human
acuagccucaggggucugagc

SEQ ID NO: 127585 - RNA, 22 nt, Human
agccuuuguguguaucucucca

SEQ ID NO: 127586 - RNA, 23 nt, Human
ugauauggacaucuauucuuuua

SEQ ID NO: 127587 - RNA, 23 nt, Human
caggaguuggaggcugaagagag

SEQ ID NO: 127588 - RNA, 27 nt, Human
cagaccccuuggcuuuugcuuggcaga

SEQ ID NO: 127589 - RNA, 21 nt, Human
aggaagagcagagaaaucuua

SEQ ID NO: 127590 - RNA, 22 nt, Human
agcccccuccccuccccuccag

SEQ ID NO: 127591 - RNA, 24 nt, Human
uucuccaaacccgcgcugcggagu

SEQ ID NO: 127592 - RNA, 19 nt, Human
uagagaagaaagaacaaca

SEQ ID NO: 127593 - RNA, 27 nt, Human
ggggggcaccuugcagccccuuccugc

SEQ ID NO: 127594 - RNA, 23 nt, Human
cgccgugucucagccucugccag

SEQ ID NO: 127595 - RNA, 27 nt, Human
ccaaagucacuuccccaagaucugcca

SEQ ID NO: 127596 - RNA, 20 nt, Human
uggccagccccacagcccac

SEQ ID NO: 127597 - RNA, 20 nt, Human
ugcuuuggaaauuuggaaga

SEQ ID NO: 127598 - RNA, 21 nt, Human
ucagccaacaguaccaaaagu

SEQ ID NO: 127599 - RNA, 24 nt, Human
ugucucccaggcuggagugcagug

SEQ ID NO: 127600 - RNA, 23 nt, Human
ugcaggacuugggguugagguga

SEQ ID NO: 127601 - RNA, 26 nt, Human
gccccugcuccagcagcugucaucuc

SEQ ID NO: 127602 - RNA, 20 nt, Human
gggcuuaauauucuuuaaag

SEQ ID NO: 127603 - RNA, 25 nt, Human
caagugucuuccaucauggauucau

SEQ ID NO: 127604 - RNA, 17 nt, Human
cuucccuuccccagccg

SEQ ID NO: 127605 - RNA, 19 nt, Human
uugauuugugcuguguaca

SEQ ID NO: 127606 - RNA, 21 nt, Human
gcugggcugccuucuucuaca

SEQ ID NO: 127607 - RNA, 27 nt, Human
ccaacuugucacuugccagucacuccg

SEQ ID NO: 127608 - RNA, 24 nt, Human
gcucuguccacacccaugcgcccc

SEQ ID NO: 127609 - RNA, 20 nt, Human
guauaaauauaucaccauuu

SEQ ID NO: 127610 - RNA, 24 nt, Human
ggauggggagagcuacgugguagu

SEQ ID NO: 127611 - RNA, 19 nt, Human
uccucaccuggguccucuc

SEQ ID NO: 127612 - RNA, 21 nt, Human
ggggagggaaggaggagcagc

SEQ ID NO: 127613 - RNA, 24 nt, Human
acuagccuggccaacauguuguaa

SEQ ID NO: 127614 - RNA, 22 nt, Human
gagcuugucuuuucugcugagg

SEQ ID NO: 127615 - RNA, 22 nt, Human
ccagcucuaccugguguggcag

SEQ ID NO: 127616 - RNA, 27 nt, Human
accccaguccuggauuagcccucuuga

SEQ ID NO: 127617 - RNA, 25 nt, Human
gccugcaucuucuugcaucuaauga

SEQ ID NO: 127618 - RNA, 28 nt, Human
cuuuugcccuuugucaucaccaacacaa

SEQ ID NO: 127619 - RNA, 21 nt, Human
gcaaacgccugagugcugcug

SEQ ID NO: 127620 - RNA, 25 nt, Human
cccauguccccucuggaagacaaac

SEQ ID NO: 127621 - RNA, 23 nt, Human
caagugcuggcaccaccaggcac

SEQ ID NO: 127622 - RNA, 23 nt, Human
gacagccgccucuaggggcuggg

SEQ ID NO: 127623 - RNA, 27 nt, Human
accugcgcccauugucuggcacucccu

SEQ ID NO: 127624 - RNA, 20 nt, Human
cuguuccugaguuugagugc

SEQ ID NO: 127625 - RNA, 21 nt, Human
uucuacccacagaucaacugu

SEQ ID NO: 127626 - RNA, 21 nt, Human
cucccacugcuucuggucucc

SEQ ID NO: 127627 - RNA, 20 nt, Human
ccuuccuuacagccuugggg

SEQ ID NO: 127628 - RNA, 22 nt, Human
gacuucugcucccuuuccaguu

SEQ ID NO: 127629 - RNA, 23 nt, Human
gcaggcuuugugagagaggaccu

SEQ ID NO: 127630 - RNA, 31 nt, Human
ccuaaaguuacugcugaccuugaagcauugu

SEQ ID NO: 127631 - RNA, 22 nt, Human
acagagagacgagcccaggagg

SEQ ID NO: 127632 - RNA, 22 nt, Human
uguugcccaggcuggaguggag

SEQ ID NO: 127633 - RNA, 22 nt, Human
uguugcccaggguggagugcag

SEQ ID NO: 127634 - RNA, 24 nt, Human
aucuggggagagaaugagcuggag

SEQ ID NO: 127635 - RNA, 20 nt, Human
agcugccuccagccuggugg

SEQ ID NO: 127636 - RNA, 20 nt, Human
cggcagcauuucaccgauug

SEQ ID NO: 127637 - RNA, 28 nt, Human
ggauggggccucacacuugccaccccca

SEQ ID NO: 127638 - RNA, 23 nt, Human
agccugcacccuuccgagggcca

SEQ ID NO: 127639 - RNA, 23 nt, Human
cacuccauuccggaaccuccugg

SEQ ID NO: 127640 - RNA, 24 nt, Human
ugggugucuuuuucuuuucaucug

SEQ ID NO: 127641 - RNA, 26 nt, Human
ggaaacacuugagaggcgauauuguc

SEQ ID NO: 127642 - RNA, 21 nt, Human
uccuuaauuuggaaagcaguu

SEQ ID NO: 127643 - RNA, 22 nt, Human
cugggagguggagguugcugug

SEQ ID NO: 127644 - RNA, 23 nt, Human
acuuccuuucuacccugccugug

SEQ ID NO: 127645 - RNA, 22 nt, Human
agagggggcucaugggagcccu

SEQ ID NO: 127646 - RNA, 25 nt, Human
cuguggcuaguugucuguccggugg

SEQ ID NO: 127647 - RNA, 21 nt, Human
uggguucugccugccagcugc

SEQ ID NO: 127648 - RNA, 26 nt, Human
uucuccccacccuggggcucuucugu

SEQ ID NO: 127649 - RNA, 26 nt, Human
uucacauuccuuuauucugagaauuu

SEQ ID NO: 127650 - RNA, 22 nt, Human
guuuuaagaagaaaacaucuac

SEQ ID NO: 127651 - RNA, 21 nt, Human
agcuacaagaaauauguaaua

SEQ ID NO: 127652 - RNA, 22 nt, Human
gggauuacaggugcgcaccacc

SEQ ID NO: 127653 - RNA, 21 nt, Human
ugccuccucaggaauauucuc

SEQ ID NO: 127654 - RNA, 19 nt, Human
cuugaaacauugcaaccaa

SEQ ID NO: 127655 - RNA, 22 nt, Human
cacaaggucaugggaucucaug

SEQ ID NO: 127656 - RNA, 22 nt, Human
gggggugggacagggaggaaaa

SEQ ID NO: 127657 - RNA, 23 nt, Human
gcccccgccagccucccuccucg

SEQ ID NO: 127658 - RNA, 27 nt, Human
cacugcacaccagccugggcaacacag

SEQ ID NO: 127659 - RNA, 20 nt, Human
uucucaauuaccuguauuug

SEQ ID NO: 127660 - RNA, 20 nt, Human
gcugcuuucuccuuuacuug

SEQ ID NO: 127661 - RNA, 21 nt, Human
ugauccuuguguucagcucuu

SEQ ID NO: 127662 - RNA, 22 nt, Human
agcaguuucacugccaacuuuu

SEQ ID NO: 127663 - RNA, 22 nt, Human
gcuagagcgagacccacacaac

SEQ ID NO: 127664 - RNA, 20 nt, Human
ccucugcugcccccuucccc

SEQ ID NO: 127665 - RNA, 22 nt, Human
ccaacauggugaaaccccauau

SEQ ID NO: 127666 - RNA, 25 nt, Human
cuagcugaccacagacuccacagug

SEQ ID NO: 127667 - RNA, 22 nt, Human
gcucaguuucaguucacuccug

SEQ ID NO: 127668 - RNA, 21 nt, Human
aagacuccaguggggugguca

SEQ ID NO: 127669 - RNA, 24 nt, Human
cagcugucuguggcuucccauguc

SEQ ID NO: 127670 - RNA, 21 nt, Human
uuucuuucguugucucugggc

SEQ ID NO: 127671 - RNA, 27 nt, Human
gucagaaucucuggacuggagaauaau

SEQ ID NO: 127672 - RNA, 27 nt, Human
ccccugccugugcccgcaugugugccu

SEQ ID NO: 127673 - RNA, 25 nt, Human
gcuugcugugugaauugacaagcac

SEQ ID NO: 127674 - RNA, 21 nt, Human
ugggaaagaacgaaaagggag

SEQ ID NO: 127675 - RNA, 17 nt, Human
cccacucccuucauaca

SEQ ID NO: 127676 - RNA, 22 nt, Human
ccagaaaccacauguauuugca

SEQ ID NO: 127677 - RNA, 26 nt, Human
acugguuuuucuacucucaugcauuc

SEQ ID NO: 127678 - RNA, 24 nt, Human
cugcgacucgcuggcuuucgcucc

SEQ ID NO: 127679 - RNA, 19 nt, Human
cauguugccuucuuuucua

SEQ ID NO: 127680 - RNA, 21 nt, Human
cagguaacauuaaaugugaac

SEQ ID NO: 127681 - RNA, 22 nt, Human
gcugccucuaaaaggccugucc

SEQ ID NO: 127682 - RNA, 27 nt, Human
acucagggcuccauucuggagggcacc

SEQ ID NO: 127683 - RNA, 22 nt, Human
uguugccugauuuucucuggca

SEQ ID NO: 127684 - RNA, 27 nt, Human
ccugcugcggccgugccccaucucccc

SEQ ID NO: 127685 - RNA, 23 nt, Human
cccaggaggcggagguuacagug

SEQ ID NO: 127686 - RNA, 21 nt, Human
aagugacccccagcuaucgcc

SEQ ID NO: 127687 - RNA, 22 nt, Human
uguugaccaggcuggagugcag

SEQ ID NO: 127688 - RNA, 24 nt, Human
ucagaaauuugaagaaguuauuug

SEQ ID NO: 127689 - RNA, 24 nt, Human
aucuuuuuuguuuaauuguauuua

SEQ ID NO: 127690 - RNA, 27 nt, Human
cuuugggccuaguaguucgaguccagc

SEQ ID NO: 127691 - RNA, 20 nt, Human
ggggauggacuugcccacac

SEQ ID NO: 127692 - RNA, 23 nt, Human
caaguagcugggauuacaagcac

SEQ ID NO: 127693 - RNA, 23 nt, Human
cagguagcugggauuacaggcac

SEQ ID NO: 127694 - RNA, 25 nt, Human
ggccaggcacgauggcucaaaccug

SEQ ID NO: 127695 - RNA, 22 nt, Human
aacugucauuguuguugcccag

SEQ ID NO: 127696 - RNA, 23 nt, Human
ccuggguucugcugagucuucca

SEQ ID NO: 127697 - RNA, 23 nt, Human
cgacacccagacagaggcugcag

SEQ ID NO: 127698 - RNA, 24 nt, Human
gauacccucugagacagagagcca

SEQ ID NO: 127699 - RNA, 27 nt, Human
ggugaagccccggggccggcagccgga

SEQ ID NO: 127700 - RNA, 16 nt, Human
gguuggacccacucac

SEQ ID NO: 127701 - RNA, 26 nt, Human
gugggugggcgggugcugcagcugug

SEQ ID NO: 127702 - RNA, 23 nt, Human
caaggauagaugcuggcccaggg

SEQ ID NO: 127703 - RNA, 26 nt, Human
ucucucuccccugcacuagcuguccc

SEQ ID NO: 127704 - RNA, 22 nt, Human
acuggccaccacaagcugcagu

SEQ ID NO: 127705 - RNA, 27 nt, Human
ggaggcuggccccagagaugaucuugc

SEQ ID NO: 127706 - RNA, 27 nt, Human
ccuuguuacucaggaaccucaccuugg

SEQ ID NO: 127707 - RNA, 21 nt, Human
ucuucugcucuuucuucuucc

SEQ ID NO: 127708 - RNA, 23 nt, Human
uuucuacugaucaucauaacucu

SEQ ID NO: 127709 - RNA, 22 nt, Human
ucugcucgcccugccuagcuug

SEQ ID NO: 127710 - RNA, 23 nt, Human
ucaagaaugcauuaagugugguu

SEQ ID NO: 127711 - RNA, 24 nt, Human
cagcccagccucugucccucuuug

SEQ ID NO: 127712 - RNA, 22 nt, Human
aacguucugucuguggcacauu

SEQ ID NO: 127713 - RNA, 22 nt, Human
ugccuguaaucccaacacuuag

SEQ ID NO: 127714 - RNA, 21 nt, Human
cacauuugcacaccuuccaca

SEQ ID NO: 127715 - RNA, 20 nt, Human
gggcucucugagacucuuua

SEQ ID NO: 127716 - RNA, 23 nt, Human
cccucccuccccuugccugugcc

SEQ ID NO: 127717 - RNA, 21 nt, Human
uguuucaguccaucauccagc

SEQ ID NO: 127718 - RNA, 23 nt, Human
auaucccucgucauguggcagua

SEQ ID NO: 127719 - RNA, 22 nt, Human
ucucuccucuuuuccucucuua

SEQ ID NO: 127720 - RNA, 22 nt, Human
ugccucccagguucaagcaauu

SEQ ID NO: 127721 - RNA, 22 nt, Human
ucaccuaggcuggagugcagcg

SEQ ID NO: 127722 - RNA, 22 nt, Human
cccuccucucuuuccucacccg

SEQ ID NO: 127723 - RNA, 28 nt, Human
ccgucgcccucccuacgggcagcccccg

SEQ ID NO: 127724 - RNA, 23 nt, Human
cugaacuucggcaacagaaugau

SEQ ID NO: 127725 - RNA, 22 nt, Human
ggcaggaggggagugaggcagg

SEQ ID NO: 127726 - RNA, 25 nt, Human
cagcuuauugacuuaauaaagcuuu

SEQ ID NO: 127727 - RNA, 23 nt, Human
uugggccuugaggucuguggcag

SEQ ID NO: 127728 - RNA, 24 nt, Human
cagucucucaaaagacuuuguugu

SEQ ID NO: 127729 - RNA, 24 nt, Human
auuucuuaacaugagcuccaguuu

SEQ ID NO: 127730 - RNA, 24 nt, Human
ggugguaacugaguuuguguuaua

SEQ ID NO: 127731 - RNA, 26 nt, Human
guuuuaucugaaacauacuggauuua

SEQ ID NO: 127732 - RNA, 26 nt, Human
cccugcuccccaccuccaguucugcc

SEQ ID NO: 127733 - RNA, 22 nt, Human
uccaggagggggaagaggagug

SEQ ID NO: 127734 - RNA, 23 nt, Human
ugccaucaggauuguugaggagu

SEQ ID NO: 127735 - RNA, 20 nt, Human
uaaguucagcacuugucuca

SEQ ID NO: 127736 - RNA, 20 nt, Human
auuaaucucuaauuuuuugg

SEQ ID NO: 127737 - RNA, 19 nt, Human
ucccaggcuggagugcagu

SEQ ID NO: 127738 - RNA, 24 nt, Human
cuccuauuaauugucaccccacca

SEQ ID NO: 127739 - RNA, 27 nt, Human
uugggaggccgaggcgggcagaucacg

SEQ ID NO: 127740 - RNA, 29 nt, Human
ucccugcccagauccuguaggccucaucu

SEQ ID NO: 127741 - RNA, 22 nt, Human
uggcuuucacuuucucuuuugu

SEQ ID NO: 127742 - RNA, 27 nt, Human
cccuccuggugggaagacagcuggaaa

SEQ ID NO: 127743 - RNA, 23 nt, Human
aaggacuucuacagcuaugcgca

SEQ ID NO: 127744 - RNA, 23 nt, Human
acccccagccucaacugauccuc

SEQ ID NO: 127745 - RNA, 22 nt, Human
ccagcucucugauuccccaaau

SEQ ID NO: 127746 - RNA, 21 nt, Human
acacagucacccacaggcccc

SEQ ID NO: 127747 - RNA, 26 nt, Human
aggcauucagguugcuugcguagacu

SEQ ID NO: 127748 - RNA, 22 nt, Human
ggguacugguggcacaccagac

SEQ ID NO: 127749 - RNA, 16 nt, Human
cugagccuccuuaccu

SEQ ID NO: 127750 - RNA, 21 nt, Human
uauugauuucacagucagcug

SEQ ID NO: 127751 - RNA, 20 nt, Human
aaagaacauuaaaagcaaug

SEQ ID NO: 127752 - RNA, 21 nt, Human
uaccuguuauaccagcacuuu

SEQ ID NO: 127753 - RNA, 23 nt, Human
cagcucuuccauagggcaguugu

SEQ ID NO: 127754 - RNA, 23 nt, Human
accaugcccggcuaauuuuuuga

SEQ ID NO: 127755 - RNA, 25 nt, Human
aucuccacucugcguaacagguucc

SEQ ID NO: 127756 - RNA, 21 nt, Human
uccccuuccucaaguggugcu

SEQ ID NO: 127757 - RNA, 22 nt, Human
ggggaagagggagauggagacu

SEQ ID NO: 127758 - RNA, 19 nt, Human
cagccaccugggaacacag

SEQ ID NO: 127759 - RNA, 23 nt, Human
ggcgcggaggcaggaggagcagu

SEQ ID NO: 127760 - RNA, 23 nt, Human
ugaagacacuagaauccugaccu

SEQ ID NO: 127761 - RNA, 22 nt, Human
cugggcacaggaaaaggaucua

SEQ ID NO: 127762 - RNA, 18 nt, Human
gccaggcucccugugucc

SEQ ID NO: 127763 - RNA, 21 nt, Human
ugggauuacaggcuccugcca

SEQ ID NO: 127764 - RNA, 21 nt, Human
guggagcccugcuccucucug

SEQ ID NO: 127765 - RNA, 24 nt, Human
ugagacaagggaagagagaugagg

SEQ ID NO: 127766 - RNA, 23 nt, Human
gagaaccaaacuggaucacuggg

SEQ ID NO: 127767 - RNA, 26 nt, Human
uuucuuucuuuuucuucaaauuuaca

SEQ ID NO: 127768 - RNA, 21 nt, Human
cagaucuuuguugugugggag

SEQ ID NO: 127769 - RNA, 19 nt, Human
gaagauguauuucaucuca

SEQ ID NO: 127770 - RNA, 29 nt, Human
cucugggacucuccuccuccccuccucuu

SEQ ID NO: 127771 - RNA, 25 nt, Human
gccucaguguuacuucccaggauuu

SEQ ID NO: 127772 - RNA, 22 nt, Human
gucgccaggcuggagugcagug

SEQ ID NO: 127773 - RNA, 19 nt, Human
cugcagaccgcuccagaca

SEQ ID NO: 127774 - RNA, 21 nt, Human
ugagggcuucacagggcugca

SEQ ID NO: 127775 - RNA, 24 nt, Human
ccucaggcgcuguccuucacuggg

SEQ ID NO: 127776 - RNA, 22 nt, Human
cuaacaacugggaaauaagcaa

SEQ ID NO: 127777 - RNA, 22 nt, Human
cuaucugauuuuucccagcaaa

SEQ ID NO: 127778 - RNA, 21 nt, Human
aggaaauacccccaccugccc

SEQ ID NO: 127779 - RNA, 27 nt, Human
ggcucagagacagagcagaagacagaa

SEQ ID NO: 127780 - RNA, 24 nt, Human
uucuaucuauuuagaaauauguaa

SEQ ID NO: 127781 - RNA, 27 nt, Human
ucuuuuccauuaugugacuguuugacc

SEQ ID NO: 127782 - RNA, 24 nt, Human
augagucuucugagagcuaaggag

SEQ ID NO: 127783 - RNA, 25 nt, Human
agaagcccuguucaugguuggggau

SEQ ID NO: 127784 - RNA, 23 nt, Human
aucgcgccacugcacucuagccu

SEQ ID NO: 127785 - RNA, 24 nt, Human
gcuauuucagcaacaaccaucuca

SEQ ID NO: 127786 - RNA, 27 nt, Human
caggcagcagaagucugggcagaguuc

SEQ ID NO: 127787 - RNA, 22 nt, Human
ucagggccugccaggagucuac

SEQ ID NO: 127788 - RNA, 22 nt, Human
cagcacuugaacugucuggggu

SEQ ID NO: 127789 - RNA, 21 nt, Human
gugccagggagaacagccagg

SEQ ID NO: 127790 - RNA, 19 nt, Human
cccuccagaagcauacugg

SEQ ID NO: 127791 - RNA, 23 nt, Human
gccaucggcugugaaaggagaug

SEQ ID NO: 127792 - RNA, 19 nt, Human
accauauuuauuuacuucu

SEQ ID NO: 127793 - RNA, 25 nt, Human
gcauuuugaauacauccaguacuuu

SEQ ID NO: 127794 - RNA, 27 nt, Human
agcaguuuucaggacuuaaggcucugg

SEQ ID NO: 127795 - RNA, 21 nt, Human
ugcagaacacauuucaaauga

SEQ ID NO: 127796 - RNA, 27 nt, Human
acccuccuccucuucaccaggugcaug

SEQ ID NO: 127797 - RNA, 21 nt, Human
cccgcgucuucagcuguuucg

SEQ ID NO: 127798 - RNA, 21 nt, Human
uucccagcagcggcaccaagg

SEQ ID NO: 127799 - RNA, 20 nt, Human
ugaugauuuguugagccuug

SEQ ID NO: 127800 - RNA, 23 nt, Human
aguuaccacauuacucugccucu

SEQ ID NO: 127801 - RNA, 25 nt, Human
acccaggcuggagugcaauggugag

SEQ ID NO: 127802 - RNA, 23 nt, Human
gcugcauuuuguucgugccugua

SEQ ID NO: 127803 - RNA, 22 nt, Human
cuggaaggaaaaagagguagca

SEQ ID NO: 127804 - RNA, 28 nt, Human
auuuauucucagcaucaaauaccuugua

SEQ ID NO: 127805 - RNA, 21 nt, Human
ggugacuuuccuaugacacuc

SEQ ID NO: 127806 - RNA, 26 nt, Human
gacucacugcagcuaucucucgccuc

SEQ ID NO: 127807 - RNA, 26 nt, Human
gcuggaaggugggcgucgucacgguu

SEQ ID NO: 127808 - RNA, 20 nt, Human
aacagcauuuuuuauaauga

SEQ ID NO: 127809 - RNA, 26 nt, Human
gagauggagggcgagauuuggauggg

SEQ ID NO: 127810 - RNA, 25 nt, Human
gagagcuagggcagacaugcaguga

SEQ ID NO: 127811 - RNA, 22 nt, Human
gucacccaggcuugagugcagu

SEQ ID NO: 127812 - RNA, 20 nt, Human
uauuaucauucuaguuucag

SEQ ID NO: 127813 - RNA, 22 nt, Human
cauugcacuucagccugggcga

SEQ ID NO: 127814 - RNA, 19 nt, Human
gacaggcugggacucagag

SEQ ID NO: 127815 - RNA, 16 nt, Human
aucaugaaaugccuga

SEQ ID NO: 127816 - RNA, 20 nt, Human
uuuacaccuucacucagcca

SEQ ID NO: 127817 - RNA, 27 nt, Human
ccucuacucucguuaucugaccucaug

SEQ ID NO: 127818 - RNA, 20 nt, Human
cucucccaccucauccucug

SEQ ID NO: 127819 - RNA, 22 nt, Human
accucagccauccaaauagcug

SEQ ID NO: 127820 - RNA, 20 nt, Human
ccgaggcuggagugcaauga

SEQ ID NO: 127821 - RNA, 20 nt, Human
gaauucccucccccugggcc

SEQ ID NO: 127822 - RNA, 22 nt, Human
agaccagccagggcaacauaau

SEQ ID NO: 127823 - RNA, 25 nt, Human
cggguggcgggggcgggucugagug

SEQ ID NO: 127824 - RNA, 19 nt, Human
cucucgucgcccaggcugg

SEQ ID NO: 127825 - RNA, 24 nt, Human
ggggcagagucucuggcagagguu

SEQ ID NO: 127826 - RNA, 22 nt, Human
ccugcugcuccucagaauccug

SEQ ID NO: 127827 - RNA, 25 nt, Human
ggccaggcuggagugcaguaagugg

SEQ ID NO: 127828 - RNA, 25 nt, Human
acaguucuucuucuugccagugugg

SEQ ID NO: 127829 - RNA, 26 nt, Human
ggacgcaauggcuucaagguuacuuc

SEQ ID NO: 127830 - RNA, 26 nt, Human
acaccaagccccuagcuggggcacag

SEQ ID NO: 127831 - RNA, 26 nt, Human
gagggaaccuguuucacuauggccuc

SEQ ID NO: 127832 - RNA, 22 nt, Human
auaaagugaccaagcacaccuu

SEQ ID NO: 127833 - RNA, 21 nt, Human
gggaagggaggggagacuaug

SEQ ID NO: 127834 - RNA, 22 nt, Human
gugaacaaugcagucaggccug

SEQ ID NO: 127835 - RNA, 27 nt, Human
auuuuauuucucacuguauuuuccuca

SEQ ID NO: 127836 - RNA, 23 nt, Human
aaucuguuguaguggugagcuga

SEQ ID NO: 127837 - RNA, 23 nt, Human
gaggaagagaaauuucucuagua

SEQ ID NO: 127838 - RNA, 23 nt, Human
uaucucccuucacugacucucuu

SEQ ID NO: 127839 - RNA, 24 nt, Human
cagcucagcucagcucagcgcagc

SEQ ID NO: 127840 - RNA, 22 nt, Human
gcaccucacucguuauucucca

SEQ ID NO: 127841 - RNA, 22 nt, Human
caugugcagaagaauaaggcag

SEQ ID NO: 127842 - RNA, 24 nt, Human
gguugcagugagcuaugauuguac

SEQ ID NO: 127843 - RNA, 29 nt, Human
cuguucuuggccuuccauccucuccccac

SEQ ID NO: 127844 - RNA, 25 nt, Human
uugccucauucaugagcuggucagc

SEQ ID NO: 127845 - RNA, 21 nt, Human
agcuugcuuccuuccuccugg

SEQ ID NO: 127846 - RNA, 21 nt, Human
uguggucggaucugcccagcc

SEQ ID NO: 127847 - RNA, 21 nt, Human
ucccuccagccgagaccuuuu

SEQ ID NO: 127848 - RNA, 22 nt, Human
ucugggaggaugacuccagucc

SEQ ID NO: 127849 - RNA, 19 nt, Human
agcuaugcaaccucuguuc

SEQ ID NO: 127850 - RNA, 23 nt, Human
ccuccuggguccucucaggcucc

SEQ ID NO: 127851 - RNA, 25 nt, Human
ggucucuguguggucuccgcuggca

SEQ ID NO: 127852 - RNA, 27 nt, Human
gcugauuuaaagaggugagcuugggaa

SEQ ID NO: 127853 - RNA, 20 nt, Human
ugcacaccccccgcucaaac

SEQ ID NO: 127854 - RNA, 23 nt, Human
accacaacugagaguggggaguc

SEQ ID NO: 127855 - RNA, 23 nt, Human
gccaacaacagcaccucaaucug

SEQ ID NO: 127856 - RNA, 26 nt, Human
uuguuacuuugcaggccaucugugau

SEQ ID NO: 127857 - RNA, 21 nt, Human
gucucgaacuccuggccuagg

SEQ ID NO: 127858 - RNA, 22 nt, Human
gaacuccugggcucaagcaguc

SEQ ID NO: 127859 - RNA, 24 nt, Human
gcccggcuucacacccauuucuuu

SEQ ID NO: 127860 - RNA, 21 nt, Human
gugccucagaauugcuauuuc

SEQ ID NO: 127861 - RNA, 22 nt, Human
cagaaccuaaaaguauuauuca

SEQ ID NO: 127862 - RNA, 23 nt, Human
gacccaucacucuaccucuacca

SEQ ID NO: 127863 - RNA, 22 nt, Human
ggccaggaggcagccuccgaac

SEQ ID NO: 127864 - RNA, 23 nt, Human
uuggggcaggguggagagguggg

SEQ ID NO: 127865 - RNA, 31 nt, Human
gggaagcggagguugcagggagccgagauca

SEQ ID NO: 127866 - RNA, 19 nt, Human
agcccaggcuggggaagug

SEQ ID NO: 127867 - RNA, 19 nt, Human
auagcuuugcuugcagccu

SEQ ID NO: 127868 - RNA, 20 nt, Human
cacccaggcuugaggcagcg

SEQ ID NO: 127869 - RNA, 22 nt, Human
gcugagugaagauuaagggagg

SEQ ID NO: 127870 - RNA, 27 nt, Human
gauuauggguccugcaauucuacaguu

SEQ ID NO: 127871 - RNA, 21 nt, Human
cugcaaccucgccucccuggu

SEQ ID NO: 127872 - RNA, 23 nt, Human
gcagaggggaggaggaagcacaa

SEQ ID NO: 127873 - RNA, 25 nt, Human
ucccagguugacaccauucuccugc

SEQ ID NO: 127874 - RNA, 23 nt, Human
cuccagcccccggcgccugccgc

SEQ ID NO: 127875 - RNA, 26 nt, Human
uucugcuucucuucauauaacugagc

SEQ ID NO: 127876 - RNA, 27 nt, Human
gggcggccggcccugccugcgggagag

SEQ ID NO: 127877 - RNA, 22 nt, Human
uguggaggggguggugaggagg

SEQ ID NO: 127878 - RNA, 26 nt, Human
uggggagagauagggugggaggcagg

SEQ ID NO: 127879 - RNA, 19 nt, Human
ugugccccugaugcagccu

SEQ ID NO: 127880 - RNA, 20 nt, Human
uggugagcugcaaaauagcu

SEQ ID NO: 127881 - RNA, 24 nt, Human
ccaguucacacccuucacugugcg

SEQ ID NO: 127882 - RNA, 15 nt, Human
auggaaagaggcaga

SEQ ID NO: 127883 - RNA, 21 nt, Human
acgcaugaaguggaaaaagga

SEQ ID NO: 127884 - RNA, 22 nt, Human
cggggaggggguggagugaagc

SEQ ID NO: 127885 - RNA, 20 nt, Human
ugcuauuccccucugauauu

SEQ ID NO: 127886 - RNA, 18 nt, Human
gacuggguggggagggug

SEQ ID NO: 127887 - RNA, 18 nt, Human
ccagagcagagaagggca

SEQ ID NO: 127888 - RNA, 22 nt, Human
cgggaggcagagguugcagugu

SEQ ID NO: 127889 - RNA, 29 nt, Human
ccuugcagcucuccccuucucuguauucc

SEQ ID NO: 127890 - RNA, 23 nt, Human
accagcacucacccuuguccacc

SEQ ID NO: 127891 - RNA, 23 nt, Human
uggucucaaaucgauuugccucc

SEQ ID NO: 127892 - RNA, 21 nt, Human
gugucuguuagcaucuuccuu

SEQ ID NO: 127893 - RNA, 21 nt, Human
uggcgcgcagagugcaccuuc

SEQ ID NO: 127894 - RNA, 23 nt, Human
ggggggcaaugauaccuaccuca

SEQ ID NO: 127895 - RNA, 21 nt, Human
ccagauugguucugaauugga

SEQ ID NO: 127896 - RNA, 20 nt, Human
gcaucuuugccucucaguug

SEQ ID NO: 127897 - RNA, 23 nt, Human
caacccaguccauggcuucuagc

SEQ ID NO: 127898 - RNA, 23 nt, Human
ugagggaggcguguagcuucuua

SEQ ID NO: 127899 - RNA, 23 nt, Human
ggccuugggaguagcugaggggg

SEQ ID NO: 127900 - RNA, 17 nt, Human
ccacacagagacuugca

SEQ ID NO: 127901 - RNA, 23 nt, Human
uaagagaccuguuuuaaaaagga

SEQ ID NO: 127902 - RNA, 22 nt, Human
auuucuccagggagccacaggc

SEQ ID NO: 127903 - RNA, 25 nt, Human
agagcaccuggugaucacgugguca

SEQ ID NO: 127904 - RNA, 21 nt, Human
gacaggcugacauagaaaaua

SEQ ID NO: 127905 - RNA, 27 nt, Human
gucucgaacuccuggacuuaagugagc

SEQ ID NO: 127906 - RNA, 20 nt, Human
caucacuuauuucagcacuu

SEQ ID NO: 127907 - RNA, 18 nt, Human
uacuaccaauaacuuuua

SEQ ID NO: 127908 - RNA, 27 nt, Human
gggaggcacccccuccagugcuccuac

SEQ ID NO: 127909 - RNA, 27 nt, Human
acaucuguagacaucuugaguuguagc

SEQ ID NO: 127910 - RNA, 22 nt, Human
gagucaggcaggaaggagaagc

SEQ ID NO: 127911 - RNA, 22 nt, Human
aauugauaauaaacuguccucu

SEQ ID NO: 127912 - RNA, 21 nt, Human
cuuuuucugcccucccuauuu

SEQ ID NO: 127913 - RNA, 24 nt, Human
cuggcucacuggcuuugaaaaguc

SEQ ID NO: 127914 - RNA, 20 nt, Human
ugucugucugguccauagcu

SEQ ID NO: 127915 - RNA, 21 nt, Human
uuggcucccuuccaccuguca

SEQ ID NO: 127916 - RNA, 24 nt, Human
gccgcucuuucuccgacagcugcc

SEQ ID NO: 127917 - RNA, 26 nt, Human
ggugcgaucucagcucacugcagccu

SEQ ID NO: 127918 - RNA, 25 nt, Human
ucuuacccaauuucugggcucugga

SEQ ID NO: 127919 - RNA, 21 nt, Human
uaucugaagcccucccaggug

SEQ ID NO: 127920 - RNA, 24 nt, Human
cugcaaauugauuuuguuuguaau

SEQ ID NO: 127921 - RNA, 19 nt, Human
guggccuucagaacugagu

SEQ ID NO: 127922 - RNA, 20 nt, Human
aaucauuacuguguauguua

SEQ ID NO: 127923 - RNA, 22 nt, Human
ccccucccuucccaugggagug

SEQ ID NO: 127924 - RNA, 22 nt, Human
aggcugagacaggagaaucucu

SEQ ID NO: 127925 - RNA, 26 nt, Human
ccuuucguucugcugaccaaauggcc

SEQ ID NO: 127926 - RNA, 27 nt, Human
gcaagcugcugacugggcacacucaug

SEQ ID NO: 127927 - RNA, 22 nt, Human
gaucagccugggcaacauggug

SEQ ID NO: 127928 - RNA, 27 nt, Human
cccuccaggagaucccagggugcaaag

SEQ ID NO: 127929 - RNA, 21 nt, Human
ggucacaugccaucucuuccu

SEQ ID NO: 127930 - RNA, 21 nt, Human
acacccuugcuuggaugagga

SEQ ID NO: 127931 - RNA, 21 nt, Human
gacaguuuucaggcuccuguu

SEQ ID NO: 127932 - RNA, 23 nt, Human
aauggauaaaucaguuaugucaa

SEQ ID NO: 127933 - RNA, 21 nt, Human
auaucugaacuccuaaauaag

SEQ ID NO: 127934 - RNA, 24 nt, Human
uucuccaucuuccacuguuagugc

SEQ ID NO: 127935 - RNA, 29 nt, Human
uugcacuccaggcugggcagcaagagcaa

SEQ ID NO: 127936 - RNA, 22 nt, Human
caacagcccuguccacugugag

SEQ ID NO: 127937 - RNA, 22 nt, Human
ugugcuguguccucucagaauu

SEQ ID NO: 127938 - RNA, 27 nt, Human
aaaacucaagcaagaugagcugugcgc

SEQ ID NO: 127939 - RNA, 22 nt, Human
ucgcccaggccugggaugcagu

SEQ ID NO: 127940 - RNA, 23 nt, Human
uugcccagccaauggacacagua

SEQ ID NO: 127941 - RNA, 25 nt, Human
gaccugccugcugugguaugagcua

SEQ ID NO: 127942 - RNA, 21 nt, Human
aaaccaucugccccuguccca

SEQ ID NO: 127943 - RNA, 20 nt, Human
aaaauacaaaaauuagucag

SEQ ID NO: 127944 - RNA, 22 nt, Human
uuccuuuuucuucuuuaguccu

SEQ ID NO: 127945 - RNA, 27 nt, Human
uacuacuguagaacugcaauuuccauu

SEQ ID NO: 127946 - RNA, 25 nt, Human
ucuggcuuccuuucauugucuuagg

SEQ ID NO: 127947 - RNA, 21 nt, Human
aagggucuuugccagcaaagg

SEQ ID NO: 127948 - RNA, 22 nt, Human
cuucagcuaaaaaauaggauaa

SEQ ID NO: 127949 - RNA, 21 nt, Human
augcucucccucccuucauca

SEQ ID NO: 127950 - RNA, 23 nt, Human
acugagguuugcugccugccuuc

SEQ ID NO: 127951 - RNA, 27 nt, Human
gguucacaugauucuccugccucagcc

SEQ ID NO: 127952 - RNA, 25 nt, Human
agccucgggccgucagcaauaccuc

SEQ ID NO: 127953 - RNA, 27 nt, Human
gccagugcagugcccagcuccaaggcu

SEQ ID NO: 127954 - RNA, 22 nt, Human
uccucaaguugcuacgguucag

SEQ ID NO: 127955 - RNA, 19 nt, Human
cugggaaaguuuguagaaa

SEQ ID NO: 127956 - RNA, 22 nt, Human
ugccuguguacaacaaugcuuu

SEQ ID NO: 127957 - RNA, 27 nt, Human
aaaacauugaaguauuaguuacuugcu

SEQ ID NO: 127958 - RNA, 23 nt, Human
cucucccauccuuuucugcucca

SEQ ID NO: 127959 - RNA, 27 nt, Human
uaggaggucccuggccaaagauuuauu

SEQ ID NO: 127960 - RNA, 20 nt, Human
aguuuguucuguguuuccca

SEQ ID NO: 127961 - RNA, 23 nt, Human
gcuucuuugaggacccagugggu

SEQ ID NO: 127962 - RNA, 22 nt, Human
gguuucagaagcugcagcuggu

SEQ ID NO: 127963 - RNA, 21 nt, Human
aacucacagcagcacgccuua

SEQ ID NO: 127964 - RNA, 22 nt, Human
ccauggucaaugcuggugccau

SEQ ID NO: 127965 - RNA, 24 nt, Human
aucauuuacuagaaaggcuuuuuc

SEQ ID NO: 127966 - RNA, 21 nt, Human
auuuuuggucacuugcuuuau

SEQ ID NO: 127967 - RNA, 27 nt, Human
ugaaaguuuuuaauucauauuuuuccu

SEQ ID NO: 127968 - RNA, 22 nt, Human
gcgaucccuccccucagccucc

SEQ ID NO: 127969 - RNA, 20 nt, Human
caggcugggaauugcagugg

SEQ ID NO: 127970 - RNA, 23 nt, Human
uucugcugaagauucaguuuaag

SEQ ID NO: 127971 - RNA, 24 nt, Human
uccccacuguccuccaucaaaguc

SEQ ID NO: 127972 - RNA, 19 nt, Human
auuuaaacugaauuuccag

SEQ ID NO: 127973 - RNA, 19 nt, Human
agaugcuggccagcauuuu

SEQ ID NO: 127974 - RNA, 19 nt, Human
acagguuccuguggagaca

SEQ ID NO: 127975 - RNA, 25 nt, Human
ggacaccacacccagccucaguccu

SEQ ID NO: 127976 - RNA, 31 nt, Human
cugcuucacccucacccccuccuggcaauca

SEQ ID NO: 127977 - RNA, 21 nt, Human
gcccagucucuucugguuuaa

SEQ ID NO: 127978 - RNA, 27 nt, Human
caggcuggagugcaguggccuggucau

SEQ ID NO: 127979 - RNA, 28 nt, Human
gcugcugcccuuccuccuccuccucagu

SEQ ID NO: 127980 - RNA, 18 nt, Human
cccaggaggucagcaguc

SEQ ID NO: 127981 - RNA, 26 nt, Human
ggcucgagccucuccugcucagcacc

SEQ ID NO: 127982 - RNA, 23 nt, Human
ggcuuggacaggcccugguuguu

SEQ ID NO: 127983 - RNA, 22 nt, Human
aaucaagugguuggaacacugu

SEQ ID NO: 127984 - RNA, 19 nt, Human
cccucucccccaccucuuc

SEQ ID NO: 127985 - RNA, 23 nt, Human
gaacauuguacucacuggacuua

SEQ ID NO: 127986 - RNA, 26 nt, Human
cuccucuuuggcuccuugaaguuugc

SEQ ID NO: 127987 - RNA, 20 nt, Human
agacccuugaagauguagcu

SEQ ID NO: 127988 - RNA, 27 nt, Human
agccuccuccaccucaccuccaugaca

SEQ ID NO: 127989 - RNA, 23 nt, Human
ugucucccaggcuggaggucagu

SEQ ID NO: 127990 - RNA, 30 nt, Human; identical to SEQ ID NO: 6873

SEQ ID NO: 127991 - RNA, 27 nt, Human
gacaggaucucaggcuggagugcagug

SEQ ID NO: 127992 - RNA, 23 nt, Human
gucuguaaucucagaggcuuguu

SEQ ID NO: 127993 - RNA, 22 nt, Human
gguacacauuuauuuacuguuu

SEQ ID NO: 127994 - RNA, 23 nt, Human
ggcuaauuuuuuguauuuugucu

SEQ ID NO: 127995 - RNA, 27 nt, Human
cacaggcuggguuggucugccccucag

SEQ ID NO: 127996 - RNA, 20 nt, Human
uauucagauguaugugcccu

SEQ ID NO: 127997 - RNA, 21 nt, Human
cacugcucuccagccuggcga

SEQ ID NO: 127998 - RNA, 21 nt, Human
ggccuggugggggaggcaggg

SEQ ID NO: 127999 - RNA, 19 nt, Human
cuguuuuaaucauagauga

SEQ ID NO: 128000 - RNA, 19 nt, Human
ucaccagcaaaggcuaaga

SEQ ID NO: 128001 - RNA, 22 nt, Human
gcugcgggguggggaccccaag

SEQ ID NO: 128002 - RNA, 22 nt, Human
cccucacugcugccucaacuuc

SEQ ID NO: 128003 - RNA, 19 nt, Human
ccaggcaauuuguagagga

SEQ ID NO: 128004 - RNA, 27 nt, Human
aggccauuuggacucugccuucaaaca

SEQ ID NO: 128005 - RNA, 22 nt, Human
caagagguggagguuacaguga

SEQ ID NO: 128006 - RNA, 26 nt, Human
auccacccuuuuccaaguugauugcc

SEQ ID NO: 128007 - RNA, 20 nt, Human
ucuccuaauaccaucucguu

SEQ ID NO: 128008 - RNA, 18 nt, Human
ggccucggaaccagcuuu

SEQ ID NO: 128009 - RNA, 22 nt, Human
gcacagaccacacacagcacua

SEQ ID NO: 128010 - RNA, 20 nt, Human
uggauccacaggcagagcca

SEQ ID NO: 128011 - RNA, 26 nt, Human
uucuuuauuucugucauucaaauggg

SEQ ID NO: 128012 - RNA, 24 nt, Human
cccuucuccccaaaucaucaacaa

SEQ ID NO: 128013 - RNA, 21 nt, Human
gcuagaaagcauccauuaauu

SEQ ID NO: 128014 - RNA, 21 nt, Human
acaauuuuaccgccagugugc

SEQ ID NO: 128015 - RNA, 26 nt, Human
accaugugcaagucugugucuuguca

SEQ ID NO: 128016 - RNA, 25 nt, Human
ggagggaggggugugcaggagccgc

SEQ ID NO: 128017 - RNA, 22 nt, Human
augggacuaauuauucccacua

SEQ ID NO: 128018 - RNA, 23 nt, Human
ugucucugagcucuguguccucc

SEQ ID NO: 128019 - RNA, 17 nt, Human
ugggcccugauggucau

SEQ ID NO: 128020 - RNA, 21 nt, Human
ccacuucuaagaaaagccuaa

SEQ ID NO: 128021 - RNA, 25 nt, Human
ugcuguccccuccccucuguuuaca

SEQ ID NO: 128022 - RNA, 23 nt, Human
cacccuccccaccagugcaacag

SEQ ID NO: 128023 - RNA, 23 nt, Human
uccaagccacaugccacuaacca

SEQ ID NO: 128024 - RNA, 22 nt, Human
gcaggcagaucaccugagguca

SEQ ID NO: 128025 - RNA, 22 nt, Human
ugcccugcccagugacagcugg

SEQ ID NO: 128026 - RNA, 22 nt, Human
cggcguuaagauuucaacaaga

SEQ ID NO: 128027 - RNA, 24 nt, Human
aucucggagacaaaacuaguacug

SEQ ID NO: 128028 - RNA, 23 nt, Human
cuggguagaagggaaaagacugg

SEQ ID NO: 128029 - RNA, 27 nt, Human
aaagggaggcgugccugagaagguagc

SEQ ID NO: 128030 - RNA, 22 nt, Human
gggaggggauaagguggcagaa

SEQ ID NO: 128031 - RNA, 20 nt, Human
cucaucugagggcccaacug

SEQ ID NO: 128032 - RNA, 21 nt, Human
uuguccauuuuaugcauuuca

SEQ ID NO: 128033 - RNA, 26 nt, Human
aacugcacuccagcuugggcaacagg

SEQ ID NO: 128034 - RNA, 23 nt, Human
ggagggggcaucuucugaacagc

SEQ ID NO: 128035 - RNA, 24 nt, Human
agcucacucuggucgacucuuccu

SEQ ID NO: 128036 - RNA, 23 nt, Human
gccagaacuugacccugagcuga

SEQ ID NO: 128037 - RNA, 23 nt, Human
aucccaagccgccuccuccaccg

SEQ ID NO: 128038 - RNA, 22 nt, Human
cugcccuuugggcuggauuacc

SEQ ID NO: 128039 - RNA, 22 nt, Human
gcucgcugcaaccucugacucc

SEQ ID NO: 128040 - RNA, 22 nt, Human
agguugcaaggcaguucugcuc

SEQ ID NO: 128041 - RNA, 26 nt, Human
cagcacucucuaaaucuuccuuguga

SEQ ID NO: 128042 - RNA, 27 nt, Human
ucagcacucccuucuucccuuuuauag

SEQ ID NO: 128043 - RNA, 21 nt, Human
gagcccaggagcagaggaagu

SEQ ID NO: 128044 - RNA, 21 nt, Human
ugucccccugucagcugccuc

SEQ ID NO: 128045 - RNA, 28 nt, Human
uguacuuaaucuuugcuuucuuugcaca

SEQ ID NO: 128046 - RNA, 24 nt, Human
aaagaagaaaagguucuuacugcu

SEQ ID NO: 128047 - RNA, 21 nt, Human
cugccaccuggcugcccacag

SEQ ID NO: 128048 - RNA, 22 nt, Human
cuuuuggcccucuucuuucuga

SEQ ID NO: 128049 - RNA, 26 nt, Human
aaagaaugugaggaagaaaugggacu

SEQ ID NO: 128050 - RNA, 23 nt, Human
uguccccuccuacuucuugcugc

SEQ ID NO: 128051 - RNA, 27 nt, Human
guugguggcaucggaggccuuaccacu

SEQ ID NO: 128052 - RNA, 22 nt, Human
ccuggccucugcccacuagaca

SEQ ID NO: 128053 - RNA, 24 nt, Human
cuccugucauaauuccaucccucc

SEQ ID NO: 128054 - RNA, 23 nt, Human
ucgcccaggauggagaggcgggu

SEQ ID NO: 128055 - RNA, 22 nt, Human
gcaauauugccuucacaguuau

SEQ ID NO: 128056 - RNA, 22 nt, Human
gacuaaggggagagggagaagc

SEQ ID NO: 128057 - RNA, 21 nt, Human
uuacuugcugcucacacuaua

SEQ ID NO: 128058 - RNA, 24 nt, Human
agccuggaugcccaccugcccuca

SEQ ID NO: 128059 - RNA, 19 nt, Human
uagcucaggaggcuuggaa

SEQ ID NO: 128060 - RNA, 23 nt, Human
agcuuugggaaagccugccucgu

SEQ ID NO: 128061 - RNA, 21 nt, Human
acagacacugacuguuuuugu

SEQ ID NO: 128062 - RNA, 22 nt, Human
aauuucuugggaaacuucuagc

SEQ ID NO: 128063 - RNA, 25 nt, Human
uagaugcucugagaaauugaaugua

SEQ ID NO: 128064 - RNA, 21 nt, Human
gccugacucucagcagcuaug

SEQ ID NO: 128065 - RNA, 17 nt, Human
caguucugcagcuggcc

SEQ ID NO: 128066 - RNA, 22 nt, Human
gcccagcccugacaccugcccu

SEQ ID NO: 128067 - RNA, 27 nt, Human
uucucucucacagauagugagggucug

SEQ ID NO: 128068 - RNA, 25 nt, Human
uuccaucuucugaaauucugagauu

SEQ ID NO: 128069 - RNA, 23 nt, Human
agcaaggaugaaagagagagguc

SEQ ID NO: 128070 - RNA, 22 nt, Human
cagcaaccucuaccuccugggu

SEQ ID NO: 128071 - RNA, 20 nt, Human
uaauaucacaauggaaggaa

SEQ ID NO: 128072 - RNA, 20 nt, Human
ccugcacucugucucuccaa

SEQ ID NO: 128073 - RNA, 21 nt, Human
ggggaggcggagguuacagug

SEQ ID NO: 128074 - RNA, 21 nt, Human
gcagcugcugggcacgcccag

SEQ ID NO: 128075 - RNA, 20 nt, Human
cagccuggcccuccuggugc

SEQ ID NO: 128076 - RNA, 21 nt, Human
ucugcugggaacucccugacu

SEQ ID NO: 128077 - RNA, 25 nt, Human
uuggcaguguggcagugaccauggc

SEQ ID NO: 128078 - RNA, 27 nt, Human
agcucacugcaagcucuaccucuuggu

SEQ ID NO: 128079 - RNA, 20 nt, Human
agcuccuucuuucugcaaca

SEQ ID NO: 128080 - RNA, 23 nt, Human
cacaggcacuccuggagauauga

SEQ ID NO: 128081 - RNA, 23 nt, Human
ccaggcgccaccacugaugccac

SEQ ID NO: 128082 - RNA, 20 nt, Human
uaccauucagaccgagagaa

SEQ ID NO: 128083 - RNA, 24 nt, Human
cccacuccccacucucagccuggg

SEQ ID NO: 128084 - RNA, 24 nt, Human
aauaaacaaggucauacauaccuu

SEQ ID NO: 128085 - RNA, 22 nt, Human
ccugaguagcugggacuacagg

SEQ ID NO: 128086 - RNA, 22 nt, Human
uguccuacuccuugcaggugac

SEQ ID NO: 128087 - RNA, 31 nt, Human
uuguauuuuggcugcuagagugcagcauuug

SEQ ID NO: 128088 - RNA, 25 nt, Human
auuccaggaaaccauggcagcaugg

SEQ ID NO: 128089 - RNA, 26 nt, Human
uguaaauauuaaaccuuaagauggca

SEQ ID NO: 128090 - RNA, 27 nt, Human
gugauguuuaauauuauuaaauccagg

SEQ ID NO: 128091 - RNA, 18 nt, Human
cugcugcuccuccuccuu

SEQ ID NO: 128092 - RNA, 21 nt, Human
acccccacuucucucaguucc

SEQ ID NO: 128093 - RNA, 19 nt, Human
gcugcugcugcugcuccug

SEQ ID NO: 128094 - RNA, 24 nt, Human
aggucacuagauucuacugcucuu

SEQ ID NO: 128095 - RNA, 26 nt, Human
acaugcuguuggguuuuaauucucua

SEQ ID NO: 128096 - RNA, 23 nt, Human
ucacggggaccagaacacuggua

SEQ ID NO: 128097 - RNA, 21 nt, Human
ccaagugcuaggauuacaggc

SEQ ID NO: 128098 - RNA, 22 nt, Human
cagagauaagguucguucucaa

SEQ ID NO: 128099 - RNA, 19 nt, Human
uggcaaagccaaaauagcu

SEQ ID NO: 128100 - RNA, 19 nt, Human
uugcuaccucagugcuccu

SEQ ID NO: 128101 - RNA, 29 nt, Human
uaaggcuguauguuucuggaacaaaauau

SEQ ID NO: 128102 - RNA, 23 nt, Human
cugcuucugcugccuguuugggg

SEQ ID NO: 128103 - RNA, 22 nt, Human
gaggcaagagcacagacuuaca

SEQ ID NO: 128104 - RNA, 22 nt, Human
ccuccugccccuuccuucugcc

SEQ ID NO: 128105 - RNA, 24 nt, Human
gggaagugcaaauuggauagagaa

SEQ ID NO: 128106 - RNA, 30 nt, Human
gcacaggccugggccuuccccuucccucaa

SEQ ID NO: 128107 - RNA, 22 nt, Human
caugccuguaauccuagcacuu

SEQ ID NO: 128108 - RNA, 22 nt, Human
cugggugagcugagauggaguc

SEQ ID NO: 128109 - RNA, 22 nt, Human
auagaguuuauuuuuucuucau

SEQ ID NO: 128110 - RNA, 23 nt, Human
ccacuguacuccagcccggcacu

SEQ ID NO: 128111 - RNA, 24 nt, Human
ggcgugccuggcagugugguggcc

SEQ ID NO: 128112 - RNA, 21 nt, Human
gcaccugaaaugauucuucac

SEQ ID NO: 128113 - RNA, 24 nt, Human
cccuugcccagcuugccaagguga

SEQ ID NO: 128114 - RNA, 25 nt, Human
ggaaaagauauuuuuauaggcuugg

SEQ ID NO: 128115 - RNA, 26 nt, Human
gugccaguauauggcccuggcucugc

SEQ ID NO: 128116 - RNA, 21 nt, Human
ccacuggccuauuuucucagc

SEQ ID NO: 128117 - RNA, 21 nt, Human
acagcccucuagccugggggg

SEQ ID NO: 128118 - RNA, 21 nt, Human
ucuguuuucuguccauggccc

SEQ ID NO: 128119 - RNA, 25 nt, Human
ggcuccucucccaagaaauccaggu

SEQ ID NO: 128120 - RNA, 27 nt, Human
agacuccugggcucaccuguuagcgcu

SEQ ID NO: 128121 - RNA, 23 nt, Human
gucagaggcugcucaucugagca

SEQ ID NO: 128122 - RNA, 21 nt, Human
agugguuuuuucauuauguaa

SEQ ID NO: 128123 - RNA, 19 nt, Human
cccuaaugucauucacauu

SEQ ID NO: 128124 - RNA, 20 nt, Human
gcggcgggcccugcccacac

SEQ ID NO: 128125 - RNA, 24 nt, Human
gccccugggaaccugcgugccaca

SEQ ID NO: 128126 - RNA, 25 nt, Human
gguggaggcggcggcggcagaggag

SEQ ID NO: 128127 - RNA, 23 nt, Human
uuaggggcagaaaaacauuugua

SEQ ID NO: 128128 - RNA, 20 nt, Human
ccucacaugggcagaaaaau

SEQ ID NO: 128129 - RNA, 22 nt, Human
uuccucuaguaagagguggcuc

SEQ ID NO: 128130 - RNA, 23 nt, Human
gccacgucuggcuaauuauuauu

SEQ ID NO: 128131 - RNA, 25 nt, Human
aagcaacaggcggcauucaggacuc

SEQ ID NO: 128132 - RNA, 20 nt, Human
cccagcacuuuguagucuca

SEQ ID NO: 128133 - RNA, 22 nt, Human
gcuucuaggcacuccagugggg

SEQ ID NO: 128134 - RNA, 21 nt, Human
acagcugcagcaggugaccuc

SEQ ID NO: 128135 - RNA, 26 nt, Human
ccgggccaucccacuagcagcuuugg

SEQ ID NO: 128136 - RNA, 24 nt, Human
ugugucaucacugcagcgguccuc

SEQ ID NO: 128137 - RNA, 27 nt, Human
ccccaagaauuaucauggaaugucaga

SEQ ID NO: 128138 - RNA, 21 nt, Human
uaggaagggggaguggcgcug

SEQ ID NO: 128139 - RNA, 22 nt, Human
acagagaaaucacagacuuuug

SEQ ID NO: 128140 - RNA, 24 nt, Human
ccgauaacagccaugcacugugca

SEQ ID NO: 128141 - RNA, 22 nt, Human
agcuuugggaucccacccuggg

SEQ ID NO: 128142 - RNA, 27 nt, Human
ugaguaauuuuagaagcauuauuuuag

SEQ ID NO: 128143 - RNA, 26 nt, Human
ccuuguucauuuauaucgcuggccag

SEQ ID NO: 128144 - RNA, 22 nt, Human
uugcccagcuuuccuggcaauu

SEQ ID NO: 128145 - RNA, 26 nt, Human
acagaagucaugaagcccaagugaaa

SEQ ID NO: 128146 - RNA, 27 nt, Human
uuugugacuuccuuuggaggacuuggc

SEQ ID NO: 128147 - RNA, 22 nt, Human
gccugcucucgaggcagcagug

SEQ ID NO: 128148 - RNA, 18 nt, Human
uguauuucaaaauugauu

SEQ ID NO: 128149 - RNA, 19 nt, Human
gaacaauauucuucaagag

SEQ ID NO: 128150 - RNA, 21 nt, Human
ccauuugagccucaucucugg

SEQ ID NO: 128151 - RNA, 22 nt, Human
uucagugguaccuggaggucug

SEQ ID NO: 128152 - RNA, 22 nt, Human
cgcccaggcuggagugcaacgg

SEQ ID NO: 128153 - RNA, 29 nt, Human
cucuaccuggccgguaggcugcuggcgcc

SEQ ID NO: 128154 - RNA, 22 nt, Human
cgcccaggcuggagugcagucg

SEQ ID NO: 128155 - RNA, 24 nt, Human
gcuuucagcacucacucucccccu

SEQ ID NO: 128156 - RNA, 22 nt, Human
gugggagacaaugucacaaguu

SEQ ID NO: 128157 - RNA, 20 nt, Human
cagcuuuugccccacacccu

SEQ ID NO: 128158 - RNA, 22 nt, Human
ccaauauggugaaaccccaugu

SEQ ID NO: 128159 - RNA, 20 nt, Human
ggacuucucuaauagaaaag

SEQ ID NO: 128160 - RNA, 24 nt, Human
ugcuugucaguggggaccccucgc

SEQ ID NO: 128161 - RNA, 21 nt, Human
gccagccacaguggcagcucu

SEQ ID NO: 128162 - RNA, 26 nt, Human
auuugaaaacauugcgguauccauga

SEQ ID NO: 128163 - RNA, 28 nt, Human
ucugggaagcuugagccucccccaaagc

SEQ ID NO: 128164 - RNA, 27 nt, Human
ggcuguaaauuaccauuuacuagauua

SEQ ID NO: 128165 - RNA, 23 nt, Human
uuuuccuucuaugcaaucaugcc

SEQ ID NO: 128166 - RNA, 20 nt, Human
uguagcuaauuaggaagcuu

SEQ ID NO: 128167 - RNA, 22 nt, Human
accauccuggccaacacaguga

SEQ ID NO: 128168 - RNA, 25 nt, Human
gggacuggagucagaugagcaagga

SEQ ID NO: 128169 - RNA, 23 nt, Human
agcuuucuaggucacauuggguu

SEQ ID NO: 128170 - RNA, 20 nt, Human
gaucuuuguucaccaguucu

SEQ ID NO: 128171 - RNA, 26 nt, Human
caggaccuccggagcagacagcacag

SEQ ID NO: 128172 - RNA, 21 nt, Human
aggaggucaaggcugcaguga

SEQ ID NO: 128173 - RNA, 21 nt, Human
gggaggucgaggcugcaguga

SEQ ID NO: 128174 - RNA, 23 nt, Human
ucugucguguucaccagagaaag

SEQ ID NO: 128175 - RNA, 28 nt, Human
cucacucauuccuucacucauccagcca

SEQ ID NO: 128176 - RNA, 25 nt, Human
ucucccaccuccuuccccccaccag

SEQ ID NO: 128177 - RNA, 24 nt, Human
uagcugaaauacugucuaucucua

SEQ ID NO: 128178 - RNA, 27 nt, Human
uacagguguguguccaugcacagcuaa

SEQ ID NO: 128179 - RNA, 22 nt, Human
agcuagauguggcaugcaucug

SEQ ID NO: 128180 - RNA, 28 nt, Human
ccuggugcaaagugccccaaacagcaau

SEQ ID NO: 128181 - RNA, 25 nt, Human
ccaucgggcccaggucucugggguu

SEQ ID NO: 128182 - RNA, 21 nt, Human
ccaacuugguuuugcuacaua

SEQ ID NO: 128183 - RNA, 24 nt, Human
gauaccuguuuuccacugcuaaaa

SEQ ID NO: 128184 - RNA, 25 nt, Human
gucugcagggggcacuuguuccuga

SEQ ID NO: 128185 - RNA, 19 nt, Human
uagagagaaagggagccgc

SEQ ID NO: 128186 - RNA, 26 nt, Human
ggaagggggagagacaaacugccgua

SEQ ID NO: 128187 - RNA, 18 nt, Human
gaagaagcuucaaagcuc

SEQ ID NO: 128188 - RNA, 22 nt, Human
uaggcuggagugcaguggggca

SEQ ID NO: 128189 - RNA, 25 nt, Human
ccuaaaacaacagauguacgacuug

SEQ ID NO: 128190 - RNA, 22 nt, Human
ugggaguuagagguugcaguga

SEQ ID NO: 128191 - RNA, 25 nt, Human
gaaauuggcuccaaaugaaugaacu

SEQ ID NO: 128192 - RNA, 21 nt, Human
ugccugcaauuccagcacuuu

SEQ ID NO: 128193 - RNA, 25 nt, Human
cggcuccuccucccacucugcuccu

SEQ ID NO: 128194 - RNA, 22 nt, Human
uaugaguuguccaucuuaaaga

SEQ ID NO: 128195 - RNA, 16 nt, Human
agccuccuccaccuca

SEQ ID NO: 128196 - RNA, 19 nt, Human
ucccugacacacauucaug

SEQ ID NO: 128197 - RNA, 21 nt, Human
gaggugaccccagacacugca

SEQ ID NO: 128198 - RNA, 18 nt, Human
uuucugcugccagucaca

SEQ ID NO: 128199 - RNA, 25 nt, Human
uccaccccaccccuuuucgucacga

SEQ ID NO: 128200 - RNA, 22 nt, Human
uuuucuuucuuuuuucucugac

SEQ ID NO: 128201 - RNA, 21 nt, Human
ccagggagggagcugaggagc

SEQ ID NO: 128202 - RNA, 27 nt, Human
aaguagcugggauuacaggcgccugcc

SEQ ID NO: 128203 - RNA, 22 nt, Human
ggcagggguuccagcuucccuu

SEQ ID NO: 128204 - RNA, 22 nt, Human
cugaggcaugagaaucgcuugg

SEQ ID NO: 128205 - RNA, 23 nt, Human
ggugugguggcucauaccuguaa

SEQ ID NO: 128206 - RNA, 31 nt, Human
uugcauuuucucugugcuuuggcaucugaau

SEQ ID NO: 128207 - RNA, 28 nt, Human
gccagguuugcaccagccucgagucucc

SEQ ID NO: 128208 - RNA, 24 nt, Human
uaaaacaaugaggaaauguugguc

SEQ ID NO: 128209 - RNA, 21 nt, Human
auuucgggcccuccucuucag

SEQ ID NO: 128210 - RNA, 24 nt, Human
ugccucucccccuuuccucgacag

SEQ ID NO: 128211 - RNA, 20 nt, Human
ugaguggggauuacaggcca

SEQ ID NO: 128212 - RNA, 20 nt, Human
cugcagcuucuaaauccaga

SEQ ID NO: 128213 - RNA, 18 nt, Human
uaaagaaaugacuuucua

SEQ ID NO: 128214 - RNA, 24 nt, Human
agucacugauugccacugccaucu

SEQ ID NO: 128215 - RNA, 25 nt, Human
uuccccacuuuuagaaauuauguua

SEQ ID NO: 128216 - RNA, 19 nt, Human
cagacucccuuuugaccuc

SEQ ID NO: 128217 - RNA, 24 nt, Human
ucuccagcccuucuccugugugcc

SEQ ID NO: 128218 - RNA, 22 nt, Human
agaccagccuggccaacacuau

SEQ ID NO: 128219 - RNA, 24 nt, Human
auuccucaggggccuguggcugga

SEQ ID NO: 128220 - RNA, 27 nt, Human
cuccugagccugucucucccuacccuc

SEQ ID NO: 128221 - RNA, 22 nt, Human
cacgccuaugaucccagcacuu

SEQ ID NO: 128222 - RNA, 22 nt, Human
ccggcugguggagcugcuggug

SEQ ID NO: 128223 - RNA, 20 nt, Human
uucugggugggaguggggag

SEQ ID NO: 128224 - RNA, 20 nt, Human
ugagucuugccagaauguga

SEQ ID NO: 128225 - RNA, 22 nt, Human
guuugagggugggguaagggau

SEQ ID NO: 128226 - RNA, 23 nt, Human
ccgguggggcagaggacccggug

SEQ ID NO: 128227 - RNA, 23 nt, Human
uggaaagggagccugggagccag

SEQ ID NO: 128228 - RNA, 24 nt, Human
ugcagcaaaagcaggcaacaaaau

SEQ ID NO: 128229 - RNA, 19 nt, Human
guccgaccucuggaaaugu

SEQ ID NO: 128230 - RNA, 22 nt, Human
ccuacaaaagugccuacagccc

SEQ ID NO: 128231 - RNA, 24 nt, Human
aggcaggcggaucaccugagguca

SEQ ID NO: 128232 - RNA, 17 nt, Human
cccucugcccuuuugcc

SEQ ID NO: 128233 - RNA, 21 nt, Human
guugcccaggcugaauucaga

SEQ ID NO: 128234 - RNA, 21 nt, Human
uguuugcuguuccacaaagca

SEQ ID NO: 128235 - RNA, 23 nt, Human
ccgucuggcccaccaggguccuu

SEQ ID NO: 128236 - RNA, 25 nt, Human
ccuugguccucacagcuccaaaaag

SEQ ID NO: 128237 - RNA, 21 nt, Human
gcagcacuuuggggccagcuu

SEQ ID NO: 128238 - RNA, 21 nt, Human
ucugccaccccucacacagcc

SEQ ID NO: 128239 - RNA, 22 nt, Human
aacuccacaguucccaggcugg

SEQ ID NO: 128240 - RNA, 20 nt, Human
gcaaaagggagcccauguag

SEQ ID NO: 128241 - RNA, 24 nt, Human
ccacugcagccucgagugccccug

SEQ ID NO: 128242 - RNA, 17 nt, Human
gccauccgucaccagaa

SEQ ID NO: 128243 - RNA, 26 nt, Human
ccagcagaaagaggaaagagguagca

SEQ ID NO: 128244 - RNA, 23 nt, Human
ccaacaggaugaacgugugcaaa

SEQ ID NO: 128245 - RNA, 27 nt, Human
cugagggugccucaggagcagugggac

SEQ ID NO: 128246 - RNA, 20 nt, Human
cuuggaaaagacuuggcucu

SEQ ID NO: 128247 - RNA, 21 nt, Human
uguucaugcuuuguaccaaau

SEQ ID NO: 128248 - RNA, 26 nt, Human
cugucggugacugcgccguccgggcc

SEQ ID NO: 128249 - RNA, 20 nt, Human
uacuaaugaugagcauuuag

SEQ ID NO: 128250 - RNA, 23 nt, Human
ucuggcuucugcuucauccugcu

SEQ ID NO: 128251 - RNA, 22 nt, Human
gaaauuugauaaugacacuguu

SEQ ID NO: 128252 - RNA, 21 nt, Human
ggcuggaacuguuucuuuaaa

SEQ ID NO: 128253 - RNA, 21 nt, Human
ugggcccaggcuggggacaga

SEQ ID NO: 128254 - RNA, 23 nt, Human
gcuaauucuucuccuccuucaca

SEQ ID NO: 128255 - RNA, 21 nt, Human
ggaggaaagcaaaauccaacu

SEQ ID NO: 128256 - RNA, 21 nt, Human
ucuguauuucuugcuuauuau

SEQ ID NO: 128257 - RNA, 22 nt, Human
ggggugcugggaccuggggcac

SEQ ID NO: 128258 - RNA, 20 nt, Human
gcugugcauuccagcagguu

SEQ ID NO: 128259 - RNA, 24 nt, Human
ccuggucucuggcccugguucuua

SEQ ID NO: 128260 - RNA, 28 nt, Human
cugacugauguugagggaacagacagga

SEQ ID NO: 128261 - RNA, 20 nt, Human
aauaaaacaugcaucauuuu

SEQ ID NO: 128262 - RNA, 24 nt, Human
gcaauuuauuaaauuuauauucuu

SEQ ID NO: 128263 - RNA, 21 nt, Human
acuccucccuccuccuccacu

SEQ ID NO: 128264 - RNA, 20 nt, Human
ucuuuuuucucauuucuuuu

SEQ ID NO: 128265 - RNA, 21 nt, Human
uuguccagguuccucaguuaa

SEQ ID NO: 128266 - RNA, 22 nt, Human
uguaauaaacucucuagggcca

SEQ ID NO: 128267 - RNA, 23 nt, Human
cugaaacacuggcagucguugga

SEQ ID NO: 128268 - RNA, 21 nt, Human
cugaacaaaagcuuuucuuuc

SEQ ID NO: 128269 - RNA, 26 nt, Human
aagcaguuugaggggauguguaggag

SEQ ID NO: 128270 - RNA, 20 nt, Human
ucucauacuuuacauucaug

SEQ ID NO: 128271 - RNA, 20 nt, Human
accuuccucuucacacugag

SEQ ID NO: 128272 - RNA, 21 nt, Human
gcuccagauuuaaauccagcu

SEQ ID NO: 128273 - RNA, 20 nt, Human
uugaagccugcccuugucug

SEQ ID NO: 128274 - RNA, 21 nt, Human
cgggggaggggcugggggagu

SEQ ID NO: 128275 - RNA, 21 nt, Human
gccccaggaguggguggagag

SEQ ID NO: 128276 - RNA, 30 nt, Human
ggacuggacuuggcuuauuucuuccugucu

SEQ ID NO: 128277 - RNA, 21 nt, Human
caagugauucucuugccucag

SEQ ID NO: 128278 - RNA, 26 nt, Human
cucccaggcuggagugcaaucgcgca

SEQ ID NO: 128279 - RNA, 27 nt, Human
cugcagcuaggaaugaugugggugacg

SEQ ID NO: 128280 - RNA, 21 nt, Human
uuuuguuuucuugauuuuuac

SEQ ID NO: 128281 - RNA, 27 nt, Human
ucauggcacuccaagucagguucuggg

SEQ ID NO: 128282 - RNA, 23 nt, Human
agaauguugcuuucugaauuuug

SEQ ID NO: 128283 - RNA, 26 nt, Human
ggggcagagucaggggcuggccagag

SEQ ID NO: 128284 - RNA, 26 nt, Human
agcuuugugugauucauguuuuaaaa

SEQ ID NO: 128285 - RNA, 23 nt, Human
caggaccuagaagaguggcauug

SEQ ID NO: 128286 - RNA, 20 nt, Human
agauaaauauugagcagauc

SEQ ID NO: 128287 - RNA, 21 nt, Human
augugcccgugcacaccagug

SEQ ID NO: 128288 - RNA, 28 nt, Human
ugccaagucugcagcacagugaccaaau

SEQ ID NO: 128289 - RNA, 22 nt, Human
uucugguggcaaaugaauuuau

SEQ ID NO: 128290 - RNA, 26 nt, Human
uuacuaagccacaagaaauuugauuu

SEQ ID NO: 128291 - RNA, 25 nt, Human
gugucauccaggcuggagugcggug

SEQ ID NO: 128292 - RNA, 21 nt, Human
agcccauagauuccuaaccca

SEQ ID NO: 128293 - RNA, 27 nt, Human
ugcccuuuaauacacuccuaucaucag

SEQ ID NO: 128294 - RNA, 23 nt, Human
ucccaggcuggggaugcuuugcc

SEQ ID NO: 128295 - RNA, 25 nt, Human
gcaucaucuuaacuaacauucugaa

SEQ ID NO: 128296 - RNA, 22 nt, Human
cccuuaucugcacccaccuccc

SEQ ID NO: 128297 - RNA, 25 nt, Human
uuaccuuucaugugccugaaggcua

SEQ ID NO: 128298 - RNA, 20 nt, Human
uuugagaucagccugggcaa

SEQ ID NO: 128299 - RNA, 20 nt, Human
agcucucgaaguggaggcgg

SEQ ID NO: 128300 - RNA, 24 nt, Human
uucuacaaguaauuuugcacagac

SEQ ID NO: 128301 - RNA, 25 nt, Human
ucuggaaauuaauuuucucuuuagg

SEQ ID NO: 128302 - RNA, 26 nt, Human
uaggguagaaaacaaaaagggagugg

SEQ ID NO: 128303 - RNA, 23 nt, Human
cucccugaggccucuccgcacca

SEQ ID NO: 128304 - RNA, 21 nt, Human
gagcucaagaaggugaucuag

SEQ ID NO: 128305 - RNA, 27 nt, Human
ggagagggauauggagagcagguggug

SEQ ID NO: 128306 - RNA, 26 nt, Human
ggagaggaacguggaacaggagcagg

SEQ ID NO: 128307 - RNA, 22 nt, Human
ggguucuaaauauacaacuugu

SEQ ID NO: 128308 - RNA, 27 nt, Human
agagcaucugaccccuuauuaccaccu

SEQ ID NO: 128309 - RNA, 25 nt, Human
ugcuuugggguuggugcaaccucag

SEQ ID NO: 128310 - RNA, 22 nt, Human
caaugccuuuucagcugcacua

SEQ ID NO: 128311 - RNA, 22 nt, Human
cccaccccucauaccuacaccc

SEQ ID NO: 128312 - RNA, 27 nt, Human
ugggcuuuugcuuuucuaggucauuaa

SEQ ID NO: 128313 - RNA, 23 nt, Human
uuucaguuuugaaucaguauugu

SEQ ID NO: 128314 - RNA, 23 nt, Human
gcccccacugccugucgguugcu

SEQ ID NO: 128315 - RNA, 22 nt, Human
cagaggcaauaaaagcugcagu

SEQ ID NO: 128316 - RNA, 25 nt, Human
uuuagaaccugcuucucugaucugu

SEQ ID NO: 128317 - RNA, 21 nt, Human
cgacaccaccgccaucaugcc

SEQ ID NO: 128318 - RNA, 25 nt, Human
ugggaucagaagucagaaguuugga

SEQ ID NO: 128319 - RNA, 22 nt, Human
gccuguaauccuagcuacuugg

SEQ ID NO: 128320 - RNA, 26 nt, Human
ccaugcugggucugaggccccugccu

SEQ ID NO: 128321 - RNA, 22 nt, Human
gccuguaaucccagcuacucgg

SEQ ID NO: 128322 - RNA, 26 nt, Human
cccagccugugucccaugggcacaag

SEQ ID NO: 128323 - RNA, 23 nt, Human
ucgcccgcgccuggccuaccgcg

SEQ ID NO: 128324 - RNA, 24 nt, Human
gcccugguguuugcaccgcacuuu

SEQ ID NO: 128325 - RNA, 27 nt, Human
cggagaaggcucuacagggaagggguc

SEQ ID NO: 128326 - RNA, 20 nt, Human
auauauuuguacuggagauu

SEQ ID NO: 128327 - RNA, 16 nt, Human
ccuuuucucccugccu

SEQ ID NO: 128328 - RNA, 22 nt, Human
ccucacugcaacacaaagcucc

SEQ ID NO: 128329 - RNA, 20 nt, Human
cggucccagcccggccacug

SEQ ID NO: 128330 - RNA, 26 nt, Human
guuuguaaugagagcacuuucuuuuu

SEQ ID NO: 128331 - RNA, 20 nt, Human
uucccaucacauucuggucu

SEQ ID NO: 128332 - RNA, 27 nt, Human
ucauccagcucacucaucaauggggcc

SEQ ID NO: 128333 - RNA, 27 nt, Human
gugaggccccugcagagcugcugauga

SEQ ID NO: 128334 - RNA, 21 nt, Human
ggguacauuucagagcuguuc

SEQ ID NO: 128335 - RNA, 27 nt, Human
gagagggguauacacagggaggccagg

SEQ ID NO: 128336 - RNA, 22 nt, Human
auaaaauguauuaagcagcagu

SEQ ID NO: 128337 - RNA, 23 nt, Human
agcauuuaggaaagcagugcagu

SEQ ID NO: 128338 - RNA, 20 nt, Human
gccucuucucccaggggagc

SEQ ID NO: 128339 - RNA, 20 nt, Human
ggcgcucacaccugagcuca

SEQ ID NO: 128340 - RNA, 20 nt, Human
aucuccagauugucugauuu

SEQ ID NO: 128341 - RNA, 27 nt, Human
gucucuaacuccugggcuuaagugauc

SEQ ID NO: 128342 - RNA, 21 nt, Human
ugggauggagcacuucuucug

SEQ ID NO: 128343 - RNA, 20 nt, Human
gacacccuucaacccuggga

SEQ ID NO: 128344 - RNA, 24 nt, Human
uucagaagaaauggcucaaaggca

SEQ ID NO: 128345 - RNA, 20 nt, Human
aacaacaacaaaacaaucug

SEQ ID NO: 128346 - RNA, 24 nt, Human
ugggcauuguaguuaaugaugguu

SEQ ID NO: 128347 - RNA, 22 nt, Human
agugugugcugggggguucggg

SEQ ID NO: 128348 - RNA, 19 nt, Human
auacauacauguaacuuca

SEQ ID NO: 128349 - RNA, 21 nt, Human
uucuucaucucaccauccugu

SEQ ID NO: 128350 - RNA, 22 nt, Human
cugccuguuaucuucaagccag

SEQ ID NO: 128351 - RNA, 21 nt, Human
ugucaaaaaucagagaggaga

SEQ ID NO: 128352 - RNA, 21 nt, Human
aguauuuuuaaauggcauacc

SEQ ID NO: 128353 - RNA, 23 nt, Human
gguucccuguucuuccuccagcu

SEQ ID NO: 128354 - RNA, 25 nt, Human
gugugcauuugcaugugcaacagua

SEQ ID NO: 128355 - RNA, 26 nt, Human
gggaaaggaagagucuuagaauuccu

SEQ ID NO: 128356 - RNA, 21 nt, Human
ccggcgcagauccucuguggu

SEQ ID NO: 128357 - RNA, 26 nt, Human
acaccuaggacccaggaaauaaaugc

SEQ ID NO: 128358 - RNA, 21 nt, Human
cccauacccuucagugcagug

SEQ ID NO: 128359 - RNA, 22 nt, Human
ccaggcugaagugcaguggugu

SEQ ID NO: 128360 - RNA, 24 nt, Human
uucauuugugucaaugggcaauga

SEQ ID NO: 128361 - RNA, 20 nt, Human
ggaugugagggaaggaaggu

SEQ ID NO: 128362 - RNA, 22 nt, Human
gcccuguggaguccagcucuac

SEQ ID NO: 128363 - RNA, 23 nt, Human
acaugcucucaaacugcagacaa

SEQ ID NO: 128364 - RNA, 20 nt, Human
gaugagggagagagagccag

SEQ ID NO: 128365 - RNA, 21 nt, Human
gagacuccugcccuguugugu

SEQ ID NO: 128366 - RNA, 22 nt, Human
ugcucaguaaggcagugcaaua

SEQ ID NO: 128367 - RNA, 22 nt, Human
cagcccaggcagcccacagugc

SEQ ID NO: 128368 - RNA, 26 nt, Human
uuuaauucuccuuuacauugccaccu

SEQ ID NO: 128369 - RNA, 19 nt, Human
auaugauucuguguuccug

SEQ ID NO: 128370 - RNA, 23 nt, Human
gcaugccguucugcaccuaccca

SEQ ID NO: 128371 - RNA, 24 nt, Human
aacuauuuauuaacuaauguaaug

SEQ ID NO: 128372 - RNA, 19 nt, Human
aaggcuguacaagggcaaa

SEQ ID NO: 128373 - RNA, 22 nt, Human
ugcuuuguucuuguugcuuuuc

SEQ ID NO: 128374 - RNA, 26 nt, Human
ggguccagagcuagcccaggcugggg

SEQ ID NO: 128375 - RNA, 23 nt, Human
ucccugcaaaacuccaggcagga

SEQ ID NO: 128376 - RNA, 18 nt, Human
agcauacuccaguuuacu

SEQ ID NO: 128377 - RNA, 22 nt, Human
gcugaugguaucaccaucucuu

SEQ ID NO: 128378 - RNA, 20 nt, Human
ggaaaaggaggcuggcacac

SEQ ID NO: 128379 - RNA, 20 nt, Human
guagagugccuaggagcccu

SEQ ID NO: 128380 - RNA, 20 nt, Human
uggaggauagcccagcucug

SEQ ID NO: 128381 - RNA, 23 nt, Human
ugagucuaguacuuaaugaucug

SEQ ID NO: 128382 - RNA, 20 nt, Human
aacuguuuguuucaugacaa

SEQ ID NO: 128383 - RNA, 27 nt, Human
cuggaaugcuucuucaaagguuaaaaa

SEQ ID NO: 128384 - RNA, 22 nt, Human
aguguuugcacuauacuuucug

SEQ ID NO: 128385 - RNA, 22 nt, Human
aaacagauggaguuacugugaa

SEQ ID NO: 128386 - RNA, 22 nt, Human
guggguggaagggcuggguguc

SEQ ID NO: 128387 - RNA, 27 nt, Human
accagccuguccaacagaggggcagcc

SEQ ID NO: 128388 - RNA, 24 nt, Human
guguggaagaagucacagcuuucu

SEQ ID NO: 128389 - RNA, 27 nt, Human
gaggaagaggcugucugugucauuaug

SEQ ID NO: 128390 - RNA, 22 nt, Human
cugaggcaggagaaucacugga

SEQ ID NO: 128391 - RNA, 20 nt, Human
uugcccagcuggguccaaca

SEQ ID NO: 128392 - RNA, 27 nt, Human
cugggcccaggcugugaguuccagguc

SEQ ID NO: 128393 - RNA, 23 nt, Human
cugccaccucgcggaucaggagc

SEQ ID NO: 128394 - RNA, 21 nt, Human
auccucuccagaucuuaacca

SEQ ID NO: 128395 - RNA, 25 nt, Human
agauggcggcaggaggcaguggcgu

SEQ ID NO: 128396 - RNA, 18 nt, Human
agccuuccaccugggauu

SEQ ID NO: 128397 - RNA, 21 nt, Human
uucacacauaaaguccuuuua

SEQ ID NO: 128398 - RNA, 25 nt, Human
acucugaagaaaucuauaguucucu

SEQ ID NO: 128399 - RNA, 21 nt, Human
auaucaucugagagguaguua

SEQ ID NO: 128400 - RNA, 23 nt, Human
acacuuuauucguuuauauugug

SEQ ID NO: 128401 - RNA, 24 nt, Human
cuucugcuuuuucaaauucuugcu

SEQ ID NO: 128402 - RNA, 22 nt, Human
gagguagcuucucucagccuag

SEQ ID NO: 128403 - RNA, 20 nt, Human
gaugaagggcuucaggcugg

SEQ ID NO: 128404 - RNA, 21 nt, Human
cauuguauauaggucuuauuu

SEQ ID NO: 128405 - RNA, 23 nt, Human
ccuuuuaaugucugcacagucug

SEQ ID NO: 128406 - RNA, 22 nt, Human
gcccaggcccggaugcagaggc

SEQ ID NO: 128407 - RNA, 19 nt, Human
gcugugaccgcaucuccug

SEQ ID NO: 128408 - RNA, 21 nt, Human
cagggaggcggcgcucugggg

SEQ ID NO: 128409 - RNA, 24 nt, Human
ggacauucccaaaaccaaaggaca

SEQ ID NO: 128410 - RNA, 24 nt, Human
gccacugccgcaggaggcgugagg

SEQ ID NO: 128411 - RNA, 27 nt, Human
gcagggauaucguacaucuauugcucu

SEQ ID NO: 128412 - RNA, 20 nt, Human
ggccagaaugcggugaucaa

SEQ ID NO: 128413 - RNA, 22 nt, Human
ucugggagccaguuccuagucc

SEQ ID NO: 128414 - RNA, 24 nt, Human
uggagcucauggagaaauggauag

SEQ ID NO: 128415 - RNA, 22 nt, Human
ggccuccagcagaucaugauga

SEQ ID NO: 128416 - RNA, 27 nt, Human
ggucuugaacuccugacgucaagugau

SEQ ID NO: 128417 - RNA, 21 nt, Human
aggcuggggaguccucaggac

SEQ ID NO: 128418 - RNA, 26 nt, Human
uggaggugaaggcagagaggagccag

SEQ ID NO: 128419 - RNA, 23 nt, Human
agacggguucagcacccaccuuu

SEQ ID NO: 128420 - RNA, 22 nt, Human
ccucuucugcugauuaucaguu

SEQ ID NO: 128421 - RNA, 22 nt, Human
aauuucucucagauuuccacag

SEQ ID NO: 128422 - RNA, 19 nt, Human
ucuaauaagagcaacagca

SEQ ID NO: 128423 - RNA, 21 nt, Human
uuuacccaggcuggagugcaa

SEQ ID NO: 128424 - RNA, 21 nt, Human
cugaauucucuuucucucuca

SEQ ID NO: 128425 - RNA, 24 nt, Human
uuucuugccugaacuccugccaua

SEQ ID NO: 128426 - RNA, 27 nt, Human
ggagaaaggguuuugcaaacugaaaga

SEQ ID NO: 128427 - RNA, 24 nt, Human
guuaccucaauucuuacuguagua

SEQ ID NO: 128428 - RNA, 19 nt, Human
gcccaggcuggaguacagu

SEQ ID NO: 128429 - RNA, 19 nt, Human
gcccagacuggagugcagu

SEQ ID NO: 128430 - RNA, 23 nt, Human
cugaguagcugggaugacaggcg

SEQ ID NO: 128431 - RNA, 22 nt, Human
uuccuugagacacggagcccag

SEQ ID NO: 128432 - RNA, 22 nt, Human
ugcccaggcuggagggcaaugg

SEQ ID NO: 128433 - RNA, 22 nt, Human
ugcccaugcuggagugcaaugg

SEQ ID NO: 128434 - RNA, 21 nt, Human
caugggcucccacugcagccu

SEQ ID NO: 128435 - RNA, 26 nt, Human
agucuugccuauagauuuugccaucg

SEQ ID NO: 128436 - RNA, 27 nt, Human
uugccuaggcuggucuggagcucuuga

SEQ ID NO: 128437 - RNA, 18 nt, Human
gagggagaagcacuguga

SEQ ID NO: 128438 - RNA, 19 nt, Human
ccagucauggacacagggc

SEQ ID NO: 128439 - RNA, 21 nt, Human
ucaguagagcugaacuuagcu

SEQ ID NO: 128440 - RNA, 27 nt, Human
ggaaaacaaaguuguugagccuugcuu

SEQ ID NO: 128441 - RNA, 26 nt, Human
ugagugagaagauaaaaacugcccau

SEQ ID NO: 128442 - RNA, 22 nt, Human
cucgaacuuucaaaauauauuu

SEQ ID NO: 128443 - RNA, 21 nt, Human
aaauaaaauauucacucucca

SEQ ID NO: 128444 - RNA, 25 nt, Human
cugcugaggcccagugcauaugcaa

SEQ ID NO: 128445 - RNA, 23 nt, Human
cccauaaacaacaggagccuuuu

SEQ ID NO: 128446 - RNA, 25 nt, Human
uggucucagaggcucugcuuccuua

SEQ ID NO: 128447 - RNA, 22 nt, Human
ucugaaaagagcccuuggcuca

SEQ ID NO: 128448 - RNA, 22 nt, Human
gggggaugucaacaacagauca

SEQ ID NO: 128449 - RNA, 25 nt, Human
ugcugagaaauugcacugaagagau

SEQ ID NO: 128450 - RNA, 20 nt, Human
cccugauuaaagugccuuca

SEQ ID NO: 128451 - RNA, 21 nt, Human
uguauaugaugcugugauugc

SEQ ID NO: 128452 - RNA, 21 nt, Human
ggccgacccuuccuuaggccu

SEQ ID NO: 128453 - RNA, 23 nt, Human
ugcacaucugggcacaguaccuu

SEQ ID NO: 128454 - RNA, 22 nt, Human
cgcuggcaggagcgcuugggga

SEQ ID NO: 128455 - RNA, 25 nt, Human
cgcugcacacagacggccuaggggu

SEQ ID NO: 128456 - RNA, 24 nt, Human
gcccaggcuggagugcaaugcacg

SEQ ID NO: 128457 - RNA, 27 nt, Human
ccagguggcagagggggagggagaggc

SEQ ID NO: 128458 - RNA, 20 nt, Human
cagaacagcacguaccagag

SEQ ID NO: 128459 - RNA, 21 nt, Human
cauuggaauauggaauuugug

SEQ ID NO: 128460 - RNA, 22 nt, Human
uguugccaaacuuuggaaaugu

SEQ ID NO: 128461 - RNA, 23 nt, Human
gggggugggguggggagccaggc

SEQ ID NO: 128462 - RNA, 22 nt, Human
uguccacacaaccacaucugcc

SEQ ID NO: 128463 - RNA, 22 nt, Human
ccgucucucggguucaagcaau

SEQ ID NO: 128464 - RNA, 20 nt, Human
cauccaggcuggagugcagu

SEQ ID NO: 128465 - RNA, 23 nt, Human
ugugugccacagucuggugccca

SEQ ID NO: 128466 - RNA, 18 nt, Human
agaaacugagcaguugaa

SEQ ID NO: 128467 - RNA, 25 nt, Human
gaucaauuucauuaccguguaccuu

SEQ ID NO: 128468 - RNA, 27 nt, Human
acucuuaugcccacgcuggagugcagu

SEQ ID NO: 128469 - RNA, 22 nt, Human
cagggaccuaccccucccaggg

SEQ ID NO: 128470 - RNA, 23 nt, Human
cagcccagggcgcacggccugag

SEQ ID NO: 128471 - RNA, 24 nt, Human
caggaaggggaaacacagcugaug

SEQ ID NO: 128472 - RNA, 24 nt, Human
agggacagaggcccaacuccagga

SEQ ID NO: 128473 - RNA, 21 nt, Human
gggccugccccuguguauuca

SEQ ID NO: 128474 - RNA, 26 nt, Human
ccuccugggcaagggcugaaggaggc

SEQ ID NO: 128475 - RNA, 23 nt, Human
uugugcccaggcuggagugcaau

SEQ ID NO: 128476 - RNA, 27 nt, Human
ccccucggcgggcgccccgccauguac

SEQ ID NO: 128477 - RNA, 27 nt, Human
ggcucacugcaaccucugccuaccgga

SEQ ID NO: 128478 - RNA, 20 nt, Human
ucacacugcgcaggucucuu

SEQ ID NO: 128479 - RNA, 21 nt, Human
ugugcuauucacaguaccaug

SEQ ID NO: 128480 - RNA, 23 nt, Human
uggcugugcuaggggggaacauu

SEQ ID NO: 128481 - RNA, 20 nt, Human
agagacauacaccuauguca

SEQ ID NO: 128482 - RNA, 21 nt, Human
gcaaucccuaauauaauguaa

SEQ ID NO: 128483 - RNA, 24 nt, Human
ucagugccuauuuuuccuggaaac

SEQ ID NO: 128484 - RNA, 19 nt, Human
ugaaaacaagagacugcuu

SEQ ID NO: 128485 - RNA, 27 nt, Human
ggacaguguuggccuuuggagucgggc

SEQ ID NO: 128486 - RNA, 26 nt, Human
cauugccuuuugccuaggcuggcguc

SEQ ID NO: 128487 - RNA, 22 nt, Human
uuaucaucuacuacaucagcac

SEQ ID NO: 128488 - RNA, 19 nt, Human
accacaccccaaugccuuc

SEQ ID NO: 128489 - RNA, 24 nt, Human
cgggcugagacguggccaggggaa

SEQ ID NO: 128490 - RNA, 26 nt, Human
agcugcuuccaucagaauuccagggu

SEQ ID NO: 128491 - RNA, 23 nt, Human
ccaucugucugucuauauuuguc

SEQ ID NO: 128492 - RNA, 23 nt, Human
aggacaguacaucucuaguagaa

SEQ ID NO: 128493 - RNA, 20 nt, Human
guacaaggacugacuuuaau

SEQ ID NO: 128494 - RNA, 18 nt, Human
aacaugcucacauacaca

SEQ ID NO: 128495 - RNA, 17 nt, Human
uucuccucugcuaugca

SEQ ID NO: 128496 - RNA, 21 nt, Human
cugcccuuagaaauucuagcc

SEQ ID NO: 128497 - RNA, 20 nt, Human
cccaucauuccuucuggccu

SEQ ID NO: 128498 - RNA, 22 nt, Human
cagucauuuuuguuucuaccuc

SEQ ID NO: 128499 - RNA, 20 nt, Human
cuucugcuucagucucccaa

SEQ ID NO: 128500 - RNA, 20 nt, Human
ggaggcggaggugggggugg

SEQ ID NO: 128501 - RNA, 26 nt, Human
aggaggugaaggucaugcgaugccug

SEQ ID NO: 128502 - RNA, 27 nt, Human
gagcccugcucccucugccacugugga

SEQ ID NO: 128503 - RNA, 23 nt, Human
uuuauccucauuuuacagcagug

SEQ ID NO: 128504 - RNA, 27 nt, Human
ccccacccuccucuuggaauuacaagc

SEQ ID NO: 128505 - RNA, 27 nt, Human
cugagacugaagggaaaucccccuuuc

SEQ ID NO: 128506 - RNA, 20 nt, Human
gguccugcugccucccuuuc

SEQ ID NO: 128507 - RNA, 22 nt, Human
acacacauauacacacaugugc

SEQ ID NO: 128508 - RNA, 26 nt, Human
caggguagggagaugacaguggugca

SEQ ID NO: 128509 - RNA, 21 nt, Human
aaagaaagagaggaaugcagg

SEQ ID NO: 128510 - RNA, 23 nt, Human
aagaaaacugauucucuaugaca

SEQ ID NO: 128511 - RNA, 23 nt, Human
gcuccuccucuuccuccuccucc

SEQ ID NO: 128512 - RNA, 21 nt, Human
gccagaacguggcucugcugg

SEQ ID NO: 128513 - RNA, 21 nt, Human
uggggaaggggguuggacgug

SEQ ID NO: 128514 - RNA, 23 nt, Human
ggcuaauuuuugguguuuuuugu

SEQ ID NO: 128515 - RNA, 30 nt, Human
agcaaguugaaagcagaguguaacaaggga

SEQ ID NO: 128516 - RNA, 22 nt, Human
uaacauccuucuuuucuauugc

SEQ ID NO: 128517 - RNA, 22 nt, Human
auccacuuucuugcucaccuca

SEQ ID NO: 128518 - RNA, 22 nt, Human
gcauuggcagcaggugcugcua

SEQ ID NO: 128519 - RNA, 26 nt, Human
aacuucagagagcugaagaaaggggg

SEQ ID NO: 128520 - RNA, 22 nt, Human
cggcccaggcggggugcgagug

SEQ ID NO: 128521 - RNA, 22 nt, Human
caauguaaaguaaaacacucuc

SEQ ID NO: 128522 - RNA, 27 nt, Human
ggagcagccugggcugccccuugacau

SEQ ID NO: 128523 - RNA, 20 nt, Human
ccagccgcccgcucccgcgg

SEQ ID NO: 128524 - RNA, 26 nt, Human
gucucaacacuuucccuuuuuuccca

SEQ ID NO: 128525 - RNA, 22 nt, Human
cacuccgcgccccggccuagaa

SEQ ID NO: 128526 - RNA, 26 nt, Human
uuagaaccagcagaagccagagggug

SEQ ID NO: 128527 - RNA, 21 nt, Human
gccuagugccacccuccuccc

SEQ ID NO: 128528 - RNA, 21 nt, Human
uggucuccagggacucaguga

SEQ ID NO: 128529 - RNA, 23 nt, Human
cuuuuuaaaaaauaacaugccua

SEQ ID NO: 128530 - RNA, 22 nt, Human
uuucuuaauuguuagcuauuua

SEQ ID NO: 128531 - RNA, 18 nt, Human
acacuccagacuaaagca

SEQ ID NO: 128532 - RNA, 21 nt, Human
accucuccucuucgucuccgc

SEQ ID NO: 128533 - RNA, 22 nt, Human
gagggauggggugggaggcacc

SEQ ID NO: 128534 - RNA, 27 nt, Human
ucaauccuuuauuuaauuuuauuucca

SEQ ID NO: 128535 - RNA, 21 nt, Human
agucccaagccucaccugccu

SEQ ID NO: 128536 - RNA, 20 nt, Human
gacgccagcccccacccucu

SEQ ID NO: 128537 - RNA, 23 nt, Human
ugaaaagagagggucagggggag

SEQ ID NO: 128538 - RNA, 22 nt, Human
ucugggguuggcaacaggacag

SEQ ID NO: 128539 - RNA, 24 nt, Human
ggguccuuauguacacaccacguu

SEQ ID NO: 128540 - RNA, 22 nt, Human
ucugcacaucaugaugacuuua

SEQ ID NO: 128541 - RNA, 24 nt, Human
ucucagcccacaucucagcccuuc

SEQ ID NO: 128542 - RNA, 21 nt, Human
uucuacucuucuuuuuacaua

SEQ ID NO: 128543 - RNA, 24 nt, Human
ggagacagagggaggaccuguugu

SEQ ID NO: 128544 - RNA, 18 nt, Human
uuccuccucucccuccca

SEQ ID NO: 128545 - RNA, 23 nt, Human
uguuacaggcucuaaagugcaau

SEQ ID NO: 128546 - RNA, 22 nt, Human
ccgaggcacgagaaucgcuuga

SEQ ID NO: 128547 - RNA, 21 nt, Human
gccgccuccacagccugggcc

SEQ ID NO: 128548 - RNA, 22 nt, Human
caugccuuuguuuccaucucga

SEQ ID NO: 128549 - RNA, 27 nt, Human
ccugcccaaaguggucuucuccagcua

SEQ ID NO: 128550 - RNA, 22 nt, Human
ucaaugcuuuauuucaggccga

SEQ ID NO: 128551 - RNA, 19 nt, Human
caaucagcuguguuaugcc

SEQ ID NO: 128552 - RNA, 26 nt, Human
gagguggggaaaggaagucuuccugu

SEQ ID NO: 128553 - RNA, 24 nt, Human
ccgcucagucuuugagcgagccca

SEQ ID NO: 128554 - RNA, 21 nt, Human
gcugaggagagaaaaggguga

SEQ ID NO: 128555 - RNA, 22 nt, Human
ugaacaacaaaauggggacuuc

SEQ ID NO: 128556 - RNA, 24 nt, Human
gcuggcgaccugcuccagucucca

SEQ ID NO: 128557 - RNA, 16 nt, Human
caaaucacaccucugg

SEQ ID NO: 128558 - RNA, 22 nt, Human
cagcacugcacugcagccuggg

SEQ ID NO: 128559 - RNA, 22 nt, Human
cgacucugugucccaggcacag

SEQ ID NO: 128560 - RNA, 24 nt, Human
cacuugaggucaggaguuugaggc

SEQ ID NO: 128561 - RNA, 27 nt, Human
ucugccacuccagcuccuggguuaggg

SEQ ID NO: 128562 - RNA, 28 nt, Human
ccaggaagcagagguugcaguaagcuga

SEQ ID NO: 128563 - RNA, 22 nt, Human
uucauuugugcuuuugcauuaa

SEQ ID NO: 128564 - RNA, 20 nt, Human
aucugcuguggcaggcugug

SEQ ID NO: 128565 - RNA, 20 nt, Human
uggcaaaguuuguuuugagg

SEQ ID NO: 128566 - RNA, 26 nt, Human
gcaaagcacuuuuccauauguguguc

SEQ ID NO: 128567 - RNA, 24 nt, Human
agugucucaacuggccaggcggug

SEQ ID NO: 128568 - RNA, 23 nt, Human
acccuaucaucaguuaggauuag

SEQ ID NO: 128569 - RNA, 20 nt, Human
uugaaauuauggcacaguga

SEQ ID NO: 128570 - RNA, 27 nt, Human
agccaucacaaauagccacauucugcu

SEQ ID NO: 128571 - RNA, 20 nt, Human
ugguuggucaaggagggaug

SEQ ID NO: 128572 - RNA, 22 nt, Human
uugcccaggcuggugugcaaug

SEQ ID NO: 128573 - RNA, 20 nt, Human
cauguucugcucuugugccc

SEQ ID NO: 128574 - RNA, 19 nt, Human
uguggcugcccaggaaaag

SEQ ID NO: 128575 - RNA, 19 nt, Human
agggcccccagacaccaca

SEQ ID NO: 128576 - RNA, 22 nt, Human
auucauagugauagagugcagu

SEQ ID NO: 128577 - RNA, 21 nt, Human
uccaucuccuggaggcagaca

SEQ ID NO: 128578 - RNA, 21 nt, Human
acagacucaaugucccccuca

SEQ ID NO: 128579 - RNA, 23 nt, Human
cccgaguuuaguaacagugcaga

SEQ ID NO: 128580 - RNA, 21 nt, Human
gcagaggggaggaggaagcac

SEQ ID NO: 128581 - RNA, 27 nt, Human
ucaguuccaggcuuuugcccaggucac

SEQ ID NO: 128582 - RNA, 22 nt, Human
cugagucaccaggaauguuaaa

SEQ ID NO: 128583 - RNA, 21 nt, Human
uugcccaggcuggagugcagu

SEQ ID NO: 128584 - RNA, 21 nt, Human
ucgcccaggcuggaguguagu

SEQ ID NO: 128585 - RNA, 22 nt, Human
aucggcggcagcugugaggggg

SEQ ID NO: 128586 - RNA, 22 nt, Human
gguuugguuuuguuuucugcuu

SEQ ID NO: 128587 - RNA, 25 nt, Human
uuguccuagaugcuggagugagauu

SEQ ID NO: 128588 - RNA, 19 nt, Human
uagaaauuuuucagaugcu

SEQ ID NO: 128589 - RNA, 23 nt, Human
uggagccacucuguuccuggcuc

SEQ ID NO: 128590 - RNA, 25 nt, Human
acacagggaaacaaacacauaccac

SEQ ID NO: 128591 - RNA, 24 nt, Human
cccggcacagccaugaucaaggcg

SEQ ID NO: 128592 - RNA, 21 nt, Human
cuggcgcgguggcucacaccu

SEQ ID NO: 128593 - RNA, 23 nt, Human
ugggagccuggagcaagguggag

SEQ ID NO: 128594 - RNA, 19 nt, Human
caggauggggcuucuucaa

SEQ ID NO: 128595 - RNA, 25 nt, Human
cagcuuuguuaccuaacagcuuggc

SEQ ID NO: 128596 - RNA, 22 nt, Human
aggcugagguaccuggaucuug

SEQ ID NO: 128597 - RNA, 22 nt, Human
auugaaccuuggcucuccuggg

SEQ ID NO: 128598 - RNA, 23 nt, Human
guaaaacaggcugcuuagauuuc

SEQ ID NO: 128599 - RNA, 21 nt, Human
gggcuucucccuuuccuugag

SEQ ID NO: 128600 - RNA, 19 nt, Human
ccccaggagaacaggcugg

SEQ ID NO: 128601 - RNA, 23 nt, Human
aucaguggcgcgaguccaggaag

SEQ ID NO: 128602 - RNA, 21 nt, Human
ccccacagggaccucagucac

SEQ ID NO: 128603 - RNA, 22 nt, Human
uguuuuuaaacaaucguuuuug

SEQ ID NO: 128604 - RNA, 26 nt, Human
cugccuggccacugagcacuggccga

SEQ ID NO: 128605 - RNA, 23 nt, Human
gcaguguccugacuguaagauca

SEQ ID NO: 128606 - RNA, 25 nt, Human
gaagggccuuagaaccugcauagaa

SEQ ID NO: 128607 - RNA, 26 nt, Human
ucaguuacacaugaucauaauuuaaa

SEQ ID NO: 128608 - RNA, 26 nt, Human
agaccagcuuugcagugacagcuuga

SEQ ID NO: 128609 - RNA, 21 nt, Human
agggaucugauuccucccagg

SEQ ID NO: 128610 - RNA, 24 nt, Human
cauuguuuuaucuuaucaguauua

SEQ ID NO: 128611 - RNA, 22 nt, Human
uaaagaaugcccuuuaugaugc

SEQ ID NO: 128612 - RNA, 21 nt, Human
gggggaugucauucuuauuca

SEQ ID NO: 128613 - RNA, 25 nt, Human
gggcuguuucugcgggcacagcugc

SEQ ID NO: 128614 - RNA, 20 nt, Human
aucaaguaacaucuguauca

SEQ ID NO: 128615 - RNA, 26 nt, Human
gagcaagcaagguuagcaacugugaa

SEQ ID NO: 128616 - RNA, 21 nt, Human
uacagugucuggccuugggaa

SEQ ID NO: 128617 - RNA, 23 nt, Human
uaaagaagaguaaaauggcuguu

SEQ ID NO: 128618 - RNA, 27 nt, Human
gcugcuacccagcuggggugggugagg

SEQ ID NO: 128619 - RNA, 21 nt, Human
uguccuuuaacaaaauuacug

SEQ ID NO: 128620 - RNA, 25 nt, Human
uucuggauccuucaggacugggguu

SEQ ID NO: 128621 - RNA, 24 nt, Human
gggacucagugacucauggauaua

SEQ ID NO: 128622 - RNA, 22 nt, Human
guugggugcuucauuuguguuc

SEQ ID NO: 128623 - RNA, 22 nt, Human
agcuuccccagcagcugggacu

SEQ ID NO: 128624 - RNA, 22 nt, Human
agccuccccaguagcugggacu

SEQ ID NO: 128625 - RNA, 24 nt, Human
ggaaggguccagagcaggagcuuc

SEQ ID NO: 128626 - RNA, 23 nt, Human
ggugcugguggguucacuuucca

SEQ ID NO: 128627 - RNA, 26 nt, Human
gcucacuguccacaugugaacuuuuu

SEQ ID NO: 128628 - RNA, 21 nt, Human
caaucagccaacuaaguuguc

SEQ ID NO: 128629 - RNA, 21 nt, Human
gugaguuagagauggaaguac

SEQ ID NO: 128630 - RNA, 21 nt, Human
aggcagugucagcagugaagg

SEQ ID NO: 128631 - RNA, 21 nt, Human
gcuauuuuacauaucccaagc

SEQ ID NO: 128632 - RNA, 22 nt, Human
cacugcaguccagccuaggcaa

SEQ ID NO: 128633 - RNA, 22 nt, Human
gggccuuuucuuucuuuuuguu

SEQ ID NO: 128634 - RNA, 22 nt, Human
guguuugcucaguugcugaccc

SEQ ID NO: 128635 - RNA, 24 nt, Human
cagaaacaccagcugcucccucac

SEQ ID NO: 128636 - RNA, 21 nt, Human
cugcaaccuccgccucccagg

SEQ ID NO: 128637 - RNA, 22 nt, Human
cgccucccgaguucaagcgauu

SEQ ID NO: 128638 - RNA, 20 nt, Human
uguuaucauuugucuuacag

SEQ ID NO: 128639 - RNA, 22 nt, Human
gacuggguggccccugaggucu

SEQ ID NO: 128640 - RNA, 22 nt, Human
gaucaaauuaauuuaaauauga

SEQ ID NO: 128641 - RNA, 21 nt, Human
cccucacucccuuuuuuguca

SEQ ID NO: 128642 - RNA, 23 nt, Human
ucauggacucaggauccuccugg

SEQ ID NO: 128643 - RNA, 21 nt, Human
ccuaaaaucuauguguuuuag

SEQ ID NO: 128644 - RNA, 22 nt, Human
gccccaacugugaucacgaucc

SEQ ID NO: 128645 - RNA, 24 nt, Human
gagggaggagugagcucccugggu

SEQ ID NO: 128646 - RNA, 24 nt, Human
cugccccguuggcacagggccaca

SEQ ID NO: 128647 - RNA, 22 nt, Human
gggagcuggcggggaacccugg

SEQ ID NO: 128648 - RNA, 26 nt, Human
cucucaucuuuuguccuccuuagcac

SEQ ID NO: 128649 - RNA, 27 nt, Human
gccuuggcuugauggaagugggccagu

SEQ ID NO: 128650 - RNA, 30 nt, Human
gguccccagacccaagagcuguggcugccu

SEQ ID NO: 128651 - RNA, 23 nt, Human
uuccagugauucuccugccucag

SEQ ID NO: 128652 - RNA, 22 nt, Human
ggguagaggcaggggaagaucu

SEQ ID NO: 128653 - RNA, 25 nt, Human
gugaguguccaggcaugccagcgga

SEQ ID NO: 128654 - RNA, 21 nt, Human
ugcucucaccagcugcugcuc

SEQ ID NO: 128655 - RNA, 25 nt, Human
uccgcuaucuuuuggguucauucca

SEQ ID NO: 128656 - RNA, 30 nt, Human
gguugaagaccuaaccagggccagaaguag

SEQ ID NO: 128657 - RNA, 22 nt, Human
ccaaguguuuuuacaucaucuc

SEQ ID NO: 128658 - RNA, 23 nt, Human
guccuuguuuccacuggcuuucc

SEQ ID NO: 128659 - RNA, 26 nt, Human
ucucuuucccuucaaaaugcuuuuca

SEQ ID NO: 128660 - RNA, 23 nt, Human
aacuccagucccaaacuaaucug

SEQ ID NO: 128661 - RNA, 22 nt, Human
auuauuacuuccaucuacuucu

SEQ ID NO: 128662 - RNA, 20 nt, Human
cgcauggacaagcccaguaa

SEQ ID NO: 128663 - RNA, 30 nt, Human
cccucuguguauuugcuuuuuuguuuuggc

SEQ ID NO: 128664 - RNA, 23 nt, Human
aucgcccaggcuggagugcagug

SEQ ID NO: 128665 - RNA, 22 nt, Human
cagcguccccuccuuggcuucc

SEQ ID NO: 128666 - RNA, 26 nt, Human
ggaccccgggccgaagaagagauuuc

SEQ ID NO: 128667 - RNA, 32 nt, Human
gagagccaccauacaagguucaucucuagaga

SEQ ID NO: 128668 - RNA, 28 nt, Human
uugguggcaagcugcaaagugccuugcu

SEQ ID NO: 128669 - RNA, 21 nt, Human
uuuugccaggcuggaugcugu

SEQ ID NO: 128670 - RNA, 22 nt, Human
gccuguaaucccagcacugugg

SEQ ID NO: 128671 - RNA, 23 nt, Human
augacuucccuuguaaacagaag

SEQ ID NO: 128672 - RNA, 23 nt, Human
cgauuuuucugucauuaguucua

SEQ ID NO: 128673 - RNA, 21 nt, Human
ccaucuuacugggcucaggcc

SEQ ID NO: 128674 - RNA, 25 nt, Human
ucauuggacuuacauggaauuugua

SEQ ID NO: 128675 - RNA, 26 nt, Human
uuacccaggauggaaacacugcaguu

SEQ ID NO: 128676 - RNA, 24 nt, Human
ccuuugagcugcugacuuucagcu

SEQ ID NO: 128677 - RNA, 21 nt, Human
ccagaauguuuccuguggaaa

SEQ ID NO: 128678 - RNA, 22 nt, Human
ugcaaccucugccuccuaaguu

SEQ ID NO: 128679 - RNA, 27 nt, Human
uucucucuuauuccacuucgguagagg

SEQ ID NO: 128680 - RNA, 20 nt, Human
guucuuucauuuccuccagc

SEQ ID NO: 128681 - RNA, 23 nt, Human
cuaccaccuguagagaagcggga

SEQ ID NO: 128682 - RNA, 22 nt, Human
caggcuggagugcaauggcaca

SEQ ID NO: 128683 - RNA, 23 nt, Human
cagcccuucccaguauacuugaa

SEQ ID NO: 128684 - RNA, 22 nt, Human
uggaagcuuuugcucgcaguuu

SEQ ID NO: 128685 - RNA, 22 nt, Human
cugcagcugcccuguaaauguu

SEQ ID NO: 128686 - RNA, 27 nt, Human
gcgggcagugaacgaguguggggaagg

SEQ ID NO: 128687 - RNA, 24 nt, Human
acuccacccucuucugggauggcu

SEQ ID NO: 128688 - RNA, 20 nt, Human
ugauuaacuagaauauuucu

SEQ ID NO: 128689 - RNA, 26 nt, Human
gcaacccagcugcuggacugaucuga

SEQ ID NO: 128690 - RNA, 26 nt, Human
uggagugacaggaaaaacagcuggca

SEQ ID NO: 128691 - RNA, 19 nt, Human
ggccucggaagccacuguc

SEQ ID NO: 128692 - RNA, 19 nt, Human
uccauuuccccucugcacc

SEQ ID NO: 128693 - RNA, 26 nt, Human
agagugagagggcaugcgcacaaggc

SEQ ID NO: 128694 - RNA, 23 nt, Human
gagccaggcugcuaggagccagg

SEQ ID NO: 128695 - RNA, 23 nt, Human
gcccgugccucugugcuguguau

SEQ ID NO: 128696 - RNA, 26 nt, Human
ccacaucuucucaguguuuuagcugu

SEQ ID NO: 128697 - RNA, 22 nt, Human
caguucugcaacauaucugaaa

SEQ ID NO: 128698 - RNA, 24 nt, Human
uuucccuuccuuaaagcucagggg

SEQ ID NO: 128699 - RNA, 19 nt, Human
gggagcccaggagcuggcg

SEQ ID NO: 128700 - RNA, 19 nt, Human
gcauuucucugcuuuuuca

SEQ ID NO: 128701 - RNA, 23 nt, Human
ggcgauggugccuggucucugag

SEQ ID NO: 128702 - RNA, 19 nt, Human
uagaaucugaaggccaggc

SEQ ID NO: 128703 - RNA, 25 nt, Human
cacagcucagccacugugaugcaga

SEQ ID NO: 128704 - RNA, 22 nt, Human
gcccaggcuggagugcagaggu

SEQ ID NO: 128705 - RNA, 27 nt, Human
agccuaguuaaauauuucaguguuguu

SEQ ID NO: 128706 - RNA, 19 nt, Human
cagucucuuaauccguuaa

SEQ ID NO: 128707 - RNA, 22 nt, Human
aggcucugcuccucccugggcc

SEQ ID NO: 128708 - RNA, 19 nt, Human
cuacagguuacaacaguug

SEQ ID NO: 128709 - RNA, 21 nt, Human
ccgggagguugaggcugcagu

SEQ ID NO: 128710 - RNA, 26 nt, Human
gguggcugaguuacuugcugcccugu

SEQ ID NO: 128711 - RNA, 27 nt, Human
auugacaaaagcaaauccacuuuuucu

SEQ ID NO: 128712 - RNA, 21 nt, Human
cugcccaaccugcucacccca

SEQ ID NO: 128713 - RNA, 24 nt, Human
uacauauguauaacuuucgcuuua

SEQ ID NO: 128714 - RNA, 24 nt, Human
cccagccucuccccgcucuggauc

SEQ ID NO: 128715 - RNA, 21 nt, Human
aacuucugggcuuaagcaauc

SEQ ID NO: 128716 - RNA, 21 nt, Human
aacuccugggcucaagcaauc

SEQ ID NO: 128717 - RNA, 23 nt, Human
ccuuucuccucguauguguguuu

SEQ ID NO: 128718 - RNA, 21 nt, Human
gagcgagaccaguuuuaaggg

SEQ ID NO: 128719 - RNA, 19 nt, Human
cccaaauacuaggcucaga

SEQ ID NO: 128720 - RNA, 24 nt, Human
uucuucauaguccucaggcuuugg

SEQ ID NO: 128721 - RNA, 22 nt, Human
gggcacuggagcugucuugucc

SEQ ID NO: 128722 - RNA, 17 nt, Human
uggaggcagagcacuga

SEQ ID NO: 128723 - RNA, 22 nt, Human
gggaggcaauuaccuucggaga

SEQ ID NO: 128724 - RNA, 26 nt, Human
aggaagggaccuguggcagcucacag

SEQ ID NO: 128725 - RNA, 22 nt, Human
ucuuuauuuucccuuguggaua

SEQ ID NO: 128726 - RNA, 25 nt, Human
cccaggacugcgggaaggcgcggga

SEQ ID NO: 128727 - RNA, 26 nt, Human
uguugucugcuacccucauccugguc

SEQ ID NO: 128728 - RNA, 22 nt, Human
gcuguagugccuucugcgccag

SEQ ID NO: 128729 - RNA, 27 nt, Human
auaaagugucuauaauaaaacuaaacu

SEQ ID NO: 128730 - RNA, 18 nt, Human
cccugcucuguaacccug

SEQ ID NO: 128731 - RNA, 22 nt, Human
ggguccccucuguuggggguuu

SEQ ID NO: 128732 - RNA, 21 nt, Human
acucacugcggccucaaccuu

SEQ ID NO: 128733 - RNA, 24 nt, Human
uaaagaaaaucucugugaaacccc

SEQ ID NO: 128734 - RNA, 20 nt, Human
caugcaucugcuauuguguu

SEQ ID NO: 128735 - RNA, 24 nt, Human
gcaaggaacugucuuucugguuca

SEQ ID NO: 128736 - RNA, 26 nt, Human
ccucaagcuccuuaagugauugccgu

SEQ ID NO: 128737 - RNA, 21 nt, Human
ucgaacuuuuguucucaguau

SEQ ID NO: 128738 - RNA, 25 nt, Human
uacaggcaugggccaccacgcccag

SEQ ID NO: 128739 - RNA, 21 nt, Human
guguccucuggcugaguggcc

SEQ ID NO: 128740 - RNA, 27 nt, Human
aagcaggacugcgacuugauacuugga

SEQ ID NO: 128741 - RNA, 27 nt, Human
cuauucccagcugauucuuuuucccuc

SEQ ID NO: 128742 - RNA, 25 nt, Human
ggaggaagggcacagcaggagcggu

SEQ ID NO: 128743 - RNA, 26 nt, Human
uauucaaaugagagucacgcuuuuaa

SEQ ID NO: 128744 - RNA, 24 nt, Human
gcugccucugggcgcccgccucua

SEQ ID NO: 128745 - RNA, 19 nt, Human
ccuuaaccagcuucucagc

SEQ ID NO: 128746 - RNA, 24 nt, Human
guauagaucuggaggaaagaaagc

SEQ ID NO: 128747 - RNA, 22 nt, Human
ccauuguacuccagcuugggca

SEQ ID NO: 128748 - RNA, 27 nt, Human
cccuuuaggaagccuccgcucucuuuu

SEQ ID NO: 128749 - RNA, 21 nt, Human
ucucauugugugacucagugc

SEQ ID NO: 128750 - RNA, 27 nt, Human
guugcaaaugcucuuuaucccuucagc

SEQ ID NO: 128751 - RNA, 21 nt, Human
gugugcuuuuauucacuucac

SEQ ID NO: 128752 - RNA, 23 nt, Human
aucacuuccacugcaccccgucu

SEQ ID NO: 128753 - RNA, 20 nt, Human
aggcccaggcuccagaggaa

SEQ ID NO: 128754 - RNA, 22 nt, Human
ucccuccgggggcacccgcucc

SEQ ID NO: 128755 - RNA, 24 nt, Human
gcacagccugggcagcucagccug

SEQ ID NO: 128756 - RNA, 24 nt, Human
auuauuuuaaagauaugauuuauc

SEQ ID NO: 128757 - RNA, 27 nt, Human
gaguagcugggacuacaggcacgcacc

SEQ ID NO: 128758 - RNA, 21 nt, Human
uggacuccaagcuguaacuuc

SEQ ID NO: 128759 - RNA, 26 nt, Human
uccucauucuuuguaccugaggaaca

SEQ ID NO: 128760 - RNA, 22 nt, Human
cugcacccuccgccucucgggu

SEQ ID NO: 128761 - RNA, 20 nt, Human
cucacagcacauuuguuaau

SEQ ID NO: 128762 - RNA, 23 nt, Human
gccuguauugcagucuucauaca

SEQ ID NO: 128763 - RNA, 22 nt, Human
caggcuggagugcaguggcgca

SEQ ID NO: 128764 - RNA, 25 nt, Human
ccccucacugguccacuggcuugag

SEQ ID NO: 128765 - RNA, 26 nt, Human
guugucugcauuaaccuguucauaca

SEQ ID NO: 128766 - RNA, 26 nt, Human
ggagaggcccuuugccaggagcacag

SEQ ID NO: 128767 - RNA, 21 nt, Human
uucaguuuuguuucuuugcgu

SEQ ID NO: 128768 - RNA, 18 nt, Human
agcaucacucuuccucac

SEQ ID NO: 128769 - RNA, 23 nt, Human
ccuguucugguggggagacgcca

SEQ ID NO: 128770 - RNA, 22 nt, Human
uguaauugucuaacacuccuuu

SEQ ID NO: 128771 - RNA, 26 nt, Human
gugcugccucacauugggccucagca

SEQ ID NO: 128772 - RNA, 22 nt, Human
uugugggccugggcuccuggac

SEQ ID NO: 128773 - RNA, 20 nt, Human
ucucucugugucugugccaa

SEQ ID NO: 128774 - RNA, 20 nt, Human
ccgccgccucuccuugcugc

SEQ ID NO: 128775 - RNA, 21 nt, Human
gccgugucccuguccaggccu

SEQ ID NO: 128776 - RNA, 21 nt, Human
ugguugcaaaaccuugaucug

SEQ ID NO: 128777 - RNA, 23 nt, Human
ccagaagccagauggucccggga

SEQ ID NO: 128778 - RNA, 24 nt, Human
cuguugcccaggcuggagugcagu

SEQ ID NO: 128779 - RNA, 24 nt, Human
cugucgccaggcuggaguguagug

SEQ ID NO: 128780 - RNA, 28 nt, Human
cugugacacacugggcucugcccucauu

SEQ ID NO: 128781 - RNA, 27 nt, Human
ucaagagcuugugaugaaaucuauagg

SEQ ID NO: 128782 - RNA, 22 nt, Human
ggacauaaguuuuucugcuuuc

SEQ ID NO: 128783 - RNA, 25 nt, Human
acuccugauguuuuuucuacaaaag

SEQ ID NO: 128784 - RNA, 25 nt, Human
ggaccugccuucuuccuuuuuccuu

SEQ ID NO: 128785 - RNA, 26 nt, Human
cugccucucugggugggugaggggcg

SEQ ID NO: 128786 - RNA, 26 nt, Human
ccugcugcaguucgccguacuuccau

SEQ ID NO: 128787 - RNA, 22 nt, Human
ccacugcucuccagccugggag

SEQ ID NO: 128788 - RNA, 25 nt, Human
cgccuagggcuggagaauagcgcug

SEQ ID NO: 128789 - RNA, 22 nt, Human
cacuacacuccagccugagcaa

SEQ ID NO: 128790 - RNA, 23 nt, Human
uaccccgaugguuaccuagacca

SEQ ID NO: 128791 - RNA, 18 nt, Human
cuccccauggcuuuagcu

SEQ ID NO: 128792 - RNA, 18 nt, Human
gcauaccgcugacuuuug

SEQ ID NO: 128793 - RNA, 22 nt, Human
aggugaggagaaagagcgcuag

SEQ ID NO: 128794 - RNA, 27 nt, Human
uggccaacauggcaaaacccugucuac

SEQ ID NO: 128795 - RNA, 22 nt, Human
ucugggcuuagggaaggagaga

SEQ ID NO: 128796 - RNA, 22 nt, Human
ugucaaaauuauacaucaugca

SEQ ID NO: 128797 - RNA, 26 nt, Human
cuuuugcaccugcucucuuguaauga

SEQ ID NO: 128798 - RNA, 26 nt, Human
caugcaaaucaaauauuacugaucaa

SEQ ID NO: 128799 - RNA, 19 nt, Human
ugguggccacauaagccau

SEQ ID NO: 128800 - RNA, 23 nt, Human
ucucauggagaagcagaaauaca

SEQ ID NO: 128801 - RNA, 21 nt, Human
agcucacugcaaaucuaacuu

SEQ ID NO: 128802 - RNA, 25 nt, Human
caggcaauuccuaccucuucaccug

SEQ ID NO: 128803 - RNA, 22 nt, Human
uaccauggugaccagcuguuac

SEQ ID NO: 128804 - RNA, 27 nt, Human
uggguuaucccuguaauuccagggcuu

SEQ ID NO: 128805 - RNA, 25 nt, Human
cuguccuuguggggcuggagagaug

SEQ ID NO: 128806 - RNA, 23 nt, Human
gggcuaaggaacaaaucucuccu

SEQ ID NO: 128807 - RNA, 29 nt, Human
ucuggccuugagcuucuaaaucucuguau

SEQ ID NO: 128808 - RNA, 27 nt, Human
ccggacauugguuuuuaaauuuuuugu

SEQ ID NO: 128809 - RNA, 21 nt, Human
ccuccaccuccuggguucagg

SEQ ID NO: 128810 - RNA, 20 nt, Human
cagggagccgagaucacgcc

SEQ ID NO: 128811 - RNA, 20 nt, Human
uucuccucuuccaagaugcu

SEQ ID NO: 128812 - RNA, 21 nt, Human
uggggaggggacuagaugggc

SEQ ID NO: 128813 - RNA, 22 nt, Human
uacuuucuguuaucaagcuacc

SEQ ID NO: 128814 - RNA, 18 nt, Human
ccuccaucagacucuccc

SEQ ID NO: 128815 - RNA, 22 nt, Human
cacacuccuaccugcugcccug

SEQ ID NO: 128816 - RNA, 24 nt, Human
uaaagccaagaacacccuuucuuu

SEQ ID NO: 128817 - RNA, 24 nt, Human
cugccuggcucagcugcacgcugc

SEQ ID NO: 128818 - RNA, 22 nt, Human
gaguccugggugugaggaacac

SEQ ID NO: 128819 - RNA, 27 nt, Human
ugagggccagccaugccuccccuccca

SEQ ID NO: 128820 - RNA, 31 nt, Human
ugggaaggaacccccucaccaccugcccggc

SEQ ID NO: 128821 - RNA, 20 nt, Human
aagggcggccuuucccacug

SEQ ID NO: 128822 - RNA, 25 nt, Human
agcauuuuggaaugagucuccuuua

SEQ ID NO: 128823 - RNA, 27 nt, Human
gcugccucugagccaauccugggaccu

SEQ ID NO: 128824 - RNA, 21 nt, Human
agcugccagggugcuugggga

SEQ ID NO: 128825 - RNA, 25 nt, Human
gugggcggugaaacuuuuccagaug

SEQ ID NO: 128826 - RNA, 26 nt, Human
gaaaauguauauuuugaugagcuuag

SEQ ID NO: 128827 - RNA, 20 nt, Human
cuccaccccuccuguguguc

SEQ ID NO: 128828 - RNA, 22 nt, Human
caggcuggagugcaacgguacg

SEQ ID NO: 128829 - RNA, 19 nt, Human
gcaacauuccacagcugcc

SEQ ID NO: 128830 - RNA, 23 nt, Human
gccucagaccagcuauggggaga

SEQ ID NO: 128831 - RNA, 18 nt, Human
ggugucugagcuggguga

SEQ ID NO: 128832 - RNA, 20 nt, Human
gucugaaaauaccuuggucu

SEQ ID NO: 128833 - RNA, 22 nt, Human
ugguggagcugggccaggcagg

SEQ ID NO: 128834 - RNA, 25 nt, Human
cuccauuucauuggacuaaauaaca

SEQ ID NO: 128835 - RNA, 23 nt, Human
cugguagaugugcucauucuccc

SEQ ID NO: 128836 - RNA, 21 nt, Human
guaugcccugcucccuuugcu

SEQ ID NO: 128837 - RNA, 21 nt, Human
aucggggucaggcaaaggagg

SEQ ID NO: 128838 - RNA, 26 nt, Human
cugggacggaacccggguuccucucg

SEQ ID NO: 128839 - RNA, 22 nt, Human
accuauaauucccagcacuuug

SEQ ID NO: 128840 - RNA, 27 nt, Human
ccagcagaaaacaugguuaaaauacuu

SEQ ID NO: 128841 - RNA, 26 nt, Human
uaucguuuaacuuugcaccuagauac

SEQ ID NO: 128842 - RNA, 21 nt, Human
uucccucucaaaaccagaaca

SEQ ID NO: 128843 - RNA, 23 nt, Human
ucucauucuguugcccaggcugg

SEQ ID NO: 128844 - RNA, 18 nt, Human
ucugcucccugccuuugc

SEQ ID NO: 128845 - RNA, 20 nt, Human
uuuagcuggcaggccagguu

SEQ ID NO: 128846 - RNA, 22 nt, Human
uaggcuggagugcaguggcgug

SEQ ID NO: 128847 - RNA, 26 nt, Human
acuacccuuguuuuauguuuucagua

SEQ ID NO: 128848 - RNA, 23 nt, Human
uaccucuucgccuuucugugguu

SEQ ID NO: 128849 - RNA, 25 nt, Human
cugaggcacaggggagucugcucgg

SEQ ID NO: 128850 - RNA, 24 nt, Human
caggcagcagacacaugccagggc

SEQ ID NO: 128851 - RNA, 26 nt, Human
gacacgugucuucuaguucugccuuu

SEQ ID NO: 128852 - RNA, 27 nt, Human
gcuggcaugggcuggacaguugcuuga

SEQ ID NO: 128853 - RNA, 21 nt, Human
caguguuuuuauuuuguuguu

SEQ ID NO: 128854 - RNA, 23 nt, Human
uaacugcauuuuagaccauuuau

SEQ ID NO: 128855 - RNA, 22 nt, Human
gccuguaaugccagcgcuuugg

SEQ ID NO: 128856 - RNA, 22 nt, Human
ggauacuuugcuuauucguuua

SEQ ID NO: 128857 - RNA, 22 nt, Human
gcacgugucuguaaucccagcu

SEQ ID NO: 128858 - RNA, 24 nt, Human
gcuccuggaguccaauggcugcuu

SEQ ID NO: 128859 - RNA, 22 nt, Human
ccagcccugcucacgccaugcc

SEQ ID NO: 128860 - RNA, 23 nt, Human
agaaggggggcccugcacaagga

SEQ ID NO: 128861 - RNA, 25 nt, Human
ccucauucuuacuauccaaaagcca

SEQ ID NO: 128862 - RNA, 27 nt, Human
uccaauacucguuuugccucuauuuuu

SEQ ID NO: 128863 - RNA, 27 nt, Human
acaugguaccugcuccagugccgcgug

SEQ ID NO: 128864 - RNA, 26 nt, Human
gaaagaaaacucacgaagcagaggcu

SEQ ID NO: 128865 - RNA, 21 nt, Human
ccaccugccagacccguggcu

SEQ ID NO: 128866 - RNA, 25 nt, Human
gugccuucucucucccuuuucaggg

SEQ ID NO: 128867 - RNA, 22 nt, Human
caggaggcagagguugcaauga

SEQ ID NO: 128868 - RNA, 27 nt, Human
ucccaaagucacggaaccgcagucuag

SEQ ID NO: 128869 - RNA, 18 nt, Human
cccugucgucgcacuuug

SEQ ID NO: 128870 - RNA, 22 nt, Human
gucauugcugugaaugggcugg

SEQ ID NO: 128871 - RNA, 27 nt, Human
augcuggugguuaaggccagggccucu

SEQ ID NO: 128872 - RNA, 24 nt, Human
gaggaagaagaggagcugaaggua

SEQ ID NO: 128873 - RNA, 23 nt, Human
ccaaguagcugggacuauuuugc

SEQ ID NO: 128874 - RNA, 23 nt, Human
agggagcugucagccagggaaaa

SEQ ID NO: 128875 - RNA, 21 nt, Human
caaggcggaggucgcgguaag

SEQ ID NO: 128876 - RNA, 22 nt, Human
ugaaaucccaggaaucucuuua

SEQ ID NO: 128877 - RNA, 28 nt, Human
cuccuucaugauuccugaccccucccau

SEQ ID NO: 128878 - RNA, 21 nt, Human
gaacuccuggccuaggugauc

SEQ ID NO: 128879 - RNA, 20 nt, Human
cugcuuguguucccuuuuga

SEQ ID NO: 128880 - RNA, 22 nt, Human
cgugcgucugugugugccugug

SEQ ID NO: 128881 - RNA, 19 nt, Human
ccaagaacugggauuaaug

SEQ ID NO: 128882 - RNA, 23 nt, Human
agccaagccuccugugguccuga

SEQ ID NO: 128883 - RNA, 31 nt, Human
ggaagcccuucugccuuuugcugguguuucu

SEQ ID NO: 128884 - RNA, 18 nt, Human
ccuggcuucuuucucuug

SEQ ID NO: 128885 - RNA, 27 nt, Human
ccagcugaccugcccuguccucuccag

SEQ ID NO: 128886 - RNA, 22 nt, Human
gauuuccacaugaaagcacuuu

SEQ ID NO: 128887 - RNA, 20 nt, Human
gaucaagaucagcuucacuc

SEQ ID NO: 128888 - RNA, 21 nt, Human
ccgcuuggcccugccuucugc

SEQ ID NO: 128889 - RNA, 27 nt, Human
uccugaaggaccucuccagaauccgga

SEQ ID NO: 128890 - RNA, 20 nt, Human
aaccuccagccucccugucu

SEQ ID NO: 128891 - RNA, 24 nt, Human
ucauuagggccccaaagcaccaga

SEQ ID NO: 128892 - RNA, 27 nt, Human
ggauuauggcuaacaagaauaaauaca

SEQ ID NO: 128893 - RNA, 21 nt, Human
gucaucugauuggacaggcau

SEQ ID NO: 128894 - RNA, 18 nt, Human
agaggcaccguguaaaga

SEQ ID NO: 128895 - RNA, 19 nt, Human
ggccacacccucccucccu

SEQ ID NO: 128896 - RNA, 20 nt, Human
caaugaaugaaggaaauauc

SEQ ID NO: 128897 - RNA, 20 nt, Human
ucauuuucuccagggagggu

SEQ ID NO: 128898 - RNA, 23 nt, Human
uaaugaguucugauucacccacg

SEQ ID NO: 128899 - RNA, 21 nt, Human
cccacccccaugcagccucuu

SEQ ID NO: 128900 - RNA, 21 nt, Human
auugcugaaccuuacugcaaa

SEQ ID NO: 128901 - RNA, 20 nt, Human
gcaucuggggagguacugaa

SEQ ID NO: 128902 - RNA, 24 nt, Human
cuccacccucagcucuuccuugcc

SEQ ID NO: 128903 - RNA, 23 nt, Human
acuuagcuuccucagucucucca

SEQ ID NO: 128904 - RNA, 26 nt, Human
cuucuggucuggcggcugugcaucag

SEQ ID NO: 128905 - RNA, 24 nt, Human
ucugguguuaacucuuucucucca

SEQ ID NO: 128906 - RNA, 22 nt, Human
cccuccucccucagacucagag

SEQ ID NO: 128907 - RNA, 22 nt, Human
ggauuuacaggguggggggaca

SEQ ID NO: 128908 - RNA, 23 nt, Human
ccgggagguccaccugcguugug

SEQ ID NO: 128909 - RNA, 18 nt, Human
ucugggcauuaagucagu

SEQ ID NO: 128910 - RNA, 26 nt, Human
gucaucucuuaugcuucacuuuuugg

SEQ ID NO: 128911 - RNA, 27 nt, Human
cccugcaggaggaccccggccucucga

SEQ ID NO: 128912 - RNA, 22 nt, Human
cuauuuuugcaguccaacauca

SEQ ID NO: 128913 - RNA, 21 nt, Human
cugucugaaccacgcgggggc

SEQ ID NO: 128914 - RNA, 23 nt, Human
caucagagaguguacaucauguu

SEQ ID NO: 128915 - RNA, 26 nt, Human
gccugacagaacucaaagacacgucu

SEQ ID NO: 128916 - RNA, 25 nt, Human
ggcuuucugagguuuagcugggugg

SEQ ID NO: 128917 - RNA, 22 nt, Human
agaucaguucuaaccugcucug

SEQ ID NO: 128918 - RNA, 24 nt, Human
uucucuggauuuguucucagugcc

SEQ ID NO: 128919 - RNA, 27 nt, Human
ucauagaacauuuuaauagauuuuuca

SEQ ID NO: 128920 - RNA, 17 nt, Human
cuucuccuuaccugcac

SEQ ID NO: 128921 - RNA, 20 nt, Human
cugagucccagcuaugggga

SEQ ID NO: 128922 - RNA, 22 nt, Human
ccaaagcgauaggauuacaggc

SEQ ID NO: 128923 - RNA, 21 nt, Human
cuguggacucaaggaguccag

SEQ ID NO: 128924 - RNA, 24 nt, Human
accaaaacuuauccagguguggcg

SEQ ID NO: 128925 - RNA, 27 nt, Human
ugccugcuggggauuacucgaucaaaa

SEQ ID NO: 128926 - RNA, 26 nt, Human
agggagaccuguugguuauugugcac

SEQ ID NO: 128927 - RNA, 21 nt, Human
uucuggguuuuguuggcuuuu

SEQ ID NO: 128928 - RNA, 24 nt, Human
uggcggggagguggcauucuugaa

SEQ ID NO: 128929 - RNA, 25 nt, Human
cgugcccuauucacacucugggaag

SEQ ID NO: 128930 - RNA, 23 nt, Human
agaauugaauuuacucuucagua

SEQ ID NO: 128931 - RNA, 25 nt, Human
cccuuucucccuuggcuguucaccc

SEQ ID NO: 128932 - RNA, 23 nt, Human
cuggaccugggaacgacuggacu

SEQ ID NO: 128933 - RNA, 27 nt, Human
ucugcucccaugcucauaccucuucuu

SEQ ID NO: 128934 - RNA, 25 nt, Human
uuuaggauaauugccuacagaggga

SEQ ID NO: 128935 - RNA, 24 nt, Human
acugcugauauuuuuucuaauuuc

SEQ ID NO: 128936 - RNA, 27 nt, Human
uuuaaaaugugaggcaauaagaauuac

SEQ ID NO: 128937 - RNA, 22 nt, Human
cagacaacauccugccccuugu

SEQ ID NO: 128938 - RNA, 26 nt, Human
gcccuccccaccaugccuccuuccca

SEQ ID NO: 128939 - RNA, 21 nt, Human
ccucuagcccucagcuuccca

SEQ ID NO: 128940 - RNA, 26 nt, Human
guuagaaggaguugaaauuuucuaaa

SEQ ID NO: 128941 - RNA, 23 nt, Human
uguccuguaaacacucagcuguu

SEQ ID NO: 128942 - RNA, 28 nt, Human
agaaggaucaagcaggcauuuggagcac

SEQ ID NO: 128943 - RNA, 27 nt, Human
cuugcagacagggcagggagcggucaa

SEQ ID NO: 128944 - RNA, 25 nt, Human
aggaaacugucucgcauaggagccu

SEQ ID NO: 128945 - RNA, 24 nt, Human
cuaaugaaugugcaaccuaauugu

SEQ ID NO: 128946 - RNA, 19 nt, Human
aauguucuuggccucugcu

SEQ ID NO: 128947 - RNA, 25 nt, Human
ucuauucauaagucuuugguacaag

SEQ ID NO: 128948 - RNA, 23 nt, Human
caaaacuggagaugcaucgggaa

SEQ ID NO: 128949 - RNA, 22 nt, Human
ggaugagagagcacagcuguga

SEQ ID NO: 128950 - RNA, 19 nt, Human
uagcuuaaacuacuacuca

SEQ ID NO: 128951 - RNA, 20 nt, Human
ucuaugacaguguacauaua

SEQ ID NO: 128952 - RNA, 22 nt, Human
cccauucucuagacaaaaucaa

SEQ ID NO: 128953 - RNA, 25 nt, Human
cuugcuguccucccuucccugcagc

SEQ ID NO: 128954 - RNA, 27 nt, Human
ucuccauccucacaccuucugccuuug

SEQ ID NO: 128955 - RNA, 27 nt, Human
cugcccuuuuaaauggcaugacaaggu

SEQ ID NO: 128956 - RNA, 19 nt, Human
ccuggauaugaaaggccau

SEQ ID NO: 128957 - RNA, 23 nt, Human
cacauacauucuuggaacuuccc

SEQ ID NO: 128958 - RNA, 16 nt, Human
gcaugaucucugugag

SEQ ID NO: 128959 - RNA, 24 nt, Human
gccuauggcgcuuugucauggauu

SEQ ID NO: 128960 - RNA, 25 nt, Human
uuugagacuuguuucggugugucug

SEQ ID NO: 128961 - RNA, 22 nt, Human
ccugcagccaccagacuuggcc

SEQ ID NO: 128962 - RNA, 22 nt, Human
ccaaagugcugauauuacaggc

SEQ ID NO: 128963 - RNA, 24 nt, Human
ccuuggcugcugcccgcucucugc

SEQ ID NO: 128964 - RNA, 25 nt, Human
ggguugugauacuuugcacacacau

SEQ ID NO: 128965 - RNA, 21 nt, Human
uugaauugaaagcucucagga

SEQ ID NO: 128966 - RNA, 27 nt, Human
gggagagaaugagcuggaggagggggc

SEQ ID NO: 128967 - RNA, 20 nt, Human
ugggugaggugggggucugg

SEQ ID NO: 128968 - RNA, 25 nt, Human
cucuccuccacuguugaggcuggcu

SEQ ID NO: 128969 - RNA, 23 nt, Human
ggcccaauggaaucagcuacagc

SEQ ID NO: 128970 - RNA, 21 nt, Human
ugugccucaaaccccaaggag

SEQ ID NO: 128971 - RNA, 25 nt, Human
ucaagccccucacuuuacagaugag

SEQ ID NO: 128972 - RNA, 19 nt, Human
uggucuggaaguccuggcc

SEQ ID NO: 128973 - RNA, 27 nt, Human
auagagugauuugaaauacuauauggc

SEQ ID NO: 128974 - RNA, 21 nt, Human
cccugcuccgaggggcucaug

SEQ ID NO: 128975 - RNA, 26 nt, Human
aacuacauuguaaccuguuugucuuu

SEQ ID NO: 128976 - RNA, 21 nt, Human
cccaagaaacauaaacauaua

SEQ ID NO: 128977 - RNA, 23 nt, Human
cguccuucaccuggucucuggcc

SEQ ID NO: 128978 - RNA, 24 nt, Human
ccaagagugucaguuguacccgag

SEQ ID NO: 128979 - RNA, 21 nt, Human
gcaggaggacugcagacucag

SEQ ID NO: 128980 - RNA, 24 nt, Human
cagggcucugcaggccacugugag

SEQ ID NO: 128981 - RNA, 21 nt, Human
gcaggaaauaacccacaaaag

SEQ ID NO: 128982 - RNA, 19 nt, Human
ggcugcuggagugcagugg

SEQ ID NO: 128983 - RNA, 22 nt, Human
cccuacuuccucugcaaaaaga

SEQ ID NO: 128984 - RNA, 22 nt, Human
cgguggccagagaugccagcag

SEQ ID NO: 128985 - RNA, 22 nt, Human
auaaaucgugaagcacaggguu

SEQ ID NO: 128986 - RNA, 20 nt, Human
gcagcugccuguggggaaga

SEQ ID NO: 128987 - RNA, 25 nt, Human
gucuggguucugguguccacucacc

SEQ ID NO: 128988 - RNA, 23 nt, Human
cagggcuuuccuuucaagucuuu

SEQ ID NO: 128989 - RNA, 27 nt, Human
aaugucaguagaagacuugacagcuug

SEQ ID NO: 128990 - RNA, 21 nt, Human
ccagugucccauccucucaca

SEQ ID NO: 128991 - RNA, 22 nt, Human
cugcuggggaggcuggaagcau

SEQ ID NO: 128992 - RNA, 14 nt, Human
auucccuuauucca

SEQ ID NO: 128993 - RNA, 23 nt, Human
gauucucuucccacccucaccau

SEQ ID NO: 128994 - RNA, 25 nt, Human
cagguucucaggggacagggagagc

SEQ ID NO: 128995 - RNA, 24 nt, Human
caaaaccaaugcugaugaccuuau

SEQ ID NO: 128996 - RNA, 23 nt, Human
acauaugucuuuucaaaaagccu

SEQ ID NO: 128997 - RNA, 22 nt, Human
augcagugccuuuccccauuca

SEQ ID NO: 128998 - RNA, 26 nt, Human
gaggagggucagggcuggccuuccuc

SEQ ID NO: 128999 - RNA, 25 nt, Human
ccagcuucuggagacccccugccgg

SEQ ID NO: 129000 - RNA, 20 nt, Human
gggcuggacuggaggugggc

SEQ ID NO: 129001 - RNA, 21 nt, Human
cuucauuucauaucugacugc

SEQ ID NO: 129002 - RNA, 25 nt, Human
ggucauuaccacaggccaggggcug

SEQ ID NO: 129003 - RNA, 22 nt, Human
ugugugcagaguauacaagugu

SEQ ID NO: 129004 - RNA, 24 nt, Human
ggcuuuggagcugucccaccugca

SEQ ID NO: 129005 - RNA, 22 nt, Human
gucuuaaaauauuaguggcuua

SEQ ID NO: 129006 - RNA, 23 nt, Human
uagcaaacagcaccuagaccugg

SEQ ID NO: 129007 - RNA, 21 nt, Human
uucucauucccauguggaaca

SEQ ID NO: 129008 - RNA, 16 nt, Human
acuagaaaaugccucu

SEQ ID NO: 129009 - RNA, 24 nt, Human
ucaaugacaccuuccugguaacau

SEQ ID NO: 129010 - RNA, 25 nt, Human
gcugcugcuguggccccagcagguu

SEQ ID NO: 129011 - RNA, 26 nt, Human
ucuugaauuccugaccucagugaucc

SEQ ID NO: 129012 - RNA, 21 nt, Human
uccaucaucgugcacucguca

SEQ ID NO: 129013 - RNA, 25 nt, Human
ucauauauuuaacuuugcaaaaaga

SEQ ID NO: 129014 - RNA, 23 nt, Human
ugucuucucuaacaccuugugac

SEQ ID NO: 129015 - RNA, 32 nt, Human
cagccuccggcggggacccagggagugguuug

SEQ ID NO: 129016 - RNA, 20 nt, Human
agagacaguguuuugccaug

SEQ ID NO: 129017 - RNA, 23 nt, Human
gucuugggcaugauugcaaugga

SEQ ID NO: 129018 - RNA, 26 nt, Human
cucucuucccuucuuucaggaauacu

SEQ ID NO: 129019 - RNA, 25 nt, Human
acccccaccucuuuccagaacugcu

SEQ ID NO: 129020 - RNA, 28 nt, Human
uccccugucuuucccucuucugcucuca

SEQ ID NO: 129021 - RNA, 25 nt, Human
gggauuacaggugugugccaucaug

SEQ ID NO: 129022 - RNA, 22 nt, Human
ggaacaaugcuuuuguuuuuua

SEQ ID NO: 129023 - RNA, 21 nt, Human
acauguuugaagaacugugua

SEQ ID NO: 129024 - RNA, 22 nt, Human
ugggcagcagaagaucaugugc

SEQ ID NO: 129025 - RNA, 19 nt, Human
ggagggugggcgcccaggc

SEQ ID NO: 129026 - RNA, 22 nt, Human
gaaccugggaguuagagguugc

SEQ ID NO: 129027 - RNA, 32 nt, Human
ucucuggucuggggaucaccucaggcgcuguc

SEQ ID NO: 129028 - RNA, 24 nt, Human
uacgcccaacccuuccccacugca

SEQ ID NO: 129029 - RNA, 30 nt, Human
uuguccuaccaccccuugcucuuugagggc

SEQ ID NO: 129030 - RNA, 20 nt, Human
auaaguuauacauguaugca

SEQ ID NO: 129031 - RNA, 22 nt, Human
acggaagggagaauaugacaga

SEQ ID NO: 129032 - RNA, 25 nt, Human
aaagggaaaaacuucugacaauaug

SEQ ID NO: 129033 - RNA, 25 nt, Human
gacuucccuugacuggguuguguuu

SEQ ID NO: 129034 - RNA, 25 nt, Human
cuugugugcauuucugucucucucu

SEQ ID NO: 129035 - RNA, 26 nt, Human
uccaauaaaaugccucaaccacggaa

SEQ ID NO: 129036 - RNA, 16 nt, Human
uuucccuuauuuuccu

SEQ ID NO: 129037 - RNA, 20 nt, Human
gagcuuacuuacuuggacgc

SEQ ID NO: 129038 - RNA, 21 nt, Human
aggaggcgaagauugcaguga

SEQ ID NO: 129039 - RNA, 21 nt, Human
gggaggcggagauugcaguga

SEQ ID NO: 129040 - RNA, 21 nt, Human
ggggggcggagguugcaguga

SEQ ID NO: 129041 - RNA, 23 nt, Human
cuguauuauaauaagcaaaaaga

SEQ ID NO: 129042 - RNA, 19 nt, Human
uggcugcaccuggcaugac

SEQ ID NO: 129043 - RNA, 22 nt, Human
cuuggccucccaaagugcugag

SEQ ID NO: 129044 - RNA, 22 nt, Human
cccuugcuuuuucucuggacca

SEQ ID NO: 129045 - RNA, 22 nt, Human
acccaggcuggagugcaauggg

SEQ ID NO: 129046 - RNA, 27 nt, Human
uccagcaggacuccaggaugguucagc

SEQ ID NO: 129047 - RNA, 22 nt, Human
acuaccccaggaugcaugcagg

SEQ ID NO: 129048 - RNA, 22 nt, Human
ugucacccaaguuggagugcag

SEQ ID NO: 129049 - RNA, 18 nt, Human
guguguguccuaacacac

SEQ ID NO: 129050 - RNA, 21 nt, Human
ccuucucccuccucugucuca

SEQ ID NO: 129051 - RNA, 26 nt, Human
uagaagcuauuuaaugauuaaaguca

SEQ ID NO: 129052 - RNA, 24 nt, Human
gguuucccuccuuccuuuccacug

SEQ ID NO: 129053 - RNA, 24 nt, Human
ccaggcuuuugagcuguuuacuua

SEQ ID NO: 129054 - RNA, 19 nt, Human
acuaaugcuuacaacuuuc

SEQ ID NO: 129055 - RNA, 22 nt, Human
cgccuguaauccuagcacuuuu

SEQ ID NO: 129056 - RNA, 27 nt, Human
ucacucuugucaccgaggcuggagugc

SEQ ID NO: 129057 - RNA, 22 nt, Human
aggcugaggcaggcagaucaug

SEQ ID NO: 129058 - RNA, 25 nt, Human
cuugccaguuuaauuccagccuuac

SEQ ID NO: 129059 - RNA, 26 nt, Human
gcacuauuaucaguucugccuaggua

SEQ ID NO: 129060 - RNA, 20 nt, Human
gggaacaccuuccaccauga

SEQ ID NO: 129061 - RNA, 21 nt, Human
gaaguacugccaauacugcca

SEQ ID NO: 129062 - RNA, 19 nt, Human
caucugucuguccaugugu

SEQ ID NO: 129063 - RNA, 28 nt, Human
ggcuucucaauuuucuuccuucucugcc

SEQ ID NO: 129064 - RNA, 27 nt, Human
gccguggaugcugcacucgggcucggg

SEQ ID NO: 129065 - RNA, 20 nt, Human
uggaaugaucaaaucacaga

SEQ ID NO: 129066 - RNA, 32 nt, Human
acuguagcuaauucuagaugcccuucaguauu

SEQ ID NO: 129067 - RNA, 27 nt, Human
uugcuaccucuuugaaaaccugcaugc

SEQ ID NO: 129068 - RNA, 22 nt, Human
uuagaaguaacuaauguuugaa

SEQ ID NO: 129069 - RNA, 25 nt, Human
caauuuacgaaaccaaaaaguugag

SEQ ID NO: 129070 - RNA, 27 nt, Human
uuugcugcugcuuaauccuacccccuc

SEQ ID NO: 129071 - RNA, 22 nt, Human
uugaccaugguguucaggagcg

SEQ ID NO: 129072 - RNA, 21 nt, Human
augugaaucugcaaugaucau

SEQ ID NO: 129073 - RNA, 25 nt, Human
ucaugggguuucaccgccuuccuca

SEQ ID NO: 129074 - RNA, 20 nt, Human
auugcccucaauugagaacc

SEQ ID NO: 129075 - RNA, 20 nt, Human
gccuuugcccugucaccccc

SEQ ID NO: 129076 - RNA, 22 nt, Human
caggccagagugcaguggcgcg

SEQ ID NO: 129077 - RNA, 18 nt, Human
uguuacaugaaugcuucu

SEQ ID NO: 129078 - RNA, 21 nt, Human
ccaacuugauuuucuuccaua

SEQ ID NO: 129079 - RNA, 20 nt, Human
cagaacauugucuuacuuga

SEQ ID NO: 129080 - RNA, 22 nt, Human
cuccagagagagccaagguucu

SEQ ID NO: 129081 - RNA, 24 nt, Human
ggagagaagagagagcccggccag

SEQ ID NO: 129082 - RNA, 21 nt, Human
ccuacagcacuccaccuuggg

SEQ ID NO: 129083 - RNA, 22 nt, Human
ccgcaaaccacacuggacuccg

SEQ ID NO: 129084 - RNA, 18 nt, Human
gccuuagccgcagucuag

SEQ ID NO: 129085 - RNA, 21 nt, Human
acaagcugagccauauguaca

SEQ ID NO: 129086 - RNA, 27 nt, Human
cugcaucuucgcgugugcucagaggug

SEQ ID NO: 129087 - RNA, 23 nt, Human
cucugccacuuugaugcuauuug

SEQ ID NO: 129088 - RNA, 17 nt, Human
uuuaguuuuuucagcaa

SEQ ID NO: 129089 - RNA, 18 nt, Human
caggugcaaaaagauugu

SEQ ID NO: 129090 - RNA, 24 nt, Human
ugcugcuacucuaacacugagcaa

SEQ ID NO: 129091 - RNA, 21 nt, Human
acagcaucuguagucagccga

SEQ ID NO: 129092 - RNA, 24 nt, Human
uaggagccagggcugaguguggaa

SEQ ID NO: 129093 - RNA, 20 nt, Human
aggcuagaaccuggcaagcu

SEQ ID NO: 129094 - RNA, 22 nt, Human
ucaugugcagauaaccaaaaau

SEQ ID NO: 129095 - RNA, 22 nt, Human
acugcauccucaaccuccuggg

SEQ ID NO: 129096 - RNA, 23 nt, Human
gaacccuagaggcggaguuugca

SEQ ID NO: 129097 - RNA, 24 nt, Human
agaauucugcauggugacagucuc

SEQ ID NO: 129098 - RNA, 23 nt, Human
ccagccccucgucgcggguucag

SEQ ID NO: 129099 - RNA, 18 nt, Human
uggccucuccacuucugu

SEQ ID NO: 129100 - RNA, 25 nt, Human
uggcagcucacaggcaugaggggug

SEQ ID NO: 129101 - RNA, 22 nt, Human
uccaacaacaauauuagucgua

SEQ ID NO: 129102 - RNA, 23 nt, Human
uggaguuugucaguggaggcaga

SEQ ID NO: 129103 - RNA, 13 nt, Human
ggcccccaccucg

SEQ ID NO: 129104 - RNA, 23 nt, Human
ggggggaggggguaccagguggc

SEQ ID NO: 129105 - RNA, 22 nt, Human
aguuuuguuuaaggaucaaaga

SEQ ID NO: 129106 - RNA, 25 nt, Human
gacagaacauugccuuccucgugca

SEQ ID NO: 129107 - RNA, 26 nt, Human
ccugccuggcuuccuuagcuugcccc

SEQ ID NO: 129108 - RNA, 23 nt, Human
cacugcccuuuuugaaaucaccu

SEQ ID NO: 129109 - RNA, 19 nt, Human
aguaaaggcuguucuggcu

SEQ ID NO: 129110 - RNA, 22 nt, Human
gaucugguuccagcuuucagcc

SEQ ID NO: 129111 - RNA, 24 nt, Human
cuuuaugaaccuccauccucccag

SEQ ID NO: 129112 - RNA, 26 nt, Human
gagcccaaguuaucuuucccucuucg

SEQ ID NO: 129113 - RNA, 20 nt, Human
ucaggagagagcagcuuuga

SEQ ID NO: 129114 - RNA, 21 nt, Human
cugagcguggagguucuuguc

SEQ ID NO: 129115 - RNA, 22 nt, Human
uccagaaagaaaaugaauuuga

SEQ ID NO: 129116 - RNA, 19 nt, Human
cccaggagguguugcagug

SEQ ID NO: 129117 - RNA, 28 nt, Human
cuggcagugcuggggggaaauguguuuc

SEQ ID NO: 129118 - RNA, 23 nt, Human
gucuucucucccuguguaagccu

SEQ ID NO: 129119 - RNA, 18 nt, Human
cauaagauauaaaagcaa

SEQ ID NO: 129120 - RNA, 23 nt, Human
ucuggagaacagugguugccugg

SEQ ID NO: 129121 - RNA, 22 nt, Human
gaaagcuuaacagcaaugugau

SEQ ID NO: 129122 - RNA, 26 nt, Human
cugcaucuuggcccuguugccugggc

SEQ ID NO: 129123 - RNA, 27 nt, Human
ccaguucugcugccucaggucaggcca

SEQ ID NO: 129124 - RNA, 26 nt, Human
ccuccugggcagggccugccuccucu

SEQ ID NO: 129125 - RNA, 22 nt, Human
cccugcucugccacugugcucc

SEQ ID NO: 129126 - RNA, 21 nt, Human
uccucuccuuuuuauuuuagg

SEQ ID NO: 129127 - RNA, 23 nt, Human
ggaaggugugagaagcaaagccc

SEQ ID NO: 129128 - RNA, 22 nt, Human
cuugcuuguugcaaugugguag

SEQ ID NO: 129129 - RNA, 27 nt, Human
cacuucuagguuugggguuucucaguu

SEQ ID NO: 129130 - RNA, 23 nt, Human
acagcucccaaacccugagcaag

SEQ ID NO: 129131 - RNA, 21 nt, Human
cucucucuucuguggccccca

SEQ ID NO: 129132 - RNA, 26 nt, Human
ccuggcaucuuaggaagcaguccuug

SEQ ID NO: 129133 - RNA, 21 nt, Human
cagugagacaaaaacggguga

SEQ ID NO: 129134 - RNA, 23 nt, Human
ucaguugagagggugcaguccag

SEQ ID NO: 129135 - RNA, 24 nt, Human
uucaguuauuuacaaauguuuguc

SEQ ID NO: 129136 - RNA, 23 nt, Human
ggagcaggcauuuccagcaguga

SEQ ID NO: 129137 - RNA, 23 nt, Human
uuuucucaucaaagcagaaugcu

SEQ ID NO: 129138 - RNA, 19 nt, Human
ccuccagcccagacccagu

SEQ ID NO: 129139 - RNA, 28 nt, Human
uccuccuaacugucaggguggggagcug

SEQ ID NO: 129140 - RNA, 21 nt, Human
acagggagaccuugugauggc

SEQ ID NO: 129141 - RNA, 20 nt, Human
aaaaggagagagcaauugag

SEQ ID NO: 129142 - RNA, 23 nt, Human
ugccuguagcucauuuuauuaug

SEQ ID NO: 129143 - RNA, 19 nt, Human
ugcaagccgggggucucca

SEQ ID NO: 129144 - RNA, 24 nt, Human
ugucacccaggcuagagugcagug

SEQ ID NO: 129145 - RNA, 24 nt, Human
ugucacccaggcuggagugcaaug

SEQ ID NO: 129146 - RNA, 24 nt, Human
ugucucccaggcuggagugcuaug

SEQ ID NO: 129147 - RNA, 23 nt, Human
aucagcuaccuguuucugccuca

SEQ ID NO: 129148 - RNA, 22 nt, Human
aggcuggagugcaggggcgcaa

SEQ ID NO: 129149 - RNA, 22 nt, Human
accucagccuccugaauagcug

SEQ ID NO: 129150 - RNA, 23 nt, Human
cuuaacccaaauaagaacaguga

SEQ ID NO: 129151 - RNA, 27 nt, Human
ucucacugccaucacauacuaaccuua

SEQ ID NO: 129152 - RNA, 24 nt, Human
ggggagggagagugaggagggagu

SEQ ID NO: 129153 - RNA, 25 nt, Human
gccucuauucuuugagaugugauua

SEQ ID NO: 129154 - RNA, 23 nt, Human
cucccacaaaugacagccccuua

SEQ ID NO: 129155 - RNA, 21 nt, Human
cuacagguuaggagaccguug

SEQ ID NO: 129156 - RNA, 21 nt, Human
ccagccugggcaacagaguga

SEQ ID NO: 129157 - RNA, 23 nt, Human
gcccucuggagcuucaggaggcg

SEQ ID NO: 129158 - RNA, 26 nt, Human
ccaucacugcugacccucuccggacc

SEQ ID NO: 129159 - RNA, 21 nt, Human
cauuguccucugagcugcagu

SEQ ID NO: 129160 - RNA, 22 nt, Human
gcucagaugaugguaucuguga

SEQ ID NO: 129161 - RNA, 21 nt, Human
uuaaaugaucaugaaaccaaa

SEQ ID NO: 129162 - RNA, 24 nt, Human
uuaugaucuuaacuucacuuccau

SEQ ID NO: 129163 - RNA, 27 nt, Human
ccccagccugagucagcugucuggacu

SEQ ID NO: 129164 - RNA, 21 nt, Human
acauuuuggaguguccuggcu

SEQ ID NO: 129165 - RNA, 25 nt, Human
aaccuugugccuucuguccuaccag

SEQ ID NO: 129166 - RNA, 23 nt, Human
gaggcccucgagguugcucugga

SEQ ID NO: 129167 - RNA, 27 nt, Human
acuccgagucuuggucuccgucccucu

SEQ ID NO: 129168 - RNA, 20 nt, Human
ggcugaaauuuccacaaaga

SEQ ID NO: 129169 - RNA, 21 nt, Human
ggguccgcucugccauuccug

SEQ ID NO: 129170 - RNA, 27 nt, Human
ggcagccccacaccugcccuugggggu

SEQ ID NO: 129171 - RNA, 22 nt, Human
agugccaugaucacagcucacu

SEQ ID NO: 129172 - RNA, 23 nt, Human
gcacauggaguagcugagguuaa

SEQ ID NO: 129173 - RNA, 25 nt, Human
ucugcuucucucuugcauagauaca

SEQ ID NO: 129174 - RNA, 21 nt, Human
gcaaccuccaccuccuggguu

SEQ ID NO: 129175 - RNA, 22 nt, Human
ccuuguuccuagaguagagugg

SEQ ID NO: 129176 - RNA, 25 nt, Human
ggugauaucuuuucaugauuuuaua

SEQ ID NO: 129177 - RNA, 26 nt, Human
gccccuaccagccacgggcacaagac

SEQ ID NO: 129178 - RNA, 26 nt, Human
ggugaucuucuugaaugauguuucag

SEQ ID NO: 129179 - RNA, 25 nt, Human
ucuguucugggcccugauuuugcca

SEQ ID NO: 129180 - RNA, 17 nt, Human
ccaagcuggagugcagu

SEQ ID NO: 129181 - RNA, 21 nt, Human
uuaagagaugggauuacaagu

SEQ ID NO: 129182 - RNA, 21 nt, Human
auuugaugagcaaaugagcua

SEQ ID NO: 129183 - RNA, 26 nt, Human
aaaguucuccuuccgucuuuucuccc

SEQ ID NO: 129184 - RNA, 21 nt, Human
cauaagccacugagcccagcc

SEQ ID NO: 129185 - RNA, 19 nt, Human
ugagacaaacggccuauug

SEQ ID NO: 129186 - RNA, 26 nt, Human
aggagcuguaguguccugcugccucu

SEQ ID NO: 129187 - RNA, 18 nt, Human
ucauccaguaagcuaagg

SEQ ID NO: 129188 - RNA, 21 nt, Human
ucacuaccucagaucuaauca

SEQ ID NO: 129189 - RNA, 27 nt, Human
gggacagagggugucaaacauucguga

SEQ ID NO: 129190 - RNA, 23 nt, Human
ucuugagcccagcuucuucucgu

SEQ ID NO: 129191 - RNA, 28 nt, Human
uacaaauacaucuacagauauuuucagg

SEQ ID NO: 129192 - RNA, 20 nt, Human
uacaguuggcuucuaaugcu

SEQ ID NO: 129193 - RNA, 25 nt, Human
cuccugagcgucuuucugcucuccu

SEQ ID NO: 129194 - RNA, 27 nt, Human
cgaggaaagcgggaugggaacaagugg

SEQ ID NO: 129195 - RNA, 22 nt, Human
ggggguggggaaaggggucggc

SEQ ID NO: 129196 - RNA, 21 nt, Human
uccucauucucagucugacca

SEQ ID NO: 129197 - RNA, 19 nt, Human
ugauaauuaggacauucag

SEQ ID NO: 129198 - RNA, 22 nt, Human
ucuucauuguauuaauuauuac

SEQ ID NO: 129199 - RNA, 21 nt, Human
agacaguacucuccaguucug

SEQ ID NO: 129200 - RNA, 22 nt, Human
gagaggcagagagcagggcagc

SEQ ID NO: 129201 - RNA, 24 nt, Human
ggugguguggaaauggcugaagag

SEQ ID NO: 129202 - RNA, 26 nt, Human
ucccuuuccuuucuccaguccacgug

SEQ ID NO: 129203 - RNA, 25 nt, Human
gucacaugucucucagaccccugga

SEQ ID NO: 129204 - RNA, 22 nt, Human
guauguaaucccagcacuuugg

SEQ ID NO: 129205 - RNA, 20 nt, Human
aaaagguccagggggccaag

SEQ ID NO: 129206 - RNA, 24 nt, Human
gcugcugagaaggccuugagggaa

SEQ ID NO: 129207 - RNA, 20 nt, Human
aggguuuugcuuuggauuuu

SEQ ID NO: 129208 - RNA, 20 nt, Human
aacugugaucuuuguccuca

SEQ ID NO: 129209 - RNA, 22 nt, Human
cgagugguuucuugugcacugg

SEQ ID NO: 129210 - RNA, 20 nt, Human
uaaagugcugggauuacagg

SEQ ID NO: 129211 - RNA, 26 nt, Human
acacagacacacagagucacacacac

SEQ ID NO: 129212 - RNA, 27 nt, Human
ggaggcugagguaggagaaucguuuga

SEQ ID NO: 129213 - RNA, 22 nt, Human
guuccuguaacucccugccucc

SEQ ID NO: 129214 - RNA, 21 nt, Human
aaccugacagaggugucaucc

SEQ ID NO: 129215 - RNA, 23 nt, Human
ucaaccucucgugacugccugug

SEQ ID NO: 129216 - RNA, 23 nt, Human
uguggcggcggaucuccuccucc

SEQ ID NO: 129217 - RNA, 23 nt, Human
cugcaggcagcuuggaaguuucu

SEQ ID NO: 129218 - RNA, 22 nt, Human
cggauaggcuaaucaauacccu

SEQ ID NO: 129219 - RNA, 21 nt, Human
agagccggcagcuccuccuca

SEQ ID NO: 129220 - RNA, 21 nt, Human
gagggagucccugaaacuucu

SEQ ID NO: 129221 - RNA, 19 nt, Human
uucugagugaggagugugg

SEQ ID NO: 129222 - RNA, 20 nt, Human
gccaguaguuauauuacaaa

SEQ ID NO: 129223 - RNA, 27 nt, Human
cuauagaaaacgauuuugaacauacuu

SEQ ID NO: 129224 - RNA, 24 nt, Human
ugguuuguuauucuuuuccagaaa

SEQ ID NO: 129225 - RNA, 21 nt, Human
ucucuccucauccaucaccag

SEQ ID NO: 129226 - RNA, 18 nt, Human
ugcuccauccgugccucu

SEQ ID NO: 129227 - RNA, 27 nt, Human
cugagacugaaggccaaggaauauagu

SEQ ID NO: 129228 - RNA, 27 nt, Human
gucaacccucugaggauggaaggcagu

SEQ ID NO: 129229 - RNA, 20 nt, Human
acagaaaagggaauagaaau

SEQ ID NO: 129230 - RNA, 21 nt, Human
gcaaaccuguucaucuugcca

SEQ ID NO: 129231 - RNA, 23 nt, Human
aggagagccugguugcccaggga

SEQ ID NO: 129232 - RNA, 21 nt, Human
gaugcugguggucacuagcuu

SEQ ID NO: 129233 - RNA, 20 nt, Human
gaggauaggcaucucaggga

SEQ ID NO: 129234 - RNA, 28 nt, Human
gucauccagagcuggagugcagcggcac

SEQ ID NO: 129235 - RNA, 21 nt, Human
uaaucucagcuccugccugua

SEQ ID NO: 129236 - RNA, 21 nt, Human
ugugcccaggcuggagugcaa

SEQ ID NO: 129237 - RNA, 21 nt, Human
gucgcccaggcuggagguuaa

SEQ ID NO: 129238 - RNA, 22 nt, Human
uuauagaagcugauauauaagg

SEQ ID NO: 129239 - RNA, 23 nt, Human
cuuucuucucugcucccaaacca

SEQ ID NO: 129240 - RNA, 21 nt, Human
ucugacauuccauugcucuuc

SEQ ID NO: 129241 - RNA, 23 nt, Human
cuucaucuuggcacagaaauugu

SEQ ID NO: 129242 - RNA, 28 nt, Human
gugaccugcugugacacugugcucucuu

SEQ ID NO: 129243 - RNA, 25 nt, Human
uaauauuuuaucuuuacagauuucc

SEQ ID NO: 129244 - RNA, 21 nt, Human
cagcucuggccacaacagggc

SEQ ID NO: 129245 - RNA, 22 nt, Human
ucucaacacgcuggacaggugg

SEQ ID NO: 129246 - RNA, 21 nt, Human
cucccauccuuccugccuccu

SEQ ID NO: 129247 - RNA, 24 nt, Human
accuuccgagugcagugaggcaua

SEQ ID NO: 129248 - RNA, 22 nt, Human
agagacgggguuucacuguguu

SEQ ID NO: 129249 - RNA, 28 nt, Human
uacuaugagcacauucaccaggcggucc

SEQ ID NO: 129250 - RNA, 21 nt, Human
gcaaaugauuaguuuuagaag

SEQ ID NO: 129251 - RNA, 20 nt, Human
uuccgcuccacggugaccuc

SEQ ID NO: 129252 - RNA, 27 nt, Human
ucucugauaaggggcugaaagauucug

SEQ ID NO: 129253 - RNA, 20 nt, Human
uggcuucauggaaacucccu

SEQ ID NO: 129254 - RNA, 22 nt, Human
accuaggcuggagugcagcggc

SEQ ID NO: 129255 - RNA, 26 nt, Human
agacaccuccacgcccaccugguccu

SEQ ID NO: 129256 - RNA, 32 nt, Human
acuguuuucuccuucccuucuuugcugcugcu

SEQ ID NO: 129257 - RNA, 21 nt, Human
guaaaggaucauuaaaaugaa

SEQ ID NO: 129258 - RNA, 21 nt, Human
gggcuccuggacugagaauag

SEQ ID NO: 129259 - RNA, 20 nt, Human
uuagaaucuggaacagaaga

SEQ ID NO: 129260 - RNA, 21 nt, Human
ucccucgaauccaccagcacg

SEQ ID NO: 129261 - RNA, 21 nt, Human
uccaacagggugucaggauuu

SEQ ID NO: 129262 - RNA, 19 nt, Human
ccuuuagcucccuccugcc

SEQ ID NO: 129263 - RNA, 24 nt, Human
cauugcagagcccaaacaugugga

SEQ ID NO: 129264 - RNA, 21 nt, Human
guaaaacugaggacagaggag

SEQ ID NO: 129265 - RNA, 21 nt, Human
ggagugugucucaugcuuuca

SEQ ID NO: 129266 - RNA, 22 nt, Human
agcuacugcugccuccauuucu

SEQ ID NO: 129267 - RNA, 25 nt, Human
gcacacccacacccacgcgcgcccg

SEQ ID NO: 129268 - RNA, 25 nt, Human
uaucacacccuccaucuuuauucuu

SEQ ID NO: 129269 - RNA, 26 nt, Human
ccuccccaccccugccuguguucugu

SEQ ID NO: 129270 - RNA, 22 nt, Human
ucacccaggcuggaguguagug

SEQ ID NO: 129271 - RNA, 25 nt, Human
ucgcaaaccuggagugcagaccaca

SEQ ID NO: 129272 - RNA, 22 nt, Human
uugcccaggcuggagugcggug

SEQ ID NO: 129273 - RNA, 22 nt, Human
uuacccaggcuggagugcagug

SEQ ID NO: 129274 - RNA, 22 nt, Human
ucacccagguuggagugcagug

SEQ ID NO: 129275 - RNA, 23 nt, Human
ccaggagauggaaguugcaguga

SEQ ID NO: 129276 - RNA, 27 nt, Human
aaguagcugggauuacagaaagccgcc

SEQ ID NO: 129277 - RNA, 21 nt, Human
uucacagucuccgggccgccu

SEQ ID NO: 129278 - RNA, 22 nt, Human
gaggcugaggcacggggagcca

SEQ ID NO: 129279 - RNA, 22 nt, Human
ggcagacgugugagagggacgg

SEQ ID NO: 129280 - RNA, 22 nt, Human
aaucuuccccagcagaaucugg

SEQ ID NO: 129281 - RNA, 22 nt, Human
caggccucaguuucuucaccug

SEQ ID NO: 129282 - RNA, 25 nt, Human
ucccucgggcagguggcagcggcca

SEQ ID NO: 129283 - RNA, 21 nt, Human
ucucagccaugcacggacucg

SEQ ID NO: 129284 - RNA, 22 nt, Human
guggccagaaggccgaguugug

SEQ ID NO: 129285 - RNA, 26 nt, Human
cauguuacccucccuuccucacauug

SEQ ID NO: 129286 - RNA, 25 nt, Human
ccugccuguguucugugcccugugu

SEQ ID NO: 129287 - RNA, 24 nt, Human
gcaagaucccuguccuccugggcc

SEQ ID NO: 129288 - RNA, 22 nt, Human
uuaauccuucacuuuaauacaa

SEQ ID NO: 129289 - RNA, 19 nt, Human
caagaaccuguuuccugga

SEQ ID NO: 129290 - RNA, 24 nt, Human
ugcccaggugggguuuccugcaug

SEQ ID NO: 129291 - RNA, 29 nt, Human
aggacuucacagagagagcugugcccauc

SEQ ID NO: 129292 - RNA, 21 nt, Human
ucgcuucagccucuucuguua

SEQ ID NO: 129293 - RNA, 19 nt, Human
uuaauuaugcccaguguga

SEQ ID NO: 129294 - RNA, 26 nt, Human
caguggcuguggaacaguccugggcc

SEQ ID NO: 129295 - RNA, 29 nt, Human
ucccugucccaauccccaggugcgcacgc

SEQ ID NO: 129296 - RNA, 26 nt, Human
gccccuucuccccuccccgccuggcc

SEQ ID NO: 129297 - RNA, 29 nt, Human
gguagcucacgccuguaaucccaacacuu

SEQ ID NO: 129298 - RNA, 24 nt, Human
gugagacaaaauuuuaguccaaau

SEQ ID NO: 129299 - RNA, 25 nt, Human
gcugacuccagccuguccaugcacg

SEQ ID NO: 129300 - RNA, 22 nt, Human
agaaaacuaagaaauaugcaca

SEQ ID NO: 129301 - RNA, 26 nt, Human
gagauggggaggaagccccaucucug

SEQ ID NO: 129302 - RNA, 23 nt, Human
uuguccaccuauuaauuguuuac

SEQ ID NO: 129303 - RNA, 23 nt, Human
gcaaggcccugcgugccugcugc

SEQ ID NO: 129304 - RNA, 26 nt, Human
cagcucauaaaauggaagcaauugcu

SEQ ID NO: 129305 - RNA, 27 nt, Human
ccagggcccagcugcguccaacccagc

SEQ ID NO: 129306 - RNA, 20 nt, Human
gcuugaggcuagugagcugu

SEQ ID NO: 129307 - RNA, 27 nt, Human
cccacagacauuuguuuuuaaguauga

SEQ ID NO: 129308 - RNA, 25 nt, Human
uuuucuggcacuuccucucuauugc

SEQ ID NO: 129309 - RNA, 23 nt, Human
ggcucacugaaaccucugccuuc

SEQ ID NO: 129310 - RNA, 19 nt, Human
gacaggggaaagggcucuc

SEQ ID NO: 129311 - RNA, 22 nt, Human
agaauauaaggaaaauuagaag

SEQ ID NO: 129312 - RNA, 18 nt, Human
uccugcaucuuguggauu

SEQ ID NO: 129313 - RNA, 20 nt, Human
cucuccucugaacucgggcc

SEQ ID NO: 129314 - RNA, 23 nt, Human
aucaucccuguggggagugcagg

SEQ ID NO: 129315 - RNA, 20 nt, Human
gugacuucuuuuugcccagg

SEQ ID NO: 129316 - RNA, 20 nt, Human
aauaaaaccaccaaauggca

SEQ ID NO: 129317 - RNA, 28 nt, Human
aaggccucacacgcagccacuucuucaa

SEQ ID NO: 129318 - RNA, 26 nt, Human
ggcucauugaaccucuuggguucaag

SEQ ID NO: 129319 - RNA, 23 nt, Human
gguggaaggaugggauggguucc

SEQ ID NO: 129320 - RNA, 26 nt, Human
cacagcccgagccccuuggggagcag

SEQ ID NO: 129321 - RNA, 22 nt, Human
cuaggagguggagguugcauuc

SEQ ID NO: 129322 - RNA, 21 nt, Human
ggaacugaagaaacugccgcu

SEQ ID NO: 129323 - RNA, 26 nt, Human
agauucaaggggaggagaaauagagu

SEQ ID NO: 129324 - RNA, 16 nt, Human
gaucaaaugacaguga

SEQ ID NO: 129325 - RNA, 22 nt, Human
gagaaaccgcauucacaaaaaa

SEQ ID NO: 129326 - RNA, 22 nt, Human
cucaucuaggauguaacaguga

SEQ ID NO: 129327 - RNA, 21 nt, Human
ucgccaaguuggagugcaaug

SEQ ID NO: 129328 - RNA, 22 nt, Human
agcacagcugugacuuccuccu

SEQ ID NO: 129329 - RNA, 22 nt, Human
uacuacugaauaaacuaguucu

SEQ ID NO: 129330 - RNA, 28 nt, Human
ucauguugcagaaccagcagguggauag

SEQ ID NO: 129331 - RNA, 24 nt, Human
ucucagacucugauuacugccucc

SEQ ID NO: 129332 - RNA, 22 nt, Human
gccaagauuugaacccagcuag

SEQ ID NO: 129333 - RNA, 21 nt, Human
uggccaagaaaguugcaguga

SEQ ID NO: 129334 - RNA, 23 nt, Human
auccaauaaugauugauaccuca

SEQ ID NO: 129335 - RNA, 26 nt, Human
gccucagcuuuuuuccuugcagccgc

SEQ ID NO: 129336 - RNA, 20 nt, Human
gcagguggcaucucuaauug

SEQ ID NO: 129337 - RNA, 26 nt, Human
gggaagagaugacucaagccagugga

SEQ ID NO: 129338 - RNA, 27 nt, Human
uaacugcauuaguggccauuuugaauc

SEQ ID NO: 129339 - RNA, 22 nt, Human
gaguguuugguuuaagaaagau

SEQ ID NO: 129340 - RNA, 23 nt, Human
cuggagcagagaacaucuggaga

SEQ ID NO: 129341 - RNA, 22 nt, Human
gcaagcagaucacuugagguca

SEQ ID NO: 129342 - RNA, 24 nt, Human
ggaccccaccauaggcagaggcag

SEQ ID NO: 129343 - RNA, 23 nt, Human
ggagaaagcgcggccgcuguggg

SEQ ID NO: 129344 - RNA, 20 nt, Human
caucuaggcuaggugcagug

SEQ ID NO: 129345 - RNA, 22 nt, Human
ucccccaggcuggagugcagug

SEQ ID NO: 129346 - RNA, 22 nt, Human
ucacccaggcuggagugccgug

SEQ ID NO: 129347 - RNA, 27 nt, Human
uucauucuucauggcauccuuggaagg

SEQ ID NO: 129348 - RNA, 22 nt, Human
cugcagccucaaacuccugggc

SEQ ID NO: 129349 - RNA, 30 nt, Human
gcgcuucaucuaggugggccuguuggggag

SEQ ID NO: 129350 - RNA, 24 nt, Human
gacgacggcccggacuuccucuca

SEQ ID NO: 129351 - RNA, 20 nt, Human
ggaaggagauuccacacagg

SEQ ID NO: 129352 - RNA, 25 nt, Human
cccucucucugucaacacuggaaua

SEQ ID NO: 129353 - RNA, 22 nt, Human
acccaccucuaaggacucagag

SEQ ID NO: 129354 - RNA, 22 nt, Human
ccuaucuucacaccugccaccu

SEQ ID NO: 129355 - RNA, 21 nt, Human
acaaaacaaaaaacaccggcu

SEQ ID NO: 129356 - RNA, 22 nt, Human
gagaggagaaggucaaguccuc

SEQ ID NO: 129357 - RNA, 22 nt, Human
uccagucuugugggggcagcuu

SEQ ID NO: 129358 - RNA, 21 nt, Human
aaaucacuaugggugagcaua

SEQ ID NO: 129359 - RNA, 23 nt, Human
ggagggaagacguggcucagguc

SEQ ID NO: 129360 - RNA, 21 nt, Human
ugggggccuuucuuuaacugc

SEQ ID NO: 129361 - RNA, 22 nt, Human
gccacucugccuggaguggggg

SEQ ID NO: 129362 - RNA, 21 nt, Human
aauacuccuagggcucaggac

SEQ ID NO: 129363 - RNA, 24 nt, Human
cggggggcgcggagguuggagaga

SEQ ID NO: 129364 - RNA, 24 nt, Human
aauaagcacguuggaaauauuugg

SEQ ID NO: 129365 - RNA, 21 nt, Human
uugcagaaucaggacuuuaua

SEQ ID NO: 129366 - RNA, 23 nt, Human
cuugccccacucugccugccugc

SEQ ID NO: 129367 - RNA, 22 nt, Human
gggagagagggagagagccuau

SEQ ID NO: 129368 - RNA, 19 nt, Human
cuccacaaauaaaaggaca

SEQ ID NO: 129369 - RNA, 23 nt, Human
cucuggggguccucucugaguca

SEQ ID NO: 129370 - RNA, 21 nt, Human
ugccuuugaggggaaggagga

SEQ ID NO: 129371 - RNA, 23 nt, Human
cacacaagcgaaucucugccuuu

SEQ ID NO: 129372 - RNA, 26 nt, Human
cugccucuuacgguuugguaugggac

SEQ ID NO: 129373 - RNA, 21 nt, Human
uuccaguuuacugaacuccag

SEQ ID NO: 129374 - RNA, 27 nt, Human
gccucaagaagagcauggccugggacc

SEQ ID NO: 129375 - RNA, 22 nt, Human
cccugggaagccuccgggugau

SEQ ID NO: 129376 - RNA, 21 nt, Human
agaucacugcaaccucugccu

SEQ ID NO: 129377 - RNA, 26 nt, Human
gguggguggagucaggcuucucuugc

SEQ ID NO: 129378 - RNA, 23 nt, Human
cguucuccggggagggagggacu

SEQ ID NO: 129379 - RNA, 28 nt, Human
cugagcuuucuaaaaugauagcucucua

SEQ ID NO: 129380 - RNA, 19 nt, Human
ggguuugcuagaaugugau

SEQ ID NO: 129381 - RNA, 24 nt, Human
ggcuauaauaguucuguucuuaca

SEQ ID NO: 129382 - RNA, 21 nt, Human
uucugcaucucccuugugccc

SEQ ID NO: 129383 - RNA, 27 nt, Human
ugugcagugaacaaacuacacaaguca

SEQ ID NO: 129384 - RNA, 21 nt, Human
gcaucugcuuuacucuggacc

SEQ ID NO: 129385 - RNA, 24 nt, Human
ucucauagaugacccccagguauu

SEQ ID NO: 129386 - RNA, 26 nt, Human
caguguccuaaugcauauugugacug

SEQ ID NO: 129387 - RNA, 26 nt, Human
cagcagcugcucccggcuccgcggcc

SEQ ID NO: 129388 - RNA, 25 nt, Human
cccucacugcacucugcucaucacg

SEQ ID NO: 129389 - RNA, 24 nt, Human
cugccucucuccugggaccguggg

SEQ ID NO: 129390 - RNA, 22 nt, Human
cauauuuauuacgaguacucug

SEQ ID NO: 129391 - RNA, 19 nt, Human
cuugguccugcucugguca

SEQ ID NO: 129392 - RNA, 23 nt, Human
gucaccuguagauuuccacacgc

SEQ ID NO: 129393 - RNA, 20 nt, Human
uuccugccccuuccuccucg

SEQ ID NO: 129394 - RNA, 24 nt, Human
auagaaauuguuaauuuuaacaau

SEQ ID NO: 129395 - RNA, 22 nt, Human
aaaagagacauuucagcuguga

SEQ ID NO: 129396 - RNA, 27 nt, Human
acacagaacuauauacacacauuguac

SEQ ID NO: 129397 - RNA, 21 nt, Human
acacauuucuaaaaaugucau

SEQ ID NO: 129398 - RNA, 24 nt, Human
uucuaaaaaaugccuuuuuuggag

SEQ ID NO: 129399 - RNA, 21 nt, Human
cccuucucccugaccuggcuc

SEQ ID NO: 129400 - RNA, 20 nt, Human
cugcacuuccaggugcccca

SEQ ID NO: 129401 - RNA, 28 nt, Human
cagcugaaggcagauggaaauauuuaca

SEQ ID NO: 129402 - RNA, 26 nt, Human
acagauucucuccuuuuuccuguccc

SEQ ID NO: 129403 - RNA, 21 nt, Human
agguuagaucugugaaccuga

SEQ ID NO: 129404 - RNA, 22 nt, Human
ugggcacaggcucuugggugca

SEQ ID NO: 129405 - RNA, 21 nt, Human
aauggcgaacauguguuuuca

SEQ ID NO: 129406 - RNA, 23 nt, Human
gcuguguccuaaggcccauuuga

SEQ ID NO: 129407 - RNA, 25 nt, Human
uccaacaaauuuuaaacgaauccaa

SEQ ID NO: 129408 - RNA, 16 nt, Human
ggccguucccaccugg

SEQ ID NO: 129409 - RNA, 20 nt, Human
uugugagccaccaugccagg

SEQ ID NO: 129410 - RNA, 25 nt, Human
agucaccugaguaacuuggccacua

SEQ ID NO: 129411 - RNA, 28 nt, Human
agagaggaggaagagggagucugagcau

SEQ ID NO: 129412 - RNA, 22 nt, Human
aucauggagcugaggaggugcc

SEQ ID NO: 129413 - RNA, 26 nt, Human
cacccaggcugcaguguaguggugca

SEQ ID NO: 129414 - RNA, 20 nt, Human
ccugccuggugcauugcugu

SEQ ID NO: 129415 - RNA, 23 nt, Human
gugguaggagggagaguagcaga

SEQ ID NO: 129416 - RNA, 28 nt, Human
gcggccugcugcagaucuucccugaggg

SEQ ID NO: 129417 - RNA, 22 nt, Human
cggggaggagcugcuacugcug

SEQ ID NO: 129418 - RNA, 26 nt, Human
caguccugccucugcuccugccuggu

SEQ ID NO: 129419 - RNA, 24 nt, Human
gcgcgagucacaguugacagcccu

SEQ ID NO: 129420 - RNA, 20 nt, Human
gaguuugagcauuauucagc

SEQ ID NO: 129421 - RNA, 27 nt, Human
ucgcccagccugcgcuggagggaagaa

SEQ ID NO: 129422 - RNA, 19 nt, Human
gcccaggauggagugcagu

SEQ ID NO: 129423 - RNA, 22 nt, Human
gggaggcggagguugcagugag

SEQ ID NO: 129424 - RNA, 27 nt, Human
ucuucgugguauggcuuuuuuaauucu

SEQ ID NO: 129425 - RNA, 23 nt, Human
cugaaaaacuguugguucaucca

SEQ ID NO: 129426 - RNA, 18 nt, Human
uuguuucguuuucuagcu

SEQ ID NO: 129427 - RNA, 21 nt, Human
ugucccuucucacaggcauuc

SEQ ID NO: 129428 - RNA, 28 nt, Human
ccagggucuuugccucuaucugugguuu

SEQ ID NO: 129429 - RNA, 24 nt, Human
ccuuguucugccagcuggagccaa

SEQ ID NO: 129430 - RNA, 20 nt, Human
cccuccagacaacauccugc

SEQ ID NO: 129431 - RNA, 25 nt, Human
ucauuucauaaaugauauuuuuaua

SEQ ID NO: 129432 - RNA, 22 nt, Human
ccuuccagaugccucagugcua

SEQ ID NO: 129433 - RNA, 19 nt, Human
ucuggagaauucucuuagu

SEQ ID NO: 129434 - RNA, 20 nt, Human
uaagcugaaccaccaacaga

SEQ ID NO: 129435 - RNA, 17 nt, Human
cacacugaagcugucgu

SEQ ID NO: 129436 - RNA, 22 nt, Human
auguucucuguauuuaugcagc

SEQ ID NO: 129437 - RNA, 23 nt, Human
ggagcagucccagaagggagggc

SEQ ID NO: 129438 - RNA, 19 nt, Human
gucuuaaacuccuaaccuc

SEQ ID NO: 129439 - RNA, 24 nt, Human
aggcuggagucagugucugccccu

SEQ ID NO: 129440 - RNA, 22 nt, Human
aacucuggccuugguuccucca

SEQ ID NO: 129441 - RNA, 17 nt, Human
ccugcuguccuucuguc

SEQ ID NO: 129442 - RNA, 27 nt, Human
acagauggagaagguggagaggaggau

SEQ ID NO: 129443 - RNA, 25 nt, Human
gcagcugcaacucuauagacuuuug

SEQ ID NO: 129444 - RNA, 21 nt, Human
ucuccuccuccucaucuuagc

SEQ ID NO: 129445 - RNA, 27 nt, Human
uacucgagaggccaaagaaggaggaug

SEQ ID NO: 129446 - RNA, 19 nt, Human
cccuuaagaccucaggggg

SEQ ID NO: 129447 - RNA, 22 nt, Human
uucagcacccugucccuccucc

SEQ ID NO: 129448 - RNA, 27 nt, Human
cccugcagcagcggcagucacagcuuc

SEQ ID NO: 129449 - RNA, 29 nt, Human
gcagucagccacaaacugacccagaguuu

SEQ ID NO: 129450 - RNA, 23 nt, Human
aucccaugcuguccauccauucu

SEQ ID NO: 129451 - RNA, 23 nt, Human
ccagugaucacgccauugcacuc

SEQ ID NO: 129452 - RNA, 27 nt, Human
gaggcacaggcacaaagcauugcuugg

SEQ ID NO: 129453 - RNA, 22 nt, Human
gagcaagacuccaucucaaaaa

SEQ ID NO: 129454 - RNA, 22 nt, Human
gagugagacucugucucaaaaa

SEQ ID NO: 129455 - RNA, 21 nt, Human
uucccuuugccacacuguggu

SEQ ID NO: 129456 - RNA, 20 nt, Human
ucgcccagcccaguucugga

SEQ ID NO: 129457 - RNA, 29 nt, Human
gcaucauuaacaccuuccccacccccucc

SEQ ID NO: 129458 - RNA, 19 nt, Human
auuucccuuucuucuuucc

SEQ ID NO: 129459 - RNA, 26 nt, Human
gcaguuucaguccauaucaauugugu

SEQ ID NO: 129460 - RNA, 21 nt, Human
uguccagcaaaggcuccgugg

SEQ ID NO: 129461 - RNA, 22 nt, Human
gaugccagcuuuggaaucagag

SEQ ID NO: 129462 - RNA, 26 nt, Human
ccaaagcucggcagauuaugaaccag

SEQ ID NO: 129463 - RNA, 23 nt, Human
aaaugauuuuuuaaagcauuuug

SEQ ID NO: 129464 - RNA, 22 nt, Human
uucuguagcccacggcacccca

SEQ ID NO: 129465 - RNA, 21 nt, Human
ucauuuauacuucuaguguca

SEQ ID NO: 129466 - RNA, 23 nt, Human
ccucuaaaugggguugggucuca

SEQ ID NO: 129467 - RNA, 24 nt, Human
aagcaaaaaacaaaaaccuacccu

SEQ ID NO: 129468 - RNA, 25 nt, Human
gaccaaggugaagcaaauuuguggu

SEQ ID NO: 129469 - RNA, 27 nt, Human
cgcuguccugguguuuuacuacacucc

SEQ ID NO: 129470 - RNA, 24 nt, Human
aauuaugguaguuauucugccuuc

SEQ ID NO: 129471 - RNA, 21 nt, Human
uguugcccugcuacacucccc

SEQ ID NO: 129472 - RNA, 23 nt, Human
auggugccacugcauuccagccu

SEQ ID NO: 129473 - RNA, 20 nt, Human
aggagcuucaguauuguggg

SEQ ID NO: 129474 - RNA, 27 nt, Human
ucuuagcaacaaacuguuuguuuuucu

SEQ ID NO: 129475 - RNA, 26 nt, Human
gggaagggggagugugacacuuucuu

SEQ ID NO: 129476 - RNA, 25 nt, Human
gugggaggggacgggcgggacgagc

SEQ ID NO: 129477 - RNA, 21 nt, Human
ccccaggcugggagaaggggc

SEQ ID NO: 129478 - RNA, 22 nt, Human
uggaggagagcaggcuagaggc

SEQ ID NO: 129479 - RNA, 22 nt, Human
ccucaccuguuccuaauuucuc

SEQ ID NO: 129480 - RNA, 21 nt, Human
gagacuugcaggagaccgugu

SEQ ID NO: 129481 - RNA, 26 nt, Human
cucacacuuucaugugcuuguggauc

SEQ ID NO: 129482 - RNA, 26 nt, Human
ugccuugccacuccaucucccuccgu

SEQ ID NO: 129483 - RNA, 21 nt, Human
caagcagaucacuugagguca

SEQ ID NO: 129484 - RNA, 22 nt, Human
acgaucucaguucacugcaacc

SEQ ID NO: 129485 - RNA, 23 nt, Human
ugucaaucauauuuaaagggaau

SEQ ID NO: 129486 - RNA, 27 nt, Human
cccugcagcccccagcuucaggccuca

SEQ ID NO: 129487 - RNA, 24 nt, Human
ugggaacacuggugggcagcugag

SEQ ID NO: 129488 - RNA, 22 nt, Human
uugcaaaccacgccaugaccca

SEQ ID NO: 129489 - RNA, 27 nt, Human
uggucucaaacaccugaccuugugauc

SEQ ID NO: 129490 - RNA, 21 nt, Human
agcaggaaccccaccgugugc

SEQ ID NO: 129491 - RNA, 27 nt, Human
ccacuucugguugccaggagacagcaa

SEQ ID NO: 129492 - RNA, 26 nt, Human
ucuccacugugcuuucagaagugccc

SEQ ID NO: 129493 - RNA, 23 nt, Human
uuccacguccuugcuucaccuca

SEQ ID NO: 129494 - RNA, 22 nt, Human
gcaguuugucuacuacagcaga

SEQ ID NO: 129495 - RNA, 20 nt, Human
uucaguuaguguaaacugca

SEQ ID NO: 129496 - RNA, 27 nt, Human
caggauggagugcaguggugagaucac

SEQ ID NO: 129497 - RNA, 25 nt, Human
acaaguugauuuggaacacuggacu

SEQ ID NO: 129498 - RNA, 19 nt, Human
cucuccaaagggcaggaag

SEQ ID NO: 129499 - RNA, 19 nt, Human
ugucauauauugccaaaca

SEQ ID NO: 129500 - RNA, 27 nt, Human
ccucaaaucaggaagaaacaucaaaga

SEQ ID NO: 129501 - RNA, 20 nt, Human
agguuuaauagauccuggcc

SEQ ID NO: 129502 - RNA, 22 nt, Human
ggcugguggagaaacaggagac

SEQ ID NO: 129503 - RNA, 23 nt, Human
ugacuuggccaagaucugcucau

SEQ ID NO: 129504 - RNA, 19 nt, Human
uucuucuccuccuccuugc

SEQ ID NO: 129505 - RNA, 23 nt, Human
acacauuuaucauauucauucac

SEQ ID NO: 129506 - RNA, 26 nt, Human
gggcuggccauggagcugcugugcca

SEQ ID NO: 129507 - RNA, 25 nt, Human
agccccagccccgcgcugcgcugcc

SEQ ID NO: 129508 - RNA, 27 nt, Human
cccuucaguuuggucugcuccgccugg

SEQ ID NO: 129509 - RNA, 22 nt, Human
cuggccauggcccugcccucac

SEQ ID NO: 129510 - RNA, 24 nt, Human
cagagccuauggucucaacugugc

SEQ ID NO: 129511 - RNA, 27 nt, Human
gucccauauuccugagugcagggguag

SEQ ID NO: 129512 - RNA, 23 nt, Human
gcagucgggcuggaugcucugug

SEQ ID NO: 129513 - RNA, 27 nt, Human
uugcccaggucucacugcuuugcaccg

SEQ ID NO: 129514 - RNA, 25 nt, Human
ccagaucuaugugucugucugugug

SEQ ID NO: 129515 - RNA, 25 nt, Human
guuucaggcuuaaacaucacagcag

SEQ ID NO: 129516 - RNA, 27 nt, Human
ugaccgcuccgccuugccaggagucug

SEQ ID NO: 129517 - RNA, 22 nt, Human
ucaucuuucuucgcuucuauac

SEQ ID NO: 129518 - RNA, 27 nt, Human
uugagacugaaagauuuagccauaaug

SEQ ID NO: 129519 - RNA, 21 nt, Human
cccugcucaguaaagcacuug

SEQ ID NO: 129520 - RNA, 22 nt, Human
acuccagccugggugacagagu

SEQ ID NO: 129521 - RNA, 20 nt, Human
cuaagcugggaucugaauac

SEQ ID NO: 129522 - RNA, 22 nt, Human
aagacuugaauuucaguuuggu

SEQ ID NO: 129523 - RNA, 23 nt, Human
uuuauaucuucuuuauucgucgu

SEQ ID NO: 129524 - RNA, 23 nt, Human
accuguaaucccagcacuuuagg

SEQ ID NO: 129525 - RNA, 22 nt, Human
ugugguuucucugagucacaga

SEQ ID NO: 129526 - RNA, 25 nt, Human
ggccaggcuggagugcaguggugca

SEQ ID NO: 129527 - RNA, 26 nt, Human
ggagagaaagaggagcccucccgcuc

SEQ ID NO: 129528 - RNA, 21 nt, Human
gggcuaggguggucagaggaa

SEQ ID NO: 129529 - RNA, 22 nt, Human
ucacaugcccauucacaccaca

SEQ ID NO: 129530 - RNA, 23 nt, Human
aggcuggagugcaacggcaugau

SEQ ID NO: 129531 - RNA, 27 nt, Human
cgcuuccagagccagaacugagcccag

SEQ ID NO: 129532 - RNA, 29 nt, Human
ggacagaaccacaggcacacacugagggg

SEQ ID NO: 129533 - RNA, 22 nt, Human
uuuagaauaaagauuacauauc

SEQ ID NO: 129534 - RNA, 21 nt, Human
caguucuggaggagccagguu

SEQ ID NO: 129535 - RNA, 27 nt, Human
cccagcgccauccugaggaucggggug

SEQ ID NO: 129536 - RNA, 27 nt, Human
cucagccgccguccacacucgcugcag

SEQ ID NO: 129537 - RNA, 24 nt, Human
gagcaguggcagcagagaggcaga

SEQ ID NO: 129538 - RNA, 18 nt, Human
gagaaaacaggcucacag

SEQ ID NO: 129539 - RNA, 21 nt, Human
ucucuaguuguuaaauagcug

SEQ ID NO: 129540 - RNA, 22 nt, Human
gaucauuaaaaugaaaguaauu

SEQ ID NO: 129541 - RNA, 20 nt, Human
aagcacacuggaaaggccau

SEQ ID NO: 129542 - RNA, 26 nt, Human
cugauuuguccauuucuuucccugca

SEQ ID NO: 129543 - RNA, 21 nt, Human
aauuacaucucuaauuuugga

SEQ ID NO: 129544 - RNA, 27 nt, Human
ggcucuggcaccacuaggguccuggcc

SEQ ID NO: 129545 - RNA, 20 nt, Human
auauuccuacugucuuugga

SEQ ID NO: 129546 - RNA, 23 nt, Human
uagaucauuaagacuuaugugcu

SEQ ID NO: 129547 - RNA, 23 nt, Human
ucuucugucuguacaucguuguc

SEQ ID NO: 129548 - RNA, 26 nt, Human
uccugccucucugcuccagagagagg

SEQ ID NO: 129549 - RNA, 22 nt, Human
cccaaaaugcugggauuacagg

SEQ ID NO: 129550 - RNA, 24 nt, Human
ggugaagagagggcaggggagccc

SEQ ID NO: 129551 - RNA, 29 nt, Human
gaugcagagaugaccucucgcugccucac

SEQ ID NO: 129552 - RNA, 26 nt, Human
gcauugcgcagcaucuucaguucucc

SEQ ID NO: 129553 - RNA, 27 nt, Human
auuguaaccuuugucuaaucauuggau

SEQ ID NO: 129554 - RNA, 21 nt, Human
cgagaggcucccuucuggccu

SEQ ID NO: 129555 - RNA, 22 nt, Human
uuuuacccaggcuggagugcaa

SEQ ID NO: 129556 - RNA, 19 nt, Human
cugucucucuuucucuccu

SEQ ID NO: 129557 - RNA, 24 nt, Human
uccgggcugccaggcagcugcugu

SEQ ID NO: 129558 - RNA, 21 nt, Human
uucuucuucuuuauuauucuu

SEQ ID NO: 129559 - RNA, 22 nt, Human
uagcccagucuggagugcagug

SEQ ID NO: 129560 - RNA, 19 nt, Human
gcacaggaagauauuggug

SEQ ID NO: 129561 - RNA, 22 nt, Human
ccuggcaguggcccauccuguc

SEQ ID NO: 129562 - RNA, 20 nt, Human
ucuuugggaaggaacacuaa

SEQ ID NO: 129563 - RNA, 22 nt, Human
ccucugcccagcuccccauuca

SEQ ID NO: 129564 - RNA, 24 nt, Human
ggccucucugucgcugucgccguc

SEQ ID NO: 129565 - RNA, 23 nt, Human
aagcagcugugacaugaagugaa

SEQ ID NO: 129566 - RNA, 21 nt, Human
ccccucuccccuaccuggccc

SEQ ID NO: 129567 - RNA, 22 nt, Human
cucuggauaaauuagcauaguu

SEQ ID NO: 129568 - RNA, 20 nt, Human
gagucugcucaggagccagc

SEQ ID NO: 129569 - RNA, 24 nt, Human
gacugcuguguccccacagaucug

SEQ ID NO: 129570 - RNA, 20 nt, Human
uccagacccugcugcgucuc

SEQ ID NO: 129571 - RNA, 22 nt, Human
cuagagugaugaugugaaagaa

SEQ ID NO: 129572 - RNA, 21 nt, Human
gggugggggcugggugcagug

SEQ ID NO: 129573 - RNA, 27 nt, Human
cccugucuugggcuccaaccccucaac

SEQ ID NO: 129574 - RNA, 21 nt, Human
acccguuucacaugcuuuuca

SEQ ID NO: 129575 - RNA, 17 nt, Human
gccauaaaaagaccaca

SEQ ID NO: 129576 - RNA, 24 nt, Human
ccacuucuggguggggcagugggu

SEQ ID NO: 129577 - RNA, 19 nt, Human
gaggggaaggcagagcuca

SEQ ID NO: 129578 - RNA, 25 nt, Human
aagagagagcuccuuucgccauguu

SEQ ID NO: 129579 - RNA, 21 nt, Human
uauacucuugaauuccucuca

SEQ ID NO: 129580 - RNA, 22 nt, Human
aaagaaauuuauuuucuuccua

SEQ ID NO: 129581 - RNA, 27 nt, Human
ugcuggcacuuucugcacacuggcucu

SEQ ID NO: 129582 - RNA, 17 nt, Human
aauguucuccugggcag

SEQ ID NO: 129583 - RNA, 19 nt, Human
uaggggcagcaaugcugaa

SEQ ID NO: 129584 - RNA, 25 nt, Human
gccugggccccuccugggacuuuau

SEQ ID NO: 129585 - RNA, 22 nt, Human
uucuagccugcauugagcuugc

SEQ ID NO: 129586 - RNA, 25 nt, Human
auauuaagcaaaauguuuaaagaca

SEQ ID NO: 129587 - RNA, 20 nt, Human
gaggggagagcggccgccgc

SEQ ID NO: 129588 - RNA, 25 nt, Human
gaaaccagaucugggguaaagucaa

SEQ ID NO: 129589 - RNA, 23 nt, Human
cuguggacuuuuagcauuugugg

SEQ ID NO: 129590 - RNA, 27 nt, Human
augcagaaugaacguagguggucaaca

SEQ ID NO: 129591 - RNA, 27 nt, Human
gggaggcacacuuucugcaaacguuuc

SEQ ID NO: 129592 - RNA, 20 nt, Human
aagaaaccauugugcuucug

SEQ ID NO: 129593 - RNA, 20 nt, Human
cccucucugccgcaggcugg

SEQ ID NO: 129594 - RNA, 25 nt, Human
cugucauggaagaggguggagccgc

SEQ ID NO: 129595 - RNA, 25 nt, Human
ugcagccucugccuccagcccggca

SEQ ID NO: 129596 - RNA, 22 nt, Human
cugucugugugucugucucucu

SEQ ID NO: 129597 - RNA, 22 nt, Human
gauaaauucugagauuuggagc

SEQ ID NO: 129598 - RNA, 18 nt, Human
uucuccuuuaagcacuua

SEQ ID NO: 129599 - RNA, 21 nt, Human
acuguucugucucauguuuau

SEQ ID NO: 129600 - RNA, 22 nt, Human
guggauuacaggcaugagccac

SEQ ID NO: 129601 - RNA, 22 nt, Human
aagggagggggcgggcaggugc

SEQ ID NO: 129602 - RNA, 22 nt, Human
guggugaaagcaagguucccca

SEQ ID NO: 129603 - RNA, 22 nt, Human
caggagauccuggacugccuga

SEQ ID NO: 129604 - RNA, 24 nt, Human
cgccaggagaaaaacuuaggccuc

SEQ ID NO: 129605 - RNA, 23 nt, Human
aaucuaggauuuuuuguuuuuug

SEQ ID NO: 129606 - RNA, 27 nt, Human
cugcucuguuuuaaaaacucagaggca

SEQ ID NO: 129607 - RNA, 26 nt, Human
cugccuuccugagucccuuccaguca

SEQ ID NO: 129608 - RNA, 21 nt, Human
cuucccccuuucuaaaaguuu

SEQ ID NO: 129609 - RNA, 27 nt, Human
ccaccuggccccaugucucucagaauu

SEQ ID NO: 129610 - RNA, 23 nt, Human
aagguaccuagggcucuugggag

SEQ ID NO: 129611 - RNA, 23 nt, Human
cagcaccacuuugccuuacuuga

SEQ ID NO: 129612 - RNA, 22 nt, Human
cuguguacacaucuauucucaa

SEQ ID NO: 129613 - RNA, 22 nt, Human
cugaguggcugagcucaggccu

SEQ ID NO: 129614 - RNA, 26 nt, Human
gaacacuggacaacauuuuacuacug

SEQ ID NO: 129615 - RNA, 23 nt, Human
ugggcugccucgugcagagacac

SEQ ID NO: 129616 - RNA, 23 nt, Human
aggagagcuuagggucucagggu

SEQ ID NO: 129617 - RNA, 21 nt, Human
uccaugaaggaagagaggaaa

SEQ ID NO: 129618 - RNA, 23 nt, Human
uccugcccugcagucacaugggu

SEQ ID NO: 129619 - RNA, 22 nt, Human
cacugcauuccagccugggcga

SEQ ID NO: 129620 - RNA, 23 nt, Human
ugggcacaucuuccuaaucuguu

SEQ ID NO: 129621 - RNA, 25 nt, Human
gaaagagaaagaagguauccuagga

SEQ ID NO: 129622 - RNA, 22 nt, Human
gcuauguugcccuuuggagaca

SEQ ID NO: 129623 - RNA, 22 nt, Human
ucucauuccacuguugguauua

SEQ ID NO: 129624 - RNA, 27 nt, Human
gugcuccgggauggagcaggugugcag

SEQ ID NO: 129625 - RNA, 27 nt, Human
uaagccacucugucccuuccugggcaa

SEQ ID NO: 129626 - RNA, 22 nt, Human
gccuguaauccagcuacucagg

SEQ ID NO: 129627 - RNA, 22 nt, Human
ucaucuuucccucacagaaaga

SEQ ID NO: 129628 - RNA, 22 nt, Human
ccgggcggcggagauugcagug

SEQ ID NO: 129629 - RNA, 22 nt, Human
ccgggaggcggagcuugcagug

SEQ ID NO: 129630 - RNA, 22 nt, Human
ucagaaaucuggagcuggcacu

SEQ ID NO: 129631 - RNA, 25 nt, Human
cgggcaggggcuggagggaggcggg

SEQ ID NO: 129632 - RNA, 26 nt, Human
gacggggucucguuuuguugccaaag

SEQ ID NO: 129633 - RNA, 20 nt, Human
acucuucucccuauacaagg

SEQ ID NO: 129634 - RNA, 21 nt, Human
cuugcccagguagugaucagu

SEQ ID NO: 129635 - RNA, 25 nt, Human
uaaaguguccauugacauguacaga

SEQ ID NO: 129636 - RNA, 21 nt, Human
agugauuugggggugcaauga

SEQ ID NO: 129637 - RNA, 26 nt, Human
ggcagaaaagcacauuuuaaaaacca

SEQ ID NO: 129638 - RNA, 23 nt, Human
gugggaggagggaggggccaggc

SEQ ID NO: 129639 - RNA, 20 nt, Human
ggcauauaggaagcacgcug

SEQ ID NO: 129640 - RNA, 22 nt, Human
uaacuggagaaagaagcuccau

SEQ ID NO: 129641 - RNA, 25 nt, Human
cuccaucuuuccaagcaccggggcg

SEQ ID NO: 129642 - RNA, 24 nt, Human
ccuccuuccuugggccugccucag

SEQ ID NO: 129643 - RNA, 26 nt, Human
uguugaggggaccaaagccaccaaga

SEQ ID NO: 129644 - RNA, 30 nt, Human
cuuccccagcuccgccuccccacacuccuc

SEQ ID NO: 129645 - RNA, 27 nt, Human
ggcuagcaaucugccuguaucucucac

SEQ ID NO: 129646 - RNA, 18 nt, Human
cagcccucgucaccacag

SEQ ID NO: 129647 - RNA, 25 nt, Human
gacuggccuggcccugagacugggg

SEQ ID NO: 129648 - RNA, 20 nt, Human
gccgguucccuccucuccag

SEQ ID NO: 129649 - RNA, 21 nt, Human
cuuccucccuccucuuucaca

SEQ ID NO: 129650 - RNA, 26 nt, Human
ggcaggugccuggacauuugccuugc

SEQ ID NO: 129651 - RNA, 22 nt, Human
aggcuuacaggguguacacaca

SEQ ID NO: 129652 - RNA, 22 nt, Human
ucuuuguaguccagggcagcag

SEQ ID NO: 129653 - RNA, 28 nt, Human
accguguguuaucacagugcaguuuuaa

SEQ ID NO: 129654 - RNA, 23 nt, Human
caccagcucuccagccaggacga

SEQ ID NO: 129655 - RNA, 18 nt, Human
ucccccuucucugaggcc

SEQ ID NO: 129656 - RNA, 24 nt, Human
agcuuaaaauaauuuuauuuacaa

SEQ ID NO: 129657 - RNA, 19 nt, Human
ucugaggcaaagaugggga

SEQ ID NO: 129658 - RNA, 21 nt, Human
gagaaacccugagaaacccca

SEQ ID NO: 129659 - RNA, 27 nt, Human
ugcccgcauuagcucuuagacccacag

SEQ ID NO: 129660 - RNA, 24 nt, Human
aucaugcgccgcccuccuccaucg

SEQ ID NO: 129661 - RNA, 24 nt, Human
gccuguguccucaucgccuuccac

SEQ ID NO: 129662 - RNA, 18 nt, Human
gaacccaggagguguugc

SEQ ID NO: 129663 - RNA, 24 nt, Human
uaauaugcugcaacaaaauguaga

SEQ ID NO: 129664 - RNA, 18 nt, Human
agagaauacauucucuau

SEQ ID NO: 129665 - RNA, 21 nt, Human
ccagcaucuucuguuuccugg

SEQ ID NO: 129666 - RNA, 23 nt, Human
cugcagccuccaccucccaggcu

SEQ ID NO: 129667 - RNA, 26 nt, Human
ccagcuagucucuucucuucugugau

SEQ ID NO: 129668 - RNA, 23 nt, Human
ccuaaaaugccugagauggcugu

SEQ ID NO: 129669 - RNA, 23 nt, Human
ccagccgccagucauggacacag

SEQ ID NO: 129670 - RNA, 23 nt, Human
acacugaaauauacacacagcag

SEQ ID NO: 129671 - RNA, 22 nt, Human
uucuuuauuuuuucuuuuuuac

SEQ ID NO: 129672 - RNA, 23 nt, Human
ccacagaagacacugucucaaau

SEQ ID NO: 129673 - RNA, 24 nt, Human
uccucauugauccucuucaguugg

SEQ ID NO: 129674 - RNA, 19 nt, Human
aaccuacauggagaccuua

SEQ ID NO: 129675 - RNA, 21 nt, Human
uuauuuuaaaacagaagaauu

SEQ ID NO: 129676 - RNA, 21 nt, Human
accuagcccaggcuuggaggc

SEQ ID NO: 129677 - RNA, 27 nt, Human
acgcacaggcuggagugcaguggcucc

SEQ ID NO: 129678 - RNA, 20 nt, Human
ccagacccacaaggccaggu

SEQ ID NO: 129679 - RNA, 23 nt, Human
caaggaagucucucuaggcugca

SEQ ID NO: 129680 - RNA, 19 nt, Human
agccucucccccauucugu

SEQ ID NO: 129681 - RNA, 27 nt, Human
uuugcuccccuuugcuugaagagaccc

SEQ ID NO: 129682 - RNA, 20 nt, Human
gcucacuguggccagcuuug

SEQ ID NO: 129683 - RNA, 21 nt, Human
gcuggugguguuccaauaaug

SEQ ID NO: 129684 - RNA, 19 nt, Human
ccucagcccaugcccagcu

SEQ ID NO: 129685 - RNA, 23 nt, Human
aaccuguuccuuggauaggcuuu

SEQ ID NO: 129686 - RNA, 24 nt, Human
ucaggacuaauucccuuacugcaa

SEQ ID NO: 129687 - RNA, 23 nt, Human
ucccacccucuuuggcuuuagcc

SEQ ID NO: 129688 - RNA, 22 nt, Human
auuggagcucugcgacaauggc

SEQ ID NO: 129689 - RNA, 26 nt, Human
guccagaguuccuguguagcacgggg

SEQ ID NO: 129690 - RNA, 22 nt, Human
cacugagggggcaguguggcuc

SEQ ID NO: 129691 - RNA, 24 nt, Human
acuugccaaaauaauacauacuuc

SEQ ID NO: 129692 - RNA, 24 nt, Human
cuggucugugcugcccugcucugg

SEQ ID NO: 129693 - RNA, 24 nt, Human
cacuugaggucaggaguucaacau

SEQ ID NO: 129694 - RNA, 25 nt, Human
gccaaaaauauagcucacuuaucua

SEQ ID NO: 129695 - RNA, 21 nt, Human
ucaucccucuggcagucacgc

SEQ ID NO: 129696 - RNA, 22 nt, Human
cgugggcuggcggcgggaccag

SEQ ID NO: 129697 - RNA, 22 nt, Human
gugcaggcuggggucaggacag

SEQ ID NO: 129698 - RNA, 18 nt, Human
gauacuuguuucuuuuca

SEQ ID NO: 129699 - RNA, 21 nt, Human
gcgucacccaagcacacucac

SEQ ID NO: 129700 - RNA, 27 nt, Human
gcaaaguuuaauggugccuucauuugg

SEQ ID NO: 129701 - RNA, 27 nt, Human
gucacccaggcuggaguacacuggcac

SEQ ID NO: 129702 - RNA, 22 nt, Human
aggauuacaggcaugagccacc

SEQ ID NO: 129703 - RNA, 22 nt, Human
ccuccacaugcaccugcuagug

SEQ ID NO: 129704 - RNA, 20 nt, Human
ccuaauccccucugccugcc

SEQ ID NO: 129705 - RNA, 27 nt, Human
ugucauugacucgauuuaaacuccagc

SEQ ID NO: 129706 - RNA, 23 nt, Human
ugccuguaaucccauguacucug

SEQ ID NO: 129707 - RNA, 25 nt, Human
ggaaaacaaaacacagguuuuuuca

SEQ ID NO: 129708 - RNA, 27 nt, Human
ccgugugcuuuaccaaaggauauggaa

SEQ ID NO: 129709 - RNA, 23 nt, Human
guaaagucggugauuauauuuuu

SEQ ID NO: 129710 - RNA, 23 nt, Human
ccccugcccccucaguuuuccac

SEQ ID NO: 129711 - RNA, 24 nt, Human
cccugcaggcuagggguuagggug

SEQ ID NO: 129712 - RNA, 27 nt, Human
gucucgaacuccuggccucaagugauc

SEQ ID NO: 129713 - RNA, 20 nt, Human
ggcagaaucuugcucuguca

SEQ ID NO: 129714 - RNA, 21 nt, Human
cuaaucugcuaucuucauucc

SEQ ID NO: 129715 - RNA, 21 nt, Human
ugcagaggcacagcacaagua

SEQ ID NO: 129716 - RNA, 21 nt, Human
ugucagccuuaucaguguuua

SEQ ID NO: 129717 - RNA, 26 nt, Human
gguaggagaaggaggucugaaacccu

SEQ ID NO: 129718 - RNA, 19 nt, Human
ucaucccaaguuucccagg

SEQ ID NO: 129719 - RNA, 22 nt, Human
ggcuuucuagagcagcguagac

SEQ ID NO: 129720 - RNA, 22 nt, Human
cugggcuuggaggcugccuaga

SEQ ID NO: 129721 - RNA, 27 nt, Human
ccagcuccuuauuuuuuaauguagaau

SEQ ID NO: 129722 - RNA, 27 nt, Human
gaaaugagauaaaagauguacuuguga

SEQ ID NO: 129723 - RNA, 26 nt, Human
agcuguuuaauguuaagucaugacaa

SEQ ID NO: 129724 - RNA, 19 nt, Human
cuaauuguaucauaaagcc

SEQ ID NO: 129725 - RNA, 21 nt, Human
cuuaggaggcugaggugggag

SEQ ID NO: 129726 - RNA, 24 nt, Human
gcucccuucccuugccccuucggg

SEQ ID NO: 129727 - RNA, 28 nt, Human
aacugguauucaaaaaugaauaacagcc

SEQ ID NO: 129728 - RNA, 22 nt, Human
uucuuuauauuugauuguguuu

SEQ ID NO: 129729 - RNA, 21 nt, Human
acuaaugaggaaacugcacug

SEQ ID NO: 129730 - RNA, 21 nt, Human
gagaagagugaucuggcuucu

SEQ ID NO: 129731 - RNA, 26 nt, Human
cugagguaacggauaaguuuauacca

SEQ ID NO: 129732 - RNA, 27 nt, Human
gagagugagcgggacuaggcugcgccu

SEQ ID NO: 129733 - RNA, 27 nt, Human
cugcuucugccugcuuuccaccucccc

SEQ ID NO: 129734 - RNA, 19 nt, Human
uaaauauuuuaaaugagug

SEQ ID NO: 129735 - RNA, 18 nt, Human
gucccccuccugccucau

SEQ ID NO: 129736 - RNA, 22 nt, Human
gcugaaaaccaccuggucugca

SEQ ID NO: 129737 - RNA, 21 nt, Human
ccuaaagauucauuugcuuuc

SEQ ID NO: 129738 - RNA, 18 nt, Human
caguaauuguaaagugau

SEQ ID NO: 129739 - RNA, 24 nt, Human
uuucaacaaaaaagcaaacagaga

SEQ ID NO: 129740 - RNA, 22 nt, Human
cugaggcaggaggauuguuuga

SEQ ID NO: 129741 - RNA, 17 nt, Human
cccuuccuccugggcca

SEQ ID NO: 129742 - RNA, 25 nt, Human
ggagagggagaccuagagaucuggc

SEQ ID NO: 129743 - RNA, 22 nt, Human
ucuccuaucaccugucuugccu

SEQ ID NO: 129744 - RNA, 27 nt, Human
ccacaaacuugacaccugaucaggucu

SEQ ID NO: 129745 - RNA, 25 nt, Human
aagugcuaugcuauuuccugguuau

SEQ ID NO: 129746 - RNA, 25 nt, Human
ggccuacucaaucucucccaccuca

SEQ ID NO: 129747 - RNA, 24 nt, Human
ugucacccaaaccggcaggugcga

SEQ ID NO: 129748 - RNA, 23 nt, Human
cccuaaccuuggaggcccgggag

SEQ ID NO: 129749 - RNA, 24 nt, Human
ccugccguuuccccuccuuggguu

SEQ ID NO: 129750 - RNA, 28 nt, Human
cugccuuugcaugggccuggcccggcuc

SEQ ID NO: 129751 - RNA, 23 nt, Human
ucugccucuggccgcggccugug

SEQ ID NO: 129752 - RNA, 27 nt, Human
uccugcuggaaccucagcugcaacaug

SEQ ID NO: 129753 - RNA, 26 nt, Human
ugacugaggcaggcauggaguugggc

SEQ ID NO: 129754 - RNA, 27 nt, Human
auuugaaaacacugcuguucuuuaaau

SEQ ID NO: 129755 - RNA, 26 nt, Human
ccuuugcauuuauuuauacagugccu

SEQ ID NO: 129756 - RNA, 23 nt, Human
uccuucggggcaccucaggcagc

SEQ ID NO: 129757 - RNA, 21 nt, Human
agguacccaugaaugugagcu

SEQ ID NO: 129758 - RNA, 26 nt, Human
gcaugcuggggcccuaccagcagcug

SEQ ID NO: 129759 - RNA, 22 nt, Human
cuauaugguucuccaagaaacu

SEQ ID NO: 129760 - RNA, 22 nt, Human
agguguaaugcuacacaaguca

SEQ ID NO: 129761 - RNA, 26 nt, Human
ugccugcacucccagcaugccaugca

SEQ ID NO: 129762 - RNA, 18 nt, Human
uaagccuuuuauacugau

SEQ ID NO: 129763 - RNA, 21 nt, Human
ugagcuggggagggaggcagg

SEQ ID NO: 129764 - RNA, 25 nt, Human
ucgggcuuagggccugcuguggagg

SEQ ID NO: 129765 - RNA, 22 nt, Human
ucccaggacaccacacccagcc

SEQ ID NO: 129766 - RNA, 22 nt, Human
gagaguuacagaaaugggagac

SEQ ID NO: 129767 - RNA, 27 nt, Human
uggccgcuguguucaucgacuuccuca

SEQ ID NO: 129768 - RNA, 26 nt, Human
cuuaacaaaugagaacuacuuaaagg

SEQ ID NO: 129769 - RNA, 21 nt, Human
ccacuugccaggccuccugca

SEQ ID NO: 129770 - RNA, 18 nt, Human
gggucuuggcugccugug

SEQ ID NO: 129771 - RNA, 20 nt, Human
cucgccccuccccucagccu

SEQ ID NO: 129772 - RNA, 20 nt, Human
acuuggaccugggaugagga

SEQ ID NO: 129773 - RNA, 22 nt, Human
cacucaccucaccucugccugc

SEQ ID NO: 129774 - RNA, 19 nt, Human
agagcagcccugcccagau

SEQ ID NO: 129775 - RNA, 27 nt, Human
gcaggaaacauagaacucagagccaga

SEQ ID NO: 129776 - RNA, 23 nt, Human
aagcacccagagaucaauuggga

SEQ ID NO: 129777 - RNA, 27 nt, Human
ccagcugucugcgcgucugacucuugu

SEQ ID NO: 129778 - RNA, 23 nt, Human
uucuucuucuuuauuauucuuug

SEQ ID NO: 129779 - RNA, 22 nt, Human
cuuuguauuacuuagguuauuu

SEQ ID NO: 129780 - RNA, 21 nt, Human
ccauguggguccuuucugugc

SEQ ID NO: 129781 - RNA, 22 nt, Human
caggcuggagcugccuggggca

SEQ ID NO: 129782 - RNA, 27 nt, Human
uuucucucuggaaaggauuuucauuca

SEQ ID NO: 129783 - RNA, 22 nt, Human
uuucuccacaucuucugaggcu

SEQ ID NO: 129784 - RNA, 28 nt, Human
gggucuugguccaccuuccagcacaagg

SEQ ID NO: 129785 - RNA, 22 nt, Human
cagcaggcucaggcacauacac

SEQ ID NO: 129786 - RNA, 23 nt, Human
auuuugcguuucuuacugccuuc

SEQ ID NO: 129787 - RNA, 24 nt, Human
caggcccagagggcuucccaguaa

SEQ ID NO: 129788 - RNA, 23 nt, Human
agguccaaagaggagagcuguuc

SEQ ID NO: 129789 - RNA, 26 nt, Human
ugacaccugagcaguguccagaaccu

SEQ ID NO: 129790 - RNA, 20 nt, Human
cugcuacuaaaauguucuca

SEQ ID NO: 129791 - RNA, 21 nt, Human
aucuucuguuccacauccaca

SEQ ID NO: 129792 - RNA, 23 nt, Human
ccgaggcuggagugcaguggcgc

SEQ ID NO: 129793 - RNA, 19 nt, Human
auuuuucuuagcagacugc

SEQ ID NO: 129794 - RNA, 21 nt, Human
cggaaucaucggaauccuuca

SEQ ID NO: 129795 - RNA, 20 nt, Human
ucuccacccuacugcgugcu

SEQ ID NO: 129796 - RNA, 20 nt, Human
uccaguccaggacacuggug

SEQ ID NO: 129797 - RNA, 21 nt, Human
uugucacccaggcuggaguac

SEQ ID NO: 129798 - RNA, 24 nt, Human
cugugcccucuccauuccacugcu

SEQ ID NO: 129799 - RNA, 23 nt, Human
uuauuuugcaaaagccuuucaga

SEQ ID NO: 129800 - RNA, 24 nt, Human
guucccuucugccaccugccuucu

SEQ ID NO: 129801 - RNA, 20 nt, Human
cagggagggagcugaggagc

SEQ ID NO: 129802 - RNA, 25 nt, Human
gugccuugccagcacuaacauucua

SEQ ID NO: 129803 - RNA, 25 nt, Human
gcucugaaguuaaaaugauuuacau

SEQ ID NO: 129804 - RNA, 22 nt, Human
uggccaugugacccucucccca

SEQ ID NO: 129805 - RNA, 27 nt, Human
cuggcuucuacacuggguucugcuacu

SEQ ID NO: 129806 - RNA, 28 nt, Human
ugcucccucuuccucuagcugagagugg

SEQ ID NO: 129807 - RNA, 22 nt, Human
uucuaaaaucacuuuuuucccu

SEQ ID NO: 129808 - RNA, 28 nt, Human
ucugccacugcccugccucuccucuggc

SEQ ID NO: 129809 - RNA, 23 nt, Human
ugucgcccaggcuggagggcagu

SEQ ID NO: 129810 - RNA, 23 nt, Human
ugucgcccaugcuggagugcagu

SEQ ID NO: 129811 - RNA, 21 nt, Human
auagaccacagccaaagccuu

SEQ ID NO: 129812 - RNA, 19 nt, Human
acggaaaagagcaagcuca

SEQ ID NO: 129813 - RNA, 23 nt, Human
aaaugccaccaaugccaagugcc

SEQ ID NO: 129814 - RNA, 22 nt, Human
auaugcagagccccaaggccac

SEQ ID NO: 129815 - RNA, 21 nt, Human
cggaucccugaaaccaaaaag

SEQ ID NO: 129816 - RNA, 21 nt, Human
uaggcugcgggccacgcccag

SEQ ID NO: 129817 - RNA, 20 nt, Human
uuuagaacccaaauuuugga

SEQ ID NO: 129818 - RNA, 18 nt, Human
ccacacugcugaccugcc

SEQ ID NO: 129819 - RNA, 27 nt, Human
caggcagcauggugaggucugcucccg

SEQ ID NO: 129820 - RNA, 20 nt, Human
cgccaaguuggagugcaaug

SEQ ID NO: 129821 - RNA, 21 nt, Human
ugcguggaaucagaccucuuu

SEQ ID NO: 129822 - RNA, 21 nt, Human
caucuuaauuaaaaauaaaug

SEQ ID NO: 129823 - RNA, 21 nt, Human
uggggccggagccgcagugag

SEQ ID NO: 129824 - RNA, 23 nt, Human
gcaaaaacuuucagcauuaaaua

SEQ ID NO: 129825 - RNA, 22 nt, Human
gcacuccggagguagagguugu

SEQ ID NO: 129826 - RNA, 19 nt, Human
gcagcuggcccaggaagag

SEQ ID NO: 129827 - RNA, 27 nt, Human
gagcuggguggaaacugcuuugcacua

SEQ ID NO: 129828 - RNA, 24 nt, Human
acugccucucggcugugcuccgug

SEQ ID NO: 129829 - RNA, 21 nt, Human
cgagccgagcccugcccccgc

SEQ ID NO: 129830 - RNA, 27 nt, Human
aucuguauauuuuccugcucugccuuc

SEQ ID NO: 129831 - RNA, 23 nt, Human
agacugagcucuccaggccaggu

SEQ ID NO: 129832 - RNA, 22 nt, Human
ugcugcccggaaggaucagugg

SEQ ID NO: 129833 - RNA, 24 nt, Human
uuaugaaguaccacaacaaaaagg

SEQ ID NO: 129834 - RNA, 21 nt, Human
uccccuguagggucagagaca

SEQ ID NO: 129835 - RNA, 26 nt, Human
cugcacauagcaggugcucaguaaau

SEQ ID NO: 129836 - RNA, 21 nt, Human
ggggagacggagguugcagug

SEQ ID NO: 129837 - RNA, 20 nt, Human
uuaucuauuuguucucccuu

SEQ ID NO: 129838 - RNA, 24 nt, Human
ucuuuuccuacuuuuccuucccuc

SEQ ID NO: 129839 - RNA, 21 nt, Human
gggaauagaaauguuugcuga

SEQ ID NO: 129840 - RNA, 27 nt, Human
gcugagucugcagaauggaaugcagcu

SEQ ID NO: 129841 - RNA, 18 nt, Human
gaagagagagaccucgga

SEQ ID NO: 129842 - RNA, 28 nt, Human
cagucacaaagcuguuuucacuguggcc

SEQ ID NO: 129843 - RNA, 21 nt, Human
cuugcuccuguucucagccug

SEQ ID NO: 129844 - RNA, 19 nt, Human
cauaccacguuuugcucaa

SEQ ID NO: 129845 - RNA, 23 nt, Human
ccucacuggccugucccugcugc

SEQ ID NO: 129846 - RNA, 24 nt, Human
agaggcagcgaggacggagaggac

SEQ ID NO: 129847 - RNA, 21 nt, Human
aagagccucuuauaaacucca

SEQ ID NO: 129848 - RNA, 22 nt, Human
ggcagggagucuggugccugca

SEQ ID NO: 129849 - RNA, 21 nt, Human
cccaguaacacguuucuaccc

SEQ ID NO: 129850 - RNA, 26 nt, Human
gagcccaggccacauggaugaugaug

SEQ ID NO: 129851 - RNA, 20 nt, Human
cgagggggacgggagagggc

SEQ ID NO: 129852 - RNA, 22 nt, Human
ucaccuaucauucuauacaaca

SEQ ID NO: 129853 - RNA, 21 nt, Human
aaauguucuuuauacagccua

SEQ ID NO: 129854 - RNA, 22 nt, Human
cgggaggcagagguugucauga

SEQ ID NO: 129855 - RNA, 22 nt, Human
ccagaggcagagguugugguga

SEQ ID NO: 129856 - RNA, 22 nt, Human
acauuaaaaauguagcugacuu

SEQ ID NO: 129857 - RNA, 23 nt, Human
agaauugaaagguguugguuaag

SEQ ID NO: 129858 - RNA, 21 nt, Human
agcccggacccgggggcuggc

SEQ ID NO: 129859 - RNA, 18 nt, Human
ggcucaauuucagucuuc

SEQ ID NO: 129860 - RNA, 21 nt, Human
ccauuaaauacauuuguauuu

SEQ ID NO: 129861 - RNA, 24 nt, Human
gauuuugguauuacacuguauuug

SEQ ID NO: 129862 - RNA, 20 nt, Human
ccagguacuugagaaacccc

SEQ ID NO: 129863 - RNA, 22 nt, Human
uccaaagugcugggauuacagg

SEQ ID NO: 129864 - RNA, 25 nt, Human
acccaggcugaagugcaguggagca

SEQ ID NO: 129865 - RNA, 24 nt, Human
ccaccaggagucuggagugcaaug

SEQ ID NO: 129866 - RNA, 24 nt, Human
gaccucaagugaucugcccgccuc

SEQ ID NO: 129867 - RNA, 19 nt, Human
aauucaugccccaguauua

SEQ ID NO: 129868 - RNA, 23 nt, Human
accagcaccaggggcucucuaga

SEQ ID NO: 129869 - RNA, 24 nt, Human
ggagccccccucaacacggaccgc

SEQ ID NO: 129870 - RNA, 26 nt, Human
agaugccacccuagccaaugucuccu

SEQ ID NO: 129871 - RNA, 24 nt, Human
caccugaagucaggaguucaagac

SEQ ID NO: 129872 - RNA, 22 nt, Human
ugccuguaauccuagcacuuug

SEQ ID NO: 129873 - RNA, 22 nt, Human
gcucagugcaaccucugccucc

SEQ ID NO: 129874 - RNA, 22 nt, Human
agcuuucuuaacuguuuuuugu

SEQ ID NO: 129875 - RNA, 21 nt, Human
gggaaagagacagagugcuga

SEQ ID NO: 129876 - RNA, 22 nt, Human
ucucgccaggcuggaguguagu

SEQ ID NO: 129877 - RNA, 22 nt, Human
cggccggcuggagcugggagug

SEQ ID NO: 129878 - RNA, 22 nt, Human
ucugcgccugccccacacccuc

SEQ ID NO: 129879 - RNA, 24 nt, Human
ucaggaagaauauaaugaacugua

SEQ ID NO: 129880 - RNA, 22 nt, Human
acuccaguaacugcugucgcuc

SEQ ID NO: 129881 - RNA, 21 nt, Human
uacauuuaggguucaccagga

SEQ ID NO: 129882 - RNA, 19 nt, Human
uaauugccuuugagguuau

SEQ ID NO: 129883 - RNA, 22 nt, Human
ccaacaucgugaaacccugucu

SEQ ID NO: 129884 - RNA, 22 nt, Human
ucaaugcuauuaacaguaucag

SEQ ID NO: 129885 - RNA, 23 nt, Human
ugaggcuucuuccuggauggggc

SEQ ID NO: 129886 - RNA, 23 nt, Human
auuguaagugaaaacugagggaa

SEQ ID NO: 129887 - RNA, 27 nt, Human
uuagguuggucuuaagcaguguuagaa

SEQ ID NO: 129888 - RNA, 25 nt, Human
ucacugaucuggacucaccucugga

SEQ ID NO: 129889 - RNA, 21 nt, Human
ccccucucucccuccuguguc

SEQ ID NO: 129890 - RNA, 19 nt, Human
aauuugaaauuucuaaauu

SEQ ID NO: 129891 - RNA, 22 nt, Human
cagaagguugacagcuucagua

SEQ ID NO: 129892 - RNA, 25 nt, Human
ccccacagccucagcaucuucagca

SEQ ID NO: 129893 - RNA, 24 nt, Human
gcuuuuccuggagucucuugguga

SEQ ID NO: 129894 - RNA, 29 nt, Human
cucucagcuggagcuuccauaccuucugg

SEQ ID NO: 129895 - RNA, 22 nt, Human
gggauuacaggcaugugccaca

SEQ ID NO: 129896 - RNA, 21 nt, Human
uuccucuuaagaccucuguca

SEQ ID NO: 129897 - RNA, 23 nt, Human
uccugggccagaaguagaggggg

SEQ ID NO: 129898 - RNA, 27 nt, Human
agaaauucucugugauuaagaagauaa

SEQ ID NO: 129899 - RNA, 22 nt, Human
ccaaaguauugggauuacccgc

SEQ ID NO: 129900 - RNA, 26 nt, Human
aauccuucugaagcaaagcaccacga

SEQ ID NO: 129901 - RNA, 26 nt, Human
ggagagggaagaugggccccaccagc

SEQ ID NO: 129902 - RNA, 23 nt, Human
acaccuaaacaacaaccaaaaau

SEQ ID NO: 129903 - RNA, 23 nt, Human
ucccaggcugaagugcagugagu

SEQ ID NO: 129904 - RNA, 23 nt, Human
ugucuggaacuauugguucuaag

SEQ ID NO: 129905 - RNA, 21 nt, Human
uccagggcuagagcaagcgcg

SEQ ID NO: 129906 - RNA, 27 nt, Human
agcucugcauuugucuauucuccagcu

SEQ ID NO: 129907 - RNA, 25 nt, Human
acacauuuacauauauauaaaguau

SEQ ID NO: 129908 - RNA, 25 nt, Human
aucuccaucucccaaagugcuggga

SEQ ID NO: 129909 - RNA, 22 nt, Human
agagcaucaucuuguucagccu

SEQ ID NO: 129910 - RNA, 26 nt, Human
auacauacaucuaucuacaucugccu

SEQ ID NO: 129911 - RNA, 23 nt, Human
uguuuccccgugggucucugggc

SEQ ID NO: 129912 - RNA, 17 nt, Human
agucacugcauuugccu

SEQ ID NO: 129913 - RNA, 24 nt, Human
acuaaaaauuagccaaguguggua

SEQ ID NO: 129914 - RNA, 22 nt, Human
uauccuuuuuaaaaaauguugu

SEQ ID NO: 129915 - RNA, 24 nt, Human
ccuaucucccuugaaaaguacacc

SEQ ID NO: 129916 - RNA, 26 nt, Human
aauggcggucgcucgugcagcuuugg

SEQ ID NO: 129917 - RNA, 26 nt, Human
ggggaauggggugggggugggagagg

SEQ ID NO: 129918 - RNA, 20 nt, Human
agaaauguucuaguguagag

SEQ ID NO: 129919 - RNA, 23 nt, Human
ggaggggaagaaaguucuacgua

SEQ ID NO: 129920 - RNA, 23 nt, Human
gagcucaagcgaucuaccugccu

SEQ ID NO: 129921 - RNA, 27 nt, Human
gggaucugaauagagugaaagguugga

SEQ ID NO: 129922 - RNA, 24 nt, Human
agcgggccucauccuacacccuca

SEQ ID NO: 129923 - RNA, 24 nt, Human
uuaagaacugacacaaaggacaaa

SEQ ID NO: 129924 - RNA, 20 nt, Human
cccaccccaccaugucccca

SEQ ID NO: 129925 - RNA, 19 nt, Human
gagguggagcuugcaguga

SEQ ID NO: 129926 - RNA, 21 nt, Human
guguuuuuauauugacucugc

SEQ ID NO: 129927 - RNA, 21 nt, Human
guccagaauuuuuuguuuucu

SEQ ID NO: 129928 - RNA, 20 nt, Human
aaggugucauuugacaacac

SEQ ID NO: 129929 - RNA, 20 nt, Human
ucacccuguguccuuaggag

SEQ ID NO: 129930 - RNA, 22 nt, Human
guugacuaucaaagagugcaga

SEQ ID NO: 129931 - RNA, 23 nt, Human
ggcugagcuggggaccugguacc

SEQ ID NO: 129932 - RNA, 24 nt, Human
gacuaauugcccugcuguuuuacu

SEQ ID NO: 129933 - RNA, 24 nt, Human
ccuuguuccucagauagcguucau

SEQ ID NO: 129934 - RNA, 25 nt, Human
cucuuugcucuauggcccuuccuca

SEQ ID NO: 129935 - RNA, 23 nt, Human
ccagcugcagguggcaucugcca

SEQ ID NO: 129936 - RNA, 27 nt, Human
aucauucuauuugcuuuauuaucggug

SEQ ID NO: 129937 - RNA, 22 nt, Human
acucauuuuaguggcugccucc

SEQ ID NO: 129938 - RNA, 22 nt, Human
guucacugcaaccucugccucc

SEQ ID NO: 129939 - RNA, 22 nt, Human
agaagaaggugggaggauguga

SEQ ID NO: 129940 - RNA, 21 nt, Human
ccagcuaacaguaauucuucc

SEQ ID NO: 129941 - RNA, 23 nt, Human
aucacacagaauuggagugcugu

SEQ ID NO: 129942 - RNA, 25 nt, Human
uuaagaaaggaaaauaucccaagga

SEQ ID NO: 129943 - RNA, 22 nt, Human
ccugccugucccauccccaugc

SEQ ID NO: 129944 - RNA, 19 nt, Human
acaaaccuacauguacaua

SEQ ID NO: 129945 - RNA, 22 nt, Human
ugauauguguaauaucauuuca

SEQ ID NO: 129946 - RNA, 27 nt, Human
uccagcgugccgaccacaaagcucuuc

SEQ ID NO: 129947 - RNA, 27 nt, Human
gguuuugaacuccuggcuucaagcgau

SEQ ID NO: 129948 - RNA, 20 nt, Human
gcuuaagggaaaugagggaa

SEQ ID NO: 129949 - RNA, 22 nt, Human
cuuugcuuguucacugcagucu

SEQ ID NO: 129950 - RNA, 15 nt, Human
cuucccuuacaguca

SEQ ID NO: 129951 - RNA, 22 nt, Human
guucacuggggguguauggggu

SEQ ID NO: 129952 - RNA, 23 nt, Human
gggccucuucaucagcagccugc

SEQ ID NO: 129953 - RNA, 19 nt, Human
cuggcugcuacccgcccgc

SEQ ID NO: 129954 - RNA, 24 nt, Human
ugagagaaggagaggaagauacag

SEQ ID NO: 129955 - RNA, 21 nt, Human
gcaguuccuuaccucccuggu

SEQ ID NO: 129956 - RNA, 22 nt, Human
aucucuagcuuauccucaguuc

SEQ ID NO: 129957 - RNA, 27 nt, Human
uucucuuccugguaauccucuggccca

SEQ ID NO: 129958 - RNA, 27 nt, Human
caccgccgccucggaacccaggccugg

SEQ ID NO: 129959 - RNA, 21 nt, Human
gaagaaagaagaagcgcugca

SEQ ID NO: 129960 - RNA, 21 nt, Human
accuguaauuccagcacuuug

SEQ ID NO: 129961 - RNA, 21 nt, Human
aucuguaaucccagcacuuug

SEQ ID NO: 129962 - RNA, 19 nt, Human
ugggcagcugauaauuuaa

SEQ ID NO: 129963 - RNA, 22 nt, Human
aggguccauuuuucuuccagga

SEQ ID NO: 129964 - RNA, 23 nt, Human
ucacccagggacuccaguucaca

SEQ ID NO: 129965 - RNA, 23 nt, Human
aaagcgagcauuuucauucuucc

SEQ ID NO: 129966 - RNA, 20 nt, Human
augagggagaaggaagcagc

SEQ ID NO: 129967 - RNA, 22 nt, Human
ccuguucuuccuccagcugcac

SEQ ID NO: 129968 - RNA, 24 nt, Human
cccuuccuuccuucuccugggacu

SEQ ID NO: 129969 - RNA, 27 nt, Human
caccacugcuggcuucagccccuugag

SEQ ID NO: 129970 - RNA, 24 nt, Human
ugcccaggugguggcugcaaggug

SEQ ID NO: 129971 - RNA, 20 nt, Human
ccugcagcugccuagacccc

SEQ ID NO: 129972 - RNA, 21 nt, Human
cagccacacccccugccuucc

SEQ ID NO: 129973 - RNA, 19 nt, Human
uugcugucuagccuuaguc

SEQ ID NO: 129974 - RNA, 21 nt, Human
ccaggcugggaauugcagugg

SEQ ID NO: 129975 - RNA, 25 nt, Human
caaucuuugcuauaauuguauaaag

SEQ ID NO: 129976 - RNA, 27 nt, Human
uaaaugauguggugccugaggucugua

SEQ ID NO: 129977 - RNA, 22 nt, Human
gcucauuccuguaaucccagca

SEQ ID NO: 129978 - RNA, 19 nt, Human
gaccaagcagagcucacag

SEQ ID NO: 129979 - RNA, 26 nt, Human
gucucuucuuuaugucuaccuccucc

SEQ ID NO: 129980 - RNA, 21 nt, Human
aaucguauuauaaauauuuca

SEQ ID NO: 129981 - RNA, 23 nt, Human
auaaauacaaagcccauucuucc

SEQ ID NO: 129982 - RNA, 24 nt, Human
cuccccaggugaccugcucucuuu

SEQ ID NO: 129983 - RNA, 21 nt, Human
caggcagcuggggcugaguga

SEQ ID NO: 129984 - RNA, 22 nt, Human
ccaacguggugaaacuccgucu

SEQ ID NO: 129985 - RNA, 20 nt, Human
cagcccagcgccauccugag

SEQ ID NO: 129986 - RNA, 27 nt, Human
aaagugcugggauuacaugagccacca

SEQ ID NO: 129987 - RNA, 20 nt, Human
cacccaggcuggagugcagu

SEQ ID NO: 129988 - RNA, 20 nt, Human
cacccaggcuagagugcaau

SEQ ID NO: 129989 - RNA, 24 nt, Human
ucauuucucccuugagucacaagg

SEQ ID NO: 129990 - RNA, 26 nt, Human
auacacaugggguggaaaggccaggc

SEQ ID NO: 129991 - RNA, 19 nt, Human
uauaaaaauauuaaaagaa

SEQ ID NO: 129992 - RNA, 23 nt, Human
agcacagauuccagaggucacag

SEQ ID NO: 129993 - RNA, 20 nt, Human
cccggaccagccccuccucc

SEQ ID NO: 129994 - RNA, 22 nt, Human
guaggcagaucaccugagguca

SEQ ID NO: 129995 - RNA, 24 nt, Human
ccgagcccgccgccacauccucug

SEQ ID NO: 129996 - RNA, 22 nt, Human
agucacccagacuagaggucag

SEQ ID NO: 129997 - RNA, 20 nt, Human
agcugaaagcaccuagcuca

SEQ ID NO: 129998 - RNA, 22 nt, Human
cuucaaacuaggggacaaagca

SEQ ID NO: 129999 - RNA, 20 nt, Human
gcacuuagaaugauguaaua

SEQ ID NO: 130000 - RNA, 23 nt, Human
agggccugagcaggaaagacugg

SEQ ID NO: 130001 - RNA, 27 nt, Human
ugaacccuuccccugggaggugagggc

SEQ ID NO: 130002 - RNA, 22 nt, Human
ggcuguaauuaggggauuuggg

SEQ ID NO: 130003 - RNA, 26 nt, Human
ugcuauugugauauuuuagcacuuug

SEQ ID NO: 130004 - RNA, 24 nt, Human
cauucagugcaagggagaucaugu

SEQ ID NO: 130005 - RNA, 27 nt, Human
auaaucagcucugcauacaucugaaga

SEQ ID NO: 130006 - RNA, 26 nt, Human
ugguauuuauuuuuucuuuucuuuac

SEQ ID NO: 130007 - RNA, 20 nt, Human
ucauuuguccuuuucugcua

SEQ ID NO: 130008 - RNA, 21 nt, Human
ccuagcaugagguggcaugua

SEQ ID NO: 130009 - RNA, 25 nt, Human
ugccuccuccuaaguagcugggacu

SEQ ID NO: 130010 - RNA, 21 nt, Human
agggacacuuucacaguccug

SEQ ID NO: 130011 - RNA, 22 nt, Human
acugcuguuccugucacacauu

SEQ ID NO: 130012 - RNA, 25 nt, Human
ccuccuuccuguucaccuuugccuu

SEQ ID NO: 130013 - RNA, 27 nt, Human
ucccugccuaugccucuaagcuguauu

SEQ ID NO: 130014 - RNA, 28 nt, Human
cugugacgcccuccuaagccagccucag

SEQ ID NO: 130015 - RNA, 21 nt, Human
gaggcaggaaaauugcuugaa

SEQ ID NO: 130016 - RNA, 28 nt, Human
ucuuuauucugcccccaucccaacccag

SEQ ID NO: 130017 - RNA, 23 nt, Human
ccucuguagcagccuccuggacu

SEQ ID NO: 130018 - RNA, 22 nt, Human
gccucccaaaagagcucucgcc

SEQ ID NO: 130019 - RNA, 22 nt, Human
uccaggccccaccuccuccucc

SEQ ID NO: 130020 - RNA, 24 nt, Human
cccugaggaagccccacuucucug

SEQ ID NO: 130021 - RNA, 23 nt, Human
ucuauacucagguaccucuuuca

SEQ ID NO: 130022 - RNA, 23 nt, Human
aguucucaacaauuuagaaggaa

SEQ ID NO: 130023 - RNA, 22 nt, Human
ggaagcugagacaagaggauca

SEQ ID NO: 130024 - RNA, 24 nt, Human
cugaaucuggaccccaucugugaa

SEQ ID NO: 130025 - RNA, 21 nt, Human
aauggaucuuguaaacagggc

SEQ ID NO: 130026 - RNA, 23 nt, Human
ccugcaguuuuggugaagcagga

SEQ ID NO: 130027 - RNA, 27 nt, Human
acucuuccgcccaggcugcagugcagu

SEQ ID NO: 130028 - RNA, 23 nt, Human
uuaucucuucccaggagaggcua

SEQ ID NO: 130029 - RNA, 20 nt, Human
uggggauaagaauaggucau

SEQ ID NO: 130030 - RNA, 26 nt, Human
gcuacccuuucuuuccucucggacag

SEQ ID NO: 130031 - RNA, 25 nt, Human
ugcauugcucaaagcuggcuuuuca

SEQ ID NO: 130032 - RNA, 21 nt, Human
cacugcucuccccuggcuacu

SEQ ID NO: 130033 - RNA, 27 nt, Human
ggggagggagagaucugacaaauacug

SEQ ID NO: 130034 - RNA, 24 nt, Human
aaacuauucucccgccucaaccuc

SEQ ID NO: 130035 - RNA, 21 nt, Human
caucucuaguuccccaccuca

SEQ ID NO: 130036 - RNA, 27 nt, Human
uccuccagggacuugccuggcccuccu

SEQ ID NO: 130037 - RNA, 20 nt, Human
gcgaugaugguucuguugcu

SEQ ID NO: 130038 - RNA, 24 nt, Human
gcuuccacuuacugauuagaagac

SEQ ID NO: 130039 - RNA, 24 nt, Human
ccgagggaggagagaggggcucgg

SEQ ID NO: 130040 - RNA, 23 nt, Human
gugggcggcaggaucagagugaa

SEQ ID NO: 130041 - RNA, 24 nt, Human
ucuaggaagaaagagaaaguagca

SEQ ID NO: 130042 - RNA, 20 nt, Human
acacacacauuuaucauuua

SEQ ID NO: 130043 - RNA, 24 nt, Human
gauccagcaggugcugcaccauga

SEQ ID NO: 130044 - RNA, 24 nt, Human
cuguggacaccucaugcucuguuc

SEQ ID NO: 130045 - RNA, 29 nt, Human
gggguggggucguagggaggcuguuugcc

SEQ ID NO: 130046 - RNA, 26 nt, Human
guguuuucacaggugcuguuuucugu

SEQ ID NO: 130047 - RNA, 23 nt, Human
cuuuguuccuauaaguagaucuu

SEQ ID NO: 130048 - RNA, 23 nt, Human
cuugcuuguacauauaggagcaa

SEQ ID NO: 130049 - RNA, 26 nt, Human
uccaauaaacgcuuauuuggccaagc

SEQ ID NO: 130050 - RNA, 17 nt, Human
ccauacuccacucugau

SEQ ID NO: 130051 - RNA, 27 nt, Human
aaagugcugggauuaccggcuugagcc

SEQ ID NO: 130052 - RNA, 21 nt, Human
cuagaagcagagacucuguga

SEQ ID NO: 130053 - RNA, 19 nt, Human
uccggguuuucacacuggg

SEQ ID NO: 130054 - RNA, 27 nt, Human
ccuguccucaccacucugggcuugugc

SEQ ID NO: 130055 - RNA, 24 nt, Human
ccucuguggcucuccucugguuca

SEQ ID NO: 130056 - RNA, 24 nt, Human
ccuccacuguccuaagauaaagcc

SEQ ID NO: 130057 - RNA, 22 nt, Human
uugccucuaaaguugcugcuuu

SEQ ID NO: 130058 - RNA, 24 nt, Human
guucagaaagugaggcucaaagaa

SEQ ID NO: 130059 - RNA, 21 nt, Human
acuccacaguccucaggcuuc

SEQ ID NO: 130060 - RNA, 25 nt, Human
accucagguagcuccugaagaucug

SEQ ID NO: 130061 - RNA, 21 nt, Human
cuguacccgcugcucucagcu

SEQ ID NO: 130062 - RNA, 21 nt, Human
auaucucaggagguccaaggu

SEQ ID NO: 130063 - RNA, 22 nt, Human
gaccccaaacuccaccucuugg

SEQ ID NO: 130064 - RNA, 21 nt, Human
uaauaaaaaacugugaacccu

SEQ ID NO: 130065 - RNA, 20 nt, Human
agaccgcuggaaaacacugu

SEQ ID NO: 130066 - RNA, 13 nt, Human
ugccuaacagcaa

SEQ ID NO: 130067 - RNA, 22 nt, Human
ccaagguaggaggauugcuuga

SEQ ID NO: 130068 - RNA, 24 nt, Human
aguauuaaagccuuucucuugccu

SEQ ID NO: 130069 - RNA, 20 nt, Human
uuugggaauacaguagcaaa

SEQ ID NO: 130070 - RNA, 22 nt, Human
cugcaagcuccgccucucgggu

SEQ ID NO: 130071 - RNA, 22 nt, Human
aggccgaggcagguugaucacc

SEQ ID NO: 130072 - RNA, 23 nt, Human
gucucauccuucucugacucuuc

SEQ ID NO: 130073 - RNA, 19 nt, Human
uaguuucuuaauggcuacc

SEQ ID NO: 130074 - RNA, 21 nt, Human
uuguauauguaaaugcauauc

SEQ ID NO: 130075 - RNA, 20 nt, Human
guccuguccuuucucucucc

SEQ ID NO: 130076 - RNA, 20 nt, Human
uuuccucuuugagaacauca

SEQ ID NO: 130077 - RNA, 23 nt, Human
cccucucuccuuuuccuggacug

SEQ ID NO: 130078 - RNA, 23 nt, Human
aucgagccacugcauuccagccu

SEQ ID NO: 130079 - RNA, 24 nt, Human
ccacuucugaaaguaucagcuacu

SEQ ID NO: 130080 - RNA, 26 nt, Human
gagggagggagcgcagggaaaagagc

SEQ ID NO: 130081 - RNA, 22 nt, Human
uucugaugugcugcucuuaugu

SEQ ID NO: 130082 - RNA, 26 nt, Human
uuggggaagggagggcaggguggggc

SEQ ID NO: 130083 - RNA, 26 nt, Human
cugggugacagagcgagacuccaccu

SEQ ID NO: 130084 - RNA, 20 nt, Human
caccgaggcuggagugcaau

SEQ ID NO: 130085 - RNA, 25 nt, Human
ccugucccugagcuuggccugcugg

SEQ ID NO: 130086 - RNA, 23 nt, Human
cucgagugccugcaguggcugaa

SEQ ID NO: 130087 - RNA, 21 nt, Human
ccagcaucccugccucuuguc

SEQ ID NO: 130088 - RNA, 21 nt, Human
ccugagccacacccaggcccu

SEQ ID NO: 130089 - RNA, 21 nt, Human
ggaucugaugaaucccacaaa

SEQ ID NO: 130090 - RNA, 22 nt, Human
gucuccccggcuggagugcagu

SEQ ID NO: 130091 - RNA, 22 nt, Human
uuggggcagcagggagcaaaau

SEQ ID NO: 130092 - RNA, 20 nt, Human
acaugauggggaaggaguac

SEQ ID NO: 130093 - RNA, 25 nt, Human
cagccucuuuuuaguucucuuaaaa

SEQ ID NO: 130094 - RNA, 21 nt, Human
uacuaguaauaauguaauacu

SEQ ID NO: 130095 - RNA, 18 nt, Human
ccagucuaccaccaccac

SEQ ID NO: 130096 - RNA, 21 nt, Human
aagggcauaaaacagcuuugg

SEQ ID NO: 130097 - RNA, 19 nt, Human
ucaucucaggccucccuca

SEQ ID NO: 130098 - RNA, 21 nt, Human
cugcccccacacccacuccac

SEQ ID NO: 130099 - RNA, 27 nt, Human
ccagcuccuggaguuguuugcugcaac

SEQ ID NO: 130100 - RNA, 22 nt, Human
gugagccucaguuuccucaucu

SEQ ID NO: 130101 - RNA, 26 nt, Human
cagaaggcacacucugccaugcugag

SEQ ID NO: 130102 - RNA, 22 nt, Human
acagacaacauggaaaugagug

SEQ ID NO: 130103 - RNA, 19 nt, Human
acucaggcugaggcagcag

SEQ ID NO: 130104 - RNA, 21 nt, Human
gcuuaucuuugcacauguuaa

SEQ ID NO: 130105 - RNA, 27 nt, Human
aacuucugcugcauuauuuuuccaaga

SEQ ID NO: 130106 - RNA, 22 nt, Human
cacgaggucaggaguuucagac

SEQ ID NO: 130107 - RNA, 25 nt, Human
gugcucaucuucucuugucauucau

SEQ ID NO: 130108 - RNA, 27 nt, Human
ggaguuagagggaugcgaggcuaacaa

SEQ ID NO: 130109 - RNA, 22 nt, Human
ggugaucaagggugugguuagu

SEQ ID NO: 130110 - RNA, 22 nt, Human
guugcuuucauucuuccucaaa

SEQ ID NO: 130111 - RNA, 21 nt, Human
uguuggccaggcuggucucga

SEQ ID NO: 130112 - RNA, 21 nt, Human
cuucccuuaggauaacagccc

SEQ ID NO: 130113 - RNA, 25 nt, Human
acccaggcuggagugcaguggugug

SEQ ID NO: 130114 - RNA, 22 nt, Human
ugguuggagcagaacuggugag

SEQ ID NO: 130115 - RNA, 20 nt, Human
ggagcggggcccugcacacc

SEQ ID NO: 130116 - RNA, 23 nt, Human
auuguaugacugcacuccagccu

SEQ ID NO: 130117 - RNA, 27 nt, Human
gcagaccccugcccugccgcugcagaa

SEQ ID NO: 130118 - RNA, 23 nt, Human
ccauucuccugccccagccuccc

SEQ ID NO: 130119 - RNA, 21 nt, Human
ccuuuccccaucccugccucc

SEQ ID NO: 130120 - RNA, 21 nt, Human
cugacacccugguucagaaca

SEQ ID NO: 130121 - RNA, 22 nt, Human
cuuaggacagcgucuggcuccu

SEQ ID NO: 130122 - RNA, 22 nt, Human
agugggucuccauugcccagcu

SEQ ID NO: 130123 - RNA, 24 nt, Human
uguagacuuucagcagcaaucuca

SEQ ID NO: 130124 - RNA, 27 nt, Human
ucaagcccccuccaaaggcuccccuac

SEQ ID NO: 130125 - RNA, 22 nt, Human
ccugcugugcagcagugccauu

SEQ ID NO: 130126 - RNA, 19 nt, Human
acugcaaucaugugcuuca

SEQ ID NO: 130127 - RNA, 28 nt, Human
uagaacauacaguugagugggaguaaac

SEQ ID NO: 130128 - RNA, 24 nt, Human
ccccgcaguuuucaaucaugucug

SEQ ID NO: 130129 - RNA, 24 nt, Human
ucuccugccucagccucuggagga

SEQ ID NO: 130130 - RNA, 24 nt, Human
gccagugcugugagcaggcgggga

SEQ ID NO: 130131 - RNA, 22 nt, Human
ccaggagucagagguuucagug

SEQ ID NO: 130132 - RNA, 28 nt, Human
ucaacggcuccaucaccagcccgggcug

SEQ ID NO: 130133 - RNA, 22 nt, Human
augugguuauuuucuccauguc

SEQ ID NO: 130134 - RNA, 21 nt, Human
gugagguggaugggggaguga

SEQ ID NO: 130135 - RNA, 23 nt, Human
cagagguagugaaaagaacugga

SEQ ID NO: 130136 - RNA, 22 nt, Human
uucaacaaaauaaugcacuucc

SEQ ID NO: 130137 - RNA, 27 nt, Human
uuggacuuguuuuaacguucugcugcu

SEQ ID NO: 130138 - RNA, 27 nt, Human
acaggggagacuaaaaaggccagggaa

SEQ ID NO: 130139 - RNA, 24 nt, Human
uauuuuaaaugaaauguuacagca

SEQ ID NO: 130140 - RNA, 27 nt, Human
gaggcggagaacaggagcauggagggc

SEQ ID NO: 130141 - RNA, 23 nt, Human
cuugauacauccucaaacuuucc

SEQ ID NO: 130142 - RNA, 27 nt, Human
acagaaucaaaagcagcccuguuuucc

SEQ ID NO: 130143 - RNA, 21 nt, Human
gaacuuugccauuugucuaca

SEQ ID NO: 130144 - RNA, 26 nt, Human
ccucugccccacugccagccugagug

SEQ ID NO: 130145 - RNA, 21 nt, Human
uaaagugcauuuuuaaauuuc

SEQ ID NO: 130146 - RNA, 23 nt, Human
aaugccacugagcccugcucccu

SEQ ID NO: 130147 - RNA, 18 nt, Human
cauucuauguugauccca

SEQ ID NO: 130148 - RNA, 23 nt, Human
agcugacccugcuucaagcaauu

SEQ ID NO: 130149 - RNA, 27 nt, Human
gcuggucucugggcuccgggagccaga

SEQ ID NO: 130150 - RNA, 22 nt, Human
caugacaaccugccucagucca

SEQ ID NO: 130151 - RNA, 22 nt, Human
ugcagugaguugagauugugcc

SEQ ID NO: 130152 - RNA, 23 nt, Human
cugccccagagccaaaugucgcu

SEQ ID NO: 130153 - RNA, 27 nt, Human
aacacagccuuguuauuuuuaaguccu

SEQ ID NO: 130154 - RNA, 21 nt, Human
gucuuccuucuuuccaaugac

SEQ ID NO: 130155 - RNA, 27 nt, Human
cccugcagccagcucacguccagguuc

SEQ ID NO: 130156 - RNA, 25 nt, Human
gaccugaggcgaucugcccaccucg

SEQ ID NO: 130157 - RNA, 20 nt, Human
ggggugagggccagagcugg

SEQ ID NO: 130158 - RNA, 25 nt, Human
ccuccuccuccuccuggcccugcug

SEQ ID NO: 130159 - RNA, 22 nt, Human
aucaacacuuuucuccaggguu

SEQ ID NO: 130160 - RNA, 22 nt, Human
cugagccucaguucccucguau

SEQ ID NO: 130161 - RNA, 27 nt, Human
gaucaaauuaauacaaucagaagguuu

SEQ ID NO: 130162 - RNA, 20 nt, Human
gcugcuugaagaagaucuca

SEQ ID NO: 130163 - RNA, 25 nt, Human
gggcagagagaggggagcccccucu

SEQ ID NO: 130164 - RNA, 23 nt, Human
ucugucggcaguuccucagucug

SEQ ID NO: 130165 - RNA, 23 nt, Human
ugucuagcccagaaucuugagca

SEQ ID NO: 130166 - RNA, 20 nt, Human
aauucagagaacgguguuug

SEQ ID NO: 130167 - RNA, 18 nt, Human
guucucuccccucuuucc

SEQ ID NO: 130168 - RNA, 23 nt, Human
accagcgcccccacuccuccucc

SEQ ID NO: 130169 - RNA, 23 nt, Human
auuucugucccagcuccaagggu

SEQ ID NO: 130170 - RNA, 27 nt, Human
aaacacugaaaccuaccacguccagau

SEQ ID NO: 130171 - RNA, 26 nt, Human
guuggcugaucauucucauuuacuua

SEQ ID NO: 130172 - RNA, 21 nt, Human
cgugaaagaccaugccugguc

SEQ ID NO: 130173 - RNA, 23 nt, Human
gcccagugucucuucuagccccu

SEQ ID NO: 130174 - RNA, 27 nt, Human
gcuggaggaccugccccuaccugcugc

SEQ ID NO: 130175 - RNA, 27 nt, Human
cucccacaggugggcaccccccacuuu

SEQ ID NO: 130176 - RNA, 22 nt, Human
ggagaggggaagucuuggcagg

SEQ ID NO: 130177 - RNA, 25 nt, Human
cuggcgggcuuccggcauugagcug

SEQ ID NO: 130178 - RNA, 17 nt, Human
ccucuggaccucagguu

SEQ ID NO: 130179 - RNA, 25 nt, Human
gugagucuuuggguaggggaagggu

SEQ ID NO: 130180 - RNA, 23 nt, Human
cuguucucccaguuguucaguuu

SEQ ID NO: 130181 - RNA, 23 nt, Human
ccuuucgguccaacaacaggaaa

SEQ ID NO: 130182 - RNA, 20 nt, Human
uacagguaucccagcuuugg

SEQ ID NO: 130183 - RNA, 21 nt, Human
ggugggguggaagcuugggga

SEQ ID NO: 130184 - RNA, 24 nt, Human
acccccugaauuucucacaaagga

SEQ ID NO: 130185 - RNA, 23 nt, Human
uguucuuuuucugaacuccauuu

SEQ ID NO: 130186 - RNA, 24 nt, Human
ugaacuccugaaaccucaaacagu

SEQ ID NO: 130187 - RNA, 21 nt, Human
gggaggcggagguugcaguga

SEQ ID NO: 130188 - RNA, 25 nt, Human
ccgcggcgcgcagcggcugaaggag

SEQ ID NO: 130189 - RNA, 24 nt, Human
ugggacuucugggucuccagggag

SEQ ID NO: 130190 - RNA, 27 nt, Human
gucuaccagugaccucagggcacuuug

SEQ ID NO: 130191 - RNA, 21 nt, Human
cugcaggcugacgagagaugg

SEQ ID NO: 130192 - RNA, 19 nt, Human
gcuuuauaaaccucagugg

SEQ ID NO: 130193 - RNA, 25 nt, Human
aucuccaucagagcaaggcagccag

SEQ ID NO: 130194 - RNA, 22 nt, Human
gcucacugagaacccagcuuug

SEQ ID NO: 130195 - RNA, 24 nt, Human
uugccgugaggacacacagacuug

SEQ ID NO: 130196 - RNA, 23 nt, Human
uuaaugccuuugaaauuuuguaa

SEQ ID NO: 130197 - RNA, 27 nt, Human
uucacacauuaauuuuaucucagucuu

SEQ ID NO: 130198 - RNA, 21 nt, Human
acgggugucaaaccccuguca

SEQ ID NO: 130199 - RNA, 24 nt, Human
agagagaagcauccccuggcccgg

SEQ ID NO: 130200 - RNA, 15 nt, Human
agcccuuggaaaugu

SEQ ID NO: 130201 - RNA, 20 nt, Human
ggcugacccagcaucuccca

SEQ ID NO: 130202 - RNA, 19 nt, Human
uagaugcuagaccaaccag

SEQ ID NO: 130203 - RNA, 24 nt, Human
ggugcccaagcuguggccugcagu

SEQ ID NO: 130204 - RNA, 17 nt, Human
guggcuucaaguguggg

SEQ ID NO: 130205 - RNA, 21 nt, Human
caacagcaugucccucggcca

SEQ ID NO: 130206 - RNA, 21 nt, Human
guuaacugcaaccuuguuuau

SEQ ID NO: 130207 - RNA, 26 nt, Human
ccugcagggucuuugucucaccauuu

SEQ ID NO: 130208 - RNA, 21 nt, Human
ggcccaggcuggagugcagug

SEQ ID NO: 130209 - RNA, 21 nt, Human
ggaaaguugaguuccaccucu

SEQ ID NO: 130210 - RNA, 22 nt, Human
caaagaaaaaccagaaguuguc

SEQ ID NO: 130211 - RNA, 22 nt, Human
cauucaggcuggagugcagugg

SEQ ID NO: 130212 - RNA, 21 nt, Human
uuggugcauaccuuauguaag

SEQ ID NO: 130213 - RNA, 27 nt, Human
cacugucccccaggcuggagugcagug

SEQ ID NO: 130214 - RNA, 21 nt, Human
ggggccaaacucuucugucac

SEQ ID NO: 130215 - RNA, 22 nt, Human
ugguuauuuuuaauaagccucu

SEQ ID NO: 130216 - RNA, 25 nt, Human
uccacgaagaaagcaacgaaugaaa

SEQ ID NO: 130217 - RNA, 27 nt, Human
uuagaaaacagaaaucugcaucucagc

SEQ ID NO: 130218 - RNA, 21 nt, Human
cauagcaaguucauaaaaguu

SEQ ID NO: 130219 - RNA, 21 nt, Human
aggcugggcgcaguggccuca

SEQ ID NO: 130220 - RNA, 19 nt, Human
uuucuuuuucuuggacuac

SEQ ID NO: 130221 - RNA, 27 nt, Human
ggcuggcucagcccagagucccugucu

SEQ ID NO: 130222 - RNA, 18 nt, Human
uuccacugcacauggccc

SEQ ID NO: 130223 - RNA, 24 nt, Human
cucuauuuuguaaaacaaacuacu

SEQ ID NO: 130224 - RNA, 22 nt, Human
aguggugccuauaaugaagaca

SEQ ID NO: 130225 - RNA, 22 nt, Human
aacccugccccuuucuguccca

SEQ ID NO: 130226 - RNA, 26 nt, Human
gggaggcagcaucagggacacagggg

SEQ ID NO: 130227 - RNA, 24 nt, Human
gcccaggcuggagugcaacggcac

SEQ ID NO: 130228 - RNA, 21 nt, Human
ggcuucccacccaaaccuucu

SEQ ID NO: 130229 - RNA, 22 nt, Human
cuucauacaaaacaaaaggaau

SEQ ID NO: 130230 - RNA, 32 nt, Human
ggcauccauguuuugugccugcccucccucuu

SEQ ID NO: 130231 - RNA, 22 nt, Human
ccuguuugccuuuccuuugcca

SEQ ID NO: 130232 - RNA, 27 nt, Human
cacagcguuauguguaaaaaacaagua

SEQ ID NO: 130233 - RNA, 21 nt, Human
gacgggccgccuucugcucca

SEQ ID NO: 130234 - RNA, 24 nt, Human
cuucaugccugaccucaaccccgc

SEQ ID NO: 130235 - RNA, 21 nt, Human
agaagucaccuccucagugca

SEQ ID NO: 130236 - RNA, 22 nt, Human
ucuggagaggagggaugcugcc

SEQ ID NO: 130237 - RNA, 23 nt, Human
caaucagguuauugcauugacuu

SEQ ID NO: 130238 - RNA, 21 nt, Human
ucagaccuucuuccacagcaa

SEQ ID NO: 130239 - RNA, 23 nt, Human
gacucaacaguuuguggcaagac

SEQ ID NO: 130240 - RNA, 19 nt, Human
ugagacacggcuugcagug

SEQ ID NO: 130241 - RNA, 22 nt, Human
uccucuuccuucuccuccucca

SEQ ID NO: 130242 - RNA, 27 nt, Human
gcaucacugcacuccaaccugggcaac

SEQ ID NO: 130243 - RNA, 22 nt, Human
cugaaccucaguuuccucaucu

SEQ ID NO: 130244 - RNA, 21 nt, Human
agagguuucauuuucaucuca

SEQ ID NO: 130245 - RNA, 20 nt, Human
uaggugauggagauguguac

SEQ ID NO: 130246 - RNA, 22 nt, Human
ugggaaagagggggcaggggcu

SEQ ID NO: 130247 - RNA, 22 nt, Human
auuggucuaucuacuggcagcu

SEQ ID NO: 130248 - RNA, 26 nt, Human
cugggcgguggagcaggagcuggcgu

SEQ ID NO: 130249 - RNA, 26 nt, Human
ugacucuugccuuuccaccugcuuuc

SEQ ID NO: 130250 - RNA, 21 nt, Human
aaaauguuaagcaucuaagga

SEQ ID NO: 130251 - RNA, 22 nt, Human
cuuguuuucuucacagugcagu

SEQ ID NO: 130252 - RNA, 18 nt, Human
acacagaaaaugccacuu

SEQ ID NO: 130253 - RNA, 22 nt, Human
acccacaaaggcugcucuuuag

SEQ ID NO: 130254 - RNA, 20 nt, Human
guuuucugggggagugcagg

SEQ ID NO: 130255 - RNA, 22 nt, Human
uuugaggcgcucacuccuguga

SEQ ID NO: 130256 - RNA, 31 nt, Human
ggcugugcauguuggcuucuuuggaccugca

SEQ ID NO: 130257 - RNA, 22 nt, Human
uggucucaaacuuguggccuca

SEQ ID NO: 130258 - RNA, 22 nt, Human
gagcugggaugcaauguaggcu

SEQ ID NO: 130259 - RNA, 22 nt, Human
ugucacccaggcuggaguacaa

SEQ ID NO: 130260 - RNA, 28 nt, Human
caccccaaggcuggagccgcugcacccu

SEQ ID NO: 130261 - RNA, 20 nt, Human
ucccccagcccuaaauccuc

SEQ ID NO: 130262 - RNA, 24 nt, Human
gaaggggggucagaagagagggug

SEQ ID NO: 130263 - RNA, 21 nt, Human
agcaggaagccagcugucaua

SEQ ID NO: 130264 - RNA, 23 nt, Human
cccuuccuguucccuccuggucc

SEQ ID NO: 130265 - RNA, 24 nt, Human
aacagcaacagcagcuccuccucc

SEQ ID NO: 130266 - RNA, 21 nt, Human
ccccuaucccuaggcacuuaa

SEQ ID NO: 130267 - RNA, 20 nt, Human
cccagcaccagcucugcuca

SEQ ID NO: 130268 - RNA, 27 nt, Human
gcuuccuugcggaaguggugaccguga

SEQ ID NO: 130269 - RNA, 20 nt, Human
ugaaauuuagaauuguugaa

SEQ ID NO: 130270 - RNA, 26 nt, Human
uccaauaaacauccugaaccucuguc

SEQ ID NO: 130271 - RNA, 27 nt, Human
ggcucacugcagccuugacuccgugag

SEQ ID NO: 130272 - RNA, 20 nt, Human
ucagaggucaggagcagggc

SEQ ID NO: 130273 - RNA, 22 nt, Human
gaauccucucugccaauccugc

SEQ ID NO: 130274 - RNA, 21 nt, Human
ugggaggugggagggccaggc

SEQ ID NO: 130275 - RNA, 23 nt, Human
cuaucacugcauuuauuuugccu

SEQ ID NO: 130276 - RNA, 26 nt, Human
gccagccuggccagcagcucagagug

SEQ ID NO: 130277 - RNA, 22 nt, Human
cugggaaggagagcuugcuuuu

SEQ ID NO: 130278 - RNA, 21 nt, Human
uguucuguuuucagcugacuu

SEQ ID NO: 130279 - RNA, 22 nt, Human
cccucauuuucccucagaaccc

SEQ ID NO: 130280 - RNA, 24 nt, Human
gcaugguccgaggagugugcucag

SEQ ID NO: 130281 - RNA, 27 nt, Human
ucuccaccugcauuauguacuacauga

SEQ ID NO: 130282 - RNA, 27 nt, Human
gaccagugugcaaaacauagcaagacc

SEQ ID NO: 130283 - RNA, 21 nt, Human
cccccauuccaccacaguuuc

SEQ ID NO: 130284 - RNA, 24 nt, Human
aaccuuauacugaauaacuacuga

SEQ ID NO: 130285 - RNA, 23 nt, Human
auucucaaacauacugauguuca

SEQ ID NO: 130286 - RNA, 19 nt, Human
cccaguaagcuuccaugac

SEQ ID NO: 130287 - RNA, 23 nt, Human
uuucguuccuccugaggagacca

SEQ ID NO: 130288 - RNA, 22 nt, Human
aggugcccgcuacuucccagaa

SEQ ID NO: 130289 - RNA, 20 nt, Human
cacagccuucaagcugcagu

SEQ ID NO: 130290 - RNA, 20 nt, Human
cagaggagagcaugaggggu

SEQ ID NO: 130291 - RNA, 23 nt, Human
gggugagacagcagggcccaggg

SEQ ID NO: 130292 - RNA, 25 nt, Human
ucugggcguccagcucagcccuggc

SEQ ID NO: 130293 - RNA, 25 nt, Human
ugucaacaaagugcuuuuucacugc

SEQ ID NO: 130294 - RNA, 26 nt, Human
cugucugaccugaacuugcuuaggga

SEQ ID NO: 130295 - RNA, 26 nt, Human
uucccagcaccuggacaucucuucca

SEQ ID NO: 130296 - RNA, 22 nt, Human
gucgagggggaggaggccaccu

SEQ ID NO: 130297 - RNA, 23 nt, Human
gaagcuggaggagaaacuaaagc

SEQ ID NO: 130298 - RNA, 22 nt, Human
ccuagaggcggaguuugcagug

SEQ ID NO: 130299 - RNA, 23 nt, Human
augccuggccugccagacacugc

SEQ ID NO: 130300 - RNA, 20 nt, Human
uagcugggcgugguggugca

SEQ ID NO: 130301 - RNA, 25 nt, Human
uccagcaggcagcuggggcugagug

SEQ ID NO: 130302 - RNA, 22 nt, Human
accacccuucugaucuuagggg

SEQ ID NO: 130303 - RNA, 26 nt, Human
gcaaucaggcacagugccucaugccu

SEQ ID NO: 130304 - RNA, 27 nt, Human
gcccagccuggaaaccuacagacaagg

SEQ ID NO: 130305 - RNA, 20 nt, Human
ccucacccucuccgcacacc

SEQ ID NO: 130306 - RNA, 19 nt, Human
cuccugccucagccucacg

SEQ ID NO: 130307 - RNA, 22 nt, Human
cccuguguccuuggacagcaga

SEQ ID NO: 130308 - RNA, 20 nt, Human
uccuucugcuucucagacuc

SEQ ID NO: 130309 - RNA, 21 nt, Human
cuugguaagauccacuaaucu

SEQ ID NO: 130310 - RNA, 29 nt, Human
gcaguggcacuuuguggcuucaugaagga

SEQ ID NO: 130311 - RNA, 22 nt, Human
gcauuuauaauuauuuauguga

SEQ ID NO: 130312 - RNA, 25 nt, Human
cgccucgggcagcccaaagcuccuc

SEQ ID NO: 130313 - RNA, 22 nt, Human
ugggagccacugggagggggac

SEQ ID NO: 130314 - RNA, 22 nt, Human
uucauuucucagcccuuuacaa

SEQ ID NO: 130315 - RNA, 24 nt, Human
agaucaacagacuucagacccuca

SEQ ID NO: 130316 - RNA, 21 nt, Human
ccucagcaaccugcucuuccg

SEQ ID NO: 130317 - RNA, 20 nt, Human
gucaauacauagugcugcug

SEQ ID NO: 130318 - RNA, 21 nt, Human
gggccaucaugcagagguggu

SEQ ID NO: 130319 - RNA, 23 nt, Human
gacuaugugccaagcuguuuggu

SEQ ID NO: 130320 - RNA, 19 nt, Human
ggcccugcaagugccugga

SEQ ID NO: 130321 - RNA, 20 nt, Human
ggggcagcaggagcgguaga

SEQ ID NO: 130322 - RNA, 22 nt, Human
cuggcugaggauuucaagccug

SEQ ID NO: 130323 - RNA, 21 nt, Human
agcugcauuucaugaauaguu

SEQ ID NO: 130324 - RNA, 26 nt, Human
ugccuuuuuaaauuguauaguugaug

SEQ ID NO: 130325 - RNA, 22 nt, Human
gcucacacaccuguagcacuua

SEQ ID NO: 130326 - RNA, 20 nt, Human
ccggagcugcuccugcugcu

SEQ ID NO: 130327 - RNA, 18 nt, Human
gccuccagccacauucuc

SEQ ID NO: 130328 - RNA, 19 nt, Human
uccuucccuaauucauaca

SEQ ID NO: 130329 - RNA, 23 nt, Human
acuccucccuguacaacaucaca

SEQ ID NO: 130330 - RNA, 21 nt, Human
cauccagccaccauuccaagg

SEQ ID NO: 130331 - RNA, 22 nt, Human
gcucagccuggagugcagugag

SEQ ID NO: 130332 - RNA, 22 nt, Human
ccucaguaauuauuagcauuga

SEQ ID NO: 130333 - RNA, 22 nt, Human
gggagguggagguugccgugag

SEQ ID NO: 130334 - RNA, 26 nt, Human
accuccucagucugggugggacuuau

SEQ ID NO: 130335 - RNA, 27 nt, Human
caucuggaagaaacaggaagauuggaa

SEQ ID NO: 130336 - RNA, 24 nt, Human
ucuauugagagucagguaugugag

SEQ ID NO: 130337 - RNA, 20 nt, Human
ccucagcucagccccccagc

SEQ ID NO: 130338 - RNA, 27 nt, Human
gggccccaggccguuguccugcucuga

SEQ ID NO: 130339 - RNA, 19 nt, Human
ugggucucccuuuccaugg

SEQ ID NO: 130340 - RNA, 18 nt, Human
agaugaagccauaaggcu

SEQ ID NO: 130341 - RNA, 19 nt, Human
cacuccugccacuguucca

SEQ ID NO: 130342 - RNA, 29 nt, Human
aggcggcuccagccccagacaacagccca

SEQ ID NO: 130343 - RNA, 25 nt, Human
cgggaagggagcuggggcggugagg

SEQ ID NO: 130344 - RNA, 26 nt, Human
aaggcgagagcugcgaagggccaggu

SEQ ID NO: 130345 - RNA, 22 nt, Human
cacaaggucaggaguucgagac

SEQ ID NO: 130346 - RNA, 26 nt, Human
uaguauuuuucuuuaccugaaggagg

SEQ ID NO: 130347 - RNA, 23 nt, Human
cagucucuuccuggucugaacuc

SEQ ID NO: 130348 - RNA, 21 nt, Human
ggcuucaggcugggggcagug

SEQ ID NO: 130349 - RNA, 22 nt, Human
aggcaggcggaucacgagguca

SEQ ID NO: 130350 - RNA, 21 nt, Human
uuccuuugggauguggaagcu

SEQ ID NO: 130351 - RNA, 24 nt, Human
ugggacuacaagaagaggagcugc

SEQ ID NO: 130352 - RNA, 25 nt, Human
ugaaggaauuugugcuguguauugg

SEQ ID NO: 130353 - RNA, 21 nt, Human
ucuuccuccugugcugaccuc

SEQ ID NO: 130354 - RNA, 22 nt, Human
guugcccaggcuagcaugcaau

SEQ ID NO: 130355 - RNA, 22 nt, Human
cagggaggaggaaggcugagga

SEQ ID NO: 130356 - RNA, 15 nt, Human
cgaacauccuacucu

SEQ ID NO: 130357 - RNA, 23 nt, Human
aagcauaauauaaaauuaguuag

SEQ ID NO: 130358 - RNA, 18 nt, Human
aucauaaaaauagcccca

SEQ ID NO: 130359 - RNA, 25 nt, Human
cacuccauccugggugacagcaaga

SEQ ID NO: 130360 - RNA, 19 nt, Human
augccacccucuccaugcc

SEQ ID NO: 130361 - RNA, 19 nt, Human
ggcagugaugacuugcugu

SEQ ID NO: 130362 - RNA, 23 nt, Human
uacuaaauaagaguauuuuuugu

SEQ ID NO: 130363 - RNA, 24 nt, Human
gcuuucuccuuuuggauugaggcu

SEQ ID NO: 130364 - RNA, 24 nt, Human
cccuuccuccuccuccucagucca

SEQ ID NO: 130365 - RNA, 22 nt, Human
aggaauagguaggaaaauuugg

SEQ ID NO: 130366 - RNA, 27 nt, Human
ugguggagucaagggugggcagcguac

SEQ ID NO: 130367 - RNA, 23 nt, Human
ggauauauccugguguugcuuga

SEQ ID NO: 130368 - RNA, 22 nt, Human
cuuucacuccaguucuggguga

SEQ ID NO: 130369 - RNA, 21 nt, Human
agccucuggcuaccucugucc

SEQ ID NO: 130370 - RNA, 26 nt, Human
gguuugcauuccugaccucaagugau

SEQ ID NO: 130371 - RNA, 19 nt, Human
ccugucugucucggacaga

SEQ ID NO: 130372 - RNA, 18 nt, Human
ccuguaguucacacugug

SEQ ID NO: 130373 - RNA, 23 nt, Human
aggccagccugaggaacugcagg

SEQ ID NO: 130374 - RNA, 25 nt, Human
gcaggaggagacaucacagcuuucc

SEQ ID NO: 130375 - RNA, 21 nt, Human
ucacacacaaauugacucuua

SEQ ID NO: 130376 - RNA, 20 nt, Human
cuuucugcuucuuaauugcc

SEQ ID NO: 130377 - RNA, 22 nt, Human
uuggccugccccagugcagugg

SEQ ID NO: 130378 - RNA, 25 nt, Human
ccuagcuagcauuuuaaaaggggaa

SEQ ID NO: 130379 - RNA, 23 nt, Human
gccuguuuuucuguaccugcugc

SEQ ID NO: 130380 - RNA, 25 nt, Human
acuaagcucaguaacaagaaggcau

SEQ ID NO: 130381 - RNA, 22 nt, Human
cccagcagcugggacuacaggc

SEQ ID NO: 130382 - RNA, 19 nt, Human
ucacugcaucugacuaugg

SEQ ID NO: 130383 - RNA, 22 nt, Human
uguacacgugacagagugccuu

SEQ ID NO: 130384 - RNA, 27 nt, Human
ugcagcucaucacuuggagcaguuucu

SEQ ID NO: 130385 - RNA, 26 nt, Human
augaagcuggggcugcaagacugccu

SEQ ID NO: 130386 - RNA, 24 nt, Human
gcacagccaacacgcaccugccuc

SEQ ID NO: 130387 - RNA, 19 nt, Human
agauggucagcagguucaa

SEQ ID NO: 130388 - RNA, 23 nt, Human
agagaaacaggaaacaaagaaug

SEQ ID NO: 130389 - RNA, 22 nt, Human
uuuccuucacuuauugcugaaa

SEQ ID NO: 130390 - RNA, 22 nt, Human
uccaugccaugaaugagugggc

SEQ ID NO: 130391 - RNA, 19 nt, Human
caucacugcacuccagccu

SEQ ID NO: 130392 - RNA, 27 nt, Human
ucugccucccgggcuugagcgauucuu

SEQ ID NO: 130393 - RNA, 22 nt, Human
aaauguuuagcucuuacacucu

SEQ ID NO: 130394 - RNA, 22 nt, Human
augaagcccugggcuuugccug

SEQ ID NO: 130395 - RNA, 22 nt, Human
ccgaagagaaccaugcuuggca

SEQ ID NO: 130396 - RNA, 24 nt, Human
cacacauuuauaaggacagagauu

SEQ ID NO: 130397 - RNA, 22 nt, Human
cugguuguugcuaagguugcug

SEQ ID NO: 130398 - RNA, 25 nt, Human
ugggcuccagggacuggaguguaau

SEQ ID NO: 130399 - RNA, 26 nt, Human
acagaaaguaacugauugacacuguu

SEQ ID NO: 130400 - RNA, 22 nt, Human
accuuucuaccaguuguggacc

SEQ ID NO: 130401 - RNA, 22 nt, Human
cccugcuccucucuguccugcc

SEQ ID NO: 130402 - RNA, 21 nt, Human
cuccaccauacuccaucaguu

SEQ ID NO: 130403 - RNA, 20 nt, Human
uuguagagauugagugcucu

SEQ ID NO: 130404 - RNA, 27 nt, Human
ccugcagcugcgccuccuugcaccugc

SEQ ID NO: 130405 - RNA, 22 nt, Human
aggugaagagcaaccacaaguu

SEQ ID NO: 130406 - RNA, 25 nt, Human
gccuuuucauuauuuuuuagcuuuu

SEQ ID NO: 130407 - RNA, 21 nt, Human
ggcagggagagaggaggccgg

SEQ ID NO: 130408 - RNA, 25 nt, Human
aagugaccgaaagguuauguuagca

SEQ ID NO: 130409 - RNA, 24 nt, Human
gaucugcccgccucggucucccaa

SEQ ID NO: 130410 - RNA, 23 nt, Human
aacucagaccucaccuuccuccc

SEQ ID NO: 130411 - RNA, 22 nt, Human
gcauuuacccuguugcauguca

SEQ ID NO: 130412 - RNA, 20 nt, Human
ccucccaaacuccugccugc

SEQ ID NO: 130413 - RNA, 28 nt, Human
uccaagaucuucccuugggcuuuucagc

SEQ ID NO: 130414 - RNA, 28 nt, Human
uuuucauuucuuuuguuuuugagagaag

SEQ ID NO: 130415 - RNA, 21 nt, Human
agcuaauuuuuguauuugagu

SEQ ID NO: 130416 - RNA, 27 nt, Human
uuggaacccuuuagcuuuguuuuggaa

SEQ ID NO: 130417 - RNA, 25 nt, Human
cuguggaccccagagaagguggcag

SEQ ID NO: 130418 - RNA, 20 nt, Human
uuccuccagaguucggauuu

SEQ ID NO: 130419 - RNA, 22 nt, Human
agcuaauuuuuguauuuuucgu

SEQ ID NO: 130420 - RNA, 22 nt, Human
ccuguuuacucguaccaaaaau

SEQ ID NO: 130421 - RNA, 21 nt, Human
gcuugaggggagcccugagaa

SEQ ID NO: 130422 - RNA, 21 nt, Human
ccucuucugcagccucaccuc

SEQ ID NO: 130423 - RNA, 22 nt, Human
cccugucggugaaggaucaugu

SEQ ID NO: 130424 - RNA, 27 nt, Human
ugaggggaaaaaguguuccucaugaag

SEQ ID NO: 130425 - RNA, 20 nt, Human
ucaagauuaucaacugugug

SEQ ID NO: 130426 - RNA, 20 nt, Human
cccugcuggcccuccagggg

SEQ ID NO: 130427 - RNA, 21 nt, Human
caccguugagguugcagugag

SEQ ID NO: 130428 - RNA, 27 nt, Human
ggggcggucgcggcggaggcagaggaa

SEQ ID NO: 130429 - RNA, 21 nt, Human
ucuucuucucucucuuuuuuc

SEQ ID NO: 130430 - RNA, 21 nt, Human
uguguuuucacaccuuucucc

SEQ ID NO: 130431 - RNA, 22 nt, Human
ggcucugggaagagagugaggg

SEQ ID NO: 130432 - RNA, 21 nt, Human
aacacaaacacaguuauucca

SEQ ID NO: 130433 - RNA, 22 nt, Human
ggagcuuugauuacugacuccg

SEQ ID NO: 130434 - RNA, 23 nt, Human
gugucuucacccaccugccauca

SEQ ID NO: 130435 - RNA, 24 nt, Human
cucuccuacugucauucuuauacc

SEQ ID NO: 130436 - RNA, 22 nt, Human
agccucccaaagugcugggaug

SEQ ID NO: 130437 - RNA, 23 nt, Human
ccucucugugucccugcugcugc

SEQ ID NO: 130438 - RNA, 27 nt, Human
caggcagcuggagagaagagaaggcag

SEQ ID NO: 130439 - RNA, 23 nt, Human
ugaugcaguggauaaugauggga

SEQ ID NO: 130440 - RNA, 20 nt, Human
cgucuguggccaugcccauc

SEQ ID NO: 130441 - RNA, 20 nt, Human
cauaugcauuggucaagguu

SEQ ID NO: 130442 - RNA, 23 nt, Human
agagcccacauggccgggcccuc

SEQ ID NO: 130443 - RNA, 23 nt, Human
cugagccuugguguacagaccac

SEQ ID NO: 130444 - RNA, 26 nt, Human
aaccaguugcuguuucuucccauguc

SEQ ID NO: 130445 - RNA, 16 nt, Human
uccacugcaggcaggg

SEQ ID NO: 130446 - RNA, 20 nt, Human
cccgauuuuaaccacuugaa

SEQ ID NO: 130447 - RNA, 20 nt, Human
gggggcuccugggggugggg

SEQ ID NO: 130448 - RNA, 22 nt, Human
caggaggcugaggcugcaauga

SEQ ID NO: 130449 - RNA, 21 nt, Human
auggucaguaggcacacugcc

SEQ ID NO: 130450 - RNA, 20 nt, Human
gcagggcccagcacagcccc

SEQ ID NO: 130451 - RNA, 24 nt, Human
gacaggaacuguggaacugugaug

SEQ ID NO: 130452 - RNA, 26 nt, Human
ccaucguugcuaucaccaguaccucu

SEQ ID NO: 130453 - RNA, 26 nt, Human
ccucauccacugucugcuagcaaaga

SEQ ID NO: 130454 - RNA, 24 nt, Human
caggaauagaaacugaugagcuga

SEQ ID NO: 130455 - RNA, 22 nt, Human
ugccaucuugcuuuucuuugga

SEQ ID NO: 130456 - RNA, 21 nt, Human
ucuccuuucuggcauccuggc

SEQ ID NO: 130457 - RNA, 20 nt, Human
ugggaaauggcagagcugaa

SEQ ID NO: 130458 - RNA, 22 nt, Human
gacacagccguguaugcuccca

SEQ ID NO: 130459 - RNA, 21 nt, Human
auuugcauuugaaauuuugga

SEQ ID NO: 130460 - RNA, 26 nt, Human
acacccagaagacgucaggugacuuc

SEQ ID NO: 130461 - RNA, 20 nt, Human
ggcucuccaugaugggaacc

SEQ ID NO: 130462 - RNA, 20 nt, Human
accucaggccaggugcagug

SEQ ID NO: 130463 - RNA, 27 nt, Human
gaggguuacuaugcacaauuuaaucac

SEQ ID NO: 130464 - RNA, 27 nt, Human
gcuggugguggcuucgggcucaugccc

SEQ ID NO: 130465 - RNA, 22 nt, Human
gcaugagccaccacacccugcc

SEQ ID NO: 130466 - RNA, 26 nt, Human
aaccaaaaagagacugaucauccagg

SEQ ID NO: 130467 - RNA, 23 nt, Human
gcauacaagauuuaaauuuggga

SEQ ID NO: 130468 - RNA, 26 nt, Human
gcugcucuuccuggcaggccugggcc

SEQ ID NO: 130469 - RNA, 23 nt, Human
ggcaugucuuuccagaacuuucc

SEQ ID NO: 130470 - RNA, 27 nt, Human
uuucaaaacagauuuaaggaaaggacu

SEQ ID NO: 130471 - RNA, 20 nt, Human
cggggguggcgguggaggga

SEQ ID NO: 130472 - RNA, 22 nt, Human
ggaguauguaucuucucucacu

SEQ ID NO: 130473 - RNA, 27 nt, Human
uuuaggcuacagugucucgaugccaua

SEQ ID NO: 130474 - RNA, 22 nt, Human
aauuuguaugcagugugaagga

SEQ ID NO: 130475 - RNA, 22 nt, Human
cagaauuauccccaauuuccaa

SEQ ID NO: 130476 - RNA, 27 nt, Human
agacugcacuuuucuguuccguuuacu

SEQ ID NO: 130477 - RNA, 28 nt, Human
uguuauuucucuggggucugugaugggg

SEQ ID NO: 130478 - RNA, 32 nt, Human
ggugagaggaagccucgcagaauccagcagaa

SEQ ID NO: 130479 - RNA, 26 nt, Human
auuuuguacauacuguauuuuuacua

SEQ ID NO: 130480 - RNA, 27 nt, Human
uucagcaggcguaggcucacccugggc

SEQ ID NO: 130481 - RNA, 24 nt, Human
cgggucugcagagucccaucugcc

SEQ ID NO: 130482 - RNA, 18 nt, Human
aucccuuaagaaguuaga

SEQ ID NO: 130483 - RNA, 19 nt, Human
auccuguuuguucuuuguu

SEQ ID NO: 130484 - RNA, 24 nt, Human
ucuggguggugggaugggagacca

SEQ ID NO: 130485 - RNA, 24 nt, Human
ggaacucaaggaaaucugugucag

SEQ ID NO: 130486 - RNA, 22 nt, Human
cuaccuuaguucuuucucucug

SEQ ID NO: 130487 - RNA, 28 nt, Human
aucgccauaggccaaggugcauauagaa

SEQ ID NO: 130488 - RNA, 21 nt, Human
ucugccuggagcccagguugc

SEQ ID NO: 130489 - RNA, 22 nt, Human
cugcauccucaaccuccugggu

SEQ ID NO: 130490 - RNA, 21 nt, Human
caguccaccugagcugccauc

SEQ ID NO: 130491 - RNA, 26 nt, Human
gcacagacagguuuucacauaaaugc

SEQ ID NO: 130492 - RNA, 21 nt, Human
gcuuugaagaaaaagcaaaag

SEQ ID NO: 130493 - RNA, 19 nt, Human
aagccugcccugagcccag

SEQ ID NO: 130494 - RNA, 21 nt, Human
agugcugcugcagagcuagaa

SEQ ID NO: 130495 - RNA, 19 nt, Human
cuacacagcacggcuuuuu

SEQ ID NO: 130496 - RNA, 21 nt, Human
ccuccaucaguacuucaucca

SEQ ID NO: 130497 - RNA, 23 nt, Human
gaugaaucuggagucugcuuacu

SEQ ID NO: 130498 - RNA, 24 nt, Human
gccccugcccacaaaaccccaggg

SEQ ID NO: 130499 - RNA, 21 nt, Human
caagagguggaaggguacuga

SEQ ID NO: 130500 - RNA, 17 nt, Human
auacuccucauguuuaa

SEQ ID NO: 130501 - RNA, 22 nt, Human
gccugggacucagaccaggaag

SEQ ID NO: 130502 - RNA, 21 nt, Human
gcugcuggggcagggcccagg

SEQ ID NO: 130503 - RNA, 26 nt, Human
ucuggguggugggggauugauacaga

SEQ ID NO: 130504 - RNA, 21 nt, Human
auuuuuaaaaaugaaaucuua

SEQ ID NO: 130505 - RNA, 19 nt, Human
cuuuuucugaauggacuuc

SEQ ID NO: 130506 - RNA, 27 nt, Human
ggagccgcgugaugcaucccaaagaag

SEQ ID NO: 130507 - RNA, 22 nt, Human
cuucugccucauccugccuuag

SEQ ID NO: 130508 - RNA, 23 nt, Human
uaugcaaauauuauuuucuucau

SEQ ID NO: 130509 - RNA, 26 nt, Human
ccugcuuccagcugcugcagcgcgcc

SEQ ID NO: 130510 - RNA, 20 nt, Human
uaagaguggauuacaggcau

SEQ ID NO: 130511 - RNA, 23 nt, Human
auugcgccacugcacuccagucu

SEQ ID NO: 130512 - RNA, 23 nt, Human
auugugccacugcacuccagccu

SEQ ID NO: 130513 - RNA, 21 nt, Human
gccaaggaggcugcuguggug

SEQ ID NO: 130514 - RNA, 20 nt, Human
uuaauauugugaagaaaaau

SEQ ID NO: 130515 - RNA, 21 nt, Human
uauucuggcuuuucucaccag

SEQ ID NO: 130516 - RNA, 28 nt, Human
ugggagugacugcaagcauuuuuccauc

SEQ ID NO: 130517 - RNA, 21 nt, Human
uugggcugggugcaguggcuc

SEQ ID NO: 130518 - RNA, 24 nt, Human
ggagaauguuuguaacuuaaucag

SEQ ID NO: 130519 - RNA, 28 nt, Human
uccugaacgccaggaaccuggggucugg

SEQ ID NO: 130520 - RNA, 23 nt, Human
uguaagcuucacucuguccuaca

SEQ ID NO: 130521 - RNA, 25 nt, Human
ggaaggaggggaagcugcagcuugg

SEQ ID NO: 130522 - RNA, 23 nt, Human
gccuugugucagcaggucauggu

SEQ ID NO: 130523 - RNA, 25 nt, Human
gugcacaccaccacacucagcuaau

SEQ ID NO: 130524 - RNA, 20 nt, Human
acuaucucccuuauucucca

SEQ ID NO: 130525 - RNA, 21 nt, Human
ccuccagaagacuugccugcu

SEQ ID NO: 130526 - RNA, 23 nt, Human
cuccugggacugaggaggcaggg

SEQ ID NO: 130527 - RNA, 27 nt, Human
cuuucauguccccucuggauuguccag

SEQ ID NO: 130528 - RNA, 20 nt, Human
cugucacccagucacugcca

SEQ ID NO: 130529 - RNA, 24 nt, Human
uuuggagcuguaaguacugaugua

SEQ ID NO: 130530 - RNA, 21 nt, Human
agcuacuaagccaacuggaac

SEQ ID NO: 130531 - RNA, 20 nt, Human
ccauggcucacaggucacua

SEQ ID NO: 130532 - RNA, 24 nt, Human
ucuuagcagggucugcgcuucgca

SEQ ID NO: 130533 - RNA, 19 nt, Human
gcugccuggugucugcugu

SEQ ID NO: 130534 - RNA, 27 nt, Human
ugcucuucccuccccucuccagcuaca

SEQ ID NO: 130535 - RNA, 26 nt, Human
uccuccuccccagagcgagagugggg

SEQ ID NO: 130536 - RNA, 23 nt, Human
agcaggagaaauuucuggacugu

SEQ ID NO: 130537 - RNA, 21 nt, Human
uggagggagugugcucugagu

SEQ ID NO: 130538 - RNA, 22 nt, Human
cuggaggcggagguugcaguga

SEQ ID NO: 130539 - RNA, 17 nt, Human
aucugacagagaacuca

SEQ ID NO: 130540 - RNA, 22 nt, Human
gggcucucuaccccucuccuca

SEQ ID NO: 130541 - RNA, 28 nt, Human
ccaagcuucccugcaucuugguccuugu

SEQ ID NO: 130542 - RNA, 23 nt, Human
ccuugccuauuuucaucuugcug

SEQ ID NO: 130543 - RNA, 28 nt, Human
cgccugccgccucgcagccccucugcgu

SEQ ID NO: 130544 - RNA, 23 nt, Human
ccuccccuuccccucccugcccc

SEQ ID NO: 130545 - RNA, 19 nt, Human
ccccugaggagaacuuucu

SEQ ID NO: 130546 - RNA, 20 nt, Human
ccugcuguuuucccugccug

SEQ ID NO: 130547 - RNA, 21 nt, Human
uuccaaaucuaacuuugcaca

SEQ ID NO: 130548 - RNA, 26 nt, Human
ccagccugaccagcaucggccuggcc

SEQ ID NO: 130549 - RNA, 20 nt, Human
uuauuugaaucuacaaaaaa

SEQ ID NO: 130550 - RNA, 23 nt, Human
ucaggcuuaaacaucacagcaga

SEQ ID NO: 130551 - RNA, 27 nt, Human
agagaaguguagaggaugauguuuaca

SEQ ID NO: 130552 - RNA, 24 nt, Human
ccucccuacagagagaugcugucc

SEQ ID NO: 130553 - RNA, 20 nt, Human
cagccaguaaggcagcucug

SEQ ID NO: 130554 - RNA, 19 nt, Human
cuccacccacccuccugcc

SEQ ID NO: 130555 - RNA, 27 nt, Human
accuugacguugcagugcaguuucaca

SEQ ID NO: 130556 - RNA, 20 nt, Human
gcucacaucuuucauuggug

SEQ ID NO: 130557 - RNA, 26 nt, Human
caguuuuauccuggccuuguacuugc

SEQ ID NO: 130558 - RNA, 23 nt, Human
acucaggaagcacuuggugagga

SEQ ID NO: 130559 - RNA, 27 nt, Human
caggagguggcuggauugcagggcugg

SEQ ID NO: 130560 - RNA, 26 nt, Human
cuguaacucccuccaucccaaccugg

SEQ ID NO: 130561 - RNA, 20 nt, Human
uggggugagaggaggcccag

SEQ ID NO: 130562 - RNA, 20 nt, Human
uugcccaggcuagucuggaa

SEQ ID NO: 130563 - RNA, 20 nt, Human
ggugcaggaagcgccagcug

SEQ ID NO: 130564 - RNA, 23 nt, Human
acgcgcccugggcgcacgcccag

SEQ ID NO: 130565 - RNA, 21 nt, Human
cucugagcgccuccauccaag

SEQ ID NO: 130566 - RNA, 21 nt, Human
ggugguauccaaaaucuucag

SEQ ID NO: 130567 - RNA, 21 nt, Human
ucuuauccuuguaucuuuuua

SEQ ID NO: 130568 - RNA, 22 nt, Human
cagccucugcuucucccuuuua

SEQ ID NO: 130569 - RNA, 22 nt, Human
agaccagccucggcaacauggc

SEQ ID NO: 130570 - RNA, 21 nt, Human
cugacaucagucacugcgucu

SEQ ID NO: 130571 - RNA, 25 nt, Human
uuuucucagucaaccagcuagaugc

SEQ ID NO: 130572 - RNA, 22 nt, Human
caagaggaagaaaaaugaugga

SEQ ID NO: 130573 - RNA, 26 nt, Human
cugcacguuucuuucucuccugauuc

SEQ ID NO: 130574 - RNA, 26 nt, Human
gcuagccucaaccuccuggggcaggg

SEQ ID NO: 130575 - RNA, 24 nt, Human
uucaaccacccuagagaacugccu

SEQ ID NO: 130576 - RNA, 27 nt, Human
cagcccagauacucuucaucuauucaa

SEQ ID NO: 130577 - RNA, 23 nt, Human
uccucagggguugugauccagcu

SEQ ID NO: 130578 - RNA, 22 nt, Human
cuaccuccuggguucaagcaaa

SEQ ID NO: 130579 - RNA, 18 nt, Human
ucaugacaucacaaccug

SEQ ID NO: 130580 - RNA, 18 nt, Human
agcccacugcaacugcua

SEQ ID NO: 130581 - RNA, 26 nt, Human
cgcgccgccucacuggacucauggac

SEQ ID NO: 130582 - RNA, 22 nt, Human
cgagcagcggcggugcccacac

SEQ ID NO: 130583 - RNA, 22 nt, Human
agaagaaauguuauacagggaa

SEQ ID NO: 130584 - RNA, 27 nt, Human
cgcugccgccucuuccccgccgcaugg

SEQ ID NO: 130585 - RNA, 28 nt, Human
ggcaguauucacaugcuuuaaacugaag

SEQ ID NO: 130586 - RNA, 26 nt, Human
ugagccaagaucacaccauugcacuc

SEQ ID NO: 130587 - RNA, 22 nt, Human
augccuguaaccccagcacuuu

SEQ ID NO: 130588 - RNA, 23 nt, Human
gaaguguccuuuauauuaccaga

SEQ ID NO: 130589 - RNA, 26 nt, Human
uguauguuucaggauauuugaccugu

SEQ ID NO: 130590 - RNA, 22 nt, Human
cuccugaggucuuuguucucac

SEQ ID NO: 130591 - RNA, 22 nt, Human
gacaggggaaggguguucuuuc

SEQ ID NO: 130592 - RNA, 24 nt, Human
cugucauucaggcuggagugcagu

SEQ ID NO: 130593 - RNA, 24 nt, Human
ucauggagcacuccauagucucaa

SEQ ID NO: 130594 - RNA, 20 nt, Human
cuguguugaaauauaguuga

SEQ ID NO: 130595 - RNA, 22 nt, Human
ucuuacagacuguaucagucua

SEQ ID NO: 130596 - RNA, 20 nt, Human
ucuucagaacacacagacuu

SEQ ID NO: 130597 - RNA, 23 nt, Human
cuaacuccuagcugacucagcau

SEQ ID NO: 130598 - RNA, 25 nt, Human
cccaaggaguaaucagagggugaga

SEQ ID NO: 130599 - RNA, 28 nt, Human
auuguauacugccuuuuuguaauccugu

SEQ ID NO: 130600 - RNA, 23 nt, Human
ucaaucaaggaaaaucuaauaaa

SEQ ID NO: 130601 - RNA, 25 nt, Human
ugguggcgaaugacuguaaucccag

SEQ ID NO: 130602 - RNA, 27 nt, Human
ugcacacaagcccacagcacagcuccc

SEQ ID NO: 130603 - RNA, 19 nt, Human
cccaacaccacccuaaacc

SEQ ID NO: 130604 - RNA, 24 nt, Human
gcuggaaagguugagcccagagug

SEQ ID NO: 130605 - RNA, 18 nt, Human
ucuccaucccucucucau

SEQ ID NO: 130606 - RNA, 26 nt, Human
uuuaaacaccauuuacccuacuuauc

SEQ ID NO: 130607 - RNA, 23 nt, Human
ucuucuuccuccugugcugaccu

SEQ ID NO: 130608 - RNA, 27 nt, Human
cgugauccguccaccuuggccuugcaa

SEQ ID NO: 130609 - RNA, 22 nt, Human
aaguacacucugucacuuuguc

SEQ ID NO: 130610 - RNA, 21 nt, Human
ccuccacccucucccccagcc

SEQ ID NO: 130611 - RNA, 27 nt, Human
uccugcuccauggaguccugaguugcu

SEQ ID NO: 130612 - RNA, 21 nt, Human
gguucagaaacugccaggggc

SEQ ID NO: 130613 - RNA, 26 nt, Human
aucauccugaucuaaccauuccccag

SEQ ID NO: 130614 - RNA, 25 nt, Human
ccgcacggaggggcuccuggggguc

SEQ ID NO: 130615 - RNA, 27 nt, Human
ucacaaaccgcuggguuuuugaaagga

SEQ ID NO: 130616 - RNA, 23 nt, Human
ggaggagggaaagauuagcuuug

SEQ ID NO: 130617 - RNA, 21 nt, Human
gagaacccuggggacccagaa

SEQ ID NO: 130618 - RNA, 23 nt, Human
gugaacaaacaaugaaaacucuu

SEQ ID NO: 130619 - RNA, 24 nt, Human
cugccuggcucugcucgcuccggc

SEQ ID NO: 130620 - RNA, 21 nt, Human
gguucuugccugcuucacugu

SEQ ID NO: 130621 - RNA, 18 nt, Human
cacagcuacucagaucug

SEQ ID NO: 130622 - RNA, 27 nt, Human
uggucaacauggugaaaccccgucucu

SEQ ID NO: 130623 - RNA, 24 nt, Human
gugauggagagucucugccgugcc

SEQ ID NO: 130624 - RNA, 22 nt, Human
ggcggcagcgcccugccgacgc

SEQ ID NO: 130625 - RNA, 24 nt, Human
uuaggucuuuucaaaagggugaga

SEQ ID NO: 130626 - RNA, 24 nt, Human
gguugccaggggcugggguccagg

SEQ ID NO: 130627 - RNA, 26 nt, Human
agcuucagucucggaacaugaccuuu

SEQ ID NO: 130628 - RNA, 27 nt, Human
cccagcaccuagaguagugcuuggugc

SEQ ID NO: 130629 - RNA, 22 nt, Human
gaauuccugggcucaagcuucc

SEQ ID NO: 130630 - RNA, 22 nt, Human
cacacacacuccuuccccuugu

SEQ ID NO: 130631 - RNA, 24 nt, Human
uggcuaacacggugaaaccccauc

SEQ ID NO: 130632 - RNA, 27 nt, Human
acacuucagcagggcggcgacuuggca

SEQ ID NO: 130633 - RNA, 24 nt, Human
ucucacugugucacccagacugga

SEQ ID NO: 130634 - RNA, 22 nt, Human
gggucaggggucagagauucug

SEQ ID NO: 130635 - RNA, 26 nt, Human
uuguccaguguggccccuagaauuga

SEQ ID NO: 130636 - RNA, 22 nt, Human
gcuugcacaucaguaguuucug

SEQ ID NO: 130637 - RNA, 23 nt, Human
cugcuuugggguuccuggggugg

SEQ ID NO: 130638 - RNA, 23 nt, Human
gcuuguaaucccagcuacucugg

SEQ ID NO: 130639 - RNA, 20 nt, Human
gcugggagggaaaaggcugg

SEQ ID NO: 130640 - RNA, 21 nt, Human
uggcuuugcccagccugcugc

SEQ ID NO: 130641 - RNA, 22 nt, Human
uuugcacgauuucauccauuuu

SEQ ID NO: 130642 - RNA, 22 nt, Human
uguguccaugugaaauuuacag

SEQ ID NO: 130643 - RNA, 18 nt, Human
uccuugagugaggcaugc

SEQ ID NO: 130644 - RNA, 23 nt, Human
uccaagccccuugccaagggagu

SEQ ID NO: 130645 - RNA, 22 nt, Human
cccacagagucuguguguagcc

SEQ ID NO: 130646 - RNA, 26 nt, Human
ggaguaugagcucagcagauguacuu

SEQ ID NO: 130647 - RNA, 22 nt, Human
cccaggcccugugagcucacca

SEQ ID NO: 130648 - RNA, 25 nt, Human
ucagcaacccuuccugcugcugcua

SEQ ID NO: 130649 - RNA, 24 nt, Human
auaguguccuaaacgacuuuuuua

SEQ ID NO: 130650 - RNA, 22 nt, Human
gagugucucugccuggagcagg

SEQ ID NO: 130651 - RNA, 29 nt, Human
ggagcucguaauuuuuuaacuguaagcuu

SEQ ID NO: 130652 - RNA, 19 nt, Human
gcaugaucaccagagggug

SEQ ID NO: 130653 - RNA, 24 nt, Human
gccugaucuuuaccacugcagggg

SEQ ID NO: 130654 - RNA, 18 nt, Human
cgccccucagccucugcc

SEQ ID NO: 130655 - RNA, 27 nt, Human
ucccaaggcugccagacauggacuccg

SEQ ID NO: 130656 - RNA, 20 nt, Human
ugagagugguacaagggaga

SEQ ID NO: 130657 - RNA, 20 nt, Human
cuaccuuuguauucucuccu

SEQ ID NO: 130658 - RNA, 26 nt, Human
gggugaggauugaagcagcccagucu

SEQ ID NO: 130659 - RNA, 25 nt, Human
ccaugaauucauaucugaaaccauu

SEQ ID NO: 130660 - RNA, 22 nt, Human
ggccucccggguggcugggauu

SEQ ID NO: 130661 - RNA, 22 nt, Human
ugccuccccaccgcccaccucg

SEQ ID NO: 130662 - RNA, 23 nt, Human
ugugccaagauucuacucuuguc

SEQ ID NO: 130663 - RNA, 20 nt, Human
gagcagggagccugggggug

SEQ ID NO: 130664 - RNA, 18 nt, Human
cccaaguagauuuacaug

SEQ ID NO: 130665 - RNA, 21 nt, Human
acaaaccuaaaaauuuuguga

SEQ ID NO: 130666 - RNA, 26 nt, Human
gcucugcccagccucgcgugaccuca

SEQ ID NO: 130667 - RNA, 22 nt, Human
ucuaacauagcuuaagcuauug

SEQ ID NO: 130668 - RNA, 20 nt, Human
gggcacagccuuccucccca

SEQ ID NO: 130669 - RNA, 22 nt, Human
caccacugcacuccagccuagg

SEQ ID NO: 130670 - RNA, 24 nt, Human
ccuuucuacucacugaugccuuca

SEQ ID NO: 130671 - RNA, 23 nt, Human
gcaggucggccaggagcuccugc

SEQ ID NO: 130672 - RNA, 20 nt, Human
guuugaacucuucuuugcca

SEQ ID NO: 130673 - RNA, 21 nt, Human
ccagccugggugacagaguaa

SEQ ID NO: 130674 - RNA, 21 nt, Human
ccagccuggguaacagaguga

SEQ ID NO: 130675 - RNA, 28 nt, Human
cagcguguccacaucacagcucccucca

SEQ ID NO: 130676 - RNA, 24 nt, Human
ugcaccauuggguggagucuggug

SEQ ID NO: 130677 - RNA, 23 nt, Human
gucugagcucugcugcaucuguc

SEQ ID NO: 130678 - RNA, 28 nt, Human
ggaacuccugccauuaccagcucccuuc

SEQ ID NO: 130679 - RNA, 16 nt, Human
accagggaaugccuug

SEQ ID NO: 130680 - RNA, 27 nt, Human
ugaccaacaggcguuucagcgagcuuu

SEQ ID NO: 130681 - RNA, 18 nt, Human
acaacaucauaguaauuu

SEQ ID NO: 130682 - RNA, 23 nt, Human
cugggaggagcagggugagggug

SEQ ID NO: 130683 - RNA, 27 nt, Human
gaggaagaguaaacacagugcuggcuc

SEQ ID NO: 130684 - RNA, 21 nt, Human
agguucccugaucccugggag

SEQ ID NO: 130685 - RNA, 23 nt, Human
aggcaggagaagaacaagaaaug

SEQ ID NO: 130686 - RNA, 27 nt, Human
uuaaaaaagucuacaacauagcagauc

SEQ ID NO: 130687 - RNA, 25 nt, Human
auucuuuuucaagauucucagugug

SEQ ID NO: 130688 - RNA, 19 nt, Human
auguauacauuagaugugu

SEQ ID NO: 130689 - RNA, 27 nt, Human
ugcacacauaucuccuguucucugaga

SEQ ID NO: 130690 - RNA, 20 nt, Human
uccagccuggacucccgagc

SEQ ID NO: 130691 - RNA, 23 nt, Human
uucuccucugugggaaagagguu

SEQ ID NO: 130692 - RNA, 26 nt, Human
cucugccgcccaaacuggagugcagu

SEQ ID NO: 130693 - RNA, 23 nt, Human
ugucgcccaggcuggagugcaau

SEQ ID NO: 130694 - RNA, 23 nt, Human
cacugcuguaaccccgcgccggc

SEQ ID NO: 130695 - RNA, 20 nt, Human
gagaagcaaguagcucuugc

SEQ ID NO: 130696 - RNA, 16 nt, Human
uuugcagugccugugu

SEQ ID NO: 130697 - RNA, 22 nt, Human
aggcucccugccccuccucaug

SEQ ID NO: 130698 - RNA, 23 nt, Human
cugaacucucuggaccucagguu

SEQ ID NO: 130699 - RNA, 21 nt, Human
ggagaaacuuagauuaaaauu

SEQ ID NO: 130700 - RNA, 21 nt, Human
ggcccaggcuagagugcagug

SEQ ID NO: 130701 - RNA, 20 nt, Human
acauuugcacaccuuccaca

SEQ ID NO: 130702 - RNA, 22 nt, Human
gugcauaugcauauacauugua

SEQ ID NO: 130703 - RNA, 19 nt, Human
ccuccuggcccugccucua

SEQ ID NO: 130704 - RNA, 21 nt, Human
cccagcacugccgucuacuca

SEQ ID NO: 130705 - RNA, 27 nt, Human
ccugccugacccuucaaggccugaccu

SEQ ID NO: 130706 - RNA, 27 nt, Human
uuuuggcuauugggaauagugcugcua

SEQ ID NO: 130707 - RNA, 26 nt, Human
gggagcgcggaggggaagggagcccc

SEQ ID NO: 130708 - RNA, 22 nt, Human
ggcucacugccuccugcccuuc

SEQ ID NO: 130709 - RNA, 24 nt, Human
guuaguucccuacuccauccuucc

SEQ ID NO: 130710 - RNA, 25 nt, Human
gugguauaacuguuccgcugccuuc

SEQ ID NO: 130711 - RNA, 14 nt, Human
uguucuuugcagug

SEQ ID NO: 130712 - RNA, 21 nt, Human
cugaaggugcuaauugcuugg

SEQ ID NO: 130713 - RNA, 21 nt, Human
gcagggcagagccguccagac

SEQ ID NO: 130714 - RNA, 25 nt, Human
ugggcuggcauuggucacaccaggc

SEQ ID NO: 130715 - RNA, 24 nt, Human
ccauggcuucaggagagggucucu

SEQ ID NO: 130716 - RNA, 22 nt, Human
auuucccaagcuggagugcagu

SEQ ID NO: 130717 - RNA, 24 nt, Human
ccuggucugugcauuguggcuguc

SEQ ID NO: 130718 - RNA, 25 nt, Human
gaccucaggugaucuacccaccucg

SEQ ID NO: 130719 - RNA, 25 nt, Human
cauaaucaagauccugccucuacgg

SEQ ID NO: 130720 - RNA, 23 nt, Human
uuugagggugaugugcacuauga

SEQ ID NO: 130721 - RNA, 20 nt, Human
ucagcacuuauuucuguagu

SEQ ID NO: 130722 - RNA, 22 nt, Human
gaauuucucuccacaaguguga

SEQ ID NO: 130723 - RNA, 24 nt, Human
agccucaccucuaccugcccccau

SEQ ID NO: 130724 - RNA, 20 nt, Human
gcacauuuacugaaauguaa

SEQ ID NO: 130725 - RNA, 22 nt, Human
ggagagucaaugggcagagcca

SEQ ID NO: 130726 - RNA, 24 nt, Human
auuguucaucuuuaaauucuuucc

SEQ ID NO: 130727 - RNA, 22 nt, Human
ccucaccucuccaagcucugcc

SEQ ID NO: 130728 - RNA, 21 nt, Human
uucauaccugguggagccuua

SEQ ID NO: 130729 - RNA, 27 nt, Human
cgccaucacacuccagccugcucuucc

SEQ ID NO: 130730 - RNA, 23 nt, Human
acaaaugaacgauauguagcaga

SEQ ID NO: 130731 - RNA, 26 nt, Human
ggcaucaguugauuaucuuuucucau

SEQ ID NO: 130732 - RNA, 21 nt, Human
uugucuagaggugagaccaaa

SEQ ID NO: 130733 - RNA, 27 nt, Human
ucuuuuuauccuuauuccucccccgac

SEQ ID NO: 130734 - RNA, 23 nt, Human
ugcggcgacgccuggauccugcc

SEQ ID NO: 130735 - RNA, 21 nt, Human
cacgaccacacaggacaccca

SEQ ID NO: 130736 - RNA, 27 nt, Human
uccuccagggggcccagggugccugca

SEQ ID NO: 130737 - RNA, 22 nt, Human
ucccugccccucugcuggcaca

SEQ ID NO: 130738 - RNA, 25 nt, Human
uucugcaggaaaccccagcagugug

SEQ ID NO: 130739 - RNA, 27 nt, Human
guuuuugagagaagguauugcucuguc

SEQ ID NO: 130740 - RNA, 32 nt, Human
gaggcggcguuaccuccagauuccguagaguu

SEQ ID NO: 130741 - RNA, 24 nt, Human
cucauuucaugcagguuuguguuu

SEQ ID NO: 130742 - RNA, 22 nt, Human
gccgcuggacuccgcugccucc

SEQ ID NO: 130743 - RNA, 25 nt, Human
agcuuucugggaauucaguuggagu

SEQ ID NO: 130744 - RNA, 22 nt, Human
ggcagguugcaguggaggggcc

SEQ ID NO: 130745 - RNA, 21 nt, Human
cauuccccaccuuuccugugg

SEQ ID NO: 130746 - RNA, 23 nt, Human
gggaccucagacugaaucaaaga

SEQ ID NO: 130747 - RNA, 26 nt, Human
agcagagggcagaaggcuugcacuug

SEQ ID NO: 130748 - RNA, 30 nt, Human
gggaaggacccccucccccacccaccucuc

SEQ ID NO: 130749 - RNA, 26 nt, Human
cacaucucacucauccuucuacucgu

SEQ ID NO: 130750 - RNA, 28 nt, Human
cccugccccuuaaccccaaggacugagg

SEQ ID NO: 130751 - RNA, 20 nt, Human
ugcacaaacauagacagaug

SEQ ID NO: 130752 - RNA, 27 nt, Human
gagcccaagcgcucccagccagcuucc

SEQ ID NO: 130753 - RNA, 29 nt, Human
ggagaaggaggcggagggagcgauugugg

SEQ ID NO: 130754 - RNA, 20 nt, Human
gccuauucccucuaggaacc

SEQ ID NO: 130755 - RNA, 21 nt, Human
aauccccagauauuuauguau

SEQ ID NO: 130756 - RNA, 19 nt, Human
gauccgcuaacaggcacag

SEQ ID NO: 130757 - RNA, 22 nt, Human
ugaggguagaggcaggggaaga

SEQ ID NO: 130758 - RNA, 21 nt, Human
ggacgcuccuuucugcugaca

SEQ ID NO: 130759 - RNA, 24 nt, Human
ugccuccaggagcugcaagaaguc

SEQ ID NO: 130760 - RNA, 24 nt, Human
gauuauacucaacuuacuguuuag

SEQ ID NO: 130761 - RNA, 25 nt, Human
uucaguuuugucauuguucuaguaa

SEQ ID NO: 130762 - RNA, 29 nt, Human
aguaaaucuaaauguggcuuuugucaagc

SEQ ID NO: 130763 - RNA, 22 nt, Human
cuuguucuuccucuuaucuucc

SEQ ID NO: 130764 - RNA, 28 nt, Human
cugauuguuguuuccuuuuucuccuccc

SEQ ID NO: 130765 - RNA, 22 nt, Human
gaagggagaagaaaggugaguu

SEQ ID NO: 130766 - RNA, 20 nt, Human
uuccuaaguccgcuucuggu

SEQ ID NO: 130767 - RNA, 20 nt, Human
ccguucccggguagccacug

SEQ ID NO: 130768 - RNA, 26 nt, Human
auucuuuaacauacaucuaagucagu

SEQ ID NO: 130769 - RNA, 21 nt, Human
aggggagacaggagccuagcg

SEQ ID NO: 130770 - RNA, 20 nt, Human
guagggaaaaggauccacug

SEQ ID NO: 130771 - RNA, 18 nt, Human
guucccccacaccugcca

SEQ ID NO: 130772 - RNA, 23 nt, Human
ugggguggggaagggaggggagc

SEQ ID NO: 130773 - RNA, 23 nt, Human
gcuccuagcugaccauucauucu

SEQ ID NO: 130774 - RNA, 23 nt, Human
ggucucacaaaaagcaauccauc

SEQ ID NO: 130775 - RNA, 20 nt, Human
cagggagguguggacuggau

SEQ ID NO: 130776 - RNA, 21 nt, Human
ccagaccccagccuccccucc

SEQ ID NO: 130777 - RNA, 24 nt, Human
aaaauauucaauuaaacauucaua

SEQ ID NO: 130778 - RNA, 27 nt, Human
gcacuccucugucucugcucuugccuc

SEQ ID NO: 130779 - RNA, 27 nt, Human
cagcccagacccuucuccuuagaagug

SEQ ID NO: 130780 - RNA, 19 nt, Human
gcagcaucuuuaacacagc

SEQ ID NO: 130781 - RNA, 22 nt, Human
aguccaggccauggaggcagaa

SEQ ID NO: 130782 - RNA, 23 nt, Human
uggccuggacgcuguggcuuaag

SEQ ID NO: 130783 - RNA, 20 nt, Human
gcucacugcaaccucaaucc

SEQ ID NO: 130784 - RNA, 20 nt, Human
aucuuccagccucugccucc

SEQ ID NO: 130785 - RNA, 20 nt, Human
ccucuccagcuccugcaccc

SEQ ID NO: 130786 - RNA, 23 nt, Human
ccaugcugucaacuccugccucc

SEQ ID NO: 130787 - RNA, 22 nt, Human
cugagaagggagagcgagcuua

SEQ ID NO: 130788 - RNA, 21 nt, Human
uauuuucuuaaaacagcagau

SEQ ID NO: 130789 - RNA, 26 nt, Human
aucuccauuuucugaccucuggacua

SEQ ID NO: 130790 - RNA, 26 nt, Human
uccugcucugucuuucucagaaaacc

SEQ ID NO: 130791 - RNA, 20 nt, Human
ugcuuauuucucaaaaaaga

SEQ ID NO: 130792 - RNA, 21 nt, Human
cacgucaggcuguggagcagg

SEQ ID NO: 130793 - RNA, 24 nt, Human
uggcgaugggguccuggcagcgug

SEQ ID NO: 130794 - RNA, 27 nt, Human
gccacugccaacauuucccuucuucca

SEQ ID NO: 130795 - RNA, 26 nt, Human
cccagccaagcucagaguaggcgccc

SEQ ID NO: 130796 - RNA, 25 nt, Human
guguuucucccuuucgagccggcgg

SEQ ID NO: 130797 - RNA, 28 nt, Human
gaggcaagccucaaggcacuucuaggac

SEQ ID NO: 130798 - RNA, 21 nt, Human
agccgcuguuaccucuuguuu

SEQ ID NO: 130799 - RNA, 19 nt, Human
uaagaaccagauugaaaug

SEQ ID NO: 130800 - RNA, 22 nt, Human
aaagugaugggauuacaggcau

SEQ ID NO: 130801 - RNA, 20 nt, Human
ucaggcagacugguggcagu

SEQ ID NO: 130802 - RNA, 20 nt, Human
aaacuauuuugaaugcuucc

SEQ ID NO: 130803 - RNA, 19 nt, Human
gacacgucuuuucauucca

SEQ ID NO: 130804 - RNA, 20 nt, Human
ugcugcuggcuaagcauuua

SEQ ID NO: 130805 - RNA, 19 nt, Human
cuaagcccacaaucaugcc

SEQ ID NO: 130806 - RNA, 22 nt, Human
uuuuucuccuuuuggagggaga

SEQ ID NO: 130807 - RNA, 20 nt, Human
gggagguggaguugcaguga

SEQ ID NO: 130808 - RNA, 21 nt, Human
uugcagacugggugaggugga

SEQ ID NO: 130809 - RNA, 21 nt, Human
cagaauuguuuugagaugugu

SEQ ID NO: 130810 - RNA, 22 nt, Human
aacuauucacaaaauaucacca

SEQ ID NO: 130811 - RNA, 19 nt, Human
agcacagguucucagucua

SEQ ID NO: 130812 - RNA, 23 nt, Human
ccggagccgcagccaccggugcc

SEQ ID NO: 130813 - RNA, 26 nt, Human
ucaggcaauucuccugccuuugccuc

SEQ ID NO: 130814 - RNA, 19 nt, Human
auugcugaauucugaaaug

SEQ ID NO: 130815 - RNA, 20 nt, Human
uagcaaauuuuacuuacagu

SEQ ID NO: 130816 - RNA, 22 nt, Human
ugcagugagccaagauggcgcc

SEQ ID NO: 130817 - RNA, 22 nt, Human
ugcggugagccaagauggcacc

SEQ ID NO: 130818 - RNA, 24 nt, Human
aggugcuuguaaucccagcuacuu

SEQ ID NO: 130819 - RNA, 23 nt, Human
augaauaagcaucugauuuuaug

SEQ ID NO: 130820 - RNA, 19 nt, Human
gccagccugagccagcagu

SEQ ID NO: 130821 - RNA, 26 nt, Human
caccuugccuuccucccccaaaugug

SEQ ID NO: 130822 - RNA, 20 nt, Human
cacccagcuuuauguaaaua

SEQ ID NO: 130823 - RNA, 26 nt, Human
cugaguagcugggacuacaguugugc

SEQ ID NO: 130824 - RNA, 21 nt, Human
cuuacuuagaauuuauccuuu

SEQ ID NO: 130825 - RNA, 19 nt, Human
gauuucugccuuccuugcu

SEQ ID NO: 130826 - RNA, 20 nt, Human
acuacuuagggcacuuagga

SEQ ID NO: 130827 - RNA, 22 nt, Human
aaguuguuaagagugggggaga

SEQ ID NO: 130828 - RNA, 22 nt, Human
guacucaguuaggcagugcagu

SEQ ID NO: 130829 - RNA, 24 nt, Human
gucggcccagacugaagugcagug

SEQ ID NO: 130830 - RNA, 29 nt, Human
ggugccaggcugaccucagcucccgaagg

SEQ ID NO: 130831 - RNA, 28 nt, Human
ucuccagagcuccugaguggaaucaagu

SEQ ID NO: 130832 - RNA, 20 nt, Human
aacccucacccacagccugc

SEQ ID NO: 130833 - RNA, 24 nt, Human
ucagcacuuaacuacuuuguuggc

SEQ ID NO: 130834 - RNA, 21 nt, Human
acacagacuacagccagaagc

SEQ ID NO: 130835 - RNA, 25 nt, Human
caccaguucccuacaagcauggaga

SEQ ID NO: 130836 - RNA, 24 nt, Human
auuccugacccaaggacacugugu

SEQ ID NO: 130837 - RNA, 22 nt, Human
gaccauccuggccaacaugaug

SEQ ID NO: 130838 - RNA, 21 nt, Human
cacucugaaguacagccuggg

SEQ ID NO: 130839 - RNA, 25 nt, Human
gggugggagagagaaaagaaaccag

SEQ ID NO: 130840 - RNA, 26 nt, Human
cuaauaauagaaaacuacccauauuc

SEQ ID NO: 130841 - RNA, 22 nt, Human
gagagccucuuuggagauauca

SEQ ID NO: 130842 - RNA, 15 nt, Human
cuuuacccucaggcu

SEQ ID NO: 130843 - RNA, 22 nt, Human
ggcaggagaauugcuugaaccc

SEQ ID NO: 130844 - RNA, 22 nt, Human
ggcaggagaaucgcuugaaucc

SEQ ID NO: 130845 - RNA, 25 nt, Human
uguuuuaaaagucacuuauuucuua

SEQ ID NO: 130846 - RNA, 28 nt, Human
aaagacagagagggcugaagccuuguca

SEQ ID NO: 130847 - RNA, 23 nt, Human
gugcugagccaccauuucagacu

SEQ ID NO: 130848 - RNA, 21 nt, Human
ugaaggaauuugauugcuuug

SEQ ID NO: 130849 - RNA, 23 nt, Human
auacacagaugauaauaugcuaa

SEQ ID NO: 130850 - RNA, 21 nt, Human
gcauccuggccaacaugguga

SEQ ID NO: 130851 - RNA, 26 nt, Human
cugggagcugggggaaacgacgccag

SEQ ID NO: 130852 - RNA, 22 nt, Human
ggcuuggaaugguuuauugcuu

SEQ ID NO: 130853 - RNA, 22 nt, Human
cuuaccacugcucugaugaaga

SEQ ID NO: 130854 - RNA, 26 nt, Human
gggaggugugauguaguuaucacauu

SEQ ID NO: 130855 - RNA, 22 nt, Human
cccaggcugugcccuccagagg

SEQ ID NO: 130856 - RNA, 23 nt, Human
gcgaagagaucuacccgucuccc

SEQ ID NO: 130857 - RNA, 25 nt, Human
ggugcugccagagagaagguuguca

SEQ ID NO: 130858 - RNA, 22 nt, Human
cagaaacuaagaagguagcaca

SEQ ID NO: 130859 - RNA, 27 nt, Human
ucaggaggugacaguugucuuaguugu

SEQ ID NO: 130860 - RNA, 23 nt, Human
auuguaccacugcacuccagcuc

SEQ ID NO: 130861 - RNA, 22 nt, Human
aggcugagacaggaggauuccu

SEQ ID NO: 130862 - RNA, 20 nt, Human
uguugaauuccuguucuauc

SEQ ID NO: 130863 - RNA, 27 nt, Human
auucaggcugcugaaacaagaaauucu

SEQ ID NO: 130864 - RNA, 22 nt, Human
ccauacaccacacaggcauuug

SEQ ID NO: 130865 - RNA, 21 nt, Human
gaccacauuugauucaacuga

SEQ ID NO: 130866 - RNA, 26 nt, Human
cagaaacaguuuccccacugauggga

SEQ ID NO: 130867 - RNA, 27 nt, Human
cuccagcucaugacacuguuuggccuu

SEQ ID NO: 130868 - RNA, 21 nt, Human
ugcuauguuguccaggcugcu

SEQ ID NO: 130869 - RNA, 23 nt, Human
cugcccaggugacuugugcauug

SEQ ID NO: 130870 - RNA, 20 nt, Human
uauguugggccuccugcugc

SEQ ID NO: 130871 - RNA, 20 nt, Human
caccaucucagugaggggca

SEQ ID NO: 130872 - RNA, 23 nt, Human
aggccagagugcaguggcgcgau

SEQ ID NO: 130873 - RNA, 21 nt, Human
cuuggucucaccuauccugcc

SEQ ID NO: 130874 - RNA, 22 nt, Human
gauugucggauuuccucccuca

SEQ ID NO: 130875 - RNA, 27 nt, Human
uccauuuauaugugaucuuuguuuuau

SEQ ID NO: 130876 - RNA, 19 nt, Human
auuuuuauuugcuuuugug

SEQ ID NO: 130877 - RNA, 23 nt, Human
cucauuucucucugcaaucugca

SEQ ID NO: 130878 - RNA, 22 nt, Human
uuggggacacagggaagggaaa

SEQ ID NO: 130879 - RNA, 22 nt, Human
agaaccgaagaagccacaggca

SEQ ID NO: 130880 - RNA, 22 nt, Human
cagggucucacucugucacuca

SEQ ID NO: 130881 - RNA, 19 nt, Human
gccuuucuacuccuuugcc

SEQ ID NO: 130882 - RNA, 22 nt, Human
gugaagccucugagggauugag

SEQ ID NO: 130883 - RNA, 21 nt, Human
uggaugccagggcgugcucca

SEQ ID NO: 130884 - RNA, 26 nt, Human
gccaggcaaugguguggcccugcacu

SEQ ID NO: 130885 - RNA, 23 nt, Human
caaguagcugggauuacagacuc

SEQ ID NO: 130886 - RNA, 21 nt, Human
uggccuggcacaucagaaagg

SEQ ID NO: 130887 - RNA, 24 nt, Human
cagcucuuaaccauuccagucuau

SEQ ID NO: 130888 - RNA, 27 nt, Human
gugucccagggcccuggaugguccucu

SEQ ID NO: 130889 - RNA, 19 nt, Human
aagaguuuucaagauguca

SEQ ID NO: 130890 - RNA, 23 nt, Human
uaaaggagagcaaggaacaugua

SEQ ID NO: 130891 - RNA, 24 nt, Human
gauauuucagugucauggacuucc

SEQ ID NO: 130892 - RNA, 22 nt, Human
uauuaaaagucuacguuuucca

SEQ ID NO: 130893 - RNA, 23 nt, Human
uauuauuccagaucugcagucac

SEQ ID NO: 130894 - RNA, 23 nt, Human
gcugcucuuuuuguucccuucug

SEQ ID NO: 130895 - RNA, 22 nt, Human
ccugccucuacuccaccuccau

SEQ ID NO: 130896 - RNA, 21 nt, Human
cccucagaaagggaaagaguu

SEQ ID NO: 130897 - RNA, 28 nt, Human
gggagacugauaacuuggggaggcaaga

SEQ ID NO: 130898 - RNA, 21 nt, Human
ucccugcuuaaagggaacuga

SEQ ID NO: 130899 - RNA, 23 nt, Human
aucaugcuacugcacuccagcuu

SEQ ID NO: 130900 - RNA, 27 nt, Human
uuaccauugcuuccuccagcuugucag

SEQ ID NO: 130901 - RNA, 22 nt, Human
cagaucugaugaugccaggagg

SEQ ID NO: 130902 - RNA, 27 nt, Human
agagcaucugauucuuguugcuguaca

SEQ ID NO: 130903 - RNA, 27 nt, Human
aaacuauucuuucaugucugauucuga

SEQ ID NO: 130904 - RNA, 21 nt, Human
cuugcuuggaagaauaagcag

SEQ ID NO: 130905 - RNA, 22 nt, Human
aagcauuaugguuuucagaaca

SEQ ID NO: 130906 - RNA, 21 nt, Human
ugugagccagcagcgaguccg

SEQ ID NO: 130907 - RNA, 23 nt, Human
gcagaaggugaagcaggaagcac

SEQ ID NO: 130908 - RNA, 22 nt, Human
aguaaagcauacaaauacuaga

SEQ ID NO: 130909 - RNA, 22 nt, Human
cccccaggcuggagugcagugg

SEQ ID NO: 130910 - RNA, 22 nt, Human
cacccaggcuggagugccgugg

SEQ ID NO: 130911 - RNA, 21 nt, Human
gggagguggagguugcaguga

SEQ ID NO: 130912 - RNA, 18 nt, Human
uugcccaggcuggagugc

SEQ ID NO: 130913 - RNA, 19 nt, Human
cagcacugugaugcuuuau

SEQ ID NO: 130914 - RNA, 27 nt, Human
ggagcaguuuggggcaggggguucugg

SEQ ID NO: 130915 - RNA, 24 nt, Human
cacggcccugccccauccugggcc

SEQ ID NO: 130916 - RNA, 20 nt, Human
cucucugcugacucaaguuc

SEQ ID NO: 130917 - RNA, 22 nt, Human
ccacacacauacacacacgcau

SEQ ID NO: 130918 - RNA, 20 nt, Human
ggagagcaugaggggugggg

SEQ ID NO: 130919 - RNA, 27 nt, Human
gcuagaugacaaucucauugagaagca

SEQ ID NO: 130920 - RNA, 22 nt, Human
cucccccauguucugucccuug

SEQ ID NO: 130921 - RNA, 30 nt, Human
gcugugaccuccgagcccuccuggugggaa

SEQ ID NO: 130922 - RNA, 23 nt, Human
cagagggcaaagaggugaacaua

SEQ ID NO: 130923 - RNA, 17 nt, Human
accuugcuuugcacuga

SEQ ID NO: 130924 - RNA, 24 nt, Human
ugaaaguauguagucagcucuugu

SEQ ID NO: 130925 - RNA, 23 nt, Human
aucuucuaggaucuaagccacua

SEQ ID NO: 130926 - RNA, 21 nt, Human
uugccugcccugucuccuggg

SEQ ID NO: 130927 - RNA, 21 nt, Human
guucacugcaaucucugccuc

SEQ ID NO: 130928 - RNA, 25 nt, Human
gugaacaaagcagccacgaggugca

SEQ ID NO: 130929 - RNA, 25 nt, Human
cugagccuugguguacagaccaccu

SEQ ID NO: 130930 - RNA, 22 nt, Human
uugcccaagacagaaacacacu

SEQ ID NO: 130931 - RNA, 27 nt, Human
ucuucuuuaugucuaccuccuccauua

SEQ ID NO: 130932 - RNA, 28 nt, Human
uguguaaaucugccuuuaucuuggauug

SEQ ID NO: 130933 - RNA, 24 nt, Human
uuggauagauacagcccuacaaau

SEQ ID NO: 130934 - RNA, 27 nt, Human
uucucucucagcauucuuuauccccug

SEQ ID NO: 130935 - RNA, 22 nt, Human
auuaaaauauuuuaauucuuca

SEQ ID NO: 130936 - RNA, 21 nt, Human
cucuaauuaaaaagauagaaa

SEQ ID NO: 130937 - RNA, 26 nt, Human
gaagcagccaggacucuuccuaccac

SEQ ID NO: 130938 - RNA, 22 nt, Human
aagucaaaggaaaaugagccca

SEQ ID NO: 130939 - RNA, 22 nt, Human
ucaccaggcuggagugcagugg

SEQ ID NO: 130940 - RNA, 20 nt, Human
gcccugcucuguagggcuga

SEQ ID NO: 130941 - RNA, 22 nt, Human
acagccuagaaggugagaagca

SEQ ID NO: 130942 - RNA, 23 nt, Human
ggcaagcaagaugcccacacaac

SEQ ID NO: 130943 - RNA, 19 nt, Human
gggguggaaauaggguggg

SEQ ID NO: 130944 - RNA, 21 nt, Human
uuugucuuccucacuuuucac

SEQ ID NO: 130945 - RNA, 19 nt, Human
cugaguguauauguucgua

SEQ ID NO: 130946 - RNA, 23 nt, Human
ucugucauccugcuaaugugcau

SEQ ID NO: 130947 - RNA, 23 nt, Human
cuggucccugcgagcccguggag

SEQ ID NO: 130948 - RNA, 27 nt, Human
aucucagccaacaugcaucaguacugc

SEQ ID NO: 130949 - RNA, 31 nt, Human
cugcucagggcuauccucucagagugacauu

SEQ ID NO: 130950 - RNA, 21 nt, Human
ccuuagcccagcaagccaggc

SEQ ID NO: 130951 - RNA, 21 nt, Human
ggaagcacagcagcaucuuca

SEQ ID NO: 130952 - RNA, 27 nt, Human
gcucccucugcucuuccucccuucgcu

SEQ ID NO: 130953 - RNA, 23 nt, Human
caucucaguggcuggaggccaug

SEQ ID NO: 130954 - RNA, 20 nt, Human
ucauuccaguuuauugaccu

SEQ ID NO: 130955 - RNA, 22 nt, Human
caggaggcuggggaugggggug

SEQ ID NO: 130956 - RNA, 23 nt, Human
agguacccaccguccugucagcu

SEQ ID NO: 130957 - RNA, 23 nt, Human
ucuaauucaacucugugucccag

SEQ ID NO: 130958 - RNA, 26 nt, Human
ggacugggggugugggaguuggugag

SEQ ID NO: 130959 - RNA, 19 nt, Human
ugggaagagagagggacag

SEQ ID NO: 130960 - RNA, 21 nt, Human
cuaucucuguggcuuucagcu

SEQ ID NO: 130961 - RNA, 22 nt, Human
uuuguguaugugcucugugcca

SEQ ID NO: 130962 - RNA, 19 nt, Human
ugggauaggggcagaggag

SEQ ID NO: 130963 - RNA, 20 nt, Human
gggguggaauaaaggcugag

SEQ ID NO: 130964 - RNA, 21 nt, Human
ucuccacccuucaugacugcc

SEQ ID NO: 130965 - RNA, 22 nt, Human
acucgggaagcugaggcaggug

SEQ ID NO: 130966 - RNA, 25 nt, Human
gcccagccacaccaccaaacacccu

SEQ ID NO: 130967 - RNA, 21 nt, Human
aggggaaaacauguauguuug

SEQ ID NO: 130968 - RNA, 22 nt, Human
cuaacacggugaaaccccgucu

SEQ ID NO: 130969 - RNA, 23 nt, Human
aaaacaaaagauauuuuuaaccc

SEQ ID NO: 130970 - RNA, 21 nt, Human
guuucaaacuccugaccucag

SEQ ID NO: 130971 - RNA, 24 nt, Human
aacaugugaaugaaucgucuugga

SEQ ID NO: 130972 - RNA, 23 nt, Human
ugcacaccagagacaagcagagu

SEQ ID NO: 130973 - RNA, 24 nt, Human
cagguauuauuucagguuuaguac

SEQ ID NO: 130974 - RNA, 23 nt, Human
gcgggaguggcugauggaagcac

SEQ ID NO: 130975 - RNA, 27 nt, Human
gccuugcuuuucucucuucuucauuca

SEQ ID NO: 130976 - RNA, 23 nt, Human
ugaaaugaccauaaauauacaaa

SEQ ID NO: 130977 - RNA, 23 nt, Human
ggucucagccaaaaugagugaua

SEQ ID NO: 130978 - RNA, 22 nt, Human
ccagguucucccugccaaaaag

SEQ ID NO: 130979 - RNA, 21 nt, Human
auccagaaacugagaagcuua

SEQ ID NO: 130980 - RNA, 25 nt, Human
cuucagccacacgcuucauggccuu

SEQ ID NO: 130981 - RNA, 21 nt, Human
ugaccaggcuggagugaagug

SEQ ID NO: 130982 - RNA, 22 nt, Human
aaaaagagggacuguuaaauac

SEQ ID NO: 130983 - RNA, 24 nt, Human
ugugguuccucaguggugccugca

SEQ ID NO: 130984 - RNA, 23 nt, Human
agccuccucucccuucugugggu

SEQ ID NO: 130985 - RNA, 22 nt, Human
gugaucacaggguucaaacagu

SEQ ID NO: 130986 - RNA, 25 nt, Human
aagcugaagauguuuauuacaauca

SEQ ID NO: 130987 - RNA, 20 nt, Human
gggacaaacuuuucccaaac

SEQ ID NO: 130988 - RNA, 21 nt, Human
acuucccccaccuccuccuca

SEQ ID NO: 130989 - RNA, 22 nt, Human
aaggugagacccucucccaaga

SEQ ID NO: 130990 - RNA, 27 nt, Human
uccaugaugcugggauuuacacuugag

SEQ ID NO: 130991 - RNA, 20 nt, Human
ucucauuggaaucugccucc

SEQ ID NO: 130992 - RNA, 20 nt, Human
gugggcaagcagaugacaga

SEQ ID NO: 130993 - RNA, 19 nt, Human
ccuuuuauaugugccuuca

SEQ ID NO: 130994 - RNA, 23 nt, Human
uccaggaggcagagcuugcagug

SEQ ID NO: 130995 - RNA, 23 nt, Human
cucugggcuauggacacagggug

SEQ ID NO: 130996 - RNA, 25 nt, Human
gccagucgggucugcucacagcccg

SEQ ID NO: 130997 - RNA, 25 nt, Human
uucccuuauucagguuucuguggga

SEQ ID NO: 130998 - RNA, 25 nt, Human
gccgcauucugcucccacagugccu

SEQ ID NO: 130999 - RNA, 20 nt, Human
uucuuuggggcuucagugag

SEQ ID NO: 131000 - RNA, 23 nt, Human
auuuaaaacuguuauuuuuacag

SEQ ID NO: 131001 - RNA, 21 nt, Human
guuauaugugaauauauauca

SEQ ID NO: 131002 - RNA, 23 nt, Human
cagccucugcaaggagcuuuguc

SEQ ID NO: 131003 - RNA, 23 nt, Human
cugucgccaggcuggagugcagu

SEQ ID NO: 131004 - RNA, 25 nt, Human
uauuuagugcgguauugcucuguga

SEQ ID NO: 131005 - RNA, 20 nt, Human
acacaugccucuuuguuuug

SEQ ID NO: 131006 - RNA, 21 nt, Human
agcuuugaauucacuuagugu

SEQ ID NO: 131007 - RNA, 23 nt, Human
ccaacaugaugaaacccuugucu

SEQ ID NO: 131008 - RNA, 19 nt, Human
ccucgugguacucuugccu

SEQ ID NO: 131009 - RNA, 27 nt, Human
guggacucucugacaaaguggguacuu

SEQ ID NO: 131010 - RNA, 24 nt, Human
gugaaggagcuggagacuguguug

SEQ ID NO: 131011 - RNA, 25 nt, Human
ucuaauaagacaaguuuguggaaau

SEQ ID NO: 131012 - RNA, 23 nt, Human
acgccuggcccggucagugcugc

SEQ ID NO: 131013 - RNA, 29 nt, Human
cccugcuguuugccccucagucuuuauau

SEQ ID NO: 131014 - RNA, 20 nt, Human
cuuccaucugcccucuccca

SEQ ID NO: 131015 - RNA, 21 nt, Human
acaggauuuguuuauuuucua

SEQ ID NO: 131016 - RNA, 19 nt, Human
uguuaggccaaaauaaaca

SEQ ID NO: 131017 - RNA, 31 nt, Human
ggagaggaacguggaacaggagcaggcucug

SEQ ID NO: 131018 - RNA, 23 nt, Human
gguuuguuguucugccuggagac

SEQ ID NO: 131019 - RNA, 29 nt, Human
ccuacuuucaacuccuuuuuccccccucu

SEQ ID NO: 131020 - RNA, 21 nt, Human
guuacagccacuacaucccca

SEQ ID NO: 131021 - RNA, 24 nt, Human
gguggucagacauggaaauggugg

SEQ ID NO: 131022 - RNA, 22 nt, Human
guggguggggaguggggguggg

SEQ ID NO: 131023 - RNA, 26 nt, Human
uuagugcuuugccagaggcugauguc

SEQ ID NO: 131024 - RNA, 22 nt, Human
gaggcugaaauucagaauauua

SEQ ID NO: 131025 - RNA, 22 nt, Human
uucucagccagcucuaaaacag

SEQ ID NO: 131026 - RNA, 30 nt, Human
ugugaaaugcuggcauuugcaccuaccuca

SEQ ID NO: 131027 - RNA, 23 nt, Human
ggcaggcauggcuggugccugaa

SEQ ID NO: 131028 - RNA, 21 nt, Human
cacagcuguucuucuguucug

SEQ ID NO: 131029 - RNA, 22 nt, Human
gaggaauuggccgcugucacug

SEQ ID NO: 131030 - RNA, 23 nt, Human
cugcugcuucccaaggauggcug

SEQ ID NO: 131031 - RNA, 19 nt, Human
uucucagacauucuuaucc

SEQ ID NO: 131032 - RNA, 26 nt, Human
ucccccaggcuauggagggcggacuc

SEQ ID NO: 131033 - RNA, 24 nt, Human
agcuucuacagauuuuagacaagg

SEQ ID NO: 131034 - RNA, 21 nt, Human
acaccccauaugucaguguaa

SEQ ID NO: 131035 - RNA, 20 nt, Human
ccugcaagcagaggugguga

SEQ ID NO: 131036 - RNA, 29 nt, Human
gggcugcaccugcaucuucugaucaccug

SEQ ID NO: 131037 - RNA, 19 nt, Human
aucaggggcuucacuguga

SEQ ID NO: 131038 - RNA, 21 nt, Human
ccuguaaucccaacacuuagg

SEQ ID NO: 131039 - RNA, 23 nt, Human
agaggaagacccugccauuccac

SEQ ID NO: 131040 - RNA, 31 nt, Human
auacuauuuauauacaagugauaauacagau

SEQ ID NO: 131041 - RNA, 25 nt, Human
gggccucccuucccaccugccugug

SEQ ID NO: 131042 - RNA, 22 nt, Human
ccagggcugccaggcguauucc

SEQ ID NO: 131043 - RNA, 22 nt, Human
agcaaucuauaaacacuggaaa

SEQ ID NO: 131044 - RNA, 26 nt, Human
gccuggguggaucggccuccucuuca

SEQ ID NO: 131045 - RNA, 27 nt, Human
auguaaaccagugaaaaguggauuuuc

SEQ ID NO: 131046 - RNA, 24 nt, Human
agcaaguaaaucauccucuuuuca

SEQ ID NO: 131047 - RNA, 22 nt, Human
gccuguauucccagagcuuugg

SEQ ID NO: 131048 - RNA, 25 nt, Human
uggaaacaauuaugauucugcugga

SEQ ID NO: 131049 - RNA, 27 nt, Human
uguaguguggccuggugcuggggugaa

SEQ ID NO: 131050 - RNA, 23 nt, Human
acucagcccagcugcucuugagc

SEQ ID NO: 131051 - RNA, 21 nt, Human
ccuuccaucccugucgagucc

SEQ ID NO: 131052 - RNA, 21 nt, Human
cuuugucaguggcaggugccu

SEQ ID NO: 131053 - RNA, 22 nt, Human
ucagaggaaaaaugggagccag

SEQ ID NO: 131054 - RNA, 21 nt, Human
uguucucaaacucugagccca

SEQ ID NO: 131055 - RNA, 24 nt, Human
caacagcacacauaguuucuggua

SEQ ID NO: 131056 - RNA, 25 nt, Human
cagcuuucaaccugcuuacucauuu

SEQ ID NO: 131057 - RNA, 20 nt, Human
cucuuuuucuccucucugag

SEQ ID NO: 131058 - RNA, 22 nt, Human
cugggagauggaaguugcagug

SEQ ID NO: 131059 - RNA, 22 nt, Human
cugccgcaggcugggugcacgg

SEQ ID NO: 131060 - RNA, 21 nt, Human
gucgcccaggcuggagugcag

SEQ ID NO: 131061 - RNA, 22 nt, Human
gaacuccugaccucaagcgauc

SEQ ID NO: 131062 - RNA, 22 nt, Human
cacaggaacgcacagaucaugg

SEQ ID NO: 131063 - RNA, 18 nt, Human
uuuuacauuccauuucau

SEQ ID NO: 131064 - RNA, 24 nt, Human
caggccggagacaaguugcagucc

SEQ ID NO: 131065 - RNA, 20 nt, Human
cugauagugcaggcuugcgc

SEQ ID NO: 131066 - RNA, 20 nt, Human
gggcuggagcuggggcuggg

SEQ ID NO: 131067 - RNA, 17 nt, Human
ggcuugcagaaaaagaa

SEQ ID NO: 131068 - RNA, 27 nt, Human
aagauucacacuugaaacagauuaauc

SEQ ID NO: 131069 - RNA, 23 nt, Human
cacuccugcgcuuuucaucgcca

SEQ ID NO: 131070 - RNA, 22 nt, Human
gcucauugcaaccucugccucc

SEQ ID NO: 131071 - RNA, 23 nt, Human
ggaccugcaagggacugaaggcg

SEQ ID NO: 131072 - RNA, 20 nt, Human
caguucugacauucuaggcu

SEQ ID NO: 131073 - RNA, 29 nt, Human
ggccaggcuuuaaaaugaaaaguguuuua

SEQ ID NO: 131074 - RNA, 24 nt, Human
ggcuuugugccuguagcucauuuu

SEQ ID NO: 131075 - RNA, 24 nt, Human
acuauuucuauaauaaaaagcacu

SEQ ID NO: 131076 - RNA, 21 nt, Human
agggagcauggcgagacccau

SEQ ID NO: 131077 - RNA, 32 nt, Human; identical to SEQ ID NO: 5673

SEQ ID NO: 131078 - RNA, 23 nt, Human
ucugcuggcccucaggcugcugc

SEQ ID NO: 131079 - RNA, 19 nt, Human
ggaggauugaggaggauca

SEQ ID NO: 131080 - RNA, 23 nt, Human
cuauccauguaauaagcacuugc

SEQ ID NO: 131081 - RNA, 30 nt, Human
auguaauauuccaggaugcugcugcaggug

SEQ ID NO: 131082 - RNA, 25 nt, Human
gucacccaggcuggagugcaauggu

SEQ ID NO: 131083 - RNA, 22 nt, Human
gggcuguaaccgucgucugucc

SEQ ID NO: 131084 - RNA, 19 nt, Human
cgagcgggagggaggcggg

SEQ ID NO: 131085 - RNA, 21 nt, Human
cuuuccaccucucacccauug

SEQ ID NO: 131086 - RNA, 21 nt, Human
cacagccagaggagccuguga

SEQ ID NO: 131087 - RNA, 26 nt, Human
ggucauguggacauuuccagaaaagc

SEQ ID NO: 131088 - RNA, 22 nt, Human
agggaugcccuaucugaaggaa

SEQ ID NO: 131089 - RNA, 22 nt, Human
ccuaccacagauccugccucca

SEQ ID NO: 131090 - RNA, 22 nt, Human
aggcugagacagguggaucacu

SEQ ID NO: 131091 - RNA, 26 nt, Human
cuccaaugcuguuaucccugccuggu

SEQ ID NO: 131092 - RNA, 22 nt, Human
ucuuaaagcuucaguggccuag

SEQ ID NO: 131093 - RNA, 16 nt, Human
cugggagacccaugua

SEQ ID NO: 131094 - RNA, 21 nt, Human
cuuaccaagugugaauguugg

SEQ ID NO: 131095 - RNA, 23 nt, Human
uguuggugccaucgcacaugcuc

SEQ ID NO: 131096 - RNA, 28 nt, Human
ccagagagguggagucgguagcggggcc

SEQ ID NO: 131097 - RNA, 20 nt, Human
ucuguuuacacucuuugcca

SEQ ID NO: 131098 - RNA, 22 nt, Human
aggcugaggcggguggaucacg

SEQ ID NO: 131099 - RNA, 21 nt, Human
ccuguaaucccaguacucugg

SEQ ID NO: 131100 - RNA, 26 nt, Human
acuuuuccuccccauccuggagaaug

SEQ ID NO: 131101 - RNA, 28 nt, Human
gacuugaagacaaccucuuuuauauuuc

SEQ ID NO: 131102 - RNA, 21 nt, Human
cugggacacccacagcugcag

SEQ ID NO: 131103 - RNA, 27 nt, Human
caggcuggaguacaguggugugauccc

SEQ ID NO: 131104 - RNA, 23 nt, Human
gcgugcguaaugucggcacuuug

SEQ ID NO: 131105 - RNA, 20 nt, Human
gaaucaggacuuguacuggg

SEQ ID NO: 131106 - RNA, 21 nt, Human
aaaugccacugacaauguuau

SEQ ID NO: 131107 - RNA, 25 nt, Human
ucugcccuuccucuagccucuuguc

SEQ ID NO: 131108 - RNA, 18 nt, Human
acacauacacaaaugcac

SEQ ID NO: 131109 - RNA, 25 nt, Human
cagguauuucagaaggagaaggcug

SEQ ID NO: 131110 - RNA, 22 nt, Human
ugccuguaaucccagcacuuuc

SEQ ID NO: 131111 - RNA, 22 nt, Human
gggauuacaggugugagcuacc

SEQ ID NO: 131112 - RNA, 21 nt, Human
uucucucuuugcauggauuuc

SEQ ID NO: 131113 - RNA, 23 nt, Human
ggaauaugcagcacauuuuugcc

SEQ ID NO: 131114 - RNA, 21 nt, Human
ggagcugcucacuaccuccuc

SEQ ID NO: 131115 - RNA, 26 nt, Human
ccugcagcuuuuuaguccuuugugcu

SEQ ID NO: 131116 - RNA, 24 nt, Human
uuccaucucaaaaguauuguggca

SEQ ID NO: 131117 - RNA, 27 nt, Human
aaguuuucacuccagcuacacagaugu

SEQ ID NO: 131118 - RNA, 27 nt, Human
cagucuggagugcaguggugugaucac

SEQ ID NO: 131119 - RNA, 23 nt, Human
ccucacugggggcaggguggagu

SEQ ID NO: 131120 - RNA, 23 nt, Human
gcaucucugcuugcaucuuccau

SEQ ID NO: 131121 - RNA, 21 nt, Human
cuuucaaagcauucacaaacu

SEQ ID NO: 131122 - RNA, 24 nt, Human
gagguuagagggaacugggaggca

SEQ ID NO: 131123 - RNA, 21 nt, Human
aggaaacaaaaaguuaaacuu

SEQ ID NO: 131124 - RNA, 27 nt, Human
ccuugauaacaugcuuuugcgaagugc

SEQ ID NO: 131125 - RNA, 27 nt, Human
uuacuuacucuguaucucuuuguacuc

SEQ ID NO: 131126 - RNA, 27 nt, Human
caggcuggagugcaguggcaggaucuc

SEQ ID NO: 131127 - RNA, 25 nt, Human
gcucugaaaagaagauauuuuucaa

SEQ ID NO: 131128 - RNA, 23 nt, Human
ugcucagcuuucugcccccacca

SEQ ID NO: 131129 - RNA, 22 nt, Human
gaguagcugggauuacaggcgu

SEQ ID NO: 131130 - RNA, 24 nt, Human
gcaaaugacuaguaaacauguggg

SEQ ID NO: 131131 - RNA, 21 nt, Human
gguagauggcagaggcagaga

SEQ ID NO: 131132 - RNA, 22 nt, Human
gacacaccauaucuaugauauc

SEQ ID NO: 131133 - RNA, 21 nt, Human
auggaaagaaugaggcucagg
